United States Patent 7,250,289 (METHODS OF GENETIC ANALYSIS OF MOUSE) - sequence listing, part 9

SEQ ID NO: 323062 - DNA, 25 bp, Mus musculus
cagtctgagggcttccctaaagtgg

SEQ ID NO: 323063 - DNA, 25 bp, Mus musculus
cagtctgagggcttgagcctccagt

SEQ ID NO: 323064 - DNA, 25 bp, Mus musculus
cagtctgagtataccgacatccgga

SEQ ID NO: 323065 - DNA, 25 bp, Mus musculus
cagtctgagtattccgacatccgga

SEQ ID NO: 323066 - DNA, 25 bp, Mus musculus
cagtctgagtttcctgtgctagaat

SEQ ID NO: 323067 - DNA, 25 bp, Mus musculus
cagtctgagtttgctgtgctagaat

SEQ ID NO: 323068 - DNA, 25 bp, Mus musculus
cagtctgcaccaatggtacagttaa

SEQ ID NO: 323069 - DNA, 25 bp, Mus musculus
cagtctgcaccattggtacagttaa

SEQ ID NO: 323070 - DNA, 25 bp, Mus musculus
cagtctgccagacaaagcttggtag

SEQ ID NO: 323071 - DNA, 25 bp, Mus musculus
cagtctgccagagaaagcttggtag

SEQ ID NO: 323072 - DNA, 25 bp, Mus musculus
cagtctgccttccaattggtagtga

SEQ ID NO: 323073 - DNA, 25 bp, Mus musculus
cagtctgccttcgaattggtagtga

SEQ ID NO: 323074 - DNA, 25 bp, Mus musculus
cagtctgcgcttattaaagggccca

SEQ ID NO: 323075 - DNA, 25 bp, Mus musculus
cagtctgcgctttttaaagggccca

SEQ ID NO: 323076 - DNA, 25 bp, Mus musculus
cagtctgcggtgacgtgatgcgcaa

SEQ ID NO: 323077 - DNA, 25 bp, Mus musculus
cagtctgcggtgtcgtgatgcgcaa

SEQ ID NO: 323078 - DNA, 25 bp, Mus musculus
cagtctgctcaacgcccacgatgat

SEQ ID NO: 323079 - DNA, 25 bp, Mus musculus
cagtctgctcaaggcccacgatgat

SEQ ID NO: 323080 - DNA, 25 bp, Mus musculus
cagtctgctcttcgccaaagggcag

SEQ ID NO: 323081 - DNA, 25 bp, Mus musculus
cagtctgctcttggccaaagggcag

SEQ ID NO: 323082 - DNA, 25 bp, Mus musculus
cagtctgctgagatgtatgtacaca

SEQ ID NO: 323083 - DNA, 25 bp, Mus musculus
cagtctgctgagttgtatgtacaca

SEQ ID NO: 323084 - DNA, 25 bp, Mus musculus
cagtctgctgtgaccaaggctggag

SEQ ID NO: 323085 - DNA, 25 bp, Mus musculus
cagtctgctgtgtccaaggctggag

SEQ ID NO: 323086 - DNA, 25 bp, Mus musculus
cagtctgctttgaacgagccatggt

SEQ ID NO: 323087 - DNA, 25 bp, Mus musculus
cagtctgctttgtacgagccatggt

SEQ ID NO: 323088 - DNA, 25 bp, Mus musculus
cagtctggcatgctcccaaatggag

SEQ ID NO: 323089 - DNA, 25 bp, Mus musculus
cagtctggcatggtcccaaatggag

SEQ ID NO: 323090 - DNA, 25 bp, Mus musculus
cagtctggcgtaagtagcaagttcc

SEQ ID NO: 323091 - DNA, 25 bp, Mus musculus
cagtctggcgtatgtagcaagttcc

SEQ ID NO: 323092 - DNA, 25 bp, Mus musculus
cagtctggctcaagatcagctacat

SEQ ID NO: 323093 - DNA, 25 bp, Mus musculus
cagtctggctcaccagactcctgta

SEQ ID NO: 323094 - DNA, 25 bp, Mus musculus
cagtctggctcagcagactcctgta

SEQ ID NO: 323095 - DNA, 25 bp, Mus musculus
cagtctggctcatgatcagctacat

SEQ ID NO: 323096 - DNA, 25 bp, Mus musculus
cagtctggctgtagtatgtggtgtt

SEQ ID NO: 323097 - DNA, 25 bp, Mus musculus
cagtctggctgttgtatgtggtgtt

SEQ ID NO: 323098 - DNA, 25 bp, Mus musculus
cagtctgggcaacactgtggaattt

SEQ ID NO: 323099 - DNA, 25 bp, Mus musculus
cagtctgggcaagactgtggaattt

SEQ ID NO: 323100 - DNA, 25 bp, Mus musculus
cagtctgggctgacctttgagtcaa

SEQ ID NO: 323101 - DNA, 25 bp, Mus musculus
cagtctgggctgtcctttgagtcaa

SEQ ID NO: 323102 - DNA, 25 bp, Mus musculus
cagtctggtctcctaaatctgtgat

SEQ ID NO: 323103 - DNA, 25 bp, Mus musculus
cagtctggtctcgtaaatctgtgat

SEQ ID NO: 323104 - DNA, 25 bp, Mus musculus
cagtctggtgagcattctcctgtgc

SEQ ID NO: 323105 - DNA, 25 bp, Mus musculus
cagtctggtgaggattctcctgtgc

SEQ ID NO: 323106 - DNA, 25 bp, Mus musculus
cagtctggtggtagagctcctggaa

SEQ ID NO: 323107 - DNA, 25 bp, Mus musculus
cagtctggtggttgagctcctggaa

SEQ ID NO: 323108 - DNA, 25 bp, Mus musculus
cagtctggtttgacctttaccgcac

SEQ ID NO: 323109 - DNA, 25 bp, Mus musculus
cagtctggtttgtcctttaccgcac

SEQ ID NO: 323110 - DNA, 25 bp, Mus musculus
cagtctgtaacactcctatacttgt

SEQ ID NO: 323111 - DNA, 25 bp, Mus musculus
cagtctgtaacagtcctatacttgt

SEQ ID NO: 323112 - DNA, 25 bp, Mus musculus
cagtctgtcccaactcagtttgcaa

SEQ ID NO: 323113 - DNA, 25 bp, Mus musculus
cagtctgtcccatctcagtttgcaa

SEQ ID NO: 323114 - DNA, 25 bp, Mus musculus
cagtctgtcccgagctcaggagtgc

SEQ ID NO: 323115 - DNA, 25 bp, Mus musculus
cagtctgtcccgtgctcaggagtgc

SEQ ID NO: 323116 - DNA, 25 bp, Mus musculus
cagtctgtcctgacatctcaggaaa

SEQ ID NO: 323117 - DNA, 25 bp, Mus musculus
cagtctgtcctgtcatctcaggaaa

SEQ ID NO: 323118 - DNA, 25 bp, Mus musculus
cagtctgtctgaatgagttggtttt

SEQ ID NO: 323119 - DNA, 25 bp, Mus musculus
cagtctgtctgattgagttggtttt

SEQ ID NO: 323120 - DNA, 25 bp, Mus musculus
cagtctgtgactcttccagcaaatg

SEQ ID NO: 323121 - DNA, 25 bp, Mus musculus
cagtctgtgactgttccagcaaatg

SEQ ID NO: 323122 - DNA, 25 bp, Mus musculus
cagtctgtgcgtagtaggagccatc

SEQ ID NO: 323123 - DNA, 25 bp, Mus musculus
cagtctgtgcgttgtaggagccatc

SEQ ID NO: 323124 - DNA, 25 bp, Mus musculus
cagtctgtgtaaaagtgcctgtaca

SEQ ID NO: 323125 - DNA, 25 bp, Mus musculus
cagtctgtgtaatagtgcctgtaca

SEQ ID NO: 323126 - DNA, 25 bp, Mus musculus
cagtctgtgtatcactgcttctctg

SEQ ID NO: 323127 - DNA, 25 bp, Mus musculus
cagtctgtgtatgactgcttctctg

SEQ ID NO: 323128 - DNA, 25 bp, Mus musculus
cagtctgtgtctctggtgttgccat

SEQ ID NO: 323129 - DNA, 25 bp, Mus musculus
cagtctgtgtctgtggtgttgccat

SEQ ID NO: 323130 - DNA, 25 bp, Mus musculus
cagtctgtgtgtacctggttggaga

SEQ ID NO: 323131 - DNA, 25 bp, Mus musculus
cagtctgtgtgttcctggttggaga

SEQ ID NO: 323132 - DNA, 25 bp, Mus musculus
cagtctgtgtttcgaggcgttacat

SEQ ID NO: 323133 - DNA, 25 bp, Mus musculus
cagtctgtgtttggaggcgttacat

SEQ ID NO: 323134 - DNA, 25 bp, Mus musculus
cagtctgttgtgatggtggcatttg

SEQ ID NO: 323135 - DNA, 25 bp, Mus musculus
cagtctgttgtgttggtggcatttg

SEQ ID NO: 323136 - DNA, 25 bp, Mus musculus
cagtctgttttactaacctctccaa

SEQ ID NO: 323137 - DNA, 25 bp, Mus musculus
cagtctgttttagtaacctctccaa

SEQ ID NO: 323138 - DNA, 25 bp, Mus musculus
cagtctgttttcaacacatgtactt

SEQ ID NO: 323139 - DNA, 25 bp, Mus musculus
cagtctgttttcatatagaatccaa

SEQ ID NO: 323140 - DNA, 25 bp, Mus musculus
cagtctgttttctacacatgtactt

SEQ ID NO: 323141 - DNA, 25 bp, Mus musculus
cagtctgttttcttatagaatccaa

SEQ ID NO: 323142 - DNA, 25 bp, Mus musculus
cagtcttaaactagttacgtagcag

SEQ ID NO: 323143 - DNA, 25 bp, Mus musculus
cagtcttaaacttgttacgtagcag

SEQ ID NO: 323144 - DNA, 25 bp, Mus musculus
cagtcttaacttacaaatgcatgtg

SEQ ID NO: 323145 - DNA, 25 bp, Mus musculus
cagtcttaactttcaaatgcatgtg

SEQ ID NO: 323146 - DNA, 25 bp, Mus musculus
cagtcttaagccagcattggtgaca

SEQ ID NO: 323147 - DNA, 25 bp, Mus musculus
cagtcttaagcctgcattggtgaca

SEQ ID NO: 323148 - DNA, 25 bp, Mus musculus
cagtcttaccccagtatcttgtaat

SEQ ID NO: 323149 - DNA, 25 bp, Mus musculus
cagtcttacccctgtatcttgtaat

SEQ ID NO: 323150 - DNA, 25 bp, Mus musculus
cagtcttaccctcttatcttcagta

SEQ ID NO: 323151 - DNA, 25 bp, Mus musculus
cagtcttaccctgttatcttcagta

SEQ ID NO: 323152 - DNA, 25 bp, Mus musculus
cagtcttacttgctttttgtctact

SEQ ID NO: 323153 - DNA, 25 bp, Mus musculus
cagtcttacttggtttttgtctact

SEQ ID NO: 323154 - DNA, 25 bp, Mus musculus
cagtcttattaaactcccgatgctg

SEQ ID NO: 323155 - DNA, 25 bp, Mus musculus
cagtcttattaatctcccgatgctg

SEQ ID NO: 323156 - DNA, 25 bp, Mus musculus
cagtcttcaccaagtttcttcactg

SEQ ID NO: 323157 - DNA, 25 bp, Mus musculus
cagtcttcaccatgtttcttcactg

SEQ ID NO: 323158 - DNA, 25 bp, Mus musculus
cagtcttcagatccatctgcctgat

SEQ ID NO: 323159 - DNA, 25 bp, Mus musculus
cagtcttcagatgcatctgcctgat

SEQ ID NO: 323160 - DNA, 25 bp, Mus musculus
cagtcttcagtgagcttgggtgcag

SEQ ID NO: 323161 - DNA, 25 bp, Mus musculus
cagtcttcagtgcttacagtataac

SEQ ID NO: 323162 - DNA, 25 bp, Mus musculus
cagtcttcagtggttacagtataac

SEQ ID NO: 323163 - DNA, 25 bp, Mus musculus
cagtcttcagtgtgcttgggtgcag

SEQ ID NO: 323164 - DNA, 25 bp, Mus musculus
cagtcttccaatattgggccgatga

SEQ ID NO: 323165 - DNA, 25 bp, Mus musculus
cagtcttccaattttgggccgatga

SEQ ID NO: 323166 - DNA, 25 bp, Mus musculus
cagtcttccacgcttagtactcaga

SEQ ID NO: 323167 - DNA, 25 bp, Mus musculus
cagtcttccacggttagtactcaga

SEQ ID NO: 323168 - DNA, 25 bp, Mus musculus
cagtcttccctaaacagcaagtcag

SEQ ID NO: 323169 - DNA, 25 bp, Mus musculus
cagtcttccctatacagcaagtcag

SEQ ID NO: 323170 - DNA, 25 bp, Mus musculus
cagtcttccctgattatttggtgca

SEQ ID NO: 323171 - DNA, 25 bp, Mus musculus
cagtcttccctgtttatttggtgca

SEQ ID NO: 323172 - DNA, 25 bp, Mus musculus
cagtcttcctgtcttgagtttggtt

SEQ ID NO: 323173 - DNA, 25 bp, Mus musculus
cagtcttcctgtgttgagtttggtt

SEQ ID NO: 323174 - DNA, 25 bp, Mus musculus
cagtcttcgattcccattcatgtgc

SEQ ID NO: 323175 - DNA, 25 bp, Mus musculus
cagtcttcgattgccattcatgtgc

SEQ ID NO: 323176 - DNA, 25 bp, Mus musculus
cagtcttctcttaaggtgggtttgc

SEQ ID NO: 323177 - DNA, 25 bp, Mus musculus
cagtcttctctttaggtgggtttgc

SEQ ID NO: 323178 - DNA, 25 bp, Mus musculus
cagtcttctggtacccttcggaaga

SEQ ID NO: 323179 - DNA, 25 bp, Mus musculus
cagtcttctggttcccttcggaaga

SEQ ID NO: 323180 - DNA, 25 bp, Mus musculus
cagtcttcttgcatagttgccttct

SEQ ID NO: 323181 - DNA, 25 bp, Mus musculus
cagtcttcttgcttagttgccttct

SEQ ID NO: 323182 - DNA, 25 bp, Mus musculus
cagtcttctttcatggcgtgtctct

SEQ ID NO: 323183 - DNA, 25 bp, Mus musculus
cagtcttctttcttggcgtgtctct

SEQ ID NO: 323184 - DNA, 25 bp, Mus musculus
cagtcttgactgagcttggtggatg

SEQ ID NO: 323185 - DNA, 25 bp, Mus musculus
cagtcttgactgtgcttggtggatg

SEQ ID NO: 323186 - DNA, 25 bp, Mus musculus
cagtcttgatataacgaacgactcc

SEQ ID NO: 323187 - DNA, 25 bp, Mus musculus
cagtcttgatattacgaacgactcc

SEQ ID NO: 323188 - DNA, 25 bp, Mus musculus
cagtcttgctttcttaacccagtta

SEQ ID NO: 323189 - DNA, 25 bp, Mus musculus
cagtcttgctttgttaacccagtta

SEQ ID NO: 323190 - DNA, 25 bp, Mus musculus
cagtcttggatcatggagttttcta

SEQ ID NO: 323191 - DNA, 25 bp, Mus musculus
cagtcttggatcttggagttttcta

SEQ ID NO: 323192 - DNA, 25 bp, Mus musculus
cagtcttgggaacagtgattcaccc

SEQ ID NO: 323193 - DNA, 25 bp, Mus musculus
cagtcttgggaagagtgattcaccc

SEQ ID NO: 323194 - DNA, 25 bp, Mus musculus
cagtctttactgaatgcatgtgcat

SEQ ID NO: 323195 - DNA, 25 bp, Mus musculus
cagtctttactgtatgcatgtgcat

SEQ ID NO: 323196 - DNA, 25 bp, Mus musculus
cagtctttccagaagacctgggtga

SEQ ID NO: 323197 - DNA, 25 bp, Mus musculus
cagtctttccagtagacctgggtga

SEQ ID NO: 323198 - DNA, 25 bp, Mus musculus
cagtctttccccatgggaagctgag

SEQ ID NO: 323199 - DNA, 25 bp, Mus musculus
cagtctttccccttgggaagctgag

SEQ ID NO: 323200 - DNA, 25 bp, Mus musculus
cagtctttctggagttcatgtttgc

SEQ ID NO: 323201 - DNA, 25 bp, Mus musculus
cagtctttctggtgttcatgtttgc

SEQ ID NO: 323202 - DNA, 25 bp, Mus musculus
cagtctttcttgagttcttttgtac

SEQ ID NO: 323203 - DNA, 25 bp, Mus musculus
cagtctttcttgtgttcttttgtac

SEQ ID NO: 323204 - DNA, 25 bp, Mus musculus
cagtctttgtccatgtctggcaagg

SEQ ID NO: 323205 - DNA, 25 bp, Mus musculus
cagtctttgtccttgtctggcaagg

SEQ ID NO: 323206 - DNA, 25 bp, Mus musculus
cagtctttgtggactgcactgtcca

SEQ ID NO: 323207 - DNA, 25 bp, Mus musculus
cagtctttgtggtctgcactgtcca

SEQ ID NO: 323208 - DNA, 25 bp, Mus musculus
cagtcttttaagctcacccctggag

SEQ ID NO: 323209 - DNA, 25 bp, Mus musculus
cagtcttttaaggtcacccctggag

SEQ ID NO: 323210 - DNA, 25 bp, Mus musculus
cagtcttttcttaattaggatgtta

SEQ ID NO: 323211 - DNA, 25 bp, Mus musculus
cagtcttttctttattaggatgtta

SEQ ID NO: 323212 - DNA, 25 bp, Mus musculus
cagtctttttatccttcctaattac

SEQ ID NO: 323213 - DNA, 25 bp, Mus musculus
cagtctttttatctcatatgtgcag

SEQ ID NO: 323214 - DNA, 25 bp, Mus musculus
cagtctttttatgcttcctaattac

SEQ ID NO: 323215 - DNA, 25 bp, Mus musculus
cagtctttttatgtcatatgtgcag

SEQ ID NO: 323216 - DNA, 25 bp, Mus musculus
cagtctttttgactgcatcttttac

SEQ ID NO: 323217 - DNA, 25 bp, Mus musculus
cagtctttttgagtgcatcttttac

SEQ ID NO: 323218 - DNA, 25 bp, Mus musculus
cagtcttttttgaccgtcacggaca

SEQ ID NO: 323219 - DNA, 25 bp, Mus musculus
cagtcttttttgtccgtcacggaca

SEQ ID NO: 323220 - DNA, 25 bp, Mus musculus
cagtgaaaacgtagagtcttgggaa

SEQ ID NO: 323221 - DNA, 25 bp, Mus musculus
cagtgaaaacgttgagtcttgggaa

SEQ ID NO: 323222 - DNA, 25 bp, Mus musculus
cagtgaaactgaccatccagaacag

SEQ ID NO: 323223 - DNA, 25 bp, Mus musculus
cagtgaaactgagcatccagaacag

SEQ ID NO: 323224 - DNA, 25 bp, Mus musculus
cagtgaaagagtctcctgtgctgga

SEQ ID NO: 323225 - DNA, 25 bp, Mus musculus
cagtgaaagagtgtcctgtgctgga

SEQ ID NO: 323226 - DNA, 25 bp, Mus musculus
cagtgaaatcacattgggcagcagt

SEQ ID NO: 323227 - DNA, 25 bp, Mus musculus
cagtgaaatcactttgggcagcagt

SEQ ID NO: 323228 - DNA, 25 bp, Mus musculus
cagtgaaatgtgacatcatccaata

SEQ ID NO: 323229 - DNA, 25 bp, Mus musculus
cagtgaaatgtgtcatcatccaata

SEQ ID NO: 323230 - DNA, 25 bp, Mus musculus
cagtgaaattctactcacacttcag

SEQ ID NO: 323231 - DNA, 25 bp, Mus musculus
cagtgaaattcttctcacacttcag

SEQ ID NO: 323232 - DNA, 25 bp, Mus musculus
cagtgaacaagaccgactacccaac

SEQ ID NO: 323233 - DNA, 25 bp, Mus musculus
cagtgaacaagagcgactacccaac

SEQ ID NO: 323234 - DNA, 25 bp, Mus musculus
cagtgaacactccttgaatcacaca

SEQ ID NO: 323235 - DNA, 25 bp, Mus musculus
cagtgaacactcgttgaatcacaca

SEQ ID NO: 323236 - DNA, 25 bp, Mus musculus
cagtgaacactgcatcttgtattag

SEQ ID NO: 323237 - DNA, 25 bp, Mus musculus
cagtgaacactggatcttgtattag

SEQ ID NO: 323238 - DNA, 25 bp, Mus musculus
cagtgaacagtgattccttgttaag

SEQ ID NO: 323239 - DNA, 25 bp, Mus musculus
cagtgaacagtgtttccttgttaag

SEQ ID NO: 323240 - DNA, 25 bp, Mus musculus
cagtgaaccaccattgagggcgttt

SEQ ID NO: 323241 - DNA, 25 bp, Mus musculus
cagtgaaccacctttgagggcgttt

SEQ ID NO: 323242 - DNA, 25 bp, Mus musculus
cagtgaacctctatgtgattctttt

SEQ ID NO: 323243 - DNA, 25 bp, Mus musculus
cagtgaacctctttgtgattctttt

SEQ ID NO: 323244 - DNA, 25 bp, Mus musculus
cagtgaactctgacgggctctccag

SEQ ID NO: 323245 - DNA, 25 bp, Mus musculus
cagtgaactctgtcgggctctccag

SEQ ID NO: 323246 - DNA, 25 bp, Mus musculus
cagtgaactgaaatgcccttggtaa

SEQ ID NO: 323247 - DNA, 25 bp, Mus musculus
cagtgaactgaattgcccttggtaa

SEQ ID NO: 323248 - DNA, 25 bp, Mus musculus
cagtgaactgccctacatatcttaa

SEQ ID NO: 323249 - DNA, 25 bp, Mus musculus
cagtgaactgccgtacatatcttaa

SEQ ID NO: 323250 - DNA, 25 bp, Mus musculus
cagtgaactgctcctctatactcta

SEQ ID NO: 323251 - DNA, 25 bp, Mus musculus
cagtgaactgctgctctatactcta

SEQ ID NO: 323252 - DNA, 25 bp, Mus musculus
cagtgaactttgactgtctaaggtt

SEQ ID NO: 323253 - DNA, 25 bp, Mus musculus
cagtgaactttgtctgtctaaggtt

SEQ ID NO: 323254 - DNA, 25 bp, Mus musculus
cagtgaagacacaacagaccctgga

SEQ ID NO: 323255 - DNA, 25 bp, Mus musculus
cagtgaagacactacagaccctgga

SEQ ID NO: 323256 - DNA, 25 bp, Mus musculus
cagtgaagagtcaacagctgcttta

SEQ ID NO: 323257 - DNA, 25 bp, Mus musculus
cagtgaagagtcaacttggctctct

SEQ ID NO: 323258 - DNA, 25 bp, Mus musculus
cagtgaagagtctacagctgcttta

SEQ ID NO: 323259 - DNA, 25 bp, Mus musculus
cagtgaagagtctacttggctctct

SEQ ID NO: 323260 - DNA, 25 bp, Mus musculus
cagtgaagcagaacccagtgggata

SEQ ID NO: 323261 - DNA, 25 bp, Mus musculus
cagtgaagcagaagtgtggaagcca

SEQ ID NO: 323262 - DNA, 25 bp, Mus musculus
cagtgaagcagatcccagtgggata

SEQ ID NO: 323263 - DNA, 25 bp, Mus musculus
cagtgaagcagatgtgtggaagcca

SEQ ID NO: 323264 - DNA, 25 bp, Mus musculus
cagtgaagctgtattgtgctgaaaa

SEQ ID NO: 323265 - DNA, 25 bp, Mus musculus
cagtgaagctgttttgtgctgaaaa

SEQ ID NO: 323266 - DNA, 25 bp, Mus musculus
cagtgaagtcggagaagccctggct

SEQ ID NO: 323267 - DNA, 25 bp, Mus musculus
cagtgaagtcggtgaagccctggct

SEQ ID NO: 323268 - DNA, 25 bp, Mus musculus
cagtgaagtttacgttaagatgtta

SEQ ID NO: 323269 - DNA, 25 bp, Mus musculus
cagtgaagtttaggttaagatgtta

SEQ ID NO: 323270 - DNA, 25 bp, Mus musculus
cagtgaatacgcaaacagcactgtt

SEQ ID NO: 323271 - DNA, 25 bp, Mus musculus
cagtgaatacgctaacagcactgtt

SEQ ID NO: 323272 - DNA, 25 bp, Mus musculus
cagtgaatcactatttctttctctt

SEQ ID NO: 323273 - DNA, 25 bp, Mus musculus
cagtgaatcactttttctttctctt

SEQ ID NO: 323274 - DNA, 25 bp, Mus musculus
cagtgaatccgcacctgttgcagag

SEQ ID NO: 323275 - DNA, 25 bp, Mus musculus
cagtgaatccgctcctgttgcagag

SEQ ID NO: 323276 - DNA, 25 bp, Mus musculus
cagtgaatccttatctgtctgttcc

SEQ ID NO: 323277 - DNA, 25 bp, Mus musculus
cagtgaatccttttctgtctgttcc

SEQ ID NO: 323278 - DNA, 25 bp, Mus musculus
cagtgaatgcttactggtcaaccaa

SEQ ID NO: 323279 - DNA, 25 bp, Mus musculus
cagtgaatgctttctggtcaaccaa

SEQ ID NO: 323280 - DNA, 25 bp, Mus musculus
cagtgaattatcacagttcccttca

SEQ ID NO: 323281 - DNA, 25 bp, Mus musculus
cagtgaattatctcagttcccttca

SEQ ID NO: 323282 - DNA, 25 bp, Mus musculus
cagtgaattcataagttccgtctat

SEQ ID NO: 323283 - DNA, 25 bp, Mus musculus
cagtgaattcattagttccgtctat

SEQ ID NO: 323284 - DNA, 25 bp, Mus musculus
cagtgaattctacatgtgcctgctg

SEQ ID NO: 323285 - DNA, 25 bp, Mus musculus
cagtgaattctagatgtgcctgctg

SEQ ID NO: 323286 - DNA, 25 bp, Mus musculus
cagtgaattctgattgttgttagtt

SEQ ID NO: 323287 - DNA, 25 bp, Mus musculus
cagtgaattctgtttgttgttagtt

SEQ ID NO: 323288 - DNA, 25 bp, Mus musculus
cagtgaattttcacagtcctgtgga

SEQ ID NO: 323289 - DNA, 25 bp, Mus musculus
cagtgaattttctcagtcctgtgga

SEQ ID NO: 323290 - DNA, 25 bp, Mus musculus
cagtgacaagagcatggcttccctg

SEQ ID NO: 323291 - DNA, 25 bp, Mus musculus
cagtgacaagaggatggcttccctg

SEQ ID NO: 323292 - DNA, 25 bp, Mus musculus
cagtgacacacgcaggctgctgtgt

SEQ ID NO: 323293 - DNA, 25 bp, Mus musculus
cagtgacacacggaggctgctgtgt

SEQ ID NO: 323294 - DNA, 25 bp, Mus musculus
cagtgacacagcatctcagacattt

SEQ ID NO: 323295 - DNA, 25 bp, Mus musculus
cagtgacacagcttctcagacattt

SEQ ID NO: 323296 - DNA, 25 bp, Mus musculus
cagtgacaccgtattcttagaagct

SEQ ID NO: 323297 - DNA, 25 bp, Mus musculus
cagtgacaccgttttcttagaagct

SEQ ID NO: 323298 - DNA, 25 bp, Mus musculus
cagtgacactccagggatggcctta

SEQ ID NO: 323299 - DNA, 25 bp, Mus musculus
cagtgacactcctgggatggcctta

SEQ ID NO: 323300 - DNA, 25 bp, Mus musculus
cagtgacagcagattgaggcgacca

SEQ ID NO: 323301 - DNA, 25 bp, Mus musculus
cagtgacagcagtttgaggcgacca

SEQ ID NO: 323302 - DNA, 25 bp, Mus musculus
cagtgacaggcgaggctgctaccaa

SEQ ID NO: 323303 - DNA, 25 bp, Mus musculus
cagtgacaggcgtggctgctaccaa

SEQ ID NO: 323304 - DNA, 25 bp, Mus musculus
cagtgacagtgaaagcagctccgcc

SEQ ID NO: 323305 - DNA, 25 bp, Mus musculus
cagtgacagtgatagcagctccgcc

SEQ ID NO: 323306 - DNA, 25 bp, Mus musculus
cagtgacataccatatcatctaaag

SEQ ID NO: 323307 - DNA, 25 bp, Mus musculus
cagtgacataccttatcatctaaag

SEQ ID NO: 323308 - DNA, 25 bp, Mus musculus
cagtgacatcacctcgtggtgggtc

SEQ ID NO: 323309 - DNA, 25 bp, Mus musculus
cagtgacatcacgtcgtggtgggtc

SEQ ID NO: 323310 - DNA, 25 bp, Mus musculus
cagtgacatctgactttgtccataa

SEQ ID NO: 323311 - DNA, 25 bp, Mus musculus
cagtgacatctgtctttgtccataa

SEQ ID NO: 323312 - DNA, 25 bp, Mus musculus
cagtgacattttcctacaagagcca

SEQ ID NO: 323313 - DNA, 25 bp, Mus musculus
cagtgacattttgctacaagagcca

SEQ ID NO: 323314 - DNA, 25 bp, Mus musculus
cagtgaccaaataatctgtgcattt

SEQ ID NO: 323315 - DNA, 25 bp, Mus musculus
cagtgaccaaattatctgtgcattt

SEQ ID NO: 323316 - DNA, 25 bp, Mus musculus
cagtgaccaacgagagccccatgca

SEQ ID NO: 323317 - DNA, 25 bp, Mus musculus
cagtgaccaacgtgagccccatgca

SEQ ID NO: 323318 - DNA, 25 bp, Mus musculus
cagtgaccaagtagagagccatcct

SEQ ID NO: 323319 - DNA, 25 bp, Mus musculus
cagtgaccaagttgagagccatcct

SEQ ID NO: 323320 - DNA, 25 bp, Mus musculus
cagtgaccaggacaataatagagac

SEQ ID NO: 323321 - DNA, 25 bp, Mus musculus
cagtgaccaggagaataatagagac

SEQ ID NO: 323322 - DNA, 25 bp, Mus musculus
cagtgaccatgcatttcctatcaga

SEQ ID NO: 323323 - DNA, 25 bp, Mus musculus
cagtgaccatgcttttcctatcaga

SEQ ID NO: 323324 - DNA, 25 bp, Mus musculus
cagtgacccattaactggcttctcg

SEQ ID NO: 323325 - DNA, 25 bp, Mus musculus
cagtgacccatttactggcttctcg

SEQ ID NO: 323326 - DNA, 25 bp, Mus musculus
cagtgaccccagatgttttcaagtt

SEQ ID NO: 323327 - DNA, 25 bp, Mus musculus
cagtgaccccagttgttttcaagtt

SEQ ID NO: 323328 - DNA, 25 bp, Mus musculus
cagtgacctaccaggaccagcaaaa

SEQ ID NO: 323329 - DNA, 25 bp, Mus musculus
cagtgacctacctggaccagcaaaa

SEQ ID NO: 323330 - DNA, 25 bp, Mus musculus
cagtgacctcagacgggttacttaa

SEQ ID NO: 323331 - DNA, 25 bp, Mus musculus
cagtgacctcagaggtcatttgacc

SEQ ID NO: 323332 - DNA, 25 bp, Mus musculus
cagtgacctcagtcgggttacttaa

SEQ ID NO: 323333 - DNA, 25 bp, Mus musculus
cagtgacctcagtggtcatttgacc

SEQ ID NO: 323334 - DNA, 25 bp, Mus musculus
cagtgacctcttagtacctaaagat

SEQ ID NO: 323335 - DNA, 25 bp, Mus musculus
cagtgacctctttgtacctaaagat

SEQ ID NO: 323336 - DNA, 25 bp, Mus musculus
cagtgacctgacacctggaaataga

SEQ ID NO: 323337 - DNA, 25 bp, Mus musculus
cagtgacctgactcctggaaataga

SEQ ID NO: 323338 - DNA, 25 bp, Mus musculus
cagtgacctgccaggcattgtagct

SEQ ID NO: 323339 - DNA, 25 bp, Mus musculus
cagtgacctgcctggcattgtagct

SEQ ID NO: 323340 - DNA, 25 bp, Mus musculus
cagtgacctgctagaatgccgttgg

SEQ ID NO: 323341 - DNA, 25 bp, Mus musculus
cagtgacctgcttgaatgccgttgg

SEQ ID NO: 323342 - DNA, 25 bp, Mus musculus
cagtgaccttccaaggctctcaggg

SEQ ID NO: 323343 - DNA, 25 bp, Mus musculus
cagtgaccttcctaggctctcaggg

SEQ ID NO: 323344 - DNA, 25 bp, Mus musculus
cagtgacgatcaatggtacagtttc

SEQ ID NO: 323345 - DNA, 25 bp, Mus musculus
cagtgacgatcattggtacagtttc

SEQ ID NO: 323346 - DNA, 25 bp, Mus musculus
cagtgacgatgaccagcctgttgaa

SEQ ID NO: 323347 - DNA, 25 bp, Mus musculus
cagtgacgatgagcagcctgttgaa

SEQ ID NO: 323348 - DNA, 25 bp, Mus musculus
cagtgacgatgcaggacgtacagat

SEQ ID NO: 323349 - DNA, 25 bp, Mus musculus
cagtgacgatgctggacgtacagat

SEQ ID NO: 323350 - DNA, 25 bp, Mus musculus
cagtgacgcgccctttaattgtaaa

SEQ ID NO: 323351 - DNA, 25 bp, Mus musculus
cagtgacgcgccgtttaattgtaaa

SEQ ID NO: 323352 - DNA, 25 bp, Mus musculus
cagtgacgggttatgccggagtcca

SEQ ID NO: 323353 - DNA, 25 bp, Mus musculus
cagtgacgggttttgccggagtcca

SEQ ID NO: 323354 - DNA, 25 bp, Mus musculus
cagtgactaacaagcatataaaatc

SEQ ID NO: 323355 - DNA, 25 bp, Mus musculus
cagtgactaacatgcatataaaatc

SEQ ID NO: 323356 - DNA, 25 bp, Mus musculus
cagtgactacggcacgctctttgta

SEQ ID NO: 323357 - DNA, 25 bp, Mus musculus
cagtgactacgggacgctctttgta

SEQ ID NO: 323358 - DNA, 25 bp, Mus musculus
cagtgactactccagtgattattct

SEQ ID NO: 323359 - DNA, 25 bp, Mus musculus
cagtgactactcgagtgattattct

SEQ ID NO: 323360 - DNA, 25 bp, Mus musculus
cagtgactatgaactctgtagccat

SEQ ID NO: 323361 - DNA, 25 bp, Mus musculus
cagtgactatgatctctgtagccat

SEQ ID NO: 323362 - DNA, 25 bp, Mus musculus
cagtgactatgtccgcgccatgcga

SEQ ID NO: 323363 - DNA, 25 bp, Mus musculus
cagtgactatgtgcgcgccatgcga

SEQ ID NO: 323364 - DNA, 25 bp, Mus musculus
cagtgactctcgctacatcttcagc

SEQ ID NO: 323365 - DNA, 25 bp, Mus musculus
cagtgactctcggtacatcttcagc

SEQ ID NO: 323366 - DNA, 25 bp, Mus musculus
cagtgactctgacccagatgctgtc

SEQ ID NO: 323367 - DNA, 25 bp, Mus musculus
cagtgactctgagccagatgctgtc

SEQ ID NO: 323368 - DNA, 25 bp, Mus musculus
cagtgactctgcctatgtgtgaaag

SEQ ID NO: 323369 - DNA, 25 bp, Mus musculus
cagtgactctgcgtatgtgtgaaag

SEQ ID NO: 323370 - DNA, 25 bp, Mus musculus
cagtgactctggagttgctttcttc

SEQ ID NO: 323371 - DNA, 25 bp, Mus musculus
cagtgactctggtgttgctttcttc

SEQ ID NO: 323372 - DNA, 25 bp, Mus musculus
cagtgactgactaacctgtggtatt

SEQ ID NO: 323373 - DNA, 25 bp, Mus musculus
cagtgactgacttacctgtggtatt

SEQ ID NO: 323374 - DNA, 25 bp, Mus musculus
cagtgactgagaaaaatatggccaa

SEQ ID NO: 323375 - DNA, 25 bp, Mus musculus
cagtgactgagataaatatggccaa

SEQ ID NO: 323376 - DNA, 25 bp, Mus musculus
cagtgactgatgagcttgtgttcaa

SEQ ID NO: 323377 - DNA, 25 bp, Mus musculus
cagtgactgatgtgcttgtgttcaa

SEQ ID NO: 323378 - DNA, 25 bp, Mus musculus
cagtgactgcccatgaggacgcccc

SEQ ID NO: 323379 - DNA, 25 bp, Mus musculus
cagtgactgcccttgaggacgcccc

SEQ ID NO: 323380 - DNA, 25 bp, Mus musculus
cagtgactggcgatgaggatatttc

SEQ ID NO: 323381 - DNA, 25 bp, Mus musculus
cagtgactggcgttgaggatatttc

SEQ ID NO: 323382 - DNA, 25 bp, Mus musculus
cagtgactgtacctgagggactctt

SEQ ID NO: 323383 - DNA, 25 bp, Mus musculus
cagtgactgtacgtgagggactctt

SEQ ID NO: 323384 - DNA, 25 bp, Mus musculus
cagtgacttagactgaagccagtgg

SEQ ID NO: 323385 - DNA, 25 bp, Mus musculus
cagtgacttagagtgaagccagtgg

SEQ ID NO: 323386 - DNA, 25 bp, Mus musculus
cagtgacttcctcggaattgcttgt

SEQ ID NO: 323387 - DNA, 25 bp, Mus musculus
cagtgacttcctgggaattgcttgt

SEQ ID NO: 323388 - DNA, 25 bp, Mus musculus
cagtgacttctcaattatgtgtatc

SEQ ID NO: 323389 - DNA, 25 bp, Mus musculus
cagtgacttctctattatgtgtatc

SEQ ID NO: 323390 - DNA, 25 bp, Mus musculus
cagtgactttgaatgcagggcatgc

SEQ ID NO: 323391 - DNA, 25 bp, Mus musculus
cagtgactttgattgcagggcatgc

SEQ ID NO: 323392 - DNA, 25 bp, Mus musculus
cagtgactttggcttttatagctca

SEQ ID NO: 323393 - DNA, 25 bp, Mus musculus
cagtgactttgggttttatagctca

SEQ ID NO: 323394 - DNA, 25 bp, Mus musculus
cagtgagaaagcatccttgtcacag

SEQ ID NO: 323395 - DNA, 25 bp, Mus musculus
cagtgagaaagcttccttgtcacag

SEQ ID NO: 323396 - DNA, 25 bp, Mus musculus
cagtgagactgaacgttgcctatct

SEQ ID NO: 323397 - DNA, 25 bp, Mus musculus
cagtgagactgatcgttgcctatct

SEQ ID NO: 323398 - DNA, 25 bp, Mus musculus
cagtgagactgccaacccggcacaa

SEQ ID NO: 323399 - DNA, 25 bp, Mus musculus
cagtgagactgcgaacccggcacaa

SEQ ID NO: 323400 - DNA, 25 bp, Mus musculus
cagtgagagaccaacagcatgtgca

SEQ ID NO: 323401 - DNA, 25 bp, Mus musculus
cagtgagagacctacagcatgtgca

SEQ ID NO: 323402 - DNA, 25 bp, Mus musculus
cagtgagagatgcttgtttggtttt

SEQ ID NO: 323403 - DNA, 25 bp, Mus musculus
cagtgagagatggttgtttggtttt

SEQ ID NO: 323404 - DNA, 25 bp, Mus musculus
cagtgagagcataatcagtcagtct

SEQ ID NO: 323405 - DNA, 25 bp, Mus musculus
cagtgagagcattatcagtcagtct

SEQ ID NO: 323406 - DNA, 25 bp, Mus musculus
cagtgagagggtaggaaatgtcatt

SEQ ID NO: 323407 - DNA, 25 bp, Mus musculus
cagtgagagggttggaaatgtcatt

SEQ ID NO: 323408 - DNA, 25 bp, Mus musculus
cagtgagaggtcagccagcttgtgc

SEQ ID NO: 323409 - DNA, 25 bp, Mus musculus
cagtgagaggtctgccagcttgtgc

SEQ ID NO: 323410 - DNA, 25 bp, Mus musculus
cagtgagagtgccaaccaagccttc

SEQ ID NO: 323411 - DNA, 25 bp, Mus musculus
cagtgagagtgcgaaccaagccttc

SEQ ID NO: 323412 - DNA, 25 bp, Mus musculus
cagtgagatatgcttcccagccata

SEQ ID NO: 323413 - DNA, 25 bp, Mus musculus
cagtgagatatggttcccagccata

SEQ ID NO: 323414 - DNA, 25 bp, Mus musculus
cagtgagatctgctctccctgtaac

SEQ ID NO: 323415 - DNA, 25 bp, Mus musculus
cagtgagatctggtctccctgtaac

SEQ ID NO: 323416 - DNA, 25 bp, Mus musculus
cagtgagattctcgacgcagacctt

SEQ ID NO: 323417 - DNA, 25 bp, Mus musculus
cagtgagattctggacgcagacctt

SEQ ID NO: 323418 - DNA, 25 bp, Mus musculus
cagtgagatttcatcagcttctatt

SEQ ID NO: 323419 - DNA, 25 bp, Mus musculus
cagtgagatttcttcagcttctatt

SEQ ID NO: 323420 - DNA, 25 bp, Mus musculus
cagtgagcaccgaatgaatgagagc

SEQ ID NO: 323421 - DNA, 25 bp, Mus musculus
cagtgagcaccgtatgaatgagagc

SEQ ID NO: 323422 - DNA, 25 bp, Mus musculus
cagtgagcatgaccacagtgggcta

SEQ ID NO: 323423 - DNA, 25 bp, Mus musculus
cagtgagcatgagcacagtgggcta

SEQ ID NO: 323424 - DNA, 25 bp, Mus musculus
cagtgagcatggcttggacctatta

SEQ ID NO: 323425 - DNA, 25 bp, Mus musculus
cagtgagcatgggttggacctatta

SEQ ID NO: 323426 - DNA, 25 bp, Mus musculus
cagtgagccaatccctgtgggcgaa

SEQ ID NO: 323427 - DNA, 25 bp, Mus musculus
cagtgagccaatgcctgtgggcgaa

SEQ ID NO: 323428 - DNA, 25 bp, Mus musculus
cagtgagccctcagcgctgtgcgca

SEQ ID NO: 323429 - DNA, 25 bp, Mus musculus
cagtgagccctctgcgctgtgcgca

SEQ ID NO: 323430 - DNA, 25 bp, Mus musculus
cagtgagcctacctatcgtaagtta

SEQ ID NO: 323431 - DNA, 25 bp, Mus musculus
cagtgagcctacgtatcgtaagtta

SEQ ID NO: 323432 - DNA, 25 bp, Mus musculus
cagtgagctgggactcgaaacacga

SEQ ID NO: 323433 - DNA, 25 bp, Mus musculus
cagtgagctgggtctcgaaacacga

SEQ ID NO: 323434 - DNA, 25 bp, Mus musculus
cagtgagctgtcagggagctgtttc

SEQ ID NO: 323435 - DNA, 25 bp, Mus musculus
cagtgagctgtctgggagctgtttc

SEQ ID NO: 323436 - DNA, 25 bp, Mus musculus
cagtgagctttccactccagagaaa

SEQ ID NO: 323437 - DNA, 25 bp, Mus musculus
cagtgagctttcgactccagagaaa

SEQ ID NO: 323438 - DNA, 25 bp, Mus musculus
cagtgaggaagcatgtacgtttggt

SEQ ID NO: 323439 - DNA, 25 bp, Mus musculus
cagtgaggaagcttgtacgtttggt

SEQ ID NO: 323440 - DNA, 25 bp, Mus musculus
cagtgaggactgagaaccggagcct

SEQ ID NO: 323441 - DNA, 25 bp, Mus musculus
cagtgaggactgtgaaccggagcct

SEQ ID NO: 323442 - DNA, 25 bp, Mus musculus
cagtgaggagctcgaccttagtgaa

SEQ ID NO: 323443 - DNA, 25 bp, Mus musculus
cagtgaggagctggaccttagtgaa

SEQ ID NO: 323444 - DNA, 25 bp, Mus musculus
cagtgaggatcaaggctacccagac

SEQ ID NO: 323445 - DNA, 25 bp, Mus musculus
cagtgaggatcatggctacccagac

SEQ ID NO: 323446 - DNA, 25 bp, Mus musculus
cagtgaggcatgattaccacctact

SEQ ID NO: 323447 - DNA, 25 bp, Mus musculus
cagtgaggcatgtttaccacctact

SEQ ID NO: 323448 - DNA, 25 bp, Mus musculus
cagtgaggcccacgacggaaaacgt

SEQ ID NO: 323449 - DNA, 25 bp, Mus musculus
cagtgaggcccaggacggaaaacgt

SEQ ID NO: 323450 - DNA, 25 bp, Mus musculus
cagtgaggcggcagtgctctgttct

SEQ ID NO: 323451 - DNA, 25 bp, Mus musculus
cagtgaggcggctgtgctctgttct

SEQ ID NO: 323452 - DNA, 25 bp, Mus musculus
cagtgaggctatcctttccttcgaa

SEQ ID NO: 323453 - DNA, 25 bp, Mus musculus
cagtgaggctatgctttccttcgaa

SEQ ID NO: 323454 - DNA, 25 bp, Mus musculus
cagtgagggagtatctagagtctta

SEQ ID NO: 323455 - DNA, 25 bp, Mus musculus
cagtgagggagtttctagagtctta

SEQ ID NO: 323456 - DNA, 25 bp, Mus musculus
cagtgagggctgaggtcttacatcc

SEQ ID NO: 323457 - DNA, 25 bp, Mus musculus
cagtgagggctgtggtcttacatcc

SEQ ID NO: 323458 - DNA, 25 bp, Mus musculus
cagtgaggtcaaccctgtccgacag

SEQ ID NO: 323459 - DNA, 25 bp, Mus musculus
cagtgaggtcaagcctgtccgacag

SEQ ID NO: 323460 - DNA, 25 bp, Mus musculus
cagtgaggtcatagaaatgtgtgac

SEQ ID NO: 323461 - DNA, 25 bp, Mus musculus
cagtgaggtcattgaaatgtgtgac

SEQ ID NO: 323462 - DNA, 25 bp, Mus musculus
cagtgaggtctgaattacttccgaa

SEQ ID NO: 323463 - DNA, 25 bp, Mus musculus
cagtgaggtctgtattacttccgaa

SEQ ID NO: 323464 - DNA, 25 bp, Mus musculus
cagtgaggtgctatccgacatgaca

SEQ ID NO: 323465 - DNA, 25 bp, Mus musculus
cagtgaggtgctttccgacatgaca

SEQ ID NO: 323466 - DNA, 25 bp, Mus musculus
cagtgagtcactccgcctcatcttg

SEQ ID NO: 323467 - DNA, 25 bp, Mus musculus
cagtgagtcactgcgcctcatcttg

SEQ ID NO: 323468 - DNA, 25 bp, Mus musculus
cagtgagtccatctgtgccaagaaa

SEQ ID NO: 323469 - DNA, 25 bp, Mus musculus
cagtgagtccatgtgtgccaagaaa

SEQ ID NO: 323470 - DNA, 25 bp, Mus musculus
cagtgagtcccacggtctgtctctg

SEQ ID NO: 323471 - DNA, 25 bp, Mus musculus
cagtgagtcccagggtctgtctctg

SEQ ID NO: 323472 - DNA, 25 bp, Mus musculus
cagtgagtccctctgcagagattga

SEQ ID NO: 323473 - DNA, 25 bp, Mus musculus
cagtgagtccctgtgcagagattga

SEQ ID NO: 323474 - DNA, 25 bp, Mus musculus
cagtgagtcctccagtgtttcaagt

SEQ ID NO: 323475 - DNA, 25 bp, Mus musculus
cagtgagtcctcgagtgtttcaagt

SEQ ID NO: 323476 - DNA, 25 bp, Mus musculus
cagtgagtgacaccctggtttgcag

SEQ ID NO: 323477 - DNA, 25 bp, Mus musculus
cagtgagtgacagcctggtttgcag

SEQ ID NO: 323478 - DNA, 25 bp, Mus musculus
cagtgagtgcaaccggagctctgcc

SEQ ID NO: 323479 - DNA, 25 bp, Mus musculus
cagtgagtgcaagcggagctctgcc

SEQ ID NO: 323480 - DNA, 25 bp, Mus musculus
cagtgagtgcgtaatttgtgtgcca

SEQ ID NO: 323481 - DNA, 25 bp, Mus musculus
cagtgagtgcgttatttgtgtgcca

SEQ ID NO: 323482 - DNA, 25 bp, Mus musculus
cagtgagtgctgagtttgtagcctc

SEQ ID NO: 323483 - DNA, 25 bp, Mus musculus
cagtgagtgctgtgtttgtagcctc

SEQ ID NO: 323484 - DNA, 25 bp, Mus musculus
cagtgagttagcatttattcaaagt

SEQ ID NO: 323485 - DNA, 25 bp, Mus musculus
cagtgagttagcttttattcaaagt

SEQ ID NO: 323486 - DNA, 25 bp, Mus musculus
cagtgagttctgattcactcagaga

SEQ ID NO: 323487 - DNA, 25 bp, Mus musculus
cagtgagttctgtttcactcagaga

SEQ ID NO: 323488 - DNA, 25 bp, Mus musculus
cagtgagttgagagtttgctaccca

SEQ ID NO: 323489 - DNA, 25 bp, Mus musculus
cagtgagttgagtgtttgctaccca

SEQ ID NO: 323490 - DNA, 25 bp, Mus musculus
cagtgagttgcgctgaaaactgtgt

SEQ ID NO: 323491 - DNA, 25 bp, Mus musculus
cagtgagttgcggtgaaaactgtgt

SEQ ID NO: 323492 - DNA, 25 bp, Mus musculus
cagtgagtttgacacaagtctgaac

SEQ ID NO: 323493 - DNA, 25 bp, Mus musculus
cagtgagtttgagacaagtctgaac

SEQ ID NO: 323494 - DNA, 25 bp, Mus musculus
cagtgagttttcattggtccatgtt

SEQ ID NO: 323495 - DNA, 25 bp, Mus musculus
cagtgagttttctttggtccatgtt

SEQ ID NO: 323496 - DNA, 25 bp, Mus musculus
cagtgataactcacttgtcttgtaa

SEQ ID NO: 323497 - DNA, 25 bp, Mus musculus
cagtgataactctcttgtcttgtaa

SEQ ID NO: 323498 - DNA, 25 bp, Mus musculus
cagtgataactgcatgctaacttca

SEQ ID NO: 323499 - DNA, 25 bp, Mus musculus
cagtgataactggatgctaacttca

SEQ ID NO: 323500 - DNA, 25 bp, Mus musculus
cagtgataagatattgttaccaagc

SEQ ID NO: 323501 - DNA, 25 bp, Mus musculus
cagtgataagattttgttaccaagc

SEQ ID NO: 323502 - DNA, 25 bp, Mus musculus
cagtgataatacatatagggtctaa

SEQ ID NO: 323503 - DNA, 25 bp, Mus musculus
cagtgataatacttatagggtctaa

SEQ ID NO: 323504 - DNA, 25 bp, Mus musculus
cagtgatactgaccctccgtgggaa

SEQ ID NO: 323505 - DNA, 25 bp, Mus musculus
cagtgatactgagcctccgtgggaa

SEQ ID NO: 323506 - DNA, 25 bp, Mus musculus
cagtgatagaacatgaagatctgtt

SEQ ID NO: 323507 - DNA, 25 bp, Mus musculus
cagtgatagaacttgaagatctgtt

SEQ ID NO: 323508 - DNA, 25 bp, Mus musculus
cagtgatagagcagacaggaggtct

SEQ ID NO: 323509 - DNA, 25 bp, Mus musculus
cagtgatagagctgacaggaggtct

SEQ ID NO: 323510 - DNA, 25 bp, Mus musculus
cagtgatatcaccttttcatacatg

SEQ ID NO: 323511 - DNA, 25 bp, Mus musculus
cagtgatatcacgttttcatacatg

SEQ ID NO: 323512 - DNA, 25 bp, Mus musculus
cagtgatatgcactatatgtccaac

SEQ ID NO: 323513 - DNA, 25 bp, Mus musculus
cagtgatatgcagtatatgtccaac

SEQ ID NO: 323514 - DNA, 25 bp, Mus musculus
cagtgatatttcagactccatctcc

SEQ ID NO: 323515 - DNA, 25 bp, Mus musculus
cagtgatatttctgactccatctcc

SEQ ID NO: 323516 - DNA, 25 bp, Mus musculus
cagtgatcaagactgttggctgctc

SEQ ID NO: 323517 - DNA, 25 bp, Mus musculus
cagtgatcaagagtgttggctgctc

SEQ ID NO: 323518 - DNA, 25 bp, Mus musculus
cagtgatccctgcataaaatatgtt

SEQ ID NO: 323519 - DNA, 25 bp, Mus musculus
cagtgatccctggataaaatatgtt

SEQ ID NO: 323520 - DNA, 25 bp, Mus musculus
cagtgatctctccgcgtgtgacatg

SEQ ID NO: 323521 - DNA, 25 bp, Mus musculus
cagtgatctctcggcgtgtgacatg

SEQ ID NO: 323522 - DNA, 25 bp, Mus musculus
cagtgatctgccagacttccctgac

SEQ ID NO: 323523 - DNA, 25 bp, Mus musculus
cagtgatctgcctgacttccctgac

SEQ ID NO: 323524 - DNA, 25 bp, Mus musculus
cagtgatctggcatcggacacaggt

SEQ ID NO: 323525 - DNA, 25 bp, Mus musculus
cagtgatctggcttcggacacaggt

SEQ ID NO: 323526 - DNA, 25 bp, Mus musculus
cagtgatctgttaccccggatttca

SEQ ID NO: 323527 - DNA, 25 bp, Mus musculus
cagtgatctgtttccccggatttca

SEQ ID NO: 323528 - DNA, 25 bp, Mus musculus
cagtgatcttggcttgttccgagta

SEQ ID NO: 323529 - DNA, 25 bp, Mus musculus
cagtgatcttgggttgttccgagta

SEQ ID NO: 323530 - DNA, 25 bp, Mus musculus
cagtgatgaatgcatttgcctctct

SEQ ID NO: 323531 - DNA, 25 bp, Mus musculus
cagtgatgaatggatttgcctctct

SEQ ID NO: 323532 - DNA, 25 bp, Mus musculus
cagtgatgacagatccttcattgag

SEQ ID NO: 323533 - DNA, 25 bp, Mus musculus
cagtgatgacagttccttcattgag

SEQ ID NO: 323534 - DNA, 25 bp, Mus musculus
cagtgatgacggactccttgctgat

SEQ ID NO: 323535 - DNA, 25 bp, Mus musculus
cagtgatgacggtctccttgctgat

SEQ ID NO: 323536 - DNA, 25 bp, Mus musculus
cagtgatgagccaccatgttctagt

SEQ ID NO: 323537 - DNA, 25 bp, Mus musculus
cagtgatgagcctccatgttctagt

SEQ ID NO: 323538 - DNA, 25 bp, Mus musculus
cagtgatgatgtcatggtgattgag

SEQ ID NO: 323539 - DNA, 25 bp, Mus musculus
cagtgatgatgtgatggtgattgag

SEQ ID NO: 323540 - DNA, 25 bp, Mus musculus
cagtgatgattgcaacggcgctcaa

SEQ ID NO: 323541 - DNA, 25 bp, Mus musculus
cagtgatgattggaacggcgctcaa

SEQ ID NO: 323542 - DNA, 25 bp, Mus musculus
cagtgatgcaagagagagctttcag

SEQ ID NO: 323543 - DNA, 25 bp, Mus musculus
cagtgatgcaagtgagagctttcag

SEQ ID NO: 323544 - DNA, 25 bp, Mus musculus
cagtgatgcaggatcttgcttttta

SEQ ID NO: 323545 - DNA, 25 bp, Mus musculus
cagtgatgcaggttcttgcttttta

SEQ ID NO: 323546 - DNA, 25 bp, Mus musculus
cagtgatgcattcccggattctgtt

SEQ ID NO: 323547 - DNA, 25 bp, Mus musculus
cagtgatgcattgccggattctgtt

SEQ ID NO: 323548 - DNA, 25 bp, Mus musculus
cagtgatgcctactgtacttcctgg

SEQ ID NO: 323549 - DNA, 25 bp, Mus musculus
cagtgatgcctagtgtacttcctgg

SEQ ID NO: 323550 - DNA, 25 bp, Mus musculus
cagtgatgcttcaggtgaggtgaaa

SEQ ID NO: 323551 - DNA, 25 bp, Mus musculus
cagtgatgcttctggtgaggtgaaa

SEQ ID NO: 323552 - DNA, 25 bp, Mus musculus
cagtgatggaacagacacctgagca

SEQ ID NO: 323553 - DNA, 25 bp, Mus musculus
cagtgatggaactgacacctgagca

SEQ ID NO: 323554 - DNA, 25 bp, Mus musculus
cagtgatgggcaccgtttggctctc

SEQ ID NO: 323555 - DNA, 25 bp, Mus musculus
cagtgatgggcagcgtttggctctc

SEQ ID NO: 323556 - DNA, 25 bp, Mus musculus
cagtgatggtgcaaaacgcctttaa

SEQ ID NO: 323557 - DNA, 25 bp, Mus musculus
cagtgatggtgctaaacgcctttaa

SEQ ID NO: 323558 - DNA, 25 bp, Mus musculus
cagtgatgtcagcttcttatttgta

SEQ ID NO: 323559 - DNA, 25 bp, Mus musculus
cagtgatgtcaggttcttatttgta

SEQ ID NO: 323560 - DNA, 25 bp, Mus musculus
cagtgatgtgaacaccttgctcaaa

SEQ ID NO: 323561 - DNA, 25 bp, Mus musculus
cagtgatgtgaagaccttgctcaaa

SEQ ID NO: 323562 - DNA, 25 bp, Mus musculus
cagtgatgtgtcatccggtggcaat

SEQ ID NO: 323563 - DNA, 25 bp, Mus musculus
cagtgatgtgtcttccggtggcaat

SEQ ID NO: 323564 - DNA, 25 bp, Mus musculus
cagtgatgtgttatgtccccagtta

SEQ ID NO: 323565 - DNA, 25 bp, Mus musculus
cagtgatgtgttttgtccccagtta

SEQ ID NO: 323566 - DNA, 25 bp, Mus musculus
cagtgattacagactcgctgacagt

SEQ ID NO: 323567 - DNA, 25 bp, Mus musculus
cagtgattacagtctcgctgacagt

SEQ ID NO: 323568 - DNA, 25 bp, Mus musculus
cagtgattagttattcagagccatt

SEQ ID NO: 323569 - DNA, 25 bp, Mus musculus
cagtgattagtttttcagagccatt

SEQ ID NO: 323570 - DNA, 25 bp, Mus musculus
cagtgattatggcatctatacaatg

SEQ ID NO: 323571 - DNA, 25 bp, Mus musculus
cagtgattatgggatctatacaatg

SEQ ID NO: 323572 - DNA, 25 bp, Mus musculus
cagtgattcactccttttcatttag

SEQ ID NO: 323573 - DNA, 25 bp, Mus musculus
cagtgattcactgcttttcatttag

SEQ ID NO: 323574 - DNA, 25 bp, Mus musculus
cagtgattcataccgtacatctcca

SEQ ID NO: 323575 - DNA, 25 bp, Mus musculus
cagtgattcatagcgtacatctcca

SEQ ID NO: 323576 - DNA, 25 bp, Mus musculus
cagtgattccctattcaatgacatt

SEQ ID NO: 323577 - DNA, 25 bp, Mus musculus
cagtgattcccttttcaatgacatt

SEQ ID NO: 323578 - DNA, 25 bp, Mus musculus
cagtgattcctaattcagtcagttt

SEQ ID NO: 323579 - DNA, 25 bp, Mus musculus
cagtgattcctatttcagtcagttt

SEQ ID NO: 323580 - DNA, 25 bp, Mus musculus
cagtgattccttaacctgaggtgtt

SEQ ID NO: 323581 - DNA, 25 bp, Mus musculus
cagtgattcctttacctgaggtgtt

SEQ ID NO: 323582 - DNA, 25 bp, Mus musculus
cagtgattctgccataatgacctat

SEQ ID NO: 323583 - DNA, 25 bp, Mus musculus
cagtgattctgcgataatgacctat

SEQ ID NO: 323584 - DNA, 25 bp, Mus musculus
cagtgattgagccagcattccttca

SEQ ID NO: 323585 - DNA, 25 bp, Mus musculus
cagtgattgagcgagcattccttca

SEQ ID NO: 323586 - DNA, 25 bp, Mus musculus
cagtgattgtctatgcagttatgca

SEQ ID NO: 323587 - DNA, 25 bp, Mus musculus
cagtgattgtctttgcagttatgca

SEQ ID NO: 323588 - DNA, 25 bp, Mus musculus
cagtgatttactcttgctgattaaa

SEQ ID NO: 323589 - DNA, 25 bp, Mus musculus
cagtgatttactgttgctgattaaa

SEQ ID NO: 323590 - DNA, 25 bp, Mus musculus
cagtgatttcacagacactgccatg

SEQ ID NO: 323591 - DNA, 25 bp, Mus musculus
cagtgatttcacataggatgatttg

SEQ ID NO: 323592 - DNA, 25 bp, Mus musculus
cagtgatttcactgacactgccatg

SEQ ID NO: 323593 - DNA, 25 bp, Mus musculus
cagtgatttcacttaggatgatttg

SEQ ID NO: 323594 - DNA, 25 bp, Mus musculus
cagtgatttcccacggtttccggag

SEQ ID NO: 323595 - DNA, 25 bp, Mus musculus
cagtgatttccctcggtttccggag

SEQ ID NO: 323596 - DNA, 25 bp, Mus musculus
cagtgatttctacacgttgttttta

SEQ ID NO: 323597 - DNA, 25 bp, Mus musculus
cagtgatttctagacgttgttttta

SEQ ID NO: 323598 - DNA, 25 bp, Mus musculus
cagtgattttcacttgttgcttata

SEQ ID NO: 323599 - DNA, 25 bp, Mus musculus
cagtgattttcagttgttgcttata

SEQ ID NO: 323600 - DNA, 25 bp, Mus musculus
cagtgatttttgagctcgttgtctt

SEQ ID NO: 323601 - DNA, 25 bp, Mus musculus
cagtgatttttgtgctcgttgtctt

SEQ ID NO: 323602 - DNA, 25 bp, Mus musculus
cagtgcaagaatcctcgtccatgtc

SEQ ID NO: 323603 - DNA, 25 bp, Mus musculus
cagtgcaagaatgctcgtccatgtc

SEQ ID NO: 323604 - DNA, 25 bp, Mus musculus
cagtgcaagagaagcttctccgtaa

SEQ ID NO: 323605 - DNA, 25 bp, Mus musculus
cagtgcaagagatgcttctccgtaa

SEQ ID NO: 323606 - DNA, 25 bp, Mus musculus
cagtgcaagtggacatcctggctga

SEQ ID NO: 323607 - DNA, 25 bp, Mus musculus
cagtgcaagtggaggactctccagt

SEQ ID NO: 323608 - DNA, 25 bp, Mus musculus
cagtgcaagtggtcatcctggctga

SEQ ID NO: 323609 - DNA, 25 bp, Mus musculus
cagtgcaagtggtggactctccagt

SEQ ID NO: 323610 - DNA, 25 bp, Mus musculus
cagtgcaatcagctttcatttcctt

SEQ ID NO: 323611 - DNA, 25 bp, Mus musculus
cagtgcaatcaggtttcatttcctt

SEQ ID NO: 323612 - DNA, 25 bp, Mus musculus
cagtgcaattgtctgtatttctcag

SEQ ID NO: 323613 - DNA, 25 bp, Mus musculus
cagtgcaattgtgtgtatttctcag

SEQ ID NO: 323614 - DNA, 25 bp, Mus musculus
cagtgcaatttccagtaatgtaaaa

SEQ ID NO: 323615 - DNA, 25 bp, Mus musculus
cagtgcaatttcgagtaatgtaaaa

SEQ ID NO: 323616 - DNA, 25 bp, Mus musculus
cagtgcacaagacgctcctacaggg

SEQ ID NO: 323617 - DNA, 25 bp, Mus musculus
cagtgcacaagaggctcctacaggg

SEQ ID NO: 323618 - DNA, 25 bp, Mus musculus
cagtgcacacgaaggctgactactc

SEQ ID NO: 323619 - DNA, 25 bp, Mus musculus
cagtgcacacgatggctgactactc

SEQ ID NO: 323620 - DNA, 25 bp, Mus musculus
cagtgcacagcccttagaaccaaga

SEQ ID NO: 323621 - DNA, 25 bp, Mus musculus
cagtgcacagccgttagaaccaaga

SEQ ID NO: 323622 - DNA, 25 bp, Mus musculus
cagtgcaccgctagctgtggagaag

SEQ ID NO: 323623 - DNA, 25 bp, Mus musculus
cagtgcaccgctcccatgaagagaa

SEQ ID NO: 323624 - DNA, 25 bp, Mus musculus
cagtgcaccgctgccatgaagagaa

SEQ ID NO: 323625 - DNA, 25 bp, Mus musculus
cagtgcaccgcttgctgtggagaag

SEQ ID NO: 323626 - DNA, 25 bp, Mus musculus
cagtgcacgttcacttccacagaga

SEQ ID NO: 323627 - DNA, 25 bp, Mus musculus
cagtgcacgttctcttccacagaga

SEQ ID NO: 323628 - DNA, 25 bp, Mus musculus
cagtgcagagcccatcaaaagccgg

SEQ ID NO: 323629 - DNA, 25 bp, Mus musculus
cagtgcagagccgatcaaaagccgg

SEQ ID NO: 323630 - DNA, 25 bp, Mus musculus
cagtgcagcttgactcaaaacaatg

SEQ ID NO: 323631 - DNA, 25 bp, Mus musculus
cagtgcagcttgtctcaaaacaatg

SEQ ID NO: 323632 - DNA, 25 bp, Mus musculus
cagtgcagtcacagaagggttgatt

SEQ ID NO: 323633 - DNA, 25 bp, Mus musculus
cagtgcagtcactgaagggttgatt

SEQ ID NO: 323634 - DNA, 25 bp, Mus musculus
cagtgcagtcagaggtgccagagat

SEQ ID NO: 323635 - DNA, 25 bp, Mus musculus
cagtgcagtcagtggtgccagagat

SEQ ID NO: 323636 - DNA, 25 bp, Mus musculus
cagtgcagtgacatggcatcaactt

SEQ ID NO: 323637 - DNA, 25 bp, Mus musculus
cagtgcagtgacttggcatcaactt

SEQ ID NO: 323638 - DNA, 25 bp, Mus musculus
cagtgcagtgatacttgctggtcct

SEQ ID NO: 323639 - DNA, 25 bp, Mus musculus
cagtgcagtgattcttgctggtcct

SEQ ID NO: 323640 - DNA, 25 bp, Mus musculus
cagtgcagtgtactgacagaaggaa

SEQ ID NO: 323641 - DNA, 25 bp, Mus musculus
cagtgcagtgtagtgacagaaggaa

SEQ ID NO: 323642 - DNA, 25 bp, Mus musculus
cagtgcagtgtgctttctgttatta

SEQ ID NO: 323643 - DNA, 25 bp, Mus musculus
cagtgcagtgtggtttctgttatta

SEQ ID NO: 323644 - DNA, 25 bp, Mus musculus
cagtgcagtgttccccattagcatg

SEQ ID NO: 323645 - DNA, 25 bp, Mus musculus
cagtgcagtgttctctgggctcaac

SEQ ID NO: 323646 - DNA, 25 bp, Mus musculus
cagtgcagtgttgcccattagcatg

SEQ ID NO: 323647 - DNA, 25 bp, Mus musculus
cagtgcagtgttgtctgggctcaac

SEQ ID NO: 323648 - DNA, 25 bp, Mus musculus
cagtgcagttggaaacaggtggttt

SEQ ID NO: 323649 - DNA, 25 bp, Mus musculus
cagtgcagttggtaacaggtggttt

SEQ ID NO: 323650 - DNA, 25 bp, Mus musculus
cagtgcagtttgaattaagctaggt

SEQ ID NO: 323651 - DNA, 25 bp, Mus musculus
cagtgcagtttgtattaagctaggt

SEQ ID NO: 323652 - DNA, 25 bp, Mus musculus
cagtgcatattaaagggtgtacatt

SEQ ID NO: 323653 - DNA, 25 bp, Mus musculus
cagtgcatattatagggtgtacatt

SEQ ID NO: 323654 - DNA, 25 bp, Mus musculus
cagtgcatcatcatcattcagctat

SEQ ID NO: 323655 - DNA, 25 bp, Mus musculus
cagtgcatcatcttcattcagctat

SEQ ID NO: 323656 - DNA, 25 bp, Mus musculus
cagtgcatctatcgcattgttgcgt

SEQ ID NO: 323657 - DNA, 25 bp, Mus musculus
cagtgcatctatggcattgttgcgt

SEQ ID NO: 323658 - DNA, 25 bp, Mus musculus
cagtgcatctccaccagcagacagg

SEQ ID NO: 323659 - DNA, 25 bp, Mus musculus
cagtgcatctcctccagcagacagg

SEQ ID NO: 323660 - DNA, 25 bp, Mus musculus
cagtgcatggtgattcaggctggct

SEQ ID NO: 323661 - DNA, 25 bp, Mus musculus
cagtgcatggtgtttcaggctggct

SEQ ID NO: 323662 - DNA, 25 bp, Mus musculus
cagtgcattcatctttccctgagtt

SEQ ID NO: 323663 - DNA, 25 bp, Mus musculus
cagtgcattcatgtttccctgagtt

SEQ ID NO: 323664 - DNA, 25 bp, Mus musculus
cagtgcatttgcaagataccccaat

SEQ ID NO: 323665 - DNA, 25 bp, Mus musculus
cagtgcatttgctagataccccaat

SEQ ID NO: 323666 - DNA, 25 bp, Mus musculus
cagtgccaccttccatatgtgggaa

SEQ ID NO: 323667 - DNA, 25 bp, Mus musculus
cagtgccaccttgcatatgtgggaa

SEQ ID NO: 323668 - DNA, 25 bp, Mus musculus
cagtgccaggcactaacagattgct

SEQ ID NO: 323669 - DNA, 25 bp, Mus musculus
cagtgccaggcagtaacagattgct

SEQ ID NO: 323670 - DNA, 25 bp, Mus musculus
cagtgccatcaacccagtgatttac

SEQ ID NO: 323671 - DNA, 25 bp, Mus musculus
cagtgccatcaagccagtgatttac

SEQ ID NO: 323672 - DNA, 25 bp, Mus musculus
cagtgccatcggatttagctgcaga

SEQ ID NO: 323673 - DNA, 25 bp, Mus musculus
cagtgccatcggttttagctgcaga

SEQ ID NO: 323674 - DNA, 25 bp, Mus musculus
cagtgccatgggaggctccatttgt

SEQ ID NO: 323675 - DNA, 25 bp, Mus musculus
cagtgccatgggtggctccatttgt

SEQ ID NO: 323676 - DNA, 25 bp, Mus musculus
cagtgcccaatcataaagggtccta

SEQ ID NO: 323677 - DNA, 25 bp, Mus musculus
cagtgcccaatcttaaagggtccta

SEQ ID NO: 323678 - DNA, 25 bp, Mus musculus
cagtgcccagtaaccgaaataacca

SEQ ID NO: 323679 - DNA, 25 bp, Mus musculus
cagtgcccagtatccgaaataacca

SEQ ID NO: 323680 - DNA, 25 bp, Mus musculus
cagtgcccattaatatgcagttgtg

SEQ ID NO: 323681 - DNA, 25 bp, Mus musculus
cagtgcccattattatgcagttgtg

SEQ ID NO: 323682 - DNA, 25 bp, Mus musculus
cagtgccctaccagctgtgggaaaa

SEQ ID NO: 323683 - DNA, 25 bp, Mus musculus
cagtgccctacctgctgtgggaaaa

SEQ ID NO: 323684 - DNA, 25 bp, Mus musculus
cagtgccctgtcatgggtgatcaac

SEQ ID NO: 323685 - DNA, 25 bp, Mus musculus
cagtgccctgtcttgggtgatcaac

SEQ ID NO: 323686 - DNA, 25 bp, Mus musculus
cagtgcccttgaactgtgctggctc

SEQ ID NO: 323687 - DNA, 25 bp, Mus musculus
cagtgcccttgatctgtgctggctc

SEQ ID NO: 323688 - DNA, 25 bp, Mus musculus
cagtgccgaacacgtctttactact

SEQ ID NO: 323689 - DNA, 25 bp, Mus musculus
cagtgccgaacaggtctttactact

SEQ ID NO: 323690 - DNA, 25 bp, Mus musculus
cagtgccgaattctagctcacaatt

SEQ ID NO: 323691 - DNA, 25 bp, Mus musculus
cagtgccgaattgtagctcacaatt

SEQ ID NO: 323692 - DNA, 25 bp, Mus musculus
cagtgccgcttcacagctgtgctgt

SEQ ID NO: 323693 - DNA, 25 bp, Mus musculus
cagtgccgcttctcagctgtgctgt

SEQ ID NO: 323694 - DNA, 25 bp, Mus musculus
cagtgccgctttctcatacaagatt

SEQ ID NO: 323695 - DNA, 25 bp, Mus musculus
cagtgccgctttgtcatacaagatt

SEQ ID NO: 323696 - DNA, 25 bp, Mus musculus
cagtgccgtgagcatcgacgttgaa

SEQ ID NO: 323697 - DNA, 25 bp, Mus musculus
cagtgccgtgaggatcgacgttgaa

SEQ ID NO: 323698 - DNA, 25 bp, Mus musculus
cagtgcctaagaaagtttttccctg

SEQ ID NO: 323699 - DNA, 25 bp, Mus musculus
cagtgcctaagatagtttttccctg

SEQ ID NO: 323700 - DNA, 25 bp, Mus musculus
cagtgcctacatatgtgctctccat

SEQ ID NO: 323701 - DNA, 25 bp, Mus musculus
cagtgcctacatttgtgctctccat

SEQ ID NO: 323702 - DNA, 25 bp, Mus musculus
cagtgcctctgaccctggtgttaag

SEQ ID NO: 323703 - DNA, 25 bp, Mus musculus
cagtgcctctgagcctggtgttaag

SEQ ID NO: 323704 - DNA, 25 bp, Mus musculus
cagtgcctgcaaaggccagccagat

SEQ ID NO: 323705 - DNA, 25 bp, Mus musculus
cagtgcctgcaatggccagccagat

SEQ ID NO: 323706 - DNA, 25 bp, Mus musculus
cagtgcctgccgactgaatttatta

SEQ ID NO: 323707 - DNA, 25 bp, Mus musculus
cagtgcctgccgtctgaatttatta

SEQ ID NO: 323708 - DNA, 25 bp, Mus musculus
cagtgcctggcacatgttttgacgc

SEQ ID NO: 323709 - DNA, 25 bp, Mus musculus
cagtgcctggcagatgttttgacgc

SEQ ID NO: 323710 - DNA, 25 bp, Mus musculus
cagtgccttaaaacagaacgagaga

SEQ ID NO: 323711 - DNA, 25 bp, Mus musculus
cagtgccttaaatcagaacgagaga

SEQ ID NO: 323712 - DNA, 25 bp, Mus musculus
cagtgccttcaccacaggtaaatgt

SEQ ID NO: 323713 - DNA, 25 bp, Mus musculus
cagtgccttcacgacaggtaaatgt

SEQ ID NO: 323714 - DNA, 25 bp, Mus musculus
cagtgccttcttatctaagttgttt

SEQ ID NO: 323715 - DNA, 25 bp, Mus musculus
cagtgccttcttttctaagttgttt

SEQ ID NO: 323716 - DNA, 25 bp, Mus musculus
cagtgccttgcaacatgggaatcat

SEQ ID NO: 323717 - DNA, 25 bp, Mus musculus
cagtgccttgcatcatgggaatcat

SEQ ID NO: 323718 - DNA, 25 bp, Mus musculus
cagtgccttgctctcttattagaat

SEQ ID NO: 323719 - DNA, 25 bp, Mus musculus
cagtgccttgctgtcttattagaat

SEQ ID NO: 323720 - DNA, 25 bp, Mus musculus
cagtgccttgggacagagctttatc

SEQ ID NO: 323721 - DNA, 25 bp, Mus musculus
cagtgccttgggtcagagctttatc

SEQ ID NO: 323722 - DNA, 25 bp, Mus musculus
cagtgccttgtgatccgtgacgtag

SEQ ID NO: 323723 - DNA, 25 bp, Mus musculus
cagtgccttgtgttccgtgacgtag

SEQ ID NO: 323724 - DNA, 25 bp, Mus musculus
cagtgcgctatcagggtcgtgccag

SEQ ID NO: 323725 - DNA, 25 bp, Mus musculus
cagtgcgctatctgggtcgtgccag

SEQ ID NO: 323726 - DNA, 25 bp, Mus musculus
cagtgcggagtgacccggtgactgg

SEQ ID NO: 323727 - DNA, 25 bp, Mus musculus
cagtgcggagtgtcccggtgactgg

SEQ ID NO: 323728 - DNA, 25 bp, Mus musculus
cagtgcggctttaagctttgagaca

SEQ ID NO: 323729 - DNA, 25 bp, Mus musculus
cagtgcggcttttagctttgagaca

SEQ ID NO: 323730 - DNA, 25 bp, Mus musculus
cagtgcgggcccaggatatgtagct

SEQ ID NO: 323731 - DNA, 25 bp, Mus musculus
cagtgcgggccctggatatgtagct

SEQ ID NO: 323732 - DNA, 25 bp, Mus musculus
cagtgcggtgctatacagaatgctc

SEQ ID NO: 323733 - DNA, 25 bp, Mus musculus
cagtgcggtgctttacagaatgctc

SEQ ID NO: 323734 - DNA, 25 bp, Mus musculus
cagtgcgtagcccataatgaccagg

SEQ ID NO: 323735 - DNA, 25 bp, Mus musculus
cagtgcgtagccgataatgaccagg

SEQ ID NO: 323736 - DNA, 25 bp, Mus musculus
cagtgcgtcaccacgtggctgaaag

SEQ ID NO: 323737 - DNA, 25 bp, Mus musculus
cagtgcgtcacctcgtggctgaaag

SEQ ID NO: 323738 - DNA, 25 bp, Mus musculus
cagtgcgtgcccactgagtggaaaa

SEQ ID NO: 323739 - DNA, 25 bp, Mus musculus
cagtgcgtgccctctgagtggaaaa

SEQ ID NO: 323740 - DNA, 25 bp, Mus musculus
cagtgcgtgggaagacatgccccag

SEQ ID NO: 323741 - DNA, 25 bp, Mus musculus
cagtgcgtgggatgacatgccccag

SEQ ID NO: 323742 - DNA, 25 bp, Mus musculus
cagtgctaaagtccaaactggagga

SEQ ID NO: 323743 - DNA, 25 bp, Mus musculus
cagtgctaaagtgcaaactggagga

SEQ ID NO: 323744 - DNA, 25 bp, Mus musculus
cagtgctaaatgctgtgtatatcat

SEQ ID NO: 323745 - DNA, 25 bp, Mus musculus
cagtgctaaatggtgtgtatatcat

SEQ ID NO: 323746 - DNA, 25 bp, Mus musculus
cagtgctaagacagttcctcatgtt

SEQ ID NO: 323747 - DNA, 25 bp, Mus musculus
cagtgctaagactgttcctcatgtt

SEQ ID NO: 323748 - DNA, 25 bp, Mus musculus
cagtgctatgatatgggtgatgccc

SEQ ID NO: 323749 - DNA, 25 bp, Mus musculus
cagtgctatgatttgggtgatgccc

SEQ ID NO: 323750 - DNA, 25 bp, Mus musculus
cagtgctatggcagggtatactctc

SEQ ID NO: 323751 - DNA, 25 bp, Mus musculus
cagtgctatggctgggtatactctc

SEQ ID NO: 323752 - DNA, 25 bp, Mus musculus
cagtgctcaatcaccaggtactata

SEQ ID NO: 323753 - DNA, 25 bp, Mus musculus
cagtgctcaatctccaggtactata

SEQ ID NO: 323754 - DNA, 25 bp, Mus musculus
cagtgctcaccaagaccacacagag

SEQ ID NO: 323755 - DNA, 25 bp, Mus musculus
cagtgctcaccatgaccacacagag

SEQ ID NO: 323756 - DNA, 25 bp, Mus musculus
cagtgctcacccagtgtgttaggaa

SEQ ID NO: 323757 - DNA, 25 bp, Mus musculus
cagtgctcaccctgtgtgttaggaa

SEQ ID NO: 323758 - DNA, 25 bp, Mus musculus
cagtgctcagcacggcaagcatatt

SEQ ID NO: 323759 - DNA, 25 bp, Mus musculus
cagtgctcagcagggcaagcatatt

SEQ ID NO: 323760 - DNA, 25 bp, Mus musculus
cagtgctcatgtatgacgtgtgcgc

SEQ ID NO: 323761 - DNA, 25 bp, Mus musculus
cagtgctcatgtttgacgtgtgcgc

SEQ ID NO: 323762 - DNA, 25 bp, Mus musculus
cagtgctccaagctgatcgtggtga

SEQ ID NO: 323763 - DNA, 25 bp, Mus musculus
cagtgctccaaggtgatcgtggtga

SEQ ID NO: 323764 - DNA, 25 bp, Mus musculus
cagtgctccagtagctgggcttaaa

SEQ ID NO: 323765 - DNA, 25 bp, Mus musculus
cagtgctccagttgctgggcttaaa

SEQ ID NO: 323766 - DNA, 25 bp, Mus musculus
cagtgctcccagcatgcttagcaga

SEQ ID NO: 323767 - DNA, 25 bp, Mus musculus
cagtgctcccaggatgcttagcaga

SEQ ID NO: 323768 - DNA, 25 bp, Mus musculus
cagtgctcgctgatgctgaataggc

SEQ ID NO: 323769 - DNA, 25 bp, Mus musculus
cagtgctcgctgttgctgaataggc

SEQ ID NO: 323770 - DNA, 25 bp, Mus musculus
cagtgctcggttacagtattcaact

SEQ ID NO: 323771 - DNA, 25 bp, Mus musculus
cagtgctcggtttcagtattcaact

SEQ ID NO: 323772 - DNA, 25 bp, Mus musculus
cagtgctctctcagtgtggtgttct

SEQ ID NO: 323773 - DNA, 25 bp, Mus musculus
cagtgctctctctgtgtggtgttct

SEQ ID NO: 323774 - DNA, 25 bp, Mus musculus
cagtgctctgagctttggtcccaga

SEQ ID NO: 323775 - DNA, 25 bp, Mus musculus
cagtgctctgaggtttggtcccaga

SEQ ID NO: 323776 - DNA, 25 bp, Mus musculus
cagtgctctggccaccatgtcaggt

SEQ ID NO: 323777 - DNA, 25 bp, Mus musculus
cagtgctctggcgaccatgtcaggt

SEQ ID NO: 323778 - DNA, 25 bp, Mus musculus
cagtgctctttaccataacaaagat

SEQ ID NO: 323779 - DNA, 25 bp, Mus musculus
cagtgctctttagcataacaaagat

SEQ ID NO: 323780 - DNA, 25 bp, Mus musculus
cagtgctctttcactatacttgaag

SEQ ID NO: 323781 - DNA, 25 bp, Mus musculus
cagtgctctttctctatacttgaag

SEQ ID NO: 323782 - DNA, 25 bp, Mus musculus
cagtgctgactgaatgaatggatga

SEQ ID NO: 323783 - DNA, 25 bp, Mus musculus
cagtgctgactgtatgaatggatga

SEQ ID NO: 323784 - DNA, 25 bp, Mus musculus
cagtgctgagaaatccttcaccaaa

SEQ ID NO: 323785 - DNA, 25 bp, Mus musculus
cagtgctgagaattccttcaccaaa

SEQ ID NO: 323786 - DNA, 25 bp, Mus musculus
cagtgctgagccatgtgtgctgaag

SEQ ID NO: 323787 - DNA, 25 bp, Mus musculus
cagtgctgagccttgtgtgctgaag

SEQ ID NO: 323788 - DNA, 25 bp, Mus musculus
cagtgctgatagaggccgctgcctt

SEQ ID NO: 323789 - DNA, 25 bp, Mus musculus
cagtgctgatagtggccgctgcctt

SEQ ID NO: 323790 - DNA, 25 bp, Mus musculus
cagtgctgatttaatatccctgtca

SEQ ID NO: 323791 - DNA, 25 bp, Mus musculus
cagtgctgattttatatccctgtca

SEQ ID NO: 323792 - DNA, 25 bp, Mus musculus
cagtgctgcaaacccaggtgtacac

SEQ ID NO: 323793 - DNA, 25 bp, Mus musculus
cagtgctgcaaagccaggtgtacac

SEQ ID NO: 323794 - DNA, 25 bp, Mus musculus
cagtgctgccagactaaactttagt

SEQ ID NO: 323795 - DNA, 25 bp, Mus musculus
cagtgctgccagtctaaactttagt

SEQ ID NO: 323796 - DNA, 25 bp, Mus musculus
cagtgctgcccaatcagcagaaggt

SEQ ID NO: 323797 - DNA, 25 bp, Mus musculus
cagtgctgcccattcagcagaaggt

SEQ ID NO: 323798 - DNA, 25 bp, Mus musculus
cagtgctgcggcacacagtgatgtc

SEQ ID NO: 323799 - DNA, 25 bp, Mus musculus
cagtgctgcggctcacagtgatgtc

SEQ ID NO: 323800 - DNA, 25 bp, Mus musculus
cagtgctgctatattggaatggtca

SEQ ID NO: 323801 - DNA, 25 bp, Mus musculus
cagtgctgctattttggaatggtca

SEQ ID NO: 323802 - DNA, 25 bp, Mus musculus
cagtgctgcttcatttcgttctgaa

SEQ ID NO: 323803 - DNA, 25 bp, Mus musculus
cagtgctgcttcttttcgttctgaa

SEQ ID NO: 323804 - DNA, 25 bp, Mus musculus
cagtgctggcctacagttgggtaac

SEQ ID NO: 323805 - DNA, 25 bp, Mus musculus
cagtgctggccttcagttgggtaac

SEQ ID NO: 323806 - DNA, 25 bp, Mus musculus
cagtgctgggagactgtgttgtcca

SEQ ID NO: 323807 - DNA, 25 bp, Mus musculus
cagtgctgggagtctgtgttgtcca

SEQ ID NO: 323808 - DNA, 25 bp, Mus musculus
cagtgctgggctaaccactgtgcac

SEQ ID NO: 323809 - DNA, 25 bp, Mus musculus
cagtgctgggcttaccactgtgcac

SEQ ID NO: 323810 - DNA, 25 bp, Mus musculus
cagtgctgggtacgcttctctcgtg

SEQ ID NO: 323811 - DNA, 25 bp, Mus musculus
cagtgctgggtaggcttctctcgtg

SEQ ID NO: 323812 - DNA, 25 bp, Mus musculus
cagtgctggtggcatgctctctaac

SEQ ID NO: 323813 - DNA, 25 bp, Mus musculus
cagtgctggtgggatgctctctaac

SEQ ID NO: 323814 - DNA, 25 bp, Mus musculus
cagtgctggtttaacaacttactac

SEQ ID NO: 323815 - DNA, 25 bp, Mus musculus
cagtgctggttttacaacttactac

SEQ ID NO: 323816 - DNA, 25 bp, Mus musculus
cagtgctgtaaaccctcaggacggt

SEQ ID NO: 323817 - DNA, 25 bp, Mus musculus
cagtgctgtaaagcctcaggacggt

SEQ ID NO: 323818 - DNA, 25 bp, Mus musculus
cagtgctgtcaaccctgattctaat

SEQ ID NO: 323819 - DNA, 25 bp, Mus musculus
cagtgctgtcaagcctgattctaat

SEQ ID NO: 323820 - DNA, 25 bp, Mus musculus
cagtgctgtctaatctgtagctcat

SEQ ID NO: 323821 - DNA, 25 bp, Mus musculus
cagtgctgtctattctgtagctcat

SEQ ID NO: 323822 - DNA, 25 bp, Mus musculus
cagtgctgtgcccaaaatggaagtt

SEQ ID NO: 323823 - DNA, 25 bp, Mus musculus
cagtgctgtgccgaaaatggaagtt

SEQ ID NO: 323824 - DNA, 25 bp, Mus musculus
cagtgctgtggcacagcagtctgat

SEQ ID NO: 323825 - DNA, 25 bp, Mus musculus
cagtgctgtggctcagcagtctgat

SEQ ID NO: 323826 - DNA, 25 bp, Mus musculus
cagtgctgttgtcaccttatactaa

SEQ ID NO: 323827 - DNA, 25 bp, Mus musculus
cagtgctgttgtgaccttatactaa

SEQ ID NO: 323828 - DNA, 25 bp, Mus musculus
cagtgcttaactaaggaccaagagt

SEQ ID NO: 323829 - DNA, 25 bp, Mus musculus
cagtgcttaacttaggaccaagagt

SEQ ID NO: 323830 - DNA, 25 bp, Mus musculus
cagtgcttagaacccagagtcatta

SEQ ID NO: 323831 - DNA, 25 bp, Mus musculus
cagtgcttagaagccagagtcatta

SEQ ID NO: 323832 - DNA, 25 bp, Mus musculus
cagtgcttaggtagtagcccagggt

SEQ ID NO: 323833 - DNA, 25 bp, Mus musculus
cagtgcttaggttgtagcccagggt

SEQ ID NO: 323834 - DNA, 25 bp, Mus musculus
cagtgcttcacactgttgctaatca

SEQ ID NO: 323835 - DNA, 25 bp, Mus musculus
cagtgcttcacagtgttgctaatca

SEQ ID NO: 323836 - DNA, 25 bp, Mus musculus
cagtgcttcagacaggacgcgccag

SEQ ID NO: 323837 - DNA, 25 bp, Mus musculus
cagtgcttcagacccttgggtggat

SEQ ID NO: 323838 - DNA, 25 bp, Mus musculus
cagtgcttcagagaggacgcgccag

SEQ ID NO: 323839 - DNA, 25 bp, Mus musculus
cagtgcttcagagccttgggtggat

SEQ ID NO: 323840 - DNA, 25 bp, Mus musculus
cagtgcttcatgatacatgtactat

SEQ ID NO: 323841 - DNA, 25 bp, Mus musculus
cagtgcttcatgttacatgtactat

SEQ ID NO: 323842 - DNA, 25 bp, Mus musculus
cagtgcttcgtgactcccttcagta

SEQ ID NO: 323843 - DNA, 25 bp, Mus musculus
cagtgcttcgtgtctcccttcagta

SEQ ID NO: 323844 - DNA, 25 bp, Mus musculus
cagtgcttgcaacaggactgggaca

SEQ ID NO: 323845 - DNA, 25 bp, Mus musculus
cagtgcttgcaagaggactgggaca

SEQ ID NO: 323846 - DNA, 25 bp, Mus musculus
cagtgcttgcgtatgaatttcccag

SEQ ID NO: 323847 - DNA, 25 bp, Mus musculus
cagtgcttgcgtttgaatttcccag

SEQ ID NO: 323848 - DNA, 25 bp, Mus musculus
cagtgcttggctatagtatgtgttc

SEQ ID NO: 323849 - DNA, 25 bp, Mus musculus
cagtgcttggctttagtatgtgttc

SEQ ID NO: 323850 - DNA, 25 bp, Mus musculus
cagtgcttgtctagattgttctaac

SEQ ID NO: 323851 - DNA, 25 bp, Mus musculus
cagtgcttgtcttgattgttctaac

SEQ ID NO: 323852 - DNA, 25 bp, Mus musculus
cagtgcttgtggcattggtcatctc

SEQ ID NO: 323853 - DNA, 25 bp, Mus musculus
cagtgcttgtgggattggtcatctc

SEQ ID NO: 323854 - DNA, 25 bp, Mus musculus
cagtgctttaggagattgccctggt

SEQ ID NO: 323855 - DNA, 25 bp, Mus musculus
cagtgctttaggtgattgccctggt

SEQ ID NO: 323856 - DNA, 25 bp, Mus musculus
cagtgctttattaaccagacctgcc

SEQ ID NO: 323857 - DNA, 25 bp, Mus musculus
cagtgctttatttaccagacctgcc

SEQ ID NO: 323858 - DNA, 25 bp, Mus musculus
cagtgcttttacaggcctagccatt

SEQ ID NO: 323859 - DNA, 25 bp, Mus musculus
cagtgcttttactggcctagccatt

SEQ ID NO: 323860 - DNA, 25 bp, Mus musculus
cagtgcttttcacctgtggtgtgca

SEQ ID NO: 323861 - DNA, 25 bp, Mus musculus
cagtgcttttcagctgtggtgtgca

SEQ ID NO: 323862 - DNA, 25 bp, Mus musculus
cagtggaaacggaaggcccatcgcc

SEQ ID NO: 323863 - DNA, 25 bp, Mus musculus
cagtggaaacggtaggcccatcgcc

SEQ ID NO: 323864 - DNA, 25 bp, Mus musculus
cagtggaaaggtaggcgttacggcg

SEQ ID NO: 323865 - DNA, 25 bp, Mus musculus
cagtggaaaggttggcgttacggcg

SEQ ID NO: 323866 - DNA, 25 bp, Mus musculus
cagtggaaattccacaccatgccag

SEQ ID NO: 323867 - DNA, 25 bp, Mus musculus
cagtggaaattcgacaccatgccag

SEQ ID NO: 323868 - DNA, 25 bp, Mus musculus
cagtggaacctgaggctccctgtag

SEQ ID NO: 323869 - DNA, 25 bp, Mus musculus
cagtggaacctgtggctccctgtag

SEQ ID NO: 323870 - DNA, 25 bp, Mus musculus
cagtggaagactccggcgaaagctt

SEQ ID NO: 323871 - DNA, 25 bp, Mus musculus
cagtggaagactgcggcgaaagctt

SEQ ID NO: 323872 - DNA, 25 bp, Mus musculus
cagtggaagattatggctccttacc

SEQ ID NO: 323873 - DNA, 25 bp, Mus musculus
cagtggaagattttggctccttacc

SEQ ID NO: 323874 - DNA, 25 bp, Mus musculus
cagtggaagcttcccttcttaataa

SEQ ID NO: 323875 - DNA, 25 bp, Mus musculus
cagtggaagcttgccttcttaataa

SEQ ID NO: 323876 - DNA, 25 bp, Mus musculus
cagtggaaggatcctggcataccct

SEQ ID NO: 323877 - DNA, 25 bp, Mus musculus
cagtggaaggatgctggcataccct

SEQ ID NO: 323878 - DNA, 25 bp, Mus musculus
cagtggaagtgacgccacagtgcta

SEQ ID NO: 323879 - DNA, 25 bp, Mus musculus
cagtggaagtgaggccacagtgcta

SEQ ID NO: 323880 - DNA, 25 bp, Mus musculus
cagtggacacacatcacatctcaaa

SEQ ID NO: 323881 - DNA, 25 bp, Mus musculus
cagtggacacacttcacatctcaaa

SEQ ID NO: 323882 - DNA, 25 bp, Mus musculus
cagtggacacttctgtggagttgca

SEQ ID NO: 323883 - DNA, 25 bp, Mus musculus
cagtggacacttgtgtggagttgca

SEQ ID NO: 323884 - DNA, 25 bp, Mus musculus
cagtggacatgcctggtgaacccat

SEQ ID NO: 323885 - DNA, 25 bp, Mus musculus
cagtggacatgcgtggtgaacccat

SEQ ID NO: 323886 - DNA, 25 bp, Mus musculus
cagtggaccagcacccaaggaataa

SEQ ID NO: 323887 - DNA, 25 bp, Mus musculus
cagtggaccagctcccaaggaataa

SEQ ID NO: 323888 - DNA, 25 bp, Mus musculus
cagtggaccatcagtgccaacccgt

SEQ ID NO: 323889 - DNA, 25 bp, Mus musculus
cagtggaccatctgtgccaacccgt

SEQ ID NO: 323890 - DNA, 25 bp, Mus musculus
cagtggaccccaagggaacccaggt

SEQ ID NO: 323891 - DNA, 25 bp, Mus musculus
cagtggaccccatgggaacccaggt

SEQ ID NO: 323892 - DNA, 25 bp, Mus musculus
cagtggaccgtgaacgtgagcgcct

SEQ ID NO: 323893 - DNA, 25 bp, Mus musculus
cagtggaccgtgtacgtgagcgcct

SEQ ID NO: 323894 - DNA, 25 bp, Mus musculus
cagtggacctctatgtacagctaca

SEQ ID NO: 323895 - DNA, 25 bp, Mus musculus
cagtggacctctttgtacagctaca

SEQ ID NO: 323896 - DNA, 25 bp, Mus musculus
cagtggacgtttacattaaatgttc

SEQ ID NO: 323897 - DNA, 25 bp, Mus musculus
cagtggacgttttcattaaatgttc

SEQ ID NO: 323898 - DNA, 25 bp, Mus musculus
cagtggactgacaccctggacggcc

SEQ ID NO: 323899 - DNA, 25 bp, Mus musculus
cagtggactgactccctggacggcc

SEQ ID NO: 323900 - DNA, 25 bp, Mus musculus
cagtggagacctatttgctctttta

SEQ ID NO: 323901 - DNA, 25 bp, Mus musculus
cagtggagacctttttgctctttta

SEQ ID NO: 323902 - DNA, 25 bp, Mus musculus
cagtggagccttcacatggtcctgg

SEQ ID NO: 323903 - DNA, 25 bp, Mus musculus
cagtggagccttgacatggtcctgg

SEQ ID NO: 323904 - DNA, 25 bp, Mus musculus
cagtggaggaagctttgtcttaaac

SEQ ID NO: 323905 - DNA, 25 bp, Mus musculus
cagtggaggaaggtttgtcttaaac

SEQ ID NO: 323906 - DNA, 25 bp, Mus musculus
cagtggaggccgactttcaggagca

SEQ ID NO: 323907 - DNA, 25 bp, Mus musculus
cagtggaggccgtctttcaggagca

SEQ ID NO: 323908 - DNA, 25 bp, Mus musculus
cagtggagtccacggtatggcctct

SEQ ID NO: 323909 - DNA, 25 bp, Mus musculus
cagtggagtccagggtatggcctct

SEQ ID NO: 323910 - DNA, 25 bp, Mus musculus
cagtggagtcttcgccctccggaac

SEQ ID NO: 323911 - DNA, 25 bp, Mus musculus
cagtggagtcttggccctccggaac

SEQ ID NO: 323912 - DNA, 25 bp, Mus musculus
cagtggagtgcccagctagttaaga

SEQ ID NO: 323913 - DNA, 25 bp, Mus musculus
cagtggagtgccgagctagttaaga

SEQ ID NO: 323914 - DNA, 25 bp, Mus musculus
cagtggagtgttacctatccccggt

SEQ ID NO: 323915 - DNA, 25 bp, Mus musculus
cagtggagtgtttcctatccccggt

SEQ ID NO: 323916 - DNA, 25 bp, Mus musculus
cagtggagtttcatgtgctggacaa

SEQ ID NO: 323917 - DNA, 25 bp, Mus musculus
cagtggagtttcttgtgctggacaa

SEQ ID NO: 323918 - DNA, 25 bp, Mus musculus
cagtggatatagctttttgtgtaat

SEQ ID NO: 323919 - DNA, 25 bp, Mus musculus
cagtggatataggtttttgtgtaat

SEQ ID NO: 323920 - DNA, 25 bp, Mus musculus
cagtggatcaagaattagttcattc

SEQ ID NO: 323921 - DNA, 25 bp, Mus musculus
cagtggatcaagtattagttcattc

SEQ ID NO: 323922 - DNA, 25 bp, Mus musculus
cagtggatccagagaaccgtgcttc

SEQ ID NO: 323923 - DNA, 25 bp, Mus musculus
cagtggatccagtgaaccgtgcttc

SEQ ID NO: 323924 - DNA, 25 bp, Mus musculus
cagtggatcctacctgaagtagtca

SEQ ID NO: 323925 - DNA, 25 bp, Mus musculus
cagtggatcctagctgaagtagtca

SEQ ID NO: 323926 - DNA, 25 bp, Mus musculus
cagtggatcgagctccgacagcagt

SEQ ID NO: 323927 - DNA, 25 bp, Mus musculus
cagtggatcgaggtccgacagcagt

SEQ ID NO: 323928 - DNA, 25 bp, Mus musculus
cagtggatctgaaccggcactgctc

SEQ ID NO: 323929 - DNA, 25 bp, Mus musculus
cagtggatctgatccggcactgctc

SEQ ID NO: 323930 - DNA, 25 bp, Mus musculus
cagtggatctgtctgacgacgtctt

SEQ ID NO: 323931 - DNA, 25 bp, Mus musculus
cagtggatctgtgtgacgacgtctt

SEQ ID NO: 323932 - DNA, 25 bp, Mus musculus
cagtggatgcctcttttgtgaaagc

SEQ ID NO: 323933 - DNA, 25 bp, Mus musculus
cagtggatgcctgttttgtgaaagc

SEQ ID NO: 323934 - DNA, 25 bp, Mus musculus
cagtggatgcttctgttgcagctta

SEQ ID NO: 323935 - DNA, 25 bp, Mus musculus
cagtggatgcttgtgttgcagctta

SEQ ID NO: 323936 - DNA, 25 bp, Mus musculus
cagtggatggtaccttgcctttgca

SEQ ID NO: 323937 - DNA, 25 bp, Mus musculus
cagtggatggtagcttgcctttgca

SEQ ID NO: 323938 - DNA, 25 bp, Mus musculus
cagtggatgtgaatgcttcaagttt

SEQ ID NO: 323939 - DNA, 25 bp, Mus musculus
cagtggatgtgattgcttcaagttt

SEQ ID NO: 323940 - DNA, 25 bp, Mus musculus
cagtggattatgacacaaccaaatt

SEQ ID NO: 323941 - DNA, 25 bp, Mus musculus
cagtggattatgtcacaaccaaatt

SEQ ID NO: 323942 - DNA, 25 bp, Mus musculus
cagtggattcaaactctttctgagg

SEQ ID NO: 323943 - DNA, 25 bp, Mus musculus
cagtggattcaatctctttctgagg

SEQ ID NO: 323944 - DNA, 25 bp, Mus musculus
cagtggattctgaacatcagggaat

SEQ ID NO: 323945 - DNA, 25 bp, Mus musculus
cagtggattctgtacatcagggaat

SEQ ID NO: 323946 - DNA, 25 bp, Mus musculus
cagtggcaaaggagaccgacctcca

SEQ ID NO: 323947 - DNA, 25 bp, Mus musculus
cagtggcaaaggtgaccgacctcca

SEQ ID NO: 323948 - DNA, 25 bp, Mus musculus
cagtggcaaagtacttacctaacat

SEQ ID NO: 323949 - DNA, 25 bp, Mus musculus
cagtggcaaagttcttacctaacat

SEQ ID NO: 323950 - DNA, 25 bp, Mus musculus
cagtggcaaccaagagctcttgtat

SEQ ID NO: 323951 - DNA, 25 bp, Mus musculus
cagtggcaaccatgagctcttgtat

SEQ ID NO: 323952 - DNA, 25 bp, Mus musculus
cagtggcaacccaacaagcagtata

SEQ ID NO: 323953 - DNA, 25 bp, Mus musculus
cagtggcaaccctacaagcagtata

SEQ ID NO: 323954 - DNA, 25 bp, Mus musculus
cagtggcaccacatctcaaaattac

SEQ ID NO: 323955 - DNA, 25 bp, Mus musculus
cagtggcaccacttctcaaaattac

SEQ ID NO: 323956 - DNA, 25 bp, Mus musculus
cagtggcacctcactgaagttgtat

SEQ ID NO: 323957 - DNA, 25 bp, Mus musculus
cagtggcacctcagccttgttccta

SEQ ID NO: 323958 - DNA, 25 bp, Mus musculus
cagtggcacctctctgaagttgtat

SEQ ID NO: 323959 - DNA, 25 bp, Mus musculus
cagtggcacctctgccttgttccta

SEQ ID NO: 323960 - DNA, 25 bp, Mus musculus
cagtggcacctgctaacctgaaagg

SEQ ID NO: 323961 - DNA, 25 bp, Mus musculus
cagtggcacctggtaacctgaaagg

SEQ ID NO: 323962 - DNA, 25 bp, Mus musculus
cagtggcagctcattgggacccaag

SEQ ID NO: 323963 - DNA, 25 bp, Mus musculus
cagtggcagctctttgggacccaag

SEQ ID NO: 323964 - DNA, 25 bp, Mus musculus
cagtggcaggaacctagtggtccct

SEQ ID NO: 323965 - DNA, 25 bp, Mus musculus
cagtggcaggaagctagtggtccct

SEQ ID NO: 323966 - DNA, 25 bp, Mus musculus
cagtggcaggccagtggtcaactta

SEQ ID NO: 323967 - DNA, 25 bp, Mus musculus
cagtggcaggcctgtggtcaactta

SEQ ID NO: 323968 - DNA, 25 bp, Mus musculus
cagtggcagtttagtggcgctttga

SEQ ID NO: 323969 - DNA, 25 bp, Mus musculus
cagtggcagttttgtggcgctttga

SEQ ID NO: 323970 - DNA, 25 bp, Mus musculus
cagtggcatggcactatctatattc

SEQ ID NO: 323971 - DNA, 25 bp, Mus musculus
cagtggcatggctctatctatattc

SEQ ID NO: 323972 - DNA, 25 bp, Mus musculus
cagtggcatggtcggatttgatctt

SEQ ID NO: 323973 - DNA, 25 bp, Mus musculus
cagtggcatggtgggatttgatctt

SEQ ID NO: 323974 - DNA, 25 bp, Mus musculus
cagtggcattcaacataggcaaaaa

SEQ ID NO: 323975 - DNA, 25 bp, Mus musculus
cagtggcattcatcataggcaaaaa

SEQ ID NO: 323976 - DNA, 25 bp, Mus musculus
cagtggccaacaagaccgtggagga

SEQ ID NO: 323977 - DNA, 25 bp, Mus musculus
cagtggccaacatgaccgtggagga

SEQ ID NO: 323978 - DNA, 25 bp, Mus musculus
cagtggccacatatagttacttcaa

SEQ ID NO: 323979 - DNA, 25 bp, Mus musculus
cagtggccacatttagttacttcaa

SEQ ID NO: 323980 - DNA, 25 bp, Mus musculus
cagtggccagagcatgcgtgcaata

SEQ ID NO: 323981 - DNA, 25 bp, Mus musculus
cagtggccagaggatgcgtgcaata

SEQ ID NO: 323982 - DNA, 25 bp, Mus musculus
cagtggccaggaagaaaactgcccc

SEQ ID NO: 323983 - DNA, 25 bp, Mus musculus
cagtggccaggatgaaaactgcccc

SEQ ID NO: 323984 - DNA, 25 bp, Mus musculus
cagtggccagtaccccaaagggaaa

SEQ ID NO: 323985 - DNA, 25 bp, Mus musculus
cagtggccagtagcccaaagggaaa

SEQ ID NO: 323986 - DNA, 25 bp, Mus musculus
cagtggccccagaagactagtacaa

SEQ ID NO: 323987 - DNA, 25 bp, Mus musculus
cagtggccccagtagactagtacaa

SEQ ID NO: 323988 - DNA, 25 bp, Mus musculus
cagtggccgggacagtggcgaggac

SEQ ID NO: 323989 - DNA, 25 bp, Mus musculus
cagtggccgggagagtggcgaggac

SEQ ID NO: 323990 - DNA, 25 bp, Mus musculus
cagtggcctacgctggctccagctg

SEQ ID NO: 323991 - DNA, 25 bp, Mus musculus
cagtggcctacggtggctccagctg

SEQ ID NO: 323992 - DNA, 25 bp, Mus musculus
cagtggcctataccttggtacctaa

SEQ ID NO: 323993 - DNA, 25 bp, Mus musculus
cagtggcctatagcttggtacctaa

SEQ ID NO: 323994 - DNA, 25 bp, Mus musculus
cagtggcctgtcagctcagcatcct

SEQ ID NO: 323995 - DNA, 25 bp, Mus musculus
cagtggcctgtctgctcagcatcct

SEQ ID NO: 323996 - DNA, 25 bp, Mus musculus
cagtggcgcctgataaaaatttgac

SEQ ID NO: 323997 - DNA, 25 bp, Mus musculus
cagtggcgcctgttaaaaatttgac

SEQ ID NO: 323998 - DNA, 25 bp, Mus musculus
cagtggcgtccacaaaggaattcca

SEQ ID NO: 323999 - DNA, 25 bp, Mus musculus
cagtggcgtccagaaaggaattcca

SEQ ID NO: 324000 - DNA, 25 bp, Mus musculus
cagtggctaagacaattggctgttc

SEQ ID NO: 324001 - DNA, 25 bp, Mus musculus
cagtggctaagagaattggctgttc

SEQ ID NO: 324002 - DNA, 25 bp, Mus musculus
cagtggctacctagtcacaactaga

SEQ ID NO: 324003 - DNA, 25 bp, Mus musculus
cagtggctaccttgtcacaactaga

SEQ ID NO: 324004 - DNA, 25 bp, Mus musculus
cagtggctacgacacacaagctgtt

SEQ ID NO: 324005 - DNA, 25 bp, Mus musculus
cagtggctacgagacacaagctgtt

SEQ ID NO: 324006 - DNA, 25 bp, Mus musculus
cagtggctactcctcaagcttcaaa

SEQ ID NO: 324007 - DNA, 25 bp, Mus musculus
cagtggctactcgtcaagcttcaaa

SEQ ID NO: 324008 - DNA, 25 bp, Mus musculus
cagtggctagtgacaggttataata

SEQ ID NO: 324009 - DNA, 25 bp, Mus musculus
cagtggctagtgtcaggttataata

SEQ ID NO: 324010 - DNA, 25 bp, Mus musculus
cagtggctcacacagtaaagctggt

SEQ ID NO: 324011 - DNA, 25 bp, Mus musculus
cagtggctcacagagtaaagctggt

SEQ ID NO: 324012 - DNA, 25 bp, Mus musculus
cagtggctcatgctcttgtccttta

SEQ ID NO: 324013 - DNA, 25 bp, Mus musculus
cagtggctcatggtcttgtccttta

SEQ ID NO: 324014 - DNA, 25 bp, Mus musculus
cagtggctccatccagtgtccatag

SEQ ID NO: 324015 - DNA, 25 bp, Mus musculus
cagtggctccatgcagtgtccatag

SEQ ID NO: 324016 - DNA, 25 bp, Mus musculus
cagtggctgcacatttgagaatcag

SEQ ID NO: 324017 - DNA, 25 bp, Mus musculus
cagtggctgcacttttgagaatcag

SEQ ID NO: 324018 - DNA, 25 bp, Mus musculus
cagtggctgcttatgagggacgcac

SEQ ID NO: 324019 - DNA, 25 bp, Mus musculus
cagtggctgcttttgagggacgcac

SEQ ID NO: 324020 - DNA, 25 bp, Mus musculus
cagtggctggagacgcttgtaaagc

SEQ ID NO: 324021 - DNA, 25 bp, Mus musculus
cagtggctggagtcgcttgtaaagc

SEQ ID NO: 324022 - DNA, 25 bp, Mus musculus
cagtggcttatacccatccacagct

SEQ ID NO: 324023 - DNA, 25 bp, Mus musculus
cagtggcttatagccatccacagct

SEQ ID NO: 324024 - DNA, 25 bp, Mus musculus
cagtggcttcccattagataagatt

SEQ ID NO: 324025 - DNA, 25 bp, Mus musculus
cagtggcttccctttagataagatt

SEQ ID NO: 324026 - DNA, 25 bp, Mus musculus
cagtggcttcggctcatgacacaga

SEQ ID NO: 324027 - DNA, 25 bp, Mus musculus
cagtggcttcgggtcatgacacaga

SEQ ID NO: 324028 - DNA, 25 bp, Mus musculus
cagtggcttctgatttcaccgtaca

SEQ ID NO: 324029 - DNA, 25 bp, Mus musculus
cagtggcttctgttttcaccgtaca

SEQ ID NO: 324030 - DNA, 25 bp, Mus musculus
cagtggcttgcgcttgttcagatat

SEQ ID NO: 324031 - DNA, 25 bp, Mus musculus
cagtggcttgcggttgttcagatat

SEQ ID NO: 324032 - DNA, 25 bp, Mus musculus
cagtggctttctaagagactttttt

SEQ ID NO: 324033 - DNA, 25 bp, Mus musculus
cagtggctttcttagagactttttt

SEQ ID NO: 324034 - DNA, 25 bp, Mus musculus
cagtggctttgaatatggcttcaaa

SEQ ID NO: 324035 - DNA, 25 bp, Mus musculus
cagtggctttgaatgaaatccagtt

SEQ ID NO: 324036 - DNA, 25 bp, Mus musculus
cagtggctttgattatggcttcaaa

SEQ ID NO: 324037 - DNA, 25 bp, Mus musculus
cagtggctttgattgaaatccagtt

SEQ ID NO: 324038 - DNA, 25 bp, Mus musculus
cagtgggaaactcttctgaagcctc

SEQ ID NO: 324039 - DNA, 25 bp, Mus musculus
cagtgggaaactgttctgaagcctc

SEQ ID NO: 324040 - DNA, 25 bp, Mus musculus
cagtgggaaatgacacgcggctgca

SEQ ID NO: 324041 - DNA, 25 bp, Mus musculus
cagtgggaaatgtcacgcggctgca

SEQ ID NO: 324042 - DNA, 25 bp, Mus musculus
cagtgggaagccagtatcgggacat

SEQ ID NO: 324043 - DNA, 25 bp, Mus musculus
cagtgggaagcctgtatcgggacat

SEQ ID NO: 324044 - DNA, 25 bp, Mus musculus
cagtgggaaggtagactacccctca

SEQ ID NO: 324045 - DNA, 25 bp, Mus musculus
cagtgggaaggttgactacccctca

SEQ ID NO: 324046 - DNA, 25 bp, Mus musculus
cagtgggaagtgatccttaaccata

SEQ ID NO: 324047 - DNA, 25 bp, Mus musculus
cagtgggaagtgttccttaaccata

SEQ ID NO: 324048 - DNA, 25 bp, Mus musculus
cagtgggaatgcaaatttctttaac

SEQ ID NO: 324049 - DNA, 25 bp, Mus musculus
cagtgggaatgctaatttctttaac

SEQ ID NO: 324050 - DNA, 25 bp, Mus musculus
cagtgggacattccgctgctcaatc

SEQ ID NO: 324051 - DNA, 25 bp, Mus musculus
cagtgggacattgcgctgctcaatc

SEQ ID NO: 324052 - DNA, 25 bp, Mus musculus
cagtgggacggacgttttctacagt

SEQ ID NO: 324053 - DNA, 25 bp, Mus musculus
cagtgggacggaggttttctacagt

SEQ ID NO: 324054 - DNA, 25 bp, Mus musculus
cagtgggactgtcgctgttgtctta

SEQ ID NO: 324055 - DNA, 25 bp, Mus musculus
cagtgggactgtggctgttgtctta

SEQ ID NO: 324056 - DNA, 25 bp, Mus musculus
cagtgggagagacaaagaaaatact

SEQ ID NO: 324057 - DNA, 25 bp, Mus musculus
cagtgggagagagaaagaaaatact

SEQ ID NO: 324058 - DNA, 25 bp, Mus musculus
cagtgggagcgtctagagaccatct

SEQ ID NO: 324059 - DNA, 25 bp, Mus musculus
cagtgggagcgtgtagagaccatct

SEQ ID NO: 324060 - DNA, 25 bp, Mus musculus
cagtgggagggcaccgacgcacacc

SEQ ID NO: 324061 - DNA, 25 bp, Mus musculus
cagtgggagggctccgacgcacacc

SEQ ID NO: 324062 - DNA, 25 bp, Mus musculus
cagtgggagtcccttgcatttcagt

SEQ ID NO: 324063 - DNA, 25 bp, Mus musculus
cagtgggagtccgttgcatttcagt

SEQ ID NO: 324064 - DNA, 25 bp, Mus musculus
cagtgggagtttagtctgtactttt

SEQ ID NO: 324065 - DNA, 25 bp, Mus musculus
cagtgggagttttgtctgtactttt

SEQ ID NO: 324066 - DNA, 25 bp, Mus musculus
cagtgggataagcttctccgaagtc

SEQ ID NO: 324067 - DNA, 25 bp, Mus musculus
cagtgggataaggttctccgaagtc

SEQ ID NO: 324068 - DNA, 25 bp, Mus musculus
cagtgggatatgagtctgccctggt

SEQ ID NO: 324069 - DNA, 25 bp, Mus musculus
cagtgggatatgtgtctgccctggt

SEQ ID NO: 324070 - DNA, 25 bp, Mus musculus
cagtgggatcttagggttgttgctt

SEQ ID NO: 324071 - DNA, 25 bp, Mus musculus
cagtgggatctttgggttgttgctt

SEQ ID NO: 324072 - DNA, 25 bp, Mus musculus
cagtgggattccatcgagtctgaat

SEQ ID NO: 324073 - DNA, 25 bp, Mus musculus
cagtgggattccttcgagtctgaat

SEQ ID NO: 324074 - DNA, 25 bp, Mus musculus
cagtgggattttctgcacaggaacc

SEQ ID NO: 324075 - DNA, 25 bp, Mus musculus
cagtgggattttgtgcacaggaacc

SEQ ID NO: 324076 - DNA, 25 bp, Mus musculus
cagtgggcacctcgagtggaacata

SEQ ID NO: 324077 - DNA, 25 bp, Mus musculus
cagtgggcacctggagtggaacata

SEQ ID NO: 324078 - DNA, 25 bp, Mus musculus
cagtgggcagatcgcttgctcacct

SEQ ID NO: 324079 - DNA, 25 bp, Mus musculus
cagtgggcagatggcttgctcacct

SEQ ID NO: 324080 - DNA, 25 bp, Mus musculus
cagtgggcagtgatggcattactct

SEQ ID NO: 324081 - DNA, 25 bp, Mus musculus
cagtgggcagtgttggcattactct

SEQ ID NO: 324082 - DNA, 25 bp, Mus musculus
cagtgggcatggctgtccaaaagaa

SEQ ID NO: 324083 - DNA, 25 bp, Mus musculus
cagtgggcatgggtgtccaaaagaa

SEQ ID NO: 324084 - DNA, 25 bp, Mus musculus
cagtgggccaacctgatctggataa

SEQ ID NO: 324085 - DNA, 25 bp, Mus musculus
cagtgggccaacgtgatctggataa

SEQ ID NO: 324086 - DNA, 25 bp, Mus musculus
cagtgggctggcagcagatcttcca

SEQ ID NO: 324087 - DNA, 25 bp, Mus musculus
cagtgggctggctgcagatcttcca

SEQ ID NO: 324088 - DNA, 25 bp, Mus musculus
cagtgggtaagaccacccgactgct

SEQ ID NO: 324089 - DNA, 25 bp, Mus musculus
cagtgggtaagagcacccgactgct

SEQ ID NO: 324090 - DNA, 25 bp, Mus musculus
cagtgggtattcaagactcctgttc

SEQ ID NO: 324091 - DNA, 25 bp, Mus musculus
cagtgggtattctagactcctgttc

SEQ ID NO: 324092 - DNA, 25 bp, Mus musculus
cagtgggtcaggattgccctgagtt

SEQ ID NO: 324093 - DNA, 25 bp, Mus musculus
cagtgggtcaggtttgccctgagtt

SEQ ID NO: 324094 - DNA, 25 bp, Mus musculus
cagtgggtcctgcccgtgaagaaaa

SEQ ID NO: 324095 - DNA, 25 bp, Mus musculus
cagtgggtcctggccgtgaagaaaa

SEQ ID NO: 324096 - DNA, 25 bp, Mus musculus
cagtgggtcgctcatgctagtcaca

SEQ ID NO: 324097 - DNA, 25 bp, Mus musculus
cagtgggtcgctgatgctagtcaca

SEQ ID NO: 324098 - DNA, 25 bp, Mus musculus
cagtgggtctcaacgaatgcctgtt

SEQ ID NO: 324099 - DNA, 25 bp, Mus musculus
cagtgggtctcatcgaatgcctgtt

SEQ ID NO: 324100 - DNA, 25 bp, Mus musculus
cagtgggtctgtcgcgtccacctgc

SEQ ID NO: 324101 - DNA, 25 bp, Mus musculus
cagtgggtctgtctgttcaggttca

SEQ ID NO: 324102 - DNA, 25 bp, Mus musculus
cagtgggtctgtggcgtccacctgc

SEQ ID NO: 324103 - DNA, 25 bp, Mus musculus
cagtgggtctgtgtgttcaggttca

SEQ ID NO: 324104 - DNA, 25 bp, Mus musculus
cagtgggtgactagcattgtgtagc

SEQ ID NO: 324105 - DNA, 25 bp, Mus musculus
cagtgggtgacttgcattgtgtagc

SEQ ID NO: 324106 - DNA, 25 bp, Mus musculus
cagtgggtggacaagacgccattta

SEQ ID NO: 324107 - DNA, 25 bp, Mus musculus
cagtgggtggactagacgccattta

SEQ ID NO: 324108 - DNA, 25 bp, Mus musculus
cagtgggtggctagtcacctacaaa

SEQ ID NO: 324109 - DNA, 25 bp, Mus musculus
cagtgggtggcttgtcacctacaaa

SEQ ID NO: 324110 - DNA, 25 bp, Mus musculus
cagtgggtggttactgtgtcagcta

SEQ ID NO: 324111 - DNA, 25 bp, Mus musculus
cagtgggtggtttctgtgtcagcta

SEQ ID NO: 324112 - DNA, 25 bp, Mus musculus
cagtgggttaatacagcggttgtac

SEQ ID NO: 324113 - DNA, 25 bp, Mus musculus
cagtgggttaattcagcggttgtac

SEQ ID NO: 324114 - DNA, 25 bp, Mus musculus
cagtgggttcagaccagatagcccc

SEQ ID NO: 324115 - DNA, 25 bp, Mus musculus
cagtgggttcagtccagatagcccc

SEQ ID NO: 324116 - DNA, 25 bp, Mus musculus
cagtgggttgacacggatgatgcca

SEQ ID NO: 324117 - DNA, 25 bp, Mus musculus
cagtgggttgactcggatgatgcca

SEQ ID NO: 324118 - DNA, 25 bp, Mus musculus
cagtgggttgtacccagctggtact

SEQ ID NO: 324119 - DNA, 25 bp, Mus musculus
cagtgggttgtagccagctggtact

SEQ ID NO: 324120 - DNA, 25 bp, Mus musculus
cagtgggtttatcgtgactctccta

SEQ ID NO: 324121 - DNA, 25 bp, Mus musculus
cagtgggtttatggtgactctccta

SEQ ID NO: 324122 - DNA, 25 bp, Mus musculus
cagtgggtttctctttagcttccaa

SEQ ID NO: 324123 - DNA, 25 bp, Mus musculus
cagtgggtttctgtttagcttccaa

SEQ ID NO: 324124 - DNA, 25 bp, Mus musculus
cagtggtaaagcatggtagatagaa

SEQ ID NO: 324125 - DNA, 25 bp, Mus musculus
cagtggtaaagcttggtagatagaa

SEQ ID NO: 324126 - DNA, 25 bp, Mus musculus
cagtggtaaagtacaggcctagcgt

SEQ ID NO: 324127 - DNA, 25 bp, Mus musculus
cagtggtaaagttcaggcctagcgt

SEQ ID NO: 324128 - DNA, 25 bp, Mus musculus
cagtggtacagaaggtgtgtgctat

SEQ ID NO: 324129 - DNA, 25 bp, Mus musculus
cagtggtacagatggtgtgtgctat

SEQ ID NO: 324130 - DNA, 25 bp, Mus musculus
cagtggtacatcagaaattatgcag

SEQ ID NO: 324131 - DNA, 25 bp, Mus musculus
cagtggtacatctgaaattatgcag

SEQ ID NO: 324132 - DNA, 25 bp, Mus musculus
cagtggtacattactgtagccctgg

SEQ ID NO: 324133 - DNA, 25 bp, Mus musculus
cagtggtacatttctgtagccctgg

SEQ ID NO: 324134 - DNA, 25 bp, Mus musculus
cagtggtactcaatgcatatgtgct

SEQ ID NO: 324135 - DNA, 25 bp, Mus musculus
cagtggtactcattgcatatgtgct

SEQ ID NO: 324136 - DNA, 25 bp, Mus musculus
cagtggtactgcatgaagaaatcct

SEQ ID NO: 324137 - DNA, 25 bp, Mus musculus
cagtggtactgcttgaagaaatcct

SEQ ID NO: 324138 - DNA, 25 bp, Mus musculus
cagtggtagaccaaaccagatcatc

SEQ ID NO: 324139 - DNA, 25 bp, Mus musculus
cagtggtagacctaaccagatcatc

SEQ ID NO: 324140 - DNA, 25 bp, Mus musculus
cagtggtagtgtatccttatcatta

SEQ ID NO: 324141 - DNA, 25 bp, Mus musculus
cagtggtagtgtttccttatcatta

SEQ ID NO: 324142 - DNA, 25 bp, Mus musculus
cagtggtagttcatgggtggtcaac

SEQ ID NO: 324143 - DNA, 25 bp, Mus musculus
cagtggtagttcttgggtggtcaac

SEQ ID NO: 324144 - DNA, 25 bp, Mus musculus
cagtggtatccaccaagccttagta

SEQ ID NO: 324145 - DNA, 25 bp, Mus musculus
cagtggtatccagcaagccttagta

SEQ ID NO: 324146 - DNA, 25 bp, Mus musculus
cagtggtatcttaggcagtgcctca

SEQ ID NO: 324147 - DNA, 25 bp, Mus musculus
cagtggtatctttggcagtgcctca

SEQ ID NO: 324148 - DNA, 25 bp, Mus musculus
cagtggtatgctccagaggttctct

SEQ ID NO: 324149 - DNA, 25 bp, Mus musculus
cagtggtatgctgcagaggttctct

SEQ ID NO: 324150 - DNA, 25 bp, Mus musculus
cagtggtatgggacactcctcaagt

SEQ ID NO: 324151 - DNA, 25 bp, Mus musculus
cagtggtatgggtcactcctcaagt

SEQ ID NO: 324152 - DNA, 25 bp, Mus musculus
cagtggtattccatcaggagctata

SEQ ID NO: 324153 - DNA, 25 bp, Mus musculus
cagtggtattcccaggctcagctga

SEQ ID NO: 324154 - DNA, 25 bp, Mus musculus
cagtggtattccgaggctcagctga

SEQ ID NO: 324155 - DNA, 25 bp, Mus musculus
cagtggtattccttcaggagctata

SEQ ID NO: 324156 - DNA, 25 bp, Mus musculus
cagtggtcatctcgcatcttagaca

SEQ ID NO: 324157 - DNA, 25 bp, Mus musculus
cagtggtcatctggcatcttagaca

SEQ ID NO: 324158 - DNA, 25 bp, Mus musculus
cagtggtcattgagtgccgtaggca

SEQ ID NO: 324159 - DNA, 25 bp, Mus musculus
cagtggtcattgtgtgccgtaggca

SEQ ID NO: 324160 - DNA, 25 bp, Mus musculus
cagtggtcatttcctcataagtgtt

SEQ ID NO: 324161 - DNA, 25 bp, Mus musculus
cagtggtcatttgctcataagtgtt

SEQ ID NO: 324162 - DNA, 25 bp, Mus musculus
cagtggtccaagctagtttctcgaa

SEQ ID NO: 324163 - DNA, 25 bp, Mus musculus
cagtggtccaaggtagtttctcgaa

SEQ ID NO: 324164 - DNA, 25 bp, Mus musculus
cagtggtcccttcaggctcagctta

SEQ ID NO: 324165 - DNA, 25 bp, Mus musculus
cagtggtcccttgaggctcagctta

SEQ ID NO: 324166 - DNA, 25 bp, Mus musculus
cagtggtcctgaagtgtcccagata

SEQ ID NO: 324167 - DNA, 25 bp, Mus musculus
cagtggtcctgatgtgtcccagata

SEQ ID NO: 324168 - DNA, 25 bp, Mus musculus
cagtggtcgcttcctgtccttagag

SEQ ID NO: 324169 - DNA, 25 bp, Mus musculus
cagtggtcgcttgctgtccttagag

SEQ ID NO: 324170 - DNA, 25 bp, Mus musculus
cagtggtctcttaagcttctgaaga

SEQ ID NO: 324171 - DNA, 25 bp, Mus musculus
cagtggtctcttcgcaacggcatcc

SEQ ID NO: 324172 - DNA, 25 bp, Mus musculus
cagtggtctcttggcaacggcatcc

SEQ ID NO: 324173 - DNA, 25 bp, Mus musculus
cagtggtctctttagcttctgaaga

SEQ ID NO: 324174 - DNA, 25 bp, Mus musculus
cagtggtctgggattcatgttcctt

SEQ ID NO: 324175 - DNA, 25 bp, Mus musculus
cagtggtctgggtttcatgttcctt

SEQ ID NO: 324176 - DNA, 25 bp, Mus musculus
cagtggtcttgcactctttgttcaa

SEQ ID NO: 324177 - DNA, 25 bp, Mus musculus
cagtggtcttgccaggctgtgcaaa

SEQ ID NO: 324178 - DNA, 25 bp, Mus musculus
cagtggtcttgcgaggctgtgcaaa

SEQ ID NO: 324179 - DNA, 25 bp, Mus musculus
cagtggtcttgctctctttgttcaa

SEQ ID NO: 324180 - DNA, 25 bp, Mus musculus
cagtggtgctgaatctttgaaaata

SEQ ID NO: 324181 - DNA, 25 bp, Mus musculus
cagtggtgctgattctttgaaaata

SEQ ID NO: 324182 - DNA, 25 bp, Mus musculus
cagtggtggataagcagtttgtcaa

SEQ ID NO: 324183 - DNA, 25 bp, Mus musculus
cagtggtggatatgcagtttgtcaa

SEQ ID NO: 324184 - DNA, 25 bp, Mus musculus
cagtggtgggagctcttgtccttcc

SEQ ID NO: 324185 - DNA, 25 bp, Mus musculus
cagtggtgggaggtcttgtccttcc

SEQ ID NO: 324186 - DNA, 25 bp, Mus musculus
cagtggtgtcgtctacgcttagtgt

SEQ ID NO: 324187 - DNA, 25 bp, Mus musculus
cagtggtgtcgtgtacgcttagtgt

SEQ ID NO: 324188 - DNA, 25 bp, Mus musculus
cagtggtgtggaccccataacaaac

SEQ ID NO: 324189 - DNA, 25 bp, Mus musculus
cagtggtgtggagcccataacaaac

SEQ ID NO: 324190 - DNA, 25 bp, Mus musculus
cagtggtgtgtcatcatctgttaca

SEQ ID NO: 324191 - DNA, 25 bp, Mus musculus
cagtggtgtgtcttcatctgttaca

SEQ ID NO: 324192 - DNA, 25 bp, Mus musculus
cagtggttaacactgcttgcggctc

SEQ ID NO: 324193 - DNA, 25 bp, Mus musculus
cagtggttaacagtgcttgcggctc

SEQ ID NO: 324194 - DNA, 25 bp, Mus musculus
cagtggttaagaatgcttccttttt

SEQ ID NO: 324195 - DNA, 25 bp, Mus musculus
cagtggttaagacggctccagctac

SEQ ID NO: 324196 - DNA, 25 bp, Mus musculus
cagtggttaagagggctccagctac

SEQ ID NO: 324197 - DNA, 25 bp, Mus musculus
cagtggttaagattgcttccttttt

SEQ ID NO: 324198 - DNA, 25 bp, Mus musculus
cagtggttacgtcgtgaagctgttc

SEQ ID NO: 324199 - DNA, 25 bp, Mus musculus
cagtggttacgtggtgaagctgttc

SEQ ID NO: 324200 - DNA, 25 bp, Mus musculus
cagtggttccagatctcagagttgt

SEQ ID NO: 324201 - DNA, 25 bp, Mus musculus
cagtggttccagttctcagagttgt

SEQ ID NO: 324202 - DNA, 25 bp, Mus musculus
cagtggttcccgagagtggattttt

SEQ ID NO: 324203 - DNA, 25 bp, Mus musculus
cagtggttcccgtgagtggattttt

SEQ ID NO: 324204 - DNA, 25 bp, Mus musculus
cagtggttctcaaatgctttgtaat

SEQ ID NO: 324205 - DNA, 25 bp, Mus musculus
cagtggttctcatatgctttgtaat

SEQ ID NO: 324206 - DNA, 25 bp, Mus musculus
cagtggttcttcatggtaggcattt

SEQ ID NO: 324207 - DNA, 25 bp, Mus musculus
cagtggttcttcttggtaggcattt

SEQ ID NO: 324208 - DNA, 25 bp, Mus musculus
cagtggttgattagcccaatgacta

SEQ ID NO: 324209 - DNA, 25 bp, Mus musculus
cagtggttgatttgcccaatgacta

SEQ ID NO: 324210 - DNA, 25 bp, Mus musculus
cagtggtttattcctgtgcgtcgtt

SEQ ID NO: 324211 - DNA, 25 bp, Mus musculus
cagtggtttattgctgtgcgtcgtt

SEQ ID NO: 324212 - DNA, 25 bp, Mus musculus
cagtggttttaacagcaggccccgg

SEQ ID NO: 324213 - DNA, 25 bp, Mus musculus
cagtggttttaagagcaggccccgg

SEQ ID NO: 324214 - DNA, 25 bp, Mus musculus
cagtgtaaccttctctgttctggaa

SEQ ID NO: 324215 - DNA, 25 bp, Mus musculus
cagtgtaaccttgtctgttctggaa

SEQ ID NO: 324216 - DNA, 25 bp, Mus musculus
cagtgtaactgacttcacccagact

SEQ ID NO: 324217 - DNA, 25 bp, Mus musculus
cagtgtaactgagttcacccagact

SEQ ID NO: 324218 - DNA, 25 bp, Mus musculus
cagtgtaactgtcatgctgtttcca

SEQ ID NO: 324219 - DNA, 25 bp, Mus musculus
cagtgtaactgtgatgctgtttcca

SEQ ID NO: 324220 - DNA, 25 bp, Mus musculus
cagtgtaaggcacctaagccagatg

SEQ ID NO: 324221 - DNA, 25 bp, Mus musculus
cagtgtaaggcagctaagccagatg

SEQ ID NO: 324222 - DNA, 25 bp, Mus musculus
cagtgtaatattagtgtcgtgccag

SEQ ID NO: 324223 - DNA, 25 bp, Mus musculus
cagtgtaatatttgtgtcgtgccag

SEQ ID NO: 324224 - DNA, 25 bp, Mus musculus
cagtgtaatgacactctactctctc

SEQ ID NO: 324225 - DNA, 25 bp, Mus musculus
cagtgtaatgactctctactctctc

SEQ ID NO: 324226 - DNA, 25 bp, Mus musculus
cagtgtaattaaccttccaggatca

SEQ ID NO: 324227 - DNA, 25 bp, Mus musculus
cagtgtaattaagcttccaggatca

SEQ ID NO: 324228 - DNA, 25 bp, Mus musculus
cagtgtaattgcattgacgtgaata

SEQ ID NO: 324229 - DNA, 25 bp, Mus musculus
cagtgtaattgctttgacgtgaata

SEQ ID NO: 324230 - DNA, 25 bp, Mus musculus
cagtgtacacagcaggactcatcaa

SEQ ID NO: 324231 - DNA, 25 bp, Mus musculus
cagtgtacacaggaggactcatcaa

SEQ ID NO: 324232 - DNA, 25 bp, Mus musculus
cagtgtacagacatcatggacgaag

SEQ ID NO: 324233 - DNA, 25 bp, Mus musculus
cagtgtacagacttcatggacgaag

SEQ ID NO: 324234 - DNA, 25 bp, Mus musculus
cagtgtaccaaacgttaccccacag

SEQ ID NO: 324235 - DNA, 25 bp, Mus musculus
cagtgtaccaaaggttaccccacag

SEQ ID NO: 324236 - DNA, 25 bp, Mus musculus
cagtgtaccaccaaatgcagcgcat

SEQ ID NO: 324237 - DNA, 25 bp, Mus musculus
cagtgtaccacctaatgcagcgcat

SEQ ID NO: 324238 - DNA, 25 bp, Mus musculus
cagtgtacccatccttgatctgtct

SEQ ID NO: 324239 - DNA, 25 bp, Mus musculus
cagtgtacccatgcttgatctgtct

SEQ ID NO: 324240 - DNA, 25 bp, Mus musculus
cagtgtacgttcagaacctttcagg

SEQ ID NO: 324241 - DNA, 25 bp, Mus musculus
cagtgtacgttctgaacctttcagg

SEQ ID NO: 324242 - DNA, 25 bp, Mus musculus
cagtgtactcatctagcttcgtgct

SEQ ID NO: 324243 - DNA, 25 bp, Mus musculus
cagtgtactcatgtagcttcgtgct

SEQ ID NO: 324244 - DNA, 25 bp, Mus musculus
cagtgtactggcctacagggttctg

SEQ ID NO: 324245 - DNA, 25 bp, Mus musculus
cagtgtactggcgtacagggttctg

SEQ ID NO: 324246 - DNA, 25 bp, Mus musculus
cagtgtagcatacccctaagtagta

SEQ ID NO: 324247 - DNA, 25 bp, Mus musculus
cagtgtagcatagccctaagtagta

SEQ ID NO: 324248 - DNA, 25 bp, Mus musculus
cagtgtagcctcatggttccagtga

SEQ ID NO: 324249 - DNA, 25 bp, Mus musculus
cagtgtagcctcttggttccagtga

SEQ ID NO: 324250 - DNA, 25 bp, Mus musculus
cagtgtaggagacccgtgccattga

SEQ ID NO: 324251 - DNA, 25 bp, Mus musculus
cagtgtaggagagccgtgccattga

SEQ ID NO: 324252 - DNA, 25 bp, Mus musculus
cagtgtaggcacatagcacccttta

SEQ ID NO: 324253 - DNA, 25 bp, Mus musculus
cagtgtaggcacttagcacccttta

SEQ ID NO: 324254 - DNA, 25 bp, Mus musculus
cagtgtaggcccatgaatgctgcag

SEQ ID NO: 324255 - DNA, 25 bp, Mus musculus
cagtgtaggcccttgaatgctgcag

SEQ ID NO: 324256 - DNA, 25 bp, Mus musculus
cagtgtaggttcattctgtttggtt

SEQ ID NO: 324257 - DNA, 25 bp, Mus musculus
cagtgtaggttctttctgtttggtt

SEQ ID NO: 324258 - DNA, 25 bp, Mus musculus
cagtgtatcatccaccaagcacaga

SEQ ID NO: 324259 - DNA, 25 bp, Mus musculus
cagtgtatcatcgaccaagcacaga

SEQ ID NO: 324260 - DNA, 25 bp, Mus musculus
cagtgtatctgtctgcaggtgttat

SEQ ID NO: 324261 - DNA, 25 bp, Mus musculus
cagtgtatctgtgtgcaggtgttat

SEQ ID NO: 324262 - DNA, 25 bp, Mus musculus
cagtgtatttatatagagcaggtta

SEQ ID NO: 324263 - DNA, 25 bp, Mus musculus
cagtgtatttatttagagcaggtta

SEQ ID NO: 324264 - DNA, 25 bp, Mus musculus
cagtgtcaaagaagtctccatcccc

SEQ ID NO: 324265 - DNA, 25 bp, Mus musculus
cagtgtcaaagatgtctccatcccc

SEQ ID NO: 324266 - DNA, 25 bp, Mus musculus
cagtgtcaagggagcgttttaattc

SEQ ID NO: 324267 - DNA, 25 bp, Mus musculus
cagtgtcaagggtgcgttttaattc

SEQ ID NO: 324268 - DNA, 25 bp, Mus musculus
cagtgtcacaataaagaattttcca

SEQ ID NO: 324269 - DNA, 25 bp, Mus musculus
cagtgtcacaattaagaattttcca

SEQ ID NO: 324270 - DNA, 25 bp, Mus musculus
cagtgtcacagtcactcgaagcttc

SEQ ID NO: 324271 - DNA, 25 bp, Mus musculus
cagtgtcacagtccttttgctgagc

SEQ ID NO: 324272 - DNA, 25 bp, Mus musculus
cagtgtcacagtgactcgaagcttc

SEQ ID NO: 324273 - DNA, 25 bp, Mus musculus
cagtgtcacagtgcttttgctgagc

SEQ ID NO: 324274 - DNA, 25 bp, Mus musculus
cagtgtcacctgacaacagtgcagg

SEQ ID NO: 324275 - DNA, 25 bp, Mus musculus
cagtgtcacctgatgctggagataa

SEQ ID NO: 324276 - DNA, 25 bp, Mus musculus
cagtgtcacctgtcaacagtgcagg

SEQ ID NO: 324277 - DNA, 25 bp, Mus musculus
cagtgtcacctgttgctggagataa

SEQ ID NO: 324278 - DNA, 25 bp, Mus musculus
cagtgtcactagaggaacctgccca

SEQ ID NO: 324279 - DNA, 25 bp, Mus musculus
cagtgtcactagtggaacctgccca

SEQ ID NO: 324280 - DNA, 25 bp, Mus musculus
cagtgtcagaacagggcacagggca

SEQ ID NO: 324281 - DNA, 25 bp, Mus musculus
cagtgtcagaactgggcacagggca

SEQ ID NO: 324282 - DNA, 25 bp, Mus musculus
cagtgtcagagtacgggcacggcct

SEQ ID NO: 324283 - DNA, 25 bp, Mus musculus
cagtgtcagagttcgggcacggcct

SEQ ID NO: 324284 - DNA, 25 bp, Mus musculus
cagtgtcagattaggaacctgcccc

SEQ ID NO: 324285 - DNA, 25 bp, Mus musculus
cagtgtcagatttggaacctgcccc

SEQ ID NO: 324286 - DNA, 25 bp, Mus musculus
cagtgtcagctgaacgagggccaga

SEQ ID NO: 324287 - DNA, 25 bp, Mus musculus
cagtgtcagctgtacgagggccaga

SEQ ID NO: 324288 - DNA, 25 bp, Mus musculus
cagtgtcaggaacaccctgctgctc

SEQ ID NO: 324289 - DNA, 25 bp, Mus musculus
cagtgtcaggaagaccctgctgctc

SEQ ID NO: 324290 - DNA, 25 bp, Mus musculus
cagtgtcagtatctgtttctcatga

SEQ ID NO: 324291 - DNA, 25 bp, Mus musculus
cagtgtcagtatgtgtttctcatga

SEQ ID NO: 324292 - DNA, 25 bp, Mus musculus
cagtgtcagtgtcggtgtgtcttat

SEQ ID NO: 324293 - DNA, 25 bp, Mus musculus
cagtgtcagtgtgggtgtgtcttat

SEQ ID NO: 324294 - DNA, 25 bp, Mus musculus
cagtgtcatccaccgacagttggaa

SEQ ID NO: 324295 - DNA, 25 bp, Mus musculus
cagtgtcatccagcgacagttggaa

SEQ ID NO: 324296 - DNA, 25 bp, Mus musculus
cagtgtcatggtagtaaacggttca

SEQ ID NO: 324297 - DNA, 25 bp, Mus musculus
cagtgtcatggttgtaaacggttca

SEQ ID NO: 324298 - DNA, 25 bp, Mus musculus
cagtgtcattaccaaagctggcagc

SEQ ID NO: 324299 - DNA, 25 bp, Mus musculus
cagtgtcattacgaaagctggcagc

SEQ ID NO: 324300 - DNA, 25 bp, Mus musculus
cagtgtcattttcatagttgggtgt

SEQ ID NO: 324301 - DNA, 25 bp, Mus musculus
cagtgtcattttcttataggtgttc

SEQ ID NO: 324302 - DNA, 25 bp, Mus musculus
cagtgtcattttgatagttgggtgt

SEQ ID NO: 324303 - DNA, 25 bp, Mus musculus
cagtgtcattttgttataggtgttc

SEQ ID NO: 324304 - DNA, 25 bp, Mus musculus
cagtgtccacttctttttatattca

SEQ ID NO: 324305 - DNA, 25 bp, Mus musculus
cagtgtccacttgtttttatattca

SEQ ID NO: 324306 - DNA, 25 bp, Mus musculus
cagtgtccagtgactagcacagggt

SEQ ID NO: 324307 - DNA, 25 bp, Mus musculus
cagtgtccagtgtctagcacagggt

SEQ ID NO: 324308 - DNA, 25 bp, Mus musculus
cagtgtccatcgaggctggttgaaa

SEQ ID NO: 324309 - DNA, 25 bp, Mus musculus
cagtgtccatcgtggctggttgaaa

SEQ ID NO: 324310 - DNA, 25 bp, Mus musculus
cagtgtccatggagcctagcaggca

SEQ ID NO: 324311 - DNA, 25 bp, Mus musculus
cagtgtccatggtgcctagcaggca

SEQ ID NO: 324312 - DNA, 25 bp, Mus musculus
cagtgtccattgcaagagtgtgttt

SEQ ID NO: 324313 - DNA, 25 bp, Mus musculus
cagtgtccattggaagagtgtgttt

SEQ ID NO: 324314 - DNA, 25 bp, Mus musculus
cagtgtcccaatccgggctgtggaa

SEQ ID NO: 324315 - DNA, 25 bp, Mus musculus
cagtgtcccaatgcgggctgtggaa

SEQ ID NO: 324316 - DNA, 25 bp, Mus musculus
cagtgtccccagaacttattcggta

SEQ ID NO: 324317 - DNA, 25 bp, Mus musculus
cagtgtccccagtacttattcggta

SEQ ID NO: 324318 - DNA, 25 bp, Mus musculus
cagtgtccctaacccattgataaat

SEQ ID NO: 324319 - DNA, 25 bp, Mus musculus
cagtgtccctaagccattgataaat

SEQ ID NO: 324320 - DNA, 25 bp, Mus musculus
cagtgtccctacagtactcttttaa

SEQ ID NO: 324321 - DNA, 25 bp, Mus musculus
cagtgtccctactgtactcttttaa

SEQ ID NO: 324322 - DNA, 25 bp, Mus musculus
cagtgtcctatgctgttcttacaaa

SEQ ID NO: 324323 - DNA, 25 bp, Mus musculus
cagtgtcctatggtgttcttacaaa

SEQ ID NO: 324324 - DNA, 25 bp, Mus musculus
cagtgtcctcatagtcctttttgat

SEQ ID NO: 324325 - DNA, 25 bp, Mus musculus
cagtgtcctcattgtcctttttgat

SEQ ID NO: 324326 - DNA, 25 bp, Mus musculus
cagtgtcctgaaagctgccacaaat

SEQ ID NO: 324327 - DNA, 25 bp, Mus musculus
cagtgtcctgaatgctgccacaaat

SEQ ID NO: 324328 - DNA, 25 bp, Mus musculus
cagtgtcctgcactgaacttttatt

SEQ ID NO: 324329 - DNA, 25 bp, Mus musculus
cagtgtcctgcagtgaacttttatt

SEQ ID NO: 324330 - DNA, 25 bp, Mus musculus
cagtgtcctgccataacaaatgtga

SEQ ID NO: 324331 - DNA, 25 bp, Mus musculus
cagtgtcctgccttaacaaatgtga

SEQ ID NO: 324332 - DNA, 25 bp, Mus musculus
cagtgtcctggaaaacatctgacag

SEQ ID NO: 324333 - DNA, 25 bp, Mus musculus
cagtgtcctggaagcagtcaggttg

SEQ ID NO: 324334 - DNA, 25 bp, Mus musculus
cagtgtcctggataacatctgacag

SEQ ID NO: 324335 - DNA, 25 bp, Mus musculus
cagtgtcctggatgcagtcaggttg

SEQ ID NO: 324336 - DNA, 25 bp, Mus musculus
cagtgtcctggtcatcattgtcatc

SEQ ID NO: 324337 - DNA, 25 bp, Mus musculus
cagtgtcctggtgatcattgtcatc

SEQ ID NO: 324338 - DNA, 25 bp, Mus musculus
cagtgtcctgtaattgatccctaga

SEQ ID NO: 324339 - DNA, 25 bp, Mus musculus
cagtgtcctgtatttgatccctaga

SEQ ID NO: 324340 - DNA, 25 bp, Mus musculus
cagtgtcctgttaataccattcctc

SEQ ID NO: 324341 - DNA, 25 bp, Mus musculus
cagtgtcctgtttataccattcctc

SEQ ID NO: 324342 - DNA, 25 bp, Mus musculus
cagtgtcgcagacaccaggttgtca

SEQ ID NO: 324343 - DNA, 25 bp, Mus musculus
cagtgtcgcagagaccaggttgtca

SEQ ID NO: 324344 - DNA, 25 bp, Mus musculus
cagtgtcgggtacctgctgaccatg

SEQ ID NO: 324345 - DNA, 25 bp, Mus musculus
cagtgtcgggtagctgctgaccatg

SEQ ID NO: 324346 - DNA, 25 bp, Mus musculus
cagtgtcgggttaccgttgtcaaat

SEQ ID NO: 324347 - DNA, 25 bp, Mus musculus
cagtgtcgggtttccgttgtcaaat

SEQ ID NO: 324348 - DNA, 25 bp, Mus musculus
cagtgtcgtcacaggtactgacatt

SEQ ID NO: 324349 - DNA, 25 bp, Mus musculus
cagtgtcgtcactggtactgacatt

SEQ ID NO: 324350 - DNA, 25 bp, Mus musculus
cagtgtctacatctcatggattcag

SEQ ID NO: 324351 - DNA, 25 bp, Mus musculus
cagtgtctacatgtcatggattcag

SEQ ID NO: 324352 - DNA, 25 bp, Mus musculus
cagtgtctactgagtgaaggtgata

SEQ ID NO: 324353 - DNA, 25 bp, Mus musculus
cagtgtctactgtgtgaaggtgata

SEQ ID NO: 324354 - DNA, 25 bp, Mus musculus
cagtgtctataaaacagtgtctttt

SEQ ID NO: 324355 - DNA, 25 bp, Mus musculus
cagtgtctataatacagtgtctttt

SEQ ID NO: 324356 - DNA, 25 bp, Mus musculus
cagtgtctattcaccaattacatga

SEQ ID NO: 324357 - DNA, 25 bp, Mus musculus
cagtgtctattctccaattacatga

SEQ ID NO: 324358 - DNA, 25 bp, Mus musculus
cagtgtctcaccatctaacatttga

SEQ ID NO: 324359 - DNA, 25 bp, Mus musculus
cagtgtctcaccttctaacatttga

SEQ ID NO: 324360 - DNA, 25 bp, Mus musculus
cagtgtctcacgagtcatactaagt

SEQ ID NO: 324361 - DNA, 25 bp, Mus musculus
cagtgtctcacgtgtcatactaagt

SEQ ID NO: 324362 - DNA, 25 bp, Mus musculus
cagtgtctcattatgctgggtaaga

SEQ ID NO: 324363 - DNA, 25 bp, Mus musculus
cagtgtctcattttgctgggtaaga

SEQ ID NO: 324364 - DNA, 25 bp, Mus musculus
cagtgtctccacaaagaccagctga

SEQ ID NO: 324365 - DNA, 25 bp, Mus musculus
cagtgtctccactaagaccagctga

SEQ ID NO: 324366 - DNA, 25 bp, Mus musculus
cagtgtctccagaagtgttgcccag

SEQ ID NO: 324367 - DNA, 25 bp, Mus musculus
cagtgtctccagtagtgttgcccag

SEQ ID NO: 324368 - DNA, 25 bp, Mus musculus
cagtgtctcccactggttaggcaca

SEQ ID NO: 324369 - DNA, 25 bp, Mus musculus
cagtgtctcccagtggttaggcaca

SEQ ID NO: 324370 - DNA, 25 bp, Mus musculus
cagtgtctccttcattggttttgct

SEQ ID NO: 324371 - DNA, 25 bp, Mus musculus
cagtgtctccttgattggttttgct

SEQ ID NO: 324372 - DNA, 25 bp, Mus musculus
cagtgtctctccaattccacagaaa

SEQ ID NO: 324373 - DNA, 25 bp, Mus musculus
cagtgtctctcctattccacagaaa

SEQ ID NO: 324374 - DNA, 25 bp, Mus musculus
cagtgtctctcgagttgcaatgtgt

SEQ ID NO: 324375 - DNA, 25 bp, Mus musculus
cagtgtctctcgtgttgcaatgtgt

SEQ ID NO: 324376 - DNA, 25 bp, Mus musculus
cagtgtctctggatgttcattggaa

SEQ ID NO: 324377 - DNA, 25 bp, Mus musculus
cagtgtctctggttgttcattggaa

SEQ ID NO: 324378 - DNA, 25 bp, Mus musculus
cagtgtctctttccaatgcatggta

SEQ ID NO: 324379 - DNA, 25 bp, Mus musculus
cagtgtctctttgcaatgcatggta

SEQ ID NO: 324380 - DNA, 25 bp, Mus musculus
cagtgtctgaccatagctcaagcta

SEQ ID NO: 324381 - DNA, 25 bp, Mus musculus
cagtgtctgaccttagctcaagcta

SEQ ID NO: 324382 - DNA, 25 bp, Mus musculus
cagtgtctgcaaaacttgtgggcca

SEQ ID NO: 324383 - DNA, 25 bp, Mus musculus
cagtgtctgcaatacttgtgggcca

SEQ ID NO: 324384 - DNA, 25 bp, Mus musculus
cagtgtctgcataatttttggcccc

SEQ ID NO: 324385 - DNA, 25 bp, Mus musculus
cagtgtctgcattatttttggcccc

SEQ ID NO: 324386 - DNA, 25 bp, Mus musculus
cagtgtctggagctttcctgatgta

SEQ ID NO: 324387 - DNA, 25 bp, Mus musculus
cagtgtctggaggtttcctgatgta

SEQ ID NO: 324388 - DNA, 25 bp, Mus musculus
cagtgtctgggcagcgagcataaga

SEQ ID NO: 324389 - DNA, 25 bp, Mus musculus
cagtgtctgggcataggatcctcag

SEQ ID NO: 324390 - DNA, 25 bp, Mus musculus
cagtgtctgggcatctgggaaactc

SEQ ID NO: 324391 - DNA, 25 bp, Mus musculus
cagtgtctgggctgcgagcataaga

SEQ ID NO: 324392 - DNA, 25 bp, Mus musculus
cagtgtctgggcttaggatcctcag

SEQ ID NO: 324393 - DNA, 25 bp, Mus musculus
cagtgtctgggcttctgggaaactc

SEQ ID NO: 324394 - DNA, 25 bp, Mus musculus
cagtgtctggtgaccctagaaactt

SEQ ID NO: 324395 - DNA, 25 bp, Mus musculus
cagtgtctggtgtccctagaaactt

SEQ ID NO: 324396 - DNA, 25 bp, Mus musculus
cagtgtctgtacaggttatcatcta

SEQ ID NO: 324397 - DNA, 25 bp, Mus musculus
cagtgtctgtactggttatcatcta

SEQ ID NO: 324398 - DNA, 25 bp, Mus musculus
cagtgtctgtgcaagttaacatata

SEQ ID NO: 324399 - DNA, 25 bp, Mus musculus
cagtgtctgtgctagttaacatata

SEQ ID NO: 324400 - DNA, 25 bp, Mus musculus
cagtgtctgttcaggtcagtggagt

SEQ ID NO: 324401 - DNA, 25 bp, Mus musculus
cagtgtctgttctggtcagtggagt

SEQ ID NO: 324402 - DNA, 25 bp, Mus musculus
cagtgtctgttgcaaagcagaggct

SEQ ID NO: 324403 - DNA, 25 bp, Mus musculus
cagtgtctgttggaaagcagaggct

SEQ ID NO: 324404 - DNA, 25 bp, Mus musculus
cagtgtcttcaaatcccaatagcag

SEQ ID NO: 324405 - DNA, 25 bp, Mus musculus
cagtgtcttcaattcccaatagcag

SEQ ID NO: 324406 - DNA, 25 bp, Mus musculus
cagtgtcttcatctgaactcttcac

SEQ ID NO: 324407 - DNA, 25 bp, Mus musculus
cagtgtcttcatgtgaactcttcac

SEQ ID NO: 324408 - DNA, 25 bp, Mus musculus
cagtgtcttgtgattggcattttcc

SEQ ID NO: 324409 - DNA, 25 bp, Mus musculus
cagtgtcttgtgatttcattctata

SEQ ID NO: 324410 - DNA, 25 bp, Mus musculus
cagtgtcttgtgtttggcattttcc

SEQ ID NO: 324411 - DNA, 25 bp, Mus musculus
cagtgtcttgtgttttcattctata

SEQ ID NO: 324412 - DNA, 25 bp, Mus musculus
cagtgtctttgcaagtcccaaggtg

SEQ ID NO: 324413 - DNA, 25 bp, Mus musculus
cagtgtctttgctagtcccaaggtg

SEQ ID NO: 324414 - DNA, 25 bp, Mus musculus
cagtgtctttggaatagtaaatgtt

SEQ ID NO: 324415 - DNA, 25 bp, Mus musculus
cagtgtctttggtatagtaaatgtt

SEQ ID NO: 324416 - DNA, 25 bp, Mus musculus
cagtgtcttttccttatggttccag

SEQ ID NO: 324417 - DNA, 25 bp, Mus musculus
cagtgtcttttcgttatggttccag

SEQ ID NO: 324418 - DNA, 25 bp, Mus musculus
cagtgtgaagacagacggactgctg

SEQ ID NO: 324419 - DNA, 25 bp, Mus musculus
cagtgtgaagactgacggactgctg

SEQ ID NO: 324420 - DNA, 25 bp, Mus musculus
cagtgtgaatgacagccagccacat

SEQ ID NO: 324421 - DNA, 25 bp, Mus musculus
cagtgtgaatgagagccagccacat

SEQ ID NO: 324422 - DNA, 25 bp, Mus musculus
cagtgtgacctgaagcaagtccctt

SEQ ID NO: 324423 - DNA, 25 bp, Mus musculus
cagtgtgacctgtagcaagtccctt

SEQ ID NO: 324424 - DNA, 25 bp, Mus musculus
cagtgtgacgtaagtgacttggctt

SEQ ID NO: 324425 - DNA, 25 bp, Mus musculus
cagtgtgacgtatgtgacttggctt

SEQ ID NO: 324426 - DNA, 25 bp, Mus musculus
cagtgtgactgaactctcgtgattg

SEQ ID NO: 324427 - DNA, 25 bp, Mus musculus
cagtgtgactgatctctcgtgattg

SEQ ID NO: 324428 - DNA, 25 bp, Mus musculus
cagtgtgactttatgactattcctt

SEQ ID NO: 324429 - DNA, 25 bp, Mus musculus
cagtgtgactttttgactattcctt

SEQ ID NO: 324430 - DNA, 25 bp, Mus musculus
cagtgtgagcgcagatggagccatc

SEQ ID NO: 324431 - DNA, 25 bp, Mus musculus
cagtgtgagcgctgatggagccatc

SEQ ID NO: 324432 - DNA, 25 bp, Mus musculus
cagtgtgaggctaacggaggcttct

SEQ ID NO: 324433 - DNA, 25 bp, Mus musculus
cagtgtgaggcttacggaggcttct

SEQ ID NO: 324434 - DNA, 25 bp, Mus musculus
cagtgtgagggaacccttttggcat

SEQ ID NO: 324435 - DNA, 25 bp, Mus musculus
cagtgtgagggatcccttttggcat

SEQ ID NO: 324436 - DNA, 25 bp, Mus musculus
cagtgtgaggtcagtcgctgcgtaa

SEQ ID NO: 324437 - DNA, 25 bp, Mus musculus
cagtgtgaggtctgtcgctgcgtaa

SEQ ID NO: 324438 - DNA, 25 bp, Mus musculus
cagtgtgagtctctagtaaagccat

SEQ ID NO: 324439 - DNA, 25 bp, Mus musculus
cagtgtgagtctgtagtaaagccat

SEQ ID NO: 324440 - DNA, 25 bp, Mus musculus
cagtgtgatacaacctgcctgttat

SEQ ID NO: 324441 - DNA, 25 bp, Mus musculus
cagtgtgatacatcctgcctgttat

SEQ ID NO: 324442 - DNA, 25 bp, Mus musculus
cagtgtgatattctctacgcggttt

SEQ ID NO: 324443 - DNA, 25 bp, Mus musculus
cagtgtgatattgtctacgcggttt

SEQ ID NO: 324444 - DNA, 25 bp, Mus musculus
cagtgtgatcttctgccaccatggc

SEQ ID NO: 324445 - DNA, 25 bp, Mus musculus
cagtgtgatcttgtgccaccatggc

SEQ ID NO: 324446 - DNA, 25 bp, Mus musculus
cagtgtgattctagctccattcatg

SEQ ID NO: 324447 - DNA, 25 bp, Mus musculus
cagtgtgattcttgctccattcatg

SEQ ID NO: 324448 - DNA, 25 bp, Mus musculus
cagtgtgattgtctgctgtgtcttt

SEQ ID NO: 324449 - DNA, 25 bp, Mus musculus
cagtgtgattgtgtgctgtgtcttt

SEQ ID NO: 324450 - DNA, 25 bp, Mus musculus
cagtgtgcaaagctggccccgtgca

SEQ ID NO: 324451 - DNA, 25 bp, Mus musculus
cagtgtgcaaaggtggccccgtgca

SEQ ID NO: 324452 - DNA, 25 bp, Mus musculus
cagtgtgcaaataccctcgggaata

SEQ ID NO: 324453 - DNA, 25 bp, Mus musculus
cagtgtgcaaattccctcgggaata

SEQ ID NO: 324454 - DNA, 25 bp, Mus musculus
cagtgtgcacctaccgggagcttgc

SEQ ID NO: 324455 - DNA, 25 bp, Mus musculus
cagtgtgcaccttccgggagcttgc

SEQ ID NO: 324456 - DNA, 25 bp, Mus musculus
cagtgtgcacttagagtaactccgg

SEQ ID NO: 324457 - DNA, 25 bp, Mus musculus
cagtgtgcactttgagtaactccgg

SEQ ID NO: 324458 - DNA, 25 bp, Mus musculus
cagtgtgcagatatgcccaggcaat

SEQ ID NO: 324459 - DNA, 25 bp, Mus musculus
cagtgtgcagatttgcccaggcaat

SEQ ID NO: 324460 - DNA, 25 bp, Mus musculus
cagtgtgcagctctcattggaataa

SEQ ID NO: 324461 - DNA, 25 bp, Mus musculus
cagtgtgcagctgtcattggaataa

SEQ ID NO: 324462 - DNA, 25 bp, Mus musculus
cagtgtgcatgcctacatgtgggta

SEQ ID NO: 324463 - DNA, 25 bp, Mus musculus
cagtgtgcatgcgtacatgtgggta

SEQ ID NO: 324464 - DNA, 25 bp, Mus musculus
cagtgtgccaagaataaaaccattt

SEQ ID NO: 324465 - DNA, 25 bp, Mus musculus
cagtgtgccaagtataaaaccattt

SEQ ID NO: 324466 - DNA, 25 bp, Mus musculus
cagtgtgccagtcccgccgaaagag

SEQ ID NO: 324467 - DNA, 25 bp, Mus musculus
cagtgtgccagtgccgccgaaagag

SEQ ID NO: 324468 - DNA, 25 bp, Mus musculus
cagtgtgccccgacagtgggtcccg

SEQ ID NO: 324469 - DNA, 25 bp, Mus musculus
cagtgtgccccgtcagtgggtcccg

SEQ ID NO: 324470 - DNA, 25 bp, Mus musculus
cagtgtgccctcctggcctggctgt

SEQ ID NO: 324471 - DNA, 25 bp, Mus musculus
cagtgtgccctcgtggcctggctgt

SEQ ID NO: 324472 - DNA, 25 bp, Mus musculus
cagtgtgccctgaagcagtgctgcg

SEQ ID NO: 324473 - DNA, 25 bp, Mus musculus
cagtgtgccctgtagcagtgctgcg

SEQ ID NO: 324474 - DNA, 25 bp, Mus musculus
cagtgtgccgctagccccaaggaga

SEQ ID NO: 324475 - DNA, 25 bp, Mus musculus
cagtgtgccgcttgccccaaggaga

SEQ ID NO: 324476 - DNA, 25 bp, Mus musculus
cagtgtgcgaccatcacctgggctg

SEQ ID NO: 324477 - DNA, 25 bp, Mus musculus
cagtgtgcgaccttcacctgggctg

SEQ ID NO: 324478 - DNA, 25 bp, Mus musculus
cagtgtgctaaaattgtgcccagaa

SEQ ID NO: 324479 - DNA, 25 bp, Mus musculus
cagtgtgctaaatttgtgcccagaa

SEQ ID NO: 324480 - DNA, 25 bp, Mus musculus
cagtgtgctcccctaaaaaacgtcg

SEQ ID NO: 324481 - DNA, 25 bp, Mus musculus
cagtgtgctcccgtaaaaaacgtcg

SEQ ID NO: 324482 - DNA, 25 bp, Mus musculus
cagtgtgctctaactcatggtgaaa

SEQ ID NO: 324483 - DNA, 25 bp, Mus musculus
cagtgtgctctatctcatggtgaaa

SEQ ID NO: 324484 - DNA, 25 bp, Mus musculus
cagtgtgctgataatgtattgtgtg

SEQ ID NO: 324485 - DNA, 25 bp, Mus musculus
cagtgtgctgattatgtattgtgtg

SEQ ID NO: 324486 - DNA, 25 bp, Mus musculus
cagtgtgctgtcatatggccatggc

SEQ ID NO: 324487 - DNA, 25 bp, Mus musculus
cagtgtgctgtccatcatctgtaca

SEQ ID NO: 324488 - DNA, 25 bp, Mus musculus
cagtgtgctgtcgatcatctgtaca

SEQ ID NO: 324489 - DNA, 25 bp, Mus musculus
cagtgtgctgtcttatggccatggc

SEQ ID NO: 324490 - DNA, 25 bp, Mus musculus
cagtgtgcttagacatatgaacttt

SEQ ID NO: 324491 - DNA, 25 bp, Mus musculus
cagtgtgcttagtcatatgaacttt

SEQ ID NO: 324492 - DNA, 25 bp, Mus musculus
cagtgtgcttcacgtgccccaagaa

SEQ ID NO: 324493 - DNA, 25 bp, Mus musculus
cagtgtgcttcaggtgccccaagaa

SEQ ID NO: 324494 - DNA, 25 bp, Mus musculus
cagtgtgcttgcacactgggcaagg

SEQ ID NO: 324495 - DNA, 25 bp, Mus musculus
cagtgtgcttgctcactgggcaagg

SEQ ID NO: 324496 - DNA, 25 bp, Mus musculus
cagtgtgctttgaggcctgcagctg

SEQ ID NO: 324497 - DNA, 25 bp, Mus musculus
cagtgtgctttgtggcctgcagctg

SEQ ID NO: 324498 - DNA, 25 bp, Mus musculus
cagtgtgcttttcccaaccaccata

SEQ ID NO: 324499 - DNA, 25 bp, Mus musculus
cagtgtgcttttgccaaccaccata

SEQ ID NO: 324500 - DNA, 25 bp, Mus musculus
cagtgtggaaacacgggcacccctg

SEQ ID NO: 324501 - DNA, 25 bp, Mus musculus
cagtgtggaaactcgggcacccctg

SEQ ID NO: 324502 - DNA, 25 bp, Mus musculus
cagtgtggacagatgcacccctgga

SEQ ID NO: 324503 - DNA, 25 bp, Mus musculus
cagtgtggacagttgcacccctgga

SEQ ID NO: 324504 - DNA, 25 bp, Mus musculus
cagtgtggacggaaccacagggaca

SEQ ID NO: 324505 - DNA, 25 bp, Mus musculus
cagtgtggacggtaccacagggaca

SEQ ID NO: 324506 - DNA, 25 bp, Mus musculus
cagtgtggagctagtgctggcctca

SEQ ID NO: 324507 - DNA, 25 bp, Mus musculus
cagtgtggagcttgtgctggcctca

SEQ ID NO: 324508 - DNA, 25 bp, Mus musculus
cagtgtggatacactgggcagatgc

SEQ ID NO: 324509 - DNA, 25 bp, Mus musculus
cagtgtggatactctgggcagatgc

SEQ ID NO: 324510 - DNA, 25 bp, Mus musculus
cagtgtggatttcagtgcagaatac

SEQ ID NO: 324511 - DNA, 25 bp, Mus musculus
cagtgtggatttgagtgcagaatac

SEQ ID NO: 324512 - DNA, 25 bp, Mus musculus
cagtgtggcaccaagcccttatgac

SEQ ID NO: 324513 - DNA, 25 bp, Mus musculus
cagtgtggcacctagcccttatgac

SEQ ID NO: 324514 - DNA, 25 bp, Mus musculus
cagtgtggcatgagccaggacgcct

SEQ ID NO: 324515 - DNA, 25 bp, Mus musculus
cagtgtggcatgtgccaggacgcct

SEQ ID NO: 324516 - DNA, 25 bp, Mus musculus
cagtgtggccatatgggtccttgta

SEQ ID NO: 324517 - DNA, 25 bp, Mus musculus
cagtgtggccatttgggtccttgta

SEQ ID NO: 324518 - DNA, 25 bp, Mus musculus
cagtgtggcctgactgtccgtagga

SEQ ID NO: 324519 - DNA, 25 bp, Mus musculus
cagtgtggcctgtctgtccgtagga

SEQ ID NO: 324520 - DNA, 25 bp, Mus musculus
cagtgtggctctctccatggagact

SEQ ID NO: 324521 - DNA, 25 bp, Mus musculus
cagtgtggctctgtccatggagact

SEQ ID NO: 324522 - DNA, 25 bp, Mus musculus
cagtgtggctgaatgtgttggtatt

SEQ ID NO: 324523 - DNA, 25 bp, Mus musculus
cagtgtggctgattgtgttggtatt

SEQ ID NO: 324524 - DNA, 25 bp, Mus musculus
cagtgtggcttgacttgcttctgat

SEQ ID NO: 324525 - DNA, 25 bp, Mus musculus
cagtgtggcttgcactgagcagtca

SEQ ID NO: 324526 - DNA, 25 bp, Mus musculus
cagtgtggcttggactgagcagtca

SEQ ID NO: 324527 - DNA, 25 bp, Mus musculus
cagtgtggcttgtcttgcttctgat

SEQ ID NO: 324528 - DNA, 25 bp, Mus musculus
cagtgtggctttaccgaccagttgt

SEQ ID NO: 324529 - DNA, 25 bp, Mus musculus
cagtgtggcttttccgaccagttgt

SEQ ID NO: 324530 - DNA, 25 bp, Mus musculus
cagtgtgggcccaggttatggtcta

SEQ ID NO: 324531 - DNA, 25 bp, Mus musculus
cagtgtgggccctggttatggtcta

SEQ ID NO: 324532 - DNA, 25 bp, Mus musculus
cagtgtgggtatatgttctggactt

SEQ ID NO: 324533 - DNA, 25 bp, Mus musculus
cagtgtgggtatttgttctggactt

SEQ ID NO: 324534 - DNA, 25 bp, Mus musculus
cagtgtggtctacatagctgcaggc

SEQ ID NO: 324535 - DNA, 25 bp, Mus musculus
cagtgtggtctagatagctgcaggc

SEQ ID NO: 324536 - DNA, 25 bp, Mus musculus
cagtgtggtgacctgcactgtacat

SEQ ID NO: 324537 - DNA, 25 bp, Mus musculus
cagtgtggtgacgtgcactgtacat

SEQ ID NO: 324538 - DNA, 25 bp, Mus musculus
cagtgtgtacatagcccctttttgc

SEQ ID NO: 324539 - DNA, 25 bp, Mus musculus
cagtgtgtacattgcccctttttgc

SEQ ID NO: 324540 - DNA, 25 bp, Mus musculus
cagtgtgtaccaatttgagatattc

SEQ ID NO: 324541 - DNA, 25 bp, Mus musculus
cagtgtgtaccattttgagatattc

SEQ ID NO: 324542 - DNA, 25 bp, Mus musculus
cagtgtgtcaatattctattttgta

SEQ ID NO: 324543 - DNA, 25 bp, Mus musculus
cagtgtgtcaattttctattttgta

SEQ ID NO: 324544 - DNA, 25 bp, Mus musculus
cagtgtgtcagccacttcttcctgt

SEQ ID NO: 324545 - DNA, 25 bp, Mus musculus
cagtgtgtcagcgacttcttcctgt

SEQ ID NO: 324546 - DNA, 25 bp, Mus musculus
cagtgtgtcagtctagaggctctac

SEQ ID NO: 324547 - DNA, 25 bp, Mus musculus
cagtgtgtcagtgtagaggctctac

SEQ ID NO: 324548 - DNA, 25 bp, Mus musculus
cagtgtgtccccatgatctttgagg

SEQ ID NO: 324549 - DNA, 25 bp, Mus musculus
cagtgtgtccccttgatctttgagg

SEQ ID NO: 324550 - DNA, 25 bp, Mus musculus
cagtgtgtgacaaaaccagttaggt

SEQ ID NO: 324551 - DNA, 25 bp, Mus musculus
cagtgtgtgacataaccagttaggt

SEQ ID NO: 324552 - DNA, 25 bp, Mus musculus
cagtgtgtggagaacgcctggctaa

SEQ ID NO: 324553 - DNA, 25 bp, Mus musculus
cagtgtgtggagtacgcctggctaa

SEQ ID NO: 324554 - DNA, 25 bp, Mus musculus
cagtgtgtggtgcattcctcttaaa

SEQ ID NO: 324555 - DNA, 25 bp, Mus musculus
cagtgtgtggtggattcctcttaaa

SEQ ID NO: 324556 - DNA, 25 bp, Mus musculus
cagtgtgtgtccacgagccaatggg

SEQ ID NO: 324557 - DNA, 25 bp, Mus musculus
cagtgtgtgtcctcgagccaatggg

SEQ ID NO: 324558 - DNA, 25 bp, Mus musculus
cagtgtgtgtgcattgatgttgcta

SEQ ID NO: 324559 - DNA, 25 bp, Mus musculus
cagtgtgtgtgctttgatgttgcta

SEQ ID NO: 324560 - DNA, 25 bp, Mus musculus
cagtgtgttcaccataaagtcatta

SEQ ID NO: 324561 - DNA, 25 bp, Mus musculus
cagtgtgttcacgataaagtcatta

SEQ ID NO: 324562 - DNA, 25 bp, Mus musculus
cagtgtgttcttcttgggtgcctat

SEQ ID NO: 324563 - DNA, 25 bp, Mus musculus
cagtgtgttcttgttgggtgcctat

SEQ ID NO: 324564 - DNA, 25 bp, Mus musculus
cagtgtgttgccatgtgctgtaact

SEQ ID NO: 324565 - DNA, 25 bp, Mus musculus
cagtgtgttgccctgtcattgaaag

SEQ ID NO: 324566 - DNA, 25 bp, Mus musculus
cagtgtgttgccgtgtcattgaaag

SEQ ID NO: 324567 - DNA, 25 bp, Mus musculus
cagtgtgttgccttgtgctgtaact

SEQ ID NO: 324568 - DNA, 25 bp, Mus musculus
cagtgtgttggcactcagtctgact

SEQ ID NO: 324569 - DNA, 25 bp, Mus musculus
cagtgtgttggctctcagtctgact

SEQ ID NO: 324570 - DNA, 25 bp, Mus musculus
cagtgtgtttaaattcattatcccc

SEQ ID NO: 324571 - DNA, 25 bp, Mus musculus
cagtgtgtttaatttcattatcccc

SEQ ID NO: 324572 - DNA, 25 bp, Mus musculus
cagtgtgtttctacttagtaaatca

SEQ ID NO: 324573 - DNA, 25 bp, Mus musculus
cagtgtgtttctcagacttctcctt

SEQ ID NO: 324574 - DNA, 25 bp, Mus musculus
cagtgtgtttctgagacttctcctt

SEQ ID NO: 324575 - DNA, 25 bp, Mus musculus
cagtgtgtttcttcttagtaaatca

SEQ ID NO: 324576 - DNA, 25 bp, Mus musculus
cagtgtgtttggctctgacattttt

SEQ ID NO: 324577 - DNA, 25 bp, Mus musculus
cagtgtgtttgggtctgacattttt

SEQ ID NO: 324578 - DNA, 25 bp, Mus musculus
cagtgtgtttgtaaagatcttgcag

SEQ ID NO: 324579 - DNA, 25 bp, Mus musculus
cagtgtgtttgttaagatcttgcag

SEQ ID NO: 324580 - DNA, 25 bp, Mus musculus
cagtgtgttttcatggccttccctg

SEQ ID NO: 324581 - DNA, 25 bp, Mus musculus
cagtgtgttttcttggccttccctg

SEQ ID NO: 324582 - DNA, 25 bp, Mus musculus
cagtgttaaagcaagcgctggactc

SEQ ID NO: 324583 - DNA, 25 bp, Mus musculus
cagtgttaaagctagcgctggactc

SEQ ID NO: 324584 - DNA, 25 bp, Mus musculus
cagtgttaacccagcattggcaatt

SEQ ID NO: 324585 - DNA, 25 bp, Mus musculus
cagtgttaaccctgcattggcaatt

SEQ ID NO: 324586 - DNA, 25 bp, Mus musculus
cagtgttaactgatcattgggaaat

SEQ ID NO: 324587 - DNA, 25 bp, Mus musculus
cagtgttaactgttcattgggaaat

SEQ ID NO: 324588 - DNA, 25 bp, Mus musculus
cagtgttaagtaccacagatgctaa

SEQ ID NO: 324589 - DNA, 25 bp, Mus musculus
cagtgttaagtagcacagatgctaa

SEQ ID NO: 324590 - DNA, 25 bp, Mus musculus
cagtgttaatgtactttgtgtccta

SEQ ID NO: 324591 - DNA, 25 bp, Mus musculus
cagtgttaatgttctttgtgtccta

SEQ ID NO: 324592 - DNA, 25 bp, Mus musculus
cagtgttacactcgagttttcggtt

SEQ ID NO: 324593 - DNA, 25 bp, Mus musculus
cagtgttacactggagttttcggtt

SEQ ID NO: 324594 - DNA, 25 bp, Mus musculus
cagtgttacagaaagatgggctcct

SEQ ID NO: 324595 - DNA, 25 bp, Mus musculus
cagtgttacagatagatgggctcct

SEQ ID NO: 324596 - DNA, 25 bp, Mus musculus
cagtgttatactatctccaaggaaa

SEQ ID NO: 324597 - DNA, 25 bp, Mus musculus
cagtgttatactttctccaaggaaa

SEQ ID NO: 324598 - DNA, 25 bp, Mus musculus
cagtgttatagcaaccttgatacac

SEQ ID NO: 324599 - DNA, 25 bp, Mus musculus
cagtgttatagctaccttgatacac

SEQ ID NO: 324600 - DNA, 25 bp, Mus musculus
cagtgttatcacagtctgatgctgt

SEQ ID NO: 324601 - DNA, 25 bp, Mus musculus
cagtgttatcactgtctgatgctgt

SEQ ID NO: 324602 - DNA, 25 bp, Mus musculus
cagtgttatcgtctgccatggcatg

SEQ ID NO: 324603 - DNA, 25 bp, Mus musculus
cagtgttatcgtgtgccatggcatg

SEQ ID NO: 324604 - DNA, 25 bp, Mus musculus
cagtgttatgttaccctggagcttt

SEQ ID NO: 324605 - DNA, 25 bp, Mus musculus
cagtgttatgtttccctggagcttt

SEQ ID NO: 324606 - DNA, 25 bp, Mus musculus
cagtgttcacttacagctgattgtt

SEQ ID NO: 324607 - DNA, 25 bp, Mus musculus
cagtgttcactttcagctgattgtt

SEQ ID NO: 324608 - DNA, 25 bp, Mus musculus
cagtgttcagggatcctatttccta

SEQ ID NO: 324609 - DNA, 25 bp, Mus musculus
cagtgttcagggttcctatttccta

SEQ ID NO: 324610 - DNA, 25 bp, Mus musculus
cagtgttcagttcagtgtggagaaa

SEQ ID NO: 324611 - DNA, 25 bp, Mus musculus
cagtgttcagttgagtgtggagaaa

SEQ ID NO: 324612 - DNA, 25 bp, Mus musculus
cagtgttcatatatatggccaggca

SEQ ID NO: 324613 - DNA, 25 bp, Mus musculus
cagtgttcatatttatggccaggca

SEQ ID NO: 324614 - DNA, 25 bp, Mus musculus
cagtgttccacccagacaggagaga

SEQ ID NO: 324615 - DNA, 25 bp, Mus musculus
cagtgttccaccgagacaggagaga

SEQ ID NO: 324616 - DNA, 25 bp, Mus musculus
cagtgttccagtacctaacctattt

SEQ ID NO: 324617 - DNA, 25 bp, Mus musculus
cagtgttccagttcctaacctattt

SEQ ID NO: 324618 - DNA, 25 bp, Mus musculus
cagtgttcccgtccgaggaaacatt

SEQ ID NO: 324619 - DNA, 25 bp, Mus musculus
cagtgttcccgtgcgaggaaacatt

SEQ ID NO: 324620 - DNA, 25 bp, Mus musculus
cagtgttcctccaggtttgggttct

SEQ ID NO: 324621 - DNA, 25 bp, Mus musculus
cagtgttcctcctggtttgggttct

SEQ ID NO: 324622 - DNA, 25 bp, Mus musculus
cagtgttcctttccaatgcatacta

SEQ ID NO: 324623 - DNA, 25 bp, Mus musculus
cagtgttcctttgcaatgcatacta

SEQ ID NO: 324624 - DNA, 25 bp, Mus musculus
cagtgttcgcggaagaggaattacc

SEQ ID NO: 324625 - DNA, 25 bp, Mus musculus
cagtgttcgcggtagaggaattacc

SEQ ID NO: 324626 - DNA, 25 bp, Mus musculus
cagtgttcgctgatggttttctaaa

SEQ ID NO: 324627 - DNA, 25 bp, Mus musculus
cagtgttcgctgttggttttctaaa

SEQ ID NO: 324628 - DNA, 25 bp, Mus musculus
cagtgttctatgcagtgtttacatt

SEQ ID NO: 324629 - DNA, 25 bp, Mus musculus
cagtgttctatggagtgtttacatt

SEQ ID NO: 324630 - DNA, 25 bp, Mus musculus
cagtgttcttacacagtgttatttg

SEQ ID NO: 324631 - DNA, 25 bp, Mus musculus
cagtgttcttacatcctgtacataa

SEQ ID NO: 324632 - DNA, 25 bp, Mus musculus
cagtgttcttacctctcttgcttta

SEQ ID NO: 324633 - DNA, 25 bp, Mus musculus
cagtgttcttacgtctcttgcttta

SEQ ID NO: 324634 - DNA, 25 bp, Mus musculus
cagtgttcttactcagtgttatttg

SEQ ID NO: 324635 - DNA, 25 bp, Mus musculus
cagtgttcttacttcctgtacataa

SEQ ID NO: 324636 - DNA, 25 bp, Mus musculus
cagtgttcttcacctatcctgaaaa

SEQ ID NO: 324637 - DNA, 25 bp, Mus musculus
cagtgttcttcagctatcctgaaaa

SEQ ID NO: 324638 - DNA, 25 bp, Mus musculus
cagtgttctttgctagtttacccgt

SEQ ID NO: 324639 - DNA, 25 bp, Mus musculus
cagtgttctttggtagtttacccgt

SEQ ID NO: 324640 - DNA, 25 bp, Mus musculus
cagtgttgaaaaagagtagcagggc

SEQ ID NO: 324641 - DNA, 25 bp, Mus musculus
cagtgttgaaaatgagtagcagggc

SEQ ID NO: 324642 - DNA, 25 bp, Mus musculus
cagtgttgaactataagagtgtcac

SEQ ID NO: 324643 - DNA, 25 bp, Mus musculus
cagtgttgaactttaagagtgtcac

SEQ ID NO: 324644 - DNA, 25 bp, Mus musculus
cagtgttgactgatatcccaccttg

SEQ ID NO: 324645 - DNA, 25 bp, Mus musculus
cagtgttgactgttatcccaccttg

SEQ ID NO: 324646 - DNA, 25 bp, Mus musculus
cagtgttgacttcttcacgatcaaa

SEQ ID NO: 324647 - DNA, 25 bp, Mus musculus
cagtgttgacttgttcacgatcaaa

SEQ ID NO: 324648 - DNA, 25 bp, Mus musculus
cagtgttgcagaacctggctatgac

SEQ ID NO: 324649 - DNA, 25 bp, Mus musculus
cagtgttgcagatcctggctatgac

SEQ ID NO: 324650 - DNA, 25 bp, Mus musculus
cagtgttgcctaaggcatgagagca

SEQ ID NO: 324651 - DNA, 25 bp, Mus musculus
cagtgttgcctactttgacctttgt

SEQ ID NO: 324652 - DNA, 25 bp, Mus musculus
cagtgttgcctagtttgacctttgt

SEQ ID NO: 324653 - DNA, 25 bp, Mus musculus
cagtgttgcctatggcatgagagca

SEQ ID NO: 324654 - DNA, 25 bp, Mus musculus
cagtgttggctgacgtaaagcattt

SEQ ID NO: 324655 - DNA, 25 bp, Mus musculus
cagtgttggctgtcgtaaagcattt

SEQ ID NO: 324656 - DNA, 25 bp, Mus musculus
cagtgttgtaggcacttgccctgaa

SEQ ID NO: 324657 - DNA, 25 bp, Mus musculus
cagtgttgtagggacttgccctgaa

SEQ ID NO: 324658 - DNA, 25 bp, Mus musculus
cagtgttgtcatataaggtatctcg

SEQ ID NO: 324659 - DNA, 25 bp, Mus musculus
cagtgttgtcatttaaggtatctcg

SEQ ID NO: 324660 - DNA, 25 bp, Mus musculus
cagtgtttaaaaattgcatttgact

SEQ ID NO: 324661 - DNA, 25 bp, Mus musculus
cagtgtttaaaatttgcatttgact

SEQ ID NO: 324662 - DNA, 25 bp, Mus musculus
cagtgtttaaatattgctcttctca

SEQ ID NO: 324663 - DNA, 25 bp, Mus musculus
cagtgtttaaattttgctcttctca

SEQ ID NO: 324664 - DNA, 25 bp, Mus musculus
cagtgtttaactaatgggtgctatt

SEQ ID NO: 324665 - DNA, 25 bp, Mus musculus
cagtgtttaacttatgggtgctatt

SEQ ID NO: 324666 - DNA, 25 bp, Mus musculus
cagtgtttacagaacttgtctccta

SEQ ID NO: 324667 - DNA, 25 bp, Mus musculus
cagtgtttacagtacttgtctccta

SEQ ID NO: 324668 - DNA, 25 bp, Mus musculus
cagtgtttaccccagcacttaataa

SEQ ID NO: 324669 - DNA, 25 bp, Mus musculus
cagtgtttacccgagcacttaataa

SEQ ID NO: 324670 - DNA, 25 bp, Mus musculus
cagtgtttagtgaaaactgttccct

SEQ ID NO: 324671 - DNA, 25 bp, Mus musculus
cagtgtttagtgtaaactgttccct

SEQ ID NO: 324672 - DNA, 25 bp, Mus musculus
cagtgtttattcatatctctactaa

SEQ ID NO: 324673 - DNA, 25 bp, Mus musculus
cagtgtttattcttatctctactaa

SEQ ID NO: 324674 - DNA, 25 bp, Mus musculus
cagtgtttcaaaatgattccctcta

SEQ ID NO: 324675 - DNA, 25 bp, Mus musculus
cagtgtttcaaattgattccctcta

SEQ ID NO: 324676 - DNA, 25 bp, Mus musculus
cagtgtttcataagacccatttttt

SEQ ID NO: 324677 - DNA, 25 bp, Mus musculus
cagtgtttcatatgacccatttttt

SEQ ID NO: 324678 - DNA, 25 bp, Mus musculus
cagtgtttcatgattcttagtgtgt

SEQ ID NO: 324679 - DNA, 25 bp, Mus musculus
cagtgtttcatgtttcttagtgtgt

SEQ ID NO: 324680 - DNA, 25 bp, Mus musculus
cagtgtttcctacagcctgggatat

SEQ ID NO: 324681 - DNA, 25 bp, Mus musculus
cagtgtttcctagagcctgggatat

SEQ ID NO: 324682 - DNA, 25 bp, Mus musculus
cagtgtttccttcttaagatttata

SEQ ID NO: 324683 - DNA, 25 bp, Mus musculus
cagtgtttccttgttaagatttata

SEQ ID NO: 324684 - DNA, 25 bp, Mus musculus
cagtgtttctgtagtcagacttgtt

SEQ ID NO: 324685 - DNA, 25 bp, Mus musculus
cagtgtttctgttgtcagacttgtt

SEQ ID NO: 324686 - DNA, 25 bp, Mus musculus
cagtgtttgcccatagccgggaagt

SEQ ID NO: 324687 - DNA, 25 bp, Mus musculus
cagtgtttgcccttagccgggaagt

SEQ ID NO: 324688 - DNA, 25 bp, Mus musculus
cagtgtttgcttcttagagggttta

SEQ ID NO: 324689 - DNA, 25 bp, Mus musculus
cagtgtttgcttgttagagggttta

SEQ ID NO: 324690 - DNA, 25 bp, Mus musculus
cagtgtttgggtccctgctcttaca

SEQ ID NO: 324691 - DNA, 25 bp, Mus musculus
cagtgtttgggtgcctgctcttaca

SEQ ID NO: 324692 - DNA, 25 bp, Mus musculus
cagtgtttgtagacccttccagcaa

SEQ ID NO: 324693 - DNA, 25 bp, Mus musculus
cagtgtttgtagctcagggatcccc

SEQ ID NO: 324694 - DNA, 25 bp, Mus musculus
cagtgtttgtaggtcagggatcccc

SEQ ID NO: 324695 - DNA, 25 bp, Mus musculus
cagtgtttgtagtcccttccagcaa

SEQ ID NO: 324696 - DNA, 25 bp, Mus musculus
cagtgttttgagcagctttttagaa

SEQ ID NO: 324697 - DNA, 25 bp, Mus musculus
cagtgttttgaggagctttttagaa

SEQ ID NO: 324698 - DNA, 25 bp, Mus musculus
cagtgttttgggagatggctcttga

SEQ ID NO: 324699 - DNA, 25 bp, Mus musculus
cagtgttttgggtgatggctcttga

SEQ ID NO: 324700 - DNA, 25 bp, Mus musculus
cagtgttttgtacatttcagatgac

SEQ ID NO: 324701 - DNA, 25 bp, Mus musculus
cagtgttttgtagatttcagatgac

SEQ ID NO: 324702 - DNA, 25 bp, Mus musculus
cagtgtttttacatactctgtccct

SEQ ID NO: 324703 - DNA, 25 bp, Mus musculus
cagtgtttttacttactctgtccct

SEQ ID NO: 324704 - DNA, 25 bp, Mus musculus
cagttaaaagtacatctggaggact

SEQ ID NO: 324705 - DNA, 25 bp, Mus musculus
cagttaaaagtagatctggaggact

SEQ ID NO: 324706 - DNA, 25 bp, Mus musculus
cagttaaaccccagtagagttgcta

SEQ ID NO: 324707 - DNA, 25 bp, Mus musculus
cagttaaacccctgtagagttgcta

SEQ ID NO: 324708 - DNA, 25 bp, Mus musculus
cagttaaacctgctgtgaggaggaa

SEQ ID NO: 324709 - DNA, 25 bp, Mus musculus
cagttaaacctggtgtgaggaggaa

SEQ ID NO: 324710 - DNA, 25 bp, Mus musculus
cagttaaactatcctgtggccttac

SEQ ID NO: 324711 - DNA, 25 bp, Mus musculus
cagttaaactatgctgtggccttac

SEQ ID NO: 324712 - DNA, 25 bp, Mus musculus
cagttaaagcctccatggtttaggg

SEQ ID NO: 324713 - DNA, 25 bp, Mus musculus
cagttaaagcctgcatggtttaggg

SEQ ID NO: 324714 - DNA, 25 bp, Mus musculus
cagttaaatttgctcctcaaaatgt

SEQ ID NO: 324715 - DNA, 25 bp, Mus musculus
cagttaaatttggtcctcaaaatgt

SEQ ID NO: 324716 - DNA, 25 bp, Mus musculus
cagttaacctcgactagtttagcag

SEQ ID NO: 324717 - DNA, 25 bp, Mus musculus
cagttaacctcgtctagtttagcag

SEQ ID NO: 324718 - DNA, 25 bp, Mus musculus
cagttaactagcatctgagtctggc

SEQ ID NO: 324719 - DNA, 25 bp, Mus musculus
cagttaactagcttctgagtctggc

SEQ ID NO: 324720 - DNA, 25 bp, Mus musculus
cagttaactgcactgagtgctgtgg

SEQ ID NO: 324721 - DNA, 25 bp, Mus musculus
cagttaactgcagtgagtgctgtgg

SEQ ID NO: 324722 - DNA, 25 bp, Mus musculus
cagttaagcttcagggataattgcc

SEQ ID NO: 324723 - DNA, 25 bp, Mus musculus
cagttaagcttctgggataattgcc

SEQ ID NO: 324724 - DNA, 25 bp, Mus musculus
cagttaatcagactcctttgctagg

SEQ ID NO: 324725 - DNA, 25 bp, Mus musculus
cagttaatcagagtcctttgctagg

SEQ ID NO: 324726 - DNA, 25 bp, Mus musculus
cagttaatgcgacttatggtggcca

SEQ ID NO: 324727 - DNA, 25 bp, Mus musculus
cagttaatgcgagttatggtggcca

SEQ ID NO: 324728 - DNA, 25 bp, Mus musculus
cagttaatgggtagccagaggacca

SEQ ID NO: 324729 - DNA, 25 bp, Mus musculus
cagttaatgggttgccagaggacca

SEQ ID NO: 324730 - DNA, 25 bp, Mus musculus
cagttaattctcaggctaaggtccc

SEQ ID NO: 324731 - DNA, 25 bp, Mus musculus
cagttaattctctggctaaggtccc

SEQ ID NO: 324732 - DNA, 25 bp, Mus musculus
cagttaatttatactaatctcctac

SEQ ID NO: 324733 - DNA, 25 bp, Mus musculus
cagttaatttattctaatctcctac

SEQ ID NO: 324734 - DNA, 25 bp, Mus musculus
cagttacaatatccactgggtaaag

SEQ ID NO: 324735 - DNA, 25 bp, Mus musculus
cagttacaatatgcactgggtaaag

SEQ ID NO: 324736 - DNA, 25 bp, Mus musculus
cagttacacattccctgccgaaggg

SEQ ID NO: 324737 - DNA, 25 bp, Mus musculus
cagttacacattgcctgccgaaggg

SEQ ID NO: 324738 - DNA, 25 bp, Mus musculus
cagttacaccttcagattctttcta

SEQ ID NO: 324739 - DNA, 25 bp, Mus musculus
cagttacaccttgagattctttcta

SEQ ID NO: 324740 - DNA, 25 bp, Mus musculus
cagttacactgcagagggagaaaca

SEQ ID NO: 324741 - DNA, 25 bp, Mus musculus
cagttacactgctgagggagaaaca

SEQ ID NO: 324742 - DNA, 25 bp, Mus musculus
cagttacagaagctcactgctcaga

SEQ ID NO: 324743 - DNA, 25 bp, Mus musculus
cagttacagaaggtcactgctcaga

SEQ ID NO: 324744 - DNA, 25 bp, Mus musculus
cagttacagtagaggctgctccagc

SEQ ID NO: 324745 - DNA, 25 bp, Mus musculus
cagttacagtagtggctgctccagc

SEQ ID NO: 324746 - DNA, 25 bp, Mus musculus
cagttacagtctaacaaatggttcc

SEQ ID NO: 324747 - DNA, 25 bp, Mus musculus
cagttacagtcttacaaatggttcc

SEQ ID NO: 324748 - DNA, 25 bp, Mus musculus
cagttaccagaaacttgctgctcaa

SEQ ID NO: 324749 - DNA, 25 bp, Mus musculus
cagttaccagaatcttgctgctcaa

SEQ ID NO: 324750 - DNA, 25 bp, Mus musculus
cagttaccccgtcatgggttttgag

SEQ ID NO: 324751 - DNA, 25 bp, Mus musculus
cagttaccccgtgatgggttttgag

SEQ ID NO: 324752 - DNA, 25 bp, Mus musculus
cagttacctagcagctgggcaatta

SEQ ID NO: 324753 - DNA, 25 bp, Mus musculus
cagttacctagctgctgggcaatta

SEQ ID NO: 324754 - DNA, 25 bp, Mus musculus
cagttacctagtctcctaccaatat

SEQ ID NO: 324755 - DNA, 25 bp, Mus musculus
cagttacctagtgtcctaccaatat

SEQ ID NO: 324756 - DNA, 25 bp, Mus musculus
cagttacctcacagacgtctatttt

SEQ ID NO: 324757 - DNA, 25 bp, Mus musculus
cagttacctcactgacgtctatttt

SEQ ID NO: 324758 - DNA, 25 bp, Mus musculus
cagttactccctctactagctggtt

SEQ ID NO: 324759 - DNA, 25 bp, Mus musculus
cagttactccctgtactagctggtt

SEQ ID NO: 324760 - DNA, 25 bp, Mus musculus
cagttactctatctggtgactttca

SEQ ID NO: 324761 - DNA, 25 bp, Mus musculus
cagttactctatgtggtgactttca

SEQ ID NO: 324762 - DNA, 25 bp, Mus musculus
cagttactctcaccacagcataaat

SEQ ID NO: 324763 - DNA, 25 bp, Mus musculus
cagttactctcagcacagcataaat

SEQ ID NO: 324764 - DNA, 25 bp, Mus musculus
cagttactgagcacaaatcacttaa

SEQ ID NO: 324765 - DNA, 25 bp, Mus musculus
cagttactgagctcaaatcacttaa

SEQ ID NO: 324766 - DNA, 25 bp, Mus musculus
cagttactgctgctcatgtgtacat

SEQ ID NO: 324767 - DNA, 25 bp, Mus musculus
cagttactgctggtcatgtgtacat

SEQ ID NO: 324768 - DNA, 25 bp, Mus musculus
cagttactggataggcttctcattt

SEQ ID NO: 324769 - DNA, 25 bp, Mus musculus
cagttactggattggcttctcattt

SEQ ID NO: 324770 - DNA, 25 bp, Mus musculus
cagttactggttacctttgacgata

SEQ ID NO: 324771 - DNA, 25 bp, Mus musculus
cagttactggtttcctttgacgata

SEQ ID NO: 324772 - DNA, 25 bp, Mus musculus
cagttactgtgactggtgcccatca

SEQ ID NO: 324773 - DNA, 25 bp, Mus musculus
cagttactgtgagtggtgcccatca

SEQ ID NO: 324774 - DNA, 25 bp, Mus musculus
cagttactgttcagtgctggagaaa

SEQ ID NO: 324775 - DNA, 25 bp, Mus musculus
cagttactgttctgtgctggagaaa

SEQ ID NO: 324776 - DNA, 25 bp, Mus musculus
cagttacttcccatcttactttttg

SEQ ID NO: 324777 - DNA, 25 bp, Mus musculus
cagttacttcccttcttactttttg

SEQ ID NO: 324778 - DNA, 25 bp, Mus musculus
cagttactttctaaatttcgctagg

SEQ ID NO: 324779 - DNA, 25 bp, Mus musculus
cagttactttcttaatttcgctagg

SEQ ID NO: 324780 - DNA, 25 bp, Mus musculus
cagttagaagcaatcagcacagggc

SEQ ID NO: 324781 - DNA, 25 bp, Mus musculus
cagttagaagcattcagcacagggc

SEQ ID NO: 324782 - DNA, 25 bp, Mus musculus
cagttagagtagcacccagttttgt

SEQ ID NO: 324783 - DNA, 25 bp, Mus musculus
cagttagagtaggacccagttttgt

SEQ ID NO: 324784 - DNA, 25 bp, Mus musculus
cagttagcagttcttcatgtccagc

SEQ ID NO: 324785 - DNA, 25 bp, Mus musculus
cagttagcagttgttcatgtccagc

SEQ ID NO: 324786 - DNA, 25 bp, Mus musculus
cagttagctgtaagtctgtaagtca

SEQ ID NO: 324787 - DNA, 25 bp, Mus musculus
cagttagctgtatgtctgtaagtca

SEQ ID NO: 324788 - DNA, 25 bp, Mus musculus
cagttaggatttatcgcttgcgagc

SEQ ID NO: 324789 - DNA, 25 bp, Mus musculus
cagttaggatttttcgcttgcgagc

SEQ ID NO: 324790 - DNA, 25 bp, Mus musculus
cagttagggaaaaggacatgtacaa

SEQ ID NO: 324791 - DNA, 25 bp, Mus musculus
cagttagggaaatggacatgtacaa

SEQ ID NO: 324792 - DNA, 25 bp, Mus musculus
cagttagggtctaaacctccatgtt

SEQ ID NO: 324793 - DNA, 25 bp, Mus musculus
cagttagggtcttaacctccatgtt

SEQ ID NO: 324794 - DNA, 25 bp, Mus musculus
cagttaggtaccacctgtactggaa

SEQ ID NO: 324795 - DNA, 25 bp, Mus musculus
cagttaggtacctcctgtactggaa

SEQ ID NO: 324796 - DNA, 25 bp, Mus musculus
cagttagttgagagcctgcctggca

SEQ ID NO: 324797 - DNA, 25 bp, Mus musculus
cagttagttgagtgcctgcctggca

SEQ ID NO: 324798 - DNA, 25 bp, Mus musculus
cagttataagaaaatctttgcctcc

SEQ ID NO: 324799 - DNA, 25 bp, Mus musculus
cagttataagaatatctttgcctcc

SEQ ID NO: 324800 - DNA, 25 bp, Mus musculus
cagttatacataaggctgacctgta

SEQ ID NO: 324801 - DNA, 25 bp, Mus musculus
cagttatacatatggctgacctgta

SEQ ID NO: 324802 - DNA, 25 bp, Mus musculus
cagttatagcctcccactcggtggt

SEQ ID NO: 324803 - DNA, 25 bp, Mus musculus
cagttatagcctgccactcggtggt

SEQ ID NO: 324804 - DNA, 25 bp, Mus musculus
cagttatagttaagtgcagcacctc

SEQ ID NO: 324805 - DNA, 25 bp, Mus musculus
cagttatagttatgtgcagcacctc

SEQ ID NO: 324806 - DNA, 25 bp, Mus musculus
cagttatatcacctatgctatttta

SEQ ID NO: 324807 - DNA, 25 bp, Mus musculus
cagttatatcacgtatgctatttta

SEQ ID NO: 324808 - DNA, 25 bp, Mus musculus
cagttatatctgcagggtcctcatt

SEQ ID NO: 324809 - DNA, 25 bp, Mus musculus
cagttatatctggagggtcctcatt

SEQ ID NO: 324810 - DNA, 25 bp, Mus musculus
cagttatcacggctgtggtgctaaa

SEQ ID NO: 324811 - DNA, 25 bp, Mus musculus
cagttatcacgggtgtggtgctaaa

SEQ ID NO: 324812 - DNA, 25 bp, Mus musculus
cagttatcactgaaaagacaggcaa

SEQ ID NO: 324813 - DNA, 25 bp, Mus musculus
cagttatcactgtaaagacaggcaa

SEQ ID NO: 324814 - DNA, 25 bp, Mus musculus
cagttatcatgaaatccttgtgtaa

SEQ ID NO: 324815 - DNA, 25 bp, Mus musculus
cagttatcatgatatccttgtgtaa

SEQ ID NO: 324816 - DNA, 25 bp, Mus musculus
cagttatctgtcatggtcttgccgt

SEQ ID NO: 324817 - DNA, 25 bp, Mus musculus
cagttatctgtcttggtcttgccgt

SEQ ID NO: 324818 - DNA, 25 bp, Mus musculus
cagttatcttcaattctgctgctct

SEQ ID NO: 324819 - DNA, 25 bp, Mus musculus
cagttatcttcatttctgctgctct

SEQ ID NO: 324820 - DNA, 25 bp, Mus musculus
cagttatgacacagttctattttcc

SEQ ID NO: 324821 - DNA, 25 bp, Mus musculus
cagttatgacactgttctattttcc

SEQ ID NO: 324822 - DNA, 25 bp, Mus musculus
cagttatgcagacgactgtccaagc

SEQ ID NO: 324823 - DNA, 25 bp, Mus musculus
cagttatgcagaggactgtccaagc

SEQ ID NO: 324824 - DNA, 25 bp, Mus musculus
cagttatggcctacaccctgcacat

SEQ ID NO: 324825 - DNA, 25 bp, Mus musculus
cagttatggccttcaccctgcacat

SEQ ID NO: 324826 - DNA, 25 bp, Mus musculus
cagttatgggctacatgaggacaat

SEQ ID NO: 324827 - DNA, 25 bp, Mus musculus
cagttatgggcttcatgaggacaat

SEQ ID NO: 324828 - DNA, 25 bp, Mus musculus
cagttatgggtgcttctgagctgcc

SEQ ID NO: 324829 - DNA, 25 bp, Mus musculus
cagttatgggtggttctgagctgcc

SEQ ID NO: 324830 - DNA, 25 bp, Mus musculus
cagttattacttctacttcatgata

SEQ ID NO: 324831 - DNA, 25 bp, Mus musculus
cagttattacttgtacttcatgata

SEQ ID NO: 324832 - DNA, 25 bp, Mus musculus
cagttattgaacagtggccattgca

SEQ ID NO: 324833 - DNA, 25 bp, Mus musculus
cagttattgaactgtggccattgca

SEQ ID NO: 324834 - DNA, 25 bp, Mus musculus
cagttattttggattcttgggctaa

SEQ ID NO: 324835 - DNA, 25 bp, Mus musculus
cagttattttggtttcttgggctaa

SEQ ID NO: 324836 - DNA, 25 bp, Mus musculus
cagttatttttccatcaccaagaga

SEQ ID NO: 324837 - DNA, 25 bp, Mus musculus
cagttatttttcgatcaccaagaga

SEQ ID NO: 324838 - DNA, 25 bp, Mus musculus
cagttcaaacccaaatgcgtacttt

SEQ ID NO: 324839 - DNA, 25 bp, Mus musculus
cagttcaaacccatgctggcaaagt

SEQ ID NO: 324840 - DNA, 25 bp, Mus musculus
cagttcaaaccctaatgcgtacttt

SEQ ID NO: 324841 - DNA, 25 bp, Mus musculus
cagttcaaacccttgctggcaaagt

SEQ ID NO: 324842 - DNA, 25 bp, Mus musculus
cagttcaaaggcacccaataaaaca

SEQ ID NO: 324843 - DNA, 25 bp, Mus musculus
cagttcaaaggctcccaataaaaca

SEQ ID NO: 324844 - DNA, 25 bp, Mus musculus
cagttcaaatacctcaatcccattt

SEQ ID NO: 324845 - DNA, 25 bp, Mus musculus
cagttcaaatacgtcaatcccattt

SEQ ID NO: 324846 - DNA, 25 bp, Mus musculus
cagttcaacaatccgtggctgctca

SEQ ID NO: 324847 - DNA, 25 bp, Mus musculus
cagttcaacaatgcgtggctgctca

SEQ ID NO: 324848 - DNA, 25 bp, Mus musculus
cagttcaaggccagcagatagttgg

SEQ ID NO: 324849 - DNA, 25 bp, Mus musculus
cagttcaaggcctgcagatagttgg

SEQ ID NO: 324850 - DNA, 25 bp, Mus musculus
cagttcaagttacatggccagttta

SEQ ID NO: 324851 - DNA, 25 bp, Mus musculus
cagttcaagttagatggccagttta

SEQ ID NO: 324852 - DNA, 25 bp, Mus musculus
cagttcacactaacaacggctttgt

SEQ ID NO: 324853 - DNA, 25 bp, Mus musculus
cagttcacactatcaacggctttgt

SEQ ID NO: 324854 - DNA, 25 bp, Mus musculus
cagttcacactgcattgttatctga

SEQ ID NO: 324855 - DNA, 25 bp, Mus musculus
cagttcacactggattgttatctga

SEQ ID NO: 324856 - DNA, 25 bp, Mus musculus
cagttcacatatcgcccttagcagc

SEQ ID NO: 324857 - DNA, 25 bp, Mus musculus
cagttcacatatggcccttagcagc

SEQ ID NO: 324858 - DNA, 25 bp, Mus musculus
cagttcacatttccaaatcgcccgt

SEQ ID NO: 324859 - DNA, 25 bp, Mus musculus
cagttcacatttgcaaatcgcccgt

SEQ ID NO: 324860 - DNA, 25 bp, Mus musculus
cagttcaccttaccaaagactctat

SEQ ID NO: 324861 - DNA, 25 bp, Mus musculus
cagttcaccttagcaaagactctat

SEQ ID NO: 324862 - DNA, 25 bp, Mus musculus
cagttcactcatcatcagcacaaag

SEQ ID NO: 324863 - DNA, 25 bp, Mus musculus
cagttcactcatgatcagcacaaag

SEQ ID NO: 324864 - DNA, 25 bp, Mus musculus
cagttcactctcctgactgttcaga

SEQ ID NO: 324865 - DNA, 25 bp, Mus musculus
cagttcactctcgtgactgttcaga

SEQ ID NO: 324866 - DNA, 25 bp, Mus musculus
cagttcactgatcatgttagcaaac

SEQ ID NO: 324867 - DNA, 25 bp, Mus musculus
cagttcactgatgatgttagcaaac

SEQ ID NO: 324868 - DNA, 25 bp, Mus musculus
cagttcacttacatgctgtgtgtgt

SEQ ID NO: 324869 - DNA, 25 bp, Mus musculus
cagttcacttacttgctgtgtgtgt

SEQ ID NO: 324870 - DNA, 25 bp, Mus musculus
cagttcagaactaccgatgcccggc

SEQ ID NO: 324871 - DNA, 25 bp, Mus musculus
cagttcagaacttccgatgcccggc

SEQ ID NO: 324872 - DNA, 25 bp, Mus musculus
cagttcagccaacgtcagtgtgttt

SEQ ID NO: 324873 - DNA, 25 bp, Mus musculus
cagttcagccaaggtcagtgtgttt

SEQ ID NO: 324874 - DNA, 25 bp, Mus musculus
cagttcaggaagagctcatatccct

SEQ ID NO: 324875 - DNA, 25 bp, Mus musculus
cagttcaggaagtgctcatatccct

SEQ ID NO: 324876 - DNA, 25 bp, Mus musculus
cagttcaggcctctgtgtgtatgca

SEQ ID NO: 324877 - DNA, 25 bp, Mus musculus
cagttcaggcctgtgtgtgtatgca

SEQ ID NO: 324878 - DNA, 25 bp, Mus musculus
cagttcaggctgcttggacaggttt

SEQ ID NO: 324879 - DNA, 25 bp, Mus musculus
cagttcaggctggttggacaggttt

SEQ ID NO: 324880 - DNA, 25 bp, Mus musculus
cagttcagtcttcggctaatttaca

SEQ ID NO: 324881 - DNA, 25 bp, Mus musculus
cagttcagtcttgggctaatttaca

SEQ ID NO: 324882 - DNA, 25 bp, Mus musculus
cagttcatagcaaagttgtacttgg

SEQ ID NO: 324883 - DNA, 25 bp, Mus musculus
cagttcatagcatagttgtacttgg

SEQ ID NO: 324884 - DNA, 25 bp, Mus musculus
cagttcatagtcatcttccataaaa

SEQ ID NO: 324885 - DNA, 25 bp, Mus musculus
cagttcatagtcttcttccataaaa

SEQ ID NO: 324886 - DNA, 25 bp, Mus musculus
cagttcatattgattattggctatt

SEQ ID NO: 324887 - DNA, 25 bp, Mus musculus
cagttcatattgtttattggctatt

SEQ ID NO: 324888 - DNA, 25 bp, Mus musculus
cagttcatcagacctgtttctcaag

SEQ ID NO: 324889 - DNA, 25 bp, Mus musculus
cagttcatcagagctgtttctcaag

SEQ ID NO: 324890 - DNA, 25 bp, Mus musculus
cagttcatccagctttccaaagttg

SEQ ID NO: 324891 - DNA, 25 bp, Mus musculus
cagttcatccaggtttccaaagttg

SEQ ID NO: 324892 - DNA, 25 bp, Mus musculus
cagttcatcttccagcagcctgagg

SEQ ID NO: 324893 - DNA, 25 bp, Mus musculus
cagttcatcttcgagcagcctgagg

SEQ ID NO: 324894 - DNA, 25 bp, Mus musculus
cagttcatgctcatgagtttcagta

SEQ ID NO: 324895 - DNA, 25 bp, Mus musculus
cagttcatgctcttgagtttcagta

SEQ ID NO: 324896 - DNA, 25 bp, Mus musculus
cagttcatggtgcagaatgggttga

SEQ ID NO: 324897 - DNA, 25 bp, Mus musculus
cagttcatggtggagaatgggttga

SEQ ID NO: 324898 - DNA, 25 bp, Mus musculus
cagttcatgtaaaacccacgaaaca

SEQ ID NO: 324899 - DNA, 25 bp, Mus musculus
cagttcatgtaatacccacgaaaca

SEQ ID NO: 324900 - DNA, 25 bp, Mus musculus
cagttcattctaaaggcagtttttt

SEQ ID NO: 324901 - DNA, 25 bp, Mus musculus
cagttcattctataggcagtttttt

SEQ ID NO: 324902 - DNA, 25 bp, Mus musculus
cagttcattttacagtacaaacttt

SEQ ID NO: 324903 - DNA, 25 bp, Mus musculus
cagttcattttagagtacaaacttt

SEQ ID NO: 324904 - DNA, 25 bp, Mus musculus
cagttccaaagtacttacaacagag

SEQ ID NO: 324905 - DNA, 25 bp, Mus musculus
cagttccaaagttcttacaacagag

SEQ ID NO: 324906 - DNA, 25 bp, Mus musculus
cagttccacaacaaaacgccctgga

SEQ ID NO: 324907 - DNA, 25 bp, Mus musculus
cagttccacaactaaacgccctgga

SEQ ID NO: 324908 - DNA, 25 bp, Mus musculus
cagttccacagactattggcgacat

SEQ ID NO: 324909 - DNA, 25 bp, Mus musculus
cagttccacagagtattggcgacat

SEQ ID NO: 324910 - DNA, 25 bp, Mus musculus
cagttccaccatagttaaataagtt

SEQ ID NO: 324911 - DNA, 25 bp, Mus musculus
cagttccaccattgttaaataagtt

SEQ ID NO: 324912 - DNA, 25 bp, Mus musculus
cagttccacgacaccaagatcaaat

SEQ ID NO: 324913 - DNA, 25 bp, Mus musculus
cagttccacgactccaagatcaaat

SEQ ID NO: 324914 - DNA, 25 bp, Mus musculus
cagttccacttaagtatcttttcat

SEQ ID NO: 324915 - DNA, 25 bp, Mus musculus
cagttccacttatgtatcttttcat

SEQ ID NO: 324916 - DNA, 25 bp, Mus musculus
cagttccagaacatgcggcaagtga

SEQ ID NO: 324917 - DNA, 25 bp, Mus musculus
cagttccagaacttgcggcaagtga

SEQ ID NO: 324918 - DNA, 25 bp, Mus musculus
cagttccagccaattgccttgaatg

SEQ ID NO: 324919 - DNA, 25 bp, Mus musculus
cagttccagccatttgccttgaatg

SEQ ID NO: 324920 - DNA, 25 bp, Mus musculus
cagttccagcccaattatatctgtg

SEQ ID NO: 324921 - DNA, 25 bp, Mus musculus
cagttccagccctattatatctgtg

SEQ ID NO: 324922 - DNA, 25 bp, Mus musculus
cagttccaggcacctctggatggat

SEQ ID NO: 324923 - DNA, 25 bp, Mus musculus
cagttccaggcagctctggatggat

SEQ ID NO: 324924 - DNA, 25 bp, Mus musculus
cagttcccaactatctgcagaagat

SEQ ID NO: 324925 - DNA, 25 bp, Mus musculus
cagttcccaactttctgcagaagat

SEQ ID NO: 324926 - DNA, 25 bp, Mus musculus
cagttcccactgattaaatttcagg

SEQ ID NO: 324927 - DNA, 25 bp, Mus musculus
cagttcccactgtttaaatttcagg

SEQ ID NO: 324928 - DNA, 25 bp, Mus musculus
cagttcccagaaattttaagtgatg

SEQ ID NO: 324929 - DNA, 25 bp, Mus musculus
cagttcccagaatttttaagtgatg

SEQ ID NO: 324930 - DNA, 25 bp, Mus musculus
cagttcccagcccttgtagcggaat

SEQ ID NO: 324931 - DNA, 25 bp, Mus musculus
cagttcccagccgttgtagcggaat

SEQ ID NO: 324932 - DNA, 25 bp, Mus musculus
cagttcccaggaccccatatagagg

SEQ ID NO: 324933 - DNA, 25 bp, Mus musculus
cagttcccaggagcccatatagagg

SEQ ID NO: 324934 - DNA, 25 bp, Mus musculus
cagttcccaggtcttaaaactcttg

SEQ ID NO: 324935 - DNA, 25 bp, Mus musculus
cagttcccaggtgttaaaactcttg

SEQ ID NO: 324936 - DNA, 25 bp, Mus musculus
cagttcccatgcctcacatgaataa

SEQ ID NO: 324937 - DNA, 25 bp, Mus musculus
cagttcccatgcgtcacatgaataa

SEQ ID NO: 324938 - DNA, 25 bp, Mus musculus
cagttccccagcaatggacggagga

SEQ ID NO: 324939 - DNA, 25 bp, Mus musculus
cagttccccagctatggacggagga

SEQ ID NO: 324940 - DNA, 25 bp, Mus musculus
cagttccccattcatccagaaggtc

SEQ ID NO: 324941 - DNA, 25 bp, Mus musculus
cagttccccattgatccagaaggtc

SEQ ID NO: 324942 - DNA, 25 bp, Mus musculus
cagttccccgaaactacaagacagt

SEQ ID NO: 324943 - DNA, 25 bp, Mus musculus
cagttccccgaatctacaagacagt

SEQ ID NO: 324944 - DNA, 25 bp, Mus musculus
cagttccctgatccaaagaccgata

SEQ ID NO: 324945 - DNA, 25 bp, Mus musculus
cagttccctgatgcaaagaccgata

SEQ ID NO: 324946 - DNA, 25 bp, Mus musculus
cagttccctggaatcaaggaagttc

SEQ ID NO: 324947 - DNA, 25 bp, Mus musculus
cagttccctggattcaaggaagttc

SEQ ID NO: 324948 - DNA, 25 bp, Mus musculus
cagttccctgggagtggcattcctt

SEQ ID NO: 324949 - DNA, 25 bp, Mus musculus
cagttccctgggtgtggcattcctt

SEQ ID NO: 324950 - DNA, 25 bp, Mus musculus
cagttccgaatccagttgcagagga

SEQ ID NO: 324951 - DNA, 25 bp, Mus musculus
cagttccgaatcgagttgcagagga

SEQ ID NO: 324952 - DNA, 25 bp, Mus musculus
cagttccgtgcaaactttggtgtga

SEQ ID NO: 324953 - DNA, 25 bp, Mus musculus
cagttccgtgcatactttggtgtga

SEQ ID NO: 324954 - DNA, 25 bp, Mus musculus
cagttcctaaatcatactgtggaaa

SEQ ID NO: 324955 - DNA, 25 bp, Mus musculus
cagttcctaaatgatactgtggaaa

SEQ ID NO: 324956 - DNA, 25 bp, Mus musculus
cagttcctaaccaattttcaacact

SEQ ID NO: 324957 - DNA, 25 bp, Mus musculus
cagttcctaacctattttcaacact

SEQ ID NO: 324958 - DNA, 25 bp, Mus musculus
cagttcctacatatcagtcaatcct

SEQ ID NO: 324959 - DNA, 25 bp, Mus musculus
cagttcctacatttcagtcaatcct

SEQ ID NO: 324960 - DNA, 25 bp, Mus musculus
cagttcctagtgatctgactccctt

SEQ ID NO: 324961 - DNA, 25 bp, Mus musculus
cagttcctagtgttctgactccctt

SEQ ID NO: 324962 - DNA, 25 bp, Mus musculus
cagttcctatggcagctatgagaga

SEQ ID NO: 324963 - DNA, 25 bp, Mus musculus
cagttcctatgggagctatgagaga

SEQ ID NO: 324964 - DNA, 25 bp, Mus musculus
cagttcctatgtagtcatgtgctta

SEQ ID NO: 324965 - DNA, 25 bp, Mus musculus
cagttcctatgtcttagctctacct

SEQ ID NO: 324966 - DNA, 25 bp, Mus musculus
cagttcctatgtgttagctctacct

SEQ ID NO: 324967 - DNA, 25 bp, Mus musculus
cagttcctatgttgtcatgtgctta

SEQ ID NO: 324968 - DNA, 25 bp, Mus musculus
cagttcctccctatggagtagtaat

SEQ ID NO: 324969 - DNA, 25 bp, Mus musculus
cagttcctccctttggagtagtaat

SEQ ID NO: 324970 - DNA, 25 bp, Mus musculus
cagttcctctgaagcagccactctg

SEQ ID NO: 324971 - DNA, 25 bp, Mus musculus
cagttcctctgatgcagccactctg

SEQ ID NO: 324972 - DNA, 25 bp, Mus musculus
cagttcctctggcaagtgtccttta

SEQ ID NO: 324973 - DNA, 25 bp, Mus musculus
cagttcctctgggaagtgtccttta

SEQ ID NO: 324974 - DNA, 25 bp, Mus musculus
cagttcctgaatcttgatcctgaat

SEQ ID NO: 324975 - DNA, 25 bp, Mus musculus
cagttcctgaatgttgatcctgaat

SEQ ID NO: 324976 - DNA, 25 bp, Mus musculus
cagttcctgacccaggtaaggtctt

SEQ ID NO: 324977 - DNA, 25 bp, Mus musculus
cagttcctgaccgaggtaaggtctt

SEQ ID NO: 324978 - DNA, 25 bp, Mus musculus
cagttcctgcaaagccgtaacttga

SEQ ID NO: 324979 - DNA, 25 bp, Mus musculus
cagttcctgcaatgccgtaacttga

SEQ ID NO: 324980 - DNA, 25 bp, Mus musculus
cagttcctgccgagatgtcctgcca

SEQ ID NO: 324981 - DNA, 25 bp, Mus musculus
cagttcctgccgtgatgtcctgcca

SEQ ID NO: 324982 - DNA, 25 bp, Mus musculus
cagttcctggagagctggtcctgaa

SEQ ID NO: 324983 - DNA, 25 bp, Mus musculus
cagttcctggagtgctggtcctgaa

SEQ ID NO: 324984 - DNA, 25 bp, Mus musculus
cagttcctgggcaaagatgagtatc

SEQ ID NO: 324985 - DNA, 25 bp, Mus musculus
cagttcctgggctaagatgagtatc

SEQ ID NO: 324986 - DNA, 25 bp, Mus musculus
cagttcctgtccacaaactagtttt

SEQ ID NO: 324987 - DNA, 25 bp, Mus musculus
cagttcctgtcctcaaactagtttt

SEQ ID NO: 324988 - DNA, 25 bp, Mus musculus
cagttcctgttgaaggtttcgcata

SEQ ID NO: 324989 - DNA, 25 bp, Mus musculus
cagttcctgttgtaggtttcgcata

SEQ ID NO: 324990 - DNA, 25 bp, Mus musculus
cagttccttctaatttccaaaagat

SEQ ID NO: 324991 - DNA, 25 bp, Mus musculus
cagttccttctattttccaaaagat

SEQ ID NO: 324992 - DNA, 25 bp, Mus musculus
cagttccttgtcattatgcagtaaa

SEQ ID NO: 324993 - DNA, 25 bp, Mus musculus
cagttccttgtctttatgcagtaaa

SEQ ID NO: 324994 - DNA, 25 bp, Mus musculus
cagttcctttagacaattcgtggct

SEQ ID NO: 324995 - DNA, 25 bp, Mus musculus
cagttcctttagtcaattcgtggct

SEQ ID NO: 324996 - DNA, 25 bp, Mus musculus
cagttcctttcgacttatgagtatt

SEQ ID NO: 324997 - DNA, 25 bp, Mus musculus
cagttcctttcgtcttatgagtatt

SEQ ID NO: 324998 - DNA, 25 bp, Mus musculus
cagttcgctttgatgctgcaggaaa

SEQ ID NO: 324999 - DNA, 25 bp, Mus musculus
cagttcgctttgttgctgcaggaaa

SEQ ID NO: 325000 - DNA, 25 bp, Mus musculus
cagttcgtcggcacagtgaacctgg

SEQ ID NO: 325001 - DNA, 25 bp, Mus musculus
cagttcgtcggctcagtgaacctgg

SEQ ID NO: 325002 - DNA, 25 bp, Mus musculus
cagttcgtggagctgttctgatctt

SEQ ID NO: 325003 - DNA, 25 bp, Mus musculus
cagttcgtggaggtgttctgatctt

SEQ ID NO: 325004 - DNA, 25 bp, Mus musculus
cagttcgtggtgaagtggtcagaca

SEQ ID NO: 325005 - DNA, 25 bp, Mus musculus
cagttcgtggtgtagtggtcagaca

SEQ ID NO: 325006 - DNA, 25 bp, Mus musculus
cagttctaacttagcaagtgctttt

SEQ ID NO: 325007 - DNA, 25 bp, Mus musculus
cagttctaactttgcaagtgctttt

SEQ ID NO: 325008 - DNA, 25 bp, Mus musculus
cagttctaatggacctgacaccctc

SEQ ID NO: 325009 - DNA, 25 bp, Mus musculus
cagttctaatggtcctgacaccctc

SEQ ID NO: 325010 - DNA, 25 bp, Mus musculus
cagttctacaatctgcattctgagg

SEQ ID NO: 325011 - DNA, 25 bp, Mus musculus
cagttctacaatgtgcattctgagg

SEQ ID NO: 325012 - DNA, 25 bp, Mus musculus
cagttctacctacttaccattcttt

SEQ ID NO: 325013 - DNA, 25 bp, Mus musculus
cagttctacctagttaccattcttt

SEQ ID NO: 325014 - DNA, 25 bp, Mus musculus
cagttctactaacctcactgtggga

SEQ ID NO: 325015 - DNA, 25 bp, Mus musculus
cagttctactaagctcactgtggga

SEQ ID NO: 325016 - DNA, 25 bp, Mus musculus
cagttctagactcgctggtgcagcc

SEQ ID NO: 325017 - DNA, 25 bp, Mus musculus
cagttctagactggctggtgcagcc

SEQ ID NO: 325018 - DNA, 25 bp, Mus musculus
cagttctatacaaccagagctggat

SEQ ID NO: 325019 - DNA, 25 bp, Mus musculus
cagttctatacatccagagctggat

SEQ ID NO: 325020 - DNA, 25 bp, Mus musculus
cagttctatcagaggcagtgcaata

SEQ ID NO: 325021 - DNA, 25 bp, Mus musculus
cagttctatcagtggcagtgcaata

SEQ ID NO: 325022 - DNA, 25 bp, Mus musculus
cagttctcaagtacaacaccatgtg

SEQ ID NO: 325023 - DNA, 25 bp, Mus musculus
cagttctcaagttcaacaccatgtg

SEQ ID NO: 325024 - DNA, 25 bp, Mus musculus
cagttctcactgcttatattttgtt

SEQ ID NO: 325025 - DNA, 25 bp, Mus musculus
cagttctcactggttatattttgtt

SEQ ID NO: 325026 - DNA, 25 bp, Mus musculus
cagttctcacttaagttggtaagtt

SEQ ID NO: 325027 - DNA, 25 bp, Mus musculus
cagttctcactttagttggtaagtt

SEQ ID NO: 325028 - DNA, 25 bp, Mus musculus
cagttctcagcaaccgtggtgggtg

SEQ ID NO: 325029 - DNA, 25 bp, Mus musculus
cagttctcagcatccgtggtgggtg

SEQ ID NO: 325030 - DNA, 25 bp, Mus musculus
cagttctcgatacccagtctgaaat

SEQ ID NO: 325031 - DNA, 25 bp, Mus musculus
cagttctcgatagccagtctgaaat

SEQ ID NO: 325032 - DNA, 25 bp, Mus musculus
cagttctcgcacatccaacttgaac

SEQ ID NO: 325033 - DNA, 25 bp, Mus musculus
cagttctcgcacttccaacttgaac

SEQ ID NO: 325034 - DNA, 25 bp, Mus musculus
cagttctcgctcaggttttatgaga

SEQ ID NO: 325035 - DNA, 25 bp, Mus musculus
cagttctcgctctggttttatgaga

SEQ ID NO: 325036 - DNA, 25 bp, Mus musculus
cagttctctatgattttgttggcga

SEQ ID NO: 325037 - DNA, 25 bp, Mus musculus
cagttctctatgtttttgttggcga

SEQ ID NO: 325038 - DNA, 25 bp, Mus musculus
cagttctctctcaggagtttctgaa

SEQ ID NO: 325039 - DNA, 25 bp, Mus musculus
cagttctctctctggagtttctgaa

SEQ ID NO: 325040 - DNA, 25 bp, Mus musculus
cagttctctgctctatgtgtgttga

SEQ ID NO: 325041 - DNA, 25 bp, Mus musculus
cagttctctgctgtatgtgtgttga

SEQ ID NO: 325042 - DNA, 25 bp, Mus musculus
cagttctctggtcctgggattgttg

SEQ ID NO: 325043 - DNA, 25 bp, Mus musculus
cagttctctggtgctgggattgttg

SEQ ID NO: 325044 - DNA, 25 bp, Mus musculus
cagttctctttcatatggcgtgcag

SEQ ID NO: 325045 - DNA, 25 bp, Mus musculus
cagttctctttcttatggcgtgcag

SEQ ID NO: 325046 - DNA, 25 bp, Mus musculus
cagttctcttttactaccgtgtaag

SEQ ID NO: 325047 - DNA, 25 bp, Mus musculus
cagttctctttttctaccgtgtaag

SEQ ID NO: 325048 - DNA, 25 bp, Mus musculus
cagttctgaaagagacgtgtggagc

SEQ ID NO: 325049 - DNA, 25 bp, Mus musculus
cagttctgaaagtgacgtgtggagc

SEQ ID NO: 325050 - DNA, 25 bp, Mus musculus
cagttctgaacacacccagtcatga

SEQ ID NO: 325051 - DNA, 25 bp, Mus musculus
cagttctgaacagacccagtcatga

SEQ ID NO: 325052 - DNA, 25 bp, Mus musculus
cagttctgagatccagtcccttctt

SEQ ID NO: 325053 - DNA, 25 bp, Mus musculus
cagttctgagatgcagtcccttctt

SEQ ID NO: 325054 - DNA, 25 bp, Mus musculus
cagttctgagtaatctgggacatac

SEQ ID NO: 325055 - DNA, 25 bp, Mus musculus
cagttctgagtattctgggacatac

SEQ ID NO: 325056 - DNA, 25 bp, Mus musculus
cagttctgcatcattgcccaagaag

SEQ ID NO: 325057 - DNA, 25 bp, Mus musculus
cagttctgcatctttgcccaagaag

SEQ ID NO: 325058 - DNA, 25 bp, Mus musculus
cagttctgccgccttgggtgatgaa

SEQ ID NO: 325059 - DNA, 25 bp, Mus musculus
cagttctgccgcgttgggtgatgaa

SEQ ID NO: 325060 - DNA, 25 bp, Mus musculus
cagttctgggatagtggtttcttta

SEQ ID NO: 325061 - DNA, 25 bp, Mus musculus
cagttctgggattgtggtttcttta

SEQ ID NO: 325062 - DNA, 25 bp, Mus musculus
cagttctggtttagcctttggaaag

SEQ ID NO: 325063 - DNA, 25 bp, Mus musculus
cagttctggttttgcctttggaaag

SEQ ID NO: 325064 - DNA, 25 bp, Mus musculus
cagttctgtgtaatgggctatataa

SEQ ID NO: 325065 - DNA, 25 bp, Mus musculus
cagttctgtgtattgggctatataa

SEQ ID NO: 325066 - DNA, 25 bp, Mus musculus
cagttctgttttctcttcaatccca

SEQ ID NO: 325067 - DNA, 25 bp, Mus musculus
cagttctgttttgtcttcaatccca

SEQ ID NO: 325068 - DNA, 25 bp, Mus musculus
cagttcttaagtcttcctttcttct

SEQ ID NO: 325069 - DNA, 25 bp, Mus musculus
cagttcttaagtgttcctttcttct

SEQ ID NO: 325070 - DNA, 25 bp, Mus musculus
cagttcttaattcttttctatacaa

SEQ ID NO: 325071 - DNA, 25 bp, Mus musculus
cagttcttaattgttttctatacaa

SEQ ID NO: 325072 - DNA, 25 bp, Mus musculus
cagttcttacagacaggattcccaa

SEQ ID NO: 325073 - DNA, 25 bp, Mus musculus
cagttcttacagtcaggattcccaa

SEQ ID NO: 325074 - DNA, 25 bp, Mus musculus
cagttcttaggcatcagcaattaca

SEQ ID NO: 325075 - DNA, 25 bp, Mus musculus
cagttcttaggcttcagcaattaca

SEQ ID NO: 325076 - DNA, 25 bp, Mus musculus
cagttcttcatccacatttgcatac

SEQ ID NO: 325077 - DNA, 25 bp, Mus musculus
cagttcttcatcgacatttgcatac

SEQ ID NO: 325078 - DNA, 25 bp, Mus musculus
cagttcttcatgcagcatgtttcaa

SEQ ID NO: 325079 - DNA, 25 bp, Mus musculus
cagttcttcatggagcatgtttcaa

SEQ ID NO: 325080 - DNA, 25 bp, Mus musculus
cagttcttcccaaagaccatgccaa

SEQ ID NO: 325081 - DNA, 25 bp, Mus musculus
cagttcttcccatagaccatgccaa

SEQ ID NO: 325082 - DNA, 25 bp, Mus musculus
cagttcttcggacgcctcgtcaaca

SEQ ID NO: 325083 - DNA, 25 bp, Mus musculus
cagttcttcggaggcctcgtcaaca

SEQ ID NO: 325084 - DNA, 25 bp, Mus musculus
cagttcttctggagctaagttccca

SEQ ID NO: 325085 - DNA, 25 bp, Mus musculus
cagttcttctggtgctaagttccca

SEQ ID NO: 325086 - DNA, 25 bp, Mus musculus
cagttcttggagcagctgcttacca

SEQ ID NO: 325087 - DNA, 25 bp, Mus musculus
cagttcttggaggagctgcttacca

SEQ ID NO: 325088 - DNA, 25 bp, Mus musculus
cagttctttcctcttgggtgttcaa

SEQ ID NO: 325089 - DNA, 25 bp, Mus musculus
cagttctttcctgttgggtgttcaa

SEQ ID NO: 325090 - DNA, 25 bp, Mus musculus
cagttctttgacaatgcctcatatg

SEQ ID NO: 325091 - DNA, 25 bp, Mus musculus
cagttctttgactatgcctcatatg

SEQ ID NO: 325092 - DNA, 25 bp, Mus musculus
cagttctttggaatgctcccattta

SEQ ID NO: 325093 - DNA, 25 bp, Mus musculus
cagttctttggattgctcccattta

SEQ ID NO: 325094 - DNA, 25 bp, Mus musculus
cagttctttgtgatcatacgagatt

SEQ ID NO: 325095 - DNA, 25 bp, Mus musculus
cagttctttgtgttcatacgagatt

SEQ ID NO: 325096 - DNA, 25 bp, Mus musculus
cagttctttttacgctcagtttttg

SEQ ID NO: 325097 - DNA, 25 bp, Mus musculus
cagttctttttaggctcagtttttg

SEQ ID NO: 325098 - DNA, 25 bp, Mus musculus
cagttgaaacagatggtgcctcagt

SEQ ID NO: 325099 - DNA, 25 bp, Mus musculus
cagttgaaacagttggtgcctcagt

SEQ ID NO: 325100 - DNA, 25 bp, Mus musculus
cagttgaaagtcatctgagctgtga

SEQ ID NO: 325101 - DNA, 25 bp, Mus musculus
cagttgaaagtcttctgagctgtga

SEQ ID NO: 325102 - DNA, 25 bp, Mus musculus
cagttgaaggaaagtatgggtgact

SEQ ID NO: 325103 - DNA, 25 bp, Mus musculus
cagttgaaggaatgtatgggtgact

SEQ ID NO: 325104 - DNA, 25 bp, Mus musculus
cagttgaatgtaagccatcttgagg

SEQ ID NO: 325105 - DNA, 25 bp, Mus musculus
cagttgaatgtatgccatcttgagg

SEQ ID NO: 325106 - DNA, 25 bp, Mus musculus
cagttgacaaacactctgtgtagtt

SEQ ID NO: 325107 - DNA, 25 bp, Mus musculus
cagttgacaaactctctgtgtagtt

SEQ ID NO: 325108 - DNA, 25 bp, Mus musculus
cagttgacagttcggttgactcttt

SEQ ID NO: 325109 - DNA, 25 bp, Mus musculus
cagttgacagttcgtcttccaggcc

SEQ ID NO: 325110 - DNA, 25 bp, Mus musculus
cagttgacagttgggttgactcttt

SEQ ID NO: 325111 - DNA, 25 bp, Mus musculus
cagttgacagttggtcttccaggcc

SEQ ID NO: 325112 - DNA, 25 bp, Mus musculus
cagttgacccttcacacagagtgcc

SEQ ID NO: 325113 - DNA, 25 bp, Mus musculus
cagttgacccttgacacagagtgcc

SEQ ID NO: 325114 - DNA, 25 bp, Mus musculus
cagttgacttacagtttcttacctt

SEQ ID NO: 325115 - DNA, 25 bp, Mus musculus
cagttgacttactgtttcttacctt

SEQ ID NO: 325116 - DNA, 25 bp, Mus musculus
cagttgacttatatcccaggatgca

SEQ ID NO: 325117 - DNA, 25 bp, Mus musculus
cagttgacttatttcccaggatgca

SEQ ID NO: 325118 - DNA, 25 bp, Mus musculus
cagttgagaagtatgtttttgcttt

SEQ ID NO: 325119 - DNA, 25 bp, Mus musculus
cagttgagaagtttgtttttgcttt

SEQ ID NO: 325120 - DNA, 25 bp, Mus musculus
cagttgagagctcccatcttccaca

SEQ ID NO: 325121 - DNA, 25 bp, Mus musculus
cagttgagagctgccatcttccaca

SEQ ID NO: 325122 - DNA, 25 bp, Mus musculus
cagttgaggttcagtctccccaggg

SEQ ID NO: 325123 - DNA, 25 bp, Mus musculus
cagttgaggttctgtctccccaggg

SEQ ID NO: 325124 - DNA, 25 bp, Mus musculus
cagttgagtttgctaccgtggtaca

SEQ ID NO: 325125 - DNA, 25 bp, Mus musculus
cagttgagtttggtaccgtggtaca

SEQ ID NO: 325126 - DNA, 25 bp, Mus musculus
cagttgataattaggccctcagctt

SEQ ID NO: 325127 - DNA, 25 bp, Mus musculus
cagttgataatttggccctcagctt

SEQ ID NO: 325128 - DNA, 25 bp, Mus musculus
cagttgatgatgacacgttgcgttg

SEQ ID NO: 325129 - DNA, 25 bp, Mus musculus
cagttgatgatgtcacgttgcgttg

SEQ ID NO: 325130 - DNA, 25 bp, Mus musculus
cagttgatgattagttcctgagaag

SEQ ID NO: 325131 - DNA, 25 bp, Mus musculus
cagttgatgatttgttcctgagaag

SEQ ID NO: 325132 - DNA, 25 bp, Mus musculus
cagttgatggttctctctctgcaag

SEQ ID NO: 325133 - DNA, 25 bp, Mus musculus
cagttgatggttgtctctctgcaag

SEQ ID NO: 325134 - DNA, 25 bp, Mus musculus
cagttgattggcatgctgctggctt

SEQ ID NO: 325135 - DNA, 25 bp, Mus musculus
cagttgattggcttgctgctggctt

SEQ ID NO: 325136 - DNA, 25 bp, Mus musculus
cagttgcaaaaaccagacgctccat

SEQ ID NO: 325137 - DNA, 25 bp, Mus musculus
cagttgcaaaaagcagacgctccat

SEQ ID NO: 325138 - DNA, 25 bp, Mus musculus
cagttgcacacacgagtgtcggtgt

SEQ ID NO: 325139 - DNA, 25 bp, Mus musculus
cagttgcacacaggagtgtcggtgt

SEQ ID NO: 325140 - DNA, 25 bp, Mus musculus
cagttgcacagcatccaagcctctt

SEQ ID NO: 325141 - DNA, 25 bp, Mus musculus
cagttgcacagcttccaagcctctt

SEQ ID NO: 325142 - DNA, 25 bp, Mus musculus
cagttgcagcatagtctacacatcc

SEQ ID NO: 325143 - DNA, 25 bp, Mus musculus
cagttgcagcattgtctacacatcc

SEQ ID NO: 325144 - DNA, 25 bp, Mus musculus
cagttgcagccacaagctgcttctc

SEQ ID NO: 325145 - DNA, 25 bp, Mus musculus
cagttgcagccagaagctgcttctc

SEQ ID NO: 325146 - DNA, 25 bp, Mus musculus
cagttgcatgaaatccctagccaga

SEQ ID NO: 325147 - DNA, 25 bp, Mus musculus
cagttgcatgaattccctagccaga

SEQ ID NO: 325148 - DNA, 25 bp, Mus musculus
cagttgccagcaaacgccagtcttg

SEQ ID NO: 325149 - DNA, 25 bp, Mus musculus
cagttgccagcatacgccagtcttg

SEQ ID NO: 325150 - DNA, 25 bp, Mus musculus
cagttgccaggtatttacagctttg

SEQ ID NO: 325151 - DNA, 25 bp, Mus musculus
cagttgccaggtttttacagctttg

SEQ ID NO: 325152 - DNA, 25 bp, Mus musculus
cagttgccatttctcgacaagaagt

SEQ ID NO: 325153 - DNA, 25 bp, Mus musculus
cagttgccatttgtcgacaagaagt

SEQ ID NO: 325154 - DNA, 25 bp, Mus musculus
cagttgcccctgagttagtggagga

SEQ ID NO: 325155 - DNA, 25 bp, Mus musculus
cagttgcccctgtgttagtggagga

SEQ ID NO: 325156 - DNA, 25 bp, Mus musculus
cagttgcccgcactctgtgcaagga

SEQ ID NO: 325157 - DNA, 25 bp, Mus musculus
cagttgcccgcagtctgtgcaagga

SEQ ID NO: 325158 - DNA, 25 bp, Mus musculus
cagttgcccgtgagaatttgctata

SEQ ID NO: 325159 - DNA, 25 bp, Mus musculus
cagttgcccgtgtgaatttgctata

SEQ ID NO: 325160 - DNA, 25 bp, Mus musculus
cagttgccctctcagtaagatcctt

SEQ ID NO: 325161 - DNA, 25 bp, Mus musculus
cagttgccctctgagtaagatcctt

SEQ ID NO: 325162 - DNA, 25 bp, Mus musculus
cagttgcctctgcaaatggagctga

SEQ ID NO: 325163 - DNA, 25 bp, Mus musculus
cagttgcctctggaaatggagctga

SEQ ID NO: 325164 - DNA, 25 bp, Mus musculus
cagttgcctttcattcagcagctat

SEQ ID NO: 325165 - DNA, 25 bp, Mus musculus
cagttgcctttctttcagcagctat

SEQ ID NO: 325166 - DNA, 25 bp, Mus musculus
cagttgcgaaacagcctggaggcct

SEQ ID NO: 325167 - DNA, 25 bp, Mus musculus
cagttgcgaaactgcctggaggcct

SEQ ID NO: 325168 - DNA, 25 bp, Mus musculus
cagttgcgaagtaatttgccattac

SEQ ID NO: 325169 - DNA, 25 bp, Mus musculus
cagttgcgaagttatttgccattac

SEQ ID NO: 325170 - DNA, 25 bp, Mus musculus
cagttgctatgaagtgaccgcgcca

SEQ ID NO: 325171 - DNA, 25 bp, Mus musculus
cagttgctatgatgtgaccgcgcca

SEQ ID NO: 325172 - DNA, 25 bp, Mus musculus
cagttgctccacaggaatttctata

SEQ ID NO: 325173 - DNA, 25 bp, Mus musculus
cagttgctccactggaatttctata

SEQ ID NO: 325174 - DNA, 25 bp, Mus musculus
cagttgctcctccaaaggtgcagag

SEQ ID NO: 325175 - DNA, 25 bp, Mus musculus
cagttgctcctcgaaaggtgcagag

SEQ ID NO: 325176 - DNA, 25 bp, Mus musculus
cagttgctctgtcggcattctggga

SEQ ID NO: 325177 - DNA, 25 bp, Mus musculus
cagttgctctgtgggcattctggga

SEQ ID NO: 325178 - DNA, 25 bp, Mus musculus
cagttgctggctagtagtgtcatca

SEQ ID NO: 325179 - DNA, 25 bp, Mus musculus
cagttgctggcttgtagtgtcatca

SEQ ID NO: 325180 - DNA, 25 bp, Mus musculus
cagttgctgtgtatgaaatacctta

SEQ ID NO: 325181 - DNA, 25 bp, Mus musculus
cagttgctgtgtttgaaatacctta

SEQ ID NO: 325182 - DNA, 25 bp, Mus musculus
cagttgctgtttcttagttggttgg

SEQ ID NO: 325183 - DNA, 25 bp, Mus musculus
cagttgctgtttgttagttggttgg

SEQ ID NO: 325184 - DNA, 25 bp, Mus musculus
cagttgcttattattggccttggcc

SEQ ID NO: 325185 - DNA, 25 bp, Mus musculus
cagttgcttatttttggccttggcc

SEQ ID NO: 325186 - DNA, 25 bp, Mus musculus
cagttgctttctcgcttgagtcggc

SEQ ID NO: 325187 - DNA, 25 bp, Mus musculus
cagttgctttctggcttgagtcggc

SEQ ID NO: 325188 - DNA, 25 bp, Mus musculus
cagttgctttgacaggtgcacagga

SEQ ID NO: 325189 - DNA, 25 bp, Mus musculus
cagttgctttgagaggtgcacagga

SEQ ID NO: 325190 - DNA, 25 bp, Mus musculus
cagttggaaaacatcttagagacgt

SEQ ID NO: 325191 - DNA, 25 bp, Mus musculus
cagttggaaaacttcttagagacgt

SEQ ID NO: 325192 - DNA, 25 bp, Mus musculus
cagttggaagctatacccgatttaa

SEQ ID NO: 325193 - DNA, 25 bp, Mus musculus
cagttggaagctttacccgatttaa

SEQ ID NO: 325194 - DNA, 25 bp, Mus musculus
cagttggacaatcaagcctggaaac

SEQ ID NO: 325195 - DNA, 25 bp, Mus musculus
cagttggacaatgaagcctggaaac

SEQ ID NO: 325196 - DNA, 25 bp, Mus musculus
cagttggaccctccttgtgatttgg

SEQ ID NO: 325197 - DNA, 25 bp, Mus musculus
cagttggaccctgcttgtgatttgg

SEQ ID NO: 325198 - DNA, 25 bp, Mus musculus
cagttggactctagtctggcctgag

SEQ ID NO: 325199 - DNA, 25 bp, Mus musculus
cagttggactcttgtctggcctgag

SEQ ID NO: 325200 - DNA, 25 bp, Mus musculus
cagttggactgtctgctcttttata

SEQ ID NO: 325201 - DNA, 25 bp, Mus musculus
cagttggactgtgtgctcttttata

SEQ ID NO: 325202 - DNA, 25 bp, Mus musculus
cagttggcatttctttgaaattgta

SEQ ID NO: 325203 - DNA, 25 bp, Mus musculus
cagttggcatttgtttgaaattgta

SEQ ID NO: 325204 - DNA, 25 bp, Mus musculus
cagttggcgaaaattccaggcaaat

SEQ ID NO: 325205 - DNA, 25 bp, Mus musculus
cagttggcgaaatttccaggcaaat

SEQ ID NO: 325206 - DNA, 25 bp, Mus musculus
cagttggcggagacagtggatgtac

SEQ ID NO: 325207 - DNA, 25 bp, Mus musculus
cagttggcggagtcagtggatgtac

SEQ ID NO: 325208 - DNA, 25 bp, Mus musculus
cagttggcttgccaagcaggctcca

SEQ ID NO: 325209 - DNA, 25 bp, Mus musculus
cagttggcttgcgaagcaggctcca

SEQ ID NO: 325210 - DNA, 25 bp, Mus musculus
cagttgggaaacctgagccttatag

SEQ ID NO: 325211 - DNA, 25 bp, Mus musculus
cagttgggaaacgtgagccttatag

SEQ ID NO: 325212 - DNA, 25 bp, Mus musculus
cagttgggacatctttaccccccat

SEQ ID NO: 325213 - DNA, 25 bp, Mus musculus
cagttgggacatgtttaccccccat

SEQ ID NO: 325214 - DNA, 25 bp, Mus musculus
cagttgggctcacgtgtttcttaat

SEQ ID NO: 325215 - DNA, 25 bp, Mus musculus
cagttgggctcaggtgtttcttaat

SEQ ID NO: 325216 - DNA, 25 bp, Mus musculus
cagttgggctgtatcttaacctgaa

SEQ ID NO: 325217 - DNA, 25 bp, Mus musculus
cagttgggctgtttcttaacctgaa

SEQ ID NO: 325218 - DNA, 25 bp, Mus musculus
cagttgggttgactcttttattggg

SEQ ID NO: 325219 - DNA, 25 bp, Mus musculus
cagttgggttgagtcttttattggg

SEQ ID NO: 325220 - DNA, 25 bp, Mus musculus
cagttgggtttgatgcctttagacg

SEQ ID NO: 325221 - DNA, 25 bp, Mus musculus
cagttgggtttgttgcctttagacg

SEQ ID NO: 325222 - DNA, 25 bp, Mus musculus
cagttgggttttagctgtactgcta

SEQ ID NO: 325223 - DNA, 25 bp, Mus musculus
cagttgggtttttgctgtactgcta

SEQ ID NO: 325224 - DNA, 25 bp, Mus musculus
cagttggtactgcaaaatgaattga

SEQ ID NO: 325225 - DNA, 25 bp, Mus musculus
cagttggtactggaaaatgaattga

SEQ ID NO: 325226 - DNA, 25 bp, Mus musculus
cagttggtagtgaacttgtgtggaa

SEQ ID NO: 325227 - DNA, 25 bp, Mus musculus
cagttggtagtgtacttgtgtggaa

SEQ ID NO: 325228 - DNA, 25 bp, Mus musculus
cagttggtatggagccatcggacgt

SEQ ID NO: 325229 - DNA, 25 bp, Mus musculus
cagttggtatggtgccatcggacgt

SEQ ID NO: 325230 - DNA, 25 bp, Mus musculus
cagttggtcccaattagcacagtga

SEQ ID NO: 325231 - DNA, 25 bp, Mus musculus
cagttggtcccatttagcacagtga

SEQ ID NO: 325232 - DNA, 25 bp, Mus musculus
cagttggtcctcacaccttttaaag

SEQ ID NO: 325233 - DNA, 25 bp, Mus musculus
cagttggtcctctcaccttttaaag

SEQ ID NO: 325234 - DNA, 25 bp, Mus musculus
cagttggtgaggactaggtttagtt

SEQ ID NO: 325235 - DNA, 25 bp, Mus musculus
cagttggtgaggtctaggtttagtt

SEQ ID NO: 325236 - DNA, 25 bp, Mus musculus
cagttggtgcctactctgtaactta

SEQ ID NO: 325237 - DNA, 25 bp, Mus musculus
cagttggtgccttctctgtaactta

SEQ ID NO: 325238 - DNA, 25 bp, Mus musculus
cagttggtggctagcatgtagaaga

SEQ ID NO: 325239 - DNA, 25 bp, Mus musculus
cagttggtggcttgcatgtagaaga

SEQ ID NO: 325240 - DNA, 25 bp, Mus musculus
cagttggtgtgcattagaaaatgat

SEQ ID NO: 325241 - DNA, 25 bp, Mus musculus
cagttggtgtgctttagaaaatgat

SEQ ID NO: 325242 - DNA, 25 bp, Mus musculus
cagttggttctgctatatggtaaag

SEQ ID NO: 325243 - DNA, 25 bp, Mus musculus
cagttggttctggtatatggtaaag

SEQ ID NO: 325244 - DNA, 25 bp, Mus musculus
cagttgtaaatgataccgcttccaa

SEQ ID NO: 325245 - DNA, 25 bp, Mus musculus
cagttgtaaatgttaccgcttccaa

SEQ ID NO: 325246 - DNA, 25 bp, Mus musculus
cagttgtaatggctattcccgtgag

SEQ ID NO: 325247 - DNA, 25 bp, Mus musculus
cagttgtaatgggtattcccgtgag

SEQ ID NO: 325248 - DNA, 25 bp, Mus musculus
cagttgtacatacctgacgccctgg

SEQ ID NO: 325249 - DNA, 25 bp, Mus musculus
cagttgtacatagctgacgccctgg

SEQ ID NO: 325250 - DNA, 25 bp, Mus musculus
cagttgtatatgatgtttgtcaggg

SEQ ID NO: 325251 - DNA, 25 bp, Mus musculus
cagttgtatatgttgtttgtcaggg

SEQ ID NO: 325252 - DNA, 25 bp, Mus musculus
cagttgtatcacagaatcatttctt

SEQ ID NO: 325253 - DNA, 25 bp, Mus musculus
cagttgtatcactgaatcatttctt

SEQ ID NO: 325254 - DNA, 25 bp, Mus musculus
cagttgtatcagattaattggagca

SEQ ID NO: 325255 - DNA, 25 bp, Mus musculus
cagttgtatcagtttaattggagca

SEQ ID NO: 325256 - DNA, 25 bp, Mus musculus
cagttgtattcaagagatgttcaga

SEQ ID NO: 325257 - DNA, 25 bp, Mus musculus
cagttgtattcatgagatgttcaga

SEQ ID NO: 325258 - DNA, 25 bp, Mus musculus
cagttgtcaggcaaatttacgtatc

SEQ ID NO: 325259 - DNA, 25 bp, Mus musculus
cagttgtcaggctaatttacgtatc

SEQ ID NO: 325260 - DNA, 25 bp, Mus musculus
cagttgtcagtacagcccagggcgc

SEQ ID NO: 325261 - DNA, 25 bp, Mus musculus
cagttgtcagtagagcccagggcgc

SEQ ID NO: 325262 - DNA, 25 bp, Mus musculus
cagttgtcatggacccatgcctggg

SEQ ID NO: 325263 - DNA, 25 bp, Mus musculus
cagttgtcatggtcccatgcctggg

SEQ ID NO: 325264 - DNA, 25 bp, Mus musculus
cagttgtcattgcatctcatccaaa

SEQ ID NO: 325265 - DNA, 25 bp, Mus musculus
cagttgtcattggatctcatccaaa

SEQ ID NO: 325266 - DNA, 25 bp, Mus musculus
cagttgtccctcactgagatttgga

SEQ ID NO: 325267 - DNA, 25 bp, Mus musculus
cagttgtccctctctgagatttgga

SEQ ID NO: 325268 - DNA, 25 bp, Mus musculus
cagttgtcctggctttgagacctaa

SEQ ID NO: 325269 - DNA, 25 bp, Mus musculus
cagttgtcctgggtttgagacctaa

SEQ ID NO: 325270 - DNA, 25 bp, Mus musculus
cagttgtctaagcaccaggtcttca

SEQ ID NO: 325271 - DNA, 25 bp, Mus musculus
cagttgtctaaggaccaggtcttca

SEQ ID NO: 325272 - DNA, 25 bp, Mus musculus
cagttgtctcccagactgagaaaga

SEQ ID NO: 325273 - DNA, 25 bp, Mus musculus
cagttgtctccctgactgagaaaga

SEQ ID NO: 325274 - DNA, 25 bp, Mus musculus
cagttgtctgctatgtaattttcta

SEQ ID NO: 325275 - DNA, 25 bp, Mus musculus
cagttgtctgctttgtaattttcta

SEQ ID NO: 325276 - DNA, 25 bp, Mus musculus
cagttgtctgtcatcctgggctatg

SEQ ID NO: 325277 - DNA, 25 bp, Mus musculus
cagttgtctgtcttcctgggctatg

SEQ ID NO: 325278 - DNA, 25 bp, Mus musculus
cagttgtcttctcccagccatggat

SEQ ID NO: 325279 - DNA, 25 bp, Mus musculus
cagttgtcttctgccagccatggat

SEQ ID NO: 325280 - DNA, 25 bp, Mus musculus
cagttgtgaaatccaaatgttctct

SEQ ID NO: 325281 - DNA, 25 bp, Mus musculus
cagttgtgaaatgcaaatgttctct

SEQ ID NO: 325282 - DNA, 25 bp, Mus musculus
cagttgtgatgtactgtgttacatt

SEQ ID NO: 325283 - DNA, 25 bp, Mus musculus
cagttgtgatgttctgtgttacatt

SEQ ID NO: 325284 - DNA, 25 bp, Mus musculus
cagttgtgcaaaatcttaagaccta

SEQ ID NO: 325285 - DNA, 25 bp, Mus musculus
cagttgtgcaaattcttaagaccta

SEQ ID NO: 325286 - DNA, 25 bp, Mus musculus
cagttgtgcaatcaacaaggtgctt

SEQ ID NO: 325287 - DNA, 25 bp, Mus musculus
cagttgtgcaatgaacaaggtgctt

SEQ ID NO: 325288 - DNA, 25 bp, Mus musculus
cagttgtgctcactggtgtgaagaa

SEQ ID NO: 325289 - DNA, 25 bp, Mus musculus
cagttgtgctcagtggtgtgaagaa

SEQ ID NO: 325290 - DNA, 25 bp, Mus musculus
cagttgtggcccagtgatctggaca

SEQ ID NO: 325291 - DNA, 25 bp, Mus musculus
cagttgtggccctgtgatctggaca

SEQ ID NO: 325292 - DNA, 25 bp, Mus musculus
cagttgtggtttaccgtgatgggct

SEQ ID NO: 325293 - DNA, 25 bp, Mus musculus
cagttgtggttttccgtgatgggct

SEQ ID NO: 325294 - DNA, 25 bp, Mus musculus
cagttgtgtcttagcggacatctgg

SEQ ID NO: 325295 - DNA, 25 bp, Mus musculus
cagttgtgtctttgcggacatctgg

SEQ ID NO: 325296 - DNA, 25 bp, Mus musculus
cagttgtgttttcgcctgtgttcta

SEQ ID NO: 325297 - DNA, 25 bp, Mus musculus
cagttgtgttttggcctgtgttcta

SEQ ID NO: 325298 - DNA, 25 bp, Mus musculus
cagttgttacagaagaccgtgtgcg

SEQ ID NO: 325299 - DNA, 25 bp, Mus musculus
cagttgttacagtagaccgtgtgcg

SEQ ID NO: 325300 - DNA, 25 bp, Mus musculus
cagttgttagaaccaaccctccatc

SEQ ID NO: 325301 - DNA, 25 bp, Mus musculus
cagttgttagaagcaaccctccatc

SEQ ID NO: 325302 - DNA, 25 bp, Mus musculus
cagttgttagtgacggtgctacccc

SEQ ID NO: 325303 - DNA, 25 bp, Mus musculus
cagttgttagtgtcggtgctacccc

SEQ ID NO: 325304 - DNA, 25 bp, Mus musculus
cagttgttccaacactttccgaaag

SEQ ID NO: 325305 - DNA, 25 bp, Mus musculus
cagttgttccaagactttccgaaag

SEQ ID NO: 325306 - DNA, 25 bp, Mus musculus
cagttgttgaaaagccacgtgataa

SEQ ID NO: 325307 - DNA, 25 bp, Mus musculus
cagttgttgaaatgccacgtgataa

SEQ ID NO: 325308 - DNA, 25 bp, Mus musculus
cagttgttggctaaatgatagacat

SEQ ID NO: 325309 - DNA, 25 bp, Mus musculus
cagttgttggcttaatgatagacat

SEQ ID NO: 325310 - DNA, 25 bp, Mus musculus
cagttgttgtacacaatcctagaaa

SEQ ID NO: 325311 - DNA, 25 bp, Mus musculus
cagttgttgtactcaatcctagaaa

SEQ ID NO: 325312 - DNA, 25 bp, Mus musculus
cagttgtttaatcctagtctcaaag

SEQ ID NO: 325313 - DNA, 25 bp, Mus musculus
cagttgtttaatgctagtctcaaag

SEQ ID NO: 325314 - DNA, 25 bp, Mus musculus
cagttgtttcctcggtgctttacca

SEQ ID NO: 325315 - DNA, 25 bp, Mus musculus
cagttgtttcctgggtgctttacca

SEQ ID NO: 325316 - DNA, 25 bp, Mus musculus
cagttgttttgccagacagtcagaa

SEQ ID NO: 325317 - DNA, 25 bp, Mus musculus
cagttgttttgcgagacagtcagaa

SEQ ID NO: 325318 - DNA, 25 bp, Mus musculus
cagttgttttgtacatagtgtttca

SEQ ID NO: 325319 - DNA, 25 bp, Mus musculus
cagttgttttgttcatagtgtttca

SEQ ID NO: 325320 - DNA, 25 bp, Mus musculus
cagtttaaaaccaatggcatctgcg

SEQ ID NO: 325321 - DNA, 25 bp, Mus musculus
cagtttaaaacctatggcatctgcg

SEQ ID NO: 325322 - DNA, 25 bp, Mus musculus
cagtttaaagagacccaggccacct

SEQ ID NO: 325323 - DNA, 25 bp, Mus musculus
cagtttaaagagtcccaggccacct

SEQ ID NO: 325324 - DNA, 25 bp, Mus musculus
cagtttaacctgctttccacgctgt

SEQ ID NO: 325325 - DNA, 25 bp, Mus musculus
cagtttaacctggtttccacgctgt

SEQ ID NO: 325326 - DNA, 25 bp, Mus musculus
cagtttaaggcacagatcctcgagt

SEQ ID NO: 325327 - DNA, 25 bp, Mus musculus
cagtttaaggcagagatcctcgagt

SEQ ID NO: 325328 - DNA, 25 bp, Mus musculus
cagtttaataagcacgtagcttgga

SEQ ID NO: 325329 - DNA, 25 bp, Mus musculus
cagtttaataaggacgtagcttgga

SEQ ID NO: 325330 - DNA, 25 bp, Mus musculus
cagtttacaacacgccagtccagtc

SEQ ID NO: 325331 - DNA, 25 bp, Mus musculus
cagtttacaacaggccagtccagtc

SEQ ID NO: 325332 - DNA, 25 bp, Mus musculus
cagtttacaagtcccagtccatggg

SEQ ID NO: 325333 - DNA, 25 bp, Mus musculus
cagtttacaagtgccagtccatggg

SEQ ID NO: 325334 - DNA, 25 bp, Mus musculus
cagtttaccaacaatgggctggtgg

SEQ ID NO: 325335 - DNA, 25 bp, Mus musculus
cagtttaccaactatgggctggtgg

SEQ ID NO: 325336 - DNA, 25 bp, Mus musculus
cagtttagcctgctgtggtctgaat

SEQ ID NO: 325337 - DNA, 25 bp, Mus musculus
cagtttagcctggtgtggtctgaat

SEQ ID NO: 325338 - DNA, 25 bp, Mus musculus
cagtttaggtgccagcaaccctgcg

SEQ ID NO: 325339 - DNA, 25 bp, Mus musculus
cagtttaggtgcgagcaaccctgcg

SEQ ID NO: 325340 - DNA, 25 bp, Mus musculus
cagtttagtggcacttccagcctgc

SEQ ID NO: 325341 - DNA, 25 bp, Mus musculus
cagtttagtggctcttccagcctgc

SEQ ID NO: 325342 - DNA, 25 bp, Mus musculus
cagtttagtttgaaccgagaggcat

SEQ ID NO: 325343 - DNA, 25 bp, Mus musculus
cagtttagtttgtaccgagaggcat

SEQ ID NO: 325344 - DNA, 25 bp, Mus musculus
cagtttagttttcatcatgtgtgag

SEQ ID NO: 325345 - DNA, 25 bp, Mus musculus
cagtttagttttgatcatgtgtgag

SEQ ID NO: 325346 - DNA, 25 bp, Mus musculus
cagtttatacacagagccagggcgc

SEQ ID NO: 325347 - DNA, 25 bp, Mus musculus
cagtttatacactgagccagggcgc

SEQ ID NO: 325348 - DNA, 25 bp, Mus musculus
cagtttatagctactcatgcaggga

SEQ ID NO: 325349 - DNA, 25 bp, Mus musculus
cagtttatagcttctcatgcaggga

SEQ ID NO: 325350 - DNA, 25 bp, Mus musculus
cagtttatatatcaggaagccgatt

SEQ ID NO: 325351 - DNA, 25 bp, Mus musculus
cagtttatatatgaggaagccgatt

SEQ ID NO: 325352 - DNA, 25 bp, Mus musculus
cagtttatatcccttcttgggtcag

SEQ ID NO: 325353 - DNA, 25 bp, Mus musculus
cagtttatatccgttcttgggtcag

SEQ ID NO: 325354 - DNA, 25 bp, Mus musculus
cagtttatctttcaccatgtgttca

SEQ ID NO: 325355 - DNA, 25 bp, Mus musculus
cagtttatctttgaccatgtgttca

SEQ ID NO: 325356 - DNA, 25 bp, Mus musculus
cagtttatgaacactttctcccttt

SEQ ID NO: 325357 - DNA, 25 bp, Mus musculus
cagtttatgaactctttctcccttt

SEQ ID NO: 325358 - DNA, 25 bp, Mus musculus
cagtttatgagcactgcttcatggc

SEQ ID NO: 325359 - DNA, 25 bp, Mus musculus
cagtttatgagctctgcttcatggc

SEQ ID NO: 325360 - DNA, 25 bp, Mus musculus
cagtttatggctcttagggtgtagt

SEQ ID NO: 325361 - DNA, 25 bp, Mus musculus
cagtttatggctgttagggtgtagt

SEQ ID NO: 325362 - DNA, 25 bp, Mus musculus
cagtttattagtcggtcatgaatta

SEQ ID NO: 325363 - DNA, 25 bp, Mus musculus
cagtttattagtgggtcatgaatta

SEQ ID NO: 325364 - DNA, 25 bp, Mus musculus
cagtttattctgacagctgggcagt

SEQ ID NO: 325365 - DNA, 25 bp, Mus musculus
cagtttattctgtcagctgggcagt

SEQ ID NO: 325366 - DNA, 25 bp, Mus musculus
cagtttattgaaatcttgggagctc

SEQ ID NO: 325367 - DNA, 25 bp, Mus musculus
cagtttattgaattcttgggagctc

SEQ ID NO: 325368 - DNA, 25 bp, Mus musculus
cagtttattggcattgtttggagat

SEQ ID NO: 325369 - DNA, 25 bp, Mus musculus
cagtttattggctttgtttggagat

SEQ ID NO: 325370 - DNA, 25 bp, Mus musculus
cagtttattgtcctgtcttgttaaa

SEQ ID NO: 325371 - DNA, 25 bp, Mus musculus
cagtttattgtcgtgtcttgttaaa

SEQ ID NO: 325372 - DNA, 25 bp, Mus musculus
cagtttatttctcactagggatatt

SEQ ID NO: 325373 - DNA, 25 bp, Mus musculus
cagtttatttctgactagggatatt

SEQ ID NO: 325374 - DNA, 25 bp, Mus musculus
cagtttcaactccatcagttatgaa

SEQ ID NO: 325375 - DNA, 25 bp, Mus musculus
cagtttcaactcgatcagttatgaa

SEQ ID NO: 325376 - DNA, 25 bp, Mus musculus
cagtttcacttaagtttccatagca

SEQ ID NO: 325377 - DNA, 25 bp, Mus musculus
cagtttcacttatgtttccatagca

SEQ ID NO: 325378 - DNA, 25 bp, Mus musculus
cagtttcagatcctcagctatttta

SEQ ID NO: 325379 - DNA, 25 bp, Mus musculus
cagtttcagatcgtcagctatttta

SEQ ID NO: 325380 - DNA, 25 bp, Mus musculus
cagtttcataccaccgtttctataa

SEQ ID NO: 325381 - DNA, 25 bp, Mus musculus
cagtttcatacctccgtttctataa

SEQ ID NO: 325382 - DNA, 25 bp, Mus musculus
cagtttcattcaccgacaatgtgac

SEQ ID NO: 325383 - DNA, 25 bp, Mus musculus
cagtttcattcagcgacaatgtgac

SEQ ID NO: 325384 - DNA, 25 bp, Mus musculus
cagtttccacacagcgagactggga

SEQ ID NO: 325385 - DNA, 25 bp, Mus musculus
cagtttccacactgcgagactggga

SEQ ID NO: 325386 - DNA, 25 bp, Mus musculus
cagtttccacgtccccggagactga

SEQ ID NO: 325387 - DNA, 25 bp, Mus musculus
cagtttccacgtgcccggagactga

SEQ ID NO: 325388 - DNA, 25 bp, Mus musculus
cagtttccagcacgcatgggttccc

SEQ ID NO: 325389 - DNA, 25 bp, Mus musculus
cagtttccagcaggcatgggttccc

SEQ ID NO: 325390 - DNA, 25 bp, Mus musculus
cagtttccaggacttgtatctgcct

SEQ ID NO: 325391 - DNA, 25 bp, Mus musculus
cagtttccaggagttgtatctgcct

SEQ ID NO: 325392 - DNA, 25 bp, Mus musculus
cagtttccatgcagctgagtttgga

SEQ ID NO: 325393 - DNA, 25 bp, Mus musculus
cagtttccatgctgctgagtttgga

SEQ ID NO: 325394 - DNA, 25 bp, Mus musculus
cagtttccctaacacaattgtttgg

SEQ ID NO: 325395 - DNA, 25 bp, Mus musculus
cagtttccctaagacaattgtttgg

SEQ ID NO: 325396 - DNA, 25 bp, Mus musculus
cagtttcccttaatcctgtttagat

SEQ ID NO: 325397 - DNA, 25 bp, Mus musculus
cagtttcccttattcctgtttagat

SEQ ID NO: 325398 - DNA, 25 bp, Mus musculus
cagtttcccttgctcatgtctgtgg

SEQ ID NO: 325399 - DNA, 25 bp, Mus musculus
cagtttcccttggtcatgtctgtgg

SEQ ID NO: 325400 - DNA, 25 bp, Mus musculus
cagtttccgcatctacccctggatg

SEQ ID NO: 325401 - DNA, 25 bp, Mus musculus
cagtttccgcatgtacccctggatg

SEQ ID NO: 325402 - DNA, 25 bp, Mus musculus
cagtttcctaacaagtggactgaaa

SEQ ID NO: 325403 - DNA, 25 bp, Mus musculus
cagtttcctaactagtggactgaaa

SEQ ID NO: 325404 - DNA, 25 bp, Mus musculus
cagtttcctgctaggcgttgggcaa

SEQ ID NO: 325405 - DNA, 25 bp, Mus musculus
cagtttcctgcttggcgttgggcaa

SEQ ID NO: 325406 - DNA, 25 bp, Mus musculus
cagtttcctgttaagcctggctggg

SEQ ID NO: 325407 - DNA, 25 bp, Mus musculus
cagtttcctgtttagcctggctggg

SEQ ID NO: 325408 - DNA, 25 bp, Mus musculus
cagtttcgaaggagtttccttgtga

SEQ ID NO: 325409 - DNA, 25 bp, Mus musculus
cagtttcgaaggtgtttccttgtga

SEQ ID NO: 325410 - DNA, 25 bp, Mus musculus
cagtttcgcctaagaaagttctgaa

SEQ ID NO: 325411 - DNA, 25 bp, Mus musculus
cagtttcgcctatgaaagttctgaa

SEQ ID NO: 325412 - DNA, 25 bp, Mus musculus
cagtttcgctgaagttggttattaa

SEQ ID NO: 325413 - DNA, 25 bp, Mus musculus
cagtttcgctgatgttggttattaa

SEQ ID NO: 325414 - DNA, 25 bp, Mus musculus
cagtttcgtagtcttttaggaacag

SEQ ID NO: 325415 - DNA, 25 bp, Mus musculus
cagtttcgtagtgttttaggaacag

SEQ ID NO: 325416 - DNA, 25 bp, Mus musculus
cagtttcgtcgtccgtttgatttgg

SEQ ID NO: 325417 - DNA, 25 bp, Mus musculus
cagtttcgtcgtgcgtttgatttgg

SEQ ID NO: 325418 - DNA, 25 bp, Mus musculus
cagtttcgtgctcggtggcgttcaa

SEQ ID NO: 325419 - DNA, 25 bp, Mus musculus
cagtttcgtgctgggtggcgttcaa

SEQ ID NO: 325420 - DNA, 25 bp, Mus musculus
cagtttctagttactcaatatttaa

SEQ ID NO: 325421 - DNA, 25 bp, Mus musculus
cagtttctagttcctggctcttgag

SEQ ID NO: 325422 - DNA, 25 bp, Mus musculus
cagtttctagttgctggctcttgag

SEQ ID NO: 325423 - DNA, 25 bp, Mus musculus
cagtttctagtttctcaatatttaa

SEQ ID NO: 325424 - DNA, 25 bp, Mus musculus
cagtttctattgattggtgttcacc

SEQ ID NO: 325425 - DNA, 25 bp, Mus musculus
cagtttctattgtttggtgttcacc

SEQ ID NO: 325426 - DNA, 25 bp, Mus musculus
cagtttctcctgatgtctctttaat

SEQ ID NO: 325427 - DNA, 25 bp, Mus musculus
cagtttctcctgttgtctctttaat

SEQ ID NO: 325428 - DNA, 25 bp, Mus musculus
cagtttctgagtatctaatttaaaa

SEQ ID NO: 325429 - DNA, 25 bp, Mus musculus
cagtttctgagtttctaatttaaaa

SEQ ID NO: 325430 - DNA, 25 bp, Mus musculus
cagtttctgccacgttgtactcaaa

SEQ ID NO: 325431 - DNA, 25 bp, Mus musculus
cagtttctgccaggttgtactcaaa

SEQ ID NO: 325432 - DNA, 25 bp, Mus musculus
cagtttctgggcatcccatggagac

SEQ ID NO: 325433 - DNA, 25 bp, Mus musculus
cagtttctgggcttcccatggagac

SEQ ID NO: 325434 - DNA, 25 bp, Mus musculus
cagtttctgttcacactgtggattg

SEQ ID NO: 325435 - DNA, 25 bp, Mus musculus
cagtttctgttctcactgtggattg

SEQ ID NO: 325436 - DNA, 25 bp, Mus musculus
cagtttcttctcagttactatagca

SEQ ID NO: 325437 - DNA, 25 bp, Mus musculus
cagtttcttctctgttactatagca

SEQ ID NO: 325438 - DNA, 25 bp, Mus musculus
cagtttcttgttcagccaatgagga

SEQ ID NO: 325439 - DNA, 25 bp, Mus musculus
cagtttcttgttgagccaatgagga

SEQ ID NO: 325440 - DNA, 25 bp, Mus musculus
cagtttctttaaaccaggagtccgt

SEQ ID NO: 325441 - DNA, 25 bp, Mus musculus
cagtttctttaatccaggagtccgt

SEQ ID NO: 325442 - DNA, 25 bp, Mus musculus
cagtttgaaataatctgtcttcatt

SEQ ID NO: 325443 - DNA, 25 bp, Mus musculus
cagtttgaaatattctgtcttcatt

SEQ ID NO: 325444 - DNA, 25 bp, Mus musculus
cagtttgaactcattgctattgtag

SEQ ID NO: 325445 - DNA, 25 bp, Mus musculus
cagtttgaactctttgctattgtag

SEQ ID NO: 325446 - DNA, 25 bp, Mus musculus
cagtttgaatagctatggccccatt

SEQ ID NO: 325447 - DNA, 25 bp, Mus musculus
cagtttgaataggtatggccccatt

SEQ ID NO: 325448 - DNA, 25 bp, Mus musculus
cagtttgaatcaaccgcagctcagt

SEQ ID NO: 325449 - DNA, 25 bp, Mus musculus
cagtttgaatcatccgcagctcagt

SEQ ID NO: 325450 - DNA, 25 bp, Mus musculus
cagtttgaccaacctctgaggctga

SEQ ID NO: 325451 - DNA, 25 bp, Mus musculus
cagtttgaccaagctctgaggctga

SEQ ID NO: 325452 - DNA, 25 bp, Mus musculus
cagtttgagaggaggtagtcctaga

SEQ ID NO: 325453 - DNA, 25 bp, Mus musculus
cagtttgagaggtggtagtcctaga

SEQ ID NO: 325454 - DNA, 25 bp, Mus musculus
cagtttgaggaaatcggccgggcct

SEQ ID NO: 325455 - DNA, 25 bp, Mus musculus
cagtttgaggaattcggccgggcct

SEQ ID NO: 325456 - DNA, 25 bp, Mus musculus
cagtttgaggttcacgaggcagcaa

SEQ ID NO: 325457 - DNA, 25 bp, Mus musculus
cagtttgaggttgacgaggcagcaa

SEQ ID NO: 325458 - DNA, 25 bp, Mus musculus
cagtttgatcttctggttccataac

SEQ ID NO: 325459 - DNA, 25 bp, Mus musculus
cagtttgatcttgtggttccataac

SEQ ID NO: 325460 - DNA, 25 bp, Mus musculus
cagtttgatgacattggtctggtta

SEQ ID NO: 325461 - DNA, 25 bp, Mus musculus
cagtttgatgactttggtctggtta

SEQ ID NO: 325462 - DNA, 25 bp, Mus musculus
cagtttgatgcacaccttggtgaca

SEQ ID NO: 325463 - DNA, 25 bp, Mus musculus
cagtttgatgcagaccttggtgaca

SEQ ID NO: 325464 - DNA, 25 bp, Mus musculus
cagtttgatggcagtctctctctct

SEQ ID NO: 325465 - DNA, 25 bp, Mus musculus
cagtttgatggctgtctctctctct

SEQ ID NO: 325466 - DNA, 25 bp, Mus musculus
cagtttgattccaagcacggcagga

SEQ ID NO: 325467 - DNA, 25 bp, Mus musculus
cagtttgattcctagcacggcagga

SEQ ID NO: 325468 - DNA, 25 bp, Mus musculus
cagtttgattttagatgttgccata

SEQ ID NO: 325469 - DNA, 25 bp, Mus musculus
cagtttgatttttgatgttgccata

SEQ ID NO: 325470 - DNA, 25 bp, Mus musculus
cagtttgcaggaagcactagcgtgg

SEQ ID NO: 325471 - DNA, 25 bp, Mus musculus
cagtttgcaggacacatatgaggca

SEQ ID NO: 325472 - DNA, 25 bp, Mus musculus
cagtttgcaggagacatatgaggca

SEQ ID NO: 325473 - DNA, 25 bp, Mus musculus
cagtttgcaggatgcactagcgtgg

SEQ ID NO: 325474 - DNA, 25 bp, Mus musculus
cagtttgcctccagttacgtatttt

SEQ ID NO: 325475 - DNA, 25 bp, Mus musculus
cagtttgcctcccaaaatccagggt

SEQ ID NO: 325476 - DNA, 25 bp, Mus musculus
cagtttgcctccgaaaatccagggt

SEQ ID NO: 325477 - DNA, 25 bp, Mus musculus
cagtttgcctcctgttacgtatttt

SEQ ID NO: 325478 - DNA, 25 bp, Mus musculus
cagtttgctcccaatagcttactaa

SEQ ID NO: 325479 - DNA, 25 bp, Mus musculus
cagtttgctccctatagcttactaa

SEQ ID NO: 325480 - DNA, 25 bp, Mus musculus
cagtttgctcctattatggaccttt

SEQ ID NO: 325481 - DNA, 25 bp, Mus musculus
cagtttgctccttttatggaccttt

SEQ ID NO: 325482 - DNA, 25 bp, Mus musculus
cagtttgctcgtcgatttttggcta

SEQ ID NO: 325483 - DNA, 25 bp, Mus musculus
cagtttgctcgtggatttttggcta

SEQ ID NO: 325484 - DNA, 25 bp, Mus musculus
cagtttgcttctcgcatctgtgact

SEQ ID NO: 325485 - DNA, 25 bp, Mus musculus
cagtttgcttctggcatctgtgact

SEQ ID NO: 325486 - DNA, 25 bp, Mus musculus
cagtttggaattctggtgcagctca

SEQ ID NO: 325487 - DNA, 25 bp, Mus musculus
cagtttggaattgtggtgcagctca

SEQ ID NO: 325488 - DNA, 25 bp, Mus musculus
cagtttggacagattgttattattg

SEQ ID NO: 325489 - DNA, 25 bp, Mus musculus
cagtttggacagtttgttattattg

SEQ ID NO: 325490 - DNA, 25 bp, Mus musculus
cagtttggacgtcttcaaagtcata

SEQ ID NO: 325491 - DNA, 25 bp, Mus musculus
cagtttggacgtgttcaaagtcata

SEQ ID NO: 325492 - DNA, 25 bp, Mus musculus
cagtttggagccatcagcaattcca

SEQ ID NO: 325493 - DNA, 25 bp, Mus musculus
cagtttggagccccagccagtgaat

SEQ ID NO: 325494 - DNA, 25 bp, Mus musculus
cagtttggagccgcagccagtgaat

SEQ ID NO: 325495 - DNA, 25 bp, Mus musculus
cagtttggagccttcagcaattcca

SEQ ID NO: 325496 - DNA, 25 bp, Mus musculus
cagtttggagctcggattcggttcc

SEQ ID NO: 325497 - DNA, 25 bp, Mus musculus
cagtttggagctgggattcggttcc

SEQ ID NO: 325498 - DNA, 25 bp, Mus musculus
cagtttggatacctactagagcatc

SEQ ID NO: 325499 - DNA, 25 bp, Mus musculus
cagtttggatacgtactagagcatc

SEQ ID NO: 325500 - DNA, 25 bp, Mus musculus
cagtttgggagtaatctggacacca

SEQ ID NO: 325501 - DNA, 25 bp, Mus musculus
cagtttgggagttatctggacacca

SEQ ID NO: 325502 - DNA, 25 bp, Mus musculus
cagtttgggcccaggacattagaaa

SEQ ID NO: 325503 - DNA, 25 bp, Mus musculus
cagtttgggccctggacattagaaa

SEQ ID NO: 325504 - DNA, 25 bp, Mus musculus
cagtttggtctcaccatgtttgaca

SEQ ID NO: 325505 - DNA, 25 bp, Mus musculus
cagtttggtctctccatgtttgaca

SEQ ID NO: 325506 - DNA, 25 bp, Mus musculus
cagtttggtgagacgaaccttctct

SEQ ID NO: 325507 - DNA, 25 bp, Mus musculus
cagtttggtgagtcgaaccttctct

SEQ ID NO: 325508 - DNA, 25 bp, Mus musculus
cagtttggtgtgatgtcctcccctc

SEQ ID NO: 325509 - DNA, 25 bp, Mus musculus
cagtttggtgtgttgtcctcccctc

SEQ ID NO: 325510 - DNA, 25 bp, Mus musculus
cagtttgtagtcatagtttgtgtat

SEQ ID NO: 325511 - DNA, 25 bp, Mus musculus
cagtttgtagtcttagtttgtgtat

SEQ ID NO: 325512 - DNA, 25 bp, Mus musculus
cagtttgtatggctattctcagaat

SEQ ID NO: 325513 - DNA, 25 bp, Mus musculus
cagtttgtatgggtattctcagaat

SEQ ID NO: 325514 - DNA, 25 bp, Mus musculus
cagtttgtattcatcctcagtttat

SEQ ID NO: 325515 - DNA, 25 bp, Mus musculus
cagtttgtattcttcctcagtttat

SEQ ID NO: 325516 - DNA, 25 bp, Mus musculus
cagtttgtcatacccacgtggcagc

SEQ ID NO: 325517 - DNA, 25 bp, Mus musculus
cagtttgtcatagccacgtggcagc

SEQ ID NO: 325518 - DNA, 25 bp, Mus musculus
cagtttgtccatctgtagttaccag

SEQ ID NO: 325519 - DNA, 25 bp, Mus musculus
cagtttgtccatgtgtagttaccag

SEQ ID NO: 325520 - DNA, 25 bp, Mus musculus
cagtttgtcccacgtaggtcctagg

SEQ ID NO: 325521 - DNA, 25 bp, Mus musculus
cagtttgtcccaggtaggtcctagg

SEQ ID NO: 325522 - DNA, 25 bp, Mus musculus
cagtttgtcctgatgtgagataatg

SEQ ID NO: 325523 - DNA, 25 bp, Mus musculus
cagtttgtcctgttgtgagataatg

SEQ ID NO: 325524 - DNA, 25 bp, Mus musculus
cagtttgtgctacgttttctgggtt

SEQ ID NO: 325525 - DNA, 25 bp, Mus musculus
cagtttgtgctaggttttctgggtt

SEQ ID NO: 325526 - DNA, 25 bp, Mus musculus
cagtttgtggcacagtcacacatca

SEQ ID NO: 325527 - DNA, 25 bp, Mus musculus
cagtttgtggcagagtcacacatca

SEQ ID NO: 325528 - DNA, 25 bp, Mus musculus
cagtttgtggtacgccatatccctt

SEQ ID NO: 325529 - DNA, 25 bp, Mus musculus
cagtttgtggtaggccatatccctt

SEQ ID NO: 325530 - DNA, 25 bp, Mus musculus
cagtttgtgtgcactgacggctcgg

SEQ ID NO: 325531 - DNA, 25 bp, Mus musculus
cagtttgtgtgctctgacggctcgg

SEQ ID NO: 325532 - DNA, 25 bp, Mus musculus
cagtttgtgttcacacctcctgcag

SEQ ID NO: 325533 - DNA, 25 bp, Mus musculus
cagtttgtgttcagtctgtgaaggt

SEQ ID NO: 325534 - DNA, 25 bp, Mus musculus
cagtttgtgttctcacctcctgcag

SEQ ID NO: 325535 - DNA, 25 bp, Mus musculus
cagtttgtgttctgtctgtgaaggt

SEQ ID NO: 325536 - DNA, 25 bp, Mus musculus
cagtttgtgttgagtatatttcgat

SEQ ID NO: 325537 - DNA, 25 bp, Mus musculus
cagtttgtgttgatcagagatgtct

SEQ ID NO: 325538 - DNA, 25 bp, Mus musculus
cagtttgtgttgtgtatatttcgat

SEQ ID NO: 325539 - DNA, 25 bp, Mus musculus
cagtttgtgttgttcagagatgtct

SEQ ID NO: 325540 - DNA, 25 bp, Mus musculus
cagtttgttctccatagtgctctaa

SEQ ID NO: 325541 - DNA, 25 bp, Mus musculus
cagtttgttctcgatagtgctctaa

SEQ ID NO: 325542 - DNA, 25 bp, Mus musculus
cagtttgttggtaaggtgactttca

SEQ ID NO: 325543 - DNA, 25 bp, Mus musculus
cagtttgttggttaggtgactttca

SEQ ID NO: 325544 - DNA, 25 bp, Mus musculus
cagtttgtttcacatcccttttcat

SEQ ID NO: 325545 - DNA, 25 bp, Mus musculus
cagtttgtttcagatcccttttcat

SEQ ID NO: 325546 - DNA, 25 bp, Mus musculus
cagtttgtttccaccaatggagcct

SEQ ID NO: 325547 - DNA, 25 bp, Mus musculus
cagtttgtttcctccaatggagcct

SEQ ID NO: 325548 - DNA, 25 bp, Mus musculus
cagtttgttttcatgcagacccttg

SEQ ID NO: 325549 - DNA, 25 bp, Mus musculus
cagtttgttttcttgcagacccttg

SEQ ID NO: 325550 - DNA, 25 bp, Mus musculus
cagttttaactccactctcatttta

SEQ ID NO: 325551 - DNA, 25 bp, Mus musculus
cagttttaactcgactctcatttta

SEQ ID NO: 325552 - DNA, 25 bp, Mus musculus
cagttttaactgaatctttaggaag

SEQ ID NO: 325553 - DNA, 25 bp, Mus musculus
cagttttaactgtatctttaggaag

SEQ ID NO: 325554 - DNA, 25 bp, Mus musculus
cagttttacctgagaccttattggg

SEQ ID NO: 325555 - DNA, 25 bp, Mus musculus
cagttttacctgctgatactgtaag

SEQ ID NO: 325556 - DNA, 25 bp, Mus musculus
cagttttacctggtgatactgtaag

SEQ ID NO: 325557 - DNA, 25 bp, Mus musculus
cagttttacctgtgaccttattggg

SEQ ID NO: 325558 - DNA, 25 bp, Mus musculus
cagttttactctataggctatggac

SEQ ID NO: 325559 - DNA, 25 bp, Mus musculus
cagttttactctttaggctatggac

SEQ ID NO: 325560 - DNA, 25 bp, Mus musculus
cagttttaggacagccgggctaaag

SEQ ID NO: 325561 - DNA, 25 bp, Mus musculus
cagttttaggactgccgggctaaag

SEQ ID NO: 325562 - DNA, 25 bp, Mus musculus
cagttttagtgcctttatcatttga

SEQ ID NO: 325563 - DNA, 25 bp, Mus musculus
cagttttagtgcgtttatcatttga

SEQ ID NO: 325564 - DNA, 25 bp, Mus musculus
cagttttagtgtctggccttctttt

SEQ ID NO: 325565 - DNA, 25 bp, Mus musculus
cagttttagtgtgtggccttctttt

SEQ ID NO: 325566 - DNA, 25 bp, Mus musculus
cagttttagtttatgcatttcctta

SEQ ID NO: 325567 - DNA, 25 bp, Mus musculus
cagttttagtttttgcatttcctta

SEQ ID NO: 325568 - DNA, 25 bp, Mus musculus
cagttttatgtcatcgcccacagag

SEQ ID NO: 325569 - DNA, 25 bp, Mus musculus
cagttttatgtcttcgcccacagag

SEQ ID NO: 325570 - DNA, 25 bp, Mus musculus
cagttttattcacgttgtgcagttt

SEQ ID NO: 325571 - DNA, 25 bp, Mus musculus
cagttttattcaggttgtgcagttt

SEQ ID NO: 325572 - DNA, 25 bp, Mus musculus
cagttttcaactagtcgagcgacct

SEQ ID NO: 325573 - DNA, 25 bp, Mus musculus
cagttttcaacttgtcgagcgacct

SEQ ID NO: 325574 - DNA, 25 bp, Mus musculus
cagttttcactgactggttcagtta

SEQ ID NO: 325575 - DNA, 25 bp, Mus musculus
cagttttcactgtctggttcagtta

SEQ ID NO: 325576 - DNA, 25 bp, Mus musculus
cagttttcagatacacctgtgcgtg

SEQ ID NO: 325577 - DNA, 25 bp, Mus musculus
cagttttcagattcacctgtgcgtg

SEQ ID NO: 325578 - DNA, 25 bp, Mus musculus
cagttttcatagagagtcattcccc

SEQ ID NO: 325579 - DNA, 25 bp, Mus musculus
cagttttcatagtgagtcattcccc

SEQ ID NO: 325580 - DNA, 25 bp, Mus musculus
cagttttcatggaaggttcttgtaa

SEQ ID NO: 325581 - DNA, 25 bp, Mus musculus
cagttttcatggtaggttcttgtaa

SEQ ID NO: 325582 - DNA, 25 bp, Mus musculus
cagttttcattgactgcattgcttt

SEQ ID NO: 325583 - DNA, 25 bp, Mus musculus
cagttttcattgtctgcattgcttt

SEQ ID NO: 325584 - DNA, 25 bp, Mus musculus
cagttttccacccactcagagctgg

SEQ ID NO: 325585 - DNA, 25 bp, Mus musculus
cagttttccaccgactcagagctgg

SEQ ID NO: 325586 - DNA, 25 bp, Mus musculus
cagttttccactataccttctttag

SEQ ID NO: 325587 - DNA, 25 bp, Mus musculus
cagttttccactttaccttctttag

SEQ ID NO: 325588 - DNA, 25 bp, Mus musculus
cagttttccatgctctgaaactcca

SEQ ID NO: 325589 - DNA, 25 bp, Mus musculus
cagttttccatggtctgaaactcca

SEQ ID NO: 325590 - DNA, 25 bp, Mus musculus
cagttttccggtcaagcttttcttg

SEQ ID NO: 325591 - DNA, 25 bp, Mus musculus
cagttttccggtgaagcttttcttg

SEQ ID NO: 325592 - DNA, 25 bp, Mus musculus
cagttttcctacactgtacagcttt

SEQ ID NO: 325593 - DNA, 25 bp, Mus musculus
cagttttcctactctgtacagcttt

SEQ ID NO: 325594 - DNA, 25 bp, Mus musculus
cagttttcctcaatgatatgtggtc

SEQ ID NO: 325595 - DNA, 25 bp, Mus musculus
cagttttcctcattgatatgtggtc

SEQ ID NO: 325596 - DNA, 25 bp, Mus musculus
cagttttcctgcagtatagataatg

SEQ ID NO: 325597 - DNA, 25 bp, Mus musculus
cagttttcctgctgtatagataatg

SEQ ID NO: 325598 - DNA, 25 bp, Mus musculus
cagttttcgatgctgtagtgcatgc

SEQ ID NO: 325599 - DNA, 25 bp, Mus musculus
cagttttcgatggtgtagtgcatgc

SEQ ID NO: 325600 - DNA, 25 bp, Mus musculus
cagttttcgctaaacctaattcatt

SEQ ID NO: 325601 - DNA, 25 bp, Mus musculus
cagttttcgctatacctaattcatt

SEQ ID NO: 325602 - DNA, 25 bp, Mus musculus
cagttttctcatactgcttcctaaa

SEQ ID NO: 325603 - DNA, 25 bp, Mus musculus
cagttttctcattctgcttcctaaa

SEQ ID NO: 325604 - DNA, 25 bp, Mus musculus
cagttttctctacaaggctctgagt

SEQ ID NO: 325605 - DNA, 25 bp, Mus musculus
cagttttctctagaaggctctgagt

SEQ ID NO: 325606 - DNA, 25 bp, Mus musculus
cagttttctgataccttgtgcttta

SEQ ID NO: 325607 - DNA, 25 bp, Mus musculus
cagttttctgattccttgtgcttta

SEQ ID NO: 325608 - DNA, 25 bp, Mus musculus
cagttttcttgtactgaggatcccc

SEQ ID NO: 325609 - DNA, 25 bp, Mus musculus
cagttttcttgttctgaggatcccc

SEQ ID NO: 325610 - DNA, 25 bp, Mus musculus
cagttttctttaagagcctcctaac

SEQ ID NO: 325611 - DNA, 25 bp, Mus musculus
cagttttctttatgagcctcctaac

SEQ ID NO: 325612 - DNA, 25 bp, Mus musculus
cagttttcttttatcaggtcacatt

SEQ ID NO: 325613 - DNA, 25 bp, Mus musculus
cagttttcttttttcaggtcacatt

SEQ ID NO: 325614 - DNA, 25 bp, Mus musculus
cagttttgagggatgcagctctctt

SEQ ID NO: 325615 - DNA, 25 bp, Mus musculus
cagttttgagggttgcagctctctt

SEQ ID NO: 325616 - DNA, 25 bp, Mus musculus
cagttttgaggtaatgcacactaaa

SEQ ID NO: 325617 - DNA, 25 bp, Mus musculus
cagttttgaggttatgcacactaaa

SEQ ID NO: 325618 - DNA, 25 bp, Mus musculus
cagttttgagttaagagggtttcat

SEQ ID NO: 325619 - DNA, 25 bp, Mus musculus
cagttttgagtttagagggtttcat

SEQ ID NO: 325620 - DNA, 25 bp, Mus musculus
cagttttggaagcactgccccagcc

SEQ ID NO: 325621 - DNA, 25 bp, Mus musculus
cagttttggaaggactgccccagcc

SEQ ID NO: 325622 - DNA, 25 bp, Mus musculus
cagttttggacaacttggacgtgaa

SEQ ID NO: 325623 - DNA, 25 bp, Mus musculus
cagttttggacatcttggacgtgaa

SEQ ID NO: 325624 - DNA, 25 bp, Mus musculus
cagttttggactatcagcttctagg

SEQ ID NO: 325625 - DNA, 25 bp, Mus musculus
cagttttggactttcagcttctagg

SEQ ID NO: 325626 - DNA, 25 bp, Mus musculus
cagttttgggacaacagtgttgtgc

SEQ ID NO: 325627 - DNA, 25 bp, Mus musculus
cagttttgggactacagtgttgtgc

SEQ ID NO: 325628 - DNA, 25 bp, Mus musculus
cagttttgggtgcacatagccaaga

SEQ ID NO: 325629 - DNA, 25 bp, Mus musculus
cagttttgggtggacatagccaaga

SEQ ID NO: 325630 - DNA, 25 bp, Mus musculus
cagttttgtgctacagactgtcttt

SEQ ID NO: 325631 - DNA, 25 bp, Mus musculus
cagttttgtgcttcagactgtcttt

SEQ ID NO: 325632 - DNA, 25 bp, Mus musculus
cagttttgttacacccagcccctgg

SEQ ID NO: 325633 - DNA, 25 bp, Mus musculus
cagttttgttactcccagcccctgg

SEQ ID NO: 325634 - DNA, 25 bp, Mus musculus
cagtttttaagacttgtaatgtttg

SEQ ID NO: 325635 - DNA, 25 bp, Mus musculus
cagtttttaagagttgtaatgtttg

SEQ ID NO: 325636 - DNA, 25 bp, Mus musculus
cagtttttaggaattgccatggtaa

SEQ ID NO: 325637 - DNA, 25 bp, Mus musculus
cagtttttaggatttgccatggtaa

SEQ ID NO: 325638 - DNA, 25 bp, Mus musculus
cagtttttagggagatggtttgaat

SEQ ID NO: 325639 - DNA, 25 bp, Mus musculus
cagtttttagggtgatggtttgaat

SEQ ID NO: 325640 - DNA, 25 bp, Mus musculus
cagtttttcatgacattgtgattca

SEQ ID NO: 325641 - DNA, 25 bp, Mus musculus
cagtttttcatgtcattgtgattca

SEQ ID NO: 325642 - DNA, 25 bp, Mus musculus
cagtttttccagctgttaaatgaca

SEQ ID NO: 325643 - DNA, 25 bp, Mus musculus
cagtttttccaggtgttaaatgaca

SEQ ID NO: 325644 - DNA, 25 bp, Mus musculus
cagtttttccatactttacttatat

SEQ ID NO: 325645 - DNA, 25 bp, Mus musculus
cagtttttccattctttacttatat

SEQ ID NO: 325646 - DNA, 25 bp, Mus musculus
cagtttttccccagaggaggccagg

SEQ ID NO: 325647 - DNA, 25 bp, Mus musculus
cagtttttcccctgaggaggccagg

SEQ ID NO: 325648 - DNA, 25 bp, Mus musculus
cagtttttctttactttcgaatctg

SEQ ID NO: 325649 - DNA, 25 bp, Mus musculus
cagtttttcttttctttcgaatctg

SEQ ID NO: 325650 - DNA, 25 bp, Mus musculus
cagtttttgaaaagtcaattctgaa

SEQ ID NO: 325651 - DNA, 25 bp, Mus musculus
cagtttttgaaatgtcaattctgaa

SEQ ID NO: 325652 - DNA, 25 bp, Mus musculus
cagtttttgagacgtgacgcttggt

SEQ ID NO: 325653 - DNA, 25 bp, Mus musculus
cagtttttgagaggtgacgcttggt

SEQ ID NO: 325654 - DNA, 25 bp, Mus musculus
cagtttttgagcacgggtgctggca

SEQ ID NO: 325655 - DNA, 25 bp, Mus musculus
cagtttttgagctcgggtgctggca

SEQ ID NO: 325656 - DNA, 25 bp, Mus musculus
cagtttttgggaatgttccccagag

SEQ ID NO: 325657 - DNA, 25 bp, Mus musculus
cagtttttgggattgttccccagag

SEQ ID NO: 325658 - DNA, 25 bp, Mus musculus
cagtttttgtcaatcttgtctttat

SEQ ID NO: 325659 - DNA, 25 bp, Mus musculus
cagtttttgtcattcttgtctttat

SEQ ID NO: 325660 - DNA, 25 bp, Mus musculus
cagtttttgtgtattctctagggct

SEQ ID NO: 325661 - DNA, 25 bp, Mus musculus
cagtttttgtgttttctctagggct

SEQ ID NO: 325662 - DNA, 25 bp, Mus musculus
cagttttttacaacttttcattcag

SEQ ID NO: 325663 - DNA, 25 bp, Mus musculus
cagttttttacatcttttcattcag

SEQ ID NO: 325664 - DNA, 25 bp, Mus musculus
cagttttttgaaagcacaaggtccc

SEQ ID NO: 325665 - DNA, 25 bp, Mus musculus
cagttttttgaatgcacaaggtccc

SEQ ID NO: 325666 - DNA, 25 bp, Mus musculus
cagtttttttgtacgacaacatgaa

SEQ ID NO: 325667 - DNA, 25 bp, Mus musculus
cagtttttttgttcgacaacatgaa

SEQ ID NO: 325668 - DNA, 25 bp, Mus musculus
cataaaaacaatcaccaggcctagt

SEQ ID NO: 325669 - DNA, 25 bp, Mus musculus
cataaaaacaatgaccaggcctagt

SEQ ID NO: 325670 - DNA, 25 bp, Mus musculus
cataaaaacacacaggagagaaacc

SEQ ID NO: 325671 - DNA, 25 bp, Mus musculus
cataaaaacacagaggagagaaacc

SEQ ID NO: 325672 - DNA, 25 bp, Mus musculus
cataaaacctgtactgccttctgtt

SEQ ID NO: 325673 - DNA, 25 bp, Mus musculus
cataaaacctgttctgccttctgtt

SEQ ID NO: 325674 - DNA, 25 bp, Mus musculus
cataaaacttacctagccctaccag

SEQ ID NO: 325675 - DNA, 25 bp, Mus musculus
cataaaacttacgtagccctaccag

SEQ ID NO: 325676 - DNA, 25 bp, Mus musculus
cataaaatggtgctggctccccagt

SEQ ID NO: 325677 - DNA, 25 bp, Mus musculus
cataaaatggtggtggctccccagt

SEQ ID NO: 325678 - DNA, 25 bp, Mus musculus
cataaacaccatatgagtttttgct

SEQ ID NO: 325679 - DNA, 25 bp, Mus musculus
cataaacaccatttgagtttttgct

SEQ ID NO: 325680 - DNA, 25 bp, Mus musculus
cataaacattatcgccttccattta

SEQ ID NO: 325681 - DNA, 25 bp, Mus musculus
cataaacattatggccttccattta

SEQ ID NO: 325682 - DNA, 25 bp, Mus musculus
cataaacctcgtcgccaagggcagt

SEQ ID NO: 325683 - DNA, 25 bp, Mus musculus
cataaacctcgtggccaagggcagt

SEQ ID NO: 325684 - DNA, 25 bp, Mus musculus
cataaactctttatgcccgcagcat

SEQ ID NO: 325685 - DNA, 25 bp, Mus musculus
cataaactctttttgcccgcagcat

SEQ ID NO: 325686 - DNA, 25 bp, Mus musculus
cataaactgggcagcttgggcacag

SEQ ID NO: 325687 - DNA, 25 bp, Mus musculus
cataaactgggctgcttgggcacag

SEQ ID NO: 325688 - DNA, 25 bp, Mus musculus
cataaactgggtcggtctatgtctt

SEQ ID NO: 325689 - DNA, 25 bp, Mus musculus
cataaactgggtgggtctatgtctt

SEQ ID NO: 325690 - DNA, 25 bp, Mus musculus
cataaactggtgagctggattcaat

SEQ ID NO: 325691 - DNA, 25 bp, Mus musculus
cataaactggtgtgctggattcaat

SEQ ID NO: 325692 - DNA, 25 bp, Mus musculus
cataaacttttacaactgcacagca

SEQ ID NO: 325693 - DNA, 25 bp, Mus musculus
cataaacttttagaactgcacagca

SEQ ID NO: 325694 - DNA, 25 bp, Mus musculus
cataaacttttcacaggtggcctgg

SEQ ID NO: 325695 - DNA, 25 bp, Mus musculus
cataaacttttctcaggtggcctgg

SEQ ID NO: 325696 - DNA, 25 bp, Mus musculus
cataaagaaacccctcagcccaaag

SEQ ID NO: 325697 - DNA, 25 bp, Mus musculus
cataaagaaaccgctcagcccaaag

SEQ ID NO: 325698 - DNA, 25 bp, Mus musculus
cataaagaagtgagtttgagggctg

SEQ ID NO: 325699 - DNA, 25 bp, Mus musculus
cataaagaagtgtgtttgagggctg

SEQ ID NO: 325700 - DNA, 25 bp, Mus musculus
cataaagaggtcaacttggtttcga

SEQ ID NO: 325701 - DNA, 25 bp, Mus musculus
cataaagaggtctacttggtttcga

SEQ ID NO: 325702 - DNA, 25 bp, Mus musculus
cataaagataacacaaagctgggca

SEQ ID NO: 325703 - DNA, 25 bp, Mus musculus
cataaagataactcaaagctgggca

SEQ ID NO: 325704 - DNA, 25 bp, Mus musculus
cataaagatcctagccgtggcagct

SEQ ID NO: 325705 - DNA, 25 bp, Mus musculus
cataaagatccttgccgtggcagct

SEQ ID NO: 325706 - DNA, 25 bp, Mus musculus
cataaagcacttcctgagcacagca

SEQ ID NO: 325707 - DNA, 25 bp, Mus musculus
cataaagcacttctttctcagatct

SEQ ID NO: 325708 - DNA, 25 bp, Mus musculus
cataaagcacttgctgagcacagca

SEQ ID NO: 325709 - DNA, 25 bp, Mus musculus
cataaagcacttgtttctcagatct

SEQ ID NO: 325710 - DNA, 25 bp, Mus musculus
cataaagcgtccaatgaatgccttc

SEQ ID NO: 325711 - DNA, 25 bp, Mus musculus
cataaagcgtcctatgaatgccttc

SEQ ID NO: 325712 - DNA, 25 bp, Mus musculus
cataaagcttcccaccccggtggag

SEQ ID NO: 325713 - DNA, 25 bp, Mus musculus
cataaagcttccgaccccggtggag

SEQ ID NO: 325714 - DNA, 25 bp, Mus musculus
cataaagcttcgacatggacaggac

SEQ ID NO: 325715 - DNA, 25 bp, Mus musculus
cataaagcttcgtcatggacaggac

SEQ ID NO: 325716 - DNA, 25 bp, Mus musculus
cataaaggacgaccgatggattgta

SEQ ID NO: 325717 - DNA, 25 bp, Mus musculus
cataaaggacgagcgatggattgta

SEQ ID NO: 325718 - DNA, 25 bp, Mus musculus
cataaaggaggtcgcttttttcctg

SEQ ID NO: 325719 - DNA, 25 bp, Mus musculus
cataaaggaggtggcttttttcctg

SEQ ID NO: 325720 - DNA, 25 bp, Mus musculus
cataaagggctcactcccggagaaa

SEQ ID NO: 325721 - DNA, 25 bp, Mus musculus
cataaagggctctctcccggagaaa

SEQ ID NO: 325722 - DNA, 25 bp, Mus musculus
cataaaggtaaactgcttaattgaa

SEQ ID NO: 325723 - DNA, 25 bp, Mus musculus
cataaaggtaaagtgcttaattgaa

SEQ ID NO: 325724 - DNA, 25 bp, Mus musculus
cataaaggtttgatctccagatggt

SEQ ID NO: 325725 - DNA, 25 bp, Mus musculus
cataaaggtttgttctccagatggt

SEQ ID NO: 325726 - DNA, 25 bp, Mus musculus
cataaagtaaacctacccattcctg

SEQ ID NO: 325727 - DNA, 25 bp, Mus musculus
cataaagtaaacgtacccattcctg

SEQ ID NO: 325728 - DNA, 25 bp, Mus musculus
cataaagtagttcaacctggagtga

SEQ ID NO: 325729 - DNA, 25 bp, Mus musculus
cataaagtagttgaacctggagtga

SEQ ID NO: 325730 - DNA, 25 bp, Mus musculus
cataaagttgtaatgtgttcacctt

SEQ ID NO: 325731 - DNA, 25 bp, Mus musculus
cataaagttgtattgtgttcacctt

SEQ ID NO: 325732 - DNA, 25 bp, Mus musculus
cataaagtttgtagacctgtcttcc

SEQ ID NO: 325733 - DNA, 25 bp, Mus musculus
cataaagtttgttgacctgtcttcc

SEQ ID NO: 325734 - DNA, 25 bp, Mus musculus
cataaatagactctcttcagcacat

SEQ ID NO: 325735 - DNA, 25 bp, Mus musculus
cataaatagactgtcttcagcacat

SEQ ID NO: 325736 - DNA, 25 bp, Mus musculus
cataaatatctccttctgcagctga

SEQ ID NO: 325737 - DNA, 25 bp, Mus musculus
cataaatatctcgttctgcagctga

SEQ ID NO: 325738 - DNA, 25 bp, Mus musculus
cataaatatggtatcctacgtggga

SEQ ID NO: 325739 - DNA, 25 bp, Mus musculus
cataaatatggtttcctacgtggga

SEQ ID NO: 325740 - DNA, 25 bp, Mus musculus
cataaatatgtcacttcctagcctc

SEQ ID NO: 325741 - DNA, 25 bp, Mus musculus
cataaatatgtctcttcctagcctc

SEQ ID NO: 325742 - DNA, 25 bp, Mus musculus
cataaatcatggcttcatcacaaga

SEQ ID NO: 325743 - DNA, 25 bp, Mus musculus
cataaatcatgggttcatcacaaga

SEQ ID NO: 325744 - DNA, 25 bp, Mus musculus
cataaatcctgtcaaatttcagtga

SEQ ID NO: 325745 - DNA, 25 bp, Mus musculus
cataaatcctgtgaaatttcagtga

SEQ ID NO: 325746 - DNA, 25 bp, Mus musculus
cataaatgctgtagtgtgcacaagc

SEQ ID NO: 325747 - DNA, 25 bp, Mus musculus
cataaatgctgttgtgtgcacaagc

SEQ ID NO: 325748 - DNA, 25 bp, Mus musculus
cataaatttcccctcagacctaagt

SEQ ID NO: 325749 - DNA, 25 bp, Mus musculus
cataaatttcccgtcagacctaagt

SEQ ID NO: 325750 - DNA, 25 bp, Mus musculus
cataaatttgctacttttgtggttt

SEQ ID NO: 325751 - DNA, 25 bp, Mus musculus
cataaatttgcttcttttgtggttt

SEQ ID NO: 325752 - DNA, 25 bp, Mus musculus
cataacagcaaacccgggtcgtgtt

SEQ ID NO: 325753 - DNA, 25 bp, Mus musculus
cataacagcaaagccgggtcgtgtt

SEQ ID NO: 325754 - DNA, 25 bp, Mus musculus
cataacagctatacctgtgaggcca

SEQ ID NO: 325755 - DNA, 25 bp, Mus musculus
cataacagctattcctgtgaggcca

SEQ ID NO: 325756 - DNA, 25 bp, Mus musculus
cataacaggattacagctttggaaa

SEQ ID NO: 325757 - DNA, 25 bp, Mus musculus
cataacaggatttcagctttggaaa

SEQ ID NO: 325758 - DNA, 25 bp, Mus musculus
cataacagggtacatgggtagctaa

SEQ ID NO: 325759 - DNA, 25 bp, Mus musculus
cataacagggtagatgggtagctaa

SEQ ID NO: 325760 - DNA, 25 bp, Mus musculus
cataacatcacccaccagagtcccc

SEQ ID NO: 325761 - DNA, 25 bp, Mus musculus
cataacatcaccgaccagagtcccc

SEQ ID NO: 325762 - DNA, 25 bp, Mus musculus
cataacatggatagagtgagacact

SEQ ID NO: 325763 - DNA, 25 bp, Mus musculus
cataacatggattgagtgagacact

SEQ ID NO: 325764 - DNA, 25 bp, Mus musculus
cataaccagccacggcagcttctct

SEQ ID NO: 325765 - DNA, 25 bp, Mus musculus
cataaccagccagggcagcttctct

SEQ ID NO: 325766 - DNA, 25 bp, Mus musculus
cataaccagtggagtgctggattaa

SEQ ID NO: 325767 - DNA, 25 bp, Mus musculus
cataaccagtggtgtgctggattaa

SEQ ID NO: 325768 - DNA, 25 bp, Mus musculus
cataaccataagacaggctgctccc

SEQ ID NO: 325769 - DNA, 25 bp, Mus musculus
cataaccataagtcaggctgctccc

SEQ ID NO: 325770 - DNA, 25 bp, Mus musculus
cataaccatctaagagttgtaccct

SEQ ID NO: 325771 - DNA, 25 bp, Mus musculus
cataaccatctatgagttgtaccct

SEQ ID NO: 325772 - DNA, 25 bp, Mus musculus
cataaccatgtgcttgcctatttcc

SEQ ID NO: 325773 - DNA, 25 bp, Mus musculus
cataaccatgtggttgcctatttcc

SEQ ID NO: 325774 - DNA, 25 bp, Mus musculus
cataaccccaaaatagataaaagct

SEQ ID NO: 325775 - DNA, 25 bp, Mus musculus
cataaccccaaattagataaaagct

SEQ ID NO: 325776 - DNA, 25 bp, Mus musculus
cataaccctaacctcgtaggcaagt

SEQ ID NO: 325777 - DNA, 25 bp, Mus musculus
cataaccctaacgtcgtaggcaagt

SEQ ID NO: 325778 - DNA, 25 bp, Mus musculus
cataacctccggattatgatccagt

SEQ ID NO: 325779 - DNA, 25 bp, Mus musculus
cataacctccggtttatgatccagt

SEQ ID NO: 325780 - DNA, 25 bp, Mus musculus
cataacctctgcaccaatgggaagt

SEQ ID NO: 325781 - DNA, 25 bp, Mus musculus
cataacctctgctccaatgggaagt

SEQ ID NO: 325782 - DNA, 25 bp, Mus musculus
cataaccttctaaatttgctcacct

SEQ ID NO: 325783 - DNA, 25 bp, Mus musculus
cataaccttctatatttgctcacct

SEQ ID NO: 325784 - DNA, 25 bp, Mus musculus
cataaccttcttcttgcattttctt

SEQ ID NO: 325785 - DNA, 25 bp, Mus musculus
cataaccttcttgttgcattttctt

SEQ ID NO: 325786 - DNA, 25 bp, Mus musculus
cataaccttggtcgtctgaaataat

SEQ ID NO: 325787 - DNA, 25 bp, Mus musculus
cataaccttggtggtctgaaataat

SEQ ID NO: 325788 - DNA, 25 bp, Mus musculus
cataacgaatcacgttttctatttt

SEQ ID NO: 325789 - DNA, 25 bp, Mus musculus
cataacgaatcaggttttctatttt

SEQ ID NO: 325790 - DNA, 25 bp, Mus musculus
cataacgacctgcaatctgtgcctc

SEQ ID NO: 325791 - DNA, 25 bp, Mus musculus
cataacgacctggaatctgtgcctc

SEQ ID NO: 325792 - DNA, 25 bp, Mus musculus
cataacgccgttccgaggagattga

SEQ ID NO: 325793 - DNA, 25 bp, Mus musculus
cataacgccgttgcgaggagattga

SEQ ID NO: 325794 - DNA, 25 bp, Mus musculus
cataacgctggacaccacagacttc

SEQ ID NO: 325795 - DNA, 25 bp, Mus musculus
cataacgctggagaccacagacttc

SEQ ID NO: 325796 - DNA, 25 bp, Mus musculus
cataacgtcaaaaccttccgtgttt

SEQ ID NO: 325797 - DNA, 25 bp, Mus musculus
cataacgtcaaatccttccgtgttt

SEQ ID NO: 325798 - DNA, 25 bp, Mus musculus
cataacgtgaagaagccttcccgga

SEQ ID NO: 325799 - DNA, 25 bp, Mus musculus
cataacgtgaagtagccttcccgga

SEQ ID NO: 325800 - DNA, 25 bp, Mus musculus
cataacgttgacattttccccagtg

SEQ ID NO: 325801 - DNA, 25 bp, Mus musculus
cataacgttgactttttccccagtg

SEQ ID NO: 325802 - DNA, 25 bp, Mus musculus
cataactagattccagatggagtcc

SEQ ID NO: 325803 - DNA, 25 bp, Mus musculus
cataactagattgcagatggagtcc

SEQ ID NO: 325804 - DNA, 25 bp, Mus musculus
cataactccattatcagtcttccat

SEQ ID NO: 325805 - DNA, 25 bp, Mus musculus
cataactccattttcagtcttccat

SEQ ID NO: 325806 - DNA, 25 bp, Mus musculus
cataactccccacgccgtttgagtt

SEQ ID NO: 325807 - DNA, 25 bp, Mus musculus
cataactccccaggccgtttgagtt

SEQ ID NO: 325808 - DNA, 25 bp, Mus musculus
cataactctaacagccacaggactt

SEQ ID NO: 325809 - DNA, 25 bp, Mus musculus
cataactctaactgccacaggactt

SEQ ID NO: 325810 - DNA, 25 bp, Mus musculus
cataactgtgacctgaattgtccat

SEQ ID NO: 325811 - DNA, 25 bp, Mus musculus
cataactgtgacgtgaattgtccat

SEQ ID NO: 325812 - DNA, 25 bp, Mus musculus
cataactgttttcaccccaggaagg

SEQ ID NO: 325813 - DNA, 25 bp, Mus musculus
cataactgttttcatgggtttcaac

SEQ ID NO: 325814 - DNA, 25 bp, Mus musculus
cataactgttttgaccccaggaagg

SEQ ID NO: 325815 - DNA, 25 bp, Mus musculus
cataactgttttgatgggtttcaac

SEQ ID NO: 325816 - DNA, 25 bp, Mus musculus
cataacttcatgctggcgacgggta

SEQ ID NO: 325817 - DNA, 25 bp, Mus musculus
cataacttcatggtggcgacgggta

SEQ ID NO: 325818 - DNA, 25 bp, Mus musculus
cataacttgtatatgctgcttggga

SEQ ID NO: 325819 - DNA, 25 bp, Mus musculus
cataacttgtatttgctgcttggga

SEQ ID NO: 325820 - DNA, 25 bp, Mus musculus
cataacttgtcaactatatccccta

SEQ ID NO: 325821 - DNA, 25 bp, Mus musculus
cataacttgtcatctatatccccta

SEQ ID NO: 325822 - DNA, 25 bp, Mus musculus
cataactttctgcatgtccacatac

SEQ ID NO: 325823 - DNA, 25 bp, Mus musculus
cataactttctggatgtccacatac

SEQ ID NO: 325824 - DNA, 25 bp, Mus musculus
cataactttttgctaggtagcacac

SEQ ID NO: 325825 - DNA, 25 bp, Mus musculus
cataactttttggtaggtagcacac

SEQ ID NO: 325826 - DNA, 25 bp, Mus musculus
cataagaaagtacgcctttcacagt

SEQ ID NO: 325827 - DNA, 25 bp, Mus musculus
cataagaaagtaggcctttcacagt

SEQ ID NO: 325828 - DNA, 25 bp, Mus musculus
cataagaatttaatgacctcgggct

SEQ ID NO: 325829 - DNA, 25 bp, Mus musculus
cataagaatttattgacctcgggct

SEQ ID NO: 325830 - DNA, 25 bp, Mus musculus
cataagacagacaatgcgaggcgct

SEQ ID NO: 325831 - DNA, 25 bp, Mus musculus
cataagacagactatgcgaggcgct

SEQ ID NO: 325832 - DNA, 25 bp, Mus musculus
cataagactttgcactctcagtgtc

SEQ ID NO: 325833 - DNA, 25 bp, Mus musculus
cataagactttggactctcagtgtc

SEQ ID NO: 325834 - DNA, 25 bp, Mus musculus
cataagcagctactcttactgctcc

SEQ ID NO: 325835 - DNA, 25 bp, Mus musculus
cataagcagctagtcttactgctcc

SEQ ID NO: 325836 - DNA, 25 bp, Mus musculus
cataagcatctaatgaacatacatt

SEQ ID NO: 325837 - DNA, 25 bp, Mus musculus
cataagcatctattgaacatacatt

SEQ ID NO: 325838 - DNA, 25 bp, Mus musculus
cataagcatctgacacctcagtctt

SEQ ID NO: 325839 - DNA, 25 bp, Mus musculus
cataagcatctgtcacctcagtctt

SEQ ID NO: 325840 - DNA, 25 bp, Mus musculus
cataagcctgatagatgttcatggt

SEQ ID NO: 325841 - DNA, 25 bp, Mus musculus
cataagcctgattgatgttcatggt

SEQ ID NO: 325842 - DNA, 25 bp, Mus musculus
cataagcgaactatgtgcctgtcct

SEQ ID NO: 325843 - DNA, 25 bp, Mus musculus
cataagcgaactttgtgcctgtcct

SEQ ID NO: 325844 - DNA, 25 bp, Mus musculus
cataagctccttaacttgtggaaat

SEQ ID NO: 325845 - DNA, 25 bp, Mus musculus
cataagctcctttacttgtggaaat

SEQ ID NO: 325846 - DNA, 25 bp, Mus musculus
cataagctttgtcctggtttgcaca

SEQ ID NO: 325847 - DNA, 25 bp, Mus musculus
cataagctttgtgctggtttgcaca

SEQ ID NO: 325848 - DNA, 25 bp, Mus musculus
cataaggacctcagattaaatcttg

SEQ ID NO: 325849 - DNA, 25 bp, Mus musculus
cataaggacctctgattaaatcttg

SEQ ID NO: 325850 - DNA, 25 bp, Mus musculus
cataaggatgcaaggcagaggtact

SEQ ID NO: 325851 - DNA, 25 bp, Mus musculus
cataaggatgcatggcagaggtact

SEQ ID NO: 325852 - DNA, 25 bp, Mus musculus
cataaggatgctcacttgggttcag

SEQ ID NO: 325853 - DNA, 25 bp, Mus musculus
cataaggatgctgacttgggttcag

SEQ ID NO: 325854 - DNA, 25 bp, Mus musculus
cataaggcccggctcctgggtttct

SEQ ID NO: 325855 - DNA, 25 bp, Mus musculus
cataaggcccgggtcctgggtttct

SEQ ID NO: 325856 - DNA, 25 bp, Mus musculus
cataaggcgtgtctgtatccgagaa

SEQ ID NO: 325857 - DNA, 25 bp, Mus musculus
cataaggcgtgtgtgtatccgagaa

SEQ ID NO: 325858 - DNA, 25 bp, Mus musculus
cataaggctcttatactcctccgac

SEQ ID NO: 325859 - DNA, 25 bp, Mus musculus
cataaggctcttttactcctccgac

SEQ ID NO: 325860 - DNA, 25 bp, Mus musculus
cataaggctggacaaatcaattgct

SEQ ID NO: 325861 - DNA, 25 bp, Mus musculus
cataaggctggagaaatcaattgct

SEQ ID NO: 325862 - DNA, 25 bp, Mus musculus
cataaggctggcatctggactttgg

SEQ ID NO: 325863 - DNA, 25 bp, Mus musculus
cataaggctggcttctggactttgg

SEQ ID NO: 325864 - DNA, 25 bp, Mus musculus
cataagggaactacaaattgctaga

SEQ ID NO: 325865 - DNA, 25 bp, Mus musculus
cataagggaacttcaaattgctaga

SEQ ID NO: 325866 - DNA, 25 bp, Mus musculus
cataagggtcctctgatcaaggtga

SEQ ID NO: 325867 - DNA, 25 bp, Mus musculus
cataagggtcctgtgatcaaggtga

SEQ ID NO: 325868 - DNA, 25 bp, Mus musculus
cataaggtgttgatgactcgggtac

SEQ ID NO: 325869 - DNA, 25 bp, Mus musculus
cataaggtgttgttgactcgggtac

SEQ ID NO: 325870 - DNA, 25 bp, Mus musculus
cataaggttgatcgagatgtcgaag

SEQ ID NO: 325871 - DNA, 25 bp, Mus musculus
cataaggttgatggagatgtcgaag

SEQ ID NO: 325872 - DNA, 25 bp, Mus musculus
cataagtaatgcatgccctctgtgt

SEQ ID NO: 325873 - DNA, 25 bp, Mus musculus
cataagtaatgcttgccctctgtgt

SEQ ID NO: 325874 - DNA, 25 bp, Mus musculus
cataagtgcaccatcgggaaggagt

SEQ ID NO: 325875 - DNA, 25 bp, Mus musculus
cataagtgcaccttcgggaaggagt

SEQ ID NO: 325876 - DNA, 25 bp, Mus musculus
cataagtgttggcacgttttacctt

SEQ ID NO: 325877 - DNA, 25 bp, Mus musculus
cataagtgttgggacgttttacctt

SEQ ID NO: 325878 - DNA, 25 bp, Mus musculus
cataagttaactctgcacccgagcc

SEQ ID NO: 325879 - DNA, 25 bp, Mus musculus
cataagttaactgtgcacccgagcc

SEQ ID NO: 325880 - DNA, 25 bp, Mus musculus
cataagttgaatctttaggagtcca

SEQ ID NO: 325881 - DNA, 25 bp, Mus musculus
cataagttgaatgtttaggagtcca

SEQ ID NO: 325882 - DNA, 25 bp, Mus musculus
cataagtttggacatgtgctgttct

SEQ ID NO: 325883 - DNA, 25 bp, Mus musculus
cataagtttggagatgtgctgttct

SEQ ID NO: 325884 - DNA, 25 bp, Mus musculus
cataagtttgtcacagaagcacaca

SEQ ID NO: 325885 - DNA, 25 bp, Mus musculus
cataagtttgtctcagaagcacaca

SEQ ID NO: 325886 - DNA, 25 bp, Mus musculus
cataataagcttacccatcataata

SEQ ID NO: 325887 - DNA, 25 bp, Mus musculus
cataataagctttcccatcataata

SEQ ID NO: 325888 - DNA, 25 bp, Mus musculus
cataataatacaacgactattctct

SEQ ID NO: 325889 - DNA, 25 bp, Mus musculus
cataataatacatcgactattctct

SEQ ID NO: 325890 - DNA, 25 bp, Mus musculus
cataatagcagcacatcattacccc

SEQ ID NO: 325891 - DNA, 25 bp, Mus musculus
cataatagcagctcatcattacccc

SEQ ID NO: 325892 - DNA, 25 bp, Mus musculus
cataatatctatctctggcatcatc

SEQ ID NO: 325893 - DNA, 25 bp, Mus musculus
cataatatctatgtctggcatcatc

SEQ ID NO: 325894 - DNA, 25 bp, Mus musculus
cataatattgggagggttctgaact

SEQ ID NO: 325895 - DNA, 25 bp, Mus musculus
cataatattgggtgggttctgaact

SEQ ID NO: 325896 - DNA, 25 bp, Mus musculus
cataatcagtcacagctttgtgctt

SEQ ID NO: 325897 - DNA, 25 bp, Mus musculus
cataatcagtcagagctttgtgctt

SEQ ID NO: 325898 - DNA, 25 bp, Mus musculus
cataatcatcaacccttttccactt

SEQ ID NO: 325899 - DNA, 25 bp, Mus musculus
cataatcatcaagccttttccactt

SEQ ID NO: 325900 - DNA, 25 bp, Mus musculus
cataatccgaagacatttctaccaa

SEQ ID NO: 325901 - DNA, 25 bp, Mus musculus
cataatccgaagtcatttctaccaa

SEQ ID NO: 325902 - DNA, 25 bp, Mus musculus
cataatcctttgagtctctgggagt

SEQ ID NO: 325903 - DNA, 25 bp, Mus musculus
cataatcctttgtgtctctgggagt

SEQ ID NO: 325904 - DNA, 25 bp, Mus musculus
cataatcgaccacgttagtccactt

SEQ ID NO: 325905 - DNA, 25 bp, Mus musculus
cataatcgaccaggttagtccactt

SEQ ID NO: 325906 - DNA, 25 bp, Mus musculus
cataatcggattacattgtgctctg

SEQ ID NO: 325907 - DNA, 25 bp, Mus musculus
cataatcggatttcattgtgctctg

SEQ ID NO: 325908 - DNA, 25 bp, Mus musculus
cataatctagtgacttctgtaagag

SEQ ID NO: 325909 - DNA, 25 bp, Mus musculus
cataatctagtgtcttctgtaagag

SEQ ID NO: 325910 - DNA, 25 bp, Mus musculus
cataatctcctgagtgaagctcaag

SEQ ID NO: 325911 - DNA, 25 bp, Mus musculus
cataatctcctgtgtgaagctcaag

SEQ ID NO: 325912 - DNA, 25 bp, Mus musculus
cataatctgaggaccctgtggaaac

SEQ ID NO: 325913 - DNA, 25 bp, Mus musculus
cataatctgaggtccctgtggaaac

SEQ ID NO: 325914 - DNA, 25 bp, Mus musculus
cataatgaaatgacagttgctgcta

SEQ ID NO: 325915 - DNA, 25 bp, Mus musculus
cataatgaaatgtcagttgctgcta

SEQ ID NO: 325916 - DNA, 25 bp, Mus musculus
cataatgaacacaccagacatgggt

SEQ ID NO: 325917 - DNA, 25 bp, Mus musculus
cataatgaacactccagacatgggt

SEQ ID NO: 325918 - DNA, 25 bp, Mus musculus
cataatgacaataatgatgggactc

SEQ ID NO: 325919 - DNA, 25 bp, Mus musculus
cataatgacaattatgatgggactc

SEQ ID NO: 325920 - DNA, 25 bp, Mus musculus
cataatgacaccagcttctaatctc

SEQ ID NO: 325921 - DNA, 25 bp, Mus musculus
cataatgacacctgcttctaatctc

SEQ ID NO: 325922 - DNA, 25 bp, Mus musculus
cataatgatcgtccgctgtgatgct

SEQ ID NO: 325923 - DNA, 25 bp, Mus musculus
cataatgatcgtgcgctgtgatgct

SEQ ID NO: 325924 - DNA, 25 bp, Mus musculus
cataatgcagtcctttgaaaaccca

SEQ ID NO: 325925 - DNA, 25 bp, Mus musculus
cataatgcagtcgtttgaaaaccca

SEQ ID NO: 325926 - DNA, 25 bp, Mus musculus
cataatgcagttccccaaggcctgt

SEQ ID NO: 325927 - DNA, 25 bp, Mus musculus
cataatgcagttgcccaaggcctgt

SEQ ID NO: 325928 - DNA, 25 bp, Mus musculus
cataatgcctaaaacttgagtcttg

SEQ ID NO: 325929 - DNA, 25 bp, Mus musculus
cataatgcctaatacttgagtcttg

SEQ ID NO: 325930 - DNA, 25 bp, Mus musculus
cataatgctgttagtacttttggaa

SEQ ID NO: 325931 - DNA, 25 bp, Mus musculus
cataatgctgtttgtacttttggaa

SEQ ID NO: 325932 - DNA, 25 bp, Mus musculus
cataatggccatacagaacttttaa

SEQ ID NO: 325933 - DNA, 25 bp, Mus musculus
cataatggccattcagaacttttaa

SEQ ID NO: 325934 - DNA, 25 bp, Mus musculus
cataatgggcgcaggattggctgct

SEQ ID NO: 325935 - DNA, 25 bp, Mus musculus
cataatgggcgctggattggctgct

SEQ ID NO: 325936 - DNA, 25 bp, Mus musculus
cataatgtaaataagcggctacaga

SEQ ID NO: 325937 - DNA, 25 bp, Mus musculus
cataatgtaaattagcggctacaga

SEQ ID NO: 325938 - DNA, 25 bp, Mus musculus
cataatgtagtcatggttttggagt

SEQ ID NO: 325939 - DNA, 25 bp, Mus musculus
cataatgtagtcttggttttggagt

SEQ ID NO: 325940 - DNA, 25 bp, Mus musculus
cataatgtcactaggcggcactaat

SEQ ID NO: 325941 - DNA, 25 bp, Mus musculus
cataatgtcacttggcggcactaat

SEQ ID NO: 325942 - DNA, 25 bp, Mus musculus
cataatgtctcaatactgggtgtta

SEQ ID NO: 325943 - DNA, 25 bp, Mus musculus
cataatgtctcattactgggtgtta

SEQ ID NO: 325944 - DNA, 25 bp, Mus musculus
cataatgtctggaactttgctgaga

SEQ ID NO: 325945 - DNA, 25 bp, Mus musculus
cataatgtctggtactttgctgaga

SEQ ID NO: 325946 - DNA, 25 bp, Mus musculus
cataattaaattctccaggtatctc

SEQ ID NO: 325947 - DNA, 25 bp, Mus musculus
cataattaaattgtccaggtatctc

SEQ ID NO: 325948 - DNA, 25 bp, Mus musculus
cataattagatgaccaggctgcaga

SEQ ID NO: 325949 - DNA, 25 bp, Mus musculus
cataattagatgtccaggctgcaga

SEQ ID NO: 325950 - DNA, 25 bp, Mus musculus
cataattcaaatcgagtgtcccaga

SEQ ID NO: 325951 - DNA, 25 bp, Mus musculus
cataattcaaatggagtgtcccaga

SEQ ID NO: 325952 - DNA, 25 bp, Mus musculus
cataattccaacatgtgactgccaa

SEQ ID NO: 325953 - DNA, 25 bp, Mus musculus
cataattccaacttgtgactgccaa

SEQ ID NO: 325954 - DNA, 25 bp, Mus musculus
cataattccagtcctctgagatggg

SEQ ID NO: 325955 - DNA, 25 bp, Mus musculus
cataattccagtgctctgagatggg

SEQ ID NO: 325956 - DNA, 25 bp, Mus musculus
cataattctgttattgtcactgcaa

SEQ ID NO: 325957 - DNA, 25 bp, Mus musculus
cataattctgtttttgtcactgcaa

SEQ ID NO: 325958 - DNA, 25 bp, Mus musculus
cataattgatttactgatgcattta

SEQ ID NO: 325959 - DNA, 25 bp, Mus musculus
cataattgattttctgatgcattta

SEQ ID NO: 325960 - DNA, 25 bp, Mus musculus
cataattgtgcaaccgaactgggct

SEQ ID NO: 325961 - DNA, 25 bp, Mus musculus
cataattgtgcatccgaactgggct

SEQ ID NO: 325962 - DNA, 25 bp, Mus musculus
cataattgtggacgtggtgcaccct

SEQ ID NO: 325963 - DNA, 25 bp, Mus musculus
cataattgtggaggtggtgcaccct

SEQ ID NO: 325964 - DNA, 25 bp, Mus musculus
cataatttagctagcgtggtctata

SEQ ID NO: 325965 - DNA, 25 bp, Mus musculus
cataatttagcttgcgtggtctata

SEQ ID NO: 325966 - DNA, 25 bp, Mus musculus
cataatttcatgaatccttgttcat

SEQ ID NO: 325967 - DNA, 25 bp, Mus musculus
cataatttcatgtatccttgttcat

SEQ ID NO: 325968 - DNA, 25 bp, Mus musculus
catacaaatcaaagtgccggcagac

SEQ ID NO: 325969 - DNA, 25 bp, Mus musculus
catacaaatcaatgtgccggcagac

SEQ ID NO: 325970 - DNA, 25 bp, Mus musculus
catacaaatgaacaccaggtggagg

SEQ ID NO: 325971 - DNA, 25 bp, Mus musculus
catacaaatgaagaccaggtggagg

SEQ ID NO: 325972 - DNA, 25 bp, Mus musculus
catacaacaaggagggtcccattcc

SEQ ID NO: 325973 - DNA, 25 bp, Mus musculus
catacaacaaggtgggtcccattcc

SEQ ID NO: 325974 - DNA, 25 bp, Mus musculus
catacaacagtaacagtcctttaat

SEQ ID NO: 325975 - DNA, 25 bp, Mus musculus
catacaacagtatcagtcctttaat

SEQ ID NO: 325976 - DNA, 25 bp, Mus musculus
catacaaggagtccaggcaacactt

SEQ ID NO: 325977 - DNA, 25 bp, Mus musculus
catacaaggagtgcaggcaacactt

SEQ ID NO: 325978 - DNA, 25 bp, Mus musculus
catacaagtgttagcctgccaggct

SEQ ID NO: 325979 - DNA, 25 bp, Mus musculus
catacaagtgtttgcctgccaggct

SEQ ID NO: 325980 - DNA, 25 bp, Mus musculus
catacaatacaccaggttccttcaa

SEQ ID NO: 325981 - DNA, 25 bp, Mus musculus
catacaatacacgaggttccttcaa

SEQ ID NO: 325982 - DNA, 25 bp, Mus musculus
catacaattagaatcgtgctcgcct

SEQ ID NO: 325983 - DNA, 25 bp, Mus musculus
catacaattagattcgtgctcgcct

SEQ ID NO: 325984 - DNA, 25 bp, Mus musculus
catacaattgacagcgattgcctct

SEQ ID NO: 325985 - DNA, 25 bp, Mus musculus
catacaattgactgcgattgcctct

SEQ ID NO: 325986 - DNA, 25 bp, Mus musculus
catacaattgttagcttagaatctt

SEQ ID NO: 325987 - DNA, 25 bp, Mus musculus
catacaattgtttgcttagaatctt

SEQ ID NO: 325988 - DNA, 25 bp, Mus musculus
catacaattttgatactataatagt

SEQ ID NO: 325989 - DNA, 25 bp, Mus musculus
catacaattttgttactataatagt

SEQ ID NO: 325990 - DNA, 25 bp, Mus musculus
catacacaaaaaatggtctgctggt

SEQ ID NO: 325991 - DNA, 25 bp, Mus musculus
catacacaaaaattggtctgctggt

SEQ ID NO: 325992 - DNA, 25 bp, Mus musculus
catacacaagagctcccacatttag

SEQ ID NO: 325993 - DNA, 25 bp, Mus musculus
catacacaagaggtcccacatttag

SEQ ID NO: 325994 - DNA, 25 bp, Mus musculus
catacacaatgtaggttctcttcat

SEQ ID NO: 325995 - DNA, 25 bp, Mus musculus
catacacaatgttggttctcttcat

SEQ ID NO: 325996 - DNA, 25 bp, Mus musculus
catacacacaccctgttattctagt

SEQ ID NO: 325997 - DNA, 25 bp, Mus musculus
catacacacaccgtgttattctagt

SEQ ID NO: 325998 - DNA, 25 bp, Mus musculus
catacacacatgaagctggatgtca

SEQ ID NO: 325999 - DNA, 25 bp, Mus musculus
catacacacatgtagctggatgtca

SEQ ID NO: 326000 - DNA, 25 bp, Mus musculus
catacacacctgcattaaatgaatg

SEQ ID NO: 326001 - DNA, 25 bp, Mus musculus
catacacacctggattaaatgaatg

SEQ ID NO: 326002 - DNA, 25 bp, Mus musculus
catacacacgtgctctgacatataa

SEQ ID NO: 326003 - DNA, 25 bp, Mus musculus
catacacacgtggtctgacatataa

SEQ ID NO: 326004 - DNA, 25 bp, Mus musculus
catacacacttaccctattgtacac

SEQ ID NO: 326005 - DNA, 25 bp, Mus musculus
catacacacttagcctattgtacac

SEQ ID NO: 326006 - DNA, 25 bp, Mus musculus
catacacataggctactgaccagtg

SEQ ID NO: 326007 - DNA, 25 bp, Mus musculus
catacacatagggtactgaccagtg

SEQ ID NO: 326008 - DNA, 25 bp, Mus musculus
catacaccatacagatacacaccag

SEQ ID NO: 326009 - DNA, 25 bp, Mus musculus
catacaccatactgatacacaccag

SEQ ID NO: 326010 - DNA, 25 bp, Mus musculus
catacacccattcatacacacatag

SEQ ID NO: 326011 - DNA, 25 bp, Mus musculus
catacacccattgatacacacatag

SEQ ID NO: 326012 - DNA, 25 bp, Mus musculus
catacaccgttccttttacatgtgg

SEQ ID NO: 326013 - DNA, 25 bp, Mus musculus
catacaccgttcgttttacatgtgg

SEQ ID NO: 326014 - DNA, 25 bp, Mus musculus
catacacgggtcctttatttactgg

SEQ ID NO: 326015 - DNA, 25 bp, Mus musculus
catacacgggtcgtttatttactgg

SEQ ID NO: 326016 - DNA, 25 bp, Mus musculus
catacactaaacaggctcaccattt

SEQ ID NO: 326017 - DNA, 25 bp, Mus musculus
catacactaaactggctcaccattt

SEQ ID NO: 326018 - DNA, 25 bp, Mus musculus
catacactagagactgcaggaggtt

SEQ ID NO: 326019 - DNA, 25 bp, Mus musculus
catacactagagtctgcaggaggtt

SEQ ID NO: 326020 - DNA, 25 bp, Mus musculus
catacactctccatcagctgtctgt

SEQ ID NO: 326021 - DNA, 25 bp, Mus musculus
catacactctccttcagctgtctgt

SEQ ID NO: 326022 - DNA, 25 bp, Mus musculus
catacactgtccagaggcattctca

SEQ ID NO: 326023 - DNA, 25 bp, Mus musculus
catacactgtcctgaggcattctca

SEQ ID NO: 326024 - DNA, 25 bp, Mus musculus
catacactgtgtctttctagaaccc

SEQ ID NO: 326025 - DNA, 25 bp, Mus musculus
catacactgtgtgtttctagaaccc

SEQ ID NO: 326026 - DNA, 25 bp, Mus musculus
catacacttgtcatataacgtttta

SEQ ID NO: 326027 - DNA, 25 bp, Mus musculus
catacacttgtcttataacgtttta

SEQ ID NO: 326028 - DNA, 25 bp, Mus musculus
catacacttgtgagcatgactcagg

SEQ ID NO: 326029 - DNA, 25 bp, Mus musculus
catacacttgtgtgcatgactcagg

SEQ ID NO: 326030 - DNA, 25 bp, Mus musculus
catacagaatgaagggtctcctggt

SEQ ID NO: 326031 - DNA, 25 bp, Mus musculus
catacagaatgatgggtctcctggt

SEQ ID NO: 326032 - DNA, 25 bp, Mus musculus
catacagacctcagcaaaccaaatt

SEQ ID NO: 326033 - DNA, 25 bp, Mus musculus
catacagacctctgcaaaccaaatt

SEQ ID NO: 326034 - DNA, 25 bp, Mus musculus
catacagactaaatgtgcaagcacc

SEQ ID NO: 326035 - DNA, 25 bp, Mus musculus
catacagactaattgtgcaagcacc

SEQ ID NO: 326036 - DNA, 25 bp, Mus musculus
catacagagatgctcgagtggcaca

SEQ ID NO: 326037 - DNA, 25 bp, Mus musculus
catacagagatggtcgagtggcaca

SEQ ID NO: 326038 - DNA, 25 bp, Mus musculus
catacagaggtacagcactggccta

SEQ ID NO: 326039 - DNA, 25 bp, Mus musculus
catacagaggtagagcactggccta

SEQ ID NO: 326040 - DNA, 25 bp, Mus musculus
catacagatgtacggaatgtggcaa

SEQ ID NO: 326041 - DNA, 25 bp, Mus musculus
catacagatgtagggaatgtggcaa

SEQ ID NO: 326042 - DNA, 25 bp, Mus musculus
catacagcaccaataaactttgcag

SEQ ID NO: 326043 - DNA, 25 bp, Mus musculus
catacagcaccattaaactttgcag

SEQ ID NO: 326044 - DNA, 25 bp, Mus musculus
catacaggatacatgtttttggttt

SEQ ID NO: 326045 - DNA, 25 bp, Mus musculus
catacaggatacttgtttttggttt

SEQ ID NO: 326046 - DNA, 25 bp, Mus musculus
catacaggcagacataatgttgaag

SEQ ID NO: 326047 - DNA, 25 bp, Mus musculus
catacaggcagagataatgttgaag

SEQ ID NO: 326048 - DNA, 25 bp, Mus musculus
catacaggccctcagttggacattt

SEQ ID NO: 326049 - DNA, 25 bp, Mus musculus
catacaggccctgagttggacattt

SEQ ID NO: 326050 - DNA, 25 bp, Mus musculus
catacaggctctccagggaaggctg

SEQ ID NO: 326051 - DNA, 25 bp, Mus musculus
catacaggctctgcagggaaggctg

SEQ ID NO: 326052 - DNA, 25 bp, Mus musculus
catacagggccactactccatgagc

SEQ ID NO: 326053 - DNA, 25 bp, Mus musculus
catacagggccagtactccatgagc

SEQ ID NO: 326054 - DNA, 25 bp, Mus musculus
catacaggtactatgggacccctgg

SEQ ID NO: 326055 - DNA, 25 bp, Mus musculus
catacaggtactttgggacccctgg

SEQ ID NO: 326056 - DNA, 25 bp, Mus musculus
catacaggtgagctggttctataca

SEQ ID NO: 326057 - DNA, 25 bp, Mus musculus
catacaggtgaggtggttctataca

SEQ ID NO: 326058 - DNA, 25 bp, Mus musculus
catacagtaattaccttacctcctc

SEQ ID NO: 326059 - DNA, 25 bp, Mus musculus
catacagtaatttccttacctcctc

SEQ ID NO: 326060 - DNA, 25 bp, Mus musculus
catacagtatgtctgaaggtctcct

SEQ ID NO: 326061 - DNA, 25 bp, Mus musculus
catacagtatgtgtgaaggtctcct

SEQ ID NO: 326062 - DNA, 25 bp, Mus musculus
catacagtatttattcccttcacct

SEQ ID NO: 326063 - DNA, 25 bp, Mus musculus
catacagtattttttcccttcacct

SEQ ID NO: 326064 - DNA, 25 bp, Mus musculus
catacagtcacacagatttctagtc

SEQ ID NO: 326065 - DNA, 25 bp, Mus musculus
catacagtcacagagatttctagtc

SEQ ID NO: 326066 - DNA, 25 bp, Mus musculus
catacagtgagccactttgggtcga

SEQ ID NO: 326067 - DNA, 25 bp, Mus musculus
catacagtgagcgactttgggtcga

SEQ ID NO: 326068 - DNA, 25 bp, Mus musculus
catacagtgcttatgtaccttgtaa

SEQ ID NO: 326069 - DNA, 25 bp, Mus musculus
catacagtgcttttgtaccttgtaa

SEQ ID NO: 326070 - DNA, 25 bp, Mus musculus
catacagtgtatcatcaattgagat

SEQ ID NO: 326071 - DNA, 25 bp, Mus musculus
catacagtgtatgatcaattgagat

SEQ ID NO: 326072 - DNA, 25 bp, Mus musculus
catacagtgtttagggttttagact

SEQ ID NO: 326073 - DNA, 25 bp, Mus musculus
catacagtgttttgggttttagact

SEQ ID NO: 326074 - DNA, 25 bp, Mus musculus
catacataaatgcttcaagacttac

SEQ ID NO: 326075 - DNA, 25 bp, Mus musculus
catacataaatggttcaagacttac

SEQ ID NO: 326076 - DNA, 25 bp, Mus musculus
catacatacaagcaggcaaacgcct

SEQ ID NO: 326077 - DNA, 25 bp, Mus musculus
catacatacaaggaggcaaacgcct

SEQ ID NO: 326078 - DNA, 25 bp, Mus musculus
catacataccttacccatttatcag

SEQ ID NO: 326079 - DNA, 25 bp, Mus musculus
catacatacctttcccatttatcag

SEQ ID NO: 326080 - DNA, 25 bp, Mus musculus
catacatactccactgatgccaaac

SEQ ID NO: 326081 - DNA, 25 bp, Mus musculus
catacatactcctctgatgccaaac

SEQ ID NO: 326082 - DNA, 25 bp, Mus musculus
catacatagtaaaagcaggcaatca

SEQ ID NO: 326083 - DNA, 25 bp, Mus musculus
catacatagtaatagcaggcaatca

SEQ ID NO: 326084 - DNA, 25 bp, Mus musculus
catacatccctacgctgatgtttat

SEQ ID NO: 326085 - DNA, 25 bp, Mus musculus
catacatccctaggctgatgtttat

SEQ ID NO: 326086 - DNA, 25 bp, Mus musculus
catacatccttaaataattctcccc

SEQ ID NO: 326087 - DNA, 25 bp, Mus musculus
catacatccttatataattctcccc

SEQ ID NO: 326088 - DNA, 25 bp, Mus musculus
catacatgccctaccaatacatgca

SEQ ID NO: 326089 - DNA, 25 bp, Mus musculus
catacatgcccttccaatacatgca

SEQ ID NO: 326090 - DNA, 25 bp, Mus musculus
catacatgctacaaatgggcctatg

SEQ ID NO: 326091 - DNA, 25 bp, Mus musculus
catacatgctactaatgggcctatg

SEQ ID NO: 326092 - DNA, 25 bp, Mus musculus
catacatgggtcactggctcaccag

SEQ ID NO: 326093 - DNA, 25 bp, Mus musculus
catacatgggtctctggctcaccag

SEQ ID NO: 326094 - DNA, 25 bp, Mus musculus
catacatgtaccatcgtgtgatcat

SEQ ID NO: 326095 - DNA, 25 bp, Mus musculus
catacatgtaccttcgtgtgatcat

SEQ ID NO: 326096 - DNA, 25 bp, Mus musculus
catacattagacagtgaagttcttt

SEQ ID NO: 326097 - DNA, 25 bp, Mus musculus
catacattagactgtgaagttcttt

SEQ ID NO: 326098 - DNA, 25 bp, Mus musculus
catacattgataccattatttttca

SEQ ID NO: 326099 - DNA, 25 bp, Mus musculus
catacattgatagcattatttttca

SEQ ID NO: 326100 - DNA, 25 bp, Mus musculus
catacatttaaacgccacggaatcc

SEQ ID NO: 326101 - DNA, 25 bp, Mus musculus
catacatttaaaggccacggaatcc

SEQ ID NO: 326102 - DNA, 25 bp, Mus musculus
catacatttctaaaagacttgcgac

SEQ ID NO: 326103 - DNA, 25 bp, Mus musculus
catacatttctataagacttgcgac

SEQ ID NO: 326104 - DNA, 25 bp, Mus musculus
cataccaagcacagtcttgtgtttt

SEQ ID NO: 326105 - DNA, 25 bp, Mus musculus
cataccaagcactgtcttgtgtttt

SEQ ID NO: 326106 - DNA, 25 bp, Mus musculus
cataccaatcacacttctgatctgg

SEQ ID NO: 326107 - DNA, 25 bp, Mus musculus
cataccaatcactcttctgatctgg

SEQ ID NO: 326108 - DNA, 25 bp, Mus musculus
cataccacattacccctggacaaaa

SEQ ID NO: 326109 - DNA, 25 bp, Mus musculus
cataccacattagccctggacaaaa

SEQ ID NO: 326110 - DNA, 25 bp, Mus musculus
cataccactatgaaattcaacttta

SEQ ID NO: 326111 - DNA, 25 bp, Mus musculus
cataccactatgtaattcaacttta

SEQ ID NO: 326112 - DNA, 25 bp, Mus musculus
cataccactgcccaaagcctttttt

SEQ ID NO: 326113 - DNA, 25 bp, Mus musculus
cataccactgccgaaagcctttttt

SEQ ID NO: 326114 - DNA, 25 bp, Mus musculus
cataccagatgtatcagatttgaga

SEQ ID NO: 326115 - DNA, 25 bp, Mus musculus
cataccagatgtttcagatttgaga

SEQ ID NO: 326116 - DNA, 25 bp, Mus musculus
cataccagatttagctattcacatt

SEQ ID NO: 326117 - DNA, 25 bp, Mus musculus
cataccagattttgctattcacatt

SEQ ID NO: 326118 - DNA, 25 bp, Mus musculus
cataccagcgtgctgttttatttgc

SEQ ID NO: 326119 - DNA, 25 bp, Mus musculus
cataccagcgtggtgttttatttgc

SEQ ID NO: 326120 - DNA, 25 bp, Mus musculus
cataccagtgcgatagctgctgcaa

SEQ ID NO: 326121 - DNA, 25 bp, Mus musculus
cataccagtgcgttagctgctgcaa

SEQ ID NO: 326122 - DNA, 25 bp, Mus musculus
cataccataatcattttcgcatcat

SEQ ID NO: 326123 - DNA, 25 bp, Mus musculus
cataccataatctttttcgcatcat

SEQ ID NO: 326124 - DNA, 25 bp, Mus musculus
cataccatgcaactgggttcttaca

SEQ ID NO: 326125 - DNA, 25 bp, Mus musculus
cataccatgcaagtgggttcttaca

SEQ ID NO: 326126 - DNA, 25 bp, Mus musculus
cataccatgtgcattttgaaatcag

SEQ ID NO: 326127 - DNA, 25 bp, Mus musculus
cataccatgtgctttttgaaatcag

SEQ ID NO: 326128 - DNA, 25 bp, Mus musculus
cataccatgtgtctattgattcttg

SEQ ID NO: 326129 - DNA, 25 bp, Mus musculus
cataccatgtgtgtattgattcttg

SEQ ID NO: 326130 - DNA, 25 bp, Mus musculus
cataccattcttattccactaatac

SEQ ID NO: 326131 - DNA, 25 bp, Mus musculus
cataccattctttttccactaatac

SEQ ID NO: 326132 - DNA, 25 bp, Mus musculus
cataccattttaatctgcttgaggg

SEQ ID NO: 326133 - DNA, 25 bp, Mus musculus
cataccattttattctgcttgaggg

SEQ ID NO: 326134 - DNA, 25 bp, Mus musculus
catacccaacccagtagaagttaga

SEQ ID NO: 326135 - DNA, 25 bp, Mus musculus
catacccaaccctgtagaagttaga

SEQ ID NO: 326136 - DNA, 25 bp, Mus musculus
catacccaacctcacaatttaaaca

SEQ ID NO: 326137 - DNA, 25 bp, Mus musculus
catacccaacctgacaatttaaaca

SEQ ID NO: 326138 - DNA, 25 bp, Mus musculus
catacccaccacagtgtgacattaa

SEQ ID NO: 326139 - DNA, 25 bp, Mus musculus
catacccaccactgtgtgacattaa

SEQ ID NO: 326140 - DNA, 25 bp, Mus musculus
catacccaccctagttgtgtataaa

SEQ ID NO: 326141 - DNA, 25 bp, Mus musculus
catacccacccttgttgtgtataaa

SEQ ID NO: 326142 - DNA, 25 bp, Mus musculus
catacccacctacccagatatttta

SEQ ID NO: 326143 - DNA, 25 bp, Mus musculus
catacccacctagccagatatttta

SEQ ID NO: 326144 - DNA, 25 bp, Mus musculus
catacccacgtgcccagtcagatct

SEQ ID NO: 326145 - DNA, 25 bp, Mus musculus
catacccacgtggccagtcagatct

SEQ ID NO: 326146 - DNA, 25 bp, Mus musculus
cataccccatgcaacttgttagagc

SEQ ID NO: 326147 - DNA, 25 bp, Mus musculus
cataccccatgctacttgttagagc

SEQ ID NO: 326148 - DNA, 25 bp, Mus musculus
catacccctctaacatgtagtgcat

SEQ ID NO: 326149 - DNA, 25 bp, Mus musculus
catacccctctatcatgtagtgcat

SEQ ID NO: 326150 - DNA, 25 bp, Mus musculus
catacccctggaacctcttgtggct

SEQ ID NO: 326151 - DNA, 25 bp, Mus musculus
catacccctggatcctcttgtggct

SEQ ID NO: 326152 - DNA, 25 bp, Mus musculus
cataccccttctcggtttctagaat

SEQ ID NO: 326153 - DNA, 25 bp, Mus musculus
cataccccttctgggtttctagaat

SEQ ID NO: 326154 - DNA, 25 bp, Mus musculus
catacccgtaggaacacagagattt

SEQ ID NO: 326155 - DNA, 25 bp, Mus musculus
catacccgtaggtacacagagattt

SEQ ID NO: 326156 - DNA, 25 bp, Mus musculus
cataccctcaagcttcgtgctctgt

SEQ ID NO: 326157 - DNA, 25 bp, Mus musculus
cataccctcaaggttcgtgctctgt

SEQ ID NO: 326158 - DNA, 25 bp, Mus musculus
cataccctcccaaaacaattcagtt

SEQ ID NO: 326159 - DNA, 25 bp, Mus musculus
cataccctcccataacaattcagtt

SEQ ID NO: 326160 - DNA, 25 bp, Mus musculus
cataccctgaccagccactgatttt

SEQ ID NO: 326161 - DNA, 25 bp, Mus musculus
cataccctgacctgccactgatttt

SEQ ID NO: 326162 - DNA, 25 bp, Mus musculus
cataccctgaggaacaggctgctct

SEQ ID NO: 326163 - DNA, 25 bp, Mus musculus
cataccctgaggtacaggctgctct

SEQ ID NO: 326164 - DNA, 25 bp, Mus musculus
cataccctgccccttcagtgggtgg

SEQ ID NO: 326165 - DNA, 25 bp, Mus musculus
cataccctgcccgttcagtgggtgg

SEQ ID NO: 326166 - DNA, 25 bp, Mus musculus
cataccctggcgaatgggacacaat

SEQ ID NO: 326167 - DNA, 25 bp, Mus musculus
cataccctggcgtatgggacacaat

SEQ ID NO: 326168 - DNA, 25 bp, Mus musculus
catacccttggtagacatttctcat

SEQ ID NO: 326169 - DNA, 25 bp, Mus musculus
catacccttggttgacatttctcat

SEQ ID NO: 326170 - DNA, 25 bp, Mus musculus
cataccgggtaaaggcaccccttct

SEQ ID NO: 326171 - DNA, 25 bp, Mus musculus
cataccgggtaatggcaccccttct

SEQ ID NO: 326172 - DNA, 25 bp, Mus musculus
catacctaagagaaacccttcaaat

SEQ ID NO: 326173 - DNA, 25 bp, Mus musculus
catacctaagagtaacccttcaaat

SEQ ID NO: 326174 - DNA, 25 bp, Mus musculus
catacctaatgacctgtcttcacca

SEQ ID NO: 326175 - DNA, 25 bp, Mus musculus
catacctaatgagctgtcttcacca

SEQ ID NO: 326176 - DNA, 25 bp, Mus musculus
catacctacatgatggttgctgctt

SEQ ID NO: 326177 - DNA, 25 bp, Mus musculus
catacctacatgttggttgctgctt

SEQ ID NO: 326178 - DNA, 25 bp, Mus musculus
catacctaccttctaatttgctcaa

SEQ ID NO: 326179 - DNA, 25 bp, Mus musculus
catacctaccttgtaatttgctcaa

SEQ ID NO: 326180 - DNA, 25 bp, Mus musculus
catacctatgaacccatccgtgaaa

SEQ ID NO: 326181 - DNA, 25 bp, Mus musculus
catacctatgaagccatccgtgaaa

SEQ ID NO: 326182 - DNA, 25 bp, Mus musculus
catacctccaggcagggttggaaat

SEQ ID NO: 326183 - DNA, 25 bp, Mus musculus
catacctccagggagggttggaaat

SEQ ID NO: 326184 - DNA, 25 bp, Mus musculus
catacctgacacagcttgggtaact

SEQ ID NO: 326185 - DNA, 25 bp, Mus musculus
catacctgacactgcttgggtaact

SEQ ID NO: 326186 - DNA, 25 bp, Mus musculus
catacctgataaagttgggactttg

SEQ ID NO: 326187 - DNA, 25 bp, Mus musculus
catacctgataatgttgggactttg

SEQ ID NO: 326188 - DNA, 25 bp, Mus musculus
catacctgcattcccaagctttggg

SEQ ID NO: 326189 - DNA, 25 bp, Mus musculus
catacctgcattgccaagctttggg

SEQ ID NO: 326190 - DNA, 25 bp, Mus musculus
catacctgccgcagccggtggacaa

SEQ ID NO: 326191 - DNA, 25 bp, Mus musculus
catacctgccgctgccggtggacaa

SEQ ID NO: 326192 - DNA, 25 bp, Mus musculus
catacctgcctaacttaaactctta

SEQ ID NO: 326193 - DNA, 25 bp, Mus musculus
catacctgcctatcttaaactctta

SEQ ID NO: 326194 - DNA, 25 bp, Mus musculus
catacctgtcctagatttataatac

SEQ ID NO: 326195 - DNA, 25 bp, Mus musculus
catacctgtccttgatttataatac

SEQ ID NO: 326196 - DNA, 25 bp, Mus musculus
catacctgtctgctacttgcttatt

SEQ ID NO: 326197 - DNA, 25 bp, Mus musculus
catacctgtctggtacttgcttatt

SEQ ID NO: 326198 - DNA, 25 bp, Mus musculus
cataccttccttcaaccaaactttg

SEQ ID NO: 326199 - DNA, 25 bp, Mus musculus
cataccttccttcaagttttgtcct

SEQ ID NO: 326200 - DNA, 25 bp, Mus musculus
cataccttccttgaaccaaactttg

SEQ ID NO: 326201 - DNA, 25 bp, Mus musculus
cataccttccttgaagttttgtcct

SEQ ID NO: 326202 - DNA, 25 bp, Mus musculus
cataccttgcttagcccagactgac

SEQ ID NO: 326203 - DNA, 25 bp, Mus musculus
cataccttgctttgcccagactgac

SEQ ID NO: 326204 - DNA, 25 bp, Mus musculus
cataccttggcacacagatatctca

SEQ ID NO: 326205 - DNA, 25 bp, Mus musculus
cataccttggcagacagatatctca

SEQ ID NO: 326206 - DNA, 25 bp, Mus musculus
catacctttaggcttggtaagggag

SEQ ID NO: 326207 - DNA, 25 bp, Mus musculus
catacctttagggttggtaagggag

SEQ ID NO: 326208 - DNA, 25 bp, Mus musculus
catacctttatcctgagtgaccctt

SEQ ID NO: 326209 - DNA, 25 bp, Mus musculus
catacctttatcgtgagtgaccctt

SEQ ID NO: 326210 - DNA, 25 bp, Mus musculus
catacctttccaacttgtgtgggct

SEQ ID NO: 326211 - DNA, 25 bp, Mus musculus
catacctttccatcttgtgtgggct

SEQ ID NO: 326212 - DNA, 25 bp, Mus musculus
catacctttcttaccactcaattgt

SEQ ID NO: 326213 - DNA, 25 bp, Mus musculus
catacctttctttccactcaattgt

SEQ ID NO: 326214 - DNA, 25 bp, Mus musculus
cataccttttaaaccttgtggtcct

SEQ ID NO: 326215 - DNA, 25 bp, Mus musculus
cataccttttaatccttgtggtcct

SEQ ID NO: 326216 - DNA, 25 bp, Mus musculus
catacgaaggtgatgctgtggagtt

SEQ ID NO: 326217 - DNA, 25 bp, Mus musculus
catacgaaggtgttgctgtggagtt

SEQ ID NO: 326218 - DNA, 25 bp, Mus musculus
catacgactcgtatttcttcagtag

SEQ ID NO: 326219 - DNA, 25 bp, Mus musculus
catacgactcgtttttcttcagtag

SEQ ID NO: 326220 - DNA, 25 bp, Mus musculus
catacgaggagaccaaacagagata

SEQ ID NO: 326221 - DNA, 25 bp, Mus musculus
catacgaggagagcaaacagagata

SEQ ID NO: 326222 - DNA, 25 bp, Mus musculus
catacgagtgacagccattggttga

SEQ ID NO: 326223 - DNA, 25 bp, Mus musculus
catacgagtgactgccattggttga

SEQ ID NO: 326224 - DNA, 25 bp, Mus musculus
catacgatctgaagtgcctgaccac

SEQ ID NO: 326225 - DNA, 25 bp, Mus musculus
catacgatctgatgtgcctgaccac

SEQ ID NO: 326226 - DNA, 25 bp, Mus musculus
catacgatgttgatagtaacagcga

SEQ ID NO: 326227 - DNA, 25 bp, Mus musculus
catacgatgttgttagtaacagcga

SEQ ID NO: 326228 - DNA, 25 bp, Mus musculus
catacgattgtccttttccgtggga

SEQ ID NO: 326229 - DNA, 25 bp, Mus musculus
catacgattgtcgttttccgtggga

SEQ ID NO: 326230 - DNA, 25 bp, Mus musculus
catacggcaggtcgccattgagttc

SEQ ID NO: 326231 - DNA, 25 bp, Mus musculus
catacggcaggtggccattgagttc

SEQ ID NO: 326232 - DNA, 25 bp, Mus musculus
catacggtgggtcaccaaggtctta

SEQ ID NO: 326233 - DNA, 25 bp, Mus musculus
catacggtgggtgaccaaggtctta

SEQ ID NO: 326234 - DNA, 25 bp, Mus musculus
catacgtatgctatgctttttgatt

SEQ ID NO: 326235 - DNA, 25 bp, Mus musculus
catacgtatgctttgctttttgatt

SEQ ID NO: 326236 - DNA, 25 bp, Mus musculus
catacgtgaacaaacctgacagggt

SEQ ID NO: 326237 - DNA, 25 bp, Mus musculus
catacgtgaacatacctgacagggt

SEQ ID NO: 326238 - DNA, 25 bp, Mus musculus
catacgtggcctataaacctagcat

SEQ ID NO: 326239 - DNA, 25 bp, Mus musculus
catacgtggcctttaaacctagcat

SEQ ID NO: 326240 - DNA, 25 bp, Mus musculus
catacgtgtaacaattttctcaccc

SEQ ID NO: 326241 - DNA, 25 bp, Mus musculus
catacgtgtaactattttctcaccc

SEQ ID NO: 326242 - DNA, 25 bp, Mus musculus
catacgtgtgccagtgtgatttttt

SEQ ID NO: 326243 - DNA, 25 bp, Mus musculus
catacgtgtgcctgtgtgatttttt

SEQ ID NO: 326244 - DNA, 25 bp, Mus musculus
catacgttgcaaacctaggaggctt

SEQ ID NO: 326245 - DNA, 25 bp, Mus musculus
catacgttgcaatcctaggaggctt

SEQ ID NO: 326246 - DNA, 25 bp, Mus musculus
catacgtttcataactcccaaggga

SEQ ID NO: 326247 - DNA, 25 bp, Mus musculus
catacgtttcattactcccaaggga

SEQ ID NO: 326248 - DNA, 25 bp, Mus musculus
catactacacacatgcaatgcagac

SEQ ID NO: 326249 - DNA, 25 bp, Mus musculus
catactacacacttgcaatgcagac

SEQ ID NO: 326250 - DNA, 25 bp, Mus musculus
catactacagctatccaatacggaa

SEQ ID NO: 326251 - DNA, 25 bp, Mus musculus
catactacagctttccaatacggaa

SEQ ID NO: 326252 - DNA, 25 bp, Mus musculus
catactaccatcagtccttgccatt

SEQ ID NO: 326253 - DNA, 25 bp, Mus musculus
catactaccatctgtccttgccatt

SEQ ID NO: 326254 - DNA, 25 bp, Mus musculus
catactaccattctaataacagcaa

SEQ ID NO: 326255 - DNA, 25 bp, Mus musculus
catactaccattgtaataacagcaa

SEQ ID NO: 326256 - DNA, 25 bp, Mus musculus
catactaggtatctttcaggtaaac

SEQ ID NO: 326257 - DNA, 25 bp, Mus musculus
catactaggtatgtttcaggtaaac

SEQ ID NO: 326258 - DNA, 25 bp, Mus musculus
catactataataaagcagagctgtg

SEQ ID NO: 326259 - DNA, 25 bp, Mus musculus
catactataatatagcagagctgtg

SEQ ID NO: 326260 - DNA, 25 bp, Mus musculus
catactatagcacggcagaggcatt

SEQ ID NO: 326261 - DNA, 25 bp, Mus musculus
catactatagcagggcagaggcatt

SEQ ID NO: 326262 - DNA, 25 bp, Mus musculus
catactatggtcatgacaatataag

SEQ ID NO: 326263 - DNA, 25 bp, Mus musculus
catactatggtcttgacaatataag

SEQ ID NO: 326264 - DNA, 25 bp, Mus musculus
catactatgttcaaggatatccagg

SEQ ID NO: 326265 - DNA, 25 bp, Mus musculus
catactatgttctaggatatccagg

SEQ ID NO: 326266 - DNA, 25 bp, Mus musculus
catactcagagtcgcacagtttcac

SEQ ID NO: 326267 - DNA, 25 bp, Mus musculus
catactcagagtggcacagtttcac

SEQ ID NO: 326268 - DNA, 25 bp, Mus musculus
catactcagtagctgggacctgaca

SEQ ID NO: 326269 - DNA, 25 bp, Mus musculus
catactcagtaggtgggacctgaca

SEQ ID NO: 326270 - DNA, 25 bp, Mus musculus
catactcagtttatgcactgccggg

SEQ ID NO: 326271 - DNA, 25 bp, Mus musculus
catactcagtttttgcactgccggg

SEQ ID NO: 326272 - DNA, 25 bp, Mus musculus
catactccctctctaaataaatgtg

SEQ ID NO: 326273 - DNA, 25 bp, Mus musculus
catactccctctgtaaataaatgtg

SEQ ID NO: 326274 - DNA, 25 bp, Mus musculus
catactcctcgaagcaccaaggatg

SEQ ID NO: 326275 - DNA, 25 bp, Mus musculus
catactcctcgatgcaccaaggatg

SEQ ID NO: 326276 - DNA, 25 bp, Mus musculus
catactctccgtaccagtgtaggag

SEQ ID NO: 326277 - DNA, 25 bp, Mus musculus
catactctccgttccagtgtaggag

SEQ ID NO: 326278 - DNA, 25 bp, Mus musculus
catactctgaacaccctgagaaagt

SEQ ID NO: 326279 - DNA, 25 bp, Mus musculus
catactctgaactccctgagaaagt

SEQ ID NO: 326280 - DNA, 25 bp, Mus musculus
catactctgaccatatctttccaaa

SEQ ID NO: 326281 - DNA, 25 bp, Mus musculus
catactctgaccttatctttccaaa

SEQ ID NO: 326282 - DNA, 25 bp, Mus musculus
catactctgaggcaactgagactga

SEQ ID NO: 326283 - DNA, 25 bp, Mus musculus
catactctgagggaactgagactga

SEQ ID NO: 326284 - DNA, 25 bp, Mus musculus
catactctgatcagctaccatcttc

SEQ ID NO: 326285 - DNA, 25 bp, Mus musculus
catactctgatctgctaccatcttc

SEQ ID NO: 326286 - DNA, 25 bp, Mus musculus
catactctgtgaatccaggctcctc

SEQ ID NO: 326287 - DNA, 25 bp, Mus musculus
catactctgtgattccaggctcctc

SEQ ID NO: 326288 - DNA, 25 bp, Mus musculus
catactctttgacaacacccgtgat

SEQ ID NO: 326289 - DNA, 25 bp, Mus musculus
catactctttgagaacacccgtgat

SEQ ID NO: 326290 - DNA, 25 bp, Mus musculus
catactgaacacactgccttttatc

SEQ ID NO: 326291 - DNA, 25 bp, Mus musculus
catactgaacactctgccttttatc

SEQ ID NO: 326292 - DNA, 25 bp, Mus musculus
catactgagttccaaatctatagag

SEQ ID NO: 326293 - DNA, 25 bp, Mus musculus
catactgagttcgaaatctatagag

SEQ ID NO: 326294 - DNA, 25 bp, Mus musculus
catactgatatcagtttcctgggaa

SEQ ID NO: 326295 - DNA, 25 bp, Mus musculus
catactgatatctgtttcctgggaa

SEQ ID NO: 326296 - DNA, 25 bp, Mus musculus
catactgatctcaatttttgtttaa

SEQ ID NO: 326297 - DNA, 25 bp, Mus musculus
catactgatctctatttttgtttaa

SEQ ID NO: 326298 - DNA, 25 bp, Mus musculus
catactgcatccatggtgtcatgaa

SEQ ID NO: 326299 - DNA, 25 bp, Mus musculus
catactgcatccttggtgtcatgaa

SEQ ID NO: 326300 - DNA, 25 bp, Mus musculus
catactgcggatcctgcaggctctg

SEQ ID NO: 326301 - DNA, 25 bp, Mus musculus
catactgcggatgctgcaggctctg

SEQ ID NO: 326302 - DNA, 25 bp, Mus musculus
catactgctgttacttcctaaagtg

SEQ ID NO: 326303 - DNA, 25 bp, Mus musculus
catactgctgtttcttcctaaagtg

SEQ ID NO: 326304 - DNA, 25 bp, Mus musculus
catactgcttcaaacattcctttgt

SEQ ID NO: 326305 - DNA, 25 bp, Mus musculus
catactgcttcatacattcctttgt

SEQ ID NO: 326306 - DNA, 25 bp, Mus musculus
catactgcttcgcaaccctaaggaa

SEQ ID NO: 326307 - DNA, 25 bp, Mus musculus
catactgcttcggaaccctaaggaa

SEQ ID NO: 326308 - DNA, 25 bp, Mus musculus
catactgcttgcatactctgtagaa

SEQ ID NO: 326309 - DNA, 25 bp, Mus musculus
catactgcttgcttactctgtagaa

SEQ ID NO: 326310 - DNA, 25 bp, Mus musculus
catactggattcacaaaggcagcaa

SEQ ID NO: 326311 - DNA, 25 bp, Mus musculus
catactggattctcaaaggcagcaa

SEQ ID NO: 326312 - DNA, 25 bp, Mus musculus
catactggcttacggattggctcag

SEQ ID NO: 326313 - DNA, 25 bp, Mus musculus
catactggcttagggattggctcag

SEQ ID NO: 326314 - DNA, 25 bp, Mus musculus
catactgggtaaaggttcacaacta

SEQ ID NO: 326315 - DNA, 25 bp, Mus musculus
catactgggtaatggttcacaacta

SEQ ID NO: 326316 - DNA, 25 bp, Mus musculus
catactggttggctaggcttgctca

SEQ ID NO: 326317 - DNA, 25 bp, Mus musculus
catactggttgggtaggcttgctca

SEQ ID NO: 326318 - DNA, 25 bp, Mus musculus
catactgtaccaacagggtgtggag

SEQ ID NO: 326319 - DNA, 25 bp, Mus musculus
catactgtaccatcagggtgtggag

SEQ ID NO: 326320 - DNA, 25 bp, Mus musculus
catactgtatgcattctacctgtaa

SEQ ID NO: 326321 - DNA, 25 bp, Mus musculus
catactgtatgctttctacctgtaa

SEQ ID NO: 326322 - DNA, 25 bp, Mus musculus
catactgtcacaacactgaagctga

SEQ ID NO: 326323 - DNA, 25 bp, Mus musculus
catactgtcacatcactgaagctga

SEQ ID NO: 326324 - DNA, 25 bp, Mus musculus
catactgtccagagtactcattgag

SEQ ID NO: 326325 - DNA, 25 bp, Mus musculus
catactgtccagtgtactcattgag

SEQ ID NO: 326326 - DNA, 25 bp, Mus musculus
catactgtgatgcagaccgtgatat

SEQ ID NO: 326327 - DNA, 25 bp, Mus musculus
catactgtgatggagaccgtgatat

SEQ ID NO: 326328 - DNA, 25 bp, Mus musculus
catactgtgcttagttgtttgtgaa

SEQ ID NO: 326329 - DNA, 25 bp, Mus musculus
catactgtgctttgttgtttgtgaa

SEQ ID NO: 326330 - DNA, 25 bp, Mus musculus
catactgtggtgacctaagtgctta

SEQ ID NO: 326331 - DNA, 25 bp, Mus musculus
catactgtggtgtcctaagtgctta

SEQ ID NO: 326332 - DNA, 25 bp, Mus musculus
catactgtgtgcaagtttgtgtggg

SEQ ID NO: 326333 - DNA, 25 bp, Mus musculus
catactgtgtgctagtttgtgtggg

SEQ ID NO: 326334 - DNA, 25 bp, Mus musculus
catactgttagcctccatggagaat

SEQ ID NO: 326335 - DNA, 25 bp, Mus musculus
catactgttagcgtccatggagaat

SEQ ID NO: 326336 - DNA, 25 bp, Mus musculus
catactgttcagatgtcgtgtgctg

SEQ ID NO: 326337 - DNA, 25 bp, Mus musculus
catactgttcagttgtcgtgtgctg

SEQ ID NO: 326338 - DNA, 25 bp, Mus musculus
catacttaggttatgtggccttcca

SEQ ID NO: 326339 - DNA, 25 bp, Mus musculus
catacttaggttttgtggccttcca

SEQ ID NO: 326340 - DNA, 25 bp, Mus musculus
catacttagttcctctgtcacttta

SEQ ID NO: 326341 - DNA, 25 bp, Mus musculus
catacttagttcgtctgtcacttta

SEQ ID NO: 326342 - DNA, 25 bp, Mus musculus
catacttagttgaattcagctctca

SEQ ID NO: 326343 - DNA, 25 bp, Mus musculus
catacttagttgtattcagctctca

SEQ ID NO: 326344 - DNA, 25 bp, Mus musculus
catacttatatccatgggctgcttt

SEQ ID NO: 326345 - DNA, 25 bp, Mus musculus
catacttatatcgatgggctgcttt

SEQ ID NO: 326346 - DNA, 25 bp, Mus musculus
catacttattccaggaaattcctta

SEQ ID NO: 326347 - DNA, 25 bp, Mus musculus
catacttattcccctgagacctgag

SEQ ID NO: 326348 - DNA, 25 bp, Mus musculus
catacttattccgctgagacctgag

SEQ ID NO: 326349 - DNA, 25 bp, Mus musculus
catacttattcctggaaattcctta

SEQ ID NO: 326350 - DNA, 25 bp, Mus musculus
catacttcacgtcgtaggagcagat

SEQ ID NO: 326351 - DNA, 25 bp, Mus musculus
catacttcacgtggtaggagcagat

SEQ ID NO: 326352 - DNA, 25 bp, Mus musculus
catacttcccttaactttgctaatt

SEQ ID NO: 326353 - DNA, 25 bp, Mus musculus
catacttccctttactttgctaatt

SEQ ID NO: 326354 - DNA, 25 bp, Mus musculus
catacttcctgtcgagaaggcacca

SEQ ID NO: 326355 - DNA, 25 bp, Mus musculus
catacttcctgtggagaaggcacca

SEQ ID NO: 326356 - DNA, 25 bp, Mus musculus
catacttctgagacactttctggac

SEQ ID NO: 326357 - DNA, 25 bp, Mus musculus
catacttctgagtcactttctggac

SEQ ID NO: 326358 - DNA, 25 bp, Mus musculus
catacttgaatgaacatgcgtattt

SEQ ID NO: 326359 - DNA, 25 bp, Mus musculus
catacttgaatgtacatgcgtattt

SEQ ID NO: 326360 - DNA, 25 bp, Mus musculus
catacttgatttctgaacagagact

SEQ ID NO: 326361 - DNA, 25 bp, Mus musculus
catacttgatttgtgaacagagact

SEQ ID NO: 326362 - DNA, 25 bp, Mus musculus
catacttgtaatcgcagcatgcagg

SEQ ID NO: 326363 - DNA, 25 bp, Mus musculus
catacttgtaatggcagcatgcagg

SEQ ID NO: 326364 - DNA, 25 bp, Mus musculus
catacttgtgtgactgtagatcatc

SEQ ID NO: 326365 - DNA, 25 bp, Mus musculus
catacttgtgtgtctgtagatcatc

SEQ ID NO: 326366 - DNA, 25 bp, Mus musculus
catactttattgatggtactgttac

SEQ ID NO: 326367 - DNA, 25 bp, Mus musculus
catactttattgttggtactgttac

SEQ ID NO: 326368 - DNA, 25 bp, Mus musculus
catactttccccactggaatgacat

SEQ ID NO: 326369 - DNA, 25 bp, Mus musculus
catactttcccctctggaatgacat

SEQ ID NO: 326370 - DNA, 25 bp, Mus musculus
catactttctagcagttacttctgg

SEQ ID NO: 326371 - DNA, 25 bp, Mus musculus
catactttctaggagttacttctgg

SEQ ID NO: 326372 - DNA, 25 bp, Mus musculus
catactttctgcctgtgactgagga

SEQ ID NO: 326373 - DNA, 25 bp, Mus musculus
catactttctgcgtgtgactgagga

SEQ ID NO: 326374 - DNA, 25 bp, Mus musculus
catactttcttgaatatatcctgaa

SEQ ID NO: 326375 - DNA, 25 bp, Mus musculus
catactttcttgtatatatcctgaa

SEQ ID NO: 326376 - DNA, 25 bp, Mus musculus
catactttgccactaaacattcaaa

SEQ ID NO: 326377 - DNA, 25 bp, Mus musculus
catactttgccagtaaacattcaaa

SEQ ID NO: 326378 - DNA, 25 bp, Mus musculus
catacttttaataccagtgctgatg

SEQ ID NO: 326379 - DNA, 25 bp, Mus musculus
catacttttaattccagtgctgatg

SEQ ID NO: 326380 - DNA, 25 bp, Mus musculus
catacttttaggaggcgcagtttct

SEQ ID NO: 326381 - DNA, 25 bp, Mus musculus
catacttttaggtggcgcagtttct

SEQ ID NO: 326382 - DNA, 25 bp, Mus musculus
catacttttagtaaactgtgaagca

SEQ ID NO: 326383 - DNA, 25 bp, Mus musculus
catacttttagttaactgtgaagca

SEQ ID NO: 326384 - DNA, 25 bp, Mus musculus
catacttttcatccaaagttttgta

SEQ ID NO: 326385 - DNA, 25 bp, Mus musculus
catacttttcatgcaaagttttgta

SEQ ID NO: 326386 - DNA, 25 bp, Mus musculus
catacttttccaattctaaccatca

SEQ ID NO: 326387 - DNA, 25 bp, Mus musculus
catacttttccatttctaaccatca

SEQ ID NO: 326388 - DNA, 25 bp, Mus musculus
catagaaaaccacagattccccggg

SEQ ID NO: 326389 - DNA, 25 bp, Mus musculus
catagaaaaccagagattccccggg

SEQ ID NO: 326390 - DNA, 25 bp, Mus musculus
catagaaactagacctctcgaccga

SEQ ID NO: 326391 - DNA, 25 bp, Mus musculus
catagaaactagtcctctcgaccga

SEQ ID NO: 326392 - DNA, 25 bp, Mus musculus
catagaactaggcaacagcatgttt

SEQ ID NO: 326393 - DNA, 25 bp, Mus musculus
catagaactagggaacagcatgttt

SEQ ID NO: 326394 - DNA, 25 bp, Mus musculus
catagaaggtctcgtttaagcaaca

SEQ ID NO: 326395 - DNA, 25 bp, Mus musculus
catagaaggtctggtttaagcaaca

SEQ ID NO: 326396 - DNA, 25 bp, Mus musculus
catagaaggttgagttaaccggact

SEQ ID NO: 326397 - DNA, 25 bp, Mus musculus
catagaaggttgtgttaaccggact

SEQ ID NO: 326398 - DNA, 25 bp, Mus musculus
catagaagtgtcatggagtgtcaat

SEQ ID NO: 326399 - DNA, 25 bp, Mus musculus
catagaagtgtcttggagtgtcaat

SEQ ID NO: 326400 - DNA, 25 bp, Mus musculus
catagaatcataatggcttactcca

SEQ ID NO: 326401 - DNA, 25 bp, Mus musculus
catagaatcatattggcttactcca

SEQ ID NO: 326402 - DNA, 25 bp, Mus musculus
catagaatcggtcatcttgcagatc

SEQ ID NO: 326403 - DNA, 25 bp, Mus musculus
catagaatcggtgatcttgcagatc

SEQ ID NO: 326404 - DNA, 25 bp, Mus musculus
catagaatctcaagggcatcaggga

SEQ ID NO: 326405 - DNA, 25 bp, Mus musculus
catagaatctcatgggcatcaggga

SEQ ID NO: 326406 - DNA, 25 bp, Mus musculus
catagaattctacccagccagcact

SEQ ID NO: 326407 - DNA, 25 bp, Mus musculus
catagaattctagccagccagcact

SEQ ID NO: 326408 - DNA, 25 bp, Mus musculus
catagacacataagttctcacctca

SEQ ID NO: 326409 - DNA, 25 bp, Mus musculus
catagacacatatgttctcacctca

SEQ ID NO: 326410 - DNA, 25 bp, Mus musculus
catagacacatgcaagcaaagcatt

SEQ ID NO: 326411 - DNA, 25 bp, Mus musculus
catagacacatggaagcaaagcatt

SEQ ID NO: 326412 - DNA, 25 bp, Mus musculus
catagacactcaagaccagcagggt

SEQ ID NO: 326413 - DNA, 25 bp, Mus musculus
catagacactcatgaccagcagggt

SEQ ID NO: 326414 - DNA, 25 bp, Mus musculus
catagacctatgagtggccctagct

SEQ ID NO: 326415 - DNA, 25 bp, Mus musculus
catagacctatgtgtggccctagct

SEQ ID NO: 326416 - DNA, 25 bp, Mus musculus
catagacgcattcgccatcggtagt

SEQ ID NO: 326417 - DNA, 25 bp, Mus musculus
catagacgcattggccatcggtagt

SEQ ID NO: 326418 - DNA, 25 bp, Mus musculus
catagactaactctgaccttgggca

SEQ ID NO: 326419 - DNA, 25 bp, Mus musculus
catagactaactgtgaccttgggca

SEQ ID NO: 326420 - DNA, 25 bp, Mus musculus
catagactagcaaaagccgatgtag

SEQ ID NO: 326421 - DNA, 25 bp, Mus musculus
catagactagcataagccgatgtag

SEQ ID NO: 326422 - DNA, 25 bp, Mus musculus
catagactgcggcctttttctaagc

SEQ ID NO: 326423 - DNA, 25 bp, Mus musculus
catagactgcgggctttttctaagc

SEQ ID NO: 326424 - DNA, 25 bp, Mus musculus
catagactgtgcatgttggaacatt

SEQ ID NO: 326425 - DNA, 25 bp, Mus musculus
catagactgtgcttgttggaacatt

SEQ ID NO: 326426 - DNA, 25 bp, Mus musculus
catagactgttccatagactgttcc

SEQ ID NO: 326427 - DNA, 25 bp, Mus musculus
catagactgttcgatagactgttcc

SEQ ID NO: 326428 - DNA, 25 bp, Mus musculus
catagacttgacaacacaaagactg

SEQ ID NO: 326429 - DNA, 25 bp, Mus musculus
catagacttgactacacaaagactg

SEQ ID NO: 326430 - DNA, 25 bp, Mus musculus
catagactttgtagacataccgtgt

SEQ ID NO: 326431 - DNA, 25 bp, Mus musculus
catagactttgttgacataccgtgt

SEQ ID NO: 326432 - DNA, 25 bp, Mus musculus
catagagaacgaaccaccctttgag

SEQ ID NO: 326433 - DNA, 25 bp, Mus musculus
catagagaacgatccaccctttgag

SEQ ID NO: 326434 - DNA, 25 bp, Mus musculus
catagagaattcatccccagctggg

SEQ ID NO: 326435 - DNA, 25 bp, Mus musculus
catagagaattcttccccagctggg

SEQ ID NO: 326436 - DNA, 25 bp, Mus musculus
catagagaccatcttgctgtcagga

SEQ ID NO: 326437 - DNA, 25 bp, Mus musculus
catagagaccatgttgctgtcagga

SEQ ID NO: 326438 - DNA, 25 bp, Mus musculus
catagagaccttcatagacatattt

SEQ ID NO: 326439 - DNA, 25 bp, Mus musculus
catagagaccttgatagacatattt

SEQ ID NO: 326440 - DNA, 25 bp, Mus musculus
catagagactgactatatctttggc

SEQ ID NO: 326441 - DNA, 25 bp, Mus musculus
catagagactgagtatatctttggc

SEQ ID NO: 326442 - DNA, 25 bp, Mus musculus
catagagatatacagcgattgaaga

SEQ ID NO: 326443 - DNA, 25 bp, Mus musculus
catagagatatagagcgattgaaga

SEQ ID NO: 326444 - DNA, 25 bp, Mus musculus
catagagatcgcaaaaccattccct

SEQ ID NO: 326445 - DNA, 25 bp, Mus musculus
catagagatcgctaaaccattccct

SEQ ID NO: 326446 - DNA, 25 bp, Mus musculus
catagagcacacaccgctgttttct

SEQ ID NO: 326447 - DNA, 25 bp, Mus musculus
catagagcacactccgctgttttct

SEQ ID NO: 326448 - DNA, 25 bp, Mus musculus
catagagcacatatgttcattctaa

SEQ ID NO: 326449 - DNA, 25 bp, Mus musculus
catagagcacatttgttcattctaa

SEQ ID NO: 326450 - DNA, 25 bp, Mus musculus
catagagcagctcttatccctcagt

SEQ ID NO: 326451 - DNA, 25 bp, Mus musculus
catagagcagctgttatccctcagt

SEQ ID NO: 326452 - DNA, 25 bp, Mus musculus
catagagcatctagggattccctgg

SEQ ID NO: 326453 - DNA, 25 bp, Mus musculus
catagagcatcttgggattccctgg

SEQ ID NO: 326454 - DNA, 25 bp, Mus musculus
catagagcattcagtttggcagatt

SEQ ID NO: 326455 - DNA, 25 bp, Mus musculus
catagagcattctgtttggcagatt

SEQ ID NO: 326456 - DNA, 25 bp, Mus musculus
catagagccgggatctgtggattta

SEQ ID NO: 326457 - DNA, 25 bp, Mus musculus
catagagccgggttctgtggattta

SEQ ID NO: 326458 - DNA, 25 bp, Mus musculus
catagagcctgactgagagccagaa

SEQ ID NO: 326459 - DNA, 25 bp, Mus musculus
catagagcctgagtgagagccagaa

SEQ ID NO: 326460 - DNA, 25 bp, Mus musculus
catagaggaactctctctgtctctc

SEQ ID NO: 326461 - DNA, 25 bp, Mus musculus
catagaggaactgtctctgtctctc

SEQ ID NO: 326462 - DNA, 25 bp, Mus musculus
catagaggcactcgaggtcatgtct

SEQ ID NO: 326463 - DNA, 25 bp, Mus musculus
catagaggcactggaggtcatgtct

SEQ ID NO: 326464 - DNA, 25 bp, Mus musculus
catagaggctaaaccacctgtaact

SEQ ID NO: 326465 - DNA, 25 bp, Mus musculus
catagaggctaatccacctgtaact

SEQ ID NO: 326466 - DNA, 25 bp, Mus musculus
catagagttcctagtacagaataat

SEQ ID NO: 326467 - DNA, 25 bp, Mus musculus
catagagttccttgtacagaataat

SEQ ID NO: 326468 - DNA, 25 bp, Mus musculus
catagagtttgcagacaccatcaag

SEQ ID NO: 326469 - DNA, 25 bp, Mus musculus
catagagtttgctgacaccatcaag

SEQ ID NO: 326470 - DNA, 25 bp, Mus musculus
catagatcacagataacaggtacac

SEQ ID NO: 326471 - DNA, 25 bp, Mus musculus
catagatcacagttaacaggtacac

SEQ ID NO: 326472 - DNA, 25 bp, Mus musculus
catagatccctgcagttaccagaaa

SEQ ID NO: 326473 - DNA, 25 bp, Mus musculus
catagatccctggagttaccagaaa

SEQ ID NO: 326474 - DNA, 25 bp, Mus musculus
catagatcctgtatcccatataaaa

SEQ ID NO: 326475 - DNA, 25 bp, Mus musculus
catagatcctgtttcccatataaaa

SEQ ID NO: 326476 - DNA, 25 bp, Mus musculus
catagatgacatcaacagtggtgca

SEQ ID NO: 326477 - DNA, 25 bp, Mus musculus
catagatgacatgaacagtggtgca

SEQ ID NO: 326478 - DNA, 25 bp, Mus musculus
catagatggctactgcaggctgcaa

SEQ ID NO: 326479 - DNA, 25 bp, Mus musculus
catagatggctagtgcaggctgcaa

SEQ ID NO: 326480 - DNA, 25 bp, Mus musculus
catagatggtggagcctgtctttca

SEQ ID NO: 326481 - DNA, 25 bp, Mus musculus
catagatggtggtgcctgtctttca

SEQ ID NO: 326482 - DNA, 25 bp, Mus musculus
catagatgtattaaggtttcgggta

SEQ ID NO: 326483 - DNA, 25 bp, Mus musculus
catagatgtatttaggtttcgggta

SEQ ID NO: 326484 - DNA, 25 bp, Mus musculus
catagattaaggagtccccagggac

SEQ ID NO: 326485 - DNA, 25 bp, Mus musculus
catagattaaggtgtccccagggac

SEQ ID NO: 326486 - DNA, 25 bp, Mus musculus
catagattagatcatctcatggcta

SEQ ID NO: 326487 - DNA, 25 bp, Mus musculus
catagattagatgatctcatggcta

SEQ ID NO: 326488 - DNA, 25 bp, Mus musculus
catagattccggagtgtatcaacta

SEQ ID NO: 326489 - DNA, 25 bp, Mus musculus
catagattccggtgtgtatcaacta

SEQ ID NO: 326490 - DNA, 25 bp, Mus musculus
catagattctgcagtaccgttcggt

SEQ ID NO: 326491 - DNA, 25 bp, Mus musculus
catagattctgctgtaccgttcggt

SEQ ID NO: 326492 - DNA, 25 bp, Mus musculus
catagattcttcatgtaagctggaa

SEQ ID NO: 326493 - DNA, 25 bp, Mus musculus
catagattcttcttgtaagctggaa

SEQ ID NO: 326494 - DNA, 25 bp, Mus musculus
catagattgtacaccatttctaggt

SEQ ID NO: 326495 - DNA, 25 bp, Mus musculus
catagattgtactccatttctaggt

SEQ ID NO: 326496 - DNA, 25 bp, Mus musculus
catagcaaaacacccctttaggcat

SEQ ID NO: 326497 - DNA, 25 bp, Mus musculus
catagcaaaacagccctttaggcat

SEQ ID NO: 326498 - DNA, 25 bp, Mus musculus
catagcaaaagcaacctgggaggaa

SEQ ID NO: 326499 - DNA, 25 bp, Mus musculus
catagcaaaagctacctgggaggaa

SEQ ID NO: 326500 - DNA, 25 bp, Mus musculus
catagcaaaatgactctttcctaaa

SEQ ID NO: 326501 - DNA, 25 bp, Mus musculus
catagcaaaatgtctctttcctaaa

SEQ ID NO: 326502 - DNA, 25 bp, Mus musculus
catagcaaaattagccgagggtggt

SEQ ID NO: 326503 - DNA, 25 bp, Mus musculus
catagcaaaatttgccgagggtggt

SEQ ID NO: 326504 - DNA, 25 bp, Mus musculus
catagcaactctactgtaattcatt

SEQ ID NO: 326505 - DNA, 25 bp, Mus musculus
catagcaactcttctgtaattcatt

SEQ ID NO: 326506 - DNA, 25 bp, Mus musculus
catagcaagctcactgttctcagat

SEQ ID NO: 326507 - DNA, 25 bp, Mus musculus
catagcaagctctctgttctcagat

SEQ ID NO: 326508 - DNA, 25 bp, Mus musculus
catagcaagctgcagtaggtcatat

SEQ ID NO: 326509 - DNA, 25 bp, Mus musculus
catagcaagctggagtaggtcatat

SEQ ID NO: 326510 - DNA, 25 bp, Mus musculus
catagcacaggcctagtgtgctcaa

SEQ ID NO: 326511 - DNA, 25 bp, Mus musculus
catagcacaggcgtagtgtgctcaa

SEQ ID NO: 326512 - DNA, 25 bp, Mus musculus
catagcacatcaacagtgagctatc

SEQ ID NO: 326513 - DNA, 25 bp, Mus musculus
catagcacatcatcagtgagctatc

SEQ ID NO: 326514 - DNA, 25 bp, Mus musculus
catagcacatgcacgggaagatacc

SEQ ID NO: 326515 - DNA, 25 bp, Mus musculus
catagcacatgctcgggaagatacc

SEQ ID NO: 326516 - DNA, 25 bp, Mus musculus
catagcacgccaagtctgtgggcaa

SEQ ID NO: 326517 - DNA, 25 bp, Mus musculus
catagcacgccatgtctgtgggcaa

SEQ ID NO: 326518 - DNA, 25 bp, Mus musculus
catagcactgcccatgtttatatat

SEQ ID NO: 326519 - DNA, 25 bp, Mus musculus
catagcactgccgatgtttatatat

SEQ ID NO: 326520 - DNA, 25 bp, Mus musculus
catagcagatgtcccatgatggtaa

SEQ ID NO: 326521 - DNA, 25 bp, Mus musculus
catagcagatgtgccatgatggtaa

SEQ ID NO: 326522 - DNA, 25 bp, Mus musculus
catagcagctccaactgtctatagc

SEQ ID NO: 326523 - DNA, 25 bp, Mus musculus
catagcagctcctactgtctatagc

SEQ ID NO: 326524 - DNA, 25 bp, Mus musculus
catagcatcatcagtgcatgctggg

SEQ ID NO: 326525 - DNA, 25 bp, Mus musculus
catagcatcatctgtgcatgctggg

SEQ ID NO: 326526 - DNA, 25 bp, Mus musculus
catagccaaccaagagttaagaagt

SEQ ID NO: 326527 - DNA, 25 bp, Mus musculus
catagccaaccatgagttaagaagt

SEQ ID NO: 326528 - DNA, 25 bp, Mus musculus
catagccaacgaagagttacgaaga

SEQ ID NO: 326529 - DNA, 25 bp, Mus musculus
catagccaacgatgagttacgaaga

SEQ ID NO: 326530 - DNA, 25 bp, Mus musculus
catagccaatggaaatagtttcatc

SEQ ID NO: 326531 - DNA, 25 bp, Mus musculus
catagccaatggtaatagtttcatc

SEQ ID NO: 326532 - DNA, 25 bp, Mus musculus
catagccacattagttcatgcccac

SEQ ID NO: 326533 - DNA, 25 bp, Mus musculus
catagccacatttgttcatgcccac

SEQ ID NO: 326534 - DNA, 25 bp, Mus musculus
catagccaccaacacttccatgaaa

SEQ ID NO: 326535 - DNA, 25 bp, Mus musculus
catagccaccaagacttccatgaaa

SEQ ID NO: 326536 - DNA, 25 bp, Mus musculus
catagccagcctatttctttggtta

SEQ ID NO: 326537 - DNA, 25 bp, Mus musculus
catagccagcctttttctttggtta

SEQ ID NO: 326538 - DNA, 25 bp, Mus musculus
catagccatcggacagagacactaa

SEQ ID NO: 326539 - DNA, 25 bp, Mus musculus
catagccatcggtcagagacactaa

SEQ ID NO: 326540 - DNA, 25 bp, Mus musculus
catagccatgatagtaattgttttc

SEQ ID NO: 326541 - DNA, 25 bp, Mus musculus
catagccatgattgtaattgttttc

SEQ ID NO: 326542 - DNA, 25 bp, Mus musculus
catagccattaacttgtcattgcct

SEQ ID NO: 326543 - DNA, 25 bp, Mus musculus
catagccattaagttgtcattgcct

SEQ ID NO: 326544 - DNA, 25 bp, Mus musculus
catagcccaatgatagtgtcttcct

SEQ ID NO: 326545 - DNA, 25 bp, Mus musculus
catagcccaatgttagtgtcttcct

SEQ ID NO: 326546 - DNA, 25 bp, Mus musculus
catagccccacacttcttacgagga

SEQ ID NO: 326547 - DNA, 25 bp, Mus musculus
catagccccacagttcttacgagga

SEQ ID NO: 326548 - DNA, 25 bp, Mus musculus
catagccccgggaagggcaaggcaa

SEQ ID NO: 326549 - DNA, 25 bp, Mus musculus
catagccccgggtagggcaaggcaa

SEQ ID NO: 326550 - DNA, 25 bp, Mus musculus
catagcccgtgacgtttatccgagg

SEQ ID NO: 326551 - DNA, 25 bp, Mus musculus
catagcccgtgaggtttatccgagg

SEQ ID NO: 326552 - DNA, 25 bp, Mus musculus
catagccctggtaaaggccctaaag

SEQ ID NO: 326553 - DNA, 25 bp, Mus musculus
catagccctggttaaggccctaaag

SEQ ID NO: 326554 - DNA, 25 bp, Mus musculus
catagcccttcgattgttagagcaa

SEQ ID NO: 326555 - DNA, 25 bp, Mus musculus
catagcccttcgtttgttagagcaa

SEQ ID NO: 326556 - DNA, 25 bp, Mus musculus
catagccctttacattcactgttag

SEQ ID NO: 326557 - DNA, 25 bp, Mus musculus
catagccctttagattcactgttag

SEQ ID NO: 326558 - DNA, 25 bp, Mus musculus
catagccgggacagcacgtggatta

SEQ ID NO: 326559 - DNA, 25 bp, Mus musculus
catagccgggactgcacgtggatta

SEQ ID NO: 326560 - DNA, 25 bp, Mus musculus
catagcctagagctcagttttagtt

SEQ ID NO: 326561 - DNA, 25 bp, Mus musculus
catagcctagaggtcagttttagtt

SEQ ID NO: 326562 - DNA, 25 bp, Mus musculus
catagcctggatatccaaaccaatt

SEQ ID NO: 326563 - DNA, 25 bp, Mus musculus
catagcctggatttccaaaccaatt

SEQ ID NO: 326564 - DNA, 25 bp, Mus musculus
catagccttcttcagggagctggat

SEQ ID NO: 326565 - DNA, 25 bp, Mus musculus
catagccttcttgagggagctggat

SEQ ID NO: 326566 - DNA, 25 bp, Mus musculus
catagccttggccaagaggtctttg

SEQ ID NO: 326567 - DNA, 25 bp, Mus musculus
catagccttggcgaagaggtctttg

SEQ ID NO: 326568 - DNA, 25 bp, Mus musculus
catagcgacactctgtaggtcccag

SEQ ID NO: 326569 - DNA, 25 bp, Mus musculus
catagcgacactgtgtaggtcccag

SEQ ID NO: 326570 - DNA, 25 bp, Mus musculus
catagcgactacaagattctcttta

SEQ ID NO: 326571 - DNA, 25 bp, Mus musculus
catagcgactactagattctcttta

SEQ ID NO: 326572 - DNA, 25 bp, Mus musculus
catagcgctgggaggtgtcatcgtc

SEQ ID NO: 326573 - DNA, 25 bp, Mus musculus
catagcgctgggtggtgtcatcgtc

SEQ ID NO: 326574 - DNA, 25 bp, Mus musculus
catagcgttcataaccttccttttt

SEQ ID NO: 326575 - DNA, 25 bp, Mus musculus
catagcgttcattaccttccttttt

SEQ ID NO: 326576 - DNA, 25 bp, Mus musculus
catagctaacttctctggaaccaga

SEQ ID NO: 326577 - DNA, 25 bp, Mus musculus
catagctaacttgtctggaaccaga

SEQ ID NO: 326578 - DNA, 25 bp, Mus musculus
catagctacctcatgattcatttta

SEQ ID NO: 326579 - DNA, 25 bp, Mus musculus
catagctacctcttgattcatttta

SEQ ID NO: 326580 - DNA, 25 bp, Mus musculus
catagctacgtgagtttgatttcag

SEQ ID NO: 326581 - DNA, 25 bp, Mus musculus
catagctacgtgtgtttgatttcag

SEQ ID NO: 326582 - DNA, 25 bp, Mus musculus
catagctagcaactcaaggccctgg

SEQ ID NO: 326583 - DNA, 25 bp, Mus musculus
catagctagcaagtcaaggccctgg

SEQ ID NO: 326584 - DNA, 25 bp, Mus musculus
catagctatgaactgattgcttgag

SEQ ID NO: 326585 - DNA, 25 bp, Mus musculus
catagctatgaagtgattgcttgag

SEQ ID NO: 326586 - DNA, 25 bp, Mus musculus
catagctcaaaaccagattcatctg

SEQ ID NO: 326587 - DNA, 25 bp, Mus musculus
catagctcaaaagcagattcatctg

SEQ ID NO: 326588 - DNA, 25 bp, Mus musculus
catagctcagagaagatgttcccta

SEQ ID NO: 326589 - DNA, 25 bp, Mus musculus
catagctcagagtagatgttcccta

SEQ ID NO: 326590 - DNA, 25 bp, Mus musculus
catagctcattaactggacttcagt

SEQ ID NO: 326591 - DNA, 25 bp, Mus musculus
catagctcattatctggacttcagt

SEQ ID NO: 326592 - DNA, 25 bp, Mus musculus
catagctcttaaaccgtgtgggtga

SEQ ID NO: 326593 - DNA, 25 bp, Mus musculus
catagctcttaatccgtgtgggtga

SEQ ID NO: 326594 - DNA, 25 bp, Mus musculus
catagctgctctccccaggaatctt

SEQ ID NO: 326595 - DNA, 25 bp, Mus musculus
catagctgctctgcccaggaatctt

SEQ ID NO: 326596 - DNA, 25 bp, Mus musculus
catagctgctgacactggctcacag

SEQ ID NO: 326597 - DNA, 25 bp, Mus musculus
catagctgctgagactggctcacag

SEQ ID NO: 326598 - DNA, 25 bp, Mus musculus
catagctgtactcagtgtcattttc

SEQ ID NO: 326599 - DNA, 25 bp, Mus musculus
catagctgtactgagtgtcattttc

SEQ ID NO: 326600 - DNA, 25 bp, Mus musculus
catagcttccctctatgtggctaat

SEQ ID NO: 326601 - DNA, 25 bp, Mus musculus
catagcttccctgtatgtggctaat

SEQ ID NO: 326602 - DNA, 25 bp, Mus musculus
catagcttctgcaggtatccataca

SEQ ID NO: 326603 - DNA, 25 bp, Mus musculus
catagcttctgctggtatccataca

SEQ ID NO: 326604 - DNA, 25 bp, Mus musculus
catagcttcttacccaggtttgcat

SEQ ID NO: 326605 - DNA, 25 bp, Mus musculus
catagcttcttagccaggtttgcat

SEQ ID NO: 326606 - DNA, 25 bp, Mus musculus
catagcttgtggaggactgtagtct

SEQ ID NO: 326607 - DNA, 25 bp, Mus musculus
catagcttgtggtggactgtagtct

SEQ ID NO: 326608 - DNA, 25 bp, Mus musculus
catagcttgtgtatgtgacatcctg

SEQ ID NO: 326609 - DNA, 25 bp, Mus musculus
catagcttgtgtttgtgacatcctg

SEQ ID NO: 326610 - DNA, 25 bp, Mus musculus
catagctttaatcatctgctcagag

SEQ ID NO: 326611 - DNA, 25 bp, Mus musculus
catagctttaatgatctgctcagag

SEQ ID NO: 326612 - DNA, 25 bp, Mus musculus
catagctttactccggcactcgggt

SEQ ID NO: 326613 - DNA, 25 bp, Mus musculus
catagctttactgcggcactcgggt

SEQ ID NO: 326614 - DNA, 25 bp, Mus musculus
catagctttctgactggctcttaca

SEQ ID NO: 326615 - DNA, 25 bp, Mus musculus
catagctttctgtctggctcttaca

SEQ ID NO: 326616 - DNA, 25 bp, Mus musculus
catagctttttaccccagtgctgaa

SEQ ID NO: 326617 - DNA, 25 bp, Mus musculus
catagctttttagcccagtgctgaa

SEQ ID NO: 326618 - DNA, 25 bp, Mus musculus
cataggaaaatcagagctgcctctc

SEQ ID NO: 326619 - DNA, 25 bp, Mus musculus
cataggaaaatctgagctgcctctc

SEQ ID NO: 326620 - DNA, 25 bp, Mus musculus
cataggaaacctcaagctgccacgg

SEQ ID NO: 326621 - DNA, 25 bp, Mus musculus
cataggaaacctgaagctgccacgg

SEQ ID NO: 326622 - DNA, 25 bp, Mus musculus
cataggaaacgtctctccccgtgta

SEQ ID NO: 326623 - DNA, 25 bp, Mus musculus
cataggaaacgtgtctccccgtgta

SEQ ID NO: 326624 - DNA, 25 bp, Mus musculus
cataggaaagccaggttggcaattt

SEQ ID NO: 326625 - DNA, 25 bp, Mus musculus
cataggaaagcctggttggcaattt

SEQ ID NO: 326626 - DNA, 25 bp, Mus musculus
cataggaagctacgccttggcacct

SEQ ID NO: 326627 - DNA, 25 bp, Mus musculus
cataggaagctaggccttggcacct

SEQ ID NO: 326628 - DNA, 25 bp, Mus musculus
cataggacagcgaccctcgggagtg

SEQ ID NO: 326629 - DNA, 25 bp, Mus musculus
cataggacagcgtccctcgggagtg

SEQ ID NO: 326630 - DNA, 25 bp, Mus musculus
cataggacgggcacagacgcgctcg

SEQ ID NO: 326631 - DNA, 25 bp, Mus musculus
cataggacgggctcagacgcgctcg

SEQ ID NO: 326632 - DNA, 25 bp, Mus musculus
cataggaggaacattctgtcatctt

SEQ ID NO: 326633 - DNA, 25 bp, Mus musculus
cataggaggaactttctgtcatctt

SEQ ID NO: 326634 - DNA, 25 bp, Mus musculus
cataggagtcctagttactgctgag

SEQ ID NO: 326635 - DNA, 25 bp, Mus musculus
cataggagtccttgttactgctgag

SEQ ID NO: 326636 - DNA, 25 bp, Mus musculus
cataggagtgtgaccaacccggtgt

SEQ ID NO: 326637 - DNA, 25 bp, Mus musculus
cataggagtgtgtccaacccggtgt

SEQ ID NO: 326638 - DNA, 25 bp, Mus musculus
cataggatacctaattttcttaact

SEQ ID NO: 326639 - DNA, 25 bp, Mus musculus
cataggataccttattttcttaact

SEQ ID NO: 326640 - DNA, 25 bp, Mus musculus
cataggatatctccatctgggtata

SEQ ID NO: 326641 - DNA, 25 bp, Mus musculus
cataggatatctgcatctgggtata

SEQ ID NO: 326642 - DNA, 25 bp, Mus musculus
cataggatgattagtacttgcttac

SEQ ID NO: 326643 - DNA, 25 bp, Mus musculus
cataggatgatttgtacttgcttac

SEQ ID NO: 326644 - DNA, 25 bp, Mus musculus
cataggatggacattctggacgtga

SEQ ID NO: 326645 - DNA, 25 bp, Mus musculus
cataggatggactttctggacgtga

SEQ ID NO: 326646 - DNA, 25 bp, Mus musculus
cataggatggcaattcttttataga

SEQ ID NO: 326647 - DNA, 25 bp, Mus musculus
cataggatggcatttcttttataga

SEQ ID NO: 326648 - DNA, 25 bp, Mus musculus
cataggattcatcatttctgatact

SEQ ID NO: 326649 - DNA, 25 bp, Mus musculus
cataggattcatgatttctgatact

SEQ ID NO: 326650 - DNA, 25 bp, Mus musculus
cataggatttgccaatctactctgg

SEQ ID NO: 326651 - DNA, 25 bp, Mus musculus
cataggatttgcgaatctactctgg

SEQ ID NO: 326652 - DNA, 25 bp, Mus musculus
cataggcaacttcccttacacattt

SEQ ID NO: 326653 - DNA, 25 bp, Mus musculus
cataggcaacttgccttacacattt

SEQ ID NO: 326654 - DNA, 25 bp, Mus musculus
cataggcaagttacctcttggtgat

SEQ ID NO: 326655 - DNA, 25 bp, Mus musculus
cataggcaagtttcctcttggtgat

SEQ ID NO: 326656 - DNA, 25 bp, Mus musculus
cataggcacctgcacttaagtgcac

SEQ ID NO: 326657 - DNA, 25 bp, Mus musculus
cataggcacctggacttaagtgcac

SEQ ID NO: 326658 - DNA, 25 bp, Mus musculus
cataggccacatcctatttgggagg

SEQ ID NO: 326659 - DNA, 25 bp, Mus musculus
cataggccacatgctatttgggagg

SEQ ID NO: 326660 - DNA, 25 bp, Mus musculus
cataggccagaaagctcacagattt

SEQ ID NO: 326661 - DNA, 25 bp, Mus musculus
cataggccagaatgctcacagattt

SEQ ID NO: 326662 - DNA, 25 bp, Mus musculus
cataggccctgcactcaggaaactg

SEQ ID NO: 326663 - DNA, 25 bp, Mus musculus
cataggccctgctctcaggaaactg

SEQ ID NO: 326664 - DNA, 25 bp, Mus musculus
cataggccgggtaattgtcaattcc

SEQ ID NO: 326665 - DNA, 25 bp, Mus musculus
cataggccgggttattgtcaattcc

SEQ ID NO: 326666 - DNA, 25 bp, Mus musculus
cataggccgtggcttccgttagaga

SEQ ID NO: 326667 - DNA, 25 bp, Mus musculus
cataggccgtgggttccgttagaga

SEQ ID NO: 326668 - DNA, 25 bp, Mus musculus
cataggcctgctcagtaaacacaag

SEQ ID NO: 326669 - DNA, 25 bp, Mus musculus
cataggcctgctgagtaaacacaag

SEQ ID NO: 326670 - DNA, 25 bp, Mus musculus
cataggcctgtcactttcgttaaaa

SEQ ID NO: 326671 - DNA, 25 bp, Mus musculus
cataggcctgtctctttcgttaaaa

SEQ ID NO: 326672 - DNA, 25 bp, Mus musculus
cataggctcattaataggactcaaa

SEQ ID NO: 326673 - DNA, 25 bp, Mus musculus
cataggctcatttataggactcaaa

SEQ ID NO: 326674 - DNA, 25 bp, Mus musculus
cataggctcctgaatttgcatgctt

SEQ ID NO: 326675 - DNA, 25 bp, Mus musculus
cataggctcctgtatttgcatgctt

SEQ ID NO: 326676 - DNA, 25 bp, Mus musculus
cataggctctgcagggtacctggaa

SEQ ID NO: 326677 - DNA, 25 bp, Mus musculus
cataggctctgctgggtacctggaa

SEQ ID NO: 326678 - DNA, 25 bp, Mus musculus
cataggctgattcgtgagtgtgctt

SEQ ID NO: 326679 - DNA, 25 bp, Mus musculus
cataggctgattggtgagtgtgctt

SEQ ID NO: 326680 - DNA, 25 bp, Mus musculus
cataggctgctaatctgtagaaatt

SEQ ID NO: 326681 - DNA, 25 bp, Mus musculus
cataggctgctattctgtagaaatt

SEQ ID NO: 326682 - DNA, 25 bp, Mus musculus
catagggaccttaatcatcagggaa

SEQ ID NO: 326683 - DNA, 25 bp, Mus musculus
catagggacctttatcatcagggaa

SEQ ID NO: 326684 - DNA, 25 bp, Mus musculus
catagggacgtcatccagggcttac

SEQ ID NO: 326685 - DNA, 25 bp, Mus musculus
catagggacgtcttccagggcttac

SEQ ID NO: 326686 - DNA, 25 bp, Mus musculus
catagggagggacctttaactcact

SEQ ID NO: 326687 - DNA, 25 bp, Mus musculus
catagggagggagctttaactcact

SEQ ID NO: 326688 - DNA, 25 bp, Mus musculus
catagggatgttaagacagttttaa

SEQ ID NO: 326689 - DNA, 25 bp, Mus musculus
catagggatgtttagacagttttaa

SEQ ID NO: 326690 - DNA, 25 bp, Mus musculus
catagggattttcactgtgcaggac

SEQ ID NO: 326691 - DNA, 25 bp, Mus musculus
catagggattttgactgtgcaggac

SEQ ID NO: 326692 - DNA, 25 bp, Mus musculus
catagggcataaacactgatgtata

SEQ ID NO: 326693 - DNA, 25 bp, Mus musculus
catagggcataatcactgatgtata

SEQ ID NO: 326694 - DNA, 25 bp, Mus musculus
catagggccacaaaaaggaattacc

SEQ ID NO: 326695 - DNA, 25 bp, Mus musculus
catagggccacataaaggaattacc

SEQ ID NO: 326696 - DNA, 25 bp, Mus musculus
catagggcctgtctgcttcttgtaa

SEQ ID NO: 326697 - DNA, 25 bp, Mus musculus
catagggcctgtgtgcttcttgtaa

SEQ ID NO: 326698 - DNA, 25 bp, Mus musculus
catagggctacactcattactgttc

SEQ ID NO: 326699 - DNA, 25 bp, Mus musculus
catagggctacagtcattactgttc

SEQ ID NO: 326700 - DNA, 25 bp, Mus musculus
catagggctcttccagagtgcctag

SEQ ID NO: 326701 - DNA, 25 bp, Mus musculus
catagggctcttgcagagtgcctag

SEQ ID NO: 326702 - DNA, 25 bp, Mus musculus
catagggtattacgaactgttcatc

SEQ ID NO: 326703 - DNA, 25 bp, Mus musculus
catagggtattaggaactgttcatc

SEQ ID NO: 326704 - DNA, 25 bp, Mus musculus
catagggtcagacccatcctgagct

SEQ ID NO: 326705 - DNA, 25 bp, Mus musculus
catagggtcagagccatcctgagct

SEQ ID NO: 326706 - DNA, 25 bp, Mus musculus
catagggtcttgaactaggagtgct

SEQ ID NO: 326707 - DNA, 25 bp, Mus musculus
catagggtcttgtactaggagtgct

SEQ ID NO: 326708 - DNA, 25 bp, Mus musculus
catagggttagacccactgcctgtg

SEQ ID NO: 326709 - DNA, 25 bp, Mus musculus
catagggttagagccactgcctgtg

SEQ ID NO: 326710 - DNA, 25 bp, Mus musculus
catagggttttaactacatactcaa

SEQ ID NO: 326711 - DNA, 25 bp, Mus musculus
catagggttttatctacatactcaa

SEQ ID NO: 326712 - DNA, 25 bp, Mus musculus
cataggtaaagcatatcaagtgaga

SEQ ID NO: 326713 - DNA, 25 bp, Mus musculus
cataggtaaagcttatcaagtgaga

SEQ ID NO: 326714 - DNA, 25 bp, Mus musculus
cataggtagtccaagtgctgagtta

SEQ ID NO: 326715 - DNA, 25 bp, Mus musculus
cataggtagtcctagtgctgagtta

SEQ ID NO: 326716 - DNA, 25 bp, Mus musculus
cataggtagtggctttcctgtagct

SEQ ID NO: 326717 - DNA, 25 bp, Mus musculus
cataggtagtgggtttcctgtagct

SEQ ID NO: 326718 - DNA, 25 bp, Mus musculus
cataggtattttctgacactggtca

SEQ ID NO: 326719 - DNA, 25 bp, Mus musculus
cataggtattttgtgacactggtca

SEQ ID NO: 326720 - DNA, 25 bp, Mus musculus
cataggtcggtgcaagagtgcttac

SEQ ID NO: 326721 - DNA, 25 bp, Mus musculus
cataggtcggtggaagagtgcttac

SEQ ID NO: 326722 - DNA, 25 bp, Mus musculus
cataggtgatagacagacaggtgcc

SEQ ID NO: 326723 - DNA, 25 bp, Mus musculus
cataggtgatagtcagacaggtgcc

SEQ ID NO: 326724 - DNA, 25 bp, Mus musculus
cataggtggtggatgtgtcacttac

SEQ ID NO: 326725 - DNA, 25 bp, Mus musculus
cataggtggtggttgtgtcacttac

SEQ ID NO: 326726 - DNA, 25 bp, Mus musculus
cataggtgtccaatactcgagggat

SEQ ID NO: 326727 - DNA, 25 bp, Mus musculus
cataggtgtccattactcgagggat

SEQ ID NO: 326728 - DNA, 25 bp, Mus musculus
cataggtgtcttctcagttctgtca

SEQ ID NO: 326729 - DNA, 25 bp, Mus musculus
cataggtgtcttgtcagttctgtca

SEQ ID NO: 326730 - DNA, 25 bp, Mus musculus
cataggttcccgactgttgccctta

SEQ ID NO: 326731 - DNA, 25 bp, Mus musculus
cataggttcccgtctgttgccctta

SEQ ID NO: 326732 - DNA, 25 bp, Mus musculus
cataggttccctctcttgcatggga

SEQ ID NO: 326733 - DNA, 25 bp, Mus musculus
cataggttccctgtcttgcatggga

SEQ ID NO: 326734 - DNA, 25 bp, Mus musculus
cataggttctaaaaaatctgttttg

SEQ ID NO: 326735 - DNA, 25 bp, Mus musculus
cataggttctaataaatctgttttg

SEQ ID NO: 326736 - DNA, 25 bp, Mus musculus
cataggttcttcaactggctgcaaa

SEQ ID NO: 326737 - DNA, 25 bp, Mus musculus
cataggttcttctactggctgcaaa

SEQ ID NO: 326738 - DNA, 25 bp, Mus musculus
cataggtttcacacataatttcttc

SEQ ID NO: 326739 - DNA, 25 bp, Mus musculus
cataggtttcactcataatttcttc

SEQ ID NO: 326740 - DNA, 25 bp, Mus musculus
cataggtttttccatttgggtgata

SEQ ID NO: 326741 - DNA, 25 bp, Mus musculus
cataggtttttcgatttgggtgata

SEQ ID NO: 326742 - DNA, 25 bp, Mus musculus
catagtaaagagactgcaagggaac

SEQ ID NO: 326743 - DNA, 25 bp, Mus musculus
catagtaaagagtctgcaagggaac

SEQ ID NO: 326744 - DNA, 25 bp, Mus musculus
catagtaacattatccgaggtgaca

SEQ ID NO: 326745 - DNA, 25 bp, Mus musculus
catagtaacattttccgaggtgaca

SEQ ID NO: 326746 - DNA, 25 bp, Mus musculus
catagtaagttcactggccaaggta

SEQ ID NO: 326747 - DNA, 25 bp, Mus musculus
catagtaagttctctggccaaggta

SEQ ID NO: 326748 - DNA, 25 bp, Mus musculus
catagtactaaacgacctgcatatt

SEQ ID NO: 326749 - DNA, 25 bp, Mus musculus
catagtactaaaggacctgcatatt

SEQ ID NO: 326750 - DNA, 25 bp, Mus musculus
catagtagtgctatggaaacccttt

SEQ ID NO: 326751 - DNA, 25 bp, Mus musculus
catagtagtgctttggaaacccttt

SEQ ID NO: 326752 - DNA, 25 bp, Mus musculus
catagtataactcttctgggcaagt

SEQ ID NO: 326753 - DNA, 25 bp, Mus musculus
catagtataactgttctgggcaagt

SEQ ID NO: 326754 - DNA, 25 bp, Mus musculus
catagtatgtaacggcgcttgccaa

SEQ ID NO: 326755 - DNA, 25 bp, Mus musculus
catagtatgtaagggcgcttgccaa

SEQ ID NO: 326756 - DNA, 25 bp, Mus musculus
catagtatgtgaagtctgttacagt

SEQ ID NO: 326757 - DNA, 25 bp, Mus musculus
catagtatgtgatgtctgttacagt

SEQ ID NO: 326758 - DNA, 25 bp, Mus musculus
catagtatttctcggttttgtttgt

SEQ ID NO: 326759 - DNA, 25 bp, Mus musculus
catagtatttctgggttttgtttgt

SEQ ID NO: 326760 - DNA, 25 bp, Mus musculus
catagtcaaatgagcctctctgtca

SEQ ID NO: 326761 - DNA, 25 bp, Mus musculus
catagtcaaatgtgcctctctgtca

SEQ ID NO: 326762 - DNA, 25 bp, Mus musculus
catagtcaagaaccccttcatgtct

SEQ ID NO: 326763 - DNA, 25 bp, Mus musculus
catagtcaagaagcccttcatgtct

SEQ ID NO: 326764 - DNA, 25 bp, Mus musculus
catagtcagaagcaggctatagaga

SEQ ID NO: 326765 - DNA, 25 bp, Mus musculus
catagtcagaaggaggctatagaga

SEQ ID NO: 326766 - DNA, 25 bp, Mus musculus
catagtcagtgaattccttaaaaac

SEQ ID NO: 326767 - DNA, 25 bp, Mus musculus
catagtcagtgatttccttaaaaac

SEQ ID NO: 326768 - DNA, 25 bp, Mus musculus
catagtcatattatccagtgttttt

SEQ ID NO: 326769 - DNA, 25 bp, Mus musculus
catagtcatattttccagtgttttt

SEQ ID NO: 326770 - DNA, 25 bp, Mus musculus
catagtcatcttcggtttgttgaca

SEQ ID NO: 326771 - DNA, 25 bp, Mus musculus
catagtcatcttgggtttgttgaca

SEQ ID NO: 326772 - DNA, 25 bp, Mus musculus
catagtcatgtgaagaagtgccaag

SEQ ID NO: 326773 - DNA, 25 bp, Mus musculus
catagtcatgtgtagaagtgccaag

SEQ ID NO: 326774 - DNA, 25 bp, Mus musculus
catagtccaggccatatgactttta

SEQ ID NO: 326775 - DNA, 25 bp, Mus musculus
catagtccaggcgatatgactttta

SEQ ID NO: 326776 - DNA, 25 bp, Mus musculus
catagtccagttctgcctctgtgaa

SEQ ID NO: 326777 - DNA, 25 bp, Mus musculus
catagtccagttgtgcctctgtgaa

SEQ ID NO: 326778 - DNA, 25 bp, Mus musculus
catagtccatcaacaaagcagtcag

SEQ ID NO: 326779 - DNA, 25 bp, Mus musculus
catagtccatcatcaaagcagtcag

SEQ ID NO: 326780 - DNA, 25 bp, Mus musculus
catagtccggaaattattgtggtag

SEQ ID NO: 326781 - DNA, 25 bp, Mus musculus
catagtccggaatttattgtggtag

SEQ ID NO: 326782 - DNA, 25 bp, Mus musculus
catagtcctagactttttcttcaaa

SEQ ID NO: 326783 - DNA, 25 bp, Mus musculus
catagtcctagagtttttcttcaaa

SEQ ID NO: 326784 - DNA, 25 bp, Mus musculus
catagtcctggaaattatttgtggt

SEQ ID NO: 326785 - DNA, 25 bp, Mus musculus
catagtcctggatattatttgtggt

SEQ ID NO: 326786 - DNA, 25 bp, Mus musculus
catagtcttagtattatctcctttg

SEQ ID NO: 326787 - DNA, 25 bp, Mus musculus
catagtcttagttttatctcctttg

SEQ ID NO: 326788 - DNA, 25 bp, Mus musculus
catagtgaagtgacttctcttgaca

SEQ ID NO: 326789 - DNA, 25 bp, Mus musculus
catagtgaagtgtcttctcttgaca

SEQ ID NO: 326790 - DNA, 25 bp, Mus musculus
catagtgacaaacggcgccttagta

SEQ ID NO: 326791 - DNA, 25 bp, Mus musculus
catagtgacaaagggcgccttagta

SEQ ID NO: 326792 - DNA, 25 bp, Mus musculus
catagtgacattaaccctgcagcct

SEQ ID NO: 326793 - DNA, 25 bp, Mus musculus
catagtgacatttaccctgcagcct

SEQ ID NO: 326794 - DNA, 25 bp, Mus musculus
catagtgaccagaattgtttgttgt

SEQ ID NO: 326795 - DNA, 25 bp, Mus musculus
catagtgaccagtattgtttgttgt

SEQ ID NO: 326796 - DNA, 25 bp, Mus musculus
catagtgaccggagtgctcttctgt

SEQ ID NO: 326797 - DNA, 25 bp, Mus musculus
catagtgaccggtgtgctcttctgt

SEQ ID NO: 326798 - DNA, 25 bp, Mus musculus
catagtgatgcacgctggtgatccc

SEQ ID NO: 326799 - DNA, 25 bp, Mus musculus
catagtgatgcaggctggtgatccc

SEQ ID NO: 326800 - DNA, 25 bp, Mus musculus
catagtgattaacggctgtttgtaa

SEQ ID NO: 326801 - DNA, 25 bp, Mus musculus
catagtgattaagggctgtttgtaa

SEQ ID NO: 326802 - DNA, 25 bp, Mus musculus
catagtgattgcatcaattataaca

SEQ ID NO: 326803 - DNA, 25 bp, Mus musculus
catagtgattgcttcaattataaca

SEQ ID NO: 326804 - DNA, 25 bp, Mus musculus
catagtgcaatgactgttccttttt

SEQ ID NO: 326805 - DNA, 25 bp, Mus musculus
catagtgcaatgtctgttccttttt

SEQ ID NO: 326806 - DNA, 25 bp, Mus musculus
catagtgcactgacaacaacctaca

SEQ ID NO: 326807 - DNA, 25 bp, Mus musculus
catagtgcactgtcaacaacctaca

SEQ ID NO: 326808 - DNA, 25 bp, Mus musculus
catagtgccaaacaggtcagattta

SEQ ID NO: 326809 - DNA, 25 bp, Mus musculus
catagtgccaaagaggtcagattta

SEQ ID NO: 326810 - DNA, 25 bp, Mus musculus
catagtgcctggcattctcctctct

SEQ ID NO: 326811 - DNA, 25 bp, Mus musculus
catagtgcctgggattctcctctct

SEQ ID NO: 326812 - DNA, 25 bp, Mus musculus
catagtggacaaatgccggcagcat

SEQ ID NO: 326813 - DNA, 25 bp, Mus musculus
catagtggacaattgccggcagcat

SEQ ID NO: 326814 - DNA, 25 bp, Mus musculus
catagtgggcctaaatgagatacaa

SEQ ID NO: 326815 - DNA, 25 bp, Mus musculus
catagtgggccttaatgagatacaa

SEQ ID NO: 326816 - DNA, 25 bp, Mus musculus
catagtgggttcacttcatgaatgt

SEQ ID NO: 326817 - DNA, 25 bp, Mus musculus
catagtgggttctcttcatgaatgt

SEQ ID NO: 326818 - DNA, 25 bp, Mus musculus
catagtgtataacctagtgccaggc

SEQ ID NO: 326819 - DNA, 25 bp, Mus musculus
catagtgtataagctagtgccaggc

SEQ ID NO: 326820 - DNA, 25 bp, Mus musculus
catagtgtccacaaagcgaggcaaa

SEQ ID NO: 326821 - DNA, 25 bp, Mus musculus
catagtgtccactaagcgaggcaaa

SEQ ID NO: 326822 - DNA, 25 bp, Mus musculus
catagtgtctttctggtctgtgtgt

SEQ ID NO: 326823 - DNA, 25 bp, Mus musculus
catagtgtctttgtggtctgtgtgt

SEQ ID NO: 326824 - DNA, 25 bp, Mus musculus
catagtgtgtctattcgtttcccag

SEQ ID NO: 326825 - DNA, 25 bp, Mus musculus
catagtgtgtcttttcgtttcccag

SEQ ID NO: 326826 - DNA, 25 bp, Mus musculus
catagtgtgtgccttctataaagga

SEQ ID NO: 326827 - DNA, 25 bp, Mus musculus
catagtgtgtgcgttctataaagga

SEQ ID NO: 326828 - DNA, 25 bp, Mus musculus
catagtgtgtgtcgccctccaccat

SEQ ID NO: 326829 - DNA, 25 bp, Mus musculus
catagtgtgtgtggccctccaccat

SEQ ID NO: 326830 - DNA, 25 bp, Mus musculus
catagtgttattatcctggaatccc

SEQ ID NO: 326831 - DNA, 25 bp, Mus musculus
catagtgttattttcctggaatccc

SEQ ID NO: 326832 - DNA, 25 bp, Mus musculus
catagttagttccttcacgtctttg

SEQ ID NO: 326833 - DNA, 25 bp, Mus musculus
catagttagttcgttcacgtctttg

SEQ ID NO: 326834 - DNA, 25 bp, Mus musculus
catagttatttcatctttgtcttac

SEQ ID NO: 326835 - DNA, 25 bp, Mus musculus
catagttatttcttctttgtcttac

SEQ ID NO: 326836 - DNA, 25 bp, Mus musculus
catagttcatcacactcctggagtt

SEQ ID NO: 326837 - DNA, 25 bp, Mus musculus
catagttcatcagactcctggagtt

SEQ ID NO: 326838 - DNA, 25 bp, Mus musculus
catagttcctccagcatatacacac

SEQ ID NO: 326839 - DNA, 25 bp, Mus musculus
catagttcctcctgcatatacacac

SEQ ID NO: 326840 - DNA, 25 bp, Mus musculus
catagttcctgcaaatgggtcatca

SEQ ID NO: 326841 - DNA, 25 bp, Mus musculus
catagttcctgctaatgggtcatca

SEQ ID NO: 326842 - DNA, 25 bp, Mus musculus
catagttgaatgcacggcccggatt

SEQ ID NO: 326843 - DNA, 25 bp, Mus musculus
catagttgaatggacggcccggatt

SEQ ID NO: 326844 - DNA, 25 bp, Mus musculus
catagttgagcactggatacctcct

SEQ ID NO: 326845 - DNA, 25 bp, Mus musculus
catagttgagcagtggatacctcct

SEQ ID NO: 326846 - DNA, 25 bp, Mus musculus
catagttgggcaagcagacgattaa

SEQ ID NO: 326847 - DNA, 25 bp, Mus musculus
catagttgggcatgcagacgattaa

SEQ ID NO: 326848 - DNA, 25 bp, Mus musculus
catagttggtcaatgcctggcaggt

SEQ ID NO: 326849 - DNA, 25 bp, Mus musculus
catagttggtcattgcctggcaggt

SEQ ID NO: 326850 - DNA, 25 bp, Mus musculus
catagttgtcttacatattgggttt

SEQ ID NO: 326851 - DNA, 25 bp, Mus musculus
catagttgtctttcatattgggttt

SEQ ID NO: 326852 - DNA, 25 bp, Mus musculus
catagtttagacataacttctagca

SEQ ID NO: 326853 - DNA, 25 bp, Mus musculus
catagtttagacttaacttctagca

SEQ ID NO: 326854 - DNA, 25 bp, Mus musculus
catagtttcattatcatttttacct

SEQ ID NO: 326855 - DNA, 25 bp, Mus musculus
catagtttcattttcatttttacct

SEQ ID NO: 326856 - DNA, 25 bp, Mus musculus
catagtttgatgaggtaggttcttt

SEQ ID NO: 326857 - DNA, 25 bp, Mus musculus
catagtttgatgtggtaggttcttt

SEQ ID NO: 326858 - DNA, 25 bp, Mus musculus
catagttttacacacagctccaggc

SEQ ID NO: 326859 - DNA, 25 bp, Mus musculus
catagttttacagacagctccaggc

SEQ ID NO: 326860 - DNA, 25 bp, Mus musculus
catagttttatgacccattggatta

SEQ ID NO: 326861 - DNA, 25 bp, Mus musculus
catagttttatgtcccattggatta

SEQ ID NO: 326862 - DNA, 25 bp, Mus musculus
catagttttattagctggactttta

SEQ ID NO: 326863 - DNA, 25 bp, Mus musculus
catagttttatttgctggactttta

SEQ ID NO: 326864 - DNA, 25 bp, Mus musculus
catataaacctacagttaacaccct

SEQ ID NO: 326865 - DNA, 25 bp, Mus musculus
catataaacctagagttaacaccct

SEQ ID NO: 326866 - DNA, 25 bp, Mus musculus
catataaagcctactacaagcattt

SEQ ID NO: 326867 - DNA, 25 bp, Mus musculus
catataaagccttctacaagcattt

SEQ ID NO: 326868 - DNA, 25 bp, Mus musculus
catataaatccacactgccacataa

SEQ ID NO: 326869 - DNA, 25 bp, Mus musculus
catataaatccagactgccacataa

SEQ ID NO: 326870 - DNA, 25 bp, Mus musculus
catataacctggctgggcttttgga

SEQ ID NO: 326871 - DNA, 25 bp, Mus musculus
catataacctgggtgggcttttgga

SEQ ID NO: 326872 - DNA, 25 bp, Mus musculus
catataagacctaccacatccagat

SEQ ID NO: 326873 - DNA, 25 bp, Mus musculus
catataagaccttccacatccagat

SEQ ID NO: 326874 - DNA, 25 bp, Mus musculus
catataagatctcctgttgccgctg

SEQ ID NO: 326875 - DNA, 25 bp, Mus musculus
catataagatctgctgttgccgctg

SEQ ID NO: 326876 - DNA, 25 bp, Mus musculus
catataatagacatcattctcctta

SEQ ID NO: 326877 - DNA, 25 bp, Mus musculus
catataatagacttcattctcctta

SEQ ID NO: 326878 - DNA, 25 bp, Mus musculus
catataatatggctctttccccaaa

SEQ ID NO: 326879 - DNA, 25 bp, Mus musculus
catataatatgggtctttccccaaa

SEQ ID NO: 326880 - DNA, 25 bp, Mus musculus
catataatgagcacctgattccaaa

SEQ ID NO: 326881 - DNA, 25 bp, Mus musculus
catataatgagctcctgattccaaa

SEQ ID NO: 326882 - DNA, 25 bp, Mus musculus
catataattctcataaggcacctat

SEQ ID NO: 326883 - DNA, 25 bp, Mus musculus
catataattctcttaaggcacctat

SEQ ID NO: 326884 - DNA, 25 bp, Mus musculus
catatacaacaaaggatccctgttc

SEQ ID NO: 326885 - DNA, 25 bp, Mus musculus
catatacaacaatggatccctgttc

SEQ ID NO: 326886 - DNA, 25 bp, Mus musculus
catataccagatatgtgtgctcaca

SEQ ID NO: 326887 - DNA, 25 bp, Mus musculus
catataccagatttgtgtgctcaca

SEQ ID NO: 326888 - DNA, 25 bp, Mus musculus
catataccgctgctgcactgatatg

SEQ ID NO: 326889 - DNA, 25 bp, Mus musculus
catataccgctggtgcactgatatg

SEQ ID NO: 326890 - DNA, 25 bp, Mus musculus
catatacctgtgatatcaggacctg

SEQ ID NO: 326891 - DNA, 25 bp, Mus musculus
catatacctgtgttatcaggacctg

SEQ ID NO: 326892 - DNA, 25 bp, Mus musculus
catatactgtgaaagccatccgttt

SEQ ID NO: 326893 - DNA, 25 bp, Mus musculus
catatactgtgatagccatccgttt

SEQ ID NO: 326894 - DNA, 25 bp, Mus musculus
catatacttaaaccattttggttaa

SEQ ID NO: 326895 - DNA, 25 bp, Mus musculus
catatacttaaagcattttggttaa

SEQ ID NO: 326896 - DNA, 25 bp, Mus musculus
catatactttatctttgcttgctta

SEQ ID NO: 326897 - DNA, 25 bp, Mus musculus
catatactttatgtttgcttgctta

SEQ ID NO: 326898 - DNA, 25 bp, Mus musculus
catatagaattcacggccagggctc

SEQ ID NO: 326899 - DNA, 25 bp, Mus musculus
catatagaattctcggccagggctc

SEQ ID NO: 326900 - DNA, 25 bp, Mus musculus
catatagacttaacttgtggaccta

SEQ ID NO: 326901 - DNA, 25 bp, Mus musculus
catatagacttatcttgtggaccta

SEQ ID NO: 326902 - DNA, 25 bp, Mus musculus
catatagatgcacaccctttctgtc

SEQ ID NO: 326903 - DNA, 25 bp, Mus musculus
catatagatgcagaccctttctgtc

SEQ ID NO: 326904 - DNA, 25 bp, Mus musculus
catatagccaccattaacccaagtt

SEQ ID NO: 326905 - DNA, 25 bp, Mus musculus
catatagccacctttaacccaagtt

SEQ ID NO: 326906 - DNA, 25 bp, Mus musculus
catatagccatcaggcagccattgc

SEQ ID NO: 326907 - DNA, 25 bp, Mus musculus
catatagccatctggcagccattgc

SEQ ID NO: 326908 - DNA, 25 bp, Mus musculus
catatagccgttccctagcatgtat

SEQ ID NO: 326909 - DNA, 25 bp, Mus musculus
catatagccgttgcctagcatgtat

SEQ ID NO: 326910 - DNA, 25 bp, Mus musculus
catataggccacattttagtaataa

SEQ ID NO: 326911 - DNA, 25 bp, Mus musculus
catataggccactttttagtaataa

SEQ ID NO: 326912 - DNA, 25 bp, Mus musculus
catatagggataatggcattgagac

SEQ ID NO: 326913 - DNA, 25 bp, Mus musculus
catatagggatattggcattgagac

SEQ ID NO: 326914 - DNA, 25 bp, Mus musculus
catataggtgttactaagactctga

SEQ ID NO: 326915 - DNA, 25 bp, Mus musculus
catataggtgtttctaagactctga

SEQ ID NO: 326916 - DNA, 25 bp, Mus musculus
catatagtccatctggtagcacttg

SEQ ID NO: 326917 - DNA, 25 bp, Mus musculus
catatagtccatgtggtagcacttg

SEQ ID NO: 326918 - DNA, 25 bp, Mus musculus
catatagttacacgacccaaagggc

SEQ ID NO: 326919 - DNA, 25 bp, Mus musculus
catatagttacaggacccaaagggc

SEQ ID NO: 326920 - DNA, 25 bp, Mus musculus
catatataacctcaccaaaccttgt

SEQ ID NO: 326921 - DNA, 25 bp, Mus musculus
catatataacctgaccaaaccttgt

SEQ ID NO: 326922 - DNA, 25 bp, Mus musculus
catatataatatctgcacaagcagg

SEQ ID NO: 326923 - DNA, 25 bp, Mus musculus
catatataatatgtgcacaagcagg

SEQ ID NO: 326924 - DNA, 25 bp, Mus musculus
catatataggaacccagaggtacca

SEQ ID NO: 326925 - DNA, 25 bp, Mus musculus
catatataggaaccccgaggttccc

SEQ ID NO: 326926 - DNA, 25 bp, Mus musculus
catatataggaagccagaggtacca

SEQ ID NO: 326927 - DNA, 25 bp, Mus musculus
catatataggaagcccgaggttccc

SEQ ID NO: 326928 - DNA, 25 bp, Mus musculus
catatatcccccctatttaaaattg

SEQ ID NO: 326929 - DNA, 25 bp, Mus musculus
catatatcccccgtatttaaaattg

SEQ ID NO: 326930 - DNA, 25 bp, Mus musculus
catatatccttgctgtcactcattt

SEQ ID NO: 326931 - DNA, 25 bp, Mus musculus
catatatccttggtgtcactcattt

SEQ ID NO: 326932 - DNA, 25 bp, Mus musculus
catatatgacctcttcctttgtgaa

SEQ ID NO: 326933 - DNA, 25 bp, Mus musculus
catatatgacctgttcctttgtgaa

SEQ ID NO: 326934 - DNA, 25 bp, Mus musculus
catatatgtcgtagctgttctctgc

SEQ ID NO: 326935 - DNA, 25 bp, Mus musculus
catatatgtcgttgctgttctctgc

SEQ ID NO: 326936 - DNA, 25 bp, Mus musculus
catatattcatgagagttccaggga

SEQ ID NO: 326937 - DNA, 25 bp, Mus musculus
catatattcatgtgagttccaggga

SEQ ID NO: 326938 - DNA, 25 bp, Mus musculus
catatattctccaatctatcatggg

SEQ ID NO: 326939 - DNA, 25 bp, Mus musculus
catatattctcctatctatcatggg

SEQ ID NO: 326940 - DNA, 25 bp, Mus musculus
catatatttcagacgctgcctcaac

SEQ ID NO: 326941 - DNA, 25 bp, Mus musculus
catatatttcagtcgctgcctcaac

SEQ ID NO: 326942 - DNA, 25 bp, Mus musculus
catatatttctcaccttttgctatc

SEQ ID NO: 326943 - DNA, 25 bp, Mus musculus
catatatttctctccttttgctatc

SEQ ID NO: 326944 - DNA, 25 bp, Mus musculus
catatcaaaatgatccctcagggct

SEQ ID NO: 326945 - DNA, 25 bp, Mus musculus
catatcaaaatgttccctcagggct

SEQ ID NO: 326946 - DNA, 25 bp, Mus musculus
catatcaacataataagtctgctaa

SEQ ID NO: 326947 - DNA, 25 bp, Mus musculus
catatcaacatattaagtctgctaa

SEQ ID NO: 326948 - DNA, 25 bp, Mus musculus
catatcaagactctgccctaggaaa

SEQ ID NO: 326949 - DNA, 25 bp, Mus musculus
catatcaagactgtgccctaggaaa

SEQ ID NO: 326950 - DNA, 25 bp, Mus musculus
catatcaatttaccatgtccctggg

SEQ ID NO: 326951 - DNA, 25 bp, Mus musculus
catatcaatttagcatgtccctggg

SEQ ID NO: 326952 - DNA, 25 bp, Mus musculus
catatcacacgtcgccttgtctaga

SEQ ID NO: 326953 - DNA, 25 bp, Mus musculus
catatcacacgtggccttgtctaga

SEQ ID NO: 326954 - DNA, 25 bp, Mus musculus
catatcagctcgagggtgtctggaa

SEQ ID NO: 326955 - DNA, 25 bp, Mus musculus
catatcagctcgtgggtgtctggaa

SEQ ID NO: 326956 - DNA, 25 bp, Mus musculus
catatcagttgaattcactttgcat

SEQ ID NO: 326957 - DNA, 25 bp, Mus musculus
catatcagttgatttcactttgcat

SEQ ID NO: 326958 - DNA, 25 bp, Mus musculus
catatcagttggaatagtgagcttt

SEQ ID NO: 326959 - DNA, 25 bp, Mus musculus
catatcagttggtatagtgagcttt

SEQ ID NO: 326960 - DNA, 25 bp, Mus musculus
catatcataatgctgttttattgcc

SEQ ID NO: 326961 - DNA, 25 bp, Mus musculus
catatcataatggtgttttattgcc

SEQ ID NO: 326962 - DNA, 25 bp, Mus musculus
catatcatgaggagtggtggcacaa

SEQ ID NO: 326963 - DNA, 25 bp, Mus musculus
catatcatgaggtgtggtggcacaa

SEQ ID NO: 326964 - DNA, 25 bp, Mus musculus
catatcattccaagatggttctcaa

SEQ ID NO: 326965 - DNA, 25 bp, Mus musculus
catatcattccatgatggttctcaa

SEQ ID NO: 326966 - DNA, 25 bp, Mus musculus
catatcattgtgattccgtttgccc

SEQ ID NO: 326967 - DNA, 25 bp, Mus musculus
catatcattgtgtttccgtttgccc

SEQ ID NO: 326968 - DNA, 25 bp, Mus musculus
catatccacatgatgctagagggac

SEQ ID NO: 326969 - DNA, 25 bp, Mus musculus
catatccacatgttgctagagggac

SEQ ID NO: 326970 - DNA, 25 bp, Mus musculus
catatccaccgcaacttttaattcc

SEQ ID NO: 326971 - DNA, 25 bp, Mus musculus
catatccaccgctacttttaattcc

SEQ ID NO: 326972 - DNA, 25 bp, Mus musculus
catatccagataccattcggctgtc

SEQ ID NO: 326973 - DNA, 25 bp, Mus musculus
catatccagatagcattcggctgtc

SEQ ID NO: 326974 - DNA, 25 bp, Mus musculus
catatccattgccatcagaaaccac

SEQ ID NO: 326975 - DNA, 25 bp, Mus musculus
catatccattgcgatcagaaaccac

SEQ ID NO: 326976 - DNA, 25 bp, Mus musculus
catatcccagagaacaatcactatt

SEQ ID NO: 326977 - DNA, 25 bp, Mus musculus
catatcccagagtacaatcactatt

SEQ ID NO: 326978 - DNA, 25 bp, Mus musculus
catatcccagggaggccaacaggaa

SEQ ID NO: 326979 - DNA, 25 bp, Mus musculus
catatcccagggtggccaacaggaa

SEQ ID NO: 326980 - DNA, 25 bp, Mus musculus
catatcccagtcagcattatcacac

SEQ ID NO: 326981 - DNA, 25 bp, Mus musculus
catatcccagtctgcattatcacac

SEQ ID NO: 326982 - DNA, 25 bp, Mus musculus
catatccccaagaccggttcagtaa

SEQ ID NO: 326983 - DNA, 25 bp, Mus musculus
catatccccaagtccggttcagtaa

SEQ ID NO: 326984 - DNA, 25 bp, Mus musculus
catatccctgtgcaaaagatctgtg

SEQ ID NO: 326985 - DNA, 25 bp, Mus musculus
catatccctgtggaaaagatctgtg

SEQ ID NO: 326986 - DNA, 25 bp, Mus musculus
catatccctgttacccatacactca

SEQ ID NO: 326987 - DNA, 25 bp, Mus musculus
catatccctgtttcccatacactca

SEQ ID NO: 326988 - DNA, 25 bp, Mus musculus
catatcctctccacagccagcccag

SEQ ID NO: 326989 - DNA, 25 bp, Mus musculus
catatcctctcctcagccagcccag

SEQ ID NO: 326990 - DNA, 25 bp, Mus musculus
catatcctgaacatttctttttaag

SEQ ID NO: 326991 - DNA, 25 bp, Mus musculus
catatcctgaacttttctttttaag

SEQ ID NO: 326992 - DNA, 25 bp, Mus musculus
catatcctgcttcatgggcgtaaaa

SEQ ID NO: 326993 - DNA, 25 bp, Mus musculus
catatcctgcttgatgggcgtaaaa

SEQ ID NO: 326994 - DNA, 25 bp, Mus musculus
catatccttcatctggtcagcaata

SEQ ID NO: 326995 - DNA, 25 bp, Mus musculus
catatccttcatgtggtcagcaata

SEQ ID NO: 326996 - DNA, 25 bp, Mus musculus
catatccttcttatctagtggtgct

SEQ ID NO: 326997 - DNA, 25 bp, Mus musculus
catatccttcttttctagtggtgct

SEQ ID NO: 326998 - DNA, 25 bp, Mus musculus
catatcctttagagaccctttgcag

SEQ ID NO: 326999 - DNA, 25 bp, Mus musculus
catatcctttagtgaccctttgcag

SEQ ID NO: 327000 - DNA, 25 bp, Mus musculus
catatcgttgtcagtgctgtaattc

SEQ ID NO: 327001 - DNA, 25 bp, Mus musculus
catatcgttgtctgtgctgtaattc

SEQ ID NO: 327002 - DNA, 25 bp, Mus musculus
catatctactcacctagtttgcctt

SEQ ID NO: 327003 - DNA, 25 bp, Mus musculus
catatctactcagctagtttgcctt

SEQ ID NO: 327004 - DNA, 25 bp, Mus musculus
catatctcaaccagtctacttgtga

SEQ ID NO: 327005 - DNA, 25 bp, Mus musculus
catatctcaacctgtctacttgtga

SEQ ID NO: 327006 - DNA, 25 bp, Mus musculus
catatctcagtgctcggtttcagta

SEQ ID NO: 327007 - DNA, 25 bp, Mus musculus
catatctcagtggtcggtttcagta

SEQ ID NO: 327008 - DNA, 25 bp, Mus musculus
catatctcttcgagttacttcacac

SEQ ID NO: 327009 - DNA, 25 bp, Mus musculus
catatctcttcgtgttacttcacac

SEQ ID NO: 327010 - DNA, 25 bp, Mus musculus
catatctgatctcggctgttgttac

SEQ ID NO: 327011 - DNA, 25 bp, Mus musculus
catatctgatctgggctgttgttac

SEQ ID NO: 327012 - DNA, 25 bp, Mus musculus
catatctgtattctttagtgctcat

SEQ ID NO: 327013 - DNA, 25 bp, Mus musculus
catatctgtattgtttagtgctcat

SEQ ID NO: 327014 - DNA, 25 bp, Mus musculus
catatctgtgagacctttttgctac

SEQ ID NO: 327015 - DNA, 25 bp, Mus musculus
catatctgtgagtcctttttgctac

SEQ ID NO: 327016 - DNA, 25 bp, Mus musculus
catatcttaattcgacacagggcac

SEQ ID NO: 327017 - DNA, 25 bp, Mus musculus
catatcttaattggacacagggcac

SEQ ID NO: 327018 - DNA, 25 bp, Mus musculus
catatcttctgacccatcttgcagt

SEQ ID NO: 327019 - DNA, 25 bp, Mus musculus
catatcttctgagccatcttgcagt

SEQ ID NO: 327020 - DNA, 25 bp, Mus musculus
catatcttgggaattatctgggcat

SEQ ID NO: 327021 - DNA, 25 bp, Mus musculus
catatcttgggatttatctgggcat

SEQ ID NO: 327022 - DNA, 25 bp, Mus musculus
catatcttttgacgagtacttattt

SEQ ID NO: 327023 - DNA, 25 bp, Mus musculus
catatcttttgaggagtacttattt

SEQ ID NO: 327024 - DNA, 25 bp, Mus musculus
catatgaaataaagcccatggcctg

SEQ ID NO: 327025 - DNA, 25 bp, Mus musculus
catatgaaataatgcccatggcctg

SEQ ID NO: 327026 - DNA, 25 bp, Mus musculus
catatgaacctaatttgagtttttc

SEQ ID NO: 327027 - DNA, 25 bp, Mus musculus
catatgaacctattttgagtttttc

SEQ ID NO: 327028 - DNA, 25 bp, Mus musculus
catatgaccacaagcatagggtgca

SEQ ID NO: 327029 - DNA, 25 bp, Mus musculus
catatgaccacatgcatagggtgca

SEQ ID NO: 327030 - DNA, 25 bp, Mus musculus
catatgactatgatgccactcttaa

SEQ ID NO: 327031 - DNA, 25 bp, Mus musculus
catatgactatgttgccactcttaa

SEQ ID NO: 327032 - DNA, 25 bp, Mus musculus
catatgacttcaactggcacaggaa

SEQ ID NO: 327033 - DNA, 25 bp, Mus musculus
catatgacttcatctggcacaggaa

SEQ ID NO: 327034 - DNA, 25 bp, Mus musculus
catatgatcattactgttccccagc

SEQ ID NO: 327035 - DNA, 25 bp, Mus musculus
catatgatcatttctgttccccagc

SEQ ID NO: 327036 - DNA, 25 bp, Mus musculus
catatgatgccgctcttcagtacat

SEQ ID NO: 327037 - DNA, 25 bp, Mus musculus
catatgatgccggtcttcagtacat

SEQ ID NO: 327038 - DNA, 25 bp, Mus musculus
catatgatggtccttaccctgggac

SEQ ID NO: 327039 - DNA, 25 bp, Mus musculus
catatgatggtcgttaccctgggac

SEQ ID NO: 327040 - DNA, 25 bp, Mus musculus
catatgatgttcaggctggctttga

SEQ ID NO: 327041 - DNA, 25 bp, Mus musculus
catatgatgttctggctggctttga

SEQ ID NO: 327042 - DNA, 25 bp, Mus musculus
catatgattacaaagcagaagctgc

SEQ ID NO: 327043 - DNA, 25 bp, Mus musculus
catatgattacatagcagaagctgc

SEQ ID NO: 327044 - DNA, 25 bp, Mus musculus
catatgcaaattaacctactggtag

SEQ ID NO: 327045 - DNA, 25 bp, Mus musculus
catatgcaaatttacctactggtag

SEQ ID NO: 327046 - DNA, 25 bp, Mus musculus
catatgcagcataaactaatagtgt

SEQ ID NO: 327047 - DNA, 25 bp, Mus musculus
catatgcagcattaactaatagtgt

SEQ ID NO: 327048 - DNA, 25 bp, Mus musculus
catatgcagctacacttgatagact

SEQ ID NO: 327049 - DNA, 25 bp, Mus musculus
catatgcagctagacttgatagact

SEQ ID NO: 327050 - DNA, 25 bp, Mus musculus
catatgcatttgactgtgtgtgagc

SEQ ID NO: 327051 - DNA, 25 bp, Mus musculus
catatgcatttgtctgtgtgtgagc

SEQ ID NO: 327052 - DNA, 25 bp, Mus musculus
catatgcccaccagtgtgtgcacaa

SEQ ID NO: 327053 - DNA, 25 bp, Mus musculus
catatgcccacctgtgtgtgcacaa

SEQ ID NO: 327054 - DNA, 25 bp, Mus musculus
catatgccttttaatcccggtacaa

SEQ ID NO: 327055 - DNA, 25 bp, Mus musculus
catatgcctttttatcccggtacaa

SEQ ID NO: 327056 - DNA, 25 bp, Mus musculus
catatgcgatggaaactgcttttta

SEQ ID NO: 327057 - DNA, 25 bp, Mus musculus
catatgcgatggtaactgcttttta

SEQ ID NO: 327058 - DNA, 25 bp, Mus musculus
catatggaccatccccttcagagct

SEQ ID NO: 327059 - DNA, 25 bp, Mus musculus
catatggaccatgcccttcagagct

SEQ ID NO: 327060 - DNA, 25 bp, Mus musculus
catatggaggcaatgctttgctggt

SEQ ID NO: 327061 - DNA, 25 bp, Mus musculus
catatggaggcattgctttgctggt

SEQ ID NO: 327062 - DNA, 25 bp, Mus musculus
catatggagtgcatttgtagaaaac

SEQ ID NO: 327063 - DNA, 25 bp, Mus musculus
catatggagtgcttttgtagaaaac

SEQ ID NO: 327064 - DNA, 25 bp, Mus musculus
catatggcctcacggtcctttccag

SEQ ID NO: 327065 - DNA, 25 bp, Mus musculus
catatggcctcagggtcctttccag

SEQ ID NO: 327066 - DNA, 25 bp, Mus musculus
catatggcggtgatagagtccctgt

SEQ ID NO: 327067 - DNA, 25 bp, Mus musculus
catatggcggtgttagagtccctgt

SEQ ID NO: 327068 - DNA, 25 bp, Mus musculus
catatggctacacctgtgttatcag

SEQ ID NO: 327069 - DNA, 25 bp, Mus musculus
catatggctacagctgtgttatcag

SEQ ID NO: 327070 - DNA, 25 bp, Mus musculus
catatggctattacttcattgtctg

SEQ ID NO: 327071 - DNA, 25 bp, Mus musculus
catatggctatttcttcattgtctg

SEQ ID NO: 327072 - DNA, 25 bp, Mus musculus
catatgggacagacttttcttcaca

SEQ ID NO: 327073 - DNA, 25 bp, Mus musculus
catatgggacagtcttttcttcaca

SEQ ID NO: 327074 - DNA, 25 bp, Mus musculus
catatgggattcatcttggataacc

SEQ ID NO: 327075 - DNA, 25 bp, Mus musculus
catatgggattcttcttggataacc

SEQ ID NO: 327076 - DNA, 25 bp, Mus musculus
catatggttggcacacggtgacatc

SEQ ID NO: 327077 - DNA, 25 bp, Mus musculus
catatggttggctcacggtgacatc

SEQ ID NO: 327078 - DNA, 25 bp, Mus musculus
catatggttggtaagccgtctgctt

SEQ ID NO: 327079 - DNA, 25 bp, Mus musculus
catatggttggttagccgtctgctt

SEQ ID NO: 327080 - DNA, 25 bp, Mus musculus
catatggtttgacagattttttaaa

SEQ ID NO: 327081 - DNA, 25 bp, Mus musculus
catatggtttgagagattttttaaa

SEQ ID NO: 327082 - DNA, 25 bp, Mus musculus
catatggttttactcagcagtgtaa

SEQ ID NO: 327083 - DNA, 25 bp, Mus musculus
catatggttttagtcagcagtgtaa

SEQ ID NO: 327084 - DNA, 25 bp, Mus musculus
catatgtaactcataccctgttctc

SEQ ID NO: 327085 - DNA, 25 bp, Mus musculus
catatgtaactcttaccctgttctc

SEQ ID NO: 327086 - DNA, 25 bp, Mus musculus
catatgtatctgatgccccgtgaat

SEQ ID NO: 327087 - DNA, 25 bp, Mus musculus
catatgtatctgttgccccgtgaat

SEQ ID NO: 327088 - DNA, 25 bp, Mus musculus
catatgtattatactgattgtttgc

SEQ ID NO: 327089 - DNA, 25 bp, Mus musculus
catatgtattattctgattgtttgc

SEQ ID NO: 327090 - DNA, 25 bp, Mus musculus
catatgtcctgtctctagtctaaac

SEQ ID NO: 327091 - DNA, 25 bp, Mus musculus
catatgtcctgtgtctagtctaaac

SEQ ID NO: 327092 - DNA, 25 bp, Mus musculus
catatgtgaacaagtggcaccgtca

SEQ ID NO: 327093 - DNA, 25 bp, Mus musculus
catatgtgaacatgtggcaccgtca

SEQ ID NO: 327094 - DNA, 25 bp, Mus musculus
catatgtgccagacagtcatcctgt

SEQ ID NO: 327095 - DNA, 25 bp, Mus musculus
catatgtgccagtcagtcatcctgt

SEQ ID NO: 327096 - DNA, 25 bp, Mus musculus
catatgtgcctccttgttgctaaaa

SEQ ID NO: 327097 - DNA, 25 bp, Mus musculus
catatgtgcctcgttgttgctaaaa

SEQ ID NO: 327098 - DNA, 25 bp, Mus musculus
catatgtgtacaatgctgagtgtaa

SEQ ID NO: 327099 - DNA, 25 bp, Mus musculus
catatgtgtacattgctgagtgtaa

SEQ ID NO: 327100 - DNA, 25 bp, Mus musculus
catatgtgtgtcagcaataccaaat

SEQ ID NO: 327101 - DNA, 25 bp, Mus musculus
catatgtgtgtctgcaataccaaat

SEQ ID NO: 327102 - DNA, 25 bp, Mus musculus
catatgttcaaaatgctcatggcaa

SEQ ID NO: 327103 - DNA, 25 bp, Mus musculus
catatgttcaaattgctcatggcaa

SEQ ID NO: 327104 - DNA, 25 bp, Mus musculus
catatgttcatcacctgggtcttga

SEQ ID NO: 327105 - DNA, 25 bp, Mus musculus
catatgttcatctcctgggtcttga

SEQ ID NO: 327106 - DNA, 25 bp, Mus musculus
catatgttcatgatcttgggacaga

SEQ ID NO: 327107 - DNA, 25 bp, Mus musculus
catatgttcatgttcttgggacaga

SEQ ID NO: 327108 - DNA, 25 bp, Mus musculus
catatgttccggaccctgcgaagcc

SEQ ID NO: 327109 - DNA, 25 bp, Mus musculus
catatgttccggtccctgcgaagcc

SEQ ID NO: 327110 - DNA, 25 bp, Mus musculus
catatgtttcagatgtatagcttgg

SEQ ID NO: 327111 - DNA, 25 bp, Mus musculus
catatgtttcagttgtatagcttgg

SEQ ID NO: 327112 - DNA, 25 bp, Mus musculus
catattaaggcaatgcccttagctt

SEQ ID NO: 327113 - DNA, 25 bp, Mus musculus
catattaaggcattgcccttagctt

SEQ ID NO: 327114 - DNA, 25 bp, Mus musculus
catattaatgtgagtgactacttga

SEQ ID NO: 327115 - DNA, 25 bp, Mus musculus
catattaatgtgtgtgactacttga

SEQ ID NO: 327116 - DNA, 25 bp, Mus musculus
catattacatttaatcttgtgctga

SEQ ID NO: 327117 - DNA, 25 bp, Mus musculus
catattacattttatcttgtgctga

SEQ ID NO: 327118 - DNA, 25 bp, Mus musculus
catattactctacgggttagtctcc

SEQ ID NO: 327119 - DNA, 25 bp, Mus musculus
catattactctaggggttagtctcc

SEQ ID NO: 327120 - DNA, 25 bp, Mus musculus
catattatattcaggctttctggag

SEQ ID NO: 327121 - DNA, 25 bp, Mus musculus
catattatattctggctttctggag

SEQ ID NO: 327122 - DNA, 25 bp, Mus musculus
catattatgcatctggaccagcaca

SEQ ID NO: 327123 - DNA, 25 bp, Mus musculus
catattatgcatgtggaccagcaca

SEQ ID NO: 327124 - DNA, 25 bp, Mus musculus
catattatgccaataggattttctt

SEQ ID NO: 327125 - DNA, 25 bp, Mus musculus
catattatgccattaggattttctt

SEQ ID NO: 327126 - DNA, 25 bp, Mus musculus
catattattgaacctggtgtgcatt

SEQ ID NO: 327127 - DNA, 25 bp, Mus musculus
catattattgaagctggtgtgcatt

SEQ ID NO: 327128 - DNA, 25 bp, Mus musculus
catattcaaagtcctcatttcccta

SEQ ID NO: 327129 - DNA, 25 bp, Mus musculus
catattcaaagtgctcatttcccta

SEQ ID NO: 327130 - DNA, 25 bp, Mus musculus
catattcagagtaggccacaggtgc

SEQ ID NO: 327131 - DNA, 25 bp, Mus musculus
catattcagagttggccacaggtgc

SEQ ID NO: 327132 - DNA, 25 bp, Mus musculus
catattcatttgaatccaaggtgct

SEQ ID NO: 327133 - DNA, 25 bp, Mus musculus
catattcatttgtatccaaggtgct

SEQ ID NO: 327134 - DNA, 25 bp, Mus musculus
catattccagaaaacctccaacact

SEQ ID NO: 327135 - DNA, 25 bp, Mus musculus
catattccagaatacctccaacact

SEQ ID NO: 327136 - DNA, 25 bp, Mus musculus
catattccagacaccctgggtggga

SEQ ID NO: 327137 - DNA, 25 bp, Mus musculus
catattccagactccctgggtggga

SEQ ID NO: 327138 - DNA, 25 bp, Mus musculus
catattccttggcattttgactttt

SEQ ID NO: 327139 - DNA, 25 bp, Mus musculus
catattccttgggattttgactttt

SEQ ID NO: 327140 - DNA, 25 bp, Mus musculus
catattcggattacttgttcatttt

SEQ ID NO: 327141 - DNA, 25 bp, Mus musculus
catattcggatttcttgttcatttt

SEQ ID NO: 327142 - DNA, 25 bp, Mus musculus
catattctacacaggccagagggcc

SEQ ID NO: 327143 - DNA, 25 bp, Mus musculus
catattctacactggccagagggcc

SEQ ID NO: 327144 - DNA, 25 bp, Mus musculus
catattctagctcggccttgggcac

SEQ ID NO: 327145 - DNA, 25 bp, Mus musculus
catattctagctgggccttgggcac

SEQ ID NO: 327146 - DNA, 25 bp, Mus musculus
catattctcattatctcagatatgc

SEQ ID NO: 327147 - DNA, 25 bp, Mus musculus
catattctcattttctcagatatgc

SEQ ID NO: 327148 - DNA, 25 bp, Mus musculus
catattctctcgcttcatacaaagg

SEQ ID NO: 327149 - DNA, 25 bp, Mus musculus
catattctctcggttcatacaaagg

SEQ ID NO: 327150 - DNA, 25 bp, Mus musculus
catattctgaggaggaaagccccaa

SEQ ID NO: 327151 - DNA, 25 bp, Mus musculus
catattctgaggtggaaagccccaa

SEQ ID NO: 327152 - DNA, 25 bp, Mus musculus
catattctgtttagctcaatggcaa

SEQ ID NO: 327153 - DNA, 25 bp, Mus musculus
catattctgttttgctcaatggcaa

SEQ ID NO: 327154 - DNA, 25 bp, Mus musculus
catattcttgcaccttttgcacacc

SEQ ID NO: 327155 - DNA, 25 bp, Mus musculus
catattcttgcagcttttgcacacc

SEQ ID NO: 327156 - DNA, 25 bp, Mus musculus
catattctttcaccgttttgacttt

SEQ ID NO: 327157 - DNA, 25 bp, Mus musculus
catattctttcagcgttttgacttt

SEQ ID NO: 327158 - DNA, 25 bp, Mus musculus
catattgaattgaactgcagcgtgg

SEQ ID NO: 327159 - DNA, 25 bp, Mus musculus
catattgaattgtactgcagcgtgg

SEQ ID NO: 327160 - DNA, 25 bp, Mus musculus
catattgcatacctcatttgtgtca

SEQ ID NO: 327161 - DNA, 25 bp, Mus musculus
catattgcatacgtcatttgtgtca

SEQ ID NO: 327162 - DNA, 25 bp, Mus musculus
catattgccacacaatccttttgtc

SEQ ID NO: 327163 - DNA, 25 bp, Mus musculus
catattgccacagaatccttttgtc

SEQ ID NO: 327164 - DNA, 25 bp, Mus musculus
catattgcttgtctgggtgaccatc

SEQ ID NO: 327165 - DNA, 25 bp, Mus musculus
catattgcttgtgtgggtgaccatc

SEQ ID NO: 327166 - DNA, 25 bp, Mus musculus
catattgctttgatggttttcactc

SEQ ID NO: 327167 - DNA, 25 bp, Mus musculus
catattgctttgttggttttcactc

SEQ ID NO: 327168 - DNA, 25 bp, Mus musculus
catattggtactagaaacttccttt

SEQ ID NO: 327169 - DNA, 25 bp, Mus musculus
catattggtacttgaaacttccttt

SEQ ID NO: 327170 - DNA, 25 bp, Mus musculus
catattggtcatccctatagaggat

SEQ ID NO: 327171 - DNA, 25 bp, Mus musculus
catattggtcatgcctatagaggat

SEQ ID NO: 327172 - DNA, 25 bp, Mus musculus
catattgtaataacatgtctgagtg

SEQ ID NO: 327173 - DNA, 25 bp, Mus musculus
catattgtaatatcatgtctgagtg

SEQ ID NO: 327174 - DNA, 25 bp, Mus musculus
catattgtacttaggagtgtgtgtg

SEQ ID NO: 327175 - DNA, 25 bp, Mus musculus
catattgtactttggagtgtgtgtg

SEQ ID NO: 327176 - DNA, 25 bp, Mus musculus
catattgtgaatcattttgaagttc

SEQ ID NO: 327177 - DNA, 25 bp, Mus musculus
catattgtgaatgattttgaagttc

SEQ ID NO: 327178 - DNA, 25 bp, Mus musculus
catattgtgacgctgggtccttgct

SEQ ID NO: 327179 - DNA, 25 bp, Mus musculus
catattgtgacggtgggtccttgct

SEQ ID NO: 327180 - DNA, 25 bp, Mus musculus
catattgtgccgaaagggcccagga

SEQ ID NO: 327181 - DNA, 25 bp, Mus musculus
catattgtgccgtaagggcccagga

SEQ ID NO: 327182 - DNA, 25 bp, Mus musculus
catattgtggttagtgggttcattc

SEQ ID NO: 327183 - DNA, 25 bp, Mus musculus
catattgtggtttgtgggttcattc

SEQ ID NO: 327184 - DNA, 25 bp, Mus musculus
catattgtgtgaaacttgaagagat

SEQ ID NO: 327185 - DNA, 25 bp, Mus musculus
catattgtgtgatacttgaagagat

SEQ ID NO: 327186 - DNA, 25 bp, Mus musculus
catattgtgtttcaagttatctggg

SEQ ID NO: 327187 - DNA, 25 bp, Mus musculus
catattgtgtttgaagttatctggg

SEQ ID NO: 327188 - DNA, 25 bp, Mus musculus
catatttaaacacccatgccactgg

SEQ ID NO: 327189 - DNA, 25 bp, Mus musculus
catatttaaacagccatgccactgg

SEQ ID NO: 327190 - DNA, 25 bp, Mus musculus
catatttaaggcctaatgccattct

SEQ ID NO: 327191 - DNA, 25 bp, Mus musculus
catatttaaggcctgcccagggctg

SEQ ID NO: 327192 - DNA, 25 bp, Mus musculus
catatttaaggcgtaatgccattct

SEQ ID NO: 327193 - DNA, 25 bp, Mus musculus
catatttaaggcgtgcccagggctg

SEQ ID NO: 327194 - DNA, 25 bp, Mus musculus
catatttacaaaatgggttccaaca

SEQ ID NO: 327195 - DNA, 25 bp, Mus musculus
catatttacaaattgggttccaaca

SEQ ID NO: 327196 - DNA, 25 bp, Mus musculus
catatttacttaaacttgccatagg

SEQ ID NO: 327197 - DNA, 25 bp, Mus musculus
catatttacttatacttgccatagg

SEQ ID NO: 327198 - DNA, 25 bp, Mus musculus
catatttagctgattggaacagagt

SEQ ID NO: 327199 - DNA, 25 bp, Mus musculus
catatttagctgtttggaacagagt

SEQ ID NO: 327200 - DNA, 25 bp, Mus musculus
catatttagggcagtgtgcatcaat

SEQ ID NO: 327201 - DNA, 25 bp, Mus musculus
catatttagggctgtgtgcatcaat

SEQ ID NO: 327202 - DNA, 25 bp, Mus musculus
catatttattcgctcatcactttga

SEQ ID NO: 327203 - DNA, 25 bp, Mus musculus
catatttattcggtcatcactttga

SEQ ID NO: 327204 - DNA, 25 bp, Mus musculus
catatttcaattaccacttaaattt

SEQ ID NO: 327205 - DNA, 25 bp, Mus musculus
catatttcaatttccacttaaattt

SEQ ID NO: 327206 - DNA, 25 bp, Mus musculus
catatttcagtaaccttttgtgttg

SEQ ID NO: 327207 - DNA, 25 bp, Mus musculus
catatttcagtatccttttgtgttg

SEQ ID NO: 327208 - DNA, 25 bp, Mus musculus
catatttcctggagactacctcaga

SEQ ID NO: 327209 - DNA, 25 bp, Mus musculus
catatttcctggtgactacctcaga

SEQ ID NO: 327210 - DNA, 25 bp, Mus musculus
catatttctgtaattgcaatgacta

SEQ ID NO: 327211 - DNA, 25 bp, Mus musculus
catatttctgtatttgcaatgacta

SEQ ID NO: 327212 - DNA, 25 bp, Mus musculus
catatttgaattcgcctgaacagat

SEQ ID NO: 327213 - DNA, 25 bp, Mus musculus
catatttgaattggcctgaacagat

SEQ ID NO: 327214 - DNA, 25 bp, Mus musculus
catatttgcatgagcttcctaccca

SEQ ID NO: 327215 - DNA, 25 bp, Mus musculus
catatttgcatgtgcttcctaccca

SEQ ID NO: 327216 - DNA, 25 bp, Mus musculus
catatttgcggtcagtgcctgaagc

SEQ ID NO: 327217 - DNA, 25 bp, Mus musculus
catatttgcggtgagtgcctgaagc

SEQ ID NO: 327218 - DNA, 25 bp, Mus musculus
catatttgcttcatccattagttaa

SEQ ID NO: 327219 - DNA, 25 bp, Mus musculus
catatttgcttcttccattagttaa

SEQ ID NO: 327220 - DNA, 25 bp, Mus musculus
catatttggttaaccccttgggtgg

SEQ ID NO: 327221 - DNA, 25 bp, Mus musculus
catatttggttatccccttgggtgg

SEQ ID NO: 327222 - DNA, 25 bp, Mus musculus
catatttgtatcagtcacatgactt

SEQ ID NO: 327223 - DNA, 25 bp, Mus musculus
catatttgtatctgtcacatgactt

SEQ ID NO: 327224 - DNA, 25 bp, Mus musculus
catatttgtcttcgtgtttctgatt

SEQ ID NO: 327225 - DNA, 25 bp, Mus musculus
catatttgtcttggtgtttctgatt

SEQ ID NO: 327226 - DNA, 25 bp, Mus musculus
catatttgtgcgcatggttaatgta

SEQ ID NO: 327227 - DNA, 25 bp, Mus musculus
catatttgtgcggatggttaatgta

SEQ ID NO: 327228 - DNA, 25 bp, Mus musculus
catatttgtgtgaacctgtatggta

SEQ ID NO: 327229 - DNA, 25 bp, Mus musculus
catatttgtgtgtacctgtatggta

SEQ ID NO: 327230 - DNA, 25 bp, Mus musculus
catatttgttgaatgccttacctct

SEQ ID NO: 327231 - DNA, 25 bp, Mus musculus
catatttgttgacatggagacacct

SEQ ID NO: 327232 - DNA, 25 bp, Mus musculus
catatttgttgagatggagacacct

SEQ ID NO: 327233 - DNA, 25 bp, Mus musculus
catatttgttgattgccttacctct

SEQ ID NO: 327234 - DNA, 25 bp, Mus musculus
catattttaagtcagtgtgctacct

SEQ ID NO: 327235 - DNA, 25 bp, Mus musculus
catattttaagtgagtgtgctacct

SEQ ID NO: 327236 - DNA, 25 bp, Mus musculus
catattttatgcagtaactggagtt

SEQ ID NO: 327237 - DNA, 25 bp, Mus musculus
catattttatgctgtaactggagtt

SEQ ID NO: 327238 - DNA, 25 bp, Mus musculus
catattttcataaaccagtcggttt

SEQ ID NO: 327239 - DNA, 25 bp, Mus musculus
catattttcatataccagtcggttt

SEQ ID NO: 327240 - DNA, 25 bp, Mus musculus
catattttctaactttcagcctggg

SEQ ID NO: 327241 - DNA, 25 bp, Mus musculus
catattttctaagtttcagcctggg

SEQ ID NO: 327242 - DNA, 25 bp, Mus musculus
catattttgcccagtcattggactt

SEQ ID NO: 327243 - DNA, 25 bp, Mus musculus
catattttgccctgtcattggactt

SEQ ID NO: 327244 - DNA, 25 bp, Mus musculus
catattttgtctcattagtttgtta

SEQ ID NO: 327245 - DNA, 25 bp, Mus musculus
catattttgtctgattagtttgtta

SEQ ID NO: 327246 - DNA, 25 bp, Mus musculus
catatttttaaacttccctatctca

SEQ ID NO: 327247 - DNA, 25 bp, Mus musculus
catatttttaaagttccctatctca

SEQ ID NO: 327248 - DNA, 25 bp, Mus musculus
catatttttcaaacccatactccca

SEQ ID NO: 327249 - DNA, 25 bp, Mus musculus
catatttttcaatcccatactccca

SEQ ID NO: 327250 - DNA, 25 bp, Mus musculus
catatttttgccactgaggtttcca

SEQ ID NO: 327251 - DNA, 25 bp, Mus musculus
catatttttgcctctgaggtttcca

SEQ ID NO: 327252 - DNA, 25 bp, Mus musculus
catcaaaaacttacctcctgtcggg

SEQ ID NO: 327253 - DNA, 25 bp, Mus musculus
catcaaaaactttcctcctgtcggg

SEQ ID NO: 327254 - DNA, 25 bp, Mus musculus
catcaaaaccatcgctgttttgttt

SEQ ID NO: 327255 - DNA, 25 bp, Mus musculus
catcaaaaccatggctgttttgttt

SEQ ID NO: 327256 - DNA, 25 bp, Mus musculus
catcaaaaccctactgaaaccctag

SEQ ID NO: 327257 - DNA, 25 bp, Mus musculus
catcaaaacccttctgaaaccctag

SEQ ID NO: 327258 - DNA, 25 bp, Mus musculus
catcaaaatggaccggtataaggac

SEQ ID NO: 327259 - DNA, 25 bp, Mus musculus
catcaaaatggagcggtataaggac

SEQ ID NO: 327260 - DNA, 25 bp, Mus musculus
catcaaacccctcagcagaatggat

SEQ ID NO: 327261 - DNA, 25 bp, Mus musculus
catcaaacccctgagcagaatggat

SEQ ID NO: 327262 - DNA, 25 bp, Mus musculus
catcaaaccctgattggatgcttgg

SEQ ID NO: 327263 - DNA, 25 bp, Mus musculus
catcaaaccctgtttggatgcttgg

SEQ ID NO: 327264 - DNA, 25 bp, Mus musculus
catcaaaccttcctcactgtggaga

SEQ ID NO: 327265 - DNA, 25 bp, Mus musculus
catcaaaccttcgtcactgtggaga

SEQ ID NO: 327266 - DNA, 25 bp, Mus musculus
catcaaacgagtctccaatgccata

SEQ ID NO: 327267 - DNA, 25 bp, Mus musculus
catcaaacgagtgtccaatgccata

SEQ ID NO: 327268 - DNA, 25 bp, Mus musculus
catcaaacttcgaggtgggcatacc

SEQ ID NO: 327269 - DNA, 25 bp, Mus musculus
catcaaacttcgtggtgggcatacc

SEQ ID NO: 327270 - DNA, 25 bp, Mus musculus
catcaaagcattacacggcctaatc

SEQ ID NO: 327271 - DNA, 25 bp, Mus musculus
catcaaagcatttcacggcctaatc

SEQ ID NO: 327272 - DNA, 25 bp, Mus musculus
catcaaagtcgacgaaagctatgcg

SEQ ID NO: 327273 - DNA, 25 bp, Mus musculus
catcaaagtcgaggaaagctatgcg

SEQ ID NO: 327274 - DNA, 25 bp, Mus musculus
catcaaatgatcattctgcttaata

SEQ ID NO: 327275 - DNA, 25 bp, Mus musculus
catcaaatgatctttctgcttaata

SEQ ID NO: 327276 - DNA, 25 bp, Mus musculus
catcaaatgcataacagagcttctt

SEQ ID NO: 327277 - DNA, 25 bp, Mus musculus
catcaaatgcattacagagcttctt

SEQ ID NO: 327278 - DNA, 25 bp, Mus musculus
catcaaatggttatttcttagagag

SEQ ID NO: 327279 - DNA, 25 bp, Mus musculus
catcaaatggttttttcttagagag

SEQ ID NO: 327280 - DNA, 25 bp, Mus musculus
catcaaattctgctgtgacagtgac

SEQ ID NO: 327281 - DNA, 25 bp, Mus musculus
catcaaattctggtgtgacagtgac

SEQ ID NO: 327282 - DNA, 25 bp, Mus musculus
catcaaattcttctccttagggttc

SEQ ID NO: 327283 - DNA, 25 bp, Mus musculus
catcaaattcttgtccttagggttc

SEQ ID NO: 327284 - DNA, 25 bp, Mus musculus
catcaacaaggtctaactaagcatt

SEQ ID NO: 327285 - DNA, 25 bp, Mus musculus
catcaacaaggtgtaactaagcatt

SEQ ID NO: 327286 - DNA, 25 bp, Mus musculus
catcaacactaaattgtccttttgt

SEQ ID NO: 327287 - DNA, 25 bp, Mus musculus
catcaacactaatttgtccttttgt

SEQ ID NO: 327288 - DNA, 25 bp, Mus musculus
catcaacagcggaatcccaggaatt

SEQ ID NO: 327289 - DNA, 25 bp, Mus musculus
catcaacagcggtatcccaggaatt

SEQ ID NO: 327290 - DNA, 25 bp, Mus musculus
catcaaccagttccgtagtctttca

SEQ ID NO: 327291 - DNA, 25 bp, Mus musculus
catcaaccagttgcgtagtctttca

SEQ ID NO: 327292 - DNA, 25 bp, Mus musculus
catcaaccgagaattgggaggcaga

SEQ ID NO: 327293 - DNA, 25 bp, Mus musculus
catcaaccgagatttgggaggcaga

SEQ ID NO: 327294 - DNA, 25 bp, Mus musculus
catcaacctcagagcaatatgccct

SEQ ID NO: 327295 - DNA, 25 bp, Mus musculus
catcaacctcagtgcaatatgccct

SEQ ID NO: 327296 - DNA, 25 bp, Mus musculus
catcaacctttcattcatcagtagc

SEQ ID NO: 327297 - DNA, 25 bp, Mus musculus
catcaacctttctttcatcagtagc

SEQ ID NO: 327298 - DNA, 25 bp, Mus musculus
catcaacgacatcttcaagcacgac

SEQ ID NO: 327299 - DNA, 25 bp, Mus musculus
catcaacgacatgttcaagcacgac

SEQ ID NO: 327300 - DNA, 25 bp, Mus musculus
catcaacgactcatgggtgtgcaga

SEQ ID NO: 327301 - DNA, 25 bp, Mus musculus
catcaacgactcttgggtgtgcaga

SEQ ID NO: 327302 - DNA, 25 bp, Mus musculus
catcaacggccacttcctgaaggag

SEQ ID NO: 327303 - DNA, 25 bp, Mus musculus
catcaacggccagttcctgaaggag

SEQ ID NO: 327304 - DNA, 25 bp, Mus musculus
catcaacgtcgtcatccaggagaat

SEQ ID NO: 327305 - DNA, 25 bp, Mus musculus
catcaacgtcgtgatccaggagaat

SEQ ID NO: 327306 - DNA, 25 bp, Mus musculus
catcaactactgacgaattgctact

SEQ ID NO: 327307 - DNA, 25 bp, Mus musculus
catcaactactgtcgaattgctact

SEQ ID NO: 327308 - DNA, 25 bp, Mus musculus
catcaactataaaacctactcagga

SEQ ID NO: 327309 - DNA, 25 bp, Mus musculus
catcaactataatacctactcagga

SEQ ID NO: 327310 - DNA, 25 bp, Mus musculus
catcaactttccagaagccatacct

SEQ ID NO: 327311 - DNA, 25 bp, Mus musculus
catcaactttcctgaagccatacct

SEQ ID NO: 327312 - DNA, 25 bp, Mus musculus
catcaagaaccaagttcaccttcag

SEQ ID NO: 327313 - DNA, 25 bp, Mus musculus
catcaagaaccatgttcaccttcag

SEQ ID NO: 327314 - DNA, 25 bp, Mus musculus
catcaagaagtaaacgagggcagga

SEQ ID NO: 327315 - DNA, 25 bp, Mus musculus
catcaagaagtatacgagggcagga

SEQ ID NO: 327316 - DNA, 25 bp, Mus musculus
catcaagaagtcatgctcttggcac

SEQ ID NO: 327317 - DNA, 25 bp, Mus musculus
catcaagaagtcttgctcttggcac

SEQ ID NO: 327318 - DNA, 25 bp, Mus musculus
catcaagactttacaggacctgggt

SEQ ID NO: 327319 - DNA, 25 bp, Mus musculus
catcaagacttttcaggacctgggt

SEQ ID NO: 327320 - DNA, 25 bp, Mus musculus
catcaagaggcacccatgcccgtgg

SEQ ID NO: 327321 - DNA, 25 bp, Mus musculus
catcaagaggcagccatgcccgtgg

SEQ ID NO: 327322 - DNA, 25 bp, Mus musculus
catcaagagggcatttccaaatttc

SEQ ID NO: 327323 - DNA, 25 bp, Mus musculus
catcaagagggcttttccaaatttc

SEQ ID NO: 327324 - DNA, 25 bp, Mus musculus
catcaagagtggatccagcaccgtt

SEQ ID NO: 327325 - DNA, 25 bp, Mus musculus
catcaagagtggttccagcaccgtt

SEQ ID NO: 327326 - DNA, 25 bp, Mus musculus
catcaagatgctcctgactgtggcc

SEQ ID NO: 327327 - DNA, 25 bp, Mus musculus
catcaagatgctgctgactgtggcc

SEQ ID NO: 327328 - DNA, 25 bp, Mus musculus
catcaagattacactcaggagtccc

SEQ ID NO: 327329 - DNA, 25 bp, Mus musculus
catcaagattactctcaggagtccc

SEQ ID NO: 327330 - DNA, 25 bp, Mus musculus
catcaagcacatccgggacatgcat

SEQ ID NO: 327331 - DNA, 25 bp, Mus musculus
catcaagcacatgcgggacatgcat

SEQ ID NO: 327332 - DNA, 25 bp, Mus musculus
catcaagcagctaagtgtacccctt

SEQ ID NO: 327333 - DNA, 25 bp, Mus musculus
catcaagcagcttagtgtacccctt

SEQ ID NO: 327334 - DNA, 25 bp, Mus musculus
catcaagcatgcacatggtgtacag

SEQ ID NO: 327335 - DNA, 25 bp, Mus musculus
catcaagcatgctcatggtgtacag

SEQ ID NO: 327336 - DNA, 25 bp, Mus musculus
catcaagctggaatgttatcccaac

SEQ ID NO: 327337 - DNA, 25 bp, Mus musculus
catcaagctggattgttatcccaac

SEQ ID NO: 327338 - DNA, 25 bp, Mus musculus
catcaagctgggagtgtgtgccaat

SEQ ID NO: 327339 - DNA, 25 bp, Mus musculus
catcaagctgggtgtgtgtgccaat

SEQ ID NO: 327340 - DNA, 25 bp, Mus musculus
catcaaggaacgcacagtggctcag

SEQ ID NO: 327341 - DNA, 25 bp, Mus musculus
catcaaggaacggacagtggctcag

SEQ ID NO: 327342 - DNA, 25 bp, Mus musculus
catcaaggcatacgaggattctctt

SEQ ID NO: 327343 - DNA, 25 bp, Mus musculus
catcaaggcataggaggattctctt

SEQ ID NO: 327344 - DNA, 25 bp, Mus musculus
catcaaggccatcccagagtccagt

SEQ ID NO: 327345 - DNA, 25 bp, Mus musculus
catcaaggccatgccagagtccagt

SEQ ID NO: 327346 - DNA, 25 bp, Mus musculus
catcaaggggttagacagcgcgaaa

SEQ ID NO: 327347 - DNA, 25 bp, Mus musculus
catcaaggggtttgacagcgcgaaa

SEQ ID NO: 327348 - DNA, 25 bp, Mus musculus
catcaaggtcaacagcgcggagccg

SEQ ID NO: 327349 - DNA, 25 bp, Mus musculus
catcaaggtcaagagcgcggagccg

SEQ ID NO: 327350 - DNA, 25 bp, Mus musculus
catcaagtgagtattcaggaccata

SEQ ID NO: 327351 - DNA, 25 bp, Mus musculus
catcaagtgagttttcaggaccata

SEQ ID NO: 327352 - DNA, 25 bp, Mus musculus
catcaagtgtgaaccggtgaggcgt

SEQ ID NO: 327353 - DNA, 25 bp, Mus musculus
catcaagtgtgatccggtgaggcgt

SEQ ID NO: 327354 - DNA, 25 bp, Mus musculus
catcaagtttttactgacagagcta

SEQ ID NO: 327355 - DNA, 25 bp, Mus musculus
catcaagtttttcgtctgctattaa

SEQ ID NO: 327356 - DNA, 25 bp, Mus musculus
catcaagtttttggtctgctattaa

SEQ ID NO: 327357 - DNA, 25 bp, Mus musculus
catcaagttttttctgacagagcta

SEQ ID NO: 327358 - DNA, 25 bp, Mus musculus
catcaatattttactgtcggttttt

SEQ ID NO: 327359 - DNA, 25 bp, Mus musculus
catcaatatttttctgtcggttttt

SEQ ID NO: 327360 - DNA, 25 bp, Mus musculus
catcaatcattgctctgtctgcctc

SEQ ID NO: 327361 - DNA, 25 bp, Mus musculus
catcaatcattggtctgtctgcctc

SEQ ID NO: 327362 - DNA, 25 bp, Mus musculus
catcaatctgatcctcaagtcccat

SEQ ID NO: 327363 - DNA, 25 bp, Mus musculus
catcaatctgatgctcaagtcccat

SEQ ID NO: 327364 - DNA, 25 bp, Mus musculus
catcaatgtggaccgtgccctgaaa

SEQ ID NO: 327365 - DNA, 25 bp, Mus musculus
catcaatgtggagcgtgccctgaaa

SEQ ID NO: 327366 - DNA, 25 bp, Mus musculus
catcaatgtgttcgtgaggtgtcaa

SEQ ID NO: 327367 - DNA, 25 bp, Mus musculus
catcaatgtgttggtgaggtgtcaa

SEQ ID NO: 327368 - DNA, 25 bp, Mus musculus
catcaattgtttctagctcttcatt

SEQ ID NO: 327369 - DNA, 25 bp, Mus musculus
catcaattgtttgtagctcttcatt

SEQ ID NO: 327370 - DNA, 25 bp, Mus musculus
catcaatttcttaatcttctcctca

SEQ ID NO: 327371 - DNA, 25 bp, Mus musculus
catcaatttctttatcttctcctca

SEQ ID NO: 327372 - DNA, 25 bp, Mus musculus
catcacaacatccatctacagtcat

SEQ ID NO: 327373 - DNA, 25 bp, Mus musculus
catcacaacatcgatctacagtcat

SEQ ID NO: 327374 - DNA, 25 bp, Mus musculus
catcacaactctccacgggaagatt

SEQ ID NO: 327375 - DNA, 25 bp, Mus musculus
catcacaactctgcacgggaagatt

SEQ ID NO: 327376 - DNA, 25 bp, Mus musculus
catcacaattctaatgaggtgttca

SEQ ID NO: 327377 - DNA, 25 bp, Mus musculus
catcacaattcttatgaggtgttca

SEQ ID NO: 327378 - DNA, 25 bp, Mus musculus
catcacaccaataattccttataag

SEQ ID NO: 327379 - DNA, 25 bp, Mus musculus
catcacaccaattattccttataag

SEQ ID NO: 327380 - DNA, 25 bp, Mus musculus
catcacaccctgattcagagaccat

SEQ ID NO: 327381 - DNA, 25 bp, Mus musculus
catcacaccctgtttcagagaccat

SEQ ID NO: 327382 - DNA, 25 bp, Mus musculus
catcacagcaataatgtccccgcta

SEQ ID NO: 327383 - DNA, 25 bp, Mus musculus
catcacagcaattatgtccccgcta

SEQ ID NO: 327384 - DNA, 25 bp, Mus musculus
catcacagcttcaatgacttcatcg

SEQ ID NO: 327385 - DNA, 25 bp, Mus musculus
catcacagcttctatgacttcatcg

SEQ ID NO: 327386 - DNA, 25 bp, Mus musculus
catcacagggttctgtcctttcctt

SEQ ID NO: 327387 - DNA, 25 bp, Mus musculus
catcacagggttgtgtcctttcctt

SEQ ID NO: 327388 - DNA, 25 bp, Mus musculus
catcacaggtgcagacatgaaaagt

SEQ ID NO: 327389 - DNA, 25 bp, Mus musculus
catcacaggtgctgacatgaaaagt

SEQ ID NO: 327390 - DNA, 25 bp, Mus musculus
catcacagtcgtaaggcagggcttt

SEQ ID NO: 327391 - DNA, 25 bp, Mus musculus
catcacagtcgttaggcagggcttt

SEQ ID NO: 327392 - DNA, 25 bp, Mus musculus
catcacagtgtccagcatgtgctgt

SEQ ID NO: 327393 - DNA, 25 bp, Mus musculus
catcacagtgtcgagcatgtgctgt

SEQ ID NO: 327394 - DNA, 25 bp, Mus musculus
catcacagttgtatgcatgggacaa

SEQ ID NO: 327395 - DNA, 25 bp, Mus musculus
catcacagttgtttgcatgggacaa

SEQ ID NO: 327396 - DNA, 25 bp, Mus musculus
catcacagttttatgagcggtgctt

SEQ ID NO: 327397 - DNA, 25 bp, Mus musculus
catcacagttttttgagcggtgctt

SEQ ID NO: 327398 - DNA, 25 bp, Mus musculus
catcacatatggaaccccacttgaa

SEQ ID NO: 327399 - DNA, 25 bp, Mus musculus
catcacatatggtaccccacttgaa

SEQ ID NO: 327400 - DNA, 25 bp, Mus musculus
catcacatattactgtagctctcta

SEQ ID NO: 327401 - DNA, 25 bp, Mus musculus
catcacatattagtgtagctctcta

SEQ ID NO: 327402 - DNA, 25 bp, Mus musculus
catcacatccttcctacacagaagt

SEQ ID NO: 327403 - DNA, 25 bp, Mus musculus
catcacatccttgctacacagaagt

SEQ ID NO: 327404 - DNA, 25 bp, Mus musculus
catcacatctgtaaagcaatcaatt

SEQ ID NO: 327405 - DNA, 25 bp, Mus musculus
catcacatctgttaagcaatcaatt

SEQ ID NO: 327406 - DNA, 25 bp, Mus musculus
catcacatgcatacaggtaccgaag

SEQ ID NO: 327407 - DNA, 25 bp, Mus musculus
catcacatgcattcaggtaccgaag

SEQ ID NO: 327408 - DNA, 25 bp, Mus musculus
catcacatgttgctaaccgtgctaa

SEQ ID NO: 327409 - DNA, 25 bp, Mus musculus
catcacatgttggtaaccgtgctaa

SEQ ID NO: 327410 - DNA, 25 bp, Mus musculus
catcacattggcctagggacattta

SEQ ID NO: 327411 - DNA, 25 bp, Mus musculus
catcacattggcgtagggacattta

SEQ ID NO: 327412 - DNA, 25 bp, Mus musculus
catcacatttctccagtacctttgg

SEQ ID NO: 327413 - DNA, 25 bp, Mus musculus
catcacatttctgcagtacctttgg

SEQ ID NO: 327414 - DNA, 25 bp, Mus musculus
catcacattttaagcatacatgaat

SEQ ID NO: 327415 - DNA, 25 bp, Mus musculus
catcacattttatgcatacatgaat

SEQ ID NO: 327416 - DNA, 25 bp, Mus musculus
catcacattttgacctgttctcaac

SEQ ID NO: 327417 - DNA, 25 bp, Mus musculus
catcacattttgtcctgttctcaac

SEQ ID NO: 327418 - DNA, 25 bp, Mus musculus
catcaccaataaactgttcctttag

SEQ ID NO: 327419 - DNA, 25 bp, Mus musculus
catcaccaataatctgttcctttag

SEQ ID NO: 327420 - DNA, 25 bp, Mus musculus
catcaccacagcacaaggcagggaa

SEQ ID NO: 327421 - DNA, 25 bp, Mus musculus
catcaccacagctcaaggcagggaa

SEQ ID NO: 327422 - DNA, 25 bp, Mus musculus
catcaccagaggattttcccagctc

SEQ ID NO: 327423 - DNA, 25 bp, Mus musculus
catcaccagaggtttttcccagctc

SEQ ID NO: 327424 - DNA, 25 bp, Mus musculus
catcaccagagtccgagtgctcagt

SEQ ID NO: 327425 - DNA, 25 bp, Mus musculus
catcaccagagtgcgagtgctcagt

SEQ ID NO: 327426 - DNA, 25 bp, Mus musculus
catcaccagggcaagcagaaccaga

SEQ ID NO: 327427 - DNA, 25 bp, Mus musculus
catcaccagggctagcagaaccaga

SEQ ID NO: 327428 - DNA, 25 bp, Mus musculus
catcaccagtcgcaggagaatacct

SEQ ID NO: 327429 - DNA, 25 bp, Mus musculus
catcaccagtcggaggagaatacct

SEQ ID NO: 327430 - DNA, 25 bp, Mus musculus
catcaccagtgaccagtgctttgat

SEQ ID NO: 327431 - DNA, 25 bp, Mus musculus
catcaccagtgagcagtgctttgat

SEQ ID NO: 327432 - DNA, 25 bp, Mus musculus
catcaccatattatgtttgtacacc

SEQ ID NO: 327433 - DNA, 25 bp, Mus musculus
catcaccatattttgtttgtacacc

SEQ ID NO: 327434 - DNA, 25 bp, Mus musculus
catcaccatcacagaacagccttaa

SEQ ID NO: 327435 - DNA, 25 bp, Mus musculus
catcaccatcactgaacagccttaa

SEQ ID NO: 327436 - DNA, 25 bp, Mus musculus
catcaccatcttccaggctagtcaa

SEQ ID NO: 327437 - DNA, 25 bp, Mus musculus
catcaccatcttgcaggctagtcaa

SEQ ID NO: 327438 - DNA, 25 bp, Mus musculus
catcaccattgacgctgagccaaga

SEQ ID NO: 327439 - DNA, 25 bp, Mus musculus
catcaccattgaggctgagccaaga

SEQ ID NO: 327440 - DNA, 25 bp, Mus musculus
catcaccccttaatcttttattatc

SEQ ID NO: 327441 - DNA, 25 bp, Mus musculus
catcaccccttattcttttattatc

SEQ ID NO: 327442 - DNA, 25 bp, Mus musculus
catcacccggcaagttttggatttt

SEQ ID NO: 327443 - DNA, 25 bp, Mus musculus
catcacccggcatgttttggatttt

SEQ ID NO: 327444 - DNA, 25 bp, Mus musculus
catcaccctccacttggacagtgaa

SEQ ID NO: 327445 - DNA, 25 bp, Mus musculus
catcaccctccagttggacagtgaa

SEQ ID NO: 327446 - DNA, 25 bp, Mus musculus
catcaccctccgctggtgcatggtg

SEQ ID NO: 327447 - DNA, 25 bp, Mus musculus
catcaccctccggtggtgcatggtg

SEQ ID NO: 327448 - DNA, 25 bp, Mus musculus
catcaccctttacctagcactgtga

SEQ ID NO: 327449 - DNA, 25 bp, Mus musculus
catcaccctttagctagcactgtga

SEQ ID NO: 327450 - DNA, 25 bp, Mus musculus
catcaccggcatatcattgtactcg

SEQ ID NO: 327451 - DNA, 25 bp, Mus musculus
catcaccggcatttcattgtactcg

SEQ ID NO: 327452 - DNA, 25 bp, Mus musculus
catcaccgtataatcccgtacaaat

SEQ ID NO: 327453 - DNA, 25 bp, Mus musculus
catcaccgtatattcccgtacaaat

SEQ ID NO: 327454 - DNA, 25 bp, Mus musculus
catcaccgtatgaaaccactgtttt

SEQ ID NO: 327455 - DNA, 25 bp, Mus musculus
catcaccgtatgtaaccactgtttt

SEQ ID NO: 327456 - DNA, 25 bp, Mus musculus
catcacctaggtaaacttcccaact

SEQ ID NO: 327457 - DNA, 25 bp, Mus musculus
catcacctaggttaacttcccaact

SEQ ID NO: 327458 - DNA, 25 bp, Mus musculus
catcacctctttaggtggagagaag

SEQ ID NO: 327459 - DNA, 25 bp, Mus musculus
catcacctcttttggtggagagaag

SEQ ID NO: 327460 - DNA, 25 bp, Mus musculus
catcacctgtgaatcctttagctca

SEQ ID NO: 327461 - DNA, 25 bp, Mus musculus
catcacctgtgattcctttagctca

SEQ ID NO: 327462 - DNA, 25 bp, Mus musculus
catcacgaagagcactttacagata

SEQ ID NO: 327463 - DNA, 25 bp, Mus musculus
catcacgaagaggactttacagata

SEQ ID NO: 327464 - DNA, 25 bp, Mus musculus
catcacgataggctgtggctgacct

SEQ ID NO: 327465 - DNA, 25 bp, Mus musculus
catcacgatagggtgtggctgacct

SEQ ID NO: 327466 - DNA, 25 bp, Mus musculus
catcacgccacacttcatgttttca

SEQ ID NO: 327467 - DNA, 25 bp, Mus musculus
catcacgccacagttcatgttttca

SEQ ID NO: 327468 - DNA, 25 bp, Mus musculus
catcacgcccatctggtcttccttt

SEQ ID NO: 327469 - DNA, 25 bp, Mus musculus
catcacgcccatgtggtcttccttt

SEQ ID NO: 327470 - DNA, 25 bp, Mus musculus
catcacgctggacggatgaatttca

SEQ ID NO: 327471 - DNA, 25 bp, Mus musculus
catcacgctggagggatgaatttca

SEQ ID NO: 327472 - DNA, 25 bp, Mus musculus
catcacgcttttcgctcattgtttg

SEQ ID NO: 327473 - DNA, 25 bp, Mus musculus
catcacgcttttggctcattgtttg

SEQ ID NO: 327474 - DNA, 25 bp, Mus musculus
catcacggagtcagagctcgggaac

SEQ ID NO: 327475 - DNA, 25 bp, Mus musculus
catcacggagtctgagctcgggaac

SEQ ID NO: 327476 - DNA, 25 bp, Mus musculus
catcacggataactgcaggacccct

SEQ ID NO: 327477 - DNA, 25 bp, Mus musculus
catcacggataagtgcaggacccct

SEQ ID NO: 327478 - DNA, 25 bp, Mus musculus
catcacggttgtcaggcagagctat

SEQ ID NO: 327479 - DNA, 25 bp, Mus musculus
catcacggttgtgaggcagagctat

SEQ ID NO: 327480 - DNA, 25 bp, Mus musculus
catcacgtcatccagatctttacat

SEQ ID NO: 327481 - DNA, 25 bp, Mus musculus
catcacgtcatcgagatctttacat

SEQ ID NO: 327482 - DNA, 25 bp, Mus musculus
catcacgtgccaagttacttctggg

SEQ ID NO: 327483 - DNA, 25 bp, Mus musculus
catcacgtgccatgttacttctggg

SEQ ID NO: 327484 - DNA, 25 bp, Mus musculus
catcacgtgctgcttctgataactt

SEQ ID NO: 327485 - DNA, 25 bp, Mus musculus
catcacgtgctggttctgataactt

SEQ ID NO: 327486 - DNA, 25 bp, Mus musculus
catcactacactaggctgccatttg

SEQ ID NO: 327487 - DNA, 25 bp, Mus musculus
catcactacacttggctgccatttg

SEQ ID NO: 327488 - DNA, 25 bp, Mus musculus
catcactacccaccttccaaatgac

SEQ ID NO: 327489 - DNA, 25 bp, Mus musculus
catcactacccagcttccaaatgac

SEQ ID NO: 327490 - DNA, 25 bp, Mus musculus
catcactaccttctccttaaaggtg

SEQ ID NO: 327491 - DNA, 25 bp, Mus musculus
catcactaccttgtccttaaaggtg

SEQ ID NO: 327492 - DNA, 25 bp, Mus musculus
catcactactgacccttaaatttaa

SEQ ID NO: 327493 - DNA, 25 bp, Mus musculus
catcactactgagccttaaatttaa

SEQ ID NO: 327494 - DNA, 25 bp, Mus musculus
catcactatcctcggtatggtttgt

SEQ ID NO: 327495 - DNA, 25 bp, Mus musculus
catcactatcctgggtatggtttgt

SEQ ID NO: 327496 - DNA, 25 bp, Mus musculus
catcactatcttccatggtaccatt

SEQ ID NO: 327497 - DNA, 25 bp, Mus musculus
catcactatcttgcatggtaccatt

SEQ ID NO: 327498 - DNA, 25 bp, Mus musculus
catcactcaaatcgtctcttcaaga

SEQ ID NO: 327499 - DNA, 25 bp, Mus musculus
catcactcaaatggtctcttcaaga

SEQ ID NO: 327500 - DNA, 25 bp, Mus musculus
catcactcaactccaattgggcttt

SEQ ID NO: 327501 - DNA, 25 bp, Mus musculus
catcactcaactgcaattgggcttt

SEQ ID NO: 327502 - DNA, 25 bp, Mus musculus
catcactcattgacttggtttggaa

SEQ ID NO: 327503 - DNA, 25 bp, Mus musculus
catcactcattgtcttggtttggaa

SEQ ID NO: 327504 - DNA, 25 bp, Mus musculus
catcactccccacttaagaataaac

SEQ ID NO: 327505 - DNA, 25 bp, Mus musculus
catcactccccagttaagaataaac

SEQ ID NO: 327506 - DNA, 25 bp, Mus musculus
catcactccctgaaactagcgaaaa

SEQ ID NO: 327507 - DNA, 25 bp, Mus musculus
catcactccctgtaactagcgaaaa

SEQ ID NO: 327508 - DNA, 25 bp, Mus musculus
catcactctgctagagcctgtggaa

SEQ ID NO: 327509 - DNA, 25 bp, Mus musculus
catcactctgcttgagcctgtggaa

SEQ ID NO: 327510 - DNA, 25 bp, Mus musculus
catcactctgtgagttactttggat

SEQ ID NO: 327511 - DNA, 25 bp, Mus musculus
catcactctgtgtgttactttggat

SEQ ID NO: 327512 - DNA, 25 bp, Mus musculus
catcactgacccactgggagtatgt

SEQ ID NO: 327513 - DNA, 25 bp, Mus musculus
catcactgaccctctgggagtatgt

SEQ ID NO: 327514 - DNA, 25 bp, Mus musculus
catcactgaggaaatgtgtttagac

SEQ ID NO: 327515 - DNA, 25 bp, Mus musculus
catcactgaggatatgtgtttagac

SEQ ID NO: 327516 - DNA, 25 bp, Mus musculus
catcactgcagtcttttataccctg

SEQ ID NO: 327517 - DNA, 25 bp, Mus musculus
catcactgcagtgttttataccctg

SEQ ID NO: 327518 - DNA, 25 bp, Mus musculus
catcactgctaaatgctatttctgt

SEQ ID NO: 327519 - DNA, 25 bp, Mus musculus
catcactgctaattgctatttctgt

SEQ ID NO: 327520 - DNA, 25 bp, Mus musculus
catcactgtgtgatccgaaggatcc

SEQ ID NO: 327521 - DNA, 25 bp, Mus musculus
catcactgtgtgttccgaaggatcc

SEQ ID NO: 327522 - DNA, 25 bp, Mus musculus
catcacttcccaaaggttgttcagt

SEQ ID NO: 327523 - DNA, 25 bp, Mus musculus
catcacttcccataggttgttcagt

SEQ ID NO: 327524 - DNA, 25 bp, Mus musculus
catcacttcgatacttggcttggga

SEQ ID NO: 327525 - DNA, 25 bp, Mus musculus
catcacttcgattcttggcttggga

SEQ ID NO: 327526 - DNA, 25 bp, Mus musculus
catcacttctttcttccacatttct

SEQ ID NO: 327527 - DNA, 25 bp, Mus musculus
catcacttctttgttccacatttct

SEQ ID NO: 327528 - DNA, 25 bp, Mus musculus
catcacttgaccagctataacacag

SEQ ID NO: 327529 - DNA, 25 bp, Mus musculus
catcacttgacctgctataacacag

SEQ ID NO: 327530 - DNA, 25 bp, Mus musculus
catcacttgtccaaacttctgttaa

SEQ ID NO: 327531 - DNA, 25 bp, Mus musculus
catcacttgtcctaacttctgttaa

SEQ ID NO: 327532 - DNA, 25 bp, Mus musculus
catcactttagtctgggctggctgc

SEQ ID NO: 327533 - DNA, 25 bp, Mus musculus
catcactttagtgtgggctggctgc

SEQ ID NO: 327534 - DNA, 25 bp, Mus musculus
catcactttcttcatctcttaggta

SEQ ID NO: 327535 - DNA, 25 bp, Mus musculus
catcactttcttgatctcttaggta

SEQ ID NO: 327536 - DNA, 25 bp, Mus musculus
catcactttgatcaccttcagaaaa

SEQ ID NO: 327537 - DNA, 25 bp, Mus musculus
catcactttgatgaccttcagaaaa

SEQ ID NO: 327538 - DNA, 25 bp, Mus musculus
catcactttgtgagcctctcagtta

SEQ ID NO: 327539 - DNA, 25 bp, Mus musculus
catcactttgtgtgcctctcagtta

SEQ ID NO: 327540 - DNA, 25 bp, Mus musculus
catcacttttgaagcatggttttct

SEQ ID NO: 327541 - DNA, 25 bp, Mus musculus
catcacttttgatgcatggttttct

SEQ ID NO: 327542 - DNA, 25 bp, Mus musculus
catcagaaccataagagtaccactt

SEQ ID NO: 327543 - DNA, 25 bp, Mus musculus
catcagaaccattagagtaccactt

SEQ ID NO: 327544 - DNA, 25 bp, Mus musculus
catcagaagagccaagtgtgaatct

SEQ ID NO: 327545 - DNA, 25 bp, Mus musculus
catcagaagagcgaagtgtgaatct

SEQ ID NO: 327546 - DNA, 25 bp, Mus musculus
catcagaatctgacggccaaaagcg

SEQ ID NO: 327547 - DNA, 25 bp, Mus musculus
catcagaatctgatagtgactagtt

SEQ ID NO: 327548 - DNA, 25 bp, Mus musculus
catcagaatctgtcggccaaaagcg

SEQ ID NO: 327549 - DNA, 25 bp, Mus musculus
catcagaatctgttagtgactagtt

SEQ ID NO: 327550 - DNA, 25 bp, Mus musculus
catcagaccactacaatcctaatct

SEQ ID NO: 327551 - DNA, 25 bp, Mus musculus
catcagaccacttcaatcctaatct

SEQ ID NO: 327552 - DNA, 25 bp, Mus musculus
catcagactttcatacaactgccac

SEQ ID NO: 327553 - DNA, 25 bp, Mus musculus
catcagactttcttacaactgccac

SEQ ID NO: 327554 - DNA, 25 bp, Mus musculus
catcagagaagaagggccatgagat

SEQ ID NO: 327555 - DNA, 25 bp, Mus musculus
catcagagaagatgggccatgagat

SEQ ID NO: 327556 - DNA, 25 bp, Mus musculus
catcagagagatcgaagagaagtat

SEQ ID NO: 327557 - DNA, 25 bp, Mus musculus
catcagagagatggaagagaagtat

SEQ ID NO: 327558 - DNA, 25 bp, Mus musculus
catcagaggcagagtggaagcagac

SEQ ID NO: 327559 - DNA, 25 bp, Mus musculus
catcagaggcagtgtggaagcagac

SEQ ID NO: 327560 - DNA, 25 bp, Mus musculus
catcagagggcgctgcaggataaca

SEQ ID NO: 327561 - DNA, 25 bp, Mus musculus
catcagagggcggtgcaggataaca

SEQ ID NO: 327562 - DNA, 25 bp, Mus musculus
catcagagtagacgcagtacagggc

SEQ ID NO: 327563 - DNA, 25 bp, Mus musculus
catcagagtagaggcagtacagggc

SEQ ID NO: 327564 - DNA, 25 bp, Mus musculus
catcagagttcacggttctgtccat

SEQ ID NO: 327565 - DNA, 25 bp, Mus musculus
catcagagttcagggttctgtccat

SEQ ID NO: 327566 - DNA, 25 bp, Mus musculus
catcagatgactctcttgccatgag

SEQ ID NO: 327567 - DNA, 25 bp, Mus musculus
catcagatgactgtcttgccatgag

SEQ ID NO: 327568 - DNA, 25 bp, Mus musculus
catcagatgttaactcatggccttc

SEQ ID NO: 327569 - DNA, 25 bp, Mus musculus
catcagatgttatctcatggccttc

SEQ ID NO: 327570 - DNA, 25 bp, Mus musculus
catcagattttaatactgtcggaat

SEQ ID NO: 327571 - DNA, 25 bp, Mus musculus
catcagattttattactgtcggaat

SEQ ID NO: 327572 - DNA, 25 bp, Mus musculus
catcagcaacaacagaatagtgggc

SEQ ID NO: 327573 - DNA, 25 bp, Mus musculus
catcagcaacaagagaatagtgggc

SEQ ID NO: 327574 - DNA, 25 bp, Mus musculus
catcagcaagcacgtcattgtttca

SEQ ID NO: 327575 - DNA, 25 bp, Mus musculus
catcagcaagcaggtcattgtttca

SEQ ID NO: 327576 - DNA, 25 bp, Mus musculus
catcagcatggcagactatgtgtct

SEQ ID NO: 327577 - DNA, 25 bp, Mus musculus
catcagcatggccagcctaggctat

SEQ ID NO: 327578 - DNA, 25 bp, Mus musculus
catcagcatggcgagcctaggctat

SEQ ID NO: 327579 - DNA, 25 bp, Mus musculus
catcagcatggctgactatgtgtct

SEQ ID NO: 327580 - DNA, 25 bp, Mus musculus
catcagcatgtcagttccctgtttt

SEQ ID NO: 327581 - DNA, 25 bp, Mus musculus
catcagcatgtctgttccctgtttt

SEQ ID NO: 327582 - DNA, 25 bp, Mus musculus
catcagcatttcctgcagtgcagta

SEQ ID NO: 327583 - DNA, 25 bp, Mus musculus
catcagcatttcgtgcagtgcagta

SEQ ID NO: 327584 - DNA, 25 bp, Mus musculus
catcagccaaacccgaataaacctt

SEQ ID NO: 327585 - DNA, 25 bp, Mus musculus
catcagccaaacgcgaataaacctt

SEQ ID NO: 327586 - DNA, 25 bp, Mus musculus
catcagccaatcctaactttgtgtc

SEQ ID NO: 327587 - DNA, 25 bp, Mus musculus
catcagccaatcgtaactttgtgtc

SEQ ID NO: 327588 - DNA, 25 bp, Mus musculus
catcagccaggtcagcatttgcatg

SEQ ID NO: 327589 - DNA, 25 bp, Mus musculus
catcagccaggtgagcatttgcatg

SEQ ID NO: 327590 - DNA, 25 bp, Mus musculus
catcagccctagcaaaatatgtttt

SEQ ID NO: 327591 - DNA, 25 bp, Mus musculus
catcagccctaggaaaatatgtttt

SEQ ID NO: 327592 - DNA, 25 bp, Mus musculus
catcagccctctagattatggagat

SEQ ID NO: 327593 - DNA, 25 bp, Mus musculus
catcagccctcttgattatggagat

SEQ ID NO: 327594 - DNA, 25 bp, Mus musculus
catcagcctggcatcatcattagag

SEQ ID NO: 327595 - DNA, 25 bp, Mus musculus
catcagcctggcttcatcattagag

SEQ ID NO: 327596 - DNA, 25 bp, Mus musculus
catcagcctggtcagggagatgttc

SEQ ID NO: 327597 - DNA, 25 bp, Mus musculus
catcagcctggtgagggagatgttc

SEQ ID NO: 327598 - DNA, 25 bp, Mus musculus
catcagccttgcagcggcttgaagg

SEQ ID NO: 327599 - DNA, 25 bp, Mus musculus
catcagccttgctgcggcttgaagg

SEQ ID NO: 327600 - DNA, 25 bp, Mus musculus
catcagccttttcttattggtagtg

SEQ ID NO: 327601 - DNA, 25 bp, Mus musculus
catcagccttttgttattggtagtg

SEQ ID NO: 327602 - DNA, 25 bp, Mus musculus
catcagcgacttagtgggcgaggac

SEQ ID NO: 327603 - DNA, 25 bp, Mus musculus
catcagcgactttgtgggcgaggac

SEQ ID NO: 327604 - DNA, 25 bp, Mus musculus
catcagcgccagattttggagtaga

SEQ ID NO: 327605 - DNA, 25 bp, Mus musculus
catcagcgccagtttttggagtaga

SEQ ID NO: 327606 - DNA, 25 bp, Mus musculus
catcagcgcgcaagagggcagaccg

SEQ ID NO: 327607 - DNA, 25 bp, Mus musculus
catcagcgcgcatgagggcagaccg

SEQ ID NO: 327608 - DNA, 25 bp, Mus musculus
catcagcgcttgctcctttagggag

SEQ ID NO: 327609 - DNA, 25 bp, Mus musculus
catcagcgcttggtcctttagggag

SEQ ID NO: 327610 - DNA, 25 bp, Mus musculus
catcagcggcagattgacttagaag

SEQ ID NO: 327611 - DNA, 25 bp, Mus musculus
catcagcggcagtttgacttagaag

SEQ ID NO: 327612 - DNA, 25 bp, Mus musculus
catcagcgtcagaattcttgtgggc

SEQ ID NO: 327613 - DNA, 25 bp, Mus musculus
catcagcgtcagtattcttgtgggc

SEQ ID NO: 327614 - DNA, 25 bp, Mus musculus
catcagcgtgcgcacacaggcgagc

SEQ ID NO: 327615 - DNA, 25 bp, Mus musculus
catcagcgtgcggacacaggcgagc

SEQ ID NO: 327616 - DNA, 25 bp, Mus musculus
catcagcgttatcccaaagtcctgg

SEQ ID NO: 327617 - DNA, 25 bp, Mus musculus
catcagcgttatgccaaagtcctgg

SEQ ID NO: 327618 - DNA, 25 bp, Mus musculus
catcagcgtttgctaagttgtcagt

SEQ ID NO: 327619 - DNA, 25 bp, Mus musculus
catcagcgtttggtaagttgtcagt

SEQ ID NO: 327620 - DNA, 25 bp, Mus musculus
catcagctcagcaacctaacaggta

SEQ ID NO: 327621 - DNA, 25 bp, Mus musculus
catcagctcagctacctaacaggta

SEQ ID NO: 327622 - DNA, 25 bp, Mus musculus
catcagctcagtcaacttgtgccat

SEQ ID NO: 327623 - DNA, 25 bp, Mus musculus
catcagctcagtgaacttgtgccat

SEQ ID NO: 327624 - DNA, 25 bp, Mus musculus
catcagctctgtaatgttctcctag

SEQ ID NO: 327625 - DNA, 25 bp, Mus musculus
catcagctctgtatggaactacaaa

SEQ ID NO: 327626 - DNA, 25 bp, Mus musculus
catcagctctgttatgttctcctag

SEQ ID NO: 327627 - DNA, 25 bp, Mus musculus
catcagctctgtttggaactacaaa

SEQ ID NO: 327628 - DNA, 25 bp, Mus musculus
catcagctggagatcatcctcaggc

SEQ ID NO: 327629 - DNA, 25 bp, Mus musculus
catcagctggagttcatcctcaggc

SEQ ID NO: 327630 - DNA, 25 bp, Mus musculus
catcagctggatcattgcacagtct

SEQ ID NO: 327631 - DNA, 25 bp, Mus musculus
catcagctggatgattgcacagtct

SEQ ID NO: 327632 - DNA, 25 bp, Mus musculus
catcagctggcgacacatgtggaaa

SEQ ID NO: 327633 - DNA, 25 bp, Mus musculus
catcagctggcgtcacatgtggaaa

SEQ ID NO: 327634 - DNA, 25 bp, Mus musculus
catcagctggctcgataagaaccag

SEQ ID NO: 327635 - DNA, 25 bp, Mus musculus
catcagctggctggataagaaccag

SEQ ID NO: 327636 - DNA, 25 bp, Mus musculus
catcagctgggtaggcaggactttg

SEQ ID NO: 327637 - DNA, 25 bp, Mus musculus
catcagctgggttggcaggactttg

SEQ ID NO: 327638 - DNA, 25 bp, Mus musculus
catcagctggtcctatgtatggcgg

SEQ ID NO: 327639 - DNA, 25 bp, Mus musculus
catcagctggtcgtatgtatggcgg

SEQ ID NO: 327640 - DNA, 25 bp, Mus musculus
catcagcttccaacccttaaaaaag

SEQ ID NO: 327641 - DNA, 25 bp, Mus musculus
catcagcttccatcccttaaaaaag

SEQ ID NO: 327642 - DNA, 25 bp, Mus musculus
catcagcttctaatctttctcattt

SEQ ID NO: 327643 - DNA, 25 bp, Mus musculus
catcagcttctattctttctcattt

SEQ ID NO: 327644 - DNA, 25 bp, Mus musculus
catcagcttgctacttggacttatt

SEQ ID NO: 327645 - DNA, 25 bp, Mus musculus
catcagcttgcttcttggacttatt

SEQ ID NO: 327646 - DNA, 25 bp, Mus musculus
catcagcttggtcgcgggcagttct

SEQ ID NO: 327647 - DNA, 25 bp, Mus musculus
catcagcttggtggcgggcagttct

SEQ ID NO: 327648 - DNA, 25 bp, Mus musculus
catcaggatctcagggcaggtgtcc

SEQ ID NO: 327649 - DNA, 25 bp, Mus musculus
catcaggatctctgggcaggtgtcc

SEQ ID NO: 327650 - DNA, 25 bp, Mus musculus
catcaggatgtccaatgccctttgt

SEQ ID NO: 327651 - DNA, 25 bp, Mus musculus
catcaggatgtcgaatgccctttgt

SEQ ID NO: 327652 - DNA, 25 bp, Mus musculus
catcaggcactcctgtcacttagta

SEQ ID NO: 327653 - DNA, 25 bp, Mus musculus
catcaggcactcgtgtcacttagta

SEQ ID NO: 327654 - DNA, 25 bp, Mus musculus
catcaggccccgagtctgggattga

SEQ ID NO: 327655 - DNA, 25 bp, Mus musculus
catcaggccccgtgtctgggattga

SEQ ID NO: 327656 - DNA, 25 bp, Mus musculus
catcaggcctcgctctgctcatgat

SEQ ID NO: 327657 - DNA, 25 bp, Mus musculus
catcaggcctcggtctgctcatgat

SEQ ID NO: 327658 - DNA, 25 bp, Mus musculus
catcaggctggaagattctgtaaat

SEQ ID NO: 327659 - DNA, 25 bp, Mus musculus
catcaggctggatgattctgtaaat

SEQ ID NO: 327660 - DNA, 25 bp, Mus musculus
catcagggatttctataacccgttg

SEQ ID NO: 327661 - DNA, 25 bp, Mus musculus
catcagggatttgtataacccgttg

SEQ ID NO: 327662 - DNA, 25 bp, Mus musculus
catcagggccccattacccaatgag

SEQ ID NO: 327663 - DNA, 25 bp, Mus musculus
catcagggcccctttacccaatgag

SEQ ID NO: 327664 - DNA, 25 bp, Mus musculus
catcagggcgagatctcaggtgtct

SEQ ID NO: 327665 - DNA, 25 bp, Mus musculus
catcagggcgagttctcaggtgtct

SEQ ID NO: 327666 - DNA, 25 bp, Mus musculus
catcaggtattactccatccttttg

SEQ ID NO: 327667 - DNA, 25 bp, Mus musculus
catcaggtattagtccatccttttg

SEQ ID NO: 327668 - DNA, 25 bp, Mus musculus
catcaggtctccacacgagagaggt

SEQ ID NO: 327669 - DNA, 25 bp, Mus musculus
catcaggtctcctcacgagagaggt

SEQ ID NO: 327670 - DNA, 25 bp, Mus musculus
catcaggtgacacggatttgtttca

SEQ ID NO: 327671 - DNA, 25 bp, Mus musculus
catcaggtgacagggatttgtttca

SEQ ID NO: 327672 - DNA, 25 bp, Mus musculus
catcaggtggcactacttcttagga

SEQ ID NO: 327673 - DNA, 25 bp, Mus musculus
catcaggtggcagtacttcttagga

SEQ ID NO: 327674 - DNA, 25 bp, Mus musculus
catcaggttgcccattctatggaat

SEQ ID NO: 327675 - DNA, 25 bp, Mus musculus
catcaggttgccgattctatggaat

SEQ ID NO: 327676 - DNA, 25 bp, Mus musculus
catcaggttggcctgtggacatgtc

SEQ ID NO: 327677 - DNA, 25 bp, Mus musculus
catcaggttggcgtgtggacatgtc

SEQ ID NO: 327678 - DNA, 25 bp, Mus musculus
catcagtacaacagcaatccctggg

SEQ ID NO: 327679 - DNA, 25 bp, Mus musculus
catcagtacaactgcaatccctggg

SEQ ID NO: 327680 - DNA, 25 bp, Mus musculus
catcagtagtgaaattgaagcgcta

SEQ ID NO: 327681 - DNA, 25 bp, Mus musculus
catcagtagtgatattgaagcgcta

SEQ ID NO: 327682 - DNA, 25 bp, Mus musculus
catcagtatcaccagcagctggctt

SEQ ID NO: 327683 - DNA, 25 bp, Mus musculus
catcagtatcacgagcagctggctt

SEQ ID NO: 327684 - DNA, 25 bp, Mus musculus
catcagtatgcccaggacctttatt

SEQ ID NO: 327685 - DNA, 25 bp, Mus musculus
catcagtatgccgaggacctttatt

SEQ ID NO: 327686 - DNA, 25 bp, Mus musculus
catcagtcaggaccgctacaggttg

SEQ ID NO: 327687 - DNA, 25 bp, Mus musculus
catcagtcaggagcgctacaggttg

SEQ ID NO: 327688 - DNA, 25 bp, Mus musculus
catcagtcagtgatcttctgcttgt

SEQ ID NO: 327689 - DNA, 25 bp, Mus musculus
catcagtcagtgttcttctgcttgt

SEQ ID NO: 327690 - DNA, 25 bp, Mus musculus
catcagtcctcacgtattggctgga

SEQ ID NO: 327691 - DNA, 25 bp, Mus musculus
catcagtcctcaggtattggctgga

SEQ ID NO: 327692 - DNA, 25 bp, Mus musculus
catcagtcgcaaagattcagctcgc

SEQ ID NO: 327693 - DNA, 25 bp, Mus musculus
catcagtcgcaatgattcagctcgc

SEQ ID NO: 327694 - DNA, 25 bp, Mus musculus
catcagtctcttcctggaatttgag

SEQ ID NO: 327695 - DNA, 25 bp, Mus musculus
catcagtctcttgctggaatttgag

SEQ ID NO: 327696 - DNA, 25 bp, Mus musculus
catcagtctgtgataggagattcct

SEQ ID NO: 327697 - DNA, 25 bp, Mus musculus
catcagtctgtgttaggagattcct

SEQ ID NO: 327698 - DNA, 25 bp, Mus musculus
catcagtcttccctggaaatggagg

SEQ ID NO: 327699 - DNA, 25 bp, Mus musculus
catcagtcttccgtggaaatggagg

SEQ ID NO: 327700 - DNA, 25 bp, Mus musculus
catcagtgatccagacctgggcttc

SEQ ID NO: 327701 - DNA, 25 bp, Mus musculus
catcagtgatcctgacctgggcttc

SEQ ID NO: 327702 - DNA, 25 bp, Mus musculus
catcagtggtttcttagtgttctac

SEQ ID NO: 327703 - DNA, 25 bp, Mus musculus
catcagtggtttgttagtgttctac

SEQ ID NO: 327704 - DNA, 25 bp, Mus musculus
catcagtgtcataaccaaagctggc

SEQ ID NO: 327705 - DNA, 25 bp, Mus musculus
catcagtgtcattaccaaagctggc

SEQ ID NO: 327706 - DNA, 25 bp, Mus musculus
catcagtgtgcgctcattttatatt

SEQ ID NO: 327707 - DNA, 25 bp, Mus musculus
catcagtgtgcggtcattttatatt

SEQ ID NO: 327708 - DNA, 25 bp, Mus musculus
catcagtgtgtaagagacgtcctca

SEQ ID NO: 327709 - DNA, 25 bp, Mus musculus
catcagtgtgtatgagacgtcctca

SEQ ID NO: 327710 - DNA, 25 bp, Mus musculus
catcagtgttaaccatatccctgtc

SEQ ID NO: 327711 - DNA, 25 bp, Mus musculus
catcagtgttaagcatatccctgtc

SEQ ID NO: 327712 - DNA, 25 bp, Mus musculus
catcagttcatgagtcctttgaaac

SEQ ID NO: 327713 - DNA, 25 bp, Mus musculus
catcagttcatgtgtcctttgaaac

SEQ ID NO: 327714 - DNA, 25 bp, Mus musculus
catcagttctgtatggccatattat

SEQ ID NO: 327715 - DNA, 25 bp, Mus musculus
catcagttctgtttggccatattat

SEQ ID NO: 327716 - DNA, 25 bp, Mus musculus
catcagttggaaatagtaccttaag

SEQ ID NO: 327717 - DNA, 25 bp, Mus musculus
catcagttggaattagtaccttaag

SEQ ID NO: 327718 - DNA, 25 bp, Mus musculus
catcagtttcaaccctattgacaac

SEQ ID NO: 327719 - DNA, 25 bp, Mus musculus
catcagtttcaagcctattgacaac

SEQ ID NO: 327720 - DNA, 25 bp, Mus musculus
catcagtttccgcaacttatgggag

SEQ ID NO: 327721 - DNA, 25 bp, Mus musculus
catcagtttccggaacttatgggag

SEQ ID NO: 327722 - DNA, 25 bp, Mus musculus
catcagtttgagacagttgtgagct

SEQ ID NO: 327723 - DNA, 25 bp, Mus musculus
catcagtttgagtcagttgtgagct

SEQ ID NO: 327724 - DNA, 25 bp, Mus musculus
catcagtttgcccattggtggcgct

SEQ ID NO: 327725 - DNA, 25 bp, Mus musculus
catcagtttgccgattggtggcgct

SEQ ID NO: 327726 - DNA, 25 bp, Mus musculus
catcagtttggacaggtagcacttt

SEQ ID NO: 327727 - DNA, 25 bp, Mus musculus
catcagtttggagaggtagcacttt

SEQ ID NO: 327728 - DNA, 25 bp, Mus musculus
catcagttttccatgggttttcact

SEQ ID NO: 327729 - DNA, 25 bp, Mus musculus
catcagttttccttgggttttcact

SEQ ID NO: 327730 - DNA, 25 bp, Mus musculus
catcataactatccctttcttctag

SEQ ID NO: 327731 - DNA, 25 bp, Mus musculus
catcataactatgcctttcttctag

SEQ ID NO: 327732 - DNA, 25 bp, Mus musculus
catcataattccaccccgagaaaga

SEQ ID NO: 327733 - DNA, 25 bp, Mus musculus
catcataattcctccccgagaaaga

SEQ ID NO: 327734 - DNA, 25 bp, Mus musculus
catcatacctatccattttccaatg

SEQ ID NO: 327735 - DNA, 25 bp, Mus musculus
catcatacctatgcattttccaatg

SEQ ID NO: 327736 - DNA, 25 bp, Mus musculus
catcatactgaccattgtggctatg

SEQ ID NO: 327737 - DNA, 25 bp, Mus musculus
catcatactgacgattgtggctatg

SEQ ID NO: 327738 - DNA, 25 bp, Mus musculus
catcataggagcatggtgacaggca

SEQ ID NO: 327739 - DNA, 25 bp, Mus musculus
catcataggagcttggtgacaggca

SEQ ID NO: 327740 - DNA, 25 bp, Mus musculus
catcatagtaagcagtgtggctgca

SEQ ID NO: 327741 - DNA, 25 bp, Mus musculus
catcatagtaaggagtgtggctgca

SEQ ID NO: 327742 - DNA, 25 bp, Mus musculus
catcatatatccaaggttgtccttg

SEQ ID NO: 327743 - DNA, 25 bp, Mus musculus
catcatatatcctaggttgtccttg

SEQ ID NO: 327744 - DNA, 25 bp, Mus musculus
catcatatatgtctcctcaaagtca

SEQ ID NO: 327745 - DNA, 25 bp, Mus musculus
catcatatatgtgtcctcaaagtca

SEQ ID NO: 327746 - DNA, 25 bp, Mus musculus
catcatatcctgacactaccagttt

SEQ ID NO: 327747 - DNA, 25 bp, Mus musculus
catcatatcctgtcactaccagttt

SEQ ID NO: 327748 - DNA, 25 bp, Mus musculus
catcatatgtgaatgtcgcctcctt

SEQ ID NO: 327749 - DNA, 25 bp, Mus musculus
catcatatgtgattgtcgcctcctt

SEQ ID NO: 327750 - DNA, 25 bp, Mus musculus
catcatattttgaagctgacagcgg

SEQ ID NO: 327751 - DNA, 25 bp, Mus musculus
catcatattttgtagctgacagcgg

SEQ ID NO: 327752 - DNA, 25 bp, Mus musculus
catcatcaagaacgcgcacaagaag

SEQ ID NO: 327753 - DNA, 25 bp, Mus musculus
catcatcaagaaggcgcacaagaag

SEQ ID NO: 327754 - DNA, 25 bp, Mus musculus
catcatcacaggcatttccatggca

SEQ ID NO: 327755 - DNA, 25 bp, Mus musculus
catcatcacagggatttccatggca

SEQ ID NO: 327756 - DNA, 25 bp, Mus musculus
catcatcactcaagcagccacagtc

SEQ ID NO: 327757 - DNA, 25 bp, Mus musculus
catcatcactcatgcagccacagtc

SEQ ID NO: 327758 - DNA, 25 bp, Mus musculus
catcatcagcgccagattttggagt

SEQ ID NO: 327759 - DNA, 25 bp, Mus musculus
catcatcagcgcgagattttggagt

SEQ ID NO: 327760 - DNA, 25 bp, Mus musculus
catcatcatcatcggaccttatttc

SEQ ID NO: 327761 - DNA, 25 bp, Mus musculus
catcatcatcatgggaccttatttc

SEQ ID NO: 327762 - DNA, 25 bp, Mus musculus
catcatcatggcaattgtcatcagc

SEQ ID NO: 327763 - DNA, 25 bp, Mus musculus
catcatcatggctattgtcatcagc

SEQ ID NO: 327764 - DNA, 25 bp, Mus musculus
catcatcattatatgtggagttggc

SEQ ID NO: 327765 - DNA, 25 bp, Mus musculus
catcatcattatttgtggagttggc

SEQ ID NO: 327766 - DNA, 25 bp, Mus musculus
catcatcccgtccatgggtctagaa

SEQ ID NO: 327767 - DNA, 25 bp, Mus musculus
catcatcccgtcgatgggtctagaa

SEQ ID NO: 327768 - DNA, 25 bp, Mus musculus
catcatcgtttacttcagcacttaa

SEQ ID NO: 327769 - DNA, 25 bp, Mus musculus
catcatcgtttagttcagcacttaa

SEQ ID NO: 327770 - DNA, 25 bp, Mus musculus
catcatctatgaacttttccatccc

SEQ ID NO: 327771 - DNA, 25 bp, Mus musculus
catcatctatgatcttttccatccc

SEQ ID NO: 327772 - DNA, 25 bp, Mus musculus
catcatctcatcagaaggtgacgaa

SEQ ID NO: 327773 - DNA, 25 bp, Mus musculus
catcatctcatctgaaggtgacgaa

SEQ ID NO: 327774 - DNA, 25 bp, Mus musculus
catcatctctgtatttaccctggga

SEQ ID NO: 327775 - DNA, 25 bp, Mus musculus
catcatctctgtttttaccctggga

SEQ ID NO: 327776 - DNA, 25 bp, Mus musculus
catcatctgaatatagtgtttgaaa

SEQ ID NO: 327777 - DNA, 25 bp, Mus musculus
catcatctgaatttagtgtttgaaa

SEQ ID NO: 327778 - DNA, 25 bp, Mus musculus
catcatctgaccagtgtgcaaagct

SEQ ID NO: 327779 - DNA, 25 bp, Mus musculus
catcatctgacctgtgtgcaaagct

SEQ ID NO: 327780 - DNA, 25 bp, Mus musculus
catcatctgcacattcaatgggtga

SEQ ID NO: 327781 - DNA, 25 bp, Mus musculus
catcatctgcactttcaatgggtga

SEQ ID NO: 327782 - DNA, 25 bp, Mus musculus
catcatctggatcgtgagcacttgt

SEQ ID NO: 327783 - DNA, 25 bp, Mus musculus
catcatctggatggtgagcacttgt

SEQ ID NO: 327784 - DNA, 25 bp, Mus musculus
catcatctgtgtcatggccttagag

SEQ ID NO: 327785 - DNA, 25 bp, Mus musculus
catcatctgtgtgatggccttagag

SEQ ID NO: 327786 - DNA, 25 bp, Mus musculus
catcatcttcatattatggttcatt

SEQ ID NO: 327787 - DNA, 25 bp, Mus musculus
catcatcttcattttatggttcatt

SEQ ID NO: 327788 - DNA, 25 bp, Mus musculus
catcatcttgggactactggacata

SEQ ID NO: 327789 - DNA, 25 bp, Mus musculus
catcatcttgggtctactggacata

SEQ ID NO: 327790 - DNA, 25 bp, Mus musculus
catcatcttggtcttcatggtgttc

SEQ ID NO: 327791 - DNA, 25 bp, Mus musculus
catcatcttggtgttcatggtgttc

SEQ ID NO: 327792 - DNA, 25 bp, Mus musculus
catcatcttgtaccttgccttttaa

SEQ ID NO: 327793 - DNA, 25 bp, Mus musculus
catcatcttgtagcttgccttttaa

SEQ ID NO: 327794 - DNA, 25 bp, Mus musculus
catcatctttatctggctatgggaa

SEQ ID NO: 327795 - DNA, 25 bp, Mus musculus
catcatctttatgtggctatgggaa

SEQ ID NO: 327796 - DNA, 25 bp, Mus musculus
catcatctttgaaatcttgaacatt

SEQ ID NO: 327797 - DNA, 25 bp, Mus musculus
catcatctttgatatcttgaacatt

SEQ ID NO: 327798 - DNA, 25 bp, Mus musculus
catcatgaaaggcttactgcttata

SEQ ID NO: 327799 - DNA, 25 bp, Mus musculus
catcatgaaagggttactgcttata

SEQ ID NO: 327800 - DNA, 25 bp, Mus musculus
catcatgaagtgcaggagccgctat

SEQ ID NO: 327801 - DNA, 25 bp, Mus musculus
catcatgaagtggaggagccgctat

SEQ ID NO: 327802 - DNA, 25 bp, Mus musculus
catcatgaatgcactgcttgtggca

SEQ ID NO: 327803 - DNA, 25 bp, Mus musculus
catcatgaatgctctgcttgtggca

SEQ ID NO: 327804 - DNA, 25 bp, Mus musculus
catcatgaccatccccaaactgaaa

SEQ ID NO: 327805 - DNA, 25 bp, Mus musculus
catcatgaccatgcccaaactgaaa

SEQ ID NO: 327806 - DNA, 25 bp, Mus musculus
catcatgagcgaagtgactgtatct

SEQ ID NO: 327807 - DNA, 25 bp, Mus musculus
catcatgagcgatgtgactgtatct

SEQ ID NO: 327808 - DNA, 25 bp, Mus musculus
catcatgatcatctctcggtttgct

SEQ ID NO: 327809 - DNA, 25 bp, Mus musculus
catcatgatcatgtctcggtttgct

SEQ ID NO: 327810 - DNA, 25 bp, Mus musculus
catcatgatggtatgggttcgtttt

SEQ ID NO: 327811 - DNA, 25 bp, Mus musculus
catcatgatggtttgggttcgtttt

SEQ ID NO: 327812 - DNA, 25 bp, Mus musculus
catcatgattgccatcgttgctggg

SEQ ID NO: 327813 - DNA, 25 bp, Mus musculus
catcatgattgcgatcgttgctggg

SEQ ID NO: 327814 - DNA, 25 bp, Mus musculus
catcatgattgtcaggagggccatc

SEQ ID NO: 327815 - DNA, 25 bp, Mus musculus
catcatgattgtgaggagggccatc

SEQ ID NO: 327816 - DNA, 25 bp, Mus musculus
catcatgatttcagtctcggttcat

SEQ ID NO: 327817 - DNA, 25 bp, Mus musculus
catcatgatttctgtctcggttcat

SEQ ID NO: 327818 - DNA, 25 bp, Mus musculus
catcatgctgccagtgtggttcacc

SEQ ID NO: 327819 - DNA, 25 bp, Mus musculus
catcatgctgcctgtgtggttcacc

SEQ ID NO: 327820 - DNA, 25 bp, Mus musculus
catcatgctgtactgttggcatttt

SEQ ID NO: 327821 - DNA, 25 bp, Mus musculus
catcatgctgtagtgttggcatttt

SEQ ID NO: 327822 - DNA, 25 bp, Mus musculus
catcatgcttggagccatgtataca

SEQ ID NO: 327823 - DNA, 25 bp, Mus musculus
catcatgcttggtgccatgtataca

SEQ ID NO: 327824 - DNA, 25 bp, Mus musculus
catcatggaaccatttacagcaaat

SEQ ID NO: 327825 - DNA, 25 bp, Mus musculus
catcatggaaccttttacagcaaat

SEQ ID NO: 327826 - DNA, 25 bp, Mus musculus
catcatggcagaattggtgtttaac

SEQ ID NO: 327827 - DNA, 25 bp, Mus musculus
catcatggcagatttggtgtttaac

SEQ ID NO: 327828 - DNA, 25 bp, Mus musculus
catcatggcaggaggcatacaggca

SEQ ID NO: 327829 - DNA, 25 bp, Mus musculus
catcatggcaggtggcatacaggca

SEQ ID NO: 327830 - DNA, 25 bp, Mus musculus
catcatggcctgagtcggagcagat

SEQ ID NO: 327831 - DNA, 25 bp, Mus musculus
catcatggcctgtgtcggagcagat

SEQ ID NO: 327832 - DNA, 25 bp, Mus musculus
catcatgggctgcacactggacttc

SEQ ID NO: 327833 - DNA, 25 bp, Mus musculus
catcatgggctggacactggacttc

SEQ ID NO: 327834 - DNA, 25 bp, Mus musculus
catcatggtattccccttactaaaa

SEQ ID NO: 327835 - DNA, 25 bp, Mus musculus
catcatggtattgcccttactaaaa

SEQ ID NO: 327836 - DNA, 25 bp, Mus musculus
catcatgtaacaccttttagccaag

SEQ ID NO: 327837 - DNA, 25 bp, Mus musculus
catcatgtaacagcttttagccaag

SEQ ID NO: 327838 - DNA, 25 bp, Mus musculus
catcatgtagcgactcaggactgtt

SEQ ID NO: 327839 - DNA, 25 bp, Mus musculus
catcatgtagcgtctcaggactgtt

SEQ ID NO: 327840 - DNA, 25 bp, Mus musculus
catcatgtatataggactgtgctgt

SEQ ID NO: 327841 - DNA, 25 bp, Mus musculus
catcatgtatattggactgtgctgt

SEQ ID NO: 327842 - DNA, 25 bp, Mus musculus
catcatgtccatcccagactggttt

SEQ ID NO: 327843 - DNA, 25 bp, Mus musculus
catcatgtccatgccagactggttt

SEQ ID NO: 327844 - DNA, 25 bp, Mus musculus
catcatgtctatcccactgtttgtg

SEQ ID NO: 327845 - DNA, 25 bp, Mus musculus
catcatgtctatgccactgtttgtg

SEQ ID NO: 327846 - DNA, 25 bp, Mus musculus
catcatgtgacaactccagtggagc

SEQ ID NO: 327847 - DNA, 25 bp, Mus musculus
catcatgtgacatctccagtggagc

SEQ ID NO: 327848 - DNA, 25 bp, Mus musculus
catcatgtggtcaggacaatgttta

SEQ ID NO: 327849 - DNA, 25 bp, Mus musculus
catcatgtggtctggacaatgttta

SEQ ID NO: 327850 - DNA, 25 bp, Mus musculus
catcatgtgtttacccatgggctga

SEQ ID NO: 327851 - DNA, 25 bp, Mus musculus
catcatgtgtttctgaagcccaccc

SEQ ID NO: 327852 - DNA, 25 bp, Mus musculus
catcatgtgtttgtgaagcccaccc

SEQ ID NO: 327853 - DNA, 25 bp, Mus musculus
catcatgtgttttcccatgggctga

SEQ ID NO: 327854 - DNA, 25 bp, Mus musculus
catcatgttagtcttgggtgtatgc

SEQ ID NO: 327855 - DNA, 25 bp, Mus musculus
catcatgttagtgttgggtgtatgc

SEQ ID NO: 327856 - DNA, 25 bp, Mus musculus
catcatgttcacatggtatgcacac

SEQ ID NO: 327857 - DNA, 25 bp, Mus musculus
catcatgttcacttggtatgcacac

SEQ ID NO: 327858 - DNA, 25 bp, Mus musculus
catcatgttgttacgaaaggcctaa

SEQ ID NO: 327859 - DNA, 25 bp, Mus musculus
catcatgttgtttcgaaaggcctaa

SEQ ID NO: 327860 - DNA, 25 bp, Mus musculus
catcattaccccattgtgtgtggct

SEQ ID NO: 327861 - DNA, 25 bp, Mus musculus
catcattacccctttgtgtgtggct

SEQ ID NO: 327862 - DNA, 25 bp, Mus musculus
catcattataatcagcccactagtc

SEQ ID NO: 327863 - DNA, 25 bp, Mus musculus
catcattataatgagcccactagtc

SEQ ID NO: 327864 - DNA, 25 bp, Mus musculus
catcattatttaactattctgcaat

SEQ ID NO: 327865 - DNA, 25 bp, Mus musculus
catcattatttatctattctgcaat

SEQ ID NO: 327866 - DNA, 25 bp, Mus musculus
catcattcacagaaaaaccaacagc

SEQ ID NO: 327867 - DNA, 25 bp, Mus musculus
catcattcacagtaaaaccaacagc

SEQ ID NO: 327868 - DNA, 25 bp, Mus musculus
catcattcagtaatggatgacccaa

SEQ ID NO: 327869 - DNA, 25 bp, Mus musculus
catcattcagtattggatgacccaa

SEQ ID NO: 327870 - DNA, 25 bp, Mus musculus
catcattcatgacccgaagtatgag

SEQ ID NO: 327871 - DNA, 25 bp, Mus musculus
catcattcatgagccgaagtatgag

SEQ ID NO: 327872 - DNA, 25 bp, Mus musculus
catcattcccatacttccaaaagtg

SEQ ID NO: 327873 - DNA, 25 bp, Mus musculus
catcattcccattcttccaaaagtg

SEQ ID NO: 327874 - DNA, 25 bp, Mus musculus
catcattcgcgtaggagaagaactt

SEQ ID NO: 327875 - DNA, 25 bp, Mus musculus
catcattcgcgttggagaagaactt

SEQ ID NO: 327876 - DNA, 25 bp, Mus musculus
catcattgagaaaaggtgtccgaca

SEQ ID NO: 327877 - DNA, 25 bp, Mus musculus
catcattgagaataggtgtccgaca

SEQ ID NO: 327878 - DNA, 25 bp, Mus musculus
catcattgatgtccctgtgcccagt

SEQ ID NO: 327879 - DNA, 25 bp, Mus musculus
catcattgatgtgcctgtgcccagt

SEQ ID NO: 327880 - DNA, 25 bp, Mus musculus
catcattgcaagaaggaggaccgta

SEQ ID NO: 327881 - DNA, 25 bp, Mus musculus
catcattgcaagtaggaggaccgta

SEQ ID NO: 327882 - DNA, 25 bp, Mus musculus
catcattgcagaagagcggagagct

SEQ ID NO: 327883 - DNA, 25 bp, Mus musculus
catcattgcagatgagcggagagct

SEQ ID NO: 327884 - DNA, 25 bp, Mus musculus
catcattggcctacgagggtgggtt

SEQ ID NO: 327885 - DNA, 25 bp, Mus musculus
catcattggccttcgagggtgggtt

SEQ ID NO: 327886 - DNA, 25 bp, Mus musculus
catcattggtgcagttcgaacgaat

SEQ ID NO: 327887 - DNA, 25 bp, Mus musculus
catcattggtgctgttcgaacgaat

SEQ ID NO: 327888 - DNA, 25 bp, Mus musculus
catcattggttgctgtctatatcat

SEQ ID NO: 327889 - DNA, 25 bp, Mus musculus
catcattggttggtgtctatatcat

SEQ ID NO: 327890 - DNA, 25 bp, Mus musculus
catcattgtattctcttcatcttcc

SEQ ID NO: 327891 - DNA, 25 bp, Mus musculus
catcattgtattgtcttcatcttcc

SEQ ID NO: 327892 - DNA, 25 bp, Mus musculus
catcatttagatctagtccttaagg

SEQ ID NO: 327893 - DNA, 25 bp, Mus musculus
catcatttagatgtagtccttaagg

SEQ ID NO: 327894 - DNA, 25 bp, Mus musculus
catcatttatggacgcttgctccaa

SEQ ID NO: 327895 - DNA, 25 bp, Mus musculus
catcatttatggtcgcttgctccaa

SEQ ID NO: 327896 - DNA, 25 bp, Mus musculus
catcatttccatagttctttgctct

SEQ ID NO: 327897 - DNA, 25 bp, Mus musculus
catcatttccattgttctttgctct

SEQ ID NO: 327898 - DNA, 25 bp, Mus musculus
catcatttgcctccactgaaggaat

SEQ ID NO: 327899 - DNA, 25 bp, Mus musculus
catcatttgcctgcactgaaggaat

SEQ ID NO: 327900 - DNA, 25 bp, Mus musculus
catcatttgctcactgtatagtagg

SEQ ID NO: 327901 - DNA, 25 bp, Mus musculus
catcatttgctctctgtatagtagg

SEQ ID NO: 327902 - DNA, 25 bp, Mus musculus
catcattttagacggcacagctgct

SEQ ID NO: 327903 - DNA, 25 bp, Mus musculus
catcattttagagggcacagctgct

SEQ ID NO: 327904 - DNA, 25 bp, Mus musculus
catcattttgagctggcataaattc

SEQ ID NO: 327905 - DNA, 25 bp, Mus musculus
catcattttgaggtggcataaattc

SEQ ID NO: 327906 - DNA, 25 bp, Mus musculus
catcattttggtcgcttctctgttt

SEQ ID NO: 327907 - DNA, 25 bp, Mus musculus
catcattttggtggcttctctgttt

SEQ ID NO: 327908 - DNA, 25 bp, Mus musculus
catccaaaaactctccttggcctta

SEQ ID NO: 327909 - DNA, 25 bp, Mus musculus
catccaaaaactgtccttggcctta

SEQ ID NO: 327910 - DNA, 25 bp, Mus musculus
catccaaacactaaccttgtttatc

SEQ ID NO: 327911 - DNA, 25 bp, Mus musculus
catccaaacactacatgtatcccag

SEQ ID NO: 327912 - DNA, 25 bp, Mus musculus
catccaaacacttaccttgtttatc

SEQ ID NO: 327913 - DNA, 25 bp, Mus musculus
catccaaacacttcatgtatcccag

SEQ ID NO: 327914 - DNA, 25 bp, Mus musculus
catccaaatgagaggtggtggcttg

SEQ ID NO: 327915 - DNA, 25 bp, Mus musculus
catccaaatgagtggtggtggcttg

SEQ ID NO: 327916 - DNA, 25 bp, Mus musculus
catccaaatgctcccatctgtaggg

SEQ ID NO: 327917 - DNA, 25 bp, Mus musculus
catccaaatgctgccatctgtaggg

SEQ ID NO: 327918 - DNA, 25 bp, Mus musculus
catccaaattccaaataccagagac

SEQ ID NO: 327919 - DNA, 25 bp, Mus musculus
catccaaattcctaataccagagac

SEQ ID NO: 327920 - DNA, 25 bp, Mus musculus
catccaacagaacgctccaatcaaa

SEQ ID NO: 327921 - DNA, 25 bp, Mus musculus
catccaacagaaggctccaatcaaa

SEQ ID NO: 327922 - DNA, 25 bp, Mus musculus
catccaacatggatctggaagcgga

SEQ ID NO: 327923 - DNA, 25 bp, Mus musculus
catccaacatggttctggaagcgga

SEQ ID NO: 327924 - DNA, 25 bp, Mus musculus
catccaacccacagacttgaatctg

SEQ ID NO: 327925 - DNA, 25 bp, Mus musculus
catccaacccactgacttgaatctg

SEQ ID NO: 327926 - DNA, 25 bp, Mus musculus
catccaagacttactcgctttctaa

SEQ ID NO: 327927 - DNA, 25 bp, Mus musculus
catccaagactttctcgctttctaa

SEQ ID NO: 327928 - DNA, 25 bp, Mus musculus
catccaagctgccttgcgcctggag

SEQ ID NO: 327929 - DNA, 25 bp, Mus musculus
catccaagctgcgttgcgcctggag

SEQ ID NO: 327930 - DNA, 25 bp, Mus musculus
catccaaggactatgttactctttg

SEQ ID NO: 327931 - DNA, 25 bp, Mus musculus
catccaaggactttgttactctttg

SEQ ID NO: 327932 - DNA, 25 bp, Mus musculus
catccaagggaccagcgtggttttg

SEQ ID NO: 327933 - DNA, 25 bp, Mus musculus
catccaagggacgagcgtggttttg

SEQ ID NO: 327934 - DNA, 25 bp, Mus musculus
catccaaggtgccttcagcttcaca

SEQ ID NO: 327935 - DNA, 25 bp, Mus musculus
catccaaggtgcgttcagcttcaca

SEQ ID NO: 327936 - DNA, 25 bp, Mus musculus
catccaagtggacgaatgactactc

SEQ ID NO: 327937 - DNA, 25 bp, Mus musculus
catccaagtggaggaatgactactc

SEQ ID NO: 327938 - DNA, 25 bp, Mus musculus
catccaattcgccacggtctatggg

SEQ ID NO: 327939 - DNA, 25 bp, Mus musculus
catccaattcgcgacggtctatggg

SEQ ID NO: 327940 - DNA, 25 bp, Mus musculus
catccaattgtacgtccagaagatt

SEQ ID NO: 327941 - DNA, 25 bp, Mus musculus
catccaattgtaggtccagaagatt

SEQ ID NO: 327942 - DNA, 25 bp, Mus musculus
catccacaaaagcatgttctgaaat

SEQ ID NO: 327943 - DNA, 25 bp, Mus musculus
catccacaaaaggatgttctgaaat

SEQ ID NO: 327944 - DNA, 25 bp, Mus musculus
catccacaacagagaagctgctcac

SEQ ID NO: 327945 - DNA, 25 bp, Mus musculus
catccacaacagtgaagctgctcac

SEQ ID NO: 327946 - DNA, 25 bp, Mus musculus
catccacatgaacaagccccaggtg

SEQ ID NO: 327947 - DNA, 25 bp, Mus musculus
catccacatgaagaagccccaggtg

SEQ ID NO: 327948 - DNA, 25 bp, Mus musculus
catccaccaagacggcaaccggttg

SEQ ID NO: 327949 - DNA, 25 bp, Mus musculus
catccaccaagactaacacagtaat

SEQ ID NO: 327950 - DNA, 25 bp, Mus musculus
catccaccaagagggcaaccggttg

SEQ ID NO: 327951 - DNA, 25 bp, Mus musculus
catccaccaagagtaacacagtaat

SEQ ID NO: 327952 - DNA, 25 bp, Mus musculus
catccaccacatctgagactattca

SEQ ID NO: 327953 - DNA, 25 bp, Mus musculus
catccaccacatgtgagactattca

SEQ ID NO: 327954 - DNA, 25 bp, Mus musculus
catccaccaggtatgcaattttatt

SEQ ID NO: 327955 - DNA, 25 bp, Mus musculus
catccaccaggtttgcaattttatt

SEQ ID NO: 327956 - DNA, 25 bp, Mus musculus
catccaccatttacatttggcttca

SEQ ID NO: 327957 - DNA, 25 bp, Mus musculus
catccaccattttcatttggcttca

SEQ ID NO: 327958 - DNA, 25 bp, Mus musculus
catccacctcagaaaatgggcagtg

SEQ ID NO: 327959 - DNA, 25 bp, Mus musculus
catccacctcagtaaatgggcagtg

SEQ ID NO: 327960 - DNA, 25 bp, Mus musculus
catccacctctcaggacagtaatgg

SEQ ID NO: 327961 - DNA, 25 bp, Mus musculus
catccacctctctggacagtaatgg

SEQ ID NO: 327962 - DNA, 25 bp, Mus musculus
catccaccttttctttccacgtgaa

SEQ ID NO: 327963 - DNA, 25 bp, Mus musculus
catccaccttttgtttccacgtgaa

SEQ ID NO: 327964 - DNA, 25 bp, Mus musculus
catccactcgagaatgggctattaa

SEQ ID NO: 327965 - DNA, 25 bp, Mus musculus
catccactcgagtatgggctattaa

SEQ ID NO: 327966 - DNA, 25 bp, Mus musculus
catccactggtactgaaattcctct

SEQ ID NO: 327967 - DNA, 25 bp, Mus musculus
catccactggtagtgaaattcctct

SEQ ID NO: 327968 - DNA, 25 bp, Mus musculus
catccagaattcatactgtcttgat

SEQ ID NO: 327969 - DNA, 25 bp, Mus musculus
catccagaattcttactgtcttgat

SEQ ID NO: 327970 - DNA, 25 bp, Mus musculus
catccagagatgatgttgtgttctg

SEQ ID NO: 327971 - DNA, 25 bp, Mus musculus
catccagagatgttgttgtgttctg

SEQ ID NO: 327972 - DNA, 25 bp, Mus musculus
catccagagcacacataccagtggt

SEQ ID NO: 327973 - DNA, 25 bp, Mus musculus
catccagagcactcataccagtggt

SEQ ID NO: 327974 - DNA, 25 bp, Mus musculus
catccagagcagacacggcagagtt

SEQ ID NO: 327975 - DNA, 25 bp, Mus musculus
catccagagcagcaccggtgagtga

SEQ ID NO: 327976 - DNA, 25 bp, Mus musculus
catccagagcaggaccggtgagtga

SEQ ID NO: 327977 - DNA, 25 bp, Mus musculus
catccagagcagtcacggcagagtt

SEQ ID NO: 327978 - DNA, 25 bp, Mus musculus
catccagagtcgatgctgctccatt

SEQ ID NO: 327979 - DNA, 25 bp, Mus musculus
catccagagtcgttgctgctccatt

SEQ ID NO: 327980 - DNA, 25 bp, Mus musculus
catccagatgaccacgacactcggt

SEQ ID NO: 327981 - DNA, 25 bp, Mus musculus
catccagatgacgacgacactcggt

SEQ ID NO: 327982 - DNA, 25 bp, Mus musculus
catccagcaccaatcagttcttctt

SEQ ID NO: 327983 - DNA, 25 bp, Mus musculus
catccagcaccattcagttcttctt

SEQ ID NO: 327984 - DNA, 25 bp, Mus musculus
catccagccactccgtgcttaaagg

SEQ ID NO: 327985 - DNA, 25 bp, Mus musculus
catccagccactgcgtgcttaaagg

SEQ ID NO: 327986 - DNA, 25 bp, Mus musculus
catccagccatgaatccgattaaca

SEQ ID NO: 327987 - DNA, 25 bp, Mus musculus
catccagccatgtatccgattaaca

SEQ ID NO: 327988 - DNA, 25 bp, Mus musculus
catccagcctcgaccacaaatttaa

SEQ ID NO: 327989 - DNA, 25 bp, Mus musculus
catccagcctcgtccacaaatttaa

SEQ ID NO: 327990 - DNA, 25 bp, Mus musculus
catccagcgatcctgaattcagttc

SEQ ID NO: 327991 - DNA, 25 bp, Mus musculus
catccagcgatcgtgaattcagttc

SEQ ID NO: 327992 - DNA, 25 bp, Mus musculus
catccagctattctaacacctcagg

SEQ ID NO: 327993 - DNA, 25 bp, Mus musculus
catccagctattgtaacacctcagg

SEQ ID NO: 327994 - DNA, 25 bp, Mus musculus
catccagcttggagttaaatcatac

SEQ ID NO: 327995 - DNA, 25 bp, Mus musculus
catccagcttggtgttaaatcatac

SEQ ID NO: 327996 - DNA, 25 bp, Mus musculus
catccaggagatcatgacagtcccc

SEQ ID NO: 327997 - DNA, 25 bp, Mus musculus
catccaggagatgatgacagtcccc

SEQ ID NO: 327998 - DNA, 25 bp, Mus musculus
catccaggccgcagtgcaggagcag

SEQ ID NO: 327999 - DNA, 25 bp, Mus musculus
catccaggccgctgtgcaggagcag

SEQ ID NO: 328000 - DNA, 25 bp, Mus musculus
catccaggcggaccagcacttggga

SEQ ID NO: 328001 - DNA, 25 bp, Mus musculus
catccaggcggagcagcacttggga

SEQ ID NO: 328002 - DNA, 25 bp, Mus musculus
catccaggctggaggcagtaaagat

SEQ ID NO: 328003 - DNA, 25 bp, Mus musculus
catccaggctggtggcagtaaagat

SEQ ID NO: 328004 - DNA, 25 bp, Mus musculus
catccagggactacgggttgcagag

SEQ ID NO: 328005 - DNA, 25 bp, Mus musculus
catccagggacttcgggttgcagag

SEQ ID NO: 328006 - DNA, 25 bp, Mus musculus
catccagggatgcagtcacttggct

SEQ ID NO: 328007 - DNA, 25 bp, Mus musculus
catccagggatggagtcacttggct

SEQ ID NO: 328008 - DNA, 25 bp, Mus musculus
catccagggctaccggtcctcttgg

SEQ ID NO: 328009 - DNA, 25 bp, Mus musculus
catccagggctagcggtcctcttgg

SEQ ID NO: 328010 - DNA, 25 bp, Mus musculus
catccaggtgaacaaggcacctaag

SEQ ID NO: 328011 - DNA, 25 bp, Mus musculus
catccaggtgaacgaggcacttaac

SEQ ID NO: 328012 - DNA, 25 bp, Mus musculus
catccaggtgaagaaggcacctaag

SEQ ID NO: 328013 - DNA, 25 bp, Mus musculus
catccaggtgaaggaggcacttaac

SEQ ID NO: 328014 - DNA, 25 bp, Mus musculus
catccaggtggcagaagttttagtt

SEQ ID NO: 328015 - DNA, 25 bp, Mus musculus
catccaggtggctgaagttttagtt

SEQ ID NO: 328016 - DNA, 25 bp, Mus musculus
catccaggtttaatggcgttggcat

SEQ ID NO: 328017 - DNA, 25 bp, Mus musculus
catccaggtttattggcgttggcat

SEQ ID NO: 328018 - DNA, 25 bp, Mus musculus
catccagtaaataagatttccttca

SEQ ID NO: 328019 - DNA, 25 bp, Mus musculus
catccagtaaattagatttccttca

SEQ ID NO: 328020 - DNA, 25 bp, Mus musculus
catccagtatctccgagactacctg

SEQ ID NO: 328021 - DNA, 25 bp, Mus musculus
catccagtatctgcgagactacctg

SEQ ID NO: 328022 - DNA, 25 bp, Mus musculus
catccagtctctcgttaaggtgtga

SEQ ID NO: 328023 - DNA, 25 bp, Mus musculus
catccagtctctggttaaggtgtga

SEQ ID NO: 328024 - DNA, 25 bp, Mus musculus
catccagtgaggaagctcccattta

SEQ ID NO: 328025 - DNA, 25 bp, Mus musculus
catccagtgaggtagctcccattta

SEQ ID NO: 328026 - DNA, 25 bp, Mus musculus
catccagtgcctaaacttttccttt

SEQ ID NO: 328027 - DNA, 25 bp, Mus musculus
catccagtgccttaacttttccttt

SEQ ID NO: 328028 - DNA, 25 bp, Mus musculus
catccagtgctacctttcaagtttg

SEQ ID NO: 328029 - DNA, 25 bp, Mus musculus
catccagtgctagctttcaagtttg

SEQ ID NO: 328030 - DNA, 25 bp, Mus musculus
catccagtggatcgtttatcaacaa

SEQ ID NO: 328031 - DNA, 25 bp, Mus musculus
catccagtggatggtttatcaacaa

SEQ ID NO: 328032 - DNA, 25 bp, Mus musculus
catccagtggctcacaagtgtgtgt

SEQ ID NO: 328033 - DNA, 25 bp, Mus musculus
catccagtggctgacaagtgtgtgt

SEQ ID NO: 328034 - DNA, 25 bp, Mus musculus
catccagtttcactttagcagttcc

SEQ ID NO: 328035 - DNA, 25 bp, Mus musculus
catccagtttcagtttagcagttcc

SEQ ID NO: 328036 - DNA, 25 bp, Mus musculus
catccagtttctccacgaagacgag

SEQ ID NO: 328037 - DNA, 25 bp, Mus musculus
catccagtttctgcacgaagacgag

SEQ ID NO: 328038 - DNA, 25 bp, Mus musculus
catccatacccaagtgaatgtgatg

SEQ ID NO: 328039 - DNA, 25 bp, Mus musculus
catccatacccatgtgaatgtgatg

SEQ ID NO: 328040 - DNA, 25 bp, Mus musculus
catccatatggacgcaggcaaggtt

SEQ ID NO: 328041 - DNA, 25 bp, Mus musculus
catccatatggaggcaggcaaggtt

SEQ ID NO: 328042 - DNA, 25 bp, Mus musculus
catccatcaagcagtgtgtcttcat

SEQ ID NO: 328043 - DNA, 25 bp, Mus musculus
catccatcaagctgtgtgtcttcat

SEQ ID NO: 328044 - DNA, 25 bp, Mus musculus
catccatccatcatggcgtggtgga

SEQ ID NO: 328045 - DNA, 25 bp, Mus musculus
catccatccatcttggcgtggtgga

SEQ ID NO: 328046 - DNA, 25 bp, Mus musculus
catccatcccatcgtcttctgaaaa

SEQ ID NO: 328047 - DNA, 25 bp, Mus musculus
catccatcccatggtcttctgaaaa

SEQ ID NO: 328048 - DNA, 25 bp, Mus musculus
catccatgaaacagtactaattaac

SEQ ID NO: 328049 - DNA, 25 bp, Mus musculus
catccatgaaactgtactaattaac

SEQ ID NO: 328050 - DNA, 25 bp, Mus musculus
catccatgacaactttggcattgtg

SEQ ID NO: 328051 - DNA, 25 bp, Mus musculus
catccatgacaagtttggcattgtg

SEQ ID NO: 328052 - DNA, 25 bp, Mus musculus
catccatgattgactgtctcactga

SEQ ID NO: 328053 - DNA, 25 bp, Mus musculus
catccatgattgtctgtctcactga

SEQ ID NO: 328054 - DNA, 25 bp, Mus musculus
catccatgcgagctttttgcagcaa

SEQ ID NO: 328055 - DNA, 25 bp, Mus musculus
catccatgcgaggtttttgcagcaa

SEQ ID NO: 328056 - DNA, 25 bp, Mus musculus
catccatgctgtctcctttagggac

SEQ ID NO: 328057 - DNA, 25 bp, Mus musculus
catccatgctgtgtcctttagggac

SEQ ID NO: 328058 - DNA, 25 bp, Mus musculus
catccatggacaatccctggcagca

SEQ ID NO: 328059 - DNA, 25 bp, Mus musculus
catccatggacattccctggcagca

SEQ ID NO: 328060 - DNA, 25 bp, Mus musculus
catccatggcctaagaagagtgctt

SEQ ID NO: 328061 - DNA, 25 bp, Mus musculus
catccatggccttagaagagtgctt

SEQ ID NO: 328062 - DNA, 25 bp, Mus musculus
catccatggctgagatcttccagca

SEQ ID NO: 328063 - DNA, 25 bp, Mus musculus
catccatggctgtgatcttccagca

SEQ ID NO: 328064 - DNA, 25 bp, Mus musculus
catccatggtggaaacttgttctgc

SEQ ID NO: 328065 - DNA, 25 bp, Mus musculus
catccatggtggtaacttgttctgc

SEQ ID NO: 328066 - DNA, 25 bp, Mus musculus
catccatgtatgatgcatctttgag

SEQ ID NO: 328067 - DNA, 25 bp, Mus musculus
catccatgtatgttgcatctttgag

SEQ ID NO: 328068 - DNA, 25 bp, Mus musculus
catccatgtgcactgtatgtagcta

SEQ ID NO: 328069 - DNA, 25 bp, Mus musculus
catccatgtgcagtgtatgtagcta

SEQ ID NO: 328070 - DNA, 25 bp, Mus musculus
catccattatggctgtgcttgcaat

SEQ ID NO: 328071 - DNA, 25 bp, Mus musculus
catccattatgggtgtgcttgcaat

SEQ ID NO: 328072 - DNA, 25 bp, Mus musculus
catccattcaagaaattcccagtgt

SEQ ID NO: 328073 - DNA, 25 bp, Mus musculus
catccattcaagtaattcccagtgt

SEQ ID NO: 328074 - DNA, 25 bp, Mus musculus
catccattcactacaaccaacaaat

SEQ ID NO: 328075 - DNA, 25 bp, Mus musculus
catccattcacttcaaccaacaaat

SEQ ID NO: 328076 - DNA, 25 bp, Mus musculus
catccattccttaactcagtattca

SEQ ID NO: 328077 - DNA, 25 bp, Mus musculus
catccattcctttactcagtattca

SEQ ID NO: 328078 - DNA, 25 bp, Mus musculus
catccattgctcctagtaaatgtgc

SEQ ID NO: 328079 - DNA, 25 bp, Mus musculus
catccattgctcgtagtaaatgtgc

SEQ ID NO: 328080 - DNA, 25 bp, Mus musculus
catccattgtagatactggcttcaa

SEQ ID NO: 328081 - DNA, 25 bp, Mus musculus
catccattgtagttactggcttcaa

SEQ ID NO: 328082 - DNA, 25 bp, Mus musculus
catccattgtccaccgcaagtgctt

SEQ ID NO: 328083 - DNA, 25 bp, Mus musculus
catccattgtcctccgcaagtgctt

SEQ ID NO: 328084 - DNA, 25 bp, Mus musculus
catccattgtggctttggcttgaat

SEQ ID NO: 328085 - DNA, 25 bp, Mus musculus
catccattgtgggtttggcttgaat

SEQ ID NO: 328086 - DNA, 25 bp, Mus musculus
catccatttacactgtgccagcaat

SEQ ID NO: 328087 - DNA, 25 bp, Mus musculus
catccatttacagtgtgccagcaat

SEQ ID NO: 328088 - DNA, 25 bp, Mus musculus
catccatttatgaatctctgcaaag

SEQ ID NO: 328089 - DNA, 25 bp, Mus musculus
catccatttatgtatctctgcaaag

SEQ ID NO: 328090 - DNA, 25 bp, Mus musculus
catccatttcagctttgcttgctca

SEQ ID NO: 328091 - DNA, 25 bp, Mus musculus
catccatttcaggtttgcttgctca

SEQ ID NO: 328092 - DNA, 25 bp, Mus musculus
catccatttcgacccttgtacaata

SEQ ID NO: 328093 - DNA, 25 bp, Mus musculus
catccatttcgagccttgtacaata

SEQ ID NO: 328094 - DNA, 25 bp, Mus musculus
catccatttctccaggtctagggac

SEQ ID NO: 328095 - DNA, 25 bp, Mus musculus
catccatttctcgaggtctagggac

SEQ ID NO: 328096 - DNA, 25 bp, Mus musculus
catcccaacaccacaaattacttaa

SEQ ID NO: 328097 - DNA, 25 bp, Mus musculus
catcccaacacctcaaattacttaa

SEQ ID NO: 328098 - DNA, 25 bp, Mus musculus
catcccaaccttatcttcattaagt

SEQ ID NO: 328099 - DNA, 25 bp, Mus musculus
catcccaaccttttcttcattaagt

SEQ ID NO: 328100 - DNA, 25 bp, Mus musculus
catcccaagggtacttggcccattt

SEQ ID NO: 328101 - DNA, 25 bp, Mus musculus
catcccaagggttcttggcccattt

SEQ ID NO: 328102 - DNA, 25 bp, Mus musculus
catcccacagacacttgaaggcagt

SEQ ID NO: 328103 - DNA, 25 bp, Mus musculus
catcccacagactcttgaaggcagt

SEQ ID NO: 328104 - DNA, 25 bp, Mus musculus
catcccaccatcagtgtgtgagtgt

SEQ ID NO: 328105 - DNA, 25 bp, Mus musculus
catcccaccatctgtgtgtgagtgt

SEQ ID NO: 328106 - DNA, 25 bp, Mus musculus
catcccaccatgcaagctttagtga

SEQ ID NO: 328107 - DNA, 25 bp, Mus musculus
catcccaccatggaagctttagtga

SEQ ID NO: 328108 - DNA, 25 bp, Mus musculus
catcccacgagactctttctaatag

SEQ ID NO: 328109 - DNA, 25 bp, Mus musculus
catcccacgagagtctttctaatag

SEQ ID NO: 328110 - DNA, 25 bp, Mus musculus
catcccacgtctatgtgaaccaagg

SEQ ID NO: 328111 - DNA, 25 bp, Mus musculus
catcccacgtctttgtgaaccaagg

SEQ ID NO: 328112 - DNA, 25 bp, Mus musculus
catcccactcctaccgggtaaatgg

SEQ ID NO: 328113 - DNA, 25 bp, Mus musculus
catcccactccttccgggtaaatgg

SEQ ID NO: 328114 - DNA, 25 bp, Mus musculus
catcccactttccattataacacaa

SEQ ID NO: 328115 - DNA, 25 bp, Mus musculus
catcccactttcgattataacacaa

SEQ ID NO: 328116 - DNA, 25 bp, Mus musculus
catcccagaaatcaactcttgtaga

SEQ ID NO: 328117 - DNA, 25 bp, Mus musculus
catcccagaaatgaactcttgtaga

SEQ ID NO: 328118 - DNA, 25 bp, Mus musculus
catcccagcacaaatgatccagaag

SEQ ID NO: 328119 - DNA, 25 bp, Mus musculus
catcccagcacatatgatccagaag

SEQ ID NO: 328120 - DNA, 25 bp, Mus musculus
catcccagcccgagaaaaactcagg

SEQ ID NO: 328121 - DNA, 25 bp, Mus musculus
catcccagcccgtgaaaaactcagg

SEQ ID NO: 328122 - DNA, 25 bp, Mus musculus
catcccagcctccagatgaagagga

SEQ ID NO: 328123 - DNA, 25 bp, Mus musculus
catcccagcctcgagatgaagagga

SEQ ID NO: 328124 - DNA, 25 bp, Mus musculus
catcccaggaatcagtttcacagtt

SEQ ID NO: 328125 - DNA, 25 bp, Mus musculus
catcccaggaatgagtttcacagtt

SEQ ID NO: 328126 - DNA, 25 bp, Mus musculus
catcccaggacgcttctcaggataa

SEQ ID NO: 328127 - DNA, 25 bp, Mus musculus
catcccaggacggttctcaggataa

SEQ ID NO: 328128 - DNA, 25 bp, Mus musculus
catcccaggatacagctgcagcaaa

SEQ ID NO: 328129 - DNA, 25 bp, Mus musculus
catcccaggatagagctgcagcaaa

SEQ ID NO: 328130 - DNA, 25 bp, Mus musculus
catcccaggcctctgataggagctt

SEQ ID NO: 328131 - DNA, 25 bp, Mus musculus
catcccaggcctgtgataggagctt

SEQ ID NO: 328132 - DNA, 25 bp, Mus musculus
catcccagggatagcacatctgtat

SEQ ID NO: 328133 - DNA, 25 bp, Mus musculus
catcccagggattgcacatctgtat

SEQ ID NO: 328134 - DNA, 25 bp, Mus musculus
catcccagtacccttgtagtgtttt

SEQ ID NO: 328135 - DNA, 25 bp, Mus musculus
catcccagtaccgttgtagtgtttt

SEQ ID NO: 328136 - DNA, 25 bp, Mus musculus
catcccagtcccagagcgagaatag

SEQ ID NO: 328137 - DNA, 25 bp, Mus musculus
catcccagtccctgagcgagaatag

SEQ ID NO: 328138 - DNA, 25 bp, Mus musculus
catcccatagcgaatgtcttcgtta

SEQ ID NO: 328139 - DNA, 25 bp, Mus musculus
catcccatagcgtatgtcttcgtta

SEQ ID NO: 328140 - DNA, 25 bp, Mus musculus
catcccatcctgagcttgttaaaaa

SEQ ID NO: 328141 - DNA, 25 bp, Mus musculus
catcccatcctgtgcttgttaaaaa

SEQ ID NO: 328142 - DNA, 25 bp, Mus musculus
catcccatggctcttgtctttggaa

SEQ ID NO: 328143 - DNA, 25 bp, Mus musculus
catcccatggctgttgtctttggaa

SEQ ID NO: 328144 - DNA, 25 bp, Mus musculus
catcccattcggcagttttcaataa

SEQ ID NO: 328145 - DNA, 25 bp, Mus musculus
catcccattcgggagttttcaataa

SEQ ID NO: 328146 - DNA, 25 bp, Mus musculus
catccccaagatcgcttctttgtga

SEQ ID NO: 328147 - DNA, 25 bp, Mus musculus
catccccaagatggcttctttgtga

SEQ ID NO: 328148 - DNA, 25 bp, Mus musculus
catccccaccacagctgaataaaag

SEQ ID NO: 328149 - DNA, 25 bp, Mus musculus
catccccaccactgctgaataaaag

SEQ ID NO: 328150 - DNA, 25 bp, Mus musculus
catccccaccctcttaaatggtgta

SEQ ID NO: 328151 - DNA, 25 bp, Mus musculus
catccccaccctgttaaatggtgta

SEQ ID NO: 328152 - DNA, 25 bp, Mus musculus
catccccagactcctaagtgattga

SEQ ID NO: 328153 - DNA, 25 bp, Mus musculus
catccccagactgctaagtgattga

SEQ ID NO: 328154 - DNA, 25 bp, Mus musculus
catccccagctcatccgtttctttt

SEQ ID NO: 328155 - DNA, 25 bp, Mus musculus
catccccagctcctatattatggtt

SEQ ID NO: 328156 - DNA, 25 bp, Mus musculus
catccccagctcgtatattatggtt

SEQ ID NO: 328157 - DNA, 25 bp, Mus musculus
catccccagctcttccgtttctttt

SEQ ID NO: 328158 - DNA, 25 bp, Mus musculus
catccccagcttctgggtttatttt

SEQ ID NO: 328159 - DNA, 25 bp, Mus musculus
catccccagcttgtgggtttatttt

SEQ ID NO: 328160 - DNA, 25 bp, Mus musculus
catccccatgaccaacttaaagacg

SEQ ID NO: 328161 - DNA, 25 bp, Mus musculus
catccccatgacgaacttaaagacg

SEQ ID NO: 328162 - DNA, 25 bp, Mus musculus
catccccatgtgaagttaactgtgt

SEQ ID NO: 328163 - DNA, 25 bp, Mus musculus
catccccatgtgtagttaactgtgt

SEQ ID NO: 328164 - DNA, 25 bp, Mus musculus
catcccccagtgacggctgagatgt

SEQ ID NO: 328165 - DNA, 25 bp, Mus musculus
catcccccagtgtcggctgagatgt

SEQ ID NO: 328166 - DNA, 25 bp, Mus musculus
catccccgactaccctatttattat

SEQ ID NO: 328167 - DNA, 25 bp, Mus musculus
catccccgactagcctatttattat

SEQ ID NO: 328168 - DNA, 25 bp, Mus musculus
catccccgtttgcacgaatgcgtgt

SEQ ID NO: 328169 - DNA, 25 bp, Mus musculus
catccccgtttggacgaatgcgtgt

SEQ ID NO: 328170 - DNA, 25 bp, Mus musculus
catcccctataaagaagtgattcat

SEQ ID NO: 328171 - DNA, 25 bp, Mus musculus
catcccctataatgaagtgattcat

SEQ ID NO: 328172 - DNA, 25 bp, Mus musculus
catcccctatctacttaatccagat

SEQ ID NO: 328173 - DNA, 25 bp, Mus musculus
catcccctatcttcttaatccagat

SEQ ID NO: 328174 - DNA, 25 bp, Mus musculus
catcccctctctcgtggatatgaga

SEQ ID NO: 328175 - DNA, 25 bp, Mus musculus
catcccctctctggtggatatgaga

SEQ ID NO: 328176 - DNA, 25 bp, Mus musculus
catcccctgagtcagaagctgtgga

SEQ ID NO: 328177 - DNA, 25 bp, Mus musculus
catcccctgagtgagaagctgtgga

SEQ ID NO: 328178 - DNA, 25 bp, Mus musculus
catcccctgctaattcttaagtttt

SEQ ID NO: 328179 - DNA, 25 bp, Mus musculus
catcccctgctatttcttaagtttt

SEQ ID NO: 328180 - DNA, 25 bp, Mus musculus
catcccctgcttaacactattatat

SEQ ID NO: 328181 - DNA, 25 bp, Mus musculus
catcccctgctttacactattatat

SEQ ID NO: 328182 - DNA, 25 bp, Mus musculus
catcccctggatagaagtgctgaga

SEQ ID NO: 328183 - DNA, 25 bp, Mus musculus
catcccctggattgaagtgctgaga

SEQ ID NO: 328184 - DNA, 25 bp, Mus musculus
catcccctggcacgctaaagtgctg

SEQ ID NO: 328185 - DNA, 25 bp, Mus musculus
catcccctggcaggctaaagtgctg

SEQ ID NO: 328186 - DNA, 25 bp, Mus musculus
catcccctggtcatcctaaagagaa

SEQ ID NO: 328187 - DNA, 25 bp, Mus musculus
catcccctggtcttcctaaagagaa

SEQ ID NO: 328188 - DNA, 25 bp, Mus musculus
catcccctgtcaccacagagagaag

SEQ ID NO: 328189 - DNA, 25 bp, Mus musculus
catcccctgtcagcacagagagaag

SEQ ID NO: 328190 - DNA, 25 bp, Mus musculus
catccccttcagaaagcctgtgaaa

SEQ ID NO: 328191 - DNA, 25 bp, Mus musculus
catccccttcagtaagcctgtgaaa

SEQ ID NO: 328192 - DNA, 25 bp, Mus musculus
catccccttccaagtattatcagtc

SEQ ID NO: 328193 - DNA, 25 bp, Mus musculus
catccccttccatgtattatcagtc

SEQ ID NO: 328194 - DNA, 25 bp, Mus musculus
catcccgaacaccagcagaaatgga

SEQ ID NO: 328195 - DNA, 25 bp, Mus musculus
catcccgaacacgagcagaaatgga

SEQ ID NO: 328196 - DNA, 25 bp, Mus musculus
catcccgaagaaaacatccctccaa

SEQ ID NO: 328197 - DNA, 25 bp, Mus musculus
catcccgaagaatacatccctccaa

SEQ ID NO: 328198 - DNA, 25 bp, Mus musculus
catcccgaatttcagcttcagctct

SEQ ID NO: 328199 - DNA, 25 bp, Mus musculus
catcccgaatttgagcttcagctct

SEQ ID NO: 328200 - DNA, 25 bp, Mus musculus
catcccgaccctcaatttgattgtc

SEQ ID NO: 328201 - DNA, 25 bp, Mus musculus
catcccgaccctgaatttgattgtc

SEQ ID NO: 328202 - DNA, 25 bp, Mus musculus
catcccgaccttcaatttttattat

SEQ ID NO: 328203 - DNA, 25 bp, Mus musculus
catcccgaccttgaatttttattat

SEQ ID NO: 328204 - DNA, 25 bp, Mus musculus
catcccgactacagagaaaccactt

SEQ ID NO: 328205 - DNA, 25 bp, Mus musculus
catcccgactactgagaaaccactt

SEQ ID NO: 328206 - DNA, 25 bp, Mus musculus
catcccggaagcattatttcgtaat

SEQ ID NO: 328207 - DNA, 25 bp, Mus musculus
catcccggaagctttatttcgtaat

SEQ ID NO: 328208 - DNA, 25 bp, Mus musculus
catcccggttaccttcctacataat

SEQ ID NO: 328209 - DNA, 25 bp, Mus musculus
catcccggttacgttcctacataat

SEQ ID NO: 328210 - DNA, 25 bp, Mus musculus
catcccgtgagaattggccatctta

SEQ ID NO: 328211 - DNA, 25 bp, Mus musculus
catcccgtgagatttggccatctta

SEQ ID NO: 328212 - DNA, 25 bp, Mus musculus
catcccgtgcaccttgaatgggtgg

SEQ ID NO: 328213 - DNA, 25 bp, Mus musculus
catcccgtgcacgttgaatgggtgg

SEQ ID NO: 328214 - DNA, 25 bp, Mus musculus
catcccgttggaactgctagacagg

SEQ ID NO: 328215 - DNA, 25 bp, Mus musculus
catcccgttggatctgctagacagg

SEQ ID NO: 328216 - DNA, 25 bp, Mus musculus
catccctaagtgcactgacttgggc

SEQ ID NO: 328217 - DNA, 25 bp, Mus musculus
catccctaagtggactgacttgggc

SEQ ID NO: 328218 - DNA, 25 bp, Mus musculus
catccctacaaactactacaactgg

SEQ ID NO: 328219 - DNA, 25 bp, Mus musculus
catccctacaaagtactacaactgg

SEQ ID NO: 328220 - DNA, 25 bp, Mus musculus
catccctacctaagtggccgaggag

SEQ ID NO: 328221 - DNA, 25 bp, Mus musculus
catccctacctatgtggccgaggag

SEQ ID NO: 328222 - DNA, 25 bp, Mus musculus
catccctagctgctgtttgtttgtt

SEQ ID NO: 328223 - DNA, 25 bp, Mus musculus
catccctagctggtgtttgtttgtt

SEQ ID NO: 328224 - DNA, 25 bp, Mus musculus
catccctattttccagtggtgtgaa

SEQ ID NO: 328225 - DNA, 25 bp, Mus musculus
catccctattttgcagtggtgtgaa

SEQ ID NO: 328226 - DNA, 25 bp, Mus musculus
catccctcacatacctaaatactag

SEQ ID NO: 328227 - DNA, 25 bp, Mus musculus
catccctcacattcctaaatactag

SEQ ID NO: 328228 - DNA, 25 bp, Mus musculus
catccctcaggtcggtagccaagga

SEQ ID NO: 328229 - DNA, 25 bp, Mus musculus
catccctcaggtgggtagccaagga

SEQ ID NO: 328230 - DNA, 25 bp, Mus musculus
catccctcattgactgtgttttatg

SEQ ID NO: 328231 - DNA, 25 bp, Mus musculus
catccctcattgtctgtgttttatg

SEQ ID NO: 328232 - DNA, 25 bp, Mus musculus
catccctcatttctgacaacttgac

SEQ ID NO: 328233 - DNA, 25 bp, Mus musculus
catccctcatttgtgacaacttgac

SEQ ID NO: 328234 - DNA, 25 bp, Mus musculus
catccctcgattcagaggccaaaga

SEQ ID NO: 328235 - DNA, 25 bp, Mus musculus
catccctcgattgagaggccaaaga

SEQ ID NO: 328236 - DNA, 25 bp, Mus musculus
catccctctactcgacagcgtggag

SEQ ID NO: 328237 - DNA, 25 bp, Mus musculus
catccctctactggacagcgtggag

SEQ ID NO: 328238 - DNA, 25 bp, Mus musculus
catccctctgatatcatgtgttaaa

SEQ ID NO: 328239 - DNA, 25 bp, Mus musculus
catccctctgatttcatgtgttaaa

SEQ ID NO: 328240 - DNA, 25 bp, Mus musculus
catccctctgtccttaatttttatt

SEQ ID NO: 328241 - DNA, 25 bp, Mus musculus
catccctctgtcgttaatttttatt

SEQ ID NO: 328242 - DNA, 25 bp, Mus musculus
catccctgagatcaagctgacagct

SEQ ID NO: 328243 - DNA, 25 bp, Mus musculus
catccctgagatgaagctgacagct

SEQ ID NO: 328244 - DNA, 25 bp, Mus musculus
catccctgaggacgtgacatgccta

SEQ ID NO: 328245 - DNA, 25 bp, Mus musculus
catccctgaggaggtgacatgccta

SEQ ID NO: 328246 - DNA, 25 bp, Mus musculus
catccctgccctcgtactcacagag

SEQ ID NO: 328247 - DNA, 25 bp, Mus musculus
catccctgccctggtactcacagag

SEQ ID NO: 328248 - DNA, 25 bp, Mus musculus
catccctgctccataaaggcatggg

SEQ ID NO: 328249 - DNA, 25 bp, Mus musculus
catccctgctccttaaaggcatggg

SEQ ID NO: 328250 - DNA, 25 bp, Mus musculus
catccctggagaataacctggagga

SEQ ID NO: 328251 - DNA, 25 bp, Mus musculus
catccctggagattaacctggagga

SEQ ID NO: 328252 - DNA, 25 bp, Mus musculus
catccctggcaaccaggctgtagtg

SEQ ID NO: 328253 - DNA, 25 bp, Mus musculus
catccctggcaagcaggctgtagtg

SEQ ID NO: 328254 - DNA, 25 bp, Mus musculus
catccctggccaccagtggagtgaa

SEQ ID NO: 328255 - DNA, 25 bp, Mus musculus
catccctggccagcagtggagtgaa

SEQ ID NO: 328256 - DNA, 25 bp, Mus musculus
catccctggttaccaattccatcaa

SEQ ID NO: 328257 - DNA, 25 bp, Mus musculus
catccctggttagcaattccatcaa

SEQ ID NO: 328258 - DNA, 25 bp, Mus musculus
catccctgtgacattggctttattt

SEQ ID NO: 328259 - DNA, 25 bp, Mus musculus
catccctgtgactttggctttattt

SEQ ID NO: 328260 - DNA, 25 bp, Mus musculus
catccctgttccagtagacgtatag

SEQ ID NO: 328261 - DNA, 25 bp, Mus musculus
catccctgttcctgtagacgtatag

SEQ ID NO: 328262 - DNA, 25 bp, Mus musculus
catccctgttggatcttgatcaaag

SEQ ID NO: 328263 - DNA, 25 bp, Mus musculus
catccctgttggttcttgatcaaag

SEQ ID NO: 328264 - DNA, 25 bp, Mus musculus
catcccttaatgctgtgcagttcat

SEQ ID NO: 328265 - DNA, 25 bp, Mus musculus
catcccttaatggtgtgcagttcat

SEQ ID NO: 328266 - DNA, 25 bp, Mus musculus
catcccttagctatcctgtctaaat

SEQ ID NO: 328267 - DNA, 25 bp, Mus musculus
catcccttagctttcctgtctaaat

SEQ ID NO: 328268 - DNA, 25 bp, Mus musculus
catcccttcctactaaacggtcttg

SEQ ID NO: 328269 - DNA, 25 bp, Mus musculus
catcccttcctagtaaacggtcttg

SEQ ID NO: 328270 - DNA, 25 bp, Mus musculus
catcccttgaagctggtggtaactc

SEQ ID NO: 328271 - DNA, 25 bp, Mus musculus
catcccttgaaggtggtggtaactc

SEQ ID NO: 328272 - DNA, 25 bp, Mus musculus
catcccttggttcgactgcttagtt

SEQ ID NO: 328273 - DNA, 25 bp, Mus musculus
catcccttggttggactgcttagtt

SEQ ID NO: 328274 - DNA, 25 bp, Mus musculus
catcccttgttgattggtggtgttt

SEQ ID NO: 328275 - DNA, 25 bp, Mus musculus
catcccttgttgtttggtggtgttt

SEQ ID NO: 328276 - DNA, 25 bp, Mus musculus
catccctttactctacggctgaaga

SEQ ID NO: 328277 - DNA, 25 bp, Mus musculus
catccctttactgtacggctgaaga

SEQ ID NO: 328278 - DNA, 25 bp, Mus musculus
catccctttgggaaactggacaata

SEQ ID NO: 328279 - DNA, 25 bp, Mus musculus
catccctttgggtaactggacaata

SEQ ID NO: 328280 - DNA, 25 bp, Mus musculus
catccctttgtaccctgtgtgtgtt

SEQ ID NO: 328281 - DNA, 25 bp, Mus musculus
catccctttgtagcctgtgtgtgtt

SEQ ID NO: 328282 - DNA, 25 bp, Mus musculus
catccctttgttaccgttgattcca

SEQ ID NO: 328283 - DNA, 25 bp, Mus musculus
catccctttgtttccgttgattcca

SEQ ID NO: 328284 - DNA, 25 bp, Mus musculus
catcccttttctcccggacagtgga

SEQ ID NO: 328285 - DNA, 25 bp, Mus musculus
catcccttttctgccggacagtgga

SEQ ID NO: 328286 - DNA, 25 bp, Mus musculus
catccgaaatcaagtcaccttctga

SEQ ID NO: 328287 - DNA, 25 bp, Mus musculus
catccgaaatcatgtcaccttctga

SEQ ID NO: 328288 - DNA, 25 bp, Mus musculus
catccgagcaataagggctgggttt

SEQ ID NO: 328289 - DNA, 25 bp, Mus musculus
catccgagcaattagggctgggttt

SEQ ID NO: 328290 - DNA, 25 bp, Mus musculus
catccgagcagcatcagcagcgaaa

SEQ ID NO: 328291 - DNA, 25 bp, Mus musculus
catccgagcagcttcagcagcgaaa

SEQ ID NO: 328292 - DNA, 25 bp, Mus musculus
catccgagtgttacgtgcgtgcaca

SEQ ID NO: 328293 - DNA, 25 bp, Mus musculus
catccgagtgtttcgtgcgtgcaca

SEQ ID NO: 328294 - DNA, 25 bp, Mus musculus
catccgatagcaacttgggtgtata

SEQ ID NO: 328295 - DNA, 25 bp, Mus musculus
catccgatagcatcttgggtgtata

SEQ ID NO: 328296 - DNA, 25 bp, Mus musculus
catccgatccgtccctgtgacaagg

SEQ ID NO: 328297 - DNA, 25 bp, Mus musculus
catccgatccgtgcctgtgacaagg

SEQ ID NO: 328298 - DNA, 25 bp, Mus musculus
catccgattctgagtttgtgtgtgt

SEQ ID NO: 328299 - DNA, 25 bp, Mus musculus
catccgattctgtgtttgtgtgtgt

SEQ ID NO: 328300 - DNA, 25 bp, Mus musculus
catccgcacaatattccacttaagc

SEQ ID NO: 328301 - DNA, 25 bp, Mus musculus
catccgcacaattttccacttaagc

SEQ ID NO: 328302 - DNA, 25 bp, Mus musculus
catccgcactgacgtcttcatggaa

SEQ ID NO: 328303 - DNA, 25 bp, Mus musculus
catccgcactgaggtcttcatggaa

SEQ ID NO: 328304 - DNA, 25 bp, Mus musculus
catccgcagagcacgctgttggaag

SEQ ID NO: 328305 - DNA, 25 bp, Mus musculus
catccgcagagctcgctgttggaag

SEQ ID NO: 328306 - DNA, 25 bp, Mus musculus
catccgcagggacaaggaccagttc

SEQ ID NO: 328307 - DNA, 25 bp, Mus musculus
catccgcagggagaaggaccagttc

SEQ ID NO: 328308 - DNA, 25 bp, Mus musculus
catccgccaccaaatcagtatttag

SEQ ID NO: 328309 - DNA, 25 bp, Mus musculus
catccgccaccatatcagtatttag

SEQ ID NO: 328310 - DNA, 25 bp, Mus musculus
catccgcgccaacagaaagcgggag

SEQ ID NO: 328311 - DNA, 25 bp, Mus musculus
catccgcgccaagagaaagcgggag

SEQ ID NO: 328312 - DNA, 25 bp, Mus musculus
catccgctctctaagaagaccttag

SEQ ID NO: 328313 - DNA, 25 bp, Mus musculus
catccgctctcttagaagaccttag

SEQ ID NO: 328314 - DNA, 25 bp, Mus musculus
catccgctgcatcgtcacagtagag

SEQ ID NO: 328315 - DNA, 25 bp, Mus musculus
catccgctgcatggtcacagtagag

SEQ ID NO: 328316 - DNA, 25 bp, Mus musculus
catccgcttgcaagacatttctgaa

SEQ ID NO: 328317 - DNA, 25 bp, Mus musculus
catccgcttgcatgacatttctgaa

SEQ ID NO: 328318 - DNA, 25 bp, Mus musculus
catccggagagaacctgaggcctgt

SEQ ID NO: 328319 - DNA, 25 bp, Mus musculus
catccggagagatcctgaggcctgt

SEQ ID NO: 328320 - DNA, 25 bp, Mus musculus
catccggagggaattcattgagaaa

SEQ ID NO: 328321 - DNA, 25 bp, Mus musculus
catccggagggatttcattgagaaa

SEQ ID NO: 328322 - DNA, 25 bp, Mus musculus
catccggcagatcttgtacctcggg

SEQ ID NO: 328323 - DNA, 25 bp, Mus musculus
catccggcagatgttgtacctcggg

SEQ ID NO: 328324 - DNA, 25 bp, Mus musculus
catccggctggaaggggccattcga

SEQ ID NO: 328325 - DNA, 25 bp, Mus musculus
catccggctggatggggccattcga

SEQ ID NO: 328326 - DNA, 25 bp, Mus musculus
catccgggtgttagtgtggctgcta

SEQ ID NO: 328327 - DNA, 25 bp, Mus musculus
catccgggtgtttgtgtggctgcta

SEQ ID NO: 328328 - DNA, 25 bp, Mus musculus
catccggtacctatgtagccttaga

SEQ ID NO: 328329 - DNA, 25 bp, Mus musculus
catccggtacctttgtagccttaga

SEQ ID NO: 328330 - DNA, 25 bp, Mus musculus
catccggtcaagctctactgcctgg

SEQ ID NO: 328331 - DNA, 25 bp, Mus musculus
catccggtcaaggtctactgcctgg

SEQ ID NO: 328332 - DNA, 25 bp, Mus musculus
catccggtgctgcagctgatagttt

SEQ ID NO: 328333 - DNA, 25 bp, Mus musculus
catccggtgctggagctgatagttt

SEQ ID NO: 328334 - DNA, 25 bp, Mus musculus
catccgtacatcattgcctctgtgg

SEQ ID NO: 328335 - DNA, 25 bp, Mus musculus
catccgtacatctttgcctctgtgg

SEQ ID NO: 328336 - DNA, 25 bp, Mus musculus
catccgtccagacttccaaagaggg

SEQ ID NO: 328337 - DNA, 25 bp, Mus musculus
catccgtccagagttccaaagaggg

SEQ ID NO: 328338 - DNA, 25 bp, Mus musculus
catccgtgagaaagtgatcccttca

SEQ ID NO: 328339 - DNA, 25 bp, Mus musculus
catccgtgagaatgtgatcccttca

SEQ ID NO: 328340 - DNA, 25 bp, Mus musculus
catccgtggctgctgattttagtca

SEQ ID NO: 328341 - DNA, 25 bp, Mus musculus
catccgtggctggtgattttagtca

SEQ ID NO: 328342 - DNA, 25 bp, Mus musculus
catcctaaatgtaaagtgcagtgtc

SEQ ID NO: 328343 - DNA, 25 bp, Mus musculus
catcctaaatgttaagtgcagtgtc

SEQ ID NO: 328344 - DNA, 25 bp, Mus musculus
catcctaacttaatcagcatcatgt

SEQ ID NO: 328345 - DNA, 25 bp, Mus musculus
catcctaacttattcagcatcatgt

SEQ ID NO: 328346 - DNA, 25 bp, Mus musculus
catcctacaagactgcaaacccgaa

SEQ ID NO: 328347 - DNA, 25 bp, Mus musculus
catcctacaagagtgcaaacccgaa

SEQ ID NO: 328348 - DNA, 25 bp, Mus musculus
catcctacacgccagcagtggactg

SEQ ID NO: 328349 - DNA, 25 bp, Mus musculus
catcctacacgcgagcagtggactg

SEQ ID NO: 328350 - DNA, 25 bp, Mus musculus
catcctacccttatacagttagcta

SEQ ID NO: 328351 - DNA, 25 bp, Mus musculus
catcctacccttttacagttagcta

SEQ ID NO: 328352 - DNA, 25 bp, Mus musculus
catcctaccttcactgataactgta

SEQ ID NO: 328353 - DNA, 25 bp, Mus musculus
catcctaccttctctgataactgta

SEQ ID NO: 328354 - DNA, 25 bp, Mus musculus
catcctacgggtcggcagcactgtt

SEQ ID NO: 328355 - DNA, 25 bp, Mus musculus
catcctacgggtgggcagcactgtt

SEQ ID NO: 328356 - DNA, 25 bp, Mus musculus
catcctactcagatgcgtatctaca

SEQ ID NO: 328357 - DNA, 25 bp, Mus musculus
catcctactcagttgcgtatctaca

SEQ ID NO: 328358 - DNA, 25 bp, Mus musculus
catcctagaatgatgtactgtttta

SEQ ID NO: 328359 - DNA, 25 bp, Mus musculus
catcctagaatgttgtactgtttta

SEQ ID NO: 328360 - DNA, 25 bp, Mus musculus
catcctagcctgcatctggctgaaa

SEQ ID NO: 328361 - DNA, 25 bp, Mus musculus
catcctagcctggatctggctgaaa

SEQ ID NO: 328362 - DNA, 25 bp, Mus musculus
catcctagtttgatcctttactgta

SEQ ID NO: 328363 - DNA, 25 bp, Mus musculus
catcctagtttgttcctttactgta

SEQ ID NO: 328364 - DNA, 25 bp, Mus musculus
catcctataaggatgttttggcatt

SEQ ID NO: 328365 - DNA, 25 bp, Mus musculus
catcctataaggttgttttggcatt

SEQ ID NO: 328366 - DNA, 25 bp, Mus musculus
catcctatcagaaggccagataaac

SEQ ID NO: 328367 - DNA, 25 bp, Mus musculus
catcctatcagatggccagataaac

SEQ ID NO: 328368 - DNA, 25 bp, Mus musculus
catcctatgtgtattgctgcaagta

SEQ ID NO: 328369 - DNA, 25 bp, Mus musculus
catcctatgtgttttgctgcaagta

SEQ ID NO: 328370 - DNA, 25 bp, Mus musculus
catcctcaaatcctagcaggcacag

SEQ ID NO: 328371 - DNA, 25 bp, Mus musculus
catcctcaaatcgtagcaggcacag

SEQ ID NO: 328372 - DNA, 25 bp, Mus musculus
catcctcaagacacagaaacatcct

SEQ ID NO: 328373 - DNA, 25 bp, Mus musculus
catcctcaagactcagaaacatcct

SEQ ID NO: 328374 - DNA, 25 bp, Mus musculus
catcctcaagtcacgcaaataccaa

SEQ ID NO: 328375 - DNA, 25 bp, Mus musculus
catcctcaagtctcgcaaataccaa

SEQ ID NO: 328376 - DNA, 25 bp, Mus musculus
catcctcacagacctagcacatgat

SEQ ID NO: 328377 - DNA, 25 bp, Mus musculus
catcctcacagagctagcacatgat

SEQ ID NO: 328378 - DNA, 25 bp, Mus musculus
catcctcacaggcatttgggactga

SEQ ID NO: 328379 - DNA, 25 bp, Mus musculus
catcctcacagggatttgggactga

SEQ ID NO: 328380 - DNA, 25 bp, Mus musculus
catcctcagcctacattactaacat

SEQ ID NO: 328381 - DNA, 25 bp, Mus musculus
catcctcagccttcattactaacat

SEQ ID NO: 328382 - DNA, 25 bp, Mus musculus
catcctcagctacgtagtgagttgg

SEQ ID NO: 328383 - DNA, 25 bp, Mus musculus
catcctcagctaggtagtgagttgg

SEQ ID NO: 328384 - DNA, 25 bp, Mus musculus
catcctcagggaaattttgccacta

SEQ ID NO: 328385 - DNA, 25 bp, Mus musculus
catcctcagggatattttgccacta

SEQ ID NO: 328386 - DNA, 25 bp, Mus musculus
catcctcaggtgatcagttgtcatt

SEQ ID NO: 328387 - DNA, 25 bp, Mus musculus
catcctcaggtgttcagttgtcatt

SEQ ID NO: 328388 - DNA, 25 bp, Mus musculus
catcctcataatcctgttttaccag

SEQ ID NO: 328389 - DNA, 25 bp, Mus musculus
catcctcataatgctgttttaccag

SEQ ID NO: 328390 - DNA, 25 bp, Mus musculus
catcctcataccattgcatagtcag

SEQ ID NO: 328391 - DNA, 25 bp, Mus musculus
catcctcatacctttgcatagtcag

SEQ ID NO: 328392 - DNA, 25 bp, Mus musculus
catcctcatagcagtctgcgatgat

SEQ ID NO: 328393 - DNA, 25 bp, Mus musculus
catcctcatagctgtctgcgatgat

SEQ ID NO: 328394 - DNA, 25 bp, Mus musculus
catcctcatggacatgacttccttg

SEQ ID NO: 328395 - DNA, 25 bp, Mus musculus
catcctcatggagatgacttccttg

SEQ ID NO: 328396 - DNA, 25 bp, Mus musculus
catcctcatggcctggagttcttat

SEQ ID NO: 328397 - DNA, 25 bp, Mus musculus
catcctcatggcgtggagttcttat

SEQ ID NO: 328398 - DNA, 25 bp, Mus musculus
catcctcatgtcaaatcagtatgta

SEQ ID NO: 328399 - DNA, 25 bp, Mus musculus
catcctcatgtctaatcagtatgta

SEQ ID NO: 328400 - DNA, 25 bp, Mus musculus
catcctccaagccatatttgtatat

SEQ ID NO: 328401 - DNA, 25 bp, Mus musculus
catcctccaagcgatatttgtatat

SEQ ID NO: 328402 - DNA, 25 bp, Mus musculus
catcctccaggaatccctaatagaa

SEQ ID NO: 328403 - DNA, 25 bp, Mus musculus
catcctccaggattccctaatagaa

SEQ ID NO: 328404 - DNA, 25 bp, Mus musculus
catcctccagtgaggatctcttcaa

SEQ ID NO: 328405 - DNA, 25 bp, Mus musculus
catcctccagtgtggatctcttcaa

SEQ ID NO: 328406 - DNA, 25 bp, Mus musculus
catcctccccttaccaggagaaaga

SEQ ID NO: 328407 - DNA, 25 bp, Mus musculus
catcctcccctttccaggagaaaga

SEQ ID NO: 328408 - DNA, 25 bp, Mus musculus
catcctccgaaactgctggtccagg

SEQ ID NO: 328409 - DNA, 25 bp, Mus musculus
catcctccgaaagtgctggtccagg

SEQ ID NO: 328410 - DNA, 25 bp, Mus musculus
catcctccgtttccatcttaggaaa

SEQ ID NO: 328411 - DNA, 25 bp, Mus musculus
catcctccgtttgcatcttaggaaa

SEQ ID NO: 328412 - DNA, 25 bp, Mus musculus
catcctcctggaccacgaagagtta

SEQ ID NO: 328413 - DNA, 25 bp, Mus musculus
catcctcctggagcacgaagagtta

SEQ ID NO: 328414 - DNA, 25 bp, Mus musculus
catcctccttggcaaggtcaaaggg

SEQ ID NO: 328415 - DNA, 25 bp, Mus musculus
catcctccttgggaaggtcaaaggg

SEQ ID NO: 328416 - DNA, 25 bp, Mus musculus
catcctcgctcccatggcatgggtg

SEQ ID NO: 328417 - DNA, 25 bp, Mus musculus
catcctcgctccgatggcatgggtg

SEQ ID NO: 328418 - DNA, 25 bp, Mus musculus
catcctcgtaccatctttcagaaac

SEQ ID NO: 328419 - DNA, 25 bp, Mus musculus
catcctcgtaccttctttcagaaac

SEQ ID NO: 328420 - DNA, 25 bp, Mus musculus
catcctctacaacctgaaactcggg

SEQ ID NO: 328421 - DNA, 25 bp, Mus musculus
catcctctacaagctgaaactcggg

SEQ ID NO: 328422 - DNA, 25 bp, Mus musculus
catcctctacgcaggtgtatggtag

SEQ ID NO: 328423 - DNA, 25 bp, Mus musculus
catcctctacgctggtgtatggtag

SEQ ID NO: 328424 - DNA, 25 bp, Mus musculus
catcctctagagctctccttgggag

SEQ ID NO: 328425 - DNA, 25 bp, Mus musculus
catcctctagaggtctccttgggag

SEQ ID NO: 328426 - DNA, 25 bp, Mus musculus
catcctctcatgcacactccacttt

SEQ ID NO: 328427 - DNA, 25 bp, Mus musculus
catcctctcatggacactccacttt

SEQ ID NO: 328428 - DNA, 25 bp, Mus musculus
catcctctccctatagaaaaaatct

SEQ ID NO: 328429 - DNA, 25 bp, Mus musculus
catcctctccctttagaaaaaatct

SEQ ID NO: 328430 - DNA, 25 bp, Mus musculus
catcctctctgcagcaatactggga

SEQ ID NO: 328431 - DNA, 25 bp, Mus musculus
catcctctctgctgcaatactggga

SEQ ID NO: 328432 - DNA, 25 bp, Mus musculus
catcctctgttccagactggacatc

SEQ ID NO: 328433 - DNA, 25 bp, Mus musculus
catcctctgttcgagactggacatc

SEQ ID NO: 328434 - DNA, 25 bp, Mus musculus
catcctctgtttctcagatgtctaa

SEQ ID NO: 328435 - DNA, 25 bp, Mus musculus
catcctctgtttgtcagatgtctaa

SEQ ID NO: 328436 - DNA, 25 bp, Mus musculus
catcctcttgttaagtaccagcatc

SEQ ID NO: 328437 - DNA, 25 bp, Mus musculus
catcctcttgtttagtaccagcatc

SEQ ID NO: 328438 - DNA, 25 bp, Mus musculus
catcctctttatacactgactctga

SEQ ID NO: 328439 - DNA, 25 bp, Mus musculus
catcctctttattcactgactctga

SEQ ID NO: 328440 - DNA, 25 bp, Mus musculus
catcctgaaatgcaaccggtctaaa

SEQ ID NO: 328441 - DNA, 25 bp, Mus musculus
catcctgaaatggaaccggtctaaa

SEQ ID NO: 328442 - DNA, 25 bp, Mus musculus
catcctgaaccaagcatgcttgtgt

SEQ ID NO: 328443 - DNA, 25 bp, Mus musculus
catcctgaaccatgcatgcttgtgt

SEQ ID NO: 328444 - DNA, 25 bp, Mus musculus
catcctgaagaacaagcgcgccatc

SEQ ID NO: 328445 - DNA, 25 bp, Mus musculus
catcctgaagaagaagcgcgccatc

SEQ ID NO: 328446 - DNA, 25 bp, Mus musculus
catcctgaagttcccctggtgtcga

SEQ ID NO: 328447 - DNA, 25 bp, Mus musculus
catcctgaagttgccctggtgtcga

SEQ ID NO: 328448 - DNA, 25 bp, Mus musculus
catcctgaattcagtgtctctagca

SEQ ID NO: 328449 - DNA, 25 bp, Mus musculus
catcctgaattctgtgtctctagca

SEQ ID NO: 328450 - DNA, 25 bp, Mus musculus
catcctgactcaagcctgtcagaca

SEQ ID NO: 328451 - DNA, 25 bp, Mus musculus
catcctgactcatgcctgtcagaca

SEQ ID NO: 328452 - DNA, 25 bp, Mus musculus
catcctgagcctctaattgagcata

SEQ ID NO: 328453 - DNA, 25 bp, Mus musculus
catcctgagcctgtaattgagcata

SEQ ID NO: 328454 - DNA, 25 bp, Mus musculus
catcctgagcggcactacttagcga

SEQ ID NO: 328455 - DNA, 25 bp, Mus musculus
catcctgagcgggactacttagcga

SEQ ID NO: 328456 - DNA, 25 bp, Mus musculus
catcctgagctcctactaagattca

SEQ ID NO: 328457 - DNA, 25 bp, Mus musculus
catcctgagctcgtactaagattca

SEQ ID NO: 328458 - DNA, 25 bp, Mus musculus
catcctgaggatcttgtttgttttc

SEQ ID NO: 328459 - DNA, 25 bp, Mus musculus
catcctgaggatgttgtttgttttc

SEQ ID NO: 328460 - DNA, 25 bp, Mus musculus
catcctgagtagaggttctttcttc

SEQ ID NO: 328461 - DNA, 25 bp, Mus musculus
catcctgagtagtggttctttcttc

SEQ ID NO: 328462 - DNA, 25 bp, Mus musculus
catcctgagtcgctagggccccgag

SEQ ID NO: 328463 - DNA, 25 bp, Mus musculus
catcctgagtcggtagggccccgag

SEQ ID NO: 328464 - DNA, 25 bp, Mus musculus
catcctgagtgcctgcagtgagcag

SEQ ID NO: 328465 - DNA, 25 bp, Mus musculus
catcctgagtgcgtgcagtgagcag

SEQ ID NO: 328466 - DNA, 25 bp, Mus musculus
catcctgatgtgatgcttgttctta

SEQ ID NO: 328467 - DNA, 25 bp, Mus musculus
catcctgatgtgttgcttgttctta

SEQ ID NO: 328468 - DNA, 25 bp, Mus musculus
catcctgattagatctgatgtcctc

SEQ ID NO: 328469 - DNA, 25 bp, Mus musculus
catcctgattagttctgatgtcctc

SEQ ID NO: 328470 - DNA, 25 bp, Mus musculus
catcctgattgtcactgggatcaaa

SEQ ID NO: 328471 - DNA, 25 bp, Mus musculus
catcctgattgtgactgggatcaaa

SEQ ID NO: 328472 - DNA, 25 bp, Mus musculus
catcctgatttacagtttcctaccc

SEQ ID NO: 328473 - DNA, 25 bp, Mus musculus
catcctgatttagagtttcctaccc

SEQ ID NO: 328474 - DNA, 25 bp, Mus musculus
catcctgcagcaccgctacgaaggg

SEQ ID NO: 328475 - DNA, 25 bp, Mus musculus
catcctgcagcagcgctacgaaggg

SEQ ID NO: 328476 - DNA, 25 bp, Mus musculus
catcctgcagtgattgggcctggct

SEQ ID NO: 328477 - DNA, 25 bp, Mus musculus
catcctgcagtgtttgggcctggct

SEQ ID NO: 328478 - DNA, 25 bp, Mus musculus
catcctgcatgtctgtagcgttagg

SEQ ID NO: 328479 - DNA, 25 bp, Mus musculus
catcctgcatgtgtgtagcgttagg

SEQ ID NO: 328480 - DNA, 25 bp, Mus musculus
catcctgcgtgtaacctgaagttct

SEQ ID NO: 328481 - DNA, 25 bp, Mus musculus
catcctgcgtgttacctgaagttct

SEQ ID NO: 328482 - DNA, 25 bp, Mus musculus
catcctgctaggctccactggaaag

SEQ ID NO: 328483 - DNA, 25 bp, Mus musculus
catcctgctagggtccactggaaag

SEQ ID NO: 328484 - DNA, 25 bp, Mus musculus
catcctgctggtaggaatgcggcta

SEQ ID NO: 328485 - DNA, 25 bp, Mus musculus
catcctgctggttggaatgcggcta

SEQ ID NO: 328486 - DNA, 25 bp, Mus musculus
catcctgctttcctaagcatctgaa

SEQ ID NO: 328487 - DNA, 25 bp, Mus musculus
catcctgctttcgtaagcatctgaa

SEQ ID NO: 328488 - DNA, 25 bp, Mus musculus
catcctggacagcagttagctgcca

SEQ ID NO: 328489 - DNA, 25 bp, Mus musculus
catcctggacaggagttagctgcca

SEQ ID NO: 328490 - DNA, 25 bp, Mus musculus
catcctggccaacctcgagaagtac

SEQ ID NO: 328491 - DNA, 25 bp, Mus musculus
catcctggccaagctcgagaagtac

SEQ ID NO: 328492 - DNA, 25 bp, Mus musculus
catcctggcgttactgtggacaagt

SEQ ID NO: 328493 - DNA, 25 bp, Mus musculus
catcctggcgtttctgtggacaagt

SEQ ID NO: 328494 - DNA, 25 bp, Mus musculus
catcctgggacaaacactggctggt

SEQ ID NO: 328495 - DNA, 25 bp, Mus musculus
catcctgggacatacactggctggt

SEQ ID NO: 328496 - DNA, 25 bp, Mus musculus
catcctgggcaactgaccacaacta

SEQ ID NO: 328497 - DNA, 25 bp, Mus musculus
catcctgggcaagtgaccacaacta

SEQ ID NO: 328498 - DNA, 25 bp, Mus musculus
catcctgggcttctggctttattca

SEQ ID NO: 328499 - DNA, 25 bp, Mus musculus
catcctgggcttgtggctttattca

SEQ ID NO: 328500 - DNA, 25 bp, Mus musculus
catcctggtgacactgttgtcagac

SEQ ID NO: 328501 - DNA, 25 bp, Mus musculus
catcctggtgactctgttgtcagac

SEQ ID NO: 328502 - DNA, 25 bp, Mus musculus
catcctggttggactgggactgtat

SEQ ID NO: 328503 - DNA, 25 bp, Mus musculus
catcctggttggtctgggactgtat

SEQ ID NO: 328504 - DNA, 25 bp, Mus musculus
catcctgtaaaccaggtggcttcca

SEQ ID NO: 328505 - DNA, 25 bp, Mus musculus
catcctgtaaacgaggtggcttcca

SEQ ID NO: 328506 - DNA, 25 bp, Mus musculus
catcctgtaacacctttcattttga

SEQ ID NO: 328507 - DNA, 25 bp, Mus musculus
catcctgtaacagctttcattttga

SEQ ID NO: 328508 - DNA, 25 bp, Mus musculus
catcctgtagtccatgggtgctagg

SEQ ID NO: 328509 - DNA, 25 bp, Mus musculus
catcctgtagtcgatgggtgctagg

SEQ ID NO: 328510 - DNA, 25 bp, Mus musculus
catcctgtatatcgccaaccttgga

SEQ ID NO: 328511 - DNA, 25 bp, Mus musculus
catcctgtatatggccaaccttgga

SEQ ID NO: 328512 - DNA, 25 bp, Mus musculus
catcctgtcggtaatatttatctta

SEQ ID NO: 328513 - DNA, 25 bp, Mus musculus
catcctgtcggttatatttatctta

SEQ ID NO: 328514 - DNA, 25 bp, Mus musculus
catcctgtgtggacagatttctcag

SEQ ID NO: 328515 - DNA, 25 bp, Mus musculus
catcctgtgtggtcagatttctcag

SEQ ID NO: 328516 - DNA, 25 bp, Mus musculus
catcctgtgtttcaagccccttagg

SEQ ID NO: 328517 - DNA, 25 bp, Mus musculus
catcctgtgtttgaagccccttagg

SEQ ID NO: 328518 - DNA, 25 bp, Mus musculus
catcctgttacaagggaccgtctta

SEQ ID NO: 328519 - DNA, 25 bp, Mus musculus
catcctgttacatgggaccgtctta

SEQ ID NO: 328520 - DNA, 25 bp, Mus musculus
catcctgtttatcgccactgtgcta

SEQ ID NO: 328521 - DNA, 25 bp, Mus musculus
catcctgtttatggccactgtgcta

SEQ ID NO: 328522 - DNA, 25 bp, Mus musculus
catcctgtttgaaatgtggctctaa

SEQ ID NO: 328523 - DNA, 25 bp, Mus musculus
catcctgtttgatatgtggctctaa

SEQ ID NO: 328524 - DNA, 25 bp, Mus musculus
catcctgtttggaaattctaccata

SEQ ID NO: 328525 - DNA, 25 bp, Mus musculus
catcctgtttggtaattctaccata

SEQ ID NO: 328526 - DNA, 25 bp, Mus musculus
catccttaaagcagtctgggtattc

SEQ ID NO: 328527 - DNA, 25 bp, Mus musculus
catccttaaagctgtctgggtattc

SEQ ID NO: 328528 - DNA, 25 bp, Mus musculus
catccttaactccttcatctaggtt

SEQ ID NO: 328529 - DNA, 25 bp, Mus musculus
catccttaactcgttcatctaggtt

SEQ ID NO: 328530 - DNA, 25 bp, Mus musculus
catccttaaggaatgactgcttctg

SEQ ID NO: 328531 - DNA, 25 bp, Mus musculus
catccttaaggattgactgcttctg

SEQ ID NO: 328532 - DNA, 25 bp, Mus musculus
catccttaccagatgatttgttgaa

SEQ ID NO: 328533 - DNA, 25 bp, Mus musculus
catccttaccagttgatttgttgaa

SEQ ID NO: 328534 - DNA, 25 bp, Mus musculus
catccttagagtctctctgtgtctg

SEQ ID NO: 328535 - DNA, 25 bp, Mus musculus
catccttagagtgtctctgtgtctg

SEQ ID NO: 328536 - DNA, 25 bp, Mus musculus
catccttaggcaaccatttacttgg

SEQ ID NO: 328537 - DNA, 25 bp, Mus musculus
catccttaggcatccatttacttgg

SEQ ID NO: 328538 - DNA, 25 bp, Mus musculus
catccttaggctatggaattccatt

SEQ ID NO: 328539 - DNA, 25 bp, Mus musculus
catccttaggctttggaattccatt

SEQ ID NO: 328540 - DNA, 25 bp, Mus musculus
catccttagtaacccgagcgtggct

SEQ ID NO: 328541 - DNA, 25 bp, Mus musculus
catccttagtaagccgagcgtggct

SEQ ID NO: 328542 - DNA, 25 bp, Mus musculus
catccttatggaatcacaagagtaa

SEQ ID NO: 328543 - DNA, 25 bp, Mus musculus
catccttatggattcacaagagtaa

SEQ ID NO: 328544 - DNA, 25 bp, Mus musculus
catccttattgtacagtttagcttt

SEQ ID NO: 328545 - DNA, 25 bp, Mus musculus
catccttattgttcagtttagcttt

SEQ ID NO: 328546 - DNA, 25 bp, Mus musculus
catccttcaacgagtttatctctgg

SEQ ID NO: 328547 - DNA, 25 bp, Mus musculus
catccttcaacgtgtttatctctgg

SEQ ID NO: 328548 - DNA, 25 bp, Mus musculus
catccttcaaggacaacgacacgaa

SEQ ID NO: 328549 - DNA, 25 bp, Mus musculus
catccttcaaggtcaacgacacgaa

SEQ ID NO: 328550 - DNA, 25 bp, Mus musculus
catccttcagagaccaactagctag

SEQ ID NO: 328551 - DNA, 25 bp, Mus musculus
catccttcagagtccaactagctag

SEQ ID NO: 328552 - DNA, 25 bp, Mus musculus
catccttcagcaaggcgcatttgga

SEQ ID NO: 328553 - DNA, 25 bp, Mus musculus
catccttcagcatggcgcatttgga

SEQ ID NO: 328554 - DNA, 25 bp, Mus musculus
catccttcatccaggttatagagtg

SEQ ID NO: 328555 - DNA, 25 bp, Mus musculus
catccttcatcctggttatagagtg

SEQ ID NO: 328556 - DNA, 25 bp, Mus musculus
catccttcccagagggaggaggata

SEQ ID NO: 328557 - DNA, 25 bp, Mus musculus
catccttcccagtgggaggaggata

SEQ ID NO: 328558 - DNA, 25 bp, Mus musculus
catccttccctacacatttttgtga

SEQ ID NO: 328559 - DNA, 25 bp, Mus musculus
catccttccctagacatttttgtga

SEQ ID NO: 328560 - DNA, 25 bp, Mus musculus
catccttccggtaggtaacaatcta

SEQ ID NO: 328561 - DNA, 25 bp, Mus musculus
catccttccggttggtaacaatcta

SEQ ID NO: 328562 - DNA, 25 bp, Mus musculus
catccttcctatctctggaatatag

SEQ ID NO: 328563 - DNA, 25 bp, Mus musculus
catccttcctatgtctggaatatag

SEQ ID NO: 328564 - DNA, 25 bp, Mus musculus
catccttctcttatgtggttgtgtg

SEQ ID NO: 328565 - DNA, 25 bp, Mus musculus
catccttctcttttgtggttgtgtg

SEQ ID NO: 328566 - DNA, 25 bp, Mus musculus
catccttctgatccactagtgttaa

SEQ ID NO: 328567 - DNA, 25 bp, Mus musculus
catccttctgatgcactagtgttaa

SEQ ID NO: 328568 - DNA, 25 bp, Mus musculus
catccttctggaaccgttaagccaa

SEQ ID NO: 328569 - DNA, 25 bp, Mus musculus
catccttctggatccgttaagccaa

SEQ ID NO: 328570 - DNA, 25 bp, Mus musculus
catccttctgtaattccctttttat

SEQ ID NO: 328571 - DNA, 25 bp, Mus musculus
catccttctgtatttccctttttat

SEQ ID NO: 328572 - DNA, 25 bp, Mus musculus
catccttcttccattgcctagaaaa

SEQ ID NO: 328573 - DNA, 25 bp, Mus musculus
catccttcttcctttgcctagaaaa

SEQ ID NO: 328574 - DNA, 25 bp, Mus musculus
catccttgaaccatcatgtctaggc

SEQ ID NO: 328575 - DNA, 25 bp, Mus musculus
catccttgaaccttcatgtctaggc

SEQ ID NO: 328576 - DNA, 25 bp, Mus musculus
catccttgagttcctgttctaagtg

SEQ ID NO: 328577 - DNA, 25 bp, Mus musculus
catccttgagttgctgttctaagtg

SEQ ID NO: 328578 - DNA, 25 bp, Mus musculus
catccttggctacagttagttagga

SEQ ID NO: 328579 - DNA, 25 bp, Mus musculus
catccttggctagagttagttagga

SEQ ID NO: 328580 - DNA, 25 bp, Mus musculus
catccttggctgcagccgcaagaat

SEQ ID NO: 328581 - DNA, 25 bp, Mus musculus
catccttggctggagccgcaagaat

SEQ ID NO: 328582 - DNA, 25 bp, Mus musculus
catccttgggatctctttctgagaa

SEQ ID NO: 328583 - DNA, 25 bp, Mus musculus
catccttgggatgtctttctgagaa

SEQ ID NO: 328584 - DNA, 25 bp, Mus musculus
catccttgggctaactttgctgtta

SEQ ID NO: 328585 - DNA, 25 bp, Mus musculus
catccttgggcttactttgctgtta

SEQ ID NO: 328586 - DNA, 25 bp, Mus musculus
catccttggtataggtcagtccttt

SEQ ID NO: 328587 - DNA, 25 bp, Mus musculus
catccttggtattggtcagtccttt

SEQ ID NO: 328588 - DNA, 25 bp, Mus musculus
catccttgtcttagtattattgtac

SEQ ID NO: 328589 - DNA, 25 bp, Mus musculus
catccttgtctttgtattattgtac

SEQ ID NO: 328590 - DNA, 25 bp, Mus musculus
catcctttcctgaaactaggcttag

SEQ ID NO: 328591 - DNA, 25 bp, Mus musculus
catcctttcctgtaactaggcttag

SEQ ID NO: 328592 - DNA, 25 bp, Mus musculus
catcctttccttcgattggcataac

SEQ ID NO: 328593 - DNA, 25 bp, Mus musculus
catcctttccttggattggcataac

SEQ ID NO: 328594 - DNA, 25 bp, Mus musculus
catcctttctatcaccattcaattt

SEQ ID NO: 328595 - DNA, 25 bp, Mus musculus
catcctttctatgaccattcaattt

SEQ ID NO: 328596 - DNA, 25 bp, Mus musculus
catcctttctcaccgggtgtatcaa

SEQ ID NO: 328597 - DNA, 25 bp, Mus musculus
catcctttctcagcgggtgtatcaa

SEQ ID NO: 328598 - DNA, 25 bp, Mus musculus
catcctttctgaatgggcacttcta

SEQ ID NO: 328599 - DNA, 25 bp, Mus musculus
catcctttctgattgggcacttcta

SEQ ID NO: 328600 - DNA, 25 bp, Mus musculus
catcctttcttactgagacctggtc

SEQ ID NO: 328601 - DNA, 25 bp, Mus musculus
catcctttcttagtgagacctggtc

SEQ ID NO: 328602 - DNA, 25 bp, Mus musculus
catcctttcttgaattatccagtga

SEQ ID NO: 328603 - DNA, 25 bp, Mus musculus
catcctttcttgtattatccagtga

SEQ ID NO: 328604 - DNA, 25 bp, Mus musculus
catcctttgaggcaagtgttccctt

SEQ ID NO: 328605 - DNA, 25 bp, Mus musculus
catcctttgagggaagtgttccctt

SEQ ID NO: 328606 - DNA, 25 bp, Mus musculus
catcctttgccaaggtggttacaag

SEQ ID NO: 328607 - DNA, 25 bp, Mus musculus
catcctttgccatggtggttacaag

SEQ ID NO: 328608 - DNA, 25 bp, Mus musculus
catcctttgctcatagtaaaatgtg

SEQ ID NO: 328609 - DNA, 25 bp, Mus musculus
catcctttgctcttagtaaaatgtg

SEQ ID NO: 328610 - DNA, 25 bp, Mus musculus
catcctttggagcttcttggttttt

SEQ ID NO: 328611 - DNA, 25 bp, Mus musculus
catcctttggaggttcttggttttt

SEQ ID NO: 328612 - DNA, 25 bp, Mus musculus
catcctttggtaagcgtcgcaacaa

SEQ ID NO: 328613 - DNA, 25 bp, Mus musculus
catcctttggtatgcgtcgcaacaa

SEQ ID NO: 328614 - DNA, 25 bp, Mus musculus
catcctttggtgaagcagctcatct

SEQ ID NO: 328615 - DNA, 25 bp, Mus musculus
catcctttggtgtagcagctcatct

SEQ ID NO: 328616 - DNA, 25 bp, Mus musculus
catccttttcaaccacactctaaat

SEQ ID NO: 328617 - DNA, 25 bp, Mus musculus
catccttttcaagcacactctaaat

SEQ ID NO: 328618 - DNA, 25 bp, Mus musculus
catccttttcttccttctaagatat

SEQ ID NO: 328619 - DNA, 25 bp, Mus musculus
catccttttcttgcttctaagatat

SEQ ID NO: 328620 - DNA, 25 bp, Mus musculus
catccttttggcatagtttgcataa

SEQ ID NO: 328621 - DNA, 25 bp, Mus musculus
catccttttggcttagtttgcataa

SEQ ID NO: 328622 - DNA, 25 bp, Mus musculus
catccttttgtaatcccactgagta

SEQ ID NO: 328623 - DNA, 25 bp, Mus musculus
catccttttgtattcccactgagta

SEQ ID NO: 328624 - DNA, 25 bp, Mus musculus
catcctttttatcacattctcaggg

SEQ ID NO: 328625 - DNA, 25 bp, Mus musculus
catcctttttatgacattctcaggg

SEQ ID NO: 328626 - DNA, 25 bp, Mus musculus
catcctttttctctctagatccaac

SEQ ID NO: 328627 - DNA, 25 bp, Mus musculus
catcctttttctgtctagatccaac

SEQ ID NO: 328628 - DNA, 25 bp, Mus musculus
catcgaacatccacgaactggctgg

SEQ ID NO: 328629 - DNA, 25 bp, Mus musculus
catcgaacatcctcgaactggctgg

SEQ ID NO: 328630 - DNA, 25 bp, Mus musculus
catcgaatgtccaagaactgcagtt

SEQ ID NO: 328631 - DNA, 25 bp, Mus musculus
catcgaatgtcctagaactgcagtt

SEQ ID NO: 328632 - DNA, 25 bp, Mus musculus
catcgaattttgatgtgtcctccct

SEQ ID NO: 328633 - DNA, 25 bp, Mus musculus
catcgaattttgttgtgtcctccct

SEQ ID NO: 328634 - DNA, 25 bp, Mus musculus
catcgacactcactactacctggag

SEQ ID NO: 328635 - DNA, 25 bp, Mus musculus
catcgacactcagtactacctggag

SEQ ID NO: 328636 - DNA, 25 bp, Mus musculus
catcgacatgtcaagcactcaggag

SEQ ID NO: 328637 - DNA, 25 bp, Mus musculus
catcgacatgtctagcactcaggag

SEQ ID NO: 328638 - DNA, 25 bp, Mus musculus
catcgaccattgaataaccggcttc

SEQ ID NO: 328639 - DNA, 25 bp, Mus musculus
catcgaccattgtataaccggcttc

SEQ ID NO: 328640 - DNA, 25 bp, Mus musculus
catcgaccgctgcttgtctgagaat

SEQ ID NO: 328641 - DNA, 25 bp, Mus musculus
catcgaccgctggttgtctgagaat

SEQ ID NO: 328642 - DNA, 25 bp, Mus musculus
catcgacgctcgattgagcgggctt

SEQ ID NO: 328643 - DNA, 25 bp, Mus musculus
catcgacgctcgtttgagcgggctt

SEQ ID NO: 328644 - DNA, 25 bp, Mus musculus
catcgactgctaaaaggtttctggt

SEQ ID NO: 328645 - DNA, 25 bp, Mus musculus
catcgactgctataaggtttctggt

SEQ ID NO: 328646 - DNA, 25 bp, Mus musculus
catcgacttcagaagcagcgcagga

SEQ ID NO: 328647 - DNA, 25 bp, Mus musculus
catcgacttcagtagcagcgcagga

SEQ ID NO: 328648 - DNA, 25 bp, Mus musculus
catcgagaagatcctggccaccaca

SEQ ID NO: 328649 - DNA, 25 bp, Mus musculus
catcgagaagatgctggccaccaca

SEQ ID NO: 328650 - DNA, 25 bp, Mus musculus
catcgagatgtaccgagacctcttc

SEQ ID NO: 328651 - DNA, 25 bp, Mus musculus
catcgagatgtagcgagacctcttc

SEQ ID NO: 328652 - DNA, 25 bp, Mus musculus
catcgagcaggacctgtgtaatgaa

SEQ ID NO: 328653 - DNA, 25 bp, Mus musculus
catcgagcaggagctgtgtaatgaa

SEQ ID NO: 328654 - DNA, 25 bp, Mus musculus
catcgagcaggtattcaggtctttc

SEQ ID NO: 328655 - DNA, 25 bp, Mus musculus
catcgagcaggttttcaggtctttc

SEQ ID NO: 328656 - DNA, 25 bp, Mus musculus
catcgagccaagcagagccaggcga

SEQ ID NO: 328657 - DNA, 25 bp, Mus musculus
catcgagccaaggagagccaggcga

SEQ ID NO: 328658 - DNA, 25 bp, Mus musculus
catcgagcttcacatcagagaactt

SEQ ID NO: 328659 - DNA, 25 bp, Mus musculus
catcgagcttcagatcagagaactt

SEQ ID NO: 328660 - DNA, 25 bp, Mus musculus
catcgaggaatacttcaagtgcaag

SEQ ID NO: 328661 - DNA, 25 bp, Mus musculus
catcgaggaatagttcaagtgcaag

SEQ ID NO: 328662 - DNA, 25 bp, Mus musculus
catcgaggacgacctgatcttccga

SEQ ID NO: 328663 - DNA, 25 bp, Mus musculus
catcgaggacgagctgatcttccga

SEQ ID NO: 328664 - DNA, 25 bp, Mus musculus
catcgaggaggtcctagcctggcaa

SEQ ID NO: 328665 - DNA, 25 bp, Mus musculus
catcgaggaggtgctagcctggcaa

SEQ ID NO: 328666 - DNA, 25 bp, Mus musculus
catcgagggtatattccactgaaag

SEQ ID NO: 328667 - DNA, 25 bp, Mus musculus
catcgagggtattttccactgaaag

SEQ ID NO: 328668 - DNA, 25 bp, Mus musculus
catcgaggttggagcatttgaagct

SEQ ID NO: 328669 - DNA, 25 bp, Mus musculus
catcgaggttggtgcatttgaagct

SEQ ID NO: 328670 - DNA, 25 bp, Mus musculus
catcgagtaacaactgcatcaggcc

SEQ ID NO: 328671 - DNA, 25 bp, Mus musculus
catcgagtaacatctgcatcaggcc

SEQ ID NO: 328672 - DNA, 25 bp, Mus musculus
catcgagtactgcattgtccgaaat

SEQ ID NO: 328673 - DNA, 25 bp, Mus musculus
catcgagtactggattgtccgaaat

SEQ ID NO: 328674 - DNA, 25 bp, Mus musculus
catcgatccagcaccagatttattt

SEQ ID NO: 328675 - DNA, 25 bp, Mus musculus
catcgatccagctccagatttattt

SEQ ID NO: 328676 - DNA, 25 bp, Mus musculus
catcgatccgtcagtggtcagtgcg

SEQ ID NO: 328677 - DNA, 25 bp, Mus musculus
catcgatccgtctgtggtcagtgcg

SEQ ID NO: 328678 - DNA, 25 bp, Mus musculus
catcgatctgatattttacccttta

SEQ ID NO: 328679 - DNA, 25 bp, Mus musculus
catcgatctgattttttacccttta

SEQ ID NO: 328680 - DNA, 25 bp, Mus musculus
catcgatgaggaaacatgcttaata

SEQ ID NO: 328681 - DNA, 25 bp, Mus musculus
catcgatgaggatacatgcttaata

SEQ ID NO: 328682 - DNA, 25 bp, Mus musculus
catcgatggtagatcagttctgctt

SEQ ID NO: 328683 - DNA, 25 bp, Mus musculus
catcgatggtagttcagttctgctt

SEQ ID NO: 328684 - DNA, 25 bp, Mus musculus
catcgatgttgtatttataaccttc

SEQ ID NO: 328685 - DNA, 25 bp, Mus musculus
catcgatgttgtttttataaccttc

SEQ ID NO: 328686 - DNA, 25 bp, Mus musculus
catcgcaaggagcatcaggactcat

SEQ ID NO: 328687 - DNA, 25 bp, Mus musculus
catcgcaaggaggatcaggactcat

SEQ ID NO: 328688 - DNA, 25 bp, Mus musculus
catcgcagagaacagccggagtccg

SEQ ID NO: 328689 - DNA, 25 bp, Mus musculus
catcgcagagaagagccggagtccg

SEQ ID NO: 328690 - DNA, 25 bp, Mus musculus
catcgcagagctactcattgtggct

SEQ ID NO: 328691 - DNA, 25 bp, Mus musculus
catcgcagagcttctcattgtggct

SEQ ID NO: 328692 - DNA, 25 bp, Mus musculus
catcgcagcatcatttattctggca

SEQ ID NO: 328693 - DNA, 25 bp, Mus musculus
catcgcagcatcttttattctggca

SEQ ID NO: 328694 - DNA, 25 bp, Mus musculus
catcgcaggatcactgtttctcaaa

SEQ ID NO: 328695 - DNA, 25 bp, Mus musculus
catcgcaggatctctgtttctcaaa

SEQ ID NO: 328696 - DNA, 25 bp, Mus musculus
catcgcataaaacttacctagccct

SEQ ID NO: 328697 - DNA, 25 bp, Mus musculus
catcgcataaaagttacctagccct

SEQ ID NO: 328698 - DNA, 25 bp, Mus musculus
catcgcatagaaccttccctgtaac

SEQ ID NO: 328699 - DNA, 25 bp, Mus musculus
catcgcatagaagcttccctgtaac

SEQ ID NO: 328700 - DNA, 25 bp, Mus musculus
catcgccatcatctgtgaagtctaa

SEQ ID NO: 328701 - DNA, 25 bp, Mus musculus
catcgccatcatgtgtgaagtctaa

SEQ ID NO: 328702 - DNA, 25 bp, Mus musculus
catcgccatgccagtgctcctggaa

SEQ ID NO: 328703 - DNA, 25 bp, Mus musculus
catcgccatgcctgtgctcctggaa

SEQ ID NO: 328704 - DNA, 25 bp, Mus musculus
catcgccatggcaggaatgccgtcc

SEQ ID NO: 328705 - DNA, 25 bp, Mus musculus
catcgccatggctggaatgccgtcc

SEQ ID NO: 328706 - DNA, 25 bp, Mus musculus
catcgccatgttagttagctgtcaa

SEQ ID NO: 328707 - DNA, 25 bp, Mus musculus
catcgccatgtttgttagctgtcaa

SEQ ID NO: 328708 - DNA, 25 bp, Mus musculus
catcgcccaggtctagcttgttaat

SEQ ID NO: 328709 - DNA, 25 bp, Mus musculus
catcgcccaggtgtagcttgttaat

SEQ ID NO: 328710 - DNA, 25 bp, Mus musculus
catcgccctgtgcttcacgctggat

SEQ ID NO: 328711 - DNA, 25 bp, Mus musculus
catcgccctgtggttcacgctggat

SEQ ID NO: 328712 - DNA, 25 bp, Mus musculus
catcgccgaatcagtgttcatgaat

SEQ ID NO: 328713 - DNA, 25 bp, Mus musculus
catcgccgaatctgtgttcatgaat

SEQ ID NO: 328714 - DNA, 25 bp, Mus musculus
catcgcctacgtcctctataaaaag

SEQ ID NO: 328715 - DNA, 25 bp, Mus musculus
catcgcctacgtgctctataaaaag

SEQ ID NO: 328716 - DNA, 25 bp, Mus musculus
catcgcctgcatctgtattgaagag

SEQ ID NO: 328717 - DNA, 25 bp, Mus musculus
catcgcctgcatgtgtattgaagag

SEQ ID NO: 328718 - DNA, 25 bp, Mus musculus
catcgcctgctcatggaatttgaca

SEQ ID NO: 328719 - DNA, 25 bp, Mus musculus
catcgcctgctcttggaatttgaca

SEQ ID NO: 328720 - DNA, 25 bp, Mus musculus
catcgccttgctctgtggttgaggt

SEQ ID NO: 328721 - DNA, 25 bp, Mus musculus
catcgccttgctgtgtggttgaggt

SEQ ID NO: 328722 - DNA, 25 bp, Mus musculus
catcgcgtgtttaggctggttacgg

SEQ ID NO: 328723 - DNA, 25 bp, Mus musculus
catcgcgtgttttggctggttacgg

SEQ ID NO: 328724 - DNA, 25 bp, Mus musculus
catcgctcagggagttggcaagctg

SEQ ID NO: 328725 - DNA, 25 bp, Mus musculus
catcgctcagggtgttggcaagctg

SEQ ID NO: 328726 - DNA, 25 bp, Mus musculus
catcgcttacccctatgttactgaa

SEQ ID NO: 328727 - DNA, 25 bp, Mus musculus
catcgcttacccgtatgttactgaa

SEQ ID NO: 328728 - DNA, 25 bp, Mus musculus
catcgctttcttctatcttttatat

SEQ ID NO: 328729 - DNA, 25 bp, Mus musculus
catcgctttcttgtatcttttatat

SEQ ID NO: 328730 - DNA, 25 bp, Mus musculus
catcggaataagaagcattacctat

SEQ ID NO: 328731 - DNA, 25 bp, Mus musculus
catcggaataagtagcattacctat

SEQ ID NO: 328732 - DNA, 25 bp, Mus musculus
catcggacggccagttgtggtgaaa

SEQ ID NO: 328733 - DNA, 25 bp, Mus musculus
catcggacggcctgttgtggtgaaa

SEQ ID NO: 328734 - DNA, 25 bp, Mus musculus
catcggagcgctctgtgatacttca

SEQ ID NO: 328735 - DNA, 25 bp, Mus musculus
catcggagcgctgtgtgatacttca

SEQ ID NO: 328736 - DNA, 25 bp, Mus musculus
catcggatagacatgggtttgccac

SEQ ID NO: 328737 - DNA, 25 bp, Mus musculus
catcggatagacttgggtttgccac

SEQ ID NO: 328738 - DNA, 25 bp, Mus musculus
catcggatgaggcactctgttctga

SEQ ID NO: 328739 - DNA, 25 bp, Mus musculus
catcggatgagggactctgttctga

SEQ ID NO: 328740 - DNA, 25 bp, Mus musculus
catcggcttccgagctggagtaaag

SEQ ID NO: 328741 - DNA, 25 bp, Mus musculus
catcggcttccgtgctggagtaaag

SEQ ID NO: 328742 - DNA, 25 bp, Mus musculus
catcggcttgcgatttagtcttagt

SEQ ID NO: 328743 - DNA, 25 bp, Mus musculus
catcggcttgcgttttagtcttagt

SEQ ID NO: 328744 - DNA, 25 bp, Mus musculus
catcggctttatccctcaatgagag

SEQ ID NO: 328745 - DNA, 25 bp, Mus musculus
catcggctttatgcctcaatgagag

SEQ ID NO: 328746 - DNA, 25 bp, Mus musculus
catcgggacactatatttcctcagg

SEQ ID NO: 328747 - DNA, 25 bp, Mus musculus
catcgggacactttatttcctcagg

SEQ ID NO: 328748 - DNA, 25 bp, Mus musculus
catcgggacgctcgctgtgtttgca

SEQ ID NO: 328749 - DNA, 25 bp, Mus musculus
catcgggacgctggctgtgtttgca

SEQ ID NO: 328750 - DNA, 25 bp, Mus musculus
catcgggaggctatagtgcctggat

SEQ ID NO: 328751 - DNA, 25 bp, Mus musculus
catcgggaggctttagtgcctggat

SEQ ID NO: 328752 - DNA, 25 bp, Mus musculus
catcgggattgcctctgtagaaaca

SEQ ID NO: 328753 - DNA, 25 bp, Mus musculus
catcgggattgcgtctgtagaaaca

SEQ ID NO: 328754 - DNA, 25 bp, Mus musculus
catcgggctcaaccacacgggcgtg

SEQ ID NO: 328755 - DNA, 25 bp, Mus musculus
catcgggctcaagcacacgggcgtg

SEQ ID NO: 328756 - DNA, 25 bp, Mus musculus
catcgggctctgatttactcgagtt

SEQ ID NO: 328757 - DNA, 25 bp, Mus musculus
catcgggctctgttttactcgagtt

SEQ ID NO: 328758 - DNA, 25 bp, Mus musculus
catcgggctgacatcttctttatga

SEQ ID NO: 328759 - DNA, 25 bp, Mus musculus
catcgggctgacttcttctttatga

SEQ ID NO: 328760 - DNA, 25 bp, Mus musculus
catcggggacctatctctaaaagtg

SEQ ID NO: 328761 - DNA, 25 bp, Mus musculus
catcggggacctttctctaaaagtg

SEQ ID NO: 328762 - DNA, 25 bp, Mus musculus
catcgggtcaaccagtcacgtttta

SEQ ID NO: 328763 - DNA, 25 bp, Mus musculus
catcgggtcaacgagtcacgtttta

SEQ ID NO: 328764 - DNA, 25 bp, Mus musculus
catcggtcatagatgtggcctggtg

SEQ ID NO: 328765 - DNA, 25 bp, Mus musculus
catcggtcatagttgtggcctggtg

SEQ ID NO: 328766 - DNA, 25 bp, Mus musculus
catcggtggcttcagacttgatata

SEQ ID NO: 328767 - DNA, 25 bp, Mus musculus
catcggtggcttgagacttgatata

SEQ ID NO: 328768 - DNA, 25 bp, Mus musculus
catcggtgggaacaatcctctcatt

SEQ ID NO: 328769 - DNA, 25 bp, Mus musculus
catcggtgggaagaatcctctcatt

SEQ ID NO: 328770 - DNA, 25 bp, Mus musculus
catcggtgtaggcaagaatctggac

SEQ ID NO: 328771 - DNA, 25 bp, Mus musculus
catcggtgtagggaagaatctggac

SEQ ID NO: 328772 - DNA, 25 bp, Mus musculus
catcggtgtcccctgtggccaaggt

SEQ ID NO: 328773 - DNA, 25 bp, Mus musculus
catcggtgtcccgtgtggccaaggt

SEQ ID NO: 328774 - DNA, 25 bp, Mus musculus
catcggtgttaaaggccactctggg

SEQ ID NO: 328775 - DNA, 25 bp, Mus musculus
catcggtgttaatggccactctggg

SEQ ID NO: 328776 - DNA, 25 bp, Mus musculus
catcggttacagaagtatgtgtctt

SEQ ID NO: 328777 - DNA, 25 bp, Mus musculus
catcggttacagtagtatgtgtctt

SEQ ID NO: 328778 - DNA, 25 bp, Mus musculus
catcggttccaacctttacgaaaga

SEQ ID NO: 328779 - DNA, 25 bp, Mus musculus
catcggttccaagctttacgaaaga

SEQ ID NO: 328780 - DNA, 25 bp, Mus musculus
catcggttgccgaggtctggaaact

SEQ ID NO: 328781 - DNA, 25 bp, Mus musculus
catcggttgccgtggtctggaaact

SEQ ID NO: 328782 - DNA, 25 bp, Mus musculus
catcgtaacgcacggctgtaagtct

SEQ ID NO: 328783 - DNA, 25 bp, Mus musculus
catcgtaacgcagggctgtaagtct

SEQ ID NO: 328784 - DNA, 25 bp, Mus musculus
catcgtaaggttccgtgtatttcaa

SEQ ID NO: 328785 - DNA, 25 bp, Mus musculus
catcgtaaggttgcgtgtatttcaa

SEQ ID NO: 328786 - DNA, 25 bp, Mus musculus
catcgtatagttagagggcctctgc

SEQ ID NO: 328787 - DNA, 25 bp, Mus musculus
catcgtatagtttgagggcctctgc

SEQ ID NO: 328788 - DNA, 25 bp, Mus musculus
catcgtattggaaaaggccacatct

SEQ ID NO: 328789 - DNA, 25 bp, Mus musculus
catcgtattggataaggccacatct

SEQ ID NO: 328790 - DNA, 25 bp, Mus musculus
catcgtcagattccaatcctgtgtt

SEQ ID NO: 328791 - DNA, 25 bp, Mus musculus
catcgtcagattgcaatcctgtgtt

SEQ ID NO: 328792 - DNA, 25 bp, Mus musculus
catcgtcatgacacttggtttcaaa

SEQ ID NO: 328793 - DNA, 25 bp, Mus musculus
catcgtcatgactcttggtttcaaa

SEQ ID NO: 328794 - DNA, 25 bp, Mus musculus
catcgtcatgtaagccgtgggcgtg

SEQ ID NO: 328795 - DNA, 25 bp, Mus musculus
catcgtcatgtatgccgtgggcgtg

SEQ ID NO: 328796 - DNA, 25 bp, Mus musculus
catcgtccccttacctgacaataat

SEQ ID NO: 328797 - DNA, 25 bp, Mus musculus
catcgtcccctttcctgacaataat

SEQ ID NO: 328798 - DNA, 25 bp, Mus musculus
catcgtccctgtccggagaggctac

SEQ ID NO: 328799 - DNA, 25 bp, Mus musculus
catcgtccctgtgcggagaggctac

SEQ ID NO: 328800 - DNA, 25 bp, Mus musculus
catcgtcggctgatataggtcgtgg

SEQ ID NO: 328801 - DNA, 25 bp, Mus musculus
catcgtcggctgttataggtcgtgg

SEQ ID NO: 328802 - DNA, 25 bp, Mus musculus
catcgtctagaaaatttcaagcctt

SEQ ID NO: 328803 - DNA, 25 bp, Mus musculus
catcgtctagaatatttcaagcctt

SEQ ID NO: 328804 - DNA, 25 bp, Mus musculus
catcgtctatgactaagttcttacc

SEQ ID NO: 328805 - DNA, 25 bp, Mus musculus
catcgtctatgagtaagttcttacc

SEQ ID NO: 328806 - DNA, 25 bp, Mus musculus
catcgtctctgtatgggttgtgcat

SEQ ID NO: 328807 - DNA, 25 bp, Mus musculus
catcgtctctgtttgggttgtgcat

SEQ ID NO: 328808 - DNA, 25 bp, Mus musculus
catcgtctttataaacctgtctgct

SEQ ID NO: 328809 - DNA, 25 bp, Mus musculus
catcgtctttattaacctgtctgct

SEQ ID NO: 328810 - DNA, 25 bp, Mus musculus
catcgtctttctcaacaagtgcgaa

SEQ ID NO: 328811 - DNA, 25 bp, Mus musculus
catcgtctttctgaacaagtgcgaa

SEQ ID NO: 328812 - DNA, 25 bp, Mus musculus
catcgtgatggaaccgctgtcgtga

SEQ ID NO: 328813 - DNA, 25 bp, Mus musculus
catcgtgatggatccgctgtcgtga

SEQ ID NO: 328814 - DNA, 25 bp, Mus musculus
catcgtgatgtgattgcttggctat

SEQ ID NO: 328815 - DNA, 25 bp, Mus musculus
catcgtgatgtgtttgcttggctat

SEQ ID NO: 328816 - DNA, 25 bp, Mus musculus
catcgtgcaccgcaagtgcttctag

SEQ ID NO: 328817 - DNA, 25 bp, Mus musculus
catcgtgcaccggaagtgcttctag

SEQ ID NO: 328818 - DNA, 25 bp, Mus musculus
catcgtgcaggactgtgtcctttat

SEQ ID NO: 328819 - DNA, 25 bp, Mus musculus
catcgtgcaggagtgtgtcctttat

SEQ ID NO: 328820 - DNA, 25 bp, Mus musculus
catcgtgcattgacatgactctgtc

SEQ ID NO: 328821 - DNA, 25 bp, Mus musculus
catcgtgcattgtcatgactctgtc

SEQ ID NO: 328822 - DNA, 25 bp, Mus musculus
catcgtgccctacagtggacactgt

SEQ ID NO: 328823 - DNA, 25 bp, Mus musculus
catcgtgccctagagtggacactgt

SEQ ID NO: 328824 - DNA, 25 bp, Mus musculus
catcgtgctctgaagggtcccctga

SEQ ID NO: 328825 - DNA, 25 bp, Mus musculus
catcgtgctctgtagggtcccctga

SEQ ID NO: 328826 - DNA, 25 bp, Mus musculus
catcgtggacacagcgggtagatat

SEQ ID NO: 328827 - DNA, 25 bp, Mus musculus
catcgtggacactgcgggtagatat

SEQ ID NO: 328828 - DNA, 25 bp, Mus musculus
catcgtggacttcacatgtgcctat

SEQ ID NO: 328829 - DNA, 25 bp, Mus musculus
catcgtggacttgacatgtgcctat

SEQ ID NO: 328830 - DNA, 25 bp, Mus musculus
catcgtggccaaatgctgagaacaa

SEQ ID NO: 328831 - DNA, 25 bp, Mus musculus
catcgtggccaattgctgagaacaa

SEQ ID NO: 328832 - DNA, 25 bp, Mus musculus
catcgtggctatcattgtcctgcac

SEQ ID NO: 328833 - DNA, 25 bp, Mus musculus
catcgtggctatgattgtcctgcac

SEQ ID NO: 328834 - DNA, 25 bp, Mus musculus
catcgtggctctcctattcatagta

SEQ ID NO: 328835 - DNA, 25 bp, Mus musculus
catcgtggctctgctattcatagta

SEQ ID NO: 328836 - DNA, 25 bp, Mus musculus
catcgtggctggatatgggtcacca

SEQ ID NO: 328837 - DNA, 25 bp, Mus musculus
catcgtggctggttatgggtcacca

SEQ ID NO: 328838 - DNA, 25 bp, Mus musculus
catcgtggtcttacttgtttactaa

SEQ ID NO: 328839 - DNA, 25 bp, Mus musculus
catcgtggtctttcttgtttactaa

SEQ ID NO: 328840 - DNA, 25 bp, Mus musculus
catcgtgtagctccagttttatgga

SEQ ID NO: 328841 - DNA, 25 bp, Mus musculus
catcgtgtagctgcagttttatgga

SEQ ID NO: 328842 - DNA, 25 bp, Mus musculus
catcgtgtccgacgctaagtgcaag

SEQ ID NO: 328843 - DNA, 25 bp, Mus musculus
catcgtgtccgaggctaagtgcaag

SEQ ID NO: 328844 - DNA, 25 bp, Mus musculus
catcgtgtgaggagcgtgtgctcat

SEQ ID NO: 328845 - DNA, 25 bp, Mus musculus
catcgtgtgaggtgcgtgtgctcat

SEQ ID NO: 328846 - DNA, 25 bp, Mus musculus
catcgtgtgcctcatgatcacgcag

SEQ ID NO: 328847 - DNA, 25 bp, Mus musculus
catcgtgtgcctgatgatcacgcag

SEQ ID NO: 328848 - DNA, 25 bp, Mus musculus
catcgtgttccacaagcaactgcga

SEQ ID NO: 328849 - DNA, 25 bp, Mus musculus
catcgtgttccactgcagtgtaggt

SEQ ID NO: 328850 - DNA, 25 bp, Mus musculus
catcgtgttccagaagcaactgcga

SEQ ID NO: 328851 - DNA, 25 bp, Mus musculus
catcgtgttccagtgcagtgtaggt

SEQ ID NO: 328852 - DNA, 25 bp, Mus musculus
catcgtgtttgcattcttgttaagt

SEQ ID NO: 328853 - DNA, 25 bp, Mus musculus
catcgtgtttgctttcttgttaagt

SEQ ID NO: 328854 - DNA, 25 bp, Mus musculus
catcgttactgtccctgaaatgtca

SEQ ID NO: 328855 - DNA, 25 bp, Mus musculus
catcgttactgtgcctgaaatgtca

SEQ ID NO: 328856 - DNA, 25 bp, Mus musculus
catcgttcctcacttatagacttca

SEQ ID NO: 328857 - DNA, 25 bp, Mus musculus
catcgttcctcagttatagacttca

SEQ ID NO: 328858 - DNA, 25 bp, Mus musculus
catcgttctgcaccaaggagagaaa

SEQ ID NO: 328859 - DNA, 25 bp, Mus musculus
catcgttctgcagcaaggagagaaa

SEQ ID NO: 328860 - DNA, 25 bp, Mus musculus
catcgttgccctacttactaagcaa

SEQ ID NO: 328861 - DNA, 25 bp, Mus musculus
catcgttgcccttcttactaagcaa

SEQ ID NO: 328862 - DNA, 25 bp, Mus musculus
catcgttgtttaaacctgaaggcca

SEQ ID NO: 328863 - DNA, 25 bp, Mus musculus
catcgttgtttatacctgaaggcca

SEQ ID NO: 328864 - DNA, 25 bp, Mus musculus
catcgtttcttgattaaccactccg

SEQ ID NO: 328865 - DNA, 25 bp, Mus musculus
catcgtttcttgtttaaccactccg

SEQ ID NO: 328866 - DNA, 25 bp, Mus musculus
catcgtttttgcagtggtggctttt

SEQ ID NO: 328867 - DNA, 25 bp, Mus musculus
catcgtttttgctgtggtggctttt

SEQ ID NO: 328868 - DNA, 25 bp, Mus musculus
catctaaaacttctagctttttgga

SEQ ID NO: 328869 - DNA, 25 bp, Mus musculus
catctaaaacttgtagctttttgga

SEQ ID NO: 328870 - DNA, 25 bp, Mus musculus
catctaaaggtgctgtttgctgtat

SEQ ID NO: 328871 - DNA, 25 bp, Mus musculus
catctaaaggtggtgtttgctgtat

SEQ ID NO: 328872 - DNA, 25 bp, Mus musculus
catctaaatagacttaaggtgcacc

SEQ ID NO: 328873 - DNA, 25 bp, Mus musculus
catctaaatagagttaaggtgcacc

SEQ ID NO: 328874 - DNA, 25 bp, Mus musculus
catctaagaactctggtggcctggc

SEQ ID NO: 328875 - DNA, 25 bp, Mus musculus
catctaagaactgtggtggcctggc

SEQ ID NO: 328876 - DNA, 25 bp, Mus musculus
catctaataagtatccattgtagga

SEQ ID NO: 328877 - DNA, 25 bp, Mus musculus
catctaataagtttccattgtagga

SEQ ID NO: 328878 - DNA, 25 bp, Mus musculus
catctaatcaacactctgagatttg

SEQ ID NO: 328879 - DNA, 25 bp, Mus musculus
catctaatcaactctctgagatttg

SEQ ID NO: 328880 - DNA, 25 bp, Mus musculus
catctacaacgtcgtctcctaataa

SEQ ID NO: 328881 - DNA, 25 bp, Mus musculus
catctacaacgtggtctcctaataa

SEQ ID NO: 328882 - DNA, 25 bp, Mus musculus
catctacatcttccatttcatctaa

SEQ ID NO: 328883 - DNA, 25 bp, Mus musculus
catctacatcttgcatttcatctaa

SEQ ID NO: 328884 - DNA, 25 bp, Mus musculus
catctacatgtgactttctcaagct

SEQ ID NO: 328885 - DNA, 25 bp, Mus musculus
catctacatgtgtctttctcaagct

SEQ ID NO: 328886 - DNA, 25 bp, Mus musculus
catctaccaagtccacaccttttat

SEQ ID NO: 328887 - DNA, 25 bp, Mus musculus
catctaccaagtgcacaccttttat

SEQ ID NO: 328888 - DNA, 25 bp, Mus musculus
catctacccaatcatccatgctgta

SEQ ID NO: 328889 - DNA, 25 bp, Mus musculus
catctacccaatgatccatgctgta

SEQ ID NO: 328890 - DNA, 25 bp, Mus musculus
catctacccacacgattgcattgta

SEQ ID NO: 328891 - DNA, 25 bp, Mus musculus
catctacccacaggattgcattgta

SEQ ID NO: 328892 - DNA, 25 bp, Mus musculus
catctaccctttccaagtgtttagt

SEQ ID NO: 328893 - DNA, 25 bp, Mus musculus
catctaccctttgcaagtgtttagt

SEQ ID NO: 328894 - DNA, 25 bp, Mus musculus
catctactcctgatatatttgtttg

SEQ ID NO: 328895 - DNA, 25 bp, Mus musculus
catctactcctgttatatttgtttg

SEQ ID NO: 328896 - DNA, 25 bp, Mus musculus
catctactcttacctgcagtcttgc

SEQ ID NO: 328897 - DNA, 25 bp, Mus musculus
catctactcttagctgcagtcttgc

SEQ ID NO: 328898 - DNA, 25 bp, Mus musculus
catctactctttctgggctccataa

SEQ ID NO: 328899 - DNA, 25 bp, Mus musculus
catctactctttgtgggctccataa

SEQ ID NO: 328900 - DNA, 25 bp, Mus musculus
catctactgtttaaacttcctaagg

SEQ ID NO: 328901 - DNA, 25 bp, Mus musculus
catctactgttttaacttcctaagg

SEQ ID NO: 328902 - DNA, 25 bp, Mus musculus
catctacttatcatttaattggttt

SEQ ID NO: 328903 - DNA, 25 bp, Mus musculus
catctacttatcttttaattggttt

SEQ ID NO: 328904 - DNA, 25 bp, Mus musculus
catctagaagctctgtgcacatcac

SEQ ID NO: 328905 - DNA, 25 bp, Mus musculus
catctagaagctgtgtgcacatcac

SEQ ID NO: 328906 - DNA, 25 bp, Mus musculus
catctagatctgattgtaggctcaa

SEQ ID NO: 328907 - DNA, 25 bp, Mus musculus
catctagatctgtttgtaggctcaa

SEQ ID NO: 328908 - DNA, 25 bp, Mus musculus
catctagatgaaagagactctgagt

SEQ ID NO: 328909 - DNA, 25 bp, Mus musculus
catctagatgaatgagactctgagt

SEQ ID NO: 328910 - DNA, 25 bp, Mus musculus
catctagctctaagaacatcccatt

SEQ ID NO: 328911 - DNA, 25 bp, Mus musculus
catctagctctatgaacatcccatt

SEQ ID NO: 328912 - DNA, 25 bp, Mus musculus
catctagctggtcggctatgcagca

SEQ ID NO: 328913 - DNA, 25 bp, Mus musculus
catctagctggtgggctatgcagca

SEQ ID NO: 328914 - DNA, 25 bp, Mus musculus
catctaggactacttggtgcccagt

SEQ ID NO: 328915 - DNA, 25 bp, Mus musculus
catctaggactagttggtgcccagt

SEQ ID NO: 328916 - DNA, 25 bp, Mus musculus
catctaggacttcttgcggccttaa

SEQ ID NO: 328917 - DNA, 25 bp, Mus musculus
catctaggacttgttgcggccttaa

SEQ ID NO: 328918 - DNA, 25 bp, Mus musculus
catctaggattcagggagcaacaca

SEQ ID NO: 328919 - DNA, 25 bp, Mus musculus
catctaggattctgggagcaacaca

SEQ ID NO: 328920 - DNA, 25 bp, Mus musculus
catctagggcatcaaactttaggta

SEQ ID NO: 328921 - DNA, 25 bp, Mus musculus
catctagggcatgaaactttaggta

SEQ ID NO: 328922 - DNA, 25 bp, Mus musculus
catctaggtcgtctggcgtggctac

SEQ ID NO: 328923 - DNA, 25 bp, Mus musculus
catctaggtcgtgtggcgtggctac

SEQ ID NO: 328924 - DNA, 25 bp, Mus musculus
catctaggtgagatttgccaaagga

SEQ ID NO: 328925 - DNA, 25 bp, Mus musculus
catctaggtgagttttgccaaagga

SEQ ID NO: 328926 - DNA, 25 bp, Mus musculus
catctaggtttgctttgtgagggaa

SEQ ID NO: 328927 - DNA, 25 bp, Mus musculus
catctaggtttggtttgtgagggaa

SEQ ID NO: 328928 - DNA, 25 bp, Mus musculus
catctagtaataatcttggtgtaag

SEQ ID NO: 328929 - DNA, 25 bp, Mus musculus
catctagtaatattcttggtgtaag

SEQ ID NO: 328930 - DNA, 25 bp, Mus musculus
catctataagataagcaactgcata

SEQ ID NO: 328931 - DNA, 25 bp, Mus musculus
catctataagattagcaactgcata

SEQ ID NO: 328932 - DNA, 25 bp, Mus musculus
catctataatccagtgtcttgtttt

SEQ ID NO: 328933 - DNA, 25 bp, Mus musculus
catctataatcctgtgtcttgtttt

SEQ ID NO: 328934 - DNA, 25 bp, Mus musculus
catctataattgaacttcgagcttg

SEQ ID NO: 328935 - DNA, 25 bp, Mus musculus
catctataattgtacttcgagcttg

SEQ ID NO: 328936 - DNA, 25 bp, Mus musculus
catctatactccagacactttaaaa

SEQ ID NO: 328937 - DNA, 25 bp, Mus musculus
catctatactcctgacactttaaaa

SEQ ID NO: 328938 - DNA, 25 bp, Mus musculus
catctatacttgaacagtccctaag

SEQ ID NO: 328939 - DNA, 25 bp, Mus musculus
catctatacttgtacagtccctaag

SEQ ID NO: 328940 - DNA, 25 bp, Mus musculus
catctatatgcacgagttatttttc

SEQ ID NO: 328941 - DNA, 25 bp, Mus musculus
catctatatgcaggagttatttttc

SEQ ID NO: 328942 - DNA, 25 bp, Mus musculus
catctatcacctcagacatcctgcc

SEQ ID NO: 328943 - DNA, 25 bp, Mus musculus
catctatcacctgagacatcctgcc

SEQ ID NO: 328944 - DNA, 25 bp, Mus musculus
catctatcagtacagctatggtgta

SEQ ID NO: 328945 - DNA, 25 bp, Mus musculus
catctatcagtagagctatggtgta

SEQ ID NO: 328946 - DNA, 25 bp, Mus musculus
catctatcatgtactgggtctattt

SEQ ID NO: 328947 - DNA, 25 bp, Mus musculus
catctatcatgttctgggtctattt

SEQ ID NO: 328948 - DNA, 25 bp, Mus musculus
catctatccaataggtgagcttcaa

SEQ ID NO: 328949 - DNA, 25 bp, Mus musculus
catctatccaattggtgagcttcaa

SEQ ID NO: 328950 - DNA, 25 bp, Mus musculus
catctatctataagcactcacacac

SEQ ID NO: 328951 - DNA, 25 bp, Mus musculus
catctatctatatgcactcacacac

SEQ ID NO: 328952 - DNA, 25 bp, Mus musculus
catctatctgtaaggcatttgtggt

SEQ ID NO: 328953 - DNA, 25 bp, Mus musculus
catctatctgtatggcatttgtggt

SEQ ID NO: 328954 - DNA, 25 bp, Mus musculus
catctatctttcactagacctgagc

SEQ ID NO: 328955 - DNA, 25 bp, Mus musculus
catctatctttctctagacctgagc

SEQ ID NO: 328956 - DNA, 25 bp, Mus musculus
catctatggatgatttctgggggga

SEQ ID NO: 328957 - DNA, 25 bp, Mus musculus
catctatggatgttttctgggggga

SEQ ID NO: 328958 - DNA, 25 bp, Mus musculus
catctatggcttattgaatgcctgc

SEQ ID NO: 328959 - DNA, 25 bp, Mus musculus
catctatggctttttgaatgcctgc

SEQ ID NO: 328960 - DNA, 25 bp, Mus musculus
catctatgtggcagaggccctcatc

SEQ ID NO: 328961 - DNA, 25 bp, Mus musculus
catctatgtggctgaggccctcatc

SEQ ID NO: 328962 - DNA, 25 bp, Mus musculus
catctattctctcggttttcttcat

SEQ ID NO: 328963 - DNA, 25 bp, Mus musculus
catctattctctgggttttcttcat

SEQ ID NO: 328964 - DNA, 25 bp, Mus musculus
catctattgaatcgaacacagagtc

SEQ ID NO: 328965 - DNA, 25 bp, Mus musculus
catctattgaatggaacacagagtc

SEQ ID NO: 328966 - DNA, 25 bp, Mus musculus
catctattgcttaattgtcattctt

SEQ ID NO: 328967 - DNA, 25 bp, Mus musculus
catctattgctttattgtcattctt

SEQ ID NO: 328968 - DNA, 25 bp, Mus musculus
catctatttaataagggagccccaa

SEQ ID NO: 328969 - DNA, 25 bp, Mus musculus
catctatttaattagggagccccaa

SEQ ID NO: 328970 - DNA, 25 bp, Mus musculus
catctatttgatctgttctttttta

SEQ ID NO: 328971 - DNA, 25 bp, Mus musculus
catctatttgatgtgttctttttta

SEQ ID NO: 328972 - DNA, 25 bp, Mus musculus
catctcaaagttcgcctatcaccag

SEQ ID NO: 328973 - DNA, 25 bp, Mus musculus
catctcaaagttggcctatcaccag

SEQ ID NO: 328974 - DNA, 25 bp, Mus musculus
catctcaaatatccctgctcaggtg

SEQ ID NO: 328975 - DNA, 25 bp, Mus musculus
catctcaaatatgcctgctcaggtg

SEQ ID NO: 328976 - DNA, 25 bp, Mus musculus
catctcacagtgaagtccagttgat

SEQ ID NO: 328977 - DNA, 25 bp, Mus musculus
catctcacagtgtagtccagttgat

SEQ ID NO: 328978 - DNA, 25 bp, Mus musculus
catctcaccaatccccttttagtat

SEQ ID NO: 328979 - DNA, 25 bp, Mus musculus
catctcaccaatgcccttttagtat

SEQ ID NO: 328980 - DNA, 25 bp, Mus musculus
catctcacccctaagttggaaaaag

SEQ ID NO: 328981 - DNA, 25 bp, Mus musculus
catctcaccccttagttggaaaaag

SEQ ID NO: 328982 - DNA, 25 bp, Mus musculus
catctcactcctcaaggcttaagat

SEQ ID NO: 328983 - DNA, 25 bp, Mus musculus
catctcactcctgaaggcttaagat

SEQ ID NO: 328984 - DNA, 25 bp, Mus musculus
catctcactggcacacaaaactatt

SEQ ID NO: 328985 - DNA, 25 bp, Mus musculus
catctcactggctcacaaaactatt

SEQ ID NO: 328986 - DNA, 25 bp, Mus musculus
catctcagaaacactagcaggtggg

SEQ ID NO: 328987 - DNA, 25 bp, Mus musculus
catctcagaaactctagcaggtggg

SEQ ID NO: 328988 - DNA, 25 bp, Mus musculus
catctcagcctcatgtctgttaagg

SEQ ID NO: 328989 - DNA, 25 bp, Mus musculus
catctcagcctcttgtctgttaagg

SEQ ID NO: 328990 - DNA, 25 bp, Mus musculus
catctcaggttaagccggcttcgtc

SEQ ID NO: 328991 - DNA, 25 bp, Mus musculus
catctcaggttatgccggcttcgtc

SEQ ID NO: 328992 - DNA, 25 bp, Mus musculus
catctcagtggtatattaatgtgaa

SEQ ID NO: 328993 - DNA, 25 bp, Mus musculus
catctcagtggtttattaatgtgaa

SEQ ID NO: 328994 - DNA, 25 bp, Mus musculus
catctcatcaaacttctccctgaaa

SEQ ID NO: 328995 - DNA, 25 bp, Mus musculus
catctcatcaaagttctccctgaaa

SEQ ID NO: 328996 - DNA, 25 bp, Mus musculus
catctcatccgtatttattttatag

SEQ ID NO: 328997 - DNA, 25 bp, Mus musculus
catctcatccgtttttattttatag

SEQ ID NO: 328998 - DNA, 25 bp, Mus musculus
catctcatctcaagtaaagccagtc

SEQ ID NO: 328999 - DNA, 25 bp, Mus musculus
catctcatctcatgtaaagccagtc

SEQ ID NO: 329000 - DNA, 25 bp, Mus musculus
catctcatgccaagcgacactctgg

SEQ ID NO: 329001 - DNA, 25 bp, Mus musculus
catctcatgccatgcgacactctgg

SEQ ID NO: 329002 - DNA, 25 bp, Mus musculus
catctcatgggtaggtctttgttgt

SEQ ID NO: 329003 - DNA, 25 bp, Mus musculus
catctcatgggttggtctttgttgt

SEQ ID NO: 329004 - DNA, 25 bp, Mus musculus
catctcattaggaggcccacagaat

SEQ ID NO: 329005 - DNA, 25 bp, Mus musculus
catctcattaggtggcccacagaat

SEQ ID NO: 329006 - DNA, 25 bp, Mus musculus
catctcattctaacttccaaagctt

SEQ ID NO: 329007 - DNA, 25 bp, Mus musculus
catctcattctatcttccaaagctt

SEQ ID NO: 329008 - DNA, 25 bp, Mus musculus
catctcattgatctggtgttcctaa

SEQ ID NO: 329009 - DNA, 25 bp, Mus musculus
catctcattgatgtggtgttcctaa

SEQ ID NO: 329010 - DNA, 25 bp, Mus musculus
catctcatttggataactttgtcac

SEQ ID NO: 329011 - DNA, 25 bp, Mus musculus
catctcatttggttaactttgtcac

SEQ ID NO: 329012 - DNA, 25 bp, Mus musculus
catctccacaggcatgtccataata

SEQ ID NO: 329013 - DNA, 25 bp, Mus musculus
catctccacagggatgtccataata

SEQ ID NO: 329014 - DNA, 25 bp, Mus musculus
catctccagaaccaagggctaccag

SEQ ID NO: 329015 - DNA, 25 bp, Mus musculus
catctccagaacgaagggctaccag

SEQ ID NO: 329016 - DNA, 25 bp, Mus musculus
catctccagggtcagagacttggca

SEQ ID NO: 329017 - DNA, 25 bp, Mus musculus
catctccagggtgagagacttggca

SEQ ID NO: 329018 - DNA, 25 bp, Mus musculus
catctccatcttcgtgaacttcatc

SEQ ID NO: 329019 - DNA, 25 bp, Mus musculus
catctccatcttggtgaacttcatc

SEQ ID NO: 329020 - DNA, 25 bp, Mus musculus
catctccatgcgactggcagaacat

SEQ ID NO: 329021 - DNA, 25 bp, Mus musculus
catctccatgcgtctggcagaacat

SEQ ID NO: 329022 - DNA, 25 bp, Mus musculus
catctccattttcggcatcatgaca

SEQ ID NO: 329023 - DNA, 25 bp, Mus musculus
catctccattttgggcatcatgaca

SEQ ID NO: 329024 - DNA, 25 bp, Mus musculus
catctcccatatccctgttagaaag

SEQ ID NO: 329025 - DNA, 25 bp, Mus musculus
catctcccatatgcctgttagaaag

SEQ ID NO: 329026 - DNA, 25 bp, Mus musculus
catctcccatgtctctgatattgtt

SEQ ID NO: 329027 - DNA, 25 bp, Mus musculus
catctcccatgtgtctgatattgtt

SEQ ID NO: 329028 - DNA, 25 bp, Mus musculus
catctccccaatccagggattacaa

SEQ ID NO: 329029 - DNA, 25 bp, Mus musculus
catctccccaatgcagggattacaa

SEQ ID NO: 329030 - DNA, 25 bp, Mus musculus
catctccccagcaatatactttatt

SEQ ID NO: 329031 - DNA, 25 bp, Mus musculus
catctccccagctatatactttatt

SEQ ID NO: 329032 - DNA, 25 bp, Mus musculus
catctcccgtccctggattaacttt

SEQ ID NO: 329033 - DNA, 25 bp, Mus musculus
catctcccgtccgtggattaacttt

SEQ ID NO: 329034 - DNA, 25 bp, Mus musculus
catctccctgaaaggcgtggtgaaa

SEQ ID NO: 329035 - DNA, 25 bp, Mus musculus
catctccctgaatggcgtggtgaaa

SEQ ID NO: 329036 - DNA, 25 bp, Mus musculus
catctccctgctcaacatagtggtg

SEQ ID NO: 329037 - DNA, 25 bp, Mus musculus
catctccctgctgaacatagtggtg

SEQ ID NO: 329038 - DNA, 25 bp, Mus musculus
catctcccttttatagctgttctaa

SEQ ID NO: 329039 - DNA, 25 bp, Mus musculus
catctcccttttttagctgttctaa

SEQ ID NO: 329040 - DNA, 25 bp, Mus musculus
catctccgtgcccatatatgtgtac

SEQ ID NO: 329041 - DNA, 25 bp, Mus musculus
catctccgtgccgatatatgtgtac

SEQ ID NO: 329042 - DNA, 25 bp, Mus musculus
catctcctaactcggctagctaaaa

SEQ ID NO: 329043 - DNA, 25 bp, Mus musculus
catctcctaactgggctagctaaaa

SEQ ID NO: 329044 - DNA, 25 bp, Mus musculus
catctcctacaacctcaacggaaag

SEQ ID NO: 329045 - DNA, 25 bp, Mus musculus
catctcctacaagctcaacggaaag

SEQ ID NO: 329046 - DNA, 25 bp, Mus musculus
catctcctattgctggctaaaacag

SEQ ID NO: 329047 - DNA, 25 bp, Mus musculus
catctcctattggtggctaaaacag

SEQ ID NO: 329048 - DNA, 25 bp, Mus musculus
catctcctccctcttgttaataaaa

SEQ ID NO: 329049 - DNA, 25 bp, Mus musculus
catctcctccctgttgttaataaaa

SEQ ID NO: 329050 - DNA, 25 bp, Mus musculus
catctcctccgaaagttactgcgat

SEQ ID NO: 329051 - DNA, 25 bp, Mus musculus
catctcctccgatagttactgcgat

SEQ ID NO: 329052 - DNA, 25 bp, Mus musculus
catctcctgaccagcagtgtactaa

SEQ ID NO: 329053 - DNA, 25 bp, Mus musculus
catctcctgacctgcagtgtactaa

SEQ ID NO: 329054 - DNA, 25 bp, Mus musculus
catctcctgacgaccataatggatt

SEQ ID NO: 329055 - DNA, 25 bp, Mus musculus
catctcctgacgtccataatggatt

SEQ ID NO: 329056 - DNA, 25 bp, Mus musculus
catctcctgagtactggctttaaag

SEQ ID NO: 329057 - DNA, 25 bp, Mus musculus
catctcctgagttctggctttaaag

SEQ ID NO: 329058 - DNA, 25 bp, Mus musculus
catctcctgccaagaacaggtcatt

SEQ ID NO: 329059 - DNA, 25 bp, Mus musculus
catctcctgccatgaacaggtcatt

SEQ ID NO: 329060 - DNA, 25 bp, Mus musculus
catctcctggaacctacagacaaca

SEQ ID NO: 329061 - DNA, 25 bp, Mus musculus
catctcctggaagctacagacaaca

SEQ ID NO: 329062 - DNA, 25 bp, Mus musculus
catctccttggaacttgaattacag

SEQ ID NO: 329063 - DNA, 25 bp, Mus musculus
catctccttggatcttgaattacag

SEQ ID NO: 329064 - DNA, 25 bp, Mus musculus
catctcctttgtcgtagctgggtac

SEQ ID NO: 329065 - DNA, 25 bp, Mus musculus
catctcctttgtggtagctgggtac

SEQ ID NO: 329066 - DNA, 25 bp, Mus musculus
catctccttttaatgctaagtgctg

SEQ ID NO: 329067 - DNA, 25 bp, Mus musculus
catctccttttattgctaagtgctg

SEQ ID NO: 329068 - DNA, 25 bp, Mus musculus
catctcgagtcccaggtagctttga

SEQ ID NO: 329069 - DNA, 25 bp, Mus musculus
catctcgagtccgaggtagctttga

SEQ ID NO: 329070 - DNA, 25 bp, Mus musculus
catctcgccagacccaggaatgtgt

SEQ ID NO: 329071 - DNA, 25 bp, Mus musculus
catctcgccagagccaggaatgtgt

SEQ ID NO: 329072 - DNA, 25 bp, Mus musculus
catctcgggctgactcgttggtgaa

SEQ ID NO: 329073 - DNA, 25 bp, Mus musculus
catctcgggctgtctcgttggtgaa

SEQ ID NO: 329074 - DNA, 25 bp, Mus musculus
catctcgtttgaacctttgaagcaa

SEQ ID NO: 329075 - DNA, 25 bp, Mus musculus
catctcgtttgatcctttgaagcaa

SEQ ID NO: 329076 - DNA, 25 bp, Mus musculus
catctctactctcacgcttttgtct

SEQ ID NO: 329077 - DNA, 25 bp, Mus musculus
catctctactctgacgcttttgtct

SEQ ID NO: 329078 - DNA, 25 bp, Mus musculus
catctctactgcaccacttaaaaag

SEQ ID NO: 329079 - DNA, 25 bp, Mus musculus
catctctactgctccacttaaaaag

SEQ ID NO: 329080 - DNA, 25 bp, Mus musculus
catctctagaggcaaccaggtcttg

SEQ ID NO: 329081 - DNA, 25 bp, Mus musculus
catctctagagggaaccaggtcttg

SEQ ID NO: 329082 - DNA, 25 bp, Mus musculus
catctctagcctctcaactatatgt

SEQ ID NO: 329083 - DNA, 25 bp, Mus musculus
catctctagcctgtcaactatatgt

SEQ ID NO: 329084 - DNA, 25 bp, Mus musculus
catctctatattacattggacccaa

SEQ ID NO: 329085 - DNA, 25 bp, Mus musculus
catctctatatttcattggacccaa

SEQ ID NO: 329086 - DNA, 25 bp, Mus musculus
catctctatcatatgttatgattgg

SEQ ID NO: 329087 - DNA, 25 bp, Mus musculus
catctctatcatttgttatgattgg

SEQ ID NO: 329088 - DNA, 25 bp, Mus musculus
catctctatctaagtgtaggcactg

SEQ ID NO: 329089 - DNA, 25 bp, Mus musculus
catctctatctatgtgtaggcactg

SEQ ID NO: 329090 - DNA, 25 bp, Mus musculus
catctctatgccctaaattcgaaat

SEQ ID NO: 329091 - DNA, 25 bp, Mus musculus
catctctatgccgtaaattcgaaat

SEQ ID NO: 329092 - DNA, 25 bp, Mus musculus
catctctcacccatagcatgcaggg

SEQ ID NO: 329093 - DNA, 25 bp, Mus musculus
catctctcacccttagcatgcaggg

SEQ ID NO: 329094 - DNA, 25 bp, Mus musculus
catctctcatccaaggtgctcagag

SEQ ID NO: 329095 - DNA, 25 bp, Mus musculus
catctctcatcctaggtgctcagag

SEQ ID NO: 329096 - DNA, 25 bp, Mus musculus
catctctccacaaacacattaagca

SEQ ID NO: 329097 - DNA, 25 bp, Mus musculus
catctctccacatacacattaagca

SEQ ID NO: 329098 - DNA, 25 bp, Mus musculus
catctctccccaaggaagcattaaa

SEQ ID NO: 329099 - DNA, 25 bp, Mus musculus
catctctccccatggaagcattaaa

SEQ ID NO: 329100 - DNA, 25 bp, Mus musculus
catctctccctactttgcaagaatt

SEQ ID NO: 329101 - DNA, 25 bp, Mus musculus
catctctccctagtttgcaagaatt

SEQ ID NO: 329102 - DNA, 25 bp, Mus musculus
catctctccgagatctggtatatca

SEQ ID NO: 329103 - DNA, 25 bp, Mus musculus
catctctccgagttctggtatatca

SEQ ID NO: 329104 - DNA, 25 bp, Mus musculus
catctctcctaacctagctttgaga

SEQ ID NO: 329105 - DNA, 25 bp, Mus musculus
catctctcctaagctagctttgaga

SEQ ID NO: 329106 - DNA, 25 bp, Mus musculus
catctctcggagaaatgatcttaat

SEQ ID NO: 329107 - DNA, 25 bp, Mus musculus
catctctcggagtaatgatcttaat

SEQ ID NO: 329108 - DNA, 25 bp, Mus musculus
catctctctagtctctagcttgatt

SEQ ID NO: 329109 - DNA, 25 bp, Mus musculus
catctctctagtgtctagcttgatt

SEQ ID NO: 329110 - DNA, 25 bp, Mus musculus
catctctctatcctgagaaaatgta

SEQ ID NO: 329111 - DNA, 25 bp, Mus musculus
catctctctatcgtgagaaaatgta

SEQ ID NO: 329112 - DNA, 25 bp, Mus musculus
catctctctggcagtattagggaac

SEQ ID NO: 329113 - DNA, 25 bp, Mus musculus
catctctctggctgtattagggaac

SEQ ID NO: 329114 - DNA, 25 bp, Mus musculus
catctctctttacctgtgttctaaa

SEQ ID NO: 329115 - DNA, 25 bp, Mus musculus
catctctctttagctgtgttctaaa

SEQ ID NO: 329116 - DNA, 25 bp, Mus musculus
catctctgaaagattccaggtagga

SEQ ID NO: 329117 - DNA, 25 bp, Mus musculus
catctctgaaagtttccaggtagga

SEQ ID NO: 329118 - DNA, 25 bp, Mus musculus
catctctgagagagaaagcccttca

SEQ ID NO: 329119 - DNA, 25 bp, Mus musculus
catctctgagagtgaaagcccttca

SEQ ID NO: 329120 - DNA, 25 bp, Mus musculus
catctctgatgcactgttactagaa

SEQ ID NO: 329121 - DNA, 25 bp, Mus musculus
catctctgatgctctgttactagaa

SEQ ID NO: 329122 - DNA, 25 bp, Mus musculus
catctctgcagaatcaagtcaatca

SEQ ID NO: 329123 - DNA, 25 bp, Mus musculus
catctctgcagattcaagtcaatca

SEQ ID NO: 329124 - DNA, 25 bp, Mus musculus
catctctgcagcctagttggcttga

SEQ ID NO: 329125 - DNA, 25 bp, Mus musculus
catctctgcagcctgatagttcata

SEQ ID NO: 329126 - DNA, 25 bp, Mus musculus
catctctgcagcgtagttggcttga

SEQ ID NO: 329127 - DNA, 25 bp, Mus musculus
catctctgcagcgtgatagttcata

SEQ ID NO: 329128 - DNA, 25 bp, Mus musculus
catctctgcctaatttcttgctaat

SEQ ID NO: 329129 - DNA, 25 bp, Mus musculus
catctctgcctattttcttgctaat

SEQ ID NO: 329130 - DNA, 25 bp, Mus musculus
catctctggaacctagcctagcttg

SEQ ID NO: 329131 - DNA, 25 bp, Mus musculus
catctctggaacgtagcctagcttg

SEQ ID NO: 329132 - DNA, 25 bp, Mus musculus
catctctgggcaagttgttcttgta

SEQ ID NO: 329133 - DNA, 25 bp, Mus musculus
catctctgggcatgttgttcttgta

SEQ ID NO: 329134 - DNA, 25 bp, Mus musculus
catctctgtagtactaacacgtcca

SEQ ID NO: 329135 - DNA, 25 bp, Mus musculus
catctctgtagttctaacacgtcca

SEQ ID NO: 329136 - DNA, 25 bp, Mus musculus
catctcttacccagaacaggctact

SEQ ID NO: 329137 - DNA, 25 bp, Mus musculus
catctcttaccctgaacaggctact

SEQ ID NO: 329138 - DNA, 25 bp, Mus musculus
catctcttacggaagcgagttacaa

SEQ ID NO: 329139 - DNA, 25 bp, Mus musculus
catctcttacggtagcgagttacaa

SEQ ID NO: 329140 - DNA, 25 bp, Mus musculus
catctcttactgacacactatttca

SEQ ID NO: 329141 - DNA, 25 bp, Mus musculus
catctcttactgtcacactatttca

SEQ ID NO: 329142 - DNA, 25 bp, Mus musculus
catctcttccaacttgggagacagt

SEQ ID NO: 329143 - DNA, 25 bp, Mus musculus
catctcttccaagttgggagacagt

SEQ ID NO: 329144 - DNA, 25 bp, Mus musculus
catctcttcgtgaaaatgacttcat

SEQ ID NO: 329145 - DNA, 25 bp, Mus musculus
catctcttcgtgtaaatgacttcat

SEQ ID NO: 329146 - DNA, 25 bp, Mus musculus
catctcttcttgaaatcaccttggc

SEQ ID NO: 329147 - DNA, 25 bp, Mus musculus
catctcttcttgactaacctaaggg

SEQ ID NO: 329148 - DNA, 25 bp, Mus musculus
catctcttcttgtaatcaccttggc

SEQ ID NO: 329149 - DNA, 25 bp, Mus musculus
catctcttcttgtctaacctaaggg

SEQ ID NO: 329150 - DNA, 25 bp, Mus musculus
catctcttgacgcaaggcctgggag

SEQ ID NO: 329151 - DNA, 25 bp, Mus musculus
catctcttgacggaaggcctgggag

SEQ ID NO: 329152 - DNA, 25 bp, Mus musculus
catctcttgccaaataagggcctgc

SEQ ID NO: 329153 - DNA, 25 bp, Mus musculus
catctcttgccatataagggcctgc

SEQ ID NO: 329154 - DNA, 25 bp, Mus musculus
catctcttgggaaagatactcttgt

SEQ ID NO: 329155 - DNA, 25 bp, Mus musculus
catctcttgggatagatactcttgt

SEQ ID NO: 329156 - DNA, 25 bp, Mus musculus
catctcttgggccacatgacagaac

SEQ ID NO: 329157 - DNA, 25 bp, Mus musculus
catctcttgggcgacatgacagaac

SEQ ID NO: 329158 - DNA, 25 bp, Mus musculus
catctctttactccccagtaggaga

SEQ ID NO: 329159 - DNA, 25 bp, Mus musculus
catctctttactgcccagtaggaga

SEQ ID NO: 329160 - DNA, 25 bp, Mus musculus
catctcttttaacgctgtccagtgc

SEQ ID NO: 329161 - DNA, 25 bp, Mus musculus
catctcttttaaggctgtccagtgc

SEQ ID NO: 329162 - DNA, 25 bp, Mus musculus
catctgaaaaatccctaacctcact

SEQ ID NO: 329163 - DNA, 25 bp, Mus musculus
catctgaaaaatgcctaacctcact

SEQ ID NO: 329164 - DNA, 25 bp, Mus musculus
catctgaaatgacggcagccgttta

SEQ ID NO: 329165 - DNA, 25 bp, Mus musculus
catctgaaatgagggcagccgttta

SEQ ID NO: 329166 - DNA, 25 bp, Mus musculus
catctgaacacaccgggtagtgtat

SEQ ID NO: 329167 - DNA, 25 bp, Mus musculus
catctgaacacagcgggtagtgtat

SEQ ID NO: 329168 - DNA, 25 bp, Mus musculus
catctgaaggcccagtagctgggac

SEQ ID NO: 329169 - DNA, 25 bp, Mus musculus
catctgaaggccgagtagctgggac

SEQ ID NO: 329170 - DNA, 25 bp, Mus musculus
catctgaatcacctccccagtcaga

SEQ ID NO: 329171 - DNA, 25 bp, Mus musculus
catctgaatcacgtccccagtcaga

SEQ ID NO: 329172 - DNA, 25 bp, Mus musculus
catctgacccagatgcttccaggca

SEQ ID NO: 329173 - DNA, 25 bp, Mus musculus
catctgacccagttgcttccaggca

SEQ ID NO: 329174 - DNA, 25 bp, Mus musculus
catctgacctcaataaagcaaccgg

SEQ ID NO: 329175 - DNA, 25 bp, Mus musculus
catctgacctcattaaagcaaccgg

SEQ ID NO: 329176 - DNA, 25 bp, Mus musculus
catctgactcttccactacttattt

SEQ ID NO: 329177 - DNA, 25 bp, Mus musculus
catctgactcttgcactacttattt

SEQ ID NO: 329178 - DNA, 25 bp, Mus musculus
catctgagataaacagctgggtgta

SEQ ID NO: 329179 - DNA, 25 bp, Mus musculus
catctgagataatcagctgggtgta

SEQ ID NO: 329180 - DNA, 25 bp, Mus musculus
catctgaggcatcctctgggtttgt

SEQ ID NO: 329181 - DNA, 25 bp, Mus musculus
catctgaggcatgctctgggtttgt

SEQ ID NO: 329182 - DNA, 25 bp, Mus musculus
catctgagtctgcaatcagtgctaa

SEQ ID NO: 329183 - DNA, 25 bp, Mus musculus
catctgagtctggaatcagtgctaa

SEQ ID NO: 329184 - DNA, 25 bp, Mus musculus
catctgataagtctggaaggctcca

SEQ ID NO: 329185 - DNA, 25 bp, Mus musculus
catctgataagtgtggaaggctcca

SEQ ID NO: 329186 - DNA, 25 bp, Mus musculus
catctgatggccaatgtctgcatac

SEQ ID NO: 329187 - DNA, 25 bp, Mus musculus
catctgatggcctatgtctgcatac

SEQ ID NO: 329188 - DNA, 25 bp, Mus musculus
catctgatgtacactgattggctag

SEQ ID NO: 329189 - DNA, 25 bp, Mus musculus
catctgatgtactctgattggctag

SEQ ID NO: 329190 - DNA, 25 bp, Mus musculus
catctgatgtctcttcacgatactg

SEQ ID NO: 329191 - DNA, 25 bp, Mus musculus
catctgatgtctgttcacgatactg

SEQ ID NO: 329192 - DNA, 25 bp, Mus musculus
catctgattccccaatactcttttt

SEQ ID NO: 329193 - DNA, 25 bp, Mus musculus
catctgattcccgaatactcttttt

SEQ ID NO: 329194 - DNA, 25 bp, Mus musculus
catctgattctcacaagtgggtggg

SEQ ID NO: 329195 - DNA, 25 bp, Mus musculus
catctgattctctcaagtgggtggg

SEQ ID NO: 329196 - DNA, 25 bp, Mus musculus
catctgatttccaaccaatgtcttt

SEQ ID NO: 329197 - DNA, 25 bp, Mus musculus
catctgatttcctaccaatgtcttt

SEQ ID NO: 329198 - DNA, 25 bp, Mus musculus
catctgcaaacaccctgtacatcgg

SEQ ID NO: 329199 - DNA, 25 bp, Mus musculus
catctgcaaacagcctgtacatcgg

SEQ ID NO: 329200 - DNA, 25 bp, Mus musculus
catctgcaagccagcggacaaggga

SEQ ID NO: 329201 - DNA, 25 bp, Mus musculus
catctgcaagcctgcggacaaggga

SEQ ID NO: 329202 - DNA, 25 bp, Mus musculus
catctgcacctccacttacagggat

SEQ ID NO: 329203 - DNA, 25 bp, Mus musculus
catctgcacctcgacttacagggat

SEQ ID NO: 329204 - DNA, 25 bp, Mus musculus
catctgcacttaccgggattccctt

SEQ ID NO: 329205 - DNA, 25 bp, Mus musculus
catctgcacttagcgggattccctt

SEQ ID NO: 329206 - DNA, 25 bp, Mus musculus
catctgcaggatccatccggcactg

SEQ ID NO: 329207 - DNA, 25 bp, Mus musculus
catctgcaggatgcatccggcactg

SEQ ID NO: 329208 - DNA, 25 bp, Mus musculus
catctgcatattactctggtggtca

SEQ ID NO: 329209 - DNA, 25 bp, Mus musculus
catctgcatatttctctggtggtca

SEQ ID NO: 329210 - DNA, 25 bp, Mus musculus
catctgcatcttaggacactccaaa

SEQ ID NO: 329211 - DNA, 25 bp, Mus musculus
catctgcatcttctgctgtaaatgc

SEQ ID NO: 329212 - DNA, 25 bp, Mus musculus
catctgcatcttgtgctgtaaatgc

SEQ ID NO: 329213 - DNA, 25 bp, Mus musculus
catctgcatctttggacactccaaa

SEQ ID NO: 329214 - DNA, 25 bp, Mus musculus
catctgcatgcacacaaaatgccca

SEQ ID NO: 329215 - DNA, 25 bp, Mus musculus
catctgcatgcagacaaaatgccca

SEQ ID NO: 329216 - DNA, 25 bp, Mus musculus
catctgccagcacacattgttatag

SEQ ID NO: 329217 - DNA, 25 bp, Mus musculus
catctgccagcagacattgttatag

SEQ ID NO: 329218 - DNA, 25 bp, Mus musculus
catctgccatccattctagttttag

SEQ ID NO: 329219 - DNA, 25 bp, Mus musculus
catctgccatcctttctagttttag

SEQ ID NO: 329220 - DNA, 25 bp, Mus musculus
catctgccatgacctttctgaatca

SEQ ID NO: 329221 - DNA, 25 bp, Mus musculus
catctgccatgagctttctgaatca

SEQ ID NO: 329222 - DNA, 25 bp, Mus musculus
catctgcccaggctgtcactggaga

SEQ ID NO: 329223 - DNA, 25 bp, Mus musculus
catctgcccagggtgtcactggaga

SEQ ID NO: 329224 - DNA, 25 bp, Mus musculus
catctgcctgctccgccaaggagga

SEQ ID NO: 329225 - DNA, 25 bp, Mus musculus
catctgcctgctgcgccaaggagga

SEQ ID NO: 329226 - DNA, 25 bp, Mus musculus
catctgcctggacgactacgaggag

SEQ ID NO: 329227 - DNA, 25 bp, Mus musculus
catctgcctggaggactacgaggag

SEQ ID NO: 329228 - DNA, 25 bp, Mus musculus
catctgccttctacattttaaacct

SEQ ID NO: 329229 - DNA, 25 bp, Mus musculus
catctgccttcttcattttaaacct

SEQ ID NO: 329230 - DNA, 25 bp, Mus musculus
catctgctagtgagggctgataaac

SEQ ID NO: 329231 - DNA, 25 bp, Mus musculus
catctgctagtgtgggctgataaac

SEQ ID NO: 329232 - DNA, 25 bp, Mus musculus
catctgctatcccatctgtattata

SEQ ID NO: 329233 - DNA, 25 bp, Mus musculus
catctgctatccgatctgtattata

SEQ ID NO: 329234 - DNA, 25 bp, Mus musculus
catctgctatgcagtgggctctcag

SEQ ID NO: 329235 - DNA, 25 bp, Mus musculus
catctgctatgctgtgggctctcag

SEQ ID NO: 329236 - DNA, 25 bp, Mus musculus
catctgctcatgctatgcttactga

SEQ ID NO: 329237 - DNA, 25 bp, Mus musculus
catctgctcatggtatgcttactga

SEQ ID NO: 329238 - DNA, 25 bp, Mus musculus
catctgctctgcactacaagtcagt

SEQ ID NO: 329239 - DNA, 25 bp, Mus musculus
catctgctctgctctacaagtcagt

SEQ ID NO: 329240 - DNA, 25 bp, Mus musculus
catctgctgatgagcatcgaccgga

SEQ ID NO: 329241 - DNA, 25 bp, Mus musculus
catctgctgatgtgcatcgaccgga

SEQ ID NO: 329242 - DNA, 25 bp, Mus musculus
catctgctgcttattctactgtgaa

SEQ ID NO: 329243 - DNA, 25 bp, Mus musculus
catctgctgctttttctactgtgaa

SEQ ID NO: 329244 - DNA, 25 bp, Mus musculus
catctgctggctatgctgaagagct

SEQ ID NO: 329245 - DNA, 25 bp, Mus musculus
catctgctggctttgctgaagagct

SEQ ID NO: 329246 - DNA, 25 bp, Mus musculus
catctgctgtacctgtcaggagaaa

SEQ ID NO: 329247 - DNA, 25 bp, Mus musculus
catctgctgtacgtgtcaggagaaa

SEQ ID NO: 329248 - DNA, 25 bp, Mus musculus
catctgcttgataatctaccctgat

SEQ ID NO: 329249 - DNA, 25 bp, Mus musculus
catctgcttgatctggaggctttat

SEQ ID NO: 329250 - DNA, 25 bp, Mus musculus
catctgcttgatgtggaggctttat

SEQ ID NO: 329251 - DNA, 25 bp, Mus musculus
catctgcttgattatctaccctgat

SEQ ID NO: 329252 - DNA, 25 bp, Mus musculus
catctgcttggactggaacttggga

SEQ ID NO: 329253 - DNA, 25 bp, Mus musculus
catctgcttggagtggaacttggga

SEQ ID NO: 329254 - DNA, 25 bp, Mus musculus
catctgcttgggagaggcggcttta

SEQ ID NO: 329255 - DNA, 25 bp, Mus musculus
catctgcttgggtgaggcggcttta

SEQ ID NO: 329256 - DNA, 25 bp, Mus musculus
catctgcttgtcagaacactctgaa

SEQ ID NO: 329257 - DNA, 25 bp, Mus musculus
catctgcttgtctgaacactctgaa

SEQ ID NO: 329258 - DNA, 25 bp, Mus musculus
catctgctttagcaaccaagcctgg

SEQ ID NO: 329259 - DNA, 25 bp, Mus musculus
catctgctttaggaaccaagcctgg

SEQ ID NO: 329260 - DNA, 25 bp, Mus musculus
catctggaacatctatttgcattat

SEQ ID NO: 329261 - DNA, 25 bp, Mus musculus
catctggaacatgtatttgcattat

SEQ ID NO: 329262 - DNA, 25 bp, Mus musculus
catctggaagcgctgttgaacatta

SEQ ID NO: 329263 - DNA, 25 bp, Mus musculus
catctggaagcggtgttgaacatta

SEQ ID NO: 329264 - DNA, 25 bp, Mus musculus
catctggaaggtctctgcatagaaa

SEQ ID NO: 329265 - DNA, 25 bp, Mus musculus
catctggaaggtgtctgcatagaaa

SEQ ID NO: 329266 - DNA, 25 bp, Mus musculus
catctggaatagcagctggtgcccc

SEQ ID NO: 329267 - DNA, 25 bp, Mus musculus
catctggaataggagctggtgcccc

SEQ ID NO: 329268 - DNA, 25 bp, Mus musculus
catctggacggaccctgagctgaaa

SEQ ID NO: 329269 - DNA, 25 bp, Mus musculus
catctggacggagcctgagctgaaa

SEQ ID NO: 329270 - DNA, 25 bp, Mus musculus
catctggactttccctctgactgaa

SEQ ID NO: 329271 - DNA, 25 bp, Mus musculus
catctggactttgcctctgactgaa

SEQ ID NO: 329272 - DNA, 25 bp, Mus musculus
catctggagagtatttgggtcattc

SEQ ID NO: 329273 - DNA, 25 bp, Mus musculus
catctggagagtttttgggtcattc

SEQ ID NO: 329274 - DNA, 25 bp, Mus musculus
catctggaggtcagtgttcttggga

SEQ ID NO: 329275 - DNA, 25 bp, Mus musculus
catctggaggtctgtgttcttggga

SEQ ID NO: 329276 - DNA, 25 bp, Mus musculus
catctggagtgtaaattgctgtttc

SEQ ID NO: 329277 - DNA, 25 bp, Mus musculus
catctggagtgttaattgctgtttc

SEQ ID NO: 329278 - DNA, 25 bp, Mus musculus
catctggatgatctgcaaggccctt

SEQ ID NO: 329279 - DNA, 25 bp, Mus musculus
catctggatgatgtgcaaggccctt

SEQ ID NO: 329280 - DNA, 25 bp, Mus musculus
catctggcaaaaccatgcttctcta

SEQ ID NO: 329281 - DNA, 25 bp, Mus musculus
catctggcaaaagcatgcttctcta

SEQ ID NO: 329282 - DNA, 25 bp, Mus musculus
catctggcagttctcgttgtgtgtc

SEQ ID NO: 329283 - DNA, 25 bp, Mus musculus
catctggcagttgtcgttgtgtgtc

SEQ ID NO: 329284 - DNA, 25 bp, Mus musculus
catctggcgtgcacggagattcgag

SEQ ID NO: 329285 - DNA, 25 bp, Mus musculus
catctggcgtgctcggagattcgag

SEQ ID NO: 329286 - DNA, 25 bp, Mus musculus
catctggctggcacctaagtaattt

SEQ ID NO: 329287 - DNA, 25 bp, Mus musculus
catctggctggctcctaagtaattt

SEQ ID NO: 329288 - DNA, 25 bp, Mus musculus
catctgggactgcactacattgaac

SEQ ID NO: 329289 - DNA, 25 bp, Mus musculus
catctgggactggactacattgaac

SEQ ID NO: 329290 - DNA, 25 bp, Mus musculus
catctgggatggactggtggcattt

SEQ ID NO: 329291 - DNA, 25 bp, Mus musculus
catctgggatggtctggtggcattt

SEQ ID NO: 329292 - DNA, 25 bp, Mus musculus
catctgggcccaactgacattgtcg

SEQ ID NO: 329293 - DNA, 25 bp, Mus musculus
catctgggcccatctgacattgtcg

SEQ ID NO: 329294 - DNA, 25 bp, Mus musculus
catctgggctaccaactgggtgagc

SEQ ID NO: 329295 - DNA, 25 bp, Mus musculus
catctgggctacgaactgggtgagc

SEQ ID NO: 329296 - DNA, 25 bp, Mus musculus
catctgggtaggcaagcgttgactt

SEQ ID NO: 329297 - DNA, 25 bp, Mus musculus
catctgggtagggaagcgttgactt

SEQ ID NO: 329298 - DNA, 25 bp, Mus musculus
catctgggtttacggccattgcctc

SEQ ID NO: 329299 - DNA, 25 bp, Mus musculus
catctgggtttagggccattgcctc

SEQ ID NO: 329300 - DNA, 25 bp, Mus musculus
catctggtatttaatcagttgtact

SEQ ID NO: 329301 - DNA, 25 bp, Mus musculus
catctggtatttagtggttagtctg

SEQ ID NO: 329302 - DNA, 25 bp, Mus musculus
catctggtattttatcagttgtact

SEQ ID NO: 329303 - DNA, 25 bp, Mus musculus
catctggtattttgtggttagtctg

SEQ ID NO: 329304 - DNA, 25 bp, Mus musculus
catctggtccctactgttagaatgt

SEQ ID NO: 329305 - DNA, 25 bp, Mus musculus
catctggtcccttctgttagaatgt

SEQ ID NO: 329306 - DNA, 25 bp, Mus musculus
catctggtgacaacagaattctgtc

SEQ ID NO: 329307 - DNA, 25 bp, Mus musculus
catctggtgacatcagaattctgtc

SEQ ID NO: 329308 - DNA, 25 bp, Mus musculus
catctggtgggcaggaaatcatttc

SEQ ID NO: 329309 - DNA, 25 bp, Mus musculus
catctggtgggctggaaatcatttc

SEQ ID NO: 329310 - DNA, 25 bp, Mus musculus
catctggtggttctcatcacgttgt

SEQ ID NO: 329311 - DNA, 25 bp, Mus musculus
catctggtggttgtcatcacgttgt

SEQ ID NO: 329312 - DNA, 25 bp, Mus musculus
catctgtaacggattctggtgtatc

SEQ ID NO: 329313 - DNA, 25 bp, Mus musculus
catctgtaacggtttctggtgtatc

SEQ ID NO: 329314 - DNA, 25 bp, Mus musculus
catctgtaatttccttggcacaata

SEQ ID NO: 329315 - DNA, 25 bp, Mus musculus
catctgtaatttgcttggcacaata

SEQ ID NO: 329316 - DNA, 25 bp, Mus musculus
catctgtactgactctccaaccttg

SEQ ID NO: 329317 - DNA, 25 bp, Mus musculus
catctgtactgagtctccaaccttg

SEQ ID NO: 329318 - DNA, 25 bp, Mus musculus
catctgtacttgacctgatcttgta

SEQ ID NO: 329319 - DNA, 25 bp, Mus musculus
catctgtacttgtcctgatcttgta

SEQ ID NO: 329320 - DNA, 25 bp, Mus musculus
catctgtatataatcaacgtcattg

SEQ ID NO: 329321 - DNA, 25 bp, Mus musculus
catctgtatatattcaacgtcattg

SEQ ID NO: 329322 - DNA, 25 bp, Mus musculus
catctgtattgactccttgtgtcat

SEQ ID NO: 329323 - DNA, 25 bp, Mus musculus
catctgtattgagtccttgtgtcat

SEQ ID NO: 329324 - DNA, 25 bp, Mus musculus
catctgtcaacccttgctttataac

SEQ ID NO: 329325 - DNA, 25 bp, Mus musculus
catctgtcaaccgttgctttataac

SEQ ID NO: 329326 - DNA, 25 bp, Mus musculus
catctgtcagtaaccccaggaggga

SEQ ID NO: 329327 - DNA, 25 bp, Mus musculus
catctgtcagtatccccaggaggga

SEQ ID NO: 329328 - DNA, 25 bp, Mus musculus
catctgtcatcactattgagggtga

SEQ ID NO: 329329 - DNA, 25 bp, Mus musculus
catctgtcatcagtattgagggtga

SEQ ID NO: 329330 - DNA, 25 bp, Mus musculus
catctgtccagcaaccagagagaac

SEQ ID NO: 329331 - DNA, 25 bp, Mus musculus
catctgtccagctaccagagagaac

SEQ ID NO: 329332 - DNA, 25 bp, Mus musculus
catctgtccagtattgtcttcatca

SEQ ID NO: 329333 - DNA, 25 bp, Mus musculus
catctgtccagttttgtcttcatca

SEQ ID NO: 329334 - DNA, 25 bp, Mus musculus
catctgtcctgtctgaacgcagcga

SEQ ID NO: 329335 - DNA, 25 bp, Mus musculus
catctgtcctgtgtgaacgcagcga

SEQ ID NO: 329336 - DNA, 25 bp, Mus musculus
catctgtcttcacttgtttttttgt

SEQ ID NO: 329337 - DNA, 25 bp, Mus musculus
catctgtcttcagttgtttttttgt

SEQ ID NO: 329338 - DNA, 25 bp, Mus musculus
catctgtctttaatctgtatcttag

SEQ ID NO: 329339 - DNA, 25 bp, Mus musculus
catctgtctttattctgtatcttag

SEQ ID NO: 329340 - DNA, 25 bp, Mus musculus
catctgtgatacaagcatgtctgtt

SEQ ID NO: 329341 - DNA, 25 bp, Mus musculus
catctgtgatactagcatgtctgtt

SEQ ID NO: 329342 - DNA, 25 bp, Mus musculus
catctgtgatggattatctttcgga

SEQ ID NO: 329343 - DNA, 25 bp, Mus musculus
catctgtgatggtttatctttcgga

SEQ ID NO: 329344 - DNA, 25 bp, Mus musculus
catctgtgattgactgctctgtctg

SEQ ID NO: 329345 - DNA, 25 bp, Mus musculus
catctgtgattgtctgctctgtctg

SEQ ID NO: 329346 - DNA, 25 bp, Mus musculus
catctgtgcatacaaatgttgcatc

SEQ ID NO: 329347 - DNA, 25 bp, Mus musculus
catctgtgcatagaaatgttgcatc

SEQ ID NO: 329348 - DNA, 25 bp, Mus musculus
catctgtgccacaggcttctagaag

SEQ ID NO: 329349 - DNA, 25 bp, Mus musculus
catctgtgccactggcttctagaag

SEQ ID NO: 329350 - DNA, 25 bp, Mus musculus
catctgtgctgtcatttctgacggg

SEQ ID NO: 329351 - DNA, 25 bp, Mus musculus
catctgtgctgtgatttctgacggg

SEQ ID NO: 329352 - DNA, 25 bp, Mus musculus
catctgtgcttcagagaattgctct

SEQ ID NO: 329353 - DNA, 25 bp, Mus musculus
catctgtgcttctgagaattgctct

SEQ ID NO: 329354 - DNA, 25 bp, Mus musculus
catctgtggcctagcatattttcta

SEQ ID NO: 329355 - DNA, 25 bp, Mus musculus
catctgtggccttgcatattttcta

SEQ ID NO: 329356 - DNA, 25 bp, Mus musculus
catctgtgggataggcaacgattat

SEQ ID NO: 329357 - DNA, 25 bp, Mus musculus
catctgtgggattggcaacgattat

SEQ ID NO: 329358 - DNA, 25 bp, Mus musculus
catctgtgggctatttctaaattca

SEQ ID NO: 329359 - DNA, 25 bp, Mus musculus
catctgtgggctttttctaaattca

SEQ ID NO: 329360 - DNA, 25 bp, Mus musculus
catctgtgtatgaagggtcctggct

SEQ ID NO: 329361 - DNA, 25 bp, Mus musculus
catctgtgtatgtagggtcctggct

SEQ ID NO: 329362 - DNA, 25 bp, Mus musculus
catctgtgtgacctgggtaagccat

SEQ ID NO: 329363 - DNA, 25 bp, Mus musculus
catctgtgtgacgtgggtaagccat

SEQ ID NO: 329364 - DNA, 25 bp, Mus musculus
catctgtgtgatcgctatccccgtt

SEQ ID NO: 329365 - DNA, 25 bp, Mus musculus
catctgtgtgatggctatccccgtt

SEQ ID NO: 329366 - DNA, 25 bp, Mus musculus
catctgtgtggtactcagacaacac

SEQ ID NO: 329367 - DNA, 25 bp, Mus musculus
catctgtgtggttctcagacaacac

SEQ ID NO: 329368 - DNA, 25 bp, Mus musculus
catctgtgttacacctttaccatat

SEQ ID NO: 329369 - DNA, 25 bp, Mus musculus
catctgtgttactcctttaccatat

SEQ ID NO: 329370 - DNA, 25 bp, Mus musculus
catctgttatgtctccaccggaaaa

SEQ ID NO: 329371 - DNA, 25 bp, Mus musculus
catctgttatgtgtccaccggaaaa

SEQ ID NO: 329372 - DNA, 25 bp, Mus musculus
catctgttctggcttcttgagctgc

SEQ ID NO: 329373 - DNA, 25 bp, Mus musculus
catctgttctgggttcttgagctgc

SEQ ID NO: 329374 - DNA, 25 bp, Mus musculus
catctgttgccaactgaatttttga

SEQ ID NO: 329375 - DNA, 25 bp, Mus musculus
catctgttgccatctgaatttttga

SEQ ID NO: 329376 - DNA, 25 bp, Mus musculus
catctgttggtcaaccttttttcct

SEQ ID NO: 329377 - DNA, 25 bp, Mus musculus
catctgttggtctaccttttttcct

SEQ ID NO: 329378 - DNA, 25 bp, Mus musculus
catctgttggttcttccagttaaca

SEQ ID NO: 329379 - DNA, 25 bp, Mus musculus
catctgttggttgttccagttaaca

SEQ ID NO: 329380 - DNA, 25 bp, Mus musculus
catctgttgtatacgaagttgaatc

SEQ ID NO: 329381 - DNA, 25 bp, Mus musculus
catctgttgtattcgaagttgaatc

SEQ ID NO: 329382 - DNA, 25 bp, Mus musculus
catctgtttaatcctgctgctgaca

SEQ ID NO: 329383 - DNA, 25 bp, Mus musculus
catctgtttaatgctgctgctgaca

SEQ ID NO: 329384 - DNA, 25 bp, Mus musculus
catctgtttagacgaggaaatctca

SEQ ID NO: 329385 - DNA, 25 bp, Mus musculus
catctgtttagaggaggaaatctca

SEQ ID NO: 329386 - DNA, 25 bp, Mus musculus
catctgtttgataatggtctgggca

SEQ ID NO: 329387 - DNA, 25 bp, Mus musculus
catctgtttgattatggtctgggca

SEQ ID NO: 329388 - DNA, 25 bp, Mus musculus
catctgtttgtccatctgctgaaat

SEQ ID NO: 329389 - DNA, 25 bp, Mus musculus
catctgtttgtcgatctgctgaaat

SEQ ID NO: 329390 - DNA, 25 bp, Mus musculus
catctgttttccatgattccgtgaa

SEQ ID NO: 329391 - DNA, 25 bp, Mus musculus
catctgttttccttgattccgtgaa

SEQ ID NO: 329392 - DNA, 25 bp, Mus musculus
catcttaatcgacctcattcacaac

SEQ ID NO: 329393 - DNA, 25 bp, Mus musculus
catcttaatcgagctcattcacaac

SEQ ID NO: 329394 - DNA, 25 bp, Mus musculus
catcttacttccctacaggttagaa

SEQ ID NO: 329395 - DNA, 25 bp, Mus musculus
catcttacttccgtacaggttagaa

SEQ ID NO: 329396 - DNA, 25 bp, Mus musculus
catcttaggagaactggcaaccaaa

SEQ ID NO: 329397 - DNA, 25 bp, Mus musculus
catcttaggagatctggcaaccaaa

SEQ ID NO: 329398 - DNA, 25 bp, Mus musculus
catcttagttttatctcccaagcaa

SEQ ID NO: 329399 - DNA, 25 bp, Mus musculus
catcttagttttttctcccaagcaa

SEQ ID NO: 329400 - DNA, 25 bp, Mus musculus
catcttatattaatcccagggattc

SEQ ID NO: 329401 - DNA, 25 bp, Mus musculus
catcttatattattcccagggattc

SEQ ID NO: 329402 - DNA, 25 bp, Mus musculus
catcttatcaggctacatgcaaggt

SEQ ID NO: 329403 - DNA, 25 bp, Mus musculus
catcttatcagggtacatgcaaggt

SEQ ID NO: 329404 - DNA, 25 bp, Mus musculus
catcttatctggcatcaactcgtta

SEQ ID NO: 329405 - DNA, 25 bp, Mus musculus
catcttatctgggatcaactcgtta

SEQ ID NO: 329406 - DNA, 25 bp, Mus musculus
catcttatgctaagactgtgaccat

SEQ ID NO: 329407 - DNA, 25 bp, Mus musculus
catcttatgctatgactgtgaccat

SEQ ID NO: 329408 - DNA, 25 bp, Mus musculus
catcttatgtgcaattcttttcctg

SEQ ID NO: 329409 - DNA, 25 bp, Mus musculus
catcttatgtgctattcttttcctg

SEQ ID NO: 329410 - DNA, 25 bp, Mus musculus
catcttattcccatacttgtccaaa

SEQ ID NO: 329411 - DNA, 25 bp, Mus musculus
catcttattcccttacttgtccaaa

SEQ ID NO: 329412 - DNA, 25 bp, Mus musculus
catcttattgttcttactcggtttt

SEQ ID NO: 329413 - DNA, 25 bp, Mus musculus
catcttattgttgttactcggtttt

SEQ ID NO: 329414 - DNA, 25 bp, Mus musculus
catcttcaggatccatcaccagaaa

SEQ ID NO: 329415 - DNA, 25 bp, Mus musculus
catcttcaggatcggcggaagcctt

SEQ ID NO: 329416 - DNA, 25 bp, Mus musculus
catcttcaggatgcatcaccagaaa

SEQ ID NO: 329417 - DNA, 25 bp, Mus musculus
catcttcaggatgggcggaagcctt

SEQ ID NO: 329418 - DNA, 25 bp, Mus musculus
catcttcagtggcaccgtggtctag

SEQ ID NO: 329419 - DNA, 25 bp, Mus musculus
catcttcagtgggaccgtggtctag

SEQ ID NO: 329420 - DNA, 25 bp, Mus musculus
catcttcatcacactcatagccatg

SEQ ID NO: 329421 - DNA, 25 bp, Mus musculus
catcttcatcactctcatagccatg

SEQ ID NO: 329422 - DNA, 25 bp, Mus musculus
catcttcatccaacacgatacttga

SEQ ID NO: 329423 - DNA, 25 bp, Mus musculus
catcttcatccatcacgatacttga

SEQ ID NO: 329424 - DNA, 25 bp, Mus musculus
catcttcatgctctcaagcccgtta

SEQ ID NO: 329425 - DNA, 25 bp, Mus musculus
catcttcatgctgtcaagcccgtta

SEQ ID NO: 329426 - DNA, 25 bp, Mus musculus
catcttcattctactagcacacttt

SEQ ID NO: 329427 - DNA, 25 bp, Mus musculus
catcttcattcttctagcacacttt

SEQ ID NO: 329428 - DNA, 25 bp, Mus musculus
catcttccaggcagtagcttaggca

SEQ ID NO: 329429 - DNA, 25 bp, Mus musculus
catcttccaggctgtagcttaggca

SEQ ID NO: 329430 - DNA, 25 bp, Mus musculus
catcttcccacaaaagtcaccttaa

SEQ ID NO: 329431 - DNA, 25 bp, Mus musculus
catcttcccacataagtcaccttaa

SEQ ID NO: 329432 - DNA, 25 bp, Mus musculus
catcttccggatcctagatatgcta

SEQ ID NO: 329433 - DNA, 25 bp, Mus musculus
catcttccggatgctagatatgcta

SEQ ID NO: 329434 - DNA, 25 bp, Mus musculus
catcttccggcgaggttattataag

SEQ ID NO: 329435 - DNA, 25 bp, Mus musculus
catcttccggcgtggttattataag

SEQ ID NO: 329436 - DNA, 25 bp, Mus musculus
catcttcctctaccatcttgttaat

SEQ ID NO: 329437 - DNA, 25 bp, Mus musculus
catcttcctctagcatcttgttaat

SEQ ID NO: 329438 - DNA, 25 bp, Mus musculus
catcttcctgacatagcagaatggg

SEQ ID NO: 329439 - DNA, 25 bp, Mus musculus
catcttcctgacttagcagaatggg

SEQ ID NO: 329440 - DNA, 25 bp, Mus musculus
catcttcctggtccgacgctttgac

SEQ ID NO: 329441 - DNA, 25 bp, Mus musculus
catcttcctggtgcgacgctttgac

SEQ ID NO: 329442 - DNA, 25 bp, Mus musculus
catcttccttccaggtaaacagaga

SEQ ID NO: 329443 - DNA, 25 bp, Mus musculus
catcttccttccagtacagtatttt

SEQ ID NO: 329444 - DNA, 25 bp, Mus musculus
catcttccttcctggtaaacagaga

SEQ ID NO: 329445 - DNA, 25 bp, Mus musculus
catcttccttcctgtacagtatttt

SEQ ID NO: 329446 - DNA, 25 bp, Mus musculus
catcttccttgacgagcacagccgg

SEQ ID NO: 329447 - DNA, 25 bp, Mus musculus
catcttccttgaggagcacagccgg

SEQ ID NO: 329448 - DNA, 25 bp, Mus musculus
catcttcggcttcagtttcaagggt

SEQ ID NO: 329449 - DNA, 25 bp, Mus musculus
catcttcggcttgagtttcaagggt

SEQ ID NO: 329450 - DNA, 25 bp, Mus musculus
catcttcgtgccactgcaattataa

SEQ ID NO: 329451 - DNA, 25 bp, Mus musculus
catcttcgtgcctctgcaattataa

SEQ ID NO: 329452 - DNA, 25 bp, Mus musculus
catcttcgtggtcgtcgtggtctac

SEQ ID NO: 329453 - DNA, 25 bp, Mus musculus
catcttcgtggtggtcgtggtctac

SEQ ID NO: 329454 - DNA, 25 bp, Mus musculus
catcttctatggcttatgcctccga

SEQ ID NO: 329455 - DNA, 25 bp, Mus musculus
catcttctatgggttatgcctccga

SEQ ID NO: 329456 - DNA, 25 bp, Mus musculus
catcttctcataatttatcttcaga

SEQ ID NO: 329457 - DNA, 25 bp, Mus musculus
catcttctcatattttatcttcaga

SEQ ID NO: 329458 - DNA, 25 bp, Mus musculus
catcttctcccaaggacactgtata

SEQ ID NO: 329459 - DNA, 25 bp, Mus musculus
catcttctcccatggacactgtata

SEQ ID NO: 329460 - DNA, 25 bp, Mus musculus
catcttctcctgcttagcaactatt

SEQ ID NO: 329461 - DNA, 25 bp, Mus musculus
catcttctcctggttagcaactatt

SEQ ID NO: 329462 - DNA, 25 bp, Mus musculus
catcttctctgcctattcatttgat

SEQ ID NO: 329463 - DNA, 25 bp, Mus musculus
catcttctctgcgtattcatttgat

SEQ ID NO: 329464 - DNA, 25 bp, Mus musculus
catcttctgagtagtaaaggaacag

SEQ ID NO: 329465 - DNA, 25 bp, Mus musculus
catcttctgagttgtaaaggaacag

SEQ ID NO: 329466 - DNA, 25 bp, Mus musculus
catcttctgattagtgcaagcttca

SEQ ID NO: 329467 - DNA, 25 bp, Mus musculus
catcttctgatttgtgcaagcttca

SEQ ID NO: 329468 - DNA, 25 bp, Mus musculus
catcttctgcggcaagcacgtgagt

SEQ ID NO: 329469 - DNA, 25 bp, Mus musculus
catcttctgcgggaagcacgtgagt

SEQ ID NO: 329470 - DNA, 25 bp, Mus musculus
catcttctgctgctggtacttggat

SEQ ID NO: 329471 - DNA, 25 bp, Mus musculus
catcttctgctggtggtacttggat

SEQ ID NO: 329472 - DNA, 25 bp, Mus musculus
catcttctgtctagcattccatgta

SEQ ID NO: 329473 - DNA, 25 bp, Mus musculus
catcttctgtcttgcattccatgta

SEQ ID NO: 329474 - DNA, 25 bp, Mus musculus
catcttcttagaagtagacccaaga

SEQ ID NO: 329475 - DNA, 25 bp, Mus musculus
catcttcttagatgtagacccaaga

SEQ ID NO: 329476 - DNA, 25 bp, Mus musculus
catcttctttgtcccgggcatcctg

SEQ ID NO: 329477 - DNA, 25 bp, Mus musculus
catcttctttgtgccgggcatcctg

SEQ ID NO: 329478 - DNA, 25 bp, Mus musculus
catcttgacaacattgtttgttagg

SEQ ID NO: 329479 - DNA, 25 bp, Mus musculus
catcttgacaactttgtttgttagg

SEQ ID NO: 329480 - DNA, 25 bp, Mus musculus
catcttgacctccagttcaacttta

SEQ ID NO: 329481 - DNA, 25 bp, Mus musculus
catcttgacctcgagttcaacttta

SEQ ID NO: 329482 - DNA, 25 bp, Mus musculus
catcttgagaacatgggctcccatg

SEQ ID NO: 329483 - DNA, 25 bp, Mus musculus
catcttgagaacttgggctcccatg

SEQ ID NO: 329484 - DNA, 25 bp, Mus musculus
catcttgaggatccctgtccacaca

SEQ ID NO: 329485 - DNA, 25 bp, Mus musculus
catcttgaggatgcctgtccacaca

SEQ ID NO: 329486 - DNA, 25 bp, Mus musculus
catcttgatccaaaacttccggcag

SEQ ID NO: 329487 - DNA, 25 bp, Mus musculus
catcttgatccataacttccggcag

SEQ ID NO: 329488 - DNA, 25 bp, Mus musculus
catcttgcaagtaatagtttgtcat

SEQ ID NO: 329489 - DNA, 25 bp, Mus musculus
catcttgcaagttatagtttgtcat

SEQ ID NO: 329490 - DNA, 25 bp, Mus musculus
catcttgcaggaccttgggaccatt

SEQ ID NO: 329491 - DNA, 25 bp, Mus musculus
catcttgcaggagcttgggaccatt

SEQ ID NO: 329492 - DNA, 25 bp, Mus musculus
catcttgcccgacatgcccgaggtg

SEQ ID NO: 329493 - DNA, 25 bp, Mus musculus
catcttgcccgagatgcccgaggtg

SEQ ID NO: 329494 - DNA, 25 bp, Mus musculus
catcttgcgcttaccagagagtgac

SEQ ID NO: 329495 - DNA, 25 bp, Mus musculus
catcttgcgctttccagagagtgac

SEQ ID NO: 329496 - DNA, 25 bp, Mus musculus
catcttgcggtgctaggcttcctgc

SEQ ID NO: 329497 - DNA, 25 bp, Mus musculus
catcttgcggtggtaggcttcctgc

SEQ ID NO: 329498 - DNA, 25 bp, Mus musculus
catcttgctaaacgcgtgggctcgg

SEQ ID NO: 329499 - DNA, 25 bp, Mus musculus
catcttgctaaaggcgtgggctcgg

SEQ ID NO: 329500 - DNA, 25 bp, Mus musculus
catcttgctatgacaactgttacag

SEQ ID NO: 329501 - DNA, 25 bp, Mus musculus
catcttgctatgtcaactgttacag

SEQ ID NO: 329502 - DNA, 25 bp, Mus musculus
catcttgctgtccaagcccttgaag

SEQ ID NO: 329503 - DNA, 25 bp, Mus musculus
catcttgctgtcgaagcccttgaag

SEQ ID NO: 329504 - DNA, 25 bp, Mus musculus
catcttgctgttcactaataggcca

SEQ ID NO: 329505 - DNA, 25 bp, Mus musculus
catcttgctgttgactaataggcca

SEQ ID NO: 329506 - DNA, 25 bp, Mus musculus
catcttgcttttatgtgatgagatt

SEQ ID NO: 329507 - DNA, 25 bp, Mus musculus
catcttgcttttttgtgatgagatt

SEQ ID NO: 329508 - DNA, 25 bp, Mus musculus
catcttggaaaacgcacccagaaga

SEQ ID NO: 329509 - DNA, 25 bp, Mus musculus
catcttggaaaaggcacccagaaga

SEQ ID NO: 329510 - DNA, 25 bp, Mus musculus
catcttggaggaagggtccagtcct

SEQ ID NO: 329511 - DNA, 25 bp, Mus musculus
catcttggaggatgggtccagtcct

SEQ ID NO: 329512 - DNA, 25 bp, Mus musculus
catcttggcatcagtctttggtcct

SEQ ID NO: 329513 - DNA, 25 bp, Mus musculus
catcttggcatctgtctttggtcct

SEQ ID NO: 329514 - DNA, 25 bp, Mus musculus
catcttgggaggattcttcttgtag

SEQ ID NO: 329515 - DNA, 25 bp, Mus musculus
catcttgggaggtttcttcttgtag

SEQ ID NO: 329516 - DNA, 25 bp, Mus musculus
catcttgggttgaaggtggatccga

SEQ ID NO: 329517 - DNA, 25 bp, Mus musculus
catcttgggttgtaggtggatccga

SEQ ID NO: 329518 - DNA, 25 bp, Mus musculus
catcttgtaggcagtcgtgctgagc

SEQ ID NO: 329519 - DNA, 25 bp, Mus musculus
catcttgtaggccttcgctctaatt

SEQ ID NO: 329520 - DNA, 25 bp, Mus musculus
catcttgtaggcgttcgctctaatt

SEQ ID NO: 329521 - DNA, 25 bp, Mus musculus
catcttgtaggctgtcgtgctgagc

SEQ ID NO: 329522 - DNA, 25 bp, Mus musculus
catcttgtatagattttacagtgtg

SEQ ID NO: 329523 - DNA, 25 bp, Mus musculus
catcttgtatagtttttacagtgtg

SEQ ID NO: 329524 - DNA, 25 bp, Mus musculus
catcttgtcaaaccgttgtctgcca

SEQ ID NO: 329525 - DNA, 25 bp, Mus musculus
catcttgtcaaagcgttgtctgcca

SEQ ID NO: 329526 - DNA, 25 bp, Mus musculus
catcttgtcattactttttcctttt

SEQ ID NO: 329527 - DNA, 25 bp, Mus musculus
catcttgtcatttctttttcctttt

SEQ ID NO: 329528 - DNA, 25 bp, Mus musculus
catcttgtctccagtggttctctgc

SEQ ID NO: 329529 - DNA, 25 bp, Mus musculus
catcttgtctcctgtggttctctgc

SEQ ID NO: 329530 - DNA, 25 bp, Mus musculus
catcttgtgaggctgttatgcaaag

SEQ ID NO: 329531 - DNA, 25 bp, Mus musculus
catcttgtgagggtgttatgcaaag

SEQ ID NO: 329532 - DNA, 25 bp, Mus musculus
catcttgtgcaaccccaatggtgag

SEQ ID NO: 329533 - DNA, 25 bp, Mus musculus
catcttgtgcaagcccaatggtgag

SEQ ID NO: 329534 - DNA, 25 bp, Mus musculus
catctttaacagaattcagttggtc

SEQ ID NO: 329535 - DNA, 25 bp, Mus musculus
catctttaacagtattcagttggtc

SEQ ID NO: 329536 - DNA, 25 bp, Mus musculus
catctttaatcacgccaggcccggg

SEQ ID NO: 329537 - DNA, 25 bp, Mus musculus
catctttaatcaggccaggcccggg

SEQ ID NO: 329538 - DNA, 25 bp, Mus musculus
catctttaatttccctgtaatactt

SEQ ID NO: 329539 - DNA, 25 bp, Mus musculus
catctttaatttgcctgtaatactt

SEQ ID NO: 329540 - DNA, 25 bp, Mus musculus
catctttacatgagcttattattag

SEQ ID NO: 329541 - DNA, 25 bp, Mus musculus
catctttacatgcagggtgatctgt

SEQ ID NO: 329542 - DNA, 25 bp, Mus musculus
catctttacatggagggtgatctgt

SEQ ID NO: 329543 - DNA, 25 bp, Mus musculus
catctttacatgtgcttattattag

SEQ ID NO: 329544 - DNA, 25 bp, Mus musculus
catctttaccagcaagaagtccctc

SEQ ID NO: 329545 - DNA, 25 bp, Mus musculus
catctttaccaggaagaagtccctc

SEQ ID NO: 329546 - DNA, 25 bp, Mus musculus
catctttactgccaccaatacatta

SEQ ID NO: 329547 - DNA, 25 bp, Mus musculus
catctttactgcgaccaatacatta

SEQ ID NO: 329548 - DNA, 25 bp, Mus musculus
catctttactttcctgttgttgcta

SEQ ID NO: 329549 - DNA, 25 bp, Mus musculus
catctttactttgctgttgttgcta

SEQ ID NO: 329550 - DNA, 25 bp, Mus musculus
catctttagaaaccttcctgggaag

SEQ ID NO: 329551 - DNA, 25 bp, Mus musculus
catctttagaaagcttcctgggaag

SEQ ID NO: 329552 - DNA, 25 bp, Mus musculus
catctttagcccctggactagtaaa

SEQ ID NO: 329553 - DNA, 25 bp, Mus musculus
catctttagcccgtggactagtaaa

SEQ ID NO: 329554 - DNA, 25 bp, Mus musculus
catctttagcttcctcttgaggtga

SEQ ID NO: 329555 - DNA, 25 bp, Mus musculus
catctttagcttgctcttgaggtga

SEQ ID NO: 329556 - DNA, 25 bp, Mus musculus
catctttagggtagggtgtttcatc

SEQ ID NO: 329557 - DNA, 25 bp, Mus musculus
catctttagggttgggtgtttcatc

SEQ ID NO: 329558 - DNA, 25 bp, Mus musculus
catctttattcacatctccatgctt

SEQ ID NO: 329559 - DNA, 25 bp, Mus musculus
catctttattcagatctccatgctt

SEQ ID NO: 329560 - DNA, 25 bp, Mus musculus
catctttcagctagacatcaccaaa

SEQ ID NO: 329561 - DNA, 25 bp, Mus musculus
catctttcagcttgacatcaccaaa

SEQ ID NO: 329562 - DNA, 25 bp, Mus musculus
catctttcatatcgagttcatggtt

SEQ ID NO: 329563 - DNA, 25 bp, Mus musculus
catctttcatatggagttcatggtt

SEQ ID NO: 329564 - DNA, 25 bp, Mus musculus
catctttccaatcccaagtaacttc

SEQ ID NO: 329565 - DNA, 25 bp, Mus musculus
catctttccaatgccaagtaacttc

SEQ ID NO: 329566 - DNA, 25 bp, Mus musculus
catctttccagcctagtagttttta

SEQ ID NO: 329567 - DNA, 25 bp, Mus musculus
catctttccagcgtagtagttttta

SEQ ID NO: 329568 - DNA, 25 bp, Mus musculus
catctttcgcataaggaaatgcacc

SEQ ID NO: 329569 - DNA, 25 bp, Mus musculus
catctttcgcattaggaaatgcacc

SEQ ID NO: 329570 - DNA, 25 bp, Mus musculus
catctttctatgagctccagctagt

SEQ ID NO: 329571 - DNA, 25 bp, Mus musculus
catctttctatgtgctccagctagt

SEQ ID NO: 329572 - DNA, 25 bp, Mus musculus
catctttctcataaagtagcagtgt

SEQ ID NO: 329573 - DNA, 25 bp, Mus musculus
catctttctcattaagtagcagtgt

SEQ ID NO: 329574 - DNA, 25 bp, Mus musculus
catctttctgatcgcgtgaccatgt

SEQ ID NO: 329575 - DNA, 25 bp, Mus musculus
catctttctgatggcgtgaccatgt

SEQ ID NO: 329576 - DNA, 25 bp, Mus musculus
catctttctgcacaagctcatgggt

SEQ ID NO: 329577 - DNA, 25 bp, Mus musculus
catctttctgcagaagctcatgggt

SEQ ID NO: 329578 - DNA, 25 bp, Mus musculus
catctttctggtagatgctcaggtc

SEQ ID NO: 329579 - DNA, 25 bp, Mus musculus
catctttctggttgatgctcaggtc

SEQ ID NO: 329580 - DNA, 25 bp, Mus musculus
catctttcttttcactgcagcagtg

SEQ ID NO: 329581 - DNA, 25 bp, Mus musculus
catctttcttttgactgcagcagtg

SEQ ID NO: 329582 - DNA, 25 bp, Mus musculus
catctttgaactcggaacttcctgt

SEQ ID NO: 329583 - DNA, 25 bp, Mus musculus
catctttgaactgggaacttcctgt

SEQ ID NO: 329584 - DNA, 25 bp, Mus musculus
catctttgactgcaactgtagcatt

SEQ ID NO: 329585 - DNA, 25 bp, Mus musculus
catctttgactggaactgtagcatt

SEQ ID NO: 329586 - DNA, 25 bp, Mus musculus
catctttgagaaatgctacctggga

SEQ ID NO: 329587 - DNA, 25 bp, Mus musculus
catctttgagaattgctacctggga

SEQ ID NO: 329588 - DNA, 25 bp, Mus musculus
catctttgagcccatcctgggtgag

SEQ ID NO: 329589 - DNA, 25 bp, Mus musculus
catctttgagccgatcctgggtgag

SEQ ID NO: 329590 - DNA, 25 bp, Mus musculus
catctttgagctcttacccaaatga

SEQ ID NO: 329591 - DNA, 25 bp, Mus musculus
catctttgagctgttacccaaatga

SEQ ID NO: 329592 - DNA, 25 bp, Mus musculus
catctttgataacggaaatggtttc

SEQ ID NO: 329593 - DNA, 25 bp, Mus musculus
catctttgataagggaaatggtttc

SEQ ID NO: 329594 - DNA, 25 bp, Mus musculus
catctttggagaacctcctctgaga

SEQ ID NO: 329595 - DNA, 25 bp, Mus musculus
catctttggagatcctcctctgaga

SEQ ID NO: 329596 - DNA, 25 bp, Mus musculus
catctttggattctggctctgtgta

SEQ ID NO: 329597 - DNA, 25 bp, Mus musculus
catctttggattgtggctctgtgta

SEQ ID NO: 329598 - DNA, 25 bp, Mus musculus
catctttggctaatctggctgttta

SEQ ID NO: 329599 - DNA, 25 bp, Mus musculus
catctttggctattctggctgttta

SEQ ID NO: 329600 - DNA, 25 bp, Mus musculus
catctttggctgagcttagacagag

SEQ ID NO: 329601 - DNA, 25 bp, Mus musculus
catctttggctgtgcttagacagag

SEQ ID NO: 329602 - DNA, 25 bp, Mus musculus
catctttgggcccttggcactaaaa

SEQ ID NO: 329603 - DNA, 25 bp, Mus musculus
catctttgggccgttggcactaaaa

SEQ ID NO: 329604 - DNA, 25 bp, Mus musculus
catctttgggtgctgctccttatat

SEQ ID NO: 329605 - DNA, 25 bp, Mus musculus
catctttgggtggtgctccttatat

SEQ ID NO: 329606 - DNA, 25 bp, Mus musculus
catctttgtatgacattagcagggt

SEQ ID NO: 329607 - DNA, 25 bp, Mus musculus
catctttgtatgtcattagcagggt

SEQ ID NO: 329608 - DNA, 25 bp, Mus musculus
catctttgtgatctctttggtccat

SEQ ID NO: 329609 - DNA, 25 bp, Mus musculus
catctttgtgatgtctttggtccat

SEQ ID NO: 329610 - DNA, 25 bp, Mus musculus
catctttgtggtccccacctggtag

SEQ ID NO: 329611 - DNA, 25 bp, Mus musculus
catctttgtggtgcccacctggtag

SEQ ID NO: 329612 - DNA, 25 bp, Mus musculus
catctttgtgtgcaggtgacctctc

SEQ ID NO: 329613 - DNA, 25 bp, Mus musculus
catctttgtgtggaggtgacctctc

SEQ ID NO: 329614 - DNA, 25 bp, Mus musculus
catctttgttctagtctttgtcagt

SEQ ID NO: 329615 - DNA, 25 bp, Mus musculus
catctttgttcttgtctttgtcagt

SEQ ID NO: 329616 - DNA, 25 bp, Mus musculus
catcttttaaacagacctgcatttt

SEQ ID NO: 329617 - DNA, 25 bp, Mus musculus
catcttttaaactgacctgcatttt

SEQ ID NO: 329618 - DNA, 25 bp, Mus musculus
catcttttattcatgctgaggccat

SEQ ID NO: 329619 - DNA, 25 bp, Mus musculus
catcttttattcttgctgaggccat

SEQ ID NO: 329620 - DNA, 25 bp, Mus musculus
catcttttctatactgctgttctac

SEQ ID NO: 329621 - DNA, 25 bp, Mus musculus
catcttttctattctgctgttctac

SEQ ID NO: 329622 - DNA, 25 bp, Mus musculus
catcttttctgcatttcaccttgta

SEQ ID NO: 329623 - DNA, 25 bp, Mus musculus
catcttttctgcttttcaccttgta

SEQ ID NO: 329624 - DNA, 25 bp, Mus musculus
catcttttgaatctccccttttcta

SEQ ID NO: 329625 - DNA, 25 bp, Mus musculus
catcttttgaatgtccccttttcta

SEQ ID NO: 329626 - DNA, 25 bp, Mus musculus
catcttttggtaagccccggagtcc

SEQ ID NO: 329627 - DNA, 25 bp, Mus musculus
catcttttggtatgccccggagtcc

SEQ ID NO: 329628 - DNA, 25 bp, Mus musculus
catcttttgttcaatttaaaccttg

SEQ ID NO: 329629 - DNA, 25 bp, Mus musculus
catcttttgttctatttaaaccttg

SEQ ID NO: 329630 - DNA, 25 bp, Mus musculus
catcttttgttgaccccattggaga

SEQ ID NO: 329631 - DNA, 25 bp, Mus musculus
catcttttgttgtccccattggaga

SEQ ID NO: 329632 - DNA, 25 bp, Mus musculus
catctttttactcctgtttgggttg

SEQ ID NO: 329633 - DNA, 25 bp, Mus musculus
catctttttactgctgtttgggttg

SEQ ID NO: 329634 - DNA, 25 bp, Mus musculus
catctttttataaaaggctctcaag

SEQ ID NO: 329635 - DNA, 25 bp, Mus musculus
catctttttatataaggctctcaag

SEQ ID NO: 329636 - DNA, 25 bp, Mus musculus
catctttttcatccggcttcacgac

SEQ ID NO: 329637 - DNA, 25 bp, Mus musculus
catctttttcatgcggcttcacgac

SEQ ID NO: 329638 - DNA, 25 bp, Mus musculus
catctttttggtcttctaggtagct

SEQ ID NO: 329639 - DNA, 25 bp, Mus musculus
catctttttggtgttctaggtagct

SEQ ID NO: 329640 - DNA, 25 bp, Mus musculus
catcttttttccacccagagtatcc

SEQ ID NO: 329641 - DNA, 25 bp, Mus musculus
catcttttttcctcccagagtatcc

SEQ ID NO: 329642 - DNA, 25 bp, Mus musculus
catgaaaacattagctgcctacctc

SEQ ID NO: 329643 - DNA, 25 bp, Mus musculus
catgaaaacatttgctgcctacctc

SEQ ID NO: 329644 - DNA, 25 bp, Mus musculus
catgaaaagctgctctctgcggcag

SEQ ID NO: 329645 - DNA, 25 bp, Mus musculus
catgaaaagctggtctctgcggcag

SEQ ID NO: 329646 - DNA, 25 bp, Mus musculus
catgaaacagtgacctagtcactgc

SEQ ID NO: 329647 - DNA, 25 bp, Mus musculus
catgaaacagtgtcctagtcactgc

SEQ ID NO: 329648 - DNA, 25 bp, Mus musculus
catgaaacatgccttaagcccctca

SEQ ID NO: 329649 - DNA, 25 bp, Mus musculus
catgaaacatgcgttaagcccctca

SEQ ID NO: 329650 - DNA, 25 bp, Mus musculus
catgaaaccctgagcaactatgtgg

SEQ ID NO: 329651 - DNA, 25 bp, Mus musculus
catgaaaccctgtgcaactatgtgg

SEQ ID NO: 329652 - DNA, 25 bp, Mus musculus
catgaaaccgagatcacggactact

SEQ ID NO: 329653 - DNA, 25 bp, Mus musculus
catgaaaccgagttcacggactact

SEQ ID NO: 329654 - DNA, 25 bp, Mus musculus
catgaaagcagcctggacttccctt

SEQ ID NO: 329655 - DNA, 25 bp, Mus musculus
catgaaagcagcgtggacttccctt

SEQ ID NO: 329656 - DNA, 25 bp, Mus musculus
catgaaagcccacacttagcagaat

SEQ ID NO: 329657 - DNA, 25 bp, Mus musculus
catgaaagcccagacttagcagaat

SEQ ID NO: 329658 - DNA, 25 bp, Mus musculus
catgaaagctcaactaaaccgtgat

SEQ ID NO: 329659 - DNA, 25 bp, Mus musculus
catgaaagctcatctaaaccgtgat

SEQ ID NO: 329660 - DNA, 25 bp, Mus musculus
catgaaataataaattcagtccaat

SEQ ID NO: 329661 - DNA, 25 bp, Mus musculus
catgaaataatatattcagtccaat

SEQ ID NO: 329662 - DNA, 25 bp, Mus musculus
catgaaatctcaacaacatggctgc

SEQ ID NO: 329663 - DNA, 25 bp, Mus musculus
catgaaatctcatcaacatggctgc

SEQ ID NO: 329664 - DNA, 25 bp, Mus musculus
catgaaatgtctccctgttccccat

SEQ ID NO: 329665 - DNA, 25 bp, Mus musculus
catgaaatgtctgcctgttccccat

SEQ ID NO: 329666 - DNA, 25 bp, Mus musculus
catgaaatgttgatcaagcactccc

SEQ ID NO: 329667 - DNA, 25 bp, Mus musculus
catgaaatgttgttcaagcactccc

SEQ ID NO: 329668 - DNA, 25 bp, Mus musculus
catgaaatttagcttgttgtgtgtg

SEQ ID NO: 329669 - DNA, 25 bp, Mus musculus
catgaaatttaggttgttgtgtgtg

SEQ ID NO: 329670 - DNA, 25 bp, Mus musculus
catgaacaatgtcaccctgggcaat

SEQ ID NO: 329671 - DNA, 25 bp, Mus musculus
catgaacaatgtgaccctgggcaat

SEQ ID NO: 329672 - DNA, 25 bp, Mus musculus
catgaacacaacagccaccaagatt

SEQ ID NO: 329673 - DNA, 25 bp, Mus musculus
catgaacacaactgccaccaagatt

SEQ ID NO: 329674 - DNA, 25 bp, Mus musculus
catgaacacatcagctagcaacaga

SEQ ID NO: 329675 - DNA, 25 bp, Mus musculus
catgaacacatctgctagcaacaga

SEQ ID NO: 329676 - DNA, 25 bp, Mus musculus
catgaacagcctatgccaatcgtgg

SEQ ID NO: 329677 - DNA, 25 bp, Mus musculus
catgaacagcctttgccaatcgtgg

SEQ ID NO: 329678 - DNA, 25 bp, Mus musculus
catgaacatgaactcagacttttgt

SEQ ID NO: 329679 - DNA, 25 bp, Mus musculus
catgaacatgaagtcagacttttgt

SEQ ID NO: 329680 - DNA, 25 bp, Mus musculus
catgaacatgtgactcaggacctac

SEQ ID NO: 329681 - DNA, 25 bp, Mus musculus
catgaacatgtgtctcaggacctac

SEQ ID NO: 329682 - DNA, 25 bp, Mus musculus
catgaacccaatcttccagaagagc

SEQ ID NO: 329683 - DNA, 25 bp, Mus musculus
catgaacccaatgttccagaagagc

SEQ ID NO: 329684 - DNA, 25 bp, Mus musculus
catgaaccctcaacacaagtgcgaa

SEQ ID NO: 329685 - DNA, 25 bp, Mus musculus
catgaaccctcatcacaagtgcgaa

SEQ ID NO: 329686 - DNA, 25 bp, Mus musculus
catgaacctgaccatagacgagttg

SEQ ID NO: 329687 - DNA, 25 bp, Mus musculus
catgaacctgacgatagacgagttg

SEQ ID NO: 329688 - DNA, 25 bp, Mus musculus
catgaacctttcaattatcccctaa

SEQ ID NO: 329689 - DNA, 25 bp, Mus musculus
catgaacctttctattatcccctaa

SEQ ID NO: 329690 - DNA, 25 bp, Mus musculus
catgaacgctttccattacgcttcg

SEQ ID NO: 329691 - DNA, 25 bp, Mus musculus
catgaacgctttgcattacgcttcg

SEQ ID NO: 329692 - DNA, 25 bp, Mus musculus
catgaactacgtaagatgctatctt

SEQ ID NO: 329693 - DNA, 25 bp, Mus musculus
catgaactacgttagatgctatctt

SEQ ID NO: 329694 - DNA, 25 bp, Mus musculus
catgaactcagcacctaaatgtcac

SEQ ID NO: 329695 - DNA, 25 bp, Mus musculus
catgaactcagctcctaaatgtcac

SEQ ID NO: 329696 - DNA, 25 bp, Mus musculus
catgaactctatcgcaggcagctct

SEQ ID NO: 329697 - DNA, 25 bp, Mus musculus
catgaactctatggcaggcagctct

SEQ ID NO: 329698 - DNA, 25 bp, Mus musculus
catgaactgtagctggcctttacct

SEQ ID NO: 329699 - DNA, 25 bp, Mus musculus
catgaactgtaggtggcctttacct

SEQ ID NO: 329700 - DNA, 25 bp, Mus musculus
catgaactgtggctttttgtaaaaa

SEQ ID NO: 329701 - DNA, 25 bp, Mus musculus
catgaactgtgggtttttgtaaaaa

SEQ ID NO: 329702 - DNA, 25 bp, Mus musculus
catgaacttctgctgtatactggaa

SEQ ID NO: 329703 - DNA, 25 bp, Mus musculus
catgaacttctggtgtatactggaa

SEQ ID NO: 329704 - DNA, 25 bp, Mus musculus
catgaactttcaagaggtgctggca

SEQ ID NO: 329705 - DNA, 25 bp, Mus musculus
catgaactttcatgaggtgctggca

SEQ ID NO: 329706 - DNA, 25 bp, Mus musculus
catgaagacaccacattcctagcat

SEQ ID NO: 329707 - DNA, 25 bp, Mus musculus
catgaagacacctcattcctagcat

SEQ ID NO: 329708 - DNA, 25 bp, Mus musculus
catgaagacactaatcctcctctct

SEQ ID NO: 329709 - DNA, 25 bp, Mus musculus
catgaagacacttatcctcctctct

SEQ ID NO: 329710 - DNA, 25 bp, Mus musculus
catgaagactatcggctgctcctga

SEQ ID NO: 329711 - DNA, 25 bp, Mus musculus
catgaagactatgggctgctcctga

SEQ ID NO: 329712 - DNA, 25 bp, Mus musculus
catgaagagaatagctgcttgccag

SEQ ID NO: 329713 - DNA, 25 bp, Mus musculus
catgaagagaattgctgcttgccag

SEQ ID NO: 329714 - DNA, 25 bp, Mus musculus
catgaagaggtcacttctggtgcaa

SEQ ID NO: 329715 - DNA, 25 bp, Mus musculus
catgaagaggtctcttctggtgcaa

SEQ ID NO: 329716 - DNA, 25 bp, Mus musculus
catgaagatctgctgctgcgcggat

SEQ ID NO: 329717 - DNA, 25 bp, Mus musculus
catgaagatctggtgctgcgcggat

SEQ ID NO: 329718 - DNA, 25 bp, Mus musculus
catgaagatgcaatgctgtgctcaa

SEQ ID NO: 329719 - DNA, 25 bp, Mus musculus
catgaagatgcattgctgtgctcaa

SEQ ID NO: 329720 - DNA, 25 bp, Mus musculus
catgaagccacaaacgctagagaag

SEQ ID NO: 329721 - DNA, 25 bp, Mus musculus
catgaagccacacaaccaagcctga

SEQ ID NO: 329722 - DNA, 25 bp, Mus musculus
catgaagccacagaaccaagcctga

SEQ ID NO: 329723 - DNA, 25 bp, Mus musculus
catgaagccacatacgctagagaag

SEQ ID NO: 329724 - DNA, 25 bp, Mus musculus
catgaaggagtcagcaaggagccaa

SEQ ID NO: 329725 - DNA, 25 bp, Mus musculus
catgaaggagtctgcaaggagccaa

SEQ ID NO: 329726 - DNA, 25 bp, Mus musculus
catgaaggccagagttggtagaagc

SEQ ID NO: 329727 - DNA, 25 bp, Mus musculus
catgaaggccagtgttggtagaagc

SEQ ID NO: 329728 - DNA, 25 bp, Mus musculus
catgaaggctgacgcttggaatagt

SEQ ID NO: 329729 - DNA, 25 bp, Mus musculus
catgaaggctgaggcttggaatagt

SEQ ID NO: 329730 - DNA, 25 bp, Mus musculus
catgaagggttacctgagcctctca

SEQ ID NO: 329731 - DNA, 25 bp, Mus musculus
catgaagggttagctgagcctctca

SEQ ID NO: 329732 - DNA, 25 bp, Mus musculus
catgaaggtaggatgctagtgcagc

SEQ ID NO: 329733 - DNA, 25 bp, Mus musculus
catgaaggtaggttgctagtgcagc

SEQ ID NO: 329734 - DNA, 25 bp, Mus musculus
catgaaggtctaaacgtacaaggga

SEQ ID NO: 329735 - DNA, 25 bp, Mus musculus
catgaaggtctaatctttgcacttt

SEQ ID NO: 329736 - DNA, 25 bp, Mus musculus
catgaaggtctatacgtacaaggga

SEQ ID NO: 329737 - DNA, 25 bp, Mus musculus
catgaaggtctattctttgcacttt

SEQ ID NO: 329738 - DNA, 25 bp, Mus musculus
catgaaggtggcctgttgccttgat

SEQ ID NO: 329739 - DNA, 25 bp, Mus musculus
catgaaggtggcgtgttgccttgat

SEQ ID NO: 329740 - DNA, 25 bp, Mus musculus
catgaaggttcccaaccatctatac

SEQ ID NO: 329741 - DNA, 25 bp, Mus musculus
catgaaggttccgaaccatctatac

SEQ ID NO: 329742 - DNA, 25 bp, Mus musculus
catgaagtagtcctccagtcaccca

SEQ ID NO: 329743 - DNA, 25 bp, Mus musculus
catgaagtagtcgtccagtcaccca

SEQ ID NO: 329744 - DNA, 25 bp, Mus musculus
catgaagtcatcattgcctttgtga

SEQ ID NO: 329745 - DNA, 25 bp, Mus musculus
catgaagtcatctttgcctttgtga

SEQ ID NO: 329746 - DNA, 25 bp, Mus musculus
catgaagtgcagaacccatccagaa

SEQ ID NO: 329747 - DNA, 25 bp, Mus musculus
catgaagtgcagtacccatccagaa

SEQ ID NO: 329748 - DNA, 25 bp, Mus musculus
catgaagttcttctctgtagtttta

SEQ ID NO: 329749 - DNA, 25 bp, Mus musculus
catgaagttcttgtctgtagtttta

SEQ ID NO: 329750 - DNA, 25 bp, Mus musculus
catgaagtttcaaatctgtacagat

SEQ ID NO: 329751 - DNA, 25 bp, Mus musculus
catgaagtttcatatctgtacagat

SEQ ID NO: 329752 - DNA, 25 bp, Mus musculus
catgaatactggactgttccttgaa

SEQ ID NO: 329753 - DNA, 25 bp, Mus musculus
catgaatactggtctgttccttgaa

SEQ ID NO: 329754 - DNA, 25 bp, Mus musculus
catgaatatgctctgatcctcgttt

SEQ ID NO: 329755 - DNA, 25 bp, Mus musculus
catgaatatgctgtgatcctcgttt

SEQ ID NO: 329756 - DNA, 25 bp, Mus musculus
catgaatattgaccggcccctgttg

SEQ ID NO: 329757 - DNA, 25 bp, Mus musculus
catgaatattgagcggcccctgttg

SEQ ID NO: 329758 - DNA, 25 bp, Mus musculus
catgaatcacataaactacctccac

SEQ ID NO: 329759 - DNA, 25 bp, Mus musculus
catgaatcacattaactacctccac

SEQ ID NO: 329760 - DNA, 25 bp, Mus musculus
catgaatcaggtacactctctgaga

SEQ ID NO: 329761 - DNA, 25 bp, Mus musculus
catgaatcaggttcactctctgaga

SEQ ID NO: 329762 - DNA, 25 bp, Mus musculus
catgaatcctttaggaaccctgaag

SEQ ID NO: 329763 - DNA, 25 bp, Mus musculus
catgaatccttttggaaccctgaag

SEQ ID NO: 329764 - DNA, 25 bp, Mus musculus
catgaatgaatactgcttactggct

SEQ ID NO: 329765 - DNA, 25 bp, Mus musculus
catgaatgaatagtgcttactggct

SEQ ID NO: 329766 - DNA, 25 bp, Mus musculus
catgaatgagcacgcccgaggttca

SEQ ID NO: 329767 - DNA, 25 bp, Mus musculus
catgaatgagcaggcccgaggttca

SEQ ID NO: 329768 - DNA, 25 bp, Mus musculus
catgaatggcccatagcatttcttt

SEQ ID NO: 329769 - DNA, 25 bp, Mus musculus
catgaatggcccttagcatttcttt

SEQ ID NO: 329770 - DNA, 25 bp, Mus musculus
catgaatgggatcgtatttatccac

SEQ ID NO: 329771 - DNA, 25 bp, Mus musculus
catgaatgggatggtatttatccac

SEQ ID NO: 329772 - DNA, 25 bp, Mus musculus
catgaatggtagatgaagtagacat

SEQ ID NO: 329773 - DNA, 25 bp, Mus musculus
catgaatggtagttgaagtagacat

SEQ ID NO: 329774 - DNA, 25 bp, Mus musculus
catgaattcagtacacggcagttgt

SEQ ID NO: 329775 - DNA, 25 bp, Mus musculus
catgaattcagttcacggcagttgt

SEQ ID NO: 329776 - DNA, 25 bp, Mus musculus
catgaattccgtaccagcgtgacaa

SEQ ID NO: 329777 - DNA, 25 bp, Mus musculus
catgaattccgttccagcgtgacaa

SEQ ID NO: 329778 - DNA, 25 bp, Mus musculus
catgaattcgcgcatgtggttttca

SEQ ID NO: 329779 - DNA, 25 bp, Mus musculus
catgaattcgcggatgtggttttca

SEQ ID NO: 329780 - DNA, 25 bp, Mus musculus
catgaattgtgccttaaatgggata

SEQ ID NO: 329781 - DNA, 25 bp, Mus musculus
catgaattgtgcgttaaatgggata

SEQ ID NO: 329782 - DNA, 25 bp, Mus musculus
catgaatttcctcccaggatggctt

SEQ ID NO: 329783 - DNA, 25 bp, Mus musculus
catgaatttcctgccaggatggctt

SEQ ID NO: 329784 - DNA, 25 bp, Mus musculus
catgacaaatttcgctctcccttca

SEQ ID NO: 329785 - DNA, 25 bp, Mus musculus
catgacaaatttggctctcccttca

SEQ ID NO: 329786 - DNA, 25 bp, Mus musculus
catgacaagtgtactaatcctctcc

SEQ ID NO: 329787 - DNA, 25 bp, Mus musculus
catgacaagtgttctaatcctctcc

SEQ ID NO: 329788 - DNA, 25 bp, Mus musculus
catgacacaatgctctggtggctcc

SEQ ID NO: 329789 - DNA, 25 bp, Mus musculus
catgacacaatggtctggtggctcc

SEQ ID NO: 329790 - DNA, 25 bp, Mus musculus
catgacaccgacaggccagcagagg

SEQ ID NO: 329791 - DNA, 25 bp, Mus musculus
catgacaccgactggccagcagagg

SEQ ID NO: 329792 - DNA, 25 bp, Mus musculus
catgacactgagatacctgccattc

SEQ ID NO: 329793 - DNA, 25 bp, Mus musculus
catgacactgagttacctgccattc

SEQ ID NO: 329794 - DNA, 25 bp, Mus musculus
catgacactggcatcagcgatcagt

SEQ ID NO: 329795 - DNA, 25 bp, Mus musculus
catgacactggcttcagcgatcagt

SEQ ID NO: 329796 - DNA, 25 bp, Mus musculus
catgacagcattacttactagcctt

SEQ ID NO: 329797 - DNA, 25 bp, Mus musculus
catgacagcatttcttactagcctt

SEQ ID NO: 329798 - DNA, 25 bp, Mus musculus
catgacagccatcggaattgatttc

SEQ ID NO: 329799 - DNA, 25 bp, Mus musculus
catgacagccatgggaattgatttc

SEQ ID NO: 329800 - DNA, 25 bp, Mus musculus
catgacagttgtcgctgtcctctga

SEQ ID NO: 329801 - DNA, 25 bp, Mus musculus
catgacagttgtggctgtcctctga

SEQ ID NO: 329802 - DNA, 25 bp, Mus musculus
catgacatacaaatgagccccaggg

SEQ ID NO: 329803 - DNA, 25 bp, Mus musculus
catgacatacaattgagccccaggg

SEQ ID NO: 329804 - DNA, 25 bp, Mus musculus
catgacatgtttatggacatcgcca

SEQ ID NO: 329805 - DNA, 25 bp, Mus musculus
catgacatgtttttggacatcgcca

SEQ ID NO: 329806 - DNA, 25 bp, Mus musculus
catgacattattatgcccaggaaat

SEQ ID NO: 329807 - DNA, 25 bp, Mus musculus
catgacattattttgcccaggaaat

SEQ ID NO: 329808 - DNA, 25 bp, Mus musculus
catgaccacagtccatgccatcact

SEQ ID NO: 329809 - DNA, 25 bp, Mus musculus
catgaccacagtgcatgccatcact

SEQ ID NO: 329810 - DNA, 25 bp, Mus musculus
catgaccagaagcttgacgcaccaa

SEQ ID NO: 329811 - DNA, 25 bp, Mus musculus
catgaccagaaggttgacgcaccaa

SEQ ID NO: 329812 - DNA, 25 bp, Mus musculus
catgaccagaggcactttagtataa

SEQ ID NO: 329813 - DNA, 25 bp, Mus musculus
catgaccagagggactttagtataa

SEQ ID NO: 329814 - DNA, 25 bp, Mus musculus
catgaccaggagcactacagagatt

SEQ ID NO: 329815 - DNA, 25 bp, Mus musculus
catgaccaggaggactacagagatt

SEQ ID NO: 329816 - DNA, 25 bp, Mus musculus
catgaccaggcacctttgtgtcgtg

SEQ ID NO: 329817 - DNA, 25 bp, Mus musculus
catgaccaggcagctttgtgtcgtg

SEQ ID NO: 329818 - DNA, 25 bp, Mus musculus
catgaccatgcccaaactgaaatac

SEQ ID NO: 329819 - DNA, 25 bp, Mus musculus
catgaccatgccgaaactgaaatac

SEQ ID NO: 329820 - DNA, 25 bp, Mus musculus
catgaccatgtgaggactggagttt

SEQ ID NO: 329821 - DNA, 25 bp, Mus musculus
catgaccatgtgtggactggagttt

SEQ ID NO: 329822 - DNA, 25 bp, Mus musculus
catgaccccactctgttgtgtgtgt

SEQ ID NO: 329823 - DNA, 25 bp, Mus musculus
catgaccccactgtgttgtgtgtgt

SEQ ID NO: 329824 - DNA, 25 bp, Mus musculus
catgacccctttagttatgtttcct

SEQ ID NO: 329825 - DNA, 25 bp, Mus musculus
catgaccccttttgttatgtttcct

SEQ ID NO: 329826 - DNA, 25 bp, Mus musculus
catgaccctcatactctagcgtgaa

SEQ ID NO: 329827 - DNA, 25 bp, Mus musculus
catgaccctcattctctagcgtgaa

SEQ ID NO: 329828 - DNA, 25 bp, Mus musculus
catgaccctggcatactgtgtaaat

SEQ ID NO: 329829 - DNA, 25 bp, Mus musculus
catgaccctggcttactgtgtaaat

SEQ ID NO: 329830 - DNA, 25 bp, Mus musculus
catgaccgagtcatctgaggatcaa

SEQ ID NO: 329831 - DNA, 25 bp, Mus musculus
catgaccgagtcttctgaggatcaa

SEQ ID NO: 329832 - DNA, 25 bp, Mus musculus
catgaccggcctctgatggttttag

SEQ ID NO: 329833 - DNA, 25 bp, Mus musculus
catgaccggcctgtgatggttttag

SEQ ID NO: 329834 - DNA, 25 bp, Mus musculus
catgacctctgacgaggctcttctg

SEQ ID NO: 329835 - DNA, 25 bp, Mus musculus
catgacctctgaggaggctcttctg

SEQ ID NO: 329836 - DNA, 25 bp, Mus musculus
catgacctgataccgtcttgtgaaa

SEQ ID NO: 329837 - DNA, 25 bp, Mus musculus
catgacctgatagcgtcttgtgaaa

SEQ ID NO: 329838 - DNA, 25 bp, Mus musculus
catgacctgtgtatgggagtgccca

SEQ ID NO: 329839 - DNA, 25 bp, Mus musculus
catgacctgtgtttgggagtgccca

SEQ ID NO: 329840 - DNA, 25 bp, Mus musculus
catgaccttcataacctttttcgaa

SEQ ID NO: 329841 - DNA, 25 bp, Mus musculus
catgaccttcatcgcctcggaaggt

SEQ ID NO: 329842 - DNA, 25 bp, Mus musculus
catgaccttcatggcctcggaaggt

SEQ ID NO: 329843 - DNA, 25 bp, Mus musculus
catgaccttcattacctttttcgaa

SEQ ID NO: 329844 - DNA, 25 bp, Mus musculus
catgaccttgtaagctctagcctta

SEQ ID NO: 329845 - DNA, 25 bp, Mus musculus
catgaccttgtatgctctagcctta

SEQ ID NO: 329846 - DNA, 25 bp, Mus musculus
catgaccttgtcatgatccggctaa

SEQ ID NO: 329847 - DNA, 25 bp, Mus musculus
catgaccttgtcttgatccggctaa

SEQ ID NO: 329848 - DNA, 25 bp, Mus musculus
catgacgctggtagatgagactaac

SEQ ID NO: 329849 - DNA, 25 bp, Mus musculus
catgacgctggttgatgagactaac

SEQ ID NO: 329850 - DNA, 25 bp, Mus musculus
catgacggctgccatcaaagaccag

SEQ ID NO: 329851 - DNA, 25 bp, Mus musculus
catgacggctgcgatcaaagaccag

SEQ ID NO: 329852 - DNA, 25 bp, Mus musculus
catgacgggttcatatctctctgga

SEQ ID NO: 329853 - DNA, 25 bp, Mus musculus
catgacgggttcttatctctctgga

SEQ ID NO: 329854 - DNA, 25 bp, Mus musculus
catgactactttcctgggttggtgt

SEQ ID NO: 329855 - DNA, 25 bp, Mus musculus
catgactactttgctgggttggtgt

SEQ ID NO: 329856 - DNA, 25 bp, Mus musculus
catgactagctcaatgtatgtaaat

SEQ ID NO: 329857 - DNA, 25 bp, Mus musculus
catgactagctctatgtatgtaaat

SEQ ID NO: 329858 - DNA, 25 bp, Mus musculus
catgactccattcctagcacttagg

SEQ ID NO: 329859 - DNA, 25 bp, Mus musculus
catgactccattgctagcacttagg

SEQ ID NO: 329860 - DNA, 25 bp, Mus musculus
catgactcccgacataggctttgag

SEQ ID NO: 329861 - DNA, 25 bp, Mus musculus
catgactcccgagataggctttgag

SEQ ID NO: 329862 - DNA, 25 bp, Mus musculus
catgactctggcactttgaaaataa

SEQ ID NO: 329863 - DNA, 25 bp, Mus musculus
catgactctggctctttgaaaataa

SEQ ID NO: 329864 - DNA, 25 bp, Mus musculus
catgactgaagcaataaaccttttc

SEQ ID NO: 329865 - DNA, 25 bp, Mus musculus
catgactgaagctataaaccttttc

SEQ ID NO: 329866 - DNA, 25 bp, Mus musculus
catgactgaagtctgacttcaggaa

SEQ ID NO: 329867 - DNA, 25 bp, Mus musculus
catgactgaagtgtgacttcaggaa

SEQ ID NO: 329868 - DNA, 25 bp, Mus musculus
catgactgggtgagaagtgccttct

SEQ ID NO: 329869 - DNA, 25 bp, Mus musculus
catgactgggtgtgaagtgccttct

SEQ ID NO: 329870 - DNA, 25 bp, Mus musculus
catgactggtgtcgaacaatggcca

SEQ ID NO: 329871 - DNA, 25 bp, Mus musculus
catgactggtgtggaacaatggcca

SEQ ID NO: 329872 - DNA, 25 bp, Mus musculus
catgactgtcccacttgcaaagaga

SEQ ID NO: 329873 - DNA, 25 bp, Mus musculus
catgactgtccctcttgcaaagaga

SEQ ID NO: 329874 - DNA, 25 bp, Mus musculus
catgactgtgcgagtgcatgtgctg

SEQ ID NO: 329875 - DNA, 25 bp, Mus musculus
catgactgtgcgtgtgcatgtgctg

SEQ ID NO: 329876 - DNA, 25 bp, Mus musculus
catgactgtgtgagattaaggcttc

SEQ ID NO: 329877 - DNA, 25 bp, Mus musculus
catgactgtgtgtgattaaggcttc

SEQ ID NO: 329878 - DNA, 25 bp, Mus musculus
catgacttaacactcagctgcattc

SEQ ID NO: 329879 - DNA, 25 bp, Mus musculus
catgacttaacagtcagctgcattc

SEQ ID NO: 329880 - DNA, 25 bp, Mus musculus
catgacttcatacttgtgatctcaa

SEQ ID NO: 329881 - DNA, 25 bp, Mus musculus
catgacttcatagttgtgatctcaa

SEQ ID NO: 329882 - DNA, 25 bp, Mus musculus
catgacttctttagatcactggtct

SEQ ID NO: 329883 - DNA, 25 bp, Mus musculus
catgacttcttttgatcactggtct

SEQ ID NO: 329884 - DNA, 25 bp, Mus musculus
catgacttgagtccagtgagatctc

SEQ ID NO: 329885 - DNA, 25 bp, Mus musculus
catgacttgagtgcagtgagatctc

SEQ ID NO: 329886 - DNA, 25 bp, Mus musculus
catgacttggatatgaggaggcaga

SEQ ID NO: 329887 - DNA, 25 bp, Mus musculus
catgacttggatttgaggaggcaga

SEQ ID NO: 329888 - DNA, 25 bp, Mus musculus
catgactttcttacagcactgtttg

SEQ ID NO: 329889 - DNA, 25 bp, Mus musculus
catgactttctttcagcactgtttg

SEQ ID NO: 329890 - DNA, 25 bp, Mus musculus
catgactttgctccctagtttggct

SEQ ID NO: 329891 - DNA, 25 bp, Mus musculus
catgactttgctgcctagtttggct

SEQ ID NO: 329892 - DNA, 25 bp, Mus musculus
catgactttgttactggagggcctg

SEQ ID NO: 329893 - DNA, 25 bp, Mus musculus
catgactttgtttctggagggcctg

SEQ ID NO: 329894 - DNA, 25 bp, Mus musculus
catgacttttgacagcaccattcac

SEQ ID NO: 329895 - DNA, 25 bp, Mus musculus
catgacttttgagagcaccattcac

SEQ ID NO: 329896 - DNA, 25 bp, Mus musculus
catgactttttacctatttgcttat

SEQ ID NO: 329897 - DNA, 25 bp, Mus musculus
catgactttttagctatttgcttat

SEQ ID NO: 329898 - DNA, 25 bp, Mus musculus
catgagaaaaaccgcacaggccttc

SEQ ID NO: 329899 - DNA, 25 bp, Mus musculus
catgagaaaaacggcacaggccttc

SEQ ID NO: 329900 - DNA, 25 bp, Mus musculus
catgagaaacatcaggacgctgggc

SEQ ID NO: 329901 - DNA, 25 bp, Mus musculus
catgagaaacatgaggacgctgggc

SEQ ID NO: 329902 - DNA, 25 bp, Mus musculus
catgagaacagaaccattaacagcc

SEQ ID NO: 329903 - DNA, 25 bp, Mus musculus
catgagaacagatccattaacagcc

SEQ ID NO: 329904 - DNA, 25 bp, Mus musculus
catgagaagggactcccatgtcctc

SEQ ID NO: 329905 - DNA, 25 bp, Mus musculus
catgagaagggagtcccatgtcctc

SEQ ID NO: 329906 - DNA, 25 bp, Mus musculus
catgagaatgttatctatgcatcgt

SEQ ID NO: 329907 - DNA, 25 bp, Mus musculus
catgagaatgttttctatgcatcgt

SEQ ID NO: 329908 - DNA, 25 bp, Mus musculus
catgagacactacgttcgggccgat

SEQ ID NO: 329909 - DNA, 25 bp, Mus musculus
catgagacactaggttcgggccgat

SEQ ID NO: 329910 - DNA, 25 bp, Mus musculus
catgagacactgcaagtttctaaac

SEQ ID NO: 329911 - DNA, 25 bp, Mus musculus
catgagacactggaagtttctaaac

SEQ ID NO: 329912 - DNA, 25 bp, Mus musculus
catgagacagtgagatcaacctttt

SEQ ID NO: 329913 - DNA, 25 bp, Mus musculus
catgagacagtgtgatcaacctttt

SEQ ID NO: 329914 - DNA, 25 bp, Mus musculus
catgagaccctaatccaaaattatc

SEQ ID NO: 329915 - DNA, 25 bp, Mus musculus
catgagaccctattccaaaattatc

SEQ ID NO: 329916 - DNA, 25 bp, Mus musculus
catgagagccccaagtgggccactt

SEQ ID NO: 329917 - DNA, 25 bp, Mus musculus
catgagagcccctagtgggccactt

SEQ ID NO: 329918 - DNA, 25 bp, Mus musculus
catgagagctgtcgccagtgtaccc

SEQ ID NO: 329919 - DNA, 25 bp, Mus musculus
catgagagctgtggccagtgtaccc

SEQ ID NO: 329920 - DNA, 25 bp, Mus musculus
catgagaggaagctcctggctctgc

SEQ ID NO: 329921 - DNA, 25 bp, Mus musculus
catgagaggaaggtcctggctctgc

SEQ ID NO: 329922 - DNA, 25 bp, Mus musculus
catgagaggtggatacatcgggtcc

SEQ ID NO: 329923 - DNA, 25 bp, Mus musculus
catgagaggtggttacatcgggtcc

SEQ ID NO: 329924 - DNA, 25 bp, Mus musculus
catgagatactgaatgtgtaagcac

SEQ ID NO: 329925 - DNA, 25 bp, Mus musculus
catgagatactgtatgtgtaagcac

SEQ ID NO: 329926 - DNA, 25 bp, Mus musculus
catgagatccatcttcttcaagcat

SEQ ID NO: 329927 - DNA, 25 bp, Mus musculus
catgagatccatgttcttcaagcat

SEQ ID NO: 329928 - DNA, 25 bp, Mus musculus
catgagatctgtcgatgggaaggcg

SEQ ID NO: 329929 - DNA, 25 bp, Mus musculus
catgagatctgtggatgggaaggcg

SEQ ID NO: 329930 - DNA, 25 bp, Mus musculus
catgagattgccacttaccattttc

SEQ ID NO: 329931 - DNA, 25 bp, Mus musculus
catgagattgcctcttaccattttc

SEQ ID NO: 329932 - DNA, 25 bp, Mus musculus
catgagcatttcactgagctctgtg

SEQ ID NO: 329933 - DNA, 25 bp, Mus musculus
catgagcatttctctgagctctgtg

SEQ ID NO: 329934 - DNA, 25 bp, Mus musculus
catgagccagtcagtggccgatttg

SEQ ID NO: 329935 - DNA, 25 bp, Mus musculus
catgagccagtctgtggccgatttg

SEQ ID NO: 329936 - DNA, 25 bp, Mus musculus
catgagccatcccttttttaaccta

SEQ ID NO: 329937 - DNA, 25 bp, Mus musculus
catgagccatccgttttttaaccta

SEQ ID NO: 329938 - DNA, 25 bp, Mus musculus
catgagcccaggaccggtgactgca

SEQ ID NO: 329939 - DNA, 25 bp, Mus musculus
catgagcccaggtccggtgactgca

SEQ ID NO: 329940 - DNA, 25 bp, Mus musculus
catgagcccatcactgttatttgca

SEQ ID NO: 329941 - DNA, 25 bp, Mus musculus
catgagcccatctctgttatttgca

SEQ ID NO: 329942 - DNA, 25 bp, Mus musculus
catgagctacaaccaggccatgttg

SEQ ID NO: 329943 - DNA, 25 bp, Mus musculus
catgagctacaagcaggccatgttg

SEQ ID NO: 329944 - DNA, 25 bp, Mus musculus
catgagctagcgactctgaggttgt

SEQ ID NO: 329945 - DNA, 25 bp, Mus musculus
catgagctagcgtctctgaggttgt

SEQ ID NO: 329946 - DNA, 25 bp, Mus musculus
catgagctgaggacttggaccgaat

SEQ ID NO: 329947 - DNA, 25 bp, Mus musculus
catgagctgaggtcttggaccgaat

SEQ ID NO: 329948 - DNA, 25 bp, Mus musculus
catgagctggatacctcaggagact

SEQ ID NO: 329949 - DNA, 25 bp, Mus musculus
catgagctggattcctcaggagact

SEQ ID NO: 329950 - DNA, 25 bp, Mus musculus
catgagctgtggacattgtgccttc

SEQ ID NO: 329951 - DNA, 25 bp, Mus musculus
catgagctgtggtcattgtgccttc

SEQ ID NO: 329952 - DNA, 25 bp, Mus musculus
catgagctgtttccaaaatcggatt

SEQ ID NO: 329953 - DNA, 25 bp, Mus musculus
catgagctgtttgcaaaatcggatt

SEQ ID NO: 329954 - DNA, 25 bp, Mus musculus
catgagcttaggctggcttcttccc

SEQ ID NO: 329955 - DNA, 25 bp, Mus musculus
catgagcttagggtggcttcttccc

SEQ ID NO: 329956 - DNA, 25 bp, Mus musculus
catgagcttcatacacagacagtgg

SEQ ID NO: 329957 - DNA, 25 bp, Mus musculus
catgagcttcattcacagacagtgg

SEQ ID NO: 329958 - DNA, 25 bp, Mus musculus
catgaggacaaaccaggacctgctg

SEQ ID NO: 329959 - DNA, 25 bp, Mus musculus
catgaggacaaagcaggacctgctg

SEQ ID NO: 329960 - DNA, 25 bp, Mus musculus
catgaggactaaagtgtagagatcc

SEQ ID NO: 329961 - DNA, 25 bp, Mus musculus
catgaggactaatgtgtagagatcc

SEQ ID NO: 329962 - DNA, 25 bp, Mus musculus
catgaggactgcagttggaacccca

SEQ ID NO: 329963 - DNA, 25 bp, Mus musculus
catgaggactgctgttggaacccca

SEQ ID NO: 329964 - DNA, 25 bp, Mus musculus
catgaggactggcatttgagtctcc

SEQ ID NO: 329965 - DNA, 25 bp, Mus musculus
catgaggactgggatttgagtctcc

SEQ ID NO: 329966 - DNA, 25 bp, Mus musculus
catgaggagggcagacttgccatca

SEQ ID NO: 329967 - DNA, 25 bp, Mus musculus
catgaggagggctgacttgccatca

SEQ ID NO: 329968 - DNA, 25 bp, Mus musculus
catgaggaggtgaatctacaattaa

SEQ ID NO: 329969 - DNA, 25 bp, Mus musculus
catgaggaggtgtatctacaattaa

SEQ ID NO: 329970 - DNA, 25 bp, Mus musculus
catgaggaggttatctggtagctgc

SEQ ID NO: 329971 - DNA, 25 bp, Mus musculus
catgaggaggttttctggtagctgc

SEQ ID NO: 329972 - DNA, 25 bp, Mus musculus
catgaggatcatcggtgttgctacc

SEQ ID NO: 329973 - DNA, 25 bp, Mus musculus
catgaggatcatgggtgttgctacc

SEQ ID NO: 329974 - DNA, 25 bp, Mus musculus
catgaggatcctcgctaacaagaca

SEQ ID NO: 329975 - DNA, 25 bp, Mus musculus
catgaggatcctggctaacaagaca

SEQ ID NO: 329976 - DNA, 25 bp, Mus musculus
catgaggatgtgaaggtagcattac

SEQ ID NO: 329977 - DNA, 25 bp, Mus musculus
catgaggatgtgtaggtagcattac

SEQ ID NO: 329978 - DNA, 25 bp, Mus musculus
catgaggccaagctgcagtactaca

SEQ ID NO: 329979 - DNA, 25 bp, Mus musculus
catgaggccaaggtgcagtactaca

SEQ ID NO: 329980 - DNA, 25 bp, Mus musculus
catgaggccttacgtttaattccca

SEQ ID NO: 329981 - DNA, 25 bp, Mus musculus
catgaggccttaggtttaattccca

SEQ ID NO: 329982 - DNA, 25 bp, Mus musculus
catgaggctactcgacggagatgat

SEQ ID NO: 329983 - DNA, 25 bp, Mus musculus
catgaggctactggacggagatgat

SEQ ID NO: 329984 - DNA, 25 bp, Mus musculus
catgaggcttcaagttagtaagcaa

SEQ ID NO: 329985 - DNA, 25 bp, Mus musculus
catgaggcttcatgttagtaagcaa

SEQ ID NO: 329986 - DNA, 25 bp, Mus musculus
catgagggagaaacaacgactcttt

SEQ ID NO: 329987 - DNA, 25 bp, Mus musculus
catgagggagaatcaacgactcttt

SEQ ID NO: 329988 - DNA, 25 bp, Mus musculus
catgaggtcgctaggaaggctctgc

SEQ ID NO: 329989 - DNA, 25 bp, Mus musculus
catgaggtcgcttggaaggctctgc

SEQ ID NO: 329990 - DNA, 25 bp, Mus musculus
catgaggtcttgacggaggcacgct

SEQ ID NO: 329991 - DNA, 25 bp, Mus musculus
catgaggtcttgtcggaggcacgct

SEQ ID NO: 329992 - DNA, 25 bp, Mus musculus
catgaggtggtcctgctactgtatc

SEQ ID NO: 329993 - DNA, 25 bp, Mus musculus
catgaggtggtcgtgctactgtatc

SEQ ID NO: 329994 - DNA, 25 bp, Mus musculus
catgaggttgctcccgagcctgaca

SEQ ID NO: 329995 - DNA, 25 bp, Mus musculus
catgaggttgctgccgagcctgaca

SEQ ID NO: 329996 - DNA, 25 bp, Mus musculus
catgagtaatgtataagttcccaag

SEQ ID NO: 329997 - DNA, 25 bp, Mus musculus
catgagtaatgtttaagttcccaag

SEQ ID NO: 329998 - DNA, 25 bp, Mus musculus
catgagtacatgactggaagtctga

SEQ ID NO: 329999 - DNA, 25 bp, Mus musculus
catgagtacatgtctggaagtctga

SEQ ID NO: 330000 - DNA, 25 bp, Mus musculus
catgagtaccatcgacagtgatttt

SEQ ID NO: 330001 - DNA, 25 bp, Mus musculus
catgagtaccatggacagtgatttt

SEQ ID NO: 330002 - DNA, 25 bp, Mus musculus
catgagtcagaccaagcagttgaag

SEQ ID NO: 330003 - DNA, 25 bp, Mus musculus
catgagtcagacgaagcagttgaag

SEQ ID NO: 330004 - DNA, 25 bp, Mus musculus
catgagtcctatcttttgctcagtt

SEQ ID NO: 330005 - DNA, 25 bp, Mus musculus
catgagtcctatgttttgctcagtt

SEQ ID NO: 330006 - DNA, 25 bp, Mus musculus
catgagtcctttcgccaaatggcac

SEQ ID NO: 330007 - DNA, 25 bp, Mus musculus
catgagtcctttggccaaatggcac

SEQ ID NO: 330008 - DNA, 25 bp, Mus musculus
catgagtctataacacagtgctggg

SEQ ID NO: 330009 - DNA, 25 bp, Mus musculus
catgagtctatatcacagtgctggg

SEQ ID NO: 330010 - DNA, 25 bp, Mus musculus
catgagtgactgatggctgccctaa

SEQ ID NO: 330011 - DNA, 25 bp, Mus musculus
catgagtgactgttggctgccctaa

SEQ ID NO: 330012 - DNA, 25 bp, Mus musculus
catgagtgagggactgggatcaaac

SEQ ID NO: 330013 - DNA, 25 bp, Mus musculus
catgagtgagggtctgggatcaaac

SEQ ID NO: 330014 - DNA, 25 bp, Mus musculus
catgagtgccttaaatatgtcttaa

SEQ ID NO: 330015 - DNA, 25 bp, Mus musculus
catgagtgcctttaatatgtcttaa

SEQ ID NO: 330016 - DNA, 25 bp, Mus musculus
catgagtgtcacctgggcagagctt

SEQ ID NO: 330017 - DNA, 25 bp, Mus musculus
catgagtgtcacgtgggcagagctt

SEQ ID NO: 330018 - DNA, 25 bp, Mus musculus
catgagttaatgattatggagttca

SEQ ID NO: 330019 - DNA, 25 bp, Mus musculus
catgagttaatgtttatggagttca

SEQ ID NO: 330020 - DNA, 25 bp, Mus musculus
catgagttatcaagtagcatctaac

SEQ ID NO: 330021 - DNA, 25 bp, Mus musculus
catgagttatcatgtagcatctaac

SEQ ID NO: 330022 - DNA, 25 bp, Mus musculus
catgagttcactcttcagaatgtaa

SEQ ID NO: 330023 - DNA, 25 bp, Mus musculus
catgagttcactgttcagaatgtaa

SEQ ID NO: 330024 - DNA, 25 bp, Mus musculus
catgagttcctcacgtgcatggagg

SEQ ID NO: 330025 - DNA, 25 bp, Mus musculus
catgagttcctctcgtgcatggagg

SEQ ID NO: 330026 - DNA, 25 bp, Mus musculus
catgagttgctcattttgtgtctgt

SEQ ID NO: 330027 - DNA, 25 bp, Mus musculus
catgagttgctctttttgtgtctgt

SEQ ID NO: 330028 - DNA, 25 bp, Mus musculus
catgagtttaatcagtgacaacgca

SEQ ID NO: 330029 - DNA, 25 bp, Mus musculus
catgagtttaatgagtgacaacgca

SEQ ID NO: 330030 - DNA, 25 bp, Mus musculus
catgagtttaggattacagctggct

SEQ ID NO: 330031 - DNA, 25 bp, Mus musculus
catgagtttaggtttacagctggct

SEQ ID NO: 330032 - DNA, 25 bp, Mus musculus
catgagtttattatggtcctggtgc

SEQ ID NO: 330033 - DNA, 25 bp, Mus musculus
catgagtttattttggtcctggtgc

SEQ ID NO: 330034 - DNA, 25 bp, Mus musculus
catgagtttcagctgttggaagttt

SEQ ID NO: 330035 - DNA, 25 bp, Mus musculus
catgagtttcaggtgttggaagttt

SEQ ID NO: 330036 - DNA, 25 bp, Mus musculus
catgagtttttaagtgccaattttt

SEQ ID NO: 330037 - DNA, 25 bp, Mus musculus
catgagtttttatgtgccaattttt

SEQ ID NO: 330038 - DNA, 25 bp, Mus musculus
catgataagagcagttgcctaccct

SEQ ID NO: 330039 - DNA, 25 bp, Mus musculus
catgataagagctgttgcctaccct

SEQ ID NO: 330040 - DNA, 25 bp, Mus musculus
catgataagcccatgcttgggtgta

SEQ ID NO: 330041 - DNA, 25 bp, Mus musculus
catgataagcccttgcttgggtgta

SEQ ID NO: 330042 - DNA, 25 bp, Mus musculus
catgataccctgatgcaaagttccc

SEQ ID NO: 330043 - DNA, 25 bp, Mus musculus
catgataccctgttgcaaagttccc

SEQ ID NO: 330044 - DNA, 25 bp, Mus musculus
catgatagcattagggcccttagta

SEQ ID NO: 330045 - DNA, 25 bp, Mus musculus
catgatagcatttgggcccttagta

SEQ ID NO: 330046 - DNA, 25 bp, Mus musculus
catgatagtaagctttgaactggaa

SEQ ID NO: 330047 - DNA, 25 bp, Mus musculus
catgatagtaaggtttgaactggaa

SEQ ID NO: 330048 - DNA, 25 bp, Mus musculus
catgatataaaaagggacactgcag

SEQ ID NO: 330049 - DNA, 25 bp, Mus musculus
catgatataaaactcccttcctctg

SEQ ID NO: 330050 - DNA, 25 bp, Mus musculus
catgatataaaagtcccttcctctg

SEQ ID NO: 330051 - DNA, 25 bp, Mus musculus
catgatataaaatgggacactgcag

SEQ ID NO: 330052 - DNA, 25 bp, Mus musculus
catgatatcaagaaacagcgggaga

SEQ ID NO: 330053 - DNA, 25 bp, Mus musculus
catgatatcaagtaacagcgggaga

SEQ ID NO: 330054 - DNA, 25 bp, Mus musculus
catgatcaccaacatcgaggagatg

SEQ ID NO: 330055 - DNA, 25 bp, Mus musculus
catgatcaccaagatcgaggagatg

SEQ ID NO: 330056 - DNA, 25 bp, Mus musculus
catgatcacggtccaggagctggat

SEQ ID NO: 330057 - DNA, 25 bp, Mus musculus
catgatcacggtgcaggagctggat

SEQ ID NO: 330058 - DNA, 25 bp, Mus musculus
catgatcagatcagcgtgcggtatt

SEQ ID NO: 330059 - DNA, 25 bp, Mus musculus
catgatcagatctgcgtgcggtatt

SEQ ID NO: 330060 - DNA, 25 bp, Mus musculus
catgatcaggccacttgtcctacaa

SEQ ID NO: 330061 - DNA, 25 bp, Mus musculus
catgatcaggcctcttgtcctacaa

SEQ ID NO: 330062 - DNA, 25 bp, Mus musculus
catgatcagtgcagacatggcccat

SEQ ID NO: 330063 - DNA, 25 bp, Mus musculus
catgatcagtgctgacatggcccat

SEQ ID NO: 330064 - DNA, 25 bp, Mus musculus
catgatcatagcctggatttccaaa

SEQ ID NO: 330065 - DNA, 25 bp, Mus musculus
catgatcatagcgtggatttccaaa

SEQ ID NO: 330066 - DNA, 25 bp, Mus musculus
catgatcatctgctaggccaggatg

SEQ ID NO: 330067 - DNA, 25 bp, Mus musculus
catgatcatctggtaggccaggatg

SEQ ID NO: 330068 - DNA, 25 bp, Mus musculus
catgatccatgcaaattatttaaag

SEQ ID NO: 330069 - DNA, 25 bp, Mus musculus
catgatccatgctaattatttaaag

SEQ ID NO: 330070 - DNA, 25 bp, Mus musculus
catgatccattacaaccccagagat

SEQ ID NO: 330071 - DNA, 25 bp, Mus musculus
catgatccattagaaccccagagat

SEQ ID NO: 330072 - DNA, 25 bp, Mus musculus
catgatcccatcatatttgcaaagg

SEQ ID NO: 330073 - DNA, 25 bp, Mus musculus
catgatcccatcttatttgcaaagg

SEQ ID NO: 330074 - DNA, 25 bp, Mus musculus
catgatcctcgcagaacggcagaaa

SEQ ID NO: 330075 - DNA, 25 bp, Mus musculus
catgatcctcgctgaacggcagaaa

SEQ ID NO: 330076 - DNA, 25 bp, Mus musculus
catgatcctctactttgcactatga

SEQ ID NO: 330077 - DNA, 25 bp, Mus musculus
catgatcctctagtttgcactatga

SEQ ID NO: 330078 - DNA, 25 bp, Mus musculus
catgatcgacttagaggccaatttc

SEQ ID NO: 330079 - DNA, 25 bp, Mus musculus
catgatcgactttgaggccaatttc

SEQ ID NO: 330080 - DNA, 25 bp, Mus musculus
catgatcgcctaatggaccaacttt

SEQ ID NO: 330081 - DNA, 25 bp, Mus musculus
catgatcgcctattggaccaacttt

SEQ ID NO: 330082 - DNA, 25 bp, Mus musculus
catgatctcatgactgtttgctaga

SEQ ID NO: 330083 - DNA, 25 bp, Mus musculus
catgatctcatgtctgtttgctaga

SEQ ID NO: 330084 - DNA, 25 bp, Mus musculus
catgatctctatcaggcttgaaaat

SEQ ID NO: 330085 - DNA, 25 bp, Mus musculus
catgatctctatgaggcttgaaaat

SEQ ID NO: 330086 - DNA, 25 bp, Mus musculus
catgatctgtggctttgggtcctga

SEQ ID NO: 330087 - DNA, 25 bp, Mus musculus
catgatctgtgggtttgggtcctga

SEQ ID NO: 330088 - DNA, 25 bp, Mus musculus
catgatcttaacagtgtgccagggt

SEQ ID NO: 330089 - DNA, 25 bp, Mus musculus
catgatcttaactgtgtgccagggt

SEQ ID NO: 330090 - DNA, 25 bp, Mus musculus
catgatcttcacagggctggaattt

SEQ ID NO: 330091 - DNA, 25 bp, Mus musculus
catgatcttcactgggctggaattt

SEQ ID NO: 330092 - DNA, 25 bp, Mus musculus
catgatcttgatcccttttcttttt

SEQ ID NO: 330093 - DNA, 25 bp, Mus musculus
catgatcttgatgccttttcttttt

SEQ ID NO: 330094 - DNA, 25 bp, Mus musculus
catgatcttgcaaccctaagagggt

SEQ ID NO: 330095 - DNA, 25 bp, Mus musculus
catgatcttgcatccctaagagggt

SEQ ID NO: 330096 - DNA, 25 bp, Mus musculus
catgatgacaatcgcctaaacctgt

SEQ ID NO: 330097 - DNA, 25 bp, Mus musculus
catgatgacaatggcctaaacctgt

SEQ ID NO: 330098 - DNA, 25 bp, Mus musculus
catgatgacagccataatgttacat

SEQ ID NO: 330099 - DNA, 25 bp, Mus musculus
catgatgacagcgataatgttacat

SEQ ID NO: 330100 - DNA, 25 bp, Mus musculus
catgatgactctagtggtccagctc

SEQ ID NO: 330101 - DNA, 25 bp, Mus musculus
catgatgactcttgtggtccagctc

SEQ ID NO: 330102 - DNA, 25 bp, Mus musculus
catgatgagatcaaccagggcaggg

SEQ ID NO: 330103 - DNA, 25 bp, Mus musculus
catgatgagatctaccagggcaggg

SEQ ID NO: 330104 - DNA, 25 bp, Mus musculus
catgatgagcaaagcctcgggcaga

SEQ ID NO: 330105 - DNA, 25 bp, Mus musculus
catgatgagcaatgcctcgggcaga

SEQ ID NO: 330106 - DNA, 25 bp, Mus musculus
catgatgatcccaatgtgacccaag

SEQ ID NO: 330107 - DNA, 25 bp, Mus musculus
catgatgatccctatgtgacccaag

SEQ ID NO: 330108 - DNA, 25 bp, Mus musculus
catgatgatgccaagtgacaaggat

SEQ ID NO: 330109 - DNA, 25 bp, Mus musculus
catgatgatgcctagtgacaaggat

SEQ ID NO: 330110 - DNA, 25 bp, Mus musculus
catgatgattaaagcggtggtgcca

SEQ ID NO: 330111 - DNA, 25 bp, Mus musculus
catgatgattaatgcggtggtgcca

SEQ ID NO: 330112 - DNA, 25 bp, Mus musculus
catgatgcctgtcgtgcttcacctg

SEQ ID NO: 330113 - DNA, 25 bp, Mus musculus
catgatgcctgtggtgcttcacctg

SEQ ID NO: 330114 - DNA, 25 bp, Mus musculus
catgatgcttgtcttgttaactgaa

SEQ ID NO: 330115 - DNA, 25 bp, Mus musculus
catgatgcttgtgttgttaactgaa

SEQ ID NO: 330116 - DNA, 25 bp, Mus musculus
catgatggaaatattctctccttat

SEQ ID NO: 330117 - DNA, 25 bp, Mus musculus
catgatggaaattttctctccttat

SEQ ID NO: 330118 - DNA, 25 bp, Mus musculus
catgatggatgcctcacgtatacag

SEQ ID NO: 330119 - DNA, 25 bp, Mus musculus
catgatggatgcgtcacgtatacag

SEQ ID NO: 330120 - DNA, 25 bp, Mus musculus
catgatggccagactttctgtgctg

SEQ ID NO: 330121 - DNA, 25 bp, Mus musculus
catgatggccagtctttctgtgctg

SEQ ID NO: 330122 - DNA, 25 bp, Mus musculus
catgatgggccacagctatctacaa

SEQ ID NO: 330123 - DNA, 25 bp, Mus musculus
catgatgggccagagctatctacaa

SEQ ID NO: 330124 - DNA, 25 bp, Mus musculus
catgatggtggcaattcaataaaac

SEQ ID NO: 330125 - DNA, 25 bp, Mus musculus
catgatggtggcattctggcctcac

SEQ ID NO: 330126 - DNA, 25 bp, Mus musculus
catgatggtggctattcaataaaac

SEQ ID NO: 330127 - DNA, 25 bp, Mus musculus
catgatggtggctttctggcctcac

SEQ ID NO: 330128 - DNA, 25 bp, Mus musculus
catgatggttgtcagcttgttttgc

SEQ ID NO: 330129 - DNA, 25 bp, Mus musculus
catgatggttgtgagcttgttttgc

SEQ ID NO: 330130 - DNA, 25 bp, Mus musculus
catgatgtcacaaacgctactcgga

SEQ ID NO: 330131 - DNA, 25 bp, Mus musculus
catgatgtcacatacgctactcgga

SEQ ID NO: 330132 - DNA, 25 bp, Mus musculus
catgatgtcatgctgtttgattctt

SEQ ID NO: 330133 - DNA, 25 bp, Mus musculus
catgatgtcatggtgtttgattctt

SEQ ID NO: 330134 - DNA, 25 bp, Mus musculus
catgatgtccgcagcaatgggagct

SEQ ID NO: 330135 - DNA, 25 bp, Mus musculus
catgatgtccgctgcaatgggagct

SEQ ID NO: 330136 - DNA, 25 bp, Mus musculus
catgatgtgagtcctcgggactggc

SEQ ID NO: 330137 - DNA, 25 bp, Mus musculus
catgatgtgagtgctcgggactggc

SEQ ID NO: 330138 - DNA, 25 bp, Mus musculus
catgatgtggtgagattccagataa

SEQ ID NO: 330139 - DNA, 25 bp, Mus musculus
catgatgtggtgtgattccagataa

SEQ ID NO: 330140 - DNA, 25 bp, Mus musculus
catgattaaagtccgcgtgggccag

SEQ ID NO: 330141 - DNA, 25 bp, Mus musculus
catgattaaagtgcgcgtgggccag

SEQ ID NO: 330142 - DNA, 25 bp, Mus musculus
catgattccaacagatactttttaa

SEQ ID NO: 330143 - DNA, 25 bp, Mus musculus
catgattccaactgatactttttaa

SEQ ID NO: 330144 - DNA, 25 bp, Mus musculus
catgattcccgccccgctgctggga

SEQ ID NO: 330145 - DNA, 25 bp, Mus musculus
catgattcccgcgccgctgctggga

SEQ ID NO: 330146 - DNA, 25 bp, Mus musculus
catgattcgagacgtggctggccaa

SEQ ID NO: 330147 - DNA, 25 bp, Mus musculus
catgattcgagaggtggctggccaa

SEQ ID NO: 330148 - DNA, 25 bp, Mus musculus
catgattctcacagttctgtgttat

SEQ ID NO: 330149 - DNA, 25 bp, Mus musculus
catgattctcactgttctgtgttat

SEQ ID NO: 330150 - DNA, 25 bp, Mus musculus
catgattcttcgcatgacacggctt

SEQ ID NO: 330151 - DNA, 25 bp, Mus musculus
catgattcttcggatgacacggctt

SEQ ID NO: 330152 - DNA, 25 bp, Mus musculus
catgattgggcgacggccatatgca

SEQ ID NO: 330153 - DNA, 25 bp, Mus musculus
catgattgggcgtcggccatatgca

SEQ ID NO: 330154 - DNA, 25 bp, Mus musculus
catgattgtcatagcctcggtgtga

SEQ ID NO: 330155 - DNA, 25 bp, Mus musculus
catgattgtcattgcctcggtgtga

SEQ ID NO: 330156 - DNA, 25 bp, Mus musculus
catgattgttttcgagcctctacca

SEQ ID NO: 330157 - DNA, 25 bp, Mus musculus
catgattgttttggagcctctacca

SEQ ID NO: 330158 - DNA, 25 bp, Mus musculus
catgatttaggcagctactcttaaa

SEQ ID NO: 330159 - DNA, 25 bp, Mus musculus
catgatttaggctgctactcttaaa

SEQ ID NO: 330160 - DNA, 25 bp, Mus musculus
catgatttcctaataatccaatgtg

SEQ ID NO: 330161 - DNA, 25 bp, Mus musculus
catgatttcctattaatccaatgtg

SEQ ID NO: 330162 - DNA, 25 bp, Mus musculus
catgatttctgaaactgctgatcaa

SEQ ID NO: 330163 - DNA, 25 bp, Mus musculus
catgatttctgatactgctgatcaa

SEQ ID NO: 330164 - DNA, 25 bp, Mus musculus
catgatttggtaccgtctggaggac

SEQ ID NO: 330165 - DNA, 25 bp, Mus musculus
catgatttggtagcgtctggaggac

SEQ ID NO: 330166 - DNA, 25 bp, Mus musculus
catgattttaatcctccagagctgt

SEQ ID NO: 330167 - DNA, 25 bp, Mus musculus
catgattttaatcgagctgctttaa

SEQ ID NO: 330168 - DNA, 25 bp, Mus musculus
catgattttaatgctccagagctgt

SEQ ID NO: 330169 - DNA, 25 bp, Mus musculus
catgattttaatggagctgctttaa

SEQ ID NO: 330170 - DNA, 25 bp, Mus musculus
catgattttacactataacttgacg

SEQ ID NO: 330171 - DNA, 25 bp, Mus musculus
catgattttacagtataacttgacg

SEQ ID NO: 330172 - DNA, 25 bp, Mus musculus
catgcaaaagtccatctcctgatgt

SEQ ID NO: 330173 - DNA, 25 bp, Mus musculus
catgcaaaagtcgatctcctgatgt

SEQ ID NO: 330174 - DNA, 25 bp, Mus musculus
catgcaaacagacatacggacagca

SEQ ID NO: 330175 - DNA, 25 bp, Mus musculus
catgcaaacagagatacggacagca

SEQ ID NO: 330176 - DNA, 25 bp, Mus musculus
catgcaaagacgaggatgtagacaa

SEQ ID NO: 330177 - DNA, 25 bp, Mus musculus
catgcaaagacgtggatgtagacaa

SEQ ID NO: 330178 - DNA, 25 bp, Mus musculus
catgcaaagatgagacctccaggaa

SEQ ID NO: 330179 - DNA, 25 bp, Mus musculus
catgcaaagatgtgacctccaggaa

SEQ ID NO: 330180 - DNA, 25 bp, Mus musculus
catgcaacacttcctggaccaggta

SEQ ID NO: 330181 - DNA, 25 bp, Mus musculus
catgcaacacttgctggaccaggta

SEQ ID NO: 330182 - DNA, 25 bp, Mus musculus
catgcaacagcaaatggccctttat

SEQ ID NO: 330183 - DNA, 25 bp, Mus musculus
catgcaacagcatatggccctttat

SEQ ID NO: 330184 - DNA, 25 bp, Mus musculus
catgcaagcattcgctcaggttttt

SEQ ID NO: 330185 - DNA, 25 bp, Mus musculus
catgcaagcattggctcaggttttt

SEQ ID NO: 330186 - DNA, 25 bp, Mus musculus
catgcaagtaccatgatttggctta

SEQ ID NO: 330187 - DNA, 25 bp, Mus musculus
catgcaagtaccttgatttggctta

SEQ ID NO: 330188 - DNA, 25 bp, Mus musculus
catgcaagttgtcctggtcaccatt

SEQ ID NO: 330189 - DNA, 25 bp, Mus musculus
catgcaagttgtgctggtcaccatt

SEQ ID NO: 330190 - DNA, 25 bp, Mus musculus
catgcaatcttgatgctgtggaagt

SEQ ID NO: 330191 - DNA, 25 bp, Mus musculus
catgcaatcttgttgctgtggaagt

SEQ ID NO: 330192 - DNA, 25 bp, Mus musculus
catgcaatggtaccttttctggact

SEQ ID NO: 330193 - DNA, 25 bp, Mus musculus
catgcaatggtagcttttctggact

SEQ ID NO: 330194 - DNA, 25 bp, Mus musculus
catgcaattaccaggaactggtcct

SEQ ID NO: 330195 - DNA, 25 bp, Mus musculus
catgcaattacctggaactggtcct

SEQ ID NO: 330196 - DNA, 25 bp, Mus musculus
catgcacaacggcaagctggccacg

SEQ ID NO: 330197 - DNA, 25 bp, Mus musculus
catgcacaacgggaagctggccacg

SEQ ID NO: 330198 - DNA, 25 bp, Mus musculus
catgcacaactcactctagactaga

SEQ ID NO: 330199 - DNA, 25 bp, Mus musculus
catgcacaactctctctagactaga

SEQ ID NO: 330200 - DNA, 25 bp, Mus musculus
catgcacaagatacgacctcatatt

SEQ ID NO: 330201 - DNA, 25 bp, Mus musculus
catgcacaagattcgacctcatatt

SEQ ID NO: 330202 - DNA, 25 bp, Mus musculus
catgcacaattccaacatcagcaag

SEQ ID NO: 330203 - DNA, 25 bp, Mus musculus
catgcacaattcgaacatcagcaag

SEQ ID NO: 330204 - DNA, 25 bp, Mus musculus
catgcacacaccaactgagtatgta

SEQ ID NO: 330205 - DNA, 25 bp, Mus musculus
catgcacacacctactgagtatgta

SEQ ID NO: 330206 - DNA, 25 bp, Mus musculus
catgcacacaggcactgggtttgat

SEQ ID NO: 330207 - DNA, 25 bp, Mus musculus
catgcacacagggactgggtttgat

SEQ ID NO: 330208 - DNA, 25 bp, Mus musculus
catgcacacattccccatgatagtt

SEQ ID NO: 330209 - DNA, 25 bp, Mus musculus
catgcacacattgcccatgatagtt

SEQ ID NO: 330210 - DNA, 25 bp, Mus musculus
catgcacacttgaagggttggccct

SEQ ID NO: 330211 - DNA, 25 bp, Mus musculus
catgcacacttgtagggttggccct

SEQ ID NO: 330212 - DNA, 25 bp, Mus musculus
catgcacagagacaattcttggaga

SEQ ID NO: 330213 - DNA, 25 bp, Mus musculus
catgcacagagaccagaggacaact

SEQ ID NO: 330214 - DNA, 25 bp, Mus musculus
catgcacagagagaattcttggaga

SEQ ID NO: 330215 - DNA, 25 bp, Mus musculus
catgcacagagagcagaggacaact

SEQ ID NO: 330216 - DNA, 25 bp, Mus musculus
catgcacatacactggacatccatc

SEQ ID NO: 330217 - DNA, 25 bp, Mus musculus
catgcacatacagtggacatccatc

SEQ ID NO: 330218 - DNA, 25 bp, Mus musculus
catgcacatgcacaggtttgaacag

SEQ ID NO: 330219 - DNA, 25 bp, Mus musculus
catgcacatgcagaggtttgaacag

SEQ ID NO: 330220 - DNA, 25 bp, Mus musculus
catgcacatggcaccatctgttaaa

SEQ ID NO: 330221 - DNA, 25 bp, Mus musculus
catgcacatggctccatctgttaaa

SEQ ID NO: 330222 - DNA, 25 bp, Mus musculus
catgcacatggtacagcagcaaaat

SEQ ID NO: 330223 - DNA, 25 bp, Mus musculus
catgcacatggttcagcagcaaaat

SEQ ID NO: 330224 - DNA, 25 bp, Mus musculus
catgcaccaacgcacttcagtatta

SEQ ID NO: 330225 - DNA, 25 bp, Mus musculus
catgcaccaacggacttcagtatta

SEQ ID NO: 330226 - DNA, 25 bp, Mus musculus
catgcaccactgaaggacagaaata

SEQ ID NO: 330227 - DNA, 25 bp, Mus musculus
catgcaccactgtaggacagaaata

SEQ ID NO: 330228 - DNA, 25 bp, Mus musculus
catgcaccagctacacaaacaagaa

SEQ ID NO: 330229 - DNA, 25 bp, Mus musculus
catgcaccagcttcacaaacaagaa

SEQ ID NO: 330230 - DNA, 25 bp, Mus musculus
catgcaccatggaacatatgtatgt

SEQ ID NO: 330231 - DNA, 25 bp, Mus musculus
catgcaccatggtacatatgtatgt

SEQ ID NO: 330232 - DNA, 25 bp, Mus musculus
catgcaccccatatttcgaaaacta

SEQ ID NO: 330233 - DNA, 25 bp, Mus musculus
catgcaccccatttttcgaaaacta

SEQ ID NO: 330234 - DNA, 25 bp, Mus musculus
catgcaccctgtcggagctcaataa

SEQ ID NO: 330235 - DNA, 25 bp, Mus musculus
catgcaccctgtgggagctcaataa

SEQ ID NO: 330236 - DNA, 25 bp, Mus musculus
catgcacgcaatcggctggctctca

SEQ ID NO: 330237 - DNA, 25 bp, Mus musculus
catgcacgcaatgggctggctctca

SEQ ID NO: 330238 - DNA, 25 bp, Mus musculus
catgcacgggatcatgcttttccat

SEQ ID NO: 330239 - DNA, 25 bp, Mus musculus
catgcacgggatgatgcttttccat

SEQ ID NO: 330240 - DNA, 25 bp, Mus musculus
catgcacgggcaaaagagctcttaa

SEQ ID NO: 330241 - DNA, 25 bp, Mus musculus
catgcacgggcataagagctcttaa

SEQ ID NO: 330242 - DNA, 25 bp, Mus musculus
catgcactaaaccatgactcaggtt

SEQ ID NO: 330243 - DNA, 25 bp, Mus musculus
catgcactaaacgatgactcaggtt

SEQ ID NO: 330244 - DNA, 25 bp, Mus musculus
catgcactctgccttcggaaatggc

SEQ ID NO: 330245 - DNA, 25 bp, Mus musculus
catgcactctgcgttcggaaatggc

SEQ ID NO: 330246 - DNA, 25 bp, Mus musculus
catgcactcttgatgaagtctttca

SEQ ID NO: 330247 - DNA, 25 bp, Mus musculus
catgcactcttgttgaagtctttca

SEQ ID NO: 330248 - DNA, 25 bp, Mus musculus
catgcactggcacgtcatgcacaat

SEQ ID NO: 330249 - DNA, 25 bp, Mus musculus
catgcactggcaggtcatgcacaat

SEQ ID NO: 330250 - DNA, 25 bp, Mus musculus
catgcactggttcgctttctttgtg

SEQ ID NO: 330251 - DNA, 25 bp, Mus musculus
catgcactggttggctttctttgtg

SEQ ID NO: 330252 - DNA, 25 bp, Mus musculus
catgcacttgtgacctttctttaat

SEQ ID NO: 330253 - DNA, 25 bp, Mus musculus
catgcacttgtgtcctttctttaat

SEQ ID NO: 330254 - DNA, 25 bp, Mus musculus
catgcagaaggcctgtgggaacttc

SEQ ID NO: 330255 - DNA, 25 bp, Mus musculus
catgcagaaggcgtgtgggaacttc

SEQ ID NO: 330256 - DNA, 25 bp, Mus musculus
catgcagaatgtcctaagcggcaaa

SEQ ID NO: 330257 - DNA, 25 bp, Mus musculus
catgcagaatgtcgcctcttgtgga

SEQ ID NO: 330258 - DNA, 25 bp, Mus musculus
catgcagaatgtgctaagcggcaaa

SEQ ID NO: 330259 - DNA, 25 bp, Mus musculus
catgcagaatgtggcctcttgtgga

SEQ ID NO: 330260 - DNA, 25 bp, Mus musculus
catgcagagaaaatctggccgggca

SEQ ID NO: 330261 - DNA, 25 bp, Mus musculus
catgcagagaaattctggccgggca

SEQ ID NO: 330262 - DNA, 25 bp, Mus musculus
catgcagaggcacggactagatact

SEQ ID NO: 330263 - DNA, 25 bp, Mus musculus
catgcagaggcagggactagatact

SEQ ID NO: 330264 - DNA, 25 bp, Mus musculus
catgcagagttgagcacatgggaga

SEQ ID NO: 330265 - DNA, 25 bp, Mus musculus
catgcagagttgtgcacatgggaga

SEQ ID NO: 330266 - DNA, 25 bp, Mus musculus
catgcagataaaccactcaatgttt

SEQ ID NO: 330267 - DNA, 25 bp, Mus musculus
catgcagataaagcactcaatgttt

SEQ ID NO: 330268 - DNA, 25 bp, Mus musculus
catgcagcatttatatctttctcaa

SEQ ID NO: 330269 - DNA, 25 bp, Mus musculus
catgcagcatttttatctttctcaa

SEQ ID NO: 330270 - DNA, 25 bp, Mus musculus
catgcagcttcgagcctgaggcagg

SEQ ID NO: 330271 - DNA, 25 bp, Mus musculus
catgcagcttcgtgcctgaggcagg

SEQ ID NO: 330272 - DNA, 25 bp, Mus musculus
catgcaggaaaaatctctctcgccc

SEQ ID NO: 330273 - DNA, 25 bp, Mus musculus
catgcaggaaaattctctctcgccc

SEQ ID NO: 330274 - DNA, 25 bp, Mus musculus
catgcaggaagacagaggcccattc

SEQ ID NO: 330275 - DNA, 25 bp, Mus musculus
catgcaggaagagagaggcccattc

SEQ ID NO: 330276 - DNA, 25 bp, Mus musculus
catgcaggatcaactcttcagaggt

SEQ ID NO: 330277 - DNA, 25 bp, Mus musculus
catgcaggatcatctcttcagaggt

SEQ ID NO: 330278 - DNA, 25 bp, Mus musculus
catgcaggatctcactgggctggct

SEQ ID NO: 330279 - DNA, 25 bp, Mus musculus
catgcaggatctgactgggctggct

SEQ ID NO: 330280 - DNA, 25 bp, Mus musculus
catgcaggctgtatacgtgttgact

SEQ ID NO: 330281 - DNA, 25 bp, Mus musculus
catgcaggctgtttacgtgttgact

SEQ ID NO: 330282 - DNA, 25 bp, Mus musculus
catgcagggcaaattggactgtttt

SEQ ID NO: 330283 - DNA, 25 bp, Mus musculus
catgcagggcaatttggactgtttt

SEQ ID NO: 330284 - DNA, 25 bp, Mus musculus
catgcaggtacccagcctctaaagg

SEQ ID NO: 330285 - DNA, 25 bp, Mus musculus
catgcaggtaccgagcctctaaagg

SEQ ID NO: 330286 - DNA, 25 bp, Mus musculus
catgcagtcttacccatcaggttga

SEQ ID NO: 330287 - DNA, 25 bp, Mus musculus
catgcagtcttagccatcaggttga

SEQ ID NO: 330288 - DNA, 25 bp, Mus musculus
catgcagtgattacggcactctggg

SEQ ID NO: 330289 - DNA, 25 bp, Mus musculus
catgcagtgatttcggcactctggg

SEQ ID NO: 330290 - DNA, 25 bp, Mus musculus
catgcagtggtcatgtctcctgaca

SEQ ID NO: 330291 - DNA, 25 bp, Mus musculus
catgcagtggtcttgtctcctgaca

SEQ ID NO: 330292 - DNA, 25 bp, Mus musculus
catgcagttaggatcagtctagaaa

SEQ ID NO: 330293 - DNA, 25 bp, Mus musculus
catgcagttaggttcagtctagaaa

SEQ ID NO: 330294 - DNA, 25 bp, Mus musculus
catgcagttccaaaagcactagcaa

SEQ ID NO: 330295 - DNA, 25 bp, Mus musculus
catgcagttccataagcactagcaa

SEQ ID NO: 330296 - DNA, 25 bp, Mus musculus
catgcagttgaaaagccgtttgaat

SEQ ID NO: 330297 - DNA, 25 bp, Mus musculus
catgcagttgaatagccgtttgaat

SEQ ID NO: 330298 - DNA, 25 bp, Mus musculus
catgcagttgggatttagctgtact

SEQ ID NO: 330299 - DNA, 25 bp, Mus musculus
catgcagttgggttttagctgtact

SEQ ID NO: 330300 - DNA, 25 bp, Mus musculus
catgcagttgtaaatgttgtttgtc

SEQ ID NO: 330301 - DNA, 25 bp, Mus musculus
catgcagttgtatatgttgtttgtc

SEQ ID NO: 330302 - DNA, 25 bp, Mus musculus
catgcagttttgatgcgtgtctaac

SEQ ID NO: 330303 - DNA, 25 bp, Mus musculus
catgcagttttgttgcgtgtctaac

SEQ ID NO: 330304 - DNA, 25 bp, Mus musculus
catgcatagcctaatgtaactcccc

SEQ ID NO: 330305 - DNA, 25 bp, Mus musculus
catgcatagccttatgtaactcccc

SEQ ID NO: 330306 - DNA, 25 bp, Mus musculus
catgcatataccacccatacgaagg

SEQ ID NO: 330307 - DNA, 25 bp, Mus musculus
catgcatatacctcccatacgaagg

SEQ ID NO: 330308 - DNA, 25 bp, Mus musculus
catgcatcaatgcatggtggcaact

SEQ ID NO: 330309 - DNA, 25 bp, Mus musculus
catgcatcaatggatggtggcaact

SEQ ID NO: 330310 - DNA, 25 bp, Mus musculus
catgcatcagcaagctgggttaaag

SEQ ID NO: 330311 - DNA, 25 bp, Mus musculus
catgcatcagcatgctgggttaaag

SEQ ID NO: 330312 - DNA, 25 bp, Mus musculus
catgcatcgtcaagttcatgcctga

SEQ ID NO: 330313 - DNA, 25 bp, Mus musculus
catgcatcgtcatgttcatgcctga

SEQ ID NO: 330314 - DNA, 25 bp, Mus musculus
catgcatcttaaattcccactgtac

SEQ ID NO: 330315 - DNA, 25 bp, Mus musculus
catgcatcttaatttcccactgtac

SEQ ID NO: 330316 - DNA, 25 bp, Mus musculus
catgcatcttggatacaagtacttt

SEQ ID NO: 330317 - DNA, 25 bp, Mus musculus
catgcatcttggttacaagtacttt

SEQ ID NO: 330318 - DNA, 25 bp, Mus musculus
catgcatgatgacgaccttgttggc

SEQ ID NO: 330319 - DNA, 25 bp, Mus musculus
catgcatgatgaggaccttgttggc

SEQ ID NO: 330320 - DNA, 25 bp, Mus musculus
catgcatgcagtattgttgtatcaa

SEQ ID NO: 330321 - DNA, 25 bp, Mus musculus
catgcatgcagtcacgtgactccaa

SEQ ID NO: 330322 - DNA, 25 bp, Mus musculus
catgcatgcagtgacgtgactccaa

SEQ ID NO: 330323 - DNA, 25 bp, Mus musculus
catgcatgcagttttgttgtatcaa

SEQ ID NO: 330324 - DNA, 25 bp, Mus musculus
catgcatgcgttcatcttgcagttt

SEQ ID NO: 330325 - DNA, 25 bp, Mus musculus
catgcatgcgttgatcttgcagttt

SEQ ID NO: 330326 - DNA, 25 bp, Mus musculus
catgcatgcttgcatctcagctggg

SEQ ID NO: 330327 - DNA, 25 bp, Mus musculus
catgcatgcttggatctcagctggg

SEQ ID NO: 330328 - DNA, 25 bp, Mus musculus
catgcatggccacagctcatgtcat

SEQ ID NO: 330329 - DNA, 25 bp, Mus musculus
catgcatggccagagctcatgtcat

SEQ ID NO: 330330 - DNA, 25 bp, Mus musculus
catgcatgtattcgtccatcttaca

SEQ ID NO: 330331 - DNA, 25 bp, Mus musculus
catgcatgtattggtccatcttaca

SEQ ID NO: 330332 - DNA, 25 bp, Mus musculus
catgcatgtgttctagctaagtcca

SEQ ID NO: 330333 - DNA, 25 bp, Mus musculus
catgcatgtgttgtagctaagtcca

SEQ ID NO: 330334 - DNA, 25 bp, Mus musculus
catgcatgttgcagttgctctccca

SEQ ID NO: 330335 - DNA, 25 bp, Mus musculus
catgcatgttgctgttgctctccca

SEQ ID NO: 330336 - DNA, 25 bp, Mus musculus
catgcatgtttaagtattgacacag

SEQ ID NO: 330337 - DNA, 25 bp, Mus musculus
catgcatgtttatgtattgacacag

SEQ ID NO: 330338 - DNA, 25 bp, Mus musculus
catgcatgttttaggccagtgggaa

SEQ ID NO: 330339 - DNA, 25 bp, Mus musculus
catgcatgtttttggccagtgggaa

SEQ ID NO: 330340 - DNA, 25 bp, Mus musculus
catgcattaatgattgtatggaatt

SEQ ID NO: 330341 - DNA, 25 bp, Mus musculus
catgcattaatgtttgtatggaatt

SEQ ID NO: 330342 - DNA, 25 bp, Mus musculus
catgcattgacccattatgagataa

SEQ ID NO: 330343 - DNA, 25 bp, Mus musculus
catgcattgaccgattatgagataa

SEQ ID NO: 330344 - DNA, 25 bp, Mus musculus
catgcattgtcgaggtggtctgaat

SEQ ID NO: 330345 - DNA, 25 bp, Mus musculus
catgcattgtcgtggtggtctgaat

SEQ ID NO: 330346 - DNA, 25 bp, Mus musculus
catgcatttagaagcttcatccctc

SEQ ID NO: 330347 - DNA, 25 bp, Mus musculus
catgcatttagatgcttcatccctc

SEQ ID NO: 330348 - DNA, 25 bp, Mus musculus
catgcatttcagatccaggatggct

SEQ ID NO: 330349 - DNA, 25 bp, Mus musculus
catgcatttcagttccaggatggct

SEQ ID NO: 330350 - DNA, 25 bp, Mus musculus
catgcattttaacagtttgtgtgat

SEQ ID NO: 330351 - DNA, 25 bp, Mus musculus
catgcattttaagagtttgtgtgat

SEQ ID NO: 330352 - DNA, 25 bp, Mus musculus
catgcattttctcttttattggcta

SEQ ID NO: 330353 - DNA, 25 bp, Mus musculus
catgcattttctgttttattggcta

SEQ ID NO: 330354 - DNA, 25 bp, Mus musculus
catgcattttggcacaattgctttt

SEQ ID NO: 330355 - DNA, 25 bp, Mus musculus
catgcattttgggacaattgctttt

SEQ ID NO: 330356 - DNA, 25 bp, Mus musculus
catgcatttttcataagactattag

SEQ ID NO: 330357 - DNA, 25 bp, Mus musculus
catgcatttttcttaagactattag

SEQ ID NO: 330358 - DNA, 25 bp, Mus musculus
catgccaaagacaggatgaccctct

SEQ ID NO: 330359 - DNA, 25 bp, Mus musculus
catgccaaagactggatgaccctct

SEQ ID NO: 330360 - DNA, 25 bp, Mus musculus
catgccaacaggctattctcaataa

SEQ ID NO: 330361 - DNA, 25 bp, Mus musculus
catgccaacagggtattctcaataa

SEQ ID NO: 330362 - DNA, 25 bp, Mus musculus
catgccaaccttatggtgctggaga

SEQ ID NO: 330363 - DNA, 25 bp, Mus musculus
catgccaaccttttggtgctggaga

SEQ ID NO: 330364 - DNA, 25 bp, Mus musculus
catgccaagtttcaggaggattggg

SEQ ID NO: 330365 - DNA, 25 bp, Mus musculus
catgccaagtttgaggaggattggg

SEQ ID NO: 330366 - DNA, 25 bp, Mus musculus
catgccacagttatgaggttgacta

SEQ ID NO: 330367 - DNA, 25 bp, Mus musculus
catgccacagttttgaggttgacta

SEQ ID NO: 330368 - DNA, 25 bp, Mus musculus
catgccacatgtaaacgtgtataat

SEQ ID NO: 330369 - DNA, 25 bp, Mus musculus
catgccacatgttaacgtgtataat

SEQ ID NO: 330370 - DNA, 25 bp, Mus musculus
catgccacccaaagcctaatttata

SEQ ID NO: 330371 - DNA, 25 bp, Mus musculus
catgccacccaatgcctaatttata

SEQ ID NO: 330372 - DNA, 25 bp, Mus musculus
catgccacggtcacgagcagtaggg

SEQ ID NO: 330373 - DNA, 25 bp, Mus musculus
catgccacggtctcgagcagtaggg

SEQ ID NO: 330374 - DNA, 25 bp, Mus musculus
catgccagacatcaatgtacatagg

SEQ ID NO: 330375 - DNA, 25 bp, Mus musculus
catgccagacatgaatgtacatagg

SEQ ID NO: 330376 - DNA, 25 bp, Mus musculus
catgccagccatagtaagagttcca

SEQ ID NO: 330377 - DNA, 25 bp, Mus musculus
catgccagccattgtaagagttcca

SEQ ID NO: 330378 - DNA, 25 bp, Mus musculus
catgccaggaatactcaataaaatt

SEQ ID NO: 330379 - DNA, 25 bp, Mus musculus
catgccaggaattctcaataaaatt

SEQ ID NO: 330380 - DNA, 25 bp, Mus musculus
catgccagtggtcccatcttttgta

SEQ ID NO: 330381 - DNA, 25 bp, Mus musculus
catgccagtggtgccatcttttgta

SEQ ID NO: 330382 - DNA, 25 bp, Mus musculus
catgccatagcaaaagtgtgactaa

SEQ ID NO: 330383 - DNA, 25 bp, Mus musculus
catgccatagcataagtgtgactaa

SEQ ID NO: 330384 - DNA, 25 bp, Mus musculus
catgccatgacacttgtttcctata

SEQ ID NO: 330385 - DNA, 25 bp, Mus musculus
catgccatgacagttgtttcctata

SEQ ID NO: 330386 - DNA, 25 bp, Mus musculus
catgccatgataaactcctctgtac

SEQ ID NO: 330387 - DNA, 25 bp, Mus musculus
catgccatgatatactcctctgtac

SEQ ID NO: 330388 - DNA, 25 bp, Mus musculus
catgccatgattaccattgcccctg

SEQ ID NO: 330389 - DNA, 25 bp, Mus musculus
catgccatgatttccattgcccctg

SEQ ID NO: 330390 - DNA, 25 bp, Mus musculus
catgccatgccacgagggtgagtta

SEQ ID NO: 330391 - DNA, 25 bp, Mus musculus
catgccatgccaggagggtgagtta

SEQ ID NO: 330392 - DNA, 25 bp, Mus musculus
catgccatggcccagttggatgcat

SEQ ID NO: 330393 - DNA, 25 bp, Mus musculus
catgccatggccgagttggatgcat

SEQ ID NO: 330394 - DNA, 25 bp, Mus musculus
catgccatggcgcaggcagcttaga

SEQ ID NO: 330395 - DNA, 25 bp, Mus musculus
catgccatggcggaggcagcttaga

SEQ ID NO: 330396 - DNA, 25 bp, Mus musculus
catgccatggctatacaggacttag

SEQ ID NO: 330397 - DNA, 25 bp, Mus musculus
catgccatggctttacaggacttag

SEQ ID NO: 330398 - DNA, 25 bp, Mus musculus
catgccatgttcctgtgggtcacgc

SEQ ID NO: 330399 - DNA, 25 bp, Mus musculus
catgccatgttcgtgtgggtcacgc

SEQ ID NO: 330400 - DNA, 25 bp, Mus musculus
catgccattgatatgccttcagtgc

SEQ ID NO: 330401 - DNA, 25 bp, Mus musculus
catgccattgatttgccttcagtgc

SEQ ID NO: 330402 - DNA, 25 bp, Mus musculus
catgccatttcccttctaaaaggtt

SEQ ID NO: 330403 - DNA, 25 bp, Mus musculus
catgccatttccgttctaaaaggtt

SEQ ID NO: 330404 - DNA, 25 bp, Mus musculus
catgcccaaacaccctcttaatttt

SEQ ID NO: 330405 - DNA, 25 bp, Mus musculus
catgcccaaacagcctcttaatttt

SEQ ID NO: 330406 - DNA, 25 bp, Mus musculus
catgcccaagttagttcctgacagg

SEQ ID NO: 330407 - DNA, 25 bp, Mus musculus
catgcccaagtttgttcctgacagg

SEQ ID NO: 330408 - DNA, 25 bp, Mus musculus
catgcccacaagaagttggccaaca

SEQ ID NO: 330409 - DNA, 25 bp, Mus musculus
catgcccacaagtagttggccaaca

SEQ ID NO: 330410 - DNA, 25 bp, Mus musculus
catgcccacagcaaagtaacttgat

SEQ ID NO: 330411 - DNA, 25 bp, Mus musculus
catgcccacagctaagtaacttgat

SEQ ID NO: 330412 - DNA, 25 bp, Mus musculus
catgcccacatgatagcctacaggt

SEQ ID NO: 330413 - DNA, 25 bp, Mus musculus
catgcccacatgttagcctacaggt

SEQ ID NO: 330414 - DNA, 25 bp, Mus musculus
catgcccagcagaagttggttaaca

SEQ ID NO: 330415 - DNA, 25 bp, Mus musculus
catgcccagcagtagttggttaaca

SEQ ID NO: 330416 - DNA, 25 bp, Mus musculus
catgcccagccacggttctgtgtga

SEQ ID NO: 330417 - DNA, 25 bp, Mus musculus
catgcccagccagggttctgtgtga

SEQ ID NO: 330418 - DNA, 25 bp, Mus musculus
catgcccagctcagatcaattcaaa

SEQ ID NO: 330419 - DNA, 25 bp, Mus musculus
catgcccagctctgatcaattcaaa

SEQ ID NO: 330420 - DNA, 25 bp, Mus musculus
catgcccaggataggatgtggtctg

SEQ ID NO: 330421 - DNA, 25 bp, Mus musculus
catgcccaggattggatgtggtctg

SEQ ID NO: 330422 - DNA, 25 bp, Mus musculus
catgcccagtttagtcagtaggagg

SEQ ID NO: 330423 - DNA, 25 bp, Mus musculus
catgcccagttttgtcagtaggagg

SEQ ID NO: 330424 - DNA, 25 bp, Mus musculus
catgcccataaccttagtccttagg

SEQ ID NO: 330425 - DNA, 25 bp, Mus musculus
catgcccataacgttagtccttagg

SEQ ID NO: 330426 - DNA, 25 bp, Mus musculus
catgcccatctaccaatgaatgctg

SEQ ID NO: 330427 - DNA, 25 bp, Mus musculus
catgcccatctagcaatgaatgctg

SEQ ID NO: 330428 - DNA, 25 bp, Mus musculus
catgcccatgagaccatttttggag

SEQ ID NO: 330429 - DNA, 25 bp, Mus musculus
catgcccatgagtccatttttggag

SEQ ID NO: 330430 - DNA, 25 bp, Mus musculus
catgcccattagacagtagtttgtg

SEQ ID NO: 330431 - DNA, 25 bp, Mus musculus
catgcccattagtcagtagtttgtg

SEQ ID NO: 330432 - DNA, 25 bp, Mus musculus
catgcccattctcaaggacctttta

SEQ ID NO: 330433 - DNA, 25 bp, Mus musculus
catgcccattctgaaggacctttta

SEQ ID NO: 330434 - DNA, 25 bp, Mus musculus
catgccccaaatccctcagagatgt

SEQ ID NO: 330435 - DNA, 25 bp, Mus musculus
catgccccaaatgcctcagagatgt

SEQ ID NO: 330436 - DNA, 25 bp, Mus musculus
catgccccagtaaattctgcgtgaa

SEQ ID NO: 330437 - DNA, 25 bp, Mus musculus
catgccccagtatattctgcgtgaa

SEQ ID NO: 330438 - DNA, 25 bp, Mus musculus
catgccccatgtcaattcagcttca

SEQ ID NO: 330439 - DNA, 25 bp, Mus musculus
catgccccatgtgaattcagcttca

SEQ ID NO: 330440 - DNA, 25 bp, Mus musculus
catgcccctaagatcccacaaaaag

SEQ ID NO: 330441 - DNA, 25 bp, Mus musculus
catgcccctaagttcccacaaaaag

SEQ ID NO: 330442 - DNA, 25 bp, Mus musculus
catgcccctggcaagagatctgtta

SEQ ID NO: 330443 - DNA, 25 bp, Mus musculus
catgcccctggctagagatctgtta

SEQ ID NO: 330444 - DNA, 25 bp, Mus musculus
catgcccgagatccagttggtgccc

SEQ ID NO: 330445 - DNA, 25 bp, Mus musculus
catgcccgagatgcagttggtgccc

SEQ ID NO: 330446 - DNA, 25 bp, Mus musculus
catgcccgatatcctgagtgtggtt

SEQ ID NO: 330447 - DNA, 25 bp, Mus musculus
catgcccgatatgctgagtgtggtt

SEQ ID NO: 330448 - DNA, 25 bp, Mus musculus
catgcccgctttaatttcctgtttc

SEQ ID NO: 330449 - DNA, 25 bp, Mus musculus
catgcccgcttttatttcctgtttc

SEQ ID NO: 330450 - DNA, 25 bp, Mus musculus
catgcccggcttccgatgtgtaaca

SEQ ID NO: 330451 - DNA, 25 bp, Mus musculus
catgcccggcttgcgatgtgtaaca

SEQ ID NO: 330452 - DNA, 25 bp, Mus musculus
catgccctaagactgtggctcaagg

SEQ ID NO: 330453 - DNA, 25 bp, Mus musculus
catgccctaagagtgtggctcaagg

SEQ ID NO: 330454 - DNA, 25 bp, Mus musculus
catgccctaccgacttcatgtgact

SEQ ID NO: 330455 - DNA, 25 bp, Mus musculus
catgccctaccgtcttcatgtgact

SEQ ID NO: 330456 - DNA, 25 bp, Mus musculus
catgccctatgtatgtgccttttaa

SEQ ID NO: 330457 - DNA, 25 bp, Mus musculus
catgccctatgtttgtgccttttaa

SEQ ID NO: 330458 - DNA, 25 bp, Mus musculus
catgccctcagacatggacagctag

SEQ ID NO: 330459 - DNA, 25 bp, Mus musculus
catgccctcagagatggacagctag

SEQ ID NO: 330460 - DNA, 25 bp, Mus musculus
catgccctcatgattgaaagcgtga

SEQ ID NO: 330461 - DNA, 25 bp, Mus musculus
catgccctcatgtttgaaagcgtga

SEQ ID NO: 330462 - DNA, 25 bp, Mus musculus
catgccctgcatcaaacaatgcttc

SEQ ID NO: 330463 - DNA, 25 bp, Mus musculus
catgccctgcatgaaacaatgcttc

SEQ ID NO: 330464 - DNA, 25 bp, Mus musculus
catgccctgtgtaaaggtcttggct

SEQ ID NO: 330465 - DNA, 25 bp, Mus musculus
catgccctgtgttaaggtcttggct

SEQ ID NO: 330466 - DNA, 25 bp, Mus musculus
catgcccttgccaggtaatgtcatc

SEQ ID NO: 330467 - DNA, 25 bp, Mus musculus
catgcccttgcctggtaatgtcatc

SEQ ID NO: 330468 - DNA, 25 bp, Mus musculus
catgccgaccttccagttttataaa

SEQ ID NO: 330469 - DNA, 25 bp, Mus musculus
catgccgaccttgcagttttataaa

SEQ ID NO: 330470 - DNA, 25 bp, Mus musculus
catgccgagaatcaaggaggcccat

SEQ ID NO: 330471 - DNA, 25 bp, Mus musculus
catgccgagaatgaaggaggcccat

SEQ ID NO: 330472 - DNA, 25 bp, Mus musculus
catgccgagggtaagcctgtgttct

SEQ ID NO: 330473 - DNA, 25 bp, Mus musculus
catgccgagggttagcctgtgttct

SEQ ID NO: 330474 - DNA, 25 bp, Mus musculus
catgccggaggcaatcctataagac

SEQ ID NO: 330475 - DNA, 25 bp, Mus musculus
catgccggaggctatcctataagac

SEQ ID NO: 330476 - DNA, 25 bp, Mus musculus
catgccggtttgcagtgttgactgt

SEQ ID NO: 330477 - DNA, 25 bp, Mus musculus
catgccggtttggagtgttgactgt

SEQ ID NO: 330478 - DNA, 25 bp, Mus musculus
catgcctaagaaagatcccgtcaaa

SEQ ID NO: 330479 - DNA, 25 bp, Mus musculus
catgcctaagaatgatcccgtcaaa

SEQ ID NO: 330480 - DNA, 25 bp, Mus musculus
catgcctacagaatttgactttgat

SEQ ID NO: 330481 - DNA, 25 bp, Mus musculus
catgcctacagattttgactttgat

SEQ ID NO: 330482 - DNA, 25 bp, Mus musculus
catgcctagataccagagtttctgt

SEQ ID NO: 330483 - DNA, 25 bp, Mus musculus
catgcctagatagcagagtttctgt

SEQ ID NO: 330484 - DNA, 25 bp, Mus musculus
catgcctagcaacaattttctttta

SEQ ID NO: 330485 - DNA, 25 bp, Mus musculus
catgcctagcaagaattttctttta

SEQ ID NO: 330486 - DNA, 25 bp, Mus musculus
catgcctaggagacaggctggccca

SEQ ID NO: 330487 - DNA, 25 bp, Mus musculus
catgcctaggagtcaggctggccca

SEQ ID NO: 330488 - DNA, 25 bp, Mus musculus
catgcctataatacagtatcccaga

SEQ ID NO: 330489 - DNA, 25 bp, Mus musculus
catgcctataattcagtatcccaga

SEQ ID NO: 330490 - DNA, 25 bp, Mus musculus
catgcctatcctcaagcctcaggaa

SEQ ID NO: 330491 - DNA, 25 bp, Mus musculus
catgcctatcctgaagcctcaggaa

SEQ ID NO: 330492 - DNA, 25 bp, Mus musculus
catgcctatgggattcagctcaaac

SEQ ID NO: 330493 - DNA, 25 bp, Mus musculus
catgcctatgggtttcagctcaaac

SEQ ID NO: 330494 - DNA, 25 bp, Mus musculus
catgcctcaaaaaagctaatgaaac

SEQ ID NO: 330495 - DNA, 25 bp, Mus musculus
catgcctcaaaatagctaatgaaac

SEQ ID NO: 330496 - DNA, 25 bp, Mus musculus
catgcctccacacggcatgcgtggg

SEQ ID NO: 330497 - DNA, 25 bp, Mus musculus
catgcctccacagggcatgcgtggg

SEQ ID NO: 330498 - DNA, 25 bp, Mus musculus
catgcctctagcagcacaatgttat

SEQ ID NO: 330499 - DNA, 25 bp, Mus musculus
catgcctctagctgcacaatgttat

SEQ ID NO: 330500 - DNA, 25 bp, Mus musculus
catgcctctgacatcacacattggt

SEQ ID NO: 330501 - DNA, 25 bp, Mus musculus
catgcctctgacttcacacattggt

SEQ ID NO: 330502 - DNA, 25 bp, Mus musculus
catgcctcttggaaaagctgcttga

SEQ ID NO: 330503 - DNA, 25 bp, Mus musculus
catgcctcttggcacgagatcacag

SEQ ID NO: 330504 - DNA, 25 bp, Mus musculus
catgcctcttgggacgagatcacag

SEQ ID NO: 330505 - DNA, 25 bp, Mus musculus
catgcctcttggtaaagctgcttga

SEQ ID NO: 330506 - DNA, 25 bp, Mus musculus
catgcctgcagcactaattagactc

SEQ ID NO: 330507 - DNA, 25 bp, Mus musculus
catgcctgcagctctaattagactc

SEQ ID NO: 330508 - DNA, 25 bp, Mus musculus
catgcctgcaggagcttctacagta

SEQ ID NO: 330509 - DNA, 25 bp, Mus musculus
catgcctgcaggtgcttctacagta

SEQ ID NO: 330510 - DNA, 25 bp, Mus musculus
catgcctgccatagtctttattgta

SEQ ID NO: 330511 - DNA, 25 bp, Mus musculus
catgcctgccattgtctttattgta

SEQ ID NO: 330512 - DNA, 25 bp, Mus musculus
catgcctgctacctggaggagtcta

SEQ ID NO: 330513 - DNA, 25 bp, Mus musculus
catgcctgctacgtggaggagtcta

SEQ ID NO: 330514 - DNA, 25 bp, Mus musculus
catgcctggctgataatgtttttaa

SEQ ID NO: 330515 - DNA, 25 bp, Mus musculus
catgcctggctgatttcttattttc

SEQ ID NO: 330516 - DNA, 25 bp, Mus musculus
catgcctggctgttaatgtttttaa

SEQ ID NO: 330517 - DNA, 25 bp, Mus musculus
catgcctggctgttttcttattttc

SEQ ID NO: 330518 - DNA, 25 bp, Mus musculus
catgcctgtttgatttggatgctgt

SEQ ID NO: 330519 - DNA, 25 bp, Mus musculus
catgcctgtttgttttggatgctgt

SEQ ID NO: 330520 - DNA, 25 bp, Mus musculus
catgccttactcagtgtataccttt

SEQ ID NO: 330521 - DNA, 25 bp, Mus musculus
catgccttactctgtgtataccttt

SEQ ID NO: 330522 - DNA, 25 bp, Mus musculus
catgccttaggtctgtactgtcctt

SEQ ID NO: 330523 - DNA, 25 bp, Mus musculus
catgccttaggtgtgtactgtcctt

SEQ ID NO: 330524 - DNA, 25 bp, Mus musculus
catgccttccaccatgatggttgta

SEQ ID NO: 330525 - DNA, 25 bp, Mus musculus
catgccttccacgatgatggttgta

SEQ ID NO: 330526 - DNA, 25 bp, Mus musculus
catgccttgtctattgagccttgag

SEQ ID NO: 330527 - DNA, 25 bp, Mus musculus
catgccttgtcttttgagccttgag

SEQ ID NO: 330528 - DNA, 25 bp, Mus musculus
catgccttgtgtaggcaacatgagc

SEQ ID NO: 330529 - DNA, 25 bp, Mus musculus
catgccttgtgttggcaacatgagc

SEQ ID NO: 330530 - DNA, 25 bp, Mus musculus
catgcctttaaacggctgtttctta

SEQ ID NO: 330531 - DNA, 25 bp, Mus musculus
catgcctttaaagggctgtttctta

SEQ ID NO: 330532 - DNA, 25 bp, Mus musculus
catgcctttaatattggtctactta

SEQ ID NO: 330533 - DNA, 25 bp, Mus musculus
catgcctttaattttggtctactta

SEQ ID NO: 330534 - DNA, 25 bp, Mus musculus
catgcgaaagcaaaccccagaattg

SEQ ID NO: 330535 - DNA, 25 bp, Mus musculus
catgcgaaagcataccccagaattg

SEQ ID NO: 330536 - DNA, 25 bp, Mus musculus
catgcgacactccaaacagacacat

SEQ ID NO: 330537 - DNA, 25 bp, Mus musculus
catgcgacactcgaaacagacacat

SEQ ID NO: 330538 - DNA, 25 bp, Mus musculus
catgcgaggtctcctttgatcttca

SEQ ID NO: 330539 - DNA, 25 bp, Mus musculus
catgcgaggtctgctttgatcttca

SEQ ID NO: 330540 - DNA, 25 bp, Mus musculus
catgcgaggtgaagttagcggattc

SEQ ID NO: 330541 - DNA, 25 bp, Mus musculus
catgcgaggtgatgttagcggattc

SEQ ID NO: 330542 - DNA, 25 bp, Mus musculus
catgcgatcttgattgagtccttgg

SEQ ID NO: 330543 - DNA, 25 bp, Mus musculus
catgcgatcttgtttgagtccttgg

SEQ ID NO: 330544 - DNA, 25 bp, Mus musculus
catgcgatggcaactgggacgtcat

SEQ ID NO: 330545 - DNA, 25 bp, Mus musculus
catgcgatggcatctgggacgtcat

SEQ ID NO: 330546 - DNA, 25 bp, Mus musculus
catgcgcaaggtcgttctcgaggct

SEQ ID NO: 330547 - DNA, 25 bp, Mus musculus
catgcgcaaggtggttctcgaggct

SEQ ID NO: 330548 - DNA, 25 bp, Mus musculus
catgcgcactagagaggcctttggt

SEQ ID NO: 330549 - DNA, 25 bp, Mus musculus
catgcgcactagtgaggcctttggt

SEQ ID NO: 330550 - DNA, 25 bp, Mus musculus
catgcgcagataacgggaggcagct

SEQ ID NO: 330551 - DNA, 25 bp, Mus musculus
catgcgcagatatcgggaggcagct

SEQ ID NO: 330552 - DNA, 25 bp, Mus musculus
catgcgcatcatcacgagactctca

SEQ ID NO: 330553 - DNA, 25 bp, Mus musculus
catgcgcatcatgacgagactctca

SEQ ID NO: 330554 - DNA, 25 bp, Mus musculus
catgcgcatccgaccttatcagagg

SEQ ID NO: 330555 - DNA, 25 bp, Mus musculus
catgcgcatccgtccttatcagagg

SEQ ID NO: 330556 - DNA, 25 bp, Mus musculus
catgcgcattgacttcaagaagata

SEQ ID NO: 330557 - DNA, 25 bp, Mus musculus
catgcgcattgagttcaagaagata

SEQ ID NO: 330558 - DNA, 25 bp, Mus musculus
catgcgctcttaacccggagaagag

SEQ ID NO: 330559 - DNA, 25 bp, Mus musculus
catgcgctcttatcccggagaagag

SEQ ID NO: 330560 - DNA, 25 bp, Mus musculus
catgcgctggttcctgaagacgaga

SEQ ID NO: 330561 - DNA, 25 bp, Mus musculus
catgcgctggttgctgaagacgaga

SEQ ID NO: 330562 - DNA, 25 bp, Mus musculus
catgcgctgtgtactataatttccc

SEQ ID NO: 330563 - DNA, 25 bp, Mus musculus
catgcgctgtgttctataatttccc

SEQ ID NO: 330564 - DNA, 25 bp, Mus musculus
catgcgcttcatcatgatgcgagca

SEQ ID NO: 330565 - DNA, 25 bp, Mus musculus
catgcgcttcatgatgatgcgagca

SEQ ID NO: 330566 - DNA, 25 bp, Mus musculus
catgcggcggaaagtgacgaatttt

SEQ ID NO: 330567 - DNA, 25 bp, Mus musculus
catgcggcggaatgtgacgaatttt

SEQ ID NO: 330568 - DNA, 25 bp, Mus musculus
catgcggctgataaccagggtttga

SEQ ID NO: 330569 - DNA, 25 bp, Mus musculus
catgcggctgattaccagggtttga

SEQ ID NO: 330570 - DNA, 25 bp, Mus musculus
catgcgggaggccttttcccgaagc

SEQ ID NO: 330571 - DNA, 25 bp, Mus musculus
catgcgggaggcgttttcccgaagc

SEQ ID NO: 330572 - DNA, 25 bp, Mus musculus
catgcgggccaacgatcaggacaca

SEQ ID NO: 330573 - DNA, 25 bp, Mus musculus
catgcgggccaaggatcaggacaca

SEQ ID NO: 330574 - DNA, 25 bp, Mus musculus
catgcgggtagaccaggacccctca

SEQ ID NO: 330575 - DNA, 25 bp, Mus musculus
catgcgggtagagcaggacccctca

SEQ ID NO: 330576 - DNA, 25 bp, Mus musculus
catgcggtgcaacctgggatatttg

SEQ ID NO: 330577 - DNA, 25 bp, Mus musculus
catgcggtgcaagctgggatatttg

SEQ ID NO: 330578 - DNA, 25 bp, Mus musculus
catgcggtgcggaaacattccttga

SEQ ID NO: 330579 - DNA, 25 bp, Mus musculus
catgcggtgcggtaacattccttga

SEQ ID NO: 330580 - DNA, 25 bp, Mus musculus
catgcgtaagcacagataacaggat

SEQ ID NO: 330581 - DNA, 25 bp, Mus musculus
catgcgtaagcagagataacaggat

SEQ ID NO: 330582 - DNA, 25 bp, Mus musculus
catgcgtacagcagatggagcagat

SEQ ID NO: 330583 - DNA, 25 bp, Mus musculus
catgcgtacagctgatggagcagat

SEQ ID NO: 330584 - DNA, 25 bp, Mus musculus
catgcgtagactagcttcctgagag

SEQ ID NO: 330585 - DNA, 25 bp, Mus musculus
catgcgtagacttgcttcctgagag

SEQ ID NO: 330586 - DNA, 25 bp, Mus musculus
catgcgtcttccagtgcacagaaat

SEQ ID NO: 330587 - DNA, 25 bp, Mus musculus
catgcgtcttcctgtgcacagaaat

SEQ ID NO: 330588 - DNA, 25 bp, Mus musculus
catgcgtgcaccaacacatattcaa

SEQ ID NO: 330589 - DNA, 25 bp, Mus musculus
catgcgtgcacctacacatattcaa

SEQ ID NO: 330590 - DNA, 25 bp, Mus musculus
catgcgtgtgcaagttcgtgtatgt

SEQ ID NO: 330591 - DNA, 25 bp, Mus musculus
catgcgtgtgcatgttcgtgtatgt

SEQ ID NO: 330592 - DNA, 25 bp, Mus musculus
catgcgttcattaacctaagcagta

SEQ ID NO: 330593 - DNA, 25 bp, Mus musculus
catgcgttcatttacctaagcagta

SEQ ID NO: 330594 - DNA, 25 bp, Mus musculus
catgcgttcgctcaaaggcatcggt

SEQ ID NO: 330595 - DNA, 25 bp, Mus musculus
catgcgttcgctgaaaggcatcggt

SEQ ID NO: 330596 - DNA, 25 bp, Mus musculus
catgcgttgggcacagtattggagt

SEQ ID NO: 330597 - DNA, 25 bp, Mus musculus
catgcgttgggctcagtattggagt

SEQ ID NO: 330598 - DNA, 25 bp, Mus musculus
catgctaaaaccaaaaaccccatgt

SEQ ID NO: 330599 - DNA, 25 bp, Mus musculus
catgctaaaacctaaaaccccatgt

SEQ ID NO: 330600 - DNA, 25 bp, Mus musculus
catgctaaactccttctcttataga

SEQ ID NO: 330601 - DNA, 25 bp, Mus musculus
catgctaaactcgttctcttataga

SEQ ID NO: 330602 - DNA, 25 bp, Mus musculus
catgctaatataatctcacctgtga

SEQ ID NO: 330603 - DNA, 25 bp, Mus musculus
catgctaatatattctcacctgtga

SEQ ID NO: 330604 - DNA, 25 bp, Mus musculus
catgctaatgctcaaatacgtttta

SEQ ID NO: 330605 - DNA, 25 bp, Mus musculus
catgctaatgctgaaatacgtttta

SEQ ID NO: 330606 - DNA, 25 bp, Mus musculus
catgctaatgtgaatttctccgaat

SEQ ID NO: 330607 - DNA, 25 bp, Mus musculus
catgctaatgtgtatttctccgaat

SEQ ID NO: 330608 - DNA, 25 bp, Mus musculus
catgctacctccagctttgtcaaca

SEQ ID NO: 330609 - DNA, 25 bp, Mus musculus
catgctacctcctgctttgtcaaca

SEQ ID NO: 330610 - DNA, 25 bp, Mus musculus
catgctagaaccaacactgtggctg

SEQ ID NO: 330611 - DNA, 25 bp, Mus musculus
catgctagaaccatggtatcccatg

SEQ ID NO: 330612 - DNA, 25 bp, Mus musculus
catgctagaacctacactgtggctg

SEQ ID NO: 330613 - DNA, 25 bp, Mus musculus
catgctagaaccttggtatcccatg

SEQ ID NO: 330614 - DNA, 25 bp, Mus musculus
catgctagacaaccctactacgaat

SEQ ID NO: 330615 - DNA, 25 bp, Mus musculus
catgctagacaagcctactacgaat

SEQ ID NO: 330616 - DNA, 25 bp, Mus musculus
catgctagacagcttttggtgactt

SEQ ID NO: 330617 - DNA, 25 bp, Mus musculus
catgctagacaggttttggtgactt

SEQ ID NO: 330618 - DNA, 25 bp, Mus musculus
catgctagacatcctcacagagttc

SEQ ID NO: 330619 - DNA, 25 bp, Mus musculus
catgctagacatgctcacagagttc

SEQ ID NO: 330620 - DNA, 25 bp, Mus musculus
catgctagacggatgaatggtgctg

SEQ ID NO: 330621 - DNA, 25 bp, Mus musculus
catgctagacggttgaatggtgctg

SEQ ID NO: 330622 - DNA, 25 bp, Mus musculus
catgctagactgaacgttccttggg

SEQ ID NO: 330623 - DNA, 25 bp, Mus musculus
catgctagactgtacgttccttggg

SEQ ID NO: 330624 - DNA, 25 bp, Mus musculus
catgctagcaagattcgatcttctg

SEQ ID NO: 330625 - DNA, 25 bp, Mus musculus
catgctagcaagtttcgatcttctg

SEQ ID NO: 330626 - DNA, 25 bp, Mus musculus
catgctagcatgactgtagttctag

SEQ ID NO: 330627 - DNA, 25 bp, Mus musculus
catgctagcatgtctgtagttctag

SEQ ID NO: 330628 - DNA, 25 bp, Mus musculus
catgctaggttcaggcttgatttat

SEQ ID NO: 330629 - DNA, 25 bp, Mus musculus
catgctaggttctggcttgatttat

SEQ ID NO: 330630 - DNA, 25 bp, Mus musculus
catgctataaaaaacattccctgtt

SEQ ID NO: 330631 - DNA, 25 bp, Mus musculus
catgctataaaatacattccctgtt

SEQ ID NO: 330632 - DNA, 25 bp, Mus musculus
catgctataacccaggtgtagatgt

SEQ ID NO: 330633 - DNA, 25 bp, Mus musculus
catgctataaccgaggtgtagatgt

SEQ ID NO: 330634 - DNA, 25 bp, Mus musculus
catgctataattagtgattggtttc

SEQ ID NO: 330635 - DNA, 25 bp, Mus musculus
catgctataatttgtgattggtttc

SEQ ID NO: 330636 - DNA, 25 bp, Mus musculus
catgctatagccatcatgtgggtgc

SEQ ID NO: 330637 - DNA, 25 bp, Mus musculus
catgctatagccttcatgtgggtgc

SEQ ID NO: 330638 - DNA, 25 bp, Mus musculus
catgctatagtgctgtttgtgtgct

SEQ ID NO: 330639 - DNA, 25 bp, Mus musculus
catgctatagtggtgtttgtgtgct

SEQ ID NO: 330640 - DNA, 25 bp, Mus musculus
catgctatggacattcgctgttacc

SEQ ID NO: 330641 - DNA, 25 bp, Mus musculus
catgctatggactttcgctgttacc

SEQ ID NO: 330642 - DNA, 25 bp, Mus musculus
catgctatgggcaggttatagaaca

SEQ ID NO: 330643 - DNA, 25 bp, Mus musculus
catgctatgggctggttatagaaca

SEQ ID NO: 330644 - DNA, 25 bp, Mus musculus
catgctattaatcacggcaatggaa

SEQ ID NO: 330645 - DNA, 25 bp, Mus musculus
catgctattaatgacggcaatggaa

SEQ ID NO: 330646 - DNA, 25 bp, Mus musculus
catgctatttttctgccagttgctt

SEQ ID NO: 330647 - DNA, 25 bp, Mus musculus
catgctatttttgtgccagttgctt

SEQ ID NO: 330648 - DNA, 25 bp, Mus musculus
catgctcaacccaagtgtcgaattt

SEQ ID NO: 330649 - DNA, 25 bp, Mus musculus
catgctcaaccctagtgtcgaattt

SEQ ID NO: 330650 - DNA, 25 bp, Mus musculus
catgctcaacgtcttcctcaagtcg

SEQ ID NO: 330651 - DNA, 25 bp, Mus musculus
catgctcaacgtgttcctcaagtcg

SEQ ID NO: 330652 - DNA, 25 bp, Mus musculus
catgctcaggcaagggctatggtgt

SEQ ID NO: 330653 - DNA, 25 bp, Mus musculus
catgctcaggcatgggctatggtgt

SEQ ID NO: 330654 - DNA, 25 bp, Mus musculus
catgctcagtgccttttggtttccc

SEQ ID NO: 330655 - DNA, 25 bp, Mus musculus
catgctcagtgcgttttggtttccc

SEQ ID NO: 330656 - DNA, 25 bp, Mus musculus
catgctcatagtagaggttcctgta

SEQ ID NO: 330657 - DNA, 25 bp, Mus musculus
catgctcatagttgaggttcctgta

SEQ ID NO: 330658 - DNA, 25 bp, Mus musculus
catgctcatattagatttctgaaga

SEQ ID NO: 330659 - DNA, 25 bp, Mus musculus
catgctcatatttgatttctgaaga

SEQ ID NO: 330660 - DNA, 25 bp, Mus musculus
catgctcatctgaaaatgcgaactt

SEQ ID NO: 330661 - DNA, 25 bp, Mus musculus
catgctcatctgtaaatgcgaactt

SEQ ID NO: 330662 - DNA, 25 bp, Mus musculus
catgctcattttcctgtgctgttct

SEQ ID NO: 330663 - DNA, 25 bp, Mus musculus
catgctcattttgctgtgctgttct

SEQ ID NO: 330664 - DNA, 25 bp, Mus musculus
catgctccagagataggccttgcct

SEQ ID NO: 330665 - DNA, 25 bp, Mus musculus
catgctccagagttaggccttgcct

SEQ ID NO: 330666 - DNA, 25 bp, Mus musculus
catgctccaggaaatgcacactctg

SEQ ID NO: 330667 - DNA, 25 bp, Mus musculus
catgctccaggatatgcacactctg

SEQ ID NO: 330668 - DNA, 25 bp, Mus musculus
catgctccatgtcaagtgtgtacgt

SEQ ID NO: 330669 - DNA, 25 bp, Mus musculus
catgctccatgtgaagtgtgtacgt

SEQ ID NO: 330670 - DNA, 25 bp, Mus musculus
catgctccattaaaatgtagacaag

SEQ ID NO: 330671 - DNA, 25 bp, Mus musculus
catgctccattataatgtagacaag

SEQ ID NO: 330672 - DNA, 25 bp, Mus musculus
catgctccgctaccagaagtgtctg

SEQ ID NO: 330673 - DNA, 25 bp, Mus musculus
catgctccgctagcagaagtgtctg

SEQ ID NO: 330674 - DNA, 25 bp, Mus musculus
catgctccgttaaagatgcctgtga

SEQ ID NO: 330675 - DNA, 25 bp, Mus musculus
catgctccgttatagatgcctgtga

SEQ ID NO: 330676 - DNA, 25 bp, Mus musculus
catgctccgtttagttcagttgtga

SEQ ID NO: 330677 - DNA, 25 bp, Mus musculus
catgctccgttttgttcagttgtga

SEQ ID NO: 330678 - DNA, 25 bp, Mus musculus
catgctcctataagaagtagtttga

SEQ ID NO: 330679 - DNA, 25 bp, Mus musculus
catgctcctatatgaagtagtttga

SEQ ID NO: 330680 - DNA, 25 bp, Mus musculus
catgctcctcatatggcctcacggt

SEQ ID NO: 330681 - DNA, 25 bp, Mus musculus
catgctcctcatttggcctcacggt

SEQ ID NO: 330682 - DNA, 25 bp, Mus musculus
catgctccttcaccgagcagaagca

SEQ ID NO: 330683 - DNA, 25 bp, Mus musculus
catgctccttcagcgagcagaagca

SEQ ID NO: 330684 - DNA, 25 bp, Mus musculus
catgctccttgtcgccttttttata

SEQ ID NO: 330685 - DNA, 25 bp, Mus musculus
catgctccttgtggccttttttata

SEQ ID NO: 330686 - DNA, 25 bp, Mus musculus
catgctcgagaaacagtatgtgcta

SEQ ID NO: 330687 - DNA, 25 bp, Mus musculus
catgctcgagaatcagtatgtgcta

SEQ ID NO: 330688 - DNA, 25 bp, Mus musculus
catgctcgagttacttcctgtagtg

SEQ ID NO: 330689 - DNA, 25 bp, Mus musculus
catgctcgagtttcttcctgtagtg

SEQ ID NO: 330690 - DNA, 25 bp, Mus musculus
catgctcgatggcaggttcattttc

SEQ ID NO: 330691 - DNA, 25 bp, Mus musculus
catgctcgatgggaggttcattttc

SEQ ID NO: 330692 - DNA, 25 bp, Mus musculus
catgctcgctcacaggctcgttgct

SEQ ID NO: 330693 - DNA, 25 bp, Mus musculus
catgctcgctcagaggctcgttgct

SEQ ID NO: 330694 - DNA, 25 bp, Mus musculus
catgctctacttctcatatctgtgc

SEQ ID NO: 330695 - DNA, 25 bp, Mus musculus
catgctctacttgtcatatctgtgc

SEQ ID NO: 330696 - DNA, 25 bp, Mus musculus
catgctctagccatctgggaacaga

SEQ ID NO: 330697 - DNA, 25 bp, Mus musculus
catgctctagccttctgggaacaga

SEQ ID NO: 330698 - DNA, 25 bp, Mus musculus
catgctctgatgacagcactggaga

SEQ ID NO: 330699 - DNA, 25 bp, Mus musculus
catgctctgatgtcagcactggaga

SEQ ID NO: 330700 - DNA, 25 bp, Mus musculus
catgctctgcgcagttgcttgtaaa

SEQ ID NO: 330701 - DNA, 25 bp, Mus musculus
catgctctgcgctgttgcttgtaaa

SEQ ID NO: 330702 - DNA, 25 bp, Mus musculus
catgctctggccactcctatgggaa

SEQ ID NO: 330703 - DNA, 25 bp, Mus musculus
catgctctggcctctcctatgggaa

SEQ ID NO: 330704 - DNA, 25 bp, Mus musculus
catgctcttagcagtcaggatctga

SEQ ID NO: 330705 - DNA, 25 bp, Mus musculus
catgctcttagctgtcaggatctga

SEQ ID NO: 330706 - DNA, 25 bp, Mus musculus
catgctcttcctctatgagtgacac

SEQ ID NO: 330707 - DNA, 25 bp, Mus musculus
catgctcttcctgtatgagtgacac

SEQ ID NO: 330708 - DNA, 25 bp, Mus musculus
catgctcttgccatggttataatgg

SEQ ID NO: 330709 - DNA, 25 bp, Mus musculus
catgctcttgccttggttataatgg

SEQ ID NO: 330710 - DNA, 25 bp, Mus musculus
catgctctttgtatagcgtcagacc

SEQ ID NO: 330711 - DNA, 25 bp, Mus musculus
catgctctttgtttagcgtcagacc

SEQ ID NO: 330712 - DNA, 25 bp, Mus musculus
catgctgaataccaacttgagataa

SEQ ID NO: 330713 - DNA, 25 bp, Mus musculus
catgctgaataccatctattacttg

SEQ ID NO: 330714 - DNA, 25 bp, Mus musculus
catgctgaatacgaacttgagataa

SEQ ID NO: 330715 - DNA, 25 bp, Mus musculus
catgctgaatacgatctattacttg

SEQ ID NO: 330716 - DNA, 25 bp, Mus musculus
catgctgaattgctaccatcactgc

SEQ ID NO: 330717 - DNA, 25 bp, Mus musculus
catgctgaattggtaccatcactgc

SEQ ID NO: 330718 - DNA, 25 bp, Mus musculus
catgctgacgtgctctgccacaggg

SEQ ID NO: 330719 - DNA, 25 bp, Mus musculus
catgctgacgtggtctgccacaggg

SEQ ID NO: 330720 - DNA, 25 bp, Mus musculus
catgctgactcacgacctggaaaag

SEQ ID NO: 330721 - DNA, 25 bp, Mus musculus
catgctgactcaggacctggaaaag

SEQ ID NO: 330722 - DNA, 25 bp, Mus musculus
catgctgactttctttctagagggc

SEQ ID NO: 330723 - DNA, 25 bp, Mus musculus
catgctgactttgtttctagagggc

SEQ ID NO: 330724 - DNA, 25 bp, Mus musculus
catgctgagacccagttcccagtgg

SEQ ID NO: 330725 - DNA, 25 bp, Mus musculus
catgctgagaccgagttcccagtgg

SEQ ID NO: 330726 - DNA, 25 bp, Mus musculus
catgctgagactccggagaggctct

SEQ ID NO: 330727 - DNA, 25 bp, Mus musculus
catgctgagactgcggagaggctct

SEQ ID NO: 330728 - DNA, 25 bp, Mus musculus
catgctgagctgcatacaagccaat

SEQ ID NO: 330729 - DNA, 25 bp, Mus musculus
catgctgagctggatacaagccaat

SEQ ID NO: 330730 - DNA, 25 bp, Mus musculus
catgctgaggccactaatgaggagc

SEQ ID NO: 330731 - DNA, 25 bp, Mus musculus
catgctgaggcctctaatgaggagc

SEQ ID NO: 330732 - DNA, 25 bp, Mus musculus
catgctgatccaagcttgatgagct

SEQ ID NO: 330733 - DNA, 25 bp, Mus musculus
catgctgatccatgcttgatgagct

SEQ ID NO: 330734 - DNA, 25 bp, Mus musculus
catgctgatctccaattgaatttaa

SEQ ID NO: 330735 - DNA, 25 bp, Mus musculus
catgctgatctcgaattgaatttaa

SEQ ID NO: 330736 - DNA, 25 bp, Mus musculus
catgctgatgatctgccttggcttc

SEQ ID NO: 330737 - DNA, 25 bp, Mus musculus
catgctgatgatgtgccttggcttc

SEQ ID NO: 330738 - DNA, 25 bp, Mus musculus
catgctgatttgactaaaggaacgg

SEQ ID NO: 330739 - DNA, 25 bp, Mus musculus
catgctgatttgtctaaaggaacgg

SEQ ID NO: 330740 - DNA, 25 bp, Mus musculus
catgctgcaacacttcctgtacttc

SEQ ID NO: 330741 - DNA, 25 bp, Mus musculus
catgctgcaacagttcctgtacttc

SEQ ID NO: 330742 - DNA, 25 bp, Mus musculus
catgctgcaattcgtaagtagtgtc

SEQ ID NO: 330743 - DNA, 25 bp, Mus musculus
catgctgcaattggtaagtagtgtc

SEQ ID NO: 330744 - DNA, 25 bp, Mus musculus
catgctgccagaatgaaagggtcca

SEQ ID NO: 330745 - DNA, 25 bp, Mus musculus
catgctgccagattgaaagggtcca

SEQ ID NO: 330746 - DNA, 25 bp, Mus musculus
catgctgcccacagaagtgttcgtg

SEQ ID NO: 330747 - DNA, 25 bp, Mus musculus
catgctgcccactgaagtgttcgtg

SEQ ID NO: 330748 - DNA, 25 bp, Mus musculus
catgctgccgcacgatgatcagtcc

SEQ ID NO: 330749 - DNA, 25 bp, Mus musculus
catgctgccgcaggatgatcagtcc

SEQ ID NO: 330750 - DNA, 25 bp, Mus musculus
catgctgccgcccaagggtggcccc

SEQ ID NO: 330751 - DNA, 25 bp, Mus musculus
catgctgccgccgaagggtggcccc

SEQ ID NO: 330752 - DNA, 25 bp, Mus musculus
catgctgcctgtagttcactttgaa

SEQ ID NO: 330753 - DNA, 25 bp, Mus musculus
catgctgcctgttgttcactttgaa

SEQ ID NO: 330754 - DNA, 25 bp, Mus musculus
catgctgccttccttaggtagggaa

SEQ ID NO: 330755 - DNA, 25 bp, Mus musculus
catgctgccttcgttaggtagggaa

SEQ ID NO: 330756 - DNA, 25 bp, Mus musculus
catgctgcgatgaggccggatgtca

SEQ ID NO: 330757 - DNA, 25 bp, Mus musculus
catgctgcgatgtggccggatgtca

SEQ ID NO: 330758 - DNA, 25 bp, Mus musculus
catgctgctcttcgctccagaagga

SEQ ID NO: 330759 - DNA, 25 bp, Mus musculus
catgctgctcttggctccagaagga

SEQ ID NO: 330760 - DNA, 25 bp, Mus musculus
catgctgctgtaagatgtgatggca

SEQ ID NO: 330761 - DNA, 25 bp, Mus musculus
catgctgctgtatgatgtgatggca

SEQ ID NO: 330762 - DNA, 25 bp, Mus musculus
catgctggaattagggttgttttat

SEQ ID NO: 330763 - DNA, 25 bp, Mus musculus
catgctggaatttgggttgttttat

SEQ ID NO: 330764 - DNA, 25 bp, Mus musculus
catgctggacacaggatctccctgc

SEQ ID NO: 330765 - DNA, 25 bp, Mus musculus
catgctggacactggatctccctgc

SEQ ID NO: 330766 - DNA, 25 bp, Mus musculus
catgctggacatccgggcgagcttt

SEQ ID NO: 330767 - DNA, 25 bp, Mus musculus
catgctggacatgcgggcgagcttt

SEQ ID NO: 330768 - DNA, 25 bp, Mus musculus
catgctggactacgacatggtgcat

SEQ ID NO: 330769 - DNA, 25 bp, Mus musculus
catgctggactaggacatggtgcat

SEQ ID NO: 330770 - DNA, 25 bp, Mus musculus
catgctggagaacagtgatgcccca

SEQ ID NO: 330771 - DNA, 25 bp, Mus musculus
catgctggagaagagtgatgcccca

SEQ ID NO: 330772 - DNA, 25 bp, Mus musculus
catgctggagcacctgctgttggct

SEQ ID NO: 330773 - DNA, 25 bp, Mus musculus
catgctggagcagctgctgttggct

SEQ ID NO: 330774 - DNA, 25 bp, Mus musculus
catgctggagccactatttctgagt

SEQ ID NO: 330775 - DNA, 25 bp, Mus musculus
catgctggagcctctatttctgagt

SEQ ID NO: 330776 - DNA, 25 bp, Mus musculus
catgctggaggcacgactctttgag

SEQ ID NO: 330777 - DNA, 25 bp, Mus musculus
catgctggaggctcgactctttgag

SEQ ID NO: 330778 - DNA, 25 bp, Mus musculus
catgctggatggattccccgagcgt

SEQ ID NO: 330779 - DNA, 25 bp, Mus musculus
catgctggatggtttccccgagcgt

SEQ ID NO: 330780 - DNA, 25 bp, Mus musculus
catgctggccgacaggagaagccct

SEQ ID NO: 330781 - DNA, 25 bp, Mus musculus
catgctggccgagaggagaagccct

SEQ ID NO: 330782 - DNA, 25 bp, Mus musculus
catgctggcgtgagacgtctttggt

SEQ ID NO: 330783 - DNA, 25 bp, Mus musculus
catgctggcgtgtgacgtctttggt

SEQ ID NO: 330784 - DNA, 25 bp, Mus musculus
catgctgggaaacttctgacttcct

SEQ ID NO: 330785 - DNA, 25 bp, Mus musculus
catgctgggaaagttctgacttcct

SEQ ID NO: 330786 - DNA, 25 bp, Mus musculus
catgctgggcatattgagttcttca

SEQ ID NO: 330787 - DNA, 25 bp, Mus musculus
catgctgggcattttgagttcttca

SEQ ID NO: 330788 - DNA, 25 bp, Mus musculus
catgctgggcctagctttctgtatc

SEQ ID NO: 330789 - DNA, 25 bp, Mus musculus
catgctgggccttgctttctgtatc

SEQ ID NO: 330790 - DNA, 25 bp, Mus musculus
catgctgggttcaggaatgcagagc

SEQ ID NO: 330791 - DNA, 25 bp, Mus musculus
catgctgggttctggaatgcagagc

SEQ ID NO: 330792 - DNA, 25 bp, Mus musculus
catgctgggtttctggatatctcta

SEQ ID NO: 330793 - DNA, 25 bp, Mus musculus
catgctgggtttgtggatatctcta

SEQ ID NO: 330794 - DNA, 25 bp, Mus musculus
catgctggtaaacaactgttaggaa

SEQ ID NO: 330795 - DNA, 25 bp, Mus musculus
catgctggtaaagaactgttaggaa

SEQ ID NO: 330796 - DNA, 25 bp, Mus musculus
catgctggtactacctgccagtggt

SEQ ID NO: 330797 - DNA, 25 bp, Mus musculus
catgctggtacttcctgccagtggt

SEQ ID NO: 330798 - DNA, 25 bp, Mus musculus
catgctgtaaatagtctggtcgtca

SEQ ID NO: 330799 - DNA, 25 bp, Mus musculus
catgctgtaaattgtctggtcgtca

SEQ ID NO: 330800 - DNA, 25 bp, Mus musculus
catgctgtagcaaccatgtggaggt

SEQ ID NO: 330801 - DNA, 25 bp, Mus musculus
catgctgtagcatccatgtggaggt

SEQ ID NO: 330802 - DNA, 25 bp, Mus musculus
catgctgtcagcaatgttgtaccat

SEQ ID NO: 330803 - DNA, 25 bp, Mus musculus
catgctgtcagctatgttgtaccat

SEQ ID NO: 330804 - DNA, 25 bp, Mus musculus
catgctgtcgccactctggcggaag

SEQ ID NO: 330805 - DNA, 25 bp, Mus musculus
catgctgtcgcctctctggcggaag

SEQ ID NO: 330806 - DNA, 25 bp, Mus musculus
catgctgtgacaacccaactgacat

SEQ ID NO: 330807 - DNA, 25 bp, Mus musculus
catgctgtgacatcccaactgacat

SEQ ID NO: 330808 - DNA, 25 bp, Mus musculus
catgctgtgcatcggtgcgtacata

SEQ ID NO: 330809 - DNA, 25 bp, Mus musculus
catgctgtgcatgggtgcgtacata

SEQ ID NO: 330810 - DNA, 25 bp, Mus musculus
catgctgtgcgccagtgttcggaaa

SEQ ID NO: 330811 - DNA, 25 bp, Mus musculus
catgctgtgcgcgagtgttcggaaa

SEQ ID NO: 330812 - DNA, 25 bp, Mus musculus
catgctgtgtgcctcatatggtaat

SEQ ID NO: 330813 - DNA, 25 bp, Mus musculus
catgctgtgtgcgtcatatggtaat

SEQ ID NO: 330814 - DNA, 25 bp, Mus musculus
catgctgtgttgacttcttacggag

SEQ ID NO: 330815 - DNA, 25 bp, Mus musculus
catgctgtgttgtcttcttacggag

SEQ ID NO: 330816 - DNA, 25 bp, Mus musculus
catgctgttcatcaaatttcctaca

SEQ ID NO: 330817 - DNA, 25 bp, Mus musculus
catgctgttcatgaaatttcctaca

SEQ ID NO: 330818 - DNA, 25 bp, Mus musculus
catgctgttgcactgatgaccgtgc

SEQ ID NO: 330819 - DNA, 25 bp, Mus musculus
catgctgttgcagtgatgaccgtgc

SEQ ID NO: 330820 - DNA, 25 bp, Mus musculus
catgctgttggcattgttgtaaaca

SEQ ID NO: 330821 - DNA, 25 bp, Mus musculus
catgctgttggctttgttgtaaaca

SEQ ID NO: 330822 - DNA, 25 bp, Mus musculus
catgctgttgtcatccataagctga

SEQ ID NO: 330823 - DNA, 25 bp, Mus musculus
catgctgttgtcttccataagctga

SEQ ID NO: 330824 - DNA, 25 bp, Mus musculus
catgcttagctaattatactccagg

SEQ ID NO: 330825 - DNA, 25 bp, Mus musculus
catgcttagctatttatactccagg

SEQ ID NO: 330826 - DNA, 25 bp, Mus musculus
catgcttataagacaagtcctttag

SEQ ID NO: 330827 - DNA, 25 bp, Mus musculus
catgcttataagtcaagtcctttag

SEQ ID NO: 330828 - DNA, 25 bp, Mus musculus
catgcttattttcttgtatctttga

SEQ ID NO: 330829 - DNA, 25 bp, Mus musculus
catgcttattttgttgtatctttga

SEQ ID NO: 330830 - DNA, 25 bp, Mus musculus
catgcttcactaatctggcctatga

SEQ ID NO: 330831 - DNA, 25 bp, Mus musculus
catgcttcactattctggcctatga

SEQ ID NO: 330832 - DNA, 25 bp, Mus musculus
catgcttccactaagcgtttgtgat

SEQ ID NO: 330833 - DNA, 25 bp, Mus musculus
catgcttccacttagcgtttgtgat

SEQ ID NO: 330834 - DNA, 25 bp, Mus musculus
catgcttccctaatttttcgcaaag

SEQ ID NO: 330835 - DNA, 25 bp, Mus musculus
catgcttccctattttttcgcaaag

SEQ ID NO: 330836 - DNA, 25 bp, Mus musculus
catgcttcctatatcttagtgccag

SEQ ID NO: 330837 - DNA, 25 bp, Mus musculus
catgcttcctatttcttagtgccag

SEQ ID NO: 330838 - DNA, 25 bp, Mus musculus
catgcttcgtggcttgtcctaaatt

SEQ ID NO: 330839 - DNA, 25 bp, Mus musculus
catgcttcgtgggttgtcctaaatt

SEQ ID NO: 330840 - DNA, 25 bp, Mus musculus
catgcttctcctagttctaacattt

SEQ ID NO: 330841 - DNA, 25 bp, Mus musculus
catgcttctccttgttctaacattt

SEQ ID NO: 330842 - DNA, 25 bp, Mus musculus
catgcttctggcctggacacacaag

SEQ ID NO: 330843 - DNA, 25 bp, Mus musculus
catgcttctggcgtggacacacaag

SEQ ID NO: 330844 - DNA, 25 bp, Mus musculus
catgcttgacacccatggctgaaat

SEQ ID NO: 330845 - DNA, 25 bp, Mus musculus
catgcttgacacgcatggctgaaat

SEQ ID NO: 330846 - DNA, 25 bp, Mus musculus
catgcttgagtcagtctctctctct

SEQ ID NO: 330847 - DNA, 25 bp, Mus musculus
catgcttgagtctgtctctctctct

SEQ ID NO: 330848 - DNA, 25 bp, Mus musculus
catgcttgcaaaattaataacttag

SEQ ID NO: 330849 - DNA, 25 bp, Mus musculus
catgcttgcaaatttaataacttag

SEQ ID NO: 330850 - DNA, 25 bp, Mus musculus
catgcttgcaagagagagtttcaga

SEQ ID NO: 330851 - DNA, 25 bp, Mus musculus
catgcttgcaagtgagagtttcaga

SEQ ID NO: 330852 - DNA, 25 bp, Mus musculus
catgcttgcacccagaaattttcca

SEQ ID NO: 330853 - DNA, 25 bp, Mus musculus
catgcttgcaccgagaaattttcca

SEQ ID NO: 330854 - DNA, 25 bp, Mus musculus
catgcttgcatgcacttgggttctt

SEQ ID NO: 330855 - DNA, 25 bp, Mus musculus
catgcttgcatggacttgggttctt

SEQ ID NO: 330856 - DNA, 25 bp, Mus musculus
catgcttgcattatagttgtacaga

SEQ ID NO: 330857 - DNA, 25 bp, Mus musculus
catgcttgcattttagttgtacaga

SEQ ID NO: 330858 - DNA, 25 bp, Mus musculus
catgcttgccatacagacggccata

SEQ ID NO: 330859 - DNA, 25 bp, Mus musculus
catgcttgccattcagacggccata

SEQ ID NO: 330860 - DNA, 25 bp, Mus musculus
catgcttgcctaaaaaatgctgcag

SEQ ID NO: 330861 - DNA, 25 bp, Mus musculus
catgcttgcctataaaatgctgcag

SEQ ID NO: 330862 - DNA, 25 bp, Mus musculus
catgcttgctgtatgacctggaaac

SEQ ID NO: 330863 - DNA, 25 bp, Mus musculus
catgcttgctgtttgacctggaaac

SEQ ID NO: 330864 - DNA, 25 bp, Mus musculus
catgcttggcctatgttgctttaag

SEQ ID NO: 330865 - DNA, 25 bp, Mus musculus
catgcttggcctttgttgctttaag

SEQ ID NO: 330866 - DNA, 25 bp, Mus musculus
catgcttggtcaacccaattattta

SEQ ID NO: 330867 - DNA, 25 bp, Mus musculus
catgcttggtcatcccaattattta

SEQ ID NO: 330868 - DNA, 25 bp, Mus musculus
catgcttggtggagatctttttatc

SEQ ID NO: 330869 - DNA, 25 bp, Mus musculus
catgcttggtggtgatctttttatc

SEQ ID NO: 330870 - DNA, 25 bp, Mus musculus
catgcttgtcttacgattcggaatg

SEQ ID NO: 330871 - DNA, 25 bp, Mus musculus
catgcttgtcttcgataagtgtcaa

SEQ ID NO: 330872 - DNA, 25 bp, Mus musculus
catgcttgtcttggataagtgtcaa

SEQ ID NO: 330873 - DNA, 25 bp, Mus musculus
catgcttgtctttcgattcggaatg

SEQ ID NO: 330874 - DNA, 25 bp, Mus musculus
catgcttgtgagctgcagccactta

SEQ ID NO: 330875 - DNA, 25 bp, Mus musculus
catgcttgtgaggtgcagccactta

SEQ ID NO: 330876 - DNA, 25 bp, Mus musculus
catgctttaactatttaccatagtc

SEQ ID NO: 330877 - DNA, 25 bp, Mus musculus
catgctttaactttttaccatagtc

SEQ ID NO: 330878 - DNA, 25 bp, Mus musculus
catgctttagtaagtactaggaggc

SEQ ID NO: 330879 - DNA, 25 bp, Mus musculus
catgctttagtatgtactaggaggc

SEQ ID NO: 330880 - DNA, 25 bp, Mus musculus
catgctttatgcctacctcttgtag

SEQ ID NO: 330881 - DNA, 25 bp, Mus musculus
catgctttatgcgtacctcttgtag

SEQ ID NO: 330882 - DNA, 25 bp, Mus musculus
catgctttcaatctgtcaacacaaa

SEQ ID NO: 330883 - DNA, 25 bp, Mus musculus
catgctttcaatgtgtcaacacaaa

SEQ ID NO: 330884 - DNA, 25 bp, Mus musculus
catgctttcaggcagaccctagtgc

SEQ ID NO: 330885 - DNA, 25 bp, Mus musculus
catgctttcagggagaccctagtgc

SEQ ID NO: 330886 - DNA, 25 bp, Mus musculus
catgctttcatacagggtgcttgta

SEQ ID NO: 330887 - DNA, 25 bp, Mus musculus
catgctttcatagagggtgcttgta

SEQ ID NO: 330888 - DNA, 25 bp, Mus musculus
catgctttcctaattgacagtctga

SEQ ID NO: 330889 - DNA, 25 bp, Mus musculus
catgctttcctatttgacagtctga

SEQ ID NO: 330890 - DNA, 25 bp, Mus musculus
catgctttcctcctgctaaattaag

SEQ ID NO: 330891 - DNA, 25 bp, Mus musculus
catgctttcctcgtgctaaattaag

SEQ ID NO: 330892 - DNA, 25 bp, Mus musculus
catgctttctccaccagtttaaatt

SEQ ID NO: 330893 - DNA, 25 bp, Mus musculus
catgctttctcctccagtttaaatt

SEQ ID NO: 330894 - DNA, 25 bp, Mus musculus
catgctttctctctcacattctcat

SEQ ID NO: 330895 - DNA, 25 bp, Mus musculus
catgctttctctgtcacattctcat

SEQ ID NO: 330896 - DNA, 25 bp, Mus musculus
catgctttgagcaatagctaccata

SEQ ID NO: 330897 - DNA, 25 bp, Mus musculus
catgctttgagctatagctaccata

SEQ ID NO: 330898 - DNA, 25 bp, Mus musculus
catgctttgctgctactgaaatgag

SEQ ID NO: 330899 - DNA, 25 bp, Mus musculus
catgctttgctggtactgaaatgag

SEQ ID NO: 330900 - DNA, 25 bp, Mus musculus
catgctttgtctagacataatcatc

SEQ ID NO: 330901 - DNA, 25 bp, Mus musculus
catgctttgtcttgacataatcatc

SEQ ID NO: 330902 - DNA, 25 bp, Mus musculus
catgctttgtgtcttggcatcctaa

SEQ ID NO: 330903 - DNA, 25 bp, Mus musculus
catgctttgtgtgttggcatcctaa

SEQ ID NO: 330904 - DNA, 25 bp, Mus musculus
catgcttttacaaacattcttgtgt

SEQ ID NO: 330905 - DNA, 25 bp, Mus musculus
catgcttttacatacattcttgtgt

SEQ ID NO: 330906 - DNA, 25 bp, Mus musculus
catgcttttctcactgccaaaacat

SEQ ID NO: 330907 - DNA, 25 bp, Mus musculus
catgcttttctctctgccaaaacat

SEQ ID NO: 330908 - DNA, 25 bp, Mus musculus
catgcttttcttagttggtggtttt

SEQ ID NO: 330909 - DNA, 25 bp, Mus musculus
catgcttttcttccacgtgtgagga

SEQ ID NO: 330910 - DNA, 25 bp, Mus musculus
catgcttttcttgcacgtgtgagga

SEQ ID NO: 330911 - DNA, 25 bp, Mus musculus
catgcttttctttgttggtggtttt

SEQ ID NO: 330912 - DNA, 25 bp, Mus musculus
catgcttttgcaatgtagggtcttc

SEQ ID NO: 330913 - DNA, 25 bp, Mus musculus
catgcttttgcattgtagggtcttc

SEQ ID NO: 330914 - DNA, 25 bp, Mus musculus
catgcttttgctcggctagtacctt

SEQ ID NO: 330915 - DNA, 25 bp, Mus musculus
catgcttttgctgggctagtacctt

SEQ ID NO: 330916 - DNA, 25 bp, Mus musculus
catggaaaagccactggtgaccaga

SEQ ID NO: 330917 - DNA, 25 bp, Mus musculus
catggaaaagcctctggtgaccaga

SEQ ID NO: 330918 - DNA, 25 bp, Mus musculus
catggaaacagcacaggtaatcact

SEQ ID NO: 330919 - DNA, 25 bp, Mus musculus
catggaaacagctcaggtaatcact

SEQ ID NO: 330920 - DNA, 25 bp, Mus musculus
catggaaaccccatgtacctactga

SEQ ID NO: 330921 - DNA, 25 bp, Mus musculus
catggaaaccccttgtacctactga

SEQ ID NO: 330922 - DNA, 25 bp, Mus musculus
catggaaattctccattgatttctt

SEQ ID NO: 330923 - DNA, 25 bp, Mus musculus
catggaaattctgcattgatttctt

SEQ ID NO: 330924 - DNA, 25 bp, Mus musculus
catggaacagtcagtcctgtgccgt

SEQ ID NO: 330925 - DNA, 25 bp, Mus musculus
catggaacagtctgtcctgtgccgt

SEQ ID NO: 330926 - DNA, 25 bp, Mus musculus
catggaacagttacaggacttggtg

SEQ ID NO: 330927 - DNA, 25 bp, Mus musculus
catggaacagtttcaggacttggtg

SEQ ID NO: 330928 - DNA, 25 bp, Mus musculus
catggaacccagagagctctcaata

SEQ ID NO: 330929 - DNA, 25 bp, Mus musculus
catggaacccagtgagctctcaata

SEQ ID NO: 330930 - DNA, 25 bp, Mus musculus
catggaacggagcaaggtctgtatc

SEQ ID NO: 330931 - DNA, 25 bp, Mus musculus
catggaacggaggaaggtctgtatc

SEQ ID NO: 330932 - DNA, 25 bp, Mus musculus
catggaactgagctgctgcttgctt

SEQ ID NO: 330933 - DNA, 25 bp, Mus musculus
catggaactgaggtgctgcttgctt

SEQ ID NO: 330934 - DNA, 25 bp, Mus musculus
catggaagcgcacatggcccagtga

SEQ ID NO: 330935 - DNA, 25 bp, Mus musculus
catggaagcgcagatggcccagtga

SEQ ID NO: 330936 - DNA, 25 bp, Mus musculus
catggaaggcgtatgtcagcacgtc

SEQ ID NO: 330937 - DNA, 25 bp, Mus musculus
catggaaggcgtttgtcagcacgtc

SEQ ID NO: 330938 - DNA, 25 bp, Mus musculus
catggaagttgtccaccagcaggga

SEQ ID NO: 330939 - DNA, 25 bp, Mus musculus
catggaagttgtgcaccagcaggga

SEQ ID NO: 330940 - DNA, 25 bp, Mus musculus
catggaataatactgcttgccctga

SEQ ID NO: 330941 - DNA, 25 bp, Mus musculus
catggaataatagtgcttgccctga

SEQ ID NO: 330942 - DNA, 25 bp, Mus musculus
catggaatacctacatcagttgatt

SEQ ID NO: 330943 - DNA, 25 bp, Mus musculus
catggaataccttcatcagttgatt

SEQ ID NO: 330944 - DNA, 25 bp, Mus musculus
catggaatatgcacgactctgccta

SEQ ID NO: 330945 - DNA, 25 bp, Mus musculus
catggaatatgctcgactctgccta

SEQ ID NO: 330946 - DNA, 25 bp, Mus musculus
catggaatcattaaccttggcagaa

SEQ ID NO: 330947 - DNA, 25 bp, Mus musculus
catggaatcatttaccttggcagaa

SEQ ID NO: 330948 - DNA, 25 bp, Mus musculus
catggaatctggaacgttcatcact

SEQ ID NO: 330949 - DNA, 25 bp, Mus musculus
catggaatctggtacgttcatcact

SEQ ID NO: 330950 - DNA, 25 bp, Mus musculus
catggaatgcctcggaatgttacat

SEQ ID NO: 330951 - DNA, 25 bp, Mus musculus
catggaatgcctgggaatgttacat

SEQ ID NO: 330952 - DNA, 25 bp, Mus musculus
catggaatgtcaaatcgcctatgaa

SEQ ID NO: 330953 - DNA, 25 bp, Mus musculus
catggaatgtcatatcgcctatgaa

SEQ ID NO: 330954 - DNA, 25 bp, Mus musculus
catggaatgtccaataaacttgtta

SEQ ID NO: 330955 - DNA, 25 bp, Mus musculus
catggaatgtcctataaacttgtta

SEQ ID NO: 330956 - DNA, 25 bp, Mus musculus
catggaatgtttatcagccgcttct

SEQ ID NO: 330957 - DNA, 25 bp, Mus musculus
catggaatgtttttcagccgcttct

SEQ ID NO: 330958 - DNA, 25 bp, Mus musculus
catggacaaacacaacccactgagg

SEQ ID NO: 330959 - DNA, 25 bp, Mus musculus
catggacaaacagaacccactgagg

SEQ ID NO: 330960 - DNA, 25 bp, Mus musculus
catggacaatctcctgctgactgag

SEQ ID NO: 330961 - DNA, 25 bp, Mus musculus
catggacaatctgctgctgactgag

SEQ ID NO: 330962 - DNA, 25 bp, Mus musculus
catggacacttgaggaccagagttt

SEQ ID NO: 330963 - DNA, 25 bp, Mus musculus
catggacacttgtggaccagagttt

SEQ ID NO: 330964 - DNA, 25 bp, Mus musculus
catggacagtctcgcctggaggtca

SEQ ID NO: 330965 - DNA, 25 bp, Mus musculus
catggacagtctggcctggaggtca

SEQ ID NO: 330966 - DNA, 25 bp, Mus musculus
catggacagttcacttaagcaggag

SEQ ID NO: 330967 - DNA, 25 bp, Mus musculus
catggacagttctcttaagcaggag

SEQ ID NO: 330968 - DNA, 25 bp, Mus musculus
catggacatggtcaggttaacgtca

SEQ ID NO: 330969 - DNA, 25 bp, Mus musculus
catggacatggtgaggttaacgtca

SEQ ID NO: 330970 - DNA, 25 bp, Mus musculus
catggacatgttcctgagatgctgg

SEQ ID NO: 330971 - DNA, 25 bp, Mus musculus
catggacatgttgctgagatgctgg

SEQ ID NO: 330972 - DNA, 25 bp, Mus musculus
catggacattccctggcagcaaatg

SEQ ID NO: 330973 - DNA, 25 bp, Mus musculus
catggacattccgtggcagcaaatg

SEQ ID NO: 330974 - DNA, 25 bp, Mus musculus
catggaccaaccattggagctggcc

SEQ ID NO: 330975 - DNA, 25 bp, Mus musculus
catggaccaacctttggagctggcc

SEQ ID NO: 330976 - DNA, 25 bp, Mus musculus
catggaccaaggagatgctcgcttt

SEQ ID NO: 330977 - DNA, 25 bp, Mus musculus
catggaccaaggtgatgctcgcttt

SEQ ID NO: 330978 - DNA, 25 bp, Mus musculus
catggaccagagaaaccccgtgaag

SEQ ID NO: 330979 - DNA, 25 bp, Mus musculus
catggaccagagtaaccccgtgaag

SEQ ID NO: 330980 - DNA, 25 bp, Mus musculus
catggaccatctctgttcactgaga

SEQ ID NO: 330981 - DNA, 25 bp, Mus musculus
catggaccatctgtgttcactgaga

SEQ ID NO: 330982 - DNA, 25 bp, Mus musculus
catggacccagccacgggaaggaat

SEQ ID NO: 330983 - DNA, 25 bp, Mus musculus
catggacccagcgacgggaaggaat

SEQ ID NO: 330984 - DNA, 25 bp, Mus musculus
catggaccccagagacatgatgcgg

SEQ ID NO: 330985 - DNA, 25 bp, Mus musculus
catggaccccagtgacatgatgcgg

SEQ ID NO: 330986 - DNA, 25 bp, Mus musculus
catggaccccttagtagtcacagag

SEQ ID NO: 330987 - DNA, 25 bp, Mus musculus
catggacccctttgtagtcacagag

SEQ ID NO: 330988 - DNA, 25 bp, Mus musculus
catggaccgcatccctttgctgatg

SEQ ID NO: 330989 - DNA, 25 bp, Mus musculus
catggaccgcatgcctttgctgatg

SEQ ID NO: 330990 - DNA, 25 bp, Mus musculus
catggaccgtgaccgccggcagaaa

SEQ ID NO: 330991 - DNA, 25 bp, Mus musculus
catggaccgtgagcgccggcagaaa

SEQ ID NO: 330992 - DNA, 25 bp, Mus musculus
catggacctgagatctggccttgag

SEQ ID NO: 330993 - DNA, 25 bp, Mus musculus
catggacctgagttctggccttgag

SEQ ID NO: 330994 - DNA, 25 bp, Mus musculus
catggacctggtctgcagctgcagt

SEQ ID NO: 330995 - DNA, 25 bp, Mus musculus
catggacctggtgtgcagctgcagt

SEQ ID NO: 330996 - DNA, 25 bp, Mus musculus
catggacctttaacctatccaacca

SEQ ID NO: 330997 - DNA, 25 bp, Mus musculus
catggacctttatcctatccaacca

SEQ ID NO: 330998 - DNA, 25 bp, Mus musculus
catggacgaagcagatgtatcggaa

SEQ ID NO: 330999 - DNA, 25 bp, Mus musculus
catggacgaagctgatgtatcggaa

SEQ ID NO: 331000 - DNA, 25 bp, Mus musculus
catggacgacgtatatgcgcctggg

SEQ ID NO: 331001 - DNA, 25 bp, Mus musculus
catggacgacgtttatgcgcctggg

SEQ ID NO: 331002 - DNA, 25 bp, Mus musculus
catggacgcgttacctgtgatcagt

SEQ ID NO: 331003 - DNA, 25 bp, Mus musculus
catggacgcgtttcctgtgatcagt

SEQ ID NO: 331004 - DNA, 25 bp, Mus musculus
catggacgctaaaatttggttccct

SEQ ID NO: 331005 - DNA, 25 bp, Mus musculus
catggacgctaatatttggttccct

SEQ ID NO: 331006 - DNA, 25 bp, Mus musculus
catggacggcgcagagggttcaacc

SEQ ID NO: 331007 - DNA, 25 bp, Mus musculus
catggacggcgctgagggttcaacc

SEQ ID NO: 331008 - DNA, 25 bp, Mus musculus
catggacgtcctcagttaggcaaaa

SEQ ID NO: 331009 - DNA, 25 bp, Mus musculus
catggacgtcctgagttaggcaaaa

SEQ ID NO: 331010 - DNA, 25 bp, Mus musculus
catggactaccgcatcaagctttat

SEQ ID NO: 331011 - DNA, 25 bp, Mus musculus
catggactaccggatcaagctttat

SEQ ID NO: 331012 - DNA, 25 bp, Mus musculus
catggactatatatacccactgacc

SEQ ID NO: 331013 - DNA, 25 bp, Mus musculus
catggactatatttacccactgacc

SEQ ID NO: 331014 - DNA, 25 bp, Mus musculus
catggactatccagaaactacccca

SEQ ID NO: 331015 - DNA, 25 bp, Mus musculus
catggactatcctgaaactacccca

SEQ ID NO: 331016 - DNA, 25 bp, Mus musculus
catggactccatctgcatcagtatg

SEQ ID NO: 331017 - DNA, 25 bp, Mus musculus
catggactccatgtgcatcagtatg

SEQ ID NO: 331018 - DNA, 25 bp, Mus musculus
catggactgaatctgcttgttgatc

SEQ ID NO: 331019 - DNA, 25 bp, Mus musculus
catggactgaatgtgcttgttgatc

SEQ ID NO: 331020 - DNA, 25 bp, Mus musculus
catggactggagacctggcagcttt

SEQ ID NO: 331021 - DNA, 25 bp, Mus musculus
catggactggagtcctggcagcttt

SEQ ID NO: 331022 - DNA, 25 bp, Mus musculus
catggactgggaattgcgcaggatc

SEQ ID NO: 331023 - DNA, 25 bp, Mus musculus
catggactgggatttgcgcaggatc

SEQ ID NO: 331024 - DNA, 25 bp, Mus musculus
catggactgtgtaggctgcttcaag

SEQ ID NO: 331025 - DNA, 25 bp, Mus musculus
catggactgtgtagggtgcgataaa

SEQ ID NO: 331026 - DNA, 25 bp, Mus musculus
catggactgtgttggctgcttcaag

SEQ ID NO: 331027 - DNA, 25 bp, Mus musculus
catggactgtgttgggtgcgataaa

SEQ ID NO: 331028 - DNA, 25 bp, Mus musculus
catggacttggtatctggagggttt

SEQ ID NO: 331029 - DNA, 25 bp, Mus musculus
catggacttggtttctggagggttt

SEQ ID NO: 331030 - DNA, 25 bp, Mus musculus
catggacttgttccaggatgttctt

SEQ ID NO: 331031 - DNA, 25 bp, Mus musculus
catggacttgttgcaggatgttctt

SEQ ID NO: 331032 - DNA, 25 bp, Mus musculus
catggactttggagatgtgatctca

SEQ ID NO: 331033 - DNA, 25 bp, Mus musculus
catggactttggtgatgtgatctca

SEQ ID NO: 331034 - DNA, 25 bp, Mus musculus
catggagaaagacaccgtcgggata

SEQ ID NO: 331035 - DNA, 25 bp, Mus musculus
catggagaaagagaccgtcgggata

SEQ ID NO: 331036 - DNA, 25 bp, Mus musculus
catggagaaagcagacttggctggt

SEQ ID NO: 331037 - DNA, 25 bp, Mus musculus
catggagaaagctgacttggctggt

SEQ ID NO: 331038 - DNA, 25 bp, Mus musculus
catggagaacatcggacctgagaat

SEQ ID NO: 331039 - DNA, 25 bp, Mus musculus
catggagaacatgggacctgagaat

SEQ ID NO: 331040 - DNA, 25 bp, Mus musculus
catggagactggatatccttcctgc

SEQ ID NO: 331041 - DNA, 25 bp, Mus musculus
catggagactggttatccttcctgc

SEQ ID NO: 331042 - DNA, 25 bp, Mus musculus
catggagacttgaactcacgcacac

SEQ ID NO: 331043 - DNA, 25 bp, Mus musculus
catggagacttgatcactaccttat

SEQ ID NO: 331044 - DNA, 25 bp, Mus musculus
catggagacttgctcttcttctgcc

SEQ ID NO: 331045 - DNA, 25 bp, Mus musculus
catggagacttggtcttcttctgcc

SEQ ID NO: 331046 - DNA, 25 bp, Mus musculus
catggagacttgtactcacgcacac

SEQ ID NO: 331047 - DNA, 25 bp, Mus musculus
catggagacttgttcactaccttat

SEQ ID NO: 331048 - DNA, 25 bp, Mus musculus
catggagaggcccttcccaaagtat

SEQ ID NO: 331049 - DNA, 25 bp, Mus musculus
catggagaggccgttcccaaagtat

SEQ ID NO: 331050 - DNA, 25 bp, Mus musculus
catggagatagtctggcctctgcac

SEQ ID NO: 331051 - DNA, 25 bp, Mus musculus
catggagatagtgtggcctctgcac

SEQ ID NO: 331052 - DNA, 25 bp, Mus musculus
catggagatcccaggaactaaggtt

SEQ ID NO: 331053 - DNA, 25 bp, Mus musculus
catggagatccctggaactaaggtt

SEQ ID NO: 331054 - DNA, 25 bp, Mus musculus
catggagatcctagaccagaagtct

SEQ ID NO: 331055 - DNA, 25 bp, Mus musculus
catggagatccttgaccagaagtct

SEQ ID NO: 331056 - DNA, 25 bp, Mus musculus
catggagatggtactttgttgacgg

SEQ ID NO: 331057 - DNA, 25 bp, Mus musculus
catggagatggttctttgttgacgg

SEQ ID NO: 331058 - DNA, 25 bp, Mus musculus
catggagatttacccgcactgtgaa

SEQ ID NO: 331059 - DNA, 25 bp, Mus musculus
catggagatttagccgcactgtgaa

SEQ ID NO: 331060 - DNA, 25 bp, Mus musculus
catggagcagacagctgctgactcc

SEQ ID NO: 331061 - DNA, 25 bp, Mus musculus
catggagcagactgctgctgactcc

SEQ ID NO: 331062 - DNA, 25 bp, Mus musculus
catggagccagcattccagcctttt

SEQ ID NO: 331063 - DNA, 25 bp, Mus musculus
catggagccagctttccagcctttt

SEQ ID NO: 331064 - DNA, 25 bp, Mus musculus
catggagccctgctaaaggtctgaa

SEQ ID NO: 331065 - DNA, 25 bp, Mus musculus
catggagccctggtaaaggtctgaa

SEQ ID NO: 331066 - DNA, 25 bp, Mus musculus
catggagctccaccgagtggactca

SEQ ID NO: 331067 - DNA, 25 bp, Mus musculus
catggagctccagcgagtggactca

SEQ ID NO: 331068 - DNA, 25 bp, Mus musculus
catggagctcttcttgattgtgaat

SEQ ID NO: 331069 - DNA, 25 bp, Mus musculus
catggagctcttgttgattgtgaat

SEQ ID NO: 331070 - DNA, 25 bp, Mus musculus
catggagctgctagagacctggcac

SEQ ID NO: 331071 - DNA, 25 bp, Mus musculus
catggagctgcttgagacctggcac

SEQ ID NO: 331072 - DNA, 25 bp, Mus musculus
catggagctggacgctcttgctgtt

SEQ ID NO: 331073 - DNA, 25 bp, Mus musculus
catggagctggaggctcttgctgtt

SEQ ID NO: 331074 - DNA, 25 bp, Mus musculus
catggagctgttaattttcacctgg

SEQ ID NO: 331075 - DNA, 25 bp, Mus musculus
catggagctgtttattttcacctgg

SEQ ID NO: 331076 - DNA, 25 bp, Mus musculus
catggaggaggcctacatcaacttc

SEQ ID NO: 331077 - DNA, 25 bp, Mus musculus
catggaggaggcgtacatcaacttc

SEQ ID NO: 331078 - DNA, 25 bp, Mus musculus
catggaggcagtatttgaggttata

SEQ ID NO: 331079 - DNA, 25 bp, Mus musculus
catggaggcagtttttgaggttata

SEQ ID NO: 331080 - DNA, 25 bp, Mus musculus
catggaggcctgagtaagtgagcaa

SEQ ID NO: 331081 - DNA, 25 bp, Mus musculus
catggaggcctgtgtaagtgagcaa

SEQ ID NO: 331082 - DNA, 25 bp, Mus musculus
catggagggacaagggctttccaga

SEQ ID NO: 331083 - DNA, 25 bp, Mus musculus
catggagggacatgggctttccaga

SEQ ID NO: 331084 - DNA, 25 bp, Mus musculus
catggagtaactattgtgagcctaa

SEQ ID NO: 331085 - DNA, 25 bp, Mus musculus
catggagtaacttttgtgagcctaa

SEQ ID NO: 331086 - DNA, 25 bp, Mus musculus
catggagtacacatataggcacatt

SEQ ID NO: 331087 - DNA, 25 bp, Mus musculus
catggagtacacttataggcacatt

SEQ ID NO: 331088 - DNA, 25 bp, Mus musculus
catggagtcactattcctggttatc

SEQ ID NO: 331089 - DNA, 25 bp, Mus musculus
catggagtcacttttcctggttatc

SEQ ID NO: 331090 - DNA, 25 bp, Mus musculus
catggagtcatcatctcactgagct

SEQ ID NO: 331091 - DNA, 25 bp, Mus musculus
catggagtcatcttctcactgagct

SEQ ID NO: 331092 - DNA, 25 bp, Mus musculus
catggagtccaaaatgttaccttgt

SEQ ID NO: 331093 - DNA, 25 bp, Mus musculus
catggagtccaatatgttaccttgt

SEQ ID NO: 331094 - DNA, 25 bp, Mus musculus
catggagtccatcgagcgcttcgat

SEQ ID NO: 331095 - DNA, 25 bp, Mus musculus
catggagtccatggagcgcttcgat

SEQ ID NO: 331096 - DNA, 25 bp, Mus musculus
catggagtccttaggagtttgggat

SEQ ID NO: 331097 - DNA, 25 bp, Mus musculus
catggagtcctttggagtttgggat

SEQ ID NO: 331098 - DNA, 25 bp, Mus musculus
catggagttctaaggcttcagcact

SEQ ID NO: 331099 - DNA, 25 bp, Mus musculus
catggagttctatggcttcagcact

SEQ ID NO: 331100 - DNA, 25 bp, Mus musculus
catggagtttatctgttaacgttga

SEQ ID NO: 331101 - DNA, 25 bp, Mus musculus
catggagtttatgtgttaacgttga

SEQ ID NO: 331102 - DNA, 25 bp, Mus musculus
catggagttttcatgccagtgccac

SEQ ID NO: 331103 - DNA, 25 bp, Mus musculus
catggagttttcttgccagtgccac

SEQ ID NO: 331104 - DNA, 25 bp, Mus musculus
catggataatccatgaggctcattg

SEQ ID NO: 331105 - DNA, 25 bp, Mus musculus
catggataatccttgaggctcattg

SEQ ID NO: 331106 - DNA, 25 bp, Mus musculus
catggatacactatgtgtgctttaa

SEQ ID NO: 331107 - DNA, 25 bp, Mus musculus
catggatacactttgtgtgctttaa

SEQ ID NO: 331108 - DNA, 25 bp, Mus musculus
catggatacagtcttgcaacaggaa

SEQ ID NO: 331109 - DNA, 25 bp, Mus musculus
catggatacagtgttgcaacaggaa

SEQ ID NO: 331110 - DNA, 25 bp, Mus musculus
catggatagatcagtgtgtctcatt

SEQ ID NO: 331111 - DNA, 25 bp, Mus musculus
catggatagatctgtgtgtctcatt

SEQ ID NO: 331112 - DNA, 25 bp, Mus musculus
catggataggttatccacttgtgaa

SEQ ID NO: 331113 - DNA, 25 bp, Mus musculus
catggataggttttccacttgtgaa

SEQ ID NO: 331114 - DNA, 25 bp, Mus musculus
catggatagttacggctctggagaa

SEQ ID NO: 331115 - DNA, 25 bp, Mus musculus
catggatagttagggctctggagaa

SEQ ID NO: 331116 - DNA, 25 bp, Mus musculus
catggatatatcagtcccctggtag

SEQ ID NO: 331117 - DNA, 25 bp, Mus musculus
catggatatatctgtcccctggtag

SEQ ID NO: 331118 - DNA, 25 bp, Mus musculus
catggatatgcacctttactcttta

SEQ ID NO: 331119 - DNA, 25 bp, Mus musculus
catggatatgcagctttactcttta

SEQ ID NO: 331120 - DNA, 25 bp, Mus musculus
catggatattttatcattgggtcat

SEQ ID NO: 331121 - DNA, 25 bp, Mus musculus
catggatattttttcattgggtcat

SEQ ID NO: 331122 - DNA, 25 bp, Mus musculus
catggatcaaaaattcccagcattt

SEQ ID NO: 331123 - DNA, 25 bp, Mus musculus
catggatcaaaatttcccagcattt

SEQ ID NO: 331124 - DNA, 25 bp, Mus musculus
catggatcagggaacgaggcccaga

SEQ ID NO: 331125 - DNA, 25 bp, Mus musculus
catggatcagggtacgaggcccaga

SEQ ID NO: 331126 - DNA, 25 bp, Mus musculus
catggatcatggctctgacattcag

SEQ ID NO: 331127 - DNA, 25 bp, Mus musculus
catggatcatgggtctgacattcag

SEQ ID NO: 331128 - DNA, 25 bp, Mus musculus
catggatccctacccttagaacaga

SEQ ID NO: 331129 - DNA, 25 bp, Mus musculus
catggatccctagccttagaacaga

SEQ ID NO: 331130 - DNA, 25 bp, Mus musculus
catggatcgttgcttgccttgggat

SEQ ID NO: 331131 - DNA, 25 bp, Mus musculus
catggatcgttggttgccttgggat

SEQ ID NO: 331132 - DNA, 25 bp, Mus musculus
catggatcttaactttaataaccca

SEQ ID NO: 331133 - DNA, 25 bp, Mus musculus
catggatcttaagtttaataaccca

SEQ ID NO: 331134 - DNA, 25 bp, Mus musculus
catggatgacttaggatgactgtgt

SEQ ID NO: 331135 - DNA, 25 bp, Mus musculus
catggatgactttggatgactgtgt

SEQ ID NO: 331136 - DNA, 25 bp, Mus musculus
catggatgatggctcgttggttctt

SEQ ID NO: 331137 - DNA, 25 bp, Mus musculus
catggatgatgggtcgttggttctt

SEQ ID NO: 331138 - DNA, 25 bp, Mus musculus
catggatgccaaccagcctcagcat

SEQ ID NO: 331139 - DNA, 25 bp, Mus musculus
catggatgccaagcagcctcagcat

SEQ ID NO: 331140 - DNA, 25 bp, Mus musculus
catggatgccataaccttctgattc

SEQ ID NO: 331141 - DNA, 25 bp, Mus musculus
catggatgccattaccttctgattc

SEQ ID NO: 331142 - DNA, 25 bp, Mus musculus
catggatgccctcttaacctgaaac

SEQ ID NO: 331143 - DNA, 25 bp, Mus musculus
catggatgccctgttaacctgaaac

SEQ ID NO: 331144 - DNA, 25 bp, Mus musculus
catggatggctacttctttgtggct

SEQ ID NO: 331145 - DNA, 25 bp, Mus musculus
catggatggctagttctttgtggct

SEQ ID NO: 331146 - DNA, 25 bp, Mus musculus
catggatggttaccctggactgcac

SEQ ID NO: 331147 - DNA, 25 bp, Mus musculus
catggatggttagcctggactgcac

SEQ ID NO: 331148 - DNA, 25 bp, Mus musculus
catggatgtcttctgtttgtggtaa

SEQ ID NO: 331149 - DNA, 25 bp, Mus musculus
catggatgtcttgtgtttgtggtaa

SEQ ID NO: 331150 - DNA, 25 bp, Mus musculus
catggattgtgacctgtgtattatt

SEQ ID NO: 331151 - DNA, 25 bp, Mus musculus
catggattgtgagctgtgtattatt

SEQ ID NO: 331152 - DNA, 25 bp, Mus musculus
catggattgttcatttgggcataat

SEQ ID NO: 331153 - DNA, 25 bp, Mus musculus
catggattgttcttttgggcataat

SEQ ID NO: 331154 - DNA, 25 bp, Mus musculus
catggatttcatagtctcccagaga

SEQ ID NO: 331155 - DNA, 25 bp, Mus musculus
catggatttcattgtctcccagaga

SEQ ID NO: 331156 - DNA, 25 bp, Mus musculus
catggcaaattcatctggcgtgtga

SEQ ID NO: 331157 - DNA, 25 bp, Mus musculus
catggcaaattcttctggcgtgtga

SEQ ID NO: 331158 - DNA, 25 bp, Mus musculus
catggcaacctccaacacgtgtttt

SEQ ID NO: 331159 - DNA, 25 bp, Mus musculus
catggcaacctcgaacacgtgtttt

SEQ ID NO: 331160 - DNA, 25 bp, Mus musculus
catggcaatatgaatttcccttgaa

SEQ ID NO: 331161 - DNA, 25 bp, Mus musculus
catggcaatatgtatttcccttgaa

SEQ ID NO: 331162 - DNA, 25 bp, Mus musculus
catggcacagcgcacttacttggaa

SEQ ID NO: 331163 - DNA, 25 bp, Mus musculus
catggcacagcggacttacttggaa

SEQ ID NO: 331164 - DNA, 25 bp, Mus musculus
catggcacccataagcgtgtatgct

SEQ ID NO: 331165 - DNA, 25 bp, Mus musculus
catggcacccattagcgtgtatgct

SEQ ID NO: 331166 - DNA, 25 bp, Mus musculus
catggcactacacggctgtgatgaa

SEQ ID NO: 331167 - DNA, 25 bp, Mus musculus
catggcactacagggctgtgatgaa

SEQ ID NO: 331168 - DNA, 25 bp, Mus musculus
catggcactttgacacttggtagca

SEQ ID NO: 331169 - DNA, 25 bp, Mus musculus
catggcactttgtcacttggtagca

SEQ ID NO: 331170 - DNA, 25 bp, Mus musculus
catggcagacatcgcacatatcagt

SEQ ID NO: 331171 - DNA, 25 bp, Mus musculus
catggcagacatggcacatatcagt

SEQ ID NO: 331172 - DNA, 25 bp, Mus musculus
catggcagagcaaaccctgggcaat

SEQ ID NO: 331173 - DNA, 25 bp, Mus musculus
catggcagagcataccctgggcaat

SEQ ID NO: 331174 - DNA, 25 bp, Mus musculus
catggcagagctcgtgagcaaacca

SEQ ID NO: 331175 - DNA, 25 bp, Mus musculus
catggcagagctggtgagcaaacca

SEQ ID NO: 331176 - DNA, 25 bp, Mus musculus
catggcagatgaccccagccggagt

SEQ ID NO: 331177 - DNA, 25 bp, Mus musculus
catggcagatgagcccagccggagt

SEQ ID NO: 331178 - DNA, 25 bp, Mus musculus
catggcagcaggagagggtattttt

SEQ ID NO: 331179 - DNA, 25 bp, Mus musculus
catggcagcaggtgagggtattttt

SEQ ID NO: 331180 - DNA, 25 bp, Mus musculus
catggcagcattattacttgtttaa

SEQ ID NO: 331181 - DNA, 25 bp, Mus musculus
catggcagcatttttacttgtttaa

SEQ ID NO: 331182 - DNA, 25 bp, Mus musculus
catggcagcctgactgtgatttcag

SEQ ID NO: 331183 - DNA, 25 bp, Mus musculus
catggcagcctgtctgtgatttcag

SEQ ID NO: 331184 - DNA, 25 bp, Mus musculus
catggcagctttaggatttgttgtt

SEQ ID NO: 331185 - DNA, 25 bp, Mus musculus
catggcagcttttggatttgttgtt

SEQ ID NO: 331186 - DNA, 25 bp, Mus musculus
catggcaggccacaagcggttacat

SEQ ID NO: 331187 - DNA, 25 bp, Mus musculus
catggcaggccagaagcggttacat

SEQ ID NO: 331188 - DNA, 25 bp, Mus musculus
catggcagtccccttctaaagtagg

SEQ ID NO: 331189 - DNA, 25 bp, Mus musculus
catggcagtcccgttctaaagtagg

SEQ ID NO: 331190 - DNA, 25 bp, Mus musculus
catggcagtctgctaatcgttgtaa

SEQ ID NO: 331191 - DNA, 25 bp, Mus musculus
catggcagtctggtaatcgttgtaa

SEQ ID NO: 331192 - DNA, 25 bp, Mus musculus
catggcagttggctacatgagacac

SEQ ID NO: 331193 - DNA, 25 bp, Mus musculus
catggcagttgggtacatgagacac

SEQ ID NO: 331194 - DNA, 25 bp, Mus musculus
catggcatagccacaggcaacagat

SEQ ID NO: 331195 - DNA, 25 bp, Mus musculus
catggcatagcctcaggcaacagat

SEQ ID NO: 331196 - DNA, 25 bp, Mus musculus
catggcatccagctaaggtctgaag

SEQ ID NO: 331197 - DNA, 25 bp, Mus musculus
catggcatccaggtaaggtctgaag

SEQ ID NO: 331198 - DNA, 25 bp, Mus musculus
catggcatgcacctcaataaacgct

SEQ ID NO: 331199 - DNA, 25 bp, Mus musculus
catggcatgcacgtcaataaacgct

SEQ ID NO: 331200 - DNA, 25 bp, Mus musculus
catggcatggcaacaagtgggaaac

SEQ ID NO: 331201 - DNA, 25 bp, Mus musculus
catggcatggcatcaagtgggaaac

SEQ ID NO: 331202 - DNA, 25 bp, Mus musculus
catggcatggccaagtaactatctg

SEQ ID NO: 331203 - DNA, 25 bp, Mus musculus
catggcatggcctagtaactatctg

SEQ ID NO: 331204 - DNA, 25 bp, Mus musculus
catggcatgtgaagcaatgtcctgc

SEQ ID NO: 331205 - DNA, 25 bp, Mus musculus
catggcatgtgatgcaatgtcctgc

SEQ ID NO: 331206 - DNA, 25 bp, Mus musculus
catggcattcttatggtacctggct

SEQ ID NO: 331207 - DNA, 25 bp, Mus musculus
catggcattcttttggtacctggct

SEQ ID NO: 331208 - DNA, 25 bp, Mus musculus
catggccaactccagcaaaggatta

SEQ ID NO: 331209 - DNA, 25 bp, Mus musculus
catggccaactcgagcaaaggatta

SEQ ID NO: 331210 - DNA, 25 bp, Mus musculus
catggccaagccagactgtatcatt

SEQ ID NO: 331211 - DNA, 25 bp, Mus musculus
catggccaagcctgactgtatcatt

SEQ ID NO: 331212 - DNA, 25 bp, Mus musculus
catggccaaggaactgaggttcgag

SEQ ID NO: 331213 - DNA, 25 bp, Mus musculus
catggccaaggatctgaggttcgag

SEQ ID NO: 331214 - DNA, 25 bp, Mus musculus
catggccaaggcagacgggaacata

SEQ ID NO: 331215 - DNA, 25 bp, Mus musculus
catggccaaggctgacgggaacata

SEQ ID NO: 331216 - DNA, 25 bp, Mus musculus
catggccaatgcatcagggaagttg

SEQ ID NO: 331217 - DNA, 25 bp, Mus musculus
catggccaatgcttcagggaagttg

SEQ ID NO: 331218 - DNA, 25 bp, Mus musculus
catggccaattcagcagttcctgac

SEQ ID NO: 331219 - DNA, 25 bp, Mus musculus
catggccaattctgcagttcctgac

SEQ ID NO: 331220 - DNA, 25 bp, Mus musculus
catggccacaggacaagggaatctt

SEQ ID NO: 331221 - DNA, 25 bp, Mus musculus
catggccacaggtcaagggaatctt

SEQ ID NO: 331222 - DNA, 25 bp, Mus musculus
catggccaccttagttggcatgggt

SEQ ID NO: 331223 - DNA, 25 bp, Mus musculus
catggccacctttgttggcatgggt

SEQ ID NO: 331224 - DNA, 25 bp, Mus musculus
catggccactgactgtgggacgcct

SEQ ID NO: 331225 - DNA, 25 bp, Mus musculus
catggccactgagtgtgggacgcct

SEQ ID NO: 331226 - DNA, 25 bp, Mus musculus
catggccagaagcatcggctcctgc

SEQ ID NO: 331227 - DNA, 25 bp, Mus musculus
catggccagaaggatcggctcctgc

SEQ ID NO: 331228 - DNA, 25 bp, Mus musculus
catggccagcatcgatattgcacaa

SEQ ID NO: 331229 - DNA, 25 bp, Mus musculus
catggccagcatggatattgcacaa

SEQ ID NO: 331230 - DNA, 25 bp, Mus musculus
catggccaggttccgggttcataaa

SEQ ID NO: 331231 - DNA, 25 bp, Mus musculus
catggccaggttgcgggttcataaa

SEQ ID NO: 331232 - DNA, 25 bp, Mus musculus
catggccatcaaaagaacagtactt

SEQ ID NO: 331233 - DNA, 25 bp, Mus musculus
catggccatcaatagaacagtactt

SEQ ID NO: 331234 - DNA, 25 bp, Mus musculus
catggccatgctcaacaggacagtg

SEQ ID NO: 331235 - DNA, 25 bp, Mus musculus
catggccatgctgaacaggacagtg

SEQ ID NO: 331236 - DNA, 25 bp, Mus musculus
catggcccaatcctgtatttatttc

SEQ ID NO: 331237 - DNA, 25 bp, Mus musculus
catggcccaatcgtgtatttatttc

SEQ ID NO: 331238 - DNA, 25 bp, Mus musculus
catggcccaatgaatctgcagagga

SEQ ID NO: 331239 - DNA, 25 bp, Mus musculus
catggcccaatgtatctgcagagga

SEQ ID NO: 331240 - DNA, 25 bp, Mus musculus
catggcccagctagagacttgtgtg

SEQ ID NO: 331241 - DNA, 25 bp, Mus musculus
catggcccagcttgagacttgtgtg

SEQ ID NO: 331242 - DNA, 25 bp, Mus musculus
catggcccatccctattattaacat

SEQ ID NO: 331243 - DNA, 25 bp, Mus musculus
catggcccatccgtattattaacat

SEQ ID NO: 331244 - DNA, 25 bp, Mus musculus
catggccccatgcacacttttttaa

SEQ ID NO: 331245 - DNA, 25 bp, Mus musculus
catggccccatggacacttttttaa

SEQ ID NO: 331246 - DNA, 25 bp, Mus musculus
catggcccgcggagaccaatttttt

SEQ ID NO: 331247 - DNA, 25 bp, Mus musculus
catggcccgcggtgaccaatttttt

SEQ ID NO: 331248 - DNA, 25 bp, Mus musculus
catggcccggagaagctgtctgaga

SEQ ID NO: 331249 - DNA, 25 bp, Mus musculus
catggcccggagtagctgtctgaga

SEQ ID NO: 331250 - DNA, 25 bp, Mus musculus
catggcccgggaataaattcagcat

SEQ ID NO: 331251 - DNA, 25 bp, Mus musculus
catggcccgggattaaattcagcat

SEQ ID NO: 331252 - DNA, 25 bp, Mus musculus
catggcccgtctcaagacaatcctg

SEQ ID NO: 331253 - DNA, 25 bp, Mus musculus
catggcccgtctgaagacaatcctg

SEQ ID NO: 331254 - DNA, 25 bp, Mus musculus
catggccctaagagggatacccaga

SEQ ID NO: 331255 - DNA, 25 bp, Mus musculus
catggccctaagtgggatacccaga

SEQ ID NO: 331256 - DNA, 25 bp, Mus musculus
catggccctactctgagcaagagac

SEQ ID NO: 331257 - DNA, 25 bp, Mus musculus
catggccctactgtgagcaagagac

SEQ ID NO: 331258 - DNA, 25 bp, Mus musculus
catggccctctacgctcacatattt

SEQ ID NO: 331259 - DNA, 25 bp, Mus musculus
catggccctctaggctcacatattt

SEQ ID NO: 331260 - DNA, 25 bp, Mus musculus
catggccctggcacggtccagtgga

SEQ ID NO: 331261 - DNA, 25 bp, Mus musculus
catggccctggctcggtccagtgga

SEQ ID NO: 331262 - DNA, 25 bp, Mus musculus
catggccgaggtcgctttggcatta

SEQ ID NO: 331263 - DNA, 25 bp, Mus musculus
catggccgaggtggctttggcatta

SEQ ID NO: 331264 - DNA, 25 bp, Mus musculus
catggccgccggctcctgggtatct

SEQ ID NO: 331265 - DNA, 25 bp, Mus musculus
catggccgccgggtcctgggtatct

SEQ ID NO: 331266 - DNA, 25 bp, Mus musculus
catggccgctccagtttggaggtgt

SEQ ID NO: 331267 - DNA, 25 bp, Mus musculus
catggccgctcctgtttggaggtgt

SEQ ID NO: 331268 - DNA, 25 bp, Mus musculus
catggccgggacactcgagatggct

SEQ ID NO: 331269 - DNA, 25 bp, Mus musculus
catggccgggactctcgagatggct

SEQ ID NO: 331270 - DNA, 25 bp, Mus musculus
catggccgttctaagttggtggagc

SEQ ID NO: 331271 - DNA, 25 bp, Mus musculus
catggccgttcttagttggtggagc

SEQ ID NO: 331272 - DNA, 25 bp, Mus musculus
catggcctctctcgatactatttaa

SEQ ID NO: 331273 - DNA, 25 bp, Mus musculus
catggcctctctggatactatttaa

SEQ ID NO: 331274 - DNA, 25 bp, Mus musculus
catggcctgcagaacgctcaagctg

SEQ ID NO: 331275 - DNA, 25 bp, Mus musculus
catggcctgcagtacgctcaagctg

SEQ ID NO: 331276 - DNA, 25 bp, Mus musculus
catggcctgctgaggttttgacctg

SEQ ID NO: 331277 - DNA, 25 bp, Mus musculus
catggcctgctgtggttttgacctg

SEQ ID NO: 331278 - DNA, 25 bp, Mus musculus
catggcctggaaaatagcttgagag

SEQ ID NO: 331279 - DNA, 25 bp, Mus musculus
catggcctggaacttactgtgtagc

SEQ ID NO: 331280 - DNA, 25 bp, Mus musculus
catggcctggaagttactgtgtagc

SEQ ID NO: 331281 - DNA, 25 bp, Mus musculus
catggcctggaatatagcttgagag

SEQ ID NO: 331282 - DNA, 25 bp, Mus musculus
catggcctggtgcaattcagcactt

SEQ ID NO: 331283 - DNA, 25 bp, Mus musculus
catggcctggtggaattcagcactt

SEQ ID NO: 331284 - DNA, 25 bp, Mus musculus
catggcctgtagctttgcagtagga

SEQ ID NO: 331285 - DNA, 25 bp, Mus musculus
catggcctgtaggtttgcagtagga

SEQ ID NO: 331286 - DNA, 25 bp, Mus musculus
catggcctgtggctgtgtgttcaaa

SEQ ID NO: 331287 - DNA, 25 bp, Mus musculus
catggcctgtgggtgtgtgttcaaa

SEQ ID NO: 331288 - DNA, 25 bp, Mus musculus
catggccttatcaggttgatggaat

SEQ ID NO: 331289 - DNA, 25 bp, Mus musculus
catggccttatctggttgatggaat

SEQ ID NO: 331290 - DNA, 25 bp, Mus musculus
catggccttcatccagaatttggga

SEQ ID NO: 331291 - DNA, 25 bp, Mus musculus
catggccttcatgcagaatttggga

SEQ ID NO: 331292 - DNA, 25 bp, Mus musculus
catggccttttactggatgtttgac

SEQ ID NO: 331293 - DNA, 25 bp, Mus musculus
catggccttttagtggatgtttgac

SEQ ID NO: 331294 - DNA, 25 bp, Mus musculus
catggcgaccatagctgttgtggtt

SEQ ID NO: 331295 - DNA, 25 bp, Mus musculus
catggcgaccattgctgttgtggtt

SEQ ID NO: 331296 - DNA, 25 bp, Mus musculus
catggcgacggtcaaaactttccct

SEQ ID NO: 331297 - DNA, 25 bp, Mus musculus
catggcgacggtgaaaactttccct

SEQ ID NO: 331298 - DNA, 25 bp, Mus musculus
catggcgagcaccttttcagtatgc

SEQ ID NO: 331299 - DNA, 25 bp, Mus musculus
catggcgagcacgttttcagtatgc

SEQ ID NO: 331300 - DNA, 25 bp, Mus musculus
catggcgatctgaggagctgaatct

SEQ ID NO: 331301 - DNA, 25 bp, Mus musculus
catggcgatctgtggagctgaatct

SEQ ID NO: 331302 - DNA, 25 bp, Mus musculus
catggcgcattcatgcatacagaat

SEQ ID NO: 331303 - DNA, 25 bp, Mus musculus
catggcgcattcttgcatacagaat

SEQ ID NO: 331304 - DNA, 25 bp, Mus musculus
catggcgcatttcttctgaattaaa

SEQ ID NO: 331305 - DNA, 25 bp, Mus musculus
catggcgcatttgttctgaattaaa

SEQ ID NO: 331306 - DNA, 25 bp, Mus musculus
catggcgcggaaagtgttgtacccc

SEQ ID NO: 331307 - DNA, 25 bp, Mus musculus
catggcgcggaatgtgttgtacccc

SEQ ID NO: 331308 - DNA, 25 bp, Mus musculus
catggcgctattcggtttcactaaa

SEQ ID NO: 331309 - DNA, 25 bp, Mus musculus
catggcgctattgggtttcactaaa

SEQ ID NO: 331310 - DNA, 25 bp, Mus musculus
catggcgctccacacagtagcaagt

SEQ ID NO: 331311 - DNA, 25 bp, Mus musculus
catggcgctccagacagtagcaagt

SEQ ID NO: 331312 - DNA, 25 bp, Mus musculus
catggcggtcctattttggctaccg

SEQ ID NO: 331313 - DNA, 25 bp, Mus musculus
catggcggtccttttttggctaccg

SEQ ID NO: 331314 - DNA, 25 bp, Mus musculus
catggcgtatgtctagttaagcaac

SEQ ID NO: 331315 - DNA, 25 bp, Mus musculus
catggcgtatgtgtagttaagcaac

SEQ ID NO: 331316 - DNA, 25 bp, Mus musculus
catggcgtccatcgcgtcttcggcg

SEQ ID NO: 331317 - DNA, 25 bp, Mus musculus
catggcgtccatggcgtcttcggcg

SEQ ID NO: 331318 - DNA, 25 bp, Mus musculus
catggcgtccgtatactcggaagaa

SEQ ID NO: 331319 - DNA, 25 bp, Mus musculus
catggcgtccgtttactcggaagaa

SEQ ID NO: 331320 - DNA, 25 bp, Mus musculus
catggcgtgcctagtgaccctggag

SEQ ID NO: 331321 - DNA, 25 bp, Mus musculus
catggcgtgccttgtgaccctggag

SEQ ID NO: 331322 - DNA, 25 bp, Mus musculus
catggcgttgagatgttttgcacta

SEQ ID NO: 331323 - DNA, 25 bp, Mus musculus
catggcgttgagttgttttgcacta

SEQ ID NO: 331324 - DNA, 25 bp, Mus musculus
catggcgttggtctagttcttggca

SEQ ID NO: 331325 - DNA, 25 bp, Mus musculus
catggcgttggtgtagttcttggca

SEQ ID NO: 331326 - DNA, 25 bp, Mus musculus
catggcgtttggctggaacttttca

SEQ ID NO: 331327 - DNA, 25 bp, Mus musculus
catggcgtttgggtggaacttttca

SEQ ID NO: 331328 - DNA, 25 bp, Mus musculus
catggctaagaactttccgttggac

SEQ ID NO: 331329 - DNA, 25 bp, Mus musculus
catggctaagaagtttccgttggac

SEQ ID NO: 331330 - DNA, 25 bp, Mus musculus
catggctacggaaaacatcctccag

SEQ ID NO: 331331 - DNA, 25 bp, Mus musculus
catggctacggataacatcctccag

SEQ ID NO: 331332 - DNA, 25 bp, Mus musculus
catggctacttcaggacttttaatg

SEQ ID NO: 331333 - DNA, 25 bp, Mus musculus
catggctacttctggacttttaatg

SEQ ID NO: 331334 - DNA, 25 bp, Mus musculus
catggctactttatgcgttggtcaa

SEQ ID NO: 331335 - DNA, 25 bp, Mus musculus
catggctactttttgcgttggtcaa

SEQ ID NO: 331336 - DNA, 25 bp, Mus musculus
catggctagcagacacagttttaca

SEQ ID NO: 331337 - DNA, 25 bp, Mus musculus
catggctagcagtcacagttttaca

SEQ ID NO: 331338 - DNA, 25 bp, Mus musculus
catggctagcatcggcttagcagat

SEQ ID NO: 331339 - DNA, 25 bp, Mus musculus
catggctagcatgggcttagcagat

SEQ ID NO: 331340 - DNA, 25 bp, Mus musculus
catggctattgcagaggttatttta

SEQ ID NO: 331341 - DNA, 25 bp, Mus musculus
catggctattgctgaggttatttta

SEQ ID NO: 331342 - DNA, 25 bp, Mus musculus
catggctcaaagacacgggctattc

SEQ ID NO: 331343 - DNA, 25 bp, Mus musculus
catggctcaaagtcacgggctattc

SEQ ID NO: 331344 - DNA, 25 bp, Mus musculus
catggctccactaggaacgtcagat

SEQ ID NO: 331345 - DNA, 25 bp, Mus musculus
catggctccacttggaacgtcagat

SEQ ID NO: 331346 - DNA, 25 bp, Mus musculus
catggctcccacatgtatgtataca

SEQ ID NO: 331347 - DNA, 25 bp, Mus musculus
catggctcccacttgtatgtataca

SEQ ID NO: 331348 - DNA, 25 bp, Mus musculus
catggctcccttcagcaaatggaac

SEQ ID NO: 331349 - DNA, 25 bp, Mus musculus
catggctcccttgagcaaatggaac

SEQ ID NO: 331350 - DNA, 25 bp, Mus musculus
catggctcgagcagtcgttgtcaat

SEQ ID NO: 331351 - DNA, 25 bp, Mus musculus
catggctcgagctgtcgttgtcaat

SEQ ID NO: 331352 - DNA, 25 bp, Mus musculus
catggctcgtgtatagcggtcatta

SEQ ID NO: 331353 - DNA, 25 bp, Mus musculus
catggctcgtgtttagcggtcatta

SEQ ID NO: 331354 - DNA, 25 bp, Mus musculus
catggctcttccacaacctgagttt

SEQ ID NO: 331355 - DNA, 25 bp, Mus musculus
catggctcttcctcaacctgagttt

SEQ ID NO: 331356 - DNA, 25 bp, Mus musculus
catggctgaagcatcaactcagtaa

SEQ ID NO: 331357 - DNA, 25 bp, Mus musculus
catggctgaagcttcaactcagtaa

SEQ ID NO: 331358 - DNA, 25 bp, Mus musculus
catggctgaatgcaaacacgtgtta

SEQ ID NO: 331359 - DNA, 25 bp, Mus musculus
catggctgaatggaaacacgtgtta

SEQ ID NO: 331360 - DNA, 25 bp, Mus musculus
catggctgacaacccatcttgggat

SEQ ID NO: 331361 - DNA, 25 bp, Mus musculus
catggctgacaagccatcttgggat

SEQ ID NO: 331362 - DNA, 25 bp, Mus musculus
catggctgacacaaagctgtttgta

SEQ ID NO: 331363 - DNA, 25 bp, Mus musculus
catggctgacacaagaagacgttct

SEQ ID NO: 331364 - DNA, 25 bp, Mus musculus
catggctgacactaagctgtttgta

SEQ ID NO: 331365 - DNA, 25 bp, Mus musculus
catggctgacactagaagacgttct

SEQ ID NO: 331366 - DNA, 25 bp, Mus musculus
catggctgatagacactctgaggca

SEQ ID NO: 331367 - DNA, 25 bp, Mus musculus
catggctgatagtcactctgaggca

SEQ ID NO: 331368 - DNA, 25 bp, Mus musculus
catggctgatctactctgttaccaa

SEQ ID NO: 331369 - DNA, 25 bp, Mus musculus
catggctgatcttctctgttaccaa

SEQ ID NO: 331370 - DNA, 25 bp, Mus musculus
catggctgccagatctgaactttaa

SEQ ID NO: 331371 - DNA, 25 bp, Mus musculus
catggctgccagttctgaactttaa

SEQ ID NO: 331372 - DNA, 25 bp, Mus musculus
catggctgcctaattcaccaatgag

SEQ ID NO: 331373 - DNA, 25 bp, Mus musculus
catggctgcctatttcaccaatgag

SEQ ID NO: 331374 - DNA, 25 bp, Mus musculus
catggctgctcacaattctgtgtaa

SEQ ID NO: 331375 - DNA, 25 bp, Mus musculus
catggctgctcagaattctgtgtaa

SEQ ID NO: 331376 - DNA, 25 bp, Mus musculus
catggctgctccaaagctttgccca

SEQ ID NO: 331377 - DNA, 25 bp, Mus musculus
catggctgctcctaagctttgccca

SEQ ID NO: 331378 - DNA, 25 bp, Mus musculus
catggctgggctccgatcggaacac

SEQ ID NO: 331379 - DNA, 25 bp, Mus musculus
catggctgggctgcgatcggaacac

SEQ ID NO: 331380 - DNA, 25 bp, Mus musculus
catggctggtctcctgtatctttgc

SEQ ID NO: 331381 - DNA, 25 bp, Mus musculus
catggctggtctgctgtatctttgc

SEQ ID NO: 331382 - DNA, 25 bp, Mus musculus
catggctgtccactgagaggatcta

SEQ ID NO: 331383 - DNA, 25 bp, Mus musculus
catggctgtccagtgagaggatcta

SEQ ID NO: 331384 - DNA, 25 bp, Mus musculus
catggctgttacaaggatggtgtga

SEQ ID NO: 331385 - DNA, 25 bp, Mus musculus
catggctgttactaggatggtgtga

SEQ ID NO: 331386 - DNA, 25 bp, Mus musculus
catggctgtttgctgttggattaca

SEQ ID NO: 331387 - DNA, 25 bp, Mus musculus
catggctgtttggtgttggattaca

SEQ ID NO: 331388 - DNA, 25 bp, Mus musculus
catggcttacacaatgaaccccgta

SEQ ID NO: 331389 - DNA, 25 bp, Mus musculus
catggcttacactatgaaccccgta

SEQ ID NO: 331390 - DNA, 25 bp, Mus musculus
catggcttactaaagaacttgtgag

SEQ ID NO: 331391 - DNA, 25 bp, Mus musculus
catggcttactatagaacttgtgag

SEQ ID NO: 331392 - DNA, 25 bp, Mus musculus
catggcttcacactgtctgatgtcc

SEQ ID NO: 331393 - DNA, 25 bp, Mus musculus
catggcttcacagtgtctgatgtcc

SEQ ID NO: 331394 - DNA, 25 bp, Mus musculus
catggcttccacaggacaggtttag

SEQ ID NO: 331395 - DNA, 25 bp, Mus musculus
catggcttccactggacaggtttag

SEQ ID NO: 331396 - DNA, 25 bp, Mus musculus
catggcttccctattcatagctgga

SEQ ID NO: 331397 - DNA, 25 bp, Mus musculus
catggcttcccttttcatagctgga

SEQ ID NO: 331398 - DNA, 25 bp, Mus musculus
catggcttccgaactttttattaca

SEQ ID NO: 331399 - DNA, 25 bp, Mus musculus
catggcttccgacttaaatgtccaa

SEQ ID NO: 331400 - DNA, 25 bp, Mus musculus
catggcttccgagttaaatgtccaa

SEQ ID NO: 331401 - DNA, 25 bp, Mus musculus
catggcttccgatctttttattaca

SEQ ID NO: 331402 - DNA, 25 bp, Mus musculus
catggcttccttcccaatcgaggaa

SEQ ID NO: 331403 - DNA, 25 bp, Mus musculus
catggcttccttgccaatcgaggaa

SEQ ID NO: 331404 - DNA, 25 bp, Mus musculus
catggcttcttgatctgtatgagag

SEQ ID NO: 331405 - DNA, 25 bp, Mus musculus
catggcttcttgttctgtatgagag

SEQ ID NO: 331406 - DNA, 25 bp, Mus musculus
catggcttgaggagtctgtcacagt

SEQ ID NO: 331407 - DNA, 25 bp, Mus musculus
catggcttgaggtgtctgtcacagt

SEQ ID NO: 331408 - DNA, 25 bp, Mus musculus
catggcttgcttatggttttcctta

SEQ ID NO: 331409 - DNA, 25 bp, Mus musculus
catggcttgcttttggttttcctta

SEQ ID NO: 331410 - DNA, 25 bp, Mus musculus
catggcttgtagagaggcatagcaa

SEQ ID NO: 331411 - DNA, 25 bp, Mus musculus
catggcttgtagtgaggcatagcaa

SEQ ID NO: 331412 - DNA, 25 bp, Mus musculus
catggcttgtggcagatctgaccaa

SEQ ID NO: 331413 - DNA, 25 bp, Mus musculus
catggcttgtgggagatctgaccaa

SEQ ID NO: 331414 - DNA, 25 bp, Mus musculus
catggctttatgcaggctactcaaa

SEQ ID NO: 331415 - DNA, 25 bp, Mus musculus
catggctttatggaggctactcaaa

SEQ ID NO: 331416 - DNA, 25 bp, Mus musculus
catggctttattcaggtagagtttc

SEQ ID NO: 331417 - DNA, 25 bp, Mus musculus
catggctttattgaggtagagtttc

SEQ ID NO: 331418 - DNA, 25 bp, Mus musculus
catggctttgaaacccatactttac

SEQ ID NO: 331419 - DNA, 25 bp, Mus musculus
catggctttgaatcccatactttac

SEQ ID NO: 331420 - DNA, 25 bp, Mus musculus
catggctttgcgcaggttaaacagt

SEQ ID NO: 331421 - DNA, 25 bp, Mus musculus
catggctttgcggaggttaaacagt

SEQ ID NO: 331422 - DNA, 25 bp, Mus musculus
catggctttggactaagactgccca

SEQ ID NO: 331423 - DNA, 25 bp, Mus musculus
catggctttggactagtagctatct

SEQ ID NO: 331424 - DNA, 25 bp, Mus musculus
catggctttggagtaagactgccca

SEQ ID NO: 331425 - DNA, 25 bp, Mus musculus
catggctttggagtagtagctatct

SEQ ID NO: 331426 - DNA, 25 bp, Mus musculus
catggctttgtgaagtctcctaaaa

SEQ ID NO: 331427 - DNA, 25 bp, Mus musculus
catggctttgtgtagtctcctaaaa

SEQ ID NO: 331428 - DNA, 25 bp, Mus musculus
catgggaactggcagtcatttaact

SEQ ID NO: 331429 - DNA, 25 bp, Mus musculus
catgggaactgggagtcatttaact

SEQ ID NO: 331430 - DNA, 25 bp, Mus musculus
catgggaagaccaggagctctggtc

SEQ ID NO: 331431 - DNA, 25 bp, Mus musculus
catgggaagacctggagctctggtc

SEQ ID NO: 331432 - DNA, 25 bp, Mus musculus
catgggaagtgcatggaactcagta

SEQ ID NO: 331433 - DNA, 25 bp, Mus musculus
catgggaagtgcttggaactcagta

SEQ ID NO: 331434 - DNA, 25 bp, Mus musculus
catgggaatctgaaggtggatgtca

SEQ ID NO: 331435 - DNA, 25 bp, Mus musculus
catgggaatctgtaggtggatgtca

SEQ ID NO: 331436 - DNA, 25 bp, Mus musculus
catgggaatgaaccccagctcacag

SEQ ID NO: 331437 - DNA, 25 bp, Mus musculus
catgggaatgaagcccagctcacag

SEQ ID NO: 331438 - DNA, 25 bp, Mus musculus
catgggacagtcacagtgaatggaa

SEQ ID NO: 331439 - DNA, 25 bp, Mus musculus
catgggacagtctcagtgaatggaa

SEQ ID NO: 331440 - DNA, 25 bp, Mus musculus
catgggacatccctcattgactgtg

SEQ ID NO: 331441 - DNA, 25 bp, Mus musculus
catgggacatccgtcattgactgtg

SEQ ID NO: 331442 - DNA, 25 bp, Mus musculus
catgggacatttctccctgtaggat

SEQ ID NO: 331443 - DNA, 25 bp, Mus musculus
catgggacatttgtccctgtaggat

SEQ ID NO: 331444 - DNA, 25 bp, Mus musculus
catgggacctatattttcttgaatt

SEQ ID NO: 331445 - DNA, 25 bp, Mus musculus
catgggacctattttttcttgaatt

SEQ ID NO: 331446 - DNA, 25 bp, Mus musculus
catgggacgttcatttcgggttggt

SEQ ID NO: 331447 - DNA, 25 bp, Mus musculus
catgggacgttcttttcgggttggt

SEQ ID NO: 331448 - DNA, 25 bp, Mus musculus
catgggactatgctagctgatgcta

SEQ ID NO: 331449 - DNA, 25 bp, Mus musculus
catgggactatggtagctgatgcta

SEQ ID NO: 331450 - DNA, 25 bp, Mus musculus
catgggactcaacgatctgcttttc

SEQ ID NO: 331451 - DNA, 25 bp, Mus musculus
catgggactcaaggatctgcttttc

SEQ ID NO: 331452 - DNA, 25 bp, Mus musculus
catgggactctaatgtgaatctgac

SEQ ID NO: 331453 - DNA, 25 bp, Mus musculus
catgggactctattgtgaatctgac

SEQ ID NO: 331454 - DNA, 25 bp, Mus musculus
catgggactgcacgcgactctatga

SEQ ID NO: 331455 - DNA, 25 bp, Mus musculus
catgggactgcaggcgactctatga

SEQ ID NO: 331456 - DNA, 25 bp, Mus musculus
catgggagaccgactatctagctac

SEQ ID NO: 331457 - DNA, 25 bp, Mus musculus
catgggagaccgtctatctagctac

SEQ ID NO: 331458 - DNA, 25 bp, Mus musculus
catgggagagcacattcaggaacct

SEQ ID NO: 331459 - DNA, 25 bp, Mus musculus
catgggagagcagattcaggaacct

SEQ ID NO: 331460 - DNA, 25 bp, Mus musculus
catgggagccatactgcaagtgtcc

SEQ ID NO: 331461 - DNA, 25 bp, Mus musculus
catgggagccattctgcaagtgtcc

SEQ ID NO: 331462 - DNA, 25 bp, Mus musculus
catgggaggcacctttgccccataa

SEQ ID NO: 331463 - DNA, 25 bp, Mus musculus
catgggaggcacgtttgccccataa

SEQ ID NO: 331464 - DNA, 25 bp, Mus musculus
catgggaggctcatgttgggaaaat

SEQ ID NO: 331465 - DNA, 25 bp, Mus musculus
catgggaggctcttgttgggaaaat

SEQ ID NO: 331466 - DNA, 25 bp, Mus musculus
catgggaggtctctcctctgaggaa

SEQ ID NO: 331467 - DNA, 25 bp, Mus musculus
catgggaggtctgtcctctgaggaa

SEQ ID NO: 331468 - DNA, 25 bp, Mus musculus
catgggagtccccaaaggactttct

SEQ ID NO: 331469 - DNA, 25 bp, Mus musculus
catgggagtcccgaaaggactttct

SEQ ID NO: 331470 - DNA, 25 bp, Mus musculus
catgggagtgacaagcctcctaagt

SEQ ID NO: 331471 - DNA, 25 bp, Mus musculus
catgggagtgactagcctcctaagt

SEQ ID NO: 331472 - DNA, 25 bp, Mus musculus
catgggagttttcaagcactgagtt

SEQ ID NO: 331473 - DNA, 25 bp, Mus musculus
catgggagttttgaagcactgagtt

SEQ ID NO: 331474 - DNA, 25 bp, Mus musculus
catgggatcaggcatatgccttgaa

SEQ ID NO: 331475 - DNA, 25 bp, Mus musculus
catgggatcagggatatgccttgaa

SEQ ID NO: 331476 - DNA, 25 bp, Mus musculus
catgggatctaaaacctctggtctt

SEQ ID NO: 331477 - DNA, 25 bp, Mus musculus
catgggatctaatacctctggtctt

SEQ ID NO: 331478 - DNA, 25 bp, Mus musculus
catgggatgaatagtgctggtttaa

SEQ ID NO: 331479 - DNA, 25 bp, Mus musculus
catgggatgaattgtgctggtttaa

SEQ ID NO: 331480 - DNA, 25 bp, Mus musculus
catgggatgatgaaaacctggccaa

SEQ ID NO: 331481 - DNA, 25 bp, Mus musculus
catgggatgatgtaaacctggccaa

SEQ ID NO: 331482 - DNA, 25 bp, Mus musculus
catgggatggagctttctaccactc

SEQ ID NO: 331483 - DNA, 25 bp, Mus musculus
catgggatggaggtttctaccactc

SEQ ID NO: 331484 - DNA, 25 bp, Mus musculus
catgggatgtcccacagcctggtga

SEQ ID NO: 331485 - DNA, 25 bp, Mus musculus
catgggatgtccgacagcctggtga

SEQ ID NO: 331486 - DNA, 25 bp, Mus musculus
catgggatgtttctctatgtctaac

SEQ ID NO: 331487 - DNA, 25 bp, Mus musculus
catgggatgtttgtctatgtctaac

SEQ ID NO: 331488 - DNA, 25 bp, Mus musculus
catgggattgtaaaccttgggaact

SEQ ID NO: 331489 - DNA, 25 bp, Mus musculus
catgggattgtataccttgggaact

SEQ ID NO: 331490 - DNA, 25 bp, Mus musculus
catgggatttttaagctcattaatt

SEQ ID NO: 331491 - DNA, 25 bp, Mus musculus
catgggattttttagctcattaatt

SEQ ID NO: 331492 - DNA, 25 bp, Mus musculus
catgggcaactacaccttcaggagg

SEQ ID NO: 331493 - DNA, 25 bp, Mus musculus
catgggcaactagaccttcaggagg

SEQ ID NO: 331494 - DNA, 25 bp, Mus musculus
catgggcacacccaatctatgattt

SEQ ID NO: 331495 - DNA, 25 bp, Mus musculus
catgggcacaccgaatctatgattt

SEQ ID NO: 331496 - DNA, 25 bp, Mus musculus
catgggcagacactaccatgtggcc

SEQ ID NO: 331497 - DNA, 25 bp, Mus musculus
catgggcagacagtaccatgtggcc

SEQ ID NO: 331498 - DNA, 25 bp, Mus musculus
catgggcagtgacctgactcggcta

SEQ ID NO: 331499 - DNA, 25 bp, Mus musculus
catgggcagtgagctgactcggcta

SEQ ID NO: 331500 - DNA, 25 bp, Mus musculus
catgggcatatgagactcgtgttaa

SEQ ID NO: 331501 - DNA, 25 bp, Mus musculus
catgggcatatgtgactcgtgttaa

SEQ ID NO: 331502 - DNA, 25 bp, Mus musculus
catgggcatcaacgatgtctttgat

SEQ ID NO: 331503 - DNA, 25 bp, Mus musculus
catgggcatcaaggatgtctttgat

SEQ ID NO: 331504 - DNA, 25 bp, Mus musculus
catgggcatgctatagaactgtggt

SEQ ID NO: 331505 - DNA, 25 bp, Mus musculus
catgggcatgctttagaactgtggt

SEQ ID NO: 331506 - DNA, 25 bp, Mus musculus
catgggccaagcattgtcatagcat

SEQ ID NO: 331507 - DNA, 25 bp, Mus musculus
catgggccaagctttgtcatagcat

SEQ ID NO: 331508 - DNA, 25 bp, Mus musculus
catgggccaccacactcagtttgat

SEQ ID NO: 331509 - DNA, 25 bp, Mus musculus
catgggccaccagactcagtttgat

SEQ ID NO: 331510 - DNA, 25 bp, Mus musculus
catgggcccagaactgtggtttaaa

SEQ ID NO: 331511 - DNA, 25 bp, Mus musculus
catgggcccagatctgtggtttaaa

SEQ ID NO: 331512 - DNA, 25 bp, Mus musculus
catgggccccagcactgaaccagat

SEQ ID NO: 331513 - DNA, 25 bp, Mus musculus
catgggccccaggactgaaccagat

SEQ ID NO: 331514 - DNA, 25 bp, Mus musculus
catgggccccgaagctgagaatgga

SEQ ID NO: 331515 - DNA, 25 bp, Mus musculus
catgggccccgatgctgagaatgga

SEQ ID NO: 331516 - DNA, 25 bp, Mus musculus
catgggccccggacactgtatgctg

SEQ ID NO: 331517 - DNA, 25 bp, Mus musculus
catgggccccggtcactgtatgctg

SEQ ID NO: 331518 - DNA, 25 bp, Mus musculus
catgggcctcgcacagaacctgctg

SEQ ID NO: 331519 - DNA, 25 bp, Mus musculus
catgggcctcgctcagaacctgctg

SEQ ID NO: 331520 - DNA, 25 bp, Mus musculus
catgggcctgaaacaatttagtgac

SEQ ID NO: 331521 - DNA, 25 bp, Mus musculus
catgggcctgaatcaatttagtgac

SEQ ID NO: 331522 - DNA, 25 bp, Mus musculus
catgggcctgctaacttctagtatt

SEQ ID NO: 331523 - DNA, 25 bp, Mus musculus
catgggcctgcttacttctagtatt

SEQ ID NO: 331524 - DNA, 25 bp, Mus musculus
catgggccttggcttaagcatacaa

SEQ ID NO: 331525 - DNA, 25 bp, Mus musculus
catgggccttgggttaagcatacaa

SEQ ID NO: 331526 - DNA, 25 bp, Mus musculus
catgggcgagctcatgacctctagc

SEQ ID NO: 331527 - DNA, 25 bp, Mus musculus
catgggcgagctgatgacctctagc

SEQ ID NO: 331528 - DNA, 25 bp, Mus musculus
catgggcgggatcattttccgaatt

SEQ ID NO: 331529 - DNA, 25 bp, Mus musculus
catgggcgggatgattttccgaatt

SEQ ID NO: 331530 - DNA, 25 bp, Mus musculus
catgggctacagacttggcttgcta

SEQ ID NO: 331531 - DNA, 25 bp, Mus musculus
catgggctacagtcttggcttgcta

SEQ ID NO: 331532 - DNA, 25 bp, Mus musculus
catgggctatggagaggccttccga

SEQ ID NO: 331533 - DNA, 25 bp, Mus musculus
catgggctatggtgaggccttccga

SEQ ID NO: 331534 - DNA, 25 bp, Mus musculus
catgggctatttagtccgtgtactt

SEQ ID NO: 331535 - DNA, 25 bp, Mus musculus
catgggctattttgtccgtgtactt

SEQ ID NO: 331536 - DNA, 25 bp, Mus musculus
catgggctcacacttgagctgcttt

SEQ ID NO: 331537 - DNA, 25 bp, Mus musculus
catgggctcacagttgagctgcttt

SEQ ID NO: 331538 - DNA, 25 bp, Mus musculus
catgggctcctgattaaccctctag

SEQ ID NO: 331539 - DNA, 25 bp, Mus musculus
catgggctcctgtttaaccctctag

SEQ ID NO: 331540 - DNA, 25 bp, Mus musculus
catgggctgccaagctgtgtgtatg

SEQ ID NO: 331541 - DNA, 25 bp, Mus musculus
catgggctgccatgctgtgtgtatg

SEQ ID NO: 331542 - DNA, 25 bp, Mus musculus
catgggctgcttcggtgtcaccaga

SEQ ID NO: 331543 - DNA, 25 bp, Mus musculus
catgggctgcttgggtgtcaccaga

SEQ ID NO: 331544 - DNA, 25 bp, Mus musculus
catgggctgtctcctgtgaagttag

SEQ ID NO: 331545 - DNA, 25 bp, Mus musculus
catgggctgtctgctgtgaagttag

SEQ ID NO: 331546 - DNA, 25 bp, Mus musculus
catgggctgttgactctcggtaaca

SEQ ID NO: 331547 - DNA, 25 bp, Mus musculus
catgggctgttgtctctcggtaaca

SEQ ID NO: 331548 - DNA, 25 bp, Mus musculus
catgggcttattatcaggcttttga

SEQ ID NO: 331549 - DNA, 25 bp, Mus musculus
catgggcttattttcaggcttttga

SEQ ID NO: 331550 - DNA, 25 bp, Mus musculus
catgggcttcacatgaaaatgtttt

SEQ ID NO: 331551 - DNA, 25 bp, Mus musculus
catgggcttcacttgaaaatgtttt

SEQ ID NO: 331552 - DNA, 25 bp, Mus musculus
catggggcctttcataaactgggtg

SEQ ID NO: 331553 - DNA, 25 bp, Mus musculus
catggggcctttgataaactgggtg

SEQ ID NO: 331554 - DNA, 25 bp, Mus musculus
catgggggtccacaaattatatttt

SEQ ID NO: 331555 - DNA, 25 bp, Mus musculus
catgggggtccagaaattatatttt

SEQ ID NO: 331556 - DNA, 25 bp, Mus musculus
catggggtagctcccggaacgacta

SEQ ID NO: 331557 - DNA, 25 bp, Mus musculus
catggggtagctgccggaacgacta

SEQ ID NO: 331558 - DNA, 25 bp, Mus musculus
catgggtaagcaaatgttctaatta

SEQ ID NO: 331559 - DNA, 25 bp, Mus musculus
catgggtaagcatatgttctaatta

SEQ ID NO: 331560 - DNA, 25 bp, Mus musculus
catgggtatccacactctgctaggg

SEQ ID NO: 331561 - DNA, 25 bp, Mus musculus
catgggtatccagactctgctaggg

SEQ ID NO: 331562 - DNA, 25 bp, Mus musculus
catgggtcactcagtgtgctttttt

SEQ ID NO: 331563 - DNA, 25 bp, Mus musculus
catgggtcactctgtgtgctttttt

SEQ ID NO: 331564 - DNA, 25 bp, Mus musculus
catgggtccctaagcaattgtgtga

SEQ ID NO: 331565 - DNA, 25 bp, Mus musculus
catgggtccctatgcaattgtgtga

SEQ ID NO: 331566 - DNA, 25 bp, Mus musculus
catgggtccgtgaccgtgagtctca

SEQ ID NO: 331567 - DNA, 25 bp, Mus musculus
catgggtccgtgtccgtgagtctca

SEQ ID NO: 331568 - DNA, 25 bp, Mus musculus
catgggtctcctccatagaaagtgt

SEQ ID NO: 331569 - DNA, 25 bp, Mus musculus
catgggtctcctgcatagaaagtgt

SEQ ID NO: 331570 - DNA, 25 bp, Mus musculus
catgggtctgccataggctcctaat

SEQ ID NO: 331571 - DNA, 25 bp, Mus musculus
catgggtctgccttaggctcctaat

SEQ ID NO: 331572 - DNA, 25 bp, Mus musculus
catgggtctggcctgtaaatattca

SEQ ID NO: 331573 - DNA, 25 bp, Mus musculus
catgggtctggcgtgtaaatattca

SEQ ID NO: 331574 - DNA, 25 bp, Mus musculus
catgggtctgggactgtaacgtaca

SEQ ID NO: 331575 - DNA, 25 bp, Mus musculus
catgggtctgggtctgtaacgtaca

SEQ ID NO: 331576 - DNA, 25 bp, Mus musculus
catgggtcttgaatactactttatt

SEQ ID NO: 331577 - DNA, 25 bp, Mus musculus
catgggtcttgattactactttatt

SEQ ID NO: 331578 - DNA, 25 bp, Mus musculus
catgggtcttgtcttccgtattgaa

SEQ ID NO: 331579 - DNA, 25 bp, Mus musculus
catgggtcttgtgttccgtattgaa

SEQ ID NO: 331580 - DNA, 25 bp, Mus musculus
catgggtgacatcccttgggcaaac

SEQ ID NO: 331581 - DNA, 25 bp, Mus musculus
catgggtgacatgccttgggcaaac

SEQ ID NO: 331582 - DNA, 25 bp, Mus musculus
catgggtgatgcatggatatgaaca

SEQ ID NO: 331583 - DNA, 25 bp, Mus musculus
catgggtgatgcttggatatgaaca

SEQ ID NO: 331584 - DNA, 25 bp, Mus musculus
catgggtgcagcattcagaaaactc

SEQ ID NO: 331585 - DNA, 25 bp, Mus musculus
catgggtgcagctttcagaaaactc

SEQ ID NO: 331586 - DNA, 25 bp, Mus musculus
catgggtgccaactacagcagctac

SEQ ID NO: 331587 - DNA, 25 bp, Mus musculus
catgggtgccaagtacagcagctac

SEQ ID NO: 331588 - DNA, 25 bp, Mus musculus
catgggtgcctgagggtgtttccaa

SEQ ID NO: 331589 - DNA, 25 bp, Mus musculus
catgggtgcctgtgggtgtttccaa

SEQ ID NO: 331590 - DNA, 25 bp, Mus musculus
catgggtggccaaggacactcctgg

SEQ ID NO: 331591 - DNA, 25 bp, Mus musculus
catgggtggccacggtaatgattcc

SEQ ID NO: 331592 - DNA, 25 bp, Mus musculus
catgggtggccagggtaatgattcc

SEQ ID NO: 331593 - DNA, 25 bp, Mus musculus
catgggtggccatggacactcctgg

SEQ ID NO: 331594 - DNA, 25 bp, Mus musculus
catgggtgggacacattaaaaggtg

SEQ ID NO: 331595 - DNA, 25 bp, Mus musculus
catgggtgggactcattaaaaggtg

SEQ ID NO: 331596 - DNA, 25 bp, Mus musculus
catgggtgtcttactagcgcactat

SEQ ID NO: 331597 - DNA, 25 bp, Mus musculus
catgggtgtctttctagcgcactat

SEQ ID NO: 331598 - DNA, 25 bp, Mus musculus
catgggtgtgttctttctatgtgca

SEQ ID NO: 331599 - DNA, 25 bp, Mus musculus
catgggtgtgttgtttctatgtgca

SEQ ID NO: 331600 - DNA, 25 bp, Mus musculus
catgggtgttcaagggtgtaatccc

SEQ ID NO: 331601 - DNA, 25 bp, Mus musculus
catgggtgttcatgggtgtaatccc

SEQ ID NO: 331602 - DNA, 25 bp, Mus musculus
catgggtgttgtcagtaccactgct

SEQ ID NO: 331603 - DNA, 25 bp, Mus musculus
catgggtgttgtcggcccttaaccg

SEQ ID NO: 331604 - DNA, 25 bp, Mus musculus
catgggtgttgtgagtaccactgct

SEQ ID NO: 331605 - DNA, 25 bp, Mus musculus
catgggtgttgtgggcccttaaccg

SEQ ID NO: 331606 - DNA, 25 bp, Mus musculus
catgggtgtttaaacagttagatgc

SEQ ID NO: 331607 - DNA, 25 bp, Mus musculus
catgggtgtttatacagttagatgc

SEQ ID NO: 331608 - DNA, 25 bp, Mus musculus
catgggttactgcatgggtcataaa

SEQ ID NO: 331609 - DNA, 25 bp, Mus musculus
catgggttactggatgggtcataaa

SEQ ID NO: 331610 - DNA, 25 bp, Mus musculus
catgggttattgaataggatcctaa

SEQ ID NO: 331611 - DNA, 25 bp, Mus musculus
catgggttattgtataggatcctaa

SEQ ID NO: 331612 - DNA, 25 bp, Mus musculus
catgggttcaacaaaggccttccga

SEQ ID NO: 331613 - DNA, 25 bp, Mus musculus
catgggttcaactaaggccttccga

SEQ ID NO: 331614 - DNA, 25 bp, Mus musculus
catgggttcatcacataccacaggc

SEQ ID NO: 331615 - DNA, 25 bp, Mus musculus
catgggttcatctcataccacaggc

SEQ ID NO: 331616 - DNA, 25 bp, Mus musculus
catgggttccatcgctacactaaaa

SEQ ID NO: 331617 - DNA, 25 bp, Mus musculus
catgggttccatggctacactaaaa

SEQ ID NO: 331618 - DNA, 25 bp, Mus musculus
catgggttcctccatgtgtagtcct

SEQ ID NO: 331619 - DNA, 25 bp, Mus musculus
catgggttcctcgatgtgtagtcct

SEQ ID NO: 331620 - DNA, 25 bp, Mus musculus
catgggttctacaaccagtcacaat

SEQ ID NO: 331621 - DNA, 25 bp, Mus musculus
catgggttctacagcaatgctccac

SEQ ID NO: 331622 - DNA, 25 bp, Mus musculus
catgggttctactaccagtcacaat

SEQ ID NO: 331623 - DNA, 25 bp, Mus musculus
catgggttctactgcaatgctccac

SEQ ID NO: 331624 - DNA, 25 bp, Mus musculus
catgggttgattagagtaattttgt

SEQ ID NO: 331625 - DNA, 25 bp, Mus musculus
catgggttgatttgagtaattttgt

SEQ ID NO: 331626 - DNA, 25 bp, Mus musculus
catgggttggaaaccgtgacttccc

SEQ ID NO: 331627 - DNA, 25 bp, Mus musculus
catgggttggaatccgtgacttccc

SEQ ID NO: 331628 - DNA, 25 bp, Mus musculus
catgggttgtttctggcttttcagg

SEQ ID NO: 331629 - DNA, 25 bp, Mus musculus
catgggttgtttctggcttttgagg

SEQ ID NO: 331630 - DNA, 25 bp, Mus musculus
catgggttgtttgtggcttttcagg

SEQ ID NO: 331631 - DNA, 25 bp, Mus musculus
catgggttgtttgtggcttttgagg

SEQ ID NO: 331632 - DNA, 25 bp, Mus musculus
catgggtttcctatactttctgagt

SEQ ID NO: 331633 - DNA, 25 bp, Mus musculus
catgggtttcctttactttctgagt

SEQ ID NO: 331634 - DNA, 25 bp, Mus musculus
catgggtttcttctgtttctgccat

SEQ ID NO: 331635 - DNA, 25 bp, Mus musculus
catgggtttcttgtgtttctgccat

SEQ ID NO: 331636 - DNA, 25 bp, Mus musculus
catgggtttgtgcttgcgttcagac

SEQ ID NO: 331637 - DNA, 25 bp, Mus musculus
catgggtttgtggttgcgttcagac

SEQ ID NO: 331638 - DNA, 25 bp, Mus musculus
catgggtttgttccactttgttgtc

SEQ ID NO: 331639 - DNA, 25 bp, Mus musculus
catgggtttgttgcactttgttgtc

SEQ ID NO: 331640 - DNA, 25 bp, Mus musculus
catggtaaaaggagtctcctccctt

SEQ ID NO: 331641 - DNA, 25 bp, Mus musculus
catggtaaaaggtgtctcctccctt

SEQ ID NO: 331642 - DNA, 25 bp, Mus musculus
catggtaactttcaaactaacctgg

SEQ ID NO: 331643 - DNA, 25 bp, Mus musculus
catggtaactttgaaactaacctgg

SEQ ID NO: 331644 - DNA, 25 bp, Mus musculus
catggtaatcttatgaacgacatca

SEQ ID NO: 331645 - DNA, 25 bp, Mus musculus
catggtaatcttcgtcactcggtga

SEQ ID NO: 331646 - DNA, 25 bp, Mus musculus
catggtaatcttggtcactcggtga

SEQ ID NO: 331647 - DNA, 25 bp, Mus musculus
catggtaatcttttgaacgacatca

SEQ ID NO: 331648 - DNA, 25 bp, Mus musculus
catggtaatgaccatctctctgaag

SEQ ID NO: 331649 - DNA, 25 bp, Mus musculus
catggtaatgacgatctctctgaag

SEQ ID NO: 331650 - DNA, 25 bp, Mus musculus
catggtaattttcaaggatgattcc

SEQ ID NO: 331651 - DNA, 25 bp, Mus musculus
catggtaattttgaaggatgattcc

SEQ ID NO: 331652 - DNA, 25 bp, Mus musculus
catggtacccatagatatgcattta

SEQ ID NO: 331653 - DNA, 25 bp, Mus musculus
catggtacccattgatatgcattta

SEQ ID NO: 331654 - DNA, 25 bp, Mus musculus
catggtactagtcctgtggactgaa

SEQ ID NO: 331655 - DNA, 25 bp, Mus musculus
catggtactagtgctgtggactgaa

SEQ ID NO: 331656 - DNA, 25 bp, Mus musculus
catggtactatactcagtcctctta

SEQ ID NO: 331657 - DNA, 25 bp, Mus musculus
catggtactatagtcagtcctctta

SEQ ID NO: 331658 - DNA, 25 bp, Mus musculus
catggtactggcaggtggaattcaa

SEQ ID NO: 331659 - DNA, 25 bp, Mus musculus
catggtactggctggtggaattcaa

SEQ ID NO: 331660 - DNA, 25 bp, Mus musculus
catggtagagacaggcctgctgtat

SEQ ID NO: 331661 - DNA, 25 bp, Mus musculus
catggtagagactggcctgctgtat

SEQ ID NO: 331662 - DNA, 25 bp, Mus musculus
catggtagattcagtgtctccaccc

SEQ ID NO: 331663 - DNA, 25 bp, Mus musculus
catggtagattctgtgtctccaccc

SEQ ID NO: 331664 - DNA, 25 bp, Mus musculus
catggtagcacaagctgtaataaaa

SEQ ID NO: 331665 - DNA, 25 bp, Mus musculus
catggtagcacatgctgtaataaaa

SEQ ID NO: 331666 - DNA, 25 bp, Mus musculus
catggtagccatcgaagtattctct

SEQ ID NO: 331667 - DNA, 25 bp, Mus musculus
catggtagccatggaagtattctct

SEQ ID NO: 331668 - DNA, 25 bp, Mus musculus
catggtagctatcaggacctctggt

SEQ ID NO: 331669 - DNA, 25 bp, Mus musculus
catggtagctatgaggacctctggt

SEQ ID NO: 331670 - DNA, 25 bp, Mus musculus
catggtagctgcaggtgacacggct

SEQ ID NO: 331671 - DNA, 25 bp, Mus musculus
catggtagctgctggtgacacggct

SEQ ID NO: 331672 - DNA, 25 bp, Mus musculus
catggtagcttacacttttcttccc

SEQ ID NO: 331673 - DNA, 25 bp, Mus musculus
catggtagcttagacttttcttccc

SEQ ID NO: 331674 - DNA, 25 bp, Mus musculus
catggtagcttcaacaaccatctcg

SEQ ID NO: 331675 - DNA, 25 bp, Mus musculus
catggtagcttcaaggtctgctgcc

SEQ ID NO: 331676 - DNA, 25 bp, Mus musculus
catggtagcttctacaaccatctcg

SEQ ID NO: 331677 - DNA, 25 bp, Mus musculus
catggtagcttctaggtctgctgcc

SEQ ID NO: 331678 - DNA, 25 bp, Mus musculus
catggtagttctcggtaggtgtata

SEQ ID NO: 331679 - DNA, 25 bp, Mus musculus
catggtagttctgggtaggtgtata

SEQ ID NO: 331680 - DNA, 25 bp, Mus musculus
catggtatgtttataaaacttcaga

SEQ ID NO: 331681 - DNA, 25 bp, Mus musculus
catggtatgtttttaaaacttcaga

SEQ ID NO: 331682 - DNA, 25 bp, Mus musculus
catggtattgtgacaaatgcctatc

SEQ ID NO: 331683 - DNA, 25 bp, Mus musculus
catggtattgtgtcaaatgcctatc

SEQ ID NO: 331684 - DNA, 25 bp, Mus musculus
catggtcaaagaacaagccccttgt

SEQ ID NO: 331685 - DNA, 25 bp, Mus musculus
catggtcaaagatcaagccccttgt

SEQ ID NO: 331686 - DNA, 25 bp, Mus musculus
catggtcacttaaagtttgctgtat

SEQ ID NO: 331687 - DNA, 25 bp, Mus musculus
catggtcacttatagtttgctgtat

SEQ ID NO: 331688 - DNA, 25 bp, Mus musculus
catggtcagcagctacccgacactg

SEQ ID NO: 331689 - DNA, 25 bp, Mus musculus
catggtcagcaggtacccgacactg

SEQ ID NO: 331690 - DNA, 25 bp, Mus musculus
catggtcatgaaatggctggtgcca

SEQ ID NO: 331691 - DNA, 25 bp, Mus musculus
catggtcatgaattggctggtgcca

SEQ ID NO: 331692 - DNA, 25 bp, Mus musculus
catggtcatgcaattctcttcactg

SEQ ID NO: 331693 - DNA, 25 bp, Mus musculus
catggtcatgcatttctcttcactg

SEQ ID NO: 331694 - DNA, 25 bp, Mus musculus
catggtcatgttccttactggacaa

SEQ ID NO: 331695 - DNA, 25 bp, Mus musculus
catggtcatgttgcttactggacaa

SEQ ID NO: 331696 - DNA, 25 bp, Mus musculus
catggtcattgcaggaggtctaaac

SEQ ID NO: 331697 - DNA, 25 bp, Mus musculus
catggtcattgctggaggtctaaac

SEQ ID NO: 331698 - DNA, 25 bp, Mus musculus
catggtccatgacctgaacaggtac

SEQ ID NO: 331699 - DNA, 25 bp, Mus musculus
catggtccatgagctgaacaggtac

SEQ ID NO: 331700 - DNA, 25 bp, Mus musculus
catggtcctgttcaatatgtttaac

SEQ ID NO: 331701 - DNA, 25 bp, Mus musculus
catggtcctgttgaatatgtttaac

SEQ ID NO: 331702 - DNA, 25 bp, Mus musculus
catggtctcaggcaagctggatgcc

SEQ ID NO: 331703 - DNA, 25 bp, Mus musculus
catggtctcagggaagctggatgcc

SEQ ID NO: 331704 - DNA, 25 bp, Mus musculus
catggtctcatcagggaatcttaac

SEQ ID NO: 331705 - DNA, 25 bp, Mus musculus
catggtctcatctgggaatcttaac

SEQ ID NO: 331706 - DNA, 25 bp, Mus musculus
catggtctgccgagcgggacgagta

SEQ ID NO: 331707 - DNA, 25 bp, Mus musculus
catggtctgccgtgcgggacgagta

SEQ ID NO: 331708 - DNA, 25 bp, Mus musculus
catggtcttcatcgctgagcagtct

SEQ ID NO: 331709 - DNA, 25 bp, Mus musculus
catggtcttcatggctgagcagtct

SEQ ID NO: 331710 - DNA, 25 bp, Mus musculus
catggtctttcaaacttgtttgtag

SEQ ID NO: 331711 - DNA, 25 bp, Mus musculus
catggtctttcatacttgtttgtag

SEQ ID NO: 331712 - DNA, 25 bp, Mus musculus
catggtctttcgacacagcaataga

SEQ ID NO: 331713 - DNA, 25 bp, Mus musculus
catggtctttcgtcacagcaataga

SEQ ID NO: 331714 - DNA, 25 bp, Mus musculus
catggtctttctccagggaaggcga

SEQ ID NO: 331715 - DNA, 25 bp, Mus musculus
catggtctttctgcagggaaggcga

SEQ ID NO: 331716 - DNA, 25 bp, Mus musculus
catggtcttttaatggcttggtact

SEQ ID NO: 331717 - DNA, 25 bp, Mus musculus
catggtcttttattggcttggtact

SEQ ID NO: 331718 - DNA, 25 bp, Mus musculus
catggtgaacttaactgctgaggaa

SEQ ID NO: 331719 - DNA, 25 bp, Mus musculus
catggtgaactttactgctgaggaa

SEQ ID NO: 331720 - DNA, 25 bp, Mus musculus
catggtgaatgcaatggaccgaagt

SEQ ID NO: 331721 - DNA, 25 bp, Mus musculus
catggtgaatgctatggaccgaagt

SEQ ID NO: 331722 - DNA, 25 bp, Mus musculus
catggtgaatgtccaaaacccctaa

SEQ ID NO: 331723 - DNA, 25 bp, Mus musculus
catggtgaatgtgcaaaacccctaa

SEQ ID NO: 331724 - DNA, 25 bp, Mus musculus
catggtgacgatattcccaggatca

SEQ ID NO: 331725 - DNA, 25 bp, Mus musculus
catggtgacgattttcccaggatca

SEQ ID NO: 331726 - DNA, 25 bp, Mus musculus
catggtgactttctggacttttagc

SEQ ID NO: 331727 - DNA, 25 bp, Mus musculus
catggtgactttgtggacttttagc

SEQ ID NO: 331728 - DNA, 25 bp, Mus musculus
catggtgagtctcagggccctgaaa

SEQ ID NO: 331729 - DNA, 25 bp, Mus musculus
catggtgagtctgagggccctgaaa

SEQ ID NO: 331730 - DNA, 25 bp, Mus musculus
catggtgagttcatgtgtctgttta

SEQ ID NO: 331731 - DNA, 25 bp, Mus musculus
catggtgagttcttgtgtctgttta

SEQ ID NO: 331732 - DNA, 25 bp, Mus musculus
catggtgataccatcccacacatga

SEQ ID NO: 331733 - DNA, 25 bp, Mus musculus
catggtgataccttcccacacatga

SEQ ID NO: 331734 - DNA, 25 bp, Mus musculus
catggtgatcgtctcttggtatttt

SEQ ID NO: 331735 - DNA, 25 bp, Mus musculus
catggtgatcgtgtcttggtatttt

SEQ ID NO: 331736 - DNA, 25 bp, Mus musculus
catggtgatgacctgcaactgctgt

SEQ ID NO: 331737 - DNA, 25 bp, Mus musculus
catggtgatgacgtgcaactgctgt

SEQ ID NO: 331738 - DNA, 25 bp, Mus musculus
catggtgatgcccaatctttatggc

SEQ ID NO: 331739 - DNA, 25 bp, Mus musculus
catggtgatgccgaatctttatggc

SEQ ID NO: 331740 - DNA, 25 bp, Mus musculus
catggtgattgtacatacctctctt

SEQ ID NO: 331741 - DNA, 25 bp, Mus musculus
catggtgattgtaggttgacctagc

SEQ ID NO: 331742 - DNA, 25 bp, Mus musculus
catggtgattgttcatacctctctt

SEQ ID NO: 331743 - DNA, 25 bp, Mus musculus
catggtgattgttggttgacctagc

SEQ ID NO: 331744 - DNA, 25 bp, Mus musculus
catggtgcactaagccacagaggag

SEQ ID NO: 331745 - DNA, 25 bp, Mus musculus
catggtgcactatgccacagaggag

SEQ ID NO: 331746 - DNA, 25 bp, Mus musculus
catggtgcagctaatttgtaaatat

SEQ ID NO: 331747 - DNA, 25 bp, Mus musculus
catggtgcagcttatttgtaaatat

SEQ ID NO: 331748 - DNA, 25 bp, Mus musculus
catggtgcagtcagtattgtaccta

SEQ ID NO: 331749 - DNA, 25 bp, Mus musculus
catggtgcagtctgtattgtaccta

SEQ ID NO: 331750 - DNA, 25 bp, Mus musculus
catggtgcatacatgagggggttta

SEQ ID NO: 331751 - DNA, 25 bp, Mus musculus
catggtgcatacttgagggggttta

SEQ ID NO: 331752 - DNA, 25 bp, Mus musculus
catggtgcatgacctcaaccggtac

SEQ ID NO: 331753 - DNA, 25 bp, Mus musculus
catggtgcatgagctcaaccggtac

SEQ ID NO: 331754 - DNA, 25 bp, Mus musculus
catggtgccagactgcagtacagct

SEQ ID NO: 331755 - DNA, 25 bp, Mus musculus
catggtgccagagtgcagtacagct

SEQ ID NO: 331756 - DNA, 25 bp, Mus musculus
catggtgccagtatggttccagtat

SEQ ID NO: 331757 - DNA, 25 bp, Mus musculus
catggtgccagtttggttccagtat

SEQ ID NO: 331758 - DNA, 25 bp, Mus musculus
catggtgccatacaggtcagtgcct

SEQ ID NO: 331759 - DNA, 25 bp, Mus musculus
catggtgccatagaggtcagtgcct

SEQ ID NO: 331760 - DNA, 25 bp, Mus musculus
catggtgcccaaagtgcccgaggtg

SEQ ID NO: 331761 - DNA, 25 bp, Mus musculus
catggtgcccaatgtgcccgaggtg

SEQ ID NO: 331762 - DNA, 25 bp, Mus musculus
catggtgccctcatagataaataga

SEQ ID NO: 331763 - DNA, 25 bp, Mus musculus
catggtgccctcttagataaataga

SEQ ID NO: 331764 - DNA, 25 bp, Mus musculus
catggtgccgaactcagtacattct

SEQ ID NO: 331765 - DNA, 25 bp, Mus musculus
catggtgccgaagtcagtacattct

SEQ ID NO: 331766 - DNA, 25 bp, Mus musculus
catggtgcctgtagtacttgtatat

SEQ ID NO: 331767 - DNA, 25 bp, Mus musculus
catggtgcctgttgtacttgtatat

SEQ ID NO: 331768 - DNA, 25 bp, Mus musculus
catggtgcgcataggcgtcttctcg

SEQ ID NO: 331769 - DNA, 25 bp, Mus musculus
catggtgcgcattggcgtcttctcg

SEQ ID NO: 331770 - DNA, 25 bp, Mus musculus
catggtgcgcctacacagcaataga

SEQ ID NO: 331771 - DNA, 25 bp, Mus musculus
catggtgcgccttcacagcaataga

SEQ ID NO: 331772 - DNA, 25 bp, Mus musculus
catggtgctattacaggctgacaaa

SEQ ID NO: 331773 - DNA, 25 bp, Mus musculus
catggtgctatttcaggctgacaaa

SEQ ID NO: 331774 - DNA, 25 bp, Mus musculus
catggtgctcagagcttttgctttg

SEQ ID NO: 331775 - DNA, 25 bp, Mus musculus
catggtgctcagtgcttttgctttg

SEQ ID NO: 331776 - DNA, 25 bp, Mus musculus
catggtgctgcacacttctaaagca

SEQ ID NO: 331777 - DNA, 25 bp, Mus musculus
catggtgctgcagacttctaaagca

SEQ ID NO: 331778 - DNA, 25 bp, Mus musculus
catggtgctggaatagaccccacag

SEQ ID NO: 331779 - DNA, 25 bp, Mus musculus
catggtgctggattagaccccacag

SEQ ID NO: 331780 - DNA, 25 bp, Mus musculus
catggtggaattagcagtggccctg

SEQ ID NO: 331781 - DNA, 25 bp, Mus musculus
catggtggaatttgcagtggccctg

SEQ ID NO: 331782 - DNA, 25 bp, Mus musculus
catggtggatataacagctctgcaa

SEQ ID NO: 331783 - DNA, 25 bp, Mus musculus
catggtggatattacagctctgcaa

SEQ ID NO: 331784 - DNA, 25 bp, Mus musculus
catggtggccaaatatccacgatgg

SEQ ID NO: 331785 - DNA, 25 bp, Mus musculus
catggtggccaattatccacgatgg

SEQ ID NO: 331786 - DNA, 25 bp, Mus musculus
catggtggccacaatattagagcag

SEQ ID NO: 331787 - DNA, 25 bp, Mus musculus
catggtggccactatattagagcag

SEQ ID NO: 331788 - DNA, 25 bp, Mus musculus
catggtggccgtcgaaattctttca

SEQ ID NO: 331789 - DNA, 25 bp, Mus musculus
catggtggccgtggaaattctttca

SEQ ID NO: 331790 - DNA, 25 bp, Mus musculus
catggtggctcaactccgaatagaa

SEQ ID NO: 331791 - DNA, 25 bp, Mus musculus
catggtggctcatctccgaatagaa

SEQ ID NO: 331792 - DNA, 25 bp, Mus musculus
catggtgggcatcccggacatatgc

SEQ ID NO: 331793 - DNA, 25 bp, Mus musculus
catggtgggcatgccggacatatgc

SEQ ID NO: 331794 - DNA, 25 bp, Mus musculus
catggtgggtcacttcttttttaca

SEQ ID NO: 331795 - DNA, 25 bp, Mus musculus
catggtgggtcagttcttttttaca

SEQ ID NO: 331796 - DNA, 25 bp, Mus musculus
catggtgggtctcgagagcctctcc

SEQ ID NO: 331797 - DNA, 25 bp, Mus musculus
catggtgggtctggagagcctctcc

SEQ ID NO: 331798 - DNA, 25 bp, Mus musculus
catggtggtcgtcacttttccataa

SEQ ID NO: 331799 - DNA, 25 bp, Mus musculus
catggtggtcgtgacttttccataa

SEQ ID NO: 331800 - DNA, 25 bp, Mus musculus
catggtggtgggattctatcatcct

SEQ ID NO: 331801 - DNA, 25 bp, Mus musculus
catggtggtgggtttctatcatcct

SEQ ID NO: 331802 - DNA, 25 bp, Mus musculus
catggtggtgtgctcggaacttccc

SEQ ID NO: 331803 - DNA, 25 bp, Mus musculus
catggtggtgtggtcggaacttccc

SEQ ID NO: 331804 - DNA, 25 bp, Mus musculus
catggtgtacttccagctgtgtgca

SEQ ID NO: 331805 - DNA, 25 bp, Mus musculus
catggtgtacttgcagctgtgtgca

SEQ ID NO: 331806 - DNA, 25 bp, Mus musculus
catggtgtcataagcctggaattct

SEQ ID NO: 331807 - DNA, 25 bp, Mus musculus
catggtgtcatatgcctggaattct

SEQ ID NO: 331808 - DNA, 25 bp, Mus musculus
catggtgtccatcctgtaacagtgg

SEQ ID NO: 331809 - DNA, 25 bp, Mus musculus
catggtgtccatgctgtaacagtgg

SEQ ID NO: 331810 - DNA, 25 bp, Mus musculus
catggtgtcccaccgatctggggaa

SEQ ID NO: 331811 - DNA, 25 bp, Mus musculus
catggtgtcccagcgatctggggaa

SEQ ID NO: 331812 - DNA, 25 bp, Mus musculus
catggtgtctgtaacaggtgagcct

SEQ ID NO: 331813 - DNA, 25 bp, Mus musculus
catggtgtctgttacaggtgagcct

SEQ ID NO: 331814 - DNA, 25 bp, Mus musculus
catggtgtcttaaatgtctcataac

SEQ ID NO: 331815 - DNA, 25 bp, Mus musculus
catggtgtcttaatggctggtatca

SEQ ID NO: 331816 - DNA, 25 bp, Mus musculus
catggtgtcttatatgtctcataac

SEQ ID NO: 331817 - DNA, 25 bp, Mus musculus
catggtgtcttattggctggtatca

SEQ ID NO: 331818 - DNA, 25 bp, Mus musculus
catggtgtgcgcaggcgacatgaaa

SEQ ID NO: 331819 - DNA, 25 bp, Mus musculus
catggtgtgcgctggcgacatgaaa

SEQ ID NO: 331820 - DNA, 25 bp, Mus musculus
catggtgtgctgagtgactgactga

SEQ ID NO: 331821 - DNA, 25 bp, Mus musculus
catggtgtgctgtgtgactgactga

SEQ ID NO: 331822 - DNA, 25 bp, Mus musculus
catggtgtggccatttccaataccc

SEQ ID NO: 331823 - DNA, 25 bp, Mus musculus
catggtgtggccttttccaataccc

SEQ ID NO: 331824 - DNA, 25 bp, Mus musculus
catggtgttgcaaacaggtgacctc

SEQ ID NO: 331825 - DNA, 25 bp, Mus musculus
catggtgttgcatacaggtgacctc

SEQ ID NO: 331826 - DNA, 25 bp, Mus musculus
catggtgtttccagcctgagtgtga

SEQ ID NO: 331827 - DNA, 25 bp, Mus musculus
catggtgtttcctgcctgagtgtga

SEQ ID NO: 331828 - DNA, 25 bp, Mus musculus
catggttacaggcttatctccttcc

SEQ ID NO: 331829 - DNA, 25 bp, Mus musculus
catggttacagggttatctccttcc

SEQ ID NO: 331830 - DNA, 25 bp, Mus musculus
catggttaccctaaactcaaacttg

SEQ ID NO: 331831 - DNA, 25 bp, Mus musculus
catggttacccttaactcaaacttg

SEQ ID NO: 331832 - DNA, 25 bp, Mus musculus
catggttactgtcctaagtgtgttt

SEQ ID NO: 331833 - DNA, 25 bp, Mus musculus
catggttactgtgctaagtgtgttt

SEQ ID NO: 331834 - DNA, 25 bp, Mus musculus
catggttagagtccagcactggcac

SEQ ID NO: 331835 - DNA, 25 bp, Mus musculus
catggttagagtgcagcactggcac

SEQ ID NO: 331836 - DNA, 25 bp, Mus musculus
catggttatttcatctccacatcat

SEQ ID NO: 331837 - DNA, 25 bp, Mus musculus
catggttatttcttctccacatcat

SEQ ID NO: 331838 - DNA, 25 bp, Mus musculus
catggttccccacatatgtgcatgt

SEQ ID NO: 331839 - DNA, 25 bp, Mus musculus
catggttccccagatatgtgcatgt

SEQ ID NO: 331840 - DNA, 25 bp, Mus musculus
catggttccctcagtatactagcct

SEQ ID NO: 331841 - DNA, 25 bp, Mus musculus
catggttccctctgtatactagcct

SEQ ID NO: 331842 - DNA, 25 bp, Mus musculus
catggttctgataggacacggttct

SEQ ID NO: 331843 - DNA, 25 bp, Mus musculus
catggttctgattggacacggttct

SEQ ID NO: 331844 - DNA, 25 bp, Mus musculus
catggttcttctccctgtaatcgag

SEQ ID NO: 331845 - DNA, 25 bp, Mus musculus
catggttcttctgcctgtaatcgag

SEQ ID NO: 331846 - DNA, 25 bp, Mus musculus
catggttgaaacataccttcagtcc

SEQ ID NO: 331847 - DNA, 25 bp, Mus musculus
catggttgaaacttaccttcagtcc

SEQ ID NO: 331848 - DNA, 25 bp, Mus musculus
catggttgacgtagcaaaggcgctt

SEQ ID NO: 331849 - DNA, 25 bp, Mus musculus
catggttgacgttgcaaaggcgctt

SEQ ID NO: 331850 - DNA, 25 bp, Mus musculus
catggttgagtaagtgttcctagga

SEQ ID NO: 331851 - DNA, 25 bp, Mus musculus
catggttgagtatgtgttcctagga

SEQ ID NO: 331852 - DNA, 25 bp, Mus musculus
catggttgagtcactggtcaaggaa

SEQ ID NO: 331853 - DNA, 25 bp, Mus musculus
catggttgagtctctggtcaaggaa

SEQ ID NO: 331854 - DNA, 25 bp, Mus musculus
catggttgcattaaaagctctgtaa

SEQ ID NO: 331855 - DNA, 25 bp, Mus musculus
catggttgcatttaaagctctgtaa

SEQ ID NO: 331856 - DNA, 25 bp, Mus musculus
catggttggatcacctgatcaccat

SEQ ID NO: 331857 - DNA, 25 bp, Mus musculus
catggttggatctcctgatcaccat

SEQ ID NO: 331858 - DNA, 25 bp, Mus musculus
catggttgggttagattctgattta

SEQ ID NO: 331859 - DNA, 25 bp, Mus musculus
catggttgggtttgattctgattta

SEQ ID NO: 331860 - DNA, 25 bp, Mus musculus
catggttggttaactgcttctttcc

SEQ ID NO: 331861 - DNA, 25 bp, Mus musculus
catggttggttatctgcttctttcc

SEQ ID NO: 331862 - DNA, 25 bp, Mus musculus
catggttgtaatattttccccagct

SEQ ID NO: 331863 - DNA, 25 bp, Mus musculus
catggttgtaattttttccccagct

SEQ ID NO: 331864 - DNA, 25 bp, Mus musculus
catggttgtattagttcagcttcct

SEQ ID NO: 331865 - DNA, 25 bp, Mus musculus
catggttgtatttgttcagcttcct

SEQ ID NO: 331866 - DNA, 25 bp, Mus musculus
catggttgtgggattgccgtttatt

SEQ ID NO: 331867 - DNA, 25 bp, Mus musculus
catggttgtgggtttgccgtttatt

SEQ ID NO: 331868 - DNA, 25 bp, Mus musculus
catggttgtgtgaaggaggccttcc

SEQ ID NO: 331869 - DNA, 25 bp, Mus musculus
catggttgtgtgatgtgttactaat

SEQ ID NO: 331870 - DNA, 25 bp, Mus musculus
catggttgtgtgtaggaggccttcc

SEQ ID NO: 331871 - DNA, 25 bp, Mus musculus
catggttgtgtgttgtgttactaat

SEQ ID NO: 331872 - DNA, 25 bp, Mus musculus
catggtttaatgagttccctttaca

SEQ ID NO: 331873 - DNA, 25 bp, Mus musculus
catggtttaatgtgttccctttaca

SEQ ID NO: 331874 - DNA, 25 bp, Mus musculus
catggtttatgtagccaggctcagg

SEQ ID NO: 331875 - DNA, 25 bp, Mus musculus
catggtttatgttgccaggctcagg

SEQ ID NO: 331876 - DNA, 25 bp, Mus musculus
catggtttattgctattcagagatc

SEQ ID NO: 331877 - DNA, 25 bp, Mus musculus
catggtttattggtattcagagatc

SEQ ID NO: 331878 - DNA, 25 bp, Mus musculus
catggtttcataaggtgattcttac

SEQ ID NO: 331879 - DNA, 25 bp, Mus musculus
catggtttcatatggtgattcttac

SEQ ID NO: 331880 - DNA, 25 bp, Mus musculus
catggtttcatgcaactgttatttc

SEQ ID NO: 331881 - DNA, 25 bp, Mus musculus
catggtttcatggaactgttatttc

SEQ ID NO: 331882 - DNA, 25 bp, Mus musculus
catggtttccagaatctttagtgtg

SEQ ID NO: 331883 - DNA, 25 bp, Mus musculus
catggtttccagtatctttagtgtg

SEQ ID NO: 331884 - DNA, 25 bp, Mus musculus
catggtttctcacgtgtggtggcac

SEQ ID NO: 331885 - DNA, 25 bp, Mus musculus
catggtttctcaggtgtggtggcac

SEQ ID NO: 331886 - DNA, 25 bp, Mus musculus
catggtttctgtctagtcgaaagca

SEQ ID NO: 331887 - DNA, 25 bp, Mus musculus
catggtttctgtgtagtcgaaagca

SEQ ID NO: 331888 - DNA, 25 bp, Mus musculus
catggtttcttgagtagcactggtt

SEQ ID NO: 331889 - DNA, 25 bp, Mus musculus
catggtttcttgtgtagcactggtt

SEQ ID NO: 331890 - DNA, 25 bp, Mus musculus
catggtttgcgcattttatgtcatt

SEQ ID NO: 331891 - DNA, 25 bp, Mus musculus
catggtttgcgctttttatgtcatt

SEQ ID NO: 331892 - DNA, 25 bp, Mus musculus
catggtttggatccttctatattgc

SEQ ID NO: 331893 - DNA, 25 bp, Mus musculus
catggtttggatgcttctatattgc

SEQ ID NO: 331894 - DNA, 25 bp, Mus musculus
catggtttggtacctgagtcatttt

SEQ ID NO: 331895 - DNA, 25 bp, Mus musculus
catggtttggtagctgagtcatttt

SEQ ID NO: 331896 - DNA, 25 bp, Mus musculus
catggttttataaaacggttaccag

SEQ ID NO: 331897 - DNA, 25 bp, Mus musculus
catggttttatataacggttaccag

SEQ ID NO: 331898 - DNA, 25 bp, Mus musculus
catggttttcatccctagtggctac

SEQ ID NO: 331899 - DNA, 25 bp, Mus musculus
catggttttcatgcctagtggctac

SEQ ID NO: 331900 - DNA, 25 bp, Mus musculus
catggttttctaattcaaggttcct

SEQ ID NO: 331901 - DNA, 25 bp, Mus musculus
catggttttctatttcaaggttcct

SEQ ID NO: 331902 - DNA, 25 bp, Mus musculus
catggttttgacaagccctgagggt

SEQ ID NO: 331903 - DNA, 25 bp, Mus musculus
catggttttgacaccctattcatgc

SEQ ID NO: 331904 - DNA, 25 bp, Mus musculus
catggttttgactagccctgagggt

SEQ ID NO: 331905 - DNA, 25 bp, Mus musculus
catggttttgactccctattcatgc

SEQ ID NO: 331906 - DNA, 25 bp, Mus musculus
catggttttgctctgttcgtaggtc

SEQ ID NO: 331907 - DNA, 25 bp, Mus musculus
catggttttgctgtgttcgtaggtc

SEQ ID NO: 331908 - DNA, 25 bp, Mus musculus
catggtttttatcgtgtccgtgtac

SEQ ID NO: 331909 - DNA, 25 bp, Mus musculus
catggtttttatctgagaagttgca

SEQ ID NO: 331910 - DNA, 25 bp, Mus musculus
catggtttttatggtgtccgtgtac

SEQ ID NO: 331911 - DNA, 25 bp, Mus musculus
catggtttttatgtgagaagttgca

SEQ ID NO: 331912 - DNA, 25 bp, Mus musculus
catgtaaactacatcccctgggatt

SEQ ID NO: 331913 - DNA, 25 bp, Mus musculus
catgtaaactacttcccctgggatt

SEQ ID NO: 331914 - DNA, 25 bp, Mus musculus
catgtaaataccatgaccaccaggg

SEQ ID NO: 331915 - DNA, 25 bp, Mus musculus
catgtaaataccttgaccaccaggg

SEQ ID NO: 331916 - DNA, 25 bp, Mus musculus
catgtaacacccacaatacccagtg

SEQ ID NO: 331917 - DNA, 25 bp, Mus musculus
catgtaacaccctcaatacccagtg

SEQ ID NO: 331918 - DNA, 25 bp, Mus musculus
catgtaacccagatgtcctggagga

SEQ ID NO: 331919 - DNA, 25 bp, Mus musculus
catgtaacccagttgtcctggagga

SEQ ID NO: 331920 - DNA, 25 bp, Mus musculus
catgtaaccggaacccatctgagtt

SEQ ID NO: 331921 - DNA, 25 bp, Mus musculus
catgtaaccggatcccatctgagtt

SEQ ID NO: 331922 - DNA, 25 bp, Mus musculus
catgtaactggcacgggtctttgtt

SEQ ID NO: 331923 - DNA, 25 bp, Mus musculus
catgtaactggctcgggtctttgtt

SEQ ID NO: 331924 - DNA, 25 bp, Mus musculus
catgtaagattaacactgtggtgta

SEQ ID NO: 331925 - DNA, 25 bp, Mus musculus
catgtaagattatcactgtggtgta

SEQ ID NO: 331926 - DNA, 25 bp, Mus musculus
catgtaaggaggctatggtatagta

SEQ ID NO: 331927 - DNA, 25 bp, Mus musculus
catgtaaggagggtatggtatagta

SEQ ID NO: 331928 - DNA, 25 bp, Mus musculus
catgtaagggtgctgctgtgtagac

SEQ ID NO: 331929 - DNA, 25 bp, Mus musculus
catgtaagggtggtgctgtgtagac

SEQ ID NO: 331930 - DNA, 25 bp, Mus musculus
catgtaagtgttcagcctgttagta

SEQ ID NO: 331931 - DNA, 25 bp, Mus musculus
catgtaagtgttgagcctgttagta

SEQ ID NO: 331932 - DNA, 25 bp, Mus musculus
catgtaataatcatgtgacacacat

SEQ ID NO: 331933 - DNA, 25 bp, Mus musculus
catgtaataatcttgtgacacacat

SEQ ID NO: 331934 - DNA, 25 bp, Mus musculus
catgtaatcaagagcataggcctct

SEQ ID NO: 331935 - DNA, 25 bp, Mus musculus
catgtaatcaagtgcataggcctct

SEQ ID NO: 331936 - DNA, 25 bp, Mus musculus
catgtaatccataaattttgtggga

SEQ ID NO: 331937 - DNA, 25 bp, Mus musculus
catgtaatccattaattttgtggga

SEQ ID NO: 331938 - DNA, 25 bp, Mus musculus
catgtaatggtgatttacagttcac

SEQ ID NO: 331939 - DNA, 25 bp, Mus musculus
catgtaatggtgttttacagttcac

SEQ ID NO: 331940 - DNA, 25 bp, Mus musculus
catgtaatgttgctagagtgacctt

SEQ ID NO: 331941 - DNA, 25 bp, Mus musculus
catgtaatgttggtagagtgacctt

SEQ ID NO: 331942 - DNA, 25 bp, Mus musculus
catgtacaaagtagccatctccacc

SEQ ID NO: 331943 - DNA, 25 bp, Mus musculus
catgtacaaagttgccatctccacc

SEQ ID NO: 331944 - DNA, 25 bp, Mus musculus
catgtacacaataaatctcacgctt

SEQ ID NO: 331945 - DNA, 25 bp, Mus musculus
catgtacacaattaatctcacgctt

SEQ ID NO: 331946 - DNA, 25 bp, Mus musculus
catgtacacagacccactgggagct

SEQ ID NO: 331947 - DNA, 25 bp, Mus musculus
catgtacacagagccactgggagct

SEQ ID NO: 331948 - DNA, 25 bp, Mus musculus
catgtacaccagaaggatcaggctg

SEQ ID NO: 331949 - DNA, 25 bp, Mus musculus
catgtacaccagtaggatcaggctg

SEQ ID NO: 331950 - DNA, 25 bp, Mus musculus
catgtacagattcgagtcctttccc

SEQ ID NO: 331951 - DNA, 25 bp, Mus musculus
catgtacagattggagtcctttccc

SEQ ID NO: 331952 - DNA, 25 bp, Mus musculus
catgtacagcgtccctttgacatta

SEQ ID NO: 331953 - DNA, 25 bp, Mus musculus
catgtacagcgtgcctttgacatta

SEQ ID NO: 331954 - DNA, 25 bp, Mus musculus
catgtacagtgtaaggtgcttctcc

SEQ ID NO: 331955 - DNA, 25 bp, Mus musculus
catgtacagtgttaggtgcttctcc

SEQ ID NO: 331956 - DNA, 25 bp, Mus musculus
catgtacatatgaggccagggctct

SEQ ID NO: 331957 - DNA, 25 bp, Mus musculus
catgtacatatgtggccagggctct

SEQ ID NO: 331958 - DNA, 25 bp, Mus musculus
catgtacatctgacccacagcaaat

SEQ ID NO: 331959 - DNA, 25 bp, Mus musculus
catgtacatctgtcccacagcaaat

SEQ ID NO: 331960 - DNA, 25 bp, Mus musculus
catgtacatggcagcttcaagtgaa

SEQ ID NO: 331961 - DNA, 25 bp, Mus musculus
catgtacatggctgcttcaagtgaa

SEQ ID NO: 331962 - DNA, 25 bp, Mus musculus
catgtacatgtcattgtggatgaaa

SEQ ID NO: 331963 - DNA, 25 bp, Mus musculus
catgtacatgtctttgtggatgaaa

SEQ ID NO: 331964 - DNA, 25 bp, Mus musculus
catgtacattgtagccattgtgggc

SEQ ID NO: 331965 - DNA, 25 bp, Mus musculus
catgtacattgttgccattgtgggc

SEQ ID NO: 331966 - DNA, 25 bp, Mus musculus
catgtaccaacacgctgacgctggg

SEQ ID NO: 331967 - DNA, 25 bp, Mus musculus
catgtaccaacaggctgacgctggg

SEQ ID NO: 331968 - DNA, 25 bp, Mus musculus
catgtacctagcaacctattggtaa

SEQ ID NO: 331969 - DNA, 25 bp, Mus musculus
catgtacctagctacctattggtaa

SEQ ID NO: 331970 - DNA, 25 bp, Mus musculus
catgtacctggacaagtcgggcttt

SEQ ID NO: 331971 - DNA, 25 bp, Mus musculus
catgtacctggagaagtcgggcttt

SEQ ID NO: 331972 - DNA, 25 bp, Mus musculus
catgtacctgtgaaggcctcaagaa

SEQ ID NO: 331973 - DNA, 25 bp, Mus musculus
catgtacctgtgtaggcctcaagaa

SEQ ID NO: 331974 - DNA, 25 bp, Mus musculus
catgtaccttctaaagtggcgccac

SEQ ID NO: 331975 - DNA, 25 bp, Mus musculus
catgtaccttcttaagtggcgccac

SEQ ID NO: 331976 - DNA, 25 bp, Mus musculus
catgtactacttagataacccgggt

SEQ ID NO: 331977 - DNA, 25 bp, Mus musculus
catgtactactttgataacccgggt

SEQ ID NO: 331978 - DNA, 25 bp, Mus musculus
catgtactgcctcgtgatgctattc

SEQ ID NO: 331979 - DNA, 25 bp, Mus musculus
catgtactgcctctaatgctgagtt

SEQ ID NO: 331980 - DNA, 25 bp, Mus musculus
catgtactgcctggtgatgctattc

SEQ ID NO: 331981 - DNA, 25 bp, Mus musculus
catgtactgcctgtaatgctgagtt

SEQ ID NO: 331982 - DNA, 25 bp, Mus musculus
catgtactgggacaactgcgtttaa

SEQ ID NO: 331983 - DNA, 25 bp, Mus musculus
catgtactgggagaactgcgtttaa

SEQ ID NO: 331984 - DNA, 25 bp, Mus musculus
catgtactgggtctattttggtttt

SEQ ID NO: 331985 - DNA, 25 bp, Mus musculus
catgtactgggtgtattttggtttt

SEQ ID NO: 331986 - DNA, 25 bp, Mus musculus
catgtacttgctctctttgattggc

SEQ ID NO: 331987 - DNA, 25 bp, Mus musculus
catgtacttgctgtctttgattggc

SEQ ID NO: 331988 - DNA, 25 bp, Mus musculus
catgtacttgttcttggtctgtttg

SEQ ID NO: 331989 - DNA, 25 bp, Mus musculus
catgtacttgttgttggtctgtttg

SEQ ID NO: 331990 - DNA, 25 bp, Mus musculus
catgtagacctgcatgccagaggat

SEQ ID NO: 331991 - DNA, 25 bp, Mus musculus
catgtagacctggatgccagaggat

SEQ ID NO: 331992 - DNA, 25 bp, Mus musculus
catgtagacgccatggacgggtgct

SEQ ID NO: 331993 - DNA, 25 bp, Mus musculus
catgtagacgccttggacgggtgct

SEQ ID NO: 331994 - DNA, 25 bp, Mus musculus
catgtagatatgaaccacacttgtg

SEQ ID NO: 331995 - DNA, 25 bp, Mus musculus
catgtagatatgtaccacacttgtg

SEQ ID NO: 331996 - DNA, 25 bp, Mus musculus
catgtagatggtaggcttgagccct

SEQ ID NO: 331997 - DNA, 25 bp, Mus musculus
catgtagatggttggcttgagccct

SEQ ID NO: 331998 - DNA, 25 bp, Mus musculus
catgtagcatcccattttcactgac

SEQ ID NO: 331999 - DNA, 25 bp, Mus musculus
catgtagcatccgattttcactgac

SEQ ID NO: 332000 - DNA, 25 bp, Mus musculus
catgtagccagcaggcatcctaggg

SEQ ID NO: 332001 - DNA, 25 bp, Mus musculus
catgtagccagctggcatcctaggg

SEQ ID NO: 332002 - DNA, 25 bp, Mus musculus
catgtagcgtctcaggactgttatt

SEQ ID NO: 332003 - DNA, 25 bp, Mus musculus
catgtagcgtctgaggactgttatt

SEQ ID NO: 332004 - DNA, 25 bp, Mus musculus
catgtagctactataatttttaaaa

SEQ ID NO: 332005 - DNA, 25 bp, Mus musculus
catgtagctactttaatttttaaaa

SEQ ID NO: 332006 - DNA, 25 bp, Mus musculus
catgtagctggaacctaccttcttt

SEQ ID NO: 332007 - DNA, 25 bp, Mus musculus
catgtagctggatcctaccttcttt

SEQ ID NO: 332008 - DNA, 25 bp, Mus musculus
catgtagctgtcattaattggagga

SEQ ID NO: 332009 - DNA, 25 bp, Mus musculus
catgtagctgtctttaattggagga

SEQ ID NO: 332010 - DNA, 25 bp, Mus musculus
catgtaggccagctgagggtttcag

SEQ ID NO: 332011 - DNA, 25 bp, Mus musculus
catgtaggccaggtgagggtttcag

SEQ ID NO: 332012 - DNA, 25 bp, Mus musculus
catgtaggctcaactgctcagaaag

SEQ ID NO: 332013 - DNA, 25 bp, Mus musculus
catgtaggctcatctgctcagaaag

SEQ ID NO: 332014 - DNA, 25 bp, Mus musculus
catgtagtacgacgatcccggggct

SEQ ID NO: 332015 - DNA, 25 bp, Mus musculus
catgtagtacgaggatcccggggct

SEQ ID NO: 332016 - DNA, 25 bp, Mus musculus
catgtataattgagtgaaagatctg

SEQ ID NO: 332017 - DNA, 25 bp, Mus musculus
catgtataattgtgtgaaagatctg

SEQ ID NO: 332018 - DNA, 25 bp, Mus musculus
catgtatacccaattgtgtttttaa

SEQ ID NO: 332019 - DNA, 25 bp, Mus musculus
catgtatacccatttgtgtttttaa

SEQ ID NO: 332020 - DNA, 25 bp, Mus musculus
catgtatacctgaagcaaactggct

SEQ ID NO: 332021 - DNA, 25 bp, Mus musculus
catgtatacctgtagcaaactggct

SEQ ID NO: 332022 - DNA, 25 bp, Mus musculus
catgtatagcccaggtttaccccaa

SEQ ID NO: 332023 - DNA, 25 bp, Mus musculus
catgtatagccctggtttaccccaa

SEQ ID NO: 332024 - DNA, 25 bp, Mus musculus
catgtatagctacgtgtcttgattt

SEQ ID NO: 332025 - DNA, 25 bp, Mus musculus
catgtatagctaggtgtcttgattt

SEQ ID NO: 332026 - DNA, 25 bp, Mus musculus
catgtatagtttctggaatttttcc

SEQ ID NO: 332027 - DNA, 25 bp, Mus musculus
catgtatagtttgtggaatttttcc

SEQ ID NO: 332028 - DNA, 25 bp, Mus musculus
catgtatatattattgccaacaaga

SEQ ID NO: 332029 - DNA, 25 bp, Mus musculus
catgtatatatttttgccaacaaga

SEQ ID NO: 332030 - DNA, 25 bp, Mus musculus
catgtatatctaccatattttttct

SEQ ID NO: 332031 - DNA, 25 bp, Mus musculus
catgtatatctagcatattttttct

SEQ ID NO: 332032 - DNA, 25 bp, Mus musculus
catgtatattagaactttggcttgg

SEQ ID NO: 332033 - DNA, 25 bp, Mus musculus
catgtatattagtactttggcttgg

SEQ ID NO: 332034 - DNA, 25 bp, Mus musculus
catgtatcaaggagccagggatttt

SEQ ID NO: 332035 - DNA, 25 bp, Mus musculus
catgtatcaaggtgccagggatttt

SEQ ID NO: 332036 - DNA, 25 bp, Mus musculus
catgtatcaccaagcttggcgatag

SEQ ID NO: 332037 - DNA, 25 bp, Mus musculus
catgtatcaccatgcttggcgatag

SEQ ID NO: 332038 - DNA, 25 bp, Mus musculus
catgtatcccatcgtggcctcagtc

SEQ ID NO: 332039 - DNA, 25 bp, Mus musculus
catgtatcccatggtggcctcagtc

SEQ ID NO: 332040 - DNA, 25 bp, Mus musculus
catgtatcccttacctaggttaact

SEQ ID NO: 332041 - DNA, 25 bp, Mus musculus
catgtatccctttcctaggttaact

SEQ ID NO: 332042 - DNA, 25 bp, Mus musculus
catgtatctattaatctgtggctgt

SEQ ID NO: 332043 - DNA, 25 bp, Mus musculus
catgtatctatttatctgtggctgt

SEQ ID NO: 332044 - DNA, 25 bp, Mus musculus
catgtatcttccactgtttgagatg

SEQ ID NO: 332045 - DNA, 25 bp, Mus musculus
catgtatcttcctctgtttgagatg

SEQ ID NO: 332046 - DNA, 25 bp, Mus musculus
catgtatctttacaaatggcctttg

SEQ ID NO: 332047 - DNA, 25 bp, Mus musculus
catgtatctttagaaatggcctttg

SEQ ID NO: 332048 - DNA, 25 bp, Mus musculus
catgtatgacaaacggaccagggta

SEQ ID NO: 332049 - DNA, 25 bp, Mus musculus
catgtatgacaatcggaccagggta

SEQ ID NO: 332050 - DNA, 25 bp, Mus musculus
catgtatgtgtgatgcttagataaa

SEQ ID NO: 332051 - DNA, 25 bp, Mus musculus
catgtatgtgtgttgcttagataaa

SEQ ID NO: 332052 - DNA, 25 bp, Mus musculus
catgtatgttcacttggtgtgtttc

SEQ ID NO: 332053 - DNA, 25 bp, Mus musculus
catgtatgttcagttggtgtgtttc

SEQ ID NO: 332054 - DNA, 25 bp, Mus musculus
catgtatgttgcatctttgaggcca

SEQ ID NO: 332055 - DNA, 25 bp, Mus musculus
catgtatgttgcttctttgaggcca

SEQ ID NO: 332056 - DNA, 25 bp, Mus musculus
catgtattactgagcggcgagagag

SEQ ID NO: 332057 - DNA, 25 bp, Mus musculus
catgtattactgtgcggcgagagag

SEQ ID NO: 332058 - DNA, 25 bp, Mus musculus
catgtattccaacagatcctagatg

SEQ ID NO: 332059 - DNA, 25 bp, Mus musculus
catgtattccaagagatcctagatg

SEQ ID NO: 332060 - DNA, 25 bp, Mus musculus
catgtattctctctgctattccatc

SEQ ID NO: 332061 - DNA, 25 bp, Mus musculus
catgtattctctgtgctattccatc

SEQ ID NO: 332062 - DNA, 25 bp, Mus musculus
catgtatttctaagtgcccacacta

SEQ ID NO: 332063 - DNA, 25 bp, Mus musculus
catgtatttctatgtgcccacacta

SEQ ID NO: 332064 - DNA, 25 bp, Mus musculus
catgtattttacctcgacgtgctaa

SEQ ID NO: 332065 - DNA, 25 bp, Mus musculus
catgtattttacgtcgacgtgctaa

SEQ ID NO: 332066 - DNA, 25 bp, Mus musculus
catgtcaaacttcgtttacccagga

SEQ ID NO: 332067 - DNA, 25 bp, Mus musculus
catgtcaaacttggtttacccagga

SEQ ID NO: 332068 - DNA, 25 bp, Mus musculus
catgtcaaccagatgctgtgctgtt

SEQ ID NO: 332069 - DNA, 25 bp, Mus musculus
catgtcaaccagttgctgtgctgtt

SEQ ID NO: 332070 - DNA, 25 bp, Mus musculus
catgtcaacttcaactatgtcagtt

SEQ ID NO: 332071 - DNA, 25 bp, Mus musculus
catgtcaacttctactatgtcagtt

SEQ ID NO: 332072 - DNA, 25 bp, Mus musculus
catgtcaacttgaattttgcagcaa

SEQ ID NO: 332073 - DNA, 25 bp, Mus musculus
catgtcaacttgtattttgcagcaa

SEQ ID NO: 332074 - DNA, 25 bp, Mus musculus
catgtcaatggtccctaatattttt

SEQ ID NO: 332075 - DNA, 25 bp, Mus musculus
catgtcaatggtgcctaatattttt

SEQ ID NO: 332076 - DNA, 25 bp, Mus musculus
catgtcaattttctttactctgtat

SEQ ID NO: 332077 - DNA, 25 bp, Mus musculus
catgtcaattttgtttactctgtat

SEQ ID NO: 332078 - DNA, 25 bp, Mus musculus
catgtcaccatgaaatggagcctct

SEQ ID NO: 332079 - DNA, 25 bp, Mus musculus
catgtcaccatgtaatggagcctct

SEQ ID NO: 332080 - DNA, 25 bp, Mus musculus
catgtcacctggctcaggatttctt

SEQ ID NO: 332081 - DNA, 25 bp, Mus musculus
catgtcacctgggtcaggatttctt

SEQ ID NO: 332082 - DNA, 25 bp, Mus musculus
catgtcacgcggactcgttcattct

SEQ ID NO: 332083 - DNA, 25 bp, Mus musculus
catgtcacgcggtctcgttcattct

SEQ ID NO: 332084 - DNA, 25 bp, Mus musculus
catgtcactcccagttagttctctc

SEQ ID NO: 332085 - DNA, 25 bp, Mus musculus
catgtcactccctgttagttctctc

SEQ ID NO: 332086 - DNA, 25 bp, Mus musculus
catgtcagatagatggtgaagacct

SEQ ID NO: 332087 - DNA, 25 bp, Mus musculus
catgtcagatagttggtgaagacct

SEQ ID NO: 332088 - DNA, 25 bp, Mus musculus
catgtcaggcgtaaaactgtcagtc

SEQ ID NO: 332089 - DNA, 25 bp, Mus musculus
catgtcaggcgttaaactgtcagtc

SEQ ID NO: 332090 - DNA, 25 bp, Mus musculus
catgtcatataaaagggccagtaga

SEQ ID NO: 332091 - DNA, 25 bp, Mus musculus
catgtcatataatagggccagtaga

SEQ ID NO: 332092 - DNA, 25 bp, Mus musculus
catgtcatctatattattccactta

SEQ ID NO: 332093 - DNA, 25 bp, Mus musculus
catgtcatctattttattccactta

SEQ ID NO: 332094 - DNA, 25 bp, Mus musculus
catgtcatgtttctcatcttagaac

SEQ ID NO: 332095 - DNA, 25 bp, Mus musculus
catgtcatgtttgtcatcttagaac

SEQ ID NO: 332096 - DNA, 25 bp, Mus musculus
catgtcattcaacaaccccagtgct

SEQ ID NO: 332097 - DNA, 25 bp, Mus musculus
catgtcattcaagaaccccagtgct

SEQ ID NO: 332098 - DNA, 25 bp, Mus musculus
catgtcatttcaagcttgtctgtat

SEQ ID NO: 332099 - DNA, 25 bp, Mus musculus
catgtcatttcatgcttgtctgtat

SEQ ID NO: 332100 - DNA, 25 bp, Mus musculus
catgtccaaaatcagttccagttat

SEQ ID NO: 332101 - DNA, 25 bp, Mus musculus
catgtccaaaatgagttccagttat

SEQ ID NO: 332102 - DNA, 25 bp, Mus musculus
catgtccaaggaatggccgcttgtc

SEQ ID NO: 332103 - DNA, 25 bp, Mus musculus
catgtccaaggattggccgcttgtc

SEQ ID NO: 332104 - DNA, 25 bp, Mus musculus
catgtccacgcgcttctttgatgtg

SEQ ID NO: 332105 - DNA, 25 bp, Mus musculus
catgtccacgcggttctttgatgtg

SEQ ID NO: 332106 - DNA, 25 bp, Mus musculus
catgtccagacacctataaacagtg

SEQ ID NO: 332107 - DNA, 25 bp, Mus musculus
catgtccagacagctataaacagtg

SEQ ID NO: 332108 - DNA, 25 bp, Mus musculus
catgtccataatccttgggcttgga

SEQ ID NO: 332109 - DNA, 25 bp, Mus musculus
catgtccataatgcttgggcttgga

SEQ ID NO: 332110 - DNA, 25 bp, Mus musculus
catgtccatcaaaatttctgtgttt

SEQ ID NO: 332111 - DNA, 25 bp, Mus musculus
catgtccatcaatatttctgtgttt

SEQ ID NO: 332112 - DNA, 25 bp, Mus musculus
catgtcccagggaaatgccaatgaa

SEQ ID NO: 332113 - DNA, 25 bp, Mus musculus
catgtcccagggtaatgccaatgaa

SEQ ID NO: 332114 - DNA, 25 bp, Mus musculus
catgtccccaatcctaacggttgag

SEQ ID NO: 332115 - DNA, 25 bp, Mus musculus
catgtccccaatgctaacggttgag

SEQ ID NO: 332116 - DNA, 25 bp, Mus musculus
catgtccccacaccgaagattacag

SEQ ID NO: 332117 - DNA, 25 bp, Mus musculus
catgtccccacagcgaagattacag

SEQ ID NO: 332118 - DNA, 25 bp, Mus musculus
catgtccccgggaaatccaaacaag

SEQ ID NO: 332119 - DNA, 25 bp, Mus musculus
catgtccccgggtaatccaaacaag

SEQ ID NO: 332120 - DNA, 25 bp, Mus musculus
catgtccgctctctacagaaggagg

SEQ ID NO: 332121 - DNA, 25 bp, Mus musculus
catgtccgctctgtacagaaggagg

SEQ ID NO: 332122 - DNA, 25 bp, Mus musculus
catgtccgggaacgcttgcttagtg

SEQ ID NO: 332123 - DNA, 25 bp, Mus musculus
catgtccgggaaggcttgcttagtg

SEQ ID NO: 332124 - DNA, 25 bp, Mus musculus
catgtcctcttgatgctagcccttc

SEQ ID NO: 332125 - DNA, 25 bp, Mus musculus
catgtcctcttgttgctagcccttc

SEQ ID NO: 332126 - DNA, 25 bp, Mus musculus
catgtcctgggtagttctttctgtc

SEQ ID NO: 332127 - DNA, 25 bp, Mus musculus
catgtcctgggttgttctttctgtc

SEQ ID NO: 332128 - DNA, 25 bp, Mus musculus
catgtcctgtgtcaacaacccggtc

SEQ ID NO: 332129 - DNA, 25 bp, Mus musculus
catgtcctgtgtgaacaacccggtc

SEQ ID NO: 332130 - DNA, 25 bp, Mus musculus
catgtccttgctcgcggctaacaac

SEQ ID NO: 332131 - DNA, 25 bp, Mus musculus
catgtccttgctggcggctaacaac

SEQ ID NO: 332132 - DNA, 25 bp, Mus musculus
catgtccttgtgcaacttgaagtct

SEQ ID NO: 332133 - DNA, 25 bp, Mus musculus
catgtccttgtggaacttgaagtct

SEQ ID NO: 332134 - DNA, 25 bp, Mus musculus
catgtcgccttgcttggcttcgctc

SEQ ID NO: 332135 - DNA, 25 bp, Mus musculus
catgtcgccttggttggcttcgctc

SEQ ID NO: 332136 - DNA, 25 bp, Mus musculus
catgtcggttgtcactatgctagtt

SEQ ID NO: 332137 - DNA, 25 bp, Mus musculus
catgtcggttgtgactatgctagtt

SEQ ID NO: 332138 - DNA, 25 bp, Mus musculus
catgtcgttgtcagttggctggtac

SEQ ID NO: 332139 - DNA, 25 bp, Mus musculus
catgtcgttgtctgttggctggtac

SEQ ID NO: 332140 - DNA, 25 bp, Mus musculus
catgtctaaaccctgaaaaatagca

SEQ ID NO: 332141 - DNA, 25 bp, Mus musculus
catgtctaaaccgtgaaaaatagca

SEQ ID NO: 332142 - DNA, 25 bp, Mus musculus
catgtctaagtacgcacggccggta

SEQ ID NO: 332143 - DNA, 25 bp, Mus musculus
catgtctaagtaggcacggccggta

SEQ ID NO: 332144 - DNA, 25 bp, Mus musculus
catgtctacatgcatactgggtgat

SEQ ID NO: 332145 - DNA, 25 bp, Mus musculus
catgtctacatggatactgggtgat

SEQ ID NO: 332146 - DNA, 25 bp, Mus musculus
catgtctatagactgtgccctgtga

SEQ ID NO: 332147 - DNA, 25 bp, Mus musculus
catgtctatagagtgtgccctgtga

SEQ ID NO: 332148 - DNA, 25 bp, Mus musculus
catgtctatatcaggctcatttggt

SEQ ID NO: 332149 - DNA, 25 bp, Mus musculus
catgtctatatctggctcatttggt

SEQ ID NO: 332150 - DNA, 25 bp, Mus musculus
catgtctatgttagcacagtgtgcc

SEQ ID NO: 332151 - DNA, 25 bp, Mus musculus
catgtctatgtttgcacagtgtgcc

SEQ ID NO: 332152 - DNA, 25 bp, Mus musculus
catgtctattatctttgcctttgag

SEQ ID NO: 332153 - DNA, 25 bp, Mus musculus
catgtctattatgtttgcctttgag

SEQ ID NO: 332154 - DNA, 25 bp, Mus musculus
catgtctccttgattttcctgagaa

SEQ ID NO: 332155 - DNA, 25 bp, Mus musculus
catgtctccttgtttttcctgagaa

SEQ ID NO: 332156 - DNA, 25 bp, Mus musculus
catgtctctcttatgtttaatccgt

SEQ ID NO: 332157 - DNA, 25 bp, Mus musculus
catgtctctcttttgtttaatccgt

SEQ ID NO: 332158 - DNA, 25 bp, Mus musculus
catgtctctttaagaccccatggag

SEQ ID NO: 332159 - DNA, 25 bp, Mus musculus
catgtctctttatgaccccatggag

SEQ ID NO: 332160 - DNA, 25 bp, Mus musculus
catgtctgaagtccaggaactctgc

SEQ ID NO: 332161 - DNA, 25 bp, Mus musculus
catgtctgaagtgcaggaactctgc

SEQ ID NO: 332162 - DNA, 25 bp, Mus musculus
catgtctgacccctctatggtggaa

SEQ ID NO: 332163 - DNA, 25 bp, Mus musculus
catgtctgacccgtctatggtggaa

SEQ ID NO: 332164 - DNA, 25 bp, Mus musculus
catgtctgagtgataccttttttcc

SEQ ID NO: 332165 - DNA, 25 bp, Mus musculus
catgtctgagtgttaccttttttcc

SEQ ID NO: 332166 - DNA, 25 bp, Mus musculus
catgtctggctactcctcaggagat

SEQ ID NO: 332167 - DNA, 25 bp, Mus musculus
catgtctggctagtcctcaggagat

SEQ ID NO: 332168 - DNA, 25 bp, Mus musculus
catgtctgtagtaggtttttcagaa

SEQ ID NO: 332169 - DNA, 25 bp, Mus musculus
catgtctgtagttggtttttcagaa

SEQ ID NO: 332170 - DNA, 25 bp, Mus musculus
catgtctgtcttcctgggagaaaga

SEQ ID NO: 332171 - DNA, 25 bp, Mus musculus
catgtctgtcttgctgggagaaaga

SEQ ID NO: 332172 - DNA, 25 bp, Mus musculus
catgtctgtgcccactggatacaaa

SEQ ID NO: 332173 - DNA, 25 bp, Mus musculus
catgtctgtgccgactggatacaaa

SEQ ID NO: 332174 - DNA, 25 bp, Mus musculus
catgtcttaagcaccaacgattctg

SEQ ID NO: 332175 - DNA, 25 bp, Mus musculus
catgtcttaagctccaacgattctg

SEQ ID NO: 332176 - DNA, 25 bp, Mus musculus
catgtcttccccacagagattaagt

SEQ ID NO: 332177 - DNA, 25 bp, Mus musculus
catgtcttcccctcagagattaagt

SEQ ID NO: 332178 - DNA, 25 bp, Mus musculus
catgtcttccttatttgcttctaat

SEQ ID NO: 332179 - DNA, 25 bp, Mus musculus
catgtcttccttttttgcttctaat

SEQ ID NO: 332180 - DNA, 25 bp, Mus musculus
catgtcttggaaacttggtccccgg

SEQ ID NO: 332181 - DNA, 25 bp, Mus musculus
catgtcttggaatcttggtccccgg

SEQ ID NO: 332182 - DNA, 25 bp, Mus musculus
catgtcttggctagcttttggaaca

SEQ ID NO: 332183 - DNA, 25 bp, Mus musculus
catgtcttggcttgcttttggaaca

SEQ ID NO: 332184 - DNA, 25 bp, Mus musculus
catgtctttagactccagttggcct

SEQ ID NO: 332185 - DNA, 25 bp, Mus musculus
catgtctttagagtccagttggcct

SEQ ID NO: 332186 - DNA, 25 bp, Mus musculus
catgtctttcaactgatccctgtat

SEQ ID NO: 332187 - DNA, 25 bp, Mus musculus
catgtctttcaagtgatccctgtat

SEQ ID NO: 332188 - DNA, 25 bp, Mus musculus
catgtctttgagagtccttttggat

SEQ ID NO: 332189 - DNA, 25 bp, Mus musculus
catgtctttgagtgtccttttggat

SEQ ID NO: 332190 - DNA, 25 bp, Mus musculus
catgtgaaaacaactccagaggcga

SEQ ID NO: 332191 - DNA, 25 bp, Mus musculus
catgtgaaaacatctccagaggcga

SEQ ID NO: 332192 - DNA, 25 bp, Mus musculus
catgtgaagcccaggtgtctgtaca

SEQ ID NO: 332193 - DNA, 25 bp, Mus musculus
catgtgaagccctggtgtctgtaca

SEQ ID NO: 332194 - DNA, 25 bp, Mus musculus
catgtgaagtacacttacccctttt

SEQ ID NO: 332195 - DNA, 25 bp, Mus musculus
catgtgaagtactcttacccctttt

SEQ ID NO: 332196 - DNA, 25 bp, Mus musculus
catgtgaagttcaaccaaaggtcta

SEQ ID NO: 332197 - DNA, 25 bp, Mus musculus
catgtgaagttctaccaaaggtcta

SEQ ID NO: 332198 - DNA, 25 bp, Mus musculus
catgtgaatggcctagagaacctat

SEQ ID NO: 332199 - DNA, 25 bp, Mus musculus
catgtgaatggcgtagagaacctat

SEQ ID NO: 332200 - DNA, 25 bp, Mus musculus
catgtgaattccattctaatatttt

SEQ ID NO: 332201 - DNA, 25 bp, Mus musculus
catgtgaattcctttctaatatttt

SEQ ID NO: 332202 - DNA, 25 bp, Mus musculus
catgtgacacacaggttgccgatag

SEQ ID NO: 332203 - DNA, 25 bp, Mus musculus
catgtgacacactggttgccgatag

SEQ ID NO: 332204 - DNA, 25 bp, Mus musculus
catgtgacacttagtatttaacttt

SEQ ID NO: 332205 - DNA, 25 bp, Mus musculus
catgtgacactttgtatttaacttt

SEQ ID NO: 332206 - DNA, 25 bp, Mus musculus
catgtgacatttccctggtggaaaa

SEQ ID NO: 332207 - DNA, 25 bp, Mus musculus
catgtgacatttgcctggtggaaaa

SEQ ID NO: 332208 - DNA, 25 bp, Mus musculus
catgtgacccgtccactgctgggaa

SEQ ID NO: 332209 - DNA, 25 bp, Mus musculus
catgtgacccgtgcactgctgggaa

SEQ ID NO: 332210 - DNA, 25 bp, Mus musculus
catgtgacctctacacggatgggag

SEQ ID NO: 332211 - DNA, 25 bp, Mus musculus
catgtgacctcttcacggatgggag

SEQ ID NO: 332212 - DNA, 25 bp, Mus musculus
catgtgacctgaccgtttgcataca

SEQ ID NO: 332213 - DNA, 25 bp, Mus musculus
catgtgacctgagcgtttgcataca

SEQ ID NO: 332214 - DNA, 25 bp, Mus musculus
catgtgactgcaaaggtagaatccc

SEQ ID NO: 332215 - DNA, 25 bp, Mus musculus
catgtgactgcataggtagaatccc

SEQ ID NO: 332216 - DNA, 25 bp, Mus musculus
catgtgagggcaaaggagtcagact

SEQ ID NO: 332217 - DNA, 25 bp, Mus musculus
catgtgagggcataggagtcagact

SEQ ID NO: 332218 - DNA, 25 bp, Mus musculus
catgtgagtctgcacatatgtgtgt

SEQ ID NO: 332219 - DNA, 25 bp, Mus musculus
catgtgagtctggacatatgtgtgt

SEQ ID NO: 332220 - DNA, 25 bp, Mus musculus
catgtgagtgtgcatatgagttccc

SEQ ID NO: 332221 - DNA, 25 bp, Mus musculus
catgtgagtgtggatatgagttccc

SEQ ID NO: 332222 - DNA, 25 bp, Mus musculus
catgtgataagtaccttttattcca

SEQ ID NO: 332223 - DNA, 25 bp, Mus musculus
catgtgataagttccttttattcca

SEQ ID NO: 332224 - DNA, 25 bp, Mus musculus
catgtgatcgatatccttgagcctc

SEQ ID NO: 332225 - DNA, 25 bp, Mus musculus
catgtgatcgatttccttgagcctc

SEQ ID NO: 332226 - DNA, 25 bp, Mus musculus
catgtgatctgactgatagactatc

SEQ ID NO: 332227 - DNA, 25 bp, Mus musculus
catgtgatctgagtgatagactatc

SEQ ID NO: 332228 - DNA, 25 bp, Mus musculus
catgtgatgcgcattttgtctgcag

SEQ ID NO: 332229 - DNA, 25 bp, Mus musculus
catgtgatgcgctttttgtctgcag

SEQ ID NO: 332230 - DNA, 25 bp, Mus musculus
catgtgatgtttctgtctggcggaa

SEQ ID NO: 332231 - DNA, 25 bp, Mus musculus
catgtgatgtttgtgtctggcggaa

SEQ ID NO: 332232 - DNA, 25 bp, Mus musculus
catgtgattcctcgcatccttctaa

SEQ ID NO: 332233 - DNA, 25 bp, Mus musculus
catgtgattcctggcatccttctaa

SEQ ID NO: 332234 - DNA, 25 bp, Mus musculus
catgtgattgccaaagacacggttt

SEQ ID NO: 332235 - DNA, 25 bp, Mus musculus
catgtgattgcctaagacacggttt

SEQ ID NO: 332236 - DNA, 25 bp, Mus musculus
catgtgattgttcgtttccgagaag

SEQ ID NO: 332237 - DNA, 25 bp, Mus musculus
catgtgattgttggtttccgagaag

SEQ ID NO: 332238 - DNA, 25 bp, Mus musculus
catgtgcaattcaaactgttcaata

SEQ ID NO: 332239 - DNA, 25 bp, Mus musculus
catgtgcaattctaactgttcaata

SEQ ID NO: 332240 - DNA, 25 bp, Mus musculus
catgtgcacactccagatggctagt

SEQ ID NO: 332241 - DNA, 25 bp, Mus musculus
catgtgcacactgcagatggctagt

SEQ ID NO: 332242 - DNA, 25 bp, Mus musculus
catgtgcacatcagtgatccaccag

SEQ ID NO: 332243 - DNA, 25 bp, Mus musculus
catgtgcacatctgtgatccaccag

SEQ ID NO: 332244 - DNA, 25 bp, Mus musculus
catgtgcaccttcgacttctatgag

SEQ ID NO: 332245 - DNA, 25 bp, Mus musculus
catgtgcaccttggacttctatgag

SEQ ID NO: 332246 - DNA, 25 bp, Mus musculus
catgtgcacttcaaagagagcctat

SEQ ID NO: 332247 - DNA, 25 bp, Mus musculus
catgtgcacttctaagagagcctat

SEQ ID NO: 332248 - DNA, 25 bp, Mus musculus
catgtgcagagcacctggctgtgga

SEQ ID NO: 332249 - DNA, 25 bp, Mus musculus
catgtgcagagctcctggctgtgga

SEQ ID NO: 332250 - DNA, 25 bp, Mus musculus
catgtgcagcgtctttctgtgcaga

SEQ ID NO: 332251 - DNA, 25 bp, Mus musculus
catgtgcagcgtgtttctgtgcaga

SEQ ID NO: 332252 - DNA, 25 bp, Mus musculus
catgtgcagcttcagagcaggtgcc

SEQ ID NO: 332253 - DNA, 25 bp, Mus musculus
catgtgcagcttgagagcaggtgcc

SEQ ID NO: 332254 - DNA, 25 bp, Mus musculus
catgtgcaggaaccagtgtccgcgc

SEQ ID NO: 332255 - DNA, 25 bp, Mus musculus
catgtgcaggaagcagtgtccgcgc

SEQ ID NO: 332256 - DNA, 25 bp, Mus musculus
catgtgcagtctctctgggagatga

SEQ ID NO: 332257 - DNA, 25 bp, Mus musculus
catgtgcagtctgtctgggagatga

SEQ ID NO: 332258 - DNA, 25 bp, Mus musculus
catgtgcattttcaagtgggtagac

SEQ ID NO: 332259 - DNA, 25 bp, Mus musculus
catgtgcattttgaagtgggtagac

SEQ ID NO: 332260 - DNA, 25 bp, Mus musculus
catgtgccaagccttctatgaaata

SEQ ID NO: 332261 - DNA, 25 bp, Mus musculus
catgtgccaagcgttctatgaaata

SEQ ID NO: 332262 - DNA, 25 bp, Mus musculus
catgtgccaataataatcccttaga

SEQ ID NO: 332263 - DNA, 25 bp, Mus musculus
catgtgccaatattaatcccttaga

SEQ ID NO: 332264 - DNA, 25 bp, Mus musculus
catgtgccacccattgacagtagga

SEQ ID NO: 332265 - DNA, 25 bp, Mus musculus
catgtgccaccctttgacagtagga

SEQ ID NO: 332266 - DNA, 25 bp, Mus musculus
catgtgccaggacaacttgccattg

SEQ ID NO: 332267 - DNA, 25 bp, Mus musculus
catgtgccaggagaacttgccattg

SEQ ID NO: 332268 - DNA, 25 bp, Mus musculus
catgtgccagttcggccttcctgca

SEQ ID NO: 332269 - DNA, 25 bp, Mus musculus
catgtgccagttgggccttcctgca

SEQ ID NO: 332270 - DNA, 25 bp, Mus musculus
catgtgcccactaaacaccctttac

SEQ ID NO: 332271 - DNA, 25 bp, Mus musculus
catgtgcccacttaacaccctttac

SEQ ID NO: 332272 - DNA, 25 bp, Mus musculus
catgtgcccatccttgccatggaga

SEQ ID NO: 332273 - DNA, 25 bp, Mus musculus
catgtgcccatcgttgccatggaga

SEQ ID NO: 332274 - DNA, 25 bp, Mus musculus
catgtgcccctgagaacattaacat

SEQ ID NO: 332275 - DNA, 25 bp, Mus musculus
catgtgcccctgtgaacattaacat

SEQ ID NO: 332276 - DNA, 25 bp, Mus musculus
catgtgccgagcagggatttgtgca

SEQ ID NO: 332277 - DNA, 25 bp, Mus musculus
catgtgccgagctgggatttgtgca

SEQ ID NO: 332278 - DNA, 25 bp, Mus musculus
catgtgccgtatccctattatggtc

SEQ ID NO: 332279 - DNA, 25 bp, Mus musculus
catgtgccgtatgcctattatggtc

SEQ ID NO: 332280 - DNA, 25 bp, Mus musculus
catgtgcctatgaaccgtgtgggta

SEQ ID NO: 332281 - DNA, 25 bp, Mus musculus
catgtgcctatgtaccgtgtgggta

SEQ ID NO: 332282 - DNA, 25 bp, Mus musculus
catgtgcctttaattgggtgtgcgc

SEQ ID NO: 332283 - DNA, 25 bp, Mus musculus
catgtgcctttatttgggtgtgcgc

SEQ ID NO: 332284 - DNA, 25 bp, Mus musculus
catgtgcctttgaaacattccgaag

SEQ ID NO: 332285 - DNA, 25 bp, Mus musculus
catgtgcctttgtaacattccgaag

SEQ ID NO: 332286 - DNA, 25 bp, Mus musculus
catgtgctccagaacttgctatgta

SEQ ID NO: 332287 - DNA, 25 bp, Mus musculus
catgtgctccagtacttgctatgta

SEQ ID NO: 332288 - DNA, 25 bp, Mus musculus
catgtgctgagtatgctgttgaaaa

SEQ ID NO: 332289 - DNA, 25 bp, Mus musculus
catgtgctgagtttgctgttgaaaa

SEQ ID NO: 332290 - DNA, 25 bp, Mus musculus
catgtgctgcatcaggtttacctgg

SEQ ID NO: 332291 - DNA, 25 bp, Mus musculus
catgtgctgcatgaggtttacctgg

SEQ ID NO: 332292 - DNA, 25 bp, Mus musculus
catgtgctgccactgggctgtttgt

SEQ ID NO: 332293 - DNA, 25 bp, Mus musculus
catgtgctgccagtgggctgtttgt

SEQ ID NO: 332294 - DNA, 25 bp, Mus musculus
catgtgctggaaatgctgcagtgta

SEQ ID NO: 332295 - DNA, 25 bp, Mus musculus
catgtgctggaattgctgcagtgta

SEQ ID NO: 332296 - DNA, 25 bp, Mus musculus
catgtgctgggccactatttggtga

SEQ ID NO: 332297 - DNA, 25 bp, Mus musculus
catgtgctgggcgactatttggtga

SEQ ID NO: 332298 - DNA, 25 bp, Mus musculus
catgtgctgtgccaagtcttgataa

SEQ ID NO: 332299 - DNA, 25 bp, Mus musculus
catgtgctgtgcgaagtcttgataa

SEQ ID NO: 332300 - DNA, 25 bp, Mus musculus
catgtgctgtggaaggcaactctgt

SEQ ID NO: 332301 - DNA, 25 bp, Mus musculus
catgtgctgtggtaggcaactctgt

SEQ ID NO: 332302 - DNA, 25 bp, Mus musculus
catgtgctgttgcagggtcctgcaa

SEQ ID NO: 332303 - DNA, 25 bp, Mus musculus
catgtgctgttgctgtggtgaccat

SEQ ID NO: 332304 - DNA, 25 bp, Mus musculus
catgtgctgttggagggtcctgcaa

SEQ ID NO: 332305 - DNA, 25 bp, Mus musculus
catgtgctgttggtgtggtgaccat

SEQ ID NO: 332306 - DNA, 25 bp, Mus musculus
catgtgcttaggatgcagatgcagc

SEQ ID NO: 332307 - DNA, 25 bp, Mus musculus
catgtgcttaggttgcagatgcagc

SEQ ID NO: 332308 - DNA, 25 bp, Mus musculus
catgtgcttcaccttgtaagatgat

SEQ ID NO: 332309 - DNA, 25 bp, Mus musculus
catgtgcttcacgttgtaagatgat

SEQ ID NO: 332310 - DNA, 25 bp, Mus musculus
catgtgcttcttccctaagcgagaa

SEQ ID NO: 332311 - DNA, 25 bp, Mus musculus
catgtgcttcttgcctaagcgagaa

SEQ ID NO: 332312 - DNA, 25 bp, Mus musculus
catgtgcttggtatttcctctgtga

SEQ ID NO: 332313 - DNA, 25 bp, Mus musculus
catgtgcttggtttttcctctgtga

SEQ ID NO: 332314 - DNA, 25 bp, Mus musculus
catgtgctttatacctatctgctac

SEQ ID NO: 332315 - DNA, 25 bp, Mus musculus
catgtgctttattcctatctgctac

SEQ ID NO: 332316 - DNA, 25 bp, Mus musculus
catgtgctttttagggttactgcaa

SEQ ID NO: 332317 - DNA, 25 bp, Mus musculus
catgtgcttttttgggttactgcaa

SEQ ID NO: 332318 - DNA, 25 bp, Mus musculus
catgtggacactatcagggtggttg

SEQ ID NO: 332319 - DNA, 25 bp, Mus musculus
catgtggacactttcagggtggttg

SEQ ID NO: 332320 - DNA, 25 bp, Mus musculus
catgtggacatgatctgcactgcca

SEQ ID NO: 332321 - DNA, 25 bp, Mus musculus
catgtggacatgttctgcactgcca

SEQ ID NO: 332322 - DNA, 25 bp, Mus musculus
catgtggaccctcgaatacctatgt

SEQ ID NO: 332323 - DNA, 25 bp, Mus musculus
catgtggaccctggaatacctatgt

SEQ ID NO: 332324 - DNA, 25 bp, Mus musculus
catgtggacttgaagatgggtctct

SEQ ID NO: 332325 - DNA, 25 bp, Mus musculus
catgtggacttgtagatgggtctct

SEQ ID NO: 332326 - DNA, 25 bp, Mus musculus
catgtggagattcgtctgtcagcac

SEQ ID NO: 332327 - DNA, 25 bp, Mus musculus
catgtggagattggtctgtcagcac

SEQ ID NO: 332328 - DNA, 25 bp, Mus musculus
catgtggagtagagcaacctgtgta

SEQ ID NO: 332329 - DNA, 25 bp, Mus musculus
catgtggagtagtgcaacctgtgta

SEQ ID NO: 332330 - DNA, 25 bp, Mus musculus
catgtggatataccgctgtgggcac

SEQ ID NO: 332331 - DNA, 25 bp, Mus musculus
catgtggatatagcgctgtgggcac

SEQ ID NO: 332332 - DNA, 25 bp, Mus musculus
catgtggatctcagtttacatcctg

SEQ ID NO: 332333 - DNA, 25 bp, Mus musculus
catgtggatctctgtttacatcctg

SEQ ID NO: 332334 - DNA, 25 bp, Mus musculus
catgtggatcttcggtttgaactcg

SEQ ID NO: 332335 - DNA, 25 bp, Mus musculus
catgtggatcttgggtttgaactcg

SEQ ID NO: 332336 - DNA, 25 bp, Mus musculus
catgtggatgtaatcctgattcaac

SEQ ID NO: 332337 - DNA, 25 bp, Mus musculus
catgtggatgtattcctgattcaac

SEQ ID NO: 332338 - DNA, 25 bp, Mus musculus
catgtggatttgcttctattgtttt

SEQ ID NO: 332339 - DNA, 25 bp, Mus musculus
catgtggatttggttctattgtttt

SEQ ID NO: 332340 - DNA, 25 bp, Mus musculus
catgtggcacgtccagaagagtcgt

SEQ ID NO: 332341 - DNA, 25 bp, Mus musculus
catgtggcacgtgcagaagagtcgt

SEQ ID NO: 332342 - DNA, 25 bp, Mus musculus
catgtggcactcaatgtggtggctg

SEQ ID NO: 332343 - DNA, 25 bp, Mus musculus
catgtggcactctatgtggtggctg

SEQ ID NO: 332344 - DNA, 25 bp, Mus musculus
catgtggccactaaactgtttgcat

SEQ ID NO: 332345 - DNA, 25 bp, Mus musculus
catgtggccacttaactgtttgcat

SEQ ID NO: 332346 - DNA, 25 bp, Mus musculus
catgtggccatgcaaacatttgttt

SEQ ID NO: 332347 - DNA, 25 bp, Mus musculus
catgtggccatggaaacatttgttt

SEQ ID NO: 332348 - DNA, 25 bp, Mus musculus
catgtggccattcgttcagcatgga

SEQ ID NO: 332349 - DNA, 25 bp, Mus musculus
catgtggccattggttcagcatgga

SEQ ID NO: 332350 - DNA, 25 bp, Mus musculus
catgtggcctgaatgctgactggtc

SEQ ID NO: 332351 - DNA, 25 bp, Mus musculus
catgtggcctgattgctgactggtc

SEQ ID NO: 332352 - DNA, 25 bp, Mus musculus
catgtggctattcttttactctgag

SEQ ID NO: 332353 - DNA, 25 bp, Mus musculus
catgtggctattgttttactctgag

SEQ ID NO: 332354 - DNA, 25 bp, Mus musculus
catgtggctcacaatcatatataac

SEQ ID NO: 332355 - DNA, 25 bp, Mus musculus
catgtggctcactatcatatataac

SEQ ID NO: 332356 - DNA, 25 bp, Mus musculus
catgtggctgagattgctggcaata

SEQ ID NO: 332357 - DNA, 25 bp, Mus musculus
catgtggctgagtttgctggcaata

SEQ ID NO: 332358 - DNA, 25 bp, Mus musculus
catgtggcttcaagccaccaggaca

SEQ ID NO: 332359 - DNA, 25 bp, Mus musculus
catgtggcttcatgccaccaggaca

SEQ ID NO: 332360 - DNA, 25 bp, Mus musculus
catgtgggaactagactgtctggct

SEQ ID NO: 332361 - DNA, 25 bp, Mus musculus
catgtgggaacttgactgtctggct

SEQ ID NO: 332362 - DNA, 25 bp, Mus musculus
catgtgggcacaaaagcacagcccc

SEQ ID NO: 332363 - DNA, 25 bp, Mus musculus
catgtgggcacataagcacagcccc

SEQ ID NO: 332364 - DNA, 25 bp, Mus musculus
catgtgggcctgcgcattccaggta

SEQ ID NO: 332365 - DNA, 25 bp, Mus musculus
catgtgggcctgggcattccaggta

SEQ ID NO: 332366 - DNA, 25 bp, Mus musculus
catgtgggctgtagtgtctttacac

SEQ ID NO: 332367 - DNA, 25 bp, Mus musculus
catgtgggctgtattctgttatcaa

SEQ ID NO: 332368 - DNA, 25 bp, Mus musculus
catgtgggctgttgtgtctttacac

SEQ ID NO: 332369 - DNA, 25 bp, Mus musculus
catgtgggctgttttctgttatcaa

SEQ ID NO: 332370 - DNA, 25 bp, Mus musculus
catgtgggtcatcagaagctccatt

SEQ ID NO: 332371 - DNA, 25 bp, Mus musculus
catgtgggtcatgagaagctccatt

SEQ ID NO: 332372 - DNA, 25 bp, Mus musculus
catgtggtagctccaggtttgtttt

SEQ ID NO: 332373 - DNA, 25 bp, Mus musculus
catgtggtagctgcaggtttgtttt

SEQ ID NO: 332374 - DNA, 25 bp, Mus musculus
catgtggtgcacctttgttgaaaga

SEQ ID NO: 332375 - DNA, 25 bp, Mus musculus
catgtggtgcacgtttgttgaaaga

SEQ ID NO: 332376 - DNA, 25 bp, Mus musculus
catgtggtgcttctgtattgtttat

SEQ ID NO: 332377 - DNA, 25 bp, Mus musculus
catgtggtgcttgtgtattgtttat

SEQ ID NO: 332378 - DNA, 25 bp, Mus musculus
catgtggtgggcactggtatcctgc

SEQ ID NO: 332379 - DNA, 25 bp, Mus musculus
catgtggtgggctctggtatcctgc

SEQ ID NO: 332380 - DNA, 25 bp, Mus musculus
catgtggtgtacagaagtatgtgca

SEQ ID NO: 332381 - DNA, 25 bp, Mus musculus
catgtggtgtactgaagtatgtgca

SEQ ID NO: 332382 - DNA, 25 bp, Mus musculus
catgtggttcctaaagaggccagaa

SEQ ID NO: 332383 - DNA, 25 bp, Mus musculus
catgtggttccttaagaggccagaa

SEQ ID NO: 332384 - DNA, 25 bp, Mus musculus
catgtgtacatcaagcaatggcagg

SEQ ID NO: 332385 - DNA, 25 bp, Mus musculus
catgtgtacatctagcaatggcagg

SEQ ID NO: 332386 - DNA, 25 bp, Mus musculus
catgtgtaccacctacatacctagt

SEQ ID NO: 332387 - DNA, 25 bp, Mus musculus
catgtgtaccacgtacatacctagt

SEQ ID NO: 332388 - DNA, 25 bp, Mus musculus
catgtgtactagcattttctccctc

SEQ ID NO: 332389 - DNA, 25 bp, Mus musculus
catgtgtactaggattttctccctc

SEQ ID NO: 332390 - DNA, 25 bp, Mus musculus
catgtgtagaaaagtctcctgggat

SEQ ID NO: 332391 - DNA, 25 bp, Mus musculus
catgtgtagaaatgtctcctgggat

SEQ ID NO: 332392 - DNA, 25 bp, Mus musculus
catgtgtatatgactggccttgaac

SEQ ID NO: 332393 - DNA, 25 bp, Mus musculus
catgtgtatatgtctggccttgaac

SEQ ID NO: 332394 - DNA, 25 bp, Mus musculus
catgtgtatccactgttgcctagtt

SEQ ID NO: 332395 - DNA, 25 bp, Mus musculus
catgtgtatccagtgttgcctagtt

SEQ ID NO: 332396 - DNA, 25 bp, Mus musculus
catgtgtatgccattagatactgta

SEQ ID NO: 332397 - DNA, 25 bp, Mus musculus
catgtgtatgcctttagatactgta

SEQ ID NO: 332398 - DNA, 25 bp, Mus musculus
catgtgtatgtactcctgggcaata

SEQ ID NO: 332399 - DNA, 25 bp, Mus musculus
catgtgtatgtagtcctgggcaata

SEQ ID NO: 332400 - DNA, 25 bp, Mus musculus
catgtgtcactcagtgtcagctaga

SEQ ID NO: 332401 - DNA, 25 bp, Mus musculus
catgtgtcactctgtgtcagctaga

SEQ ID NO: 332402 - DNA, 25 bp, Mus musculus
catgtgtcatggcataattgcatta

SEQ ID NO: 332403 - DNA, 25 bp, Mus musculus
catgtgtcatgggataattgcatta

SEQ ID NO: 332404 - DNA, 25 bp, Mus musculus
catgtgtccctaaactttggtacat

SEQ ID NO: 332405 - DNA, 25 bp, Mus musculus
catgtgtccctatactttggtacat

SEQ ID NO: 332406 - DNA, 25 bp, Mus musculus
catgtgtcccttctgcaagagaacc

SEQ ID NO: 332407 - DNA, 25 bp, Mus musculus
catgtgtcccttgtgcaagagaacc

SEQ ID NO: 332408 - DNA, 25 bp, Mus musculus
catgtgtcctttaattttgatgcta

SEQ ID NO: 332409 - DNA, 25 bp, Mus musculus
catgtgtccttttattttgatgcta

SEQ ID NO: 332410 - DNA, 25 bp, Mus musculus
catgtgtctcacacgcttactgtga

SEQ ID NO: 332411 - DNA, 25 bp, Mus musculus
catgtgtctcactcgcttactgtga

SEQ ID NO: 332412 - DNA, 25 bp, Mus musculus
catgtgtctcctaaaatataaccta

SEQ ID NO: 332413 - DNA, 25 bp, Mus musculus
catgtgtctccttaaatataaccta

SEQ ID NO: 332414 - DNA, 25 bp, Mus musculus
catgtgtctctaagtgaccaatgtg

SEQ ID NO: 332415 - DNA, 25 bp, Mus musculus
catgtgtctctatgtgaccaatgtg

SEQ ID NO: 332416 - DNA, 25 bp, Mus musculus
catgtgtctggacatacatgcctgg

SEQ ID NO: 332417 - DNA, 25 bp, Mus musculus
catgtgtctggagatacatgcctgg

SEQ ID NO: 332418 - DNA, 25 bp, Mus musculus
catgtgtctgtccagatgtgggctg

SEQ ID NO: 332419 - DNA, 25 bp, Mus musculus
catgtgtctgtcgagatgtgggctg

SEQ ID NO: 332420 - DNA, 25 bp, Mus musculus
catgtgtctttgagctgttttctta

SEQ ID NO: 332421 - DNA, 25 bp, Mus musculus
catgtgtctttgtgctgttttctta

SEQ ID NO: 332422 - DNA, 25 bp, Mus musculus
catgtgtgaatgatttaaaaaccta

SEQ ID NO: 332423 - DNA, 25 bp, Mus musculus
catgtgtgaatgttttaaaaaccta

SEQ ID NO: 332424 - DNA, 25 bp, Mus musculus
catgtgtgaggaatggactccattt

SEQ ID NO: 332425 - DNA, 25 bp, Mus musculus
catgtgtgaggattggactccattt

SEQ ID NO: 332426 - DNA, 25 bp, Mus musculus
catgtgtgatcgaggagtgcagcaa

SEQ ID NO: 332427 - DNA, 25 bp, Mus musculus
catgtgtgatcgtggagtgcagcaa

SEQ ID NO: 332428 - DNA, 25 bp, Mus musculus
catgtgtgcacactgaaggatacag

SEQ ID NO: 332429 - DNA, 25 bp, Mus musculus
catgtgtgcacagtgaaggatacag

SEQ ID NO: 332430 - DNA, 25 bp, Mus musculus
catgtgtgctgaagactggttgtag

SEQ ID NO: 332431 - DNA, 25 bp, Mus musculus
catgtgtgctgatgactggttgtag

SEQ ID NO: 332432 - DNA, 25 bp, Mus musculus
catgtgtgctgtcgcgtgcgctcta

SEQ ID NO: 332433 - DNA, 25 bp, Mus musculus
catgtgtgctgtggcgtgcgctcta

SEQ ID NO: 332434 - DNA, 25 bp, Mus musculus
catgtgtggaaacatcattttttaa

SEQ ID NO: 332435 - DNA, 25 bp, Mus musculus
catgtgtggaaagatcattttttaa

SEQ ID NO: 332436 - DNA, 25 bp, Mus musculus
catgtgtgtatgctaggtctgtcaa

SEQ ID NO: 332437 - DNA, 25 bp, Mus musculus
catgtgtgtatggtaggtctgtcaa

SEQ ID NO: 332438 - DNA, 25 bp, Mus musculus
catgtgtgtcgtccctgcactgtgg

SEQ ID NO: 332439 - DNA, 25 bp, Mus musculus
catgtgtgtcgtgcctgcactgtgg

SEQ ID NO: 332440 - DNA, 25 bp, Mus musculus
catgtgtgtgccacgtccccacaga

SEQ ID NO: 332441 - DNA, 25 bp, Mus musculus
catgtgtgtgcctcgtccccacaga

SEQ ID NO: 332442 - DNA, 25 bp, Mus musculus
catgtgtgtgtcactatctcgcgtc

SEQ ID NO: 332443 - DNA, 25 bp, Mus musculus
catgtgtgtgtctctatctcgcgtc

SEQ ID NO: 332444 - DNA, 25 bp, Mus musculus
catgtgtgtgtgctagccctcagaa

SEQ ID NO: 332445 - DNA, 25 bp, Mus musculus
catgtgtgtgtggtagccctcagaa

SEQ ID NO: 332446 - DNA, 25 bp, Mus musculus
catgtgtgtgttaccagtgtgtgcc

SEQ ID NO: 332447 - DNA, 25 bp, Mus musculus
catgtgtgtgtttccagtgtgtgcc

SEQ ID NO: 332448 - DNA, 25 bp, Mus musculus
catgtgtgtttgcataaagacctct

SEQ ID NO: 332449 - DNA, 25 bp, Mus musculus
catgtgtgtttggataaagacctct

SEQ ID NO: 332450 - DNA, 25 bp, Mus musculus
catgtgttaagccaggtggacttga

SEQ ID NO: 332451 - DNA, 25 bp, Mus musculus
catgtgttaagcgaggtggacttga

SEQ ID NO: 332452 - DNA, 25 bp, Mus musculus
catgtgttaattccagtgtgctttc

SEQ ID NO: 332453 - DNA, 25 bp, Mus musculus
catgtgttaattgcagtgtgctttc

SEQ ID NO: 332454 - DNA, 25 bp, Mus musculus
catgtgttacagcaggtgatctacc

SEQ ID NO: 332455 - DNA, 25 bp, Mus musculus
catgtgttacaggaggtgatctacc

SEQ ID NO: 332456 - DNA, 25 bp, Mus musculus
catgtgttgcgactagagttcctgt

SEQ ID NO: 332457 - DNA, 25 bp, Mus musculus
catgtgttgcgagtagagttcctgt

SEQ ID NO: 332458 - DNA, 25 bp, Mus musculus
catgtgttggcaaactcggttaata

SEQ ID NO: 332459 - DNA, 25 bp, Mus musculus
catgtgttggcatactcggttaata

SEQ ID NO: 332460 - DNA, 25 bp, Mus musculus
catgtgttgtctcattggcttgtag

SEQ ID NO: 332461 - DNA, 25 bp, Mus musculus
catgtgttgtctgattggcttgtag

SEQ ID NO: 332462 - DNA, 25 bp, Mus musculus
catgtgtttacgatgccgagttttc

SEQ ID NO: 332463 - DNA, 25 bp, Mus musculus
catgtgtttacgttgccgagttttc

SEQ ID NO: 332464 - DNA, 25 bp, Mus musculus
catgtgtttgtgacacgtatcgagt

SEQ ID NO: 332465 - DNA, 25 bp, Mus musculus
catgtgtttgtgtcacgtatcgagt

SEQ ID NO: 332466 - DNA, 25 bp, Mus musculus
catgtgttttgcacaggctccgagc

SEQ ID NO: 332467 - DNA, 25 bp, Mus musculus
catgtgttttgctcaggctccgagc

SEQ ID NO: 332468 - DNA, 25 bp, Mus musculus
catgtgtttttcatcttgttgtttt

SEQ ID NO: 332469 - DNA, 25 bp, Mus musculus
catgtgtttttcttcttgttgtttt

SEQ ID NO: 332470 - DNA, 25 bp, Mus musculus
catgttaactatcgtgattcatttc

SEQ ID NO: 332471 - DNA, 25 bp, Mus musculus
catgttaactatggtgattcatttc

SEQ ID NO: 332472 - DNA, 25 bp, Mus musculus
catgttaagcgtctattgactgctc

SEQ ID NO: 332473 - DNA, 25 bp, Mus musculus
catgttaagcgtgtattgactgctc

SEQ ID NO: 332474 - DNA, 25 bp, Mus musculus
catgttacaaacaattacttcctta

SEQ ID NO: 332475 - DNA, 25 bp, Mus musculus
catgttacaaactattacttcctta

SEQ ID NO: 332476 - DNA, 25 bp, Mus musculus
catgttaccaagcacatgactctgg

SEQ ID NO: 332477 - DNA, 25 bp, Mus musculus
catgttaccaaggacatgactctgg

SEQ ID NO: 332478 - DNA, 25 bp, Mus musculus
catgttacctggaagcaaactatta

SEQ ID NO: 332479 - DNA, 25 bp, Mus musculus
catgttacctggtagcaaactatta

SEQ ID NO: 332480 - DNA, 25 bp, Mus musculus
catgttacggtcaagatgccatttt

SEQ ID NO: 332481 - DNA, 25 bp, Mus musculus
catgttacggtctagatgccatttt

SEQ ID NO: 332482 - DNA, 25 bp, Mus musculus
catgttactctacttcctaccaaac

SEQ ID NO: 332483 - DNA, 25 bp, Mus musculus
catgttactctagttcctaccaaac

SEQ ID NO: 332484 - DNA, 25 bp, Mus musculus
catgttagatttactcactgtgaga

SEQ ID NO: 332485 - DNA, 25 bp, Mus musculus
catgttagattttctcactgtgaga

SEQ ID NO: 332486 - DNA, 25 bp, Mus musculus
catgttagccctcagaattgaacct

SEQ ID NO: 332487 - DNA, 25 bp, Mus musculus
catgttagccctgagaattgaacct

SEQ ID NO: 332488 - DNA, 25 bp, Mus musculus
catgttagcttcctctccccaagcc

SEQ ID NO: 332489 - DNA, 25 bp, Mus musculus
catgttagcttcgtctccccaagcc

SEQ ID NO: 332490 - DNA, 25 bp, Mus musculus
catgttaggcctaaagcctcagttt

SEQ ID NO: 332491 - DNA, 25 bp, Mus musculus
catgttaggccttaagcctcagttt

SEQ ID NO: 332492 - DNA, 25 bp, Mus musculus
catgttatactcatctctcttgaag

SEQ ID NO: 332493 - DNA, 25 bp, Mus musculus
catgttatactcttctctcttgaag

SEQ ID NO: 332494 - DNA, 25 bp, Mus musculus
catgttatgcagaatatgctgttaa

SEQ ID NO: 332495 - DNA, 25 bp, Mus musculus
catgttatgcagtatatgctgttaa

SEQ ID NO: 332496 - DNA, 25 bp, Mus musculus
catgttatggttccttctgaatttt

SEQ ID NO: 332497 - DNA, 25 bp, Mus musculus
catgttatggttgcttctgaatttt

SEQ ID NO: 332498 - DNA, 25 bp, Mus musculus
catgttattcttcgagttacttaat

SEQ ID NO: 332499 - DNA, 25 bp, Mus musculus
catgttattcttggagttacttaat

SEQ ID NO: 332500 - DNA, 25 bp, Mus musculus
catgttcaacacatgtgtccaataa

SEQ ID NO: 332501 - DNA, 25 bp, Mus musculus
catgttcaacacttgtgtccaataa

SEQ ID NO: 332502 - DNA, 25 bp, Mus musculus
catgttcacagtcaactccagttgc

SEQ ID NO: 332503 - DNA, 25 bp, Mus musculus
catgttcacagtgaactccagttgc

SEQ ID NO: 332504 - DNA, 25 bp, Mus musculus
catgttcagaagcaagcgagtctct

SEQ ID NO: 332505 - DNA, 25 bp, Mus musculus
catgttcagaaggaagcgagtctct

SEQ ID NO: 332506 - DNA, 25 bp, Mus musculus
catgttcagctccagcgccaagatc

SEQ ID NO: 332507 - DNA, 25 bp, Mus musculus
catgttcagctcgagcgccaagatc

SEQ ID NO: 332508 - DNA, 25 bp, Mus musculus
catgttcagcttcattgcatgtaat

SEQ ID NO: 332509 - DNA, 25 bp, Mus musculus
catgttcagcttgattgcatgtaat

SEQ ID NO: 332510 - DNA, 25 bp, Mus musculus
catgttcaggaccagtgctttggag

SEQ ID NO: 332511 - DNA, 25 bp, Mus musculus
catgttcaggacgagtgctttggag

SEQ ID NO: 332512 - DNA, 25 bp, Mus musculus
catgttcagggacatcacccagcag

SEQ ID NO: 332513 - DNA, 25 bp, Mus musculus
catgttcagggagatcacccagcag

SEQ ID NO: 332514 - DNA, 25 bp, Mus musculus
catgttcagtgtctttggtgaataa

SEQ ID NO: 332515 - DNA, 25 bp, Mus musculus
catgttcagtgtgtttggtgaataa

SEQ ID NO: 332516 - DNA, 25 bp, Mus musculus
catgttcatattatccttgtggact

SEQ ID NO: 332517 - DNA, 25 bp, Mus musculus
catgttcatattttccttgtggact

SEQ ID NO: 332518 - DNA, 25 bp, Mus musculus
catgttcatggtctttatgtacaag

SEQ ID NO: 332519 - DNA, 25 bp, Mus musculus
catgttcatggtgtttatgtacaag

SEQ ID NO: 332520 - DNA, 25 bp, Mus musculus
catgttcatgtaatgatgttttgtg

SEQ ID NO: 332521 - DNA, 25 bp, Mus musculus
catgttcatgtattgatgttttgtg

SEQ ID NO: 332522 - DNA, 25 bp, Mus musculus
catgttcattggctttatcctgagc

SEQ ID NO: 332523 - DNA, 25 bp, Mus musculus
catgttcattgggtttatcctgagc

SEQ ID NO: 332524 - DNA, 25 bp, Mus musculus
catgttccaactcgcctgggagttt

SEQ ID NO: 332525 - DNA, 25 bp, Mus musculus
catgttccaactggcctgggagttt

SEQ ID NO: 332526 - DNA, 25 bp, Mus musculus
catgttccagatcaggtagtttggc

SEQ ID NO: 332527 - DNA, 25 bp, Mus musculus
catgttccagatgaggtagtttggc

SEQ ID NO: 332528 - DNA, 25 bp, Mus musculus
catgttcccagacagtgaccatctt

SEQ ID NO: 332529 - DNA, 25 bp, Mus musculus
catgttcccagagagtgaccatctt

SEQ ID NO: 332530 - DNA, 25 bp, Mus musculus
catgttccccggagctttggtaggt

SEQ ID NO: 332531 - DNA, 25 bp, Mus musculus
catgttccccggtgctttggtaggt

SEQ ID NO: 332532 - DNA, 25 bp, Mus musculus
catgttcccttccattcttaaagac

SEQ ID NO: 332533 - DNA, 25 bp, Mus musculus
catgttcccttcgattcttaaagac

SEQ ID NO: 332534 - DNA, 25 bp, Mus musculus
catgttcctactcgtatggctcatt

SEQ ID NO: 332535 - DNA, 25 bp, Mus musculus
catgttcctactggtatggctcatt

SEQ ID NO: 332536 - DNA, 25 bp, Mus musculus
catgttcctatacatctatccctat

SEQ ID NO: 332537 - DNA, 25 bp, Mus musculus
catgttcctatagatctatccctat

SEQ ID NO: 332538 - DNA, 25 bp, Mus musculus
catgttcctatgcatcttccttata

SEQ ID NO: 332539 - DNA, 25 bp, Mus musculus
catgttcctatggatcttccttata

SEQ ID NO: 332540 - DNA, 25 bp, Mus musculus
catgttcctcggagaacccagaagg

SEQ ID NO: 332541 - DNA, 25 bp, Mus musculus
catgttcctcggtgaacccagaagg

SEQ ID NO: 332542 - DNA, 25 bp, Mus musculus
catgttcctgctctgttccagatga

SEQ ID NO: 332543 - DNA, 25 bp, Mus musculus
catgttcctgctgtgttccagatga

SEQ ID NO: 332544 - DNA, 25 bp, Mus musculus
catgttcctgggaaagatccttagc

SEQ ID NO: 332545 - DNA, 25 bp, Mus musculus
catgttcctgggtaagatccttagc

SEQ ID NO: 332546 - DNA, 25 bp, Mus musculus
catgttcctgttagacgcgtgagat

SEQ ID NO: 332547 - DNA, 25 bp, Mus musculus
catgttcctgtttgacgcgtgagat

SEQ ID NO: 332548 - DNA, 25 bp, Mus musculus
catgttcggctgaaggttgaggctt

SEQ ID NO: 332549 - DNA, 25 bp, Mus musculus
catgttcggctgtaggttgaggctt

SEQ ID NO: 332550 - DNA, 25 bp, Mus musculus
catgttcgtcctccctttcttcgtg

SEQ ID NO: 332551 - DNA, 25 bp, Mus musculus
catgttcgtcctgcctttcttcgtg

SEQ ID NO: 332552 - DNA, 25 bp, Mus musculus
catgttctcaaacaggcgcgtgcga

SEQ ID NO: 332553 - DNA, 25 bp, Mus musculus
catgttctcaaagaggcgcgtgcga

SEQ ID NO: 332554 - DNA, 25 bp, Mus musculus
catgttctgatgatacctgatggat

SEQ ID NO: 332555 - DNA, 25 bp, Mus musculus
catgttctgatgttacctgatggat

SEQ ID NO: 332556 - DNA, 25 bp, Mus musculus
catgttctgctgctattgttgtaat

SEQ ID NO: 332557 - DNA, 25 bp, Mus musculus
catgttctgctggtattgttgtaat

SEQ ID NO: 332558 - DNA, 25 bp, Mus musculus
catgttctgggaagaggctgtgctc

SEQ ID NO: 332559 - DNA, 25 bp, Mus musculus
catgttctgggatgaggctgtgctc

SEQ ID NO: 332560 - DNA, 25 bp, Mus musculus
catgttctgtagagccagggctgac

SEQ ID NO: 332561 - DNA, 25 bp, Mus musculus
catgttctgtagtgccagggctgac

SEQ ID NO: 332562 - DNA, 25 bp, Mus musculus
catgttctgtataagtgctgcttga

SEQ ID NO: 332563 - DNA, 25 bp, Mus musculus
catgttctgtattagtgctgcttga

SEQ ID NO: 332564 - DNA, 25 bp, Mus musculus
catgttctgtccatccatgtgggaa

SEQ ID NO: 332565 - DNA, 25 bp, Mus musculus
catgttctgtccttccatgtgggaa

SEQ ID NO: 332566 - DNA, 25 bp, Mus musculus
catgttcttatcagtctccttgtta

SEQ ID NO: 332567 - DNA, 25 bp, Mus musculus
catgttcttatctgtctccttgtta

SEQ ID NO: 332568 - DNA, 25 bp, Mus musculus
catgttcttcatcctgtcagaatta

SEQ ID NO: 332569 - DNA, 25 bp, Mus musculus
catgttcttcatgctgtcagaatta

SEQ ID NO: 332570 - DNA, 25 bp, Mus musculus
catgttcttcctaactcttctaaaa

SEQ ID NO: 332571 - DNA, 25 bp, Mus musculus
catgttcttccttactcttctaaaa

SEQ ID NO: 332572 - DNA, 25 bp, Mus musculus
catgttcttctgctagtgtttggat

SEQ ID NO: 332573 - DNA, 25 bp, Mus musculus
catgttcttctggtagtgtttggat

SEQ ID NO: 332574 - DNA, 25 bp, Mus musculus
catgttcttgaaaggcatcggctaa

SEQ ID NO: 332575 - DNA, 25 bp, Mus musculus
catgttcttgaatggcatcggctaa

SEQ ID NO: 332576 - DNA, 25 bp, Mus musculus
catgttcttgttcttaagacttctt

SEQ ID NO: 332577 - DNA, 25 bp, Mus musculus
catgttcttgttgttaagacttctt

SEQ ID NO: 332578 - DNA, 25 bp, Mus musculus
catgttgaacacacatcctgggaac

SEQ ID NO: 332579 - DNA, 25 bp, Mus musculus
catgttgaacactcatcctgggaac

SEQ ID NO: 332580 - DNA, 25 bp, Mus musculus
catgttgaacttatctgtgtagctc

SEQ ID NO: 332581 - DNA, 25 bp, Mus musculus
catgttgaacttttctgtgtagctc

SEQ ID NO: 332582 - DNA, 25 bp, Mus musculus
catgttgaatgtcaatctggcctct

SEQ ID NO: 332583 - DNA, 25 bp, Mus musculus
catgttgaatgtgaatctggcctct

SEQ ID NO: 332584 - DNA, 25 bp, Mus musculus
catgttgacaaacttctgaagccta

SEQ ID NO: 332585 - DNA, 25 bp, Mus musculus
catgttgacaaagttctgaagccta

SEQ ID NO: 332586 - DNA, 25 bp, Mus musculus
catgttgaccgccatggaaaagctg

SEQ ID NO: 332587 - DNA, 25 bp, Mus musculus
catgttgaccgcgatggaaaagctg

SEQ ID NO: 332588 - DNA, 25 bp, Mus musculus
catgttgatggtattaactgcctta

SEQ ID NO: 332589 - DNA, 25 bp, Mus musculus
catgttgatggttttaactgcctta

SEQ ID NO: 332590 - DNA, 25 bp, Mus musculus
catgttgattccaatctgggcataa

SEQ ID NO: 332591 - DNA, 25 bp, Mus musculus
catgttgattcctatctgggcataa

SEQ ID NO: 332592 - DNA, 25 bp, Mus musculus
catgttgatttgacctcgggcacgt

SEQ ID NO: 332593 - DNA, 25 bp, Mus musculus
catgttgatttgtcctcgggcacgt

SEQ ID NO: 332594 - DNA, 25 bp, Mus musculus
catgttgcacttcgctatgtggaga

SEQ ID NO: 332595 - DNA, 25 bp, Mus musculus
catgttgcacttggctatgtggaga

SEQ ID NO: 332596 - DNA, 25 bp, Mus musculus
catgttggaaaaatagagctctggg

SEQ ID NO: 332597 - DNA, 25 bp, Mus musculus
catgttggaaaattagagctctggg

SEQ ID NO: 332598 - DNA, 25 bp, Mus musculus
catgttggattcactcgttggttca

SEQ ID NO: 332599 - DNA, 25 bp, Mus musculus
catgttggattctctcgttggttca

SEQ ID NO: 332600 - DNA, 25 bp, Mus musculus
catgttggcttccttgctcacttct

SEQ ID NO: 332601 - DNA, 25 bp, Mus musculus
catgttggcttcgttgctcacttct

SEQ ID NO: 332602 - DNA, 25 bp, Mus musculus
catgttggtctcatctttgcaatta

SEQ ID NO: 332603 - DNA, 25 bp, Mus musculus
catgttggtctcttctttgcaatta

SEQ ID NO: 332604 - DNA, 25 bp, Mus musculus
catgttggtgttctaagctcctaaa

SEQ ID NO: 332605 - DNA, 25 bp, Mus musculus
catgttggtgttgtaagctcctaaa

SEQ ID NO: 332606 - DNA, 25 bp, Mus musculus
catgttggttatattacccctgact

SEQ ID NO: 332607 - DNA, 25 bp, Mus musculus
catgttggttattttacccctgact

SEQ ID NO: 332608 - DNA, 25 bp, Mus musculus
catgttggttcaataatggccttta

SEQ ID NO: 332609 - DNA, 25 bp, Mus musculus
catgttggttcactgatggctttca

SEQ ID NO: 332610 - DNA, 25 bp, Mus musculus
catgttggttcagtgatggctttca

SEQ ID NO: 332611 - DNA, 25 bp, Mus musculus
catgttggttcattaatggccttta

SEQ ID NO: 332612 - DNA, 25 bp, Mus musculus
catgttggttgtactcagatgtgcc

SEQ ID NO: 332613 - DNA, 25 bp, Mus musculus
catgttggttgttctcagatgtgcc

SEQ ID NO: 332614 - DNA, 25 bp, Mus musculus
catgttggtttcctagtgtttacga

SEQ ID NO: 332615 - DNA, 25 bp, Mus musculus
catgttggtttcgtagtgtttacga

SEQ ID NO: 332616 - DNA, 25 bp, Mus musculus
catgttgtagccagtgttgtgtccc

SEQ ID NO: 332617 - DNA, 25 bp, Mus musculus
catgttgtagcctgtgttgtgtccc

SEQ ID NO: 332618 - DNA, 25 bp, Mus musculus
catgttgtatttagctctttcagat

SEQ ID NO: 332619 - DNA, 25 bp, Mus musculus
catgttgtattttgctctttcagat

SEQ ID NO: 332620 - DNA, 25 bp, Mus musculus
catgttgtcctcctacgcaggcaga

SEQ ID NO: 332621 - DNA, 25 bp, Mus musculus
catgttgtcctcgtacgcaggcaga

SEQ ID NO: 332622 - DNA, 25 bp, Mus musculus
catgttgtgaggctttgcttccgca

SEQ ID NO: 332623 - DNA, 25 bp, Mus musculus
catgttgtgagggtttgcttccgca

SEQ ID NO: 332624 - DNA, 25 bp, Mus musculus
catgttgtgctaagtaagtcatcac

SEQ ID NO: 332625 - DNA, 25 bp, Mus musculus
catgttgtgctatgtaagtcatcac

SEQ ID NO: 332626 - DNA, 25 bp, Mus musculus
catgttgtgggcatcctcaatattg

SEQ ID NO: 332627 - DNA, 25 bp, Mus musculus
catgttgtgggcttcctcaatattg

SEQ ID NO: 332628 - DNA, 25 bp, Mus musculus
catgttgtgtatcgccaacctgcag

SEQ ID NO: 332629 - DNA, 25 bp, Mus musculus
catgttgtgtatggccaacctgcag

SEQ ID NO: 332630 - DNA, 25 bp, Mus musculus
catgttgttagtcctgcaatctaaa

SEQ ID NO: 332631 - DNA, 25 bp, Mus musculus
catgttgttagtgctgcaatctaaa

SEQ ID NO: 332632 - DNA, 25 bp, Mus musculus
catgtttaaacacctgcagcagttg

SEQ ID NO: 332633 - DNA, 25 bp, Mus musculus
catgtttaaacagctgcagcagttg

SEQ ID NO: 332634 - DNA, 25 bp, Mus musculus
catgtttaagcactactggtgttca

SEQ ID NO: 332635 - DNA, 25 bp, Mus musculus
catgtttaagcagtactggtgttca

SEQ ID NO: 332636 - DNA, 25 bp, Mus musculus
catgtttaatccactcttcaagaca

SEQ ID NO: 332637 - DNA, 25 bp, Mus musculus
catgtttaatcctctcttcaagaca

SEQ ID NO: 332638 - DNA, 25 bp, Mus musculus
catgtttacctaccttttggactta

SEQ ID NO: 332639 - DNA, 25 bp, Mus musculus
catgtttacctagcttttggactta

SEQ ID NO: 332640 - DNA, 25 bp, Mus musculus
catgtttagtccattccggaagaga

SEQ ID NO: 332641 - DNA, 25 bp, Mus musculus
catgtttagtcctttccggaagaga

SEQ ID NO: 332642 - DNA, 25 bp, Mus musculus
catgtttatatgaccatttccaaga

SEQ ID NO: 332643 - DNA, 25 bp, Mus musculus
catgtttatatgtccatttccaaga

SEQ ID NO: 332644 - DNA, 25 bp, Mus musculus
catgtttcacatacaatccactttg

SEQ ID NO: 332645 - DNA, 25 bp, Mus musculus
catgtttcacattcaatccactttg

SEQ ID NO: 332646 - DNA, 25 bp, Mus musculus
catgtttcacgactttctgggatta

SEQ ID NO: 332647 - DNA, 25 bp, Mus musculus
catgtttcacgagtttctgggatta

SEQ ID NO: 332648 - DNA, 25 bp, Mus musculus
catgtttcactaactctaacttcaa

SEQ ID NO: 332649 - DNA, 25 bp, Mus musculus
catgtttcactatctctaacttcaa

SEQ ID NO: 332650 - DNA, 25 bp, Mus musculus
catgtttcagatagggttctcttta

SEQ ID NO: 332651 - DNA, 25 bp, Mus musculus
catgtttcagattgggttctcttta

SEQ ID NO: 332652 - DNA, 25 bp, Mus musculus
catgtttcagggacttctggctaaa

SEQ ID NO: 332653 - DNA, 25 bp, Mus musculus
catgtttcagggtcttctggctaaa

SEQ ID NO: 332654 - DNA, 25 bp, Mus musculus
catgtttcatatcatcaagctgtat

SEQ ID NO: 332655 - DNA, 25 bp, Mus musculus
catgtttcatatgatcaagctgtat

SEQ ID NO: 332656 - DNA, 25 bp, Mus musculus
catgtttccacacgtgcatttaata

SEQ ID NO: 332657 - DNA, 25 bp, Mus musculus
catgtttccacaggtgcatttaata

SEQ ID NO: 332658 - DNA, 25 bp, Mus musculus
catgtttccaggagttcccggttga

SEQ ID NO: 332659 - DNA, 25 bp, Mus musculus
catgtttccaggtgttcccggttga

SEQ ID NO: 332660 - DNA, 25 bp, Mus musculus
catgtttcccctaatgacatccaag

SEQ ID NO: 332661 - DNA, 25 bp, Mus musculus
catgtttccccttatgacatccaag

SEQ ID NO: 332662 - DNA, 25 bp, Mus musculus
catgtttccgagactctagagtctc

SEQ ID NO: 332663 - DNA, 25 bp, Mus musculus
catgtttccgagtctctagagtctc

SEQ ID NO: 332664 - DNA, 25 bp, Mus musculus
catgtttctaacagctaaatggagg

SEQ ID NO: 332665 - DNA, 25 bp, Mus musculus
catgtttctaactgctaaatggagg

SEQ ID NO: 332666 - DNA, 25 bp, Mus musculus
catgtttctgatcccaaaataggtg

SEQ ID NO: 332667 - DNA, 25 bp, Mus musculus
catgtttctgatgccaaaataggtg

SEQ ID NO: 332668 - DNA, 25 bp, Mus musculus
catgtttcttggagcttgtcttata

SEQ ID NO: 332669 - DNA, 25 bp, Mus musculus
catgtttcttggtgcttgtcttata

SEQ ID NO: 332670 - DNA, 25 bp, Mus musculus
catgtttcttgtccgtgggttgatt

SEQ ID NO: 332671 - DNA, 25 bp, Mus musculus
catgtttcttgtgcgtgggttgatt

SEQ ID NO: 332672 - DNA, 25 bp, Mus musculus
catgtttgatggatattttcgtgct

SEQ ID NO: 332673 - DNA, 25 bp, Mus musculus
catgtttgatggttattttcgtgct

SEQ ID NO: 332674 - DNA, 25 bp, Mus musculus
catgtttgccaaccttgcactgtat

SEQ ID NO: 332675 - DNA, 25 bp, Mus musculus
catgtttgccaagcttgcactgtat

SEQ ID NO: 332676 - DNA, 25 bp, Mus musculus
catgtttgcctacttgttattgtga

SEQ ID NO: 332677 - DNA, 25 bp, Mus musculus
catgtttgcctagttgttattgtga

SEQ ID NO: 332678 - DNA, 25 bp, Mus musculus
catgtttgctccctgtggaagcaga

SEQ ID NO: 332679 - DNA, 25 bp, Mus musculus
catgtttgctccgtgtggaagcaga

SEQ ID NO: 332680 - DNA, 25 bp, Mus musculus
catgtttgggacagatggcggacct

SEQ ID NO: 332681 - DNA, 25 bp, Mus musculus
catgtttgggactgatggcggacct

SEQ ID NO: 332682 - DNA, 25 bp, Mus musculus
catgtttgtctacttgctggcttta

SEQ ID NO: 332683 - DNA, 25 bp, Mus musculus
catgtttgtctagttgctggcttta

SEQ ID NO: 332684 - DNA, 25 bp, Mus musculus
catgtttgtgatcaaaggctgcttt

SEQ ID NO: 332685 - DNA, 25 bp, Mus musculus
catgtttgtgatgaaaggctgcttt

SEQ ID NO: 332686 - DNA, 25 bp, Mus musculus
catgtttgttatagcttgccccgag

SEQ ID NO: 332687 - DNA, 25 bp, Mus musculus
catgtttgttattgcttgccccgag

SEQ ID NO: 332688 - DNA, 25 bp, Mus musculus
catgtttgttgaagtcacatctcaa

SEQ ID NO: 332689 - DNA, 25 bp, Mus musculus
catgtttgttgatgtcacatctcaa

SEQ ID NO: 332690 - DNA, 25 bp, Mus musculus
catgtttgttgcctgaggatctgga

SEQ ID NO: 332691 - DNA, 25 bp, Mus musculus
catgtttgttgcgtgaggatctgga

SEQ ID NO: 332692 - DNA, 25 bp, Mus musculus
catgtttgttggagatctttgtatt

SEQ ID NO: 332693 - DNA, 25 bp, Mus musculus
catgtttgttggtgatctttgtatt

SEQ ID NO: 332694 - DNA, 25 bp, Mus musculus
catgttttacttacatttaagcact

SEQ ID NO: 332695 - DNA, 25 bp, Mus musculus
catgttttactttcatttaagcact

SEQ ID NO: 332696 - DNA, 25 bp, Mus musculus
catgttttccccacatccgtaaata

SEQ ID NO: 332697 - DNA, 25 bp, Mus musculus
catgttttcccctcatccgtaaata

SEQ ID NO: 332698 - DNA, 25 bp, Mus musculus
catgttttctaaatattcataaaag

SEQ ID NO: 332699 - DNA, 25 bp, Mus musculus
catgttttctaattattcataaaag

SEQ ID NO: 332700 - DNA, 25 bp, Mus musculus
catgttttggtcaatgaacgtaaag

SEQ ID NO: 332701 - DNA, 25 bp, Mus musculus
catgttttggtctatgaacgtaaag

SEQ ID NO: 332702 - DNA, 25 bp, Mus musculus
catgttttgtttatgagggtagcca

SEQ ID NO: 332703 - DNA, 25 bp, Mus musculus
catgttttgtttttgagggtagcca

SEQ ID NO: 332704 - DNA, 25 bp, Mus musculus
catgtttttattactggcctccaca

SEQ ID NO: 332705 - DNA, 25 bp, Mus musculus
catgtttttatttctggcctccaca

SEQ ID NO: 332706 - DNA, 25 bp, Mus musculus
catgtttttccgaagtctgcatttt

SEQ ID NO: 332707 - DNA, 25 bp, Mus musculus
catgtttttccgtagtctgcatttt

SEQ ID NO: 332708 - DNA, 25 bp, Mus musculus
catgtttttctcacttaggtctcac

SEQ ID NO: 332709 - DNA, 25 bp, Mus musculus
catgtttttctctcttaggtctcac

SEQ ID NO: 332710 - DNA, 25 bp, Mus musculus
catgtttttctgaccttgagtttgt

SEQ ID NO: 332711 - DNA, 25 bp, Mus musculus
catgtttttctgtccttgagtttgt

SEQ ID NO: 332712 - DNA, 25 bp, Mus musculus
catgttttttgtccagggtctggga

SEQ ID NO: 332713 - DNA, 25 bp, Mus musculus
catgttttttgtgcagggtctggga

SEQ ID NO: 332714 - DNA, 25 bp, Mus musculus
cattaaaacaggactttggtgagca

SEQ ID NO: 332715 - DNA, 25 bp, Mus musculus
cattaaaacaggtctttggtgagca

SEQ ID NO: 332716 - DNA, 25 bp, Mus musculus
cattaaaagtcaagccaagggtcaa

SEQ ID NO: 332717 - DNA, 25 bp, Mus musculus
cattaaaagtcatgccaagggtcaa

SEQ ID NO: 332718 - DNA, 25 bp, Mus musculus
cattaaacaggacccgtgcttctaa

SEQ ID NO: 332719 - DNA, 25 bp, Mus musculus
cattaaacaggagccgtgcttctaa

SEQ ID NO: 332720 - DNA, 25 bp, Mus musculus
cattaaagtgtaaggagtttccctt

SEQ ID NO: 332721 - DNA, 25 bp, Mus musculus
cattaaagtgtatggagtttccctt

SEQ ID NO: 332722 - DNA, 25 bp, Mus musculus
cattaaataatgcttgcagccagta

SEQ ID NO: 332723 - DNA, 25 bp, Mus musculus
cattaaataatggttgcagccagta

SEQ ID NO: 332724 - DNA, 25 bp, Mus musculus
cattaaatgacaccagtgagcaaat

SEQ ID NO: 332725 - DNA, 25 bp, Mus musculus
cattaaatgacagcagtgagcaaat

SEQ ID NO: 332726 - DNA, 25 bp, Mus musculus
cattaaatggaacttctgctagcag

SEQ ID NO: 332727 - DNA, 25 bp, Mus musculus
cattaaatggaagttctgctagcag

SEQ ID NO: 332728 - DNA, 25 bp, Mus musculus
cattaaattcaccattagtagctaa

SEQ ID NO: 332729 - DNA, 25 bp, Mus musculus
cattaaattcacgattagtagctaa

SEQ ID NO: 332730 - DNA, 25 bp, Mus musculus
cattaacaagttcgcagagtacacc

SEQ ID NO: 332731 - DNA, 25 bp, Mus musculus
cattaacaagttggcagagtacacc

SEQ ID NO: 332732 - DNA, 25 bp, Mus musculus
cattaacccagcagccgaattggcc

SEQ ID NO: 332733 - DNA, 25 bp, Mus musculus
cattaacccagctgccgaattggcc

SEQ ID NO: 332734 - DNA, 25 bp, Mus musculus
cattaacccaggatctgccactggg

SEQ ID NO: 332735 - DNA, 25 bp, Mus musculus
cattaacccaggttctgccactggg

SEQ ID NO: 332736 - DNA, 25 bp, Mus musculus
cattaacgtaagatacctggcccag

SEQ ID NO: 332737 - DNA, 25 bp, Mus musculus
cattaacgtaagttacctggcccag

SEQ ID NO: 332738 - DNA, 25 bp, Mus musculus
cattaacttcttaacaatttcaggg

SEQ ID NO: 332739 - DNA, 25 bp, Mus musculus
cattaacttctttacaatttcaggg

SEQ ID NO: 332740 - DNA, 25 bp, Mus musculus
cattaactttaaatcctcctctgct

SEQ ID NO: 332741 - DNA, 25 bp, Mus musculus
cattaactttaattcctcctctgct

SEQ ID NO: 332742 - DNA, 25 bp, Mus musculus
cattaactttctctagcttctgaga

SEQ ID NO: 332743 - DNA, 25 bp, Mus musculus
cattaactttctgtagcttctgaga

SEQ ID NO: 332744 - DNA, 25 bp, Mus musculus
cattaactttggaccatccttcaaa

SEQ ID NO: 332745 - DNA, 25 bp, Mus musculus
cattaactttggtccatccttcaaa

SEQ ID NO: 332746 - DNA, 25 bp, Mus musculus
cattaagactatactcagccaggtt

SEQ ID NO: 332747 - DNA, 25 bp, Mus musculus
cattaagactattctcagccaggtt

SEQ ID NO: 332748 - DNA, 25 bp, Mus musculus
cattaagacttaaatcacttttgtt

SEQ ID NO: 332749 - DNA, 25 bp, Mus musculus
cattaagacttatatcacttttgtt

SEQ ID NO: 332750 - DNA, 25 bp, Mus musculus
cattaagagccactgtagatagaag

SEQ ID NO: 332751 - DNA, 25 bp, Mus musculus
cattaagagccagtgtagatagaag

SEQ ID NO: 332752 - DNA, 25 bp, Mus musculus
cattaagattggagatacacggcta

SEQ ID NO: 332753 - DNA, 25 bp, Mus musculus
cattaagattggtgatacacggcta

SEQ ID NO: 332754 - DNA, 25 bp, Mus musculus
cattaagcagtcactgttgctgatt

SEQ ID NO: 332755 - DNA, 25 bp, Mus musculus
cattaagcagtctctgttgctgatt

SEQ ID NO: 332756 - DNA, 25 bp, Mus musculus
cattaagcagttcccagcagcgtcc

SEQ ID NO: 332757 - DNA, 25 bp, Mus musculus
cattaagcagttgccagcagcgtcc

SEQ ID NO: 332758 - DNA, 25 bp, Mus musculus
cattaagcttccctagtcctagtaa

SEQ ID NO: 332759 - DNA, 25 bp, Mus musculus
cattaagcttccgtagtcctagtaa

SEQ ID NO: 332760 - DNA, 25 bp, Mus musculus
cattaagcttgtactgatttccaca

SEQ ID NO: 332761 - DNA, 25 bp, Mus musculus
cattaagcttgttctgatttccaca

SEQ ID NO: 332762 - DNA, 25 bp, Mus musculus
cattaaggacatcgcgggcctgctg

SEQ ID NO: 332763 - DNA, 25 bp, Mus musculus
cattaaggacatggcgggcctgctg

SEQ ID NO: 332764 - DNA, 25 bp, Mus musculus
cattaaggactcatggtaggtttta

SEQ ID NO: 332765 - DNA, 25 bp, Mus musculus
cattaaggactcttggtaggtttta

SEQ ID NO: 332766 - DNA, 25 bp, Mus musculus
cattaaggtcttctttctgccaggc

SEQ ID NO: 332767 - DNA, 25 bp, Mus musculus
cattaaggtcttgtttctgccaggc

SEQ ID NO: 332768 - DNA, 25 bp, Mus musculus
cattaaggtggaaagccgcattcta

SEQ ID NO: 332769 - DNA, 25 bp, Mus musculus
cattaaggtggatagccgcattcta

SEQ ID NO: 332770 - DNA, 25 bp, Mus musculus
cattaaggttctctggattccatcc

SEQ ID NO: 332771 - DNA, 25 bp, Mus musculus
cattaaggttctgtggattccatcc

SEQ ID NO: 332772 - DNA, 25 bp, Mus musculus
cattaagtagacaagccagccagga

SEQ ID NO: 332773 - DNA, 25 bp, Mus musculus
cattaagtagactagccagccagga

SEQ ID NO: 332774 - DNA, 25 bp, Mus musculus
cattaagtaggcatttccttccctg

SEQ ID NO: 332775 - DNA, 25 bp, Mus musculus
cattaagtaggcttttccttccctg

SEQ ID NO: 332776 - DNA, 25 bp, Mus musculus
cattaagtccttccctgccattaag

SEQ ID NO: 332777 - DNA, 25 bp, Mus musculus
cattaagtccttgcctgccattaag

SEQ ID NO: 332778 - DNA, 25 bp, Mus musculus
cattaatacaggacagaagagttct

SEQ ID NO: 332779 - DNA, 25 bp, Mus musculus
cattaatacaggtcagaagagttct

SEQ ID NO: 332780 - DNA, 25 bp, Mus musculus
cattaatagttccacttaactctca

SEQ ID NO: 332781 - DNA, 25 bp, Mus musculus
cattaatagttcgacttaactctca

SEQ ID NO: 332782 - DNA, 25 bp, Mus musculus
cattaatattttctgcaaacttgca

SEQ ID NO: 332783 - DNA, 25 bp, Mus musculus
cattaatattttgtgcaaacttgca

SEQ ID NO: 332784 - DNA, 25 bp, Mus musculus
cattaatccgttaatgtgatgtgta

SEQ ID NO: 332785 - DNA, 25 bp, Mus musculus
cattaatccgtttatgtgatgtgta

SEQ ID NO: 332786 - DNA, 25 bp, Mus musculus
cattaatcgggtccatttcattgtg

SEQ ID NO: 332787 - DNA, 25 bp, Mus musculus
cattaatcgggtgcatttcattgtg

SEQ ID NO: 332788 - DNA, 25 bp, Mus musculus
cattaatgacacatgaaacccggtt

SEQ ID NO: 332789 - DNA, 25 bp, Mus musculus
cattaatgacacttgaaacccggtt

SEQ ID NO: 332790 - DNA, 25 bp, Mus musculus
cattaatgtgagaaggctaggccca

SEQ ID NO: 332791 - DNA, 25 bp, Mus musculus
cattaatgtgagtaggctaggccca

SEQ ID NO: 332792 - DNA, 25 bp, Mus musculus
cattaattatggcagaaaagcccct

SEQ ID NO: 332793 - DNA, 25 bp, Mus musculus
cattaattatgggagaaaagcccct

SEQ ID NO: 332794 - DNA, 25 bp, Mus musculus
cattaattcaagattatctctgggt

SEQ ID NO: 332795 - DNA, 25 bp, Mus musculus
cattaattcaagtttatctctgggt

SEQ ID NO: 332796 - DNA, 25 bp, Mus musculus
cattaattcatgattgccctgcgcc

SEQ ID NO: 332797 - DNA, 25 bp, Mus musculus
cattaattcatgtttgccctgcgcc

SEQ ID NO: 332798 - DNA, 25 bp, Mus musculus
cattaattcgttataagatccctgt

SEQ ID NO: 332799 - DNA, 25 bp, Mus musculus
cattaattcgttttaagatccctgt

SEQ ID NO: 332800 - DNA, 25 bp, Mus musculus
cattacaactctcaaagggtgcatt

SEQ ID NO: 332801 - DNA, 25 bp, Mus musculus
cattacaactctgaaagggtgcatt

SEQ ID NO: 332802 - DNA, 25 bp, Mus musculus
cattacaatcgtcctgtccaggact

SEQ ID NO: 332803 - DNA, 25 bp, Mus musculus
cattacaatcgtgctgtccaggact

SEQ ID NO: 332804 - DNA, 25 bp, Mus musculus
cattacaattaacgccctgaaacct

SEQ ID NO: 332805 - DNA, 25 bp, Mus musculus
cattacaattaaggccctgaaacct

SEQ ID NO: 332806 - DNA, 25 bp, Mus musculus
cattacacacacattaccacatgca

SEQ ID NO: 332807 - DNA, 25 bp, Mus musculus
cattacacacactttaccacatgca

SEQ ID NO: 332808 - DNA, 25 bp, Mus musculus
cattacactgatcagctatgcaaga

SEQ ID NO: 332809 - DNA, 25 bp, Mus musculus
cattacactgatgagctatgcaaga

SEQ ID NO: 332810 - DNA, 25 bp, Mus musculus
cattacactggaaggctctgagcga

SEQ ID NO: 332811 - DNA, 25 bp, Mus musculus
cattacactggatggctctgagcga

SEQ ID NO: 332812 - DNA, 25 bp, Mus musculus
cattacagagttccaaggcattcga

SEQ ID NO: 332813 - DNA, 25 bp, Mus musculus
cattacagagttgcaaggcattcga

SEQ ID NO: 332814 - DNA, 25 bp, Mus musculus
cattacaggcttacatacgggatca

SEQ ID NO: 332815 - DNA, 25 bp, Mus musculus
cattacaggctttcatacgggatca

SEQ ID NO: 332816 - DNA, 25 bp, Mus musculus
cattacagtcctcaatttcctccag

SEQ ID NO: 332817 - DNA, 25 bp, Mus musculus
cattacagtcctgaatttcctccag

SEQ ID NO: 332818 - DNA, 25 bp, Mus musculus
cattacagtggtctggaccccataa

SEQ ID NO: 332819 - DNA, 25 bp, Mus musculus
cattacagtggtgtggaccccataa

SEQ ID NO: 332820 - DNA, 25 bp, Mus musculus
cattacatgatgctggctattcaat

SEQ ID NO: 332821 - DNA, 25 bp, Mus musculus
cattacatgatggtggctattcaat

SEQ ID NO: 332822 - DNA, 25 bp, Mus musculus
cattacatgtgtcaattcctggatt

SEQ ID NO: 332823 - DNA, 25 bp, Mus musculus
cattacatgtgtgaattcctggatt

SEQ ID NO: 332824 - DNA, 25 bp, Mus musculus
cattacattcaaccggccgttcctg

SEQ ID NO: 332825 - DNA, 25 bp, Mus musculus
cattacattcaagcggccgttcctg

SEQ ID NO: 332826 - DNA, 25 bp, Mus musculus
cattacattcttacttctctattcc

SEQ ID NO: 332827 - DNA, 25 bp, Mus musculus
cattacattctttcttctctattcc

SEQ ID NO: 332828 - DNA, 25 bp, Mus musculus
cattaccaaattatctgcagctccc

SEQ ID NO: 332829 - DNA, 25 bp, Mus musculus
cattaccaaattttctgcagctccc

SEQ ID NO: 332830 - DNA, 25 bp, Mus musculus
cattaccaatgtatgcagggacgca

SEQ ID NO: 332831 - DNA, 25 bp, Mus musculus
cattaccaatgtttgcagggacgca

SEQ ID NO: 332832 - DNA, 25 bp, Mus musculus
cattaccacgttcgaggaggatagc

SEQ ID NO: 332833 - DNA, 25 bp, Mus musculus
cattaccacgttggaggaggatagc

SEQ ID NO: 332834 - DNA, 25 bp, Mus musculus
cattaccatacccaattttggtttg

SEQ ID NO: 332835 - DNA, 25 bp, Mus musculus
cattaccataccgaattttggtttg

SEQ ID NO: 332836 - DNA, 25 bp, Mus musculus
cattaccattgtcgttcatcctcat

SEQ ID NO: 332837 - DNA, 25 bp, Mus musculus
cattaccattgtggttcatcctcat

SEQ ID NO: 332838 - DNA, 25 bp, Mus musculus
cattacccaccactttaaggtcaga

SEQ ID NO: 332839 - DNA, 25 bp, Mus musculus
cattacccaccagtttaaggtcaga

SEQ ID NO: 332840 - DNA, 25 bp, Mus musculus
cattacccatcaccaggacgatagg

SEQ ID NO: 332841 - DNA, 25 bp, Mus musculus
cattacccatcagcaggacgatagg

SEQ ID NO: 332842 - DNA, 25 bp, Mus musculus
cattaccccgttcaagtgtctatag

SEQ ID NO: 332843 - DNA, 25 bp, Mus musculus
cattaccccgttgaagtgtctatag

SEQ ID NO: 332844 - DNA, 25 bp, Mus musculus
cattaccgtgcacacgttgccaaca

SEQ ID NO: 332845 - DNA, 25 bp, Mus musculus
cattaccgtgcagacgttgccaaca

SEQ ID NO: 332846 - DNA, 25 bp, Mus musculus
cattacctatagaggctgggttcaa

SEQ ID NO: 332847 - DNA, 25 bp, Mus musculus
cattacctatagtggctgggttcaa

SEQ ID NO: 332848 - DNA, 25 bp, Mus musculus
cattacctcttaccttagccaaaat

SEQ ID NO: 332849 - DNA, 25 bp, Mus musculus
cattacctcttagcttagccaaaat

SEQ ID NO: 332850 - DNA, 25 bp, Mus musculus
cattacctgaggcttcccaaggata

SEQ ID NO: 332851 - DNA, 25 bp, Mus musculus
cattacctgagggttcccaaggata

SEQ ID NO: 332852 - DNA, 25 bp, Mus musculus
cattacctgctgattcatgttgcca

SEQ ID NO: 332853 - DNA, 25 bp, Mus musculus
cattacctgctgtttcatgttgcca

SEQ ID NO: 332854 - DNA, 25 bp, Mus musculus
cattacctggagacttgctcccaat

SEQ ID NO: 332855 - DNA, 25 bp, Mus musculus
cattacctggagcatctcagaaccc

SEQ ID NO: 332856 - DNA, 25 bp, Mus musculus
cattacctggaggatctcagaaccc

SEQ ID NO: 332857 - DNA, 25 bp, Mus musculus
cattacctggagtcttgctcccaat

SEQ ID NO: 332858 - DNA, 25 bp, Mus musculus
cattacctgttcaatccgtgattgc

SEQ ID NO: 332859 - DNA, 25 bp, Mus musculus
cattacctgttctatccgtgattgc

SEQ ID NO: 332860 - DNA, 25 bp, Mus musculus
cattacgaacagaggccagccaggt

SEQ ID NO: 332861 - DNA, 25 bp, Mus musculus
cattacgaacagtggccagccaggt

SEQ ID NO: 332862 - DNA, 25 bp, Mus musculus
cattacgcgttgatttttcagctgc

SEQ ID NO: 332863 - DNA, 25 bp, Mus musculus
cattacgcgttgttttttcagctgc

SEQ ID NO: 332864 - DNA, 25 bp, Mus musculus
cattacgctgacagatatcctggga

SEQ ID NO: 332865 - DNA, 25 bp, Mus musculus
cattacgctgactgatatcctggga

SEQ ID NO: 332866 - DNA, 25 bp, Mus musculus
cattacggccgcatagttctacggg

SEQ ID NO: 332867 - DNA, 25 bp, Mus musculus
cattacggccgcttagttctacggg

SEQ ID NO: 332868 - DNA, 25 bp, Mus musculus
cattacggctgaaagcaacctggtg

SEQ ID NO: 332869 - DNA, 25 bp, Mus musculus
cattacggctgatagcaacctggtg

SEQ ID NO: 332870 - DNA, 25 bp, Mus musculus
cattacggctgcatctgtttgtttt

SEQ ID NO: 332871 - DNA, 25 bp, Mus musculus
cattacggctgcttctgtttgtttt

SEQ ID NO: 332872 - DNA, 25 bp, Mus musculus
cattacgtatgcactgacatcttaa

SEQ ID NO: 332873 - DNA, 25 bp, Mus musculus
cattacgtatgctctgacatcttaa

SEQ ID NO: 332874 - DNA, 25 bp, Mus musculus
cattacgtgttgctctgtgttttca

SEQ ID NO: 332875 - DNA, 25 bp, Mus musculus
cattacgtgttggtctgtgttttca

SEQ ID NO: 332876 - DNA, 25 bp, Mus musculus
cattacgtttatatgtggtgaggtt

SEQ ID NO: 332877 - DNA, 25 bp, Mus musculus
cattacgtttatttgtggtgaggtt

SEQ ID NO: 332878 - DNA, 25 bp, Mus musculus
cattacgttttcagtgcttttgaac

SEQ ID NO: 332879 - DNA, 25 bp, Mus musculus
cattacgttttcatctggcttgcat

SEQ ID NO: 332880 - DNA, 25 bp, Mus musculus
cattacgttttctgtgcttttgaac

SEQ ID NO: 332881 - DNA, 25 bp, Mus musculus
cattacgttttcttctggcttgcat

SEQ ID NO: 332882 - DNA, 25 bp, Mus musculus
cattactcctaccatatacacatct

SEQ ID NO: 332883 - DNA, 25 bp, Mus musculus
cattactcctacgatatacacatct

SEQ ID NO: 332884 - DNA, 25 bp, Mus musculus
cattactgaaacaatacagatgttg

SEQ ID NO: 332885 - DNA, 25 bp, Mus musculus
cattactgaaactatacagatgttg

SEQ ID NO: 332886 - DNA, 25 bp, Mus musculus
cattactggcgaagttttctggttt

SEQ ID NO: 332887 - DNA, 25 bp, Mus musculus
cattactggcgatgttttctggttt

SEQ ID NO: 332888 - DNA, 25 bp, Mus musculus
cattacttataccagaggagatcca

SEQ ID NO: 332889 - DNA, 25 bp, Mus musculus
cattacttatacgagaggagatcca

SEQ ID NO: 332890 - DNA, 25 bp, Mus musculus
cattacttcacccaatactttctgg

SEQ ID NO: 332891 - DNA, 25 bp, Mus musculus
cattacttcaccgaatactttctgg

SEQ ID NO: 332892 - DNA, 25 bp, Mus musculus
cattacttccgtaactattcaaaat

SEQ ID NO: 332893 - DNA, 25 bp, Mus musculus
cattacttccgttactattcaaaat

SEQ ID NO: 332894 - DNA, 25 bp, Mus musculus
cattactttcttaccagtgttgtgg

SEQ ID NO: 332895 - DNA, 25 bp, Mus musculus
cattactttctttccagtgttgtgg

SEQ ID NO: 332896 - DNA, 25 bp, Mus musculus
cattagaactggctcacacttggct

SEQ ID NO: 332897 - DNA, 25 bp, Mus musculus
cattagaactgggtcacacttggct

SEQ ID NO: 332898 - DNA, 25 bp, Mus musculus
cattagaccattcgttcccaacctt

SEQ ID NO: 332899 - DNA, 25 bp, Mus musculus
cattagaccattggttcccaacctt

SEQ ID NO: 332900 - DNA, 25 bp, Mus musculus
cattagagccctaagtgtggaagat

SEQ ID NO: 332901 - DNA, 25 bp, Mus musculus
cattagagcccttagtgtggaagat

SEQ ID NO: 332902 - DNA, 25 bp, Mus musculus
cattagcacactcgtaggtcaaata

SEQ ID NO: 332903 - DNA, 25 bp, Mus musculus
cattagcacactcgtggcatatttt

SEQ ID NO: 332904 - DNA, 25 bp, Mus musculus
cattagcacactggtaggtcaaata

SEQ ID NO: 332905 - DNA, 25 bp, Mus musculus
cattagcacactggtggcatatttt

SEQ ID NO: 332906 - DNA, 25 bp, Mus musculus
cattagcagtggagcttcagtgccc

SEQ ID NO: 332907 - DNA, 25 bp, Mus musculus
cattagcagtggtgcttcagtgccc

SEQ ID NO: 332908 - DNA, 25 bp, Mus musculus
cattagcatttcaggtatacgcgat

SEQ ID NO: 332909 - DNA, 25 bp, Mus musculus
cattagcatttctggtatacgcgat

SEQ ID NO: 332910 - DNA, 25 bp, Mus musculus
cattagcgaggacttggaccacgtt

SEQ ID NO: 332911 - DNA, 25 bp, Mus musculus
cattagcgaggagttggaccacgtt

SEQ ID NO: 332912 - DNA, 25 bp, Mus musculus
cattagcgccttattcctgtttata

SEQ ID NO: 332913 - DNA, 25 bp, Mus musculus
cattagcgcctttttcctgtttata

SEQ ID NO: 332914 - DNA, 25 bp, Mus musculus
cattagctcagtcgtgtcccggtga

SEQ ID NO: 332915 - DNA, 25 bp, Mus musculus
cattagctcagtggtgtcccggtga

SEQ ID NO: 332916 - DNA, 25 bp, Mus musculus
cattagctgaccatctgtgttaaac

SEQ ID NO: 332917 - DNA, 25 bp, Mus musculus
cattagctgaccttctgtgttaaac

SEQ ID NO: 332918 - DNA, 25 bp, Mus musculus
cattagctgattccactgtgtagat

SEQ ID NO: 332919 - DNA, 25 bp, Mus musculus
cattagctgattgcactgtgtagat

SEQ ID NO: 332920 - DNA, 25 bp, Mus musculus
cattagctggctaccttgttcattg

SEQ ID NO: 332921 - DNA, 25 bp, Mus musculus
cattagctggcttccttgttcattg

SEQ ID NO: 332922 - DNA, 25 bp, Mus musculus
cattagcttatgactctgtaggtca

SEQ ID NO: 332923 - DNA, 25 bp, Mus musculus
cattagcttatgtctctgtaggtca

SEQ ID NO: 332924 - DNA, 25 bp, Mus musculus
cattagcttgtgagccaggacttgg

SEQ ID NO: 332925 - DNA, 25 bp, Mus musculus
cattagcttgtgtgccaggacttgg

SEQ ID NO: 332926 - DNA, 25 bp, Mus musculus
cattaggcttggagtcaagcgcctt

SEQ ID NO: 332927 - DNA, 25 bp, Mus musculus
cattaggcttggtgtcaagcgcctt

SEQ ID NO: 332928 - DNA, 25 bp, Mus musculus
cattaggcttttagttgcacttcaa

SEQ ID NO: 332929 - DNA, 25 bp, Mus musculus
cattaggctttttgttgcacttcaa

SEQ ID NO: 332930 - DNA, 25 bp, Mus musculus
cattagggaccaatttgttgtttct

SEQ ID NO: 332931 - DNA, 25 bp, Mus musculus
cattagggaccattttgttgtttct

SEQ ID NO: 332932 - DNA, 25 bp, Mus musculus
cattagggacgtatatgcacagcca

SEQ ID NO: 332933 - DNA, 25 bp, Mus musculus
cattagggacgtttatgcacagcca

SEQ ID NO: 332934 - DNA, 25 bp, Mus musculus
cattagggaggtccccgatgagttt

SEQ ID NO: 332935 - DNA, 25 bp, Mus musculus
cattagggaggtgcccgatgagttt

SEQ ID NO: 332936 - DNA, 25 bp, Mus musculus
cattagggatgtactctggagtgca

SEQ ID NO: 332937 - DNA, 25 bp, Mus musculus
cattagggatgttctctggagtgca

SEQ ID NO: 332938 - DNA, 25 bp, Mus musculus
cattagggcagcaagttcaacatca

SEQ ID NO: 332939 - DNA, 25 bp, Mus musculus
cattagggcagctagttcaacatca

SEQ ID NO: 332940 - DNA, 25 bp, Mus musculus
cattagggcatactaagtttcggca

SEQ ID NO: 332941 - DNA, 25 bp, Mus musculus
cattagggcatagtaagtttcggca

SEQ ID NO: 332942 - DNA, 25 bp, Mus musculus
cattagggcttgaaagtggcctcaa

SEQ ID NO: 332943 - DNA, 25 bp, Mus musculus
cattagggcttgtaagtggcctcaa

SEQ ID NO: 332944 - DNA, 25 bp, Mus musculus
cattaggtatacatggtgcacgtac

SEQ ID NO: 332945 - DNA, 25 bp, Mus musculus
cattaggtatacttggtgcacgtac

SEQ ID NO: 332946 - DNA, 25 bp, Mus musculus
cattaggttaccactgtgagcaaca

SEQ ID NO: 332947 - DNA, 25 bp, Mus musculus
cattaggttacctctgtgagcaaca

SEQ ID NO: 332948 - DNA, 25 bp, Mus musculus
cattaggtttccctgggttcctgcg

SEQ ID NO: 332949 - DNA, 25 bp, Mus musculus
cattaggtttccgtgggttcctgcg

SEQ ID NO: 332950 - DNA, 25 bp, Mus musculus
cattagtaattgaccactgggcagg

SEQ ID NO: 332951 - DNA, 25 bp, Mus musculus
cattagtaattgtccactgggcagg

SEQ ID NO: 332952 - DNA, 25 bp, Mus musculus
cattagtagactcttgccttgtggg

SEQ ID NO: 332953 - DNA, 25 bp, Mus musculus
cattagtagactgttgccttgtggg

SEQ ID NO: 332954 - DNA, 25 bp, Mus musculus
cattagtagtgtattcattttaggt

SEQ ID NO: 332955 - DNA, 25 bp, Mus musculus
cattagtagtgttttcattttaggt

SEQ ID NO: 332956 - DNA, 25 bp, Mus musculus
cattagtatccgaggtatttcggtt

SEQ ID NO: 332957 - DNA, 25 bp, Mus musculus
cattagtatccgtggtatttcggtt

SEQ ID NO: 332958 - DNA, 25 bp, Mus musculus
cattagtctagccaatcactctcct

SEQ ID NO: 332959 - DNA, 25 bp, Mus musculus
cattagtctagcgaatcactctcct

SEQ ID NO: 332960 - DNA, 25 bp, Mus musculus
cattagtgaaaacccaggcagattt

SEQ ID NO: 332961 - DNA, 25 bp, Mus musculus
cattagtgaaaagccaggcagattt

SEQ ID NO: 332962 - DNA, 25 bp, Mus musculus
cattagtgacccagcagagtggctc

SEQ ID NO: 332963 - DNA, 25 bp, Mus musculus
cattagtgaccctgcagagtggctc

SEQ ID NO: 332964 - DNA, 25 bp, Mus musculus
cattagtgtcttatcctagttccct

SEQ ID NO: 332965 - DNA, 25 bp, Mus musculus
cattagtgtcttttcctagttccct

SEQ ID NO: 332966 - DNA, 25 bp, Mus musculus
cattagttacagaggtggcactttc

SEQ ID NO: 332967 - DNA, 25 bp, Mus musculus
cattagttacagtggtggcactttc

SEQ ID NO: 332968 - DNA, 25 bp, Mus musculus
cattagttgggccaggatagctcta

SEQ ID NO: 332969 - DNA, 25 bp, Mus musculus
cattagttgggcgaggatagctcta

SEQ ID NO: 332970 - DNA, 25 bp, Mus musculus
cattagttgtgccaggcttggtcct

SEQ ID NO: 332971 - DNA, 25 bp, Mus musculus
cattagttgtgcgaggcttggtcct

SEQ ID NO: 332972 - DNA, 25 bp, Mus musculus
cattataacctcaaactctgcctag

SEQ ID NO: 332973 - DNA, 25 bp, Mus musculus
cattataacctctaactctgcctag

SEQ ID NO: 332974 - DNA, 25 bp, Mus musculus
cattatacctaaccttcctcctgtg

SEQ ID NO: 332975 - DNA, 25 bp, Mus musculus
cattatacctaagcttcctcctgtg

SEQ ID NO: 332976 - DNA, 25 bp, Mus musculus
cattataccttcaatttatcagtgg

SEQ ID NO: 332977 - DNA, 25 bp, Mus musculus
cattataccttctatttatcagtgg

SEQ ID NO: 332978 - DNA, 25 bp, Mus musculus
cattatactcacctattctcattca

SEQ ID NO: 332979 - DNA, 25 bp, Mus musculus
cattatactcacgtattctcattca

SEQ ID NO: 332980 - DNA, 25 bp, Mus musculus
cattatagcactccgctcacgttcg

SEQ ID NO: 332981 - DNA, 25 bp, Mus musculus
cattatagcactgcgctcacgttcg

SEQ ID NO: 332982 - DNA, 25 bp, Mus musculus
cattatagcgttagttctgtagacc

SEQ ID NO: 332983 - DNA, 25 bp, Mus musculus
cattatagcgtttgttctgtagacc

SEQ ID NO: 332984 - DNA, 25 bp, Mus musculus
cattatagtttaacattgtaccaga

SEQ ID NO: 332985 - DNA, 25 bp, Mus musculus
cattatagtttatcattgtaccaga

SEQ ID NO: 332986 - DNA, 25 bp, Mus musculus
cattatatgtgtccctgagaaagtc

SEQ ID NO: 332987 - DNA, 25 bp, Mus musculus
cattatatgtgtgcctgagaaagtc

SEQ ID NO: 332988 - DNA, 25 bp, Mus musculus
cattatatgttgactcagctgtttc

SEQ ID NO: 332989 - DNA, 25 bp, Mus musculus
cattatatgttgtctcagctgtttc

SEQ ID NO: 332990 - DNA, 25 bp, Mus musculus
cattatcattggctcgattatggat

SEQ ID NO: 332991 - DNA, 25 bp, Mus musculus
cattatcattgggtcgattatggat

SEQ ID NO: 332992 - DNA, 25 bp, Mus musculus
cattatccagagatattccaggagt

SEQ ID NO: 332993 - DNA, 25 bp, Mus musculus
cattatccagagttattccaggagt

SEQ ID NO: 332994 - DNA, 25 bp, Mus musculus
cattatccctgcaggctttaatacc

SEQ ID NO: 332995 - DNA, 25 bp, Mus musculus
cattatccctgctggctttaatacc

SEQ ID NO: 332996 - DNA, 25 bp, Mus musculus
cattatccctgtacccagttgagct

SEQ ID NO: 332997 - DNA, 25 bp, Mus musculus
cattatccctgttcccagttgagct

SEQ ID NO: 332998 - DNA, 25 bp, Mus musculus
cattatcctcaaagtttcatcaaca

SEQ ID NO: 332999 - DNA, 25 bp, Mus musculus
cattatcctcaatgtttcatcaaca

SEQ ID NO: 333000 - DNA, 25 bp, Mus musculus
cattatcctcctattggtctaccct

SEQ ID NO: 333001 - DNA, 25 bp, Mus musculus
cattatcctccttttggtctaccct

SEQ ID NO: 333002 - DNA, 25 bp, Mus musculus
cattatcctcttctaatctacaaaa

SEQ ID NO: 333003 - DNA, 25 bp, Mus musculus
cattatcctcttgtaatctacaaaa

SEQ ID NO: 333004 - DNA, 25 bp, Mus musculus
cattatcctgttactactagctgtc

SEQ ID NO: 333005 - DNA, 25 bp, Mus musculus
cattatcctgtttctactagctgtc

SEQ ID NO: 333006 - DNA, 25 bp, Mus musculus
cattatccttcacttcacatcacag

SEQ ID NO: 333007 - DNA, 25 bp, Mus musculus
cattatccttcagttcacatcacag

SEQ ID NO: 333008 - DNA, 25 bp, Mus musculus
cattatcgaagcctatgggagcaat

SEQ ID NO: 333009 - DNA, 25 bp, Mus musculus
cattatcgaagcgtatgggagcaat

SEQ ID NO: 333010 - DNA, 25 bp, Mus musculus
cattatctctttccacccttaaaat

SEQ ID NO: 333011 - DNA, 25 bp, Mus musculus
cattatctctttgcacccttaaaat

SEQ ID NO: 333012 - DNA, 25 bp, Mus musculus
cattatctgcataagcgtcctatta

SEQ ID NO: 333013 - DNA, 25 bp, Mus musculus
cattatctgcattagcgtcctatta

SEQ ID NO: 333014 - DNA, 25 bp, Mus musculus
cattatctgggtcgtgtggatctcc

SEQ ID NO: 333015 - DNA, 25 bp, Mus musculus
cattatctgggtggtgtggatctcc

SEQ ID NO: 333016 - DNA, 25 bp, Mus musculus
cattatctgtaaatacattcaccga

SEQ ID NO: 333017 - DNA, 25 bp, Mus musculus
cattatctgtaattacattcaccga

SEQ ID NO: 333018 - DNA, 25 bp, Mus musculus
cattatgagatgagcctagcctatg

SEQ ID NO: 333019 - DNA, 25 bp, Mus musculus
cattatgagatgtgcctagcctatg

SEQ ID NO: 333020 - DNA, 25 bp, Mus musculus
cattatgagccaactgcctacagat

SEQ ID NO: 333021 - DNA, 25 bp, Mus musculus
cattatgagccatctgcctacagat

SEQ ID NO: 333022 - DNA, 25 bp, Mus musculus
cattatgatggtagtactactggaa

SEQ ID NO: 333023 - DNA, 25 bp, Mus musculus
cattatgatggttgtactactggaa

SEQ ID NO: 333024 - DNA, 25 bp, Mus musculus
cattatgcatagaagctgggcttct

SEQ ID NO: 333025 - DNA, 25 bp, Mus musculus
cattatgcatagtagctgggcttct

SEQ ID NO: 333026 - DNA, 25 bp, Mus musculus
cattatgcatgtcattcttttctga

SEQ ID NO: 333027 - DNA, 25 bp, Mus musculus
cattatgcatgtgattcttttctga

SEQ ID NO: 333028 - DNA, 25 bp, Mus musculus
cattatggacccaaaacctctggaa

SEQ ID NO: 333029 - DNA, 25 bp, Mus musculus
cattatggaccctaaacctctggaa

SEQ ID NO: 333030 - DNA, 25 bp, Mus musculus
cattatggaggcatcacggtacaga

SEQ ID NO: 333031 - DNA, 25 bp, Mus musculus
cattatggaggcttcacggtacaga

SEQ ID NO: 333032 - DNA, 25 bp, Mus musculus
cattatggcaaaaccccaagatagg

SEQ ID NO: 333033 - DNA, 25 bp, Mus musculus
cattatggcaaatccccaagatagg

SEQ ID NO: 333034 - DNA, 25 bp, Mus musculus
cattatggcactcaaagcaggcttt

SEQ ID NO: 333035 - DNA, 25 bp, Mus musculus
cattatggcactgaaagcaggcttt

SEQ ID NO: 333036 - DNA, 25 bp, Mus musculus
cattatggctccaccacctggtatg

SEQ ID NO: 333037 - DNA, 25 bp, Mus musculus
cattatggctcctccacctggtatg

SEQ ID NO: 333038 - DNA, 25 bp, Mus musculus
cattatggtgtaaccttcctcaggt

SEQ ID NO: 333039 - DNA, 25 bp, Mus musculus
cattatggtgtatccttcctcaggt

SEQ ID NO: 333040 - DNA, 25 bp, Mus musculus
cattatgtactgctgtgtggctcac

SEQ ID NO: 333041 - DNA, 25 bp, Mus musculus
cattatgtactggtgtgtggctcac

SEQ ID NO: 333042 - DNA, 25 bp, Mus musculus
cattatgtctggctgacgttcttgc

SEQ ID NO: 333043 - DNA, 25 bp, Mus musculus
cattatgtctgggtgacgttcttgc

SEQ ID NO: 333044 - DNA, 25 bp, Mus musculus
cattatgtggatcgttttcttttta

SEQ ID NO: 333045 - DNA, 25 bp, Mus musculus
cattatgtggatggttttcttttta

SEQ ID NO: 333046 - DNA, 25 bp, Mus musculus
cattatgtgtgacgctctggcaggc

SEQ ID NO: 333047 - DNA, 25 bp, Mus musculus
cattatgtgtgaggctctggcaggc

SEQ ID NO: 333048 - DNA, 25 bp, Mus musculus
cattatgttgctcaagctctcttcc

SEQ ID NO: 333049 - DNA, 25 bp, Mus musculus
cattatgttgctgaagctctcttcc

SEQ ID NO: 333050 - DNA, 25 bp, Mus musculus
cattattaaagcaacaactaagagg

SEQ ID NO: 333051 - DNA, 25 bp, Mus musculus
cattattaaagctacaactaagagg

SEQ ID NO: 333052 - DNA, 25 bp, Mus musculus
cattattatcttccggtgctatttg

SEQ ID NO: 333053 - DNA, 25 bp, Mus musculus
cattattatcttgcggtgctatttg

SEQ ID NO: 333054 - DNA, 25 bp, Mus musculus
cattattattccaccagtgagctac

SEQ ID NO: 333055 - DNA, 25 bp, Mus musculus
cattattattcctccagtgagctac

SEQ ID NO: 333056 - DNA, 25 bp, Mus musculus
cattattattgcaatcggacaaatt

SEQ ID NO: 333057 - DNA, 25 bp, Mus musculus
cattattattgctatcggacaaatt

SEQ ID NO: 333058 - DNA, 25 bp, Mus musculus
cattattcacggctgttctgaagaa

SEQ ID NO: 333059 - DNA, 25 bp, Mus musculus
cattattcacgggtgttctgaagaa

SEQ ID NO: 333060 - DNA, 25 bp, Mus musculus
cattattcactgaacttagaggtta

SEQ ID NO: 333061 - DNA, 25 bp, Mus musculus
cattattcactgtacttagaggtta

SEQ ID NO: 333062 - DNA, 25 bp, Mus musculus
cattattcctggctcttttaactgt

SEQ ID NO: 333063 - DNA, 25 bp, Mus musculus
cattattcctgggtcttttaactgt

SEQ ID NO: 333064 - DNA, 25 bp, Mus musculus
cattattctcataggctgccacatg

SEQ ID NO: 333065 - DNA, 25 bp, Mus musculus
cattattctcattggctgccacatg

SEQ ID NO: 333066 - DNA, 25 bp, Mus musculus
cattattgagaccattgcccgagcc

SEQ ID NO: 333067 - DNA, 25 bp, Mus musculus
cattattgagacgattgcccgagcc

SEQ ID NO: 333068 - DNA, 25 bp, Mus musculus
cattattgcatcactgttctttttg

SEQ ID NO: 333069 - DNA, 25 bp, Mus musculus
cattattgcatctctgttctttttg

SEQ ID NO: 333070 - DNA, 25 bp, Mus musculus
cattattgccaccactcggggggaa

SEQ ID NO: 333071 - DNA, 25 bp, Mus musculus
cattattgccacgactcggggggaa

SEQ ID NO: 333072 - DNA, 25 bp, Mus musculus
cattattgggctagcagagttccct

SEQ ID NO: 333073 - DNA, 25 bp, Mus musculus
cattattgggcttgcagagttccct

SEQ ID NO: 333074 - DNA, 25 bp, Mus musculus
cattattgggtgatttgtggccatc

SEQ ID NO: 333075 - DNA, 25 bp, Mus musculus
cattattgggtgttttgtggccatc

SEQ ID NO: 333076 - DNA, 25 bp, Mus musculus
cattattgtcccaccattcataagg

SEQ ID NO: 333077 - DNA, 25 bp, Mus musculus
cattattgtccctccattcataagg

SEQ ID NO: 333078 - DNA, 25 bp, Mus musculus
cattattgtctcatggtattgcata

SEQ ID NO: 333079 - DNA, 25 bp, Mus musculus
cattattgtctcttggtattgcata

SEQ ID NO: 333080 - DNA, 25 bp, Mus musculus
cattattgtttgactgtctgagtca

SEQ ID NO: 333081 - DNA, 25 bp, Mus musculus
cattattgtttgtctgtctgagtca

SEQ ID NO: 333082 - DNA, 25 bp, Mus musculus
cattatttattaacctgaagaggca

SEQ ID NO: 333083 - DNA, 25 bp, Mus musculus
cattatttattatcctgaagaggca

SEQ ID NO: 333084 - DNA, 25 bp, Mus musculus
cattatttcataactctccactggt

SEQ ID NO: 333085 - DNA, 25 bp, Mus musculus
cattatttcatatctctccactggt

SEQ ID NO: 333086 - DNA, 25 bp, Mus musculus
cattatttctatacagctctgtgcc

SEQ ID NO: 333087 - DNA, 25 bp, Mus musculus
cattatttctattcagctctgtgcc

SEQ ID NO: 333088 - DNA, 25 bp, Mus musculus
cattatttctggaggtttcttaggc

SEQ ID NO: 333089 - DNA, 25 bp, Mus musculus
cattatttctggtggtttcttaggc

SEQ ID NO: 333090 - DNA, 25 bp, Mus musculus
cattatttgatgagcgctaccacgt

SEQ ID NO: 333091 - DNA, 25 bp, Mus musculus
cattatttgatgtgcgctaccacgt

SEQ ID NO: 333092 - DNA, 25 bp, Mus musculus
cattattttcgtaccctccacttct

SEQ ID NO: 333093 - DNA, 25 bp, Mus musculus
cattattttcgttccctccacttct

SEQ ID NO: 333094 - DNA, 25 bp, Mus musculus
cattattttctgattcgtagtcttg

SEQ ID NO: 333095 - DNA, 25 bp, Mus musculus
cattattttctgtttcgtagtcttg

SEQ ID NO: 333096 - DNA, 25 bp, Mus musculus
cattattttgacatgtgaccaacat

SEQ ID NO: 333097 - DNA, 25 bp, Mus musculus
cattattttgacttgtgaccaacat

SEQ ID NO: 333098 - DNA, 25 bp, Mus musculus
cattattttgtccatctttagagag

SEQ ID NO: 333099 - DNA, 25 bp, Mus musculus
cattattttgtcgatctttagagag

SEQ ID NO: 333100 - DNA, 25 bp, Mus musculus
cattatttttgacaattcctgtaaa

SEQ ID NO: 333101 - DNA, 25 bp, Mus musculus
cattatttttgagaattcctgtaaa

SEQ ID NO: 333102 - DNA, 25 bp, Mus musculus
cattcaaaagacatatctcccctgg

SEQ ID NO: 333103 - DNA, 25 bp, Mus musculus
cattcaaaagacttatctcccctgg

SEQ ID NO: 333104 - DNA, 25 bp, Mus musculus
cattcaaaaggactccacccttcat

SEQ ID NO: 333105 - DNA, 25 bp, Mus musculus
cattcaaaaggagtccacccttcat

SEQ ID NO: 333106 - DNA, 25 bp, Mus musculus
cattcaaaagttatgtagggtggtg

SEQ ID NO: 333107 - DNA, 25 bp, Mus musculus
cattcaaaagttttgtagggtggtg

SEQ ID NO: 333108 - DNA, 25 bp, Mus musculus
cattcaaactagcaacttggtttat

SEQ ID NO: 333109 - DNA, 25 bp, Mus musculus
cattcaaactaggaacttggtttat

SEQ ID NO: 333110 - DNA, 25 bp, Mus musculus
cattcaaactgcacgatgtctgggt

SEQ ID NO: 333111 - DNA, 25 bp, Mus musculus
cattcaaactgctcgatgtctgggt

SEQ ID NO: 333112 - DNA, 25 bp, Mus musculus
cattcaaataaacccctacggcctg

SEQ ID NO: 333113 - DNA, 25 bp, Mus musculus
cattcaaataaagccctacggcctg

SEQ ID NO: 333114 - DNA, 25 bp, Mus musculus
cattcaaataccagagcctactggg

SEQ ID NO: 333115 - DNA, 25 bp, Mus musculus
cattcaaatacctgagcctactggg

SEQ ID NO: 333116 - DNA, 25 bp, Mus musculus
cattcaaattatagatcatttcccc

SEQ ID NO: 333117 - DNA, 25 bp, Mus musculus
cattcaaattattgatcatttcccc

SEQ ID NO: 333118 - DNA, 25 bp, Mus musculus
cattcaactcagcaatttggcccag

SEQ ID NO: 333119 - DNA, 25 bp, Mus musculus
cattcaactcaggaatttggcccag

SEQ ID NO: 333120 - DNA, 25 bp, Mus musculus
cattcaactcctacagttgctcatg

SEQ ID NO: 333121 - DNA, 25 bp, Mus musculus
cattcaactccttcagttgctcatg

SEQ ID NO: 333122 - DNA, 25 bp, Mus musculus
cattcaacttttcatgtgcttaaaa

SEQ ID NO: 333123 - DNA, 25 bp, Mus musculus
cattcaacttttgatgtgcttaaaa

SEQ ID NO: 333124 - DNA, 25 bp, Mus musculus
cattcaagaaatatggaacactatg

SEQ ID NO: 333125 - DNA, 25 bp, Mus musculus
cattcaagaaatttggaacactatg

SEQ ID NO: 333126 - DNA, 25 bp, Mus musculus
cattcaagaagtcgccacaggcatt

SEQ ID NO: 333127 - DNA, 25 bp, Mus musculus
cattcaagaagtggccacaggcatt

SEQ ID NO: 333128 - DNA, 25 bp, Mus musculus
cattcaaggttcaggaccttcctta

SEQ ID NO: 333129 - DNA, 25 bp, Mus musculus
cattcaaggttctggaccttcctta

SEQ ID NO: 333130 - DNA, 25 bp, Mus musculus
cattcaatctgtacatgtgggtgta

SEQ ID NO: 333131 - DNA, 25 bp, Mus musculus
cattcaatctgttcatgtgggtgta

SEQ ID NO: 333132 - DNA, 25 bp, Mus musculus
cattcacaacttaatcggaggctta

SEQ ID NO: 333133 - DNA, 25 bp, Mus musculus
cattcacaactttatcggaggctta

SEQ ID NO: 333134 - DNA, 25 bp, Mus musculus
cattcacactggctttttcccacaa

SEQ ID NO: 333135 - DNA, 25 bp, Mus musculus
cattcacactgggtttttcccacaa

SEQ ID NO: 333136 - DNA, 25 bp, Mus musculus
cattcacagtacagaagggcggaat

SEQ ID NO: 333137 - DNA, 25 bp, Mus musculus
cattcacagtactgaagggcggaat

SEQ ID NO: 333138 - DNA, 25 bp, Mus musculus
cattcaccaaatctaggtggcctga

SEQ ID NO: 333139 - DNA, 25 bp, Mus musculus
cattcaccaaatgtaggtggcctga

SEQ ID NO: 333140 - DNA, 25 bp, Mus musculus
cattcaccccagaactatatgggaa

SEQ ID NO: 333141 - DNA, 25 bp, Mus musculus
cattcaccccagtactatatgggaa

SEQ ID NO: 333142 - DNA, 25 bp, Mus musculus
cattcacgacgtaccagttagggta

SEQ ID NO: 333143 - DNA, 25 bp, Mus musculus
cattcacgacgttccagttagggta

SEQ ID NO: 333144 - DNA, 25 bp, Mus musculus
cattcacgccagacacttggaagtg

SEQ ID NO: 333145 - DNA, 25 bp, Mus musculus
cattcacgccagtcacttggaagtg

SEQ ID NO: 333146 - DNA, 25 bp, Mus musculus
cattcactaactccttggtttcttt

SEQ ID NO: 333147 - DNA, 25 bp, Mus musculus
cattcactaactgcttggtttcttt

SEQ ID NO: 333148 - DNA, 25 bp, Mus musculus
cattcactagctatgttatgcactg

SEQ ID NO: 333149 - DNA, 25 bp, Mus musculus
cattcactagctttgttatgcactg

SEQ ID NO: 333150 - DNA, 25 bp, Mus musculus
cattcactaggaacttgtatttttc

SEQ ID NO: 333151 - DNA, 25 bp, Mus musculus
cattcactaggatcttgtatttttc

SEQ ID NO: 333152 - DNA, 25 bp, Mus musculus
cattcactccctactaatttttcct

SEQ ID NO: 333153 - DNA, 25 bp, Mus musculus
cattcactcccttctaatttttcct

SEQ ID NO: 333154 - DNA, 25 bp, Mus musculus
cattcactctgcatttagtctggac

SEQ ID NO: 333155 - DNA, 25 bp, Mus musculus
cattcactctgcttttagtctggac

SEQ ID NO: 333156 - DNA, 25 bp, Mus musculus
cattcactctggcttcaaactctag

SEQ ID NO: 333157 - DNA, 25 bp, Mus musculus
cattcactctgggttcaaactctag

SEQ ID NO: 333158 - DNA, 25 bp, Mus musculus
cattcactgggcaccggagtggcaa

SEQ ID NO: 333159 - DNA, 25 bp, Mus musculus
cattcactgggctccggagtggcaa

SEQ ID NO: 333160 - DNA, 25 bp, Mus musculus
cattcactggtaatgcctttccatc

SEQ ID NO: 333161 - DNA, 25 bp, Mus musculus
cattcactggtattgcctttccatc

SEQ ID NO: 333162 - DNA, 25 bp, Mus musculus
cattcacttaagaccgcatcagaga

SEQ ID NO: 333163 - DNA, 25 bp, Mus musculus
cattcacttaagtccgcatcagaga

SEQ ID NO: 333164 - DNA, 25 bp, Mus musculus
cattcacttcatactttgccaatct

SEQ ID NO: 333165 - DNA, 25 bp, Mus musculus
cattcacttcattctttgccaatct

SEQ ID NO: 333166 - DNA, 25 bp, Mus musculus
cattcagacaggattcagtggcaga

SEQ ID NO: 333167 - DNA, 25 bp, Mus musculus
cattcagacaggtttcagtggcaga

SEQ ID NO: 333168 - DNA, 25 bp, Mus musculus
cattcagacatccactcaagtattc

SEQ ID NO: 333169 - DNA, 25 bp, Mus musculus
cattcagacatcgactcaagtattc

SEQ ID NO: 333170 - DNA, 25 bp, Mus musculus
cattcagagcacatatcaaactcca

SEQ ID NO: 333171 - DNA, 25 bp, Mus musculus
cattcagagcacttatcaaactcca

SEQ ID NO: 333172 - DNA, 25 bp, Mus musculus
cattcagatatgactccccatcaga

SEQ ID NO: 333173 - DNA, 25 bp, Mus musculus
cattcagatatgtctccccatcaga

SEQ ID NO: 333174 - DNA, 25 bp, Mus musculus
cattcagatcttagctcactacttt

SEQ ID NO: 333175 - DNA, 25 bp, Mus musculus
cattcagatcttccatggtggctta

SEQ ID NO: 333176 - DNA, 25 bp, Mus musculus
cattcagatcttgcatggtggctta

SEQ ID NO: 333177 - DNA, 25 bp, Mus musculus
cattcagatctttgctcactacttt

SEQ ID NO: 333178 - DNA, 25 bp, Mus musculus
cattcagatttgaaactttataaac

SEQ ID NO: 333179 - DNA, 25 bp, Mus musculus
cattcagatttgtaactttataaac

SEQ ID NO: 333180 - DNA, 25 bp, Mus musculus
cattcagcacttatgggtatcctac

SEQ ID NO: 333181 - DNA, 25 bp, Mus musculus
cattcagcacttttgggtatcctac

SEQ ID NO: 333182 - DNA, 25 bp, Mus musculus
cattcagccaccacctggaaggaga

SEQ ID NO: 333183 - DNA, 25 bp, Mus musculus
cattcagccacctcctggaaggaga

SEQ ID NO: 333184 - DNA, 25 bp, Mus musculus
cattcagccagtctagccagcagaa

SEQ ID NO: 333185 - DNA, 25 bp, Mus musculus
cattcagccagtgtagccagcagaa

SEQ ID NO: 333186 - DNA, 25 bp, Mus musculus
cattcagccttgcacacagtgttct

SEQ ID NO: 333187 - DNA, 25 bp, Mus musculus
cattcagccttggacacagtgttct

SEQ ID NO: 333188 - DNA, 25 bp, Mus musculus
cattcagctcacagcttaactgaac

SEQ ID NO: 333189 - DNA, 25 bp, Mus musculus
cattcagctcactgcttaactgaac

SEQ ID NO: 333190 - DNA, 25 bp, Mus musculus
cattcagctcgtccccagtgtaata

SEQ ID NO: 333191 - DNA, 25 bp, Mus musculus
cattcagctcgtgcccagtgtaata

SEQ ID NO: 333192 - DNA, 25 bp, Mus musculus
cattcagctgatatattggccggaa

SEQ ID NO: 333193 - DNA, 25 bp, Mus musculus
cattcagctgatttattggccggaa

SEQ ID NO: 333194 - DNA, 25 bp, Mus musculus
cattcagctgctcggtgtccattgc

SEQ ID NO: 333195 - DNA, 25 bp, Mus musculus
cattcagctgctgggtgtccattgc

SEQ ID NO: 333196 - DNA, 25 bp, Mus musculus
cattcagctggactggaaggtccca

SEQ ID NO: 333197 - DNA, 25 bp, Mus musculus
cattcagctggagtggaaggtccca

SEQ ID NO: 333198 - DNA, 25 bp, Mus musculus
cattcagcttaacttgagggtgcca

SEQ ID NO: 333199 - DNA, 25 bp, Mus musculus
cattcagcttaagttgagggtgcca

SEQ ID NO: 333200 - DNA, 25 bp, Mus musculus
cattcagctttacacacccactgag

SEQ ID NO: 333201 - DNA, 25 bp, Mus musculus
cattcagctttagacacccactgag

SEQ ID NO: 333202 - DNA, 25 bp, Mus musculus
cattcaggagtaaatctcgtttata

SEQ ID NO: 333203 - DNA, 25 bp, Mus musculus
cattcaggagtatatctcgtttata

SEQ ID NO: 333204 - DNA, 25 bp, Mus musculus
cattcaggctccaggttgttgctgt

SEQ ID NO: 333205 - DNA, 25 bp, Mus musculus
cattcaggctcctggttgttgctgt

SEQ ID NO: 333206 - DNA, 25 bp, Mus musculus
cattcagtatgcaggtgttcttctg

SEQ ID NO: 333207 - DNA, 25 bp, Mus musculus
cattcagtatgctggtgttcttctg

SEQ ID NO: 333208 - DNA, 25 bp, Mus musculus
cattcagtctgtatttgtatgcttt

SEQ ID NO: 333209 - DNA, 25 bp, Mus musculus
cattcagtctgtttttgtatgcttt

SEQ ID NO: 333210 - DNA, 25 bp, Mus musculus
cattcagtgaaacgccctgtttcca

SEQ ID NO: 333211 - DNA, 25 bp, Mus musculus
cattcagtgaaaggccctgtttcca

SEQ ID NO: 333212 - DNA, 25 bp, Mus musculus
cattcagtgtctcggcttagatgca

SEQ ID NO: 333213 - DNA, 25 bp, Mus musculus
cattcagtgtctgggcttagatgca

SEQ ID NO: 333214 - DNA, 25 bp, Mus musculus
cattcagttaaactgtgagaacctt

SEQ ID NO: 333215 - DNA, 25 bp, Mus musculus
cattcagttaaagtgtgagaacctt

SEQ ID NO: 333216 - DNA, 25 bp, Mus musculus
cattcagtttccatgttagctaaat

SEQ ID NO: 333217 - DNA, 25 bp, Mus musculus
cattcagtttccttgttagctaaat

SEQ ID NO: 333218 - DNA, 25 bp, Mus musculus
cattcagtttttacggttctcaatt

SEQ ID NO: 333219 - DNA, 25 bp, Mus musculus
cattcagtttttcccctgaggaggc

SEQ ID NO: 333220 - DNA, 25 bp, Mus musculus
cattcagtttttgccctgaggaggc

SEQ ID NO: 333221 - DNA, 25 bp, Mus musculus
cattcagttttttcggttctcaatt

SEQ ID NO: 333222 - DNA, 25 bp, Mus musculus
cattcataaggcaaggttaaactgt

SEQ ID NO: 333223 - DNA, 25 bp, Mus musculus
cattcataaggctaggttaaactgt

SEQ ID NO: 333224 - DNA, 25 bp, Mus musculus
cattcataagtactgacacccctat

SEQ ID NO: 333225 - DNA, 25 bp, Mus musculus
cattcataagtagtgacacccctat

SEQ ID NO: 333226 - DNA, 25 bp, Mus musculus
cattcatacactccagcaggtaggt

SEQ ID NO: 333227 - DNA, 25 bp, Mus musculus
cattcatacactgcagcaggtaggt

SEQ ID NO: 333228 - DNA, 25 bp, Mus musculus
cattcatactcccagaaaccagcta

SEQ ID NO: 333229 - DNA, 25 bp, Mus musculus
cattcatactccgagaaaccagcta

SEQ ID NO: 333230 - DNA, 25 bp, Mus musculus
cattcatactctcggcacttgtgtt

SEQ ID NO: 333231 - DNA, 25 bp, Mus musculus
cattcatactctgggcacttgtgtt

SEQ ID NO: 333232 - DNA, 25 bp, Mus musculus
cattcatatcaaccgtggtccgaaa

SEQ ID NO: 333233 - DNA, 25 bp, Mus musculus
cattcatatcaagcgtggtccgaaa

SEQ ID NO: 333234 - DNA, 25 bp, Mus musculus
cattcatatgttcttcagctacaca

SEQ ID NO: 333235 - DNA, 25 bp, Mus musculus
cattcatatgttgttcagctacaca

SEQ ID NO: 333236 - DNA, 25 bp, Mus musculus
cattcatcacctacctcaaataaac

SEQ ID NO: 333237 - DNA, 25 bp, Mus musculus
cattcatcaccttcctcaaataaac

SEQ ID NO: 333238 - DNA, 25 bp, Mus musculus
cattcatccagtcacgttttgtaaa

SEQ ID NO: 333239 - DNA, 25 bp, Mus musculus
cattcatccagtgacgttttgtaaa

SEQ ID NO: 333240 - DNA, 25 bp, Mus musculus
cattcatcccagacttcatagttta

SEQ ID NO: 333241 - DNA, 25 bp, Mus musculus
cattcatcccagtcttcatagttta

SEQ ID NO: 333242 - DNA, 25 bp, Mus musculus
cattcatcgatgactacctgctgag

SEQ ID NO: 333243 - DNA, 25 bp, Mus musculus
cattcatcgatgtctacctgctgag

SEQ ID NO: 333244 - DNA, 25 bp, Mus musculus
cattcatcttttacctgtagaagga

SEQ ID NO: 333245 - DNA, 25 bp, Mus musculus
cattcatctttttcctgtagaagga

SEQ ID NO: 333246 - DNA, 25 bp, Mus musculus
cattcatgagatctgctgttgggaa

SEQ ID NO: 333247 - DNA, 25 bp, Mus musculus
cattcatgagatgtgctgttgggaa

SEQ ID NO: 333248 - DNA, 25 bp, Mus musculus
cattcatgcactcatctctaagcca

SEQ ID NO: 333249 - DNA, 25 bp, Mus musculus
cattcatgcactgatctctaagcca

SEQ ID NO: 333250 - DNA, 25 bp, Mus musculus
cattcatgcgcgacactaattagat

SEQ ID NO: 333251 - DNA, 25 bp, Mus musculus
cattcatgcgcgtcactaattagat

SEQ ID NO: 333252 - DNA, 25 bp, Mus musculus
cattcatggtaaatttgctttgcct

SEQ ID NO: 333253 - DNA, 25 bp, Mus musculus
cattcatggtaattttgctttgcct

SEQ ID NO: 333254 - DNA, 25 bp, Mus musculus
cattcatgtggcatctgcggcaagt

SEQ ID NO: 333255 - DNA, 25 bp, Mus musculus
cattcatgtggcttctgcggcaagt

SEQ ID NO: 333256 - DNA, 25 bp, Mus musculus
cattcattagttcttcagtgcttac

SEQ ID NO: 333257 - DNA, 25 bp, Mus musculus
cattcattagttgttcagtgcttac

SEQ ID NO: 333258 - DNA, 25 bp, Mus musculus
cattcattcacactagggagggttt

SEQ ID NO: 333259 - DNA, 25 bp, Mus musculus
cattcattcacagtagggagggttt

SEQ ID NO: 333260 - DNA, 25 bp, Mus musculus
cattcattcatccaaaggcaagtgt

SEQ ID NO: 333261 - DNA, 25 bp, Mus musculus
cattcattcatcgaaaggcaagtgt

SEQ ID NO: 333262 - DNA, 25 bp, Mus musculus
cattcattcctcaacataagccagt

SEQ ID NO: 333263 - DNA, 25 bp, Mus musculus
cattcattcctctacataagccagt

SEQ ID NO: 333264 - DNA, 25 bp, Mus musculus
cattcattctcaaattgtagggtgg

SEQ ID NO: 333265 - DNA, 25 bp, Mus musculus
cattcattctcatattgtagggtgg

SEQ ID NO: 333266 - DNA, 25 bp, Mus musculus
cattcattgatgacacggtgtttgg

SEQ ID NO: 333267 - DNA, 25 bp, Mus musculus
cattcattgatgtcacggtgtttgg

SEQ ID NO: 333268 - DNA, 25 bp, Mus musculus
cattcattgcctagggcccctagta

SEQ ID NO: 333269 - DNA, 25 bp, Mus musculus
cattcattgccttgggcccctagta

SEQ ID NO: 333270 - DNA, 25 bp, Mus musculus
cattcattgtccctgactcctttct

SEQ ID NO: 333271 - DNA, 25 bp, Mus musculus
cattcattgtccgtgactcctttct

SEQ ID NO: 333272 - DNA, 25 bp, Mus musculus
cattcatttactcccggactcacgt

SEQ ID NO: 333273 - DNA, 25 bp, Mus musculus
cattcatttactgccggactcacgt

SEQ ID NO: 333274 - DNA, 25 bp, Mus musculus
cattcatttatgctcacatgctgac

SEQ ID NO: 333275 - DNA, 25 bp, Mus musculus
cattcatttatggtcacatgctgac

SEQ ID NO: 333276 - DNA, 25 bp, Mus musculus
cattcatttcctatcccaatgaaag

SEQ ID NO: 333277 - DNA, 25 bp, Mus musculus
cattcatttcctttcccaatgaaag

SEQ ID NO: 333278 - DNA, 25 bp, Mus musculus
cattcatttgaaatcgacccatgga

SEQ ID NO: 333279 - DNA, 25 bp, Mus musculus
cattcatttgaattcgacccatgga

SEQ ID NO: 333280 - DNA, 25 bp, Mus musculus
cattcatttgtgctaggagtcagag

SEQ ID NO: 333281 - DNA, 25 bp, Mus musculus
cattcatttgtggtaggagtcagag

SEQ ID NO: 333282 - DNA, 25 bp, Mus musculus
cattccaacgttagggctgttccaa

SEQ ID NO: 333283 - DNA, 25 bp, Mus musculus
cattccaacgtttgggctgttccaa

SEQ ID NO: 333284 - DNA, 25 bp, Mus musculus
cattccaagacacctcccaaagaag

SEQ ID NO: 333285 - DNA, 25 bp, Mus musculus
cattccaagacagctcccaaagaag

SEQ ID NO: 333286 - DNA, 25 bp, Mus musculus
cattccaatttcctttcactattca

SEQ ID NO: 333287 - DNA, 25 bp, Mus musculus
cattccaatttcgtttcactattca

SEQ ID NO: 333288 - DNA, 25 bp, Mus musculus
cattccacaatgcatgttgagccat

SEQ ID NO: 333289 - DNA, 25 bp, Mus musculus
cattccacaatggatgttgagccat

SEQ ID NO: 333290 - DNA, 25 bp, Mus musculus
cattccagaaacatgttccttgaac

SEQ ID NO: 333291 - DNA, 25 bp, Mus musculus
cattccagaaacttgttccttgaac

SEQ ID NO: 333292 - DNA, 25 bp, Mus musculus
cattccagatgtctgcctgcgtata

SEQ ID NO: 333293 - DNA, 25 bp, Mus musculus
cattccagatgtgtgcctgcgtata

SEQ ID NO: 333294 - DNA, 25 bp, Mus musculus
cattccagctagcttcagtcgtgag

SEQ ID NO: 333295 - DNA, 25 bp, Mus musculus
cattccagctaggttcagtcgtgag

SEQ ID NO: 333296 - DNA, 25 bp, Mus musculus
cattccaggccgcactgagataaaa

SEQ ID NO: 333297 - DNA, 25 bp, Mus musculus
cattccaggccggactgagataaaa

SEQ ID NO: 333298 - DNA, 25 bp, Mus musculus
cattccaggtagaaattatattatt

SEQ ID NO: 333299 - DNA, 25 bp, Mus musculus
cattccaggtagtaattatattatt

SEQ ID NO: 333300 - DNA, 25 bp, Mus musculus
cattccaggtgaagcattatatgca

SEQ ID NO: 333301 - DNA, 25 bp, Mus musculus
cattccaggtgatgcattatatgca

SEQ ID NO: 333302 - DNA, 25 bp, Mus musculus
cattccagtacactggcaatcccat

SEQ ID NO: 333303 - DNA, 25 bp, Mus musculus
cattccagtacagtggcaatcccat

SEQ ID NO: 333304 - DNA, 25 bp, Mus musculus
cattccagtcggcatcatgatgata

SEQ ID NO: 333305 - DNA, 25 bp, Mus musculus
cattccagtcgggatcatgatgata

SEQ ID NO: 333306 - DNA, 25 bp, Mus musculus
cattccagttatatggtccccaagg

SEQ ID NO: 333307 - DNA, 25 bp, Mus musculus
cattccagttatttggtccccaagg

SEQ ID NO: 333308 - DNA, 25 bp, Mus musculus
cattccatgaggacattggttgatg

SEQ ID NO: 333309 - DNA, 25 bp, Mus musculus
cattccatgaggtcattggttgatg

SEQ ID NO: 333310 - DNA, 25 bp, Mus musculus
cattccatgatgaagcttgttctga

SEQ ID NO: 333311 - DNA, 25 bp, Mus musculus
cattccatgatgtagcttgttctga

SEQ ID NO: 333312 - DNA, 25 bp, Mus musculus
cattccatgctccaaaattcagtga

SEQ ID NO: 333313 - DNA, 25 bp, Mus musculus
cattccatgctcgaaaattcagtga

SEQ ID NO: 333314 - DNA, 25 bp, Mus musculus
cattccatgtatatgatgataccct

SEQ ID NO: 333315 - DNA, 25 bp, Mus musculus
cattccatgtatttgatgataccct

SEQ ID NO: 333316 - DNA, 25 bp, Mus musculus
cattccattcccacttaatttaaat

SEQ ID NO: 333317 - DNA, 25 bp, Mus musculus
cattccattcccagaggactcaaag

SEQ ID NO: 333318 - DNA, 25 bp, Mus musculus
cattccattccctcttaatttaaat

SEQ ID NO: 333319 - DNA, 25 bp, Mus musculus
cattccattccctgaggactcaaag

SEQ ID NO: 333320 - DNA, 25 bp, Mus musculus
cattccattttcacagtgcagccat

SEQ ID NO: 333321 - DNA, 25 bp, Mus musculus
cattccattttctcagtgcagccat

SEQ ID NO: 333322 - DNA, 25 bp, Mus musculus
cattcccaaaccagtgtaccagaga

SEQ ID NO: 333323 - DNA, 25 bp, Mus musculus
cattcccaaaccataactctgttct

SEQ ID NO: 333324 - DNA, 25 bp, Mus musculus
cattcccaaacctgtgtaccagaga

SEQ ID NO: 333325 - DNA, 25 bp, Mus musculus
cattcccaaaccttaactctgttct

SEQ ID NO: 333326 - DNA, 25 bp, Mus musculus
cattcccaaagtaggctgtgctggt

SEQ ID NO: 333327 - DNA, 25 bp, Mus musculus
cattcccaaagttggctgtgctggt

SEQ ID NO: 333328 - DNA, 25 bp, Mus musculus
cattcccacctgagaagacggacta

SEQ ID NO: 333329 - DNA, 25 bp, Mus musculus
cattcccacctgtgaagacggacta

SEQ ID NO: 333330 - DNA, 25 bp, Mus musculus
cattcccactacatgagccttttac

SEQ ID NO: 333331 - DNA, 25 bp, Mus musculus
cattcccactacttgagccttttac

SEQ ID NO: 333332 - DNA, 25 bp, Mus musculus
cattcccactccctcaggaaaaagt

SEQ ID NO: 333333 - DNA, 25 bp, Mus musculus
cattcccactccgtcaggaaaaagt

SEQ ID NO: 333334 - DNA, 25 bp, Mus musculus
cattcccacttcctttataactata

SEQ ID NO: 333335 - DNA, 25 bp, Mus musculus
cattcccacttcgtttataactata

SEQ ID NO: 333336 - DNA, 25 bp, Mus musculus
cattcccatctcattgctttttagg

SEQ ID NO: 333337 - DNA, 25 bp, Mus musculus
cattcccatctctttgctttttagg

SEQ ID NO: 333338 - DNA, 25 bp, Mus musculus
cattcccatgagaatgttctgtaga

SEQ ID NO: 333339 - DNA, 25 bp, Mus musculus
cattcccatgagtatgttctgtaga

SEQ ID NO: 333340 - DNA, 25 bp, Mus musculus
cattcccattcaaatcaccatagct

SEQ ID NO: 333341 - DNA, 25 bp, Mus musculus
cattcccattcatatcaccatagct

SEQ ID NO: 333342 - DNA, 25 bp, Mus musculus
cattccccaagaatactgtgacctc

SEQ ID NO: 333343 - DNA, 25 bp, Mus musculus
cattccccaagattactgtgacctc

SEQ ID NO: 333344 - DNA, 25 bp, Mus musculus
cattccccaaggcaccatgagggaa

SEQ ID NO: 333345 - DNA, 25 bp, Mus musculus
cattccccaagggaccatgagggaa

SEQ ID NO: 333346 - DNA, 25 bp, Mus musculus
cattccccaggcaaacattatcagt

SEQ ID NO: 333347 - DNA, 25 bp, Mus musculus
cattccccaggctaacattatcagt

SEQ ID NO: 333348 - DNA, 25 bp, Mus musculus
cattccccatgcattgtggcaaagc

SEQ ID NO: 333349 - DNA, 25 bp, Mus musculus
cattccccatgctttgtggcaaagc

SEQ ID NO: 333350 - DNA, 25 bp, Mus musculus
cattcccctacaaccctttgattat

SEQ ID NO: 333351 - DNA, 25 bp, Mus musculus
cattcccctacatccctttgattat

SEQ ID NO: 333352 - DNA, 25 bp, Mus musculus
cattcccctgtcctttttgtaagat

SEQ ID NO: 333353 - DNA, 25 bp, Mus musculus
cattcccctgtcgtttttgtaagat

SEQ ID NO: 333354 - DNA, 25 bp, Mus musculus
cattccctacacatggcttcttgat

SEQ ID NO: 333355 - DNA, 25 bp, Mus musculus
cattccctacacttggcttcttgat

SEQ ID NO: 333356 - DNA, 25 bp, Mus musculus
cattccctacatcgcatagaacata

SEQ ID NO: 333357 - DNA, 25 bp, Mus musculus
cattccctacatggcatagaacata

SEQ ID NO: 333358 - DNA, 25 bp, Mus musculus
cattccctatgaacagagctctgtg

SEQ ID NO: 333359 - DNA, 25 bp, Mus musculus
cattccctatgatcagagctctgtg

SEQ ID NO: 333360 - DNA, 25 bp, Mus musculus
cattccctcaacagcagatgtttgg

SEQ ID NO: 333361 - DNA, 25 bp, Mus musculus
cattccctcaactgcagatgtttgg

SEQ ID NO: 333362 - DNA, 25 bp, Mus musculus
cattccctcaatcccattttcttgg

SEQ ID NO: 333363 - DNA, 25 bp, Mus musculus
cattccctcaatgccattttcttgg

SEQ ID NO: 333364 - DNA, 25 bp, Mus musculus
cattccctccaaaatgttgctttgc

SEQ ID NO: 333365 - DNA, 25 bp, Mus musculus
cattccctccaaaccgtaattaaga

SEQ ID NO: 333366 - DNA, 25 bp, Mus musculus
cattccctccaatatgttgctttgc

SEQ ID NO: 333367 - DNA, 25 bp, Mus musculus
cattccctccaatccgtaattaaga

SEQ ID NO: 333368 - DNA, 25 bp, Mus musculus
cattccctctagagtgcacttttca

SEQ ID NO: 333369 - DNA, 25 bp, Mus musculus
cattccctctagtgtgcacttttca

SEQ ID NO: 333370 - DNA, 25 bp, Mus musculus
cattccctctgaaagcactcgaaga

SEQ ID NO: 333371 - DNA, 25 bp, Mus musculus
cattccctctgatagcactcgaaga

SEQ ID NO: 333372 - DNA, 25 bp, Mus musculus
cattccctgcagctcttagctgaaa

SEQ ID NO: 333373 - DNA, 25 bp, Mus musculus
cattccctgcaggtcttagctgaaa

SEQ ID NO: 333374 - DNA, 25 bp, Mus musculus
cattccctgtgtcttttgattttca

SEQ ID NO: 333375 - DNA, 25 bp, Mus musculus
cattccctgtgtgttttgattttca

SEQ ID NO: 333376 - DNA, 25 bp, Mus musculus
cattcccttaagcttccgagacaag

SEQ ID NO: 333377 - DNA, 25 bp, Mus musculus
cattcccttaaggttccgagacaag

SEQ ID NO: 333378 - DNA, 25 bp, Mus musculus
cattcccttatgaggactctgttgt

SEQ ID NO: 333379 - DNA, 25 bp, Mus musculus
cattcccttatgtggactctgttgt

SEQ ID NO: 333380 - DNA, 25 bp, Mus musculus
cattcccttattcatacatttgagt

SEQ ID NO: 333381 - DNA, 25 bp, Mus musculus
cattcccttattgatacatttgagt

SEQ ID NO: 333382 - DNA, 25 bp, Mus musculus
cattcccttcctctacatgtggata

SEQ ID NO: 333383 - DNA, 25 bp, Mus musculus
cattcccttcctgtacatgtggata

SEQ ID NO: 333384 - DNA, 25 bp, Mus musculus
cattccgaaaacatctcttgtcttc

SEQ ID NO: 333385 - DNA, 25 bp, Mus musculus
cattccgaaaacttctcttgtcttc

SEQ ID NO: 333386 - DNA, 25 bp, Mus musculus
cattccgagattatgttgaccgatc

SEQ ID NO: 333387 - DNA, 25 bp, Mus musculus
cattccgagattttgttgaccgatc

SEQ ID NO: 333388 - DNA, 25 bp, Mus musculus
cattccgaggtcactgagcctcatg

SEQ ID NO: 333389 - DNA, 25 bp, Mus musculus
cattccgaggtctctgagcctcatg

SEQ ID NO: 333390 - DNA, 25 bp, Mus musculus
cattccggcggtataatggtggagt

SEQ ID NO: 333391 - DNA, 25 bp, Mus musculus
cattccggcggtttaatggtggagt

SEQ ID NO: 333392 - DNA, 25 bp, Mus musculus
cattccgggtgaaggaggtgtccct

SEQ ID NO: 333393 - DNA, 25 bp, Mus musculus
cattccgggtgatggaggtgtccct

SEQ ID NO: 333394 - DNA, 25 bp, Mus musculus
cattcctaagaaattggagctagct

SEQ ID NO: 333395 - DNA, 25 bp, Mus musculus
cattcctaagaatttggagctagct

SEQ ID NO: 333396 - DNA, 25 bp, Mus musculus
cattcctaatgcctcagctgtcact

SEQ ID NO: 333397 - DNA, 25 bp, Mus musculus
cattcctaatgcgtcagctgtcact

SEQ ID NO: 333398 - DNA, 25 bp, Mus musculus
cattcctaattcacacttgatgtgg

SEQ ID NO: 333399 - DNA, 25 bp, Mus musculus
cattcctaattctcacttgatgtgg

SEQ ID NO: 333400 - DNA, 25 bp, Mus musculus
cattcctacaggctctttggagaca

SEQ ID NO: 333401 - DNA, 25 bp, Mus musculus
cattcctacagggtctttggagaca

SEQ ID NO: 333402 - DNA, 25 bp, Mus musculus
cattcctattcaaactgccacaaag

SEQ ID NO: 333403 - DNA, 25 bp, Mus musculus
cattcctattcatactgccacaaag

SEQ ID NO: 333404 - DNA, 25 bp, Mus musculus
cattcctcacgactgtgctcgagta

SEQ ID NO: 333405 - DNA, 25 bp, Mus musculus
cattcctcacgagtgtgctcgagta

SEQ ID NO: 333406 - DNA, 25 bp, Mus musculus
cattcctcagaactccctagttatt

SEQ ID NO: 333407 - DNA, 25 bp, Mus musculus
cattcctcagaagtccctagttatt

SEQ ID NO: 333408 - DNA, 25 bp, Mus musculus
cattcctcaggaccgtgagactgga

SEQ ID NO: 333409 - DNA, 25 bp, Mus musculus
cattcctcaggagcgtgagactgga

SEQ ID NO: 333410 - DNA, 25 bp, Mus musculus
cattcctcaggccaggcaagcctga

SEQ ID NO: 333411 - DNA, 25 bp, Mus musculus
cattcctcaggcgaggcaagcctga

SEQ ID NO: 333412 - DNA, 25 bp, Mus musculus
cattcctcagggacatcttgatgag

SEQ ID NO: 333413 - DNA, 25 bp, Mus musculus
cattcctcagggtcatcttgatgag

SEQ ID NO: 333414 - DNA, 25 bp, Mus musculus
cattcctcaggtataagccacggct

SEQ ID NO: 333415 - DNA, 25 bp, Mus musculus
cattcctcaggtttaagccacggct

SEQ ID NO: 333416 - DNA, 25 bp, Mus musculus
cattcctccacgacatttctttttt

SEQ ID NO: 333417 - DNA, 25 bp, Mus musculus
cattcctccacgtcatttctttttt

SEQ ID NO: 333418 - DNA, 25 bp, Mus musculus
cattcctcccatagtcaatgatgat

SEQ ID NO: 333419 - DNA, 25 bp, Mus musculus
cattcctcccattgtcaatgatgat

SEQ ID NO: 333420 - DNA, 25 bp, Mus musculus
cattcctccctaaaaatataaaatc

SEQ ID NO: 333421 - DNA, 25 bp, Mus musculus
cattcctccctataaatataaaatc

SEQ ID NO: 333422 - DNA, 25 bp, Mus musculus
cattcctcctgacagtaacaaattt

SEQ ID NO: 333423 - DNA, 25 bp, Mus musculus
cattcctcctgagagtaacaaattt

SEQ ID NO: 333424 - DNA, 25 bp, Mus musculus
cattcctctgaaatgaaactgcccc

SEQ ID NO: 333425 - DNA, 25 bp, Mus musculus
cattcctctgaattgaaactgcccc

SEQ ID NO: 333426 - DNA, 25 bp, Mus musculus
cattcctgcccgagctgaggatggg

SEQ ID NO: 333427 - DNA, 25 bp, Mus musculus
cattcctgcccgtgctgaggatggg

SEQ ID NO: 333428 - DNA, 25 bp, Mus musculus
cattcctgctggctgactttgagag

SEQ ID NO: 333429 - DNA, 25 bp, Mus musculus
cattcctgctgggtgactttgagag

SEQ ID NO: 333430 - DNA, 25 bp, Mus musculus
cattcctggaaaaggctggtcctag

SEQ ID NO: 333431 - DNA, 25 bp, Mus musculus
cattcctggaaacaaacttctgttt

SEQ ID NO: 333432 - DNA, 25 bp, Mus musculus
cattcctggaaagaaacttctgttt

SEQ ID NO: 333433 - DNA, 25 bp, Mus musculus
cattcctggaaatggctggtcctag

SEQ ID NO: 333434 - DNA, 25 bp, Mus musculus
cattcctggaacaatcgtgattttt

SEQ ID NO: 333435 - DNA, 25 bp, Mus musculus
cattcctggaactatcgtgattttt

SEQ ID NO: 333436 - DNA, 25 bp, Mus musculus
cattcctgggtaagttggccatcca

SEQ ID NO: 333437 - DNA, 25 bp, Mus musculus
cattcctgggtacccatctactttc

SEQ ID NO: 333438 - DNA, 25 bp, Mus musculus
cattcctgggtagccatctactttc

SEQ ID NO: 333439 - DNA, 25 bp, Mus musculus
cattcctgggtatgttggccatcca

SEQ ID NO: 333440 - DNA, 25 bp, Mus musculus
cattcctggtacaatataatcatca

SEQ ID NO: 333441 - DNA, 25 bp, Mus musculus
cattcctggtactatataatcatca

SEQ ID NO: 333442 - DNA, 25 bp, Mus musculus
cattcctggttcagtggttgctgaa

SEQ ID NO: 333443 - DNA, 25 bp, Mus musculus
cattcctggttctgtggttgctgaa

SEQ ID NO: 333444 - DNA, 25 bp, Mus musculus
cattcctgtataaagcattttgcac

SEQ ID NO: 333445 - DNA, 25 bp, Mus musculus
cattcctgtatatagcattttgcac

SEQ ID NO: 333446 - DNA, 25 bp, Mus musculus
cattcctgtctcagttgctgtaata

SEQ ID NO: 333447 - DNA, 25 bp, Mus musculus
cattcctgtctctgttgctgtaata

SEQ ID NO: 333448 - DNA, 25 bp, Mus musculus
cattcctgtgctcagatgtcagcgt

SEQ ID NO: 333449 - DNA, 25 bp, Mus musculus
cattcctgtgctgagatgtcagcgt

SEQ ID NO: 333450 - DNA, 25 bp, Mus musculus
cattcctgtgtaccaatattcatca

SEQ ID NO: 333451 - DNA, 25 bp, Mus musculus
cattcctgtgtagcaatattcatca

SEQ ID NO: 333452 - DNA, 25 bp, Mus musculus
cattcctgttggcttatgtaataaa

SEQ ID NO: 333453 - DNA, 25 bp, Mus musculus
cattcctgttgggttatgtaataaa

SEQ ID NO: 333454 - DNA, 25 bp, Mus musculus
cattccttagatcccttttcagcct

SEQ ID NO: 333455 - DNA, 25 bp, Mus musculus
cattccttagatgccttttcagcct

SEQ ID NO: 333456 - DNA, 25 bp, Mus musculus
cattccttagcaatactgtggctat

SEQ ID NO: 333457 - DNA, 25 bp, Mus musculus
cattccttagcattactgtggctat

SEQ ID NO: 333458 - DNA, 25 bp, Mus musculus
cattccttaggtctacaacctgtgt

SEQ ID NO: 333459 - DNA, 25 bp, Mus musculus
cattccttaggtgtacaacctgtgt

SEQ ID NO: 333460 - DNA, 25 bp, Mus musculus
cattccttagtcaggctcagttttt

SEQ ID NO: 333461 - DNA, 25 bp, Mus musculus
cattccttagtctggctcagttttt

SEQ ID NO: 333462 - DNA, 25 bp, Mus musculus
cattccttattaattgtcgtcagat

SEQ ID NO: 333463 - DNA, 25 bp, Mus musculus
cattccttattatttgtcgtcagat

SEQ ID NO: 333464 - DNA, 25 bp, Mus musculus
cattccttcactccacaaatatttg

SEQ ID NO: 333465 - DNA, 25 bp, Mus musculus
cattccttcactgcacaaatatttg

SEQ ID NO: 333466 - DNA, 25 bp, Mus musculus
cattccttcttcctacggttgggag

SEQ ID NO: 333467 - DNA, 25 bp, Mus musculus
cattccttcttcgtacggttgggag

SEQ ID NO: 333468 - DNA, 25 bp, Mus musculus
cattccttgaggacggcaacatggt

SEQ ID NO: 333469 - DNA, 25 bp, Mus musculus
cattccttgaggtcggcaacatggt

SEQ ID NO: 333470 - DNA, 25 bp, Mus musculus
cattccttgggcattgagtaagtaa

SEQ ID NO: 333471 - DNA, 25 bp, Mus musculus
cattccttgggctttgagtaagtaa

SEQ ID NO: 333472 - DNA, 25 bp, Mus musculus
cattccttgtatcttagatctgtga

SEQ ID NO: 333473 - DNA, 25 bp, Mus musculus
cattccttgtatgttagatctgtga

SEQ ID NO: 333474 - DNA, 25 bp, Mus musculus
cattccttgtcaaagtaggtagcta

SEQ ID NO: 333475 - DNA, 25 bp, Mus musculus
cattccttgtcatagtaggtagcta

SEQ ID NO: 333476 - DNA, 25 bp, Mus musculus
cattccttgttgctcatttttactt

SEQ ID NO: 333477 - DNA, 25 bp, Mus musculus
cattccttgttggtcatttttactt

SEQ ID NO: 333478 - DNA, 25 bp, Mus musculus
cattcctttagcaatttagggacca

SEQ ID NO: 333479 - DNA, 25 bp, Mus musculus
cattcctttagctatttagggacca

SEQ ID NO: 333480 - DNA, 25 bp, Mus musculus
cattcctttcggacacggactggga

SEQ ID NO: 333481 - DNA, 25 bp, Mus musculus
cattcctttcggtcacggactggga

SEQ ID NO: 333482 - DNA, 25 bp, Mus musculus
cattcctttctgatgttagtgatac

SEQ ID NO: 333483 - DNA, 25 bp, Mus musculus
cattcctttctgttgttagtgatac

SEQ ID NO: 333484 - DNA, 25 bp, Mus musculus
cattcctttggcaatcttgttaagt

SEQ ID NO: 333485 - DNA, 25 bp, Mus musculus
cattcctttggctatcttgttaagt

SEQ ID NO: 333486 - DNA, 25 bp, Mus musculus
cattccttttatcagtaaacatcgg

SEQ ID NO: 333487 - DNA, 25 bp, Mus musculus
cattccttttatgagtaaacatcgg

SEQ ID NO: 333488 - DNA, 25 bp, Mus musculus
cattccttttgtcggtatcttgtta

SEQ ID NO: 333489 - DNA, 25 bp, Mus musculus
cattccttttgtgggtatcttgtta

SEQ ID NO: 333490 - DNA, 25 bp, Mus musculus
cattcgaaacggaggcatatgccag

SEQ ID NO: 333491 - DNA, 25 bp, Mus musculus
cattcgaaacggtggcatatgccag

SEQ ID NO: 333492 - DNA, 25 bp, Mus musculus
cattcgactgcacgctgcgttcagg

SEQ ID NO: 333493 - DNA, 25 bp, Mus musculus
cattcgactgcaggctgcgttcagg

SEQ ID NO: 333494 - DNA, 25 bp, Mus musculus
cattcgactgtgaccgtatatctgt

SEQ ID NO: 333495 - DNA, 25 bp, Mus musculus
cattcgactgtgtccgtatatctgt

SEQ ID NO: 333496 - DNA, 25 bp, Mus musculus
cattcgagtgctccagtgggtcata

SEQ ID NO: 333497 - DNA, 25 bp, Mus musculus
cattcgagtgctgcagtgggtcata

SEQ ID NO: 333498 - DNA, 25 bp, Mus musculus
cattcgatacatacagcagggactc

SEQ ID NO: 333499 - DNA, 25 bp, Mus musculus
cattcgatacattcagcagggactc

SEQ ID NO: 333500 - DNA, 25 bp, Mus musculus
cattcgatcattcctggtctcagaa

SEQ ID NO: 333501 - DNA, 25 bp, Mus musculus
cattcgatcattgctggtctcagaa

SEQ ID NO: 333502 - DNA, 25 bp, Mus musculus
cattcgatttctcaggattccacat

SEQ ID NO: 333503 - DNA, 25 bp, Mus musculus
cattcgatttctgaggattccacat

SEQ ID NO: 333504 - DNA, 25 bp, Mus musculus
cattcgcactcaataatccaaggct

SEQ ID NO: 333505 - DNA, 25 bp, Mus musculus
cattcgcactcattaatccaaggct

SEQ ID NO: 333506 - DNA, 25 bp, Mus musculus
cattcgcattaacgctactgactga

SEQ ID NO: 333507 - DNA, 25 bp, Mus musculus
cattcgcattaaggctactgactga

SEQ ID NO: 333508 - DNA, 25 bp, Mus musculus
cattcgcattttctatcggttcatg

SEQ ID NO: 333509 - DNA, 25 bp, Mus musculus
cattcgcattttgtatcggttcatg

SEQ ID NO: 333510 - DNA, 25 bp, Mus musculus
cattcgccgggtaatctgttcggtt

SEQ ID NO: 333511 - DNA, 25 bp, Mus musculus
cattcgccgggttatctgttcggtt

SEQ ID NO: 333512 - DNA, 25 bp, Mus musculus
cattcgcgacggctttttgtttgtt

SEQ ID NO: 333513 - DNA, 25 bp, Mus musculus
cattcgcgacgggtttttgtttgtt

SEQ ID NO: 333514 - DNA, 25 bp, Mus musculus
cattcggaacttagcgctgaggata

SEQ ID NO: 333515 - DNA, 25 bp, Mus musculus
cattcggaactttgcgctgaggata

SEQ ID NO: 333516 - DNA, 25 bp, Mus musculus
cattcggagtccaaacgtgcactga

SEQ ID NO: 333517 - DNA, 25 bp, Mus musculus
cattcggagtcctaacgtgcactga

SEQ ID NO: 333518 - DNA, 25 bp, Mus musculus
cattcggcatttcgactttggagac

SEQ ID NO: 333519 - DNA, 25 bp, Mus musculus
cattcggcatttggactttggagac

SEQ ID NO: 333520 - DNA, 25 bp, Mus musculus
cattcggctaaacggactggtgtct

SEQ ID NO: 333521 - DNA, 25 bp, Mus musculus
cattcggctaaagggactggtgtct

SEQ ID NO: 333522 - DNA, 25 bp, Mus musculus
cattcgggccatcctcgcaggtgga

SEQ ID NO: 333523 - DNA, 25 bp, Mus musculus
cattcgggccatgctcgcaggtgga

SEQ ID NO: 333524 - DNA, 25 bp, Mus musculus
cattcgggcggcaagagagaggcgt

SEQ ID NO: 333525 - DNA, 25 bp, Mus musculus
cattcgggcggctagagagaggcgt

SEQ ID NO: 333526 - DNA, 25 bp, Mus musculus
cattcgggtttaccaggaggtgcaa

SEQ ID NO: 333527 - DNA, 25 bp, Mus musculus
cattcgggtttagcaggaggtgcaa

SEQ ID NO: 333528 - DNA, 25 bp, Mus musculus
cattcggttatacgcagatcccaat

SEQ ID NO: 333529 - DNA, 25 bp, Mus musculus
cattcggttataggcagatcccaat

SEQ ID NO: 333530 - DNA, 25 bp, Mus musculus
cattcggttgtacactttgtgcttt

SEQ ID NO: 333531 - DNA, 25 bp, Mus musculus
cattcggttgtagactttgtgcttt

SEQ ID NO: 333532 - DNA, 25 bp, Mus musculus
cattcgtagacactctttggttgtt

SEQ ID NO: 333533 - DNA, 25 bp, Mus musculus
cattcgtagacagtctttggttgtt

SEQ ID NO: 333534 - DNA, 25 bp, Mus musculus
cattcgtgaaaaaaccagtgtcggc

SEQ ID NO: 333535 - DNA, 25 bp, Mus musculus
cattcgtgaaaataccagtgtcggc

SEQ ID NO: 333536 - DNA, 25 bp, Mus musculus
cattcgtgtacccacttagctcgga

SEQ ID NO: 333537 - DNA, 25 bp, Mus musculus
cattcgtgtaccgacttagctcgga

SEQ ID NO: 333538 - DNA, 25 bp, Mus musculus
cattcgttcactataacaatttatt

SEQ ID NO: 333539 - DNA, 25 bp, Mus musculus
cattcgttcactttaacaatttatt

SEQ ID NO: 333540 - DNA, 25 bp, Mus musculus
cattcgttggatatgaagcttgcca

SEQ ID NO: 333541 - DNA, 25 bp, Mus musculus
cattcgttggatttgaagcttgcca

SEQ ID NO: 333542 - DNA, 25 bp, Mus musculus
cattctaaaaccctactcatacttg

SEQ ID NO: 333543 - DNA, 25 bp, Mus musculus
cattctaaaaccgtactcatacttg

SEQ ID NO: 333544 - DNA, 25 bp, Mus musculus
cattctaaatagctgtttccattac

SEQ ID NO: 333545 - DNA, 25 bp, Mus musculus
cattctaaataggtgtttccattac

SEQ ID NO: 333546 - DNA, 25 bp, Mus musculus
cattctaaggagctctatttgtcat

SEQ ID NO: 333547 - DNA, 25 bp, Mus musculus
cattctaaggaggtctatttgtcat

SEQ ID NO: 333548 - DNA, 25 bp, Mus musculus
cattctaagttacctctcaagtgct

SEQ ID NO: 333549 - DNA, 25 bp, Mus musculus
cattctaagttagctctcaagtgct

SEQ ID NO: 333550 - DNA, 25 bp, Mus musculus
cattctacagtaagcacagaccact

SEQ ID NO: 333551 - DNA, 25 bp, Mus musculus
cattctacagtatgcacagaccact

SEQ ID NO: 333552 - DNA, 25 bp, Mus musculus
cattctacatctagatagttttttc

SEQ ID NO: 333553 - DNA, 25 bp, Mus musculus
cattctacatcttgatagttttttc

SEQ ID NO: 333554 - DNA, 25 bp, Mus musculus
cattctacccaaatctttttcacaa

SEQ ID NO: 333555 - DNA, 25 bp, Mus musculus
cattctacccaattctttttcacaa

SEQ ID NO: 333556 - DNA, 25 bp, Mus musculus
cattctacccagctcttatcagcta

SEQ ID NO: 333557 - DNA, 25 bp, Mus musculus
cattctacccaggtcttatcagcta

SEQ ID NO: 333558 - DNA, 25 bp, Mus musculus
cattctacctgactgcttcattgaa

SEQ ID NO: 333559 - DNA, 25 bp, Mus musculus
cattctacctgagtgcttcattgaa

SEQ ID NO: 333560 - DNA, 25 bp, Mus musculus
cattctacctggaaccggctccgga

SEQ ID NO: 333561 - DNA, 25 bp, Mus musculus
cattctacctggtaccggctccgga

SEQ ID NO: 333562 - DNA, 25 bp, Mus musculus
cattctacgggaacctcttcggaac

SEQ ID NO: 333563 - DNA, 25 bp, Mus musculus
cattctacgggatcctcttcggaac

SEQ ID NO: 333564 - DNA, 25 bp, Mus musculus
cattctactagaccagactgctgtg

SEQ ID NO: 333565 - DNA, 25 bp, Mus musculus
cattctactagagcagactgctgtg

SEQ ID NO: 333566 - DNA, 25 bp, Mus musculus
cattctactgttaggtattcttgga

SEQ ID NO: 333567 - DNA, 25 bp, Mus musculus
cattctactgtttggtattcttgga

SEQ ID NO: 333568 - DNA, 25 bp, Mus musculus
cattctagccacaaattgtagctca

SEQ ID NO: 333569 - DNA, 25 bp, Mus musculus
cattctagccactaattgtagctca

SEQ ID NO: 333570 - DNA, 25 bp, Mus musculus
cattctagtccaattgtgcctttta

SEQ ID NO: 333571 - DNA, 25 bp, Mus musculus
cattctagtccatttgtgcctttta

SEQ ID NO: 333572 - DNA, 25 bp, Mus musculus
cattctagtggaagttcatctctgt

SEQ ID NO: 333573 - DNA, 25 bp, Mus musculus
cattctagtggatgttcatctctgt

SEQ ID NO: 333574 - DNA, 25 bp, Mus musculus
cattctatacatcttgttccacttt

SEQ ID NO: 333575 - DNA, 25 bp, Mus musculus
cattctatacatgttgttccacttt

SEQ ID NO: 333576 - DNA, 25 bp, Mus musculus
cattctatacctccctatgctatta

SEQ ID NO: 333577 - DNA, 25 bp, Mus musculus
cattctatacctgcctatgctatta

SEQ ID NO: 333578 - DNA, 25 bp, Mus musculus
cattctatatttcgtattgctggga

SEQ ID NO: 333579 - DNA, 25 bp, Mus musculus
cattctatatttggtattgctggga

SEQ ID NO: 333580 - DNA, 25 bp, Mus musculus
cattctatctgtacttggtttagtg

SEQ ID NO: 333581 - DNA, 25 bp, Mus musculus
cattctatctgttcttggtttagtg

SEQ ID NO: 333582 - DNA, 25 bp, Mus musculus
cattctatggaacaggtttgaggcc

SEQ ID NO: 333583 - DNA, 25 bp, Mus musculus
cattctatggaagaggtttgaggcc

SEQ ID NO: 333584 - DNA, 25 bp, Mus musculus
cattctattggtactgttcctctag

SEQ ID NO: 333585 - DNA, 25 bp, Mus musculus
cattctattggttctgttcctctag

SEQ ID NO: 333586 - DNA, 25 bp, Mus musculus
cattctcagaggacagctaccgatg

SEQ ID NO: 333587 - DNA, 25 bp, Mus musculus
cattctcagaggtcagctaccgatg

SEQ ID NO: 333588 - DNA, 25 bp, Mus musculus
cattctcagcctctcgacgtaattt

SEQ ID NO: 333589 - DNA, 25 bp, Mus musculus
cattctcagcctgtcgacgtaattt

SEQ ID NO: 333590 - DNA, 25 bp, Mus musculus
cattctcaggatatctaactcaagt

SEQ ID NO: 333591 - DNA, 25 bp, Mus musculus
cattctcaggatttctaactcaagt

SEQ ID NO: 333592 - DNA, 25 bp, Mus musculus
cattctcagggaaggtttcttccac

SEQ ID NO: 333593 - DNA, 25 bp, Mus musculus
cattctcagggatggtttcttccac

SEQ ID NO: 333594 - DNA, 25 bp, Mus musculus
cattctcatcagacgcaatgattca

SEQ ID NO: 333595 - DNA, 25 bp, Mus musculus
cattctcatcagtcgcaatgattca

SEQ ID NO: 333596 - DNA, 25 bp, Mus musculus
cattctcatccccatgtttagctga

SEQ ID NO: 333597 - DNA, 25 bp, Mus musculus
cattctcatcccgatgtttagctga

SEQ ID NO: 333598 - DNA, 25 bp, Mus musculus
cattctcatgagctggtctggatca

SEQ ID NO: 333599 - DNA, 25 bp, Mus musculus
cattctcatgaggtggtctggatca

SEQ ID NO: 333600 - DNA, 25 bp, Mus musculus
cattctccagccacagttgtttaat

SEQ ID NO: 333601 - DNA, 25 bp, Mus musculus
cattctccagcctcagttgtttaat

SEQ ID NO: 333602 - DNA, 25 bp, Mus musculus
cattctccagtgagcttagctgtgt

SEQ ID NO: 333603 - DNA, 25 bp, Mus musculus
cattctccagtgtgcttagctgtgt

SEQ ID NO: 333604 - DNA, 25 bp, Mus musculus
cattctccatttcagtgacaatatt

SEQ ID NO: 333605 - DNA, 25 bp, Mus musculus
cattctccatttgagtgacaatatt

SEQ ID NO: 333606 - DNA, 25 bp, Mus musculus
cattctcccactcaggtggtctgaa

SEQ ID NO: 333607 - DNA, 25 bp, Mus musculus
cattctcccactgaggtggtctgaa

SEQ ID NO: 333608 - DNA, 25 bp, Mus musculus
cattctcccgagacagattttaagt

SEQ ID NO: 333609 - DNA, 25 bp, Mus musculus
cattctcccgagtcagattttaagt

SEQ ID NO: 333610 - DNA, 25 bp, Mus musculus
cattctccctccaaaagttttacag

SEQ ID NO: 333611 - DNA, 25 bp, Mus musculus
cattctccctcctaaagttttacag

SEQ ID NO: 333612 - DNA, 25 bp, Mus musculus
cattctccgtgaactgtatcagtca

SEQ ID NO: 333613 - DNA, 25 bp, Mus musculus
cattctccgtgatctgtatcagtca

SEQ ID NO: 333614 - DNA, 25 bp, Mus musculus
cattctccgttcagctccaattgga

SEQ ID NO: 333615 - DNA, 25 bp, Mus musculus
cattctccgttctgctccaattgga

SEQ ID NO: 333616 - DNA, 25 bp, Mus musculus
cattctcctgcaaattccatggtag

SEQ ID NO: 333617 - DNA, 25 bp, Mus musculus
cattctcctgcatattccatggtag

SEQ ID NO: 333618 - DNA, 25 bp, Mus musculus
cattctcctggcaactagtgtggct

SEQ ID NO: 333619 - DNA, 25 bp, Mus musculus
cattctcctggctactagtgtggct

SEQ ID NO: 333620 - DNA, 25 bp, Mus musculus
cattctccttctcagtgttacggaa

SEQ ID NO: 333621 - DNA, 25 bp, Mus musculus
cattctccttctgagtgttacggaa

SEQ ID NO: 333622 - DNA, 25 bp, Mus musculus
cattctccttggagcaaggccacat

SEQ ID NO: 333623 - DNA, 25 bp, Mus musculus
cattctccttggtgcaaggccacat

SEQ ID NO: 333624 - DNA, 25 bp, Mus musculus
cattctcgtgttctccatgtcagga

SEQ ID NO: 333625 - DNA, 25 bp, Mus musculus
cattctcgtgttgtccatgtcagga

SEQ ID NO: 333626 - DNA, 25 bp, Mus musculus
cattctctagatatccctcatttgg

SEQ ID NO: 333627 - DNA, 25 bp, Mus musculus
cattctctagatttccctcatttgg

SEQ ID NO: 333628 - DNA, 25 bp, Mus musculus
cattctctcactattcatctatcta

SEQ ID NO: 333629 - DNA, 25 bp, Mus musculus
cattctctcacttttcatctatcta

SEQ ID NO: 333630 - DNA, 25 bp, Mus musculus
cattctctcctcctgtatttttata

SEQ ID NO: 333631 - DNA, 25 bp, Mus musculus
cattctctcctcgtgtatttttata

SEQ ID NO: 333632 - DNA, 25 bp, Mus musculus
cattctctcgagctcagggcataac

SEQ ID NO: 333633 - DNA, 25 bp, Mus musculus
cattctctcgaggtcagggcataac

SEQ ID NO: 333634 - DNA, 25 bp, Mus musculus
cattctctctatactttcttccttt

SEQ ID NO: 333635 - DNA, 25 bp, Mus musculus
cattctctctattctttcttccttt

SEQ ID NO: 333636 - DNA, 25 bp, Mus musculus
cattctctctcgctttgaaagtaca

SEQ ID NO: 333637 - DNA, 25 bp, Mus musculus
cattctctctcggtttgaaagtaca

SEQ ID NO: 333638 - DNA, 25 bp, Mus musculus
cattctctgctaaataggtggctga

SEQ ID NO: 333639 - DNA, 25 bp, Mus musculus
cattctctgctatataggtggctga

SEQ ID NO: 333640 - DNA, 25 bp, Mus musculus
cattctctggatagagactgcctcc

SEQ ID NO: 333641 - DNA, 25 bp, Mus musculus
cattctctggattgagactgcctcc

SEQ ID NO: 333642 - DNA, 25 bp, Mus musculus
cattctcttagtaaacttgccggcc

SEQ ID NO: 333643 - DNA, 25 bp, Mus musculus
cattctcttagttaacttgccggcc

SEQ ID NO: 333644 - DNA, 25 bp, Mus musculus
cattctcttccacttctgtggtatt

SEQ ID NO: 333645 - DNA, 25 bp, Mus musculus
cattctcttccagttctgtggtatt

SEQ ID NO: 333646 - DNA, 25 bp, Mus musculus
cattctgagcttatcagtgatggta

SEQ ID NO: 333647 - DNA, 25 bp, Mus musculus
cattctgagcttttcagtgatggta

SEQ ID NO: 333648 - DNA, 25 bp, Mus musculus
cattctgatctgcttcctgaagagt

SEQ ID NO: 333649 - DNA, 25 bp, Mus musculus
cattctgatctggttcctgaagagt

SEQ ID NO: 333650 - DNA, 25 bp, Mus musculus
cattctgattgcatcatggtgtgaa

SEQ ID NO: 333651 - DNA, 25 bp, Mus musculus
cattctgattgcttcatggtgtgaa

SEQ ID NO: 333652 - DNA, 25 bp, Mus musculus
cattctgcagctctctaactcaaag

SEQ ID NO: 333653 - DNA, 25 bp, Mus musculus
cattctgcagctgtctaactcaaag

SEQ ID NO: 333654 - DNA, 25 bp, Mus musculus
cattctgcagtgaggcaattacatt

SEQ ID NO: 333655 - DNA, 25 bp, Mus musculus
cattctgcagtgtggcaattacatt

SEQ ID NO: 333656 - DNA, 25 bp, Mus musculus
cattctgcattaaggagcgctgatc

SEQ ID NO: 333657 - DNA, 25 bp, Mus musculus
cattctgcattatggagcgctgatc

SEQ ID NO: 333658 - DNA, 25 bp, Mus musculus
cattctggaacaccgactgacacta

SEQ ID NO: 333659 - DNA, 25 bp, Mus musculus
cattctggaacagcgactgacacta

SEQ ID NO: 333660 - DNA, 25 bp, Mus musculus
cattctggaaccctggcatccttct

SEQ ID NO: 333661 - DNA, 25 bp, Mus musculus
cattctggaaccgtggcatccttct

SEQ ID NO: 333662 - DNA, 25 bp, Mus musculus
cattctggaagcactggccatctat

SEQ ID NO: 333663 - DNA, 25 bp, Mus musculus
cattctggaagctctggccatctat

SEQ ID NO: 333664 - DNA, 25 bp, Mus musculus
cattctggaaggagcctagcctggc

SEQ ID NO: 333665 - DNA, 25 bp, Mus musculus
cattctggaaggtgcctagcctggc

SEQ ID NO: 333666 - DNA, 25 bp, Mus musculus
cattctggaattcagccgaggtgtg

SEQ ID NO: 333667 - DNA, 25 bp, Mus musculus
cattctggaattgagccgaggtgtg

SEQ ID NO: 333668 - DNA, 25 bp, Mus musculus
cattctggacagattctctgggctt

SEQ ID NO: 333669 - DNA, 25 bp, Mus musculus
cattctggacagtttctctgggctt

SEQ ID NO: 333670 - DNA, 25 bp, Mus musculus
cattctggatgtattcaggaagatg

SEQ ID NO: 333671 - DNA, 25 bp, Mus musculus
cattctggatgttttcaggaagatg

SEQ ID NO: 333672 - DNA, 25 bp, Mus musculus
cattctggatttcctactaggacgt

SEQ ID NO: 333673 - DNA, 25 bp, Mus musculus
cattctggatttgctactaggacgt

SEQ ID NO: 333674 - DNA, 25 bp, Mus musculus
cattctggcaagatgggtttccata

SEQ ID NO: 333675 - DNA, 25 bp, Mus musculus
cattctggcaagttgggtttccata

SEQ ID NO: 333676 - DNA, 25 bp, Mus musculus
cattctggccaaactttcattaaat

SEQ ID NO: 333677 - DNA, 25 bp, Mus musculus
cattctggccaaagaactgtctgtg

SEQ ID NO: 333678 - DNA, 25 bp, Mus musculus
cattctggccaactctttctataga

SEQ ID NO: 333679 - DNA, 25 bp, Mus musculus
cattctggccaagtctttctataga

SEQ ID NO: 333680 - DNA, 25 bp, Mus musculus
cattctggccaatctttcattaaat

SEQ ID NO: 333681 - DNA, 25 bp, Mus musculus
cattctggccaatgaactgtctgtg

SEQ ID NO: 333682 - DNA, 25 bp, Mus musculus
cattctgggaggctagtatttggta

SEQ ID NO: 333683 - DNA, 25 bp, Mus musculus
cattctgggagggtagtatttggta

SEQ ID NO: 333684 - DNA, 25 bp, Mus musculus
cattctgggatgagctgctgactac

SEQ ID NO: 333685 - DNA, 25 bp, Mus musculus
cattctgggatgtgctgctgactac

SEQ ID NO: 333686 - DNA, 25 bp, Mus musculus
cattctgggcgcatgttgatcgctg

SEQ ID NO: 333687 - DNA, 25 bp, Mus musculus
cattctgggcgcttgttgatcgctg

SEQ ID NO: 333688 - DNA, 25 bp, Mus musculus
cattctggtcccaatttgtggttat

SEQ ID NO: 333689 - DNA, 25 bp, Mus musculus
cattctggtccctatttgtggttat

SEQ ID NO: 333690 - DNA, 25 bp, Mus musculus
cattctgtaccaaactttgggtatt

SEQ ID NO: 333691 - DNA, 25 bp, Mus musculus
cattctgtaccatactttgggtatt

SEQ ID NO: 333692 - DNA, 25 bp, Mus musculus
cattctgtaggacctctggcagcta

SEQ ID NO: 333693 - DNA, 25 bp, Mus musculus
cattctgtaggagctctggcagcta

SEQ ID NO: 333694 - DNA, 25 bp, Mus musculus
cattctgtcataccacattttctct

SEQ ID NO: 333695 - DNA, 25 bp, Mus musculus
cattctgtcatagcacattttctct

SEQ ID NO: 333696 - DNA, 25 bp, Mus musculus
cattctgtccctaagtcctttaaat

SEQ ID NO: 333697 - DNA, 25 bp, Mus musculus
cattctgtcccttagtcctttaaat

SEQ ID NO: 333698 - DNA, 25 bp, Mus musculus
cattctgtcttgatccaaagctcta

SEQ ID NO: 333699 - DNA, 25 bp, Mus musculus
cattctgtcttgttccaaagctcta

SEQ ID NO: 333700 - DNA, 25 bp, Mus musculus
cattctgtgaacatgtgcgtagctt

SEQ ID NO: 333701 - DNA, 25 bp, Mus musculus
cattctgtgaacttgtgcgtagctt

SEQ ID NO: 333702 - DNA, 25 bp, Mus musculus
cattctgtgacaccgtgtcccttaa

SEQ ID NO: 333703 - DNA, 25 bp, Mus musculus
cattctgtgacagcgtgtcccttaa

SEQ ID NO: 333704 - DNA, 25 bp, Mus musculus
cattctgtgcctctttacaggacta

SEQ ID NO: 333705 - DNA, 25 bp, Mus musculus
cattctgtgcctgtttacaggacta

SEQ ID NO: 333706 - DNA, 25 bp, Mus musculus
cattctgtgcgacgaggtctgtgca

SEQ ID NO: 333707 - DNA, 25 bp, Mus musculus
cattctgtgcgaggaggtctgtgca

SEQ ID NO: 333708 - DNA, 25 bp, Mus musculus
cattctgtggatctcacactctgat

SEQ ID NO: 333709 - DNA, 25 bp, Mus musculus
cattctgtggatgtcacactctgat

SEQ ID NO: 333710 - DNA, 25 bp, Mus musculus
cattctgtggtgcaagaatagattt

SEQ ID NO: 333711 - DNA, 25 bp, Mus musculus
cattctgtggtggaagaatagattt

SEQ ID NO: 333712 - DNA, 25 bp, Mus musculus
cattctgtgtcaagtctggtggcat

SEQ ID NO: 333713 - DNA, 25 bp, Mus musculus
cattctgtgtcatgtctggtggcat

SEQ ID NO: 333714 - DNA, 25 bp, Mus musculus
cattctgttaccatgtgagtctgac

SEQ ID NO: 333715 - DNA, 25 bp, Mus musculus
cattctgttaccttgtgagtctgac

SEQ ID NO: 333716 - DNA, 25 bp, Mus musculus
cattctgttcacatgtgcctagaag

SEQ ID NO: 333717 - DNA, 25 bp, Mus musculus
cattctgttcacttgtgcctagaag

SEQ ID NO: 333718 - DNA, 25 bp, Mus musculus
cattctgttctgctagttggctatg

SEQ ID NO: 333719 - DNA, 25 bp, Mus musculus
cattctgttctggtagttggctatg

SEQ ID NO: 333720 - DNA, 25 bp, Mus musculus
cattctgttcttacattttttccgg

SEQ ID NO: 333721 - DNA, 25 bp, Mus musculus
cattctgttctttcattttttccgg

SEQ ID NO: 333722 - DNA, 25 bp, Mus musculus
cattctgttggcatccttgatagga

SEQ ID NO: 333723 - DNA, 25 bp, Mus musculus
cattctgttggcttccttgatagga

SEQ ID NO: 333724 - DNA, 25 bp, Mus musculus
cattctgttgtgatttttcatccca

SEQ ID NO: 333725 - DNA, 25 bp, Mus musculus
cattctgttgtgttttttcatccca

SEQ ID NO: 333726 - DNA, 25 bp, Mus musculus
cattcttagctcctgtagactggaa

SEQ ID NO: 333727 - DNA, 25 bp, Mus musculus
cattcttagctcgtgtagactggaa

SEQ ID NO: 333728 - DNA, 25 bp, Mus musculus
cattcttattaaaccacctgctatt

SEQ ID NO: 333729 - DNA, 25 bp, Mus musculus
cattcttattaatccacctgctatt

SEQ ID NO: 333730 - DNA, 25 bp, Mus musculus
cattcttatttcatccaaaggtcac

SEQ ID NO: 333731 - DNA, 25 bp, Mus musculus
cattcttatttcttccaaaggtcac

SEQ ID NO: 333732 - DNA, 25 bp, Mus musculus
cattcttcccaacattcctttgtca

SEQ ID NO: 333733 - DNA, 25 bp, Mus musculus
cattcttcccaagattcctttgtca

SEQ ID NO: 333734 - DNA, 25 bp, Mus musculus
cattcttccctcattttgtacagtt

SEQ ID NO: 333735 - DNA, 25 bp, Mus musculus
cattcttccctctttttgtacagtt

SEQ ID NO: 333736 - DNA, 25 bp, Mus musculus
cattcttcctagaaaattttatcca

SEQ ID NO: 333737 - DNA, 25 bp, Mus musculus
cattcttcctagtaaattttatcca

SEQ ID NO: 333738 - DNA, 25 bp, Mus musculus
cattcttctattaacccggtgggag

SEQ ID NO: 333739 - DNA, 25 bp, Mus musculus
cattcttctatttacccggtgggag

SEQ ID NO: 333740 - DNA, 25 bp, Mus musculus
cattcttctgaacgctgattatgaa

SEQ ID NO: 333741 - DNA, 25 bp, Mus musculus
cattcttctgaaggctgattatgaa

SEQ ID NO: 333742 - DNA, 25 bp, Mus musculus
cattcttctgtcatcaactgtctag

SEQ ID NO: 333743 - DNA, 25 bp, Mus musculus
cattcttctgtcttcaactgtctag

SEQ ID NO: 333744 - DNA, 25 bp, Mus musculus
cattcttctgttagcgatgccgtta

SEQ ID NO: 333745 - DNA, 25 bp, Mus musculus
cattcttctgtttgcgatgccgtta

SEQ ID NO: 333746 - DNA, 25 bp, Mus musculus
cattcttcttccatgagtgttggtg

SEQ ID NO: 333747 - DNA, 25 bp, Mus musculus
cattcttcttccttgagtgttggtg

SEQ ID NO: 333748 - DNA, 25 bp, Mus musculus
cattcttcttgaattccaggtctga

SEQ ID NO: 333749 - DNA, 25 bp, Mus musculus
cattcttcttgatttccaggtctga

SEQ ID NO: 333750 - DNA, 25 bp, Mus musculus
cattcttgaaaaacggctgcccata

SEQ ID NO: 333751 - DNA, 25 bp, Mus musculus
cattcttgaaaatcggctgcccata

SEQ ID NO: 333752 - DNA, 25 bp, Mus musculus
cattcttgaaggacacgtgcttatg

SEQ ID NO: 333753 - DNA, 25 bp, Mus musculus
cattcttgaaggtcacgtgcttatg

SEQ ID NO: 333754 - DNA, 25 bp, Mus musculus
cattcttgatttcagatacaggaac

SEQ ID NO: 333755 - DNA, 25 bp, Mus musculus
cattcttgatttgagatacaggaac

SEQ ID NO: 333756 - DNA, 25 bp, Mus musculus
cattcttgctagaacttgtgtggtt

SEQ ID NO: 333757 - DNA, 25 bp, Mus musculus
cattcttgctagtacttgtgtggtt

SEQ ID NO: 333758 - DNA, 25 bp, Mus musculus
cattcttgggccatctgtcctactg

SEQ ID NO: 333759 - DNA, 25 bp, Mus musculus
cattcttgggccttctgtcctactg

SEQ ID NO: 333760 - DNA, 25 bp, Mus musculus
cattcttggtagcaatttctaacta

SEQ ID NO: 333761 - DNA, 25 bp, Mus musculus
cattcttggtaggaatttctaacta

SEQ ID NO: 333762 - DNA, 25 bp, Mus musculus
cattctttaaccacccttgagctgt

SEQ ID NO: 333763 - DNA, 25 bp, Mus musculus
cattctttaacctcccttgagctgt

SEQ ID NO: 333764 - DNA, 25 bp, Mus musculus
cattctttcattccaactgttgtaa

SEQ ID NO: 333765 - DNA, 25 bp, Mus musculus
cattctttcattgcaactgttgtaa

SEQ ID NO: 333766 - DNA, 25 bp, Mus musculus
cattctttccctcttggatgtagga

SEQ ID NO: 333767 - DNA, 25 bp, Mus musculus
cattctttccctgttggatgtagga

SEQ ID NO: 333768 - DNA, 25 bp, Mus musculus
cattctttgaagcatgcctcaccaa

SEQ ID NO: 333769 - DNA, 25 bp, Mus musculus
cattctttgaaggatgcctcaccaa

SEQ ID NO: 333770 - DNA, 25 bp, Mus musculus
cattctttgcatcgcccgtctgaag

SEQ ID NO: 333771 - DNA, 25 bp, Mus musculus
cattctttgcatggcccgtctgaag

SEQ ID NO: 333772 - DNA, 25 bp, Mus musculus
cattctttgggtaacgacttcaggc

SEQ ID NO: 333773 - DNA, 25 bp, Mus musculus
cattctttgggttacgacttcaggc

SEQ ID NO: 333774 - DNA, 25 bp, Mus musculus
cattcttttaacattcactgtaaag

SEQ ID NO: 333775 - DNA, 25 bp, Mus musculus
cattcttttaactttcactgtaaag

SEQ ID NO: 333776 - DNA, 25 bp, Mus musculus
cattcttttactaccatgtttgtat

SEQ ID NO: 333777 - DNA, 25 bp, Mus musculus
cattcttttacttccatgtttgtat

SEQ ID NO: 333778 - DNA, 25 bp, Mus musculus
cattcttttatactgtactttgcga

SEQ ID NO: 333779 - DNA, 25 bp, Mus musculus
cattcttttatagtgtactttgcga

SEQ ID NO: 333780 - DNA, 25 bp, Mus musculus
cattcttttatgcaagttccaacag

SEQ ID NO: 333781 - DNA, 25 bp, Mus musculus
cattcttttatggaagttccaacag

SEQ ID NO: 333782 - DNA, 25 bp, Mus musculus
cattcttttcaccttactgggaatt

SEQ ID NO: 333783 - DNA, 25 bp, Mus musculus
cattcttttcacgttactgggaatt

SEQ ID NO: 333784 - DNA, 25 bp, Mus musculus
cattcttttgtcagtcactgtgttt

SEQ ID NO: 333785 - DNA, 25 bp, Mus musculus
cattcttttgtctgtcactgtgttt

SEQ ID NO: 333786 - DNA, 25 bp, Mus musculus
cattgaaaatacaccgaagcacctt

SEQ ID NO: 333787 - DNA, 25 bp, Mus musculus
cattgaaaatactccgaagcacctt

SEQ ID NO: 333788 - DNA, 25 bp, Mus musculus
cattgaaagcttccctaaggtagtc

SEQ ID NO: 333789 - DNA, 25 bp, Mus musculus
cattgaaagcttgcctaaggtagtc

SEQ ID NO: 333790 - DNA, 25 bp, Mus musculus
cattgaaatcctagctatgctcatt

SEQ ID NO: 333791 - DNA, 25 bp, Mus musculus
cattgaaatccttgctatgctcatt

SEQ ID NO: 333792 - DNA, 25 bp, Mus musculus
cattgaagtctccattaaagtctct

SEQ ID NO: 333793 - DNA, 25 bp, Mus musculus
cattgaagtctcgattaaagtctct

SEQ ID NO: 333794 - DNA, 25 bp, Mus musculus
cattgacacgcccaagtgcaacctg

SEQ ID NO: 333795 - DNA, 25 bp, Mus musculus
cattgacacgccgaagtgcaacctg

SEQ ID NO: 333796 - DNA, 25 bp, Mus musculus
cattgacagaaacatcgagttcccc

SEQ ID NO: 333797 - DNA, 25 bp, Mus musculus
cattgacagaaagatcgagttcccc

SEQ ID NO: 333798 - DNA, 25 bp, Mus musculus
cattgacagctgagtccattgaaga

SEQ ID NO: 333799 - DNA, 25 bp, Mus musculus
cattgacagctgtgtccattgaaga

SEQ ID NO: 333800 - DNA, 25 bp, Mus musculus
cattgacatcttcctattttcttga

SEQ ID NO: 333801 - DNA, 25 bp, Mus musculus
cattgacatcttgctattttcttga

SEQ ID NO: 333802 - DNA, 25 bp, Mus musculus
cattgacattgtaactggcgagaat

SEQ ID NO: 333803 - DNA, 25 bp, Mus musculus
cattgacattgttactggcgagaat

SEQ ID NO: 333804 - DNA, 25 bp, Mus musculus
cattgaccagagaatacctaagaaa

SEQ ID NO: 333805 - DNA, 25 bp, Mus musculus
cattgaccagagaatcacgctgaaa

SEQ ID NO: 333806 - DNA, 25 bp, Mus musculus
cattgaccagagtatacctaagaaa

SEQ ID NO: 333807 - DNA, 25 bp, Mus musculus
cattgaccagagtatcacgctgaaa

SEQ ID NO: 333808 - DNA, 25 bp, Mus musculus
cattgaccaggacctcaagccgtgg

SEQ ID NO: 333809 - DNA, 25 bp, Mus musculus
cattgaccaggagctcaagccgtgg

SEQ ID NO: 333810 - DNA, 25 bp, Mus musculus
cattgaccatgaacatacagttgag

SEQ ID NO: 333811 - DNA, 25 bp, Mus musculus
cattgaccatgatcatacagttgag

SEQ ID NO: 333812 - DNA, 25 bp, Mus musculus
cattgaccgactaccatcctcagtg

SEQ ID NO: 333813 - DNA, 25 bp, Mus musculus
cattgaccgacttccatcctcagtg

SEQ ID NO: 333814 - DNA, 25 bp, Mus musculus
cattgacgagtaccagtccccatta

SEQ ID NO: 333815 - DNA, 25 bp, Mus musculus
cattgacgagtagcagtccccatta

SEQ ID NO: 333816 - DNA, 25 bp, Mus musculus
cattgacggtgtcaggaacatccct

SEQ ID NO: 333817 - DNA, 25 bp, Mus musculus
cattgacggtgtgaggaacatccct

SEQ ID NO: 333818 - DNA, 25 bp, Mus musculus
cattgactagggacttgttactgat

SEQ ID NO: 333819 - DNA, 25 bp, Mus musculus
cattgactagggtcttgttactgat

SEQ ID NO: 333820 - DNA, 25 bp, Mus musculus
cattgactatttagtgaggttcttt

SEQ ID NO: 333821 - DNA, 25 bp, Mus musculus
cattgactattttgtgaggttcttt

SEQ ID NO: 333822 - DNA, 25 bp, Mus musculus
cattgactctctcacaagtgttaaa

SEQ ID NO: 333823 - DNA, 25 bp, Mus musculus
cattgactctctgacaagtgttaaa

SEQ ID NO: 333824 - DNA, 25 bp, Mus musculus
cattgacttagaagttagctgcata

SEQ ID NO: 333825 - DNA, 25 bp, Mus musculus
cattgacttagatgttagctgcata

SEQ ID NO: 333826 - DNA, 25 bp, Mus musculus
cattgacttccgaatcggagacgga

SEQ ID NO: 333827 - DNA, 25 bp, Mus musculus
cattgacttccgtatcggagacgga

SEQ ID NO: 333828 - DNA, 25 bp, Mus musculus
cattgacttcctactctgagttttc

SEQ ID NO: 333829 - DNA, 25 bp, Mus musculus
cattgacttccttctctgagttttc

SEQ ID NO: 333830 - DNA, 25 bp, Mus musculus
cattgacttcgtatgtactttcgta

SEQ ID NO: 333831 - DNA, 25 bp, Mus musculus
cattgacttcgtttgtactttcgta

SEQ ID NO: 333832 - DNA, 25 bp, Mus musculus
cattgacttgaaatcctaactccca

SEQ ID NO: 333833 - DNA, 25 bp, Mus musculus
cattgacttgaattcctaactccca

SEQ ID NO: 333834 - DNA, 25 bp, Mus musculus
cattgactttacagagctctttagg

SEQ ID NO: 333835 - DNA, 25 bp, Mus musculus
cattgactttactgagctctttagg

SEQ ID NO: 333836 - DNA, 25 bp, Mus musculus
cattgagaaggaataccagccccat

SEQ ID NO: 333837 - DNA, 25 bp, Mus musculus
cattgagaaggattaccagccccat

SEQ ID NO: 333838 - DNA, 25 bp, Mus musculus
cattgagagctcagggactgtccag

SEQ ID NO: 333839 - DNA, 25 bp, Mus musculus
cattgagagctctgggactgtccag

SEQ ID NO: 333840 - DNA, 25 bp, Mus musculus
cattgagcagacacggtagaggact

SEQ ID NO: 333841 - DNA, 25 bp, Mus musculus
cattgagcagactcggtagaggact

SEQ ID NO: 333842 - DNA, 25 bp, Mus musculus
cattgagcatatatgtgtgtacctg

SEQ ID NO: 333843 - DNA, 25 bp, Mus musculus
cattgagcatatttgtgtgtacctg

SEQ ID NO: 333844 - DNA, 25 bp, Mus musculus
cattgagcattcctaaattgttgtc

SEQ ID NO: 333845 - DNA, 25 bp, Mus musculus
cattgagcattcgtaaattgttgtc

SEQ ID NO: 333846 - DNA, 25 bp, Mus musculus
cattgagccagaacggaacccggaa

SEQ ID NO: 333847 - DNA, 25 bp, Mus musculus
cattgagccagatcggaacccggaa

SEQ ID NO: 333848 - DNA, 25 bp, Mus musculus
cattgagccagccactgacggatga

SEQ ID NO: 333849 - DNA, 25 bp, Mus musculus
cattgagccagcgactgacggatga

SEQ ID NO: 333850 - DNA, 25 bp, Mus musculus
cattgagcccctaaacagagactat

SEQ ID NO: 333851 - DNA, 25 bp, Mus musculus
cattgagccccttaacagagactat

SEQ ID NO: 333852 - DNA, 25 bp, Mus musculus
cattgagctacaatttgtggctaga

SEQ ID NO: 333853 - DNA, 25 bp, Mus musculus
cattgagctacattttgtggctaga

SEQ ID NO: 333854 - DNA, 25 bp, Mus musculus
cattgagctggcctatcttcaacag

SEQ ID NO: 333855 - DNA, 25 bp, Mus musculus
cattgagctggcgtatcttcaacag

SEQ ID NO: 333856 - DNA, 25 bp, Mus musculus
cattgagcttctctgcctacaagaa

SEQ ID NO: 333857 - DNA, 25 bp, Mus musculus
cattgagcttctgtgcctacaagaa

SEQ ID NO: 333858 - DNA, 25 bp, Mus musculus
cattgagctttcagccctagagatg

SEQ ID NO: 333859 - DNA, 25 bp, Mus musculus
cattgagctttctgccctagagatg

SEQ ID NO: 333860 - DNA, 25 bp, Mus musculus
cattgaggaatcatccagctccctg

SEQ ID NO: 333861 - DNA, 25 bp, Mus musculus
cattgaggaatcttccagctccctg

SEQ ID NO: 333862 - DNA, 25 bp, Mus musculus
cattgaggccggagactcccctggc

SEQ ID NO: 333863 - DNA, 25 bp, Mus musculus
cattgaggccggtgactcccctggc

SEQ ID NO: 333864 - DNA, 25 bp, Mus musculus
cattgaggtggaacccgacaccaag

SEQ ID NO: 333865 - DNA, 25 bp, Mus musculus
cattgaggtggatcccgacaccaag

SEQ ID NO: 333866 - DNA, 25 bp, Mus musculus
cattgaggttctaggagacgtcgga

SEQ ID NO: 333867 - DNA, 25 bp, Mus musculus
cattgaggttcttggagacgtcgga

SEQ ID NO: 333868 - DNA, 25 bp, Mus musculus
cattgagtagatctcttgcttttga

SEQ ID NO: 333869 - DNA, 25 bp, Mus musculus
cattgagtagatgtcttgcttttga

SEQ ID NO: 333870 - DNA, 25 bp, Mus musculus
cattgagtcctgctagtctacatcc

SEQ ID NO: 333871 - DNA, 25 bp, Mus musculus
cattgagtcctggtagtctacatcc

SEQ ID NO: 333872 - DNA, 25 bp, Mus musculus
cattgagtggagctgctaggtccca

SEQ ID NO: 333873 - DNA, 25 bp, Mus musculus
cattgagtggaggtgctaggtccca

SEQ ID NO: 333874 - DNA, 25 bp, Mus musculus
cattgagtggccactatgatcctgt

SEQ ID NO: 333875 - DNA, 25 bp, Mus musculus
cattgagtggcctctatgatcctgt

SEQ ID NO: 333876 - DNA, 25 bp, Mus musculus
cattgagtgggtatctctgatgtca

SEQ ID NO: 333877 - DNA, 25 bp, Mus musculus
cattgagtgggtttctctgatgtca

SEQ ID NO: 333878 - DNA, 25 bp, Mus musculus
cattgagtgtagacggccatatcct

SEQ ID NO: 333879 - DNA, 25 bp, Mus musculus
cattgagtgtagtcggccatatcct

SEQ ID NO: 333880 - DNA, 25 bp, Mus musculus
cattgagtttgacacactactgcct

SEQ ID NO: 333881 - DNA, 25 bp, Mus musculus
cattgagtttgagacactactgcct

SEQ ID NO: 333882 - DNA, 25 bp, Mus musculus
cattgagtttttagtcaccgaggaa

SEQ ID NO: 333883 - DNA, 25 bp, Mus musculus
cattgagttttttgtcaccgaggaa

SEQ ID NO: 333884 - DNA, 25 bp, Mus musculus
cattgataaagtatttctccccaat

SEQ ID NO: 333885 - DNA, 25 bp, Mus musculus
cattgataaagtttttctccccaat

SEQ ID NO: 333886 - DNA, 25 bp, Mus musculus
cattgataatgtcccctgtgataag

SEQ ID NO: 333887 - DNA, 25 bp, Mus musculus
cattgataatgtgccctgtgataag

SEQ ID NO: 333888 - DNA, 25 bp, Mus musculus
cattgatcgggcaaccttgacgaga

SEQ ID NO: 333889 - DNA, 25 bp, Mus musculus
cattgatcgggctaccttgacgaga

SEQ ID NO: 333890 - DNA, 25 bp, Mus musculus
cattgatgacctcgaagacgagctc

SEQ ID NO: 333891 - DNA, 25 bp, Mus musculus
cattgatgacctggaagacgagctc

SEQ ID NO: 333892 - DNA, 25 bp, Mus musculus
cattgatgatctacttgatgccaac

SEQ ID NO: 333893 - DNA, 25 bp, Mus musculus
cattgatgatcttcttgatgccaac

SEQ ID NO: 333894 - DNA, 25 bp, Mus musculus
cattgatgcagtatttcccattcca

SEQ ID NO: 333895 - DNA, 25 bp, Mus musculus
cattgatgcagtttttcccattcca

SEQ ID NO: 333896 - DNA, 25 bp, Mus musculus
cattgatgccacctcaaggaaaggg

SEQ ID NO: 333897 - DNA, 25 bp, Mus musculus
cattgatgccacgtcaaggaaaggg

SEQ ID NO: 333898 - DNA, 25 bp, Mus musculus
cattgatggcctaatagcttggtga

SEQ ID NO: 333899 - DNA, 25 bp, Mus musculus
cattgatggccttatagcttggtga

SEQ ID NO: 333900 - DNA, 25 bp, Mus musculus
cattgatgttcaaggaatgtcctat

SEQ ID NO: 333901 - DNA, 25 bp, Mus musculus
cattgatgttcacattttggaaata

SEQ ID NO: 333902 - DNA, 25 bp, Mus musculus
cattgatgttcagattttggaaata

SEQ ID NO: 333903 - DNA, 25 bp, Mus musculus
cattgatgttcatggaatgtcctat

SEQ ID NO: 333904 - DNA, 25 bp, Mus musculus
cattgattccccaatcctctaaaag

SEQ ID NO: 333905 - DNA, 25 bp, Mus musculus
cattgattcccctatcctctaaaag

SEQ ID NO: 333906 - DNA, 25 bp, Mus musculus
cattgattgaacacagtgcactgtt

SEQ ID NO: 333907 - DNA, 25 bp, Mus musculus
cattgattgaactcagtgcactgtt

SEQ ID NO: 333908 - DNA, 25 bp, Mus musculus
cattgattgaggagctaaaagcact

SEQ ID NO: 333909 - DNA, 25 bp, Mus musculus
cattgattgaggtgctaaaagcact

SEQ ID NO: 333910 - DNA, 25 bp, Mus musculus
cattgattggacacagactaataaa

SEQ ID NO: 333911 - DNA, 25 bp, Mus musculus
cattgattggactcagactaataaa

SEQ ID NO: 333912 - DNA, 25 bp, Mus musculus
cattgattggagcacttgtgcttag

SEQ ID NO: 333913 - DNA, 25 bp, Mus musculus
cattgattggaggacttgtgcttag

SEQ ID NO: 333914 - DNA, 25 bp, Mus musculus
cattgatttccaaccttctagttaa

SEQ ID NO: 333915 - DNA, 25 bp, Mus musculus
cattgatttccatccttctagttaa

SEQ ID NO: 333916 - DNA, 25 bp, Mus musculus
cattgcacacttaaaggattaaata

SEQ ID NO: 333917 - DNA, 25 bp, Mus musculus
cattgcacactttaaggattaaata

SEQ ID NO: 333918 - DNA, 25 bp, Mus musculus
cattgcacagagagcgtgagccgct

SEQ ID NO: 333919 - DNA, 25 bp, Mus musculus
cattgcacagagtgcgtgagccgct

SEQ ID NO: 333920 - DNA, 25 bp, Mus musculus
cattgcacagctcaaagtggtccac

SEQ ID NO: 333921 - DNA, 25 bp, Mus musculus
cattgcacagctgaaagtggtccac

SEQ ID NO: 333922 - DNA, 25 bp, Mus musculus
cattgcaccttcagatttggagcga

SEQ ID NO: 333923 - DNA, 25 bp, Mus musculus
cattgcaccttctgatttggagcga

SEQ ID NO: 333924 - DNA, 25 bp, Mus musculus
cattgcacggtacgttcacacgcga

SEQ ID NO: 333925 - DNA, 25 bp, Mus musculus
cattgcacggtaggttcacacgcga

SEQ ID NO: 333926 - DNA, 25 bp, Mus musculus
cattgcactgtgcatacgtatctgt

SEQ ID NO: 333927 - DNA, 25 bp, Mus musculus
cattgcactgtggatacgtatctgt

SEQ ID NO: 333928 - DNA, 25 bp, Mus musculus
cattgcagacatcagtccactcctg

SEQ ID NO: 333929 - DNA, 25 bp, Mus musculus
cattgcagacatgagtccactcctg

SEQ ID NO: 333930 - DNA, 25 bp, Mus musculus
cattgcagagtgagatcggagaacc

SEQ ID NO: 333931 - DNA, 25 bp, Mus musculus
cattgcagagtgtgatcggagaacc

SEQ ID NO: 333932 - DNA, 25 bp, Mus musculus
cattgcagcaaaccggaagatgccc

SEQ ID NO: 333933 - DNA, 25 bp, Mus musculus
cattgcagcaaagcggaagatgccc

SEQ ID NO: 333934 - DNA, 25 bp, Mus musculus
cattgcagctggaagggctgtgtat

SEQ ID NO: 333935 - DNA, 25 bp, Mus musculus
cattgcagctggtagggctgtgtat

SEQ ID NO: 333936 - DNA, 25 bp, Mus musculus
cattgcagggacaatggtgtgaatt

SEQ ID NO: 333937 - DNA, 25 bp, Mus musculus
cattgcagggactatggtgtgaatt

SEQ ID NO: 333938 - DNA, 25 bp, Mus musculus
cattgcagtggactggtttctggac

SEQ ID NO: 333939 - DNA, 25 bp, Mus musculus
cattgcagtggagtggtttctggac

SEQ ID NO: 333940 - DNA, 25 bp, Mus musculus
cattgcagtggtatccctttgggtt

SEQ ID NO: 333941 - DNA, 25 bp, Mus musculus
cattgcagtggtttccctttgggtt

SEQ ID NO: 333942 - DNA, 25 bp, Mus musculus
cattgcagttatctgttcttggagt

SEQ ID NO: 333943 - DNA, 25 bp, Mus musculus
cattgcagttatgtgttcttggagt

SEQ ID NO: 333944 - DNA, 25 bp, Mus musculus
cattgcatacctcattcctgatata

SEQ ID NO: 333945 - DNA, 25 bp, Mus musculus
cattgcatacctgattcctgatata

SEQ ID NO: 333946 - DNA, 25 bp, Mus musculus
cattgcatcgttagccatggtgaca

SEQ ID NO: 333947 - DNA, 25 bp, Mus musculus
cattgcatcgtttgccatggtgaca

SEQ ID NO: 333948 - DNA, 25 bp, Mus musculus
cattgcatgcggaccagggagcagc

SEQ ID NO: 333949 - DNA, 25 bp, Mus musculus
cattgcatgcggtccagggagcagc

SEQ ID NO: 333950 - DNA, 25 bp, Mus musculus
cattgcatgggcctggcttaccaga

SEQ ID NO: 333951 - DNA, 25 bp, Mus musculus
cattgcatgggcgtggcttaccaga

SEQ ID NO: 333952 - DNA, 25 bp, Mus musculus
cattgcatggttaggtgtcacctgc

SEQ ID NO: 333953 - DNA, 25 bp, Mus musculus
cattgcatggtttggtgtcacctgc

SEQ ID NO: 333954 - DNA, 25 bp, Mus musculus
cattgcatgtttctgacacgtaact

SEQ ID NO: 333955 - DNA, 25 bp, Mus musculus
cattgcatgtttgtgacacgtaact

SEQ ID NO: 333956 - DNA, 25 bp, Mus musculus
cattgcattaccacagaaacctgaa

SEQ ID NO: 333957 - DNA, 25 bp, Mus musculus
cattgcattacctcagaaacctgaa

SEQ ID NO: 333958 - DNA, 25 bp, Mus musculus
cattgccaagtgcattgaagatcta

SEQ ID NO: 333959 - DNA, 25 bp, Mus musculus
cattgccaagtggattgaagatcta

SEQ ID NO: 333960 - DNA, 25 bp, Mus musculus
cattgccaatttatagctctgaagt

SEQ ID NO: 333961 - DNA, 25 bp, Mus musculus
cattgccaatttttagctctgaagt

SEQ ID NO: 333962 - DNA, 25 bp, Mus musculus
cattgccaccatacataactcttga

SEQ ID NO: 333963 - DNA, 25 bp, Mus musculus
cattgccaccattcataactcttga

SEQ ID NO: 333964 - DNA, 25 bp, Mus musculus
cattgccaggccctctaagtgggag

SEQ ID NO: 333965 - DNA, 25 bp, Mus musculus
cattgccaggccgtctaagtgggag

SEQ ID NO: 333966 - DNA, 25 bp, Mus musculus
cattgccatcagaaaccacaagaaa

SEQ ID NO: 333967 - DNA, 25 bp, Mus musculus
cattgccatcagtaaccacaagaaa

SEQ ID NO: 333968 - DNA, 25 bp, Mus musculus
cattgccatttcagtgtcttccagg

SEQ ID NO: 333969 - DNA, 25 bp, Mus musculus
cattgccatttctgtgtcttccagg

SEQ ID NO: 333970 - DNA, 25 bp, Mus musculus
cattgccatttgatcttgggctttg

SEQ ID NO: 333971 - DNA, 25 bp, Mus musculus
cattgccatttgttcttgggctttg

SEQ ID NO: 333972 - DNA, 25 bp, Mus musculus
cattgccattttcgttggagccctc

SEQ ID NO: 333973 - DNA, 25 bp, Mus musculus
cattgccattttggttggagccctc

SEQ ID NO: 333974 - DNA, 25 bp, Mus musculus
cattgcccaggccacactagttggc

SEQ ID NO: 333975 - DNA, 25 bp, Mus musculus
cattgcccaggcgacactagttggc

SEQ ID NO: 333976 - DNA, 25 bp, Mus musculus
cattgccccagaatgccctgatgag

SEQ ID NO: 333977 - DNA, 25 bp, Mus musculus
cattgccccagattgccctgatgag

SEQ ID NO: 333978 - DNA, 25 bp, Mus musculus
cattgcccctgaaatactgtgctaa

SEQ ID NO: 333979 - DNA, 25 bp, Mus musculus
cattgcccctgatatactgtgctaa

SEQ ID NO: 333980 - DNA, 25 bp, Mus musculus
cattgccctccaacagttaatgctg

SEQ ID NO: 333981 - DNA, 25 bp, Mus musculus
cattgccctccatcagttaatgctg

SEQ ID NO: 333982 - DNA, 25 bp, Mus musculus
cattgccctcctcgaaagcaatcag

SEQ ID NO: 333983 - DNA, 25 bp, Mus musculus
cattgccctcctggaaagcaatcag

SEQ ID NO: 333984 - DNA, 25 bp, Mus musculus
cattgcccttgcaacagacagtagt

SEQ ID NO: 333985 - DNA, 25 bp, Mus musculus
cattgcccttgctacagacagtagt

SEQ ID NO: 333986 - DNA, 25 bp, Mus musculus
cattgccctttcagacttgagcttg

SEQ ID NO: 333987 - DNA, 25 bp, Mus musculus
cattgccctttctgacttgagcttg

SEQ ID NO: 333988 - DNA, 25 bp, Mus musculus
cattgcctagtgatcttcttggtgt

SEQ ID NO: 333989 - DNA, 25 bp, Mus musculus
cattgcctagtgttcttcttggtgt

SEQ ID NO: 333990 - DNA, 25 bp, Mus musculus
cattgcctatctaggtctctaaaag

SEQ ID NO: 333991 - DNA, 25 bp, Mus musculus
cattgcctatcttggtctctaaaag

SEQ ID NO: 333992 - DNA, 25 bp, Mus musculus
cattgcctcagaactatcaattgaa

SEQ ID NO: 333993 - DNA, 25 bp, Mus musculus
cattgcctcagatctatcaattgaa

SEQ ID NO: 333994 - DNA, 25 bp, Mus musculus
cattgcctgatgactttctgtaaat

SEQ ID NO: 333995 - DNA, 25 bp, Mus musculus
cattgcctgatgtctttctgtaaat

SEQ ID NO: 333996 - DNA, 25 bp, Mus musculus
cattgccttatccattccttatgaa

SEQ ID NO: 333997 - DNA, 25 bp, Mus musculus
cattgccttatcgattccttatgaa

SEQ ID NO: 333998 - DNA, 25 bp, Mus musculus
cattgccttccaagccactttaggt

SEQ ID NO: 333999 - DNA, 25 bp, Mus musculus
cattgccttccatgccactttaggt

SEQ ID NO: 334000 - DNA, 25 bp, Mus musculus
cattgccttctaaaatccagtttaa

SEQ ID NO: 334001 - DNA, 25 bp, Mus musculus
cattgccttctataatccagtttaa

SEQ ID NO: 334002 - DNA, 25 bp, Mus musculus
cattgcctttccaggtaatttcctt

SEQ ID NO: 334003 - DNA, 25 bp, Mus musculus
cattgcctttcctggtaatttcctt

SEQ ID NO: 334004 - DNA, 25 bp, Mus musculus
cattgcctttgaagttgtaactcat

SEQ ID NO: 334005 - DNA, 25 bp, Mus musculus
cattgcctttgatgttgtaactcat

SEQ ID NO: 334006 - DNA, 25 bp, Mus musculus
cattgcctttgccattgactgaagg

SEQ ID NO: 334007 - DNA, 25 bp, Mus musculus
cattgcctttgcgattgactgaagg

SEQ ID NO: 334008 - DNA, 25 bp, Mus musculus
cattgcgagaggctgagcttgcccc

SEQ ID NO: 334009 - DNA, 25 bp, Mus musculus
cattgcgagagggtgagcttgcccc

SEQ ID NO: 334010 - DNA, 25 bp, Mus musculus
cattgcgctgagagtaaagtggttt

SEQ ID NO: 334011 - DNA, 25 bp, Mus musculus
cattgcgctgagtgtaaagtggttt

SEQ ID NO: 334012 - DNA, 25 bp, Mus musculus
cattgcggatgcagtcattgccgtg

SEQ ID NO: 334013 - DNA, 25 bp, Mus musculus
cattgcggatgctgtcattgccgtg

SEQ ID NO: 334014 - DNA, 25 bp, Mus musculus
cattgcggtccgcaggtgaactact

SEQ ID NO: 334015 - DNA, 25 bp, Mus musculus
cattgcggtccggaggtgaactact

SEQ ID NO: 334016 - DNA, 25 bp, Mus musculus
cattgcgtccctcccagttggtctg

SEQ ID NO: 334017 - DNA, 25 bp, Mus musculus
cattgcgtccctgccagttggtctg

SEQ ID NO: 334018 - DNA, 25 bp, Mus musculus
cattgctaaacaaaacacggtctgt

SEQ ID NO: 334019 - DNA, 25 bp, Mus musculus
cattgctaaacataacacggtctgt

SEQ ID NO: 334020 - DNA, 25 bp, Mus musculus
cattgctaattaaaagtccttccct

SEQ ID NO: 334021 - DNA, 25 bp, Mus musculus
cattgctaattataagtccttccct

SEQ ID NO: 334022 - DNA, 25 bp, Mus musculus
cattgctactacagacctttccatc

SEQ ID NO: 334023 - DNA, 25 bp, Mus musculus
cattgctactactgacctttccatc

SEQ ID NO: 334024 - DNA, 25 bp, Mus musculus
cattgctagcgtaccatttcttgaa

SEQ ID NO: 334025 - DNA, 25 bp, Mus musculus
cattgctagcgttccatttcttgaa

SEQ ID NO: 334026 - DNA, 25 bp, Mus musculus
cattgctagtttaggtccagcctga

SEQ ID NO: 334027 - DNA, 25 bp, Mus musculus
cattgctagttttggtccagcctga

SEQ ID NO: 334028 - DNA, 25 bp, Mus musculus
cattgctatagcacaaggtggaaca

SEQ ID NO: 334029 - DNA, 25 bp, Mus musculus
cattgctatagctcaaggtggaaca

SEQ ID NO: 334030 - DNA, 25 bp, Mus musculus
cattgctatcccattatcatagggt

SEQ ID NO: 334031 - DNA, 25 bp, Mus musculus
cattgctatccctttatcatagggt

SEQ ID NO: 334032 - DNA, 25 bp, Mus musculus
cattgctattgccaaaactgtaaaa

SEQ ID NO: 334033 - DNA, 25 bp, Mus musculus
cattgctattgcgaaaactgtaaaa

SEQ ID NO: 334034 - DNA, 25 bp, Mus musculus
cattgctcacaaaccagggtttttt

SEQ ID NO: 334035 - DNA, 25 bp, Mus musculus
cattgctcacaatccagggtttttt

SEQ ID NO: 334036 - DNA, 25 bp, Mus musculus
cattgctcacatattacctttcttt

SEQ ID NO: 334037 - DNA, 25 bp, Mus musculus
cattgctcacattttacctttcttt

SEQ ID NO: 334038 - DNA, 25 bp, Mus musculus
cattgctcagctcaaggtggtccag

SEQ ID NO: 334039 - DNA, 25 bp, Mus musculus
cattgctcagctgaaggtggtccag

SEQ ID NO: 334040 - DNA, 25 bp, Mus musculus
cattgctcaggaatatggagtctta

SEQ ID NO: 334041 - DNA, 25 bp, Mus musculus
cattgctcaggattatggagtctta

SEQ ID NO: 334042 - DNA, 25 bp, Mus musculus
cattgctcatatccagttcttcaaa

SEQ ID NO: 334043 - DNA, 25 bp, Mus musculus
cattgctcatatgcagttcttcaaa

SEQ ID NO: 334044 - DNA, 25 bp, Mus musculus
cattgctccacaaggtggcagctga

SEQ ID NO: 334045 - DNA, 25 bp, Mus musculus
cattgctccacatggtggcagctga

SEQ ID NO: 334046 - DNA, 25 bp, Mus musculus
cattgctcggaaagtcagacacaaa

SEQ ID NO: 334047 - DNA, 25 bp, Mus musculus
cattgctcggaatgtcagacacaaa

SEQ ID NO: 334048 - DNA, 25 bp, Mus musculus
cattgctcgtagaaaatgtgcgcag

SEQ ID NO: 334049 - DNA, 25 bp, Mus musculus
cattgctcgtagtaaatgtgcgcag

SEQ ID NO: 334050 - DNA, 25 bp, Mus musculus
cattgctctgcaagcttatgggaac

SEQ ID NO: 334051 - DNA, 25 bp, Mus musculus
cattgctctgcatgcttatgggaac

SEQ ID NO: 334052 - DNA, 25 bp, Mus musculus
cattgctcttcgacaagggtgcggt

SEQ ID NO: 334053 - DNA, 25 bp, Mus musculus
cattgctcttcgtcaagggtgcggt

SEQ ID NO: 334054 - DNA, 25 bp, Mus musculus
cattgctgaccaaggcattggaatt

SEQ ID NO: 334055 - DNA, 25 bp, Mus musculus
cattgctgaccatggcattggaatt

SEQ ID NO: 334056 - DNA, 25 bp, Mus musculus
cattgctgacccagcagtttttata

SEQ ID NO: 334057 - DNA, 25 bp, Mus musculus
cattgctgaccctgcagtttttata

SEQ ID NO: 334058 - DNA, 25 bp, Mus musculus
cattgctgatcgcaaggctcgtgaa

SEQ ID NO: 334059 - DNA, 25 bp, Mus musculus
cattgctgatcggaaggctcgtgaa

SEQ ID NO: 334060 - DNA, 25 bp, Mus musculus
cattgctgccacagaactcgaagga

SEQ ID NO: 334061 - DNA, 25 bp, Mus musculus
cattgctgccactgaactcgaagga

SEQ ID NO: 334062 - DNA, 25 bp, Mus musculus
cattgctggcagctgtgagcttcca

SEQ ID NO: 334063 - DNA, 25 bp, Mus musculus
cattgctggcaggtgtgagcttcca

SEQ ID NO: 334064 - DNA, 25 bp, Mus musculus
cattgctgggaacccgaagccgctg

SEQ ID NO: 334065 - DNA, 25 bp, Mus musculus
cattgctgggaagccgaagccgctg

SEQ ID NO: 334066 - DNA, 25 bp, Mus musculus
cattgctgggttcctggtaagaact

SEQ ID NO: 334067 - DNA, 25 bp, Mus musculus
cattgctgggttgctggtaagaact

SEQ ID NO: 334068 - DNA, 25 bp, Mus musculus
cattgctgtaatactaagtgttctt

SEQ ID NO: 334069 - DNA, 25 bp, Mus musculus
cattgctgtaattctaagtgttctt

SEQ ID NO: 334070 - DNA, 25 bp, Mus musculus
cattgctgtgaaattagtggcctta

SEQ ID NO: 334071 - DNA, 25 bp, Mus musculus
cattgctgtgaatttagtggcctta

SEQ ID NO: 334072 - DNA, 25 bp, Mus musculus
cattgctgtgatccatttgtgtagc

SEQ ID NO: 334073 - DNA, 25 bp, Mus musculus
cattgctgtgatgcatttgtgtagc

SEQ ID NO: 334074 - DNA, 25 bp, Mus musculus
cattgctgtggaagcaggcgctttt

SEQ ID NO: 334075 - DNA, 25 bp, Mus musculus
cattgctgtggatgcaggcgctttt

SEQ ID NO: 334076 - DNA, 25 bp, Mus musculus
cattgctgtgttagtttggcacttc

SEQ ID NO: 334077 - DNA, 25 bp, Mus musculus
cattgctgtgtttgtttggcacttc

SEQ ID NO: 334078 - DNA, 25 bp, Mus musculus
cattgcttaatgagttctgggctag

SEQ ID NO: 334079 - DNA, 25 bp, Mus musculus
cattgcttaatgtgttctgggctag

SEQ ID NO: 334080 - DNA, 25 bp, Mus musculus
cattgcttatcactatttcctttcc

SEQ ID NO: 334081 - DNA, 25 bp, Mus musculus
cattgcttatcagtatttcctttcc

SEQ ID NO: 334082 - DNA, 25 bp, Mus musculus
cattgcttatctcggatcgctgaca

SEQ ID NO: 334083 - DNA, 25 bp, Mus musculus
cattgcttatctgggatcgctgaca

SEQ ID NO: 334084 - DNA, 25 bp, Mus musculus
cattgcttattgcaaacttgtaggt

SEQ ID NO: 334085 - DNA, 25 bp, Mus musculus
cattgcttattggaaacttgtaggt

SEQ ID NO: 334086 - DNA, 25 bp, Mus musculus
cattgcttcagtcctactgtttgga

SEQ ID NO: 334087 - DNA, 25 bp, Mus musculus
cattgcttcagtgctactgtttgga

SEQ ID NO: 334088 - DNA, 25 bp, Mus musculus
cattgcttcgcaagggcatggtcat

SEQ ID NO: 334089 - DNA, 25 bp, Mus musculus
cattgcttcgcatgggcatggtcat

SEQ ID NO: 334090 - DNA, 25 bp, Mus musculus
cattgcttctggactgtgtagtata

SEQ ID NO: 334091 - DNA, 25 bp, Mus musculus
cattgcttctggtctgtgtagtata

SEQ ID NO: 334092 - DNA, 25 bp, Mus musculus
cattgcttcttgatccgtcaaaggg

SEQ ID NO: 334093 - DNA, 25 bp, Mus musculus
cattgcttcttgttccgtcaaaggg

SEQ ID NO: 334094 - DNA, 25 bp, Mus musculus
cattgcttctttccaaaaggagatc

SEQ ID NO: 334095 - DNA, 25 bp, Mus musculus
cattgcttctttgcaaaaggagatc

SEQ ID NO: 334096 - DNA, 25 bp, Mus musculus
cattgcttgacaatccttgttgtca

SEQ ID NO: 334097 - DNA, 25 bp, Mus musculus
cattgcttgacattccttgttgtca

SEQ ID NO: 334098 - DNA, 25 bp, Mus musculus
cattgcttgtgtatgacttggaaga

SEQ ID NO: 334099 - DNA, 25 bp, Mus musculus
cattgcttgtgtcgcgccttgagtt

SEQ ID NO: 334100 - DNA, 25 bp, Mus musculus
cattgcttgtgtggcgccttgagtt

SEQ ID NO: 334101 - DNA, 25 bp, Mus musculus
cattgcttgtgtttgacttggaaga

SEQ ID NO: 334102 - DNA, 25 bp, Mus musculus
cattgcttgtttattctgtgtccac

SEQ ID NO: 334103 - DNA, 25 bp, Mus musculus
cattgcttgttttttctgtgtccac

SEQ ID NO: 334104 - DNA, 25 bp, Mus musculus
cattgctttgttccttgtgttgatc

SEQ ID NO: 334105 - DNA, 25 bp, Mus musculus
cattgctttgttgcttgtgttgatc

SEQ ID NO: 334106 - DNA, 25 bp, Mus musculus
cattggaaatgtaatgcatgttgtt

SEQ ID NO: 334107 - DNA, 25 bp, Mus musculus
cattggaaatgttatgcatgttgtt

SEQ ID NO: 334108 - DNA, 25 bp, Mus musculus
cattggaactttcaggttttggagg

SEQ ID NO: 334109 - DNA, 25 bp, Mus musculus
cattggaactttgaggttttggagg

SEQ ID NO: 334110 - DNA, 25 bp, Mus musculus
cattggaatattctctgccattgga

SEQ ID NO: 334111 - DNA, 25 bp, Mus musculus
cattggaatattgtctgccattgga

SEQ ID NO: 334112 - DNA, 25 bp, Mus musculus
cattggaatcggaataaataaactt

SEQ ID NO: 334113 - DNA, 25 bp, Mus musculus
cattggaatcggtataaataaactt

SEQ ID NO: 334114 - DNA, 25 bp, Mus musculus
cattggaatctactcacatcagctt

SEQ ID NO: 334115 - DNA, 25 bp, Mus musculus
cattggaatctagtcacatcagctt

SEQ ID NO: 334116 - DNA, 25 bp, Mus musculus
cattggaatggaagatgtgcagcct

SEQ ID NO: 334117 - DNA, 25 bp, Mus musculus
cattggaatggatgatgtgcagcct

SEQ ID NO: 334118 - DNA, 25 bp, Mus musculus
cattggactcataaaccagtggtaa

SEQ ID NO: 334119 - DNA, 25 bp, Mus musculus
cattggactcattaaccagtggtaa

SEQ ID NO: 334120 - DNA, 25 bp, Mus musculus
cattggagaaataagcaacgcttat

SEQ ID NO: 334121 - DNA, 25 bp, Mus musculus
cattggagaaattagcaacgcttat

SEQ ID NO: 334122 - DNA, 25 bp, Mus musculus
cattggagacacactgacaaggcag

SEQ ID NO: 334123 - DNA, 25 bp, Mus musculus
cattggagacactctgacaaggcag

SEQ ID NO: 334124 - DNA, 25 bp, Mus musculus
cattggagcagtcggtatcggcatc

SEQ ID NO: 334125 - DNA, 25 bp, Mus musculus
cattggagcagtgggtatcggcatc

SEQ ID NO: 334126 - DNA, 25 bp, Mus musculus
cattggagccctaaagttcaaacaa

SEQ ID NO: 334127 - DNA, 25 bp, Mus musculus
cattggagcccttaagttcaaacaa

SEQ ID NO: 334128 - DNA, 25 bp, Mus musculus
cattggaggaatcccgtcaccaatt

SEQ ID NO: 334129 - DNA, 25 bp, Mus musculus
cattggaggaatgccgtcaccaatt

SEQ ID NO: 334130 - DNA, 25 bp, Mus musculus
cattggagtgacagaacaacaaggc

SEQ ID NO: 334131 - DNA, 25 bp, Mus musculus
cattggagtgactgaacaacaaggc

SEQ ID NO: 334132 - DNA, 25 bp, Mus musculus
cattggatacagaaactgccacaaa

SEQ ID NO: 334133 - DNA, 25 bp, Mus musculus
cattggatacagtaactgccacaaa

SEQ ID NO: 334134 - DNA, 25 bp, Mus musculus
cattggatcccaacactttctaagg

SEQ ID NO: 334135 - DNA, 25 bp, Mus musculus
cattggatcccatcactttctaagg

SEQ ID NO: 334136 - DNA, 25 bp, Mus musculus
cattggatggacctgtttggtactt

SEQ ID NO: 334137 - DNA, 25 bp, Mus musculus
cattggatggacgtgtttggtactt

SEQ ID NO: 334138 - DNA, 25 bp, Mus musculus
cattggatggctccctccatgcact

SEQ ID NO: 334139 - DNA, 25 bp, Mus musculus
cattggatggctgcctccatgcact

SEQ ID NO: 334140 - DNA, 25 bp, Mus musculus
cattggattctcaccactgcagctg

SEQ ID NO: 334141 - DNA, 25 bp, Mus musculus
cattggattctctccactgcagctg

SEQ ID NO: 334142 - DNA, 25 bp, Mus musculus
cattggcacaacataccttcaggtg

SEQ ID NO: 334143 - DNA, 25 bp, Mus musculus
cattggcacaacttaccttcaggtg

SEQ ID NO: 334144 - DNA, 25 bp, Mus musculus
cattggcagagtatgttgtgcagca

SEQ ID NO: 334145 - DNA, 25 bp, Mus musculus
cattggcagagtttgttgtgcagca

SEQ ID NO: 334146 - DNA, 25 bp, Mus musculus
cattggcatgtcaatccagatgaac

SEQ ID NO: 334147 - DNA, 25 bp, Mus musculus
cattggcatgtctatccagatgaac

SEQ ID NO: 334148 - DNA, 25 bp, Mus musculus
cattggcatgtgagacgccggcaca

SEQ ID NO: 334149 - DNA, 25 bp, Mus musculus
cattggcatgtgtgacgccggcaca

SEQ ID NO: 334150 - DNA, 25 bp, Mus musculus
cattggcattcacgcaggaaattca

SEQ ID NO: 334151 - DNA, 25 bp, Mus musculus
cattggcattcaggcaggaaattca

SEQ ID NO: 334152 - DNA, 25 bp, Mus musculus
cattggcccattacaactacatcaa

SEQ ID NO: 334153 - DNA, 25 bp, Mus musculus
cattggcccatttcaactacatcaa

SEQ ID NO: 334154 - DNA, 25 bp, Mus musculus
cattggccggttcagttcagagagc

SEQ ID NO: 334155 - DNA, 25 bp, Mus musculus
cattggccggttgagttcagagagc

SEQ ID NO: 334156 - DNA, 25 bp, Mus musculus
cattggcctcctatatggctttata

SEQ ID NO: 334157 - DNA, 25 bp, Mus musculus
cattggcctcctttatggctttata

SEQ ID NO: 334158 - DNA, 25 bp, Mus musculus
cattggcgccataggtctagagctg

SEQ ID NO: 334159 - DNA, 25 bp, Mus musculus
cattggcgccattggtctagagctg

SEQ ID NO: 334160 - DNA, 25 bp, Mus musculus
cattggcgcctaagaccacaagtac

SEQ ID NO: 334161 - DNA, 25 bp, Mus musculus
cattggcgcctatgaccacaagtac

SEQ ID NO: 334162 - DNA, 25 bp, Mus musculus
cattggcgtggcatggtgctattga

SEQ ID NO: 334163 - DNA, 25 bp, Mus musculus
cattggcgtggcttggtgctattga

SEQ ID NO: 334164 - DNA, 25 bp, Mus musculus
cattggcgtgtactgtcttagtgtc

SEQ ID NO: 334165 - DNA, 25 bp, Mus musculus
cattggcgtgtagtgtcttagtgtc

SEQ ID NO: 334166 - DNA, 25 bp, Mus musculus
cattggctaagacggctggctgttc

SEQ ID NO: 334167 - DNA, 25 bp, Mus musculus
cattggctaagagggctggctgttc

SEQ ID NO: 334168 - DNA, 25 bp, Mus musculus
cattggctaccacatgctcatgaag

SEQ ID NO: 334169 - DNA, 25 bp, Mus musculus
cattggctaccagatgctcatgaag

SEQ ID NO: 334170 - DNA, 25 bp, Mus musculus
cattggctatggatatttgcaccga

SEQ ID NO: 334171 - DNA, 25 bp, Mus musculus
cattggctatggttatttgcaccga

SEQ ID NO: 334172 - DNA, 25 bp, Mus musculus
cattggctctcacccttggcaacgg

SEQ ID NO: 334173 - DNA, 25 bp, Mus musculus
cattggctctcagccttggcaacgg

SEQ ID NO: 334174 - DNA, 25 bp, Mus musculus
cattggctcttgatgaatgacacaa

SEQ ID NO: 334175 - DNA, 25 bp, Mus musculus
cattggctcttgttgaatgacacaa

SEQ ID NO: 334176 - DNA, 25 bp, Mus musculus
cattggcttcatattatactgtttt

SEQ ID NO: 334177 - DNA, 25 bp, Mus musculus
cattggcttcattttatactgtttt

SEQ ID NO: 334178 - DNA, 25 bp, Mus musculus
cattggcttcctcatgagttctgaa

SEQ ID NO: 334179 - DNA, 25 bp, Mus musculus
cattggcttcctgatgagttctgaa

SEQ ID NO: 334180 - DNA, 25 bp, Mus musculus
cattgggaaatccatgaatttgtat

SEQ ID NO: 334181 - DNA, 25 bp, Mus musculus
cattgggaaatcgatgaatttgtat

SEQ ID NO: 334182 - DNA, 25 bp, Mus musculus
cattgggcaatcaggttggcaaact

SEQ ID NO: 334183 - DNA, 25 bp, Mus musculus
cattgggcaatctggttggcaaact

SEQ ID NO: 334184 - DNA, 25 bp, Mus musculus
cattgggcctagagctgctcgtgga

SEQ ID NO: 334185 - DNA, 25 bp, Mus musculus
cattgggcctagtgctgctcgtgga

SEQ ID NO: 334186 - DNA, 25 bp, Mus musculus
cattgggcctggagctatgatgaat

SEQ ID NO: 334187 - DNA, 25 bp, Mus musculus
cattgggcctggtgctatgatgaat

SEQ ID NO: 334188 - DNA, 25 bp, Mus musculus
cattgggctactatcttagtcctaa

SEQ ID NO: 334189 - DNA, 25 bp, Mus musculus
cattgggctactttcttagtcctaa

SEQ ID NO: 334190 - DNA, 25 bp, Mus musculus
cattgggctattccccaactggaga

SEQ ID NO: 334191 - DNA, 25 bp, Mus musculus
cattgggctattgcccaactggaga

SEQ ID NO: 334192 - DNA, 25 bp, Mus musculus
cattgggctgtcatctttgagctgc

SEQ ID NO: 334193 - DNA, 25 bp, Mus musculus
cattgggctgtcttctttgagctgc

SEQ ID NO: 334194 - DNA, 25 bp, Mus musculus
cattgggcttgacggcacgtgcctt

SEQ ID NO: 334195 - DNA, 25 bp, Mus musculus
cattgggcttgagggcacgtgcctt

SEQ ID NO: 334196 - DNA, 25 bp, Mus musculus
cattgggcttggattggtattgaca

SEQ ID NO: 334197 - DNA, 25 bp, Mus musculus
cattgggcttggtttggtattgaca

SEQ ID NO: 334198 - DNA, 25 bp, Mus musculus
cattgggtaactactccccttagag

SEQ ID NO: 334199 - DNA, 25 bp, Mus musculus
cattgggtaacttctccccttagag

SEQ ID NO: 334200 - DNA, 25 bp, Mus musculus
cattgggtaccacataagctaggat

SEQ ID NO: 334201 - DNA, 25 bp, Mus musculus
cattgggtaccagataagctaggat

SEQ ID NO: 334202 - DNA, 25 bp, Mus musculus
cattgggtacctacactgttttgag

SEQ ID NO: 334203 - DNA, 25 bp, Mus musculus
cattgggtaccttcactgttttgag

SEQ ID NO: 334204 - DNA, 25 bp, Mus musculus
cattgggtccgacatgtggcaccat

SEQ ID NO: 334205 - DNA, 25 bp, Mus musculus
cattgggtccgagatgtggcaccat

SEQ ID NO: 334206 - DNA, 25 bp, Mus musculus
cattgggtgcaaaaacttagtagta

SEQ ID NO: 334207 - DNA, 25 bp, Mus musculus
cattgggtgcaataacttagtagta

SEQ ID NO: 334208 - DNA, 25 bp, Mus musculus
cattgggtgcatcgagtcatttcta

SEQ ID NO: 334209 - DNA, 25 bp, Mus musculus
cattgggtgcatggagtcatttcta

SEQ ID NO: 334210 - DNA, 25 bp, Mus musculus
cattgggtgtaaattccttcctttg

SEQ ID NO: 334211 - DNA, 25 bp, Mus musculus
cattgggtgtaatttccttcctttg

SEQ ID NO: 334212 - DNA, 25 bp, Mus musculus
cattgggtttcgagtgactgttaaa

SEQ ID NO: 334213 - DNA, 25 bp, Mus musculus
cattgggtttcgtgtgactgttaaa

SEQ ID NO: 334214 - DNA, 25 bp, Mus musculus
cattgggttttcagggtacaactca

SEQ ID NO: 334215 - DNA, 25 bp, Mus musculus
cattgggttttctgggtacaactca

SEQ ID NO: 334216 - DNA, 25 bp, Mus musculus
cattggtaacaacatggcggcccta

SEQ ID NO: 334217 - DNA, 25 bp, Mus musculus
cattggtaacaagatggcggcccta

SEQ ID NO: 334218 - DNA, 25 bp, Mus musculus
cattggtacacactagcatatattc

SEQ ID NO: 334219 - DNA, 25 bp, Mus musculus
cattggtacacagtagcatatattc

SEQ ID NO: 334220 - DNA, 25 bp, Mus musculus
cattggtactatcggcctgacctga

SEQ ID NO: 334221 - DNA, 25 bp, Mus musculus
cattggtactatgggcctgacctga

SEQ ID NO: 334222 - DNA, 25 bp, Mus musculus
cattggtacttcaccctggaagaac

SEQ ID NO: 334223 - DNA, 25 bp, Mus musculus
cattggtacttctccctggaagaac

SEQ ID NO: 334224 - DNA, 25 bp, Mus musculus
cattggtagacaagagtgcttactc

SEQ ID NO: 334225 - DNA, 25 bp, Mus musculus
cattggtagacatgagtgcttactc

SEQ ID NO: 334226 - DNA, 25 bp, Mus musculus
cattggtagagaacttgctttggaa

SEQ ID NO: 334227 - DNA, 25 bp, Mus musculus
cattggtagagatcttgctttggaa

SEQ ID NO: 334228 - DNA, 25 bp, Mus musculus
cattggtatgggagagctggctttc

SEQ ID NO: 334229 - DNA, 25 bp, Mus musculus
cattggtatgggtgagctggctttc

SEQ ID NO: 334230 - DNA, 25 bp, Mus musculus
cattggtcaattagaggctcctgga

SEQ ID NO: 334231 - DNA, 25 bp, Mus musculus
cattggtcaatttgaggctcctgga

SEQ ID NO: 334232 - DNA, 25 bp, Mus musculus
cattggtcacatattcaggttcaga

SEQ ID NO: 334233 - DNA, 25 bp, Mus musculus
cattggtcacattttcaggttcaga

SEQ ID NO: 334234 - DNA, 25 bp, Mus musculus
cattggtcaccaagctttgagcagc

SEQ ID NO: 334235 - DNA, 25 bp, Mus musculus
cattggtcaccatgctttgagcagc

SEQ ID NO: 334236 - DNA, 25 bp, Mus musculus
cattggtcctaaacagtctgcacag

SEQ ID NO: 334237 - DNA, 25 bp, Mus musculus
cattggtcctaatcagtctgcacag

SEQ ID NO: 334238 - DNA, 25 bp, Mus musculus
cattggtcggccaacagcaaagcaa

SEQ ID NO: 334239 - DNA, 25 bp, Mus musculus
cattggtcggcctacagcaaagcaa

SEQ ID NO: 334240 - DNA, 25 bp, Mus musculus
cattggtctcagagaattgccctag

SEQ ID NO: 334241 - DNA, 25 bp, Mus musculus
cattggtctcagtgaattgccctag

SEQ ID NO: 334242 - DNA, 25 bp, Mus musculus
cattggtctgtaccctgccaattac

SEQ ID NO: 334243 - DNA, 25 bp, Mus musculus
cattggtctgtagcctgccaattac

SEQ ID NO: 334244 - DNA, 25 bp, Mus musculus
cattggtcttacctttcagtaagat

SEQ ID NO: 334245 - DNA, 25 bp, Mus musculus
cattggtcttacgtttcagtaagat

SEQ ID NO: 334246 - DNA, 25 bp, Mus musculus
cattggtctttcaactttgcattct

SEQ ID NO: 334247 - DNA, 25 bp, Mus musculus
cattggtctttctactttgcattct

SEQ ID NO: 334248 - DNA, 25 bp, Mus musculus
cattggtgatcacccagtcagcatt

SEQ ID NO: 334249 - DNA, 25 bp, Mus musculus
cattggtgatcagccagtcagcatt

SEQ ID NO: 334250 - DNA, 25 bp, Mus musculus
cattggtgcatcagtatccagcgat

SEQ ID NO: 334251 - DNA, 25 bp, Mus musculus
cattggtgcatctgtatccagcgat

SEQ ID NO: 334252 - DNA, 25 bp, Mus musculus
cattggtgccaacggcctgaatgag

SEQ ID NO: 334253 - DNA, 25 bp, Mus musculus
cattggtgccaagggcctgaatgag

SEQ ID NO: 334254 - DNA, 25 bp, Mus musculus
cattggtggctccaatggttgtcca

SEQ ID NO: 334255 - DNA, 25 bp, Mus musculus
cattggtggctcgaatggttgtcca

SEQ ID NO: 334256 - DNA, 25 bp, Mus musculus
cattggtggcttcctgtttaattac

SEQ ID NO: 334257 - DNA, 25 bp, Mus musculus
cattggtggcttgctgtttaattac

SEQ ID NO: 334258 - DNA, 25 bp, Mus musculus
cattggtgggagcttgtacatactt

SEQ ID NO: 334259 - DNA, 25 bp, Mus musculus
cattggtgggaggttgtacatactt

SEQ ID NO: 334260 - DNA, 25 bp, Mus musculus
cattggtgggttattctagtactgt

SEQ ID NO: 334261 - DNA, 25 bp, Mus musculus
cattggtgggtttttctagtactgt

SEQ ID NO: 334262 - DNA, 25 bp, Mus musculus
cattggtgtatgcttttaacggtca

SEQ ID NO: 334263 - DNA, 25 bp, Mus musculus
cattggtgtatggttttaacggtca

SEQ ID NO: 334264 - DNA, 25 bp, Mus musculus
cattggtgttcaagtagctggaacc

SEQ ID NO: 334265 - DNA, 25 bp, Mus musculus
cattggtgttcatgtagctggaacc

SEQ ID NO: 334266 - DNA, 25 bp, Mus musculus
cattggttacctctgtttttaatat

SEQ ID NO: 334267 - DNA, 25 bp, Mus musculus
cattggttacctgtgtttttaatat

SEQ ID NO: 334268 - DNA, 25 bp, Mus musculus
cattggttagcaccctcatttggag

SEQ ID NO: 334269 - DNA, 25 bp, Mus musculus
cattggttagcagcctcatttggag

SEQ ID NO: 334270 - DNA, 25 bp, Mus musculus
cattggttatctccctgcacttata

SEQ ID NO: 334271 - DNA, 25 bp, Mus musculus
cattggttatctgcctgcacttata

SEQ ID NO: 334272 - DNA, 25 bp, Mus musculus
cattggttattcatctgtaaagtgg

SEQ ID NO: 334273 - DNA, 25 bp, Mus musculus
cattggttattcttctgtaaagtgg

SEQ ID NO: 334274 - DNA, 25 bp, Mus musculus
cattggttatttacaacaactatgg

SEQ ID NO: 334275 - DNA, 25 bp, Mus musculus
cattggttattttcaacaactatgg

SEQ ID NO: 334276 - DNA, 25 bp, Mus musculus
cattggttctcgatcattatgtgga

SEQ ID NO: 334277 - DNA, 25 bp, Mus musculus
cattggttctcgttcattatgtgga

SEQ ID NO: 334278 - DNA, 25 bp, Mus musculus
cattggttcttcctgacttggttta

SEQ ID NO: 334279 - DNA, 25 bp, Mus musculus
cattggttcttcgtgacttggttta

SEQ ID NO: 334280 - DNA, 25 bp, Mus musculus
cattggttgaatctgaccctcgctt

SEQ ID NO: 334281 - DNA, 25 bp, Mus musculus
cattggttgaatctgtgcctcatgt

SEQ ID NO: 334282 - DNA, 25 bp, Mus musculus
cattggttgaatgtgaccctcgctt

SEQ ID NO: 334283 - DNA, 25 bp, Mus musculus
cattggttgaatgtgtgcctcatgt

SEQ ID NO: 334284 - DNA, 25 bp, Mus musculus
cattggttgataatgcatggatata

SEQ ID NO: 334285 - DNA, 25 bp, Mus musculus
cattggttgatattgcatggatata

SEQ ID NO: 334286 - DNA, 25 bp, Mus musculus
cattggttgctcaaattcaggttga

SEQ ID NO: 334287 - DNA, 25 bp, Mus musculus
cattggttgctctaattcaggttga

SEQ ID NO: 334288 - DNA, 25 bp, Mus musculus
cattggtttggaatgagtgtgtgca

SEQ ID NO: 334289 - DNA, 25 bp, Mus musculus
cattggtttggattgagtgtgtgca

SEQ ID NO: 334290 - DNA, 25 bp, Mus musculus
cattggttttgtatctccggagatc

SEQ ID NO: 334291 - DNA, 25 bp, Mus musculus
cattggttttgtttctccggagatc

SEQ ID NO: 334292 - DNA, 25 bp, Mus musculus
cattgtaaacccacctattcgctag

SEQ ID NO: 334293 - DNA, 25 bp, Mus musculus
cattgtaaaccctcctattcgctag

SEQ ID NO: 334294 - DNA, 25 bp, Mus musculus
cattgtaacatccatgctggcctta

SEQ ID NO: 334295 - DNA, 25 bp, Mus musculus
cattgtaacatcgatgctggcctta

SEQ ID NO: 334296 - DNA, 25 bp, Mus musculus
cattgtaacctcatgtctagtagaa

SEQ ID NO: 334297 - DNA, 25 bp, Mus musculus
cattgtaacctcttgtctagtagaa

SEQ ID NO: 334298 - DNA, 25 bp, Mus musculus
cattgtaactggcttttaagaaaag

SEQ ID NO: 334299 - DNA, 25 bp, Mus musculus
cattgtaactgggttttaagaaaag

SEQ ID NO: 334300 - DNA, 25 bp, Mus musculus
cattgtaagtaaacctcctgtcctg

SEQ ID NO: 334301 - DNA, 25 bp, Mus musculus
cattgtaagtaatcctcctgtcctg

SEQ ID NO: 334302 - DNA, 25 bp, Mus musculus
cattgtaatatcagccgctggcatt

SEQ ID NO: 334303 - DNA, 25 bp, Mus musculus
cattgtaatatctgccgctggcatt

SEQ ID NO: 334304 - DNA, 25 bp, Mus musculus
cattgtactgttctgccttgaaagg

SEQ ID NO: 334305 - DNA, 25 bp, Mus musculus
cattgtactgttgtgccttgaaagg

SEQ ID NO: 334306 - DNA, 25 bp, Mus musculus
cattgtacttacataggactttcaa

SEQ ID NO: 334307 - DNA, 25 bp, Mus musculus
cattgtacttacttaggactttcaa

SEQ ID NO: 334308 - DNA, 25 bp, Mus musculus
cattgtagaaggaaccactttattt

SEQ ID NO: 334309 - DNA, 25 bp, Mus musculus
cattgtagaaggtaccactttattt

SEQ ID NO: 334310 - DNA, 25 bp, Mus musculus
cattgtagatctaagcctgctgtat

SEQ ID NO: 334311 - DNA, 25 bp, Mus musculus
cattgtagatcttagcctgctgtat

SEQ ID NO: 334312 - DNA, 25 bp, Mus musculus
cattgtagctgtccgagtcctctgc

SEQ ID NO: 334313 - DNA, 25 bp, Mus musculus
cattgtagctgtgcgagtcctctgc

SEQ ID NO: 334314 - DNA, 25 bp, Mus musculus
cattgtagcttcatgatgcctgtca

SEQ ID NO: 334315 - DNA, 25 bp, Mus musculus
cattgtagcttcttgatgcctgtca

SEQ ID NO: 334316 - DNA, 25 bp, Mus musculus
cattgtaggcctcatgagtcgtcat

SEQ ID NO: 334317 - DNA, 25 bp, Mus musculus
cattgtaggcctgatgagtcgtcat

SEQ ID NO: 334318 - DNA, 25 bp, Mus musculus
cattgtagtaaaccactgtgctgtt

SEQ ID NO: 334319 - DNA, 25 bp, Mus musculus
cattgtagtaaagcactgtgctgtt

SEQ ID NO: 334320 - DNA, 25 bp, Mus musculus
cattgtatcatgactgccaaggagt

SEQ ID NO: 334321 - DNA, 25 bp, Mus musculus
cattgtatcatgtctgccaaggagt

SEQ ID NO: 334322 - DNA, 25 bp, Mus musculus
cattgtatccctatatgtgactata

SEQ ID NO: 334323 - DNA, 25 bp, Mus musculus
cattgtatccctttatgtgactata

SEQ ID NO: 334324 - DNA, 25 bp, Mus musculus
cattgtatccgcacagcctatgaac

SEQ ID NO: 334325 - DNA, 25 bp, Mus musculus
cattgtatccgctcagcctatgaac

SEQ ID NO: 334326 - DNA, 25 bp, Mus musculus
cattgtatgatacgtctgggaagac

SEQ ID NO: 334327 - DNA, 25 bp, Mus musculus
cattgtatgataggtctgggaagac

SEQ ID NO: 334328 - DNA, 25 bp, Mus musculus
cattgtatgccaaatagctgtggtg

SEQ ID NO: 334329 - DNA, 25 bp, Mus musculus
cattgtatgccacaagagctcttgt

SEQ ID NO: 334330 - DNA, 25 bp, Mus musculus
cattgtatgccagaagagctcttgt

SEQ ID NO: 334331 - DNA, 25 bp, Mus musculus
cattgtatgccatatagctgtggtg

SEQ ID NO: 334332 - DNA, 25 bp, Mus musculus
cattgtattcctcagctttggcaac

SEQ ID NO: 334333 - DNA, 25 bp, Mus musculus
cattgtattcctgagctttggcaac

SEQ ID NO: 334334 - DNA, 25 bp, Mus musculus
cattgtattgccacagccattacta

SEQ ID NO: 334335 - DNA, 25 bp, Mus musculus
cattgtattgcctcagccattacta

SEQ ID NO: 334336 - DNA, 25 bp, Mus musculus
cattgtatttctcttttgcctgtta

SEQ ID NO: 334337 - DNA, 25 bp, Mus musculus
cattgtatttctgttttgcctgtta

SEQ ID NO: 334338 - DNA, 25 bp, Mus musculus
cattgtcaaataagagtcccatctc

SEQ ID NO: 334339 - DNA, 25 bp, Mus musculus
cattgtcaaatatgagtcccatctc

SEQ ID NO: 334340 - DNA, 25 bp, Mus musculus
cattgtcacagacccaagcctggta

SEQ ID NO: 334341 - DNA, 25 bp, Mus musculus
cattgtcacagagccaagcctggta

SEQ ID NO: 334342 - DNA, 25 bp, Mus musculus
cattgtcagattctatagtttcgta

SEQ ID NO: 334343 - DNA, 25 bp, Mus musculus
cattgtcagattgtatagtttcgta

SEQ ID NO: 334344 - DNA, 25 bp, Mus musculus
cattgtcatcatattcatctggtcc

SEQ ID NO: 334345 - DNA, 25 bp, Mus musculus
cattgtcatcattttcatctggtcc

SEQ ID NO: 334346 - DNA, 25 bp, Mus musculus
cattgtcatgtactgttgcaatcct

SEQ ID NO: 334347 - DNA, 25 bp, Mus musculus
cattgtcatgtagtgttgcaatcct

SEQ ID NO: 334348 - DNA, 25 bp, Mus musculus
cattgtcattttcgttggaagcctc

SEQ ID NO: 334349 - DNA, 25 bp, Mus musculus
cattgtcattttggttggaagcctc

SEQ ID NO: 334350 - DNA, 25 bp, Mus musculus
cattgtccacccaaagtacttcaag

SEQ ID NO: 334351 - DNA, 25 bp, Mus musculus
cattgtccaccctaagtacttcaag

SEQ ID NO: 334352 - DNA, 25 bp, Mus musculus
cattgtccatctatccactgtgtga

SEQ ID NO: 334353 - DNA, 25 bp, Mus musculus
cattgtccatctttccactgtgtga

SEQ ID NO: 334354 - DNA, 25 bp, Mus musculus
cattgtcccaaaagtctgtcttagg

SEQ ID NO: 334355 - DNA, 25 bp, Mus musculus
cattgtcccaaatgtctgtcttagg

SEQ ID NO: 334356 - DNA, 25 bp, Mus musculus
cattgtccctatattgtttccggcg

SEQ ID NO: 334357 - DNA, 25 bp, Mus musculus
cattgtccctattttgtttccggcg

SEQ ID NO: 334358 - DNA, 25 bp, Mus musculus
cattgtccgaagaaccctgattgtg

SEQ ID NO: 334359 - DNA, 25 bp, Mus musculus
cattgtccgaagtaccctgattgtg

SEQ ID NO: 334360 - DNA, 25 bp, Mus musculus
cattgtccggtcaagttttcagagt

SEQ ID NO: 334361 - DNA, 25 bp, Mus musculus
cattgtccggtctagttttcagagt

SEQ ID NO: 334362 - DNA, 25 bp, Mus musculus
cattgtccttgtacagtgctgcagt

SEQ ID NO: 334363 - DNA, 25 bp, Mus musculus
cattgtccttgttcagtgctgcagt

SEQ ID NO: 334364 - DNA, 25 bp, Mus musculus
cattgtcggcatcggtttccagtat

SEQ ID NO: 334365 - DNA, 25 bp, Mus musculus
cattgtcggcatgggtttccagtat

SEQ ID NO: 334366 - DNA, 25 bp, Mus musculus
cattgtctagagctcttggaaggac

SEQ ID NO: 334367 - DNA, 25 bp, Mus musculus
cattgtctagaggtcttggaaggac

SEQ ID NO: 334368 - DNA, 25 bp, Mus musculus
cattgtctcgtgatttgtacctgaa

SEQ ID NO: 334369 - DNA, 25 bp, Mus musculus
cattgtctcgtgttttgtacctgaa

SEQ ID NO: 334370 - DNA, 25 bp, Mus musculus
cattgtctctcccaatcttaacttt

SEQ ID NO: 334371 - DNA, 25 bp, Mus musculus
cattgtctctccgaatcttaacttt

SEQ ID NO: 334372 - DNA, 25 bp, Mus musculus
cattgtctctgcctttccctaagta

SEQ ID NO: 334373 - DNA, 25 bp, Mus musculus
cattgtctctgcgtttccctaagta

SEQ ID NO: 334374 - DNA, 25 bp, Mus musculus
cattgtctctgtcctaaaccatttg

SEQ ID NO: 334375 - DNA, 25 bp, Mus musculus
cattgtctctgtgctaaaccatttg

SEQ ID NO: 334376 - DNA, 25 bp, Mus musculus
cattgtctgagacccatgacttgga

SEQ ID NO: 334377 - DNA, 25 bp, Mus musculus
cattgtctgagagccatgacttgga

SEQ ID NO: 334378 - DNA, 25 bp, Mus musculus
cattgtctggtcattggaagccatc

SEQ ID NO: 334379 - DNA, 25 bp, Mus musculus
cattgtctggtctttggaagccatc

SEQ ID NO: 334380 - DNA, 25 bp, Mus musculus
cattgtcttacactgtgcccaacag

SEQ ID NO: 334381 - DNA, 25 bp, Mus musculus
cattgtcttacagtgtgcccaacag

SEQ ID NO: 334382 - DNA, 25 bp, Mus musculus
cattgtcttataaacctcctgacca

SEQ ID NO: 334383 - DNA, 25 bp, Mus musculus
cattgtcttatatacctcctgacca

SEQ ID NO: 334384 - DNA, 25 bp, Mus musculus
cattgtcttccacgatcatctgctc

SEQ ID NO: 334385 - DNA, 25 bp, Mus musculus
cattgtcttccaggatcatctgctc

SEQ ID NO: 334386 - DNA, 25 bp, Mus musculus
cattgtctttgaatgtattggaagc

SEQ ID NO: 334387 - DNA, 25 bp, Mus musculus
cattgtctttgattgtattggaagc

SEQ ID NO: 334388 - DNA, 25 bp, Mus musculus
cattgtctttgcaggtgggtcagcc

SEQ ID NO: 334389 - DNA, 25 bp, Mus musculus
cattgtctttgctggtgggtcagcc

SEQ ID NO: 334390 - DNA, 25 bp, Mus musculus
cattgtctttttccagatgggttgc

SEQ ID NO: 334391 - DNA, 25 bp, Mus musculus
cattgtctttttgcagatgggttgc

SEQ ID NO: 334392 - DNA, 25 bp, Mus musculus
cattgtgaacaacgagtgccatttt

SEQ ID NO: 334393 - DNA, 25 bp, Mus musculus
cattgtgaacaaggagtgccatttt

SEQ ID NO: 334394 - DNA, 25 bp, Mus musculus
cattgtgaagaacatcgctttggac

SEQ ID NO: 334395 - DNA, 25 bp, Mus musculus
cattgtgaagaagatcgctttggac

SEQ ID NO: 334396 - DNA, 25 bp, Mus musculus
cattgtgacctgctgtactctggaa

SEQ ID NO: 334397 - DNA, 25 bp, Mus musculus
cattgtgacctggtgtactctggaa

SEQ ID NO: 334398 - DNA, 25 bp, Mus musculus
cattgtgactgcatctagagacgga

SEQ ID NO: 334399 - DNA, 25 bp, Mus musculus
cattgtgactgcttctagagacgga

SEQ ID NO: 334400 - DNA, 25 bp, Mus musculus
cattgtgagccacgaccatctgtaa

SEQ ID NO: 334401 - DNA, 25 bp, Mus musculus
cattgtgagccaggaccatctgtaa

SEQ ID NO: 334402 - DNA, 25 bp, Mus musculus
cattgtgagggcctcagatgaccat

SEQ ID NO: 334403 - DNA, 25 bp, Mus musculus
cattgtgagggcgtcagatgaccat

SEQ ID NO: 334404 - DNA, 25 bp, Mus musculus
cattgtgagggtcactgtggcctat

SEQ ID NO: 334405 - DNA, 25 bp, Mus musculus
cattgtgagggtgactgtggcctat

SEQ ID NO: 334406 - DNA, 25 bp, Mus musculus
cattgtgatattaaccatactaagt

SEQ ID NO: 334407 - DNA, 25 bp, Mus musculus
cattgtgatattcccacctaactca

SEQ ID NO: 334408 - DNA, 25 bp, Mus musculus
cattgtgatattgccacctaactca

SEQ ID NO: 334409 - DNA, 25 bp, Mus musculus
cattgtgatatttaccatactaagt

SEQ ID NO: 334410 - DNA, 25 bp, Mus musculus
cattgtgatggacagaactgatttc

SEQ ID NO: 334411 - DNA, 25 bp, Mus musculus
cattgtgatggagagaactgatttc

SEQ ID NO: 334412 - DNA, 25 bp, Mus musculus
cattgtgatggcagtattgtgacat

SEQ ID NO: 334413 - DNA, 25 bp, Mus musculus
cattgtgatggctgtattgtgacat

SEQ ID NO: 334414 - DNA, 25 bp, Mus musculus
cattgtgcaatgagcctggttctta

SEQ ID NO: 334415 - DNA, 25 bp, Mus musculus
cattgtgcaatgtgcctggttctta

SEQ ID NO: 334416 - DNA, 25 bp, Mus musculus
cattgtgcacacagagaccgtatat

SEQ ID NO: 334417 - DNA, 25 bp, Mus musculus
cattgtgcacactgagaccgtatat

SEQ ID NO: 334418 - DNA, 25 bp, Mus musculus
cattgtgcaggtctatcagatcatc

SEQ ID NO: 334419 - DNA, 25 bp, Mus musculus
cattgtgcaggtgtatcagatcatc

SEQ ID NO: 334420 - DNA, 25 bp, Mus musculus
cattgtgcatgacaagcaagctgat

SEQ ID NO: 334421 - DNA, 25 bp, Mus musculus
cattgtgcatgagaagcaagctgat

SEQ ID NO: 334422 - DNA, 25 bp, Mus musculus
cattgtgccatacgaatatcggttc

SEQ ID NO: 334423 - DNA, 25 bp, Mus musculus
cattgtgccataggaatatcggttc

SEQ ID NO: 334424 - DNA, 25 bp, Mus musculus
cattgtgccatgatgctaatcagtg

SEQ ID NO: 334425 - DNA, 25 bp, Mus musculus
cattgtgccatgttgctaatcagtg

SEQ ID NO: 334426 - DNA, 25 bp, Mus musculus
cattgtgccattcagatctcgttat

SEQ ID NO: 334427 - DNA, 25 bp, Mus musculus
cattgtgccattgagatctcgttat

SEQ ID NO: 334428 - DNA, 25 bp, Mus musculus
cattgtgctactatggatatatata

SEQ ID NO: 334429 - DNA, 25 bp, Mus musculus
cattgtgctactttggatatatata

SEQ ID NO: 334430 - DNA, 25 bp, Mus musculus
cattgtgctgccatagagtttgtac

SEQ ID NO: 334431 - DNA, 25 bp, Mus musculus
cattgtgctgccttagagtttgtac

SEQ ID NO: 334432 - DNA, 25 bp, Mus musculus
cattgtgctgttccctggtgtacca

SEQ ID NO: 334433 - DNA, 25 bp, Mus musculus
cattgtgctgttgcctggtgtacca

SEQ ID NO: 334434 - DNA, 25 bp, Mus musculus
cattgtgcttctatgaacacacaga

SEQ ID NO: 334435 - DNA, 25 bp, Mus musculus
cattgtgcttctttgaacacacaga

SEQ ID NO: 334436 - DNA, 25 bp, Mus musculus
cattgtgctttgaatcagtcagtgc

SEQ ID NO: 334437 - DNA, 25 bp, Mus musculus
cattgtgctttgtatcagtcagtgc

SEQ ID NO: 334438 - DNA, 25 bp, Mus musculus
cattgtggacatcgcagccactaga

SEQ ID NO: 334439 - DNA, 25 bp, Mus musculus
cattgtggacatggcagccactaga

SEQ ID NO: 334440 - DNA, 25 bp, Mus musculus
cattgtggactcacagtcacagcca

SEQ ID NO: 334441 - DNA, 25 bp, Mus musculus
cattgtggactctcagtcacagcca

SEQ ID NO: 334442 - DNA, 25 bp, Mus musculus
cattgtggcagaaggctttaatccc

SEQ ID NO: 334443 - DNA, 25 bp, Mus musculus
cattgtggcagatggctttaatccc

SEQ ID NO: 334444 - DNA, 25 bp, Mus musculus
cattgtggctttagtgtgtacatgc

SEQ ID NO: 334445 - DNA, 25 bp, Mus musculus
cattgtggcttttgtgtgtacatgc

SEQ ID NO: 334446 - DNA, 25 bp, Mus musculus
cattgtgggaatccctgatcccttt

SEQ ID NO: 334447 - DNA, 25 bp, Mus musculus
cattgtgggaatgcctgatcccttt

SEQ ID NO: 334448 - DNA, 25 bp, Mus musculus
cattgtgggcatcgcttcagctgga

SEQ ID NO: 334449 - DNA, 25 bp, Mus musculus
cattgtgggcatggcttcagctgga

SEQ ID NO: 334450 - DNA, 25 bp, Mus musculus
cattgtggtatcatgagtcttctac

SEQ ID NO: 334451 - DNA, 25 bp, Mus musculus
cattgtggtatcttgagtcttctac

SEQ ID NO: 334452 - DNA, 25 bp, Mus musculus
cattgtggtgggatgcttcgtcctc

SEQ ID NO: 334453 - DNA, 25 bp, Mus musculus
cattgtggtgggttgcttcgtcctc

SEQ ID NO: 334454 - DNA, 25 bp, Mus musculus
cattgtggtgtgacctgatgtgtgc

SEQ ID NO: 334455 - DNA, 25 bp, Mus musculus
cattgtggtgtgtcctgatgtgtgc

SEQ ID NO: 334456 - DNA, 25 bp, Mus musculus
cattgtggttcaaagtggatctgtc

SEQ ID NO: 334457 - DNA, 25 bp, Mus musculus
cattgtggttcatagtggatctgtc

SEQ ID NO: 334458 - DNA, 25 bp, Mus musculus
cattgtggtttaaccagttctcctt

SEQ ID NO: 334459 - DNA, 25 bp, Mus musculus
cattgtggtttatccagttctcctt

SEQ ID NO: 334460 - DNA, 25 bp, Mus musculus
cattgtggtttcacctaacgtgtgt

SEQ ID NO: 334461 - DNA, 25 bp, Mus musculus
cattgtggtttctcctaacgtgtgt

SEQ ID NO: 334462 - DNA, 25 bp, Mus musculus
cattgtgtaacaatgcattggagaa

SEQ ID NO: 334463 - DNA, 25 bp, Mus musculus
cattgtgtaacattgcattggagaa

SEQ ID NO: 334464 - DNA, 25 bp, Mus musculus
cattgtgtaccactgtccgtgaaag

SEQ ID NO: 334465 - DNA, 25 bp, Mus musculus
cattgtgtaccagtgtccgtgaaag

SEQ ID NO: 334466 - DNA, 25 bp, Mus musculus
cattgtgtagctattattcccatta

SEQ ID NO: 334467 - DNA, 25 bp, Mus musculus
cattgtgtagcttttattcccatta

SEQ ID NO: 334468 - DNA, 25 bp, Mus musculus
cattgtgtatacctgcctcttgtca

SEQ ID NO: 334469 - DNA, 25 bp, Mus musculus
cattgtgtatacgtgcctcttgtca

SEQ ID NO: 334470 - DNA, 25 bp, Mus musculus
cattgtgtcacacagtatatccttt

SEQ ID NO: 334471 - DNA, 25 bp, Mus musculus
cattgtgtcacagagtatatccttt

SEQ ID NO: 334472 - DNA, 25 bp, Mus musculus
cattgtgtcataatgtagtcctggt

SEQ ID NO: 334473 - DNA, 25 bp, Mus musculus
cattgtgtcatattgtagtcctggt

SEQ ID NO: 334474 - DNA, 25 bp, Mus musculus
cattgtgtcattcgtgtctcctaaa

SEQ ID NO: 334475 - DNA, 25 bp, Mus musculus
cattgtgtcattggtgtctcctaaa

SEQ ID NO: 334476 - DNA, 25 bp, Mus musculus
cattgtgtgcatctttccccttacc

SEQ ID NO: 334477 - DNA, 25 bp, Mus musculus
cattgtgtgcatgtttccccttacc

SEQ ID NO: 334478 - DNA, 25 bp, Mus musculus
cattgtgtggtcattttgctcgaat

SEQ ID NO: 334479 - DNA, 25 bp, Mus musculus
cattgtgtggtctttttgctcgaat

SEQ ID NO: 334480 - DNA, 25 bp, Mus musculus
cattgtgtgtcacgcaacatcagat

SEQ ID NO: 334481 - DNA, 25 bp, Mus musculus
cattgtgtgtcaggcaacatcagat

SEQ ID NO: 334482 - DNA, 25 bp, Mus musculus
cattgtgtgtgtcctaaatatgaga

SEQ ID NO: 334483 - DNA, 25 bp, Mus musculus
cattgtgtgtgtgctaaatatgaga

SEQ ID NO: 334484 - DNA, 25 bp, Mus musculus
cattgtgttacccttgaactagctt

SEQ ID NO: 334485 - DNA, 25 bp, Mus musculus
cattgtgttaccgttgaactagctt

SEQ ID NO: 334486 - DNA, 25 bp, Mus musculus
cattgtgttcaaatccaggtgggaa

SEQ ID NO: 334487 - DNA, 25 bp, Mus musculus
cattgtgttcaattccaggtgggaa

SEQ ID NO: 334488 - DNA, 25 bp, Mus musculus
cattgtgttcatacagagagcaagt

SEQ ID NO: 334489 - DNA, 25 bp, Mus musculus
cattgtgttcattcagagagcaagt

SEQ ID NO: 334490 - DNA, 25 bp, Mus musculus
cattgtgtttcccagaggtttgaaa

SEQ ID NO: 334491 - DNA, 25 bp, Mus musculus
cattgtgtttccgagaggtttgaaa

SEQ ID NO: 334492 - DNA, 25 bp, Mus musculus
cattgtgtttctaggcttcggagca

SEQ ID NO: 334493 - DNA, 25 bp, Mus musculus
cattgtgtttcttggcttcggagca

SEQ ID NO: 334494 - DNA, 25 bp, Mus musculus
cattgtgtttgcctccgatagaaat

SEQ ID NO: 334495 - DNA, 25 bp, Mus musculus
cattgtgtttgcgtccgatagaaat

SEQ ID NO: 334496 - DNA, 25 bp, Mus musculus
cattgttaacccatgtcttagtcac

SEQ ID NO: 334497 - DNA, 25 bp, Mus musculus
cattgttaacccttgtcttagtcac

SEQ ID NO: 334498 - DNA, 25 bp, Mus musculus
cattgttaatctacttcacttccca

SEQ ID NO: 334499 - DNA, 25 bp, Mus musculus
cattgttaatcttcttcacttccca

SEQ ID NO: 334500 - DNA, 25 bp, Mus musculus
cattgttaatttatgtggcttcacc

SEQ ID NO: 334501 - DNA, 25 bp, Mus musculus
cattgttaatttcctaacgctcagg

SEQ ID NO: 334502 - DNA, 25 bp, Mus musculus
cattgttaatttgctaacgctcagg

SEQ ID NO: 334503 - DNA, 25 bp, Mus musculus
cattgttaatttttgtggcttcacc

SEQ ID NO: 334504 - DNA, 25 bp, Mus musculus
cattgttactacaaaatacccagat

SEQ ID NO: 334505 - DNA, 25 bp, Mus musculus
cattgttactactaaatacccagat

SEQ ID NO: 334506 - DNA, 25 bp, Mus musculus
cattgttactgtactgttcactaaa

SEQ ID NO: 334507 - DNA, 25 bp, Mus musculus
cattgttactgttctgttcactaaa

SEQ ID NO: 334508 - DNA, 25 bp, Mus musculus
cattgttactttatgatattttcat

SEQ ID NO: 334509 - DNA, 25 bp, Mus musculus
cattgttactttttgatattttcat

SEQ ID NO: 334510 - DNA, 25 bp, Mus musculus
cattgttagtatatgtctctcctta

SEQ ID NO: 334511 - DNA, 25 bp, Mus musculus
cattgttagtatttgtctctcctta

SEQ ID NO: 334512 - DNA, 25 bp, Mus musculus
cattgttatcatccttgtgggcaat

SEQ ID NO: 334513 - DNA, 25 bp, Mus musculus
cattgttatcatgcttgtgggcaat

SEQ ID NO: 334514 - DNA, 25 bp, Mus musculus
cattgttcacgaaacttgctgcctc

SEQ ID NO: 334515 - DNA, 25 bp, Mus musculus
cattgttcacgatacttgctgcctc

SEQ ID NO: 334516 - DNA, 25 bp, Mus musculus
cattgttcagaaccctctactgagg

SEQ ID NO: 334517 - DNA, 25 bp, Mus musculus
cattgttcagaagcctctactgagg

SEQ ID NO: 334518 - DNA, 25 bp, Mus musculus
cattgttcatacatgagaggacatt

SEQ ID NO: 334519 - DNA, 25 bp, Mus musculus
cattgttcatacttgagaggacatt

SEQ ID NO: 334520 - DNA, 25 bp, Mus musculus
cattgttcatatactgtaatcgcac

SEQ ID NO: 334521 - DNA, 25 bp, Mus musculus
cattgttcatattctgtaatcgcac

SEQ ID NO: 334522 - DNA, 25 bp, Mus musculus
cattgttccaggcaattttgagaga

SEQ ID NO: 334523 - DNA, 25 bp, Mus musculus
cattgttccagggaattttgagaga

SEQ ID NO: 334524 - DNA, 25 bp, Mus musculus
cattgttcttacacccctaactttg

SEQ ID NO: 334525 - DNA, 25 bp, Mus musculus
cattgttcttactcccctaactttg

SEQ ID NO: 334526 - DNA, 25 bp, Mus musculus
cattgttctttcaatatctgtccac

SEQ ID NO: 334527 - DNA, 25 bp, Mus musculus
cattgttctttctatatctgtccac

SEQ ID NO: 334528 - DNA, 25 bp, Mus musculus
cattgttgccttcctttttcttctt

SEQ ID NO: 334529 - DNA, 25 bp, Mus musculus
cattgttgccttcgccctgacagat

SEQ ID NO: 334530 - DNA, 25 bp, Mus musculus
cattgttgccttgctttttcttctt

SEQ ID NO: 334531 - DNA, 25 bp, Mus musculus
cattgttgccttggccctgacagat

SEQ ID NO: 334532 - DNA, 25 bp, Mus musculus
cattgttgcggtctcgcgtagaaca

SEQ ID NO: 334533 - DNA, 25 bp, Mus musculus
cattgttgcggtgtcgcgtagaaca

SEQ ID NO: 334534 - DNA, 25 bp, Mus musculus
cattgttgctgaatctgttccggaa

SEQ ID NO: 334535 - DNA, 25 bp, Mus musculus
cattgttgctgattctgttccggaa

SEQ ID NO: 334536 - DNA, 25 bp, Mus musculus
cattgttgctgtcattaactgtggg

SEQ ID NO: 334537 - DNA, 25 bp, Mus musculus
cattgttgctgtgattaactgtggg

SEQ ID NO: 334538 - DNA, 25 bp, Mus musculus
cattgttgcttgagagtatgtacat

SEQ ID NO: 334539 - DNA, 25 bp, Mus musculus
cattgttgcttgtgagtatgtacat

SEQ ID NO: 334540 - DNA, 25 bp, Mus musculus
cattgttgctttcgtgtcttgaggt

SEQ ID NO: 334541 - DNA, 25 bp, Mus musculus
cattgttgctttctattctgtgttc

SEQ ID NO: 334542 - DNA, 25 bp, Mus musculus
cattgttgctttggtgtcttgaggt

SEQ ID NO: 334543 - DNA, 25 bp, Mus musculus
cattgttgctttgtattctgtgttc

SEQ ID NO: 334544 - DNA, 25 bp, Mus musculus
cattgttggctaactcagacctgaa

SEQ ID NO: 334545 - DNA, 25 bp, Mus musculus
cattgttggctatctcagacctgaa

SEQ ID NO: 334546 - DNA, 25 bp, Mus musculus
cattgttgtcatagtttggctttgg

SEQ ID NO: 334547 - DNA, 25 bp, Mus musculus
cattgttgtcattgtttggctttgg

SEQ ID NO: 334548 - DNA, 25 bp, Mus musculus
cattgttgttacatcctgggtcata

SEQ ID NO: 334549 - DNA, 25 bp, Mus musculus
cattgttgttacttcctgggtcata

SEQ ID NO: 334550 - DNA, 25 bp, Mus musculus
cattgtttagaaagcctgctcctgc

SEQ ID NO: 334551 - DNA, 25 bp, Mus musculus
cattgtttagaatgcctgctcctgc

SEQ ID NO: 334552 - DNA, 25 bp, Mus musculus
cattgtttattactgtccatgtcca

SEQ ID NO: 334553 - DNA, 25 bp, Mus musculus
cattgtttattagtgtccatgtcca

SEQ ID NO: 334554 - DNA, 25 bp, Mus musculus
cattgtttatttactattcgtttca

SEQ ID NO: 334555 - DNA, 25 bp, Mus musculus
cattgtttattttctattcgtttca

SEQ ID NO: 334556 - DNA, 25 bp, Mus musculus
cattgtttccacatcactttccttg

SEQ ID NO: 334557 - DNA, 25 bp, Mus musculus
cattgtttccacatctggtggataa

SEQ ID NO: 334558 - DNA, 25 bp, Mus musculus
cattgtttccacttcactttccttg

SEQ ID NO: 334559 - DNA, 25 bp, Mus musculus
cattgtttccacttctggtggataa

SEQ ID NO: 334560 - DNA, 25 bp, Mus musculus
cattgtttccatatggatgtgagca

SEQ ID NO: 334561 - DNA, 25 bp, Mus musculus
cattgtttccatttggatgtgagca

SEQ ID NO: 334562 - DNA, 25 bp, Mus musculus
cattgtttcctacactttagcctta

SEQ ID NO: 334563 - DNA, 25 bp, Mus musculus
cattgtttcctagactttagcctta

SEQ ID NO: 334564 - DNA, 25 bp, Mus musculus
cattgtttctagcttgggcagagca

SEQ ID NO: 334565 - DNA, 25 bp, Mus musculus
cattgtttctaggttgggcagagca

SEQ ID NO: 334566 - DNA, 25 bp, Mus musculus
cattgtttctctcggctaaagcatg

SEQ ID NO: 334567 - DNA, 25 bp, Mus musculus
cattgtttctctgggctaaagcatg

SEQ ID NO: 334568 - DNA, 25 bp, Mus musculus
cattgtttggctactggtgggttat

SEQ ID NO: 334569 - DNA, 25 bp, Mus musculus
cattgtttggcttctggtgggttat

SEQ ID NO: 334570 - DNA, 25 bp, Mus musculus
cattgtttgtgtcaggtttgggctt

SEQ ID NO: 334571 - DNA, 25 bp, Mus musculus
cattgtttgtgtgaggtttgggctt

SEQ ID NO: 334572 - DNA, 25 bp, Mus musculus
cattgttttatgatgggctgagtaa

SEQ ID NO: 334573 - DNA, 25 bp, Mus musculus
cattgttttatgttgggctgagtaa

SEQ ID NO: 334574 - DNA, 25 bp, Mus musculus
cattgttttcaaatccaggtacgag

SEQ ID NO: 334575 - DNA, 25 bp, Mus musculus
cattgttttcaattccaggtacgag

SEQ ID NO: 334576 - DNA, 25 bp, Mus musculus
cattgttttcgtagcccttggagac

SEQ ID NO: 334577 - DNA, 25 bp, Mus musculus
cattgttttcgttgcccttggagac

SEQ ID NO: 334578 - DNA, 25 bp, Mus musculus
catttaaaaaataccagcctccaga

SEQ ID NO: 334579 - DNA, 25 bp, Mus musculus
catttaaaaaattccagcctccaga

SEQ ID NO: 334580 - DNA, 25 bp, Mus musculus
catttaaaagcgactgtggttccaa

SEQ ID NO: 334581 - DNA, 25 bp, Mus musculus
catttaaaagcgtctgtggttccaa

SEQ ID NO: 334582 - DNA, 25 bp, Mus musculus
catttaaaggctaccccatacattt

SEQ ID NO: 334583 - DNA, 25 bp, Mus musculus
catttaaaggcttccccatacattt

SEQ ID NO: 334584 - DNA, 25 bp, Mus musculus
catttaaagttcacaagttctctct

SEQ ID NO: 334585 - DNA, 25 bp, Mus musculus
catttaaagttctcaagttctctct

SEQ ID NO: 334586 - DNA, 25 bp, Mus musculus
catttaacactgatcgtccttggaa

SEQ ID NO: 334587 - DNA, 25 bp, Mus musculus
catttaacactgttcgtccttggaa

SEQ ID NO: 334588 - DNA, 25 bp, Mus musculus
catttaacctaacctctctgaacat

SEQ ID NO: 334589 - DNA, 25 bp, Mus musculus
catttaacctaagctctctgaacat

SEQ ID NO: 334590 - DNA, 25 bp, Mus musculus
catttaactgtgaccttctagctaa

SEQ ID NO: 334591 - DNA, 25 bp, Mus musculus
catttaactgtgtccttctagctaa

SEQ ID NO: 334592 - DNA, 25 bp, Mus musculus
catttaacttttcaaccctatcagt

SEQ ID NO: 334593 - DNA, 25 bp, Mus musculus
catttaacttttgaaccctatcagt

SEQ ID NO: 334594 - DNA, 25 bp, Mus musculus
catttaagaatgctgccgctgaagt

SEQ ID NO: 334595 - DNA, 25 bp, Mus musculus
catttaagaatggtgccgctgaagt

SEQ ID NO: 334596 - DNA, 25 bp, Mus musculus
catttaagcaggcagtggccacctc

SEQ ID NO: 334597 - DNA, 25 bp, Mus musculus
catttaagcagggagtggccacctc

SEQ ID NO: 334598 - DNA, 25 bp, Mus musculus
catttaaggagaaccctgctgggtc

SEQ ID NO: 334599 - DNA, 25 bp, Mus musculus
catttaaggagatccctgctgggtc

SEQ ID NO: 334600 - DNA, 25 bp, Mus musculus
catttaagtggtcccttggtgcatt

SEQ ID NO: 334601 - DNA, 25 bp, Mus musculus
catttaagtggtgccttggtgcatt

SEQ ID NO: 334602 - DNA, 25 bp, Mus musculus
catttaatatcaagcaataagctgt

SEQ ID NO: 334603 - DNA, 25 bp, Mus musculus
catttaatatcatgcaataagctgt

SEQ ID NO: 334604 - DNA, 25 bp, Mus musculus
catttaatatgtatcctttgggctt

SEQ ID NO: 334605 - DNA, 25 bp, Mus musculus
catttaatatgtttcctttgggctt

SEQ ID NO: 334606 - DNA, 25 bp, Mus musculus
catttaatcagtctagcctttgcga

SEQ ID NO: 334607 - DNA, 25 bp, Mus musculus
catttaatcagtgtagcctttgcga

SEQ ID NO: 334608 - DNA, 25 bp, Mus musculus
catttaatgactactttgaccacca

SEQ ID NO: 334609 - DNA, 25 bp, Mus musculus
catttaatgacttctttgaccacca

SEQ ID NO: 334610 - DNA, 25 bp, Mus musculus
catttaatggacaggacttttccca

SEQ ID NO: 334611 - DNA, 25 bp, Mus musculus
catttaatggactggacttttccca

SEQ ID NO: 334612 - DNA, 25 bp, Mus musculus
catttaatgtaacgaccggtgtgct

SEQ ID NO: 334613 - DNA, 25 bp, Mus musculus
catttaatgtaaggaccggtgtgct

SEQ ID NO: 334614 - DNA, 25 bp, Mus musculus
catttaattgcccaagacgtctctg

SEQ ID NO: 334615 - DNA, 25 bp, Mus musculus
catttaattgccgaagacgtctctg

SEQ ID NO: 334616 - DNA, 25 bp, Mus musculus
catttaattggaactctattgtgaa

SEQ ID NO: 334617 - DNA, 25 bp, Mus musculus
catttaattggatctctattgtgaa

SEQ ID NO: 334618 - DNA, 25 bp, Mus musculus
catttaattttgctagctgtttggc

SEQ ID NO: 334619 - DNA, 25 bp, Mus musculus
catttaattttggtagctgtttggc

SEQ ID NO: 334620 - DNA, 25 bp, Mus musculus
catttacaagatcccactcctgggt

SEQ ID NO: 334621 - DNA, 25 bp, Mus musculus
catttacaagatgccactcctgggt

SEQ ID NO: 334622 - DNA, 25 bp, Mus musculus
catttacaatgtcccatgccatttc

SEQ ID NO: 334623 - DNA, 25 bp, Mus musculus
catttacaatgtgccatgccatttc

SEQ ID NO: 334624 - DNA, 25 bp, Mus musculus
catttacacggaccatcagaagatt

SEQ ID NO: 334625 - DNA, 25 bp, Mus musculus
catttacacggagcatcagaagatt

SEQ ID NO: 334626 - DNA, 25 bp, Mus musculus
catttacatcggaaacgtctgggtt

SEQ ID NO: 334627 - DNA, 25 bp, Mus musculus
catttacatcggtaacgtctgggtt

SEQ ID NO: 334628 - DNA, 25 bp, Mus musculus
catttacatgtaccttcagcgcagt

SEQ ID NO: 334629 - DNA, 25 bp, Mus musculus
catttacatgtagcttcagcgcagt

SEQ ID NO: 334630 - DNA, 25 bp, Mus musculus
catttaccaagaacctgccatgtac

SEQ ID NO: 334631 - DNA, 25 bp, Mus musculus
catttaccaagatcctgccatgtac

SEQ ID NO: 334632 - DNA, 25 bp, Mus musculus
catttactacagaaaaggccctaga

SEQ ID NO: 334633 - DNA, 25 bp, Mus musculus
catttactacagtaaaggccctaga

SEQ ID NO: 334634 - DNA, 25 bp, Mus musculus
catttactctggagctttctttcca

SEQ ID NO: 334635 - DNA, 25 bp, Mus musculus
catttactctggtgctttctttcca

SEQ ID NO: 334636 - DNA, 25 bp, Mus musculus
catttactgcataaactagcctgtg

SEQ ID NO: 334637 - DNA, 25 bp, Mus musculus
catttactgcattaactagcctgtg

SEQ ID NO: 334638 - DNA, 25 bp, Mus musculus
catttactggctactcggcttagac

SEQ ID NO: 334639 - DNA, 25 bp, Mus musculus
catttactggcttctcggcttagac

SEQ ID NO: 334640 - DNA, 25 bp, Mus musculus
catttactgtgcacatgctgaaagg

SEQ ID NO: 334641 - DNA, 25 bp, Mus musculus
catttactgtgctcatgctgaaagg

SEQ ID NO: 334642 - DNA, 25 bp, Mus musculus
catttactgtgtaaacattggttaa

SEQ ID NO: 334643 - DNA, 25 bp, Mus musculus
catttactgtgttaacattggttaa

SEQ ID NO: 334644 - DNA, 25 bp, Mus musculus
catttacttcccattgtctaatact

SEQ ID NO: 334645 - DNA, 25 bp, Mus musculus
catttacttccctttgtctaatact

SEQ ID NO: 334646 - DNA, 25 bp, Mus musculus
catttacttctcactggaggagtgg

SEQ ID NO: 334647 - DNA, 25 bp, Mus musculus
catttacttctctctggaggagtgg

SEQ ID NO: 334648 - DNA, 25 bp, Mus musculus
catttacttctgaccttgcatttca

SEQ ID NO: 334649 - DNA, 25 bp, Mus musculus
catttacttctgtccttgcatttca

SEQ ID NO: 334650 - DNA, 25 bp, Mus musculus
catttacttttcacgcgatggaaat

SEQ ID NO: 334651 - DNA, 25 bp, Mus musculus
catttacttttctcgcgatggaaat

SEQ ID NO: 334652 - DNA, 25 bp, Mus musculus
catttagaaatgatccagcaaagac

SEQ ID NO: 334653 - DNA, 25 bp, Mus musculus
catttagaaatgttccagcaaagac

SEQ ID NO: 334654 - DNA, 25 bp, Mus musculus
catttagaagctatctgcccttcag

SEQ ID NO: 334655 - DNA, 25 bp, Mus musculus
catttagaagctttctgcccttcag

SEQ ID NO: 334656 - DNA, 25 bp, Mus musculus
catttagagcttcgatgcagccctg

SEQ ID NO: 334657 - DNA, 25 bp, Mus musculus
catttagagcttggatgcagccctg

SEQ ID NO: 334658 - DNA, 25 bp, Mus musculus
catttagataccactgttcccttga

SEQ ID NO: 334659 - DNA, 25 bp, Mus musculus
catttagatacctctgttcccttga

SEQ ID NO: 334660 - DNA, 25 bp, Mus musculus
catttagcaagaagtttcggctagt

SEQ ID NO: 334661 - DNA, 25 bp, Mus musculus
catttagcaagatgtttcggctagt

SEQ ID NO: 334662 - DNA, 25 bp, Mus musculus
catttagcagttcagttggcctaga

SEQ ID NO: 334663 - DNA, 25 bp, Mus musculus
catttagcagttgagttggcctaga

SEQ ID NO: 334664 - DNA, 25 bp, Mus musculus
catttagcatttatatctctgtagg

SEQ ID NO: 334665 - DNA, 25 bp, Mus musculus
catttagcatttttatctctgtagg

SEQ ID NO: 334666 - DNA, 25 bp, Mus musculus
catttagccatcagagttacacaaa

SEQ ID NO: 334667 - DNA, 25 bp, Mus musculus
catttagccatctgagttacacaaa

SEQ ID NO: 334668 - DNA, 25 bp, Mus musculus
catttagccttcagtgtatccaata

SEQ ID NO: 334669 - DNA, 25 bp, Mus musculus
catttagccttctgtgtatccaata

SEQ ID NO: 334670 - DNA, 25 bp, Mus musculus
catttagcgatgactttttgattgg

SEQ ID NO: 334671 - DNA, 25 bp, Mus musculus
catttagcgatgtctttttgattgg

SEQ ID NO: 334672 - DNA, 25 bp, Mus musculus
catttagctgtaactatatattgca

SEQ ID NO: 334673 - DNA, 25 bp, Mus musculus
catttagctgtatctatatattgca

SEQ ID NO: 334674 - DNA, 25 bp, Mus musculus
catttagcttgacacacctaggata

SEQ ID NO: 334675 - DNA, 25 bp, Mus musculus
catttagcttgagacacctaggata

SEQ ID NO: 334676 - DNA, 25 bp, Mus musculus
catttaggctggcttgaggctcaaa

SEQ ID NO: 334677 - DNA, 25 bp, Mus musculus
catttaggctgggttgaggctcaaa

SEQ ID NO: 334678 - DNA, 25 bp, Mus musculus
catttagggtttatcagagcttaaa

SEQ ID NO: 334679 - DNA, 25 bp, Mus musculus
catttagggtttttcagagcttaaa

SEQ ID NO: 334680 - DNA, 25 bp, Mus musculus
catttagtgtgtcgttctgctcagc

SEQ ID NO: 334681 - DNA, 25 bp, Mus musculus
catttagtgtgtggttctgctcagc

SEQ ID NO: 334682 - DNA, 25 bp, Mus musculus
catttagttgaaacaggccccttca

SEQ ID NO: 334683 - DNA, 25 bp, Mus musculus
catttagttgaatcaggccccttca

SEQ ID NO: 334684 - DNA, 25 bp, Mus musculus
catttataaatcacagaggcacgtt

SEQ ID NO: 334685 - DNA, 25 bp, Mus musculus
catttataaatctcagaggcacgtt

SEQ ID NO: 334686 - DNA, 25 bp, Mus musculus
catttatagctcaaagcatcatttt

SEQ ID NO: 334687 - DNA, 25 bp, Mus musculus
catttatagctctaagcatcatttt

SEQ ID NO: 334688 - DNA, 25 bp, Mus musculus
catttatagggtaaggacatatcca

SEQ ID NO: 334689 - DNA, 25 bp, Mus musculus
catttatagggttaggacatatcca

SEQ ID NO: 334690 - DNA, 25 bp, Mus musculus
catttatcggtcctcactgaactag

SEQ ID NO: 334691 - DNA, 25 bp, Mus musculus
catttatcggtcgtcactgaactag

SEQ ID NO: 334692 - DNA, 25 bp, Mus musculus
catttatctaaccacattcccaatc

SEQ ID NO: 334693 - DNA, 25 bp, Mus musculus
catttatctaacgacattcccaatc

SEQ ID NO: 334694 - DNA, 25 bp, Mus musculus
catttatctagcaacttgcctcttt

SEQ ID NO: 334695 - DNA, 25 bp, Mus musculus
catttatctagctacttgcctcttt

SEQ ID NO: 334696 - DNA, 25 bp, Mus musculus
catttatgctcacaaagtccttctc

SEQ ID NO: 334697 - DNA, 25 bp, Mus musculus
catttatgctcagaaagtccttctc

SEQ ID NO: 334698 - DNA, 25 bp, Mus musculus
catttatgctggcaagtgtttttca

SEQ ID NO: 334699 - DNA, 25 bp, Mus musculus
catttatgctgggaagtgtttttca

SEQ ID NO: 334700 - DNA, 25 bp, Mus musculus
catttatgtactagggctttgggct

SEQ ID NO: 334701 - DNA, 25 bp, Mus musculus
catttatgtacttgggctttgggct

SEQ ID NO: 334702 - DNA, 25 bp, Mus musculus
catttatgtgggaggctatcctgcc

SEQ ID NO: 334703 - DNA, 25 bp, Mus musculus
catttatgtgggtggctatcctgcc

SEQ ID NO: 334704 - DNA, 25 bp, Mus musculus
catttatgtgttctcttcttttgca

SEQ ID NO: 334705 - DNA, 25 bp, Mus musculus
catttatgtgttgtcttcttttgca

SEQ ID NO: 334706 - DNA, 25 bp, Mus musculus
catttattaatgatgcaggcttact

SEQ ID NO: 334707 - DNA, 25 bp, Mus musculus
catttattaatgttgcaggcttact

SEQ ID NO: 334708 - DNA, 25 bp, Mus musculus
catttattacttctgctagcttgtt

SEQ ID NO: 334709 - DNA, 25 bp, Mus musculus
catttattacttgtgctagcttgtt

SEQ ID NO: 334710 - DNA, 25 bp, Mus musculus
catttattcataatccttctaggct

SEQ ID NO: 334711 - DNA, 25 bp, Mus musculus
catttattcatattccttctaggct

SEQ ID NO: 334712 - DNA, 25 bp, Mus musculus
catttattcctgcccgggattcgtt

SEQ ID NO: 334713 - DNA, 25 bp, Mus musculus
catttattcctggccgggattcgtt

SEQ ID NO: 334714 - DNA, 25 bp, Mus musculus
catttattgagaccatccctaggga

SEQ ID NO: 334715 - DNA, 25 bp, Mus musculus
catttattgagagcatccctaggga

SEQ ID NO: 334716 - DNA, 25 bp, Mus musculus
catttattggtaccctgcgtgtaac

SEQ ID NO: 334717 - DNA, 25 bp, Mus musculus
catttattggtagcctgcgtgtaac

SEQ ID NO: 334718 - DNA, 25 bp, Mus musculus
catttattggtgctcatctgtttga

SEQ ID NO: 334719 - DNA, 25 bp, Mus musculus
catttattggtggtcatctgtttga

SEQ ID NO: 334720 - DNA, 25 bp, Mus musculus
catttatttccaagacgcctttcaa

SEQ ID NO: 334721 - DNA, 25 bp, Mus musculus
catttatttccatgacgcctttcaa

SEQ ID NO: 334722 - DNA, 25 bp, Mus musculus
catttatttctcctgctgagcagaa

SEQ ID NO: 334723 - DNA, 25 bp, Mus musculus
catttatttctcgtgctgagcagaa

SEQ ID NO: 334724 - DNA, 25 bp, Mus musculus
catttattttagaatgacagctcta

SEQ ID NO: 334725 - DNA, 25 bp, Mus musculus
catttattttagtatgacagctcta

SEQ ID NO: 334726 - DNA, 25 bp, Mus musculus
catttattttgccatcatactggta

SEQ ID NO: 334727 - DNA, 25 bp, Mus musculus
catttattttgcgatcatactggta

SEQ ID NO: 334728 - DNA, 25 bp, Mus musculus
catttcaaaagcagtcaccacctga

SEQ ID NO: 334729 - DNA, 25 bp, Mus musculus
catttcaaaagctgtcaccacctga

SEQ ID NO: 334730 - DNA, 25 bp, Mus musculus
catttcaaacctctgtatgtcaaag

SEQ ID NO: 334731 - DNA, 25 bp, Mus musculus
catttcaaacctgtgtatgtcaaag

SEQ ID NO: 334732 - DNA, 25 bp, Mus musculus
catttcaaacttccactccaagttg

SEQ ID NO: 334733 - DNA, 25 bp, Mus musculus
catttcaaacttgcactccaagttg

SEQ ID NO: 334734 - DNA, 25 bp, Mus musculus
catttcaaaggcacttatggcactt

SEQ ID NO: 334735 - DNA, 25 bp, Mus musculus
catttcaaaggctcttatggcactt

SEQ ID NO: 334736 - DNA, 25 bp, Mus musculus
catttcaaccttatactcttcttta

SEQ ID NO: 334737 - DNA, 25 bp, Mus musculus
catttcaaccttccggcctgaaagg

SEQ ID NO: 334738 - DNA, 25 bp, Mus musculus
catttcaaccttgcggcctgaaagg

SEQ ID NO: 334739 - DNA, 25 bp, Mus musculus
catttcaaccttttactcttcttta

SEQ ID NO: 334740 - DNA, 25 bp, Mus musculus
catttcaagagaagcgtggagtttg

SEQ ID NO: 334741 - DNA, 25 bp, Mus musculus
catttcaagagatgcgtggagtttg

SEQ ID NO: 334742 - DNA, 25 bp, Mus musculus
catttcaagggccaggatgtaattg

SEQ ID NO: 334743 - DNA, 25 bp, Mus musculus
catttcaagggcgaggatgtaattg

SEQ ID NO: 334744 - DNA, 25 bp, Mus musculus
catttcacacagcaagctagagcat

SEQ ID NO: 334745 - DNA, 25 bp, Mus musculus
catttcacacaggaagctagagcat

SEQ ID NO: 334746 - DNA, 25 bp, Mus musculus
catttcacatgcagtggaggtagtc

SEQ ID NO: 334747 - DNA, 25 bp, Mus musculus
catttcacatgctgtggaggtagtc

SEQ ID NO: 334748 - DNA, 25 bp, Mus musculus
catttcactccactgtttaccttag

SEQ ID NO: 334749 - DNA, 25 bp, Mus musculus
catttcactccagtgtttaccttag

SEQ ID NO: 334750 - DNA, 25 bp, Mus musculus
catttcacttgcatgtaacattcat

SEQ ID NO: 334751 - DNA, 25 bp, Mus musculus
catttcacttgcttgtaacattcat

SEQ ID NO: 334752 - DNA, 25 bp, Mus musculus
catttcagagttatgtcacagggtg

SEQ ID NO: 334753 - DNA, 25 bp, Mus musculus
catttcagagttttgtcacagggtg

SEQ ID NO: 334754 - DNA, 25 bp, Mus musculus
catttcagattcagtggtaccctct

SEQ ID NO: 334755 - DNA, 25 bp, Mus musculus
catttcagattctgtggtaccctct

SEQ ID NO: 334756 - DNA, 25 bp, Mus musculus
catttcagcctcaaggaatagcagt

SEQ ID NO: 334757 - DNA, 25 bp, Mus musculus
catttcagcctctaggaatagcagt

SEQ ID NO: 334758 - DNA, 25 bp, Mus musculus
catttcagggaaaaggccgcttcaa

SEQ ID NO: 334759 - DNA, 25 bp, Mus musculus
catttcagggaataggccgcttcaa

SEQ ID NO: 334760 - DNA, 25 bp, Mus musculus
catttcagtctcatttgcaggtgga

SEQ ID NO: 334761 - DNA, 25 bp, Mus musculus
catttcagtctcttttgcaggtgga

SEQ ID NO: 334762 - DNA, 25 bp, Mus musculus
catttcagtgttaagtgtgcatatt

SEQ ID NO: 334763 - DNA, 25 bp, Mus musculus
catttcagtgtttagtgtgcatatt

SEQ ID NO: 334764 - DNA, 25 bp, Mus musculus
catttcatacaccaaggccttctta

SEQ ID NO: 334765 - DNA, 25 bp, Mus musculus
catttcatacacgaaggccttctta

SEQ ID NO: 334766 - DNA, 25 bp, Mus musculus
catttcatagtgattctgtctggat

SEQ ID NO: 334767 - DNA, 25 bp, Mus musculus
catttcatagtgtttctgtctggat

SEQ ID NO: 334768 - DNA, 25 bp, Mus musculus
catttcatgcttcgccagagggttc

SEQ ID NO: 334769 - DNA, 25 bp, Mus musculus
catttcatgcttggccagagggttc

SEQ ID NO: 334770 - DNA, 25 bp, Mus musculus
catttcatgtgaactattactctga

SEQ ID NO: 334771 - DNA, 25 bp, Mus musculus
catttcatgtgatctattactctga

SEQ ID NO: 334772 - DNA, 25 bp, Mus musculus
catttcattgagaaagggtttttct

SEQ ID NO: 334773 - DNA, 25 bp, Mus musculus
catttcattgagtaagggtttttct

SEQ ID NO: 334774 - DNA, 25 bp, Mus musculus
catttcatttttccccaccagcttt

SEQ ID NO: 334775 - DNA, 25 bp, Mus musculus
catttcatttttgcccaccagcttt

SEQ ID NO: 334776 - DNA, 25 bp, Mus musculus
catttccaatagacctgaccttttc

SEQ ID NO: 334777 - DNA, 25 bp, Mus musculus
catttccaatagtcctgaccttttc

SEQ ID NO: 334778 - DNA, 25 bp, Mus musculus
catttccaattgactggccaggtaa

SEQ ID NO: 334779 - DNA, 25 bp, Mus musculus
catttccaattgtctggccaggtaa

SEQ ID NO: 334780 - DNA, 25 bp, Mus musculus
catttccacctgactcctgaatgaa

SEQ ID NO: 334781 - DNA, 25 bp, Mus musculus
catttccacctgtctcctgaatgaa

SEQ ID NO: 334782 - DNA, 25 bp, Mus musculus
catttccacttcactccttaaatat

SEQ ID NO: 334783 - DNA, 25 bp, Mus musculus
catttccacttctctccttaaatat

SEQ ID NO: 334784 - DNA, 25 bp, Mus musculus
catttccactttcccctgaactaat

SEQ ID NO: 334785 - DNA, 25 bp, Mus musculus
catttccactttgccctgaactaat

SEQ ID NO: 334786 - DNA, 25 bp, Mus musculus
catttccagcaaaaggaggtgttca

SEQ ID NO: 334787 - DNA, 25 bp, Mus musculus
catttccagcaataggaggtgttca

SEQ ID NO: 334788 - DNA, 25 bp, Mus musculus
catttccagcgcaacctgtaaaggt

SEQ ID NO: 334789 - DNA, 25 bp, Mus musculus
catttccagcgctacctgtaaaggt

SEQ ID NO: 334790 - DNA, 25 bp, Mus musculus
catttccatgacaaacaaaaattca

SEQ ID NO: 334791 - DNA, 25 bp, Mus musculus
catttccatgactaacaaaaattca

SEQ ID NO: 334792 - DNA, 25 bp, Mus musculus
catttcccaaagctagaacctgttt

SEQ ID NO: 334793 - DNA, 25 bp, Mus musculus
catttcccaaaggtagaacctgttt

SEQ ID NO: 334794 - DNA, 25 bp, Mus musculus
catttcccaattccttccagattct

SEQ ID NO: 334795 - DNA, 25 bp, Mus musculus
catttcccaattgcttccagattct

SEQ ID NO: 334796 - DNA, 25 bp, Mus musculus
catttcccagacatcttattcacaa

SEQ ID NO: 334797 - DNA, 25 bp, Mus musculus
catttcccagacttcttattcacaa

SEQ ID NO: 334798 - DNA, 25 bp, Mus musculus
catttcccagcaaacatctgtaatg

SEQ ID NO: 334799 - DNA, 25 bp, Mus musculus
catttcccagcatacatctgtaatg

SEQ ID NO: 334800 - DNA, 25 bp, Mus musculus
catttcccaggaccgccagtgtgag

SEQ ID NO: 334801 - DNA, 25 bp, Mus musculus
catttcccaggagcgccagtgtgag

SEQ ID NO: 334802 - DNA, 25 bp, Mus musculus
catttcccaggtcgagccagatata

SEQ ID NO: 334803 - DNA, 25 bp, Mus musculus
catttcccaggtggagccagatata

SEQ ID NO: 334804 - DNA, 25 bp, Mus musculus
catttcccccagaacattcagaaag

SEQ ID NO: 334805 - DNA, 25 bp, Mus musculus
catttcccccagtacattcagaaag

SEQ ID NO: 334806 - DNA, 25 bp, Mus musculus
catttcccgattcctgagtctgaga

SEQ ID NO: 334807 - DNA, 25 bp, Mus musculus
catttcccgattgctgagtctgaga

SEQ ID NO: 334808 - DNA, 25 bp, Mus musculus
catttccctcttactgtccaattaa

SEQ ID NO: 334809 - DNA, 25 bp, Mus musculus
catttccctctttctgtccaattaa

SEQ ID NO: 334810 - DNA, 25 bp, Mus musculus
catttccctgaactgccattcacag

SEQ ID NO: 334811 - DNA, 25 bp, Mus musculus
catttccctgaagtgccattcacag

SEQ ID NO: 334812 - DNA, 25 bp, Mus musculus
catttccctttgaaagattcaggag

SEQ ID NO: 334813 - DNA, 25 bp, Mus musculus
catttccctttgtaagattcaggag

SEQ ID NO: 334814 - DNA, 25 bp, Mus musculus
catttccgctcacggtaaccgcaaa

SEQ ID NO: 334815 - DNA, 25 bp, Mus musculus
catttccgctcagggtaaccgcaaa

SEQ ID NO: 334816 - DNA, 25 bp, Mus musculus
catttccgctttaggtcttcctggt

SEQ ID NO: 334817 - DNA, 25 bp, Mus musculus
catttccgcttttggtcttcctggt

SEQ ID NO: 334818 - DNA, 25 bp, Mus musculus
catttccgtaaacgattatccacca

SEQ ID NO: 334819 - DNA, 25 bp, Mus musculus
catttccgtaaaggattatccacca

SEQ ID NO: 334820 - DNA, 25 bp, Mus musculus
catttccgttgtcagctggtgagga

SEQ ID NO: 334821 - DNA, 25 bp, Mus musculus
catttccgttgtgagctggtgagga

SEQ ID NO: 334822 - DNA, 25 bp, Mus musculus
catttcctaattctgctgcattcct

SEQ ID NO: 334823 - DNA, 25 bp, Mus musculus
catttcctaattgtgctgcattcct

SEQ ID NO: 334824 - DNA, 25 bp, Mus musculus
catttcctagcgagtaatttcgggt

SEQ ID NO: 334825 - DNA, 25 bp, Mus musculus
catttcctagcgtgtaatttcgggt

SEQ ID NO: 334826 - DNA, 25 bp, Mus musculus
catttcctaggtactgttatatcag

SEQ ID NO: 334827 - DNA, 25 bp, Mus musculus
catttcctaggttctgttatatcag

SEQ ID NO: 334828 - DNA, 25 bp, Mus musculus
catttcctcattcggttggctgagt

SEQ ID NO: 334829 - DNA, 25 bp, Mus musculus
catttcctcattgggttggctgagt

SEQ ID NO: 334830 - DNA, 25 bp, Mus musculus
catttcctcgagctgacacaggagt

SEQ ID NO: 334831 - DNA, 25 bp, Mus musculus
catttcctcgaggtgacacaggagt

SEQ ID NO: 334832 - DNA, 25 bp, Mus musculus
catttcctctgccactaaaaactga

SEQ ID NO: 334833 - DNA, 25 bp, Mus musculus
catttcctctgcgactaaaaactga

SEQ ID NO: 334834 - DNA, 25 bp, Mus musculus
catttcctgaatctcacaccaacga

SEQ ID NO: 334835 - DNA, 25 bp, Mus musculus
catttcctgaatgtcacaccaacga

SEQ ID NO: 334836 - DNA, 25 bp, Mus musculus
catttcctgtgcaggagagtccagt

SEQ ID NO: 334837 - DNA, 25 bp, Mus musculus
catttcctgtgctggagagtccagt

SEQ ID NO: 334838 - DNA, 25 bp, Mus musculus
catttcctgtgtcaagcctagcagt

SEQ ID NO: 334839 - DNA, 25 bp, Mus musculus
catttcctgtgtgaagcctagcagt

SEQ ID NO: 334840 - DNA, 25 bp, Mus musculus
catttccttaacactccctggaaga

SEQ ID NO: 334841 - DNA, 25 bp, Mus musculus
catttccttaactctccctggaaga

SEQ ID NO: 334842 - DNA, 25 bp, Mus musculus
catttccttcccatgtcattcaaga

SEQ ID NO: 334843 - DNA, 25 bp, Mus musculus
catttccttcccttgtcattcaaga

SEQ ID NO: 334844 - DNA, 25 bp, Mus musculus
catttccttcgcaggtattgtttaa

SEQ ID NO: 334845 - DNA, 25 bp, Mus musculus
catttccttcgctggtattgtttaa

SEQ ID NO: 334846 - DNA, 25 bp, Mus musculus
catttccttgctctttggtaatcac

SEQ ID NO: 334847 - DNA, 25 bp, Mus musculus
catttccttgctgtttggtaatcac

SEQ ID NO: 334848 - DNA, 25 bp, Mus musculus
catttccttggacgccttttggaga

SEQ ID NO: 334849 - DNA, 25 bp, Mus musculus
catttccttggaggccttttggaga

SEQ ID NO: 334850 - DNA, 25 bp, Mus musculus
catttccttggcattatgacttgat

SEQ ID NO: 334851 - DNA, 25 bp, Mus musculus
catttccttggctttatgacttgat

SEQ ID NO: 334852 - DNA, 25 bp, Mus musculus
catttccttgtgagccatccctttg

SEQ ID NO: 334853 - DNA, 25 bp, Mus musculus
catttccttgtgtgccatccctttg

SEQ ID NO: 334854 - DNA, 25 bp, Mus musculus
catttcctttccaggtgcctttagt

SEQ ID NO: 334855 - DNA, 25 bp, Mus musculus
catttcctttcctggtgcctttagt

SEQ ID NO: 334856 - DNA, 25 bp, Mus musculus
catttcctttgtcttctttgaagca

SEQ ID NO: 334857 - DNA, 25 bp, Mus musculus
catttcctttgtgttctttgaagca

SEQ ID NO: 334858 - DNA, 25 bp, Mus musculus
catttccttttcaacagctgttcat

SEQ ID NO: 334859 - DNA, 25 bp, Mus musculus
catttccttttctacagctgttcat

SEQ ID NO: 334860 - DNA, 25 bp, Mus musculus
catttcgaaggcctggtaccaagaa

SEQ ID NO: 334861 - DNA, 25 bp, Mus musculus
catttcgaaggcgtggtaccaagaa

SEQ ID NO: 334862 - DNA, 25 bp, Mus musculus
catttcgagagcatcatcagtccaa

SEQ ID NO: 334863 - DNA, 25 bp, Mus musculus
catttcgagagcttcatcagtccaa

SEQ ID NO: 334864 - DNA, 25 bp, Mus musculus
catttcgatcctcgtcaggtgcagg

SEQ ID NO: 334865 - DNA, 25 bp, Mus musculus
catttcgatcctggtcaggtgcagg

SEQ ID NO: 334866 - DNA, 25 bp, Mus musculus
catttcggaatgctgagcctgtcaa

SEQ ID NO: 334867 - DNA, 25 bp, Mus musculus
catttcggaatggtgagcctgtcaa

SEQ ID NO: 334868 - DNA, 25 bp, Mus musculus
catttcggatgtatcactgactatt

SEQ ID NO: 334869 - DNA, 25 bp, Mus musculus
catttcggatgtttcactgactatt

SEQ ID NO: 334870 - DNA, 25 bp, Mus musculus
catttctacccacagctggaagcag

SEQ ID NO: 334871 - DNA, 25 bp, Mus musculus
catttctacccagagctggaagcag

SEQ ID NO: 334872 - DNA, 25 bp, Mus musculus
catttctactggaaccttacgaacg

SEQ ID NO: 334873 - DNA, 25 bp, Mus musculus
catttctactggtaccttacgaacg

SEQ ID NO: 334874 - DNA, 25 bp, Mus musculus
catttctagcaaaaagtgggccact

SEQ ID NO: 334875 - DNA, 25 bp, Mus musculus
catttctagcaataagtgggccact

SEQ ID NO: 334876 - DNA, 25 bp, Mus musculus
catttctagcttcctacttaccagc

SEQ ID NO: 334877 - DNA, 25 bp, Mus musculus
catttctagcttgctacttaccagc

SEQ ID NO: 334878 - DNA, 25 bp, Mus musculus
catttctagtagataggatacctaa

SEQ ID NO: 334879 - DNA, 25 bp, Mus musculus
catttctagtagttaggatacctaa

SEQ ID NO: 334880 - DNA, 25 bp, Mus musculus
catttctagtctcccattggttgtg

SEQ ID NO: 334881 - DNA, 25 bp, Mus musculus
catttctagtctgccattggttgtg

SEQ ID NO: 334882 - DNA, 25 bp, Mus musculus
catttctataacctgttgctctgaa

SEQ ID NO: 334883 - DNA, 25 bp, Mus musculus
catttctataacgtgttgctctgaa

SEQ ID NO: 334884 - DNA, 25 bp, Mus musculus
catttctatcttctgctatctgtac

SEQ ID NO: 334885 - DNA, 25 bp, Mus musculus
catttctatcttgtgctatctgtac

SEQ ID NO: 334886 - DNA, 25 bp, Mus musculus
catttctcattgcacacttctgtta

SEQ ID NO: 334887 - DNA, 25 bp, Mus musculus
catttctcattggacacttctgtta

SEQ ID NO: 334888 - DNA, 25 bp, Mus musculus
catttctcatttaatactcgttcat

SEQ ID NO: 334889 - DNA, 25 bp, Mus musculus
catttctcattttatactcgttcat

SEQ ID NO: 334890 - DNA, 25 bp, Mus musculus
catttctccatcatagcatgactgc

SEQ ID NO: 334891 - DNA, 25 bp, Mus musculus
catttctccatcttagcatgactgc

SEQ ID NO: 334892 - DNA, 25 bp, Mus musculus
catttctcctctcattaaacttcag

SEQ ID NO: 334893 - DNA, 25 bp, Mus musculus
catttctcctctgattaaacttcag

SEQ ID NO: 334894 - DNA, 25 bp, Mus musculus
catttctctattagactgtgccact

SEQ ID NO: 334895 - DNA, 25 bp, Mus musculus
catttctctatttgactgtgccact

SEQ ID NO: 334896 - DNA, 25 bp, Mus musculus
catttctctcatatactgctttcat

SEQ ID NO: 334897 - DNA, 25 bp, Mus musculus
catttctctcatttactgctttcat

SEQ ID NO: 334898 - DNA, 25 bp, Mus musculus
catttctcttggcacaggcttcagg

SEQ ID NO: 334899 - DNA, 25 bp, Mus musculus
catttctcttgggacaggcttcagg

SEQ ID NO: 334900 - DNA, 25 bp, Mus musculus
catttctctttgctccaactaaaat

SEQ ID NO: 334901 - DNA, 25 bp, Mus musculus
catttctctttggtccaactaaaat

SEQ ID NO: 334902 - DNA, 25 bp, Mus musculus
catttctcttttcatcttaaacaga

SEQ ID NO: 334903 - DNA, 25 bp, Mus musculus
catttctcttttgatcttaaacaga

SEQ ID NO: 334904 - DNA, 25 bp, Mus musculus
catttctgaagtcctctttaccctg

SEQ ID NO: 334905 - DNA, 25 bp, Mus musculus
catttctgaagtgctctttaccctg

SEQ ID NO: 334906 - DNA, 25 bp, Mus musculus
catttctgagcacttttggtttgtt

SEQ ID NO: 334907 - DNA, 25 bp, Mus musculus
catttctgagcagttttggtttgtt

SEQ ID NO: 334908 - DNA, 25 bp, Mus musculus
catttctgcgtacgtctcattccat

SEQ ID NO: 334909 - DNA, 25 bp, Mus musculus
catttctgcgtaggtctcattccat

SEQ ID NO: 334910 - DNA, 25 bp, Mus musculus
catttctggatgcattgctgatcaa

SEQ ID NO: 334911 - DNA, 25 bp, Mus musculus
catttctggatggattgctgatcaa

SEQ ID NO: 334912 - DNA, 25 bp, Mus musculus
catttctggcatcagcgaggttccg

SEQ ID NO: 334913 - DNA, 25 bp, Mus musculus
catttctggcatgagcgaggttccg

SEQ ID NO: 334914 - DNA, 25 bp, Mus musculus
catttctggccaacctagtgatgta

SEQ ID NO: 334915 - DNA, 25 bp, Mus musculus
catttctggccatcctagtgatgta

SEQ ID NO: 334916 - DNA, 25 bp, Mus musculus
catttctggtgaagttacagtttca

SEQ ID NO: 334917 - DNA, 25 bp, Mus musculus
catttctggtgatgttacagtttca

SEQ ID NO: 334918 - DNA, 25 bp, Mus musculus
catttctgtattccgttaccttaag

SEQ ID NO: 334919 - DNA, 25 bp, Mus musculus
catttctgtattgcgttaccttaag

SEQ ID NO: 334920 - DNA, 25 bp, Mus musculus
catttctgtcttccatgcttgtaca

SEQ ID NO: 334921 - DNA, 25 bp, Mus musculus
catttctgtcttgcatgcttgtaca

SEQ ID NO: 334922 - DNA, 25 bp, Mus musculus
catttctgtgggaaagggactccaa

SEQ ID NO: 334923 - DNA, 25 bp, Mus musculus
catttctgtgggtaagggactccaa

SEQ ID NO: 334924 - DNA, 25 bp, Mus musculus
catttctgttccatttactacacgg

SEQ ID NO: 334925 - DNA, 25 bp, Mus musculus
catttctgttccttttactacacgg

SEQ ID NO: 334926 - DNA, 25 bp, Mus musculus
catttcttaagtctttgcttgtacc

SEQ ID NO: 334927 - DNA, 25 bp, Mus musculus
catttcttaagtgtttgcttgtacc

SEQ ID NO: 334928 - DNA, 25 bp, Mus musculus
catttcttacccagacaatggtttt

SEQ ID NO: 334929 - DNA, 25 bp, Mus musculus
catttcttaccctgacaatggtttt

SEQ ID NO: 334930 - DNA, 25 bp, Mus musculus
catttcttagtgatcgtgtcggtct

SEQ ID NO: 334931 - DNA, 25 bp, Mus musculus
catttcttagtgttcgtgtcggtct

SEQ ID NO: 334932 - DNA, 25 bp, Mus musculus
catttcttcagacctataagccata

SEQ ID NO: 334933 - DNA, 25 bp, Mus musculus
catttcttcagagctataagccata

SEQ ID NO: 334934 - DNA, 25 bp, Mus musculus
catttcttcataagtcccatgccat

SEQ ID NO: 334935 - DNA, 25 bp, Mus musculus
catttcttcatatgtcccatgccat

SEQ ID NO: 334936 - DNA, 25 bp, Mus musculus
catttcttcatcattcatcttctac

SEQ ID NO: 334937 - DNA, 25 bp, Mus musculus
catttcttcatctttcatcttctac

SEQ ID NO: 334938 - DNA, 25 bp, Mus musculus
catttcttccccataagtctgtgag

SEQ ID NO: 334939 - DNA, 25 bp, Mus musculus
catttcttccccttaagtctgtgag

SEQ ID NO: 334940 - DNA, 25 bp, Mus musculus
catttcttgctgatcatttctggct

SEQ ID NO: 334941 - DNA, 25 bp, Mus musculus
catttcttgctgttcatttctggct

SEQ ID NO: 334942 - DNA, 25 bp, Mus musculus
catttcttggtcacgtgttcattta

SEQ ID NO: 334943 - DNA, 25 bp, Mus musculus
catttcttggtctcgtgttcattta

SEQ ID NO: 334944 - DNA, 25 bp, Mus musculus
catttctttatcctgcattgctagc

SEQ ID NO: 334945 - DNA, 25 bp, Mus musculus
catttctttatcgtgcattgctagc

SEQ ID NO: 334946 - DNA, 25 bp, Mus musculus
catttctttcatcagtagcacactt

SEQ ID NO: 334947 - DNA, 25 bp, Mus musculus
catttctttcatgagtagcacactt

SEQ ID NO: 334948 - DNA, 25 bp, Mus musculus
catttctttccaaattgtcttttaa

SEQ ID NO: 334949 - DNA, 25 bp, Mus musculus
catttctttccatattgtcttttaa

SEQ ID NO: 334950 - DNA, 25 bp, Mus musculus
catttctttcccagcactttgttac

SEQ ID NO: 334951 - DNA, 25 bp, Mus musculus
catttctttccctgcactttgttac

SEQ ID NO: 334952 - DNA, 25 bp, Mus musculus
catttctttcttcccagtcatgtgc

SEQ ID NO: 334953 - DNA, 25 bp, Mus musculus
catttctttcttctgtagctacaga

SEQ ID NO: 334954 - DNA, 25 bp, Mus musculus
catttctttcttgccagtcatgtgc

SEQ ID NO: 334955 - DNA, 25 bp, Mus musculus
catttctttcttgtgtagctacaga

SEQ ID NO: 334956 - DNA, 25 bp, Mus musculus
catttcttttgacagacttgttttg

SEQ ID NO: 334957 - DNA, 25 bp, Mus musculus
catttcttttgagagacttgttttg

SEQ ID NO: 334958 - DNA, 25 bp, Mus musculus
catttgaaacgaaacttctggagtt

SEQ ID NO: 334959 - DNA, 25 bp, Mus musculus
catttgaaacgatacttctggagtt

SEQ ID NO: 334960 - DNA, 25 bp, Mus musculus
catttgaaatgcatgtgtggatata

SEQ ID NO: 334961 - DNA, 25 bp, Mus musculus
catttgaaatgcttgtgtggatata

SEQ ID NO: 334962 - DNA, 25 bp, Mus musculus
catttgaacgcaactctggcgcgga

SEQ ID NO: 334963 - DNA, 25 bp, Mus musculus
catttgaacgcatctctggcgcgga

SEQ ID NO: 334964 - DNA, 25 bp, Mus musculus
catttgaatatgatttgtgtcttat

SEQ ID NO: 334965 - DNA, 25 bp, Mus musculus
catttgaatatgttttgtgtcttat

SEQ ID NO: 334966 - DNA, 25 bp, Mus musculus
catttgagagccagtattcctcctt

SEQ ID NO: 334967 - DNA, 25 bp, Mus musculus
catttgagagcctgtattcctcctt

SEQ ID NO: 334968 - DNA, 25 bp, Mus musculus
catttgagcaagattatagatgaac

SEQ ID NO: 334969 - DNA, 25 bp, Mus musculus
catttgagcaagtttatagatgaac

SEQ ID NO: 334970 - DNA, 25 bp, Mus musculus
catttgagcagtcagtttgcaggct

SEQ ID NO: 334971 - DNA, 25 bp, Mus musculus
catttgagcagtgagtttgcaggct

SEQ ID NO: 334972 - DNA, 25 bp, Mus musculus
catttgagctgtagtttcttctctc

SEQ ID NO: 334973 - DNA, 25 bp, Mus musculus
catttgagctgttgtttcttctctc

SEQ ID NO: 334974 - DNA, 25 bp, Mus musculus
catttgaggaacagccttgggcatt

SEQ ID NO: 334975 - DNA, 25 bp, Mus musculus
catttgaggaactgccttgggcatt

SEQ ID NO: 334976 - DNA, 25 bp, Mus musculus
catttgagggtgagtttgtcaggca

SEQ ID NO: 334977 - DNA, 25 bp, Mus musculus
catttgagggtgtgtttgtcaggca

SEQ ID NO: 334978 - DNA, 25 bp, Mus musculus
catttgagtaaaatcttggtcccct

SEQ ID NO: 334979 - DNA, 25 bp, Mus musculus
catttgagtaaattcttggtcccct

SEQ ID NO: 334980 - DNA, 25 bp, Mus musculus
catttgagtagtaaggagggtatct

SEQ ID NO: 334981 - DNA, 25 bp, Mus musculus
catttgagtagttaggagggtatct

SEQ ID NO: 334982 - DNA, 25 bp, Mus musculus
catttgagtatgactgctgtgatct

SEQ ID NO: 334983 - DNA, 25 bp, Mus musculus
catttgagtatgtctgctgtgatct

SEQ ID NO: 334984 - DNA, 25 bp, Mus musculus
catttgatatatagcaccatgcatg

SEQ ID NO: 334985 - DNA, 25 bp, Mus musculus
catttgatatatagggaaccctgat

SEQ ID NO: 334986 - DNA, 25 bp, Mus musculus
catttgatatattgcaccatgcatg

SEQ ID NO: 334987 - DNA, 25 bp, Mus musculus
catttgatatattgggaaccctgat

SEQ ID NO: 334988 - DNA, 25 bp, Mus musculus
catttgatcacaactggagactggt

SEQ ID NO: 334989 - DNA, 25 bp, Mus musculus
catttgatcacatctggagactggt

SEQ ID NO: 334990 - DNA, 25 bp, Mus musculus
catttgatcctgattgcaatgtcaa

SEQ ID NO: 334991 - DNA, 25 bp, Mus musculus
catttgatcctgtttgcaatgtcaa

SEQ ID NO: 334992 - DNA, 25 bp, Mus musculus
catttgatctgtaactgctgctagt

SEQ ID NO: 334993 - DNA, 25 bp, Mus musculus
catttgatctgttactgctgctagt

SEQ ID NO: 334994 - DNA, 25 bp, Mus musculus
catttgatgatgcagatacctcttt

SEQ ID NO: 334995 - DNA, 25 bp, Mus musculus
catttgatgatggagatacctcttt

SEQ ID NO: 334996 - DNA, 25 bp, Mus musculus
catttgatgttgacctgtgttgcta

SEQ ID NO: 334997 - DNA, 25 bp, Mus musculus
catttgatgttgtcctgtgttgcta

SEQ ID NO: 334998 - DNA, 25 bp, Mus musculus
catttgattaatcctgtagctatgg

SEQ ID NO: 334999 - DNA, 25 bp, Mus musculus
catttgattaatgctgtagctatgg

SEQ ID NO: 335000 - DNA, 25 bp, Mus musculus
catttgcacggtatgggttatttca

SEQ ID NO: 335001 - DNA, 25 bp, Mus musculus
catttgcacggtttgggttatttca

SEQ ID NO: 335002 - DNA, 25 bp, Mus musculus
catttgcattgcaacgagtttttga

SEQ ID NO: 335003 - DNA, 25 bp, Mus musculus
catttgcattgctacgagtttttga

SEQ ID NO: 335004 - DNA, 25 bp, Mus musculus
catttgccaaagcaagctgtcgata

SEQ ID NO: 335005 - DNA, 25 bp, Mus musculus
catttgccaaaggaagctgtcgata

SEQ ID NO: 335006 - DNA, 25 bp, Mus musculus
catttgccacccaacttagcttaaa

SEQ ID NO: 335007 - DNA, 25 bp, Mus musculus
catttgccaccctacttagcttaaa

SEQ ID NO: 335008 - DNA, 25 bp, Mus musculus
catttgccacttaattcccaatacc

SEQ ID NO: 335009 - DNA, 25 bp, Mus musculus
catttgccactttattcccaatacc

SEQ ID NO: 335010 - DNA, 25 bp, Mus musculus
catttgcccagccacttgtgaaagc

SEQ ID NO: 335011 - DNA, 25 bp, Mus musculus
catttgcccagcgacttgtgaaagc

SEQ ID NO: 335012 - DNA, 25 bp, Mus musculus
catttgcccatgcttcagggtcaat

SEQ ID NO: 335013 - DNA, 25 bp, Mus musculus
catttgcccatggttcagggtcaat

SEQ ID NO: 335014 - DNA, 25 bp, Mus musculus
catttgcccctaccccattgttaat

SEQ ID NO: 335015 - DNA, 25 bp, Mus musculus
catttgcccctagcccattgttaat

SEQ ID NO: 335016 - DNA, 25 bp, Mus musculus
catttgccggccagtcaagaggaga

SEQ ID NO: 335017 - DNA, 25 bp, Mus musculus
catttgccggcctgtcaagaggaga

SEQ ID NO: 335018 - DNA, 25 bp, Mus musculus
catttgcctgaaacctgagcccaat

SEQ ID NO: 335019 - DNA, 25 bp, Mus musculus
catttgcctgaatcctgagcccaat

SEQ ID NO: 335020 - DNA, 25 bp, Mus musculus
catttgcctgtaactccggttttag

SEQ ID NO: 335021 - DNA, 25 bp, Mus musculus
catttgcctgtatctccggttttag

SEQ ID NO: 335022 - DNA, 25 bp, Mus musculus
catttgccttcccttaaacatcata

SEQ ID NO: 335023 - DNA, 25 bp, Mus musculus
catttgccttccgttaaacatcata

SEQ ID NO: 335024 - DNA, 25 bp, Mus musculus
catttgcgtgtacttttgccatttg

SEQ ID NO: 335025 - DNA, 25 bp, Mus musculus
catttgcgtgtagttttgccatttg

SEQ ID NO: 335026 - DNA, 25 bp, Mus musculus
catttgctacagcagttctgaacat

SEQ ID NO: 335027 - DNA, 25 bp, Mus musculus
catttgctacaggagttctgaacat

SEQ ID NO: 335028 - DNA, 25 bp, Mus musculus
catttgctaggacagttcatgaacc

SEQ ID NO: 335029 - DNA, 25 bp, Mus musculus
catttgctaggagagttcatgaacc

SEQ ID NO: 335030 - DNA, 25 bp, Mus musculus
catttgctcacgctagctaggcacg

SEQ ID NO: 335031 - DNA, 25 bp, Mus musculus
catttgctcacggtagctaggcacg

SEQ ID NO: 335032 - DNA, 25 bp, Mus musculus
catttgctctatactcacatgctga

SEQ ID NO: 335033 - DNA, 25 bp, Mus musculus
catttgctctattctcacatgctga

SEQ ID NO: 335034 - DNA, 25 bp, Mus musculus
catttgctctccacgggtttttgca

SEQ ID NO: 335035 - DNA, 25 bp, Mus musculus
catttgctctcctcgggtttttgca

SEQ ID NO: 335036 - DNA, 25 bp, Mus musculus
catttgctctggagctgaatagtgc

SEQ ID NO: 335037 - DNA, 25 bp, Mus musculus
catttgctctggtgctgaatagtgc

SEQ ID NO: 335038 - DNA, 25 bp, Mus musculus
catttgctgaagcaacaccggctta

SEQ ID NO: 335039 - DNA, 25 bp, Mus musculus
catttgctgaaggaacaccggctta

SEQ ID NO: 335040 - DNA, 25 bp, Mus musculus
catttgctgcggaggacctgggtga

SEQ ID NO: 335041 - DNA, 25 bp, Mus musculus
catttgctgcggtggacctgggtga

SEQ ID NO: 335042 - DNA, 25 bp, Mus musculus
catttgctgctgattaagttgacaa

SEQ ID NO: 335043 - DNA, 25 bp, Mus musculus
catttgctgctgtttaagttgacaa

SEQ ID NO: 335044 - DNA, 25 bp, Mus musculus
catttgctgtaaacagtttttaaaa

SEQ ID NO: 335045 - DNA, 25 bp, Mus musculus
catttgctgtaatcagtttttaaaa

SEQ ID NO: 335046 - DNA, 25 bp, Mus musculus
catttgctgtgaagagaggccgctc

SEQ ID NO: 335047 - DNA, 25 bp, Mus musculus
catttgctgtgatgagaggccgctc

SEQ ID NO: 335048 - DNA, 25 bp, Mus musculus
catttgcttccgattctagctatga

SEQ ID NO: 335049 - DNA, 25 bp, Mus musculus
catttgcttccgctgtatcacaata

SEQ ID NO: 335050 - DNA, 25 bp, Mus musculus
catttgcttccggtgtatcacaata

SEQ ID NO: 335051 - DNA, 25 bp, Mus musculus
catttgcttccgtttctagctatga

SEQ ID NO: 335052 - DNA, 25 bp, Mus musculus
catttgcttgttctacagtttcttg

SEQ ID NO: 335053 - DNA, 25 bp, Mus musculus
catttgcttgttgtacagtttcttg

SEQ ID NO: 335054 - DNA, 25 bp, Mus musculus
catttgctttgcatgaggtagtcca

SEQ ID NO: 335055 - DNA, 25 bp, Mus musculus
catttgctttgcttgaggtagtcca

SEQ ID NO: 335056 - DNA, 25 bp, Mus musculus
catttgctttggaggtgcagactct

SEQ ID NO: 335057 - DNA, 25 bp, Mus musculus
catttgctttggtggtgcagactct

SEQ ID NO: 335058 - DNA, 25 bp, Mus musculus
catttgctttgtcggagtccgggcc

SEQ ID NO: 335059 - DNA, 25 bp, Mus musculus
catttgctttgtgggagtccgggcc

SEQ ID NO: 335060 - DNA, 25 bp, Mus musculus
catttgcttttccttggccagtttc

SEQ ID NO: 335061 - DNA, 25 bp, Mus musculus
catttgcttttcgttggccagtttc

SEQ ID NO: 335062 - DNA, 25 bp, Mus musculus
catttggaaaacaagtcgtgacatt

SEQ ID NO: 335063 - DNA, 25 bp, Mus musculus
catttggaaaactagtcgtgacatt

SEQ ID NO: 335064 - DNA, 25 bp, Mus musculus
catttggaaattacagcgggacatt

SEQ ID NO: 335065 - DNA, 25 bp, Mus musculus
catttggaaatttcagcgggacatt

SEQ ID NO: 335066 - DNA, 25 bp, Mus musculus
catttggaatggactggagaaaacc

SEQ ID NO: 335067 - DNA, 25 bp, Mus musculus
catttggaatggtctggagaaaacc

SEQ ID NO: 335068 - DNA, 25 bp, Mus musculus
catttggaattcagttgacttatca

SEQ ID NO: 335069 - DNA, 25 bp, Mus musculus
catttggaattctgttgacttatca

SEQ ID NO: 335070 - DNA, 25 bp, Mus musculus
catttggacgagctgttactggatt

SEQ ID NO: 335071 - DNA, 25 bp, Mus musculus
catttggacgaggtgttactggatt

SEQ ID NO: 335072 - DNA, 25 bp, Mus musculus
catttggactagaagcaactgctgt

SEQ ID NO: 335073 - DNA, 25 bp, Mus musculus
catttggactagtagcaactgctgt

SEQ ID NO: 335074 - DNA, 25 bp, Mus musculus
catttggactgtattaaaatcctac

SEQ ID NO: 335075 - DNA, 25 bp, Mus musculus
catttggactgtctgattgtgcctc

SEQ ID NO: 335076 - DNA, 25 bp, Mus musculus
catttggactgtgtgattgtgcctc

SEQ ID NO: 335077 - DNA, 25 bp, Mus musculus
catttggactgttttaaaatcctac

SEQ ID NO: 335078 - DNA, 25 bp, Mus musculus
catttggactttagcacctgttgtt

SEQ ID NO: 335079 - DNA, 25 bp, Mus musculus
catttggacttttgcacctgttgtt

SEQ ID NO: 335080 - DNA, 25 bp, Mus musculus
catttggatagacccttgcacctta

SEQ ID NO: 335081 - DNA, 25 bp, Mus musculus
catttggatagagccttgcacctta

SEQ ID NO: 335082 - DNA, 25 bp, Mus musculus
catttggcagccagcactgactgac

SEQ ID NO: 335083 - DNA, 25 bp, Mus musculus
catttggcagcccttttgaagagtt

SEQ ID NO: 335084 - DNA, 25 bp, Mus musculus
catttggcagccgttttgaagagtt

SEQ ID NO: 335085 - DNA, 25 bp, Mus musculus
catttggcagcctgcactgactgac

SEQ ID NO: 335086 - DNA, 25 bp, Mus musculus
catttggcataactgggacctttgt

SEQ ID NO: 335087 - DNA, 25 bp, Mus musculus
catttggcataagtgggacctttgt

SEQ ID NO: 335088 - DNA, 25 bp, Mus musculus
catttggcattgatcaagaatccta

SEQ ID NO: 335089 - DNA, 25 bp, Mus musculus
catttggcattgttcaagaatccta

SEQ ID NO: 335090 - DNA, 25 bp, Mus musculus
catttggccataatggtgctgctgt

SEQ ID NO: 335091 - DNA, 25 bp, Mus musculus
catttggccatattggtgctgctgt

SEQ ID NO: 335092 - DNA, 25 bp, Mus musculus
catttggcctggctatcgctgggat

SEQ ID NO: 335093 - DNA, 25 bp, Mus musculus
catttggcctgggtatcgctgggat

SEQ ID NO: 335094 - DNA, 25 bp, Mus musculus
catttggcctttatgtcattagaac

SEQ ID NO: 335095 - DNA, 25 bp, Mus musculus
catttggcctttcggtacaaaccag

SEQ ID NO: 335096 - DNA, 25 bp, Mus musculus
catttggcctttgggtacaaaccag

SEQ ID NO: 335097 - DNA, 25 bp, Mus musculus
catttggcctttttgtcattagaac

SEQ ID NO: 335098 - DNA, 25 bp, Mus musculus
catttggctatgactccagtccctg

SEQ ID NO: 335099 - DNA, 25 bp, Mus musculus
catttggctatgtctccagtccctg

SEQ ID NO: 335100 - DNA, 25 bp, Mus musculus
catttggctgatcgcagcaggtagc

SEQ ID NO: 335101 - DNA, 25 bp, Mus musculus
catttggctgatggcagcaggtagc

SEQ ID NO: 335102 - DNA, 25 bp, Mus musculus
catttggcttctataacctcagtag

SEQ ID NO: 335103 - DNA, 25 bp, Mus musculus
catttggcttctttaacctcagtag

SEQ ID NO: 335104 - DNA, 25 bp, Mus musculus
catttggcttttagtacgaatataa

SEQ ID NO: 335105 - DNA, 25 bp, Mus musculus
catttggctttttgtacgaatataa

SEQ ID NO: 335106 - DNA, 25 bp, Mus musculus
catttgggatgcagatgcaggatga

SEQ ID NO: 335107 - DNA, 25 bp, Mus musculus
catttgggatgctgatgcaggatga

SEQ ID NO: 335108 - DNA, 25 bp, Mus musculus
catttgggcaagagccggcataaac

SEQ ID NO: 335109 - DNA, 25 bp, Mus musculus
catttgggcaagtgccggcataaac

SEQ ID NO: 335110 - DNA, 25 bp, Mus musculus
catttgggctatatgtacgtttttg

SEQ ID NO: 335111 - DNA, 25 bp, Mus musculus
catttgggctatttgtacgtttttg

SEQ ID NO: 335112 - DNA, 25 bp, Mus musculus
catttgggtggaaggcctagcagta

SEQ ID NO: 335113 - DNA, 25 bp, Mus musculus
catttgggtggatggcctagcagta

SEQ ID NO: 335114 - DNA, 25 bp, Mus musculus
catttgggtggtcctatactggatc

SEQ ID NO: 335115 - DNA, 25 bp, Mus musculus
catttgggtggtgctatactggatc

SEQ ID NO: 335116 - DNA, 25 bp, Mus musculus
catttggtatctcggccctaattgt

SEQ ID NO: 335117 - DNA, 25 bp, Mus musculus
catttggtatctgggccctaattgt

SEQ ID NO: 335118 - DNA, 25 bp, Mus musculus
catttggtcacaccatacatgtcta

SEQ ID NO: 335119 - DNA, 25 bp, Mus musculus
catttggtcacagcatacatgtcta

SEQ ID NO: 335120 - DNA, 25 bp, Mus musculus
catttggttctcaaacttgtttttg

SEQ ID NO: 335121 - DNA, 25 bp, Mus musculus
catttggttctctaacttgtttttg

SEQ ID NO: 335122 - DNA, 25 bp, Mus musculus
catttgtaatgaactagtgccctat

SEQ ID NO: 335123 - DNA, 25 bp, Mus musculus
catttgtaatgatctagtgccctat

SEQ ID NO: 335124 - DNA, 25 bp, Mus musculus
catttgtaccttagagggagggatg

SEQ ID NO: 335125 - DNA, 25 bp, Mus musculus
catttgtacctttgagggagggatg

SEQ ID NO: 335126 - DNA, 25 bp, Mus musculus
catttgtactttatgcatttgtaga

SEQ ID NO: 335127 - DNA, 25 bp, Mus musculus
catttgtactttttgcatttgtaga

SEQ ID NO: 335128 - DNA, 25 bp, Mus musculus
catttgtatactagctgtgtcatag

SEQ ID NO: 335129 - DNA, 25 bp, Mus musculus
catttgtatacttgctgtgtcatag

SEQ ID NO: 335130 - DNA, 25 bp, Mus musculus
catttgtatccaaggtgctgaatct

SEQ ID NO: 335131 - DNA, 25 bp, Mus musculus
catttgtatccatggtgctgaatct

SEQ ID NO: 335132 - DNA, 25 bp, Mus musculus
catttgtcacatcgacccattttgg

SEQ ID NO: 335133 - DNA, 25 bp, Mus musculus
catttgtcacatggacccattttgg

SEQ ID NO: 335134 - DNA, 25 bp, Mus musculus
catttgtccttcatgctaaaccgtt

SEQ ID NO: 335135 - DNA, 25 bp, Mus musculus
catttgtccttcttgctaaaccgtt

SEQ ID NO: 335136 - DNA, 25 bp, Mus musculus
catttgtcctttcctactaaccaat

SEQ ID NO: 335137 - DNA, 25 bp, Mus musculus
catttgtcctttgctactaaccaat

SEQ ID NO: 335138 - DNA, 25 bp, Mus musculus
catttgtcggacatggtggttaaat

SEQ ID NO: 335139 - DNA, 25 bp, Mus musculus
catttgtcggacttggtggttaaat

SEQ ID NO: 335140 - DNA, 25 bp, Mus musculus
catttgtctgtactcgagaactgta

SEQ ID NO: 335141 - DNA, 25 bp, Mus musculus
catttgtctgtagtcgagaactgta

SEQ ID NO: 335142 - DNA, 25 bp, Mus musculus
catttgtcttctattgatagtgtat

SEQ ID NO: 335143 - DNA, 25 bp, Mus musculus
catttgtcttcttttgatagtgtat

SEQ ID NO: 335144 - DNA, 25 bp, Mus musculus
catttgtgaaagattgttgctgctc

SEQ ID NO: 335145 - DNA, 25 bp, Mus musculus
catttgtgaaagtttgttgctgctc

SEQ ID NO: 335146 - DNA, 25 bp, Mus musculus
catttgtgagccagccttttaggtg

SEQ ID NO: 335147 - DNA, 25 bp, Mus musculus
catttgtgagcctgccttttaggtg

SEQ ID NO: 335148 - DNA, 25 bp, Mus musculus
catttgtgatacactgtgttaaatc

SEQ ID NO: 335149 - DNA, 25 bp, Mus musculus
catttgtgatactctgtgttaaatc

SEQ ID NO: 335150 - DNA, 25 bp, Mus musculus
catttgtgatgcatgggtccctgaa

SEQ ID NO: 335151 - DNA, 25 bp, Mus musculus
catttgtgatgcttgggtccctgaa

SEQ ID NO: 335152 - DNA, 25 bp, Mus musculus
catttgtgatggcttatggaattaa

SEQ ID NO: 335153 - DNA, 25 bp, Mus musculus
catttgtgatgggttatggaattaa

SEQ ID NO: 335154 - DNA, 25 bp, Mus musculus
catttgtgccaaagtattactgtag

SEQ ID NO: 335155 - DNA, 25 bp, Mus musculus
catttgtgccaatgtattactgtag

SEQ ID NO: 335156 - DNA, 25 bp, Mus musculus
catttgtgccttctcttcatagtca

SEQ ID NO: 335157 - DNA, 25 bp, Mus musculus
catttgtgccttgtcttcatagtca

SEQ ID NO: 335158 - DNA, 25 bp, Mus musculus
catttgtgggtgctgaaagctccta

SEQ ID NO: 335159 - DNA, 25 bp, Mus musculus
catttgtgggtggtgaaagctccta

SEQ ID NO: 335160 - DNA, 25 bp, Mus musculus
catttgtggtggctaattgccttca

SEQ ID NO: 335161 - DNA, 25 bp, Mus musculus
catttgtggtgggtaattgccttca

SEQ ID NO: 335162 - DNA, 25 bp, Mus musculus
catttgtgtgagatacctgcccacc

SEQ ID NO: 335163 - DNA, 25 bp, Mus musculus
catttgtgtgagttacctgcccacc

SEQ ID NO: 335164 - DNA, 25 bp, Mus musculus
catttgtgttgtctagctttgctca

SEQ ID NO: 335165 - DNA, 25 bp, Mus musculus
catttgtgttgtgtagctttgctca

SEQ ID NO: 335166 - DNA, 25 bp, Mus musculus
catttgttaggcctttgccctttag

SEQ ID NO: 335167 - DNA, 25 bp, Mus musculus
catttgttaggcgtttgccctttag

SEQ ID NO: 335168 - DNA, 25 bp, Mus musculus
catttgttatatagctcactaccac

SEQ ID NO: 335169 - DNA, 25 bp, Mus musculus
catttgttatattgctcactaccac

SEQ ID NO: 335170 - DNA, 25 bp, Mus musculus
catttgttcaaaaccctatgatgct

SEQ ID NO: 335171 - DNA, 25 bp, Mus musculus
catttgttcaaatccctatgatgct

SEQ ID NO: 335172 - DNA, 25 bp, Mus musculus
catttgttcattagtacaggacagt

SEQ ID NO: 335173 - DNA, 25 bp, Mus musculus
catttgttcatttgtacaggacagt

SEQ ID NO: 335174 - DNA, 25 bp, Mus musculus
catttgttgactaattttgttgttc

SEQ ID NO: 335175 - DNA, 25 bp, Mus musculus
catttgttgacttattttgttgttc

SEQ ID NO: 335176 - DNA, 25 bp, Mus musculus
catttgttggttctcgggaaaatag

SEQ ID NO: 335177 - DNA, 25 bp, Mus musculus
catttgttggttgtcgggaaaatag

SEQ ID NO: 335178 - DNA, 25 bp, Mus musculus
catttgtttatacaccagttggctg

SEQ ID NO: 335179 - DNA, 25 bp, Mus musculus
catttgtttatagaccagttggctg

SEQ ID NO: 335180 - DNA, 25 bp, Mus musculus
catttgtttatgacaagggtctgaa

SEQ ID NO: 335181 - DNA, 25 bp, Mus musculus
catttgtttatgtcaagggtctgaa

SEQ ID NO: 335182 - DNA, 25 bp, Mus musculus
catttgtttgaccagggaacttcta

SEQ ID NO: 335183 - DNA, 25 bp, Mus musculus
catttgtttgacgagggaacttcta

SEQ ID NO: 335184 - DNA, 25 bp, Mus musculus
catttgtttgttcggttctgagctt

SEQ ID NO: 335185 - DNA, 25 bp, Mus musculus
catttgtttgttgggttctgagctt

SEQ ID NO: 335186 - DNA, 25 bp, Mus musculus
catttgttttcactggcagttttta

SEQ ID NO: 335187 - DNA, 25 bp, Mus musculus
catttgttttcagtggcagttttta

SEQ ID NO: 335188 - DNA, 25 bp, Mus musculus
catttgttttccaatgatgtgtatt

SEQ ID NO: 335189 - DNA, 25 bp, Mus musculus
catttgttttcctatgatgtgtatt

SEQ ID NO: 335190 - DNA, 25 bp, Mus musculus
catttgttttgaatagctggttttc

SEQ ID NO: 335191 - DNA, 25 bp, Mus musculus
catttgttttgattagctggttttc

SEQ ID NO: 335192 - DNA, 25 bp, Mus musculus
catttgttttgcatggctttttctc

SEQ ID NO: 335193 - DNA, 25 bp, Mus musculus
catttgttttgcttggctttttctc

SEQ ID NO: 335194 - DNA, 25 bp, Mus musculus
cattttaaatccacacggcggcgtt

SEQ ID NO: 335195 - DNA, 25 bp, Mus musculus
cattttaaatcctcacggcggcgtt

SEQ ID NO: 335196 - DNA, 25 bp, Mus musculus
cattttaactgactgtgggaagata

SEQ ID NO: 335197 - DNA, 25 bp, Mus musculus
cattttaactgagtgtgggaagata

SEQ ID NO: 335198 - DNA, 25 bp, Mus musculus
cattttaagcacattccccggaagg

SEQ ID NO: 335199 - DNA, 25 bp, Mus musculus
cattttaagcactttccccggaagg

SEQ ID NO: 335200 - DNA, 25 bp, Mus musculus
cattttaagctacattttaccctga

SEQ ID NO: 335201 - DNA, 25 bp, Mus musculus
cattttaagctagattttaccctga

SEQ ID NO: 335202 - DNA, 25 bp, Mus musculus
cattttaagtgcattttgcctctac

SEQ ID NO: 335203 - DNA, 25 bp, Mus musculus
cattttaagtgctttttgcctctac

SEQ ID NO: 335204 - DNA, 25 bp, Mus musculus
cattttaatgaaacgggtgaactta

SEQ ID NO: 335205 - DNA, 25 bp, Mus musculus
cattttaatgaatcgggtgaactta

SEQ ID NO: 335206 - DNA, 25 bp, Mus musculus
cattttaatttgattgttagctttc

SEQ ID NO: 335207 - DNA, 25 bp, Mus musculus
cattttaatttgtttgttagctttc

SEQ ID NO: 335208 - DNA, 25 bp, Mus musculus
cattttactcccacattgatgttta

SEQ ID NO: 335209 - DNA, 25 bp, Mus musculus
cattttactccctcattgatgttta

SEQ ID NO: 335210 - DNA, 25 bp, Mus musculus
cattttagcctgaggtcttgccaga

SEQ ID NO: 335211 - DNA, 25 bp, Mus musculus
cattttagcctgtggtcttgccaga

SEQ ID NO: 335212 - DNA, 25 bp, Mus musculus
cattttaggaaaacactggagtcaa

SEQ ID NO: 335213 - DNA, 25 bp, Mus musculus
cattttaggaaatcactggagtcaa

SEQ ID NO: 335214 - DNA, 25 bp, Mus musculus
cattttaggatcattcatatctgga

SEQ ID NO: 335215 - DNA, 25 bp, Mus musculus
cattttaggatctttcatatctgga

SEQ ID NO: 335216 - DNA, 25 bp, Mus musculus
cattttatccccagagagtttgact

SEQ ID NO: 335217 - DNA, 25 bp, Mus musculus
cattttatcccctgagagtttgact

SEQ ID NO: 335218 - DNA, 25 bp, Mus musculus
cattttatgaacctgacactgctga

SEQ ID NO: 335219 - DNA, 25 bp, Mus musculus
cattttatgaacgtgacactgctga

SEQ ID NO: 335220 - DNA, 25 bp, Mus musculus
cattttatggctccacatgttggaa

SEQ ID NO: 335221 - DNA, 25 bp, Mus musculus
cattttatggctgcacatgttggaa

SEQ ID NO: 335222 - DNA, 25 bp, Mus musculus
cattttatggttcagcgaaaccgca

SEQ ID NO: 335223 - DNA, 25 bp, Mus musculus
cattttatggttgagcgaaaccgca

SEQ ID NO: 335224 - DNA, 25 bp, Mus musculus
cattttatgtgccactgtgtttgat

SEQ ID NO: 335225 - DNA, 25 bp, Mus musculus
cattttatgtgcgactgtgtttgat

SEQ ID NO: 335226 - DNA, 25 bp, Mus musculus
cattttattcaaagagtgggcatta

SEQ ID NO: 335227 - DNA, 25 bp, Mus musculus
cattttattcaatgagtgggcatta

SEQ ID NO: 335228 - DNA, 25 bp, Mus musculus
cattttatttaaatgctcccttcct

SEQ ID NO: 335229 - DNA, 25 bp, Mus musculus
cattttatttaattgctcccttcct

SEQ ID NO: 335230 - DNA, 25 bp, Mus musculus
cattttatttatctggctcatttta

SEQ ID NO: 335231 - DNA, 25 bp, Mus musculus
cattttatttatgtggctcatttta

SEQ ID NO: 335232 - DNA, 25 bp, Mus musculus
cattttattttcaacagctgcctaa

SEQ ID NO: 335233 - DNA, 25 bp, Mus musculus
cattttattttctacagctgcctaa

SEQ ID NO: 335234 - DNA, 25 bp, Mus musculus
cattttcaagctctgtaaagtgcaa

SEQ ID NO: 335235 - DNA, 25 bp, Mus musculus
cattttcaagctgtgtaaagtgcaa

SEQ ID NO: 335236 - DNA, 25 bp, Mus musculus
cattttcaatgccaactttctccta

SEQ ID NO: 335237 - DNA, 25 bp, Mus musculus
cattttcaatgcgaactttctccta

SEQ ID NO: 335238 - DNA, 25 bp, Mus musculus
cattttcaatttatagctgctacta

SEQ ID NO: 335239 - DNA, 25 bp, Mus musculus
cattttcaatttttagctgctacta

SEQ ID NO: 335240 - DNA, 25 bp, Mus musculus
cattttcacagcatggagaagatag

SEQ ID NO: 335241 - DNA, 25 bp, Mus musculus
cattttcacagcttggagaagatag

SEQ ID NO: 335242 - DNA, 25 bp, Mus musculus
cattttcaccagatgcttattattg

SEQ ID NO: 335243 - DNA, 25 bp, Mus musculus
cattttcaccagttgcttattattg

SEQ ID NO: 335244 - DNA, 25 bp, Mus musculus
cattttcactgacccaattgtagag

SEQ ID NO: 335245 - DNA, 25 bp, Mus musculus
cattttcactgagccaattgtagag

SEQ ID NO: 335246 - DNA, 25 bp, Mus musculus
cattttcagagactgagtactccca

SEQ ID NO: 335247 - DNA, 25 bp, Mus musculus
cattttcagagagtgagtactccca

SEQ ID NO: 335248 - DNA, 25 bp, Mus musculus
cattttcaggctatcttctttatca

SEQ ID NO: 335249 - DNA, 25 bp, Mus musculus
cattttcaggctttcttctttatca

SEQ ID NO: 335250 - DNA, 25 bp, Mus musculus
cattttcataccctcggatttcaac

SEQ ID NO: 335251 - DNA, 25 bp, Mus musculus
cattttcataccgtcggatttcaac

SEQ ID NO: 335252 - DNA, 25 bp, Mus musculus
cattttcatattccgttgctcacac

SEQ ID NO: 335253 - DNA, 25 bp, Mus musculus
cattttcatattgcgttgctcacac

SEQ ID NO: 335254 - DNA, 25 bp, Mus musculus
cattttcatgtaaggcagtgcctgt

SEQ ID NO: 335255 - DNA, 25 bp, Mus musculus
cattttcatgtatggcagtgcctgt

SEQ ID NO: 335256 - DNA, 25 bp, Mus musculus
cattttcatgtgacccagacccttc

SEQ ID NO: 335257 - DNA, 25 bp, Mus musculus
cattttcatgtgtcccagacccttc

SEQ ID NO: 335258 - DNA, 25 bp, Mus musculus
cattttcatgttctgcctgttttca

SEQ ID NO: 335259 - DNA, 25 bp, Mus musculus
cattttcatgttgtgcctgttttca

SEQ ID NO: 335260 - DNA, 25 bp, Mus musculus
cattttcattttagccttttactca

SEQ ID NO: 335261 - DNA, 25 bp, Mus musculus
cattttcatttttgccttttactca

SEQ ID NO: 335262 - DNA, 25 bp, Mus musculus
cattttccaaccatcctttttatat

SEQ ID NO: 335263 - DNA, 25 bp, Mus musculus
cattttccaaccttcctttttatat

SEQ ID NO: 335264 - DNA, 25 bp, Mus musculus
cattttccaatgagcttattagcag

SEQ ID NO: 335265 - DNA, 25 bp, Mus musculus
cattttccaatgtgcttattagcag

SEQ ID NO: 335266 - DNA, 25 bp, Mus musculus
cattttccacttcgaaccacaggga

SEQ ID NO: 335267 - DNA, 25 bp, Mus musculus
cattttccacttggaaccacaggga

SEQ ID NO: 335268 - DNA, 25 bp, Mus musculus
cattttccagcaaaagagatgcgtg

SEQ ID NO: 335269 - DNA, 25 bp, Mus musculus
cattttccagcataagagatgcgtg

SEQ ID NO: 335270 - DNA, 25 bp, Mus musculus
cattttccatcacctggcagcaacg

SEQ ID NO: 335271 - DNA, 25 bp, Mus musculus
cattttccatcagctggcagcaacg

SEQ ID NO: 335272 - DNA, 25 bp, Mus musculus
cattttccatgtcagttccctttaa

SEQ ID NO: 335273 - DNA, 25 bp, Mus musculus
cattttccatgtgagttccctttaa

SEQ ID NO: 335274 - DNA, 25 bp, Mus musculus
cattttccattcagttttgagggtt

SEQ ID NO: 335275 - DNA, 25 bp, Mus musculus
cattttccattctgttttgagggtt

SEQ ID NO: 335276 - DNA, 25 bp, Mus musculus
cattttcccagcactgtttgttgaa

SEQ ID NO: 335277 - DNA, 25 bp, Mus musculus
cattttcccagctctgtttgttgaa

SEQ ID NO: 335278 - DNA, 25 bp, Mus musculus
cattttcccatcatcctttgttctg

SEQ ID NO: 335279 - DNA, 25 bp, Mus musculus
cattttcccatcttcctttgttctg

SEQ ID NO: 335280 - DNA, 25 bp, Mus musculus
cattttcccctgaggtacatcttta

SEQ ID NO: 335281 - DNA, 25 bp, Mus musculus
cattttcccctgtggtacatcttta

SEQ ID NO: 335282 - DNA, 25 bp, Mus musculus
cattttccctgtacgtgggtggaag

SEQ ID NO: 335283 - DNA, 25 bp, Mus musculus
cattttccctgttcgtgggtggaag

SEQ ID NO: 335284 - DNA, 25 bp, Mus musculus
cattttcccttaccccttcagcttg

SEQ ID NO: 335285 - DNA, 25 bp, Mus musculus
cattttcccttagcccttcagcttg

SEQ ID NO: 335286 - DNA, 25 bp, Mus musculus
cattttcccttgcacagggttgaca

SEQ ID NO: 335287 - DNA, 25 bp, Mus musculus
cattttcccttggacagggttgaca

SEQ ID NO: 335288 - DNA, 25 bp, Mus musculus
cattttccctttacttatggtggag

SEQ ID NO: 335289 - DNA, 25 bp, Mus musculus
cattttcccttttcttatggtggag

SEQ ID NO: 335290 - DNA, 25 bp, Mus musculus
cattttccgacactacaccaagttt

SEQ ID NO: 335291 - DNA, 25 bp, Mus musculus
cattttccgacagtacaccaagttt

SEQ ID NO: 335292 - DNA, 25 bp, Mus musculus
cattttcctagcaaaatatccagaa

SEQ ID NO: 335293 - DNA, 25 bp, Mus musculus
cattttcctagctaaatatccagaa

SEQ ID NO: 335294 - DNA, 25 bp, Mus musculus
cattttcctaggctttcgggaatgt

SEQ ID NO: 335295 - DNA, 25 bp, Mus musculus
cattttcctagggtttcgggaatgt

SEQ ID NO: 335296 - DNA, 25 bp, Mus musculus
cattttcctcacaacctccagctgg

SEQ ID NO: 335297 - DNA, 25 bp, Mus musculus
cattttcctcactacctccagctgg

SEQ ID NO: 335298 - DNA, 25 bp, Mus musculus
cattttcctgatagaacggtgtctt

SEQ ID NO: 335299 - DNA, 25 bp, Mus musculus
cattttcctgatagatgcttcgtgg

SEQ ID NO: 335300 - DNA, 25 bp, Mus musculus
cattttcctgattgaacggtgtctt

SEQ ID NO: 335301 - DNA, 25 bp, Mus musculus
cattttcctgattgatgcttcgtgg

SEQ ID NO: 335302 - DNA, 25 bp, Mus musculus
cattttcctgcgagcttaagattac

SEQ ID NO: 335303 - DNA, 25 bp, Mus musculus
cattttcctgcgtgcttaagattac

SEQ ID NO: 335304 - DNA, 25 bp, Mus musculus
cattttcctgttagttctctgcaca

SEQ ID NO: 335305 - DNA, 25 bp, Mus musculus
cattttcctgtttgttctctgcaca

SEQ ID NO: 335306 - DNA, 25 bp, Mus musculus
cattttccttctcacaaagaagagg

SEQ ID NO: 335307 - DNA, 25 bp, Mus musculus
cattttccttctgacaaagaagagg

SEQ ID NO: 335308 - DNA, 25 bp, Mus musculus
cattttcgtcccaatgttcagaacc

SEQ ID NO: 335309 - DNA, 25 bp, Mus musculus
cattttcgtccctatgttcagaacc

SEQ ID NO: 335310 - DNA, 25 bp, Mus musculus
cattttcgtctgctgtgttagtgga

SEQ ID NO: 335311 - DNA, 25 bp, Mus musculus
cattttcgtctggtgtgttagtgga

SEQ ID NO: 335312 - DNA, 25 bp, Mus musculus
cattttctaagtaggcacatgcact

SEQ ID NO: 335313 - DNA, 25 bp, Mus musculus
cattttctaagttggcacatgcact

SEQ ID NO: 335314 - DNA, 25 bp, Mus musculus
cattttctcacacttggtctaaaaa

SEQ ID NO: 335315 - DNA, 25 bp, Mus musculus
cattttctcacagttggtctaaaaa

SEQ ID NO: 335316 - DNA, 25 bp, Mus musculus
cattttctcatgctgtcatccttaa

SEQ ID NO: 335317 - DNA, 25 bp, Mus musculus
cattttctcatggtgtcatccttaa

SEQ ID NO: 335318 - DNA, 25 bp, Mus musculus
cattttctccgacgtcatctcagac

SEQ ID NO: 335319 - DNA, 25 bp, Mus musculus
cattttctccgaggtcatctcagac

SEQ ID NO: 335320 - DNA, 25 bp, Mus musculus
cattttctctatccattcactcaat

SEQ ID NO: 335321 - DNA, 25 bp, Mus musculus
cattttctctatgcattcactcaat

SEQ ID NO: 335322 - DNA, 25 bp, Mus musculus
cattttctctccaaactaaggtctg

SEQ ID NO: 335323 - DNA, 25 bp, Mus musculus
cattttctctccagtgactttataa

SEQ ID NO: 335324 - DNA, 25 bp, Mus musculus
cattttctctcctaactaaggtctg

SEQ ID NO: 335325 - DNA, 25 bp, Mus musculus
cattttctctcctgtgactttataa

SEQ ID NO: 335326 - DNA, 25 bp, Mus musculus
cattttctctgacccactctgaaaa

SEQ ID NO: 335327 - DNA, 25 bp, Mus musculus
cattttctctgagccactctgaaaa

SEQ ID NO: 335328 - DNA, 25 bp, Mus musculus
cattttctcttacaggttttcattt

SEQ ID NO: 335329 - DNA, 25 bp, Mus musculus
cattttctcttagaggttttcattt

SEQ ID NO: 335330 - DNA, 25 bp, Mus musculus
cattttctgaaacgttgttcaattc

SEQ ID NO: 335331 - DNA, 25 bp, Mus musculus
cattttctgaaaggttgttcaattc

SEQ ID NO: 335332 - DNA, 25 bp, Mus musculus
cattttctgataatgctgcctcgga

SEQ ID NO: 335333 - DNA, 25 bp, Mus musculus
cattttctgatattgctgcctcgga

SEQ ID NO: 335334 - DNA, 25 bp, Mus musculus
cattttctggatatctgattggtgt

SEQ ID NO: 335335 - DNA, 25 bp, Mus musculus
cattttctggatttctgattggtgt

SEQ ID NO: 335336 - DNA, 25 bp, Mus musculus
cattttctgggcagaatacagaggc

SEQ ID NO: 335337 - DNA, 25 bp, Mus musculus
cattttctgggctgaatacagaggc

SEQ ID NO: 335338 - DNA, 25 bp, Mus musculus
cattttctggtaagtcctacatccc

SEQ ID NO: 335339 - DNA, 25 bp, Mus musculus
cattttctggtatgtcctacatccc

SEQ ID NO: 335340 - DNA, 25 bp, Mus musculus
cattttctgttgactcacgatcatt

SEQ ID NO: 335341 - DNA, 25 bp, Mus musculus
cattttctgttgtctcacgatcatt

SEQ ID NO: 335342 - DNA, 25 bp, Mus musculus
cattttcttacaagcttagcacaga

SEQ ID NO: 335343 - DNA, 25 bp, Mus musculus
cattttcttacatgcttagcacaga

SEQ ID NO: 335344 - DNA, 25 bp, Mus musculus
cattttcttatactttgctgctcaa

SEQ ID NO: 335345 - DNA, 25 bp, Mus musculus
cattttcttatagtttgctgctcaa

SEQ ID NO: 335346 - DNA, 25 bp, Mus musculus
cattttcttcagatcagggcagaac

SEQ ID NO: 335347 - DNA, 25 bp, Mus musculus
cattttcttcagttcagggcagaac

SEQ ID NO: 335348 - DNA, 25 bp, Mus musculus
cattttcttcatacagcacattaag

SEQ ID NO: 335349 - DNA, 25 bp, Mus musculus
cattttcttcattcagcacattaag

SEQ ID NO: 335350 - DNA, 25 bp, Mus musculus
cattttcttcctccatcatgccatg

SEQ ID NO: 335351 - DNA, 25 bp, Mus musculus
cattttcttcctgcatcatgccatg

SEQ ID NO: 335352 - DNA, 25 bp, Mus musculus
cattttctttagctgtttcaatgag

SEQ ID NO: 335353 - DNA, 25 bp, Mus musculus
cattttctttaggtgtttcaatgag

SEQ ID NO: 335354 - DNA, 25 bp, Mus musculus
cattttctttatcgtcctcagcagc

SEQ ID NO: 335355 - DNA, 25 bp, Mus musculus
cattttctttatggtcctcagcagc

SEQ ID NO: 335356 - DNA, 25 bp, Mus musculus
cattttctttcccagaagatctgtg

SEQ ID NO: 335357 - DNA, 25 bp, Mus musculus
cattttctttccgagaagatctgtg

SEQ ID NO: 335358 - DNA, 25 bp, Mus musculus
cattttctttgtatgattgatggtc

SEQ ID NO: 335359 - DNA, 25 bp, Mus musculus
cattttctttgtttgattgatggtc

SEQ ID NO: 335360 - DNA, 25 bp, Mus musculus
cattttcttttaatgacctacccat

SEQ ID NO: 335361 - DNA, 25 bp, Mus musculus
cattttcttttattgacctacccat

SEQ ID NO: 335362 - DNA, 25 bp, Mus musculus
cattttgaaaaaactgctggcttag

SEQ ID NO: 335363 - DNA, 25 bp, Mus musculus
cattttgaaaaatctgctggcttag

SEQ ID NO: 335364 - DNA, 25 bp, Mus musculus
cattttgaaggtatgtgttgcagct

SEQ ID NO: 335365 - DNA, 25 bp, Mus musculus
cattttgaaggtttgtgttgcagct

SEQ ID NO: 335366 - DNA, 25 bp, Mus musculus
cattttgaatatatactttccacca

SEQ ID NO: 335367 - DNA, 25 bp, Mus musculus
cattttgaatatttactttccacca

SEQ ID NO: 335368 - DNA, 25 bp, Mus musculus
cattttgaatctattagtggttaca

SEQ ID NO: 335369 - DNA, 25 bp, Mus musculus
cattttgaatcttttagtggttaca

SEQ ID NO: 335370 - DNA, 25 bp, Mus musculus
cattttgacaacactgaaacgtgtt

SEQ ID NO: 335371 - DNA, 25 bp, Mus musculus
cattttgacaactctgaaacgtgtt

SEQ ID NO: 335372 - DNA, 25 bp, Mus musculus
cattttgacattctctgggactcga

SEQ ID NO: 335373 - DNA, 25 bp, Mus musculus
cattttgacattgtctgggactcga

SEQ ID NO: 335374 - DNA, 25 bp, Mus musculus
cattttgaccatcgtgaatctcagt

SEQ ID NO: 335375 - DNA, 25 bp, Mus musculus
cattttgaccatggtgaatctcagt

SEQ ID NO: 335376 - DNA, 25 bp, Mus musculus
cattttgagtttcgttgctgtgata

SEQ ID NO: 335377 - DNA, 25 bp, Mus musculus
cattttgagtttggttgctgtgata

SEQ ID NO: 335378 - DNA, 25 bp, Mus musculus
cattttgatcttcccagagcagatg

SEQ ID NO: 335379 - DNA, 25 bp, Mus musculus
cattttgatcttgccagagcagatg

SEQ ID NO: 335380 - DNA, 25 bp, Mus musculus
cattttgatggccagctctattaga

SEQ ID NO: 335381 - DNA, 25 bp, Mus musculus
cattttgatggcgagctctattaga

SEQ ID NO: 335382 - DNA, 25 bp, Mus musculus
cattttgcaatcagggtgagcggtc

SEQ ID NO: 335383 - DNA, 25 bp, Mus musculus
cattttgcaatctgggtgagcggtc

SEQ ID NO: 335384 - DNA, 25 bp, Mus musculus
cattttgccaccctgtatatttgaa

SEQ ID NO: 335385 - DNA, 25 bp, Mus musculus
cattttgccaccgtgtatatttgaa

SEQ ID NO: 335386 - DNA, 25 bp, Mus musculus
cattttgccctcactgggacaggtg

SEQ ID NO: 335387 - DNA, 25 bp, Mus musculus
cattttgccctctctgggacaggtg

SEQ ID NO: 335388 - DNA, 25 bp, Mus musculus
cattttgctcatatcaggttactaa

SEQ ID NO: 335389 - DNA, 25 bp, Mus musculus
cattttgctcatttcaggttactaa

SEQ ID NO: 335390 - DNA, 25 bp, Mus musculus
cattttgctgtgagctacttcatgc

SEQ ID NO: 335391 - DNA, 25 bp, Mus musculus
cattttgctgtgtgctacttcatgc

SEQ ID NO: 335392 - DNA, 25 bp, Mus musculus
cattttgcttaaatccggagtgtac

SEQ ID NO: 335393 - DNA, 25 bp, Mus musculus
cattttgcttaattccggagtgtac

SEQ ID NO: 335394 - DNA, 25 bp, Mus musculus
cattttggaagtcactgctgctgtt

SEQ ID NO: 335395 - DNA, 25 bp, Mus musculus
cattttggaagtgactgctgctgtt

SEQ ID NO: 335396 - DNA, 25 bp, Mus musculus
cattttggccagctcataaaaactg

SEQ ID NO: 335397 - DNA, 25 bp, Mus musculus
cattttggccagctgttcgtgagga

SEQ ID NO: 335398 - DNA, 25 bp, Mus musculus
cattttggccaggtcataaaaactg

SEQ ID NO: 335399 - DNA, 25 bp, Mus musculus
cattttggccaggtgttcgtgagga

SEQ ID NO: 335400 - DNA, 25 bp, Mus musculus
cattttggctccctggcccttttat

SEQ ID NO: 335401 - DNA, 25 bp, Mus musculus
cattttggctccgtggcccttttat

SEQ ID NO: 335402 - DNA, 25 bp, Mus musculus
cattttgggactctttttgcttcac

SEQ ID NO: 335403 - DNA, 25 bp, Mus musculus
cattttgggactgtttttgcttcac

SEQ ID NO: 335404 - DNA, 25 bp, Mus musculus
cattttgggctacggaaccctgcct

SEQ ID NO: 335405 - DNA, 25 bp, Mus musculus
cattttgggctagggaaccctgcct

SEQ ID NO: 335406 - DNA, 25 bp, Mus musculus
cattttgggtacctcccctgtgaca

SEQ ID NO: 335407 - DNA, 25 bp, Mus musculus
cattttgggtacgtcccctgtgaca

SEQ ID NO: 335408 - DNA, 25 bp, Mus musculus
cattttggtagtccctcctctggag

SEQ ID NO: 335409 - DNA, 25 bp, Mus musculus
cattttggtagtgcctcctctggag

SEQ ID NO: 335410 - DNA, 25 bp, Mus musculus
cattttggtcctcgttgtggtttat

SEQ ID NO: 335411 - DNA, 25 bp, Mus musculus
cattttggtcctggttgtggtttat

SEQ ID NO: 335412 - DNA, 25 bp, Mus musculus
cattttggtggcaggctcctttggg

SEQ ID NO: 335413 - DNA, 25 bp, Mus musculus
cattttggtggctggctcctttggg

SEQ ID NO: 335414 - DNA, 25 bp, Mus musculus
cattttggttgcagattctactttg

SEQ ID NO: 335415 - DNA, 25 bp, Mus musculus
cattttggttgctgattctactttg

SEQ ID NO: 335416 - DNA, 25 bp, Mus musculus
cattttggttggaagcctccagagt

SEQ ID NO: 335417 - DNA, 25 bp, Mus musculus
cattttggttggtagcctccagagt

SEQ ID NO: 335418 - DNA, 25 bp, Mus musculus
cattttgtaacgatttgggtttcat

SEQ ID NO: 335419 - DNA, 25 bp, Mus musculus
cattttgtaacgttttgggtttcat

SEQ ID NO: 335420 - DNA, 25 bp, Mus musculus
cattttgtaagcagctctgactagc

SEQ ID NO: 335421 - DNA, 25 bp, Mus musculus
cattttgtaagctgctctgactagc

SEQ ID NO: 335422 - DNA, 25 bp, Mus musculus
cattttgtatgtatcttatctgtgt

SEQ ID NO: 335423 - DNA, 25 bp, Mus musculus
cattttgtatgtttcttatctgtgt

SEQ ID NO: 335424 - DNA, 25 bp, Mus musculus
cattttgtattcatgcttatgtgca

SEQ ID NO: 335425 - DNA, 25 bp, Mus musculus
cattttgtattcttgcttatgtgca

SEQ ID NO: 335426 - DNA, 25 bp, Mus musculus
cattttgtgctcagctatttggcta

SEQ ID NO: 335427 - DNA, 25 bp, Mus musculus
cattttgtgctctgctatttggcta

SEQ ID NO: 335428 - DNA, 25 bp, Mus musculus
cattttgtgttcaagctgcttgtga

SEQ ID NO: 335429 - DNA, 25 bp, Mus musculus
cattttgtgttcagttggtgaggtt

SEQ ID NO: 335430 - DNA, 25 bp, Mus musculus
cattttgtgttctagctgcttgtga

SEQ ID NO: 335431 - DNA, 25 bp, Mus musculus
cattttgtgttctgttggtgaggtt

SEQ ID NO: 335432 - DNA, 25 bp, Mus musculus
cattttgtgtttaaggtcaatttgt

SEQ ID NO: 335433 - DNA, 25 bp, Mus musculus
cattttgtgttttaggtcaatttgt

SEQ ID NO: 335434 - DNA, 25 bp, Mus musculus
cattttgttctaatggtctcttgtc

SEQ ID NO: 335435 - DNA, 25 bp, Mus musculus
cattttgttctattggtctcttgtc

SEQ ID NO: 335436 - DNA, 25 bp, Mus musculus
cattttgttctcctagtttgcaggt

SEQ ID NO: 335437 - DNA, 25 bp, Mus musculus
cattttgttctcgtagtttgcaggt

SEQ ID NO: 335438 - DNA, 25 bp, Mus musculus
cattttgttcttatgtgacacaaac

SEQ ID NO: 335439 - DNA, 25 bp, Mus musculus
cattttgttcttttgtgacacaaac

SEQ ID NO: 335440 - DNA, 25 bp, Mus musculus
catttttaaaagatggtgcctcaga

SEQ ID NO: 335441 - DNA, 25 bp, Mus musculus
catttttaaaagttggtgcctcaga

SEQ ID NO: 335442 - DNA, 25 bp, Mus musculus
catttttaatgtaattcgctgcaaa

SEQ ID NO: 335443 - DNA, 25 bp, Mus musculus
catttttaatgttattcgctgcaaa

SEQ ID NO: 335444 - DNA, 25 bp, Mus musculus
catttttaccttatcatctagacca

SEQ ID NO: 335445 - DNA, 25 bp, Mus musculus
catttttaccttttcatctagacca

SEQ ID NO: 335446 - DNA, 25 bp, Mus musculus
catttttactttccaacatatgtat

SEQ ID NO: 335447 - DNA, 25 bp, Mus musculus
catttttactttgcaacatatgtat

SEQ ID NO: 335448 - DNA, 25 bp, Mus musculus
catttttagacactacatcacctct

SEQ ID NO: 335449 - DNA, 25 bp, Mus musculus
catttttagacagtacatcacctct

SEQ ID NO: 335450 - DNA, 25 bp, Mus musculus
catttttagattcgcttgtccttta

SEQ ID NO: 335451 - DNA, 25 bp, Mus musculus
catttttagattggcttgtccttta

SEQ ID NO: 335452 - DNA, 25 bp, Mus musculus
catttttatactcttcaggacataa

SEQ ID NO: 335453 - DNA, 25 bp, Mus musculus
catttttatactgttcaggacataa

SEQ ID NO: 335454 - DNA, 25 bp, Mus musculus
catttttatcataccaacttgccaa

SEQ ID NO: 335455 - DNA, 25 bp, Mus musculus
catttttatcattccaacttgccaa

SEQ ID NO: 335456 - DNA, 25 bp, Mus musculus
catttttatcctctagacccttaag

SEQ ID NO: 335457 - DNA, 25 bp, Mus musculus
catttttatcctgtagacccttaag

SEQ ID NO: 335458 - DNA, 25 bp, Mus musculus
catttttattgcctcagcccataga

SEQ ID NO: 335459 - DNA, 25 bp, Mus musculus
catttttattgcgtcagcccataga

SEQ ID NO: 335460 - DNA, 25 bp, Mus musculus
catttttatttaccaccaggaaagg

SEQ ID NO: 335461 - DNA, 25 bp, Mus musculus
catttttatttagcaccaggaaagg

SEQ ID NO: 335462 - DNA, 25 bp, Mus musculus
catttttcaaatcccctgatctgtt

SEQ ID NO: 335463 - DNA, 25 bp, Mus musculus
catttttcaaatgccctgatctgtt

SEQ ID NO: 335464 - DNA, 25 bp, Mus musculus
catttttcaatgaacccgagaccaa

SEQ ID NO: 335465 - DNA, 25 bp, Mus musculus
catttttcaatgtacccgagaccaa

SEQ ID NO: 335466 - DNA, 25 bp, Mus musculus
catttttcagaaagccggagccggc

SEQ ID NO: 335467 - DNA, 25 bp, Mus musculus
catttttcagaatgccggagccggc

SEQ ID NO: 335468 - DNA, 25 bp, Mus musculus
catttttccatgatgtcttgatttt

SEQ ID NO: 335469 - DNA, 25 bp, Mus musculus
catttttccatgttgtcttgatttt

SEQ ID NO: 335470 - DNA, 25 bp, Mus musculus
catttttcccttctagttcagcttt

SEQ ID NO: 335471 - DNA, 25 bp, Mus musculus
catttttcccttgtagttcagcttt

SEQ ID NO: 335472 - DNA, 25 bp, Mus musculus
catttttctaccacacgcatagtca

SEQ ID NO: 335473 - DNA, 25 bp, Mus musculus
catttttctacctcacgcatagtca

SEQ ID NO: 335474 - DNA, 25 bp, Mus musculus
catttttctgttaattggccattac

SEQ ID NO: 335475 - DNA, 25 bp, Mus musculus
catttttctgtttattggccattac

SEQ ID NO: 335476 - DNA, 25 bp, Mus musculus
catttttcttgcatcaccagtgtaa

SEQ ID NO: 335477 - DNA, 25 bp, Mus musculus
catttttcttgcttcaccagtgtaa

SEQ ID NO: 335478 - DNA, 25 bp, Mus musculus
catttttgaataatgggttgactgt

SEQ ID NO: 335479 - DNA, 25 bp, Mus musculus
catttttgaatattgggttgactgt

SEQ ID NO: 335480 - DNA, 25 bp, Mus musculus
catttttgcatcaagttctctccgc

SEQ ID NO: 335481 - DNA, 25 bp, Mus musculus
catttttgcatctagttctctccgc

SEQ ID NO: 335482 - DNA, 25 bp, Mus musculus
catttttgccccattgttctaagag

SEQ ID NO: 335483 - DNA, 25 bp, Mus musculus
catttttgcccctttgttctaagag

SEQ ID NO: 335484 - DNA, 25 bp, Mus musculus
catttttgctgtaccaggaaattct

SEQ ID NO: 335485 - DNA, 25 bp, Mus musculus
catttttgctgttccaggaaattct

SEQ ID NO: 335486 - DNA, 25 bp, Mus musculus
catttttgctttcaccagtgggaaa

SEQ ID NO: 335487 - DNA, 25 bp, Mus musculus
catttttgctttgaccagtgggaaa

SEQ ID NO: 335488 - DNA, 25 bp, Mus musculus
catttttggaggatctggtgtttgt

SEQ ID NO: 335489 - DNA, 25 bp, Mus musculus
catttttggaggttctggtgtttgt

SEQ ID NO: 335490 - DNA, 25 bp, Mus musculus
catttttggatgacaggcgggaaac

SEQ ID NO: 335491 - DNA, 25 bp, Mus musculus
catttttggatgtcaggcgggaaac

SEQ ID NO: 335492 - DNA, 25 bp, Mus musculus
catttttggtataggttgcttcatt

SEQ ID NO: 335493 - DNA, 25 bp, Mus musculus
catttttggtattggttgcttcatt

SEQ ID NO: 335494 - DNA, 25 bp, Mus musculus
catttttggtgcagtttacattttc

SEQ ID NO: 335495 - DNA, 25 bp, Mus musculus
catttttggtgctgtttacattttc

SEQ ID NO: 335496 - DNA, 25 bp, Mus musculus
catttttgtagtaaacagaacactg

SEQ ID NO: 335497 - DNA, 25 bp, Mus musculus
catttttgtagttaacagaacactg

SEQ ID NO: 335498 - DNA, 25 bp, Mus musculus
catttttgtgcgaagaaagggaaga

SEQ ID NO: 335499 - DNA, 25 bp, Mus musculus
catttttgtgcgtagaaagggaaga

SEQ ID NO: 335500 - DNA, 25 bp, Mus musculus
catttttgtggactagtttgcagtg

SEQ ID NO: 335501 - DNA, 25 bp, Mus musculus
catttttgtggagtagtttgcagtg

SEQ ID NO: 335502 - DNA, 25 bp, Mus musculus
catttttgtgttcatttaggcaccc

SEQ ID NO: 335503 - DNA, 25 bp, Mus musculus
catttttgtgttgatttaggcaccc

SEQ ID NO: 335504 - DNA, 25 bp, Mus musculus
cattttttacatctgctatttgcaa

SEQ ID NO: 335505 - DNA, 25 bp, Mus musculus
cattttttacatgtgctatttgcaa

SEQ ID NO: 335506 - DNA, 25 bp, Mus musculus
cattttttagataggcataagcact

SEQ ID NO: 335507 - DNA, 25 bp, Mus musculus
cattttttagattggcataagcact

SEQ ID NO: 335508 - DNA, 25 bp, Mus musculus
cattttttaggaaccacttgtgcat

SEQ ID NO: 335509 - DNA, 25 bp, Mus musculus
cattttttaggatccacttgtgcat

SEQ ID NO: 335510 - DNA, 25 bp, Mus musculus
cattttttcaagaatttcctagtcg

SEQ ID NO: 335511 - DNA, 25 bp, Mus musculus
cattttttcaagtatttcctagtcg

SEQ ID NO: 335512 - DNA, 25 bp, Mus musculus
cattttttcctactgcatgagaaat

SEQ ID NO: 335513 - DNA, 25 bp, Mus musculus
cattttttcctagtgcatgagaaat

SEQ ID NO: 335514 - DNA, 25 bp, Mus musculus
cattttttggtgaccgtttgtattg

SEQ ID NO: 335515 - DNA, 25 bp, Mus musculus
cattttttggtgtccgtttgtattg

SEQ ID NO: 335516 - DNA, 25 bp, Mus musculus
cattttttgtgcatatttgcctcaa

SEQ ID NO: 335517 - DNA, 25 bp, Mus musculus
cattttttgtgcttatttgcctcaa

SEQ ID NO: 335518 - DNA, 25 bp, Mus musculus
ccaaaaacaacaaatgcgaggactt

SEQ ID NO: 335519 - DNA, 25 bp, Mus musculus
ccaaaaacaacatatgcgaggactt

SEQ ID NO: 335520 - DNA, 25 bp, Mus musculus
ccaaaaagcacaaggtagccctaag

SEQ ID NO: 335521 - DNA, 25 bp, Mus musculus
ccaaaaagcacatggtagccctaag

SEQ ID NO: 335522 - DNA, 25 bp, Mus musculus
ccaaaaagcggcagggagcaaacca

SEQ ID NO: 335523 - DNA, 25 bp, Mus musculus
ccaaaaagcggctgggagcaaacca

SEQ ID NO: 335524 - DNA, 25 bp, Mus musculus
ccaaaaaggaggagctttcaggcct

SEQ ID NO: 335525 - DNA, 25 bp, Mus musculus
ccaaaaaggaggtgctttcaggcct

SEQ ID NO: 335526 - DNA, 25 bp, Mus musculus
ccaaaaatattaactgtcggccaag

SEQ ID NO: 335527 - DNA, 25 bp, Mus musculus
ccaaaaatattatctgtcggccaag

SEQ ID NO: 335528 - DNA, 25 bp, Mus musculus
ccaaaacatggaacgaagtctcagg

SEQ ID NO: 335529 - DNA, 25 bp, Mus musculus
ccaaaacatggatcgaagtctcagg

SEQ ID NO: 335530 - DNA, 25 bp, Mus musculus
ccaaaacgctgtacggtgacaccgg

SEQ ID NO: 335531 - DNA, 25 bp, Mus musculus
ccaaaacgctgttcggtgacaccgg

SEQ ID NO: 335532 - DNA, 25 bp, Mus musculus
ccaaaacttcctatatgcactcatt

SEQ ID NO: 335533 - DNA, 25 bp, Mus musculus
ccaaaacttcctttatgcactcatt

SEQ ID NO: 335534 - DNA, 25 bp, Mus musculus
ccaaaagaatggagtctgggagttt

SEQ ID NO: 335535 - DNA, 25 bp, Mus musculus
ccaaaagaatggtgtctgggagttt

SEQ ID NO: 335536 - DNA, 25 bp, Mus musculus
ccaaaaggctgaaagcgcttagctt

SEQ ID NO: 335537 - DNA, 25 bp, Mus musculus
ccaaaaggctgatagcgcttagctt

SEQ ID NO: 335538 - DNA, 25 bp, Mus musculus
ccaaaaggtcacaccattctcaaga

SEQ ID NO: 335539 - DNA, 25 bp, Mus musculus
ccaaaaggtcactccattctcaaga

SEQ ID NO: 335540 - DNA, 25 bp, Mus musculus
ccaaaaggttgtcctatcccgattt

SEQ ID NO: 335541 - DNA, 25 bp, Mus musculus
ccaaaaggttgtgctatcccgattt

SEQ ID NO: 335542 - DNA, 25 bp, Mus musculus
ccaaaagtcctcaaatgtgtagttg

SEQ ID NO: 335543 - DNA, 25 bp, Mus musculus
ccaaaagtcctcctgagtctccggg

SEQ ID NO: 335544 - DNA, 25 bp, Mus musculus
ccaaaagtcctcgtgagtctccggg

SEQ ID NO: 335545 - DNA, 25 bp, Mus musculus
ccaaaagtcctctaatgtgtagttg

SEQ ID NO: 335546 - DNA, 25 bp, Mus musculus
ccaaaataagtcctcttccttctag

SEQ ID NO: 335547 - DNA, 25 bp, Mus musculus
ccaaaataagtcgtcttccttctag

SEQ ID NO: 335548 - DNA, 25 bp, Mus musculus
ccaaaatcacgcaaacatcacagag

SEQ ID NO: 335549 - DNA, 25 bp, Mus musculus
ccaaaatcacgctaacatcacagag

SEQ ID NO: 335550 - DNA, 25 bp, Mus musculus
ccaaaatgaagtcctccaggacagt

SEQ ID NO: 335551 - DNA, 25 bp, Mus musculus
ccaaaatgaagtgctccaggacagt

SEQ ID NO: 335552 - DNA, 25 bp, Mus musculus
ccaaaatggcctagaaatttcgatc

SEQ ID NO: 335553 - DNA, 25 bp, Mus musculus
ccaaaatggcctcggttctgtggga

SEQ ID NO: 335554 - DNA, 25 bp, Mus musculus
ccaaaatggcctgggttctgtggga

SEQ ID NO: 335555 - DNA, 25 bp, Mus musculus
ccaaaatggccttgaaatttcgatc

SEQ ID NO: 335556 - DNA, 25 bp, Mus musculus
ccaaaattatctctgcatgctgaag

SEQ ID NO: 335557 - DNA, 25 bp, Mus musculus
ccaaaattatctgtgcatgctgaag

SEQ ID NO: 335558 - DNA, 25 bp, Mus musculus
ccaaacaacacacagggaggccatt

SEQ ID NO: 335559 - DNA, 25 bp, Mus musculus
ccaaacaacacagagggaggccatt

SEQ ID NO: 335560 - DNA, 25 bp, Mus musculus
ccaaacacaaacagggttgcgtgct

SEQ ID NO: 335561 - DNA, 25 bp, Mus musculus
ccaaacacaaactgggttgcgtgct

SEQ ID NO: 335562 - DNA, 25 bp, Mus musculus
ccaaacactaaccttgtttatctgg

SEQ ID NO: 335563 - DNA, 25 bp, Mus musculus
ccaaacactaacgttgtttatctgg

SEQ ID NO: 335564 - DNA, 25 bp, Mus musculus
ccaaacacttgccaggagctagtct

SEQ ID NO: 335565 - DNA, 25 bp, Mus musculus
ccaaacacttgcgaggagctagtct

SEQ ID NO: 335566 - DNA, 25 bp, Mus musculus
ccaaacagttctatccttgatggga

SEQ ID NO: 335567 - DNA, 25 bp, Mus musculus
ccaaacagttctttccttgatggga

SEQ ID NO: 335568 - DNA, 25 bp, Mus musculus
ccaaacatattgaagccaccacact

SEQ ID NO: 335569 - DNA, 25 bp, Mus musculus
ccaaacatattgtagccaccacact

SEQ ID NO: 335570 - DNA, 25 bp, Mus musculus
ccaaacatgttcattttggtcacta

SEQ ID NO: 335571 - DNA, 25 bp, Mus musculus
ccaaacatgttctttttggtcacta

SEQ ID NO: 335572 - DNA, 25 bp, Mus musculus
ccaaacattggtcgacatctgcagc

SEQ ID NO: 335573 - DNA, 25 bp, Mus musculus
ccaaacattggtggacatctgcagc

SEQ ID NO: 335574 - DNA, 25 bp, Mus musculus
ccaaaccaaaggcaactgggcctgg

SEQ ID NO: 335575 - DNA, 25 bp, Mus musculus
ccaaaccaaagggaactgggcctgg

SEQ ID NO: 335576 - DNA, 25 bp, Mus musculus
ccaaaccaactcatctggcgaattt

SEQ ID NO: 335577 - DNA, 25 bp, Mus musculus
ccaaaccaactcttctggcgaattt

SEQ ID NO: 335578 - DNA, 25 bp, Mus musculus
ccaaaccagatgagatcttcaagtt

SEQ ID NO: 335579 - DNA, 25 bp, Mus musculus
ccaaaccagatgtgatcttcaagtt

SEQ ID NO: 335580 - DNA, 25 bp, Mus musculus
ccaaaccagcaacggcagttcaaga

SEQ ID NO: 335581 - DNA, 25 bp, Mus musculus
ccaaaccagcaagggcagttcaaga

SEQ ID NO: 335582 - DNA, 25 bp, Mus musculus
ccaaaccatctccaggtcggtgaaa

SEQ ID NO: 335583 - DNA, 25 bp, Mus musculus
ccaaaccatctcgaggtcggtgaaa

SEQ ID NO: 335584 - DNA, 25 bp, Mus musculus
ccaaaccattatatgtccaaggaca

SEQ ID NO: 335585 - DNA, 25 bp, Mus musculus
ccaaaccattatttgtccaaggaca

SEQ ID NO: 335586 - DNA, 25 bp, Mus musculus
ccaaacccagacactatggaagatg

SEQ ID NO: 335587 - DNA, 25 bp, Mus musculus
ccaaacccagactctatggaagatg

SEQ ID NO: 335588 - DNA, 25 bp, Mus musculus
ccaaaccccaagcttcagtatttag

SEQ ID NO: 335589 - DNA, 25 bp, Mus musculus
ccaaaccccaaggttcagtatttag

SEQ ID NO: 335590 - DNA, 25 bp, Mus musculus
ccaaaccctcttcaacacaaatggt

SEQ ID NO: 335591 - DNA, 25 bp, Mus musculus
ccaaaccctcttgaacacaaatggt

SEQ ID NO: 335592 - DNA, 25 bp, Mus musculus
ccaaaccctggtcgaacattgagtt

SEQ ID NO: 335593 - DNA, 25 bp, Mus musculus
ccaaaccctggtggaacattgagtt

SEQ ID NO: 335594 - DNA, 25 bp, Mus musculus
ccaaaccctttccaatgctatgcaa

SEQ ID NO: 335595 - DNA, 25 bp, Mus musculus
ccaaaccctttcgaatgctatgcaa

SEQ ID NO: 335596 - DNA, 25 bp, Mus musculus
ccaaaccggcaacatattaatcaac

SEQ ID NO: 335597 - DNA, 25 bp, Mus musculus
ccaaaccggcaagatattaatcaac

SEQ ID NO: 335598 - DNA, 25 bp, Mus musculus
ccaaacctcatgacatatgcagctc

SEQ ID NO: 335599 - DNA, 25 bp, Mus musculus
ccaaacctcatgtcatatgcagctc

SEQ ID NO: 335600 - DNA, 25 bp, Mus musculus
ccaaacgctggaagggtgtgattca

SEQ ID NO: 335601 - DNA, 25 bp, Mus musculus
ccaaacgctggatgggtgtgattca

SEQ ID NO: 335602 - DNA, 25 bp, Mus musculus
ccaaacgtgcagatgctgggcggac

SEQ ID NO: 335603 - DNA, 25 bp, Mus musculus
ccaaacgtgcagttgctgggcggac

SEQ ID NO: 335604 - DNA, 25 bp, Mus musculus
ccaaacgtgtttcacaaggaccata

SEQ ID NO: 335605 - DNA, 25 bp, Mus musculus
ccaaacgtgtttgacaaggaccata

SEQ ID NO: 335606 - DNA, 25 bp, Mus musculus
ccaaactactcgcacaagcatgaag

SEQ ID NO: 335607 - DNA, 25 bp, Mus musculus
ccaaactactcggacaagcatgaag

SEQ ID NO: 335608 - DNA, 25 bp, Mus musculus
ccaaactcaggtcttcctggacagc

SEQ ID NO: 335609 - DNA, 25 bp, Mus musculus
ccaaactcaggtgttcctggacagc

SEQ ID NO: 335610 - DNA, 25 bp, Mus musculus
ccaaactctgcaacttcatacttat

SEQ ID NO: 335611 - DNA, 25 bp, Mus musculus
ccaaactctgcatcttcatacttat

SEQ ID NO: 335612 - DNA, 25 bp, Mus musculus
ccaaactctgccatgtgctggcatg

SEQ ID NO: 335613 - DNA, 25 bp, Mus musculus
ccaaactctgccttgtgctggcatg

SEQ ID NO: 335614 - DNA, 25 bp, Mus musculus
ccaaactctgctctgatgtcaggaa

SEQ ID NO: 335615 - DNA, 25 bp, Mus musculus
ccaaactctgctgtgatgtcaggaa

SEQ ID NO: 335616 - DNA, 25 bp, Mus musculus
ccaaactctggcctctttcaagggc

SEQ ID NO: 335617 - DNA, 25 bp, Mus musculus
ccaaactctggcgtctttcaagggc

SEQ ID NO: 335618 - DNA, 25 bp, Mus musculus
ccaaactgccatatcatattttaag

SEQ ID NO: 335619 - DNA, 25 bp, Mus musculus
ccaaactgccatttcatattttaag

SEQ ID NO: 335620 - DNA, 25 bp, Mus musculus
ccaaactgtggccttaagctaattg

SEQ ID NO: 335621 - DNA, 25 bp, Mus musculus
ccaaactgtggcgttaagctaattg

SEQ ID NO: 335622 - DNA, 25 bp, Mus musculus
ccaaacttcaacattcttgtgtcca

SEQ ID NO: 335623 - DNA, 25 bp, Mus musculus
ccaaacttcaactttcttgtgtcca

SEQ ID NO: 335624 - DNA, 25 bp, Mus musculus
ccaaacttcacgacagaatccagca

SEQ ID NO: 335625 - DNA, 25 bp, Mus musculus
ccaaacttcacgtcagaatccagca

SEQ ID NO: 335626 - DNA, 25 bp, Mus musculus
ccaaacttgaacaggcggtctctat

SEQ ID NO: 335627 - DNA, 25 bp, Mus musculus
ccaaacttgaactggcggtctctat

SEQ ID NO: 335628 - DNA, 25 bp, Mus musculus
ccaaacttgaggctgctgggcagct

SEQ ID NO: 335629 - DNA, 25 bp, Mus musculus
ccaaacttgagggtgctgggcagct

SEQ ID NO: 335630 - DNA, 25 bp, Mus musculus
ccaaacttttctcatctcttaggat

SEQ ID NO: 335631 - DNA, 25 bp, Mus musculus
ccaaacttttctgatctcttaggat

SEQ ID NO: 335632 - DNA, 25 bp, Mus musculus
ccaaacttttgacctcagggcgtgg

SEQ ID NO: 335633 - DNA, 25 bp, Mus musculus
ccaaacttttgagctcagggcgtgg

SEQ ID NO: 335634 - DNA, 25 bp, Mus musculus
ccaaagaagttccacaaatatgtag

SEQ ID NO: 335635 - DNA, 25 bp, Mus musculus
ccaaagaagttcgacaaatatgtag

SEQ ID NO: 335636 - DNA, 25 bp, Mus musculus
ccaaagaatccaaaggtgatcccct

SEQ ID NO: 335637 - DNA, 25 bp, Mus musculus
ccaaagaatccataggtgatcccct

SEQ ID NO: 335638 - DNA, 25 bp, Mus musculus
ccaaagacaataaaccctcctcaga

SEQ ID NO: 335639 - DNA, 25 bp, Mus musculus
ccaaagacaatataccctcctcaga

SEQ ID NO: 335640 - DNA, 25 bp, Mus musculus
ccaaagaccttcataacatacagtg

SEQ ID NO: 335641 - DNA, 25 bp, Mus musculus
ccaaagaccttcttaacatacagtg

SEQ ID NO: 335642 - DNA, 25 bp, Mus musculus
ccaaagacctttaagcactcccatt

SEQ ID NO: 335643 - DNA, 25 bp, Mus musculus
ccaaagaccttttagcactcccatt

SEQ ID NO: 335644 - DNA, 25 bp, Mus musculus
ccaaagactgaaaccagctgctggg

SEQ ID NO: 335645 - DNA, 25 bp, Mus musculus
ccaaagactgaatccagctgctggg

SEQ ID NO: 335646 - DNA, 25 bp, Mus musculus
ccaaagactggaagaccctctgttc

SEQ ID NO: 335647 - DNA, 25 bp, Mus musculus
ccaaagactggatgaccctctgttc

SEQ ID NO: 335648 - DNA, 25 bp, Mus musculus
ccaaagagattgatagctatacctt

SEQ ID NO: 335649 - DNA, 25 bp, Mus musculus
ccaaagagattgttagctatacctt

SEQ ID NO: 335650 - DNA, 25 bp, Mus musculus
ccaaagagggatccatgcggtgctc

SEQ ID NO: 335651 - DNA, 25 bp, Mus musculus
ccaaagagggatgcatgcggtgctc

SEQ ID NO: 335652 - DNA, 25 bp, Mus musculus
ccaaagatgaacactgagaagcaaa

SEQ ID NO: 335653 - DNA, 25 bp, Mus musculus
ccaaagatgaactctgagaagcaaa

SEQ ID NO: 335654 - DNA, 25 bp, Mus musculus
ccaaagatggatacgtggtttcata

SEQ ID NO: 335655 - DNA, 25 bp, Mus musculus
ccaaagatggattcgtggtttcata

SEQ ID NO: 335656 - DNA, 25 bp, Mus musculus
ccaaagcagcctccttgaagcggag

SEQ ID NO: 335657 - DNA, 25 bp, Mus musculus
ccaaagcagcctgcttgaagcggag

SEQ ID NO: 335658 - DNA, 25 bp, Mus musculus
ccaaagcaggcaaacccaattcctg

SEQ ID NO: 335659 - DNA, 25 bp, Mus musculus
ccaaagcaggcatacccaattcctg

SEQ ID NO: 335660 - DNA, 25 bp, Mus musculus
ccaaagcccccacatttgcctttca

SEQ ID NO: 335661 - DNA, 25 bp, Mus musculus
ccaaagcccccagatttgcctttca

SEQ ID NO: 335662 - DNA, 25 bp, Mus musculus
ccaaagccctctcggttagggccag

SEQ ID NO: 335663 - DNA, 25 bp, Mus musculus
ccaaagccctctgggttagggccag

SEQ ID NO: 335664 - DNA, 25 bp, Mus musculus
ccaaagcctggtatgagggtgctaa

SEQ ID NO: 335665 - DNA, 25 bp, Mus musculus
ccaaagcctggtttgagggtgctaa

SEQ ID NO: 335666 - DNA, 25 bp, Mus musculus
ccaaagctcaggataattttaattg

SEQ ID NO: 335667 - DNA, 25 bp, Mus musculus
ccaaagctcaggttaattttaattg

SEQ ID NO: 335668 - DNA, 25 bp, Mus musculus
ccaaagctcagtcacgtgctggtgg

SEQ ID NO: 335669 - DNA, 25 bp, Mus musculus
ccaaagctcagtgacgtgctggtgg

SEQ ID NO: 335670 - DNA, 25 bp, Mus musculus
ccaaagctcctgatctacaaagttt

SEQ ID NO: 335671 - DNA, 25 bp, Mus musculus
ccaaagctcctgttctacaaagttt

SEQ ID NO: 335672 - DNA, 25 bp, Mus musculus
ccaaagctcttgctaaatgccagat

SEQ ID NO: 335673 - DNA, 25 bp, Mus musculus
ccaaagctcttggtaaatgccagat

SEQ ID NO: 335674 - DNA, 25 bp, Mus musculus
ccaaagctggtaatgctgtgagcca

SEQ ID NO: 335675 - DNA, 25 bp, Mus musculus
ccaaagctggtattgctgtgagcca

SEQ ID NO: 335676 - DNA, 25 bp, Mus musculus
ccaaagcttagccacttagggttct

SEQ ID NO: 335677 - DNA, 25 bp, Mus musculus
ccaaagcttagcgacttagggttct

SEQ ID NO: 335678 - DNA, 25 bp, Mus musculus
ccaaagctttagagatgtaagaata

SEQ ID NO: 335679 - DNA, 25 bp, Mus musculus
ccaaagctttagtgatgtaagaata

SEQ ID NO: 335680 - DNA, 25 bp, Mus musculus
ccaaaggaagatctcttgtctgctc

SEQ ID NO: 335681 - DNA, 25 bp, Mus musculus
ccaaaggaagatgtcttgtctgctc

SEQ ID NO: 335682 - DNA, 25 bp, Mus musculus
ccaaaggagcttctgatgtttttca

SEQ ID NO: 335683 - DNA, 25 bp, Mus musculus
ccaaaggagcttgtgatgtttttca

SEQ ID NO: 335684 - DNA, 25 bp, Mus musculus
ccaaaggattgtatagtagctaagt

SEQ ID NO: 335685 - DNA, 25 bp, Mus musculus
ccaaaggattgtttagtagctaagt

SEQ ID NO: 335686 - DNA, 25 bp, Mus musculus
ccaaaggcaactcggcctgggttcg

SEQ ID NO: 335687 - DNA, 25 bp, Mus musculus
ccaaaggcaactgggcctgggttcg

SEQ ID NO: 335688 - DNA, 25 bp, Mus musculus
ccaaaggcaagcatttggtttccgg

SEQ ID NO: 335689 - DNA, 25 bp, Mus musculus
ccaaaggcaagcttttggtttccgg

SEQ ID NO: 335690 - DNA, 25 bp, Mus musculus
ccaaaggcacccaggaagcttctat

SEQ ID NO: 335691 - DNA, 25 bp, Mus musculus
ccaaaggcaccctggaagcttctat

SEQ ID NO: 335692 - DNA, 25 bp, Mus musculus
ccaaaggcgcctccgacaaggcgga

SEQ ID NO: 335693 - DNA, 25 bp, Mus musculus
ccaaaggcgcctgcgacaaggcgga

SEQ ID NO: 335694 - DNA, 25 bp, Mus musculus
ccaaaggcgctgacataaaggagca

SEQ ID NO: 335695 - DNA, 25 bp, Mus musculus
ccaaaggcgctgtcataaaggagca

SEQ ID NO: 335696 - DNA, 25 bp, Mus musculus
ccaaaggcggctcgcaagaaagcgt

SEQ ID NO: 335697 - DNA, 25 bp, Mus musculus
ccaaaggcggctggcaagaaagcgt

SEQ ID NO: 335698 - DNA, 25 bp, Mus musculus
ccaaaggcttaaacttacccaatat

SEQ ID NO: 335699 - DNA, 25 bp, Mus musculus
ccaaaggcttaatcttacccaatat

SEQ ID NO: 335700 - DNA, 25 bp, Mus musculus
ccaaaggtggctacactggagagaa

SEQ ID NO: 335701 - DNA, 25 bp, Mus musculus
ccaaaggtggcttcactggagagaa

SEQ ID NO: 335702 - DNA, 25 bp, Mus musculus
ccaaagtagaggctgtctggcctta

SEQ ID NO: 335703 - DNA, 25 bp, Mus musculus
ccaaagtagagggtgtctggcctta

SEQ ID NO: 335704 - DNA, 25 bp, Mus musculus
ccaaagtccacaaactgcacttggt

SEQ ID NO: 335705 - DNA, 25 bp, Mus musculus
ccaaagtccacatactgcacttggt

SEQ ID NO: 335706 - DNA, 25 bp, Mus musculus
ccaaagtgaaagatgccccagaaat

SEQ ID NO: 335707 - DNA, 25 bp, Mus musculus
ccaaagtgaaagttgccccagaaat

SEQ ID NO: 335708 - DNA, 25 bp, Mus musculus
ccaaagtgactgagtttgtacaaat

SEQ ID NO: 335709 - DNA, 25 bp, Mus musculus
ccaaagtgactgtgtttgtacaaat

SEQ ID NO: 335710 - DNA, 25 bp, Mus musculus
ccaaagttgctgctgagatctcccc

SEQ ID NO: 335711 - DNA, 25 bp, Mus musculus
ccaaagttgctggtgagatctcccc

SEQ ID NO: 335712 - DNA, 25 bp, Mus musculus
ccaaagttgttcctgcccagcaccg

SEQ ID NO: 335713 - DNA, 25 bp, Mus musculus
ccaaagttgttcgtgcccagcaccg

SEQ ID NO: 335714 - DNA, 25 bp, Mus musculus
ccaaataccagaaggtccaagggca

SEQ ID NO: 335715 - DNA, 25 bp, Mus musculus
ccaaataccagatggtccaagggca

SEQ ID NO: 335716 - DNA, 25 bp, Mus musculus
ccaaatacctgcctgttcaaacaag

SEQ ID NO: 335717 - DNA, 25 bp, Mus musculus
ccaaatacctgcgtgttcaaacaag

SEQ ID NO: 335718 - DNA, 25 bp, Mus musculus
ccaaatagtttgcattgtctcccag

SEQ ID NO: 335719 - DNA, 25 bp, Mus musculus
ccaaatagtttggattgtctcccag

SEQ ID NO: 335720 - DNA, 25 bp, Mus musculus
ccaaatatacccacacttcgtgtac

SEQ ID NO: 335721 - DNA, 25 bp, Mus musculus
ccaaatataccctcacttcgtgtac

SEQ ID NO: 335722 - DNA, 25 bp, Mus musculus
ccaaatatattaccccaacctcaat

SEQ ID NO: 335723 - DNA, 25 bp, Mus musculus
ccaaatatattagcccaacctcaat

SEQ ID NO: 335724 - DNA, 25 bp, Mus musculus
ccaaatcactgaatcttgtgctgta

SEQ ID NO: 335725 - DNA, 25 bp, Mus musculus
ccaaatcactgattcttgtgctgta

SEQ ID NO: 335726 - DNA, 25 bp, Mus musculus
ccaaatcagagtatgcctgggagtg

SEQ ID NO: 335727 - DNA, 25 bp, Mus musculus
ccaaatcagagtttgcctgggagtg

SEQ ID NO: 335728 - DNA, 25 bp, Mus musculus
ccaaatcagcagatgcccatggaag

SEQ ID NO: 335729 - DNA, 25 bp, Mus musculus
ccaaatcagcagttgcccatggaag

SEQ ID NO: 335730 - DNA, 25 bp, Mus musculus
ccaaatccacaaagcctactttatt

SEQ ID NO: 335731 - DNA, 25 bp, Mus musculus
ccaaatccacaatgcctactttatt

SEQ ID NO: 335732 - DNA, 25 bp, Mus musculus
ccaaatccatgacctctagctaaaa

SEQ ID NO: 335733 - DNA, 25 bp, Mus musculus
ccaaatccatgagctctagctaaaa

SEQ ID NO: 335734 - DNA, 25 bp, Mus musculus
ccaaatcccacacattttattaaga

SEQ ID NO: 335735 - DNA, 25 bp, Mus musculus
ccaaatcccacagattttattaaga

SEQ ID NO: 335736 - DNA, 25 bp, Mus musculus
ccaaatcccctgaatttactcacat

SEQ ID NO: 335737 - DNA, 25 bp, Mus musculus
ccaaatcccctgtatttactcacat

SEQ ID NO: 335738 - DNA, 25 bp, Mus musculus
ccaaatcctttaccttatgtgccaa

SEQ ID NO: 335739 - DNA, 25 bp, Mus musculus
ccaaatcctttagcttatgtgccaa

SEQ ID NO: 335740 - DNA, 25 bp, Mus musculus
ccaaatcctttgaacctggctgggt

SEQ ID NO: 335741 - DNA, 25 bp, Mus musculus
ccaaatcctttgtacctggctgggt

SEQ ID NO: 335742 - DNA, 25 bp, Mus musculus
ccaaatcgaagccagtctctaacct

SEQ ID NO: 335743 - DNA, 25 bp, Mus musculus
ccaaatcgaagcgagtctctaacct

SEQ ID NO: 335744 - DNA, 25 bp, Mus musculus
ccaaatctccagaaaacgcactcaa

SEQ ID NO: 335745 - DNA, 25 bp, Mus musculus
ccaaatctccagtaaacgcactcaa

SEQ ID NO: 335746 - DNA, 25 bp, Mus musculus
ccaaatctcttgctgcctatactat

SEQ ID NO: 335747 - DNA, 25 bp, Mus musculus
ccaaatctcttggtgcctatactat

SEQ ID NO: 335748 - DNA, 25 bp, Mus musculus
ccaaatctgatgatcgccctttttt

SEQ ID NO: 335749 - DNA, 25 bp, Mus musculus
ccaaatctgatgttcgccctttttt

SEQ ID NO: 335750 - DNA, 25 bp, Mus musculus
ccaaatctgcatctgctcactgtaa

SEQ ID NO: 335751 - DNA, 25 bp, Mus musculus
ccaaatctgcatgtgctcactgtaa

SEQ ID NO: 335752 - DNA, 25 bp, Mus musculus
ccaaatctggacagcagctgtggct

SEQ ID NO: 335753 - DNA, 25 bp, Mus musculus
ccaaatctggactgcagctgtggct

SEQ ID NO: 335754 - DNA, 25 bp, Mus musculus
ccaaatgaaaccaatggtcagggtg

SEQ ID NO: 335755 - DNA, 25 bp, Mus musculus
ccaaatgaaacctatggtcagggtg

SEQ ID NO: 335756 - DNA, 25 bp, Mus musculus
ccaaatgaatgcctccccacttatg

SEQ ID NO: 335757 - DNA, 25 bp, Mus musculus
ccaaatgaatgcgtccccacttatg

SEQ ID NO: 335758 - DNA, 25 bp, Mus musculus
ccaaatgactgtcagatgagacaca

SEQ ID NO: 335759 - DNA, 25 bp, Mus musculus
ccaaatgactgtgagatgagacaca

SEQ ID NO: 335760 - DNA, 25 bp, Mus musculus
ccaaatgatagcacacggtcacaag

SEQ ID NO: 335761 - DNA, 25 bp, Mus musculus
ccaaatgatagctcacggtcacaag

SEQ ID NO: 335762 - DNA, 25 bp, Mus musculus
ccaaatgatccgcgtcccgaatgct

SEQ ID NO: 335763 - DNA, 25 bp, Mus musculus
ccaaatgatccgggtcccgaatgct

SEQ ID NO: 335764 - DNA, 25 bp, Mus musculus
ccaaatgcagtgatctttctgtctg

SEQ ID NO: 335765 - DNA, 25 bp, Mus musculus
ccaaatgcagtgttctttctgtctg

SEQ ID NO: 335766 - DNA, 25 bp, Mus musculus
ccaaatgcctttcggtgcctgatgc

SEQ ID NO: 335767 - DNA, 25 bp, Mus musculus
ccaaatgcctttgggtgcctgatgc

SEQ ID NO: 335768 - DNA, 25 bp, Mus musculus
ccaaatgcgcccaggatcgaggaga

SEQ ID NO: 335769 - DNA, 25 bp, Mus musculus
ccaaatgcgccctggatcgaggaga

SEQ ID NO: 335770 - DNA, 25 bp, Mus musculus
ccaaatgcgggtctgttgtacctaa

SEQ ID NO: 335771 - DNA, 25 bp, Mus musculus
ccaaatgcgggtgtgttgtacctaa

SEQ ID NO: 335772 - DNA, 25 bp, Mus musculus
ccaaatgctgctccaagttacttaa

SEQ ID NO: 335773 - DNA, 25 bp, Mus musculus
ccaaatgctgctcccagtgttgctg

SEQ ID NO: 335774 - DNA, 25 bp, Mus musculus
ccaaatgctgctgcaagttacttaa

SEQ ID NO: 335775 - DNA, 25 bp, Mus musculus
ccaaatgctgctgccagtgttgctg

SEQ ID NO: 335776 - DNA, 25 bp, Mus musculus
ccaaatgcttacacgggcccataca

SEQ ID NO: 335777 - DNA, 25 bp, Mus musculus
ccaaatgcttactcgggcccataca

SEQ ID NO: 335778 - DNA, 25 bp, Mus musculus
ccaaatggaaggactcaagctacta

SEQ ID NO: 335779 - DNA, 25 bp, Mus musculus
ccaaatggaaggtctcaagctacta

SEQ ID NO: 335780 - DNA, 25 bp, Mus musculus
ccaaatggacctatcatcatacggg

SEQ ID NO: 335781 - DNA, 25 bp, Mus musculus
ccaaatggacctttcatcatacggg

SEQ ID NO: 335782 - DNA, 25 bp, Mus musculus
ccaaatggaggaatacggaacagtc

SEQ ID NO: 335783 - DNA, 25 bp, Mus musculus
ccaaatggaggattacggaacagtc

SEQ ID NO: 335784 - DNA, 25 bp, Mus musculus
ccaaatggctaaccagtctgccgag

SEQ ID NO: 335785 - DNA, 25 bp, Mus musculus
ccaaatggctaagcagtctgccgag

SEQ ID NO: 335786 - DNA, 25 bp, Mus musculus
ccaaatggttcgaacagcagcggaa

SEQ ID NO: 335787 - DNA, 25 bp, Mus musculus
ccaaatggttcgtacagcagcggaa

SEQ ID NO: 335788 - DNA, 25 bp, Mus musculus
ccaaatgttggccatgaatatcgaa

SEQ ID NO: 335789 - DNA, 25 bp, Mus musculus
ccaaatgttggcgatgaatatcgaa

SEQ ID NO: 335790 - DNA, 25 bp, Mus musculus
ccaaatgtttccagcttttataaat

SEQ ID NO: 335791 - DNA, 25 bp, Mus musculus
ccaaatgtttcctgcttttataaat

SEQ ID NO: 335792 - DNA, 25 bp, Mus musculus
ccaaatgttttgataatgcctagat

SEQ ID NO: 335793 - DNA, 25 bp, Mus musculus
ccaaatgttttgttaatgcctagat

SEQ ID NO: 335794 - DNA, 25 bp, Mus musculus
ccaaattatctgagcatttaaggct

SEQ ID NO: 335795 - DNA, 25 bp, Mus musculus
ccaaattatctgtgcatttaaggct

SEQ ID NO: 335796 - DNA, 25 bp, Mus musculus
ccaaattcccctcagcaagttcatt

SEQ ID NO: 335797 - DNA, 25 bp, Mus musculus
ccaaattcccctgagcaagttcatt

SEQ ID NO: 335798 - DNA, 25 bp, Mus musculus
ccaaattctggcatttttgttacag

SEQ ID NO: 335799 - DNA, 25 bp, Mus musculus
ccaaattctggcttttttgttacag

SEQ ID NO: 335800 - DNA, 25 bp, Mus musculus
ccaaattgctccagtgacttcagct

SEQ ID NO: 335801 - DNA, 25 bp, Mus musculus
ccaaattgctcctgtgacttcagct

SEQ ID NO: 335802 - DNA, 25 bp, Mus musculus
ccaaatttagttcccagtgcccatg

SEQ ID NO: 335803 - DNA, 25 bp, Mus musculus
ccaaatttagttgccagtgcccatg

SEQ ID NO: 335804 - DNA, 25 bp, Mus musculus
ccaaatttatctccagataggactg

SEQ ID NO: 335805 - DNA, 25 bp, Mus musculus
ccaaatttatctgcagataggactg

SEQ ID NO: 335806 - DNA, 25 bp, Mus musculus
ccaaatttcaggagagaatgtgctt

SEQ ID NO: 335807 - DNA, 25 bp, Mus musculus
ccaaatttcaggtgagaatgtgctt

SEQ ID NO: 335808 - DNA, 25 bp, Mus musculus
ccaaattttctccaggaagtacaag

SEQ ID NO: 335809 - DNA, 25 bp, Mus musculus
ccaaattttctcgaggaagtacaag

SEQ ID NO: 335810 - DNA, 25 bp, Mus musculus
ccaaattttctgaacctggtcctca

SEQ ID NO: 335811 - DNA, 25 bp, Mus musculus
ccaaattttctgtacctggtcctca

SEQ ID NO: 335812 - DNA, 25 bp, Mus musculus
ccaaattttgaacctcagcttgcag

SEQ ID NO: 335813 - DNA, 25 bp, Mus musculus
ccaaattttgaagctcagcttgcag

SEQ ID NO: 335814 - DNA, 25 bp, Mus musculus
ccaaattttgcgctcggtgcgatac

SEQ ID NO: 335815 - DNA, 25 bp, Mus musculus
ccaaattttgcggtcggtgcgatac

SEQ ID NO: 335816 - DNA, 25 bp, Mus musculus
ccaacaaacagtcaagataaccagt

SEQ ID NO: 335817 - DNA, 25 bp, Mus musculus
ccaacaaacagtgaagataaccagt

SEQ ID NO: 335818 - DNA, 25 bp, Mus musculus
ccaacaacagttcatgtagccagtt

SEQ ID NO: 335819 - DNA, 25 bp, Mus musculus
ccaacaacagttgatgtagccagtt

SEQ ID NO: 335820 - DNA, 25 bp, Mus musculus
ccaacaactctcatcagtgcatata

SEQ ID NO: 335821 - DNA, 25 bp, Mus musculus
ccaacaactctcttcagtgcatata

SEQ ID NO: 335822 - DNA, 25 bp, Mus musculus
ccaacaagggcaacatcgaagaact

SEQ ID NO: 335823 - DNA, 25 bp, Mus musculus
ccaacaagggcatcatcgaagaact

SEQ ID NO: 335824 - DNA, 25 bp, Mus musculus
ccaacaaggtggagacgtacaaaga

SEQ ID NO: 335825 - DNA, 25 bp, Mus musculus
ccaacaaggtggtgacgtacaaaga

SEQ ID NO: 335826 - DNA, 25 bp, Mus musculus
ccaacaagtgttctctgggagacaa

SEQ ID NO: 335827 - DNA, 25 bp, Mus musculus
ccaacaagtgttgtctgggagacaa

SEQ ID NO: 335828 - DNA, 25 bp, Mus musculus
ccaacaatgataaggcgtccaccaa

SEQ ID NO: 335829 - DNA, 25 bp, Mus musculus
ccaacaatgatatggcgtccaccaa

SEQ ID NO: 335830 - DNA, 25 bp, Mus musculus
ccaacaatgatcagaagcccaggga

SEQ ID NO: 335831 - DNA, 25 bp, Mus musculus
ccaacaatgatctgaagcccaggga

SEQ ID NO: 335832 - DNA, 25 bp, Mus musculus
ccaacaatgggcaggtgggctccag

SEQ ID NO: 335833 - DNA, 25 bp, Mus musculus
ccaacaatgggctggtgggctccag

SEQ ID NO: 335834 - DNA, 25 bp, Mus musculus
ccaacacactttctgagctttcttt

SEQ ID NO: 335835 - DNA, 25 bp, Mus musculus
ccaacacactttgtgagctttcttt

SEQ ID NO: 335836 - DNA, 25 bp, Mus musculus
ccaacacagttaatgtactttgtaa

SEQ ID NO: 335837 - DNA, 25 bp, Mus musculus
ccaacacagttattgtactttgtaa

SEQ ID NO: 335838 - DNA, 25 bp, Mus musculus
ccaacaccaggcaagattctttttt

SEQ ID NO: 335839 - DNA, 25 bp, Mus musculus
ccaacaccaggctagattctttttt

SEQ ID NO: 335840 - DNA, 25 bp, Mus musculus
ccaacaccagtgatctactcagttt

SEQ ID NO: 335841 - DNA, 25 bp, Mus musculus
ccaacaccagtgttctactcagttt

SEQ ID NO: 335842 - DNA, 25 bp, Mus musculus
ccaacaccccatatataagacagct

SEQ ID NO: 335843 - DNA, 25 bp, Mus musculus
ccaacaccccatttataagacagct

SEQ ID NO: 335844 - DNA, 25 bp, Mus musculus
ccaacacctcaacaaccttaataat

SEQ ID NO: 335845 - DNA, 25 bp, Mus musculus
ccaacacctcaagaaccttaataat

SEQ ID NO: 335846 - DNA, 25 bp, Mus musculus
ccaacacctgtaaggcagctcataa

SEQ ID NO: 335847 - DNA, 25 bp, Mus musculus
ccaacacctgtatggcagctcataa

SEQ ID NO: 335848 - DNA, 25 bp, Mus musculus
ccaacacgcggaaaggctgagggca

SEQ ID NO: 335849 - DNA, 25 bp, Mus musculus
ccaacacgcggataggctgagggca

SEQ ID NO: 335850 - DNA, 25 bp, Mus musculus
ccaacacgtgtgagagtctgctcat

SEQ ID NO: 335851 - DNA, 25 bp, Mus musculus
ccaacacgtgtgtgagtctgctcat

SEQ ID NO: 335852 - DNA, 25 bp, Mus musculus
ccaacacgtgttcccctcaggatgt

SEQ ID NO: 335853 - DNA, 25 bp, Mus musculus
ccaacacgtgttgccctcaggatgt

SEQ ID NO: 335854 - DNA, 25 bp, Mus musculus
ccaacactactgcatcctgaaggat

SEQ ID NO: 335855 - DNA, 25 bp, Mus musculus
ccaacactactggatcctgaaggat

SEQ ID NO: 335856 - DNA, 25 bp, Mus musculus
ccaacactcatgagggtttcttctg

SEQ ID NO: 335857 - DNA, 25 bp, Mus musculus
ccaacactcatgtgggtttcttctg

SEQ ID NO: 335858 - DNA, 25 bp, Mus musculus
ccaacactgggaacatagacaccta

SEQ ID NO: 335859 - DNA, 25 bp, Mus musculus
ccaacactgggactaggcaaactac

SEQ ID NO: 335860 - DNA, 25 bp, Mus musculus
ccaacactgggagtaggcaaactac

SEQ ID NO: 335861 - DNA, 25 bp, Mus musculus
ccaacactgggatcatagacaccta

SEQ ID NO: 335862 - DNA, 25 bp, Mus musculus
ccaacactgggtacactcggaggaa

SEQ ID NO: 335863 - DNA, 25 bp, Mus musculus
ccaacactgggttcactcggaggaa

SEQ ID NO: 335864 - DNA, 25 bp, Mus musculus
ccaacactgttgaaggttgatcata

SEQ ID NO: 335865 - DNA, 25 bp, Mus musculus
ccaacactgttgtaggttgatcata

SEQ ID NO: 335866 - DNA, 25 bp, Mus musculus
ccaacacttgagaggttcaaggcgt

SEQ ID NO: 335867 - DNA, 25 bp, Mus musculus
ccaacacttgagtggttcaaggcgt

SEQ ID NO: 335868 - DNA, 25 bp, Mus musculus
ccaacagaatctagatccgtgtgat

SEQ ID NO: 335869 - DNA, 25 bp, Mus musculus
ccaacagaatcttgatccgtgtgat

SEQ ID NO: 335870 - DNA, 25 bp, Mus musculus
ccaacagaatgtcatgctggatctt

SEQ ID NO: 335871 - DNA, 25 bp, Mus musculus
ccaacagaatgtgatgctggatctt

SEQ ID NO: 335872 - DNA, 25 bp, Mus musculus
ccaacagaggcaaccaattccagat

SEQ ID NO: 335873 - DNA, 25 bp, Mus musculus
ccaacagaggcatccaattccagat

SEQ ID NO: 335874 - DNA, 25 bp, Mus musculus
ccaacagagtgtcttgctagtgtct

SEQ ID NO: 335875 - DNA, 25 bp, Mus musculus
ccaacagagtgtgttgctagtgtct

SEQ ID NO: 335876 - DNA, 25 bp, Mus musculus
ccaacagagtttcgtagaccttggg

SEQ ID NO: 335877 - DNA, 25 bp, Mus musculus
ccaacagagtttggtagaccttggg

SEQ ID NO: 335878 - DNA, 25 bp, Mus musculus
ccaacagcacccctttgtacataaa

SEQ ID NO: 335879 - DNA, 25 bp, Mus musculus
ccaacagcacccgtttgtacataaa

SEQ ID NO: 335880 - DNA, 25 bp, Mus musculus
ccaacagcaggacggcgggcagcgc

SEQ ID NO: 335881 - DNA, 25 bp, Mus musculus
ccaacagcaggagggcgggcagcgc

SEQ ID NO: 335882 - DNA, 25 bp, Mus musculus
ccaacagccggtcggtgtatttata

SEQ ID NO: 335883 - DNA, 25 bp, Mus musculus
ccaacagccggtgggtgtatttata

SEQ ID NO: 335884 - DNA, 25 bp, Mus musculus
ccaacagcctgcctaggtggctgga

SEQ ID NO: 335885 - DNA, 25 bp, Mus musculus
ccaacagcctgcgtaggtggctgga

SEQ ID NO: 335886 - DNA, 25 bp, Mus musculus
ccaacagccttgatcatggaagtct

SEQ ID NO: 335887 - DNA, 25 bp, Mus musculus
ccaacagccttgttcatggaagtct

SEQ ID NO: 335888 - DNA, 25 bp, Mus musculus
ccaacagctctgcatccaagaagca

SEQ ID NO: 335889 - DNA, 25 bp, Mus musculus
ccaacagctctggatccaagaagca

SEQ ID NO: 335890 - DNA, 25 bp, Mus musculus
ccaacaggaggtagactttcaaatc

SEQ ID NO: 335891 - DNA, 25 bp, Mus musculus
ccaacaggaggttgactttcaaatc

SEQ ID NO: 335892 - DNA, 25 bp, Mus musculus
ccaacaggagttcatggttacgcat

SEQ ID NO: 335893 - DNA, 25 bp, Mus musculus
ccaacaggagttgatggttacgcat

SEQ ID NO: 335894 - DNA, 25 bp, Mus musculus
ccaacagggctgcaaaggtgtcgca

SEQ ID NO: 335895 - DNA, 25 bp, Mus musculus
ccaacagggctggaaaggtgtcgca

SEQ ID NO: 335896 - DNA, 25 bp, Mus musculus
ccaacaggtctgatctctctgaggg

SEQ ID NO: 335897 - DNA, 25 bp, Mus musculus
ccaacaggtctgttctctctgaggg

SEQ ID NO: 335898 - DNA, 25 bp, Mus musculus
ccaacaggtggcaagaagtccgcat

SEQ ID NO: 335899 - DNA, 25 bp, Mus musculus
ccaacaggtggctagaagtccgcat

SEQ ID NO: 335900 - DNA, 25 bp, Mus musculus
ccaacaggttcacctcatatataat

SEQ ID NO: 335901 - DNA, 25 bp, Mus musculus
ccaacaggttcagctcatatataat

SEQ ID NO: 335902 - DNA, 25 bp, Mus musculus
ccaacagtgccacggagtggctcct

SEQ ID NO: 335903 - DNA, 25 bp, Mus musculus
ccaacagtgccagggagtggctcct

SEQ ID NO: 335904 - DNA, 25 bp, Mus musculus
ccaacagttggcatgcacagcaggc

SEQ ID NO: 335905 - DNA, 25 bp, Mus musculus
ccaacagttggcttgcacagcaggc

SEQ ID NO: 335906 - DNA, 25 bp, Mus musculus
ccaacatcaaccagactctgcatag

SEQ ID NO: 335907 - DNA, 25 bp, Mus musculus
ccaacatcaacctgactctgcatag

SEQ ID NO: 335908 - DNA, 25 bp, Mus musculus
ccaacatccaggctgactacctgta

SEQ ID NO: 335909 - DNA, 25 bp, Mus musculus
ccaacatccagggtgactacctgta

SEQ ID NO: 335910 - DNA, 25 bp, Mus musculus
ccaacatgacccattgaccatataa

SEQ ID NO: 335911 - DNA, 25 bp, Mus musculus
ccaacatgaccctttgaccatataa

SEQ ID NO: 335912 - DNA, 25 bp, Mus musculus
ccaacatgactcatatgcagagcat

SEQ ID NO: 335913 - DNA, 25 bp, Mus musculus
ccaacatgactcttatgcagagcat

SEQ ID NO: 335914 - DNA, 25 bp, Mus musculus
ccaacatgatctacttggcagtccc

SEQ ID NO: 335915 - DNA, 25 bp, Mus musculus
ccaacatgatcttcttggcagtccc

SEQ ID NO: 335916 - DNA, 25 bp, Mus musculus
ccaacatggctgagactactgtctt

SEQ ID NO: 335917 - DNA, 25 bp, Mus musculus
ccaacatggctgtgactactgtctt

SEQ ID NO: 335918 - DNA, 25 bp, Mus musculus
ccaacatggttcaggaagcggaaac

SEQ ID NO: 335919 - DNA, 25 bp, Mus musculus
ccaacatggttctggaagcggaaac

SEQ ID NO: 335920 - DNA, 25 bp, Mus musculus
ccaacatgtggacctaaggtttcaa

SEQ ID NO: 335921 - DNA, 25 bp, Mus musculus
ccaacatgtggagctaaggtttcaa

SEQ ID NO: 335922 - DNA, 25 bp, Mus musculus
ccaacattaggtaccgaggctgcat

SEQ ID NO: 335923 - DNA, 25 bp, Mus musculus
ccaacattaggttccgaggctgcat

SEQ ID NO: 335924 - DNA, 25 bp, Mus musculus
ccaacattggcacgttccgatcttc

SEQ ID NO: 335925 - DNA, 25 bp, Mus musculus
ccaacattggcaggttccgatcttc

SEQ ID NO: 335926 - DNA, 25 bp, Mus musculus
ccaacattggctcagtatgctaatg

SEQ ID NO: 335927 - DNA, 25 bp, Mus musculus
ccaacattggctgagtatgctaatg

SEQ ID NO: 335928 - DNA, 25 bp, Mus musculus
ccaacatttaccacaatttccacag

SEQ ID NO: 335929 - DNA, 25 bp, Mus musculus
ccaacatttacctcaatttccacag

SEQ ID NO: 335930 - DNA, 25 bp, Mus musculus
ccaacatttcatatacttcttgtca

SEQ ID NO: 335931 - DNA, 25 bp, Mus musculus
ccaacatttcatttacttcttgtca

SEQ ID NO: 335932 - DNA, 25 bp, Mus musculus
ccaacattttgaactgtggttttgt

SEQ ID NO: 335933 - DNA, 25 bp, Mus musculus
ccaacattttgatctgtggttttgt

SEQ ID NO: 335934 - DNA, 25 bp, Mus musculus
ccaaccaaaccgcattcgtgtggat

SEQ ID NO: 335935 - DNA, 25 bp, Mus musculus
ccaaccaaaccggattcgtgtggat

SEQ ID NO: 335936 - DNA, 25 bp, Mus musculus
ccaaccaagaaaacaatgactggac

SEQ ID NO: 335937 - DNA, 25 bp, Mus musculus
ccaaccaagaaatcaatgactggac

SEQ ID NO: 335938 - DNA, 25 bp, Mus musculus
ccaaccaagtggctcaagtcggaga

SEQ ID NO: 335939 - DNA, 25 bp, Mus musculus
ccaaccaagtgggtcaagtcggaga

SEQ ID NO: 335940 - DNA, 25 bp, Mus musculus
ccaaccacaacaacctacagattgt

SEQ ID NO: 335941 - DNA, 25 bp, Mus musculus
ccaaccacaacatcctacagattgt

SEQ ID NO: 335942 - DNA, 25 bp, Mus musculus
ccaaccacagagatcgagagagcct

SEQ ID NO: 335943 - DNA, 25 bp, Mus musculus
ccaaccacagagttcgagagagcct

SEQ ID NO: 335944 - DNA, 25 bp, Mus musculus
ccaaccacgccaatcagaattctaa

SEQ ID NO: 335945 - DNA, 25 bp, Mus musculus
ccaaccacgccattcagaattctaa

SEQ ID NO: 335946 - DNA, 25 bp, Mus musculus
ccaaccactgcgatttgctttatag

SEQ ID NO: 335947 - DNA, 25 bp, Mus musculus
ccaaccactgcgttttgctttatag

SEQ ID NO: 335948 - DNA, 25 bp, Mus musculus
ccaaccactgtgagaaaccccaata

SEQ ID NO: 335949 - DNA, 25 bp, Mus musculus
ccaaccactgtgtgaaaccccaata

SEQ ID NO: 335950 - DNA, 25 bp, Mus musculus
ccaaccacttaaatcccagcaggaa

SEQ ID NO: 335951 - DNA, 25 bp, Mus musculus
ccaaccacttaattcccagcaggaa

SEQ ID NO: 335952 - DNA, 25 bp, Mus musculus
ccaaccagattcatcacacttcttg

SEQ ID NO: 335953 - DNA, 25 bp, Mus musculus
ccaaccagattcttcacacttcttg

SEQ ID NO: 335954 - DNA, 25 bp, Mus musculus
ccaaccaggaccagatcctcaataa

SEQ ID NO: 335955 - DNA, 25 bp, Mus musculus
ccaaccaggacctgatcctcaataa

SEQ ID NO: 335956 - DNA, 25 bp, Mus musculus
ccaaccagtatcacaatcagaatgt

SEQ ID NO: 335957 - DNA, 25 bp, Mus musculus
ccaaccagtatctcaatcagaatgt

SEQ ID NO: 335958 - DNA, 25 bp, Mus musculus
ccaaccagtccgagaaagatatcct

SEQ ID NO: 335959 - DNA, 25 bp, Mus musculus
ccaaccagtccgtgaaagatatcct

SEQ ID NO: 335960 - DNA, 25 bp, Mus musculus
ccaaccagtgaaaggagacgtgctc

SEQ ID NO: 335961 - DNA, 25 bp, Mus musculus
ccaaccagtgaatggagacgtgctc

SEQ ID NO: 335962 - DNA, 25 bp, Mus musculus
ccaacccattgactgctaagcagct

SEQ ID NO: 335963 - DNA, 25 bp, Mus musculus
ccaacccattgagtgctaagcagct

SEQ ID NO: 335964 - DNA, 25 bp, Mus musculus
ccaaccccaatactcttcaaggtga

SEQ ID NO: 335965 - DNA, 25 bp, Mus musculus
ccaaccccaatagtcttcaaggtga

SEQ ID NO: 335966 - DNA, 25 bp, Mus musculus
ccaaccccacttcctagaaagagag

SEQ ID NO: 335967 - DNA, 25 bp, Mus musculus
ccaaccccacttgctagaaagagag

SEQ ID NO: 335968 - DNA, 25 bp, Mus musculus
ccaaccccagaaatctctaatgtgc

SEQ ID NO: 335969 - DNA, 25 bp, Mus musculus
ccaaccccagaattctctaatgtgc

SEQ ID NO: 335970 - DNA, 25 bp, Mus musculus
ccaaccccagcaccagaagagaaag

SEQ ID NO: 335971 - DNA, 25 bp, Mus musculus
ccaaccccagcagcagaagagaaag

SEQ ID NO: 335972 - DNA, 25 bp, Mus musculus
ccaaccccatcaacgatggtaggaa

SEQ ID NO: 335973 - DNA, 25 bp, Mus musculus
ccaaccccatcatcgatggtaggaa

SEQ ID NO: 335974 - DNA, 25 bp, Mus musculus
ccaacccctctgatcaacatgaaaa

SEQ ID NO: 335975 - DNA, 25 bp, Mus musculus
ccaacccctctgttcaacatgaaaa

SEQ ID NO: 335976 - DNA, 25 bp, Mus musculus
ccaacccgtgcgctgtagaacagat

SEQ ID NO: 335977 - DNA, 25 bp, Mus musculus
ccaacccgtgcggtgtagaacagat

SEQ ID NO: 335978 - DNA, 25 bp, Mus musculus
ccaacccgtggtcctatgagaattt

SEQ ID NO: 335979 - DNA, 25 bp, Mus musculus
ccaacccgtggtgctatgagaattt

SEQ ID NO: 335980 - DNA, 25 bp, Mus musculus
ccaaccctaactaatacgagttgat

SEQ ID NO: 335981 - DNA, 25 bp, Mus musculus
ccaaccctaacttatacgagttgat

SEQ ID NO: 335982 - DNA, 25 bp, Mus musculus
ccaaccctcaggatcaatacttcat

SEQ ID NO: 335983 - DNA, 25 bp, Mus musculus
ccaaccctcaggttcaatacttcat

SEQ ID NO: 335984 - DNA, 25 bp, Mus musculus
ccaaccctctgtatcagtcatgaaa

SEQ ID NO: 335985 - DNA, 25 bp, Mus musculus
ccaaccctctgtttcagtcatgaaa

SEQ ID NO: 335986 - DNA, 25 bp, Mus musculus
ccaaccctgcagagacagagctggt

SEQ ID NO: 335987 - DNA, 25 bp, Mus musculus
ccaaccctgcagtgacagagctggt

SEQ ID NO: 335988 - DNA, 25 bp, Mus musculus
ccaaccctgtagaagttagaagatg

SEQ ID NO: 335989 - DNA, 25 bp, Mus musculus
ccaaccctgtagtagttagaagatg

SEQ ID NO: 335990 - DNA, 25 bp, Mus musculus
ccaaccctgtatcacttacctaagt

SEQ ID NO: 335991 - DNA, 25 bp, Mus musculus
ccaaccctgtatgacttacctaagt

SEQ ID NO: 335992 - DNA, 25 bp, Mus musculus
ccaaccctgtgacgtgtcattgttt

SEQ ID NO: 335993 - DNA, 25 bp, Mus musculus
ccaaccctgtgaggtgtcattgttt

SEQ ID NO: 335994 - DNA, 25 bp, Mus musculus
ccaacccttgatccattttgacatt

SEQ ID NO: 335995 - DNA, 25 bp, Mus musculus
ccaacccttgatgcattttgacatt

SEQ ID NO: 335996 - DNA, 25 bp, Mus musculus
ccaacccttgctccattattttgaa

SEQ ID NO: 335997 - DNA, 25 bp, Mus musculus
ccaacccttgctgcattattttgaa

SEQ ID NO: 335998 - DNA, 25 bp, Mus musculus
ccaaccgactatcagcagggacgtt

SEQ ID NO: 335999 - DNA, 25 bp, Mus musculus
ccaaccgactatgagcagggacgtt

SEQ ID NO: 336000 - DNA, 25 bp, Mus musculus
ccaaccgcccagatattgatttgtt

SEQ ID NO: 336001 - DNA, 25 bp, Mus musculus
ccaaccgcccagttattgatttgtt

SEQ ID NO: 336002 - DNA, 25 bp, Mus musculus
ccaaccggataactgcattcaagag

SEQ ID NO: 336003 - DNA, 25 bp, Mus musculus
ccaaccggataagtgcattcaagag

SEQ ID NO: 336004 - DNA, 25 bp, Mus musculus
ccaaccgtacacattcattgactcg

SEQ ID NO: 336005 - DNA, 25 bp, Mus musculus
ccaaccgtacactttcattgactcg

SEQ ID NO: 336006 - DNA, 25 bp, Mus musculus
ccaaccgtgtcaacagcacagtgtt

SEQ ID NO: 336007 - DNA, 25 bp, Mus musculus
ccaaccgtgtcatcagcacagtgtt

SEQ ID NO: 336008 - DNA, 25 bp, Mus musculus
ccaacctactggcaactgtgtgagg

SEQ ID NO: 336009 - DNA, 25 bp, Mus musculus
ccaacctactgggaactgtgtgagg

SEQ ID NO: 336010 - DNA, 25 bp, Mus musculus
ccaacctcatggcagaaggctacaa

SEQ ID NO: 336011 - DNA, 25 bp, Mus musculus
ccaacctcatgggagaaggctacaa

SEQ ID NO: 336012 - DNA, 25 bp, Mus musculus
ccaacctcctcaattcttggattga

SEQ ID NO: 336013 - DNA, 25 bp, Mus musculus
ccaacctcctcatttcttggattga

SEQ ID NO: 336014 - DNA, 25 bp, Mus musculus
ccaacctcctggacagggtagggat

SEQ ID NO: 336015 - DNA, 25 bp, Mus musculus
ccaacctcctggtcagggtagggat

SEQ ID NO: 336016 - DNA, 25 bp, Mus musculus
ccaacctcttcacctttgatttctg

SEQ ID NO: 336017 - DNA, 25 bp, Mus musculus
ccaacctcttcagctttgatttctg

SEQ ID NO: 336018 - DNA, 25 bp, Mus musculus
ccaacctcttctaaatgctttgact

SEQ ID NO: 336019 - DNA, 25 bp, Mus musculus
ccaacctcttcttaatgctttgact

SEQ ID NO: 336020 - DNA, 25 bp, Mus musculus
ccaacctgatgacccaagctgagtt

SEQ ID NO: 336021 - DNA, 25 bp, Mus musculus
ccaacctgatgagccaagctgagtt

SEQ ID NO: 336022 - DNA, 25 bp, Mus musculus
ccaacctgctcaaacttaccaagtt

SEQ ID NO: 336023 - DNA, 25 bp, Mus musculus
ccaacctgctcatacttaccaagtt

SEQ ID NO: 336024 - DNA, 25 bp, Mus musculus
ccaacctggatcacaggcgtagggt

SEQ ID NO: 336025 - DNA, 25 bp, Mus musculus
ccaacctggatctcaggcgtagggt

SEQ ID NO: 336026 - DNA, 25 bp, Mus musculus
ccaacctggtgtcatggtcttcttt

SEQ ID NO: 336027 - DNA, 25 bp, Mus musculus
ccaacctggtgtgatggtcttcttt

SEQ ID NO: 336028 - DNA, 25 bp, Mus musculus
ccaaccttagagcttcatttattat

SEQ ID NO: 336029 - DNA, 25 bp, Mus musculus
ccaaccttagaggttcatttattat

SEQ ID NO: 336030 - DNA, 25 bp, Mus musculus
ccaaccttcctacctcagaggagaa

SEQ ID NO: 336031 - DNA, 25 bp, Mus musculus
ccaaccttcctagctcagaggagaa

SEQ ID NO: 336032 - DNA, 25 bp, Mus musculus
ccaaccttctaaactgtctattctg

SEQ ID NO: 336033 - DNA, 25 bp, Mus musculus
ccaaccttctaatctgtctattctg

SEQ ID NO: 336034 - DNA, 25 bp, Mus musculus
ccaaccttttttcatgactgcctat

SEQ ID NO: 336035 - DNA, 25 bp, Mus musculus
ccaaccttttttgatgactgcctat

SEQ ID NO: 336036 - DNA, 25 bp, Mus musculus
ccaacgaactgccttccttaatatt

SEQ ID NO: 336037 - DNA, 25 bp, Mus musculus
ccaacgaactgcgttccttaatatt

SEQ ID NO: 336038 - DNA, 25 bp, Mus musculus
ccaacgacgcatatggttctcaggg

SEQ ID NO: 336039 - DNA, 25 bp, Mus musculus
ccaacgacgcatttggttctcaggg

SEQ ID NO: 336040 - DNA, 25 bp, Mus musculus
ccaacgactcttaaaaacgaatgat

SEQ ID NO: 336041 - DNA, 25 bp, Mus musculus
ccaacgactctttaaaacgaatgat

SEQ ID NO: 336042 - DNA, 25 bp, Mus musculus
ccaacgagtgaccctgagaaccagg

SEQ ID NO: 336043 - DNA, 25 bp, Mus musculus
ccaacgagtgacgctgagaaccagg

SEQ ID NO: 336044 - DNA, 25 bp, Mus musculus
ccaacgcaggcaccattgcatgatt

SEQ ID NO: 336045 - DNA, 25 bp, Mus musculus
ccaacgcaggcagcattgcatgatt

SEQ ID NO: 336046 - DNA, 25 bp, Mus musculus
ccaacgcccagactatgtggagctg

SEQ ID NO: 336047 - DNA, 25 bp, Mus musculus
ccaacgcccagagtatgtggagctg

SEQ ID NO: 336048 - DNA, 25 bp, Mus musculus
ccaacgccgaggagctcaaggtcct

SEQ ID NO: 336049 - DNA, 25 bp, Mus musculus
ccaacgccgaggtgctcaaggtcct

SEQ ID NO: 336050 - DNA, 25 bp, Mus musculus
ccaacgctgataagtactggagtta

SEQ ID NO: 336051 - DNA, 25 bp, Mus musculus
ccaacgctgatatgtactggagtta

SEQ ID NO: 336052 - DNA, 25 bp, Mus musculus
ccaacggagggcacggtgactcatg

SEQ ID NO: 336053 - DNA, 25 bp, Mus musculus
ccaacggagggctcggtgactcatg

SEQ ID NO: 336054 - DNA, 25 bp, Mus musculus
ccaacgggcctcaacagtcagagtc

SEQ ID NO: 336055 - DNA, 25 bp, Mus musculus
ccaacgggcctctacagtcagagtc

SEQ ID NO: 336056 - DNA, 25 bp, Mus musculus
ccaactaaggtcagtgtcgccttct

SEQ ID NO: 336057 - DNA, 25 bp, Mus musculus
ccaactaaggtctgtgtcgccttct

SEQ ID NO: 336058 - DNA, 25 bp, Mus musculus
ccaactacaggtcgctgttgacaat

SEQ ID NO: 336059 - DNA, 25 bp, Mus musculus
ccaactacaggtggctgttgacaat

SEQ ID NO: 336060 - DNA, 25 bp, Mus musculus
ccaactaccatactgttcaccataa

SEQ ID NO: 336061 - DNA, 25 bp, Mus musculus
ccaactaccatagtgttcaccataa

SEQ ID NO: 336062 - DNA, 25 bp, Mus musculus
ccaactatgatcactgtcccagaac

SEQ ID NO: 336063 - DNA, 25 bp, Mus musculus
ccaactatgatctctgtcccagaac

SEQ ID NO: 336064 - DNA, 25 bp, Mus musculus
ccaactatgggcacaatattcgtgt

SEQ ID NO: 336065 - DNA, 25 bp, Mus musculus
ccaactatgggctcaatattcgtgt

SEQ ID NO: 336066 - DNA, 25 bp, Mus musculus
ccaactcccatgatctaatctgagg

SEQ ID NO: 336067 - DNA, 25 bp, Mus musculus
ccaactcccatgttctaatctgagg

SEQ ID NO: 336068 - DNA, 25 bp, Mus musculus
ccaactccgtgtatcgctaaggaat

SEQ ID NO: 336069 - DNA, 25 bp, Mus musculus
ccaactccgtgtttcgctaaggaat

SEQ ID NO: 336070 - DNA, 25 bp, Mus musculus
ccaactcctgagaaccagggagcag

SEQ ID NO: 336071 - DNA, 25 bp, Mus musculus
ccaactcctgagtaccagggagcag

SEQ ID NO: 336072 - DNA, 25 bp, Mus musculus
ccaactcctgttctatcttttcaca

SEQ ID NO: 336073 - DNA, 25 bp, Mus musculus
ccaactcctgttgtatcttttcaca

SEQ ID NO: 336074 - DNA, 25 bp, Mus musculus
ccaactcgcactatttcaagaccga

SEQ ID NO: 336075 - DNA, 25 bp, Mus musculus
ccaactcgcactttttcaagaccga

SEQ ID NO: 336076 - DNA, 25 bp, Mus musculus
ccaactctcactatctttatcttaa

SEQ ID NO: 336077 - DNA, 25 bp, Mus musculus
ccaactctcactttctttatcttaa

SEQ ID NO: 336078 - DNA, 25 bp, Mus musculus
ccaactctcagtatgcaggatcagc

SEQ ID NO: 336079 - DNA, 25 bp, Mus musculus
ccaactctcagtttgcaggatcagc

SEQ ID NO: 336080 - DNA, 25 bp, Mus musculus
ccaactctcctcagataacttttaa

SEQ ID NO: 336081 - DNA, 25 bp, Mus musculus
ccaactctcctctgataacttttaa

SEQ ID NO: 336082 - DNA, 25 bp, Mus musculus
ccaactctgtccaaagggtacactg

SEQ ID NO: 336083 - DNA, 25 bp, Mus musculus
ccaactctgtcctaagggtacactg

SEQ ID NO: 336084 - DNA, 25 bp, Mus musculus
ccaactcttcttaagctgctctgag

SEQ ID NO: 336085 - DNA, 25 bp, Mus musculus
ccaactcttctttagctgctctgag

SEQ ID NO: 336086 - DNA, 25 bp, Mus musculus
ccaactgacagaagaccgcaataat

SEQ ID NO: 336087 - DNA, 25 bp, Mus musculus
ccaactgacagatgaccgcaataat

SEQ ID NO: 336088 - DNA, 25 bp, Mus musculus
ccaactgacattccgtgctgctggc

SEQ ID NO: 336089 - DNA, 25 bp, Mus musculus
ccaactgacattgcgtgctgctggc

SEQ ID NO: 336090 - DNA, 25 bp, Mus musculus
ccaactgataatctgcttttttaga

SEQ ID NO: 336091 - DNA, 25 bp, Mus musculus
ccaactgataatgtgcttttttaga

SEQ ID NO: 336092 - DNA, 25 bp, Mus musculus
ccaactgatcatattctgtcttcta

SEQ ID NO: 336093 - DNA, 25 bp, Mus musculus
ccaactgatcattttctgtcttcta

SEQ ID NO: 336094 - DNA, 25 bp, Mus musculus
ccaactgatctgattccacatggag

SEQ ID NO: 336095 - DNA, 25 bp, Mus musculus
ccaactgatctgtttccacatggag

SEQ ID NO: 336096 - DNA, 25 bp, Mus musculus
ccaactgatgcactttatgataatt

SEQ ID NO: 336097 - DNA, 25 bp, Mus musculus
ccaactgatgcagtttatgataatt

SEQ ID NO: 336098 - DNA, 25 bp, Mus musculus
ccaactgcacagatcctgttgtagg

SEQ ID NO: 336099 - DNA, 25 bp, Mus musculus
ccaactgcacagttcctgttgtagg

SEQ ID NO: 336100 - DNA, 25 bp, Mus musculus
ccaactgcctgtcgtggactatgaa

SEQ ID NO: 336101 - DNA, 25 bp, Mus musculus
ccaactgcctgtggtggactatgaa

SEQ ID NO: 336102 - DNA, 25 bp, Mus musculus
ccaactgctcagatcacaactaact

SEQ ID NO: 336103 - DNA, 25 bp, Mus musculus
ccaactgctcagttcacaactaact

SEQ ID NO: 336104 - DNA, 25 bp, Mus musculus
ccaactgctcctactctttaaggag

SEQ ID NO: 336105 - DNA, 25 bp, Mus musculus
ccaactgctccttctctttaaggag

SEQ ID NO: 336106 - DNA, 25 bp, Mus musculus
ccaactgctgcaaacttttgacaag

SEQ ID NO: 336107 - DNA, 25 bp, Mus musculus
ccaactgctgcatacttttgacaag

SEQ ID NO: 336108 - DNA, 25 bp, Mus musculus
ccaactgctggacgacaaactgcaa

SEQ ID NO: 336109 - DNA, 25 bp, Mus musculus
ccaactgctggaggacaaactgcaa

SEQ ID NO: 336110 - DNA, 25 bp, Mus musculus
ccaactggaagtccagtggtgctca

SEQ ID NO: 336111 - DNA, 25 bp, Mus musculus
ccaactggaagtgcagtggtgctca

SEQ ID NO: 336112 - DNA, 25 bp, Mus musculus
ccaactgggctgagctatttttaaa

SEQ ID NO: 336113 - DNA, 25 bp, Mus musculus
ccaactgggctgtgctatttttaaa

SEQ ID NO: 336114 - DNA, 25 bp, Mus musculus
ccaactgtagccatttttgcagagt

SEQ ID NO: 336115 - DNA, 25 bp, Mus musculus
ccaactgtagccttttttgcagagt

SEQ ID NO: 336116 - DNA, 25 bp, Mus musculus
ccaactgtattaactaagggcttta

SEQ ID NO: 336117 - DNA, 25 bp, Mus musculus
ccaactgtattatctaagggcttta

SEQ ID NO: 336118 - DNA, 25 bp, Mus musculus
ccaactgtcatcatggttaggcgag

SEQ ID NO: 336119 - DNA, 25 bp, Mus musculus
ccaactgtcatcttggttaggcgag

SEQ ID NO: 336120 - DNA, 25 bp, Mus musculus
ccaactgtgacaagttttgataaaa

SEQ ID NO: 336121 - DNA, 25 bp, Mus musculus
ccaactgtgacatgttttgataaaa

SEQ ID NO: 336122 - DNA, 25 bp, Mus musculus
ccaactgtggcaatactttatttta

SEQ ID NO: 336123 - DNA, 25 bp, Mus musculus
ccaactgtggcattactttatttta

SEQ ID NO: 336124 - DNA, 25 bp, Mus musculus
ccaactgtgggcagccgtcgtcctg

SEQ ID NO: 336125 - DNA, 25 bp, Mus musculus
ccaactgtgggctgccgtcgtcctg

SEQ ID NO: 336126 - DNA, 25 bp, Mus musculus
ccaactgttcacagtttttcaaaat

SEQ ID NO: 336127 - DNA, 25 bp, Mus musculus
ccaactgttcactgtttttcaaaat

SEQ ID NO: 336128 - DNA, 25 bp, Mus musculus
ccaactgttttgatccttcttgaca

SEQ ID NO: 336129 - DNA, 25 bp, Mus musculus
ccaactgttttgttccttcttgaca

SEQ ID NO: 336130 - DNA, 25 bp, Mus musculus
ccaactgtttttcaccttgtctgat

SEQ ID NO: 336131 - DNA, 25 bp, Mus musculus
ccaactgtttttgaccttgtctgat

SEQ ID NO: 336132 - DNA, 25 bp, Mus musculus
ccaacttaaagtcattcgcagattt

SEQ ID NO: 336133 - DNA, 25 bp, Mus musculus
ccaacttaaagtgattcgcagattt

SEQ ID NO: 336134 - DNA, 25 bp, Mus musculus
ccaacttagatgaggtgaacctcag

SEQ ID NO: 336135 - DNA, 25 bp, Mus musculus
ccaacttagatgtggtgaacctcag

SEQ ID NO: 336136 - DNA, 25 bp, Mus musculus
ccaacttattccaggcttgaaagca

SEQ ID NO: 336137 - DNA, 25 bp, Mus musculus
ccaacttattcctggcttgaaagca

SEQ ID NO: 336138 - DNA, 25 bp, Mus musculus
ccaacttcaatgcaaagggctatat

SEQ ID NO: 336139 - DNA, 25 bp, Mus musculus
ccaacttcaatggaaagggctatat

SEQ ID NO: 336140 - DNA, 25 bp, Mus musculus
ccaacttcctggagttagtctcttt

SEQ ID NO: 336141 - DNA, 25 bp, Mus musculus
ccaacttcctggtgttagtctcttt

SEQ ID NO: 336142 - DNA, 25 bp, Mus musculus
ccaacttcctgtagtctttatcaca

SEQ ID NO: 336143 - DNA, 25 bp, Mus musculus
ccaacttcctgttgtctttatcaca

SEQ ID NO: 336144 - DNA, 25 bp, Mus musculus
ccaacttctcttataacctgacatc

SEQ ID NO: 336145 - DNA, 25 bp, Mus musculus
ccaacttctcttttaacctgacatc

SEQ ID NO: 336146 - DNA, 25 bp, Mus musculus
ccaacttctgctagtgtagtagtat

SEQ ID NO: 336147 - DNA, 25 bp, Mus musculus
ccaacttctgcttgtgtagtagtat

SEQ ID NO: 336148 - DNA, 25 bp, Mus musculus
ccaacttctgttactggtgggagcg

SEQ ID NO: 336149 - DNA, 25 bp, Mus musculus
ccaacttctgtttctggtgggagcg

SEQ ID NO: 336150 - DNA, 25 bp, Mus musculus
ccaacttgccaaatttgttttatag

SEQ ID NO: 336151 - DNA, 25 bp, Mus musculus
ccaacttgccaattttgttttatag

SEQ ID NO: 336152 - DNA, 25 bp, Mus musculus
ccaacttgggtcagacttctgaata

SEQ ID NO: 336153 - DNA, 25 bp, Mus musculus
ccaacttgggtctgacttctgaata

SEQ ID NO: 336154 - DNA, 25 bp, Mus musculus
ccaacttgtcctagtaccctttgca

SEQ ID NO: 336155 - DNA, 25 bp, Mus musculus
ccaacttgtccttgtaccctttgca

SEQ ID NO: 336156 - DNA, 25 bp, Mus musculus
ccaactttcatgaagtgcctggtta

SEQ ID NO: 336157 - DNA, 25 bp, Mus musculus
ccaactttcatgtagtgcctggtta

SEQ ID NO: 336158 - DNA, 25 bp, Mus musculus
ccaactttcggtccatgttcagtaa

SEQ ID NO: 336159 - DNA, 25 bp, Mus musculus
ccaactttcggtgcatgttcagtaa

SEQ ID NO: 336160 - DNA, 25 bp, Mus musculus
ccaactttgcataccacagaaattt

SEQ ID NO: 336161 - DNA, 25 bp, Mus musculus
ccaactttgcattccacagaaattt

SEQ ID NO: 336162 - DNA, 25 bp, Mus musculus
ccaactttggcaccaactgcatttg

SEQ ID NO: 336163 - DNA, 25 bp, Mus musculus
ccaactttggcagcaactgcatttg

SEQ ID NO: 336164 - DNA, 25 bp, Mus musculus
ccaactttgggacctgtgatgtcta

SEQ ID NO: 336165 - DNA, 25 bp, Mus musculus
ccaactttgggagctgtgatgtcta

SEQ ID NO: 336166 - DNA, 25 bp, Mus musculus
ccaacttttcaccatcagatctgta

SEQ ID NO: 336167 - DNA, 25 bp, Mus musculus
ccaacttttcacgatcagatctgta

SEQ ID NO: 336168 - DNA, 25 bp, Mus musculus
ccaagaacaagactagccagcgata

SEQ ID NO: 336169 - DNA, 25 bp, Mus musculus
ccaagaacaagagtagccagcgata

SEQ ID NO: 336170 - DNA, 25 bp, Mus musculus
ccaagaacaggaagacctttgaagg

SEQ ID NO: 336171 - DNA, 25 bp, Mus musculus
ccaagaacaggatgacctttgaagg

SEQ ID NO: 336172 - DNA, 25 bp, Mus musculus
ccaagaacttgtcatgtgccccatc

SEQ ID NO: 336173 - DNA, 25 bp, Mus musculus
ccaagaacttgtgatgtgccccatc

SEQ ID NO: 336174 - DNA, 25 bp, Mus musculus
ccaagaagaattccccacgggatgt

SEQ ID NO: 336175 - DNA, 25 bp, Mus musculus
ccaagaagaattgcccacgggatgt

SEQ ID NO: 336176 - DNA, 25 bp, Mus musculus
ccaagaagacacagacttgcggtgt

SEQ ID NO: 336177 - DNA, 25 bp, Mus musculus
ccaagaagacactgacttgcggtgt

SEQ ID NO: 336178 - DNA, 25 bp, Mus musculus
ccaagaagcattagtggatgggttg

SEQ ID NO: 336179 - DNA, 25 bp, Mus musculus
ccaagaagcatttgtggatgggttg

SEQ ID NO: 336180 - DNA, 25 bp, Mus musculus
ccaagaaggcctccggatgttttcc

SEQ ID NO: 336181 - DNA, 25 bp, Mus musculus
ccaagaaggcctgcggatgttttcc

SEQ ID NO: 336182 - DNA, 25 bp, Mus musculus
ccaagaagggccagtctacttcccg

SEQ ID NO: 336183 - DNA, 25 bp, Mus musculus
ccaagaagggcctgtctacttcccg

SEQ ID NO: 336184 - DNA, 25 bp, Mus musculus
ccaagaaggtgtagctttgttccac

SEQ ID NO: 336185 - DNA, 25 bp, Mus musculus
ccaagaaggtgttgctttgttccac

SEQ ID NO: 336186 - DNA, 25 bp, Mus musculus
ccaagaatcatgcagccaggttttg

SEQ ID NO: 336187 - DNA, 25 bp, Mus musculus
ccaagaatcatggagccaggttttg

SEQ ID NO: 336188 - DNA, 25 bp, Mus musculus
ccaagaatgctccatcaacagtgtg

SEQ ID NO: 336189 - DNA, 25 bp, Mus musculus
ccaagaatgctcgatcaacagtgtg

SEQ ID NO: 336190 - DNA, 25 bp, Mus musculus
ccaagaatgcttcggcgtgcagcag

SEQ ID NO: 336191 - DNA, 25 bp, Mus musculus
ccaagaatgcttgggcgtgcagcag

SEQ ID NO: 336192 - DNA, 25 bp, Mus musculus
ccaagacaccttagatgctgacacc

SEQ ID NO: 336193 - DNA, 25 bp, Mus musculus
ccaagacacctttgatgctgacacc

SEQ ID NO: 336194 - DNA, 25 bp, Mus musculus
ccaagacatcaaacacacttttctg

SEQ ID NO: 336195 - DNA, 25 bp, Mus musculus
ccaagacatcaatcacacttttctg

SEQ ID NO: 336196 - DNA, 25 bp, Mus musculus
ccaagacatggcatacgtactcttt

SEQ ID NO: 336197 - DNA, 25 bp, Mus musculus
ccaagacatggcttacgtactcttt

SEQ ID NO: 336198 - DNA, 25 bp, Mus musculus
ccaagaccaagaccactgttgactg

SEQ ID NO: 336199 - DNA, 25 bp, Mus musculus
ccaagaccaagagcactgttgactg

SEQ ID NO: 336200 - DNA, 25 bp, Mus musculus
ccaagaccacgcagatctgtgctgg

SEQ ID NO: 336201 - DNA, 25 bp, Mus musculus
ccaagaccacgctgatctgtgctgg

SEQ ID NO: 336202 - DNA, 25 bp, Mus musculus
ccaagaccacgtactctgcacagtg

SEQ ID NO: 336203 - DNA, 25 bp, Mus musculus
ccaagaccacgttctctgcacagtg

SEQ ID NO: 336204 - DNA, 25 bp, Mus musculus
ccaagaccagggagagcgtccttga

SEQ ID NO: 336205 - DNA, 25 bp, Mus musculus
ccaagaccagggtgagcgtccttga

SEQ ID NO: 336206 - DNA, 25 bp, Mus musculus
ccaagacgaaccagacggccaagtt

SEQ ID NO: 336207 - DNA, 25 bp, Mus musculus
ccaagacgaacctgacggccaagtt

SEQ ID NO: 336208 - DNA, 25 bp, Mus musculus
ccaagacggatcactcaggacagga

SEQ ID NO: 336209 - DNA, 25 bp, Mus musculus
ccaagacggatctctcaggacagga

SEQ ID NO: 336210 - DNA, 25 bp, Mus musculus
ccaagacggtggctgcacggacctt

SEQ ID NO: 336211 - DNA, 25 bp, Mus musculus
ccaagacggtgggtgcacggacctt

SEQ ID NO: 336212 - DNA, 25 bp, Mus musculus
ccaagactaatgatcagcccaggat

SEQ ID NO: 336213 - DNA, 25 bp, Mus musculus
ccaagactaatgttcagcccaggat

SEQ ID NO: 336214 - DNA, 25 bp, Mus musculus
ccaagactcagcctacattcttttg

SEQ ID NO: 336215 - DNA, 25 bp, Mus musculus
ccaagactcagcgtacattcttttg

SEQ ID NO: 336216 - DNA, 25 bp, Mus musculus
ccaagactctagcaagactgttgtg

SEQ ID NO: 336217 - DNA, 25 bp, Mus musculus
ccaagactctaggaagactgttgtg

SEQ ID NO: 336218 - DNA, 25 bp, Mus musculus
ccaagactgcttcgcatcctcaaat

SEQ ID NO: 336219 - DNA, 25 bp, Mus musculus
ccaagactgcttggcatcctcaaat

SEQ ID NO: 336220 - DNA, 25 bp, Mus musculus
ccaagactgtgtccagagtgcgctg

SEQ ID NO: 336221 - DNA, 25 bp, Mus musculus
ccaagactgtgtgcagagtgcgctg

SEQ ID NO: 336222 - DNA, 25 bp, Mus musculus
ccaagagaacttcgcgagtcaggtg

SEQ ID NO: 336223 - DNA, 25 bp, Mus musculus
ccaagagaacttggcgagtcaggtg

SEQ ID NO: 336224 - DNA, 25 bp, Mus musculus
ccaagagactcgagcccactgggtc

SEQ ID NO: 336225 - DNA, 25 bp, Mus musculus
ccaagagactcgtgcccactgggtc

SEQ ID NO: 336226 - DNA, 25 bp, Mus musculus
ccaagagacttgagatgttatttgt

SEQ ID NO: 336227 - DNA, 25 bp, Mus musculus
ccaagagacttgtgatgttatttgt

SEQ ID NO: 336228 - DNA, 25 bp, Mus musculus
ccaagagccatgaggttcctgctgc

SEQ ID NO: 336229 - DNA, 25 bp, Mus musculus
ccaagagccatgtggttcctgctgc

SEQ ID NO: 336230 - DNA, 25 bp, Mus musculus
ccaagagctggcagtacaggcaccc

SEQ ID NO: 336231 - DNA, 25 bp, Mus musculus
ccaagagctggccatggtgacgcat

SEQ ID NO: 336232 - DNA, 25 bp, Mus musculus
ccaagagctggcgatggtgacgcat

SEQ ID NO: 336233 - DNA, 25 bp, Mus musculus
ccaagagctggctgtacaggcaccc

SEQ ID NO: 336234 - DNA, 25 bp, Mus musculus
ccaagagctgtaactgaggcccaga

SEQ ID NO: 336235 - DNA, 25 bp, Mus musculus
ccaagagctgtatctgaggcccaga

SEQ ID NO: 336236 - DNA, 25 bp, Mus musculus
ccaagaggagcgactgatcatggcc

SEQ ID NO: 336237 - DNA, 25 bp, Mus musculus
ccaagaggagcgtctgatcatggcc

SEQ ID NO: 336238 - DNA, 25 bp, Mus musculus
ccaagaggcaaccagtgagcgcctt

SEQ ID NO: 336239 - DNA, 25 bp, Mus musculus
ccaagaggcaacgagtgagcgcctt

SEQ ID NO: 336240 - DNA, 25 bp, Mus musculus
ccaagagggacacctccagttggct

SEQ ID NO: 336241 - DNA, 25 bp, Mus musculus
ccaagagggacagctccagttggct

SEQ ID NO: 336242 - DNA, 25 bp, Mus musculus
ccaagagggctgcagaactcacgga

SEQ ID NO: 336243 - DNA, 25 bp, Mus musculus
ccaagagggctggagaactcacgga

SEQ ID NO: 336244 - DNA, 25 bp, Mus musculus
ccaagaggtgggacgttcccagcgt

SEQ ID NO: 336245 - DNA, 25 bp, Mus musculus
ccaagaggtgggtcgttcccagcgt

SEQ ID NO: 336246 - DNA, 25 bp, Mus musculus
ccaagagttaacatctgttcttcaa

SEQ ID NO: 336247 - DNA, 25 bp, Mus musculus
ccaagagttaacttctgttcttcaa

SEQ ID NO: 336248 - DNA, 25 bp, Mus musculus
ccaagagttctgcagcctatgtggg

SEQ ID NO: 336249 - DNA, 25 bp, Mus musculus
ccaagagttctggagcctatgtggg

SEQ ID NO: 336250 - DNA, 25 bp, Mus musculus
ccaagatagcttacggctcacacat

SEQ ID NO: 336251 - DNA, 25 bp, Mus musculus
ccaagatagcttattgtagatttgt

SEQ ID NO: 336252 - DNA, 25 bp, Mus musculus
ccaagatagctttcggctcacacat

SEQ ID NO: 336253 - DNA, 25 bp, Mus musculus
ccaagatagctttttgtagatttgt

SEQ ID NO: 336254 - DNA, 25 bp, Mus musculus
ccaagatcacggcaagggagcgcaa

SEQ ID NO: 336255 - DNA, 25 bp, Mus musculus
ccaagatcacgggaagggagcgcaa

SEQ ID NO: 336256 - DNA, 25 bp, Mus musculus
ccaagatcattaagtgggtcattct

SEQ ID NO: 336257 - DNA, 25 bp, Mus musculus
ccaagatcattatgtgggtcattct

SEQ ID NO: 336258 - DNA, 25 bp, Mus musculus
ccaagatcgtccctgtggtggagct

SEQ ID NO: 336259 - DNA, 25 bp, Mus musculus
ccaagatcgtccgtgtggtggagct

SEQ ID NO: 336260 - DNA, 25 bp, Mus musculus
ccaagatgatggagctggccagaga

SEQ ID NO: 336261 - DNA, 25 bp, Mus musculus
ccaagatgatggtgctggccagaga

SEQ ID NO: 336262 - DNA, 25 bp, Mus musculus
ccaagatgcatgcagacttcttcca

SEQ ID NO: 336263 - DNA, 25 bp, Mus musculus
ccaagatgcatggagacttcttcca

SEQ ID NO: 336264 - DNA, 25 bp, Mus musculus
ccaagatgccttaatccacttctct

SEQ ID NO: 336265 - DNA, 25 bp, Mus musculus
ccaagatgcctttatccacttctct

SEQ ID NO: 336266 - DNA, 25 bp, Mus musculus
ccaagatgctgtatgcactggttgt

SEQ ID NO: 336267 - DNA, 25 bp, Mus musculus
ccaagatgctgtttgcactggttgt

SEQ ID NO: 336268 - DNA, 25 bp, Mus musculus
ccaagatggcagatacatttttccc

SEQ ID NO: 336269 - DNA, 25 bp, Mus musculus
ccaagatggcagttacatttttccc

SEQ ID NO: 336270 - DNA, 25 bp, Mus musculus
ccaagatggcgaagcaagcggctaa

SEQ ID NO: 336271 - DNA, 25 bp, Mus musculus
ccaagatggcgatgcaagcggctaa

SEQ ID NO: 336272 - DNA, 25 bp, Mus musculus
ccaagatggctaagaacaaggactt

SEQ ID NO: 336273 - DNA, 25 bp, Mus musculus
ccaagatggctatgaacaaggactt

SEQ ID NO: 336274 - DNA, 25 bp, Mus musculus
ccaagatgggggctttgctacacaa

SEQ ID NO: 336275 - DNA, 25 bp, Mus musculus
ccaagatggggggtttgctacacaa

SEQ ID NO: 336276 - DNA, 25 bp, Mus musculus
ccaagatgggttaatgagctccaga

SEQ ID NO: 336277 - DNA, 25 bp, Mus musculus
ccaagatgggtttatgagctccaga

SEQ ID NO: 336278 - DNA, 25 bp, Mus musculus
ccaagatggtttatagaactataat

SEQ ID NO: 336279 - DNA, 25 bp, Mus musculus
ccaagatggtttttagaactataat

SEQ ID NO: 336280 - DNA, 25 bp, Mus musculus
ccaagattaatgctttttgtggcga

SEQ ID NO: 336281 - DNA, 25 bp, Mus musculus
ccaagattaatggtttttgtggcga

SEQ ID NO: 336282 - DNA, 25 bp, Mus musculus
ccaagattatgaaggactacgcggg

SEQ ID NO: 336283 - DNA, 25 bp, Mus musculus
ccaagattatgatggactacgcggg

SEQ ID NO: 336284 - DNA, 25 bp, Mus musculus
ccaagattgatcatgtacctttcat

SEQ ID NO: 336285 - DNA, 25 bp, Mus musculus
ccaagattgatcttgtacctttcat

SEQ ID NO: 336286 - DNA, 25 bp, Mus musculus
ccaagattgcatattcaacacatag

SEQ ID NO: 336287 - DNA, 25 bp, Mus musculus
ccaagattgcattttcaacacatag

SEQ ID NO: 336288 - DNA, 25 bp, Mus musculus
ccaagatttatgacagccccgagat

SEQ ID NO: 336289 - DNA, 25 bp, Mus musculus
ccaagatttatgtcagccccgagat

SEQ ID NO: 336290 - DNA, 25 bp, Mus musculus
ccaagatttctgacttcagctggaa

SEQ ID NO: 336291 - DNA, 25 bp, Mus musculus
ccaagatttctgattcactggccca

SEQ ID NO: 336292 - DNA, 25 bp, Mus musculus
ccaagatttctgtcttcagctggaa

SEQ ID NO: 336293 - DNA, 25 bp, Mus musculus
ccaagatttctgtttcactggccca

SEQ ID NO: 336294 - DNA, 25 bp, Mus musculus
ccaagcaaagctactaaagaccgaa

SEQ ID NO: 336295 - DNA, 25 bp, Mus musculus
ccaagcaaagcttctaaagaccgaa

SEQ ID NO: 336296 - DNA, 25 bp, Mus musculus
ccaagcaaatccagttcttttcttg

SEQ ID NO: 336297 - DNA, 25 bp, Mus musculus
ccaagcaaatcctgttcttttcttg

SEQ ID NO: 336298 - DNA, 25 bp, Mus musculus
ccaagcaatcaacgctttacaagat

SEQ ID NO: 336299 - DNA, 25 bp, Mus musculus
ccaagcaatcaaggctttacaagat

SEQ ID NO: 336300 - DNA, 25 bp, Mus musculus
ccaagcacaaggactcgagggttaa

SEQ ID NO: 336301 - DNA, 25 bp, Mus musculus
ccaagcacaaggtctcgagggttaa

SEQ ID NO: 336302 - DNA, 25 bp, Mus musculus
ccaagcacacacacctgaggatatt

SEQ ID NO: 336303 - DNA, 25 bp, Mus musculus
ccaagcacacactcctgaggatatt

SEQ ID NO: 336304 - DNA, 25 bp, Mus musculus
ccaagcacagacaaacggaaagccc

SEQ ID NO: 336305 - DNA, 25 bp, Mus musculus
ccaagcacagactaacggaaagccc

SEQ ID NO: 336306 - DNA, 25 bp, Mus musculus
ccaagcacagggatatcttcagact

SEQ ID NO: 336307 - DNA, 25 bp, Mus musculus
ccaagcacagggttatcttcagact

SEQ ID NO: 336308 - DNA, 25 bp, Mus musculus
ccaagcacatcccagcagtggtaat

SEQ ID NO: 336309 - DNA, 25 bp, Mus musculus
ccaagcacatccgagcagtggtaat

SEQ ID NO: 336310 - DNA, 25 bp, Mus musculus
ccaagcacatgacggaggccgtccg

SEQ ID NO: 336311 - DNA, 25 bp, Mus musculus
ccaagcacatgagggaggccgtccg

SEQ ID NO: 336312 - DNA, 25 bp, Mus musculus
ccaagcacccagcagagtaaaaaag

SEQ ID NO: 336313 - DNA, 25 bp, Mus musculus
ccaagcacccaggagagtaaaaaag

SEQ ID NO: 336314 - DNA, 25 bp, Mus musculus
ccaagcacctctctctgatagaaat

SEQ ID NO: 336315 - DNA, 25 bp, Mus musculus
ccaagcacctctgtctgatagaaat

SEQ ID NO: 336316 - DNA, 25 bp, Mus musculus
ccaagcacctggcagcactgaggaa

SEQ ID NO: 336317 - DNA, 25 bp, Mus musculus
ccaagcacctgggagcactgaggaa

SEQ ID NO: 336318 - DNA, 25 bp, Mus musculus
ccaagcactctaatagtttgtgcat

SEQ ID NO: 336319 - DNA, 25 bp, Mus musculus
ccaagcactctattagtttgtgcat

SEQ ID NO: 336320 - DNA, 25 bp, Mus musculus
ccaagcagcctcaacattttcaaat

SEQ ID NO: 336321 - DNA, 25 bp, Mus musculus
ccaagcagcctctacattttcaaat

SEQ ID NO: 336322 - DNA, 25 bp, Mus musculus
ccaagcaggttacggaaagctgaga

SEQ ID NO: 336323 - DNA, 25 bp, Mus musculus
ccaagcaggttagggaaagctgaga

SEQ ID NO: 336324 - DNA, 25 bp, Mus musculus
ccaagcatatggacttttcgcctat

SEQ ID NO: 336325 - DNA, 25 bp, Mus musculus
ccaagcatatggtcttttcgcctat

SEQ ID NO: 336326 - DNA, 25 bp, Mus musculus
ccaagcatgcaactggtccacagtt

SEQ ID NO: 336327 - DNA, 25 bp, Mus musculus
ccaagcatgcaagtggtccacagtt

SEQ ID NO: 336328 - DNA, 25 bp, Mus musculus
ccaagcatggagaagcctgggtcga

SEQ ID NO: 336329 - DNA, 25 bp, Mus musculus
ccaagcatggagtagcctgggtcga

SEQ ID NO: 336330 - DNA, 25 bp, Mus musculus
ccaagcatggctcggtttttcttta

SEQ ID NO: 336331 - DNA, 25 bp, Mus musculus
ccaagcatggctgggtttttcttta

SEQ ID NO: 336332 - DNA, 25 bp, Mus musculus
ccaagcatggtcctaaggccgtgga

SEQ ID NO: 336333 - DNA, 25 bp, Mus musculus
ccaagcatggtcgtaaggccgtgga

SEQ ID NO: 336334 - DNA, 25 bp, Mus musculus
ccaagccaacccaaggatatgtatt

SEQ ID NO: 336335 - DNA, 25 bp, Mus musculus
ccaagccaaccctaggatatgtatt

SEQ ID NO: 336336 - DNA, 25 bp, Mus musculus
ccaagccactgcagtgttcacagta

SEQ ID NO: 336337 - DNA, 25 bp, Mus musculus
ccaagccactgctgtgttcacagta

SEQ ID NO: 336338 - DNA, 25 bp, Mus musculus
ccaagccagactcggagacaggaat

SEQ ID NO: 336339 - DNA, 25 bp, Mus musculus
ccaagccagactgggagacaggaat

SEQ ID NO: 336340 - DNA, 25 bp, Mus musculus
ccaagccccactattgtgatatgtg

SEQ ID NO: 336341 - DNA, 25 bp, Mus musculus
ccaagccccacttttgtgatatgtg

SEQ ID NO: 336342 - DNA, 25 bp, Mus musculus
ccaagccccatgaaagtatgcaaat

SEQ ID NO: 336343 - DNA, 25 bp, Mus musculus
ccaagccccatgtaagtatgcaaat

SEQ ID NO: 336344 - DNA, 25 bp, Mus musculus
ccaagcccgactctacttatttaga

SEQ ID NO: 336345 - DNA, 25 bp, Mus musculus
ccaagcccgactgtacttatttaga

SEQ ID NO: 336346 - DNA, 25 bp, Mus musculus
ccaagcccttgcattgctgtaaaag

SEQ ID NO: 336347 - DNA, 25 bp, Mus musculus
ccaagcccttgctttgctgtaaaag

SEQ ID NO: 336348 - DNA, 25 bp, Mus musculus
ccaagcccttgtctggatattccaa

SEQ ID NO: 336349 - DNA, 25 bp, Mus musculus
ccaagcccttgtgtggatattccaa

SEQ ID NO: 336350 - DNA, 25 bp, Mus musculus
ccaagccgtgccactaacacttaaa

SEQ ID NO: 336351 - DNA, 25 bp, Mus musculus
ccaagccgtgcctctaacacttaaa

SEQ ID NO: 336352 - DNA, 25 bp, Mus musculus
ccaagcctaggtacttttgctgact

SEQ ID NO: 336353 - DNA, 25 bp, Mus musculus
ccaagcctaggttcttttgctgact

SEQ ID NO: 336354 - DNA, 25 bp, Mus musculus
ccaagcctagtgcacagatttccag

SEQ ID NO: 336355 - DNA, 25 bp, Mus musculus
ccaagcctagtggacagatttccag

SEQ ID NO: 336356 - DNA, 25 bp, Mus musculus
ccaagcctctaacgctgctgtaaaa

SEQ ID NO: 336357 - DNA, 25 bp, Mus musculus
ccaagcctctaaggctgctgtaaaa

SEQ ID NO: 336358 - DNA, 25 bp, Mus musculus
ccaagcctctagatctgttgcaggg

SEQ ID NO: 336359 - DNA, 25 bp, Mus musculus
ccaagcctctagttctgttgcaggg

SEQ ID NO: 336360 - DNA, 25 bp, Mus musculus
ccaagcctctgtcgtaatggttgca

SEQ ID NO: 336361 - DNA, 25 bp, Mus musculus
ccaagcctctgtggtaatggttgca

SEQ ID NO: 336362 - DNA, 25 bp, Mus musculus
ccaagcctctttaccatggacaaaa

SEQ ID NO: 336363 - DNA, 25 bp, Mus musculus
ccaagcctcttttccatggacaaaa

SEQ ID NO: 336364 - DNA, 25 bp, Mus musculus
ccaagcctgcttctttaaccaagag

SEQ ID NO: 336365 - DNA, 25 bp, Mus musculus
ccaagcctgcttgtttaaccaagag

SEQ ID NO: 336366 - DNA, 25 bp, Mus musculus
ccaagcctggtaccactctgaatag

SEQ ID NO: 336367 - DNA, 25 bp, Mus musculus
ccaagcctggtagcactctgaatag

SEQ ID NO: 336368 - DNA, 25 bp, Mus musculus
ccaagcctggtgatccgagttcgat

SEQ ID NO: 336369 - DNA, 25 bp, Mus musculus
ccaagcctggtgttccgagttcgat

SEQ ID NO: 336370 - DNA, 25 bp, Mus musculus
ccaagccttgatccacaggtttttt

SEQ ID NO: 336371 - DNA, 25 bp, Mus musculus
ccaagccttgatgcacaggtttttt

SEQ ID NO: 336372 - DNA, 25 bp, Mus musculus
ccaagcctttggatgtcaattagaa

SEQ ID NO: 336373 - DNA, 25 bp, Mus musculus
ccaagcctttggttgtcaattagaa

SEQ ID NO: 336374 - DNA, 25 bp, Mus musculus
ccaagcgatggactacgtgcgttct

SEQ ID NO: 336375 - DNA, 25 bp, Mus musculus
ccaagcgatggagtacgtgcgttct

SEQ ID NO: 336376 - DNA, 25 bp, Mus musculus
ccaagcgcttgtagatggagtccaa

SEQ ID NO: 336377 - DNA, 25 bp, Mus musculus
ccaagcgcttgttgatggagtccaa

SEQ ID NO: 336378 - DNA, 25 bp, Mus musculus
ccaagcggctccaggacacaatggg

SEQ ID NO: 336379 - DNA, 25 bp, Mus musculus
ccaagcggctcctggacacaatggg

SEQ ID NO: 336380 - DNA, 25 bp, Mus musculus
ccaagcgggttgctcggaagccaaa

SEQ ID NO: 336381 - DNA, 25 bp, Mus musculus
ccaagcgggttggtcggaagccaaa

SEQ ID NO: 336382 - DNA, 25 bp, Mus musculus
ccaagcgtcggacactacagtcaca

SEQ ID NO: 336383 - DNA, 25 bp, Mus musculus
ccaagcgtcggagactacagtcaca

SEQ ID NO: 336384 - DNA, 25 bp, Mus musculus
ccaagcgttcttcccaatggaggca

SEQ ID NO: 336385 - DNA, 25 bp, Mus musculus
ccaagcgttcttgccaatggaggca

SEQ ID NO: 336386 - DNA, 25 bp, Mus musculus
ccaagctatggtcccggtctaggtg

SEQ ID NO: 336387 - DNA, 25 bp, Mus musculus
ccaagctatggtgccggtctaggtg

SEQ ID NO: 336388 - DNA, 25 bp, Mus musculus
ccaagctccagaacccggaggatat

SEQ ID NO: 336389 - DNA, 25 bp, Mus musculus
ccaagctccagatcccggaggatat

SEQ ID NO: 336390 - DNA, 25 bp, Mus musculus
ccaagctccatgagttcggtgggat

SEQ ID NO: 336391 - DNA, 25 bp, Mus musculus
ccaagctccatgtgttcggtgggat

SEQ ID NO: 336392 - DNA, 25 bp, Mus musculus
ccaagctcgggcaaaagttcagcga

SEQ ID NO: 336393 - DNA, 25 bp, Mus musculus
ccaagctcgggctaaagttcagcga

SEQ ID NO: 336394 - DNA, 25 bp, Mus musculus
ccaagctctatgacaagctgcatta

SEQ ID NO: 336395 - DNA, 25 bp, Mus musculus
ccaagctctatgtcaagctgcatta

SEQ ID NO: 336396 - DNA, 25 bp, Mus musculus
ccaagctcttccacttctattgtat

SEQ ID NO: 336397 - DNA, 25 bp, Mus musculus
ccaagctcttcctcttctattgtat

SEQ ID NO: 336398 - DNA, 25 bp, Mus musculus
ccaagctcttggacagtatcactgt

SEQ ID NO: 336399 - DNA, 25 bp, Mus musculus
ccaagctcttggtcagtatcactgt

SEQ ID NO: 336400 - DNA, 25 bp, Mus musculus
ccaagctgatgtattactacgactg

SEQ ID NO: 336401 - DNA, 25 bp, Mus musculus
ccaagctgatgttttactacgactg

SEQ ID NO: 336402 - DNA, 25 bp, Mus musculus
ccaagctggagcccttgcgagagaa

SEQ ID NO: 336403 - DNA, 25 bp, Mus musculus
ccaagctggagcgcttgcgagagaa

SEQ ID NO: 336404 - DNA, 25 bp, Mus musculus
ccaagctggctgccttacagagctt

SEQ ID NO: 336405 - DNA, 25 bp, Mus musculus
ccaagctggctggcttacagagctt

SEQ ID NO: 336406 - DNA, 25 bp, Mus musculus
ccaagctgggttcaaagtgtatcag

SEQ ID NO: 336407 - DNA, 25 bp, Mus musculus
ccaagctgggttgaaagtgtatcag

SEQ ID NO: 336408 - DNA, 25 bp, Mus musculus
ccaagctggtagatgaggagcccca

SEQ ID NO: 336409 - DNA, 25 bp, Mus musculus
ccaagctggtagttgaggagcccca

SEQ ID NO: 336410 - DNA, 25 bp, Mus musculus
ccaagctggtgtcatgaggctcatg

SEQ ID NO: 336411 - DNA, 25 bp, Mus musculus
ccaagctggtgtgatgaggctcatg

SEQ ID NO: 336412 - DNA, 25 bp, Mus musculus
ccaagctggttaaggaagaggcacc

SEQ ID NO: 336413 - DNA, 25 bp, Mus musculus
ccaagctggttatggaagaggcacc

SEQ ID NO: 336414 - DNA, 25 bp, Mus musculus
ccaagcttagctactcaaaggccta

SEQ ID NO: 336415 - DNA, 25 bp, Mus musculus
ccaagcttagcttctcaaaggccta

SEQ ID NO: 336416 - DNA, 25 bp, Mus musculus
ccaagcttcttgagagattgctcat

SEQ ID NO: 336417 - DNA, 25 bp, Mus musculus
ccaagcttcttgtgagattgctcat

SEQ ID NO: 336418 - DNA, 25 bp, Mus musculus
ccaagctttggaccccacgagggag

SEQ ID NO: 336419 - DNA, 25 bp, Mus musculus
ccaagctttggagcccacgagggag

SEQ ID NO: 336420 - DNA, 25 bp, Mus musculus
ccaagctttgggatgctctagcaag

SEQ ID NO: 336421 - DNA, 25 bp, Mus musculus
ccaagctttgggttgctctagcaag

SEQ ID NO: 336422 - DNA, 25 bp, Mus musculus
ccaagctttgtaatctcccatatca

SEQ ID NO: 336423 - DNA, 25 bp, Mus musculus
ccaagctttgtattctcccatatca

SEQ ID NO: 336424 - DNA, 25 bp, Mus musculus
ccaagctttgtgatggacggtggca

SEQ ID NO: 336425 - DNA, 25 bp, Mus musculus
ccaagctttgtgttggacggtggca

SEQ ID NO: 336426 - DNA, 25 bp, Mus musculus
ccaagcttttgaaatcctgcagttt

SEQ ID NO: 336427 - DNA, 25 bp, Mus musculus
ccaagcttttgatatcctgcagttt

SEQ ID NO: 336428 - DNA, 25 bp, Mus musculus
ccaagctttttgagcttcttcacac

SEQ ID NO: 336429 - DNA, 25 bp, Mus musculus
ccaagctttttgtgcttcttcacac

SEQ ID NO: 336430 - DNA, 25 bp, Mus musculus
ccaagcttttttcccatagcccttg

SEQ ID NO: 336431 - DNA, 25 bp, Mus musculus
ccaagcttttttgccatagcccttg

SEQ ID NO: 336432 - DNA, 25 bp, Mus musculus
ccaaggaacagacgaagcacatgaa

SEQ ID NO: 336433 - DNA, 25 bp, Mus musculus
ccaaggaacagaggaagcacatgaa

SEQ ID NO: 336434 - DNA, 25 bp, Mus musculus
ccaaggaaccacatcatatggccct

SEQ ID NO: 336435 - DNA, 25 bp, Mus musculus
ccaaggaaccacttcatatggccct

SEQ ID NO: 336436 - DNA, 25 bp, Mus musculus
ccaaggaaggagagcgaccccgaga

SEQ ID NO: 336437 - DNA, 25 bp, Mus musculus
ccaaggaaggagtgcgaccccgaga

SEQ ID NO: 336438 - DNA, 25 bp, Mus musculus
ccaaggaagttcaagctgaggccta

SEQ ID NO: 336439 - DNA, 25 bp, Mus musculus
ccaaggaagttctagctgaggccta

SEQ ID NO: 336440 - DNA, 25 bp, Mus musculus
ccaaggaatgggaaagttcagactg

SEQ ID NO: 336441 - DNA, 25 bp, Mus musculus
ccaaggaatgggtaagttcagactg

SEQ ID NO: 336442 - DNA, 25 bp, Mus musculus
ccaaggaatgtactgtattttcaag

SEQ ID NO: 336443 - DNA, 25 bp, Mus musculus
ccaaggaatgtagtgtattttcaag

SEQ ID NO: 336444 - DNA, 25 bp, Mus musculus
ccaaggacaaccctctgaacgaagg

SEQ ID NO: 336445 - DNA, 25 bp, Mus musculus
ccaaggacaaccgtctgaacgaagg

SEQ ID NO: 336446 - DNA, 25 bp, Mus musculus
ccaaggacaccaagcatttgcataa

SEQ ID NO: 336447 - DNA, 25 bp, Mus musculus
ccaaggacaccatgcatttgcataa

SEQ ID NO: 336448 - DNA, 25 bp, Mus musculus
ccaaggacaggaatcaaactgcccc

SEQ ID NO: 336449 - DNA, 25 bp, Mus musculus
ccaaggacaggattcaaactgcccc

SEQ ID NO: 336450 - DNA, 25 bp, Mus musculus
ccaaggacattgagaagggatgcag

SEQ ID NO: 336451 - DNA, 25 bp, Mus musculus
ccaaggacattgtgaagggatgcag

SEQ ID NO: 336452 - DNA, 25 bp, Mus musculus
ccaaggacgtgactttggctcccag

SEQ ID NO: 336453 - DNA, 25 bp, Mus musculus
ccaaggacgtgagtttggctcccag

SEQ ID NO: 336454 - DNA, 25 bp, Mus musculus
ccaaggacttggattcatcagttac

SEQ ID NO: 336455 - DNA, 25 bp, Mus musculus
ccaaggacttggtttcatcagttac

SEQ ID NO: 336456 - DNA, 25 bp, Mus musculus
ccaaggagaaggctcgagctactcg

SEQ ID NO: 336457 - DNA, 25 bp, Mus musculus
ccaaggagaagggtcgagctactcg

SEQ ID NO: 336458 - DNA, 25 bp, Mus musculus
ccaaggagacgaaccctgggagact

SEQ ID NO: 336459 - DNA, 25 bp, Mus musculus
ccaaggagacgatccctgggagact

SEQ ID NO: 336460 - DNA, 25 bp, Mus musculus
ccaaggagacttcccgggcaatact

SEQ ID NO: 336461 - DNA, 25 bp, Mus musculus
ccaaggagacttgccgggcaatact

SEQ ID NO: 336462 - DNA, 25 bp, Mus musculus
ccaaggagctgtcgcagagtattca

SEQ ID NO: 336463 - DNA, 25 bp, Mus musculus
ccaaggagctgtggcagagtattca

SEQ ID NO: 336464 - DNA, 25 bp, Mus musculus
ccaaggaggacaataaaccaatctt

SEQ ID NO: 336465 - DNA, 25 bp, Mus musculus
ccaaggaggacattaaaccaatctt

SEQ ID NO: 336466 - DNA, 25 bp, Mus musculus
ccaaggaggctgataaccatcctat

SEQ ID NO: 336467 - DNA, 25 bp, Mus musculus
ccaaggaggctgttaaccatcctat

SEQ ID NO: 336468 - DNA, 25 bp, Mus musculus
ccaaggatgatgacactgggctttc

SEQ ID NO: 336469 - DNA, 25 bp, Mus musculus
ccaaggatgatgtcactgggctttc

SEQ ID NO: 336470 - DNA, 25 bp, Mus musculus
ccaaggatgggcactcgggactgta

SEQ ID NO: 336471 - DNA, 25 bp, Mus musculus
ccaaggatgggctctcgggactgta

SEQ ID NO: 336472 - DNA, 25 bp, Mus musculus
ccaaggattgtgaagcttccgcgaa

SEQ ID NO: 336473 - DNA, 25 bp, Mus musculus
ccaaggattgtgtagcttccgcgaa

SEQ ID NO: 336474 - DNA, 25 bp, Mus musculus
ccaaggcactcgatgcgctcagcgc

SEQ ID NO: 336475 - DNA, 25 bp, Mus musculus
ccaaggcactcgttgcgctcagcgc

SEQ ID NO: 336476 - DNA, 25 bp, Mus musculus
ccaaggcagcagcaaggaccaacca

SEQ ID NO: 336477 - DNA, 25 bp, Mus musculus
ccaaggcagcaggaaggaccaacca

SEQ ID NO: 336478 - DNA, 25 bp, Mus musculus
ccaaggcagttaatgtttacattct

SEQ ID NO: 336479 - DNA, 25 bp, Mus musculus
ccaaggcagttattgtttacattct

SEQ ID NO: 336480 - DNA, 25 bp, Mus musculus
ccaaggccaagcagaagggccgaag

SEQ ID NO: 336481 - DNA, 25 bp, Mus musculus
ccaaggccaagctgaagggccgaag

SEQ ID NO: 336482 - DNA, 25 bp, Mus musculus
ccaaggccattgacttaccactatg

SEQ ID NO: 336483 - DNA, 25 bp, Mus musculus
ccaaggccattgtcttaccactatg

SEQ ID NO: 336484 - DNA, 25 bp, Mus musculus
ccaaggcctaagcactgtgctccat

SEQ ID NO: 336485 - DNA, 25 bp, Mus musculus
ccaaggcctaaggactgtgctccat

SEQ ID NO: 336486 - DNA, 25 bp, Mus musculus
ccaaggcctcggaatttagtaacag

SEQ ID NO: 336487 - DNA, 25 bp, Mus musculus
ccaaggcctcggtatttagtaacag

SEQ ID NO: 336488 - DNA, 25 bp, Mus musculus
ccaaggcctgccatgaagctatgat

SEQ ID NO: 336489 - DNA, 25 bp, Mus musculus
ccaaggcctgccttgaagctatgat

SEQ ID NO: 336490 - DNA, 25 bp, Mus musculus
ccaaggccttggacccatgggaaat

SEQ ID NO: 336491 - DNA, 25 bp, Mus musculus
ccaaggccttggtcccatgggaaat

SEQ ID NO: 336492 - DNA, 25 bp, Mus musculus
ccaaggcgcaaacggagctgctgtc

SEQ ID NO: 336493 - DNA, 25 bp, Mus musculus
ccaaggcgcaaagggagctgctgtc

SEQ ID NO: 336494 - DNA, 25 bp, Mus musculus
ccaaggcgtggtatccagtgtggta

SEQ ID NO: 336495 - DNA, 25 bp, Mus musculus
ccaaggcgtggtttccagtgtggta

SEQ ID NO: 336496 - DNA, 25 bp, Mus musculus
ccaaggctaaggctaacgtgctgct

SEQ ID NO: 336497 - DNA, 25 bp, Mus musculus
ccaaggctaagggtaacgtgctgct

SEQ ID NO: 336498 - DNA, 25 bp, Mus musculus
ccaaggctcaggaggaagaggctct

SEQ ID NO: 336499 - DNA, 25 bp, Mus musculus
ccaaggctcaggtggaagaggctct

SEQ ID NO: 336500 - DNA, 25 bp, Mus musculus
ccaaggctctggatgttgtgagaat

SEQ ID NO: 336501 - DNA, 25 bp, Mus musculus
ccaaggctctggttgttgtgagaat

SEQ ID NO: 336502 - DNA, 25 bp, Mus musculus
ccaaggctgaggatgtgtctgccat

SEQ ID NO: 336503 - DNA, 25 bp, Mus musculus
ccaaggctgaggttgtgtctgccat

SEQ ID NO: 336504 - DNA, 25 bp, Mus musculus
ccaaggctgagtactaccggcaggt

SEQ ID NO: 336505 - DNA, 25 bp, Mus musculus
ccaaggctgagttctaccggcaggt

SEQ ID NO: 336506 - DNA, 25 bp, Mus musculus
ccaaggctggtcaattcacctaggt

SEQ ID NO: 336507 - DNA, 25 bp, Mus musculus
ccaaggctggtctattcacctaggt

SEQ ID NO: 336508 - DNA, 25 bp, Mus musculus
ccaaggcttagcaacttatgtctat

SEQ ID NO: 336509 - DNA, 25 bp, Mus musculus
ccaaggcttagctacttatgtctat

SEQ ID NO: 336510 - DNA, 25 bp, Mus musculus
ccaaggcttgatcctgaatgggctt

SEQ ID NO: 336511 - DNA, 25 bp, Mus musculus
ccaaggcttgatgctgaatgggctt

SEQ ID NO: 336512 - DNA, 25 bp, Mus musculus
ccaaggctttatcaaccgggtgaat

SEQ ID NO: 336513 - DNA, 25 bp, Mus musculus
ccaaggctttatgaaccgggtgaat

SEQ ID NO: 336514 - DNA, 25 bp, Mus musculus
ccaagggaactaagtgcacattaca

SEQ ID NO: 336515 - DNA, 25 bp, Mus musculus
ccaagggaactatgtgcacattaca

SEQ ID NO: 336516 - DNA, 25 bp, Mus musculus
ccaagggaaggaccagcctgtgcct

SEQ ID NO: 336517 - DNA, 25 bp, Mus musculus
ccaagggaaggagcagcctgtgcct

SEQ ID NO: 336518 - DNA, 25 bp, Mus musculus
ccaagggacagacagcataggccag

SEQ ID NO: 336519 - DNA, 25 bp, Mus musculus
ccaagggacagagagcataggccag

SEQ ID NO: 336520 - DNA, 25 bp, Mus musculus
ccaagggagagcctttattcttctt

SEQ ID NO: 336521 - DNA, 25 bp, Mus musculus
ccaagggagagcgtttattcttctt

SEQ ID NO: 336522 - DNA, 25 bp, Mus musculus
ccaagggagcacaggataacgtatt

SEQ ID NO: 336523 - DNA, 25 bp, Mus musculus
ccaagggagcactggataacgtatt

SEQ ID NO: 336524 - DNA, 25 bp, Mus musculus
ccaagggaggaactggtccttcgat

SEQ ID NO: 336525 - DNA, 25 bp, Mus musculus
ccaagggaggaagtggtccttcgat

SEQ ID NO: 336526 - DNA, 25 bp, Mus musculus
ccaagggagttgagccccatttcag

SEQ ID NO: 336527 - DNA, 25 bp, Mus musculus
ccaagggagttgtgccccatttcag

SEQ ID NO: 336528 - DNA, 25 bp, Mus musculus
ccaagggatcctaagcaaaaagcaa

SEQ ID NO: 336529 - DNA, 25 bp, Mus musculus
ccaagggatccttagcaaaaagcaa

SEQ ID NO: 336530 - DNA, 25 bp, Mus musculus
ccaagggcatctctcagcaatgaat

SEQ ID NO: 336531 - DNA, 25 bp, Mus musculus
ccaagggcatctgtcagcaatgaat

SEQ ID NO: 336532 - DNA, 25 bp, Mus musculus
ccaagggccagaaagcagcgaatct

SEQ ID NO: 336533 - DNA, 25 bp, Mus musculus
ccaagggccagatagcagcgaatct

SEQ ID NO: 336534 - DNA, 25 bp, Mus musculus
ccaagggccgacacagtgcaagcag

SEQ ID NO: 336535 - DNA, 25 bp, Mus musculus
ccaagggccgactcagtgcaagcag

SEQ ID NO: 336536 - DNA, 25 bp, Mus musculus
ccaagggctctgatcatgttaccaa

SEQ ID NO: 336537 - DNA, 25 bp, Mus musculus
ccaagggctctgttcatgttaccaa

SEQ ID NO: 336538 - DNA, 25 bp, Mus musculus
ccaagggctgacatcctatgacctg

SEQ ID NO: 336539 - DNA, 25 bp, Mus musculus
ccaagggctgacttcctatgacctg

SEQ ID NO: 336540 - DNA, 25 bp, Mus musculus
ccaagggcttgcaggatgacctgcg

SEQ ID NO: 336541 - DNA, 25 bp, Mus musculus
ccaagggcttgctggatgacctgcg

SEQ ID NO: 336542 - DNA, 25 bp, Mus musculus
ccaagggtgactaccagaaggcact

SEQ ID NO: 336543 - DNA, 25 bp, Mus musculus
ccaagggtgacttccagaaggcact

SEQ ID NO: 336544 - DNA, 25 bp, Mus musculus
ccaagggtggcccagtgtaaatcac

SEQ ID NO: 336545 - DNA, 25 bp, Mus musculus
ccaagggtggccgagtgtaaatcac

SEQ ID NO: 336546 - DNA, 25 bp, Mus musculus
ccaagggtgtctctctcatacaacc

SEQ ID NO: 336547 - DNA, 25 bp, Mus musculus
ccaagggtgtctgtctcatacaacc

SEQ ID NO: 336548 - DNA, 25 bp, Mus musculus
ccaagggtgtttctggattccctgt

SEQ ID NO: 336549 - DNA, 25 bp, Mus musculus
ccaagggtgtttgtggattccctgt

SEQ ID NO: 336550 - DNA, 25 bp, Mus musculus
ccaaggtcagacatggtaccatctt

SEQ ID NO: 336551 - DNA, 25 bp, Mus musculus
ccaaggtcagacttggtaccatctt

SEQ ID NO: 336552 - DNA, 25 bp, Mus musculus
ccaaggtcatccatgcaggcaggat

SEQ ID NO: 336553 - DNA, 25 bp, Mus musculus
ccaaggtcatccttgcaggcaggat

SEQ ID NO: 336554 - DNA, 25 bp, Mus musculus
ccaaggtcccatcgccagagtgata

SEQ ID NO: 336555 - DNA, 25 bp, Mus musculus
ccaaggtcccatggccagagtgata

SEQ ID NO: 336556 - DNA, 25 bp, Mus musculus
ccaaggtccgctcagcctgcagggt

SEQ ID NO: 336557 - DNA, 25 bp, Mus musculus
ccaaggtccgctgagcctgcagggt

SEQ ID NO: 336558 - DNA, 25 bp, Mus musculus
ccaaggtcctaccatcttatatgtg

SEQ ID NO: 336559 - DNA, 25 bp, Mus musculus
ccaaggtcctacgatcttatatgtg

SEQ ID NO: 336560 - DNA, 25 bp, Mus musculus
ccaaggtctatcctacagctgagat

SEQ ID NO: 336561 - DNA, 25 bp, Mus musculus
ccaaggtctatcgtacagctgagat

SEQ ID NO: 336562 - DNA, 25 bp, Mus musculus
ccaaggtctcgacgtgttaagcaag

SEQ ID NO: 336563 - DNA, 25 bp, Mus musculus
ccaaggtctcgaggtgttaagcaag

SEQ ID NO: 336564 - DNA, 25 bp, Mus musculus
ccaaggtgaatcagatggccgcttt

SEQ ID NO: 336565 - DNA, 25 bp, Mus musculus
ccaaggtgaatctgatggccgcttt

SEQ ID NO: 336566 - DNA, 25 bp, Mus musculus
ccaaggtgactacacggtggccaaa

SEQ ID NO: 336567 - DNA, 25 bp, Mus musculus
ccaaggtgactagacggtggccaaa

SEQ ID NO: 336568 - DNA, 25 bp, Mus musculus
ccaaggtgactgctattttgtttgt

SEQ ID NO: 336569 - DNA, 25 bp, Mus musculus
ccaaggtgactggtattttgtttgt

SEQ ID NO: 336570 - DNA, 25 bp, Mus musculus
ccaaggtgcccgacgtgcccgaggt

SEQ ID NO: 336571 - DNA, 25 bp, Mus musculus
ccaaggtgcccgtcgtgcccgaggt

SEQ ID NO: 336572 - DNA, 25 bp, Mus musculus
ccaaggtgcctgagatgcccaatgt

SEQ ID NO: 336573 - DNA, 25 bp, Mus musculus
ccaaggtgcctgtgatgcccaatgt

SEQ ID NO: 336574 - DNA, 25 bp, Mus musculus
ccaaggtggcccactgtgtatcagg

SEQ ID NO: 336575 - DNA, 25 bp, Mus musculus
ccaaggtggccctctgtgtatcagg

SEQ ID NO: 336576 - DNA, 25 bp, Mus musculus
ccaaggtggctcacggcaagggctc

SEQ ID NO: 336577 - DNA, 25 bp, Mus musculus
ccaaggtggctctcggcaagggctc

SEQ ID NO: 336578 - DNA, 25 bp, Mus musculus
ccaaggtggctgattcctgctgact

SEQ ID NO: 336579 - DNA, 25 bp, Mus musculus
ccaaggtggctgtttcctgctgact

SEQ ID NO: 336580 - DNA, 25 bp, Mus musculus
ccaaggttaaggacactaagctcat

SEQ ID NO: 336581 - DNA, 25 bp, Mus musculus
ccaaggttaaggtcactaagctcat

SEQ ID NO: 336582 - DNA, 25 bp, Mus musculus
ccaaggttatctcatttctcattta

SEQ ID NO: 336583 - DNA, 25 bp, Mus musculus
ccaaggttatctgatttctcattta

SEQ ID NO: 336584 - DNA, 25 bp, Mus musculus
ccaaggttcatgaatagccctggtt

SEQ ID NO: 336585 - DNA, 25 bp, Mus musculus
ccaaggttcatgtatagccctggtt

SEQ ID NO: 336586 - DNA, 25 bp, Mus musculus
ccaaggttgggtcgctagagaccta

SEQ ID NO: 336587 - DNA, 25 bp, Mus musculus
ccaaggttgggtggctagagaccta

SEQ ID NO: 336588 - DNA, 25 bp, Mus musculus
ccaaggttgtagatgctgccgataa

SEQ ID NO: 336589 - DNA, 25 bp, Mus musculus
ccaaggttgtagttgctgccgataa

SEQ ID NO: 336590 - DNA, 25 bp, Mus musculus
ccaaggtttggacgcttttgctgct

SEQ ID NO: 336591 - DNA, 25 bp, Mus musculus
ccaaggtttggaggcttttgctgct

SEQ ID NO: 336592 - DNA, 25 bp, Mus musculus
ccaagtacccggatacagcagcagc

SEQ ID NO: 336593 - DNA, 25 bp, Mus musculus
ccaagtacccggttacagcagcagc

SEQ ID NO: 336594 - DNA, 25 bp, Mus musculus
ccaagtatattcattcctggccgaa

SEQ ID NO: 336595 - DNA, 25 bp, Mus musculus
ccaagtatattctttcctggccgaa

SEQ ID NO: 336596 - DNA, 25 bp, Mus musculus
ccaagtatcaggagcgtgtatttct

SEQ ID NO: 336597 - DNA, 25 bp, Mus musculus
ccaagtatcaggtgcgtgtatttct

SEQ ID NO: 336598 - DNA, 25 bp, Mus musculus
ccaagtatctacactttggtcttcc

SEQ ID NO: 336599 - DNA, 25 bp, Mus musculus
ccaagtatctactctttggtcttcc

SEQ ID NO: 336600 - DNA, 25 bp, Mus musculus
ccaagtatgcatagttagctttaca

SEQ ID NO: 336601 - DNA, 25 bp, Mus musculus
ccaagtatgcattgttagctttaca

SEQ ID NO: 336602 - DNA, 25 bp, Mus musculus
ccaagtatgtagcaggagtaaaaat

SEQ ID NO: 336603 - DNA, 25 bp, Mus musculus
ccaagtatgtaggaggagtaaaaat

SEQ ID NO: 336604 - DNA, 25 bp, Mus musculus
ccaagtattattaagctacccactg

SEQ ID NO: 336605 - DNA, 25 bp, Mus musculus
ccaagtattatttagctacccactg

SEQ ID NO: 336606 - DNA, 25 bp, Mus musculus
ccaagtattggcatgctgtagtcta

SEQ ID NO: 336607 - DNA, 25 bp, Mus musculus
ccaagtattggcttgctgtagtcta

SEQ ID NO: 336608 - DNA, 25 bp, Mus musculus
ccaagtcaccccacatttagattgt

SEQ ID NO: 336609 - DNA, 25 bp, Mus musculus
ccaagtcacccctcatttagattgt

SEQ ID NO: 336610 - DNA, 25 bp, Mus musculus
ccaagtcagtatatcatcaccacca

SEQ ID NO: 336611 - DNA, 25 bp, Mus musculus
ccaagtcagtatttcatcaccacca

SEQ ID NO: 336612 - DNA, 25 bp, Mus musculus
ccaagtccaaatcctggaggcagcc

SEQ ID NO: 336613 - DNA, 25 bp, Mus musculus
ccaagtccaaatgctggaggcagcc

SEQ ID NO: 336614 - DNA, 25 bp, Mus musculus
ccaagtccatgaatctgtaaccctg

SEQ ID NO: 336615 - DNA, 25 bp, Mus musculus
ccaagtccatgattctgtaaccctg

SEQ ID NO: 336616 - DNA, 25 bp, Mus musculus
ccaagtccatgtctgaatgatttaa

SEQ ID NO: 336617 - DNA, 25 bp, Mus musculus
ccaagtccatgtgtgaatgatttaa

SEQ ID NO: 336618 - DNA, 25 bp, Mus musculus
ccaagtcccatgcaacaacagagtt

SEQ ID NO: 336619 - DNA, 25 bp, Mus musculus
ccaagtcccatggaacaacagagtt

SEQ ID NO: 336620 - DNA, 25 bp, Mus musculus
ccaagtccctaacagaactatccat

SEQ ID NO: 336621 - DNA, 25 bp, Mus musculus
ccaagtccctaagagaactatccat

SEQ ID NO: 336622 - DNA, 25 bp, Mus musculus
ccaagtcctctgaaagtgctcttaa

SEQ ID NO: 336623 - DNA, 25 bp, Mus musculus
ccaagtcctctgtaagtgctcttaa

SEQ ID NO: 336624 - DNA, 25 bp, Mus musculus
ccaagtctaggtatcagcgtatgca

SEQ ID NO: 336625 - DNA, 25 bp, Mus musculus
ccaagtctaggtttcagcgtatgca

SEQ ID NO: 336626 - DNA, 25 bp, Mus musculus
ccaagtctcactaaagcaaatgctt

SEQ ID NO: 336627 - DNA, 25 bp, Mus musculus
ccaagtctcacttaagcaaatgctt

SEQ ID NO: 336628 - DNA, 25 bp, Mus musculus
ccaagtctccagaaaggctgcagga

SEQ ID NO: 336629 - DNA, 25 bp, Mus musculus
ccaagtctccagtaaggctgcagga

SEQ ID NO: 336630 - DNA, 25 bp, Mus musculus
ccaagtctcttgataaccagcacta

SEQ ID NO: 336631 - DNA, 25 bp, Mus musculus
ccaagtctcttgttaaccagcacta

SEQ ID NO: 336632 - DNA, 25 bp, Mus musculus
ccaagtctgacaccatagttttgat

SEQ ID NO: 336633 - DNA, 25 bp, Mus musculus
ccaagtctgacagcatagttttgat

SEQ ID NO: 336634 - DNA, 25 bp, Mus musculus
ccaagtcttggtccggtgtcactta

SEQ ID NO: 336635 - DNA, 25 bp, Mus musculus
ccaagtcttggtgcggtgtcactta

SEQ ID NO: 336636 - DNA, 25 bp, Mus musculus
ccaagtgaagttcctcgcagctggg

SEQ ID NO: 336637 - DNA, 25 bp, Mus musculus
ccaagtgaagttgctcgcagctggg

SEQ ID NO: 336638 - DNA, 25 bp, Mus musculus
ccaagtgacgatcctcctgaggaag

SEQ ID NO: 336639 - DNA, 25 bp, Mus musculus
ccaagtgacgatgctcctgaggaag

SEQ ID NO: 336640 - DNA, 25 bp, Mus musculus
ccaagtgagtgactgccgccagcat

SEQ ID NO: 336641 - DNA, 25 bp, Mus musculus
ccaagtgagtgagtgccgccagcat

SEQ ID NO: 336642 - DNA, 25 bp, Mus musculus
ccaagtgcaatcagaatttaatccc

SEQ ID NO: 336643 - DNA, 25 bp, Mus musculus
ccaagtgcaatctgaatttaatccc

SEQ ID NO: 336644 - DNA, 25 bp, Mus musculus
ccaagtgcagcactgcaggacccag

SEQ ID NO: 336645 - DNA, 25 bp, Mus musculus
ccaagtgcagcagtgcaggacccag

SEQ ID NO: 336646 - DNA, 25 bp, Mus musculus
ccaagtgcagtaacggtagcccaaa

SEQ ID NO: 336647 - DNA, 25 bp, Mus musculus
ccaagtgcagtatcggtagcccaaa

SEQ ID NO: 336648 - DNA, 25 bp, Mus musculus
ccaagtgcccttaaacagagacaga

SEQ ID NO: 336649 - DNA, 25 bp, Mus musculus
ccaagtgccctttaacagagacaga

SEQ ID NO: 336650 - DNA, 25 bp, Mus musculus
ccaagtgccttgcagagctcacagc

SEQ ID NO: 336651 - DNA, 25 bp, Mus musculus
ccaagtgccttggagagctcacagc

SEQ ID NO: 336652 - DNA, 25 bp, Mus musculus
ccaagtgctagaacctggtgggtgt

SEQ ID NO: 336653 - DNA, 25 bp, Mus musculus
ccaagtgctagatcctggtgggtgt

SEQ ID NO: 336654 - DNA, 25 bp, Mus musculus
ccaagtgctagtacactttggttgc

SEQ ID NO: 336655 - DNA, 25 bp, Mus musculus
ccaagtgctagttcactttggttgc

SEQ ID NO: 336656 - DNA, 25 bp, Mus musculus
ccaagtgctattcctcacagagacc

SEQ ID NO: 336657 - DNA, 25 bp, Mus musculus
ccaagtgctattgctcacagagacc

SEQ ID NO: 336658 - DNA, 25 bp, Mus musculus
ccaagtgctctcagaacaagttgaa

SEQ ID NO: 336659 - DNA, 25 bp, Mus musculus
ccaagtgctctctgaacaagttgaa

SEQ ID NO: 336660 - DNA, 25 bp, Mus musculus
ccaagtgctcttatctgtctctgtg

SEQ ID NO: 336661 - DNA, 25 bp, Mus musculus
ccaagtgctcttttctgtctctgtg

SEQ ID NO: 336662 - DNA, 25 bp, Mus musculus
ccaagtgctgctctgaattcctaaa

SEQ ID NO: 336663 - DNA, 25 bp, Mus musculus
ccaagtgctgctgtgaattcctaaa

SEQ ID NO: 336664 - DNA, 25 bp, Mus musculus
ccaagtgctgggaagcctgctttcc

SEQ ID NO: 336665 - DNA, 25 bp, Mus musculus
ccaagtgctgggtagcctgctttcc

SEQ ID NO: 336666 - DNA, 25 bp, Mus musculus
ccaagtgctggtcataagtcgtctg

SEQ ID NO: 336667 - DNA, 25 bp, Mus musculus
ccaagtgctggtgataagtcgtctg

SEQ ID NO: 336668 - DNA, 25 bp, Mus musculus
ccaagtgctgttcagccacataaga

SEQ ID NO: 336669 - DNA, 25 bp, Mus musculus
ccaagtgctgttgagccacataaga

SEQ ID NO: 336670 - DNA, 25 bp, Mus musculus
ccaagtggactgagccagtatagta

SEQ ID NO: 336671 - DNA, 25 bp, Mus musculus
ccaagtggactgtgccagtatagta

SEQ ID NO: 336672 - DNA, 25 bp, Mus musculus
ccaagtggccagattggagccgcag

SEQ ID NO: 336673 - DNA, 25 bp, Mus musculus
ccaagtggccagtttggagccgcag

SEQ ID NO: 336674 - DNA, 25 bp, Mus musculus
ccaagtgggactcgtggaacaagct

SEQ ID NO: 336675 - DNA, 25 bp, Mus musculus
ccaagtgggactggtggaacaagct

SEQ ID NO: 336676 - DNA, 25 bp, Mus musculus
ccaagtggtagcagagacgcgcaag

SEQ ID NO: 336677 - DNA, 25 bp, Mus musculus
ccaagtggtagctgagacgcgcaag

SEQ ID NO: 336678 - DNA, 25 bp, Mus musculus
ccaagtggttctcgccttagagtca

SEQ ID NO: 336679 - DNA, 25 bp, Mus musculus
ccaagtggttctggccttagagtca

SEQ ID NO: 336680 - DNA, 25 bp, Mus musculus
ccaagtgtctgtattctcaaggcga

SEQ ID NO: 336681 - DNA, 25 bp, Mus musculus
ccaagtgtctgttttctcaaggcga

SEQ ID NO: 336682 - DNA, 25 bp, Mus musculus
ccaagtgtgaatatctgcgcagtcc

SEQ ID NO: 336683 - DNA, 25 bp, Mus musculus
ccaagtgtgaatttctgcgcagtcc

SEQ ID NO: 336684 - DNA, 25 bp, Mus musculus
ccaagtgtgcgacctgaagatgcag

SEQ ID NO: 336685 - DNA, 25 bp, Mus musculus
ccaagtgtgcgagctgaagatgcag

SEQ ID NO: 336686 - DNA, 25 bp, Mus musculus
ccaagtgtggctcattcctgtcagt

SEQ ID NO: 336687 - DNA, 25 bp, Mus musculus
ccaagtgtggctgattcctgtcagt

SEQ ID NO: 336688 - DNA, 25 bp, Mus musculus
ccaagtgttacacatcatgtggcaa

SEQ ID NO: 336689 - DNA, 25 bp, Mus musculus
ccaagtgttacagatcatgtggcaa

SEQ ID NO: 336690 - DNA, 25 bp, Mus musculus
ccaagtgttattatatgtgaggttc

SEQ ID NO: 336691 - DNA, 25 bp, Mus musculus
ccaagtgttattttatgtgaggttc

SEQ ID NO: 336692 - DNA, 25 bp, Mus musculus
ccaagtgttcagctgcttcaggtct

SEQ ID NO: 336693 - DNA, 25 bp, Mus musculus
ccaagtgttcaggtgcttcaggtct

SEQ ID NO: 336694 - DNA, 25 bp, Mus musculus
ccaagtgttctgagcctgggtagct

SEQ ID NO: 336695 - DNA, 25 bp, Mus musculus
ccaagtgttctgtgcctgggtagct

SEQ ID NO: 336696 - DNA, 25 bp, Mus musculus
ccaagtgttggcagtgattgctgaa

SEQ ID NO: 336697 - DNA, 25 bp, Mus musculus
ccaagtgttggctgtgattgctgaa

SEQ ID NO: 336698 - DNA, 25 bp, Mus musculus
ccaagttacattaactgcagacttt

SEQ ID NO: 336699 - DNA, 25 bp, Mus musculus
ccaagttacatttactgcagacttt

SEQ ID NO: 336700 - DNA, 25 bp, Mus musculus
ccaagttatcacagagcccagggaa

SEQ ID NO: 336701 - DNA, 25 bp, Mus musculus
ccaagttatcactgagcccagggaa

SEQ ID NO: 336702 - DNA, 25 bp, Mus musculus
ccaagttattccaatagcaagccta

SEQ ID NO: 336703 - DNA, 25 bp, Mus musculus
ccaagttattcctatagcaagccta

SEQ ID NO: 336704 - DNA, 25 bp, Mus musculus
ccaagttcaggaaagcccagcatga

SEQ ID NO: 336705 - DNA, 25 bp, Mus musculus
ccaagttcaggatagcccagcatga

SEQ ID NO: 336706 - DNA, 25 bp, Mus musculus
ccaagttcatcacggctatgataaa

SEQ ID NO: 336707 - DNA, 25 bp, Mus musculus
ccaagttcatcagggctatgataaa

SEQ ID NO: 336708 - DNA, 25 bp, Mus musculus
ccaagttccacaacctgaaggcagt

SEQ ID NO: 336709 - DNA, 25 bp, Mus musculus
ccaagttccacatcctgaaggcagt

SEQ ID NO: 336710 - DNA, 25 bp, Mus musculus
ccaagttcctgcaaaagaggcccag

SEQ ID NO: 336711 - DNA, 25 bp, Mus musculus
ccaagttcctgctaaagaggcccag

SEQ ID NO: 336712 - DNA, 25 bp, Mus musculus
ccaagttcttgaagccgagagagaa

SEQ ID NO: 336713 - DNA, 25 bp, Mus musculus
ccaagttcttgatgccgagagagaa

SEQ ID NO: 336714 - DNA, 25 bp, Mus musculus
ccaagttgctgaagtgttctctaga

SEQ ID NO: 336715 - DNA, 25 bp, Mus musculus
ccaagttgctgatgtgttctctaga

SEQ ID NO: 336716 - DNA, 25 bp, Mus musculus
ccaagttggctacattcgggtgaag

SEQ ID NO: 336717 - DNA, 25 bp, Mus musculus
ccaagttggctagattcgggtgaag

SEQ ID NO: 336718 - DNA, 25 bp, Mus musculus
ccaagtttattgaaatgtcctcatc

SEQ ID NO: 336719 - DNA, 25 bp, Mus musculus
ccaagtttattgtaatgtcctcatc

SEQ ID NO: 336720 - DNA, 25 bp, Mus musculus
ccaagtttgcacaggttgtactcca

SEQ ID NO: 336721 - DNA, 25 bp, Mus musculus
ccaagtttgcactggttgtactcca

SEQ ID NO: 336722 - DNA, 25 bp, Mus musculus
ccaagtttgcagaaagccaagtgcc

SEQ ID NO: 336723 - DNA, 25 bp, Mus musculus
ccaagtttgcagtaagccaagtgcc

SEQ ID NO: 336724 - DNA, 25 bp, Mus musculus
ccaagtttgggtcggccttctggtg

SEQ ID NO: 336725 - DNA, 25 bp, Mus musculus
ccaagtttgggtgggccttctggtg

SEQ ID NO: 336726 - DNA, 25 bp, Mus musculus
ccaagtttgttgcactaaataagct

SEQ ID NO: 336727 - DNA, 25 bp, Mus musculus
ccaagtttgttggactaaataagct

SEQ ID NO: 336728 - DNA, 25 bp, Mus musculus
ccaagttttctgctgtgctggtaga

SEQ ID NO: 336729 - DNA, 25 bp, Mus musculus
ccaagttttctggtgtgctggtaga

SEQ ID NO: 336730 - DNA, 25 bp, Mus musculus
ccaagttttgtgctgactatttgaa

SEQ ID NO: 336731 - DNA, 25 bp, Mus musculus
ccaagttttgtggtgactatttgaa

SEQ ID NO: 336732 - DNA, 25 bp, Mus musculus
ccaataaccacaatttcttgtgccc

SEQ ID NO: 336733 - DNA, 25 bp, Mus musculus
ccaataaccacattttcttgtgccc

SEQ ID NO: 336734 - DNA, 25 bp, Mus musculus
ccaataagagcccttggcgttcaga

SEQ ID NO: 336735 - DNA, 25 bp, Mus musculus
ccaataagagccgttggcgttcaga

SEQ ID NO: 336736 - DNA, 25 bp, Mus musculus
ccaataagctagacatggtggcata

SEQ ID NO: 336737 - DNA, 25 bp, Mus musculus
ccaataagctagtcatggtggcata

SEQ ID NO: 336738 - DNA, 25 bp, Mus musculus
ccaatacagttgcttccttatgtta

SEQ ID NO: 336739 - DNA, 25 bp, Mus musculus
ccaatacagttggttccttatgtta

SEQ ID NO: 336740 - DNA, 25 bp, Mus musculus
ccaatacgccggcagtctacacaaa

SEQ ID NO: 336741 - DNA, 25 bp, Mus musculus
ccaatacgccgggagtctacacaaa

SEQ ID NO: 336742 - DNA, 25 bp, Mus musculus
ccaatagcccaaagctgcactgcaa

SEQ ID NO: 336743 - DNA, 25 bp, Mus musculus
ccaatagcccaatgctgcactgcaa

SEQ ID NO: 336744 - DNA, 25 bp, Mus musculus
ccaataggtctcactctagtgagaa

SEQ ID NO: 336745 - DNA, 25 bp, Mus musculus
ccaataggtctctctctagtgagaa

SEQ ID NO: 336746 - DNA, 25 bp, Mus musculus
ccaatagtcgttcgcgatgccgttt

SEQ ID NO: 336747 - DNA, 25 bp, Mus musculus
ccaatagtcgttggcgatgccgttt

SEQ ID NO: 336748 - DNA, 25 bp, Mus musculus
ccaatatctctaccgaacatttcag

SEQ ID NO: 336749 - DNA, 25 bp, Mus musculus
ccaatatctctagcgaacatttcag

SEQ ID NO: 336750 - DNA, 25 bp, Mus musculus
ccaatatgtgttcggacttgctgga

SEQ ID NO: 336751 - DNA, 25 bp, Mus musculus
ccaatatgtgttgggacttgctgga

SEQ ID NO: 336752 - DNA, 25 bp, Mus musculus
ccaatattacctcaacgagcagggc

SEQ ID NO: 336753 - DNA, 25 bp, Mus musculus
ccaatattacctgaacgagcagggc

SEQ ID NO: 336754 - DNA, 25 bp, Mus musculus
ccaatattccatactttcagtaagt

SEQ ID NO: 336755 - DNA, 25 bp, Mus musculus
ccaatattccattctttcagtaagt

SEQ ID NO: 336756 - DNA, 25 bp, Mus musculus
ccaatattgggccatagatggaaga

SEQ ID NO: 336757 - DNA, 25 bp, Mus musculus
ccaatattgggcgatagatggaaga

SEQ ID NO: 336758 - DNA, 25 bp, Mus musculus
ccaatatttccactcctccttttca

SEQ ID NO: 336759 - DNA, 25 bp, Mus musculus
ccaatatttccagtcctccttttca

SEQ ID NO: 336760 - DNA, 25 bp, Mus musculus
ccaatcaaagccctttatttcaact

SEQ ID NO: 336761 - DNA, 25 bp, Mus musculus
ccaatcaaagccgtttatttcaact

SEQ ID NO: 336762 - DNA, 25 bp, Mus musculus
ccaatcaacttcaggccaaaagcaa

SEQ ID NO: 336763 - DNA, 25 bp, Mus musculus
ccaatcaacttctggccaaaagcaa

SEQ ID NO: 336764 - DNA, 25 bp, Mus musculus
ccaatcaagtgcaggtaaattcatg

SEQ ID NO: 336765 - DNA, 25 bp, Mus musculus
ccaatcaagtgctggtaaattcatg

SEQ ID NO: 336766 - DNA, 25 bp, Mus musculus
ccaatcacttggcatggctatagtt

SEQ ID NO: 336767 - DNA, 25 bp, Mus musculus
ccaatcacttgggatggctatagtt

SEQ ID NO: 336768 - DNA, 25 bp, Mus musculus
ccaatcagatgcaattagggaccat

SEQ ID NO: 336769 - DNA, 25 bp, Mus musculus
ccaatcagatgctattagggaccat

SEQ ID NO: 336770 - DNA, 25 bp, Mus musculus
ccaatcaggaggcccctgtctgtac

SEQ ID NO: 336771 - DNA, 25 bp, Mus musculus
ccaatcaggagggccctgtctgtac

SEQ ID NO: 336772 - DNA, 25 bp, Mus musculus
ccaatcaggattcgatgtttgtaac

SEQ ID NO: 336773 - DNA, 25 bp, Mus musculus
ccaatcaggattggatgtttgtaac

SEQ ID NO: 336774 - DNA, 25 bp, Mus musculus
ccaatcagtagaatgtggcactatt

SEQ ID NO: 336775 - DNA, 25 bp, Mus musculus
ccaatcagtagattgtggcactatt

SEQ ID NO: 336776 - DNA, 25 bp, Mus musculus
ccaatcagtagcatcttgcctcttc

SEQ ID NO: 336777 - DNA, 25 bp, Mus musculus
ccaatcagtagcttcttgcctcttc

SEQ ID NO: 336778 - DNA, 25 bp, Mus musculus
ccaatcagtgtgaacctggctccat

SEQ ID NO: 336779 - DNA, 25 bp, Mus musculus
ccaatcagtgtgtacctggctccat

SEQ ID NO: 336780 - DNA, 25 bp, Mus musculus
ccaatccatataatcctcccaaaat

SEQ ID NO: 336781 - DNA, 25 bp, Mus musculus
ccaatccatatattcctcccaaaat

SEQ ID NO: 336782 - DNA, 25 bp, Mus musculus
ccaatccatgcgagaataatgggtg

SEQ ID NO: 336783 - DNA, 25 bp, Mus musculus
ccaatccatgcgtgaataatgggtg

SEQ ID NO: 336784 - DNA, 25 bp, Mus musculus
ccaatccctcttcaactgtttatat

SEQ ID NO: 336785 - DNA, 25 bp, Mus musculus
ccaatccctcttgaactgtttatat

SEQ ID NO: 336786 - DNA, 25 bp, Mus musculus
ccaatccctgagacctaagactatc

SEQ ID NO: 336787 - DNA, 25 bp, Mus musculus
ccaatccctgagtcctaagactatc

SEQ ID NO: 336788 - DNA, 25 bp, Mus musculus
ccaatccctggaacaagtatactga

SEQ ID NO: 336789 - DNA, 25 bp, Mus musculus
ccaatccctggatcaagtatactga

SEQ ID NO: 336790 - DNA, 25 bp, Mus musculus
ccaatcctgtacaatcatctgtcaa

SEQ ID NO: 336791 - DNA, 25 bp, Mus musculus
ccaatcctgtactatcatctgtcaa

SEQ ID NO: 336792 - DNA, 25 bp, Mus musculus
ccaatcctgtgacagcatgagctgt

SEQ ID NO: 336793 - DNA, 25 bp, Mus musculus
ccaatcctgtgagagcatgagctgt

SEQ ID NO: 336794 - DNA, 25 bp, Mus musculus
ccaatcggatgactgtggatgctgt

SEQ ID NO: 336795 - DNA, 25 bp, Mus musculus
ccaatcggatgagtgtggatgctgt

SEQ ID NO: 336796 - DNA, 25 bp, Mus musculus
ccaatctcataaaaggctccatcgc

SEQ ID NO: 336797 - DNA, 25 bp, Mus musculus
ccaatctcataataggctccatcgc

SEQ ID NO: 336798 - DNA, 25 bp, Mus musculus
ccaatctctgccatgatgttgtttt

SEQ ID NO: 336799 - DNA, 25 bp, Mus musculus
ccaatctctgccttgatgttgtttt

SEQ ID NO: 336800 - DNA, 25 bp, Mus musculus
ccaatctgacttagaatttcctaac

SEQ ID NO: 336801 - DNA, 25 bp, Mus musculus
ccaatctgactttgaatttcctaac

SEQ ID NO: 336802 - DNA, 25 bp, Mus musculus
ccaatctgcgcaacttaatgaggaa

SEQ ID NO: 336803 - DNA, 25 bp, Mus musculus
ccaatctgcgcatcttaatgaggaa

SEQ ID NO: 336804 - DNA, 25 bp, Mus musculus
ccaatctggtggctgcttacgagaa

SEQ ID NO: 336805 - DNA, 25 bp, Mus musculus
ccaatctggtgggtgcttacgagaa

SEQ ID NO: 336806 - DNA, 25 bp, Mus musculus
ccaatcttcaccagcttcagaaatc

SEQ ID NO: 336807 - DNA, 25 bp, Mus musculus
ccaatcttcacctgcttcagaaatc

SEQ ID NO: 336808 - DNA, 25 bp, Mus musculus
ccaatcttcgttagtgctttctatt

SEQ ID NO: 336809 - DNA, 25 bp, Mus musculus
ccaatcttcgtttgtgctttctatt

SEQ ID NO: 336810 - DNA, 25 bp, Mus musculus
ccaatctttagcattcatgttatca

SEQ ID NO: 336811 - DNA, 25 bp, Mus musculus
ccaatctttagctttcatgttatca

SEQ ID NO: 336812 - DNA, 25 bp, Mus musculus
ccaatgaaaggccaacttcgaagaa

SEQ ID NO: 336813 - DNA, 25 bp, Mus musculus
ccaatgaaaggcgaacttcgaagaa

SEQ ID NO: 336814 - DNA, 25 bp, Mus musculus
ccaatgaatcagagcctggtggcta

SEQ ID NO: 336815 - DNA, 25 bp, Mus musculus
ccaatgaatcagtgcctggtggcta

SEQ ID NO: 336816 - DNA, 25 bp, Mus musculus
ccaatgactataagcgggccaccct

SEQ ID NO: 336817 - DNA, 25 bp, Mus musculus
ccaatgactatatgcgggccaccct

SEQ ID NO: 336818 - DNA, 25 bp, Mus musculus
ccaatgactgaacacaacctgctct

SEQ ID NO: 336819 - DNA, 25 bp, Mus musculus
ccaatgactgaagacaacctgctct

SEQ ID NO: 336820 - DNA, 25 bp, Mus musculus
ccaatgactgtgatctcagctttgt

SEQ ID NO: 336821 - DNA, 25 bp, Mus musculus
ccaatgactgtgttctcagctttgt

SEQ ID NO: 336822 - DNA, 25 bp, Mus musculus
ccaatgacttttacaggctgatcaa

SEQ ID NO: 336823 - DNA, 25 bp, Mus musculus
ccaatgactttttcaggctgatcaa

SEQ ID NO: 336824 - DNA, 25 bp, Mus musculus
ccaatgagggataacccgcccagaa

SEQ ID NO: 336825 - DNA, 25 bp, Mus musculus
ccaatgagggattacccgcccagaa

SEQ ID NO: 336826 - DNA, 25 bp, Mus musculus
ccaatgagtgctaccaagtcttgct

SEQ ID NO: 336827 - DNA, 25 bp, Mus musculus
ccaatgagtgcttccaagtcttgct

SEQ ID NO: 336828 - DNA, 25 bp, Mus musculus
ccaatgatcgggagcgcaatcgcat

SEQ ID NO: 336829 - DNA, 25 bp, Mus musculus
ccaatgatcgggtgcgcaatcgcat

SEQ ID NO: 336830 - DNA, 25 bp, Mus musculus
ccaatgatggttccctcagcactgt

SEQ ID NO: 336831 - DNA, 25 bp, Mus musculus
ccaatgatggttgcctcagcactgt

SEQ ID NO: 336832 - DNA, 25 bp, Mus musculus
ccaatgcaactaatccagagagtaa

SEQ ID NO: 336833 - DNA, 25 bp, Mus musculus
ccaatgcaactattccagagagtaa

SEQ ID NO: 336834 - DNA, 25 bp, Mus musculus
ccaatgcaatgccttatgggtatta

SEQ ID NO: 336835 - DNA, 25 bp, Mus musculus
ccaatgcaatgcgttatgggtatta

SEQ ID NO: 336836 - DNA, 25 bp, Mus musculus
ccaatgcaatttattactccttcca

SEQ ID NO: 336837 - DNA, 25 bp, Mus musculus
ccaatgcaattttttactccttcca

SEQ ID NO: 336838 - DNA, 25 bp, Mus musculus
ccaatgcatcacaacaaatatctca

SEQ ID NO: 336839 - DNA, 25 bp, Mus musculus
ccaatgcatcactacaaatatctca

SEQ ID NO: 336840 - DNA, 25 bp, Mus musculus
ccaatgcattcaagggtatttccca

SEQ ID NO: 336841 - DNA, 25 bp, Mus musculus
ccaatgcattcatgggtatttccca

SEQ ID NO: 336842 - DNA, 25 bp, Mus musculus
ccaatgcccattagttgttatttat

SEQ ID NO: 336843 - DNA, 25 bp, Mus musculus
ccaatgcccatttgttgttatttat

SEQ ID NO: 336844 - DNA, 25 bp, Mus musculus
ccaatgcccccgaggatgagaccat

SEQ ID NO: 336845 - DNA, 25 bp, Mus musculus
ccaatgcccccgtggatgagaccat

SEQ ID NO: 336846 - DNA, 25 bp, Mus musculus
ccaatgccccgtctcaatgagataa

SEQ ID NO: 336847 - DNA, 25 bp, Mus musculus
ccaatgccccgtgtcaatgagataa

SEQ ID NO: 336848 - DNA, 25 bp, Mus musculus
ccaatgcctgagatacttgatggat

SEQ ID NO: 336849 - DNA, 25 bp, Mus musculus
ccaatgcctgagttacttgatggat

SEQ ID NO: 336850 - DNA, 25 bp, Mus musculus
ccaatgcctggtcagataactttaa

SEQ ID NO: 336851 - DNA, 25 bp, Mus musculus
ccaatgcctggtgagataactttaa

SEQ ID NO: 336852 - DNA, 25 bp, Mus musculus
ccaatgcgagcaactgtcccttgag

SEQ ID NO: 336853 - DNA, 25 bp, Mus musculus
ccaatgcgagcatctgtcccttgag

SEQ ID NO: 336854 - DNA, 25 bp, Mus musculus
ccaatgctcagtacagtgtgcgtct

SEQ ID NO: 336855 - DNA, 25 bp, Mus musculus
ccaatgctcagttcagtgtgcgtct

SEQ ID NO: 336856 - DNA, 25 bp, Mus musculus
ccaatgctgctaagtctgtgaagcc

SEQ ID NO: 336857 - DNA, 25 bp, Mus musculus
ccaatgctgctatgtctgtgaagcc

SEQ ID NO: 336858 - DNA, 25 bp, Mus musculus
ccaatgctgctccatggtagaaatt

SEQ ID NO: 336859 - DNA, 25 bp, Mus musculus
ccaatgctgctcgatggtagaaatt

SEQ ID NO: 336860 - DNA, 25 bp, Mus musculus
ccaatgcttggaagtttgattccaa

SEQ ID NO: 336861 - DNA, 25 bp, Mus musculus
ccaatgcttggatgtttgattccaa

SEQ ID NO: 336862 - DNA, 25 bp, Mus musculus
ccaatgcttgtgctggcttccaaag

SEQ ID NO: 336863 - DNA, 25 bp, Mus musculus
ccaatgcttgtggtggcttccaaag

SEQ ID NO: 336864 - DNA, 25 bp, Mus musculus
ccaatgctttttctctcccgatgat

SEQ ID NO: 336865 - DNA, 25 bp, Mus musculus
ccaatgctttttgtctcccgatgat

SEQ ID NO: 336866 - DNA, 25 bp, Mus musculus
ccaatggcaccgctctaaagggaaa

SEQ ID NO: 336867 - DNA, 25 bp, Mus musculus
ccaatggcaccggtctaaagggaaa

SEQ ID NO: 336868 - DNA, 25 bp, Mus musculus
ccaatggcctggaggcgcctgccta

SEQ ID NO: 336869 - DNA, 25 bp, Mus musculus
ccaatggcctggtggcgcctgccta

SEQ ID NO: 336870 - DNA, 25 bp, Mus musculus
ccaatggcggcgacctggagaactg

SEQ ID NO: 336871 - DNA, 25 bp, Mus musculus
ccaatggcggcgtcctggagaactg

SEQ ID NO: 336872 - DNA, 25 bp, Mus musculus
ccaatgggaagcacaggtttctgtt

SEQ ID NO: 336873 - DNA, 25 bp, Mus musculus
ccaatgggaagctcaggtttctgtt

SEQ ID NO: 336874 - DNA, 25 bp, Mus musculus
ccaatggtcctacgcactccagagg

SEQ ID NO: 336875 - DNA, 25 bp, Mus musculus
ccaatggtcctaggcactccagagg

SEQ ID NO: 336876 - DNA, 25 bp, Mus musculus
ccaatggtgaccctgcaagtgtgca

SEQ ID NO: 336877 - DNA, 25 bp, Mus musculus
ccaatggtgaccgtgcaagtgtgca

SEQ ID NO: 336878 - DNA, 25 bp, Mus musculus
ccaatgtaaataatgtcatgaacta

SEQ ID NO: 336879 - DNA, 25 bp, Mus musculus
ccaatgtaaatattgtcatgaacta

SEQ ID NO: 336880 - DNA, 25 bp, Mus musculus
ccaatgtactggcactagagtgatt

SEQ ID NO: 336881 - DNA, 25 bp, Mus musculus
ccaatgtactgggactagagtgatt

SEQ ID NO: 336882 - DNA, 25 bp, Mus musculus
ccaatgtatttgaacaatctggtgt

SEQ ID NO: 336883 - DNA, 25 bp, Mus musculus
ccaatgtatttgtacaatctggtgt

SEQ ID NO: 336884 - DNA, 25 bp, Mus musculus
ccaatgtctgggagtctggtgtcca

SEQ ID NO: 336885 - DNA, 25 bp, Mus musculus
ccaatgtctgggtgtctggtgtcca

SEQ ID NO: 336886 - DNA, 25 bp, Mus musculus
ccaatgtcttgaaaagccaccattt

SEQ ID NO: 336887 - DNA, 25 bp, Mus musculus
ccaatgtcttgataagccaccattt

SEQ ID NO: 336888 - DNA, 25 bp, Mus musculus
ccaatgtgccggctatttacaccag

SEQ ID NO: 336889 - DNA, 25 bp, Mus musculus
ccaatgtgccgggtatttacaccag

SEQ ID NO: 336890 - DNA, 25 bp, Mus musculus
ccaatgtgctgccagtgttaagttc

SEQ ID NO: 336891 - DNA, 25 bp, Mus musculus
ccaatgtgctgcgagtgttaagttc

SEQ ID NO: 336892 - DNA, 25 bp, Mus musculus
ccaatgtgctggcaagactgagaga

SEQ ID NO: 336893 - DNA, 25 bp, Mus musculus
ccaatgtgctgggaagactgagaga

SEQ ID NO: 336894 - DNA, 25 bp, Mus musculus
ccaatgtggtcaaccgccagagcct

SEQ ID NO: 336895 - DNA, 25 bp, Mus musculus
ccaatgtggtcatccgccagagcct

SEQ ID NO: 336896 - DNA, 25 bp, Mus musculus
ccaatgtgttgtatgaactgtgcgc

SEQ ID NO: 336897 - DNA, 25 bp, Mus musculus
ccaatgtgttgtttgaactgtgcgc

SEQ ID NO: 336898 - DNA, 25 bp, Mus musculus
ccaatgttccagcttcccgaatgaa

SEQ ID NO: 336899 - DNA, 25 bp, Mus musculus
ccaatgttccaggttcccgaatgaa

SEQ ID NO: 336900 - DNA, 25 bp, Mus musculus
ccaatgttcgaacttcctaattctg

SEQ ID NO: 336901 - DNA, 25 bp, Mus musculus
ccaatgttcgaagttcctaattctg

SEQ ID NO: 336902 - DNA, 25 bp, Mus musculus
ccaatgttgccaatttgtgggagta

SEQ ID NO: 336903 - DNA, 25 bp, Mus musculus
ccaatgttgccattttgtgggagta

SEQ ID NO: 336904 - DNA, 25 bp, Mus musculus
ccaatgttgccgatttgtggaacta

SEQ ID NO: 336905 - DNA, 25 bp, Mus musculus
ccaatgttgccgttttgtggaacta

SEQ ID NO: 336906 - DNA, 25 bp, Mus musculus
ccaatgttgcttacctaagtggctc

SEQ ID NO: 336907 - DNA, 25 bp, Mus musculus
ccaatgttgctttcctaagtggctc

SEQ ID NO: 336908 - DNA, 25 bp, Mus musculus
ccaattacatgtacccgagccaagg

SEQ ID NO: 336909 - DNA, 25 bp, Mus musculus
ccaattacatgttcccgagccaagg

SEQ ID NO: 336910 - DNA, 25 bp, Mus musculus
ccaattataattcatggaccctgga

SEQ ID NO: 336911 - DNA, 25 bp, Mus musculus
ccaattataattgatggaccctgga

SEQ ID NO: 336912 - DNA, 25 bp, Mus musculus
ccaattatgttgctacatgcccaca

SEQ ID NO: 336913 - DNA, 25 bp, Mus musculus
ccaattatgttggtacatgcccaca

SEQ ID NO: 336914 - DNA, 25 bp, Mus musculus
ccaattcaaactaaggcagcacctc

SEQ ID NO: 336915 - DNA, 25 bp, Mus musculus
ccaattcaaacttaggcagcacctc

SEQ ID NO: 336916 - DNA, 25 bp, Mus musculus
ccaattcaacaaactgagagagaaa

SEQ ID NO: 336917 - DNA, 25 bp, Mus musculus
ccaattcaacaatctgagagagaaa

SEQ ID NO: 336918 - DNA, 25 bp, Mus musculus
ccaattcagtatataggagattttc

SEQ ID NO: 336919 - DNA, 25 bp, Mus musculus
ccaattcagtatcccctgacaagtg

SEQ ID NO: 336920 - DNA, 25 bp, Mus musculus
ccaattcagtatgccctgacaagtg

SEQ ID NO: 336921 - DNA, 25 bp, Mus musculus
ccaattcagtatttaggagattttc

SEQ ID NO: 336922 - DNA, 25 bp, Mus musculus
ccaattccagtcaatccacatgtta

SEQ ID NO: 336923 - DNA, 25 bp, Mus musculus
ccaattccagtctatccacatgtta

SEQ ID NO: 336924 - DNA, 25 bp, Mus musculus
ccaattcctcaacttctttgttcta

SEQ ID NO: 336925 - DNA, 25 bp, Mus musculus
ccaattcctcaagttctttgttcta

SEQ ID NO: 336926 - DNA, 25 bp, Mus musculus
ccaattcgaagccttccatgtcttt

SEQ ID NO: 336927 - DNA, 25 bp, Mus musculus
ccaattcgaagcgttccatgtcttt

SEQ ID NO: 336928 - DNA, 25 bp, Mus musculus
ccaattcggcaactccatggagacg

SEQ ID NO: 336929 - DNA, 25 bp, Mus musculus
ccaattcggcaagtccatggagacg

SEQ ID NO: 336930 - DNA, 25 bp, Mus musculus
ccaattctacatctattgttgtggt

SEQ ID NO: 336931 - DNA, 25 bp, Mus musculus
ccaattctacatgtattgttgtggt

SEQ ID NO: 336932 - DNA, 25 bp, Mus musculus
ccaattctcatcacttagccagtta

SEQ ID NO: 336933 - DNA, 25 bp, Mus musculus
ccaattctcatctcttagccagtta

SEQ ID NO: 336934 - DNA, 25 bp, Mus musculus
ccaattctcctgacatcatcaatga

SEQ ID NO: 336935 - DNA, 25 bp, Mus musculus
ccaattctcctgtcatcatcaatga

SEQ ID NO: 336936 - DNA, 25 bp, Mus musculus
ccaattctgaggcaggtcgaacatc

SEQ ID NO: 336937 - DNA, 25 bp, Mus musculus
ccaattctgagggaggtcgaacatc

SEQ ID NO: 336938 - DNA, 25 bp, Mus musculus
ccaattcttccaagcaggaaagcag

SEQ ID NO: 336939 - DNA, 25 bp, Mus musculus
ccaattcttccatgcaggaaagcag

SEQ ID NO: 336940 - DNA, 25 bp, Mus musculus
ccaattgagtggagtaagacccgaa

SEQ ID NO: 336941 - DNA, 25 bp, Mus musculus
ccaattgagtggtgtaagacccgaa

SEQ ID NO: 336942 - DNA, 25 bp, Mus musculus
ccaattggccccattggagagccat

SEQ ID NO: 336943 - DNA, 25 bp, Mus musculus
ccaattggcccctttggagagccat

SEQ ID NO: 336944 - DNA, 25 bp, Mus musculus
ccaatttcagaaagctttgttgcca

SEQ ID NO: 336945 - DNA, 25 bp, Mus musculus
ccaatttcagaatgctttgttgcca

SEQ ID NO: 336946 - DNA, 25 bp, Mus musculus
ccaatttcctatcatgactctgcat

SEQ ID NO: 336947 - DNA, 25 bp, Mus musculus
ccaatttcctatgatgactctgcat

SEQ ID NO: 336948 - DNA, 25 bp, Mus musculus
ccaatttcctgcaggcgggtacaaa

SEQ ID NO: 336949 - DNA, 25 bp, Mus musculus
ccaatttcctgctggcgggtacaaa

SEQ ID NO: 336950 - DNA, 25 bp, Mus musculus
ccaatttcggtcatcatgtatgatt

SEQ ID NO: 336951 - DNA, 25 bp, Mus musculus
ccaatttcggtcttcatgtatgatt

SEQ ID NO: 336952 - DNA, 25 bp, Mus musculus
ccaatttctcatacgatttctcagg

SEQ ID NO: 336953 - DNA, 25 bp, Mus musculus
ccaatttctcattcgatttctcagg

SEQ ID NO: 336954 - DNA, 25 bp, Mus musculus
ccaatttctgatctgttagtcaaat

SEQ ID NO: 336955 - DNA, 25 bp, Mus musculus
ccaatttctgatgtgttagtcaaat

SEQ ID NO: 336956 - DNA, 25 bp, Mus musculus
ccaatttgtctactgctggctccta

SEQ ID NO: 336957 - DNA, 25 bp, Mus musculus
ccaatttgtctagtgctggctccta

SEQ ID NO: 336958 - DNA, 25 bp, Mus musculus
ccaattttagcgattttgtgatcat

SEQ ID NO: 336959 - DNA, 25 bp, Mus musculus
ccaattttagcgtttttgtgatcat

SEQ ID NO: 336960 - DNA, 25 bp, Mus musculus
ccaattttatcaccataacctggaa

SEQ ID NO: 336961 - DNA, 25 bp, Mus musculus
ccaattttatcagcataacctggaa

SEQ ID NO: 336962 - DNA, 25 bp, Mus musculus
ccaattttgcttcaagagactcccc

SEQ ID NO: 336963 - DNA, 25 bp, Mus musculus
ccaattttgcttgaagagactcccc

SEQ ID NO: 336964 - DNA, 25 bp, Mus musculus
ccaatttttatcactgtgcatattc

SEQ ID NO: 336965 - DNA, 25 bp, Mus musculus
ccaatttttatctctgtgcatattc

SEQ ID NO: 336966 - DNA, 25 bp, Mus musculus
ccacaaagcaatctcattccactgt

SEQ ID NO: 336967 - DNA, 25 bp, Mus musculus
ccacaaagcaatgtcattccactgt

SEQ ID NO: 336968 - DNA, 25 bp, Mus musculus
ccacaaaggtggcatcagtatacat

SEQ ID NO: 336969 - DNA, 25 bp, Mus musculus
ccacaaaggtgggatcagtatacat

SEQ ID NO: 336970 - DNA, 25 bp, Mus musculus
ccacaaagtgaaactttatcctggt

SEQ ID NO: 336971 - DNA, 25 bp, Mus musculus
ccacaaagtgaatctttatcctggt

SEQ ID NO: 336972 - DNA, 25 bp, Mus musculus
ccacaaatgcatcgattcctttgaa

SEQ ID NO: 336973 - DNA, 25 bp, Mus musculus
ccacaaatgcatggattcctttgaa

SEQ ID NO: 336974 - DNA, 25 bp, Mus musculus
ccacaaatggttctgcctttctcta

SEQ ID NO: 336975 - DNA, 25 bp, Mus musculus
ccacaaatggttgtgcctttctcta

SEQ ID NO: 336976 - DNA, 25 bp, Mus musculus
ccacaacaccccattgaggaaaaag

SEQ ID NO: 336977 - DNA, 25 bp, Mus musculus
ccacaacacccctttgaggaaaaag

SEQ ID NO: 336978 - DNA, 25 bp, Mus musculus
ccacaacagaccaatcactcaaatg

SEQ ID NO: 336979 - DNA, 25 bp, Mus musculus
ccacaacagacctatcactcaaatg

SEQ ID NO: 336980 - DNA, 25 bp, Mus musculus
ccacaaccacgaagagaaggcgttt

SEQ ID NO: 336981 - DNA, 25 bp, Mus musculus
ccacaaccacgatgagaaggcgttt

SEQ ID NO: 336982 - DNA, 25 bp, Mus musculus
ccacaacccagaacctgaggacgat

SEQ ID NO: 336983 - DNA, 25 bp, Mus musculus
ccacaacccagatcctgaggacgat

SEQ ID NO: 336984 - DNA, 25 bp, Mus musculus
ccacaacgtgatcgactgtagccct

SEQ ID NO: 336985 - DNA, 25 bp, Mus musculus
ccacaacgtgatggactgtagccct

SEQ ID NO: 336986 - DNA, 25 bp, Mus musculus
ccacaactcattcttccggagagaa

SEQ ID NO: 336987 - DNA, 25 bp, Mus musculus
ccacaactcattgttccggagagaa

SEQ ID NO: 336988 - DNA, 25 bp, Mus musculus
ccacaactgatgcttcttgcttcct

SEQ ID NO: 336989 - DNA, 25 bp, Mus musculus
ccacaactgatggttcttgcttcct

SEQ ID NO: 336990 - DNA, 25 bp, Mus musculus
ccacaactggctacctacttaagaa

SEQ ID NO: 336991 - DNA, 25 bp, Mus musculus
ccacaactggcttcctacttaagaa

SEQ ID NO: 336992 - DNA, 25 bp, Mus musculus
ccacaacttccaaatgtctggcagc

SEQ ID NO: 336993 - DNA, 25 bp, Mus musculus
ccacaacttccatatgtctggcagc

SEQ ID NO: 336994 - DNA, 25 bp, Mus musculus
ccacaagacactatcagttcctgga

SEQ ID NO: 336995 - DNA, 25 bp, Mus musculus
ccacaagacactttcagttcctgga

SEQ ID NO: 336996 - DNA, 25 bp, Mus musculus
ccacaagagaccaggctttggagaa

SEQ ID NO: 336997 - DNA, 25 bp, Mus musculus
ccacaagagacctggctttggagaa

SEQ ID NO: 336998 - DNA, 25 bp, Mus musculus
ccacaagccacaatgtcaaatcagt

SEQ ID NO: 336999 - DNA, 25 bp, Mus musculus
ccacaagccacattgtcaaatcagt

SEQ ID NO: 337000 - DNA, 25 bp, Mus musculus
ccacaagccatcagttttcacctgg

SEQ ID NO: 337001 - DNA, 25 bp, Mus musculus
ccacaagccatctgttttcacctgg

SEQ ID NO: 337002 - DNA, 25 bp, Mus musculus
ccacaagctggaaaaccatgcggca

SEQ ID NO: 337003 - DNA, 25 bp, Mus musculus
ccacaagctggataaccatgcggca

SEQ ID NO: 337004 - DNA, 25 bp, Mus musculus
ccacaaggaggtcctcagggaccct

SEQ ID NO: 337005 - DNA, 25 bp, Mus musculus
ccacaaggaggtgctcagggaccct

SEQ ID NO: 337006 - DNA, 25 bp, Mus musculus
ccacaagggtgtagattatgaggga

SEQ ID NO: 337007 - DNA, 25 bp, Mus musculus
ccacaagggtgttgattatgaggga

SEQ ID NO: 337008 - DNA, 25 bp, Mus musculus
ccacaaggtgacacaaaagcatcta

SEQ ID NO: 337009 - DNA, 25 bp, Mus musculus
ccacaaggtgactcaaaagcatcta

SEQ ID NO: 337010 - DNA, 25 bp, Mus musculus
ccacaaggtggacgcattacctcat

SEQ ID NO: 337011 - DNA, 25 bp, Mus musculus
ccacaaggtggaggcattacctcat

SEQ ID NO: 337012 - DNA, 25 bp, Mus musculus
ccacaagtacaacgcaaagaggaac

SEQ ID NO: 337013 - DNA, 25 bp, Mus musculus
ccacaagtacaaggcaaagaggaac

SEQ ID NO: 337014 - DNA, 25 bp, Mus musculus
ccacaagtttgaactgttgcatgcc

SEQ ID NO: 337015 - DNA, 25 bp, Mus musculus
ccacaagtttgatctgttgcatgcc

SEQ ID NO: 337016 - DNA, 25 bp, Mus musculus
ccacaagttttcaacagctgatttt

SEQ ID NO: 337017 - DNA, 25 bp, Mus musculus
ccacaagttttctacagctgatttt

SEQ ID NO: 337018 - DNA, 25 bp, Mus musculus
ccacaataacgtcagggtaagagaa

SEQ ID NO: 337019 - DNA, 25 bp, Mus musculus
ccacaataacgtgagggtaagagaa

SEQ ID NO: 337020 - DNA, 25 bp, Mus musculus
ccacaataccaaagcttccctgttt

SEQ ID NO: 337021 - DNA, 25 bp, Mus musculus
ccacaataccaatgcttccctgttt

SEQ ID NO: 337022 - DNA, 25 bp, Mus musculus
ccacaatatactcttttccccaggg

SEQ ID NO: 337023 - DNA, 25 bp, Mus musculus
ccacaatatactgttttccccaggg

SEQ ID NO: 337024 - DNA, 25 bp, Mus musculus
ccacaatatttacctcttgatttat

SEQ ID NO: 337025 - DNA, 25 bp, Mus musculus
ccacaatatttagctcttgatttat

SEQ ID NO: 337026 - DNA, 25 bp, Mus musculus
ccacaatcactgctgctgggatcaa

SEQ ID NO: 337027 - DNA, 25 bp, Mus musculus
ccacaatcactggtgctgggatcaa

SEQ ID NO: 337028 - DNA, 25 bp, Mus musculus
ccacaattcaagcaacgagatgttg

SEQ ID NO: 337029 - DNA, 25 bp, Mus musculus
ccacaattcaaggaacgagatgttg

SEQ ID NO: 337030 - DNA, 25 bp, Mus musculus
ccacacaaatggaacttttcaaagt

SEQ ID NO: 337031 - DNA, 25 bp, Mus musculus
ccacacaaatggtacttttcaaagt

SEQ ID NO: 337032 - DNA, 25 bp, Mus musculus
ccacacacagctaccgtccatcaag

SEQ ID NO: 337033 - DNA, 25 bp, Mus musculus
ccacacacagcttccgtccatcaag

SEQ ID NO: 337034 - DNA, 25 bp, Mus musculus
ccacacacatgcattctaatcgttt

SEQ ID NO: 337035 - DNA, 25 bp, Mus musculus
ccacacacatgctttctaatcgttt

SEQ ID NO: 337036 - DNA, 25 bp, Mus musculus
ccacacacattccagaagtcagggc

SEQ ID NO: 337037 - DNA, 25 bp, Mus musculus
ccacacacattcgagaagtcagggc

SEQ ID NO: 337038 - DNA, 25 bp, Mus musculus
ccacacaccaggatgctatctttaa

SEQ ID NO: 337039 - DNA, 25 bp, Mus musculus
ccacacaccaggttgctatctttaa

SEQ ID NO: 337040 - DNA, 25 bp, Mus musculus
ccacacacccatcatgagactgtat

SEQ ID NO: 337041 - DNA, 25 bp, Mus musculus
ccacacacccatgatgagactgtat

SEQ ID NO: 337042 - DNA, 25 bp, Mus musculus
ccacacacctgcagagttgactatt

SEQ ID NO: 337043 - DNA, 25 bp, Mus musculus
ccacacacctgctgagttgactatt

SEQ ID NO: 337044 - DNA, 25 bp, Mus musculus
ccacacacgtgtatccttctattta

SEQ ID NO: 337045 - DNA, 25 bp, Mus musculus
ccacacacgtgtttccttctattta

SEQ ID NO: 337046 - DNA, 25 bp, Mus musculus
ccacacactggaagctggctggttt

SEQ ID NO: 337047 - DNA, 25 bp, Mus musculus
ccacacactggatgctggctggttt

SEQ ID NO: 337048 - DNA, 25 bp, Mus musculus
ccacacagacgaaggtagccagtca

SEQ ID NO: 337049 - DNA, 25 bp, Mus musculus
ccacacagacgatggtagccagtca

SEQ ID NO: 337050 - DNA, 25 bp, Mus musculus
ccacacagactgagcacagactggt

SEQ ID NO: 337051 - DNA, 25 bp, Mus musculus
ccacacagactgtgcacagactggt

SEQ ID NO: 337052 - DNA, 25 bp, Mus musculus
ccacacagcccacagagcaagaagg

SEQ ID NO: 337053 - DNA, 25 bp, Mus musculus
ccacacagcccagagagcaagaagg

SEQ ID NO: 337054 - DNA, 25 bp, Mus musculus
ccacacatacctctggagtatctgg

SEQ ID NO: 337055 - DNA, 25 bp, Mus musculus
ccacacatacctgtggagtatctgg

SEQ ID NO: 337056 - DNA, 25 bp, Mus musculus
ccacacatgcttccaaacttgtttg

SEQ ID NO: 337057 - DNA, 25 bp, Mus musculus
ccacacatgcttgcaaacttgtttg

SEQ ID NO: 337058 - DNA, 25 bp, Mus musculus
ccacacatgggacggcagcttctag

SEQ ID NO: 337059 - DNA, 25 bp, Mus musculus
ccacacatgggagggcagcttctag

SEQ ID NO: 337060 - DNA, 25 bp, Mus musculus
ccacacatggttaggatgcttctat

SEQ ID NO: 337061 - DNA, 25 bp, Mus musculus
ccacacatggtttggatgcttctat

SEQ ID NO: 337062 - DNA, 25 bp, Mus musculus
ccacacatttaccagcatcactaat

SEQ ID NO: 337063 - DNA, 25 bp, Mus musculus
ccacacatttacgagcatcactaat

SEQ ID NO: 337064 - DNA, 25 bp, Mus musculus
ccacaccaccgccttttatgaaaat

SEQ ID NO: 337065 - DNA, 25 bp, Mus musculus
ccacaccaccgcgttttatgaaaat

SEQ ID NO: 337066 - DNA, 25 bp, Mus musculus
ccacaccagaagcagcatcgcatga

SEQ ID NO: 337067 - DNA, 25 bp, Mus musculus
ccacaccagaaggagcatcgcatga

SEQ ID NO: 337068 - DNA, 25 bp, Mus musculus
ccacaccagctcaacaaggaaattt

SEQ ID NO: 337069 - DNA, 25 bp, Mus musculus
ccacaccagctctacaaggaaattt

SEQ ID NO: 337070 - DNA, 25 bp, Mus musculus
ccacaccagggcatcgtgaagtttt

SEQ ID NO: 337071 - DNA, 25 bp, Mus musculus
ccacaccagggcttcgtgaagtttt

SEQ ID NO: 337072 - DNA, 25 bp, Mus musculus
ccacacccagctaagaaatgttaaa

SEQ ID NO: 337073 - DNA, 25 bp, Mus musculus
ccacacccagctcgaatagattttt

SEQ ID NO: 337074 - DNA, 25 bp, Mus musculus
ccacacccagctggaatagattttt

SEQ ID NO: 337075 - DNA, 25 bp, Mus musculus
ccacacccagcttagaaatgttaaa

SEQ ID NO: 337076 - DNA, 25 bp, Mus musculus
ccacaccccaggaagtcagaggcaa

SEQ ID NO: 337077 - DNA, 25 bp, Mus musculus
ccacaccccaggtagtcagaggcaa

SEQ ID NO: 337078 - DNA, 25 bp, Mus musculus
ccacaccccggtcaatgtagatgat

SEQ ID NO: 337079 - DNA, 25 bp, Mus musculus
ccacaccccggtgaatgtagatgat

SEQ ID NO: 337080 - DNA, 25 bp, Mus musculus
ccacaccctcacattcattataaaa

SEQ ID NO: 337081 - DNA, 25 bp, Mus musculus
ccacaccctcactttcattataaaa

SEQ ID NO: 337082 - DNA, 25 bp, Mus musculus
ccacaccctccaacgattgattaaa

SEQ ID NO: 337083 - DNA, 25 bp, Mus musculus
ccacaccctccatcgattgattaaa

SEQ ID NO: 337084 - DNA, 25 bp, Mus musculus
ccacaccctgtgattacaatcaatg

SEQ ID NO: 337085 - DNA, 25 bp, Mus musculus
ccacaccctgtgtttacaatcaatg

SEQ ID NO: 337086 - DNA, 25 bp, Mus musculus
ccacaccctttaattctgcttaatg

SEQ ID NO: 337087 - DNA, 25 bp, Mus musculus
ccacaccctttatttctgcttaatg

SEQ ID NO: 337088 - DNA, 25 bp, Mus musculus
ccacaccgacttagtccttcagaaa

SEQ ID NO: 337089 - DNA, 25 bp, Mus musculus
ccacaccgactttgtccttcagaaa

SEQ ID NO: 337090 - DNA, 25 bp, Mus musculus
ccacacctatcacacaaagatggat

SEQ ID NO: 337091 - DNA, 25 bp, Mus musculus
ccacacctatcagacaaagatggat

SEQ ID NO: 337092 - DNA, 25 bp, Mus musculus
ccacacctcacaaacacattaataa

SEQ ID NO: 337093 - DNA, 25 bp, Mus musculus
ccacacctcacatacacattaataa

SEQ ID NO: 337094 - DNA, 25 bp, Mus musculus
ccacacctgaagaaattttaagaat

SEQ ID NO: 337095 - DNA, 25 bp, Mus musculus
ccacacctgaagtaattttaagaat

SEQ ID NO: 337096 - DNA, 25 bp, Mus musculus
ccacacctggctacaatgttcagtt

SEQ ID NO: 337097 - DNA, 25 bp, Mus musculus
ccacacctggcttcaatgttcagtt

SEQ ID NO: 337098 - DNA, 25 bp, Mus musculus
ccacacctgggtatggtgaccagtt

SEQ ID NO: 337099 - DNA, 25 bp, Mus musculus
ccacacctgggtttggtgaccagtt

SEQ ID NO: 337100 - DNA, 25 bp, Mus musculus
ccacacctggttctgtactcagttt

SEQ ID NO: 337101 - DNA, 25 bp, Mus musculus
ccacacctggttgtgtactcagttt

SEQ ID NO: 337102 - DNA, 25 bp, Mus musculus
ccacacctgtatacctggtgtttaa

SEQ ID NO: 337103 - DNA, 25 bp, Mus musculus
ccacacctgtattcctggtgtttaa

SEQ ID NO: 337104 - DNA, 25 bp, Mus musculus
ccacaccttgccatttaataacatc

SEQ ID NO: 337105 - DNA, 25 bp, Mus musculus
ccacaccttgccttttaataacatc

SEQ ID NO: 337106 - DNA, 25 bp, Mus musculus
ccacacctttggcaactaaccatat

SEQ ID NO: 337107 - DNA, 25 bp, Mus musculus
ccacacctttgggaactaaccatat

SEQ ID NO: 337108 - DNA, 25 bp, Mus musculus
ccacacctttttcattagcaacact

SEQ ID NO: 337109 - DNA, 25 bp, Mus musculus
ccacacctttttgattagcaacact

SEQ ID NO: 337110 - DNA, 25 bp, Mus musculus
ccacacgaattgcagcctgagaagg

SEQ ID NO: 337111 - DNA, 25 bp, Mus musculus
ccacacgaattggagcctgagaagg

SEQ ID NO: 337112 - DNA, 25 bp, Mus musculus
ccacacgatcttccgttctttgctg

SEQ ID NO: 337113 - DNA, 25 bp, Mus musculus
ccacacgatcttgcgttctttgctg

SEQ ID NO: 337114 - DNA, 25 bp, Mus musculus
ccacacgatggccttcagggaaggt

SEQ ID NO: 337115 - DNA, 25 bp, Mus musculus
ccacacgatggcgttcagggaaggt

SEQ ID NO: 337116 - DNA, 25 bp, Mus musculus
ccacacgcatggcaatcagtactta

SEQ ID NO: 337117 - DNA, 25 bp, Mus musculus
ccacacgcatgggaatcagtactta

SEQ ID NO: 337118 - DNA, 25 bp, Mus musculus
ccacacgcttaaccactgttggatg

SEQ ID NO: 337119 - DNA, 25 bp, Mus musculus
ccacacgcttaagcactgttggatg

SEQ ID NO: 337120 - DNA, 25 bp, Mus musculus
ccacacggagacacaggcggcatct

SEQ ID NO: 337121 - DNA, 25 bp, Mus musculus
ccacacggagactcaggcggcatct

SEQ ID NO: 337122 - DNA, 25 bp, Mus musculus
ccacacggcactcttttctaatatt

SEQ ID NO: 337123 - DNA, 25 bp, Mus musculus
ccacacggcactgttttctaatatt

SEQ ID NO: 337124 - DNA, 25 bp, Mus musculus
ccacacggcagaagaacaacctatg

SEQ ID NO: 337125 - DNA, 25 bp, Mus musculus
ccacacggcagatgaacaacctatg

SEQ ID NO: 337126 - DNA, 25 bp, Mus musculus
ccacacgtgcatcatggctcatgaa

SEQ ID NO: 337127 - DNA, 25 bp, Mus musculus
ccacacgtgcatgatggctcatgaa

SEQ ID NO: 337128 - DNA, 25 bp, Mus musculus
ccacacgtgtgacctgtgaggacat

SEQ ID NO: 337129 - DNA, 25 bp, Mus musculus
ccacacgtgtgagctgtgaggacat

SEQ ID NO: 337130 - DNA, 25 bp, Mus musculus
ccacactaatccatctaaatgggaa

SEQ ID NO: 337131 - DNA, 25 bp, Mus musculus
ccacactaatccttctaaatgggaa

SEQ ID NO: 337132 - DNA, 25 bp, Mus musculus
ccacactcaggaacgtgcttgatat

SEQ ID NO: 337133 - DNA, 25 bp, Mus musculus
ccacactcaggatcgtgcttgatat

SEQ ID NO: 337134 - DNA, 25 bp, Mus musculus
ccacactcagtgagagaatccagag

SEQ ID NO: 337135 - DNA, 25 bp, Mus musculus
ccacactcagtgtgagaatccagag

SEQ ID NO: 337136 - DNA, 25 bp, Mus musculus
ccacactcccagaaagctttgagaa

SEQ ID NO: 337137 - DNA, 25 bp, Mus musculus
ccacactcccagtaagctttgagaa

SEQ ID NO: 337138 - DNA, 25 bp, Mus musculus
ccacactcttgaccagtctggaaga

SEQ ID NO: 337139 - DNA, 25 bp, Mus musculus
ccacactcttgagcagtctggaaga

SEQ ID NO: 337140 - DNA, 25 bp, Mus musculus
ccacactcttggataaatactttga

SEQ ID NO: 337141 - DNA, 25 bp, Mus musculus
ccacactcttggttaaatactttga

SEQ ID NO: 337142 - DNA, 25 bp, Mus musculus
ccacactcttttacctgtcacaata

SEQ ID NO: 337143 - DNA, 25 bp, Mus musculus
ccacactctttttcctgtcacaata

SEQ ID NO: 337144 - DNA, 25 bp, Mus musculus
ccacactgcaaacagggacttccag

SEQ ID NO: 337145 - DNA, 25 bp, Mus musculus
ccacactgcaaagagggacttccag

SEQ ID NO: 337146 - DNA, 25 bp, Mus musculus
ccacactgcatgcaatctttagttt

SEQ ID NO: 337147 - DNA, 25 bp, Mus musculus
ccacactgcatggaatctttagttt

SEQ ID NO: 337148 - DNA, 25 bp, Mus musculus
ccacactggagaaggcacctaagaa

SEQ ID NO: 337149 - DNA, 25 bp, Mus musculus
ccacactggagatggcacctaagaa

SEQ ID NO: 337150 - DNA, 25 bp, Mus musculus
ccacactggtgtcaggatgctgttt

SEQ ID NO: 337151 - DNA, 25 bp, Mus musculus
ccacactggtgtgaggatgctgttt

SEQ ID NO: 337152 - DNA, 25 bp, Mus musculus
ccacactgtgaaccatcatgagata

SEQ ID NO: 337153 - DNA, 25 bp, Mus musculus
ccacactgtgaagcatcatgagata

SEQ ID NO: 337154 - DNA, 25 bp, Mus musculus
ccacactgttccatgcaaggtgaca

SEQ ID NO: 337155 - DNA, 25 bp, Mus musculus
ccacactgttccttgcaaggtgaca

SEQ ID NO: 337156 - DNA, 25 bp, Mus musculus
ccacacttccggattataatcgcag

SEQ ID NO: 337157 - DNA, 25 bp, Mus musculus
ccacacttccggtttataatcgcag

SEQ ID NO: 337158 - DNA, 25 bp, Mus musculus
ccacacttctctcgacatgtaggct

SEQ ID NO: 337159 - DNA, 25 bp, Mus musculus
ccacacttctctggacatgtaggct

SEQ ID NO: 337160 - DNA, 25 bp, Mus musculus
ccacacttctggaattttctttctc

SEQ ID NO: 337161 - DNA, 25 bp, Mus musculus
ccacacttctggtattttctttctc

SEQ ID NO: 337162 - DNA, 25 bp, Mus musculus
ccacacttgggaacacacagatgtg

SEQ ID NO: 337163 - DNA, 25 bp, Mus musculus
ccacacttgggatcacacagatgtg

SEQ ID NO: 337164 - DNA, 25 bp, Mus musculus
ccacactttcaacccctgagtttaa

SEQ ID NO: 337165 - DNA, 25 bp, Mus musculus
ccacactttcaagccctgagtttaa

SEQ ID NO: 337166 - DNA, 25 bp, Mus musculus
ccacactttggcctctatttatttc

SEQ ID NO: 337167 - DNA, 25 bp, Mus musculus
ccacactttggcgtctatttatttc

SEQ ID NO: 337168 - DNA, 25 bp, Mus musculus
ccacagaaaatcatactgggaacag

SEQ ID NO: 337169 - DNA, 25 bp, Mus musculus
ccacagaaaatcttactgggaacag

SEQ ID NO: 337170 - DNA, 25 bp, Mus musculus
ccacagaatcagactcaggctagct

SEQ ID NO: 337171 - DNA, 25 bp, Mus musculus
ccacagaatcagtctcaggctagct

SEQ ID NO: 337172 - DNA, 25 bp, Mus musculus
ccacagacagcacaagatgttcaca

SEQ ID NO: 337173 - DNA, 25 bp, Mus musculus
ccacagacagcagaagatgttcaca

SEQ ID NO: 337174 - DNA, 25 bp, Mus musculus
ccacagaccctgctgacatcagaga

SEQ ID NO: 337175 - DNA, 25 bp, Mus musculus
ccacagaccctggtgacatcagaga

SEQ ID NO: 337176 - DNA, 25 bp, Mus musculus
ccacagagagccaaggggacccatg

SEQ ID NO: 337177 - DNA, 25 bp, Mus musculus
ccacagagagcctaggggacccatg

SEQ ID NO: 337178 - DNA, 25 bp, Mus musculus
ccacagagatttattaacccgcccg

SEQ ID NO: 337179 - DNA, 25 bp, Mus musculus
ccacagagattttttaacccgcccg

SEQ ID NO: 337180 - DNA, 25 bp, Mus musculus
ccacagagcctaaatttaaacagaa

SEQ ID NO: 337181 - DNA, 25 bp, Mus musculus
ccacagagcctatatttaaacagaa

SEQ ID NO: 337182 - DNA, 25 bp, Mus musculus
ccacagagctcaagtttatagctgc

SEQ ID NO: 337183 - DNA, 25 bp, Mus musculus
ccacagagctcatgtttatagctgc

SEQ ID NO: 337184 - DNA, 25 bp, Mus musculus
ccacagagctgtcggctgaggaacc

SEQ ID NO: 337185 - DNA, 25 bp, Mus musculus
ccacagagctgtgggctgaggaacc

SEQ ID NO: 337186 - DNA, 25 bp, Mus musculus
ccacagaggaagctgagccaaagga

SEQ ID NO: 337187 - DNA, 25 bp, Mus musculus
ccacagaggaaggtgagccaaagga

SEQ ID NO: 337188 - DNA, 25 bp, Mus musculus
ccacagaggagaactgggcccaggt

SEQ ID NO: 337189 - DNA, 25 bp, Mus musculus
ccacagaggagatctgggcccaggt

SEQ ID NO: 337190 - DNA, 25 bp, Mus musculus
ccacagagggctccatcgtgggaaa

SEQ ID NO: 337191 - DNA, 25 bp, Mus musculus
ccacagagggctgcatcgtgggaaa

SEQ ID NO: 337192 - DNA, 25 bp, Mus musculus
ccacagatactccatcctatggtgt

SEQ ID NO: 337193 - DNA, 25 bp, Mus musculus
ccacagatactcgatcctatggtgt

SEQ ID NO: 337194 - DNA, 25 bp, Mus musculus
ccacagatcccaactcagatagttg

SEQ ID NO: 337195 - DNA, 25 bp, Mus musculus
ccacagatcccatctcagatagttg

SEQ ID NO: 337196 - DNA, 25 bp, Mus musculus
ccacagatgagaagtttgtagaagg

SEQ ID NO: 337197 - DNA, 25 bp, Mus musculus
ccacagatgagatgtttgtagaagg

SEQ ID NO: 337198 - DNA, 25 bp, Mus musculus
ccacagatggccattaggtgtcacc

SEQ ID NO: 337199 - DNA, 25 bp, Mus musculus
ccacagatggcctttaggtgtcacc

SEQ ID NO: 337200 - DNA, 25 bp, Mus musculus
ccacagatgggcaggaattcagtcc

SEQ ID NO: 337201 - DNA, 25 bp, Mus musculus
ccacagatgggctggaattcagtcc

SEQ ID NO: 337202 - DNA, 25 bp, Mus musculus
ccacagattgagcactgctagtcta

SEQ ID NO: 337203 - DNA, 25 bp, Mus musculus
ccacagattgaggactgctagtcta

SEQ ID NO: 337204 - DNA, 25 bp, Mus musculus
ccacagattttgcattcaggatttt

SEQ ID NO: 337205 - DNA, 25 bp, Mus musculus
ccacagattttggattcaggatttt

SEQ ID NO: 337206 - DNA, 25 bp, Mus musculus
ccacagcacactcggtacaaacgga

SEQ ID NO: 337207 - DNA, 25 bp, Mus musculus
ccacagcacactgggtacaaacgga

SEQ ID NO: 337208 - DNA, 25 bp, Mus musculus
ccacagcagcttccgccagagaagg

SEQ ID NO: 337209 - DNA, 25 bp, Mus musculus
ccacagcagcttgcgccagagaagg

SEQ ID NO: 337210 - DNA, 25 bp, Mus musculus
ccacagcattttatcctggcttaca

SEQ ID NO: 337211 - DNA, 25 bp, Mus musculus
ccacagcattttttcctggcttaca

SEQ ID NO: 337212 - DNA, 25 bp, Mus musculus
ccacagccactgatgttaggaaata

SEQ ID NO: 337213 - DNA, 25 bp, Mus musculus
ccacagccactgttgttaggaaata

SEQ ID NO: 337214 - DNA, 25 bp, Mus musculus
ccacagccctggaaaccgtgatgag

SEQ ID NO: 337215 - DNA, 25 bp, Mus musculus
ccacagccctggtaaccgtgatgag

SEQ ID NO: 337216 - DNA, 25 bp, Mus musculus
ccacagcctacaagtcggagacaaa

SEQ ID NO: 337217 - DNA, 25 bp, Mus musculus
ccacagcctacaccaatgtgtgtct

SEQ ID NO: 337218 - DNA, 25 bp, Mus musculus
ccacagcctacagcaatgtgtgtct

SEQ ID NO: 337219 - DNA, 25 bp, Mus musculus
ccacagcctacatgtcggagacaaa

SEQ ID NO: 337220 - DNA, 25 bp, Mus musculus
ccacagccttggccattcttgtatc

SEQ ID NO: 337221 - DNA, 25 bp, Mus musculus
ccacagccttgggcattcttgtatc

SEQ ID NO: 337222 - DNA, 25 bp, Mus musculus
ccacagcctttaatcttttgtcaca

SEQ ID NO: 337223 - DNA, 25 bp, Mus musculus
ccacagcctttattcttttgtcaca

SEQ ID NO: 337224 - DNA, 25 bp, Mus musculus
ccacagcgaggaagagagtaaagaa

SEQ ID NO: 337225 - DNA, 25 bp, Mus musculus
ccacagcgaggatgagagtaaagaa

SEQ ID NO: 337226 - DNA, 25 bp, Mus musculus
ccacagcgggcgactaagtgcctgt

SEQ ID NO: 337227 - DNA, 25 bp, Mus musculus
ccacagcgggcgtctaagtgcctgt

SEQ ID NO: 337228 - DNA, 25 bp, Mus musculus
ccacagcgtggtacatgcagatcgt

SEQ ID NO: 337229 - DNA, 25 bp, Mus musculus
ccacagcgtggttcatgcagatcgt

SEQ ID NO: 337230 - DNA, 25 bp, Mus musculus
ccacagctactgacgtcaataaaat

SEQ ID NO: 337231 - DNA, 25 bp, Mus musculus
ccacagctactgtcgtcaataaaat

SEQ ID NO: 337232 - DNA, 25 bp, Mus musculus
ccacagcttgagaaacagtgctcta

SEQ ID NO: 337233 - DNA, 25 bp, Mus musculus
ccacagcttgagtaacagtgctcta

SEQ ID NO: 337234 - DNA, 25 bp, Mus musculus
ccacagcttgggagcagagactcga

SEQ ID NO: 337235 - DNA, 25 bp, Mus musculus
ccacagcttgggtgcagagactcga

SEQ ID NO: 337236 - DNA, 25 bp, Mus musculus
ccacagctttgtagaacagttcatg

SEQ ID NO: 337237 - DNA, 25 bp, Mus musculus
ccacagctttgttgaacagttcatg

SEQ ID NO: 337238 - DNA, 25 bp, Mus musculus
ccacaggatttgaggctcaggttta

SEQ ID NO: 337239 - DNA, 25 bp, Mus musculus
ccacaggatttgtggctcaggttta

SEQ ID NO: 337240 - DNA, 25 bp, Mus musculus
ccacaggcagtgaggcatccctaac

SEQ ID NO: 337241 - DNA, 25 bp, Mus musculus
ccacaggcagtgtggcatccctaac

SEQ ID NO: 337242 - DNA, 25 bp, Mus musculus
ccacaggccttgcacgagactgaca

SEQ ID NO: 337243 - DNA, 25 bp, Mus musculus
ccacaggccttggacgagactgaca

SEQ ID NO: 337244 - DNA, 25 bp, Mus musculus
ccacaggcgctcagggcttaggaaa

SEQ ID NO: 337245 - DNA, 25 bp, Mus musculus
ccacaggcgctctgggcttaggaaa

SEQ ID NO: 337246 - DNA, 25 bp, Mus musculus
ccacaggctggcaggacttggaaga

SEQ ID NO: 337247 - DNA, 25 bp, Mus musculus
ccacaggctggctggacttggaaga

SEQ ID NO: 337248 - DNA, 25 bp, Mus musculus
ccacaggcttccatgtataataaag

SEQ ID NO: 337249 - DNA, 25 bp, Mus musculus
ccacaggcttccttgtataataaag

SEQ ID NO: 337250 - DNA, 25 bp, Mus musculus
ccacagggagtgataatgaattata

SEQ ID NO: 337251 - DNA, 25 bp, Mus musculus
ccacagggagtgttaatgaattata

SEQ ID NO: 337252 - DNA, 25 bp, Mus musculus
ccacagggatacacttcctccaaaa

SEQ ID NO: 337253 - DNA, 25 bp, Mus musculus
ccacagggatactcttcctccaaaa

SEQ ID NO: 337254 - DNA, 25 bp, Mus musculus
ccacagggcaggacctaagatctgg

SEQ ID NO: 337255 - DNA, 25 bp, Mus musculus
ccacagggcaggtcctaagatctgg

SEQ ID NO: 337256 - DNA, 25 bp, Mus musculus
ccacagggtcgaagattccccattg

SEQ ID NO: 337257 - DNA, 25 bp, Mus musculus
ccacagggtcgatgattccccattg

SEQ ID NO: 337258 - DNA, 25 bp, Mus musculus
ccacaggtaagaagggtttcgccct

SEQ ID NO: 337259 - DNA, 25 bp, Mus musculus
ccacaggtaagatgggtttcgccct

SEQ ID NO: 337260 - DNA, 25 bp, Mus musculus
ccacaggtgtacatagacgctttct

SEQ ID NO: 337261 - DNA, 25 bp, Mus musculus
ccacaggtgtacttagacgctttct

SEQ ID NO: 337262 - DNA, 25 bp, Mus musculus
ccacagtaactaccaggagaggcct

SEQ ID NO: 337263 - DNA, 25 bp, Mus musculus
ccacagtaactagcaggagaggcct

SEQ ID NO: 337264 - DNA, 25 bp, Mus musculus
ccacagtacattagagacacaataa

SEQ ID NO: 337265 - DNA, 25 bp, Mus musculus
ccacagtacatttgagacacaataa

SEQ ID NO: 337266 - DNA, 25 bp, Mus musculus
ccacagtactgtagtcatgtccctt

SEQ ID NO: 337267 - DNA, 25 bp, Mus musculus
ccacagtactgttgtcatgtccctt

SEQ ID NO: 337268 - DNA, 25 bp, Mus musculus
ccacagtactttcagttcgagtttg

SEQ ID NO: 337269 - DNA, 25 bp, Mus musculus
ccacagtactttgagttcgagtttg

SEQ ID NO: 337270 - DNA, 25 bp, Mus musculus
ccacagtagcacaaggccctttgat

SEQ ID NO: 337271 - DNA, 25 bp, Mus musculus
ccacagtagcactaggccctttgat

SEQ ID NO: 337272 - DNA, 25 bp, Mus musculus
ccacagtatcccatgtcacaagtgt

SEQ ID NO: 337273 - DNA, 25 bp, Mus musculus
ccacagtatcccttgtcacaagtgt

SEQ ID NO: 337274 - DNA, 25 bp, Mus musculus
ccacagtatgcacctttctctttct

SEQ ID NO: 337275 - DNA, 25 bp, Mus musculus
ccacagtatgcagctttctctttct

SEQ ID NO: 337276 - DNA, 25 bp, Mus musculus
ccacagtattttcttcaatgccctt

SEQ ID NO: 337277 - DNA, 25 bp, Mus musculus
ccacagtattttgttcaatgccctt

SEQ ID NO: 337278 - DNA, 25 bp, Mus musculus
ccacagtcattaagctctgaaccca

SEQ ID NO: 337279 - DNA, 25 bp, Mus musculus
ccacagtcattatgctctgaaccca

SEQ ID NO: 337280 - DNA, 25 bp, Mus musculus
ccacagtcctgtctcaagatcagag

SEQ ID NO: 337281 - DNA, 25 bp, Mus musculus
ccacagtcctgtgtcaagatcagag

SEQ ID NO: 337282 - DNA, 25 bp, Mus musculus
ccacagtcggttccctgacaaggat

SEQ ID NO: 337283 - DNA, 25 bp, Mus musculus
ccacagtcggttgcctgacaaggat

SEQ ID NO: 337284 - DNA, 25 bp, Mus musculus
ccacagtctatcatcagcacaaact

SEQ ID NO: 337285 - DNA, 25 bp, Mus musculus
ccacagtctatcttcagcacaaact

SEQ ID NO: 337286 - DNA, 25 bp, Mus musculus
ccacagtctggaccgaaggctcgtg

SEQ ID NO: 337287 - DNA, 25 bp, Mus musculus
ccacagtctggagcgaaggctcgtg

SEQ ID NO: 337288 - DNA, 25 bp, Mus musculus
ccacagtctttgaagccgttcctat

SEQ ID NO: 337289 - DNA, 25 bp, Mus musculus
ccacagtctttgtagccgttcctat

SEQ ID NO: 337290 - DNA, 25 bp, Mus musculus
ccacagtgactgaaggccccaggaa

SEQ ID NO: 337291 - DNA, 25 bp, Mus musculus
ccacagtgactgtaggccccaggaa

SEQ ID NO: 337292 - DNA, 25 bp, Mus musculus
ccacagtgacttacatctcttcaaa

SEQ ID NO: 337293 - DNA, 25 bp, Mus musculus
ccacagtgactttcatctcttcaaa

SEQ ID NO: 337294 - DNA, 25 bp, Mus musculus
ccacagtgcagcagggacctctttt

SEQ ID NO: 337295 - DNA, 25 bp, Mus musculus
ccacagtgcagctgggacctctttt

SEQ ID NO: 337296 - DNA, 25 bp, Mus musculus
ccacagtgcctgatagatatgctat

SEQ ID NO: 337297 - DNA, 25 bp, Mus musculus
ccacagtgcctgttagatatgctat

SEQ ID NO: 337298 - DNA, 25 bp, Mus musculus
ccacagtggacaaggcccagctgaa

SEQ ID NO: 337299 - DNA, 25 bp, Mus musculus
ccacagtggacatggcccagctgaa

SEQ ID NO: 337300 - DNA, 25 bp, Mus musculus
ccacagtggtgtatgggtggctcac

SEQ ID NO: 337301 - DNA, 25 bp, Mus musculus
ccacagtggtgtttgggtggctcac

SEQ ID NO: 337302 - DNA, 25 bp, Mus musculus
ccacagtggttcctaggtctcatat

SEQ ID NO: 337303 - DNA, 25 bp, Mus musculus
ccacagtggttcgtaggtctcatat

SEQ ID NO: 337304 - DNA, 25 bp, Mus musculus
ccacagtgtacaagaaggtggacgg

SEQ ID NO: 337305 - DNA, 25 bp, Mus musculus
ccacagtgtacatgaaggtggacgg

SEQ ID NO: 337306 - DNA, 25 bp, Mus musculus
ccacagtgtgtgctcaggtaaatca

SEQ ID NO: 337307 - DNA, 25 bp, Mus musculus
ccacagtgtgtggtcaggtaaatca

SEQ ID NO: 337308 - DNA, 25 bp, Mus musculus
ccacagtgttcactcgtgtatgcac

SEQ ID NO: 337309 - DNA, 25 bp, Mus musculus
ccacagtgttcagtcgtgtatgcac

SEQ ID NO: 337310 - DNA, 25 bp, Mus musculus
ccacagttgcctagatgcctggatt

SEQ ID NO: 337311 - DNA, 25 bp, Mus musculus
ccacagttgccttgatgcctggatt

SEQ ID NO: 337312 - DNA, 25 bp, Mus musculus
ccacagtttgtaaagcttctccatc

SEQ ID NO: 337313 - DNA, 25 bp, Mus musculus
ccacagtttgtatagcttctccatc

SEQ ID NO: 337314 - DNA, 25 bp, Mus musculus
ccacataaactgctgagctggattc

SEQ ID NO: 337315 - DNA, 25 bp, Mus musculus
ccacataaactggtgagctggattc

SEQ ID NO: 337316 - DNA, 25 bp, Mus musculus
ccacatacataaattacctcatgat

SEQ ID NO: 337317 - DNA, 25 bp, Mus musculus
ccacatacataatttacctcatgat

SEQ ID NO: 337318 - DNA, 25 bp, Mus musculus
ccacatacatagctaggaagtggca

SEQ ID NO: 337319 - DNA, 25 bp, Mus musculus
ccacatacataggtaggaagtggca

SEQ ID NO: 337320 - DNA, 25 bp, Mus musculus
ccacataccctgaaacttatactca

SEQ ID NO: 337321 - DNA, 25 bp, Mus musculus
ccacataccctgtaacttatactca

SEQ ID NO: 337322 - DNA, 25 bp, Mus musculus
ccacataccttcatgctatctcaaa

SEQ ID NO: 337323 - DNA, 25 bp, Mus musculus
ccacataccttcttgctatctcaaa

SEQ ID NO: 337324 - DNA, 25 bp, Mus musculus
ccacatactgatcccaagtctccat

SEQ ID NO: 337325 - DNA, 25 bp, Mus musculus
ccacatactgatgccaagtctccat

SEQ ID NO: 337326 - DNA, 25 bp, Mus musculus
ccacatagttctcacttcctagatg

SEQ ID NO: 337327 - DNA, 25 bp, Mus musculus
ccacatagttctgacttcctagatg

SEQ ID NO: 337328 - DNA, 25 bp, Mus musculus
ccacatatggtgattgttgcagaaa

SEQ ID NO: 337329 - DNA, 25 bp, Mus musculus
ccacatatggtgtttgttgcagaaa

SEQ ID NO: 337330 - DNA, 25 bp, Mus musculus
ccacatatgtccactctttatgaga

SEQ ID NO: 337331 - DNA, 25 bp, Mus musculus
ccacatatgtcctctctttatgaga

SEQ ID NO: 337332 - DNA, 25 bp, Mus musculus
ccacatcaaatacccctaaagcaat

SEQ ID NO: 337333 - DNA, 25 bp, Mus musculus
ccacatcaaatagccctaaagcaat

SEQ ID NO: 337334 - DNA, 25 bp, Mus musculus
ccacatcaacctcctttattatttc

SEQ ID NO: 337335 - DNA, 25 bp, Mus musculus
ccacatcaacctgctttattatttc

SEQ ID NO: 337336 - DNA, 25 bp, Mus musculus
ccacatcactgacaaatcagaagaa

SEQ ID NO: 337337 - DNA, 25 bp, Mus musculus
ccacatcactgagaaatcagaagaa

SEQ ID NO: 337338 - DNA, 25 bp, Mus musculus
ccacatcaggtcacaactatatcat

SEQ ID NO: 337339 - DNA, 25 bp, Mus musculus
ccacatcaggtctcaactatatcat

SEQ ID NO: 337340 - DNA, 25 bp, Mus musculus
ccacatcagtgactttcagtttcct

SEQ ID NO: 337341 - DNA, 25 bp, Mus musculus
ccacatcagtgagtttcagtttcct

SEQ ID NO: 337342 - DNA, 25 bp, Mus musculus
ccacatcagtgccatcgagagcaag

SEQ ID NO: 337343 - DNA, 25 bp, Mus musculus
ccacatcagtgcgatcgagagcaag

SEQ ID NO: 337344 - DNA, 25 bp, Mus musculus
ccacatcagttgcaagactttgagt

SEQ ID NO: 337345 - DNA, 25 bp, Mus musculus
ccacatcagttggaagactttgagt

SEQ ID NO: 337346 - DNA, 25 bp, Mus musculus
ccacatcatctacgttgccaaggag

SEQ ID NO: 337347 - DNA, 25 bp, Mus musculus
ccacatcatctaggttgccaaggag

SEQ ID NO: 337348 - DNA, 25 bp, Mus musculus
ccacatccaggcaactgcatggtat

SEQ ID NO: 337349 - DNA, 25 bp, Mus musculus
ccacatccaggctactgcatggtat

SEQ ID NO: 337350 - DNA, 25 bp, Mus musculus
ccacatcccacaacctgaggacaag

SEQ ID NO: 337351 - DNA, 25 bp, Mus musculus
ccacatcccacatcctgaggacaag

SEQ ID NO: 337352 - DNA, 25 bp, Mus musculus
ccacatccttttccaagtctgttta

SEQ ID NO: 337353 - DNA, 25 bp, Mus musculus
ccacatccttttgcaagtctgttta

SEQ ID NO: 337354 - DNA, 25 bp, Mus musculus
ccacatctagccagataaaaggttg

SEQ ID NO: 337355 - DNA, 25 bp, Mus musculus
ccacatctagcctgataaaaggttg

SEQ ID NO: 337356 - DNA, 25 bp, Mus musculus
ccacatctagctattcccatgaaat

SEQ ID NO: 337357 - DNA, 25 bp, Mus musculus
ccacatctagcttttcccatgaaat

SEQ ID NO: 337358 - DNA, 25 bp, Mus musculus
ccacatctccttctgtgacattgag

SEQ ID NO: 337359 - DNA, 25 bp, Mus musculus
ccacatctccttgtgtgacattgag

SEQ ID NO: 337360 - DNA, 25 bp, Mus musculus
ccacatctctgccattgattgttga

SEQ ID NO: 337361 - DNA, 25 bp, Mus musculus
ccacatctctgcgattgattgttga

SEQ ID NO: 337362 - DNA, 25 bp, Mus musculus
ccacatctggctacttcacagttat

SEQ ID NO: 337363 - DNA, 25 bp, Mus musculus
ccacatctggcttcttcacagttat

SEQ ID NO: 337364 - DNA, 25 bp, Mus musculus
ccacatctgtgaagtgcctacagaa

SEQ ID NO: 337365 - DNA, 25 bp, Mus musculus
ccacatctgtgatgtgcctacagaa

SEQ ID NO: 337366 - DNA, 25 bp, Mus musculus
ccacatctgtggctagctcattaga

SEQ ID NO: 337367 - DNA, 25 bp, Mus musculus
ccacatctgtggctatacgtatttc

SEQ ID NO: 337368 - DNA, 25 bp, Mus musculus
ccacatctgtgggtagctcattaga

SEQ ID NO: 337369 - DNA, 25 bp, Mus musculus
ccacatctgtgggtatacgtatttc

SEQ ID NO: 337370 - DNA, 25 bp, Mus musculus
ccacatcttcctctacttagggaga

SEQ ID NO: 337371 - DNA, 25 bp, Mus musculus
ccacatcttcctgtacttagggaga

SEQ ID NO: 337372 - DNA, 25 bp, Mus musculus
ccacatctttccagggctttggtga

SEQ ID NO: 337373 - DNA, 25 bp, Mus musculus
ccacatctttcctgggctttggtga

SEQ ID NO: 337374 - DNA, 25 bp, Mus musculus
ccacatgaagcaactcctttgcata

SEQ ID NO: 337375 - DNA, 25 bp, Mus musculus
ccacatgaagcatctcctttgcata

SEQ ID NO: 337376 - DNA, 25 bp, Mus musculus
ccacatgactgaaccattttggatg

SEQ ID NO: 337377 - DNA, 25 bp, Mus musculus
ccacatgactgatccattttggatg

SEQ ID NO: 337378 - DNA, 25 bp, Mus musculus
ccacatgacttgatctgcgggtgca

SEQ ID NO: 337379 - DNA, 25 bp, Mus musculus
ccacatgacttgttctgcgggtgca

SEQ ID NO: 337380 - DNA, 25 bp, Mus musculus
ccacatgagctaatgctgaggacat

SEQ ID NO: 337381 - DNA, 25 bp, Mus musculus
ccacatgagctattgctgaggacat

SEQ ID NO: 337382 - DNA, 25 bp, Mus musculus
ccacatgaggagatttgcctttctg

SEQ ID NO: 337383 - DNA, 25 bp, Mus musculus
ccacatgaggagttttgcctttctg

SEQ ID NO: 337384 - DNA, 25 bp, Mus musculus
ccacatgaggcgaacatctcacagg

SEQ ID NO: 337385 - DNA, 25 bp, Mus musculus
ccacatgaggcgtacatctcacagg

SEQ ID NO: 337386 - DNA, 25 bp, Mus musculus
ccacatgcactcagggcaaagtgtt

SEQ ID NO: 337387 - DNA, 25 bp, Mus musculus
ccacatgcactctgggcaaagtgtt

SEQ ID NO: 337388 - DNA, 25 bp, Mus musculus
ccacatgcccacacaaatagtttga

SEQ ID NO: 337389 - DNA, 25 bp, Mus musculus
ccacatgcccactcaaatagtttga

SEQ ID NO: 337390 - DNA, 25 bp, Mus musculus
ccacatgcgatccaacttgtttcaa

SEQ ID NO: 337391 - DNA, 25 bp, Mus musculus
ccacatgcgatcgaacttgtttcaa

SEQ ID NO: 337392 - DNA, 25 bp, Mus musculus
ccacatgcggctcacaatcatgcag

SEQ ID NO: 337393 - DNA, 25 bp, Mus musculus
ccacatgcggctgacaatcatgcag

SEQ ID NO: 337394 - DNA, 25 bp, Mus musculus
ccacatgctttcatcgtatttgtga

SEQ ID NO: 337395 - DNA, 25 bp, Mus musculus
ccacatgctttcttcgtatttgtga

SEQ ID NO: 337396 - DNA, 25 bp, Mus musculus
ccacatggagtgaaggctgtcacca

SEQ ID NO: 337397 - DNA, 25 bp, Mus musculus
ccacatggagtgtaggctgtcacca

SEQ ID NO: 337398 - DNA, 25 bp, Mus musculus
ccacatggcagcatagactcttttg

SEQ ID NO: 337399 - DNA, 25 bp, Mus musculus
ccacatggcagcttagactcttttg

SEQ ID NO: 337400 - DNA, 25 bp, Mus musculus
ccacatggcaggcaattacgcatac

SEQ ID NO: 337401 - DNA, 25 bp, Mus musculus
ccacatggcagggaattacgcatac

SEQ ID NO: 337402 - DNA, 25 bp, Mus musculus
ccacatggcatgacacactatctat

SEQ ID NO: 337403 - DNA, 25 bp, Mus musculus
ccacatggcatgtcacactatctat

SEQ ID NO: 337404 - DNA, 25 bp, Mus musculus
ccacatggccagcttcaggtcaggt

SEQ ID NO: 337405 - DNA, 25 bp, Mus musculus
ccacatggccaggttcaggtcaggt

SEQ ID NO: 337406 - DNA, 25 bp, Mus musculus
ccacatgggccactcactgttgagt

SEQ ID NO: 337407 - DNA, 25 bp, Mus musculus
ccacatgggccagtcactgttgagt

SEQ ID NO: 337408 - DNA, 25 bp, Mus musculus
ccacatgggttgatttgagtaattt

SEQ ID NO: 337409 - DNA, 25 bp, Mus musculus
ccacatgggttgttttgagtaattt

SEQ ID NO: 337410 - DNA, 25 bp, Mus musculus
ccacatggtaggctagttcacaagg

SEQ ID NO: 337411 - DNA, 25 bp, Mus musculus
ccacatggtagggtagttcacaagg

SEQ ID NO: 337412 - DNA, 25 bp, Mus musculus
ccacatgtatgtaagactctatttt

SEQ ID NO: 337413 - DNA, 25 bp, Mus musculus
ccacatgtatgttagactctatttt

SEQ ID NO: 337414 - DNA, 25 bp, Mus musculus
ccacatgtatttccttcaagtctca

SEQ ID NO: 337415 - DNA, 25 bp, Mus musculus
ccacatgtatttgcttcaagtctca

SEQ ID NO: 337416 - DNA, 25 bp, Mus musculus
ccacatgtcaggacaacagtgttag

SEQ ID NO: 337417 - DNA, 25 bp, Mus musculus
ccacatgtcaggtcaacagtgttag

SEQ ID NO: 337418 - DNA, 25 bp, Mus musculus
ccacatgtgctgatcaatgtctctc

SEQ ID NO: 337419 - DNA, 25 bp, Mus musculus
ccacatgtgctgttcaatgtctctc

SEQ ID NO: 337420 - DNA, 25 bp, Mus musculus
ccacatgtggtgaccatgcctttaa

SEQ ID NO: 337421 - DNA, 25 bp, Mus musculus
ccacatgtggtgtccatgcctttaa

SEQ ID NO: 337422 - DNA, 25 bp, Mus musculus
ccacatgttcctccacaattcataa

SEQ ID NO: 337423 - DNA, 25 bp, Mus musculus
ccacatgttcctgcacaattcataa

SEQ ID NO: 337424 - DNA, 25 bp, Mus musculus
ccacatgttgagaacgactaattta

SEQ ID NO: 337425 - DNA, 25 bp, Mus musculus
ccacatgttgagtacgactaattta

SEQ ID NO: 337426 - DNA, 25 bp, Mus musculus
ccacattaggaacggagtgagtgac

SEQ ID NO: 337427 - DNA, 25 bp, Mus musculus
ccacattaggaagggagtgagtgac

SEQ ID NO: 337428 - DNA, 25 bp, Mus musculus
ccacattatgatcgttgtactactg

SEQ ID NO: 337429 - DNA, 25 bp, Mus musculus
ccacattatgatggttgtactactg

SEQ ID NO: 337430 - DNA, 25 bp, Mus musculus
ccacattattgtatggtttctcaaa

SEQ ID NO: 337431 - DNA, 25 bp, Mus musculus
ccacattattgtttggtttctcaaa

SEQ ID NO: 337432 - DNA, 25 bp, Mus musculus
ccacattcacgtagactgtctcaga

SEQ ID NO: 337433 - DNA, 25 bp, Mus musculus
ccacattcacgttgactgtctcaga

SEQ ID NO: 337434 - DNA, 25 bp, Mus musculus
ccacattctcttcagtcaggtttga

SEQ ID NO: 337435 - DNA, 25 bp, Mus musculus
ccacattctcttgagtcaggtttga

SEQ ID NO: 337436 - DNA, 25 bp, Mus musculus
ccacattctgaccggggctagcctg

SEQ ID NO: 337437 - DNA, 25 bp, Mus musculus
ccacattctgacgggggctagcctg

SEQ ID NO: 337438 - DNA, 25 bp, Mus musculus
ccacattctgggagcttgcatctag

SEQ ID NO: 337439 - DNA, 25 bp, Mus musculus
ccacattctgggtgcttgcatctag

SEQ ID NO: 337440 - DNA, 25 bp, Mus musculus
ccacattcttatcccgctgtctgat

SEQ ID NO: 337441 - DNA, 25 bp, Mus musculus
ccacattcttatgccgctgtctgat

SEQ ID NO: 337442 - DNA, 25 bp, Mus musculus
ccacattgcattctagggttgactt

SEQ ID NO: 337443 - DNA, 25 bp, Mus musculus
ccacattgcattgtagggttgactt

SEQ ID NO: 337444 - DNA, 25 bp, Mus musculus
ccacattggtctatggattcttcat

SEQ ID NO: 337445 - DNA, 25 bp, Mus musculus
ccacattggtctttggattcttcat

SEQ ID NO: 337446 - DNA, 25 bp, Mus musculus
ccacattgtgttaggattctgaaga

SEQ ID NO: 337447 - DNA, 25 bp, Mus musculus
ccacattgtgtttggattctgaaga

SEQ ID NO: 337448 - DNA, 25 bp, Mus musculus
ccacattgttaactgtaggagctga

SEQ ID NO: 337449 - DNA, 25 bp, Mus musculus
ccacattgttaagtgtaggagctga

SEQ ID NO: 337450 - DNA, 25 bp, Mus musculus
ccacatttctatacacactcagctc

SEQ ID NO: 337451 - DNA, 25 bp, Mus musculus
ccacatttctattcacactcagctc

SEQ ID NO: 337452 - DNA, 25 bp, Mus musculus
ccacatttctccatggcgtgtcttc

SEQ ID NO: 337453 - DNA, 25 bp, Mus musculus
ccacatttctccttggcgtgtcttc

SEQ ID NO: 337454 - DNA, 25 bp, Mus musculus
ccacatttgactcaattgagctgtc

SEQ ID NO: 337455 - DNA, 25 bp, Mus musculus
ccacatttgactgaattgagctgtc

SEQ ID NO: 337456 - DNA, 25 bp, Mus musculus
ccacatttgtttagccgatttgcac

SEQ ID NO: 337457 - DNA, 25 bp, Mus musculus
ccacatttgttttgccgatttgcac

SEQ ID NO: 337458 - DNA, 25 bp, Mus musculus
ccacattttctaaaaaaggctgtat

SEQ ID NO: 337459 - DNA, 25 bp, Mus musculus
ccacattttctataaaaggctgtat

SEQ ID NO: 337460 - DNA, 25 bp, Mus musculus
ccacattttggcctatcagaagcag

SEQ ID NO: 337461 - DNA, 25 bp, Mus musculus
ccacattttggcgtatcagaagcag

SEQ ID NO: 337462 - DNA, 25 bp, Mus musculus
ccacatttttacatttgcacgcatc

SEQ ID NO: 337463 - DNA, 25 bp, Mus musculus
ccacatttttacttttgcacgcatc

SEQ ID NO: 337464 - DNA, 25 bp, Mus musculus
ccaccaaaagtcaccagcccatttc

SEQ ID NO: 337465 - DNA, 25 bp, Mus musculus
ccaccaaaagtctccagcccatttc

SEQ ID NO: 337466 - DNA, 25 bp, Mus musculus
ccaccaaacctaatgaccttttcat

SEQ ID NO: 337467 - DNA, 25 bp, Mus musculus
ccaccaaacctattgaccttttcat

SEQ ID NO: 337468 - DNA, 25 bp, Mus musculus
ccaccaaagagaaatctggctaata

SEQ ID NO: 337469 - DNA, 25 bp, Mus musculus
ccaccaaagagatatctggctaata

SEQ ID NO: 337470 - DNA, 25 bp, Mus musculus
ccaccaacaaccaccaagattaaca

SEQ ID NO: 337471 - DNA, 25 bp, Mus musculus
ccaccaacaacctccaagattaaca

SEQ ID NO: 337472 - DNA, 25 bp, Mus musculus
ccaccaacagggaggtggccctcat

SEQ ID NO: 337473 - DNA, 25 bp, Mus musculus
ccaccaacagggtggtggccctcat

SEQ ID NO: 337474 - DNA, 25 bp, Mus musculus
ccaccaacatccacgtcggaagatg

SEQ ID NO: 337475 - DNA, 25 bp, Mus musculus
ccaccaacatcctcgtcggaagatg

SEQ ID NO: 337476 - DNA, 25 bp, Mus musculus
ccaccaacgggtcgaattccttcat

SEQ ID NO: 337477 - DNA, 25 bp, Mus musculus
ccaccaacgggtggaattccttcat

SEQ ID NO: 337478 - DNA, 25 bp, Mus musculus
ccaccaactcctattcttatacatt

SEQ ID NO: 337479 - DNA, 25 bp, Mus musculus
ccaccaactccttttcttatacatt

SEQ ID NO: 337480 - DNA, 25 bp, Mus musculus
ccaccaactggccatagctcatttt

SEQ ID NO: 337481 - DNA, 25 bp, Mus musculus
ccaccaactggcgatagctcatttt

SEQ ID NO: 337482 - DNA, 25 bp, Mus musculus
ccaccaacttttatctctcatatag

SEQ ID NO: 337483 - DNA, 25 bp, Mus musculus
ccaccaacttttttctctcatatag

SEQ ID NO: 337484 - DNA, 25 bp, Mus musculus
ccaccaagatgaccagagccctggc

SEQ ID NO: 337485 - DNA, 25 bp, Mus musculus
ccaccaagatgagcagagccctggc

SEQ ID NO: 337486 - DNA, 25 bp, Mus musculus
ccaccaagcctgatgctgtgttcaa

SEQ ID NO: 337487 - DNA, 25 bp, Mus musculus
ccaccaagcctgatgttcagtctct

SEQ ID NO: 337488 - DNA, 25 bp, Mus musculus
ccaccaagcctgttgctgtgttcaa

SEQ ID NO: 337489 - DNA, 25 bp, Mus musculus
ccaccaagcctgttgttcagtctct

SEQ ID NO: 337490 - DNA, 25 bp, Mus musculus
ccaccaaggcatccgttgaacaaac

SEQ ID NO: 337491 - DNA, 25 bp, Mus musculus
ccaccaaggcatgcgttgaacaaac

SEQ ID NO: 337492 - DNA, 25 bp, Mus musculus
ccaccaagggtgaactcggacattg

SEQ ID NO: 337493 - DNA, 25 bp, Mus musculus
ccaccaagggtgtactcggacattg

SEQ ID NO: 337494 - DNA, 25 bp, Mus musculus
ccaccaagtctgacaccatagtttt

SEQ ID NO: 337495 - DNA, 25 bp, Mus musculus
ccaccaagtctgtcaccatagtttt

SEQ ID NO: 337496 - DNA, 25 bp, Mus musculus
ccaccaatcaggagggccctgtctg

SEQ ID NO: 337497 - DNA, 25 bp, Mus musculus
ccaccaatcaggtgggccctgtctg

SEQ ID NO: 337498 - DNA, 25 bp, Mus musculus
ccaccaattactaatgtttctctcc

SEQ ID NO: 337499 - DNA, 25 bp, Mus musculus
ccaccaattacttatgtttctctcc

SEQ ID NO: 337500 - DNA, 25 bp, Mus musculus
ccaccaattgttcttgtctccacag

SEQ ID NO: 337501 - DNA, 25 bp, Mus musculus
ccaccaattgttgttgtctccacag

SEQ ID NO: 337502 - DNA, 25 bp, Mus musculus
ccaccaattttaccgtttttgtgat

SEQ ID NO: 337503 - DNA, 25 bp, Mus musculus
ccaccaattttagcgtttttgtgat

SEQ ID NO: 337504 - DNA, 25 bp, Mus musculus
ccaccacacatacgaggagagcaaa

SEQ ID NO: 337505 - DNA, 25 bp, Mus musculus
ccaccacacataggaggagagcaaa

SEQ ID NO: 337506 - DNA, 25 bp, Mus musculus
ccaccacacctaatggtgaagagta

SEQ ID NO: 337507 - DNA, 25 bp, Mus musculus
ccaccacacctattggtgaagagta

SEQ ID NO: 337508 - DNA, 25 bp, Mus musculus
ccaccacagactcagttcctgtgag

SEQ ID NO: 337509 - DNA, 25 bp, Mus musculus
ccaccacagactgagttcctgtgag

SEQ ID NO: 337510 - DNA, 25 bp, Mus musculus
ccaccacagcagacttactagcatt

SEQ ID NO: 337511 - DNA, 25 bp, Mus musculus
ccaccacagcagtcttactagcatt

SEQ ID NO: 337512 - DNA, 25 bp, Mus musculus
ccaccacaggctccgggctagaaaa

SEQ ID NO: 337513 - DNA, 25 bp, Mus musculus
ccaccacaggctgcgggctagaaaa

SEQ ID NO: 337514 - DNA, 25 bp, Mus musculus
ccaccacagtcactaggcgggtaaa

SEQ ID NO: 337515 - DNA, 25 bp, Mus musculus
ccaccacagtcagtaggcgggtaaa

SEQ ID NO: 337516 - DNA, 25 bp, Mus musculus
ccaccaccatcacagtactattgag

SEQ ID NO: 337517 - DNA, 25 bp, Mus musculus
ccaccaccatcaccatgtcagttcc

SEQ ID NO: 337518 - DNA, 25 bp, Mus musculus
ccaccaccatcagagtactattgag

SEQ ID NO: 337519 - DNA, 25 bp, Mus musculus
ccaccaccatcagcatgtcagttcc

SEQ ID NO: 337520 - DNA, 25 bp, Mus musculus
ccaccaccatcgatttgttttgtag

SEQ ID NO: 337521 - DNA, 25 bp, Mus musculus
ccaccaccatcgttttgttttgtag

SEQ ID NO: 337522 - DNA, 25 bp, Mus musculus
ccaccaccgcttaggttctgctggg

SEQ ID NO: 337523 - DNA, 25 bp, Mus musculus
ccaccaccgcttcctaggattataa

SEQ ID NO: 337524 - DNA, 25 bp, Mus musculus
ccaccaccgcttgctaggattataa

SEQ ID NO: 337525 - DNA, 25 bp, Mus musculus
ccaccaccgctttggttctgctggg

SEQ ID NO: 337526 - DNA, 25 bp, Mus musculus
ccaccaccgttgacttaacttggat

SEQ ID NO: 337527 - DNA, 25 bp, Mus musculus
ccaccaccgttgtcttaacttggat

SEQ ID NO: 337528 - DNA, 25 bp, Mus musculus
ccaccacctagtcattttgatgtgt

SEQ ID NO: 337529 - DNA, 25 bp, Mus musculus
ccaccacctagtgattttgatgtgt

SEQ ID NO: 337530 - DNA, 25 bp, Mus musculus
ccaccaccttacagtccttaaagag

SEQ ID NO: 337531 - DNA, 25 bp, Mus musculus
ccaccaccttactgtccttaaagag

SEQ ID NO: 337532 - DNA, 25 bp, Mus musculus
ccaccaccttatcagttctgtaact

SEQ ID NO: 337533 - DNA, 25 bp, Mus musculus
ccaccaccttatgagttctgtaact

SEQ ID NO: 337534 - DNA, 25 bp, Mus musculus
ccaccaccttccagtttgaagagta

SEQ ID NO: 337535 - DNA, 25 bp, Mus musculus
ccaccaccttcctgtttgaagagta

SEQ ID NO: 337536 - DNA, 25 bp, Mus musculus
ccaccacgagaaaccgtgtgatttt

SEQ ID NO: 337537 - DNA, 25 bp, Mus musculus
ccaccacgagaatccgtgtgatttt

SEQ ID NO: 337538 - DNA, 25 bp, Mus musculus
ccaccactgaccagtgattatattg

SEQ ID NO: 337539 - DNA, 25 bp, Mus musculus
ccaccactgacctgtgattatattg

SEQ ID NO: 337540 - DNA, 25 bp, Mus musculus
ccaccactgtaaccagctctgttaa

SEQ ID NO: 337541 - DNA, 25 bp, Mus musculus
ccaccactgtaagcagctctgttaa

SEQ ID NO: 337542 - DNA, 25 bp, Mus musculus
ccaccacttcagattctgtgcatat

SEQ ID NO: 337543 - DNA, 25 bp, Mus musculus
ccaccacttcagtttctgtgcatat

SEQ ID NO: 337544 - DNA, 25 bp, Mus musculus
ccaccacttcatcctggtacttgaa

SEQ ID NO: 337545 - DNA, 25 bp, Mus musculus
ccaccacttcatgctggtacttgaa

SEQ ID NO: 337546 - DNA, 25 bp, Mus musculus
ccaccagaccagcagagctattttt

SEQ ID NO: 337547 - DNA, 25 bp, Mus musculus
ccaccagaccaggagagctattttt

SEQ ID NO: 337548 - DNA, 25 bp, Mus musculus
ccaccagagccccagaacccggcgg

SEQ ID NO: 337549 - DNA, 25 bp, Mus musculus
ccaccagagcccgagaacccggcgg

SEQ ID NO: 337550 - DNA, 25 bp, Mus musculus
ccaccagataccagacacatttgta

SEQ ID NO: 337551 - DNA, 25 bp, Mus musculus
ccaccagatacctgacacatttgta

SEQ ID NO: 337552 - DNA, 25 bp, Mus musculus
ccaccagatccacctttatgaagca

SEQ ID NO: 337553 - DNA, 25 bp, Mus musculus
ccaccagatccagctttatgaagca

SEQ ID NO: 337554 - DNA, 25 bp, Mus musculus
ccaccagattatattgagcctcact

SEQ ID NO: 337555 - DNA, 25 bp, Mus musculus
ccaccagattattttgagcctcact

SEQ ID NO: 337556 - DNA, 25 bp, Mus musculus
ccaccagccagcaaacggttatttt

SEQ ID NO: 337557 - DNA, 25 bp, Mus musculus
ccaccagccagctaacggttatttt

SEQ ID NO: 337558 - DNA, 25 bp, Mus musculus
ccaccagctctacatctgacaggag

SEQ ID NO: 337559 - DNA, 25 bp, Mus musculus
ccaccagctctagatctgacaggag

SEQ ID NO: 337560 - DNA, 25 bp, Mus musculus
ccaccagctcttcgatctgattgaa

SEQ ID NO: 337561 - DNA, 25 bp, Mus musculus
ccaccagctcttggatctgattgaa

SEQ ID NO: 337562 - DNA, 25 bp, Mus musculus
ccaccagcttgaataacagggagtg

SEQ ID NO: 337563 - DNA, 25 bp, Mus musculus
ccaccagcttgaccttagacttctg

SEQ ID NO: 337564 - DNA, 25 bp, Mus musculus
ccaccagcttgagcttagacttctg

SEQ ID NO: 337565 - DNA, 25 bp, Mus musculus
ccaccagcttgattaacagggagtg

SEQ ID NO: 337566 - DNA, 25 bp, Mus musculus
ccaccagcttgcataatgatctagc

SEQ ID NO: 337567 - DNA, 25 bp, Mus musculus
ccaccagcttgcttaatgatctagc

SEQ ID NO: 337568 - DNA, 25 bp, Mus musculus
ccaccaggaactagcctccgatggg

SEQ ID NO: 337569 - DNA, 25 bp, Mus musculus
ccaccaggaacttgcctccgatggg

SEQ ID NO: 337570 - DNA, 25 bp, Mus musculus
ccaccagggctgaaaatatgactca

SEQ ID NO: 337571 - DNA, 25 bp, Mus musculus
ccaccagggctgtaaatatgactca

SEQ ID NO: 337572 - DNA, 25 bp, Mus musculus
ccaccagggtcgagcaggtagtgaa

SEQ ID NO: 337573 - DNA, 25 bp, Mus musculus
ccaccagggtcgtgcaggtagtgaa

SEQ ID NO: 337574 - DNA, 25 bp, Mus musculus
ccaccaggtggtcagccggattata

SEQ ID NO: 337575 - DNA, 25 bp, Mus musculus
ccaccaggtggtgagccggattata

SEQ ID NO: 337576 - DNA, 25 bp, Mus musculus
ccaccagtccagcacgtgcgataat

SEQ ID NO: 337577 - DNA, 25 bp, Mus musculus
ccaccagtccaggacgtgcgataat

SEQ ID NO: 337578 - DNA, 25 bp, Mus musculus
ccaccagtgatacatatgggaacta

SEQ ID NO: 337579 - DNA, 25 bp, Mus musculus
ccaccagtgatagatatgggaacta

SEQ ID NO: 337580 - DNA, 25 bp, Mus musculus
ccaccagtgtttagcctatttgaaa

SEQ ID NO: 337581 - DNA, 25 bp, Mus musculus
ccaccagtgttttgcctatttgaaa

SEQ ID NO: 337582 - DNA, 25 bp, Mus musculus
ccaccataacagaccagattcggct

SEQ ID NO: 337583 - DNA, 25 bp, Mus musculus
ccaccataacagtccagattcggct

SEQ ID NO: 337584 - DNA, 25 bp, Mus musculus
ccaccataaggcagttaagggagaa

SEQ ID NO: 337585 - DNA, 25 bp, Mus musculus
ccaccataaggctgttaagggagaa

SEQ ID NO: 337586 - DNA, 25 bp, Mus musculus
ccaccataccctactacattatatt

SEQ ID NO: 337587 - DNA, 25 bp, Mus musculus
ccaccatacccttctacattatatt

SEQ ID NO: 337588 - DNA, 25 bp, Mus musculus
ccaccatatggtattgttcagttaa

SEQ ID NO: 337589 - DNA, 25 bp, Mus musculus
ccaccatatggttttgttcagttaa

SEQ ID NO: 337590 - DNA, 25 bp, Mus musculus
ccaccatcacccagtattacttgta

SEQ ID NO: 337591 - DNA, 25 bp, Mus musculus
ccaccatcaccctgtattacttgta

SEQ ID NO: 337592 - DNA, 25 bp, Mus musculus
ccaccatcataaattcttttccatc

SEQ ID NO: 337593 - DNA, 25 bp, Mus musculus
ccaccatcataatttcttttccatc

SEQ ID NO: 337594 - DNA, 25 bp, Mus musculus
ccaccatcccaaatttattcctgaa

SEQ ID NO: 337595 - DNA, 25 bp, Mus musculus
ccaccatcccaattttattcctgaa

SEQ ID NO: 337596 - DNA, 25 bp, Mus musculus
ccaccatctgatcgccaggaagatt

SEQ ID NO: 337597 - DNA, 25 bp, Mus musculus
ccaccatctgatggccaggaagatt

SEQ ID NO: 337598 - DNA, 25 bp, Mus musculus
ccaccatctgtaatttccttggcac

SEQ ID NO: 337599 - DNA, 25 bp, Mus musculus
ccaccatctgtattttccttggcac

SEQ ID NO: 337600 - DNA, 25 bp, Mus musculus
ccaccatgagagacgtctgagcaga

SEQ ID NO: 337601 - DNA, 25 bp, Mus musculus
ccaccatgagagtcgtctgagcaga

SEQ ID NO: 337602 - DNA, 25 bp, Mus musculus
ccaccatgatggcagcatgtgacag

SEQ ID NO: 337603 - DNA, 25 bp, Mus musculus
ccaccatgatgggagcatgtgacag

SEQ ID NO: 337604 - DNA, 25 bp, Mus musculus
ccaccatgcaggcagtcttcaagag

SEQ ID NO: 337605 - DNA, 25 bp, Mus musculus
ccaccatgcagggagtcttcaagag

SEQ ID NO: 337606 - DNA, 25 bp, Mus musculus
ccaccatgcggcaccgaggagggca

SEQ ID NO: 337607 - DNA, 25 bp, Mus musculus
ccaccatgcggctccgaggagggca

SEQ ID NO: 337608 - DNA, 25 bp, Mus musculus
ccaccatggcacaggtgctatggcg

SEQ ID NO: 337609 - DNA, 25 bp, Mus musculus
ccaccatggcactggtgctatggcg

SEQ ID NO: 337610 - DNA, 25 bp, Mus musculus
ccaccatggcagcattaaaatttta

SEQ ID NO: 337611 - DNA, 25 bp, Mus musculus
ccaccatggcaggattaaaatttta

SEQ ID NO: 337612 - DNA, 25 bp, Mus musculus
ccaccatggtcgagcagcgagagga

SEQ ID NO: 337613 - DNA, 25 bp, Mus musculus
ccaccatggtcgtgcagcgagagga

SEQ ID NO: 337614 - DNA, 25 bp, Mus musculus
ccaccatgttggactggtcccagga

SEQ ID NO: 337615 - DNA, 25 bp, Mus musculus
ccaccatgttggtctggtcccagga

SEQ ID NO: 337616 - DNA, 25 bp, Mus musculus
ccaccattgagcatggtttttcctc

SEQ ID NO: 337617 - DNA, 25 bp, Mus musculus
ccaccattgagcttggtttttcctc

SEQ ID NO: 337618 - DNA, 25 bp, Mus musculus
ccaccattgaggatgaagacgtgaa

SEQ ID NO: 337619 - DNA, 25 bp, Mus musculus
ccaccattgaggttgaagacgtgaa

SEQ ID NO: 337620 - DNA, 25 bp, Mus musculus
ccaccattgcatcaaaaacggtatt

SEQ ID NO: 337621 - DNA, 25 bp, Mus musculus
ccaccattgcatgaaaaacggtatt

SEQ ID NO: 337622 - DNA, 25 bp, Mus musculus
ccaccattgtatacaggtttccctg

SEQ ID NO: 337623 - DNA, 25 bp, Mus musculus
ccaccattgtattcaggtttccctg

SEQ ID NO: 337624 - DNA, 25 bp, Mus musculus
ccaccatttggcatcttttgtgtgt

SEQ ID NO: 337625 - DNA, 25 bp, Mus musculus
ccaccatttggcttcttttgtgtgt

SEQ ID NO: 337626 - DNA, 25 bp, Mus musculus
ccacccaaacacattttctgtaaat

SEQ ID NO: 337627 - DNA, 25 bp, Mus musculus
ccacccaaacactttttctgtaaat

SEQ ID NO: 337628 - DNA, 25 bp, Mus musculus
ccacccaaacatctagtccttgtgt

SEQ ID NO: 337629 - DNA, 25 bp, Mus musculus
ccacccaaacatgtagtccttgtgt

SEQ ID NO: 337630 - DNA, 25 bp, Mus musculus
ccacccaaagtgcacagagtcaggt

SEQ ID NO: 337631 - DNA, 25 bp, Mus musculus
ccacccaaagtggacagagtcaggt

SEQ ID NO: 337632 - DNA, 25 bp, Mus musculus
ccacccaagacaaggcttacgtact

SEQ ID NO: 337633 - DNA, 25 bp, Mus musculus
ccacccaagacatggcttacgtact

SEQ ID NO: 337634 - DNA, 25 bp, Mus musculus
ccacccaaggtgaaggcatgacatc

SEQ ID NO: 337635 - DNA, 25 bp, Mus musculus
ccacccaaggtgtaggcatgacatc

SEQ ID NO: 337636 - DNA, 25 bp, Mus musculus
ccacccacacgtaatccattgtgaa

SEQ ID NO: 337637 - DNA, 25 bp, Mus musculus
ccacccacacgttatccattgtgaa

SEQ ID NO: 337638 - DNA, 25 bp, Mus musculus
ccacccacatttccatagatacaga

SEQ ID NO: 337639 - DNA, 25 bp, Mus musculus
ccacccacatttgcatagatacaga

SEQ ID NO: 337640 - DNA, 25 bp, Mus musculus
ccacccaccggacatggagacagga

SEQ ID NO: 337641 - DNA, 25 bp, Mus musculus
ccacccaccggagatggagacagga

SEQ ID NO: 337642 - DNA, 25 bp, Mus musculus
ccacccacctatcatgttaaatcga

SEQ ID NO: 337643 - DNA, 25 bp, Mus musculus
ccacccacctatgatgttaaatcga

SEQ ID NO: 337644 - DNA, 25 bp, Mus musculus
ccacccactcgcaagaagttcaata

SEQ ID NO: 337645 - DNA, 25 bp, Mus musculus
ccacccactcgctagaagttcaata

SEQ ID NO: 337646 - DNA, 25 bp, Mus musculus
ccacccactgctctggatttgaacg

SEQ ID NO: 337647 - DNA, 25 bp, Mus musculus
ccacccactgctgtggatttgaacg

SEQ ID NO: 337648 - DNA, 25 bp, Mus musculus
ccacccagatggaggcccagggaaa

SEQ ID NO: 337649 - DNA, 25 bp, Mus musculus
ccacccagatggtggcccagggaaa

SEQ ID NO: 337650 - DNA, 25 bp, Mus musculus
ccacccatgctactcttttttctta

SEQ ID NO: 337651 - DNA, 25 bp, Mus musculus
ccacccatgctagtcttttttctta

SEQ ID NO: 337652 - DNA, 25 bp, Mus musculus
ccacccatggtgatgtgtgtcttca

SEQ ID NO: 337653 - DNA, 25 bp, Mus musculus
ccacccatggtgttgtgtgtcttca

SEQ ID NO: 337654 - DNA, 25 bp, Mus musculus
ccaccccaatatcgaaacaatgaac

SEQ ID NO: 337655 - DNA, 25 bp, Mus musculus
ccaccccaatatggaaacaatgaac

SEQ ID NO: 337656 - DNA, 25 bp, Mus musculus
ccaccccaattaaatctctcatatg

SEQ ID NO: 337657 - DNA, 25 bp, Mus musculus
ccaccccaattatatctctcatatg

SEQ ID NO: 337658 - DNA, 25 bp, Mus musculus
ccaccccacagaccctatatttaaa

SEQ ID NO: 337659 - DNA, 25 bp, Mus musculus
ccaccccacagagcctatatttaaa

SEQ ID NO: 337660 - DNA, 25 bp, Mus musculus
ccaccccacagcatgtgtgttggtt

SEQ ID NO: 337661 - DNA, 25 bp, Mus musculus
ccaccccacagcttgtgtgttggtt

SEQ ID NO: 337662 - DNA, 25 bp, Mus musculus
ccaccccaccttaaatagttctgtg

SEQ ID NO: 337663 - DNA, 25 bp, Mus musculus
ccaccccacctttaatagttctgtg

SEQ ID NO: 337664 - DNA, 25 bp, Mus musculus
ccaccccacttaaatactctggaat

SEQ ID NO: 337665 - DNA, 25 bp, Mus musculus
ccaccccacttatatactctggaat

SEQ ID NO: 337666 - DNA, 25 bp, Mus musculus
ccaccccactttatgacgaagaatg

SEQ ID NO: 337667 - DNA, 25 bp, Mus musculus
ccaccccactttttgacgaagaatg

SEQ ID NO: 337668 - DNA, 25 bp, Mus musculus
ccaccccagaggattgatggccatg

SEQ ID NO: 337669 - DNA, 25 bp, Mus musculus
ccaccccagaggtttgatggccatg

SEQ ID NO: 337670 - DNA, 25 bp, Mus musculus
ccaccccagatcactaagttctaat

SEQ ID NO: 337671 - DNA, 25 bp, Mus musculus
ccaccccagatctctaagttctaat

SEQ ID NO: 337672 - DNA, 25 bp, Mus musculus
ccaccccagcttatttacatgaatt

SEQ ID NO: 337673 - DNA, 25 bp, Mus musculus
ccaccccagcttttttacatgaatt

SEQ ID NO: 337674 - DNA, 25 bp, Mus musculus
ccaccccaggccagttagaatagaa

SEQ ID NO: 337675 - DNA, 25 bp, Mus musculus
ccaccccaggcctgttagaatagaa

SEQ ID NO: 337676 - DNA, 25 bp, Mus musculus
ccaccccaggtgaggtcagcataga

SEQ ID NO: 337677 - DNA, 25 bp, Mus musculus
ccaccccaggtgtggtcagcataga

SEQ ID NO: 337678 - DNA, 25 bp, Mus musculus
ccaccccatcaaagttctttagtta

SEQ ID NO: 337679 - DNA, 25 bp, Mus musculus
ccaccccatcaatgttctttagtta

SEQ ID NO: 337680 - DNA, 25 bp, Mus musculus
ccaccccatgtgagtcattatttca

SEQ ID NO: 337681 - DNA, 25 bp, Mus musculus
ccaccccatgtgtgtcattatttca

SEQ ID NO: 337682 - DNA, 25 bp, Mus musculus
ccaccccgaaccatgaagaacagat

SEQ ID NO: 337683 - DNA, 25 bp, Mus musculus
ccaccccgaaccttgaagaacagat

SEQ ID NO: 337684 - DNA, 25 bp, Mus musculus
ccaccccggaaaccactgtgaaatt

SEQ ID NO: 337685 - DNA, 25 bp, Mus musculus
ccaccccggaaagcactgtgaaatt

SEQ ID NO: 337686 - DNA, 25 bp, Mus musculus
ccaccccgttctattagcaaatgca

SEQ ID NO: 337687 - DNA, 25 bp, Mus musculus
ccaccccgttcttttagcaaatgca

SEQ ID NO: 337688 - DNA, 25 bp, Mus musculus
ccacccctaaagcaagacatagaag

SEQ ID NO: 337689 - DNA, 25 bp, Mus musculus
ccacccctaaaggaagacatagaag

SEQ ID NO: 337690 - DNA, 25 bp, Mus musculus
ccacccctagttaattttgtgtgtg

SEQ ID NO: 337691 - DNA, 25 bp, Mus musculus
ccacccctagtttattttgtgtgtg

SEQ ID NO: 337692 - DNA, 25 bp, Mus musculus
ccacccctatttacagatcacagag

SEQ ID NO: 337693 - DNA, 25 bp, Mus musculus
ccacccctattttcagatcacagag

SEQ ID NO: 337694 - DNA, 25 bp, Mus musculus
ccacccctcattcgcgagatgtatg

SEQ ID NO: 337695 - DNA, 25 bp, Mus musculus
ccacccctcattggcgagatgtatg

SEQ ID NO: 337696 - DNA, 25 bp, Mus musculus
ccacccctctagagtatgatgctaa

SEQ ID NO: 337697 - DNA, 25 bp, Mus musculus
ccacccctctagtgtatgatgctaa

SEQ ID NO: 337698 - DNA, 25 bp, Mus musculus
ccacccctggttagtttgttgactg

SEQ ID NO: 337699 - DNA, 25 bp, Mus musculus
ccacccctggtttgtttgttgactg

SEQ ID NO: 337700 - DNA, 25 bp, Mus musculus
ccaccccttaacatttctgtaatca

SEQ ID NO: 337701 - DNA, 25 bp, Mus musculus
ccaccccttaacttttctgtaatca

SEQ ID NO: 337702 - DNA, 25 bp, Mus musculus
ccacccgagtgcagagatgaatgct

SEQ ID NO: 337703 - DNA, 25 bp, Mus musculus
ccacccgagtgctgagatgaatgct

SEQ ID NO: 337704 - DNA, 25 bp, Mus musculus
ccacccgctgaactgggcttttcag

SEQ ID NO: 337705 - DNA, 25 bp, Mus musculus
ccacccgctgaagtgggcttttcag

SEQ ID NO: 337706 - DNA, 25 bp, Mus musculus
ccacccggcacacaggaagtgagtt

SEQ ID NO: 337707 - DNA, 25 bp, Mus musculus
ccacccggcacagaggaagtgagtt

SEQ ID NO: 337708 - DNA, 25 bp, Mus musculus
ccacccggtctgacgatttggcttg

SEQ ID NO: 337709 - DNA, 25 bp, Mus musculus
ccacccggtctgtcgatttggcttg

SEQ ID NO: 337710 - DNA, 25 bp, Mus musculus
ccacccgtgaaacatcctgtacttt

SEQ ID NO: 337711 - DNA, 25 bp, Mus musculus
ccacccgtgaaagatcctgtacttt

SEQ ID NO: 337712 - DNA, 25 bp, Mus musculus
ccacccgttgtaccctttggctgta

SEQ ID NO: 337713 - DNA, 25 bp, Mus musculus
ccacccgttgtagcctttggctgta

SEQ ID NO: 337714 - DNA, 25 bp, Mus musculus
ccaccctacgctaatgcggtattaa

SEQ ID NO: 337715 - DNA, 25 bp, Mus musculus
ccaccctacgcttatgcggtattaa

SEQ ID NO: 337716 - DNA, 25 bp, Mus musculus
ccaccctagatcacgcatggttggt

SEQ ID NO: 337717 - DNA, 25 bp, Mus musculus
ccaccctagatctcgcatggttggt

SEQ ID NO: 337718 - DNA, 25 bp, Mus musculus
ccaccctatgttatcttgttctgaa

SEQ ID NO: 337719 - DNA, 25 bp, Mus musculus
ccaccctatgttttcttgttctgaa

SEQ ID NO: 337720 - DNA, 25 bp, Mus musculus
ccaccctcaggactaagtcgtatag

SEQ ID NO: 337721 - DNA, 25 bp, Mus musculus
ccaccctcaggagtaagtcgtatag

SEQ ID NO: 337722 - DNA, 25 bp, Mus musculus
ccaccctcaggccatatggtgaata

SEQ ID NO: 337723 - DNA, 25 bp, Mus musculus
ccaccctcaggcgatatggtgaata

SEQ ID NO: 337724 - DNA, 25 bp, Mus musculus
ccaccctcctgtcttcaagtaggtt

SEQ ID NO: 337725 - DNA, 25 bp, Mus musculus
ccaccctcctgtgttcaagtaggtt

SEQ ID NO: 337726 - DNA, 25 bp, Mus musculus
ccaccctcgatgatttgtacatttc

SEQ ID NO: 337727 - DNA, 25 bp, Mus musculus
ccaccctcgatgttttgtacatttc

SEQ ID NO: 337728 - DNA, 25 bp, Mus musculus
ccaccctctatgattttgtagagca

SEQ ID NO: 337729 - DNA, 25 bp, Mus musculus
ccaccctctatgtttttgtagagca

SEQ ID NO: 337730 - DNA, 25 bp, Mus musculus
ccaccctgaagactgcctggagtta

SEQ ID NO: 337731 - DNA, 25 bp, Mus musculus
ccaccctgaagagtgcctggagtta

SEQ ID NO: 337732 - DNA, 25 bp, Mus musculus
ccaccctgaagtcatattgtattgt

SEQ ID NO: 337733 - DNA, 25 bp, Mus musculus
ccaccctgaagtgatattgtattgt

SEQ ID NO: 337734 - DNA, 25 bp, Mus musculus
ccaccctgacctagttgcaagaatt

SEQ ID NO: 337735 - DNA, 25 bp, Mus musculus
ccaccctgaccttgttgcaagaatt

SEQ ID NO: 337736 - DNA, 25 bp, Mus musculus
ccaccctgagctctgtattgagact

SEQ ID NO: 337737 - DNA, 25 bp, Mus musculus
ccaccctgagctgtgtattgagact

SEQ ID NO: 337738 - DNA, 25 bp, Mus musculus
ccaccctgaggacctatgacactta

SEQ ID NO: 337739 - DNA, 25 bp, Mus musculus
ccaccctgaggagctatgacactta

SEQ ID NO: 337740 - DNA, 25 bp, Mus musculus
ccaccctgagggacccagagaaaca

SEQ ID NO: 337741 - DNA, 25 bp, Mus musculus
ccaccctgagggtcccagagaaaca

SEQ ID NO: 337742 - DNA, 25 bp, Mus musculus
ccaccctgcgggacagtgaactgtg

SEQ ID NO: 337743 - DNA, 25 bp, Mus musculus
ccaccctgcgggtcagtgaactgtg

SEQ ID NO: 337744 - DNA, 25 bp, Mus musculus
ccaccctggagaatcactgtaggaa

SEQ ID NO: 337745 - DNA, 25 bp, Mus musculus
ccaccctggagattcactgtaggaa

SEQ ID NO: 337746 - DNA, 25 bp, Mus musculus
ccaccctggcctagagagataataa

SEQ ID NO: 337747 - DNA, 25 bp, Mus musculus
ccaccctggccttgagagataataa

SEQ ID NO: 337748 - DNA, 25 bp, Mus musculus
ccaccctggctgaagttcttttaga

SEQ ID NO: 337749 - DNA, 25 bp, Mus musculus
ccaccctggctgtagttcttttaga

SEQ ID NO: 337750 - DNA, 25 bp, Mus musculus
ccaccctgggctctgtacagggaga

SEQ ID NO: 337751 - DNA, 25 bp, Mus musculus
ccaccctgggctgtgtacagggaga

SEQ ID NO: 337752 - DNA, 25 bp, Mus musculus
ccaccctggttgaagaagctagaca

SEQ ID NO: 337753 - DNA, 25 bp, Mus musculus
ccaccctggttgtagaagctagaca

SEQ ID NO: 337754 - DNA, 25 bp, Mus musculus
ccaccctgtactcgatatgtagagc

SEQ ID NO: 337755 - DNA, 25 bp, Mus musculus
ccaccctgtactggatatgtagagc

SEQ ID NO: 337756 - DNA, 25 bp, Mus musculus
ccaccctgtgtgcagtctgtgagtg

SEQ ID NO: 337757 - DNA, 25 bp, Mus musculus
ccaccctgtgtggagtctgtgagtg

SEQ ID NO: 337758 - DNA, 25 bp, Mus musculus
ccaccctgtttgcacttagtgcctg

SEQ ID NO: 337759 - DNA, 25 bp, Mus musculus
ccaccctgtttggacttagtgcctg

SEQ ID NO: 337760 - DNA, 25 bp, Mus musculus
ccacccttcatcaggtgttgagact

SEQ ID NO: 337761 - DNA, 25 bp, Mus musculus
ccacccttcatctggtgttgagact

SEQ ID NO: 337762 - DNA, 25 bp, Mus musculus
ccacccttgagtatttatgctgagt

SEQ ID NO: 337763 - DNA, 25 bp, Mus musculus
ccacccttgagtttttatgctgagt

SEQ ID NO: 337764 - DNA, 25 bp, Mus musculus
ccacccttgggaacagtcatacaga

SEQ ID NO: 337765 - DNA, 25 bp, Mus musculus
ccacccttgggatcagtcatacaga

SEQ ID NO: 337766 - DNA, 25 bp, Mus musculus
ccacccttgttccacggaatgcaag

SEQ ID NO: 337767 - DNA, 25 bp, Mus musculus
ccacccttgttcgacggaatgcaag

SEQ ID NO: 337768 - DNA, 25 bp, Mus musculus
ccaccctttagtacagggcagagca

SEQ ID NO: 337769 - DNA, 25 bp, Mus musculus
ccaccctttagttcagggcagagca

SEQ ID NO: 337770 - DNA, 25 bp, Mus musculus
ccaccgactgccattcaagagagat

SEQ ID NO: 337771 - DNA, 25 bp, Mus musculus
ccaccgactgcctttcaagagagat

SEQ ID NO: 337772 - DNA, 25 bp, Mus musculus
ccaccgaggacactgtgatgtgaga

SEQ ID NO: 337773 - DNA, 25 bp, Mus musculus
ccaccgaggacagtgtgatgtgaga

SEQ ID NO: 337774 - DNA, 25 bp, Mus musculus
ccaccgaggactaagcttgcatgct

SEQ ID NO: 337775 - DNA, 25 bp, Mus musculus
ccaccgaggacttagcttgcatgct

SEQ ID NO: 337776 - DNA, 25 bp, Mus musculus
ccaccgcatggaagggccttgaagt

SEQ ID NO: 337777 - DNA, 25 bp, Mus musculus
ccaccgcatggatgggccttgaagt

SEQ ID NO: 337778 - DNA, 25 bp, Mus musculus
ccaccgcctggtaaagatgtgattt

SEQ ID NO: 337779 - DNA, 25 bp, Mus musculus
ccaccgcctggttaagatgtgattt

SEQ ID NO: 337780 - DNA, 25 bp, Mus musculus
ccaccgcctgtgcttggttctggga

SEQ ID NO: 337781 - DNA, 25 bp, Mus musculus
ccaccgcctgtggttggttctggga

SEQ ID NO: 337782 - DNA, 25 bp, Mus musculus
ccaccgctgtacattgtgtcctggg

SEQ ID NO: 337783 - DNA, 25 bp, Mus musculus
ccaccgctgtactttgtgtcctggg

SEQ ID NO: 337784 - DNA, 25 bp, Mus musculus
ccaccgcttctgacttgtagttgat

SEQ ID NO: 337785 - DNA, 25 bp, Mus musculus
ccaccgcttctgtcttgtagttgat

SEQ ID NO: 337786 - DNA, 25 bp, Mus musculus
ccaccggaggagatagggtctcaga

SEQ ID NO: 337787 - DNA, 25 bp, Mus musculus
ccaccggaggagttagggtctcaga

SEQ ID NO: 337788 - DNA, 25 bp, Mus musculus
ccaccggccattactatctccagca

SEQ ID NO: 337789 - DNA, 25 bp, Mus musculus
ccaccggccatttctatctccagca

SEQ ID NO: 337790 - DNA, 25 bp, Mus musculus
ccaccggctgcaagtcttggaatat

SEQ ID NO: 337791 - DNA, 25 bp, Mus musculus
ccaccggctgcatgtcttggaatat

SEQ ID NO: 337792 - DNA, 25 bp, Mus musculus
ccaccggtggttccagctgtagaag

SEQ ID NO: 337793 - DNA, 25 bp, Mus musculus
ccaccggtggttgcagctgtagaag

SEQ ID NO: 337794 - DNA, 25 bp, Mus musculus
ccaccgtaaagccactacaattgat

SEQ ID NO: 337795 - DNA, 25 bp, Mus musculus
ccaccgtaaagcgactacaattgat

SEQ ID NO: 337796 - DNA, 25 bp, Mus musculus
ccaccgtagcagagactcgggacta

SEQ ID NO: 337797 - DNA, 25 bp, Mus musculus
ccaccgtagcagtgactcgggacta

SEQ ID NO: 337798 - DNA, 25 bp, Mus musculus
ccaccgtaggataataacacaggcg

SEQ ID NO: 337799 - DNA, 25 bp, Mus musculus
ccaccgtaggattataacacaggcg

SEQ ID NO: 337800 - DNA, 25 bp, Mus musculus
ccaccgtcggctacgaagaggaggt

SEQ ID NO: 337801 - DNA, 25 bp, Mus musculus
ccaccgtcggcttcgaagaggaggt

SEQ ID NO: 337802 - DNA, 25 bp, Mus musculus
ccaccgtctgccatcattattgaaa

SEQ ID NO: 337803 - DNA, 25 bp, Mus musculus
ccaccgtctgccttcattattgaaa

SEQ ID NO: 337804 - DNA, 25 bp, Mus musculus
ccaccgtgggagatgttaatgagaa

SEQ ID NO: 337805 - DNA, 25 bp, Mus musculus
ccaccgtgggagttgttaatgagaa

SEQ ID NO: 337806 - DNA, 25 bp, Mus musculus
ccaccgtgggctagtgcacactaag

SEQ ID NO: 337807 - DNA, 25 bp, Mus musculus
ccaccgtgggcttgtgcacactaag

SEQ ID NO: 337808 - DNA, 25 bp, Mus musculus
ccaccgttaccgctaatacacgtga

SEQ ID NO: 337809 - DNA, 25 bp, Mus musculus
ccaccgttaccggtaatacacgtga

SEQ ID NO: 337810 - DNA, 25 bp, Mus musculus
ccaccgttttctccatatgttgctt

SEQ ID NO: 337811 - DNA, 25 bp, Mus musculus
ccaccgttttctgcatatgttgctt

SEQ ID NO: 337812 - DNA, 25 bp, Mus musculus
ccacctaaatgaatctgatgagttc

SEQ ID NO: 337813 - DNA, 25 bp, Mus musculus
ccacctaaatgattctgatgagttc

SEQ ID NO: 337814 - DNA, 25 bp, Mus musculus
ccacctaaatggaatctgatggagt

SEQ ID NO: 337815 - DNA, 25 bp, Mus musculus
ccacctaaatggtatctgatggagt

SEQ ID NO: 337816 - DNA, 25 bp, Mus musculus
ccacctaagctgatctcatattgtt

SEQ ID NO: 337817 - DNA, 25 bp, Mus musculus
ccacctaagctgttctcatattgtt

SEQ ID NO: 337818 - DNA, 25 bp, Mus musculus
ccacctacaaagacccaacattgat

SEQ ID NO: 337819 - DNA, 25 bp, Mus musculus
ccacctacaaagtcccaacattgat

SEQ ID NO: 337820 - DNA, 25 bp, Mus musculus
ccacctacagatactccattcatga

SEQ ID NO: 337821 - DNA, 25 bp, Mus musculus
ccacctacagatccctatttccgat

SEQ ID NO: 337822 - DNA, 25 bp, Mus musculus
ccacctacagatgcctatttccgat

SEQ ID NO: 337823 - DNA, 25 bp, Mus musculus
ccacctacagattctccattcatga

SEQ ID NO: 337824 - DNA, 25 bp, Mus musculus
ccacctacagctagcctggaagaag

SEQ ID NO: 337825 - DNA, 25 bp, Mus musculus
ccacctacagcttgcctggaagaag

SEQ ID NO: 337826 - DNA, 25 bp, Mus musculus
ccacctacagtcacatcaaagcagg

SEQ ID NO: 337827 - DNA, 25 bp, Mus musculus
ccacctacagtctcatcaaagcagg

SEQ ID NO: 337828 - DNA, 25 bp, Mus musculus
ccacctacagtgcagtattccgaac

SEQ ID NO: 337829 - DNA, 25 bp, Mus musculus
ccacctacagtggagtattccgaac

SEQ ID NO: 337830 - DNA, 25 bp, Mus musculus
ccacctaccagcagttggcttggaa

SEQ ID NO: 337831 - DNA, 25 bp, Mus musculus
ccacctaccagctgttggcttggaa

SEQ ID NO: 337832 - DNA, 25 bp, Mus musculus
ccacctaccctactaatgaatttct

SEQ ID NO: 337833 - DNA, 25 bp, Mus musculus
ccacctaccctagtaatgaatttct

SEQ ID NO: 337834 - DNA, 25 bp, Mus musculus
ccacctaccctcattaactgtaatt

SEQ ID NO: 337835 - DNA, 25 bp, Mus musculus
ccacctaccctctttaactgtaatt

SEQ ID NO: 337836 - DNA, 25 bp, Mus musculus
ccacctacgctcatatattgtcttt

SEQ ID NO: 337837 - DNA, 25 bp, Mus musculus
ccacctacgctcttatattgtcttt

SEQ ID NO: 337838 - DNA, 25 bp, Mus musculus
ccacctactggcagcatatggaatt

SEQ ID NO: 337839 - DNA, 25 bp, Mus musculus
ccacctactggctgcatatggaatt

SEQ ID NO: 337840 - DNA, 25 bp, Mus musculus
ccacctactgtcagttatttgcttt

SEQ ID NO: 337841 - DNA, 25 bp, Mus musculus
ccacctactgtctgttatttgcttt

SEQ ID NO: 337842 - DNA, 25 bp, Mus musculus
ccacctactgttctacacatttctt

SEQ ID NO: 337843 - DNA, 25 bp, Mus musculus
ccacctactgttgtacacatttctt

SEQ ID NO: 337844 - DNA, 25 bp, Mus musculus
ccacctagacttaatgttcttcagt

SEQ ID NO: 337845 - DNA, 25 bp, Mus musculus
ccacctagactttatgttcttcagt

SEQ ID NO: 337846 - DNA, 25 bp, Mus musculus
ccacctagaggtccattgcaactaa

SEQ ID NO: 337847 - DNA, 25 bp, Mus musculus
ccacctagaggtgcattgcaactaa

SEQ ID NO: 337848 - DNA, 25 bp, Mus musculus
ccacctaggaaacaggttgttccag

SEQ ID NO: 337849 - DNA, 25 bp, Mus musculus
ccacctaggaaagaggttgttccag

SEQ ID NO: 337850 - DNA, 25 bp, Mus musculus
ccacctaggcccagtgtcacaataa

SEQ ID NO: 337851 - DNA, 25 bp, Mus musculus
ccacctaggccctgtgtcacaataa

SEQ ID NO: 337852 - DNA, 25 bp, Mus musculus
ccacctatcactcaggacgggatga

SEQ ID NO: 337853 - DNA, 25 bp, Mus musculus
ccacctatcactgaggacgggatga

SEQ ID NO: 337854 - DNA, 25 bp, Mus musculus
ccacctattgtgagatccttgcatt

SEQ ID NO: 337855 - DNA, 25 bp, Mus musculus
ccacctattgtgtgatccttgcatt

SEQ ID NO: 337856 - DNA, 25 bp, Mus musculus
ccacctcaccacacaggaaatgtta

SEQ ID NO: 337857 - DNA, 25 bp, Mus musculus
ccacctcaccactcaggaaatgtta

SEQ ID NO: 337858 - DNA, 25 bp, Mus musculus
ccacctcaccagcatggatttagtt

SEQ ID NO: 337859 - DNA, 25 bp, Mus musculus
ccacctcaccaggatggatttagtt

SEQ ID NO: 337860 - DNA, 25 bp, Mus musculus
ccacctcactgaaactctttaacaa

SEQ ID NO: 337861 - DNA, 25 bp, Mus musculus
ccacctcactgatactctttaacaa

SEQ ID NO: 337862 - DNA, 25 bp, Mus musculus
ccacctcagaggcatttgacagaac

SEQ ID NO: 337863 - DNA, 25 bp, Mus musculus
ccacctcagagggatttgacagaac

SEQ ID NO: 337864 - DNA, 25 bp, Mus musculus
ccacctcagtggacctctggatggt

SEQ ID NO: 337865 - DNA, 25 bp, Mus musculus
ccacctcagtggtcctctggatggt

SEQ ID NO: 337866 - DNA, 25 bp, Mus musculus
ccacctcatcctctgtaaacagaag

SEQ ID NO: 337867 - DNA, 25 bp, Mus musculus
ccacctcatcctgtgtaaacagaag

SEQ ID NO: 337868 - DNA, 25 bp, Mus musculus
ccacctcattccattaggctatgga

SEQ ID NO: 337869 - DNA, 25 bp, Mus musculus
ccacctcattcctttaggctatgga

SEQ ID NO: 337870 - DNA, 25 bp, Mus musculus
ccacctccagagattgtggtgttac

SEQ ID NO: 337871 - DNA, 25 bp, Mus musculus
ccacctccagagtttgtggtgttac

SEQ ID NO: 337872 - DNA, 25 bp, Mus musculus
ccacctccataccaagctgtagtga

SEQ ID NO: 337873 - DNA, 25 bp, Mus musculus
ccacctccatacgaagctgtagtga

SEQ ID NO: 337874 - DNA, 25 bp, Mus musculus
ccacctccatccctagatttttttg

SEQ ID NO: 337875 - DNA, 25 bp, Mus musculus
ccacctccatccgtagatttttttg

SEQ ID NO: 337876 - DNA, 25 bp, Mus musculus
ccacctccatgtatctgggattatt

SEQ ID NO: 337877 - DNA, 25 bp, Mus musculus
ccacctccatgtttctgggattatt

SEQ ID NO: 337878 - DNA, 25 bp, Mus musculus
ccacctcccagaatgctctaatgag

SEQ ID NO: 337879 - DNA, 25 bp, Mus musculus
ccacctcccagattgctctaatgag

SEQ ID NO: 337880 - DNA, 25 bp, Mus musculus
ccacctcccttaatcagcagaaggt

SEQ ID NO: 337881 - DNA, 25 bp, Mus musculus
ccacctcccttattcagcagaaggt

SEQ ID NO: 337882 - DNA, 25 bp, Mus musculus
ccacctcctagcacaaacaaaatgt

SEQ ID NO: 337883 - DNA, 25 bp, Mus musculus
ccacctcctagctcaaacaaaatgt

SEQ ID NO: 337884 - DNA, 25 bp, Mus musculus
ccacctcgagacctttaaaagcctg

SEQ ID NO: 337885 - DNA, 25 bp, Mus musculus
ccacctcgagacgtttaaaagcctg

SEQ ID NO: 337886 - DNA, 25 bp, Mus musculus
ccacctctaagtcagtacatacagt

SEQ ID NO: 337887 - DNA, 25 bp, Mus musculus
ccacctctaagtgagtacatacagt

SEQ ID NO: 337888 - DNA, 25 bp, Mus musculus
ccacctctaattatctgaaccatct

SEQ ID NO: 337889 - DNA, 25 bp, Mus musculus
ccacctctaattttctgaaccatct

SEQ ID NO: 337890 - DNA, 25 bp, Mus musculus
ccacctctagcaatagccttttgag

SEQ ID NO: 337891 - DNA, 25 bp, Mus musculus
ccacctctagcattagccttttgag

SEQ ID NO: 337892 - DNA, 25 bp, Mus musculus
ccacctctagctataccctttaaag

SEQ ID NO: 337893 - DNA, 25 bp, Mus musculus
ccacctctagctttaccctttaaag

SEQ ID NO: 337894 - DNA, 25 bp, Mus musculus
ccacctctcaagaacaatgtgctat

SEQ ID NO: 337895 - DNA, 25 bp, Mus musculus
ccacctctcaagtacaatgtgctat

SEQ ID NO: 337896 - DNA, 25 bp, Mus musculus
ccacctctcctgagctaagattaag

SEQ ID NO: 337897 - DNA, 25 bp, Mus musculus
ccacctctcctgtgctaagattaag

SEQ ID NO: 337898 - DNA, 25 bp, Mus musculus
ccacctctcttccattacataagga

SEQ ID NO: 337899 - DNA, 25 bp, Mus musculus
ccacctctcttcgattacataagga

SEQ ID NO: 337900 - DNA, 25 bp, Mus musculus
ccacctctgctcctgtttgattttt

SEQ ID NO: 337901 - DNA, 25 bp, Mus musculus
ccacctctgctcgtgtttgattttt

SEQ ID NO: 337902 - DNA, 25 bp, Mus musculus
ccacctctgcttcttctcaaaaaga

SEQ ID NO: 337903 - DNA, 25 bp, Mus musculus
ccacctctgcttgttctcaaaaaga

SEQ ID NO: 337904 - DNA, 25 bp, Mus musculus
ccacctctggacataaggattcctt

SEQ ID NO: 337905 - DNA, 25 bp, Mus musculus
ccacctctggacttaaggattcctt

SEQ ID NO: 337906 - DNA, 25 bp, Mus musculus
ccacctctgggcagctaggacggca

SEQ ID NO: 337907 - DNA, 25 bp, Mus musculus
ccacctctgggctgctaggacggca

SEQ ID NO: 337908 - DNA, 25 bp, Mus musculus
ccacctctggtgaagggagaacata

SEQ ID NO: 337909 - DNA, 25 bp, Mus musculus
ccacctctggtgtagggagaacata

SEQ ID NO: 337910 - DNA, 25 bp, Mus musculus
ccacctctgtagcactgttaatttc

SEQ ID NO: 337911 - DNA, 25 bp, Mus musculus
ccacctctgtaggactgttaatttc

SEQ ID NO: 337912 - DNA, 25 bp, Mus musculus
ccacctcttagactccttgagatgg

SEQ ID NO: 337913 - DNA, 25 bp, Mus musculus
ccacctcttagagtccttgagatgg

SEQ ID NO: 337914 - DNA, 25 bp, Mus musculus
ccacctgaaaatcggtcattagtca

SEQ ID NO: 337915 - DNA, 25 bp, Mus musculus
ccacctgaaaatgggtcattagtca

SEQ ID NO: 337916 - DNA, 25 bp, Mus musculus
ccacctgaagacacttggcgagaaa

SEQ ID NO: 337917 - DNA, 25 bp, Mus musculus
ccacctgaagactcttggcgagaaa

SEQ ID NO: 337918 - DNA, 25 bp, Mus musculus
ccacctgaggctaggctgaagagct

SEQ ID NO: 337919 - DNA, 25 bp, Mus musculus
ccacctgaggcttggctgaagagct

SEQ ID NO: 337920 - DNA, 25 bp, Mus musculus
ccacctgagggtcagcgactcctgt

SEQ ID NO: 337921 - DNA, 25 bp, Mus musculus
ccacctgagggtgagcgactcctgt

SEQ ID NO: 337922 - DNA, 25 bp, Mus musculus
ccacctgcaagaaggacgcgagcca

SEQ ID NO: 337923 - DNA, 25 bp, Mus musculus
ccacctgcaagatggacgcgagcca

SEQ ID NO: 337924 - DNA, 25 bp, Mus musculus
ccacctgccatcagacaaggtagat

SEQ ID NO: 337925 - DNA, 25 bp, Mus musculus
ccacctgccatctgacaaggtagat

SEQ ID NO: 337926 - DNA, 25 bp, Mus musculus
ccacctgccatgattgtttgttggg

SEQ ID NO: 337927 - DNA, 25 bp, Mus musculus
ccacctgccatgtttgtttgttggg

SEQ ID NO: 337928 - DNA, 25 bp, Mus musculus
ccacctgcccctatagaagattaat

SEQ ID NO: 337929 - DNA, 25 bp, Mus musculus
ccacctgcccctttagaagattaat

SEQ ID NO: 337930 - DNA, 25 bp, Mus musculus
ccacctgccgtacctttcagtaagg

SEQ ID NO: 337931 - DNA, 25 bp, Mus musculus
ccacctgccgtagctttcagtaagg

SEQ ID NO: 337932 - DNA, 25 bp, Mus musculus
ccacctgcgctgcatctgaaataaa

SEQ ID NO: 337933 - DNA, 25 bp, Mus musculus
ccacctgcgctggatctgaaataaa

SEQ ID NO: 337934 - DNA, 25 bp, Mus musculus
ccacctgctactaggcacatgacaa

SEQ ID NO: 337935 - DNA, 25 bp, Mus musculus
ccacctgctacttggcacatgacaa

SEQ ID NO: 337936 - DNA, 25 bp, Mus musculus
ccacctgctggaaggctttagacca

SEQ ID NO: 337937 - DNA, 25 bp, Mus musculus
ccacctgctggatggctttagacca

SEQ ID NO: 337938 - DNA, 25 bp, Mus musculus
ccacctggaggactttaacacaagt

SEQ ID NO: 337939 - DNA, 25 bp, Mus musculus
ccacctggaggagtttaacacaagt

SEQ ID NO: 337940 - DNA, 25 bp, Mus musculus
ccacctggccagctctaacttattg

SEQ ID NO: 337941 - DNA, 25 bp, Mus musculus
ccacctggccaggtctaacttattg

SEQ ID NO: 337942 - DNA, 25 bp, Mus musculus
ccacctggtggaagtgagccatgca

SEQ ID NO: 337943 - DNA, 25 bp, Mus musculus
ccacctggtggatgtgagccatgca

SEQ ID NO: 337944 - DNA, 25 bp, Mus musculus
ccacctggtgttcgctcttagagga

SEQ ID NO: 337945 - DNA, 25 bp, Mus musculus
ccacctggtgttggctcttagagga

SEQ ID NO: 337946 - DNA, 25 bp, Mus musculus
ccacctggttgcaatggtcccctat

SEQ ID NO: 337947 - DNA, 25 bp, Mus musculus
ccacctggttgctatggtcccctat

SEQ ID NO: 337948 - DNA, 25 bp, Mus musculus
ccacctgtacatatcccagagaaca

SEQ ID NO: 337949 - DNA, 25 bp, Mus musculus
ccacctgtacatttcccagagaaca

SEQ ID NO: 337950 - DNA, 25 bp, Mus musculus
ccacctgtgacccttaagcattaat

SEQ ID NO: 337951 - DNA, 25 bp, Mus musculus
ccacctgtgaccgttaagcattaat

SEQ ID NO: 337952 - DNA, 25 bp, Mus musculus
ccacctgtgattccggctccaggag

SEQ ID NO: 337953 - DNA, 25 bp, Mus musculus
ccacctgtgattgcggctccaggag

SEQ ID NO: 337954 - DNA, 25 bp, Mus musculus
ccacctgtgcttatcctggacgaag

SEQ ID NO: 337955 - DNA, 25 bp, Mus musculus
ccacctgtgcttttcctggacgaag

SEQ ID NO: 337956 - DNA, 25 bp, Mus musculus
ccacctgtgggcagaaatctaacgt

SEQ ID NO: 337957 - DNA, 25 bp, Mus musculus
ccacctgtgggctgaaatctaacgt

SEQ ID NO: 337958 - DNA, 25 bp, Mus musculus
ccacctgtgtaacccaacgtgtaga

SEQ ID NO: 337959 - DNA, 25 bp, Mus musculus
ccacctgtgtaagccaacgtgtaga

SEQ ID NO: 337960 - DNA, 25 bp, Mus musculus
ccacctgtgtagcaagccctttagg

SEQ ID NO: 337961 - DNA, 25 bp, Mus musculus
ccacctgtgtaggaagccctttagg

SEQ ID NO: 337962 - DNA, 25 bp, Mus musculus
ccaccttactttagacagaatggga

SEQ ID NO: 337963 - DNA, 25 bp, Mus musculus
ccaccttacttttgacagaatggga

SEQ ID NO: 337964 - DNA, 25 bp, Mus musculus
ccaccttagggaccaatgtcaggcc

SEQ ID NO: 337965 - DNA, 25 bp, Mus musculus
ccaccttagggagcaatgtcaggcc

SEQ ID NO: 337966 - DNA, 25 bp, Mus musculus
ccaccttatgagatctgtaactaat

SEQ ID NO: 337967 - DNA, 25 bp, Mus musculus
ccaccttatgagttctgtaactaat

SEQ ID NO: 337968 - DNA, 25 bp, Mus musculus
ccaccttcaatcaggttgtgctgaa

SEQ ID NO: 337969 - DNA, 25 bp, Mus musculus
ccaccttcaatctggttgtgctgaa

SEQ ID NO: 337970 - DNA, 25 bp, Mus musculus
ccaccttccaggaattctttggact

SEQ ID NO: 337971 - DNA, 25 bp, Mus musculus
ccaccttccaggtattctttggact

SEQ ID NO: 337972 - DNA, 25 bp, Mus musculus
ccaccttccagtaatgccttcatat

SEQ ID NO: 337973 - DNA, 25 bp, Mus musculus
ccaccttccagttatgccttcatat

SEQ ID NO: 337974 - DNA, 25 bp, Mus musculus
ccaccttcctatctttgtaaaatat

SEQ ID NO: 337975 - DNA, 25 bp, Mus musculus
ccaccttcctatgtttgtaaaatat

SEQ ID NO: 337976 - DNA, 25 bp, Mus musculus
ccaccttccttcctttgtgtaaatg

SEQ ID NO: 337977 - DNA, 25 bp, Mus musculus
ccaccttccttcgtttgtgtaaatg

SEQ ID NO: 337978 - DNA, 25 bp, Mus musculus
ccaccttctgtcctgaagcaatgtt

SEQ ID NO: 337979 - DNA, 25 bp, Mus musculus
ccaccttctgtcgtgaagcaatgtt

SEQ ID NO: 337980 - DNA, 25 bp, Mus musculus
ccaccttctttgatttgctcaagta

SEQ ID NO: 337981 - DNA, 25 bp, Mus musculus
ccaccttctttgttttgctcaagta

SEQ ID NO: 337982 - DNA, 25 bp, Mus musculus
ccaccttgacaacctttcctgtttt

SEQ ID NO: 337983 - DNA, 25 bp, Mus musculus
ccaccttgacaagctttcctgtttt

SEQ ID NO: 337984 - DNA, 25 bp, Mus musculus
ccaccttgatctccatgcaagcaag

SEQ ID NO: 337985 - DNA, 25 bp, Mus musculus
ccaccttgatctgcatgcaagcaag

SEQ ID NO: 337986 - DNA, 25 bp, Mus musculus
ccaccttgccctattttgtacataa

SEQ ID NO: 337987 - DNA, 25 bp, Mus musculus
ccaccttgcccttttttgtacataa

SEQ ID NO: 337988 - DNA, 25 bp, Mus musculus
ccaccttgtggccattgagtatttt

SEQ ID NO: 337989 - DNA, 25 bp, Mus musculus
ccaccttgtggcgattgagtatttt

SEQ ID NO: 337990 - DNA, 25 bp, Mus musculus
ccacctttacatcactttggctaag

SEQ ID NO: 337991 - DNA, 25 bp, Mus musculus
ccacctttacatgactttggctaag

SEQ ID NO: 337992 - DNA, 25 bp, Mus musculus
ccacctttctcaataatgctcactt

SEQ ID NO: 337993 - DNA, 25 bp, Mus musculus
ccacctttctcattaatgctcactt

SEQ ID NO: 337994 - DNA, 25 bp, Mus musculus
ccacctttctccataaaattctcta

SEQ ID NO: 337995 - DNA, 25 bp, Mus musculus
ccacctttctccttaaaattctcta

SEQ ID NO: 337996 - DNA, 25 bp, Mus musculus
ccacctttgctaatcccggatgaaa

SEQ ID NO: 337997 - DNA, 25 bp, Mus musculus
ccacctttgctattcccggatgaaa

SEQ ID NO: 337998 - DNA, 25 bp, Mus musculus
ccacctttgcttcgctgtaaaactt

SEQ ID NO: 337999 - DNA, 25 bp, Mus musculus
ccacctttgcttggctgtaaaactt

SEQ ID NO: 338000 - DNA, 25 bp, Mus musculus
ccaccttttgtccatgtaattgata

SEQ ID NO: 338001 - DNA, 25 bp, Mus musculus
ccaccttttgtcgatgtaattgata

SEQ ID NO: 338002 - DNA, 25 bp, Mus musculus
ccacctttttatagccaggcctatg

SEQ ID NO: 338003 - DNA, 25 bp, Mus musculus
ccacctttttattgccaggcctatg

SEQ ID NO: 338004 - DNA, 25 bp, Mus musculus
ccacgaagcatcagtctgactacaa

SEQ ID NO: 338005 - DNA, 25 bp, Mus musculus
ccacgaagcatctgtctgactacaa

SEQ ID NO: 338006 - DNA, 25 bp, Mus musculus
ccacgacagagccattcctaatgtg

SEQ ID NO: 338007 - DNA, 25 bp, Mus musculus
ccacgacagagcgattcctaatgtg

SEQ ID NO: 338008 - DNA, 25 bp, Mus musculus
ccacgacctggaaattgaagctatc

SEQ ID NO: 338009 - DNA, 25 bp, Mus musculus
ccacgacctggatattgaagctatc

SEQ ID NO: 338010 - DNA, 25 bp, Mus musculus
ccacgacgaggcagtgcaggcattg

SEQ ID NO: 338011 - DNA, 25 bp, Mus musculus
ccacgacgaggctgtgcaggcattg

SEQ ID NO: 338012 - DNA, 25 bp, Mus musculus
ccacgactagtacgccatttcattc

SEQ ID NO: 338013 - DNA, 25 bp, Mus musculus
ccacgactagtaggccatttcattc

SEQ ID NO: 338014 - DNA, 25 bp, Mus musculus
ccacgactggttatggtttctagac

SEQ ID NO: 338015 - DNA, 25 bp, Mus musculus
ccacgactggttttggtttctagac

SEQ ID NO: 338016 - DNA, 25 bp, Mus musculus
ccacgagaaaccctgtgatttttat

SEQ ID NO: 338017 - DNA, 25 bp, Mus musculus
ccacgagaaaccgtgtgatttttat

SEQ ID NO: 338018 - DNA, 25 bp, Mus musculus
ccacgagccatccagagaactttta

SEQ ID NO: 338019 - DNA, 25 bp, Mus musculus
ccacgagccatcgagagaactttta

SEQ ID NO: 338020 - DNA, 25 bp, Mus musculus
ccacgagctttgctggtgcatagtt

SEQ ID NO: 338021 - DNA, 25 bp, Mus musculus
ccacgagctttggtggtgcatagtt

SEQ ID NO: 338022 - DNA, 25 bp, Mus musculus
ccacgagggctgatgtttttcttag

SEQ ID NO: 338023 - DNA, 25 bp, Mus musculus
ccacgagggctgttgtttttcttag

SEQ ID NO: 338024 - DNA, 25 bp, Mus musculus
ccacgagggttacagtttggcctca

SEQ ID NO: 338025 - DNA, 25 bp, Mus musculus
ccacgagggttagagtttggcctca

SEQ ID NO: 338026 - DNA, 25 bp, Mus musculus
ccacgattactgaacatccttgtct

SEQ ID NO: 338027 - DNA, 25 bp, Mus musculus
ccacgattactgtacatccttgtct

SEQ ID NO: 338028 - DNA, 25 bp, Mus musculus
ccacgcacttaaacgcagcgtttag

SEQ ID NO: 338029 - DNA, 25 bp, Mus musculus
ccacgcacttaatcgcagcgtttag

SEQ ID NO: 338030 - DNA, 25 bp, Mus musculus
ccacgcagcgagacaagggagtttt

SEQ ID NO: 338031 - DNA, 25 bp, Mus musculus
ccacgcagcgagtcaagggagtttt

SEQ ID NO: 338032 - DNA, 25 bp, Mus musculus
ccacgcagtgctaggacgaacatgt

SEQ ID NO: 338033 - DNA, 25 bp, Mus musculus
ccacgcagtgcttggacgaacatgt

SEQ ID NO: 338034 - DNA, 25 bp, Mus musculus
ccacgcagttggcacttctacagac

SEQ ID NO: 338035 - DNA, 25 bp, Mus musculus
ccacgcagttgggacttctacagac

SEQ ID NO: 338036 - DNA, 25 bp, Mus musculus
ccacgcatcctgatggcatatgata

SEQ ID NO: 338037 - DNA, 25 bp, Mus musculus
ccacgcatcctgttggcatatgata

SEQ ID NO: 338038 - DNA, 25 bp, Mus musculus
ccacgccattctcagggccatgggt

SEQ ID NO: 338039 - DNA, 25 bp, Mus musculus
ccacgccattctgagggccatgggt

SEQ ID NO: 338040 - DNA, 25 bp, Mus musculus
ccacgcccagctcaagatagttgta

SEQ ID NO: 338041 - DNA, 25 bp, Mus musculus
ccacgcccagctgaagatagttgta

SEQ ID NO: 338042 - DNA, 25 bp, Mus musculus
ccacgcccaggacggttgattggca

SEQ ID NO: 338043 - DNA, 25 bp, Mus musculus
ccacgcccaggagggttgattggca

SEQ ID NO: 338044 - DNA, 25 bp, Mus musculus
ccacgcccgggaagagtgcagaata

SEQ ID NO: 338045 - DNA, 25 bp, Mus musculus
ccacgcccgggatgagtgcagaata

SEQ ID NO: 338046 - DNA, 25 bp, Mus musculus
ccacgccctctcattctgtgttcag

SEQ ID NO: 338047 - DNA, 25 bp, Mus musculus
ccacgccctctctttctgtgttcag

SEQ ID NO: 338048 - DNA, 25 bp, Mus musculus
ccacgcctggcaattattgtttatt

SEQ ID NO: 338049 - DNA, 25 bp, Mus musculus
ccacgcctggcatttattgtttatt

SEQ ID NO: 338050 - DNA, 25 bp, Mus musculus
ccacgcggcgggaggacaagttcat

SEQ ID NO: 338051 - DNA, 25 bp, Mus musculus
ccacgcggcgggtggacaagttcat

SEQ ID NO: 338052 - DNA, 25 bp, Mus musculus
ccacgcgtgctcaccattaggtgaa

SEQ ID NO: 338053 - DNA, 25 bp, Mus musculus
ccacgcgtgctctccattaggtgaa

SEQ ID NO: 338054 - DNA, 25 bp, Mus musculus
ccacgcgtggtcctggttacctgtt

SEQ ID NO: 338055 - DNA, 25 bp, Mus musculus
ccacgcgtggtcgtggttacctgtt

SEQ ID NO: 338056 - DNA, 25 bp, Mus musculus
ccacgctactttatctaccttgaga

SEQ ID NO: 338057 - DNA, 25 bp, Mus musculus
ccacgctactttttctaccttgaga

SEQ ID NO: 338058 - DNA, 25 bp, Mus musculus
ccacgctcatacaaatcaggccaag

SEQ ID NO: 338059 - DNA, 25 bp, Mus musculus
ccacgctcatactaatcaggccaag

SEQ ID NO: 338060 - DNA, 25 bp, Mus musculus
ccacgctgctggatctgagacaaga

SEQ ID NO: 338061 - DNA, 25 bp, Mus musculus
ccacgctgctggttctgagacaaga

SEQ ID NO: 338062 - DNA, 25 bp, Mus musculus
ccacgctggagcagcacggagaaaa

SEQ ID NO: 338063 - DNA, 25 bp, Mus musculus
ccacgctggagctgcacggagaaaa

SEQ ID NO: 338064 - DNA, 25 bp, Mus musculus
ccacgctggtcgattctccattaaa

SEQ ID NO: 338065 - DNA, 25 bp, Mus musculus
ccacgctggtcgtttctccattaaa

SEQ ID NO: 338066 - DNA, 25 bp, Mus musculus
ccacgctgttgcagcccttgtcggg

SEQ ID NO: 338067 - DNA, 25 bp, Mus musculus
ccacgctgttgctgcccttgtcggg

SEQ ID NO: 338068 - DNA, 25 bp, Mus musculus
ccacgcttatgaacccagtgttagg

SEQ ID NO: 338069 - DNA, 25 bp, Mus musculus
ccacgcttatgatcccagtgttagg

SEQ ID NO: 338070 - DNA, 25 bp, Mus musculus
ccacggaattggatatctttaacga

SEQ ID NO: 338071 - DNA, 25 bp, Mus musculus
ccacggaattggttatctttaacga

SEQ ID NO: 338072 - DNA, 25 bp, Mus musculus
ccacggatgacgagcaagacaggaa

SEQ ID NO: 338073 - DNA, 25 bp, Mus musculus
ccacggatgacgtgcaagacaggaa

SEQ ID NO: 338074 - DNA, 25 bp, Mus musculus
ccacggcagcggaggcataagccca

SEQ ID NO: 338075 - DNA, 25 bp, Mus musculus
ccacggcagcggtggcataagccca

SEQ ID NO: 338076 - DNA, 25 bp, Mus musculus
ccacggccaacacattgtcttcaag

SEQ ID NO: 338077 - DNA, 25 bp, Mus musculus
ccacggccaacagattgtcttcaag

SEQ ID NO: 338078 - DNA, 25 bp, Mus musculus
ccacggccattaactcatgcaagaa

SEQ ID NO: 338079 - DNA, 25 bp, Mus musculus
ccacggccattatctcatgcaagaa

SEQ ID NO: 338080 - DNA, 25 bp, Mus musculus
ccacgggacagtaacccagctggca

SEQ ID NO: 338081 - DNA, 25 bp, Mus musculus
ccacgggacagttacccagctggca

SEQ ID NO: 338082 - DNA, 25 bp, Mus musculus
ccacgggatgttcgtcgttgatatc

SEQ ID NO: 338083 - DNA, 25 bp, Mus musculus
ccacgggatgttggtcgttgatatc

SEQ ID NO: 338084 - DNA, 25 bp, Mus musculus
ccacgggtgttgagaacatcgacga

SEQ ID NO: 338085 - DNA, 25 bp, Mus musculus
ccacgggtgttgtgaacatcgacga

SEQ ID NO: 338086 - DNA, 25 bp, Mus musculus
ccacggtcaacccattgctatatta

SEQ ID NO: 338087 - DNA, 25 bp, Mus musculus
ccacggtcaaccgattgctatatta

SEQ ID NO: 338088 - DNA, 25 bp, Mus musculus
ccacggtcccaaatcttctgaagaa

SEQ ID NO: 338089 - DNA, 25 bp, Mus musculus
ccacggtcccaattcttctgaagaa

SEQ ID NO: 338090 - DNA, 25 bp, Mus musculus
ccacggtgaaccatcttgtttacag

SEQ ID NO: 338091 - DNA, 25 bp, Mus musculus
ccacggtgaaccttcttgtttacag

SEQ ID NO: 338092 - DNA, 25 bp, Mus musculus
ccacggtgatcacggcaacagcatt

SEQ ID NO: 338093 - DNA, 25 bp, Mus musculus
ccacggtgatcagggcaacagcatt

SEQ ID NO: 338094 - DNA, 25 bp, Mus musculus
ccacggtggcacagttgcaggtgat

SEQ ID NO: 338095 - DNA, 25 bp, Mus musculus
ccacggtggcactgttgcaggtgat

SEQ ID NO: 338096 - DNA, 25 bp, Mus musculus
ccacggtggtctagcacatgactaa

SEQ ID NO: 338097 - DNA, 25 bp, Mus musculus
ccacggtggtcttgcacatgactaa

SEQ ID NO: 338098 - DNA, 25 bp, Mus musculus
ccacggttttaaatcaggcttctgt

SEQ ID NO: 338099 - DNA, 25 bp, Mus musculus
ccacggttttaattcaggcttctgt

SEQ ID NO: 338100 - DNA, 25 bp, Mus musculus
ccacggtttttgcagctcacagaga

SEQ ID NO: 338101 - DNA, 25 bp, Mus musculus
ccacggtttttggagctcacagaga

SEQ ID NO: 338102 - DNA, 25 bp, Mus musculus
ccacgtacctgccttcatgtgtgta

SEQ ID NO: 338103 - DNA, 25 bp, Mus musculus
ccacgtacctgcgttcatgtgtgta

SEQ ID NO: 338104 - DNA, 25 bp, Mus musculus
ccacgtagtgggaatcacgccctag

SEQ ID NO: 338105 - DNA, 25 bp, Mus musculus
ccacgtagtgggtatcacgccctag

SEQ ID NO: 338106 - DNA, 25 bp, Mus musculus
ccacgtattgtcaagtcagttttta

SEQ ID NO: 338107 - DNA, 25 bp, Mus musculus
ccacgtattgtctagtcagttttta

SEQ ID NO: 338108 - DNA, 25 bp, Mus musculus
ccacgtcacacaaactgcaggttaa

SEQ ID NO: 338109 - DNA, 25 bp, Mus musculus
ccacgtcacacatactgcaggttaa

SEQ ID NO: 338110 - DNA, 25 bp, Mus musculus
ccacgtcagcttccggaatcgaagg

SEQ ID NO: 338111 - DNA, 25 bp, Mus musculus
ccacgtcagcttgcggaatcgaagg

SEQ ID NO: 338112 - DNA, 25 bp, Mus musculus
ccacgtcctcacacaggttcaggag

SEQ ID NO: 338113 - DNA, 25 bp, Mus musculus
ccacgtcctcactcaggttcaggag

SEQ ID NO: 338114 - DNA, 25 bp, Mus musculus
ccacgtcggagcagtcttaactaaa

SEQ ID NO: 338115 - DNA, 25 bp, Mus musculus
ccacgtcggagctgtcttaactaaa

SEQ ID NO: 338116 - DNA, 25 bp, Mus musculus
ccacgtctcaggacctatttttagt

SEQ ID NO: 338117 - DNA, 25 bp, Mus musculus
ccacgtctcaggtcctatttttagt

SEQ ID NO: 338118 - DNA, 25 bp, Mus musculus
ccacgtctgtatcatggcatgtatg

SEQ ID NO: 338119 - DNA, 25 bp, Mus musculus
ccacgtctgtatgatggcatgtatg

SEQ ID NO: 338120 - DNA, 25 bp, Mus musculus
ccacgtgaccggatgtaagctttca

SEQ ID NO: 338121 - DNA, 25 bp, Mus musculus
ccacgtgaccggttgtaagctttca

SEQ ID NO: 338122 - DNA, 25 bp, Mus musculus
ccacgtgcagtaagagcgtctgggc

SEQ ID NO: 338123 - DNA, 25 bp, Mus musculus
ccacgtgcagtatgagcgtctgggc

SEQ ID NO: 338124 - DNA, 25 bp, Mus musculus
ccacgtgccaaccaacaaaactgat

SEQ ID NO: 338125 - DNA, 25 bp, Mus musculus
ccacgtgccaacgaacaaaactgat

SEQ ID NO: 338126 - DNA, 25 bp, Mus musculus
ccacgtgcccggagactgaagaagt

SEQ ID NO: 338127 - DNA, 25 bp, Mus musculus
ccacgtgcccggtgactgaagaagt

SEQ ID NO: 338128 - DNA, 25 bp, Mus musculus
ccacgtgcccttcacattggaatca

SEQ ID NO: 338129 - DNA, 25 bp, Mus musculus
ccacgtgcccttgacattggaatca

SEQ ID NO: 338130 - DNA, 25 bp, Mus musculus
ccacgtgcggcccaggaagaacagt

SEQ ID NO: 338131 - DNA, 25 bp, Mus musculus
ccacgtgcggccgaggaagaacagt

SEQ ID NO: 338132 - DNA, 25 bp, Mus musculus
ccacgtgcttgacgcctggcagctt

SEQ ID NO: 338133 - DNA, 25 bp, Mus musculus
ccacgtgcttgaggcctggcagctt

SEQ ID NO: 338134 - DNA, 25 bp, Mus musculus
ccacgtggaaagatctgacggctct

SEQ ID NO: 338135 - DNA, 25 bp, Mus musculus
ccacgtggaaagttctgacggctct

SEQ ID NO: 338136 - DNA, 25 bp, Mus musculus
ccacgtggcagtccctgcggaaaaa

SEQ ID NO: 338137 - DNA, 25 bp, Mus musculus
ccacgtggcagtgcctgcggaaaaa

SEQ ID NO: 338138 - DNA, 25 bp, Mus musculus
ccacgtgggcccagcaaatcaggga

SEQ ID NO: 338139 - DNA, 25 bp, Mus musculus
ccacgtgggccctgcaaatcaggga

SEQ ID NO: 338140 - DNA, 25 bp, Mus musculus
ccacgtgggtgtatactgcggccaa

SEQ ID NO: 338141 - DNA, 25 bp, Mus musculus
ccacgtgggtgtttactgcggccaa

SEQ ID NO: 338142 - DNA, 25 bp, Mus musculus
ccacgtggttctcatctggtaagat

SEQ ID NO: 338143 - DNA, 25 bp, Mus musculus
ccacgtggttctgatctggtaagat

SEQ ID NO: 338144 - DNA, 25 bp, Mus musculus
ccacgtgtcctaatgatgaagtcag

SEQ ID NO: 338145 - DNA, 25 bp, Mus musculus
ccacgtgtcctattgatgaagtcag

SEQ ID NO: 338146 - DNA, 25 bp, Mus musculus
ccacgtgtggcaactctccgaggag

SEQ ID NO: 338147 - DNA, 25 bp, Mus musculus
ccacgtgtggcatctctccgaggag

SEQ ID NO: 338148 - DNA, 25 bp, Mus musculus
ccacgtgttcacctgtaagagatca

SEQ ID NO: 338149 - DNA, 25 bp, Mus musculus
ccacgtgttcacgtgtaagagatca

SEQ ID NO: 338150 - DNA, 25 bp, Mus musculus
ccacgtgttcggcacagtgagacct

SEQ ID NO: 338151 - DNA, 25 bp, Mus musculus
ccacgtgttcgggacagtgagacct

SEQ ID NO: 338152 - DNA, 25 bp, Mus musculus
ccacgtgttctcaaggtaatccgca

SEQ ID NO: 338153 - DNA, 25 bp, Mus musculus
ccacgtgttctctaggtaatccgca

SEQ ID NO: 338154 - DNA, 25 bp, Mus musculus
ccacgttaaaaacactcaggcaatg

SEQ ID NO: 338155 - DNA, 25 bp, Mus musculus
ccacgttaaaaagactcaggcaatg

SEQ ID NO: 338156 - DNA, 25 bp, Mus musculus
ccacgttaacttaggcggcagagca

SEQ ID NO: 338157 - DNA, 25 bp, Mus musculus
ccacgttaactttggcggcagagca

SEQ ID NO: 338158 - DNA, 25 bp, Mus musculus
ccacgttaatcactcacacaaactt

SEQ ID NO: 338159 - DNA, 25 bp, Mus musculus
ccacgttaatcagtcacacaaactt

SEQ ID NO: 338160 - DNA, 25 bp, Mus musculus
ccacgttacataccactgactaaca

SEQ ID NO: 338161 - DNA, 25 bp, Mus musculus
ccacgttacatagcactgactaaca

SEQ ID NO: 338162 - DNA, 25 bp, Mus musculus
ccacgttcatacaggagcatgttga

SEQ ID NO: 338163 - DNA, 25 bp, Mus musculus
ccacgttcatactggagcatgttga

SEQ ID NO: 338164 - DNA, 25 bp, Mus musculus
ccacgttcctagattcgttttagat

SEQ ID NO: 338165 - DNA, 25 bp, Mus musculus
ccacgttcctagtttcgttttagat

SEQ ID NO: 338166 - DNA, 25 bp, Mus musculus
ccacgttctgtgacagagctgtgtt

SEQ ID NO: 338167 - DNA, 25 bp, Mus musculus
ccacgttctgtgtcagagctgtgtt

SEQ ID NO: 338168 - DNA, 25 bp, Mus musculus
ccacgttgactcagaagccgatgaa

SEQ ID NO: 338169 - DNA, 25 bp, Mus musculus
ccacgttgactctgaagccgatgaa

SEQ ID NO: 338170 - DNA, 25 bp, Mus musculus
ccacgttggaggaggatagctcaga

SEQ ID NO: 338171 - DNA, 25 bp, Mus musculus
ccacgttggaggtggatagctcaga

SEQ ID NO: 338172 - DNA, 25 bp, Mus musculus
ccacgttgttggcatgcactttttt

SEQ ID NO: 338173 - DNA, 25 bp, Mus musculus
ccacgttgttgggatgcactttttt

SEQ ID NO: 338174 - DNA, 25 bp, Mus musculus
ccacgtttgcacaactcgtaacata

SEQ ID NO: 338175 - DNA, 25 bp, Mus musculus
ccacgtttgcactactcgtaacata

SEQ ID NO: 338176 - DNA, 25 bp, Mus musculus
ccacgtttgtgtattttccctgtga

SEQ ID NO: 338177 - DNA, 25 bp, Mus musculus
ccacgtttgtgttttttccctgtga

SEQ ID NO: 338178 - DNA, 25 bp, Mus musculus
ccacgtttttgcagcttcgggaaca

SEQ ID NO: 338179 - DNA, 25 bp, Mus musculus
ccacgtttttgctgcttcgggaaca

SEQ ID NO: 338180 - DNA, 25 bp, Mus musculus
ccacgttttttgcagatggcccctg

SEQ ID NO: 338181 - DNA, 25 bp, Mus musculus
ccacgttttttggagatggcccctg

SEQ ID NO: 338182 - DNA, 25 bp, Mus musculus
ccactaaacatgcaagagggaacct

SEQ ID NO: 338183 - DNA, 25 bp, Mus musculus
ccactaaacatggaagagggaacct

SEQ ID NO: 338184 - DNA, 25 bp, Mus musculus
ccactaaagccacctgacaacatta

SEQ ID NO: 338185 - DNA, 25 bp, Mus musculus
ccactaaagccagctgacaacatta

SEQ ID NO: 338186 - DNA, 25 bp, Mus musculus
ccactaacgctgagctttgcttgta

SEQ ID NO: 338187 - DNA, 25 bp, Mus musculus
ccactaacgctgtgctttgcttgta

SEQ ID NO: 338188 - DNA, 25 bp, Mus musculus
ccactaagtgagatggcagctatta

SEQ ID NO: 338189 - DNA, 25 bp, Mus musculus
ccactaagtgagttggcagctatta

SEQ ID NO: 338190 - DNA, 25 bp, Mus musculus
ccactaatataacctgctgtcagaa

SEQ ID NO: 338191 - DNA, 25 bp, Mus musculus
ccactaatataagctgctgtcagaa

SEQ ID NO: 338192 - DNA, 25 bp, Mus musculus
ccactacagactactctgctaggtc

SEQ ID NO: 338193 - DNA, 25 bp, Mus musculus
ccactacagacttctctgctaggtc

SEQ ID NO: 338194 - DNA, 25 bp, Mus musculus
ccactacagctcagagtggcgtggg

SEQ ID NO: 338195 - DNA, 25 bp, Mus musculus
ccactacagctctgagtggcgtggg

SEQ ID NO: 338196 - DNA, 25 bp, Mus musculus
ccactacatcgaattttgttttgtg

SEQ ID NO: 338197 - DNA, 25 bp, Mus musculus
ccactacatcgatttttgttttgtg

SEQ ID NO: 338198 - DNA, 25 bp, Mus musculus
ccactacctggcacagatttcttaa

SEQ ID NO: 338199 - DNA, 25 bp, Mus musculus
ccactacctggctcagatttcttaa

SEQ ID NO: 338200 - DNA, 25 bp, Mus musculus
ccactacggaataacacctaccatt

SEQ ID NO: 338201 - DNA, 25 bp, Mus musculus
ccactacggaattacacctaccatt

SEQ ID NO: 338202 - DNA, 25 bp, Mus musculus
ccactagaattgactgttgttgctt

SEQ ID NO: 338203 - DNA, 25 bp, Mus musculus
ccactagaattgtctgttgttgctt

SEQ ID NO: 338204 - DNA, 25 bp, Mus musculus
ccactagactggctggttattaagt

SEQ ID NO: 338205 - DNA, 25 bp, Mus musculus
ccactagactgggtggttattaagt

SEQ ID NO: 338206 - DNA, 25 bp, Mus musculus
ccactagccaggattgttcaccagt

SEQ ID NO: 338207 - DNA, 25 bp, Mus musculus
ccactagccaggtttgttcaccagt

SEQ ID NO: 338208 - DNA, 25 bp, Mus musculus
ccactagggcctacttttgggatca

SEQ ID NO: 338209 - DNA, 25 bp, Mus musculus
ccactagggccttcttttgggatca

SEQ ID NO: 338210 - DNA, 25 bp, Mus musculus
ccactagtgcctcgcctaaggttat

SEQ ID NO: 338211 - DNA, 25 bp, Mus musculus
ccactagtgcctggcctaaggttat

SEQ ID NO: 338212 - DNA, 25 bp, Mus musculus
ccactagtgtctcccaagaacttgg

SEQ ID NO: 338213 - DNA, 25 bp, Mus musculus
ccactagtgtctgccaagaacttgg

SEQ ID NO: 338214 - DNA, 25 bp, Mus musculus
ccactatagcagaactaagagcctt

SEQ ID NO: 338215 - DNA, 25 bp, Mus musculus
ccactatagcagtactaagagcctt

SEQ ID NO: 338216 - DNA, 25 bp, Mus musculus
ccactatatctgactaggatctaga

SEQ ID NO: 338217 - DNA, 25 bp, Mus musculus
ccactatatctgtctaggatctaga

SEQ ID NO: 338218 - DNA, 25 bp, Mus musculus
ccactatgcttgctttgatgctttt

SEQ ID NO: 338219 - DNA, 25 bp, Mus musculus
ccactatgcttggtttgatgctttt

SEQ ID NO: 338220 - DNA, 25 bp, Mus musculus
ccactatgggtgctgtcattcttct

SEQ ID NO: 338221 - DNA, 25 bp, Mus musculus
ccactatgggtggtgtcattcttct

SEQ ID NO: 338222 - DNA, 25 bp, Mus musculus
ccactatgtttaaccctcgtagcaa

SEQ ID NO: 338223 - DNA, 25 bp, Mus musculus
ccactatgtttatccctcgtagcaa

SEQ ID NO: 338224 - DNA, 25 bp, Mus musculus
ccactattcccgcgctagaaagtag

SEQ ID NO: 338225 - DNA, 25 bp, Mus musculus
ccactattcccgggctagaaagtag

SEQ ID NO: 338226 - DNA, 25 bp, Mus musculus
ccactcaagcgcatctgtccaaatg

SEQ ID NO: 338227 - DNA, 25 bp, Mus musculus
ccactcaagcgcttctgtccaaatg

SEQ ID NO: 338228 - DNA, 25 bp, Mus musculus
ccactcaagtatactaggcatatgt

SEQ ID NO: 338229 - DNA, 25 bp, Mus musculus
ccactcaagtattctaggcatatgt

SEQ ID NO: 338230 - DNA, 25 bp, Mus musculus
ccactcaattaaactttccttgcct

SEQ ID NO: 338231 - DNA, 25 bp, Mus musculus
ccactcaattaatctttccttgcct

SEQ ID NO: 338232 - DNA, 25 bp, Mus musculus
ccactcacacatcagcaatttcaga

SEQ ID NO: 338233 - DNA, 25 bp, Mus musculus
ccactcacacatgagcaatttcaga

SEQ ID NO: 338234 - DNA, 25 bp, Mus musculus
ccactcacagttccttatcagacag

SEQ ID NO: 338235 - DNA, 25 bp, Mus musculus
ccactcacagttgcttatcagacag

SEQ ID NO: 338236 - DNA, 25 bp, Mus musculus
ccactcactgggatcaattagatat

SEQ ID NO: 338237 - DNA, 25 bp, Mus musculus
ccactcactgggttcaattagatat

SEQ ID NO: 338238 - DNA, 25 bp, Mus musculus
ccactcagcagtaaacgtctttaga

SEQ ID NO: 338239 - DNA, 25 bp, Mus musculus
ccactcagcagttaacgtctttaga

SEQ ID NO: 338240 - DNA, 25 bp, Mus musculus
ccactcaggctgaatacaattaatg

SEQ ID NO: 338241 - DNA, 25 bp, Mus musculus
ccactcaggctgtatacaattaatg

SEQ ID NO: 338242 - DNA, 25 bp, Mus musculus
ccactcaggtggacggttcagcgaa

SEQ ID NO: 338243 - DNA, 25 bp, Mus musculus
ccactcaggtggtcggttcagcgaa

SEQ ID NO: 338244 - DNA, 25 bp, Mus musculus
ccactcagtggtagggtaggattcc

SEQ ID NO: 338245 - DNA, 25 bp, Mus musculus
ccactcagtggttgggtaggattcc

SEQ ID NO: 338246 - DNA, 25 bp, Mus musculus
ccactcatagcaaatacgcacacag

SEQ ID NO: 338247 - DNA, 25 bp, Mus musculus
ccactcatagcatatacgcacacag

SEQ ID NO: 338248 - DNA, 25 bp, Mus musculus
ccactcatgcatcttgcagtgtgaa

SEQ ID NO: 338249 - DNA, 25 bp, Mus musculus
ccactcatgcatgttgcagtgtgaa

SEQ ID NO: 338250 - DNA, 25 bp, Mus musculus
ccactccaaggtctcattgaacttt

SEQ ID NO: 338251 - DNA, 25 bp, Mus musculus
ccactccaaggtgtcattgaacttt

SEQ ID NO: 338252 - DNA, 25 bp, Mus musculus
ccactccaccttaatatgctgtaaa

SEQ ID NO: 338253 - DNA, 25 bp, Mus musculus
ccactccacctttatatgctgtaaa

SEQ ID NO: 338254 - DNA, 25 bp, Mus musculus
ccactccagacaagttgttcttaca

SEQ ID NO: 338255 - DNA, 25 bp, Mus musculus
ccactccagacatgttgttcttaca

SEQ ID NO: 338256 - DNA, 25 bp, Mus musculus
ccactcccaatgctatttagtgtgt

SEQ ID NO: 338257 - DNA, 25 bp, Mus musculus
ccactcccaatggtatttagtgtgt

SEQ ID NO: 338258 - DNA, 25 bp, Mus musculus
ccactcccgtgtactatacagtaaa

SEQ ID NO: 338259 - DNA, 25 bp, Mus musculus
ccactcccgtgttctatacagtaaa

SEQ ID NO: 338260 - DNA, 25 bp, Mus musculus
ccactcccttgcattatttctttgt

SEQ ID NO: 338261 - DNA, 25 bp, Mus musculus
ccactcccttgctttatttctttgt

SEQ ID NO: 338262 - DNA, 25 bp, Mus musculus
ccactccgagccaggtgaagacgag

SEQ ID NO: 338263 - DNA, 25 bp, Mus musculus
ccactccgagcctggtgaagacgag

SEQ ID NO: 338264 - DNA, 25 bp, Mus musculus
ccactccgtctaatctgcatttgaa

SEQ ID NO: 338265 - DNA, 25 bp, Mus musculus
ccactccgtctattctgcatttgaa

SEQ ID NO: 338266 - DNA, 25 bp, Mus musculus
ccactcctccgtcgtggaagtgaga

SEQ ID NO: 338267 - DNA, 25 bp, Mus musculus
ccactcctccgtggtggaagtgaga

SEQ ID NO: 338268 - DNA, 25 bp, Mus musculus
ccactcctccttatcaggatattta

SEQ ID NO: 338269 - DNA, 25 bp, Mus musculus
ccactcctccttttcaggatattta

SEQ ID NO: 338270 - DNA, 25 bp, Mus musculus
ccactcctggagagaggatcgttct

SEQ ID NO: 338271 - DNA, 25 bp, Mus musculus
ccactcctggagtgaggatcgttct

SEQ ID NO: 338272 - DNA, 25 bp, Mus musculus
ccactcctgggcatattcattttat

SEQ ID NO: 338273 - DNA, 25 bp, Mus musculus
ccactcctgggcttattcattttat

SEQ ID NO: 338274 - DNA, 25 bp, Mus musculus
ccactcctgtgcctaatatttcttc

SEQ ID NO: 338275 - DNA, 25 bp, Mus musculus
ccactcctgtgcgtaatatttcttc

SEQ ID NO: 338276 - DNA, 25 bp, Mus musculus
ccactccttcttatgtctatctgta

SEQ ID NO: 338277 - DNA, 25 bp, Mus musculus
ccactccttcttttgtctatctgta

SEQ ID NO: 338278 - DNA, 25 bp, Mus musculus
ccactcctttatacatttgcaactg

SEQ ID NO: 338279 - DNA, 25 bp, Mus musculus
ccactcctttattcatttgcaactg

SEQ ID NO: 338280 - DNA, 25 bp, Mus musculus
ccactcgccctgcaaggcggaatat

SEQ ID NO: 338281 - DNA, 25 bp, Mus musculus
ccactcgccctggaaggcggaatat

SEQ ID NO: 338282 - DNA, 25 bp, Mus musculus
ccactcggctgtccaacatttttgt

SEQ ID NO: 338283 - DNA, 25 bp, Mus musculus
ccactcggctgtgcaacatttttgt

SEQ ID NO: 338284 - DNA, 25 bp, Mus musculus
ccactcgggtgtatgctgcagactg

SEQ ID NO: 338285 - DNA, 25 bp, Mus musculus
ccactcgggtgtttgctgcagactg

SEQ ID NO: 338286 - DNA, 25 bp, Mus musculus
ccactctacctccattgtacaaaaa

SEQ ID NO: 338287 - DNA, 25 bp, Mus musculus
ccactctacctcgattgtacaaaaa

SEQ ID NO: 338288 - DNA, 25 bp, Mus musculus
ccactctactgcagtccaggagaca

SEQ ID NO: 338289 - DNA, 25 bp, Mus musculus
ccactctactgctgtccaggagaca

SEQ ID NO: 338290 - DNA, 25 bp, Mus musculus
ccactctcacacactaaggttcaga

SEQ ID NO: 338291 - DNA, 25 bp, Mus musculus
ccactctcacactctaaggttcaga

SEQ ID NO: 338292 - DNA, 25 bp, Mus musculus
ccactctccaggaacatcattcatt

SEQ ID NO: 338293 - DNA, 25 bp, Mus musculus
ccactctccaggtacatcattcatt

SEQ ID NO: 338294 - DNA, 25 bp, Mus musculus
ccactctcctggaaaatgatcccag

SEQ ID NO: 338295 - DNA, 25 bp, Mus musculus
ccactctcctggtaaatgatcccag

SEQ ID NO: 338296 - DNA, 25 bp, Mus musculus
ccactctcggtcatttgtatttttt

SEQ ID NO: 338297 - DNA, 25 bp, Mus musculus
ccactctcggtcttttgtatttttt

SEQ ID NO: 338298 - DNA, 25 bp, Mus musculus
ccactctctctcacttggtggtgtg

SEQ ID NO: 338299 - DNA, 25 bp, Mus musculus
ccactctctctctcttggtggtgtg

SEQ ID NO: 338300 - DNA, 25 bp, Mus musculus
ccactctgaagtcaggctctgttta

SEQ ID NO: 338301 - DNA, 25 bp, Mus musculus
ccactctgaagtgaggctctgttta

SEQ ID NO: 338302 - DNA, 25 bp, Mus musculus
ccactctgctacattttccgaaaaa

SEQ ID NO: 338303 - DNA, 25 bp, Mus musculus
ccactctgctactttttccgaaaaa

SEQ ID NO: 338304 - DNA, 25 bp, Mus musculus
ccactctgcttccttatcttaaaac

SEQ ID NO: 338305 - DNA, 25 bp, Mus musculus
ccactctgcttcgttatcttaaaac

SEQ ID NO: 338306 - DNA, 25 bp, Mus musculus
ccactctggcctaaatgctttttgt

SEQ ID NO: 338307 - DNA, 25 bp, Mus musculus
ccactctggccttaatgctttttgt

SEQ ID NO: 338308 - DNA, 25 bp, Mus musculus
ccactctgggcaaccaggagaagta

SEQ ID NO: 338309 - DNA, 25 bp, Mus musculus
ccactctgggcatccaggagaagta

SEQ ID NO: 338310 - DNA, 25 bp, Mus musculus
ccactctgggtcagagcggccagaa

SEQ ID NO: 338311 - DNA, 25 bp, Mus musculus
ccactctgggtctgagcggccagaa

SEQ ID NO: 338312 - DNA, 25 bp, Mus musculus
ccactctgtccactgtaaattcatt

SEQ ID NO: 338313 - DNA, 25 bp, Mus musculus
ccactctgtccagtgtaaattcatt

SEQ ID NO: 338314 - DNA, 25 bp, Mus musculus
ccactctgttgccatgttattctga

SEQ ID NO: 338315 - DNA, 25 bp, Mus musculus
ccactctgttgcgatgttattctga

SEQ ID NO: 338316 - DNA, 25 bp, Mus musculus
ccactcttagctaggctcttaggaa

SEQ ID NO: 338317 - DNA, 25 bp, Mus musculus
ccactcttagcttggctcttaggaa

SEQ ID NO: 338318 - DNA, 25 bp, Mus musculus
ccactgaaggccctgtttgcaggtg

SEQ ID NO: 338319 - DNA, 25 bp, Mus musculus
ccactgaaggccgtgtttgcaggtg

SEQ ID NO: 338320 - DNA, 25 bp, Mus musculus
ccactgaaggtgaaggctgtccaat

SEQ ID NO: 338321 - DNA, 25 bp, Mus musculus
ccactgaaggtgtaggctgtccaat

SEQ ID NO: 338322 - DNA, 25 bp, Mus musculus
ccactgacatccctgattggtgtat

SEQ ID NO: 338323 - DNA, 25 bp, Mus musculus
ccactgacatccgtgattggtgtat

SEQ ID NO: 338324 - DNA, 25 bp, Mus musculus
ccactgaccccaattgaatattaat

SEQ ID NO: 338325 - DNA, 25 bp, Mus musculus
ccactgaccccatttgaatattaat

SEQ ID NO: 338326 - DNA, 25 bp, Mus musculus
ccactgacctgtccctccaagtgat

SEQ ID NO: 338327 - DNA, 25 bp, Mus musculus
ccactgacctgtgcctccaagtgat

SEQ ID NO: 338328 - DNA, 25 bp, Mus musculus
ccactgaccttcaaaagactgcttc

SEQ ID NO: 338329 - DNA, 25 bp, Mus musculus
ccactgaccttctaaagactgcttc

SEQ ID NO: 338330 - DNA, 25 bp, Mus musculus
ccactgaccttgagtagaaagatca

SEQ ID NO: 338331 - DNA, 25 bp, Mus musculus
ccactgaccttgtgtagaaagatca

SEQ ID NO: 338332 - DNA, 25 bp, Mus musculus
ccactgacctttacctttcaaatga

SEQ ID NO: 338333 - DNA, 25 bp, Mus musculus
ccactgaccttttcctttcaaatga

SEQ ID NO: 338334 - DNA, 25 bp, Mus musculus
ccactgactgcgcagactcgattta

SEQ ID NO: 338335 - DNA, 25 bp, Mus musculus
ccactgactgcggagactcgattta

SEQ ID NO: 338336 - DNA, 25 bp, Mus musculus
ccactgactggtaaggactctgtat

SEQ ID NO: 338337 - DNA, 25 bp, Mus musculus
ccactgactggttaggactctgtat

SEQ ID NO: 338338 - DNA, 25 bp, Mus musculus
ccactgagactgatacatacgcctg

SEQ ID NO: 338339 - DNA, 25 bp, Mus musculus
ccactgagactgttacatacgcctg

SEQ ID NO: 338340 - DNA, 25 bp, Mus musculus
ccactgagcacaaattattttccct

SEQ ID NO: 338341 - DNA, 25 bp, Mus musculus
ccactgagcacatattattttccct

SEQ ID NO: 338342 - DNA, 25 bp, Mus musculus
ccactgagccccagtgttatctttt

SEQ ID NO: 338343 - DNA, 25 bp, Mus musculus
ccactgagcccctgtgttatctttt

SEQ ID NO: 338344 - DNA, 25 bp, Mus musculus
ccactgagcttcaaacaatacccaa

SEQ ID NO: 338345 - DNA, 25 bp, Mus musculus
ccactgagcttctaacaatacccaa

SEQ ID NO: 338346 - DNA, 25 bp, Mus musculus
ccactgaggctaccggtgcttagct

SEQ ID NO: 338347 - DNA, 25 bp, Mus musculus
ccactgaggctagcggtgcttagct

SEQ ID NO: 338348 - DNA, 25 bp, Mus musculus
ccactgaggcttcgttgctggtttg

SEQ ID NO: 338349 - DNA, 25 bp, Mus musculus
ccactgaggcttggttgctggtttg

SEQ ID NO: 338350 - DNA, 25 bp, Mus musculus
ccactgagggtcacaagctgagctt

SEQ ID NO: 338351 - DNA, 25 bp, Mus musculus
ccactgagggtctcaagctgagctt

SEQ ID NO: 338352 - DNA, 25 bp, Mus musculus
ccactgagtacccagaagagggact

SEQ ID NO: 338353 - DNA, 25 bp, Mus musculus
ccactgagtaccgagaagagggact

SEQ ID NO: 338354 - DNA, 25 bp, Mus musculus
ccactgcaccttcggtaatgggcta

SEQ ID NO: 338355 - DNA, 25 bp, Mus musculus
ccactgcaccttgggtaatgggcta

SEQ ID NO: 338356 - DNA, 25 bp, Mus musculus
ccactgcagatcaaacactggagaa

SEQ ID NO: 338357 - DNA, 25 bp, Mus musculus
ccactgcagatcatagtgcagagtt

SEQ ID NO: 338358 - DNA, 25 bp, Mus musculus
ccactgcagatctaacactggagaa

SEQ ID NO: 338359 - DNA, 25 bp, Mus musculus
ccactgcagatcttagtgcagagtt

SEQ ID NO: 338360 - DNA, 25 bp, Mus musculus
ccactgccatttaaggattgccaag

SEQ ID NO: 338361 - DNA, 25 bp, Mus musculus
ccactgccattttaggattgccaag

SEQ ID NO: 338362 - DNA, 25 bp, Mus musculus
ccactgcccaccagaatttcagtag

SEQ ID NO: 338363 - DNA, 25 bp, Mus musculus
ccactgcccacctgaatttcagtag

SEQ ID NO: 338364 - DNA, 25 bp, Mus musculus
ccactgcccagcatatttatagctc

SEQ ID NO: 338365 - DNA, 25 bp, Mus musculus
ccactgcccagcttatttatagctc

SEQ ID NO: 338366 - DNA, 25 bp, Mus musculus
ccactgcccaggatacgggagactg

SEQ ID NO: 338367 - DNA, 25 bp, Mus musculus
ccactgcccaggttacgggagactg

SEQ ID NO: 338368 - DNA, 25 bp, Mus musculus
ccactgcccggtatatcatattagt

SEQ ID NO: 338369 - DNA, 25 bp, Mus musculus
ccactgcccggtttatcatattagt

SEQ ID NO: 338370 - DNA, 25 bp, Mus musculus
ccactgccctgtcgttggtgaaaga

SEQ ID NO: 338371 - DNA, 25 bp, Mus musculus
ccactgccctgtggttggtgaaaga

SEQ ID NO: 338372 - DNA, 25 bp, Mus musculus
ccactgccggagctgcagccaggca

SEQ ID NO: 338373 - DNA, 25 bp, Mus musculus
ccactgccggaggtgcagccaggca

SEQ ID NO: 338374 - DNA, 25 bp, Mus musculus
ccactgcctggacctatgcatgatt

SEQ ID NO: 338375 - DNA, 25 bp, Mus musculus
ccactgcctggagctatgcatgatt

SEQ ID NO: 338376 - DNA, 25 bp, Mus musculus
ccactgccttctctatctttaagtt

SEQ ID NO: 338377 - DNA, 25 bp, Mus musculus
ccactgccttctgtatctttaagtt

SEQ ID NO: 338378 - DNA, 25 bp, Mus musculus
ccactgccttgcagtttgagtgtaa

SEQ ID NO: 338379 - DNA, 25 bp, Mus musculus
ccactgccttgctgtttgagtgtaa

SEQ ID NO: 338380 - DNA, 25 bp, Mus musculus
ccactgcgtccacatgagagggctg

SEQ ID NO: 338381 - DNA, 25 bp, Mus musculus
ccactgcgtccagatgagagggctg

SEQ ID NO: 338382 - DNA, 25 bp, Mus musculus
ccactgctaggtctagatatatttt

SEQ ID NO: 338383 - DNA, 25 bp, Mus musculus
ccactgctaggtgtagatatatttt

SEQ ID NO: 338384 - DNA, 25 bp, Mus musculus
ccactgctctgcattctatgtgaaa

SEQ ID NO: 338385 - DNA, 25 bp, Mus musculus
ccactgctctgctttctatgtgaaa

SEQ ID NO: 338386 - DNA, 25 bp, Mus musculus
ccactgctgggtagataatcatttc

SEQ ID NO: 338387 - DNA, 25 bp, Mus musculus
ccactgctgggttgataatcatttc

SEQ ID NO: 338388 - DNA, 25 bp, Mus musculus
ccactgctgtctctacactgtaaat

SEQ ID NO: 338389 - DNA, 25 bp, Mus musculus
ccactgctgtctgtacactgtaaat

SEQ ID NO: 338390 - DNA, 25 bp, Mus musculus
ccactgctgtggatcggcacatgag

SEQ ID NO: 338391 - DNA, 25 bp, Mus musculus
ccactgctgtggttcggcacatgag

SEQ ID NO: 338392 - DNA, 25 bp, Mus musculus
ccactgctgtttctcacatacaggt

SEQ ID NO: 338393 - DNA, 25 bp, Mus musculus
ccactgctgtttgtcacatacaggt

SEQ ID NO: 338394 - DNA, 25 bp, Mus musculus
ccactgcttagcattcagttcatct

SEQ ID NO: 338395 - DNA, 25 bp, Mus musculus
ccactgcttagctttcagttcatct

SEQ ID NO: 338396 - DNA, 25 bp, Mus musculus
ccactgcttcatagactccatgtat

SEQ ID NO: 338397 - DNA, 25 bp, Mus musculus
ccactgcttcattgactccatgtat

SEQ ID NO: 338398 - DNA, 25 bp, Mus musculus
ccactgcttgtgcagctagagcagg

SEQ ID NO: 338399 - DNA, 25 bp, Mus musculus
ccactgcttgtggagctagagcagg

SEQ ID NO: 338400 - DNA, 25 bp, Mus musculus
ccactgctttccatttgacagagca

SEQ ID NO: 338401 - DNA, 25 bp, Mus musculus
ccactgctttccttttgacagagca

SEQ ID NO: 338402 - DNA, 25 bp, Mus musculus
ccactgctttgactccaatttttac

SEQ ID NO: 338403 - DNA, 25 bp, Mus musculus
ccactgctttgagtccaatttttac

SEQ ID NO: 338404 - DNA, 25 bp, Mus musculus
ccactggacagtcttcatcatcctg

SEQ ID NO: 338405 - DNA, 25 bp, Mus musculus
ccactggacagtgttcatcatcctg

SEQ ID NO: 338406 - DNA, 25 bp, Mus musculus
ccactggactctcttctgtttgaga

SEQ ID NO: 338407 - DNA, 25 bp, Mus musculus
ccactggactctgttctgtttgaga

SEQ ID NO: 338408 - DNA, 25 bp, Mus musculus
ccactggaggccactgacagggaaa

SEQ ID NO: 338409 - DNA, 25 bp, Mus musculus
ccactggaggcctctgacagggaaa

SEQ ID NO: 338410 - DNA, 25 bp, Mus musculus
ccactggagtaacaagtaggccctt

SEQ ID NO: 338411 - DNA, 25 bp, Mus musculus
ccactggagtaagaagtaggccctt

SEQ ID NO: 338412 - DNA, 25 bp, Mus musculus
ccactggataaacgatggtgcaccc

SEQ ID NO: 338413 - DNA, 25 bp, Mus musculus
ccactggataaaggatggtgcaccc

SEQ ID NO: 338414 - DNA, 25 bp, Mus musculus
ccactggatcagaatgcgcttgtta

SEQ ID NO: 338415 - DNA, 25 bp, Mus musculus
ccactggatcagtatgcgcttgtta

SEQ ID NO: 338416 - DNA, 25 bp, Mus musculus
ccactggattcacaaatggcaagga

SEQ ID NO: 338417 - DNA, 25 bp, Mus musculus
ccactggattcagaaatggcaagga

SEQ ID NO: 338418 - DNA, 25 bp, Mus musculus
ccactggattctcaacagtaatctt

SEQ ID NO: 338419 - DNA, 25 bp, Mus musculus
ccactggattctgaacagtaatctt

SEQ ID NO: 338420 - DNA, 25 bp, Mus musculus
ccactggccaacaacacatctttgg

SEQ ID NO: 338421 - DNA, 25 bp, Mus musculus
ccactggccaactacacatctttgg

SEQ ID NO: 338422 - DNA, 25 bp, Mus musculus
ccactggcccagacgtcgaggatgc

SEQ ID NO: 338423 - DNA, 25 bp, Mus musculus
ccactggcccagtcgtcgaggatgc

SEQ ID NO: 338424 - DNA, 25 bp, Mus musculus
ccactggctcctctgcaaaggcaga

SEQ ID NO: 338425 - DNA, 25 bp, Mus musculus
ccactggctcctgtgcaaaggcaga

SEQ ID NO: 338426 - DNA, 25 bp, Mus musculus
ccactggcttagaaattctgtgaag

SEQ ID NO: 338427 - DNA, 25 bp, Mus musculus
ccactggcttagtaattctgtgaag

SEQ ID NO: 338428 - DNA, 25 bp, Mus musculus
ccactgggatttcagatcctcagca

SEQ ID NO: 338429 - DNA, 25 bp, Mus musculus
ccactgggatttgagatcctcagca

SEQ ID NO: 338430 - DNA, 25 bp, Mus musculus
ccactgggcaaaccgtttggagcaa

SEQ ID NO: 338431 - DNA, 25 bp, Mus musculus
ccactgggcaaagcgtttggagcaa

SEQ ID NO: 338432 - DNA, 25 bp, Mus musculus
ccactggtctagaacacggctttga

SEQ ID NO: 338433 - DNA, 25 bp, Mus musculus
ccactggtctagtacacggctttga

SEQ ID NO: 338434 - DNA, 25 bp, Mus musculus
ccactggtctatcaggtttcaaatg

SEQ ID NO: 338435 - DNA, 25 bp, Mus musculus
ccactggtctatgaggtttcaaatg

SEQ ID NO: 338436 - DNA, 25 bp, Mus musculus
ccactggtgaagaaggtgcatcaat

SEQ ID NO: 338437 - DNA, 25 bp, Mus musculus
ccactggtgaagtaggtgcatcaat

SEQ ID NO: 338438 - DNA, 25 bp, Mus musculus
ccactggttcttctcttaaggataa

SEQ ID NO: 338439 - DNA, 25 bp, Mus musculus
ccactggttcttgtcttaaggataa

SEQ ID NO: 338440 - DNA, 25 bp, Mus musculus
ccactggttgcgctgttaatgattt

SEQ ID NO: 338441 - DNA, 25 bp, Mus musculus
ccactggttgcggtgttaatgattt

SEQ ID NO: 338442 - DNA, 25 bp, Mus musculus
ccactgtaaccccacaccgtggaag

SEQ ID NO: 338443 - DNA, 25 bp, Mus musculus
ccactgtaacccgacaccgtggaag

SEQ ID NO: 338444 - DNA, 25 bp, Mus musculus
ccactgtacaggctgttcctagtct

SEQ ID NO: 338445 - DNA, 25 bp, Mus musculus
ccactgtacagggtgttcctagtct

SEQ ID NO: 338446 - DNA, 25 bp, Mus musculus
ccactgtagactatgacggtgttac

SEQ ID NO: 338447 - DNA, 25 bp, Mus musculus
ccactgtagactttgacggtgttac

SEQ ID NO: 338448 - DNA, 25 bp, Mus musculus
ccactgtagtgcagaccagagccta

SEQ ID NO: 338449 - DNA, 25 bp, Mus musculus
ccactgtagtgctgaccagagccta

SEQ ID NO: 338450 - DNA, 25 bp, Mus musculus
ccactgtcacaaccttgatcatgtt

SEQ ID NO: 338451 - DNA, 25 bp, Mus musculus
ccactgtcacaagcttgatcatgtt

SEQ ID NO: 338452 - DNA, 25 bp, Mus musculus
ccactgtcaccaatcgagtgtttag

SEQ ID NO: 338453 - DNA, 25 bp, Mus musculus
ccactgtcaccactgattgttgact

SEQ ID NO: 338454 - DNA, 25 bp, Mus musculus
ccactgtcaccagtgattgttgact

SEQ ID NO: 338455 - DNA, 25 bp, Mus musculus
ccactgtcaccattcgagtgtttag

SEQ ID NO: 338456 - DNA, 25 bp, Mus musculus
ccactgtcacccactataattttgt

SEQ ID NO: 338457 - DNA, 25 bp, Mus musculus
ccactgtcaccctctataattttgt

SEQ ID NO: 338458 - DNA, 25 bp, Mus musculus
ccactgtcactaatgcactggcaaa

SEQ ID NO: 338459 - DNA, 25 bp, Mus musculus
ccactgtcactattgcactggcaaa

SEQ ID NO: 338460 - DNA, 25 bp, Mus musculus
ccactgtcccagcttaacaaggtct

SEQ ID NO: 338461 - DNA, 25 bp, Mus musculus
ccactgtcccaggttaacaaggtct

SEQ ID NO: 338462 - DNA, 25 bp, Mus musculus
ccactgtcctctctcctcatgtttt

SEQ ID NO: 338463 - DNA, 25 bp, Mus musculus
ccactgtcctctgtcctcatgtttt

SEQ ID NO: 338464 - DNA, 25 bp, Mus musculus
ccactgtctagcagctcatatgtac

SEQ ID NO: 338465 - DNA, 25 bp, Mus musculus
ccactgtctagctgctcatatgtac

SEQ ID NO: 338466 - DNA, 25 bp, Mus musculus
ccactgtctggcatcattatcaaaa

SEQ ID NO: 338467 - DNA, 25 bp, Mus musculus
ccactgtctggcttcattatcaaaa

SEQ ID NO: 338468 - DNA, 25 bp, Mus musculus
ccactgtcttgtagcgatggagcca

SEQ ID NO: 338469 - DNA, 25 bp, Mus musculus
ccactgtcttgttgcgatggagcca

SEQ ID NO: 338470 - DNA, 25 bp, Mus musculus
ccactgtgagctcggatggtgacaa

SEQ ID NO: 338471 - DNA, 25 bp, Mus musculus
ccactgtgagctgggatggtgacaa

SEQ ID NO: 338472 - DNA, 25 bp, Mus musculus
ccactgtgcaataagacccttttac

SEQ ID NO: 338473 - DNA, 25 bp, Mus musculus
ccactgtgcaattagacccttttac

SEQ ID NO: 338474 - DNA, 25 bp, Mus musculus
ccactgtgcactcgcatccagagaa

SEQ ID NO: 338475 - DNA, 25 bp, Mus musculus
ccactgtgcactggcatccagagaa

SEQ ID NO: 338476 - DNA, 25 bp, Mus musculus
ccactgtgggaccagcttgtgtcag

SEQ ID NO: 338477 - DNA, 25 bp, Mus musculus
ccactgtgggacgagcttgtgtcag

SEQ ID NO: 338478 - DNA, 25 bp, Mus musculus
ccactgtggtggcatattgtgacca

SEQ ID NO: 338479 - DNA, 25 bp, Mus musculus
ccactgtggtgggatattgtgacca

SEQ ID NO: 338480 - DNA, 25 bp, Mus musculus
ccactgtgtaacatctgggaactta

SEQ ID NO: 338481 - DNA, 25 bp, Mus musculus
ccactgtgtaacttctgggaactta

SEQ ID NO: 338482 - DNA, 25 bp, Mus musculus
ccactgtgtcatataaagtcagttt

SEQ ID NO: 338483 - DNA, 25 bp, Mus musculus
ccactgtgtcatttaaagtcagttt

SEQ ID NO: 338484 - DNA, 25 bp, Mus musculus
ccactgttatctaggtgcctggtag

SEQ ID NO: 338485 - DNA, 25 bp, Mus musculus
ccactgttatcttggtgcctggtag

SEQ ID NO: 338486 - DNA, 25 bp, Mus musculus
ccactgttcctgctgtcactttaaa

SEQ ID NO: 338487 - DNA, 25 bp, Mus musculus
ccactgttcctggtgtcactttaaa

SEQ ID NO: 338488 - DNA, 25 bp, Mus musculus
ccactgttcgctcttgtagtagtta

SEQ ID NO: 338489 - DNA, 25 bp, Mus musculus
ccactgttcgctgttgtagtagtta

SEQ ID NO: 338490 - DNA, 25 bp, Mus musculus
ccactgttctgtccaggaacttgtt

SEQ ID NO: 338491 - DNA, 25 bp, Mus musculus
ccactgttctgtgcaggaacttgtt

SEQ ID NO: 338492 - DNA, 25 bp, Mus musculus
ccactgttgtttaatcacataccta

SEQ ID NO: 338493 - DNA, 25 bp, Mus musculus
ccactgttgttttatcacataccta

SEQ ID NO: 338494 - DNA, 25 bp, Mus musculus
ccactgtttctacgccgtcattgaa

SEQ ID NO: 338495 - DNA, 25 bp, Mus musculus
ccactgtttctaggccgtcattgaa

SEQ ID NO: 338496 - DNA, 25 bp, Mus musculus
ccactgtttgtgacctgtgtgggca

SEQ ID NO: 338497 - DNA, 25 bp, Mus musculus
ccactgtttgtgtcctgtgtgggca

SEQ ID NO: 338498 - DNA, 25 bp, Mus musculus
ccactgtttgttcggtaataaatgg

SEQ ID NO: 338499 - DNA, 25 bp, Mus musculus
ccactgtttgttgggtaataaatgg

SEQ ID NO: 338500 - DNA, 25 bp, Mus musculus
ccactgttttctcagctcttttatg

SEQ ID NO: 338501 - DNA, 25 bp, Mus musculus
ccactgttttctgagctcttttatg

SEQ ID NO: 338502 - DNA, 25 bp, Mus musculus
ccacttaacctcagggaaggacatg

SEQ ID NO: 338503 - DNA, 25 bp, Mus musculus
ccacttaacctctgggaaggacatg

SEQ ID NO: 338504 - DNA, 25 bp, Mus musculus
ccacttaatctcaggcacccaggtt

SEQ ID NO: 338505 - DNA, 25 bp, Mus musculus
ccacttaatctctggcacccaggtt

SEQ ID NO: 338506 - DNA, 25 bp, Mus musculus
ccacttacttgacgattccgcagat

SEQ ID NO: 338507 - DNA, 25 bp, Mus musculus
ccacttacttgaggattccgcagat

SEQ ID NO: 338508 - DNA, 25 bp, Mus musculus
ccacttagaggaactacgattggaa

SEQ ID NO: 338509 - DNA, 25 bp, Mus musculus
ccacttagaggatctacgattggaa

SEQ ID NO: 338510 - DNA, 25 bp, Mus musculus
ccacttagatttcgccttagacgtc

SEQ ID NO: 338511 - DNA, 25 bp, Mus musculus
ccacttagatttggccttagacgtc

SEQ ID NO: 338512 - DNA, 25 bp, Mus musculus
ccacttagcttcaaggaccctcatt

SEQ ID NO: 338513 - DNA, 25 bp, Mus musculus
ccacttagcttcatcctgacagaaa

SEQ ID NO: 338514 - DNA, 25 bp, Mus musculus
ccacttagcttctaggaccctcatt

SEQ ID NO: 338515 - DNA, 25 bp, Mus musculus
ccacttagcttcttcctgacagaaa

SEQ ID NO: 338516 - DNA, 25 bp, Mus musculus
ccacttagtttcagacatcttgcta

SEQ ID NO: 338517 - DNA, 25 bp, Mus musculus
ccacttagtttctgacatcttgcta

SEQ ID NO: 338518 - DNA, 25 bp, Mus musculus
ccacttatatccctaaatgagtata

SEQ ID NO: 338519 - DNA, 25 bp, Mus musculus
ccacttatatccgtaaatgagtata

SEQ ID NO: 338520 - DNA, 25 bp, Mus musculus
ccacttatctacctgaacactgcaa

SEQ ID NO: 338521 - DNA, 25 bp, Mus musculus
ccacttatctacgtgaacactgcaa

SEQ ID NO: 338522 - DNA, 25 bp, Mus musculus
ccacttatctgtaatgccatcttgc

SEQ ID NO: 338523 - DNA, 25 bp, Mus musculus
ccacttatctgttatgccatcttgc

SEQ ID NO: 338524 - DNA, 25 bp, Mus musculus
ccacttatgtgacttcattgagacg

SEQ ID NO: 338525 - DNA, 25 bp, Mus musculus
ccacttatgtgagttcattgagacg

SEQ ID NO: 338526 - DNA, 25 bp, Mus musculus
ccacttattgccacgttcgtaagaa

SEQ ID NO: 338527 - DNA, 25 bp, Mus musculus
ccacttattgcctcgttcgtaagaa

SEQ ID NO: 338528 - DNA, 25 bp, Mus musculus
ccacttcaaatcagggtccttggag

SEQ ID NO: 338529 - DNA, 25 bp, Mus musculus
ccacttcaaatctgggtccttggag

SEQ ID NO: 338530 - DNA, 25 bp, Mus musculus
ccacttcaacacatatgcatctttc

SEQ ID NO: 338531 - DNA, 25 bp, Mus musculus
ccacttcaacacttatgcatctttc

SEQ ID NO: 338532 - DNA, 25 bp, Mus musculus
ccacttcacaggacatcaaacacaa

SEQ ID NO: 338533 - DNA, 25 bp, Mus musculus
ccacttcacaggtcatcaaacacaa

SEQ ID NO: 338534 - DNA, 25 bp, Mus musculus
ccacttcactaaagctctgactgta

SEQ ID NO: 338535 - DNA, 25 bp, Mus musculus
ccacttcactaatgctctgactgta

SEQ ID NO: 338536 - DNA, 25 bp, Mus musculus
ccacttcagaagctgggcctgagct

SEQ ID NO: 338537 - DNA, 25 bp, Mus musculus
ccacttcagaaggtgggcctgagct

SEQ ID NO: 338538 - DNA, 25 bp, Mus musculus
ccacttcagtcaccctgtgaacaga

SEQ ID NO: 338539 - DNA, 25 bp, Mus musculus
ccacttcagtcagcctgtgaacaga

SEQ ID NO: 338540 - DNA, 25 bp, Mus musculus
ccacttcataccaggcatggtttaa

SEQ ID NO: 338541 - DNA, 25 bp, Mus musculus
ccacttcatacctggcatggtttaa

SEQ ID NO: 338542 - DNA, 25 bp, Mus musculus
ccacttcatatgctcctttcagttt

SEQ ID NO: 338543 - DNA, 25 bp, Mus musculus
ccacttcatatggtcctttcagttt

SEQ ID NO: 338544 - DNA, 25 bp, Mus musculus
ccacttcatgccataggaggctgaa

SEQ ID NO: 338545 - DNA, 25 bp, Mus musculus
ccacttcatgccttaggaggctgaa

SEQ ID NO: 338546 - DNA, 25 bp, Mus musculus
ccacttccaattagtaaaacagtat

SEQ ID NO: 338547 - DNA, 25 bp, Mus musculus
ccacttccaatttgtaaaacagtat

SEQ ID NO: 338548 - DNA, 25 bp, Mus musculus
ccacttccatttactgattgaacta

SEQ ID NO: 338549 - DNA, 25 bp, Mus musculus
ccacttccattttctgattgaacta

SEQ ID NO: 338550 - DNA, 25 bp, Mus musculus
ccacttcccagaactctagtatatt

SEQ ID NO: 338551 - DNA, 25 bp, Mus musculus
ccacttcccagatctctagtatatt

SEQ ID NO: 338552 - DNA, 25 bp, Mus musculus
ccacttcccagtcttggtgctgtag

SEQ ID NO: 338553 - DNA, 25 bp, Mus musculus
ccacttcccagtgttggtgctgtag

SEQ ID NO: 338554 - DNA, 25 bp, Mus musculus
ccacttccgcaaattttgaaatgcc

SEQ ID NO: 338555 - DNA, 25 bp, Mus musculus
ccacttccgcaatttttgaaatgcc

SEQ ID NO: 338556 - DNA, 25 bp, Mus musculus
ccacttcctcctataaaatgtccat

SEQ ID NO: 338557 - DNA, 25 bp, Mus musculus
ccacttcctcctttaaaatgtccat

SEQ ID NO: 338558 - DNA, 25 bp, Mus musculus
ccacttccttgtctctgaaattaga

SEQ ID NO: 338559 - DNA, 25 bp, Mus musculus
ccacttccttgtgtctgaaattaga

SEQ ID NO: 338560 - DNA, 25 bp, Mus musculus
ccacttcggagtcgtgaatgtctgc

SEQ ID NO: 338561 - DNA, 25 bp, Mus musculus
ccacttcggagtggtgaatgtctgc

SEQ ID NO: 338562 - DNA, 25 bp, Mus musculus
ccacttctcaggataatggacactg

SEQ ID NO: 338563 - DNA, 25 bp, Mus musculus
ccacttctcaggttaatggacactg

SEQ ID NO: 338564 - DNA, 25 bp, Mus musculus
ccacttctcattatactcaaaactg

SEQ ID NO: 338565 - DNA, 25 bp, Mus musculus
ccacttctcattttactcaaaactg

SEQ ID NO: 338566 - DNA, 25 bp, Mus musculus
ccacttctcccacaatgtaacattg

SEQ ID NO: 338567 - DNA, 25 bp, Mus musculus
ccacttctcccagaatgtaacattg

SEQ ID NO: 338568 - DNA, 25 bp, Mus musculus
ccacttctctgacgcggaggactga

SEQ ID NO: 338569 - DNA, 25 bp, Mus musculus
ccacttctctgaggcggaggactga

SEQ ID NO: 338570 - DNA, 25 bp, Mus musculus
ccacttcttgccactactggaaaga

SEQ ID NO: 338571 - DNA, 25 bp, Mus musculus
ccacttcttgcctctactggaaaga

SEQ ID NO: 338572 - DNA, 25 bp, Mus musculus
ccacttgaacttagcaggggactga

SEQ ID NO: 338573 - DNA, 25 bp, Mus musculus
ccacttgaactttgcaggggactga

SEQ ID NO: 338574 - DNA, 25 bp, Mus musculus
ccacttgaagctcactcaatatcct

SEQ ID NO: 338575 - DNA, 25 bp, Mus musculus
ccacttgaagctgactcaatatcct

SEQ ID NO: 338576 - DNA, 25 bp, Mus musculus
ccacttgaatttaaacgttgattat

SEQ ID NO: 338577 - DNA, 25 bp, Mus musculus
ccacttgaattttaacgttgattat

SEQ ID NO: 338578 - DNA, 25 bp, Mus musculus
ccacttgacactcactgttgggaag

SEQ ID NO: 338579 - DNA, 25 bp, Mus musculus
ccacttgacactgactgttgggaag

SEQ ID NO: 338580 - DNA, 25 bp, Mus musculus
ccacttgaccaaatacccgaatctt

SEQ ID NO: 338581 - DNA, 25 bp, Mus musculus
ccacttgaccaattacccgaatctt

SEQ ID NO: 338582 - DNA, 25 bp, Mus musculus
ccacttgactttagcactgactaca

SEQ ID NO: 338583 - DNA, 25 bp, Mus musculus
ccacttgacttttgcactgactaca

SEQ ID NO: 338584 - DNA, 25 bp, Mus musculus
ccacttgatcttaacacctgttttg

SEQ ID NO: 338585 - DNA, 25 bp, Mus musculus
ccacttgatctttacacctgttttg

SEQ ID NO: 338586 - DNA, 25 bp, Mus musculus
ccacttgcctggcagcctgaaagcg

SEQ ID NO: 338587 - DNA, 25 bp, Mus musculus
ccacttgcctgggagcctgaaagcg

SEQ ID NO: 338588 - DNA, 25 bp, Mus musculus
ccacttgctcccaatggagctgaag

SEQ ID NO: 338589 - DNA, 25 bp, Mus musculus
ccacttgctccctatggagctgaag

SEQ ID NO: 338590 - DNA, 25 bp, Mus musculus
ccacttgctgtcacactcataaatg

SEQ ID NO: 338591 - DNA, 25 bp, Mus musculus
ccacttgctgtctcactcataaatg

SEQ ID NO: 338592 - DNA, 25 bp, Mus musculus
ccacttgcttcgatagcttctatca

SEQ ID NO: 338593 - DNA, 25 bp, Mus musculus
ccacttgcttcgttagcttctatca

SEQ ID NO: 338594 - DNA, 25 bp, Mus musculus
ccacttggaagcattggcagccatt

SEQ ID NO: 338595 - DNA, 25 bp, Mus musculus
ccacttggaagctttggcagccatt

SEQ ID NO: 338596 - DNA, 25 bp, Mus musculus
ccacttggagctatatgggcagagc

SEQ ID NO: 338597 - DNA, 25 bp, Mus musculus
ccacttggagctttatgggcagagc

SEQ ID NO: 338598 - DNA, 25 bp, Mus musculus
ccacttggcaatagtgcctccattg

SEQ ID NO: 338599 - DNA, 25 bp, Mus musculus
ccacttggcaattgtgcctccattg

SEQ ID NO: 338600 - DNA, 25 bp, Mus musculus
ccacttggctctattgctgacgggc

SEQ ID NO: 338601 - DNA, 25 bp, Mus musculus
ccacttggctcttttgctgacgggc

SEQ ID NO: 338602 - DNA, 25 bp, Mus musculus
ccacttgtaaatatgctaagggtat

SEQ ID NO: 338603 - DNA, 25 bp, Mus musculus
ccacttgtaaatttgctaagggtat

SEQ ID NO: 338604 - DNA, 25 bp, Mus musculus
ccacttgtgccgactgccgtgttag

SEQ ID NO: 338605 - DNA, 25 bp, Mus musculus
ccacttgtgccgtctgccgtgttag

SEQ ID NO: 338606 - DNA, 25 bp, Mus musculus
ccacttgtggttaccatgtcactaa

SEQ ID NO: 338607 - DNA, 25 bp, Mus musculus
ccacttgtggtttccatgtcactaa

SEQ ID NO: 338608 - DNA, 25 bp, Mus musculus
ccacttgtgtctaaccaggacacca

SEQ ID NO: 338609 - DNA, 25 bp, Mus musculus
ccacttgtgtcttaccaggacacca

SEQ ID NO: 338610 - DNA, 25 bp, Mus musculus
ccactttcaaataggtcactgtact

SEQ ID NO: 338611 - DNA, 25 bp, Mus musculus
ccactttcaaattggtcactgtact

SEQ ID NO: 338612 - DNA, 25 bp, Mus musculus
ccactttcaccccaggaggaatctt

SEQ ID NO: 338613 - DNA, 25 bp, Mus musculus
ccactttcacccgaggaggaatctt

SEQ ID NO: 338614 - DNA, 25 bp, Mus musculus
ccactttcagtaaactccttgctgt

SEQ ID NO: 338615 - DNA, 25 bp, Mus musculus
ccactttcagtatactccttgctgt

SEQ ID NO: 338616 - DNA, 25 bp, Mus musculus
ccactttcatgaccttcctacagtg

SEQ ID NO: 338617 - DNA, 25 bp, Mus musculus
ccactttcatgagcttcctacagtg

SEQ ID NO: 338618 - DNA, 25 bp, Mus musculus
ccactttccaccagtttggtggtct

SEQ ID NO: 338619 - DNA, 25 bp, Mus musculus
ccactttccacctgtttggtggtct

SEQ ID NO: 338620 - DNA, 25 bp, Mus musculus
ccactttccatacagaattcacaga

SEQ ID NO: 338621 - DNA, 25 bp, Mus musculus
ccactttccatagagaattcacaga

SEQ ID NO: 338622 - DNA, 25 bp, Mus musculus
ccactttcgtacctcatgtttttat

SEQ ID NO: 338623 - DNA, 25 bp, Mus musculus
ccactttcgtacgtcatgtttttat

SEQ ID NO: 338624 - DNA, 25 bp, Mus musculus
ccactttctagactatactactaac

SEQ ID NO: 338625 - DNA, 25 bp, Mus musculus
ccactttctagagtatactactaac

SEQ ID NO: 338626 - DNA, 25 bp, Mus musculus
ccactttctctcatcactgaggtaa

SEQ ID NO: 338627 - DNA, 25 bp, Mus musculus
ccactttctctcttcactgaggtaa

SEQ ID NO: 338628 - DNA, 25 bp, Mus musculus
ccactttctgacaggtgtgtctgcc

SEQ ID NO: 338629 - DNA, 25 bp, Mus musculus
ccactttctgactggtgtgtctgcc

SEQ ID NO: 338630 - DNA, 25 bp, Mus musculus
ccactttgaaggcagcagctgatca

SEQ ID NO: 338631 - DNA, 25 bp, Mus musculus
ccactttgaagggagcagctgatca

SEQ ID NO: 338632 - DNA, 25 bp, Mus musculus
ccactttgcacacctttaccaggaa

SEQ ID NO: 338633 - DNA, 25 bp, Mus musculus
ccactttgcacagctttaccaggaa

SEQ ID NO: 338634 - DNA, 25 bp, Mus musculus
ccactttggcctacaactgatttac

SEQ ID NO: 338635 - DNA, 25 bp, Mus musculus
ccactttggccttcaactgatttac

SEQ ID NO: 338636 - DNA, 25 bp, Mus musculus
ccacttttagctcgagtgggaatcc

SEQ ID NO: 338637 - DNA, 25 bp, Mus musculus
ccacttttagctggagtgggaatcc

SEQ ID NO: 338638 - DNA, 25 bp, Mus musculus
ccacttttatgtattgaatagtttt

SEQ ID NO: 338639 - DNA, 25 bp, Mus musculus
ccacttttatgttttgaatagtttt

SEQ ID NO: 338640 - DNA, 25 bp, Mus musculus
ccacttttcaaacatgcttcctaaa

SEQ ID NO: 338641 - DNA, 25 bp, Mus musculus
ccacttttcaaagatgcttcctaaa

SEQ ID NO: 338642 - DNA, 25 bp, Mus musculus
ccacttttcattctgtactgtcgag

SEQ ID NO: 338643 - DNA, 25 bp, Mus musculus
ccacttttcattgtgtactgtcgag

SEQ ID NO: 338644 - DNA, 25 bp, Mus musculus
ccacttttggaaccgactgtgtaaa

SEQ ID NO: 338645 - DNA, 25 bp, Mus musculus
ccacttttggaagcgactgtgtaaa

SEQ ID NO: 338646 - DNA, 25 bp, Mus musculus
ccacttttgtaactgcccctaagag

SEQ ID NO: 338647 - DNA, 25 bp, Mus musculus
ccacttttgtaagtgcccctaagag

SEQ ID NO: 338648 - DNA, 25 bp, Mus musculus
ccacttttgtttcaccttatgctgt

SEQ ID NO: 338649 - DNA, 25 bp, Mus musculus
ccacttttgtttgaccttatgctgt

SEQ ID NO: 338650 - DNA, 25 bp, Mus musculus
ccagaaaagatacccaaggtcaact

SEQ ID NO: 338651 - DNA, 25 bp, Mus musculus
ccagaaaagatagccaaggtcaact

SEQ ID NO: 338652 - DNA, 25 bp, Mus musculus
ccagaaaagcgtcgaagcctgtgtg

SEQ ID NO: 338653 - DNA, 25 bp, Mus musculus
ccagaaaagcgtggaagcctgtgtg

SEQ ID NO: 338654 - DNA, 25 bp, Mus musculus
ccagaaaattccagcttacagagga

SEQ ID NO: 338655 - DNA, 25 bp, Mus musculus
ccagaaaattcctgcttacagagga

SEQ ID NO: 338656 - DNA, 25 bp, Mus musculus
ccagaaaatttcctgctgtggttgc

SEQ ID NO: 338657 - DNA, 25 bp, Mus musculus
ccagaaaatttcgtgctgtggttgc

SEQ ID NO: 338658 - DNA, 25 bp, Mus musculus
ccagaaacagaaacagagcacccat

SEQ ID NO: 338659 - DNA, 25 bp, Mus musculus
ccagaaacagaatcagagcacccat

SEQ ID NO: 338660 - DNA, 25 bp, Mus musculus
ccagaaagatgccttggaacccggg

SEQ ID NO: 338661 - DNA, 25 bp, Mus musculus
ccagaaagatgcgttggaacccggg

SEQ ID NO: 338662 - DNA, 25 bp, Mus musculus
ccagaaagctgacggccatcaaggc

SEQ ID NO: 338663 - DNA, 25 bp, Mus musculus
ccagaaagctgagggccatcaaggc

SEQ ID NO: 338664 - DNA, 25 bp, Mus musculus
ccagaaaggaagatggcgccctgaa

SEQ ID NO: 338665 - DNA, 25 bp, Mus musculus
ccagaaaggaagttggcgccctgaa

SEQ ID NO: 338666 - DNA, 25 bp, Mus musculus
ccagaaaggactctttctccctgag

SEQ ID NO: 338667 - DNA, 25 bp, Mus musculus
ccagaaaggactgtttctccctgag

SEQ ID NO: 338668 - DNA, 25 bp, Mus musculus
ccagaaaggattcaggatcaacatt

SEQ ID NO: 338669 - DNA, 25 bp, Mus musculus
ccagaaaggattgaggatcaacatt

SEQ ID NO: 338670 - DNA, 25 bp, Mus musculus
ccagaaatagctcgctgtatgaggg

SEQ ID NO: 338671 - DNA, 25 bp, Mus musculus
ccagaaatagctggctgtatgaggg

SEQ ID NO: 338672 - DNA, 25 bp, Mus musculus
ccagaaatcctaccgataagcccat

SEQ ID NO: 338673 - DNA, 25 bp, Mus musculus
ccagaaatcctagcgataagcccat

SEQ ID NO: 338674 - DNA, 25 bp, Mus musculus
ccagaaatcgacatcctgctgaggt

SEQ ID NO: 338675 - DNA, 25 bp, Mus musculus
ccagaaatcgacttcctgctgaggt

SEQ ID NO: 338676 - DNA, 25 bp, Mus musculus
ccagaaatgagtctctttttacttt

SEQ ID NO: 338677 - DNA, 25 bp, Mus musculus
ccagaaatgagtgtctttttacttt

SEQ ID NO: 338678 - DNA, 25 bp, Mus musculus
ccagaaatgcccagtttggtcatac

SEQ ID NO: 338679 - DNA, 25 bp, Mus musculus
ccagaaatgccctgtttggtcatac

SEQ ID NO: 338680 - DNA, 25 bp, Mus musculus
ccagaaatggccagttgatgtacaa

SEQ ID NO: 338681 - DNA, 25 bp, Mus musculus
ccagaaatggcctgttgatgtacaa

SEQ ID NO: 338682 - DNA, 25 bp, Mus musculus
ccagaaatgtccctgctgaggtgca

SEQ ID NO: 338683 - DNA, 25 bp, Mus musculus
ccagaaatgtccgtgctgaggtgca

SEQ ID NO: 338684 - DNA, 25 bp, Mus musculus
ccagaacatctgcaatcaagtttca

SEQ ID NO: 338685 - DNA, 25 bp, Mus musculus
ccagaacatctggaatcaagtttca

SEQ ID NO: 338686 - DNA, 25 bp, Mus musculus
ccagaaccactacatatccaatcat

SEQ ID NO: 338687 - DNA, 25 bp, Mus musculus
ccagaaccactagatatccaatcat

SEQ ID NO: 338688 - DNA, 25 bp, Mus musculus
ccagaaccattcataagttatcagt

SEQ ID NO: 338689 - DNA, 25 bp, Mus musculus
ccagaaccattcttaagttatcagt

SEQ ID NO: 338690 - DNA, 25 bp, Mus musculus
ccagaacccagcatgttaatcaaaa

SEQ ID NO: 338691 - DNA, 25 bp, Mus musculus
ccagaacccagcttgttaatcaaaa

SEQ ID NO: 338692 - DNA, 25 bp, Mus musculus
ccagaaccgaggaggcgacagctgc

SEQ ID NO: 338693 - DNA, 25 bp, Mus musculus
ccagaaccgaggtggcgacagctgc

SEQ ID NO: 338694 - DNA, 25 bp, Mus musculus
ccagaacctgaaatgagagcgcaca

SEQ ID NO: 338695 - DNA, 25 bp, Mus musculus
ccagaacctgaattgagagcgcaca

SEQ ID NO: 338696 - DNA, 25 bp, Mus musculus
ccagaacctggtatttatgtataag

SEQ ID NO: 338697 - DNA, 25 bp, Mus musculus
ccagaacctggtttttatgtataag

SEQ ID NO: 338698 - DNA, 25 bp, Mus musculus
ccagaaccttagacatttgggctct

SEQ ID NO: 338699 - DNA, 25 bp, Mus musculus
ccagaaccttagtcatttgggctct

SEQ ID NO: 338700 - DNA, 25 bp, Mus musculus
ccagaactcatcacgggtggtttac

SEQ ID NO: 338701 - DNA, 25 bp, Mus musculus
ccagaactcatccttttgttttctt

SEQ ID NO: 338702 - DNA, 25 bp, Mus musculus
ccagaactcatcgttttgttttctt

SEQ ID NO: 338703 - DNA, 25 bp, Mus musculus
ccagaactcatctcgggtggtttac

SEQ ID NO: 338704 - DNA, 25 bp, Mus musculus
ccagaactccctccaacagaggaag

SEQ ID NO: 338705 - DNA, 25 bp, Mus musculus
ccagaactccctgcaacagaggaag

SEQ ID NO: 338706 - DNA, 25 bp, Mus musculus
ccagaactctatcctgcttatgttg

SEQ ID NO: 338707 - DNA, 25 bp, Mus musculus
ccagaactctatgctgcttatgttg

SEQ ID NO: 338708 - DNA, 25 bp, Mus musculus
ccagaactctggatactattttgac

SEQ ID NO: 338709 - DNA, 25 bp, Mus musculus
ccagaactctggttactattttgac

SEQ ID NO: 338710 - DNA, 25 bp, Mus musculus
ccagaactgcggctcgcggtaataa

SEQ ID NO: 338711 - DNA, 25 bp, Mus musculus
ccagaactgcgggtcgcggtaataa

SEQ ID NO: 338712 - DNA, 25 bp, Mus musculus
ccagaactgctgctctactgttatc

SEQ ID NO: 338713 - DNA, 25 bp, Mus musculus
ccagaactgctggtctactgttatc

SEQ ID NO: 338714 - DNA, 25 bp, Mus musculus
ccagaactggccagctagagaccgt

SEQ ID NO: 338715 - DNA, 25 bp, Mus musculus
ccagaactggcctgctagagaccgt

SEQ ID NO: 338716 - DNA, 25 bp, Mus musculus
ccagaacttgtgaaggacggctcca

SEQ ID NO: 338717 - DNA, 25 bp, Mus musculus
ccagaacttgtgtaggacggctcca

SEQ ID NO: 338718 - DNA, 25 bp, Mus musculus
ccagaagaacaacagagcccacgat

SEQ ID NO: 338719 - DNA, 25 bp, Mus musculus
ccagaagaacaagagagcccacgat

SEQ ID NO: 338720 - DNA, 25 bp, Mus musculus
ccagaagaagtgcaatcacgtgaat

SEQ ID NO: 338721 - DNA, 25 bp, Mus musculus
ccagaagaagtggaatcacgtgaat

SEQ ID NO: 338722 - DNA, 25 bp, Mus musculus
ccagaagagttcaccacaggcagat

SEQ ID NO: 338723 - DNA, 25 bp, Mus musculus
ccagaagagttctccacaggcagat

SEQ ID NO: 338724 - DNA, 25 bp, Mus musculus
ccagaagatgtcacaccttgtttcc

SEQ ID NO: 338725 - DNA, 25 bp, Mus musculus
ccagaagatgtctcaccttgtttcc

SEQ ID NO: 338726 - DNA, 25 bp, Mus musculus
ccagaagatttcagtatagcagata

SEQ ID NO: 338727 - DNA, 25 bp, Mus musculus
ccagaagatttctgtatagcagata

SEQ ID NO: 338728 - DNA, 25 bp, Mus musculus
ccagaagcaatcacggccatactta

SEQ ID NO: 338729 - DNA, 25 bp, Mus musculus
ccagaagcaatctcggccatactta

SEQ ID NO: 338730 - DNA, 25 bp, Mus musculus
ccagaagcatctctgcctgtaactt

SEQ ID NO: 338731 - DNA, 25 bp, Mus musculus
ccagaagcatctgtgcctgtaactt

SEQ ID NO: 338732 - DNA, 25 bp, Mus musculus
ccagaagccaggatggatgtcctat

SEQ ID NO: 338733 - DNA, 25 bp, Mus musculus
ccagaagccaggttggatgtcctat

SEQ ID NO: 338734 - DNA, 25 bp, Mus musculus
ccagaagcttatcttgtgacccatt

SEQ ID NO: 338735 - DNA, 25 bp, Mus musculus
ccagaagcttatgttgtgacccatt

SEQ ID NO: 338736 - DNA, 25 bp, Mus musculus
ccagaagcttccatttgggcgagga

SEQ ID NO: 338737 - DNA, 25 bp, Mus musculus
ccagaagcttccttttgggcgagga

SEQ ID NO: 338738 - DNA, 25 bp, Mus musculus
ccagaaggatgccgcagaccattat

SEQ ID NO: 338739 - DNA, 25 bp, Mus musculus
ccagaaggatgcggcagaccattat

SEQ ID NO: 338740 - DNA, 25 bp, Mus musculus
ccagaagggcctagggctctgccat

SEQ ID NO: 338741 - DNA, 25 bp, Mus musculus
ccagaagggccttgggctctgccat

SEQ ID NO: 338742 - DNA, 25 bp, Mus musculus
ccagaagtctctcctgtagtctata

SEQ ID NO: 338743 - DNA, 25 bp, Mus musculus
ccagaagtctctgctgtagtctata

SEQ ID NO: 338744 - DNA, 25 bp, Mus musculus
ccagaagtgaccagcctccctgtgg

SEQ ID NO: 338745 - DNA, 25 bp, Mus musculus
ccagaagtgacctgcctccctgtgg

SEQ ID NO: 338746 - DNA, 25 bp, Mus musculus
ccagaatagaaaagatcctcccctc

SEQ ID NO: 338747 - DNA, 25 bp, Mus musculus
ccagaatagaaatgatcctcccctc

SEQ ID NO: 338748 - DNA, 25 bp, Mus musculus
ccagaatatcatctggctcaggctt

SEQ ID NO: 338749 - DNA, 25 bp, Mus musculus
ccagaatatcatgtggctcaggctt

SEQ ID NO: 338750 - DNA, 25 bp, Mus musculus
ccagaatccactactgctcgatcat

SEQ ID NO: 338751 - DNA, 25 bp, Mus musculus
ccagaatccacttctgctcgatcat

SEQ ID NO: 338752 - DNA, 25 bp, Mus musculus
ccagaatccagcatgtattttccca

SEQ ID NO: 338753 - DNA, 25 bp, Mus musculus
ccagaatccagcttgtattttccca

SEQ ID NO: 338754 - DNA, 25 bp, Mus musculus
ccagaatccctgctggagacccagt

SEQ ID NO: 338755 - DNA, 25 bp, Mus musculus
ccagaatccctggtggagacccagt

SEQ ID NO: 338756 - DNA, 25 bp, Mus musculus
ccagaatcctggaaggcctgtgtat

SEQ ID NO: 338757 - DNA, 25 bp, Mus musculus
ccagaatcctggtaggcctgtgtat

SEQ ID NO: 338758 - DNA, 25 bp, Mus musculus
ccagaatcgaataaaactgtgactg

SEQ ID NO: 338759 - DNA, 25 bp, Mus musculus
ccagaatcgaattaaactgtgactg

SEQ ID NO: 338760 - DNA, 25 bp, Mus musculus
ccagaatcggcgcactaagcagaag

SEQ ID NO: 338761 - DNA, 25 bp, Mus musculus
ccagaatcggcggactaagcagaag

SEQ ID NO: 338762 - DNA, 25 bp, Mus musculus
ccagaatctgatctctctatcgcac

SEQ ID NO: 338763 - DNA, 25 bp, Mus musculus
ccagaatctgatgtctctatcgcac

SEQ ID NO: 338764 - DNA, 25 bp, Mus musculus
ccagaatgctggctattacttcggg

SEQ ID NO: 338765 - DNA, 25 bp, Mus musculus
ccagaatgctgggtattacttcggg

SEQ ID NO: 338766 - DNA, 25 bp, Mus musculus
ccagaatggcccagaactctatctt

SEQ ID NO: 338767 - DNA, 25 bp, Mus musculus
ccagaatggccctgaactctatctt

SEQ ID NO: 338768 - DNA, 25 bp, Mus musculus
ccagaatgggccaacggaaagaaag

SEQ ID NO: 338769 - DNA, 25 bp, Mus musculus
ccagaatgggcctacggaaagaaag

SEQ ID NO: 338770 - DNA, 25 bp, Mus musculus
ccagaatgtccaccccatgcgaagg

SEQ ID NO: 338771 - DNA, 25 bp, Mus musculus
ccagaatgtccagcccatgcgaagg

SEQ ID NO: 338772 - DNA, 25 bp, Mus musculus
ccagaattgcatccaacgcaggcag

SEQ ID NO: 338773 - DNA, 25 bp, Mus musculus
ccagaattgcatgcaacgcaggcag

SEQ ID NO: 338774 - DNA, 25 bp, Mus musculus
ccagaattggccaagggagggttat

SEQ ID NO: 338775 - DNA, 25 bp, Mus musculus
ccagaattggcctagggagggttat

SEQ ID NO: 338776 - DNA, 25 bp, Mus musculus
ccagaatttcttcgtcatttttcca

SEQ ID NO: 338777 - DNA, 25 bp, Mus musculus
ccagaatttcttggtcatttttcca

SEQ ID NO: 338778 - DNA, 25 bp, Mus musculus
ccagacaaagagaccctgaacctgt

SEQ ID NO: 338779 - DNA, 25 bp, Mus musculus
ccagacaaagagtccctgaacctgt

SEQ ID NO: 338780 - DNA, 25 bp, Mus musculus
ccagacaaccgactcctgcaggatt

SEQ ID NO: 338781 - DNA, 25 bp, Mus musculus
ccagacaaccgagtcctgcaggatt

SEQ ID NO: 338782 - DNA, 25 bp, Mus musculus
ccagacaaccgtcgctgtgctgagg

SEQ ID NO: 338783 - DNA, 25 bp, Mus musculus
ccagacaaccgtggctgtgctgagg

SEQ ID NO: 338784 - DNA, 25 bp, Mus musculus
ccagacaccgtacaggactcgcgtg

SEQ ID NO: 338785 - DNA, 25 bp, Mus musculus
ccagacaccgtagaggactcgcgtg

SEQ ID NO: 338786 - DNA, 25 bp, Mus musculus
ccagacacctcaagtatacaccata

SEQ ID NO: 338787 - DNA, 25 bp, Mus musculus
ccagacacctcatgtatacaccata

SEQ ID NO: 338788 - DNA, 25 bp, Mus musculus
ccagacaccttgctttttgactatt

SEQ ID NO: 338789 - DNA, 25 bp, Mus musculus
ccagacaccttggtttttgactatt

SEQ ID NO: 338790 - DNA, 25 bp, Mus musculus
ccagacacctttctgactactgctg

SEQ ID NO: 338791 - DNA, 25 bp, Mus musculus
ccagacacctttgtgactactgctg

SEQ ID NO: 338792 - DNA, 25 bp, Mus musculus
ccagacactcgccattgaattttat

SEQ ID NO: 338793 - DNA, 25 bp, Mus musculus
ccagacactcgcgattgaattttat

SEQ ID NO: 338794 - DNA, 25 bp, Mus musculus
ccagacactgcccaaaacatcttag

SEQ ID NO: 338795 - DNA, 25 bp, Mus musculus
ccagacactgccgaaaacatcttag

SEQ ID NO: 338796 - DNA, 25 bp, Mus musculus
ccagacacttgccttctttgccaag

SEQ ID NO: 338797 - DNA, 25 bp, Mus musculus
ccagacacttgcgttctttgccaag

SEQ ID NO: 338798 - DNA, 25 bp, Mus musculus
ccagacagaagcaggtgtgtgtcct

SEQ ID NO: 338799 - DNA, 25 bp, Mus musculus
ccagacagaagctggtgtgtgtcct

SEQ ID NO: 338800 - DNA, 25 bp, Mus musculus
ccagacagactaatcagggagtggt

SEQ ID NO: 338801 - DNA, 25 bp, Mus musculus
ccagacagactattcagggagtggt

SEQ ID NO: 338802 - DNA, 25 bp, Mus musculus
ccagacagctttagtgatgtttcaa

SEQ ID NO: 338803 - DNA, 25 bp, Mus musculus
ccagacagcttttgtgatgtttcaa

SEQ ID NO: 338804 - DNA, 25 bp, Mus musculus
ccagacaggagaatgtttcattttc

SEQ ID NO: 338805 - DNA, 25 bp, Mus musculus
ccagacaggagattgtttcattttc

SEQ ID NO: 338806 - DNA, 25 bp, Mus musculus
ccagacaggttgctgactttggcca

SEQ ID NO: 338807 - DNA, 25 bp, Mus musculus
ccagacaggttggtgactttggcca

SEQ ID NO: 338808 - DNA, 25 bp, Mus musculus
ccagacagtggaaatttggtccgtg

SEQ ID NO: 338809 - DNA, 25 bp, Mus musculus
ccagacagtggatatttggtccgtg

SEQ ID NO: 338810 - DNA, 25 bp, Mus musculus
ccagacataatgcattccccttttt

SEQ ID NO: 338811 - DNA, 25 bp, Mus musculus
ccagacataatggattccccttttt

SEQ ID NO: 338812 - DNA, 25 bp, Mus musculus
ccagacatagggaattcatgggcat

SEQ ID NO: 338813 - DNA, 25 bp, Mus musculus
ccagacatagggtattcatgggcat

SEQ ID NO: 338814 - DNA, 25 bp, Mus musculus
ccagacatatcacctgttcaggaca

SEQ ID NO: 338815 - DNA, 25 bp, Mus musculus
ccagacatatcagctgttcaggaca

SEQ ID NO: 338816 - DNA, 25 bp, Mus musculus
ccagacatgtgtatcaggtgaccct

SEQ ID NO: 338817 - DNA, 25 bp, Mus musculus
ccagacatgtgtttcaggtgaccct

SEQ ID NO: 338818 - DNA, 25 bp, Mus musculus
ccagaccaggctctaaggccgtgaa

SEQ ID NO: 338819 - DNA, 25 bp, Mus musculus
ccagaccaggctgtaaggccgtgaa

SEQ ID NO: 338820 - DNA, 25 bp, Mus musculus
ccagacccagctactgttacagatg

SEQ ID NO: 338821 - DNA, 25 bp, Mus musculus
ccagacccagcttctgttacagatg

SEQ ID NO: 338822 - DNA, 25 bp, Mus musculus
ccagacccagggatagattggagct

SEQ ID NO: 338823 - DNA, 25 bp, Mus musculus
ccagacccagggttagattggagct

SEQ ID NO: 338824 - DNA, 25 bp, Mus musculus
ccagaccccacaatccatgaatgaa

SEQ ID NO: 338825 - DNA, 25 bp, Mus musculus
ccagaccccacattccatgaatgaa

SEQ ID NO: 338826 - DNA, 25 bp, Mus musculus
ccagaccccggcatggtgaagagga

SEQ ID NO: 338827 - DNA, 25 bp, Mus musculus
ccagaccccggcttggtgaagagga

SEQ ID NO: 338828 - DNA, 25 bp, Mus musculus
ccagaccgaggacgaccgcaagaac

SEQ ID NO: 338829 - DNA, 25 bp, Mus musculus
ccagaccgaggaggaccgcaagaac

SEQ ID NO: 338830 - DNA, 25 bp, Mus musculus
ccagaccgagtgactgaattctccc

SEQ ID NO: 338831 - DNA, 25 bp, Mus musculus
ccagaccgagtgtctgaattctccc

SEQ ID NO: 338832 - DNA, 25 bp, Mus musculus
ccagacctagagctattttcctctt

SEQ ID NO: 338833 - DNA, 25 bp, Mus musculus
ccagacctagaggtattttcctctt

SEQ ID NO: 338834 - DNA, 25 bp, Mus musculus
ccagacctcttgattccattttgaa

SEQ ID NO: 338835 - DNA, 25 bp, Mus musculus
ccagacctcttgtttccattttgaa

SEQ ID NO: 338836 - DNA, 25 bp, Mus musculus
ccagaccttgaaccacagtgttgta

SEQ ID NO: 338837 - DNA, 25 bp, Mus musculus
ccagaccttgaagcacagtgttgta

SEQ ID NO: 338838 - DNA, 25 bp, Mus musculus
ccagacgcaagacccgcggaagaga

SEQ ID NO: 338839 - DNA, 25 bp, Mus musculus
ccagacgcaagagccgcggaagaga

SEQ ID NO: 338840 - DNA, 25 bp, Mus musculus
ccagacggaatgctccgagaggaac

SEQ ID NO: 338841 - DNA, 25 bp, Mus musculus
ccagacggaatggtccgagaggaac

SEQ ID NO: 338842 - DNA, 25 bp, Mus musculus
ccagacggcagacttaaacggtctt

SEQ ID NO: 338843 - DNA, 25 bp, Mus musculus
ccagacggcagagttaaacggtctt

SEQ ID NO: 338844 - DNA, 25 bp, Mus musculus
ccagacggctttcttacagaactaa

SEQ ID NO: 338845 - DNA, 25 bp, Mus musculus
ccagacggctttgttacagaactaa

SEQ ID NO: 338846 - DNA, 25 bp, Mus musculus
ccagacgtacggctcagaagatcat

SEQ ID NO: 338847 - DNA, 25 bp, Mus musculus
ccagacgtacgggtcagaagatcat

SEQ ID NO: 338848 - DNA, 25 bp, Mus musculus
ccagacgtgctcagagccttttatt

SEQ ID NO: 338849 - DNA, 25 bp, Mus musculus
ccagacgtgctctgagccttttatt

SEQ ID NO: 338850 - DNA, 25 bp, Mus musculus
ccagacgtgttcagagtgccgagct

SEQ ID NO: 338851 - DNA, 25 bp, Mus musculus
ccagacgtgttctgagtgccgagct

SEQ ID NO: 338852 - DNA, 25 bp, Mus musculus
ccagacgtttccagagtactcagct

SEQ ID NO: 338853 - DNA, 25 bp, Mus musculus
ccagacgtttcctgagtactcagct

SEQ ID NO: 338854 - DNA, 25 bp, Mus musculus
ccagactatctcatgtcactgaggg

SEQ ID NO: 338855 - DNA, 25 bp, Mus musculus
ccagactatctcttgtcactgaggg

SEQ ID NO: 338856 - DNA, 25 bp, Mus musculus
ccagactcaggaacggtacaaggaa

SEQ ID NO: 338857 - DNA, 25 bp, Mus musculus
ccagactcaggatcggtacaaggaa

SEQ ID NO: 338858 - DNA, 25 bp, Mus musculus
ccagactcagtcatagctactcttc

SEQ ID NO: 338859 - DNA, 25 bp, Mus musculus
ccagactcagtcttagctactcttc

SEQ ID NO: 338860 - DNA, 25 bp, Mus musculus
ccagactccagactcgatctttctt

SEQ ID NO: 338861 - DNA, 25 bp, Mus musculus
ccagactccagagtcgatctttctt

SEQ ID NO: 338862 - DNA, 25 bp, Mus musculus
ccagactcccaacgaatcaggtgat

SEQ ID NO: 338863 - DNA, 25 bp, Mus musculus
ccagactcccaaggaatcaggtgat

SEQ ID NO: 338864 - DNA, 25 bp, Mus musculus
ccagactccttgagggacatttttg

SEQ ID NO: 338865 - DNA, 25 bp, Mus musculus
ccagactccttgtgggacatttttg

SEQ ID NO: 338866 - DNA, 25 bp, Mus musculus
ccagactcgaatacctagaaccttt

SEQ ID NO: 338867 - DNA, 25 bp, Mus musculus
ccagactcgaattcctagaaccttt

SEQ ID NO: 338868 - DNA, 25 bp, Mus musculus
ccagactgctgaagtggtcaccggg

SEQ ID NO: 338869 - DNA, 25 bp, Mus musculus
ccagactgctgatgtggtcaccggg

SEQ ID NO: 338870 - DNA, 25 bp, Mus musculus
ccagactgggatccatgagagcttt

SEQ ID NO: 338871 - DNA, 25 bp, Mus musculus
ccagactgggatgcatgagagcttt

SEQ ID NO: 338872 - DNA, 25 bp, Mus musculus
ccagacttagggagggagcctgcca

SEQ ID NO: 338873 - DNA, 25 bp, Mus musculus
ccagacttagggtgggagcctgcca

SEQ ID NO: 338874 - DNA, 25 bp, Mus musculus
ccagacttccttaattgctatattc

SEQ ID NO: 338875 - DNA, 25 bp, Mus musculus
ccagacttcctttattgctatattc

SEQ ID NO: 338876 - DNA, 25 bp, Mus musculus
ccagacttctggcattttactgtca

SEQ ID NO: 338877 - DNA, 25 bp, Mus musculus
ccagacttctgggattttactgtca

SEQ ID NO: 338878 - DNA, 25 bp, Mus musculus
ccagacttgattccgccttcaaaag

SEQ ID NO: 338879 - DNA, 25 bp, Mus musculus
ccagacttgattgcgccttcaaaag

SEQ ID NO: 338880 - DNA, 25 bp, Mus musculus
ccagacttgtatcggcagcttgatt

SEQ ID NO: 338881 - DNA, 25 bp, Mus musculus
ccagacttgtatgggcagcttgatt

SEQ ID NO: 338882 - DNA, 25 bp, Mus musculus
ccagacttgtggaaccgattatatc

SEQ ID NO: 338883 - DNA, 25 bp, Mus musculus
ccagacttgtggtaccgattatatc

SEQ ID NO: 338884 - DNA, 25 bp, Mus musculus
ccagacttgtgtcgtaagttttaga

SEQ ID NO: 338885 - DNA, 25 bp, Mus musculus
ccagacttgtgtggtaagttttaga

SEQ ID NO: 338886 - DNA, 25 bp, Mus musculus
ccagactttcttccacaaacagttg

SEQ ID NO: 338887 - DNA, 25 bp, Mus musculus
ccagactttcttgcacaaacagttg

SEQ ID NO: 338888 - DNA, 25 bp, Mus musculus
ccagactttgcaactgatgggatca

SEQ ID NO: 338889 - DNA, 25 bp, Mus musculus
ccagactttgcatctgatgggatca

SEQ ID NO: 338890 - DNA, 25 bp, Mus musculus
ccagacttttgaaccagaccttcac

SEQ ID NO: 338891 - DNA, 25 bp, Mus musculus
ccagacttttgatccagaccttcac

SEQ ID NO: 338892 - DNA, 25 bp, Mus musculus
ccagagaacaacagtctgtgaagat

SEQ ID NO: 338893 - DNA, 25 bp, Mus musculus
ccagagaacaactgtctgtgaagat

SEQ ID NO: 338894 - DNA, 25 bp, Mus musculus
ccagagaccactcggccagctggga

SEQ ID NO: 338895 - DNA, 25 bp, Mus musculus
ccagagaccactgggccagctggga

SEQ ID NO: 338896 - DNA, 25 bp, Mus musculus
ccagagaccctccagatgttttggg

SEQ ID NO: 338897 - DNA, 25 bp, Mus musculus
ccagagaccctcgagatgttttggg

SEQ ID NO: 338898 - DNA, 25 bp, Mus musculus
ccagagagcaccacgcgtgaagggt

SEQ ID NO: 338899 - DNA, 25 bp, Mus musculus
ccagagagcacctcgcgtgaagggt

SEQ ID NO: 338900 - DNA, 25 bp, Mus musculus
ccagagagctgcattccttttacct

SEQ ID NO: 338901 - DNA, 25 bp, Mus musculus
ccagagagctgctttccttttacct

SEQ ID NO: 338902 - DNA, 25 bp, Mus musculus
ccagagagtggtcagctaagagcct

SEQ ID NO: 338903 - DNA, 25 bp, Mus musculus
ccagagagtggtgagctaagagcct

SEQ ID NO: 338904 - DNA, 25 bp, Mus musculus
ccagagataagacgcaaagtgccca

SEQ ID NO: 338905 - DNA, 25 bp, Mus musculus
ccagagataagaggcaaagtgccca

SEQ ID NO: 338906 - DNA, 25 bp, Mus musculus
ccagagatcatcctcagtgacgttt

SEQ ID NO: 338907 - DNA, 25 bp, Mus musculus
ccagagatcatcgtcagtgacgttt

SEQ ID NO: 338908 - DNA, 25 bp, Mus musculus
ccagagatgcagaccagattgaaga

SEQ ID NO: 338909 - DNA, 25 bp, Mus musculus
ccagagatgcagtccagattgaaga

SEQ ID NO: 338910 - DNA, 25 bp, Mus musculus
ccagagatgcctcgctgtcaggaca

SEQ ID NO: 338911 - DNA, 25 bp, Mus musculus
ccagagatgcctggctgtcaggaca

SEQ ID NO: 338912 - DNA, 25 bp, Mus musculus
ccagagattaaactcataggcccta

SEQ ID NO: 338913 - DNA, 25 bp, Mus musculus
ccagagattaaagtcataggcccta

SEQ ID NO: 338914 - DNA, 25 bp, Mus musculus
ccagagattgggacttcaccacctt

SEQ ID NO: 338915 - DNA, 25 bp, Mus musculus
ccagagattgggtcttcaccacctt

SEQ ID NO: 338916 - DNA, 25 bp, Mus musculus
ccagagcaagtcatggctttgtaga

SEQ ID NO: 338917 - DNA, 25 bp, Mus musculus
ccagagcaagtcttggctttgtaga

SEQ ID NO: 338918 - DNA, 25 bp, Mus musculus
ccagagcaataccttccttattcca

SEQ ID NO: 338919 - DNA, 25 bp, Mus musculus
ccagagcaatacgttccttattcca

SEQ ID NO: 338920 - DNA, 25 bp, Mus musculus
ccagagcacacactatgccttattt

SEQ ID NO: 338921 - DNA, 25 bp, Mus musculus
ccagagcacacagtatgccttattt

SEQ ID NO: 338922 - DNA, 25 bp, Mus musculus
ccagagcacttacggcgccaaggga

SEQ ID NO: 338923 - DNA, 25 bp, Mus musculus
ccagagcacttagggcgccaaggga

SEQ ID NO: 338924 - DNA, 25 bp, Mus musculus
ccagagcagtataagcgatgcagag

SEQ ID NO: 338925 - DNA, 25 bp, Mus musculus
ccagagcagtattagcgatgcagag

SEQ ID NO: 338926 - DNA, 25 bp, Mus musculus
ccagagcagtggacccgacagcggc

SEQ ID NO: 338927 - DNA, 25 bp, Mus musculus
ccagagcagtggtcccgacagcggc

SEQ ID NO: 338928 - DNA, 25 bp, Mus musculus
ccagagcagtttaggagattgtaaa

SEQ ID NO: 338929 - DNA, 25 bp, Mus musculus
ccagagcagttttggagattgtaaa

SEQ ID NO: 338930 - DNA, 25 bp, Mus musculus
ccagagccatttattgaacaagact

SEQ ID NO: 338931 - DNA, 25 bp, Mus musculus
ccagagccattttttgaacaagact

SEQ ID NO: 338932 - DNA, 25 bp, Mus musculus
ccagagcccaaaatcaccgtgaata

SEQ ID NO: 338933 - DNA, 25 bp, Mus musculus
ccagagcccaaattcaccgtgaata

SEQ ID NO: 338934 - DNA, 25 bp, Mus musculus
ccagagcccatcagttttcagaaac

SEQ ID NO: 338935 - DNA, 25 bp, Mus musculus
ccagagcccatctgttttcagaaac

SEQ ID NO: 338936 - DNA, 25 bp, Mus musculus
ccagagcctcagcacagttatggtg

SEQ ID NO: 338937 - DNA, 25 bp, Mus musculus
ccagagcctcaggacagttatggtg

SEQ ID NO: 338938 - DNA, 25 bp, Mus musculus
ccagagcctcgtcgttcttctgaaa

SEQ ID NO: 338939 - DNA, 25 bp, Mus musculus
ccagagcctcgtggttcttctgaaa

SEQ ID NO: 338940 - DNA, 25 bp, Mus musculus
ccagagcctctgacatgcttagcaa

SEQ ID NO: 338941 - DNA, 25 bp, Mus musculus
ccagagcctctgtcatgcttagcaa

SEQ ID NO: 338942 - DNA, 25 bp, Mus musculus
ccagagccttcaatccaattacaag

SEQ ID NO: 338943 - DNA, 25 bp, Mus musculus
ccagagccttcattccaattacaag

SEQ ID NO: 338944 - DNA, 25 bp, Mus musculus
ccagagcgcaaacgccagtggcaat

SEQ ID NO: 338945 - DNA, 25 bp, Mus musculus
ccagagcgcaaaggccagtggcaat

SEQ ID NO: 338946 - DNA, 25 bp, Mus musculus
ccagagcgccatagtttcaaggtat

SEQ ID NO: 338947 - DNA, 25 bp, Mus musculus
ccagagcgccattgtttcaaggtat

SEQ ID NO: 338948 - DNA, 25 bp, Mus musculus
ccagagcgcttgagttaggttccta

SEQ ID NO: 338949 - DNA, 25 bp, Mus musculus
ccagagcgcttgtgttaggttccta

SEQ ID NO: 338950 - DNA, 25 bp, Mus musculus
ccagagcgggcaacatcaggtcaga

SEQ ID NO: 338951 - DNA, 25 bp, Mus musculus
ccagagcgggcatcatcaggtcaga

SEQ ID NO: 338952 - DNA, 25 bp, Mus musculus
ccagagctaattacctctcacagta

SEQ ID NO: 338953 - DNA, 25 bp, Mus musculus
ccagagctaatttcctctcacagta

SEQ ID NO: 338954 - DNA, 25 bp, Mus musculus
ccagagctacagcatgaggcgcatt

SEQ ID NO: 338955 - DNA, 25 bp, Mus musculus
ccagagctacaggatgaggcgcatt

SEQ ID NO: 338956 - DNA, 25 bp, Mus musculus
ccagagctgactcccacgcagttgg

SEQ ID NO: 338957 - DNA, 25 bp, Mus musculus
ccagagctgactgccacgcagttgg

SEQ ID NO: 338958 - DNA, 25 bp, Mus musculus
ccagagctgagaccttgtgcatgca

SEQ ID NO: 338959 - DNA, 25 bp, Mus musculus
ccagagctgagagcttgtgcatgca

SEQ ID NO: 338960 - DNA, 25 bp, Mus musculus
ccagagctgcctatctgtatatggc

SEQ ID NO: 338961 - DNA, 25 bp, Mus musculus
ccagagctgcctttctgtatatggc

SEQ ID NO: 338962 - DNA, 25 bp, Mus musculus
ccagagctgcgcatggcggctactc

SEQ ID NO: 338963 - DNA, 25 bp, Mus musculus
ccagagctgcgcttggcggctactc

SEQ ID NO: 338964 - DNA, 25 bp, Mus musculus
ccagagctgtccaggtaagaggctg

SEQ ID NO: 338965 - DNA, 25 bp, Mus musculus
ccagagctgtcctggtaagaggctg

SEQ ID NO: 338966 - DNA, 25 bp, Mus musculus
ccagagcttcttctggataattcta

SEQ ID NO: 338967 - DNA, 25 bp, Mus musculus
ccagagcttcttgtggataattcta

SEQ ID NO: 338968 - DNA, 25 bp, Mus musculus
ccagagcttggacacaagacctatt

SEQ ID NO: 338969 - DNA, 25 bp, Mus musculus
ccagagcttggagacaagacctatt

SEQ ID NO: 338970 - DNA, 25 bp, Mus musculus
ccagagcttgttcccagatcacatg

SEQ ID NO: 338971 - DNA, 25 bp, Mus musculus
ccagagcttgttgccagatcacatg

SEQ ID NO: 338972 - DNA, 25 bp, Mus musculus
ccagaggaacatccatcctttgctc

SEQ ID NO: 338973 - DNA, 25 bp, Mus musculus
ccagaggaacatgcatcctttgctc

SEQ ID NO: 338974 - DNA, 25 bp, Mus musculus
ccagaggaagttagggtgctcagtt

SEQ ID NO: 338975 - DNA, 25 bp, Mus musculus
ccagaggaagtttgggtgctcagtt

SEQ ID NO: 338976 - DNA, 25 bp, Mus musculus
ccagaggacccactggaatgtctta

SEQ ID NO: 338977 - DNA, 25 bp, Mus musculus
ccagaggacccagtggaatgtctta

SEQ ID NO: 338978 - DNA, 25 bp, Mus musculus
ccagaggaccttcattttggtcttt

SEQ ID NO: 338979 - DNA, 25 bp, Mus musculus
ccagaggaccttgattttggtcttt

SEQ ID NO: 338980 - DNA, 25 bp, Mus musculus
ccagaggaggcccaatttgttgttt

SEQ ID NO: 338981 - DNA, 25 bp, Mus musculus
ccagaggaggccgaatttgttgttt

SEQ ID NO: 338982 - DNA, 25 bp, Mus musculus
ccagaggcaaaaatcagagttcagt

SEQ ID NO: 338983 - DNA, 25 bp, Mus musculus
ccagaggcaaaattcagagttcagt

SEQ ID NO: 338984 - DNA, 25 bp, Mus musculus
ccagaggcaaggctcttcaatgctt

SEQ ID NO: 338985 - DNA, 25 bp, Mus musculus
ccagaggcaagggtcttcaatgctt

SEQ ID NO: 338986 - DNA, 25 bp, Mus musculus
ccagaggcagagaagttcatctcac

SEQ ID NO: 338987 - DNA, 25 bp, Mus musculus
ccagaggcagagtagttcatctcac

SEQ ID NO: 338988 - DNA, 25 bp, Mus musculus
ccagaggcagggattcgtttgtatt

SEQ ID NO: 338989 - DNA, 25 bp, Mus musculus
ccagaggcagggtttcgtttgtatt

SEQ ID NO: 338990 - DNA, 25 bp, Mus musculus
ccagaggccaggacggaatcgccga

SEQ ID NO: 338991 - DNA, 25 bp, Mus musculus
ccagaggccaggtcggaatcgccga

SEQ ID NO: 338992 - DNA, 25 bp, Mus musculus
ccagaggcccagattggattctata

SEQ ID NO: 338993 - DNA, 25 bp, Mus musculus
ccagaggcccagtttggattctata

SEQ ID NO: 338994 - DNA, 25 bp, Mus musculus
ccagaggccccactttgagttttgt

SEQ ID NO: 338995 - DNA, 25 bp, Mus musculus
ccagaggccccagtttgagttttgt

SEQ ID NO: 338996 - DNA, 25 bp, Mus musculus
ccagaggcctcccagggtgcagact

SEQ ID NO: 338997 - DNA, 25 bp, Mus musculus
ccagaggcctccgagggtgcagact

SEQ ID NO: 338998 - DNA, 25 bp, Mus musculus
ccagaggctctcatgaggccaagga

SEQ ID NO: 338999 - DNA, 25 bp, Mus musculus
ccagaggctctcttgaggccaagga

SEQ ID NO: 339000 - DNA, 25 bp, Mus musculus
ccagaggcttcccagaggtcatgga

SEQ ID NO: 339001 - DNA, 25 bp, Mus musculus
ccagaggcttccgagaggtcatgga

SEQ ID NO: 339002 - DNA, 25 bp, Mus musculus
ccagagggaacacgcttaggctaga

SEQ ID NO: 339003 - DNA, 25 bp, Mus musculus
ccagagggaacaggcttaggctaga

SEQ ID NO: 339004 - DNA, 25 bp, Mus musculus
ccagagggattcatagatgttccat

SEQ ID NO: 339005 - DNA, 25 bp, Mus musculus
ccagagggattcttagatgttccat

SEQ ID NO: 339006 - DNA, 25 bp, Mus musculus
ccagagggcaccaggtaactggaac

SEQ ID NO: 339007 - DNA, 25 bp, Mus musculus
ccagagggcacctggtaactggaac

SEQ ID NO: 339008 - DNA, 25 bp, Mus musculus
ccagagggcaggaaacacatgtaaa

SEQ ID NO: 339009 - DNA, 25 bp, Mus musculus
ccagagggcaggtaacacatgtaaa

SEQ ID NO: 339010 - DNA, 25 bp, Mus musculus
ccagagggcattagcagaggcagct

SEQ ID NO: 339011 - DNA, 25 bp, Mus musculus
ccagagggcatttgcagaggcagct

SEQ ID NO: 339012 - DNA, 25 bp, Mus musculus
ccagagggccgcatctactttgctg

SEQ ID NO: 339013 - DNA, 25 bp, Mus musculus
ccagagggccgcttctactttgctg

SEQ ID NO: 339014 - DNA, 25 bp, Mus musculus
ccagagggccttactacgtgaatca

SEQ ID NO: 339015 - DNA, 25 bp, Mus musculus
ccagagggccttctctaatcataca

SEQ ID NO: 339016 - DNA, 25 bp, Mus musculus
ccagagggccttgtctaatcataca

SEQ ID NO: 339017 - DNA, 25 bp, Mus musculus
ccagagggcctttctacgtgaatca

SEQ ID NO: 339018 - DNA, 25 bp, Mus musculus
ccagagggtcacaagccaaggatgt

SEQ ID NO: 339019 - DNA, 25 bp, Mus musculus
ccagagggtcactagccaaggatgt

SEQ ID NO: 339020 - DNA, 25 bp, Mus musculus
ccagagggttggagttcagttcgca

SEQ ID NO: 339021 - DNA, 25 bp, Mus musculus
ccagagggttggtgttcagttcgca

SEQ ID NO: 339022 - DNA, 25 bp, Mus musculus
ccagagggttttcaagactcctgtt

SEQ ID NO: 339023 - DNA, 25 bp, Mus musculus
ccagagggttttgaagactcctgtt

SEQ ID NO: 339024 - DNA, 25 bp, Mus musculus
ccagaggtaagaactcatccttctt

SEQ ID NO: 339025 - DNA, 25 bp, Mus musculus
ccagaggtaagatctcatccttctt

SEQ ID NO: 339026 - DNA, 25 bp, Mus musculus
ccagaggtagaactagacggcttta

SEQ ID NO: 339027 - DNA, 25 bp, Mus musculus
ccagaggtagaagtagacggcttta

SEQ ID NO: 339028 - DNA, 25 bp, Mus musculus
ccagaggtagcaccagtcggctcaa

SEQ ID NO: 339029 - DNA, 25 bp, Mus musculus
ccagaggtagcagcagtcggctcaa

SEQ ID NO: 339030 - DNA, 25 bp, Mus musculus
ccagaggtgacgcacctactgcgag

SEQ ID NO: 339031 - DNA, 25 bp, Mus musculus
ccagaggtgacggacctactgcgag

SEQ ID NO: 339032 - DNA, 25 bp, Mus musculus
ccagaggtggctacagtataagttt

SEQ ID NO: 339033 - DNA, 25 bp, Mus musculus
ccagaggtggcttcagtataagttt

SEQ ID NO: 339034 - DNA, 25 bp, Mus musculus
ccagaggtttaaccacagcatagtg

SEQ ID NO: 339035 - DNA, 25 bp, Mus musculus
ccagaggtttaagcacagcatagtg

SEQ ID NO: 339036 - DNA, 25 bp, Mus musculus
ccagaggtttttatagcggctgcat

SEQ ID NO: 339037 - DNA, 25 bp, Mus musculus
ccagaggtttttttagcggctgcat

SEQ ID NO: 339038 - DNA, 25 bp, Mus musculus
ccagagtaacacctttgctgtcttc

SEQ ID NO: 339039 - DNA, 25 bp, Mus musculus
ccagagtaacacgtttgctgtcttc

SEQ ID NO: 339040 - DNA, 25 bp, Mus musculus
ccagagtaactcatgacccagggac

SEQ ID NO: 339041 - DNA, 25 bp, Mus musculus
ccagagtaactcttgacccagggac

SEQ ID NO: 339042 - DNA, 25 bp, Mus musculus
ccagagtaccttccacctgaagtaa

SEQ ID NO: 339043 - DNA, 25 bp, Mus musculus
ccagagtaccttgcacctgaagtaa

SEQ ID NO: 339044 - DNA, 25 bp, Mus musculus
ccagagtatgaaatagcttccgggt

SEQ ID NO: 339045 - DNA, 25 bp, Mus musculus
ccagagtatgaattagcttccgggt

SEQ ID NO: 339046 - DNA, 25 bp, Mus musculus
ccagagtccggtccaggcagtgaat

SEQ ID NO: 339047 - DNA, 25 bp, Mus musculus
ccagagtccggtgcaggcagtgaat

SEQ ID NO: 339048 - DNA, 25 bp, Mus musculus
ccagagtcgggtaagttctctctgc

SEQ ID NO: 339049 - DNA, 25 bp, Mus musculus
ccagagtcgggttagttctctctgc

SEQ ID NO: 339050 - DNA, 25 bp, Mus musculus
ccagagtctggccttttggactaat

SEQ ID NO: 339051 - DNA, 25 bp, Mus musculus
ccagagtctggcgttttggactaat

SEQ ID NO: 339052 - DNA, 25 bp, Mus musculus
ccagagtctgtaccatgctgacttt

SEQ ID NO: 339053 - DNA, 25 bp, Mus musculus
ccagagtctgtagcatgctgacttt

SEQ ID NO: 339054 - DNA, 25 bp, Mus musculus
ccagagtgccccacttcatgaagga

SEQ ID NO: 339055 - DNA, 25 bp, Mus musculus
ccagagtgcccctcttcatgaagga

SEQ ID NO: 339056 - DNA, 25 bp, Mus musculus
ccagagtgcgcacgtctccaaggga

SEQ ID NO: 339057 - DNA, 25 bp, Mus musculus
ccagagtgcgcaggtctccaaggga

SEQ ID NO: 339058 - DNA, 25 bp, Mus musculus
ccagagtgtgggaatcattttgagt

SEQ ID NO: 339059 - DNA, 25 bp, Mus musculus
ccagagtgtgggtatcattttgagt

SEQ ID NO: 339060 - DNA, 25 bp, Mus musculus
ccagagttccatacacatctttgtg

SEQ ID NO: 339061 - DNA, 25 bp, Mus musculus
ccagagttccattcacatctttgtg

SEQ ID NO: 339062 - DNA, 25 bp, Mus musculus
ccagagttctatagcttcacttcag

SEQ ID NO: 339063 - DNA, 25 bp, Mus musculus
ccagagttctattgcttcacttcag

SEQ ID NO: 339064 - DNA, 25 bp, Mus musculus
ccagagttctggcattccatatata

SEQ ID NO: 339065 - DNA, 25 bp, Mus musculus
ccagagttctgggattccatatata

SEQ ID NO: 339066 - DNA, 25 bp, Mus musculus
ccagataaattcagtgagattcata

SEQ ID NO: 339067 - DNA, 25 bp, Mus musculus
ccagataaattctgtgagattcata

SEQ ID NO: 339068 - DNA, 25 bp, Mus musculus
ccagataacggtcagggtcctaaat

SEQ ID NO: 339069 - DNA, 25 bp, Mus musculus
ccagataacggtgagggtcctaaat

SEQ ID NO: 339070 - DNA, 25 bp, Mus musculus
ccagataattatcgattttgcacat

SEQ ID NO: 339071 - DNA, 25 bp, Mus musculus
ccagataattatggattttgcacat

SEQ ID NO: 339072 - DNA, 25 bp, Mus musculus
ccagatacagggatgagaatttgca

SEQ ID NO: 339073 - DNA, 25 bp, Mus musculus
ccagatacagggttgagaatttgca

SEQ ID NO: 339074 - DNA, 25 bp, Mus musculus
ccagatactgctactgtggtttaca

SEQ ID NO: 339075 - DNA, 25 bp, Mus musculus
ccagatactgcttctgtggtttaca

SEQ ID NO: 339076 - DNA, 25 bp, Mus musculus
ccagatacttggatagttccttttt

SEQ ID NO: 339077 - DNA, 25 bp, Mus musculus
ccagatacttggttagttccttttt

SEQ ID NO: 339078 - DNA, 25 bp, Mus musculus
ccagataggcctagacattctttat

SEQ ID NO: 339079 - DNA, 25 bp, Mus musculus
ccagataggccttgacattctttat

SEQ ID NO: 339080 - DNA, 25 bp, Mus musculus
ccagatattcccaagctgctgcagt

SEQ ID NO: 339081 - DNA, 25 bp, Mus musculus
ccagatattccctagctgctgcagt

SEQ ID NO: 339082 - DNA, 25 bp, Mus musculus
ccagatatttctctgccagccagac

SEQ ID NO: 339083 - DNA, 25 bp, Mus musculus
ccagatatttctgtgccagccagac

SEQ ID NO: 339084 - DNA, 25 bp, Mus musculus
ccagatcaaggaagacattttcaac

SEQ ID NO: 339085 - DNA, 25 bp, Mus musculus
ccagatcaaggatgacattttcaac

SEQ ID NO: 339086 - DNA, 25 bp, Mus musculus
ccagatcactggcaatgggatgttc

SEQ ID NO: 339087 - DNA, 25 bp, Mus musculus
ccagatcactggcactgagcatctg

SEQ ID NO: 339088 - DNA, 25 bp, Mus musculus
ccagatcactgggaatgggatgttc

SEQ ID NO: 339089 - DNA, 25 bp, Mus musculus
ccagatcactgggactgagcatctg

SEQ ID NO: 339090 - DNA, 25 bp, Mus musculus
ccagatcattccagattcaagcatc

SEQ ID NO: 339091 - DNA, 25 bp, Mus musculus
ccagatcattcctgattcaagcatc

SEQ ID NO: 339092 - DNA, 25 bp, Mus musculus
ccagatccaaagatggcttggcaaa

SEQ ID NO: 339093 - DNA, 25 bp, Mus musculus
ccagatccaaagttggcttggcaaa

SEQ ID NO: 339094 - DNA, 25 bp, Mus musculus
ccagatccaagcctactttcaaagt

SEQ ID NO: 339095 - DNA, 25 bp, Mus musculus
ccagatccaagcgtactttcaaagt

SEQ ID NO: 339096 - DNA, 25 bp, Mus musculus
ccagatccaccaactcattcatatt

SEQ ID NO: 339097 - DNA, 25 bp, Mus musculus
ccagatccaccatctcattcatatt

SEQ ID NO: 339098 - DNA, 25 bp, Mus musculus
ccagatccacttcagggcccaagtg

SEQ ID NO: 339099 - DNA, 25 bp, Mus musculus
ccagatccacttgagggcccaagtg

SEQ ID NO: 339100 - DNA, 25 bp, Mus musculus
ccagatccagctcgaaaactgaagt

SEQ ID NO: 339101 - DNA, 25 bp, Mus musculus
ccagatccagctggaaaactgaagt

SEQ ID NO: 339102 - DNA, 25 bp, Mus musculus
ccagatccaggtctgcgggcacagc

SEQ ID NO: 339103 - DNA, 25 bp, Mus musculus
ccagatccaggtgtgcgggcacagc

SEQ ID NO: 339104 - DNA, 25 bp, Mus musculus
ccagatccatttctgcttagtcacc

SEQ ID NO: 339105 - DNA, 25 bp, Mus musculus
ccagatccatttgtgcttagtcacc

SEQ ID NO: 339106 - DNA, 25 bp, Mus musculus
ccagatcccaggctgcttggaaaga

SEQ ID NO: 339107 - DNA, 25 bp, Mus musculus
ccagatcccagggtgcttggaaaga

SEQ ID NO: 339108 - DNA, 25 bp, Mus musculus
ccagatcctactcgaacaggaaggg

SEQ ID NO: 339109 - DNA, 25 bp, Mus musculus
ccagatcctactggaacaggaaggg

SEQ ID NO: 339110 - DNA, 25 bp, Mus musculus
ccagatcctgggaagcattttagaa

SEQ ID NO: 339111 - DNA, 25 bp, Mus musculus
ccagatcctgggtagcattttagaa

SEQ ID NO: 339112 - DNA, 25 bp, Mus musculus
ccagatctcctccactgagatggga

SEQ ID NO: 339113 - DNA, 25 bp, Mus musculus
ccagatctcctcgactgagatggga

SEQ ID NO: 339114 - DNA, 25 bp, Mus musculus
ccagatctctggaattggagctaca

SEQ ID NO: 339115 - DNA, 25 bp, Mus musculus
ccagatctctggtattggagctaca

SEQ ID NO: 339116 - DNA, 25 bp, Mus musculus
ccagatctgaatcttggctctcacc

SEQ ID NO: 339117 - DNA, 25 bp, Mus musculus
ccagatctgaatgttggctctcacc

SEQ ID NO: 339118 - DNA, 25 bp, Mus musculus
ccagatctgcacagcccacatggga

SEQ ID NO: 339119 - DNA, 25 bp, Mus musculus
ccagatctgcactgcccacatggga

SEQ ID NO: 339120 - DNA, 25 bp, Mus musculus
ccagatcttctgagggttcccttat

SEQ ID NO: 339121 - DNA, 25 bp, Mus musculus
ccagatcttctgtgggttcccttat

SEQ ID NO: 339122 - DNA, 25 bp, Mus musculus
ccagatcttggtagtaaaaggcctt

SEQ ID NO: 339123 - DNA, 25 bp, Mus musculus
ccagatcttggttgtaaaaggcctt

SEQ ID NO: 339124 - DNA, 25 bp, Mus musculus
ccagatcttttgagagagttctttt

SEQ ID NO: 339125 - DNA, 25 bp, Mus musculus
ccagatcttttgtgagagttctttt

SEQ ID NO: 339126 - DNA, 25 bp, Mus musculus
ccagatgaagcgatgatgcccagat

SEQ ID NO: 339127 - DNA, 25 bp, Mus musculus
ccagatgaagcgttgatgcccagat

SEQ ID NO: 339128 - DNA, 25 bp, Mus musculus
ccagatgagctgaatggataatgaa

SEQ ID NO: 339129 - DNA, 25 bp, Mus musculus
ccagatgagctgtatggataatgaa

SEQ ID NO: 339130 - DNA, 25 bp, Mus musculus
ccagatgagggtaactaccagggtg

SEQ ID NO: 339131 - DNA, 25 bp, Mus musculus
ccagatgagggttactaccagggtg

SEQ ID NO: 339132 - DNA, 25 bp, Mus musculus
ccagatgattcacagccagggattc

SEQ ID NO: 339133 - DNA, 25 bp, Mus musculus
ccagatgattcagagccagggattc

SEQ ID NO: 339134 - DNA, 25 bp, Mus musculus
ccagatgattctcaccccttttctt

SEQ ID NO: 339135 - DNA, 25 bp, Mus musculus
ccagatgattctgaccccttttctt

SEQ ID NO: 339136 - DNA, 25 bp, Mus musculus
ccagatgattgcacgccgggaggaa

SEQ ID NO: 339137 - DNA, 25 bp, Mus musculus
ccagatgattgctcgccgggaggaa

SEQ ID NO: 339138 - DNA, 25 bp, Mus musculus
ccagatgcctcccaaaaatagggat

SEQ ID NO: 339139 - DNA, 25 bp, Mus musculus
ccagatgcctccgaaaaatagggat

SEQ ID NO: 339140 - DNA, 25 bp, Mus musculus
ccagatgctctgctgacatagataa

SEQ ID NO: 339141 - DNA, 25 bp, Mus musculus
ccagatgctctggtgacatagataa

SEQ ID NO: 339142 - DNA, 25 bp, Mus musculus
ccagatgcttctcggctacaccagt

SEQ ID NO: 339143 - DNA, 25 bp, Mus musculus
ccagatgcttctgggctacaccagt

SEQ ID NO: 339144 - DNA, 25 bp, Mus musculus
ccagatggaactaagtagaacatat

SEQ ID NO: 339145 - DNA, 25 bp, Mus musculus
ccagatggaacttagtagaacatat

SEQ ID NO: 339146 - DNA, 25 bp, Mus musculus
ccagatggagaccttgatcccttta

SEQ ID NO: 339147 - DNA, 25 bp, Mus musculus
ccagatggagacgttgatcccttta

SEQ ID NO: 339148 - DNA, 25 bp, Mus musculus
ccagatggatggacagctttattat

SEQ ID NO: 339149 - DNA, 25 bp, Mus musculus
ccagatggatggtcagctttattat

SEQ ID NO: 339150 - DNA, 25 bp, Mus musculus
ccagatgggctcattgggctcgtcg

SEQ ID NO: 339151 - DNA, 25 bp, Mus musculus
ccagatgggctctttgggctcgtcg

SEQ ID NO: 339152 - DNA, 25 bp, Mus musculus
ccagatggtcccagtggtgtccagg

SEQ ID NO: 339153 - DNA, 25 bp, Mus musculus
ccagatggtccctgtggtgtccagg

SEQ ID NO: 339154 - DNA, 25 bp, Mus musculus
ccagatggttgacgctattcgctat

SEQ ID NO: 339155 - DNA, 25 bp, Mus musculus
ccagatggttgaggctattcgctat

SEQ ID NO: 339156 - DNA, 25 bp, Mus musculus
ccagatggttgtaagggctcgtgca

SEQ ID NO: 339157 - DNA, 25 bp, Mus musculus
ccagatggttgttagggctcgtgca

SEQ ID NO: 339158 - DNA, 25 bp, Mus musculus
ccagatgtaatgatttagttcctta

SEQ ID NO: 339159 - DNA, 25 bp, Mus musculus
ccagatgtaatgttttagttcctta

SEQ ID NO: 339160 - DNA, 25 bp, Mus musculus
ccagatgtatcaaagttgacctctt

SEQ ID NO: 339161 - DNA, 25 bp, Mus musculus
ccagatgtatcatagttgacctctt

SEQ ID NO: 339162 - DNA, 25 bp, Mus musculus
ccagatgtcactccattggaagagt

SEQ ID NO: 339163 - DNA, 25 bp, Mus musculus
ccagatgtcactgcattggaagagt

SEQ ID NO: 339164 - DNA, 25 bp, Mus musculus
ccagatgtgatgaagccacaggatt

SEQ ID NO: 339165 - DNA, 25 bp, Mus musculus
ccagatgtgatgtagccacaggatt

SEQ ID NO: 339166 - DNA, 25 bp, Mus musculus
ccagatgtggatcattccgggccgt

SEQ ID NO: 339167 - DNA, 25 bp, Mus musculus
ccagatgtggatgattccgggccgt

SEQ ID NO: 339168 - DNA, 25 bp, Mus musculus
ccagatgttctgctttcacctaaaa

SEQ ID NO: 339169 - DNA, 25 bp, Mus musculus
ccagatgttctggtttcacctaaaa

SEQ ID NO: 339170 - DNA, 25 bp, Mus musculus
ccagattagcataggctgtcttttc

SEQ ID NO: 339171 - DNA, 25 bp, Mus musculus
ccagattagcattggctgtcttttc

SEQ ID NO: 339172 - DNA, 25 bp, Mus musculus
ccagattatttaagtgcagtgtaaa

SEQ ID NO: 339173 - DNA, 25 bp, Mus musculus
ccagattatttatgtgcagtgtaaa

SEQ ID NO: 339174 - DNA, 25 bp, Mus musculus
ccagattcacacacgcacatgttta

SEQ ID NO: 339175 - DNA, 25 bp, Mus musculus
ccagattcacactcgcacatgttta

SEQ ID NO: 339176 - DNA, 25 bp, Mus musculus
ccagattcagagctggcctactcag

SEQ ID NO: 339177 - DNA, 25 bp, Mus musculus
ccagattcagaggtggcctactcag

SEQ ID NO: 339178 - DNA, 25 bp, Mus musculus
ccagattctaaaatgaggacttcac

SEQ ID NO: 339179 - DNA, 25 bp, Mus musculus
ccagattctaaattgaggacttcac

SEQ ID NO: 339180 - DNA, 25 bp, Mus musculus
ccagattctcatactgtttcatcag

SEQ ID NO: 339181 - DNA, 25 bp, Mus musculus
ccagattctcattctgtttcatcag

SEQ ID NO: 339182 - DNA, 25 bp, Mus musculus
ccagattctgtgaagatgtgcaaca

SEQ ID NO: 339183 - DNA, 25 bp, Mus musculus
ccagattctgtgacccaagttcctc

SEQ ID NO: 339184 - DNA, 25 bp, Mus musculus
ccagattctgtgtagatgtgcaaca

SEQ ID NO: 339185 - DNA, 25 bp, Mus musculus
ccagattctgtgtcccaagttcctc

SEQ ID NO: 339186 - DNA, 25 bp, Mus musculus
ccagattcttctagcaaaacattga

SEQ ID NO: 339187 - DNA, 25 bp, Mus musculus
ccagattcttcttgcaaaacattga

SEQ ID NO: 339188 - DNA, 25 bp, Mus musculus
ccagattgacggaaggcaggaagtc

SEQ ID NO: 339189 - DNA, 25 bp, Mus musculus
ccagattgacggtaggcaggaagtc

SEQ ID NO: 339190 - DNA, 25 bp, Mus musculus
ccagattgatcacggcaacttggaa

SEQ ID NO: 339191 - DNA, 25 bp, Mus musculus
ccagattgatcagggcaacttggaa

SEQ ID NO: 339192 - DNA, 25 bp, Mus musculus
ccagattgcctgcatttaatgaagt

SEQ ID NO: 339193 - DNA, 25 bp, Mus musculus
ccagattgcctggatttaatgaagt

SEQ ID NO: 339194 - DNA, 25 bp, Mus musculus
ccagattgttttcctagtagttcca

SEQ ID NO: 339195 - DNA, 25 bp, Mus musculus
ccagattgttttgctagtagttcca

SEQ ID NO: 339196 - DNA, 25 bp, Mus musculus
ccagatttggaaaaggcctcgtcat

SEQ ID NO: 339197 - DNA, 25 bp, Mus musculus
ccagatttggaataggcctcgtcat

SEQ ID NO: 339198 - DNA, 25 bp, Mus musculus
ccagatttgtggattgggcaactga

SEQ ID NO: 339199 - DNA, 25 bp, Mus musculus
ccagatttgtggtttgggcaactga

SEQ ID NO: 339200 - DNA, 25 bp, Mus musculus
ccagattttcagattgtactgcctg

SEQ ID NO: 339201 - DNA, 25 bp, Mus musculus
ccagattttcagtttgtactgcctg

SEQ ID NO: 339202 - DNA, 25 bp, Mus musculus
ccagattttccactgatgtaccaat

SEQ ID NO: 339203 - DNA, 25 bp, Mus musculus
ccagattttccagtgatgtaccaat

SEQ ID NO: 339204 - DNA, 25 bp, Mus musculus
ccagattttcccaaacaccttatct

SEQ ID NO: 339205 - DNA, 25 bp, Mus musculus
ccagattttccctaacaccttatct

SEQ ID NO: 339206 - DNA, 25 bp, Mus musculus
ccagattttcggctggctcctgtag

SEQ ID NO: 339207 - DNA, 25 bp, Mus musculus
ccagattttcgggtggctcctgtag

SEQ ID NO: 339208 - DNA, 25 bp, Mus musculus
ccagattttttgattactcaaagag

SEQ ID NO: 339209 - DNA, 25 bp, Mus musculus
ccagattttttgtttactcaaagag

SEQ ID NO: 339210 - DNA, 25 bp, Mus musculus
ccagcaaaatgactgcaccttcttt

SEQ ID NO: 339211 - DNA, 25 bp, Mus musculus
ccagcaaaatgagtgcaccttcttt

SEQ ID NO: 339212 - DNA, 25 bp, Mus musculus
ccagcaaagtccagtccaaggcaat

SEQ ID NO: 339213 - DNA, 25 bp, Mus musculus
ccagcaaagtcctgtccaaggcaat

SEQ ID NO: 339214 - DNA, 25 bp, Mus musculus
ccagcaaagtgcatacagtaggcat

SEQ ID NO: 339215 - DNA, 25 bp, Mus musculus
ccagcaaagtgcttacagtaggcat

SEQ ID NO: 339216 - DNA, 25 bp, Mus musculus
ccagcaaatggcaactacttatagt

SEQ ID NO: 339217 - DNA, 25 bp, Mus musculus
ccagcaaatggctactacttatagt

SEQ ID NO: 339218 - DNA, 25 bp, Mus musculus
ccagcaacaggcaagcaggatatgt

SEQ ID NO: 339219 - DNA, 25 bp, Mus musculus
ccagcaacaggctagcaggatatgt

SEQ ID NO: 339220 - DNA, 25 bp, Mus musculus
ccagcaaccacaaggtagcttcaac

SEQ ID NO: 339221 - DNA, 25 bp, Mus musculus
ccagcaaccacatggtagcttcaac

SEQ ID NO: 339222 - DNA, 25 bp, Mus musculus
ccagcaactgaaacctttgagacaa

SEQ ID NO: 339223 - DNA, 25 bp, Mus musculus
ccagcaactgaatcctttgagacaa

SEQ ID NO: 339224 - DNA, 25 bp, Mus musculus
ccagcaagaccaaaggatgatttta

SEQ ID NO: 339225 - DNA, 25 bp, Mus musculus
ccagcaagaccataggatgatttta

SEQ ID NO: 339226 - DNA, 25 bp, Mus musculus
ccagcaagagagcaaactattggtc

SEQ ID NO: 339227 - DNA, 25 bp, Mus musculus
ccagcaagagaggaaactattggtc

SEQ ID NO: 339228 - DNA, 25 bp, Mus musculus
ccagcaagatgcctctgacagtcat

SEQ ID NO: 339229 - DNA, 25 bp, Mus musculus
ccagcaagatgcgtctgacagtcat

SEQ ID NO: 339230 - DNA, 25 bp, Mus musculus
ccagcaagcctaagttgaccaagta

SEQ ID NO: 339231 - DNA, 25 bp, Mus musculus
ccagcaagcctatgttgaccaagta

SEQ ID NO: 339232 - DNA, 25 bp, Mus musculus
ccagcaaggctcacagaagggagcg

SEQ ID NO: 339233 - DNA, 25 bp, Mus musculus
ccagcaaggctctcagaagggagcg

SEQ ID NO: 339234 - DNA, 25 bp, Mus musculus
ccagcaaggtttccgatccccaagg

SEQ ID NO: 339235 - DNA, 25 bp, Mus musculus
ccagcaaggtttgcgatccccaagg

SEQ ID NO: 339236 - DNA, 25 bp, Mus musculus
ccagcaagtcttaggctctacagag

SEQ ID NO: 339237 - DNA, 25 bp, Mus musculus
ccagcaagtctttggctctacagag

SEQ ID NO: 339238 - DNA, 25 bp, Mus musculus
ccagcaataatactgtcttggcaca

SEQ ID NO: 339239 - DNA, 25 bp, Mus musculus
ccagcaataatagtgtcttggcaca

SEQ ID NO: 339240 - DNA, 25 bp, Mus musculus
ccagcaatgaggacacagctaatgg

SEQ ID NO: 339241 - DNA, 25 bp, Mus musculus
ccagcaatgaggtcacagctaatgg

SEQ ID NO: 339242 - DNA, 25 bp, Mus musculus
ccagcaatgggcctacagagcaaaa

SEQ ID NO: 339243 - DNA, 25 bp, Mus musculus
ccagcaatgggcgtacagagcaaaa

SEQ ID NO: 339244 - DNA, 25 bp, Mus musculus
ccagcaattcatcgcagcagctaat

SEQ ID NO: 339245 - DNA, 25 bp, Mus musculus
ccagcaattcatggcagcagctaat

SEQ ID NO: 339246 - DNA, 25 bp, Mus musculus
ccagcacacacacggtggcttaaag

SEQ ID NO: 339247 - DNA, 25 bp, Mus musculus
ccagcacacacagggtggcttaaag

SEQ ID NO: 339248 - DNA, 25 bp, Mus musculus
ccagcacacaggatgcagagcaggc

SEQ ID NO: 339249 - DNA, 25 bp, Mus musculus
ccagcacacaggttgcagagcaggc

SEQ ID NO: 339250 - DNA, 25 bp, Mus musculus
ccagcacagatgatctagttgtgtg

SEQ ID NO: 339251 - DNA, 25 bp, Mus musculus
ccagcacagatgttctagttgtgtg

SEQ ID NO: 339252 - DNA, 25 bp, Mus musculus
ccagcacagattcaccctgatttta

SEQ ID NO: 339253 - DNA, 25 bp, Mus musculus
ccagcacagattgaccctgatttta

SEQ ID NO: 339254 - DNA, 25 bp, Mus musculus
ccagcacaggctagcatggcattat

SEQ ID NO: 339255 - DNA, 25 bp, Mus musculus
ccagcacaggcttgcatggcattat

SEQ ID NO: 339256 - DNA, 25 bp, Mus musculus
ccagcacattagatgatagacagga

SEQ ID NO: 339257 - DNA, 25 bp, Mus musculus
ccagcacattagttgatagacagga

SEQ ID NO: 339258 - DNA, 25 bp, Mus musculus
ccagcaccacataaatgcaggtaag

SEQ ID NO: 339259 - DNA, 25 bp, Mus musculus
ccagcaccacattaatgcaggtaag

SEQ ID NO: 339260 - DNA, 25 bp, Mus musculus
ccagcaccaggacgcgacatgagat

SEQ ID NO: 339261 - DNA, 25 bp, Mus musculus
ccagcaccaggaggcgacatgagat

SEQ ID NO: 339262 - DNA, 25 bp, Mus musculus
ccagcaccaggtactctttgaagaa

SEQ ID NO: 339263 - DNA, 25 bp, Mus musculus
ccagcaccaggttctctttgaagaa

SEQ ID NO: 339264 - DNA, 25 bp, Mus musculus
ccagcaccatatagagatgggctaa

SEQ ID NO: 339265 - DNA, 25 bp, Mus musculus
ccagcaccatattgagatgggctaa

SEQ ID NO: 339266 - DNA, 25 bp, Mus musculus
ccagcaccattcagtaatacagcct

SEQ ID NO: 339267 - DNA, 25 bp, Mus musculus
ccagcaccattctgtaatacagcct

SEQ ID NO: 339268 - DNA, 25 bp, Mus musculus
ccagcacctacacttgtgtgcttta

SEQ ID NO: 339269 - DNA, 25 bp, Mus musculus
ccagcacctacagttgtgtgcttta

SEQ ID NO: 339270 - DNA, 25 bp, Mus musculus
ccagcacctgatccccaagattgag

SEQ ID NO: 339271 - DNA, 25 bp, Mus musculus
ccagcacctgatgcccaagattgag

SEQ ID NO: 339272 - DNA, 25 bp, Mus musculus
ccagcacctgtcatcctgattgtaa

SEQ ID NO: 339273 - DNA, 25 bp, Mus musculus
ccagcacctgtcttcctgattgtaa

SEQ ID NO: 339274 - DNA, 25 bp, Mus musculus
ccagcactaggcacatttgtagtac

SEQ ID NO: 339275 - DNA, 25 bp, Mus musculus
ccagcactaggctcatttgtagtac

SEQ ID NO: 339276 - DNA, 25 bp, Mus musculus
ccagcactatctactccaggaggag

SEQ ID NO: 339277 - DNA, 25 bp, Mus musculus
ccagcactatcttctccaggaggag

SEQ ID NO: 339278 - DNA, 25 bp, Mus musculus
ccagcactccccatttgatatattg

SEQ ID NO: 339279 - DNA, 25 bp, Mus musculus
ccagcactccccttttgatatattg

SEQ ID NO: 339280 - DNA, 25 bp, Mus musculus
ccagcactctctcgagtgggatagg

SEQ ID NO: 339281 - DNA, 25 bp, Mus musculus
ccagcactctctggagtgggatagg

SEQ ID NO: 339282 - DNA, 25 bp, Mus musculus
ccagcactgccaaaaaccaatataa

SEQ ID NO: 339283 - DNA, 25 bp, Mus musculus
ccagcactgccataaaccaatataa

SEQ ID NO: 339284 - DNA, 25 bp, Mus musculus
ccagcactggaaagaggttatatag

SEQ ID NO: 339285 - DNA, 25 bp, Mus musculus
ccagcactggaatgaggttatatag

SEQ ID NO: 339286 - DNA, 25 bp, Mus musculus
ccagcactggatatggttcctacaa

SEQ ID NO: 339287 - DNA, 25 bp, Mus musculus
ccagcactggatttggttcctacaa

SEQ ID NO: 339288 - DNA, 25 bp, Mus musculus
ccagcactggccaattaagacttca

SEQ ID NO: 339289 - DNA, 25 bp, Mus musculus
ccagcactggcctattaagacttca

SEQ ID NO: 339290 - DNA, 25 bp, Mus musculus
ccagcacttatgaggtataggccag

SEQ ID NO: 339291 - DNA, 25 bp, Mus musculus
ccagcacttatgtggtataggccag

SEQ ID NO: 339292 - DNA, 25 bp, Mus musculus
ccagcacttcccaaagatctttatg

SEQ ID NO: 339293 - DNA, 25 bp, Mus musculus
ccagcacttccctaagatctttatg

SEQ ID NO: 339294 - DNA, 25 bp, Mus musculus
ccagcactttcacatgggttttggg

SEQ ID NO: 339295 - DNA, 25 bp, Mus musculus
ccagcactttcagatgggttttggg

SEQ ID NO: 339296 - DNA, 25 bp, Mus musculus
ccagcagaaggtatagcccatgtta

SEQ ID NO: 339297 - DNA, 25 bp, Mus musculus
ccagcagaaggtttagcccatgtta

SEQ ID NO: 339298 - DNA, 25 bp, Mus musculus
ccagcagaagttacggcccagattc

SEQ ID NO: 339299 - DNA, 25 bp, Mus musculus
ccagcagaagtttcggcccagattc

SEQ ID NO: 339300 - DNA, 25 bp, Mus musculus
ccagcagactggagatctggagtct

SEQ ID NO: 339301 - DNA, 25 bp, Mus musculus
ccagcagactggtgatctggagtct

SEQ ID NO: 339302 - DNA, 25 bp, Mus musculus
ccagcagagaaacagtgatagaact

SEQ ID NO: 339303 - DNA, 25 bp, Mus musculus
ccagcagagaaagagtgatagaact

SEQ ID NO: 339304 - DNA, 25 bp, Mus musculus
ccagcagaggccagtgtcgtgtaac

SEQ ID NO: 339305 - DNA, 25 bp, Mus musculus
ccagcagaggcctgtgtcgtgtaac

SEQ ID NO: 339306 - DNA, 25 bp, Mus musculus
ccagcagagtcactgagatcaaggt

SEQ ID NO: 339307 - DNA, 25 bp, Mus musculus
ccagcagagtcagtgagatcaaggt

SEQ ID NO: 339308 - DNA, 25 bp, Mus musculus
ccagcagatactacgtgagcgagta

SEQ ID NO: 339309 - DNA, 25 bp, Mus musculus
ccagcagatacttcgtgagcgagta

SEQ ID NO: 339310 - DNA, 25 bp, Mus musculus
ccagcagatgagaaaagggcctaat

SEQ ID NO: 339311 - DNA, 25 bp, Mus musculus
ccagcagatgagtaaagggcctaat

SEQ ID NO: 339312 - DNA, 25 bp, Mus musculus
ccagcagcaattatcctacctctgc

SEQ ID NO: 339313 - DNA, 25 bp, Mus musculus
ccagcagcaattttcctacctctgc

SEQ ID NO: 339314 - DNA, 25 bp, Mus musculus
ccagcagcacaacgatctatcacat

SEQ ID NO: 339315 - DNA, 25 bp, Mus musculus
ccagcagcacaaggatctatcacat

SEQ ID NO: 339316 - DNA, 25 bp, Mus musculus
ccagcagcacggaaagagccttttt

SEQ ID NO: 339317 - DNA, 25 bp, Mus musculus
ccagcagcacggtaagagccttttt

SEQ ID NO: 339318 - DNA, 25 bp, Mus musculus
ccagcagcaggcacggttcatccag

SEQ ID NO: 339319 - DNA, 25 bp, Mus musculus
ccagcagcaggctcggttcatccag

SEQ ID NO: 339320 - DNA, 25 bp, Mus musculus
ccagcagcagtcagtacaggtcatg

SEQ ID NO: 339321 - DNA, 25 bp, Mus musculus
ccagcagcagtctgtacaggtcatg

SEQ ID NO: 339322 - DNA, 25 bp, Mus musculus
ccagcagcagtgaaagacccagagt

SEQ ID NO: 339323 - DNA, 25 bp, Mus musculus
ccagcagcagtgtaagacccagagt

SEQ ID NO: 339324 - DNA, 25 bp, Mus musculus
ccagcagcattgattatagcagcca

SEQ ID NO: 339325 - DNA, 25 bp, Mus musculus
ccagcagcattgtttatagcagcca

SEQ ID NO: 339326 - DNA, 25 bp, Mus musculus
ccagcagccactctaccttgtggta

SEQ ID NO: 339327 - DNA, 25 bp, Mus musculus
ccagcagccactgtaccttgtggta

SEQ ID NO: 339328 - DNA, 25 bp, Mus musculus
ccagcagccggtcgtgtcagcgaca

SEQ ID NO: 339329 - DNA, 25 bp, Mus musculus
ccagcagccggtggtgtcagcgaca

SEQ ID NO: 339330 - DNA, 25 bp, Mus musculus
ccagcagcctgcatattttataaat

SEQ ID NO: 339331 - DNA, 25 bp, Mus musculus
ccagcagcctgcttattttataaat

SEQ ID NO: 339332 - DNA, 25 bp, Mus musculus
ccagcagccttaactagtgtgatat

SEQ ID NO: 339333 - DNA, 25 bp, Mus musculus
ccagcagccttatctagtgtgatat

SEQ ID NO: 339334 - DNA, 25 bp, Mus musculus
ccagcagccttcagtatggagcagt

SEQ ID NO: 339335 - DNA, 25 bp, Mus musculus
ccagcagccttctgtatggagcagt

SEQ ID NO: 339336 - DNA, 25 bp, Mus musculus
ccagcagcgtttccagtgtgtgaac

SEQ ID NO: 339337 - DNA, 25 bp, Mus musculus
ccagcagcgtttgcagtgtgtgaac

SEQ ID NO: 339338 - DNA, 25 bp, Mus musculus
ccagcagctactaaggcggtctata

SEQ ID NO: 339339 - DNA, 25 bp, Mus musculus
ccagcagctacttaggcggtctata

SEQ ID NO: 339340 - DNA, 25 bp, Mus musculus
ccagcagctgggagacctgagtctg

SEQ ID NO: 339341 - DNA, 25 bp, Mus musculus
ccagcagctgggtgacctgagtctg

SEQ ID NO: 339342 - DNA, 25 bp, Mus musculus
ccagcaggaactctctcagtctgtg

SEQ ID NO: 339343 - DNA, 25 bp, Mus musculus
ccagcaggaactgtctcagtctgtg

SEQ ID NO: 339344 - DNA, 25 bp, Mus musculus
ccagcaggacaaccagcaacaaaag

SEQ ID NO: 339345 - DNA, 25 bp, Mus musculus
ccagcaggacaagcagcaacaaaag

SEQ ID NO: 339346 - DNA, 25 bp, Mus musculus
ccagcaggagatcgctcgtctggct

SEQ ID NO: 339347 - DNA, 25 bp, Mus musculus
ccagcaggagatggctcgtctggct

SEQ ID NO: 339348 - DNA, 25 bp, Mus musculus
ccagcaggcaggcagtgacgtcaac

SEQ ID NO: 339349 - DNA, 25 bp, Mus musculus
ccagcaggcagggagtgacgtcaac

SEQ ID NO: 339350 - DNA, 25 bp, Mus musculus
ccagcaggcgcgacctcaggcagaa

SEQ ID NO: 339351 - DNA, 25 bp, Mus musculus
ccagcaggcgcgtcctcaggcagaa

SEQ ID NO: 339352 - DNA, 25 bp, Mus musculus
ccagcaggcttaccaagaagcattt

SEQ ID NO: 339353 - DNA, 25 bp, Mus musculus
ccagcaggcttagcaagaagcattt

SEQ ID NO: 339354 - DNA, 25 bp, Mus musculus
ccagcaggcttcagcaggcttcagg

SEQ ID NO: 339355 - DNA, 25 bp, Mus musculus
ccagcaggcttctgcaggcttcagg

SEQ ID NO: 339356 - DNA, 25 bp, Mus musculus
ccagcaggctttcatgcgagcgtga

SEQ ID NO: 339357 - DNA, 25 bp, Mus musculus
ccagcaggctttgatgcgagcgtga

SEQ ID NO: 339358 - DNA, 25 bp, Mus musculus
ccagcagggcttagatctgcagtta

SEQ ID NO: 339359 - DNA, 25 bp, Mus musculus
ccagcagggctttgatctgcagtta

SEQ ID NO: 339360 - DNA, 25 bp, Mus musculus
ccagcagggtggagtgcacttgtct

SEQ ID NO: 339361 - DNA, 25 bp, Mus musculus
ccagcagggtggtgtgcacttgtct

SEQ ID NO: 339362 - DNA, 25 bp, Mus musculus
ccagcaggtgaaacctacttacaac

SEQ ID NO: 339363 - DNA, 25 bp, Mus musculus
ccagcaggtgaatcctacttacaac

SEQ ID NO: 339364 - DNA, 25 bp, Mus musculus
ccagcagtcctgacctaggacaaga

SEQ ID NO: 339365 - DNA, 25 bp, Mus musculus
ccagcagtcctgtcctaggacaaga

SEQ ID NO: 339366 - DNA, 25 bp, Mus musculus
ccagcagtgatacccttgaggtttc

SEQ ID NO: 339367 - DNA, 25 bp, Mus musculus
ccagcagtgatagccttgaggtttc

SEQ ID NO: 339368 - DNA, 25 bp, Mus musculus
ccagcagtgggtaccctaacacatt

SEQ ID NO: 339369 - DNA, 25 bp, Mus musculus
ccagcagtgggttccctaacacatt

SEQ ID NO: 339370 - DNA, 25 bp, Mus musculus
ccagcagtgtgaccagcacgtttat

SEQ ID NO: 339371 - DNA, 25 bp, Mus musculus
ccagcagtgtgagcagcacgtttat

SEQ ID NO: 339372 - DNA, 25 bp, Mus musculus
ccagcagttagcatacgtctcaggg

SEQ ID NO: 339373 - DNA, 25 bp, Mus musculus
ccagcagttagcttacgtctcaggg

SEQ ID NO: 339374 - DNA, 25 bp, Mus musculus
ccagcatacaccaggcaaattctct

SEQ ID NO: 339375 - DNA, 25 bp, Mus musculus
ccagcatacacctggcaaattctct

SEQ ID NO: 339376 - DNA, 25 bp, Mus musculus
ccagcatagatgcagcaagccctac

SEQ ID NO: 339377 - DNA, 25 bp, Mus musculus
ccagcatagatggagcaagccctac

SEQ ID NO: 339378 - DNA, 25 bp, Mus musculus
ccagcatatcctacactgtgcagaa

SEQ ID NO: 339379 - DNA, 25 bp, Mus musculus
ccagcatatccttcactgtgcagaa

SEQ ID NO: 339380 - DNA, 25 bp, Mus musculus
ccagcatcacccactgtctgttgga

SEQ ID NO: 339381 - DNA, 25 bp, Mus musculus
ccagcatcaccctctgtctgttgga

SEQ ID NO: 339382 - DNA, 25 bp, Mus musculus
ccagcatccacaaatggcttacaat

SEQ ID NO: 339383 - DNA, 25 bp, Mus musculus
ccagcatccacatatggcttacaat

SEQ ID NO: 339384 - DNA, 25 bp, Mus musculus
ccagcatcccagatgtctgtgtatt

SEQ ID NO: 339385 - DNA, 25 bp, Mus musculus
ccagcatcccagttgtctgtgtatt

SEQ ID NO: 339386 - DNA, 25 bp, Mus musculus
ccagcatcggagcagagaaggtcat

SEQ ID NO: 339387 - DNA, 25 bp, Mus musculus
ccagcatcggaggagagaaggtcat

SEQ ID NO: 339388 - DNA, 25 bp, Mus musculus
ccagcatctacaaaagggaatagtg

SEQ ID NO: 339389 - DNA, 25 bp, Mus musculus
ccagcatctacataagggaatagtg

SEQ ID NO: 339390 - DNA, 25 bp, Mus musculus
ccagcatctggtagtgtcttcggag

SEQ ID NO: 339391 - DNA, 25 bp, Mus musculus
ccagcatctggttgtgtcttcggag

SEQ ID NO: 339392 - DNA, 25 bp, Mus musculus
ccagcatcttctaagtgtactccag

SEQ ID NO: 339393 - DNA, 25 bp, Mus musculus
ccagcatcttcttagtgtactccag

SEQ ID NO: 339394 - DNA, 25 bp, Mus musculus
ccagcatgatgtatccaagagccct

SEQ ID NO: 339395 - DNA, 25 bp, Mus musculus
ccagcatgatgtttccaagagccct

SEQ ID NO: 339396 - DNA, 25 bp, Mus musculus
ccagcatgggacactgtgaggccac

SEQ ID NO: 339397 - DNA, 25 bp, Mus musculus
ccagcatgggactctgtgaggccac

SEQ ID NO: 339398 - DNA, 25 bp, Mus musculus
ccagcatgggtgataggcagtttcc

SEQ ID NO: 339399 - DNA, 25 bp, Mus musculus
ccagcatgggtgttaggcagtttcc

SEQ ID NO: 339400 - DNA, 25 bp, Mus musculus
ccagcatggtggaacatccctgtaa

SEQ ID NO: 339401 - DNA, 25 bp, Mus musculus
ccagcatggtggtacatccctgtaa

SEQ ID NO: 339402 - DNA, 25 bp, Mus musculus
ccagcattaggcacgcatgtggtaa

SEQ ID NO: 339403 - DNA, 25 bp, Mus musculus
ccagcattaggctcgcatgtggtaa

SEQ ID NO: 339404 - DNA, 25 bp, Mus musculus
ccagcattccacatttgttcattaa

SEQ ID NO: 339405 - DNA, 25 bp, Mus musculus
ccagcattccacttttgttcattaa

SEQ ID NO: 339406 - DNA, 25 bp, Mus musculus
ccagcattctgcaaggaccttacta

SEQ ID NO: 339407 - DNA, 25 bp, Mus musculus
ccagcattctgctaggaccttacta

SEQ ID NO: 339408 - DNA, 25 bp, Mus musculus
ccagcattctggatcataggcgttt

SEQ ID NO: 339409 - DNA, 25 bp, Mus musculus
ccagcattctggcttctagtccttg

SEQ ID NO: 339410 - DNA, 25 bp, Mus musculus
ccagcattctgggttctagtccttg

SEQ ID NO: 339411 - DNA, 25 bp, Mus musculus
ccagcattctggttcataggcgttt

SEQ ID NO: 339412 - DNA, 25 bp, Mus musculus
ccagcattgactcttcctgtgaatt

SEQ ID NO: 339413 - DNA, 25 bp, Mus musculus
ccagcattgactgttcctgtgaatt

SEQ ID NO: 339414 - DNA, 25 bp, Mus musculus
ccagcatttatgacagcttataagg

SEQ ID NO: 339415 - DNA, 25 bp, Mus musculus
ccagcatttatgtcagcttataagg

SEQ ID NO: 339416 - DNA, 25 bp, Mus musculus
ccagcatttcatcccgtttacatta

SEQ ID NO: 339417 - DNA, 25 bp, Mus musculus
ccagcatttcatgccgtttacatta

SEQ ID NO: 339418 - DNA, 25 bp, Mus musculus
ccagccacacttattgggatgaagt

SEQ ID NO: 339419 - DNA, 25 bp, Mus musculus
ccagccacactttttgggatgaagt

SEQ ID NO: 339420 - DNA, 25 bp, Mus musculus
ccagccacagaaatattttcgttgc

SEQ ID NO: 339421 - DNA, 25 bp, Mus musculus
ccagccacagaattattttcgttgc

SEQ ID NO: 339422 - DNA, 25 bp, Mus musculus
ccagccacagatcttctttctaagt

SEQ ID NO: 339423 - DNA, 25 bp, Mus musculus
ccagccacagatgttctttctaagt

SEQ ID NO: 339424 - DNA, 25 bp, Mus musculus
ccagccaccgaacactacttttagt

SEQ ID NO: 339425 - DNA, 25 bp, Mus musculus
ccagccaccgaagactacttttagt

SEQ ID NO: 339426 - DNA, 25 bp, Mus musculus
ccagccacctctatgagcagagcag

SEQ ID NO: 339427 - DNA, 25 bp, Mus musculus
ccagccacctctttgagcagagcag

SEQ ID NO: 339428 - DNA, 25 bp, Mus musculus
ccagccaccttcatctgttaataat

SEQ ID NO: 339429 - DNA, 25 bp, Mus musculus
ccagccaccttcttctgttaataat

SEQ ID NO: 339430 - DNA, 25 bp, Mus musculus
ccagccactctacttctaagaaagg

SEQ ID NO: 339431 - DNA, 25 bp, Mus musculus
ccagccactctagttctaagaaagg

SEQ ID NO: 339432 - DNA, 25 bp, Mus musculus
ccagccactggcatcttggttgaga

SEQ ID NO: 339433 - DNA, 25 bp, Mus musculus
ccagccactggcttcttggttgaga

SEQ ID NO: 339434 - DNA, 25 bp, Mus musculus
ccagccagactgcaaggtgctaata

SEQ ID NO: 339435 - DNA, 25 bp, Mus musculus
ccagccagactggaaggtgctaata

SEQ ID NO: 339436 - DNA, 25 bp, Mus musculus
ccagccagcaatacagagcagtttt

SEQ ID NO: 339437 - DNA, 25 bp, Mus musculus
ccagccagcaattcagagcagtttt

SEQ ID NO: 339438 - DNA, 25 bp, Mus musculus
ccagccagcaggcaacatgttcagg

SEQ ID NO: 339439 - DNA, 25 bp, Mus musculus
ccagccagcagggaacatgttcagg

SEQ ID NO: 339440 - DNA, 25 bp, Mus musculus
ccagccagctacctttttagtcaag

SEQ ID NO: 339441 - DNA, 25 bp, Mus musculus
ccagccagctacgtttttagtcaag

SEQ ID NO: 339442 - DNA, 25 bp, Mus musculus
ccagccagctttctgagctagctat

SEQ ID NO: 339443 - DNA, 25 bp, Mus musculus
ccagccagctttgtgagctagctat

SEQ ID NO: 339444 - DNA, 25 bp, Mus musculus
ccagccaggagtcagcatcaggtct

SEQ ID NO: 339445 - DNA, 25 bp, Mus musculus
ccagccaggagtctggaagcctact

SEQ ID NO: 339446 - DNA, 25 bp, Mus musculus
ccagccaggagtgagcatcaggtct

SEQ ID NO: 339447 - DNA, 25 bp, Mus musculus
ccagccaggagtgtggaagcctact

SEQ ID NO: 339448 - DNA, 25 bp, Mus musculus
ccagccaggcatagttgacagaggt

SEQ ID NO: 339449 - DNA, 25 bp, Mus musculus
ccagccaggcattgttgacagaggt

SEQ ID NO: 339450 - DNA, 25 bp, Mus musculus
ccagccagggaaagacaaattcaag

SEQ ID NO: 339451 - DNA, 25 bp, Mus musculus
ccagccagggaatgacaaattcaag

SEQ ID NO: 339452 - DNA, 25 bp, Mus musculus
ccagccatcatcagattcacaatca

SEQ ID NO: 339453 - DNA, 25 bp, Mus musculus
ccagccatcatctgattcacaatca

SEQ ID NO: 339454 - DNA, 25 bp, Mus musculus
ccagccatcattagcagaccaagag

SEQ ID NO: 339455 - DNA, 25 bp, Mus musculus
ccagccatcatttgcagaccaagag

SEQ ID NO: 339456 - DNA, 25 bp, Mus musculus
ccagccatctctctttactgagata

SEQ ID NO: 339457 - DNA, 25 bp, Mus musculus
ccagccatctctgtttactgagata

SEQ ID NO: 339458 - DNA, 25 bp, Mus musculus
ccagccatggaaaagcctattttgt

SEQ ID NO: 339459 - DNA, 25 bp, Mus musculus
ccagccatggaatagcctattttgt

SEQ ID NO: 339460 - DNA, 25 bp, Mus musculus
ccagccatggctacagaggattaca

SEQ ID NO: 339461 - DNA, 25 bp, Mus musculus
ccagccatggcttcagaggattaca

SEQ ID NO: 339462 - DNA, 25 bp, Mus musculus
ccagccatggtaaccaggcaggagg

SEQ ID NO: 339463 - DNA, 25 bp, Mus musculus
ccagccatggtatccaggcaggagg

SEQ ID NO: 339464 - DNA, 25 bp, Mus musculus
ccagccattgccaccaggtgaggtg

SEQ ID NO: 339465 - DNA, 25 bp, Mus musculus
ccagccattgcctccaggtgaggtg

SEQ ID NO: 339466 - DNA, 25 bp, Mus musculus
ccagcccaaaatccagttctttcaa

SEQ ID NO: 339467 - DNA, 25 bp, Mus musculus
ccagcccaaaatgcagttctttcaa

SEQ ID NO: 339468 - DNA, 25 bp, Mus musculus
ccagcccacgggatctttaatagta

SEQ ID NO: 339469 - DNA, 25 bp, Mus musculus
ccagcccacgggttctttaatagta

SEQ ID NO: 339470 - DNA, 25 bp, Mus musculus
ccagcccactggaatgttttcattg

SEQ ID NO: 339471 - DNA, 25 bp, Mus musculus
ccagcccactggtatgttttcattg

SEQ ID NO: 339472 - DNA, 25 bp, Mus musculus
ccagcccagacactaaaaccaagtg

SEQ ID NO: 339473 - DNA, 25 bp, Mus musculus
ccagcccagacagtaaaaccaagtg

SEQ ID NO: 339474 - DNA, 25 bp, Mus musculus
ccagcccagcttctgagagtcagtt

SEQ ID NO: 339475 - DNA, 25 bp, Mus musculus
ccagcccagcttgtgagagtcagtt

SEQ ID NO: 339476 - DNA, 25 bp, Mus musculus
ccagcccatgacagattatttaaaa

SEQ ID NO: 339477 - DNA, 25 bp, Mus musculus
ccagcccatgactgattatttaaaa

SEQ ID NO: 339478 - DNA, 25 bp, Mus musculus
ccagcccatgccaagattttgcttt

SEQ ID NO: 339479 - DNA, 25 bp, Mus musculus
ccagcccatgcctagattttgcttt

SEQ ID NO: 339480 - DNA, 25 bp, Mus musculus
ccagccccacatctatagcagtgaa

SEQ ID NO: 339481 - DNA, 25 bp, Mus musculus
ccagccccacatgtatagcagtgaa

SEQ ID NO: 339482 - DNA, 25 bp, Mus musculus
ccagccccacttaagttcttgtaat

SEQ ID NO: 339483 - DNA, 25 bp, Mus musculus
ccagccccactttagttcttgtaat

SEQ ID NO: 339484 - DNA, 25 bp, Mus musculus
ccagccccaggtatatcacttttaa

SEQ ID NO: 339485 - DNA, 25 bp, Mus musculus
ccagccccaggtttatcacttttaa

SEQ ID NO: 339486 - DNA, 25 bp, Mus musculus
ccagccccagtgatgtgactatgga

SEQ ID NO: 339487 - DNA, 25 bp, Mus musculus
ccagccccagtgttgtgactatgga

SEQ ID NO: 339488 - DNA, 25 bp, Mus musculus
ccagccccatcaaaaggactttgac

SEQ ID NO: 339489 - DNA, 25 bp, Mus musculus
ccagccccatcataaggactttgac

SEQ ID NO: 339490 - DNA, 25 bp, Mus musculus
ccagccccatgactacattttttta

SEQ ID NO: 339491 - DNA, 25 bp, Mus musculus
ccagccccatgagtacattttttta

SEQ ID NO: 339492 - DNA, 25 bp, Mus musculus
ccagccccatggagtgagacatgca

SEQ ID NO: 339493 - DNA, 25 bp, Mus musculus
ccagccccatggtgtgagacatgca

SEQ ID NO: 339494 - DNA, 25 bp, Mus musculus
ccagccccgattaacttgcattaag

SEQ ID NO: 339495 - DNA, 25 bp, Mus musculus
ccagccccgatttacttgcattaag

SEQ ID NO: 339496 - DNA, 25 bp, Mus musculus
ccagccccttgacccataatgaaga

SEQ ID NO: 339497 - DNA, 25 bp, Mus musculus
ccagccccttgagccataatgaaga

SEQ ID NO: 339498 - DNA, 25 bp, Mus musculus
ccagcccggtaaactcactgtcgct

SEQ ID NO: 339499 - DNA, 25 bp, Mus musculus
ccagcccggtaatctcactgtcgct

SEQ ID NO: 339500 - DNA, 25 bp, Mus musculus
ccagccctacagcaggctcaaaata

SEQ ID NO: 339501 - DNA, 25 bp, Mus musculus
ccagccctacaggaggctcaaaata

SEQ ID NO: 339502 - DNA, 25 bp, Mus musculus
ccagccctatttccacaaagcaaat

SEQ ID NO: 339503 - DNA, 25 bp, Mus musculus
ccagccctatttctgtcctttaaat

SEQ ID NO: 339504 - DNA, 25 bp, Mus musculus
ccagccctatttgcacaaagcaaat

SEQ ID NO: 339505 - DNA, 25 bp, Mus musculus
ccagccctatttgtgtcctttaaat

SEQ ID NO: 339506 - DNA, 25 bp, Mus musculus
ccagccctgagacacgtaggaaaga

SEQ ID NO: 339507 - DNA, 25 bp, Mus musculus
ccagccctgagagacgtaggaaaga

SEQ ID NO: 339508 - DNA, 25 bp, Mus musculus
ccagccctggcacaattcagagctt

SEQ ID NO: 339509 - DNA, 25 bp, Mus musculus
ccagccctggcagaattcagagctt

SEQ ID NO: 339510 - DNA, 25 bp, Mus musculus
ccagccctggttagtttattttgca

SEQ ID NO: 339511 - DNA, 25 bp, Mus musculus
ccagccctggtttgtttattttgca

SEQ ID NO: 339512 - DNA, 25 bp, Mus musculus
ccagcccttacacggcaaagtgtgg

SEQ ID NO: 339513 - DNA, 25 bp, Mus musculus
ccagcccttacagggcaaagtgtgg

SEQ ID NO: 339514 - DNA, 25 bp, Mus musculus
ccagcccttgagatgttagtcagca

SEQ ID NO: 339515 - DNA, 25 bp, Mus musculus
ccagcccttgagttgttagtcagca

SEQ ID NO: 339516 - DNA, 25 bp, Mus musculus
ccagccgaacggagaacggcagccg

SEQ ID NO: 339517 - DNA, 25 bp, Mus musculus
ccagccgaacggtgaacggcagccg

SEQ ID NO: 339518 - DNA, 25 bp, Mus musculus
ccagccgaactcatcagggtaatct

SEQ ID NO: 339519 - DNA, 25 bp, Mus musculus
ccagccgaactcttcagggtaatct

SEQ ID NO: 339520 - DNA, 25 bp, Mus musculus
ccagccggagagcactattcacaaa

SEQ ID NO: 339521 - DNA, 25 bp, Mus musculus
ccagccggagaggactattcacaaa

SEQ ID NO: 339522 - DNA, 25 bp, Mus musculus
ccagccggtactattagctcaacaa

SEQ ID NO: 339523 - DNA, 25 bp, Mus musculus
ccagccggtacttttagctcaacaa

SEQ ID NO: 339524 - DNA, 25 bp, Mus musculus
ccagccggtccactgtaggcaagag

SEQ ID NO: 339525 - DNA, 25 bp, Mus musculus
ccagccggtccagtgtaggcaagag

SEQ ID NO: 339526 - DNA, 25 bp, Mus musculus
ccagccgtctacctgtggatatagt

SEQ ID NO: 339527 - DNA, 25 bp, Mus musculus
ccagccgtctacgtgtggatatagt

SEQ ID NO: 339528 - DNA, 25 bp, Mus musculus
ccagccgtgaccagaaaagacaaca

SEQ ID NO: 339529 - DNA, 25 bp, Mus musculus
ccagccgtgacctgaaaagacaaca

SEQ ID NO: 339530 - DNA, 25 bp, Mus musculus
ccagccgtgatgatgaatgcaggaa

SEQ ID NO: 339531 - DNA, 25 bp, Mus musculus
ccagccgtgatgttgaatgcaggaa

SEQ ID NO: 339532 - DNA, 25 bp, Mus musculus
ccagccgtgtttacgtgccgatcgt

SEQ ID NO: 339533 - DNA, 25 bp, Mus musculus
ccagccgtgttttcgtgccgatcgt

SEQ ID NO: 339534 - DNA, 25 bp, Mus musculus
ccagcctaaggactgcagcaggtgc

SEQ ID NO: 339535 - DNA, 25 bp, Mus musculus
ccagcctaaggagtgcagcaggtgc

SEQ ID NO: 339536 - DNA, 25 bp, Mus musculus
ccagcctacagtcggtagtgccaac

SEQ ID NO: 339537 - DNA, 25 bp, Mus musculus
ccagcctacagtgggtagtgccaac

SEQ ID NO: 339538 - DNA, 25 bp, Mus musculus
ccagcctagacccatcagattttat

SEQ ID NO: 339539 - DNA, 25 bp, Mus musculus
ccagcctagaccgatcagattttat

SEQ ID NO: 339540 - DNA, 25 bp, Mus musculus
ccagcctagcctagatgaaagaata

SEQ ID NO: 339541 - DNA, 25 bp, Mus musculus
ccagcctagccttgatgaaagaata

SEQ ID NO: 339542 - DNA, 25 bp, Mus musculus
ccagcctaggtcatcgtgtggacat

SEQ ID NO: 339543 - DNA, 25 bp, Mus musculus
ccagcctaggtcttcgtgtggacat

SEQ ID NO: 339544 - DNA, 25 bp, Mus musculus
ccagcctagtcaacccttagtaaga

SEQ ID NO: 339545 - DNA, 25 bp, Mus musculus
ccagcctagtcatcccttagtaaga

SEQ ID NO: 339546 - DNA, 25 bp, Mus musculus
ccagcctcactgaggactagagaac

SEQ ID NO: 339547 - DNA, 25 bp, Mus musculus
ccagcctcactgtggactagagaac

SEQ ID NO: 339548 - DNA, 25 bp, Mus musculus
ccagcctcagtgatgaactcttgat

SEQ ID NO: 339549 - DNA, 25 bp, Mus musculus
ccagcctcagtgttgaactcttgat

SEQ ID NO: 339550 - DNA, 25 bp, Mus musculus
ccagcctccagaacacaatatgaaa

SEQ ID NO: 339551 - DNA, 25 bp, Mus musculus
ccagcctccagatcacaatatgaaa

SEQ ID NO: 339552 - DNA, 25 bp, Mus musculus
ccagcctccatgcaaggatgggtca

SEQ ID NO: 339553 - DNA, 25 bp, Mus musculus
ccagcctccatggaaggatgggtca

SEQ ID NO: 339554 - DNA, 25 bp, Mus musculus
ccagcctccctacattctttatttt

SEQ ID NO: 339555 - DNA, 25 bp, Mus musculus
ccagcctccctagattctttatttt

SEQ ID NO: 339556 - DNA, 25 bp, Mus musculus
ccagcctctaccagtcttgtgagag

SEQ ID NO: 339557 - DNA, 25 bp, Mus musculus
ccagcctctacctgtcttgtgagag

SEQ ID NO: 339558 - DNA, 25 bp, Mus musculus
ccagcctctgagcacaaatctgcta

SEQ ID NO: 339559 - DNA, 25 bp, Mus musculus
ccagcctctgaggacaaatctgcta

SEQ ID NO: 339560 - DNA, 25 bp, Mus musculus
ccagcctctgtgaaatctagtctag

SEQ ID NO: 339561 - DNA, 25 bp, Mus musculus
ccagcctctgtgtaatctagtctag

SEQ ID NO: 339562 - DNA, 25 bp, Mus musculus
ccagcctgactcattgtgacagatt

SEQ ID NO: 339563 - DNA, 25 bp, Mus musculus
ccagcctgactctttgtgacagatt

SEQ ID NO: 339564 - DNA, 25 bp, Mus musculus
ccagcctgcacgaggaccacagtga

SEQ ID NO: 339565 - DNA, 25 bp, Mus musculus
ccagcctgcacgtggaccacagtga

SEQ ID NO: 339566 - DNA, 25 bp, Mus musculus
ccagcctgcagacttgttctggttc

SEQ ID NO: 339567 - DNA, 25 bp, Mus musculus
ccagcctgcagagttgttctggttc

SEQ ID NO: 339568 - DNA, 25 bp, Mus musculus
ccagcctgcccactgtggagaagtg

SEQ ID NO: 339569 - DNA, 25 bp, Mus musculus
ccagcctgcccagtgtggagaagtg

SEQ ID NO: 339570 - DNA, 25 bp, Mus musculus
ccagcctggaaaacaccatttgttc

SEQ ID NO: 339571 - DNA, 25 bp, Mus musculus
ccagcctggaaatcaccatttgttc

SEQ ID NO: 339572 - DNA, 25 bp, Mus musculus
ccagcctggactatggtataaaacc

SEQ ID NO: 339573 - DNA, 25 bp, Mus musculus
ccagcctggactttggtataaaacc

SEQ ID NO: 339574 - DNA, 25 bp, Mus musculus
ccagcctggctacttgagactctgt

SEQ ID NO: 339575 - DNA, 25 bp, Mus musculus
ccagcctggctagttgagactctgt

SEQ ID NO: 339576 - DNA, 25 bp, Mus musculus
ccagcctgggaacgcctatgtggcc

SEQ ID NO: 339577 - DNA, 25 bp, Mus musculus
ccagcctgggaaggcctatgtggcc

SEQ ID NO: 339578 - DNA, 25 bp, Mus musculus
ccagcctggtacatagtgtgtttcc

SEQ ID NO: 339579 - DNA, 25 bp, Mus musculus
ccagcctggtacttagtgtgtttcc

SEQ ID NO: 339580 - DNA, 25 bp, Mus musculus
ccagcctggtcaacctaaagagttc

SEQ ID NO: 339581 - DNA, 25 bp, Mus musculus
ccagcctggtcatcctaaagagttc

SEQ ID NO: 339582 - DNA, 25 bp, Mus musculus
ccagcctggtggagtccaaaggaga

SEQ ID NO: 339583 - DNA, 25 bp, Mus musculus
ccagcctggtggtgtccaaaggaga

SEQ ID NO: 339584 - DNA, 25 bp, Mus musculus
ccagcctgtacactgtttgaccatt

SEQ ID NO: 339585 - DNA, 25 bp, Mus musculus
ccagcctgtacagtgtttgaccatt

SEQ ID NO: 339586 - DNA, 25 bp, Mus musculus
ccagcctgtgctaactcttgaatag

SEQ ID NO: 339587 - DNA, 25 bp, Mus musculus
ccagcctgtgcttactcttgaatag

SEQ ID NO: 339588 - DNA, 25 bp, Mus musculus
ccagccttaaaactgtccgaatgta

SEQ ID NO: 339589 - DNA, 25 bp, Mus musculus
ccagccttaaaagtgtccgaatgta

SEQ ID NO: 339590 - DNA, 25 bp, Mus musculus
ccagccttaacactaactctagcaa

SEQ ID NO: 339591 - DNA, 25 bp, Mus musculus
ccagccttaacagtaactctagcaa

SEQ ID NO: 339592 - DNA, 25 bp, Mus musculus
ccagccttaacccactgtggctttt

SEQ ID NO: 339593 - DNA, 25 bp, Mus musculus
ccagccttaaccgactgtggctttt

SEQ ID NO: 339594 - DNA, 25 bp, Mus musculus
ccagccttaatcctcattgctgtag

SEQ ID NO: 339595 - DNA, 25 bp, Mus musculus
ccagccttaatcgtcattgctgtag

SEQ ID NO: 339596 - DNA, 25 bp, Mus musculus
ccagccttcagtcggcgcaagatgg

SEQ ID NO: 339597 - DNA, 25 bp, Mus musculus
ccagccttcagtgggcgcaagatgg

SEQ ID NO: 339598 - DNA, 25 bp, Mus musculus
ccagccttcctcaacagattcagaa

SEQ ID NO: 339599 - DNA, 25 bp, Mus musculus
ccagccttcctcagagtgtgtgtat

SEQ ID NO: 339600 - DNA, 25 bp, Mus musculus
ccagccttcctctacagattcagaa

SEQ ID NO: 339601 - DNA, 25 bp, Mus musculus
ccagccttcctctgagtgtgtgtat

SEQ ID NO: 339602 - DNA, 25 bp, Mus musculus
ccagccttcctgcaggttagtgttt

SEQ ID NO: 339603 - DNA, 25 bp, Mus musculus
ccagccttcctggaggttagtgttt

SEQ ID NO: 339604 - DNA, 25 bp, Mus musculus
ccagccttcgttctgtttggagaat

SEQ ID NO: 339605 - DNA, 25 bp, Mus musculus
ccagccttcgttgtgtttggagaat

SEQ ID NO: 339606 - DNA, 25 bp, Mus musculus
ccagccttctatcggcagttatctc

SEQ ID NO: 339607 - DNA, 25 bp, Mus musculus
ccagccttctatgggcagttatctc

SEQ ID NO: 339608 - DNA, 25 bp, Mus musculus
ccagccttctcaaagaattcctttg

SEQ ID NO: 339609 - DNA, 25 bp, Mus musculus
ccagccttctcatagaattcctttg

SEQ ID NO: 339610 - DNA, 25 bp, Mus musculus
ccagccttctcgctgtaaggattga

SEQ ID NO: 339611 - DNA, 25 bp, Mus musculus
ccagccttctcggtgtaaggattga

SEQ ID NO: 339612 - DNA, 25 bp, Mus musculus
ccagccttctgacggatgtgcagct

SEQ ID NO: 339613 - DNA, 25 bp, Mus musculus
ccagccttctgagggatgtgcagct

SEQ ID NO: 339614 - DNA, 25 bp, Mus musculus
ccagccttctgtacacactttaaaa

SEQ ID NO: 339615 - DNA, 25 bp, Mus musculus
ccagccttctgttcacactttaaaa

SEQ ID NO: 339616 - DNA, 25 bp, Mus musculus
ccagccttgatacggccaccaggta

SEQ ID NO: 339617 - DNA, 25 bp, Mus musculus
ccagccttgatagggccaccaggta

SEQ ID NO: 339618 - DNA, 25 bp, Mus musculus
ccagccttgatgagggaggacccat

SEQ ID NO: 339619 - DNA, 25 bp, Mus musculus
ccagccttgatgtgggaggacccat

SEQ ID NO: 339620 - DNA, 25 bp, Mus musculus
ccagccttgccaccaggagagggaa

SEQ ID NO: 339621 - DNA, 25 bp, Mus musculus
ccagccttgccagcaggagagggaa

SEQ ID NO: 339622 - DNA, 25 bp, Mus musculus
ccagccttgctccttaataatatct

SEQ ID NO: 339623 - DNA, 25 bp, Mus musculus
ccagccttgctcgttaataatatct

SEQ ID NO: 339624 - DNA, 25 bp, Mus musculus
ccagccttgcttactactgcaaaga

SEQ ID NO: 339625 - DNA, 25 bp, Mus musculus
ccagccttgcttagagttggaggga

SEQ ID NO: 339626 - DNA, 25 bp, Mus musculus
ccagccttgctttctactgcaaaga

SEQ ID NO: 339627 - DNA, 25 bp, Mus musculus
ccagccttgctttgagttggaggga

SEQ ID NO: 339628 - DNA, 25 bp, Mus musculus
ccagccttggacatttcttttccag

SEQ ID NO: 339629 - DNA, 25 bp, Mus musculus
ccagccttggacttttcttttccag

SEQ ID NO: 339630 - DNA, 25 bp, Mus musculus
ccagccttgggaagaggattgacct

SEQ ID NO: 339631 - DNA, 25 bp, Mus musculus
ccagccttgggatgaggattgacct

SEQ ID NO: 339632 - DNA, 25 bp, Mus musculus
ccagccttggtaactctgttgagta

SEQ ID NO: 339633 - DNA, 25 bp, Mus musculus
ccagccttggtatctctgttgagta

SEQ ID NO: 339634 - DNA, 25 bp, Mus musculus
ccagccttggtgactgtaaatagaa

SEQ ID NO: 339635 - DNA, 25 bp, Mus musculus
ccagccttggtgtctgtaaatagaa

SEQ ID NO: 339636 - DNA, 25 bp, Mus musculus
ccagccttgtccataggagtcagaa

SEQ ID NO: 339637 - DNA, 25 bp, Mus musculus
ccagccttgtccttaggagtcagaa

SEQ ID NO: 339638 - DNA, 25 bp, Mus musculus
ccagcctttaccagtcttcctgtgt

SEQ ID NO: 339639 - DNA, 25 bp, Mus musculus
ccagcctttacctgtcttcctgtgt

SEQ ID NO: 339640 - DNA, 25 bp, Mus musculus
ccagcctttccaccaggttttagtg

SEQ ID NO: 339641 - DNA, 25 bp, Mus musculus
ccagcctttccagcaggttttagtg

SEQ ID NO: 339642 - DNA, 25 bp, Mus musculus
ccagcctttgtaatcaaagaagtgc

SEQ ID NO: 339643 - DNA, 25 bp, Mus musculus
ccagcctttgtattcaaagaagtgc

SEQ ID NO: 339644 - DNA, 25 bp, Mus musculus
ccagccttttgcaaatgcccatgat

SEQ ID NO: 339645 - DNA, 25 bp, Mus musculus
ccagccttttgctaatgcccatgat

SEQ ID NO: 339646 - DNA, 25 bp, Mus musculus
ccagcgaccacgagatcactttttt

SEQ ID NO: 339647 - DNA, 25 bp, Mus musculus
ccagcgaccacgtgatcactttttt

SEQ ID NO: 339648 - DNA, 25 bp, Mus musculus
ccagcgagctccagtggggacaatg

SEQ ID NO: 339649 - DNA, 25 bp, Mus musculus
ccagcgagctcctgtggggacaatg

SEQ ID NO: 339650 - DNA, 25 bp, Mus musculus
ccagcgagggcccttagatcaggat

SEQ ID NO: 339651 - DNA, 25 bp, Mus musculus
ccagcgagggccgttagatcaggat

SEQ ID NO: 339652 - DNA, 25 bp, Mus musculus
ccagcgaggtttacttagatacttt

SEQ ID NO: 339653 - DNA, 25 bp, Mus musculus
ccagcgaggttttcttagatacttt

SEQ ID NO: 339654 - DNA, 25 bp, Mus musculus
ccagcgagtggacggcctcccagaa

SEQ ID NO: 339655 - DNA, 25 bp, Mus musculus
ccagcgagtggagggcctcccagaa

SEQ ID NO: 339656 - DNA, 25 bp, Mus musculus
ccagcgatgactcttttgccatgat

SEQ ID NO: 339657 - DNA, 25 bp, Mus musculus
ccagcgatgactgttttgccatgat

SEQ ID NO: 339658 - DNA, 25 bp, Mus musculus
ccagcgcacctgatgcagtgtggga

SEQ ID NO: 339659 - DNA, 25 bp, Mus musculus
ccagcgcacctgttgcagtgtggga

SEQ ID NO: 339660 - DNA, 25 bp, Mus musculus
ccagcgccatctctagcaggaagaa

SEQ ID NO: 339661 - DNA, 25 bp, Mus musculus
ccagcgccatctgtagcaggaagaa

SEQ ID NO: 339662 - DNA, 25 bp, Mus musculus
ccagcgcccggaagtttttattcat

SEQ ID NO: 339663 - DNA, 25 bp, Mus musculus
ccagcgcccggatgtttttattcat

SEQ ID NO: 339664 - DNA, 25 bp, Mus musculus
ccagcgccgggaagtggactacagt

SEQ ID NO: 339665 - DNA, 25 bp, Mus musculus
ccagcgccgggatgtggactacagt

SEQ ID NO: 339666 - DNA, 25 bp, Mus musculus
ccagcgcctgtcattgattcataac

SEQ ID NO: 339667 - DNA, 25 bp, Mus musculus
ccagcgcctgtctttgattcataac

SEQ ID NO: 339668 - DNA, 25 bp, Mus musculus
ccagcgcttgccatagtctttggaa

SEQ ID NO: 339669 - DNA, 25 bp, Mus musculus
ccagcgcttgccttagtctttggaa

SEQ ID NO: 339670 - DNA, 25 bp, Mus musculus
ccagcggagtctatctgaagctcaa

SEQ ID NO: 339671 - DNA, 25 bp, Mus musculus
ccagcggagtctttctgaagctcaa

SEQ ID NO: 339672 - DNA, 25 bp, Mus musculus
ccagcggccgtgatagtctgtggat

SEQ ID NO: 339673 - DNA, 25 bp, Mus musculus
ccagcggccgtgttagtctgtggat

SEQ ID NO: 339674 - DNA, 25 bp, Mus musculus
ccagcggctaggctggtgtcaatct

SEQ ID NO: 339675 - DNA, 25 bp, Mus musculus
ccagcggctagggtggtgtcaatct

SEQ ID NO: 339676 - DNA, 25 bp, Mus musculus
ccagcggctgggatgtctcaatgat

SEQ ID NO: 339677 - DNA, 25 bp, Mus musculus
ccagcggctgggttgtctcaatgat

SEQ ID NO: 339678 - DNA, 25 bp, Mus musculus
ccagcgggatctactcttaggagca

SEQ ID NO: 339679 - DNA, 25 bp, Mus musculus
ccagcgggatcttctcttaggagca

SEQ ID NO: 339680 - DNA, 25 bp, Mus musculus
ccagcgggtgttagccgacctgaag

SEQ ID NO: 339681 - DNA, 25 bp, Mus musculus
ccagcgggtgtttgccgacctgaag

SEQ ID NO: 339682 - DNA, 25 bp, Mus musculus
ccagcggtacttagatagctttgga

SEQ ID NO: 339683 - DNA, 25 bp, Mus musculus
ccagcggtactttgatagctttgga

SEQ ID NO: 339684 - DNA, 25 bp, Mus musculus
ccagcggtctggatttgatagtttc

SEQ ID NO: 339685 - DNA, 25 bp, Mus musculus
ccagcggtctggttttgatagtttc

SEQ ID NO: 339686 - DNA, 25 bp, Mus musculus
ccagcggttgccaataattctaaat

SEQ ID NO: 339687 - DNA, 25 bp, Mus musculus
ccagcggttgcctataattctaaat

SEQ ID NO: 339688 - DNA, 25 bp, Mus musculus
ccagcgtagatcaaaccatgttaga

SEQ ID NO: 339689 - DNA, 25 bp, Mus musculus
ccagcgtagatctaaccatgttaga

SEQ ID NO: 339690 - DNA, 25 bp, Mus musculus
ccagcgtcacgtctaggcagatgca

SEQ ID NO: 339691 - DNA, 25 bp, Mus musculus
ccagcgtcacgtgtaggcagatgca

SEQ ID NO: 339692 - DNA, 25 bp, Mus musculus
ccagcgtctcaaaaccaggtgaaag

SEQ ID NO: 339693 - DNA, 25 bp, Mus musculus
ccagcgtctcaataccaggtgaaag

SEQ ID NO: 339694 - DNA, 25 bp, Mus musculus
ccagcgtctttcatgagcatgtata

SEQ ID NO: 339695 - DNA, 25 bp, Mus musculus
ccagcgtctttcttgagcatgtata

SEQ ID NO: 339696 - DNA, 25 bp, Mus musculus
ccagcgtggacaccaattaccattt

SEQ ID NO: 339697 - DNA, 25 bp, Mus musculus
ccagcgtggacagcaattaccattt

SEQ ID NO: 339698 - DNA, 25 bp, Mus musculus
ccagcgtggagcactctagtcaagt

SEQ ID NO: 339699 - DNA, 25 bp, Mus musculus
ccagcgtggagctctctagtcaagt

SEQ ID NO: 339700 - DNA, 25 bp, Mus musculus
ccagcgtggcccatgctgaacggaa

SEQ ID NO: 339701 - DNA, 25 bp, Mus musculus
ccagcgtggcccttgctgaacggaa

SEQ ID NO: 339702 - DNA, 25 bp, Mus musculus
ccagcgtggtgcaaagagccctgga

SEQ ID NO: 339703 - DNA, 25 bp, Mus musculus
ccagcgtggtgctaagagccctgga

SEQ ID NO: 339704 - DNA, 25 bp, Mus musculus
ccagcgtgtctgaggtgaagagcca

SEQ ID NO: 339705 - DNA, 25 bp, Mus musculus
ccagcgtgtctgtggtgaagagcca

SEQ ID NO: 339706 - DNA, 25 bp, Mus musculus
ccagcgtgtgggacagcagttgtac

SEQ ID NO: 339707 - DNA, 25 bp, Mus musculus
ccagcgtgtgggtcagcagttgtac

SEQ ID NO: 339708 - DNA, 25 bp, Mus musculus
ccagcgttactcatagggacttgtt

SEQ ID NO: 339709 - DNA, 25 bp, Mus musculus
ccagcgttactcttagggacttgtt

SEQ ID NO: 339710 - DNA, 25 bp, Mus musculus
ccagcgttgcaacatagcaggctgt

SEQ ID NO: 339711 - DNA, 25 bp, Mus musculus
ccagcgttgcaagatagcaggctgt

SEQ ID NO: 339712 - DNA, 25 bp, Mus musculus
ccagcgtttggtctctcggaatagt

SEQ ID NO: 339713 - DNA, 25 bp, Mus musculus
ccagcgtttggtgtctcggaatagt

SEQ ID NO: 339714 - DNA, 25 bp, Mus musculus
ccagcgttttggatggcattaaact

SEQ ID NO: 339715 - DNA, 25 bp, Mus musculus
ccagcgttttggttggcattaaact

SEQ ID NO: 339716 - DNA, 25 bp, Mus musculus
ccagctaaacatccttcatcgtcgg

SEQ ID NO: 339717 - DNA, 25 bp, Mus musculus
ccagctaaacatgcttcatcgtcgg

SEQ ID NO: 339718 - DNA, 25 bp, Mus musculus
ccagctacacatatgacagagggtt

SEQ ID NO: 339719 - DNA, 25 bp, Mus musculus
ccagctacacatttgacagagggtt

SEQ ID NO: 339720 - DNA, 25 bp, Mus musculus
ccagctacagagagacaagtatgga

SEQ ID NO: 339721 - DNA, 25 bp, Mus musculus
ccagctacagagtgacaagtatgga

SEQ ID NO: 339722 - DNA, 25 bp, Mus musculus
ccagctacatggaggcactgcttaa

SEQ ID NO: 339723 - DNA, 25 bp, Mus musculus
ccagctacatggtggcactgcttaa

SEQ ID NO: 339724 - DNA, 25 bp, Mus musculus
ccagctacccatcagttttagagct

SEQ ID NO: 339725 - DNA, 25 bp, Mus musculus
ccagctacccatgagttttagagct

SEQ ID NO: 339726 - DNA, 25 bp, Mus musculus
ccagctacgccaatgtggtgctatt

SEQ ID NO: 339727 - DNA, 25 bp, Mus musculus
ccagctacgccattgtggtgctatt

SEQ ID NO: 339728 - DNA, 25 bp, Mus musculus
ccagctactcatcctctttgacaaa

SEQ ID NO: 339729 - DNA, 25 bp, Mus musculus
ccagctactcatgctctttgacaaa

SEQ ID NO: 339730 - DNA, 25 bp, Mus musculus
ccagctactgcacggccagggaact

SEQ ID NO: 339731 - DNA, 25 bp, Mus musculus
ccagctactgcagggccagggaact

SEQ ID NO: 339732 - DNA, 25 bp, Mus musculus
ccagctagaagactccacatggact

SEQ ID NO: 339733 - DNA, 25 bp, Mus musculus
ccagctagaagagtccacatggact

SEQ ID NO: 339734 - DNA, 25 bp, Mus musculus
ccagctagtctaccctaatgggtta

SEQ ID NO: 339735 - DNA, 25 bp, Mus musculus
ccagctagtctagcctaatgggtta

SEQ ID NO: 339736 - DNA, 25 bp, Mus musculus
ccagctagtgctcctgttttggaag

SEQ ID NO: 339737 - DNA, 25 bp, Mus musculus
ccagctagtgctgctgttttggaag

SEQ ID NO: 339738 - DNA, 25 bp, Mus musculus
ccagctatcaacacgcgccctggaa

SEQ ID NO: 339739 - DNA, 25 bp, Mus musculus
ccagctatcaactcgcgccctggaa

SEQ ID NO: 339740 - DNA, 25 bp, Mus musculus
ccagctatctctcgacatgttgaag

SEQ ID NO: 339741 - DNA, 25 bp, Mus musculus
ccagctatctctggacatgttgaag

SEQ ID NO: 339742 - DNA, 25 bp, Mus musculus
ccagctatgatcatgttgattctga

SEQ ID NO: 339743 - DNA, 25 bp, Mus musculus
ccagctatgatcttgttgattctga

SEQ ID NO: 339744 - DNA, 25 bp, Mus musculus
ccagctatggccagtactcaattac

SEQ ID NO: 339745 - DNA, 25 bp, Mus musculus
ccagctatggcctgtactcaattac

SEQ ID NO: 339746 - DNA, 25 bp, Mus musculus
ccagctatgtaaaagatcgggttga

SEQ ID NO: 339747 - DNA, 25 bp, Mus musculus
ccagctatgtaatagatcgggttga

SEQ ID NO: 339748 - DNA, 25 bp, Mus musculus
ccagctattgctagggagttgataa

SEQ ID NO: 339749 - DNA, 25 bp, Mus musculus
ccagctattgcttgggagttgataa

SEQ ID NO: 339750 - DNA, 25 bp, Mus musculus
ccagctcaaaagatcgatctgtttt

SEQ ID NO: 339751 - DNA, 25 bp, Mus musculus
ccagctcaaaagttcgatctgtttt

SEQ ID NO: 339752 - DNA, 25 bp, Mus musculus
ccagctcaagttaaagtttcatgca

SEQ ID NO: 339753 - DNA, 25 bp, Mus musculus
ccagctcaagtttaagtttcatgca

SEQ ID NO: 339754 - DNA, 25 bp, Mus musculus
ccagctcagctcagtgttgtggaag

SEQ ID NO: 339755 - DNA, 25 bp, Mus musculus
ccagctcagctctgtgttgtggaag

SEQ ID NO: 339756 - DNA, 25 bp, Mus musculus
ccagctcagttccttatctaaacag

SEQ ID NO: 339757 - DNA, 25 bp, Mus musculus
ccagctcagttcgttatctaaacag

SEQ ID NO: 339758 - DNA, 25 bp, Mus musculus
ccagctcatgcgcattgagttcaag

SEQ ID NO: 339759 - DNA, 25 bp, Mus musculus
ccagctcatgcggattgagttcaag

SEQ ID NO: 339760 - DNA, 25 bp, Mus musculus
ccagctccacatctttctagttaat

SEQ ID NO: 339761 - DNA, 25 bp, Mus musculus
ccagctccacatgtttctagttaat

SEQ ID NO: 339762 - DNA, 25 bp, Mus musculus
ccagctccagaaattgacgggtgat

SEQ ID NO: 339763 - DNA, 25 bp, Mus musculus
ccagctccagaatttgacgggtgat

SEQ ID NO: 339764 - DNA, 25 bp, Mus musculus
ccagctccatacattcacacgaaga

SEQ ID NO: 339765 - DNA, 25 bp, Mus musculus
ccagctccatactttcacacgaaga

SEQ ID NO: 339766 - DNA, 25 bp, Mus musculus
ccagctcccatcacatattgttaag

SEQ ID NO: 339767 - DNA, 25 bp, Mus musculus
ccagctcccatctcatattgttaag

SEQ ID NO: 339768 - DNA, 25 bp, Mus musculus
ccagctccgtgtatttcgaactaac

SEQ ID NO: 339769 - DNA, 25 bp, Mus musculus
ccagctccgtgtttttcgaactaac

SEQ ID NO: 339770 - DNA, 25 bp, Mus musculus
ccagctcctcataggatttttacca

SEQ ID NO: 339771 - DNA, 25 bp, Mus musculus
ccagctcctcattggatttttacca

SEQ ID NO: 339772 - DNA, 25 bp, Mus musculus
ccagctcctcgaagactacaaagaa

SEQ ID NO: 339773 - DNA, 25 bp, Mus musculus
ccagctcctcgatgactacaaagaa

SEQ ID NO: 339774 - DNA, 25 bp, Mus musculus
ccagctccttatatttaactagtct

SEQ ID NO: 339775 - DNA, 25 bp, Mus musculus
ccagctccttatttttaactagtct

SEQ ID NO: 339776 - DNA, 25 bp, Mus musculus
ccagctccttgtcaccgagagatag

SEQ ID NO: 339777 - DNA, 25 bp, Mus musculus
ccagctccttgtgaccgagagatag

SEQ ID NO: 339778 - DNA, 25 bp, Mus musculus
ccagctcgcccacttatgaaatcag

SEQ ID NO: 339779 - DNA, 25 bp, Mus musculus
ccagctcgcccagttatgaaatcag

SEQ ID NO: 339780 - DNA, 25 bp, Mus musculus
ccagctcgtgagcaactgaacctga

SEQ ID NO: 339781 - DNA, 25 bp, Mus musculus
ccagctcgtgaggaactgaacctga

SEQ ID NO: 339782 - DNA, 25 bp, Mus musculus
ccagctctactaaatcttcttcctt

SEQ ID NO: 339783 - DNA, 25 bp, Mus musculus
ccagctctactatatcttcttcctt

SEQ ID NO: 339784 - DNA, 25 bp, Mus musculus
ccagctctagtgaaggcatgcatct

SEQ ID NO: 339785 - DNA, 25 bp, Mus musculus
ccagctctagtgtaggcatgcatct

SEQ ID NO: 339786 - DNA, 25 bp, Mus musculus
ccagctctcaacagtgttcatcaaa

SEQ ID NO: 339787 - DNA, 25 bp, Mus musculus
ccagctctcaactgtgttcatcaaa

SEQ ID NO: 339788 - DNA, 25 bp, Mus musculus
ccagctctccaactcaggtacatat

SEQ ID NO: 339789 - DNA, 25 bp, Mus musculus
ccagctctccaagtcaggtacatat

SEQ ID NO: 339790 - DNA, 25 bp, Mus musculus
ccagctctccctaggtttttgaaag

SEQ ID NO: 339791 - DNA, 25 bp, Mus musculus
ccagctctccctcggcatttggaaa

SEQ ID NO: 339792 - DNA, 25 bp, Mus musculus
ccagctctccctgggcatttggaaa

SEQ ID NO: 339793 - DNA, 25 bp, Mus musculus
ccagctctcccttggtttttgaaag

SEQ ID NO: 339794 - DNA, 25 bp, Mus musculus
ccagctctctcacggttgtgtgaag

SEQ ID NO: 339795 - DNA, 25 bp, Mus musculus
ccagctctctcagggttgtgtgaag

SEQ ID NO: 339796 - DNA, 25 bp, Mus musculus
ccagctctctgaagtctttatgtca

SEQ ID NO: 339797 - DNA, 25 bp, Mus musculus
ccagctctctgatgtctttatgtca

SEQ ID NO: 339798 - DNA, 25 bp, Mus musculus
ccagctctctgtattcctgaaggaa

SEQ ID NO: 339799 - DNA, 25 bp, Mus musculus
ccagctctctgttttcctgaaggaa

SEQ ID NO: 339800 - DNA, 25 bp, Mus musculus
ccagctctgaccaactgtctttgta

SEQ ID NO: 339801 - DNA, 25 bp, Mus musculus
ccagctctgacctactgtctttgta

SEQ ID NO: 339802 - DNA, 25 bp, Mus musculus
ccagctctggtcactgtattttcac

SEQ ID NO: 339803 - DNA, 25 bp, Mus musculus
ccagctctggtcatcctaggaatag

SEQ ID NO: 339804 - DNA, 25 bp, Mus musculus
ccagctctggtctctgtattttcac

SEQ ID NO: 339805 - DNA, 25 bp, Mus musculus
ccagctctggtcttcctaggaatag

SEQ ID NO: 339806 - DNA, 25 bp, Mus musculus
ccagctctgtgacgccttggactga

SEQ ID NO: 339807 - DNA, 25 bp, Mus musculus
ccagctctgtgaggccttggactga

SEQ ID NO: 339808 - DNA, 25 bp, Mus musculus
ccagctctgtttaatgtttgccctt

SEQ ID NO: 339809 - DNA, 25 bp, Mus musculus
ccagctctgttttatgtttgccctt

SEQ ID NO: 339810 - DNA, 25 bp, Mus musculus
ccagctcttagtagtgggaacaata

SEQ ID NO: 339811 - DNA, 25 bp, Mus musculus
ccagctcttagttgtgggaacaata

SEQ ID NO: 339812 - DNA, 25 bp, Mus musculus
ccagctcttggcatagaaaccttac

SEQ ID NO: 339813 - DNA, 25 bp, Mus musculus
ccagctcttggcttagaaaccttac

SEQ ID NO: 339814 - DNA, 25 bp, Mus musculus
ccagctctttggcaagtcttcagtt

SEQ ID NO: 339815 - DNA, 25 bp, Mus musculus
ccagctctttgggaagtcttcagtt

SEQ ID NO: 339816 - DNA, 25 bp, Mus musculus
ccagctcttttcatttgcctaatat

SEQ ID NO: 339817 - DNA, 25 bp, Mus musculus
ccagctcttttcttttgcctaatat

SEQ ID NO: 339818 - DNA, 25 bp, Mus musculus
ccagctgaaaatagcctacccttag

SEQ ID NO: 339819 - DNA, 25 bp, Mus musculus
ccagctgaaaattgcctacccttag

SEQ ID NO: 339820 - DNA, 25 bp, Mus musculus
ccagctgaaccgacccagaggagcg

SEQ ID NO: 339821 - DNA, 25 bp, Mus musculus
ccagctgaaccgtcccagaggagcg

SEQ ID NO: 339822 - DNA, 25 bp, Mus musculus
ccagctgaatccagtgaccatctag

SEQ ID NO: 339823 - DNA, 25 bp, Mus musculus
ccagctgaatcctgtgaccatctag

SEQ ID NO: 339824 - DNA, 25 bp, Mus musculus
ccagctgaccacagtttattggatg

SEQ ID NO: 339825 - DNA, 25 bp, Mus musculus
ccagctgaccactgtttattggatg

SEQ ID NO: 339826 - DNA, 25 bp, Mus musculus
ccagctgactggagcagatctctat

SEQ ID NO: 339827 - DNA, 25 bp, Mus musculus
ccagctgactggtgcagatctctat

SEQ ID NO: 339828 - DNA, 25 bp, Mus musculus
ccagctgagagcacctcggtggtgt

SEQ ID NO: 339829 - DNA, 25 bp, Mus musculus
ccagctgagagctcctcggtggtgt

SEQ ID NO: 339830 - DNA, 25 bp, Mus musculus
ccagctgagaggctgtgtccacaga

SEQ ID NO: 339831 - DNA, 25 bp, Mus musculus
ccagctgagagggtgtgtccacaga

SEQ ID NO: 339832 - DNA, 25 bp, Mus musculus
ccagctgagcgcattgagtttgact

SEQ ID NO: 339833 - DNA, 25 bp, Mus musculus
ccagctgagcgctttgagtttgact

SEQ ID NO: 339834 - DNA, 25 bp, Mus musculus
ccagctgatgtccaagggcgatgca

SEQ ID NO: 339835 - DNA, 25 bp, Mus musculus
ccagctgatgtcgaagggcgatgca

SEQ ID NO: 339836 - DNA, 25 bp, Mus musculus
ccagctgattccaagcagtgtccaa

SEQ ID NO: 339837 - DNA, 25 bp, Mus musculus
ccagctgattcctagcagtgtccaa

SEQ ID NO: 339838 - DNA, 25 bp, Mus musculus
ccagctgcaatcacggagtttgttt

SEQ ID NO: 339839 - DNA, 25 bp, Mus musculus
ccagctgcaatctcggagtttgttt

SEQ ID NO: 339840 - DNA, 25 bp, Mus musculus
ccagctgcagttcatgcttgctctg

SEQ ID NO: 339841 - DNA, 25 bp, Mus musculus
ccagctgcagttgatgcttgctctg

SEQ ID NO: 339842 - DNA, 25 bp, Mus musculus
ccagctgccaacactataatcggtg

SEQ ID NO: 339843 - DNA, 25 bp, Mus musculus
ccagctgccaactctataatcggtg

SEQ ID NO: 339844 - DNA, 25 bp, Mus musculus
ccagctgccctaaaacgttgttaag

SEQ ID NO: 339845 - DNA, 25 bp, Mus musculus
ccagctgccctataacgttgttaag

SEQ ID NO: 339846 - DNA, 25 bp, Mus musculus
ccagctgccctgagtcatgtgagga

SEQ ID NO: 339847 - DNA, 25 bp, Mus musculus
ccagctgccctgtgtcatgtgagga

SEQ ID NO: 339848 - DNA, 25 bp, Mus musculus
ccagctgcctcaatgattctgagat

SEQ ID NO: 339849 - DNA, 25 bp, Mus musculus
ccagctgcctcattgattctgagat

SEQ ID NO: 339850 - DNA, 25 bp, Mus musculus
ccagctgcgggactttataaacaag

SEQ ID NO: 339851 - DNA, 25 bp, Mus musculus
ccagctgcgggagtttataaacaag

SEQ ID NO: 339852 - DNA, 25 bp, Mus musculus
ccagctgctcgtcgatcagatctat

SEQ ID NO: 339853 - DNA, 25 bp, Mus musculus
ccagctgctcgtggatcagatctat

SEQ ID NO: 339854 - DNA, 25 bp, Mus musculus
ccagctgctgaaatgaatcatcccc

SEQ ID NO: 339855 - DNA, 25 bp, Mus musculus
ccagctgctgaattgaatcatcccc

SEQ ID NO: 339856 - DNA, 25 bp, Mus musculus
ccagctgctggacctgtagttccac

SEQ ID NO: 339857 - DNA, 25 bp, Mus musculus
ccagctgctggagctgtagttccac

SEQ ID NO: 339858 - DNA, 25 bp, Mus musculus
ccagctgctgtcctgtcttgtataa

SEQ ID NO: 339859 - DNA, 25 bp, Mus musculus
ccagctgctgtcgtgtcttgtataa

SEQ ID NO: 339860 - DNA, 25 bp, Mus musculus
ccagctgctgtgaggaaaggcttca

SEQ ID NO: 339861 - DNA, 25 bp, Mus musculus
ccagctgctgtgtggaaaggcttca

SEQ ID NO: 339862 - DNA, 25 bp, Mus musculus
ccagctgcttggcttgattgtagat

SEQ ID NO: 339863 - DNA, 25 bp, Mus musculus
ccagctgcttgggttgattgtagat

SEQ ID NO: 339864 - DNA, 25 bp, Mus musculus
ccagctggcccgacgcattcgtggg

SEQ ID NO: 339865 - DNA, 25 bp, Mus musculus
ccagctggcccgtcgcattcgtggg

SEQ ID NO: 339866 - DNA, 25 bp, Mus musculus
ccagctgggcatccttttaagaaac

SEQ ID NO: 339867 - DNA, 25 bp, Mus musculus
ccagctgggcatgcttttaagaaac

SEQ ID NO: 339868 - DNA, 25 bp, Mus musculus
ccagctgggtgtcggcagttactaa

SEQ ID NO: 339869 - DNA, 25 bp, Mus musculus
ccagctgggtgtgggcagttactaa

SEQ ID NO: 339870 - DNA, 25 bp, Mus musculus
ccagctgtagctcttcttcagtgag

SEQ ID NO: 339871 - DNA, 25 bp, Mus musculus
ccagctgtagctgttcttcagtgag

SEQ ID NO: 339872 - DNA, 25 bp, Mus musculus
ccagctgtatccagtgctcttgaac

SEQ ID NO: 339873 - DNA, 25 bp, Mus musculus
ccagctgtatcctgtgctcttgaac

SEQ ID NO: 339874 - DNA, 25 bp, Mus musculus
ccagctgtccttctgttgacaggga

SEQ ID NO: 339875 - DNA, 25 bp, Mus musculus
ccagctgtccttgtgttgacaggga

SEQ ID NO: 339876 - DNA, 25 bp, Mus musculus
ccagctgtctcaatgcttagctcta

SEQ ID NO: 339877 - DNA, 25 bp, Mus musculus
ccagctgtctcattgcttagctcta

SEQ ID NO: 339878 - DNA, 25 bp, Mus musculus
ccagctgtcttgcaggtggaatgcc

SEQ ID NO: 339879 - DNA, 25 bp, Mus musculus
ccagctgtcttggaggtggaatgcc

SEQ ID NO: 339880 - DNA, 25 bp, Mus musculus
ccagctgtgaatcggacctcacaca

SEQ ID NO: 339881 - DNA, 25 bp, Mus musculus
ccagctgtgaatgggacctcacaca

SEQ ID NO: 339882 - DNA, 25 bp, Mus musculus
ccagctgtgagcaggatggccagcc

SEQ ID NO: 339883 - DNA, 25 bp, Mus musculus
ccagctgtgagctggatggccagcc

SEQ ID NO: 339884 - DNA, 25 bp, Mus musculus
ccagctgtgcagacaccaaggcaga

SEQ ID NO: 339885 - DNA, 25 bp, Mus musculus
ccagctgtgcagaggcttcggtgaa

SEQ ID NO: 339886 - DNA, 25 bp, Mus musculus
ccagctgtgcagtcaccaaggcaga

SEQ ID NO: 339887 - DNA, 25 bp, Mus musculus
ccagctgtgcagtggcttcggtgaa

SEQ ID NO: 339888 - DNA, 25 bp, Mus musculus
ccagctgtgcttattagaagaccta

SEQ ID NO: 339889 - DNA, 25 bp, Mus musculus
ccagctgtgctttttagaagaccta

SEQ ID NO: 339890 - DNA, 25 bp, Mus musculus
ccagctgtgtccctattaactttta

SEQ ID NO: 339891 - DNA, 25 bp, Mus musculus
ccagctgtgtccgtattaactttta

SEQ ID NO: 339892 - DNA, 25 bp, Mus musculus
ccagctgttggtaaatactagtcat

SEQ ID NO: 339893 - DNA, 25 bp, Mus musculus
ccagctgttggttaatactagtcat

SEQ ID NO: 339894 - DNA, 25 bp, Mus musculus
ccagcttaacctacagtttgagaga

SEQ ID NO: 339895 - DNA, 25 bp, Mus musculus
ccagcttaaccttcagtttgagaga

SEQ ID NO: 339896 - DNA, 25 bp, Mus musculus
ccagcttacagtaaatcacaccggg

SEQ ID NO: 339897 - DNA, 25 bp, Mus musculus
ccagcttacagttaatcacaccggg

SEQ ID NO: 339898 - DNA, 25 bp, Mus musculus
ccagcttacttacaactagtgaaaa

SEQ ID NO: 339899 - DNA, 25 bp, Mus musculus
ccagcttacttagaactagtgaaaa

SEQ ID NO: 339900 - DNA, 25 bp, Mus musculus
ccagcttagtgtacacagtgaaact

SEQ ID NO: 339901 - DNA, 25 bp, Mus musculus
ccagcttagtgttcacagtgaaact

SEQ ID NO: 339902 - DNA, 25 bp, Mus musculus
ccagcttatagcacattaacttctt

SEQ ID NO: 339903 - DNA, 25 bp, Mus musculus
ccagcttatagctcattaacttctt

SEQ ID NO: 339904 - DNA, 25 bp, Mus musculus
ccagcttcatctctctgagaggaga

SEQ ID NO: 339905 - DNA, 25 bp, Mus musculus
ccagcttcatctgtctgagaggaga

SEQ ID NO: 339906 - DNA, 25 bp, Mus musculus
ccagcttcattaacaatgcactatg

SEQ ID NO: 339907 - DNA, 25 bp, Mus musculus
ccagcttcattatcaatgcactatg

SEQ ID NO: 339908 - DNA, 25 bp, Mus musculus
ccagcttcctgaaagacactcattc

SEQ ID NO: 339909 - DNA, 25 bp, Mus musculus
ccagcttcctgatagacactcattc

SEQ ID NO: 339910 - DNA, 25 bp, Mus musculus
ccagcttccttgagacttgagcata

SEQ ID NO: 339911 - DNA, 25 bp, Mus musculus
ccagcttccttgtgacttgagcata

SEQ ID NO: 339912 - DNA, 25 bp, Mus musculus
ccagcttctaccaaattcaaactct

SEQ ID NO: 339913 - DNA, 25 bp, Mus musculus
ccagcttctacctaattcaaactct

SEQ ID NO: 339914 - DNA, 25 bp, Mus musculus
ccagcttctagacgaatttggtcta

SEQ ID NO: 339915 - DNA, 25 bp, Mus musculus
ccagcttctagaggaatttggtcta

SEQ ID NO: 339916 - DNA, 25 bp, Mus musculus
ccagcttctagtatactttcgggat

SEQ ID NO: 339917 - DNA, 25 bp, Mus musculus
ccagcttctagtttactttcgggat

SEQ ID NO: 339918 - DNA, 25 bp, Mus musculus
ccagcttctcgcaggcagaagatga

SEQ ID NO: 339919 - DNA, 25 bp, Mus musculus
ccagcttctcgctggcagaagatga

SEQ ID NO: 339920 - DNA, 25 bp, Mus musculus
ccagcttctctgaatcctaggtgaa

SEQ ID NO: 339921 - DNA, 25 bp, Mus musculus
ccagcttctctgtatcctaggtgaa

SEQ ID NO: 339922 - DNA, 25 bp, Mus musculus
ccagcttctcttcaagtgtcatgac

SEQ ID NO: 339923 - DNA, 25 bp, Mus musculus
ccagcttctcttgaagtgtcatgac

SEQ ID NO: 339924 - DNA, 25 bp, Mus musculus
ccagcttctgatcagtggctttttt

SEQ ID NO: 339925 - DNA, 25 bp, Mus musculus
ccagcttctgatgagtggctttttt

SEQ ID NO: 339926 - DNA, 25 bp, Mus musculus
ccagcttctgggactgggtttgtga

SEQ ID NO: 339927 - DNA, 25 bp, Mus musculus
ccagcttctgggtctgggtttgtga

SEQ ID NO: 339928 - DNA, 25 bp, Mus musculus
ccagcttctggtcgatcaggccaaa

SEQ ID NO: 339929 - DNA, 25 bp, Mus musculus
ccagcttctggtggatcaggccaaa

SEQ ID NO: 339930 - DNA, 25 bp, Mus musculus
ccagcttctgtaactccttatggaa

SEQ ID NO: 339931 - DNA, 25 bp, Mus musculus
ccagcttctgtatctccttatggaa

SEQ ID NO: 339932 - DNA, 25 bp, Mus musculus
ccagcttcttctatcataaatttgt

SEQ ID NO: 339933 - DNA, 25 bp, Mus musculus
ccagcttcttctttcataaatttgt

SEQ ID NO: 339934 - DNA, 25 bp, Mus musculus
ccagcttgaactccattgtgagtta

SEQ ID NO: 339935 - DNA, 25 bp, Mus musculus
ccagcttgaactgcattgtgagtta

SEQ ID NO: 339936 - DNA, 25 bp, Mus musculus
ccagcttgacttcttaatccattct

SEQ ID NO: 339937 - DNA, 25 bp, Mus musculus
ccagcttgacttgttaatccattct

SEQ ID NO: 339938 - DNA, 25 bp, Mus musculus
ccagcttgccaacagtggactcaaa

SEQ ID NO: 339939 - DNA, 25 bp, Mus musculus
ccagcttgccaagagtggactcaaa

SEQ ID NO: 339940 - DNA, 25 bp, Mus musculus
ccagcttgcctgctaatgactgctt

SEQ ID NO: 339941 - DNA, 25 bp, Mus musculus
ccagcttgcctggtaatgactgctt

SEQ ID NO: 339942 - DNA, 25 bp, Mus musculus
ccagcttggcctacgtggtgaggta

SEQ ID NO: 339943 - DNA, 25 bp, Mus musculus
ccagcttggccttcgtggtgaggta

SEQ ID NO: 339944 - DNA, 25 bp, Mus musculus
ccagcttgggacagtatgaggccct

SEQ ID NO: 339945 - DNA, 25 bp, Mus musculus
ccagcttgggacatagcaagaccct

SEQ ID NO: 339946 - DNA, 25 bp, Mus musculus
ccagcttgggactgtatgaggccct

SEQ ID NO: 339947 - DNA, 25 bp, Mus musculus
ccagcttgggacttagcaagaccct

SEQ ID NO: 339948 - DNA, 25 bp, Mus musculus
ccagcttggttgcatcctgatttag

SEQ ID NO: 339949 - DNA, 25 bp, Mus musculus
ccagcttggttggatcctgatttag

SEQ ID NO: 339950 - DNA, 25 bp, Mus musculus
ccagcttggtttacacatagcaagt

SEQ ID NO: 339951 - DNA, 25 bp, Mus musculus
ccagcttggttttcacatagcaagt

SEQ ID NO: 339952 - DNA, 25 bp, Mus musculus
ccagcttgtcacatggtgccagagt

SEQ ID NO: 339953 - DNA, 25 bp, Mus musculus
ccagcttgtcacttggtgccagagt

SEQ ID NO: 339954 - DNA, 25 bp, Mus musculus
ccagctttaccacacaccatggaga

SEQ ID NO: 339955 - DNA, 25 bp, Mus musculus
ccagctttaccagacaccatggaga

SEQ ID NO: 339956 - DNA, 25 bp, Mus musculus
ccagctttagcaacacaacaagtgt

SEQ ID NO: 339957 - DNA, 25 bp, Mus musculus
ccagctttagcatcacaacaagtgt

SEQ ID NO: 339958 - DNA, 25 bp, Mus musculus
ccagctttaggcaaactttctgtta

SEQ ID NO: 339959 - DNA, 25 bp, Mus musculus
ccagctttaggctaactttctgtta

SEQ ID NO: 339960 - DNA, 25 bp, Mus musculus
ccagctttcctcctatgtgaaacag

SEQ ID NO: 339961 - DNA, 25 bp, Mus musculus
ccagctttcctcgtatgtgaaacag

SEQ ID NO: 339962 - DNA, 25 bp, Mus musculus
ccagctttcctgaatgcagttctca

SEQ ID NO: 339963 - DNA, 25 bp, Mus musculus
ccagctttcctgtatgcagttctca

SEQ ID NO: 339964 - DNA, 25 bp, Mus musculus
ccagctttcttcatgtcacacactg

SEQ ID NO: 339965 - DNA, 25 bp, Mus musculus
ccagctttcttcttgtcacacactg

SEQ ID NO: 339966 - DNA, 25 bp, Mus musculus
ccagctttgacacacctgctttcaa

SEQ ID NO: 339967 - DNA, 25 bp, Mus musculus
ccagctttgacagacctgctttcaa

SEQ ID NO: 339968 - DNA, 25 bp, Mus musculus
ccagctttgaggctctcactgggag

SEQ ID NO: 339969 - DNA, 25 bp, Mus musculus
ccagctttgagggtctcactgggag

SEQ ID NO: 339970 - DNA, 25 bp, Mus musculus
ccagctttgccgaagcactagagga

SEQ ID NO: 339971 - DNA, 25 bp, Mus musculus
ccagctttgccgtagcactagagga

SEQ ID NO: 339972 - DNA, 25 bp, Mus musculus
ccagctttgctgctaatgtgtttta

SEQ ID NO: 339973 - DNA, 25 bp, Mus musculus
ccagctttgctggtaatgtgtttta

SEQ ID NO: 339974 - DNA, 25 bp, Mus musculus
ccagcttttgatcgtgcctttcctt

SEQ ID NO: 339975 - DNA, 25 bp, Mus musculus
ccagcttttgatggtgcctttcctt

SEQ ID NO: 339976 - DNA, 25 bp, Mus musculus
ccagcttttggactgaatctcagag

SEQ ID NO: 339977 - DNA, 25 bp, Mus musculus
ccagcttttggagtgaatctcagag

SEQ ID NO: 339978 - DNA, 25 bp, Mus musculus
ccagcttttggtagtttgccctatt

SEQ ID NO: 339979 - DNA, 25 bp, Mus musculus
ccagcttttggttgtttgccctatt

SEQ ID NO: 339980 - DNA, 25 bp, Mus musculus
ccaggaaaccttcagagggttgtca

SEQ ID NO: 339981 - DNA, 25 bp, Mus musculus
ccaggaaaccttgagagggttgtca

SEQ ID NO: 339982 - DNA, 25 bp, Mus musculus
ccaggaaactgacccatgtccttca

SEQ ID NO: 339983 - DNA, 25 bp, Mus musculus
ccaggaaactgagccatgtccttca

SEQ ID NO: 339984 - DNA, 25 bp, Mus musculus
ccaggaaagtgtccattggccacat

SEQ ID NO: 339985 - DNA, 25 bp, Mus musculus
ccaggaaagtgtgcattggccacat

SEQ ID NO: 339986 - DNA, 25 bp, Mus musculus
ccaggaaatgaacaggttgcagcaa

SEQ ID NO: 339987 - DNA, 25 bp, Mus musculus
ccaggaaatgaagaggttgcagcaa

SEQ ID NO: 339988 - DNA, 25 bp, Mus musculus
ccaggaaatgccacaaaacagaatt

SEQ ID NO: 339989 - DNA, 25 bp, Mus musculus
ccaggaaatgcctcaaaacagaatt

SEQ ID NO: 339990 - DNA, 25 bp, Mus musculus
ccaggaacaggtcacttggaacaca

SEQ ID NO: 339991 - DNA, 25 bp, Mus musculus
ccaggaacaggtgacttggaacaca

SEQ ID NO: 339992 - DNA, 25 bp, Mus musculus
ccaggaacccgtattctctctatag

SEQ ID NO: 339993 - DNA, 25 bp, Mus musculus
ccaggaacccgttttctctctatag

SEQ ID NO: 339994 - DNA, 25 bp, Mus musculus
ccaggaagccacagggtccaggttt

SEQ ID NO: 339995 - DNA, 25 bp, Mus musculus
ccaggaagccaccaggtaggttagg

SEQ ID NO: 339996 - DNA, 25 bp, Mus musculus
ccaggaagccacgaggtaggttagg

SEQ ID NO: 339997 - DNA, 25 bp, Mus musculus
ccaggaagccactgggtccaggttt

SEQ ID NO: 339998 - DNA, 25 bp, Mus musculus
ccaggaagctctcacgtacttgggt

SEQ ID NO: 339999 - DNA, 25 bp, Mus musculus
ccaggaagctctgacgtacttgggt

SEQ ID NO: 340000 - DNA, 25 bp, Mus musculus
ccaggaaggaagcacatcctctcag

SEQ ID NO: 340001 - DNA, 25 bp, Mus musculus
ccaggaaggaaggacatcctctcag

SEQ ID NO: 340002 - DNA, 25 bp, Mus musculus
ccaggaaggactccgtgcagcctca

SEQ ID NO: 340003 - DNA, 25 bp, Mus musculus
ccaggaaggactgcgtgcagcctca

SEQ ID NO: 340004 - DNA, 25 bp, Mus musculus
ccaggaagtgtgacccgtctgtggt

SEQ ID NO: 340005 - DNA, 25 bp, Mus musculus
ccaggaagtgtgatggcagcctctt

SEQ ID NO: 340006 - DNA, 25 bp, Mus musculus
ccaggaagtgtgtcccgtctgtggt

SEQ ID NO: 340007 - DNA, 25 bp, Mus musculus
ccaggaagtgtgttggcagcctctt

SEQ ID NO: 340008 - DNA, 25 bp, Mus musculus
ccaggaagttttcttgtgtgcttac

SEQ ID NO: 340009 - DNA, 25 bp, Mus musculus
ccaggaagttttgttgtgtgcttac

SEQ ID NO: 340010 - DNA, 25 bp, Mus musculus
ccaggaatatcaaggctgcacctcc

SEQ ID NO: 340011 - DNA, 25 bp, Mus musculus
ccaggaatatcatggctgcacctcc

SEQ ID NO: 340012 - DNA, 25 bp, Mus musculus
ccaggaatcctactttatgggccta

SEQ ID NO: 340013 - DNA, 25 bp, Mus musculus
ccaggaatcctagtttatgggccta

SEQ ID NO: 340014 - DNA, 25 bp, Mus musculus
ccaggaatgaggcagccatggcctt

SEQ ID NO: 340015 - DNA, 25 bp, Mus musculus
ccaggaatgagggagccatggcctt

SEQ ID NO: 340016 - DNA, 25 bp, Mus musculus
ccaggaatgcagctcaggtgacaga

SEQ ID NO: 340017 - DNA, 25 bp, Mus musculus
ccaggaatgcaggtcaggtgacaga

SEQ ID NO: 340018 - DNA, 25 bp, Mus musculus
ccaggaatgctcatggtacacataa

SEQ ID NO: 340019 - DNA, 25 bp, Mus musculus
ccaggaatgctcttggtacacataa

SEQ ID NO: 340020 - DNA, 25 bp, Mus musculus
ccaggaatgggacgcccgtgtcctt

SEQ ID NO: 340021 - DNA, 25 bp, Mus musculus
ccaggaatgggaggcccgtgtcctt

SEQ ID NO: 340022 - DNA, 25 bp, Mus musculus
ccaggaatggtgagatgtgcatgct

SEQ ID NO: 340023 - DNA, 25 bp, Mus musculus
ccaggaatggtgtgatgtgcatgct

SEQ ID NO: 340024 - DNA, 25 bp, Mus musculus
ccaggacaaatgcttgtgaaagtaa

SEQ ID NO: 340025 - DNA, 25 bp, Mus musculus
ccaggacaaatggttgtgaaagtaa

SEQ ID NO: 340026 - DNA, 25 bp, Mus musculus
ccaggacacaggaagctcaggcgca

SEQ ID NO: 340027 - DNA, 25 bp, Mus musculus
ccaggacacaggtagctcaggcgca

SEQ ID NO: 340028 - DNA, 25 bp, Mus musculus
ccaggacagaaccacatctctgata

SEQ ID NO: 340029 - DNA, 25 bp, Mus musculus
ccaggacagaacgacatctctgata

SEQ ID NO: 340030 - DNA, 25 bp, Mus musculus
ccaggacagggcagagctaggactc

SEQ ID NO: 340031 - DNA, 25 bp, Mus musculus
ccaggacagggctgagctaggactc

SEQ ID NO: 340032 - DNA, 25 bp, Mus musculus
ccaggacagttcagagctgagagct

SEQ ID NO: 340033 - DNA, 25 bp, Mus musculus
ccaggacagttctgagctgagagct

SEQ ID NO: 340034 - DNA, 25 bp, Mus musculus
ccaggacccatgcttttgacaagcc

SEQ ID NO: 340035 - DNA, 25 bp, Mus musculus
ccaggacccatggttttgacaagcc

SEQ ID NO: 340036 - DNA, 25 bp, Mus musculus
ccaggaccgatcctggcagtaacca

SEQ ID NO: 340037 - DNA, 25 bp, Mus musculus
ccaggaccgatcgtggcagtaacca

SEQ ID NO: 340038 - DNA, 25 bp, Mus musculus
ccaggaccgggtctattagttgact

SEQ ID NO: 340039 - DNA, 25 bp, Mus musculus
ccaggaccgggtgtattagttgact

SEQ ID NO: 340040 - DNA, 25 bp, Mus musculus
ccaggaccttgcactttattcctgc

SEQ ID NO: 340041 - DNA, 25 bp, Mus musculus
ccaggaccttgctctttattcctgc

SEQ ID NO: 340042 - DNA, 25 bp, Mus musculus
ccaggacggtccaggtagaaatagt

SEQ ID NO: 340043 - DNA, 25 bp, Mus musculus
ccaggacggtcctggtagaaatagt

SEQ ID NO: 340044 - DNA, 25 bp, Mus musculus
ccaggacgtcagagggccacagtgt

SEQ ID NO: 340045 - DNA, 25 bp, Mus musculus
ccaggacgtcagtgggccacagtgt

SEQ ID NO: 340046 - DNA, 25 bp, Mus musculus
ccaggactacagagaggacttacag

SEQ ID NO: 340047 - DNA, 25 bp, Mus musculus
ccaggactacagtgaggacttacag

SEQ ID NO: 340048 - DNA, 25 bp, Mus musculus
ccaggactacatacttcaactgtgc

SEQ ID NO: 340049 - DNA, 25 bp, Mus musculus
ccaggactacattcttcaactgtgc

SEQ ID NO: 340050 - DNA, 25 bp, Mus musculus
ccaggactcccacagactaagccat

SEQ ID NO: 340051 - DNA, 25 bp, Mus musculus
ccaggactcccagagactaagccat

SEQ ID NO: 340052 - DNA, 25 bp, Mus musculus
ccaggactccctacattttatgata

SEQ ID NO: 340053 - DNA, 25 bp, Mus musculus
ccaggactcccttcattttatgata

SEQ ID NO: 340054 - DNA, 25 bp, Mus musculus
ccaggactcctgacgggtgaggcct

SEQ ID NO: 340055 - DNA, 25 bp, Mus musculus
ccaggactcctgtcgggtgaggcct

SEQ ID NO: 340056 - DNA, 25 bp, Mus musculus
ccaggactctcacttgattgcttgc

SEQ ID NO: 340057 - DNA, 25 bp, Mus musculus
ccaggactctcagttgattgcttgc

SEQ ID NO: 340058 - DNA, 25 bp, Mus musculus
ccaggactgggacctccctgctagg

SEQ ID NO: 340059 - DNA, 25 bp, Mus musculus
ccaggactgggagctccctgctagg

SEQ ID NO: 340060 - DNA, 25 bp, Mus musculus
ccaggactgggtctgtagacttgac

SEQ ID NO: 340061 - DNA, 25 bp, Mus musculus
ccaggactgggtgtgtagacttgac

SEQ ID NO: 340062 - DNA, 25 bp, Mus musculus
ccaggactggttcgatggcctcatg

SEQ ID NO: 340063 - DNA, 25 bp, Mus musculus
ccaggactggttggatggcctcatg

SEQ ID NO: 340064 - DNA, 25 bp, Mus musculus
ccaggactgtcaaagggctcagtgc

SEQ ID NO: 340065 - DNA, 25 bp, Mus musculus
ccaggactgtcatagggctcagtgc

SEQ ID NO: 340066 - DNA, 25 bp, Mus musculus
ccaggacttcacagattcactttct

SEQ ID NO: 340067 - DNA, 25 bp, Mus musculus
ccaggacttcactgattcactttct

SEQ ID NO: 340068 - DNA, 25 bp, Mus musculus
ccaggacttggcattgtgggaattt

SEQ ID NO: 340069 - DNA, 25 bp, Mus musculus
ccaggacttggctttgtgggaattt

SEQ ID NO: 340070 - DNA, 25 bp, Mus musculus
ccaggagaccatccgcgtgactaag

SEQ ID NO: 340071 - DNA, 25 bp, Mus musculus
ccaggagaccatgcgcgtgactaag

SEQ ID NO: 340072 - DNA, 25 bp, Mus musculus
ccaggagacccactctgcaggttga

SEQ ID NO: 340073 - DNA, 25 bp, Mus musculus
ccaggagacccagtctgcaggttga

SEQ ID NO: 340074 - DNA, 25 bp, Mus musculus
ccaggagagctgacagtcgggcccc

SEQ ID NO: 340075 - DNA, 25 bp, Mus musculus
ccaggagagctgtcagtcgggcccc

SEQ ID NO: 340076 - DNA, 25 bp, Mus musculus
ccaggagaggcaagcgcaggctact

SEQ ID NO: 340077 - DNA, 25 bp, Mus musculus
ccaggagaggcatgcgcaggctact

SEQ ID NO: 340078 - DNA, 25 bp, Mus musculus
ccaggagaggtcatttcagggccag

SEQ ID NO: 340079 - DNA, 25 bp, Mus musculus
ccaggagaggtcttttcagggccag

SEQ ID NO: 340080 - DNA, 25 bp, Mus musculus
ccaggagatcaaaagcagggcatgt

SEQ ID NO: 340081 - DNA, 25 bp, Mus musculus
ccaggagatcaatagcagggcatgt

SEQ ID NO: 340082 - DNA, 25 bp, Mus musculus
ccaggagatccgactgatggtcatg

SEQ ID NO: 340083 - DNA, 25 bp, Mus musculus
ccaggagatccgtctgatggtcatg

SEQ ID NO: 340084 - DNA, 25 bp, Mus musculus
ccaggagcaggtatgccgaacggtt

SEQ ID NO: 340085 - DNA, 25 bp, Mus musculus
ccaggagcaggtttgccgaacggtt

SEQ ID NO: 340086 - DNA, 25 bp, Mus musculus
ccaggagccaggcttccagaaaggc

SEQ ID NO: 340087 - DNA, 25 bp, Mus musculus
ccaggagccagggttccagaaaggc

SEQ ID NO: 340088 - DNA, 25 bp, Mus musculus
ccaggagccccgcagcaagtagaaa

SEQ ID NO: 340089 - DNA, 25 bp, Mus musculus
ccaggagccccggagcaagtagaaa

SEQ ID NO: 340090 - DNA, 25 bp, Mus musculus
ccaggagcccggagaaaatgccagt

SEQ ID NO: 340091 - DNA, 25 bp, Mus musculus
ccaggagcccggtgaaaatgccagt

SEQ ID NO: 340092 - DNA, 25 bp, Mus musculus
ccaggagccctgactagcggagatg

SEQ ID NO: 340093 - DNA, 25 bp, Mus musculus
ccaggagccctgtctagcggagatg

SEQ ID NO: 340094 - DNA, 25 bp, Mus musculus
ccaggagccgggacttgttaatggt

SEQ ID NO: 340095 - DNA, 25 bp, Mus musculus
ccaggagccgggtcttgttaatggt

SEQ ID NO: 340096 - DNA, 25 bp, Mus musculus
ccaggagccttgatcctgtgtgttt

SEQ ID NO: 340097 - DNA, 25 bp, Mus musculus
ccaggagccttgttcctgtgtgttt

SEQ ID NO: 340098 - DNA, 25 bp, Mus musculus
ccaggagcggttattattctaccat

SEQ ID NO: 340099 - DNA, 25 bp, Mus musculus
ccaggagcggtttttattctaccat

SEQ ID NO: 340100 - DNA, 25 bp, Mus musculus
ccaggagctaccagttgaacttgat

SEQ ID NO: 340101 - DNA, 25 bp, Mus musculus
ccaggagctacctgttgaacttgat

SEQ ID NO: 340102 - DNA, 25 bp, Mus musculus
ccaggagctcctcaagagacctcag

SEQ ID NO: 340103 - DNA, 25 bp, Mus musculus
ccaggagctcctgaagagacctcag

SEQ ID NO: 340104 - DNA, 25 bp, Mus musculus
ccaggagctggacaatctgaggatc

SEQ ID NO: 340105 - DNA, 25 bp, Mus musculus
ccaggagctggagaatctgaggatc

SEQ ID NO: 340106 - DNA, 25 bp, Mus musculus
ccaggagctggccagttatcttaga

SEQ ID NO: 340107 - DNA, 25 bp, Mus musculus
ccaggagctggcgagttatcttaga

SEQ ID NO: 340108 - DNA, 25 bp, Mus musculus
ccaggagcttctagatgggaggctt

SEQ ID NO: 340109 - DNA, 25 bp, Mus musculus
ccaggagcttctagttggtctcaca

SEQ ID NO: 340110 - DNA, 25 bp, Mus musculus
ccaggagcttcttgatgggaggctt

SEQ ID NO: 340111 - DNA, 25 bp, Mus musculus
ccaggagcttcttgttggtctcaca

SEQ ID NO: 340112 - DNA, 25 bp, Mus musculus
ccaggaggaaagctgagctgctaca

SEQ ID NO: 340113 - DNA, 25 bp, Mus musculus
ccaggaggaaaggtgagctgctaca

SEQ ID NO: 340114 - DNA, 25 bp, Mus musculus
ccaggaggagctactcgtggccatg

SEQ ID NO: 340115 - DNA, 25 bp, Mus musculus
ccaggaggagcttctcgtggccatg

SEQ ID NO: 340116 - DNA, 25 bp, Mus musculus
ccaggaggaggtcaagttccacacg

SEQ ID NO: 340117 - DNA, 25 bp, Mus musculus
ccaggaggaggtgaagttccacacg

SEQ ID NO: 340118 - DNA, 25 bp, Mus musculus
ccaggaggagtacatcaagcgcgcc

SEQ ID NO: 340119 - DNA, 25 bp, Mus musculus
ccaggaggagtagatcaagcgcgcc

SEQ ID NO: 340120 - DNA, 25 bp, Mus musculus
ccaggaggattcagtttagaatcca

SEQ ID NO: 340121 - DNA, 25 bp, Mus musculus
ccaggaggattctgtttagaatcca

SEQ ID NO: 340122 - DNA, 25 bp, Mus musculus
ccaggaggcaagatgaccccacgac

SEQ ID NO: 340123 - DNA, 25 bp, Mus musculus
ccaggaggcaagttgaccccacgac

SEQ ID NO: 340124 - DNA, 25 bp, Mus musculus
ccaggaggcggcagtattccaggat

SEQ ID NO: 340125 - DNA, 25 bp, Mus musculus
ccaggaggcggctgtattccaggat

SEQ ID NO: 340126 - DNA, 25 bp, Mus musculus
ccaggaggctctcttagtgaggcta

SEQ ID NO: 340127 - DNA, 25 bp, Mus musculus
ccaggaggctctgttagtgaggcta

SEQ ID NO: 340128 - DNA, 25 bp, Mus musculus
ccaggagggcatcgcttggctccca

SEQ ID NO: 340129 - DNA, 25 bp, Mus musculus
ccaggagggcatggcttggctccca

SEQ ID NO: 340130 - DNA, 25 bp, Mus musculus
ccaggagggtctatggacagctgca

SEQ ID NO: 340131 - DNA, 25 bp, Mus musculus
ccaggagggtctttggacagctgca

SEQ ID NO: 340132 - DNA, 25 bp, Mus musculus
ccaggaggtccaatgaggcaggtca

SEQ ID NO: 340133 - DNA, 25 bp, Mus musculus
ccaggaggtccattgaggcaggtca

SEQ ID NO: 340134 - DNA, 25 bp, Mus musculus
ccaggaggtgtgagttcagaagcaa

SEQ ID NO: 340135 - DNA, 25 bp, Mus musculus
ccaggaggtgtgtgttcagaagcaa

SEQ ID NO: 340136 - DNA, 25 bp, Mus musculus
ccaggaggttctagcaaggtcactt

SEQ ID NO: 340137 - DNA, 25 bp, Mus musculus
ccaggaggttcttgcaaggtcactt

SEQ ID NO: 340138 - DNA, 25 bp, Mus musculus
ccaggagtactgagggaccacacta

SEQ ID NO: 340139 - DNA, 25 bp, Mus musculus
ccaggagtactgtgggaccacacta

SEQ ID NO: 340140 - DNA, 25 bp, Mus musculus
ccaggagtagacaagctcatggact

SEQ ID NO: 340141 - DNA, 25 bp, Mus musculus
ccaggagtagactagctcatggact

SEQ ID NO: 340142 - DNA, 25 bp, Mus musculus
ccaggagtaggtagatcagcaaaca

SEQ ID NO: 340143 - DNA, 25 bp, Mus musculus
ccaggagtaggttgatcagcaaaca

SEQ ID NO: 340144 - DNA, 25 bp, Mus musculus
ccaggagtcccaactgttctataaa

SEQ ID NO: 340145 - DNA, 25 bp, Mus musculus
ccaggagtcccatctgttctataaa

SEQ ID NO: 340146 - DNA, 25 bp, Mus musculus
ccaggagtctagcaagcaggttcaa

SEQ ID NO: 340147 - DNA, 25 bp, Mus musculus
ccaggagtctaggaagcaggttcaa

SEQ ID NO: 340148 - DNA, 25 bp, Mus musculus
ccaggagtctgtagattgtgaagct

SEQ ID NO: 340149 - DNA, 25 bp, Mus musculus
ccaggagtctgttgattgtgaagct

SEQ ID NO: 340150 - DNA, 25 bp, Mus musculus
ccaggagtgcccacttgacaggaag

SEQ ID NO: 340151 - DNA, 25 bp, Mus musculus
ccaggagtgccctcttgacaggaag

SEQ ID NO: 340152 - DNA, 25 bp, Mus musculus
ccaggagtgggaccccaactttgag

SEQ ID NO: 340153 - DNA, 25 bp, Mus musculus
ccaggagtgggagcccaactttgag

SEQ ID NO: 340154 - DNA, 25 bp, Mus musculus
ccaggagttaggcttcagagagcac

SEQ ID NO: 340155 - DNA, 25 bp, Mus musculus
ccaggagttagggttcagagagcac

SEQ ID NO: 340156 - DNA, 25 bp, Mus musculus
ccaggagttctcatacagggtaggg

SEQ ID NO: 340157 - DNA, 25 bp, Mus musculus
ccaggagttctcttacagggtaggg

SEQ ID NO: 340158 - DNA, 25 bp, Mus musculus
ccaggagttctgacggaggttcatg

SEQ ID NO: 340159 - DNA, 25 bp, Mus musculus
ccaggagttctgtcggaggttcatg

SEQ ID NO: 340160 - DNA, 25 bp, Mus musculus
ccaggatactccacttgcttataaa

SEQ ID NO: 340161 - DNA, 25 bp, Mus musculus
ccaggatactcctcttgcttataaa

SEQ ID NO: 340162 - DNA, 25 bp, Mus musculus
ccaggatagacacctttgagagacc

SEQ ID NO: 340163 - DNA, 25 bp, Mus musculus
ccaggatagacagctttgagagacc

SEQ ID NO: 340164 - DNA, 25 bp, Mus musculus
ccaggatagcccaggttatacagaa

SEQ ID NO: 340165 - DNA, 25 bp, Mus musculus
ccaggatagccctggttatacagaa

SEQ ID NO: 340166 - DNA, 25 bp, Mus musculus
ccaggataggttctacgggattctc

SEQ ID NO: 340167 - DNA, 25 bp, Mus musculus
ccaggataggttgtacgggattctc

SEQ ID NO: 340168 - DNA, 25 bp, Mus musculus
ccaggatatcctaggctatccaggg

SEQ ID NO: 340169 - DNA, 25 bp, Mus musculus
ccaggatatccttggctatccaggg

SEQ ID NO: 340170 - DNA, 25 bp, Mus musculus
ccaggatatctgatctttgatgtat

SEQ ID NO: 340171 - DNA, 25 bp, Mus musculus
ccaggatatctgttctttgatgtat

SEQ ID NO: 340172 - DNA, 25 bp, Mus musculus
ccaggatatgctcgcagccaggctt

SEQ ID NO: 340173 - DNA, 25 bp, Mus musculus
ccaggatatgctggcagccaggctt

SEQ ID NO: 340174 - DNA, 25 bp, Mus musculus
ccaggatcacagagtagcatgagga

SEQ ID NO: 340175 - DNA, 25 bp, Mus musculus
ccaggatcacagtgtagcatgagga

SEQ ID NO: 340176 - DNA, 25 bp, Mus musculus
ccaggatcatacagcaattgagagc

SEQ ID NO: 340177 - DNA, 25 bp, Mus musculus
ccaggatcatactgcaattgagagc

SEQ ID NO: 340178 - DNA, 25 bp, Mus musculus
ccaggatcatggattcaggagttat

SEQ ID NO: 340179 - DNA, 25 bp, Mus musculus
ccaggatcatggtttcaggagttat

SEQ ID NO: 340180 - DNA, 25 bp, Mus musculus
ccaggatcattgctgtttggctcag

SEQ ID NO: 340181 - DNA, 25 bp, Mus musculus
ccaggatcattggtgtttggctcag

SEQ ID NO: 340182 - DNA, 25 bp, Mus musculus
ccaggatcctgcagtgctgagggaa

SEQ ID NO: 340183 - DNA, 25 bp, Mus musculus
ccaggatcctgctgtgctgagggaa

SEQ ID NO: 340184 - DNA, 25 bp, Mus musculus
ccaggatctcgactctcatctctga

SEQ ID NO: 340185 - DNA, 25 bp, Mus musculus
ccaggatctcgagtctcatctctga

SEQ ID NO: 340186 - DNA, 25 bp, Mus musculus
ccaggatgagccagaggtgccagta

SEQ ID NO: 340187 - DNA, 25 bp, Mus musculus
ccaggatgagcctgaggtgccagta

SEQ ID NO: 340188 - DNA, 25 bp, Mus musculus
ccaggatgatgcatcggttttgacc

SEQ ID NO: 340189 - DNA, 25 bp, Mus musculus
ccaggatgatgcttcggttttgacc

SEQ ID NO: 340190 - DNA, 25 bp, Mus musculus
ccaggatgcctacgagggacctcaa

SEQ ID NO: 340191 - DNA, 25 bp, Mus musculus
ccaggatgcctaggagggacctcaa

SEQ ID NO: 340192 - DNA, 25 bp, Mus musculus
ccaggatggacccttcagttataga

SEQ ID NO: 340193 - DNA, 25 bp, Mus musculus
ccaggatggaccgttcagttataga

SEQ ID NO: 340194 - DNA, 25 bp, Mus musculus
ccaggatggagccactctcacgatt

SEQ ID NO: 340195 - DNA, 25 bp, Mus musculus
ccaggatggagcgactctcacgatt

SEQ ID NO: 340196 - DNA, 25 bp, Mus musculus
ccaggatgggacagtctcaggacct

SEQ ID NO: 340197 - DNA, 25 bp, Mus musculus
ccaggatgggactgtctcaggacct

SEQ ID NO: 340198 - DNA, 25 bp, Mus musculus
ccaggatgtaacatgcattgcccat

SEQ ID NO: 340199 - DNA, 25 bp, Mus musculus
ccaggatgtaacttgcattgcccat

SEQ ID NO: 340200 - DNA, 25 bp, Mus musculus
ccaggatgtcatagaggatgttgtt

SEQ ID NO: 340201 - DNA, 25 bp, Mus musculus
ccaggatgtcattgaggatgttgtt

SEQ ID NO: 340202 - DNA, 25 bp, Mus musculus
ccaggatgtctgcatgtctaggtga

SEQ ID NO: 340203 - DNA, 25 bp, Mus musculus
ccaggatgtctggatgtctaggtga

SEQ ID NO: 340204 - DNA, 25 bp, Mus musculus
ccaggatgtggccagccgtcagaca

SEQ ID NO: 340205 - DNA, 25 bp, Mus musculus
ccaggatgtggcgagccgtcagaca

SEQ ID NO: 340206 - DNA, 25 bp, Mus musculus
ccaggattcagtcccattgcgggcg

SEQ ID NO: 340207 - DNA, 25 bp, Mus musculus
ccaggattcagtgccattgcgggcg

SEQ ID NO: 340208 - DNA, 25 bp, Mus musculus
ccaggattccagactgtatgactgt

SEQ ID NO: 340209 - DNA, 25 bp, Mus musculus
ccaggattccagtctgtatgactgt

SEQ ID NO: 340210 - DNA, 25 bp, Mus musculus
ccaggattcctgctttcatcatgga

SEQ ID NO: 340211 - DNA, 25 bp, Mus musculus
ccaggattcctggtttcatcatgga

SEQ ID NO: 340212 - DNA, 25 bp, Mus musculus
ccaggattctcccatgatactttga

SEQ ID NO: 340213 - DNA, 25 bp, Mus musculus
ccaggattctccgatgatactttga

SEQ ID NO: 340214 - DNA, 25 bp, Mus musculus
ccaggattctggcaggtgcaaaaac

SEQ ID NO: 340215 - DNA, 25 bp, Mus musculus
ccaggattctgggaggtgcaaaaac

SEQ ID NO: 340216 - DNA, 25 bp, Mus musculus
ccaggattgatgaaaggccaccaga

SEQ ID NO: 340217 - DNA, 25 bp, Mus musculus
ccaggattgatgtaaggccaccaga

SEQ ID NO: 340218 - DNA, 25 bp, Mus musculus
ccaggattgggcatttcttctcagt

SEQ ID NO: 340219 - DNA, 25 bp, Mus musculus
ccaggattgggcttttcttctcagt

SEQ ID NO: 340220 - DNA, 25 bp, Mus musculus
ccaggatttaggcatcagggctttc

SEQ ID NO: 340221 - DNA, 25 bp, Mus musculus
ccaggatttagggatcagggctttc

SEQ ID NO: 340222 - DNA, 25 bp, Mus musculus
ccaggcaacactcctgttttcctga

SEQ ID NO: 340223 - DNA, 25 bp, Mus musculus
ccaggcaacactgctgttttcctga

SEQ ID NO: 340224 - DNA, 25 bp, Mus musculus
ccaggcaactagaatgaggaccagt

SEQ ID NO: 340225 - DNA, 25 bp, Mus musculus
ccaggcaactagtatgaggaccagt

SEQ ID NO: 340226 - DNA, 25 bp, Mus musculus
ccaggcaaggcccaagttgaaaatg

SEQ ID NO: 340227 - DNA, 25 bp, Mus musculus
ccaggcaaggccgaagttgaaaatg

SEQ ID NO: 340228 - DNA, 25 bp, Mus musculus
ccaggcaaggctatcgttcaacagt

SEQ ID NO: 340229 - DNA, 25 bp, Mus musculus
ccaggcaaggctcagactgtcttat

SEQ ID NO: 340230 - DNA, 25 bp, Mus musculus
ccaggcaaggctgagactgtcttat

SEQ ID NO: 340231 - DNA, 25 bp, Mus musculus
ccaggcaaggctttcgttcaacagt

SEQ ID NO: 340232 - DNA, 25 bp, Mus musculus
ccaggcaagggtactcattagctta

SEQ ID NO: 340233 - DNA, 25 bp, Mus musculus
ccaggcaagggttctcattagctta

SEQ ID NO: 340234 - DNA, 25 bp, Mus musculus
ccaggcaatgctaaacacactctta

SEQ ID NO: 340235 - DNA, 25 bp, Mus musculus
ccaggcaatgcttaacacactctta

SEQ ID NO: 340236 - DNA, 25 bp, Mus musculus
ccaggcacagtaacataggcacaca

SEQ ID NO: 340237 - DNA, 25 bp, Mus musculus
ccaggcacagtatcataggcacaca

SEQ ID NO: 340238 - DNA, 25 bp, Mus musculus
ccaggcacagtcagatcaaagcgtt

SEQ ID NO: 340239 - DNA, 25 bp, Mus musculus
ccaggcacagtctgatcaaagcgtt

SEQ ID NO: 340240 - DNA, 25 bp, Mus musculus
ccaggcactattctacccagtgaaa

SEQ ID NO: 340241 - DNA, 25 bp, Mus musculus
ccaggcactattgtacccagtgaaa

SEQ ID NO: 340242 - DNA, 25 bp, Mus musculus
ccaggcactctgctggagcgaatac

SEQ ID NO: 340243 - DNA, 25 bp, Mus musculus
ccaggcactctggtggagcgaatac

SEQ ID NO: 340244 - DNA, 25 bp, Mus musculus
ccaggcactgagatgggctggacct

SEQ ID NO: 340245 - DNA, 25 bp, Mus musculus
ccaggcactgagttgggctggacct

SEQ ID NO: 340246 - DNA, 25 bp, Mus musculus
ccaggcagaaggaggtaccctggac

SEQ ID NO: 340247 - DNA, 25 bp, Mus musculus
ccaggcagaaggtggtaccctggac

SEQ ID NO: 340248 - DNA, 25 bp, Mus musculus
ccaggcagagacagcgcccagagct

SEQ ID NO: 340249 - DNA, 25 bp, Mus musculus
ccaggcagagactgcgcccagagct

SEQ ID NO: 340250 - DNA, 25 bp, Mus musculus
ccaggcagattcaccttcaggaaag

SEQ ID NO: 340251 - DNA, 25 bp, Mus musculus
ccaggcagattcacgatcggtattt

SEQ ID NO: 340252 - DNA, 25 bp, Mus musculus
ccaggcagattctccttcaggaaag

SEQ ID NO: 340253 - DNA, 25 bp, Mus musculus
ccaggcagattctcgatcggtattt

SEQ ID NO: 340254 - DNA, 25 bp, Mus musculus
ccaggcagccatctgtactaaagct

SEQ ID NO: 340255 - DNA, 25 bp, Mus musculus
ccaggcagccatgtgtactaaagct

SEQ ID NO: 340256 - DNA, 25 bp, Mus musculus
ccaggcagcgggattagatctctat

SEQ ID NO: 340257 - DNA, 25 bp, Mus musculus
ccaggcagcgggtttagatctctat

SEQ ID NO: 340258 - DNA, 25 bp, Mus musculus
ccaggcagctctcaattgtcatgat

SEQ ID NO: 340259 - DNA, 25 bp, Mus musculus
ccaggcagctctcgatggatatgag

SEQ ID NO: 340260 - DNA, 25 bp, Mus musculus
ccaggcagctctgaattgtcatgat

SEQ ID NO: 340261 - DNA, 25 bp, Mus musculus
ccaggcagctctggatggatatgag

SEQ ID NO: 340262 - DNA, 25 bp, Mus musculus
ccaggcagctgcaagaaccttccat

SEQ ID NO: 340263 - DNA, 25 bp, Mus musculus
ccaggcagctgctagaaccttccat

SEQ ID NO: 340264 - DNA, 25 bp, Mus musculus
ccaggcaggaacagagatctgcaca

SEQ ID NO: 340265 - DNA, 25 bp, Mus musculus
ccaggcaggaactgagatctgcaca

SEQ ID NO: 340266 - DNA, 25 bp, Mus musculus
ccaggcaggcaaccagcgcataatc

SEQ ID NO: 340267 - DNA, 25 bp, Mus musculus
ccaggcaggcaagcagcgcataatc

SEQ ID NO: 340268 - DNA, 25 bp, Mus musculus
ccaggcaggctgatctacgaagaaa

SEQ ID NO: 340269 - DNA, 25 bp, Mus musculus
ccaggcaggctgttctacgaagaaa

SEQ ID NO: 340270 - DNA, 25 bp, Mus musculus
ccaggcagggctatgctactgatta

SEQ ID NO: 340271 - DNA, 25 bp, Mus musculus
ccaggcagggctttgctactgatta

SEQ ID NO: 340272 - DNA, 25 bp, Mus musculus
ccaggcagtgcgctgctttacagaa

SEQ ID NO: 340273 - DNA, 25 bp, Mus musculus
ccaggcagtgcggtgctttacagaa

SEQ ID NO: 340274 - DNA, 25 bp, Mus musculus
ccaggcagtgtgaggctgtgaccta

SEQ ID NO: 340275 - DNA, 25 bp, Mus musculus
ccaggcagtgtgtggctgtgaccta

SEQ ID NO: 340276 - DNA, 25 bp, Mus musculus
ccaggcatccatccagatttggaga

SEQ ID NO: 340277 - DNA, 25 bp, Mus musculus
ccaggcatccatgcagatttggaga

SEQ ID NO: 340278 - DNA, 25 bp, Mus musculus
ccaggcatctccacatcaaacaaaa

SEQ ID NO: 340279 - DNA, 25 bp, Mus musculus
ccaggcatctcctcatcaaacaaaa

SEQ ID NO: 340280 - DNA, 25 bp, Mus musculus
ccaggcatgcccatagagcatggtg

SEQ ID NO: 340281 - DNA, 25 bp, Mus musculus
ccaggcatgcccttagagcatggtg

SEQ ID NO: 340282 - DNA, 25 bp, Mus musculus
ccaggcatgctcacaaactagtcat

SEQ ID NO: 340283 - DNA, 25 bp, Mus musculus
ccaggcatgctctcaaactagtcat

SEQ ID NO: 340284 - DNA, 25 bp, Mus musculus
ccaggcatggccagtcttgtataac

SEQ ID NO: 340285 - DNA, 25 bp, Mus musculus
ccaggcatggcctgtcttgtataac

SEQ ID NO: 340286 - DNA, 25 bp, Mus musculus
ccaggcattctcaattttatgaaga

SEQ ID NO: 340287 - DNA, 25 bp, Mus musculus
ccaggcattctctattttatgaaga

SEQ ID NO: 340288 - DNA, 25 bp, Mus musculus
ccaggcattcttcagcattgcgaca

SEQ ID NO: 340289 - DNA, 25 bp, Mus musculus
ccaggcattcttgagcattgcgaca

SEQ ID NO: 340290 - DNA, 25 bp, Mus musculus
ccaggcatttcaagttccatcaaaa

SEQ ID NO: 340291 - DNA, 25 bp, Mus musculus
ccaggcatttcatgttccatcaaaa

SEQ ID NO: 340292 - DNA, 25 bp, Mus musculus
ccaggccacagtactgagtgctttt

SEQ ID NO: 340293 - DNA, 25 bp, Mus musculus
ccaggccacagttctgagtgctttt

SEQ ID NO: 340294 - DNA, 25 bp, Mus musculus
ccaggccaccacatagaggattaca

SEQ ID NO: 340295 - DNA, 25 bp, Mus musculus
ccaggccaccacttagaggattaca

SEQ ID NO: 340296 - DNA, 25 bp, Mus musculus
ccaggccaccatcacttgttaattc

SEQ ID NO: 340297 - DNA, 25 bp, Mus musculus
ccaggccaccatgacttgttaattc

SEQ ID NO: 340298 - DNA, 25 bp, Mus musculus
ccaggccactgcaaacaaggatttg

SEQ ID NO: 340299 - DNA, 25 bp, Mus musculus
ccaggccactgctaacaaggatttg

SEQ ID NO: 340300 - DNA, 25 bp, Mus musculus
ccaggccagcaaatagaagagttag

SEQ ID NO: 340301 - DNA, 25 bp, Mus musculus
ccaggccagcaattagaagagttag

SEQ ID NO: 340302 - DNA, 25 bp, Mus musculus
ccaggccagccactacctgagagta

SEQ ID NO: 340303 - DNA, 25 bp, Mus musculus
ccaggccagccagtacctgagagta

SEQ ID NO: 340304 - DNA, 25 bp, Mus musculus
ccaggccagcctaagttacaatgtg

SEQ ID NO: 340305 - DNA, 25 bp, Mus musculus
ccaggccagccttagttacaatgtg

SEQ ID NO: 340306 - DNA, 25 bp, Mus musculus
ccaggccatgggatttgtgaattat

SEQ ID NO: 340307 - DNA, 25 bp, Mus musculus
ccaggccatgggttttgtgaattat

SEQ ID NO: 340308 - DNA, 25 bp, Mus musculus
ccaggccatgttagcagggaaggat

SEQ ID NO: 340309 - DNA, 25 bp, Mus musculus
ccaggccatgtttgcagggaaggat

SEQ ID NO: 340310 - DNA, 25 bp, Mus musculus
ccaggcccaagtcttggcaacagat

SEQ ID NO: 340311 - DNA, 25 bp, Mus musculus
ccaggcccaagtgttggcaacagat

SEQ ID NO: 340312 - DNA, 25 bp, Mus musculus
ccaggcccaggaagatgcccaggtg

SEQ ID NO: 340313 - DNA, 25 bp, Mus musculus
ccaggcccaggatgatgcccaggtg

SEQ ID NO: 340314 - DNA, 25 bp, Mus musculus
ccaggcccagttctgagcatgtgca

SEQ ID NO: 340315 - DNA, 25 bp, Mus musculus
ccaggcccagttgtgagcatgtgca

SEQ ID NO: 340316 - DNA, 25 bp, Mus musculus
ccaggcccccaaaatttcagaagag

SEQ ID NO: 340317 - DNA, 25 bp, Mus musculus
ccaggcccccaatatttcagaagag

SEQ ID NO: 340318 - DNA, 25 bp, Mus musculus
ccaggcccctatacgaaggacaaag

SEQ ID NO: 340319 - DNA, 25 bp, Mus musculus
ccaggcccctattcgaaggacaaag

SEQ ID NO: 340320 - DNA, 25 bp, Mus musculus
ccaggcccctttccaagatttaatc

SEQ ID NO: 340321 - DNA, 25 bp, Mus musculus
ccaggcccctttgcaagatttaatc

SEQ ID NO: 340322 - DNA, 25 bp, Mus musculus
ccaggccctcaactgtattgttaag

SEQ ID NO: 340323 - DNA, 25 bp, Mus musculus
ccaggccctcaagtgtattgttaag

SEQ ID NO: 340324 - DNA, 25 bp, Mus musculus
ccaggccctggaaagaagatgcatt

SEQ ID NO: 340325 - DNA, 25 bp, Mus musculus
ccaggccctggatagaagatgcatt

SEQ ID NO: 340326 - DNA, 25 bp, Mus musculus
ccaggccgagtcatcttagatgact

SEQ ID NO: 340327 - DNA, 25 bp, Mus musculus
ccaggccgagtcttcttagatgact

SEQ ID NO: 340328 - DNA, 25 bp, Mus musculus
ccaggccgggtcatctagcaaggga

SEQ ID NO: 340329 - DNA, 25 bp, Mus musculus
ccaggccgggtcttctagcaaggga

SEQ ID NO: 340330 - DNA, 25 bp, Mus musculus
ccaggcctacttcgcgtgtgaaaaa

SEQ ID NO: 340331 - DNA, 25 bp, Mus musculus
ccaggcctacttggcgtgtgaaaaa

SEQ ID NO: 340332 - DNA, 25 bp, Mus musculus
ccaggcctagaaaccttggtgtctt

SEQ ID NO: 340333 - DNA, 25 bp, Mus musculus
ccaggcctagaatccttggtgtctt

SEQ ID NO: 340334 - DNA, 25 bp, Mus musculus
ccaggcctagctcgccagggacaag

SEQ ID NO: 340335 - DNA, 25 bp, Mus musculus
ccaggcctagctggccagggacaag

SEQ ID NO: 340336 - DNA, 25 bp, Mus musculus
ccaggcctatcacggtcagagagtc

SEQ ID NO: 340337 - DNA, 25 bp, Mus musculus
ccaggcctatcagggtcagagagtc

SEQ ID NO: 340338 - DNA, 25 bp, Mus musculus
ccaggcctcttgattaaaatcagca

SEQ ID NO: 340339 - DNA, 25 bp, Mus musculus
ccaggcctcttgtttaaaatcagca

SEQ ID NO: 340340 - DNA, 25 bp, Mus musculus
ccaggcctgatgcagctactataaa

SEQ ID NO: 340341 - DNA, 25 bp, Mus musculus
ccaggcctgatggagctactataaa

SEQ ID NO: 340342 - DNA, 25 bp, Mus musculus
ccaggcctgcctatttaattcaaat

SEQ ID NO: 340343 - DNA, 25 bp, Mus musculus
ccaggcctgcctccttagggatggt

SEQ ID NO: 340344 - DNA, 25 bp, Mus musculus
ccaggcctgcctcttttatgatgca

SEQ ID NO: 340345 - DNA, 25 bp, Mus musculus
ccaggcctgcctgcttagggatggt

SEQ ID NO: 340346 - DNA, 25 bp, Mus musculus
ccaggcctgcctgttttatgatgca

SEQ ID NO: 340347 - DNA, 25 bp, Mus musculus
ccaggcctgcctttttaattcaaat

SEQ ID NO: 340348 - DNA, 25 bp, Mus musculus
ccaggcctgctgacttgagtacaaa

SEQ ID NO: 340349 - DNA, 25 bp, Mus musculus
ccaggcctgctgtcttgagtacaaa

SEQ ID NO: 340350 - DNA, 25 bp, Mus musculus
ccaggcctggcgctatgagaagttt

SEQ ID NO: 340351 - DNA, 25 bp, Mus musculus
ccaggcctggcggtatgagaagttt

SEQ ID NO: 340352 - DNA, 25 bp, Mus musculus
ccaggcctgggaagatggcatgcca

SEQ ID NO: 340353 - DNA, 25 bp, Mus musculus
ccaggcctgggatgatggcatgcca

SEQ ID NO: 340354 - DNA, 25 bp, Mus musculus
ccaggcctggtcctcttgggtgaat

SEQ ID NO: 340355 - DNA, 25 bp, Mus musculus
ccaggcctggtcgtcttgggtgaat

SEQ ID NO: 340356 - DNA, 25 bp, Mus musculus
ccaggccttggtaagtgttgcggat

SEQ ID NO: 340357 - DNA, 25 bp, Mus musculus
ccaggccttggttagtgttgcggat

SEQ ID NO: 340358 - DNA, 25 bp, Mus musculus
ccaggcctttgcagattatgtcagc

SEQ ID NO: 340359 - DNA, 25 bp, Mus musculus
ccaggcctttgctgattatgtcagc

SEQ ID NO: 340360 - DNA, 25 bp, Mus musculus
ccaggccttttcatcgtcaagaata

SEQ ID NO: 340361 - DNA, 25 bp, Mus musculus
ccaggccttttcttcgtcaagaata

SEQ ID NO: 340362 - DNA, 25 bp, Mus musculus
ccaggcgcctgtcaggccagagact

SEQ ID NO: 340363 - DNA, 25 bp, Mus musculus
ccaggcgcctgtgaggccagagact

SEQ ID NO: 340364 - DNA, 25 bp, Mus musculus
ccaggcggagagattaggtctgtct

SEQ ID NO: 340365 - DNA, 25 bp, Mus musculus
ccaggcggagagtttaggtctgtct

SEQ ID NO: 340366 - DNA, 25 bp, Mus musculus
ccaggcggtgtgcttcttgtagaac

SEQ ID NO: 340367 - DNA, 25 bp, Mus musculus
ccaggcggtgtggttcttgtagaac

SEQ ID NO: 340368 - DNA, 25 bp, Mus musculus
ccaggcgtaatgctgcacacacctt

SEQ ID NO: 340369 - DNA, 25 bp, Mus musculus
ccaggcgtaatggtgcacacacctt

SEQ ID NO: 340370 - DNA, 25 bp, Mus musculus
ccaggcgtcgttccagacaccggag

SEQ ID NO: 340371 - DNA, 25 bp, Mus musculus
ccaggcgtcgttgcagacaccggag

SEQ ID NO: 340372 - DNA, 25 bp, Mus musculus
ccaggctacatacagatgttctgtt

SEQ ID NO: 340373 - DNA, 25 bp, Mus musculus
ccaggctacatagagatgttctgtt

SEQ ID NO: 340374 - DNA, 25 bp, Mus musculus
ccaggctactaaccgagcgagatgt

SEQ ID NO: 340375 - DNA, 25 bp, Mus musculus
ccaggctactaagcgagcgagatgt

SEQ ID NO: 340376 - DNA, 25 bp, Mus musculus
ccaggctactcaaaggtgttcgtgt

SEQ ID NO: 340377 - DNA, 25 bp, Mus musculus
ccaggctactcataggtgttcgtgt

SEQ ID NO: 340378 - DNA, 25 bp, Mus musculus
ccaggctactgtcaggcatcttcac

SEQ ID NO: 340379 - DNA, 25 bp, Mus musculus
ccaggctactgtgaggcatcttcac

SEQ ID NO: 340380 - DNA, 25 bp, Mus musculus
ccaggctagcgacggaactcgagaa

SEQ ID NO: 340381 - DNA, 25 bp, Mus musculus
ccaggctagcgagggaactcgagaa

SEQ ID NO: 340382 - DNA, 25 bp, Mus musculus
ccaggctagctgctttttttcctac

SEQ ID NO: 340383 - DNA, 25 bp, Mus musculus
ccaggctagctggtttttttcctac

SEQ ID NO: 340384 - DNA, 25 bp, Mus musculus
ccaggctagcttccgctatgtatag

SEQ ID NO: 340385 - DNA, 25 bp, Mus musculus
ccaggctagcttgcgctatgtatag

SEQ ID NO: 340386 - DNA, 25 bp, Mus musculus
ccaggctattgtcgagctcactctg

SEQ ID NO: 340387 - DNA, 25 bp, Mus musculus
ccaggctattgtggagctcactctg

SEQ ID NO: 340388 - DNA, 25 bp, Mus musculus
ccaggctcagacagccaaggttcag

SEQ ID NO: 340389 - DNA, 25 bp, Mus musculus
ccaggctcagactgccaaggttcag

SEQ ID NO: 340390 - DNA, 25 bp, Mus musculus
ccaggctcagatacatgtcccataa

SEQ ID NO: 340391 - DNA, 25 bp, Mus musculus
ccaggctcagattcatgtcccataa

SEQ ID NO: 340392 - DNA, 25 bp, Mus musculus
ccaggctccataaccatgtgcttgc

SEQ ID NO: 340393 - DNA, 25 bp, Mus musculus
ccaggctccatatccatgtgcttgc

SEQ ID NO: 340394 - DNA, 25 bp, Mus musculus
ccaggctccatgagacctataggta

SEQ ID NO: 340395 - DNA, 25 bp, Mus musculus
ccaggctccatgtgacctataggta

SEQ ID NO: 340396 - DNA, 25 bp, Mus musculus
ccaggctcccatatgctgaagtaaa

SEQ ID NO: 340397 - DNA, 25 bp, Mus musculus
ccaggctcccatttgctgaagtaaa

SEQ ID NO: 340398 - DNA, 25 bp, Mus musculus
ccaggctctgaaaaacctgcctcaa

SEQ ID NO: 340399 - DNA, 25 bp, Mus musculus
ccaggctctgaataacctgcctcaa

SEQ ID NO: 340400 - DNA, 25 bp, Mus musculus
ccaggctctgttccagatggttctc

SEQ ID NO: 340401 - DNA, 25 bp, Mus musculus
ccaggctctgttgcagatggttctc

SEQ ID NO: 340402 - DNA, 25 bp, Mus musculus
ccaggctgcaggcttcttagggtca

SEQ ID NO: 340403 - DNA, 25 bp, Mus musculus
ccaggctgcagggttcttagggtca

SEQ ID NO: 340404 - DNA, 25 bp, Mus musculus
ccaggctgcgaacggttggcaccaa

SEQ ID NO: 340405 - DNA, 25 bp, Mus musculus
ccaggctgcgaagggttggcaccaa

SEQ ID NO: 340406 - DNA, 25 bp, Mus musculus
ccaggctggactcccaggaaggcca

SEQ ID NO: 340407 - DNA, 25 bp, Mus musculus
ccaggctggactgccaggaaggcca

SEQ ID NO: 340408 - DNA, 25 bp, Mus musculus
ccaggctggccaaagactcataaag

SEQ ID NO: 340409 - DNA, 25 bp, Mus musculus
ccaggctggccatagactcataaag

SEQ ID NO: 340410 - DNA, 25 bp, Mus musculus
ccaggctgtataagcagtgcagtat

SEQ ID NO: 340411 - DNA, 25 bp, Mus musculus
ccaggctgtatatgcagtgcagtat

SEQ ID NO: 340412 - DNA, 25 bp, Mus musculus
ccaggctgtctgatctcagtgtaat

SEQ ID NO: 340413 - DNA, 25 bp, Mus musculus
ccaggctgtctgttctcagtgtaat

SEQ ID NO: 340414 - DNA, 25 bp, Mus musculus
ccaggctgtgggatgatcacacact

SEQ ID NO: 340415 - DNA, 25 bp, Mus musculus
ccaggctgtgggttgatcacacact

SEQ ID NO: 340416 - DNA, 25 bp, Mus musculus
ccaggctgttttctatagggagtga

SEQ ID NO: 340417 - DNA, 25 bp, Mus musculus
ccaggctgttttgtatagggagtga

SEQ ID NO: 340418 - DNA, 25 bp, Mus musculus
ccaggcttacttaggcatgaaaaga

SEQ ID NO: 340419 - DNA, 25 bp, Mus musculus
ccaggcttactttggcatgaaaaga

SEQ ID NO: 340420 - DNA, 25 bp, Mus musculus
ccaggcttaggtaggcagtgttatt

SEQ ID NO: 340421 - DNA, 25 bp, Mus musculus
ccaggcttaggttggcagtgttatt

SEQ ID NO: 340422 - DNA, 25 bp, Mus musculus
ccaggcttcaagcacacacttgttc

SEQ ID NO: 340423 - DNA, 25 bp, Mus musculus
ccaggcttcaaggacacacttgttc

SEQ ID NO: 340424 - DNA, 25 bp, Mus musculus
ccaggcttcattctcgtggaaacta

SEQ ID NO: 340425 - DNA, 25 bp, Mus musculus
ccaggcttcattgtcgtggaaacta

SEQ ID NO: 340426 - DNA, 25 bp, Mus musculus
ccaggcttccccacagtgaattaaa

SEQ ID NO: 340427 - DNA, 25 bp, Mus musculus
ccaggcttcccctcagtgaattaaa

SEQ ID NO: 340428 - DNA, 25 bp, Mus musculus
ccaggcttggcgatagaattccccg

SEQ ID NO: 340429 - DNA, 25 bp, Mus musculus
ccaggcttggcgttagaattccccg

SEQ ID NO: 340430 - DNA, 25 bp, Mus musculus
ccaggcttggtgagatgtgtctata

SEQ ID NO: 340431 - DNA, 25 bp, Mus musculus
ccaggcttggtgtgatgtgtctata

SEQ ID NO: 340432 - DNA, 25 bp, Mus musculus
ccaggctttaacagctcagcagaga

SEQ ID NO: 340433 - DNA, 25 bp, Mus musculus
ccaggctttaactgctcagcagaga

SEQ ID NO: 340434 - DNA, 25 bp, Mus musculus
ccaggctttcagcgttgccaaggaa

SEQ ID NO: 340435 - DNA, 25 bp, Mus musculus
ccaggctttcagggttgccaaggaa

SEQ ID NO: 340436 - DNA, 25 bp, Mus musculus
ccaggctttgaccacactgatgaaa

SEQ ID NO: 340437 - DNA, 25 bp, Mus musculus
ccaggctttgacgacactgatgaaa

SEQ ID NO: 340438 - DNA, 25 bp, Mus musculus
ccaggctttgcactttcctatacag

SEQ ID NO: 340439 - DNA, 25 bp, Mus musculus
ccaggctttgcagtttcctatacag

SEQ ID NO: 340440 - DNA, 25 bp, Mus musculus
ccaggctttggccattatctgtaag

SEQ ID NO: 340441 - DNA, 25 bp, Mus musculus
ccaggctttggcgattatctgtaag

SEQ ID NO: 340442 - DNA, 25 bp, Mus musculus
ccaggctttgggaaatcagggcatt

SEQ ID NO: 340443 - DNA, 25 bp, Mus musculus
ccaggctttgggtaatcagggcatt

SEQ ID NO: 340444 - DNA, 25 bp, Mus musculus
ccagggaaacaaagccccggctgca

SEQ ID NO: 340445 - DNA, 25 bp, Mus musculus
ccagggaaacaatgccccggctgca

SEQ ID NO: 340446 - DNA, 25 bp, Mus musculus
ccagggaaacttactgcaggagata

SEQ ID NO: 340447 - DNA, 25 bp, Mus musculus
ccagggaaactttctgcaggagata

SEQ ID NO: 340448 - DNA, 25 bp, Mus musculus
ccagggaacaagacaccagagtttt

SEQ ID NO: 340449 - DNA, 25 bp, Mus musculus
ccagggaacaagtcaccagagtttt

SEQ ID NO: 340450 - DNA, 25 bp, Mus musculus
ccagggaatcctcatctttctaaaa

SEQ ID NO: 340451 - DNA, 25 bp, Mus musculus
ccagggaatcctgatctttctaaaa

SEQ ID NO: 340452 - DNA, 25 bp, Mus musculus
ccagggaatctgctatcctcttttc

SEQ ID NO: 340453 - DNA, 25 bp, Mus musculus
ccagggaatctggtatcctcttttc

SEQ ID NO: 340454 - DNA, 25 bp, Mus musculus
ccagggacaagtcagcaatgcagct

SEQ ID NO: 340455 - DNA, 25 bp, Mus musculus
ccagggacaagtgagcaatgcagct

SEQ ID NO: 340456 - DNA, 25 bp, Mus musculus
ccagggacagagcaatgtggacaca

SEQ ID NO: 340457 - DNA, 25 bp, Mus musculus
ccagggacagaggaatgtggacaca

SEQ ID NO: 340458 - DNA, 25 bp, Mus musculus
ccagggaccacgacggtgatagctt

SEQ ID NO: 340459 - DNA, 25 bp, Mus musculus
ccagggaccacgtcggtgatagctt

SEQ ID NO: 340460 - DNA, 25 bp, Mus musculus
ccagggaccagacagctgaggtttt

SEQ ID NO: 340461 - DNA, 25 bp, Mus musculus
ccagggaccagagagctgaggtttt

SEQ ID NO: 340462 - DNA, 25 bp, Mus musculus
ccagggactcaacgagagggtacct

SEQ ID NO: 340463 - DNA, 25 bp, Mus musculus
ccagggactcaaggagagggtacct

SEQ ID NO: 340464 - DNA, 25 bp, Mus musculus
ccagggactctgaagtgttgtgtta

SEQ ID NO: 340465 - DNA, 25 bp, Mus musculus
ccagggactctgtagtgttgtgtta

SEQ ID NO: 340466 - DNA, 25 bp, Mus musculus
ccagggactgtcatttagagccata

SEQ ID NO: 340467 - DNA, 25 bp, Mus musculus
ccagggactgtcttttagagccata

SEQ ID NO: 340468 - DNA, 25 bp, Mus musculus
ccagggagcaggactcggctacaaa

SEQ ID NO: 340469 - DNA, 25 bp, Mus musculus
ccagggagcaggtctcggctacaaa

SEQ ID NO: 340470 - DNA, 25 bp, Mus musculus
ccagggagccctagtacgatttaat

SEQ ID NO: 340471 - DNA, 25 bp, Mus musculus
ccagggagcccttgtacgatttaat

SEQ ID NO: 340472 - DNA, 25 bp, Mus musculus
ccagggagccgcagaggcccagcat

SEQ ID NO: 340473 - DNA, 25 bp, Mus musculus
ccagggagccgctgaggcccagcat

SEQ ID NO: 340474 - DNA, 25 bp, Mus musculus
ccagggagccttaacacggagataa

SEQ ID NO: 340475 - DNA, 25 bp, Mus musculus
ccagggagcctttacacggagataa

SEQ ID NO: 340476 - DNA, 25 bp, Mus musculus
ccagggaggtggatcagtgactaac

SEQ ID NO: 340477 - DNA, 25 bp, Mus musculus
ccagggaggtggttcagtgactaac

SEQ ID NO: 340478 - DNA, 25 bp, Mus musculus
ccagggagtccactgcccttttctg

SEQ ID NO: 340479 - DNA, 25 bp, Mus musculus
ccagggagtccagtgcccttttctg

SEQ ID NO: 340480 - DNA, 25 bp, Mus musculus
ccagggagtgacaggactagaatgt

SEQ ID NO: 340481 - DNA, 25 bp, Mus musculus
ccagggagtgactggactagaatgt

SEQ ID NO: 340482 - DNA, 25 bp, Mus musculus
ccagggatcaggagctaggccgttt

SEQ ID NO: 340483 - DNA, 25 bp, Mus musculus
ccagggatcaggtgctaggccgttt

SEQ ID NO: 340484 - DNA, 25 bp, Mus musculus
ccagggatgccaagatgctttatat

SEQ ID NO: 340485 - DNA, 25 bp, Mus musculus
ccagggatgccatgatgctttatat

SEQ ID NO: 340486 - DNA, 25 bp, Mus musculus
ccagggatgtgaaaagcagcttttt

SEQ ID NO: 340487 - DNA, 25 bp, Mus musculus
ccagggatgtgataagcagcttttt

SEQ ID NO: 340488 - DNA, 25 bp, Mus musculus
ccagggattcaactgaggcgcagaa

SEQ ID NO: 340489 - DNA, 25 bp, Mus musculus
ccagggattcaagtgaggcgcagaa

SEQ ID NO: 340490 - DNA, 25 bp, Mus musculus
ccagggatttgtcagcctttcctag

SEQ ID NO: 340491 - DNA, 25 bp, Mus musculus
ccagggatttgtgagcctttcctag

SEQ ID NO: 340492 - DNA, 25 bp, Mus musculus
ccagggcaaggtcagatattggttt

SEQ ID NO: 340493 - DNA, 25 bp, Mus musculus
ccagggcaaggtgagatattggttt

SEQ ID NO: 340494 - DNA, 25 bp, Mus musculus
ccagggcaatggaagtttagagaat

SEQ ID NO: 340495 - DNA, 25 bp, Mus musculus
ccagggcaatggtagtttagagaat

SEQ ID NO: 340496 - DNA, 25 bp, Mus musculus
ccagggcacaccatgcagaatgcaa

SEQ ID NO: 340497 - DNA, 25 bp, Mus musculus
ccagggcacaccttgcagaatgcaa

SEQ ID NO: 340498 - DNA, 25 bp, Mus musculus
ccagggcacactctgtctgtgtaaa

SEQ ID NO: 340499 - DNA, 25 bp, Mus musculus
ccagggcacactgtgtctgtgtaaa

SEQ ID NO: 340500 - DNA, 25 bp, Mus musculus
ccagggcacctcatttaagtagaca

SEQ ID NO: 340501 - DNA, 25 bp, Mus musculus
ccagggcacctcttttaagtagaca

SEQ ID NO: 340502 - DNA, 25 bp, Mus musculus
ccagggcactacacgggaaaccatc

SEQ ID NO: 340503 - DNA, 25 bp, Mus musculus
ccagggcactactcgggaaaccatc

SEQ ID NO: 340504 - DNA, 25 bp, Mus musculus
ccagggcactggaagtctcagatgt

SEQ ID NO: 340505 - DNA, 25 bp, Mus musculus
ccagggcactggtagtctcagatgt

SEQ ID NO: 340506 - DNA, 25 bp, Mus musculus
ccagggcagccaacgcgataacgaa

SEQ ID NO: 340507 - DNA, 25 bp, Mus musculus
ccagggcagccatcgcgataacgaa

SEQ ID NO: 340508 - DNA, 25 bp, Mus musculus
ccagggcaggtaagaactgatggca

SEQ ID NO: 340509 - DNA, 25 bp, Mus musculus
ccagggcaggtatgaactgatggca

SEQ ID NO: 340510 - DNA, 25 bp, Mus musculus
ccagggcagttactctagtggttaa

SEQ ID NO: 340511 - DNA, 25 bp, Mus musculus
ccagggcagttagtctagtggttaa

SEQ ID NO: 340512 - DNA, 25 bp, Mus musculus
ccagggcagtttcgtgctatatcaa

SEQ ID NO: 340513 - DNA, 25 bp, Mus musculus
ccagggcagtttggtgctatatcaa

SEQ ID NO: 340514 - DNA, 25 bp, Mus musculus
ccagggcatcagcttcagtcaaaag

SEQ ID NO: 340515 - DNA, 25 bp, Mus musculus
ccagggcatcaggttcagtcaaaag

SEQ ID NO: 340516 - DNA, 25 bp, Mus musculus
ccagggcatccacccgcccggactg

SEQ ID NO: 340517 - DNA, 25 bp, Mus musculus
ccagggcatccagccgcccggactg

SEQ ID NO: 340518 - DNA, 25 bp, Mus musculus
ccagggccacggacaacttggaagt

SEQ ID NO: 340519 - DNA, 25 bp, Mus musculus
ccagggccacggtcaacttggaagt

SEQ ID NO: 340520 - DNA, 25 bp, Mus musculus
ccagggccactcacttattctgtag

SEQ ID NO: 340521 - DNA, 25 bp, Mus musculus
ccagggccactctcttattctgtag

SEQ ID NO: 340522 - DNA, 25 bp, Mus musculus
ccagggccaggaatcaggtctctga

SEQ ID NO: 340523 - DNA, 25 bp, Mus musculus
ccagggccaggattcaggtctctga

SEQ ID NO: 340524 - DNA, 25 bp, Mus musculus
ccagggccagtacaaggtgagctat

SEQ ID NO: 340525 - DNA, 25 bp, Mus musculus
ccagggccagtagaaggtgagctat

SEQ ID NO: 340526 - DNA, 25 bp, Mus musculus
ccagggccatcgattgtggacgttt

SEQ ID NO: 340527 - DNA, 25 bp, Mus musculus
ccagggccatcgtttgtggacgttt

SEQ ID NO: 340528 - DNA, 25 bp, Mus musculus
ccagggccatggcttagcatctaca

SEQ ID NO: 340529 - DNA, 25 bp, Mus musculus
ccagggccatgggttagcatctaca

SEQ ID NO: 340530 - DNA, 25 bp, Mus musculus
ccagggcccactcaggatttgaaaa

SEQ ID NO: 340531 - DNA, 25 bp, Mus musculus
ccagggcccactgaggatttgaaaa

SEQ ID NO: 340532 - DNA, 25 bp, Mus musculus
ccagggcccgagaactgacctcatt

SEQ ID NO: 340533 - DNA, 25 bp, Mus musculus
ccagggcccgagtactgacctcatt

SEQ ID NO: 340534 - DNA, 25 bp, Mus musculus
ccagggcccttgaagtcttgtgctg

SEQ ID NO: 340535 - DNA, 25 bp, Mus musculus
ccagggcccttgtagtcttgtgctg

SEQ ID NO: 340536 - DNA, 25 bp, Mus musculus
ccagggcctcagaagccagtggcag

SEQ ID NO: 340537 - DNA, 25 bp, Mus musculus
ccagggcctcagtagccagtggcag

SEQ ID NO: 340538 - DNA, 25 bp, Mus musculus
ccagggcctcatctgtgttaggaca

SEQ ID NO: 340539 - DNA, 25 bp, Mus musculus
ccagggcctcatgtgtgttaggaca

SEQ ID NO: 340540 - DNA, 25 bp, Mus musculus
ccagggcctctgcatatgtatagaa

SEQ ID NO: 340541 - DNA, 25 bp, Mus musculus
ccagggcctctggatatgtatagaa

SEQ ID NO: 340542 - DNA, 25 bp, Mus musculus
ccagggcgctggatctgaaacggtt

SEQ ID NO: 340543 - DNA, 25 bp, Mus musculus
ccagggcgctggttctgaaacggtt

SEQ ID NO: 340544 - DNA, 25 bp, Mus musculus
ccagggcggcagattccagagtgat

SEQ ID NO: 340545 - DNA, 25 bp, Mus musculus
ccagggcggcagtttccagagtgat

SEQ ID NO: 340546 - DNA, 25 bp, Mus musculus
ccagggcggcttccgtgctaagcaa

SEQ ID NO: 340547 - DNA, 25 bp, Mus musculus
ccagggcggcttgcgtgctaagcaa

SEQ ID NO: 340548 - DNA, 25 bp, Mus musculus
ccagggctacagacaaatatataca

SEQ ID NO: 340549 - DNA, 25 bp, Mus musculus
ccagggctacagtcaaatatataca

SEQ ID NO: 340550 - DNA, 25 bp, Mus musculus
ccagggctaggacgacacagacaca

SEQ ID NO: 340551 - DNA, 25 bp, Mus musculus
ccagggctaggaggacacagacaca

SEQ ID NO: 340552 - DNA, 25 bp, Mus musculus
ccagggctcgctctagggttgaaaa

SEQ ID NO: 340553 - DNA, 25 bp, Mus musculus
ccagggctcgctgtagggttgaaaa

SEQ ID NO: 340554 - DNA, 25 bp, Mus musculus
ccagggctctccaatggtgagtaga

SEQ ID NO: 340555 - DNA, 25 bp, Mus musculus
ccagggctctcctatggtgagtaga

SEQ ID NO: 340556 - DNA, 25 bp, Mus musculus
ccagggctgcagagcattctgtaaa

SEQ ID NO: 340557 - DNA, 25 bp, Mus musculus
ccagggctgcagtgcattctgtaaa

SEQ ID NO: 340558 - DNA, 25 bp, Mus musculus
ccagggctgtggaagacatgtgctt

SEQ ID NO: 340559 - DNA, 25 bp, Mus musculus
ccagggctgtggtagacatgtgctt

SEQ ID NO: 340560 - DNA, 25 bp, Mus musculus
ccagggctttttacaagtactctat

SEQ ID NO: 340561 - DNA, 25 bp, Mus musculus
ccagggcttttttcaagtactctat

SEQ ID NO: 340562 - DNA, 25 bp, Mus musculus
ccaggggttcctctccagctgtttt

SEQ ID NO: 340563 - DNA, 25 bp, Mus musculus
ccaggggttcctgtccagctgtttt

SEQ ID NO: 340564 - DNA, 25 bp, Mus musculus
ccagggtaacaacccctgccatgaa

SEQ ID NO: 340565 - DNA, 25 bp, Mus musculus
ccagggtaacaagccctgccatgaa

SEQ ID NO: 340566 - DNA, 25 bp, Mus musculus
ccagggtaacacagtctttatggac

SEQ ID NO: 340567 - DNA, 25 bp, Mus musculus
ccagggtaacactgtctttatggac

SEQ ID NO: 340568 - DNA, 25 bp, Mus musculus
ccagggtagctgaacccacacacat

SEQ ID NO: 340569 - DNA, 25 bp, Mus musculus
ccagggtagctgtacccacacacat

SEQ ID NO: 340570 - DNA, 25 bp, Mus musculus
ccagggtatgtgagtacacacagat

SEQ ID NO: 340571 - DNA, 25 bp, Mus musculus
ccagggtatgtgagttctcttaggg

SEQ ID NO: 340572 - DNA, 25 bp, Mus musculus
ccagggtatgtgtgtacacacagat

SEQ ID NO: 340573 - DNA, 25 bp, Mus musculus
ccagggtatgtgtgttctcttaggg

SEQ ID NO: 340574 - DNA, 25 bp, Mus musculus
ccagggtcaggtccttggaaccgtt

SEQ ID NO: 340575 - DNA, 25 bp, Mus musculus
ccagggtcaggtgcttggaaccgtt

SEQ ID NO: 340576 - DNA, 25 bp, Mus musculus
ccagggtcatggactgagttcagtt

SEQ ID NO: 340577 - DNA, 25 bp, Mus musculus
ccagggtcatggtctgagttcagtt

SEQ ID NO: 340578 - DNA, 25 bp, Mus musculus
ccagggtccttcctgaagatcctta

SEQ ID NO: 340579 - DNA, 25 bp, Mus musculus
ccagggtccttcgtgaagatcctta

SEQ ID NO: 340580 - DNA, 25 bp, Mus musculus
ccagggtctctgaggagcagaaagt

SEQ ID NO: 340581 - DNA, 25 bp, Mus musculus
ccagggtctctgattaaattgatga

SEQ ID NO: 340582 - DNA, 25 bp, Mus musculus
ccagggtctctgtggagcagaaagt

SEQ ID NO: 340583 - DNA, 25 bp, Mus musculus
ccagggtctctgtttaaattgatga

SEQ ID NO: 340584 - DNA, 25 bp, Mus musculus
ccagggtctcttcccatttgaatat

SEQ ID NO: 340585 - DNA, 25 bp, Mus musculus
ccagggtctcttgccatttgaatat

SEQ ID NO: 340586 - DNA, 25 bp, Mus musculus
ccagggtctgggagttataatgaat

SEQ ID NO: 340587 - DNA, 25 bp, Mus musculus
ccagggtctgggtgttataatgaat

SEQ ID NO: 340588 - DNA, 25 bp, Mus musculus
ccagggtcttggctatgttaggcaa

SEQ ID NO: 340589 - DNA, 25 bp, Mus musculus
ccagggtcttgggtatgttaggcaa

SEQ ID NO: 340590 - DNA, 25 bp, Mus musculus
ccagggtgaattagacctcagcagt

SEQ ID NO: 340591 - DNA, 25 bp, Mus musculus
ccagggtgaatttgacctcagcagt

SEQ ID NO: 340592 - DNA, 25 bp, Mus musculus
ccagggtgacttcgtatcatggctt

SEQ ID NO: 340593 - DNA, 25 bp, Mus musculus
ccagggtgacttggtatcatggctt

SEQ ID NO: 340594 - DNA, 25 bp, Mus musculus
ccagggtgatttactgtcttctttt

SEQ ID NO: 340595 - DNA, 25 bp, Mus musculus
ccagggtgattttctgtcttctttt

SEQ ID NO: 340596 - DNA, 25 bp, Mus musculus
ccagggtggaggatagagtgctact

SEQ ID NO: 340597 - DNA, 25 bp, Mus musculus
ccagggtggaggttagagtgctact

SEQ ID NO: 340598 - DNA, 25 bp, Mus musculus
ccagggtggcccagctccagagatg

SEQ ID NO: 340599 - DNA, 25 bp, Mus musculus
ccagggtggccctgctccagagatg

SEQ ID NO: 340600 - DNA, 25 bp, Mus musculus
ccagggttacccaggagtagagact

SEQ ID NO: 340601 - DNA, 25 bp, Mus musculus
ccagggttaccctggagtagagact

SEQ ID NO: 340602 - DNA, 25 bp, Mus musculus
ccagggttcattccaacgcccatga

SEQ ID NO: 340603 - DNA, 25 bp, Mus musculus
ccagggttcattgcaacgcccatga

SEQ ID NO: 340604 - DNA, 25 bp, Mus musculus
ccagggttggacctgaagctctgta

SEQ ID NO: 340605 - DNA, 25 bp, Mus musculus
ccagggttggacgtgaagctctgta

SEQ ID NO: 340606 - DNA, 25 bp, Mus musculus
ccagggttggcaacctttggtactt

SEQ ID NO: 340607 - DNA, 25 bp, Mus musculus
ccagggttggcatcctttggtactt

SEQ ID NO: 340608 - DNA, 25 bp, Mus musculus
ccagggttggctaggcctgcctgta

SEQ ID NO: 340609 - DNA, 25 bp, Mus musculus
ccagggttggcttggcctgcctgta

SEQ ID NO: 340610 - DNA, 25 bp, Mus musculus
ccagggttgggaagttcagtcattc

SEQ ID NO: 340611 - DNA, 25 bp, Mus musculus
ccagggttgggatgttcagtcattc

SEQ ID NO: 340612 - DNA, 25 bp, Mus musculus
ccagggttgtcgactataggtcact

SEQ ID NO: 340613 - DNA, 25 bp, Mus musculus
ccagggttgtcgtctataggtcact

SEQ ID NO: 340614 - DNA, 25 bp, Mus musculus
ccagggtttcgtccttgctatgtaa

SEQ ID NO: 340615 - DNA, 25 bp, Mus musculus
ccagggtttcgtgcttgctatgtaa

SEQ ID NO: 340616 - DNA, 25 bp, Mus musculus
ccagggtttctgataggctccttta

SEQ ID NO: 340617 - DNA, 25 bp, Mus musculus
ccagggtttctgttaggctccttta

SEQ ID NO: 340618 - DNA, 25 bp, Mus musculus
ccagggtttgttctctagccaatag

SEQ ID NO: 340619 - DNA, 25 bp, Mus musculus
ccagggtttgttgtctagccaatag

SEQ ID NO: 340620 - DNA, 25 bp, Mus musculus
ccagggttttatacacatgcaggtt

SEQ ID NO: 340621 - DNA, 25 bp, Mus musculus
ccagggttttattcacatgcaggtt

SEQ ID NO: 340622 - DNA, 25 bp, Mus musculus
ccaggtaaaggtcacactgtgtgtt

SEQ ID NO: 340623 - DNA, 25 bp, Mus musculus
ccaggtaaaggtgacactgtgtgtt

SEQ ID NO: 340624 - DNA, 25 bp, Mus musculus
ccaggtaagggaaatgtgtttgtaa

SEQ ID NO: 340625 - DNA, 25 bp, Mus musculus
ccaggtaagggatatgtgtttgtaa

SEQ ID NO: 340626 - DNA, 25 bp, Mus musculus
ccaggtaatgccagtgagtttctat

SEQ ID NO: 340627 - DNA, 25 bp, Mus musculus
ccaggtaatgcctgtgagtttctat

SEQ ID NO: 340628 - DNA, 25 bp, Mus musculus
ccaggtaccaaacccatccagatgg

SEQ ID NO: 340629 - DNA, 25 bp, Mus musculus
ccaggtaccaaagccatccagatgg

SEQ ID NO: 340630 - DNA, 25 bp, Mus musculus
ccaggtactgttagggcaatattgt

SEQ ID NO: 340631 - DNA, 25 bp, Mus musculus
ccaggtactgtttgggcaatattgt

SEQ ID NO: 340632 - DNA, 25 bp, Mus musculus
ccaggtacttggatctcttgttcag

SEQ ID NO: 340633 - DNA, 25 bp, Mus musculus
ccaggtacttggttctcttgttcag

SEQ ID NO: 340634 - DNA, 25 bp, Mus musculus
ccaggtagcccaaggtatccaacag

SEQ ID NO: 340635 - DNA, 25 bp, Mus musculus
ccaggtagcccatggtatccaacag

SEQ ID NO: 340636 - DNA, 25 bp, Mus musculus
ccaggtagccctagaaattctcaaa

SEQ ID NO: 340637 - DNA, 25 bp, Mus musculus
ccaggtagcccttgaaattctcaaa

SEQ ID NO: 340638 - DNA, 25 bp, Mus musculus
ccaggtagctgacgcccttgagtaa

SEQ ID NO: 340639 - DNA, 25 bp, Mus musculus
ccaggtagctgaggcccttgagtaa

SEQ ID NO: 340640 - DNA, 25 bp, Mus musculus
ccaggtatccatctggtgcttaaac

SEQ ID NO: 340641 - DNA, 25 bp, Mus musculus
ccaggtatccatgtggtgcttaaac

SEQ ID NO: 340642 - DNA, 25 bp, Mus musculus
ccaggtatggttaggatgctgtata

SEQ ID NO: 340643 - DNA, 25 bp, Mus musculus
ccaggtatggtttggatgctgtata

SEQ ID NO: 340644 - DNA, 25 bp, Mus musculus
ccaggtattgaaccatggcttaatc

SEQ ID NO: 340645 - DNA, 25 bp, Mus musculus
ccaggtattgaagcatggcttaatc

SEQ ID NO: 340646 - DNA, 25 bp, Mus musculus
ccaggtcaacaacgactgcttggtg

SEQ ID NO: 340647 - DNA, 25 bp, Mus musculus
ccaggtcaacaaggactgcttggtg

SEQ ID NO: 340648 - DNA, 25 bp, Mus musculus
ccaggtcacagcctattagttatat

SEQ ID NO: 340649 - DNA, 25 bp, Mus musculus
ccaggtcacagcgtattagttatat

SEQ ID NO: 340650 - DNA, 25 bp, Mus musculus
ccaggtcaccggcttctttgaagtg

SEQ ID NO: 340651 - DNA, 25 bp, Mus musculus
ccaggtcaccgggttctttgaagtg

SEQ ID NO: 340652 - DNA, 25 bp, Mus musculus
ccaggtcactttccttcagtaacaa

SEQ ID NO: 340653 - DNA, 25 bp, Mus musculus
ccaggtcactttgcttcagtaacaa

SEQ ID NO: 340654 - DNA, 25 bp, Mus musculus
ccaggtcagcacatgagcacatact

SEQ ID NO: 340655 - DNA, 25 bp, Mus musculus
ccaggtcagcacttgagcacatact

SEQ ID NO: 340656 - DNA, 25 bp, Mus musculus
ccaggtcagggaaatatattcttta

SEQ ID NO: 340657 - DNA, 25 bp, Mus musculus
ccaggtcagggatatatattcttta

SEQ ID NO: 340658 - DNA, 25 bp, Mus musculus
ccaggtcatattacagggttcaaga

SEQ ID NO: 340659 - DNA, 25 bp, Mus musculus
ccaggtcatatttcagggttcaaga

SEQ ID NO: 340660 - DNA, 25 bp, Mus musculus
ccaggtcattccaactatcgcagtt

SEQ ID NO: 340661 - DNA, 25 bp, Mus musculus
ccaggtcattcctactatcgcagtt

SEQ ID NO: 340662 - DNA, 25 bp, Mus musculus
ccaggtccacagaactcattcttaa

SEQ ID NO: 340663 - DNA, 25 bp, Mus musculus
ccaggtccacagtactcattcttaa

SEQ ID NO: 340664 - DNA, 25 bp, Mus musculus
ccaggtcccatgagtcagaggcttg

SEQ ID NO: 340665 - DNA, 25 bp, Mus musculus
ccaggtcccatgtgtcagaggcttg

SEQ ID NO: 340666 - DNA, 25 bp, Mus musculus
ccaggtcccctgagcgcaggcgaga

SEQ ID NO: 340667 - DNA, 25 bp, Mus musculus
ccaggtcccctgtgcgcaggcgaga

SEQ ID NO: 340668 - DNA, 25 bp, Mus musculus
ccaggtccctcgatggtccaataaa

SEQ ID NO: 340669 - DNA, 25 bp, Mus musculus
ccaggtccctcgttggtccaataaa

SEQ ID NO: 340670 - DNA, 25 bp, Mus musculus
ccaggtcccttacccagcaagtttg

SEQ ID NO: 340671 - DNA, 25 bp, Mus musculus
ccaggtcccttagccagcaagtttg

SEQ ID NO: 340672 - DNA, 25 bp, Mus musculus
ccaggtccgaatcaacatgcacttt

SEQ ID NO: 340673 - DNA, 25 bp, Mus musculus
ccaggtccgaatgaacatgcacttt

SEQ ID NO: 340674 - DNA, 25 bp, Mus musculus
ccaggtcctagcagcctccagtgat

SEQ ID NO: 340675 - DNA, 25 bp, Mus musculus
ccaggtcctagctgcctccagtgat

SEQ ID NO: 340676 - DNA, 25 bp, Mus musculus
ccaggtcctgggaacatagcgacgg

SEQ ID NO: 340677 - DNA, 25 bp, Mus musculus
ccaggtcctgggtacatagcgacgg

SEQ ID NO: 340678 - DNA, 25 bp, Mus musculus
ccaggtccttgtctatgtagctcta

SEQ ID NO: 340679 - DNA, 25 bp, Mus musculus
ccaggtccttgtgtatgtagctcta

SEQ ID NO: 340680 - DNA, 25 bp, Mus musculus
ccaggtcggatgagatctgtgctca

SEQ ID NO: 340681 - DNA, 25 bp, Mus musculus
ccaggtcggatgtgatctgtgctca

SEQ ID NO: 340682 - DNA, 25 bp, Mus musculus
ccaggtctcttacggaatcagttta

SEQ ID NO: 340683 - DNA, 25 bp, Mus musculus
ccaggtctcttagggaatcagttta

SEQ ID NO: 340684 - DNA, 25 bp, Mus musculus
ccaggtctcttgctggtttggagaa

SEQ ID NO: 340685 - DNA, 25 bp, Mus musculus
ccaggtctcttggtggtttggagaa

SEQ ID NO: 340686 - DNA, 25 bp, Mus musculus
ccaggtcttaggctcaagtctctta

SEQ ID NO: 340687 - DNA, 25 bp, Mus musculus
ccaggtcttagggtcaagtctctta

SEQ ID NO: 340688 - DNA, 25 bp, Mus musculus
ccaggtcttatgatctgcgcctgac

SEQ ID NO: 340689 - DNA, 25 bp, Mus musculus
ccaggtcttatgttctgcgcctgac

SEQ ID NO: 340690 - DNA, 25 bp, Mus musculus
ccaggtcttcacagctccttgtgag

SEQ ID NO: 340691 - DNA, 25 bp, Mus musculus
ccaggtcttcactgctccttgtgag

SEQ ID NO: 340692 - DNA, 25 bp, Mus musculus
ccaggtcttgtaaatcccagcagta

SEQ ID NO: 340693 - DNA, 25 bp, Mus musculus
ccaggtcttgtatatcccagcagta

SEQ ID NO: 340694 - DNA, 25 bp, Mus musculus
ccaggtgaagctctcctcatgttac

SEQ ID NO: 340695 - DNA, 25 bp, Mus musculus
ccaggtgaagctgtcctcatgttac

SEQ ID NO: 340696 - DNA, 25 bp, Mus musculus
ccaggtgacaagaacataggtgaat

SEQ ID NO: 340697 - DNA, 25 bp, Mus musculus
ccaggtgacaagtacataggtgaat

SEQ ID NO: 340698 - DNA, 25 bp, Mus musculus
ccaggtgacaataccagatgacgat

SEQ ID NO: 340699 - DNA, 25 bp, Mus musculus
ccaggtgacaattccagatgacgat

SEQ ID NO: 340700 - DNA, 25 bp, Mus musculus
ccaggtgacaccagctatggctaat

SEQ ID NO: 340701 - DNA, 25 bp, Mus musculus
ccaggtgacacctgctatggctaat

SEQ ID NO: 340702 - DNA, 25 bp, Mus musculus
ccaggtgacatgctgtggctcctct

SEQ ID NO: 340703 - DNA, 25 bp, Mus musculus
ccaggtgacatggtgtggctcctct

SEQ ID NO: 340704 - DNA, 25 bp, Mus musculus
ccaggtgaccctaggcttgtcaagt

SEQ ID NO: 340705 - DNA, 25 bp, Mus musculus
ccaggtgaccctccagagtacacag

SEQ ID NO: 340706 - DNA, 25 bp, Mus musculus
ccaggtgaccctgcagagtacacag

SEQ ID NO: 340707 - DNA, 25 bp, Mus musculus
ccaggtgacccttggcttgtcaagt

SEQ ID NO: 340708 - DNA, 25 bp, Mus musculus
ccaggtgaccgaaggctctgtggac

SEQ ID NO: 340709 - DNA, 25 bp, Mus musculus
ccaggtgaccgatggctctgtggac

SEQ ID NO: 340710 - DNA, 25 bp, Mus musculus
ccaggtgacggtcgcacacgacttt

SEQ ID NO: 340711 - DNA, 25 bp, Mus musculus
ccaggtgacggtggcacacgacttt

SEQ ID NO: 340712 - DNA, 25 bp, Mus musculus
ccaggtgactcccagtcatgaagac

SEQ ID NO: 340713 - DNA, 25 bp, Mus musculus
ccaggtgactccgagtcatgaagac

SEQ ID NO: 340714 - DNA, 25 bp, Mus musculus
ccaggtgagacgcaaggccttgcaa

SEQ ID NO: 340715 - DNA, 25 bp, Mus musculus
ccaggtgagacggaaggccttgcaa

SEQ ID NO: 340716 - DNA, 25 bp, Mus musculus
ccaggtgatagccggtgttgttttt

SEQ ID NO: 340717 - DNA, 25 bp, Mus musculus
ccaggtgatagcgggtgttgttttt

SEQ ID NO: 340718 - DNA, 25 bp, Mus musculus
ccaggtgatctccttagtgcagcag

SEQ ID NO: 340719 - DNA, 25 bp, Mus musculus
ccaggtgatctcgttagtgcagcag

SEQ ID NO: 340720 - DNA, 25 bp, Mus musculus
ccaggtgattttaataattgcgcca

SEQ ID NO: 340721 - DNA, 25 bp, Mus musculus
ccaggtgatttttataattgcgcca

SEQ ID NO: 340722 - DNA, 25 bp, Mus musculus
ccaggtgcaagacttcactgccttt

SEQ ID NO: 340723 - DNA, 25 bp, Mus musculus
ccaggtgcaagagttcactgccttt

SEQ ID NO: 340724 - DNA, 25 bp, Mus musculus
ccaggtgccaatcatgaaggatttg

SEQ ID NO: 340725 - DNA, 25 bp, Mus musculus
ccaggtgccaatgatgaaggatttg

SEQ ID NO: 340726 - DNA, 25 bp, Mus musculus
ccaggtgccataccattgcctttaa

SEQ ID NO: 340727 - DNA, 25 bp, Mus musculus
ccaggtgccatagcattgcctttaa

SEQ ID NO: 340728 - DNA, 25 bp, Mus musculus
ccaggtgcctccatttgactcgcat

SEQ ID NO: 340729 - DNA, 25 bp, Mus musculus
ccaggtgcctccttttgactcgcat

SEQ ID NO: 340730 - DNA, 25 bp, Mus musculus
ccaggtgcctttaaattcattgttc

SEQ ID NO: 340731 - DNA, 25 bp, Mus musculus
ccaggtgccttttaattcattgttc

SEQ ID NO: 340732 - DNA, 25 bp, Mus musculus
ccaggtgctctgatttagtgtttca

SEQ ID NO: 340733 - DNA, 25 bp, Mus musculus
ccaggtgctctgttttagtgtttca

SEQ ID NO: 340734 - DNA, 25 bp, Mus musculus
ccaggtgcttatcttgttactttaa

SEQ ID NO: 340735 - DNA, 25 bp, Mus musculus
ccaggtgcttatgttgttactttaa

SEQ ID NO: 340736 - DNA, 25 bp, Mus musculus
ccaggtggaccgctcagaatctatg

SEQ ID NO: 340737 - DNA, 25 bp, Mus musculus
ccaggtggaccggtcagaatctatg

SEQ ID NO: 340738 - DNA, 25 bp, Mus musculus
ccaggtggacgtaatattgttttca

SEQ ID NO: 340739 - DNA, 25 bp, Mus musculus
ccaggtggacgttatattgttttca

SEQ ID NO: 340740 - DNA, 25 bp, Mus musculus
ccaggtggactgaggcagatcaata

SEQ ID NO: 340741 - DNA, 25 bp, Mus musculus
ccaggtggactgtggcagatcaata

SEQ ID NO: 340742 - DNA, 25 bp, Mus musculus
ccaggtggagcacaccatctcagaa

SEQ ID NO: 340743 - DNA, 25 bp, Mus musculus
ccaggtggagcagaccatctcagaa

SEQ ID NO: 340744 - DNA, 25 bp, Mus musculus
ccaggtggcagacccgttcagaaga

SEQ ID NO: 340745 - DNA, 25 bp, Mus musculus
ccaggtggcagagccgttcagaaga

SEQ ID NO: 340746 - DNA, 25 bp, Mus musculus
ccaggtggcagcatcaagtttccca

SEQ ID NO: 340747 - DNA, 25 bp, Mus musculus
ccaggtggcagcttcaagtttccca

SEQ ID NO: 340748 - DNA, 25 bp, Mus musculus
ccaggtggcctcacggactgggaaa

SEQ ID NO: 340749 - DNA, 25 bp, Mus musculus
ccaggtggcctctcggactgggaaa

SEQ ID NO: 340750 - DNA, 25 bp, Mus musculus
ccaggtggctcacacaggtaacaca

SEQ ID NO: 340751 - DNA, 25 bp, Mus musculus
ccaggtggctcagacaggtaacaca

SEQ ID NO: 340752 - DNA, 25 bp, Mus musculus
ccaggtgggcttactaactaggttg

SEQ ID NO: 340753 - DNA, 25 bp, Mus musculus
ccaggtgggctttctaactaggttg

SEQ ID NO: 340754 - DNA, 25 bp, Mus musculus
ccaggtggtgtgcttcacgccttta

SEQ ID NO: 340755 - DNA, 25 bp, Mus musculus
ccaggtggtgtggttcacgccttta

SEQ ID NO: 340756 - DNA, 25 bp, Mus musculus
ccaggtgtagagcaagcagcatgaa

SEQ ID NO: 340757 - DNA, 25 bp, Mus musculus
ccaggtgtagaggaagcagcatgaa

SEQ ID NO: 340758 - DNA, 25 bp, Mus musculus
ccaggtgtccttaatcactttggtg

SEQ ID NO: 340759 - DNA, 25 bp, Mus musculus
ccaggtgtcctttatcactttggtg

SEQ ID NO: 340760 - DNA, 25 bp, Mus musculus
ccaggtgtctgacttctggccatac

SEQ ID NO: 340761 - DNA, 25 bp, Mus musculus
ccaggtgtctgagttctggccatac

SEQ ID NO: 340762 - DNA, 25 bp, Mus musculus
ccaggtgtgactccgggctcataca

SEQ ID NO: 340763 - DNA, 25 bp, Mus musculus
ccaggtgtgactgcgggctcataca

SEQ ID NO: 340764 - DNA, 25 bp, Mus musculus
ccaggtgtgcttccaacacaagtgt

SEQ ID NO: 340765 - DNA, 25 bp, Mus musculus
ccaggtgtgcttgcaacacaagtgt

SEQ ID NO: 340766 - DNA, 25 bp, Mus musculus
ccaggtgtgtgaagatgtccgctca

SEQ ID NO: 340767 - DNA, 25 bp, Mus musculus
ccaggtgtgtgatgatgtccgctca

SEQ ID NO: 340768 - DNA, 25 bp, Mus musculus
ccaggtgtgtggcttagcattgacc

SEQ ID NO: 340769 - DNA, 25 bp, Mus musculus
ccaggtgtgtgggttagcattgacc

SEQ ID NO: 340770 - DNA, 25 bp, Mus musculus
ccaggtgtgttcctcttgtgctgta

SEQ ID NO: 340771 - DNA, 25 bp, Mus musculus
ccaggtgtgttcgtcttgtgctgta

SEQ ID NO: 340772 - DNA, 25 bp, Mus musculus
ccaggtgttcctataaatcgcatac

SEQ ID NO: 340773 - DNA, 25 bp, Mus musculus
ccaggtgttcctttaaatcgcatac

SEQ ID NO: 340774 - DNA, 25 bp, Mus musculus
ccaggtgttcgtcccaagtgcatta

SEQ ID NO: 340775 - DNA, 25 bp, Mus musculus
ccaggtgttcgtgccaagtgcatta

SEQ ID NO: 340776 - DNA, 25 bp, Mus musculus
ccaggtgttgatctgtacattggta

SEQ ID NO: 340777 - DNA, 25 bp, Mus musculus
ccaggtgttgatgtgtacattggta

SEQ ID NO: 340778 - DNA, 25 bp, Mus musculus
ccaggtgttttaagattgaatgttt

SEQ ID NO: 340779 - DNA, 25 bp, Mus musculus
ccaggtgttttatgattgaatgttt

SEQ ID NO: 340780 - DNA, 25 bp, Mus musculus
ccaggttacagaccggtgtgcagca

SEQ ID NO: 340781 - DNA, 25 bp, Mus musculus
ccaggttacagagcggtgtgcagca

SEQ ID NO: 340782 - DNA, 25 bp, Mus musculus
ccaggttagagcaattggctgcact

SEQ ID NO: 340783 - DNA, 25 bp, Mus musculus
ccaggttagagctattggctgcact

SEQ ID NO: 340784 - DNA, 25 bp, Mus musculus
ccaggttattcaagctttatccata

SEQ ID NO: 340785 - DNA, 25 bp, Mus musculus
ccaggttattcatgctttatccata

SEQ ID NO: 340786 - DNA, 25 bp, Mus musculus
ccaggttcaaatacattgccatcat

SEQ ID NO: 340787 - DNA, 25 bp, Mus musculus
ccaggttcaaattcattgccatcat

SEQ ID NO: 340788 - DNA, 25 bp, Mus musculus
ccaggttcaaggctttcgtcgctat

SEQ ID NO: 340789 - DNA, 25 bp, Mus musculus
ccaggttcaagggtttcgtcgctat

SEQ ID NO: 340790 - DNA, 25 bp, Mus musculus
ccaggttcagtaagtcttcattatg

SEQ ID NO: 340791 - DNA, 25 bp, Mus musculus
ccaggttcagtatgtcttcattatg

SEQ ID NO: 340792 - DNA, 25 bp, Mus musculus
ccaggttcctgcagagatacttctc

SEQ ID NO: 340793 - DNA, 25 bp, Mus musculus
ccaggttcctgctgagatacttctc

SEQ ID NO: 340794 - DNA, 25 bp, Mus musculus
ccaggttcgtgcaaggcttgcgcta

SEQ ID NO: 340795 - DNA, 25 bp, Mus musculus
ccaggttcgtgctaggcttgcgcta

SEQ ID NO: 340796 - DNA, 25 bp, Mus musculus
ccaggttgacctagtgatgtgaatt

SEQ ID NO: 340797 - DNA, 25 bp, Mus musculus
ccaggttgaccttgtgatgtgaatt

SEQ ID NO: 340798 - DNA, 25 bp, Mus musculus
ccaggttgatctaagccagcagcag

SEQ ID NO: 340799 - DNA, 25 bp, Mus musculus
ccaggttgatcttagccagcagcag

SEQ ID NO: 340800 - DNA, 25 bp, Mus musculus
ccaggttgctgaagctcttctggag

SEQ ID NO: 340801 - DNA, 25 bp, Mus musculus
ccaggttgctgatgctcttctggag

SEQ ID NO: 340802 - DNA, 25 bp, Mus musculus
ccaggttgctggagtggcttatttt

SEQ ID NO: 340803 - DNA, 25 bp, Mus musculus
ccaggttgctggtgtggcttatttt

SEQ ID NO: 340804 - DNA, 25 bp, Mus musculus
ccaggttggagaatcagctgcctta

SEQ ID NO: 340805 - DNA, 25 bp, Mus musculus
ccaggttggagattcagctgcctta

SEQ ID NO: 340806 - DNA, 25 bp, Mus musculus
ccaggttggtcgagtagcagtgcta

SEQ ID NO: 340807 - DNA, 25 bp, Mus musculus
ccaggttggtcgtgtagcagtgcta

SEQ ID NO: 340808 - DNA, 25 bp, Mus musculus
ccaggttggtctagtacttactttg

SEQ ID NO: 340809 - DNA, 25 bp, Mus musculus
ccaggttggtctcacattcagagat

SEQ ID NO: 340810 - DNA, 25 bp, Mus musculus
ccaggttggtctgacattcagagat

SEQ ID NO: 340811 - DNA, 25 bp, Mus musculus
ccaggttggtcttgtacttactttg

SEQ ID NO: 340812 - DNA, 25 bp, Mus musculus
ccaggttggtgaccctcagagatgc

SEQ ID NO: 340813 - DNA, 25 bp, Mus musculus
ccaggttggtgagcctcagagatgc

SEQ ID NO: 340814 - DNA, 25 bp, Mus musculus
ccaggttgtctcctgcgacttcaac

SEQ ID NO: 340815 - DNA, 25 bp, Mus musculus
ccaggttgtctcgtgcgacttcaac

SEQ ID NO: 340816 - DNA, 25 bp, Mus musculus
ccaggtttaactctagcataagcat

SEQ ID NO: 340817 - DNA, 25 bp, Mus musculus
ccaggtttaactgtagcataagcat

SEQ ID NO: 340818 - DNA, 25 bp, Mus musculus
ccaggtttcaagctttgagtatttc

SEQ ID NO: 340819 - DNA, 25 bp, Mus musculus
ccaggtttcaaggtttgagtatttc

SEQ ID NO: 340820 - DNA, 25 bp, Mus musculus
ccaggtttctctaagggccataact

SEQ ID NO: 340821 - DNA, 25 bp, Mus musculus
ccaggtttctcttagggccataact

SEQ ID NO: 340822 - DNA, 25 bp, Mus musculus
ccaggtttctggacaagattgtgta

SEQ ID NO: 340823 - DNA, 25 bp, Mus musculus
ccaggtttctggtcaagattgtgta

SEQ ID NO: 340824 - DNA, 25 bp, Mus musculus
ccaggtttctttattgcattctcaa

SEQ ID NO: 340825 - DNA, 25 bp, Mus musculus
ccaggtttcttttttgcattctcaa

SEQ ID NO: 340826 - DNA, 25 bp, Mus musculus
ccaggtttgaacatcagcaactgca

SEQ ID NO: 340827 - DNA, 25 bp, Mus musculus
ccaggtttgaacttcagcaactgca

SEQ ID NO: 340828 - DNA, 25 bp, Mus musculus
ccaggtttgtcacccggagttagca

SEQ ID NO: 340829 - DNA, 25 bp, Mus musculus
ccaggtttgtcagccggagttagca

SEQ ID NO: 340830 - DNA, 25 bp, Mus musculus
ccaggttttttcaagactccagagg

SEQ ID NO: 340831 - DNA, 25 bp, Mus musculus
ccaggttttttctagactccagagg

SEQ ID NO: 340832 - DNA, 25 bp, Mus musculus
ccagtaacactgcagaggaaccagc

SEQ ID NO: 340833 - DNA, 25 bp, Mus musculus
ccagtaacactggagaggaaccagc

SEQ ID NO: 340834 - DNA, 25 bp, Mus musculus
ccagtaagctccagggatcctcaag

SEQ ID NO: 340835 - DNA, 25 bp, Mus musculus
ccagtaagctcctgggatcctcaag

SEQ ID NO: 340836 - DNA, 25 bp, Mus musculus
ccagtaagtgaaaacacccatccac

SEQ ID NO: 340837 - DNA, 25 bp, Mus musculus
ccagtaagtgaatacacccatccac

SEQ ID NO: 340838 - DNA, 25 bp, Mus musculus
ccagtaagtgcgcgtcataagcttg

SEQ ID NO: 340839 - DNA, 25 bp, Mus musculus
ccagtaagtgcgggtcataagcttg

SEQ ID NO: 340840 - DNA, 25 bp, Mus musculus
ccagtacactggctctgtgtaaaca

SEQ ID NO: 340841 - DNA, 25 bp, Mus musculus
ccagtacactgggtctgtgtaaaca

SEQ ID NO: 340842 - DNA, 25 bp, Mus musculus
ccagtacagatcatgggaaatccct

SEQ ID NO: 340843 - DNA, 25 bp, Mus musculus
ccagtacagatcttgggaaatccct

SEQ ID NO: 340844 - DNA, 25 bp, Mus musculus
ccagtacatcccattcctgctgttt

SEQ ID NO: 340845 - DNA, 25 bp, Mus musculus
ccagtacatccctttcctgctgttt

SEQ ID NO: 340846 - DNA, 25 bp, Mus musculus
ccagtaccaaccacatctaggcagg

SEQ ID NO: 340847 - DNA, 25 bp, Mus musculus
ccagtaccaacctcatctaggcagg

SEQ ID NO: 340848 - DNA, 25 bp, Mus musculus
ccagtaccacggaagagccaagcat

SEQ ID NO: 340849 - DNA, 25 bp, Mus musculus
ccagtaccacggtagagccaagcat

SEQ ID NO: 340850 - DNA, 25 bp, Mus musculus
ccagtacccatgagctatctgtaac

SEQ ID NO: 340851 - DNA, 25 bp, Mus musculus
ccagtacccatgtgctatctgtaac

SEQ ID NO: 340852 - DNA, 25 bp, Mus musculus
ccagtacctcctccattttagcaaa

SEQ ID NO: 340853 - DNA, 25 bp, Mus musculus
ccagtacctcctgcattttagcaaa

SEQ ID NO: 340854 - DNA, 25 bp, Mus musculus
ccagtacgatctcaggcagcaggtt

SEQ ID NO: 340855 - DNA, 25 bp, Mus musculus
ccagtacgatctgaggcagcaggtt

SEQ ID NO: 340856 - DNA, 25 bp, Mus musculus
ccagtactactgagagggtggatag

SEQ ID NO: 340857 - DNA, 25 bp, Mus musculus
ccagtactactgtgagggtggatag

SEQ ID NO: 340858 - DNA, 25 bp, Mus musculus
ccagtactcaagaatggaactcatt

SEQ ID NO: 340859 - DNA, 25 bp, Mus musculus
ccagtactcaagtatggaactcatt

SEQ ID NO: 340860 - DNA, 25 bp, Mus musculus
ccagtactcctgacaagcttgaaga

SEQ ID NO: 340861 - DNA, 25 bp, Mus musculus
ccagtactcctgtcaagcttgaaga

SEQ ID NO: 340862 - DNA, 25 bp, Mus musculus
ccagtactggctatctatccaagaa

SEQ ID NO: 340863 - DNA, 25 bp, Mus musculus
ccagtactggctttctatccaagaa

SEQ ID NO: 340864 - DNA, 25 bp, Mus musculus
ccagtacttcccaactttttgaatg

SEQ ID NO: 340865 - DNA, 25 bp, Mus musculus
ccagtacttccctactttttgaatg

SEQ ID NO: 340866 - DNA, 25 bp, Mus musculus
ccagtacttgtgcatgcaactccca

SEQ ID NO: 340867 - DNA, 25 bp, Mus musculus
ccagtacttgtggatgcaactccca

SEQ ID NO: 340868 - DNA, 25 bp, Mus musculus
ccagtagaactgagggtggtgccat

SEQ ID NO: 340869 - DNA, 25 bp, Mus musculus
ccagtagaactgtgggtggtgccat

SEQ ID NO: 340870 - DNA, 25 bp, Mus musculus
ccagtagaccataagcatttgctta

SEQ ID NO: 340871 - DNA, 25 bp, Mus musculus
ccagtagaccattagcatttgctta

SEQ ID NO: 340872 - DNA, 25 bp, Mus musculus
ccagtagataggactctgtgtgcaa

SEQ ID NO: 340873 - DNA, 25 bp, Mus musculus
ccagtagataggtctctgtgtgcaa

SEQ ID NO: 340874 - DNA, 25 bp, Mus musculus
ccagtagcaatcctccgtaggagtt

SEQ ID NO: 340875 - DNA, 25 bp, Mus musculus
ccagtagcaatcgtccgtaggagtt

SEQ ID NO: 340876 - DNA, 25 bp, Mus musculus
ccagtagcacccattacagacttaa

SEQ ID NO: 340877 - DNA, 25 bp, Mus musculus
ccagtagcaccctttacagacttaa

SEQ ID NO: 340878 - DNA, 25 bp, Mus musculus
ccagtagtagtccttcagctcagtt

SEQ ID NO: 340879 - DNA, 25 bp, Mus musculus
ccagtagtagtcgttcagctcagtt

SEQ ID NO: 340880 - DNA, 25 bp, Mus musculus
ccagtagtcaccacctgagagaggg

SEQ ID NO: 340881 - DNA, 25 bp, Mus musculus
ccagtagtcacctcctgagagaggg

SEQ ID NO: 340882 - DNA, 25 bp, Mus musculus
ccagtagttcatatcgataaaaact

SEQ ID NO: 340883 - DNA, 25 bp, Mus musculus
ccagtagttcatttcgataaaaact

SEQ ID NO: 340884 - DNA, 25 bp, Mus musculus
ccagtagttttaccctaggcttctg

SEQ ID NO: 340885 - DNA, 25 bp, Mus musculus
ccagtagttttagcctaggcttctg

SEQ ID NO: 340886 - DNA, 25 bp, Mus musculus
ccagtatataacctgctatcttggg

SEQ ID NO: 340887 - DNA, 25 bp, Mus musculus
ccagtatataacgtgctatcttggg

SEQ ID NO: 340888 - DNA, 25 bp, Mus musculus
ccagtatcaatcactcaggccaaac

SEQ ID NO: 340889 - DNA, 25 bp, Mus musculus
ccagtatcaatctctcaggccaaac

SEQ ID NO: 340890 - DNA, 25 bp, Mus musculus
ccagtatcagtaataaacttaccct

SEQ ID NO: 340891 - DNA, 25 bp, Mus musculus
ccagtatcagtattaaacttaccct

SEQ ID NO: 340892 - DNA, 25 bp, Mus musculus
ccagtatccagcaggcagccggagg

SEQ ID NO: 340893 - DNA, 25 bp, Mus musculus
ccagtatccagctggcagccggagg

SEQ ID NO: 340894 - DNA, 25 bp, Mus musculus
ccagtatcccttcggtgtcacctgt

SEQ ID NO: 340895 - DNA, 25 bp, Mus musculus
ccagtatcccttgggtgtcacctgt

SEQ ID NO: 340896 - DNA, 25 bp, Mus musculus
ccagtatcctctattcgcagttaaa

SEQ ID NO: 340897 - DNA, 25 bp, Mus musculus
ccagtatcctcttttcgcagttaaa

SEQ ID NO: 340898 - DNA, 25 bp, Mus musculus
ccagtatctcatctgccaaagcctt

SEQ ID NO: 340899 - DNA, 25 bp, Mus musculus
ccagtatctcatgtgccaaagcctt

SEQ ID NO: 340900 - DNA, 25 bp, Mus musculus
ccagtatggtacaagcctacatgat

SEQ ID NO: 340901 - DNA, 25 bp, Mus musculus
ccagtatggtactagcctacatgat

SEQ ID NO: 340902 - DNA, 25 bp, Mus musculus
ccagtatgttccagactggcctgga

SEQ ID NO: 340903 - DNA, 25 bp, Mus musculus
ccagtatgttcctgactggcctgga

SEQ ID NO: 340904 - DNA, 25 bp, Mus musculus
ccagtattacccctgtgtgtgctac

SEQ ID NO: 340905 - DNA, 25 bp, Mus musculus
ccagtattacccgtgtgtgtgctac

SEQ ID NO: 340906 - DNA, 25 bp, Mus musculus
ccagtattccttcattgggatctgt

SEQ ID NO: 340907 - DNA, 25 bp, Mus musculus
ccagtattccttgattgggatctgt

SEQ ID NO: 340908 - DNA, 25 bp, Mus musculus
ccagtattctgtcaacaagttccag

SEQ ID NO: 340909 - DNA, 25 bp, Mus musculus
ccagtattctgtgaacaagttccag

SEQ ID NO: 340910 - DNA, 25 bp, Mus musculus
ccagtattttcaactatgccaggcc

SEQ ID NO: 340911 - DNA, 25 bp, Mus musculus
ccagtattttcatctatgccaggcc

SEQ ID NO: 340912 - DNA, 25 bp, Mus musculus
ccagtattttgtcaaccagcggaaa

SEQ ID NO: 340913 - DNA, 25 bp, Mus musculus
ccagtattttgtgaaccagcggaaa

SEQ ID NO: 340914 - DNA, 25 bp, Mus musculus
ccagtcacagacacatccatacata

SEQ ID NO: 340915 - DNA, 25 bp, Mus musculus
ccagtcacagactcatccatacata

SEQ ID NO: 340916 - DNA, 25 bp, Mus musculus
ccagtcacaggtacgagccttgaga

SEQ ID NO: 340917 - DNA, 25 bp, Mus musculus
ccagtcacaggttcgagccttgaga

SEQ ID NO: 340918 - DNA, 25 bp, Mus musculus
ccagtcaccaaaaccagacactatt

SEQ ID NO: 340919 - DNA, 25 bp, Mus musculus
ccagtcaccaaatccagacactatt

SEQ ID NO: 340920 - DNA, 25 bp, Mus musculus
ccagtcacttaacatctgcctattt

SEQ ID NO: 340921 - DNA, 25 bp, Mus musculus
ccagtcacttaagatctgcctattt

SEQ ID NO: 340922 - DNA, 25 bp, Mus musculus
ccagtcagagcacacaaggtcttga

SEQ ID NO: 340923 - DNA, 25 bp, Mus musculus
ccagtcagagcagacaaggtcttga

SEQ ID NO: 340924 - DNA, 25 bp, Mus musculus
ccagtcagatgcatacgagcgtatt

SEQ ID NO: 340925 - DNA, 25 bp, Mus musculus
ccagtcagatgcttacgagcgtatt

SEQ ID NO: 340926 - DNA, 25 bp, Mus musculus
ccagtcagccttccatgagatgggt

SEQ ID NO: 340927 - DNA, 25 bp, Mus musculus
ccagtcagccttgcatgagatgggt

SEQ ID NO: 340928 - DNA, 25 bp, Mus musculus
ccagtcaggcttcaatgtgtctgtc

SEQ ID NO: 340929 - DNA, 25 bp, Mus musculus
ccagtcaggcttgaatgtgtctgtc

SEQ ID NO: 340930 - DNA, 25 bp, Mus musculus
ccagtcagtagtagtgttccctcat

SEQ ID NO: 340931 - DNA, 25 bp, Mus musculus
ccagtcagtagttgtgttccctcat

SEQ ID NO: 340932 - DNA, 25 bp, Mus musculus
ccagtcagtctgcacaggcatgcaa

SEQ ID NO: 340933 - DNA, 25 bp, Mus musculus
ccagtcagtctggacaggcatgcaa

SEQ ID NO: 340934 - DNA, 25 bp, Mus musculus
ccagtcatctgaagattgccgtata

SEQ ID NO: 340935 - DNA, 25 bp, Mus musculus
ccagtcatctgatgattgccgtata

SEQ ID NO: 340936 - DNA, 25 bp, Mus musculus
ccagtcatctgtcgtttgctagcga

SEQ ID NO: 340937 - DNA, 25 bp, Mus musculus
ccagtcatctgtggtttgctagcga

SEQ ID NO: 340938 - DNA, 25 bp, Mus musculus
ccagtcatgacgagcaagtgtgaac

SEQ ID NO: 340939 - DNA, 25 bp, Mus musculus
ccagtcatgacgtgcaagtgtgaac

SEQ ID NO: 340940 - DNA, 25 bp, Mus musculus
ccagtcatttacactaattcttaag

SEQ ID NO: 340941 - DNA, 25 bp, Mus musculus
ccagtcatttactctaattcttaag

SEQ ID NO: 340942 - DNA, 25 bp, Mus musculus
ccagtcatttctaggcttgcgtctt

SEQ ID NO: 340943 - DNA, 25 bp, Mus musculus
ccagtcatttcttggcttgcgtctt

SEQ ID NO: 340944 - DNA, 25 bp, Mus musculus
ccagtccaagccatacagccatgaa

SEQ ID NO: 340945 - DNA, 25 bp, Mus musculus
ccagtccaagcccagcagagattaa

SEQ ID NO: 340946 - DNA, 25 bp, Mus musculus
ccagtccaagccgagcagagattaa

SEQ ID NO: 340947 - DNA, 25 bp, Mus musculus
ccagtccaagccttacagccatgaa

SEQ ID NO: 340948 - DNA, 25 bp, Mus musculus
ccagtccaccacataactattctaa

SEQ ID NO: 340949 - DNA, 25 bp, Mus musculus
ccagtccaccacttaactattctaa

SEQ ID NO: 340950 - DNA, 25 bp, Mus musculus
ccagtccaggctcaggtctatgtga

SEQ ID NO: 340951 - DNA, 25 bp, Mus musculus
ccagtccaggctgaggtctatgtga

SEQ ID NO: 340952 - DNA, 25 bp, Mus musculus
ccagtccatcgtcagcggatgtcag

SEQ ID NO: 340953 - DNA, 25 bp, Mus musculus
ccagtccatcgtgagcggatgtcag

SEQ ID NO: 340954 - DNA, 25 bp, Mus musculus
ccagtccccaaacaccagtaataat

SEQ ID NO: 340955 - DNA, 25 bp, Mus musculus
ccagtccccaaagaccagtaataat

SEQ ID NO: 340956 - DNA, 25 bp, Mus musculus
ccagtccctctcattgatagtgcaa

SEQ ID NO: 340957 - DNA, 25 bp, Mus musculus
ccagtccctctctttgatagtgcaa

SEQ ID NO: 340958 - DNA, 25 bp, Mus musculus
ccagtccgtgagattgtcatttcaa

SEQ ID NO: 340959 - DNA, 25 bp, Mus musculus
ccagtccgtgagtttgtcatttcaa

SEQ ID NO: 340960 - DNA, 25 bp, Mus musculus
ccagtcctaactcagtgcacagtga

SEQ ID NO: 340961 - DNA, 25 bp, Mus musculus
ccagtcctaactgagtgcacagtga

SEQ ID NO: 340962 - DNA, 25 bp, Mus musculus
ccagtcctaccaaatatactcttca

SEQ ID NO: 340963 - DNA, 25 bp, Mus musculus
ccagtcctaccatatatactcttca

SEQ ID NO: 340964 - DNA, 25 bp, Mus musculus
ccagtcctagtacatctgatgccct

SEQ ID NO: 340965 - DNA, 25 bp, Mus musculus
ccagtcctagtagatctgatgccct

SEQ ID NO: 340966 - DNA, 25 bp, Mus musculus
ccagtcctgacaaatgggattgcat

SEQ ID NO: 340967 - DNA, 25 bp, Mus musculus
ccagtcctgacatatgggattgcat

SEQ ID NO: 340968 - DNA, 25 bp, Mus musculus
ccagtcctgcaaatggcacatgaat

SEQ ID NO: 340969 - DNA, 25 bp, Mus musculus
ccagtcctgcaattggcacatgaat

SEQ ID NO: 340970 - DNA, 25 bp, Mus musculus
ccagtcctgcgtatcagggacatgg

SEQ ID NO: 340971 - DNA, 25 bp, Mus musculus
ccagtcctgcgtttcagggacatgg

SEQ ID NO: 340972 - DNA, 25 bp, Mus musculus
ccagtcctgtctaatgtcttatttt

SEQ ID NO: 340973 - DNA, 25 bp, Mus musculus
ccagtcctgtcttatgtcttatttt

SEQ ID NO: 340974 - DNA, 25 bp, Mus musculus
ccagtccttcttcgcacagcaaaga

SEQ ID NO: 340975 - DNA, 25 bp, Mus musculus
ccagtccttcttggcacagcaaaga

SEQ ID NO: 340976 - DNA, 25 bp, Mus musculus
ccagtccttgctcggaggagtgccc

SEQ ID NO: 340977 - DNA, 25 bp, Mus musculus
ccagtccttgctgggaggagtgccc

SEQ ID NO: 340978 - DNA, 25 bp, Mus musculus
ccagtcggcctgctctttaagtggg

SEQ ID NO: 340979 - DNA, 25 bp, Mus musculus
ccagtcggcctggtctttaagtggg

SEQ ID NO: 340980 - DNA, 25 bp, Mus musculus
ccagtctagcctcgtgttgtattta

SEQ ID NO: 340981 - DNA, 25 bp, Mus musculus
ccagtctagcctggtgttgtattta

SEQ ID NO: 340982 - DNA, 25 bp, Mus musculus
ccagtctatccacatgttacctagg

SEQ ID NO: 340983 - DNA, 25 bp, Mus musculus
ccagtctatccagatgttacctagg

SEQ ID NO: 340984 - DNA, 25 bp, Mus musculus
ccagtctcaaaaccctgagttccat

SEQ ID NO: 340985 - DNA, 25 bp, Mus musculus
ccagtctcaaaagcctgagttccat

SEQ ID NO: 340986 - DNA, 25 bp, Mus musculus
ccagtctcaattcaccacttaactt

SEQ ID NO: 340987 - DNA, 25 bp, Mus musculus
ccagtctcaattgaccacttaactt

SEQ ID NO: 340988 - DNA, 25 bp, Mus musculus
ccagtctcaggtcaccttcaattga

SEQ ID NO: 340989 - DNA, 25 bp, Mus musculus
ccagtctcaggtgaccttcaattga

SEQ ID NO: 340990 - DNA, 25 bp, Mus musculus
ccagtctccagaactcagaattatt

SEQ ID NO: 340991 - DNA, 25 bp, Mus musculus
ccagtctccagatctcagaattatt

SEQ ID NO: 340992 - DNA, 25 bp, Mus musculus
ccagtctcccagatatgcagtccta

SEQ ID NO: 340993 - DNA, 25 bp, Mus musculus
ccagtctcccagttatgcagtccta

SEQ ID NO: 340994 - DNA, 25 bp, Mus musculus
ccagtctccgtcagctccaattgga

SEQ ID NO: 340995 - DNA, 25 bp, Mus musculus
ccagtctccgtctgctccaattgga

SEQ ID NO: 340996 - DNA, 25 bp, Mus musculus
ccagtctctcagatagggtcaggta

SEQ ID NO: 340997 - DNA, 25 bp, Mus musculus
ccagtctctcagttagggtcaggta

SEQ ID NO: 340998 - DNA, 25 bp, Mus musculus
ccagtctctgagctgtgcgtttgta

SEQ ID NO: 340999 - DNA, 25 bp, Mus musculus
ccagtctctgaggtgtgcgtttgta

SEQ ID NO: 341000 - DNA, 25 bp, Mus musculus
ccagtctgaactacatcgtttgttt

SEQ ID NO: 341001 - DNA, 25 bp, Mus musculus
ccagtctgaacttcatcgtttgttt

SEQ ID NO: 341002 - DNA, 25 bp, Mus musculus
ccagtctgaggcctgtgtagtcaca

SEQ ID NO: 341003 - DNA, 25 bp, Mus musculus
ccagtctgaggcgtgtgtagtcaca

SEQ ID NO: 341004 - DNA, 25 bp, Mus musculus
ccagtctgccttcccttgtggagga

SEQ ID NO: 341005 - DNA, 25 bp, Mus musculus
ccagtctgccttgccttgtggagga

SEQ ID NO: 341006 - DNA, 25 bp, Mus musculus
ccagtctgcgtcaccatgaagaaac

SEQ ID NO: 341007 - DNA, 25 bp, Mus musculus
ccagtctgcgtctccatgaagaaac

SEQ ID NO: 341008 - DNA, 25 bp, Mus musculus
ccagtctggcctagaactttgaatc

SEQ ID NO: 341009 - DNA, 25 bp, Mus musculus
ccagtctggccttgaactttgaatc

SEQ ID NO: 341010 - DNA, 25 bp, Mus musculus
ccagtctgtatgaccgtagagtcca

SEQ ID NO: 341011 - DNA, 25 bp, Mus musculus
ccagtctgtatgtccgtagagtcca

SEQ ID NO: 341012 - DNA, 25 bp, Mus musculus
ccagtctgtgctcacttgggaggat

SEQ ID NO: 341013 - DNA, 25 bp, Mus musculus
ccagtctgtgctgacttgggaggat

SEQ ID NO: 341014 - DNA, 25 bp, Mus musculus
ccagtcttaatgacactaaagcaga

SEQ ID NO: 341015 - DNA, 25 bp, Mus musculus
ccagtcttaatgtcactaaagcaga

SEQ ID NO: 341016 - DNA, 25 bp, Mus musculus
ccagtcttacatcgcactttcagtt

SEQ ID NO: 341017 - DNA, 25 bp, Mus musculus
ccagtcttacatggcactttcagtt

SEQ ID NO: 341018 - DNA, 25 bp, Mus musculus
ccagtcttcatcactgatggagttt

SEQ ID NO: 341019 - DNA, 25 bp, Mus musculus
ccagtcttcatctctgatggagttt

SEQ ID NO: 341020 - DNA, 25 bp, Mus musculus
ccagtctttacaccggttctcagtt

SEQ ID NO: 341021 - DNA, 25 bp, Mus musculus
ccagtctttacagcggttctcagtt

SEQ ID NO: 341022 - DNA, 25 bp, Mus musculus
ccagtctttgctcctgtttgcaatt

SEQ ID NO: 341023 - DNA, 25 bp, Mus musculus
ccagtctttgctgctgtttgcaatt

SEQ ID NO: 341024 - DNA, 25 bp, Mus musculus
ccagtcttttggcaacacaggactt

SEQ ID NO: 341025 - DNA, 25 bp, Mus musculus
ccagtcttttgggaacacaggactt

SEQ ID NO: 341026 - DNA, 25 bp, Mus musculus
ccagtgaaccaccattgagggcgtt

SEQ ID NO: 341027 - DNA, 25 bp, Mus musculus
ccagtgaaccacgattgagggcgtt

SEQ ID NO: 341028 - DNA, 25 bp, Mus musculus
ccagtgaattctcttttggagttct

SEQ ID NO: 341029 - DNA, 25 bp, Mus musculus
ccagtgaattctgttttggagttct

SEQ ID NO: 341030 - DNA, 25 bp, Mus musculus
ccagtgaccaagcagaaaagttcct

SEQ ID NO: 341031 - DNA, 25 bp, Mus musculus
ccagtgaccaaggagaaaagttcct

SEQ ID NO: 341032 - DNA, 25 bp, Mus musculus
ccagtgactataatattgaacagaa

SEQ ID NO: 341033 - DNA, 25 bp, Mus musculus
ccagtgactatattattgaacagaa

SEQ ID NO: 341034 - DNA, 25 bp, Mus musculus
ccagtgactctacctttgttctaga

SEQ ID NO: 341035 - DNA, 25 bp, Mus musculus
ccagtgactctagctttgttctaga

SEQ ID NO: 341036 - DNA, 25 bp, Mus musculus
ccagtgactgtgcttgtcgcaatta

SEQ ID NO: 341037 - DNA, 25 bp, Mus musculus
ccagtgactgtggttgtcgcaatta

SEQ ID NO: 341038 - DNA, 25 bp, Mus musculus
ccagtgagcggccttgggaaacatc

SEQ ID NO: 341039 - DNA, 25 bp, Mus musculus
ccagtgagcggcgttgggaaacatc

SEQ ID NO: 341040 - DNA, 25 bp, Mus musculus
ccagtgagctgccacctgctgctac

SEQ ID NO: 341041 - DNA, 25 bp, Mus musculus
ccagtgagctgcgacctgctgctac

SEQ ID NO: 341042 - DNA, 25 bp, Mus musculus
ccagtgaggctcagaggcctggcta

SEQ ID NO: 341043 - DNA, 25 bp, Mus musculus
ccagtgaggctctgaggcctggcta

SEQ ID NO: 341044 - DNA, 25 bp, Mus musculus
ccagtgagtaaccatcattgtttta

SEQ ID NO: 341045 - DNA, 25 bp, Mus musculus
ccagtgagtaacgatcattgtttta

SEQ ID NO: 341046 - DNA, 25 bp, Mus musculus
ccagtgagtgtaaagcgccgctatt

SEQ ID NO: 341047 - DNA, 25 bp, Mus musculus
ccagtgagtgtatagcgccgctatt

SEQ ID NO: 341048 - DNA, 25 bp, Mus musculus
ccagtgatctcactaggtaagacat

SEQ ID NO: 341049 - DNA, 25 bp, Mus musculus
ccagtgatctcagtaggtaagacat

SEQ ID NO: 341050 - DNA, 25 bp, Mus musculus
ccagtgatgctacgcctaattgttc

SEQ ID NO: 341051 - DNA, 25 bp, Mus musculus
ccagtgatgctaggcctaattgttc

SEQ ID NO: 341052 - DNA, 25 bp, Mus musculus
ccagtgatggaactgacacctgagc

SEQ ID NO: 341053 - DNA, 25 bp, Mus musculus
ccagtgatggaagtgacacctgagc

SEQ ID NO: 341054 - DNA, 25 bp, Mus musculus
ccagtgcaacaccagaacctgaggc

SEQ ID NO: 341055 - DNA, 25 bp, Mus musculus
ccagtgcaacacgagaacctgaggc

SEQ ID NO: 341056 - DNA, 25 bp, Mus musculus
ccagtgcagccccatttaaattaaa

SEQ ID NO: 341057 - DNA, 25 bp, Mus musculus
ccagtgcagcccgatttaaattaaa

SEQ ID NO: 341058 - DNA, 25 bp, Mus musculus
ccagtgcaggttcatgccttcatta

SEQ ID NO: 341059 - DNA, 25 bp, Mus musculus
ccagtgcaggttgatgccttcatta

SEQ ID NO: 341060 - DNA, 25 bp, Mus musculus
ccagtgcagttcaggccaaggccaa

SEQ ID NO: 341061 - DNA, 25 bp, Mus musculus
ccagtgcagttctggccaaggccaa

SEQ ID NO: 341062 - DNA, 25 bp, Mus musculus
ccagtgcatcctcataaacatacct

SEQ ID NO: 341063 - DNA, 25 bp, Mus musculus
ccagtgcatcctgataaacatacct

SEQ ID NO: 341064 - DNA, 25 bp, Mus musculus
ccagtgccacgtattgtcattgtga

SEQ ID NO: 341065 - DNA, 25 bp, Mus musculus
ccagtgccacgttttgtcattgtga

SEQ ID NO: 341066 - DNA, 25 bp, Mus musculus
ccagtgccactgacaaaagagccaa

SEQ ID NO: 341067 - DNA, 25 bp, Mus musculus
ccagtgccactgtcaaaagagccaa

SEQ ID NO: 341068 - DNA, 25 bp, Mus musculus
ccagtgccagggagtatataagcat

SEQ ID NO: 341069 - DNA, 25 bp, Mus musculus
ccagtgccagggtgtatataagcat

SEQ ID NO: 341070 - DNA, 25 bp, Mus musculus
ccagtgccagttcaacctttaggga

SEQ ID NO: 341071 - DNA, 25 bp, Mus musculus
ccagtgccagttgaacctttaggga

SEQ ID NO: 341072 - DNA, 25 bp, Mus musculus
ccagtgcccttcatcgttttctaca

SEQ ID NO: 341073 - DNA, 25 bp, Mus musculus
ccagtgcccttcttcgttttctaca

SEQ ID NO: 341074 - DNA, 25 bp, Mus musculus
ccagtgcctgatcagggcttgatta

SEQ ID NO: 341075 - DNA, 25 bp, Mus musculus
ccagtgcctgatgagggcttgatta

SEQ ID NO: 341076 - DNA, 25 bp, Mus musculus
ccagtgcctggaagggcctgcagct

SEQ ID NO: 341077 - DNA, 25 bp, Mus musculus
ccagtgcctggatgggcctgcagct

SEQ ID NO: 341078 - DNA, 25 bp, Mus musculus
ccagtgcgagtacggacatcaggct

SEQ ID NO: 341079 - DNA, 25 bp, Mus musculus
ccagtgcgagtagggacatcaggct

SEQ ID NO: 341080 - DNA, 25 bp, Mus musculus
ccagtgcggaccagtggagatccga

SEQ ID NO: 341081 - DNA, 25 bp, Mus musculus
ccagtgcggacctgtggagatccga

SEQ ID NO: 341082 - DNA, 25 bp, Mus musculus
ccagtgcggccgacgctttgaaaag

SEQ ID NO: 341083 - DNA, 25 bp, Mus musculus
ccagtgcggccgtcgctttgaaaag

SEQ ID NO: 341084 - DNA, 25 bp, Mus musculus
ccagtgctaggtctctcttgagtga

SEQ ID NO: 341085 - DNA, 25 bp, Mus musculus
ccagtgctaggtgtctcttgagtga

SEQ ID NO: 341086 - DNA, 25 bp, Mus musculus
ccagtgctatttcatctttattcaa

SEQ ID NO: 341087 - DNA, 25 bp, Mus musculus
ccagtgctatttgatctttattcaa

SEQ ID NO: 341088 - DNA, 25 bp, Mus musculus
ccagtgctcagcctttgcccttggg

SEQ ID NO: 341089 - DNA, 25 bp, Mus musculus
ccagtgctcagcgtttgcccttggg

SEQ ID NO: 341090 - DNA, 25 bp, Mus musculus
ccagtgctctcaaggagtcctgaag

SEQ ID NO: 341091 - DNA, 25 bp, Mus musculus
ccagtgctctcatggagtcctgaag

SEQ ID NO: 341092 - DNA, 25 bp, Mus musculus
ccagtgctggtgaaggctacctttt

SEQ ID NO: 341093 - DNA, 25 bp, Mus musculus
ccagtgctggtgagaggttctagaa

SEQ ID NO: 341094 - DNA, 25 bp, Mus musculus
ccagtgctggtgtaggctacctttt

SEQ ID NO: 341095 - DNA, 25 bp, Mus musculus
ccagtgctggtgtgaggttctagaa

SEQ ID NO: 341096 - DNA, 25 bp, Mus musculus
ccagtggaacatacgggccttcatg

SEQ ID NO: 341097 - DNA, 25 bp, Mus musculus
ccagtggaacattcgggccttcatg

SEQ ID NO: 341098 - DNA, 25 bp, Mus musculus
ccagtggacatgcatgttgacctgt

SEQ ID NO: 341099 - DNA, 25 bp, Mus musculus
ccagtggacatggatgttgacctgt

SEQ ID NO: 341100 - DNA, 25 bp, Mus musculus
ccagtggacgccagttgtggtgatt

SEQ ID NO: 341101 - DNA, 25 bp, Mus musculus
ccagtggacgcctgttgtggtgatt

SEQ ID NO: 341102 - DNA, 25 bp, Mus musculus
ccagtggagagcagccggttcagat

SEQ ID NO: 341103 - DNA, 25 bp, Mus musculus
ccagtggagagctgccggttcagat

SEQ ID NO: 341104 - DNA, 25 bp, Mus musculus
ccagtggcagtgagcactcagctca

SEQ ID NO: 341105 - DNA, 25 bp, Mus musculus
ccagtggcagtgtgcactcagctca

SEQ ID NO: 341106 - DNA, 25 bp, Mus musculus
ccagtggccaagcacattaattttt

SEQ ID NO: 341107 - DNA, 25 bp, Mus musculus
ccagtggccaaggacattaattttt

SEQ ID NO: 341108 - DNA, 25 bp, Mus musculus
ccagtggctgttcatgcattctttg

SEQ ID NO: 341109 - DNA, 25 bp, Mus musculus
ccagtggctgttgatgcattctttg

SEQ ID NO: 341110 - DNA, 25 bp, Mus musculus
ccagtggcttatcccagggcaaatg

SEQ ID NO: 341111 - DNA, 25 bp, Mus musculus
ccagtggcttatgccagggcaaatg

SEQ ID NO: 341112 - DNA, 25 bp, Mus musculus
ccagtggctttgagtaggatctttg

SEQ ID NO: 341113 - DNA, 25 bp, Mus musculus
ccagtggctttgtgtaggatctttg

SEQ ID NO: 341114 - DNA, 25 bp, Mus musculus
ccagtgggtctgcttctgtgacaat

SEQ ID NO: 341115 - DNA, 25 bp, Mus musculus
ccagtgggtctggttctgtgacaat

SEQ ID NO: 341116 - DNA, 25 bp, Mus musculus
ccagtggtcccaagttcagggacca

SEQ ID NO: 341117 - DNA, 25 bp, Mus musculus
ccagtggtcccatgttcagggacca

SEQ ID NO: 341118 - DNA, 25 bp, Mus musculus
ccagtggtcggtaccatcatgtata

SEQ ID NO: 341119 - DNA, 25 bp, Mus musculus
ccagtggtcggttccatcatgtata

SEQ ID NO: 341120 - DNA, 25 bp, Mus musculus
ccagtggtgactcagatgtttacag

SEQ ID NO: 341121 - DNA, 25 bp, Mus musculus
ccagtggtgactgagatgtttacag

SEQ ID NO: 341122 - DNA, 25 bp, Mus musculus
ccagtggtgtggatagctttgctac

SEQ ID NO: 341123 - DNA, 25 bp, Mus musculus
ccagtggtgtggttagctttgctac

SEQ ID NO: 341124 - DNA, 25 bp, Mus musculus
ccagtggttagcatcccacttcaat

SEQ ID NO: 341125 - DNA, 25 bp, Mus musculus
ccagtggttagcttcccacttcaat

SEQ ID NO: 341126 - DNA, 25 bp, Mus musculus
ccagtggttctcaggaggttctgga

SEQ ID NO: 341127 - DNA, 25 bp, Mus musculus
ccagtggttctctggaggttctgga

SEQ ID NO: 341128 - DNA, 25 bp, Mus musculus
ccagtggttcttctggatttctgat

SEQ ID NO: 341129 - DNA, 25 bp, Mus musculus
ccagtggttcttgtggatttctgat

SEQ ID NO: 341130 - DNA, 25 bp, Mus musculus
ccagtggttgatcgagaactctaca

SEQ ID NO: 341131 - DNA, 25 bp, Mus musculus
ccagtggttgatggagaactctaca

SEQ ID NO: 341132 - DNA, 25 bp, Mus musculus
ccagtgtaaccaaaagcctgcttag

SEQ ID NO: 341133 - DNA, 25 bp, Mus musculus
ccagtgtaaccataagcctgcttag

SEQ ID NO: 341134 - DNA, 25 bp, Mus musculus
ccagtgtaagccactgatttccaca

SEQ ID NO: 341135 - DNA, 25 bp, Mus musculus
ccagtgtaagcctctgatttccaca

SEQ ID NO: 341136 - DNA, 25 bp, Mus musculus
ccagtgtaccagaccttgttagaac

SEQ ID NO: 341137 - DNA, 25 bp, Mus musculus
ccagtgtaccagtccttgttagaac

SEQ ID NO: 341138 - DNA, 25 bp, Mus musculus
ccagtgtagcataactcgggtgatg

SEQ ID NO: 341139 - DNA, 25 bp, Mus musculus
ccagtgtagcattactcgggtgatg

SEQ ID NO: 341140 - DNA, 25 bp, Mus musculus
ccagtgtagtagacccgcattcaga

SEQ ID NO: 341141 - DNA, 25 bp, Mus musculus
ccagtgtagtagtcccgcattcaga

SEQ ID NO: 341142 - DNA, 25 bp, Mus musculus
ccagtgtataaaccctccacgggat

SEQ ID NO: 341143 - DNA, 25 bp, Mus musculus
ccagtgtataaagcctccacgggat

SEQ ID NO: 341144 - DNA, 25 bp, Mus musculus
ccagtgtatgagcaattctcttctg

SEQ ID NO: 341145 - DNA, 25 bp, Mus musculus
ccagtgtatgaggaattctcttctg

SEQ ID NO: 341146 - DNA, 25 bp, Mus musculus
ccagtgtcatggatgtgtcaaggac

SEQ ID NO: 341147 - DNA, 25 bp, Mus musculus
ccagtgtcatggttgtgtcaaggac

SEQ ID NO: 341148 - DNA, 25 bp, Mus musculus
ccagtgtccagtagtgatatcacag

SEQ ID NO: 341149 - DNA, 25 bp, Mus musculus
ccagtgtccagttgtgatatcacag

SEQ ID NO: 341150 - DNA, 25 bp, Mus musculus
ccagtgtccccgagtgggagaaatt

SEQ ID NO: 341151 - DNA, 25 bp, Mus musculus
ccagtgtccccgtgtgggagaaatt

SEQ ID NO: 341152 - DNA, 25 bp, Mus musculus
ccagtgtctgaaactcatctcacta

SEQ ID NO: 341153 - DNA, 25 bp, Mus musculus
ccagtgtctgaatctcatctcacta

SEQ ID NO: 341154 - DNA, 25 bp, Mus musculus
ccagtgtctgtcacttaccttaatt

SEQ ID NO: 341155 - DNA, 25 bp, Mus musculus
ccagtgtctgtctcttaccttaatt

SEQ ID NO: 341156 - DNA, 25 bp, Mus musculus
ccagtgtgactcagtgatgcaggtt

SEQ ID NO: 341157 - DNA, 25 bp, Mus musculus
ccagtgtgactctgtgatgcaggtt

SEQ ID NO: 341158 - DNA, 25 bp, Mus musculus
ccagtgtgagatagaagaacttggt

SEQ ID NO: 341159 - DNA, 25 bp, Mus musculus
ccagtgtgagattgaagaacttggt

SEQ ID NO: 341160 - DNA, 25 bp, Mus musculus
ccagtgtgaggcattaaggctaata

SEQ ID NO: 341161 - DNA, 25 bp, Mus musculus
ccagtgtgaggctttaaggctaata

SEQ ID NO: 341162 - DNA, 25 bp, Mus musculus
ccagtgtgcagaacgaccagtcagt

SEQ ID NO: 341163 - DNA, 25 bp, Mus musculus
ccagtgtgcagatcgaccagtcagt

SEQ ID NO: 341164 - DNA, 25 bp, Mus musculus
ccagtgtggaatcgagtctccatgt

SEQ ID NO: 341165 - DNA, 25 bp, Mus musculus
ccagtgtggaatggagtctccatgt

SEQ ID NO: 341166 - DNA, 25 bp, Mus musculus
ccagtgtgggtacggctcatgcttc

SEQ ID NO: 341167 - DNA, 25 bp, Mus musculus
ccagtgtgggtagggctcatgcttc

SEQ ID NO: 341168 - DNA, 25 bp, Mus musculus
ccagtgtgggttcatcaagcccctg

SEQ ID NO: 341169 - DNA, 25 bp, Mus musculus
ccagtgtgggttgatcaagcccctg

SEQ ID NO: 341170 - DNA, 25 bp, Mus musculus
ccagtgtggtttaggaaagaactct

SEQ ID NO: 341171 - DNA, 25 bp, Mus musculus
ccagtgtggttttggaaagaactct

SEQ ID NO: 341172 - DNA, 25 bp, Mus musculus
ccagtgtgtccgatgtggatatgat

SEQ ID NO: 341173 - DNA, 25 bp, Mus musculus
ccagtgtgtccgttgtggatatgat

SEQ ID NO: 341174 - DNA, 25 bp, Mus musculus
ccagtgtgtctgactttgaggcacc

SEQ ID NO: 341175 - DNA, 25 bp, Mus musculus
ccagtgtgtctgtctttgaggcacc

SEQ ID NO: 341176 - DNA, 25 bp, Mus musculus
ccagtgtgtgaacctataaaaataa

SEQ ID NO: 341177 - DNA, 25 bp, Mus musculus
ccagtgtgtgaagctataaaaataa

SEQ ID NO: 341178 - DNA, 25 bp, Mus musculus
ccagtgttactgaggaagggttcgt

SEQ ID NO: 341179 - DNA, 25 bp, Mus musculus
ccagtgttactgtggaagggttcgt

SEQ ID NO: 341180 - DNA, 25 bp, Mus musculus
ccagtgttagtcattcttcattgtg

SEQ ID NO: 341181 - DNA, 25 bp, Mus musculus
ccagtgttagtctttcttcattgtg

SEQ ID NO: 341182 - DNA, 25 bp, Mus musculus
ccagtgttatggcaccatcatctgt

SEQ ID NO: 341183 - DNA, 25 bp, Mus musculus
ccagtgttatgggaccatcatctgt

SEQ ID NO: 341184 - DNA, 25 bp, Mus musculus
ccagtgttcacacgccctgacatat

SEQ ID NO: 341185 - DNA, 25 bp, Mus musculus
ccagtgttcacaggccctgacatat

SEQ ID NO: 341186 - DNA, 25 bp, Mus musculus
ccagtgttccatcgctttagctgaa

SEQ ID NO: 341187 - DNA, 25 bp, Mus musculus
ccagtgttccatggctttagctgaa

SEQ ID NO: 341188 - DNA, 25 bp, Mus musculus
ccagtgttccttagatactgaaatc

SEQ ID NO: 341189 - DNA, 25 bp, Mus musculus
ccagtgttcctttgatactgaaatc

SEQ ID NO: 341190 - DNA, 25 bp, Mus musculus
ccagtgttgcatacctcaaacgtag

SEQ ID NO: 341191 - DNA, 25 bp, Mus musculus
ccagtgttgcattcctcaaacgtag

SEQ ID NO: 341192 - DNA, 25 bp, Mus musculus
ccagtgttgcttctcttcgtgtaaa

SEQ ID NO: 341193 - DNA, 25 bp, Mus musculus
ccagtgttgcttgtcttcgtgtaaa

SEQ ID NO: 341194 - DNA, 25 bp, Mus musculus
ccagtgttgggcaactgtaaacttt

SEQ ID NO: 341195 - DNA, 25 bp, Mus musculus
ccagtgttgggcagtatccatgtta

SEQ ID NO: 341196 - DNA, 25 bp, Mus musculus
ccagtgttgggctactgtaaacttt

SEQ ID NO: 341197 - DNA, 25 bp, Mus musculus
ccagtgttgggctgtatccatgtta

SEQ ID NO: 341198 - DNA, 25 bp, Mus musculus
ccagtgtttacacatcctttggatg

SEQ ID NO: 341199 - DNA, 25 bp, Mus musculus
ccagtgtttacagatcctttggatg

SEQ ID NO: 341200 - DNA, 25 bp, Mus musculus
ccagtgtttgcgaccatcagtgtag

SEQ ID NO: 341201 - DNA, 25 bp, Mus musculus
ccagtgtttgcgtccatcagtgtag

SEQ ID NO: 341202 - DNA, 25 bp, Mus musculus
ccagttaaagtgctcaacaggaaat

SEQ ID NO: 341203 - DNA, 25 bp, Mus musculus
ccagttaaagtggtcaacaggaaat

SEQ ID NO: 341204 - DNA, 25 bp, Mus musculus
ccagttaatgaacctcctcttgcta

SEQ ID NO: 341205 - DNA, 25 bp, Mus musculus
ccagttaatgaagctcctcttgcta

SEQ ID NO: 341206 - DNA, 25 bp, Mus musculus
ccagttaccttgatgggactgtctt

SEQ ID NO: 341207 - DNA, 25 bp, Mus musculus
ccagttaccttgttgggactgtctt

SEQ ID NO: 341208 - DNA, 25 bp, Mus musculus
ccagttactactcttagagtgttgt

SEQ ID NO: 341209 - DNA, 25 bp, Mus musculus
ccagttactactgttagagtgttgt

SEQ ID NO: 341210 - DNA, 25 bp, Mus musculus
ccagttaggactcattaaaatttca

SEQ ID NO: 341211 - DNA, 25 bp, Mus musculus
ccagttaggactgattaaaatttca

SEQ ID NO: 341212 - DNA, 25 bp, Mus musculus
ccagttattccacgggtttcatcta

SEQ ID NO: 341213 - DNA, 25 bp, Mus musculus
ccagttattccaggggtttcatcta

SEQ ID NO: 341214 - DNA, 25 bp, Mus musculus
ccagttcaaggtccctcgggactga

SEQ ID NO: 341215 - DNA, 25 bp, Mus musculus
ccagttcaaggtgcctcgggactga

SEQ ID NO: 341216 - DNA, 25 bp, Mus musculus
ccagttcacatgcagatctctcttt

SEQ ID NO: 341217 - DNA, 25 bp, Mus musculus
ccagttcacatggagatctctcttt

SEQ ID NO: 341218 - DNA, 25 bp, Mus musculus
ccagttcaccttaccaaagactcta

SEQ ID NO: 341219 - DNA, 25 bp, Mus musculus
ccagttcacctttccaaagactcta

SEQ ID NO: 341220 - DNA, 25 bp, Mus musculus
ccagttcagcgacgctgttctccaa

SEQ ID NO: 341221 - DNA, 25 bp, Mus musculus
ccagttcagcgaggctgttctccaa

SEQ ID NO: 341222 - DNA, 25 bp, Mus musculus
ccagttcaggataatggctgttagt

SEQ ID NO: 341223 - DNA, 25 bp, Mus musculus
ccagttcaggattatggctgttagt

SEQ ID NO: 341224 - DNA, 25 bp, Mus musculus
ccagttcagggtaagaccctatttg

SEQ ID NO: 341225 - DNA, 25 bp, Mus musculus
ccagttcagggttagaccctatttg

SEQ ID NO: 341226 - DNA, 25 bp, Mus musculus
ccagttcagtcacgccttggagcag

SEQ ID NO: 341227 - DNA, 25 bp, Mus musculus
ccagttcagtcaggccttggagcag

SEQ ID NO: 341228 - DNA, 25 bp, Mus musculus
ccagttcatcatagtacagattgta

SEQ ID NO: 341229 - DNA, 25 bp, Mus musculus
ccagttcatcattgtacagattgta

SEQ ID NO: 341230 - DNA, 25 bp, Mus musculus
ccagttccaccaattcacagcagtg

SEQ ID NO: 341231 - DNA, 25 bp, Mus musculus
ccagttccaccatttcacagcagtg

SEQ ID NO: 341232 - DNA, 25 bp, Mus musculus
ccagttccaggacttgtaatgcccc

SEQ ID NO: 341233 - DNA, 25 bp, Mus musculus
ccagttccaggagttgtaatgcccc

SEQ ID NO: 341234 - DNA, 25 bp, Mus musculus
ccagttccaggcagctctggatgga

SEQ ID NO: 341235 - DNA, 25 bp, Mus musculus
ccagttccaggctgctctggatgga

SEQ ID NO: 341236 - DNA, 25 bp, Mus musculus
ccagttccatccaaatatagcccgg

SEQ ID NO: 341237 - DNA, 25 bp, Mus musculus
ccagttccatcctaatatagcccgg

SEQ ID NO: 341238 - DNA, 25 bp, Mus musculus
ccagttccctagaagggcccaggag

SEQ ID NO: 341239 - DNA, 25 bp, Mus musculus
ccagttccctagtagggcccaggag

SEQ ID NO: 341240 - DNA, 25 bp, Mus musculus
ccagttcctgaacaaagggtgaatt

SEQ ID NO: 341241 - DNA, 25 bp, Mus musculus
ccagttcctgaagaaagggtgaatt

SEQ ID NO: 341242 - DNA, 25 bp, Mus musculus
ccagttccttagatgcttctttgga

SEQ ID NO: 341243 - DNA, 25 bp, Mus musculus
ccagttccttagttgcttctttgga

SEQ ID NO: 341244 - DNA, 25 bp, Mus musculus
ccagttcgacccatctacagagtgg

SEQ ID NO: 341245 - DNA, 25 bp, Mus musculus
ccagttcgacccttctacagagtgg

SEQ ID NO: 341246 - DNA, 25 bp, Mus musculus
ccagttcgccatcgtatttttccga

SEQ ID NO: 341247 - DNA, 25 bp, Mus musculus
ccagttcgccatggtatttttccga

SEQ ID NO: 341248 - DNA, 25 bp, Mus musculus
ccagttctaataccaggttccaagt

SEQ ID NO: 341249 - DNA, 25 bp, Mus musculus
ccagttctaatagcaggttccaagt

SEQ ID NO: 341250 - DNA, 25 bp, Mus musculus
ccagttctcaaacccacttgtcagg

SEQ ID NO: 341251 - DNA, 25 bp, Mus musculus
ccagttctcaaagccacttgtcagg

SEQ ID NO: 341252 - DNA, 25 bp, Mus musculus
ccagttctcaggaagcctccaggac

SEQ ID NO: 341253 - DNA, 25 bp, Mus musculus
ccagttctcaggtagcctccaggac

SEQ ID NO: 341254 - DNA, 25 bp, Mus musculus
ccagttctccctattcacaaattgt

SEQ ID NO: 341255 - DNA, 25 bp, Mus musculus
ccagttctcccttttcacaaattgt

SEQ ID NO: 341256 - DNA, 25 bp, Mus musculus
ccagttctcctaaactctatctgag

SEQ ID NO: 341257 - DNA, 25 bp, Mus musculus
ccagttctcctatactctatctgag

SEQ ID NO: 341258 - DNA, 25 bp, Mus musculus
ccagttctcgttatacacgtcaatc

SEQ ID NO: 341259 - DNA, 25 bp, Mus musculus
ccagttctcgttttacacgtcaatc

SEQ ID NO: 341260 - DNA, 25 bp, Mus musculus
ccagttctcttaagagtgccctcat

SEQ ID NO: 341261 - DNA, 25 bp, Mus musculus
ccagttctcttatgagtgccctcat

SEQ ID NO: 341262 - DNA, 25 bp, Mus musculus
ccagttctgataaatgcgggtccca

SEQ ID NO: 341263 - DNA, 25 bp, Mus musculus
ccagttctgatatatgcgggtccca

SEQ ID NO: 341264 - DNA, 25 bp, Mus musculus
ccagttctgcctcttgtaggtgttg

SEQ ID NO: 341265 - DNA, 25 bp, Mus musculus
ccagttctgcctgttgtaggtgttg

SEQ ID NO: 341266 - DNA, 25 bp, Mus musculus
ccagttctgggcactagtgactaga

SEQ ID NO: 341267 - DNA, 25 bp, Mus musculus
ccagttctgggctctagtgactaga

SEQ ID NO: 341268 - DNA, 25 bp, Mus musculus
ccagttctggttcagcatgggatat

SEQ ID NO: 341269 - DNA, 25 bp, Mus musculus
ccagttctggttgagcatgggatat

SEQ ID NO: 341270 - DNA, 25 bp, Mus musculus
ccagttctgtagcatctaggcggca

SEQ ID NO: 341271 - DNA, 25 bp, Mus musculus
ccagttctgtaggatctaggcggca

SEQ ID NO: 341272 - DNA, 25 bp, Mus musculus
ccagttcttatacctcctgagacaa

SEQ ID NO: 341273 - DNA, 25 bp, Mus musculus
ccagttcttatagctcctgagacaa

SEQ ID NO: 341274 - DNA, 25 bp, Mus musculus
ccagttcttcctcacctgtgataag

SEQ ID NO: 341275 - DNA, 25 bp, Mus musculus
ccagttcttcctgacctgtgataag

SEQ ID NO: 341276 - DNA, 25 bp, Mus musculus
ccagttgaacgtatgctttatttga

SEQ ID NO: 341277 - DNA, 25 bp, Mus musculus
ccagttgaacgtttgctttatttga

SEQ ID NO: 341278 - DNA, 25 bp, Mus musculus
ccagttgacgttactgctccagtgt

SEQ ID NO: 341279 - DNA, 25 bp, Mus musculus
ccagttgacgtttctgctccagtgt

SEQ ID NO: 341280 - DNA, 25 bp, Mus musculus
ccagttgattggacctcaggtgttt

SEQ ID NO: 341281 - DNA, 25 bp, Mus musculus
ccagttgattggtcctcaggtgttt

SEQ ID NO: 341282 - DNA, 25 bp, Mus musculus
ccagttgattgtagccctgtgggca

SEQ ID NO: 341283 - DNA, 25 bp, Mus musculus
ccagttgattgttgccctgtgggca

SEQ ID NO: 341284 - DNA, 25 bp, Mus musculus
ccagttgccagacgctacacaagaa

SEQ ID NO: 341285 - DNA, 25 bp, Mus musculus
ccagttgccagaggctacacaagaa

SEQ ID NO: 341286 - DNA, 25 bp, Mus musculus
ccagttgccgccctgaaaaacatta

SEQ ID NO: 341287 - DNA, 25 bp, Mus musculus
ccagttgccgccgtgaaaaacatta

SEQ ID NO: 341288 - DNA, 25 bp, Mus musculus
ccagttgcctttacctgtgagacag

SEQ ID NO: 341289 - DNA, 25 bp, Mus musculus
ccagttgccttttcctgtgagacag

SEQ ID NO: 341290 - DNA, 25 bp, Mus musculus
ccagttgcttccaggcagtagaaga

SEQ ID NO: 341291 - DNA, 25 bp, Mus musculus
ccagttgcttcctggcagtagaaga

SEQ ID NO: 341292 - DNA, 25 bp, Mus musculus
ccagttggcattagtttgaaattgt

SEQ ID NO: 341293 - DNA, 25 bp, Mus musculus
ccagttggcattcggtattgataaa

SEQ ID NO: 341294 - DNA, 25 bp, Mus musculus
ccagttggcattgggtattgataaa

SEQ ID NO: 341295 - DNA, 25 bp, Mus musculus
ccagttggcatttgtttgaaattgt

SEQ ID NO: 341296 - DNA, 25 bp, Mus musculus
ccagttggcccacaatttgctatgt

SEQ ID NO: 341297 - DNA, 25 bp, Mus musculus
ccagttggcccagaatttgctatgt

SEQ ID NO: 341298 - DNA, 25 bp, Mus musculus
ccagttgggtatattgctgccacag

SEQ ID NO: 341299 - DNA, 25 bp, Mus musculus
ccagttgggtattttgctgccacag

SEQ ID NO: 341300 - DNA, 25 bp, Mus musculus
ccagttggtctcctcagagtggatt

SEQ ID NO: 341301 - DNA, 25 bp, Mus musculus
ccagttggtctcgtcagagtggatt

SEQ ID NO: 341302 - DNA, 25 bp, Mus musculus
ccagttgtgggcagactgtccctga

SEQ ID NO: 341303 - DNA, 25 bp, Mus musculus
ccagttgtgggctgactgtccctga

SEQ ID NO: 341304 - DNA, 25 bp, Mus musculus
ccagttgtgttacgcctttgtccca

SEQ ID NO: 341305 - DNA, 25 bp, Mus musculus
ccagttgtgttaggcctttgtccca

SEQ ID NO: 341306 - DNA, 25 bp, Mus musculus
ccagttgttcagcttcagaggtagt

SEQ ID NO: 341307 - DNA, 25 bp, Mus musculus
ccagttgttcaggttcagaggtagt

SEQ ID NO: 341308 - DNA, 25 bp, Mus musculus
ccagttgtttggcacattctagtta

SEQ ID NO: 341309 - DNA, 25 bp, Mus musculus
ccagttgtttgggacattctagtta

SEQ ID NO: 341310 - DNA, 25 bp, Mus musculus
ccagtttaacggaggattcagccaa

SEQ ID NO: 341311 - DNA, 25 bp, Mus musculus
ccagtttaacggtggattcagccaa

SEQ ID NO: 341312 - DNA, 25 bp, Mus musculus
ccagtttacctgattaatgttcatt

SEQ ID NO: 341313 - DNA, 25 bp, Mus musculus
ccagtttacctgtttaatgttcatt

SEQ ID NO: 341314 - DNA, 25 bp, Mus musculus
ccagtttactgaagagtttctccct

SEQ ID NO: 341315 - DNA, 25 bp, Mus musculus
ccagtttactgatgagtttctccct

SEQ ID NO: 341316 - DNA, 25 bp, Mus musculus
ccagtttagcctaacactgctctaa

SEQ ID NO: 341317 - DNA, 25 bp, Mus musculus
ccagtttagccttacactgctctaa

SEQ ID NO: 341318 - DNA, 25 bp, Mus musculus
ccagtttcaaatcttggctgcagct

SEQ ID NO: 341319 - DNA, 25 bp, Mus musculus
ccagtttcaaatgttggctgcagct

SEQ ID NO: 341320 - DNA, 25 bp, Mus musculus
ccagtttcagataccagtgcagcac

SEQ ID NO: 341321 - DNA, 25 bp, Mus musculus
ccagtttcagattccagtgcagcac

SEQ ID NO: 341322 - DNA, 25 bp, Mus musculus
ccagtttcagcacactacctacaaa

SEQ ID NO: 341323 - DNA, 25 bp, Mus musculus
ccagtttcagcagactacctacaaa

SEQ ID NO: 341324 - DNA, 25 bp, Mus musculus
ccagtttcaggacatgtggtgccct

SEQ ID NO: 341325 - DNA, 25 bp, Mus musculus
ccagtttcaggagatgtggtgccct

SEQ ID NO: 341326 - DNA, 25 bp, Mus musculus
ccagtttccatgatgtccttagttt

SEQ ID NO: 341327 - DNA, 25 bp, Mus musculus
ccagtttccatgttgtccttagttt

SEQ ID NO: 341328 - DNA, 25 bp, Mus musculus
ccagtttccttcaatgcaatccatg

SEQ ID NO: 341329 - DNA, 25 bp, Mus musculus
ccagtttccttctatgcaatccatg

SEQ ID NO: 341330 - DNA, 25 bp, Mus musculus
ccagtttccttgacagttccagagt

SEQ ID NO: 341331 - DNA, 25 bp, Mus musculus
ccagtttccttgtcagttccagagt

SEQ ID NO: 341332 - DNA, 25 bp, Mus musculus
ccagtttctctcagtttgccaaaga

SEQ ID NO: 341333 - DNA, 25 bp, Mus musculus
ccagtttctctctgtttgccaaaga

SEQ ID NO: 341334 - DNA, 25 bp, Mus musculus
ccagtttctggcatagcgctatttg

SEQ ID NO: 341335 - DNA, 25 bp, Mus musculus
ccagtttctggcttagcgctatttg

SEQ ID NO: 341336 - DNA, 25 bp, Mus musculus
ccagtttctggtcctaaagaaagat

SEQ ID NO: 341337 - DNA, 25 bp, Mus musculus
ccagtttctggtgctaaagaaagat

SEQ ID NO: 341338 - DNA, 25 bp, Mus musculus
ccagtttgcctccaggttctaataa

SEQ ID NO: 341339 - DNA, 25 bp, Mus musculus
ccagtttgcctcgaggttctaataa

SEQ ID NO: 341340 - DNA, 25 bp, Mus musculus
ccagtttgctatcccctagctaggt

SEQ ID NO: 341341 - DNA, 25 bp, Mus musculus
ccagtttgctatgccctagctaggt

SEQ ID NO: 341342 - DNA, 25 bp, Mus musculus
ccagtttgctgtcaggcttcttttt

SEQ ID NO: 341343 - DNA, 25 bp, Mus musculus
ccagtttgctgtgaggcttcttttt

SEQ ID NO: 341344 - DNA, 25 bp, Mus musculus
ccagtttggagccacagacctggat

SEQ ID NO: 341345 - DNA, 25 bp, Mus musculus
ccagtttggagccgcagccagtgaa

SEQ ID NO: 341346 - DNA, 25 bp, Mus musculus
ccagtttggagcgacagacctggat

SEQ ID NO: 341347 - DNA, 25 bp, Mus musculus
ccagtttggagcggcagccagtgaa

SEQ ID NO: 341348 - DNA, 25 bp, Mus musculus
ccagtttgtattacgctgattagtg

SEQ ID NO: 341349 - DNA, 25 bp, Mus musculus
ccagtttgtatttcgctgattagtg

SEQ ID NO: 341350 - DNA, 25 bp, Mus musculus
ccagtttgtgataattagtatgcat

SEQ ID NO: 341351 - DNA, 25 bp, Mus musculus
ccagtttgtgattattagtatgcat

SEQ ID NO: 341352 - DNA, 25 bp, Mus musculus
ccagtttgttgaattcacagaggga

SEQ ID NO: 341353 - DNA, 25 bp, Mus musculus
ccagtttgttgatttcacagaggga

SEQ ID NO: 341354 - DNA, 25 bp, Mus musculus
ccagttttactgaggcacggatgaa

SEQ ID NO: 341355 - DNA, 25 bp, Mus musculus
ccagttttactgtggcacggatgaa

SEQ ID NO: 341356 - DNA, 25 bp, Mus musculus
ccagttttcagcctgtccacaggaa

SEQ ID NO: 341357 - DNA, 25 bp, Mus musculus
ccagttttcagcgtgtccacaggaa

SEQ ID NO: 341358 - DNA, 25 bp, Mus musculus
ccagttttctgaataggtgtttcat

SEQ ID NO: 341359 - DNA, 25 bp, Mus musculus
ccagttttctgattaggtgtttcat

SEQ ID NO: 341360 - DNA, 25 bp, Mus musculus
ccagttttctgcacagggttggaag

SEQ ID NO: 341361 - DNA, 25 bp, Mus musculus
ccagttttctgctcagggttggaag

SEQ ID NO: 341362 - DNA, 25 bp, Mus musculus
ccagtttttcctccagagattcact

SEQ ID NO: 341363 - DNA, 25 bp, Mus musculus
ccagtttttcctgcagagattcact

SEQ ID NO: 341364 - DNA, 25 bp, Mus musculus
ccagtttttgggagccatgtacact

SEQ ID NO: 341365 - DNA, 25 bp, Mus musculus
ccagtttttgggtgccatgtacact

SEQ ID NO: 341366 - DNA, 25 bp, Mus musculus
ccagtttttggtagtatagccattt

SEQ ID NO: 341367 - DNA, 25 bp, Mus musculus
ccagtttttggttgtatagccattt

SEQ ID NO: 341368 - DNA, 25 bp, Mus musculus
ccagttttttatcgtgccaaatgta

SEQ ID NO: 341369 - DNA, 25 bp, Mus musculus
ccagttttttatggtgccaaatgta

SEQ ID NO: 341370 - DNA, 25 bp, Mus musculus
ccataaaccttgcaggtcacctaag

SEQ ID NO: 341371 - DNA, 25 bp, Mus musculus
ccataaaccttggaggtcacctaag

SEQ ID NO: 341372 - DNA, 25 bp, Mus musculus
ccataaacgattactgctcctcatt

SEQ ID NO: 341373 - DNA, 25 bp, Mus musculus
ccataaacgatttctgctcctcatt

SEQ ID NO: 341374 - DNA, 25 bp, Mus musculus
ccataaagacatagtggaggttctg

SEQ ID NO: 341375 - DNA, 25 bp, Mus musculus
ccataaagacattgtggaggttctg

SEQ ID NO: 341376 - DNA, 25 bp, Mus musculus
ccataaagactgagcggtgtttcct

SEQ ID NO: 341377 - DNA, 25 bp, Mus musculus
ccataaagactgtgcggtgtttcct

SEQ ID NO: 341378 - DNA, 25 bp, Mus musculus
ccataaaggctgacattttttgtat

SEQ ID NO: 341379 - DNA, 25 bp, Mus musculus
ccataaaggctgtcattttttgtat

SEQ ID NO: 341380 - DNA, 25 bp, Mus musculus
ccataaattcaaagtgtctgccact

SEQ ID NO: 341381 - DNA, 25 bp, Mus musculus
ccataaattcaatgtgtctgccact

SEQ ID NO: 341382 - DNA, 25 bp, Mus musculus
ccataaatttttactctgatgtttt

SEQ ID NO: 341383 - DNA, 25 bp, Mus musculus
ccataaattttttctctgatgtttt

SEQ ID NO: 341384 - DNA, 25 bp, Mus musculus
ccataacagcaccactgagagtcat

SEQ ID NO: 341385 - DNA, 25 bp, Mus musculus
ccataacagcacgactgagagtcat

SEQ ID NO: 341386 - DNA, 25 bp, Mus musculus
ccataaccatgtccttgcctatttc

SEQ ID NO: 341387 - DNA, 25 bp, Mus musculus
ccataaccatgtgcttgcctatttc

SEQ ID NO: 341388 - DNA, 25 bp, Mus musculus
ccataaccttggcaactgctgttgc

SEQ ID NO: 341389 - DNA, 25 bp, Mus musculus
ccataaccttgggaactgctgttgc

SEQ ID NO: 341390 - DNA, 25 bp, Mus musculus
ccataactaactaaaatcccagctc

SEQ ID NO: 341391 - DNA, 25 bp, Mus musculus
ccataactaacttaaatcccagctc

SEQ ID NO: 341392 - DNA, 25 bp, Mus musculus
ccataactactcctaaaggcccaga

SEQ ID NO: 341393 - DNA, 25 bp, Mus musculus
ccataactactcgtaaaggcccaga

SEQ ID NO: 341394 - DNA, 25 bp, Mus musculus
ccataagcatttcacccacaggata

SEQ ID NO: 341395 - DNA, 25 bp, Mus musculus
ccataagcatttgacccacaggata

SEQ ID NO: 341396 - DNA, 25 bp, Mus musculus
ccataagcccatatggccctgttga

SEQ ID NO: 341397 - DNA, 25 bp, Mus musculus
ccataagcccatttggccctgttga

SEQ ID NO: 341398 - DNA, 25 bp, Mus musculus
ccataagtacttcttgatgtgttga

SEQ ID NO: 341399 - DNA, 25 bp, Mus musculus
ccataagtacttgttgatgtgttga

SEQ ID NO: 341400 - DNA, 25 bp, Mus musculus
ccataatacaacactggttcctttg

SEQ ID NO: 341401 - DNA, 25 bp, Mus musculus
ccataatacaactctggttcctttg

SEQ ID NO: 341402 - DNA, 25 bp, Mus musculus
ccataatagcagcacatcattaccc

SEQ ID NO: 341403 - DNA, 25 bp, Mus musculus
ccataatagcaggacatcattaccc

SEQ ID NO: 341404 - DNA, 25 bp, Mus musculus
ccataatcactccttgcattctata

SEQ ID NO: 341405 - DNA, 25 bp, Mus musculus
ccataatcactcgttgcattctata

SEQ ID NO: 341406 - DNA, 25 bp, Mus musculus
ccataatctatcatcatttttcgtg

SEQ ID NO: 341407 - DNA, 25 bp, Mus musculus
ccataatctatcttcatttttcgtg

SEQ ID NO: 341408 - DNA, 25 bp, Mus musculus
ccataatctcttcggcggcgtagga

SEQ ID NO: 341409 - DNA, 25 bp, Mus musculus
ccataatctcttgggcggcgtagga

SEQ ID NO: 341410 - DNA, 25 bp, Mus musculus
ccataatgaattctgttgtgtgcta

SEQ ID NO: 341411 - DNA, 25 bp, Mus musculus
ccataatgaattgtgttgtgtgcta

SEQ ID NO: 341412 - DNA, 25 bp, Mus musculus
ccataatgagtgaccaccgcggaga

SEQ ID NO: 341413 - DNA, 25 bp, Mus musculus
ccataatgagtgtccaccgcggaga

SEQ ID NO: 341414 - DNA, 25 bp, Mus musculus
ccataatgcgttcatagcatcttta

SEQ ID NO: 341415 - DNA, 25 bp, Mus musculus
ccataatgcgttgatagcatcttta

SEQ ID NO: 341416 - DNA, 25 bp, Mus musculus
ccataatgtcttactttggcccact

SEQ ID NO: 341417 - DNA, 25 bp, Mus musculus
ccataatgtctttctttggcccact

SEQ ID NO: 341418 - DNA, 25 bp, Mus musculus
ccataattccagcacacacttgtta

SEQ ID NO: 341419 - DNA, 25 bp, Mus musculus
ccataattccaggacacacttgtta

SEQ ID NO: 341420 - DNA, 25 bp, Mus musculus
ccataatttctacacctaaccactt

SEQ ID NO: 341421 - DNA, 25 bp, Mus musculus
ccataatttctagacctaaccactt

SEQ ID NO: 341422 - DNA, 25 bp, Mus musculus
ccatacaacatgacccactgttggt

SEQ ID NO: 341423 - DNA, 25 bp, Mus musculus
ccatacaacatgtcccactgttggt

SEQ ID NO: 341424 - DNA, 25 bp, Mus musculus
ccatacaacggtcacaatctagaat

SEQ ID NO: 341425 - DNA, 25 bp, Mus musculus
ccatacaacggtgacaatctagaat

SEQ ID NO: 341426 - DNA, 25 bp, Mus musculus
ccatacactcttcaaatcccaggaa

SEQ ID NO: 341427 - DNA, 25 bp, Mus musculus
ccatacactcttgaaatcccaggaa

SEQ ID NO: 341428 - DNA, 25 bp, Mus musculus
ccatacatgaaaaatgtttgggcat

SEQ ID NO: 341429 - DNA, 25 bp, Mus musculus
ccatacatgaaatatgtttgggcat

SEQ ID NO: 341430 - DNA, 25 bp, Mus musculus
ccatacatggtgctgcggatagcag

SEQ ID NO: 341431 - DNA, 25 bp, Mus musculus
ccatacatggtggtgcggatagcag

SEQ ID NO: 341432 - DNA, 25 bp, Mus musculus
ccataccacattagccctggacaaa

SEQ ID NO: 341433 - DNA, 25 bp, Mus musculus
ccataccacatttgccctggacaaa

SEQ ID NO: 341434 - DNA, 25 bp, Mus musculus
ccatacccacccaagttgtgtataa

SEQ ID NO: 341435 - DNA, 25 bp, Mus musculus
ccatacccaccctagttgtgtataa

SEQ ID NO: 341436 - DNA, 25 bp, Mus musculus
ccatacccagttccttgggaagaca

SEQ ID NO: 341437 - DNA, 25 bp, Mus musculus
ccatacccagttgcttgggaagaca

SEQ ID NO: 341438 - DNA, 25 bp, Mus musculus
ccatacccatgcacatatagtcagc

SEQ ID NO: 341439 - DNA, 25 bp, Mus musculus
ccatacccatgctcatatagtcagc

SEQ ID NO: 341440 - DNA, 25 bp, Mus musculus
ccataccctggtctgagggtacagt

SEQ ID NO: 341441 - DNA, 25 bp, Mus musculus
ccataccctggtgtgagggtacagt

SEQ ID NO: 341442 - DNA, 25 bp, Mus musculus
ccatacctctacatgcttctgtgat

SEQ ID NO: 341443 - DNA, 25 bp, Mus musculus
ccatacctctacttgcttctgtgat

SEQ ID NO: 341444 - DNA, 25 bp, Mus musculus
ccatacctgataatgttgggacttt

SEQ ID NO: 341445 - DNA, 25 bp, Mus musculus
ccatacctgatattgttgggacttt

SEQ ID NO: 341446 - DNA, 25 bp, Mus musculus
ccatacctgattatgcctctttttt

SEQ ID NO: 341447 - DNA, 25 bp, Mus musculus
ccatacctgattttgcctctttttt

SEQ ID NO: 341448 - DNA, 25 bp, Mus musculus
ccatacctgcatctgagccaggctg

SEQ ID NO: 341449 - DNA, 25 bp, Mus musculus
ccatacctgcatgtgagccaggctg

SEQ ID NO: 341450 - DNA, 25 bp, Mus musculus
ccatacctggtaatgtgagatctag

SEQ ID NO: 341451 - DNA, 25 bp, Mus musculus
ccatacctggtattgtgagatctag

SEQ ID NO: 341452 - DNA, 25 bp, Mus musculus
ccataccttctcctgttagatcaaa

SEQ ID NO: 341453 - DNA, 25 bp, Mus musculus
ccataccttctcgtgttagatcaaa

SEQ ID NO: 341454 - DNA, 25 bp, Mus musculus
ccataccttttacacctgttagctt

SEQ ID NO: 341455 - DNA, 25 bp, Mus musculus
ccataccttttagacctgttagctt

SEQ ID NO: 341456 - DNA, 25 bp, Mus musculus
ccatacgccatgattactgttttta

SEQ ID NO: 341457 - DNA, 25 bp, Mus musculus
ccatacgccatgtttactgttttta

SEQ ID NO: 341458 - DNA, 25 bp, Mus musculus
ccatactcagggagcgctgacctca

SEQ ID NO: 341459 - DNA, 25 bp, Mus musculus
ccatactcagggtgcgctgacctca

SEQ ID NO: 341460 - DNA, 25 bp, Mus musculus
ccatactcatttcattttgggagct

SEQ ID NO: 341461 - DNA, 25 bp, Mus musculus
ccatactcatttgattttgggagct

SEQ ID NO: 341462 - DNA, 25 bp, Mus musculus
ccatactccatcatgagcctgagaa

SEQ ID NO: 341463 - DNA, 25 bp, Mus musculus
ccatactccatcttgagcctgagaa

SEQ ID NO: 341464 - DNA, 25 bp, Mus musculus
ccatactcctttcatcggatacagt

SEQ ID NO: 341465 - DNA, 25 bp, Mus musculus
ccatactcctttgatcggatacagt

SEQ ID NO: 341466 - DNA, 25 bp, Mus musculus
ccatactctgtgattccaggctcct

SEQ ID NO: 341467 - DNA, 25 bp, Mus musculus
ccatactctgtgtttccaggctcct

SEQ ID NO: 341468 - DNA, 25 bp, Mus musculus
ccatactgccatacccatgttcttt

SEQ ID NO: 341469 - DNA, 25 bp, Mus musculus
ccatactgccattcccatgttcttt

SEQ ID NO: 341470 - DNA, 25 bp, Mus musculus
ccatactgtgggagaatttcgggca

SEQ ID NO: 341471 - DNA, 25 bp, Mus musculus
ccatactgtgggtgaatttcgggca

SEQ ID NO: 341472 - DNA, 25 bp, Mus musculus
ccatacttaactagtgtagaagatg

SEQ ID NO: 341473 - DNA, 25 bp, Mus musculus
ccatacttaacttgtgtagaagatg

SEQ ID NO: 341474 - DNA, 25 bp, Mus musculus
ccatacttcaatcttggttcaggaa

SEQ ID NO: 341475 - DNA, 25 bp, Mus musculus
ccatacttcaatgttggttcaggaa

SEQ ID NO: 341476 - DNA, 25 bp, Mus musculus
ccatacttcactcccaatatttttg

SEQ ID NO: 341477 - DNA, 25 bp, Mus musculus
ccatacttcactgccaatatttttg

SEQ ID NO: 341478 - DNA, 25 bp, Mus musculus
ccatacttccatacagtgcctttga

SEQ ID NO: 341479 - DNA, 25 bp, Mus musculus
ccatacttccattcagtgcctttga

SEQ ID NO: 341480 - DNA, 25 bp, Mus musculus
ccatacttgagactttgttgtacta

SEQ ID NO: 341481 - DNA, 25 bp, Mus musculus
ccatacttgagagtttgttgtacta

SEQ ID NO: 341482 - DNA, 25 bp, Mus musculus
ccatacttgcagaatgcagacccta

SEQ ID NO: 341483 - DNA, 25 bp, Mus musculus
ccatacttgcagtatgcagacccta

SEQ ID NO: 341484 - DNA, 25 bp, Mus musculus
ccatacttgggaccctttggttcca

SEQ ID NO: 341485 - DNA, 25 bp, Mus musculus
ccatacttgggagcctttggttcca

SEQ ID NO: 341486 - DNA, 25 bp, Mus musculus
ccatacttggtcatggcatcagtaa

SEQ ID NO: 341487 - DNA, 25 bp, Mus musculus
ccatacttggtcttggcatcagtaa

SEQ ID NO: 341488 - DNA, 25 bp, Mus musculus
ccatacttgtggcaacggaactggt

SEQ ID NO: 341489 - DNA, 25 bp, Mus musculus
ccatacttgtgggaacggaactggt

SEQ ID NO: 341490 - DNA, 25 bp, Mus musculus
ccatacttttgcagtttaaacctga

SEQ ID NO: 341491 - DNA, 25 bp, Mus musculus
ccatacttttgctgtttaaacctga

SEQ ID NO: 341492 - DNA, 25 bp, Mus musculus
ccatagagccgacgctggcctggaa

SEQ ID NO: 341493 - DNA, 25 bp, Mus musculus
ccatagagccgaggctggcctggaa

SEQ ID NO: 341494 - DNA, 25 bp, Mus musculus
ccatagagggacctaggtagcttag

SEQ ID NO: 341495 - DNA, 25 bp, Mus musculus
ccatagagggacgtaggtagcttag

SEQ ID NO: 341496 - DNA, 25 bp, Mus musculus
ccatagagggctccgccacttttgg

SEQ ID NO: 341497 - DNA, 25 bp, Mus musculus
ccatagagggctgcgccacttttgg

SEQ ID NO: 341498 - DNA, 25 bp, Mus musculus
ccatagccacccaattttagcaatt

SEQ ID NO: 341499 - DNA, 25 bp, Mus musculus
ccatagccaccctattttagcaatt

SEQ ID NO: 341500 - DNA, 25 bp, Mus musculus
ccatagccatggatcaggctgccat

SEQ ID NO: 341501 - DNA, 25 bp, Mus musculus
ccatagccatggttcaggctgccat

SEQ ID NO: 341502 - DNA, 25 bp, Mus musculus
ccatagccgtgtcctattggtggga

SEQ ID NO: 341503 - DNA, 25 bp, Mus musculus
ccatagccgtgtgctattggtggga

SEQ ID NO: 341504 - DNA, 25 bp, Mus musculus
ccatagcctaagatttactgtgagc

SEQ ID NO: 341505 - DNA, 25 bp, Mus musculus
ccatagcctaagttttactgtgagc

SEQ ID NO: 341506 - DNA, 25 bp, Mus musculus
ccatagctagggaagcttgccttct

SEQ ID NO: 341507 - DNA, 25 bp, Mus musculus
ccatagctagggtagcttgccttct

SEQ ID NO: 341508 - DNA, 25 bp, Mus musculus
ccatagctccagatcagaggcaata

SEQ ID NO: 341509 - DNA, 25 bp, Mus musculus
ccatagctccagttcagaggcaata

SEQ ID NO: 341510 - DNA, 25 bp, Mus musculus
ccatagcttaggagctcctggatga

SEQ ID NO: 341511 - DNA, 25 bp, Mus musculus
ccatagcttaggtgctcctggatga

SEQ ID NO: 341512 - DNA, 25 bp, Mus musculus
ccatagcttagtattctgggagcag

SEQ ID NO: 341513 - DNA, 25 bp, Mus musculus
ccatagcttagttttctgggagcag

SEQ ID NO: 341514 - DNA, 25 bp, Mus musculus
ccatagcttggaattcagggactct

SEQ ID NO: 341515 - DNA, 25 bp, Mus musculus
ccatagcttggatttcagggactct

SEQ ID NO: 341516 - DNA, 25 bp, Mus musculus
ccataggaccttcccatgattattt

SEQ ID NO: 341517 - DNA, 25 bp, Mus musculus
ccataggaccttgccatgattattt

SEQ ID NO: 341518 - DNA, 25 bp, Mus musculus
ccataggacttcattcctggtgact

SEQ ID NO: 341519 - DNA, 25 bp, Mus musculus
ccataggacttctttcctggtgact

SEQ ID NO: 341520 - DNA, 25 bp, Mus musculus
ccataggattcaagatttctgatac

SEQ ID NO: 341521 - DNA, 25 bp, Mus musculus
ccataggattcatgatttctgatac

SEQ ID NO: 341522 - DNA, 25 bp, Mus musculus
ccataggcagtaacccctccccgca

SEQ ID NO: 341523 - DNA, 25 bp, Mus musculus
ccataggcagtatcccctccccgca

SEQ ID NO: 341524 - DNA, 25 bp, Mus musculus
ccataggcagtgctttcttaggcag

SEQ ID NO: 341525 - DNA, 25 bp, Mus musculus
ccataggcagtggtttcttaggcag

SEQ ID NO: 341526 - DNA, 25 bp, Mus musculus
ccataggctgcaattttccctcttg

SEQ ID NO: 341527 - DNA, 25 bp, Mus musculus
ccataggctgcatttttccctcttg

SEQ ID NO: 341528 - DNA, 25 bp, Mus musculus
ccatagggaggactggcattattaa

SEQ ID NO: 341529 - DNA, 25 bp, Mus musculus
ccatagggaggagtggcattattaa

SEQ ID NO: 341530 - DNA, 25 bp, Mus musculus
ccatagggcggaaagtgagcactta

SEQ ID NO: 341531 - DNA, 25 bp, Mus musculus
ccatagggcggatagtgagcactta

SEQ ID NO: 341532 - DNA, 25 bp, Mus musculus
ccatagggtggaactgactcctgca

SEQ ID NO: 341533 - DNA, 25 bp, Mus musculus
ccatagggtggatctgactcctgca

SEQ ID NO: 341534 - DNA, 25 bp, Mus musculus
ccatagggttaacgaagactttgag

SEQ ID NO: 341535 - DNA, 25 bp, Mus musculus
ccatagggttaaggaagactttgag

SEQ ID NO: 341536 - DNA, 25 bp, Mus musculus
ccataggtgtccaatactcgaggga

SEQ ID NO: 341537 - DNA, 25 bp, Mus musculus
ccataggtgtcctatactcgaggga

SEQ ID NO: 341538 - DNA, 25 bp, Mus musculus
ccataggttgagaacgggcgtgcat

SEQ ID NO: 341539 - DNA, 25 bp, Mus musculus
ccataggttgagtacgggcgtgcat

SEQ ID NO: 341540 - DNA, 25 bp, Mus musculus
ccatagtaacccattgtcagtctta

SEQ ID NO: 341541 - DNA, 25 bp, Mus musculus
ccatagtaaccctttgtcagtctta

SEQ ID NO: 341542 - DNA, 25 bp, Mus musculus
ccatagtagtatatcctcaggtgag

SEQ ID NO: 341543 - DNA, 25 bp, Mus musculus
ccatagtagtatttcctcaggtgag

SEQ ID NO: 341544 - DNA, 25 bp, Mus musculus
ccatagtctcagataaaagtgccag

SEQ ID NO: 341545 - DNA, 25 bp, Mus musculus
ccatagtctcagttaaaagtgccag

SEQ ID NO: 341546 - DNA, 25 bp, Mus musculus
ccatagtctcttcctctgtaaaggt

SEQ ID NO: 341547 - DNA, 25 bp, Mus musculus
ccatagtctcttgctctgtaaaggt

SEQ ID NO: 341548 - DNA, 25 bp, Mus musculus
ccatagtgcttgctgcttacctaag

SEQ ID NO: 341549 - DNA, 25 bp, Mus musculus
ccatagtgcttggtgcttacctaag

SEQ ID NO: 341550 - DNA, 25 bp, Mus musculus
ccatagtgggtacctactgagatca

SEQ ID NO: 341551 - DNA, 25 bp, Mus musculus
ccatagtgggtagctactgagatca

SEQ ID NO: 341552 - DNA, 25 bp, Mus musculus
ccatagtgtgtcatttcgtttccca

SEQ ID NO: 341553 - DNA, 25 bp, Mus musculus
ccatagtgtgtcttttcgtttccca

SEQ ID NO: 341554 - DNA, 25 bp, Mus musculus
ccatagttgcttaattgcagacttg

SEQ ID NO: 341555 - DNA, 25 bp, Mus musculus
ccatagttgctttattgcagacttg

SEQ ID NO: 341556 - DNA, 25 bp, Mus musculus
ccatagttggacattcattgctgaa

SEQ ID NO: 341557 - DNA, 25 bp, Mus musculus
ccatagttggactttcattgctgaa

SEQ ID NO: 341558 - DNA, 25 bp, Mus musculus
ccatagttgtgtcgagtccgtgagt

SEQ ID NO: 341559 - DNA, 25 bp, Mus musculus
ccatagttgtgtggagtccgtgagt

SEQ ID NO: 341560 - DNA, 25 bp, Mus musculus
ccatagtttcagcaggactcagatt

SEQ ID NO: 341561 - DNA, 25 bp, Mus musculus
ccatagtttcaggaggactcagatt

SEQ ID NO: 341562 - DNA, 25 bp, Mus musculus
ccatatagatgtccgagggcgctgc

SEQ ID NO: 341563 - DNA, 25 bp, Mus musculus
ccatatagatgtgcgagggcgctgc

SEQ ID NO: 341564 - DNA, 25 bp, Mus musculus
ccatatagcgcaatatactcattcc

SEQ ID NO: 341565 - DNA, 25 bp, Mus musculus
ccatatagcgcattatactcattcc

SEQ ID NO: 341566 - DNA, 25 bp, Mus musculus
ccatatagcttaaagttgtcattgt

SEQ ID NO: 341567 - DNA, 25 bp, Mus musculus
ccatatagcttatagttgtcattgt

SEQ ID NO: 341568 - DNA, 25 bp, Mus musculus
ccatatagggctcgaaagttagctt

SEQ ID NO: 341569 - DNA, 25 bp, Mus musculus
ccatatagggctggaaagttagctt

SEQ ID NO: 341570 - DNA, 25 bp, Mus musculus
ccatatagtgacagcctgggctggg

SEQ ID NO: 341571 - DNA, 25 bp, Mus musculus
ccatatagtgactgcctgggctggg

SEQ ID NO: 341572 - DNA, 25 bp, Mus musculus
ccatatatccctacgcttagatcag

SEQ ID NO: 341573 - DNA, 25 bp, Mus musculus
ccatatatcccttcgcttagatcag

SEQ ID NO: 341574 - DNA, 25 bp, Mus musculus
ccatatattactatgaccagatctt

SEQ ID NO: 341575 - DNA, 25 bp, Mus musculus
ccatatattactttgaccagatctt

SEQ ID NO: 341576 - DNA, 25 bp, Mus musculus
ccatatcaacatacgggaaattcat

SEQ ID NO: 341577 - DNA, 25 bp, Mus musculus
ccatatcaacattcgggaaattcat

SEQ ID NO: 341578 - DNA, 25 bp, Mus musculus
ccatatcagcccctctaagaatggg

SEQ ID NO: 341579 - DNA, 25 bp, Mus musculus
ccatatcagcccgtctaagaatggg

SEQ ID NO: 341580 - DNA, 25 bp, Mus musculus
ccatatccacacacaacaactaatt

SEQ ID NO: 341581 - DNA, 25 bp, Mus musculus
ccatatccacactcaacaactaatt

SEQ ID NO: 341582 - DNA, 25 bp, Mus musculus
ccatatccacagctcctgagagatg

SEQ ID NO: 341583 - DNA, 25 bp, Mus musculus
ccatatccacaggtcctgagagatg

SEQ ID NO: 341584 - DNA, 25 bp, Mus musculus
ccatatccagatagcatgcctgcag

SEQ ID NO: 341585 - DNA, 25 bp, Mus musculus
ccatatccagattgcatgcctgcag

SEQ ID NO: 341586 - DNA, 25 bp, Mus musculus
ccatatccatgcagcctgacacaga

SEQ ID NO: 341587 - DNA, 25 bp, Mus musculus
ccatatccatgctgcctgacacaga

SEQ ID NO: 341588 - DNA, 25 bp, Mus musculus
ccatatcctgggatttcctatttgt

SEQ ID NO: 341589 - DNA, 25 bp, Mus musculus
ccatatcctgggttttcctatttgt

SEQ ID NO: 341590 - DNA, 25 bp, Mus musculus
ccatatctatggagcacgcatcaag

SEQ ID NO: 341591 - DNA, 25 bp, Mus musculus
ccatatctatggtgcacgcatcaag

SEQ ID NO: 341592 - DNA, 25 bp, Mus musculus
ccatatctcgttatctctgctaatt

SEQ ID NO: 341593 - DNA, 25 bp, Mus musculus
ccatatctcgttttctctgctaatt

SEQ ID NO: 341594 - DNA, 25 bp, Mus musculus
ccatatctctcactccaatgtctga

SEQ ID NO: 341595 - DNA, 25 bp, Mus musculus
ccatatctctcagtccaatgtctga

SEQ ID NO: 341596 - DNA, 25 bp, Mus musculus
ccatatctcttccagttacttcaca

SEQ ID NO: 341597 - DNA, 25 bp, Mus musculus
ccatatctcttcgagttacttcaca

SEQ ID NO: 341598 - DNA, 25 bp, Mus musculus
ccatatctgggtatagtctgtagca

SEQ ID NO: 341599 - DNA, 25 bp, Mus musculus
ccatatctgggtttagtctgtagca

SEQ ID NO: 341600 - DNA, 25 bp, Mus musculus
ccatatcttgctctgcacgaaagtc

SEQ ID NO: 341601 - DNA, 25 bp, Mus musculus
ccatatcttgctgtgcacgaaagtc

SEQ ID NO: 341602 - DNA, 25 bp, Mus musculus
ccatatcttttacgctttctcactg

SEQ ID NO: 341603 - DNA, 25 bp, Mus musculus
ccatatcttttaggctttctcactg

SEQ ID NO: 341604 - DNA, 25 bp, Mus musculus
ccatatgacttcaactggcacagga

SEQ ID NO: 341605 - DNA, 25 bp, Mus musculus
ccatatgacttctactggcacagga

SEQ ID NO: 341606 - DNA, 25 bp, Mus musculus
ccatatgcactacactggtatctga

SEQ ID NO: 341607 - DNA, 25 bp, Mus musculus
ccatatgcactagactggtatctga

SEQ ID NO: 341608 - DNA, 25 bp, Mus musculus
ccatatgcatgactggatactgaca

SEQ ID NO: 341609 - DNA, 25 bp, Mus musculus
ccatatgcatgagtggatactgaca

SEQ ID NO: 341610 - DNA, 25 bp, Mus musculus
ccatatgctacactctccctatctc

SEQ ID NO: 341611 - DNA, 25 bp, Mus musculus
ccatatgctacagtctccctatctc

SEQ ID NO: 341612 - DNA, 25 bp, Mus musculus
ccatatgctcatatcaagtattata

SEQ ID NO: 341613 - DNA, 25 bp, Mus musculus
ccatatgctcatttcaagtattata

SEQ ID NO: 341614 - DNA, 25 bp, Mus musculus
ccatatgctgagaggtgaacgacag

SEQ ID NO: 341615 - DNA, 25 bp, Mus musculus
ccatatgctgagtggtgaacgacag

SEQ ID NO: 341616 - DNA, 25 bp, Mus musculus
ccatatggactcctctacaaccata

SEQ ID NO: 341617 - DNA, 25 bp, Mus musculus
ccatatggactcgtctacaaccata

SEQ ID NO: 341618 - DNA, 25 bp, Mus musculus
ccatatggtcctccaactatttgct

SEQ ID NO: 341619 - DNA, 25 bp, Mus musculus
ccatatggtcctgcaactatttgct

SEQ ID NO: 341620 - DNA, 25 bp, Mus musculus
ccatatggttacagcacagctgccc

SEQ ID NO: 341621 - DNA, 25 bp, Mus musculus
ccatatggttactgcacagctgccc

SEQ ID NO: 341622 - DNA, 25 bp, Mus musculus
ccatatggttggatagaccccacct

SEQ ID NO: 341623 - DNA, 25 bp, Mus musculus
ccatatggttggttagaccccacct

SEQ ID NO: 341624 - DNA, 25 bp, Mus musculus
ccatatgtatctcttgccccgtgaa

SEQ ID NO: 341625 - DNA, 25 bp, Mus musculus
ccatatgtatctgttgccccgtgaa

SEQ ID NO: 341626 - DNA, 25 bp, Mus musculus
ccatatgtatttcaactcctgagaa

SEQ ID NO: 341627 - DNA, 25 bp, Mus musculus
ccatatgtatttgaactcctgagaa

SEQ ID NO: 341628 - DNA, 25 bp, Mus musculus
ccatatgtctctatcttggatgtgt

SEQ ID NO: 341629 - DNA, 25 bp, Mus musculus
ccatatgtctctttcttggatgtgt

SEQ ID NO: 341630 - DNA, 25 bp, Mus musculus
ccatatgtctgactgggtattttta

SEQ ID NO: 341631 - DNA, 25 bp, Mus musculus
ccatatgtctgagtgggtattttta

SEQ ID NO: 341632 - DNA, 25 bp, Mus musculus
ccatatgtgaagatcgttgtaatat

SEQ ID NO: 341633 - DNA, 25 bp, Mus musculus
ccatatgtgaagttcgttgtaatat

SEQ ID NO: 341634 - DNA, 25 bp, Mus musculus
ccatatgtggatataccatattctt

SEQ ID NO: 341635 - DNA, 25 bp, Mus musculus
ccatatgtggatttaccatattctt

SEQ ID NO: 341636 - DNA, 25 bp, Mus musculus
ccatattaaaatacctgcagcctct

SEQ ID NO: 341637 - DNA, 25 bp, Mus musculus
ccatattaaaattcctgcagcctct

SEQ ID NO: 341638 - DNA, 25 bp, Mus musculus
ccatattacattatatcttgtgctg

SEQ ID NO: 341639 - DNA, 25 bp, Mus musculus
ccatattacattttatcttgtgctg

SEQ ID NO: 341640 - DNA, 25 bp, Mus musculus
ccatattagcctcgctcctgaagtt

SEQ ID NO: 341641 - DNA, 25 bp, Mus musculus
ccatattagcctggctcctgaagtt

SEQ ID NO: 341642 - DNA, 25 bp, Mus musculus
ccatattcctgactctggcttcata

SEQ ID NO: 341643 - DNA, 25 bp, Mus musculus
ccatattcctgagtctggcttcata

SEQ ID NO: 341644 - DNA, 25 bp, Mus musculus
ccatattcctttcgcttctcaattt

SEQ ID NO: 341645 - DNA, 25 bp, Mus musculus
ccatattcctttggcttctcaattt

SEQ ID NO: 341646 - DNA, 25 bp, Mus musculus
ccatattcttgcaccttttgcacac

SEQ ID NO: 341647 - DNA, 25 bp, Mus musculus
ccatattcttgctccttttgcacac

SEQ ID NO: 341648 - DNA, 25 bp, Mus musculus
ccatattctttcacgggaacagaca

SEQ ID NO: 341649 - DNA, 25 bp, Mus musculus
ccatattctttctcgggaacagaca

SEQ ID NO: 341650 - DNA, 25 bp, Mus musculus
ccatatttagtgattatgtatccac

SEQ ID NO: 341651 - DNA, 25 bp, Mus musculus
ccatatttagtgtttatgtatccac

SEQ ID NO: 341652 - DNA, 25 bp, Mus musculus
ccatatttcaacaacagaggtgctg

SEQ ID NO: 341653 - DNA, 25 bp, Mus musculus
ccatatttcaactacagaggtgctg

SEQ ID NO: 341654 - DNA, 25 bp, Mus musculus
ccatatttcttcacaccagcaggaa

SEQ ID NO: 341655 - DNA, 25 bp, Mus musculus
ccatatttcttctcaccagcaggaa

SEQ ID NO: 341656 - DNA, 25 bp, Mus musculus
ccatattttgttagtacaccaataa

SEQ ID NO: 341657 - DNA, 25 bp, Mus musculus
ccatattttgtttgtacaccaataa

SEQ ID NO: 341658 - DNA, 25 bp, Mus musculus
ccatcaaactatagctcaggccttt

SEQ ID NO: 341659 - DNA, 25 bp, Mus musculus
ccatcaaactattgctcaggccttt

SEQ ID NO: 341660 - DNA, 25 bp, Mus musculus
ccatcaaagtgtacctgtacaaatt

SEQ ID NO: 341661 - DNA, 25 bp, Mus musculus
ccatcaaagtgttcctgtacaaatt

SEQ ID NO: 341662 - DNA, 25 bp, Mus musculus
ccatcaaatgtgacaggcaactgct

SEQ ID NO: 341663 - DNA, 25 bp, Mus musculus
ccatcaaatgtgtcaggcaactgct

SEQ ID NO: 341664 - DNA, 25 bp, Mus musculus
ccatcaaatttcatcttcatcctaa

SEQ ID NO: 341665 - DNA, 25 bp, Mus musculus
ccatcaaatttcttcttcatcctaa

SEQ ID NO: 341666 - DNA, 25 bp, Mus musculus
ccatcaagaaccaagttcaccttca

SEQ ID NO: 341667 - DNA, 25 bp, Mus musculus
ccatcaagaacctagttcaccttca

SEQ ID NO: 341668 - DNA, 25 bp, Mus musculus
ccatcaagcggcacacaattttctg

SEQ ID NO: 341669 - DNA, 25 bp, Mus musculus
ccatcaagcggctcacaattttctg

SEQ ID NO: 341670 - DNA, 25 bp, Mus musculus
ccatcaagctgactaaaggttggtg

SEQ ID NO: 341671 - DNA, 25 bp, Mus musculus
ccatcaagctgagtaaaggttggtg

SEQ ID NO: 341672 - DNA, 25 bp, Mus musculus
ccatcaagctgccagacggacatga

SEQ ID NO: 341673 - DNA, 25 bp, Mus musculus
ccatcaagctgcgagacggacatga

SEQ ID NO: 341674 - DNA, 25 bp, Mus musculus
ccatcaaggaacaaagccagagaga

SEQ ID NO: 341675 - DNA, 25 bp, Mus musculus
ccatcaaggaactaagccagagaga

SEQ ID NO: 341676 - DNA, 25 bp, Mus musculus
ccatcaagggtgctgctccgctgtg

SEQ ID NO: 341677 - DNA, 25 bp, Mus musculus
ccatcaagggtggtgctccgctgtg

SEQ ID NO: 341678 - DNA, 25 bp, Mus musculus
ccatcaagtgagaattcaggaccat

SEQ ID NO: 341679 - DNA, 25 bp, Mus musculus
ccatcaagtgagtattcaggaccat

SEQ ID NO: 341680 - DNA, 25 bp, Mus musculus
ccatcaagtggtacagtttttaata

SEQ ID NO: 341681 - DNA, 25 bp, Mus musculus
ccatcaagtggttcagtttttaata

SEQ ID NO: 341682 - DNA, 25 bp, Mus musculus
ccatcaagttgtcattccagggcca

SEQ ID NO: 341683 - DNA, 25 bp, Mus musculus
ccatcaagttgtgattccagggcca

SEQ ID NO: 341684 - DNA, 25 bp, Mus musculus
ccatcacaagcaaagaggtaccttt

SEQ ID NO: 341685 - DNA, 25 bp, Mus musculus
ccatcacaagcatagaggtaccttt

SEQ ID NO: 341686 - DNA, 25 bp, Mus musculus
ccatcacactggagacgcagtatga

SEQ ID NO: 341687 - DNA, 25 bp, Mus musculus
ccatcacactggtgacgcagtatga

SEQ ID NO: 341688 - DNA, 25 bp, Mus musculus
ccatcacactgtattaattttattg

SEQ ID NO: 341689 - DNA, 25 bp, Mus musculus
ccatcacactgttttaattttattg

SEQ ID NO: 341690 - DNA, 25 bp, Mus musculus
ccatcacagacaacatctcctacgg

SEQ ID NO: 341691 - DNA, 25 bp, Mus musculus
ccatcacagacatcatctcctacgg

SEQ ID NO: 341692 - DNA, 25 bp, Mus musculus
ccatcacagcaaaccggtactatac

SEQ ID NO: 341693 - DNA, 25 bp, Mus musculus
ccatcacagcaatccggtactatac

SEQ ID NO: 341694 - DNA, 25 bp, Mus musculus
ccatcacatactatgggctgagaaa

SEQ ID NO: 341695 - DNA, 25 bp, Mus musculus
ccatcacatactttgggctgagaaa

SEQ ID NO: 341696 - DNA, 25 bp, Mus musculus
ccatcacatgtgacatatttgcggt

SEQ ID NO: 341697 - DNA, 25 bp, Mus musculus
ccatcacatgtgtcatatttgcggt

SEQ ID NO: 341698 - DNA, 25 bp, Mus musculus
ccatcacattataccttctgctgta

SEQ ID NO: 341699 - DNA, 25 bp, Mus musculus
ccatcacattattccttctgctgta

SEQ ID NO: 341700 - DNA, 25 bp, Mus musculus
ccatcaccactacagggagtaaaga

SEQ ID NO: 341701 - DNA, 25 bp, Mus musculus
ccatcaccactagagggagtaaaga

SEQ ID NO: 341702 - DNA, 25 bp, Mus musculus
ccatcaccatctaccaggagcgaga

SEQ ID NO: 341703 - DNA, 25 bp, Mus musculus
ccatcaccatcttccaggagcgaga

SEQ ID NO: 341704 - DNA, 25 bp, Mus musculus
ccatcaccattgaggctgagccaag

SEQ ID NO: 341705 - DNA, 25 bp, Mus musculus
ccatcaccattgtggctgagccaag

SEQ ID NO: 341706 - DNA, 25 bp, Mus musculus
ccatcacccagcctagaaaagtatt

SEQ ID NO: 341707 - DNA, 25 bp, Mus musculus
ccatcacccagcgtagaaaagtatt

SEQ ID NO: 341708 - DNA, 25 bp, Mus musculus
ccatcacccggcatgttttggattt

SEQ ID NO: 341709 - DNA, 25 bp, Mus musculus
ccatcacccggcttgttttggattt

SEQ ID NO: 341710 - DNA, 25 bp, Mus musculus
ccatcacccgggagagagaagacat

SEQ ID NO: 341711 - DNA, 25 bp, Mus musculus
ccatcacccgggtgagagaagacat

SEQ ID NO: 341712 - DNA, 25 bp, Mus musculus
ccatcacctagcacatatcatactt

SEQ ID NO: 341713 - DNA, 25 bp, Mus musculus
ccatcacctagctcatatcatactt

SEQ ID NO: 341714 - DNA, 25 bp, Mus musculus
ccatcacctatgcacccaaagtggt

SEQ ID NO: 341715 - DNA, 25 bp, Mus musculus
ccatcacctatggacccaaagtggt

SEQ ID NO: 341716 - DNA, 25 bp, Mus musculus
ccatcacctctgagatcctagtggg

SEQ ID NO: 341717 - DNA, 25 bp, Mus musculus
ccatcacctctgtgatcctagtggg

SEQ ID NO: 341718 - DNA, 25 bp, Mus musculus
ccatcacctcttaggaactgccaga

SEQ ID NO: 341719 - DNA, 25 bp, Mus musculus
ccatcacctctttggaactgccaga

SEQ ID NO: 341720 - DNA, 25 bp, Mus musculus
ccatcaccttgactcacctgtaaat

SEQ ID NO: 341721 - DNA, 25 bp, Mus musculus
ccatcaccttgagtcacctgtaaat

SEQ ID NO: 341722 - DNA, 25 bp, Mus musculus
ccatcacggttgacaggcagagcta

SEQ ID NO: 341723 - DNA, 25 bp, Mus musculus
ccatcacggttgtcaggcagagcta

SEQ ID NO: 341724 - DNA, 25 bp, Mus musculus
ccatcacgtactccttcttcttgag

SEQ ID NO: 341725 - DNA, 25 bp, Mus musculus
ccatcacgtactgcttcttcttgag

SEQ ID NO: 341726 - DNA, 25 bp, Mus musculus
ccatcactggacctggtcatgagga

SEQ ID NO: 341727 - DNA, 25 bp, Mus musculus
ccatcactggacgtggtcatgagga

SEQ ID NO: 341728 - DNA, 25 bp, Mus musculus
ccatcactgtggagtggagggcaca

SEQ ID NO: 341729 - DNA, 25 bp, Mus musculus
ccatcactgtggtgtggagggcaca

SEQ ID NO: 341730 - DNA, 25 bp, Mus musculus
ccatcacttaggagcctggtccaaa

SEQ ID NO: 341731 - DNA, 25 bp, Mus musculus
ccatcacttaggtgcctggtccaaa

SEQ ID NO: 341732 - DNA, 25 bp, Mus musculus
ccatcagagatgcttgccctttgag

SEQ ID NO: 341733 - DNA, 25 bp, Mus musculus
ccatcagagatggttgccctttgag

SEQ ID NO: 341734 - DNA, 25 bp, Mus musculus
ccatcagcagggaacagacaagaat

SEQ ID NO: 341735 - DNA, 25 bp, Mus musculus
ccatcagcagggtacagacaagaat

SEQ ID NO: 341736 - DNA, 25 bp, Mus musculus
ccatcagcatctactctgcagaccg

SEQ ID NO: 341737 - DNA, 25 bp, Mus musculus
ccatcagcatcttctctgcagaccg

SEQ ID NO: 341738 - DNA, 25 bp, Mus musculus
ccatcagcatgtcagttccctgttt

SEQ ID NO: 341739 - DNA, 25 bp, Mus musculus
ccatcagcatgtgagttccctgttt

SEQ ID NO: 341740 - DNA, 25 bp, Mus musculus
ccatcagcgggtagccagacggtaa

SEQ ID NO: 341741 - DNA, 25 bp, Mus musculus
ccatcagcgggttgccagacggtaa

SEQ ID NO: 341742 - DNA, 25 bp, Mus musculus
ccatcagctcaaagtcagcctttga

SEQ ID NO: 341743 - DNA, 25 bp, Mus musculus
ccatcagctcaatgtcagcctttga

SEQ ID NO: 341744 - DNA, 25 bp, Mus musculus
ccatcagctctcattgcttctaggc

SEQ ID NO: 341745 - DNA, 25 bp, Mus musculus
ccatcagctctctttgcttctaggc

SEQ ID NO: 341746 - DNA, 25 bp, Mus musculus
ccatcagctggacttcatcctcagg

SEQ ID NO: 341747 - DNA, 25 bp, Mus musculus
ccatcagctggagttcatcctcagg

SEQ ID NO: 341748 - DNA, 25 bp, Mus musculus
ccatcagctgggagcagcgctggaa

SEQ ID NO: 341749 - DNA, 25 bp, Mus musculus
ccatcagctgggtgcagcgctggaa

SEQ ID NO: 341750 - DNA, 25 bp, Mus musculus
ccatcagcttacccgaagagtgtgg

SEQ ID NO: 341751 - DNA, 25 bp, Mus musculus
ccatcagcttacgcgaagagtgtgg

SEQ ID NO: 341752 - DNA, 25 bp, Mus musculus
ccatcaggaatgctgactgcctcat

SEQ ID NO: 341753 - DNA, 25 bp, Mus musculus
ccatcaggaatggtgactgcctcat

SEQ ID NO: 341754 - DNA, 25 bp, Mus musculus
ccatcaggcagcacatgtctcaaag

SEQ ID NO: 341755 - DNA, 25 bp, Mus musculus
ccatcaggcagctcatgtctcaaag

SEQ ID NO: 341756 - DNA, 25 bp, Mus musculus
ccatcagggcatacacaccggagag

SEQ ID NO: 341757 - DNA, 25 bp, Mus musculus
ccatcagggcattcacaccggagag

SEQ ID NO: 341758 - DNA, 25 bp, Mus musculus
ccatcagggccgcagggacatatat

SEQ ID NO: 341759 - DNA, 25 bp, Mus musculus
ccatcagggccggagggacatatat

SEQ ID NO: 341760 - DNA, 25 bp, Mus musculus
ccatcagtaacacaaggcctcggct

SEQ ID NO: 341761 - DNA, 25 bp, Mus musculus
ccatcagtaacagaaggcctcggct

SEQ ID NO: 341762 - DNA, 25 bp, Mus musculus
ccatcagtaattccagtcccagggt

SEQ ID NO: 341763 - DNA, 25 bp, Mus musculus
ccatcagtaattgcagtcccagggt

SEQ ID NO: 341764 - DNA, 25 bp, Mus musculus
ccatcagtattgagccgggagttga

SEQ ID NO: 341765 - DNA, 25 bp, Mus musculus
ccatcagtattgtgccgggagttga

SEQ ID NO: 341766 - DNA, 25 bp, Mus musculus
ccatcagtgaccattttcctgtgga

SEQ ID NO: 341767 - DNA, 25 bp, Mus musculus
ccatcagtgacctttttcctgtgga

SEQ ID NO: 341768 - DNA, 25 bp, Mus musculus
ccatcagtgatcctgacctgggctt

SEQ ID NO: 341769 - DNA, 25 bp, Mus musculus
ccatcagtgatcgtgacctgggctt

SEQ ID NO: 341770 - DNA, 25 bp, Mus musculus
ccatcagttcctcagcccagagaaa

SEQ ID NO: 341771 - DNA, 25 bp, Mus musculus
ccatcagttcctgagcccagagaaa

SEQ ID NO: 341772 - DNA, 25 bp, Mus musculus
ccatcagttctgctttgtctgcaaa

SEQ ID NO: 341773 - DNA, 25 bp, Mus musculus
ccatcagttctggtttgtctgcaaa

SEQ ID NO: 341774 - DNA, 25 bp, Mus musculus
ccatcatagctgaccaaccctgttg

SEQ ID NO: 341775 - DNA, 25 bp, Mus musculus
ccatcatagctgtccaaccctgttg

SEQ ID NO: 341776 - DNA, 25 bp, Mus musculus
ccatcatcatgactgtaccgcgaaa

SEQ ID NO: 341777 - DNA, 25 bp, Mus musculus
ccatcatcatgagtgtaccgcgaaa

SEQ ID NO: 341778 - DNA, 25 bp, Mus musculus
ccatcatcatttaagatttctatct

SEQ ID NO: 341779 - DNA, 25 bp, Mus musculus
ccatcatcattttagatttctatct

SEQ ID NO: 341780 - DNA, 25 bp, Mus musculus
ccatcatcggacacatggtgggcgg

SEQ ID NO: 341781 - DNA, 25 bp, Mus musculus
ccatcatcggacagagcttcacatt

SEQ ID NO: 341782 - DNA, 25 bp, Mus musculus
ccatcatcggactcatggtgggcgg

SEQ ID NO: 341783 - DNA, 25 bp, Mus musculus
ccatcatcggactgagcttcacatt

SEQ ID NO: 341784 - DNA, 25 bp, Mus musculus
ccatcatctaccacttgaccaatgt

SEQ ID NO: 341785 - DNA, 25 bp, Mus musculus
ccatcatctacctcttgaccaatgt

SEQ ID NO: 341786 - DNA, 25 bp, Mus musculus
ccatcatctacgagctgggtacaga

SEQ ID NO: 341787 - DNA, 25 bp, Mus musculus
ccatcatctacgtgctgggtacaga

SEQ ID NO: 341788 - DNA, 25 bp, Mus musculus
ccatcatctctcataaggcctgagt

SEQ ID NO: 341789 - DNA, 25 bp, Mus musculus
ccatcatctctcttaaggcctgagt

SEQ ID NO: 341790 - DNA, 25 bp, Mus musculus
ccatcatctctgaagtccatagaat

SEQ ID NO: 341791 - DNA, 25 bp, Mus musculus
ccatcatctctgtagtccatagaat

SEQ ID NO: 341792 - DNA, 25 bp, Mus musculus
ccatcatcttcaaggacgagattga

SEQ ID NO: 341793 - DNA, 25 bp, Mus musculus
ccatcatcttcatggacgagattga

SEQ ID NO: 341794 - DNA, 25 bp, Mus musculus
ccatcatgcaataccttattgcttt

SEQ ID NO: 341795 - DNA, 25 bp, Mus musculus
ccatcatgcaattccttattgcttt

SEQ ID NO: 341796 - DNA, 25 bp, Mus musculus
ccatcatgcagaacccacgacagta

SEQ ID NO: 341797 - DNA, 25 bp, Mus musculus
ccatcatgcagatcccacgacagta

SEQ ID NO: 341798 - DNA, 25 bp, Mus musculus
ccatcatgctggctaaagctgctgt

SEQ ID NO: 341799 - DNA, 25 bp, Mus musculus
ccatcatgctgggtaaagctgctgt

SEQ ID NO: 341800 - DNA, 25 bp, Mus musculus
ccatcatggaggaagctcacggcaa

SEQ ID NO: 341801 - DNA, 25 bp, Mus musculus
ccatcatggaggtagctcacggcaa

SEQ ID NO: 341802 - DNA, 25 bp, Mus musculus
ccatcatgtccactccctgttttgg

SEQ ID NO: 341803 - DNA, 25 bp, Mus musculus
ccatcatgtccagtccctgttttgg

SEQ ID NO: 341804 - DNA, 25 bp, Mus musculus
ccatcattaccaaacttatagtgag

SEQ ID NO: 341805 - DNA, 25 bp, Mus musculus
ccatcattaccatacttatagtgag

SEQ ID NO: 341806 - DNA, 25 bp, Mus musculus
ccatcattacctagctttgttccct

SEQ ID NO: 341807 - DNA, 25 bp, Mus musculus
ccatcattaccttgctttgttccct

SEQ ID NO: 341808 - DNA, 25 bp, Mus musculus
ccatcattatcaattggcatagtaa

SEQ ID NO: 341809 - DNA, 25 bp, Mus musculus
ccatcattatcatttggcatagtaa

SEQ ID NO: 341810 - DNA, 25 bp, Mus musculus
ccatcattatttcaggcacccagaa

SEQ ID NO: 341811 - DNA, 25 bp, Mus musculus
ccatcattatttgaggcacccagaa

SEQ ID NO: 341812 - DNA, 25 bp, Mus musculus
ccatcattgtctagctgggccagca

SEQ ID NO: 341813 - DNA, 25 bp, Mus musculus
ccatcattgtcttgctgggccagca

SEQ ID NO: 341814 - DNA, 25 bp, Mus musculus
ccatcatttctaattttctagtcta

SEQ ID NO: 341815 - DNA, 25 bp, Mus musculus
ccatcatttctatttttctagtcta

SEQ ID NO: 341816 - DNA, 25 bp, Mus musculus
ccatcattttacctctgcagaactt

SEQ ID NO: 341817 - DNA, 25 bp, Mus musculus
ccatcattttacgtctgcagaactt

SEQ ID NO: 341818 - DNA, 25 bp, Mus musculus
ccatccaacagaaggctccaatcaa

SEQ ID NO: 341819 - DNA, 25 bp, Mus musculus
ccatccaacagaaggtgtgtcagat

SEQ ID NO: 341820 - DNA, 25 bp, Mus musculus
ccatccaacagatggctccaatcaa

SEQ ID NO: 341821 - DNA, 25 bp, Mus musculus
ccatccaacagatggtgtgtcagat

SEQ ID NO: 341822 - DNA, 25 bp, Mus musculus
ccatccaagcgtccttgcttaaaat

SEQ ID NO: 341823 - DNA, 25 bp, Mus musculus
ccatccaagcgtgcttgcttaaaat

SEQ ID NO: 341824 - DNA, 25 bp, Mus musculus
ccatccacaggacgaccatgttgaa

SEQ ID NO: 341825 - DNA, 25 bp, Mus musculus
ccatccacaggaggaccatgttgaa

SEQ ID NO: 341826 - DNA, 25 bp, Mus musculus
ccatccacccatctttattttgagt

SEQ ID NO: 341827 - DNA, 25 bp, Mus musculus
ccatccacccatgtttattttgagt

SEQ ID NO: 341828 - DNA, 25 bp, Mus musculus
ccatccacgtcccatattatttaat

SEQ ID NO: 341829 - DNA, 25 bp, Mus musculus
ccatccacgtccgatattatttaat

SEQ ID NO: 341830 - DNA, 25 bp, Mus musculus
ccatccagaaaactagcagagggct

SEQ ID NO: 341831 - DNA, 25 bp, Mus musculus
ccatccagaaaagtagcagagggct

SEQ ID NO: 341832 - DNA, 25 bp, Mus musculus
ccatccagaccccacatgttagatt

SEQ ID NO: 341833 - DNA, 25 bp, Mus musculus
ccatccagacccgacatgttagatt

SEQ ID NO: 341834 - DNA, 25 bp, Mus musculus
ccatccagaggcatccattagtgag

SEQ ID NO: 341835 - DNA, 25 bp, Mus musculus
ccatccagaggcttccattagtgag

SEQ ID NO: 341836 - DNA, 25 bp, Mus musculus
ccatccagcaagactgcgtgggaga

SEQ ID NO: 341837 - DNA, 25 bp, Mus musculus
ccatccagcaagtctgcgtgggaga

SEQ ID NO: 341838 - DNA, 25 bp, Mus musculus
ccatccaggctgagctgtccctgta

SEQ ID NO: 341839 - DNA, 25 bp, Mus musculus
ccatccaggctgtgctgtccctgta

SEQ ID NO: 341840 - DNA, 25 bp, Mus musculus
ccatccaggtggaatctctccttga

SEQ ID NO: 341841 - DNA, 25 bp, Mus musculus
ccatccaggtggtatctctccttga

SEQ ID NO: 341842 - DNA, 25 bp, Mus musculus
ccatccagtggtagatttcttttga

SEQ ID NO: 341843 - DNA, 25 bp, Mus musculus
ccatccagtggttgatttcttttga

SEQ ID NO: 341844 - DNA, 25 bp, Mus musculus
ccatccatcaccattttacatttgt

SEQ ID NO: 341845 - DNA, 25 bp, Mus musculus
ccatccatcacctttttacatttgt

SEQ ID NO: 341846 - DNA, 25 bp, Mus musculus
ccatccatccacacagtgctgggga

SEQ ID NO: 341847 - DNA, 25 bp, Mus musculus
ccatccatccactcagtgctgggga

SEQ ID NO: 341848 - DNA, 25 bp, Mus musculus
ccatccatgcacacaccattaagtt

SEQ ID NO: 341849 - DNA, 25 bp, Mus musculus
ccatccatgcactcaccattaagtt

SEQ ID NO: 341850 - DNA, 25 bp, Mus musculus
ccatccattcacaatacttttctaa

SEQ ID NO: 341851 - DNA, 25 bp, Mus musculus
ccatccattcactatacttttctaa

SEQ ID NO: 341852 - DNA, 25 bp, Mus musculus
ccatccattcatacagctaagtgat

SEQ ID NO: 341853 - DNA, 25 bp, Mus musculus
ccatccattcattcagctaagtgat

SEQ ID NO: 341854 - DNA, 25 bp, Mus musculus
ccatccattgtcattcttcctgcct

SEQ ID NO: 341855 - DNA, 25 bp, Mus musculus
ccatccattgtctttcttcctgcct

SEQ ID NO: 341856 - DNA, 25 bp, Mus musculus
ccatccatttctagtgtccagaggc

SEQ ID NO: 341857 - DNA, 25 bp, Mus musculus
ccatccatttcttgtgtccagaggc

SEQ ID NO: 341858 - DNA, 25 bp, Mus musculus
ccatccatttgcctccaatgcaaat

SEQ ID NO: 341859 - DNA, 25 bp, Mus musculus
ccatccatttgcgtccaatgcaaat

SEQ ID NO: 341860 - DNA, 25 bp, Mus musculus
ccatcccaagtgagcagttggctga

SEQ ID NO: 341861 - DNA, 25 bp, Mus musculus
ccatcccaagtgtgcagttggctga

SEQ ID NO: 341862 - DNA, 25 bp, Mus musculus
ccatcccaatggactgagtattagt

SEQ ID NO: 341863 - DNA, 25 bp, Mus musculus
ccatcccaatggtctgagtattagt

SEQ ID NO: 341864 - DNA, 25 bp, Mus musculus
ccatcccacagcattgtcaggagtt

SEQ ID NO: 341865 - DNA, 25 bp, Mus musculus
ccatcccacagctttgtcaggagtt

SEQ ID NO: 341866 - DNA, 25 bp, Mus musculus
ccatcccactggctggatagtgtgt

SEQ ID NO: 341867 - DNA, 25 bp, Mus musculus
ccatcccactgggtggatagtgtgt

SEQ ID NO: 341868 - DNA, 25 bp, Mus musculus
ccatcccagcgtcgacaggaaaagc

SEQ ID NO: 341869 - DNA, 25 bp, Mus musculus
ccatcccagcgtggacaggaaaagc

SEQ ID NO: 341870 - DNA, 25 bp, Mus musculus
ccatcccagctaatcaaacaagtga

SEQ ID NO: 341871 - DNA, 25 bp, Mus musculus
ccatcccagctattcaaacaagtga

SEQ ID NO: 341872 - DNA, 25 bp, Mus musculus
ccatcccaggatccatagcacaaag

SEQ ID NO: 341873 - DNA, 25 bp, Mus musculus
ccatcccaggatgcatagcacaaag

SEQ ID NO: 341874 - DNA, 25 bp, Mus musculus
ccatccccacacattaatcttgtaa

SEQ ID NO: 341875 - DNA, 25 bp, Mus musculus
ccatccccacactttaatcttgtaa

SEQ ID NO: 341876 - DNA, 25 bp, Mus musculus
ccatccccacccatgtgttgtagtg

SEQ ID NO: 341877 - DNA, 25 bp, Mus musculus
ccatccccacccttgtgttgtagtg

SEQ ID NO: 341878 - DNA, 25 bp, Mus musculus
ccatccccagagcacttgtatattg

SEQ ID NO: 341879 - DNA, 25 bp, Mus musculus
ccatccccagaggacttgtatattg

SEQ ID NO: 341880 - DNA, 25 bp, Mus musculus
ccatccccagctcagagagtacttt

SEQ ID NO: 341881 - DNA, 25 bp, Mus musculus
ccatccccagctgagagagtacttt

SEQ ID NO: 341882 - DNA, 25 bp, Mus musculus
ccatccccagtgacagagtgtttga

SEQ ID NO: 341883 - DNA, 25 bp, Mus musculus
ccatccccagtgtcagagtgtttga

SEQ ID NO: 341884 - DNA, 25 bp, Mus musculus
ccatcccctaggcagataggtctgg

SEQ ID NO: 341885 - DNA, 25 bp, Mus musculus
ccatcccctagggagataggtctgg

SEQ ID NO: 341886 - DNA, 25 bp, Mus musculus
ccatcccctgacatttgtgacaaaa

SEQ ID NO: 341887 - DNA, 25 bp, Mus musculus
ccatcccctgacttttgtgacaaaa

SEQ ID NO: 341888 - DNA, 25 bp, Mus musculus
ccatcccctttcatctataggagga

SEQ ID NO: 341889 - DNA, 25 bp, Mus musculus
ccatcccctttcttctataggagga

SEQ ID NO: 341890 - DNA, 25 bp, Mus musculus
ccatcccgacccagaatttgattgt

SEQ ID NO: 341891 - DNA, 25 bp, Mus musculus
ccatcccgaccctgaatttgattgt

SEQ ID NO: 341892 - DNA, 25 bp, Mus musculus
ccatcccgactcaaaagtgcagaag

SEQ ID NO: 341893 - DNA, 25 bp, Mus musculus
ccatcccgactctaaagtgcagaag

SEQ ID NO: 341894 - DNA, 25 bp, Mus musculus
ccatcccgagctcaatatcggggtc

SEQ ID NO: 341895 - DNA, 25 bp, Mus musculus
ccatcccgagctgaatatcggggtc

SEQ ID NO: 341896 - DNA, 25 bp, Mus musculus
ccatcccgtgagaaagtgagccctt

SEQ ID NO: 341897 - DNA, 25 bp, Mus musculus
ccatcccgtgagtaagtgagccctt

SEQ ID NO: 341898 - DNA, 25 bp, Mus musculus
ccatccctacccagtggagtcagaa

SEQ ID NO: 341899 - DNA, 25 bp, Mus musculus
ccatccctaccctgtggagtcagaa

SEQ ID NO: 341900 - DNA, 25 bp, Mus musculus
ccatccctccacactaatttaaata

SEQ ID NO: 341901 - DNA, 25 bp, Mus musculus
ccatccctccactctaatttaaata

SEQ ID NO: 341902 - DNA, 25 bp, Mus musculus
ccatccctgagaaaagctataacaa

SEQ ID NO: 341903 - DNA, 25 bp, Mus musculus
ccatccctgagataagctataacaa

SEQ ID NO: 341904 - DNA, 25 bp, Mus musculus
ccatccctgctacctgtgaactaat

SEQ ID NO: 341905 - DNA, 25 bp, Mus musculus
ccatccctgctagctgtgaactaat

SEQ ID NO: 341906 - DNA, 25 bp, Mus musculus
ccatccctgttcagtagcatcagag

SEQ ID NO: 341907 - DNA, 25 bp, Mus musculus
ccatccctgttctgtagcatcagag

SEQ ID NO: 341908 - DNA, 25 bp, Mus musculus
ccatcccttggtaggactgcttagt

SEQ ID NO: 341909 - DNA, 25 bp, Mus musculus
ccatcccttggttggactgcttagt

SEQ ID NO: 341910 - DNA, 25 bp, Mus musculus
ccatccctttctacacgtggaagtg

SEQ ID NO: 341911 - DNA, 25 bp, Mus musculus
ccatccctttcttcacgtggaagtg

SEQ ID NO: 341912 - DNA, 25 bp, Mus musculus
ccatccctttttcaagtgtaggcag

SEQ ID NO: 341913 - DNA, 25 bp, Mus musculus
ccatccctttttgaagtgtaggcag

SEQ ID NO: 341914 - DNA, 25 bp, Mus musculus
ccatccgacctcaaaccaaaagaat

SEQ ID NO: 341915 - DNA, 25 bp, Mus musculus
ccatccgacctctaaccaaaagaat

SEQ ID NO: 341916 - DNA, 25 bp, Mus musculus
ccatccgattaaataccgtggatta

SEQ ID NO: 341917 - DNA, 25 bp, Mus musculus
ccatccgattaattaccgtggatta

SEQ ID NO: 341918 - DNA, 25 bp, Mus musculus
ccatccgcaccaccttgaagagaaa

SEQ ID NO: 341919 - DNA, 25 bp, Mus musculus
ccatccgcaccagcttgaagagaaa

SEQ ID NO: 341920 - DNA, 25 bp, Mus musculus
ccatccgcagacatcacatacaaat

SEQ ID NO: 341921 - DNA, 25 bp, Mus musculus
ccatccgcagacttcacatacaaat

SEQ ID NO: 341922 - DNA, 25 bp, Mus musculus
ccatccgctggtatacatttctgta

SEQ ID NO: 341923 - DNA, 25 bp, Mus musculus
ccatccgctggtttacatttctgta

SEQ ID NO: 341924 - DNA, 25 bp, Mus musculus
ccatccgcttccaaaatgctgagaa

SEQ ID NO: 341925 - DNA, 25 bp, Mus musculus
ccatccgcttcctaaatgctgagaa

SEQ ID NO: 341926 - DNA, 25 bp, Mus musculus
ccatccgggattctgttggagacag

SEQ ID NO: 341927 - DNA, 25 bp, Mus musculus
ccatccgggattgtgttggagacag

SEQ ID NO: 341928 - DNA, 25 bp, Mus musculus
ccatccgtaggtcgtcaggcagaat

SEQ ID NO: 341929 - DNA, 25 bp, Mus musculus
ccatccgtaggtggtcaggcagaat

SEQ ID NO: 341930 - DNA, 25 bp, Mus musculus
ccatccgtctagagtttgagggtaa

SEQ ID NO: 341931 - DNA, 25 bp, Mus musculus
ccatccgtctagtgtttgagggtaa

SEQ ID NO: 341932 - DNA, 25 bp, Mus musculus
ccatccgtctctaagtctatagaac

SEQ ID NO: 341933 - DNA, 25 bp, Mus musculus
ccatccgtctcttagtctatagaac

SEQ ID NO: 341934 - DNA, 25 bp, Mus musculus
ccatccgtggcgagtcctgaagagg

SEQ ID NO: 341935 - DNA, 25 bp, Mus musculus
ccatccgtggcgtgtcctgaagagg

SEQ ID NO: 341936 - DNA, 25 bp, Mus musculus
ccatccgtgttcatactgctttaca

SEQ ID NO: 341937 - DNA, 25 bp, Mus musculus
ccatccgtgttcttactgctttaca

SEQ ID NO: 341938 - DNA, 25 bp, Mus musculus
ccatccgttgttcgagatcaaacct

SEQ ID NO: 341939 - DNA, 25 bp, Mus musculus
ccatccgttgttggagatcaaacct

SEQ ID NO: 341940 - DNA, 25 bp, Mus musculus
ccatcctaaagcagctggccagata

SEQ ID NO: 341941 - DNA, 25 bp, Mus musculus
ccatcctaaagctgctggccagata

SEQ ID NO: 341942 - DNA, 25 bp, Mus musculus
ccatcctaagctaccacccagaagc

SEQ ID NO: 341943 - DNA, 25 bp, Mus musculus
ccatcctaagcttccacccagaagc

SEQ ID NO: 341944 - DNA, 25 bp, Mus musculus
ccatcctatggaacccacacaatag

SEQ ID NO: 341945 - DNA, 25 bp, Mus musculus
ccatcctatggatcccacacaatag

SEQ ID NO: 341946 - DNA, 25 bp, Mus musculus
ccatcctatgtgctggtatcctaga

SEQ ID NO: 341947 - DNA, 25 bp, Mus musculus
ccatcctatgtggtggtatcctaga

SEQ ID NO: 341948 - DNA, 25 bp, Mus musculus
ccatcctcagaaaactctctcagag

SEQ ID NO: 341949 - DNA, 25 bp, Mus musculus
ccatcctcagaactgcttttcttaa

SEQ ID NO: 341950 - DNA, 25 bp, Mus musculus
ccatcctcagaagtgcttttcttaa

SEQ ID NO: 341951 - DNA, 25 bp, Mus musculus
ccatcctcagaatactctctcagag

SEQ ID NO: 341952 - DNA, 25 bp, Mus musculus
ccatcctccggaattatcactttat

SEQ ID NO: 341953 - DNA, 25 bp, Mus musculus
ccatcctccggatttatcactttat

SEQ ID NO: 341954 - DNA, 25 bp, Mus musculus
ccatcctcggccaagaaattgctaa

SEQ ID NO: 341955 - DNA, 25 bp, Mus musculus
ccatcctcggcctagaaattgctaa

SEQ ID NO: 341956 - DNA, 25 bp, Mus musculus
ccatcctctagaactgctggaaaaa

SEQ ID NO: 341957 - DNA, 25 bp, Mus musculus
ccatcctctagatctgctggaaaaa

SEQ ID NO: 341958 - DNA, 25 bp, Mus musculus
ccatcctctcatcactgttagggaa

SEQ ID NO: 341959 - DNA, 25 bp, Mus musculus
ccatcctctcatgactgttagggaa

SEQ ID NO: 341960 - DNA, 25 bp, Mus musculus
ccatcctctgatacatgcggctgga

SEQ ID NO: 341961 - DNA, 25 bp, Mus musculus
ccatcctctgattcatgcggctgga

SEQ ID NO: 341962 - DNA, 25 bp, Mus musculus
ccatcctgaaggcactgggactttg

SEQ ID NO: 341963 - DNA, 25 bp, Mus musculus
ccatcctgaagggactgggactttg

SEQ ID NO: 341964 - DNA, 25 bp, Mus musculus
ccatcctgaggtagttggtggaaga

SEQ ID NO: 341965 - DNA, 25 bp, Mus musculus
ccatcctgaggttgttggtggaaga

SEQ ID NO: 341966 - DNA, 25 bp, Mus musculus
ccatcctgccagaatgttggtgaca

SEQ ID NO: 341967 - DNA, 25 bp, Mus musculus
ccatcctgccagtatgttggtgaca

SEQ ID NO: 341968 - DNA, 25 bp, Mus musculus
ccatcctgcgtcaggacttggctgg

SEQ ID NO: 341969 - DNA, 25 bp, Mus musculus
ccatcctgcgtctggacttggctgg

SEQ ID NO: 341970 - DNA, 25 bp, Mus musculus
ccatcctgctgtaaagttactttca

SEQ ID NO: 341971 - DNA, 25 bp, Mus musculus
ccatcctgctgttaagttactttca

SEQ ID NO: 341972 - DNA, 25 bp, Mus musculus
ccatcctggaatatggtccataact

SEQ ID NO: 341973 - DNA, 25 bp, Mus musculus
ccatcctggaatttggtccataact

SEQ ID NO: 341974 - DNA, 25 bp, Mus musculus
ccatcctggagtatgacaaaccgga

SEQ ID NO: 341975 - DNA, 25 bp, Mus musculus
ccatcctggagtttgacaaaccgga

SEQ ID NO: 341976 - DNA, 25 bp, Mus musculus
ccatcctggcataattggtaaattc

SEQ ID NO: 341977 - DNA, 25 bp, Mus musculus
ccatcctggcattattggtaaattc

SEQ ID NO: 341978 - DNA, 25 bp, Mus musculus
ccatcctgggcaccatagggtgatc

SEQ ID NO: 341979 - DNA, 25 bp, Mus musculus
ccatcctgggcagcatagggtgatc

SEQ ID NO: 341980 - DNA, 25 bp, Mus musculus
ccatcctggtgtaggaagcctgaac

SEQ ID NO: 341981 - DNA, 25 bp, Mus musculus
ccatcctggtgttggaagcctgaac

SEQ ID NO: 341982 - DNA, 25 bp, Mus musculus
ccatcctgtgtgctgagctctgtag

SEQ ID NO: 341983 - DNA, 25 bp, Mus musculus
ccatcctgtgtggtgagctctgtag

SEQ ID NO: 341984 - DNA, 25 bp, Mus musculus
ccatcctgtgttagtgcccgcttag

SEQ ID NO: 341985 - DNA, 25 bp, Mus musculus
ccatcctgtgtttgtgcccgcttag

SEQ ID NO: 341986 - DNA, 25 bp, Mus musculus
ccatcctgttagcttttacatcatt

SEQ ID NO: 341987 - DNA, 25 bp, Mus musculus
ccatcctgttaggttttacatcatt

SEQ ID NO: 341988 - DNA, 25 bp, Mus musculus
ccatcctgttgtctgtctagtccct

SEQ ID NO: 341989 - DNA, 25 bp, Mus musculus
ccatcctgttgtgtgtctagtccct

SEQ ID NO: 341990 - DNA, 25 bp, Mus musculus
ccatccttaaaaagatccttgccca

SEQ ID NO: 341991 - DNA, 25 bp, Mus musculus
ccatccttaaaatgatccttgccca

SEQ ID NO: 341992 - DNA, 25 bp, Mus musculus
ccatccttaactctgaaagagttga

SEQ ID NO: 341993 - DNA, 25 bp, Mus musculus
ccatccttaactgtgaaagagttga

SEQ ID NO: 341994 - DNA, 25 bp, Mus musculus
ccatccttacatccatccttttatt

SEQ ID NO: 341995 - DNA, 25 bp, Mus musculus
ccatccttacatgcatccttttatt

SEQ ID NO: 341996 - DNA, 25 bp, Mus musculus
ccatccttccttctggtgtatgtaa

SEQ ID NO: 341997 - DNA, 25 bp, Mus musculus
ccatccttccttgtggtgtatgtaa

SEQ ID NO: 341998 - DNA, 25 bp, Mus musculus
ccatccttgatcacatcgagcgtaa

SEQ ID NO: 341999 - DNA, 25 bp, Mus musculus
ccatccttgatctcatcgagcgtaa

SEQ ID NO: 342000 - DNA, 25 bp, Mus musculus
ccatcctttctcaggcacagaagaa

SEQ ID NO: 342001 - DNA, 25 bp, Mus musculus
ccatcctttctctggcacagaagaa

SEQ ID NO: 342002 - DNA, 25 bp, Mus musculus
ccatcgaatttaaggcttcatctgt

SEQ ID NO: 342003 - DNA, 25 bp, Mus musculus
ccatcgaatttatggcttcatctgt

SEQ ID NO: 342004 - DNA, 25 bp, Mus musculus
ccatcgacaaccacccaatgaatag

SEQ ID NO: 342005 - DNA, 25 bp, Mus musculus
ccatcgacaacctcccaatgaatag

SEQ ID NO: 342006 - DNA, 25 bp, Mus musculus
ccatcgactcaccggatattgacca

SEQ ID NO: 342007 - DNA, 25 bp, Mus musculus
ccatcgactcacgggatattgacca

SEQ ID NO: 342008 - DNA, 25 bp, Mus musculus
ccatcgagaaacaggccgtgtctga

SEQ ID NO: 342009 - DNA, 25 bp, Mus musculus
ccatcgagaaactggccgtgtctga

SEQ ID NO: 342010 - DNA, 25 bp, Mus musculus
ccatcgagctgcatagctatacttc

SEQ ID NO: 342011 - DNA, 25 bp, Mus musculus
ccatcgagctgcttagctatacttc

SEQ ID NO: 342012 - DNA, 25 bp, Mus musculus
ccatcgattccacctaggctatata

SEQ ID NO: 342013 - DNA, 25 bp, Mus musculus
ccatcgattccagctaggctatata

SEQ ID NO: 342014 - DNA, 25 bp, Mus musculus
ccatcgcacttaaacttgaggaaga

SEQ ID NO: 342015 - DNA, 25 bp, Mus musculus
ccatcgcacttatacttgaggaaga

SEQ ID NO: 342016 - DNA, 25 bp, Mus musculus
ccatcgctgattcaaatgagtggtt

SEQ ID NO: 342017 - DNA, 25 bp, Mus musculus
ccatcgctgattgaaatgagtggtt

SEQ ID NO: 342018 - DNA, 25 bp, Mus musculus
ccatcggcaatcaacacgggaagcg

SEQ ID NO: 342019 - DNA, 25 bp, Mus musculus
ccatcggcaatctacacgggaagcg

SEQ ID NO: 342020 - DNA, 25 bp, Mus musculus
ccatcggccaggaaattcaagaggg

SEQ ID NO: 342021 - DNA, 25 bp, Mus musculus
ccatcggccaggtaattcaagaggg

SEQ ID NO: 342022 - DNA, 25 bp, Mus musculus
ccatcggctgaaatacgggttactg

SEQ ID NO: 342023 - DNA, 25 bp, Mus musculus
ccatcggctgaattacgggttactg

SEQ ID NO: 342024 - DNA, 25 bp, Mus musculus
ccatcgggagccaagctgacattaa

SEQ ID NO: 342025 - DNA, 25 bp, Mus musculus
ccatcgggagcctagctgacattaa

SEQ ID NO: 342026 - DNA, 25 bp, Mus musculus
ccatcgggccacagtgtgcaaaggt

SEQ ID NO: 342027 - DNA, 25 bp, Mus musculus
ccatcgggccactgtgtgcaaaggt

SEQ ID NO: 342028 - DNA, 25 bp, Mus musculus
ccatcggtagatattgtttgtacaa

SEQ ID NO: 342029 - DNA, 25 bp, Mus musculus
ccatcggtagattttgtttgtacaa

SEQ ID NO: 342030 - DNA, 25 bp, Mus musculus
ccatcgtccccacaatcaaaagtga

SEQ ID NO: 342031 - DNA, 25 bp, Mus musculus
ccatcgtccccagaatcaaaagtga

SEQ ID NO: 342032 - DNA, 25 bp, Mus musculus
ccatcgtcttcaacctttagtgtat

SEQ ID NO: 342033 - DNA, 25 bp, Mus musculus
ccatcgtcttcatcctttagtgtat

SEQ ID NO: 342034 - DNA, 25 bp, Mus musculus
ccatcgtgaaaaaagacttcctttt

SEQ ID NO: 342035 - DNA, 25 bp, Mus musculus
ccatcgtgaaaatagacttcctttt

SEQ ID NO: 342036 - DNA, 25 bp, Mus musculus
ccatcgtgagcactgcatgtgtgtg

SEQ ID NO: 342037 - DNA, 25 bp, Mus musculus
ccatcgtgagcagtgcatgtgtgtg

SEQ ID NO: 342038 - DNA, 25 bp, Mus musculus
ccatcgtgggcgctattcttatagg

SEQ ID NO: 342039 - DNA, 25 bp, Mus musculus
ccatcgtgggcggtattcttatagg

SEQ ID NO: 342040 - DNA, 25 bp, Mus musculus
ccatcgttcattctcaggggccaga

SEQ ID NO: 342041 - DNA, 25 bp, Mus musculus
ccatcgttcattgtcaggggccaga

SEQ ID NO: 342042 - DNA, 25 bp, Mus musculus
ccatcgttctacacaaaggttgtta

SEQ ID NO: 342043 - DNA, 25 bp, Mus musculus
ccatcgttctactcaaaggttgtta

SEQ ID NO: 342044 - DNA, 25 bp, Mus musculus
ccatcgttgctcagtccagatatga

SEQ ID NO: 342045 - DNA, 25 bp, Mus musculus
ccatcgttgctctgtccagatatga

SEQ ID NO: 342046 - DNA, 25 bp, Mus musculus
ccatcgtttctacatttgtggaact

SEQ ID NO: 342047 - DNA, 25 bp, Mus musculus
ccatcgtttctagatttgtggaact

SEQ ID NO: 342048 - DNA, 25 bp, Mus musculus
ccatctaaccagcatgtactgacat

SEQ ID NO: 342049 - DNA, 25 bp, Mus musculus
ccatctaaccaggatgtactgacat

SEQ ID NO: 342050 - DNA, 25 bp, Mus musculus
ccatctaagccgcaaggtgtttctt

SEQ ID NO: 342051 - DNA, 25 bp, Mus musculus
ccatctaagccggaaggtgtttctt

SEQ ID NO: 342052 - DNA, 25 bp, Mus musculus
ccatctaaggatactctctgctttg

SEQ ID NO: 342053 - DNA, 25 bp, Mus musculus
ccatctaaggattctctctgctttg

SEQ ID NO: 342054 - DNA, 25 bp, Mus musculus
ccatctacacggcagaatacaggct

SEQ ID NO: 342055 - DNA, 25 bp, Mus musculus
ccatctacacgggagaatacaggct

SEQ ID NO: 342056 - DNA, 25 bp, Mus musculus
ccatctacccgcagggagtatataa

SEQ ID NO: 342057 - DNA, 25 bp, Mus musculus
ccatctacccgctgggagtatataa

SEQ ID NO: 342058 - DNA, 25 bp, Mus musculus
ccatctataaggaatctgattccct

SEQ ID NO: 342059 - DNA, 25 bp, Mus musculus
ccatctataaggtatctgattccct

SEQ ID NO: 342060 - DNA, 25 bp, Mus musculus
ccatctatccctcctcagagatgag

SEQ ID NO: 342061 - DNA, 25 bp, Mus musculus
ccatctatccctgctcagagatgag

SEQ ID NO: 342062 - DNA, 25 bp, Mus musculus
ccatctatctgcaggtgactcacaa

SEQ ID NO: 342063 - DNA, 25 bp, Mus musculus
ccatctatctgctggtgactcacaa

SEQ ID NO: 342064 - DNA, 25 bp, Mus musculus
ccatctatggatccttcgcttttga

SEQ ID NO: 342065 - DNA, 25 bp, Mus musculus
ccatctatggatgcttcgcttttga

SEQ ID NO: 342066 - DNA, 25 bp, Mus musculus
ccatctattaagcacattgaagcag

SEQ ID NO: 342067 - DNA, 25 bp, Mus musculus
ccatctattaaggacattgaagcag

SEQ ID NO: 342068 - DNA, 25 bp, Mus musculus
ccatctcaacaaagggcacaaagag

SEQ ID NO: 342069 - DNA, 25 bp, Mus musculus
ccatctcaacaatgggcacaaagag

SEQ ID NO: 342070 - DNA, 25 bp, Mus musculus
ccatctcaatccctgagacacagag

SEQ ID NO: 342071 - DNA, 25 bp, Mus musculus
ccatctcaatccgtgagacacagag

SEQ ID NO: 342072 - DNA, 25 bp, Mus musculus
ccatctcaatgtcagtgtgagctaa

SEQ ID NO: 342073 - DNA, 25 bp, Mus musculus
ccatctcaatgtgagtgtgagctaa

SEQ ID NO: 342074 - DNA, 25 bp, Mus musculus
ccatctcaattaactctggatccta

SEQ ID NO: 342075 - DNA, 25 bp, Mus musculus
ccatctcaattatctctggatccta

SEQ ID NO: 342076 - DNA, 25 bp, Mus musculus
ccatctcacctgcaggcggtaggaa

SEQ ID NO: 342077 - DNA, 25 bp, Mus musculus
ccatctcacctggaggcggtaggaa

SEQ ID NO: 342078 - DNA, 25 bp, Mus musculus
ccatctcactgtacttcacatagga

SEQ ID NO: 342079 - DNA, 25 bp, Mus musculus
ccatctcactgtagctgcagaggat

SEQ ID NO: 342080 - DNA, 25 bp, Mus musculus
ccatctcactgttcttcacatagga

SEQ ID NO: 342081 - DNA, 25 bp, Mus musculus
ccatctcactgttgctgcagaggat

SEQ ID NO: 342082 - DNA, 25 bp, Mus musculus
ccatctcagagccatgcggttaatt

SEQ ID NO: 342083 - DNA, 25 bp, Mus musculus
ccatctcagagcgatgcggttaatt

SEQ ID NO: 342084 - DNA, 25 bp, Mus musculus
ccatctcatctgatcaactcttaac

SEQ ID NO: 342085 - DNA, 25 bp, Mus musculus
ccatctcatctgttcaactcttaac

SEQ ID NO: 342086 - DNA, 25 bp, Mus musculus
ccatctccaaatacctcgggttgaa

SEQ ID NO: 342087 - DNA, 25 bp, Mus musculus
ccatctccaaattcctcgggttgaa

SEQ ID NO: 342088 - DNA, 25 bp, Mus musculus
ccatctccaatgagaaattcccggg

SEQ ID NO: 342089 - DNA, 25 bp, Mus musculus
ccatctccaatgtgaaattcccggg

SEQ ID NO: 342090 - DNA, 25 bp, Mus musculus
ccatctccagagaccattctaagac

SEQ ID NO: 342091 - DNA, 25 bp, Mus musculus
ccatctccagagtccattctaagac

SEQ ID NO: 342092 - DNA, 25 bp, Mus musculus
ccatctccagccagcatgaacaaaa

SEQ ID NO: 342093 - DNA, 25 bp, Mus musculus
ccatctccagcctgcatgaacaaaa

SEQ ID NO: 342094 - DNA, 25 bp, Mus musculus
ccatctccatccatttgatatagtg

SEQ ID NO: 342095 - DNA, 25 bp, Mus musculus
ccatctccatccttttgatatagtg

SEQ ID NO: 342096 - DNA, 25 bp, Mus musculus
ccatctcccgtactatatgacacag

SEQ ID NO: 342097 - DNA, 25 bp, Mus musculus
ccatctcccgtagtatatgacacag

SEQ ID NO: 342098 - DNA, 25 bp, Mus musculus
ccatctccgtggatagcatccagta

SEQ ID NO: 342099 - DNA, 25 bp, Mus musculus
ccatctccgtggttagcatccagta

SEQ ID NO: 342100 - DNA, 25 bp, Mus musculus
ccatctcctctcctatttttacaat

SEQ ID NO: 342101 - DNA, 25 bp, Mus musculus
ccatctcctctcgtatttttacaat

SEQ ID NO: 342102 - DNA, 25 bp, Mus musculus
ccatctcctgatcagaaaggtcaga

SEQ ID NO: 342103 - DNA, 25 bp, Mus musculus
ccatctcctgatgagaaaggtcaga

SEQ ID NO: 342104 - DNA, 25 bp, Mus musculus
ccatctcctgtacagtttcaaatca

SEQ ID NO: 342105 - DNA, 25 bp, Mus musculus
ccatctcctgtagagtttcaaatca

SEQ ID NO: 342106 - DNA, 25 bp, Mus musculus
ccatctccttctcccaaaatattta

SEQ ID NO: 342107 - DNA, 25 bp, Mus musculus
ccatctccttctgccaaaatattta

SEQ ID NO: 342108 - DNA, 25 bp, Mus musculus
ccatctcctttcacacagccttggt

SEQ ID NO: 342109 - DNA, 25 bp, Mus musculus
ccatctcctttctcacagccttggt

SEQ ID NO: 342110 - DNA, 25 bp, Mus musculus
ccatctcggaaaaagacagatacta

SEQ ID NO: 342111 - DNA, 25 bp, Mus musculus
ccatctcggaaatagacagatacta

SEQ ID NO: 342112 - DNA, 25 bp, Mus musculus
ccatctcgggccacagtaaactgaa

SEQ ID NO: 342113 - DNA, 25 bp, Mus musculus
ccatctcgggcctcagtaaactgaa

SEQ ID NO: 342114 - DNA, 25 bp, Mus musculus
ccatctctccatatcttagatataa

SEQ ID NO: 342115 - DNA, 25 bp, Mus musculus
ccatctctccatttcttagatataa

SEQ ID NO: 342116 - DNA, 25 bp, Mus musculus
ccatctctcttaaaacaaggaaata

SEQ ID NO: 342117 - DNA, 25 bp, Mus musculus
ccatctctcttataacaaggaaata

SEQ ID NO: 342118 - DNA, 25 bp, Mus musculus
ccatctctgcaactacttttcatga

SEQ ID NO: 342119 - DNA, 25 bp, Mus musculus
ccatctctgcaagtacttttcatga

SEQ ID NO: 342120 - DNA, 25 bp, Mus musculus
ccatctctggctcggatcaactaat

SEQ ID NO: 342121 - DNA, 25 bp, Mus musculus
ccatctctggctgggatcaactaat

SEQ ID NO: 342122 - DNA, 25 bp, Mus musculus
ccatctctgggtacacagaaactga

SEQ ID NO: 342123 - DNA, 25 bp, Mus musculus
ccatctctgggttcacagaaactga

SEQ ID NO: 342124 - DNA, 25 bp, Mus musculus
ccatctcttcagcttcctaaatttt

SEQ ID NO: 342125 - DNA, 25 bp, Mus musculus
ccatctcttcaggttcctaaatttt

SEQ ID NO: 342126 - DNA, 25 bp, Mus musculus
ccatctcttgatctagttttacgga

SEQ ID NO: 342127 - DNA, 25 bp, Mus musculus
ccatctcttgatgtagttttacgga

SEQ ID NO: 342128 - DNA, 25 bp, Mus musculus
ccatctgacactccagtccaagaga

SEQ ID NO: 342129 - DNA, 25 bp, Mus musculus
ccatctgacactgcagtccaagaga

SEQ ID NO: 342130 - DNA, 25 bp, Mus musculus
ccatctgacattagtgtgctcctaa

SEQ ID NO: 342131 - DNA, 25 bp, Mus musculus
ccatctgacatttgtgtgctcctaa

SEQ ID NO: 342132 - DNA, 25 bp, Mus musculus
ccatctgactggcctgcaggaagtg

SEQ ID NO: 342133 - DNA, 25 bp, Mus musculus
ccatctgactgggctgcaggaagtg

SEQ ID NO: 342134 - DNA, 25 bp, Mus musculus
ccatctgccacgatggaactttgat

SEQ ID NO: 342135 - DNA, 25 bp, Mus musculus
ccatctgccacgttggaactttgat

SEQ ID NO: 342136 - DNA, 25 bp, Mus musculus
ccatctgcccagaaaaggtctttct

SEQ ID NO: 342137 - DNA, 25 bp, Mus musculus
ccatctgcccagtaaaggtctttct

SEQ ID NO: 342138 - DNA, 25 bp, Mus musculus
ccatctgcccatcaatggtcctggg

SEQ ID NO: 342139 - DNA, 25 bp, Mus musculus
ccatctgcccatgaatggtcctggg

SEQ ID NO: 342140 - DNA, 25 bp, Mus musculus
ccatctgccctcctaatattgaaag

SEQ ID NO: 342141 - DNA, 25 bp, Mus musculus
ccatctgccctcgtaatattgaaag

SEQ ID NO: 342142 - DNA, 25 bp, Mus musculus
ccatctgcttctagggatattagat

SEQ ID NO: 342143 - DNA, 25 bp, Mus musculus
ccatctgcttcttgggatattagat

SEQ ID NO: 342144 - DNA, 25 bp, Mus musculus
ccatctgcttgcctcaagtctggaa

SEQ ID NO: 342145 - DNA, 25 bp, Mus musculus
ccatctgcttgcgtcaagtctggaa

SEQ ID NO: 342146 - DNA, 25 bp, Mus musculus
ccatctggaattaagtgacatgctt

SEQ ID NO: 342147 - DNA, 25 bp, Mus musculus
ccatctggaatttagtgacatgctt

SEQ ID NO: 342148 - DNA, 25 bp, Mus musculus
ccatctggagccacattccaaggga

SEQ ID NO: 342149 - DNA, 25 bp, Mus musculus
ccatctggagcctcattccaaggga

SEQ ID NO: 342150 - DNA, 25 bp, Mus musculus
ccatctggagctccatgagcttgct

SEQ ID NO: 342151 - DNA, 25 bp, Mus musculus
ccatctggagctgcatgagcttgct

SEQ ID NO: 342152 - DNA, 25 bp, Mus musculus
ccatctggcatcattgttctctttg

SEQ ID NO: 342153 - DNA, 25 bp, Mus musculus
ccatctggcatctttgttctctttg

SEQ ID NO: 342154 - DNA, 25 bp, Mus musculus
ccatctggccccattgttttgctca

SEQ ID NO: 342155 - DNA, 25 bp, Mus musculus
ccatctggcccctttgttttgctca

SEQ ID NO: 342156 - DNA, 25 bp, Mus musculus
ccatctgggataaaactacccttag

SEQ ID NO: 342157 - DNA, 25 bp, Mus musculus
ccatctgggatataactacccttag

SEQ ID NO: 342158 - DNA, 25 bp, Mus musculus
ccatctggtctgattttatttaact

SEQ ID NO: 342159 - DNA, 25 bp, Mus musculus
ccatctggtctgtttttatttaact

SEQ ID NO: 342160 - DNA, 25 bp, Mus musculus
ccatctggtggcctgtcttgtctat

SEQ ID NO: 342161 - DNA, 25 bp, Mus musculus
ccatctggtggcgtgtcttgtctat

SEQ ID NO: 342162 - DNA, 25 bp, Mus musculus
ccatctggttgcatcatgtatatat

SEQ ID NO: 342163 - DNA, 25 bp, Mus musculus
ccatctggttgcttcatgtatatat

SEQ ID NO: 342164 - DNA, 25 bp, Mus musculus
ccatctgtaattaccttggcacaat

SEQ ID NO: 342165 - DNA, 25 bp, Mus musculus
ccatctgtaatttccttggcacaat

SEQ ID NO: 342166 - DNA, 25 bp, Mus musculus
ccatctgtattcattcctggaggat

SEQ ID NO: 342167 - DNA, 25 bp, Mus musculus
ccatctgtattctttcctggaggat

SEQ ID NO: 342168 - DNA, 25 bp, Mus musculus
ccatctgtctcgatcctaacaatag

SEQ ID NO: 342169 - DNA, 25 bp, Mus musculus
ccatctgtctcgttcctaacaatag

SEQ ID NO: 342170 - DNA, 25 bp, Mus musculus
ccatctgttaaccttgttttgtgat

SEQ ID NO: 342171 - DNA, 25 bp, Mus musculus
ccatctgttaacgttgttttgtgat

SEQ ID NO: 342172 - DNA, 25 bp, Mus musculus
ccatctgttcctcttcttttcataa

SEQ ID NO: 342173 - DNA, 25 bp, Mus musculus
ccatctgttcctgttcttttcataa

SEQ ID NO: 342174 - DNA, 25 bp, Mus musculus
ccatctgttctcaggaaaactttat

SEQ ID NO: 342175 - DNA, 25 bp, Mus musculus
ccatctgttctctggaaaactttat

SEQ ID NO: 342176 - DNA, 25 bp, Mus musculus
ccatcttaaccaacagacctacaga

SEQ ID NO: 342177 - DNA, 25 bp, Mus musculus
ccatcttaaccatcagacctacaga

SEQ ID NO: 342178 - DNA, 25 bp, Mus musculus
ccatcttaagttaatccctgaagcc

SEQ ID NO: 342179 - DNA, 25 bp, Mus musculus
ccatcttaagtttatccctgaagcc

SEQ ID NO: 342180 - DNA, 25 bp, Mus musculus
ccatcttaatcgacctcattcacaa

SEQ ID NO: 342181 - DNA, 25 bp, Mus musculus
ccatcttaatcgtcctcattcacaa

SEQ ID NO: 342182 - DNA, 25 bp, Mus musculus
ccatcttactgaatcgattagagtt

SEQ ID NO: 342183 - DNA, 25 bp, Mus musculus
ccatcttactgattcgattagagtt

SEQ ID NO: 342184 - DNA, 25 bp, Mus musculus
ccatcttagacaatgagggcacaag

SEQ ID NO: 342185 - DNA, 25 bp, Mus musculus
ccatcttagacaatgtgagcccact

SEQ ID NO: 342186 - DNA, 25 bp, Mus musculus
ccatcttagacattgagggcacaag

SEQ ID NO: 342187 - DNA, 25 bp, Mus musculus
ccatcttagacattgtgagcccact

SEQ ID NO: 342188 - DNA, 25 bp, Mus musculus
ccatcttaggacacagtctctatgg

SEQ ID NO: 342189 - DNA, 25 bp, Mus musculus
ccatcttaggactcagtctctatgg

SEQ ID NO: 342190 - DNA, 25 bp, Mus musculus
ccatcttaggctcggctctggcgag

SEQ ID NO: 342191 - DNA, 25 bp, Mus musculus
ccatcttaggctgggctctggcgag

SEQ ID NO: 342192 - DNA, 25 bp, Mus musculus
ccatcttatctcagtatggtacagg

SEQ ID NO: 342193 - DNA, 25 bp, Mus musculus
ccatcttatctctgtatggtacagg

SEQ ID NO: 342194 - DNA, 25 bp, Mus musculus
ccatcttcacacaaaaggtttagga

SEQ ID NO: 342195 - DNA, 25 bp, Mus musculus
ccatcttcacactaaaggtttagga

SEQ ID NO: 342196 - DNA, 25 bp, Mus musculus
ccatcttcactgatgatatcaaaat

SEQ ID NO: 342197 - DNA, 25 bp, Mus musculus
ccatcttcactgttgatatcaaaat

SEQ ID NO: 342198 - DNA, 25 bp, Mus musculus
ccatcttcagacagggctcttgtga

SEQ ID NO: 342199 - DNA, 25 bp, Mus musculus
ccatcttcagactgggctcttgtga

SEQ ID NO: 342200 - DNA, 25 bp, Mus musculus
ccatcttcagatagtgcaccacaga

SEQ ID NO: 342201 - DNA, 25 bp, Mus musculus
ccatcttcagattgtgcaccacaga

SEQ ID NO: 342202 - DNA, 25 bp, Mus musculus
ccatcttcaggccacacagatcaaa

SEQ ID NO: 342203 - DNA, 25 bp, Mus musculus
ccatcttcaggcgacacagatcaaa

SEQ ID NO: 342204 - DNA, 25 bp, Mus musculus
ccatcttcatcgagggaaacaaagg

SEQ ID NO: 342205 - DNA, 25 bp, Mus musculus
ccatcttcatcgtgggaaacaaagg

SEQ ID NO: 342206 - DNA, 25 bp, Mus musculus
ccatcttcatttcgcctcctgagaa

SEQ ID NO: 342207 - DNA, 25 bp, Mus musculus
ccatcttcatttggcctcctgagaa

SEQ ID NO: 342208 - DNA, 25 bp, Mus musculus
ccatcttctcttcgaggaaggaccg

SEQ ID NO: 342209 - DNA, 25 bp, Mus musculus
ccatcttctcttctgtcacttgttt

SEQ ID NO: 342210 - DNA, 25 bp, Mus musculus
ccatcttctcttggaggaaggaccg

SEQ ID NO: 342211 - DNA, 25 bp, Mus musculus
ccatcttctcttgtgtcacttgttt

SEQ ID NO: 342212 - DNA, 25 bp, Mus musculus
ccatcttctgcgctgggcattttaa

SEQ ID NO: 342213 - DNA, 25 bp, Mus musculus
ccatcttctgcggtgggcattttaa

SEQ ID NO: 342214 - DNA, 25 bp, Mus musculus
ccatcttgatggaatctgtgctgat

SEQ ID NO: 342215 - DNA, 25 bp, Mus musculus
ccatcttgatggtatctgtgctgat

SEQ ID NO: 342216 - DNA, 25 bp, Mus musculus
ccatcttgcactacttctagggtaa

SEQ ID NO: 342217 - DNA, 25 bp, Mus musculus
ccatcttgcacttcttctagggtaa

SEQ ID NO: 342218 - DNA, 25 bp, Mus musculus
ccatcttgcagaacttccgtttcaa

SEQ ID NO: 342219 - DNA, 25 bp, Mus musculus
ccatcttgcagatcttccgtttcaa

SEQ ID NO: 342220 - DNA, 25 bp, Mus musculus
ccatcttgccgtcttggacactgaa

SEQ ID NO: 342221 - DNA, 25 bp, Mus musculus
ccatcttgccgtgttggacactgaa

SEQ ID NO: 342222 - DNA, 25 bp, Mus musculus
ccatcttgctggacccaaaagaaag

SEQ ID NO: 342223 - DNA, 25 bp, Mus musculus
ccatcttgctggtcccaaaagaaag

SEQ ID NO: 342224 - DNA, 25 bp, Mus musculus
ccatcttggagcagaggcgtcacct

SEQ ID NO: 342225 - DNA, 25 bp, Mus musculus
ccatcttggagctgaggcgtcacct

SEQ ID NO: 342226 - DNA, 25 bp, Mus musculus
ccatcttgtgtgctcctgtctggat

SEQ ID NO: 342227 - DNA, 25 bp, Mus musculus
ccatcttgtgtggtcctgtctggat

SEQ ID NO: 342228 - DNA, 25 bp, Mus musculus
ccatcttgttgtccaggagttcagt

SEQ ID NO: 342229 - DNA, 25 bp, Mus musculus
ccatcttgttgtgcaggagttcagt

SEQ ID NO: 342230 - DNA, 25 bp, Mus musculus
ccatctttattgaagggaccaggat

SEQ ID NO: 342231 - DNA, 25 bp, Mus musculus
ccatctttattgtagggaccaggat

SEQ ID NO: 342232 - DNA, 25 bp, Mus musculus
ccatctttctagctgcttgtggcat

SEQ ID NO: 342233 - DNA, 25 bp, Mus musculus
ccatctttctaggtgcttgtggcat

SEQ ID NO: 342234 - DNA, 25 bp, Mus musculus
ccatctttctccagccataagaggg

SEQ ID NO: 342235 - DNA, 25 bp, Mus musculus
ccatctttctcctgccataagaggg

SEQ ID NO: 342236 - DNA, 25 bp, Mus musculus
ccatctttgactaaggaggtggaaa

SEQ ID NO: 342237 - DNA, 25 bp, Mus musculus
ccatctttgacttaggaggtggaaa

SEQ ID NO: 342238 - DNA, 25 bp, Mus musculus
ccatctttggcccttaattttgatt

SEQ ID NO: 342239 - DNA, 25 bp, Mus musculus
ccatctttggccgttaattttgatt

SEQ ID NO: 342240 - DNA, 25 bp, Mus musculus
ccatctttgggcaactgtaatatga

SEQ ID NO: 342241 - DNA, 25 bp, Mus musculus
ccatctttgggctactgtaatatga

SEQ ID NO: 342242 - DNA, 25 bp, Mus musculus
ccatctttgttacgtagggttctct

SEQ ID NO: 342243 - DNA, 25 bp, Mus musculus
ccatctttgttaggtagggttctct

SEQ ID NO: 342244 - DNA, 25 bp, Mus musculus
ccatgaaagagtatctgtccaccag

SEQ ID NO: 342245 - DNA, 25 bp, Mus musculus
ccatgaaagagtttctgtccaccag

SEQ ID NO: 342246 - DNA, 25 bp, Mus musculus
ccatgaaagtagccctcgggtccca

SEQ ID NO: 342247 - DNA, 25 bp, Mus musculus
ccatgaaagtaggcctcgggtccca

SEQ ID NO: 342248 - DNA, 25 bp, Mus musculus
ccatgaacaagacgagtcagagact

SEQ ID NO: 342249 - DNA, 25 bp, Mus musculus
ccatgaacaagaggagtcagagact

SEQ ID NO: 342250 - DNA, 25 bp, Mus musculus
ccatgaacacatacggtggcgaggt

SEQ ID NO: 342251 - DNA, 25 bp, Mus musculus
ccatgaacacattcggtggcgaggt

SEQ ID NO: 342252 - DNA, 25 bp, Mus musculus
ccatgaacaccaagatgtgtacatg

SEQ ID NO: 342253 - DNA, 25 bp, Mus musculus
ccatgaacaccatgatgtgtacatg

SEQ ID NO: 342254 - DNA, 25 bp, Mus musculus
ccatgaacactcctcactgaaagat

SEQ ID NO: 342255 - DNA, 25 bp, Mus musculus
ccatgaacactcgtcactgaaagat

SEQ ID NO: 342256 - DNA, 25 bp, Mus musculus
ccatgaacctccagttagccttgtg

SEQ ID NO: 342257 - DNA, 25 bp, Mus musculus
ccatgaacctcctgttagccttgtg

SEQ ID NO: 342258 - DNA, 25 bp, Mus musculus
ccatgaacggctatcaaattggaat

SEQ ID NO: 342259 - DNA, 25 bp, Mus musculus
ccatgaacggctttcaaattggaat

SEQ ID NO: 342260 - DNA, 25 bp, Mus musculus
ccatgaagaataagccactagatat

SEQ ID NO: 342261 - DNA, 25 bp, Mus musculus
ccatgaagaatatgccactagatat

SEQ ID NO: 342262 - DNA, 25 bp, Mus musculus
ccatgaagagcaagctgataagcag

SEQ ID NO: 342263 - DNA, 25 bp, Mus musculus
ccatgaagagcatgctgataagcag

SEQ ID NO: 342264 - DNA, 25 bp, Mus musculus
ccatgaagcaggaaggcgaggacaa

SEQ ID NO: 342265 - DNA, 25 bp, Mus musculus
ccatgaagcaggaggcaggtaccat

SEQ ID NO: 342266 - DNA, 25 bp, Mus musculus
ccatgaagcaggtaggcgaggacaa

SEQ ID NO: 342267 - DNA, 25 bp, Mus musculus
ccatgaagcaggtggcaggtaccat

SEQ ID NO: 342268 - DNA, 25 bp, Mus musculus
ccatgaagcagtctttgaggtccaa

SEQ ID NO: 342269 - DNA, 25 bp, Mus musculus
ccatgaagcagtgtttgaggtccaa

SEQ ID NO: 342270 - DNA, 25 bp, Mus musculus
ccatgaagccccaattccttaagga

SEQ ID NO: 342271 - DNA, 25 bp, Mus musculus
ccatgaagcccctattccttaagga

SEQ ID NO: 342272 - DNA, 25 bp, Mus musculus
ccatgaaggctgaacttgcggactt

SEQ ID NO: 342273 - DNA, 25 bp, Mus musculus
ccatgaaggctgtacttgcggactt

SEQ ID NO: 342274 - DNA, 25 bp, Mus musculus
ccatgaataattatgtgccgtcttt

SEQ ID NO: 342275 - DNA, 25 bp, Mus musculus
ccatgaataattttgtgccgtcttt

SEQ ID NO: 342276 - DNA, 25 bp, Mus musculus
ccatgaatccttccctgtgagaata

SEQ ID NO: 342277 - DNA, 25 bp, Mus musculus
ccatgaatccttgcctgtgagaata

SEQ ID NO: 342278 - DNA, 25 bp, Mus musculus
ccatgaattaccaggaccgtttctt

SEQ ID NO: 342279 - DNA, 25 bp, Mus musculus
ccatgaattacctggaccgtttctt

SEQ ID NO: 342280 - DNA, 25 bp, Mus musculus
ccatgacaccctaagcaattatggg

SEQ ID NO: 342281 - DNA, 25 bp, Mus musculus
ccatgacacccttagcaattatggg

SEQ ID NO: 342282 - DNA, 25 bp, Mus musculus
ccatgacactgcactctttggagtt

SEQ ID NO: 342283 - DNA, 25 bp, Mus musculus
ccatgacactgctctctttggagtt

SEQ ID NO: 342284 - DNA, 25 bp, Mus musculus
ccatgacagacactctgtccctaag

SEQ ID NO: 342285 - DNA, 25 bp, Mus musculus
ccatgacagacagtctgtccctaag

SEQ ID NO: 342286 - DNA, 25 bp, Mus musculus
ccatgaccatttactaagtgaatga

SEQ ID NO: 342287 - DNA, 25 bp, Mus musculus
ccatgaccattttctaagtgaatga

SEQ ID NO: 342288 - DNA, 25 bp, Mus musculus
ccatgacccgagcaatcacaggaag

SEQ ID NO: 342289 - DNA, 25 bp, Mus musculus
ccatgacccgaggaatcacaggaag

SEQ ID NO: 342290 - DNA, 25 bp, Mus musculus
ccatgaccctgcagtcacagaagtt

SEQ ID NO: 342291 - DNA, 25 bp, Mus musculus
ccatgaccctgctgtcacagaagtt

SEQ ID NO: 342292 - DNA, 25 bp, Mus musculus
ccatgacgacttcccgagaatggct

SEQ ID NO: 342293 - DNA, 25 bp, Mus musculus
ccatgacgacttgccgagaatggct

SEQ ID NO: 342294 - DNA, 25 bp, Mus musculus
ccatgactaactctgtaagtgctta

SEQ ID NO: 342295 - DNA, 25 bp, Mus musculus
ccatgactaactgtgtaagtgctta

SEQ ID NO: 342296 - DNA, 25 bp, Mus musculus
ccatgactgttcattcggtgtcagt

SEQ ID NO: 342297 - DNA, 25 bp, Mus musculus
ccatgactgttctttcggtgtcagt

SEQ ID NO: 342298 - DNA, 25 bp, Mus musculus
ccatgagacgagctgcacgaggaca

SEQ ID NO: 342299 - DNA, 25 bp, Mus musculus
ccatgagacgaggtgcacgaggaca

SEQ ID NO: 342300 - DNA, 25 bp, Mus musculus
ccatgagactcaacctggagcagat

SEQ ID NO: 342301 - DNA, 25 bp, Mus musculus
ccatgagactcatcctggagcagat

SEQ ID NO: 342302 - DNA, 25 bp, Mus musculus
ccatgagagggcacaggcccgcggg

SEQ ID NO: 342303 - DNA, 25 bp, Mus musculus
ccatgagagggctcaggcccgcggg

SEQ ID NO: 342304 - DNA, 25 bp, Mus musculus
ccatgagagtcgactgagcagagtg

SEQ ID NO: 342305 - DNA, 25 bp, Mus musculus
ccatgagagtcgtctgagcagagtg

SEQ ID NO: 342306 - DNA, 25 bp, Mus musculus
ccatgagatgggatgacaggatcaa

SEQ ID NO: 342307 - DNA, 25 bp, Mus musculus
ccatgagatgggttgacaggatcaa

SEQ ID NO: 342308 - DNA, 25 bp, Mus musculus
ccatgagcaacaacccatcttatgt

SEQ ID NO: 342309 - DNA, 25 bp, Mus musculus
ccatgagcaacatcccatcttatgt

SEQ ID NO: 342310 - DNA, 25 bp, Mus musculus
ccatgagcacggatggcctgatgaa

SEQ ID NO: 342311 - DNA, 25 bp, Mus musculus
ccatgagcacggttggcctgatgaa

SEQ ID NO: 342312 - DNA, 25 bp, Mus musculus
ccatgagcactcaccagttattacg

SEQ ID NO: 342313 - DNA, 25 bp, Mus musculus
ccatgagcactctccagttattacg

SEQ ID NO: 342314 - DNA, 25 bp, Mus musculus
ccatgagcgaggacaggagttctta

SEQ ID NO: 342315 - DNA, 25 bp, Mus musculus
ccatgagcgaggtcaggagttctta

SEQ ID NO: 342316 - DNA, 25 bp, Mus musculus
ccatgaggacatcgccctgcatcag

SEQ ID NO: 342317 - DNA, 25 bp, Mus musculus
ccatgaggacatggccctgcatcag

SEQ ID NO: 342318 - DNA, 25 bp, Mus musculus
ccatgaggcagtagatcctaggcaa

SEQ ID NO: 342319 - DNA, 25 bp, Mus musculus
ccatgaggcagttgatcctaggcaa

SEQ ID NO: 342320 - DNA, 25 bp, Mus musculus
ccatgaggtttcattgtattaaaat

SEQ ID NO: 342321 - DNA, 25 bp, Mus musculus
ccatgaggtttctttgtattaaaat

SEQ ID NO: 342322 - DNA, 25 bp, Mus musculus
ccatgagtattcatcttttctgttc

SEQ ID NO: 342323 - DNA, 25 bp, Mus musculus
ccatgagtattcttcttttctgttc

SEQ ID NO: 342324 - DNA, 25 bp, Mus musculus
ccatgagttgatatcagcattggaa

SEQ ID NO: 342325 - DNA, 25 bp, Mus musculus
ccatgagttgatttcagcattggaa

SEQ ID NO: 342326 - DNA, 25 bp, Mus musculus
ccatgataacagaagcagcctaggc

SEQ ID NO: 342327 - DNA, 25 bp, Mus musculus
ccatgataacagtagcagcctaggc

SEQ ID NO: 342328 - DNA, 25 bp, Mus musculus
ccatgatacagtaccacgtggacga

SEQ ID NO: 342329 - DNA, 25 bp, Mus musculus
ccatgatacagttccacgtggacga

SEQ ID NO: 342330 - DNA, 25 bp, Mus musculus
ccatgatccaagatattaaatagaa

SEQ ID NO: 342331 - DNA, 25 bp, Mus musculus
ccatgatccaagttattaaatagaa

SEQ ID NO: 342332 - DNA, 25 bp, Mus musculus
ccatgatccctactagacacgtata

SEQ ID NO: 342333 - DNA, 25 bp, Mus musculus
ccatgatccctagtagacacgtata

SEQ ID NO: 342334 - DNA, 25 bp, Mus musculus
ccatgatcctggcagttgagggagg

SEQ ID NO: 342335 - DNA, 25 bp, Mus musculus
ccatgatcctgggagttgagggagg

SEQ ID NO: 342336 - DNA, 25 bp, Mus musculus
ccatgatgcagtcgcgggatgtccc

SEQ ID NO: 342337 - DNA, 25 bp, Mus musculus
ccatgatgcagtggcgggatgtccc

SEQ ID NO: 342338 - DNA, 25 bp, Mus musculus
ccatgatgctaaactgcttaatttt

SEQ ID NO: 342339 - DNA, 25 bp, Mus musculus
ccatgatgctaatctgcttaatttt

SEQ ID NO: 342340 - DNA, 25 bp, Mus musculus
ccatgatggaggcaccaggcgctaa

SEQ ID NO: 342341 - DNA, 25 bp, Mus musculus
ccatgatggagggaccaggcgctaa

SEQ ID NO: 342342 - DNA, 25 bp, Mus musculus
ccatgatggtctcctgattctttga

SEQ ID NO: 342343 - DNA, 25 bp, Mus musculus
ccatgatggtctgctgattctttga

SEQ ID NO: 342344 - DNA, 25 bp, Mus musculus
ccatgatgtcatagtgtgctgcaga

SEQ ID NO: 342345 - DNA, 25 bp, Mus musculus
ccatgatgtcatcttctatgtcaca

SEQ ID NO: 342346 - DNA, 25 bp, Mus musculus
ccatgatgtcatgttctatgtcaca

SEQ ID NO: 342347 - DNA, 25 bp, Mus musculus
ccatgatgtcattgtgtgctgcaga

SEQ ID NO: 342348 - DNA, 25 bp, Mus musculus
ccatgattaaaaccctctccgggag

SEQ ID NO: 342349 - DNA, 25 bp, Mus musculus
ccatgattaaaagcctctccgggag

SEQ ID NO: 342350 - DNA, 25 bp, Mus musculus
ccatgattcactcctataatcccag

SEQ ID NO: 342351 - DNA, 25 bp, Mus musculus
ccatgattcactgctataatcccag

SEQ ID NO: 342352 - DNA, 25 bp, Mus musculus
ccatgattcattacacctccaaaat

SEQ ID NO: 342353 - DNA, 25 bp, Mus musculus
ccatgattcatttcacctccaaaat

SEQ ID NO: 342354 - DNA, 25 bp, Mus musculus
ccatgattgcagcaaagtttagcat

SEQ ID NO: 342355 - DNA, 25 bp, Mus musculus
ccatgattgcaggaaagtttagcat

SEQ ID NO: 342356 - DNA, 25 bp, Mus musculus
ccatgattgcctcggaatggacagt

SEQ ID NO: 342357 - DNA, 25 bp, Mus musculus
ccatgattgcctgggaatggacagt

SEQ ID NO: 342358 - DNA, 25 bp, Mus musculus
ccatgattgtcacttccccacaccc

SEQ ID NO: 342359 - DNA, 25 bp, Mus musculus
ccatgattgtcagttccccacaccc

SEQ ID NO: 342360 - DNA, 25 bp, Mus musculus
ccatgattgtgtacttttgaggtca

SEQ ID NO: 342361 - DNA, 25 bp, Mus musculus
ccatgattgtgttcttttgaggtca

SEQ ID NO: 342362 - DNA, 25 bp, Mus musculus
ccatgcacacatataccaagaaggg

SEQ ID NO: 342363 - DNA, 25 bp, Mus musculus
ccatgcacacatttaccaagaaggg

SEQ ID NO: 342364 - DNA, 25 bp, Mus musculus
ccatgcacatatagagtcctcctga

SEQ ID NO: 342365 - DNA, 25 bp, Mus musculus
ccatgcacatattgagtcctcctga

SEQ ID NO: 342366 - DNA, 25 bp, Mus musculus
ccatgcactcagctctagaagggaa

SEQ ID NO: 342367 - DNA, 25 bp, Mus musculus
ccatgcactcaggtctagaagggaa

SEQ ID NO: 342368 - DNA, 25 bp, Mus musculus
ccatgcactgaacgctagctcatct

SEQ ID NO: 342369 - DNA, 25 bp, Mus musculus
ccatgcactgaaggctagctcatct

SEQ ID NO: 342370 - DNA, 25 bp, Mus musculus
ccatgcagaaggcaccgccaggaat

SEQ ID NO: 342371 - DNA, 25 bp, Mus musculus
ccatgcagaagggaccgccaggaat

SEQ ID NO: 342372 - DNA, 25 bp, Mus musculus
ccatgcagccttagggccccaggga

SEQ ID NO: 342373 - DNA, 25 bp, Mus musculus
ccatgcagcctttgggccccaggga

SEQ ID NO: 342374 - DNA, 25 bp, Mus musculus
ccatgcagcgatactttaaggatag

SEQ ID NO: 342375 - DNA, 25 bp, Mus musculus
ccatgcagcgattctttaaggatag

SEQ ID NO: 342376 - DNA, 25 bp, Mus musculus
ccatgcagcgccaggacttgaactt

SEQ ID NO: 342377 - DNA, 25 bp, Mus musculus
ccatgcagcgcctggacttgaactt

SEQ ID NO: 342378 - DNA, 25 bp, Mus musculus
ccatgcagctggaagataacatctt

SEQ ID NO: 342379 - DNA, 25 bp, Mus musculus
ccatgcagctggtagataacatctt

SEQ ID NO: 342380 - DNA, 25 bp, Mus musculus
ccatgcatcatgcagaggtgatatt

SEQ ID NO: 342381 - DNA, 25 bp, Mus musculus
ccatgcatcatggagaggtgatatt

SEQ ID NO: 342382 - DNA, 25 bp, Mus musculus
ccatgcatgctaacctggtactgga

SEQ ID NO: 342383 - DNA, 25 bp, Mus musculus
ccatgcatgctatcctggtactgga

SEQ ID NO: 342384 - DNA, 25 bp, Mus musculus
ccatgcatgctgaatgtagaggcta

SEQ ID NO: 342385 - DNA, 25 bp, Mus musculus
ccatgcatgctgtatgtagaggcta

SEQ ID NO: 342386 - DNA, 25 bp, Mus musculus
ccatgcattaccactgagactcaga

SEQ ID NO: 342387 - DNA, 25 bp, Mus musculus
ccatgcattacctctgagactcaga

SEQ ID NO: 342388 - DNA, 25 bp, Mus musculus
ccatgccaacttcaagctctactta

SEQ ID NO: 342389 - DNA, 25 bp, Mus musculus
ccatgccaacttgaagctctactta

SEQ ID NO: 342390 - DNA, 25 bp, Mus musculus
ccatgccactggcttgcggaaaact

SEQ ID NO: 342391 - DNA, 25 bp, Mus musculus
ccatgccactgggttgcggaaaact

SEQ ID NO: 342392 - DNA, 25 bp, Mus musculus
ccatgcccaaacagaaatacctgct

SEQ ID NO: 342393 - DNA, 25 bp, Mus musculus
ccatgcccaaactgaaatacctgct

SEQ ID NO: 342394 - DNA, 25 bp, Mus musculus
ccatgcccacatatttattccagtt

SEQ ID NO: 342395 - DNA, 25 bp, Mus musculus
ccatgcccacatttttattccagtt

SEQ ID NO: 342396 - DNA, 25 bp, Mus musculus
ccatgcccagcaactatgtgttttt

SEQ ID NO: 342397 - DNA, 25 bp, Mus musculus
ccatgcccagcatctatgtgttttt

SEQ ID NO: 342398 - DNA, 25 bp, Mus musculus
ccatgcccatcaacattgtatgtag

SEQ ID NO: 342399 - DNA, 25 bp, Mus musculus
ccatgcccatcatcattgtatgtag

SEQ ID NO: 342400 - DNA, 25 bp, Mus musculus
ccatgcccatgacttgaagataagg

SEQ ID NO: 342401 - DNA, 25 bp, Mus musculus
ccatgcccatgagttgaagataagg

SEQ ID NO: 342402 - DNA, 25 bp, Mus musculus
ccatgcccatggatgtgagtagaca

SEQ ID NO: 342403 - DNA, 25 bp, Mus musculus
ccatgcccatggttgtgagtagaca

SEQ ID NO: 342404 - DNA, 25 bp, Mus musculus
ccatgcccctgtaagcaagcttagt

SEQ ID NO: 342405 - DNA, 25 bp, Mus musculus
ccatgcccctgttagcaagcttagt

SEQ ID NO: 342406 - DNA, 25 bp, Mus musculus
ccatgccccttgcaactatacaaaa

SEQ ID NO: 342407 - DNA, 25 bp, Mus musculus
ccatgccccttggaactatacaaaa

SEQ ID NO: 342408 - DNA, 25 bp, Mus musculus
ccatgcccgagaagcagttggtgcc

SEQ ID NO: 342409 - DNA, 25 bp, Mus musculus
ccatgcccgagatgcagttggtgcc

SEQ ID NO: 342410 - DNA, 25 bp, Mus musculus
ccatgcccgggaatcgctgtactaa

SEQ ID NO: 342411 - DNA, 25 bp, Mus musculus
ccatgcccgggattcgctgtactaa

SEQ ID NO: 342412 - DNA, 25 bp, Mus musculus
ccatgccctatcatgctgttttaga

SEQ ID NO: 342413 - DNA, 25 bp, Mus musculus
ccatgccctatcttgctgttttaga

SEQ ID NO: 342414 - DNA, 25 bp, Mus musculus
ccatgcctagatattgctttctggc

SEQ ID NO: 342415 - DNA, 25 bp, Mus musculus
ccatgcctagattttgctttctggc

SEQ ID NO: 342416 - DNA, 25 bp, Mus musculus
ccatgcctaggcctgttagttagcc

SEQ ID NO: 342417 - DNA, 25 bp, Mus musculus
ccatgcctaggcgtgttagttagcc

SEQ ID NO: 342418 - DNA, 25 bp, Mus musculus
ccatgcctgacaaattggatgtagg

SEQ ID NO: 342419 - DNA, 25 bp, Mus musculus
ccatgcctgacatattggatgtagg

SEQ ID NO: 342420 - DNA, 25 bp, Mus musculus
ccatgcctgatgactctctagaaaa

SEQ ID NO: 342421 - DNA, 25 bp, Mus musculus
ccatgcctgatgtctctctagaaaa

SEQ ID NO: 342422 - DNA, 25 bp, Mus musculus
ccatgcctgggacactccataaaga

SEQ ID NO: 342423 - DNA, 25 bp, Mus musculus
ccatgcctgggagactccataaaga

SEQ ID NO: 342424 - DNA, 25 bp, Mus musculus
ccatgccttcaacgtcaaattttct

SEQ ID NO: 342425 - DNA, 25 bp, Mus musculus
ccatgccttcaaggtcaaattttct

SEQ ID NO: 342426 - DNA, 25 bp, Mus musculus
ccatgccttgatcctgcgcgagctt

SEQ ID NO: 342427 - DNA, 25 bp, Mus musculus
ccatgccttgatgctgcgcgagctt

SEQ ID NO: 342428 - DNA, 25 bp, Mus musculus
ccatgcctttgccaaacatcttcaa

SEQ ID NO: 342429 - DNA, 25 bp, Mus musculus
ccatgcctttgcgaaacatcttcaa

SEQ ID NO: 342430 - DNA, 25 bp, Mus musculus
ccatgcggtgtcctacatgcatcaa

SEQ ID NO: 342431 - DNA, 25 bp, Mus musculus
ccatgcggtgtcgtacatgcatcaa

SEQ ID NO: 342432 - DNA, 25 bp, Mus musculus
ccatgctagcttcaaaaggtatagt

SEQ ID NO: 342433 - DNA, 25 bp, Mus musculus
ccatgctagcttgaaaaggtatagt

SEQ ID NO: 342434 - DNA, 25 bp, Mus musculus
ccatgctatcttatttcgcttgtga

SEQ ID NO: 342435 - DNA, 25 bp, Mus musculus
ccatgctatcttttttcgcttgtga

SEQ ID NO: 342436 - DNA, 25 bp, Mus musculus
ccatgctcacagacacttacgtata

SEQ ID NO: 342437 - DNA, 25 bp, Mus musculus
ccatgctcacagtcacttacgtata

SEQ ID NO: 342438 - DNA, 25 bp, Mus musculus
ccatgctcactcaagtgccaagcaa

SEQ ID NO: 342439 - DNA, 25 bp, Mus musculus
ccatgctcactctagtgccaagcaa

SEQ ID NO: 342440 - DNA, 25 bp, Mus musculus
ccatgctcagctatgaggatagcct

SEQ ID NO: 342441 - DNA, 25 bp, Mus musculus
ccatgctcagctatgtagagagttc

SEQ ID NO: 342442 - DNA, 25 bp, Mus musculus
ccatgctcagctttgaggatagcct

SEQ ID NO: 342443 - DNA, 25 bp, Mus musculus
ccatgctcagctttgtagagagttc

SEQ ID NO: 342444 - DNA, 25 bp, Mus musculus
ccatgctccattatggctactggat

SEQ ID NO: 342445 - DNA, 25 bp, Mus musculus
ccatgctccattttggctactggat

SEQ ID NO: 342446 - DNA, 25 bp, Mus musculus
ccatgctcccagatgaagggctttt

SEQ ID NO: 342447 - DNA, 25 bp, Mus musculus
ccatgctcccagttgaagggctttt

SEQ ID NO: 342448 - DNA, 25 bp, Mus musculus
ccatgctcctggatcagctgaatta

SEQ ID NO: 342449 - DNA, 25 bp, Mus musculus
ccatgctcctggttcagctgaatta

SEQ ID NO: 342450 - DNA, 25 bp, Mus musculus
ccatgctccttgcttagcagagcga

SEQ ID NO: 342451 - DNA, 25 bp, Mus musculus
ccatgctccttggttagcagagcga

SEQ ID NO: 342452 - DNA, 25 bp, Mus musculus
ccatgctcgagaaacagtatgtgct

SEQ ID NO: 342453 - DNA, 25 bp, Mus musculus
ccatgctcgagatacagtatgtgct

SEQ ID NO: 342454 - DNA, 25 bp, Mus musculus
ccatgctctacaacttcaaattttt

SEQ ID NO: 342455 - DNA, 25 bp, Mus musculus
ccatgctctacatcttcaaattttt

SEQ ID NO: 342456 - DNA, 25 bp, Mus musculus
ccatgctctattcacctttttggtg

SEQ ID NO: 342457 - DNA, 25 bp, Mus musculus
ccatgctctattgacctttttggtg

SEQ ID NO: 342458 - DNA, 25 bp, Mus musculus
ccatgctctctgatacatttgggaa

SEQ ID NO: 342459 - DNA, 25 bp, Mus musculus
ccatgctctctgttacatttgggaa

SEQ ID NO: 342460 - DNA, 25 bp, Mus musculus
ccatgctgcactattttattctgcc

SEQ ID NO: 342461 - DNA, 25 bp, Mus musculus
ccatgctgcacttttttattctgcc

SEQ ID NO: 342462 - DNA, 25 bp, Mus musculus
ccatgctgctgactagttggatagc

SEQ ID NO: 342463 - DNA, 25 bp, Mus musculus
ccatgctgctgagtagttggatagc

SEQ ID NO: 342464 - DNA, 25 bp, Mus musculus
ccatgctggcagacattgagagaaa

SEQ ID NO: 342465 - DNA, 25 bp, Mus musculus
ccatgctggcagtcattgagagaaa

SEQ ID NO: 342466 - DNA, 25 bp, Mus musculus
ccatgctgtcacaatgcaagtgaag

SEQ ID NO: 342467 - DNA, 25 bp, Mus musculus
ccatgctgtcacaattgggtgaact

SEQ ID NO: 342468 - DNA, 25 bp, Mus musculus
ccatgctgtcactatgcaagtgaag

SEQ ID NO: 342469 - DNA, 25 bp, Mus musculus
ccatgctgtcactattgggtgaact

SEQ ID NO: 342470 - DNA, 25 bp, Mus musculus
ccatgctgtcctcggcgtgtgtctc

SEQ ID NO: 342471 - DNA, 25 bp, Mus musculus
ccatgctgtcctgggcgtgtgtctc

SEQ ID NO: 342472 - DNA, 25 bp, Mus musculus
ccatgctgttcgagataagggcgct

SEQ ID NO: 342473 - DNA, 25 bp, Mus musculus
ccatgctgttcgtgataagggcgct

SEQ ID NO: 342474 - DNA, 25 bp, Mus musculus
ccatgctgttctcgtggtcggctat

SEQ ID NO: 342475 - DNA, 25 bp, Mus musculus
ccatgctgttctggtggtcggctat

SEQ ID NO: 342476 - DNA, 25 bp, Mus musculus
ccatgcttagaaatgagaactgctt

SEQ ID NO: 342477 - DNA, 25 bp, Mus musculus
ccatgcttagaattgagaactgctt

SEQ ID NO: 342478 - DNA, 25 bp, Mus musculus
ccatgcttagctctttttactttca

SEQ ID NO: 342479 - DNA, 25 bp, Mus musculus
ccatgcttagctgtttttactttca

SEQ ID NO: 342480 - DNA, 25 bp, Mus musculus
ccatgcttaggccagtcagtacaat

SEQ ID NO: 342481 - DNA, 25 bp, Mus musculus
ccatgcttaggcgagtcagtacaat

SEQ ID NO: 342482 - DNA, 25 bp, Mus musculus
ccatgcttcctacagactttattgc

SEQ ID NO: 342483 - DNA, 25 bp, Mus musculus
ccatgcttcctagagactttattgc

SEQ ID NO: 342484 - DNA, 25 bp, Mus musculus
ccatgcttgcctatttgctgtatac

SEQ ID NO: 342485 - DNA, 25 bp, Mus musculus
ccatgcttgcctttttgctgtatac

SEQ ID NO: 342486 - DNA, 25 bp, Mus musculus
ccatgcttgctgattgacctggaaa

SEQ ID NO: 342487 - DNA, 25 bp, Mus musculus
ccatgcttgctgtttgacctggaaa

SEQ ID NO: 342488 - DNA, 25 bp, Mus musculus
ccatgcttggcacgatgatctttgt

SEQ ID NO: 342489 - DNA, 25 bp, Mus musculus
ccatgcttggcaggatgatctttgt

SEQ ID NO: 342490 - DNA, 25 bp, Mus musculus
ccatgcttgtgtctatgccttgaaa

SEQ ID NO: 342491 - DNA, 25 bp, Mus musculus
ccatgcttgtgtgtatgccttgaaa

SEQ ID NO: 342492 - DNA, 25 bp, Mus musculus
ccatgctttggaatagggcaagcca

SEQ ID NO: 342493 - DNA, 25 bp, Mus musculus
ccatgctttggattagggcaagcca

SEQ ID NO: 342494 - DNA, 25 bp, Mus musculus
ccatgcttttgtagagtatttgatt

SEQ ID NO: 342495 - DNA, 25 bp, Mus musculus
ccatgcttttgttgagtatttgatt

SEQ ID NO: 342496 - DNA, 25 bp, Mus musculus
ccatgcttttttcttcaactacaca

SEQ ID NO: 342497 - DNA, 25 bp, Mus musculus
ccatgcttttttgttcaactacaca

SEQ ID NO: 342498 - DNA, 25 bp, Mus musculus
ccatggaacagtcgcagggcttgcc

SEQ ID NO: 342499 - DNA, 25 bp, Mus musculus
ccatggaacagtggcagggcttgcc

SEQ ID NO: 342500 - DNA, 25 bp, Mus musculus
ccatggaaggtgcaaaggactcaga

SEQ ID NO: 342501 - DNA, 25 bp, Mus musculus
ccatggaaggtggaaaggactcaga

SEQ ID NO: 342502 - DNA, 25 bp, Mus musculus
ccatggaatcccatcgaggaatgaa

SEQ ID NO: 342503 - DNA, 25 bp, Mus musculus
ccatggaatcccttcgaggaatgaa

SEQ ID NO: 342504 - DNA, 25 bp, Mus musculus
ccatggaatgttacagtattatcac

SEQ ID NO: 342505 - DNA, 25 bp, Mus musculus
ccatggaatgtttcagtattatcac

SEQ ID NO: 342506 - DNA, 25 bp, Mus musculus
ccatggacactgagcatcatgtgta

SEQ ID NO: 342507 - DNA, 25 bp, Mus musculus
ccatggacactgtgcatcatgtgta

SEQ ID NO: 342508 - DNA, 25 bp, Mus musculus
ccatggacgccacggtgcaagcagc

SEQ ID NO: 342509 - DNA, 25 bp, Mus musculus
ccatggacgccagggtgcaagcagc

SEQ ID NO: 342510 - DNA, 25 bp, Mus musculus
ccatggactacgaggttctaaccaa

SEQ ID NO: 342511 - DNA, 25 bp, Mus musculus
ccatggactacgtggttctaaccaa

SEQ ID NO: 342512 - DNA, 25 bp, Mus musculus
ccatggactcgaaggttaaggactt

SEQ ID NO: 342513 - DNA, 25 bp, Mus musculus
ccatggactcgatggttaaggactt

SEQ ID NO: 342514 - DNA, 25 bp, Mus musculus
ccatggactttcacgaagagtcgaa

SEQ ID NO: 342515 - DNA, 25 bp, Mus musculus
ccatggactttctcgaagagtcgaa

SEQ ID NO: 342516 - DNA, 25 bp, Mus musculus
ccatggagaaggaaaccaagatctt

SEQ ID NO: 342517 - DNA, 25 bp, Mus musculus
ccatggagaaggtaaccaagatctt

SEQ ID NO: 342518 - DNA, 25 bp, Mus musculus
ccatggagcaggcaccggacattgt

SEQ ID NO: 342519 - DNA, 25 bp, Mus musculus
ccatggagcagggaccggacattgt

SEQ ID NO: 342520 - DNA, 25 bp, Mus musculus
ccatggagccacactgttggtacat

SEQ ID NO: 342521 - DNA, 25 bp, Mus musculus
ccatggagccactctgttggtacat

SEQ ID NO: 342522 - DNA, 25 bp, Mus musculus
ccatggagccagcatttcccaggaa

SEQ ID NO: 342523 - DNA, 25 bp, Mus musculus
ccatggagccaggatttcccaggaa

SEQ ID NO: 342524 - DNA, 25 bp, Mus musculus
ccatggaggaggagttacgcctggc

SEQ ID NO: 342525 - DNA, 25 bp, Mus musculus
ccatggaggaggtgttacgcctggc

SEQ ID NO: 342526 - DNA, 25 bp, Mus musculus
ccatggagggctagggatcctcctg

SEQ ID NO: 342527 - DNA, 25 bp, Mus musculus
ccatggagggcttgggatcctcctg

SEQ ID NO: 342528 - DNA, 25 bp, Mus musculus
ccatggagggtgataattgttttga

SEQ ID NO: 342529 - DNA, 25 bp, Mus musculus
ccatggagggtgttaattgttttga

SEQ ID NO: 342530 - DNA, 25 bp, Mus musculus
ccatggagggttaagtgcacggaaa

SEQ ID NO: 342531 - DNA, 25 bp, Mus musculus
ccatggagggtttagtgcacggaaa

SEQ ID NO: 342532 - DNA, 25 bp, Mus musculus
ccatggagtcctatattctacttaa

SEQ ID NO: 342533 - DNA, 25 bp, Mus musculus
ccatggagtcctttattctacttaa

SEQ ID NO: 342534 - DNA, 25 bp, Mus musculus
ccatggagttttactggttgccctc

SEQ ID NO: 342535 - DNA, 25 bp, Mus musculus
ccatggagtttttctggttgccctc

SEQ ID NO: 342536 - DNA, 25 bp, Mus musculus
ccatggataagacgctgtgcagctg

SEQ ID NO: 342537 - DNA, 25 bp, Mus musculus
ccatggataagaggctgtgcagctg

SEQ ID NO: 342538 - DNA, 25 bp, Mus musculus
ccatggataattactgtcactttaa

SEQ ID NO: 342539 - DNA, 25 bp, Mus musculus
ccatggataatttctgtcactttaa

SEQ ID NO: 342540 - DNA, 25 bp, Mus musculus
ccatggatatccatctagggcttga

SEQ ID NO: 342541 - DNA, 25 bp, Mus musculus
ccatggatatccttctagggcttga

SEQ ID NO: 342542 - DNA, 25 bp, Mus musculus
ccatggatgcagacctggaggcagc

SEQ ID NO: 342543 - DNA, 25 bp, Mus musculus
ccatggatgcagtcctggaggcagc

SEQ ID NO: 342544 - DNA, 25 bp, Mus musculus
ccatggcaccacagtacaggctgtt

SEQ ID NO: 342545 - DNA, 25 bp, Mus musculus
ccatggcaccactgtacaggctgtt

SEQ ID NO: 342546 - DNA, 25 bp, Mus musculus
ccatggcaccgcagtcagtggagcc

SEQ ID NO: 342547 - DNA, 25 bp, Mus musculus
ccatggcaccgctgtcagtggagcc

SEQ ID NO: 342548 - DNA, 25 bp, Mus musculus
ccatggcagaagacggagacccctt

SEQ ID NO: 342549 - DNA, 25 bp, Mus musculus
ccatggcagaagtcggagacccctt

SEQ ID NO: 342550 - DNA, 25 bp, Mus musculus
ccatggcatgggagttcttgttatt

SEQ ID NO: 342551 - DNA, 25 bp, Mus musculus
ccatggcatgggtgttcttgttatt

SEQ ID NO: 342552 - DNA, 25 bp, Mus musculus
ccatggcattggagatctgaactga

SEQ ID NO: 342553 - DNA, 25 bp, Mus musculus
ccatggcattggtgatctgaactga

SEQ ID NO: 342554 - DNA, 25 bp, Mus musculus
ccatggccacaaaggattataactg

SEQ ID NO: 342555 - DNA, 25 bp, Mus musculus
ccatggccacaatggattataactg

SEQ ID NO: 342556 - DNA, 25 bp, Mus musculus
ccatggccactgagctgcatatcta

SEQ ID NO: 342557 - DNA, 25 bp, Mus musculus
ccatggccactgtgctgcatatcta

SEQ ID NO: 342558 - DNA, 25 bp, Mus musculus
ccatggcctgctatgaaagggctct

SEQ ID NO: 342559 - DNA, 25 bp, Mus musculus
ccatggcctgctttgaaagggctct

SEQ ID NO: 342560 - DNA, 25 bp, Mus musculus
ccatggcctggcagtgtacggagaa

SEQ ID NO: 342561 - DNA, 25 bp, Mus musculus
ccatggcctggctgtgtacggagaa

SEQ ID NO: 342562 - DNA, 25 bp, Mus musculus
ccatggcctgtgagtggcgctcaga

SEQ ID NO: 342563 - DNA, 25 bp, Mus musculus
ccatggcctgtgtgtggcgctcaga

SEQ ID NO: 342564 - DNA, 25 bp, Mus musculus
ccatggcgagtcacgtgcagaggct

SEQ ID NO: 342565 - DNA, 25 bp, Mus musculus
ccatggcgagtctcgtgcagaggct

SEQ ID NO: 342566 - DNA, 25 bp, Mus musculus
ccatggctactgattgctactgatt

SEQ ID NO: 342567 - DNA, 25 bp, Mus musculus
ccatggctactgtttgctactgatt

SEQ ID NO: 342568 - DNA, 25 bp, Mus musculus
ccatggctatggacctgtgataagg

SEQ ID NO: 342569 - DNA, 25 bp, Mus musculus
ccatggctatggtcctgtgataagg

SEQ ID NO: 342570 - DNA, 25 bp, Mus musculus
ccatggctcacgaggcttctgagaa

SEQ ID NO: 342571 - DNA, 25 bp, Mus musculus
ccatggctcacgtggcttctgagaa

SEQ ID NO: 342572 - DNA, 25 bp, Mus musculus
ccatggctctaaatgactgcctaga

SEQ ID NO: 342573 - DNA, 25 bp, Mus musculus
ccatggctctaattgactgcctaga

SEQ ID NO: 342574 - DNA, 25 bp, Mus musculus
ccatggctctagagaagatgaggcc

SEQ ID NO: 342575 - DNA, 25 bp, Mus musculus
ccatggctctagtgaagatgaggcc

SEQ ID NO: 342576 - DNA, 25 bp, Mus musculus
ccatggctctcaaatgtgtaacagc

SEQ ID NO: 342577 - DNA, 25 bp, Mus musculus
ccatggctctcatatgtgtaacagc

SEQ ID NO: 342578 - DNA, 25 bp, Mus musculus
ccatggctggtgacatcttcattga

SEQ ID NO: 342579 - DNA, 25 bp, Mus musculus
ccatggctggtgtcatcttcattga

SEQ ID NO: 342580 - DNA, 25 bp, Mus musculus
ccatggctgtctagggccctgaaga

SEQ ID NO: 342581 - DNA, 25 bp, Mus musculus
ccatggctgtcttgggccctgaaga

SEQ ID NO: 342582 - DNA, 25 bp, Mus musculus
ccatggctgtttatagtgactgaga

SEQ ID NO: 342583 - DNA, 25 bp, Mus musculus
ccatggctgtttttagtgactgaga

SEQ ID NO: 342584 - DNA, 25 bp, Mus musculus
ccatggcttgaacttgtatcatctc

SEQ ID NO: 342585 - DNA, 25 bp, Mus musculus
ccatggcttgaagttgtatcatctc

SEQ ID NO: 342586 - DNA, 25 bp, Mus musculus
ccatggcttgggagtaactaatata

SEQ ID NO: 342587 - DNA, 25 bp, Mus musculus
ccatggcttgggtgtaactaatata

SEQ ID NO: 342588 - DNA, 25 bp, Mus musculus
ccatggctttgaccaaccagtgatt

SEQ ID NO: 342589 - DNA, 25 bp, Mus musculus
ccatggctttgagcaaccagtgatt

SEQ ID NO: 342590 - DNA, 25 bp, Mus musculus
ccatgggaaggaactaccgggctca

SEQ ID NO: 342591 - DNA, 25 bp, Mus musculus
ccatgggaaggatctaccgggctca

SEQ ID NO: 342592 - DNA, 25 bp, Mus musculus
ccatgggaagggaagtagacactgt

SEQ ID NO: 342593 - DNA, 25 bp, Mus musculus
ccatgggaagggtagtagacactgt

SEQ ID NO: 342594 - DNA, 25 bp, Mus musculus
ccatgggactgtattgtacctgctt

SEQ ID NO: 342595 - DNA, 25 bp, Mus musculus
ccatgggactgttttgtacctgctt

SEQ ID NO: 342596 - DNA, 25 bp, Mus musculus
ccatgggaggccaccgaggctcgtt

SEQ ID NO: 342597 - DNA, 25 bp, Mus musculus
ccatgggaggcctccgaggctcgtt

SEQ ID NO: 342598 - DNA, 25 bp, Mus musculus
ccatgggatgaaacagttgagcttc

SEQ ID NO: 342599 - DNA, 25 bp, Mus musculus
ccatgggatgaatcagttgagcttc

SEQ ID NO: 342600 - DNA, 25 bp, Mus musculus
ccatgggcacagacctcacagggag

SEQ ID NO: 342601 - DNA, 25 bp, Mus musculus
ccatgggcacagtcctcacagggag

SEQ ID NO: 342602 - DNA, 25 bp, Mus musculus
ccatgggcagtgcttcatcagccaa

SEQ ID NO: 342603 - DNA, 25 bp, Mus musculus
ccatgggcagtggttcatcagccaa

SEQ ID NO: 342604 - DNA, 25 bp, Mus musculus
ccatgggccgcgagtttgggaacct

SEQ ID NO: 342605 - DNA, 25 bp, Mus musculus
ccatgggccgcgtgtttgggaacct

SEQ ID NO: 342606 - DNA, 25 bp, Mus musculus
ccatgggccttcagtgtctcaggaa

SEQ ID NO: 342607 - DNA, 25 bp, Mus musculus
ccatgggccttctgtgtctcaggaa

SEQ ID NO: 342608 - DNA, 25 bp, Mus musculus
ccatgggcgccgaggttcttttctg

SEQ ID NO: 342609 - DNA, 25 bp, Mus musculus
ccatgggcgccgtggttcttttctg

SEQ ID NO: 342610 - DNA, 25 bp, Mus musculus
ccatgggctcctatgtgaacaacat

SEQ ID NO: 342611 - DNA, 25 bp, Mus musculus
ccatgggctcctttgtgaacaacat

SEQ ID NO: 342612 - DNA, 25 bp, Mus musculus
ccatgggtatggagttcagtcctta

SEQ ID NO: 342613 - DNA, 25 bp, Mus musculus
ccatgggtatggtgttcagtcctta

SEQ ID NO: 342614 - DNA, 25 bp, Mus musculus
ccatgggtcacacttacggttttat

SEQ ID NO: 342615 - DNA, 25 bp, Mus musculus
ccatgggtcacagttacggttttat

SEQ ID NO: 342616 - DNA, 25 bp, Mus musculus
ccatgggtcactcctcacgaaatgt

SEQ ID NO: 342617 - DNA, 25 bp, Mus musculus
ccatgggtcactgctcacgaaatgt

SEQ ID NO: 342618 - DNA, 25 bp, Mus musculus
ccatgggtcataaccgagttcgcag

SEQ ID NO: 342619 - DNA, 25 bp, Mus musculus
ccatgggtcatatccgagttcgcag

SEQ ID NO: 342620 - DNA, 25 bp, Mus musculus
ccatgggtgaataagaggctgctct

SEQ ID NO: 342621 - DNA, 25 bp, Mus musculus
ccatgggtgaattagaggctgctct

SEQ ID NO: 342622 - DNA, 25 bp, Mus musculus
ccatgggtgatgagctttcaagctt

SEQ ID NO: 342623 - DNA, 25 bp, Mus musculus
ccatgggtgatgtgctttcaagctt

SEQ ID NO: 342624 - DNA, 25 bp, Mus musculus
ccatgggtgcatattactgtttgtg

SEQ ID NO: 342625 - DNA, 25 bp, Mus musculus
ccatgggtgcattttactgtttgtg

SEQ ID NO: 342626 - DNA, 25 bp, Mus musculus
ccatgggtgctaagggatccatttc

SEQ ID NO: 342627 - DNA, 25 bp, Mus musculus
ccatgggtgctatgggatccatttc

SEQ ID NO: 342628 - DNA, 25 bp, Mus musculus
ccatgggtgttgagagtaccactgc

SEQ ID NO: 342629 - DNA, 25 bp, Mus musculus
ccatgggtgttgtgagtaccactgc

SEQ ID NO: 342630 - DNA, 25 bp, Mus musculus
ccatgggttgcaagccctagagcgg

SEQ ID NO: 342631 - DNA, 25 bp, Mus musculus
ccatgggttgcatgccctagagcgg

SEQ ID NO: 342632 - DNA, 25 bp, Mus musculus
ccatgggttgttactggcttttcag

SEQ ID NO: 342633 - DNA, 25 bp, Mus musculus
ccatgggttgttactggcttttgag

SEQ ID NO: 342634 - DNA, 25 bp, Mus musculus
ccatgggttgttccttgacctctgc

SEQ ID NO: 342635 - DNA, 25 bp, Mus musculus
ccatgggttgttgcttgacctctgc

SEQ ID NO: 342636 - DNA, 25 bp, Mus musculus
ccatgggttgtttctggcttttcag

SEQ ID NO: 342637 - DNA, 25 bp, Mus musculus
ccatgggttgtttctggcttttgag

SEQ ID NO: 342638 - DNA, 25 bp, Mus musculus
ccatgggttttaatattgctgtcta

SEQ ID NO: 342639 - DNA, 25 bp, Mus musculus
ccatgggttttattattgctgtcta

SEQ ID NO: 342640 - DNA, 25 bp, Mus musculus
ccatggtaaccacgcaggaggatca

SEQ ID NO: 342641 - DNA, 25 bp, Mus musculus
ccatggtaaccaggcaggaggatca

SEQ ID NO: 342642 - DNA, 25 bp, Mus musculus
ccatggtaactgctgcatcattgca

SEQ ID NO: 342643 - DNA, 25 bp, Mus musculus
ccatggtaactggtgcatcattgca

SEQ ID NO: 342644 - DNA, 25 bp, Mus musculus
ccatggtaatacaggcgtggcgtat

SEQ ID NO: 342645 - DNA, 25 bp, Mus musculus
ccatggtaatactggcgtggcgtat

SEQ ID NO: 342646 - DNA, 25 bp, Mus musculus
ccatggtaatgcccgctcatctaaa

SEQ ID NO: 342647 - DNA, 25 bp, Mus musculus
ccatggtaatgcgcgctcatctaaa

SEQ ID NO: 342648 - DNA, 25 bp, Mus musculus
ccatggtacaatccctttcaacagg

SEQ ID NO: 342649 - DNA, 25 bp, Mus musculus
ccatggtacaatgcctttcaacagg

SEQ ID NO: 342650 - DNA, 25 bp, Mus musculus
ccatggtacctactgatgaacctgt

SEQ ID NO: 342651 - DNA, 25 bp, Mus musculus
ccatggtacctagtgatgaacctgt

SEQ ID NO: 342652 - DNA, 25 bp, Mus musculus
ccatggtaccttacgtcacagctat

SEQ ID NO: 342653 - DNA, 25 bp, Mus musculus
ccatggtacctttcgtcacagctat

SEQ ID NO: 342654 - DNA, 25 bp, Mus musculus
ccatggtacttgacattcctttctg

SEQ ID NO: 342655 - DNA, 25 bp, Mus musculus
ccatggtacttgtcattcctttctg

SEQ ID NO: 342656 - DNA, 25 bp, Mus musculus
ccatggtaggtcaccaggtgttcct

SEQ ID NO: 342657 - DNA, 25 bp, Mus musculus
ccatggtaggtctccaggtgttcct

SEQ ID NO: 342658 - DNA, 25 bp, Mus musculus
ccatggtatggtaatttcactctta

SEQ ID NO: 342659 - DNA, 25 bp, Mus musculus
ccatggtatggttatttcactctta

SEQ ID NO: 342660 - DNA, 25 bp, Mus musculus
ccatggtatttgactacagatgaag

SEQ ID NO: 342661 - DNA, 25 bp, Mus musculus
ccatggtatttgtctacagatgaag

SEQ ID NO: 342662 - DNA, 25 bp, Mus musculus
ccatggtccctaactgtagtcagac

SEQ ID NO: 342663 - DNA, 25 bp, Mus musculus
ccatggtccctatctgtagtcagac

SEQ ID NO: 342664 - DNA, 25 bp, Mus musculus
ccatggtctattactcccactaaat

SEQ ID NO: 342665 - DNA, 25 bp, Mus musculus
ccatggtctatttctcccactaaat

SEQ ID NO: 342666 - DNA, 25 bp, Mus musculus
ccatggtctgatactcaggttagaa

SEQ ID NO: 342667 - DNA, 25 bp, Mus musculus
ccatggtctgattctcaggttagaa

SEQ ID NO: 342668 - DNA, 25 bp, Mus musculus
ccatggtggccgacagaacgaaagt

SEQ ID NO: 342669 - DNA, 25 bp, Mus musculus
ccatggtggccgtcagaacgaaagt

SEQ ID NO: 342670 - DNA, 25 bp, Mus musculus
ccatggtgtcatcaattctcttact

SEQ ID NO: 342671 - DNA, 25 bp, Mus musculus
ccatggtgtcatgaattctcttact

SEQ ID NO: 342672 - DNA, 25 bp, Mus musculus
ccatggttgccaaacactacgtctg

SEQ ID NO: 342673 - DNA, 25 bp, Mus musculus
ccatggttgccatacactacgtctg

SEQ ID NO: 342674 - DNA, 25 bp, Mus musculus
ccatggttgttaccaaaagtgtatt

SEQ ID NO: 342675 - DNA, 25 bp, Mus musculus
ccatggttgttagcaaaagtgtatt

SEQ ID NO: 342676 - DNA, 25 bp, Mus musculus
ccatggtttctgatcccaagggtca

SEQ ID NO: 342677 - DNA, 25 bp, Mus musculus
ccatggtttctgttcccaagggtca

SEQ ID NO: 342678 - DNA, 25 bp, Mus musculus
ccatggttttgacaagccctgaggg

SEQ ID NO: 342679 - DNA, 25 bp, Mus musculus
ccatggttttgagaagccctgaggg

SEQ ID NO: 342680 - DNA, 25 bp, Mus musculus
ccatgtaaagggatctttctctctt

SEQ ID NO: 342681 - DNA, 25 bp, Mus musculus
ccatgtaaagggttctttctctctt

SEQ ID NO: 342682 - DNA, 25 bp, Mus musculus
ccatgtaaatggacaactctaggtt

SEQ ID NO: 342683 - DNA, 25 bp, Mus musculus
ccatgtaaatggtcaactctaggtt

SEQ ID NO: 342684 - DNA, 25 bp, Mus musculus
ccatgtacacttagcctcgtcaggc

SEQ ID NO: 342685 - DNA, 25 bp, Mus musculus
ccatgtacactttgcctcgtcaggc

SEQ ID NO: 342686 - DNA, 25 bp, Mus musculus
ccatgtacagttacagtcctgcagc

SEQ ID NO: 342687 - DNA, 25 bp, Mus musculus
ccatgtacagtttcagtcctgcagc

SEQ ID NO: 342688 - DNA, 25 bp, Mus musculus
ccatgtactaatctcggtcggacga

SEQ ID NO: 342689 - DNA, 25 bp, Mus musculus
ccatgtactaatgtcggtcggacga

SEQ ID NO: 342690 - DNA, 25 bp, Mus musculus
ccatgtactcttactgtatcattaa

SEQ ID NO: 342691 - DNA, 25 bp, Mus musculus
ccatgtactctttctgtatcattaa

SEQ ID NO: 342692 - DNA, 25 bp, Mus musculus
ccatgtactgaaaacctgttcctta

SEQ ID NO: 342693 - DNA, 25 bp, Mus musculus
ccatgtactgaatacctgttcctta

SEQ ID NO: 342694 - DNA, 25 bp, Mus musculus
ccatgtacttgtagttggtctgttt

SEQ ID NO: 342695 - DNA, 25 bp, Mus musculus
ccatgtacttgttgttggtctgttt

SEQ ID NO: 342696 - DNA, 25 bp, Mus musculus
ccatgtagccccaggtgatgaagtt

SEQ ID NO: 342697 - DNA, 25 bp, Mus musculus
ccatgtagcccctggtgatgaagtt

SEQ ID NO: 342698 - DNA, 25 bp, Mus musculus
ccatgtagctttacgctgctaagtg

SEQ ID NO: 342699 - DNA, 25 bp, Mus musculus
ccatgtagcttttcgctgctaagtg

SEQ ID NO: 342700 - DNA, 25 bp, Mus musculus
ccatgtagtctaccctggtggaatt

SEQ ID NO: 342701 - DNA, 25 bp, Mus musculus
ccatgtagtctagcctggtggaatt

SEQ ID NO: 342702 - DNA, 25 bp, Mus musculus
ccatgtataataccaccactgctac

SEQ ID NO: 342703 - DNA, 25 bp, Mus musculus
ccatgtataatagcaccactgctac

SEQ ID NO: 342704 - DNA, 25 bp, Mus musculus
ccatgtatccaacgtcaccatcttt

SEQ ID NO: 342705 - DNA, 25 bp, Mus musculus
ccatgtatccaaggtcaccatcttt

SEQ ID NO: 342706 - DNA, 25 bp, Mus musculus
ccatgtatgtctaggtcagcagcct

SEQ ID NO: 342707 - DNA, 25 bp, Mus musculus
ccatgtatgtcttggtcagcagcct

SEQ ID NO: 342708 - DNA, 25 bp, Mus musculus
ccatgtattgaaagtgtgcattgga

SEQ ID NO: 342709 - DNA, 25 bp, Mus musculus
ccatgtattgaatgtgtgcattgga

SEQ ID NO: 342710 - DNA, 25 bp, Mus musculus
ccatgtattttaagttgcagtaata

SEQ ID NO: 342711 - DNA, 25 bp, Mus musculus
ccatgtattttatgttgcagtaata

SEQ ID NO: 342712 - DNA, 25 bp, Mus musculus
ccatgtcaatatagctgtccaggtg

SEQ ID NO: 342713 - DNA, 25 bp, Mus musculus
ccatgtcaatattgctgtccaggtg

SEQ ID NO: 342714 - DNA, 25 bp, Mus musculus
ccatgtcacagcagaagcagtggaa

SEQ ID NO: 342715 - DNA, 25 bp, Mus musculus
ccatgtcacagctgaagcagtggaa

SEQ ID NO: 342716 - DNA, 25 bp, Mus musculus
ccatgtcaccacagcgtggagcatt

SEQ ID NO: 342717 - DNA, 25 bp, Mus musculus
ccatgtcaccactgcgtggagcatt

SEQ ID NO: 342718 - DNA, 25 bp, Mus musculus
ccatgtcacctaaggaaagagcctt

SEQ ID NO: 342719 - DNA, 25 bp, Mus musculus
ccatgtcacctatggaaagagcctt

SEQ ID NO: 342720 - DNA, 25 bp, Mus musculus
ccatgtcagtggcttcctctgagac

SEQ ID NO: 342721 - DNA, 25 bp, Mus musculus
ccatgtcagtgggttcctctgagac

SEQ ID NO: 342722 - DNA, 25 bp, Mus musculus
ccatgtccacacaggttcatacaga

SEQ ID NO: 342723 - DNA, 25 bp, Mus musculus
ccatgtccacactggttcatacaga

SEQ ID NO: 342724 - DNA, 25 bp, Mus musculus
ccatgtcccatgcaggctgtaaaaa

SEQ ID NO: 342725 - DNA, 25 bp, Mus musculus
ccatgtcccatggaggctgtaaaaa

SEQ ID NO: 342726 - DNA, 25 bp, Mus musculus
ccatgtccccatcaacttccctgtc

SEQ ID NO: 342727 - DNA, 25 bp, Mus musculus
ccatgtccccatgaacttccctgtc

SEQ ID NO: 342728 - DNA, 25 bp, Mus musculus
ccatgtcctcgaatgatttttctta

SEQ ID NO: 342729 - DNA, 25 bp, Mus musculus
ccatgtcctcgattgatttttctta

SEQ ID NO: 342730 - DNA, 25 bp, Mus musculus
ccatgtcctctgagttggagttgaa

SEQ ID NO: 342731 - DNA, 25 bp, Mus musculus
ccatgtcctctgtgttggagttgaa

SEQ ID NO: 342732 - DNA, 25 bp, Mus musculus
ccatgtccttgaccctgtcagtaat

SEQ ID NO: 342733 - DNA, 25 bp, Mus musculus
ccatgtccttgagcctgtcagtaat

SEQ ID NO: 342734 - DNA, 25 bp, Mus musculus
ccatgtcggagaaatttgaggtcaa

SEQ ID NO: 342735 - DNA, 25 bp, Mus musculus
ccatgtcggagatatttgaggtcaa

SEQ ID NO: 342736 - DNA, 25 bp, Mus musculus
ccatgtctaaatatttagcaggcta

SEQ ID NO: 342737 - DNA, 25 bp, Mus musculus
ccatgtctaaatttttagcaggcta

SEQ ID NO: 342738 - DNA, 25 bp, Mus musculus
ccatgtctcatgcactggcacaatg

SEQ ID NO: 342739 - DNA, 25 bp, Mus musculus
ccatgtctcatggactggcacaatg

SEQ ID NO: 342740 - DNA, 25 bp, Mus musculus
ccatgtctccaactgcatatgctgt

SEQ ID NO: 342741 - DNA, 25 bp, Mus musculus
ccatgtctccaagtgcatatgctgt

SEQ ID NO: 342742 - DNA, 25 bp, Mus musculus
ccatgtctctctacagttggtacaa

SEQ ID NO: 342743 - DNA, 25 bp, Mus musculus
ccatgtctctcttcagttggtacaa

SEQ ID NO: 342744 - DNA, 25 bp, Mus musculus
ccatgtctgcttcgtgatgctttag

SEQ ID NO: 342745 - DNA, 25 bp, Mus musculus
ccatgtctgcttggtgatgctttag

SEQ ID NO: 342746 - DNA, 25 bp, Mus musculus
ccatgtctggctcttataggttctt

SEQ ID NO: 342747 - DNA, 25 bp, Mus musculus
ccatgtctggctgttataggttctt

SEQ ID NO: 342748 - DNA, 25 bp, Mus musculus
ccatgtctgtctattgtgttgctca

SEQ ID NO: 342749 - DNA, 25 bp, Mus musculus
ccatgtctgtcttttgtgttgctca

SEQ ID NO: 342750 - DNA, 25 bp, Mus musculus
ccatgtcttcagatccaaagagttt

SEQ ID NO: 342751 - DNA, 25 bp, Mus musculus
ccatgtcttcagttccaaagagttt

SEQ ID NO: 342752 - DNA, 25 bp, Mus musculus
ccatgtcttgatatgttaccactga

SEQ ID NO: 342753 - DNA, 25 bp, Mus musculus
ccatgtcttgatttgttaccactga

SEQ ID NO: 342754 - DNA, 25 bp, Mus musculus
ccatgtctttctagtaattcctcta

SEQ ID NO: 342755 - DNA, 25 bp, Mus musculus
ccatgtctttcttgtaattcctcta

SEQ ID NO: 342756 - DNA, 25 bp, Mus musculus
ccatgtgaagttaactgtgttgtat

SEQ ID NO: 342757 - DNA, 25 bp, Mus musculus
ccatgtgaagtttactgtgttgtat

SEQ ID NO: 342758 - DNA, 25 bp, Mus musculus
ccatgtgacataatgggcaatgctg

SEQ ID NO: 342759 - DNA, 25 bp, Mus musculus
ccatgtgacatattgggcaatgctg

SEQ ID NO: 342760 - DNA, 25 bp, Mus musculus
ccatgtgacggtcagggttgtttct

SEQ ID NO: 342761 - DNA, 25 bp, Mus musculus
ccatgtgacggtgagggttgtttct

SEQ ID NO: 342762 - DNA, 25 bp, Mus musculus
ccatgtgactctacaccttggtgag

SEQ ID NO: 342763 - DNA, 25 bp, Mus musculus
ccatgtgactcttcaccttggtgag

SEQ ID NO: 342764 - DNA, 25 bp, Mus musculus
ccatgtgaggtgagtggtgctaaca

SEQ ID NO: 342765 - DNA, 25 bp, Mus musculus
ccatgtgaggtgtgtggtgctaaca

SEQ ID NO: 342766 - DNA, 25 bp, Mus musculus
ccatgtgatcacaacctggtcttta

SEQ ID NO: 342767 - DNA, 25 bp, Mus musculus
ccatgtgatcactacctggtcttta

SEQ ID NO: 342768 - DNA, 25 bp, Mus musculus
ccatgtgcaaaacgccttgggttta

SEQ ID NO: 342769 - DNA, 25 bp, Mus musculus
ccatgtgcaaaaggccttgggttta

SEQ ID NO: 342770 - DNA, 25 bp, Mus musculus
ccatgtgcatggaacttgtttttca

SEQ ID NO: 342771 - DNA, 25 bp, Mus musculus
ccatgtgcatggtacttgtttttca

SEQ ID NO: 342772 - DNA, 25 bp, Mus musculus
ccatgtgccgagagaatgtacattg

SEQ ID NO: 342773 - DNA, 25 bp, Mus musculus
ccatgtgccgagtgaatgtacattg

SEQ ID NO: 342774 - DNA, 25 bp, Mus musculus
ccatgtgccggaagctagcatagat

SEQ ID NO: 342775 - DNA, 25 bp, Mus musculus
ccatgtgccggatgctagcatagat

SEQ ID NO: 342776 - DNA, 25 bp, Mus musculus
ccatgtgcctgtcataactcctgaa

SEQ ID NO: 342777 - DNA, 25 bp, Mus musculus
ccatgtgcctgtgataactcctgaa

SEQ ID NO: 342778 - DNA, 25 bp, Mus musculus
ccatgtgctacaccgtcattacgtt

SEQ ID NO: 342779 - DNA, 25 bp, Mus musculus
ccatgtgctacagcgtcattacgtt

SEQ ID NO: 342780 - DNA, 25 bp, Mus musculus
ccatgtgctctacgagtcagggctg

SEQ ID NO: 342781 - DNA, 25 bp, Mus musculus
ccatgtgctctaggagtcagggctg

SEQ ID NO: 342782 - DNA, 25 bp, Mus musculus
ccatgtgctctgctcattaaacttt

SEQ ID NO: 342783 - DNA, 25 bp, Mus musculus
ccatgtgctctggtcattaaacttt

SEQ ID NO: 342784 - DNA, 25 bp, Mus musculus
ccatgtgctgctcttcttgtataaa

SEQ ID NO: 342785 - DNA, 25 bp, Mus musculus
ccatgtgctgctgttcttgtataaa

SEQ ID NO: 342786 - DNA, 25 bp, Mus musculus
ccatgtgctgtgaccctgggctttc

SEQ ID NO: 342787 - DNA, 25 bp, Mus musculus
ccatgtgctgtgtccctgggctttc

SEQ ID NO: 342788 - DNA, 25 bp, Mus musculus
ccatgtgcttatatcagggcaaaaa

SEQ ID NO: 342789 - DNA, 25 bp, Mus musculus
ccatgtgcttatttcagggcaaaaa

SEQ ID NO: 342790 - DNA, 25 bp, Mus musculus
ccatgtgcttctcggacagtgctgc

SEQ ID NO: 342791 - DNA, 25 bp, Mus musculus
ccatgtgcttctgggacagtgctgc

SEQ ID NO: 342792 - DNA, 25 bp, Mus musculus
ccatgtggaggtctgctgtcacctg

SEQ ID NO: 342793 - DNA, 25 bp, Mus musculus
ccatgtggaggtgtgctgtcacctg

SEQ ID NO: 342794 - DNA, 25 bp, Mus musculus
ccatgtggcacgaattgctttggaa

SEQ ID NO: 342795 - DNA, 25 bp, Mus musculus
ccatgtggcacgtattgctttggaa

SEQ ID NO: 342796 - DNA, 25 bp, Mus musculus
ccatgtggctcccaggaggaagttt

SEQ ID NO: 342797 - DNA, 25 bp, Mus musculus
ccatgtggctccgaggaggaagttt

SEQ ID NO: 342798 - DNA, 25 bp, Mus musculus
ccatgtggctttacctagggaaata

SEQ ID NO: 342799 - DNA, 25 bp, Mus musculus
ccatgtggcttttcctagggaaata

SEQ ID NO: 342800 - DNA, 25 bp, Mus musculus
ccatgtgggaacaagaacagctctt

SEQ ID NO: 342801 - DNA, 25 bp, Mus musculus
ccatgtgggaactagaacagctctt

SEQ ID NO: 342802 - DNA, 25 bp, Mus musculus
ccatgtgggtgtaggcaatctaacc

SEQ ID NO: 342803 - DNA, 25 bp, Mus musculus
ccatgtgggtgttggcaatctaacc

SEQ ID NO: 342804 - DNA, 25 bp, Mus musculus
ccatgtggtcttattggcaaggaat

SEQ ID NO: 342805 - DNA, 25 bp, Mus musculus
ccatgtggtctttttggcaaggaat

SEQ ID NO: 342806 - DNA, 25 bp, Mus musculus
ccatgtggtggtctttagctgtaaa

SEQ ID NO: 342807 - DNA, 25 bp, Mus musculus
ccatgtggtggtgtttagctgtaaa

SEQ ID NO: 342808 - DNA, 25 bp, Mus musculus
ccatgtggttaacaattcgctcctt

SEQ ID NO: 342809 - DNA, 25 bp, Mus musculus
ccatgtggttaagaattcgctcctt

SEQ ID NO: 342810 - DNA, 25 bp, Mus musculus
ccatgtggttgaaagagtggattcc

SEQ ID NO: 342811 - DNA, 25 bp, Mus musculus
ccatgtggttgatagagtggattcc

SEQ ID NO: 342812 - DNA, 25 bp, Mus musculus
ccatgtgtagaaaattgccagtgtt

SEQ ID NO: 342813 - DNA, 25 bp, Mus musculus
ccatgtgtagaatattgccagtgtt

SEQ ID NO: 342814 - DNA, 25 bp, Mus musculus
ccatgtgtagtccttggttgatagg

SEQ ID NO: 342815 - DNA, 25 bp, Mus musculus
ccatgtgtagtcgttggttgatagg

SEQ ID NO: 342816 - DNA, 25 bp, Mus musculus
ccatgtgtcacacgaacgtgggtaa

SEQ ID NO: 342817 - DNA, 25 bp, Mus musculus
ccatgtgtcacaggaacgtgggtaa

SEQ ID NO: 342818 - DNA, 25 bp, Mus musculus
ccatgtgtccctcctggactagaaa

SEQ ID NO: 342819 - DNA, 25 bp, Mus musculus
ccatgtgtccctgctggactagaaa

SEQ ID NO: 342820 - DNA, 25 bp, Mus musculus
ccatgtgtctttctgagcctttaaa

SEQ ID NO: 342821 - DNA, 25 bp, Mus musculus
ccatgtgtctttgtgagcctttaaa

SEQ ID NO: 342822 - DNA, 25 bp, Mus musculus
ccatgtgtgaccctgtctggaagtc

SEQ ID NO: 342823 - DNA, 25 bp, Mus musculus
ccatgtgtgaccgtgtctggaagtc

SEQ ID NO: 342824 - DNA, 25 bp, Mus musculus
ccatgtgtgcccctcttttttgtgt

SEQ ID NO: 342825 - DNA, 25 bp, Mus musculus
ccatgtgtgcccgtcttttttgtgt

SEQ ID NO: 342826 - DNA, 25 bp, Mus musculus
ccatgtgtgcgcctagtgagaagtt

SEQ ID NO: 342827 - DNA, 25 bp, Mus musculus
ccatgtgtgcgcgtagtgagaagtt

SEQ ID NO: 342828 - DNA, 25 bp, Mus musculus
ccatgtgtgctaaggaaatcaaaga

SEQ ID NO: 342829 - DNA, 25 bp, Mus musculus
ccatgtgtgctaaggctggtgttcc

SEQ ID NO: 342830 - DNA, 25 bp, Mus musculus
ccatgtgtgctatggaaatcaaaga

SEQ ID NO: 342831 - DNA, 25 bp, Mus musculus
ccatgtgtgctatggctggtgttcc

SEQ ID NO: 342832 - DNA, 25 bp, Mus musculus
ccatgtgtgctcaagggtcaagacc

SEQ ID NO: 342833 - DNA, 25 bp, Mus musculus
ccatgtgtgctcaggatgagctgat

SEQ ID NO: 342834 - DNA, 25 bp, Mus musculus
ccatgtgtgctctagggtcaagacc

SEQ ID NO: 342835 - DNA, 25 bp, Mus musculus
ccatgtgtgctctggatgagctgat

SEQ ID NO: 342836 - DNA, 25 bp, Mus musculus
ccatgtgtggaaagatcatttttta

SEQ ID NO: 342837 - DNA, 25 bp, Mus musculus
ccatgtgtggaatgatcatttttta

SEQ ID NO: 342838 - DNA, 25 bp, Mus musculus
ccatgtgtgtgaactaaagaactct

SEQ ID NO: 342839 - DNA, 25 bp, Mus musculus
ccatgtgtgtgatctaaagaactct

SEQ ID NO: 342840 - DNA, 25 bp, Mus musculus
ccatgtgttctgcactttggttcac

SEQ ID NO: 342841 - DNA, 25 bp, Mus musculus
ccatgtgttctggactttggttcac

SEQ ID NO: 342842 - DNA, 25 bp, Mus musculus
ccatgtgttgtaattctctgggcat

SEQ ID NO: 342843 - DNA, 25 bp, Mus musculus
ccatgtgttgtatttctctgggcat

SEQ ID NO: 342844 - DNA, 25 bp, Mus musculus
ccatgttacagcatacaactccagt

SEQ ID NO: 342845 - DNA, 25 bp, Mus musculus
ccatgttacagcttacaactccagt

SEQ ID NO: 342846 - DNA, 25 bp, Mus musculus
ccatgttacagtccttggaggtgga

SEQ ID NO: 342847 - DNA, 25 bp, Mus musculus
ccatgttacagtgcttggaggtgga

SEQ ID NO: 342848 - DNA, 25 bp, Mus musculus
ccatgttaccaacctgaggtgcagc

SEQ ID NO: 342849 - DNA, 25 bp, Mus musculus
ccatgttaccaagctgaggtgcagc

SEQ ID NO: 342850 - DNA, 25 bp, Mus musculus
ccatgttagtacagctacagtttac

SEQ ID NO: 342851 - DNA, 25 bp, Mus musculus
ccatgttagtactgctacagtttac

SEQ ID NO: 342852 - DNA, 25 bp, Mus musculus
ccatgttatcatacttagcacttgt

SEQ ID NO: 342853 - DNA, 25 bp, Mus musculus
ccatgttatcattcttagcacttgt

SEQ ID NO: 342854 - DNA, 25 bp, Mus musculus
ccatgttattctcatgagtctttga

SEQ ID NO: 342855 - DNA, 25 bp, Mus musculus
ccatgttattctgatgagtctttga

SEQ ID NO: 342856 - DNA, 25 bp, Mus musculus
ccatgttattggcttctaccagtta

SEQ ID NO: 342857 - DNA, 25 bp, Mus musculus
ccatgttattgggttctaccagtta

SEQ ID NO: 342858 - DNA, 25 bp, Mus musculus
ccatgttcctgaccattggagctgg

SEQ ID NO: 342859 - DNA, 25 bp, Mus musculus
ccatgttcctgagcattggagctgg

SEQ ID NO: 342860 - DNA, 25 bp, Mus musculus
ccatgttcgcttatgcatctagtga

SEQ ID NO: 342861 - DNA, 25 bp, Mus musculus
ccatgttcgcttttgcatctagtga

SEQ ID NO: 342862 - DNA, 25 bp, Mus musculus
ccatgttctcctctttacaacttaa

SEQ ID NO: 342863 - DNA, 25 bp, Mus musculus
ccatgttctcctgtttacaacttaa

SEQ ID NO: 342864 - DNA, 25 bp, Mus musculus
ccatgttctgctacctcattaataa

SEQ ID NO: 342865 - DNA, 25 bp, Mus musculus
ccatgttctgcttcctcattaataa

SEQ ID NO: 342866 - DNA, 25 bp, Mus musculus
ccatgttctgggacctgtgtgtgtc

SEQ ID NO: 342867 - DNA, 25 bp, Mus musculus
ccatgttctgggtcctgtgtgtgtc

SEQ ID NO: 342868 - DNA, 25 bp, Mus musculus
ccatgttgagctcggcttggctttt

SEQ ID NO: 342869 - DNA, 25 bp, Mus musculus
ccatgttgagctgggcttggctttt

SEQ ID NO: 342870 - DNA, 25 bp, Mus musculus
ccatgttgctgaactaaggtctatt

SEQ ID NO: 342871 - DNA, 25 bp, Mus musculus
ccatgttgctgatctaaggtctatt

SEQ ID NO: 342872 - DNA, 25 bp, Mus musculus
ccatgttggtaacggccactgggct

SEQ ID NO: 342873 - DNA, 25 bp, Mus musculus
ccatgttggtaagggccactgggct

SEQ ID NO: 342874 - DNA, 25 bp, Mus musculus
ccatgttgtgtaaatccactgcccc

SEQ ID NO: 342875 - DNA, 25 bp, Mus musculus
ccatgttgtgtatatccactgcccc

SEQ ID NO: 342876 - DNA, 25 bp, Mus musculus
ccatgtttacatcacagtgtgccaa

SEQ ID NO: 342877 - DNA, 25 bp, Mus musculus
ccatgtttacatgacagtgtgccaa

SEQ ID NO: 342878 - DNA, 25 bp, Mus musculus
ccatgtttacttagaagcccatttt

SEQ ID NO: 342879 - DNA, 25 bp, Mus musculus
ccatgtttactttgaagcccatttt

SEQ ID NO: 342880 - DNA, 25 bp, Mus musculus
ccatgtttataaaatacaggctcaa

SEQ ID NO: 342881 - DNA, 25 bp, Mus musculus
ccatgtttataatatacaggctcaa

SEQ ID NO: 342882 - DNA, 25 bp, Mus musculus
ccatgtttcatgagccaatgttcta

SEQ ID NO: 342883 - DNA, 25 bp, Mus musculus
ccatgtttcatgagttgctcagtac

SEQ ID NO: 342884 - DNA, 25 bp, Mus musculus
ccatgtttcatgtgccaatgttcta

SEQ ID NO: 342885 - DNA, 25 bp, Mus musculus
ccatgtttcatgtgttgctcagtac

SEQ ID NO: 342886 - DNA, 25 bp, Mus musculus
ccatgtttccagctgttcccggttg

SEQ ID NO: 342887 - DNA, 25 bp, Mus musculus
ccatgtttccaggtgttcccggttg

SEQ ID NO: 342888 - DNA, 25 bp, Mus musculus
ccatgtttgaggagacgcaggtgcc

SEQ ID NO: 342889 - DNA, 25 bp, Mus musculus
ccatgtttgaggtgacgcaggtgcc

SEQ ID NO: 342890 - DNA, 25 bp, Mus musculus
ccatgtttgcagcttcgataggaac

SEQ ID NO: 342891 - DNA, 25 bp, Mus musculus
ccatgtttgcaggttcgataggaac

SEQ ID NO: 342892 - DNA, 25 bp, Mus musculus
ccatgtttgcttcttgtccacaaga

SEQ ID NO: 342893 - DNA, 25 bp, Mus musculus
ccatgtttgcttgttgtccacaaga

SEQ ID NO: 342894 - DNA, 25 bp, Mus musculus
ccatgtttggcaatactgtatttta

SEQ ID NO: 342895 - DNA, 25 bp, Mus musculus
ccatgtttggcattactgtatttta

SEQ ID NO: 342896 - DNA, 25 bp, Mus musculus
ccatgtttgttaaagcttgccccga

SEQ ID NO: 342897 - DNA, 25 bp, Mus musculus
ccatgtttgttaaagcttggcccga

SEQ ID NO: 342898 - DNA, 25 bp, Mus musculus
ccatgtttgttatagcttgccccga

SEQ ID NO: 342899 - DNA, 25 bp, Mus musculus
ccatgtttgttatagcttggcccga

SEQ ID NO: 342900 - DNA, 25 bp, Mus musculus
ccatgttttagtccatgtcagccta

SEQ ID NO: 342901 - DNA, 25 bp, Mus musculus
ccatgttttagtgcatgtcagccta

SEQ ID NO: 342902 - DNA, 25 bp, Mus musculus
ccatgttttcctccagccttatggc

SEQ ID NO: 342903 - DNA, 25 bp, Mus musculus
ccatgttttcctgcagccttatggc

SEQ ID NO: 342904 - DNA, 25 bp, Mus musculus
ccattaaaagttacatcccctgtag

SEQ ID NO: 342905 - DNA, 25 bp, Mus musculus
ccattaaaagtttcatcccctgtag

SEQ ID NO: 342906 - DNA, 25 bp, Mus musculus
ccattaaagaccacattataattct

SEQ ID NO: 342907 - DNA, 25 bp, Mus musculus
ccattaaagacctcattataattct

SEQ ID NO: 342908 - DNA, 25 bp, Mus musculus
ccattaagaaatatactgacctagt

SEQ ID NO: 342909 - DNA, 25 bp, Mus musculus
ccattaagaaatttactgacctagt

SEQ ID NO: 342910 - DNA, 25 bp, Mus musculus
ccattaatagcaatttccccttctg

SEQ ID NO: 342911 - DNA, 25 bp, Mus musculus
ccattaatagcattttccccttctg

SEQ ID NO: 342912 - DNA, 25 bp, Mus musculus
ccattaatataaaagctttgcttgc

SEQ ID NO: 342913 - DNA, 25 bp, Mus musculus
ccattaatataatagctttgcttgc

SEQ ID NO: 342914 - DNA, 25 bp, Mus musculus
ccattaatttgcattcctggctgtc

SEQ ID NO: 342915 - DNA, 25 bp, Mus musculus
ccattaatttgctttcctggctgtc

SEQ ID NO: 342916 - DNA, 25 bp, Mus musculus
ccattacatcgcacatttcctataa

SEQ ID NO: 342917 - DNA, 25 bp, Mus musculus
ccattacatcgctcatttcctataa

SEQ ID NO: 342918 - DNA, 25 bp, Mus musculus
ccattacatgtgatgggcacccggg

SEQ ID NO: 342919 - DNA, 25 bp, Mus musculus
ccattacatgtgttgggcacccggg

SEQ ID NO: 342920 - DNA, 25 bp, Mus musculus
ccattactctgtacctttctgtatt

SEQ ID NO: 342921 - DNA, 25 bp, Mus musculus
ccattactctgttcctttctgtatt

SEQ ID NO: 342922 - DNA, 25 bp, Mus musculus
ccattactgacaacagggccttcac

SEQ ID NO: 342923 - DNA, 25 bp, Mus musculus
ccattactgacatcagggccttcac

SEQ ID NO: 342924 - DNA, 25 bp, Mus musculus
ccattactgtaaaaagcacctacgt

SEQ ID NO: 342925 - DNA, 25 bp, Mus musculus
ccattactgtaataagcacctacgt

SEQ ID NO: 342926 - DNA, 25 bp, Mus musculus
ccattactgttgaggttgcatcctg

SEQ ID NO: 342927 - DNA, 25 bp, Mus musculus
ccattactgttgtggttgcatcctg

SEQ ID NO: 342928 - DNA, 25 bp, Mus musculus
ccattacttatccactttctatcaa

SEQ ID NO: 342929 - DNA, 25 bp, Mus musculus
ccattacttatcgactttctatcaa

SEQ ID NO: 342930 - DNA, 25 bp, Mus musculus
ccattacttcctatcctggatggga

SEQ ID NO: 342931 - DNA, 25 bp, Mus musculus
ccattacttcctttcctggatggga

SEQ ID NO: 342932 - DNA, 25 bp, Mus musculus
ccattagaatgaacactggctgttt

SEQ ID NO: 342933 - DNA, 25 bp, Mus musculus
ccattagaatgatcactggctgttt

SEQ ID NO: 342934 - DNA, 25 bp, Mus musculus
ccattagcttctagtatttactgaa

SEQ ID NO: 342935 - DNA, 25 bp, Mus musculus
ccattagcttcttgtatttactgaa

SEQ ID NO: 342936 - DNA, 25 bp, Mus musculus
ccattaggttatagtagcttcattt

SEQ ID NO: 342937 - DNA, 25 bp, Mus musculus
ccattaggttattgtagcttcattt

SEQ ID NO: 342938 - DNA, 25 bp, Mus musculus
ccattagtggaactagaggcccatt

SEQ ID NO: 342939 - DNA, 25 bp, Mus musculus
ccattagtggaagtagaggcccatt

SEQ ID NO: 342940 - DNA, 25 bp, Mus musculus
ccattagttcccagctagtgtgtga

SEQ ID NO: 342941 - DNA, 25 bp, Mus musculus
ccattagttccctgctagtgtgtga

SEQ ID NO: 342942 - DNA, 25 bp, Mus musculus
ccattatagtctactccttgggtaa

SEQ ID NO: 342943 - DNA, 25 bp, Mus musculus
ccattatagtcttctccttgggtaa

SEQ ID NO: 342944 - DNA, 25 bp, Mus musculus
ccattatcacttagccaggacgttt

SEQ ID NO: 342945 - DNA, 25 bp, Mus musculus
ccattatcactttgccaggacgttt

SEQ ID NO: 342946 - DNA, 25 bp, Mus musculus
ccattatccctgatcccagttgagc

SEQ ID NO: 342947 - DNA, 25 bp, Mus musculus
ccattatccctgttcccagttgagc

SEQ ID NO: 342948 - DNA, 25 bp, Mus musculus
ccattatgaaaacagccagggtgat

SEQ ID NO: 342949 - DNA, 25 bp, Mus musculus
ccattatgaaaagagccagggtgat

SEQ ID NO: 342950 - DNA, 25 bp, Mus musculus
ccattatgtgagatccaaggatcca

SEQ ID NO: 342951 - DNA, 25 bp, Mus musculus
ccattatgtgagttccaaggatcca

SEQ ID NO: 342952 - DNA, 25 bp, Mus musculus
ccattattaaccagactccacacaa

SEQ ID NO: 342953 - DNA, 25 bp, Mus musculus
ccattattaacctgactccacacaa

SEQ ID NO: 342954 - DNA, 25 bp, Mus musculus
ccattattacacacaggttcatatt

SEQ ID NO: 342955 - DNA, 25 bp, Mus musculus
ccattattacactcaggttcatatt

SEQ ID NO: 342956 - DNA, 25 bp, Mus musculus
ccattattcttcctacgccaggtag

SEQ ID NO: 342957 - DNA, 25 bp, Mus musculus
ccattattcttcgtacgccaggtag

SEQ ID NO: 342958 - DNA, 25 bp, Mus musculus
ccattattgtcgacatccccaaaga

SEQ ID NO: 342959 - DNA, 25 bp, Mus musculus
ccattattgtcgtcatccccaaaga

SEQ ID NO: 342960 - DNA, 25 bp, Mus musculus
ccattatttcctaggactatcaccc

SEQ ID NO: 342961 - DNA, 25 bp, Mus musculus
ccattatttccttggactatcaccc

SEQ ID NO: 342962 - DNA, 25 bp, Mus musculus
ccattatttgcacttacatatatga

SEQ ID NO: 342963 - DNA, 25 bp, Mus musculus
ccattatttgcagttacatatatga

SEQ ID NO: 342964 - DNA, 25 bp, Mus musculus
ccattcaaggtcactgtcagaccct

SEQ ID NO: 342965 - DNA, 25 bp, Mus musculus
ccattcaaggtctctgtcagaccct

SEQ ID NO: 342966 - DNA, 25 bp, Mus musculus
ccattcacaggtcaggcagagtctc

SEQ ID NO: 342967 - DNA, 25 bp, Mus musculus
ccattcacaggtgaggcagagtctc

SEQ ID NO: 342968 - DNA, 25 bp, Mus musculus
ccattcacctaactatccattttac

SEQ ID NO: 342969 - DNA, 25 bp, Mus musculus
ccattcacctaagtatccattttac

SEQ ID NO: 342970 - DNA, 25 bp, Mus musculus
ccattcacctatatgccagggtgtt

SEQ ID NO: 342971 - DNA, 25 bp, Mus musculus
ccattcacctatttgccagggtgtt

SEQ ID NO: 342972 - DNA, 25 bp, Mus musculus
ccattcacctttcctggtggtgaca

SEQ ID NO: 342973 - DNA, 25 bp, Mus musculus
ccattcacctttgctggtggtgaca

SEQ ID NO: 342974 - DNA, 25 bp, Mus musculus
ccattcagactcaatcttggaagtt

SEQ ID NO: 342975 - DNA, 25 bp, Mus musculus
ccattcagactctatcttggaagtt

SEQ ID NO: 342976 - DNA, 25 bp, Mus musculus
ccattcagccttacatgtgcgtgaa

SEQ ID NO: 342977 - DNA, 25 bp, Mus musculus
ccattcagcctttcatgtgcgtgaa

SEQ ID NO: 342978 - DNA, 25 bp, Mus musculus
ccattcaggctccaggttgttgctg

SEQ ID NO: 342979 - DNA, 25 bp, Mus musculus
ccattcaggctcgaggttgttgctg

SEQ ID NO: 342980 - DNA, 25 bp, Mus musculus
ccattcagtaaaccggagcctacgt

SEQ ID NO: 342981 - DNA, 25 bp, Mus musculus
ccattcagtaaagcggagcctacgt

SEQ ID NO: 342982 - DNA, 25 bp, Mus musculus
ccattcagtaagagtttcttcggta

SEQ ID NO: 342983 - DNA, 25 bp, Mus musculus
ccattcagtaagtgtttcttcggta

SEQ ID NO: 342984 - DNA, 25 bp, Mus musculus
ccattcagtcttcagttttgggaaa

SEQ ID NO: 342985 - DNA, 25 bp, Mus musculus
ccattcagtcttgagttttgggaaa

SEQ ID NO: 342986 - DNA, 25 bp, Mus musculus
ccattcagttttacccctgaggagg

SEQ ID NO: 342987 - DNA, 25 bp, Mus musculus
ccattcagtttttcccctgaggagg

SEQ ID NO: 342988 - DNA, 25 bp, Mus musculus
ccattcataaatatgtgttgcagag

SEQ ID NO: 342989 - DNA, 25 bp, Mus musculus
ccattcataaatttgtgttgcagag

SEQ ID NO: 342990 - DNA, 25 bp, Mus musculus
ccattcatggtgatgttgcaggtta

SEQ ID NO: 342991 - DNA, 25 bp, Mus musculus
ccattcatggtgttgttgcaggtta

SEQ ID NO: 342992 - DNA, 25 bp, Mus musculus
ccattcatttccaaggcatattaaa

SEQ ID NO: 342993 - DNA, 25 bp, Mus musculus
ccattcatttcctaggcatattaaa

SEQ ID NO: 342994 - DNA, 25 bp, Mus musculus
ccattccaccttctggactttggga

SEQ ID NO: 342995 - DNA, 25 bp, Mus musculus
ccattccaccttgtggactttggga

SEQ ID NO: 342996 - DNA, 25 bp, Mus musculus
ccattccagactatcactatacttc

SEQ ID NO: 342997 - DNA, 25 bp, Mus musculus
ccattccagactttcactatacttc

SEQ ID NO: 342998 - DNA, 25 bp, Mus musculus
ccattccaggcaaaccctctctggg

SEQ ID NO: 342999 - DNA, 25 bp, Mus musculus
ccattccaggcataccctctctggg

SEQ ID NO: 343000 - DNA, 25 bp, Mus musculus
ccattccaggcgctttcagagtgaa

SEQ ID NO: 343001 - DNA, 25 bp, Mus musculus
ccattccaggcggtttcagagtgaa

SEQ ID NO: 343002 - DNA, 25 bp, Mus musculus
ccattcccaaatacaactgcagcta

SEQ ID NO: 343003 - DNA, 25 bp, Mus musculus
ccattcccaaattcaactgcagcta

SEQ ID NO: 343004 - DNA, 25 bp, Mus musculus
ccattcccagttaatatgtggtgct

SEQ ID NO: 343005 - DNA, 25 bp, Mus musculus
ccattcccagtttatatgtggtgct

SEQ ID NO: 343006 - DNA, 25 bp, Mus musculus
ccattcccatatcagtccgagaaga

SEQ ID NO: 343007 - DNA, 25 bp, Mus musculus
ccattcccatatgagtccgagaaga

SEQ ID NO: 343008 - DNA, 25 bp, Mus musculus
ccattccccaggctaaacacataga

SEQ ID NO: 343009 - DNA, 25 bp, Mus musculus
ccattccccagggtaaacacataga

SEQ ID NO: 343010 - DNA, 25 bp, Mus musculus
ccattcccctagatgctggagaaag

SEQ ID NO: 343011 - DNA, 25 bp, Mus musculus
ccattcccctagttgctggagaaag

SEQ ID NO: 343012 - DNA, 25 bp, Mus musculus
ccattccctacaatcttagctttta

SEQ ID NO: 343013 - DNA, 25 bp, Mus musculus
ccattccctacattcttagctttta

SEQ ID NO: 343014 - DNA, 25 bp, Mus musculus
ccattccctggtcttgactttagat

SEQ ID NO: 343015 - DNA, 25 bp, Mus musculus
ccattccctggtgttgactttagat

SEQ ID NO: 343016 - DNA, 25 bp, Mus musculus
ccattcccttagatgtacacagaaa

SEQ ID NO: 343017 - DNA, 25 bp, Mus musculus
ccattcccttagttgtacacagaaa

SEQ ID NO: 343018 - DNA, 25 bp, Mus musculus
ccattccgcttcaaggcagagcaaa

SEQ ID NO: 343019 - DNA, 25 bp, Mus musculus
ccattccgcttctaggcagagcaaa

SEQ ID NO: 343020 - DNA, 25 bp, Mus musculus
ccattccgttttcataaagagtaca

SEQ ID NO: 343021 - DNA, 25 bp, Mus musculus
ccattccgttttgataaagagtaca

SEQ ID NO: 343022 - DNA, 25 bp, Mus musculus
ccattcctcataacagtgggataaa

SEQ ID NO: 343023 - DNA, 25 bp, Mus musculus
ccattcctcatatcagtgggataaa

SEQ ID NO: 343024 - DNA, 25 bp, Mus musculus
ccattcctgagtactgcaaagggag

SEQ ID NO: 343025 - DNA, 25 bp, Mus musculus
ccattcctgagttctgcaaagggag

SEQ ID NO: 343026 - DNA, 25 bp, Mus musculus
ccattcctgttaagccggattgtaa

SEQ ID NO: 343027 - DNA, 25 bp, Mus musculus
ccattcctgttatgccggattgtaa

SEQ ID NO: 343028 - DNA, 25 bp, Mus musculus
ccattccttattattacccttgctt

SEQ ID NO: 343029 - DNA, 25 bp, Mus musculus
ccattccttatttttacccttgctt

SEQ ID NO: 343030 - DNA, 25 bp, Mus musculus
ccattccttcacatggatgttgata

SEQ ID NO: 343031 - DNA, 25 bp, Mus musculus
ccattccttcacttggatgttgata

SEQ ID NO: 343032 - DNA, 25 bp, Mus musculus
ccattccttccaaggacagaagaga

SEQ ID NO: 343033 - DNA, 25 bp, Mus musculus
ccattccttccatggacagaagaga

SEQ ID NO: 343034 - DNA, 25 bp, Mus musculus
ccattccttgaaattttgtgtcaaa

SEQ ID NO: 343035 - DNA, 25 bp, Mus musculus
ccattccttgaatttttgtgtcaaa

SEQ ID NO: 343036 - DNA, 25 bp, Mus musculus
ccattccttgagacgtcggcgaaaa

SEQ ID NO: 343037 - DNA, 25 bp, Mus musculus
ccattccttgagtcgtcggcgaaaa

SEQ ID NO: 343038 - DNA, 25 bp, Mus musculus
ccattccttggaatctgttctactt

SEQ ID NO: 343039 - DNA, 25 bp, Mus musculus
ccattccttggattctgttctactt

SEQ ID NO: 343040 - DNA, 25 bp, Mus musculus
ccattccttggcagggatcatggac

SEQ ID NO: 343041 - DNA, 25 bp, Mus musculus
ccattccttggctgggatcatggac

SEQ ID NO: 343042 - DNA, 25 bp, Mus musculus
ccattcctttcaatcaatttcttag

SEQ ID NO: 343043 - DNA, 25 bp, Mus musculus
ccattcctttcattcaatttcttag

SEQ ID NO: 343044 - DNA, 25 bp, Mus musculus
ccattcgaatgcagccttaaagggc

SEQ ID NO: 343045 - DNA, 25 bp, Mus musculus
ccattcgaatgctgccttaaagggc

SEQ ID NO: 343046 - DNA, 25 bp, Mus musculus
ccattcgcaggaagggcgagtcaga

SEQ ID NO: 343047 - DNA, 25 bp, Mus musculus
ccattcgcaggatgggcgagtcaga

SEQ ID NO: 343048 - DNA, 25 bp, Mus musculus
ccattcgccatcctagtacttagag

SEQ ID NO: 343049 - DNA, 25 bp, Mus musculus
ccattcgccatcgtagtacttagag

SEQ ID NO: 343050 - DNA, 25 bp, Mus musculus
ccattcgctattcctttgggctttt

SEQ ID NO: 343051 - DNA, 25 bp, Mus musculus
ccattcgctattgctttgggctttt

SEQ ID NO: 343052 - DNA, 25 bp, Mus musculus
ccattcggaaggaactcaatgagtt

SEQ ID NO: 343053 - DNA, 25 bp, Mus musculus
ccattcggaaggtactcaatgagtt

SEQ ID NO: 343054 - DNA, 25 bp, Mus musculus
ccattcggctcacgtattggcactg

SEQ ID NO: 343055 - DNA, 25 bp, Mus musculus
ccattcggctcaggtattggcactg

SEQ ID NO: 343056 - DNA, 25 bp, Mus musculus
ccattcgggatcaatgggtcgaaaa

SEQ ID NO: 343057 - DNA, 25 bp, Mus musculus
ccattcgggatctatgggtcgaaaa

SEQ ID NO: 343058 - DNA, 25 bp, Mus musculus
ccattcgtgacgaaattcggaatgt

SEQ ID NO: 343059 - DNA, 25 bp, Mus musculus
ccattcgtgacgtaattcggaatgt

SEQ ID NO: 343060 - DNA, 25 bp, Mus musculus
ccattctatggtagctcatttggat

SEQ ID NO: 343061 - DNA, 25 bp, Mus musculus
ccattctatggttgctcatttggat

SEQ ID NO: 343062 - DNA, 25 bp, Mus musculus
ccattctcaagacccttcaattttt

SEQ ID NO: 343063 - DNA, 25 bp, Mus musculus
ccattctcaagagccttcaattttt

SEQ ID NO: 343064 - DNA, 25 bp, Mus musculus
ccattctcagccactttgtcaatgt

SEQ ID NO: 343065 - DNA, 25 bp, Mus musculus
ccattctcagcctctttgtcaatgt

SEQ ID NO: 343066 - DNA, 25 bp, Mus musculus
ccattctcatgacgtaaggtgacac

SEQ ID NO: 343067 - DNA, 25 bp, Mus musculus
ccattctcatgaggtaaggtgacac

SEQ ID NO: 343068 - DNA, 25 bp, Mus musculus
ccattctcctgtagtgagtgcactt

SEQ ID NO: 343069 - DNA, 25 bp, Mus musculus
ccattctcctgttgtgagtgcactt

SEQ ID NO: 343070 - DNA, 25 bp, Mus musculus
ccattctgaatcctgtctcgtgtaa

SEQ ID NO: 343071 - DNA, 25 bp, Mus musculus
ccattctgaatcgtgtctcgtgtaa

SEQ ID NO: 343072 - DNA, 25 bp, Mus musculus
ccattctggtccctatttgtggtta

SEQ ID NO: 343073 - DNA, 25 bp, Mus musculus
ccattctggtccgtatttgtggtta

SEQ ID NO: 343074 - DNA, 25 bp, Mus musculus
ccattctgtgcaatctctaggagtt

SEQ ID NO: 343075 - DNA, 25 bp, Mus musculus
ccattctgtgcattctctaggagtt

SEQ ID NO: 343076 - DNA, 25 bp, Mus musculus
ccattcttaaccagttcagggttag

SEQ ID NO: 343077 - DNA, 25 bp, Mus musculus
ccattcttaacctgttcagggttag

SEQ ID NO: 343078 - DNA, 25 bp, Mus musculus
ccattcttagttatgcttatgtcta

SEQ ID NO: 343079 - DNA, 25 bp, Mus musculus
ccattcttagttttgcttatgtcta

SEQ ID NO: 343080 - DNA, 25 bp, Mus musculus
ccattcttctacaggccacgtaaaa

SEQ ID NO: 343081 - DNA, 25 bp, Mus musculus
ccattcttctactggccacgtaaaa

SEQ ID NO: 343082 - DNA, 25 bp, Mus musculus
ccattcttgccacgctgctgaataa

SEQ ID NO: 343083 - DNA, 25 bp, Mus musculus
ccattcttgccaggctgctgaataa

SEQ ID NO: 343084 - DNA, 25 bp, Mus musculus
ccattcttgtccctagattctgaat

SEQ ID NO: 343085 - DNA, 25 bp, Mus musculus
ccattcttgtccgtagattctgaat

SEQ ID NO: 343086 - DNA, 25 bp, Mus musculus
ccattctttgagatgccaagtgttt

SEQ ID NO: 343087 - DNA, 25 bp, Mus musculus
ccattctttgagttgccaagtgttt

SEQ ID NO: 343088 - DNA, 25 bp, Mus musculus
ccattcttttccaagtgacgttcag

SEQ ID NO: 343089 - DNA, 25 bp, Mus musculus
ccattcttttcctagtgacgttcag

SEQ ID NO: 343090 - DNA, 25 bp, Mus musculus
ccattcttttcgattagaatcagaa

SEQ ID NO: 343091 - DNA, 25 bp, Mus musculus
ccattcttttcgtttagaatcagaa

SEQ ID NO: 343092 - DNA, 25 bp, Mus musculus
ccattctttttaaggcagaatacaa

SEQ ID NO: 343093 - DNA, 25 bp, Mus musculus
ccattctttttatggcagaatacaa

SEQ ID NO: 343094 - DNA, 25 bp, Mus musculus
ccattcttttttctgcaatagttgg

SEQ ID NO: 343095 - DNA, 25 bp, Mus musculus
ccattcttttttgtgcaatagttgg

SEQ ID NO: 343096 - DNA, 25 bp, Mus musculus
ccattgaactttctgcacagttaac

SEQ ID NO: 343097 - DNA, 25 bp, Mus musculus
ccattgaactttgtgcacagttaac

SEQ ID NO: 343098 - DNA, 25 bp, Mus musculus
ccattgaccatcagccaggcgaaag

SEQ ID NO: 343099 - DNA, 25 bp, Mus musculus
ccattgaccatctgccaggcgaaag

SEQ ID NO: 343100 - DNA, 25 bp, Mus musculus
ccattgaccggcaagcgctgcgtgg

SEQ ID NO: 343101 - DNA, 25 bp, Mus musculus
ccattgaccggctagcgctgcgtgg

SEQ ID NO: 343102 - DNA, 25 bp, Mus musculus
ccattgagcataattgtgtgtacct

SEQ ID NO: 343103 - DNA, 25 bp, Mus musculus
ccattgagcatatttgtgtgtacct

SEQ ID NO: 343104 - DNA, 25 bp, Mus musculus
ccattgagccgccaagttattattt

SEQ ID NO: 343105 - DNA, 25 bp, Mus musculus
ccattgagccgcgaagttattattt

SEQ ID NO: 343106 - DNA, 25 bp, Mus musculus
ccattgagcttcagggtgagactcc

SEQ ID NO: 343107 - DNA, 25 bp, Mus musculus
ccattgagcttctgggtgagactcc

SEQ ID NO: 343108 - DNA, 25 bp, Mus musculus
ccattgaggctaccgcttagtaacc

SEQ ID NO: 343109 - DNA, 25 bp, Mus musculus
ccattgaggctagcgcttagtaacc

SEQ ID NO: 343110 - DNA, 25 bp, Mus musculus
ccattgataactatcatgtttagaa

SEQ ID NO: 343111 - DNA, 25 bp, Mus musculus
ccattgataactttcatgtttagaa

SEQ ID NO: 343112 - DNA, 25 bp, Mus musculus
ccattgatcgttcagacttctttca

SEQ ID NO: 343113 - DNA, 25 bp, Mus musculus
ccattgatcgttgagacttctttca

SEQ ID NO: 343114 - DNA, 25 bp, Mus musculus
ccattgattgttagtcggaagtctt

SEQ ID NO: 343115 - DNA, 25 bp, Mus musculus
ccattgattgtttgtcggaagtctt

SEQ ID NO: 343116 - DNA, 25 bp, Mus musculus
ccattgcaactaatgtgacatagca

SEQ ID NO: 343117 - DNA, 25 bp, Mus musculus
ccattgcaactattgtgacatagca

SEQ ID NO: 343118 - DNA, 25 bp, Mus musculus
ccattgcagagaacctttggacata

SEQ ID NO: 343119 - DNA, 25 bp, Mus musculus
ccattgcagagatcctttggacata

SEQ ID NO: 343120 - DNA, 25 bp, Mus musculus
ccattgcaggctcggtgagtccctg

SEQ ID NO: 343121 - DNA, 25 bp, Mus musculus
ccattgcaggctgggtgagtccctg

SEQ ID NO: 343122 - DNA, 25 bp, Mus musculus
ccattgcatctaatctcctgtgcat

SEQ ID NO: 343123 - DNA, 25 bp, Mus musculus
ccattgcatctattctcctgtgcat

SEQ ID NO: 343124 - DNA, 25 bp, Mus musculus
ccattgcattaaatgttgatagtaa

SEQ ID NO: 343125 - DNA, 25 bp, Mus musculus
ccattgcattaattgttgatagtaa

SEQ ID NO: 343126 - DNA, 25 bp, Mus musculus
ccattgcatttactggacaccacat

SEQ ID NO: 343127 - DNA, 25 bp, Mus musculus
ccattgcatttagtggacaccacat

SEQ ID NO: 343128 - DNA, 25 bp, Mus musculus
ccattgccatgaactgtggtctata

SEQ ID NO: 343129 - DNA, 25 bp, Mus musculus
ccattgccatgatctgtggtctata

SEQ ID NO: 343130 - DNA, 25 bp, Mus musculus
ccattgcccaccacttgattaagaa

SEQ ID NO: 343131 - DNA, 25 bp, Mus musculus
ccattgcccacctcttgattaagaa

SEQ ID NO: 343132 - DNA, 25 bp, Mus musculus
ccattgccttttcattggtggcttc

SEQ ID NO: 343133 - DNA, 25 bp, Mus musculus
ccattgccttttgattggtggcttc

SEQ ID NO: 343134 - DNA, 25 bp, Mus musculus
ccattgctaattatttgggaaatat

SEQ ID NO: 343135 - DNA, 25 bp, Mus musculus
ccattgctaattttttgggaaatat

SEQ ID NO: 343136 - DNA, 25 bp, Mus musculus
ccattgctcattcctgtcagttggg

SEQ ID NO: 343137 - DNA, 25 bp, Mus musculus
ccattgctcattgctgtcagttggg

SEQ ID NO: 343138 - DNA, 25 bp, Mus musculus
ccattgctgaaacttgagtaggtaa

SEQ ID NO: 343139 - DNA, 25 bp, Mus musculus
ccattgctgaaagttgagtaggtaa

SEQ ID NO: 343140 - DNA, 25 bp, Mus musculus
ccattgctgtgacacttaggtcgtg

SEQ ID NO: 343141 - DNA, 25 bp, Mus musculus
ccattgctgtgagacttaggtcgtg

SEQ ID NO: 343142 - DNA, 25 bp, Mus musculus
ccattgctgttgaggttgaccttgg

SEQ ID NO: 343143 - DNA, 25 bp, Mus musculus
ccattgctgttgtggttgaccttgg

SEQ ID NO: 343144 - DNA, 25 bp, Mus musculus
ccattgcttcttcgcctggtacttt

SEQ ID NO: 343145 - DNA, 25 bp, Mus musculus
ccattgcttcttggcctggtacttt

SEQ ID NO: 343146 - DNA, 25 bp, Mus musculus
ccattgctttggctcatcacatgat

SEQ ID NO: 343147 - DNA, 25 bp, Mus musculus
ccattgctttgggtcatcacatgat

SEQ ID NO: 343148 - DNA, 25 bp, Mus musculus
ccattggaacaactccttcgataaa

SEQ ID NO: 343149 - DNA, 25 bp, Mus musculus
ccattggaacaagtccttcgataaa

SEQ ID NO: 343150 - DNA, 25 bp, Mus musculus
ccattggacaaacggccctgacatt

SEQ ID NO: 343151 - DNA, 25 bp, Mus musculus
ccattggacaaagggccctgacatt

SEQ ID NO: 343152 - DNA, 25 bp, Mus musculus
ccattggatggaccccaaggtttcc

SEQ ID NO: 343153 - DNA, 25 bp, Mus musculus
ccattggatggagcccaaggtttcc

SEQ ID NO: 343154 - DNA, 25 bp, Mus musculus
ccattggcaagccatggtgactcag

SEQ ID NO: 343155 - DNA, 25 bp, Mus musculus
ccattggcaagcgatggtgactcag

SEQ ID NO: 343156 - DNA, 25 bp, Mus musculus
ccattggccggtagagttcagagag

SEQ ID NO: 343157 - DNA, 25 bp, Mus musculus
ccattggccggttgagttcagagag

SEQ ID NO: 343158 - DNA, 25 bp, Mus musculus
ccattggcgataatggccggccatt

SEQ ID NO: 343159 - DNA, 25 bp, Mus musculus
ccattggcgatattggccggccatt

SEQ ID NO: 343160 - DNA, 25 bp, Mus musculus
ccattggctcccaaggtgctaggga

SEQ ID NO: 343161 - DNA, 25 bp, Mus musculus
ccattggctccctaggtgctaggga

SEQ ID NO: 343162 - DNA, 25 bp, Mus musculus
ccattggctgtgaggctagctgtag

SEQ ID NO: 343163 - DNA, 25 bp, Mus musculus
ccattggctgtgtggctagctgtag

SEQ ID NO: 343164 - DNA, 25 bp, Mus musculus
ccattggcttggaagtaacggctca

SEQ ID NO: 343165 - DNA, 25 bp, Mus musculus
ccattggcttggtagtaacggctca

SEQ ID NO: 343166 - DNA, 25 bp, Mus musculus
ccattgggccagacactgcttaaaa

SEQ ID NO: 343167 - DNA, 25 bp, Mus musculus
ccattgggccagtcactgcttaaaa

SEQ ID NO: 343168 - DNA, 25 bp, Mus musculus
ccattgggttcaattttgttgccac

SEQ ID NO: 343169 - DNA, 25 bp, Mus musculus
ccattgggttcatttttgttgccac

SEQ ID NO: 343170 - DNA, 25 bp, Mus musculus
ccattggtccccagtggtgggtctg

SEQ ID NO: 343171 - DNA, 25 bp, Mus musculus
ccattggtcccctgtggtgggtctg

SEQ ID NO: 343172 - DNA, 25 bp, Mus musculus
ccattggtctatacaaagggcctga

SEQ ID NO: 343173 - DNA, 25 bp, Mus musculus
ccattggtctattcaaagggcctga

SEQ ID NO: 343174 - DNA, 25 bp, Mus musculus
ccattggtgatgatgcaaagaaact

SEQ ID NO: 343175 - DNA, 25 bp, Mus musculus
ccattggtgatgttgcaaagaaact

SEQ ID NO: 343176 - DNA, 25 bp, Mus musculus
ccattggtgtagcttgaaggcagat

SEQ ID NO: 343177 - DNA, 25 bp, Mus musculus
ccattggtgtaggttgaaggcagat

SEQ ID NO: 343178 - DNA, 25 bp, Mus musculus
ccattggttccaagcacctcaggag

SEQ ID NO: 343179 - DNA, 25 bp, Mus musculus
ccattggttccatgcacctcaggag

SEQ ID NO: 343180 - DNA, 25 bp, Mus musculus
ccattgtaatatctacatgcctgta

SEQ ID NO: 343181 - DNA, 25 bp, Mus musculus
ccattgtaatatgtacatgcctgta

SEQ ID NO: 343182 - DNA, 25 bp, Mus musculus
ccattgtacgagctttgtacagatt

SEQ ID NO: 343183 - DNA, 25 bp, Mus musculus
ccattgtacgaggtttgtacagatt

SEQ ID NO: 343184 - DNA, 25 bp, Mus musculus
ccattgtagagtaggaatccgattt

SEQ ID NO: 343185 - DNA, 25 bp, Mus musculus
ccattgtagagttggaatccgattt

SEQ ID NO: 343186 - DNA, 25 bp, Mus musculus
ccattgtatcaaagcccctccagaa

SEQ ID NO: 343187 - DNA, 25 bp, Mus musculus
ccattgtatcaatgcccctccagaa

SEQ ID NO: 343188 - DNA, 25 bp, Mus musculus
ccattgtcgtggctagagtcttata

SEQ ID NO: 343189 - DNA, 25 bp, Mus musculus
ccattgtcgtgggtagagtcttata

SEQ ID NO: 343190 - DNA, 25 bp, Mus musculus
ccattgtctgtaaaggtgagtccac

SEQ ID NO: 343191 - DNA, 25 bp, Mus musculus
ccattgtctgtataggtgagtccac

SEQ ID NO: 343192 - DNA, 25 bp, Mus musculus
ccattgtctgtcagttcctgagata

SEQ ID NO: 343193 - DNA, 25 bp, Mus musculus
ccattgtctgtctgttcctgagata

SEQ ID NO: 343194 - DNA, 25 bp, Mus musculus
ccattgtgcagacttctcatctaaa

SEQ ID NO: 343195 - DNA, 25 bp, Mus musculus
ccattgtgcagagttctcatctaaa

SEQ ID NO: 343196 - DNA, 25 bp, Mus musculus
ccattgtggaaaatttaggcagttc

SEQ ID NO: 343197 - DNA, 25 bp, Mus musculus
ccattgtggaaattttaggcagttc

SEQ ID NO: 343198 - DNA, 25 bp, Mus musculus
ccattgtggaacatcaacgtgttca

SEQ ID NO: 343199 - DNA, 25 bp, Mus musculus
ccattgtggaacttcaacgtgttca

SEQ ID NO: 343200 - DNA, 25 bp, Mus musculus
ccattgtggatgatgctgttgattt

SEQ ID NO: 343201 - DNA, 25 bp, Mus musculus
ccattgtggatgttgctgttgattt

SEQ ID NO: 343202 - DNA, 25 bp, Mus musculus
ccattgtggcataggtgtacaacgt

SEQ ID NO: 343203 - DNA, 25 bp, Mus musculus
ccattgtggcattggtgtacaacgt

SEQ ID NO: 343204 - DNA, 25 bp, Mus musculus
ccattgtgggaaaccctgatccctt

SEQ ID NO: 343205 - DNA, 25 bp, Mus musculus
ccattgtgggaatccctgatccctt

SEQ ID NO: 343206 - DNA, 25 bp, Mus musculus
ccattgtggttcactcgacaggaga

SEQ ID NO: 343207 - DNA, 25 bp, Mus musculus
ccattgtggttctctcgacaggaga

SEQ ID NO: 343208 - DNA, 25 bp, Mus musculus
ccattgtgtatcagggattaactat

SEQ ID NO: 343209 - DNA, 25 bp, Mus musculus
ccattgtgtatctgggattaactat

SEQ ID NO: 343210 - DNA, 25 bp, Mus musculus
ccattgtgtgtcctgattcattctg

SEQ ID NO: 343211 - DNA, 25 bp, Mus musculus
ccattgtgtgtcgtgattcattctg

SEQ ID NO: 343212 - DNA, 25 bp, Mus musculus
ccattgtttaccagcctggagagtt

SEQ ID NO: 343213 - DNA, 25 bp, Mus musculus
ccattgtttacctgcctggagagtt

SEQ ID NO: 343214 - DNA, 25 bp, Mus musculus
ccattgtttcccatccaggaggctc

SEQ ID NO: 343215 - DNA, 25 bp, Mus musculus
ccattgtttcccttccaggaggctc

SEQ ID NO: 343216 - DNA, 25 bp, Mus musculus
ccatttaacggtcgcggacctactg

SEQ ID NO: 343217 - DNA, 25 bp, Mus musculus
ccatttaacggtggcggacctactg

SEQ ID NO: 343218 - DNA, 25 bp, Mus musculus
ccatttaatatgctcttttatctaa

SEQ ID NO: 343219 - DNA, 25 bp, Mus musculus
ccatttaatatggtcttttatctaa

SEQ ID NO: 343220 - DNA, 25 bp, Mus musculus
ccatttaatcagcaacgtggcccat

SEQ ID NO: 343221 - DNA, 25 bp, Mus musculus
ccatttaatcaggaacgtggcccat

SEQ ID NO: 343222 - DNA, 25 bp, Mus musculus
ccatttacagcaatgccaaatatgg

SEQ ID NO: 343223 - DNA, 25 bp, Mus musculus
ccatttacagcattgccaaatatgg

SEQ ID NO: 343224 - DNA, 25 bp, Mus musculus
ccatttaccaaactagcagtgggca

SEQ ID NO: 343225 - DNA, 25 bp, Mus musculus
ccatttaccaaagtagcagtgggca

SEQ ID NO: 343226 - DNA, 25 bp, Mus musculus
ccatttaccactctaagaactactg

SEQ ID NO: 343227 - DNA, 25 bp, Mus musculus
ccatttaccactgtaagaactactg

SEQ ID NO: 343228 - DNA, 25 bp, Mus musculus
ccatttaccttacgagttctagagg

SEQ ID NO: 343229 - DNA, 25 bp, Mus musculus
ccatttaccttaggagttctagagg

SEQ ID NO: 343230 - DNA, 25 bp, Mus musculus
ccatttagattccttatgtgatttt

SEQ ID NO: 343231 - DNA, 25 bp, Mus musculus
ccatttagattcgttatgtgatttt

SEQ ID NO: 343232 - DNA, 25 bp, Mus musculus
ccatttagcccaccttgaacaaaga

SEQ ID NO: 343233 - DNA, 25 bp, Mus musculus
ccatttagcccagcttgaacaaaga

SEQ ID NO: 343234 - DNA, 25 bp, Mus musculus
ccatttagtttgcttccaatgatta

SEQ ID NO: 343235 - DNA, 25 bp, Mus musculus
ccatttagtttggttccaatgatta

SEQ ID NO: 343236 - DNA, 25 bp, Mus musculus
ccatttatcttaacccagggcattc

SEQ ID NO: 343237 - DNA, 25 bp, Mus musculus
ccatttatcttatcccagggcattc

SEQ ID NO: 343238 - DNA, 25 bp, Mus musculus
ccatttatgtgtactcttcttttgc

SEQ ID NO: 343239 - DNA, 25 bp, Mus musculus
ccatttatgtgttctcttcttttgc

SEQ ID NO: 343240 - DNA, 25 bp, Mus musculus
ccatttatttaacgcgcccacgaca

SEQ ID NO: 343241 - DNA, 25 bp, Mus musculus
ccatttatttaaggcgcccacgaca

SEQ ID NO: 343242 - DNA, 25 bp, Mus musculus
ccatttattttaacggctgccttcg

SEQ ID NO: 343243 - DNA, 25 bp, Mus musculus
ccatttattttatcggctgccttcg

SEQ ID NO: 343244 - DNA, 25 bp, Mus musculus
ccatttcaagaacgcaagagggata

SEQ ID NO: 343245 - DNA, 25 bp, Mus musculus
ccatttcaagaaggcaagagggata

SEQ ID NO: 343246 - DNA, 25 bp, Mus musculus
ccatttcaatcacaactcgtggttg

SEQ ID NO: 343247 - DNA, 25 bp, Mus musculus
ccatttcaatcagaactcgtggttg

SEQ ID NO: 343248 - DNA, 25 bp, Mus musculus
ccatttcacagaaccattcacagtt

SEQ ID NO: 343249 - DNA, 25 bp, Mus musculus
ccatttcacagatccattcacagtt

SEQ ID NO: 343250 - DNA, 25 bp, Mus musculus
ccatttcaccccattcagaatgact

SEQ ID NO: 343251 - DNA, 25 bp, Mus musculus
ccatttcacccctttcagaatgact

SEQ ID NO: 343252 - DNA, 25 bp, Mus musculus
ccatttcagcaacgatgtgcacaaa

SEQ ID NO: 343253 - DNA, 25 bp, Mus musculus
ccatttcagcaaggatgtgcacaaa

SEQ ID NO: 343254 - DNA, 25 bp, Mus musculus
ccatttcattaacagtcagaggtca

SEQ ID NO: 343255 - DNA, 25 bp, Mus musculus
ccatttcattaagagtcagaggtca

SEQ ID NO: 343256 - DNA, 25 bp, Mus musculus
ccatttcccattatctgaagacatt

SEQ ID NO: 343257 - DNA, 25 bp, Mus musculus
ccatttcccattttctgaagacatt

SEQ ID NO: 343258 - DNA, 25 bp, Mus musculus
ccatttcccctcaaactgtacattt

SEQ ID NO: 343259 - DNA, 25 bp, Mus musculus
ccatttcccctctaactgtacattt

SEQ ID NO: 343260 - DNA, 25 bp, Mus musculus
ccatttccctggagtcttcaaagga

SEQ ID NO: 343261 - DNA, 25 bp, Mus musculus
ccatttccctggtgtcttcaaagga

SEQ ID NO: 343262 - DNA, 25 bp, Mus musculus
ccatttcctcctataacttctgaat

SEQ ID NO: 343263 - DNA, 25 bp, Mus musculus
ccatttcctcctttaacttctgaat

SEQ ID NO: 343264 - DNA, 25 bp, Mus musculus
ccatttcctcggagaatttctagca

SEQ ID NO: 343265 - DNA, 25 bp, Mus musculus
ccatttcctcggtgaatttctagca

SEQ ID NO: 343266 - DNA, 25 bp, Mus musculus
ccatttcctctaaatcattagttat

SEQ ID NO: 343267 - DNA, 25 bp, Mus musculus
ccatttcctctatatcattagttat

SEQ ID NO: 343268 - DNA, 25 bp, Mus musculus
ccatttcctggacatttggagttct

SEQ ID NO: 343269 - DNA, 25 bp, Mus musculus
ccatttcctggagatttggagttct

SEQ ID NO: 343270 - DNA, 25 bp, Mus musculus
ccatttcgtattcccctgaaaagtg

SEQ ID NO: 343271 - DNA, 25 bp, Mus musculus
ccatttcgtattgccctgaaaagtg

SEQ ID NO: 343272 - DNA, 25 bp, Mus musculus
ccatttctacagattctttccattc

SEQ ID NO: 343273 - DNA, 25 bp, Mus musculus
ccatttctacagtttctttccattc

SEQ ID NO: 343274 - DNA, 25 bp, Mus musculus
ccatttctatcaaccattccgatgt

SEQ ID NO: 343275 - DNA, 25 bp, Mus musculus
ccatttctatcatccattccgatgt

SEQ ID NO: 343276 - DNA, 25 bp, Mus musculus
ccatttctatccatggagtgtgagc

SEQ ID NO: 343277 - DNA, 25 bp, Mus musculus
ccatttctatccttggagtgtgagc

SEQ ID NO: 343278 - DNA, 25 bp, Mus musculus
ccatttctgaggactaagtgagttg

SEQ ID NO: 343279 - DNA, 25 bp, Mus musculus
ccatttctgaggtctaagtgagttg

SEQ ID NO: 343280 - DNA, 25 bp, Mus musculus
ccatttctgggaataccaatacttg

SEQ ID NO: 343281 - DNA, 25 bp, Mus musculus
ccatttctgggattaccaatacttg

SEQ ID NO: 343282 - DNA, 25 bp, Mus musculus
ccatttcttattcttggtgagtaaa

SEQ ID NO: 343283 - DNA, 25 bp, Mus musculus
ccatttcttattgttggtgagtaaa

SEQ ID NO: 343284 - DNA, 25 bp, Mus musculus
ccatttcttgttcccagcattggta

SEQ ID NO: 343285 - DNA, 25 bp, Mus musculus
ccatttcttgttgccagcattggta

SEQ ID NO: 343286 - DNA, 25 bp, Mus musculus
ccatttctttccctgcactttgtta

SEQ ID NO: 343287 - DNA, 25 bp, Mus musculus
ccatttctttccgtgcactttgtta

SEQ ID NO: 343288 - DNA, 25 bp, Mus musculus
ccatttgacttgctgaagggcgcta

SEQ ID NO: 343289 - DNA, 25 bp, Mus musculus
ccatttgacttggtgaagggcgcta

SEQ ID NO: 343290 - DNA, 25 bp, Mus musculus
ccatttgatggcagtgagcatgtac

SEQ ID NO: 343291 - DNA, 25 bp, Mus musculus
ccatttgatggctgtgagcatgtac

SEQ ID NO: 343292 - DNA, 25 bp, Mus musculus
ccatttgcacatacttcctcaacat

SEQ ID NO: 343293 - DNA, 25 bp, Mus musculus
ccatttgcacattcttcctcaacat

SEQ ID NO: 343294 - DNA, 25 bp, Mus musculus
ccatttgcaccaacaagacaagcgt

SEQ ID NO: 343295 - DNA, 25 bp, Mus musculus
ccatttgcaccatcaagacaagcgt

SEQ ID NO: 343296 - DNA, 25 bp, Mus musculus
ccatttgcagtgccaaagtggagat

SEQ ID NO: 343297 - DNA, 25 bp, Mus musculus
ccatttgcagtggcaaagtggagat

SEQ ID NO: 343298 - DNA, 25 bp, Mus musculus
ccatttgcttcaatgtgttgcagag

SEQ ID NO: 343299 - DNA, 25 bp, Mus musculus
ccatttgcttcattgtgttgcagag

SEQ ID NO: 343300 - DNA, 25 bp, Mus musculus
ccatttggcatcatttgtgtgttcc

SEQ ID NO: 343301 - DNA, 25 bp, Mus musculus
ccatttggcatcttttgtgtgttcc

SEQ ID NO: 343302 - DNA, 25 bp, Mus musculus
ccatttgggcaacagccggcataaa

SEQ ID NO: 343303 - DNA, 25 bp, Mus musculus
ccatttgggcaagagccggcataaa

SEQ ID NO: 343304 - DNA, 25 bp, Mus musculus
ccatttgggcagcttgatgtggttt

SEQ ID NO: 343305 - DNA, 25 bp, Mus musculus
ccatttgggcaggttgatgtggttt

SEQ ID NO: 343306 - DNA, 25 bp, Mus musculus
ccatttggtcacaatcaatctcaac

SEQ ID NO: 343307 - DNA, 25 bp, Mus musculus
ccatttggtcactatcaatctcaac

SEQ ID NO: 343308 - DNA, 25 bp, Mus musculus
ccatttgtacatccaagcgtattaa

SEQ ID NO: 343309 - DNA, 25 bp, Mus musculus
ccatttgtacatgcaagcgtattaa

SEQ ID NO: 343310 - DNA, 25 bp, Mus musculus
ccatttgtaccaaaacagtgttctt

SEQ ID NO: 343311 - DNA, 25 bp, Mus musculus
ccatttgtaccataacagtgttctt

SEQ ID NO: 343312 - DNA, 25 bp, Mus musculus
ccatttgtacctatgagggagggat

SEQ ID NO: 343313 - DNA, 25 bp, Mus musculus
ccatttgtacctttgagggagggat

SEQ ID NO: 343314 - DNA, 25 bp, Mus musculus
ccatttgtagtaagaggcgcgttta

SEQ ID NO: 343315 - DNA, 25 bp, Mus musculus
ccatttgtagtatgaggcgcgttta

SEQ ID NO: 343316 - DNA, 25 bp, Mus musculus
ccatttgtctatcaatgtgaccatt

SEQ ID NO: 343317 - DNA, 25 bp, Mus musculus
ccatttgtctatgaatgtgaccatt

SEQ ID NO: 343318 - DNA, 25 bp, Mus musculus
ccatttgtctcactgttgagcttac

SEQ ID NO: 343319 - DNA, 25 bp, Mus musculus
ccatttgtctcagtgttgagcttac

SEQ ID NO: 343320 - DNA, 25 bp, Mus musculus
ccatttgtctctcaacatggaatga

SEQ ID NO: 343321 - DNA, 25 bp, Mus musculus
ccatttgtctctgaacatggaatga

SEQ ID NO: 343322 - DNA, 25 bp, Mus musculus
ccatttgtgcgtaaatgtttaataa

SEQ ID NO: 343323 - DNA, 25 bp, Mus musculus
ccatttgtgcgttaatgtttaataa

SEQ ID NO: 343324 - DNA, 25 bp, Mus musculus
ccatttgttaaaacagtgcgtgtgt

SEQ ID NO: 343325 - DNA, 25 bp, Mus musculus
ccatttgttaaatcagtgcgtgtgt

SEQ ID NO: 343326 - DNA, 25 bp, Mus musculus
ccatttgttcaaaagtgctccagca

SEQ ID NO: 343327 - DNA, 25 bp, Mus musculus
ccatttgttcaatagtgctccagca

SEQ ID NO: 343328 - DNA, 25 bp, Mus musculus
ccatttgttctgcattttgattctg

SEQ ID NO: 343329 - DNA, 25 bp, Mus musculus
ccatttgttctggattttgattctg

SEQ ID NO: 343330 - DNA, 25 bp, Mus musculus
ccatttgttttcagtccacagtttt

SEQ ID NO: 343331 - DNA, 25 bp, Mus musculus
ccatttgttttctgtccacagtttt

SEQ ID NO: 343332 - DNA, 25 bp, Mus musculus
ccattttcagctccaacacttggat

SEQ ID NO: 343333 - DNA, 25 bp, Mus musculus
ccattttcagctgcaacacttggat

SEQ ID NO: 343334 - DNA, 25 bp, Mus musculus
ccattttcatggatggatctttaat

SEQ ID NO: 343335 - DNA, 25 bp, Mus musculus
ccattttcatggttggatctttaat

SEQ ID NO: 343336 - DNA, 25 bp, Mus musculus
ccattttcccgtatcttgtagacag

SEQ ID NO: 343337 - DNA, 25 bp, Mus musculus
ccattttcccgtttcttgtagacag

SEQ ID NO: 343338 - DNA, 25 bp, Mus musculus
ccattttctattagttcgaactctg

SEQ ID NO: 343339 - DNA, 25 bp, Mus musculus
ccattttctatttgttcgaactctg

SEQ ID NO: 343340 - DNA, 25 bp, Mus musculus
ccattttctcccagttgctatttaa

SEQ ID NO: 343341 - DNA, 25 bp, Mus musculus
ccattttctccctgttgctatttaa

SEQ ID NO: 343342 - DNA, 25 bp, Mus musculus
ccattttcttcacatcagggcagaa

SEQ ID NO: 343343 - DNA, 25 bp, Mus musculus
ccattttcttcagatcagggcagaa

SEQ ID NO: 343344 - DNA, 25 bp, Mus musculus
ccattttcttgcagagatgacatga

SEQ ID NO: 343345 - DNA, 25 bp, Mus musculus
ccattttcttgctgagatgacatga

SEQ ID NO: 343346 - DNA, 25 bp, Mus musculus
ccattttcttggacacacatatttg

SEQ ID NO: 343347 - DNA, 25 bp, Mus musculus
ccattttcttggtcacacatatttg

SEQ ID NO: 343348 - DNA, 25 bp, Mus musculus
ccattttcttgtactccttatctaa

SEQ ID NO: 343349 - DNA, 25 bp, Mus musculus
ccattttcttgttctccttatctaa

SEQ ID NO: 343350 - DNA, 25 bp, Mus musculus
ccattttctttacctgtttcaatga

SEQ ID NO: 343351 - DNA, 25 bp, Mus musculus
ccattttctttagctgtttcaatga

SEQ ID NO: 343352 - DNA, 25 bp, Mus musculus
ccattttgaatgcagatgataattt

SEQ ID NO: 343353 - DNA, 25 bp, Mus musculus
ccattttgaatggagatgataattt

SEQ ID NO: 343354 - DNA, 25 bp, Mus musculus
ccattttgacaaagtcttgggcaat

SEQ ID NO: 343355 - DNA, 25 bp, Mus musculus
ccattttgacaatgtcttgggcaat

SEQ ID NO: 343356 - DNA, 25 bp, Mus musculus
ccattttgatggctggtatcggcaa

SEQ ID NO: 343357 - DNA, 25 bp, Mus musculus
ccattttgatgggtggtatcggcaa

SEQ ID NO: 343358 - DNA, 25 bp, Mus musculus
ccattttgcctaaagtcacagccag

SEQ ID NO: 343359 - DNA, 25 bp, Mus musculus
ccattttgcctatagtcacagccag

SEQ ID NO: 343360 - DNA, 25 bp, Mus musculus
ccattttgctggctgttggaatttc

SEQ ID NO: 343361 - DNA, 25 bp, Mus musculus
ccattttgctgggtgttggaatttc

SEQ ID NO: 343362 - DNA, 25 bp, Mus musculus
ccattttggatgaacagcacgggca

SEQ ID NO: 343363 - DNA, 25 bp, Mus musculus
ccattttggatgtacagcacgggca

SEQ ID NO: 343364 - DNA, 25 bp, Mus musculus
ccattttggtataccttgctaattt

SEQ ID NO: 343365 - DNA, 25 bp, Mus musculus
ccattttggtattccttgctaattt

SEQ ID NO: 343366 - DNA, 25 bp, Mus musculus
ccatttttgagccattcttttgtca

SEQ ID NO: 343367 - DNA, 25 bp, Mus musculus
ccatttttgagcgattcttttgtca

SEQ ID NO: 343368 - DNA, 25 bp, Mus musculus
ccatttttggcaatccgacagttta

SEQ ID NO: 343369 - DNA, 25 bp, Mus musculus
ccatttttggcattccgacagttta

SEQ ID NO: 343370 - DNA, 25 bp, Mus musculus
ccatttttgttgatccttaggcatt

SEQ ID NO: 343371 - DNA, 25 bp, Mus musculus
ccatttttgttgttccttaggcatt

SEQ ID NO: 343372 - DNA, 25 bp, Mus musculus
ccatttttgtttcccaggacatgca

SEQ ID NO: 343373 - DNA, 25 bp, Mus musculus
ccatttttgtttgccaggacatgca

SEQ ID NO: 343374 - DNA, 25 bp, Mus musculus
ccattttttcctctgcttttagtat

SEQ ID NO: 343375 - DNA, 25 bp, Mus musculus
ccattttttcctctgggtatccatg

SEQ ID NO: 343376 - DNA, 25 bp, Mus musculus
ccattttttcctgtgcttttagtat

SEQ ID NO: 343377 - DNA, 25 bp, Mus musculus
ccattttttcctgtgggtatccatg

SEQ ID NO: 343378 - DNA, 25 bp, Mus musculus
cccaaaacaagtaacatggaataat

SEQ ID NO: 343379 - DNA, 25 bp, Mus musculus
cccaaaacaagttacatggaataat

SEQ ID NO: 343380 - DNA, 25 bp, Mus musculus
cccaaaaccagccagtgagatccag

SEQ ID NO: 343381 - DNA, 25 bp, Mus musculus
cccaaaaccagcgagtgagatccag

SEQ ID NO: 343382 - DNA, 25 bp, Mus musculus
cccaaaagcaatccctggcacagag

SEQ ID NO: 343383 - DNA, 25 bp, Mus musculus
cccaaaagcaatgcctggcacagag

SEQ ID NO: 343384 - DNA, 25 bp, Mus musculus
cccaaaagcacccagacttcgtggc

SEQ ID NO: 343385 - DNA, 25 bp, Mus musculus
cccaaaagcaccgagacttcgtggc

SEQ ID NO: 343386 - DNA, 25 bp, Mus musculus
cccaaaagtagtctgcggcaggctc

SEQ ID NO: 343387 - DNA, 25 bp, Mus musculus
cccaaaagtagtgtgcggcaggctc

SEQ ID NO: 343388 - DNA, 25 bp, Mus musculus
cccaaaatatgcatcagtgtgacca

SEQ ID NO: 343389 - DNA, 25 bp, Mus musculus
cccaaaatatgcttcagtgtgacca

SEQ ID NO: 343390 - DNA, 25 bp, Mus musculus
cccaaacagcacagccagctaggga

SEQ ID NO: 343391 - DNA, 25 bp, Mus musculus
cccaaacagcactgccagctaggga

SEQ ID NO: 343392 - DNA, 25 bp, Mus musculus
cccaaacagggcagtgatcagcagt

SEQ ID NO: 343393 - DNA, 25 bp, Mus musculus
cccaaacagggctgtgatcagcagt

SEQ ID NO: 343394 - DNA, 25 bp, Mus musculus
cccaaacccagactaaaggcaacag

SEQ ID NO: 343395 - DNA, 25 bp, Mus musculus
cccaaacccagagtaaaggcaacag

SEQ ID NO: 343396 - DNA, 25 bp, Mus musculus
cccaaactctttcactctcatttgt

SEQ ID NO: 343397 - DNA, 25 bp, Mus musculus
cccaaactctttgactctcatttgt

SEQ ID NO: 343398 - DNA, 25 bp, Mus musculus
cccaaagcctacaaaacaagataca

SEQ ID NO: 343399 - DNA, 25 bp, Mus musculus
cccaaagcctactaaacaagataca

SEQ ID NO: 343400 - DNA, 25 bp, Mus musculus
cccaaagcctgcctgatgttggaca

SEQ ID NO: 343401 - DNA, 25 bp, Mus musculus
cccaaagcctgcgtgatgttggaca

SEQ ID NO: 343402 - DNA, 25 bp, Mus musculus
cccaaagctaagaatgtcctcagac

SEQ ID NO: 343403 - DNA, 25 bp, Mus musculus
cccaaagctaagtatgtcctcagac

SEQ ID NO: 343404 - DNA, 25 bp, Mus musculus
cccaaaggaagaacgctcagagcca

SEQ ID NO: 343405 - DNA, 25 bp, Mus musculus
cccaaaggaagatcgctcagagcca

SEQ ID NO: 343406 - DNA, 25 bp, Mus musculus
cccaaaggaggacgccagtcgctgt

SEQ ID NO: 343407 - DNA, 25 bp, Mus musculus
cccaaaggaggaggccagtcgctgt

SEQ ID NO: 343408 - DNA, 25 bp, Mus musculus
cccaaaggcagcaggttctactacc

SEQ ID NO: 343409 - DNA, 25 bp, Mus musculus
cccaaaggcagctggttctactacc

SEQ ID NO: 343410 - DNA, 25 bp, Mus musculus
cccaaagtaacacagttcctctaag

SEQ ID NO: 343411 - DNA, 25 bp, Mus musculus
cccaaagtaacagagttcctctaag

SEQ ID NO: 343412 - DNA, 25 bp, Mus musculus
cccaaagtgcccagagacatgccct

SEQ ID NO: 343413 - DNA, 25 bp, Mus musculus
cccaaagtgccctgagacatgccct

SEQ ID NO: 343414 - DNA, 25 bp, Mus musculus
cccaaagttgttattgtagaacatg

SEQ ID NO: 343415 - DNA, 25 bp, Mus musculus
cccaaagttgttcgtgcccagcacc

SEQ ID NO: 343416 - DNA, 25 bp, Mus musculus
cccaaagttgttggtgcccagcacc

SEQ ID NO: 343417 - DNA, 25 bp, Mus musculus
cccaaagttgtttttgtagaacatg

SEQ ID NO: 343418 - DNA, 25 bp, Mus musculus
cccaaatccacaaagcctactttat

SEQ ID NO: 343419 - DNA, 25 bp, Mus musculus
cccaaatccacatagcctactttat

SEQ ID NO: 343420 - DNA, 25 bp, Mus musculus
cccaaatcctagaaacctctgtctt

SEQ ID NO: 343421 - DNA, 25 bp, Mus musculus
cccaaatcctagtaacctctgtctt

SEQ ID NO: 343422 - DNA, 25 bp, Mus musculus
cccaaatgctcacgaagatctctac

SEQ ID NO: 343423 - DNA, 25 bp, Mus musculus
cccaaatgctcaggaagatctctac

SEQ ID NO: 343424 - DNA, 25 bp, Mus musculus
cccaaattcttgcacggtgtattgt

SEQ ID NO: 343425 - DNA, 25 bp, Mus musculus
cccaaattcttggacggtgtattgt

SEQ ID NO: 343426 - DNA, 25 bp, Mus musculus
cccaaattgccacaccttgtttaat

SEQ ID NO: 343427 - DNA, 25 bp, Mus musculus
cccaaattgccagaccttgtttaat

SEQ ID NO: 343428 - DNA, 25 bp, Mus musculus
cccaacaatcgccatcagggaagct

SEQ ID NO: 343429 - DNA, 25 bp, Mus musculus
cccaacaatcgcgatcagggaagct

SEQ ID NO: 343430 - DNA, 25 bp, Mus musculus
cccaacacaaggaggcctctcagat

SEQ ID NO: 343431 - DNA, 25 bp, Mus musculus
cccaacacaaggtggcctctcagat

SEQ ID NO: 343432 - DNA, 25 bp, Mus musculus
cccaacacagtgcatggagatatgt

SEQ ID NO: 343433 - DNA, 25 bp, Mus musculus
cccaacacagtggatggagatatgt

SEQ ID NO: 343434 - DNA, 25 bp, Mus musculus
cccaacagataacagtaccagcact

SEQ ID NO: 343435 - DNA, 25 bp, Mus musculus
cccaacagataagagtaccagcact

SEQ ID NO: 343436 - DNA, 25 bp, Mus musculus
cccaacatgtccactgtgcatatgg

SEQ ID NO: 343437 - DNA, 25 bp, Mus musculus
cccaacatgtcctctgtgcatatgg

SEQ ID NO: 343438 - DNA, 25 bp, Mus musculus
cccaacattctcaaaactgtgcctt

SEQ ID NO: 343439 - DNA, 25 bp, Mus musculus
cccaacattctctaaactgtgcctt

SEQ ID NO: 343440 - DNA, 25 bp, Mus musculus
cccaaccaagccaggtgtgtttgta

SEQ ID NO: 343441 - DNA, 25 bp, Mus musculus
cccaaccaagcctggtgtgtttgta

SEQ ID NO: 343442 - DNA, 25 bp, Mus musculus
cccaacccacagcttaggaaaaatg

SEQ ID NO: 343443 - DNA, 25 bp, Mus musculus
cccaacccacaggttaggaaaaatg

SEQ ID NO: 343444 - DNA, 25 bp, Mus musculus
cccaaccccataacaagtatcagta

SEQ ID NO: 343445 - DNA, 25 bp, Mus musculus
cccaaccccatatcaagtatcagta

SEQ ID NO: 343446 - DNA, 25 bp, Mus musculus
cccaaccctgagataccaaagaagg

SEQ ID NO: 343447 - DNA, 25 bp, Mus musculus
cccaaccctgagttaccaaagaagg

SEQ ID NO: 343448 - DNA, 25 bp, Mus musculus
cccaaccggataagtgcattcaaga

SEQ ID NO: 343449 - DNA, 25 bp, Mus musculus
cccaaccggatatgtgcattcaaga

SEQ ID NO: 343450 - DNA, 25 bp, Mus musculus
cccaaccttagcctaagcatcttat

SEQ ID NO: 343451 - DNA, 25 bp, Mus musculus
cccaaccttagcgtaagcatcttat

SEQ ID NO: 343452 - DNA, 25 bp, Mus musculus
cccaacctttttccactttgaattg

SEQ ID NO: 343453 - DNA, 25 bp, Mus musculus
cccaacctttttgcactttgaattg

SEQ ID NO: 343454 - DNA, 25 bp, Mus musculus
cccaacgtgagcatgtgcttatgca

SEQ ID NO: 343455 - DNA, 25 bp, Mus musculus
cccaacgtgagcttgtgcttatgca

SEQ ID NO: 343456 - DNA, 25 bp, Mus musculus
cccaactacacgaactccaatgaga

SEQ ID NO: 343457 - DNA, 25 bp, Mus musculus
cccaactacacgtactccaatgaga

SEQ ID NO: 343458 - DNA, 25 bp, Mus musculus
cccaactatttgagttcgatcccca

SEQ ID NO: 343459 - DNA, 25 bp, Mus musculus
cccaactatttgtgttcgatcccca

SEQ ID NO: 343460 - DNA, 25 bp, Mus musculus
cccaactcctgcattcagtacagat

SEQ ID NO: 343461 - DNA, 25 bp, Mus musculus
cccaactcctgctttcagtacagat

SEQ ID NO: 343462 - DNA, 25 bp, Mus musculus
cccaactcttatctcctattttgat

SEQ ID NO: 343463 - DNA, 25 bp, Mus musculus
cccaactcttatgtcctattttgat

SEQ ID NO: 343464 - DNA, 25 bp, Mus musculus
cccaactcttttatcatctgcgaga

SEQ ID NO: 343465 - DNA, 25 bp, Mus musculus
cccaactcttttttcatctgcgaga

SEQ ID NO: 343466 - DNA, 25 bp, Mus musculus
cccaactgtctcatgcttttgtgaa

SEQ ID NO: 343467 - DNA, 25 bp, Mus musculus
cccaactgtctcttgcttttgtgaa

SEQ ID NO: 343468 - DNA, 25 bp, Mus musculus
cccaacttcaatagcaggaccctga

SEQ ID NO: 343469 - DNA, 25 bp, Mus musculus
cccaacttcaattgcaggaccctga

SEQ ID NO: 343470 - DNA, 25 bp, Mus musculus
cccaacttgttgctagatttttctt

SEQ ID NO: 343471 - DNA, 25 bp, Mus musculus
cccaacttgttggtagatttttctt

SEQ ID NO: 343472 - DNA, 25 bp, Mus musculus
cccaactttctaactgaatccaagc

SEQ ID NO: 343473 - DNA, 25 bp, Mus musculus
cccaactttctatctgaatccaagc

SEQ ID NO: 343474 - DNA, 25 bp, Mus musculus
cccaacttttagaacccatcatcat

SEQ ID NO: 343475 - DNA, 25 bp, Mus musculus
cccaacttttagtacccatcatcat

SEQ ID NO: 343476 - DNA, 25 bp, Mus musculus
cccaagaaaccgcagaataatgttg

SEQ ID NO: 343477 - DNA, 25 bp, Mus musculus
cccaagaaaccggagaataatgttg

SEQ ID NO: 343478 - DNA, 25 bp, Mus musculus
cccaagaagatccagatatcccact

SEQ ID NO: 343479 - DNA, 25 bp, Mus musculus
cccaagaagatcgagatatcccact

SEQ ID NO: 343480 - DNA, 25 bp, Mus musculus
cccaagacatggcttacgtactctt

SEQ ID NO: 343481 - DNA, 25 bp, Mus musculus
cccaagacatgggttacgtactctt

SEQ ID NO: 343482 - DNA, 25 bp, Mus musculus
cccaagactgctcctcttaaaatag

SEQ ID NO: 343483 - DNA, 25 bp, Mus musculus
cccaagactgctgctcttaaaatag

SEQ ID NO: 343484 - DNA, 25 bp, Mus musculus
cccaagactgggagtgtgagcctca

SEQ ID NO: 343485 - DNA, 25 bp, Mus musculus
cccaagactgggtgtgtgagcctca

SEQ ID NO: 343486 - DNA, 25 bp, Mus musculus
cccaagaggaagcaccatcctgcag

SEQ ID NO: 343487 - DNA, 25 bp, Mus musculus
cccaagaggaaggaccatcctgcag

SEQ ID NO: 343488 - DNA, 25 bp, Mus musculus
cccaagaggcttcagatactagttg

SEQ ID NO: 343489 - DNA, 25 bp, Mus musculus
cccaagaggcttgagatactagttg

SEQ ID NO: 343490 - DNA, 25 bp, Mus musculus
cccaagatgcctcagccagtagtga

SEQ ID NO: 343491 - DNA, 25 bp, Mus musculus
cccaagatgcctgagccagtagtga

SEQ ID NO: 343492 - DNA, 25 bp, Mus musculus
cccaagcaccacagtacagactggg

SEQ ID NO: 343493 - DNA, 25 bp, Mus musculus
cccaagcaccactgtacagactggg

SEQ ID NO: 343494 - DNA, 25 bp, Mus musculus
cccaagccaggtaagggatggagta

SEQ ID NO: 343495 - DNA, 25 bp, Mus musculus
cccaagccaggttagggatggagta

SEQ ID NO: 343496 - DNA, 25 bp, Mus musculus
cccaagccagtgaacaactgggaac

SEQ ID NO: 343497 - DNA, 25 bp, Mus musculus
cccaagccagtgtacaactgggaac

SEQ ID NO: 343498 - DNA, 25 bp, Mus musculus
cccaagccagttcaaaatgtcctcg

SEQ ID NO: 343499 - DNA, 25 bp, Mus musculus
cccaagccagttgaaaatgtcctcg

SEQ ID NO: 343500 - DNA, 25 bp, Mus musculus
cccaagccctgaccctatggcagaa

SEQ ID NO: 343501 - DNA, 25 bp, Mus musculus
cccaagccctgagcctatggcagaa

SEQ ID NO: 343502 - DNA, 25 bp, Mus musculus
cccaagcctgcgaggatgacgagga

SEQ ID NO: 343503 - DNA, 25 bp, Mus musculus
cccaagcctgcgtggatgacgagga

SEQ ID NO: 343504 - DNA, 25 bp, Mus musculus
cccaagctctatatcttgattcttt

SEQ ID NO: 343505 - DNA, 25 bp, Mus musculus
cccaagctctatttcttgattcttt

SEQ ID NO: 343506 - DNA, 25 bp, Mus musculus
cccaagctctctctaatgtttggct

SEQ ID NO: 343507 - DNA, 25 bp, Mus musculus
cccaagctctctgtaatgtttggct

SEQ ID NO: 343508 - DNA, 25 bp, Mus musculus
cccaagctttacagtaggtccttag

SEQ ID NO: 343509 - DNA, 25 bp, Mus musculus
cccaagctttactgtaggtccttag

SEQ ID NO: 343510 - DNA, 25 bp, Mus musculus
cccaagctttatcttcttggagctt

SEQ ID NO: 343511 - DNA, 25 bp, Mus musculus
cccaagctttatgttcttggagctt

SEQ ID NO: 343512 - DNA, 25 bp, Mus musculus
cccaagctttgtatcggccatgaga

SEQ ID NO: 343513 - DNA, 25 bp, Mus musculus
cccaagctttgtttcggccatgaga

SEQ ID NO: 343514 - DNA, 25 bp, Mus musculus
cccaaggaggaaacagaaacgagaa

SEQ ID NO: 343515 - DNA, 25 bp, Mus musculus
cccaaggaggaatcagaaacgagaa

SEQ ID NO: 343516 - DNA, 25 bp, Mus musculus
cccaaggatattccctttgttacaa

SEQ ID NO: 343517 - DNA, 25 bp, Mus musculus
cccaaggatattgcctttgttacaa

SEQ ID NO: 343518 - DNA, 25 bp, Mus musculus
cccaaggcagtaataggagaccatg

SEQ ID NO: 343519 - DNA, 25 bp, Mus musculus
cccaaggcagtattaggagaccatg

SEQ ID NO: 343520 - DNA, 25 bp, Mus musculus
cccaaggcccctcattttttcagca

SEQ ID NO: 343521 - DNA, 25 bp, Mus musculus
cccaaggcccctgattttttcagca

SEQ ID NO: 343522 - DNA, 25 bp, Mus musculus
cccaaggcctgcatcagatttgtga

SEQ ID NO: 343523 - DNA, 25 bp, Mus musculus
cccaaggcctgcttcagatttgtga

SEQ ID NO: 343524 - DNA, 25 bp, Mus musculus
cccaaggcttgcatctgaccagagt

SEQ ID NO: 343525 - DNA, 25 bp, Mus musculus
cccaaggcttgcttctgaccagagt

SEQ ID NO: 343526 - DNA, 25 bp, Mus musculus
cccaaggctttgacgcaggtgctaa

SEQ ID NO: 343527 - DNA, 25 bp, Mus musculus
cccaaggctttgagctggcaaataa

SEQ ID NO: 343528 - DNA, 25 bp, Mus musculus
cccaaggctttgtcgcaggtgctaa

SEQ ID NO: 343529 - DNA, 25 bp, Mus musculus
cccaaggctttgtgctggcaaataa

SEQ ID NO: 343530 - DNA, 25 bp, Mus musculus
cccaagggatggctattattcaggt

SEQ ID NO: 343531 - DNA, 25 bp, Mus musculus
cccaagggatgggtattattcaggt

SEQ ID NO: 343532 - DNA, 25 bp, Mus musculus
cccaagggccccagagtgagtcatg

SEQ ID NO: 343533 - DNA, 25 bp, Mus musculus
cccaagggcccctgagtgagtcatg

SEQ ID NO: 343534 - DNA, 25 bp, Mus musculus
cccaagggtgagattcggtcagcca

SEQ ID NO: 343535 - DNA, 25 bp, Mus musculus
cccaagggtgagtttcggtcagcca

SEQ ID NO: 343536 - DNA, 25 bp, Mus musculus
cccaagggtgtccagtttcgctgtt

SEQ ID NO: 343537 - DNA, 25 bp, Mus musculus
cccaagggtgtcgagtttcgctgtt

SEQ ID NO: 343538 - DNA, 25 bp, Mus musculus
cccaaggtgatactggagatccacg

SEQ ID NO: 343539 - DNA, 25 bp, Mus musculus
cccaaggtgatagtggagatccacg

SEQ ID NO: 343540 - DNA, 25 bp, Mus musculus
cccaaggtggagaccagcgtggtca

SEQ ID NO: 343541 - DNA, 25 bp, Mus musculus
cccaaggtggagtccagcgtggtca

SEQ ID NO: 343542 - DNA, 25 bp, Mus musculus
cccaaggtgtgcctgcctctcaatt

SEQ ID NO: 343543 - DNA, 25 bp, Mus musculus
cccaaggtgtgcgtgcctctcaatt

SEQ ID NO: 343544 - DNA, 25 bp, Mus musculus
cccaaggttctgatggtttgtctgt

SEQ ID NO: 343545 - DNA, 25 bp, Mus musculus
cccaaggttctgttggtttgtctgt

SEQ ID NO: 343546 - DNA, 25 bp, Mus musculus
cccaaggtttacagatgctccgttt

SEQ ID NO: 343547 - DNA, 25 bp, Mus musculus
cccaaggtttactgatgctccgttt

SEQ ID NO: 343548 - DNA, 25 bp, Mus musculus
cccaaggtttcaatctctatattag

SEQ ID NO: 343549 - DNA, 25 bp, Mus musculus
cccaaggtttcattctctatattag

SEQ ID NO: 343550 - DNA, 25 bp, Mus musculus
cccaagtacaatagctccttttgtg

SEQ ID NO: 343551 - DNA, 25 bp, Mus musculus
cccaagtacaattgctccttttgtg

SEQ ID NO: 343552 - DNA, 25 bp, Mus musculus
cccaagtaccagacatgcatgtggt

SEQ ID NO: 343553 - DNA, 25 bp, Mus musculus
cccaagtaccagtcatgcatgtggt

SEQ ID NO: 343554 - DNA, 25 bp, Mus musculus
cccaagtactaacggcttcgagcca

SEQ ID NO: 343555 - DNA, 25 bp, Mus musculus
cccaagtactaagggcttcgagcca

SEQ ID NO: 343556 - DNA, 25 bp, Mus musculus
cccaagtccatccacgacagtgaga

SEQ ID NO: 343557 - DNA, 25 bp, Mus musculus
cccaagtccatcgacgacagtgaga

SEQ ID NO: 343558 - DNA, 25 bp, Mus musculus
cccaagtccattaacttaaccagct

SEQ ID NO: 343559 - DNA, 25 bp, Mus musculus
cccaagtccatttacttaaccagct

SEQ ID NO: 343560 - DNA, 25 bp, Mus musculus
cccaagtcctccaattcacattaag

SEQ ID NO: 343561 - DNA, 25 bp, Mus musculus
cccaagtcctcctattcacattaag

SEQ ID NO: 343562 - DNA, 25 bp, Mus musculus
cccaagtccttgatgttagctagct

SEQ ID NO: 343563 - DNA, 25 bp, Mus musculus
cccaagtccttgttgttagctagct

SEQ ID NO: 343564 - DNA, 25 bp, Mus musculus
cccaagtctccgaagagccatttgg

SEQ ID NO: 343565 - DNA, 25 bp, Mus musculus
cccaagtctccgtagagccatttgg

SEQ ID NO: 343566 - DNA, 25 bp, Mus musculus
cccaagtctgatagtgctttttctc

SEQ ID NO: 343567 - DNA, 25 bp, Mus musculus
cccaagtctgattgtgctttttctc

SEQ ID NO: 343568 - DNA, 25 bp, Mus musculus
cccaagtgaagtagctcgcagctgg

SEQ ID NO: 343569 - DNA, 25 bp, Mus musculus
cccaagtgaagttgctcgcagctgg

SEQ ID NO: 343570 - DNA, 25 bp, Mus musculus
cccaagtggactctgccagtatagt

SEQ ID NO: 343571 - DNA, 25 bp, Mus musculus
cccaagtggactgtgccagtatagt

SEQ ID NO: 343572 - DNA, 25 bp, Mus musculus
cccaagtggccactttggagccgca

SEQ ID NO: 343573 - DNA, 25 bp, Mus musculus
cccaagtggccagtttggagccgca

SEQ ID NO: 343574 - DNA, 25 bp, Mus musculus
cccaagtgtggtcactttctttctt

SEQ ID NO: 343575 - DNA, 25 bp, Mus musculus
cccaagtgtggtgactttctttctt

SEQ ID NO: 343576 - DNA, 25 bp, Mus musculus
cccaagtgtttcacgtgaagatgac

SEQ ID NO: 343577 - DNA, 25 bp, Mus musculus
cccaagtgtttctcgtgaagatgac

SEQ ID NO: 343578 - DNA, 25 bp, Mus musculus
cccaagttggagactacactgttgt

SEQ ID NO: 343579 - DNA, 25 bp, Mus musculus
cccaagttggagtctacactgttgt

SEQ ID NO: 343580 - DNA, 25 bp, Mus musculus
cccaagtttctcatttctgtgaaag

SEQ ID NO: 343581 - DNA, 25 bp, Mus musculus
cccaagtttctcttttctgtgaaag

SEQ ID NO: 343582 - DNA, 25 bp, Mus musculus
cccaagtttggccttttgcacatta

SEQ ID NO: 343583 - DNA, 25 bp, Mus musculus
cccaagtttggcgttttgcacatta

SEQ ID NO: 343584 - DNA, 25 bp, Mus musculus
cccaataagcttcccacattttcag

SEQ ID NO: 343585 - DNA, 25 bp, Mus musculus
cccaataagcttgccacattttcag

SEQ ID NO: 343586 - DNA, 25 bp, Mus musculus
cccaataccttcatgcgctaatgaa

SEQ ID NO: 343587 - DNA, 25 bp, Mus musculus
cccaataccttcttgcgctaatgaa

SEQ ID NO: 343588 - DNA, 25 bp, Mus musculus
cccaataggctaaagtctcacatta

SEQ ID NO: 343589 - DNA, 25 bp, Mus musculus
cccaataggctatagtctcacatta

SEQ ID NO: 343590 - DNA, 25 bp, Mus musculus
cccaatatctctaccgaacatttca

SEQ ID NO: 343591 - DNA, 25 bp, Mus musculus
cccaatatctcttccgaacatttca

SEQ ID NO: 343592 - DNA, 25 bp, Mus musculus
cccaatatgggtcacagactctcaa

SEQ ID NO: 343593 - DNA, 25 bp, Mus musculus
cccaatatgggtgacagactctcaa

SEQ ID NO: 343594 - DNA, 25 bp, Mus musculus
cccaatatttgtaatccacctgatg

SEQ ID NO: 343595 - DNA, 25 bp, Mus musculus
cccaatatttgttatccacctgatg

SEQ ID NO: 343596 - DNA, 25 bp, Mus musculus
cccaatatttttcccatgttcaaat

SEQ ID NO: 343597 - DNA, 25 bp, Mus musculus
cccaatatttttgccatgttcaaat

SEQ ID NO: 343598 - DNA, 25 bp, Mus musculus
cccaatcatttgaacgtgtgagttg

SEQ ID NO: 343599 - DNA, 25 bp, Mus musculus
cccaatcatttgtacgtgtgagttg

SEQ ID NO: 343600 - DNA, 25 bp, Mus musculus
cccaatccgggcagtggaaaccaga

SEQ ID NO: 343601 - DNA, 25 bp, Mus musculus
cccaatccgggctgtggaaaccaga

SEQ ID NO: 343602 - DNA, 25 bp, Mus musculus
cccaatcctggtctcactatgaagt

SEQ ID NO: 343603 - DNA, 25 bp, Mus musculus
cccaatcctggtgtcactatgaagt

SEQ ID NO: 343604 - DNA, 25 bp, Mus musculus
cccaatctggtcaatggcctattaa

SEQ ID NO: 343605 - DNA, 25 bp, Mus musculus
cccaatctggtctatggcctattaa

SEQ ID NO: 343606 - DNA, 25 bp, Mus musculus
cccaatcttggtcagctctggagta

SEQ ID NO: 343607 - DNA, 25 bp, Mus musculus
cccaatcttggtgagctctggagta

SEQ ID NO: 343608 - DNA, 25 bp, Mus musculus
cccaatgagaatatgagtgttgtca

SEQ ID NO: 343609 - DNA, 25 bp, Mus musculus
cccaatgagaatttgagtgttgtca

SEQ ID NO: 343610 - DNA, 25 bp, Mus musculus
cccaatgccacgagaagatgccggt

SEQ ID NO: 343611 - DNA, 25 bp, Mus musculus
cccaatgccacgtgaagatgccggt

SEQ ID NO: 343612 - DNA, 25 bp, Mus musculus
cccaatgcccttcatggcagagaca

SEQ ID NO: 343613 - DNA, 25 bp, Mus musculus
cccaatgcccttgatggcagagaca

SEQ ID NO: 343614 - DNA, 25 bp, Mus musculus
cccaatgctttcattagtgccaaca

SEQ ID NO: 343615 - DNA, 25 bp, Mus musculus
cccaatgctttctttagtgccaaca

SEQ ID NO: 343616 - DNA, 25 bp, Mus musculus
cccaatggactgactgttctccaga

SEQ ID NO: 343617 - DNA, 25 bp, Mus musculus
cccaatggactgtctgttctccaga

SEQ ID NO: 343618 - DNA, 25 bp, Mus musculus
cccaatggggacagctagtggttcc

SEQ ID NO: 343619 - DNA, 25 bp, Mus musculus
cccaatggggactgctagtggttcc

SEQ ID NO: 343620 - DNA, 25 bp, Mus musculus
cccaatggttagaaggcagaggcag

SEQ ID NO: 343621 - DNA, 25 bp, Mus musculus
cccaatggttagtaggcagaggcag

SEQ ID NO: 343622 - DNA, 25 bp, Mus musculus
cccaatgtcagtactggagactatt

SEQ ID NO: 343623 - DNA, 25 bp, Mus musculus
cccaatgtcagttctggagactatt

SEQ ID NO: 343624 - DNA, 25 bp, Mus musculus
cccaatgtgctgacaccgtatttgg

SEQ ID NO: 343625 - DNA, 25 bp, Mus musculus
cccaatgtgctgtcaccgtatttgg

SEQ ID NO: 343626 - DNA, 25 bp, Mus musculus
cccaatgtgttgattcgttactact

SEQ ID NO: 343627 - DNA, 25 bp, Mus musculus
cccaatgtgttgtttcgttactact

SEQ ID NO: 343628 - DNA, 25 bp, Mus musculus
cccaattaattgcttcctttcataa

SEQ ID NO: 343629 - DNA, 25 bp, Mus musculus
cccaattaattggttcctttcataa

SEQ ID NO: 343630 - DNA, 25 bp, Mus musculus
cccaattattttatccctatatgga

SEQ ID NO: 343631 - DNA, 25 bp, Mus musculus
cccaattattttttccctatatgga

SEQ ID NO: 343632 - DNA, 25 bp, Mus musculus
cccaattcaaacaaaggcagcacct

SEQ ID NO: 343633 - DNA, 25 bp, Mus musculus
cccaattcaaactaaggcagcacct

SEQ ID NO: 343634 - DNA, 25 bp, Mus musculus
cccaattctctgagtactaccaaca

SEQ ID NO: 343635 - DNA, 25 bp, Mus musculus
cccaattctctgtgtactaccaaca

SEQ ID NO: 343636 - DNA, 25 bp, Mus musculus
cccaattgccatcttcaggtggttt

SEQ ID NO: 343637 - DNA, 25 bp, Mus musculus
cccaattgccatgttcaggtggttt

SEQ ID NO: 343638 - DNA, 25 bp, Mus musculus
cccaatttagggactgcagtgcgga

SEQ ID NO: 343639 - DNA, 25 bp, Mus musculus
cccaatttagggtctgcagtgcgga

SEQ ID NO: 343640 - DNA, 25 bp, Mus musculus
cccaatttgggcatatgactcatag

SEQ ID NO: 343641 - DNA, 25 bp, Mus musculus
cccaatttgggcttatgactcatag

SEQ ID NO: 343642 - DNA, 25 bp, Mus musculus
cccaatttttctcgttctgtgtatt

SEQ ID NO: 343643 - DNA, 25 bp, Mus musculus
cccaatttttctggttctgtgtatt

SEQ ID NO: 343644 - DNA, 25 bp, Mus musculus
cccacaaaatggaggctaacaaaga

SEQ ID NO: 343645 - DNA, 25 bp, Mus musculus
cccacaaaatggtggctaacaaaga

SEQ ID NO: 343646 - DNA, 25 bp, Mus musculus
cccacaaacacaagttggctgctgt

SEQ ID NO: 343647 - DNA, 25 bp, Mus musculus
cccacaaacacaatcatcagctata

SEQ ID NO: 343648 - DNA, 25 bp, Mus musculus
cccacaaacacatgttggctgctgt

SEQ ID NO: 343649 - DNA, 25 bp, Mus musculus
cccacaaacacattcatcagctata

SEQ ID NO: 343650 - DNA, 25 bp, Mus musculus
cccacaaaggcaaaagactgttaca

SEQ ID NO: 343651 - DNA, 25 bp, Mus musculus
cccacaaaggcataagactgttaca

SEQ ID NO: 343652 - DNA, 25 bp, Mus musculus
cccacaaatgctcctgctatgtaac

SEQ ID NO: 343653 - DNA, 25 bp, Mus musculus
cccacaaatgctgctgctatgtaac

SEQ ID NO: 343654 - DNA, 25 bp, Mus musculus
cccacaacctcaattcatcagtatt

SEQ ID NO: 343655 - DNA, 25 bp, Mus musculus
cccacaacctcatttcatcagtatt

SEQ ID NO: 343656 - DNA, 25 bp, Mus musculus
cccacaacttggacgtcctgagtaa

SEQ ID NO: 343657 - DNA, 25 bp, Mus musculus
cccacaacttggtcgtcctgagtaa

SEQ ID NO: 343658 - DNA, 25 bp, Mus musculus
cccacaagaccaagagaggccaggc

SEQ ID NO: 343659 - DNA, 25 bp, Mus musculus
cccacaagaccatgagaggccaggc

SEQ ID NO: 343660 - DNA, 25 bp, Mus musculus
cccacaatccttctgtccagaatcc

SEQ ID NO: 343661 - DNA, 25 bp, Mus musculus
cccacaatccttgtgtccagaatcc

SEQ ID NO: 343662 - DNA, 25 bp, Mus musculus
cccacaattgggacaggagagagat

SEQ ID NO: 343663 - DNA, 25 bp, Mus musculus
cccacaattgggtcaggagagagat

SEQ ID NO: 343664 - DNA, 25 bp, Mus musculus
cccacacacgtacactttctgtaaa

SEQ ID NO: 343665 - DNA, 25 bp, Mus musculus
cccacacacgtagactttctgtaaa

SEQ ID NO: 343666 - DNA, 25 bp, Mus musculus
cccacacagcaaccgcaggtgatgt

SEQ ID NO: 343667 - DNA, 25 bp, Mus musculus
cccacacagcaagcgcaggtgatgt

SEQ ID NO: 343668 - DNA, 25 bp, Mus musculus
cccacacagccaaaccaaaccctat

SEQ ID NO: 343669 - DNA, 25 bp, Mus musculus
cccacacagccataccaaaccctat

SEQ ID NO: 343670 - DNA, 25 bp, Mus musculus
cccacaccattgatgttctctaaaa

SEQ ID NO: 343671 - DNA, 25 bp, Mus musculus
cccacaccattgttgttctctaaaa

SEQ ID NO: 343672 - DNA, 25 bp, Mus musculus
cccacacccaggaaagagcaattta

SEQ ID NO: 343673 - DNA, 25 bp, Mus musculus
cccacacccaggtaagagcaattta

SEQ ID NO: 343674 - DNA, 25 bp, Mus musculus
cccacacctgaaacttagacttcta

SEQ ID NO: 343675 - DNA, 25 bp, Mus musculus
cccacacctgaatcttagacttcta

SEQ ID NO: 343676 - DNA, 25 bp, Mus musculus
cccacacctgtccacaatttagaat

SEQ ID NO: 343677 - DNA, 25 bp, Mus musculus
cccacacctgtcgacaatttagaat

SEQ ID NO: 343678 - DNA, 25 bp, Mus musculus
cccacacgaattcgagcctgagaag

SEQ ID NO: 343679 - DNA, 25 bp, Mus musculus
cccacacgaattggagcctgagaag

SEQ ID NO: 343680 - DNA, 25 bp, Mus musculus
cccacacgagccagttttcataata

SEQ ID NO: 343681 - DNA, 25 bp, Mus musculus
cccacacgagcctgttttcataata

SEQ ID NO: 343682 - DNA, 25 bp, Mus musculus
cccacactagcgattcctaagtgaa

SEQ ID NO: 343683 - DNA, 25 bp, Mus musculus
cccacactagcgtttcctaagtgaa

SEQ ID NO: 343684 - DNA, 25 bp, Mus musculus
cccacactcctgcttcatgaagatt

SEQ ID NO: 343685 - DNA, 25 bp, Mus musculus
cccacactcctggttcatgaagatt

SEQ ID NO: 343686 - DNA, 25 bp, Mus musculus
cccacactgactccagacttttaaa

SEQ ID NO: 343687 - DNA, 25 bp, Mus musculus
cccacactgactgcagacttttaaa

SEQ ID NO: 343688 - DNA, 25 bp, Mus musculus
cccacacttgtcagtctaagtctat

SEQ ID NO: 343689 - DNA, 25 bp, Mus musculus
cccacacttgtctgtctaagtctat

SEQ ID NO: 343690 - DNA, 25 bp, Mus musculus
cccacacttgtgactatgcaggctg

SEQ ID NO: 343691 - DNA, 25 bp, Mus musculus
cccacacttgtgtctatgcaggctg

SEQ ID NO: 343692 - DNA, 25 bp, Mus musculus
cccacagaacatcaattaagacttt

SEQ ID NO: 343693 - DNA, 25 bp, Mus musculus
cccacagaacatgaattaagacttt

SEQ ID NO: 343694 - DNA, 25 bp, Mus musculus
cccacagaatgcagagtttttataa

SEQ ID NO: 343695 - DNA, 25 bp, Mus musculus
cccacagaatgctgagtttttataa

SEQ ID NO: 343696 - DNA, 25 bp, Mus musculus
cccacagaggatccagccagtgtat

SEQ ID NO: 343697 - DNA, 25 bp, Mus musculus
cccacagaggatgcagccagtgtat

SEQ ID NO: 343698 - DNA, 25 bp, Mus musculus
cccacagaggccattcattgaacag

SEQ ID NO: 343699 - DNA, 25 bp, Mus musculus
cccacagaggcctttcattgaacag

SEQ ID NO: 343700 - DNA, 25 bp, Mus musculus
cccacagagtttcaattatgttctg

SEQ ID NO: 343701 - DNA, 25 bp, Mus musculus
cccacagagtttgaattatgttctg

SEQ ID NO: 343702 - DNA, 25 bp, Mus musculus
cccacagcagacacttctggacatg

SEQ ID NO: 343703 - DNA, 25 bp, Mus musculus
cccacagcagactcttctggacatg

SEQ ID NO: 343704 - DNA, 25 bp, Mus musculus
cccacagcgagtacctatttttgat

SEQ ID NO: 343705 - DNA, 25 bp, Mus musculus
cccacagcgagttcctatttttgat

SEQ ID NO: 343706 - DNA, 25 bp, Mus musculus
cccacagctgtgacttgatttttaa

SEQ ID NO: 343707 - DNA, 25 bp, Mus musculus
cccacagctgtgtcttgatttttaa

SEQ ID NO: 343708 - DNA, 25 bp, Mus musculus
cccacagcttgtctagttcttaaat

SEQ ID NO: 343709 - DNA, 25 bp, Mus musculus
cccacagcttgtgtagttcttaaat

SEQ ID NO: 343710 - DNA, 25 bp, Mus musculus
cccacaggaagcaggagactgagct

SEQ ID NO: 343711 - DNA, 25 bp, Mus musculus
cccacaggaagctggagactgagct

SEQ ID NO: 343712 - DNA, 25 bp, Mus musculus
cccacaggaggccagagactgagct

SEQ ID NO: 343713 - DNA, 25 bp, Mus musculus
cccacaggaggcgagagactgagct

SEQ ID NO: 343714 - DNA, 25 bp, Mus musculus
cccacaggatgcatcagagcctgaa

SEQ ID NO: 343715 - DNA, 25 bp, Mus musculus
cccacaggatgcttcagagcctgaa

SEQ ID NO: 343716 - DNA, 25 bp, Mus musculus
cccacagggacacacacggacatgt

SEQ ID NO: 343717 - DNA, 25 bp, Mus musculus
cccacagggacagacacggacatgt

SEQ ID NO: 343718 - DNA, 25 bp, Mus musculus
cccacagggctaaggaaagcagagt

SEQ ID NO: 343719 - DNA, 25 bp, Mus musculus
cccacagggctatggaaagcagagt

SEQ ID NO: 343720 - DNA, 25 bp, Mus musculus
cccacaggtggcagagattagcagt

SEQ ID NO: 343721 - DNA, 25 bp, Mus musculus
cccacaggtggctgagattagcagt

SEQ ID NO: 343722 - DNA, 25 bp, Mus musculus
cccacagtactgactggctgaggag

SEQ ID NO: 343723 - DNA, 25 bp, Mus musculus
cccacagtactgtctggctgaggag

SEQ ID NO: 343724 - DNA, 25 bp, Mus musculus
cccacagtacttagagttcgagttt

SEQ ID NO: 343725 - DNA, 25 bp, Mus musculus
cccacagtactttgagttcgagttt

SEQ ID NO: 343726 - DNA, 25 bp, Mus musculus
cccacagtgatgatgtcgagatcgg

SEQ ID NO: 343727 - DNA, 25 bp, Mus musculus
cccacagtgatgttgtcgagatcgg

SEQ ID NO: 343728 - DNA, 25 bp, Mus musculus
cccacagtggctctcaatcacagta

SEQ ID NO: 343729 - DNA, 25 bp, Mus musculus
cccacagtggctgtcaatcacagta

SEQ ID NO: 343730 - DNA, 25 bp, Mus musculus
cccacagtggtaccttttacagtca

SEQ ID NO: 343731 - DNA, 25 bp, Mus musculus
cccacagtggtagcttttacagtca

SEQ ID NO: 343732 - DNA, 25 bp, Mus musculus
cccacagtgtttcctcctgttaaga

SEQ ID NO: 343733 - DNA, 25 bp, Mus musculus
cccacagtgtttgctcctgttaaga

SEQ ID NO: 343734 - DNA, 25 bp, Mus musculus
cccacatacgttctattaccattca

SEQ ID NO: 343735 - DNA, 25 bp, Mus musculus
cccacatacgttgtattaccattca

SEQ ID NO: 343736 - DNA, 25 bp, Mus musculus
cccacatagctaactgaacctcaat

SEQ ID NO: 343737 - DNA, 25 bp, Mus musculus
cccacatagctatctgaacctcaat

SEQ ID NO: 343738 - DNA, 25 bp, Mus musculus
cccacatatcctcaacttttctttt

SEQ ID NO: 343739 - DNA, 25 bp, Mus musculus
cccacatatcctgaacttttctttt

SEQ ID NO: 343740 - DNA, 25 bp, Mus musculus
cccacatattgtactttcctctaag

SEQ ID NO: 343741 - DNA, 25 bp, Mus musculus
cccacatattgttctttcctctaag

SEQ ID NO: 343742 - DNA, 25 bp, Mus musculus
cccacatcaacaaagctggcttttc

SEQ ID NO: 343743 - DNA, 25 bp, Mus musculus
cccacatcaacatagctggcttttc

SEQ ID NO: 343744 - DNA, 25 bp, Mus musculus
cccacatcagcaacgtttcttttaa

SEQ ID NO: 343745 - DNA, 25 bp, Mus musculus
cccacatcagcatcgtttcttttaa

SEQ ID NO: 343746 - DNA, 25 bp, Mus musculus
cccacatcagggatcacttccacat

SEQ ID NO: 343747 - DNA, 25 bp, Mus musculus
cccacatcagggttcacttccacat

SEQ ID NO: 343748 - DNA, 25 bp, Mus musculus
cccacatccaatactcttgcttttt

SEQ ID NO: 343749 - DNA, 25 bp, Mus musculus
cccacatccaattctcttgcttttt

SEQ ID NO: 343750 - DNA, 25 bp, Mus musculus
cccacatcgggcacagtatttttag

SEQ ID NO: 343751 - DNA, 25 bp, Mus musculus
cccacatcgggctcagtatttttag

SEQ ID NO: 343752 - DNA, 25 bp, Mus musculus
cccacatctcatacctttatcaaag

SEQ ID NO: 343753 - DNA, 25 bp, Mus musculus
cccacatctcattcctttatcaaag

SEQ ID NO: 343754 - DNA, 25 bp, Mus musculus
cccacatgatttagttttccccatg

SEQ ID NO: 343755 - DNA, 25 bp, Mus musculus
cccacatgattttgttttccccatg

SEQ ID NO: 343756 - DNA, 25 bp, Mus musculus
cccacatgcaggcagtcctaagcat

SEQ ID NO: 343757 - DNA, 25 bp, Mus musculus
cccacatgcagggagtcctaagcat

SEQ ID NO: 343758 - DNA, 25 bp, Mus musculus
cccacatgctggcttctggaatgca

SEQ ID NO: 343759 - DNA, 25 bp, Mus musculus
cccacatgctgggttctggaatgca

SEQ ID NO: 343760 - DNA, 25 bp, Mus musculus
cccacatgggtgcatggtcctgcac

SEQ ID NO: 343761 - DNA, 25 bp, Mus musculus
cccacatgggtggatggtcctgcac

SEQ ID NO: 343762 - DNA, 25 bp, Mus musculus
cccacatgtgacattcctataatct

SEQ ID NO: 343763 - DNA, 25 bp, Mus musculus
cccacatgtgactttcctataatct

SEQ ID NO: 343764 - DNA, 25 bp, Mus musculus
cccacatgtgtgctgcatggtcact

SEQ ID NO: 343765 - DNA, 25 bp, Mus musculus
cccacatgtgtggtgcatggtcact

SEQ ID NO: 343766 - DNA, 25 bp, Mus musculus
cccacatgtttaagcagaactgcta

SEQ ID NO: 343767 - DNA, 25 bp, Mus musculus
cccacatgtttatgcagaactgcta

SEQ ID NO: 343768 - DNA, 25 bp, Mus musculus
cccacattattccacaagcctgtgg

SEQ ID NO: 343769 - DNA, 25 bp, Mus musculus
cccacattattcgacaagcctgtgg

SEQ ID NO: 343770 - DNA, 25 bp, Mus musculus
cccacattctgacgggggctagcct

SEQ ID NO: 343771 - DNA, 25 bp, Mus musculus
cccacattctgaggggggctagcct

SEQ ID NO: 343772 - DNA, 25 bp, Mus musculus
cccacattggccattatttactact

SEQ ID NO: 343773 - DNA, 25 bp, Mus musculus
cccacattggcctttatttactact

SEQ ID NO: 343774 - DNA, 25 bp, Mus musculus
cccacattgtatctcacaaccattt

SEQ ID NO: 343775 - DNA, 25 bp, Mus musculus
cccacattgtatgtcacaaccattt

SEQ ID NO: 343776 - DNA, 25 bp, Mus musculus
cccacattgtgcctgtttgactttt

SEQ ID NO: 343777 - DNA, 25 bp, Mus musculus
cccacattgtgcgtgtttgactttt

SEQ ID NO: 343778 - DNA, 25 bp, Mus musculus
cccacatttcaacgcctcggaggag

SEQ ID NO: 343779 - DNA, 25 bp, Mus musculus
cccacatttcaaggcctcggaggag

SEQ ID NO: 343780 - DNA, 25 bp, Mus musculus
cccacatttctgatccttgacgaat

SEQ ID NO: 343781 - DNA, 25 bp, Mus musculus
cccacatttctgttccttgacgaat

SEQ ID NO: 343782 - DNA, 25 bp, Mus musculus
cccacattttcactaccaaacatag

SEQ ID NO: 343783 - DNA, 25 bp, Mus musculus
cccacattttcagtaccaaacatag

SEQ ID NO: 343784 - DNA, 25 bp, Mus musculus
cccaccaaagctcagtgacgtgctg

SEQ ID NO: 343785 - DNA, 25 bp, Mus musculus
cccaccaaagctgagtgacgtgctg

SEQ ID NO: 343786 - DNA, 25 bp, Mus musculus
cccaccaacatcaggagtccatccc

SEQ ID NO: 343787 - DNA, 25 bp, Mus musculus
cccaccaacatctggagtccatccc

SEQ ID NO: 343788 - DNA, 25 bp, Mus musculus
cccaccaacgtcacagcatgtatga

SEQ ID NO: 343789 - DNA, 25 bp, Mus musculus
cccaccaacgtctcagcatgtatga

SEQ ID NO: 343790 - DNA, 25 bp, Mus musculus
cccaccaagaaactatagatttagg

SEQ ID NO: 343791 - DNA, 25 bp, Mus musculus
cccaccaagaaagtatagatttagg

SEQ ID NO: 343792 - DNA, 25 bp, Mus musculus
cccaccaatgggatgaggcatagtc

SEQ ID NO: 343793 - DNA, 25 bp, Mus musculus
cccaccaatgggttgaggcatagtc

SEQ ID NO: 343794 - DNA, 25 bp, Mus musculus
cccaccacacatacctttgaaataa

SEQ ID NO: 343795 - DNA, 25 bp, Mus musculus
cccaccacacattcctttgaaataa

SEQ ID NO: 343796 - DNA, 25 bp, Mus musculus
cccaccacagcaaagacacagaata

SEQ ID NO: 343797 - DNA, 25 bp, Mus musculus
cccaccacagcatagacacagaata

SEQ ID NO: 343798 - DNA, 25 bp, Mus musculus
cccaccacataacattactctttta

SEQ ID NO: 343799 - DNA, 25 bp, Mus musculus
cccaccacataagattactctttta

SEQ ID NO: 343800 - DNA, 25 bp, Mus musculus
cccaccacctagagattttgatgtg

SEQ ID NO: 343801 - DNA, 25 bp, Mus musculus
cccaccacctagtgattttgatgtg

SEQ ID NO: 343802 - DNA, 25 bp, Mus musculus
cccaccactacacgcttattttatt

SEQ ID NO: 343803 - DNA, 25 bp, Mus musculus
cccaccactacactctgaatgaatg

SEQ ID NO: 343804 - DNA, 25 bp, Mus musculus
cccaccactacaggcttattttatt

SEQ ID NO: 343805 - DNA, 25 bp, Mus musculus
cccaccactacagtctgaatgaatg

SEQ ID NO: 343806 - DNA, 25 bp, Mus musculus
cccaccagcccgaggtagagactta

SEQ ID NO: 343807 - DNA, 25 bp, Mus musculus
cccaccagcccgtggtagagactta

SEQ ID NO: 343808 - DNA, 25 bp, Mus musculus
cccaccagtttgactactctgtagc

SEQ ID NO: 343809 - DNA, 25 bp, Mus musculus
cccaccagtttgtctactctgtagc

SEQ ID NO: 343810 - DNA, 25 bp, Mus musculus
cccaccatagccctttgagactgaa

SEQ ID NO: 343811 - DNA, 25 bp, Mus musculus
cccaccatagccgtttgagactgaa

SEQ ID NO: 343812 - DNA, 25 bp, Mus musculus
cccaccatagcgatggcagcatggg

SEQ ID NO: 343813 - DNA, 25 bp, Mus musculus
cccaccatagcgttggcagcatggg

SEQ ID NO: 343814 - DNA, 25 bp, Mus musculus
cccaccatatgactccatacagatt

SEQ ID NO: 343815 - DNA, 25 bp, Mus musculus
cccaccatatgagtccatacagatt

SEQ ID NO: 343816 - DNA, 25 bp, Mus musculus
cccaccatgcttaacctagttttat

SEQ ID NO: 343817 - DNA, 25 bp, Mus musculus
cccaccatgctttacctagttttat

SEQ ID NO: 343818 - DNA, 25 bp, Mus musculus
cccaccatgtgcaccggatatgaag

SEQ ID NO: 343819 - DNA, 25 bp, Mus musculus
cccaccatgtgctccggatatgaag

SEQ ID NO: 343820 - DNA, 25 bp, Mus musculus
cccacccaataaacatgcttcaaat

SEQ ID NO: 343821 - DNA, 25 bp, Mus musculus
cccacccaataatcatgcttcaaat

SEQ ID NO: 343822 - DNA, 25 bp, Mus musculus
cccacccacctgcattggattttgg

SEQ ID NO: 343823 - DNA, 25 bp, Mus musculus
cccacccacctggattggattttgg

SEQ ID NO: 343824 - DNA, 25 bp, Mus musculus
cccacccagggtaacagttacagat

SEQ ID NO: 343825 - DNA, 25 bp, Mus musculus
cccacccagggttacagttacagat

SEQ ID NO: 343826 - DNA, 25 bp, Mus musculus
cccacccatgtcagtgcatgagtaa

SEQ ID NO: 343827 - DNA, 25 bp, Mus musculus
cccacccatgtctgtgcatgagtaa

SEQ ID NO: 343828 - DNA, 25 bp, Mus musculus
cccacccctataataaataaatgtg

SEQ ID NO: 343829 - DNA, 25 bp, Mus musculus
cccacccctatattaaataaatgtg

SEQ ID NO: 343830 - DNA, 25 bp, Mus musculus
cccacccctctaaagttagtactat

SEQ ID NO: 343831 - DNA, 25 bp, Mus musculus
cccacccctctatagttagtactat

SEQ ID NO: 343832 - DNA, 25 bp, Mus musculus
cccacccgagccaccgagtgaggga

SEQ ID NO: 343833 - DNA, 25 bp, Mus musculus
cccacccgagcctccgagtgaggga

SEQ ID NO: 343834 - DNA, 25 bp, Mus musculus
cccacccgctgacattatttttata

SEQ ID NO: 343835 - DNA, 25 bp, Mus musculus
cccacccgctgagattatttttata

SEQ ID NO: 343836 - DNA, 25 bp, Mus musculus
cccacccggtgtcttagggatgcta

SEQ ID NO: 343837 - DNA, 25 bp, Mus musculus
cccacccggtgtgttagggatgcta

SEQ ID NO: 343838 - DNA, 25 bp, Mus musculus
cccaccctcagaatccttaaaggat

SEQ ID NO: 343839 - DNA, 25 bp, Mus musculus
cccaccctcagattccttaaaggat

SEQ ID NO: 343840 - DNA, 25 bp, Mus musculus
cccaccctgtgcacatatacaagta

SEQ ID NO: 343841 - DNA, 25 bp, Mus musculus
cccaccctgtgctcatatacaagta

SEQ ID NO: 343842 - DNA, 25 bp, Mus musculus
cccacccttcatagtgacatttggt

SEQ ID NO: 343843 - DNA, 25 bp, Mus musculus
cccacccttcattgtgacatttggt

SEQ ID NO: 343844 - DNA, 25 bp, Mus musculus
cccaccctttaaactttcagcaatg

SEQ ID NO: 343845 - DNA, 25 bp, Mus musculus
cccaccctttaatctttcagcaatg

SEQ ID NO: 343846 - DNA, 25 bp, Mus musculus
cccaccgccatgcatgatgggtgaa

SEQ ID NO: 343847 - DNA, 25 bp, Mus musculus
cccaccgccatggatgatgggtgaa

SEQ ID NO: 343848 - DNA, 25 bp, Mus musculus
cccaccggtggaaatgagaactttg

SEQ ID NO: 343849 - DNA, 25 bp, Mus musculus
cccaccggtggactcatcaacaaag

SEQ ID NO: 343850 - DNA, 25 bp, Mus musculus
cccaccggtggagtcatcaacaaag

SEQ ID NO: 343851 - DNA, 25 bp, Mus musculus
cccaccggtggatatgagaactttg

SEQ ID NO: 343852 - DNA, 25 bp, Mus musculus
cccaccgtgggacttgttaatgaga

SEQ ID NO: 343853 - DNA, 25 bp, Mus musculus
cccaccgtgggagttgttaatgaga

SEQ ID NO: 343854 - DNA, 25 bp, Mus musculus
cccacctaagctcatctcatattgt

SEQ ID NO: 343855 - DNA, 25 bp, Mus musculus
cccacctaagctgatctcatattgt

SEQ ID NO: 343856 - DNA, 25 bp, Mus musculus
cccacctacagaaccctatttccga

SEQ ID NO: 343857 - DNA, 25 bp, Mus musculus
cccacctacagatccctatttccga

SEQ ID NO: 343858 - DNA, 25 bp, Mus musculus
cccacctaggagagccaatacactt

SEQ ID NO: 343859 - DNA, 25 bp, Mus musculus
cccacctaggagtgccaatacactt

SEQ ID NO: 343860 - DNA, 25 bp, Mus musculus
cccacctagggtattttaatgagct

SEQ ID NO: 343861 - DNA, 25 bp, Mus musculus
cccacctagggttttttaatgagct

SEQ ID NO: 343862 - DNA, 25 bp, Mus musculus
cccacctcagacatcaagcttataa

SEQ ID NO: 343863 - DNA, 25 bp, Mus musculus
cccacctcagacttcaagcttataa

SEQ ID NO: 343864 - DNA, 25 bp, Mus musculus
cccacctcatttctggagttgcaat

SEQ ID NO: 343865 - DNA, 25 bp, Mus musculus
cccacctcatttgtggagttgcaat

SEQ ID NO: 343866 - DNA, 25 bp, Mus musculus
cccacctccacaaaattttggcttt

SEQ ID NO: 343867 - DNA, 25 bp, Mus musculus
cccacctccacataattttggcttt

SEQ ID NO: 343868 - DNA, 25 bp, Mus musculus
cccacctccatcataaacattttag

SEQ ID NO: 343869 - DNA, 25 bp, Mus musculus
cccacctccatcttaaacattttag

SEQ ID NO: 343870 - DNA, 25 bp, Mus musculus
cccacctccattacaggaagctgta

SEQ ID NO: 343871 - DNA, 25 bp, Mus musculus
cccacctccatttcaggaagctgta

SEQ ID NO: 343872 - DNA, 25 bp, Mus musculus
cccacctcctgacgcagggtaggta

SEQ ID NO: 343873 - DNA, 25 bp, Mus musculus
cccacctcctgaggcagggtaggta

SEQ ID NO: 343874 - DNA, 25 bp, Mus musculus
cccacctcctggctgtaaggagtgg

SEQ ID NO: 343875 - DNA, 25 bp, Mus musculus
cccacctcctgggtgtaaggagtgg

SEQ ID NO: 343876 - DNA, 25 bp, Mus musculus
cccacctctacacttgaatctgaga

SEQ ID NO: 343877 - DNA, 25 bp, Mus musculus
cccacctctacagttgaatctgaga

SEQ ID NO: 343878 - DNA, 25 bp, Mus musculus
cccacctctcagcatagagattggt

SEQ ID NO: 343879 - DNA, 25 bp, Mus musculus
cccacctctcaggatagagattggt

SEQ ID NO: 343880 - DNA, 25 bp, Mus musculus
cccacctctggtctagggagaacat

SEQ ID NO: 343881 - DNA, 25 bp, Mus musculus
cccacctctggtgtagggagaacat

SEQ ID NO: 343882 - DNA, 25 bp, Mus musculus
cccacctctgtaacatgcagttaaa

SEQ ID NO: 343883 - DNA, 25 bp, Mus musculus
cccacctctgtatcatgcagttaaa

SEQ ID NO: 343884 - DNA, 25 bp, Mus musculus
cccacctctgtccattagatcaagt

SEQ ID NO: 343885 - DNA, 25 bp, Mus musculus
cccacctctgtcgattagatcaagt

SEQ ID NO: 343886 - DNA, 25 bp, Mus musculus
cccacctgaggtagtaatagttcac

SEQ ID NO: 343887 - DNA, 25 bp, Mus musculus
cccacctgaggttgtaatagttcac

SEQ ID NO: 343888 - DNA, 25 bp, Mus musculus
cccacctggaataagttttgagcca

SEQ ID NO: 343889 - DNA, 25 bp, Mus musculus
cccacctggaattagttttgagcca

SEQ ID NO: 343890 - DNA, 25 bp, Mus musculus
cccacctggaggactttaacacaag

SEQ ID NO: 343891 - DNA, 25 bp, Mus musculus
cccacctggaggtctttaacacaag

SEQ ID NO: 343892 - DNA, 25 bp, Mus musculus
cccacctggcagatcttttacaatt

SEQ ID NO: 343893 - DNA, 25 bp, Mus musculus
cccacctggcagttcttttacaatt

SEQ ID NO: 343894 - DNA, 25 bp, Mus musculus
cccacctgggtcactctaagaatat

SEQ ID NO: 343895 - DNA, 25 bp, Mus musculus
cccacctgggtctctctaagaatat

SEQ ID NO: 343896 - DNA, 25 bp, Mus musculus
cccacctggtggagatctatgactt

SEQ ID NO: 343897 - DNA, 25 bp, Mus musculus
cccacctggtggtgatctatgactt

SEQ ID NO: 343898 - DNA, 25 bp, Mus musculus
cccacctggtttactgtggatttcg

SEQ ID NO: 343899 - DNA, 25 bp, Mus musculus
cccacctggttttctgtggatttcg

SEQ ID NO: 343900 - DNA, 25 bp, Mus musculus
cccacctgtgttagtgtagaaatgt

SEQ ID NO: 343901 - DNA, 25 bp, Mus musculus
cccacctgtgtttgtgtagaaatgt

SEQ ID NO: 343902 - DNA, 25 bp, Mus musculus
cccaccttattcctggttacgatga

SEQ ID NO: 343903 - DNA, 25 bp, Mus musculus
cccaccttattcgtggttacgatga

SEQ ID NO: 343904 - DNA, 25 bp, Mus musculus
cccaccttcagcagtattacttgta

SEQ ID NO: 343905 - DNA, 25 bp, Mus musculus
cccaccttcagctgtattacttgta

SEQ ID NO: 343906 - DNA, 25 bp, Mus musculus
cccaccttctacatatcagcaggtt

SEQ ID NO: 343907 - DNA, 25 bp, Mus musculus
cccaccttctacttatcagcaggtt

SEQ ID NO: 343908 - DNA, 25 bp, Mus musculus
cccaccttgctgcttacaaatgtat

SEQ ID NO: 343909 - DNA, 25 bp, Mus musculus
cccaccttgctggttacaaatgtat

SEQ ID NO: 343910 - DNA, 25 bp, Mus musculus
cccaccttggacacgtttgagaaga

SEQ ID NO: 343911 - DNA, 25 bp, Mus musculus
cccaccttggactcgtttgagaaga

SEQ ID NO: 343912 - DNA, 25 bp, Mus musculus
cccacctttgcaatgcttctttaaa

SEQ ID NO: 343913 - DNA, 25 bp, Mus musculus
cccacctttgcattgcttctttaaa

SEQ ID NO: 343914 - DNA, 25 bp, Mus musculus
cccacgaactggctgactttgccat

SEQ ID NO: 343915 - DNA, 25 bp, Mus musculus
cccacgaactgggtgactttgccat

SEQ ID NO: 343916 - DNA, 25 bp, Mus musculus
cccacgaagcttcgcactttgtaag

SEQ ID NO: 343917 - DNA, 25 bp, Mus musculus
cccacgaagcttggcactttgtaag

SEQ ID NO: 343918 - DNA, 25 bp, Mus musculus
cccacgaccttaagcattctaaact

SEQ ID NO: 343919 - DNA, 25 bp, Mus musculus
cccacgaccttatgcattctaaact

SEQ ID NO: 343920 - DNA, 25 bp, Mus musculus
cccacgaggcctaagatggcacagt

SEQ ID NO: 343921 - DNA, 25 bp, Mus musculus
cccacgaggccttagatggcacagt

SEQ ID NO: 343922 - DNA, 25 bp, Mus musculus
cccacgataaacagcttgcagggaa

SEQ ID NO: 343923 - DNA, 25 bp, Mus musculus
cccacgataaactgcttgcagggaa

SEQ ID NO: 343924 - DNA, 25 bp, Mus musculus
cccacgcccctaagtgaggattgat

SEQ ID NO: 343925 - DNA, 25 bp, Mus musculus
cccacgcccctatgtgaggattgat

SEQ ID NO: 343926 - DNA, 25 bp, Mus musculus
cccacgcctcaacaaattattctga

SEQ ID NO: 343927 - DNA, 25 bp, Mus musculus
cccacgcctcaagaaattattctga

SEQ ID NO: 343928 - DNA, 25 bp, Mus musculus
cccacgcgggtgacatacattttat

SEQ ID NO: 343929 - DNA, 25 bp, Mus musculus
cccacgcgggtgtcatacattttat

SEQ ID NO: 343930 - DNA, 25 bp, Mus musculus
cccacgctggtgcttgtttataatg

SEQ ID NO: 343931 - DNA, 25 bp, Mus musculus
cccacgctggtggttgtttataatg

SEQ ID NO: 343932 - DNA, 25 bp, Mus musculus
cccacgcttgagcaggcattggaag

SEQ ID NO: 343933 - DNA, 25 bp, Mus musculus
cccacgcttgaggaggcattggaag

SEQ ID NO: 343934 - DNA, 25 bp, Mus musculus
cccacgctttcaactagttgtgaac

SEQ ID NO: 343935 - DNA, 25 bp, Mus musculus
cccacgctttcatctagttgtgaac

SEQ ID NO: 343936 - DNA, 25 bp, Mus musculus
cccacggcggtgatattaatgaatt

SEQ ID NO: 343937 - DNA, 25 bp, Mus musculus
cccacggcggtgttattaatgaatt

SEQ ID NO: 343938 - DNA, 25 bp, Mus musculus
cccacggctaaccagacatgtaaca

SEQ ID NO: 343939 - DNA, 25 bp, Mus musculus
cccacggctaacgagacatgtaaca

SEQ ID NO: 343940 - DNA, 25 bp, Mus musculus
cccacggctgaaatctcggtgatga

SEQ ID NO: 343941 - DNA, 25 bp, Mus musculus
cccacggctgaattctcggtgatga

SEQ ID NO: 343942 - DNA, 25 bp, Mus musculus
cccacgggagagaaaatgcttgctt

SEQ ID NO: 343943 - DNA, 25 bp, Mus musculus
cccacgggagagtaaatgcttgctt

SEQ ID NO: 343944 - DNA, 25 bp, Mus musculus
cccacgggtccacgatgtacaaaat

SEQ ID NO: 343945 - DNA, 25 bp, Mus musculus
cccacgggtccaggatgtacaaaat

SEQ ID NO: 343946 - DNA, 25 bp, Mus musculus
cccacgggttttaattgcctgacag

SEQ ID NO: 343947 - DNA, 25 bp, Mus musculus
cccacgggtttttattgcctgacag

SEQ ID NO: 343948 - DNA, 25 bp, Mus musculus
cccacggtgactagtttacagctgg

SEQ ID NO: 343949 - DNA, 25 bp, Mus musculus
cccacggtgacttgtttacagctgg

SEQ ID NO: 343950 - DNA, 25 bp, Mus musculus
cccacggtgggcagcagaatatatt

SEQ ID NO: 343951 - DNA, 25 bp, Mus musculus
cccacggtgggctgcagaatatatt

SEQ ID NO: 343952 - DNA, 25 bp, Mus musculus
cccacgtaagttattctgtgagtca

SEQ ID NO: 343953 - DNA, 25 bp, Mus musculus
cccacgtaagtttttctgtgagtca

SEQ ID NO: 343954 - DNA, 25 bp, Mus musculus
cccacgtgctagaatgacacatctg

SEQ ID NO: 343955 - DNA, 25 bp, Mus musculus
cccacgtgctagtatgacacatctg

SEQ ID NO: 343956 - DNA, 25 bp, Mus musculus
cccacgtggctgaagttgacgtctg

SEQ ID NO: 343957 - DNA, 25 bp, Mus musculus
cccacgtggctgtagttgacgtctg

SEQ ID NO: 343958 - DNA, 25 bp, Mus musculus
cccacgtgggtgatcaattcctgtt

SEQ ID NO: 343959 - DNA, 25 bp, Mus musculus
cccacgtgggtgttcaattcctgtt

SEQ ID NO: 343960 - DNA, 25 bp, Mus musculus
cccacgtgtttgctggactgagaag

SEQ ID NO: 343961 - DNA, 25 bp, Mus musculus
cccacgtgtttggtggactgagaag

SEQ ID NO: 343962 - DNA, 25 bp, Mus musculus
cccacgttaatcagtcacacaaact

SEQ ID NO: 343963 - DNA, 25 bp, Mus musculus
cccacgttaatctgtcacacaaact

SEQ ID NO: 343964 - DNA, 25 bp, Mus musculus
cccacgttagggacagactatttat

SEQ ID NO: 343965 - DNA, 25 bp, Mus musculus
cccacgttagggtcagactatttat

SEQ ID NO: 343966 - DNA, 25 bp, Mus musculus
cccacgttgtgaatgttgtcaggct

SEQ ID NO: 343967 - DNA, 25 bp, Mus musculus
cccacgttgtgaccaggtccaggta

SEQ ID NO: 343968 - DNA, 25 bp, Mus musculus
cccacgttgtgagcaggtccaggta

SEQ ID NO: 343969 - DNA, 25 bp, Mus musculus
cccacgttgtgattgttgtcaggct

SEQ ID NO: 343970 - DNA, 25 bp, Mus musculus
cccacgtttcctacatagagacatt

SEQ ID NO: 343971 - DNA, 25 bp, Mus musculus
cccacgtttccttcatagagacatt

SEQ ID NO: 343972 - DNA, 25 bp, Mus musculus
cccacgtttctcagcaaacttactt

SEQ ID NO: 343973 - DNA, 25 bp, Mus musculus
cccacgtttctctgcaaacttactt

SEQ ID NO: 343974 - DNA, 25 bp, Mus musculus
cccacgtttgctatctgtgaatctt

SEQ ID NO: 343975 - DNA, 25 bp, Mus musculus
cccacgtttgctttctgtgaatctt

SEQ ID NO: 343976 - DNA, 25 bp, Mus musculus
cccactaagtgcattgttctcctat

SEQ ID NO: 343977 - DNA, 25 bp, Mus musculus
cccactaagtgctttgttctcctat

SEQ ID NO: 343978 - DNA, 25 bp, Mus musculus
cccactaccattcagtcatttctat

SEQ ID NO: 343979 - DNA, 25 bp, Mus musculus
cccactaccattgagtcatttctat

SEQ ID NO: 343980 - DNA, 25 bp, Mus musculus
cccactaccgaaatccacaaggatt

SEQ ID NO: 343981 - DNA, 25 bp, Mus musculus
cccactaccgaattccacaaggatt

SEQ ID NO: 343982 - DNA, 25 bp, Mus musculus
cccactactggaacctatttgaatc

SEQ ID NO: 343983 - DNA, 25 bp, Mus musculus
cccactactggatcctatttgaatc

SEQ ID NO: 343984 - DNA, 25 bp, Mus musculus
cccactagacagcacaggaggcatt

SEQ ID NO: 343985 - DNA, 25 bp, Mus musculus
cccactagacaggacaggaggcatt

SEQ ID NO: 343986 - DNA, 25 bp, Mus musculus
cccactatctagaccagtaggttaa

SEQ ID NO: 343987 - DNA, 25 bp, Mus musculus
cccactatctagtccagtaggttaa

SEQ ID NO: 343988 - DNA, 25 bp, Mus musculus
cccactattcccatctatattcaga

SEQ ID NO: 343989 - DNA, 25 bp, Mus musculus
cccactattcccttctatattcaga

SEQ ID NO: 343990 - DNA, 25 bp, Mus musculus
cccactcaacatacacttcgattta

SEQ ID NO: 343991 - DNA, 25 bp, Mus musculus
cccactcaacattcacttcgattta

SEQ ID NO: 343992 - DNA, 25 bp, Mus musculus
cccactcaggtgatcgttgttacag

SEQ ID NO: 343993 - DNA, 25 bp, Mus musculus
cccactcaggtgttcgttgttacag

SEQ ID NO: 343994 - DNA, 25 bp, Mus musculus
cccactcataaaacctctatgctta

SEQ ID NO: 343995 - DNA, 25 bp, Mus musculus
cccactcataaatcctctatgctta

SEQ ID NO: 343996 - DNA, 25 bp, Mus musculus
cccactcatgacactaagtttgttg

SEQ ID NO: 343997 - DNA, 25 bp, Mus musculus
cccactcatgactctaagtttgttg

SEQ ID NO: 343998 - DNA, 25 bp, Mus musculus
cccactccagtcattcattttataa

SEQ ID NO: 343999 - DNA, 25 bp, Mus musculus
cccactccagtctttcattttataa

SEQ ID NO: 344000 - DNA, 25 bp, Mus musculus
cccactccctgtaccaagttgagga

SEQ ID NO: 344001 - DNA, 25 bp, Mus musculus
cccactccctgttccaagttgagga

SEQ ID NO: 344002 - DNA, 25 bp, Mus musculus
cccactcccttgcattatttctttg

SEQ ID NO: 344003 - DNA, 25 bp, Mus musculus
cccactcccttggattatttctttg

SEQ ID NO: 344004 - DNA, 25 bp, Mus musculus
cccactcgccaaacttttgatacaa

SEQ ID NO: 344005 - DNA, 25 bp, Mus musculus
cccactcgccaatcttttgatacaa

SEQ ID NO: 344006 - DNA, 25 bp, Mus musculus
cccactctgggtataagcttgattt

SEQ ID NO: 344007 - DNA, 25 bp, Mus musculus
cccactctgggtttaagcttgattt

SEQ ID NO: 344008 - DNA, 25 bp, Mus musculus
cccactctggttaccatgaggtgac

SEQ ID NO: 344009 - DNA, 25 bp, Mus musculus
cccactctggtttccatgaggtgac

SEQ ID NO: 344010 - DNA, 25 bp, Mus musculus
cccactctgtacaaccagaatttat

SEQ ID NO: 344011 - DNA, 25 bp, Mus musculus
cccactctgtactaccagaatttat

SEQ ID NO: 344012 - DNA, 25 bp, Mus musculus
cccactcttcagatccctgagacag

SEQ ID NO: 344013 - DNA, 25 bp, Mus musculus
cccactcttcagttccctgagacag

SEQ ID NO: 344014 - DNA, 25 bp, Mus musculus
cccactcttcctcatttattttaat

SEQ ID NO: 344015 - DNA, 25 bp, Mus musculus
cccactcttcctgatttattttaat

SEQ ID NO: 344016 - DNA, 25 bp, Mus musculus
cccactgaagtgacctcttgagaat

SEQ ID NO: 344017 - DNA, 25 bp, Mus musculus
cccactgaagtgtcctcttgagaat

SEQ ID NO: 344018 - DNA, 25 bp, Mus musculus
cccactgactacaccatttttgata

SEQ ID NO: 344019 - DNA, 25 bp, Mus musculus
cccactgactactccatttttgata

SEQ ID NO: 344020 - DNA, 25 bp, Mus musculus
cccactgactcgacttagaatctgt

SEQ ID NO: 344021 - DNA, 25 bp, Mus musculus
cccactgactcgtcttagaatctgt

SEQ ID NO: 344022 - DNA, 25 bp, Mus musculus
cccactgacttacacacacttataa

SEQ ID NO: 344023 - DNA, 25 bp, Mus musculus
cccactgacttagacacacttataa

SEQ ID NO: 344024 - DNA, 25 bp, Mus musculus
cccactgagctgatattggaagtca

SEQ ID NO: 344025 - DNA, 25 bp, Mus musculus
cccactgagctgttattggaagtca

SEQ ID NO: 344026 - DNA, 25 bp, Mus musculus
cccactgatgtgatcttgctgatta

SEQ ID NO: 344027 - DNA, 25 bp, Mus musculus
cccactgatgtgttcttgctgatta

SEQ ID NO: 344028 - DNA, 25 bp, Mus musculus
cccactgcactgactcggataagta

SEQ ID NO: 344029 - DNA, 25 bp, Mus musculus
cccactgcactgtctcggataagta

SEQ ID NO: 344030 - DNA, 25 bp, Mus musculus
cccactgccaagaacaatgacctgt

SEQ ID NO: 344031 - DNA, 25 bp, Mus musculus
cccactgccaagtacaatgacctgt

SEQ ID NO: 344032 - DNA, 25 bp, Mus musculus
cccactgcggatcaaagctgcgaag

SEQ ID NO: 344033 - DNA, 25 bp, Mus musculus
cccactgcggatgaaagctgcgaag

SEQ ID NO: 344034 - DNA, 25 bp, Mus musculus
cccactgctaagatctccgatatga

SEQ ID NO: 344035 - DNA, 25 bp, Mus musculus
cccactgctaagcaaataactagat

SEQ ID NO: 344036 - DNA, 25 bp, Mus musculus
cccactgctaaggaaataactagat

SEQ ID NO: 344037 - DNA, 25 bp, Mus musculus
cccactgctaagttctccgatatga

SEQ ID NO: 344038 - DNA, 25 bp, Mus musculus
cccactgctgaacctctttaatttt

SEQ ID NO: 344039 - DNA, 25 bp, Mus musculus
cccactgctgaagctctttaatttt

SEQ ID NO: 344040 - DNA, 25 bp, Mus musculus
cccactggcacactttaggatttaa

SEQ ID NO: 344041 - DNA, 25 bp, Mus musculus
cccactggcacagtttaggatttaa

SEQ ID NO: 344042 - DNA, 25 bp, Mus musculus
cccactggccagaatgttaacaagt

SEQ ID NO: 344043 - DNA, 25 bp, Mus musculus
cccactggccagtatgttaacaagt

SEQ ID NO: 344044 - DNA, 25 bp, Mus musculus
cccactggctcacagctggtgtaaa

SEQ ID NO: 344045 - DNA, 25 bp, Mus musculus
cccactggctcagagctggtgtaaa

SEQ ID NO: 344046 - DNA, 25 bp, Mus musculus
cccactgggcagatactgtgtctaa

SEQ ID NO: 344047 - DNA, 25 bp, Mus musculus
cccactgggcagttactgtgtctaa

SEQ ID NO: 344048 - DNA, 25 bp, Mus musculus
cccactgggcttacaggagcaggtt

SEQ ID NO: 344049 - DNA, 25 bp, Mus musculus
cccactgggcttctgaaataaatgt

SEQ ID NO: 344050 - DNA, 25 bp, Mus musculus
cccactgggcttgtgaaataaatgt

SEQ ID NO: 344051 - DNA, 25 bp, Mus musculus
cccactgggctttcaggagcaggtt

SEQ ID NO: 344052 - DNA, 25 bp, Mus musculus
cccactgggtggctttgtgcattat

SEQ ID NO: 344053 - DNA, 25 bp, Mus musculus
cccactgggtgggtttgtgcattat

SEQ ID NO: 344054 - DNA, 25 bp, Mus musculus
cccactgggtgtagtgcctaagcaa

SEQ ID NO: 344055 - DNA, 25 bp, Mus musculus
cccactgggtgttgtgcctaagcaa

SEQ ID NO: 344056 - DNA, 25 bp, Mus musculus
cccactggtgttcttgcttagctga

SEQ ID NO: 344057 - DNA, 25 bp, Mus musculus
cccactggtgttgttgcttagctga

SEQ ID NO: 344058 - DNA, 25 bp, Mus musculus
cccactggttgtatgcagtctcatt

SEQ ID NO: 344059 - DNA, 25 bp, Mus musculus
cccactggttgtttgcagtctcatt

SEQ ID NO: 344060 - DNA, 25 bp, Mus musculus
cccactgtgcatatcgctttcctgt

SEQ ID NO: 344061 - DNA, 25 bp, Mus musculus
cccactgtgcatttcgctttcctgt

SEQ ID NO: 344062 - DNA, 25 bp, Mus musculus
cccactgtgctcatgctactgatag

SEQ ID NO: 344063 - DNA, 25 bp, Mus musculus
cccactgtgctcttgctactgatag

SEQ ID NO: 344064 - DNA, 25 bp, Mus musculus
cccactgtgggcaatttggcagagt

SEQ ID NO: 344065 - DNA, 25 bp, Mus musculus
cccactgtgggcagaaccagacatg

SEQ ID NO: 344066 - DNA, 25 bp, Mus musculus
cccactgtgggctatttggcagagt

SEQ ID NO: 344067 - DNA, 25 bp, Mus musculus
cccactgtgggctgaaccagacatg

SEQ ID NO: 344068 - DNA, 25 bp, Mus musculus
cccactgtgtggatatctgaatcta

SEQ ID NO: 344069 - DNA, 25 bp, Mus musculus
cccactgtgtggcttaggtcaggat

SEQ ID NO: 344070 - DNA, 25 bp, Mus musculus
cccactgtgtgggttaggtcaggat

SEQ ID NO: 344071 - DNA, 25 bp, Mus musculus
cccactgtgtggttatctgaatcta

SEQ ID NO: 344072 - DNA, 25 bp, Mus musculus
cccactgtgtgtataaaccttaatg

SEQ ID NO: 344073 - DNA, 25 bp, Mus musculus
cccactgtgtgtttaaaccttaatg

SEQ ID NO: 344074 - DNA, 25 bp, Mus musculus
cccactgttcaactttgctgcgtat

SEQ ID NO: 344075 - DNA, 25 bp, Mus musculus
cccactgttcaagtttgctgcgtat

SEQ ID NO: 344076 - DNA, 25 bp, Mus musculus
cccactgttgataagcttctttgtc

SEQ ID NO: 344077 - DNA, 25 bp, Mus musculus
cccactgttgattagcttctttgtc

SEQ ID NO: 344078 - DNA, 25 bp, Mus musculus
cccactgttgttatcttcagaacca

SEQ ID NO: 344079 - DNA, 25 bp, Mus musculus
cccactgttgttttcttcagaacca

SEQ ID NO: 344080 - DNA, 25 bp, Mus musculus
cccactgtttcaaccaaacgtgtat

SEQ ID NO: 344081 - DNA, 25 bp, Mus musculus
cccactgtttcatccaaacgtgtat

SEQ ID NO: 344082 - DNA, 25 bp, Mus musculus
cccacttagataccacattaccatg

SEQ ID NO: 344083 - DNA, 25 bp, Mus musculus
cccacttagatagcacattaccatg

SEQ ID NO: 344084 - DNA, 25 bp, Mus musculus
cccacttcaacaccatcaaataaat

SEQ ID NO: 344085 - DNA, 25 bp, Mus musculus
cccacttcaacacttatgcatcttt

SEQ ID NO: 344086 - DNA, 25 bp, Mus musculus
cccacttcaacagcatcaaataaat

SEQ ID NO: 344087 - DNA, 25 bp, Mus musculus
cccacttcaacagttatgcatcttt

SEQ ID NO: 344088 - DNA, 25 bp, Mus musculus
cccacttcaggcactttgacgagaa

SEQ ID NO: 344089 - DNA, 25 bp, Mus musculus
cccacttcaggctctttgacgagaa

SEQ ID NO: 344090 - DNA, 25 bp, Mus musculus
cccacttcagttagaattccagata

SEQ ID NO: 344091 - DNA, 25 bp, Mus musculus
cccacttcagtttgaattccagata

SEQ ID NO: 344092 - DNA, 25 bp, Mus musculus
cccacttccatgacagaactgtttg

SEQ ID NO: 344093 - DNA, 25 bp, Mus musculus
cccacttccatgtcagaactgtttg

SEQ ID NO: 344094 - DNA, 25 bp, Mus musculus
cccacttcctgtatgtaagcggtga

SEQ ID NO: 344095 - DNA, 25 bp, Mus musculus
cccacttcctgtttgtaagcggtga

SEQ ID NO: 344096 - DNA, 25 bp, Mus musculus
cccacttcctttaatgcgttattgc

SEQ ID NO: 344097 - DNA, 25 bp, Mus musculus
cccacttccttttatgcgttattgc

SEQ ID NO: 344098 - DNA, 25 bp, Mus musculus
cccacttcggagacgtgaatgtctg

SEQ ID NO: 344099 - DNA, 25 bp, Mus musculus
cccacttcggagtcgtgaatgtctg

SEQ ID NO: 344100 - DNA, 25 bp, Mus musculus
cccacttctaagatctccagagatc

SEQ ID NO: 344101 - DNA, 25 bp, Mus musculus
cccacttctaagttctccagagatc

SEQ ID NO: 344102 - DNA, 25 bp, Mus musculus
cccacttctgaactcaactaaggca

SEQ ID NO: 344103 - DNA, 25 bp, Mus musculus
cccacttctgaagtcaactaaggca

SEQ ID NO: 344104 - DNA, 25 bp, Mus musculus
cccacttctgagatcactaggttaa

SEQ ID NO: 344105 - DNA, 25 bp, Mus musculus
cccacttctgagttcactaggttaa

SEQ ID NO: 344106 - DNA, 25 bp, Mus musculus
cccacttcttccactatggtggaga

SEQ ID NO: 344107 - DNA, 25 bp, Mus musculus
cccacttcttcctctatggtggaga

SEQ ID NO: 344108 - DNA, 25 bp, Mus musculus
cccacttgacatctttgatccagag

SEQ ID NO: 344109 - DNA, 25 bp, Mus musculus
cccacttgacatgtttgatccagag

SEQ ID NO: 344110 - DNA, 25 bp, Mus musculus
cccacttgatggatcttgactttgt

SEQ ID NO: 344111 - DNA, 25 bp, Mus musculus
cccacttgatggttcttgactttgt

SEQ ID NO: 344112 - DNA, 25 bp, Mus musculus
cccacttgcaagaaaaactgaccag

SEQ ID NO: 344113 - DNA, 25 bp, Mus musculus
cccacttgcaagtaaaactgaccag

SEQ ID NO: 344114 - DNA, 25 bp, Mus musculus
cccacttgctacagtatcttgactt

SEQ ID NO: 344115 - DNA, 25 bp, Mus musculus
cccacttgctactgtatcttgactt

SEQ ID NO: 344116 - DNA, 25 bp, Mus musculus
cccacttgctatattgataagcagt

SEQ ID NO: 344117 - DNA, 25 bp, Mus musculus
cccacttgctattttgataagcagt

SEQ ID NO: 344118 - DNA, 25 bp, Mus musculus
cccacttggaaaccttgccgctgtt

SEQ ID NO: 344119 - DNA, 25 bp, Mus musculus
cccacttggaaagcttgccgctgtt

SEQ ID NO: 344120 - DNA, 25 bp, Mus musculus
cccacttggaatcccagacatatct

SEQ ID NO: 344121 - DNA, 25 bp, Mus musculus
cccacttggaatgccagacatatct

SEQ ID NO: 344122 - DNA, 25 bp, Mus musculus
cccacttggcgtctggtccagtgaa

SEQ ID NO: 344123 - DNA, 25 bp, Mus musculus
cccacttggcgtgtggtccagtgaa

SEQ ID NO: 344124 - DNA, 25 bp, Mus musculus
cccactttagagagctgatgttcca

SEQ ID NO: 344125 - DNA, 25 bp, Mus musculus
cccactttagagtgctgatgttcca

SEQ ID NO: 344126 - DNA, 25 bp, Mus musculus
cccactttcccaaaattcatgacat

SEQ ID NO: 344127 - DNA, 25 bp, Mus musculus
cccactttcccataattcatgacat

SEQ ID NO: 344128 - DNA, 25 bp, Mus musculus
cccactttctagactatactactaa

SEQ ID NO: 344129 - DNA, 25 bp, Mus musculus
cccactttctagtctatactactaa

SEQ ID NO: 344130 - DNA, 25 bp, Mus musculus
cccactttgcacaattcctattaga

SEQ ID NO: 344131 - DNA, 25 bp, Mus musculus
cccactttgcactattcctattaga

SEQ ID NO: 344132 - DNA, 25 bp, Mus musculus
cccactttggccattgtctatttga

SEQ ID NO: 344133 - DNA, 25 bp, Mus musculus
cccactttggcctttgtctatttga

SEQ ID NO: 344134 - DNA, 25 bp, Mus musculus
cccactttgggtctgttatgctatt

SEQ ID NO: 344135 - DNA, 25 bp, Mus musculus
cccactttgggtgtgttatgctatt

SEQ ID NO: 344136 - DNA, 25 bp, Mus musculus
cccactttgtgcacctgaaggttaa

SEQ ID NO: 344137 - DNA, 25 bp, Mus musculus
cccactttgtgctcctgaaggttaa

SEQ ID NO: 344138 - DNA, 25 bp, Mus musculus
cccacttttcacagagtgcatacca

SEQ ID NO: 344139 - DNA, 25 bp, Mus musculus
cccacttttcactgagtgcatacca

SEQ ID NO: 344140 - DNA, 25 bp, Mus musculus
cccacttttctaatcaggaacgaca

SEQ ID NO: 344141 - DNA, 25 bp, Mus musculus
cccacttttctattcaggaacgaca

SEQ ID NO: 344142 - DNA, 25 bp, Mus musculus
cccacttttgctatccaggatcaag

SEQ ID NO: 344143 - DNA, 25 bp, Mus musculus
cccacttttgctctgtcagaaaacc

SEQ ID NO: 344144 - DNA, 25 bp, Mus musculus
cccacttttgctgtgtcagaaaacc

SEQ ID NO: 344145 - DNA, 25 bp, Mus musculus
cccacttttgctttccaggatcaag

SEQ ID NO: 344146 - DNA, 25 bp, Mus musculus
cccagaaaagacatcgtggctcaca

SEQ ID NO: 344147 - DNA, 25 bp, Mus musculus
cccagaaaagacttcgtggctcaca

SEQ ID NO: 344148 - DNA, 25 bp, Mus musculus
cccagaaaggacactttctccctga

SEQ ID NO: 344149 - DNA, 25 bp, Mus musculus
cccagaaaggactctttctccctga

SEQ ID NO: 344150 - DNA, 25 bp, Mus musculus
cccagaaatccgctgctgtgtggat

SEQ ID NO: 344151 - DNA, 25 bp, Mus musculus
cccagaaatccggtgctgtgtggat

SEQ ID NO: 344152 - DNA, 25 bp, Mus musculus
cccagaactcctaggcagtgtggaa

SEQ ID NO: 344153 - DNA, 25 bp, Mus musculus
cccagaactccttggcagtgtggaa

SEQ ID NO: 344154 - DNA, 25 bp, Mus musculus
cccagaactgtaagtggaggcggct

SEQ ID NO: 344155 - DNA, 25 bp, Mus musculus
cccagaactgtatgtggaggcggct

SEQ ID NO: 344156 - DNA, 25 bp, Mus musculus
cccagaagacagagcccgtgaacaa

SEQ ID NO: 344157 - DNA, 25 bp, Mus musculus
cccagaagacagtgcccgtgaacaa

SEQ ID NO: 344158 - DNA, 25 bp, Mus musculus
cccagaagagagaccgggtcgagca

SEQ ID NO: 344159 - DNA, 25 bp, Mus musculus
cccagaagagagtccgggtcgagca

SEQ ID NO: 344160 - DNA, 25 bp, Mus musculus
cccagaagagcacagcccacagaag

SEQ ID NO: 344161 - DNA, 25 bp, Mus musculus
cccagaagagcagagcccacagaag

SEQ ID NO: 344162 - DNA, 25 bp, Mus musculus
cccagaagcttacggcctgtgtgag

SEQ ID NO: 344163 - DNA, 25 bp, Mus musculus
cccagaagcttagggcctgtgtgag

SEQ ID NO: 344164 - DNA, 25 bp, Mus musculus
cccagaagctttcaggagagtagta

SEQ ID NO: 344165 - DNA, 25 bp, Mus musculus
cccagaagctttctgctgtgtgatt

SEQ ID NO: 344166 - DNA, 25 bp, Mus musculus
cccagaagctttgaggagagtagta

SEQ ID NO: 344167 - DNA, 25 bp, Mus musculus
cccagaagctttgtgctgtgtgatt

SEQ ID NO: 344168 - DNA, 25 bp, Mus musculus
cccagaagtagcagaccagtggatt

SEQ ID NO: 344169 - DNA, 25 bp, Mus musculus
cccagaagtagctgaccagtggatt

SEQ ID NO: 344170 - DNA, 25 bp, Mus musculus
cccagaagttttacacccagcatat

SEQ ID NO: 344171 - DNA, 25 bp, Mus musculus
cccagaagtttttcacccagcatat

SEQ ID NO: 344172 - DNA, 25 bp, Mus musculus
cccagaatgggaatttcttttatat

SEQ ID NO: 344173 - DNA, 25 bp, Mus musculus
cccagaatgggattttcttttatat

SEQ ID NO: 344174 - DNA, 25 bp, Mus musculus
cccagaattgctctctgaggctaaa

SEQ ID NO: 344175 - DNA, 25 bp, Mus musculus
cccagaattgctgtctgaggctaaa

SEQ ID NO: 344176 - DNA, 25 bp, Mus musculus
cccagacaacacatttttcacacag

SEQ ID NO: 344177 - DNA, 25 bp, Mus musculus
cccagacaacacttttttcacacag

SEQ ID NO: 344178 - DNA, 25 bp, Mus musculus
cccagacagtgacagtatttatagt

SEQ ID NO: 344179 - DNA, 25 bp, Mus musculus
cccagacagtgagagtatttatagt

SEQ ID NO: 344180 - DNA, 25 bp, Mus musculus
cccagacagtgccatttgaatatta

SEQ ID NO: 344181 - DNA, 25 bp, Mus musculus
cccagacagtgcgatttgaatatta

SEQ ID NO: 344182 - DNA, 25 bp, Mus musculus
cccagaccacttaaatcctatcttt

SEQ ID NO: 344183 - DNA, 25 bp, Mus musculus
cccagaccactttaatcctatcttt

SEQ ID NO: 344184 - DNA, 25 bp, Mus musculus
cccagacctagtactttagagagta

SEQ ID NO: 344185 - DNA, 25 bp, Mus musculus
cccagacctagttctttagagagta

SEQ ID NO: 344186 - DNA, 25 bp, Mus musculus
cccagacctcacattcaggaacagg

SEQ ID NO: 344187 - DNA, 25 bp, Mus musculus
cccagacctcactttcaggaacagg

SEQ ID NO: 344188 - DNA, 25 bp, Mus musculus
cccagacctgggaagatttagaatt

SEQ ID NO: 344189 - DNA, 25 bp, Mus musculus
cccagacctgggtagatttagaatt

SEQ ID NO: 344190 - DNA, 25 bp, Mus musculus
cccagaccttgcaatcatctttgga

SEQ ID NO: 344191 - DNA, 25 bp, Mus musculus
cccagaccttgctatcatctttgga

SEQ ID NO: 344192 - DNA, 25 bp, Mus musculus
cccagactcctgatttatgacacat

SEQ ID NO: 344193 - DNA, 25 bp, Mus musculus
cccagactcctgttttatgacacat

SEQ ID NO: 344194 - DNA, 25 bp, Mus musculus
cccagactgtctcaatcgcttttat

SEQ ID NO: 344195 - DNA, 25 bp, Mus musculus
cccagactgtctgaatcgcttttat

SEQ ID NO: 344196 - DNA, 25 bp, Mus musculus
cccagactgtggaggtactctgtat

SEQ ID NO: 344197 - DNA, 25 bp, Mus musculus
cccagactgtggctcttgggtccta

SEQ ID NO: 344198 - DNA, 25 bp, Mus musculus
cccagactgtgggtcttgggtccta

SEQ ID NO: 344199 - DNA, 25 bp, Mus musculus
cccagactgtggtggtactctgtat

SEQ ID NO: 344200 - DNA, 25 bp, Mus musculus
cccagacttagccatggaaggaaag

SEQ ID NO: 344201 - DNA, 25 bp, Mus musculus
cccagacttagcgatggaaggaaag

SEQ ID NO: 344202 - DNA, 25 bp, Mus musculus
cccagacttcttcctgtattcaaca

SEQ ID NO: 344203 - DNA, 25 bp, Mus musculus
cccagacttcttgctgtattcaaca

SEQ ID NO: 344204 - DNA, 25 bp, Mus musculus
cccagagaattaatttctccccact

SEQ ID NO: 344205 - DNA, 25 bp, Mus musculus
cccagagaattattttctccccact

SEQ ID NO: 344206 - DNA, 25 bp, Mus musculus
cccagagacacccatacttgtattt

SEQ ID NO: 344207 - DNA, 25 bp, Mus musculus
cccagagacaccgatacttgtattt

SEQ ID NO: 344208 - DNA, 25 bp, Mus musculus
cccagagacatccacagtttctttg

SEQ ID NO: 344209 - DNA, 25 bp, Mus musculus
cccagagacatcgacagtttctttg

SEQ ID NO: 344210 - DNA, 25 bp, Mus musculus
cccagagaccatcatgaggtgcatg

SEQ ID NO: 344211 - DNA, 25 bp, Mus musculus
cccagagaccatgatgaggtgcatg

SEQ ID NO: 344212 - DNA, 25 bp, Mus musculus
cccagagaccttaatcaattaattg

SEQ ID NO: 344213 - DNA, 25 bp, Mus musculus
cccagagaccttcagagtaagagca

SEQ ID NO: 344214 - DNA, 25 bp, Mus musculus
cccagagaccttgagagtaagagca

SEQ ID NO: 344215 - DNA, 25 bp, Mus musculus
cccagagacctttatcaattaattg

SEQ ID NO: 344216 - DNA, 25 bp, Mus musculus
cccagagactgacttaccactgttt

SEQ ID NO: 344217 - DNA, 25 bp, Mus musculus
cccagagactgagttaccactgttt

SEQ ID NO: 344218 - DNA, 25 bp, Mus musculus
cccagagaggcaacgtgatacttct

SEQ ID NO: 344219 - DNA, 25 bp, Mus musculus
cccagagaggcatcgtgatacttct

SEQ ID NO: 344220 - DNA, 25 bp, Mus musculus
cccagagagggactttgcagagcat

SEQ ID NO: 344221 - DNA, 25 bp, Mus musculus
cccagagagggagtttgcagagcat

SEQ ID NO: 344222 - DNA, 25 bp, Mus musculus
cccagagagtgccacagtggtgtcc

SEQ ID NO: 344223 - DNA, 25 bp, Mus musculus
cccagagagtgcgacagtggtgtcc

SEQ ID NO: 344224 - DNA, 25 bp, Mus musculus
cccagagagtggagacagtggcctc

SEQ ID NO: 344225 - DNA, 25 bp, Mus musculus
cccagagagtggtgacagtggcctc

SEQ ID NO: 344226 - DNA, 25 bp, Mus musculus
cccagagatgggaacagcaagtgaa

SEQ ID NO: 344227 - DNA, 25 bp, Mus musculus
cccagagatgggtacagcaagtgaa

SEQ ID NO: 344228 - DNA, 25 bp, Mus musculus
cccagagattaaatttagttgcaac

SEQ ID NO: 344229 - DNA, 25 bp, Mus musculus
cccagagattaattttagttgcaac

SEQ ID NO: 344230 - DNA, 25 bp, Mus musculus
cccagagcacacatgcattgatcaa

SEQ ID NO: 344231 - DNA, 25 bp, Mus musculus
cccagagcacacttgcattgatcaa

SEQ ID NO: 344232 - DNA, 25 bp, Mus musculus
cccagagcagatctcggcaagtttg

SEQ ID NO: 344233 - DNA, 25 bp, Mus musculus
cccagagcagatgtcggcaagtttg

SEQ ID NO: 344234 - DNA, 25 bp, Mus musculus
cccagagcaggtccgtgccatggaa

SEQ ID NO: 344235 - DNA, 25 bp, Mus musculus
cccagagcaggtgcgtgccatggaa

SEQ ID NO: 344236 - DNA, 25 bp, Mus musculus
cccagagcagtgcacagggccttga

SEQ ID NO: 344237 - DNA, 25 bp, Mus musculus
cccagagcagtggacagggccttga

SEQ ID NO: 344238 - DNA, 25 bp, Mus musculus
cccagagcccataaccaagggctgg

SEQ ID NO: 344239 - DNA, 25 bp, Mus musculus
cccagagcccattaccaagggctgg

SEQ ID NO: 344240 - DNA, 25 bp, Mus musculus
cccagagcctgcaacatggagcata

SEQ ID NO: 344241 - DNA, 25 bp, Mus musculus
cccagagcctgctacatggagcata

SEQ ID NO: 344242 - DNA, 25 bp, Mus musculus
cccagagcctggcatttgggtactg

SEQ ID NO: 344243 - DNA, 25 bp, Mus musculus
cccagagcctgggatttgggtactg

SEQ ID NO: 344244 - DNA, 25 bp, Mus musculus
cccagagcgccacacagttgtttta

SEQ ID NO: 344245 - DNA, 25 bp, Mus musculus
cccagagcgccagacagttgtttta

SEQ ID NO: 344246 - DNA, 25 bp, Mus musculus
cccagagcgtcaatcgcgtggataa

SEQ ID NO: 344247 - DNA, 25 bp, Mus musculus
cccagagcgtcattcgcgtggataa

SEQ ID NO: 344248 - DNA, 25 bp, Mus musculus
cccagagctgaacgggaagctcact

SEQ ID NO: 344249 - DNA, 25 bp, Mus musculus
cccagagctgaaggggaagctcact

SEQ ID NO: 344250 - DNA, 25 bp, Mus musculus
cccagagctgccatagggaagttgg

SEQ ID NO: 344251 - DNA, 25 bp, Mus musculus
cccagagctgccttagggaagttgg

SEQ ID NO: 344252 - DNA, 25 bp, Mus musculus
cccagagctggcattaaagttgtgt

SEQ ID NO: 344253 - DNA, 25 bp, Mus musculus
cccagagctggctttaaagttgtgt

SEQ ID NO: 344254 - DNA, 25 bp, Mus musculus
cccagaggagatcaaacgcctgttt

SEQ ID NO: 344255 - DNA, 25 bp, Mus musculus
cccagaggagatgaaacgcctgttt

SEQ ID NO: 344256 - DNA, 25 bp, Mus musculus
cccagaggctctatttggctctaaa

SEQ ID NO: 344257 - DNA, 25 bp, Mus musculus
cccagaggctctttttggctctaaa

SEQ ID NO: 344258 - DNA, 25 bp, Mus musculus
cccagagggacaagactttctttca

SEQ ID NO: 344259 - DNA, 25 bp, Mus musculus
cccagagggacatgactttctttca

SEQ ID NO: 344260 - DNA, 25 bp, Mus musculus
cccagagggaccaatatttatattc

SEQ ID NO: 344261 - DNA, 25 bp, Mus musculus
cccagagggacctatatttatattc

SEQ ID NO: 344262 - DNA, 25 bp, Mus musculus
cccagagggagaaccttgttttcct

SEQ ID NO: 344263 - DNA, 25 bp, Mus musculus
cccagagggagatccttgttttcct

SEQ ID NO: 344264 - DNA, 25 bp, Mus musculus
cccagaggtacgaggtggcttgtaa

SEQ ID NO: 344265 - DNA, 25 bp, Mus musculus
cccagaggtacgtggtggcttgtaa

SEQ ID NO: 344266 - DNA, 25 bp, Mus musculus
cccagaggtcacatcaactactgtc

SEQ ID NO: 344267 - DNA, 25 bp, Mus musculus
cccagaggtcacttcaactactgtc

SEQ ID NO: 344268 - DNA, 25 bp, Mus musculus
cccagaggtggccttcagtgtcaga

SEQ ID NO: 344269 - DNA, 25 bp, Mus musculus
cccagaggtggcgttcagtgtcaga

SEQ ID NO: 344270 - DNA, 25 bp, Mus musculus
cccagaggttaccagcctggttttg

SEQ ID NO: 344271 - DNA, 25 bp, Mus musculus
cccagaggttacgagcctggttttg

SEQ ID NO: 344272 - DNA, 25 bp, Mus musculus
cccagagtaaccaacaagcattcat

SEQ ID NO: 344273 - DNA, 25 bp, Mus musculus
cccagagtaacctacaagcattcat

SEQ ID NO: 344274 - DNA, 25 bp, Mus musculus
cccagagtcactctccctgaacaaa

SEQ ID NO: 344275 - DNA, 25 bp, Mus musculus
cccagagtcactgtccctgaacaaa

SEQ ID NO: 344276 - DNA, 25 bp, Mus musculus
cccagagtcagaccatctgcagatt

SEQ ID NO: 344277 - DNA, 25 bp, Mus musculus
cccagagtcagagcatctgcagatt

SEQ ID NO: 344278 - DNA, 25 bp, Mus musculus
cccagagtccccatttggtgtaata

SEQ ID NO: 344279 - DNA, 25 bp, Mus musculus
cccagagtccccttttggtgtaata

SEQ ID NO: 344280 - DNA, 25 bp, Mus musculus
cccagagtctgtcgcggtagtcgca

SEQ ID NO: 344281 - DNA, 25 bp, Mus musculus
cccagagtctgtggcggtagtcgca

SEQ ID NO: 344282 - DNA, 25 bp, Mus musculus
cccagagtgagccagctctttgtgg

SEQ ID NO: 344283 - DNA, 25 bp, Mus musculus
cccagagtgagcgagctctttgtgg

SEQ ID NO: 344284 - DNA, 25 bp, Mus musculus
cccagagtgctaagactacaggcat

SEQ ID NO: 344285 - DNA, 25 bp, Mus musculus
cccagagtgctatgactacaggcat

SEQ ID NO: 344286 - DNA, 25 bp, Mus musculus
cccagagttcacaacgtaggcttct

SEQ ID NO: 344287 - DNA, 25 bp, Mus musculus
cccagagttcactacgtaggcttct

SEQ ID NO: 344288 - DNA, 25 bp, Mus musculus
cccagagttcatagcggctgctaaa

SEQ ID NO: 344289 - DNA, 25 bp, Mus musculus
cccagagttcattgcggctgctaaa

SEQ ID NO: 344290 - DNA, 25 bp, Mus musculus
cccagagttcgcaggatgaaggtca

SEQ ID NO: 344291 - DNA, 25 bp, Mus musculus
cccagagttcgctggatgaaggtca

SEQ ID NO: 344292 - DNA, 25 bp, Mus musculus
cccagagttggcattattcgtttca

SEQ ID NO: 344293 - DNA, 25 bp, Mus musculus
cccagagttggctttattcgtttca

SEQ ID NO: 344294 - DNA, 25 bp, Mus musculus
cccagatagaatagacaaggctttg

SEQ ID NO: 344295 - DNA, 25 bp, Mus musculus
cccagatagaattgacaaggctttg

SEQ ID NO: 344296 - DNA, 25 bp, Mus musculus
cccagatcaccgcagaagtcactat

SEQ ID NO: 344297 - DNA, 25 bp, Mus musculus
cccagatcaccggagaagtcactat

SEQ ID NO: 344298 - DNA, 25 bp, Mus musculus
cccagatcacgcaggctttgagatg

SEQ ID NO: 344299 - DNA, 25 bp, Mus musculus
cccagatcacgctggctttgagatg

SEQ ID NO: 344300 - DNA, 25 bp, Mus musculus
cccagatcagataggcgcagcaggt

SEQ ID NO: 344301 - DNA, 25 bp, Mus musculus
cccagatcagattggcgcagcaggt

SEQ ID NO: 344302 - DNA, 25 bp, Mus musculus
cccagatcctctctagtacttgaaa

SEQ ID NO: 344303 - DNA, 25 bp, Mus musculus
cccagatcctctgtagtacttgaaa

SEQ ID NO: 344304 - DNA, 25 bp, Mus musculus
cccagatctcaacgcatatgtgtta

SEQ ID NO: 344305 - DNA, 25 bp, Mus musculus
cccagatctcaaggcatatgtgtta

SEQ ID NO: 344306 - DNA, 25 bp, Mus musculus
cccagatctgtcagctcactgcagt

SEQ ID NO: 344307 - DNA, 25 bp, Mus musculus
cccagatctgtctgctcactgcagt

SEQ ID NO: 344308 - DNA, 25 bp, Mus musculus
cccagatcttggcttgtaggcgagt

SEQ ID NO: 344309 - DNA, 25 bp, Mus musculus
cccagatcttgggttgtaggcgagt

SEQ ID NO: 344310 - DNA, 25 bp, Mus musculus
cccagatgatatctggatgccagaa

SEQ ID NO: 344311 - DNA, 25 bp, Mus musculus
cccagatgatatgtggatgccagaa

SEQ ID NO: 344312 - DNA, 25 bp, Mus musculus
cccagatgccaccttctgaaagagt

SEQ ID NO: 344313 - DNA, 25 bp, Mus musculus
cccagatgccacgttctgaaagagt

SEQ ID NO: 344314 - DNA, 25 bp, Mus musculus
cccagatgctggctgttctactgct

SEQ ID NO: 344315 - DNA, 25 bp, Mus musculus
cccagatgctgggtgttctactgct

SEQ ID NO: 344316 - DNA, 25 bp, Mus musculus
cccagatgtgaaaacctccatattc

SEQ ID NO: 344317 - DNA, 25 bp, Mus musculus
cccagatgtgaatacctccatattc

SEQ ID NO: 344318 - DNA, 25 bp, Mus musculus
cccagatgtttgagacggtcatgga

SEQ ID NO: 344319 - DNA, 25 bp, Mus musculus
cccagatgtttgtgacggtcatgga

SEQ ID NO: 344320 - DNA, 25 bp, Mus musculus
cccagattcacacagacttttcata

SEQ ID NO: 344321 - DNA, 25 bp, Mus musculus
cccagattcacagagacttttcata

SEQ ID NO: 344322 - DNA, 25 bp, Mus musculus
cccagattctttacagtttctctct

SEQ ID NO: 344323 - DNA, 25 bp, Mus musculus
cccagattcttttcagtttctctct

SEQ ID NO: 344324 - DNA, 25 bp, Mus musculus
cccagattgatcagcctgctttctt

SEQ ID NO: 344325 - DNA, 25 bp, Mus musculus
cccagattgatctgcctgctttctt

SEQ ID NO: 344326 - DNA, 25 bp, Mus musculus
cccagattgtgtacagtgacgatct

SEQ ID NO: 344327 - DNA, 25 bp, Mus musculus
cccagattgtgttcagtgacgatct

SEQ ID NO: 344328 - DNA, 25 bp, Mus musculus
cccagatttatgcagggtgacaaac

SEQ ID NO: 344329 - DNA, 25 bp, Mus musculus
cccagatttatggagggtgacaaac

SEQ ID NO: 344330 - DNA, 25 bp, Mus musculus
cccagatttcttataccattcatta

SEQ ID NO: 344331 - DNA, 25 bp, Mus musculus
cccagatttcttttaccattcatta

SEQ ID NO: 344332 - DNA, 25 bp, Mus musculus
cccagcaaatggacgtaactacaaa

SEQ ID NO: 344333 - DNA, 25 bp, Mus musculus
cccagcaaatggtcgtaactacaaa

SEQ ID NO: 344334 - DNA, 25 bp, Mus musculus
cccagcaaccaaacggtggcttata

SEQ ID NO: 344335 - DNA, 25 bp, Mus musculus
cccagcaaccaatcggtggcttata

SEQ ID NO: 344336 - DNA, 25 bp, Mus musculus
cccagcaactatcttaggtagctca

SEQ ID NO: 344337 - DNA, 25 bp, Mus musculus
cccagcaactatgttaggtagctca

SEQ ID NO: 344338 - DNA, 25 bp, Mus musculus
cccagcaagaggcagtgctgcttat

SEQ ID NO: 344339 - DNA, 25 bp, Mus musculus
cccagcaagagggagtgctgcttat

SEQ ID NO: 344340 - DNA, 25 bp, Mus musculus
cccagcaagttcagtgtatccaagt

SEQ ID NO: 344341 - DNA, 25 bp, Mus musculus
cccagcaagttctgtgtatccaagt

SEQ ID NO: 344342 - DNA, 25 bp, Mus musculus
cccagcacagtcagcatgggctgaa

SEQ ID NO: 344343 - DNA, 25 bp, Mus musculus
cccagcacagtctgcatgggctgaa

SEQ ID NO: 344344 - DNA, 25 bp, Mus musculus
cccagcaccatgaggtagattcaca

SEQ ID NO: 344345 - DNA, 25 bp, Mus musculus
cccagcaccatgtggtagattcaca

SEQ ID NO: 344346 - DNA, 25 bp, Mus musculus
cccagcaccccaaaaacaggatgat

SEQ ID NO: 344347 - DNA, 25 bp, Mus musculus
cccagcaccccataaacaggatgat

SEQ ID NO: 344348 - DNA, 25 bp, Mus musculus
cccagcaccgatcgcattccctttg

SEQ ID NO: 344349 - DNA, 25 bp, Mus musculus
cccagcaccgatggcattccctttg

SEQ ID NO: 344350 - DNA, 25 bp, Mus musculus
cccagcacgcacagagttgactcag

SEQ ID NO: 344351 - DNA, 25 bp, Mus musculus
cccagcacgcactgagttgactcag

SEQ ID NO: 344352 - DNA, 25 bp, Mus musculus
cccagcagccacatagccaaaatag

SEQ ID NO: 344353 - DNA, 25 bp, Mus musculus
cccagcagccacttagccaaaatag

SEQ ID NO: 344354 - DNA, 25 bp, Mus musculus
cccagcagcgttaccagtgtgtgaa

SEQ ID NO: 344355 - DNA, 25 bp, Mus musculus
cccagcagcgtttccagtgtgtgaa

SEQ ID NO: 344356 - DNA, 25 bp, Mus musculus
cccagcaggcttcagcaggcttcag

SEQ ID NO: 344357 - DNA, 25 bp, Mus musculus
cccagcaggcttgagcaggcttcag

SEQ ID NO: 344358 - DNA, 25 bp, Mus musculus
cccagcagggcaagccctcaaggag

SEQ ID NO: 344359 - DNA, 25 bp, Mus musculus
cccagcagggcaattaattggatag

SEQ ID NO: 344360 - DNA, 25 bp, Mus musculus
cccagcagggcatgccctcaaggag

SEQ ID NO: 344361 - DNA, 25 bp, Mus musculus
cccagcagggcatttaattggatag

SEQ ID NO: 344362 - DNA, 25 bp, Mus musculus
cccagcagggtaataatcaggagtc

SEQ ID NO: 344363 - DNA, 25 bp, Mus musculus
cccagcagggtattaatcaggagtc

SEQ ID NO: 344364 - DNA, 25 bp, Mus musculus
cccagcagtaacacgggcatcagcg

SEQ ID NO: 344365 - DNA, 25 bp, Mus musculus
cccagcagtaactcgggcatcagcg

SEQ ID NO: 344366 - DNA, 25 bp, Mus musculus
cccagcagtcctctgagaagcaaca

SEQ ID NO: 344367 - DNA, 25 bp, Mus musculus
cccagcagtcctcttagcttatgta

SEQ ID NO: 344368 - DNA, 25 bp, Mus musculus
cccagcagtcctgtgagaagcaaca

SEQ ID NO: 344369 - DNA, 25 bp, Mus musculus
cccagcagtcctgttagcttatgta

SEQ ID NO: 344370 - DNA, 25 bp, Mus musculus
cccagcagtgggaggaccggatcca

SEQ ID NO: 344371 - DNA, 25 bp, Mus musculus
cccagcagtgggtggaccggatcca

SEQ ID NO: 344372 - DNA, 25 bp, Mus musculus
cccagcataggcagagtacattctt

SEQ ID NO: 344373 - DNA, 25 bp, Mus musculus
cccagcataggcagggacttggcta

SEQ ID NO: 344374 - DNA, 25 bp, Mus musculus
cccagcataggctgagtacattctt

SEQ ID NO: 344375 - DNA, 25 bp, Mus musculus
cccagcataggctgggacttggcta

SEQ ID NO: 344376 - DNA, 25 bp, Mus musculus
cccagcatatttactattcagtgat

SEQ ID NO: 344377 - DNA, 25 bp, Mus musculus
cccagcatattttctattcagtgat

SEQ ID NO: 344378 - DNA, 25 bp, Mus musculus
cccagcatcggcaagcgagggagaa

SEQ ID NO: 344379 - DNA, 25 bp, Mus musculus
cccagcatcggctagcgagggagaa

SEQ ID NO: 344380 - DNA, 25 bp, Mus musculus
cccagcatctggcttgcgctttgat

SEQ ID NO: 344381 - DNA, 25 bp, Mus musculus
cccagcatctgggttgcgctttgat

SEQ ID NO: 344382 - DNA, 25 bp, Mus musculus
cccagcatcttaaccgggtggaagg

SEQ ID NO: 344383 - DNA, 25 bp, Mus musculus
cccagcatcttatccgggtggaagg

SEQ ID NO: 344384 - DNA, 25 bp, Mus musculus
cccagcatcttcaatactatttcac

SEQ ID NO: 344385 - DNA, 25 bp, Mus musculus
cccagcatcttctatactatttcac

SEQ ID NO: 344386 - DNA, 25 bp, Mus musculus
cccagcatgcccaccaagaaaggga

SEQ ID NO: 344387 - DNA, 25 bp, Mus musculus
cccagcatgccctccaagaaaggga

SEQ ID NO: 344388 - DNA, 25 bp, Mus musculus
cccagcatgggcctgtagacattac

SEQ ID NO: 344389 - DNA, 25 bp, Mus musculus
cccagcatgggcgtgtagacattac

SEQ ID NO: 344390 - DNA, 25 bp, Mus musculus
cccagcattgcccagttgttagtgt

SEQ ID NO: 344391 - DNA, 25 bp, Mus musculus
cccagcattgccgagttgttagtgt

SEQ ID NO: 344392 - DNA, 25 bp, Mus musculus
cccagcattgctacatccataagtg

SEQ ID NO: 344393 - DNA, 25 bp, Mus musculus
cccagcattgcttcatccataagtg

SEQ ID NO: 344394 - DNA, 25 bp, Mus musculus
cccagcatttccaagtgtctattgg

SEQ ID NO: 344395 - DNA, 25 bp, Mus musculus
cccagcatttcccaggcaattttaa

SEQ ID NO: 344396 - DNA, 25 bp, Mus musculus
cccagcatttccgaggcaattttaa

SEQ ID NO: 344397 - DNA, 25 bp, Mus musculus
cccagcatttcctagtgtctattgg

SEQ ID NO: 344398 - DNA, 25 bp, Mus musculus
cccagccaaggcctagagcaagatt

SEQ ID NO: 344399 - DNA, 25 bp, Mus musculus
cccagccaaggcgtagagcaagatt

SEQ ID NO: 344400 - DNA, 25 bp, Mus musculus
cccagccaatggaagtgttaagata

SEQ ID NO: 344401 - DNA, 25 bp, Mus musculus
cccagccaatggtagtgttaagata

SEQ ID NO: 344402 - DNA, 25 bp, Mus musculus
cccagccaatgtagctcacgagtta

SEQ ID NO: 344403 - DNA, 25 bp, Mus musculus
cccagccaatgttgctcacgagtta

SEQ ID NO: 344404 - DNA, 25 bp, Mus musculus
cccagccacctgacgtttgaatttg

SEQ ID NO: 344405 - DNA, 25 bp, Mus musculus
cccagccacctgtcgtttgaatttg

SEQ ID NO: 344406 - DNA, 25 bp, Mus musculus
cccagccagcaaatcagagcagttt

SEQ ID NO: 344407 - DNA, 25 bp, Mus musculus
cccagccagcaattcagagcagttt

SEQ ID NO: 344408 - DNA, 25 bp, Mus musculus
cccagccagggaatgacaaattcaa

SEQ ID NO: 344409 - DNA, 25 bp, Mus musculus
cccagccagggattgacaaattcaa

SEQ ID NO: 344410 - DNA, 25 bp, Mus musculus
cccagccatgtacgtagccatccag

SEQ ID NO: 344411 - DNA, 25 bp, Mus musculus
cccagccatgtaggtagccatccag

SEQ ID NO: 344412 - DNA, 25 bp, Mus musculus
cccagccattgcctcataatttata

SEQ ID NO: 344413 - DNA, 25 bp, Mus musculus
cccagccattgcgtcataatttata

SEQ ID NO: 344414 - DNA, 25 bp, Mus musculus
cccagccattttagtatatgttgta

SEQ ID NO: 344415 - DNA, 25 bp, Mus musculus
cccagccatttttgtatatgttgta

SEQ ID NO: 344416 - DNA, 25 bp, Mus musculus
cccagcccagaactaaaatgtgagc

SEQ ID NO: 344417 - DNA, 25 bp, Mus musculus
cccagcccagaagtaaaatgtgagc

SEQ ID NO: 344418 - DNA, 25 bp, Mus musculus
cccagcccagagaacaggtgtttga

SEQ ID NO: 344419 - DNA, 25 bp, Mus musculus
cccagcccagagatacattgttgca

SEQ ID NO: 344420 - DNA, 25 bp, Mus musculus
cccagcccagagtacaggtgtttga

SEQ ID NO: 344421 - DNA, 25 bp, Mus musculus
cccagcccagagttacattgttgca

SEQ ID NO: 344422 - DNA, 25 bp, Mus musculus
cccagcccaggtcagtgaatttctt

SEQ ID NO: 344423 - DNA, 25 bp, Mus musculus
cccagcccaggtgagtgaatttctt

SEQ ID NO: 344424 - DNA, 25 bp, Mus musculus
cccagcccctcaattgaatgtttag

SEQ ID NO: 344425 - DNA, 25 bp, Mus musculus
cccagcccctcatttgaatgtttag

SEQ ID NO: 344426 - DNA, 25 bp, Mus musculus
cccagccctgagactagatgtttta

SEQ ID NO: 344427 - DNA, 25 bp, Mus musculus
cccagccctgagtctagatgtttta

SEQ ID NO: 344428 - DNA, 25 bp, Mus musculus
cccagcccttagcacagagagggag

SEQ ID NO: 344429 - DNA, 25 bp, Mus musculus
cccagcccttaggacagagagggag

SEQ ID NO: 344430 - DNA, 25 bp, Mus musculus
cccagccgtaagaaccacagagcaa

SEQ ID NO: 344431 - DNA, 25 bp, Mus musculus
cccagccgtaagtaccacagagcaa

SEQ ID NO: 344432 - DNA, 25 bp, Mus musculus
cccagccgtactctgtgcagagggt

SEQ ID NO: 344433 - DNA, 25 bp, Mus musculus
cccagccgtactgtgtgcagagggt

SEQ ID NO: 344434 - DNA, 25 bp, Mus musculus
cccagcctaactcatcgttacttga

SEQ ID NO: 344435 - DNA, 25 bp, Mus musculus
cccagcctaactgatcgttacttga

SEQ ID NO: 344436 - DNA, 25 bp, Mus musculus
cccagcctcgcgcaatcccaggttt

SEQ ID NO: 344437 - DNA, 25 bp, Mus musculus
cccagcctcgcggaatcccaggttt

SEQ ID NO: 344438 - DNA, 25 bp, Mus musculus
cccagcctctagaccatttttataa

SEQ ID NO: 344439 - DNA, 25 bp, Mus musculus
cccagcctctagtccatttttataa

SEQ ID NO: 344440 - DNA, 25 bp, Mus musculus
cccagcctctggatgaggtgtgagt

SEQ ID NO: 344441 - DNA, 25 bp, Mus musculus
cccagcctctggttgaggtgtgagt

SEQ ID NO: 344442 - DNA, 25 bp, Mus musculus
cccagcctctttcatgttgaggatg

SEQ ID NO: 344443 - DNA, 25 bp, Mus musculus
cccagcctctttgatgttgaggatg

SEQ ID NO: 344444 - DNA, 25 bp, Mus musculus
cccagcctgattacctgcaaatgag

SEQ ID NO: 344445 - DNA, 25 bp, Mus musculus
cccagcctgatttcctgcaaatgag

SEQ ID NO: 344446 - DNA, 25 bp, Mus musculus
cccagcctggctagtgaggaaacca

SEQ ID NO: 344447 - DNA, 25 bp, Mus musculus
cccagcctggcttgtgaggaaacca

SEQ ID NO: 344448 - DNA, 25 bp, Mus musculus
cccagcctggtgagatactttgtca

SEQ ID NO: 344449 - DNA, 25 bp, Mus musculus
cccagcctggtgtgatactttgtca

SEQ ID NO: 344450 - DNA, 25 bp, Mus musculus
cccagcctgttcaaggtgacctaga

SEQ ID NO: 344451 - DNA, 25 bp, Mus musculus
cccagcctgttctaggtgacctaga

SEQ ID NO: 344452 - DNA, 25 bp, Mus musculus
cccagccttaagactttgcggaaat

SEQ ID NO: 344453 - DNA, 25 bp, Mus musculus
cccagccttaagtctttgcggaaat

SEQ ID NO: 344454 - DNA, 25 bp, Mus musculus
cccagccttcagagtgagtgttagt

SEQ ID NO: 344455 - DNA, 25 bp, Mus musculus
cccagccttcagtgtgagtgttagt

SEQ ID NO: 344456 - DNA, 25 bp, Mus musculus
cccagcgagcccaagaaagtttccg

SEQ ID NO: 344457 - DNA, 25 bp, Mus musculus
cccagcgagccctagaaagtttccg

SEQ ID NO: 344458 - DNA, 25 bp, Mus musculus
cccagcgccaaacatcgggactgtg

SEQ ID NO: 344459 - DNA, 25 bp, Mus musculus
cccagcgccaaagatcgggactgtg

SEQ ID NO: 344460 - DNA, 25 bp, Mus musculus
cccagcgccaggagtggtttgcccg

SEQ ID NO: 344461 - DNA, 25 bp, Mus musculus
cccagcgccaggtgtggtttgcccg

SEQ ID NO: 344462 - DNA, 25 bp, Mus musculus
cccagcggcgctacggtgtcagcag

SEQ ID NO: 344463 - DNA, 25 bp, Mus musculus
cccagcggcgcttcggtgtcagcag

SEQ ID NO: 344464 - DNA, 25 bp, Mus musculus
cccagcgtagagaaggagcgtttta

SEQ ID NO: 344465 - DNA, 25 bp, Mus musculus
cccagcgtagagtaggagcgtttta

SEQ ID NO: 344466 - DNA, 25 bp, Mus musculus
cccagcgttagccatgtcttgtaaa

SEQ ID NO: 344467 - DNA, 25 bp, Mus musculus
cccagcgttagcgatgtcttgtaaa

SEQ ID NO: 344468 - DNA, 25 bp, Mus musculus
cccagcgttcagcagattaaaggaa

SEQ ID NO: 344469 - DNA, 25 bp, Mus musculus
cccagcgttcaggagattaaaggaa

SEQ ID NO: 344470 - DNA, 25 bp, Mus musculus
cccagctaagggatttaaagttgag

SEQ ID NO: 344471 - DNA, 25 bp, Mus musculus
cccagctaagggttttaaagttgag

SEQ ID NO: 344472 - DNA, 25 bp, Mus musculus
cccagctagcttacaggctttatgt

SEQ ID NO: 344473 - DNA, 25 bp, Mus musculus
cccagctagctttcaggctttatgt

SEQ ID NO: 344474 - DNA, 25 bp, Mus musculus
cccagctaggagattgaagggatag

SEQ ID NO: 344475 - DNA, 25 bp, Mus musculus
cccagctaggagtttgaagggatag

SEQ ID NO: 344476 - DNA, 25 bp, Mus musculus
cccagctatgatctagccaggacgt

SEQ ID NO: 344477 - DNA, 25 bp, Mus musculus
cccagctatgatgtagccaggacgt

SEQ ID NO: 344478 - DNA, 25 bp, Mus musculus
cccagctatgtgctgggccttttgg

SEQ ID NO: 344479 - DNA, 25 bp, Mus musculus
cccagctatgtggtgggccttttgg

SEQ ID NO: 344480 - DNA, 25 bp, Mus musculus
cccagctattcaaacaagtgattta

SEQ ID NO: 344481 - DNA, 25 bp, Mus musculus
cccagctattcatacaagtgattta

SEQ ID NO: 344482 - DNA, 25 bp, Mus musculus
cccagctcatgtaactcactaagtg

SEQ ID NO: 344483 - DNA, 25 bp, Mus musculus
cccagctcatgttactcactaagtg

SEQ ID NO: 344484 - DNA, 25 bp, Mus musculus
cccagctccaagacaaagtgcattt

SEQ ID NO: 344485 - DNA, 25 bp, Mus musculus
cccagctccaagtcaaagtgcattt

SEQ ID NO: 344486 - DNA, 25 bp, Mus musculus
cccagctccgagaaggttgattcct

SEQ ID NO: 344487 - DNA, 25 bp, Mus musculus
cccagctccgagtaggttgattcct

SEQ ID NO: 344488 - DNA, 25 bp, Mus musculus
cccagctccttgatgcttttagtaa

SEQ ID NO: 344489 - DNA, 25 bp, Mus musculus
cccagctccttgttgcttttagtaa

SEQ ID NO: 344490 - DNA, 25 bp, Mus musculus
cccagctcggcacgatcaggagtgc

SEQ ID NO: 344491 - DNA, 25 bp, Mus musculus
cccagctcggcaggatcaggagtgc

SEQ ID NO: 344492 - DNA, 25 bp, Mus musculus
cccagctcggccctggtgtattgtg

SEQ ID NO: 344493 - DNA, 25 bp, Mus musculus
cccagctcggccgtggtgtattgtg

SEQ ID NO: 344494 - DNA, 25 bp, Mus musculus
cccagctctagccaggacaaagaca

SEQ ID NO: 344495 - DNA, 25 bp, Mus musculus
cccagctctagcgaggacaaagaca

SEQ ID NO: 344496 - DNA, 25 bp, Mus musculus
cccagctctgtaccagggcacaatg

SEQ ID NO: 344497 - DNA, 25 bp, Mus musculus
cccagctctgtagcagggcacaatg

SEQ ID NO: 344498 - DNA, 25 bp, Mus musculus
cccagctcttagcaagccaaggcag

SEQ ID NO: 344499 - DNA, 25 bp, Mus musculus
cccagctcttaggaagccaaggcag

SEQ ID NO: 344500 - DNA, 25 bp, Mus musculus
cccagctgaatgagtggatctagac

SEQ ID NO: 344501 - DNA, 25 bp, Mus musculus
cccagctgaatgtgtggatctagac

SEQ ID NO: 344502 - DNA, 25 bp, Mus musculus
cccagctgactccacattttaattt

SEQ ID NO: 344503 - DNA, 25 bp, Mus musculus
cccagctgactcgacattttaattt

SEQ ID NO: 344504 - DNA, 25 bp, Mus musculus
cccagctgaggaacataagaggaga

SEQ ID NO: 344505 - DNA, 25 bp, Mus musculus
cccagctgaggatcataagaggaga

SEQ ID NO: 344506 - DNA, 25 bp, Mus musculus
cccagctgcagtagacgacgtgcag

SEQ ID NO: 344507 - DNA, 25 bp, Mus musculus
cccagctgcagttgacgacgtgcag

SEQ ID NO: 344508 - DNA, 25 bp, Mus musculus
cccagctggctgagattcgttgtga

SEQ ID NO: 344509 - DNA, 25 bp, Mus musculus
cccagctggctgtgattcgttgtga

SEQ ID NO: 344510 - DNA, 25 bp, Mus musculus
cccagctgggacctctgatttgtgt

SEQ ID NO: 344511 - DNA, 25 bp, Mus musculus
cccagctgggacgtctgatttgtgt

SEQ ID NO: 344512 - DNA, 25 bp, Mus musculus
cccagcttacttactaccatttttg

SEQ ID NO: 344513 - DNA, 25 bp, Mus musculus
cccagcttactttctaccatttttg

SEQ ID NO: 344514 - DNA, 25 bp, Mus musculus
cccagcttatagatcaccacttcaa

SEQ ID NO: 344515 - DNA, 25 bp, Mus musculus
cccagcttatagttcaccacttcaa

SEQ ID NO: 344516 - DNA, 25 bp, Mus musculus
cccagcttcatacgtgtaacaattt

SEQ ID NO: 344517 - DNA, 25 bp, Mus musculus
cccagcttcataggtgtaacaattt

SEQ ID NO: 344518 - DNA, 25 bp, Mus musculus
cccagcttcttcatggaaaaccaca

SEQ ID NO: 344519 - DNA, 25 bp, Mus musculus
cccagcttcttcttggaaaaccaca

SEQ ID NO: 344520 - DNA, 25 bp, Mus musculus
cccagcttgtggcactgttttgaag

SEQ ID NO: 344521 - DNA, 25 bp, Mus musculus
cccagcttgtgggactgttttgaag

SEQ ID NO: 344522 - DNA, 25 bp, Mus musculus
cccagcttgtgtcctgtgtggttca

SEQ ID NO: 344523 - DNA, 25 bp, Mus musculus
cccagcttgtgtcttctcatctaga

SEQ ID NO: 344524 - DNA, 25 bp, Mus musculus
cccagcttgtgtgctgtgtggttca

SEQ ID NO: 344525 - DNA, 25 bp, Mus musculus
cccagcttgtgtgttctcatctaga

SEQ ID NO: 344526 - DNA, 25 bp, Mus musculus
cccagctttatgcatctacgtgtag

SEQ ID NO: 344527 - DNA, 25 bp, Mus musculus
cccagctttatggatctacgtgtag

SEQ ID NO: 344528 - DNA, 25 bp, Mus musculus
cccagctttgaaccgcaaggccagg

SEQ ID NO: 344529 - DNA, 25 bp, Mus musculus
cccagctttgaagcgcaaggccagg

SEQ ID NO: 344530 - DNA, 25 bp, Mus musculus
cccagctttggcatcctcaaataat

SEQ ID NO: 344531 - DNA, 25 bp, Mus musculus
cccagctttggcttcctcaaataat

SEQ ID NO: 344532 - DNA, 25 bp, Mus musculus
cccagcttttcaaaccatgagctta

SEQ ID NO: 344533 - DNA, 25 bp, Mus musculus
cccagcttttcataccatgagctta

SEQ ID NO: 344534 - DNA, 25 bp, Mus musculus
cccaggaaagacagtgctaaggttc

SEQ ID NO: 344535 - DNA, 25 bp, Mus musculus
cccaggaaagactgtgctaaggttc

SEQ ID NO: 344536 - DNA, 25 bp, Mus musculus
cccaggaaggccatcttagagggag

SEQ ID NO: 344537 - DNA, 25 bp, Mus musculus
cccaggaaggccttcttagagggag

SEQ ID NO: 344538 - DNA, 25 bp, Mus musculus
cccaggaaggttatcaggcagtgcc

SEQ ID NO: 344539 - DNA, 25 bp, Mus musculus
cccaggaaggttttcaggcagtgcc

SEQ ID NO: 344540 - DNA, 25 bp, Mus musculus
cccaggaatatcaaggctgcacctc

SEQ ID NO: 344541 - DNA, 25 bp, Mus musculus
cccaggaatatctaggctgcacctc

SEQ ID NO: 344542 - DNA, 25 bp, Mus musculus
cccaggaatgcacctcaggtgacag

SEQ ID NO: 344543 - DNA, 25 bp, Mus musculus
cccaggaatgcagctcaggtgacag

SEQ ID NO: 344544 - DNA, 25 bp, Mus musculus
cccaggacagcaaatttatttaaga

SEQ ID NO: 344545 - DNA, 25 bp, Mus musculus
cccaggacagcatatttatttaaga

SEQ ID NO: 344546 - DNA, 25 bp, Mus musculus
cccaggacagtgaggtgactaccaa

SEQ ID NO: 344547 - DNA, 25 bp, Mus musculus
cccaggacagtgtggtgactaccaa

SEQ ID NO: 344548 - DNA, 25 bp, Mus musculus
cccaggacatcccatctagaatatg

SEQ ID NO: 344549 - DNA, 25 bp, Mus musculus
cccaggacatccgatctagaatatg

SEQ ID NO: 344550 - DNA, 25 bp, Mus musculus
cccaggacatggaggacagggtcaa

SEQ ID NO: 344551 - DNA, 25 bp, Mus musculus
cccaggacatggtggacagggtcaa

SEQ ID NO: 344552 - DNA, 25 bp, Mus musculus
cccaggaccatgagagaaactagat

SEQ ID NO: 344553 - DNA, 25 bp, Mus musculus
cccaggaccatgtgagaaactagat

SEQ ID NO: 344554 - DNA, 25 bp, Mus musculus
cccaggacccatcgttttgacaagc

SEQ ID NO: 344555 - DNA, 25 bp, Mus musculus
cccaggacccatggttttgacaagc

SEQ ID NO: 344556 - DNA, 25 bp, Mus musculus
cccaggacgcagatgagaactctgt

SEQ ID NO: 344557 - DNA, 25 bp, Mus musculus
cccaggacgcagttgagaactctgt

SEQ ID NO: 344558 - DNA, 25 bp, Mus musculus
cccaggactcgtccgtttcagacga

SEQ ID NO: 344559 - DNA, 25 bp, Mus musculus
cccaggactcgtgcgtttcagacga

SEQ ID NO: 344560 - DNA, 25 bp, Mus musculus
cccaggactgtcaaagggctcagtg

SEQ ID NO: 344561 - DNA, 25 bp, Mus musculus
cccaggactgtctaagggctcagtg

SEQ ID NO: 344562 - DNA, 25 bp, Mus musculus
cccaggagaataactgtggcactct

SEQ ID NO: 344563 - DNA, 25 bp, Mus musculus
cccaggagaatatctgtggcactct

SEQ ID NO: 344564 - DNA, 25 bp, Mus musculus
cccaggagatggaagcttgccgctg

SEQ ID NO: 344565 - DNA, 25 bp, Mus musculus
cccaggagatggtagcttgccgctg

SEQ ID NO: 344566 - DNA, 25 bp, Mus musculus
cccaggagatgtccagtgccccatg

SEQ ID NO: 344567 - DNA, 25 bp, Mus musculus
cccaggagatgtgcagtgccccatg

SEQ ID NO: 344568 - DNA, 25 bp, Mus musculus
cccaggagccgactgtagacgacat

SEQ ID NO: 344569 - DNA, 25 bp, Mus musculus
cccaggagccgagtgtagacgacat

SEQ ID NO: 344570 - DNA, 25 bp, Mus musculus
cccaggagcctgaaattcaagactt

SEQ ID NO: 344571 - DNA, 25 bp, Mus musculus
cccaggagcctgtaattcaagactt

SEQ ID NO: 344572 - DNA, 25 bp, Mus musculus
cccaggagcgccatttctcacaaag

SEQ ID NO: 344573 - DNA, 25 bp, Mus musculus
cccaggagcgccttttctcacaaag

SEQ ID NO: 344574 - DNA, 25 bp, Mus musculus
cccaggaggcccctactgaggagtt

SEQ ID NO: 344575 - DNA, 25 bp, Mus musculus
cccaggaggcccgtactgaggagtt

SEQ ID NO: 344576 - DNA, 25 bp, Mus musculus
cccaggaggtgcatggctgagccta

SEQ ID NO: 344577 - DNA, 25 bp, Mus musculus
cccaggaggtgcttggctgagccta

SEQ ID NO: 344578 - DNA, 25 bp, Mus musculus
cccaggaggtgtctgttcagaagca

SEQ ID NO: 344579 - DNA, 25 bp, Mus musculus
cccaggaggtgtgtgttcagaagca

SEQ ID NO: 344580 - DNA, 25 bp, Mus musculus
cccaggatagcaatgttctctacaa

SEQ ID NO: 344581 - DNA, 25 bp, Mus musculus
cccaggatagcattgttctctacaa

SEQ ID NO: 344582 - DNA, 25 bp, Mus musculus
cccaggatattgagtggctgccgag

SEQ ID NO: 344583 - DNA, 25 bp, Mus musculus
cccaggatattgtgtggctgccgag

SEQ ID NO: 344584 - DNA, 25 bp, Mus musculus
cccaggatgggtataaactctcaga

SEQ ID NO: 344585 - DNA, 25 bp, Mus musculus
cccaggatgggtttaaactctcaga

SEQ ID NO: 344586 - DNA, 25 bp, Mus musculus
cccaggatgtgaattaagatacttc

SEQ ID NO: 344587 - DNA, 25 bp, Mus musculus
cccaggatgtgatttaagatacttc

SEQ ID NO: 344588 - DNA, 25 bp, Mus musculus
cccaggattggccaagtgctattta

SEQ ID NO: 344589 - DNA, 25 bp, Mus musculus
cccaggattggcgaagtgctattta

SEQ ID NO: 344590 - DNA, 25 bp, Mus musculus
cccaggattggtatagtcaataaat

SEQ ID NO: 344591 - DNA, 25 bp, Mus musculus
cccaggattggtttagtcaataaat

SEQ ID NO: 344592 - DNA, 25 bp, Mus musculus
cccaggatttggatggagcagtcta

SEQ ID NO: 344593 - DNA, 25 bp, Mus musculus
cccaggatttggttggagcagtcta

SEQ ID NO: 344594 - DNA, 25 bp, Mus musculus
cccaggcaaactcctgctcgagtga

SEQ ID NO: 344595 - DNA, 25 bp, Mus musculus
cccaggcaaactgctgctcgagtga

SEQ ID NO: 344596 - DNA, 25 bp, Mus musculus
cccaggcaaagtatagttctagaag

SEQ ID NO: 344597 - DNA, 25 bp, Mus musculus
cccaggcaaagtttagttctagaag

SEQ ID NO: 344598 - DNA, 25 bp, Mus musculus
cccaggcagccacgttgttgttcaa

SEQ ID NO: 344599 - DNA, 25 bp, Mus musculus
cccaggcagccaggttgttgttcaa

SEQ ID NO: 344600 - DNA, 25 bp, Mus musculus
cccaggcagctgctacttggatgca

SEQ ID NO: 344601 - DNA, 25 bp, Mus musculus
cccaggcagctggtacttggatgca

SEQ ID NO: 344602 - DNA, 25 bp, Mus musculus
cccaggcagtgtcaggctgtgacct

SEQ ID NO: 344603 - DNA, 25 bp, Mus musculus
cccaggcagtgtgaggctgtgacct

SEQ ID NO: 344604 - DNA, 25 bp, Mus musculus
cccaggcagttcagatcaggaagat

SEQ ID NO: 344605 - DNA, 25 bp, Mus musculus
cccaggcagttctgatcaggaagat

SEQ ID NO: 344606 - DNA, 25 bp, Mus musculus
cccaggcatcctaaagagcaatgat

SEQ ID NO: 344607 - DNA, 25 bp, Mus musculus
cccaggcatccttaagagcaatgat

SEQ ID NO: 344608 - DNA, 25 bp, Mus musculus
cccaggcattggcacacaccagtag

SEQ ID NO: 344609 - DNA, 25 bp, Mus musculus
cccaggcattgggacacaccagtag

SEQ ID NO: 344610 - DNA, 25 bp, Mus musculus
cccaggcattttcttgctgatcagt

SEQ ID NO: 344611 - DNA, 25 bp, Mus musculus
cccaggcattttgttgctgatcagt

SEQ ID NO: 344612 - DNA, 25 bp, Mus musculus
cccaggccaaaccagtggcagtgga

SEQ ID NO: 344613 - DNA, 25 bp, Mus musculus
cccaggccaaacgagtggcagtgga

SEQ ID NO: 344614 - DNA, 25 bp, Mus musculus
cccaggccagggatccacgggttct

SEQ ID NO: 344615 - DNA, 25 bp, Mus musculus
cccaggccagggttccacgggttct

SEQ ID NO: 344616 - DNA, 25 bp, Mus musculus
cccaggccaggtatgagtgttgtca

SEQ ID NO: 344617 - DNA, 25 bp, Mus musculus
cccaggccaggtttgagtgttgtca

SEQ ID NO: 344618 - DNA, 25 bp, Mus musculus
cccaggcccagaaagattcacagga

SEQ ID NO: 344619 - DNA, 25 bp, Mus musculus
cccaggcccagatagattcacagga

SEQ ID NO: 344620 - DNA, 25 bp, Mus musculus
cccaggcccgtactcttgtagaatg

SEQ ID NO: 344621 - DNA, 25 bp, Mus musculus
cccaggcccgtagtcttgtagaatg

SEQ ID NO: 344622 - DNA, 25 bp, Mus musculus
cccaggccctctagagagttgtata

SEQ ID NO: 344623 - DNA, 25 bp, Mus musculus
cccaggccctcttgagagttgtata

SEQ ID NO: 344624 - DNA, 25 bp, Mus musculus
cccaggcctaacacatgagaaggga

SEQ ID NO: 344625 - DNA, 25 bp, Mus musculus
cccaggcctaactcatgagaaggga

SEQ ID NO: 344626 - DNA, 25 bp, Mus musculus
cccaggcctcagcactattctgtgg

SEQ ID NO: 344627 - DNA, 25 bp, Mus musculus
cccaggcctcaggactattctgtgg

SEQ ID NO: 344628 - DNA, 25 bp, Mus musculus
cccaggcctgggacttgaagaatga

SEQ ID NO: 344629 - DNA, 25 bp, Mus musculus
cccaggcctgggtcttgaagaatga

SEQ ID NO: 344630 - DNA, 25 bp, Mus musculus
cccaggcctggtcctcttgggtgaa

SEQ ID NO: 344631 - DNA, 25 bp, Mus musculus
cccaggcctggtgctcttgggtgaa

SEQ ID NO: 344632 - DNA, 25 bp, Mus musculus
cccaggccttgaagggcacggtgat

SEQ ID NO: 344633 - DNA, 25 bp, Mus musculus
cccaggccttgatgggcacggtgat

SEQ ID NO: 344634 - DNA, 25 bp, Mus musculus
cccaggctaggtccactgtaggagt

SEQ ID NO: 344635 - DNA, 25 bp, Mus musculus
cccaggctaggtgcactgtaggagt

SEQ ID NO: 344636 - DNA, 25 bp, Mus musculus
cccaggctattgaggagctcactct

SEQ ID NO: 344637 - DNA, 25 bp, Mus musculus
cccaggctattgagtggctctgatg

SEQ ID NO: 344638 - DNA, 25 bp, Mus musculus
cccaggctattgtggagctcactct

SEQ ID NO: 344639 - DNA, 25 bp, Mus musculus
cccaggctattgtgtggctctgatg

SEQ ID NO: 344640 - DNA, 25 bp, Mus musculus
cccaggctctagcacagtgttctat

SEQ ID NO: 344641 - DNA, 25 bp, Mus musculus
cccaggctctaggacagtgttctat

SEQ ID NO: 344642 - DNA, 25 bp, Mus musculus
cccaggctctccaagaaccagaagt

SEQ ID NO: 344643 - DNA, 25 bp, Mus musculus
cccaggctctcctagaaccagaagt

SEQ ID NO: 344644 - DNA, 25 bp, Mus musculus
cccaggctgcctattgtacaaatgt

SEQ ID NO: 344645 - DNA, 25 bp, Mus musculus
cccaggctgccttttgtacaaatgt

SEQ ID NO: 344646 - DNA, 25 bp, Mus musculus
cccaggctggccaagattaaacatt

SEQ ID NO: 344647 - DNA, 25 bp, Mus musculus
cccaggctggcctagattaaacatt

SEQ ID NO: 344648 - DNA, 25 bp, Mus musculus
cccaggcttcggagcttcataatat

SEQ ID NO: 344649 - DNA, 25 bp, Mus musculus
cccaggcttcggtgcttcataatat

SEQ ID NO: 344650 - DNA, 25 bp, Mus musculus
cccaggcttcgtagttcgtgaatga

SEQ ID NO: 344651 - DNA, 25 bp, Mus musculus
cccaggcttcgttgttcgtgaatga

SEQ ID NO: 344652 - DNA, 25 bp, Mus musculus
cccagggaacatcgcgatttttcta

SEQ ID NO: 344653 - DNA, 25 bp, Mus musculus
cccagggaacatggcgatttttcta

SEQ ID NO: 344654 - DNA, 25 bp, Mus musculus
cccagggaacctatgcacaagcagt

SEQ ID NO: 344655 - DNA, 25 bp, Mus musculus
cccagggaacctcagcagtagtatg

SEQ ID NO: 344656 - DNA, 25 bp, Mus musculus
cccagggaacctgagcagtagtatg

SEQ ID NO: 344657 - DNA, 25 bp, Mus musculus
cccagggaacctttgcacaagcagt

SEQ ID NO: 344658 - DNA, 25 bp, Mus musculus
cccagggaagcactttacatttaca

SEQ ID NO: 344659 - DNA, 25 bp, Mus musculus
cccagggaagcagtttacatttaca

SEQ ID NO: 344660 - DNA, 25 bp, Mus musculus
cccagggaattgaaacttgtgctaa

SEQ ID NO: 344661 - DNA, 25 bp, Mus musculus
cccagggaattgtaacttgtgctaa

SEQ ID NO: 344662 - DNA, 25 bp, Mus musculus
cccagggacaggagtgccttgaagt

SEQ ID NO: 344663 - DNA, 25 bp, Mus musculus
cccagggacaggtgtgccttgaagt

SEQ ID NO: 344664 - DNA, 25 bp, Mus musculus
cccagggacatgctctcaaagtttg

SEQ ID NO: 344665 - DNA, 25 bp, Mus musculus
cccagggacatggtctcaaagtttg

SEQ ID NO: 344666 - DNA, 25 bp, Mus musculus
cccagggaccaaagtcctattactt

SEQ ID NO: 344667 - DNA, 25 bp, Mus musculus
cccagggaccaatgtcctattactt

SEQ ID NO: 344668 - DNA, 25 bp, Mus musculus
cccagggaccctatgacatagaggg

SEQ ID NO: 344669 - DNA, 25 bp, Mus musculus
cccagggaccctttgacatagaggg

SEQ ID NO: 344670 - DNA, 25 bp, Mus musculus
cccagggagagacttatgcccaggt

SEQ ID NO: 344671 - DNA, 25 bp, Mus musculus
cccagggagagagttatgcccaggt

SEQ ID NO: 344672 - DNA, 25 bp, Mus musculus
cccagggaggacctcagcctggaaa

SEQ ID NO: 344673 - DNA, 25 bp, Mus musculus
cccagggaggacgtcagcctggaaa

SEQ ID NO: 344674 - DNA, 25 bp, Mus musculus
cccagggatcatccaggtcctagaa

SEQ ID NO: 344675 - DNA, 25 bp, Mus musculus
cccagggatcatgcaggtcctagaa

SEQ ID NO: 344676 - DNA, 25 bp, Mus musculus
cccagggatgtgactcatgttttca

SEQ ID NO: 344677 - DNA, 25 bp, Mus musculus
cccagggatgtgtctcatgttttca

SEQ ID NO: 344678 - DNA, 25 bp, Mus musculus
cccagggattgcacatctgtatcag

SEQ ID NO: 344679 - DNA, 25 bp, Mus musculus
cccagggattgctcatctgtatcag

SEQ ID NO: 344680 - DNA, 25 bp, Mus musculus
cccagggatttcatcagctgacggt

SEQ ID NO: 344681 - DNA, 25 bp, Mus musculus
cccagggatttcttcagctgacggt

SEQ ID NO: 344682 - DNA, 25 bp, Mus musculus
cccagggcagccaggattatgcaga

SEQ ID NO: 344683 - DNA, 25 bp, Mus musculus
cccagggcagcctggattatgcaga

SEQ ID NO: 344684 - DNA, 25 bp, Mus musculus
cccagggcaggcaactcatagctga

SEQ ID NO: 344685 - DNA, 25 bp, Mus musculus
cccagggcaggctactcatagctga

SEQ ID NO: 344686 - DNA, 25 bp, Mus musculus
cccagggcattcatttgtgtagcta

SEQ ID NO: 344687 - DNA, 25 bp, Mus musculus
cccagggcattcttttgtgtagcta

SEQ ID NO: 344688 - DNA, 25 bp, Mus musculus
cccagggctagaagatgatggttag

SEQ ID NO: 344689 - DNA, 25 bp, Mus musculus
cccagggctagatgatgatggttag

SEQ ID NO: 344690 - DNA, 25 bp, Mus musculus
cccagggctatcataaattctatga

SEQ ID NO: 344691 - DNA, 25 bp, Mus musculus
cccagggctatcttaaattctatga

SEQ ID NO: 344692 - DNA, 25 bp, Mus musculus
cccagggctatgcatccactgtgaa

SEQ ID NO: 344693 - DNA, 25 bp, Mus musculus
cccagggctatggatccactgtgaa

SEQ ID NO: 344694 - DNA, 25 bp, Mus musculus
cccagggctgcaactgaagcaggaa

SEQ ID NO: 344695 - DNA, 25 bp, Mus musculus
cccagggctgcatctgaagcaggaa

SEQ ID NO: 344696 - DNA, 25 bp, Mus musculus
cccagggtcccaaaagagtgtcatt

SEQ ID NO: 344697 - DNA, 25 bp, Mus musculus
cccagggtcccataagagtgtcatt

SEQ ID NO: 344698 - DNA, 25 bp, Mus musculus
cccagggtcctaattcttcaagatt

SEQ ID NO: 344699 - DNA, 25 bp, Mus musculus
cccagggtcctatttcttcaagatt

SEQ ID NO: 344700 - DNA, 25 bp, Mus musculus
cccagggtctgacctgctatcctta

SEQ ID NO: 344701 - DNA, 25 bp, Mus musculus
cccagggtctgagctgctatcctta

SEQ ID NO: 344702 - DNA, 25 bp, Mus musculus
cccagggttcacaaagcaggctatg

SEQ ID NO: 344703 - DNA, 25 bp, Mus musculus
cccagggttcactaagcaggctatg

SEQ ID NO: 344704 - DNA, 25 bp, Mus musculus
cccagggttggacacttagaatact

SEQ ID NO: 344705 - DNA, 25 bp, Mus musculus
cccagggttggagacttagaatact

SEQ ID NO: 344706 - DNA, 25 bp, Mus musculus
cccagggttgtcatgagagcttttg

SEQ ID NO: 344707 - DNA, 25 bp, Mus musculus
cccagggttgtcttgagagcttttg

SEQ ID NO: 344708 - DNA, 25 bp, Mus musculus
cccaggtactgaaccgcatcgagga

SEQ ID NO: 344709 - DNA, 25 bp, Mus musculus
cccaggtactgatccgcatcgagga

SEQ ID NO: 344710 - DNA, 25 bp, Mus musculus
cccaggtagcacagctgtcctggga

SEQ ID NO: 344711 - DNA, 25 bp, Mus musculus
cccaggtagcactgctgtcctggga

SEQ ID NO: 344712 - DNA, 25 bp, Mus musculus
cccaggtagcttagtgtttaacatc

SEQ ID NO: 344713 - DNA, 25 bp, Mus musculus
cccaggtagctttgtgtttaacatc

SEQ ID NO: 344714 - DNA, 25 bp, Mus musculus
cccaggtcaagtaaccagcacacaa

SEQ ID NO: 344715 - DNA, 25 bp, Mus musculus
cccaggtcaagttaccagcacacaa

SEQ ID NO: 344716 - DNA, 25 bp, Mus musculus
cccaggtcatggattgctttttaag

SEQ ID NO: 344717 - DNA, 25 bp, Mus musculus
cccaggtcatggtttgctttttaag

SEQ ID NO: 344718 - DNA, 25 bp, Mus musculus
cccaggtccaagcttgaggtaacaa

SEQ ID NO: 344719 - DNA, 25 bp, Mus musculus
cccaggtccaaggttgaggtaacaa

SEQ ID NO: 344720 - DNA, 25 bp, Mus musculus
cccaggtcgctgagtgttatatgag

SEQ ID NO: 344721 - DNA, 25 bp, Mus musculus
cccaggtcgctgtgtgttatatgag

SEQ ID NO: 344722 - DNA, 25 bp, Mus musculus
cccaggtctcttaacagttcataac

SEQ ID NO: 344723 - DNA, 25 bp, Mus musculus
cccaggtctctttacagttcataac

SEQ ID NO: 344724 - DNA, 25 bp, Mus musculus
cccaggtctggaagcttaagtctca

SEQ ID NO: 344725 - DNA, 25 bp, Mus musculus
cccaggtctggatgcttaagtctca

SEQ ID NO: 344726 - DNA, 25 bp, Mus musculus
cccaggtcttgtatttacctgcctg

SEQ ID NO: 344727 - DNA, 25 bp, Mus musculus
cccaggtcttgtttttacctgcctg

SEQ ID NO: 344728 - DNA, 25 bp, Mus musculus
cccaggtgacacagctctttgtaaa

SEQ ID NO: 344729 - DNA, 25 bp, Mus musculus
cccaggtgacactgctctttgtaaa

SEQ ID NO: 344730 - DNA, 25 bp, Mus musculus
cccaggtggctgagctcaaaggaca

SEQ ID NO: 344731 - DNA, 25 bp, Mus musculus
cccaggtggctgtgctcaaaggaca

SEQ ID NO: 344732 - DNA, 25 bp, Mus musculus
cccaggtgggatacgattgtctatg

SEQ ID NO: 344733 - DNA, 25 bp, Mus musculus
cccaggtgggattcgattgtctatg

SEQ ID NO: 344734 - DNA, 25 bp, Mus musculus
cccaggtggtgaccaatgtttctat

SEQ ID NO: 344735 - DNA, 25 bp, Mus musculus
cccaggtggtgagcaatgtttctat

SEQ ID NO: 344736 - DNA, 25 bp, Mus musculus
cccaggtggtgcagaccgatcagga

SEQ ID NO: 344737 - DNA, 25 bp, Mus musculus
cccaggtggtgctgaccgatcagga

SEQ ID NO: 344738 - DNA, 25 bp, Mus musculus
cccaggtgtggcactgatccagtga

SEQ ID NO: 344739 - DNA, 25 bp, Mus musculus
cccaggtgtggctctgatccagtga

SEQ ID NO: 344740 - DNA, 25 bp, Mus musculus
cccaggttacttcagagcagcttaa

SEQ ID NO: 344741 - DNA, 25 bp, Mus musculus
cccaggttacttgagagcagcttaa

SEQ ID NO: 344742 - DNA, 25 bp, Mus musculus
cccaggttagcaacttctcagtgat

SEQ ID NO: 344743 - DNA, 25 bp, Mus musculus
cccaggttagcatcttctcagtgat

SEQ ID NO: 344744 - DNA, 25 bp, Mus musculus
cccaggttccctatgtgtgaaatgg

SEQ ID NO: 344745 - DNA, 25 bp, Mus musculus
cccaggttccctttgtgtgaaatgg

SEQ ID NO: 344746 - DNA, 25 bp, Mus musculus
cccaggttcctcaggatttgcattt

SEQ ID NO: 344747 - DNA, 25 bp, Mus musculus
cccaggttcctctggatttgcattt

SEQ ID NO: 344748 - DNA, 25 bp, Mus musculus
cccaggttcttcacattacacagag

SEQ ID NO: 344749 - DNA, 25 bp, Mus musculus
cccaggttcttctcattacacagag

SEQ ID NO: 344750 - DNA, 25 bp, Mus musculus
cccaggttggttagatttagctaca

SEQ ID NO: 344751 - DNA, 25 bp, Mus musculus
cccaggttggtttgatttagctaca

SEQ ID NO: 344752 - DNA, 25 bp, Mus musculus
cccaggttgtagctgtttgagattc

SEQ ID NO: 344753 - DNA, 25 bp, Mus musculus
cccaggttgtaggtgtttgagattc

SEQ ID NO: 344754 - DNA, 25 bp, Mus musculus
cccaggttgtataccgaaaatgcta

SEQ ID NO: 344755 - DNA, 25 bp, Mus musculus
cccaggttgtattccgaaaatgcta

SEQ ID NO: 344756 - DNA, 25 bp, Mus musculus
cccaggttttgtcagaactagttat

SEQ ID NO: 344757 - DNA, 25 bp, Mus musculus
cccaggttttgtgagaactagttat

SEQ ID NO: 344758 - DNA, 25 bp, Mus musculus
cccagtaatgcacttccttcaaaag

SEQ ID NO: 344759 - DNA, 25 bp, Mus musculus
cccagtaatgcagttccttcaaaag

SEQ ID NO: 344760 - DNA, 25 bp, Mus musculus
cccagtacaactattgagcagaata

SEQ ID NO: 344761 - DNA, 25 bp, Mus musculus
cccagtacaacttttgagcagaata

SEQ ID NO: 344762 - DNA, 25 bp, Mus musculus
cccagtacactgacacctttaatga

SEQ ID NO: 344763 - DNA, 25 bp, Mus musculus
cccagtacactgtcacctttaatga

SEQ ID NO: 344764 - DNA, 25 bp, Mus musculus
cccagtacatgcctgttaactccag

SEQ ID NO: 344765 - DNA, 25 bp, Mus musculus
cccagtacatgcgtgttaactccag

SEQ ID NO: 344766 - DNA, 25 bp, Mus musculus
cccagtacccttaattctgtgtgta

SEQ ID NO: 344767 - DNA, 25 bp, Mus musculus
cccagtaccctttattctgtgtgta

SEQ ID NO: 344768 - DNA, 25 bp, Mus musculus
cccagtactttaaacttcatctagt

SEQ ID NO: 344769 - DNA, 25 bp, Mus musculus
cccagtactttatacttcatctagt

SEQ ID NO: 344770 - DNA, 25 bp, Mus musculus
cccagtagagccagctgtgtgagga

SEQ ID NO: 344771 - DNA, 25 bp, Mus musculus
cccagtagagcctgctgtgtgagga

SEQ ID NO: 344772 - DNA, 25 bp, Mus musculus
cccagtagctttagcaggattcaac

SEQ ID NO: 344773 - DNA, 25 bp, Mus musculus
cccagtagcttttgcaggattcaac

SEQ ID NO: 344774 - DNA, 25 bp, Mus musculus
cccagtatcagtagtttttcccagt

SEQ ID NO: 344775 - DNA, 25 bp, Mus musculus
cccagtatcagttgtttttcccagt

SEQ ID NO: 344776 - DNA, 25 bp, Mus musculus
cccagtatccctagcacttttagaa

SEQ ID NO: 344777 - DNA, 25 bp, Mus musculus
cccagtatcccttgcacttttagaa

SEQ ID NO: 344778 - DNA, 25 bp, Mus musculus
cccagtatctccagtcactagggaa

SEQ ID NO: 344779 - DNA, 25 bp, Mus musculus
cccagtatctcctgtcactagggaa

SEQ ID NO: 344780 - DNA, 25 bp, Mus musculus
cccagtatgactacttccgtgtaga

SEQ ID NO: 344781 - DNA, 25 bp, Mus musculus
cccagtatgacttcttccgtgtaga

SEQ ID NO: 344782 - DNA, 25 bp, Mus musculus
cccagtatggcacgtgtggccaaga

SEQ ID NO: 344783 - DNA, 25 bp, Mus musculus
cccagtatggcaggtgtggccaaga

SEQ ID NO: 344784 - DNA, 25 bp, Mus musculus
cccagtattgttacagacatgtttc

SEQ ID NO: 344785 - DNA, 25 bp, Mus musculus
cccagtattgtttcagacatgtttc

SEQ ID NO: 344786 - DNA, 25 bp, Mus musculus
cccagtcacaagctgtccaacaatt

SEQ ID NO: 344787 - DNA, 25 bp, Mus musculus
cccagtcacaaggtgtccaacaatt

SEQ ID NO: 344788 - DNA, 25 bp, Mus musculus
cccagtcagcccacacgaagagaga

SEQ ID NO: 344789 - DNA, 25 bp, Mus musculus
cccagtcagccctcacgaagagaga

SEQ ID NO: 344790 - DNA, 25 bp, Mus musculus
cccagtcagtatccagcccagtttg

SEQ ID NO: 344791 - DNA, 25 bp, Mus musculus
cccagtcagtatgcagcccagtttg

SEQ ID NO: 344792 - DNA, 25 bp, Mus musculus
cccagtcatcttaagctttcttgtt

SEQ ID NO: 344793 - DNA, 25 bp, Mus musculus
cccagtcatctttagctttcttgtt

SEQ ID NO: 344794 - DNA, 25 bp, Mus musculus
cccagtccctgaaccaatttgtgag

SEQ ID NO: 344795 - DNA, 25 bp, Mus musculus
cccagtccctgatccaatttgtgag

SEQ ID NO: 344796 - DNA, 25 bp, Mus musculus
cccagtctaaccaggagcttattat

SEQ ID NO: 344797 - DNA, 25 bp, Mus musculus
cccagtctaacctggagcttattat

SEQ ID NO: 344798 - DNA, 25 bp, Mus musculus
cccagtctcaggctttgtattcact

SEQ ID NO: 344799 - DNA, 25 bp, Mus musculus
cccagtctcagggtttgtattcact

SEQ ID NO: 344800 - DNA, 25 bp, Mus musculus
cccagtctgcacaattagccattca

SEQ ID NO: 344801 - DNA, 25 bp, Mus musculus
cccagtctgcactattagccattca

SEQ ID NO: 344802 - DNA, 25 bp, Mus musculus
cccagtcttcagctctagtcgatag

SEQ ID NO: 344803 - DNA, 25 bp, Mus musculus
cccagtcttcaggtctagtcgatag

SEQ ID NO: 344804 - DNA, 25 bp, Mus musculus
cccagtctttgcacggatcatcatg

SEQ ID NO: 344805 - DNA, 25 bp, Mus musculus
cccagtctttgctcggatcatcatg

SEQ ID NO: 344806 - DNA, 25 bp, Mus musculus
cccagtgaaccaccattgagggcgt

SEQ ID NO: 344807 - DNA, 25 bp, Mus musculus
cccagtgaaccagcattgagggcgt

SEQ ID NO: 344808 - DNA, 25 bp, Mus musculus
cccagtgaccatagattcgatacct

SEQ ID NO: 344809 - DNA, 25 bp, Mus musculus
cccagtgaccattgattcgatacct

SEQ ID NO: 344810 - DNA, 25 bp, Mus musculus
cccagtgaggtgatttccaaagtag

SEQ ID NO: 344811 - DNA, 25 bp, Mus musculus
cccagtgaggtgttttccaaagtag

SEQ ID NO: 344812 - DNA, 25 bp, Mus musculus
cccagtgatagcaaggagttcccca

SEQ ID NO: 344813 - DNA, 25 bp, Mus musculus
cccagtgatagctaggagttcccca

SEQ ID NO: 344814 - DNA, 25 bp, Mus musculus
cccagtgcacttagaatatggaaga

SEQ ID NO: 344815 - DNA, 25 bp, Mus musculus
cccagtgcactttgaatatggaaga

SEQ ID NO: 344816 - DNA, 25 bp, Mus musculus
cccagtgcctttctggcgcacaggt

SEQ ID NO: 344817 - DNA, 25 bp, Mus musculus
cccagtgcctttgtggcgcacaggt

SEQ ID NO: 344818 - DNA, 25 bp, Mus musculus
cccagtgcgtccacgcggtgagcaa

SEQ ID NO: 344819 - DNA, 25 bp, Mus musculus
cccagtgcgtcctcgcggtgagcaa

SEQ ID NO: 344820 - DNA, 25 bp, Mus musculus
cccagtgctccgcacttggaataga

SEQ ID NO: 344821 - DNA, 25 bp, Mus musculus
cccagtgctccggacttggaataga

SEQ ID NO: 344822 - DNA, 25 bp, Mus musculus
cccagtgctctgactttgatgaaat

SEQ ID NO: 344823 - DNA, 25 bp, Mus musculus
cccagtgctctgtctttgatgaaat

SEQ ID NO: 344824 - DNA, 25 bp, Mus musculus
cccagtgctggtcatgagtcttctg

SEQ ID NO: 344825 - DNA, 25 bp, Mus musculus
cccagtgctggtgatgagtcttctg

SEQ ID NO: 344826 - DNA, 25 bp, Mus musculus
cccagtgcttctaccaaggtagaaa

SEQ ID NO: 344827 - DNA, 25 bp, Mus musculus
cccagtgcttcttccaaggtagaaa

SEQ ID NO: 344828 - DNA, 25 bp, Mus musculus
cccagtggatgacccagtagagaat

SEQ ID NO: 344829 - DNA, 25 bp, Mus musculus
cccagtggatgagccagtagagaat

SEQ ID NO: 344830 - DNA, 25 bp, Mus musculus
cccagtggcacacgctgatggcagc

SEQ ID NO: 344831 - DNA, 25 bp, Mus musculus
cccagtggcacaggctgatggcagc

SEQ ID NO: 344832 - DNA, 25 bp, Mus musculus
cccagtggccaaccacattaatttt

SEQ ID NO: 344833 - DNA, 25 bp, Mus musculus
cccagtggccaagcacattaatttt

SEQ ID NO: 344834 - DNA, 25 bp, Mus musculus
cccagtggcgacaatcacttggaat

SEQ ID NO: 344835 - DNA, 25 bp, Mus musculus
cccagtggcgactatcacttggaat

SEQ ID NO: 344836 - DNA, 25 bp, Mus musculus
cccagtgggcacaatggttggttgt

SEQ ID NO: 344837 - DNA, 25 bp, Mus musculus
cccagtgggcacacagacactgcag

SEQ ID NO: 344838 - DNA, 25 bp, Mus musculus
cccagtgggcactatggttggttgt

SEQ ID NO: 344839 - DNA, 25 bp, Mus musculus
cccagtgggcactcagacactgcag

SEQ ID NO: 344840 - DNA, 25 bp, Mus musculus
cccagtgggctgaataatgtgtact

SEQ ID NO: 344841 - DNA, 25 bp, Mus musculus
cccagtgggctgtataatgtgtact

SEQ ID NO: 344842 - DNA, 25 bp, Mus musculus
cccagtgggtggctacaggatatct

SEQ ID NO: 344843 - DNA, 25 bp, Mus musculus
cccagtgggtgggtacaggatatct

SEQ ID NO: 344844 - DNA, 25 bp, Mus musculus
cccagtggtctcattgtaaccttta

SEQ ID NO: 344845 - DNA, 25 bp, Mus musculus
cccagtggtctctttgtaaccttta

SEQ ID NO: 344846 - DNA, 25 bp, Mus musculus
cccagtggttcgcataactgccgct

SEQ ID NO: 344847 - DNA, 25 bp, Mus musculus
cccagtggttcggataactgccgct

SEQ ID NO: 344848 - DNA, 25 bp, Mus musculus
cccagtggttttagaaaggcaggtg

SEQ ID NO: 344849 - DNA, 25 bp, Mus musculus
cccagtggtttttgaaaggcaggtg

SEQ ID NO: 344850 - DNA, 25 bp, Mus musculus
cccagtgtaccaagtggtactctag

SEQ ID NO: 344851 - DNA, 25 bp, Mus musculus
cccagtgtaccatgtggtactctag

SEQ ID NO: 344852 - DNA, 25 bp, Mus musculus
cccagtgtccagaggctgattgaaa

SEQ ID NO: 344853 - DNA, 25 bp, Mus musculus
cccagtgtccagtggctgattgaaa

SEQ ID NO: 344854 - DNA, 25 bp, Mus musculus
cccagtgtcgggaatttctatgcag

SEQ ID NO: 344855 - DNA, 25 bp, Mus musculus
cccagtgtcgggtatttctatgcag

SEQ ID NO: 344856 - DNA, 25 bp, Mus musculus
cccagtgtctaacctaggttgtttt

SEQ ID NO: 344857 - DNA, 25 bp, Mus musculus
cccagtgtctaagctaggttgtttt

SEQ ID NO: 344858 - DNA, 25 bp, Mus musculus
cccagtgtcttcactacatagcaat

SEQ ID NO: 344859 - DNA, 25 bp, Mus musculus
cccagtgtcttctctacatagcaat

SEQ ID NO: 344860 - DNA, 25 bp, Mus musculus
cccagtgtgacaatgaaggctaagt

SEQ ID NO: 344861 - DNA, 25 bp, Mus musculus
cccagtgtgacattgaaggctaagt

SEQ ID NO: 344862 - DNA, 25 bp, Mus musculus
cccagtgtgccacttcataagaatc

SEQ ID NO: 344863 - DNA, 25 bp, Mus musculus
cccagtgtgccagttcataagaatc

SEQ ID NO: 344864 - DNA, 25 bp, Mus musculus
cccagtgtgctcactgaagttaggt

SEQ ID NO: 344865 - DNA, 25 bp, Mus musculus
cccagtgtgctctctgaagttaggt

SEQ ID NO: 344866 - DNA, 25 bp, Mus musculus
cccagtgtgctgaggttgttgacca

SEQ ID NO: 344867 - DNA, 25 bp, Mus musculus
cccagtgtgctgtggttgttgacca

SEQ ID NO: 344868 - DNA, 25 bp, Mus musculus
cccagtgtggtaactgttgcaaaac

SEQ ID NO: 344869 - DNA, 25 bp, Mus musculus
cccagtgtggtatctgttgcaaaac

SEQ ID NO: 344870 - DNA, 25 bp, Mus musculus
cccagtgtgtcccttgtggatatga

SEQ ID NO: 344871 - DNA, 25 bp, Mus musculus
cccagtgtgtccgttgtggatatga

SEQ ID NO: 344872 - DNA, 25 bp, Mus musculus
cccagtgtgtggcagaaagcctcct

SEQ ID NO: 344873 - DNA, 25 bp, Mus musculus
cccagtgtgtgggagaaagcctcct

SEQ ID NO: 344874 - DNA, 25 bp, Mus musculus
cccagtgttccaacgctttagctga

SEQ ID NO: 344875 - DNA, 25 bp, Mus musculus
cccagtgttccatcgctttagctga

SEQ ID NO: 344876 - DNA, 25 bp, Mus musculus
cccagtgttgaactctatacttaat

SEQ ID NO: 344877 - DNA, 25 bp, Mus musculus
cccagtgttgaagtctatacttaat

SEQ ID NO: 344878 - DNA, 25 bp, Mus musculus
cccagtgttgcgctgtcacagagac

SEQ ID NO: 344879 - DNA, 25 bp, Mus musculus
cccagtgttgcggtgtcacagagac

SEQ ID NO: 344880 - DNA, 25 bp, Mus musculus
cccagttaaatgatatccgttatat

SEQ ID NO: 344881 - DNA, 25 bp, Mus musculus
cccagttaaatgttatccgttatat

SEQ ID NO: 344882 - DNA, 25 bp, Mus musculus
cccagttcaactagtatccttcagg

SEQ ID NO: 344883 - DNA, 25 bp, Mus musculus
cccagttcaacttgtatccttcagg

SEQ ID NO: 344884 - DNA, 25 bp, Mus musculus
cccagttcagcgacaagggtgatga

SEQ ID NO: 344885 - DNA, 25 bp, Mus musculus
cccagttcagcgtcaagggtgatga

SEQ ID NO: 344886 - DNA, 25 bp, Mus musculus
cccagttcagctcccagaatatttt

SEQ ID NO: 344887 - DNA, 25 bp, Mus musculus
cccagttcagctgccagaatatttt

SEQ ID NO: 344888 - DNA, 25 bp, Mus musculus
cccagttcatgtctcagggtggtga

SEQ ID NO: 344889 - DNA, 25 bp, Mus musculus
cccagttcatgtgtcagggtggtga

SEQ ID NO: 344890 - DNA, 25 bp, Mus musculus
cccagttccaggcttcctaagaatg

SEQ ID NO: 344891 - DNA, 25 bp, Mus musculus
cccagttccagggttcctaagaatg

SEQ ID NO: 344892 - DNA, 25 bp, Mus musculus
cccagttccattcagacatgtgata

SEQ ID NO: 344893 - DNA, 25 bp, Mus musculus
cccagttccattgagacatgtgata

SEQ ID NO: 344894 - DNA, 25 bp, Mus musculus
cccagttccgggagttacattggat

SEQ ID NO: 344895 - DNA, 25 bp, Mus musculus
cccagttccgggtgttacattggat

SEQ ID NO: 344896 - DNA, 25 bp, Mus musculus
cccagttcctacaaggctgtcaaaa

SEQ ID NO: 344897 - DNA, 25 bp, Mus musculus
cccagttcctactaggctgtcaaaa

SEQ ID NO: 344898 - DNA, 25 bp, Mus musculus
cccagttcctggctcaaagtgaatt

SEQ ID NO: 344899 - DNA, 25 bp, Mus musculus
cccagttcctgggtcaaagtgaatt

SEQ ID NO: 344900 - DNA, 25 bp, Mus musculus
cccagttgagctctgtttctggagc

SEQ ID NO: 344901 - DNA, 25 bp, Mus musculus
cccagttgagctgtgtttctggagc

SEQ ID NO: 344902 - DNA, 25 bp, Mus musculus
cccagttgccagaggctacacaaga

SEQ ID NO: 344903 - DNA, 25 bp, Mus musculus
cccagttgccagtggctacacaaga

SEQ ID NO: 344904 - DNA, 25 bp, Mus musculus
cccagttgcctgactttcgtgaatg

SEQ ID NO: 344905 - DNA, 25 bp, Mus musculus
cccagttgcctgtctttcgtgaatg

SEQ ID NO: 344906 - DNA, 25 bp, Mus musculus
cccagttggcttcaagggacatttt

SEQ ID NO: 344907 - DNA, 25 bp, Mus musculus
cccagttggcttgaagggacatttt

SEQ ID NO: 344908 - DNA, 25 bp, Mus musculus
cccagttgtgagaggcccattgtgg

SEQ ID NO: 344909 - DNA, 25 bp, Mus musculus
cccagttgtgagtggcccattgtgg

SEQ ID NO: 344910 - DNA, 25 bp, Mus musculus
cccagttgtgttcagatgggtgaac

SEQ ID NO: 344911 - DNA, 25 bp, Mus musculus
cccagttgtgttgagatgggtgaac

SEQ ID NO: 344912 - DNA, 25 bp, Mus musculus
cccagtttaatcagagttcaaggcg

SEQ ID NO: 344913 - DNA, 25 bp, Mus musculus
cccagtttaatctgagttcaaggcg

SEQ ID NO: 344914 - DNA, 25 bp, Mus musculus
cccagtttatctactctataattct

SEQ ID NO: 344915 - DNA, 25 bp, Mus musculus
cccagtttatcttctctataattct

SEQ ID NO: 344916 - DNA, 25 bp, Mus musculus
cccagtttctctatggcgttcagga

SEQ ID NO: 344917 - DNA, 25 bp, Mus musculus
cccagtttctctttggcgttcagga

SEQ ID NO: 344918 - DNA, 25 bp, Mus musculus
cccagtttcttacggaacgcaaatg

SEQ ID NO: 344919 - DNA, 25 bp, Mus musculus
cccagtttcttagggaacgcaaatg

SEQ ID NO: 344920 - DNA, 25 bp, Mus musculus
cccagtttgccaagcgttttgatga

SEQ ID NO: 344921 - DNA, 25 bp, Mus musculus
cccagtttgccaattgtgttattcc

SEQ ID NO: 344922 - DNA, 25 bp, Mus musculus
cccagtttgccatgcgttttgatga

SEQ ID NO: 344923 - DNA, 25 bp, Mus musculus
cccagtttgccatttgtgttattcc

SEQ ID NO: 344924 - DNA, 25 bp, Mus musculus
cccagttttcgaatgctttgttgct

SEQ ID NO: 344925 - DNA, 25 bp, Mus musculus
cccagttttcgattgctttgttgct

SEQ ID NO: 344926 - DNA, 25 bp, Mus musculus
cccagtttttcacctcaggattata

SEQ ID NO: 344927 - DNA, 25 bp, Mus musculus
cccagtttttcagctcaggattata

SEQ ID NO: 344928 - DNA, 25 bp, Mus musculus
cccataaacgatatctgctcctcat

SEQ ID NO: 344929 - DNA, 25 bp, Mus musculus
cccataaacgatttctgctcctcat

SEQ ID NO: 344930 - DNA, 25 bp, Mus musculus
cccataatacttcttcctaaatgaa

SEQ ID NO: 344931 - DNA, 25 bp, Mus musculus
cccataatacttgttcctaaatgaa

SEQ ID NO: 344932 - DNA, 25 bp, Mus musculus
cccatacactagaaaacccaggata

SEQ ID NO: 344933 - DNA, 25 bp, Mus musculus
cccatacactagtaaacccaggata

SEQ ID NO: 344934 - DNA, 25 bp, Mus musculus
cccatacctcatagttggcaaaatt

SEQ ID NO: 344935 - DNA, 25 bp, Mus musculus
cccatacctcattgttggcaaaatt

SEQ ID NO: 344936 - DNA, 25 bp, Mus musculus
cccatacttcttcgatagcaccttt

SEQ ID NO: 344937 - DNA, 25 bp, Mus musculus
cccatacttcttggatagcaccttt

SEQ ID NO: 344938 - DNA, 25 bp, Mus musculus
cccatactttatagtcccagatctt

SEQ ID NO: 344939 - DNA, 25 bp, Mus musculus
cccatactttattgtcccagatctt

SEQ ID NO: 344940 - DNA, 25 bp, Mus musculus
cccatagagggcagcgccacttttg

SEQ ID NO: 344941 - DNA, 25 bp, Mus musculus
cccatagagggctgcgccacttttg

SEQ ID NO: 344942 - DNA, 25 bp, Mus musculus
cccatagcagagctcagatgccaga

SEQ ID NO: 344943 - DNA, 25 bp, Mus musculus
cccatagcagaggtcagatgccaga

SEQ ID NO: 344944 - DNA, 25 bp, Mus musculus
cccatagggcttcgtagtaagtaca

SEQ ID NO: 344945 - DNA, 25 bp, Mus musculus
cccatagggcttggtagtaagtaca

SEQ ID NO: 344946 - DNA, 25 bp, Mus musculus
cccataggtggcaataaggaatcag

SEQ ID NO: 344947 - DNA, 25 bp, Mus musculus
cccataggtggctataaggaatcag

SEQ ID NO: 344948 - DNA, 25 bp, Mus musculus
cccatagtcatgaggcagatgcctt

SEQ ID NO: 344949 - DNA, 25 bp, Mus musculus
cccatagtcatgtggcagatgcctt

SEQ ID NO: 344950 - DNA, 25 bp, Mus musculus
cccatagtctcaaagggaatgacac

SEQ ID NO: 344951 - DNA, 25 bp, Mus musculus
cccatagtctcatagggaatgacac

SEQ ID NO: 344952 - DNA, 25 bp, Mus musculus
cccatagttggacccttgagaatga

SEQ ID NO: 344953 - DNA, 25 bp, Mus musculus
cccatagttggagccttgagaatga

SEQ ID NO: 344954 - DNA, 25 bp, Mus musculus
cccatatctcttcgagttacttcac

SEQ ID NO: 344955 - DNA, 25 bp, Mus musculus
cccatatctcttggagttacttcac

SEQ ID NO: 344956 - DNA, 25 bp, Mus musculus
cccatattcttgcaccttttgcaca

SEQ ID NO: 344957 - DNA, 25 bp, Mus musculus
cccatattcttggaccttttgcaca

SEQ ID NO: 344958 - DNA, 25 bp, Mus musculus
cccatatttctgatccctcatgatg

SEQ ID NO: 344959 - DNA, 25 bp, Mus musculus
cccatatttctgttccctcatgatg

SEQ ID NO: 344960 - DNA, 25 bp, Mus musculus
cccatcaacataactggccaagtga

SEQ ID NO: 344961 - DNA, 25 bp, Mus musculus
cccatcaacatatctggccaagtga

SEQ ID NO: 344962 - DNA, 25 bp, Mus musculus
cccatcaaccttatcttcagatact

SEQ ID NO: 344963 - DNA, 25 bp, Mus musculus
cccatcaaccttttcttcagatact

SEQ ID NO: 344964 - DNA, 25 bp, Mus musculus
cccatcaaggcgcagtcaggtgatc

SEQ ID NO: 344965 - DNA, 25 bp, Mus musculus
cccatcaaggcggagtcaggtgatc

SEQ ID NO: 344966 - DNA, 25 bp, Mus musculus
cccatcacagctagccgacaggtag

SEQ ID NO: 344967 - DNA, 25 bp, Mus musculus
cccatcacagcttgccgacaggtag

SEQ ID NO: 344968 - DNA, 25 bp, Mus musculus
cccatcacattgacactttattcaa

SEQ ID NO: 344969 - DNA, 25 bp, Mus musculus
cccatcacattgtcactttattcaa

SEQ ID NO: 344970 - DNA, 25 bp, Mus musculus
cccatcagctcaactgattctgtca

SEQ ID NO: 344971 - DNA, 25 bp, Mus musculus
cccatcagctcatctgattctgtca

SEQ ID NO: 344972 - DNA, 25 bp, Mus musculus
cccatcaggaaaagggaacctggtg

SEQ ID NO: 344973 - DNA, 25 bp, Mus musculus
cccatcaggaaatgggaacctggtg

SEQ ID NO: 344974 - DNA, 25 bp, Mus musculus
cccatcagtctcacttaagctagta

SEQ ID NO: 344975 - DNA, 25 bp, Mus musculus
cccatcagtctctcttaagctagta

SEQ ID NO: 344976 - DNA, 25 bp, Mus musculus
cccatcagttggaattagtacctta

SEQ ID NO: 344977 - DNA, 25 bp, Mus musculus
cccatcagttggtattagtacctta

SEQ ID NO: 344978 - DNA, 25 bp, Mus musculus
cccatcataaatctggcgcggctat

SEQ ID NO: 344979 - DNA, 25 bp, Mus musculus
cccatcataaatgtggcgcggctat

SEQ ID NO: 344980 - DNA, 25 bp, Mus musculus
cccatcataatcctgggcgacgacc

SEQ ID NO: 344981 - DNA, 25 bp, Mus musculus
cccatcataatcgtgggcgacgacc

SEQ ID NO: 344982 - DNA, 25 bp, Mus musculus
cccatcatacctaggcctgaatcaa

SEQ ID NO: 344983 - DNA, 25 bp, Mus musculus
cccatcataccttggcctgaatcaa

SEQ ID NO: 344984 - DNA, 25 bp, Mus musculus
cccatcataggtcacacatagttga

SEQ ID NO: 344985 - DNA, 25 bp, Mus musculus
cccatcataggtgacacatagttga

SEQ ID NO: 344986 - DNA, 25 bp, Mus musculus
cccatcatgagactgtattatcctt

SEQ ID NO: 344987 - DNA, 25 bp, Mus musculus
cccatcatgagagtgtattatcctt

SEQ ID NO: 344988 - DNA, 25 bp, Mus musculus
cccatcattctcactgtctttgaaa

SEQ ID NO: 344989 - DNA, 25 bp, Mus musculus
cccatcattctctctgtctttgaaa

SEQ ID NO: 344990 - DNA, 25 bp, Mus musculus
cccatcattgggaacactaagcagg

SEQ ID NO: 344991 - DNA, 25 bp, Mus musculus
cccatcattgggtacactaagcagg

SEQ ID NO: 344992 - DNA, 25 bp, Mus musculus
cccatccaaaatattctcctcaaat

SEQ ID NO: 344993 - DNA, 25 bp, Mus musculus
cccatccaaaattttctcctcaaat

SEQ ID NO: 344994 - DNA, 25 bp, Mus musculus
cccatccaaacccaattcagttgta

SEQ ID NO: 344995 - DNA, 25 bp, Mus musculus
cccatccaaaccgaattcagttgta

SEQ ID NO: 344996 - DNA, 25 bp, Mus musculus
cccatccaatcaatgtgctcgggaa

SEQ ID NO: 344997 - DNA, 25 bp, Mus musculus
cccatccaatcattgtgctcgggaa

SEQ ID NO: 344998 - DNA, 25 bp, Mus musculus
cccatccagagccagtgttggttat

SEQ ID NO: 344999 - DNA, 25 bp, Mus musculus
cccatccagagcgagtgttggttat

SEQ ID NO: 345000 - DNA, 25 bp, Mus musculus
cccatccatctcattgcataggttt

SEQ ID NO: 345001 - DNA, 25 bp, Mus musculus
cccatccatctctttgcataggttt

SEQ ID NO: 345002 - DNA, 25 bp, Mus musculus
cccatcccagcaaggatgtgcatca

SEQ ID NO: 345003 - DNA, 25 bp, Mus musculus
cccatcccagcatggatgtgcatca

SEQ ID NO: 345004 - DNA, 25 bp, Mus musculus
cccatcccaggtactgtttgattga

SEQ ID NO: 345005 - DNA, 25 bp, Mus musculus
cccatcccaggttctgtttgattga

SEQ ID NO: 345006 - DNA, 25 bp, Mus musculus
cccatcccatgcacacataatttaa

SEQ ID NO: 345007 - DNA, 25 bp, Mus musculus
cccatcccatgctcacataatttaa

SEQ ID NO: 345008 - DNA, 25 bp, Mus musculus
cccatcccgaagagctaagattata

SEQ ID NO: 345009 - DNA, 25 bp, Mus musculus
cccatcccgaagtgctaagattata

SEQ ID NO: 345010 - DNA, 25 bp, Mus musculus
cccatcccggatatgttacagcagg

SEQ ID NO: 345011 - DNA, 25 bp, Mus musculus
cccatcccggatttgttacagcagg

SEQ ID NO: 345012 - DNA, 25 bp, Mus musculus
cccatccctctaattacaagcttga

SEQ ID NO: 345013 - DNA, 25 bp, Mus musculus
cccatccctctatttacaagcttga

SEQ ID NO: 345014 - DNA, 25 bp, Mus musculus
cccatccctgcaaatcacattaatg

SEQ ID NO: 345015 - DNA, 25 bp, Mus musculus
cccatccctgcatatcacattaatg

SEQ ID NO: 345016 - DNA, 25 bp, Mus musculus
cccatccgcattacctagagtttga

SEQ ID NO: 345017 - DNA, 25 bp, Mus musculus
cccatccgcatttcctagagtttga

SEQ ID NO: 345018 - DNA, 25 bp, Mus musculus
cccatccggagcagttgtgtcagat

SEQ ID NO: 345019 - DNA, 25 bp, Mus musculus
cccatccggagctgttgtgtcagat

SEQ ID NO: 345020 - DNA, 25 bp, Mus musculus
cccatcgagaccaagcctggttttc

SEQ ID NO: 345021 - DNA, 25 bp, Mus musculus
cccatcgagacctagcctggttttc

SEQ ID NO: 345022 - DNA, 25 bp, Mus musculus
cccatcgtgttgataccaaatagga

SEQ ID NO: 345023 - DNA, 25 bp, Mus musculus
cccatcgtgttgttaccaaatagga

SEQ ID NO: 345024 - DNA, 25 bp, Mus musculus
cccatctaggataccagagagaaaa

SEQ ID NO: 345025 - DNA, 25 bp, Mus musculus
cccatctaggattccagagagaaaa

SEQ ID NO: 345026 - DNA, 25 bp, Mus musculus
cccatctatgagatccggtgacaga

SEQ ID NO: 345027 - DNA, 25 bp, Mus musculus
cccatctatgagttccggtgacaga

SEQ ID NO: 345028 - DNA, 25 bp, Mus musculus
cccatctatttcagaggtcttcttg

SEQ ID NO: 345029 - DNA, 25 bp, Mus musculus
cccatctatttctgaggtcttcttg

SEQ ID NO: 345030 - DNA, 25 bp, Mus musculus
cccatctcatttactgttctcattt

SEQ ID NO: 345031 - DNA, 25 bp, Mus musculus
cccatctcattttctgttctcattt

SEQ ID NO: 345032 - DNA, 25 bp, Mus musculus
cccatctccaggacatgccagcgac

SEQ ID NO: 345033 - DNA, 25 bp, Mus musculus
cccatctccaggtcatgccagcgac

SEQ ID NO: 345034 - DNA, 25 bp, Mus musculus
cccatctccatgagtgaagtagctt

SEQ ID NO: 345035 - DNA, 25 bp, Mus musculus
cccatctccatgtgtgaagtagctt

SEQ ID NO: 345036 - DNA, 25 bp, Mus musculus
cccatctctcatcagtcattgtaca

SEQ ID NO: 345037 - DNA, 25 bp, Mus musculus
cccatctctcatgagtcattgtaca

SEQ ID NO: 345038 - DNA, 25 bp, Mus musculus
cccatctctgatcatgtccagtcag

SEQ ID NO: 345039 - DNA, 25 bp, Mus musculus
cccatctctgatgatgtccagtcag

SEQ ID NO: 345040 - DNA, 25 bp, Mus musculus
cccatctctgtcagcggttaataga

SEQ ID NO: 345041 - DNA, 25 bp, Mus musculus
cccatctctgtctgcggttaataga

SEQ ID NO: 345042 - DNA, 25 bp, Mus musculus
cccatctgcacgaggtgtgttggac

SEQ ID NO: 345043 - DNA, 25 bp, Mus musculus
cccatctgcacgtggtgtgttggac

SEQ ID NO: 345044 - DNA, 25 bp, Mus musculus
cccatctgccaaagactgtcatgtt

SEQ ID NO: 345045 - DNA, 25 bp, Mus musculus
cccatctgccaatgactgtcatgtt

SEQ ID NO: 345046 - DNA, 25 bp, Mus musculus
cccatctgcgaacctccaggagggt

SEQ ID NO: 345047 - DNA, 25 bp, Mus musculus
cccatctgcgaagctccaggagggt

SEQ ID NO: 345048 - DNA, 25 bp, Mus musculus
cccatctggaaaacatacttgagaa

SEQ ID NO: 345049 - DNA, 25 bp, Mus musculus
cccatctggaaatcatacttgagaa

SEQ ID NO: 345050 - DNA, 25 bp, Mus musculus
cccatctgtactcgaacttcagctt

SEQ ID NO: 345051 - DNA, 25 bp, Mus musculus
cccatctgtactggaacttcagctt

SEQ ID NO: 345052 - DNA, 25 bp, Mus musculus
cccatctgtgagaagcgcttcatgc

SEQ ID NO: 345053 - DNA, 25 bp, Mus musculus
cccatctgtgagtagcgcttcatgc

SEQ ID NO: 345054 - DNA, 25 bp, Mus musculus
cccatctgtttcactgtcctgtcat

SEQ ID NO: 345055 - DNA, 25 bp, Mus musculus
cccatctgtttctctgtcctgtcat

SEQ ID NO: 345056 - DNA, 25 bp, Mus musculus
cccatcttgggccaagtcagcaggt

SEQ ID NO: 345057 - DNA, 25 bp, Mus musculus
cccatcttgggcgaagtcagcaggt

SEQ ID NO: 345058 - DNA, 25 bp, Mus musculus
cccatctttacacagttgtaatgtt

SEQ ID NO: 345059 - DNA, 25 bp, Mus musculus
cccatctttacagagttgtaatgtt

SEQ ID NO: 345060 - DNA, 25 bp, Mus musculus
cccatctttgtcagttcatcttatt

SEQ ID NO: 345061 - DNA, 25 bp, Mus musculus
cccatctttgtctgttcatcttatt

SEQ ID NO: 345062 - DNA, 25 bp, Mus musculus
cccatgaaaccaccatacctatgta

SEQ ID NO: 345063 - DNA, 25 bp, Mus musculus
cccatgaaaccagcatacctatgta

SEQ ID NO: 345064 - DNA, 25 bp, Mus musculus
cccatgaacccaatcttccagaaga

SEQ ID NO: 345065 - DNA, 25 bp, Mus musculus
cccatgaacccattcttccagaaga

SEQ ID NO: 345066 - DNA, 25 bp, Mus musculus
cccatgaccaaaagtttagagacat

SEQ ID NO: 345067 - DNA, 25 bp, Mus musculus
cccatgaccaaatgtttagagacat

SEQ ID NO: 345068 - DNA, 25 bp, Mus musculus
cccatgaccaacataaagacgacat

SEQ ID NO: 345069 - DNA, 25 bp, Mus musculus
cccatgaccaacttaaagacgacat

SEQ ID NO: 345070 - DNA, 25 bp, Mus musculus
cccatgaccagactgtccatcttaa

SEQ ID NO: 345071 - DNA, 25 bp, Mus musculus
cccatgaccagagtgtccatcttaa

SEQ ID NO: 345072 - DNA, 25 bp, Mus musculus
cccatgacgttactgcaggccagaa

SEQ ID NO: 345073 - DNA, 25 bp, Mus musculus
cccatgacgttagtgcaggccagaa

SEQ ID NO: 345074 - DNA, 25 bp, Mus musculus
cccatgactggtatggaaacgattt

SEQ ID NO: 345075 - DNA, 25 bp, Mus musculus
cccatgactggtttggaaacgattt

SEQ ID NO: 345076 - DNA, 25 bp, Mus musculus
cccatgataactcacaactctctgt

SEQ ID NO: 345077 - DNA, 25 bp, Mus musculus
cccatgataactgacaactctctgt

SEQ ID NO: 345078 - DNA, 25 bp, Mus musculus
cccatgatgatgctgtgaggtctga

SEQ ID NO: 345079 - DNA, 25 bp, Mus musculus
cccatgatgatggtgtgaggtctga

SEQ ID NO: 345080 - DNA, 25 bp, Mus musculus
cccatgatgctcctactattcggta

SEQ ID NO: 345081 - DNA, 25 bp, Mus musculus
cccatgatgctcgtactattcggta

SEQ ID NO: 345082 - DNA, 25 bp, Mus musculus
cccatgatgggcaggctgcagagct

SEQ ID NO: 345083 - DNA, 25 bp, Mus musculus
cccatgatgggctggctgcagagct

SEQ ID NO: 345084 - DNA, 25 bp, Mus musculus
cccatgcaagctatttgttgtagat

SEQ ID NO: 345085 - DNA, 25 bp, Mus musculus
cccatgcaagctttttgttgtagat

SEQ ID NO: 345086 - DNA, 25 bp, Mus musculus
cccatgccacacatttgtctgatat

SEQ ID NO: 345087 - DNA, 25 bp, Mus musculus
cccatgccacacttttgtctgatat

SEQ ID NO: 345088 - DNA, 25 bp, Mus musculus
cccatgccagatcatggccatgtca

SEQ ID NO: 345089 - DNA, 25 bp, Mus musculus
cccatgccagatgatggccatgtca

SEQ ID NO: 345090 - DNA, 25 bp, Mus musculus
cccatgccccatcttgagtaggaaa

SEQ ID NO: 345091 - DNA, 25 bp, Mus musculus
cccatgccccatgttgagtaggaaa

SEQ ID NO: 345092 - DNA, 25 bp, Mus musculus
cccatgcctcgaatctgatttttag

SEQ ID NO: 345093 - DNA, 25 bp, Mus musculus
cccatgcctcgattctgatttttag

SEQ ID NO: 345094 - DNA, 25 bp, Mus musculus
cccatgccttcaattcagctaagag

SEQ ID NO: 345095 - DNA, 25 bp, Mus musculus
cccatgccttcatttcagctaagag

SEQ ID NO: 345096 - DNA, 25 bp, Mus musculus
cccatgcggtatacctggtgtatca

SEQ ID NO: 345097 - DNA, 25 bp, Mus musculus
cccatgcggtattcctggtgtatca

SEQ ID NO: 345098 - DNA, 25 bp, Mus musculus
cccatgctaagcacgattctagttt

SEQ ID NO: 345099 - DNA, 25 bp, Mus musculus
cccatgctaagctcgattctagttt

SEQ ID NO: 345100 - DNA, 25 bp, Mus musculus
cccatgctatatctagctcttctag

SEQ ID NO: 345101 - DNA, 25 bp, Mus musculus
cccatgctatatgtagctcttctag

SEQ ID NO: 345102 - DNA, 25 bp, Mus musculus
cccatgctatttaaggatgaggtgt

SEQ ID NO: 345103 - DNA, 25 bp, Mus musculus
cccatgctattttaggatgaggtgt

SEQ ID NO: 345104 - DNA, 25 bp, Mus musculus
cccatgctgcacatttttattctgc

SEQ ID NO: 345105 - DNA, 25 bp, Mus musculus
cccatgctgcacttttttattctgc

SEQ ID NO: 345106 - DNA, 25 bp, Mus musculus
cccatgcttataaaatgtagctttt

SEQ ID NO: 345107 - DNA, 25 bp, Mus musculus
cccatgcttatataatgtagctttt

SEQ ID NO: 345108 - DNA, 25 bp, Mus musculus
cccatgctttagattgccttacatc

SEQ ID NO: 345109 - DNA, 25 bp, Mus musculus
cccatgctttagtttgccttacatc

SEQ ID NO: 345110 - DNA, 25 bp, Mus musculus
cccatgctttcactggtagtcaagg

SEQ ID NO: 345111 - DNA, 25 bp, Mus musculus
cccatgctttcagtggtagtcaagg

SEQ ID NO: 345112 - DNA, 25 bp, Mus musculus
cccatggaaggcagatcgattgata

SEQ ID NO: 345113 - DNA, 25 bp, Mus musculus
cccatggaaggctgatcgattgata

SEQ ID NO: 345114 - DNA, 25 bp, Mus musculus
cccatggagggcatccagctataat

SEQ ID NO: 345115 - DNA, 25 bp, Mus musculus
cccatggagggcttccagctataat

SEQ ID NO: 345116 - DNA, 25 bp, Mus musculus
cccatggagttgctgttatcgctgt

SEQ ID NO: 345117 - DNA, 25 bp, Mus musculus
cccatggagttggtgttatcgctgt

SEQ ID NO: 345118 - DNA, 25 bp, Mus musculus
cccatggcacgcactggacagtata

SEQ ID NO: 345119 - DNA, 25 bp, Mus musculus
cccatggcacgctctggacagtata

SEQ ID NO: 345120 - DNA, 25 bp, Mus musculus
cccatgggcatgctccagagcagga

SEQ ID NO: 345121 - DNA, 25 bp, Mus musculus
cccatgggcatggtccagagcagga

SEQ ID NO: 345122 - DNA, 25 bp, Mus musculus
cccatgggctcactcgttgtggaga

SEQ ID NO: 345123 - DNA, 25 bp, Mus musculus
cccatgggctcagtcgttgtggaga

SEQ ID NO: 345124 - DNA, 25 bp, Mus musculus
cccatggtaaggctggaggctattt

SEQ ID NO: 345125 - DNA, 25 bp, Mus musculus
cccatggtaagggtggaggctattt

SEQ ID NO: 345126 - DNA, 25 bp, Mus musculus
cccatggtagagatcgacgggatga

SEQ ID NO: 345127 - DNA, 25 bp, Mus musculus
cccatggtagagttcgacgggatga

SEQ ID NO: 345128 - DNA, 25 bp, Mus musculus
cccatggtctacaagggcttgcttg

SEQ ID NO: 345129 - DNA, 25 bp, Mus musculus
cccatggtctactagggcttgcttg

SEQ ID NO: 345130 - DNA, 25 bp, Mus musculus
cccatggtgagcatctttcttcctt

SEQ ID NO: 345131 - DNA, 25 bp, Mus musculus
cccatggtgagcttctttcttcctt

SEQ ID NO: 345132 - DNA, 25 bp, Mus musculus
cccatggtgataccttgcttgctga

SEQ ID NO: 345133 - DNA, 25 bp, Mus musculus
cccatggtgatagcttgcttgctga

SEQ ID NO: 345134 - DNA, 25 bp, Mus musculus
cccatggtggctcctagtccggaga

SEQ ID NO: 345135 - DNA, 25 bp, Mus musculus
cccatggtggctgctagtccggaga

SEQ ID NO: 345136 - DNA, 25 bp, Mus musculus
cccatggttgaaatgagtgagcttt

SEQ ID NO: 345137 - DNA, 25 bp, Mus musculus
cccatggttgaattgagtgagcttt

SEQ ID NO: 345138 - DNA, 25 bp, Mus musculus
cccatggttttgacaagccctgagg

SEQ ID NO: 345139 - DNA, 25 bp, Mus musculus
cccatggttttgtcaagccctgagg

SEQ ID NO: 345140 - DNA, 25 bp, Mus musculus
cccatgtaattaatgtgaacacctt

SEQ ID NO: 345141 - DNA, 25 bp, Mus musculus
cccatgtaattattgtgaacacctt

SEQ ID NO: 345142 - DNA, 25 bp, Mus musculus
cccatgtcattcaagaaccccagtg

SEQ ID NO: 345143 - DNA, 25 bp, Mus musculus
cccatgtcattctagaaccccagtg

SEQ ID NO: 345144 - DNA, 25 bp, Mus musculus
cccatgtctattaccacactttttt

SEQ ID NO: 345145 - DNA, 25 bp, Mus musculus
cccatgtctatttccacactttttt

SEQ ID NO: 345146 - DNA, 25 bp, Mus musculus
cccatgtctcggctgtacctcatgt

SEQ ID NO: 345147 - DNA, 25 bp, Mus musculus
cccatgtctcgggtgtacctcatgt

SEQ ID NO: 345148 - DNA, 25 bp, Mus musculus
cccatgtctcttctggcaatagagc

SEQ ID NO: 345149 - DNA, 25 bp, Mus musculus
cccatgtctcttgtggcaatagagc

SEQ ID NO: 345150 - DNA, 25 bp, Mus musculus
cccatgtgtgtacgcttgttggcat

SEQ ID NO: 345151 - DNA, 25 bp, Mus musculus
cccatgtgtgtaggcttgttggcat

SEQ ID NO: 345152 - DNA, 25 bp, Mus musculus
cccatgttctagatgctgttagcat

SEQ ID NO: 345153 - DNA, 25 bp, Mus musculus
cccatgttctagttgctgttagcat

SEQ ID NO: 345154 - DNA, 25 bp, Mus musculus
cccatgttctccagtttacaactta

SEQ ID NO: 345155 - DNA, 25 bp, Mus musculus
cccatgttctcctgtttacaactta

SEQ ID NO: 345156 - DNA, 25 bp, Mus musculus
cccatgtttctgacggttgccgtag

SEQ ID NO: 345157 - DNA, 25 bp, Mus musculus
cccatgtttctgtcggttgccgtag

SEQ ID NO: 345158 - DNA, 25 bp, Mus musculus
cccattacagtgcattcttcttaag

SEQ ID NO: 345159 - DNA, 25 bp, Mus musculus
cccattacagtggattcttcttaag

SEQ ID NO: 345160 - DNA, 25 bp, Mus musculus
cccattactaatcatgtccagtcag

SEQ ID NO: 345161 - DNA, 25 bp, Mus musculus
cccattactaatgatgtccagtcag

SEQ ID NO: 345162 - DNA, 25 bp, Mus musculus
cccattagagggagtcaggctgagc

SEQ ID NO: 345163 - DNA, 25 bp, Mus musculus
cccattagagggtgtcaggctgagc

SEQ ID NO: 345164 - DNA, 25 bp, Mus musculus
cccattaggcaaatcacaacaagct

SEQ ID NO: 345165 - DNA, 25 bp, Mus musculus
cccattaggcaattcacaacaagct

SEQ ID NO: 345166 - DNA, 25 bp, Mus musculus
cccattattagcaccaaacgctgaa

SEQ ID NO: 345167 - DNA, 25 bp, Mus musculus
cccattattagctccaaacgctgaa

SEQ ID NO: 345168 - DNA, 25 bp, Mus musculus
cccattcaagcgaggagagtttaga

SEQ ID NO: 345169 - DNA, 25 bp, Mus musculus
cccattcaagcgtggagagtttaga

SEQ ID NO: 345170 - DNA, 25 bp, Mus musculus
cccattcactagatgctgtaggctt

SEQ ID NO: 345171 - DNA, 25 bp, Mus musculus
cccattcactagttgctgtaggctt

SEQ ID NO: 345172 - DNA, 25 bp, Mus musculus
cccattcatgtgagtgttgctattg

SEQ ID NO: 345173 - DNA, 25 bp, Mus musculus
cccattcatgtgtgtgttgctattg

SEQ ID NO: 345174 - DNA, 25 bp, Mus musculus
cccattccatcgagagtttcctact

SEQ ID NO: 345175 - DNA, 25 bp, Mus musculus
cccattccatcgtgagtttcctact

SEQ ID NO: 345176 - DNA, 25 bp, Mus musculus
cccattcctcacatctggtatggaa

SEQ ID NO: 345177 - DNA, 25 bp, Mus musculus
cccattcctcacttctggtatggaa

SEQ ID NO: 345178 - DNA, 25 bp, Mus musculus
cccattctccagaagcttatttctt

SEQ ID NO: 345179 - DNA, 25 bp, Mus musculus
cccattctccagtagcttatttctt

SEQ ID NO: 345180 - DNA, 25 bp, Mus musculus
cccattctcttcctatagtactgtt

SEQ ID NO: 345181 - DNA, 25 bp, Mus musculus
cccattctcttcgtatagtactgtt

SEQ ID NO: 345182 - DNA, 25 bp, Mus musculus
cccattcttagacgttggaagcaag

SEQ ID NO: 345183 - DNA, 25 bp, Mus musculus
cccattcttagaggttggaagcaag

SEQ ID NO: 345184 - DNA, 25 bp, Mus musculus
cccattgaagtcaccattaaagtct

SEQ ID NO: 345185 - DNA, 25 bp, Mus musculus
cccattgaagtctccattaaagtct

SEQ ID NO: 345186 - DNA, 25 bp, Mus musculus
cccattgattggactcagactaata

SEQ ID NO: 345187 - DNA, 25 bp, Mus musculus
cccattgattggtctcagactaata

SEQ ID NO: 345188 - DNA, 25 bp, Mus musculus
cccattgattgtatgtcggaagtct

SEQ ID NO: 345189 - DNA, 25 bp, Mus musculus
cccattgattgtttgtcggaagtct

SEQ ID NO: 345190 - DNA, 25 bp, Mus musculus
cccattgatttgcaagtacagctcc

SEQ ID NO: 345191 - DNA, 25 bp, Mus musculus
cccattgatttggaagtacagctcc

SEQ ID NO: 345192 - DNA, 25 bp, Mus musculus
cccattgcagttccccaactattta

SEQ ID NO: 345193 - DNA, 25 bp, Mus musculus
cccattgcagttgcccaactattta

SEQ ID NO: 345194 - DNA, 25 bp, Mus musculus
cccattgcatggatttttcataata

SEQ ID NO: 345195 - DNA, 25 bp, Mus musculus
cccattgcatggttttttcataata

SEQ ID NO: 345196 - DNA, 25 bp, Mus musculus
cccattgccatgacagtgcctagaa

SEQ ID NO: 345197 - DNA, 25 bp, Mus musculus
cccattgccatgtcagtgcctagaa

SEQ ID NO: 345198 - DNA, 25 bp, Mus musculus
cccattgcttggcttctcgaagaaa

SEQ ID NO: 345199 - DNA, 25 bp, Mus musculus
cccattgcttgggttctcgaagaaa

SEQ ID NO: 345200 - DNA, 25 bp, Mus musculus
cccattgctttcaggagcacctaag

SEQ ID NO: 345201 - DNA, 25 bp, Mus musculus
cccattgctttctggagcacctaag

SEQ ID NO: 345202 - DNA, 25 bp, Mus musculus
cccattggaggcaggattgtagaat

SEQ ID NO: 345203 - DNA, 25 bp, Mus musculus
cccattggaggctggattgtagaat

SEQ ID NO: 345204 - DNA, 25 bp, Mus musculus
cccattggcggaacttgtttgtgta

SEQ ID NO: 345205 - DNA, 25 bp, Mus musculus
cccattggcggatcttgtttgtgta

SEQ ID NO: 345206 - DNA, 25 bp, Mus musculus
cccattggcttaaatctcagatctg

SEQ ID NO: 345207 - DNA, 25 bp, Mus musculus
cccattggcttatatctcagatctg

SEQ ID NO: 345208 - DNA, 25 bp, Mus musculus
cccattgggagcaaggcaggacaga

SEQ ID NO: 345209 - DNA, 25 bp, Mus musculus
cccattgggagctaggcaggacaga

SEQ ID NO: 345210 - DNA, 25 bp, Mus musculus
cccattgggtgtaccttgtctatgt

SEQ ID NO: 345211 - DNA, 25 bp, Mus musculus
cccattgggtgttccttgtctatgt

SEQ ID NO: 345212 - DNA, 25 bp, Mus musculus
cccattgtgctcctctgatggaaat

SEQ ID NO: 345213 - DNA, 25 bp, Mus musculus
cccattgtgctcgtctgatggaaat

SEQ ID NO: 345214 - DNA, 25 bp, Mus musculus
cccatttaaatgagacctatgaaca

SEQ ID NO: 345215 - DNA, 25 bp, Mus musculus
cccatttaaatgtgacctatgaaca

SEQ ID NO: 345216 - DNA, 25 bp, Mus musculus
cccatttagtgtcagctgtaaaact

SEQ ID NO: 345217 - DNA, 25 bp, Mus musculus
cccatttagtgtgagctgtaaaact

SEQ ID NO: 345218 - DNA, 25 bp, Mus musculus
cccatttatgataaactccaggcta

SEQ ID NO: 345219 - DNA, 25 bp, Mus musculus
cccatttatgattaactccaggcta

SEQ ID NO: 345220 - DNA, 25 bp, Mus musculus
cccatttatgtgatctcttcttttg

SEQ ID NO: 345221 - DNA, 25 bp, Mus musculus
cccatttatgtgttctcttcttttg

SEQ ID NO: 345222 - DNA, 25 bp, Mus musculus
cccatttcacgtatggtttagcttg

SEQ ID NO: 345223 - DNA, 25 bp, Mus musculus
cccatttcacgtttggtttagcttg

SEQ ID NO: 345224 - DNA, 25 bp, Mus musculus
cccatttcatgtctagctgaccttg

SEQ ID NO: 345225 - DNA, 25 bp, Mus musculus
cccatttcatgtgtagctgaccttg

SEQ ID NO: 345226 - DNA, 25 bp, Mus musculus
cccatttcattcactgttctttgac

SEQ ID NO: 345227 - DNA, 25 bp, Mus musculus
cccatttcattctctgttctttgac

SEQ ID NO: 345228 - DNA, 25 bp, Mus musculus
cccatttcccttattgctgccaaaa

SEQ ID NO: 345229 - DNA, 25 bp, Mus musculus
cccatttccctttttgctgccaaaa

SEQ ID NO: 345230 - DNA, 25 bp, Mus musculus
cccatttgcaccatttctggatgtg

SEQ ID NO: 345231 - DNA, 25 bp, Mus musculus
cccatttgcaccttttctggatgtg

SEQ ID NO: 345232 - DNA, 25 bp, Mus musculus
cccatttggaccagcttctgaacaa

SEQ ID NO: 345233 - DNA, 25 bp, Mus musculus
cccatttggacctgcttctgaacaa

SEQ ID NO: 345234 - DNA, 25 bp, Mus musculus
cccatttgtcttaagtgcttcagtc

SEQ ID NO: 345235 - DNA, 25 bp, Mus musculus
cccatttgtctttagtgcttcagtc

SEQ ID NO: 345236 - DNA, 25 bp, Mus musculus
cccattttcaggactattcaacctg

SEQ ID NO: 345237 - DNA, 25 bp, Mus musculus
cccattttcaggtctattcaacctg

SEQ ID NO: 345238 - DNA, 25 bp, Mus musculus
cccattttgttacctttctgttcag

SEQ ID NO: 345239 - DNA, 25 bp, Mus musculus
cccattttgttagctttctgttcag

SEQ ID NO: 345240 - DNA, 25 bp, Mus musculus
cccatttttgtaccggtcactgttt

SEQ ID NO: 345241 - DNA, 25 bp, Mus musculus
cccatttttgtagcggtcactgttt

SEQ ID NO: 345242 - DNA, 25 bp, Mus musculus
cccattttttcaacatttgacccat

SEQ ID NO: 345243 - DNA, 25 bp, Mus musculus
cccattttttcatcatttgacccat

SEQ ID NO: 345244 - DNA, 25 bp, Mus musculus
ccccaaaaatataatctgtcggcca

SEQ ID NO: 345245 - DNA, 25 bp, Mus musculus
ccccaaaaatattatctgtcggcca

SEQ ID NO: 345246 - DNA, 25 bp, Mus musculus
ccccaaaatcatagtgtccctatta

SEQ ID NO: 345247 - DNA, 25 bp, Mus musculus
ccccaaaatcattgtgtccctatta

SEQ ID NO: 345248 - DNA, 25 bp, Mus musculus
ccccaaacactcaggtggagatact

SEQ ID NO: 345249 - DNA, 25 bp, Mus musculus
ccccaaacactctggtggagatact

SEQ ID NO: 345250 - DNA, 25 bp, Mus musculus
ccccaaacacttagtgcacgattta

SEQ ID NO: 345251 - DNA, 25 bp, Mus musculus
ccccaaacactttgtgcacgattta

SEQ ID NO: 345252 - DNA, 25 bp, Mus musculus
ccccaaacgtggatgagaggctgca

SEQ ID NO: 345253 - DNA, 25 bp, Mus musculus
ccccaaacgtggttgagaggctgca

SEQ ID NO: 345254 - DNA, 25 bp, Mus musculus
ccccaaactagacgacaaagacaag

SEQ ID NO: 345255 - DNA, 25 bp, Mus musculus
ccccaaactagaggacaaagacaag

SEQ ID NO: 345256 - DNA, 25 bp, Mus musculus
ccccaaactattcttctagcttgtg

SEQ ID NO: 345257 - DNA, 25 bp, Mus musculus
ccccaaactattgttctagcttgtg

SEQ ID NO: 345258 - DNA, 25 bp, Mus musculus
ccccaaactcacaaggagctcggga

SEQ ID NO: 345259 - DNA, 25 bp, Mus musculus
ccccaaactcactaggagctcggga

SEQ ID NO: 345260 - DNA, 25 bp, Mus musculus
ccccaaagcctgacacaaaacataa

SEQ ID NO: 345261 - DNA, 25 bp, Mus musculus
ccccaaagcctgtcacaaaacataa

SEQ ID NO: 345262 - DNA, 25 bp, Mus musculus
ccccaaagggtaagtatcaggtaag

SEQ ID NO: 345263 - DNA, 25 bp, Mus musculus
ccccaaagggtatgtatcaggtaag

SEQ ID NO: 345264 - DNA, 25 bp, Mus musculus
ccccaaagtaccagtaaagtcattg

SEQ ID NO: 345265 - DNA, 25 bp, Mus musculus
ccccaaagtacctgtaaagtcattg

SEQ ID NO: 345266 - DNA, 25 bp, Mus musculus
ccccaaagttgaaacatgaggctga

SEQ ID NO: 345267 - DNA, 25 bp, Mus musculus
ccccaaagttgatacatgaggctga

SEQ ID NO: 345268 - DNA, 25 bp, Mus musculus
ccccaaatctgccatcgttggatta

SEQ ID NO: 345269 - DNA, 25 bp, Mus musculus
ccccaaatctgcgatcgttggatta

SEQ ID NO: 345270 - DNA, 25 bp, Mus musculus
ccccaaatggaacgactcaagctac

SEQ ID NO: 345271 - DNA, 25 bp, Mus musculus
ccccaaatggaaggactcaagctac

SEQ ID NO: 345272 - DNA, 25 bp, Mus musculus
ccccaaatttctctcagtgattcct

SEQ ID NO: 345273 - DNA, 25 bp, Mus musculus
ccccaaatttctgtcagtgattcct

SEQ ID NO: 345274 - DNA, 25 bp, Mus musculus
ccccaaatttgcatctgtatgtact

SEQ ID NO: 345275 - DNA, 25 bp, Mus musculus
ccccaaatttgcttctgtatgtact

SEQ ID NO: 345276 - DNA, 25 bp, Mus musculus
ccccaaatttggagaggtgctcaga

SEQ ID NO: 345277 - DNA, 25 bp, Mus musculus
ccccaaatttggtgaggtgctcaga

SEQ ID NO: 345278 - DNA, 25 bp, Mus musculus
ccccaacaagctattcatctgagtg

SEQ ID NO: 345279 - DNA, 25 bp, Mus musculus
ccccaacaagcttttcatctgagtg

SEQ ID NO: 345280 - DNA, 25 bp, Mus musculus
ccccaaccatgtattttgtgtgtca

SEQ ID NO: 345281 - DNA, 25 bp, Mus musculus
ccccaaccatgttttttgtgtgtca

SEQ ID NO: 345282 - DNA, 25 bp, Mus musculus
ccccaaccggataagtgcattcaag

SEQ ID NO: 345283 - DNA, 25 bp, Mus musculus
ccccaaccggattagtgcattcaag

SEQ ID NO: 345284 - DNA, 25 bp, Mus musculus
ccccaacgtgttacagctctataag

SEQ ID NO: 345285 - DNA, 25 bp, Mus musculus
ccccaacgtgtttcagctctataag

SEQ ID NO: 345286 - DNA, 25 bp, Mus musculus
ccccaactaagcaatgagacctcta

SEQ ID NO: 345287 - DNA, 25 bp, Mus musculus
ccccaactaagctatgagacctcta

SEQ ID NO: 345288 - DNA, 25 bp, Mus musculus
ccccaactcaggcttaatgaagtgg

SEQ ID NO: 345289 - DNA, 25 bp, Mus musculus
ccccaactcagggttaatgaagtgg

SEQ ID NO: 345290 - DNA, 25 bp, Mus musculus
ccccaactggtgaagaggatacatc

SEQ ID NO: 345291 - DNA, 25 bp, Mus musculus
ccccaactggtgtagaggatacatc

SEQ ID NO: 345292 - DNA, 25 bp, Mus musculus
ccccaacttcaccatggcttgggag

SEQ ID NO: 345293 - DNA, 25 bp, Mus musculus
ccccaacttcacgatggcttgggag

SEQ ID NO: 345294 - DNA, 25 bp, Mus musculus
ccccaagaagccagtcgtatgttac

SEQ ID NO: 345295 - DNA, 25 bp, Mus musculus
ccccaagaagcctgtcgtatgttac

SEQ ID NO: 345296 - DNA, 25 bp, Mus musculus
ccccaagaatataaggccaatgcaa

SEQ ID NO: 345297 - DNA, 25 bp, Mus musculus
ccccaagaatattaggccaatgcaa

SEQ ID NO: 345298 - DNA, 25 bp, Mus musculus
ccccaagacactcagacggaatgtt

SEQ ID NO: 345299 - DNA, 25 bp, Mus musculus
ccccaagacactgagacggaatgtt

SEQ ID NO: 345300 - DNA, 25 bp, Mus musculus
ccccaagactttaattcggtatatg

SEQ ID NO: 345301 - DNA, 25 bp, Mus musculus
ccccaagacttttattcggtatatg

SEQ ID NO: 345302 - DNA, 25 bp, Mus musculus
ccccaagcaggtcgtgctagagctt

SEQ ID NO: 345303 - DNA, 25 bp, Mus musculus
ccccaagcaggtggtgctagagctt

SEQ ID NO: 345304 - DNA, 25 bp, Mus musculus
ccccaagcctccatgatgaagagat

SEQ ID NO: 345305 - DNA, 25 bp, Mus musculus
ccccaagcctccttgatgaagagat

SEQ ID NO: 345306 - DNA, 25 bp, Mus musculus
ccccaaggaatgagttcgtgccttt

SEQ ID NO: 345307 - DNA, 25 bp, Mus musculus
ccccaaggaatgtgttcgtgccttt

SEQ ID NO: 345308 - DNA, 25 bp, Mus musculus
ccccaaggagaaaccccagcaggga

SEQ ID NO: 345309 - DNA, 25 bp, Mus musculus
ccccaaggagaatccccagcaggga

SEQ ID NO: 345310 - DNA, 25 bp, Mus musculus
ccccaagggtggcttctgtaactag

SEQ ID NO: 345311 - DNA, 25 bp, Mus musculus
ccccaagggtgggttctgtaactag

SEQ ID NO: 345312 - DNA, 25 bp, Mus musculus
ccccaaggttctaagctgactttca

SEQ ID NO: 345313 - DNA, 25 bp, Mus musculus
ccccaaggttcttagctgactttca

SEQ ID NO: 345314 - DNA, 25 bp, Mus musculus
ccccaagtaatcaagctccagaaag

SEQ ID NO: 345315 - DNA, 25 bp, Mus musculus
ccccaagtaatctagctccagaaag

SEQ ID NO: 345316 - DNA, 25 bp, Mus musculus
ccccaagtacaaatgctccttttgt

SEQ ID NO: 345317 - DNA, 25 bp, Mus musculus
ccccaagtacaattgctccttttgt

SEQ ID NO: 345318 - DNA, 25 bp, Mus musculus
ccccaagtctctccggagcaattgg

SEQ ID NO: 345319 - DNA, 25 bp, Mus musculus
ccccaagtctctgcggagcaattgg

SEQ ID NO: 345320 - DNA, 25 bp, Mus musculus
ccccaagtctggcttacggatgttg

SEQ ID NO: 345321 - DNA, 25 bp, Mus musculus
ccccaagtctgggttacggatgttg

SEQ ID NO: 345322 - DNA, 25 bp, Mus musculus
ccccaagtcttcatcgtggaatcaa

SEQ ID NO: 345323 - DNA, 25 bp, Mus musculus
ccccaagtcttcttcgtggaatcaa

SEQ ID NO: 345324 - DNA, 25 bp, Mus musculus
ccccaagtggccagtttggagccgc

SEQ ID NO: 345325 - DNA, 25 bp, Mus musculus
ccccaagtggcctgtttggagccgc

SEQ ID NO: 345326 - DNA, 25 bp, Mus musculus
ccccaagttcatatagatattctct

SEQ ID NO: 345327 - DNA, 25 bp, Mus musculus
ccccaagttcatttagatattctct

SEQ ID NO: 345328 - DNA, 25 bp, Mus musculus
ccccaataaaggcagttgggcagtt

SEQ ID NO: 345329 - DNA, 25 bp, Mus musculus
ccccaataaagggagttgggcagtt

SEQ ID NO: 345330 - DNA, 25 bp, Mus musculus
ccccaatatcctcaacttgagcggg

SEQ ID NO: 345331 - DNA, 25 bp, Mus musculus
ccccaatatcctgaacttgagcggg

SEQ ID NO: 345332 - DNA, 25 bp, Mus musculus
ccccaatattggaggctagtgatga

SEQ ID NO: 345333 - DNA, 25 bp, Mus musculus
ccccaatattggtggctagtgatga

SEQ ID NO: 345334 - DNA, 25 bp, Mus musculus
ccccaatatttaaacagaggtggct

SEQ ID NO: 345335 - DNA, 25 bp, Mus musculus
ccccaatatttatacagaggtggct

SEQ ID NO: 345336 - DNA, 25 bp, Mus musculus
ccccaatcccagatcatcagttttg

SEQ ID NO: 345337 - DNA, 25 bp, Mus musculus
ccccaatcccagttcatcagttttg

SEQ ID NO: 345338 - DNA, 25 bp, Mus musculus
ccccaatgtgctacaacgttgacaa

SEQ ID NO: 345339 - DNA, 25 bp, Mus musculus
ccccaatgtgcttcaacgttgacaa

SEQ ID NO: 345340 - DNA, 25 bp, Mus musculus
ccccaattaacgatgtgctttcttg

SEQ ID NO: 345341 - DNA, 25 bp, Mus musculus
ccccaattaacgttgtgctttcttg

SEQ ID NO: 345342 - DNA, 25 bp, Mus musculus
ccccaattactacagacctcctgga

SEQ ID NO: 345343 - DNA, 25 bp, Mus musculus
ccccaattactagagacctcctgga

SEQ ID NO: 345344 - DNA, 25 bp, Mus musculus
ccccaattacttcagttctcctaga

SEQ ID NO: 345345 - DNA, 25 bp, Mus musculus
ccccaattacttgagttctcctaga

SEQ ID NO: 345346 - DNA, 25 bp, Mus musculus
ccccaattagagcatgagcgataga

SEQ ID NO: 345347 - DNA, 25 bp, Mus musculus
ccccaattagaggatgagcgataga

SEQ ID NO: 345348 - DNA, 25 bp, Mus musculus
ccccaattataaatcatggaccctg

SEQ ID NO: 345349 - DNA, 25 bp, Mus musculus
ccccaattataattcatggaccctg

SEQ ID NO: 345350 - DNA, 25 bp, Mus musculus
ccccaattctgtcaaggcaggagtt

SEQ ID NO: 345351 - DNA, 25 bp, Mus musculus
ccccaattctgtgaaggcaggagtt

SEQ ID NO: 345352 - DNA, 25 bp, Mus musculus
ccccaatttcttcagctgagtattt

SEQ ID NO: 345353 - DNA, 25 bp, Mus musculus
ccccaatttcttgagctgagtattt

SEQ ID NO: 345354 - DNA, 25 bp, Mus musculus
ccccaatttttgctagtgtgtccac

SEQ ID NO: 345355 - DNA, 25 bp, Mus musculus
ccccaatttttggtagtgtgtccac

SEQ ID NO: 345356 - DNA, 25 bp, Mus musculus
ccccacaacaggacagagcatctaa

SEQ ID NO: 345357 - DNA, 25 bp, Mus musculus
ccccacaacaggtcagagcatctaa

SEQ ID NO: 345358 - DNA, 25 bp, Mus musculus
ccccacaagtgtagtcgtcattcaa

SEQ ID NO: 345359 - DNA, 25 bp, Mus musculus
ccccacaagtgttgtcgtcattcaa

SEQ ID NO: 345360 - DNA, 25 bp, Mus musculus
ccccacaatgggacgaggctgaata

SEQ ID NO: 345361 - DNA, 25 bp, Mus musculus
ccccacaatgggtcgaggctgaata

SEQ ID NO: 345362 - DNA, 25 bp, Mus musculus
ccccacaatgtcagaatcttccaat

SEQ ID NO: 345363 - DNA, 25 bp, Mus musculus
ccccacaatgtctgaatcttccaat

SEQ ID NO: 345364 - DNA, 25 bp, Mus musculus
ccccacacaagtaggcttagagcca

SEQ ID NO: 345365 - DNA, 25 bp, Mus musculus
ccccacacaagttggcttagagcca

SEQ ID NO: 345366 - DNA, 25 bp, Mus musculus
ccccacacatgcactgtaacatatg

SEQ ID NO: 345367 - DNA, 25 bp, Mus musculus
ccccacacatgctctgtaacatatg

SEQ ID NO: 345368 - DNA, 25 bp, Mus musculus
ccccacaccaggcttattaaagagt

SEQ ID NO: 345369 - DNA, 25 bp, Mus musculus
ccccacaccagggttattaaagagt

SEQ ID NO: 345370 - DNA, 25 bp, Mus musculus
ccccacagaggtcacgagagcactg

SEQ ID NO: 345371 - DNA, 25 bp, Mus musculus
ccccacagaggtgacgagagcactg

SEQ ID NO: 345372 - DNA, 25 bp, Mus musculus
ccccacagctcaaacaaggctggaa

SEQ ID NO: 345373 - DNA, 25 bp, Mus musculus
ccccacagctcatacaaggctggaa

SEQ ID NO: 345374 - DNA, 25 bp, Mus musculus
ccccacaggtcaatcttttgagttt

SEQ ID NO: 345375 - DNA, 25 bp, Mus musculus
ccccacaggtcattcttttgagttt

SEQ ID NO: 345376 - DNA, 25 bp, Mus musculus
ccccacatcaggcactgttcaggag

SEQ ID NO: 345377 - DNA, 25 bp, Mus musculus
ccccacatcagggactgttcaggag

SEQ ID NO: 345378 - DNA, 25 bp, Mus musculus
ccccacatgattatgttttccccat

SEQ ID NO: 345379 - DNA, 25 bp, Mus musculus
ccccacatgattttgttttccccat

SEQ ID NO: 345380 - DNA, 25 bp, Mus musculus
ccccacatgtgaatgctggtcacta

SEQ ID NO: 345381 - DNA, 25 bp, Mus musculus
ccccacatgtgattgctggtcacta

SEQ ID NO: 345382 - DNA, 25 bp, Mus musculus
ccccacatgtggacatgacctctgt

SEQ ID NO: 345383 - DNA, 25 bp, Mus musculus
ccccacatgtggtcatgacctctgt

SEQ ID NO: 345384 - DNA, 25 bp, Mus musculus
ccccacattgctcacgtaagtgttt

SEQ ID NO: 345385 - DNA, 25 bp, Mus musculus
ccccacattgctgacgtaagtgttt

SEQ ID NO: 345386 - DNA, 25 bp, Mus musculus
ccccacattgttatcattccagata

SEQ ID NO: 345387 - DNA, 25 bp, Mus musculus
ccccacattgttttcattccagata

SEQ ID NO: 345388 - DNA, 25 bp, Mus musculus
ccccacatttgtaagctataaagac

SEQ ID NO: 345389 - DNA, 25 bp, Mus musculus
ccccacatttgttagctataaagac

SEQ ID NO: 345390 - DNA, 25 bp, Mus musculus
ccccaccacctactgattttgatgt

SEQ ID NO: 345391 - DNA, 25 bp, Mus musculus
ccccaccacctagtgattttgatgt

SEQ ID NO: 345392 - DNA, 25 bp, Mus musculus
ccccaccaggttatggaccagatga

SEQ ID NO: 345393 - DNA, 25 bp, Mus musculus
ccccaccaggttttggaccagatga

SEQ ID NO: 345394 - DNA, 25 bp, Mus musculus
ccccacccactgaacatttgtaaat

SEQ ID NO: 345395 - DNA, 25 bp, Mus musculus
ccccacccactgtacatttgtaaat

SEQ ID NO: 345396 - DNA, 25 bp, Mus musculus
ccccaccccactaagtatggaggat

SEQ ID NO: 345397 - DNA, 25 bp, Mus musculus
ccccaccccacttagtatggaggat

SEQ ID NO: 345398 - DNA, 25 bp, Mus musculus
ccccacccctgtactatgagggtgt

SEQ ID NO: 345399 - DNA, 25 bp, Mus musculus
ccccacccctgttctatgagggtgt

SEQ ID NO: 345400 - DNA, 25 bp, Mus musculus
ccccaccctaacagagttgatgaac

SEQ ID NO: 345401 - DNA, 25 bp, Mus musculus
ccccaccctaactgagttgatgaac

SEQ ID NO: 345402 - DNA, 25 bp, Mus musculus
ccccaccctcagctagaggtaggag

SEQ ID NO: 345403 - DNA, 25 bp, Mus musculus
ccccaccctcaggtagaggtaggag

SEQ ID NO: 345404 - DNA, 25 bp, Mus musculus
ccccaccgggctacgatgacatgta

SEQ ID NO: 345405 - DNA, 25 bp, Mus musculus
ccccaccgggcttcgatgacatgta

SEQ ID NO: 345406 - DNA, 25 bp, Mus musculus
ccccacctaagcagatctcatattg

SEQ ID NO: 345407 - DNA, 25 bp, Mus musculus
ccccacctaagctgatctcatattg

SEQ ID NO: 345408 - DNA, 25 bp, Mus musculus
ccccacctatctatggtacatggta

SEQ ID NO: 345409 - DNA, 25 bp, Mus musculus
ccccacctatctttggtacatggta

SEQ ID NO: 345410 - DNA, 25 bp, Mus musculus
ccccacctctgtatacatgtaacaa

SEQ ID NO: 345411 - DNA, 25 bp, Mus musculus
ccccacctctgtatcatgcagttaa

SEQ ID NO: 345412 - DNA, 25 bp, Mus musculus
ccccacctctgtttacatgtaacaa

SEQ ID NO: 345413 - DNA, 25 bp, Mus musculus
ccccacctctgtttcatgcagttaa

SEQ ID NO: 345414 - DNA, 25 bp, Mus musculus
ccccacctgtgtcgctaggaaggga

SEQ ID NO: 345415 - DNA, 25 bp, Mus musculus
ccccacctgtgtggctaggaaggga

SEQ ID NO: 345416 - DNA, 25 bp, Mus musculus
ccccaccttgtgaatagcttttgac

SEQ ID NO: 345417 - DNA, 25 bp, Mus musculus
ccccaccttgtgtatagcttttgac

SEQ ID NO: 345418 - DNA, 25 bp, Mus musculus
ccccacgaggtcacagatgttgaga

SEQ ID NO: 345419 - DNA, 25 bp, Mus musculus
ccccacgaggtctcagatgttgaga

SEQ ID NO: 345420 - DNA, 25 bp, Mus musculus
ccccacgagtccatgttgatactga

SEQ ID NO: 345421 - DNA, 25 bp, Mus musculus
ccccacgagtccttgttgatactga

SEQ ID NO: 345422 - DNA, 25 bp, Mus musculus
ccccacgatgccactggagagatgg

SEQ ID NO: 345423 - DNA, 25 bp, Mus musculus
ccccacgatgcctctggagagatgg

SEQ ID NO: 345424 - DNA, 25 bp, Mus musculus
ccccacgcaactaatccaataaaag

SEQ ID NO: 345425 - DNA, 25 bp, Mus musculus
ccccacgcaacttatccaataaaag

SEQ ID NO: 345426 - DNA, 25 bp, Mus musculus
ccccacgcttgaccaggcattggaa

SEQ ID NO: 345427 - DNA, 25 bp, Mus musculus
ccccacgcttgagcaggcattggaa

SEQ ID NO: 345428 - DNA, 25 bp, Mus musculus
ccccacggagctacatatcaatttt

SEQ ID NO: 345429 - DNA, 25 bp, Mus musculus
ccccacggagcttcatatcaatttt

SEQ ID NO: 345430 - DNA, 25 bp, Mus musculus
ccccacgtaactctctatattagac

SEQ ID NO: 345431 - DNA, 25 bp, Mus musculus
ccccacgtaactgtctatattagac

SEQ ID NO: 345432 - DNA, 25 bp, Mus musculus
ccccacgtctttcattgttattctt

SEQ ID NO: 345433 - DNA, 25 bp, Mus musculus
ccccacgtctttgattgttattctt

SEQ ID NO: 345434 - DNA, 25 bp, Mus musculus
ccccactaaaatcatcattttgggc

SEQ ID NO: 345435 - DNA, 25 bp, Mus musculus
ccccactaaaatgatcattttgggc

SEQ ID NO: 345436 - DNA, 25 bp, Mus musculus
ccccactacctccaggaaatgaaga

SEQ ID NO: 345437 - DNA, 25 bp, Mus musculus
ccccactacctcgaggaaatgaaga

SEQ ID NO: 345438 - DNA, 25 bp, Mus musculus
ccccactactacaactaataaaatg

SEQ ID NO: 345439 - DNA, 25 bp, Mus musculus
ccccactactactactaataaaatg

SEQ ID NO: 345440 - DNA, 25 bp, Mus musculus
ccccactagctgaacagacctgagg

SEQ ID NO: 345441 - DNA, 25 bp, Mus musculus
ccccactagctgtacagacctgagg

SEQ ID NO: 345442 - DNA, 25 bp, Mus musculus
ccccactcaagtacacgaggatata

SEQ ID NO: 345443 - DNA, 25 bp, Mus musculus
ccccactcaagttcacgaggatata

SEQ ID NO: 345444 - DNA, 25 bp, Mus musculus
ccccactcagttcttgaaggtacac

SEQ ID NO: 345445 - DNA, 25 bp, Mus musculus
ccccactcagttgttgaaggtacac

SEQ ID NO: 345446 - DNA, 25 bp, Mus musculus
ccccactgacgtaagacggaatcaa

SEQ ID NO: 345447 - DNA, 25 bp, Mus musculus
ccccactgacgttagacggaatcaa

SEQ ID NO: 345448 - DNA, 25 bp, Mus musculus
ccccactgagataccgctgtttgga

SEQ ID NO: 345449 - DNA, 25 bp, Mus musculus
ccccactgagattccgctgtttgga

SEQ ID NO: 345450 - DNA, 25 bp, Mus musculus
ccccactgagggatgagattatctt

SEQ ID NO: 345451 - DNA, 25 bp, Mus musculus
ccccactgagggttgagattatctt

SEQ ID NO: 345452 - DNA, 25 bp, Mus musculus
ccccactgatcaagttcgtttgtat

SEQ ID NO: 345453 - DNA, 25 bp, Mus musculus
ccccactgatcatgttcgtttgtat

SEQ ID NO: 345454 - DNA, 25 bp, Mus musculus
ccccactgcgtactgtgtttttaat

SEQ ID NO: 345455 - DNA, 25 bp, Mus musculus
ccccactgcgtagtgtgtttttaat

SEQ ID NO: 345456 - DNA, 25 bp, Mus musculus
ccccactggaggatgtttttgtgat

SEQ ID NO: 345457 - DNA, 25 bp, Mus musculus
ccccactggaggttgtttttgtgat

SEQ ID NO: 345458 - DNA, 25 bp, Mus musculus
ccccactggatgagtgtatatgcaa

SEQ ID NO: 345459 - DNA, 25 bp, Mus musculus
ccccactggatgtgtgtatatgcaa

SEQ ID NO: 345460 - DNA, 25 bp, Mus musculus
ccccactgtctgagttcaagcgagg

SEQ ID NO: 345461 - DNA, 25 bp, Mus musculus
ccccactgtctgtgttcaagcgagg

SEQ ID NO: 345462 - DNA, 25 bp, Mus musculus
ccccactgtgatatctagttattct

SEQ ID NO: 345463 - DNA, 25 bp, Mus musculus
ccccactgtgatttctagttattct

SEQ ID NO: 345464 - DNA, 25 bp, Mus musculus
ccccactgtgttaatatttatttat

SEQ ID NO: 345465 - DNA, 25 bp, Mus musculus
ccccactgtgtttatatttatttat

SEQ ID NO: 345466 - DNA, 25 bp, Mus musculus
ccccacttaacaacccattgaatgt

SEQ ID NO: 345467 - DNA, 25 bp, Mus musculus
ccccacttaacatcccattgaatgt

SEQ ID NO: 345468 - DNA, 25 bp, Mus musculus
ccccacttagtcagctgaggcaaga

SEQ ID NO: 345469 - DNA, 25 bp, Mus musculus
ccccacttagtctgctgaggcaaga

SEQ ID NO: 345470 - DNA, 25 bp, Mus musculus
ccccacttatatcactggaatattg

SEQ ID NO: 345471 - DNA, 25 bp, Mus musculus
ccccacttatatgactggaatattg

SEQ ID NO: 345472 - DNA, 25 bp, Mus musculus
ccccacttcctgacaaatctgattt

SEQ ID NO: 345473 - DNA, 25 bp, Mus musculus
ccccacttcctgtcaaatctgattt

SEQ ID NO: 345474 - DNA, 25 bp, Mus musculus
ccccacttcggactcgtgaatgtct

SEQ ID NO: 345475 - DNA, 25 bp, Mus musculus
ccccacttcggagtcgtgaatgtct

SEQ ID NO: 345476 - DNA, 25 bp, Mus musculus
ccccacttctgaatgcagtttctaa

SEQ ID NO: 345477 - DNA, 25 bp, Mus musculus
ccccacttctgattgcagtttctaa

SEQ ID NO: 345478 - DNA, 25 bp, Mus musculus
ccccacttctgtcactaggtgcaga

SEQ ID NO: 345479 - DNA, 25 bp, Mus musculus
ccccacttctgtgactaggtgcaga

SEQ ID NO: 345480 - DNA, 25 bp, Mus musculus
ccccactttatcatgacgggatgga

SEQ ID NO: 345481 - DNA, 25 bp, Mus musculus
ccccactttatcttgacgggatgga

SEQ ID NO: 345482 - DNA, 25 bp, Mus musculus
ccccactttccaaatgatttgtttt

SEQ ID NO: 345483 - DNA, 25 bp, Mus musculus
ccccactttccatatgatttgtttt

SEQ ID NO: 345484 - DNA, 25 bp, Mus musculus
ccccactttggaaacctagtcagga

SEQ ID NO: 345485 - DNA, 25 bp, Mus musculus
ccccactttggatacctagtcagga

SEQ ID NO: 345486 - DNA, 25 bp, Mus musculus
ccccacttttgactgtaacatgttg

SEQ ID NO: 345487 - DNA, 25 bp, Mus musculus
ccccacttttgagtgtaacatgttg

SEQ ID NO: 345488 - DNA, 25 bp, Mus musculus
ccccagaaagccaacagaataagaa

SEQ ID NO: 345489 - DNA, 25 bp, Mus musculus
ccccagaaagcctacagaataagaa

SEQ ID NO: 345490 - DNA, 25 bp, Mus musculus
ccccagaactgtctggtcagaggtg

SEQ ID NO: 345491 - DNA, 25 bp, Mus musculus
ccccagaactgtgtggtcagaggtg

SEQ ID NO: 345492 - DNA, 25 bp, Mus musculus
ccccagaaggcaccttggtcagaag

SEQ ID NO: 345493 - DNA, 25 bp, Mus musculus
ccccagaaggcagcttggtcagaag

SEQ ID NO: 345494 - DNA, 25 bp, Mus musculus
ccccagaagtagataccaaagatgg

SEQ ID NO: 345495 - DNA, 25 bp, Mus musculus
ccccagaagtagttaccaaagatgg

SEQ ID NO: 345496 - DNA, 25 bp, Mus musculus
ccccagaagtgcagtctttcaggga

SEQ ID NO: 345497 - DNA, 25 bp, Mus musculus
ccccagaagtgctgtctttcaggga

SEQ ID NO: 345498 - DNA, 25 bp, Mus musculus
ccccagacagtgacaggcttgttta

SEQ ID NO: 345499 - DNA, 25 bp, Mus musculus
ccccagacagtgtcaggcttgttta

SEQ ID NO: 345500 - DNA, 25 bp, Mus musculus
ccccagacatggagctaaaggattg

SEQ ID NO: 345501 - DNA, 25 bp, Mus musculus
ccccagacatggtgctaaaggattg

SEQ ID NO: 345502 - DNA, 25 bp, Mus musculus
ccccagaccaggattgccatcagga

SEQ ID NO: 345503 - DNA, 25 bp, Mus musculus
ccccagaccaggtttgccatcagga

SEQ ID NO: 345504 - DNA, 25 bp, Mus musculus
ccccagactagacatgaacctacta

SEQ ID NO: 345505 - DNA, 25 bp, Mus musculus
ccccagactagagatgaacctacta

SEQ ID NO: 345506 - DNA, 25 bp, Mus musculus
ccccagactgcaatactgactgaag

SEQ ID NO: 345507 - DNA, 25 bp, Mus musculus
ccccagactgcattactgactgaag

SEQ ID NO: 345508 - DNA, 25 bp, Mus musculus
ccccagacttgccatttgaatacca

SEQ ID NO: 345509 - DNA, 25 bp, Mus musculus
ccccagacttgcgatttgaatacca

SEQ ID NO: 345510 - DNA, 25 bp, Mus musculus
ccccagagaagccactgagtgacct

SEQ ID NO: 345511 - DNA, 25 bp, Mus musculus
ccccagagaagcgactgagtgacct

SEQ ID NO: 345512 - DNA, 25 bp, Mus musculus
ccccagaggagacagtgttgatgtt

SEQ ID NO: 345513 - DNA, 25 bp, Mus musculus
ccccagaggagagagtgttgatgtt

SEQ ID NO: 345514 - DNA, 25 bp, Mus musculus
ccccagaggcacaggcattgtctct

SEQ ID NO: 345515 - DNA, 25 bp, Mus musculus
ccccagaggcactggcattgtctct

SEQ ID NO: 345516 - DNA, 25 bp, Mus musculus
ccccagaggcagattggaactcggt

SEQ ID NO: 345517 - DNA, 25 bp, Mus musculus
ccccagaggcagtttggaactcggt

SEQ ID NO: 345518 - DNA, 25 bp, Mus musculus
ccccagaggtttacatctgttaaag

SEQ ID NO: 345519 - DNA, 25 bp, Mus musculus
ccccagaggttttcatctgttaaag

SEQ ID NO: 345520 - DNA, 25 bp, Mus musculus
ccccagagtttaaggctcctgagat

SEQ ID NO: 345521 - DNA, 25 bp, Mus musculus
ccccagagtttatggctcctgagat

SEQ ID NO: 345522 - DNA, 25 bp, Mus musculus
ccccagatccttattctaatatgaa

SEQ ID NO: 345523 - DNA, 25 bp, Mus musculus
ccccagatcctttttctaatatgaa

SEQ ID NO: 345524 - DNA, 25 bp, Mus musculus
ccccagatctgaaggtaaagtaact

SEQ ID NO: 345525 - DNA, 25 bp, Mus musculus
ccccagatctgatggtaaagtaact

SEQ ID NO: 345526 - DNA, 25 bp, Mus musculus
ccccagatcttgcaggagtccaggt

SEQ ID NO: 345527 - DNA, 25 bp, Mus musculus
ccccagatcttggaggagtccaggt

SEQ ID NO: 345528 - DNA, 25 bp, Mus musculus
ccccagatgggtcgtcagcaatgag

SEQ ID NO: 345529 - DNA, 25 bp, Mus musculus
ccccagatgggtggtcagcaatgag

SEQ ID NO: 345530 - DNA, 25 bp, Mus musculus
ccccagattacgaggagattcacaa

SEQ ID NO: 345531 - DNA, 25 bp, Mus musculus
ccccagattacgtggagattcacaa

SEQ ID NO: 345532 - DNA, 25 bp, Mus musculus
ccccagcaaggacactgagcaagag

SEQ ID NO: 345533 - DNA, 25 bp, Mus musculus
ccccagcaaggagactgagcaagag

SEQ ID NO: 345534 - DNA, 25 bp, Mus musculus
ccccagcagcgtaaaggatggctag

SEQ ID NO: 345535 - DNA, 25 bp, Mus musculus
ccccagcagcgttaaggatggctag

SEQ ID NO: 345536 - DNA, 25 bp, Mus musculus
ccccagcagggcaccgtgtgtgtga

SEQ ID NO: 345537 - DNA, 25 bp, Mus musculus
ccccagcagggctccgtgtgtgtga

SEQ ID NO: 345538 - DNA, 25 bp, Mus musculus
ccccagcattccaatacaaatcttg

SEQ ID NO: 345539 - DNA, 25 bp, Mus musculus
ccccagcattcctatacaaatcttg

SEQ ID NO: 345540 - DNA, 25 bp, Mus musculus
ccccagcatttcaaaggaagggtag

SEQ ID NO: 345541 - DNA, 25 bp, Mus musculus
ccccagcatttctaaggaagggtag

SEQ ID NO: 345542 - DNA, 25 bp, Mus musculus
ccccagccacatcgaagctgtatgt

SEQ ID NO: 345543 - DNA, 25 bp, Mus musculus
ccccagccacatggaagctgtatgt

SEQ ID NO: 345544 - DNA, 25 bp, Mus musculus
ccccagccatgaaagaagccgtaaa

SEQ ID NO: 345545 - DNA, 25 bp, Mus musculus
ccccagccatgatagaagccgtaaa

SEQ ID NO: 345546 - DNA, 25 bp, Mus musculus
ccccagcccataatgctttcatata

SEQ ID NO: 345547 - DNA, 25 bp, Mus musculus
ccccagcccatattgctttcatata

SEQ ID NO: 345548 - DNA, 25 bp, Mus musculus
ccccagcccttccaggtgaagagta

SEQ ID NO: 345549 - DNA, 25 bp, Mus musculus
ccccagcccttcgaggtgaagagta

SEQ ID NO: 345550 - DNA, 25 bp, Mus musculus
ccccagccgaggagtttttcttgat

SEQ ID NO: 345551 - DNA, 25 bp, Mus musculus
ccccagccgaggtgtttttcttgat

SEQ ID NO: 345552 - DNA, 25 bp, Mus musculus
ccccagcctaagatattcaatgcca

SEQ ID NO: 345553 - DNA, 25 bp, Mus musculus
ccccagcctaagttattcaatgcca

SEQ ID NO: 345554 - DNA, 25 bp, Mus musculus
ccccagcctataactcagcattatt

SEQ ID NO: 345555 - DNA, 25 bp, Mus musculus
ccccagcctatatctcagcattatt

SEQ ID NO: 345556 - DNA, 25 bp, Mus musculus
ccccagcctgggacagagacagaat

SEQ ID NO: 345557 - DNA, 25 bp, Mus musculus
ccccagcctgggtcagagacagaat

SEQ ID NO: 345558 - DNA, 25 bp, Mus musculus
ccccagcctggtattgagctaagac

SEQ ID NO: 345559 - DNA, 25 bp, Mus musculus
ccccagcctggttttgagctaagac

SEQ ID NO: 345560 - DNA, 25 bp, Mus musculus
ccccagccttaccttaagagttcag

SEQ ID NO: 345561 - DNA, 25 bp, Mus musculus
ccccagccttacgttaagagttcag

SEQ ID NO: 345562 - DNA, 25 bp, Mus musculus
ccccagccttggatgtagtgaccgg

SEQ ID NO: 345563 - DNA, 25 bp, Mus musculus
ccccagccttggttgtagtgaccgg

SEQ ID NO: 345564 - DNA, 25 bp, Mus musculus
ccccagccttgtcaagcagaagaga

SEQ ID NO: 345565 - DNA, 25 bp, Mus musculus
ccccagccttgtgaagcagaagaga

SEQ ID NO: 345566 - DNA, 25 bp, Mus musculus
ccccagcgcctacggaagagctaga

SEQ ID NO: 345567 - DNA, 25 bp, Mus musculus
ccccagcgcctagggaagagctaga

SEQ ID NO: 345568 - DNA, 25 bp, Mus musculus
ccccagcgtgtcacatgtatataaa

SEQ ID NO: 345569 - DNA, 25 bp, Mus musculus
ccccagcgtgtctcatgtatataaa

SEQ ID NO: 345570 - DNA, 25 bp, Mus musculus
ccccagctattgagcagttggaaga

SEQ ID NO: 345571 - DNA, 25 bp, Mus musculus
ccccagctattgtgcagttggaaga

SEQ ID NO: 345572 - DNA, 25 bp, Mus musculus
ccccagctccaactattaattgaaa

SEQ ID NO: 345573 - DNA, 25 bp, Mus musculus
ccccagctccaagtattaattgaaa

SEQ ID NO: 345574 - DNA, 25 bp, Mus musculus
ccccagctgaaacgctctgaatgtc

SEQ ID NO: 345575 - DNA, 25 bp, Mus musculus
ccccagctgaaaggctctgaatgtc

SEQ ID NO: 345576 - DNA, 25 bp, Mus musculus
ccccagctgaatcagtggatctaga

SEQ ID NO: 345577 - DNA, 25 bp, Mus musculus
ccccagctgaatgagtggatctaga

SEQ ID NO: 345578 - DNA, 25 bp, Mus musculus
ccccagctgccacgtgggttttggt

SEQ ID NO: 345579 - DNA, 25 bp, Mus musculus
ccccagctgccaggtgggttttggt

SEQ ID NO: 345580 - DNA, 25 bp, Mus musculus
ccccagctgtgaatagtatataccg

SEQ ID NO: 345581 - DNA, 25 bp, Mus musculus
ccccagctgtgattagtatataccg

SEQ ID NO: 345582 - DNA, 25 bp, Mus musculus
ccccagctgtgccttaaggactaat

SEQ ID NO: 345583 - DNA, 25 bp, Mus musculus
ccccagctgtgcgttaaggactaat

SEQ ID NO: 345584 - DNA, 25 bp, Mus musculus
ccccagctgtttctggcatattatt

SEQ ID NO: 345585 - DNA, 25 bp, Mus musculus
ccccagctgtttgtggcatattatt

SEQ ID NO: 345586 - DNA, 25 bp, Mus musculus
ccccagcttcggctctagaaggagg

SEQ ID NO: 345587 - DNA, 25 bp, Mus musculus
ccccagcttcgggtctagaaggagg

SEQ ID NO: 345588 - DNA, 25 bp, Mus musculus
ccccagctttaacaacacacatggt

SEQ ID NO: 345589 - DNA, 25 bp, Mus musculus
ccccagctttaagaacacacatggt

SEQ ID NO: 345590 - DNA, 25 bp, Mus musculus
ccccagctttgtctgatccaagaag

SEQ ID NO: 345591 - DNA, 25 bp, Mus musculus
ccccagctttgtgtgatccaagaag

SEQ ID NO: 345592 - DNA, 25 bp, Mus musculus
ccccaggaaggtagcatgagagatt

SEQ ID NO: 345593 - DNA, 25 bp, Mus musculus
ccccaggaaggttgcatgagagatt

SEQ ID NO: 345594 - DNA, 25 bp, Mus musculus
ccccaggaatcacgtggcagaggag

SEQ ID NO: 345595 - DNA, 25 bp, Mus musculus
ccccaggaatcaggtggcagaggag

SEQ ID NO: 345596 - DNA, 25 bp, Mus musculus
ccccaggacactatcttgtgtgtgt

SEQ ID NO: 345597 - DNA, 25 bp, Mus musculus
ccccaggacactttcttgtgtgtgt

SEQ ID NO: 345598 - DNA, 25 bp, Mus musculus
ccccaggacccaaggttttgacaag

SEQ ID NO: 345599 - DNA, 25 bp, Mus musculus
ccccaggacccatggttttgacaag

SEQ ID NO: 345600 - DNA, 25 bp, Mus musculus
ccccaggactcaagcagatggtatg

SEQ ID NO: 345601 - DNA, 25 bp, Mus musculus
ccccaggactcatgcagatggtatg

SEQ ID NO: 345602 - DNA, 25 bp, Mus musculus
ccccaggactgtcaaagggctcagt

SEQ ID NO: 345603 - DNA, 25 bp, Mus musculus
ccccaggactgtgaaagggctcagt

SEQ ID NO: 345604 - DNA, 25 bp, Mus musculus
ccccaggagccgagttagagaacaa

SEQ ID NO: 345605 - DNA, 25 bp, Mus musculus
ccccaggagccgtgttagagaacaa

SEQ ID NO: 345606 - DNA, 25 bp, Mus musculus
ccccaggaggatccaacatggataa

SEQ ID NO: 345607 - DNA, 25 bp, Mus musculus
ccccaggaggatgcaacatggataa

SEQ ID NO: 345608 - DNA, 25 bp, Mus musculus
ccccaggaggtgagtgttcagaagc

SEQ ID NO: 345609 - DNA, 25 bp, Mus musculus
ccccaggaggtgtgtgttcagaagc

SEQ ID NO: 345610 - DNA, 25 bp, Mus musculus
ccccaggatgttacgagtacactat

SEQ ID NO: 345611 - DNA, 25 bp, Mus musculus
ccccaggatgtttcgagtacactat

SEQ ID NO: 345612 - DNA, 25 bp, Mus musculus
ccccaggattatccacggtttaaga

SEQ ID NO: 345613 - DNA, 25 bp, Mus musculus
ccccaggattatgcacggtttaaga

SEQ ID NO: 345614 - DNA, 25 bp, Mus musculus
ccccaggcacttaggaagcaaggca

SEQ ID NO: 345615 - DNA, 25 bp, Mus musculus
ccccaggcactttggaagcaaggca

SEQ ID NO: 345616 - DNA, 25 bp, Mus musculus
ccccaggccaatccagctaattttg

SEQ ID NO: 345617 - DNA, 25 bp, Mus musculus
ccccaggccaatgcagctaattttg

SEQ ID NO: 345618 - DNA, 25 bp, Mus musculus
ccccaggccagcaatgtattccggg

SEQ ID NO: 345619 - DNA, 25 bp, Mus musculus
ccccaggccagctatgtattccggg

SEQ ID NO: 345620 - DNA, 25 bp, Mus musculus
ccccaggccgaacctgtcaaagaag

SEQ ID NO: 345621 - DNA, 25 bp, Mus musculus
ccccaggccgaagctgtcaaagaag

SEQ ID NO: 345622 - DNA, 25 bp, Mus musculus
ccccaggctctgacttaaggtaaca

SEQ ID NO: 345623 - DNA, 25 bp, Mus musculus
ccccaggctctgtcttaaggtaaca

SEQ ID NO: 345624 - DNA, 25 bp, Mus musculus
ccccagggaaatctgtgtccacttg

SEQ ID NO: 345625 - DNA, 25 bp, Mus musculus
ccccagggaaatgtgtgtccacttg

SEQ ID NO: 345626 - DNA, 25 bp, Mus musculus
ccccagggaagcactggtctacggg

SEQ ID NO: 345627 - DNA, 25 bp, Mus musculus
ccccagggaagctctggtctacggg

SEQ ID NO: 345628 - DNA, 25 bp, Mus musculus
ccccagggaattacatgtagcactt

SEQ ID NO: 345629 - DNA, 25 bp, Mus musculus
ccccagggaatttcatgtagcactt

SEQ ID NO: 345630 - DNA, 25 bp, Mus musculus
ccccagggacagaccggaaggacag

SEQ ID NO: 345631 - DNA, 25 bp, Mus musculus
ccccagggacagtccggaaggacag

SEQ ID NO: 345632 - DNA, 25 bp, Mus musculus
ccccagggaccaatgtcctattact

SEQ ID NO: 345633 - DNA, 25 bp, Mus musculus
ccccagggaccattgtcctattact

SEQ ID NO: 345634 - DNA, 25 bp, Mus musculus
ccccagggactcagcattggaggga

SEQ ID NO: 345635 - DNA, 25 bp, Mus musculus
ccccagggactctgcattggaggga

SEQ ID NO: 345636 - DNA, 25 bp, Mus musculus
ccccagggagctatgaactcctttt

SEQ ID NO: 345637 - DNA, 25 bp, Mus musculus
ccccagggagctttgaactcctttt

SEQ ID NO: 345638 - DNA, 25 bp, Mus musculus
ccccagggcgtgactgtagtggact

SEQ ID NO: 345639 - DNA, 25 bp, Mus musculus
ccccagggcgtgtctgtagtggact

SEQ ID NO: 345640 - DNA, 25 bp, Mus musculus
ccccagggtaccatcacagagaatg

SEQ ID NO: 345641 - DNA, 25 bp, Mus musculus
ccccagggtaccttcacagagaatg

SEQ ID NO: 345642 - DNA, 25 bp, Mus musculus
ccccagggtcttctgagactgtgga

SEQ ID NO: 345643 - DNA, 25 bp, Mus musculus
ccccagggtcttgtgagactgtgga

SEQ ID NO: 345644 - DNA, 25 bp, Mus musculus
ccccagggtgaacatacaggcattg

SEQ ID NO: 345645 - DNA, 25 bp, Mus musculus
ccccagggtgaagatacaggcattg

SEQ ID NO: 345646 - DNA, 25 bp, Mus musculus
ccccagggtgtaaggcatgtgactc

SEQ ID NO: 345647 - DNA, 25 bp, Mus musculus
ccccagggtgtatggcatgtgactc

SEQ ID NO: 345648 - DNA, 25 bp, Mus musculus
ccccaggtagctactgtagacagac

SEQ ID NO: 345649 - DNA, 25 bp, Mus musculus
ccccaggtagcttctgtagacagac

SEQ ID NO: 345650 - DNA, 25 bp, Mus musculus
ccccaggtgcttatgatagagtgat

SEQ ID NO: 345651 - DNA, 25 bp, Mus musculus
ccccaggtgcttttgatagagtgat

SEQ ID NO: 345652 - DNA, 25 bp, Mus musculus
ccccaggtgggaatcgattgtctat

SEQ ID NO: 345653 - DNA, 25 bp, Mus musculus
ccccaggtgggattcgattgtctat

SEQ ID NO: 345654 - DNA, 25 bp, Mus musculus
ccccaggtggtgaataagatgcatc

SEQ ID NO: 345655 - DNA, 25 bp, Mus musculus
ccccaggtggtgtataagatgcatc

SEQ ID NO: 345656 - DNA, 25 bp, Mus musculus
ccccaggtggttctattcagttctc

SEQ ID NO: 345657 - DNA, 25 bp, Mus musculus
ccccaggtggttgtattcagttctc

SEQ ID NO: 345658 - DNA, 25 bp, Mus musculus
ccccaggttacacagcctttgaagg

SEQ ID NO: 345659 - DNA, 25 bp, Mus musculus
ccccaggttacagagcctttgaagg

SEQ ID NO: 345660 - DNA, 25 bp, Mus musculus
ccccaggttagacttctagtgactt

SEQ ID NO: 345661 - DNA, 25 bp, Mus musculus
ccccaggttagagttctagtgactt

SEQ ID NO: 345662 - DNA, 25 bp, Mus musculus
ccccaggttctcagtatatggttct

SEQ ID NO: 345663 - DNA, 25 bp, Mus musculus
ccccaggttctctgtatatggttct

SEQ ID NO: 345664 - DNA, 25 bp, Mus musculus
ccccaggtttgcagactgattgtca

SEQ ID NO: 345665 - DNA, 25 bp, Mus musculus
ccccaggtttgctgactgattgtca

SEQ ID NO: 345666 - DNA, 25 bp, Mus musculus
ccccagtaagtaagccgaaggctgt

SEQ ID NO: 345667 - DNA, 25 bp, Mus musculus
ccccagtaagtatgccgaaggctgt

SEQ ID NO: 345668 - DNA, 25 bp, Mus musculus
ccccagtattgtagagcaagtcttg

SEQ ID NO: 345669 - DNA, 25 bp, Mus musculus
ccccagtattgttgagcaagtcttg

SEQ ID NO: 345670 - DNA, 25 bp, Mus musculus
ccccagtcaaatctaagtcgatctg

SEQ ID NO: 345671 - DNA, 25 bp, Mus musculus
ccccagtcaaatgtaagtcgatctg

SEQ ID NO: 345672 - DNA, 25 bp, Mus musculus
ccccagtcaagcctagttctcaaaa

SEQ ID NO: 345673 - DNA, 25 bp, Mus musculus
ccccagtcaagcgtagttctcaaaa

SEQ ID NO: 345674 - DNA, 25 bp, Mus musculus
ccccagtcacacatctcatttttaa

SEQ ID NO: 345675 - DNA, 25 bp, Mus musculus
ccccagtcacacttctcatttttaa

SEQ ID NO: 345676 - DNA, 25 bp, Mus musculus
ccccagtcagcaagtgcactgaatt

SEQ ID NO: 345677 - DNA, 25 bp, Mus musculus
ccccagtcagcatgtgcactgaatt

SEQ ID NO: 345678 - DNA, 25 bp, Mus musculus
ccccagtcatttatgctccagggaa

SEQ ID NO: 345679 - DNA, 25 bp, Mus musculus
ccccagtcatttttgctccagggaa

SEQ ID NO: 345680 - DNA, 25 bp, Mus musculus
ccccagtccctaagatcagtgttgg

SEQ ID NO: 345681 - DNA, 25 bp, Mus musculus
ccccagtccctatgatcagtgttgg

SEQ ID NO: 345682 - DNA, 25 bp, Mus musculus
ccccagtcgtatagcttctgttttc

SEQ ID NO: 345683 - DNA, 25 bp, Mus musculus
ccccagtcgtattgcttctgttttc

SEQ ID NO: 345684 - DNA, 25 bp, Mus musculus
ccccagtctctcatgaatattgagc

SEQ ID NO: 345685 - DNA, 25 bp, Mus musculus
ccccagtctctcttgaatattgagc

SEQ ID NO: 345686 - DNA, 25 bp, Mus musculus
ccccagtcttataaatctcccgatg

SEQ ID NO: 345687 - DNA, 25 bp, Mus musculus
ccccagtcttattaatctcccgatg

SEQ ID NO: 345688 - DNA, 25 bp, Mus musculus
ccccagtcttcgcttaaaacacagt

SEQ ID NO: 345689 - DNA, 25 bp, Mus musculus
ccccagtcttcggttaaaacacagt

SEQ ID NO: 345690 - DNA, 25 bp, Mus musculus
ccccagtgacccaaacaaagacatg

SEQ ID NO: 345691 - DNA, 25 bp, Mus musculus
ccccagtgaccctaacaaagacatg

SEQ ID NO: 345692 - DNA, 25 bp, Mus musculus
ccccagtgagcgagcaacagaaatt

SEQ ID NO: 345693 - DNA, 25 bp, Mus musculus
ccccagtgagcgtgcaacagaaatt

SEQ ID NO: 345694 - DNA, 25 bp, Mus musculus
ccccagtgcaggacttacttgagta

SEQ ID NO: 345695 - DNA, 25 bp, Mus musculus
ccccagtgcaggtcttacttgagta

SEQ ID NO: 345696 - DNA, 25 bp, Mus musculus
ccccagtgctgtcgaaagcagccat

SEQ ID NO: 345697 - DNA, 25 bp, Mus musculus
ccccagtgctgtggaaagcagccat

SEQ ID NO: 345698 - DNA, 25 bp, Mus musculus
ccccagtggcctccagagatgaata

SEQ ID NO: 345699 - DNA, 25 bp, Mus musculus
ccccagtggcctgcagagatgaata

SEQ ID NO: 345700 - DNA, 25 bp, Mus musculus
ccccagtggtatcttggactgttaa

SEQ ID NO: 345701 - DNA, 25 bp, Mus musculus
ccccagtggtatgttggactgttaa

SEQ ID NO: 345702 - DNA, 25 bp, Mus musculus
ccccagtggtgtcagaaagcctcga

SEQ ID NO: 345703 - DNA, 25 bp, Mus musculus
ccccagtggtgtgagaaagcctcga

SEQ ID NO: 345704 - DNA, 25 bp, Mus musculus
ccccagtggttcctgaaaggcgagt

SEQ ID NO: 345705 - DNA, 25 bp, Mus musculus
ccccagtggttcgtgaaaggcgagt

SEQ ID NO: 345706 - DNA, 25 bp, Mus musculus
ccccagtgtaatccaacttagtgaa

SEQ ID NO: 345707 - DNA, 25 bp, Mus musculus
ccccagtgtaatgcaacttagtgaa

SEQ ID NO: 345708 - DNA, 25 bp, Mus musculus
ccccagtgtacgagattattaaaga

SEQ ID NO: 345709 - DNA, 25 bp, Mus musculus
ccccagtgtacgtgattattaaaga

SEQ ID NO: 345710 - DNA, 25 bp, Mus musculus
ccccagtgtggccattttgttggaa

SEQ ID NO: 345711 - DNA, 25 bp, Mus musculus
ccccagtgtggcgattttgttggaa

SEQ ID NO: 345712 - DNA, 25 bp, Mus musculus
ccccagtgtgggaagagacctcata

SEQ ID NO: 345713 - DNA, 25 bp, Mus musculus
ccccagtgtgggtagagacctcata

SEQ ID NO: 345714 - DNA, 25 bp, Mus musculus
ccccagttacatagatcttccagca

SEQ ID NO: 345715 - DNA, 25 bp, Mus musculus
ccccagttacattgatcttccagca

SEQ ID NO: 345716 - DNA, 25 bp, Mus musculus
ccccagttatctacagggtgtggac

SEQ ID NO: 345717 - DNA, 25 bp, Mus musculus
ccccagttatcttcagggtgtggac

SEQ ID NO: 345718 - DNA, 25 bp, Mus musculus
ccccagttcaccatcagcattaagg

SEQ ID NO: 345719 - DNA, 25 bp, Mus musculus
ccccagttcaccttcagcattaagg

SEQ ID NO: 345720 - DNA, 25 bp, Mus musculus
ccccagttcagacgtatttctcatt

SEQ ID NO: 345721 - DNA, 25 bp, Mus musculus
ccccagttcagaggtatttctcatt

SEQ ID NO: 345722 - DNA, 25 bp, Mus musculus
ccccagttcctacagagactatcat

SEQ ID NO: 345723 - DNA, 25 bp, Mus musculus
ccccagttcctagagagactatcat

SEQ ID NO: 345724 - DNA, 25 bp, Mus musculus
ccccagttcttcatctgaagtctat

SEQ ID NO: 345725 - DNA, 25 bp, Mus musculus
ccccagttcttcttctgaagtctat

SEQ ID NO: 345726 - DNA, 25 bp, Mus musculus
ccccagttgcatcgttctggaattg

SEQ ID NO: 345727 - DNA, 25 bp, Mus musculus
ccccagttgcatggttctggaattg

SEQ ID NO: 345728 - DNA, 25 bp, Mus musculus
ccccagttggctagaagggacattt

SEQ ID NO: 345729 - DNA, 25 bp, Mus musculus
ccccagttggcttgaagggacattt

SEQ ID NO: 345730 - DNA, 25 bp, Mus musculus
ccccagtttataattagctgccaaa

SEQ ID NO: 345731 - DNA, 25 bp, Mus musculus
ccccagtttatatttagctgccaaa

SEQ ID NO: 345732 - DNA, 25 bp, Mus musculus
ccccagtttcaacggacaaacactg

SEQ ID NO: 345733 - DNA, 25 bp, Mus musculus
ccccagtttcaagggacaaacactg

SEQ ID NO: 345734 - DNA, 25 bp, Mus musculus
ccccagttttctaaggatgtgcatg

SEQ ID NO: 345735 - DNA, 25 bp, Mus musculus
ccccagttttcttaggatgtgcatg

SEQ ID NO: 345736 - DNA, 25 bp, Mus musculus
ccccataagactcacctagcagaaa

SEQ ID NO: 345737 - DNA, 25 bp, Mus musculus
ccccataagactgacctagcagaaa

SEQ ID NO: 345738 - DNA, 25 bp, Mus musculus
ccccataagaggagcacagctttta

SEQ ID NO: 345739 - DNA, 25 bp, Mus musculus
ccccataagaggtgcacagctttta

SEQ ID NO: 345740 - DNA, 25 bp, Mus musculus
ccccatagcataaaggcagacttga

SEQ ID NO: 345741 - DNA, 25 bp, Mus musculus
ccccatagcatataggcagacttga

SEQ ID NO: 345742 - DNA, 25 bp, Mus musculus
ccccatagtgagaatgtggtctgtt

SEQ ID NO: 345743 - DNA, 25 bp, Mus musculus
ccccatagtgagtatgtggtctgtt

SEQ ID NO: 345744 - DNA, 25 bp, Mus musculus
ccccatagtgctcagtggagtctct

SEQ ID NO: 345745 - DNA, 25 bp, Mus musculus
ccccatagtgctgagtggagtctct

SEQ ID NO: 345746 - DNA, 25 bp, Mus musculus
ccccatataggtagtccagtacaga

SEQ ID NO: 345747 - DNA, 25 bp, Mus musculus
ccccatataggttgtccagtacaga

SEQ ID NO: 345748 - DNA, 25 bp, Mus musculus
ccccatatcatacactgcacaataa

SEQ ID NO: 345749 - DNA, 25 bp, Mus musculus
ccccatatcatagactgcacaataa

SEQ ID NO: 345750 - DNA, 25 bp, Mus musculus
ccccatatgggaattatccttcacc

SEQ ID NO: 345751 - DNA, 25 bp, Mus musculus
ccccatatgggatttatccttcacc

SEQ ID NO: 345752 - DNA, 25 bp, Mus musculus
ccccatattctcagtatgcatctga

SEQ ID NO: 345753 - DNA, 25 bp, Mus musculus
ccccatattctctgtatgcatctga

SEQ ID NO: 345754 - DNA, 25 bp, Mus musculus
ccccatatttataattcacttgctt

SEQ ID NO: 345755 - DNA, 25 bp, Mus musculus
ccccatatttattattcacttgctt

SEQ ID NO: 345756 - DNA, 25 bp, Mus musculus
ccccatcagacactatctggtcaag

SEQ ID NO: 345757 - DNA, 25 bp, Mus musculus
ccccatcagacagtatctggtcaag

SEQ ID NO: 345758 - DNA, 25 bp, Mus musculus
ccccatcagcttcattctaatttat

SEQ ID NO: 345759 - DNA, 25 bp, Mus musculus
ccccatcagcttgattctaatttat

SEQ ID NO: 345760 - DNA, 25 bp, Mus musculus
ccccatcagtgtagctgactccggg

SEQ ID NO: 345761 - DNA, 25 bp, Mus musculus
ccccatcagtgttgctgactccggg

SEQ ID NO: 345762 - DNA, 25 bp, Mus musculus
ccccatcataatcgtgggcgacgac

SEQ ID NO: 345763 - DNA, 25 bp, Mus musculus
ccccatcataatggtgggcgacgac

SEQ ID NO: 345764 - DNA, 25 bp, Mus musculus
ccccatcatgtgatacattttagca

SEQ ID NO: 345765 - DNA, 25 bp, Mus musculus
ccccatcatgtgttacattttagca

SEQ ID NO: 345766 - DNA, 25 bp, Mus musculus
ccccatccccagaagtacaggttag

SEQ ID NO: 345767 - DNA, 25 bp, Mus musculus
ccccatccccagtagtacaggttag

SEQ ID NO: 345768 - DNA, 25 bp, Mus musculus
ccccatcgataccatgtgctgagaa

SEQ ID NO: 345769 - DNA, 25 bp, Mus musculus
ccccatcgatacgatgtgctgagaa

SEQ ID NO: 345770 - DNA, 25 bp, Mus musculus
ccccatcgtgggaaacagcttcgta

SEQ ID NO: 345771 - DNA, 25 bp, Mus musculus
ccccatcgtgggtaacagcttcgta

SEQ ID NO: 345772 - DNA, 25 bp, Mus musculus
ccccatctatccatcatatctaata

SEQ ID NO: 345773 - DNA, 25 bp, Mus musculus
ccccatctatccttcatatctaata

SEQ ID NO: 345774 - DNA, 25 bp, Mus musculus
ccccatctattcagtccaatttgtt

SEQ ID NO: 345775 - DNA, 25 bp, Mus musculus
ccccatctattctgtccaatttgtt

SEQ ID NO: 345776 - DNA, 25 bp, Mus musculus
ccccatctctctatggtttgaaatc

SEQ ID NO: 345777 - DNA, 25 bp, Mus musculus
ccccatctctctttggtttgaaatc

SEQ ID NO: 345778 - DNA, 25 bp, Mus musculus
ccccatctgactagtattctttcta

SEQ ID NO: 345779 - DNA, 25 bp, Mus musculus
ccccatctgacttgtattctttcta

SEQ ID NO: 345780 - DNA, 25 bp, Mus musculus
ccccatctggtgattcttgagtgca

SEQ ID NO: 345781 - DNA, 25 bp, Mus musculus
ccccatctggtgtttcttgagtgca

SEQ ID NO: 345782 - DNA, 25 bp, Mus musculus
ccccatctgtcactgaggatcacgt

SEQ ID NO: 345783 - DNA, 25 bp, Mus musculus
ccccatctgtcagtgaggatcacgt

SEQ ID NO: 345784 - DNA, 25 bp, Mus musculus
ccccatctgttacgcttcttactat

SEQ ID NO: 345785 - DNA, 25 bp, Mus musculus
ccccatctgttaggcttcttactat

SEQ ID NO: 345786 - DNA, 25 bp, Mus musculus
ccccatctgtttcctgtatgagtct

SEQ ID NO: 345787 - DNA, 25 bp, Mus musculus
ccccatctgtttgctgtatgagtct

SEQ ID NO: 345788 - DNA, 25 bp, Mus musculus
ccccatcttattactgttgacatga

SEQ ID NO: 345789 - DNA, 25 bp, Mus musculus
ccccatcttatttctgttgacatga

SEQ ID NO: 345790 - DNA, 25 bp, Mus musculus
ccccatcttctcaagttgacaattc

SEQ ID NO: 345791 - DNA, 25 bp, Mus musculus
ccccatcttctctagttgacaattc

SEQ ID NO: 345792 - DNA, 25 bp, Mus musculus
ccccatctttttcgtggtgagttca

SEQ ID NO: 345793 - DNA, 25 bp, Mus musculus
ccccatctttttggtggtgagttca

SEQ ID NO: 345794 - DNA, 25 bp, Mus musculus
ccccatgaagctctctgatgtatgt

SEQ ID NO: 345795 - DNA, 25 bp, Mus musculus
ccccatgaagctgtctgatgtatgt

SEQ ID NO: 345796 - DNA, 25 bp, Mus musculus
ccccatgacactcaagcactggaga

SEQ ID NO: 345797 - DNA, 25 bp, Mus musculus
ccccatgacactgaagcactggaga

SEQ ID NO: 345798 - DNA, 25 bp, Mus musculus
ccccatgagattaatttctgacttc

SEQ ID NO: 345799 - DNA, 25 bp, Mus musculus
ccccatgagatttatttctgacttc

SEQ ID NO: 345800 - DNA, 25 bp, Mus musculus
ccccatgatggtctgtctgaaactt

SEQ ID NO: 345801 - DNA, 25 bp, Mus musculus
ccccatgatggtgtgtctgaaactt

SEQ ID NO: 345802 - DNA, 25 bp, Mus musculus
ccccatgattggacattccaacatt

SEQ ID NO: 345803 - DNA, 25 bp, Mus musculus
ccccatgattggtcattccaacatt

SEQ ID NO: 345804 - DNA, 25 bp, Mus musculus
ccccatgccctacaaactgaagatt

SEQ ID NO: 345805 - DNA, 25 bp, Mus musculus
ccccatgccctagaaactgaagatt

SEQ ID NO: 345806 - DNA, 25 bp, Mus musculus
ccccatggactgagactcagttggt

SEQ ID NO: 345807 - DNA, 25 bp, Mus musculus
ccccatggactgtgactcagttggt

SEQ ID NO: 345808 - DNA, 25 bp, Mus musculus
ccccatggatggctttttatttttg

SEQ ID NO: 345809 - DNA, 25 bp, Mus musculus
ccccatggatgggtttttatttttg

SEQ ID NO: 345810 - DNA, 25 bp, Mus musculus
ccccatggcagccaagacttgtgtg

SEQ ID NO: 345811 - DNA, 25 bp, Mus musculus
ccccatggcagcgaagacttgtgtg

SEQ ID NO: 345812 - DNA, 25 bp, Mus musculus
ccccatggctcacttgatttttagc

SEQ ID NO: 345813 - DNA, 25 bp, Mus musculus
ccccatggctcagttgatttttagc

SEQ ID NO: 345814 - DNA, 25 bp, Mus musculus
ccccatgggaggagcttagaaagac

SEQ ID NO: 345815 - DNA, 25 bp, Mus musculus
ccccatgggaggtgcttagaaagac

SEQ ID NO: 345816 - DNA, 25 bp, Mus musculus
ccccatggtaggaacatagcgtgtt

SEQ ID NO: 345817 - DNA, 25 bp, Mus musculus
ccccatggtaggtacatagcgtgtt

SEQ ID NO: 345818 - DNA, 25 bp, Mus musculus
ccccatggtctgcattcagattgat

SEQ ID NO: 345819 - DNA, 25 bp, Mus musculus
ccccatggtctggattcagattgat

SEQ ID NO: 345820 - DNA, 25 bp, Mus musculus
ccccatgtattcattaacgcaatat

SEQ ID NO: 345821 - DNA, 25 bp, Mus musculus
ccccatgtattctttaacgcaatat

SEQ ID NO: 345822 - DNA, 25 bp, Mus musculus
ccccatgtccagattggttagcttg

SEQ ID NO: 345823 - DNA, 25 bp, Mus musculus
ccccatgtccagtttggttagcttg

SEQ ID NO: 345824 - DNA, 25 bp, Mus musculus
ccccatgtctggagtatcttatgca

SEQ ID NO: 345825 - DNA, 25 bp, Mus musculus
ccccatgtctggtgtatcttatgca

SEQ ID NO: 345826 - DNA, 25 bp, Mus musculus
ccccatgtgaacacagatctatgat

SEQ ID NO: 345827 - DNA, 25 bp, Mus musculus
ccccatgtgaactcagatctatgat

SEQ ID NO: 345828 - DNA, 25 bp, Mus musculus
ccccatgtgaagataactgtgttgt

SEQ ID NO: 345829 - DNA, 25 bp, Mus musculus
ccccatgtgaagttaactgtgttgt

SEQ ID NO: 345830 - DNA, 25 bp, Mus musculus
ccccatgtggatatttcttatacta

SEQ ID NO: 345831 - DNA, 25 bp, Mus musculus
ccccatgtggatttttcttatacta

SEQ ID NO: 345832 - DNA, 25 bp, Mus musculus
ccccatgtgtgtaagctcatgaaga

SEQ ID NO: 345833 - DNA, 25 bp, Mus musculus
ccccatgtgtgtcaggtgttgtgaa

SEQ ID NO: 345834 - DNA, 25 bp, Mus musculus
ccccatgtgtgtgaggtgttgtgaa

SEQ ID NO: 345835 - DNA, 25 bp, Mus musculus
ccccatgtgtgttagctcatgaaga

SEQ ID NO: 345836 - DNA, 25 bp, Mus musculus
ccccatgttattataaatctggttt

SEQ ID NO: 345837 - DNA, 25 bp, Mus musculus
ccccatgttattttaaatctggttt

SEQ ID NO: 345838 - DNA, 25 bp, Mus musculus
ccccatgttgcaattcagtactacc

SEQ ID NO: 345839 - DNA, 25 bp, Mus musculus
ccccatgttgcatttcagtactacc

SEQ ID NO: 345840 - DNA, 25 bp, Mus musculus
ccccatgtttagctgacacacttga

SEQ ID NO: 345841 - DNA, 25 bp, Mus musculus
ccccatgtttaggtgacacacttga

SEQ ID NO: 345842 - DNA, 25 bp, Mus musculus
ccccattaacgcacattttgcaata

SEQ ID NO: 345843 - DNA, 25 bp, Mus musculus
ccccattaacgctcattttgcaata

SEQ ID NO: 345844 - DNA, 25 bp, Mus musculus
ccccattaatgcatttctttctgtt

SEQ ID NO: 345845 - DNA, 25 bp, Mus musculus
ccccattaatgcttttctttctgtt

SEQ ID NO: 345846 - DNA, 25 bp, Mus musculus
ccccattacagacattaggcagaaa

SEQ ID NO: 345847 - DNA, 25 bp, Mus musculus
ccccattacagagattaggcagaaa

SEQ ID NO: 345848 - DNA, 25 bp, Mus musculus
ccccattagcagaagcctgactcag

SEQ ID NO: 345849 - DNA, 25 bp, Mus musculus
ccccattagcagtagcctgactcag

SEQ ID NO: 345850 - DNA, 25 bp, Mus musculus
ccccattagctgagttttgttgata

SEQ ID NO: 345851 - DNA, 25 bp, Mus musculus
ccccattagctgtgttttgttgata

SEQ ID NO: 345852 - DNA, 25 bp, Mus musculus
ccccattccaacatatggagcggca

SEQ ID NO: 345853 - DNA, 25 bp, Mus musculus
ccccattccaacttatggagcggca

SEQ ID NO: 345854 - DNA, 25 bp, Mus musculus
ccccattctggtcttggatgcatag

SEQ ID NO: 345855 - DNA, 25 bp, Mus musculus
ccccattctggtgttggatgcatag

SEQ ID NO: 345856 - DNA, 25 bp, Mus musculus
ccccattcttggcatttgatttcta

SEQ ID NO: 345857 - DNA, 25 bp, Mus musculus
ccccattcttgggatttgatttcta

SEQ ID NO: 345858 - DNA, 25 bp, Mus musculus
ccccattgaagtctccattaaagtc

SEQ ID NO: 345859 - DNA, 25 bp, Mus musculus
ccccattgaagtgtccattaaagtc

SEQ ID NO: 345860 - DNA, 25 bp, Mus musculus
ccccattgatgccacctcaaggaaa

SEQ ID NO: 345861 - DNA, 25 bp, Mus musculus
ccccattgatgcgacctcaaggaaa

SEQ ID NO: 345862 - DNA, 25 bp, Mus musculus
ccccattgcctgagcatagtatgtt

SEQ ID NO: 345863 - DNA, 25 bp, Mus musculus
ccccattgcctgtgcatagtatgtt

SEQ ID NO: 345864 - DNA, 25 bp, Mus musculus
ccccattggcctcttgaagtaatct

SEQ ID NO: 345865 - DNA, 25 bp, Mus musculus
ccccattggcctgttgaagtaatct

SEQ ID NO: 345866 - DNA, 25 bp, Mus musculus
ccccattgtctcagggactagggta

SEQ ID NO: 345867 - DNA, 25 bp, Mus musculus
ccccattgtctctgggactagggta

SEQ ID NO: 345868 - DNA, 25 bp, Mus musculus
ccccattgtgtccaatctttgcaga

SEQ ID NO: 345869 - DNA, 25 bp, Mus musculus
ccccattgtgtcgaatctttgcaga

SEQ ID NO: 345870 - DNA, 25 bp, Mus musculus
ccccatttcctaccatgatttttgg

SEQ ID NO: 345871 - DNA, 25 bp, Mus musculus
ccccatttcctagcatgatttttgg

SEQ ID NO: 345872 - DNA, 25 bp, Mus musculus
ccccatttcttgcatcatgtcctta

SEQ ID NO: 345873 - DNA, 25 bp, Mus musculus
ccccatttcttggatcatgtcctta

SEQ ID NO: 345874 - DNA, 25 bp, Mus musculus
ccccatttgtgtcttggaaggcaat

SEQ ID NO: 345875 - DNA, 25 bp, Mus musculus
ccccatttgtgtgttggaaggcaat

SEQ ID NO: 345876 - DNA, 25 bp, Mus musculus
ccccattttaacaaagcttgcagga

SEQ ID NO: 345877 - DNA, 25 bp, Mus musculus
ccccattttaactaagcttgcagga

SEQ ID NO: 345878 - DNA, 25 bp, Mus musculus
ccccattttactaatacttggtatg

SEQ ID NO: 345879 - DNA, 25 bp, Mus musculus
ccccattttacttatacttggtatg

SEQ ID NO: 345880 - DNA, 25 bp, Mus musculus
cccccacgaggtatgagaggaggct

SEQ ID NO: 345881 - DNA, 25 bp, Mus musculus
cccccacgaggtttgagaggaggct

SEQ ID NO: 345882 - DNA, 25 bp, Mus musculus
cccccatatcctatggatctcgttt

SEQ ID NO: 345883 - DNA, 25 bp, Mus musculus
cccccatatcctttggatctcgttt

SEQ ID NO: 345884 - DNA, 25 bp, Mus musculus
ccccccagaaggagacagggaccat

SEQ ID NO: 345885 - DNA, 25 bp, Mus musculus
ccccccagaaggtgacagggaccat

SEQ ID NO: 345886 - DNA, 25 bp, Mus musculus
cccccccagtccccgatcacagaaa

SEQ ID NO: 345887 - DNA, 25 bp, Mus musculus
cccccccagtccgcgatcacagaaa

SEQ ID NO: 345888 - DNA, 25 bp, Mus musculus
cccccccggagtacatgtctctagc

SEQ ID NO: 345889 - DNA, 25 bp, Mus musculus
cccccccggagttcatgtctctagc

SEQ ID NO: 345890 - DNA, 25 bp, Mus musculus
ccccccggtgttcgcattgcaatat

SEQ ID NO: 345891 - DNA, 25 bp, Mus musculus
ccccccggtgttggcattgcaatat

SEQ ID NO: 345892 - DNA, 25 bp, Mus musculus
ccccgaaaggctcccagagtgtgaa

SEQ ID NO: 345893 - DNA, 25 bp, Mus musculus
ccccgaaaggctgccagagtgtgaa

SEQ ID NO: 345894 - DNA, 25 bp, Mus musculus
ccccgaaatgctagattgtgcttgt

SEQ ID NO: 345895 - DNA, 25 bp, Mus musculus
ccccgaaatgcttgattgtgcttgt

SEQ ID NO: 345896 - DNA, 25 bp, Mus musculus
ccccgaagatatcacagtgatgatg

SEQ ID NO: 345897 - DNA, 25 bp, Mus musculus
ccccgaagatatgacagtgatgatg

SEQ ID NO: 345898 - DNA, 25 bp, Mus musculus
ccccgaatatgaccctggctataag

SEQ ID NO: 345899 - DNA, 25 bp, Mus musculus
ccccgaatatgagcctggctataag

SEQ ID NO: 345900 - DNA, 25 bp, Mus musculus
ccccgaatggctagtactattaatg

SEQ ID NO: 345901 - DNA, 25 bp, Mus musculus
ccccgaatggcttgtactattaatg

SEQ ID NO: 345902 - DNA, 25 bp, Mus musculus
ccccgacacagtcaagtggtctaga

SEQ ID NO: 345903 - DNA, 25 bp, Mus musculus
ccccgacacagtgaagtggtctaga

SEQ ID NO: 345904 - DNA, 25 bp, Mus musculus
ccccgacagagacgatgtggtttat

SEQ ID NO: 345905 - DNA, 25 bp, Mus musculus
ccccgacagagaggatgtggtttat

SEQ ID NO: 345906 - DNA, 25 bp, Mus musculus
ccccgacagtgcctggagcttgtat

SEQ ID NO: 345907 - DNA, 25 bp, Mus musculus
ccccgacagtgcgtggagcttgtat

SEQ ID NO: 345908 - DNA, 25 bp, Mus musculus
ccccgacatggtcgactacaggaga

SEQ ID NO: 345909 - DNA, 25 bp, Mus musculus
ccccgacatggtggactacaggaga

SEQ ID NO: 345910 - DNA, 25 bp, Mus musculus
ccccgacgctgaactgagccatgag

SEQ ID NO: 345911 - DNA, 25 bp, Mus musculus
ccccgacgctgatctgagccatgag

SEQ ID NO: 345912 - DNA, 25 bp, Mus musculus
ccccgactggatagctaatatttat

SEQ ID NO: 345913 - DNA, 25 bp, Mus musculus
ccccgactggattgctaatatttat

SEQ ID NO: 345914 - DNA, 25 bp, Mus musculus
ccccgacttagcatggtacagaatg

SEQ ID NO: 345915 - DNA, 25 bp, Mus musculus
ccccgacttagcttggtacagaatg

SEQ ID NO: 345916 - DNA, 25 bp, Mus musculus
ccccgagaggttccattgagcccag

SEQ ID NO: 345917 - DNA, 25 bp, Mus musculus
ccccgagaggttgcattgagcccag

SEQ ID NO: 345918 - DNA, 25 bp, Mus musculus
ccccgagagtaactgatgccttcag

SEQ ID NO: 345919 - DNA, 25 bp, Mus musculus
ccccgagagtaagtgatgccttcag

SEQ ID NO: 345920 - DNA, 25 bp, Mus musculus
ccccgagatacaaagtgctgttcaa

SEQ ID NO: 345921 - DNA, 25 bp, Mus musculus
ccccgagatacatagtgctgttcaa

SEQ ID NO: 345922 - DNA, 25 bp, Mus musculus
ccccgagatcttacaaacacttgtc

SEQ ID NO: 345923 - DNA, 25 bp, Mus musculus
ccccgagatctttcaaacacttgtc

SEQ ID NO: 345924 - DNA, 25 bp, Mus musculus
ccccgagcaccaaaatgtataccta

SEQ ID NO: 345925 - DNA, 25 bp, Mus musculus
ccccgagcaccataatgtataccta

SEQ ID NO: 345926 - DNA, 25 bp, Mus musculus
ccccgaggaaatagggctccctgtg

SEQ ID NO: 345927 - DNA, 25 bp, Mus musculus
ccccgaggaaattgggctccctgtg

SEQ ID NO: 345928 - DNA, 25 bp, Mus musculus
ccccgaggatgcacaggcagtaatg

SEQ ID NO: 345929 - DNA, 25 bp, Mus musculus
ccccgaggatgctcaggcagtaatg

SEQ ID NO: 345930 - DNA, 25 bp, Mus musculus
ccccgaggcgtgaaagtcagagagt

SEQ ID NO: 345931 - DNA, 25 bp, Mus musculus
ccccgaggcgtgtaagtcagagagt

SEQ ID NO: 345932 - DNA, 25 bp, Mus musculus
ccccgaggtcacagaatgaatgact

SEQ ID NO: 345933 - DNA, 25 bp, Mus musculus
ccccgaggtcactgaatgaatgact

SEQ ID NO: 345934 - DNA, 25 bp, Mus musculus
ccccgaggtgggaggtcaatcaatc

SEQ ID NO: 345935 - DNA, 25 bp, Mus musculus
ccccgaggtgggtggtcaatcaatc

SEQ ID NO: 345936 - DNA, 25 bp, Mus musculus
ccccgaggttcaccagattctataa

SEQ ID NO: 345937 - DNA, 25 bp, Mus musculus
ccccgaggttcagcagattctataa

SEQ ID NO: 345938 - DNA, 25 bp, Mus musculus
ccccgatatggaagcgttatgaatc

SEQ ID NO: 345939 - DNA, 25 bp, Mus musculus
ccccgatatggatgcgttatgaatc

SEQ ID NO: 345940 - DNA, 25 bp, Mus musculus
ccccgatgatgtatttcctccagca

SEQ ID NO: 345941 - DNA, 25 bp, Mus musculus
ccccgatgatgtttttcctccagca

SEQ ID NO: 345942 - DNA, 25 bp, Mus musculus
ccccgattcacccattgttaattgt

SEQ ID NO: 345943 - DNA, 25 bp, Mus musculus
ccccgattcaccgattgttaattgt

SEQ ID NO: 345944 - DNA, 25 bp, Mus musculus
ccccgattcgttatagctagagatt

SEQ ID NO: 345945 - DNA, 25 bp, Mus musculus
ccccgattcgttttagctagagatt

SEQ ID NO: 345946 - DNA, 25 bp, Mus musculus
ccccgattgggtactcactgaacag

SEQ ID NO: 345947 - DNA, 25 bp, Mus musculus
ccccgattgggttctcactgaacag

SEQ ID NO: 345948 - DNA, 25 bp, Mus musculus
ccccgcactgaaaacattcttttag

SEQ ID NO: 345949 - DNA, 25 bp, Mus musculus
ccccgcactgaatacattcttttag

SEQ ID NO: 345950 - DNA, 25 bp, Mus musculus
ccccgcagaagtagaggtggcagat

SEQ ID NO: 345951 - DNA, 25 bp, Mus musculus
ccccgcagaagttgaggtggcagat

SEQ ID NO: 345952 - DNA, 25 bp, Mus musculus
ccccgcagatgaagaacttcttcgt

SEQ ID NO: 345953 - DNA, 25 bp, Mus musculus
ccccgcagatgatgaacttcttcgt

SEQ ID NO: 345954 - DNA, 25 bp, Mus musculus
ccccgcagcaagattcccatagaaa

SEQ ID NO: 345955 - DNA, 25 bp, Mus musculus
ccccgcagcaagtttcccatagaaa

SEQ ID NO: 345956 - DNA, 25 bp, Mus musculus
ccccgcagcactatcagtaaagagg

SEQ ID NO: 345957 - DNA, 25 bp, Mus musculus
ccccgcagcactttcagtaaagagg

SEQ ID NO: 345958 - DNA, 25 bp, Mus musculus
ccccgcagcgagctgcagcaagaga

SEQ ID NO: 345959 - DNA, 25 bp, Mus musculus
ccccgcagcgaggtgcagcaagaga

SEQ ID NO: 345960 - DNA, 25 bp, Mus musculus
ccccgcagcttcaattctgggtaga

SEQ ID NO: 345961 - DNA, 25 bp, Mus musculus
ccccgcagcttctattctgggtaga

SEQ ID NO: 345962 - DNA, 25 bp, Mus musculus
ccccgcatcagtacaatgtgtcaga

SEQ ID NO: 345963 - DNA, 25 bp, Mus musculus
ccccgcatcagttcaatgtgtcaga

SEQ ID NO: 345964 - DNA, 25 bp, Mus musculus
ccccgcatgcttatggcaggaggga

SEQ ID NO: 345965 - DNA, 25 bp, Mus musculus
ccccgcatgcttttggcaggaggga

SEQ ID NO: 345966 - DNA, 25 bp, Mus musculus
ccccgccatggcatttcatgatatg

SEQ ID NO: 345967 - DNA, 25 bp, Mus musculus
ccccgccatggcttttcatgatatg

SEQ ID NO: 345968 - DNA, 25 bp, Mus musculus
ccccgcctacatacacaaagtgttt

SEQ ID NO: 345969 - DNA, 25 bp, Mus musculus
ccccgcctacattcacaaagtgttt

SEQ ID NO: 345970 - DNA, 25 bp, Mus musculus
ccccgcctctgtagtaatgataata

SEQ ID NO: 345971 - DNA, 25 bp, Mus musculus
ccccgcctctgttgtaatgataata

SEQ ID NO: 345972 - DNA, 25 bp, Mus musculus
ccccgccttctaatttgtgagcaag

SEQ ID NO: 345973 - DNA, 25 bp, Mus musculus
ccccgccttctattttgtgagcaag

SEQ ID NO: 345974 - DNA, 25 bp, Mus musculus
ccccgcgcaaacctctgagatgagt

SEQ ID NO: 345975 - DNA, 25 bp, Mus musculus
ccccgcgcaaacgtctgagatgagt

SEQ ID NO: 345976 - DNA, 25 bp, Mus musculus
ccccgcgtttacattctgatatatt

SEQ ID NO: 345977 - DNA, 25 bp, Mus musculus
ccccgcgtttactttctgatatatt

SEQ ID NO: 345978 - DNA, 25 bp, Mus musculus
ccccgctacatgacatacaattgag

SEQ ID NO: 345979 - DNA, 25 bp, Mus musculus
ccccgctacatgtcatacaattgag

SEQ ID NO: 345980 - DNA, 25 bp, Mus musculus
ccccgctaccatatacaggaagata

SEQ ID NO: 345981 - DNA, 25 bp, Mus musculus
ccccgctaccatttacaggaagata

SEQ ID NO: 345982 - DNA, 25 bp, Mus musculus
ccccgctcaggtcgagcaggataag

SEQ ID NO: 345983 - DNA, 25 bp, Mus musculus
ccccgctcaggtggagcaggataag

SEQ ID NO: 345984 - DNA, 25 bp, Mus musculus
ccccgctctgttccataagaagcag

SEQ ID NO: 345985 - DNA, 25 bp, Mus musculus
ccccgctctgttgcataagaagcag

SEQ ID NO: 345986 - DNA, 25 bp, Mus musculus
ccccgctgactgacagaggaggcag

SEQ ID NO: 345987 - DNA, 25 bp, Mus musculus
ccccgctgactgtcagaggaggcag

SEQ ID NO: 345988 - DNA, 25 bp, Mus musculus
ccccgctggtggatgaggtgaagca

SEQ ID NO: 345989 - DNA, 25 bp, Mus musculus
ccccgctggtggttgaggtgaagca

SEQ ID NO: 345990 - DNA, 25 bp, Mus musculus
ccccgctgttacatgtaccagagaa

SEQ ID NO: 345991 - DNA, 25 bp, Mus musculus
ccccgctgttacttgtaccagagaa

SEQ ID NO: 345992 - DNA, 25 bp, Mus musculus
ccccgcttagccagtaggttacata

SEQ ID NO: 345993 - DNA, 25 bp, Mus musculus
ccccgcttagcctgtaggttacata

SEQ ID NO: 345994 - DNA, 25 bp, Mus musculus
ccccgcttcaataatgttcaactga

SEQ ID NO: 345995 - DNA, 25 bp, Mus musculus
ccccgcttcaattatgttcaactga

SEQ ID NO: 345996 - DNA, 25 bp, Mus musculus
ccccgcttctagctatcttctagag

SEQ ID NO: 345997 - DNA, 25 bp, Mus musculus
ccccgcttctaggtatcttctagag

SEQ ID NO: 345998 - DNA, 25 bp, Mus musculus
ccccggaatcttcttagcactgaga

SEQ ID NO: 345999 - DNA, 25 bp, Mus musculus
ccccggaatcttgttagcactgaga

SEQ ID NO: 346000 - DNA, 25 bp, Mus musculus
ccccggaccaagctgcaatgcagta

SEQ ID NO: 346001 - DNA, 25 bp, Mus musculus
ccccggaccaaggtgcaatgcagta

SEQ ID NO: 346002 - DNA, 25 bp, Mus musculus
ccccggatattgatcactgtcgtgt

SEQ ID NO: 346003 - DNA, 25 bp, Mus musculus
ccccggatattgttcactgtcgtgt

SEQ ID NO: 346004 - DNA, 25 bp, Mus musculus
ccccggatgaccagtgtgagaagat

SEQ ID NO: 346005 - DNA, 25 bp, Mus musculus
ccccggatgacctgtgtgagaagat

SEQ ID NO: 346006 - DNA, 25 bp, Mus musculus
ccccggatgtggaaggagaccccag

SEQ ID NO: 346007 - DNA, 25 bp, Mus musculus
ccccggatgtggtaggagaccccag

SEQ ID NO: 346008 - DNA, 25 bp, Mus musculus
ccccggattagaccccatggcaaga

SEQ ID NO: 346009 - DNA, 25 bp, Mus musculus
ccccggattagagcccatggcaaga

SEQ ID NO: 346010 - DNA, 25 bp, Mus musculus
ccccggcaaggtcacagctctggtg

SEQ ID NO: 346011 - DNA, 25 bp, Mus musculus
ccccggcaaggtgacagctctggtg

SEQ ID NO: 346012 - DNA, 25 bp, Mus musculus
ccccggcggtccatgagtattatga

SEQ ID NO: 346013 - DNA, 25 bp, Mus musculus
ccccggcggtccttgagtattatga

SEQ ID NO: 346014 - DNA, 25 bp, Mus musculus
ccccggctcaagagtgtttctgaga

SEQ ID NO: 346015 - DNA, 25 bp, Mus musculus
ccccggctcaagtgtgtttctgaga

SEQ ID NO: 346016 - DNA, 25 bp, Mus musculus
ccccggcttttccctggtgctacag

SEQ ID NO: 346017 - DNA, 25 bp, Mus musculus
ccccggcttttcgctggtgctacag

SEQ ID NO: 346018 - DNA, 25 bp, Mus musculus
ccccgggaagacctgattggcttga

SEQ ID NO: 346019 - DNA, 25 bp, Mus musculus
ccccgggaagacgtgattggcttga

SEQ ID NO: 346020 - DNA, 25 bp, Mus musculus
ccccgggaagctacacgatgtggag

SEQ ID NO: 346021 - DNA, 25 bp, Mus musculus
ccccgggaagcttcacgatgtggag

SEQ ID NO: 346022 - DNA, 25 bp, Mus musculus
ccccgggatcttaaagcttcaacag

SEQ ID NO: 346023 - DNA, 25 bp, Mus musculus
ccccgggatctttaagcttcaacag

SEQ ID NO: 346024 - DNA, 25 bp, Mus musculus
ccccgggattcaagttcaaggttca

SEQ ID NO: 346025 - DNA, 25 bp, Mus musculus
ccccgggattcatgttcaaggttca

SEQ ID NO: 346026 - DNA, 25 bp, Mus musculus
ccccgggcagctcgtccagttgatg

SEQ ID NO: 346027 - DNA, 25 bp, Mus musculus
ccccgggcagctggtccagttgatg

SEQ ID NO: 346028 - DNA, 25 bp, Mus musculus
ccccgggcatgacagcttgaggttt

SEQ ID NO: 346029 - DNA, 25 bp, Mus musculus
ccccgggcatgagagcttgaggttt

SEQ ID NO: 346030 - DNA, 25 bp, Mus musculus
ccccgggtggatcgtctcatttctg

SEQ ID NO: 346031 - DNA, 25 bp, Mus musculus
ccccgggtggatggtctcatttctg

SEQ ID NO: 346032 - DNA, 25 bp, Mus musculus
ccccgggtgtccaggtgcaggctca

SEQ ID NO: 346033 - DNA, 25 bp, Mus musculus
ccccgggtgtcctggtgcaggctca

SEQ ID NO: 346034 - DNA, 25 bp, Mus musculus
ccccggtctgaaccggagagattgt

SEQ ID NO: 346035 - DNA, 25 bp, Mus musculus
ccccggtctgaagcggagagattgt

SEQ ID NO: 346036 - DNA, 25 bp, Mus musculus
ccccggtgtgggacattttgagtga

SEQ ID NO: 346037 - DNA, 25 bp, Mus musculus
ccccggtgtgggtcattttgagtga

SEQ ID NO: 346038 - DNA, 25 bp, Mus musculus
ccccggttcacacgaatcttctgga

SEQ ID NO: 346039 - DNA, 25 bp, Mus musculus
ccccggttcacaggaatcttctgga

SEQ ID NO: 346040 - DNA, 25 bp, Mus musculus
ccccggttccatcgtgggagctttg

SEQ ID NO: 346041 - DNA, 25 bp, Mus musculus
ccccggttccatggtgggagctttg

SEQ ID NO: 346042 - DNA, 25 bp, Mus musculus
ccccggtttgggagacacgcattga

SEQ ID NO: 346043 - DNA, 25 bp, Mus musculus
ccccggtttgggtgacacgcattga

SEQ ID NO: 346044 - DNA, 25 bp, Mus musculus
ccccgtactcgcactatgattttta

SEQ ID NO: 346045 - DNA, 25 bp, Mus musculus
ccccgtactcgctctatgattttta

SEQ ID NO: 346046 - DNA, 25 bp, Mus musculus
ccccgtagtctgagacggtactaga

SEQ ID NO: 346047 - DNA, 25 bp, Mus musculus
ccccgtagtctgtgacggtactaga

SEQ ID NO: 346048 - DNA, 25 bp, Mus musculus
ccccgtagtgacaagactgttactt

SEQ ID NO: 346049 - DNA, 25 bp, Mus musculus
ccccgtagtgactagactgttactt

SEQ ID NO: 346050 - DNA, 25 bp, Mus musculus
ccccgtcctccactttttatatgag

SEQ ID NO: 346051 - DNA, 25 bp, Mus musculus
ccccgtcctccagtttttatatgag

SEQ ID NO: 346052 - DNA, 25 bp, Mus musculus
ccccgtcggatgacaggactgtggc

SEQ ID NO: 346053 - DNA, 25 bp, Mus musculus
ccccgtcggatgtcaggactgtggc

SEQ ID NO: 346054 - DNA, 25 bp, Mus musculus
ccccgtgaaataattgcgtctaact

SEQ ID NO: 346055 - DNA, 25 bp, Mus musculus
ccccgtgaaatatttgcgtctaact

SEQ ID NO: 346056 - DNA, 25 bp, Mus musculus
ccccgtgagatacagatttccgaac

SEQ ID NO: 346057 - DNA, 25 bp, Mus musculus
ccccgtgagatagagatttccgaac

SEQ ID NO: 346058 - DNA, 25 bp, Mus musculus
ccccgtgagtgactactgtagtcct

SEQ ID NO: 346059 - DNA, 25 bp, Mus musculus
ccccgtgagtgagtactgtagtcct

SEQ ID NO: 346060 - DNA, 25 bp, Mus musculus
ccccgtgcacggatcaatggtagat

SEQ ID NO: 346061 - DNA, 25 bp, Mus musculus
ccccgtgcacggttcaatggtagat

SEQ ID NO: 346062 - DNA, 25 bp, Mus musculus
ccccgtgccactagagaacatctga

SEQ ID NO: 346063 - DNA, 25 bp, Mus musculus
ccccgtgccacttgagaacatctga

SEQ ID NO: 346064 - DNA, 25 bp, Mus musculus
ccccgtgcggttagggtcagacgat

SEQ ID NO: 346065 - DNA, 25 bp, Mus musculus
ccccgtgcggtttgggtcagacgat

SEQ ID NO: 346066 - DNA, 25 bp, Mus musculus
ccccgtgctacgattggagtgggca

SEQ ID NO: 346067 - DNA, 25 bp, Mus musculus
ccccgtgctacgtttggagtgggca

SEQ ID NO: 346068 - DNA, 25 bp, Mus musculus
ccccgtgctcgcaattatgatatgt

SEQ ID NO: 346069 - DNA, 25 bp, Mus musculus
ccccgtgctcgctattatgatatgt

SEQ ID NO: 346070 - DNA, 25 bp, Mus musculus
ccccgtgctgccatgggaaattgca

SEQ ID NO: 346071 - DNA, 25 bp, Mus musculus
ccccgtgctgccttgggaaattgca

SEQ ID NO: 346072 - DNA, 25 bp, Mus musculus
ccccgtgctgtaaaactgccaagta

SEQ ID NO: 346073 - DNA, 25 bp, Mus musculus
ccccgtgctgtataactgccaagta

SEQ ID NO: 346074 - DNA, 25 bp, Mus musculus
ccccgtggaatgatttttgcctaat

SEQ ID NO: 346075 - DNA, 25 bp, Mus musculus
ccccgtggaatgttttttgcctaat

SEQ ID NO: 346076 - DNA, 25 bp, Mus musculus
ccccgtggagagcagccagtattct

SEQ ID NO: 346077 - DNA, 25 bp, Mus musculus
ccccgtggagaggagccagtattct

SEQ ID NO: 346078 - DNA, 25 bp, Mus musculus
ccccgtggatgtacagcagtggagt

SEQ ID NO: 346079 - DNA, 25 bp, Mus musculus
ccccgtggatgttcagcagtggagt

SEQ ID NO: 346080 - DNA, 25 bp, Mus musculus
ccccgtggccacagtcaatcatatt

SEQ ID NO: 346081 - DNA, 25 bp, Mus musculus
ccccgtggccactgtcaatcatatt

SEQ ID NO: 346082 - DNA, 25 bp, Mus musculus
ccccgtggcgacacaggaatgaggt

SEQ ID NO: 346083 - DNA, 25 bp, Mus musculus
ccccgtggcgactcaggaatgaggt

SEQ ID NO: 346084 - DNA, 25 bp, Mus musculus
ccccgtgggattattgactgatatc

SEQ ID NO: 346085 - DNA, 25 bp, Mus musculus
ccccgtgggatttttgactgatatc

SEQ ID NO: 346086 - DNA, 25 bp, Mus musculus
ccccgtgggctgagcgaagtgctcc

SEQ ID NO: 346087 - DNA, 25 bp, Mus musculus
ccccgtgggctgtgcgaagtgctcc

SEQ ID NO: 346088 - DNA, 25 bp, Mus musculus
ccccgtggtggaaatgtgaacttct

SEQ ID NO: 346089 - DNA, 25 bp, Mus musculus
ccccgtggtggatatgtgaacttct

SEQ ID NO: 346090 - DNA, 25 bp, Mus musculus
ccccgtggtgggacagtagtagtat

SEQ ID NO: 346091 - DNA, 25 bp, Mus musculus
ccccgtggtgggtcagtagtagtat

SEQ ID NO: 346092 - DNA, 25 bp, Mus musculus
ccccgtggttctatattgcactggg

SEQ ID NO: 346093 - DNA, 25 bp, Mus musculus
ccccgtggttctttattgcactggg

SEQ ID NO: 346094 - DNA, 25 bp, Mus musculus
ccccgtggttgtattgttctgattt

SEQ ID NO: 346095 - DNA, 25 bp, Mus musculus
ccccgtggttgttttgttctgattt

SEQ ID NO: 346096 - DNA, 25 bp, Mus musculus
ccccgtgtcagaaaaaccttgctat

SEQ ID NO: 346097 - DNA, 25 bp, Mus musculus
ccccgtgtcagataaaccttgctat

SEQ ID NO: 346098 - DNA, 25 bp, Mus musculus
ccccgtgtcattccaactgaggaga

SEQ ID NO: 346099 - DNA, 25 bp, Mus musculus
ccccgtgtcattgcaactgaggaga

SEQ ID NO: 346100 - DNA, 25 bp, Mus musculus
ccccgtgtgaagagtgttatcacca

SEQ ID NO: 346101 - DNA, 25 bp, Mus musculus
ccccgtgtgaagtgtgttatcacca

SEQ ID NO: 346102 - DNA, 25 bp, Mus musculus
ccccgtgtgaatcagagccggtgat

SEQ ID NO: 346103 - DNA, 25 bp, Mus musculus
ccccgtgtgaatgagagccggtgat

SEQ ID NO: 346104 - DNA, 25 bp, Mus musculus
ccccgtgtggcacatacttaagtat

SEQ ID NO: 346105 - DNA, 25 bp, Mus musculus
ccccgtgtggcagatacttaagtat

SEQ ID NO: 346106 - DNA, 25 bp, Mus musculus
ccccgtgtgtgcaggaggttaactg

SEQ ID NO: 346107 - DNA, 25 bp, Mus musculus
ccccgtgtgtgctggaggttaactg

SEQ ID NO: 346108 - DNA, 25 bp, Mus musculus
ccccgtgtttgaacattgctttgga

SEQ ID NO: 346109 - DNA, 25 bp, Mus musculus
ccccgtgtttgatcattgctttgga

SEQ ID NO: 346110 - DNA, 25 bp, Mus musculus
ccccgtgtttgcatcaaatttcaga

SEQ ID NO: 346111 - DNA, 25 bp, Mus musculus
ccccgtgtttgcttcaaatttcaga

SEQ ID NO: 346112 - DNA, 25 bp, Mus musculus
ccccgttccatgaattcgcggatgt

SEQ ID NO: 346113 - DNA, 25 bp, Mus musculus
ccccgttccatgtattcgcggatgt

SEQ ID NO: 346114 - DNA, 25 bp, Mus musculus
ccccgttgcagtcaagtcagcattg

SEQ ID NO: 346115 - DNA, 25 bp, Mus musculus
ccccgttgcagtcgtgaacatcttt

SEQ ID NO: 346116 - DNA, 25 bp, Mus musculus
ccccgttgcagtgaagtcagcattg

SEQ ID NO: 346117 - DNA, 25 bp, Mus musculus
ccccgttgcagtggtgaacatcttt

SEQ ID NO: 346118 - DNA, 25 bp, Mus musculus
ccccgttggcttaggaaggatgcac

SEQ ID NO: 346119 - DNA, 25 bp, Mus musculus
ccccgttggctttggaaggatgcac

SEQ ID NO: 346120 - DNA, 25 bp, Mus musculus
ccccgtttgatgatgagtgtgttct

SEQ ID NO: 346121 - DNA, 25 bp, Mus musculus
ccccgtttgatgttgagtgtgttct

SEQ ID NO: 346122 - DNA, 25 bp, Mus musculus
ccccgttttgctacgaatttatgat

SEQ ID NO: 346123 - DNA, 25 bp, Mus musculus
ccccgttttgcttcgaatttatgat

SEQ ID NO: 346124 - DNA, 25 bp, Mus musculus
cccctaaaagtaccagccgctgttg

SEQ ID NO: 346125 - DNA, 25 bp, Mus musculus
cccctaaaagtagcagccgctgttg

SEQ ID NO: 346126 - DNA, 25 bp, Mus musculus
cccctaactaagaagctgttcactg

SEQ ID NO: 346127 - DNA, 25 bp, Mus musculus
cccctaactaagtagctgttcactg

SEQ ID NO: 346128 - DNA, 25 bp, Mus musculus
cccctaaggactctgagtattatgg

SEQ ID NO: 346129 - DNA, 25 bp, Mus musculus
cccctaaggactgtgagtattatgg

SEQ ID NO: 346130 - DNA, 25 bp, Mus musculus
cccctaatttagcaatggacacaat

SEQ ID NO: 346131 - DNA, 25 bp, Mus musculus
cccctaatttaggaatggacacaat

SEQ ID NO: 346132 - DNA, 25 bp, Mus musculus
cccctacagacgagcgggatgttga

SEQ ID NO: 346133 - DNA, 25 bp, Mus musculus
cccctacagacgtgcgggatgttga

SEQ ID NO: 346134 - DNA, 25 bp, Mus musculus
cccctacagcgtattctgcaaaaca

SEQ ID NO: 346135 - DNA, 25 bp, Mus musculus
cccctacagcgttttctgcaaaaca

SEQ ID NO: 346136 - DNA, 25 bp, Mus musculus
cccctacattatcggaaaacattgt

SEQ ID NO: 346137 - DNA, 25 bp, Mus musculus
cccctacattatgggaaaacattgt

SEQ ID NO: 346138 - DNA, 25 bp, Mus musculus
cccctacatttcacttaagtgtgtt

SEQ ID NO: 346139 - DNA, 25 bp, Mus musculus
cccctacatttctcttaagtgtgtt

SEQ ID NO: 346140 - DNA, 25 bp, Mus musculus
cccctaccagcacggagtgttgata

SEQ ID NO: 346141 - DNA, 25 bp, Mus musculus
cccctaccagcagggagtgttgata

SEQ ID NO: 346142 - DNA, 25 bp, Mus musculus
cccctacctatgcagttcagcaggt

SEQ ID NO: 346143 - DNA, 25 bp, Mus musculus
cccctacctatggagttcagcaggt

SEQ ID NO: 346144 - DNA, 25 bp, Mus musculus
cccctaccttggcatatagcctggt

SEQ ID NO: 346145 - DNA, 25 bp, Mus musculus
cccctaccttgggatatagcctggt

SEQ ID NO: 346146 - DNA, 25 bp, Mus musculus
cccctactatccctgaattcaatga

SEQ ID NO: 346147 - DNA, 25 bp, Mus musculus
cccctactatccgtgaattcaatga

SEQ ID NO: 346148 - DNA, 25 bp, Mus musculus
cccctactgcgaccgagactatgag

SEQ ID NO: 346149 - DNA, 25 bp, Mus musculus
cccctactgcgagcgagactatgag

SEQ ID NO: 346150 - DNA, 25 bp, Mus musculus
cccctactgtgtcgagctatgagat

SEQ ID NO: 346151 - DNA, 25 bp, Mus musculus
cccctactgtgtggagctatgagat

SEQ ID NO: 346152 - DNA, 25 bp, Mus musculus
cccctacttccacatgggtgagttg

SEQ ID NO: 346153 - DNA, 25 bp, Mus musculus
cccctacttccagatgggtgagttg

SEQ ID NO: 346154 - DNA, 25 bp, Mus musculus
cccctacttcctacgtgaaaagcag

SEQ ID NO: 346155 - DNA, 25 bp, Mus musculus
cccctacttccttcgtgaaaagcag

SEQ ID NO: 346156 - DNA, 25 bp, Mus musculus
cccctagaatatctactcgctcata

SEQ ID NO: 346157 - DNA, 25 bp, Mus musculus
cccctagaatatctactcggttata

SEQ ID NO: 346158 - DNA, 25 bp, Mus musculus
cccctagaatatgtactcgctcata

SEQ ID NO: 346159 - DNA, 25 bp, Mus musculus
cccctagaatatgtactcggttata

SEQ ID NO: 346160 - DNA, 25 bp, Mus musculus
cccctagaccttccaagcatagtga

SEQ ID NO: 346161 - DNA, 25 bp, Mus musculus
cccctagaccttgcaagcatagtga

SEQ ID NO: 346162 - DNA, 25 bp, Mus musculus
cccctagactgtcagttgcttgagg

SEQ ID NO: 346163 - DNA, 25 bp, Mus musculus
cccctagactgtgagttgcttgagg

SEQ ID NO: 346164 - DNA, 25 bp, Mus musculus
cccctagagtaccaatgtttgtggt

SEQ ID NO: 346165 - DNA, 25 bp, Mus musculus
cccctagagtacgaatgtttgtggt

SEQ ID NO: 346166 - DNA, 25 bp, Mus musculus
cccctagatgctcgagaaagcctgg

SEQ ID NO: 346167 - DNA, 25 bp, Mus musculus
cccctagatgctggagaaagcctgg

SEQ ID NO: 346168 - DNA, 25 bp, Mus musculus
cccctagattccacctatttgtgaa

SEQ ID NO: 346169 - DNA, 25 bp, Mus musculus
cccctagattcctcctatttgtgaa

SEQ ID NO: 346170 - DNA, 25 bp, Mus musculus
cccctagcctctaagaatatgagct

SEQ ID NO: 346171 - DNA, 25 bp, Mus musculus
cccctagcctcttagaatatgagct

SEQ ID NO: 346172 - DNA, 25 bp, Mus musculus
cccctagctgtgagtctagtttagg

SEQ ID NO: 346173 - DNA, 25 bp, Mus musculus
cccctagctgtgtgtctagtttagg

SEQ ID NO: 346174 - DNA, 25 bp, Mus musculus
cccctagcttggcttttagacaatg

SEQ ID NO: 346175 - DNA, 25 bp, Mus musculus
cccctagcttgggttttagacaatg

SEQ ID NO: 346176 - DNA, 25 bp, Mus musculus
cccctagtaagcagatccagtgtgt

SEQ ID NO: 346177 - DNA, 25 bp, Mus musculus
cccctagtaagctgatccagtgtgt

SEQ ID NO: 346178 - DNA, 25 bp, Mus musculus
cccctagtcataccccttcctttat

SEQ ID NO: 346179 - DNA, 25 bp, Mus musculus
cccctagtcatagcccttcctttat

SEQ ID NO: 346180 - DNA, 25 bp, Mus musculus
cccctagtcttcatatttctcagta

SEQ ID NO: 346181 - DNA, 25 bp, Mus musculus
cccctagtcttcttatttctcagta

SEQ ID NO: 346182 - DNA, 25 bp, Mus musculus
cccctagtgctcaggaggagaggca

SEQ ID NO: 346183 - DNA, 25 bp, Mus musculus
cccctagtgctctggaggagaggca

SEQ ID NO: 346184 - DNA, 25 bp, Mus musculus
cccctagttcccagatcaaaaaatg

SEQ ID NO: 346185 - DNA, 25 bp, Mus musculus
cccctagttccctgatcaaaaaatg

SEQ ID NO: 346186 - DNA, 25 bp, Mus musculus
cccctataatttcactcctggagag

SEQ ID NO: 346187 - DNA, 25 bp, Mus musculus
cccctataatttgactcctggagag

SEQ ID NO: 346188 - DNA, 25 bp, Mus musculus
cccctatacttaagaccacgagatg

SEQ ID NO: 346189 - DNA, 25 bp, Mus musculus
cccctatacttatgaccacgagatg

SEQ ID NO: 346190 - DNA, 25 bp, Mus musculus
cccctatagactcttgtgcttgaat

SEQ ID NO: 346191 - DNA, 25 bp, Mus musculus
cccctatagactgttgtgcttgaat

SEQ ID NO: 346192 - DNA, 25 bp, Mus musculus
cccctataggcacgtatccacagta

SEQ ID NO: 346193 - DNA, 25 bp, Mus musculus
cccctataggcaggtatccacagta

SEQ ID NO: 346194 - DNA, 25 bp, Mus musculus
cccctatcccaaactgcatttataa

SEQ ID NO: 346195 - DNA, 25 bp, Mus musculus
cccctatcccaatctgcatttataa

SEQ ID NO: 346196 - DNA, 25 bp, Mus musculus
cccctatcccagacactgataatgt

SEQ ID NO: 346197 - DNA, 25 bp, Mus musculus
cccctatcccagtcactgataatgt

SEQ ID NO: 346198 - DNA, 25 bp, Mus musculus
cccctatccctcagatattgcaaaa

SEQ ID NO: 346199 - DNA, 25 bp, Mus musculus
cccctatccctctgatattgcaaaa

SEQ ID NO: 346200 - DNA, 25 bp, Mus musculus
cccctatccgagcagatggtttcaa

SEQ ID NO: 346201 - DNA, 25 bp, Mus musculus
cccctatccgaggagatggtttcaa

SEQ ID NO: 346202 - DNA, 25 bp, Mus musculus
cccctatctgttcattcagacatga

SEQ ID NO: 346203 - DNA, 25 bp, Mus musculus
cccctatctgttgattcagacatga

SEQ ID NO: 346204 - DNA, 25 bp, Mus musculus
cccctatgaatgaacccaatgcggc

SEQ ID NO: 346205 - DNA, 25 bp, Mus musculus
cccctatgaatgacatgtacaattg

SEQ ID NO: 346206 - DNA, 25 bp, Mus musculus
cccctatgaatgtacccaatgcggc

SEQ ID NO: 346207 - DNA, 25 bp, Mus musculus
cccctatgaatgtcatgtacaattg

SEQ ID NO: 346208 - DNA, 25 bp, Mus musculus
cccctatgactgaccaatgtgataa

SEQ ID NO: 346209 - DNA, 25 bp, Mus musculus
cccctatgactgtccaatgtgataa

SEQ ID NO: 346210 - DNA, 25 bp, Mus musculus
cccctatggtgactggaactgacag

SEQ ID NO: 346211 - DNA, 25 bp, Mus musculus
cccctatggtgagtggaactgacag

SEQ ID NO: 346212 - DNA, 25 bp, Mus musculus
cccctattactgcagattcccaaga

SEQ ID NO: 346213 - DNA, 25 bp, Mus musculus
cccctattactggagattcccaaga

SEQ ID NO: 346214 - DNA, 25 bp, Mus musculus
cccctattagcgctttgataccaga

SEQ ID NO: 346215 - DNA, 25 bp, Mus musculus
cccctattagcggtttgataccaga

SEQ ID NO: 346216 - DNA, 25 bp, Mus musculus
cccctcaaagatctcttccaaagga

SEQ ID NO: 346217 - DNA, 25 bp, Mus musculus
cccctcaaagatgtcttccaaagga

SEQ ID NO: 346218 - DNA, 25 bp, Mus musculus
cccctcaacacacattttttcaaga

SEQ ID NO: 346219 - DNA, 25 bp, Mus musculus
cccctcaacacagattttttcaaga

SEQ ID NO: 346220 - DNA, 25 bp, Mus musculus
cccctcaacagaaggaaggctatct

SEQ ID NO: 346221 - DNA, 25 bp, Mus musculus
cccctcaacagatggaaggctatct

SEQ ID NO: 346222 - DNA, 25 bp, Mus musculus
cccctcaagtgtactgcgttttaca

SEQ ID NO: 346223 - DNA, 25 bp, Mus musculus
cccctcaagtgttctgcgttttaca

SEQ ID NO: 346224 - DNA, 25 bp, Mus musculus
cccctcaataatattttcactgact

SEQ ID NO: 346225 - DNA, 25 bp, Mus musculus
cccctcaataattttttcactgact

SEQ ID NO: 346226 - DNA, 25 bp, Mus musculus
cccctcaatgttcgtgtagggagaa

SEQ ID NO: 346227 - DNA, 25 bp, Mus musculus
cccctcaatgttggtgtagggagaa

SEQ ID NO: 346228 - DNA, 25 bp, Mus musculus
cccctcacaatgaaaatactcatgt

SEQ ID NO: 346229 - DNA, 25 bp, Mus musculus
cccctcacaatgtaaatactcatgt

SEQ ID NO: 346230 - DNA, 25 bp, Mus musculus
cccctcacagcaatcatttaacaaa

SEQ ID NO: 346231 - DNA, 25 bp, Mus musculus
cccctcacagcattcatttaacaaa

SEQ ID NO: 346232 - DNA, 25 bp, Mus musculus
cccctcacaggaaaactctgttgca

SEQ ID NO: 346233 - DNA, 25 bp, Mus musculus
cccctcacaggataactctgttgca

SEQ ID NO: 346234 - DNA, 25 bp, Mus musculus
cccctcacagtgatgatagcgtgta

SEQ ID NO: 346235 - DNA, 25 bp, Mus musculus
cccctcacagtgttgatagcgtgta

SEQ ID NO: 346236 - DNA, 25 bp, Mus musculus
cccctcacatccataatgttctttt

SEQ ID NO: 346237 - DNA, 25 bp, Mus musculus
cccctcacatccttaatgttctttt

SEQ ID NO: 346238 - DNA, 25 bp, Mus musculus
cccctcacattcatggagtacactt

SEQ ID NO: 346239 - DNA, 25 bp, Mus musculus
cccctcacattcttggagtacactt

SEQ ID NO: 346240 - DNA, 25 bp, Mus musculus
cccctcactgttaccatggaagtta

SEQ ID NO: 346241 - DNA, 25 bp, Mus musculus
cccctcactgtttccatggaagtta

SEQ ID NO: 346242 - DNA, 25 bp, Mus musculus
cccctcagaagtccatatttatttc

SEQ ID NO: 346243 - DNA, 25 bp, Mus musculus
cccctcagaagtgcatatttatttc

SEQ ID NO: 346244 - DNA, 25 bp, Mus musculus
cccctcagagtacacatggctactt

SEQ ID NO: 346245 - DNA, 25 bp, Mus musculus
cccctcagagtagacatggctactt

SEQ ID NO: 346246 - DNA, 25 bp, Mus musculus
cccctcagattgctcttaggcattt

SEQ ID NO: 346247 - DNA, 25 bp, Mus musculus
cccctcagattggtcttaggcattt

SEQ ID NO: 346248 - DNA, 25 bp, Mus musculus
cccctcagcagaacgtttctgacat

SEQ ID NO: 346249 - DNA, 25 bp, Mus musculus
cccctcagcagatcgtttctgacat

SEQ ID NO: 346250 - DNA, 25 bp, Mus musculus
cccctcagctcaaaacaagtttaga

SEQ ID NO: 346251 - DNA, 25 bp, Mus musculus
cccctcagctcataacaagtttaga

SEQ ID NO: 346252 - DNA, 25 bp, Mus musculus
cccctcagtgagagactagcagtgc

SEQ ID NO: 346253 - DNA, 25 bp, Mus musculus
cccctcagtgagtgactagcagtgc

SEQ ID NO: 346254 - DNA, 25 bp, Mus musculus
cccctcagttagctgctgaagcagt

SEQ ID NO: 346255 - DNA, 25 bp, Mus musculus
cccctcagttaggtgctgaagcagt

SEQ ID NO: 346256 - DNA, 25 bp, Mus musculus
cccctcagttctagtctgttcagaa

SEQ ID NO: 346257 - DNA, 25 bp, Mus musculus
cccctcagttcttgtctgttcagaa

SEQ ID NO: 346258 - DNA, 25 bp, Mus musculus
cccctcatcctgagtctcttatttt

SEQ ID NO: 346259 - DNA, 25 bp, Mus musculus
cccctcatcctgtgtctcttatttt

SEQ ID NO: 346260 - DNA, 25 bp, Mus musculus
cccctcattgaaatcacccaagaaa

SEQ ID NO: 346261 - DNA, 25 bp, Mus musculus
cccctcattgaattcacccaagaaa

SEQ ID NO: 346262 - DNA, 25 bp, Mus musculus
cccctcatttccattgatgttattt

SEQ ID NO: 346263 - DNA, 25 bp, Mus musculus
cccctcatttcctttgatgttattt

SEQ ID NO: 346264 - DNA, 25 bp, Mus musculus
cccctccaagaaaggtggccgatga

SEQ ID NO: 346265 - DNA, 25 bp, Mus musculus
cccctccaagaatggtggccgatga

SEQ ID NO: 346266 - DNA, 25 bp, Mus musculus
cccctccaaggaattacatgtagac

SEQ ID NO: 346267 - DNA, 25 bp, Mus musculus
cccctccaaggatttacatgtagac

SEQ ID NO: 346268 - DNA, 25 bp, Mus musculus
cccctccactatatccatgaattag

SEQ ID NO: 346269 - DNA, 25 bp, Mus musculus
cccctccactatttccatgaattag

SEQ ID NO: 346270 - DNA, 25 bp, Mus musculus
cccctccagaagaactgtgtttggt

SEQ ID NO: 346271 - DNA, 25 bp, Mus musculus
cccctccagaagtactgtgtttggt

SEQ ID NO: 346272 - DNA, 25 bp, Mus musculus
cccctccagctgagaaaagcgggat

SEQ ID NO: 346273 - DNA, 25 bp, Mus musculus
cccctccagctgtgaaaagcgggat

SEQ ID NO: 346274 - DNA, 25 bp, Mus musculus
cccctccatacaatacagtggtgcc

SEQ ID NO: 346275 - DNA, 25 bp, Mus musculus
cccctccatacattacagtggtgcc

SEQ ID NO: 346276 - DNA, 25 bp, Mus musculus
cccctccatctgaagaatccaaaat

SEQ ID NO: 346277 - DNA, 25 bp, Mus musculus
cccctccatctgtagaatccaaaat

SEQ ID NO: 346278 - DNA, 25 bp, Mus musculus
cccctccatgttatagtcaagttca

SEQ ID NO: 346279 - DNA, 25 bp, Mus musculus
cccctccatgttttagtcaagttca

SEQ ID NO: 346280 - DNA, 25 bp, Mus musculus
cccctccattagagtagatagacct

SEQ ID NO: 346281 - DNA, 25 bp, Mus musculus
cccctccattagtgtagatagacct

SEQ ID NO: 346282 - DNA, 25 bp, Mus musculus
cccctccatttcagtatactatgca

SEQ ID NO: 346283 - DNA, 25 bp, Mus musculus
cccctccatttctgtatactatgca

SEQ ID NO: 346284 - DNA, 25 bp, Mus musculus
cccctcccaggtatagtgaatagat

SEQ ID NO: 346285 - DNA, 25 bp, Mus musculus
cccctcccaggtttagtgaatagat

SEQ ID NO: 346286 - DNA, 25 bp, Mus musculus
cccctcccctcaatagagaagaaag

SEQ ID NO: 346287 - DNA, 25 bp, Mus musculus
cccctcccctcattagagaagaaag

SEQ ID NO: 346288 - DNA, 25 bp, Mus musculus
cccctcctaataatgtgcgcacaga

SEQ ID NO: 346289 - DNA, 25 bp, Mus musculus
cccctcctaatattgtgcgcacaga

SEQ ID NO: 346290 - DNA, 25 bp, Mus musculus
cccctcctatcacgttggctgaaaa

SEQ ID NO: 346291 - DNA, 25 bp, Mus musculus
cccctcctatcaggttggctgaaaa

SEQ ID NO: 346292 - DNA, 25 bp, Mus musculus
cccctccttcttaatgttaagatga

SEQ ID NO: 346293 - DNA, 25 bp, Mus musculus
cccctccttctttatgttaagatga

SEQ ID NO: 346294 - DNA, 25 bp, Mus musculus
cccctccttgacatttattggcaag

SEQ ID NO: 346295 - DNA, 25 bp, Mus musculus
cccctccttgacttttattggcaag

SEQ ID NO: 346296 - DNA, 25 bp, Mus musculus
cccctccttggaagaacataatatt

SEQ ID NO: 346297 - DNA, 25 bp, Mus musculus
cccctccttggatgaacataatatt

SEQ ID NO: 346298 - DNA, 25 bp, Mus musculus
cccctcctttgtcctatatggattt

SEQ ID NO: 346299 - DNA, 25 bp, Mus musculus
cccctcctttgtgctatatggattt

SEQ ID NO: 346300 - DNA, 25 bp, Mus musculus
cccctcgaggttacattggtacaca

SEQ ID NO: 346301 - DNA, 25 bp, Mus musculus
cccctcgaggtttcattggtacaca

SEQ ID NO: 346302 - DNA, 25 bp, Mus musculus
cccctcggtggccagaatggtttga

SEQ ID NO: 346303 - DNA, 25 bp, Mus musculus
cccctcggtggcgagaatggtttga

SEQ ID NO: 346304 - DNA, 25 bp, Mus musculus
cccctcggtgggaaataagatgcta

SEQ ID NO: 346305 - DNA, 25 bp, Mus musculus
cccctcggtgggtaataagatgcta

SEQ ID NO: 346306 - DNA, 25 bp, Mus musculus
cccctcgtgagcacatgtgtttgaa

SEQ ID NO: 346307 - DNA, 25 bp, Mus musculus
cccctcgtgagctcatgtgtttgaa

SEQ ID NO: 346308 - DNA, 25 bp, Mus musculus
cccctcgtgtgtcacaacaaagctt

SEQ ID NO: 346309 - DNA, 25 bp, Mus musculus
cccctcgtgtgtgacaacaaagctt

SEQ ID NO: 346310 - DNA, 25 bp, Mus musculus
cccctctaacctattatcagtgcaa

SEQ ID NO: 346311 - DNA, 25 bp, Mus musculus
cccctctaaccttttatcagtgcaa

SEQ ID NO: 346312 - DNA, 25 bp, Mus musculus
cccctctacagcaactgaacattag

SEQ ID NO: 346313 - DNA, 25 bp, Mus musculus
cccctctacagctactgaacattag

SEQ ID NO: 346314 - DNA, 25 bp, Mus musculus
cccctctagagtcctataatgacat

SEQ ID NO: 346315 - DNA, 25 bp, Mus musculus
cccctctagagtgctataatgacat

SEQ ID NO: 346316 - DNA, 25 bp, Mus musculus
cccctctcagatcttcagatgggac

SEQ ID NO: 346317 - DNA, 25 bp, Mus musculus
cccctctcagatgttcagatgggac

SEQ ID NO: 346318 - DNA, 25 bp, Mus musculus
cccctctcggtgagcaaagaatcgc

SEQ ID NO: 346319 - DNA, 25 bp, Mus musculus
cccctctcggtgtgcaaagaatcgc

SEQ ID NO: 346320 - DNA, 25 bp, Mus musculus
cccctctctgctaatgcaaaaggca

SEQ ID NO: 346321 - DNA, 25 bp, Mus musculus
cccctctctgcttatgcaaaaggca

SEQ ID NO: 346322 - DNA, 25 bp, Mus musculus
cccctctgaagcaggttagcattga

SEQ ID NO: 346323 - DNA, 25 bp, Mus musculus
cccctctgaagctggttagcattga

SEQ ID NO: 346324 - DNA, 25 bp, Mus musculus
cccctctgctttaggactgtgggca

SEQ ID NO: 346325 - DNA, 25 bp, Mus musculus
cccctctgcttttggactgtgggca

SEQ ID NO: 346326 - DNA, 25 bp, Mus musculus
cccctctggtggatataatcgctca

SEQ ID NO: 346327 - DNA, 25 bp, Mus musculus
cccctctggtggttataatcgctca

SEQ ID NO: 346328 - DNA, 25 bp, Mus musculus
cccctctgtcttatcaaaatgtctg

SEQ ID NO: 346329 - DNA, 25 bp, Mus musculus
cccctctgtcttttcaaaatgtctg

SEQ ID NO: 346330 - DNA, 25 bp, Mus musculus
cccctctgtgttaacatggctatcg

SEQ ID NO: 346331 - DNA, 25 bp, Mus musculus
cccctctgtgtttacatggctatcg

SEQ ID NO: 346332 - DNA, 25 bp, Mus musculus
cccctcttaaagcatctaattgcag

SEQ ID NO: 346333 - DNA, 25 bp, Mus musculus
cccctcttaaaggatctaattgcag

SEQ ID NO: 346334 - DNA, 25 bp, Mus musculus
cccctcttcagccaaatatttcatt

SEQ ID NO: 346335 - DNA, 25 bp, Mus musculus
cccctcttcagcgaaatatttcatt

SEQ ID NO: 346336 - DNA, 25 bp, Mus musculus
cccctcttcctaagtagctttaatg

SEQ ID NO: 346337 - DNA, 25 bp, Mus musculus
cccctcttcctatgtagctttaatg

SEQ ID NO: 346338 - DNA, 25 bp, Mus musculus
cccctcttccttcatgttgctaaaa

SEQ ID NO: 346339 - DNA, 25 bp, Mus musculus
cccctcttccttgatgttgctaaaa

SEQ ID NO: 346340 - DNA, 25 bp, Mus musculus
cccctcttgctccaagaactttgat

SEQ ID NO: 346341 - DNA, 25 bp, Mus musculus
cccctcttgctcgaagaactttgat

SEQ ID NO: 346342 - DNA, 25 bp, Mus musculus
cccctcttgttgctgaagacattac

SEQ ID NO: 346343 - DNA, 25 bp, Mus musculus
cccctcttgttggtgaagacattac

SEQ ID NO: 346344 - DNA, 25 bp, Mus musculus
cccctctttccaaaatagcagctga

SEQ ID NO: 346345 - DNA, 25 bp, Mus musculus
cccctctttccataatagcagctga

SEQ ID NO: 346346 - DNA, 25 bp, Mus musculus
cccctctttggcagtttatttctag

SEQ ID NO: 346347 - DNA, 25 bp, Mus musculus
cccctctttggctgtttatttctag

SEQ ID NO: 346348 - DNA, 25 bp, Mus musculus
cccctctttgtgaacttcaagtctt

SEQ ID NO: 346349 - DNA, 25 bp, Mus musculus
cccctctttgtgtacttcaagtctt

SEQ ID NO: 346350 - DNA, 25 bp, Mus musculus
cccctgaaaagtcggattttgcaat

SEQ ID NO: 346351 - DNA, 25 bp, Mus musculus
cccctgaaaagtgggattttgcaat

SEQ ID NO: 346352 - DNA, 25 bp, Mus musculus
cccctgaacaagctggctagcaaaa

SEQ ID NO: 346353 - DNA, 25 bp, Mus musculus
cccctgaacaaggtggctagcaaaa

SEQ ID NO: 346354 - DNA, 25 bp, Mus musculus
cccctgaacatccaggacaaggaca

SEQ ID NO: 346355 - DNA, 25 bp, Mus musculus
cccctgaacatcgaggacaaggaca

SEQ ID NO: 346356 - DNA, 25 bp, Mus musculus
cccctgaactcaatgagctgaggaa

SEQ ID NO: 346357 - DNA, 25 bp, Mus musculus
cccctgaactcattgagctgaggaa

SEQ ID NO: 346358 - DNA, 25 bp, Mus musculus
cccctgaactgtcagcttgttagag

SEQ ID NO: 346359 - DNA, 25 bp, Mus musculus
cccctgaactgtgagcttgttagag

SEQ ID NO: 346360 - DNA, 25 bp, Mus musculus
cccctgaagctcagtgttcttagga

SEQ ID NO: 346361 - DNA, 25 bp, Mus musculus
cccctgaagctctgtgttcttagga

SEQ ID NO: 346362 - DNA, 25 bp, Mus musculus
cccctgaagggcctgagacttttga

SEQ ID NO: 346363 - DNA, 25 bp, Mus musculus
cccctgaagggcgtgagacttttga

SEQ ID NO: 346364 - DNA, 25 bp, Mus musculus
cccctgaaggttcctgacgttaatg

SEQ ID NO: 346365 - DNA, 25 bp, Mus musculus
cccctgaaggttgctgacgttaatg

SEQ ID NO: 346366 - DNA, 25 bp, Mus musculus
cccctgaagtcaatggaccactgtt

SEQ ID NO: 346367 - DNA, 25 bp, Mus musculus
cccctgaagtcattggaccactgtt

SEQ ID NO: 346368 - DNA, 25 bp, Mus musculus
cccctgacaaataggctgctggaag

SEQ ID NO: 346369 - DNA, 25 bp, Mus musculus
cccctgacaaattggctgctggaag

SEQ ID NO: 346370 - DNA, 25 bp, Mus musculus
cccctgacatatataaccttaacat

SEQ ID NO: 346371 - DNA, 25 bp, Mus musculus
cccctgacatatttaaccttaacat

SEQ ID NO: 346372 - DNA, 25 bp, Mus musculus
cccctgacctttctggagtcaaaat

SEQ ID NO: 346373 - DNA, 25 bp, Mus musculus
cccctgacctttgtggagtcaaaat

SEQ ID NO: 346374 - DNA, 25 bp, Mus musculus
cccctgagacacacctggacaaaag

SEQ ID NO: 346375 - DNA, 25 bp, Mus musculus
cccctgagacactcctggacaaaag

SEQ ID NO: 346376 - DNA, 25 bp, Mus musculus
cccctgagatgccagagtctctgaa

SEQ ID NO: 346377 - DNA, 25 bp, Mus musculus
cccctgagatgcgagagtctctgaa

SEQ ID NO: 346378 - DNA, 25 bp, Mus musculus
cccctgagcatgctagagcctttac

SEQ ID NO: 346379 - DNA, 25 bp, Mus musculus
cccctgagcatggtagagcctttac

SEQ ID NO: 346380 - DNA, 25 bp, Mus musculus
cccctgagcctaatggttggataga

SEQ ID NO: 346381 - DNA, 25 bp, Mus musculus
cccctgagcctattggttggataga

SEQ ID NO: 346382 - DNA, 25 bp, Mus musculus
cccctgagcggaatgagttggtcta

SEQ ID NO: 346383 - DNA, 25 bp, Mus musculus
cccctgagcggattgagttggtcta

SEQ ID NO: 346384 - DNA, 25 bp, Mus musculus
cccctgaggagcaccctgtgctgct

SEQ ID NO: 346385 - DNA, 25 bp, Mus musculus
cccctgaggagctccctgtgctgct

SEQ ID NO: 346386 - DNA, 25 bp, Mus musculus
cccctgaggctcatttgtggtcata

SEQ ID NO: 346387 - DNA, 25 bp, Mus musculus
cccctgaggctcttttgtggtcata

SEQ ID NO: 346388 - DNA, 25 bp, Mus musculus
cccctgaggctgagagcaagtttgc

SEQ ID NO: 346389 - DNA, 25 bp, Mus musculus
cccctgaggctgtgagcaagtttgc

SEQ ID NO: 346390 - DNA, 25 bp, Mus musculus
cccctgagggtacgcgcttctgcag

SEQ ID NO: 346391 - DNA, 25 bp, Mus musculus
cccctgagggtacgcgcttttccag

SEQ ID NO: 346392 - DNA, 25 bp, Mus musculus
cccctgagggtaggcgcttctgcag

SEQ ID NO: 346393 - DNA, 25 bp, Mus musculus
cccctgagggtaggcgcttttccag

SEQ ID NO: 346394 - DNA, 25 bp, Mus musculus
cccctgaggttgcattctttgatgt

SEQ ID NO: 346395 - DNA, 25 bp, Mus musculus
cccctgaggttggattctttgatgt

SEQ ID NO: 346396 - DNA, 25 bp, Mus musculus
cccctgatgtccatgatctttacaa

SEQ ID NO: 346397 - DNA, 25 bp, Mus musculus
cccctgatgtccttgatctttacaa

SEQ ID NO: 346398 - DNA, 25 bp, Mus musculus
cccctgattgagatggttgtggcaa

SEQ ID NO: 346399 - DNA, 25 bp, Mus musculus
cccctgattgagttggttgtggcaa

SEQ ID NO: 346400 - DNA, 25 bp, Mus musculus
cccctgatttttacaagataccaag

SEQ ID NO: 346401 - DNA, 25 bp, Mus musculus
cccctgattttttcaagataccaag

SEQ ID NO: 346402 - DNA, 25 bp, Mus musculus
cccctgcactttcaagtgatgagcg

SEQ ID NO: 346403 - DNA, 25 bp, Mus musculus
cccctgcactttgaagtgatgagcg

SEQ ID NO: 346404 - DNA, 25 bp, Mus musculus
cccctgcagcgtcggtcagaggctt

SEQ ID NO: 346405 - DNA, 25 bp, Mus musculus
cccctgcagcgtgggtcagaggctt

SEQ ID NO: 346406 - DNA, 25 bp, Mus musculus
cccctgcagtgacaagcacagattg

SEQ ID NO: 346407 - DNA, 25 bp, Mus musculus
cccctgcagtgagaagcacagattg

SEQ ID NO: 346408 - DNA, 25 bp, Mus musculus
cccctgcatagacctttgctgaatt

SEQ ID NO: 346409 - DNA, 25 bp, Mus musculus
cccctgcatagagctttgctgaatt

SEQ ID NO: 346410 - DNA, 25 bp, Mus musculus
cccctgcatagtcactggagtggtt

SEQ ID NO: 346411 - DNA, 25 bp, Mus musculus
cccctgcatagtgactggagtggtt

SEQ ID NO: 346412 - DNA, 25 bp, Mus musculus
cccctgcatctgctgtaggatttag

SEQ ID NO: 346413 - DNA, 25 bp, Mus musculus
cccctgcatctggtgtaggatttag

SEQ ID NO: 346414 - DNA, 25 bp, Mus musculus
cccctgccaggtagggcattagagc

SEQ ID NO: 346415 - DNA, 25 bp, Mus musculus
cccctgccaggttgggcattagagc

SEQ ID NO: 346416 - DNA, 25 bp, Mus musculus
cccctgcctcttcaagtattattat

SEQ ID NO: 346417 - DNA, 25 bp, Mus musculus
cccctgcctcttgaagtattattat

SEQ ID NO: 346418 - DNA, 25 bp, Mus musculus
cccctgccttcaattttaactgaga

SEQ ID NO: 346419 - DNA, 25 bp, Mus musculus
cccctgccttcatttttaactgaga

SEQ ID NO: 346420 - DNA, 25 bp, Mus musculus
cccctgcgagggactatgatggaga

SEQ ID NO: 346421 - DNA, 25 bp, Mus musculus
cccctgcgagggtctatgatggaga

SEQ ID NO: 346422 - DNA, 25 bp, Mus musculus
cccctgcgtacaaagttgtacggac

SEQ ID NO: 346423 - DNA, 25 bp, Mus musculus
cccctgcgtacatagttgtacggac

SEQ ID NO: 346424 - DNA, 25 bp, Mus musculus
cccctgctctagacctggaggaaga

SEQ ID NO: 346425 - DNA, 25 bp, Mus musculus
cccctgctctagtcctggaggaaga

SEQ ID NO: 346426 - DNA, 25 bp, Mus musculus
cccctgctctttctcaaagtgatat

SEQ ID NO: 346427 - DNA, 25 bp, Mus musculus
cccctgctctttgtcaaagtgatat

SEQ ID NO: 346428 - DNA, 25 bp, Mus musculus
cccctgctgtcaacacaagagtgtg

SEQ ID NO: 346429 - DNA, 25 bp, Mus musculus
cccctgctgtcatcacaagagtgtg

SEQ ID NO: 346430 - DNA, 25 bp, Mus musculus
cccctgctgttaaagtcaaagaact

SEQ ID NO: 346431 - DNA, 25 bp, Mus musculus
cccctgctgttatagtcaaagaact

SEQ ID NO: 346432 - DNA, 25 bp, Mus musculus
cccctgctgttcagttgctaataac

SEQ ID NO: 346433 - DNA, 25 bp, Mus musculus
cccctgctgttctgttgctaataac

SEQ ID NO: 346434 - DNA, 25 bp, Mus musculus
cccctgctgtttagctgttgttaat

SEQ ID NO: 346435 - DNA, 25 bp, Mus musculus
cccctgctgttttgctgttgttaat

SEQ ID NO: 346436 - DNA, 25 bp, Mus musculus
cccctgctttgtcagttaggcgtgc

SEQ ID NO: 346437 - DNA, 25 bp, Mus musculus
cccctgctttgtgagttaggcgtgc

SEQ ID NO: 346438 - DNA, 25 bp, Mus musculus
cccctggacgcaatgacagagggac

SEQ ID NO: 346439 - DNA, 25 bp, Mus musculus
cccctggacgcattgacagagggac

SEQ ID NO: 346440 - DNA, 25 bp, Mus musculus
cccctggagacgcaagatcttttat

SEQ ID NO: 346441 - DNA, 25 bp, Mus musculus
cccctggagacggaagatcttttat

SEQ ID NO: 346442 - DNA, 25 bp, Mus musculus
cccctggagatgcacgatgctgaga

SEQ ID NO: 346443 - DNA, 25 bp, Mus musculus
cccctggagatggacgatgctgaga

SEQ ID NO: 346444 - DNA, 25 bp, Mus musculus
cccctggagtgaaagtcaacgtttt

SEQ ID NO: 346445 - DNA, 25 bp, Mus musculus
cccctggagtgatagtcaacgtttt

SEQ ID NO: 346446 - DNA, 25 bp, Mus musculus
cccctggagttgcacttacagtcat

SEQ ID NO: 346447 - DNA, 25 bp, Mus musculus
cccctggagttgcttctggaggtat

SEQ ID NO: 346448 - DNA, 25 bp, Mus musculus
cccctggagttggacttacagtcat

SEQ ID NO: 346449 - DNA, 25 bp, Mus musculus
cccctggagttggttctggaggtat

SEQ ID NO: 346450 - DNA, 25 bp, Mus musculus
cccctggatccgaagagtcattcgt

SEQ ID NO: 346451 - DNA, 25 bp, Mus musculus
cccctggatccgtagagtcattcgt

SEQ ID NO: 346452 - DNA, 25 bp, Mus musculus
cccctggatggcaacagcatagctt

SEQ ID NO: 346453 - DNA, 25 bp, Mus musculus
cccctggatggccttatcacaagag

SEQ ID NO: 346454 - DNA, 25 bp, Mus musculus
cccctggatggcgttatcacaagag

SEQ ID NO: 346455 - DNA, 25 bp, Mus musculus
cccctggatggctacagcatagctt

SEQ ID NO: 346456 - DNA, 25 bp, Mus musculus
cccctggcacttcatgattctggaa

SEQ ID NO: 346457 - DNA, 25 bp, Mus musculus
cccctggcacttgatgattctggaa

SEQ ID NO: 346458 - DNA, 25 bp, Mus musculus
cccctggccaagctcatccatgaca

SEQ ID NO: 346459 - DNA, 25 bp, Mus musculus
cccctggccaaggtcatccatgaca

SEQ ID NO: 346460 - DNA, 25 bp, Mus musculus
cccctggcctgactggaagcagaaa

SEQ ID NO: 346461 - DNA, 25 bp, Mus musculus
cccctggcctgagtggaagcagaaa

SEQ ID NO: 346462 - DNA, 25 bp, Mus musculus
cccctggctgctcagttaagatgaa

SEQ ID NO: 346463 - DNA, 25 bp, Mus musculus
cccctggctgctgagttaagatgaa

SEQ ID NO: 346464 - DNA, 25 bp, Mus musculus
cccctgggaaagacatgcagtgtag

SEQ ID NO: 346465 - DNA, 25 bp, Mus musculus
cccctgggaaagtcatgcagtgtag

SEQ ID NO: 346466 - DNA, 25 bp, Mus musculus
cccctgggaaataacgatgaacgag

SEQ ID NO: 346467 - DNA, 25 bp, Mus musculus
cccctgggaaattacgatgaacgag

SEQ ID NO: 346468 - DNA, 25 bp, Mus musculus
cccctgggagagatttgcttggata

SEQ ID NO: 346469 - DNA, 25 bp, Mus musculus
cccctgggagagttttgcttggata

SEQ ID NO: 346470 - DNA, 25 bp, Mus musculus
cccctgggagctcgacataggagct

SEQ ID NO: 346471 - DNA, 25 bp, Mus musculus
cccctgggagctggacataggagct

SEQ ID NO: 346472 - DNA, 25 bp, Mus musculus
cccctgggataactttgagcagatg

SEQ ID NO: 346473 - DNA, 25 bp, Mus musculus
cccctgggataagtttgagcagatg

SEQ ID NO: 346474 - DNA, 25 bp, Mus musculus
cccctgggcagaatagcaattaaaa

SEQ ID NO: 346475 - DNA, 25 bp, Mus musculus
cccctgggcagattagcaattaaaa

SEQ ID NO: 346476 - DNA, 25 bp, Mus musculus
cccctgggtgaccggcatgtcatga

SEQ ID NO: 346477 - DNA, 25 bp, Mus musculus
cccctgggtgacgggcatgtcatga

SEQ ID NO: 346478 - DNA, 25 bp, Mus musculus
cccctgggtgtaccgagttcagcat

SEQ ID NO: 346479 - DNA, 25 bp, Mus musculus
cccctgggtgtagcgagttcagcat

SEQ ID NO: 346480 - DNA, 25 bp, Mus musculus
cccctgggttcaccagaatggcgga

SEQ ID NO: 346481 - DNA, 25 bp, Mus musculus
cccctgggttcagcagaatggcgga

SEQ ID NO: 346482 - DNA, 25 bp, Mus musculus
cccctggtacataatggccaaggat

SEQ ID NO: 346483 - DNA, 25 bp, Mus musculus
cccctggtacattatggccaaggat

SEQ ID NO: 346484 - DNA, 25 bp, Mus musculus
cccctggtcaggaactctagacaga

SEQ ID NO: 346485 - DNA, 25 bp, Mus musculus
cccctggtcaggtactctagacaga

SEQ ID NO: 346486 - DNA, 25 bp, Mus musculus
cccctggtgctgaggatctagctaa

SEQ ID NO: 346487 - DNA, 25 bp, Mus musculus
cccctggtgctgtggatctagctaa

SEQ ID NO: 346488 - DNA, 25 bp, Mus musculus
cccctggttccaagctgagttaaga

SEQ ID NO: 346489 - DNA, 25 bp, Mus musculus
cccctggttccatgctgagttaaga

SEQ ID NO: 346490 - DNA, 25 bp, Mus musculus
cccctggttctacactgtgttatca

SEQ ID NO: 346491 - DNA, 25 bp, Mus musculus
cccctggttctagactgtgttatca

SEQ ID NO: 346492 - DNA, 25 bp, Mus musculus
cccctggttgctatagtgggcaata

SEQ ID NO: 346493 - DNA, 25 bp, Mus musculus
cccctggttgctttagtgggcaata

SEQ ID NO: 346494 - DNA, 25 bp, Mus musculus
cccctggttttcaatgaatccttgt

SEQ ID NO: 346495 - DNA, 25 bp, Mus musculus
cccctggttttctatgaatccttgt

SEQ ID NO: 346496 - DNA, 25 bp, Mus musculus
cccctggttttgcatcctgtgtgct

SEQ ID NO: 346497 - DNA, 25 bp, Mus musculus
cccctggttttggatcctgtgtgct

SEQ ID NO: 346498 - DNA, 25 bp, Mus musculus
cccctgtaagcaattgaccattgtg

SEQ ID NO: 346499 - DNA, 25 bp, Mus musculus
cccctgtaagcatttgaccattgtg

SEQ ID NO: 346500 - DNA, 25 bp, Mus musculus
cccctgtaatgaattgaattctaaa

SEQ ID NO: 346501 - DNA, 25 bp, Mus musculus
cccctgtaatgatttgaattctaaa

SEQ ID NO: 346502 - DNA, 25 bp, Mus musculus
cccctgtaatgcaggatgctgctga

SEQ ID NO: 346503 - DNA, 25 bp, Mus musculus
cccctgtaatgctggatgctgctga

SEQ ID NO: 346504 - DNA, 25 bp, Mus musculus
cccctgtacacgctgctgaaggaga

SEQ ID NO: 346505 - DNA, 25 bp, Mus musculus
cccctgtacacggtgctgaaggaga

SEQ ID NO: 346506 - DNA, 25 bp, Mus musculus
cccctgtagatgatacagaacgaat

SEQ ID NO: 346507 - DNA, 25 bp, Mus musculus
cccctgtagatgttacagaacgaat

SEQ ID NO: 346508 - DNA, 25 bp, Mus musculus
cccctgtatgtgactacatctggaa

SEQ ID NO: 346509 - DNA, 25 bp, Mus musculus
cccctgtatgtgtctacatctggaa

SEQ ID NO: 346510 - DNA, 25 bp, Mus musculus
cccctgtcagaaatagtttcaatca

SEQ ID NO: 346511 - DNA, 25 bp, Mus musculus
cccctgtcagaattagtttcaatca

SEQ ID NO: 346512 - DNA, 25 bp, Mus musculus
cccctgtcaggtcgttttggagaga

SEQ ID NO: 346513 - DNA, 25 bp, Mus musculus
cccctgtcaggtggttttggagaga

SEQ ID NO: 346514 - DNA, 25 bp, Mus musculus
cccctgtcagtcatagttcttgtag

SEQ ID NO: 346515 - DNA, 25 bp, Mus musculus
cccctgtcagtcttagttcttgtag

SEQ ID NO: 346516 - DNA, 25 bp, Mus musculus
cccctgtccggtatgtacattcaca

SEQ ID NO: 346517 - DNA, 25 bp, Mus musculus
cccctgtccggtttgtacattcaca

SEQ ID NO: 346518 - DNA, 25 bp, Mus musculus
cccctgtcggctcctttggatagag

SEQ ID NO: 346519 - DNA, 25 bp, Mus musculus
cccctgtcggctgctttggatagag

SEQ ID NO: 346520 - DNA, 25 bp, Mus musculus
cccctgtctaggaatcaagctctaa

SEQ ID NO: 346521 - DNA, 25 bp, Mus musculus
cccctgtctaggtatcaagctctaa

SEQ ID NO: 346522 - DNA, 25 bp, Mus musculus
cccctgtgatgaatgtgtgccttta

SEQ ID NO: 346523 - DNA, 25 bp, Mus musculus
cccctgtgatgattgtgtgccttta

SEQ ID NO: 346524 - DNA, 25 bp, Mus musculus
cccctgtgatgcatgatgctgcaac

SEQ ID NO: 346525 - DNA, 25 bp, Mus musculus
cccctgtgatgcttgatgctgcaac

SEQ ID NO: 346526 - DNA, 25 bp, Mus musculus
cccctgtggatactgtaagcacatg

SEQ ID NO: 346527 - DNA, 25 bp, Mus musculus
cccctgtggatagtgtaagcacatg

SEQ ID NO: 346528 - DNA, 25 bp, Mus musculus
cccctgtggcacattaggatttcca

SEQ ID NO: 346529 - DNA, 25 bp, Mus musculus
cccctgtggcactttaggatttcca

SEQ ID NO: 346530 - DNA, 25 bp, Mus musculus
cccctgtgggtgactatcttgatga

SEQ ID NO: 346531 - DNA, 25 bp, Mus musculus
cccctgtgggtgtctatcttgatga

SEQ ID NO: 346532 - DNA, 25 bp, Mus musculus
cccctgttaggcactagataaatat

SEQ ID NO: 346533 - DNA, 25 bp, Mus musculus
cccctgttaggctctagataaatat

SEQ ID NO: 346534 - DNA, 25 bp, Mus musculus
cccctgttgaatacttagtctcttg

SEQ ID NO: 346535 - DNA, 25 bp, Mus musculus
cccctgttgaattcttagtctcttg

SEQ ID NO: 346536 - DNA, 25 bp, Mus musculus
cccctgttgctaactgatgtgttcc

SEQ ID NO: 346537 - DNA, 25 bp, Mus musculus
cccctgttgctatctgatgtgttcc

SEQ ID NO: 346538 - DNA, 25 bp, Mus musculus
cccctgttggaaagaacaagattat

SEQ ID NO: 346539 - DNA, 25 bp, Mus musculus
cccctgttggaatgaacaagattat

SEQ ID NO: 346540 - DNA, 25 bp, Mus musculus
cccctgttgtgcaagtattccatgt

SEQ ID NO: 346541 - DNA, 25 bp, Mus musculus
cccctgttgtgctagtattccatgt

SEQ ID NO: 346542 - DNA, 25 bp, Mus musculus
cccctgtttgacctggctggaataa

SEQ ID NO: 346543 - DNA, 25 bp, Mus musculus
cccctgtttgacgtggctggaataa

SEQ ID NO: 346544 - DNA, 25 bp, Mus musculus
ccccttaagacacttcgactggttg

SEQ ID NO: 346545 - DNA, 25 bp, Mus musculus
ccccttaagacagttcgactggttg

SEQ ID NO: 346546 - DNA, 25 bp, Mus musculus
ccccttaaggctaggatatgatcca

SEQ ID NO: 346547 - DNA, 25 bp, Mus musculus
ccccttaaggcttggatatgatcca

SEQ ID NO: 346548 - DNA, 25 bp, Mus musculus
ccccttaagggcagcatccactggg

SEQ ID NO: 346549 - DNA, 25 bp, Mus musculus
ccccttaagggctgcatccactggg

SEQ ID NO: 346550 - DNA, 25 bp, Mus musculus
ccccttaatttcaactaaagctcag

SEQ ID NO: 346551 - DNA, 25 bp, Mus musculus
ccccttaatttctactaaagctcag

SEQ ID NO: 346552 - DNA, 25 bp, Mus musculus
ccccttacaagcatttctggacggc

SEQ ID NO: 346553 - DNA, 25 bp, Mus musculus
ccccttacaagcttttctggacggc

SEQ ID NO: 346554 - DNA, 25 bp, Mus musculus
ccccttacacagaattctcagactt

SEQ ID NO: 346555 - DNA, 25 bp, Mus musculus
ccccttacacagtattctcagactt

SEQ ID NO: 346556 - DNA, 25 bp, Mus musculus
ccccttacatgcagtggaatgagga

SEQ ID NO: 346557 - DNA, 25 bp, Mus musculus
ccccttacatgctgtggaatgagga

SEQ ID NO: 346558 - DNA, 25 bp, Mus musculus
ccccttactgtcattggtcagtgga

SEQ ID NO: 346559 - DNA, 25 bp, Mus musculus
ccccttactgtctttggtcagtgga

SEQ ID NO: 346560 - DNA, 25 bp, Mus musculus
ccccttagttctagaattgttatga

SEQ ID NO: 346561 - DNA, 25 bp, Mus musculus
ccccttagttcttgaattgttatga

SEQ ID NO: 346562 - DNA, 25 bp, Mus musculus
ccccttatccggaagaacatgatct

SEQ ID NO: 346563 - DNA, 25 bp, Mus musculus
ccccttatccggtagaacatgatct

SEQ ID NO: 346564 - DNA, 25 bp, Mus musculus
ccccttatctgtacatagtgactgt

SEQ ID NO: 346565 - DNA, 25 bp, Mus musculus
ccccttatctgttcatagtgactgt

SEQ ID NO: 346566 - DNA, 25 bp, Mus musculus
ccccttatgtacacgtgatttatcc

SEQ ID NO: 346567 - DNA, 25 bp, Mus musculus
ccccttatgtactcgtgatttatcc

SEQ ID NO: 346568 - DNA, 25 bp, Mus musculus
ccccttatttggagttggttcagct

SEQ ID NO: 346569 - DNA, 25 bp, Mus musculus
ccccttatttggtgttggttcagct

SEQ ID NO: 346570 - DNA, 25 bp, Mus musculus
ccccttcacacacagtaaggcttta

SEQ ID NO: 346571 - DNA, 25 bp, Mus musculus
ccccttcacacagagtaaggcttta

SEQ ID NO: 346572 - DNA, 25 bp, Mus musculus
ccccttcactttatgccaatctgtg

SEQ ID NO: 346573 - DNA, 25 bp, Mus musculus
ccccttcactttttgccaatctgtg

SEQ ID NO: 346574 - DNA, 25 bp, Mus musculus
ccccttcagaatacacttagcatta

SEQ ID NO: 346575 - DNA, 25 bp, Mus musculus
ccccttcagaattcacttagcatta

SEQ ID NO: 346576 - DNA, 25 bp, Mus musculus
ccccttcagctcattaggtcatttt

SEQ ID NO: 346577 - DNA, 25 bp, Mus musculus
ccccttcagctctttaggtcatttt

SEQ ID NO: 346578 - DNA, 25 bp, Mus musculus
ccccttcatcaacactgtgggcatg

SEQ ID NO: 346579 - DNA, 25 bp, Mus musculus
ccccttcatcaagactgtgggcatg

SEQ ID NO: 346580 - DNA, 25 bp, Mus musculus
ccccttcatggtcttcaggctgatg

SEQ ID NO: 346581 - DNA, 25 bp, Mus musculus
ccccttcatggtgttcaggctgatg

SEQ ID NO: 346582 - DNA, 25 bp, Mus musculus
ccccttcatttgcatagacctgagt

SEQ ID NO: 346583 - DNA, 25 bp, Mus musculus
ccccttcatttggatagacctgagt

SEQ ID NO: 346584 - DNA, 25 bp, Mus musculus
ccccttccagcgaattttgtatgtt

SEQ ID NO: 346585 - DNA, 25 bp, Mus musculus
ccccttccagcgtattttgtatgtt

SEQ ID NO: 346586 - DNA, 25 bp, Mus musculus
ccccttccatttagatagtataatc

SEQ ID NO: 346587 - DNA, 25 bp, Mus musculus
ccccttccattttgatagtataatc

SEQ ID NO: 346588 - DNA, 25 bp, Mus musculus
ccccttccccagattagaactggat

SEQ ID NO: 346589 - DNA, 25 bp, Mus musculus
ccccttccccagtttagaactggat

SEQ ID NO: 346590 - DNA, 25 bp, Mus musculus
ccccttcctgctcatgagtgagacg

SEQ ID NO: 346591 - DNA, 25 bp, Mus musculus
ccccttcctgctgatgagtgagacg

SEQ ID NO: 346592 - DNA, 25 bp, Mus musculus
ccccttcctggaaggaggcttgagg

SEQ ID NO: 346593 - DNA, 25 bp, Mus musculus
ccccttcctggatggaggcttgagg

SEQ ID NO: 346594 - DNA, 25 bp, Mus musculus
ccccttccttggcagtcatattgat

SEQ ID NO: 346595 - DNA, 25 bp, Mus musculus
ccccttccttgggagtcatattgat

SEQ ID NO: 346596 - DNA, 25 bp, Mus musculus
ccccttcgtggaatgatgtgtctga

SEQ ID NO: 346597 - DNA, 25 bp, Mus musculus
ccccttcgtggattgatgtgtctga

SEQ ID NO: 346598 - DNA, 25 bp, Mus musculus
ccccttctccacattagcaagaaag

SEQ ID NO: 346599 - DNA, 25 bp, Mus musculus
ccccttctccactttagcaagaaag

SEQ ID NO: 346600 - DNA, 25 bp, Mus musculus
ccccttctggctcttagaggaaaag

SEQ ID NO: 346601 - DNA, 25 bp, Mus musculus
ccccttctggctgttagaggaaaag

SEQ ID NO: 346602 - DNA, 25 bp, Mus musculus
ccccttcttcaacttatgggacaag

SEQ ID NO: 346603 - DNA, 25 bp, Mus musculus
ccccttcttcaagttatgggacaag

SEQ ID NO: 346604 - DNA, 25 bp, Mus musculus
ccccttcttggcagagagcactaga

SEQ ID NO: 346605 - DNA, 25 bp, Mus musculus
ccccttcttggctgagagcactaga

SEQ ID NO: 346606 - DNA, 25 bp, Mus musculus
ccccttctttacatattggcagaga

SEQ ID NO: 346607 - DNA, 25 bp, Mus musculus
ccccttctttacttattggcagaga

SEQ ID NO: 346608 - DNA, 25 bp, Mus musculus
ccccttctttgcatggacattttta

SEQ ID NO: 346609 - DNA, 25 bp, Mus musculus
ccccttctttgcttggacattttta

SEQ ID NO: 346610 - DNA, 25 bp, Mus musculus
ccccttctttgtagtggtcagtatt

SEQ ID NO: 346611 - DNA, 25 bp, Mus musculus
ccccttctttgttgtggtcagtatt

SEQ ID NO: 346612 - DNA, 25 bp, Mus musculus
ccccttgctttacgctgtatatagc

SEQ ID NO: 346613 - DNA, 25 bp, Mus musculus
ccccttgctttaggctgtatatagc

SEQ ID NO: 346614 - DNA, 25 bp, Mus musculus
ccccttggaagcaggtgaccttggc

SEQ ID NO: 346615 - DNA, 25 bp, Mus musculus
ccccttggaagctggtgaccttggc

SEQ ID NO: 346616 - DNA, 25 bp, Mus musculus
ccccttggaaggatgtgcatgctca

SEQ ID NO: 346617 - DNA, 25 bp, Mus musculus
ccccttggaaggttgtgcatgctca

SEQ ID NO: 346618 - DNA, 25 bp, Mus musculus
ccccttggagtcagctcacaaaaga

SEQ ID NO: 346619 - DNA, 25 bp, Mus musculus
ccccttggagtctgctcacaaaaga

SEQ ID NO: 346620 - DNA, 25 bp, Mus musculus
ccccttggatcaacaatggatgctc

SEQ ID NO: 346621 - DNA, 25 bp, Mus musculus
ccccttggatcatcaatggatgctc

SEQ ID NO: 346622 - DNA, 25 bp, Mus musculus
ccccttggatttcatgatgttgtac

SEQ ID NO: 346623 - DNA, 25 bp, Mus musculus
ccccttggatttgatgatgttgtac

SEQ ID NO: 346624 - DNA, 25 bp, Mus musculus
ccccttggctgtctatagcaaactg

SEQ ID NO: 346625 - DNA, 25 bp, Mus musculus
ccccttggctgtgtatagcaaactg

SEQ ID NO: 346626 - DNA, 25 bp, Mus musculus
ccccttggctttccaggtagacatt

SEQ ID NO: 346627 - DNA, 25 bp, Mus musculus
ccccttggctttgcaggtagacatt

SEQ ID NO: 346628 - DNA, 25 bp, Mus musculus
ccccttgggactcactctaaataat

SEQ ID NO: 346629 - DNA, 25 bp, Mus musculus
ccccttgggactgactctaaataat

SEQ ID NO: 346630 - DNA, 25 bp, Mus musculus
ccccttgtacttacataacttatat

SEQ ID NO: 346631 - DNA, 25 bp, Mus musculus
ccccttgtactttcataacttatat

SEQ ID NO: 346632 - DNA, 25 bp, Mus musculus
ccccttgtgagtactggtttgtgtg

SEQ ID NO: 346633 - DNA, 25 bp, Mus musculus
ccccttgtgagttctggtttgtgtg

SEQ ID NO: 346634 - DNA, 25 bp, Mus musculus
ccccttgtgcagatgctctttaaat

SEQ ID NO: 346635 - DNA, 25 bp, Mus musculus
ccccttgtgcagttgctctttaaat

SEQ ID NO: 346636 - DNA, 25 bp, Mus musculus
ccccttgtggctacgggaagaattg

SEQ ID NO: 346637 - DNA, 25 bp, Mus musculus
ccccttgtggcttcgggaagaattg

SEQ ID NO: 346638 - DNA, 25 bp, Mus musculus
ccccttgtgtataacgcctgtagac

SEQ ID NO: 346639 - DNA, 25 bp, Mus musculus
ccccttgtgtattacgcctgtagac

SEQ ID NO: 346640 - DNA, 25 bp, Mus musculus
cccctttaatggctgatcaggagca

SEQ ID NO: 346641 - DNA, 25 bp, Mus musculus
cccctttaatgggtgatcaggagca

SEQ ID NO: 346642 - DNA, 25 bp, Mus musculus
cccctttactgtccattgagttcta

SEQ ID NO: 346643 - DNA, 25 bp, Mus musculus
cccctttactgtgcattgagttcta

SEQ ID NO: 346644 - DNA, 25 bp, Mus musculus
cccctttattggaagttcacattag

SEQ ID NO: 346645 - DNA, 25 bp, Mus musculus
cccctttattggtagttcacattag

SEQ ID NO: 346646 - DNA, 25 bp, Mus musculus
cccctttccaccaaatcatttagat

SEQ ID NO: 346647 - DNA, 25 bp, Mus musculus
cccctttccacctaatcatttagat

SEQ ID NO: 346648 - DNA, 25 bp, Mus musculus
cccctttccctgactatgaaggaca

SEQ ID NO: 346649 - DNA, 25 bp, Mus musculus
cccctttccctgtctatgaaggaca

SEQ ID NO: 346650 - DNA, 25 bp, Mus musculus
cccctttctaggctacaggcaagca

SEQ ID NO: 346651 - DNA, 25 bp, Mus musculus
cccctttctagggtacaggcaagca

SEQ ID NO: 346652 - DNA, 25 bp, Mus musculus
cccctttctcaaaacggtggcatga

SEQ ID NO: 346653 - DNA, 25 bp, Mus musculus
cccctttctcaatacggtggcatga

SEQ ID NO: 346654 - DNA, 25 bp, Mus musculus
cccctttctggaatgttatgaactc

SEQ ID NO: 346655 - DNA, 25 bp, Mus musculus
cccctttctggattgttatgaactc

SEQ ID NO: 346656 - DNA, 25 bp, Mus musculus
cccctttgattacccgagtgtggca

SEQ ID NO: 346657 - DNA, 25 bp, Mus musculus
cccctttgattagccgagtgtggca

SEQ ID NO: 346658 - DNA, 25 bp, Mus musculus
cccctttgattcaaatgtctctatc

SEQ ID NO: 346659 - DNA, 25 bp, Mus musculus
cccctttgattctaatgtctctatc

SEQ ID NO: 346660 - DNA, 25 bp, Mus musculus
cccctttgattgaccttgtgatagg

SEQ ID NO: 346661 - DNA, 25 bp, Mus musculus
cccctttgattgtccttgtgatagg

SEQ ID NO: 346662 - DNA, 25 bp, Mus musculus
cccctttgggagaacattctagttg

SEQ ID NO: 346663 - DNA, 25 bp, Mus musculus
cccctttgggagtacattctagttg

SEQ ID NO: 346664 - DNA, 25 bp, Mus musculus
cccctttggtagctgtgtaattaca

SEQ ID NO: 346665 - DNA, 25 bp, Mus musculus
cccctttggtaggtgtgtaattaca

SEQ ID NO: 346666 - DNA, 25 bp, Mus musculus
cccctttgtctcaacatcaagtgtg

SEQ ID NO: 346667 - DNA, 25 bp, Mus musculus
cccctttgtctctacatcaagtgtg

SEQ ID NO: 346668 - DNA, 25 bp, Mus musculus
cccctttgttctatagcttatggat

SEQ ID NO: 346669 - DNA, 25 bp, Mus musculus
cccctttgttctttagcttatggat

SEQ ID NO: 346670 - DNA, 25 bp, Mus musculus
ccccttttaaatcagtgtatcttat

SEQ ID NO: 346671 - DNA, 25 bp, Mus musculus
ccccttttaaatgagtgtatcttat

SEQ ID NO: 346672 - DNA, 25 bp, Mus musculus
ccccttttacacagtagaggagaat

SEQ ID NO: 346673 - DNA, 25 bp, Mus musculus
ccccttttacactgtagaggagaat

SEQ ID NO: 346674 - DNA, 25 bp, Mus musculus
ccccttttacggatcaatatgtttg

SEQ ID NO: 346675 - DNA, 25 bp, Mus musculus
ccccttttacggttcaatatgtttg

SEQ ID NO: 346676 - DNA, 25 bp, Mus musculus
ccccttttcaaacattctatcatct

SEQ ID NO: 346677 - DNA, 25 bp, Mus musculus
ccccttttcaaaccattgaatgaag

SEQ ID NO: 346678 - DNA, 25 bp, Mus musculus
ccccttttcaaagattctatcatct

SEQ ID NO: 346679 - DNA, 25 bp, Mus musculus
ccccttttcaaagcattgaatgaag

SEQ ID NO: 346680 - DNA, 25 bp, Mus musculus
ccccttttcgacaacactcaaagat

SEQ ID NO: 346681 - DNA, 25 bp, Mus musculus
ccccttttcgactacactcaaagat

SEQ ID NO: 346682 - DNA, 25 bp, Mus musculus
ccccttttgaagacacctatatcta

SEQ ID NO: 346683 - DNA, 25 bp, Mus musculus
ccccttttgaagtcacctatatcta

SEQ ID NO: 346684 - DNA, 25 bp, Mus musculus
ccccttttgggaatgtggtggcatt

SEQ ID NO: 346685 - DNA, 25 bp, Mus musculus
ccccttttgggattgtggtggcatt

SEQ ID NO: 346686 - DNA, 25 bp, Mus musculus
ccccttttgtcaccatattagctgg

SEQ ID NO: 346687 - DNA, 25 bp, Mus musculus
ccccttttgtcagcatattagctgg

SEQ ID NO: 346688 - DNA, 25 bp, Mus musculus
cccctttttccacgctcagaagatg

SEQ ID NO: 346689 - DNA, 25 bp, Mus musculus
cccctttttccaggctcagaagatg

SEQ ID NO: 346690 - DNA, 25 bp, Mus musculus
cccctttttgcactattggcttgag

SEQ ID NO: 346691 - DNA, 25 bp, Mus musculus
cccctttttgcagtattggcttgag

SEQ ID NO: 346692 - DNA, 25 bp, Mus musculus
cccgaaacccagactaggccagaga

SEQ ID NO: 346693 - DNA, 25 bp, Mus musculus
cccgaaacccagtctaggccagaga

SEQ ID NO: 346694 - DNA, 25 bp, Mus musculus
cccgaaagttgacctcctggtgaag

SEQ ID NO: 346695 - DNA, 25 bp, Mus musculus
cccgaaagttgagctcctggtgaag

SEQ ID NO: 346696 - DNA, 25 bp, Mus musculus
cccgaaatctcactgggactatttg

SEQ ID NO: 346697 - DNA, 25 bp, Mus musculus
cccgaaatctcagtgggactatttg

SEQ ID NO: 346698 - DNA, 25 bp, Mus musculus
cccgaagaggccaatgtgtgcactt

SEQ ID NO: 346699 - DNA, 25 bp, Mus musculus
cccgaagaggcctatgtgtgcactt

SEQ ID NO: 346700 - DNA, 25 bp, Mus musculus
cccgaagatgtaccagacccttttg

SEQ ID NO: 346701 - DNA, 25 bp, Mus musculus
cccgaagatgtagcagacccttttg

SEQ ID NO: 346702 - DNA, 25 bp, Mus musculus
cccgaagttctaaagtgctggtcct

SEQ ID NO: 346703 - DNA, 25 bp, Mus musculus
cccgaagttctatagtgctggtcct

SEQ ID NO: 346704 - DNA, 25 bp, Mus musculus
cccgaatgctgacattgacgtagtc

SEQ ID NO: 346705 - DNA, 25 bp, Mus musculus
cccgaatgctgagattgacgtagtc

SEQ ID NO: 346706 - DNA, 25 bp, Mus musculus
cccgaatttcagcttcagctctggt

SEQ ID NO: 346707 - DNA, 25 bp, Mus musculus
cccgaatttcaggttcagctctggt

SEQ ID NO: 346708 - DNA, 25 bp, Mus musculus
cccgacaaaacacgtgagctggaaa

SEQ ID NO: 346709 - DNA, 25 bp, Mus musculus
cccgacaaaacaggtgagctggaaa

SEQ ID NO: 346710 - DNA, 25 bp, Mus musculus
cccgacaggaggctcaggatgtata

SEQ ID NO: 346711 - DNA, 25 bp, Mus musculus
cccgacaggagggtcaggatgtata

SEQ ID NO: 346712 - DNA, 25 bp, Mus musculus
cccgacatccagaggactgctgaga

SEQ ID NO: 346713 - DNA, 25 bp, Mus musculus
cccgacatccagtggactgctgaga

SEQ ID NO: 346714 - DNA, 25 bp, Mus musculus
cccgacattggaaagctagccctaa

SEQ ID NO: 346715 - DNA, 25 bp, Mus musculus
cccgacattggatagctagccctaa

SEQ ID NO: 346716 - DNA, 25 bp, Mus musculus
cccgaccacgtgattattgactttg

SEQ ID NO: 346717 - DNA, 25 bp, Mus musculus
cccgaccacgtgtttattgactttg

SEQ ID NO: 346718 - DNA, 25 bp, Mus musculus
cccgaccagtccctgaatatgtgaa

SEQ ID NO: 346719 - DNA, 25 bp, Mus musculus
cccgaccagtccgtgaatatgtgaa

SEQ ID NO: 346720 - DNA, 25 bp, Mus musculus
cccgacccctatctgaggaatgtaa

SEQ ID NO: 346721 - DNA, 25 bp, Mus musculus
cccgacccctatgtgaggaatgtaa

SEQ ID NO: 346722 - DNA, 25 bp, Mus musculus
cccgaccgtggccatgtgctggaaa

SEQ ID NO: 346723 - DNA, 25 bp, Mus musculus
cccgaccgtggcgatgtgctggaaa

SEQ ID NO: 346724 - DNA, 25 bp, Mus musculus
cccgacgctgaactgagccatgagg

SEQ ID NO: 346725 - DNA, 25 bp, Mus musculus
cccgacgctgaagtgagccatgagg

SEQ ID NO: 346726 - DNA, 25 bp, Mus musculus
cccgactactgcagccaagatgatg

SEQ ID NO: 346727 - DNA, 25 bp, Mus musculus
cccgactactgctgccaagatgatg

SEQ ID NO: 346728 - DNA, 25 bp, Mus musculus
cccgactatacaagcattcacacat

SEQ ID NO: 346729 - DNA, 25 bp, Mus musculus
cccgactatacatgcattcacacat

SEQ ID NO: 346730 - DNA, 25 bp, Mus musculus
cccgacttaggcactgtgcattaaa

SEQ ID NO: 346731 - DNA, 25 bp, Mus musculus
cccgacttaggctctgtgcattaaa

SEQ ID NO: 346732 - DNA, 25 bp, Mus musculus
cccgacttgatacacatggttcttg

SEQ ID NO: 346733 - DNA, 25 bp, Mus musculus
cccgacttgatagacatggttcttg

SEQ ID NO: 346734 - DNA, 25 bp, Mus musculus
cccgagagcatcactgttcatgttt

SEQ ID NO: 346735 - DNA, 25 bp, Mus musculus
cccgagagcatctctgttcatgttt

SEQ ID NO: 346736 - DNA, 25 bp, Mus musculus
cccgagagccaaacattcgagtctt

SEQ ID NO: 346737 - DNA, 25 bp, Mus musculus
cccgagagccaatcattcgagtctt

SEQ ID NO: 346738 - DNA, 25 bp, Mus musculus
cccgagagcggcagttgctgctttt

SEQ ID NO: 346739 - DNA, 25 bp, Mus musculus
cccgagagcggctgttgctgctttt

SEQ ID NO: 346740 - DNA, 25 bp, Mus musculus
cccgagaggacactgtgcttgtgaa

SEQ ID NO: 346741 - DNA, 25 bp, Mus musculus
cccgagaggacagtgtgcttgtgaa

SEQ ID NO: 346742 - DNA, 25 bp, Mus musculus
cccgagaggtgtcctccctgtaaga

SEQ ID NO: 346743 - DNA, 25 bp, Mus musculus
cccgagaggtgtgctccctgtaaga

SEQ ID NO: 346744 - DNA, 25 bp, Mus musculus
cccgagagttcaatggaagtttcct

SEQ ID NO: 346745 - DNA, 25 bp, Mus musculus
cccgagagttcattggaagtttcct

SEQ ID NO: 346746 - DNA, 25 bp, Mus musculus
cccgagatccccactattatgatga

SEQ ID NO: 346747 - DNA, 25 bp, Mus musculus
cccgagatcccctctattatgatga

SEQ ID NO: 346748 - DNA, 25 bp, Mus musculus
cccgagatgcagatggtgcccaagg

SEQ ID NO: 346749 - DNA, 25 bp, Mus musculus
cccgagatgcagttggtgcccaagg

SEQ ID NO: 346750 - DNA, 25 bp, Mus musculus
cccgagccgctgacatggatggata

SEQ ID NO: 346751 - DNA, 25 bp, Mus musculus
cccgagccgctgtcatggatggata

SEQ ID NO: 346752 - DNA, 25 bp, Mus musculus
cccgagccggatagctgggacgcac

SEQ ID NO: 346753 - DNA, 25 bp, Mus musculus
cccgagccggattgctgggacgcac

SEQ ID NO: 346754 - DNA, 25 bp, Mus musculus
cccgagcctgcgaactttataaaga

SEQ ID NO: 346755 - DNA, 25 bp, Mus musculus
cccgagcctgcgtactttataaaga

SEQ ID NO: 346756 - DNA, 25 bp, Mus musculus
cccgagcgccttcacgctaaaggaa

SEQ ID NO: 346757 - DNA, 25 bp, Mus musculus
cccgagcgccttgacgctaaaggaa

SEQ ID NO: 346758 - DNA, 25 bp, Mus musculus
cccgagctgaagaagtttatggaca

SEQ ID NO: 346759 - DNA, 25 bp, Mus musculus
cccgagctgaagtagtttatggaca

SEQ ID NO: 346760 - DNA, 25 bp, Mus musculus
cccgaggcagtcacagagctatagt

SEQ ID NO: 346761 - DNA, 25 bp, Mus musculus
cccgaggcagtctcagagctatagt

SEQ ID NO: 346762 - DNA, 25 bp, Mus musculus
cccgagggccgtaagttattgctgt

SEQ ID NO: 346763 - DNA, 25 bp, Mus musculus
cccgagggccgttagttattgctgt

SEQ ID NO: 346764 - DNA, 25 bp, Mus musculus
cccgagggctgactttagagtctgc

SEQ ID NO: 346765 - DNA, 25 bp, Mus musculus
cccgagggctgagtttagagtctgc

SEQ ID NO: 346766 - DNA, 25 bp, Mus musculus
cccgaggtaacaaggaccaggtggc

SEQ ID NO: 346767 - DNA, 25 bp, Mus musculus
cccgaggtaacatggaccaggtggc

SEQ ID NO: 346768 - DNA, 25 bp, Mus musculus
cccgaggtgtgcacattttgctgga

SEQ ID NO: 346769 - DNA, 25 bp, Mus musculus
cccgaggtgtgctcattttgctgga

SEQ ID NO: 346770 - DNA, 25 bp, Mus musculus
cccgaggttcctctgtattagaaat

SEQ ID NO: 346771 - DNA, 25 bp, Mus musculus
cccgaggttcctgtgtattagaaat

SEQ ID NO: 346772 - DNA, 25 bp, Mus musculus
cccgagtgctgcatctgacatggaa

SEQ ID NO: 346773 - DNA, 25 bp, Mus musculus
cccgagtgctgcttctgacatggaa

SEQ ID NO: 346774 - DNA, 25 bp, Mus musculus
cccgagttagcaatcggaagtcagt

SEQ ID NO: 346775 - DNA, 25 bp, Mus musculus
cccgagttagcattcggaagtcagt

SEQ ID NO: 346776 - DNA, 25 bp, Mus musculus
cccgagttcagactccggagctgcg

SEQ ID NO: 346777 - DNA, 25 bp, Mus musculus
cccgagttcagagtccggagctgcg

SEQ ID NO: 346778 - DNA, 25 bp, Mus musculus
cccgagttgtgaagagaagggccaa

SEQ ID NO: 346779 - DNA, 25 bp, Mus musculus
cccgagttgtgatgagaagggccaa

SEQ ID NO: 346780 - DNA, 25 bp, Mus musculus
cccgataccagaaatcctaccgata

SEQ ID NO: 346781 - DNA, 25 bp, Mus musculus
cccgataccagatatcctaccgata

SEQ ID NO: 346782 - DNA, 25 bp, Mus musculus
cccgatatgtgtaagacaccccatc

SEQ ID NO: 346783 - DNA, 25 bp, Mus musculus
cccgatatgtgttagacaccccatc

SEQ ID NO: 346784 - DNA, 25 bp, Mus musculus
cccgatcgatcaatataggtttatt

SEQ ID NO: 346785 - DNA, 25 bp, Mus musculus
cccgatcgatcattataggtttatt

SEQ ID NO: 346786 - DNA, 25 bp, Mus musculus
cccgatgagtttcagatttcttcta

SEQ ID NO: 346787 - DNA, 25 bp, Mus musculus
cccgatgagtttgagatttcttcta

SEQ ID NO: 346788 - DNA, 25 bp, Mus musculus
cccgatgggacaattgtgacagtga

SEQ ID NO: 346789 - DNA, 25 bp, Mus musculus
cccgatgggacatttgtgacagtga

SEQ ID NO: 346790 - DNA, 25 bp, Mus musculus
cccgattccggaaacaggcattttg

SEQ ID NO: 346791 - DNA, 25 bp, Mus musculus
cccgattccggatacaggcattttg

SEQ ID NO: 346792 - DNA, 25 bp, Mus musculus
cccgattccggccagatcaaaggtt

SEQ ID NO: 346793 - DNA, 25 bp, Mus musculus
cccgattccggcgagatcaaaggtt

SEQ ID NO: 346794 - DNA, 25 bp, Mus musculus
cccgattcttagcacattttattca

SEQ ID NO: 346795 - DNA, 25 bp, Mus musculus
cccgattcttaggacattttattca

SEQ ID NO: 346796 - DNA, 25 bp, Mus musculus
cccgatttacccaatgtttacacag

SEQ ID NO: 346797 - DNA, 25 bp, Mus musculus
cccgatttaccctatgtttacacag

SEQ ID NO: 346798 - DNA, 25 bp, Mus musculus
cccgatttccacagagagctggtgt

SEQ ID NO: 346799 - DNA, 25 bp, Mus musculus
cccgatttccactgagagctggtgt

SEQ ID NO: 346800 - DNA, 25 bp, Mus musculus
cccgcaaattttactggtaggcata

SEQ ID NO: 346801 - DNA, 25 bp, Mus musculus
cccgcaaatttttctggtaggcata

SEQ ID NO: 346802 - DNA, 25 bp, Mus musculus
cccgcaacctaacgacaagagcaat

SEQ ID NO: 346803 - DNA, 25 bp, Mus musculus
cccgcaacctaaggacaagagcaat

SEQ ID NO: 346804 - DNA, 25 bp, Mus musculus
cccgcaacctgtacagtgagttttt

SEQ ID NO: 346805 - DNA, 25 bp, Mus musculus
cccgcaacctgttcagtgagttttt

SEQ ID NO: 346806 - DNA, 25 bp, Mus musculus
cccgcaagcttaatcacatactgtt

SEQ ID NO: 346807 - DNA, 25 bp, Mus musculus
cccgcaagcttattcacatactgtt

SEQ ID NO: 346808 - DNA, 25 bp, Mus musculus
cccgcaagggtcaatcgaagggctt

SEQ ID NO: 346809 - DNA, 25 bp, Mus musculus
cccgcaagggtctatcgaagggctt

SEQ ID NO: 346810 - DNA, 25 bp, Mus musculus
cccgcacacggacacagacataaga

SEQ ID NO: 346811 - DNA, 25 bp, Mus musculus
cccgcacacggagacagacataaga

SEQ ID NO: 346812 - DNA, 25 bp, Mus musculus
cccgcactgcggataatttatctgt

SEQ ID NO: 346813 - DNA, 25 bp, Mus musculus
cccgcactgcggttaatttatctgt

SEQ ID NO: 346814 - DNA, 25 bp, Mus musculus
cccgcactgcttacgtgaattttgt

SEQ ID NO: 346815 - DNA, 25 bp, Mus musculus
cccgcactgctttcgtgaattttgt

SEQ ID NO: 346816 - DNA, 25 bp, Mus musculus
cccgcactgggtaagcctggcaaga

SEQ ID NO: 346817 - DNA, 25 bp, Mus musculus
cccgcactgggttagcctggcaaga

SEQ ID NO: 346818 - DNA, 25 bp, Mus musculus
cccgcagaccaacagacttagaagt

SEQ ID NO: 346819 - DNA, 25 bp, Mus musculus
cccgcagaccaagagacttagaagt

SEQ ID NO: 346820 - DNA, 25 bp, Mus musculus
cccgcagaggagacgccatgagcaa

SEQ ID NO: 346821 - DNA, 25 bp, Mus musculus
cccgcagaggagtcgccatgagcaa

SEQ ID NO: 346822 - DNA, 25 bp, Mus musculus
cccgcagctctacgatgtgatggat

SEQ ID NO: 346823 - DNA, 25 bp, Mus musculus
cccgcagctctaggatgtgatggat

SEQ ID NO: 346824 - DNA, 25 bp, Mus musculus
cccgcagctgtgaacttgtttgcat

SEQ ID NO: 346825 - DNA, 25 bp, Mus musculus
cccgcagctgtgtacttgtttgcat

SEQ ID NO: 346826 - DNA, 25 bp, Mus musculus
cccgcaggtataatcctgaaggcca

SEQ ID NO: 346827 - DNA, 25 bp, Mus musculus
cccgcaggtatattcctgaaggcca

SEQ ID NO: 346828 - DNA, 25 bp, Mus musculus
cccgcagtgagtccaggttctgttt

SEQ ID NO: 346829 - DNA, 25 bp, Mus musculus
cccgcagtgagtgcaggttctgttt

SEQ ID NO: 346830 - DNA, 25 bp, Mus musculus
cccgcagtgcttattacaccacaga

SEQ ID NO: 346831 - DNA, 25 bp, Mus musculus
cccgcagtgctttttacaccacaga

SEQ ID NO: 346832 - DNA, 25 bp, Mus musculus
cccgcatataagctttggaggttca

SEQ ID NO: 346833 - DNA, 25 bp, Mus musculus
cccgcatataaggtttggaggttca

SEQ ID NO: 346834 - DNA, 25 bp, Mus musculus
cccgcatgattcccgcgccgctgct

SEQ ID NO: 346835 - DNA, 25 bp, Mus musculus
cccgcatgattcgcgcgccgctgct

SEQ ID NO: 346836 - DNA, 25 bp, Mus musculus
cccgcatgcatccacgggatctgat

SEQ ID NO: 346837 - DNA, 25 bp, Mus musculus
cccgcatgcatcgacgggatctgat

SEQ ID NO: 346838 - DNA, 25 bp, Mus musculus
cccgccaaggacagaggttctctga

SEQ ID NO: 346839 - DNA, 25 bp, Mus musculus
cccgccaaggactgaggttctctga

SEQ ID NO: 346840 - DNA, 25 bp, Mus musculus
cccgccactggaatgactctaagga

SEQ ID NO: 346841 - DNA, 25 bp, Mus musculus
cccgccactggattgactctaagga

SEQ ID NO: 346842 - DNA, 25 bp, Mus musculus
cccgccagcctccattttagatgga

SEQ ID NO: 346843 - DNA, 25 bp, Mus musculus
cccgccagcctcgattttagatgga

SEQ ID NO: 346844 - DNA, 25 bp, Mus musculus
cccgccatacaccattttattgttg

SEQ ID NO: 346845 - DNA, 25 bp, Mus musculus
cccgccatacacgattttattgttg

SEQ ID NO: 346846 - DNA, 25 bp, Mus musculus
cccgccatttacagacacgtagtgt

SEQ ID NO: 346847 - DNA, 25 bp, Mus musculus
cccgccatttactgacacgtagtgt

SEQ ID NO: 346848 - DNA, 25 bp, Mus musculus
cccgcccaggtacaggcttgtttat

SEQ ID NO: 346849 - DNA, 25 bp, Mus musculus
cccgcccaggtagaggcttgtttat

SEQ ID NO: 346850 - DNA, 25 bp, Mus musculus
cccgccctttttactaatgtggatg

SEQ ID NO: 346851 - DNA, 25 bp, Mus musculus
cccgcccttttttctaatgtggatg

SEQ ID NO: 346852 - DNA, 25 bp, Mus musculus
cccgccgacgccagtaggtgacagg

SEQ ID NO: 346853 - DNA, 25 bp, Mus musculus
cccgccgacgcctgtaggtgacagg

SEQ ID NO: 346854 - DNA, 25 bp, Mus musculus
cccgccgtgttcaatgacatttcat

SEQ ID NO: 346855 - DNA, 25 bp, Mus musculus
cccgccgtgttctatgacatttcat

SEQ ID NO: 346856 - DNA, 25 bp, Mus musculus
cccgcctaattcaaaagtcgaggtg

SEQ ID NO: 346857 - DNA, 25 bp, Mus musculus
cccgcctaattctaaagtcgaggtg

SEQ ID NO: 346858 - DNA, 25 bp, Mus musculus
cccgcctcacacaacagtttaagat

SEQ ID NO: 346859 - DNA, 25 bp, Mus musculus
cccgcctcacactacagtttaagat

SEQ ID NO: 346860 - DNA, 25 bp, Mus musculus
cccgcctctgacatgggagagcata

SEQ ID NO: 346861 - DNA, 25 bp, Mus musculus
cccgcctctgacttgggagagcata

SEQ ID NO: 346862 - DNA, 25 bp, Mus musculus
cccgcctctggtacatggattgtga

SEQ ID NO: 346863 - DNA, 25 bp, Mus musculus
cccgcctctggttcatggattgtga

SEQ ID NO: 346864 - DNA, 25 bp, Mus musculus
cccgcctgacacacagctatatgaa

SEQ ID NO: 346865 - DNA, 25 bp, Mus musculus
cccgcctgacactcagctatatgaa

SEQ ID NO: 346866 - DNA, 25 bp, Mus musculus
cccgccttcatgactgatggatcag

SEQ ID NO: 346867 - DNA, 25 bp, Mus musculus
cccgccttcatgtctgatggatcag

SEQ ID NO: 346868 - DNA, 25 bp, Mus musculus
cccgcgcctgatcaagtagtttgga

SEQ ID NO: 346869 - DNA, 25 bp, Mus musculus
cccgcgcctgatgaagtagtttgga

SEQ ID NO: 346870 - DNA, 25 bp, Mus musculus
cccgcgctgtttagatctgttttca

SEQ ID NO: 346871 - DNA, 25 bp, Mus musculus
cccgcgctgttttgatctgttttca

SEQ ID NO: 346872 - DNA, 25 bp, Mus musculus
cccgcgcttggcatgaggactcgag

SEQ ID NO: 346873 - DNA, 25 bp, Mus musculus
cccgcgcttggcttgaggactcgag

SEQ ID NO: 346874 - DNA, 25 bp, Mus musculus
cccgcggacaagcccgaggagaact

SEQ ID NO: 346875 - DNA, 25 bp, Mus musculus
cccgcggacaaggccgaggagaact

SEQ ID NO: 346876 - DNA, 25 bp, Mus musculus
cccgcggaccatcatgactttgtga

SEQ ID NO: 346877 - DNA, 25 bp, Mus musculus
cccgcggaccatgatgactttgtga

SEQ ID NO: 346878 - DNA, 25 bp, Mus musculus
cccgcggtgtgcagaaggtgttcct

SEQ ID NO: 346879 - DNA, 25 bp, Mus musculus
cccgcggtgtgctgaaggtgttcct

SEQ ID NO: 346880 - DNA, 25 bp, Mus musculus
cccgctacatgacatacaattgagc

SEQ ID NO: 346881 - DNA, 25 bp, Mus musculus
cccgctacatgagatacaattgagc

SEQ ID NO: 346882 - DNA, 25 bp, Mus musculus
cccgctaccataaacaggaagatat

SEQ ID NO: 346883 - DNA, 25 bp, Mus musculus
cccgctaccatatacaggaagatat

SEQ ID NO: 346884 - DNA, 25 bp, Mus musculus
cccgctaccgcaacttgaactgtga

SEQ ID NO: 346885 - DNA, 25 bp, Mus musculus
cccgctaccgcatcttgaactgtga

SEQ ID NO: 346886 - DNA, 25 bp, Mus musculus
cccgctatgcaaatgtgcttttgtt

SEQ ID NO: 346887 - DNA, 25 bp, Mus musculus
cccgctatgcaattgtgcttttgtt

SEQ ID NO: 346888 - DNA, 25 bp, Mus musculus
cccgctatgggcatgatcttcaagg

SEQ ID NO: 346889 - DNA, 25 bp, Mus musculus
cccgctatgggcttgatcttcaagg

SEQ ID NO: 346890 - DNA, 25 bp, Mus musculus
cccgctatttctcatgattcgtcaa

SEQ ID NO: 346891 - DNA, 25 bp, Mus musculus
cccgctatttctgatgattcgtcaa

SEQ ID NO: 346892 - DNA, 25 bp, Mus musculus
cccgctcacaacatggaacttacat

SEQ ID NO: 346893 - DNA, 25 bp, Mus musculus
cccgctcacaacttggaacttacat

SEQ ID NO: 346894 - DNA, 25 bp, Mus musculus
cccgctcagaccattttagactata

SEQ ID NO: 346895 - DNA, 25 bp, Mus musculus
cccgctcagacctttttagactata

SEQ ID NO: 346896 - DNA, 25 bp, Mus musculus
cccgctcatctccagtatgtgattg

SEQ ID NO: 346897 - DNA, 25 bp, Mus musculus
cccgctcatctcgagtatgtgattg

SEQ ID NO: 346898 - DNA, 25 bp, Mus musculus
cccgctcatttccacatagaacttt

SEQ ID NO: 346899 - DNA, 25 bp, Mus musculus
cccgctcatttcgacatagaacttt

SEQ ID NO: 346900 - DNA, 25 bp, Mus musculus
cccgctcgagtgctggtagatgtat

SEQ ID NO: 346901 - DNA, 25 bp, Mus musculus
cccgctcgagtggtggtagatgtat

SEQ ID NO: 346902 - DNA, 25 bp, Mus musculus
cccgctctctcacggaattaaagat

SEQ ID NO: 346903 - DNA, 25 bp, Mus musculus
cccgctctctcagggaattaaagat

SEQ ID NO: 346904 - DNA, 25 bp, Mus musculus
cccgctctgatcaacggaggactat

SEQ ID NO: 346905 - DNA, 25 bp, Mus musculus
cccgctctgatctacggaggactat

SEQ ID NO: 346906 - DNA, 25 bp, Mus musculus
cccgctctggttactactagatgac

SEQ ID NO: 346907 - DNA, 25 bp, Mus musculus
cccgctctggtttctactagatgac

SEQ ID NO: 346908 - DNA, 25 bp, Mus musculus
cccgctgaccgcccagccgcatgaa

SEQ ID NO: 346909 - DNA, 25 bp, Mus musculus
cccgctgaccgcgcagccgcatgaa

SEQ ID NO: 346910 - DNA, 25 bp, Mus musculus
cccgctgagcgtcgaacagggcaca

SEQ ID NO: 346911 - DNA, 25 bp, Mus musculus
cccgctgagcgtggaacagggcaca

SEQ ID NO: 346912 - DNA, 25 bp, Mus musculus
cccgctgcagccattttaattcatg

SEQ ID NO: 346913 - DNA, 25 bp, Mus musculus
cccgctgcagcctttttaattcatg

SEQ ID NO: 346914 - DNA, 25 bp, Mus musculus
cccgctgcctttagtgttaatgatc

SEQ ID NO: 346915 - DNA, 25 bp, Mus musculus
cccgctgccttttgtgttaatgatc

SEQ ID NO: 346916 - DNA, 25 bp, Mus musculus
cccgctgcgcagatattttgagtct

SEQ ID NO: 346917 - DNA, 25 bp, Mus musculus
cccgctgcgcagttattttgagtct

SEQ ID NO: 346918 - DNA, 25 bp, Mus musculus
cccgctgtaaaaactagttgctata

SEQ ID NO: 346919 - DNA, 25 bp, Mus musculus
cccgctgtaaaatctagttgctata

SEQ ID NO: 346920 - DNA, 25 bp, Mus musculus
cccgctgtagggatgcagggccaca

SEQ ID NO: 346921 - DNA, 25 bp, Mus musculus
cccgctgtagggttgcagggccaca

SEQ ID NO: 346922 - DNA, 25 bp, Mus musculus
cccgctgtccctaaaaaagtgctgt

SEQ ID NO: 346923 - DNA, 25 bp, Mus musculus
cccgctgtcccttaaaaagtgctgt

SEQ ID NO: 346924 - DNA, 25 bp, Mus musculus
cccgctgtgcatccatttttgatat

SEQ ID NO: 346925 - DNA, 25 bp, Mus musculus
cccgctgtgcatgcatttttgatat

SEQ ID NO: 346926 - DNA, 25 bp, Mus musculus
cccgctgttgcaagtctgttattta

SEQ ID NO: 346927 - DNA, 25 bp, Mus musculus
cccgctgttgcatgtctgttattta

SEQ ID NO: 346928 - DNA, 25 bp, Mus musculus
cccgcttccgaaaactggcagaact

SEQ ID NO: 346929 - DNA, 25 bp, Mus musculus
cccgcttccgaatactggcagaact

SEQ ID NO: 346930 - DNA, 25 bp, Mus musculus
cccgcttctgcaactcgaataaata

SEQ ID NO: 346931 - DNA, 25 bp, Mus musculus
cccgcttctgcatctcgaataaata

SEQ ID NO: 346932 - DNA, 25 bp, Mus musculus
cccgcttggtagaatgttagcacgt

SEQ ID NO: 346933 - DNA, 25 bp, Mus musculus
cccgcttggtagtatgttagcacgt

SEQ ID NO: 346934 - DNA, 25 bp, Mus musculus
cccgctttcgctaaagatttacagt

SEQ ID NO: 346935 - DNA, 25 bp, Mus musculus
cccgctttcgcttaagatttacagt

SEQ ID NO: 346936 - DNA, 25 bp, Mus musculus
cccgctttctgaccaggcacggtag

SEQ ID NO: 346937 - DNA, 25 bp, Mus musculus
cccgctttctgagcaggcacggtag

SEQ ID NO: 346938 - DNA, 25 bp, Mus musculus
cccgctttgttcagactgtctgtga

SEQ ID NO: 346939 - DNA, 25 bp, Mus musculus
cccgctttgttctgactgtctgtga

SEQ ID NO: 346940 - DNA, 25 bp, Mus musculus
cccggaaactcaacatcaactactt

SEQ ID NO: 346941 - DNA, 25 bp, Mus musculus
cccggaaactcatcatcaactactt

SEQ ID NO: 346942 - DNA, 25 bp, Mus musculus
cccggaaatcttcgatgctccaaag

SEQ ID NO: 346943 - DNA, 25 bp, Mus musculus
cccggaaatcttggatgctccaaag

SEQ ID NO: 346944 - DNA, 25 bp, Mus musculus
cccggaactgcactgctgggtacag

SEQ ID NO: 346945 - DNA, 25 bp, Mus musculus
cccggaactgcagtgctgggtacag

SEQ ID NO: 346946 - DNA, 25 bp, Mus musculus
cccggaagtacgacatgggtcactt

SEQ ID NO: 346947 - DNA, 25 bp, Mus musculus
cccggaagtacgtcatgggtcactt

SEQ ID NO: 346948 - DNA, 25 bp, Mus musculus
cccggaatgtgtcacaagcccagat

SEQ ID NO: 346949 - DNA, 25 bp, Mus musculus
cccggaatgtgtgacaagcccagat

SEQ ID NO: 346950 - DNA, 25 bp, Mus musculus
cccggaattgttatctgttcaagat

SEQ ID NO: 346951 - DNA, 25 bp, Mus musculus
cccggaattgttttctgttcaagat

SEQ ID NO: 346952 - DNA, 25 bp, Mus musculus
cccggacactgcctgtgccagggaa

SEQ ID NO: 346953 - DNA, 25 bp, Mus musculus
cccggacactgcgtgtgccagggaa

SEQ ID NO: 346954 - DNA, 25 bp, Mus musculus
cccggacaggtgagggctcagacca

SEQ ID NO: 346955 - DNA, 25 bp, Mus musculus
cccggacaggtgtgggctcagacca

SEQ ID NO: 346956 - DNA, 25 bp, Mus musculus
cccggacagtgaaggctgtcctcag

SEQ ID NO: 346957 - DNA, 25 bp, Mus musculus
cccggacagtgatggctgtcctcag

SEQ ID NO: 346958 - DNA, 25 bp, Mus musculus
cccggacatggacgttaagtatccg

SEQ ID NO: 346959 - DNA, 25 bp, Mus musculus
cccggacatggaggttaagtatccg

SEQ ID NO: 346960 - DNA, 25 bp, Mus musculus
cccggacctggccttacagagagtt

SEQ ID NO: 346961 - DNA, 25 bp, Mus musculus
cccggacctggcgttacagagagtt

SEQ ID NO: 346962 - DNA, 25 bp, Mus musculus
cccggactcgagagaggcaggcctt

SEQ ID NO: 346963 - DNA, 25 bp, Mus musculus
cccggactcgagtgaggcaggcctt

SEQ ID NO: 346964 - DNA, 25 bp, Mus musculus
cccggactcgggagcagcttcaggc

SEQ ID NO: 346965 - DNA, 25 bp, Mus musculus
cccggactcgggtgcagcttcaggc

SEQ ID NO: 346966 - DNA, 25 bp, Mus musculus
cccggactctttcgagactcggtgc

SEQ ID NO: 346967 - DNA, 25 bp, Mus musculus
cccggactctttggagactcggtgc

SEQ ID NO: 346968 - DNA, 25 bp, Mus musculus
cccggagaacttctttccctgaatg

SEQ ID NO: 346969 - DNA, 25 bp, Mus musculus
cccggagaacttgtttccctgaatg

SEQ ID NO: 346970 - DNA, 25 bp, Mus musculus
cccggagagggcacattgacgtgaa

SEQ ID NO: 346971 - DNA, 25 bp, Mus musculus
cccggagagggctcattgacgtgaa

SEQ ID NO: 346972 - DNA, 25 bp, Mus musculus
cccggagcggcacaaatcctaaaat

SEQ ID NO: 346973 - DNA, 25 bp, Mus musculus
cccggagcggcagaaatcctaaaat

SEQ ID NO: 346974 - DNA, 25 bp, Mus musculus
cccggagcgggccaacgagctgggt

SEQ ID NO: 346975 - DNA, 25 bp, Mus musculus
cccggagcgggcgaacgagctgggt

SEQ ID NO: 346976 - DNA, 25 bp, Mus musculus
cccggagctcgacatagatgtggat

SEQ ID NO: 346977 - DNA, 25 bp, Mus musculus
cccggagctcgagatagatgtggat

SEQ ID NO: 346978 - DNA, 25 bp, Mus musculus
cccggaggctacctttgacttagat

SEQ ID NO: 346979 - DNA, 25 bp, Mus musculus
cccggaggctacgtttgacttagat

SEQ ID NO: 346980 - DNA, 25 bp, Mus musculus
cccggagtgcgacggcagctgagcc

SEQ ID NO: 346981 - DNA, 25 bp, Mus musculus
cccggagtgcgagggcagctgagcc

SEQ ID NO: 346982 - DNA, 25 bp, Mus musculus
cccggatatggcacgtggacagcag

SEQ ID NO: 346983 - DNA, 25 bp, Mus musculus
cccggatatggctcgtggacagcag

SEQ ID NO: 346984 - DNA, 25 bp, Mus musculus
cccggatctggcaattcccgtgatg

SEQ ID NO: 346985 - DNA, 25 bp, Mus musculus
cccggatctggctattcccgtgatg

SEQ ID NO: 346986 - DNA, 25 bp, Mus musculus
cccggatgacgccaaacttacaaag

SEQ ID NO: 346987 - DNA, 25 bp, Mus musculus
cccggatgacgcgaaacttacaaag

SEQ ID NO: 346988 - DNA, 25 bp, Mus musculus
cccggatgtggaaggagaccccagt

SEQ ID NO: 346989 - DNA, 25 bp, Mus musculus
cccggatgtggatggagaccccagt

SEQ ID NO: 346990 - DNA, 25 bp, Mus musculus
cccggattcgtccagtcagtgacat

SEQ ID NO: 346991 - DNA, 25 bp, Mus musculus
cccggattcgtcgagtcagtgacat

SEQ ID NO: 346992 - DNA, 25 bp, Mus musculus
cccggcaaggacacacagtatggat

SEQ ID NO: 346993 - DNA, 25 bp, Mus musculus
cccggcaaggactcacagtatggat

SEQ ID NO: 346994 - DNA, 25 bp, Mus musculus
cccggcacgcacattagtaagttat

SEQ ID NO: 346995 - DNA, 25 bp, Mus musculus
cccggcacgcactttagtaagttat

SEQ ID NO: 346996 - DNA, 25 bp, Mus musculus
cccggcagctgaaatgaatcaactg

SEQ ID NO: 346997 - DNA, 25 bp, Mus musculus
cccggcagctgatatgaatcaactg

SEQ ID NO: 346998 - DNA, 25 bp, Mus musculus
cccggcatacctcttagtgtcttaa

SEQ ID NO: 346999 - DNA, 25 bp, Mus musculus
cccggcatacctgttagtgtcttaa

SEQ ID NO: 347000 - DNA, 25 bp, Mus musculus
cccggcatcctgcagagcatgagct

SEQ ID NO: 347001 - DNA, 25 bp, Mus musculus
cccggcatcctggagagcatgagct

SEQ ID NO: 347002 - DNA, 25 bp, Mus musculus
cccggccatcatatgggattttgaa

SEQ ID NO: 347003 - DNA, 25 bp, Mus musculus
cccggccatcatttgggattttgaa

SEQ ID NO: 347004 - DNA, 25 bp, Mus musculus
cccggcctggccagagagattagat

SEQ ID NO: 347005 - DNA, 25 bp, Mus musculus
cccggcctggcctgagagattagat

SEQ ID NO: 347006 - DNA, 25 bp, Mus musculus
cccggcgaagaccacgagttgcagt

SEQ ID NO: 347007 - DNA, 25 bp, Mus musculus
cccggcgaagacgacgagttgcagt

SEQ ID NO: 347008 - DNA, 25 bp, Mus musculus
cccggcggatgtatttattgtacaa

SEQ ID NO: 347009 - DNA, 25 bp, Mus musculus
cccggcggatgtttttattgtacaa

SEQ ID NO: 347010 - DNA, 25 bp, Mus musculus
cccggcggcgatccgaagatactta

SEQ ID NO: 347011 - DNA, 25 bp, Mus musculus
cccggcggcgatgcgaagatactta

SEQ ID NO: 347012 - DNA, 25 bp, Mus musculus
cccggcgtattaaggagttttatgt

SEQ ID NO: 347013 - DNA, 25 bp, Mus musculus
cccggcgtattatggagttttatgt

SEQ ID NO: 347014 - DNA, 25 bp, Mus musculus
cccggcgtctgtatgaaggcaatgc

SEQ ID NO: 347015 - DNA, 25 bp, Mus musculus
cccggcgtctgtttgaaggcaatgc

SEQ ID NO: 347016 - DNA, 25 bp, Mus musculus
cccggctaggtaccatttcatttct

SEQ ID NO: 347017 - DNA, 25 bp, Mus musculus
cccggctaggtagcatttcatttct

SEQ ID NO: 347018 - DNA, 25 bp, Mus musculus
cccggctcaagcattaagacatcct

SEQ ID NO: 347019 - DNA, 25 bp, Mus musculus
cccggctcaagctttaagacatcct

SEQ ID NO: 347020 - DNA, 25 bp, Mus musculus
cccggctccggcagaagggaatgaa

SEQ ID NO: 347021 - DNA, 25 bp, Mus musculus
cccggctccggctgaagggaatgaa

SEQ ID NO: 347022 - DNA, 25 bp, Mus musculus
cccggctctgtcaccgaaagcgaga

SEQ ID NO: 347023 - DNA, 25 bp, Mus musculus
cccggctctgtctccgaaagcgaga

SEQ ID NO: 347024 - DNA, 25 bp, Mus musculus
cccggctggaatacaacacttgtat

SEQ ID NO: 347025 - DNA, 25 bp, Mus musculus
cccggctggaattcaacacttgtat

SEQ ID NO: 347026 - DNA, 25 bp, Mus musculus
cccggctggatgagctgccatatga

SEQ ID NO: 347027 - DNA, 25 bp, Mus musculus
cccggctggatgtgctgccatatga

SEQ ID NO: 347028 - DNA, 25 bp, Mus musculus
cccggctggtaacttgggcagttgt

SEQ ID NO: 347029 - DNA, 25 bp, Mus musculus
cccggctggtaagttgggcagttgt

SEQ ID NO: 347030 - DNA, 25 bp, Mus musculus
cccggcttcactcttgactaataaa

SEQ ID NO: 347031 - DNA, 25 bp, Mus musculus
cccggcttcactgttgactaataaa

SEQ ID NO: 347032 - DNA, 25 bp, Mus musculus
cccggcttcccaatttatgcatttg

SEQ ID NO: 347033 - DNA, 25 bp, Mus musculus
cccggcttcccattttatgcatttg

SEQ ID NO: 347034 - DNA, 25 bp, Mus musculus
cccggcttcggacaggacagagtta

SEQ ID NO: 347035 - DNA, 25 bp, Mus musculus
cccggcttcggagaggacagagtta

SEQ ID NO: 347036 - DNA, 25 bp, Mus musculus
cccggcttgcagactctgtcttaaa

SEQ ID NO: 347037 - DNA, 25 bp, Mus musculus
cccggcttgcagtctctgtcttaaa

SEQ ID NO: 347038 - DNA, 25 bp, Mus musculus
cccgggaactgtacgcagttgacaa

SEQ ID NO: 347039 - DNA, 25 bp, Mus musculus
cccgggaactgttcgcagttgacaa

SEQ ID NO: 347040 - DNA, 25 bp, Mus musculus
cccgggagctgtagacgctagacga

SEQ ID NO: 347041 - DNA, 25 bp, Mus musculus
cccgggagctgttgacgctagacga

SEQ ID NO: 347042 - DNA, 25 bp, Mus musculus
cccgggagtgatcccctgaaggatt

SEQ ID NO: 347043 - DNA, 25 bp, Mus musculus
cccgggagtgatgccctgaaggatt

SEQ ID NO: 347044 - DNA, 25 bp, Mus musculus
cccgggatctccaggcggtgttgaa

SEQ ID NO: 347045 - DNA, 25 bp, Mus musculus
cccgggatctcctggcggtgttgaa

SEQ ID NO: 347046 - DNA, 25 bp, Mus musculus
cccgggatgtgtcttctgagtgcca

SEQ ID NO: 347047 - DNA, 25 bp, Mus musculus
cccgggatgtgtgttctgagtgcca

SEQ ID NO: 347048 - DNA, 25 bp, Mus musculus
cccgggcaatatatccattcttcct

SEQ ID NO: 347049 - DNA, 25 bp, Mus musculus
cccgggcaatatttccattcttcct

SEQ ID NO: 347050 - DNA, 25 bp, Mus musculus
cccgggcagctgctccagttgatgc

SEQ ID NO: 347051 - DNA, 25 bp, Mus musculus
cccgggcagctggtccagttgatgc

SEQ ID NO: 347052 - DNA, 25 bp, Mus musculus
cccgggcaggccaaaaggaggatca

SEQ ID NO: 347053 - DNA, 25 bp, Mus musculus
cccgggcaggccaggaattcgaata

SEQ ID NO: 347054 - DNA, 25 bp, Mus musculus
cccgggcaggcctaaaggaggatca

SEQ ID NO: 347055 - DNA, 25 bp, Mus musculus
cccgggcaggcctggaattcgaata

SEQ ID NO: 347056 - DNA, 25 bp, Mus musculus
cccgggcatactctaccaacagggt

SEQ ID NO: 347057 - DNA, 25 bp, Mus musculus
cccgggcatactgtaccaacagggt

SEQ ID NO: 347058 - DNA, 25 bp, Mus musculus
cccgggcgaaaaaggagtgcaagat

SEQ ID NO: 347059 - DNA, 25 bp, Mus musculus
cccgggcgaaaatggagtgcaagat

SEQ ID NO: 347060 - DNA, 25 bp, Mus musculus
cccgggctccttcggctttcaggat

SEQ ID NO: 347061 - DNA, 25 bp, Mus musculus
cccgggctccttgggctttcaggat

SEQ ID NO: 347062 - DNA, 25 bp, Mus musculus
cccgggctgatgctggtgttataat

SEQ ID NO: 347063 - DNA, 25 bp, Mus musculus
cccgggctgatggtggtgttataat

SEQ ID NO: 347064 - DNA, 25 bp, Mus musculus
cccgggcttggcatagtcctggaga

SEQ ID NO: 347065 - DNA, 25 bp, Mus musculus
cccgggcttggcttagtcctggaga

SEQ ID NO: 347066 - DNA, 25 bp, Mus musculus
cccgggctttagagtgatcccaact

SEQ ID NO: 347067 - DNA, 25 bp, Mus musculus
cccgggctttagtgtgatcccaact

SEQ ID NO: 347068 - DNA, 25 bp, Mus musculus
cccgggtaaggcagtgatattaaag

SEQ ID NO: 347069 - DNA, 25 bp, Mus musculus
cccgggtaaggctgtgatattaaag

SEQ ID NO: 347070 - DNA, 25 bp, Mus musculus
cccgggtccagaagccaaagtgcat

SEQ ID NO: 347071 - DNA, 25 bp, Mus musculus
cccgggtccagatgccaaagtgcat

SEQ ID NO: 347072 - DNA, 25 bp, Mus musculus
cccgggtggatgctctcatttctga

SEQ ID NO: 347073 - DNA, 25 bp, Mus musculus
cccgggtggatggtctcatttctga

SEQ ID NO: 347074 - DNA, 25 bp, Mus musculus
cccgggtggtggcagagatttggtc

SEQ ID NO: 347075 - DNA, 25 bp, Mus musculus
cccgggtggtgggagagatttggtc

SEQ ID NO: 347076 - DNA, 25 bp, Mus musculus
cccgggttaaggctgtactgactag

SEQ ID NO: 347077 - DNA, 25 bp, Mus musculus
cccgggttaagggtgtactgactag

SEQ ID NO: 347078 - DNA, 25 bp, Mus musculus
cccggtatagttagtataaatccat

SEQ ID NO: 347079 - DNA, 25 bp, Mus musculus
cccggtatagtttgtataaatccat

SEQ ID NO: 347080 - DNA, 25 bp, Mus musculus
cccggtcagataactttatagactt

SEQ ID NO: 347081 - DNA, 25 bp, Mus musculus
cccggtcagatatctttatagactt

SEQ ID NO: 347082 - DNA, 25 bp, Mus musculus
cccggtcccatcacaggtaagaaag

SEQ ID NO: 347083 - DNA, 25 bp, Mus musculus
cccggtcccatctcaggtaagaaag

SEQ ID NO: 347084 - DNA, 25 bp, Mus musculus
cccggtccctcaatctgaaactggg

SEQ ID NO: 347085 - DNA, 25 bp, Mus musculus
cccggtccctcattctgaaactggg

SEQ ID NO: 347086 - DNA, 25 bp, Mus musculus
cccggtctcttaacatgactcaggt

SEQ ID NO: 347087 - DNA, 25 bp, Mus musculus
cccggtctcttatcatgactcaggt

SEQ ID NO: 347088 - DNA, 25 bp, Mus musculus
cccggtgaactccatcctcagtggg

SEQ ID NO: 347089 - DNA, 25 bp, Mus musculus
cccggtgaactcgatcctcagtggg

SEQ ID NO: 347090 - DNA, 25 bp, Mus musculus
cccggtgacagactgaggcaagtat

SEQ ID NO: 347091 - DNA, 25 bp, Mus musculus
cccggtgacagagtgaggcaagtat

SEQ ID NO: 347092 - DNA, 25 bp, Mus musculus
cccggtgcatacaggagagctggac

SEQ ID NO: 347093 - DNA, 25 bp, Mus musculus
cccggtgcatactggagagctggac

SEQ ID NO: 347094 - DNA, 25 bp, Mus musculus
cccggtggagacaagtggtgacaat

SEQ ID NO: 347095 - DNA, 25 bp, Mus musculus
cccggtggagactagtggtgacaat

SEQ ID NO: 347096 - DNA, 25 bp, Mus musculus
cccggtggccatctaatacttatta

SEQ ID NO: 347097 - DNA, 25 bp, Mus musculus
cccggtggccatgtaatacttatta

SEQ ID NO: 347098 - DNA, 25 bp, Mus musculus
cccggtggtgcacatagacagacgc

SEQ ID NO: 347099 - DNA, 25 bp, Mus musculus
cccggtggtgcagatagacagacgc

SEQ ID NO: 347100 - DNA, 25 bp, Mus musculus
cccggtgtatcacgaaaagatcatc

SEQ ID NO: 347101 - DNA, 25 bp, Mus musculus
cccggtgtatcaggaaaagatcatc

SEQ ID NO: 347102 - DNA, 25 bp, Mus musculus
cccggtgtgggaattctaagttcat

SEQ ID NO: 347103 - DNA, 25 bp, Mus musculus
cccggtgtgggatttctaagttcat

SEQ ID NO: 347104 - DNA, 25 bp, Mus musculus
cccggttgaataaagtttggatgag

SEQ ID NO: 347105 - DNA, 25 bp, Mus musculus
cccggttgaatatagtttggatgag

SEQ ID NO: 347106 - DNA, 25 bp, Mus musculus
cccggttgcccgatgagtggtcgca

SEQ ID NO: 347107 - DNA, 25 bp, Mus musculus
cccggttgcccgttgagtggtcgca

SEQ ID NO: 347108 - DNA, 25 bp, Mus musculus
cccggttgcctcaaaagatgctgta

SEQ ID NO: 347109 - DNA, 25 bp, Mus musculus
cccggttgcctctaaagatgctgta

SEQ ID NO: 347110 - DNA, 25 bp, Mus musculus
cccggttgtgtaacttgaatcgtta

SEQ ID NO: 347111 - DNA, 25 bp, Mus musculus
cccggttgtgtatcttgaatcgtta

SEQ ID NO: 347112 - DNA, 25 bp, Mus musculus
cccggtttctacagtggattctttg

SEQ ID NO: 347113 - DNA, 25 bp, Mus musculus
cccggtttctactgtggattctttg

SEQ ID NO: 347114 - DNA, 25 bp, Mus musculus
cccggtttgcctagcatcagttggt

SEQ ID NO: 347115 - DNA, 25 bp, Mus musculus
cccggtttgccttgcatcagttggt

SEQ ID NO: 347116 - DNA, 25 bp, Mus musculus
cccgtaagtaggctggctagtccag

SEQ ID NO: 347117 - DNA, 25 bp, Mus musculus
cccgtaagtagggtggctagtccag

SEQ ID NO: 347118 - DNA, 25 bp, Mus musculus
cccgtaatcctcagagcgctaatgt

SEQ ID NO: 347119 - DNA, 25 bp, Mus musculus
cccgtaatcctctgagcgctaatgt

SEQ ID NO: 347120 - DNA, 25 bp, Mus musculus
cccgtacccgaacctgtggaggtga

SEQ ID NO: 347121 - DNA, 25 bp, Mus musculus
cccgtacccgaagctgtggaggtga

SEQ ID NO: 347122 - DNA, 25 bp, Mus musculus
cccgtactcgcactatgatttttac

SEQ ID NO: 347123 - DNA, 25 bp, Mus musculus
cccgtactcgcagtatgatttttac

SEQ ID NO: 347124 - DNA, 25 bp, Mus musculus
cccgtactggctcctcagggaagag

SEQ ID NO: 347125 - DNA, 25 bp, Mus musculus
cccgtactggctgctcagggaagag

SEQ ID NO: 347126 - DNA, 25 bp, Mus musculus
cccgtacttcttcgtctgaggacaa

SEQ ID NO: 347127 - DNA, 25 bp, Mus musculus
cccgtacttcttggtctgaggacaa

SEQ ID NO: 347128 - DNA, 25 bp, Mus musculus
cccgtagctcctctcttaagaagaa

SEQ ID NO: 347129 - DNA, 25 bp, Mus musculus
cccgtagctcctgtcttaagaagaa

SEQ ID NO: 347130 - DNA, 25 bp, Mus musculus
cccgtatctccactgtgggtatctg

SEQ ID NO: 347131 - DNA, 25 bp, Mus musculus
cccgtatctccagtgtgggtatctg

SEQ ID NO: 347132 - DNA, 25 bp, Mus musculus
cccgtattcaaccacttcaggtgaa

SEQ ID NO: 347133 - DNA, 25 bp, Mus musculus
cccgtattcaacgacttcaggtgaa

SEQ ID NO: 347134 - DNA, 25 bp, Mus musculus
cccgtcactctaagggatgctgaca

SEQ ID NO: 347135 - DNA, 25 bp, Mus musculus
cccgtcactctatgggatgctgaca

SEQ ID NO: 347136 - DNA, 25 bp, Mus musculus
cccgtcactgtacactcggtttgaa

SEQ ID NO: 347137 - DNA, 25 bp, Mus musculus
cccgtcactgtagactcggtttgaa

SEQ ID NO: 347138 - DNA, 25 bp, Mus musculus
cccgtcactgttcctggagatcatg

SEQ ID NO: 347139 - DNA, 25 bp, Mus musculus
cccgtcactgttgctggagatcatg

SEQ ID NO: 347140 - DNA, 25 bp, Mus musculus
cccgtcatacctagcgctgtcatgt

SEQ ID NO: 347141 - DNA, 25 bp, Mus musculus
cccgtcataccttgcgctgtcatgt

SEQ ID NO: 347142 - DNA, 25 bp, Mus musculus
cccgtcatgggacaggacttgtctt

SEQ ID NO: 347143 - DNA, 25 bp, Mus musculus
cccgtcatgggagaggacttgtctt

SEQ ID NO: 347144 - DNA, 25 bp, Mus musculus
cccgtccctggaacttgaggattga

SEQ ID NO: 347145 - DNA, 25 bp, Mus musculus
cccgtccctggatcttgaggattga

SEQ ID NO: 347146 - DNA, 25 bp, Mus musculus
cccgtccgtggtcttagagactttg

SEQ ID NO: 347147 - DNA, 25 bp, Mus musculus
cccgtccgtggtgttagagactttg

SEQ ID NO: 347148 - DNA, 25 bp, Mus musculus
cccgtcctctccaaataaatgtcaa

SEQ ID NO: 347149 - DNA, 25 bp, Mus musculus
cccgtcctctcctaataaatgtcaa

SEQ ID NO: 347150 - DNA, 25 bp, Mus musculus
cccgtcctgctcaagttttgaaatt

SEQ ID NO: 347151 - DNA, 25 bp, Mus musculus
cccgtcctgctctagttttgaaatt

SEQ ID NO: 347152 - DNA, 25 bp, Mus musculus
cccgtccttggacctgatgaaaata

SEQ ID NO: 347153 - DNA, 25 bp, Mus musculus
cccgtccttggagctgatgaaaata

SEQ ID NO: 347154 - DNA, 25 bp, Mus musculus
cccgtcgctttgctgttcctgttat

SEQ ID NO: 347155 - DNA, 25 bp, Mus musculus
cccgtcgctttggtgttcctgttat

SEQ ID NO: 347156 - DNA, 25 bp, Mus musculus
cccgtcgtggaacagcatcaggaaa

SEQ ID NO: 347157 - DNA, 25 bp, Mus musculus
cccgtcgtggaagagcatcaggaaa

SEQ ID NO: 347158 - DNA, 25 bp, Mus musculus
cccgtctcccagatgctgatgaata

SEQ ID NO: 347159 - DNA, 25 bp, Mus musculus
cccgtctcccagttgctgatgaata

SEQ ID NO: 347160 - DNA, 25 bp, Mus musculus
cccgtctctagtacttctataaggc

SEQ ID NO: 347161 - DNA, 25 bp, Mus musculus
cccgtctctagttcttctataaggc

SEQ ID NO: 347162 - DNA, 25 bp, Mus musculus
cccgtctgcacgagggaacactaga

SEQ ID NO: 347163 - DNA, 25 bp, Mus musculus
cccgtctgcacgtgggaacactaga

SEQ ID NO: 347164 - DNA, 25 bp, Mus musculus
cccgtctgcaggagtctttacatat

SEQ ID NO: 347165 - DNA, 25 bp, Mus musculus
cccgtctgcaggtgtctttacatat

SEQ ID NO: 347166 - DNA, 25 bp, Mus musculus
cccgtgaatagaattggagacattt

SEQ ID NO: 347167 - DNA, 25 bp, Mus musculus
cccgtgaatagatttggagacattt

SEQ ID NO: 347168 - DNA, 25 bp, Mus musculus
cccgtgattagtccatggtccattg

SEQ ID NO: 347169 - DNA, 25 bp, Mus musculus
cccgtgattagtgcatggtccattg

SEQ ID NO: 347170 - DNA, 25 bp, Mus musculus
cccgtgattgggattcatccttaat

SEQ ID NO: 347171 - DNA, 25 bp, Mus musculus
cccgtgattgggtttcatccttaat

SEQ ID NO: 347172 - DNA, 25 bp, Mus musculus
cccgtgcaagagacgagccaggaga

SEQ ID NO: 347173 - DNA, 25 bp, Mus musculus
cccgtgcaagagtcgagccaggaga

SEQ ID NO: 347174 - DNA, 25 bp, Mus musculus
cccgtgcactagcttggatcttgaa

SEQ ID NO: 347175 - DNA, 25 bp, Mus musculus
cccgtgcactaggttggatcttgaa

SEQ ID NO: 347176 - DNA, 25 bp, Mus musculus
cccgtgccacggaagcgtataggtt

SEQ ID NO: 347177 - DNA, 25 bp, Mus musculus
cccgtgccacggtagcgtataggtt

SEQ ID NO: 347178 - DNA, 25 bp, Mus musculus
cccgtgcggaagagaactgctgaag

SEQ ID NO: 347179 - DNA, 25 bp, Mus musculus
cccgtgcggaagtgaactgctgaag

SEQ ID NO: 347180 - DNA, 25 bp, Mus musculus
cccgtgctcatcatccatgaaaata

SEQ ID NO: 347181 - DNA, 25 bp, Mus musculus
cccgtgctcatcttccatgaaaata

SEQ ID NO: 347182 - DNA, 25 bp, Mus musculus
cccgtgctctttatctgactcagtt

SEQ ID NO: 347183 - DNA, 25 bp, Mus musculus
cccgtgctctttttctgactcagtt

SEQ ID NO: 347184 - DNA, 25 bp, Mus musculus
cccgtgctgagacagctttactgat

SEQ ID NO: 347185 - DNA, 25 bp, Mus musculus
cccgtgctgagagagctttactgat

SEQ ID NO: 347186 - DNA, 25 bp, Mus musculus
cccgtgcttgtacattctggagata

SEQ ID NO: 347187 - DNA, 25 bp, Mus musculus
cccgtgcttgtagattctggagata

SEQ ID NO: 347188 - DNA, 25 bp, Mus musculus
cccgtggactatactgagcaggcct

SEQ ID NO: 347189 - DNA, 25 bp, Mus musculus
cccgtggactattctgagcaggcct

SEQ ID NO: 347190 - DNA, 25 bp, Mus musculus
cccgtggatacaaggacccaggctg

SEQ ID NO: 347191 - DNA, 25 bp, Mus musculus
cccgtggatacatggacccaggctg

SEQ ID NO: 347192 - DNA, 25 bp, Mus musculus
cccgtggatctacatgttttttagt

SEQ ID NO: 347193 - DNA, 25 bp, Mus musculus
cccgtggatctagatgttttttagt

SEQ ID NO: 347194 - DNA, 25 bp, Mus musculus
cccgtggccactacatgagacttag

SEQ ID NO: 347195 - DNA, 25 bp, Mus musculus
cccgtggccacttcatgagacttag

SEQ ID NO: 347196 - DNA, 25 bp, Mus musculus
cccgtgggcgtgaagggcttcaaca

SEQ ID NO: 347197 - DNA, 25 bp, Mus musculus
cccgtgggcgtgtagggcttcaaca

SEQ ID NO: 347198 - DNA, 25 bp, Mus musculus
cccgtgtctttgaggatttggcatt

SEQ ID NO: 347199 - DNA, 25 bp, Mus musculus
cccgtgtctttgtggatttggcatt

SEQ ID NO: 347200 - DNA, 25 bp, Mus musculus
cccgtgtgacagaggacttcagcag

SEQ ID NO: 347201 - DNA, 25 bp, Mus musculus
cccgtgtgacagtggacttcagcag

SEQ ID NO: 347202 - DNA, 25 bp, Mus musculus
cccgtgttagtcacgatgaccaagt

SEQ ID NO: 347203 - DNA, 25 bp, Mus musculus
cccgtgttagtctcgatgaccaagt

SEQ ID NO: 347204 - DNA, 25 bp, Mus musculus
cccgtgtttccgagcacagctggtc

SEQ ID NO: 347205 - DNA, 25 bp, Mus musculus
cccgtgtttccgtgcacagctggtc

SEQ ID NO: 347206 - DNA, 25 bp, Mus musculus
cccgtgttttcacattccaggcata

SEQ ID NO: 347207 - DNA, 25 bp, Mus musculus
cccgtgttttcagattccaggcata

SEQ ID NO: 347208 - DNA, 25 bp, Mus musculus
cccgttatcactaggtcattttgca

SEQ ID NO: 347209 - DNA, 25 bp, Mus musculus
cccgttatcacttggtcattttgca

SEQ ID NO: 347210 - DNA, 25 bp, Mus musculus
cccgttccagatcccgagatagata

SEQ ID NO: 347211 - DNA, 25 bp, Mus musculus
cccgttccagatgccgagatagata

SEQ ID NO: 347212 - DNA, 25 bp, Mus musculus
cccgttctgacaagtgtaccttcta

SEQ ID NO: 347213 - DNA, 25 bp, Mus musculus
cccgttctgacatgtgtaccttcta

SEQ ID NO: 347214 - DNA, 25 bp, Mus musculus
cccgttctgggcatttgatgtataa

SEQ ID NO: 347215 - DNA, 25 bp, Mus musculus
cccgttctgggcttttgatgtataa

SEQ ID NO: 347216 - DNA, 25 bp, Mus musculus
cccgttgacgatcgctggttcgcta

SEQ ID NO: 347217 - DNA, 25 bp, Mus musculus
cccgttgacgatggctggttcgcta

SEQ ID NO: 347218 - DNA, 25 bp, Mus musculus
cccgtttccattacaatcagaactc

SEQ ID NO: 347219 - DNA, 25 bp, Mus musculus
cccgtttccatttcaatcagaactc

SEQ ID NO: 347220 - DNA, 25 bp, Mus musculus
cccgtttctgcgaactgaggtctgt

SEQ ID NO: 347221 - DNA, 25 bp, Mus musculus
cccgtttctgcgtactgaggtctgt

SEQ ID NO: 347222 - DNA, 25 bp, Mus musculus
cccgtttctggcattgtcattgtac

SEQ ID NO: 347223 - DNA, 25 bp, Mus musculus
cccgtttctggctttgtcattgtac

SEQ ID NO: 347224 - DNA, 25 bp, Mus musculus
cccgtttgtagtcgctggctgacaa

SEQ ID NO: 347225 - DNA, 25 bp, Mus musculus
cccgtttgtagtggctggctgacaa

SEQ ID NO: 347226 - DNA, 25 bp, Mus musculus
cccgttttcttcaataccaggacag

SEQ ID NO: 347227 - DNA, 25 bp, Mus musculus
cccgttttcttctataccaggacag

SEQ ID NO: 347228 - DNA, 25 bp, Mus musculus
cccgttttgctgcttttggagtgag

SEQ ID NO: 347229 - DNA, 25 bp, Mus musculus
cccgttttgctggttttggagtgag

SEQ ID NO: 347230 - DNA, 25 bp, Mus musculus
cccgttttttgacgtgcgctaggag

SEQ ID NO: 347231 - DNA, 25 bp, Mus musculus
cccgttttttgaggtgcgctaggag

SEQ ID NO: 347232 - DNA, 25 bp, Mus musculus
ccctaaaatctcaatcagttccctg

SEQ ID NO: 347233 - DNA, 25 bp, Mus musculus
ccctaaaatctctatcagttccctg

SEQ ID NO: 347234 - DNA, 25 bp, Mus musculus
ccctaaacctgtccataatgtaaat

SEQ ID NO: 347235 - DNA, 25 bp, Mus musculus
ccctaaacctgtgcataatgtaaat

SEQ ID NO: 347236 - DNA, 25 bp, Mus musculus
ccctaaaccttgctaatctcttttg

SEQ ID NO: 347237 - DNA, 25 bp, Mus musculus
ccctaaaccttggtaatctcttttg

SEQ ID NO: 347238 - DNA, 25 bp, Mus musculus
ccctaaagaagacctcctcagagtg

SEQ ID NO: 347239 - DNA, 25 bp, Mus musculus
ccctaaagaagagctcctcagagtg

SEQ ID NO: 347240 - DNA, 25 bp, Mus musculus
ccctaaagctgcaggatttaagaaa

SEQ ID NO: 347241 - DNA, 25 bp, Mus musculus
ccctaaagctgctggatttaagaaa

SEQ ID NO: 347242 - DNA, 25 bp, Mus musculus
ccctaaatacagcttggattgcttc

SEQ ID NO: 347243 - DNA, 25 bp, Mus musculus
ccctaaatacaggttggattgcttc

SEQ ID NO: 347244 - DNA, 25 bp, Mus musculus
ccctaaatgccacgttgtttcactt

SEQ ID NO: 347245 - DNA, 25 bp, Mus musculus
ccctaaatgccaggttgtttcactt

SEQ ID NO: 347246 - DNA, 25 bp, Mus musculus
ccctaacaattgacatacatcctta

SEQ ID NO: 347247 - DNA, 25 bp, Mus musculus
ccctaacaattgtcatacatcctta

SEQ ID NO: 347248 - DNA, 25 bp, Mus musculus
ccctaaccatccattgtgcagactt

SEQ ID NO: 347249 - DNA, 25 bp, Mus musculus
ccctaaccatcctttgtgcagactt

SEQ ID NO: 347250 - DNA, 25 bp, Mus musculus
ccctaacctgaacctcggcatttat

SEQ ID NO: 347251 - DNA, 25 bp, Mus musculus
ccctaacctgaagctcggcatttat

SEQ ID NO: 347252 - DNA, 25 bp, Mus musculus
ccctaacgtgctaccatcttagatt

SEQ ID NO: 347253 - DNA, 25 bp, Mus musculus
ccctaacgtgcttccatcttagatt

SEQ ID NO: 347254 - DNA, 25 bp, Mus musculus
ccctaacttatcacttatcagtcac

SEQ ID NO: 347255 - DNA, 25 bp, Mus musculus
ccctaacttatctcttatcagtcac

SEQ ID NO: 347256 - DNA, 25 bp, Mus musculus
ccctaagaaatcactgccccgtggg

SEQ ID NO: 347257 - DNA, 25 bp, Mus musculus
ccctaagaaatctctgccccgtggg

SEQ ID NO: 347258 - DNA, 25 bp, Mus musculus
ccctaagccctgaagaggaggctag

SEQ ID NO: 347259 - DNA, 25 bp, Mus musculus
ccctaagccctgtagaggaggctag

SEQ ID NO: 347260 - DNA, 25 bp, Mus musculus
ccctaagtagatatggtggcacaca

SEQ ID NO: 347261 - DNA, 25 bp, Mus musculus
ccctaagtagatttggtggcacaca

SEQ ID NO: 347262 - DNA, 25 bp, Mus musculus
ccctaagtcaccatcagctagtaag

SEQ ID NO: 347263 - DNA, 25 bp, Mus musculus
ccctaagtcaccttcagctagtaag

SEQ ID NO: 347264 - DNA, 25 bp, Mus musculus
ccctaagtggtaaaatcctaacata

SEQ ID NO: 347265 - DNA, 25 bp, Mus musculus
ccctaagtggtataatcctaacata

SEQ ID NO: 347266 - DNA, 25 bp, Mus musculus
ccctaagttagcatgcttgcaggtt

SEQ ID NO: 347267 - DNA, 25 bp, Mus musculus
ccctaagttagcttgcttgcaggtt

SEQ ID NO: 347268 - DNA, 25 bp, Mus musculus
ccctaatcacctactctagaagtct

SEQ ID NO: 347269 - DNA, 25 bp, Mus musculus
ccctaatcaccttctctagaagtct

SEQ ID NO: 347270 - DNA, 25 bp, Mus musculus
ccctaatcccggaattcagtggtga

SEQ ID NO: 347271 - DNA, 25 bp, Mus musculus
ccctaatcccggtattcagtggtga

SEQ ID NO: 347272 - DNA, 25 bp, Mus musculus
ccctaatgtgtgatttcatcagcat

SEQ ID NO: 347273 - DNA, 25 bp, Mus musculus
ccctaatgtgtgttttcatcagcat

SEQ ID NO: 347274 - DNA, 25 bp, Mus musculus
ccctaattaggacatttgattttgg

SEQ ID NO: 347275 - DNA, 25 bp, Mus musculus
ccctaattaggagatttgattttgg

SEQ ID NO: 347276 - DNA, 25 bp, Mus musculus
ccctaattgagcagccctgtttggc

SEQ ID NO: 347277 - DNA, 25 bp, Mus musculus
ccctaattgagctgccctgtttggc

SEQ ID NO: 347278 - DNA, 25 bp, Mus musculus
ccctaattggttcttgatttggtca

SEQ ID NO: 347279 - DNA, 25 bp, Mus musculus
ccctaattggttgttgatttggtca

SEQ ID NO: 347280 - DNA, 25 bp, Mus musculus
ccctaatttcctcgtgtctatacca

SEQ ID NO: 347281 - DNA, 25 bp, Mus musculus
ccctaatttcctggtgtctatacca

SEQ ID NO: 347282 - DNA, 25 bp, Mus musculus
ccctacaaagaaccgtgggcagtgt

SEQ ID NO: 347283 - DNA, 25 bp, Mus musculus
ccctacaaagaagcgtgggcagtgt

SEQ ID NO: 347284 - DNA, 25 bp, Mus musculus
ccctacaatgttctgtgtaatatga

SEQ ID NO: 347285 - DNA, 25 bp, Mus musculus
ccctacaatgttgtgtgtaatatga

SEQ ID NO: 347286 - DNA, 25 bp, Mus musculus
ccctacacacacaccgaatttaagt

SEQ ID NO: 347287 - DNA, 25 bp, Mus musculus
ccctacacacactccgaatttaagt

SEQ ID NO: 347288 - DNA, 25 bp, Mus musculus
ccctacaccaagaatgctagcatga

SEQ ID NO: 347289 - DNA, 25 bp, Mus musculus
ccctacaccaagtatgctagcatga

SEQ ID NO: 347290 - DNA, 25 bp, Mus musculus
ccctacacctctcagttctttatat

SEQ ID NO: 347291 - DNA, 25 bp, Mus musculus
ccctacacctctgagttctttatat

SEQ ID NO: 347292 - DNA, 25 bp, Mus musculus
ccctacactgacagcggcctggcat

SEQ ID NO: 347293 - DNA, 25 bp, Mus musculus
ccctacactgactgcggcctggcat

SEQ ID NO: 347294 - DNA, 25 bp, Mus musculus
ccctacagacgtccgggatgttgac

SEQ ID NO: 347295 - DNA, 25 bp, Mus musculus
ccctacagacgtgcgggatgttgac

SEQ ID NO: 347296 - DNA, 25 bp, Mus musculus
ccctacagacttctactcattgaga

SEQ ID NO: 347297 - DNA, 25 bp, Mus musculus
ccctacagacttgtactcattgaga

SEQ ID NO: 347298 - DNA, 25 bp, Mus musculus
ccctacagcatcctacgtgaggaag

SEQ ID NO: 347299 - DNA, 25 bp, Mus musculus
ccctacagcatcgtacgtgaggaag

SEQ ID NO: 347300 - DNA, 25 bp, Mus musculus
ccctacatggcaaagaacatagcat

SEQ ID NO: 347301 - DNA, 25 bp, Mus musculus
ccctacatggcatagaacatagcat

SEQ ID NO: 347302 - DNA, 25 bp, Mus musculus
ccctaccagttccaaaatgcaaaag

SEQ ID NO: 347303 - DNA, 25 bp, Mus musculus
ccctaccagttcgaaaatgcaaaag

SEQ ID NO: 347304 - DNA, 25 bp, Mus musculus
ccctaccatgtgagtccagaggttg

SEQ ID NO: 347305 - DNA, 25 bp, Mus musculus
ccctaccatgtgtgtccagaggttg

SEQ ID NO: 347306 - DNA, 25 bp, Mus musculus
ccctaccccaacagtgatggatttt

SEQ ID NO: 347307 - DNA, 25 bp, Mus musculus
ccctaccccaactgtgatggatttt

SEQ ID NO: 347308 - DNA, 25 bp, Mus musculus
ccctaccctgttagtgaaggtctct

SEQ ID NO: 347309 - DNA, 25 bp, Mus musculus
ccctaccctgtttgtgaaggtctct

SEQ ID NO: 347310 - DNA, 25 bp, Mus musculus
ccctaccggagaactactgcaggaa

SEQ ID NO: 347311 - DNA, 25 bp, Mus musculus
ccctaccggagatctactgcaggaa

SEQ ID NO: 347312 - DNA, 25 bp, Mus musculus
ccctaccgttctctaaggacttgtg

SEQ ID NO: 347313 - DNA, 25 bp, Mus musculus
ccctaccgttctgtaaggacttgtg

SEQ ID NO: 347314 - DNA, 25 bp, Mus musculus
ccctacctatgtcgccgaggagatt

SEQ ID NO: 347315 - DNA, 25 bp, Mus musculus
ccctacctatgtggccgaggagatt

SEQ ID NO: 347316 - DNA, 25 bp, Mus musculus
ccctacctcctaccatataaattat

SEQ ID NO: 347317 - DNA, 25 bp, Mus musculus
ccctacctcctagcatataaattat

SEQ ID NO: 347318 - DNA, 25 bp, Mus musculus
ccctacctggatcctttgtacatat

SEQ ID NO: 347319 - DNA, 25 bp, Mus musculus
ccctacctggatgctttgtacatat

SEQ ID NO: 347320 - DNA, 25 bp, Mus musculus
ccctacgacaggctcttacaggtaa

SEQ ID NO: 347321 - DNA, 25 bp, Mus musculus
ccctacgacagggtcttacaggtaa

SEQ ID NO: 347322 - DNA, 25 bp, Mus musculus
ccctacgattcacgcataattttat

SEQ ID NO: 347323 - DNA, 25 bp, Mus musculus
ccctacgattcaggcataattttat

SEQ ID NO: 347324 - DNA, 25 bp, Mus musculus
ccctacgcggccctgtttttatgat

SEQ ID NO: 347325 - DNA, 25 bp, Mus musculus
ccctacgcggccgtgtttttatgat

SEQ ID NO: 347326 - DNA, 25 bp, Mus musculus
ccctacgctgcactgtacgaataaa

SEQ ID NO: 347327 - DNA, 25 bp, Mus musculus
ccctacgctgcagtgtacgaataaa

SEQ ID NO: 347328 - DNA, 25 bp, Mus musculus
ccctactactccaggtgtgagttat

SEQ ID NO: 347329 - DNA, 25 bp, Mus musculus
ccctactactcctggtgtgagttat

SEQ ID NO: 347330 - DNA, 25 bp, Mus musculus
ccctactcgggaagactggctttga

SEQ ID NO: 347331 - DNA, 25 bp, Mus musculus
ccctactcgggatgactggctttga

SEQ ID NO: 347332 - DNA, 25 bp, Mus musculus
ccctactcgttgatgaccatctata

SEQ ID NO: 347333 - DNA, 25 bp, Mus musculus
ccctactcgttgttgaccatctata

SEQ ID NO: 347334 - DNA, 25 bp, Mus musculus
ccctactcttcactatactacataa

SEQ ID NO: 347335 - DNA, 25 bp, Mus musculus
ccctactcttcagtatactacataa

SEQ ID NO: 347336 - DNA, 25 bp, Mus musculus
ccctactgaatacaccctttcagaa

SEQ ID NO: 347337 - DNA, 25 bp, Mus musculus
ccctactgaatagaccctttcagaa

SEQ ID NO: 347338 - DNA, 25 bp, Mus musculus
ccctactgccataaacatccaaaga

SEQ ID NO: 347339 - DNA, 25 bp, Mus musculus
ccctactgccattaacatccaaaga

SEQ ID NO: 347340 - DNA, 25 bp, Mus musculus
ccctactgggtacgcgacagcgtga

SEQ ID NO: 347341 - DNA, 25 bp, Mus musculus
ccctactgggtaggcgacagcgtga

SEQ ID NO: 347342 - DNA, 25 bp, Mus musculus
ccctactgtacacggagaaataaag

SEQ ID NO: 347343 - DNA, 25 bp, Mus musculus
ccctactgtacagggagaaataaag

SEQ ID NO: 347344 - DNA, 25 bp, Mus musculus
ccctactgtttgaggatccagacgt

SEQ ID NO: 347345 - DNA, 25 bp, Mus musculus
ccctactgtttgtggatccagacgt

SEQ ID NO: 347346 - DNA, 25 bp, Mus musculus
ccctacttccgacctgcagatgaag

SEQ ID NO: 347347 - DNA, 25 bp, Mus musculus
ccctacttccgagctgcagatgaag

SEQ ID NO: 347348 - DNA, 25 bp, Mus musculus
ccctacttgtttcatctctgtgttt

SEQ ID NO: 347349 - DNA, 25 bp, Mus musculus
ccctacttgtttgatctctgtgttt

SEQ ID NO: 347350 - DNA, 25 bp, Mus musculus
ccctagaagcgcagggccatccttg

SEQ ID NO: 347351 - DNA, 25 bp, Mus musculus
ccctagaagcgctgggccatccttg

SEQ ID NO: 347352 - DNA, 25 bp, Mus musculus
ccctagaatatgaactcgctcatag

SEQ ID NO: 347353 - DNA, 25 bp, Mus musculus
ccctagaatatgtactcgctcatag

SEQ ID NO: 347354 - DNA, 25 bp, Mus musculus
ccctagaatcctctagtgaagggct

SEQ ID NO: 347355 - DNA, 25 bp, Mus musculus
ccctagaatcctgtagtgaagggct

SEQ ID NO: 347356 - DNA, 25 bp, Mus musculus
ccctagagaagaagtccaactatga

SEQ ID NO: 347357 - DNA, 25 bp, Mus musculus
ccctagagaagatgtccaactatga

SEQ ID NO: 347358 - DNA, 25 bp, Mus musculus
ccctagataatcctatgcctcacaa

SEQ ID NO: 347359 - DNA, 25 bp, Mus musculus
ccctagataatcgtatgcctcacaa

SEQ ID NO: 347360 - DNA, 25 bp, Mus musculus
ccctagatcaggagatcattgaggt

SEQ ID NO: 347361 - DNA, 25 bp, Mus musculus
ccctagatcaggtgatcattgaggt

SEQ ID NO: 347362 - DNA, 25 bp, Mus musculus
ccctagatggtgagttacgtgtgta

SEQ ID NO: 347363 - DNA, 25 bp, Mus musculus
ccctagatggtgtgttacgtgtgta

SEQ ID NO: 347364 - DNA, 25 bp, Mus musculus
ccctagcagaggactcattaattta

SEQ ID NO: 347365 - DNA, 25 bp, Mus musculus
ccctagcagaggatatttggttatt

SEQ ID NO: 347366 - DNA, 25 bp, Mus musculus
ccctagcagaggtctcattaattta

SEQ ID NO: 347367 - DNA, 25 bp, Mus musculus
ccctagcagaggttatttggttatt

SEQ ID NO: 347368 - DNA, 25 bp, Mus musculus
ccctagcagtgactcttaatcagaa

SEQ ID NO: 347369 - DNA, 25 bp, Mus musculus
ccctagcagtgagtcttaatcagaa

SEQ ID NO: 347370 - DNA, 25 bp, Mus musculus
ccctagccaagaaagatgcaaaaga

SEQ ID NO: 347371 - DNA, 25 bp, Mus musculus
ccctagccaagatagatgcaaaaga

SEQ ID NO: 347372 - DNA, 25 bp, Mus musculus
ccctagccctatattgtagttccat

SEQ ID NO: 347373 - DNA, 25 bp, Mus musculus
ccctagccctattttgtagttccat

SEQ ID NO: 347374 - DNA, 25 bp, Mus musculus
ccctagcctgtcatcatttaaagca

SEQ ID NO: 347375 - DNA, 25 bp, Mus musculus
ccctagcctgtcttcatttaaagca

SEQ ID NO: 347376 - DNA, 25 bp, Mus musculus
ccctagcgggctcggcgtcttcaga

SEQ ID NO: 347377 - DNA, 25 bp, Mus musculus
ccctagcgggctgggcgtcttcaga

SEQ ID NO: 347378 - DNA, 25 bp, Mus musculus
ccctagctaggcatccttgtctggc

SEQ ID NO: 347379 - DNA, 25 bp, Mus musculus
ccctagctaggcttccttgtctggc

SEQ ID NO: 347380 - DNA, 25 bp, Mus musculus
ccctagctctgcagtttgacattga

SEQ ID NO: 347381 - DNA, 25 bp, Mus musculus
ccctagctctgctgtttgacattga

SEQ ID NO: 347382 - DNA, 25 bp, Mus musculus
ccctagcttttccaagttgtcttct

SEQ ID NO: 347383 - DNA, 25 bp, Mus musculus
ccctagcttttcgaagttgtcttct

SEQ ID NO: 347384 - DNA, 25 bp, Mus musculus
ccctagctttttacgatgtgaaatg

SEQ ID NO: 347385 - DNA, 25 bp, Mus musculus
ccctagcttttttcgatgtgaaatg

SEQ ID NO: 347386 - DNA, 25 bp, Mus musculus
ccctaggattagaccaacagctgta

SEQ ID NO: 347387 - DNA, 25 bp, Mus musculus
ccctaggattagtccaacagctgta

SEQ ID NO: 347388 - DNA, 25 bp, Mus musculus
ccctaggcagtgaatatccatggtt

SEQ ID NO: 347389 - DNA, 25 bp, Mus musculus
ccctaggcagtgtatatccatggtt

SEQ ID NO: 347390 - DNA, 25 bp, Mus musculus
ccctaggcttgacatttcatctgct

SEQ ID NO: 347391 - DNA, 25 bp, Mus musculus
ccctaggcttgagatttcatctgct

SEQ ID NO: 347392 - DNA, 25 bp, Mus musculus
ccctagggatgacccttctgcttaa

SEQ ID NO: 347393 - DNA, 25 bp, Mus musculus
ccctagggatgagccttctgcttaa

SEQ ID NO: 347394 - DNA, 25 bp, Mus musculus
ccctagggtaatcagtgagcaacag

SEQ ID NO: 347395 - DNA, 25 bp, Mus musculus
ccctagggtaatgagtgagcaacag

SEQ ID NO: 347396 - DNA, 25 bp, Mus musculus
ccctaggtactacagatgcactaga

SEQ ID NO: 347397 - DNA, 25 bp, Mus musculus
ccctaggtactagagatgcactaga

SEQ ID NO: 347398 - DNA, 25 bp, Mus musculus
ccctagtcaaaacaatgagtcttta

SEQ ID NO: 347399 - DNA, 25 bp, Mus musculus
ccctagtcaaaagaatgagtcttta

SEQ ID NO: 347400 - DNA, 25 bp, Mus musculus
ccctagtctctcatcaatcagtatt

SEQ ID NO: 347401 - DNA, 25 bp, Mus musculus
ccctagtctctcttcaatcagtatt

SEQ ID NO: 347402 - DNA, 25 bp, Mus musculus
ccctagtgcctccaaatggctggaa

SEQ ID NO: 347403 - DNA, 25 bp, Mus musculus
ccctagtgcctcgaaatggctggaa

SEQ ID NO: 347404 - DNA, 25 bp, Mus musculus
ccctagtgggctctactgtatgcac

SEQ ID NO: 347405 - DNA, 25 bp, Mus musculus
ccctagtgggctgtactgtatgcac

SEQ ID NO: 347406 - DNA, 25 bp, Mus musculus
ccctagttcattaattctgcatttg

SEQ ID NO: 347407 - DNA, 25 bp, Mus musculus
ccctagttcatttattctgcatttg

SEQ ID NO: 347408 - DNA, 25 bp, Mus musculus
ccctagttcctgactgagtaagcca

SEQ ID NO: 347409 - DNA, 25 bp, Mus musculus
ccctagttcctgtctgagtaagcca

SEQ ID NO: 347410 - DNA, 25 bp, Mus musculus
ccctagtttccacacttctgtttga

SEQ ID NO: 347411 - DNA, 25 bp, Mus musculus
ccctagtttccagacttctgtttga

SEQ ID NO: 347412 - DNA, 25 bp, Mus musculus
ccctagtttgtgatggtcagtcttt

SEQ ID NO: 347413 - DNA, 25 bp, Mus musculus
ccctagtttgtgttggtcagtcttt

SEQ ID NO: 347414 - DNA, 25 bp, Mus musculus
ccctatagggcacattctcattcaa

SEQ ID NO: 347415 - DNA, 25 bp, Mus musculus
ccctatagggcagattctcattcaa

SEQ ID NO: 347416 - DNA, 25 bp, Mus musculus
ccctatatatgcctctactgttttg

SEQ ID NO: 347417 - DNA, 25 bp, Mus musculus
ccctatatatgcgtctactgttttg

SEQ ID NO: 347418 - DNA, 25 bp, Mus musculus
ccctatatcctgagtggcacattct

SEQ ID NO: 347419 - DNA, 25 bp, Mus musculus
ccctatatcctgtgtggcacattct

SEQ ID NO: 347420 - DNA, 25 bp, Mus musculus
ccctatatggaaaagttgtgcaatt

SEQ ID NO: 347421 - DNA, 25 bp, Mus musculus
ccctatatggaatagttgtgcaatt

SEQ ID NO: 347422 - DNA, 25 bp, Mus musculus
ccctatcacctgaatgcagacttga

SEQ ID NO: 347423 - DNA, 25 bp, Mus musculus
ccctatcacctgtatgcagacttga

SEQ ID NO: 347424 - DNA, 25 bp, Mus musculus
ccctatccacacagctgacagaaaa

SEQ ID NO: 347425 - DNA, 25 bp, Mus musculus
ccctatccacactgctgacagaaaa

SEQ ID NO: 347426 - DNA, 25 bp, Mus musculus
ccctatccgtacagtgtaatagttt

SEQ ID NO: 347427 - DNA, 25 bp, Mus musculus
ccctatccgtactgtgtaatagttt

SEQ ID NO: 347428 - DNA, 25 bp, Mus musculus
ccctatcgagggagtctgcggacaa

SEQ ID NO: 347429 - DNA, 25 bp, Mus musculus
ccctatcgagggtgtctgcggacaa

SEQ ID NO: 347430 - DNA, 25 bp, Mus musculus
ccctatctattcaatatagtactct

SEQ ID NO: 347431 - DNA, 25 bp, Mus musculus
ccctatctattctatatagtactct

SEQ ID NO: 347432 - DNA, 25 bp, Mus musculus
ccctatctccaaacaggtggctaga

SEQ ID NO: 347433 - DNA, 25 bp, Mus musculus
ccctatctccaatcaggtggctaga

SEQ ID NO: 347434 - DNA, 25 bp, Mus musculus
ccctatctgctgctcatgatggtag

SEQ ID NO: 347435 - DNA, 25 bp, Mus musculus
ccctatctgctggtcatgatggtag

SEQ ID NO: 347436 - DNA, 25 bp, Mus musculus
ccctatcttgttcgcgtgacacata

SEQ ID NO: 347437 - DNA, 25 bp, Mus musculus
ccctatcttgttggcgtgacacata

SEQ ID NO: 347438 - DNA, 25 bp, Mus musculus
ccctatgacggaaagtgtgtgctgt

SEQ ID NO: 347439 - DNA, 25 bp, Mus musculus
ccctatgacggatagtgtgtgctgt

SEQ ID NO: 347440 - DNA, 25 bp, Mus musculus
ccctatgatgacagtgtgtttggag

SEQ ID NO: 347441 - DNA, 25 bp, Mus musculus
ccctatgatgactgtgtgtttggag

SEQ ID NO: 347442 - DNA, 25 bp, Mus musculus
ccctatgatgctctaaattgtaatg

SEQ ID NO: 347443 - DNA, 25 bp, Mus musculus
ccctatgatgctgtaaattgtaatg

SEQ ID NO: 347444 - DNA, 25 bp, Mus musculus
ccctatggcaggaaatggtgggata

SEQ ID NO: 347445 - DNA, 25 bp, Mus musculus
ccctatggcaggtaatggtgggata

SEQ ID NO: 347446 - DNA, 25 bp, Mus musculus
ccctatggccttaggagaactcaga

SEQ ID NO: 347447 - DNA, 25 bp, Mus musculus
ccctatggcctttggagaactcaga

SEQ ID NO: 347448 - DNA, 25 bp, Mus musculus
ccctatggctggcttttattacagt

SEQ ID NO: 347449 - DNA, 25 bp, Mus musculus
ccctatggctgggttttattacagt

SEQ ID NO: 347450 - DNA, 25 bp, Mus musculus
ccctatggtggtcgctatggatctg

SEQ ID NO: 347451 - DNA, 25 bp, Mus musculus
ccctatggtggtggctatggatctg

SEQ ID NO: 347452 - DNA, 25 bp, Mus musculus
ccctatgtacacactcctagatgaa

SEQ ID NO: 347453 - DNA, 25 bp, Mus musculus
ccctatgtacactctcctagatgaa

SEQ ID NO: 347454 - DNA, 25 bp, Mus musculus
ccctatgtccagattatgagcatga

SEQ ID NO: 347455 - DNA, 25 bp, Mus musculus
ccctatgtccagtttatgagcatga

SEQ ID NO: 347456 - DNA, 25 bp, Mus musculus
ccctatgtgaccagggtgggccaag

SEQ ID NO: 347457 - DNA, 25 bp, Mus musculus
ccctatgtgacctgggtgggccaag

SEQ ID NO: 347458 - DNA, 25 bp, Mus musculus
ccctattaacatacaagtaaacctg

SEQ ID NO: 347459 - DNA, 25 bp, Mus musculus
ccctattaacattcaagtaaacctg

SEQ ID NO: 347460 - DNA, 25 bp, Mus musculus
ccctattaatccacacacaagtttc

SEQ ID NO: 347461 - DNA, 25 bp, Mus musculus
ccctattaatcctcacacaagtttc

SEQ ID NO: 347462 - DNA, 25 bp, Mus musculus
ccctattctatgagacagaggaagg

SEQ ID NO: 347463 - DNA, 25 bp, Mus musculus
ccctattctatgtgacagaggaagg

SEQ ID NO: 347464 - DNA, 25 bp, Mus musculus
ccctattcttatcacttctccaaga

SEQ ID NO: 347465 - DNA, 25 bp, Mus musculus
ccctattcttatgacttctccaaga

SEQ ID NO: 347466 - DNA, 25 bp, Mus musculus
ccctattcttgcactgtgtgtggaa

SEQ ID NO: 347467 - DNA, 25 bp, Mus musculus
ccctattcttgctctgtgtgtggaa

SEQ ID NO: 347468 - DNA, 25 bp, Mus musculus
ccctattgctttaataacatcaaga

SEQ ID NO: 347469 - DNA, 25 bp, Mus musculus
ccctattgcttttataacatcaaga

SEQ ID NO: 347470 - DNA, 25 bp, Mus musculus
ccctattggccactaaggtatttct

SEQ ID NO: 347471 - DNA, 25 bp, Mus musculus
ccctattggccagtaaggtatttct

SEQ ID NO: 347472 - DNA, 25 bp, Mus musculus
ccctattgtatcatgttccctcaaa

SEQ ID NO: 347473 - DNA, 25 bp, Mus musculus
ccctattgtatcttgttccctcaaa

SEQ ID NO: 347474 - DNA, 25 bp, Mus musculus
ccctatttcctactccaagagaagg

SEQ ID NO: 347475 - DNA, 25 bp, Mus musculus
ccctatttcctagtccaagagaagg

SEQ ID NO: 347476 - DNA, 25 bp, Mus musculus
ccctatttcgctatacatttttgtg

SEQ ID NO: 347477 - DNA, 25 bp, Mus musculus
ccctatttcgctttacatttttgtg

SEQ ID NO: 347478 - DNA, 25 bp, Mus musculus
ccctatttgatgatctctggagcac

SEQ ID NO: 347479 - DNA, 25 bp, Mus musculus
ccctatttgatgttctctggagcac

SEQ ID NO: 347480 - DNA, 25 bp, Mus musculus
ccctatttgtggatattggtcatga

SEQ ID NO: 347481 - DNA, 25 bp, Mus musculus
ccctatttgtggttattggtcatga

SEQ ID NO: 347482 - DNA, 25 bp, Mus musculus
ccctattttctgcttatcttgtgag

SEQ ID NO: 347483 - DNA, 25 bp, Mus musculus
ccctattttctggttatcttgtgag

SEQ ID NO: 347484 - DNA, 25 bp, Mus musculus
ccctcaaagcccatgtgtagacgta

SEQ ID NO: 347485 - DNA, 25 bp, Mus musculus
ccctcaaagcccttgtgtagacgta

SEQ ID NO: 347486 - DNA, 25 bp, Mus musculus
ccctcaaccacaaagtctctaaatt

SEQ ID NO: 347487 - DNA, 25 bp, Mus musculus
ccctcaaccacatagtctctaaatt

SEQ ID NO: 347488 - DNA, 25 bp, Mus musculus
ccctcaacccacacttgggatattt

SEQ ID NO: 347489 - DNA, 25 bp, Mus musculus
ccctcaacccactcttgggatattt

SEQ ID NO: 347490 - DNA, 25 bp, Mus musculus
ccctcaactagcctcacaagtaata

SEQ ID NO: 347491 - DNA, 25 bp, Mus musculus
ccctcaactagcgtcacaagtaata

SEQ ID NO: 347492 - DNA, 25 bp, Mus musculus
ccctcaactggaaggagttcagctt

SEQ ID NO: 347493 - DNA, 25 bp, Mus musculus
ccctcaactggatggagttcagctt

SEQ ID NO: 347494 - DNA, 25 bp, Mus musculus
ccctcaagacttacatcttcttcat

SEQ ID NO: 347495 - DNA, 25 bp, Mus musculus
ccctcaagactttcatcttcttcat

SEQ ID NO: 347496 - DNA, 25 bp, Mus musculus
ccctcaagcacactggatgatttca

SEQ ID NO: 347497 - DNA, 25 bp, Mus musculus
ccctcaagcacagtggatgatttca

SEQ ID NO: 347498 - DNA, 25 bp, Mus musculus
ccctcaagtcatctgggtgttctga

SEQ ID NO: 347499 - DNA, 25 bp, Mus musculus
ccctcaagtcatgtgggtgttctga

SEQ ID NO: 347500 - DNA, 25 bp, Mus musculus
ccctcacaacttcccattgggagta

SEQ ID NO: 347501 - DNA, 25 bp, Mus musculus
ccctcacaacttgccattgggagta

SEQ ID NO: 347502 - DNA, 25 bp, Mus musculus
ccctcacacactctgactattggga

SEQ ID NO: 347503 - DNA, 25 bp, Mus musculus
ccctcacacactgtgactattggga

SEQ ID NO: 347504 - DNA, 25 bp, Mus musculus
ccctcaccaggaattcattttctac

SEQ ID NO: 347505 - DNA, 25 bp, Mus musculus
ccctcaccaggatttcattttctac

SEQ ID NO: 347506 - DNA, 25 bp, Mus musculus
ccctcaccgacaccttgatggaaag

SEQ ID NO: 347507 - DNA, 25 bp, Mus musculus
ccctcaccgacagcttgatggaaag

SEQ ID NO: 347508 - DNA, 25 bp, Mus musculus
ccctcacctcttaccaaatatagaa

SEQ ID NO: 347509 - DNA, 25 bp, Mus musculus
ccctcacctctttccaaatatagaa

SEQ ID NO: 347510 - DNA, 25 bp, Mus musculus
ccctcacctggcactagagaatgtg

SEQ ID NO: 347511 - DNA, 25 bp, Mus musculus
ccctcacctggctctagagaatgtg

SEQ ID NO: 347512 - DNA, 25 bp, Mus musculus
ccctcacggaggaaatagttttgct

SEQ ID NO: 347513 - DNA, 25 bp, Mus musculus
ccctcacggaggtaatagttttgct

SEQ ID NO: 347514 - DNA, 25 bp, Mus musculus
ccctcacggtctccaggatgagtaa

SEQ ID NO: 347515 - DNA, 25 bp, Mus musculus
ccctcacggtctgcaggatgagtaa

SEQ ID NO: 347516 - DNA, 25 bp, Mus musculus
ccctcactattacctcaggatgaca

SEQ ID NO: 347517 - DNA, 25 bp, Mus musculus
ccctcactattagctcaggatgaca

SEQ ID NO: 347518 - DNA, 25 bp, Mus musculus
ccctcactcggtcgctcgggtggga

SEQ ID NO: 347519 - DNA, 25 bp, Mus musculus
ccctcactcggtggctcgggtggga

SEQ ID NO: 347520 - DNA, 25 bp, Mus musculus
ccctcactctctatgaacttaacat

SEQ ID NO: 347521 - DNA, 25 bp, Mus musculus
ccctcactctctttgaacttaacat

SEQ ID NO: 347522 - DNA, 25 bp, Mus musculus
ccctcactgctgattttctgaaata

SEQ ID NO: 347523 - DNA, 25 bp, Mus musculus
ccctcactgctgtttttctgaaata

SEQ ID NO: 347524 - DNA, 25 bp, Mus musculus
ccctcactgtatcccacttgagaaa

SEQ ID NO: 347525 - DNA, 25 bp, Mus musculus
ccctcactgtatgccacttgagaaa

SEQ ID NO: 347526 - DNA, 25 bp, Mus musculus
ccctcacttctacatgttcaaaatt

SEQ ID NO: 347527 - DNA, 25 bp, Mus musculus
ccctcacttctagatgttcaaaatt

SEQ ID NO: 347528 - DNA, 25 bp, Mus musculus
ccctcacttgacagatggttttact

SEQ ID NO: 347529 - DNA, 25 bp, Mus musculus
ccctcacttgactgatggttttact

SEQ ID NO: 347530 - DNA, 25 bp, Mus musculus
ccctcactttctcgacagactgata

SEQ ID NO: 347531 - DNA, 25 bp, Mus musculus
ccctcactttctggacagactgata

SEQ ID NO: 347532 - DNA, 25 bp, Mus musculus
ccctcagaagcactggtttgtggta

SEQ ID NO: 347533 - DNA, 25 bp, Mus musculus
ccctcagaagcagtggtttgtggta

SEQ ID NO: 347534 - DNA, 25 bp, Mus musculus
ccctcagacatacagtacctgttct

SEQ ID NO: 347535 - DNA, 25 bp, Mus musculus
ccctcagacatagagtacctgttct

SEQ ID NO: 347536 - DNA, 25 bp, Mus musculus
ccctcagagagtagttgctggactt

SEQ ID NO: 347537 - DNA, 25 bp, Mus musculus
ccctcagagagttgttgctggactt

SEQ ID NO: 347538 - DNA, 25 bp, Mus musculus
ccctcagagccacagagggctgagt

SEQ ID NO: 347539 - DNA, 25 bp, Mus musculus
ccctcagagccagagagggctgagt

SEQ ID NO: 347540 - DNA, 25 bp, Mus musculus
ccctcagagccccataagagtgaaa

SEQ ID NO: 347541 - DNA, 25 bp, Mus musculus
ccctcagagcccgataagagtgaaa

SEQ ID NO: 347542 - DNA, 25 bp, Mus musculus
ccctcagatcggcatttcaaatcgg

SEQ ID NO: 347543 - DNA, 25 bp, Mus musculus
ccctcagatcgggatttcaaatcgg

SEQ ID NO: 347544 - DNA, 25 bp, Mus musculus
ccctcagatctgatcccaaagtatg

SEQ ID NO: 347545 - DNA, 25 bp, Mus musculus
ccctcagatctgttcccaaagtatg

SEQ ID NO: 347546 - DNA, 25 bp, Mus musculus
ccctcagcaaagcacctagccagga

SEQ ID NO: 347547 - DNA, 25 bp, Mus musculus
ccctcagcaaaggacctagccagga

SEQ ID NO: 347548 - DNA, 25 bp, Mus musculus
ccctcagcacttaccattgtaatag

SEQ ID NO: 347549 - DNA, 25 bp, Mus musculus
ccctcagcactttccattgtaatag

SEQ ID NO: 347550 - DNA, 25 bp, Mus musculus
ccctcagcagaacgtttctgacata

SEQ ID NO: 347551 - DNA, 25 bp, Mus musculus
ccctcagcagaaggtttctgacata

SEQ ID NO: 347552 - DNA, 25 bp, Mus musculus
ccctcagcataacttcagttttcat

SEQ ID NO: 347553 - DNA, 25 bp, Mus musculus
ccctcagcataagttcagttttcat

SEQ ID NO: 347554 - DNA, 25 bp, Mus musculus
ccctcagcatgaagcaagcatgaat

SEQ ID NO: 347555 - DNA, 25 bp, Mus musculus
ccctcagcatgatgcaagcatgaat

SEQ ID NO: 347556 - DNA, 25 bp, Mus musculus
ccctcagcctctatgttcgaagaga

SEQ ID NO: 347557 - DNA, 25 bp, Mus musculus
ccctcagcctctttgttcgaagaga

SEQ ID NO: 347558 - DNA, 25 bp, Mus musculus
ccctcagcctttactttatcttcag

SEQ ID NO: 347559 - DNA, 25 bp, Mus musculus
ccctcagccttttctttatcttcag

SEQ ID NO: 347560 - DNA, 25 bp, Mus musculus
ccctcagctgaccactttgcctcat

SEQ ID NO: 347561 - DNA, 25 bp, Mus musculus
ccctcagctgacgactttgcctcat

SEQ ID NO: 347562 - DNA, 25 bp, Mus musculus
ccctcagcttctctgcttatttgaa

SEQ ID NO: 347563 - DNA, 25 bp, Mus musculus
ccctcagcttctgtgcttatttgaa

SEQ ID NO: 347564 - DNA, 25 bp, Mus musculus
ccctcaggagctaatgtcttggtct

SEQ ID NO: 347565 - DNA, 25 bp, Mus musculus
ccctcaggagcttatgtcttggtct

SEQ ID NO: 347566 - DNA, 25 bp, Mus musculus
ccctcaggatccaggcagagacagc

SEQ ID NO: 347567 - DNA, 25 bp, Mus musculus
ccctcaggatcctggcagagacagc

SEQ ID NO: 347568 - DNA, 25 bp, Mus musculus
ccctcaggattgctgggactcagag

SEQ ID NO: 347569 - DNA, 25 bp, Mus musculus
ccctcaggattggtgggactcagag

SEQ ID NO: 347570 - DNA, 25 bp, Mus musculus
ccctcaggccctatctagaatttgg

SEQ ID NO: 347571 - DNA, 25 bp, Mus musculus
ccctcaggccctttctagaatttgg

SEQ ID NO: 347572 - DNA, 25 bp, Mus musculus
ccctcagggacacagtagcccaaag

SEQ ID NO: 347573 - DNA, 25 bp, Mus musculus
ccctcagggacagagtagcccaaag

SEQ ID NO: 347574 - DNA, 25 bp, Mus musculus
ccctcagggaccctggatacgggct

SEQ ID NO: 347575 - DNA, 25 bp, Mus musculus
ccctcagggaccgtggatacgggct

SEQ ID NO: 347576 - DNA, 25 bp, Mus musculus
ccctcaggtctgatcagctagtggg

SEQ ID NO: 347577 - DNA, 25 bp, Mus musculus
ccctcaggtctgttcagctagtggg

SEQ ID NO: 347578 - DNA, 25 bp, Mus musculus
ccctcagtaatgactcttgtggatt

SEQ ID NO: 347579 - DNA, 25 bp, Mus musculus
ccctcagtaatgtctcttgtggatt

SEQ ID NO: 347580 - DNA, 25 bp, Mus musculus
ccctcagtactgatcgtgtagccta

SEQ ID NO: 347581 - DNA, 25 bp, Mus musculus
ccctcagtactgttcgtgtagccta

SEQ ID NO: 347582 - DNA, 25 bp, Mus musculus
ccctcagtagcgacaccaacttgtt

SEQ ID NO: 347583 - DNA, 25 bp, Mus musculus
ccctcagtagcgtcaccaacttgtt

SEQ ID NO: 347584 - DNA, 25 bp, Mus musculus
ccctcagtatctagaatgtagtttt

SEQ ID NO: 347585 - DNA, 25 bp, Mus musculus
ccctcagtatcttgaatgtagtttt

SEQ ID NO: 347586 - DNA, 25 bp, Mus musculus
ccctcagtattcatcctacaatgat

SEQ ID NO: 347587 - DNA, 25 bp, Mus musculus
ccctcagtattcttcctacaatgat

SEQ ID NO: 347588 - DNA, 25 bp, Mus musculus
ccctcagtctatatgaactacctct

SEQ ID NO: 347589 - DNA, 25 bp, Mus musculus
ccctcagtctatttgaactacctct

SEQ ID NO: 347590 - DNA, 25 bp, Mus musculus
ccctcagtgacgcatgtgagaaaag

SEQ ID NO: 347591 - DNA, 25 bp, Mus musculus
ccctcagtgacggatgtgagaaaag

SEQ ID NO: 347592 - DNA, 25 bp, Mus musculus
ccctcagttactagcacgtggtgta

SEQ ID NO: 347593 - DNA, 25 bp, Mus musculus
ccctcagttacttgcacgtggtgta

SEQ ID NO: 347594 - DNA, 25 bp, Mus musculus
ccctcagttttcacggagtggtttg

SEQ ID NO: 347595 - DNA, 25 bp, Mus musculus
ccctcagttttctcggagtggtttg

SEQ ID NO: 347596 - DNA, 25 bp, Mus musculus
ccctcatacacacctgcattaaatg

SEQ ID NO: 347597 - DNA, 25 bp, Mus musculus
ccctcatacacagctgcattaaatg

SEQ ID NO: 347598 - DNA, 25 bp, Mus musculus
ccctcatacaggaaggcgggtgtgt

SEQ ID NO: 347599 - DNA, 25 bp, Mus musculus
ccctcatacaggtaggcgggtgtgt

SEQ ID NO: 347600 - DNA, 25 bp, Mus musculus
ccctcatattctcccaaatagtcat

SEQ ID NO: 347601 - DNA, 25 bp, Mus musculus
ccctcatattctgccaaatagtcat

SEQ ID NO: 347602 - DNA, 25 bp, Mus musculus
ccctcatcatatactggctgacctt

SEQ ID NO: 347603 - DNA, 25 bp, Mus musculus
ccctcatcatattctggctgacctt

SEQ ID NO: 347604 - DNA, 25 bp, Mus musculus
ccctcatccctgcatttgggaagta

SEQ ID NO: 347605 - DNA, 25 bp, Mus musculus
ccctcatccctggatttgggaagta

SEQ ID NO: 347606 - DNA, 25 bp, Mus musculus
ccctcatcctacaggatctcaatga

SEQ ID NO: 347607 - DNA, 25 bp, Mus musculus
ccctcatcctactggatctcaatga

SEQ ID NO: 347608 - DNA, 25 bp, Mus musculus
ccctcatcggatagcatgtctctaa

SEQ ID NO: 347609 - DNA, 25 bp, Mus musculus
ccctcatcggattgcatgtctctaa

SEQ ID NO: 347610 - DNA, 25 bp, Mus musculus
ccctcatctctcaacacaggataat

SEQ ID NO: 347611 - DNA, 25 bp, Mus musculus
ccctcatctctctacacaggataat

SEQ ID NO: 347612 - DNA, 25 bp, Mus musculus
ccctcatctgctcgtgttcattttg

SEQ ID NO: 347613 - DNA, 25 bp, Mus musculus
ccctcatctgctggtgttcattttg

SEQ ID NO: 347614 - DNA, 25 bp, Mus musculus
ccctcatctggacagtgctggagaa

SEQ ID NO: 347615 - DNA, 25 bp, Mus musculus
ccctcatctggagagtgctggagaa

SEQ ID NO: 347616 - DNA, 25 bp, Mus musculus
ccctcatctggcctatgcatgtggt

SEQ ID NO: 347617 - DNA, 25 bp, Mus musculus
ccctcatctggcgtatgcatgtggt

SEQ ID NO: 347618 - DNA, 25 bp, Mus musculus
ccctcatgccgcagggtgattgtgg

SEQ ID NO: 347619 - DNA, 25 bp, Mus musculus
ccctcatgccgctgggtgattgtgg

SEQ ID NO: 347620 - DNA, 25 bp, Mus musculus
ccctcatgctccagacactaaagaa

SEQ ID NO: 347621 - DNA, 25 bp, Mus musculus
ccctcatgctcctgacactaaagaa

SEQ ID NO: 347622 - DNA, 25 bp, Mus musculus
ccctcatgctctagctggtgagata

SEQ ID NO: 347623 - DNA, 25 bp, Mus musculus
ccctcatgctcttgctggtgagata

SEQ ID NO: 347624 - DNA, 25 bp, Mus musculus
ccctcatgtgttctatacctgatca

SEQ ID NO: 347625 - DNA, 25 bp, Mus musculus
ccctcatgtgttgtatacctgatca

SEQ ID NO: 347626 - DNA, 25 bp, Mus musculus
ccctcattactgcacttcatcttga

SEQ ID NO: 347627 - DNA, 25 bp, Mus musculus
ccctcattactggacttcatcttga

SEQ ID NO: 347628 - DNA, 25 bp, Mus musculus
ccctcattagctccattcttctata

SEQ ID NO: 347629 - DNA, 25 bp, Mus musculus
ccctcattagctgcattcttctata

SEQ ID NO: 347630 - DNA, 25 bp, Mus musculus
ccctcattcaatatattaccgacgt

SEQ ID NO: 347631 - DNA, 25 bp, Mus musculus
ccctcattcaatttattaccgacgt

SEQ ID NO: 347632 - DNA, 25 bp, Mus musculus
ccctcattcagcaagagcttcattt

SEQ ID NO: 347633 - DNA, 25 bp, Mus musculus
ccctcattcagctagagcttcattt

SEQ ID NO: 347634 - DNA, 25 bp, Mus musculus
ccctcattccagagacctcagtggt

SEQ ID NO: 347635 - DNA, 25 bp, Mus musculus
ccctcattccagcacataatgcaaa

SEQ ID NO: 347636 - DNA, 25 bp, Mus musculus
ccctcattccaggacataatgcaaa

SEQ ID NO: 347637 - DNA, 25 bp, Mus musculus
ccctcattccagtgacctcagtggt

SEQ ID NO: 347638 - DNA, 25 bp, Mus musculus
ccctcattcctaacaaactctttct

SEQ ID NO: 347639 - DNA, 25 bp, Mus musculus
ccctcattcctatcaaactctttct

SEQ ID NO: 347640 - DNA, 25 bp, Mus musculus
ccctcattgaatacacccaagaaag

SEQ ID NO: 347641 - DNA, 25 bp, Mus musculus
ccctcattgaattcacccaagaaag

SEQ ID NO: 347642 - DNA, 25 bp, Mus musculus
ccctcattgactcgctagtgaatgt

SEQ ID NO: 347643 - DNA, 25 bp, Mus musculus
ccctcattgactggctagtgaatgt

SEQ ID NO: 347644 - DNA, 25 bp, Mus musculus
ccctcattgatgacttccaccagta

SEQ ID NO: 347645 - DNA, 25 bp, Mus musculus
ccctcattgatgtcttccaccagta

SEQ ID NO: 347646 - DNA, 25 bp, Mus musculus
ccctcatttctccttttctgtataa

SEQ ID NO: 347647 - DNA, 25 bp, Mus musculus
ccctcatttctcgttttctgtataa

SEQ ID NO: 347648 - DNA, 25 bp, Mus musculus
ccctcattttgcagaaacactaggt

SEQ ID NO: 347649 - DNA, 25 bp, Mus musculus
ccctcattttgctgaaacactaggt

SEQ ID NO: 347650 - DNA, 25 bp, Mus musculus
ccctccaaaatgatgctttgctttg

SEQ ID NO: 347651 - DNA, 25 bp, Mus musculus
ccctccaaaatgttgctttgctttg

SEQ ID NO: 347652 - DNA, 25 bp, Mus musculus
ccctccaactacagagtactgatgc

SEQ ID NO: 347653 - DNA, 25 bp, Mus musculus
ccctccaactactgagtactgatgc

SEQ ID NO: 347654 - DNA, 25 bp, Mus musculus
ccctccaactgtataacatgccaat

SEQ ID NO: 347655 - DNA, 25 bp, Mus musculus
ccctccaactgtttaacatgccaat

SEQ ID NO: 347656 - DNA, 25 bp, Mus musculus
ccctccaagggacatcttctagatc

SEQ ID NO: 347657 - DNA, 25 bp, Mus musculus
ccctccaagggagatcttctagatc

SEQ ID NO: 347658 - DNA, 25 bp, Mus musculus
ccctccaatcacatcttgtttctgt

SEQ ID NO: 347659 - DNA, 25 bp, Mus musculus
ccctccaatcacttcttgtttctgt

SEQ ID NO: 347660 - DNA, 25 bp, Mus musculus
ccctccacacttctggaattttctt

SEQ ID NO: 347661 - DNA, 25 bp, Mus musculus
ccctccacacttgtggaattttctt

SEQ ID NO: 347662 - DNA, 25 bp, Mus musculus
ccctccacatgcacatccaatgcat

SEQ ID NO: 347663 - DNA, 25 bp, Mus musculus
ccctccacatgctcatccaatgcat

SEQ ID NO: 347664 - DNA, 25 bp, Mus musculus
ccctccactgtaatttctcatgtag

SEQ ID NO: 347665 - DNA, 25 bp, Mus musculus
ccctccactgtattttctcatgtag

SEQ ID NO: 347666 - DNA, 25 bp, Mus musculus
ccctccacttctagtctgtatggaa

SEQ ID NO: 347667 - DNA, 25 bp, Mus musculus
ccctccacttcttgtctgtatggaa

SEQ ID NO: 347668 - DNA, 25 bp, Mus musculus
ccctccagaagtactgtgtttggta

SEQ ID NO: 347669 - DNA, 25 bp, Mus musculus
ccctccagaagttctgtgtttggta

SEQ ID NO: 347670 - DNA, 25 bp, Mus musculus
ccctccagaccaaggttgggtggct

SEQ ID NO: 347671 - DNA, 25 bp, Mus musculus
ccctccagaccatggttgggtggct

SEQ ID NO: 347672 - DNA, 25 bp, Mus musculus
ccctccagagtaataacgctccaag

SEQ ID NO: 347673 - DNA, 25 bp, Mus musculus
ccctccagagtattaacgctccaag

SEQ ID NO: 347674 - DNA, 25 bp, Mus musculus
ccctccagcaccagatgtgttagag

SEQ ID NO: 347675 - DNA, 25 bp, Mus musculus
ccctccagcacctgatgtgttagag

SEQ ID NO: 347676 - DNA, 25 bp, Mus musculus
ccctccaggctcaagaaagcgttta

SEQ ID NO: 347677 - DNA, 25 bp, Mus musculus
ccctccaggctctagaaagcgttta

SEQ ID NO: 347678 - DNA, 25 bp, Mus musculus
ccctccaggtttcttccaagatggc

SEQ ID NO: 347679 - DNA, 25 bp, Mus musculus
ccctccaggtttgttccaagatggc

SEQ ID NO: 347680 - DNA, 25 bp, Mus musculus
ccctccatattcatgggatccatat

SEQ ID NO: 347681 - DNA, 25 bp, Mus musculus
ccctccatattcttgggatccatat

SEQ ID NO: 347682 - DNA, 25 bp, Mus musculus
ccctccatgtggcaagtgtgatttc

SEQ ID NO: 347683 - DNA, 25 bp, Mus musculus
ccctccatgtgggaagtgtgatttc

SEQ ID NO: 347684 - DNA, 25 bp, Mus musculus
ccctccatgttcaggctggatgagg

SEQ ID NO: 347685 - DNA, 25 bp, Mus musculus
ccctccatgttctggctggatgagg

SEQ ID NO: 347686 - DNA, 25 bp, Mus musculus
ccctcccaagtgagatgactgaagt

SEQ ID NO: 347687 - DNA, 25 bp, Mus musculus
ccctcccaagtgtgatgactgaagt

SEQ ID NO: 347688 - DNA, 25 bp, Mus musculus
ccctcccaataaacacttgctgaat

SEQ ID NO: 347689 - DNA, 25 bp, Mus musculus
ccctcccaataatcacttgctgaat

SEQ ID NO: 347690 - DNA, 25 bp, Mus musculus
ccctcccaatggcttcagtggttat

SEQ ID NO: 347691 - DNA, 25 bp, Mus musculus
ccctcccaatgggttcagtggttat

SEQ ID NO: 347692 - DNA, 25 bp, Mus musculus
ccctcccagagtcgcttggagagga

SEQ ID NO: 347693 - DNA, 25 bp, Mus musculus
ccctcccagagtggcttggagagga

SEQ ID NO: 347694 - DNA, 25 bp, Mus musculus
ccctcccaggttaatcaagtcactg

SEQ ID NO: 347695 - DNA, 25 bp, Mus musculus
ccctcccaggtttatcaagtcactg

SEQ ID NO: 347696 - DNA, 25 bp, Mus musculus
ccctcccatataagaagtgaaggat

SEQ ID NO: 347697 - DNA, 25 bp, Mus musculus
ccctcccatatatgaagtgaaggat

SEQ ID NO: 347698 - DNA, 25 bp, Mus musculus
ccctcccgagctcaagaagtttatg

SEQ ID NO: 347699 - DNA, 25 bp, Mus musculus
ccctcccgagctgaagaagtttatg

SEQ ID NO: 347700 - DNA, 25 bp, Mus musculus
ccctccctattcagatgtcatatgt

SEQ ID NO: 347701 - DNA, 25 bp, Mus musculus
ccctccctattctgatgtcatatgt

SEQ ID NO: 347702 - DNA, 25 bp, Mus musculus
ccctccctcaacatgaacatgaagt

SEQ ID NO: 347703 - DNA, 25 bp, Mus musculus
ccctccctcaacttgaacatgaagt

SEQ ID NO: 347704 - DNA, 25 bp, Mus musculus
ccctccctcagaaatatgacctaag

SEQ ID NO: 347705 - DNA, 25 bp, Mus musculus
ccctccctcagatatatgacctaag

SEQ ID NO: 347706 - DNA, 25 bp, Mus musculus
ccctccctgtttcaatgctgtatta

SEQ ID NO: 347707 - DNA, 25 bp, Mus musculus
ccctccctgtttgaatgctgtatta

SEQ ID NO: 347708 - DNA, 25 bp, Mus musculus
ccctcccttcagctaatggaaactg

SEQ ID NO: 347709 - DNA, 25 bp, Mus musculus
ccctcccttcaggtaatggaaactg

SEQ ID NO: 347710 - DNA, 25 bp, Mus musculus
ccctcccttctgcaataattcaggg

SEQ ID NO: 347711 - DNA, 25 bp, Mus musculus
ccctcccttctggaataattcaggg

SEQ ID NO: 347712 - DNA, 25 bp, Mus musculus
ccctccctttgtaactcaattgatt

SEQ ID NO: 347713 - DNA, 25 bp, Mus musculus
ccctccctttgtacgtgctatgaaa

SEQ ID NO: 347714 - DNA, 25 bp, Mus musculus
ccctccctttgttactcaattgatt

SEQ ID NO: 347715 - DNA, 25 bp, Mus musculus
ccctccctttgttcgtgctatgaaa

SEQ ID NO: 347716 - DNA, 25 bp, Mus musculus
ccctccgaagcaacttcaggtgaag

SEQ ID NO: 347717 - DNA, 25 bp, Mus musculus
ccctccgaagcatcttcaggtgaag

SEQ ID NO: 347718 - DNA, 25 bp, Mus musculus
ccctccgatcccatgtagagtataa

SEQ ID NO: 347719 - DNA, 25 bp, Mus musculus
ccctccgatcccttgtagagtataa

SEQ ID NO: 347720 - DNA, 25 bp, Mus musculus
ccctccgattttctgtgtcttatat

SEQ ID NO: 347721 - DNA, 25 bp, Mus musculus
ccctccgattttgtgtgtcttatat

SEQ ID NO: 347722 - DNA, 25 bp, Mus musculus
ccctccgcagaacaagagcgtatga

SEQ ID NO: 347723 - DNA, 25 bp, Mus musculus
ccctccgcagaagaagagcgtatga

SEQ ID NO: 347724 - DNA, 25 bp, Mus musculus
ccctccggtacacaggactctgtgg

SEQ ID NO: 347725 - DNA, 25 bp, Mus musculus
ccctccggtacagaggactctgtgg

SEQ ID NO: 347726 - DNA, 25 bp, Mus musculus
ccctccgtaccaagataagacctaa

SEQ ID NO: 347727 - DNA, 25 bp, Mus musculus
ccctccgtaccatgataagacctaa

SEQ ID NO: 347728 - DNA, 25 bp, Mus musculus
ccctccgtccttagcacattgatgg

SEQ ID NO: 347729 - DNA, 25 bp, Mus musculus
ccctccgtcctttgcacattgatgg

SEQ ID NO: 347730 - DNA, 25 bp, Mus musculus
ccctccgtgttgatgggatgggatc

SEQ ID NO: 347731 - DNA, 25 bp, Mus musculus
ccctccgtgttgttgggatgggatc

SEQ ID NO: 347732 - DNA, 25 bp, Mus musculus
ccctcctacaggctggcattagaga

SEQ ID NO: 347733 - DNA, 25 bp, Mus musculus
ccctcctacagggtggcattagaga

SEQ ID NO: 347734 - DNA, 25 bp, Mus musculus
ccctcctactccagaaagttcaaga

SEQ ID NO: 347735 - DNA, 25 bp, Mus musculus
ccctcctactcctgaaagttcaaga

SEQ ID NO: 347736 - DNA, 25 bp, Mus musculus
ccctcctcagtcatgtcggaaggtt

SEQ ID NO: 347737 - DNA, 25 bp, Mus musculus
ccctcctcagtcttgtcggaaggtt

SEQ ID NO: 347738 - DNA, 25 bp, Mus musculus
ccctcctcatttagaatcacttctt

SEQ ID NO: 347739 - DNA, 25 bp, Mus musculus
ccctcctcattttgaatcacttctt

SEQ ID NO: 347740 - DNA, 25 bp, Mus musculus
ccctcctcgagtatctgtgaattaa

SEQ ID NO: 347741 - DNA, 25 bp, Mus musculus
ccctcctcgagtttctgtgaattaa

SEQ ID NO: 347742 - DNA, 25 bp, Mus musculus
ccctcctctcttcgatatgatcgat

SEQ ID NO: 347743 - DNA, 25 bp, Mus musculus
ccctcctctcttggatatgatcgat

SEQ ID NO: 347744 - DNA, 25 bp, Mus musculus
ccctcctctgagaatgagactggaa

SEQ ID NO: 347745 - DNA, 25 bp, Mus musculus
ccctcctctgagtatgagactggaa

SEQ ID NO: 347746 - DNA, 25 bp, Mus musculus
ccctcctctgatagtatactcggaa

SEQ ID NO: 347747 - DNA, 25 bp, Mus musculus
ccctcctctgattgtatactcggaa

SEQ ID NO: 347748 - DNA, 25 bp, Mus musculus
ccctcctgaacacacggataacaaa

SEQ ID NO: 347749 - DNA, 25 bp, Mus musculus
ccctcctgaacagacggataacaaa

SEQ ID NO: 347750 - DNA, 25 bp, Mus musculus
ccctcctgatggatgtgtcttaagc

SEQ ID NO: 347751 - DNA, 25 bp, Mus musculus
ccctcctgatggttgtgtcttaagc

SEQ ID NO: 347752 - DNA, 25 bp, Mus musculus
ccctcctgcctcataatatgttttt

SEQ ID NO: 347753 - DNA, 25 bp, Mus musculus
ccctcctgcctcttaatatgttttt

SEQ ID NO: 347754 - DNA, 25 bp, Mus musculus
ccctcctggcagaaaatctatttct

SEQ ID NO: 347755 - DNA, 25 bp, Mus musculus
ccctcctggcagtaaatctatttct

SEQ ID NO: 347756 - DNA, 25 bp, Mus musculus
ccctcctgggttcgatacatctgac

SEQ ID NO: 347757 - DNA, 25 bp, Mus musculus
ccctcctgggttggatacatctgac

SEQ ID NO: 347758 - DNA, 25 bp, Mus musculus
ccctcctggttcctgtaacatgagt

SEQ ID NO: 347759 - DNA, 25 bp, Mus musculus
ccctcctggttcgtgtaacatgagt

SEQ ID NO: 347760 - DNA, 25 bp, Mus musculus
ccctcctggtttccactttgaaatg

SEQ ID NO: 347761 - DNA, 25 bp, Mus musculus
ccctcctggtttgcactttgaaatg

SEQ ID NO: 347762 - DNA, 25 bp, Mus musculus
ccctcctgtcaaccgttcaagtgga

SEQ ID NO: 347763 - DNA, 25 bp, Mus musculus
ccctcctgtcaagcgttcaagtgga

SEQ ID NO: 347764 - DNA, 25 bp, Mus musculus
ccctcctgtgaaacctgtggatcta

SEQ ID NO: 347765 - DNA, 25 bp, Mus musculus
ccctcctgtgaatcctgtggatcta

SEQ ID NO: 347766 - DNA, 25 bp, Mus musculus
ccctcctgttccagtcattaagaaa

SEQ ID NO: 347767 - DNA, 25 bp, Mus musculus
ccctcctgttcctgtcattaagaaa

SEQ ID NO: 347768 - DNA, 25 bp, Mus musculus
ccctcctgttgacatcaacagcttt

SEQ ID NO: 347769 - DNA, 25 bp, Mus musculus
ccctcctgttgagatcaacagcttt

SEQ ID NO: 347770 - DNA, 25 bp, Mus musculus
ccctccttaaggactaatgctaact

SEQ ID NO: 347771 - DNA, 25 bp, Mus musculus
ccctccttaaggtctaatgctaact

SEQ ID NO: 347772 - DNA, 25 bp, Mus musculus
ccctccttcatgacagctaggtgaa

SEQ ID NO: 347773 - DNA, 25 bp, Mus musculus
ccctccttcatgtcagctaggtgaa

SEQ ID NO: 347774 - DNA, 25 bp, Mus musculus
ccctccttgaagctcctgtgggaag

SEQ ID NO: 347775 - DNA, 25 bp, Mus musculus
ccctccttgaaggtcctgtgggaag

SEQ ID NO: 347776 - DNA, 25 bp, Mus musculus
ccctccttgagcatgtagtcttaca

SEQ ID NO: 347777 - DNA, 25 bp, Mus musculus
ccctccttgagcttgtagtcttaca

SEQ ID NO: 347778 - DNA, 25 bp, Mus musculus
ccctccttgatgactgtgttaaaat

SEQ ID NO: 347779 - DNA, 25 bp, Mus musculus
ccctccttgatgtctgtgttaaaat

SEQ ID NO: 347780 - DNA, 25 bp, Mus musculus
ccctccttgcatagtgatgatctag

SEQ ID NO: 347781 - DNA, 25 bp, Mus musculus
ccctccttgcattgtgatgatctag

SEQ ID NO: 347782 - DNA, 25 bp, Mus musculus
ccctccttgggactttagtcacagg

SEQ ID NO: 347783 - DNA, 25 bp, Mus musculus
ccctccttgggagtttagtcacagg

SEQ ID NO: 347784 - DNA, 25 bp, Mus musculus
ccctcctttaccagtgtttataatg

SEQ ID NO: 347785 - DNA, 25 bp, Mus musculus
ccctcctttacctgtgtttataatg

SEQ ID NO: 347786 - DNA, 25 bp, Mus musculus
ccctcctttataaatatctctctct

SEQ ID NO: 347787 - DNA, 25 bp, Mus musculus
ccctcctttatatatatctctctct

SEQ ID NO: 347788 - DNA, 25 bp, Mus musculus
ccctcctttccaagtaagtgcattt

SEQ ID NO: 347789 - DNA, 25 bp, Mus musculus
ccctcctttccatgtaagtgcattt

SEQ ID NO: 347790 - DNA, 25 bp, Mus musculus
ccctcctttgtgcacttagcattac

SEQ ID NO: 347791 - DNA, 25 bp, Mus musculus
ccctcctttgtggacttagcattac

SEQ ID NO: 347792 - DNA, 25 bp, Mus musculus
ccctccttttcacatgactagcaga

SEQ ID NO: 347793 - DNA, 25 bp, Mus musculus
ccctccttttcagatgactagcaga

SEQ ID NO: 347794 - DNA, 25 bp, Mus musculus
ccctccttttgtcctacagtacaag

SEQ ID NO: 347795 - DNA, 25 bp, Mus musculus
ccctccttttgtgctacagtacaag

SEQ ID NO: 347796 - DNA, 25 bp, Mus musculus
ccctcgatgcctactttcatgtgaa

SEQ ID NO: 347797 - DNA, 25 bp, Mus musculus
ccctcgatgccttctttcatgtgaa

SEQ ID NO: 347798 - DNA, 25 bp, Mus musculus
ccctcgatgtgcacaggcagtgggt

SEQ ID NO: 347799 - DNA, 25 bp, Mus musculus
ccctcgatgtgctcaggcagtgggt

SEQ ID NO: 347800 - DNA, 25 bp, Mus musculus
ccctcgcaggctctaaatctttgat

SEQ ID NO: 347801 - DNA, 25 bp, Mus musculus
ccctcgcaggctgtaaatctttgat

SEQ ID NO: 347802 - DNA, 25 bp, Mus musculus
ccctcgcatcatcgctttggtggaa

SEQ ID NO: 347803 - DNA, 25 bp, Mus musculus
ccctcgcatcatggctttggtggaa

SEQ ID NO: 347804 - DNA, 25 bp, Mus musculus
ccctcgcctggacctttgaaaagtg

SEQ ID NO: 347805 - DNA, 25 bp, Mus musculus
ccctcgcctggagctttgaaaagtg

SEQ ID NO: 347806 - DNA, 25 bp, Mus musculus
ccctcgcctgttattaactttgcag

SEQ ID NO: 347807 - DNA, 25 bp, Mus musculus
ccctcgcctgtttttaactttgcag

SEQ ID NO: 347808 - DNA, 25 bp, Mus musculus
ccctcgccttggagatttcttgttt

SEQ ID NO: 347809 - DNA, 25 bp, Mus musculus
ccctcgccttggtgatttcttgttt

SEQ ID NO: 347810 - DNA, 25 bp, Mus musculus
ccctcgctgttgacatgtatggaag

SEQ ID NO: 347811 - DNA, 25 bp, Mus musculus
ccctcgctgttgtcatgtatggaag

SEQ ID NO: 347812 - DNA, 25 bp, Mus musculus
ccctcggagcaaatctttacttcat

SEQ ID NO: 347813 - DNA, 25 bp, Mus musculus
ccctcggagcaattctttacttcat

SEQ ID NO: 347814 - DNA, 25 bp, Mus musculus
ccctcggagtaccacatcttgaatg

SEQ ID NO: 347815 - DNA, 25 bp, Mus musculus
ccctcggagtacgacatcttgaatg

SEQ ID NO: 347816 - DNA, 25 bp, Mus musculus
ccctcggccctgaagcatagtgaat

SEQ ID NO: 347817 - DNA, 25 bp, Mus musculus
ccctcggccctgtagcatagtgaat

SEQ ID NO: 347818 - DNA, 25 bp, Mus musculus
ccctcgggaggtccagctacagaga

SEQ ID NO: 347819 - DNA, 25 bp, Mus musculus
ccctcgggaggtgcagctacagaga

SEQ ID NO: 347820 - DNA, 25 bp, Mus musculus
ccctcgggtgccagtgctaagttgg

SEQ ID NO: 347821 - DNA, 25 bp, Mus musculus
ccctcgggtgcctgtgctaagttgg

SEQ ID NO: 347822 - DNA, 25 bp, Mus musculus
ccctcggtggagaaggactgagctt

SEQ ID NO: 347823 - DNA, 25 bp, Mus musculus
ccctcggtggagtaggactgagctt

SEQ ID NO: 347824 - DNA, 25 bp, Mus musculus
ccctcggttatcagaaggacagatt

SEQ ID NO: 347825 - DNA, 25 bp, Mus musculus
ccctcggttatctgaaggacagatt

SEQ ID NO: 347826 - DNA, 25 bp, Mus musculus
ccctcgtactccatgttacttaatt

SEQ ID NO: 347827 - DNA, 25 bp, Mus musculus
ccctcgtactccttgttacttaatt

SEQ ID NO: 347828 - DNA, 25 bp, Mus musculus
ccctctacaagtagggcatgactga

SEQ ID NO: 347829 - DNA, 25 bp, Mus musculus
ccctctacaagttgggcatgactga

SEQ ID NO: 347830 - DNA, 25 bp, Mus musculus
ccctctacaccaagaactgattaat

SEQ ID NO: 347831 - DNA, 25 bp, Mus musculus
ccctctacaccatgaactgattaat

SEQ ID NO: 347832 - DNA, 25 bp, Mus musculus
ccctctacagtgacatgaagctcag

SEQ ID NO: 347833 - DNA, 25 bp, Mus musculus
ccctctacagtgtcatgaagctcag

SEQ ID NO: 347834 - DNA, 25 bp, Mus musculus
ccctctacattcagtggcagacatc

SEQ ID NO: 347835 - DNA, 25 bp, Mus musculus
ccctctacattctgtggcagacatc

SEQ ID NO: 347836 - DNA, 25 bp, Mus musculus
ccctctaccccactggttatataat

SEQ ID NO: 347837 - DNA, 25 bp, Mus musculus
ccctctaccccagtggttatataat

SEQ ID NO: 347838 - DNA, 25 bp, Mus musculus
ccctctactctacgtactgtatgtt

SEQ ID NO: 347839 - DNA, 25 bp, Mus musculus
ccctctactctaggtactgtatgtt

SEQ ID NO: 347840 - DNA, 25 bp, Mus musculus
ccctctactctcagattgtggatgt

SEQ ID NO: 347841 - DNA, 25 bp, Mus musculus
ccctctactctcatggttgttttta

SEQ ID NO: 347842 - DNA, 25 bp, Mus musculus
ccctctactctctgattgtggatgt

SEQ ID NO: 347843 - DNA, 25 bp, Mus musculus
ccctctactctcttggttgttttta

SEQ ID NO: 347844 - DNA, 25 bp, Mus musculus
ccctctacttccctctagatagaag

SEQ ID NO: 347845 - DNA, 25 bp, Mus musculus
ccctctacttccgtctagatagaag

SEQ ID NO: 347846 - DNA, 25 bp, Mus musculus
ccctctagatttcacctgtagtata

SEQ ID NO: 347847 - DNA, 25 bp, Mus musculus
ccctctagatttgacctgtagtata

SEQ ID NO: 347848 - DNA, 25 bp, Mus musculus
ccctctagcataaagaagtgctctt

SEQ ID NO: 347849 - DNA, 25 bp, Mus musculus
ccctctagcatatagaagtgctctt

SEQ ID NO: 347850 - DNA, 25 bp, Mus musculus
ccctctagccagcaatctgttgttt

SEQ ID NO: 347851 - DNA, 25 bp, Mus musculus
ccctctagccaggaatctgttgttt

SEQ ID NO: 347852 - DNA, 25 bp, Mus musculus
ccctctagctggaagtccatcagat

SEQ ID NO: 347853 - DNA, 25 bp, Mus musculus
ccctctagctggtagtccatcagat

SEQ ID NO: 347854 - DNA, 25 bp, Mus musculus
ccctctagggccctaatgatataat

SEQ ID NO: 347855 - DNA, 25 bp, Mus musculus
ccctctagggccgtaatgatataat

SEQ ID NO: 347856 - DNA, 25 bp, Mus musculus
ccctctaggtgcacaggcggatgaa

SEQ ID NO: 347857 - DNA, 25 bp, Mus musculus
ccctctaggtgctcaggcggatgaa

SEQ ID NO: 347858 - DNA, 25 bp, Mus musculus
ccctctagtggccatttctgattta

SEQ ID NO: 347859 - DNA, 25 bp, Mus musculus
ccctctagtggcgatttctgattta

SEQ ID NO: 347860 - DNA, 25 bp, Mus musculus
ccctctatatttatgctgtgacttc

SEQ ID NO: 347861 - DNA, 25 bp, Mus musculus
ccctctatatttttgctgtgacttc

SEQ ID NO: 347862 - DNA, 25 bp, Mus musculus
ccctctatgatgcacttacttctga

SEQ ID NO: 347863 - DNA, 25 bp, Mus musculus
ccctctatgatggacttacttctga

SEQ ID NO: 347864 - DNA, 25 bp, Mus musculus
ccctctatgctgcacgcggtgttag

SEQ ID NO: 347865 - DNA, 25 bp, Mus musculus
ccctctatgctggacgcggtgttag

SEQ ID NO: 347866 - DNA, 25 bp, Mus musculus
ccctctcaactacgactgcatgttt

SEQ ID NO: 347867 - DNA, 25 bp, Mus musculus
ccctctcaactaggactgcatgttt

SEQ ID NO: 347868 - DNA, 25 bp, Mus musculus
ccctctcacagtcggcttggtcaga

SEQ ID NO: 347869 - DNA, 25 bp, Mus musculus
ccctctcacagtgggcttggtcaga

SEQ ID NO: 347870 - DNA, 25 bp, Mus musculus
ccctctcaccatagcagtttaataa

SEQ ID NO: 347871 - DNA, 25 bp, Mus musculus
ccctctcaccattgcagtttaataa

SEQ ID NO: 347872 - DNA, 25 bp, Mus musculus
ccctctcaggaaagagaacctctgc

SEQ ID NO: 347873 - DNA, 25 bp, Mus musculus
ccctctcaggaatgagaacctctgc

SEQ ID NO: 347874 - DNA, 25 bp, Mus musculus
ccctctcagtatactgtgctcagaa

SEQ ID NO: 347875 - DNA, 25 bp, Mus musculus
ccctctcagtattctgtgctcagaa

SEQ ID NO: 347876 - DNA, 25 bp, Mus musculus
ccctctcagtgtatcacaatgggag

SEQ ID NO: 347877 - DNA, 25 bp, Mus musculus
ccctctcagtgtttcacaatgggag

SEQ ID NO: 347878 - DNA, 25 bp, Mus musculus
ccctctccaagacctgatgtgttca

SEQ ID NO: 347879 - DNA, 25 bp, Mus musculus
ccctctccaagagctgatgtgttca

SEQ ID NO: 347880 - DNA, 25 bp, Mus musculus
ccctctccagcaatgaccttgaaat

SEQ ID NO: 347881 - DNA, 25 bp, Mus musculus
ccctctccagcattgaccttgaaat

SEQ ID NO: 347882 - DNA, 25 bp, Mus musculus
ccctctctccaacttctgaattatg

SEQ ID NO: 347883 - DNA, 25 bp, Mus musculus
ccctctctccaagttctgaattatg

SEQ ID NO: 347884 - DNA, 25 bp, Mus musculus
ccctctctcccaattagaaagcaat

SEQ ID NO: 347885 - DNA, 25 bp, Mus musculus
ccctctctcccatttagaaagcaat

SEQ ID NO: 347886 - DNA, 25 bp, Mus musculus
ccctctctcctaccttggtaatgaa

SEQ ID NO: 347887 - DNA, 25 bp, Mus musculus
ccctctctcctagcttggtaatgaa

SEQ ID NO: 347888 - DNA, 25 bp, Mus musculus
ccctctctctctctgatagatatgg

SEQ ID NO: 347889 - DNA, 25 bp, Mus musculus
ccctctctctctgtgatagatatgg

SEQ ID NO: 347890 - DNA, 25 bp, Mus musculus
ccctctctgggcattatatactata

SEQ ID NO: 347891 - DNA, 25 bp, Mus musculus
ccctctctgggctttatatactata

SEQ ID NO: 347892 - DNA, 25 bp, Mus musculus
ccctctcttgtcctttatggtacaa

SEQ ID NO: 347893 - DNA, 25 bp, Mus musculus
ccctctcttgtcgtttatggtacaa

SEQ ID NO: 347894 - DNA, 25 bp, Mus musculus
ccctctgaactcattgtctggtagt

SEQ ID NO: 347895 - DNA, 25 bp, Mus musculus
ccctctgaactctttgtctggtagt

SEQ ID NO: 347896 - DNA, 25 bp, Mus musculus
ccctctgaagcacttaggagctact

SEQ ID NO: 347897 - DNA, 25 bp, Mus musculus
ccctctgaagcagttaggagctact

SEQ ID NO: 347898 - DNA, 25 bp, Mus musculus
ccctctgaagggagtgggttatact

SEQ ID NO: 347899 - DNA, 25 bp, Mus musculus
ccctctgaagggtgtgggttatact

SEQ ID NO: 347900 - DNA, 25 bp, Mus musculus
ccctctgaaggtatcctggttggag

SEQ ID NO: 347901 - DNA, 25 bp, Mus musculus
ccctctgaaggtttcctggttggag

SEQ ID NO: 347902 - DNA, 25 bp, Mus musculus
ccctctgactcaaaggttctgtttg

SEQ ID NO: 347903 - DNA, 25 bp, Mus musculus
ccctctgactcataggttctgtttg

SEQ ID NO: 347904 - DNA, 25 bp, Mus musculus
ccctctgagtgcaacgtgacatgtg

SEQ ID NO: 347905 - DNA, 25 bp, Mus musculus
ccctctgagtgctacgtgacatgtg

SEQ ID NO: 347906 - DNA, 25 bp, Mus musculus
ccctctgatagcactcgaagaaaag

SEQ ID NO: 347907 - DNA, 25 bp, Mus musculus
ccctctgatagctctcgaagaaaag

SEQ ID NO: 347908 - DNA, 25 bp, Mus musculus
ccctctgattctaattggtatgcgc

SEQ ID NO: 347909 - DNA, 25 bp, Mus musculus
ccctctgattcttattggtatgcgc

SEQ ID NO: 347910 - DNA, 25 bp, Mus musculus
ccctctgcacttagtttacttgttt

SEQ ID NO: 347911 - DNA, 25 bp, Mus musculus
ccctctgcactttgtttacttgttt

SEQ ID NO: 347912 - DNA, 25 bp, Mus musculus
ccctctgcagagcaaagaccgtgac

SEQ ID NO: 347913 - DNA, 25 bp, Mus musculus
ccctctgcagaggaaagaccgtgac

SEQ ID NO: 347914 - DNA, 25 bp, Mus musculus
ccctctgccaatctgagataccatt

SEQ ID NO: 347915 - DNA, 25 bp, Mus musculus
ccctctgccaatgtgagataccatt

SEQ ID NO: 347916 - DNA, 25 bp, Mus musculus
ccctctgcggagcatgtgtacgact

SEQ ID NO: 347917 - DNA, 25 bp, Mus musculus
ccctctgcggaggatgtgtacgact

SEQ ID NO: 347918 - DNA, 25 bp, Mus musculus
ccctctgcgtctcatacttaagtaa

SEQ ID NO: 347919 - DNA, 25 bp, Mus musculus
ccctctgcgtctgatacttaagtaa

SEQ ID NO: 347920 - DNA, 25 bp, Mus musculus
ccctctgcgtgtagctaagatgcag

SEQ ID NO: 347921 - DNA, 25 bp, Mus musculus
ccctctgcgtgttgctaagatgcag

SEQ ID NO: 347922 - DNA, 25 bp, Mus musculus
ccctctgctgtccataatgtgagtg

SEQ ID NO: 347923 - DNA, 25 bp, Mus musculus
ccctctgctgtcgataatgtgagtg

SEQ ID NO: 347924 - DNA, 25 bp, Mus musculus
ccctctgcttccaggacagagaggt

SEQ ID NO: 347925 - DNA, 25 bp, Mus musculus
ccctctgcttcctggacagagaggt

SEQ ID NO: 347926 - DNA, 25 bp, Mus musculus
ccctctgcttgtccaaaattcagtg

SEQ ID NO: 347927 - DNA, 25 bp, Mus musculus
ccctctgcttgtgcaaaattcagtg

SEQ ID NO: 347928 - DNA, 25 bp, Mus musculus
ccctctggaatacttctgcactgaa

SEQ ID NO: 347929 - DNA, 25 bp, Mus musculus
ccctctggaatagttctgcactgaa

SEQ ID NO: 347930 - DNA, 25 bp, Mus musculus
ccctctggaggacgcggatcatcag

SEQ ID NO: 347931 - DNA, 25 bp, Mus musculus
ccctctggaggaggcggatcatcag

SEQ ID NO: 347932 - DNA, 25 bp, Mus musculus
ccctctggccaactatagctgtgtg

SEQ ID NO: 347933 - DNA, 25 bp, Mus musculus
ccctctggccaagtatagctgtgtg

SEQ ID NO: 347934 - DNA, 25 bp, Mus musculus
ccctctggcccaattttgtctctga

SEQ ID NO: 347935 - DNA, 25 bp, Mus musculus
ccctctggcccatttttgtctctga

SEQ ID NO: 347936 - DNA, 25 bp, Mus musculus
ccctctggctaacatcctcgaggat

SEQ ID NO: 347937 - DNA, 25 bp, Mus musculus
ccctctggctaagatcctcgaggat

SEQ ID NO: 347938 - DNA, 25 bp, Mus musculus
ccctctggctcaagaaagaatctct

SEQ ID NO: 347939 - DNA, 25 bp, Mus musculus
ccctctggctcatgaaagaatctct

SEQ ID NO: 347940 - DNA, 25 bp, Mus musculus
ccctctggctgcaggcatgcatgca

SEQ ID NO: 347941 - DNA, 25 bp, Mus musculus
ccctctggctgctggcatgcatgca

SEQ ID NO: 347942 - DNA, 25 bp, Mus musculus
ccctctggctggcaatcgctgtggt

SEQ ID NO: 347943 - DNA, 25 bp, Mus musculus
ccctctggctgggaatcgctgtggt

SEQ ID NO: 347944 - DNA, 25 bp, Mus musculus
ccctctggcttgagtttcttgtgca

SEQ ID NO: 347945 - DNA, 25 bp, Mus musculus
ccctctggcttgtgtttcttgtgca

SEQ ID NO: 347946 - DNA, 25 bp, Mus musculus
ccctctgggagacttgtgtgctcca

SEQ ID NO: 347947 - DNA, 25 bp, Mus musculus
ccctctgggagagttgtgtgctcca

SEQ ID NO: 347948 - DNA, 25 bp, Mus musculus
ccctctgggatgcattgtgactact

SEQ ID NO: 347949 - DNA, 25 bp, Mus musculus
ccctctgggatggattgtgactact

SEQ ID NO: 347950 - DNA, 25 bp, Mus musculus
ccctctgggctgatttctaaacttg

SEQ ID NO: 347951 - DNA, 25 bp, Mus musculus
ccctctgggctgttttctaaacttg

SEQ ID NO: 347952 - DNA, 25 bp, Mus musculus
ccctctggtggtacatgtagtacta

SEQ ID NO: 347953 - DNA, 25 bp, Mus musculus
ccctctggtggttcatgtagtacta

SEQ ID NO: 347954 - DNA, 25 bp, Mus musculus
ccctctggtgtcaggcattattgat

SEQ ID NO: 347955 - DNA, 25 bp, Mus musculus
ccctctggtgtctggcattattgat

SEQ ID NO: 347956 - DNA, 25 bp, Mus musculus
ccctctgtaagactcggcctagaat

SEQ ID NO: 347957 - DNA, 25 bp, Mus musculus
ccctctgtaagagtcggcctagaat

SEQ ID NO: 347958 - DNA, 25 bp, Mus musculus
ccctctgtacatcgacgctggatga

SEQ ID NO: 347959 - DNA, 25 bp, Mus musculus
ccctctgtacatggacgctggatga

SEQ ID NO: 347960 - DNA, 25 bp, Mus musculus
ccctctgtagacatgtatggctaat

SEQ ID NO: 347961 - DNA, 25 bp, Mus musculus
ccctctgtagacttgtatggctaat

SEQ ID NO: 347962 - DNA, 25 bp, Mus musculus
ccctctgtcaaaaggccttcaagta

SEQ ID NO: 347963 - DNA, 25 bp, Mus musculus
ccctctgtcaaatggccttcaagta

SEQ ID NO: 347964 - DNA, 25 bp, Mus musculus
ccctctgtggttcctgtcaggcaag

SEQ ID NO: 347965 - DNA, 25 bp, Mus musculus
ccctctgtggttgctgtcaggcaag

SEQ ID NO: 347966 - DNA, 25 bp, Mus musculus
ccctctgtgtacagcctttaacaaa

SEQ ID NO: 347967 - DNA, 25 bp, Mus musculus
ccctctgtgtactgcctttaacaaa

SEQ ID NO: 347968 - DNA, 25 bp, Mus musculus
ccctctgttaaaaatgcctgtgaat

SEQ ID NO: 347969 - DNA, 25 bp, Mus musculus
ccctctgttaaatatgcctgtgaat

SEQ ID NO: 347970 - DNA, 25 bp, Mus musculus
ccctcttaacctacctgattgagaa

SEQ ID NO: 347971 - DNA, 25 bp, Mus musculus
ccctcttaaccttcctgattgagaa

SEQ ID NO: 347972 - DNA, 25 bp, Mus musculus
ccctcttaacgtacgctttctgtca

SEQ ID NO: 347973 - DNA, 25 bp, Mus musculus
ccctcttaacgttcgctttctgtca

SEQ ID NO: 347974 - DNA, 25 bp, Mus musculus
ccctcttagactacacttacactat

SEQ ID NO: 347975 - DNA, 25 bp, Mus musculus
ccctcttagacttcacttacactat

SEQ ID NO: 347976 - DNA, 25 bp, Mus musculus
ccctcttagcaacctagtcttagca

SEQ ID NO: 347977 - DNA, 25 bp, Mus musculus
ccctcttagcaagctagtcttagca

SEQ ID NO: 347978 - DNA, 25 bp, Mus musculus
ccctcttattttagctattctggta

SEQ ID NO: 347979 - DNA, 25 bp, Mus musculus
ccctcttatttttgctattctggta

SEQ ID NO: 347980 - DNA, 25 bp, Mus musculus
ccctcttcacctcaatgtgggaact

SEQ ID NO: 347981 - DNA, 25 bp, Mus musculus
ccctcttcacctgaatgtgggaact

SEQ ID NO: 347982 - DNA, 25 bp, Mus musculus
ccctcttcatggataccactaggtt

SEQ ID NO: 347983 - DNA, 25 bp, Mus musculus
ccctcttcatggttaccactaggtt

SEQ ID NO: 347984 - DNA, 25 bp, Mus musculus
ccctcttcctgactatatcaacttt

SEQ ID NO: 347985 - DNA, 25 bp, Mus musculus
ccctcttcctgagtatatcaacttt

SEQ ID NO: 347986 - DNA, 25 bp, Mus musculus
ccctcttcgtacaaacaagtctaca

SEQ ID NO: 347987 - DNA, 25 bp, Mus musculus
ccctcttcgtactaacaagtctaca

SEQ ID NO: 347988 - DNA, 25 bp, Mus musculus
ccctcttctactatgctagcaaact

SEQ ID NO: 347989 - DNA, 25 bp, Mus musculus
ccctcttctactttgctagcaaact

SEQ ID NO: 347990 - DNA, 25 bp, Mus musculus
ccctcttctccaaattgctgtgaac

SEQ ID NO: 347991 - DNA, 25 bp, Mus musculus
ccctcttctccatattgctgtgaac

SEQ ID NO: 347992 - DNA, 25 bp, Mus musculus
ccctcttctggtaccatgtggtatg

SEQ ID NO: 347993 - DNA, 25 bp, Mus musculus
ccctcttctggttccatgtggtatg

SEQ ID NO: 347994 - DNA, 25 bp, Mus musculus
ccctcttctttgaatccgttagaca

SEQ ID NO: 347995 - DNA, 25 bp, Mus musculus
ccctcttctttgtatccgttagaca

SEQ ID NO: 347996 - DNA, 25 bp, Mus musculus
ccctcttgaccacgagtgggtacca

SEQ ID NO: 347997 - DNA, 25 bp, Mus musculus
ccctcttgaccaggagtgggtacca

SEQ ID NO: 347998 - DNA, 25 bp, Mus musculus
ccctcttgacctatgcatctttagc

SEQ ID NO: 347999 - DNA, 25 bp, Mus musculus
ccctcttgacctttgcatctttagc

SEQ ID NO: 348000 - DNA, 25 bp, Mus musculus
ccctcttgcctaagatgggctgtga

SEQ ID NO: 348001 - DNA, 25 bp, Mus musculus
ccctcttgcctatgatgggctgtga

SEQ ID NO: 348002 - DNA, 25 bp, Mus musculus
ccctcttggctgcagtgtggaatgt

SEQ ID NO: 348003 - DNA, 25 bp, Mus musculus
ccctcttggctggagtgtggaatgt

SEQ ID NO: 348004 - DNA, 25 bp, Mus musculus
ccctcttggtgacttcatggaaaca

SEQ ID NO: 348005 - DNA, 25 bp, Mus musculus
ccctcttggtgagttcatggaaaca

SEQ ID NO: 348006 - DNA, 25 bp, Mus musculus
ccctctttacctcacaacagtttgg

SEQ ID NO: 348007 - DNA, 25 bp, Mus musculus
ccctctttacctgacaacagtttgg

SEQ ID NO: 348008 - DNA, 25 bp, Mus musculus
ccctctttagcccatatttgcaagg

SEQ ID NO: 348009 - DNA, 25 bp, Mus musculus
ccctctttagccgatatttgcaagg

SEQ ID NO: 348010 - DNA, 25 bp, Mus musculus
ccctctttatatcttgtctcattgt

SEQ ID NO: 348011 - DNA, 25 bp, Mus musculus
ccctctttatatgttgtctcattgt

SEQ ID NO: 348012 - DNA, 25 bp, Mus musculus
ccctctttgactacgatcctaagga

SEQ ID NO: 348013 - DNA, 25 bp, Mus musculus
ccctctttgacttcgatcctaagga

SEQ ID NO: 348014 - DNA, 25 bp, Mus musculus
ccctctttgtagctcatctatgttt

SEQ ID NO: 348015 - DNA, 25 bp, Mus musculus
ccctctttgtaggtcatctatgttt

SEQ ID NO: 348016 - DNA, 25 bp, Mus musculus
ccctctttgtgtacttcaagtcttg

SEQ ID NO: 348017 - DNA, 25 bp, Mus musculus
ccctctttgtgttcttcaagtcttg

SEQ ID NO: 348018 - DNA, 25 bp, Mus musculus
ccctcttttctccatatcttgtgaa

SEQ ID NO: 348019 - DNA, 25 bp, Mus musculus
ccctcttttctcgatatcttgtgaa

SEQ ID NO: 348020 - DNA, 25 bp, Mus musculus
ccctctttttatctgagcctggaag

SEQ ID NO: 348021 - DNA, 25 bp, Mus musculus
ccctctttttatgtgagcctggaag

SEQ ID NO: 348022 - DNA, 25 bp, Mus musculus
ccctctttttgtctatctgaagata

SEQ ID NO: 348023 - DNA, 25 bp, Mus musculus
ccctctttttgtgtatctgaagata

SEQ ID NO: 348024 - DNA, 25 bp, Mus musculus
ccctgaaactgcatgtggcaggttc

SEQ ID NO: 348025 - DNA, 25 bp, Mus musculus
ccctgaaactgcttgtggcaggttc

SEQ ID NO: 348026 - DNA, 25 bp, Mus musculus
ccctgaaatgtacgtggagccactc

SEQ ID NO: 348027 - DNA, 25 bp, Mus musculus
ccctgaaatgtaggtggagccactc

SEQ ID NO: 348028 - DNA, 25 bp, Mus musculus
ccctgaacagccagggtggaggata

SEQ ID NO: 348029 - DNA, 25 bp, Mus musculus
ccctgaacagcctgggtggaggata

SEQ ID NO: 348030 - DNA, 25 bp, Mus musculus
ccctgaaccagcaagtggagaattt

SEQ ID NO: 348031 - DNA, 25 bp, Mus musculus
ccctgaaccagctagtggagaattt

SEQ ID NO: 348032 - DNA, 25 bp, Mus musculus
ccctgaaccctacaagcgatggtat

SEQ ID NO: 348033 - DNA, 25 bp, Mus musculus
ccctgaaccctagaagcgatggtat

SEQ ID NO: 348034 - DNA, 25 bp, Mus musculus
ccctgaacgccgacacaggtgtggg

SEQ ID NO: 348035 - DNA, 25 bp, Mus musculus
ccctgaacgccgtcacaggtgtggg

SEQ ID NO: 348036 - DNA, 25 bp, Mus musculus
ccctgaagacttactgggctgaaaa

SEQ ID NO: 348037 - DNA, 25 bp, Mus musculus
ccctgaagactttctgggctgaaaa

SEQ ID NO: 348038 - DNA, 25 bp, Mus musculus
ccctgaaggctgagttggccaactt

SEQ ID NO: 348039 - DNA, 25 bp, Mus musculus
ccctgaaggctgtgttggccaactt

SEQ ID NO: 348040 - DNA, 25 bp, Mus musculus
ccctgaatcaagctgtcttacagag

SEQ ID NO: 348041 - DNA, 25 bp, Mus musculus
ccctgaatcaaggtgtcttacagag

SEQ ID NO: 348042 - DNA, 25 bp, Mus musculus
ccctgaatgtggaggacatcctcct

SEQ ID NO: 348043 - DNA, 25 bp, Mus musculus
ccctgaatgtggtggacatcctcct

SEQ ID NO: 348044 - DNA, 25 bp, Mus musculus
ccctgacaaggaaaaagtggcatta

SEQ ID NO: 348045 - DNA, 25 bp, Mus musculus
ccctgacaaggataaagtggcatta

SEQ ID NO: 348046 - DNA, 25 bp, Mus musculus
ccctgacacagcctgcagatggtca

SEQ ID NO: 348047 - DNA, 25 bp, Mus musculus
ccctgacacagcgtgcagatggtca

SEQ ID NO: 348048 - DNA, 25 bp, Mus musculus
ccctgacacgatatggttgcatgtg

SEQ ID NO: 348049 - DNA, 25 bp, Mus musculus
ccctgacacgatttggttgcatgtg

SEQ ID NO: 348050 - DNA, 25 bp, Mus musculus
ccctgacagggacatttctacacaa

SEQ ID NO: 348051 - DNA, 25 bp, Mus musculus
ccctgacagggagatttctacacaa

SEQ ID NO: 348052 - DNA, 25 bp, Mus musculus
ccctgacatgcgcgccttggcgaaa

SEQ ID NO: 348053 - DNA, 25 bp, Mus musculus
ccctgacatgcgggccttggcgaaa

SEQ ID NO: 348054 - DNA, 25 bp, Mus musculus
ccctgacatgtgatatgagctcaca

SEQ ID NO: 348055 - DNA, 25 bp, Mus musculus
ccctgacatgtgttatgagctcaca

SEQ ID NO: 348056 - DNA, 25 bp, Mus musculus
ccctgacccatgactgtatatctgt

SEQ ID NO: 348057 - DNA, 25 bp, Mus musculus
ccctgacccatgtctgtatatctgt

SEQ ID NO: 348058 - DNA, 25 bp, Mus musculus
ccctgaccccttaaatgtagcaaat

SEQ ID NO: 348059 - DNA, 25 bp, Mus musculus
ccctgacccctttaatgtagcaaat

SEQ ID NO: 348060 - DNA, 25 bp, Mus musculus
ccctgaccctgacccattgaagggt

SEQ ID NO: 348061 - DNA, 25 bp, Mus musculus
ccctgaccctgagccattgaagggt

SEQ ID NO: 348062 - DNA, 25 bp, Mus musculus
ccctgaccgtccagttacactggag

SEQ ID NO: 348063 - DNA, 25 bp, Mus musculus
ccctgaccgtcctgttacactggag

SEQ ID NO: 348064 - DNA, 25 bp, Mus musculus
ccctgacctaggctggactaagaat

SEQ ID NO: 348065 - DNA, 25 bp, Mus musculus
ccctgacctagggtggactaagaat

SEQ ID NO: 348066 - DNA, 25 bp, Mus musculus
ccctgacctcaaccaatagtgataa

SEQ ID NO: 348067 - DNA, 25 bp, Mus musculus
ccctgacctcaagcaatagtgataa

SEQ ID NO: 348068 - DNA, 25 bp, Mus musculus
ccctgacctcacagggagacctggg

SEQ ID NO: 348069 - DNA, 25 bp, Mus musculus
ccctgacctcactgggagacctggg

SEQ ID NO: 348070 - DNA, 25 bp, Mus musculus
ccctgacctggacaagtgtgcacat

SEQ ID NO: 348071 - DNA, 25 bp, Mus musculus
ccctgacctggagaagtgtgcacat

SEQ ID NO: 348072 - DNA, 25 bp, Mus musculus
ccctgacctggcagtggtgacagga

SEQ ID NO: 348073 - DNA, 25 bp, Mus musculus
ccctgacctggctgtggtgacagga

SEQ ID NO: 348074 - DNA, 25 bp, Mus musculus
ccctgaccttccaactaatgacttg

SEQ ID NO: 348075 - DNA, 25 bp, Mus musculus
ccctgaccttcctactaatgacttg

SEQ ID NO: 348076 - DNA, 25 bp, Mus musculus
ccctgacctttgaggagtcaaaatt

SEQ ID NO: 348077 - DNA, 25 bp, Mus musculus
ccctgacctttgtggagtcaaaatt

SEQ ID NO: 348078 - DNA, 25 bp, Mus musculus
ccctgacgacgacgacgtctatgag

SEQ ID NO: 348079 - DNA, 25 bp, Mus musculus
ccctgacgacgaggacgtctatgag

SEQ ID NO: 348080 - DNA, 25 bp, Mus musculus
ccctgactaagacctgcagtgtaat

SEQ ID NO: 348081 - DNA, 25 bp, Mus musculus
ccctgactaagagctgcagtgtaat

SEQ ID NO: 348082 - DNA, 25 bp, Mus musculus
ccctgactaatacaactagttaata

SEQ ID NO: 348083 - DNA, 25 bp, Mus musculus
ccctgactaatacacctgctaacta

SEQ ID NO: 348084 - DNA, 25 bp, Mus musculus
ccctgactaatagaactagttaata

SEQ ID NO: 348085 - DNA, 25 bp, Mus musculus
ccctgactaatagacctgctaacta

SEQ ID NO: 348086 - DNA, 25 bp, Mus musculus
ccctgactactgagtcttggacaag

SEQ ID NO: 348087 - DNA, 25 bp, Mus musculus
ccctgactactgtgtcttggacaag

SEQ ID NO: 348088 - DNA, 25 bp, Mus musculus
ccctgactcattccttactggtagg

SEQ ID NO: 348089 - DNA, 25 bp, Mus musculus
ccctgactcattgcttactggtagg

SEQ ID NO: 348090 - DNA, 25 bp, Mus musculus
ccctgactggctaaaaacttgctat

SEQ ID NO: 348091 - DNA, 25 bp, Mus musculus
ccctgactggcttaaaacttgctat

SEQ ID NO: 348092 - DNA, 25 bp, Mus musculus
ccctgacttcagatacacatgtaca

SEQ ID NO: 348093 - DNA, 25 bp, Mus musculus
ccctgacttcagatggttcatatct

SEQ ID NO: 348094 - DNA, 25 bp, Mus musculus
ccctgacttcagttacacatgtaca

SEQ ID NO: 348095 - DNA, 25 bp, Mus musculus
ccctgacttcagttggttcatatct

SEQ ID NO: 348096 - DNA, 25 bp, Mus musculus
ccctgacttcctcactatattttta

SEQ ID NO: 348097 - DNA, 25 bp, Mus musculus
ccctgacttcctgactatattttta

SEQ ID NO: 348098 - DNA, 25 bp, Mus musculus
ccctgacttttcaaaccttgactat

SEQ ID NO: 348099 - DNA, 25 bp, Mus musculus
ccctgacttttctaaccttgactat

SEQ ID NO: 348100 - DNA, 25 bp, Mus musculus
ccctgagaaatcatgccacgtaaca

SEQ ID NO: 348101 - DNA, 25 bp, Mus musculus
ccctgagaaatcttgccacgtaaca

SEQ ID NO: 348102 - DNA, 25 bp, Mus musculus
ccctgagaaatgaatgcgtttgtaa

SEQ ID NO: 348103 - DNA, 25 bp, Mus musculus
ccctgagaaatgtatgcgtttgtaa

SEQ ID NO: 348104 - DNA, 25 bp, Mus musculus
ccctgagaagcaacccagagatctg

SEQ ID NO: 348105 - DNA, 25 bp, Mus musculus
ccctgagaagcatcccagagatctg

SEQ ID NO: 348106 - DNA, 25 bp, Mus musculus
ccctgagacagtaggcgcaggccca

SEQ ID NO: 348107 - DNA, 25 bp, Mus musculus
ccctgagacagttggcgcaggccca

SEQ ID NO: 348108 - DNA, 25 bp, Mus musculus
ccctgagagagacgctttatggtcg

SEQ ID NO: 348109 - DNA, 25 bp, Mus musculus
ccctgagagagaggctttatggtcg

SEQ ID NO: 348110 - DNA, 25 bp, Mus musculus
ccctgagaggtgccttgaacaagaa

SEQ ID NO: 348111 - DNA, 25 bp, Mus musculus
ccctgagaggtggcttgaacaagaa

SEQ ID NO: 348112 - DNA, 25 bp, Mus musculus
ccctgagcacggaaatgttatcatg

SEQ ID NO: 348113 - DNA, 25 bp, Mus musculus
ccctgagcacggtaatgttatcatg

SEQ ID NO: 348114 - DNA, 25 bp, Mus musculus
ccctgagcagcacatctgtaataag

SEQ ID NO: 348115 - DNA, 25 bp, Mus musculus
ccctgagcagcagatctgtaataag

SEQ ID NO: 348116 - DNA, 25 bp, Mus musculus
ccctgagcatccatctcaaaacttg

SEQ ID NO: 348117 - DNA, 25 bp, Mus musculus
ccctgagcatccttctcaaaacttg

SEQ ID NO: 348118 - DNA, 25 bp, Mus musculus
ccctgagcatctctgggagcttgtt

SEQ ID NO: 348119 - DNA, 25 bp, Mus musculus
ccctgagcatctgtgggagcttgtt

SEQ ID NO: 348120 - DNA, 25 bp, Mus musculus
ccctgagcatgtccgggaaatatta

SEQ ID NO: 348121 - DNA, 25 bp, Mus musculus
ccctgagcatgtgcgggaaatatta

SEQ ID NO: 348122 - DNA, 25 bp, Mus musculus
ccctgagccaagaactcgtggctgt

SEQ ID NO: 348123 - DNA, 25 bp, Mus musculus
ccctgagccaagtactcgtggctgt

SEQ ID NO: 348124 - DNA, 25 bp, Mus musculus
ccctgagccctgcttgatggaaaac

SEQ ID NO: 348125 - DNA, 25 bp, Mus musculus
ccctgagccctggttgatggaaaac

SEQ ID NO: 348126 - DNA, 25 bp, Mus musculus
ccctgagcgcaaatctcttataaaa

SEQ ID NO: 348127 - DNA, 25 bp, Mus musculus
ccctgagcgcaattctcttataaaa

SEQ ID NO: 348128 - DNA, 25 bp, Mus musculus
ccctgagcggagatactgggttcca

SEQ ID NO: 348129 - DNA, 25 bp, Mus musculus
ccctgagcggagttactgggttcca

SEQ ID NO: 348130 - DNA, 25 bp, Mus musculus
ccctgagctataaatcctcaaaggg

SEQ ID NO: 348131 - DNA, 25 bp, Mus musculus
ccctgagctatatatcctcaaaggg

SEQ ID NO: 348132 - DNA, 25 bp, Mus musculus
ccctgagctgctcaggtacttgcta

SEQ ID NO: 348133 - DNA, 25 bp, Mus musculus
ccctgagctgctgaggtacttgcta

SEQ ID NO: 348134 - DNA, 25 bp, Mus musculus
ccctgaggaacacgctgctcttgac

SEQ ID NO: 348135 - DNA, 25 bp, Mus musculus
ccctgaggaacaggctgctcttgac

SEQ ID NO: 348136 - DNA, 25 bp, Mus musculus
ccctgaggactgagaaccagatcat

SEQ ID NO: 348137 - DNA, 25 bp, Mus musculus
ccctgaggactgtgaaccagatcat

SEQ ID NO: 348138 - DNA, 25 bp, Mus musculus
ccctgaggaggcacctgactatcct

SEQ ID NO: 348139 - DNA, 25 bp, Mus musculus
ccctgaggaggctcctgactatcct

SEQ ID NO: 348140 - DNA, 25 bp, Mus musculus
ccctgaggataaagggcatcaagaa

SEQ ID NO: 348141 - DNA, 25 bp, Mus musculus
ccctgaggataatgggcatcaagaa

SEQ ID NO: 348142 - DNA, 25 bp, Mus musculus
ccctgaggctcacactgcggaattg

SEQ ID NO: 348143 - DNA, 25 bp, Mus musculus
ccctgaggctcagactgcggaattg

SEQ ID NO: 348144 - DNA, 25 bp, Mus musculus
ccctgagggcatctctgagccaatt

SEQ ID NO: 348145 - DNA, 25 bp, Mus musculus
ccctgagggcatgtctgagccaatt

SEQ ID NO: 348146 - DNA, 25 bp, Mus musculus
ccctgagggcccacccagagagggt

SEQ ID NO: 348147 - DNA, 25 bp, Mus musculus
ccctgagggccctcccagagagggt

SEQ ID NO: 348148 - DNA, 25 bp, Mus musculus
ccctgagggcgcactgagtcctgag

SEQ ID NO: 348149 - DNA, 25 bp, Mus musculus
ccctgagggcgctctgagtcctgag

SEQ ID NO: 348150 - DNA, 25 bp, Mus musculus
ccctgagtcagtcactgtgacttgg

SEQ ID NO: 348151 - DNA, 25 bp, Mus musculus
ccctgagtcagtgactgtgacttgg

SEQ ID NO: 348152 - DNA, 25 bp, Mus musculus
ccctgagtcataacttcaagagtca

SEQ ID NO: 348153 - DNA, 25 bp, Mus musculus
ccctgagtcatatcttcaagagtca

SEQ ID NO: 348154 - DNA, 25 bp, Mus musculus
ccctgagttcgaaccgtgacgtaga

SEQ ID NO: 348155 - DNA, 25 bp, Mus musculus
ccctgagttcgatccgtgacgtaga

SEQ ID NO: 348156 - DNA, 25 bp, Mus musculus
ccctgagttcttaatgggctctgga

SEQ ID NO: 348157 - DNA, 25 bp, Mus musculus
ccctgagttctttatgggctctgga

SEQ ID NO: 348158 - DNA, 25 bp, Mus musculus
ccctgagtttagagcccctgggaat

SEQ ID NO: 348159 - DNA, 25 bp, Mus musculus
ccctgagtttagtgcccctgggaat

SEQ ID NO: 348160 - DNA, 25 bp, Mus musculus
ccctgagtttgaatgttagtatcca

SEQ ID NO: 348161 - DNA, 25 bp, Mus musculus
ccctgagtttgattgttagtatcca

SEQ ID NO: 348162 - DNA, 25 bp, Mus musculus
ccctgagttttgctccagttgggct

SEQ ID NO: 348163 - DNA, 25 bp, Mus musculus
ccctgagttttggtccagttgggct

SEQ ID NO: 348164 - DNA, 25 bp, Mus musculus
ccctgatcagttaccttgattattg

SEQ ID NO: 348165 - DNA, 25 bp, Mus musculus
ccctgatcagtttccttgattattg

SEQ ID NO: 348166 - DNA, 25 bp, Mus musculus
ccctgatccaacctcaaaacatatg

SEQ ID NO: 348167 - DNA, 25 bp, Mus musculus
ccctgatccaacgtcaaaacatatg

SEQ ID NO: 348168 - DNA, 25 bp, Mus musculus
ccctgatccacaaaaccaataaaat

SEQ ID NO: 348169 - DNA, 25 bp, Mus musculus
ccctgatccacataaccaataaaat

SEQ ID NO: 348170 - DNA, 25 bp, Mus musculus
ccctgatccgcacgtcagatgacaa

SEQ ID NO: 348171 - DNA, 25 bp, Mus musculus
ccctgatccgcaggtcagatgacaa

SEQ ID NO: 348172 - DNA, 25 bp, Mus musculus
ccctgatcgattattattggtccac

SEQ ID NO: 348173 - DNA, 25 bp, Mus musculus
ccctgatcgatttttattggtccac

SEQ ID NO: 348174 - DNA, 25 bp, Mus musculus
ccctgatctatcagtcttgcggata

SEQ ID NO: 348175 - DNA, 25 bp, Mus musculus
ccctgatctatctgtcttgcggata

SEQ ID NO: 348176 - DNA, 25 bp, Mus musculus
ccctgatgcctgcaactcggaagag

SEQ ID NO: 348177 - DNA, 25 bp, Mus musculus
ccctgatgcctggaactcggaagag

SEQ ID NO: 348178 - DNA, 25 bp, Mus musculus
ccctgatgccttctgactgaaacaa

SEQ ID NO: 348179 - DNA, 25 bp, Mus musculus
ccctgatgccttgtgactgaaacaa

SEQ ID NO: 348180 - DNA, 25 bp, Mus musculus
ccctgatgctggcaatctgaagaga

SEQ ID NO: 348181 - DNA, 25 bp, Mus musculus
ccctgatgctgggaatctgaagaga

SEQ ID NO: 348182 - DNA, 25 bp, Mus musculus
ccctgatggaacaactgtacatttg

SEQ ID NO: 348183 - DNA, 25 bp, Mus musculus
ccctgatggaactactgtacatttg

SEQ ID NO: 348184 - DNA, 25 bp, Mus musculus
ccctgatggaggaggtgctcctgct

SEQ ID NO: 348185 - DNA, 25 bp, Mus musculus
ccctgatggaggtggtgctcctgct

SEQ ID NO: 348186 - DNA, 25 bp, Mus musculus
ccctgatggccaaatccctagaata

SEQ ID NO: 348187 - DNA, 25 bp, Mus musculus
ccctgatggccatatccctagaata

SEQ ID NO: 348188 - DNA, 25 bp, Mus musculus
ccctgatgggaaattatttctgaac

SEQ ID NO: 348189 - DNA, 25 bp, Mus musculus
ccctgatgggaatttatttctgaac

SEQ ID NO: 348190 - DNA, 25 bp, Mus musculus
ccctgatggttcagactgcacttca

SEQ ID NO: 348191 - DNA, 25 bp, Mus musculus
ccctgatggttctgactgcacttca

SEQ ID NO: 348192 - DNA, 25 bp, Mus musculus
ccctgattagcaattctttccccat

SEQ ID NO: 348193 - DNA, 25 bp, Mus musculus
ccctgattagcatttctttccccat

SEQ ID NO: 348194 - DNA, 25 bp, Mus musculus
ccctgattatttatcctcgtcttaa

SEQ ID NO: 348195 - DNA, 25 bp, Mus musculus
ccctgattatttttcctcgtcttaa

SEQ ID NO: 348196 - DNA, 25 bp, Mus musculus
ccctgattcggaatagttttgtact

SEQ ID NO: 348197 - DNA, 25 bp, Mus musculus
ccctgattcggattagttttgtact

SEQ ID NO: 348198 - DNA, 25 bp, Mus musculus
ccctgattctggattctgctaaaac

SEQ ID NO: 348199 - DNA, 25 bp, Mus musculus
ccctgattctggtttctgctaaaac

SEQ ID NO: 348200 - DNA, 25 bp, Mus musculus
ccctgattttctaggtgtaggcaaa

SEQ ID NO: 348201 - DNA, 25 bp, Mus musculus
ccctgattttcttggtgtaggcaaa

SEQ ID NO: 348202 - DNA, 25 bp, Mus musculus
ccctgcaaacagaccctttgtggga

SEQ ID NO: 348203 - DNA, 25 bp, Mus musculus
ccctgcaaacagtccctttgtggga

SEQ ID NO: 348204 - DNA, 25 bp, Mus musculus
ccctgcaaatcactgttgactgtag

SEQ ID NO: 348205 - DNA, 25 bp, Mus musculus
ccctgcaaatcagtgttgactgtag

SEQ ID NO: 348206 - DNA, 25 bp, Mus musculus
ccctgcaacacgaccatcggaaaaa

SEQ ID NO: 348207 - DNA, 25 bp, Mus musculus
ccctgcaacacgtccatcggaaaaa

SEQ ID NO: 348208 - DNA, 25 bp, Mus musculus
ccctgcaatgccaggtgcttatctg

SEQ ID NO: 348209 - DNA, 25 bp, Mus musculus
ccctgcaatgcctggtgcttatctg

SEQ ID NO: 348210 - DNA, 25 bp, Mus musculus
ccctgcaatgtgctggatagctctc

SEQ ID NO: 348211 - DNA, 25 bp, Mus musculus
ccctgcaatgtggtggatagctctc

SEQ ID NO: 348212 - DNA, 25 bp, Mus musculus
ccctgcacaaacagatctatgtcct

SEQ ID NO: 348213 - DNA, 25 bp, Mus musculus
ccctgcacaaactgatctatgtcct

SEQ ID NO: 348214 - DNA, 25 bp, Mus musculus
ccctgcacagagagtataatgctac

SEQ ID NO: 348215 - DNA, 25 bp, Mus musculus
ccctgcacagagtgtataatgctac

SEQ ID NO: 348216 - DNA, 25 bp, Mus musculus
ccctgcacagccatacaaagttgtt

SEQ ID NO: 348217 - DNA, 25 bp, Mus musculus
ccctgcacagccttacaaagttgtt

SEQ ID NO: 348218 - DNA, 25 bp, Mus musculus
ccctgcacatacactaaggccttaa

SEQ ID NO: 348219 - DNA, 25 bp, Mus musculus
ccctgcacatactctaaggccttaa

SEQ ID NO: 348220 - DNA, 25 bp, Mus musculus
ccctgcacatagacagagcactcag

SEQ ID NO: 348221 - DNA, 25 bp, Mus musculus
ccctgcacatagtcagagcactcag

SEQ ID NO: 348222 - DNA, 25 bp, Mus musculus
ccctgcataagactacgcagttatg

SEQ ID NO: 348223 - DNA, 25 bp, Mus musculus
ccctgcataagagtacgcagttatg

SEQ ID NO: 348224 - DNA, 25 bp, Mus musculus
ccctgcatcttgcactctaatggac

SEQ ID NO: 348225 - DNA, 25 bp, Mus musculus
ccctgcatcttggactctaatggac

SEQ ID NO: 348226 - DNA, 25 bp, Mus musculus
ccctgcatgcttcttctctaaatta

SEQ ID NO: 348227 - DNA, 25 bp, Mus musculus
ccctgcatgcttgttctctaaatta

SEQ ID NO: 348228 - DNA, 25 bp, Mus musculus
ccctgcatgggccagctgatgacct

SEQ ID NO: 348229 - DNA, 25 bp, Mus musculus
ccctgcatgggcgagctgatgacct

SEQ ID NO: 348230 - DNA, 25 bp, Mus musculus
ccctgcatgtgactgctagttttgg

SEQ ID NO: 348231 - DNA, 25 bp, Mus musculus
ccctgcatgtgagtgctagttttgg

SEQ ID NO: 348232 - DNA, 25 bp, Mus musculus
ccctgcattctacaaggatcactgt

SEQ ID NO: 348233 - DNA, 25 bp, Mus musculus
ccctgcattctagaaggatcactgt

SEQ ID NO: 348234 - DNA, 25 bp, Mus musculus
ccctgcatttaaaggactggacttt

SEQ ID NO: 348235 - DNA, 25 bp, Mus musculus
ccctgcatttaatggactggacttt

SEQ ID NO: 348236 - DNA, 25 bp, Mus musculus
ccctgcatttacagccaagcctgaa

SEQ ID NO: 348237 - DNA, 25 bp, Mus musculus
ccctgcatttactgccaagcctgaa

SEQ ID NO: 348238 - DNA, 25 bp, Mus musculus
ccctgccaactgaaggtccttagca

SEQ ID NO: 348239 - DNA, 25 bp, Mus musculus
ccctgccaactgtaggtccttagca

SEQ ID NO: 348240 - DNA, 25 bp, Mus musculus
ccctgccacatgaagccattgtttt

SEQ ID NO: 348241 - DNA, 25 bp, Mus musculus
ccctgccacatgtagccattgtttt

SEQ ID NO: 348242 - DNA, 25 bp, Mus musculus
ccctgccacgaactgtttactgaaa

SEQ ID NO: 348243 - DNA, 25 bp, Mus musculus
ccctgccacgaagtgtttactgaaa

SEQ ID NO: 348244 - DNA, 25 bp, Mus musculus
ccctgccagcagctggcctgttgaa

SEQ ID NO: 348245 - DNA, 25 bp, Mus musculus
ccctgccagcaggtggcctgttgaa

SEQ ID NO: 348246 - DNA, 25 bp, Mus musculus
ccctgccaggacagacccatgtaaa

SEQ ID NO: 348247 - DNA, 25 bp, Mus musculus
ccctgccaggactgacccatgtaaa

SEQ ID NO: 348248 - DNA, 25 bp, Mus musculus
ccctgccaggccaagatcttacaca

SEQ ID NO: 348249 - DNA, 25 bp, Mus musculus
ccctgccaggcctagatcttacaca

SEQ ID NO: 348250 - DNA, 25 bp, Mus musculus
ccctgcccatttcatgtcctttcac

SEQ ID NO: 348251 - DNA, 25 bp, Mus musculus
ccctgcccatttgatgtcctttcac

SEQ ID NO: 348252 - DNA, 25 bp, Mus musculus
ccctgccccataacatgtatgaatg

SEQ ID NO: 348253 - DNA, 25 bp, Mus musculus
ccctgccccatatcatgtatgaatg

SEQ ID NO: 348254 - DNA, 25 bp, Mus musculus
ccctgcccggaaatctgatcaagaa

SEQ ID NO: 348255 - DNA, 25 bp, Mus musculus
ccctgcccggaattctgatcaagaa

SEQ ID NO: 348256 - DNA, 25 bp, Mus musculus
ccctgccctggaacatagttgagtc

SEQ ID NO: 348257 - DNA, 25 bp, Mus musculus
ccctgccctggatcatagttgagtc

SEQ ID NO: 348258 - DNA, 25 bp, Mus musculus
ccctgccgtcttagatgtatcttaa

SEQ ID NO: 348259 - DNA, 25 bp, Mus musculus
ccctgccgtctttgatgtatcttaa

SEQ ID NO: 348260 - DNA, 25 bp, Mus musculus
ccctgcctacttaggtggatttcaa

SEQ ID NO: 348261 - DNA, 25 bp, Mus musculus
ccctgcctactttggtggatttcaa

SEQ ID NO: 348262 - DNA, 25 bp, Mus musculus
ccctgcctagccatgggtatggtga

SEQ ID NO: 348263 - DNA, 25 bp, Mus musculus
ccctgcctagccttgggtatggtga

SEQ ID NO: 348264 - DNA, 25 bp, Mus musculus
ccctgcctattacccagtgaagtag

SEQ ID NO: 348265 - DNA, 25 bp, Mus musculus
ccctgcctattagccagtgaagtag

SEQ ID NO: 348266 - DNA, 25 bp, Mus musculus
ccctgcctgtatatcaaccaagtta

SEQ ID NO: 348267 - DNA, 25 bp, Mus musculus
ccctgcctgtatttcaaccaagtta

SEQ ID NO: 348268 - DNA, 25 bp, Mus musculus
ccctgcctttccagctttaagtaag

SEQ ID NO: 348269 - DNA, 25 bp, Mus musculus
ccctgcctttcctgctttaagtaag

SEQ ID NO: 348270 - DNA, 25 bp, Mus musculus
ccctgccttttaaactagagagata

SEQ ID NO: 348271 - DNA, 25 bp, Mus musculus
ccctgccttttatactagagagata

SEQ ID NO: 348272 - DNA, 25 bp, Mus musculus
ccctgcctttttctcttataagcat

SEQ ID NO: 348273 - DNA, 25 bp, Mus musculus
ccctgcctttttgtcttataagcat

SEQ ID NO: 348274 - DNA, 25 bp, Mus musculus
ccctgcgacaatcgaatatcttttt

SEQ ID NO: 348275 - DNA, 25 bp, Mus musculus
ccctgcgacaatggaatatcttttt

SEQ ID NO: 348276 - DNA, 25 bp, Mus musculus
ccctgcgaccctagcaacccctgct

SEQ ID NO: 348277 - DNA, 25 bp, Mus musculus
ccctgcgacccttgcaacccctgct

SEQ ID NO: 348278 - DNA, 25 bp, Mus musculus
ccctgcgagcgtaggatggtctgca

SEQ ID NO: 348279 - DNA, 25 bp, Mus musculus
ccctgcgagcgttggatggtctgca

SEQ ID NO: 348280 - DNA, 25 bp, Mus musculus
ccctgcgaggcacatccacaggaag

SEQ ID NO: 348281 - DNA, 25 bp, Mus musculus
ccctgcgaggcagatccacaggaag

SEQ ID NO: 348282 - DNA, 25 bp, Mus musculus
ccctgcgccaggaggatctgtttgg

SEQ ID NO: 348283 - DNA, 25 bp, Mus musculus
ccctgcgccaggtggatctgtttgg

SEQ ID NO: 348284 - DNA, 25 bp, Mus musculus
ccctgcgcctgtatagaagtctgta

SEQ ID NO: 348285 - DNA, 25 bp, Mus musculus
ccctgcgcctgtttagaagtctgta

SEQ ID NO: 348286 - DNA, 25 bp, Mus musculus
ccctgcgcgaggacagcacgcgtga

SEQ ID NO: 348287 - DNA, 25 bp, Mus musculus
ccctgcgcgaggtcagcacgcgtga

SEQ ID NO: 348288 - DNA, 25 bp, Mus musculus
ccctgcggaggcatcctggagtagc

SEQ ID NO: 348289 - DNA, 25 bp, Mus musculus
ccctgcggaggcttcctggagtagc

SEQ ID NO: 348290 - DNA, 25 bp, Mus musculus
ccctgcggagtcagttgcaagacgt

SEQ ID NO: 348291 - DNA, 25 bp, Mus musculus
ccctgcggagtctgttgcaagacgt

SEQ ID NO: 348292 - DNA, 25 bp, Mus musculus
ccctgcgtgtccagaagacccttct

SEQ ID NO: 348293 - DNA, 25 bp, Mus musculus
ccctgcgtgtcctgaagacccttct

SEQ ID NO: 348294 - DNA, 25 bp, Mus musculus
ccctgctagagaagtctgctggaga

SEQ ID NO: 348295 - DNA, 25 bp, Mus musculus
ccctgctagagatgtctgctggaga

SEQ ID NO: 348296 - DNA, 25 bp, Mus musculus
ccctgctagcatagggctgcaaagt

SEQ ID NO: 348297 - DNA, 25 bp, Mus musculus
ccctgctagcattgggctgcaaagt

SEQ ID NO: 348298 - DNA, 25 bp, Mus musculus
ccctgctagggtacccctgtaagca

SEQ ID NO: 348299 - DNA, 25 bp, Mus musculus
ccctgctagggttcccctgtaagca

SEQ ID NO: 348300 - DNA, 25 bp, Mus musculus
ccctgctaggtcatgcacgaagaag

SEQ ID NO: 348301 - DNA, 25 bp, Mus musculus
ccctgctaggtcttgcacgaagaag

SEQ ID NO: 348302 - DNA, 25 bp, Mus musculus
ccctgctataaaacctgctcaatca

SEQ ID NO: 348303 - DNA, 25 bp, Mus musculus
ccctgctataaatcctgctcaatca

SEQ ID NO: 348304 - DNA, 25 bp, Mus musculus
ccctgctattgtcgagattgtgttt

SEQ ID NO: 348305 - DNA, 25 bp, Mus musculus
ccctgctattgtggagattgtgttt

SEQ ID NO: 348306 - DNA, 25 bp, Mus musculus
ccctgctcacacaccagaattaaat

SEQ ID NO: 348307 - DNA, 25 bp, Mus musculus
ccctgctcacactccagaattaaat

SEQ ID NO: 348308 - DNA, 25 bp, Mus musculus
ccctgctccatcagcttgaatgtga

SEQ ID NO: 348309 - DNA, 25 bp, Mus musculus
ccctgctccatcattgaggatgtgt

SEQ ID NO: 348310 - DNA, 25 bp, Mus musculus
ccctgctccatctgcttgaatgtga

SEQ ID NO: 348311 - DNA, 25 bp, Mus musculus
ccctgctccatctttgaggatgtgt

SEQ ID NO: 348312 - DNA, 25 bp, Mus musculus
ccctgctcctctctgaatgacaagt

SEQ ID NO: 348313 - DNA, 25 bp, Mus musculus
ccctgctcctctgtgaatgacaagt

SEQ ID NO: 348314 - DNA, 25 bp, Mus musculus
ccctgctctggtacttcaagcattt

SEQ ID NO: 348315 - DNA, 25 bp, Mus musculus
ccctgctctggttcttcaagcattt

SEQ ID NO: 348316 - DNA, 25 bp, Mus musculus
ccctgctctgtcattgtcattagtt

SEQ ID NO: 348317 - DNA, 25 bp, Mus musculus
ccctgctctgtctttgtcattagtt

SEQ ID NO: 348318 - DNA, 25 bp, Mus musculus
ccctgctgaagtccgacaggtgctg

SEQ ID NO: 348319 - DNA, 25 bp, Mus musculus
ccctgctgaagtgcgacaggtgctg

SEQ ID NO: 348320 - DNA, 25 bp, Mus musculus
ccctgctgacagacactaactttgt

SEQ ID NO: 348321 - DNA, 25 bp, Mus musculus
ccctgctgacagtcactaactttgt

SEQ ID NO: 348322 - DNA, 25 bp, Mus musculus
ccctgctgacttcagcctaggctga

SEQ ID NO: 348323 - DNA, 25 bp, Mus musculus
ccctgctgacttgagcctaggctga

SEQ ID NO: 348324 - DNA, 25 bp, Mus musculus
ccctgctgagccaatggaccaataa

SEQ ID NO: 348325 - DNA, 25 bp, Mus musculus
ccctgctgagcctatggaccaataa

SEQ ID NO: 348326 - DNA, 25 bp, Mus musculus
ccctgctgaggacttgccaccccag

SEQ ID NO: 348327 - DNA, 25 bp, Mus musculus
ccctgctgaggagttgccaccccag

SEQ ID NO: 348328 - DNA, 25 bp, Mus musculus
ccctgctgcagtctcttgggtctca

SEQ ID NO: 348329 - DNA, 25 bp, Mus musculus
ccctgctgcagtgtcttgggtctca

SEQ ID NO: 348330 - DNA, 25 bp, Mus musculus
ccctgctgctcaactgtggatgtta

SEQ ID NO: 348331 - DNA, 25 bp, Mus musculus
ccctgctgctcatctgtggatgtta

SEQ ID NO: 348332 - DNA, 25 bp, Mus musculus
ccctgctggcagcaggcaaggcaca

SEQ ID NO: 348333 - DNA, 25 bp, Mus musculus
ccctgctggcaggaggcaaggcaca

SEQ ID NO: 348334 - DNA, 25 bp, Mus musculus
ccctgctggtccatgggcttcagga

SEQ ID NO: 348335 - DNA, 25 bp, Mus musculus
ccctgctggtccttgggcttcagga

SEQ ID NO: 348336 - DNA, 25 bp, Mus musculus
ccctgctgtacaatccgaagttggt

SEQ ID NO: 348337 - DNA, 25 bp, Mus musculus
ccctgctgtacattccgaagttggt

SEQ ID NO: 348338 - DNA, 25 bp, Mus musculus
ccctgctgtagacgtggctgtaaaa

SEQ ID NO: 348339 - DNA, 25 bp, Mus musculus
ccctgctgtagaggtggctgtaaaa

SEQ ID NO: 348340 - DNA, 25 bp, Mus musculus
ccctgctgtctgagtgttggaggta

SEQ ID NO: 348341 - DNA, 25 bp, Mus musculus
ccctgctgtctgtgtgttggaggta

SEQ ID NO: 348342 - DNA, 25 bp, Mus musculus
ccctgctgtggaattattcctttgt

SEQ ID NO: 348343 - DNA, 25 bp, Mus musculus
ccctgctgtggatttattcctttgt

SEQ ID NO: 348344 - DNA, 25 bp, Mus musculus
ccctgctgtgtaaagatggaagata

SEQ ID NO: 348345 - DNA, 25 bp, Mus musculus
ccctgctgtgtatagatggaagata

SEQ ID NO: 348346 - DNA, 25 bp, Mus musculus
ccctgctgttccagattatctatta

SEQ ID NO: 348347 - DNA, 25 bp, Mus musculus
ccctgctgttcctgattatctatta

SEQ ID NO: 348348 - DNA, 25 bp, Mus musculus
ccctgcttcatgctatggattttca

SEQ ID NO: 348349 - DNA, 25 bp, Mus musculus
ccctgcttcatggtatggattttca

SEQ ID NO: 348350 - DNA, 25 bp, Mus musculus
ccctgcttcccaaggtgtgggtaag

SEQ ID NO: 348351 - DNA, 25 bp, Mus musculus
ccctgcttcccatggtgtgggtaag

SEQ ID NO: 348352 - DNA, 25 bp, Mus musculus
ccctgcttgatgctgtgcatttagg

SEQ ID NO: 348353 - DNA, 25 bp, Mus musculus
ccctgcttgatggtgtgcatttagg

SEQ ID NO: 348354 - DNA, 25 bp, Mus musculus
ccctgctttctgcatgggttgatga

SEQ ID NO: 348355 - DNA, 25 bp, Mus musculus
ccctgctttctggatgggttgatga

SEQ ID NO: 348356 - DNA, 25 bp, Mus musculus
ccctgctttgtgagttaggcgtgct

SEQ ID NO: 348357 - DNA, 25 bp, Mus musculus
ccctgctttgtgtgttaggcgtgct

SEQ ID NO: 348358 - DNA, 25 bp, Mus musculus
ccctgcttttcaaaaggtgctgaag

SEQ ID NO: 348359 - DNA, 25 bp, Mus musculus
ccctgcttttcataaggtgctgaag

SEQ ID NO: 348360 - DNA, 25 bp, Mus musculus
ccctgcttttccatgttagctattt

SEQ ID NO: 348361 - DNA, 25 bp, Mus musculus
ccctgcttttccttgttagctattt

SEQ ID NO: 348362 - DNA, 25 bp, Mus musculus
ccctggaaatggaattatggctggt

SEQ ID NO: 348363 - DNA, 25 bp, Mus musculus
ccctggaaatggtattatggctggt

SEQ ID NO: 348364 - DNA, 25 bp, Mus musculus
ccctggaactagagtgactgttatg

SEQ ID NO: 348365 - DNA, 25 bp, Mus musculus
ccctggaactagtgtgactgttatg

SEQ ID NO: 348366 - DNA, 25 bp, Mus musculus
ccctggaagagccattacatcgttg

SEQ ID NO: 348367 - DNA, 25 bp, Mus musculus
ccctggaagagcgattacatcgttg

SEQ ID NO: 348368 - DNA, 25 bp, Mus musculus
ccctggaagggcatgtttaacgaca

SEQ ID NO: 348369 - DNA, 25 bp, Mus musculus
ccctggaagggcttgtttaacgaca

SEQ ID NO: 348370 - DNA, 25 bp, Mus musculus
ccctggaattcgaaccacccatttg

SEQ ID NO: 348371 - DNA, 25 bp, Mus musculus
ccctggaattcgtaccacccatttg

SEQ ID NO: 348372 - DNA, 25 bp, Mus musculus
ccctggacagacattttaaccctct

SEQ ID NO: 348373 - DNA, 25 bp, Mus musculus
ccctggacagactttttaaccctct

SEQ ID NO: 348374 - DNA, 25 bp, Mus musculus
ccctggacagctcatatttgcacat

SEQ ID NO: 348375 - DNA, 25 bp, Mus musculus
ccctggacagctgatatttgcacat

SEQ ID NO: 348376 - DNA, 25 bp, Mus musculus
ccctggacagggatctctattaatg

SEQ ID NO: 348377 - DNA, 25 bp, Mus musculus
ccctggacagggttctctattaatg

SEQ ID NO: 348378 - DNA, 25 bp, Mus musculus
ccctggacatccagagtgacttgta

SEQ ID NO: 348379 - DNA, 25 bp, Mus musculus
ccctggacatcctgagtgacttgta

SEQ ID NO: 348380 - DNA, 25 bp, Mus musculus
ccctggacggtgagctgagatcttt

SEQ ID NO: 348381 - DNA, 25 bp, Mus musculus
ccctggacggtgtgctgagatcttt

SEQ ID NO: 348382 - DNA, 25 bp, Mus musculus
ccctggactcttaattcatagttat

SEQ ID NO: 348383 - DNA, 25 bp, Mus musculus
ccctggactctttattcatagttat

SEQ ID NO: 348384 - DNA, 25 bp, Mus musculus
ccctggactgagatcctatgttaac

SEQ ID NO: 348385 - DNA, 25 bp, Mus musculus
ccctggactgagttcctatgttaac

SEQ ID NO: 348386 - DNA, 25 bp, Mus musculus
ccctggacttttaaaggactgatga

SEQ ID NO: 348387 - DNA, 25 bp, Mus musculus
ccctggactttttaaggactgatga

SEQ ID NO: 348388 - DNA, 25 bp, Mus musculus
ccctggagagtcataagccttgtct

SEQ ID NO: 348389 - DNA, 25 bp, Mus musculus
ccctggagagtcttaagccttgtct

SEQ ID NO: 348390 - DNA, 25 bp, Mus musculus
ccctggagcagcacgtgtgtatggc

SEQ ID NO: 348391 - DNA, 25 bp, Mus musculus
ccctggagcagctcgtgtgtatggc

SEQ ID NO: 348392 - DNA, 25 bp, Mus musculus
ccctggagcgccacaaggtgttgga

SEQ ID NO: 348393 - DNA, 25 bp, Mus musculus
ccctggagcgcctcaaggtgttgga

SEQ ID NO: 348394 - DNA, 25 bp, Mus musculus
ccctggagcgtaacgatttctcaat

SEQ ID NO: 348395 - DNA, 25 bp, Mus musculus
ccctggagcgtatcgatttctcaat

SEQ ID NO: 348396 - DNA, 25 bp, Mus musculus
ccctggagctgaactgttccctgag

SEQ ID NO: 348397 - DNA, 25 bp, Mus musculus
ccctggagctgatctgttccctgag

SEQ ID NO: 348398 - DNA, 25 bp, Mus musculus
ccctggaggactcgatgtgcacaga

SEQ ID NO: 348399 - DNA, 25 bp, Mus musculus
ccctggaggactggatgtgcacaga

SEQ ID NO: 348400 - DNA, 25 bp, Mus musculus
ccctggaggattagagcttgagctg

SEQ ID NO: 348401 - DNA, 25 bp, Mus musculus
ccctggaggattcgcctgagcagca

SEQ ID NO: 348402 - DNA, 25 bp, Mus musculus
ccctggaggattggcctgagcagca

SEQ ID NO: 348403 - DNA, 25 bp, Mus musculus
ccctggaggatttgagcttgagctg

SEQ ID NO: 348404 - DNA, 25 bp, Mus musculus
ccctggagggaacatcgtgcgaaca

SEQ ID NO: 348405 - DNA, 25 bp, Mus musculus
ccctggagggaagatcgtgcgaaca

SEQ ID NO: 348406 - DNA, 25 bp, Mus musculus
ccctggagtactaggatctttttgg

SEQ ID NO: 348407 - DNA, 25 bp, Mus musculus
ccctggagtacttggatctttttgg

SEQ ID NO: 348408 - DNA, 25 bp, Mus musculus
ccctggagtcgacgcacctgagagt

SEQ ID NO: 348409 - DNA, 25 bp, Mus musculus
ccctggagtcgaggcacctgagagt

SEQ ID NO: 348410 - DNA, 25 bp, Mus musculus
ccctggagtctgaagcaagtttatt

SEQ ID NO: 348411 - DNA, 25 bp, Mus musculus
ccctggagtctgtagcaagtttatt

SEQ ID NO: 348412 - DNA, 25 bp, Mus musculus
ccctggagtgctagctttactgaaa

SEQ ID NO: 348413 - DNA, 25 bp, Mus musculus
ccctggagtgctcgagagaacttag

SEQ ID NO: 348414 - DNA, 25 bp, Mus musculus
ccctggagtgctggagagaacttag

SEQ ID NO: 348415 - DNA, 25 bp, Mus musculus
ccctggagtgcttgctttactgaaa

SEQ ID NO: 348416 - DNA, 25 bp, Mus musculus
ccctggagtggaatcttgcttgtta

SEQ ID NO: 348417 - DNA, 25 bp, Mus musculus
ccctggagtggattcttgcttgtta

SEQ ID NO: 348418 - DNA, 25 bp, Mus musculus
ccctggagtttgagattgtgtacct

SEQ ID NO: 348419 - DNA, 25 bp, Mus musculus
ccctggagtttgtgattgtgtacct

SEQ ID NO: 348420 - DNA, 25 bp, Mus musculus
ccctggatcccaatactaatcatgt

SEQ ID NO: 348421 - DNA, 25 bp, Mus musculus
ccctggatcccattactaatcatgt

SEQ ID NO: 348422 - DNA, 25 bp, Mus musculus
ccctggatctgccaagcgtttgaaa

SEQ ID NO: 348423 - DNA, 25 bp, Mus musculus
ccctggatctgcgaagcgtttgaaa

SEQ ID NO: 348424 - DNA, 25 bp, Mus musculus
ccctggatctggcaccggctcagtg

SEQ ID NO: 348425 - DNA, 25 bp, Mus musculus
ccctggatctgggaccggctcagtg

SEQ ID NO: 348426 - DNA, 25 bp, Mus musculus
ccctggatggctcccattgggaaag

SEQ ID NO: 348427 - DNA, 25 bp, Mus musculus
ccctggatggctgccattgggaaag

SEQ ID NO: 348428 - DNA, 25 bp, Mus musculus
ccctggatgtagaactaaactctgt

SEQ ID NO: 348429 - DNA, 25 bp, Mus musculus
ccctggatgtagtactaaactctgt

SEQ ID NO: 348430 - DNA, 25 bp, Mus musculus
ccctggatgtcccagtagctggaga

SEQ ID NO: 348431 - DNA, 25 bp, Mus musculus
ccctggatgtccgagtagctggaga

SEQ ID NO: 348432 - DNA, 25 bp, Mus musculus
ccctggattaaaacagtcataaatg

SEQ ID NO: 348433 - DNA, 25 bp, Mus musculus
ccctggattaaatcagtcataaatg

SEQ ID NO: 348434 - DNA, 25 bp, Mus musculus
ccctggattctcagactgccgtggc

SEQ ID NO: 348435 - DNA, 25 bp, Mus musculus
ccctggattctctgactgccgtggc

SEQ ID NO: 348436 - DNA, 25 bp, Mus musculus
ccctggattggtcgtctttaattct

SEQ ID NO: 348437 - DNA, 25 bp, Mus musculus
ccctggattggtggtctttaattct

SEQ ID NO: 348438 - DNA, 25 bp, Mus musculus
ccctggattttacaaagtcctgcta

SEQ ID NO: 348439 - DNA, 25 bp, Mus musculus
ccctggattttagaaagtcctgcta

SEQ ID NO: 348440 - DNA, 25 bp, Mus musculus
ccctggattttgactgagtgactgg

SEQ ID NO: 348441 - DNA, 25 bp, Mus musculus
ccctggattttgtctgagtgactgg

SEQ ID NO: 348442 - DNA, 25 bp, Mus musculus
ccctggcaacagcattgtttacctc

SEQ ID NO: 348443 - DNA, 25 bp, Mus musculus
ccctggcaacaggattgtttacctc

SEQ ID NO: 348444 - DNA, 25 bp, Mus musculus
ccctggcaaccactgttatacattt

SEQ ID NO: 348445 - DNA, 25 bp, Mus musculus
ccctggcaaccagtgttatacattt

SEQ ID NO: 348446 - DNA, 25 bp, Mus musculus
ccctggcaaggaagcatagcagaca

SEQ ID NO: 348447 - DNA, 25 bp, Mus musculus
ccctggcaaggatgcatagcagaca

SEQ ID NO: 348448 - DNA, 25 bp, Mus musculus
ccctggcacccacatgttgaaaaat

SEQ ID NO: 348449 - DNA, 25 bp, Mus musculus
ccctggcacccagatgttgaaaaat

SEQ ID NO: 348450 - DNA, 25 bp, Mus musculus
ccctggcaccttatgtgtttacatt

SEQ ID NO: 348451 - DNA, 25 bp, Mus musculus
ccctggcaccttttgtgtttacatt

SEQ ID NO: 348452 - DNA, 25 bp, Mus musculus
ccctggcagaagctcaatttcatga

SEQ ID NO: 348453 - DNA, 25 bp, Mus musculus
ccctggcagaaggtcaatttcatga

SEQ ID NO: 348454 - DNA, 25 bp, Mus musculus
ccctggcataaactgtactggagtc

SEQ ID NO: 348455 - DNA, 25 bp, Mus musculus
ccctggcataaagtgtactggagtc

SEQ ID NO: 348456 - DNA, 25 bp, Mus musculus
ccctggcatctcatagtttgtactt

SEQ ID NO: 348457 - DNA, 25 bp, Mus musculus
ccctggcatctcttagtttgtactt

SEQ ID NO: 348458 - DNA, 25 bp, Mus musculus
ccctggccacttaggtacttggttg

SEQ ID NO: 348459 - DNA, 25 bp, Mus musculus
ccctggccactttggtacttggttg

SEQ ID NO: 348460 - DNA, 25 bp, Mus musculus
ccctggccagcaaggaacttgttag

SEQ ID NO: 348461 - DNA, 25 bp, Mus musculus
ccctggccagcatggaacttgttag

SEQ ID NO: 348462 - DNA, 25 bp, Mus musculus
ccctggccagggatcttgggaagca

SEQ ID NO: 348463 - DNA, 25 bp, Mus musculus
ccctggccagggttcttgggaagca

SEQ ID NO: 348464 - DNA, 25 bp, Mus musculus
ccctggccattaccagaacctgcaa

SEQ ID NO: 348465 - DNA, 25 bp, Mus musculus
ccctggccattagcagaacctgcaa

SEQ ID NO: 348466 - DNA, 25 bp, Mus musculus
ccctggccatttcctaatgcaaagg

SEQ ID NO: 348467 - DNA, 25 bp, Mus musculus
ccctggccatttgctaatgcaaagg

SEQ ID NO: 348468 - DNA, 25 bp, Mus musculus
ccctggcccatcatagtttgtactt

SEQ ID NO: 348469 - DNA, 25 bp, Mus musculus
ccctggcccatcttagtttgtactt

SEQ ID NO: 348470 - DNA, 25 bp, Mus musculus
ccctggccctggatggtgaatgtga

SEQ ID NO: 348471 - DNA, 25 bp, Mus musculus
ccctggccctggttggtgaatgtga

SEQ ID NO: 348472 - DNA, 25 bp, Mus musculus
ccctggctacaacgtgcattttaac

SEQ ID NO: 348473 - DNA, 25 bp, Mus musculus
ccctggctacaaggtgcattttaac

SEQ ID NO: 348474 - DNA, 25 bp, Mus musculus
ccctggctagcgcactagaagaaca

SEQ ID NO: 348475 - DNA, 25 bp, Mus musculus
ccctggctagcggactagaagaaca

SEQ ID NO: 348476 - DNA, 25 bp, Mus musculus
ccctggctcacaatgtttttcagta

SEQ ID NO: 348477 - DNA, 25 bp, Mus musculus
ccctggctcacattgtttttcagta

SEQ ID NO: 348478 - DNA, 25 bp, Mus musculus
ccctggctgactccctgttggagag

SEQ ID NO: 348479 - DNA, 25 bp, Mus musculus
ccctggctgactgcctgttggagag

SEQ ID NO: 348480 - DNA, 25 bp, Mus musculus
ccctggctgagacgcaaaggaaact

SEQ ID NO: 348481 - DNA, 25 bp, Mus musculus
ccctggctgagaggcaaaggaaact

SEQ ID NO: 348482 - DNA, 25 bp, Mus musculus
ccctggctgggtccagatcaagtgt

SEQ ID NO: 348483 - DNA, 25 bp, Mus musculus
ccctggctgggtgcagatcaagtgt

SEQ ID NO: 348484 - DNA, 25 bp, Mus musculus
ccctggctggtccacaatgatggca

SEQ ID NO: 348485 - DNA, 25 bp, Mus musculus
ccctggctggtcgacaatgatggca

SEQ ID NO: 348486 - DNA, 25 bp, Mus musculus
ccctggctgtatcactctggataag

SEQ ID NO: 348487 - DNA, 25 bp, Mus musculus
ccctggctgtatgactctggataag

SEQ ID NO: 348488 - DNA, 25 bp, Mus musculus
ccctggctgtcaaatgtcatgcatg

SEQ ID NO: 348489 - DNA, 25 bp, Mus musculus
ccctggctgtcatatgtcatgcatg

SEQ ID NO: 348490 - DNA, 25 bp, Mus musculus
ccctggcttattatgtggctttgaa

SEQ ID NO: 348491 - DNA, 25 bp, Mus musculus
ccctggcttattttgtggctttgaa

SEQ ID NO: 348492 - DNA, 25 bp, Mus musculus
ccctggcttcctctggttagaacca

SEQ ID NO: 348493 - DNA, 25 bp, Mus musculus
ccctggcttcctgtggttagaacca

SEQ ID NO: 348494 - DNA, 25 bp, Mus musculus
ccctggctttagcttctatatgatc

SEQ ID NO: 348495 - DNA, 25 bp, Mus musculus
ccctggctttaggttctatatgatc

SEQ ID NO: 348496 - DNA, 25 bp, Mus musculus
ccctggctttgcatgaatttataac

SEQ ID NO: 348497 - DNA, 25 bp, Mus musculus
ccctggctttgcttgaatttataac

SEQ ID NO: 348498 - DNA, 25 bp, Mus musculus
ccctgggaaaccactaaagatgcaa

SEQ ID NO: 348499 - DNA, 25 bp, Mus musculus
ccctgggaaacctctaaagatgcaa

SEQ ID NO: 348500 - DNA, 25 bp, Mus musculus
ccctgggaaatgagccctccaaggc

SEQ ID NO: 348501 - DNA, 25 bp, Mus musculus
ccctgggaaatgtgccctccaaggc

SEQ ID NO: 348502 - DNA, 25 bp, Mus musculus
ccctgggaaggaaatttagcaacat

SEQ ID NO: 348503 - DNA, 25 bp, Mus musculus
ccctgggaaggatatttagcaacat

SEQ ID NO: 348504 - DNA, 25 bp, Mus musculus
ccctgggaaggtctatggattctat

SEQ ID NO: 348505 - DNA, 25 bp, Mus musculus
ccctgggaaggtgtatggattctat

SEQ ID NO: 348506 - DNA, 25 bp, Mus musculus
ccctgggagaccagtacatagtgta

SEQ ID NO: 348507 - DNA, 25 bp, Mus musculus
ccctgggagacctgtacatagtgta

SEQ ID NO: 348508 - DNA, 25 bp, Mus musculus
ccctgggagctgctatttttccaaa

SEQ ID NO: 348509 - DNA, 25 bp, Mus musculus
ccctgggagctggtatttttccaaa

SEQ ID NO: 348510 - DNA, 25 bp, Mus musculus
ccctgggatggtcgtgctagattct

SEQ ID NO: 348511 - DNA, 25 bp, Mus musculus
ccctgggatggtggtgctagattct

SEQ ID NO: 348512 - DNA, 25 bp, Mus musculus
ccctgggcaaggagagccttcgaga

SEQ ID NO: 348513 - DNA, 25 bp, Mus musculus
ccctgggcaaggatgttatatttga

SEQ ID NO: 348514 - DNA, 25 bp, Mus musculus
ccctgggcaaggtgagccttcgaga

SEQ ID NO: 348515 - DNA, 25 bp, Mus musculus
ccctgggcaaggttgttatatttga

SEQ ID NO: 348516 - DNA, 25 bp, Mus musculus
ccctgggcacacattttcaatggtt

SEQ ID NO: 348517 - DNA, 25 bp, Mus musculus
ccctgggcacactttttcaatggtt

SEQ ID NO: 348518 - DNA, 25 bp, Mus musculus
ccctgggcacttactagatgagaac

SEQ ID NO: 348519 - DNA, 25 bp, Mus musculus
ccctgggcactttctagatgagaac

SEQ ID NO: 348520 - DNA, 25 bp, Mus musculus
ccctgggcagcgctgaagaatggca

SEQ ID NO: 348521 - DNA, 25 bp, Mus musculus
ccctgggcagcggtgaagaatggca

SEQ ID NO: 348522 - DNA, 25 bp, Mus musculus
ccctgggcaggcattttagaaattg

SEQ ID NO: 348523 - DNA, 25 bp, Mus musculus
ccctgggcaggctttttagaaattg

SEQ ID NO: 348524 - DNA, 25 bp, Mus musculus
ccctgggccctgcattactgtggtg

SEQ ID NO: 348525 - DNA, 25 bp, Mus musculus
ccctgggccctggattactgtggtg

SEQ ID NO: 348526 - DNA, 25 bp, Mus musculus
ccctgggctaagaagtcacctttga

SEQ ID NO: 348527 - DNA, 25 bp, Mus musculus
ccctgggctaagtagtcacctttga

SEQ ID NO: 348528 - DNA, 25 bp, Mus musculus
ccctgggctgggacttggatagaat

SEQ ID NO: 348529 - DNA, 25 bp, Mus musculus
ccctgggctgggtcttggatagaat

SEQ ID NO: 348530 - DNA, 25 bp, Mus musculus
ccctgggtatctacggtacagttga

SEQ ID NO: 348531 - DNA, 25 bp, Mus musculus
ccctgggtatcttcggtacagttga

SEQ ID NO: 348532 - DNA, 25 bp, Mus musculus
ccctgggtgacccgcatgtcatgag

SEQ ID NO: 348533 - DNA, 25 bp, Mus musculus
ccctgggtgaccggcatgtcatgag

SEQ ID NO: 348534 - DNA, 25 bp, Mus musculus
ccctgggtggtcattgcagaggcaa

SEQ ID NO: 348535 - DNA, 25 bp, Mus musculus
ccctgggtggtctttgcagaggcaa

SEQ ID NO: 348536 - DNA, 25 bp, Mus musculus
ccctgggttcatcctagtgtcccaa

SEQ ID NO: 348537 - DNA, 25 bp, Mus musculus
ccctgggttcatgctagtgtcccaa

SEQ ID NO: 348538 - DNA, 25 bp, Mus musculus
ccctgggtttcacagtaactcctgc

SEQ ID NO: 348539 - DNA, 25 bp, Mus musculus
ccctgggtttcagagtaactcctgc

SEQ ID NO: 348540 - DNA, 25 bp, Mus musculus
ccctggtagcagacagaaaaggtat

SEQ ID NO: 348541 - DNA, 25 bp, Mus musculus
ccctggtagcagtcagaaaaggtat

SEQ ID NO: 348542 - DNA, 25 bp, Mus musculus
ccctggtatcctatgaccactgaaa

SEQ ID NO: 348543 - DNA, 25 bp, Mus musculus
ccctggtatcctttgaccactgaaa

SEQ ID NO: 348544 - DNA, 25 bp, Mus musculus
ccctggtcaggtcgtgtgcattaca

SEQ ID NO: 348545 - DNA, 25 bp, Mus musculus
ccctggtcaggtggtgtgcattaca

SEQ ID NO: 348546 - DNA, 25 bp, Mus musculus
ccctggtcccacatctagagatata

SEQ ID NO: 348547 - DNA, 25 bp, Mus musculus
ccctggtcccacttctagagatata

SEQ ID NO: 348548 - DNA, 25 bp, Mus musculus
ccctggtctggacatggacacattt

SEQ ID NO: 348549 - DNA, 25 bp, Mus musculus
ccctggtctggagatggacacattt

SEQ ID NO: 348550 - DNA, 25 bp, Mus musculus
ccctggtctggcatctatagataca

SEQ ID NO: 348551 - DNA, 25 bp, Mus musculus
ccctggtctggcttctatagataca

SEQ ID NO: 348552 - DNA, 25 bp, Mus musculus
ccctggtcttctaggtgcacatgaa

SEQ ID NO: 348553 - DNA, 25 bp, Mus musculus
ccctggtcttcttggtgcacatgaa

SEQ ID NO: 348554 - DNA, 25 bp, Mus musculus
ccctggtggattcctcttgaagtac

SEQ ID NO: 348555 - DNA, 25 bp, Mus musculus
ccctggtggattgctcttgaagtac

SEQ ID NO: 348556 - DNA, 25 bp, Mus musculus
ccctggtgtccgagagggttgatat

SEQ ID NO: 348557 - DNA, 25 bp, Mus musculus
ccctggtgtccgtgagggttgatat

SEQ ID NO: 348558 - DNA, 25 bp, Mus musculus
ccctggtgtcttagtttccacagta

SEQ ID NO: 348559 - DNA, 25 bp, Mus musculus
ccctggtgtctttgtttccacagta

SEQ ID NO: 348560 - DNA, 25 bp, Mus musculus
ccctggtgttgtcgcaagctgctgc

SEQ ID NO: 348561 - DNA, 25 bp, Mus musculus
ccctggtgttgtggcaagctgctgc

SEQ ID NO: 348562 - DNA, 25 bp, Mus musculus
ccctggttaaccatgtagaaatgct

SEQ ID NO: 348563 - DNA, 25 bp, Mus musculus
ccctggttaaccttgtagaaatgct

SEQ ID NO: 348564 - DNA, 25 bp, Mus musculus
ccctggttacacacatgttggacac

SEQ ID NO: 348565 - DNA, 25 bp, Mus musculus
ccctggttacactcatgttggacac

SEQ ID NO: 348566 - DNA, 25 bp, Mus musculus
ccctggttagttaattttgcatgga

SEQ ID NO: 348567 - DNA, 25 bp, Mus musculus
ccctggttagtttattttgcatgga

SEQ ID NO: 348568 - DNA, 25 bp, Mus musculus
ccctggttcaagctttttatcactg

SEQ ID NO: 348569 - DNA, 25 bp, Mus musculus
ccctggttcaaggtttttatcactg

SEQ ID NO: 348570 - DNA, 25 bp, Mus musculus
ccctggttgcggagacagctatggt

SEQ ID NO: 348571 - DNA, 25 bp, Mus musculus
ccctggttgcggtgacagctatggt

SEQ ID NO: 348572 - DNA, 25 bp, Mus musculus
ccctggttggcacagcggtacaaca

SEQ ID NO: 348573 - DNA, 25 bp, Mus musculus
ccctggttggcagagcggtacaaca

SEQ ID NO: 348574 - DNA, 25 bp, Mus musculus
ccctggttgtttctagagtgctaca

SEQ ID NO: 348575 - DNA, 25 bp, Mus musculus
ccctggttgtttgtagagtgctaca

SEQ ID NO: 348576 - DNA, 25 bp, Mus musculus
ccctggtttactcactacccaagag

SEQ ID NO: 348577 - DNA, 25 bp, Mus musculus
ccctggtttactgactacccaagag

SEQ ID NO: 348578 - DNA, 25 bp, Mus musculus
ccctggttttacacagtcctgagaa

SEQ ID NO: 348579 - DNA, 25 bp, Mus musculus
ccctggttttactcagtcctgagaa

SEQ ID NO: 348580 - DNA, 25 bp, Mus musculus
ccctggttttctaagctgggaactg

SEQ ID NO: 348581 - DNA, 25 bp, Mus musculus
ccctggttttcttagctgggaactg

SEQ ID NO: 348582 - DNA, 25 bp, Mus musculus
ccctggttttgacccaacagtatca

SEQ ID NO: 348583 - DNA, 25 bp, Mus musculus
ccctggttttgagccaacagtatca

SEQ ID NO: 348584 - DNA, 25 bp, Mus musculus
ccctggtttttaaaactatggtgcg

SEQ ID NO: 348585 - DNA, 25 bp, Mus musculus
ccctggtttttataactatggtgcg

SEQ ID NO: 348586 - DNA, 25 bp, Mus musculus
ccctgtaaccagagactgctcaact

SEQ ID NO: 348587 - DNA, 25 bp, Mus musculus
ccctgtaaccagtgactgctcaact

SEQ ID NO: 348588 - DNA, 25 bp, Mus musculus
ccctgtaagccgcactaagacttcg

SEQ ID NO: 348589 - DNA, 25 bp, Mus musculus
ccctgtaagccggactaagacttcg

SEQ ID NO: 348590 - DNA, 25 bp, Mus musculus
ccctgtaaggctctccgaacgttgt

SEQ ID NO: 348591 - DNA, 25 bp, Mus musculus
ccctgtaaggctgtccgaacgttgt

SEQ ID NO: 348592 - DNA, 25 bp, Mus musculus
ccctgtaatcctagtgtttgagaga

SEQ ID NO: 348593 - DNA, 25 bp, Mus musculus
ccctgtaatccttgtgtttgagaga

SEQ ID NO: 348594 - DNA, 25 bp, Mus musculus
ccctgtacatcaacaaactgattta

SEQ ID NO: 348595 - DNA, 25 bp, Mus musculus
ccctgtacatcatcaaactgattta

SEQ ID NO: 348596 - DNA, 25 bp, Mus musculus
ccctgtaccactcaactcattttgt

SEQ ID NO: 348597 - DNA, 25 bp, Mus musculus
ccctgtaccactgaactcattttgt

SEQ ID NO: 348598 - DNA, 25 bp, Mus musculus
ccctgtaccctactgccagggattg

SEQ ID NO: 348599 - DNA, 25 bp, Mus musculus
ccctgtaccctagtgccagggattg

SEQ ID NO: 348600 - DNA, 25 bp, Mus musculus
ccctgtactaacatctagctggatt

SEQ ID NO: 348601 - DNA, 25 bp, Mus musculus
ccctgtactaacttctagctggatt

SEQ ID NO: 348602 - DNA, 25 bp, Mus musculus
ccctgtactgacatctctataaaaa

SEQ ID NO: 348603 - DNA, 25 bp, Mus musculus
ccctgtactgacttctctataaaaa

SEQ ID NO: 348604 - DNA, 25 bp, Mus musculus
ccctgtacttaacaggtggtggcag

SEQ ID NO: 348605 - DNA, 25 bp, Mus musculus
ccctgtacttaagaggtggtggcag

SEQ ID NO: 348606 - DNA, 25 bp, Mus musculus
ccctgtagctccagaacaacgtagt

SEQ ID NO: 348607 - DNA, 25 bp, Mus musculus
ccctgtagctcctgaacaacgtagt

SEQ ID NO: 348608 - DNA, 25 bp, Mus musculus
ccctgtaggtctccattctcataaa

SEQ ID NO: 348609 - DNA, 25 bp, Mus musculus
ccctgtaggtctgcattctcataaa

SEQ ID NO: 348610 - DNA, 25 bp, Mus musculus
ccctgtatccagaactaaagcacct

SEQ ID NO: 348611 - DNA, 25 bp, Mus musculus
ccctgtatccagtactaaagcacct

SEQ ID NO: 348612 - DNA, 25 bp, Mus musculus
ccctgtatccctcgctttggagtta

SEQ ID NO: 348613 - DNA, 25 bp, Mus musculus
ccctgtatccctggctttggagtta

SEQ ID NO: 348614 - DNA, 25 bp, Mus musculus
ccctgtatcgtgaaccttttgtgac

SEQ ID NO: 348615 - DNA, 25 bp, Mus musculus
ccctgtatcgtgtaccttttgtgac

SEQ ID NO: 348616 - DNA, 25 bp, Mus musculus
ccctgtatgctcctgcaaattacca

SEQ ID NO: 348617 - DNA, 25 bp, Mus musculus
ccctgtatgctcgtgcaaattacca

SEQ ID NO: 348618 - DNA, 25 bp, Mus musculus
ccctgtattagtcgctttgggaatt

SEQ ID NO: 348619 - DNA, 25 bp, Mus musculus
ccctgtattagtggctttgggaatt

SEQ ID NO: 348620 - DNA, 25 bp, Mus musculus
ccctgtattctcctgttagcacagg

SEQ ID NO: 348621 - DNA, 25 bp, Mus musculus
ccctgtattctcgtgttagcacagg

SEQ ID NO: 348622 - DNA, 25 bp, Mus musculus
ccctgtcacccaaatgatattttac

SEQ ID NO: 348623 - DNA, 25 bp, Mus musculus
ccctgtcacccatatgatattttac

SEQ ID NO: 348624 - DNA, 25 bp, Mus musculus
ccctgtcactggacacacttagaga

SEQ ID NO: 348625 - DNA, 25 bp, Mus musculus
ccctgtcactggtcacacttagaga

SEQ ID NO: 348626 - DNA, 25 bp, Mus musculus
ccctgtcatctcagcctactagaaa

SEQ ID NO: 348627 - DNA, 25 bp, Mus musculus
ccctgtcatctctgcctactagaaa

SEQ ID NO: 348628 - DNA, 25 bp, Mus musculus
ccctgtcatgtcctgacttttaaaa

SEQ ID NO: 348629 - DNA, 25 bp, Mus musculus
ccctgtcatgtcgtgacttttaaaa

SEQ ID NO: 348630 - DNA, 25 bp, Mus musculus
ccctgtccactgagtggtgtgatca

SEQ ID NO: 348631 - DNA, 25 bp, Mus musculus
ccctgtccactgtgtggtgtgatca

SEQ ID NO: 348632 - DNA, 25 bp, Mus musculus
ccctgtccaggacctatgggaagtt

SEQ ID NO: 348633 - DNA, 25 bp, Mus musculus
ccctgtccaggagctatgggaagtt

SEQ ID NO: 348634 - DNA, 25 bp, Mus musculus
ccctgtccagtaagggctgcaatac

SEQ ID NO: 348635 - DNA, 25 bp, Mus musculus
ccctgtccagtatgggctgcaatac

SEQ ID NO: 348636 - DNA, 25 bp, Mus musculus
ccctgtccagtcagtaactttcaac

SEQ ID NO: 348637 - DNA, 25 bp, Mus musculus
ccctgtccagtctgtaactttcaac

SEQ ID NO: 348638 - DNA, 25 bp, Mus musculus
ccctgtccctccattaatggagaat

SEQ ID NO: 348639 - DNA, 25 bp, Mus musculus
ccctgtccctcctttaatggagaat

SEQ ID NO: 348640 - DNA, 25 bp, Mus musculus
ccctgtccgtttcattgcaagctaa

SEQ ID NO: 348641 - DNA, 25 bp, Mus musculus
ccctgtccgtttgattgcaagctaa

SEQ ID NO: 348642 - DNA, 25 bp, Mus musculus
ccctgtcctcctacattgtgaagaa

SEQ ID NO: 348643 - DNA, 25 bp, Mus musculus
ccctgtcctccttcattgtgaagaa

SEQ ID NO: 348644 - DNA, 25 bp, Mus musculus
ccctgtccttggacttagtatttga

SEQ ID NO: 348645 - DNA, 25 bp, Mus musculus
ccctgtccttggtcttagtatttga

SEQ ID NO: 348646 - DNA, 25 bp, Mus musculus
ccctgtcgtgcactggctggtgaaa

SEQ ID NO: 348647 - DNA, 25 bp, Mus musculus
ccctgtcgtgcagtggctggtgaaa

SEQ ID NO: 348648 - DNA, 25 bp, Mus musculus
ccctgtcgtggtcagacacgttaca

SEQ ID NO: 348649 - DNA, 25 bp, Mus musculus
ccctgtcgtggtgagacacgttaca

SEQ ID NO: 348650 - DNA, 25 bp, Mus musculus
ccctgtctccagatcagtagagcga

SEQ ID NO: 348651 - DNA, 25 bp, Mus musculus
ccctgtctccagttcagtagagcga

SEQ ID NO: 348652 - DNA, 25 bp, Mus musculus
ccctgtctcgatactaatgcattgt

SEQ ID NO: 348653 - DNA, 25 bp, Mus musculus
ccctgtctcgattctaatgcattgt

SEQ ID NO: 348654 - DNA, 25 bp, Mus musculus
ccctgtctctgaagacaggtcagca

SEQ ID NO: 348655 - DNA, 25 bp, Mus musculus
ccctgtctctgatgacaggtcagca

SEQ ID NO: 348656 - DNA, 25 bp, Mus musculus
ccctgtctctgcactgtgtacaata

SEQ ID NO: 348657 - DNA, 25 bp, Mus musculus
ccctgtctctgctctgtgtacaata

SEQ ID NO: 348658 - DNA, 25 bp, Mus musculus
ccctgtctgtttcgtaatagtaact

SEQ ID NO: 348659 - DNA, 25 bp, Mus musculus
ccctgtctgtttggtaatagtaact

SEQ ID NO: 348660 - DNA, 25 bp, Mus musculus
ccctgtcttattactcaaggacttg

SEQ ID NO: 348661 - DNA, 25 bp, Mus musculus
ccctgtcttatttctcaaggacttg

SEQ ID NO: 348662 - DNA, 25 bp, Mus musculus
ccctgtgaagagatcctggtgaaac

SEQ ID NO: 348663 - DNA, 25 bp, Mus musculus
ccctgtgaagagttcctggtgaaac

SEQ ID NO: 348664 - DNA, 25 bp, Mus musculus
ccctgtgaagataggccagctggtg

SEQ ID NO: 348665 - DNA, 25 bp, Mus musculus
ccctgtgaagattggccagctggtg

SEQ ID NO: 348666 - DNA, 25 bp, Mus musculus
ccctgtgaatctcacatggttcatg

SEQ ID NO: 348667 - DNA, 25 bp, Mus musculus
ccctgtgaatctgacatggttcatg

SEQ ID NO: 348668 - DNA, 25 bp, Mus musculus
ccctgtgacgctacaaccattgcca

SEQ ID NO: 348669 - DNA, 25 bp, Mus musculus
ccctgtgacgcttcaaccattgcca

SEQ ID NO: 348670 - DNA, 25 bp, Mus musculus
ccctgtgactctatgaagtaccgtt

SEQ ID NO: 348671 - DNA, 25 bp, Mus musculus
ccctgtgactctttgaagtaccgtt

SEQ ID NO: 348672 - DNA, 25 bp, Mus musculus
ccctgtgagcttcggttcagtgtga

SEQ ID NO: 348673 - DNA, 25 bp, Mus musculus
ccctgtgagcttgggttcagtgtga

SEQ ID NO: 348674 - DNA, 25 bp, Mus musculus
ccctgtgagtctccgggctcaaagt

SEQ ID NO: 348675 - DNA, 25 bp, Mus musculus
ccctgtgagtctgcgggctcaaagt

SEQ ID NO: 348676 - DNA, 25 bp, Mus musculus
ccctgtgcaactacaacgtcattga

SEQ ID NO: 348677 - DNA, 25 bp, Mus musculus
ccctgtgcaacttcaacgtcattga

SEQ ID NO: 348678 - DNA, 25 bp, Mus musculus
ccctgtgcagtgctctgattcttga

SEQ ID NO: 348679 - DNA, 25 bp, Mus musculus
ccctgtgcagtggtctgattcttga

SEQ ID NO: 348680 - DNA, 25 bp, Mus musculus
ccctgtgcatctacagacctataga

SEQ ID NO: 348681 - DNA, 25 bp, Mus musculus
ccctgtgcatcttcagacctataga

SEQ ID NO: 348682 - DNA, 25 bp, Mus musculus
ccctgtgcatgacctctttgtggtt

SEQ ID NO: 348683 - DNA, 25 bp, Mus musculus
ccctgtgcatgagctctttgtggtt

SEQ ID NO: 348684 - DNA, 25 bp, Mus musculus
ccctgtgcatgcagggagaaggcaa

SEQ ID NO: 348685 - DNA, 25 bp, Mus musculus
ccctgtgcatgcatctgtgttaata

SEQ ID NO: 348686 - DNA, 25 bp, Mus musculus
ccctgtgcatgctgggagaaggcaa

SEQ ID NO: 348687 - DNA, 25 bp, Mus musculus
ccctgtgcatgcttctgtgttaata

SEQ ID NO: 348688 - DNA, 25 bp, Mus musculus
ccctgtgccggccacaaggaagaca

SEQ ID NO: 348689 - DNA, 25 bp, Mus musculus
ccctgtgccggcgacaaggaagaca

SEQ ID NO: 348690 - DNA, 25 bp, Mus musculus
ccctgtgcctttacaaagccaacaa

SEQ ID NO: 348691 - DNA, 25 bp, Mus musculus
ccctgtgccttttcaaagccaacaa

SEQ ID NO: 348692 - DNA, 25 bp, Mus musculus
ccctgtgctcagctgaagactggct

SEQ ID NO: 348693 - DNA, 25 bp, Mus musculus
ccctgtgctcaggtgaagactggct

SEQ ID NO: 348694 - DNA, 25 bp, Mus musculus
ccctgtggaaggagcacgtgttcac

SEQ ID NO: 348695 - DNA, 25 bp, Mus musculus
ccctgtggaaggtgcacgtgttcac

SEQ ID NO: 348696 - DNA, 25 bp, Mus musculus
ccctgtggaatcaggccaggcctgg

SEQ ID NO: 348697 - DNA, 25 bp, Mus musculus
ccctgtggaatctggccaggcctgg

SEQ ID NO: 348698 - DNA, 25 bp, Mus musculus
ccctgtggaccacgaagcgaattcc

SEQ ID NO: 348699 - DNA, 25 bp, Mus musculus
ccctgtggaccaggaagcgaattcc

SEQ ID NO: 348700 - DNA, 25 bp, Mus musculus
ccctgtggagcccaagaactcagag

SEQ ID NO: 348701 - DNA, 25 bp, Mus musculus
ccctgtggagccgaagaactcagag

SEQ ID NO: 348702 - DNA, 25 bp, Mus musculus
ccctgtggctaacaaggctgcacct

SEQ ID NO: 348703 - DNA, 25 bp, Mus musculus
ccctgtggctaagaaggctgcacct

SEQ ID NO: 348704 - DNA, 25 bp, Mus musculus
ccctgtggtagtccagattcaacac

SEQ ID NO: 348705 - DNA, 25 bp, Mus musculus
ccctgtggtagtgcagattcaacac

SEQ ID NO: 348706 - DNA, 25 bp, Mus musculus
ccctgtggtcaacagctaaaggatt

SEQ ID NO: 348707 - DNA, 25 bp, Mus musculus
ccctgtggtcaagagctaaaggatt

SEQ ID NO: 348708 - DNA, 25 bp, Mus musculus
ccctgtggtgagccgcccaaagtct

SEQ ID NO: 348709 - DNA, 25 bp, Mus musculus
ccctgtggtgaggcgcccaaagtct

SEQ ID NO: 348710 - DNA, 25 bp, Mus musculus
ccctgtggttttacagaagtcggtg

SEQ ID NO: 348711 - DNA, 25 bp, Mus musculus
ccctgtggtttttcagaagtcggtg

SEQ ID NO: 348712 - DNA, 25 bp, Mus musculus
ccctgtgtacctctaatgccattag

SEQ ID NO: 348713 - DNA, 25 bp, Mus musculus
ccctgtgtacctgtaatgccattag

SEQ ID NO: 348714 - DNA, 25 bp, Mus musculus
ccctgtgtatgcacttctctgaaga

SEQ ID NO: 348715 - DNA, 25 bp, Mus musculus
ccctgtgtatgctcttctctgaaga

SEQ ID NO: 348716 - DNA, 25 bp, Mus musculus
ccctgtgtatgtcttgcttgcatga

SEQ ID NO: 348717 - DNA, 25 bp, Mus musculus
ccctgtgtatgtgttgcttgcatga

SEQ ID NO: 348718 - DNA, 25 bp, Mus musculus
ccctgtgtcagtctgtatgtcccag

SEQ ID NO: 348719 - DNA, 25 bp, Mus musculus
ccctgtgtcagtgtgtatgtcccag

SEQ ID NO: 348720 - DNA, 25 bp, Mus musculus
ccctgtgtcctaactaagaacctgt

SEQ ID NO: 348721 - DNA, 25 bp, Mus musculus
ccctgtgtcctatctaagaacctgt

SEQ ID NO: 348722 - DNA, 25 bp, Mus musculus
ccctgtgtctttcccatttggagta

SEQ ID NO: 348723 - DNA, 25 bp, Mus musculus
ccctgtgtctttgccatttggagta

SEQ ID NO: 348724 - DNA, 25 bp, Mus musculus
ccctgtgtgagcaaatctcctatct

SEQ ID NO: 348725 - DNA, 25 bp, Mus musculus
ccctgtgtgagctaatctcctatct

SEQ ID NO: 348726 - DNA, 25 bp, Mus musculus
ccctgtgtggaaccatctctacaga

SEQ ID NO: 348727 - DNA, 25 bp, Mus musculus
ccctgtgtggaagcatctctacaga

SEQ ID NO: 348728 - DNA, 25 bp, Mus musculus
ccctgtgtggatcccagaaggtcct

SEQ ID NO: 348729 - DNA, 25 bp, Mus musculus
ccctgtgtggatgccagaaggtcct

SEQ ID NO: 348730 - DNA, 25 bp, Mus musculus
ccctgtgtggctctatctctatgaa

SEQ ID NO: 348731 - DNA, 25 bp, Mus musculus
ccctgtgtggctgtatctctatgaa

SEQ ID NO: 348732 - DNA, 25 bp, Mus musculus
ccctgtgtgtctctagaagtgtctg

SEQ ID NO: 348733 - DNA, 25 bp, Mus musculus
ccctgtgtgtctgtagaagtgtctg

SEQ ID NO: 348734 - DNA, 25 bp, Mus musculus
ccctgttaaacaagtaagatccttg

SEQ ID NO: 348735 - DNA, 25 bp, Mus musculus
ccctgttaaacatgtaagatccttg

SEQ ID NO: 348736 - DNA, 25 bp, Mus musculus
ccctgttaatcccacttcagagttt

SEQ ID NO: 348737 - DNA, 25 bp, Mus musculus
ccctgttaatccgacttcagagttt

SEQ ID NO: 348738 - DNA, 25 bp, Mus musculus
ccctgttagcataagactttctgtc

SEQ ID NO: 348739 - DNA, 25 bp, Mus musculus
ccctgttagcattagactttctgtc

SEQ ID NO: 348740 - DNA, 25 bp, Mus musculus
ccctgttccagcacagatgatctag

SEQ ID NO: 348741 - DNA, 25 bp, Mus musculus
ccctgttccagctcagatgatctag

SEQ ID NO: 348742 - DNA, 25 bp, Mus musculus
ccctgttccctcaatgttcaaaaat

SEQ ID NO: 348743 - DNA, 25 bp, Mus musculus
ccctgttccctctatgttcaaaaat

SEQ ID NO: 348744 - DNA, 25 bp, Mus musculus
ccctgttcctgtagacgtatagatt

SEQ ID NO: 348745 - DNA, 25 bp, Mus musculus
ccctgttcctgttgacgtatagatt

SEQ ID NO: 348746 - DNA, 25 bp, Mus musculus
ccctgttcggctcatggtggttgaa

SEQ ID NO: 348747 - DNA, 25 bp, Mus musculus
ccctgttcggctgatggtggttgaa

SEQ ID NO: 348748 - DNA, 25 bp, Mus musculus
ccctgttctctgcatttagaagtat

SEQ ID NO: 348749 - DNA, 25 bp, Mus musculus
ccctgttctctggatttagaagtat

SEQ ID NO: 348750 - DNA, 25 bp, Mus musculus
ccctgttctgttaatgcggaaatgg

SEQ ID NO: 348751 - DNA, 25 bp, Mus musculus
ccctgttctgtttatgcggaaatgg

SEQ ID NO: 348752 - DNA, 25 bp, Mus musculus
ccctgttgagcaaaagattgtggtt

SEQ ID NO: 348753 - DNA, 25 bp, Mus musculus
ccctgttgagcataagattgtggtt

SEQ ID NO: 348754 - DNA, 25 bp, Mus musculus
ccctgttgcaagaacatgaaatgat

SEQ ID NO: 348755 - DNA, 25 bp, Mus musculus
ccctgttgcaagtacatgaaatgat

SEQ ID NO: 348756 - DNA, 25 bp, Mus musculus
ccctgttgctccaggtatcaaactg

SEQ ID NO: 348757 - DNA, 25 bp, Mus musculus
ccctgttgctcctggtatcaaactg

SEQ ID NO: 348758 - DNA, 25 bp, Mus musculus
ccctgttggcaacacttggtataaa

SEQ ID NO: 348759 - DNA, 25 bp, Mus musculus
ccctgttggcaagacttggtataaa

SEQ ID NO: 348760 - DNA, 25 bp, Mus musculus
ccctgttggtatcgtcttacttggt

SEQ ID NO: 348761 - DNA, 25 bp, Mus musculus
ccctgttggtatggtcttacttggt

SEQ ID NO: 348762 - DNA, 25 bp, Mus musculus
ccctgttggtcaagttactgaaatt

SEQ ID NO: 348763 - DNA, 25 bp, Mus musculus
ccctgttggtcatgttactgaaatt

SEQ ID NO: 348764 - DNA, 25 bp, Mus musculus
ccctgtttcctacgatccgcatttg

SEQ ID NO: 348765 - DNA, 25 bp, Mus musculus
ccctgtttcctaggatccgcatttg

SEQ ID NO: 348766 - DNA, 25 bp, Mus musculus
ccctgtttcttactgattggagtta

SEQ ID NO: 348767 - DNA, 25 bp, Mus musculus
ccctgtttcttagtgattggagtta

SEQ ID NO: 348768 - DNA, 25 bp, Mus musculus
ccctgtttgaatactctcctttcct

SEQ ID NO: 348769 - DNA, 25 bp, Mus musculus
ccctgtttgaattctctcctttcct

SEQ ID NO: 348770 - DNA, 25 bp, Mus musculus
ccctgtttgaggacattggcttcat

SEQ ID NO: 348771 - DNA, 25 bp, Mus musculus
ccctgtttgaggtcattggcttcat

SEQ ID NO: 348772 - DNA, 25 bp, Mus musculus
ccctgtttgcagctgacattgaaga

SEQ ID NO: 348773 - DNA, 25 bp, Mus musculus
ccctgtttgcaggtgacattgaaga

SEQ ID NO: 348774 - DNA, 25 bp, Mus musculus
ccctgtttgtgcactgagctgagta

SEQ ID NO: 348775 - DNA, 25 bp, Mus musculus
ccctgtttgtgctctgagctgagta

SEQ ID NO: 348776 - DNA, 25 bp, Mus musculus
ccctgttttggcactctcacgagaa

SEQ ID NO: 348777 - DNA, 25 bp, Mus musculus
ccctgttttggctctctcacgagaa

SEQ ID NO: 348778 - DNA, 25 bp, Mus musculus
ccctgtttttgtatctcgtcaagca

SEQ ID NO: 348779 - DNA, 25 bp, Mus musculus
ccctgtttttgtttctcgtcaagca

SEQ ID NO: 348780 - DNA, 25 bp, Mus musculus
cccttaaacacgcgcatacacagaa

SEQ ID NO: 348781 - DNA, 25 bp, Mus musculus
cccttaaacacgggcatacacagaa

SEQ ID NO: 348782 - DNA, 25 bp, Mus musculus
cccttaaagggcataattattgaag

SEQ ID NO: 348783 - DNA, 25 bp, Mus musculus
cccttaaagggcttaattattgaag

SEQ ID NO: 348784 - DNA, 25 bp, Mus musculus
cccttaaatactatattatctctag

SEQ ID NO: 348785 - DNA, 25 bp, Mus musculus
cccttaaatactttattatctctag

SEQ ID NO: 348786 - DNA, 25 bp, Mus musculus
cccttaacaaccacactgtgatggg

SEQ ID NO: 348787 - DNA, 25 bp, Mus musculus
cccttaacaacctcactgtgatggg

SEQ ID NO: 348788 - DNA, 25 bp, Mus musculus
cccttaacttggattactgatgaca

SEQ ID NO: 348789 - DNA, 25 bp, Mus musculus
cccttaacttggtttactgatgaca

SEQ ID NO: 348790 - DNA, 25 bp, Mus musculus
cccttaagacttactcatagcacct

SEQ ID NO: 348791 - DNA, 25 bp, Mus musculus
cccttaagactttctcatagcacct

SEQ ID NO: 348792 - DNA, 25 bp, Mus musculus
cccttaaggcctatatgtgtctctt

SEQ ID NO: 348793 - DNA, 25 bp, Mus musculus
cccttaaggcctttatgtgtctctt

SEQ ID NO: 348794 - DNA, 25 bp, Mus musculus
cccttaatgcccacttaaactcaat

SEQ ID NO: 348795 - DNA, 25 bp, Mus musculus
cccttaatgccctcttaaactcaat

SEQ ID NO: 348796 - DNA, 25 bp, Mus musculus
cccttacagctgacctgaggacaca

SEQ ID NO: 348797 - DNA, 25 bp, Mus musculus
cccttacagctgtcctgaggacaca

SEQ ID NO: 348798 - DNA, 25 bp, Mus musculus
cccttaccaaggatcgaccaatctt

SEQ ID NO: 348799 - DNA, 25 bp, Mus musculus
cccttaccaaggttcgaccaatctt

SEQ ID NO: 348800 - DNA, 25 bp, Mus musculus
cccttaccctcgcagatataattta

SEQ ID NO: 348801 - DNA, 25 bp, Mus musculus
cccttaccctcggagatataattta

SEQ ID NO: 348802 - DNA, 25 bp, Mus musculus
cccttacctaggctgtgcggaagct

SEQ ID NO: 348803 - DNA, 25 bp, Mus musculus
cccttacctagggtgtgcggaagct

SEQ ID NO: 348804 - DNA, 25 bp, Mus musculus
cccttaccttggcatgtacttgaca

SEQ ID NO: 348805 - DNA, 25 bp, Mus musculus
cccttaccttgggatgtacttgaca

SEQ ID NO: 348806 - DNA, 25 bp, Mus musculus
cccttactcttgatgacatttgaga

SEQ ID NO: 348807 - DNA, 25 bp, Mus musculus
cccttactcttgttgacatttgaga

SEQ ID NO: 348808 - DNA, 25 bp, Mus musculus
cccttactgctcactgttggatttt

SEQ ID NO: 348809 - DNA, 25 bp, Mus musculus
cccttactgctctctgttggatttt

SEQ ID NO: 348810 - DNA, 25 bp, Mus musculus
cccttacttcagagtatttgtagtg

SEQ ID NO: 348811 - DNA, 25 bp, Mus musculus
cccttacttcagtgtatttgtagtg

SEQ ID NO: 348812 - DNA, 25 bp, Mus musculus
cccttacttgaacttcatcttcgtt

SEQ ID NO: 348813 - DNA, 25 bp, Mus musculus
cccttacttgaagttcatcttcgtt

SEQ ID NO: 348814 - DNA, 25 bp, Mus musculus
cccttagaccacattgcatgcaggt

SEQ ID NO: 348815 - DNA, 25 bp, Mus musculus
cccttagaccactttgcatgcaggt

SEQ ID NO: 348816 - DNA, 25 bp, Mus musculus
cccttagaggatccctaacctagaa

SEQ ID NO: 348817 - DNA, 25 bp, Mus musculus
cccttagaggatgcctaacctagaa

SEQ ID NO: 348818 - DNA, 25 bp, Mus musculus
cccttagagggcatggtatttagat

SEQ ID NO: 348819 - DNA, 25 bp, Mus musculus
cccttagagggcttggtatttagat

SEQ ID NO: 348820 - DNA, 25 bp, Mus musculus
cccttagatgtccggggctgcacgc

SEQ ID NO: 348821 - DNA, 25 bp, Mus musculus
cccttagatgtcgggggctgcacgc

SEQ ID NO: 348822 - DNA, 25 bp, Mus musculus
cccttagatgtgagaccgccctgct

SEQ ID NO: 348823 - DNA, 25 bp, Mus musculus
cccttagatgtgtgaccgccctgct

SEQ ID NO: 348824 - DNA, 25 bp, Mus musculus
cccttagctgatcggcaggtgtctc

SEQ ID NO: 348825 - DNA, 25 bp, Mus musculus
cccttagctgatgggcaggtgtctc

SEQ ID NO: 348826 - DNA, 25 bp, Mus musculus
cccttaggatgtctggcgagtttgt

SEQ ID NO: 348827 - DNA, 25 bp, Mus musculus
cccttaggatgtgtggcgagtttgt

SEQ ID NO: 348828 - DNA, 25 bp, Mus musculus
cccttagtgttgatatgtccctctt

SEQ ID NO: 348829 - DNA, 25 bp, Mus musculus
cccttagtgttgttatgtccctctt

SEQ ID NO: 348830 - DNA, 25 bp, Mus musculus
cccttatcaccaccgtaccaaaatg

SEQ ID NO: 348831 - DNA, 25 bp, Mus musculus
cccttatcaccagcgtaccaaaatg

SEQ ID NO: 348832 - DNA, 25 bp, Mus musculus
cccttatggagaaaacttcagaata

SEQ ID NO: 348833 - DNA, 25 bp, Mus musculus
cccttatggagataacttcagaata

SEQ ID NO: 348834 - DNA, 25 bp, Mus musculus
cccttatgttggattcagtgttata

SEQ ID NO: 348835 - DNA, 25 bp, Mus musculus
cccttatgttggtttcagtgttata

SEQ ID NO: 348836 - DNA, 25 bp, Mus musculus
cccttatttaagaggaatcagactg

SEQ ID NO: 348837 - DNA, 25 bp, Mus musculus
cccttatttaagtggaatcagactg

SEQ ID NO: 348838 - DNA, 25 bp, Mus musculus
cccttatttgtgacccttcagtgat

SEQ ID NO: 348839 - DNA, 25 bp, Mus musculus
cccttatttgtgtcccttcagtgat

SEQ ID NO: 348840 - DNA, 25 bp, Mus musculus
cccttcaactgaccctatatagact

SEQ ID NO: 348841 - DNA, 25 bp, Mus musculus
cccttcaactgagcctatatagact

SEQ ID NO: 348842 - DNA, 25 bp, Mus musculus
cccttcacccctagagaggccatgg

SEQ ID NO: 348843 - DNA, 25 bp, Mus musculus
cccttcaccccttgagaggccatgg

SEQ ID NO: 348844 - DNA, 25 bp, Mus musculus
cccttcactgaactccacataatgg

SEQ ID NO: 348845 - DNA, 25 bp, Mus musculus
cccttcactgaagtccacataatgg

SEQ ID NO: 348846 - DNA, 25 bp, Mus musculus
cccttcacttagactgggctgataa

SEQ ID NO: 348847 - DNA, 25 bp, Mus musculus
cccttcacttagtctgggctgataa

SEQ ID NO: 348848 - DNA, 25 bp, Mus musculus
cccttcagagttcccttcagtgtaa

SEQ ID NO: 348849 - DNA, 25 bp, Mus musculus
cccttcagagttgccttcagtgtaa

SEQ ID NO: 348850 - DNA, 25 bp, Mus musculus
cccttcagcaaacgaagcactactg

SEQ ID NO: 348851 - DNA, 25 bp, Mus musculus
cccttcagcaaaggaagcactactg

SEQ ID NO: 348852 - DNA, 25 bp, Mus musculus
cccttcagcctacaagtttatgctt

SEQ ID NO: 348853 - DNA, 25 bp, Mus musculus
cccttcagcctagaagtttatgctt

SEQ ID NO: 348854 - DNA, 25 bp, Mus musculus
cccttcaggatgcagcgacacgtag

SEQ ID NO: 348855 - DNA, 25 bp, Mus musculus
cccttcaggatggagcgacacgtag

SEQ ID NO: 348856 - DNA, 25 bp, Mus musculus
cccttcagtcttattggatgtgttt

SEQ ID NO: 348857 - DNA, 25 bp, Mus musculus
cccttcagtctttttggatgtgttt

SEQ ID NO: 348858 - DNA, 25 bp, Mus musculus
cccttcagttatattccggacatct

SEQ ID NO: 348859 - DNA, 25 bp, Mus musculus
cccttcagttattttccggacatct

SEQ ID NO: 348860 - DNA, 25 bp, Mus musculus
cccttcataaggcttagccagctaa

SEQ ID NO: 348861 - DNA, 25 bp, Mus musculus
cccttcataagggttagccagctaa

SEQ ID NO: 348862 - DNA, 25 bp, Mus musculus
cccttcatagcaattttggaatcct

SEQ ID NO: 348863 - DNA, 25 bp, Mus musculus
cccttcatagcatttttggaatcct

SEQ ID NO: 348864 - DNA, 25 bp, Mus musculus
cccttcatatccactattatcaaca

SEQ ID NO: 348865 - DNA, 25 bp, Mus musculus
cccttcatatcctctattatcaaca

SEQ ID NO: 348866 - DNA, 25 bp, Mus musculus
cccttcatcattcgtatgcctactg

SEQ ID NO: 348867 - DNA, 25 bp, Mus musculus
cccttcatcattggtatgcctactg

SEQ ID NO: 348868 - DNA, 25 bp, Mus musculus
cccttcatcctccatgtgcttatga

SEQ ID NO: 348869 - DNA, 25 bp, Mus musculus
cccttcatcctcgatgtgcttatga

SEQ ID NO: 348870 - DNA, 25 bp, Mus musculus
cccttcatcttcattccatttggat

SEQ ID NO: 348871 - DNA, 25 bp, Mus musculus
cccttcatcttctttccatttggat

SEQ ID NO: 348872 - DNA, 25 bp, Mus musculus
cccttcatttttcctccagaggtga

SEQ ID NO: 348873 - DNA, 25 bp, Mus musculus
cccttcatttttgctccagaggtga

SEQ ID NO: 348874 - DNA, 25 bp, Mus musculus
cccttccaattaaccttacattcta

SEQ ID NO: 348875 - DNA, 25 bp, Mus musculus
cccttccaattatccttacattcta

SEQ ID NO: 348876 - DNA, 25 bp, Mus musculus
cccttccacatgatatctttgtagt

SEQ ID NO: 348877 - DNA, 25 bp, Mus musculus
cccttccacatgttatctttgtagt

SEQ ID NO: 348878 - DNA, 25 bp, Mus musculus
cccttccatatcctctttacgaatg

SEQ ID NO: 348879 - DNA, 25 bp, Mus musculus
cccttccatatcgtctttacgaatg

SEQ ID NO: 348880 - DNA, 25 bp, Mus musculus
cccttccatcctatatatacagaca

SEQ ID NO: 348881 - DNA, 25 bp, Mus musculus
cccttccatcctttatatacagaca

SEQ ID NO: 348882 - DNA, 25 bp, Mus musculus
cccttcccagtcaagtacagtggac

SEQ ID NO: 348883 - DNA, 25 bp, Mus musculus
cccttcccagtctagtacagtggac

SEQ ID NO: 348884 - DNA, 25 bp, Mus musculus
cccttcccatggcaagatactacat

SEQ ID NO: 348885 - DNA, 25 bp, Mus musculus
cccttcccatgggaagatactacat

SEQ ID NO: 348886 - DNA, 25 bp, Mus musculus
cccttccctaacatccacatacatg

SEQ ID NO: 348887 - DNA, 25 bp, Mus musculus
cccttccctaacttccacatacatg

SEQ ID NO: 348888 - DNA, 25 bp, Mus musculus
cccttccctagtactgcatgcaaag

SEQ ID NO: 348889 - DNA, 25 bp, Mus musculus
cccttccctagttctgcatgcaaag

SEQ ID NO: 348890 - DNA, 25 bp, Mus musculus
cccttcccttgcagattgtgagatg

SEQ ID NO: 348891 - DNA, 25 bp, Mus musculus
cccttcccttgctgattgtgagatg

SEQ ID NO: 348892 - DNA, 25 bp, Mus musculus
cccttccgagaacggcctgcgagag

SEQ ID NO: 348893 - DNA, 25 bp, Mus musculus
cccttccgagaagggcctgcgagag

SEQ ID NO: 348894 - DNA, 25 bp, Mus musculus
cccttccgtgtgacaggacggatgt

SEQ ID NO: 348895 - DNA, 25 bp, Mus musculus
cccttccgtgtgtcaggacggatgt

SEQ ID NO: 348896 - DNA, 25 bp, Mus musculus
cccttcctggatcggacagtttcaa

SEQ ID NO: 348897 - DNA, 25 bp, Mus musculus
cccttcctggatgggacagtttcaa

SEQ ID NO: 348898 - DNA, 25 bp, Mus musculus
cccttcctggtgaagacgggctacg

SEQ ID NO: 348899 - DNA, 25 bp, Mus musculus
cccttcctggtgtagacgggctacg

SEQ ID NO: 348900 - DNA, 25 bp, Mus musculus
cccttcctgttcagaatcacggaga

SEQ ID NO: 348901 - DNA, 25 bp, Mus musculus
cccttcctgttctgaatcacggaga

SEQ ID NO: 348902 - DNA, 25 bp, Mus musculus
cccttcctttaacggcgagacagtg

SEQ ID NO: 348903 - DNA, 25 bp, Mus musculus
cccttcctttaagggcgagacagtg

SEQ ID NO: 348904 - DNA, 25 bp, Mus musculus
cccttcgcgaagctcattgtggaga

SEQ ID NO: 348905 - DNA, 25 bp, Mus musculus
cccttcgcgaaggtcattgtggaga

SEQ ID NO: 348906 - DNA, 25 bp, Mus musculus
cccttcggagaaagcaggacgcgga

SEQ ID NO: 348907 - DNA, 25 bp, Mus musculus
cccttcggagaatgcaggacgcgga

SEQ ID NO: 348908 - DNA, 25 bp, Mus musculus
cccttcggctgaccagagcaagtaa

SEQ ID NO: 348909 - DNA, 25 bp, Mus musculus
cccttcggctgagcagagcaagtaa

SEQ ID NO: 348910 - DNA, 25 bp, Mus musculus
cccttcggttcaatgagtccttcag

SEQ ID NO: 348911 - DNA, 25 bp, Mus musculus
cccttcggttcattgagtccttcag

SEQ ID NO: 348912 - DNA, 25 bp, Mus musculus
cccttcgtggtaacttcacagatca

SEQ ID NO: 348913 - DNA, 25 bp, Mus musculus
cccttcgtggtatcttcacagatca

SEQ ID NO: 348914 - DNA, 25 bp, Mus musculus
cccttctaaggtcgccattgtgtca

SEQ ID NO: 348915 - DNA, 25 bp, Mus musculus
cccttctaaggtggccattgtgtca

SEQ ID NO: 348916 - DNA, 25 bp, Mus musculus
cccttctaatgtacacaagacaaga

SEQ ID NO: 348917 - DNA, 25 bp, Mus musculus
cccttctaatgttcacaagacaaga

SEQ ID NO: 348918 - DNA, 25 bp, Mus musculus
cccttctagccacgcatagaacgta

SEQ ID NO: 348919 - DNA, 25 bp, Mus musculus
cccttctagccaggcatagaacgta

SEQ ID NO: 348920 - DNA, 25 bp, Mus musculus
cccttctagggaattctattcttgt

SEQ ID NO: 348921 - DNA, 25 bp, Mus musculus
cccttctagggatttctattcttgt

SEQ ID NO: 348922 - DNA, 25 bp, Mus musculus
cccttctatcaacactatgacctag

SEQ ID NO: 348923 - DNA, 25 bp, Mus musculus
cccttctatcaagactatgacctag

SEQ ID NO: 348924 - DNA, 25 bp, Mus musculus
cccttctcaattcaccacatttttt

SEQ ID NO: 348925 - DNA, 25 bp, Mus musculus
cccttctcaattgaccacatttttt

SEQ ID NO: 348926 - DNA, 25 bp, Mus musculus
cccttctccaagaacttattcctat

SEQ ID NO: 348927 - DNA, 25 bp, Mus musculus
cccttctccaagtacttattcctat

SEQ ID NO: 348928 - DNA, 25 bp, Mus musculus
cccttctccaccaagaatttggtca

SEQ ID NO: 348929 - DNA, 25 bp, Mus musculus
cccttctccacctagaatttggtca

SEQ ID NO: 348930 - DNA, 25 bp, Mus musculus
cccttctccctaagtgcaacagaga

SEQ ID NO: 348931 - DNA, 25 bp, Mus musculus
cccttctccctaatgactgatatga

SEQ ID NO: 348932 - DNA, 25 bp, Mus musculus
cccttctccctatgtgcaacagaga

SEQ ID NO: 348933 - DNA, 25 bp, Mus musculus
cccttctccctattgactgatatga

SEQ ID NO: 348934 - DNA, 25 bp, Mus musculus
cccttctccttcagatcaacttatt

SEQ ID NO: 348935 - DNA, 25 bp, Mus musculus
cccttctccttctgatcaacttatt

SEQ ID NO: 348936 - DNA, 25 bp, Mus musculus
cccttctctcgcattaacaaatgca

SEQ ID NO: 348937 - DNA, 25 bp, Mus musculus
cccttctctcgctttaacaaatgca

SEQ ID NO: 348938 - DNA, 25 bp, Mus musculus
cccttctctctccactccaggagac

SEQ ID NO: 348939 - DNA, 25 bp, Mus musculus
cccttctctctcgactccaggagac

SEQ ID NO: 348940 - DNA, 25 bp, Mus musculus
cccttctgacctctaatggcagtag

SEQ ID NO: 348941 - DNA, 25 bp, Mus musculus
cccttctgacctgtaatggcagtag

SEQ ID NO: 348942 - DNA, 25 bp, Mus musculus
cccttctgacttcataccatccttt

SEQ ID NO: 348943 - DNA, 25 bp, Mus musculus
cccttctgacttgataccatccttt

SEQ ID NO: 348944 - DNA, 25 bp, Mus musculus
cccttctgcctgactgattttgact

SEQ ID NO: 348945 - DNA, 25 bp, Mus musculus
cccttctgcctgtctgattttgact

SEQ ID NO: 348946 - DNA, 25 bp, Mus musculus
cccttctgctgtcgtatcatgttat

SEQ ID NO: 348947 - DNA, 25 bp, Mus musculus
cccttctgctgtggtatcatgttat

SEQ ID NO: 348948 - DNA, 25 bp, Mus musculus
cccttctggagaatcgggtactaga

SEQ ID NO: 348949 - DNA, 25 bp, Mus musculus
cccttctggagattcgggtactaga

SEQ ID NO: 348950 - DNA, 25 bp, Mus musculus
cccttctggagcaacctaatgtttc

SEQ ID NO: 348951 - DNA, 25 bp, Mus musculus
cccttctggagcaatgcctggaagg

SEQ ID NO: 348952 - DNA, 25 bp, Mus musculus
cccttctggagctacctaatgtttc

SEQ ID NO: 348953 - DNA, 25 bp, Mus musculus
cccttctggagctatgcctggaagg

SEQ ID NO: 348954 - DNA, 25 bp, Mus musculus
cccttctgggtaagcaaacttctga

SEQ ID NO: 348955 - DNA, 25 bp, Mus musculus
cccttctgggtatgcaaacttctga

SEQ ID NO: 348956 - DNA, 25 bp, Mus musculus
cccttctggtggagtcgttgagtac

SEQ ID NO: 348957 - DNA, 25 bp, Mus musculus
cccttctggtggtgtcgttgagtac

SEQ ID NO: 348958 - DNA, 25 bp, Mus musculus
cccttctgtagcattctgaggctga

SEQ ID NO: 348959 - DNA, 25 bp, Mus musculus
cccttctgtagctttctgaggctga

SEQ ID NO: 348960 - DNA, 25 bp, Mus musculus
cccttctgtgccctttagcaaatgt

SEQ ID NO: 348961 - DNA, 25 bp, Mus musculus
cccttctgtgccgtttagcaaatgt

SEQ ID NO: 348962 - DNA, 25 bp, Mus musculus
cccttctgtggtcattacatcatca

SEQ ID NO: 348963 - DNA, 25 bp, Mus musculus
cccttctgtggtgattacatcatca

SEQ ID NO: 348964 - DNA, 25 bp, Mus musculus
cccttctgtgtgcataccaacgtaa

SEQ ID NO: 348965 - DNA, 25 bp, Mus musculus
cccttctgtgtggataccaacgtaa

SEQ ID NO: 348966 - DNA, 25 bp, Mus musculus
cccttcttaagcaggccatctagaa

SEQ ID NO: 348967 - DNA, 25 bp, Mus musculus
cccttcttaagctggccatctagaa

SEQ ID NO: 348968 - DNA, 25 bp, Mus musculus
cccttcttaccactatgttttggca

SEQ ID NO: 348969 - DNA, 25 bp, Mus musculus
cccttcttaccagtatgttttggca

SEQ ID NO: 348970 - DNA, 25 bp, Mus musculus
cccttcttattcatattaccggctg

SEQ ID NO: 348971 - DNA, 25 bp, Mus musculus
cccttcttattcttattaccggctg

SEQ ID NO: 348972 - DNA, 25 bp, Mus musculus
cccttcttcagcaattacttcttgt

SEQ ID NO: 348973 - DNA, 25 bp, Mus musculus
cccttcttcagctattacttcttgt

SEQ ID NO: 348974 - DNA, 25 bp, Mus musculus
cccttcttctttctaacagatgact

SEQ ID NO: 348975 - DNA, 25 bp, Mus musculus
cccttcttctttgtaacagatgact

SEQ ID NO: 348976 - DNA, 25 bp, Mus musculus
cccttcttgaccctgactagatcag

SEQ ID NO: 348977 - DNA, 25 bp, Mus musculus
cccttcttgaccgtgactagatcag

SEQ ID NO: 348978 - DNA, 25 bp, Mus musculus
cccttcttgggacctagatccatgt

SEQ ID NO: 348979 - DNA, 25 bp, Mus musculus
cccttcttgggagctagatccatgt

SEQ ID NO: 348980 - DNA, 25 bp, Mus musculus
cccttcttgggcctgtttattcaag

SEQ ID NO: 348981 - DNA, 25 bp, Mus musculus
cccttcttgggcgtgtttattcaag

SEQ ID NO: 348982 - DNA, 25 bp, Mus musculus
cccttcttgtagaaagtgctctagt

SEQ ID NO: 348983 - DNA, 25 bp, Mus musculus
cccttcttgtagtaagtgctctagt

SEQ ID NO: 348984 - DNA, 25 bp, Mus musculus
cccttcttgtccagattttgtgtgt

SEQ ID NO: 348985 - DNA, 25 bp, Mus musculus
cccttcttgtcctgattttgtgtgt

SEQ ID NO: 348986 - DNA, 25 bp, Mus musculus
cccttcttgtttctgcttttagaga

SEQ ID NO: 348987 - DNA, 25 bp, Mus musculus
cccttcttgtttgtgcttttagaga

SEQ ID NO: 348988 - DNA, 25 bp, Mus musculus
cccttctttataacgtaactgcctg

SEQ ID NO: 348989 - DNA, 25 bp, Mus musculus
cccttctttatatcgtaactgcctg

SEQ ID NO: 348990 - DNA, 25 bp, Mus musculus
cccttcttttccagctactagtgga

SEQ ID NO: 348991 - DNA, 25 bp, Mus musculus
cccttcttttcctgctactagtgga

SEQ ID NO: 348992 - DNA, 25 bp, Mus musculus
cccttcttttgacactgaagttgta

SEQ ID NO: 348993 - DNA, 25 bp, Mus musculus
cccttcttttgagactgaagttgta

SEQ ID NO: 348994 - DNA, 25 bp, Mus musculus
cccttgaacaatagcagcatctgca

SEQ ID NO: 348995 - DNA, 25 bp, Mus musculus
cccttgaacaattgcagcatctgca

SEQ ID NO: 348996 - DNA, 25 bp, Mus musculus
cccttgaactttctgagccagagca

SEQ ID NO: 348997 - DNA, 25 bp, Mus musculus
cccttgaactttgtgagccagagca

SEQ ID NO: 348998 - DNA, 25 bp, Mus musculus
cccttgaagaggaccatcgcgtgtt

SEQ ID NO: 348999 - DNA, 25 bp, Mus musculus
cccttgaagaggtccatcgcgtgtt

SEQ ID NO: 349000 - DNA, 25 bp, Mus musculus
cccttgaaggctcgtgaagtaattt

SEQ ID NO: 349001 - DNA, 25 bp, Mus musculus
cccttgaaggctggtgaagtaattt

SEQ ID NO: 349002 - DNA, 25 bp, Mus musculus
cccttgaagtctccttctccataat

SEQ ID NO: 349003 - DNA, 25 bp, Mus musculus
cccttgaagtctgcttctccataat

SEQ ID NO: 349004 - DNA, 25 bp, Mus musculus
cccttgaatggacgttttgagcttc

SEQ ID NO: 349005 - DNA, 25 bp, Mus musculus
cccttgaatggaggttttgagcttc

SEQ ID NO: 349006 - DNA, 25 bp, Mus musculus
cccttgacacttatggacagcactc

SEQ ID NO: 349007 - DNA, 25 bp, Mus musculus
cccttgacacttttggacagcactc

SEQ ID NO: 349008 - DNA, 25 bp, Mus musculus
cccttgacttgcagaagaaacgtta

SEQ ID NO: 349009 - DNA, 25 bp, Mus musculus
cccttgacttgctgaagaaacgtta

SEQ ID NO: 349010 - DNA, 25 bp, Mus musculus
cccttgagaggaagttcccagtgtc

SEQ ID NO: 349011 - DNA, 25 bp, Mus musculus
cccttgagaggatgttcccagtgtc

SEQ ID NO: 349012 - DNA, 25 bp, Mus musculus
cccttgatatggcaacttttactat

SEQ ID NO: 349013 - DNA, 25 bp, Mus musculus
cccttgatatgggaacttttactat

SEQ ID NO: 349014 - DNA, 25 bp, Mus musculus
cccttgatgttcaggctgaactcac

SEQ ID NO: 349015 - DNA, 25 bp, Mus musculus
cccttgatgttctggctgaactcac

SEQ ID NO: 349016 - DNA, 25 bp, Mus musculus
cccttgcaagggacacccatgggaa

SEQ ID NO: 349017 - DNA, 25 bp, Mus musculus
cccttgcaagggtcacccatgggaa

SEQ ID NO: 349018 - DNA, 25 bp, Mus musculus
cccttgcaatttagtgaagtttcca

SEQ ID NO: 349019 - DNA, 25 bp, Mus musculus
cccttgcaattttgtgaagtttcca

SEQ ID NO: 349020 - DNA, 25 bp, Mus musculus
cccttgcacattcagatgatggctt

SEQ ID NO: 349021 - DNA, 25 bp, Mus musculus
cccttgcacattgagatgatggctt

SEQ ID NO: 349022 - DNA, 25 bp, Mus musculus
cccttgcactcactacagacttgga

SEQ ID NO: 349023 - DNA, 25 bp, Mus musculus
cccttgcactcagtacagacttgga

SEQ ID NO: 349024 - DNA, 25 bp, Mus musculus
cccttgcagattacctatcctgtac

SEQ ID NO: 349025 - DNA, 25 bp, Mus musculus
cccttgcagatttcctatcctgtac

SEQ ID NO: 349026 - DNA, 25 bp, Mus musculus
cccttgcagggaaccagacacttgg

SEQ ID NO: 349027 - DNA, 25 bp, Mus musculus
cccttgcagggatccagacacttgg

SEQ ID NO: 349028 - DNA, 25 bp, Mus musculus
cccttgcatgcacagtggttgtgta

SEQ ID NO: 349029 - DNA, 25 bp, Mus musculus
cccttgcatgcagagtggttgtgta

SEQ ID NO: 349030 - DNA, 25 bp, Mus musculus
cccttgcattatatctttgtttctt

SEQ ID NO: 349031 - DNA, 25 bp, Mus musculus
cccttgcattatttctttgtttctt

SEQ ID NO: 349032 - DNA, 25 bp, Mus musculus
cccttgccaatgagctgtgacactg

SEQ ID NO: 349033 - DNA, 25 bp, Mus musculus
cccttgccaatgtgctgtgacactg

SEQ ID NO: 349034 - DNA, 25 bp, Mus musculus
cccttgccacaacctgaagtgattc

SEQ ID NO: 349035 - DNA, 25 bp, Mus musculus
cccttgccacaagctgaagtgattc

SEQ ID NO: 349036 - DNA, 25 bp, Mus musculus
cccttgccactcaaacggagcaaag

SEQ ID NO: 349037 - DNA, 25 bp, Mus musculus
cccttgccactctaacggagcaaag

SEQ ID NO: 349038 - DNA, 25 bp, Mus musculus
cccttgcctggtaatgtcatcctct

SEQ ID NO: 349039 - DNA, 25 bp, Mus musculus
cccttgcctggttatgtcatcctct

SEQ ID NO: 349040 - DNA, 25 bp, Mus musculus
cccttgccttgtcaataagcggatc

SEQ ID NO: 349041 - DNA, 25 bp, Mus musculus
cccttgccttgtgaataagcggatc

SEQ ID NO: 349042 - DNA, 25 bp, Mus musculus
cccttgctcatacctggtcagtgtg

SEQ ID NO: 349043 - DNA, 25 bp, Mus musculus
cccttgctcatagctggtcagtgtg

SEQ ID NO: 349044 - DNA, 25 bp, Mus musculus
cccttgctgctgagggctgcctgct

SEQ ID NO: 349045 - DNA, 25 bp, Mus musculus
cccttgctgctgtgggctgcctgct

SEQ ID NO: 349046 - DNA, 25 bp, Mus musculus
cccttgctgtgaagaggaaatccct

SEQ ID NO: 349047 - DNA, 25 bp, Mus musculus
cccttgctgtgatgaggaaatccct

SEQ ID NO: 349048 - DNA, 25 bp, Mus musculus
cccttgcttccccttaaagaatgag

SEQ ID NO: 349049 - DNA, 25 bp, Mus musculus
cccttgcttcccgttaaagaatgag

SEQ ID NO: 349050 - DNA, 25 bp, Mus musculus
cccttgcttttcctgagttcggtat

SEQ ID NO: 349051 - DNA, 25 bp, Mus musculus
cccttgcttttcgtgagttcggtat

SEQ ID NO: 349052 - DNA, 25 bp, Mus musculus
cccttggaactccttcttgtgaaag

SEQ ID NO: 349053 - DNA, 25 bp, Mus musculus
cccttggaactcgttcttgtgaaag

SEQ ID NO: 349054 - DNA, 25 bp, Mus musculus
cccttggacagtatcctggccgtcg

SEQ ID NO: 349055 - DNA, 25 bp, Mus musculus
cccttggacagtttcctggccgtcg

SEQ ID NO: 349056 - DNA, 25 bp, Mus musculus
cccttggacctgacagtcttagagg

SEQ ID NO: 349057 - DNA, 25 bp, Mus musculus
cccttggacctgtcagtcttagagg

SEQ ID NO: 349058 - DNA, 25 bp, Mus musculus
cccttggagctacttggctttggaa

SEQ ID NO: 349059 - DNA, 25 bp, Mus musculus
cccttggagctagttggctttggaa

SEQ ID NO: 349060 - DNA, 25 bp, Mus musculus
cccttggatcaacaatggatgctca

SEQ ID NO: 349061 - DNA, 25 bp, Mus musculus
cccttggatcaagaatggatgctca

SEQ ID NO: 349062 - DNA, 25 bp, Mus musculus
cccttggatgtgctgatcacagtat

SEQ ID NO: 349063 - DNA, 25 bp, Mus musculus
cccttggatgtggtgatcacagtat

SEQ ID NO: 349064 - DNA, 25 bp, Mus musculus
cccttggcagaaccccttagttatg

SEQ ID NO: 349065 - DNA, 25 bp, Mus musculus
cccttggcagaagcccttagttatg

SEQ ID NO: 349066 - DNA, 25 bp, Mus musculus
cccttggcatggaactccctgagca

SEQ ID NO: 349067 - DNA, 25 bp, Mus musculus
cccttggcatggtactccctgagca

SEQ ID NO: 349068 - DNA, 25 bp, Mus musculus
cccttggcctggaaagcttggtggt

SEQ ID NO: 349069 - DNA, 25 bp, Mus musculus
cccttggcctggtaagcttggtggt

SEQ ID NO: 349070 - DNA, 25 bp, Mus musculus
cccttggctgccagaggtctcatgc

SEQ ID NO: 349071 - DNA, 25 bp, Mus musculus
cccttggctgcctgaggtctcatgc

SEQ ID NO: 349072 - DNA, 25 bp, Mus musculus
cccttggctgtgctgatgagttctt

SEQ ID NO: 349073 - DNA, 25 bp, Mus musculus
cccttggctgtggtgatgagttctt

SEQ ID NO: 349074 - DNA, 25 bp, Mus musculus
cccttgggaagcagcggacgcgcct

SEQ ID NO: 349075 - DNA, 25 bp, Mus musculus
cccttgggaagctgcggacgcgcct

SEQ ID NO: 349076 - DNA, 25 bp, Mus musculus
cccttgggcataacttcttattgtg

SEQ ID NO: 349077 - DNA, 25 bp, Mus musculus
cccttgggcatatcttcttattgtg

SEQ ID NO: 349078 - DNA, 25 bp, Mus musculus
cccttgggcattcctcgaaggatta

SEQ ID NO: 349079 - DNA, 25 bp, Mus musculus
cccttgggcattgctcgaaggatta

SEQ ID NO: 349080 - DNA, 25 bp, Mus musculus
cccttgggcgtacacaggtagtcag

SEQ ID NO: 349081 - DNA, 25 bp, Mus musculus
cccttgggcgtagacaggtagtcag

SEQ ID NO: 349082 - DNA, 25 bp, Mus musculus
cccttgggctcaagttgtattgtca

SEQ ID NO: 349083 - DNA, 25 bp, Mus musculus
cccttgggctcatgttgtattgtca

SEQ ID NO: 349084 - DNA, 25 bp, Mus musculus
cccttgggtggactactgtgaacat

SEQ ID NO: 349085 - DNA, 25 bp, Mus musculus
cccttgggtggagtactgtgaacat

SEQ ID NO: 349086 - DNA, 25 bp, Mus musculus
cccttgggtttcacacataaagaat

SEQ ID NO: 349087 - DNA, 25 bp, Mus musculus
cccttgggtttctcacataaagaat

SEQ ID NO: 349088 - DNA, 25 bp, Mus musculus
cccttggtagggaataactcatctt

SEQ ID NO: 349089 - DNA, 25 bp, Mus musculus
cccttggtagggtataactcatctt

SEQ ID NO: 349090 - DNA, 25 bp, Mus musculus
cccttggtcatactgaggcctgttc

SEQ ID NO: 349091 - DNA, 25 bp, Mus musculus
cccttggtcatagtgaggcctgttc

SEQ ID NO: 349092 - DNA, 25 bp, Mus musculus
cccttggtcctgactctgtgttaat

SEQ ID NO: 349093 - DNA, 25 bp, Mus musculus
cccttggtcctgtctctgtgttaat

SEQ ID NO: 349094 - DNA, 25 bp, Mus musculus
cccttggtgccaatgctctgagaag

SEQ ID NO: 349095 - DNA, 25 bp, Mus musculus
cccttggtgccattgctctgagaag

SEQ ID NO: 349096 - DNA, 25 bp, Mus musculus
cccttgtaccgcctgaaatgatagc

SEQ ID NO: 349097 - DNA, 25 bp, Mus musculus
cccttgtaccgcgtgaaatgatagc

SEQ ID NO: 349098 - DNA, 25 bp, Mus musculus
cccttgtacgtcattgtcatttgaa

SEQ ID NO: 349099 - DNA, 25 bp, Mus musculus
cccttgtacgtctttgtcatttgaa

SEQ ID NO: 349100 - DNA, 25 bp, Mus musculus
cccttgtattttaggtaaatgtctg

SEQ ID NO: 349101 - DNA, 25 bp, Mus musculus
cccttgtatttttggtaaatgtctg

SEQ ID NO: 349102 - DNA, 25 bp, Mus musculus
cccttgtcaggtcagtgctatctag

SEQ ID NO: 349103 - DNA, 25 bp, Mus musculus
cccttgtcaggtgagtgctatctag

SEQ ID NO: 349104 - DNA, 25 bp, Mus musculus
cccttgtcctttagtattgtatcca

SEQ ID NO: 349105 - DNA, 25 bp, Mus musculus
cccttgtccttttgtattgtatcca

SEQ ID NO: 349106 - DNA, 25 bp, Mus musculus
cccttgtgacgactgcttactgcag

SEQ ID NO: 349107 - DNA, 25 bp, Mus musculus
cccttgtgacgagtgcttactgcag

SEQ ID NO: 349108 - DNA, 25 bp, Mus musculus
cccttgtgagctatccaaagcactt

SEQ ID NO: 349109 - DNA, 25 bp, Mus musculus
cccttgtgagctttccaaagcactt

SEQ ID NO: 349110 - DNA, 25 bp, Mus musculus
cccttgtgcaacactgtatccagaa

SEQ ID NO: 349111 - DNA, 25 bp, Mus musculus
cccttgtgcaactctgtatccagaa

SEQ ID NO: 349112 - DNA, 25 bp, Mus musculus
cccttgtgcatgatctcgggaggaa

SEQ ID NO: 349113 - DNA, 25 bp, Mus musculus
cccttgtgcatgttctcgggaggaa

SEQ ID NO: 349114 - DNA, 25 bp, Mus musculus
cccttgtggttcaaggagcacagtt

SEQ ID NO: 349115 - DNA, 25 bp, Mus musculus
cccttgtggttctaggagcacagtt

SEQ ID NO: 349116 - DNA, 25 bp, Mus musculus
cccttgtgtccaaatttaatgtgta

SEQ ID NO: 349117 - DNA, 25 bp, Mus musculus
cccttgtgtccatatttaatgtgta

SEQ ID NO: 349118 - DNA, 25 bp, Mus musculus
cccttgtgtgcgctgttgtctgtga

SEQ ID NO: 349119 - DNA, 25 bp, Mus musculus
cccttgtgtgcgctgttgtttgtga

SEQ ID NO: 349120 - DNA, 25 bp, Mus musculus
cccttgtgtgcggtgttgtctgtga

SEQ ID NO: 349121 - DNA, 25 bp, Mus musculus
cccttgtgtgcggtgttgtttgtga

SEQ ID NO: 349122 - DNA, 25 bp, Mus musculus
cccttgtgtgtgaggcatttgcaac

SEQ ID NO: 349123 - DNA, 25 bp, Mus musculus
cccttgtgtgtgcagtcaacatcag

SEQ ID NO: 349124 - DNA, 25 bp, Mus musculus
cccttgtgtgtggagtcaacatcag

SEQ ID NO: 349125 - DNA, 25 bp, Mus musculus
cccttgtgtgtgtggcatttgcaac

SEQ ID NO: 349126 - DNA, 25 bp, Mus musculus
cccttgtgttgcatgtttctacatt

SEQ ID NO: 349127 - DNA, 25 bp, Mus musculus
cccttgtgttgcttgtttctacatt

SEQ ID NO: 349128 - DNA, 25 bp, Mus musculus
cccttgttcgtcaggcagctagaaa

SEQ ID NO: 349129 - DNA, 25 bp, Mus musculus
cccttgttcgtctggcagctagaaa

SEQ ID NO: 349130 - DNA, 25 bp, Mus musculus
cccttgttctctattcacgttgtaa

SEQ ID NO: 349131 - DNA, 25 bp, Mus musculus
cccttgttctcttttcacgttgtaa

SEQ ID NO: 349132 - DNA, 25 bp, Mus musculus
cccttgttgaatacgttgtgacatt

SEQ ID NO: 349133 - DNA, 25 bp, Mus musculus
cccttgttgaattcgttgtgacatt

SEQ ID NO: 349134 - DNA, 25 bp, Mus musculus
cccttgttttgtatgctaatttcag

SEQ ID NO: 349135 - DNA, 25 bp, Mus musculus
cccttgttttgtttgctaatttcag

SEQ ID NO: 349136 - DNA, 25 bp, Mus musculus
ccctttaactttatgaggatgtatg

SEQ ID NO: 349137 - DNA, 25 bp, Mus musculus
ccctttaactttttgaggatgtatg

SEQ ID NO: 349138 - DNA, 25 bp, Mus musculus
ccctttactgctcttcattaggaaa

SEQ ID NO: 349139 - DNA, 25 bp, Mus musculus
ccctttactgctgttcattaggaaa

SEQ ID NO: 349140 - DNA, 25 bp, Mus musculus
ccctttagcccaaaaagaaactatg

SEQ ID NO: 349141 - DNA, 25 bp, Mus musculus
ccctttagcccataaagaaactatg

SEQ ID NO: 349142 - DNA, 25 bp, Mus musculus
ccctttatcattcagtggatcccag

SEQ ID NO: 349143 - DNA, 25 bp, Mus musculus
ccctttatcattgagtggatcccag

SEQ ID NO: 349144 - DNA, 25 bp, Mus musculus
ccctttatcccacacagttttccag

SEQ ID NO: 349145 - DNA, 25 bp, Mus musculus
ccctttatcccagacagttttccag

SEQ ID NO: 349146 - DNA, 25 bp, Mus musculus
ccctttatgagcctcatctgacatc

SEQ ID NO: 349147 - DNA, 25 bp, Mus musculus
ccctttatgagcgtcatctgacatc

SEQ ID NO: 349148 - DNA, 25 bp, Mus musculus
ccctttcaaacaagcacgtgctgta

SEQ ID NO: 349149 - DNA, 25 bp, Mus musculus
ccctttcaaacatgcacgtgctgta

SEQ ID NO: 349150 - DNA, 25 bp, Mus musculus
ccctttcaagccagctgtctgagga

SEQ ID NO: 349151 - DNA, 25 bp, Mus musculus
ccctttcaagcctgctgtctgagga

SEQ ID NO: 349152 - DNA, 25 bp, Mus musculus
ccctttcacagtagtcacctaagaa

SEQ ID NO: 349153 - DNA, 25 bp, Mus musculus
ccctttcacagttgtcacctaagaa

SEQ ID NO: 349154 - DNA, 25 bp, Mus musculus
ccctttcaccatcgtgtatcagtta

SEQ ID NO: 349155 - DNA, 25 bp, Mus musculus
ccctttcaccatggtgtatcagtta

SEQ ID NO: 349156 - DNA, 25 bp, Mus musculus
ccctttcacctcctatatagtcaag

SEQ ID NO: 349157 - DNA, 25 bp, Mus musculus
ccctttcacctcgtatatagtcaag

SEQ ID NO: 349158 - DNA, 25 bp, Mus musculus
ccctttcacttcatccaggctagga

SEQ ID NO: 349159 - DNA, 25 bp, Mus musculus
ccctttcacttcttccaggctagga

SEQ ID NO: 349160 - DNA, 25 bp, Mus musculus
ccctttcagactcgatgtgccttta

SEQ ID NO: 349161 - DNA, 25 bp, Mus musculus
ccctttcagactggatgtgccttta

SEQ ID NO: 349162 - DNA, 25 bp, Mus musculus
ccctttcagcgtctggtgcgagaaa

SEQ ID NO: 349163 - DNA, 25 bp, Mus musculus
ccctttcagcgtgtggtgcgagaaa

SEQ ID NO: 349164 - DNA, 25 bp, Mus musculus
ccctttcatgcccttgcttattaaa

SEQ ID NO: 349165 - DNA, 25 bp, Mus musculus
ccctttcatgccgttgcttattaaa

SEQ ID NO: 349166 - DNA, 25 bp, Mus musculus
ccctttcccagcatgagattgttta

SEQ ID NO: 349167 - DNA, 25 bp, Mus musculus
ccctttcccagcttgagattgttta

SEQ ID NO: 349168 - DNA, 25 bp, Mus musculus
ccctttcccatcatagttgtaacag

SEQ ID NO: 349169 - DNA, 25 bp, Mus musculus
ccctttcccatcttagttgtaacag

SEQ ID NO: 349170 - DNA, 25 bp, Mus musculus
ccctttccttagagaactgtacaca

SEQ ID NO: 349171 - DNA, 25 bp, Mus musculus
ccctttccttagtgaactgtacaca

SEQ ID NO: 349172 - DNA, 25 bp, Mus musculus
ccctttccttgcagaactttttatg

SEQ ID NO: 349173 - DNA, 25 bp, Mus musculus
ccctttccttgctgaactttttatg

SEQ ID NO: 349174 - DNA, 25 bp, Mus musculus
ccctttcgagttacggagagtcatt

SEQ ID NO: 349175 - DNA, 25 bp, Mus musculus
ccctttcgagtttcggagagtcatt

SEQ ID NO: 349176 - DNA, 25 bp, Mus musculus
ccctttcgcattactcagcacagtt

SEQ ID NO: 349177 - DNA, 25 bp, Mus musculus
ccctttcgcatttctcagcacagtt

SEQ ID NO: 349178 - DNA, 25 bp, Mus musculus
ccctttctcaagcaaatacgataat

SEQ ID NO: 349179 - DNA, 25 bp, Mus musculus
ccctttctcaaggaaatacgataat

SEQ ID NO: 349180 - DNA, 25 bp, Mus musculus
ccctttctccttctgatggttagag

SEQ ID NO: 349181 - DNA, 25 bp, Mus musculus
ccctttctccttgtgatggttagag

SEQ ID NO: 349182 - DNA, 25 bp, Mus musculus
ccctttctgaacacttaatgactgg

SEQ ID NO: 349183 - DNA, 25 bp, Mus musculus
ccctttctgaactcttaatgactgg

SEQ ID NO: 349184 - DNA, 25 bp, Mus musculus
ccctttctgacccatgtatatcata

SEQ ID NO: 349185 - DNA, 25 bp, Mus musculus
ccctttctgaccgatgtatatcata

SEQ ID NO: 349186 - DNA, 25 bp, Mus musculus
ccctttctgtagaatggtctaagct

SEQ ID NO: 349187 - DNA, 25 bp, Mus musculus
ccctttctgtagtatggtctaagct

SEQ ID NO: 349188 - DNA, 25 bp, Mus musculus
ccctttctgttcagataaatgacac

SEQ ID NO: 349189 - DNA, 25 bp, Mus musculus
ccctttctgttctgataaatgacac

SEQ ID NO: 349190 - DNA, 25 bp, Mus musculus
ccctttcttctgaagccatcaatac

SEQ ID NO: 349191 - DNA, 25 bp, Mus musculus
ccctttcttctgtagccatcaatac

SEQ ID NO: 349192 - DNA, 25 bp, Mus musculus
ccctttctttcaactggccatataa

SEQ ID NO: 349193 - DNA, 25 bp, Mus musculus
ccctttctttcatctggccatataa

SEQ ID NO: 349194 - DNA, 25 bp, Mus musculus
ccctttgacaagatccagtttgagc

SEQ ID NO: 349195 - DNA, 25 bp, Mus musculus
ccctttgacaagttccagtttgagc

SEQ ID NO: 349196 - DNA, 25 bp, Mus musculus
ccctttgacacgcatcgtaatcaga

SEQ ID NO: 349197 - DNA, 25 bp, Mus musculus
ccctttgacacggatcgtaatcaga

SEQ ID NO: 349198 - DNA, 25 bp, Mus musculus
ccctttgacttgctggctgagaaca

SEQ ID NO: 349199 - DNA, 25 bp, Mus musculus
ccctttgacttggtggctgagaaca

SEQ ID NO: 349200 - DNA, 25 bp, Mus musculus
ccctttgagggaatctatagacaca

SEQ ID NO: 349201 - DNA, 25 bp, Mus musculus
ccctttgagggattctatagacaca

SEQ ID NO: 349202 - DNA, 25 bp, Mus musculus
ccctttgattcacattggagattat

SEQ ID NO: 349203 - DNA, 25 bp, Mus musculus
ccctttgattcagattggagattat

SEQ ID NO: 349204 - DNA, 25 bp, Mus musculus
ccctttgattttatggagaacattt

SEQ ID NO: 349205 - DNA, 25 bp, Mus musculus
ccctttgattttttggagaacattt

SEQ ID NO: 349206 - DNA, 25 bp, Mus musculus
ccctttgcccaaagctattttattt

SEQ ID NO: 349207 - DNA, 25 bp, Mus musculus
ccctttgcccaatgctattttattt

SEQ ID NO: 349208 - DNA, 25 bp, Mus musculus
ccctttgcccagagacccaaagagt

SEQ ID NO: 349209 - DNA, 25 bp, Mus musculus
ccctttgcccagtgacccaaagagt

SEQ ID NO: 349210 - DNA, 25 bp, Mus musculus
ccctttgcttgtcattcttagaact

SEQ ID NO: 349211 - DNA, 25 bp, Mus musculus
ccctttgcttgtgattcttagaact

SEQ ID NO: 349212 - DNA, 25 bp, Mus musculus
ccctttggacaaatgtcgctgtcag

SEQ ID NO: 349213 - DNA, 25 bp, Mus musculus
ccctttggacaattgtcgctgtcag

SEQ ID NO: 349214 - DNA, 25 bp, Mus musculus
ccctttggagctcgtattacagaca

SEQ ID NO: 349215 - DNA, 25 bp, Mus musculus
ccctttggagctggtattacagaca

SEQ ID NO: 349216 - DNA, 25 bp, Mus musculus
ccctttggagtgcaagcagtacagt

SEQ ID NO: 349217 - DNA, 25 bp, Mus musculus
ccctttggagtggaagcagtacagt

SEQ ID NO: 349218 - DNA, 25 bp, Mus musculus
ccctttggatatcagcaagataatg

SEQ ID NO: 349219 - DNA, 25 bp, Mus musculus
ccctttggatatgagcaagataatg

SEQ ID NO: 349220 - DNA, 25 bp, Mus musculus
ccctttggatgcaaagctcgtgtct

SEQ ID NO: 349221 - DNA, 25 bp, Mus musculus
ccctttggatgctaagctcgtgtct

SEQ ID NO: 349222 - DNA, 25 bp, Mus musculus
ccctttggattgactggtgggcaga

SEQ ID NO: 349223 - DNA, 25 bp, Mus musculus
ccctttggattgtctggtgggcaga

SEQ ID NO: 349224 - DNA, 25 bp, Mus musculus
ccctttggcagcaaagacacctaaa

SEQ ID NO: 349225 - DNA, 25 bp, Mus musculus
ccctttggcagctaagacacctaaa

SEQ ID NO: 349226 - DNA, 25 bp, Mus musculus
ccctttgggcccagacaagtgaaat

SEQ ID NO: 349227 - DNA, 25 bp, Mus musculus
ccctttgggccctgacaagtgaaat

SEQ ID NO: 349228 - DNA, 25 bp, Mus musculus
ccctttgggcttcatgcaaagacaa

SEQ ID NO: 349229 - DNA, 25 bp, Mus musculus
ccctttgggcttgatgcaaagacaa

SEQ ID NO: 349230 - DNA, 25 bp, Mus musculus
ccctttggtgttactttgctgtata

SEQ ID NO: 349231 - DNA, 25 bp, Mus musculus
ccctttggtgtttctttgctgtata

SEQ ID NO: 349232 - DNA, 25 bp, Mus musculus
ccctttggtttcaggtttgcacaag

SEQ ID NO: 349233 - DNA, 25 bp, Mus musculus
ccctttggtttctggtttgcacaag

SEQ ID NO: 349234 - DNA, 25 bp, Mus musculus
ccctttgtagcacacaagttgtctt

SEQ ID NO: 349235 - DNA, 25 bp, Mus musculus
ccctttgtagcagacaagttgtctt

SEQ ID NO: 349236 - DNA, 25 bp, Mus musculus
ccctttgtcactccctatgtggtaa

SEQ ID NO: 349237 - DNA, 25 bp, Mus musculus
ccctttgtcactgcctatgtggtaa

SEQ ID NO: 349238 - DNA, 25 bp, Mus musculus
ccctttgtcctcagcgaggtgattt

SEQ ID NO: 349239 - DNA, 25 bp, Mus musculus
ccctttgtcctctgcgaggtgattt

SEQ ID NO: 349240 - DNA, 25 bp, Mus musculus
ccctttgtctcacctaagtagcaat

SEQ ID NO: 349241 - DNA, 25 bp, Mus musculus
ccctttgtctcagctaagtagcaat

SEQ ID NO: 349242 - DNA, 25 bp, Mus musculus
ccctttgtcttgaagttgcatcacg

SEQ ID NO: 349243 - DNA, 25 bp, Mus musculus
ccctttgtcttgtagttgcatcacg

SEQ ID NO: 349244 - DNA, 25 bp, Mus musculus
ccctttgtggacatgcagaatttct

SEQ ID NO: 349245 - DNA, 25 bp, Mus musculus
ccctttgtggacttgcagaatttct

SEQ ID NO: 349246 - DNA, 25 bp, Mus musculus
ccctttgtgtttagtgcggagttca

SEQ ID NO: 349247 - DNA, 25 bp, Mus musculus
ccctttgtgttttgtgcggagttca

SEQ ID NO: 349248 - DNA, 25 bp, Mus musculus
ccctttgttaggctgcacattagga

SEQ ID NO: 349249 - DNA, 25 bp, Mus musculus
ccctttgttagggtgcacattagga

SEQ ID NO: 349250 - DNA, 25 bp, Mus musculus
ccctttgttcgtcctatgaaatgac

SEQ ID NO: 349251 - DNA, 25 bp, Mus musculus
ccctttgttcgtgctatgaaatgac

SEQ ID NO: 349252 - DNA, 25 bp, Mus musculus
ccctttgttcttaagcttatggatg

SEQ ID NO: 349253 - DNA, 25 bp, Mus musculus
ccctttgttctttagcttatggatg

SEQ ID NO: 349254 - DNA, 25 bp, Mus musculus
ccctttgttgtcatggagatctgtg

SEQ ID NO: 349255 - DNA, 25 bp, Mus musculus
ccctttgttgtcttggagatctgtg

SEQ ID NO: 349256 - DNA, 25 bp, Mus musculus
cccttttaaactctacactggcttg

SEQ ID NO: 349257 - DNA, 25 bp, Mus musculus
cccttttaaactgtacactggcttg

SEQ ID NO: 349258 - DNA, 25 bp, Mus musculus
cccttttacttcaggcttgttgcaa

SEQ ID NO: 349259 - DNA, 25 bp, Mus musculus
cccttttacttctggcttgttgcaa

SEQ ID NO: 349260 - DNA, 25 bp, Mus musculus
cccttttatagtccctcctttgatg

SEQ ID NO: 349261 - DNA, 25 bp, Mus musculus
cccttttatagtgcctcctttgatg

SEQ ID NO: 349262 - DNA, 25 bp, Mus musculus
cccttttcagggagcatctttaaat

SEQ ID NO: 349263 - DNA, 25 bp, Mus musculus
cccttttcagggtgcatctttaaat

SEQ ID NO: 349264 - DNA, 25 bp, Mus musculus
cccttttcatagagttccttgtaca

SEQ ID NO: 349265 - DNA, 25 bp, Mus musculus
cccttttcatagtgttccttgtaca

SEQ ID NO: 349266 - DNA, 25 bp, Mus musculus
cccttttccaggctcagtacattgc

SEQ ID NO: 349267 - DNA, 25 bp, Mus musculus
cccttttccagggtcagtacattgc

SEQ ID NO: 349268 - DNA, 25 bp, Mus musculus
cccttttcctgactcggtgtatgga

SEQ ID NO: 349269 - DNA, 25 bp, Mus musculus
cccttttcctgagtcggtgtatgga

SEQ ID NO: 349270 - DNA, 25 bp, Mus musculus
cccttttcctttaagtcacaatgat

SEQ ID NO: 349271 - DNA, 25 bp, Mus musculus
cccttttccttttagtcacaatgat

SEQ ID NO: 349272 - DNA, 25 bp, Mus musculus
cccttttctacccaggagatatctt

SEQ ID NO: 349273 - DNA, 25 bp, Mus musculus
cccttttctaccgaggagatatctt

SEQ ID NO: 349274 - DNA, 25 bp, Mus musculus
cccttttctggcatgtgtgtatatc

SEQ ID NO: 349275 - DNA, 25 bp, Mus musculus
cccttttctggcttgtgtgtatatc

SEQ ID NO: 349276 - DNA, 25 bp, Mus musculus
cccttttgatccacagacaccgttt

SEQ ID NO: 349277 - DNA, 25 bp, Mus musculus
cccttttgatcctcagacaccgttt

SEQ ID NO: 349278 - DNA, 25 bp, Mus musculus
cccttttgcaagcaagggtccatgg

SEQ ID NO: 349279 - DNA, 25 bp, Mus musculus
cccttttgcaaggaagggtccatgg

SEQ ID NO: 349280 - DNA, 25 bp, Mus musculus
cccttttggccacaattctctttag

SEQ ID NO: 349281 - DNA, 25 bp, Mus musculus
cccttttggccagaattctctttag

SEQ ID NO: 349282 - DNA, 25 bp, Mus musculus
cccttttgtgcaatctgatcagttt

SEQ ID NO: 349283 - DNA, 25 bp, Mus musculus
cccttttgtgcattctgatcagttt

SEQ ID NO: 349284 - DNA, 25 bp, Mus musculus
cccttttgtgtgatgccatgtggag

SEQ ID NO: 349285 - DNA, 25 bp, Mus musculus
cccttttgtgtgttgccatgtggag

SEQ ID NO: 349286 - DNA, 25 bp, Mus musculus
cccttttgttctctacagtgaaact

SEQ ID NO: 349287 - DNA, 25 bp, Mus musculus
cccttttgttctgtacagtgaaact

SEQ ID NO: 349288 - DNA, 25 bp, Mus musculus
ccctttttctacatgagtcatggtc

SEQ ID NO: 349289 - DNA, 25 bp, Mus musculus
ccctttttctacttgagtcatggtc

SEQ ID NO: 349290 - DNA, 25 bp, Mus musculus
ccctttttctttaggcactgtgaca

SEQ ID NO: 349291 - DNA, 25 bp, Mus musculus
ccctttttcttttggcactgtgaca

SEQ ID NO: 349292 - DNA, 25 bp, Mus musculus
ccctttttgactaatcatcctcaga

SEQ ID NO: 349293 - DNA, 25 bp, Mus musculus
ccctttttgacttatcatcctcaga

SEQ ID NO: 349294 - DNA, 25 bp, Mus musculus
ccgaaaactagaaagcacagtgcaa

SEQ ID NO: 349295 - DNA, 25 bp, Mus musculus
ccgaaaactagatagcacagtgcaa

SEQ ID NO: 349296 - DNA, 25 bp, Mus musculus
ccgaaaagcacaaagtctcttctgg

SEQ ID NO: 349297 - DNA, 25 bp, Mus musculus
ccgaaaagcacatagtctcttctgg

SEQ ID NO: 349298 - DNA, 25 bp, Mus musculus
ccgaaacccaccaacactagatttg

SEQ ID NO: 349299 - DNA, 25 bp, Mus musculus
ccgaaacccacctacactagatttg

SEQ ID NO: 349300 - DNA, 25 bp, Mus musculus
ccgaaacccagcatagtccagagaa

SEQ ID NO: 349301 - DNA, 25 bp, Mus musculus
ccgaaacccagcttagtccagagaa

SEQ ID NO: 349302 - DNA, 25 bp, Mus musculus
ccgaaactgctaatcctgggaagga

SEQ ID NO: 349303 - DNA, 25 bp, Mus musculus
ccgaaactgctattcctgggaagga

SEQ ID NO: 349304 - DNA, 25 bp, Mus musculus
ccgaaaggccagataccagattaca

SEQ ID NO: 349305 - DNA, 25 bp, Mus musculus
ccgaaaggccagttaccagattaca

SEQ ID NO: 349306 - DNA, 25 bp, Mus musculus
ccgaaagtgatgaggcagttttatg

SEQ ID NO: 349307 - DNA, 25 bp, Mus musculus
ccgaaagtgatgtggcagttttatg

SEQ ID NO: 349308 - DNA, 25 bp, Mus musculus
ccgaaatacaccacatttactccaa

SEQ ID NO: 349309 - DNA, 25 bp, Mus musculus
ccgaaatacacctcatttactccaa

SEQ ID NO: 349310 - DNA, 25 bp, Mus musculus
ccgaaatgacccacagttactgcag

SEQ ID NO: 349311 - DNA, 25 bp, Mus musculus
ccgaaatgaccctcagttactgcag

SEQ ID NO: 349312 - DNA, 25 bp, Mus musculus
ccgaaatgccttattacttcctgat

SEQ ID NO: 349313 - DNA, 25 bp, Mus musculus
ccgaaatgcctttttacttcctgat

SEQ ID NO: 349314 - DNA, 25 bp, Mus musculus
ccgaacaacggaaaaagtgatatat

SEQ ID NO: 349315 - DNA, 25 bp, Mus musculus
ccgaacaacggataaagtgatatat

SEQ ID NO: 349316 - DNA, 25 bp, Mus musculus
ccgaacacggatcatgtctgtacaa

SEQ ID NO: 349317 - DNA, 25 bp, Mus musculus
ccgaacacggatgatgtctgtacaa

SEQ ID NO: 349318 - DNA, 25 bp, Mus musculus
ccgaacaggtgaaggcaagatcctg

SEQ ID NO: 349319 - DNA, 25 bp, Mus musculus
ccgaacaggtgatggcaagatcctg

SEQ ID NO: 349320 - DNA, 25 bp, Mus musculus
ccgaacagtcggaggagacctggta

SEQ ID NO: 349321 - DNA, 25 bp, Mus musculus
ccgaacagtcggtggagacctggta

SEQ ID NO: 349322 - DNA, 25 bp, Mus musculus
ccgaacatgttgcttaccgcaccat

SEQ ID NO: 349323 - DNA, 25 bp, Mus musculus
ccgaacatgttggttaccgcaccat

SEQ ID NO: 349324 - DNA, 25 bp, Mus musculus
ccgaacatttgcatcaggatgctat

SEQ ID NO: 349325 - DNA, 25 bp, Mus musculus
ccgaacatttgcttcaggatgctat

SEQ ID NO: 349326 - DNA, 25 bp, Mus musculus
ccgaaccaattcctcatagtactga

SEQ ID NO: 349327 - DNA, 25 bp, Mus musculus
ccgaaccaattcgtcatagtactga

SEQ ID NO: 349328 - DNA, 25 bp, Mus musculus
ccgaaccagagccaccagagcaggg

SEQ ID NO: 349329 - DNA, 25 bp, Mus musculus
ccgaaccagagcgaccagagcaggg

SEQ ID NO: 349330 - DNA, 25 bp, Mus musculus
ccgaaccccatacgagagagacttt

SEQ ID NO: 349331 - DNA, 25 bp, Mus musculus
ccgaaccccataggagagagacttt

SEQ ID NO: 349332 - DNA, 25 bp, Mus musculus
ccgaaccttacaatttcttgacata

SEQ ID NO: 349333 - DNA, 25 bp, Mus musculus
ccgaaccttacattttcttgacata

SEQ ID NO: 349334 - DNA, 25 bp, Mus musculus
ccgaactcacttcggacatctttta

SEQ ID NO: 349335 - DNA, 25 bp, Mus musculus
ccgaactcacttgggacatctttta

SEQ ID NO: 349336 - DNA, 25 bp, Mus musculus
ccgaactcgtgcagttaagccgaaa

SEQ ID NO: 349337 - DNA, 25 bp, Mus musculus
ccgaactcgtgctgttaagccgaaa

SEQ ID NO: 349338 - DNA, 25 bp, Mus musculus
ccgaactctgctctgagtgtgcgcg

SEQ ID NO: 349339 - DNA, 25 bp, Mus musculus
ccgaactctgctgtgagtgtgcgcg

SEQ ID NO: 349340 - DNA, 25 bp, Mus musculus
ccgaactctgggaaagagggctgat

SEQ ID NO: 349341 - DNA, 25 bp, Mus musculus
ccgaactctgggtaagagggctgat

SEQ ID NO: 349342 - DNA, 25 bp, Mus musculus
ccgaactgcgacagatttactgcag

SEQ ID NO: 349343 - DNA, 25 bp, Mus musculus
ccgaactgcgactgatttactgcag

SEQ ID NO: 349344 - DNA, 25 bp, Mus musculus
ccgaactggtgcctttgtttgtata

SEQ ID NO: 349345 - DNA, 25 bp, Mus musculus
ccgaactggtgcgtttgtttgtata

SEQ ID NO: 349346 - DNA, 25 bp, Mus musculus
ccgaactgtgggagtatccaagaag

SEQ ID NO: 349347 - DNA, 25 bp, Mus musculus
ccgaactgtgggtgtatccaagaag

SEQ ID NO: 349348 - DNA, 25 bp, Mus musculus
ccgaactgtttcagagctaggagcc

SEQ ID NO: 349349 - DNA, 25 bp, Mus musculus
ccgaactgtttctgagctaggagcc

SEQ ID NO: 349350 - DNA, 25 bp, Mus musculus
ccgaacttggacaaaatgtgtttat

SEQ ID NO: 349351 - DNA, 25 bp, Mus musculus
ccgaacttggactaaatgtgtttat

SEQ ID NO: 349352 - DNA, 25 bp, Mus musculus
ccgaagaaatatatccctggcacta

SEQ ID NO: 349353 - DNA, 25 bp, Mus musculus
ccgaagaaatatttccctggcacta

SEQ ID NO: 349354 - DNA, 25 bp, Mus musculus
ccgaagaacgtcatgatgcagacaa

SEQ ID NO: 349355 - DNA, 25 bp, Mus musculus
ccgaagaacgtcttgatgcagacaa

SEQ ID NO: 349356 - DNA, 25 bp, Mus musculus
ccgaagacagcgaccgagtgtgcgt

SEQ ID NO: 349357 - DNA, 25 bp, Mus musculus
ccgaagacagcgtccgagtgtgcgt

SEQ ID NO: 349358 - DNA, 25 bp, Mus musculus
ccgaagagtctgctttttattgaat

SEQ ID NO: 349359 - DNA, 25 bp, Mus musculus
ccgaagagtctggtttttattgaat

SEQ ID NO: 349360 - DNA, 25 bp, Mus musculus
ccgaagcagggccttcagagctaga

SEQ ID NO: 349361 - DNA, 25 bp, Mus musculus
ccgaagcagggcgttcagagctaga

SEQ ID NO: 349362 - DNA, 25 bp, Mus musculus
ccgaagcatggcaactgggcatcaa

SEQ ID NO: 349363 - DNA, 25 bp, Mus musculus
ccgaagcatggctactgggcatcaa

SEQ ID NO: 349364 - DNA, 25 bp, Mus musculus
ccgaagcatttgcagtttgcccaat

SEQ ID NO: 349365 - DNA, 25 bp, Mus musculus
ccgaagcatttggagtttgcccaat

SEQ ID NO: 349366 - DNA, 25 bp, Mus musculus
ccgaagccacgaattgccttatttt

SEQ ID NO: 349367 - DNA, 25 bp, Mus musculus
ccgaagccacgatttgccttatttt

SEQ ID NO: 349368 - DNA, 25 bp, Mus musculus
ccgaagctacgcatgcgcacaagaa

SEQ ID NO: 349369 - DNA, 25 bp, Mus musculus
ccgaagctacgcttgcgcacaagaa

SEQ ID NO: 349370 - DNA, 25 bp, Mus musculus
ccgaagctataacctgctgttgaag

SEQ ID NO: 349371 - DNA, 25 bp, Mus musculus
ccgaagctataagctgctgttgaag

SEQ ID NO: 349372 - DNA, 25 bp, Mus musculus
ccgaagctgttcctggcaggacgaa

SEQ ID NO: 349373 - DNA, 25 bp, Mus musculus
ccgaagctgttcgtggcaggacgaa

SEQ ID NO: 349374 - DNA, 25 bp, Mus musculus
ccgaaggaggccacttgggtgcatt

SEQ ID NO: 349375 - DNA, 25 bp, Mus musculus
ccgaaggaggcctcttgggtgcatt

SEQ ID NO: 349376 - DNA, 25 bp, Mus musculus
ccgaaggtgcctattttcaatggat

SEQ ID NO: 349377 - DNA, 25 bp, Mus musculus
ccgaaggtgccttttttcaatggat

SEQ ID NO: 349378 - DNA, 25 bp, Mus musculus
ccgaagtaccaaccagcgttttttg

SEQ ID NO: 349379 - DNA, 25 bp, Mus musculus
ccgaagtaccaagcagcgttttttg

SEQ ID NO: 349380 - DNA, 25 bp, Mus musculus
ccgaagtgaccgaggaggacgccga

SEQ ID NO: 349381 - DNA, 25 bp, Mus musculus
ccgaagtgaccgtggaggacgccga

SEQ ID NO: 349382 - DNA, 25 bp, Mus musculus
ccgaagtgattccaaacctaattga

SEQ ID NO: 349383 - DNA, 25 bp, Mus musculus
ccgaagtgattcgaaacctaattga

SEQ ID NO: 349384 - DNA, 25 bp, Mus musculus
ccgaagttgctactgtctcctttta

SEQ ID NO: 349385 - DNA, 25 bp, Mus musculus
ccgaagttgctagtgtctcctttta

SEQ ID NO: 349386 - DNA, 25 bp, Mus musculus
ccgaagtttggtcctggctgctcca

SEQ ID NO: 349387 - DNA, 25 bp, Mus musculus
ccgaagtttggtgctggctgctcca

SEQ ID NO: 349388 - DNA, 25 bp, Mus musculus
ccgaatactctcagtgtagactggg

SEQ ID NO: 349389 - DNA, 25 bp, Mus musculus
ccgaatactctctgtgtagactggg

SEQ ID NO: 349390 - DNA, 25 bp, Mus musculus
ccgaatccacccagtagtgttctaa

SEQ ID NO: 349391 - DNA, 25 bp, Mus musculus
ccgaatccaccctgtagtgttctaa

SEQ ID NO: 349392 - DNA, 25 bp, Mus musculus
ccgaatgtataaagctgacgttctt

SEQ ID NO: 349393 - DNA, 25 bp, Mus musculus
ccgaatgtataatgctgacgttctt

SEQ ID NO: 349394 - DNA, 25 bp, Mus musculus
ccgaatgtggctatggagcatttgc

SEQ ID NO: 349395 - DNA, 25 bp, Mus musculus
ccgaatgtggctttggagcatttgc

SEQ ID NO: 349396 - DNA, 25 bp, Mus musculus
ccgaatgttcgtactgcttggttgt

SEQ ID NO: 349397 - DNA, 25 bp, Mus musculus
ccgaatgttcgttctgcttggttgt

SEQ ID NO: 349398 - DNA, 25 bp, Mus musculus
ccgaattcatctatggtggttgtca

SEQ ID NO: 349399 - DNA, 25 bp, Mus musculus
ccgaattcatctttggtggttgtca

SEQ ID NO: 349400 - DNA, 25 bp, Mus musculus
ccgaattctgaaagaaacgctatat

SEQ ID NO: 349401 - DNA, 25 bp, Mus musculus
ccgaattctgaatgaaacgctatat

SEQ ID NO: 349402 - DNA, 25 bp, Mus musculus
ccgaatttcagcatcagctctggtg

SEQ ID NO: 349403 - DNA, 25 bp, Mus musculus
ccgaatttcagcttcagctctggtg

SEQ ID NO: 349404 - DNA, 25 bp, Mus musculus
ccgaatttcatactggacagctttg

SEQ ID NO: 349405 - DNA, 25 bp, Mus musculus
ccgaatttcatagtggacagctttg

SEQ ID NO: 349406 - DNA, 25 bp, Mus musculus
ccgacaactgtcaccaaagcttata

SEQ ID NO: 349407 - DNA, 25 bp, Mus musculus
ccgacaactgtctccaaagcttata

SEQ ID NO: 349408 - DNA, 25 bp, Mus musculus
ccgacaactgttcaggacgctggat

SEQ ID NO: 349409 - DNA, 25 bp, Mus musculus
ccgacaactgttgaggacgctggat

SEQ ID NO: 349410 - DNA, 25 bp, Mus musculus
ccgacacagtgaagtggtctagatt

SEQ ID NO: 349411 - DNA, 25 bp, Mus musculus
ccgacacagtgatgtggtctagatt

SEQ ID NO: 349412 - DNA, 25 bp, Mus musculus
ccgacactcaggagctggctgatgt

SEQ ID NO: 349413 - DNA, 25 bp, Mus musculus
ccgacactcaggtgctggctgatgt

SEQ ID NO: 349414 - DNA, 25 bp, Mus musculus
ccgacagcatgtcgagacgttcttc

SEQ ID NO: 349415 - DNA, 25 bp, Mus musculus
ccgacagcatgtggagacgttcttc

SEQ ID NO: 349416 - DNA, 25 bp, Mus musculus
ccgacaggatgtcgagaatgagcta

SEQ ID NO: 349417 - DNA, 25 bp, Mus musculus
ccgacaggatgtggagaatgagcta

SEQ ID NO: 349418 - DNA, 25 bp, Mus musculus
ccgacaggtctcactctgaggcaga

SEQ ID NO: 349419 - DNA, 25 bp, Mus musculus
ccgacaggtctctctctgaggcaga

SEQ ID NO: 349420 - DNA, 25 bp, Mus musculus
ccgacatacagtaaaggttctctct

SEQ ID NO: 349421 - DNA, 25 bp, Mus musculus
ccgacatacagttaaggttctctct

SEQ ID NO: 349422 - DNA, 25 bp, Mus musculus
ccgacatcatcccaattgtagcagg

SEQ ID NO: 349423 - DNA, 25 bp, Mus musculus
ccgacatcatccgaattgtagcagg

SEQ ID NO: 349424 - DNA, 25 bp, Mus musculus
ccgacatcttccctgggtggaacag

SEQ ID NO: 349425 - DNA, 25 bp, Mus musculus
ccgacatcttccgtgggtggaacag

SEQ ID NO: 349426 - DNA, 25 bp, Mus musculus
ccgacatcttggaaatcagcactat

SEQ ID NO: 349427 - DNA, 25 bp, Mus musculus
ccgacatcttggtaatcagcactat

SEQ ID NO: 349428 - DNA, 25 bp, Mus musculus
ccgacatgatagagctcttgggccc

SEQ ID NO: 349429 - DNA, 25 bp, Mus musculus
ccgacatgatagtgctcttgggccc

SEQ ID NO: 349430 - DNA, 25 bp, Mus musculus
ccgacatgcacaattccaacatcag

SEQ ID NO: 349431 - DNA, 25 bp, Mus musculus
ccgacatgcacatttccaacatcag

SEQ ID NO: 349432 - DNA, 25 bp, Mus musculus
ccgacatttcagcccagagcttgag

SEQ ID NO: 349433 - DNA, 25 bp, Mus musculus
ccgacatttcaggccagagcttgag

SEQ ID NO: 349434 - DNA, 25 bp, Mus musculus
ccgaccaatgtcagtaaacgctctg

SEQ ID NO: 349435 - DNA, 25 bp, Mus musculus
ccgaccaatgtctgtaaacgctctg

SEQ ID NO: 349436 - DNA, 25 bp, Mus musculus
ccgaccaccaaacttatctacaggg

SEQ ID NO: 349437 - DNA, 25 bp, Mus musculus
ccgaccaccaaagttatctacaggg

SEQ ID NO: 349438 - DNA, 25 bp, Mus musculus
ccgaccataggcagggatctgttca

SEQ ID NO: 349439 - DNA, 25 bp, Mus musculus
ccgaccataggctgggatctgttca

SEQ ID NO: 349440 - DNA, 25 bp, Mus musculus
ccgacccagagcctagtttgtggag

SEQ ID NO: 349441 - DNA, 25 bp, Mus musculus
ccgacccagagcgtagtttgtggag

SEQ ID NO: 349442 - DNA, 25 bp, Mus musculus
ccgaccccacaaactgttttctgta

SEQ ID NO: 349443 - DNA, 25 bp, Mus musculus
ccgaccccacaatctgttttctgta

SEQ ID NO: 349444 - DNA, 25 bp, Mus musculus
ccgaccgccatgcaaacccagcgat

SEQ ID NO: 349445 - DNA, 25 bp, Mus musculus
ccgaccgccatggaaacccagcgat

SEQ ID NO: 349446 - DNA, 25 bp, Mus musculus
ccgaccgtgtgccagtaaaacatca

SEQ ID NO: 349447 - DNA, 25 bp, Mus musculus
ccgaccgtgtgcgagtaaaacatca

SEQ ID NO: 349448 - DNA, 25 bp, Mus musculus
ccgacctcttggctacttgcagaat

SEQ ID NO: 349449 - DNA, 25 bp, Mus musculus
ccgacctcttgggtacttgcagaat

SEQ ID NO: 349450 - DNA, 25 bp, Mus musculus
ccgacctgaagaatggcggccgctt

SEQ ID NO: 349451 - DNA, 25 bp, Mus musculus
ccgacctgaagattggcggccgctt

SEQ ID NO: 349452 - DNA, 25 bp, Mus musculus
ccgacctgctcaccgatgggaaatg

SEQ ID NO: 349453 - DNA, 25 bp, Mus musculus
ccgacctgctcagcgatgggaaatg

SEQ ID NO: 349454 - DNA, 25 bp, Mus musculus
ccgacctgtggtcgtgtggtcacat

SEQ ID NO: 349455 - DNA, 25 bp, Mus musculus
ccgacctgtggtggtgtggtcacat

SEQ ID NO: 349456 - DNA, 25 bp, Mus musculus
ccgaccttaaacaacttctgtgcag

SEQ ID NO: 349457 - DNA, 25 bp, Mus musculus
ccgaccttaaactacttctgtgcag

SEQ ID NO: 349458 - DNA, 25 bp, Mus musculus
ccgaccttcatcactattctaggat

SEQ ID NO: 349459 - DNA, 25 bp, Mus musculus
ccgaccttcatctctattctaggat

SEQ ID NO: 349460 - DNA, 25 bp, Mus musculus
ccgacgattcctatacatctgcatt

SEQ ID NO: 349461 - DNA, 25 bp, Mus musculus
ccgacgattcctttacatctgcatt

SEQ ID NO: 349462 - DNA, 25 bp, Mus musculus
ccgacgcggtggagcttcgagaact

SEQ ID NO: 349463 - DNA, 25 bp, Mus musculus
ccgacgcggtggtgcttcgagaact

SEQ ID NO: 349464 - DNA, 25 bp, Mus musculus
ccgacgctgaacagagccatgaggc

SEQ ID NO: 349465 - DNA, 25 bp, Mus musculus
ccgacgctgaactgagccatgaggc

SEQ ID NO: 349466 - DNA, 25 bp, Mus musculus
ccgacgtgatggatgctctcaggag

SEQ ID NO: 349467 - DNA, 25 bp, Mus musculus
ccgacgtgatggttgctctcaggag

SEQ ID NO: 349468 - DNA, 25 bp, Mus musculus
ccgacgtggaggcaaagaagttcaa

SEQ ID NO: 349469 - DNA, 25 bp, Mus musculus
ccgacgtggagggaaagaagttcaa

SEQ ID NO: 349470 - DNA, 25 bp, Mus musculus
ccgactacagtaaggccctgtccta

SEQ ID NO: 349471 - DNA, 25 bp, Mus musculus
ccgactacagtatggccctgtccta

SEQ ID NO: 349472 - DNA, 25 bp, Mus musculus
ccgactcaaactcgagctcgagcag

SEQ ID NO: 349473 - DNA, 25 bp, Mus musculus
ccgactcaaactggagctcgagcag

SEQ ID NO: 349474 - DNA, 25 bp, Mus musculus
ccgactcacacaacactcagtaata

SEQ ID NO: 349475 - DNA, 25 bp, Mus musculus
ccgactcacacatcactcagtaata

SEQ ID NO: 349476 - DNA, 25 bp, Mus musculus
ccgactcacattattcctctgagaa

SEQ ID NO: 349477 - DNA, 25 bp, Mus musculus
ccgactcacatttttcctctgagaa

SEQ ID NO: 349478 - DNA, 25 bp, Mus musculus
ccgactcccgacagtgatgtgttta

SEQ ID NO: 349479 - DNA, 25 bp, Mus musculus
ccgactcccgactgtgatgtgttta

SEQ ID NO: 349480 - DNA, 25 bp, Mus musculus
ccgactccgatgatgagggctacgt

SEQ ID NO: 349481 - DNA, 25 bp, Mus musculus
ccgactccgatgttgagggctacgt

SEQ ID NO: 349482 - DNA, 25 bp, Mus musculus
ccgactcctcctaatcctttttgtg

SEQ ID NO: 349483 - DNA, 25 bp, Mus musculus
ccgactcctccttatcctttttgtg

SEQ ID NO: 349484 - DNA, 25 bp, Mus musculus
ccgactcctttccaatagaaagaag

SEQ ID NO: 349485 - DNA, 25 bp, Mus musculus
ccgactcctttcgaatagaaagaag

SEQ ID NO: 349486 - DNA, 25 bp, Mus musculus
ccgactctccttctgtgtgttttag

SEQ ID NO: 349487 - DNA, 25 bp, Mus musculus
ccgactctccttgtgtgtgttttag

SEQ ID NO: 349488 - DNA, 25 bp, Mus musculus
ccgactctcttgctccttatggttt

SEQ ID NO: 349489 - DNA, 25 bp, Mus musculus
ccgactctcttggtccttatggttt

SEQ ID NO: 349490 - DNA, 25 bp, Mus musculus
ccgactgacctgaaaacgttctgtt

SEQ ID NO: 349491 - DNA, 25 bp, Mus musculus
ccgactgacctgtaaacgttctgtt

SEQ ID NO: 349492 - DNA, 25 bp, Mus musculus
ccgactgactgcagggacgcgatgc

SEQ ID NO: 349493 - DNA, 25 bp, Mus musculus
ccgactgactgctgggacgcgatgc

SEQ ID NO: 349494 - DNA, 25 bp, Mus musculus
ccgactgcctggaaagctgtttagc

SEQ ID NO: 349495 - DNA, 25 bp, Mus musculus
ccgactgcctggtaagctgtttagc

SEQ ID NO: 349496 - DNA, 25 bp, Mus musculus
ccgactgctctgctatcttcaatga

SEQ ID NO: 349497 - DNA, 25 bp, Mus musculus
ccgactgctctggtatcttcaatga

SEQ ID NO: 349498 - DNA, 25 bp, Mus musculus
ccgactggagggatcttctgagatc

SEQ ID NO: 349499 - DNA, 25 bp, Mus musculus
ccgactggagggttcttctgagatc

SEQ ID NO: 349500 - DNA, 25 bp, Mus musculus
ccgacttgtctgatactgaagtgtg

SEQ ID NO: 349501 - DNA, 25 bp, Mus musculus
ccgacttgtctgttactgaagtgtg

SEQ ID NO: 349502 - DNA, 25 bp, Mus musculus
ccgactttccacatactgtagcatc

SEQ ID NO: 349503 - DNA, 25 bp, Mus musculus
ccgactttccacttactgtagcatc

SEQ ID NO: 349504 - DNA, 25 bp, Mus musculus
ccgacttttaacactttcagcacta

SEQ ID NO: 349505 - DNA, 25 bp, Mus musculus
ccgacttttaactctttcagcacta

SEQ ID NO: 349506 - DNA, 25 bp, Mus musculus
ccgagaacaggcatgttgtataata

SEQ ID NO: 349507 - DNA, 25 bp, Mus musculus
ccgagaacaggcttgttgtataata

SEQ ID NO: 349508 - DNA, 25 bp, Mus musculus
ccgagaagccgcaatgaccgagatt

SEQ ID NO: 349509 - DNA, 25 bp, Mus musculus
ccgagaagccgctatgaccgagatt

SEQ ID NO: 349510 - DNA, 25 bp, Mus musculus
ccgagaatctggcatgtatgctcct

SEQ ID NO: 349511 - DNA, 25 bp, Mus musculus
ccgagaatctgggatgtatgctcct

SEQ ID NO: 349512 - DNA, 25 bp, Mus musculus
ccgagaccacagctgggtgaccctg

SEQ ID NO: 349513 - DNA, 25 bp, Mus musculus
ccgagaccacaggtgggtgaccctg

SEQ ID NO: 349514 - DNA, 25 bp, Mus musculus
ccgagaccagaacattgcatttatc

SEQ ID NO: 349515 - DNA, 25 bp, Mus musculus
ccgagaccagaagattgcatttatc

SEQ ID NO: 349516 - DNA, 25 bp, Mus musculus
ccgagacccagaagtggcccaggag

SEQ ID NO: 349517 - DNA, 25 bp, Mus musculus
ccgagacccagatgtggcccaggag

SEQ ID NO: 349518 - DNA, 25 bp, Mus musculus
ccgagacccttgattgatagtgctt

SEQ ID NO: 349519 - DNA, 25 bp, Mus musculus
ccgagacccttgtttgatagtgctt

SEQ ID NO: 349520 - DNA, 25 bp, Mus musculus
ccgagacctgagaggcttccctgca

SEQ ID NO: 349521 - DNA, 25 bp, Mus musculus
ccgagacctgagtggcttccctgca

SEQ ID NO: 349522 - DNA, 25 bp, Mus musculus
ccgagacctggaagcgactgccgct

SEQ ID NO: 349523 - DNA, 25 bp, Mus musculus
ccgagacctggatgcgactgccgct

SEQ ID NO: 349524 - DNA, 25 bp, Mus musculus
ccgagacttcaacctacccgccagt

SEQ ID NO: 349525 - DNA, 25 bp, Mus musculus
ccgagacttcaagctacccgccagt

SEQ ID NO: 349526 - DNA, 25 bp, Mus musculus
ccgagacttttgacatggagagcct

SEQ ID NO: 349527 - DNA, 25 bp, Mus musculus
ccgagacttttgtcatggagagcct

SEQ ID NO: 349528 - DNA, 25 bp, Mus musculus
ccgagagaccttatgctgagtgttt

SEQ ID NO: 349529 - DNA, 25 bp, Mus musculus
ccgagagaccttttgctgagtgttt

SEQ ID NO: 349530 - DNA, 25 bp, Mus musculus
ccgagagagcagaccaagaattgat

SEQ ID NO: 349531 - DNA, 25 bp, Mus musculus
ccgagagagcagtccaagaattgat

SEQ ID NO: 349532 - DNA, 25 bp, Mus musculus
ccgagagagcggacacctcagtgtg

SEQ ID NO: 349533 - DNA, 25 bp, Mus musculus
ccgagagagcggtcacctcagtgtg

SEQ ID NO: 349534 - DNA, 25 bp, Mus musculus
ccgagagcagatacggcttccgctt

SEQ ID NO: 349535 - DNA, 25 bp, Mus musculus
ccgagagcagattcggcttccgctt

SEQ ID NO: 349536 - DNA, 25 bp, Mus musculus
ccgagagcatctccatggtcaaaat

SEQ ID NO: 349537 - DNA, 25 bp, Mus musculus
ccgagagcatctgcatggtcaaaat

SEQ ID NO: 349538 - DNA, 25 bp, Mus musculus
ccgagagcttcactaaatggtagat

SEQ ID NO: 349539 - DNA, 25 bp, Mus musculus
ccgagagcttcagtaaatggtagat

SEQ ID NO: 349540 - DNA, 25 bp, Mus musculus
ccgagagggttacacatcattttgg

SEQ ID NO: 349541 - DNA, 25 bp, Mus musculus
ccgagagggttagacatcattttgg

SEQ ID NO: 349542 - DNA, 25 bp, Mus musculus
ccgagagtcaccagattgcagcaga

SEQ ID NO: 349543 - DNA, 25 bp, Mus musculus
ccgagagtcacctgattgcagcaga

SEQ ID NO: 349544 - DNA, 25 bp, Mus musculus
ccgagagtctctcgttgtggctttg

SEQ ID NO: 349545 - DNA, 25 bp, Mus musculus
ccgagagtctctggttgtggctttg

SEQ ID NO: 349546 - DNA, 25 bp, Mus musculus
ccgagagtggcacaagacgaccaaa

SEQ ID NO: 349547 - DNA, 25 bp, Mus musculus
ccgagagtggcagaagacgaccaaa

SEQ ID NO: 349548 - DNA, 25 bp, Mus musculus
ccgagatccaccagcgctggaagga

SEQ ID NO: 349549 - DNA, 25 bp, Mus musculus
ccgagatccacctgcgctggaagga

SEQ ID NO: 349550 - DNA, 25 bp, Mus musculus
ccgagatcgtcgagcaggccacagt

SEQ ID NO: 349551 - DNA, 25 bp, Mus musculus
ccgagatcgtcgtgcaggccacagt

SEQ ID NO: 349552 - DNA, 25 bp, Mus musculus
ccgagatctgttaccgagtggcatg

SEQ ID NO: 349553 - DNA, 25 bp, Mus musculus
ccgagatctgtttccgagtggcatg

SEQ ID NO: 349554 - DNA, 25 bp, Mus musculus
ccgagatgcagtaggtgcccaaggt

SEQ ID NO: 349555 - DNA, 25 bp, Mus musculus
ccgagatgcagttggtgcccaaggt

SEQ ID NO: 349556 - DNA, 25 bp, Mus musculus
ccgagatgcggtagacggtcttcct

SEQ ID NO: 349557 - DNA, 25 bp, Mus musculus
ccgagatgcggttgacggtcttcct

SEQ ID NO: 349558 - DNA, 25 bp, Mus musculus
ccgagatggtgtcccttggaatttg

SEQ ID NO: 349559 - DNA, 25 bp, Mus musculus
ccgagatggtgtgccttggaatttg

SEQ ID NO: 349560 - DNA, 25 bp, Mus musculus
ccgagcagttatcggttttgttcta

SEQ ID NO: 349561 - DNA, 25 bp, Mus musculus
ccgagcagttatgggttttgttcta

SEQ ID NO: 349562 - DNA, 25 bp, Mus musculus
ccgagcatgcttcgcgtctggttaa

SEQ ID NO: 349563 - DNA, 25 bp, Mus musculus
ccgagcatgcttggcgtctggttaa

SEQ ID NO: 349564 - DNA, 25 bp, Mus musculus
ccgagcattagcaactgaaggacat

SEQ ID NO: 349565 - DNA, 25 bp, Mus musculus
ccgagcattagctactgaaggacat

SEQ ID NO: 349566 - DNA, 25 bp, Mus musculus
ccgagccaaggcaaggatttgtgtt

SEQ ID NO: 349567 - DNA, 25 bp, Mus musculus
ccgagccaaggctaggatttgtgtt

SEQ ID NO: 349568 - DNA, 25 bp, Mus musculus
ccgagcccagcccagagacagatgt

SEQ ID NO: 349569 - DNA, 25 bp, Mus musculus
ccgagcccagccgagagacagatgt

SEQ ID NO: 349570 - DNA, 25 bp, Mus musculus
ccgagcccaggtcgcgaacaaaggc

SEQ ID NO: 349571 - DNA, 25 bp, Mus musculus
ccgagcccaggtggcgaacaaaggc

SEQ ID NO: 349572 - DNA, 25 bp, Mus musculus
ccgagcccgactaccaagaagagga

SEQ ID NO: 349573 - DNA, 25 bp, Mus musculus
ccgagcccgacttccaagaagagga

SEQ ID NO: 349574 - DNA, 25 bp, Mus musculus
ccgagccgaggcctacttaatagag

SEQ ID NO: 349575 - DNA, 25 bp, Mus musculus
ccgagccgaggcgtacttaatagag

SEQ ID NO: 349576 - DNA, 25 bp, Mus musculus
ccgagccgcctgcataccgcagcta

SEQ ID NO: 349577 - DNA, 25 bp, Mus musculus
ccgagccgcctggataccgcagcta

SEQ ID NO: 349578 - DNA, 25 bp, Mus musculus
ccgagccgtgccaagtttccctgag

SEQ ID NO: 349579 - DNA, 25 bp, Mus musculus
ccgagccgtgcctagtttccctgag

SEQ ID NO: 349580 - DNA, 25 bp, Mus musculus
ccgagcgcccagaggatgctgactg

SEQ ID NO: 349581 - DNA, 25 bp, Mus musculus
ccgagcgcccagtggatgctgactg

SEQ ID NO: 349582 - DNA, 25 bp, Mus musculus
ccgagcgctctaacatatctagcat

SEQ ID NO: 349583 - DNA, 25 bp, Mus musculus
ccgagcgctctatcatatctagcat

SEQ ID NO: 349584 - DNA, 25 bp, Mus musculus
ccgagcgctgtaatggcacatctgg

SEQ ID NO: 349585 - DNA, 25 bp, Mus musculus
ccgagcgctgtattggcacatctgg

SEQ ID NO: 349586 - DNA, 25 bp, Mus musculus
ccgagcggcaggattcgccttttct

SEQ ID NO: 349587 - DNA, 25 bp, Mus musculus
ccgagcggcaggtttcgccttttct

SEQ ID NO: 349588 - DNA, 25 bp, Mus musculus
ccgagctgcacgacctggaaggaga

SEQ ID NO: 349589 - DNA, 25 bp, Mus musculus
ccgagctgcacgtcctggaaggaga

SEQ ID NO: 349590 - DNA, 25 bp, Mus musculus
ccgagcttcgttatgcagtttttaa

SEQ ID NO: 349591 - DNA, 25 bp, Mus musculus
ccgagcttcgttttgcagtttttaa

SEQ ID NO: 349592 - DNA, 25 bp, Mus musculus
ccgagcttgactacctcaggttgat

SEQ ID NO: 349593 - DNA, 25 bp, Mus musculus
ccgagcttgacttcctcaggttgat

SEQ ID NO: 349594 - DNA, 25 bp, Mus musculus
ccgaggaaattcatgtttgggcata

SEQ ID NO: 349595 - DNA, 25 bp, Mus musculus
ccgaggaaattcttgtttgggcata

SEQ ID NO: 349596 - DNA, 25 bp, Mus musculus
ccgaggaacacacacctcatgggtc

SEQ ID NO: 349597 - DNA, 25 bp, Mus musculus
ccgaggaacacagacctcatgggtc

SEQ ID NO: 349598 - DNA, 25 bp, Mus musculus
ccgaggaatgctcggtgtcaccttt

SEQ ID NO: 349599 - DNA, 25 bp, Mus musculus
ccgaggaatgctgggtgtcaccttt

SEQ ID NO: 349600 - DNA, 25 bp, Mus musculus
ccgaggacaatacgcagagtgacca

SEQ ID NO: 349601 - DNA, 25 bp, Mus musculus
ccgaggacaataggcagagtgacca

SEQ ID NO: 349602 - DNA, 25 bp, Mus musculus
ccgaggacagttatctaggagtcaa

SEQ ID NO: 349603 - DNA, 25 bp, Mus musculus
ccgaggacagttttctaggagtcaa

SEQ ID NO: 349604 - DNA, 25 bp, Mus musculus
ccgaggacctcgaagaacttgtatc

SEQ ID NO: 349605 - DNA, 25 bp, Mus musculus
ccgaggacctcgtagaacttgtatc

SEQ ID NO: 349606 - DNA, 25 bp, Mus musculus
ccgaggagcgccaggagaacctgcc

SEQ ID NO: 349607 - DNA, 25 bp, Mus musculus
ccgaggagcgcctggagaacctgcc

SEQ ID NO: 349608 - DNA, 25 bp, Mus musculus
ccgaggatacaaaatgggagacata

SEQ ID NO: 349609 - DNA, 25 bp, Mus musculus
ccgaggatacaatatgggagacata

SEQ ID NO: 349610 - DNA, 25 bp, Mus musculus
ccgaggcagcccactgggcactgga

SEQ ID NO: 349611 - DNA, 25 bp, Mus musculus
ccgaggcagccctctgggcactgga

SEQ ID NO: 349612 - DNA, 25 bp, Mus musculus
ccgaggcaggtaacttaaggagtct

SEQ ID NO: 349613 - DNA, 25 bp, Mus musculus
ccgaggcaggtatcttaaggagtct

SEQ ID NO: 349614 - DNA, 25 bp, Mus musculus
ccgaggccctgaaacgttttatatt

SEQ ID NO: 349615 - DNA, 25 bp, Mus musculus
ccgaggccctgatacgttttatatt

SEQ ID NO: 349616 - DNA, 25 bp, Mus musculus
ccgaggcggaggacaatcctccata

SEQ ID NO: 349617 - DNA, 25 bp, Mus musculus
ccgaggcggaggtcaatcctccata

SEQ ID NO: 349618 - DNA, 25 bp, Mus musculus
ccgaggctatccctgagctgaaagc

SEQ ID NO: 349619 - DNA, 25 bp, Mus musculus
ccgaggctatccgtgagctgaaagc

SEQ ID NO: 349620 - DNA, 25 bp, Mus musculus
ccgaggctcaagatgggaccaagta

SEQ ID NO: 349621 - DNA, 25 bp, Mus musculus
ccgaggctcaagttgggaccaagta

SEQ ID NO: 349622 - DNA, 25 bp, Mus musculus
ccgaggctcagccatcattgcagaa

SEQ ID NO: 349623 - DNA, 25 bp, Mus musculus
ccgaggctcagcgatcattgcagaa

SEQ ID NO: 349624 - DNA, 25 bp, Mus musculus
ccgaggctctgtcgcttgtgtagac

SEQ ID NO: 349625 - DNA, 25 bp, Mus musculus
ccgaggctctgtggcttgtgtagac

SEQ ID NO: 349626 - DNA, 25 bp, Mus musculus
ccgaggctggccatctgcacaggag

SEQ ID NO: 349627 - DNA, 25 bp, Mus musculus
ccgaggctggccttctgcacaggag

SEQ ID NO: 349628 - DNA, 25 bp, Mus musculus
ccgagggagcagatggcacagacat

SEQ ID NO: 349629 - DNA, 25 bp, Mus musculus
ccgagggagcagttggcacagacat

SEQ ID NO: 349630 - DNA, 25 bp, Mus musculus
ccgagggcaaagctgtctgggtaca

SEQ ID NO: 349631 - DNA, 25 bp, Mus musculus
ccgagggcaaaggtgtctgggtaca

SEQ ID NO: 349632 - DNA, 25 bp, Mus musculus
ccgagggctcacatcttaaagctta

SEQ ID NO: 349633 - DNA, 25 bp, Mus musculus
ccgagggctcacttcttaaagctta

SEQ ID NO: 349634 - DNA, 25 bp, Mus musculus
ccgagggcttggaggcatatagtac

SEQ ID NO: 349635 - DNA, 25 bp, Mus musculus
ccgagggcttggtggcatatagtac

SEQ ID NO: 349636 - DNA, 25 bp, Mus musculus
ccgagggttctacggacttgtccat

SEQ ID NO: 349637 - DNA, 25 bp, Mus musculus
ccgagggttctagggacttgtccat

SEQ ID NO: 349638 - DNA, 25 bp, Mus musculus
ccgaggtactggagctgcgcaacga

SEQ ID NO: 349639 - DNA, 25 bp, Mus musculus
ccgaggtactggtgctgcgcaacga

SEQ ID NO: 349640 - DNA, 25 bp, Mus musculus
ccgaggtccagtagcaagtctgttt

SEQ ID NO: 349641 - DNA, 25 bp, Mus musculus
ccgaggtccagttgcaagtctgttt

SEQ ID NO: 349642 - DNA, 25 bp, Mus musculus
ccgaggttgatacgaccacaggccg

SEQ ID NO: 349643 - DNA, 25 bp, Mus musculus
ccgaggttgataggaccacaggccg

SEQ ID NO: 349644 - DNA, 25 bp, Mus musculus
ccgaggtttctcattaaatggagag

SEQ ID NO: 349645 - DNA, 25 bp, Mus musculus
ccgaggtttctctttaaatggagag

SEQ ID NO: 349646 - DNA, 25 bp, Mus musculus
ccgagtagaaatcctgaccatgcca

SEQ ID NO: 349647 - DNA, 25 bp, Mus musculus
ccgagtagaaatgctgaccatgcca

SEQ ID NO: 349648 - DNA, 25 bp, Mus musculus
ccgagtcaccgtcctgattcgggaa

SEQ ID NO: 349649 - DNA, 25 bp, Mus musculus
ccgagtcaccgtgctgattcgggaa

SEQ ID NO: 349650 - DNA, 25 bp, Mus musculus
ccgagtcataagactaatcctagta

SEQ ID NO: 349651 - DNA, 25 bp, Mus musculus
ccgagtcataagtctaatcctagta

SEQ ID NO: 349652 - DNA, 25 bp, Mus musculus
ccgagtcgttccatccaggaggaaa

SEQ ID NO: 349653 - DNA, 25 bp, Mus musculus
ccgagtcgttccttccaggaggaaa

SEQ ID NO: 349654 - DNA, 25 bp, Mus musculus
ccgagtctggttcaactttactgtt

SEQ ID NO: 349655 - DNA, 25 bp, Mus musculus
ccgagtctggttgaactttactgtt

SEQ ID NO: 349656 - DNA, 25 bp, Mus musculus
ccgagtcttggcagatgggattctt

SEQ ID NO: 349657 - DNA, 25 bp, Mus musculus
ccgagtcttggctgatgggattctt

SEQ ID NO: 349658 - DNA, 25 bp, Mus musculus
ccgagtgaccccattgttggcagac

SEQ ID NO: 349659 - DNA, 25 bp, Mus musculus
ccgagtgacccctttgttggcagac

SEQ ID NO: 349660 - DNA, 25 bp, Mus musculus
ccgagtgacctaccgcgggattagt

SEQ ID NO: 349661 - DNA, 25 bp, Mus musculus
ccgagtgacctagcgcgggattagt

SEQ ID NO: 349662 - DNA, 25 bp, Mus musculus
ccgagtgactggactgtgtgagatt

SEQ ID NO: 349663 - DNA, 25 bp, Mus musculus
ccgagtgactggtctgtgtgagatt

SEQ ID NO: 349664 - DNA, 25 bp, Mus musculus
ccgagtgaggaaatgacactgctca

SEQ ID NO: 349665 - DNA, 25 bp, Mus musculus
ccgagtgaggaattgacactgctca

SEQ ID NO: 349666 - DNA, 25 bp, Mus musculus
ccgagtgcctgtatgatgtggacga

SEQ ID NO: 349667 - DNA, 25 bp, Mus musculus
ccgagtgcctgtttgatgtggacga

SEQ ID NO: 349668 - DNA, 25 bp, Mus musculus
ccgagtgcgggcagcgcttcagcca

SEQ ID NO: 349669 - DNA, 25 bp, Mus musculus
ccgagtgcgggctgcgcttcagcca

SEQ ID NO: 349670 - DNA, 25 bp, Mus musculus
ccgagtgctgggacaattttctttt

SEQ ID NO: 349671 - DNA, 25 bp, Mus musculus
ccgagtgctgggtcaattttctttt

SEQ ID NO: 349672 - DNA, 25 bp, Mus musculus
ccgagtgcttgcacgcgattgctag

SEQ ID NO: 349673 - DNA, 25 bp, Mus musculus
ccgagtgcttgctcgcgattgctag

SEQ ID NO: 349674 - DNA, 25 bp, Mus musculus
ccgagtgctttcctttgacgagaag

SEQ ID NO: 349675 - DNA, 25 bp, Mus musculus
ccgagtgctttcgtttgacgagaag

SEQ ID NO: 349676 - DNA, 25 bp, Mus musculus
ccgagtggaccaacagggagtttaa

SEQ ID NO: 349677 - DNA, 25 bp, Mus musculus
ccgagtggaccatcagggagtttaa

SEQ ID NO: 349678 - DNA, 25 bp, Mus musculus
ccgagtggcctgatgagtgttgcaa

SEQ ID NO: 349679 - DNA, 25 bp, Mus musculus
ccgagtggcctgttgagtgttgcaa

SEQ ID NO: 349680 - DNA, 25 bp, Mus musculus
ccgagtggtgacatgctaccagaga

SEQ ID NO: 349681 - DNA, 25 bp, Mus musculus
ccgagtggtgacttgctaccagaga

SEQ ID NO: 349682 - DNA, 25 bp, Mus musculus
ccgagtgtgactctggacccttgaa

SEQ ID NO: 349683 - DNA, 25 bp, Mus musculus
ccgagtgtgactgtggacccttgaa

SEQ ID NO: 349684 - DNA, 25 bp, Mus musculus
ccgagttacctcatcaagcagggct

SEQ ID NO: 349685 - DNA, 25 bp, Mus musculus
ccgagttacctcttcaagcagggct

SEQ ID NO: 349686 - DNA, 25 bp, Mus musculus
ccgagttactgtcttccctcataaa

SEQ ID NO: 349687 - DNA, 25 bp, Mus musculus
ccgagttactgtgttccctcataaa

SEQ ID NO: 349688 - DNA, 25 bp, Mus musculus
ccgagttatctgagtgcttggctac

SEQ ID NO: 349689 - DNA, 25 bp, Mus musculus
ccgagttatctgtgtgcttggctac

SEQ ID NO: 349690 - DNA, 25 bp, Mus musculus
ccgagttcagaaaacgtgccagagg

SEQ ID NO: 349691 - DNA, 25 bp, Mus musculus
ccgagttcagaatacgtgccagagg

SEQ ID NO: 349692 - DNA, 25 bp, Mus musculus
ccgagttcgctgaggctaatgacac

SEQ ID NO: 349693 - DNA, 25 bp, Mus musculus
ccgagttcgctgtggctaatgacac

SEQ ID NO: 349694 - DNA, 25 bp, Mus musculus
ccgagttctcggcaccaaagagatt

SEQ ID NO: 349695 - DNA, 25 bp, Mus musculus
ccgagttctcgggaccaaagagatt

SEQ ID NO: 349696 - DNA, 25 bp, Mus musculus
ccgagttcttacaggagttgtggct

SEQ ID NO: 349697 - DNA, 25 bp, Mus musculus
ccgagttcttactggagttgtggct

SEQ ID NO: 349698 - DNA, 25 bp, Mus musculus
ccgagttggtgaactggtgattgtg

SEQ ID NO: 349699 - DNA, 25 bp, Mus musculus
ccgagttggtgatctggtgattgtg

SEQ ID NO: 349700 - DNA, 25 bp, Mus musculus
ccgagtttcgtgattgaattagcca

SEQ ID NO: 349701 - DNA, 25 bp, Mus musculus
ccgagtttcgtgtttgaattagcca

SEQ ID NO: 349702 - DNA, 25 bp, Mus musculus
ccgagtttgctaaattcttcctgct

SEQ ID NO: 349703 - DNA, 25 bp, Mus musculus
ccgagtttgctatattcttcctgct

SEQ ID NO: 349704 - DNA, 25 bp, Mus musculus
ccgagtttgtgcacagcggcgcgtt

SEQ ID NO: 349705 - DNA, 25 bp, Mus musculus
ccgagtttgtgctcagcggcgcgtt

SEQ ID NO: 349706 - DNA, 25 bp, Mus musculus
ccgataaagcgtcggcggtcctgca

SEQ ID NO: 349707 - DNA, 25 bp, Mus musculus
ccgataaagcgtgggcggtcctgca

SEQ ID NO: 349708 - DNA, 25 bp, Mus musculus
ccgataagccttatgaggacgtcag

SEQ ID NO: 349709 - DNA, 25 bp, Mus musculus
ccgataagccttttgaggacgtcag

SEQ ID NO: 349710 - DNA, 25 bp, Mus musculus
ccgataccagaaatcctaccgataa

SEQ ID NO: 349711 - DNA, 25 bp, Mus musculus
ccgataccagaattcctaccgataa

SEQ ID NO: 349712 - DNA, 25 bp, Mus musculus
ccgataccgggtcgagggcagcttt

SEQ ID NO: 349713 - DNA, 25 bp, Mus musculus
ccgataccgggtggagggcagcttt

SEQ ID NO: 349714 - DNA, 25 bp, Mus musculus
ccgatatattgtagtaggttgaaat

SEQ ID NO: 349715 - DNA, 25 bp, Mus musculus
ccgatatattgttgtaggttgaaat

SEQ ID NO: 349716 - DNA, 25 bp, Mus musculus
ccgatatccttcctagttggcaagt

SEQ ID NO: 349717 - DNA, 25 bp, Mus musculus
ccgatatccttcgtagttggcaagt

SEQ ID NO: 349718 - DNA, 25 bp, Mus musculus
ccgatatgtgttagacaccccatcc

SEQ ID NO: 349719 - DNA, 25 bp, Mus musculus
ccgatatgtgtttgacaccccatcc

SEQ ID NO: 349720 - DNA, 25 bp, Mus musculus
ccgatcagacgcctgaccagtatgt

SEQ ID NO: 349721 - DNA, 25 bp, Mus musculus
ccgatcagacgcgtgaccagtatgt

SEQ ID NO: 349722 - DNA, 25 bp, Mus musculus
ccgatcgatgagctctaggctcagt

SEQ ID NO: 349723 - DNA, 25 bp, Mus musculus
ccgatcgatgaggtctaggctcagt

SEQ ID NO: 349724 - DNA, 25 bp, Mus musculus
ccgatcgcaccacatcaatgatggg

SEQ ID NO: 349725 - DNA, 25 bp, Mus musculus
ccgatcgcaccagatcaatgatggg

SEQ ID NO: 349726 - DNA, 25 bp, Mus musculus
ccgatcgtcgggaagctttctgaaa

SEQ ID NO: 349727 - DNA, 25 bp, Mus musculus
ccgatcgtcgggtagctttctgaaa

SEQ ID NO: 349728 - DNA, 25 bp, Mus musculus
ccgatctggcctcgaatacgatgga

SEQ ID NO: 349729 - DNA, 25 bp, Mus musculus
ccgatctggcctggaatacgatgga

SEQ ID NO: 349730 - DNA, 25 bp, Mus musculus
ccgatcttctttcggaggcactgga

SEQ ID NO: 349731 - DNA, 25 bp, Mus musculus
ccgatcttctttgggaggcactgga

SEQ ID NO: 349732 - DNA, 25 bp, Mus musculus
ccgatgacagaaacgtgcttttact

SEQ ID NO: 349733 - DNA, 25 bp, Mus musculus
ccgatgacagaatcgtgcttttact

SEQ ID NO: 349734 - DNA, 25 bp, Mus musculus
ccgatgacttcgactgggacttgat

SEQ ID NO: 349735 - DNA, 25 bp, Mus musculus
ccgatgacttcgtctgggacttgat

SEQ ID NO: 349736 - DNA, 25 bp, Mus musculus
ccgatgagaaccagagtgtgagagt

SEQ ID NO: 349737 - DNA, 25 bp, Mus musculus
ccgatgagaacctgagtgtgagagt

SEQ ID NO: 349738 - DNA, 25 bp, Mus musculus
ccgatgagtttgagatttcttctaa

SEQ ID NO: 349739 - DNA, 25 bp, Mus musculus
ccgatgagtttgtgatttcttctaa

SEQ ID NO: 349740 - DNA, 25 bp, Mus musculus
ccgatgcagaagacccagtctgtat

SEQ ID NO: 349741 - DNA, 25 bp, Mus musculus
ccgatgcagaagtcccagtctgtat

SEQ ID NO: 349742 - DNA, 25 bp, Mus musculus
ccgatgcagcccagtctcaattttt

SEQ ID NO: 349743 - DNA, 25 bp, Mus musculus
ccgatgcagccctgtctcaattttt

SEQ ID NO: 349744 - DNA, 25 bp, Mus musculus
ccgatgcccagccaacaggatagtg

SEQ ID NO: 349745 - DNA, 25 bp, Mus musculus
ccgatgcccagcgaacaggatagtg

SEQ ID NO: 349746 - DNA, 25 bp, Mus musculus
ccgatgcccctcaatgacaatgaga

SEQ ID NO: 349747 - DNA, 25 bp, Mus musculus
ccgatgcccctctatgacaatgaga

SEQ ID NO: 349748 - DNA, 25 bp, Mus musculus
ccgatgcgccttcaaaacagtgtca

SEQ ID NO: 349749 - DNA, 25 bp, Mus musculus
ccgatgcgccttgaaaacagtgtca

SEQ ID NO: 349750 - DNA, 25 bp, Mus musculus
ccgatgctatggacgggctctccga

SEQ ID NO: 349751 - DNA, 25 bp, Mus musculus
ccgatgctatggtcgggctctccga

SEQ ID NO: 349752 - DNA, 25 bp, Mus musculus
ccgatgctggagctctaaaaagttc

SEQ ID NO: 349753 - DNA, 25 bp, Mus musculus
ccgatgctggaggtctaaaaagttc

SEQ ID NO: 349754 - DNA, 25 bp, Mus musculus
ccgatggagctcacgatggaaccaa

SEQ ID NO: 349755 - DNA, 25 bp, Mus musculus
ccgatggagctctcgatggaaccaa

SEQ ID NO: 349756 - DNA, 25 bp, Mus musculus
ccgatgggtcatctacaccaccgag

SEQ ID NO: 349757 - DNA, 25 bp, Mus musculus
ccgatgggtcatgtacaccaccgag

SEQ ID NO: 349758 - DNA, 25 bp, Mus musculus
ccgatggtaggtacagcttctggga

SEQ ID NO: 349759 - DNA, 25 bp, Mus musculus
ccgatggtaggttcagcttctggga

SEQ ID NO: 349760 - DNA, 25 bp, Mus musculus
ccgatgtaatgtcgttttgctgggt

SEQ ID NO: 349761 - DNA, 25 bp, Mus musculus
ccgatgtaatgtggttttgctgggt

SEQ ID NO: 349762 - DNA, 25 bp, Mus musculus
ccgatgtaggatctagcagttgaca

SEQ ID NO: 349763 - DNA, 25 bp, Mus musculus
ccgatgtaggatgtagcagttgaca

SEQ ID NO: 349764 - DNA, 25 bp, Mus musculus
ccgatgtattttccacacccatatt

SEQ ID NO: 349765 - DNA, 25 bp, Mus musculus
ccgatgtattttgcacacccatatt

SEQ ID NO: 349766 - DNA, 25 bp, Mus musculus
ccgatgttggttaccccagcaagga

SEQ ID NO: 349767 - DNA, 25 bp, Mus musculus
ccgatgttggtttccccagcaagga

SEQ ID NO: 349768 - DNA, 25 bp, Mus musculus
ccgattcatcaaccactcatgtgag

SEQ ID NO: 349769 - DNA, 25 bp, Mus musculus
ccgattcatcaagcactcatgtgag

SEQ ID NO: 349770 - DNA, 25 bp, Mus musculus
ccgattccgcccaatttatgtttct

SEQ ID NO: 349771 - DNA, 25 bp, Mus musculus
ccgattccgccctatttatgtttct

SEQ ID NO: 349772 - DNA, 25 bp, Mus musculus
ccgattccggatacaggcattttgt

SEQ ID NO: 349773 - DNA, 25 bp, Mus musculus
ccgattccggattcaggcattttgt

SEQ ID NO: 349774 - DNA, 25 bp, Mus musculus
ccgattcgagcacctgggcaagacg

SEQ ID NO: 349775 - DNA, 25 bp, Mus musculus
ccgattcgagcagctgggcaagacg

SEQ ID NO: 349776 - DNA, 25 bp, Mus musculus
ccgattcgccagagccttgggaaga

SEQ ID NO: 349777 - DNA, 25 bp, Mus musculus
ccgattcgccagtgccttgggaaga

SEQ ID NO: 349778 - DNA, 25 bp, Mus musculus
ccgattctcaaaacccacatgttgg

SEQ ID NO: 349779 - DNA, 25 bp, Mus musculus
ccgattctcaaatcccacatgttgg

SEQ ID NO: 349780 - DNA, 25 bp, Mus musculus
ccgattgcctctctggagctgtagg

SEQ ID NO: 349781 - DNA, 25 bp, Mus musculus
ccgattgcctctgtggagctgtagg

SEQ ID NO: 349782 - DNA, 25 bp, Mus musculus
ccgattggctaacgctgatggaatt

SEQ ID NO: 349783 - DNA, 25 bp, Mus musculus
ccgattggctaaggctgatggaatt

SEQ ID NO: 349784 - DNA, 25 bp, Mus musculus
ccgattggctctcaactgtgttggt

SEQ ID NO: 349785 - DNA, 25 bp, Mus musculus
ccgattggctctgaactgtgttggt

SEQ ID NO: 349786 - DNA, 25 bp, Mus musculus
ccgatttccctgctgagttctcagc

SEQ ID NO: 349787 - DNA, 25 bp, Mus musculus
ccgatttccctggtgagttctcagc

SEQ ID NO: 349788 - DNA, 25 bp, Mus musculus
ccgatttcttaaagtgtggtttact

SEQ ID NO: 349789 - DNA, 25 bp, Mus musculus
ccgatttcttaatgtgtggtttact

SEQ ID NO: 349790 - DNA, 25 bp, Mus musculus
ccgatttctttgatccagcttcaat

SEQ ID NO: 349791 - DNA, 25 bp, Mus musculus
ccgatttctttgttccagcttcaat

SEQ ID NO: 349792 - DNA, 25 bp, Mus musculus
ccgattttacttaagaggtggagat

SEQ ID NO: 349793 - DNA, 25 bp, Mus musculus
ccgattttactttagaggtggagat

SEQ ID NO: 349794 - DNA, 25 bp, Mus musculus
ccgattttcctacaactcccatatt

SEQ ID NO: 349795 - DNA, 25 bp, Mus musculus
ccgattttcctagaactcccatatt

SEQ ID NO: 349796 - DNA, 25 bp, Mus musculus
ccgattttcctgaaggaagatgatt

SEQ ID NO: 349797 - DNA, 25 bp, Mus musculus
ccgattttcctgtaggaagatgatt

SEQ ID NO: 349798 - DNA, 25 bp, Mus musculus
ccgcaaaacttgaatgaatctgatt

SEQ ID NO: 349799 - DNA, 25 bp, Mus musculus
ccgcaaaacttgtatgaatctgatt

SEQ ID NO: 349800 - DNA, 25 bp, Mus musculus
ccgcaaacaaccctgagaagaactg

SEQ ID NO: 349801 - DNA, 25 bp, Mus musculus
ccgcaaacaaccgtgagaagaactg

SEQ ID NO: 349802 - DNA, 25 bp, Mus musculus
ccgcaaacggttcctcttgatgaag

SEQ ID NO: 349803 - DNA, 25 bp, Mus musculus
ccgcaaacggttgctcttgatgaag

SEQ ID NO: 349804 - DNA, 25 bp, Mus musculus
ccgcaacatggccttcagtttatga

SEQ ID NO: 349805 - DNA, 25 bp, Mus musculus
ccgcaacatggcgttcagtttatga

SEQ ID NO: 349806 - DNA, 25 bp, Mus musculus
ccgcaagaatgtcctccggctgcag

SEQ ID NO: 349807 - DNA, 25 bp, Mus musculus
ccgcaagaatgtgctccggctgcag

SEQ ID NO: 349808 - DNA, 25 bp, Mus musculus
ccgcaagccctgatgatctaggttt

SEQ ID NO: 349809 - DNA, 25 bp, Mus musculus
ccgcaagccctgttgatctaggttt

SEQ ID NO: 349810 - DNA, 25 bp, Mus musculus
ccgcaaggagagctactcggtgtac

SEQ ID NO: 349811 - DNA, 25 bp, Mus musculus
ccgcaaggagaggtactcggtgtac

SEQ ID NO: 349812 - DNA, 25 bp, Mus musculus
ccgcaaggcgtacccatctgttact

SEQ ID NO: 349813 - DNA, 25 bp, Mus musculus
ccgcaaggcgtagccatctgttact

SEQ ID NO: 349814 - DNA, 25 bp, Mus musculus
ccgcaagtgctaacttacctgtgtc

SEQ ID NO: 349815 - DNA, 25 bp, Mus musculus
ccgcaagtgctaccgcatggttgga

SEQ ID NO: 349816 - DNA, 25 bp, Mus musculus
ccgcaagtgctagcgcatggttgga

SEQ ID NO: 349817 - DNA, 25 bp, Mus musculus
ccgcaagtgctatcttacctgtgtc

SEQ ID NO: 349818 - DNA, 25 bp, Mus musculus
ccgcaagttcggctttgctgacttt

SEQ ID NO: 349819 - DNA, 25 bp, Mus musculus
ccgcaagttcgggtttgctgacttt

SEQ ID NO: 349820 - DNA, 25 bp, Mus musculus
ccgcaagttgtgctggtgcagtttt

SEQ ID NO: 349821 - DNA, 25 bp, Mus musculus
ccgcaagttgtggtggtgcagtttt

SEQ ID NO: 349822 - DNA, 25 bp, Mus musculus
ccgcaatcggcaattcaacattttt

SEQ ID NO: 349823 - DNA, 25 bp, Mus musculus
ccgcaatcggcatttcaacattttt

SEQ ID NO: 349824 - DNA, 25 bp, Mus musculus
ccgcacacagacaaaggaaatggtt

SEQ ID NO: 349825 - DNA, 25 bp, Mus musculus
ccgcacacagactaaggaaatggtt

SEQ ID NO: 349826 - DNA, 25 bp, Mus musculus
ccgcacacctgactgatgttgagtt

SEQ ID NO: 349827 - DNA, 25 bp, Mus musculus
ccgcacacctgagtgatgttgagtt

SEQ ID NO: 349828 - DNA, 25 bp, Mus musculus
ccgcacagtggcagtctactcggag

SEQ ID NO: 349829 - DNA, 25 bp, Mus musculus
ccgcacagtggctgtctactcggag

SEQ ID NO: 349830 - DNA, 25 bp, Mus musculus
ccgcaccattcccgagtgtatagat

SEQ ID NO: 349831 - DNA, 25 bp, Mus musculus
ccgcaccattccggagtgtatagat

SEQ ID NO: 349832 - DNA, 25 bp, Mus musculus
ccgcaccgcgagcaaagtcaggcag

SEQ ID NO: 349833 - DNA, 25 bp, Mus musculus
ccgcaccgcgaggaaagtcaggcag

SEQ ID NO: 349834 - DNA, 25 bp, Mus musculus
ccgcacgctggtcatgtttctaaga

SEQ ID NO: 349835 - DNA, 25 bp, Mus musculus
ccgcacgctggtgatgtttctaaga

SEQ ID NO: 349836 - DNA, 25 bp, Mus musculus
ccgcactctgggatcaacgtaattg

SEQ ID NO: 349837 - DNA, 25 bp, Mus musculus
ccgcactctgggttcaacgtaattg

SEQ ID NO: 349838 - DNA, 25 bp, Mus musculus
ccgcactcttccattcaggatatag

SEQ ID NO: 349839 - DNA, 25 bp, Mus musculus
ccgcactcttcctttcaggatatag

SEQ ID NO: 349840 - DNA, 25 bp, Mus musculus
ccgcacttttgaattctacaagaga

SEQ ID NO: 349841 - DNA, 25 bp, Mus musculus
ccgcacttttgatttctacaagaga

SEQ ID NO: 349842 - DNA, 25 bp, Mus musculus
ccgcagaagcttatccgtaaggtgt

SEQ ID NO: 349843 - DNA, 25 bp, Mus musculus
ccgcagaagcttttccgtaaggtgt

SEQ ID NO: 349844 - DNA, 25 bp, Mus musculus
ccgcagaaggtacaaagagatcatt

SEQ ID NO: 349845 - DNA, 25 bp, Mus musculus
ccgcagaaggtagaaagagatcatt

SEQ ID NO: 349846 - DNA, 25 bp, Mus musculus
ccgcagaataatcttgaggtatgtg

SEQ ID NO: 349847 - DNA, 25 bp, Mus musculus
ccgcagaataatgttgaggtatgtg

SEQ ID NO: 349848 - DNA, 25 bp, Mus musculus
ccgcagactaacaggagacataatt

SEQ ID NO: 349849 - DNA, 25 bp, Mus musculus
ccgcagactaactggagacataatt

SEQ ID NO: 349850 - DNA, 25 bp, Mus musculus
ccgcagaggcggagcgcagtcaacc

SEQ ID NO: 349851 - DNA, 25 bp, Mus musculus
ccgcagaggcggtgcgcagtcaacc

SEQ ID NO: 349852 - DNA, 25 bp, Mus musculus
ccgcagatgattaggagcacactat

SEQ ID NO: 349853 - DNA, 25 bp, Mus musculus
ccgcagatgatttggagcacactat

SEQ ID NO: 349854 - DNA, 25 bp, Mus musculus
ccgcagatgcgacagattcgggttt

SEQ ID NO: 349855 - DNA, 25 bp, Mus musculus
ccgcagatgcgagagattcgggttt

SEQ ID NO: 349856 - DNA, 25 bp, Mus musculus
ccgcagcaagcgagacagaaagaat

SEQ ID NO: 349857 - DNA, 25 bp, Mus musculus
ccgcagcaagcgtgacagaaagaat

SEQ ID NO: 349858 - DNA, 25 bp, Mus musculus
ccgcagcagcgcagaattcagtggc

SEQ ID NO: 349859 - DNA, 25 bp, Mus musculus
ccgcagcagcgctgaattcagtggc

SEQ ID NO: 349860 - DNA, 25 bp, Mus musculus
ccgcagcagtacatattaaccaacg

SEQ ID NO: 349861 - DNA, 25 bp, Mus musculus
ccgcagcagtacttattaaccaacg

SEQ ID NO: 349862 - DNA, 25 bp, Mus musculus
ccgcagctcgctactttcttctgtt

SEQ ID NO: 349863 - DNA, 25 bp, Mus musculus
ccgcagctcgcttctttcttctgtt

SEQ ID NO: 349864 - DNA, 25 bp, Mus musculus
ccgcaggaggccaatactctggatg

SEQ ID NO: 349865 - DNA, 25 bp, Mus musculus
ccgcaggaggcctatactctggatg

SEQ ID NO: 349866 - DNA, 25 bp, Mus musculus
ccgcaggcatctagacatcttagta

SEQ ID NO: 349867 - DNA, 25 bp, Mus musculus
ccgcaggcatcttgacatcttagta

SEQ ID NO: 349868 - DNA, 25 bp, Mus musculus
ccgcaggctttcatcatggctgaaa

SEQ ID NO: 349869 - DNA, 25 bp, Mus musculus
ccgcaggctttcttcatggctgaaa

SEQ ID NO: 349870 - DNA, 25 bp, Mus musculus
ccgcagggaagcagcagtaccagga

SEQ ID NO: 349871 - DNA, 25 bp, Mus musculus
ccgcagggaagctgcagtaccagga

SEQ ID NO: 349872 - DNA, 25 bp, Mus musculus
ccgcagggctgtcttgtgcaagaca

SEQ ID NO: 349873 - DNA, 25 bp, Mus musculus
ccgcagggctgtgttgtgcaagaca

SEQ ID NO: 349874 - DNA, 25 bp, Mus musculus
ccgcaggtctgaacgggtcaagaca

SEQ ID NO: 349875 - DNA, 25 bp, Mus musculus
ccgcaggtctgatcgggtcaagaca

SEQ ID NO: 349876 - DNA, 25 bp, Mus musculus
ccgcaggtgggcctatcttgcaaat

SEQ ID NO: 349877 - DNA, 25 bp, Mus musculus
ccgcaggtgggcgtatcttgcaaat

SEQ ID NO: 349878 - DNA, 25 bp, Mus musculus
ccgcagtaaagtctgcttaattgta

SEQ ID NO: 349879 - DNA, 25 bp, Mus musculus
ccgcagtaaagtgtgcttaattgta

SEQ ID NO: 349880 - DNA, 25 bp, Mus musculus
ccgcagtgccagagtttatgttcta

SEQ ID NO: 349881 - DNA, 25 bp, Mus musculus
ccgcagtgccagtgtttatgttcta

SEQ ID NO: 349882 - DNA, 25 bp, Mus musculus
ccgcagtgccctcgtagacttagaa

SEQ ID NO: 349883 - DNA, 25 bp, Mus musculus
ccgcagtgccctggtagacttagaa

SEQ ID NO: 349884 - DNA, 25 bp, Mus musculus
ccgcagtgctttatacaccacagac

SEQ ID NO: 349885 - DNA, 25 bp, Mus musculus
ccgcagtgctttttacaccacagac

SEQ ID NO: 349886 - DNA, 25 bp, Mus musculus
ccgcagttgaggaggtaggtaacca

SEQ ID NO: 349887 - DNA, 25 bp, Mus musculus
ccgcagttgaggtggtaggtaacca

SEQ ID NO: 349888 - DNA, 25 bp, Mus musculus
ccgcatcagcgtacgcagggttaaa

SEQ ID NO: 349889 - DNA, 25 bp, Mus musculus
ccgcatcagcgttcgcagggttaaa

SEQ ID NO: 349890 - DNA, 25 bp, Mus musculus
ccgcatccgcgaaggcttttaatag

SEQ ID NO: 349891 - DNA, 25 bp, Mus musculus
ccgcatccgcgatggcttttaatag

SEQ ID NO: 349892 - DNA, 25 bp, Mus musculus
ccgcatccgctacatgggcgaaaga

SEQ ID NO: 349893 - DNA, 25 bp, Mus musculus
ccgcatccgctagatgggcgaaaga

SEQ ID NO: 349894 - DNA, 25 bp, Mus musculus
ccgcatccttggaataaattctaat

SEQ ID NO: 349895 - DNA, 25 bp, Mus musculus
ccgcatccttggtataaattctaat

SEQ ID NO: 349896 - DNA, 25 bp, Mus musculus
ccgcatcttgtaagggaagcagctt

SEQ ID NO: 349897 - DNA, 25 bp, Mus musculus
ccgcatcttgtatgggaagcagctt

SEQ ID NO: 349898 - DNA, 25 bp, Mus musculus
ccgcatctttggcaggaaaccttct

SEQ ID NO: 349899 - DNA, 25 bp, Mus musculus
ccgcatctttgggaggaaaccttct

SEQ ID NO: 349900 - DNA, 25 bp, Mus musculus
ccgcatcttttcatttgacggcaga

SEQ ID NO: 349901 - DNA, 25 bp, Mus musculus
ccgcatcttttcttttgacggcaga

SEQ ID NO: 349902 - DNA, 25 bp, Mus musculus
ccgcatgcacgtcgtgagcgatgtt

SEQ ID NO: 349903 - DNA, 25 bp, Mus musculus
ccgcatgcacgtggtgagcgatgtt

SEQ ID NO: 349904 - DNA, 25 bp, Mus musculus
ccgcatgcatccacgggatctgata

SEQ ID NO: 349905 - DNA, 25 bp, Mus musculus
ccgcatgcatcctcgggatctgata

SEQ ID NO: 349906 - DNA, 25 bp, Mus musculus
ccgcatgcattaaccttgacttgag

SEQ ID NO: 349907 - DNA, 25 bp, Mus musculus
ccgcatgcattatccttgacttgag

SEQ ID NO: 349908 - DNA, 25 bp, Mus musculus
ccgcatgcctgtaggagatttcttt

SEQ ID NO: 349909 - DNA, 25 bp, Mus musculus
ccgcatgcctgttggagatttcttt

SEQ ID NO: 349910 - DNA, 25 bp, Mus musculus
ccgcatgctgctaggctaaaaaagt

SEQ ID NO: 349911 - DNA, 25 bp, Mus musculus
ccgcatgctgcttggctaaaaaagt

SEQ ID NO: 349912 - DNA, 25 bp, Mus musculus
ccgcattccaacatctctgattggt

SEQ ID NO: 349913 - DNA, 25 bp, Mus musculus
ccgcattccaacttctctgattggt

SEQ ID NO: 349914 - DNA, 25 bp, Mus musculus
ccgcattctttacgaggattcaggg

SEQ ID NO: 349915 - DNA, 25 bp, Mus musculus
ccgcattctttaggaggattcaggg

SEQ ID NO: 349916 - DNA, 25 bp, Mus musculus
ccgcattgaaggaccaggccagggt

SEQ ID NO: 349917 - DNA, 25 bp, Mus musculus
ccgcattgaaggtccaggccagggt

SEQ ID NO: 349918 - DNA, 25 bp, Mus musculus
ccgcattggatcatggtgtttgaga

SEQ ID NO: 349919 - DNA, 25 bp, Mus musculus
ccgcattggatcttggtgtttgaga

SEQ ID NO: 349920 - DNA, 25 bp, Mus musculus
ccgcattggcagagggttcccagca

SEQ ID NO: 349921 - DNA, 25 bp, Mus musculus
ccgcattggcagtgggttcccagca

SEQ ID NO: 349922 - DNA, 25 bp, Mus musculus
ccgccaacagcaacttcgtgaactt

SEQ ID NO: 349923 - DNA, 25 bp, Mus musculus
ccgccaacagcatcttcgtgaactt

SEQ ID NO: 349924 - DNA, 25 bp, Mus musculus
ccgccaaccttacaaaggaactgtg

SEQ ID NO: 349925 - DNA, 25 bp, Mus musculus
ccgccaaccttagaaaggaactgtg

SEQ ID NO: 349926 - DNA, 25 bp, Mus musculus
ccgccacagttgctgtggctggatc

SEQ ID NO: 349927 - DNA, 25 bp, Mus musculus
ccgccacagttggtgtggctggatc

SEQ ID NO: 349928 - DNA, 25 bp, Mus musculus
ccgccagagcctacatgtccagaga

SEQ ID NO: 349929 - DNA, 25 bp, Mus musculus
ccgccagagccttcatgtccagaga

SEQ ID NO: 349930 - DNA, 25 bp, Mus musculus
ccgccagcacacatcggtgtttgga

SEQ ID NO: 349931 - DNA, 25 bp, Mus musculus
ccgccagcacacttcggtgtttgga

SEQ ID NO: 349932 - DNA, 25 bp, Mus musculus
ccgccagcgggaacttcattgcagg

SEQ ID NO: 349933 - DNA, 25 bp, Mus musculus
ccgccagcgggatcttcattgcagg

SEQ ID NO: 349934 - DNA, 25 bp, Mus musculus
ccgccaggaccaagagggagttagt

SEQ ID NO: 349935 - DNA, 25 bp, Mus musculus
ccgccaggaccatgagggagttagt

SEQ ID NO: 349936 - DNA, 25 bp, Mus musculus
ccgccaggctgtcatcacaaaggag

SEQ ID NO: 349937 - DNA, 25 bp, Mus musculus
ccgccaggctgtgatcacaaaggag

SEQ ID NO: 349938 - DNA, 25 bp, Mus musculus
ccgccagtacggagaccacttggag

SEQ ID NO: 349939 - DNA, 25 bp, Mus musculus
ccgccagtacggtgaccacttggag

SEQ ID NO: 349940 - DNA, 25 bp, Mus musculus
ccgccattaccgagaacaccagaag

SEQ ID NO: 349941 - DNA, 25 bp, Mus musculus
ccgccattaccgtgaacaccagaag

SEQ ID NO: 349942 - DNA, 25 bp, Mus musculus
ccgcccaatgacagaagacaacctg

SEQ ID NO: 349943 - DNA, 25 bp, Mus musculus
ccgcccaatgactgaagacaacctg

SEQ ID NO: 349944 - DNA, 25 bp, Mus musculus
ccgcccacgttacatttacacgtat

SEQ ID NO: 349945 - DNA, 25 bp, Mus musculus
ccgcccacgttagatttacacgtat

SEQ ID NO: 349946 - DNA, 25 bp, Mus musculus
ccgcccagaagacagtccgggtcga

SEQ ID NO: 349947 - DNA, 25 bp, Mus musculus
ccgcccagaagagagtccgggtcga

SEQ ID NO: 349948 - DNA, 25 bp, Mus musculus
ccgcccatgtctaaccagggtctta

SEQ ID NO: 349949 - DNA, 25 bp, Mus musculus
ccgcccatgtcttaccagggtctta

SEQ ID NO: 349950 - DNA, 25 bp, Mus musculus
ccgccccggtggacactaagatgga

SEQ ID NO: 349951 - DNA, 25 bp, Mus musculus
ccgccccggtggtcactaagatgga

SEQ ID NO: 349952 - DNA, 25 bp, Mus musculus
ccgcccctccagagatttgagaagg

SEQ ID NO: 349953 - DNA, 25 bp, Mus musculus
ccgcccctccagtgatttgagaagg

SEQ ID NO: 349954 - DNA, 25 bp, Mus musculus
ccgcccgtgtccagagggagcagca

SEQ ID NO: 349955 - DNA, 25 bp, Mus musculus
ccgcccgtgtcctgagggagcagca

SEQ ID NO: 349956 - DNA, 25 bp, Mus musculus
ccgcccgtttccaaggagatgatgt

SEQ ID NO: 349957 - DNA, 25 bp, Mus musculus
ccgcccgtttcctaggagatgatgt

SEQ ID NO: 349958 - DNA, 25 bp, Mus musculus
ccgccctaggctcgtcaatggagag

SEQ ID NO: 349959 - DNA, 25 bp, Mus musculus
ccgccctaggctggtcaatggagag

SEQ ID NO: 349960 - DNA, 25 bp, Mus musculus
ccgccctcaggacacatgcaggaag

SEQ ID NO: 349961 - DNA, 25 bp, Mus musculus
ccgccctcaggagacatgcaggaag

SEQ ID NO: 349962 - DNA, 25 bp, Mus musculus
ccgccctgcgagcagtgcattgtgt

SEQ ID NO: 349963 - DNA, 25 bp, Mus musculus
ccgccctgcgaggagtgcattgtgt

SEQ ID NO: 349964 - DNA, 25 bp, Mus musculus
ccgcccttgtggacacaggcagtga

SEQ ID NO: 349965 - DNA, 25 bp, Mus musculus
ccgcccttgtggtcacaggcagtga

SEQ ID NO: 349966 - DNA, 25 bp, Mus musculus
ccgccgatgacgaagatggccacat

SEQ ID NO: 349967 - DNA, 25 bp, Mus musculus
ccgccgatgacgtagatggccacat

SEQ ID NO: 349968 - DNA, 25 bp, Mus musculus
ccgccgccagcgcgagagctatgaa

SEQ ID NO: 349969 - DNA, 25 bp, Mus musculus
ccgccgccagcgggagagctatgaa

SEQ ID NO: 349970 - DNA, 25 bp, Mus musculus
ccgccggaacttagttgaggccaag

SEQ ID NO: 349971 - DNA, 25 bp, Mus musculus
ccgccggaactttgttgaggccaag

SEQ ID NO: 349972 - DNA, 25 bp, Mus musculus
ccgccgtcctatcagcagagctgtg

SEQ ID NO: 349973 - DNA, 25 bp, Mus musculus
ccgccgtcctatgagcagagctgtg

SEQ ID NO: 349974 - DNA, 25 bp, Mus musculus
ccgcctaaacccaagaccagtgttg

SEQ ID NO: 349975 - DNA, 25 bp, Mus musculus
ccgcctaaaccctagaccagtgttg

SEQ ID NO: 349976 - DNA, 25 bp, Mus musculus
ccgcctaaatctagcaggtatcaaa

SEQ ID NO: 349977 - DNA, 25 bp, Mus musculus
ccgcctaaatcttgcaggtatcaaa

SEQ ID NO: 349978 - DNA, 25 bp, Mus musculus
ccgcctatgtgaactcaacagacac

SEQ ID NO: 349979 - DNA, 25 bp, Mus musculus
ccgcctatgtgatctcaacagacac

SEQ ID NO: 349980 - DNA, 25 bp, Mus musculus
ccgcctcaacacctgagatctagag

SEQ ID NO: 349981 - DNA, 25 bp, Mus musculus
ccgcctcaacacgtgagatctagag

SEQ ID NO: 349982 - DNA, 25 bp, Mus musculus
ccgcctccacctatatttcttggag

SEQ ID NO: 349983 - DNA, 25 bp, Mus musculus
ccgcctccacctttatttcttggag

SEQ ID NO: 349984 - DNA, 25 bp, Mus musculus
ccgcctccagttagatgaattccag

SEQ ID NO: 349985 - DNA, 25 bp, Mus musculus
ccgcctccagtttgatgaattccag

SEQ ID NO: 349986 - DNA, 25 bp, Mus musculus
ccgcctctcttaagttatctgtaat

SEQ ID NO: 349987 - DNA, 25 bp, Mus musculus
ccgcctctcttatgttatctgtaat

SEQ ID NO: 349988 - DNA, 25 bp, Mus musculus
ccgcctctgttcagtgactttatga

SEQ ID NO: 349989 - DNA, 25 bp, Mus musculus
ccgcctctgttcatttcaagggtga

SEQ ID NO: 349990 - DNA, 25 bp, Mus musculus
ccgcctctgttctgtgactttatga

SEQ ID NO: 349991 - DNA, 25 bp, Mus musculus
ccgcctctgttcttttcaagggtga

SEQ ID NO: 349992 - DNA, 25 bp, Mus musculus
ccgcctgagggcaacgatgtggtca

SEQ ID NO: 349993 - DNA, 25 bp, Mus musculus
ccgcctgagggctacgatgtggtca

SEQ ID NO: 349994 - DNA, 25 bp, Mus musculus
ccgcctgcccacagttgtaaaataa

SEQ ID NO: 349995 - DNA, 25 bp, Mus musculus
ccgcctgcccactgttgtaaaataa

SEQ ID NO: 349996 - DNA, 25 bp, Mus musculus
ccgcctgctaaccagtggaagtggc

SEQ ID NO: 349997 - DNA, 25 bp, Mus musculus
ccgcctgctaacgagtggaagtggc

SEQ ID NO: 349998 - DNA, 25 bp, Mus musculus
ccgcctgctatcaccatatggtgtt

SEQ ID NO: 349999 - DNA, 25 bp, Mus musculus
ccgcctgctatctccatatggtgtt

SEQ ID NO: 350000 - DNA, 25 bp, Mus musculus
ccgcctggacaacgcctctgcattc

SEQ ID NO: 350001 - DNA, 25 bp, Mus musculus
ccgcctggacaaggcctctgcattc

SEQ ID NO: 350002 - DNA, 25 bp, Mus musculus
ccgcctggcaaacagggcgccagaa

SEQ ID NO: 350003 - DNA, 25 bp, Mus musculus
ccgcctggcaaagagggcgccagaa

SEQ ID NO: 350004 - DNA, 25 bp, Mus musculus
ccgcctgggcatagctcagcagaaa

SEQ ID NO: 350005 - DNA, 25 bp, Mus musculus
ccgcctgggcattgctcagcagaaa

SEQ ID NO: 350006 - DNA, 25 bp, Mus musculus
ccgcctgtacatcatgtttgagaca

SEQ ID NO: 350007 - DNA, 25 bp, Mus musculus
ccgcctgtacatgatgtttgagaca

SEQ ID NO: 350008 - DNA, 25 bp, Mus musculus
ccgcctgtacctcaaattaaagttg

SEQ ID NO: 350009 - DNA, 25 bp, Mus musculus
ccgcctgtacctgaaattaaagttg

SEQ ID NO: 350010 - DNA, 25 bp, Mus musculus
ccgcctgtgcttaaatgactgcagt

SEQ ID NO: 350011 - DNA, 25 bp, Mus musculus
ccgcctgtgctttaatgactgcagt

SEQ ID NO: 350012 - DNA, 25 bp, Mus musculus
ccgcctgtgtcgagcagaaagtcaa

SEQ ID NO: 350013 - DNA, 25 bp, Mus musculus
ccgcctgtgtcgtgcagaaagtcaa

SEQ ID NO: 350014 - DNA, 25 bp, Mus musculus
ccgccttcatctaccaggtttcaaa

SEQ ID NO: 350015 - DNA, 25 bp, Mus musculus
ccgccttcatcttccaggtttcaaa

SEQ ID NO: 350016 - DNA, 25 bp, Mus musculus
ccgccttctatgaggtggagtgcat

SEQ ID NO: 350017 - DNA, 25 bp, Mus musculus
ccgccttctatgtggtggagtgcat

SEQ ID NO: 350018 - DNA, 25 bp, Mus musculus
ccgccttctgtcatattggagccag

SEQ ID NO: 350019 - DNA, 25 bp, Mus musculus
ccgccttctgtcttattggagccag

SEQ ID NO: 350020 - DNA, 25 bp, Mus musculus
ccgccttgtgctatgttgataagat

SEQ ID NO: 350021 - DNA, 25 bp, Mus musculus
ccgccttgtgctttgttgataagat

SEQ ID NO: 350022 - DNA, 25 bp, Mus musculus
ccgcctttgggtcccatggccagtg

SEQ ID NO: 350023 - DNA, 25 bp, Mus musculus
ccgcctttgggtgccatggccagtg

SEQ ID NO: 350024 - DNA, 25 bp, Mus musculus
ccgcgaaggcggagtaggctaccca

SEQ ID NO: 350025 - DNA, 25 bp, Mus musculus
ccgcgaaggcggtgtaggctaccca

SEQ ID NO: 350026 - DNA, 25 bp, Mus musculus
ccgcgaatctccagttctattacga

SEQ ID NO: 350027 - DNA, 25 bp, Mus musculus
ccgcgaatctcctgttctattacga

SEQ ID NO: 350028 - DNA, 25 bp, Mus musculus
ccgcgacccggcaggagaaagttca

SEQ ID NO: 350029 - DNA, 25 bp, Mus musculus
ccgcgacccggctggagaaagttca

SEQ ID NO: 350030 - DNA, 25 bp, Mus musculus
ccgcgacgagcacgacgacgacgac

SEQ ID NO: 350031 - DNA, 25 bp, Mus musculus
ccgcgacgagcaggacgacgacgac

SEQ ID NO: 350032 - DNA, 25 bp, Mus musculus
ccgcgacttagtacggagtctttag

SEQ ID NO: 350033 - DNA, 25 bp, Mus musculus
ccgcgacttagttcggagtctttag

SEQ ID NO: 350034 - DNA, 25 bp, Mus musculus
ccgcgaggatgcacagctttttaaa

SEQ ID NO: 350035 - DNA, 25 bp, Mus musculus
ccgcgaggatgctcagctttttaaa

SEQ ID NO: 350036 - DNA, 25 bp, Mus musculus
ccgcgagttctgaaggacattccaa

SEQ ID NO: 350037 - DNA, 25 bp, Mus musculus
ccgcgagttctgtaggacattccaa

SEQ ID NO: 350038 - DNA, 25 bp, Mus musculus
ccgcgcagcttgaacgactaaagca

SEQ ID NO: 350039 - DNA, 25 bp, Mus musculus
ccgcgcagcttgtacgactaaagca

SEQ ID NO: 350040 - DNA, 25 bp, Mus musculus
ccgcgccaaggaaagcagttagatg

SEQ ID NO: 350041 - DNA, 25 bp, Mus musculus
ccgcgccaaggatagcagttagatg

SEQ ID NO: 350042 - DNA, 25 bp, Mus musculus
ccgcgcccgcataactttaataata

SEQ ID NO: 350043 - DNA, 25 bp, Mus musculus
ccgcgcccgcattactttaataata

SEQ ID NO: 350044 - DNA, 25 bp, Mus musculus
ccgcgctaagtgcactggctgcaga

SEQ ID NO: 350045 - DNA, 25 bp, Mus musculus
ccgcgctaagtggactggctgcaga

SEQ ID NO: 350046 - DNA, 25 bp, Mus musculus
ccgcggacctggaaagtgtcttcaa

SEQ ID NO: 350047 - DNA, 25 bp, Mus musculus
ccgcggacctggtaagtgtcttcaa

SEQ ID NO: 350048 - DNA, 25 bp, Mus musculus
ccgcggactcttcagaggctgtaaa

SEQ ID NO: 350049 - DNA, 25 bp, Mus musculus
ccgcggactcttgagaggctgtaaa

SEQ ID NO: 350050 - DNA, 25 bp, Mus musculus
ccgcggcacctgatgtggaagccgt

SEQ ID NO: 350051 - DNA, 25 bp, Mus musculus
ccgcggcacctgttgtggaagccgt

SEQ ID NO: 350052 - DNA, 25 bp, Mus musculus
ccgcggccatgaagcaggaggcaca

SEQ ID NO: 350053 - DNA, 25 bp, Mus musculus
ccgcggccatgatgcaggaggcaca

SEQ ID NO: 350054 - DNA, 25 bp, Mus musculus
ccgcggccctgactgcctggcacga

SEQ ID NO: 350055 - DNA, 25 bp, Mus musculus
ccgcggccctgagtgcctggcacga

SEQ ID NO: 350056 - DNA, 25 bp, Mus musculus
ccgcggctgttgacacggtgacaaa

SEQ ID NO: 350057 - DNA, 25 bp, Mus musculus
ccgcggctgttgtcacggtgacaaa

SEQ ID NO: 350058 - DNA, 25 bp, Mus musculus
ccgcgggagtcacgatgagtaaaca

SEQ ID NO: 350059 - DNA, 25 bp, Mus musculus
ccgcgggagtcaggatgagtaaaca

SEQ ID NO: 350060 - DNA, 25 bp, Mus musculus
ccgcgggtgtaactcttttgtcttg

SEQ ID NO: 350061 - DNA, 25 bp, Mus musculus
ccgcgggtgtaagtcttttgtcttg

SEQ ID NO: 350062 - DNA, 25 bp, Mus musculus
ccgcggtcatctactgtatcagcat

SEQ ID NO: 350063 - DNA, 25 bp, Mus musculus
ccgcggtcatcttctgtatcagcat

SEQ ID NO: 350064 - DNA, 25 bp, Mus musculus
ccgcggtggctactgtcttgaaaca

SEQ ID NO: 350065 - DNA, 25 bp, Mus musculus
ccgcggtggctagtgtcttgaaaca

SEQ ID NO: 350066 - DNA, 25 bp, Mus musculus
ccgcgtagctctccgggagaaaaag

SEQ ID NO: 350067 - DNA, 25 bp, Mus musculus
ccgcgtagctctgcgggagaaaaag

SEQ ID NO: 350068 - DNA, 25 bp, Mus musculus
ccgcgtcactaactgtatctgagca

SEQ ID NO: 350069 - DNA, 25 bp, Mus musculus
ccgcgtcactaagtgtatctgagca

SEQ ID NO: 350070 - DNA, 25 bp, Mus musculus
ccgcgtgaacaacgatgagaccggg

SEQ ID NO: 350071 - DNA, 25 bp, Mus musculus
ccgcgtgaacaaggatgagaccggg

SEQ ID NO: 350072 - DNA, 25 bp, Mus musculus
ccgcgtgaacatcagtgacagggct

SEQ ID NO: 350073 - DNA, 25 bp, Mus musculus
ccgcgtgaacatgagtgacagggct

SEQ ID NO: 350074 - DNA, 25 bp, Mus musculus
ccgcgtgcattgcttttggtctgtc

SEQ ID NO: 350075 - DNA, 25 bp, Mus musculus
ccgcgtgcattggttttggtctgtc

SEQ ID NO: 350076 - DNA, 25 bp, Mus musculus
ccgcgtgtaatgactatgggtaaat

SEQ ID NO: 350077 - DNA, 25 bp, Mus musculus
ccgcgtgtaatgtctatgggtaaat

SEQ ID NO: 350078 - DNA, 25 bp, Mus musculus
ccgcgtgtcattatctggagtggat

SEQ ID NO: 350079 - DNA, 25 bp, Mus musculus
ccgcgtgtcattttctggagtggat

SEQ ID NO: 350080 - DNA, 25 bp, Mus musculus
ccgcgtgtcctgcttgctgagggaa

SEQ ID NO: 350081 - DNA, 25 bp, Mus musculus
ccgcgtgtcctggttgctgagggaa

SEQ ID NO: 350082 - DNA, 25 bp, Mus musculus
ccgcgtttgcggattctcagttggt

SEQ ID NO: 350083 - DNA, 25 bp, Mus musculus
ccgcgtttgcggtttctcagttggt

SEQ ID NO: 350084 - DNA, 25 bp, Mus musculus
ccgctaacatgccattcgttgagtt

SEQ ID NO: 350085 - DNA, 25 bp, Mus musculus
ccgctaacatgcgattcgttgagtt

SEQ ID NO: 350086 - DNA, 25 bp, Mus musculus
ccgctacacgaaaagaatgttctac

SEQ ID NO: 350087 - DNA, 25 bp, Mus musculus
ccgctacacgaatagaatgttctac

SEQ ID NO: 350088 - DNA, 25 bp, Mus musculus
ccgctaccagaactgtctggatgct

SEQ ID NO: 350089 - DNA, 25 bp, Mus musculus
ccgctaccagaagtgtctggatgct

SEQ ID NO: 350090 - DNA, 25 bp, Mus musculus
ccgctaccgtgcattaatttttctg

SEQ ID NO: 350091 - DNA, 25 bp, Mus musculus
ccgctaccgtgctttaatttttctg

SEQ ID NO: 350092 - DNA, 25 bp, Mus musculus
ccgctagacaggagccttccaagaa

SEQ ID NO: 350093 - DNA, 25 bp, Mus musculus
ccgctagacaggtgccttccaagaa

SEQ ID NO: 350094 - DNA, 25 bp, Mus musculus
ccgctagggagcattcgatgtgcaa

SEQ ID NO: 350095 - DNA, 25 bp, Mus musculus
ccgctagggagctttcgatgtgcaa

SEQ ID NO: 350096 - DNA, 25 bp, Mus musculus
ccgctatcactcatcagactagaat

SEQ ID NO: 350097 - DNA, 25 bp, Mus musculus
ccgctatcactcttcagactagaat

SEQ ID NO: 350098 - DNA, 25 bp, Mus musculus
ccgctatgcaaaagtgcttttgtta

SEQ ID NO: 350099 - DNA, 25 bp, Mus musculus
ccgctatgcaaatgtgcttttgtta

SEQ ID NO: 350100 - DNA, 25 bp, Mus musculus
ccgctcaccataatgggacttcttt

SEQ ID NO: 350101 - DNA, 25 bp, Mus musculus
ccgctcaccatattgggacttcttt

SEQ ID NO: 350102 - DNA, 25 bp, Mus musculus
ccgctcagcacaagagtaattaatc

SEQ ID NO: 350103 - DNA, 25 bp, Mus musculus
ccgctcagcacatgagtaattaatc

SEQ ID NO: 350104 - DNA, 25 bp, Mus musculus
ccgctcaggcaccaaatttgaaccg

SEQ ID NO: 350105 - DNA, 25 bp, Mus musculus
ccgctcaggcacgaaatttgaaccg

SEQ ID NO: 350106 - DNA, 25 bp, Mus musculus
ccgctcatctttaactaaacacaag

SEQ ID NO: 350107 - DNA, 25 bp, Mus musculus
ccgctcatcttttactaaacacaag

SEQ ID NO: 350108 - DNA, 25 bp, Mus musculus
ccgctcatgggtaccattgtcatgg

SEQ ID NO: 350109 - DNA, 25 bp, Mus musculus
ccgctcatgggttccattgtcatgg

SEQ ID NO: 350110 - DNA, 25 bp, Mus musculus
ccgctcattactccaatttgcagat

SEQ ID NO: 350111 - DNA, 25 bp, Mus musculus
ccgctcattactgcaatttgcagat

SEQ ID NO: 350112 - DNA, 25 bp, Mus musculus
ccgctcattgctatacacagtagaa

SEQ ID NO: 350113 - DNA, 25 bp, Mus musculus
ccgctcattgctttacacagtagaa

SEQ ID NO: 350114 - DNA, 25 bp, Mus musculus
ccgctccaacttacaatcagacttg

SEQ ID NO: 350115 - DNA, 25 bp, Mus musculus
ccgctccaactttcaatcagacttg

SEQ ID NO: 350116 - DNA, 25 bp, Mus musculus
ccgctcccactcataataatcagta

SEQ ID NO: 350117 - DNA, 25 bp, Mus musculus
ccgctcccactcttaataatcagta

SEQ ID NO: 350118 - DNA, 25 bp, Mus musculus
ccgctccctgctatcataagaagga

SEQ ID NO: 350119 - DNA, 25 bp, Mus musculus
ccgctccctgctttcataagaagga

SEQ ID NO: 350120 - DNA, 25 bp, Mus musculus
ccgctccgtaatcgaccatcaagga

SEQ ID NO: 350121 - DNA, 25 bp, Mus musculus
ccgctccgtaatggaccatcaagga

SEQ ID NO: 350122 - DNA, 25 bp, Mus musculus
ccgctcctcctgaaagatgtgtatg

SEQ ID NO: 350123 - DNA, 25 bp, Mus musculus
ccgctcctcctgtaagatgtgtatg

SEQ ID NO: 350124 - DNA, 25 bp, Mus musculus
ccgctccttactactggtatacaga

SEQ ID NO: 350125 - DNA, 25 bp, Mus musculus
ccgctccttacttctggtatacaga

SEQ ID NO: 350126 - DNA, 25 bp, Mus musculus
ccgctcgaggccctgtgtaggatta

SEQ ID NO: 350127 - DNA, 25 bp, Mus musculus
ccgctcgaggccgtgtgtaggatta

SEQ ID NO: 350128 - DNA, 25 bp, Mus musculus
ccgctcgcagtaatttgagggtgtg

SEQ ID NO: 350129 - DNA, 25 bp, Mus musculus
ccgctcgcagtattttgagggtgtg

SEQ ID NO: 350130 - DNA, 25 bp, Mus musculus
ccgctcgggactattgaaggctggt

SEQ ID NO: 350131 - DNA, 25 bp, Mus musculus
ccgctcgggacttttgaaggctggt

SEQ ID NO: 350132 - DNA, 25 bp, Mus musculus
ccgctctagagcctgtaagtgacat

SEQ ID NO: 350133 - DNA, 25 bp, Mus musculus
ccgctctagagcgtgtaagtgacat

SEQ ID NO: 350134 - DNA, 25 bp, Mus musculus
ccgctctatctacgttggcaatgtg

SEQ ID NO: 350135 - DNA, 25 bp, Mus musculus
ccgctctatctaggttggcaatgtg

SEQ ID NO: 350136 - DNA, 25 bp, Mus musculus
ccgctctcccataggattcttaaga

SEQ ID NO: 350137 - DNA, 25 bp, Mus musculus
ccgctctcccattggattcttaaga

SEQ ID NO: 350138 - DNA, 25 bp, Mus musculus
ccgctctgaacacgtggaccaaagg

SEQ ID NO: 350139 - DNA, 25 bp, Mus musculus
ccgctctgaacaggtggaccaaagg

SEQ ID NO: 350140 - DNA, 25 bp, Mus musculus
ccgctctgcgcgaactacagtacta

SEQ ID NO: 350141 - DNA, 25 bp, Mus musculus
ccgctctgcgcgtactacagtacta

SEQ ID NO: 350142 - DNA, 25 bp, Mus musculus
ccgctctgctggaaggcccgcgagt

SEQ ID NO: 350143 - DNA, 25 bp, Mus musculus
ccgctctgctggtaggcccgcgagt

SEQ ID NO: 350144 - DNA, 25 bp, Mus musculus
ccgctctgggagacctcaaggcaga

SEQ ID NO: 350145 - DNA, 25 bp, Mus musculus
ccgctctgggagtcctcaaggcaga

SEQ ID NO: 350146 - DNA, 25 bp, Mus musculus
ccgctctgtctacaagtggcacttg

SEQ ID NO: 350147 - DNA, 25 bp, Mus musculus
ccgctctgtctagaagtggcacttg

SEQ ID NO: 350148 - DNA, 25 bp, Mus musculus
ccgctcttgttcctgggtgaggaaa

SEQ ID NO: 350149 - DNA, 25 bp, Mus musculus
ccgctcttgttcgtgggtgaggaaa

SEQ ID NO: 350150 - DNA, 25 bp, Mus musculus
ccgctctttgtgaatggtcctgtaa

SEQ ID NO: 350151 - DNA, 25 bp, Mus musculus
ccgctctttgtgtatggtcctgtaa

SEQ ID NO: 350152 - DNA, 25 bp, Mus musculus
ccgctgaaactccacacttgggaaa

SEQ ID NO: 350153 - DNA, 25 bp, Mus musculus
ccgctgaaactcgacacttgggaaa

SEQ ID NO: 350154 - DNA, 25 bp, Mus musculus
ccgctgaaggaaacccctggtctgg

SEQ ID NO: 350155 - DNA, 25 bp, Mus musculus
ccgctgaaggaatcccctggtctgg

SEQ ID NO: 350156 - DNA, 25 bp, Mus musculus
ccgctgacctcaagaatcactgtat

SEQ ID NO: 350157 - DNA, 25 bp, Mus musculus
ccgctgacctcatgaatcactgtat

SEQ ID NO: 350158 - DNA, 25 bp, Mus musculus
ccgctgactcctcttttatgtcaaa

SEQ ID NO: 350159 - DNA, 25 bp, Mus musculus
ccgctgactcctgttttatgtcaaa

SEQ ID NO: 350160 - DNA, 25 bp, Mus musculus
ccgctgagtggtatgatctgtgtat

SEQ ID NO: 350161 - DNA, 25 bp, Mus musculus
ccgctgagtggtttgatctgtgtat

SEQ ID NO: 350162 - DNA, 25 bp, Mus musculus
ccgctgatacgcatgttcatgatga

SEQ ID NO: 350163 - DNA, 25 bp, Mus musculus
ccgctgatacgcttgttcatgatga

SEQ ID NO: 350164 - DNA, 25 bp, Mus musculus
ccgctgatcattcgcacctggtgga

SEQ ID NO: 350165 - DNA, 25 bp, Mus musculus
ccgctgatcattggcacctggtgga

SEQ ID NO: 350166 - DNA, 25 bp, Mus musculus
ccgctgatttgtatggttattagct

SEQ ID NO: 350167 - DNA, 25 bp, Mus musculus
ccgctgatttgtttggttattagct

SEQ ID NO: 350168 - DNA, 25 bp, Mus musculus
ccgctgcaatgcacgggagattgcc

SEQ ID NO: 350169 - DNA, 25 bp, Mus musculus
ccgctgcaatgctcgggagattgcc

SEQ ID NO: 350170 - DNA, 25 bp, Mus musculus
ccgctgcacatcatggaggccaaaa

SEQ ID NO: 350171 - DNA, 25 bp, Mus musculus
ccgctgcacatcttggaggccaaaa

SEQ ID NO: 350172 - DNA, 25 bp, Mus musculus
ccgctgccgggaagtctcggtagaa

SEQ ID NO: 350173 - DNA, 25 bp, Mus musculus
ccgctgccgggatgtctcggtagaa

SEQ ID NO: 350174 - DNA, 25 bp, Mus musculus
ccgctgctatgtccacatcatgaaa

SEQ ID NO: 350175 - DNA, 25 bp, Mus musculus
ccgctgctatgtgcacatcatgaaa

SEQ ID NO: 350176 - DNA, 25 bp, Mus musculus
ccgctgctcttaattaatgcctcag

SEQ ID NO: 350177 - DNA, 25 bp, Mus musculus
ccgctgctcttatttaatgcctcag

SEQ ID NO: 350178 - DNA, 25 bp, Mus musculus
ccgctgctgggacagatcccctggc

SEQ ID NO: 350179 - DNA, 25 bp, Mus musculus
ccgctgctgggagagatcccctggc

SEQ ID NO: 350180 - DNA, 25 bp, Mus musculus
ccgctgcttgttatttacctggttc

SEQ ID NO: 350181 - DNA, 25 bp, Mus musculus
ccgctgcttgttttttacctggttc

SEQ ID NO: 350182 - DNA, 25 bp, Mus musculus
ccgctgctttccactaattgaatag

SEQ ID NO: 350183 - DNA, 25 bp, Mus musculus
ccgctgctttcctctaattgaatag

SEQ ID NO: 350184 - DNA, 25 bp, Mus musculus
ccgctgctttgaaagagaacctaga

SEQ ID NO: 350185 - DNA, 25 bp, Mus musculus
ccgctgctttgatagagaacctaga

SEQ ID NO: 350186 - DNA, 25 bp, Mus musculus
ccgctggacttgactttcgaggtga

SEQ ID NO: 350187 - DNA, 25 bp, Mus musculus
ccgctggacttgtctttcgaggtga

SEQ ID NO: 350188 - DNA, 25 bp, Mus musculus
ccgctggagtgtcttctgaagcctt

SEQ ID NO: 350189 - DNA, 25 bp, Mus musculus
ccgctggagtgtgttctgaagcctt

SEQ ID NO: 350190 - DNA, 25 bp, Mus musculus
ccgctggcagatagcgaggacactg

SEQ ID NO: 350191 - DNA, 25 bp, Mus musculus
ccgctggcagattgcgaggacactg

SEQ ID NO: 350192 - DNA, 25 bp, Mus musculus
ccgctggccgaaagctagagcgcca

SEQ ID NO: 350193 - DNA, 25 bp, Mus musculus
ccgctggccgaatgctagagcgcca

SEQ ID NO: 350194 - DNA, 25 bp, Mus musculus
ccgctggctctcatgtatttgatgc

SEQ ID NO: 350195 - DNA, 25 bp, Mus musculus
ccgctggctctcttgtatttgatgc

SEQ ID NO: 350196 - DNA, 25 bp, Mus musculus
ccgctggtcccgaagtttgtgaagt

SEQ ID NO: 350197 - DNA, 25 bp, Mus musculus
ccgctggtcccgtagtttgtgaagt

SEQ ID NO: 350198 - DNA, 25 bp, Mus musculus
ccgctgtacacgagccaaagtttga

SEQ ID NO: 350199 - DNA, 25 bp, Mus musculus
ccgctgtacacgtgccaaagtttga

SEQ ID NO: 350200 - DNA, 25 bp, Mus musculus
ccgctgtgaactctacagatcagat

SEQ ID NO: 350201 - DNA, 25 bp, Mus musculus
ccgctgtgaactgtacagatcagat

SEQ ID NO: 350202 - DNA, 25 bp, Mus musculus
ccgctgtgacaaacctggtgggcca

SEQ ID NO: 350203 - DNA, 25 bp, Mus musculus
ccgctgtgacaatcctggtgggcca

SEQ ID NO: 350204 - DNA, 25 bp, Mus musculus
ccgctgtgctacaaggttatcatta

SEQ ID NO: 350205 - DNA, 25 bp, Mus musculus
ccgctgtgctactaggttatcatta

SEQ ID NO: 350206 - DNA, 25 bp, Mus musculus
ccgctgtggccaagctaactatata

SEQ ID NO: 350207 - DNA, 25 bp, Mus musculus
ccgctgtggccatgctaactatata

SEQ ID NO: 350208 - DNA, 25 bp, Mus musculus
ccgctgttacctcttgtttacagtt

SEQ ID NO: 350209 - DNA, 25 bp, Mus musculus
ccgctgttacctgttgtttacagtt

SEQ ID NO: 350210 - DNA, 25 bp, Mus musculus
ccgctgttcgcaaattgctgagttt

SEQ ID NO: 350211 - DNA, 25 bp, Mus musculus
ccgctgttcgcatattgctgagttt

SEQ ID NO: 350212 - DNA, 25 bp, Mus musculus
ccgcttaagtgcacagtgactttca

SEQ ID NO: 350213 - DNA, 25 bp, Mus musculus
ccgcttaagtgctcagtgactttca

SEQ ID NO: 350214 - DNA, 25 bp, Mus musculus
ccgcttacaagcacgcaggatggca

SEQ ID NO: 350215 - DNA, 25 bp, Mus musculus
ccgcttacaagctcgcaggatggca

SEQ ID NO: 350216 - DNA, 25 bp, Mus musculus
ccgcttcaagccactgtcagataag

SEQ ID NO: 350217 - DNA, 25 bp, Mus musculus
ccgcttcaagcctctgtcagataag

SEQ ID NO: 350218 - DNA, 25 bp, Mus musculus
ccgcttcaagcgaatatctgggaca

SEQ ID NO: 350219 - DNA, 25 bp, Mus musculus
ccgcttcaagcgtatatctgggaca

SEQ ID NO: 350220 - DNA, 25 bp, Mus musculus
ccgcttcacattcatccgaagggag

SEQ ID NO: 350221 - DNA, 25 bp, Mus musculus
ccgcttcacattgatccgaagggag

SEQ ID NO: 350222 - DNA, 25 bp, Mus musculus
ccgcttccaacacaggagaaccgga

SEQ ID NO: 350223 - DNA, 25 bp, Mus musculus
ccgcttccaacagaggagaaccgga

SEQ ID NO: 350224 - DNA, 25 bp, Mus musculus
ccgcttccaccgcagtgtgaagaaa

SEQ ID NO: 350225 - DNA, 25 bp, Mus musculus
ccgcttccaccggagtgtgaagaaa

SEQ ID NO: 350226 - DNA, 25 bp, Mus musculus
ccgcttccgcaacctgttagaaaat

SEQ ID NO: 350227 - DNA, 25 bp, Mus musculus
ccgcttccgcaagctgttagaaaat

SEQ ID NO: 350228 - DNA, 25 bp, Mus musculus
ccgcttcctgcgatacgactgcaga

SEQ ID NO: 350229 - DNA, 25 bp, Mus musculus
ccgcttcctgcgttacgactgcaga

SEQ ID NO: 350230 - DNA, 25 bp, Mus musculus
ccgcttccttcacattccaatagat

SEQ ID NO: 350231 - DNA, 25 bp, Mus musculus
ccgcttccttcagattccaatagat

SEQ ID NO: 350232 - DNA, 25 bp, Mus musculus
ccgcttctgaccaaaggcacacaga

SEQ ID NO: 350233 - DNA, 25 bp, Mus musculus
ccgcttctgacctaaggcacacaga

SEQ ID NO: 350234 - DNA, 25 bp, Mus musculus
ccgcttctttttcgtgctctgaaag

SEQ ID NO: 350235 - DNA, 25 bp, Mus musculus
ccgcttctttttggtgctctgaaag

SEQ ID NO: 350236 - DNA, 25 bp, Mus musculus
ccgcttgcatttactggtgagtcag

SEQ ID NO: 350237 - DNA, 25 bp, Mus musculus
ccgcttgcattttctggtgagtcag

SEQ ID NO: 350238 - DNA, 25 bp, Mus musculus
ccgcttgccatgcaagtcacggatg

SEQ ID NO: 350239 - DNA, 25 bp, Mus musculus
ccgcttgccatggaagtcacggatg

SEQ ID NO: 350240 - DNA, 25 bp, Mus musculus
ccgcttgcccatcatagatgttggt

SEQ ID NO: 350241 - DNA, 25 bp, Mus musculus
ccgcttgcccatgatagatgttggt

SEQ ID NO: 350242 - DNA, 25 bp, Mus musculus
ccgcttgcttgacaggtaaacttgt

SEQ ID NO: 350243 - DNA, 25 bp, Mus musculus
ccgcttgcttgagaggtaaacttgt

SEQ ID NO: 350244 - DNA, 25 bp, Mus musculus
ccgcttgggcatatgtgactgttta

SEQ ID NO: 350245 - DNA, 25 bp, Mus musculus
ccgcttgggcatttgtgactgttta

SEQ ID NO: 350246 - DNA, 25 bp, Mus musculus
ccgcttgtacctctgtctcctttgt

SEQ ID NO: 350247 - DNA, 25 bp, Mus musculus
ccgcttgtacctgtgtctcctttgt

SEQ ID NO: 350248 - DNA, 25 bp, Mus musculus
ccgcttgtctacaccaaatctgatg

SEQ ID NO: 350249 - DNA, 25 bp, Mus musculus
ccgcttgtctactccaaatctgatg

SEQ ID NO: 350250 - DNA, 25 bp, Mus musculus
ccgctttatagtccctcatccagag

SEQ ID NO: 350251 - DNA, 25 bp, Mus musculus
ccgctttatagtgcctcatccagag

SEQ ID NO: 350252 - DNA, 25 bp, Mus musculus
ccgctttccacacacaggacttaga

SEQ ID NO: 350253 - DNA, 25 bp, Mus musculus
ccgctttccacagacaggacttaga

SEQ ID NO: 350254 - DNA, 25 bp, Mus musculus
ccgctttcctcgagtagtgtatgta

SEQ ID NO: 350255 - DNA, 25 bp, Mus musculus
ccgctttcctcgtgtagtgtatgta

SEQ ID NO: 350256 - DNA, 25 bp, Mus musculus
ccgctttcgcttaagatttacagtt

SEQ ID NO: 350257 - DNA, 25 bp, Mus musculus
ccgctttcgctttagatttacagtt

SEQ ID NO: 350258 - DNA, 25 bp, Mus musculus
ccgctttgacctccaactttttgaa

SEQ ID NO: 350259 - DNA, 25 bp, Mus musculus
ccgctttgacctgcaactttttgaa

SEQ ID NO: 350260 - DNA, 25 bp, Mus musculus
ccgctttggattactgtggctggaa

SEQ ID NO: 350261 - DNA, 25 bp, Mus musculus
ccgctttggatttctgtggctggaa

SEQ ID NO: 350262 - DNA, 25 bp, Mus musculus
ccgcttttacttcctgttgctgaaa

SEQ ID NO: 350263 - DNA, 25 bp, Mus musculus
ccgcttttacttgctgttgctgaaa

SEQ ID NO: 350264 - DNA, 25 bp, Mus musculus
ccggaaaacatcatgatgtgtgtgg

SEQ ID NO: 350265 - DNA, 25 bp, Mus musculus
ccggaaaacatcttgatgtgtgtgg

SEQ ID NO: 350266 - DNA, 25 bp, Mus musculus
ccggaaacgggccttgatgcaccat

SEQ ID NO: 350267 - DNA, 25 bp, Mus musculus
ccggaaacgggcgttgatgcaccat

SEQ ID NO: 350268 - DNA, 25 bp, Mus musculus
ccggaaaggcaaatgagcctcatgt

SEQ ID NO: 350269 - DNA, 25 bp, Mus musculus
ccggaaaggcaattgagcctcatgt

SEQ ID NO: 350270 - DNA, 25 bp, Mus musculus
ccggaaagtgaacagccttataact

SEQ ID NO: 350271 - DNA, 25 bp, Mus musculus
ccggaaagtgaagagccttataact

SEQ ID NO: 350272 - DNA, 25 bp, Mus musculus
ccggaaagtggtcctctatctcgta

SEQ ID NO: 350273 - DNA, 25 bp, Mus musculus
ccggaaagtggtgctctatctcgta

SEQ ID NO: 350274 - DNA, 25 bp, Mus musculus
ccggaacattatctgacattcataa

SEQ ID NO: 350275 - DNA, 25 bp, Mus musculus
ccggaacattatgtgacattcataa

SEQ ID NO: 350276 - DNA, 25 bp, Mus musculus
ccggaactatgtcccagaggatgaa

SEQ ID NO: 350277 - DNA, 25 bp, Mus musculus
ccggaactatgtgccagaggatgaa

SEQ ID NO: 350278 - DNA, 25 bp, Mus musculus
ccggaacttggacacctatggtcta

SEQ ID NO: 350279 - DNA, 25 bp, Mus musculus
ccggaacttggagacctatggtcta

SEQ ID NO: 350280 - DNA, 25 bp, Mus musculus
ccggaagaaacactagtcattggaa

SEQ ID NO: 350281 - DNA, 25 bp, Mus musculus
ccggaagaaacagtagtcattggaa

SEQ ID NO: 350282 - DNA, 25 bp, Mus musculus
ccggaagagaataagcctagcacta

SEQ ID NO: 350283 - DNA, 25 bp, Mus musculus
ccggaagagaatcgagtttagtttg

SEQ ID NO: 350284 - DNA, 25 bp, Mus musculus
ccggaagagaatggagtttagtttg

SEQ ID NO: 350285 - DNA, 25 bp, Mus musculus
ccggaagagaattagcctagcacta

SEQ ID NO: 350286 - DNA, 25 bp, Mus musculus
ccggaagataaacgcgtcgacctct

SEQ ID NO: 350287 - DNA, 25 bp, Mus musculus
ccggaagataaaggcgtcgacctct

SEQ ID NO: 350288 - DNA, 25 bp, Mus musculus
ccggaaggatctcctgaagggcaat

SEQ ID NO: 350289 - DNA, 25 bp, Mus musculus
ccggaaggatctgctgaagggcaat

SEQ ID NO: 350290 - DNA, 25 bp, Mus musculus
ccggaagggcccagcccctgaattg

SEQ ID NO: 350291 - DNA, 25 bp, Mus musculus
ccggaagggccctgcccctgaattg

SEQ ID NO: 350292 - DNA, 25 bp, Mus musculus
ccggaagtttgaccgcgccagaggc

SEQ ID NO: 350293 - DNA, 25 bp, Mus musculus
ccggaagtttgagcgcgccagaggc

SEQ ID NO: 350294 - DNA, 25 bp, Mus musculus
ccggaattcattacgcgttgatttt

SEQ ID NO: 350295 - DNA, 25 bp, Mus musculus
ccggaattcatttcgcgttgatttt

SEQ ID NO: 350296 - DNA, 25 bp, Mus musculus
ccggacaatgtgcagaatgacctca

SEQ ID NO: 350297 - DNA, 25 bp, Mus musculus
ccggacaatgtggagaatgacctca

SEQ ID NO: 350298 - DNA, 25 bp, Mus musculus
ccggacacaggcacgcgtccaggtg

SEQ ID NO: 350299 - DNA, 25 bp, Mus musculus
ccggacacaggctcgcgtccaggtg

SEQ ID NO: 350300 - DNA, 25 bp, Mus musculus
ccggacatcaagaggttctttgaaa

SEQ ID NO: 350301 - DNA, 25 bp, Mus musculus
ccggacatcaagtggttctttgaaa

SEQ ID NO: 350302 - DNA, 25 bp, Mus musculus
ccggacattgccctcagtaaggaac

SEQ ID NO: 350303 - DNA, 25 bp, Mus musculus
ccggacattgccgtcagtaaggaac

SEQ ID NO: 350304 - DNA, 25 bp, Mus musculus
ccggaccaagctccaatgcagtatt

SEQ ID NO: 350305 - DNA, 25 bp, Mus musculus
ccggaccaagctgcaatgcagtatt

SEQ ID NO: 350306 - DNA, 25 bp, Mus musculus
ccggacctggcgatacagagagttc

SEQ ID NO: 350307 - DNA, 25 bp, Mus musculus
ccggacctggcgttacagagagttc

SEQ ID NO: 350308 - DNA, 25 bp, Mus musculus
ccggactgatctagtctactttgac

SEQ ID NO: 350309 - DNA, 25 bp, Mus musculus
ccggactgatcttgtctactttgac

SEQ ID NO: 350310 - DNA, 25 bp, Mus musculus
ccggactgggtcatgctgttctgat

SEQ ID NO: 350311 - DNA, 25 bp, Mus musculus
ccggactgggtcttgctgttctgat

SEQ ID NO: 350312 - DNA, 25 bp, Mus musculus
ccggactggtgaacctaggctgtgt

SEQ ID NO: 350313 - DNA, 25 bp, Mus musculus
ccggactggtgatcctaggctgtgt

SEQ ID NO: 350314 - DNA, 25 bp, Mus musculus
ccggactttaaccagcgcgttgaat

SEQ ID NO: 350315 - DNA, 25 bp, Mus musculus
ccggactttaacgagcgcgttgaat

SEQ ID NO: 350316 - DNA, 25 bp, Mus musculus
ccggagaaagctcacctaccagttc

SEQ ID NO: 350317 - DNA, 25 bp, Mus musculus
ccggagaaagctgacctaccagttc

SEQ ID NO: 350318 - DNA, 25 bp, Mus musculus
ccggagacagggatgccttttcaga

SEQ ID NO: 350319 - DNA, 25 bp, Mus musculus
ccggagacagggttgccttttcaga

SEQ ID NO: 350320 - DNA, 25 bp, Mus musculus
ccggagacagtgagcccagtgtgcc

SEQ ID NO: 350321 - DNA, 25 bp, Mus musculus
ccggagacagtgtgcccagtgtgcc

SEQ ID NO: 350322 - DNA, 25 bp, Mus musculus
ccggagagtgatatggagctatttt

SEQ ID NO: 350323 - DNA, 25 bp, Mus musculus
ccggagagtgatttggagctatttt

SEQ ID NO: 350324 - DNA, 25 bp, Mus musculus
ccggagatagggagtaatgtatttc

SEQ ID NO: 350325 - DNA, 25 bp, Mus musculus
ccggagatagggtgtaatgtatttc

SEQ ID NO: 350326 - DNA, 25 bp, Mus musculus
ccggagatggttctccgagctgcat

SEQ ID NO: 350327 - DNA, 25 bp, Mus musculus
ccggagatggttgtccgagctgcat

SEQ ID NO: 350328 - DNA, 25 bp, Mus musculus
ccggagattccacgattgtcgccca

SEQ ID NO: 350329 - DNA, 25 bp, Mus musculus
ccggagattccaggattgtcgccca

SEQ ID NO: 350330 - DNA, 25 bp, Mus musculus
ccggagccaggtcagtcatctctgc

SEQ ID NO: 350331 - DNA, 25 bp, Mus musculus
ccggagccaggtgagtcatctctgc

SEQ ID NO: 350332 - DNA, 25 bp, Mus musculus
ccggagcggaaaatcatcttcacct

SEQ ID NO: 350333 - DNA, 25 bp, Mus musculus
ccggagcggaaattcatcttcacct

SEQ ID NO: 350334 - DNA, 25 bp, Mus musculus
ccggagctatcacgtggtcacctga

SEQ ID NO: 350335 - DNA, 25 bp, Mus musculus
ccggagctatcaggtggtcacctga

SEQ ID NO: 350336 - DNA, 25 bp, Mus musculus
ccggaggagcgcactgattctcgga

SEQ ID NO: 350337 - DNA, 25 bp, Mus musculus
ccggaggagcgctctgattctcgga

SEQ ID NO: 350338 - DNA, 25 bp, Mus musculus
ccggaggcaatcctataagacagct

SEQ ID NO: 350339 - DNA, 25 bp, Mus musculus
ccggaggcaatcgtataagacagct

SEQ ID NO: 350340 - DNA, 25 bp, Mus musculus
ccggaggcatgaactagaacataat

SEQ ID NO: 350341 - DNA, 25 bp, Mus musculus
ccggaggcatgatctagaacataat

SEQ ID NO: 350342 - DNA, 25 bp, Mus musculus
ccggaggccattctattgtctcggg

SEQ ID NO: 350343 - DNA, 25 bp, Mus musculus
ccggaggccattgtattgtctcggg

SEQ ID NO: 350344 - DNA, 25 bp, Mus musculus
ccggaggcccaacgacatttatgtc

SEQ ID NO: 350345 - DNA, 25 bp, Mus musculus
ccggaggcccaaggacatttatgtc

SEQ ID NO: 350346 - DNA, 25 bp, Mus musculus
ccggagggacctaatccaggatgtt

SEQ ID NO: 350347 - DNA, 25 bp, Mus musculus
ccggagggaccttatccaggatgtt

SEQ ID NO: 350348 - DNA, 25 bp, Mus musculus
ccggagggtctcacagcgaaataca

SEQ ID NO: 350349 - DNA, 25 bp, Mus musculus
ccggagggtctctcagcgaaataca

SEQ ID NO: 350350 - DNA, 25 bp, Mus musculus
ccggagtcatgtccgtgtacttgtt

SEQ ID NO: 350351 - DNA, 25 bp, Mus musculus
ccggagtcatgtgcgtgtacttgtt

SEQ ID NO: 350352 - DNA, 25 bp, Mus musculus
ccggagtccttcagtggcttggaac

SEQ ID NO: 350353 - DNA, 25 bp, Mus musculus
ccggagtccttctgtggcttggaac

SEQ ID NO: 350354 - DNA, 25 bp, Mus musculus
ccggagtgacccaatagtgcttgtg

SEQ ID NO: 350355 - DNA, 25 bp, Mus musculus
ccggagtgaccctatagtgcttgtg

SEQ ID NO: 350356 - DNA, 25 bp, Mus musculus
ccggataaataaagtcttctcttgt

SEQ ID NO: 350357 - DNA, 25 bp, Mus musculus
ccggataaataatgtcttctcttgt

SEQ ID NO: 350358 - DNA, 25 bp, Mus musculus
ccggatacaggcattttgtggacat

SEQ ID NO: 350359 - DNA, 25 bp, Mus musculus
ccggatacaggctttttgtggacat

SEQ ID NO: 350360 - DNA, 25 bp, Mus musculus
ccggatagtggtaggtgcttcctgc

SEQ ID NO: 350361 - DNA, 25 bp, Mus musculus
ccggatagtggttggtgcttcctgc

SEQ ID NO: 350362 - DNA, 25 bp, Mus musculus
ccggatcatacgcacagactgggat

SEQ ID NO: 350363 - DNA, 25 bp, Mus musculus
ccggatcatacggacagactgggat

SEQ ID NO: 350364 - DNA, 25 bp, Mus musculus
ccggatctgaatctttcttttcata

SEQ ID NO: 350365 - DNA, 25 bp, Mus musculus
ccggatctgaatgtttcttttcata

SEQ ID NO: 350366 - DNA, 25 bp, Mus musculus
ccggatctgtgcatgcccaggaaga

SEQ ID NO: 350367 - DNA, 25 bp, Mus musculus
ccggatctgtgcttgcccaggaaga

SEQ ID NO: 350368 - DNA, 25 bp, Mus musculus
ccggatgacctacgcaatgcttgat

SEQ ID NO: 350369 - DNA, 25 bp, Mus musculus
ccggatgacctaggcaatgcttgat

SEQ ID NO: 350370 - DNA, 25 bp, Mus musculus
ccggatgatctacctccaagggagg

SEQ ID NO: 350371 - DNA, 25 bp, Mus musculus
ccggatgatctagctccaagggagg

SEQ ID NO: 350372 - DNA, 25 bp, Mus musculus
ccggatgcctggacatttgtggcga

SEQ ID NO: 350373 - DNA, 25 bp, Mus musculus
ccggatgcctggtcatttgtggcga

SEQ ID NO: 350374 - DNA, 25 bp, Mus musculus
ccggatggcttcaggagcacacgtc

SEQ ID NO: 350375 - DNA, 25 bp, Mus musculus
ccggatggcttctggagcacacgtc

SEQ ID NO: 350376 - DNA, 25 bp, Mus musculus
ccggatgtccacatcttccggcagg

SEQ ID NO: 350377 - DNA, 25 bp, Mus musculus
ccggatgtccacttcttccggcagg

SEQ ID NO: 350378 - DNA, 25 bp, Mus musculus
ccggatgtttttagattgcctgtat

SEQ ID NO: 350379 - DNA, 25 bp, Mus musculus
ccggatgttttttgattgcctgtat

SEQ ID NO: 350380 - DNA, 25 bp, Mus musculus
ccggattatagtccagcctgggctg

SEQ ID NO: 350381 - DNA, 25 bp, Mus musculus
ccggattatagtgcagcctgggctg

SEQ ID NO: 350382 - DNA, 25 bp, Mus musculus
ccggattattgcagcaactggcaaa

SEQ ID NO: 350383 - DNA, 25 bp, Mus musculus
ccggattattgctgcaactggcaaa

SEQ ID NO: 350384 - DNA, 25 bp, Mus musculus
ccggattccatcacaagcactaggg

SEQ ID NO: 350385 - DNA, 25 bp, Mus musculus
ccggattccatctcaagcactaggg

SEQ ID NO: 350386 - DNA, 25 bp, Mus musculus
ccggatttttacaaatgggctacat

SEQ ID NO: 350387 - DNA, 25 bp, Mus musculus
ccggatttttactaatgggctacat

SEQ ID NO: 350388 - DNA, 25 bp, Mus musculus
ccggcaaaaaccacgtgctgtgtgg

SEQ ID NO: 350389 - DNA, 25 bp, Mus musculus
ccggcaaaaacctcgtgctgtgtgg

SEQ ID NO: 350390 - DNA, 25 bp, Mus musculus
ccggcaagacacagaattcctggag

SEQ ID NO: 350391 - DNA, 25 bp, Mus musculus
ccggcaagacactgaattcctggag

SEQ ID NO: 350392 - DNA, 25 bp, Mus musculus
ccggcaagatataaatcaacccctc

SEQ ID NO: 350393 - DNA, 25 bp, Mus musculus
ccggcaagatattaatcaacccctc

SEQ ID NO: 350394 - DNA, 25 bp, Mus musculus
ccggcaaggtcaatgtgtcattaaa

SEQ ID NO: 350395 - DNA, 25 bp, Mus musculus
ccggcaaggtcattgtgtcattaaa

SEQ ID NO: 350396 - DNA, 25 bp, Mus musculus
ccggcaagtatccaggtctcataaa

SEQ ID NO: 350397 - DNA, 25 bp, Mus musculus
ccggcaagtatcgaggtctcataaa

SEQ ID NO: 350398 - DNA, 25 bp, Mus musculus
ccggcacacgagaggcttcggtgaa

SEQ ID NO: 350399 - DNA, 25 bp, Mus musculus
ccggcacacgagtggcttcggtgaa

SEQ ID NO: 350400 - DNA, 25 bp, Mus musculus
ccggcacatttgctaactttacaga

SEQ ID NO: 350401 - DNA, 25 bp, Mus musculus
ccggcacatttggtaactttacaga

SEQ ID NO: 350402 - DNA, 25 bp, Mus musculus
ccggcaccccaaatataattcatgg

SEQ ID NO: 350403 - DNA, 25 bp, Mus musculus
ccggcaccccaattataattcatgg

SEQ ID NO: 350404 - DNA, 25 bp, Mus musculus
ccggcactgcgtcttttctgtgaaa

SEQ ID NO: 350405 - DNA, 25 bp, Mus musculus
ccggcactgcgtgttttctgtgaaa

SEQ ID NO: 350406 - DNA, 25 bp, Mus musculus
ccggcacttaatcctagtctttctg

SEQ ID NO: 350407 - DNA, 25 bp, Mus musculus
ccggcacttaatgctagtctttctg

SEQ ID NO: 350408 - DNA, 25 bp, Mus musculus
ccggcacttacgaggcagcatgata

SEQ ID NO: 350409 - DNA, 25 bp, Mus musculus
ccggcacttacgtggcagcatgata

SEQ ID NO: 350410 - DNA, 25 bp, Mus musculus
ccggcacttgacaaacacagttcac

SEQ ID NO: 350411 - DNA, 25 bp, Mus musculus
ccggcacttgactaacacagttcac

SEQ ID NO: 350412 - DNA, 25 bp, Mus musculus
ccggcagaatcgaggcctggtagat

SEQ ID NO: 350413 - DNA, 25 bp, Mus musculus
ccggcagaatcgtggcctggtagat

SEQ ID NO: 350414 - DNA, 25 bp, Mus musculus
ccggcagagttccagtccaagtgct

SEQ ID NO: 350415 - DNA, 25 bp, Mus musculus
ccggcagagttcgagtccaagtgct

SEQ ID NO: 350416 - DNA, 25 bp, Mus musculus
ccggcagcagttatgggtggacata

SEQ ID NO: 350417 - DNA, 25 bp, Mus musculus
ccggcagcagttttgggtggacata

SEQ ID NO: 350418 - DNA, 25 bp, Mus musculus
ccggcagctgcaccaggagttgccc

SEQ ID NO: 350419 - DNA, 25 bp, Mus musculus
ccggcagctgcagcaggagttgccc

SEQ ID NO: 350420 - DNA, 25 bp, Mus musculus
ccggcagttccacaagaccaaaata

SEQ ID NO: 350421 - DNA, 25 bp, Mus musculus
ccggcagttccagaagaccaaaata

SEQ ID NO: 350422 - DNA, 25 bp, Mus musculus
ccggcatatacgagtgtgaatctaa

SEQ ID NO: 350423 - DNA, 25 bp, Mus musculus
ccggcatatacgtgtgtgaatctaa

SEQ ID NO: 350424 - DNA, 25 bp, Mus musculus
ccggcatcggtaaatggcacctttt

SEQ ID NO: 350425 - DNA, 25 bp, Mus musculus
ccggcatcggtatatggcacctttt

SEQ ID NO: 350426 - DNA, 25 bp, Mus musculus
ccggcatcttgtatcagggctactg

SEQ ID NO: 350427 - DNA, 25 bp, Mus musculus
ccggcatcttgtttcagggctactg

SEQ ID NO: 350428 - DNA, 25 bp, Mus musculus
ccggccaaaggcagtcaacagtgga

SEQ ID NO: 350429 - DNA, 25 bp, Mus musculus
ccggccaaaggctgtcaacagtgga

SEQ ID NO: 350430 - DNA, 25 bp, Mus musculus
ccggccagcgacactgagtcctggg

SEQ ID NO: 350431 - DNA, 25 bp, Mus musculus
ccggccagcgactctgagtcctggg

SEQ ID NO: 350432 - DNA, 25 bp, Mus musculus
ccggccagcttaagcatgcacgaga

SEQ ID NO: 350433 - DNA, 25 bp, Mus musculus
ccggccagcttatgcatgcacgaga

SEQ ID NO: 350434 - DNA, 25 bp, Mus musculus
ccggccattcatcagtgtcaagttc

SEQ ID NO: 350435 - DNA, 25 bp, Mus musculus
ccggccattcatgagtgtcaagttc

SEQ ID NO: 350436 - DNA, 25 bp, Mus musculus
ccggccattgggaatcagcatttat

SEQ ID NO: 350437 - DNA, 25 bp, Mus musculus
ccggccattgggtatcagcatttat

SEQ ID NO: 350438 - DNA, 25 bp, Mus musculus
ccggccctattaagcggcgcatgtg

SEQ ID NO: 350439 - DNA, 25 bp, Mus musculus
ccggccctattatgcggcgcatgtg

SEQ ID NO: 350440 - DNA, 25 bp, Mus musculus
ccggcccttgagagtgggtgacaca

SEQ ID NO: 350441 - DNA, 25 bp, Mus musculus
ccggcccttgagtgtgggtgacaca

SEQ ID NO: 350442 - DNA, 25 bp, Mus musculus
ccggccgcctggaggatgctctgaa

SEQ ID NO: 350443 - DNA, 25 bp, Mus musculus
ccggccgcctggtggatgctctgaa

SEQ ID NO: 350444 - DNA, 25 bp, Mus musculus
ccggccggagctctatttaccaggg

SEQ ID NO: 350445 - DNA, 25 bp, Mus musculus
ccggccggagctgtatttaccaggg

SEQ ID NO: 350446 - DNA, 25 bp, Mus musculus
ccggccgggtgcaattgtttttgtg

SEQ ID NO: 350447 - DNA, 25 bp, Mus musculus
ccggccgggtgctattgtttttgtg

SEQ ID NO: 350448 - DNA, 25 bp, Mus musculus
ccggccgtcgccatgaatgtactga

SEQ ID NO: 350449 - DNA, 25 bp, Mus musculus
ccggccgtcgccttgaatgtactga

SEQ ID NO: 350450 - DNA, 25 bp, Mus musculus
ccggccgttgctactgtatatagag

SEQ ID NO: 350451 - DNA, 25 bp, Mus musculus
ccggccgttgcttctgtatatagag

SEQ ID NO: 350452 - DNA, 25 bp, Mus musculus
ccggcctaagcacccatgttatgtt

SEQ ID NO: 350453 - DNA, 25 bp, Mus musculus
ccggcctaagcagccatgttatgtt

SEQ ID NO: 350454 - DNA, 25 bp, Mus musculus
ccggcctactctcctggaaaactag

SEQ ID NO: 350455 - DNA, 25 bp, Mus musculus
ccggcctactctgctggaaaactag

SEQ ID NO: 350456 - DNA, 25 bp, Mus musculus
ccggcctatttgctgacgtgactaa

SEQ ID NO: 350457 - DNA, 25 bp, Mus musculus
ccggcctatttggtgacgtgactaa

SEQ ID NO: 350458 - DNA, 25 bp, Mus musculus
ccggcctcagcactttgatgtcatg

SEQ ID NO: 350459 - DNA, 25 bp, Mus musculus
ccggcctcagcagtttgatgtcatg

SEQ ID NO: 350460 - DNA, 25 bp, Mus musculus
ccggcctccacacttagatgtttat

SEQ ID NO: 350461 - DNA, 25 bp, Mus musculus
ccggcctccacagttagatgtttat

SEQ ID NO: 350462 - DNA, 25 bp, Mus musculus
ccggcctcgcctcaatatgcaaata

SEQ ID NO: 350463 - DNA, 25 bp, Mus musculus
ccggcctcgcctgaatatgcaaata

SEQ ID NO: 350464 - DNA, 25 bp, Mus musculus
ccggccttcagtcaatgatgcggca

SEQ ID NO: 350465 - DNA, 25 bp, Mus musculus
ccggccttcagtgaatgatgcggca

SEQ ID NO: 350466 - DNA, 25 bp, Mus musculus
ccggccttgtgtcagtcaggaagac

SEQ ID NO: 350467 - DNA, 25 bp, Mus musculus
ccggccttgtgtgagtcaggaagac

SEQ ID NO: 350468 - DNA, 25 bp, Mus musculus
ccggcctttgctcccgaaaaaatca

SEQ ID NO: 350469 - DNA, 25 bp, Mus musculus
ccggcctttgctgccgaaaaaatca

SEQ ID NO: 350470 - DNA, 25 bp, Mus musculus
ccggcgactactccggtcaattaaa

SEQ ID NO: 350471 - DNA, 25 bp, Mus musculus
ccggcgactactgcggtcaattaaa

SEQ ID NO: 350472 - DNA, 25 bp, Mus musculus
ccggcgattgttcaataagctggaa

SEQ ID NO: 350473 - DNA, 25 bp, Mus musculus
ccggcgattgttgaataagctggaa

SEQ ID NO: 350474 - DNA, 25 bp, Mus musculus
ccggcgatttgtctggaacttcttc

SEQ ID NO: 350475 - DNA, 25 bp, Mus musculus
ccggcgatttgtgtggaacttcttc

SEQ ID NO: 350476 - DNA, 25 bp, Mus musculus
ccggcgcctgtgaggctgttgtaca

SEQ ID NO: 350477 - DNA, 25 bp, Mus musculus
ccggcgcctgtgtggctgttgtaca

SEQ ID NO: 350478 - DNA, 25 bp, Mus musculus
ccggcgctggcgaattcatattata

SEQ ID NO: 350479 - DNA, 25 bp, Mus musculus
ccggcgctggcgtattcatattata

SEQ ID NO: 350480 - DNA, 25 bp, Mus musculus
ccggcggagccgcaaatgatccagc

SEQ ID NO: 350481 - DNA, 25 bp, Mus musculus
ccggcggagccggaaatgatccagc

SEQ ID NO: 350482 - DNA, 25 bp, Mus musculus
ccggcggatgtaattattgtacaaa

SEQ ID NO: 350483 - DNA, 25 bp, Mus musculus
ccggcggatgtatttattgtacaaa

SEQ ID NO: 350484 - DNA, 25 bp, Mus musculus
ccggcggcttggagactctagataa

SEQ ID NO: 350485 - DNA, 25 bp, Mus musculus
ccggcggcttggtgactctagataa

SEQ ID NO: 350486 - DNA, 25 bp, Mus musculus
ccggcgggcactatggctgagttta

SEQ ID NO: 350487 - DNA, 25 bp, Mus musculus
ccggcgggcactttggctgagttta

SEQ ID NO: 350488 - DNA, 25 bp, Mus musculus
ccggctacacttaaggaacatttca

SEQ ID NO: 350489 - DNA, 25 bp, Mus musculus
ccggctacactttaggaacatttca

SEQ ID NO: 350490 - DNA, 25 bp, Mus musculus
ccggctactagtccaggccctgaag

SEQ ID NO: 350491 - DNA, 25 bp, Mus musculus
ccggctactagtgcaggccctgaag

SEQ ID NO: 350492 - DNA, 25 bp, Mus musculus
ccggctagacaacgcaagttctcat

SEQ ID NO: 350493 - DNA, 25 bp, Mus musculus
ccggctagacaaggcaagttctcat

SEQ ID NO: 350494 - DNA, 25 bp, Mus musculus
ccggctaggtaccatttcatttctt

SEQ ID NO: 350495 - DNA, 25 bp, Mus musculus
ccggctaggtacgatttcatttctt

SEQ ID NO: 350496 - DNA, 25 bp, Mus musculus
ccggctagttcgagaattggagaaa

SEQ ID NO: 350497 - DNA, 25 bp, Mus musculus
ccggctagttcgtgaattggagaaa

SEQ ID NO: 350498 - DNA, 25 bp, Mus musculus
ccggctatgtcacgcatctgatgaa

SEQ ID NO: 350499 - DNA, 25 bp, Mus musculus
ccggctatgtcaggcatctgatgaa

SEQ ID NO: 350500 - DNA, 25 bp, Mus musculus
ccggctcaccaaccacgaggagaag

SEQ ID NO: 350501 - DNA, 25 bp, Mus musculus
ccggctcaccaagcacgaggagaag

SEQ ID NO: 350502 - DNA, 25 bp, Mus musculus
ccggctcagtaactacagtcactta

SEQ ID NO: 350503 - DNA, 25 bp, Mus musculus
ccggctcagtaagtacagtcactta

SEQ ID NO: 350504 - DNA, 25 bp, Mus musculus
ccggctccaaggacggtcactcact

SEQ ID NO: 350505 - DNA, 25 bp, Mus musculus
ccggctccaaggtcggtcactcact

SEQ ID NO: 350506 - DNA, 25 bp, Mus musculus
ccggctccatagaacagggccaatt

SEQ ID NO: 350507 - DNA, 25 bp, Mus musculus
ccggctccatagtacagggccaatt

SEQ ID NO: 350508 - DNA, 25 bp, Mus musculus
ccggctccgatactttctttggaga

SEQ ID NO: 350509 - DNA, 25 bp, Mus musculus
ccggctccgatagtttctttggaga

SEQ ID NO: 350510 - DNA, 25 bp, Mus musculus
ccggctctcctgcttgggtctcagg

SEQ ID NO: 350511 - DNA, 25 bp, Mus musculus
ccggctctcctggttgggtctcagg

SEQ ID NO: 350512 - DNA, 25 bp, Mus musculus
ccggctctcttgagcagtgctaagg

SEQ ID NO: 350513 - DNA, 25 bp, Mus musculus
ccggctctcttgtgcagtgctaagg

SEQ ID NO: 350514 - DNA, 25 bp, Mus musculus
ccggctctgctgctgtggacaccag

SEQ ID NO: 350515 - DNA, 25 bp, Mus musculus
ccggctctgctggtgtggacaccag

SEQ ID NO: 350516 - DNA, 25 bp, Mus musculus
ccggctcttctaactttcttagtga

SEQ ID NO: 350517 - DNA, 25 bp, Mus musculus
ccggctcttctatctttcttagtga

SEQ ID NO: 350518 - DNA, 25 bp, Mus musculus
ccggctgaagcaccaaagttggagg

SEQ ID NO: 350519 - DNA, 25 bp, Mus musculus
ccggctgaagcagcaaagttggagg

SEQ ID NO: 350520 - DNA, 25 bp, Mus musculus
ccggctgaccaaaatgggcatatgt

SEQ ID NO: 350521 - DNA, 25 bp, Mus musculus
ccggctgaccaatatgggcatatgt

SEQ ID NO: 350522 - DNA, 25 bp, Mus musculus
ccggctgatgagaggaaaagtcaaa

SEQ ID NO: 350523 - DNA, 25 bp, Mus musculus
ccggctgatgagtggaaaagtcaaa

SEQ ID NO: 350524 - DNA, 25 bp, Mus musculus
ccggctgcaaagagcgcgaaccgcg

SEQ ID NO: 350525 - DNA, 25 bp, Mus musculus
ccggctgcaaagtgcgcgaaccgcg

SEQ ID NO: 350526 - DNA, 25 bp, Mus musculus
ccggctgcagagcttagctgatgct

SEQ ID NO: 350527 - DNA, 25 bp, Mus musculus
ccggctgcagaggttagctgatgct

SEQ ID NO: 350528 - DNA, 25 bp, Mus musculus
ccggctgcaggtcgcttaggtgggt

SEQ ID NO: 350529 - DNA, 25 bp, Mus musculus
ccggctgcaggtggcttaggtgggt

SEQ ID NO: 350530 - DNA, 25 bp, Mus musculus
ccggctgcctagatctttgataaaa

SEQ ID NO: 350531 - DNA, 25 bp, Mus musculus
ccggctgcctagttctttgataaaa

SEQ ID NO: 350532 - DNA, 25 bp, Mus musculus
ccggctgcctgtacgggttgctgca

SEQ ID NO: 350533 - DNA, 25 bp, Mus musculus
ccggctgcctgttcgggttgctgca

SEQ ID NO: 350534 - DNA, 25 bp, Mus musculus
ccggctgctgttagtgtaacctaac

SEQ ID NO: 350535 - DNA, 25 bp, Mus musculus
ccggctgctgtttgtgtaacctaac

SEQ ID NO: 350536 - DNA, 25 bp, Mus musculus
ccggctggacatctactcttaacta

SEQ ID NO: 350537 - DNA, 25 bp, Mus musculus
ccggctggacatgtactcttaacta

SEQ ID NO: 350538 - DNA, 25 bp, Mus musculus
ccggctggtccgagggcagtataaa

SEQ ID NO: 350539 - DNA, 25 bp, Mus musculus
ccggctggtccgtgggcagtataaa

SEQ ID NO: 350540 - DNA, 25 bp, Mus musculus
ccggctgttttgcttccccatcagt

SEQ ID NO: 350541 - DNA, 25 bp, Mus musculus
ccggctgttttggttccccatcagt

SEQ ID NO: 350542 - DNA, 25 bp, Mus musculus
ccggcttcaagacatctgtgctggc

SEQ ID NO: 350543 - DNA, 25 bp, Mus musculus
ccggcttcaagagatctgtgctggc

SEQ ID NO: 350544 - DNA, 25 bp, Mus musculus
ccggcttcaggcaattggaagggtt

SEQ ID NO: 350545 - DNA, 25 bp, Mus musculus
ccggcttcaggctattggaagggtt

SEQ ID NO: 350546 - DNA, 25 bp, Mus musculus
ccggcttccctcagagctggcggga

SEQ ID NO: 350547 - DNA, 25 bp, Mus musculus
ccggcttccctctgagctggcggga

SEQ ID NO: 350548 - DNA, 25 bp, Mus musculus
ccggcttccgatctgtaacagcttg

SEQ ID NO: 350549 - DNA, 25 bp, Mus musculus
ccggcttccgatgtgtaacagcttg

SEQ ID NO: 350550 - DNA, 25 bp, Mus musculus
ccggcttgcacactgaagttatatt

SEQ ID NO: 350551 - DNA, 25 bp, Mus musculus
ccggcttgcacagtgaagttatatt

SEQ ID NO: 350552 - DNA, 25 bp, Mus musculus
ccggcttgctgcacagaggttgagc

SEQ ID NO: 350553 - DNA, 25 bp, Mus musculus
ccggcttgctgctcagaggttgagc

SEQ ID NO: 350554 - DNA, 25 bp, Mus musculus
ccggcttgtatcaggtggtctgaga

SEQ ID NO: 350555 - DNA, 25 bp, Mus musculus
ccggcttgtatctggtggtctgaga

SEQ ID NO: 350556 - DNA, 25 bp, Mus musculus
ccggctttacctcctgctttataaa

SEQ ID NO: 350557 - DNA, 25 bp, Mus musculus
ccggctttacctgctgctttataaa

SEQ ID NO: 350558 - DNA, 25 bp, Mus musculus
ccggcttttgttcttcagagaacat

SEQ ID NO: 350559 - DNA, 25 bp, Mus musculus
ccggcttttgttgttcagagaacat

SEQ ID NO: 350560 - DNA, 25 bp, Mus musculus
ccgggaagcacaatggtgtctgcat

SEQ ID NO: 350561 - DNA, 25 bp, Mus musculus
ccgggaagcacattggtgtctgcat

SEQ ID NO: 350562 - DNA, 25 bp, Mus musculus
ccgggaatcaatccctggacattgc

SEQ ID NO: 350563 - DNA, 25 bp, Mus musculus
ccgggaatcaatgcctggacattgc

SEQ ID NO: 350564 - DNA, 25 bp, Mus musculus
ccgggaatcgctctactaactgctt

SEQ ID NO: 350565 - DNA, 25 bp, Mus musculus
ccgggaatcgctgtactaactgctt

SEQ ID NO: 350566 - DNA, 25 bp, Mus musculus
ccgggaatgcttcgcggagtttctt

SEQ ID NO: 350567 - DNA, 25 bp, Mus musculus
ccgggaatgcttggcggagtttctt

SEQ ID NO: 350568 - DNA, 25 bp, Mus musculus
ccgggaattcgacggctgcaacaca

SEQ ID NO: 350569 - DNA, 25 bp, Mus musculus
ccgggaattcgagggctgcaacaca

SEQ ID NO: 350570 - DNA, 25 bp, Mus musculus
ccgggacatcttagagagcgtacgt

SEQ ID NO: 350571 - DNA, 25 bp, Mus musculus
ccgggacatctttgagagcgtacgt

SEQ ID NO: 350572 - DNA, 25 bp, Mus musculus
ccgggacatggcaaacaggatcagt

SEQ ID NO: 350573 - DNA, 25 bp, Mus musculus
ccgggacatggctaacaggatcagt

SEQ ID NO: 350574 - DNA, 25 bp, Mus musculus
ccgggacattgtcctacctgatggc

SEQ ID NO: 350575 - DNA, 25 bp, Mus musculus
ccgggacattgtgctacctgatggc

SEQ ID NO: 350576 - DNA, 25 bp, Mus musculus
ccgggaccagttattaaggcagatg

SEQ ID NO: 350577 - DNA, 25 bp, Mus musculus
ccgggaccagtttttaaggcagatg

SEQ ID NO: 350578 - DNA, 25 bp, Mus musculus
ccgggacccgtgaaactcgagcctg

SEQ ID NO: 350579 - DNA, 25 bp, Mus musculus
ccgggacccgtgtaactcgagcctg

SEQ ID NO: 350580 - DNA, 25 bp, Mus musculus
ccgggacccgttcctgttgaacagt

SEQ ID NO: 350581 - DNA, 25 bp, Mus musculus
ccgggacccgttgctgttgaacagt

SEQ ID NO: 350582 - DNA, 25 bp, Mus musculus
ccgggacccttccaggatattacag

SEQ ID NO: 350583 - DNA, 25 bp, Mus musculus
ccgggacccttcgaggatattacag

SEQ ID NO: 350584 - DNA, 25 bp, Mus musculus
ccgggaccttcaacctatagaacat

SEQ ID NO: 350585 - DNA, 25 bp, Mus musculus
ccgggaccttcatcctatagaacat

SEQ ID NO: 350586 - DNA, 25 bp, Mus musculus
ccgggacggcaactttctgaacatc

SEQ ID NO: 350587 - DNA, 25 bp, Mus musculus
ccgggacggcaagtttctgaacatc

SEQ ID NO: 350588 - DNA, 25 bp, Mus musculus
ccgggactgtttccagtggtcagaa

SEQ ID NO: 350589 - DNA, 25 bp, Mus musculus
ccgggactgtttgcagtggtcagaa

SEQ ID NO: 350590 - DNA, 25 bp, Mus musculus
ccgggagaacaccaaggcaccatca

SEQ ID NO: 350591 - DNA, 25 bp, Mus musculus
ccgggagaacacgaaggcaccatca

SEQ ID NO: 350592 - DNA, 25 bp, Mus musculus
ccgggagagctcctttatctcaaat

SEQ ID NO: 350593 - DNA, 25 bp, Mus musculus
ccgggagagctcgtttatctcaaat

SEQ ID NO: 350594 - DNA, 25 bp, Mus musculus
ccgggagcaggtcaccttcagacct

SEQ ID NO: 350595 - DNA, 25 bp, Mus musculus
ccgggagcaggtgaccttcagacct

SEQ ID NO: 350596 - DNA, 25 bp, Mus musculus
ccgggagcctgtcatcagcagtgaa

SEQ ID NO: 350597 - DNA, 25 bp, Mus musculus
ccgggagcctgtgatcagcagtgaa

SEQ ID NO: 350598 - DNA, 25 bp, Mus musculus
ccgggagctgaaatgctgagttcat

SEQ ID NO: 350599 - DNA, 25 bp, Mus musculus
ccgggagctgaattgctgagttcat

SEQ ID NO: 350600 - DNA, 25 bp, Mus musculus
ccgggagcttggacgacatggaatc

SEQ ID NO: 350601 - DNA, 25 bp, Mus musculus
ccgggagcttggtcgacatggaatc

SEQ ID NO: 350602 - DNA, 25 bp, Mus musculus
ccgggaggtgctattacagaccgct

SEQ ID NO: 350603 - DNA, 25 bp, Mus musculus
ccgggaggtgcttttacagaccgct

SEQ ID NO: 350604 - DNA, 25 bp, Mus musculus
ccgggagtccgtcgagatcatcaac

SEQ ID NO: 350605 - DNA, 25 bp, Mus musculus
ccgggagtccgtggagatcatcaac

SEQ ID NO: 350606 - DNA, 25 bp, Mus musculus
ccgggagttacaatggatccactaa

SEQ ID NO: 350607 - DNA, 25 bp, Mus musculus
ccgggagttacattggatccactaa

SEQ ID NO: 350608 - DNA, 25 bp, Mus musculus
ccgggagttcgacaccaacggtgat

SEQ ID NO: 350609 - DNA, 25 bp, Mus musculus
ccgggagttcgagaccaacggtgat

SEQ ID NO: 350610 - DNA, 25 bp, Mus musculus
ccgggataccacatgttgatcattt

SEQ ID NO: 350611 - DNA, 25 bp, Mus musculus
ccgggataccacttgttgatcattt

SEQ ID NO: 350612 - DNA, 25 bp, Mus musculus
ccgggatcaaagactgttctggcgg

SEQ ID NO: 350613 - DNA, 25 bp, Mus musculus
ccgggatcaaagtctgttctggcgg

SEQ ID NO: 350614 - DNA, 25 bp, Mus musculus
ccgggatctattcatgtgaggtcag

SEQ ID NO: 350615 - DNA, 25 bp, Mus musculus
ccgggatctattgatgtgaggtcag

SEQ ID NO: 350616 - DNA, 25 bp, Mus musculus
ccgggatgtacactgctgggcaact

SEQ ID NO: 350617 - DNA, 25 bp, Mus musculus
ccgggatgtacagtgctgggcaact

SEQ ID NO: 350618 - DNA, 25 bp, Mus musculus
ccgggattggtgacgtcctgagcaa

SEQ ID NO: 350619 - DNA, 25 bp, Mus musculus
ccgggattggtgtcgtcctgagcaa

SEQ ID NO: 350620 - DNA, 25 bp, Mus musculus
ccgggattttctagtgcgagctcag

SEQ ID NO: 350621 - DNA, 25 bp, Mus musculus
ccgggattttcttgtgcgagctcag

SEQ ID NO: 350622 - DNA, 25 bp, Mus musculus
ccgggattttgactggagtctgcct

SEQ ID NO: 350623 - DNA, 25 bp, Mus musculus
ccgggattttgagtggagtctgcct

SEQ ID NO: 350624 - DNA, 25 bp, Mus musculus
ccgggcacacttccatgcttctggg

SEQ ID NO: 350625 - DNA, 25 bp, Mus musculus
ccgggcacacttgcatgcttctggg

SEQ ID NO: 350626 - DNA, 25 bp, Mus musculus
ccgggcactccgcatgctggtcaag

SEQ ID NO: 350627 - DNA, 25 bp, Mus musculus
ccgggcactccggatgctggtcaag

SEQ ID NO: 350628 - DNA, 25 bp, Mus musculus
ccgggcactgtgcttctcggagtat

SEQ ID NO: 350629 - DNA, 25 bp, Mus musculus
ccgggcactgtggttctcggagtat

SEQ ID NO: 350630 - DNA, 25 bp, Mus musculus
ccgggcagacaccatgtaagttata

SEQ ID NO: 350631 - DNA, 25 bp, Mus musculus
ccgggcagacacgatgtaagttata

SEQ ID NO: 350632 - DNA, 25 bp, Mus musculus
ccgggcagcagacgattatggtcta

SEQ ID NO: 350633 - DNA, 25 bp, Mus musculus
ccgggcagcagaggattatggtcta

SEQ ID NO: 350634 - DNA, 25 bp, Mus musculus
ccgggcagcggaaccaggacgtctt

SEQ ID NO: 350635 - DNA, 25 bp, Mus musculus
ccgggcagcggatccaggacgtctt

SEQ ID NO: 350636 - DNA, 25 bp, Mus musculus
ccgggcagctctactttggtgaagg

SEQ ID NO: 350637 - DNA, 25 bp, Mus musculus
ccgggcagctcttctttggtgaagg

SEQ ID NO: 350638 - DNA, 25 bp, Mus musculus
ccgggcagctggaccagttgatgct

SEQ ID NO: 350639 - DNA, 25 bp, Mus musculus
ccgggcagctggtccagttgatgct

SEQ ID NO: 350640 - DNA, 25 bp, Mus musculus
ccgggcagtcataaggtccaggttc

SEQ ID NO: 350641 - DNA, 25 bp, Mus musculus
ccgggcagtcattaggtccaggttc

SEQ ID NO: 350642 - DNA, 25 bp, Mus musculus
ccgggcatgaccagagagggcaaat

SEQ ID NO: 350643 - DNA, 25 bp, Mus musculus
ccgggcatgacctgagagggcaaat

SEQ ID NO: 350644 - DNA, 25 bp, Mus musculus
ccgggcatttccagcgagtgctgga

SEQ ID NO: 350645 - DNA, 25 bp, Mus musculus
ccgggcatttcctgcgagtgctgga

SEQ ID NO: 350646 - DNA, 25 bp, Mus musculus
ccgggccatgatagaggagtttgac

SEQ ID NO: 350647 - DNA, 25 bp, Mus musculus
ccgggccatgattgaggagtttgac

SEQ ID NO: 350648 - DNA, 25 bp, Mus musculus
ccgggccattgccatcgctgcaggc

SEQ ID NO: 350649 - DNA, 25 bp, Mus musculus
ccgggccattgcgatcgctgcaggc

SEQ ID NO: 350650 - DNA, 25 bp, Mus musculus
ccgggcctagaaagggctttgagaa

SEQ ID NO: 350651 - DNA, 25 bp, Mus musculus
ccgggcctagaatgggctttgagaa

SEQ ID NO: 350652 - DNA, 25 bp, Mus musculus
ccgggcgctggcagggctaacttcc

SEQ ID NO: 350653 - DNA, 25 bp, Mus musculus
ccgggcgctggctgggctaacttcc

SEQ ID NO: 350654 - DNA, 25 bp, Mus musculus
ccgggcgggcctacctgactttgct

SEQ ID NO: 350655 - DNA, 25 bp, Mus musculus
ccgggcgggccttcctgactttgct

SEQ ID NO: 350656 - DNA, 25 bp, Mus musculus
ccgggctagagcacatcgatcaaga

SEQ ID NO: 350657 - DNA, 25 bp, Mus musculus
ccgggctagagccacatcatggtat

SEQ ID NO: 350658 - DNA, 25 bp, Mus musculus
ccgggctagagcgacatcatggtat

SEQ ID NO: 350659 - DNA, 25 bp, Mus musculus
ccgggctagagctcatcgatcaaga

SEQ ID NO: 350660 - DNA, 25 bp, Mus musculus
ccgggctaggttctgacttcttaag

SEQ ID NO: 350661 - DNA, 25 bp, Mus musculus
ccgggctaggttgtgacttcttaag

SEQ ID NO: 350662 - DNA, 25 bp, Mus musculus
ccgggctcagcactttttgctcact

SEQ ID NO: 350663 - DNA, 25 bp, Mus musculus
ccgggctcagcagtttttgctcact

SEQ ID NO: 350664 - DNA, 25 bp, Mus musculus
ccgggctccggtacatttatatatt

SEQ ID NO: 350665 - DNA, 25 bp, Mus musculus
ccgggctccggttcatttatatatt

SEQ ID NO: 350666 - DNA, 25 bp, Mus musculus
ccgggctctagtctaaagggagcaa

SEQ ID NO: 350667 - DNA, 25 bp, Mus musculus
ccgggctctagtgtaaagggagcaa

SEQ ID NO: 350668 - DNA, 25 bp, Mus musculus
ccgggctgcagcaacgatctataaa

SEQ ID NO: 350669 - DNA, 25 bp, Mus musculus
ccgggctgcagctacgatctataaa

SEQ ID NO: 350670 - DNA, 25 bp, Mus musculus
ccgggctgccaccaccaagtgacag

SEQ ID NO: 350671 - DNA, 25 bp, Mus musculus
ccgggctgccacgaccaagtgacag

SEQ ID NO: 350672 - DNA, 25 bp, Mus musculus
ccgggctgcgtgatctttattttga

SEQ ID NO: 350673 - DNA, 25 bp, Mus musculus
ccgggctgcgtgttctttattttga

SEQ ID NO: 350674 - DNA, 25 bp, Mus musculus
ccgggctggtttatagtagtgtaga

SEQ ID NO: 350675 - DNA, 25 bp, Mus musculus
ccgggctggtttttagtagtgtaga

SEQ ID NO: 350676 - DNA, 25 bp, Mus musculus
ccgggcttacctccagagcatcacc

SEQ ID NO: 350677 - DNA, 25 bp, Mus musculus
ccgggcttacctgcagagcatcacc

SEQ ID NO: 350678 - DNA, 25 bp, Mus musculus
ccgggcttgtgaccgggtctggaag

SEQ ID NO: 350679 - DNA, 25 bp, Mus musculus
ccgggcttgtgagcgggtctggaag

SEQ ID NO: 350680 - DNA, 25 bp, Mus musculus
ccgggcttttctcatcggaagaggt

SEQ ID NO: 350681 - DNA, 25 bp, Mus musculus
ccgggcttttctgatcggaagaggt

SEQ ID NO: 350682 - DNA, 25 bp, Mus musculus
ccgggcttttgcagctagatatcta

SEQ ID NO: 350683 - DNA, 25 bp, Mus musculus
ccgggcttttgctgctagatatcta

SEQ ID NO: 350684 - DNA, 25 bp, Mus musculus
ccgggtaaggctctgatattaaagg

SEQ ID NO: 350685 - DNA, 25 bp, Mus musculus
ccgggtaaggctgtgatattaaagg

SEQ ID NO: 350686 - DNA, 25 bp, Mus musculus
ccgggtacacgacactagaagccgt

SEQ ID NO: 350687 - DNA, 25 bp, Mus musculus
ccgggtacacgagactagaagccgt

SEQ ID NO: 350688 - DNA, 25 bp, Mus musculus
ccgggtatacttagtggaagaacat

SEQ ID NO: 350689 - DNA, 25 bp, Mus musculus
ccgggtatactttgtggaagaacat

SEQ ID NO: 350690 - DNA, 25 bp, Mus musculus
ccgggtatcgcaacgggcctgtaga

SEQ ID NO: 350691 - DNA, 25 bp, Mus musculus
ccgggtatcgcatcgggcctgtaga

SEQ ID NO: 350692 - DNA, 25 bp, Mus musculus
ccgggtattgctcctgttgatctgg

SEQ ID NO: 350693 - DNA, 25 bp, Mus musculus
ccgggtattgctgctgttgatctgg

SEQ ID NO: 350694 - DNA, 25 bp, Mus musculus
ccgggtcagctcctagaactcatcg

SEQ ID NO: 350695 - DNA, 25 bp, Mus musculus
ccgggtcagctcgtagaactcatcg

SEQ ID NO: 350696 - DNA, 25 bp, Mus musculus
ccgggtccagatcccaaagtgcata

SEQ ID NO: 350697 - DNA, 25 bp, Mus musculus
ccgggtccagatgccaaagtgcata

SEQ ID NO: 350698 - DNA, 25 bp, Mus musculus
ccgggtccttgcatatgctaggtga

SEQ ID NO: 350699 - DNA, 25 bp, Mus musculus
ccgggtccttgcttatgctaggtga

SEQ ID NO: 350700 - DNA, 25 bp, Mus musculus
ccgggtcgcgccagagtcatttggt

SEQ ID NO: 350701 - DNA, 25 bp, Mus musculus
ccgggtcgcgcctgagtcatttggt

SEQ ID NO: 350702 - DNA, 25 bp, Mus musculus
ccgggtcgtgccacatgatgagatt

SEQ ID NO: 350703 - DNA, 25 bp, Mus musculus
ccgggtcgtgcctcatgatgagatt

SEQ ID NO: 350704 - DNA, 25 bp, Mus musculus
ccgggtcttcggatgggccttacag

SEQ ID NO: 350705 - DNA, 25 bp, Mus musculus
ccgggtcttcggttgggccttacag

SEQ ID NO: 350706 - DNA, 25 bp, Mus musculus
ccgggtgaaggcacccaataagtca

SEQ ID NO: 350707 - DNA, 25 bp, Mus musculus
ccgggtgaaggctcccaataagtca

SEQ ID NO: 350708 - DNA, 25 bp, Mus musculus
ccgggtgaatgcagcagactgcaca

SEQ ID NO: 350709 - DNA, 25 bp, Mus musculus
ccgggtgaatgctgcagactgcaca

SEQ ID NO: 350710 - DNA, 25 bp, Mus musculus
ccgggtgcaggaaattaggtaggca

SEQ ID NO: 350711 - DNA, 25 bp, Mus musculus
ccgggtgcaggatattaggtaggca

SEQ ID NO: 350712 - DNA, 25 bp, Mus musculus
ccgggtgctgagcacagcttgttcc

SEQ ID NO: 350713 - DNA, 25 bp, Mus musculus
ccgggtgctgaggacagcttgttcc

SEQ ID NO: 350714 - DNA, 25 bp, Mus musculus
ccgggtggatggactcatttctgaa

SEQ ID NO: 350715 - DNA, 25 bp, Mus musculus
ccgggtggatggtctcatttctgaa

SEQ ID NO: 350716 - DNA, 25 bp, Mus musculus
ccgggtgtctgcacgctgatgcagc

SEQ ID NO: 350717 - DNA, 25 bp, Mus musculus
ccgggtgtctgctcgctgatgcagc

SEQ ID NO: 350718 - DNA, 25 bp, Mus musculus
ccgggttgcattatccaaactggtt

SEQ ID NO: 350719 - DNA, 25 bp, Mus musculus
ccgggttgcattttccaaactggtt

SEQ ID NO: 350720 - DNA, 25 bp, Mus musculus
ccgggtttgaccctgctgcaagcag

SEQ ID NO: 350721 - DNA, 25 bp, Mus musculus
ccgggtttgaccgtgctgcaagcag

SEQ ID NO: 350722 - DNA, 25 bp, Mus musculus
ccgggtttgcctcagccagttgcta

SEQ ID NO: 350723 - DNA, 25 bp, Mus musculus
ccgggtttgcctgagccagttgcta

SEQ ID NO: 350724 - DNA, 25 bp, Mus musculus
ccggtacagcagaggactcacaagg

SEQ ID NO: 350725 - DNA, 25 bp, Mus musculus
ccggtacagcagtggactcacaagg

SEQ ID NO: 350726 - DNA, 25 bp, Mus musculus
ccggtacctagaacagaagctgaag

SEQ ID NO: 350727 - DNA, 25 bp, Mus musculus
ccggtacctagatcagaagctgaag

SEQ ID NO: 350728 - DNA, 25 bp, Mus musculus
ccggtacctgaacgcatttctgtct

SEQ ID NO: 350729 - DNA, 25 bp, Mus musculus
ccggtacctgaaggcatttctgtct

SEQ ID NO: 350730 - DNA, 25 bp, Mus musculus
ccggtagcccctattggtaatgaat

SEQ ID NO: 350731 - DNA, 25 bp, Mus musculus
ccggtagccccttttggtaatgaat

SEQ ID NO: 350732 - DNA, 25 bp, Mus musculus
ccggtagctcacctatgcttattaa

SEQ ID NO: 350733 - DNA, 25 bp, Mus musculus
ccggtagctcacgtatgcttattaa

SEQ ID NO: 350734 - DNA, 25 bp, Mus musculus
ccggtagtgatcagttctgagccga

SEQ ID NO: 350735 - DNA, 25 bp, Mus musculus
ccggtagtgatctgttctgagccga

SEQ ID NO: 350736 - DNA, 25 bp, Mus musculus
ccggtatgggcaagagcctcttctg

SEQ ID NO: 350737 - DNA, 25 bp, Mus musculus
ccggtatgggcatgagcctcttctg

SEQ ID NO: 350738 - DNA, 25 bp, Mus musculus
ccggtattgccaattgcctcattga

SEQ ID NO: 350739 - DNA, 25 bp, Mus musculus
ccggtattgccatttgcctcattga

SEQ ID NO: 350740 - DNA, 25 bp, Mus musculus
ccggtattgctgatgctacgaggtt

SEQ ID NO: 350741 - DNA, 25 bp, Mus musculus
ccggtattgctgttgctacgaggtt

SEQ ID NO: 350742 - DNA, 25 bp, Mus musculus
ccggtcataaacagtctggcgttat

SEQ ID NO: 350743 - DNA, 25 bp, Mus musculus
ccggtcataaactgtctggcgttat

SEQ ID NO: 350744 - DNA, 25 bp, Mus musculus
ccggtccaggcgactaagccaaagt

SEQ ID NO: 350745 - DNA, 25 bp, Mus musculus
ccggtccaggcgtctaagccaaagt

SEQ ID NO: 350746 - DNA, 25 bp, Mus musculus
ccggtccatctactcaaactggaat

SEQ ID NO: 350747 - DNA, 25 bp, Mus musculus
ccggtccatctagtcaaactggaat

SEQ ID NO: 350748 - DNA, 25 bp, Mus musculus
ccggtcccagacaacaagattgaat

SEQ ID NO: 350749 - DNA, 25 bp, Mus musculus
ccggtcccagactacaagattgaat

SEQ ID NO: 350750 - DNA, 25 bp, Mus musculus
ccggtcctacgtcctgtgtgtattc

SEQ ID NO: 350751 - DNA, 25 bp, Mus musculus
ccggtcctacgtgctgtgtgtattc

SEQ ID NO: 350752 - DNA, 25 bp, Mus musculus
ccggtcctagttatgtgcacatttt

SEQ ID NO: 350753 - DNA, 25 bp, Mus musculus
ccggtcctagttttgtgcacatttt

SEQ ID NO: 350754 - DNA, 25 bp, Mus musculus
ccggtcctatcacaggcacatgtaa

SEQ ID NO: 350755 - DNA, 25 bp, Mus musculus
ccggtcctatcagaggcacatgtaa

SEQ ID NO: 350756 - DNA, 25 bp, Mus musculus
ccggtcgagaacccgtgtaagagtc

SEQ ID NO: 350757 - DNA, 25 bp, Mus musculus
ccggtcgagaacgcgtgtaagagtc

SEQ ID NO: 350758 - DNA, 25 bp, Mus musculus
ccggtcgttagtccgacttttacag

SEQ ID NO: 350759 - DNA, 25 bp, Mus musculus
ccggtcgttagtgcgacttttacag

SEQ ID NO: 350760 - DNA, 25 bp, Mus musculus
ccggtctccaggcatttctgaggga

SEQ ID NO: 350761 - DNA, 25 bp, Mus musculus
ccggtctccagggatttctgaggga

SEQ ID NO: 350762 - DNA, 25 bp, Mus musculus
ccggtcttgcgacgtggctggagaa

SEQ ID NO: 350763 - DNA, 25 bp, Mus musculus
ccggtcttgcgaggtggctggagaa

SEQ ID NO: 350764 - DNA, 25 bp, Mus musculus
ccggtgaaatctctgctaccaagtg

SEQ ID NO: 350765 - DNA, 25 bp, Mus musculus
ccggtgaaatctgtgctaccaagtg

SEQ ID NO: 350766 - DNA, 25 bp, Mus musculus
ccggtgaaatgtagacctgttttga

SEQ ID NO: 350767 - DNA, 25 bp, Mus musculus
ccggtgaaatgttgacctgttttga

SEQ ID NO: 350768 - DNA, 25 bp, Mus musculus
ccggtgaatgtgctgactagtgact

SEQ ID NO: 350769 - DNA, 25 bp, Mus musculus
ccggtgaatgtggtgactagtgact

SEQ ID NO: 350770 - DNA, 25 bp, Mus musculus
ccggtgacagccagggttctttaga

SEQ ID NO: 350771 - DNA, 25 bp, Mus musculus
ccggtgacagcctgggttctttaga

SEQ ID NO: 350772 - DNA, 25 bp, Mus musculus
ccggtgactgttactcttgtttggg

SEQ ID NO: 350773 - DNA, 25 bp, Mus musculus
ccggtgactgtttctcttgtttggg

SEQ ID NO: 350774 - DNA, 25 bp, Mus musculus
ccggtgatagcaaggattgattttt

SEQ ID NO: 350775 - DNA, 25 bp, Mus musculus
ccggtgatagcatggattgattttt

SEQ ID NO: 350776 - DNA, 25 bp, Mus musculus
ccggtgcaccaaatcctgtatgaag

SEQ ID NO: 350777 - DNA, 25 bp, Mus musculus
ccggtgcaccaattcctgtatgaag

SEQ ID NO: 350778 - DNA, 25 bp, Mus musculus
ccggtgcagtgcagctttgaggcca

SEQ ID NO: 350779 - DNA, 25 bp, Mus musculus
ccggtgcagtgctgctttgaggcca

SEQ ID NO: 350780 - DNA, 25 bp, Mus musculus
ccggtgccagcccattgagtttgat

SEQ ID NO: 350781 - DNA, 25 bp, Mus musculus
ccggtgccagccgattgagtttgat

SEQ ID NO: 350782 - DNA, 25 bp, Mus musculus
ccggtgctgcagctgatagtttctt

SEQ ID NO: 350783 - DNA, 25 bp, Mus musculus
ccggtgctgcaggtgatagtttctt

SEQ ID NO: 350784 - DNA, 25 bp, Mus musculus
ccggtgctggacagttttgttgaaa

SEQ ID NO: 350785 - DNA, 25 bp, Mus musculus
ccggtgctggactgttttgttgaaa

SEQ ID NO: 350786 - DNA, 25 bp, Mus musculus
ccggtgcttaggataggctatattc

SEQ ID NO: 350787 - DNA, 25 bp, Mus musculus
ccggtgcttaggttaggctatattc

SEQ ID NO: 350788 - DNA, 25 bp, Mus musculus
ccggtgcttctgatgttgtgggttt

SEQ ID NO: 350789 - DNA, 25 bp, Mus musculus
ccggtgcttctgttgttgtgggttt

SEQ ID NO: 350790 - DNA, 25 bp, Mus musculus
ccggtggagagcctccctggcattc

SEQ ID NO: 350791 - DNA, 25 bp, Mus musculus
ccggtggagagcgtccctggcattc

SEQ ID NO: 350792 - DNA, 25 bp, Mus musculus
ccggtggcaccgcaagaatgctatg

SEQ ID NO: 350793 - DNA, 25 bp, Mus musculus
ccggtggcaccggaagaatgctatg

SEQ ID NO: 350794 - DNA, 25 bp, Mus musculus
ccggtggcgtgcaaacctagtatgt

SEQ ID NO: 350795 - DNA, 25 bp, Mus musculus
ccggtggcgtgctaacctagtatgt

SEQ ID NO: 350796 - DNA, 25 bp, Mus musculus
ccggtgggcagaacgagctacgttc

SEQ ID NO: 350797 - DNA, 25 bp, Mus musculus
ccggtgggcagatcgagctacgttc

SEQ ID NO: 350798 - DNA, 25 bp, Mus musculus
ccggtggtacctcaagatgaaatgt

SEQ ID NO: 350799 - DNA, 25 bp, Mus musculus
ccggtggtacctgaagatgaaatgt

SEQ ID NO: 350800 - DNA, 25 bp, Mus musculus
ccggtgtcggtgacggtacacatct

SEQ ID NO: 350801 - DNA, 25 bp, Mus musculus
ccggtgtcggtgtcggtacacatct

SEQ ID NO: 350802 - DNA, 25 bp, Mus musculus
ccggtgtgaattcttgctgctcttt

SEQ ID NO: 350803 - DNA, 25 bp, Mus musculus
ccggtgtgaattgttgctgctcttt

SEQ ID NO: 350804 - DNA, 25 bp, Mus musculus
ccggtgtgctttcactgttctacaa

SEQ ID NO: 350805 - DNA, 25 bp, Mus musculus
ccggtgtgctttgactgttctacaa

SEQ ID NO: 350806 - DNA, 25 bp, Mus musculus
ccggttcagggcagcctgccaacag

SEQ ID NO: 350807 - DNA, 25 bp, Mus musculus
ccggttcagggctgcctgccaacag

SEQ ID NO: 350808 - DNA, 25 bp, Mus musculus
ccggttcgcaggcacagtgcacgca

SEQ ID NO: 350809 - DNA, 25 bp, Mus musculus
ccggttcgcagggacagtgcacgca

SEQ ID NO: 350810 - DNA, 25 bp, Mus musculus
ccggttctgggacgcctatcttaca

SEQ ID NO: 350811 - DNA, 25 bp, Mus musculus
ccggttctgggaggcctatcttaca

SEQ ID NO: 350812 - DNA, 25 bp, Mus musculus
ccggttgagcttagagtggagcaat

SEQ ID NO: 350813 - DNA, 25 bp, Mus musculus
ccggttgagctttgagtggagcaat

SEQ ID NO: 350814 - DNA, 25 bp, Mus musculus
ccggttgcgataacggctgcgcccg

SEQ ID NO: 350815 - DNA, 25 bp, Mus musculus
ccggttgcgatatcggctgcgcccg

SEQ ID NO: 350816 - DNA, 25 bp, Mus musculus
ccggttgctgacatgctgcaccttg

SEQ ID NO: 350817 - DNA, 25 bp, Mus musculus
ccggttgctgacttgctgcaccttg

SEQ ID NO: 350818 - DNA, 25 bp, Mus musculus
ccggtttattgtcatgttctgcctt

SEQ ID NO: 350819 - DNA, 25 bp, Mus musculus
ccggtttattgtgatgttctgcctt

SEQ ID NO: 350820 - DNA, 25 bp, Mus musculus
ccggtttcccatatgcacatgagtg

SEQ ID NO: 350821 - DNA, 25 bp, Mus musculus
ccggtttcccatttgcacatgagtg

SEQ ID NO: 350822 - DNA, 25 bp, Mus musculus
ccggtttgccctcggatattataga

SEQ ID NO: 350823 - DNA, 25 bp, Mus musculus
ccggtttgccctgggatattataga

SEQ ID NO: 350824 - DNA, 25 bp, Mus musculus
ccggttttctcaagatgcactcgag

SEQ ID NO: 350825 - DNA, 25 bp, Mus musculus
ccggttttctcatgatgcactcgag

SEQ ID NO: 350826 - DNA, 25 bp, Mus musculus
ccgtaaagctagaagcctgacattt

SEQ ID NO: 350827 - DNA, 25 bp, Mus musculus
ccgtaaagctagtagcctgacattt

SEQ ID NO: 350828 - DNA, 25 bp, Mus musculus
ccgtaacaaatacctgggccaacag

SEQ ID NO: 350829 - DNA, 25 bp, Mus musculus
ccgtaacaaatagctgggccaacag

SEQ ID NO: 350830 - DNA, 25 bp, Mus musculus
ccgtaactcaagctgaactgtgaaa

SEQ ID NO: 350831 - DNA, 25 bp, Mus musculus
ccgtaactcaaggtgaactgtgaaa

SEQ ID NO: 350832 - DNA, 25 bp, Mus musculus
ccgtaagacaagagtatagggacag

SEQ ID NO: 350833 - DNA, 25 bp, Mus musculus
ccgtaagacaagtgtatagggacag

SEQ ID NO: 350834 - DNA, 25 bp, Mus musculus
ccgtaagaggttagacagccgaaat

SEQ ID NO: 350835 - DNA, 25 bp, Mus musculus
ccgtaagaggtttgacagccgaaat

SEQ ID NO: 350836 - DNA, 25 bp, Mus musculus
ccgtaagccttacttgtatataaat

SEQ ID NO: 350837 - DNA, 25 bp, Mus musculus
ccgtaagccttagttgtatataaat

SEQ ID NO: 350838 - DNA, 25 bp, Mus musculus
ccgtaagtcagtcgcatggtgtctt

SEQ ID NO: 350839 - DNA, 25 bp, Mus musculus
ccgtaagtcagtggcatggtgtctt

SEQ ID NO: 350840 - DNA, 25 bp, Mus musculus
ccgtaatagggtattcaggtgcttt

SEQ ID NO: 350841 - DNA, 25 bp, Mus musculus
ccgtaatagggttttcaggtgcttt

SEQ ID NO: 350842 - DNA, 25 bp, Mus musculus
ccgtaatctgatccaagccagctat

SEQ ID NO: 350843 - DNA, 25 bp, Mus musculus
ccgtaatctgatgcaagccagctat

SEQ ID NO: 350844 - DNA, 25 bp, Mus musculus
ccgtaatggtaaatgactgattgat

SEQ ID NO: 350845 - DNA, 25 bp, Mus musculus
ccgtaatggtaattgactgattgat

SEQ ID NO: 350846 - DNA, 25 bp, Mus musculus
ccgtaatgtgatacctgattagagt

SEQ ID NO: 350847 - DNA, 25 bp, Mus musculus
ccgtaatgtgattcctgattagagt

SEQ ID NO: 350848 - DNA, 25 bp, Mus musculus
ccgtaattatgtaccatgaatattt

SEQ ID NO: 350849 - DNA, 25 bp, Mus musculus
ccgtaattatgttccatgaatattt

SEQ ID NO: 350850 - DNA, 25 bp, Mus musculus
ccgtacaacagcctgggtttttgat

SEQ ID NO: 350851 - DNA, 25 bp, Mus musculus
ccgtacaacagcgtgggtttttgat

SEQ ID NO: 350852 - DNA, 25 bp, Mus musculus
ccgtacaccagcacacatataggca

SEQ ID NO: 350853 - DNA, 25 bp, Mus musculus
ccgtacaccagctcacatataggca

SEQ ID NO: 350854 - DNA, 25 bp, Mus musculus
ccgtacagaaatcgtcttcactgga

SEQ ID NO: 350855 - DNA, 25 bp, Mus musculus
ccgtacagaaatggtcttcactgga

SEQ ID NO: 350856 - DNA, 25 bp, Mus musculus
ccgtaccctgctatcctgacatggg

SEQ ID NO: 350857 - DNA, 25 bp, Mus musculus
ccgtaccctgctttcctgacatggg

SEQ ID NO: 350858 - DNA, 25 bp, Mus musculus
ccgtacgattcacgcataattttat

SEQ ID NO: 350859 - DNA, 25 bp, Mus musculus
ccgtacgattcaggcataattttat

SEQ ID NO: 350860 - DNA, 25 bp, Mus musculus
ccgtacgatttgcttgtcatttcac

SEQ ID NO: 350861 - DNA, 25 bp, Mus musculus
ccgtacgatttggttgtcatttcac

SEQ ID NO: 350862 - DNA, 25 bp, Mus musculus
ccgtactcgcacaatgatttttact

SEQ ID NO: 350863 - DNA, 25 bp, Mus musculus
ccgtactcgcactatgatttttact

SEQ ID NO: 350864 - DNA, 25 bp, Mus musculus
ccgtactgtcacagcggcaacggcg

SEQ ID NO: 350865 - DNA, 25 bp, Mus musculus
ccgtactgtcactgcggcaacggcg

SEQ ID NO: 350866 - DNA, 25 bp, Mus musculus
ccgtacttagatcggctcattgaga

SEQ ID NO: 350867 - DNA, 25 bp, Mus musculus
ccgtacttagatgggctcattgaga

SEQ ID NO: 350868 - DNA, 25 bp, Mus musculus
ccgtactttctactgagtctaagga

SEQ ID NO: 350869 - DNA, 25 bp, Mus musculus
ccgtactttctagtgagtctaagga

SEQ ID NO: 350870 - DNA, 25 bp, Mus musculus
ccgtactttctgaaggtcattgcta

SEQ ID NO: 350871 - DNA, 25 bp, Mus musculus
ccgtactttctgtaggtcattgcta

SEQ ID NO: 350872 - DNA, 25 bp, Mus musculus
ccgtagacatagaccatctgtttgt

SEQ ID NO: 350873 - DNA, 25 bp, Mus musculus
ccgtagacatagtccatctgtttgt

SEQ ID NO: 350874 - DNA, 25 bp, Mus musculus
ccgtagcatcttcagggacattgtt

SEQ ID NO: 350875 - DNA, 25 bp, Mus musculus
ccgtagcatcttgagggacattgtt

SEQ ID NO: 350876 - DNA, 25 bp, Mus musculus
ccgtagcgatgaagcactgctggca

SEQ ID NO: 350877 - DNA, 25 bp, Mus musculus
ccgtagcgatgatgcactgctggca

SEQ ID NO: 350878 - DNA, 25 bp, Mus musculus
ccgtagctatatagtcctagaactt

SEQ ID NO: 350879 - DNA, 25 bp, Mus musculus
ccgtagctatattgtcctagaactt

SEQ ID NO: 350880 - DNA, 25 bp, Mus musculus
ccgtagctatggcattgcatgggct

SEQ ID NO: 350881 - DNA, 25 bp, Mus musculus
ccgtagctatgggattgcatgggct

SEQ ID NO: 350882 - DNA, 25 bp, Mus musculus
ccgtagctctgtctaatgggaactt

SEQ ID NO: 350883 - DNA, 25 bp, Mus musculus
ccgtagctctgtgtaatgggaactt

SEQ ID NO: 350884 - DNA, 25 bp, Mus musculus
ccgtagctgcttctgcagcctcggg

SEQ ID NO: 350885 - DNA, 25 bp, Mus musculus
ccgtagctgcttgtgcagcctcggg

SEQ ID NO: 350886 - DNA, 25 bp, Mus musculus
ccgtagctgggaagtgagctaattc

SEQ ID NO: 350887 - DNA, 25 bp, Mus musculus
ccgtagctgggatgtgagctaattc

SEQ ID NO: 350888 - DNA, 25 bp, Mus musculus
ccgtaggaggtaatatttcttgtct

SEQ ID NO: 350889 - DNA, 25 bp, Mus musculus
ccgtaggaggtattatttcttgtct

SEQ ID NO: 350890 - DNA, 25 bp, Mus musculus
ccgtaggctccgagaattcttggta

SEQ ID NO: 350891 - DNA, 25 bp, Mus musculus
ccgtaggctccgtgaattcttggta

SEQ ID NO: 350892 - DNA, 25 bp, Mus musculus
ccgtaggctttgatttgtctcagta

SEQ ID NO: 350893 - DNA, 25 bp, Mus musculus
ccgtaggctttgttttgtctcagta

SEQ ID NO: 350894 - DNA, 25 bp, Mus musculus
ccgtaggtattcagggatgctgctg

SEQ ID NO: 350895 - DNA, 25 bp, Mus musculus
ccgtaggtattctgggatgctgctg

SEQ ID NO: 350896 - DNA, 25 bp, Mus musculus
ccgtagtttcatctgagggctgtaa

SEQ ID NO: 350897 - DNA, 25 bp, Mus musculus
ccgtagtttcatgtgagggctgtaa

SEQ ID NO: 350898 - DNA, 25 bp, Mus musculus
ccgtatctgtgtcaactgggagtct

SEQ ID NO: 350899 - DNA, 25 bp, Mus musculus
ccgtatctgtgtgaactgggagtct

SEQ ID NO: 350900 - DNA, 25 bp, Mus musculus
ccgtatgctttaagcccagatggac

SEQ ID NO: 350901 - DNA, 25 bp, Mus musculus
ccgtatgctttatgcccagatggac

SEQ ID NO: 350902 - DNA, 25 bp, Mus musculus
ccgtatggttctaacctgatttcct

SEQ ID NO: 350903 - DNA, 25 bp, Mus musculus
ccgtatggttcttacctgatttcct

SEQ ID NO: 350904 - DNA, 25 bp, Mus musculus
ccgtattacctaatgtgaacctaat

SEQ ID NO: 350905 - DNA, 25 bp, Mus musculus
ccgtattacctattgtgaacctaat

SEQ ID NO: 350906 - DNA, 25 bp, Mus musculus
ccgtattcatacagtgttgttctaa

SEQ ID NO: 350907 - DNA, 25 bp, Mus musculus
ccgtattcatactgtgttgttctaa

SEQ ID NO: 350908 - DNA, 25 bp, Mus musculus
ccgtattcctgactgtgttgtactt

SEQ ID NO: 350909 - DNA, 25 bp, Mus musculus
ccgtattcctgagtgtgttgtactt

SEQ ID NO: 350910 - DNA, 25 bp, Mus musculus
ccgtatttgctgatatctgctccct

SEQ ID NO: 350911 - DNA, 25 bp, Mus musculus
ccgtatttgctgttatctgctccct

SEQ ID NO: 350912 - DNA, 25 bp, Mus musculus
ccgtcaatacatcatgggaattcac

SEQ ID NO: 350913 - DNA, 25 bp, Mus musculus
ccgtcaatacatgatgggaattcac

SEQ ID NO: 350914 - DNA, 25 bp, Mus musculus
ccgtcacacagcacaaagttcagca

SEQ ID NO: 350915 - DNA, 25 bp, Mus musculus
ccgtcacacagctcaaagttcagca

SEQ ID NO: 350916 - DNA, 25 bp, Mus musculus
ccgtcacactgcacaaccaaaaagg

SEQ ID NO: 350917 - DNA, 25 bp, Mus musculus
ccgtcacactgctcaaccaaaaagg

SEQ ID NO: 350918 - DNA, 25 bp, Mus musculus
ccgtcaccagggacagcctctgaag

SEQ ID NO: 350919 - DNA, 25 bp, Mus musculus
ccgtcaccagggtcagcctctgaag

SEQ ID NO: 350920 - DNA, 25 bp, Mus musculus
ccgtcacctcgaaagttttattgta

SEQ ID NO: 350921 - DNA, 25 bp, Mus musculus
ccgtcacctcgatagttttattgta

SEQ ID NO: 350922 - DNA, 25 bp, Mus musculus
ccgtcactgacgacatcatcaagaa

SEQ ID NO: 350923 - DNA, 25 bp, Mus musculus
ccgtcactgacgtcatcatcaagaa

SEQ ID NO: 350924 - DNA, 25 bp, Mus musculus
ccgtcactgatacactggtagacat

SEQ ID NO: 350925 - DNA, 25 bp, Mus musculus
ccgtcactgatagactggtagacat

SEQ ID NO: 350926 - DNA, 25 bp, Mus musculus
ccgtcagccttgaggagtaccttaa

SEQ ID NO: 350927 - DNA, 25 bp, Mus musculus
ccgtcagccttgtggagtaccttaa

SEQ ID NO: 350928 - DNA, 25 bp, Mus musculus
ccgtcagctcgtctgtgttaaagca

SEQ ID NO: 350929 - DNA, 25 bp, Mus musculus
ccgtcagctcgtgtgtgttaaagca

SEQ ID NO: 350930 - DNA, 25 bp, Mus musculus
ccgtcagggccaactagaagcatgt

SEQ ID NO: 350931 - DNA, 25 bp, Mus musculus
ccgtcagggccatctagaagcatgt

SEQ ID NO: 350932 - DNA, 25 bp, Mus musculus
ccgtcagggctgctaggctcttgta

SEQ ID NO: 350933 - DNA, 25 bp, Mus musculus
ccgtcagggctggtaggctcttgta

SEQ ID NO: 350934 - DNA, 25 bp, Mus musculus
ccgtcagtcatcacattaatatacc

SEQ ID NO: 350935 - DNA, 25 bp, Mus musculus
ccgtcagtcatctcattaatatacc

SEQ ID NO: 350936 - DNA, 25 bp, Mus musculus
ccgtcatatacgaacccgcagatga

SEQ ID NO: 350937 - DNA, 25 bp, Mus musculus
ccgtcatatacgtacccgcagatga

SEQ ID NO: 350938 - DNA, 25 bp, Mus musculus
ccgtcatccagcaagaagctgctga

SEQ ID NO: 350939 - DNA, 25 bp, Mus musculus
ccgtcatccagctagaagctgctga

SEQ ID NO: 350940 - DNA, 25 bp, Mus musculus
ccgtcatcgtcaccatgtcttatat

SEQ ID NO: 350941 - DNA, 25 bp, Mus musculus
ccgtcatcgtcagcatgtcttatat

SEQ ID NO: 350942 - DNA, 25 bp, Mus musculus
ccgtcatctcaacttatttccctgt

SEQ ID NO: 350943 - DNA, 25 bp, Mus musculus
ccgtcatctcaagttatttccctgt

SEQ ID NO: 350944 - DNA, 25 bp, Mus musculus
ccgtcatctttaatcgggtgcttga

SEQ ID NO: 350945 - DNA, 25 bp, Mus musculus
ccgtcatctttattcgggtgcttga

SEQ ID NO: 350946 - DNA, 25 bp, Mus musculus
ccgtcatgccgcagcaggttaatta

SEQ ID NO: 350947 - DNA, 25 bp, Mus musculus
ccgtcatgccgctgcaggttaatta

SEQ ID NO: 350948 - DNA, 25 bp, Mus musculus
ccgtcatgcttgagctgttgatcaa

SEQ ID NO: 350949 - DNA, 25 bp, Mus musculus
ccgtcatgcttgtgctgttgatcaa

SEQ ID NO: 350950 - DNA, 25 bp, Mus musculus
ccgtcattagctatgaatgcccact

SEQ ID NO: 350951 - DNA, 25 bp, Mus musculus
ccgtcattagctttgaatgcccact

SEQ ID NO: 350952 - DNA, 25 bp, Mus musculus
ccgtcattccaaaccacatatgttt

SEQ ID NO: 350953 - DNA, 25 bp, Mus musculus
ccgtcattccaatccacatatgttt

SEQ ID NO: 350954 - DNA, 25 bp, Mus musculus
ccgtcattcttgagagttactgtct

SEQ ID NO: 350955 - DNA, 25 bp, Mus musculus
ccgtcattcttgtgagttactgtct

SEQ ID NO: 350956 - DNA, 25 bp, Mus musculus
ccgtcattgactctgacctccataa

SEQ ID NO: 350957 - DNA, 25 bp, Mus musculus
ccgtcattgactgtgacctccataa

SEQ ID NO: 350958 - DNA, 25 bp, Mus musculus
ccgtcattgagtacctgatttttaa

SEQ ID NO: 350959 - DNA, 25 bp, Mus musculus
ccgtcattgagttcctgatttttaa

SEQ ID NO: 350960 - DNA, 25 bp, Mus musculus
ccgtccaacattaaatcagtgtatg

SEQ ID NO: 350961 - DNA, 25 bp, Mus musculus
ccgtccaacatttaatcagtgtatg

SEQ ID NO: 350962 - DNA, 25 bp, Mus musculus
ccgtccacagatacattcattccta

SEQ ID NO: 350963 - DNA, 25 bp, Mus musculus
ccgtccacagattcattcattccta

SEQ ID NO: 350964 - DNA, 25 bp, Mus musculus
ccgtccactcttaaagcccatttat

SEQ ID NO: 350965 - DNA, 25 bp, Mus musculus
ccgtccactctttaagcccatttat

SEQ ID NO: 350966 - DNA, 25 bp, Mus musculus
ccgtccagttagcttcttgggcaga

SEQ ID NO: 350967 - DNA, 25 bp, Mus musculus
ccgtccagttaggttcttgggcaga

SEQ ID NO: 350968 - DNA, 25 bp, Mus musculus
ccgtccatttcaagtcattggtaat

SEQ ID NO: 350969 - DNA, 25 bp, Mus musculus
ccgtccatttcatgtcattggtaat

SEQ ID NO: 350970 - DNA, 25 bp, Mus musculus
ccgtcccacgatcgaagcatgtgaa

SEQ ID NO: 350971 - DNA, 25 bp, Mus musculus
ccgtcccacgatggaagcatgtgaa

SEQ ID NO: 350972 - DNA, 25 bp, Mus musculus
ccgtcccagggtcaagtcagttatg

SEQ ID NO: 350973 - DNA, 25 bp, Mus musculus
ccgtcccagggtgaagtcagttatg

SEQ ID NO: 350974 - DNA, 25 bp, Mus musculus
ccgtcccggtgcatgatagctagga

SEQ ID NO: 350975 - DNA, 25 bp, Mus musculus
ccgtcccggtgcttgatagctagga

SEQ ID NO: 350976 - DNA, 25 bp, Mus musculus
ccgtccctggacagtgaggtcagat

SEQ ID NO: 350977 - DNA, 25 bp, Mus musculus
ccgtccctggactgtgaggtcagat

SEQ ID NO: 350978 - DNA, 25 bp, Mus musculus
ccgtcccttagtcccaaagagctag

SEQ ID NO: 350979 - DNA, 25 bp, Mus musculus
ccgtcccttagtgccaaagagctag

SEQ ID NO: 350980 - DNA, 25 bp, Mus musculus
ccgtcccttcagatacacactgaaa

SEQ ID NO: 350981 - DNA, 25 bp, Mus musculus
ccgtcccttcagttacacactgaaa

SEQ ID NO: 350982 - DNA, 25 bp, Mus musculus
ccgtccgaggttagattccgtgatt

SEQ ID NO: 350983 - DNA, 25 bp, Mus musculus
ccgtccgaggtttgattccgtgatt

SEQ ID NO: 350984 - DNA, 25 bp, Mus musculus
ccgtcctcagcaattcataatctag

SEQ ID NO: 350985 - DNA, 25 bp, Mus musculus
ccgtcctcagcatttcataatctag

SEQ ID NO: 350986 - DNA, 25 bp, Mus musculus
ccgtcctcgtatactgttgcaggga

SEQ ID NO: 350987 - DNA, 25 bp, Mus musculus
ccgtcctcgtattctgttgcaggga

SEQ ID NO: 350988 - DNA, 25 bp, Mus musculus
ccgtcctctaagactagctcataag

SEQ ID NO: 350989 - DNA, 25 bp, Mus musculus
ccgtcctctaagtctagctcataag

SEQ ID NO: 350990 - DNA, 25 bp, Mus musculus
ccgtcctggaggctgtgatcctggt

SEQ ID NO: 350991 - DNA, 25 bp, Mus musculus
ccgtcctggagggtgtgatcctggt

SEQ ID NO: 350992 - DNA, 25 bp, Mus musculus
ccgtccttcactcaaatcgaaacta

SEQ ID NO: 350993 - DNA, 25 bp, Mus musculus
ccgtccttcactgaaatcgaaacta

SEQ ID NO: 350994 - DNA, 25 bp, Mus musculus
ccgtcgagctggaagctggctgtaa

SEQ ID NO: 350995 - DNA, 25 bp, Mus musculus
ccgtcgagctggtagctggctgtaa

SEQ ID NO: 350996 - DNA, 25 bp, Mus musculus
ccgtcgggctatcagggtacattaa

SEQ ID NO: 350997 - DNA, 25 bp, Mus musculus
ccgtcgggctatgagggtacattaa

SEQ ID NO: 350998 - DNA, 25 bp, Mus musculus
ccgtcgtcgccaaggtgaagctgag

SEQ ID NO: 350999 - DNA, 25 bp, Mus musculus
ccgtcgtcgccatggtgaagctgag

SEQ ID NO: 351000 - DNA, 25 bp, Mus musculus
ccgtcgttcatcacgttcaatctgg

SEQ ID NO: 351001 - DNA, 25 bp, Mus musculus
ccgtcgttcatctcgttcaatctgg

SEQ ID NO: 351002 - DNA, 25 bp, Mus musculus
ccgtcgtttgttatccatggatgca

SEQ ID NO: 351003 - DNA, 25 bp, Mus musculus
ccgtcgtttgttttccatggatgca

SEQ ID NO: 351004 - DNA, 25 bp, Mus musculus
ccgtctaatgaacgactgcttccta

SEQ ID NO: 351005 - DNA, 25 bp, Mus musculus
ccgtctaatgaaggactgcttccta

SEQ ID NO: 351006 - DNA, 25 bp, Mus musculus
ccgtctagaaaaagagcgcaaggct

SEQ ID NO: 351007 - DNA, 25 bp, Mus musculus
ccgtctagaaaatgagcgcaaggct

SEQ ID NO: 351008 - DNA, 25 bp, Mus musculus
ccgtctaggctgcagctataggctt

SEQ ID NO: 351009 - DNA, 25 bp, Mus musculus
ccgtctaggctggagctataggctt

SEQ ID NO: 351010 - DNA, 25 bp, Mus musculus
ccgtctcacagaacagggaaagcaa

SEQ ID NO: 351011 - DNA, 25 bp, Mus musculus
ccgtctcacagatcagggaaagcaa

SEQ ID NO: 351012 - DNA, 25 bp, Mus musculus
ccgtctcagtccactgtaacgacaa

SEQ ID NO: 351013 - DNA, 25 bp, Mus musculus
ccgtctcagtcctctgtaacgacaa

SEQ ID NO: 351014 - DNA, 25 bp, Mus musculus
ccgtctctaagtctatagaacgaat

SEQ ID NO: 351015 - DNA, 25 bp, Mus musculus
ccgtctctaagtgtatagaacgaat

SEQ ID NO: 351016 - DNA, 25 bp, Mus musculus
ccgtctctcctgattcttgataata

SEQ ID NO: 351017 - DNA, 25 bp, Mus musculus
ccgtctctcctgtttcttgataata

SEQ ID NO: 351018 - DNA, 25 bp, Mus musculus
ccgtctcttcctattcgaagcaata

SEQ ID NO: 351019 - DNA, 25 bp, Mus musculus
ccgtctcttccttttcgaagcaata

SEQ ID NO: 351020 - DNA, 25 bp, Mus musculus
ccgtctgaagaaactgcaccaggaa

SEQ ID NO: 351021 - DNA, 25 bp, Mus musculus
ccgtctgaagaatctgcaccaggaa

SEQ ID NO: 351022 - DNA, 25 bp, Mus musculus
ccgtctgagatgaacctttggctgt

SEQ ID NO: 351023 - DNA, 25 bp, Mus musculus
ccgtctgagatgtacctttggctgt

SEQ ID NO: 351024 - DNA, 25 bp, Mus musculus
ccgtctgccttaaacatctatcttg

SEQ ID NO: 351025 - DNA, 25 bp, Mus musculus
ccgtctgccttatacatctatcttg

SEQ ID NO: 351026 - DNA, 25 bp, Mus musculus
ccgtctgcggcacatcttcaatggc

SEQ ID NO: 351027 - DNA, 25 bp, Mus musculus
ccgtctgcggcagatcttcaatggc

SEQ ID NO: 351028 - DNA, 25 bp, Mus musculus
ccgtctgctgcaatgcccagttggc

SEQ ID NO: 351029 - DNA, 25 bp, Mus musculus
ccgtctgctgcattgcccagttggc

SEQ ID NO: 351030 - DNA, 25 bp, Mus musculus
ccgtctggacgacgcagagcagatc

SEQ ID NO: 351031 - DNA, 25 bp, Mus musculus
ccgtctggacgaggcagagcagatc

SEQ ID NO: 351032 - DNA, 25 bp, Mus musculus
ccgtctggcagcattaggaaatttt

SEQ ID NO: 351033 - DNA, 25 bp, Mus musculus
ccgtctggcagctttaggaaatttt

SEQ ID NO: 351034 - DNA, 25 bp, Mus musculus
ccgtctggcttgagcctaaatggca

SEQ ID NO: 351035 - DNA, 25 bp, Mus musculus
ccgtctggcttgtgcctaaatggca

SEQ ID NO: 351036 - DNA, 25 bp, Mus musculus
ccgtctgggagtctgatctgctaaa

SEQ ID NO: 351037 - DNA, 25 bp, Mus musculus
ccgtctgggagtgtgatctgctaaa

SEQ ID NO: 351038 - DNA, 25 bp, Mus musculus
ccgtctgtacaaaggatcaacaatt

SEQ ID NO: 351039 - DNA, 25 bp, Mus musculus
ccgtctgtacaatggatcaacaatt

SEQ ID NO: 351040 - DNA, 25 bp, Mus musculus
ccgtctgtatttcgatctttaactg

SEQ ID NO: 351041 - DNA, 25 bp, Mus musculus
ccgtctgtatttggatctttaactg

SEQ ID NO: 351042 - DNA, 25 bp, Mus musculus
ccgtctgtcctgcagcgaactataa

SEQ ID NO: 351043 - DNA, 25 bp, Mus musculus
ccgtctgtcctggagcgaactataa

SEQ ID NO: 351044 - DNA, 25 bp, Mus musculus
ccgtctgtcttccatgttgttagaa

SEQ ID NO: 351045 - DNA, 25 bp, Mus musculus
ccgtctgtcttcgatgttgttagaa

SEQ ID NO: 351046 - DNA, 25 bp, Mus musculus
ccgtctgtcttgctgtttggcataa

SEQ ID NO: 351047 - DNA, 25 bp, Mus musculus
ccgtctgtcttggtgtttggcataa

SEQ ID NO: 351048 - DNA, 25 bp, Mus musculus
ccgtctgtttatatttgctttcctg

SEQ ID NO: 351049 - DNA, 25 bp, Mus musculus
ccgtctgtttatttttgctttcctg

SEQ ID NO: 351050 - DNA, 25 bp, Mus musculus
ccgtcttcctgaaggtgacctgcat

SEQ ID NO: 351051 - DNA, 25 bp, Mus musculus
ccgtcttcctgatggtgacctgcat

SEQ ID NO: 351052 - DNA, 25 bp, Mus musculus
ccgtcttgatttcctgttgatttct

SEQ ID NO: 351053 - DNA, 25 bp, Mus musculus
ccgtcttgatttgctgttgatttct

SEQ ID NO: 351054 - DNA, 25 bp, Mus musculus
ccgtcttggttcagtactatatcta

SEQ ID NO: 351055 - DNA, 25 bp, Mus musculus
ccgtcttggttctgtactatatcta

SEQ ID NO: 351056 - DNA, 25 bp, Mus musculus
ccgtcttgtggcattctttgtcttt

SEQ ID NO: 351057 - DNA, 25 bp, Mus musculus
ccgtcttgtggctttctttgtcttt

SEQ ID NO: 351058 - DNA, 25 bp, Mus musculus
ccgtctttaatgagaggcctacaaa

SEQ ID NO: 351059 - DNA, 25 bp, Mus musculus
ccgtctttaatgtgaggcctacaaa

SEQ ID NO: 351060 - DNA, 25 bp, Mus musculus
ccgtgaaaggttctcgcaagcaatt

SEQ ID NO: 351061 - DNA, 25 bp, Mus musculus
ccgtgaaaggttgtcgcaagcaatt

SEQ ID NO: 351062 - DNA, 25 bp, Mus musculus
ccgtgaatactgaatgtgactgttt

SEQ ID NO: 351063 - DNA, 25 bp, Mus musculus
ccgtgaatactgtatgtgactgttt

SEQ ID NO: 351064 - DNA, 25 bp, Mus musculus
ccgtgaatgtagacgcccgcgcagg

SEQ ID NO: 351065 - DNA, 25 bp, Mus musculus
ccgtgaatgtagtcgcccgcgcagg

SEQ ID NO: 351066 - DNA, 25 bp, Mus musculus
ccgtgaatttacctggacttcgaat

SEQ ID NO: 351067 - DNA, 25 bp, Mus musculus
ccgtgaatttacgtggacttcgaat

SEQ ID NO: 351068 - DNA, 25 bp, Mus musculus
ccgtgaatttagaagttccagcatg

SEQ ID NO: 351069 - DNA, 25 bp, Mus musculus
ccgtgaatttagtagttccagcatg

SEQ ID NO: 351070 - DNA, 25 bp, Mus musculus
ccgtgacacggaccctggacagaga

SEQ ID NO: 351071 - DNA, 25 bp, Mus musculus
ccgtgacacggagcctggacagaga

SEQ ID NO: 351072 - DNA, 25 bp, Mus musculus
ccgtgaccagatcctcaatcattaa

SEQ ID NO: 351073 - DNA, 25 bp, Mus musculus
ccgtgaccagatgctcaatcattaa

SEQ ID NO: 351074 - DNA, 25 bp, Mus musculus
ccgtgaccgagtccctgcaggcgtg

SEQ ID NO: 351075 - DNA, 25 bp, Mus musculus
ccgtgaccgagtgcctgcaggcgtg

SEQ ID NO: 351076 - DNA, 25 bp, Mus musculus
ccgtgactcccaagtgtccaaagag

SEQ ID NO: 351077 - DNA, 25 bp, Mus musculus
ccgtgactcccatgtgtccaaagag

SEQ ID NO: 351078 - DNA, 25 bp, Mus musculus
ccgtgagactcaaccgctacaaaat

SEQ ID NO: 351079 - DNA, 25 bp, Mus musculus
ccgtgagactcatccgctacaaaat

SEQ ID NO: 351080 - DNA, 25 bp, Mus musculus
ccgtgagcgcgtcggtaggccggag

SEQ ID NO: 351081 - DNA, 25 bp, Mus musculus
ccgtgagcgcgtgggtaggccggag

SEQ ID NO: 351082 - DNA, 25 bp, Mus musculus
ccgtgagcttcacgttcatggacac

SEQ ID NO: 351083 - DNA, 25 bp, Mus musculus
ccgtgagcttcaggttcatggacac

SEQ ID NO: 351084 - DNA, 25 bp, Mus musculus
ccgtgagcttgcatggtggccacct

SEQ ID NO: 351085 - DNA, 25 bp, Mus musculus
ccgtgagcttgcttggtggccacct

SEQ ID NO: 351086 - DNA, 25 bp, Mus musculus
ccgtgaggccagaaggcaagtcctt

SEQ ID NO: 351087 - DNA, 25 bp, Mus musculus
ccgtgaggccagtaggcaagtcctt

SEQ ID NO: 351088 - DNA, 25 bp, Mus musculus
ccgtgagggcttatgcgctgaagga

SEQ ID NO: 351089 - DNA, 25 bp, Mus musculus
ccgtgagggcttttgcgctgaagga

SEQ ID NO: 351090 - DNA, 25 bp, Mus musculus
ccgtgagtgtgtagggttctttgat

SEQ ID NO: 351091 - DNA, 25 bp, Mus musculus
ccgtgagtgtgttgggttctttgat

SEQ ID NO: 351092 - DNA, 25 bp, Mus musculus
ccgtgagttgaacactttcttcttg

SEQ ID NO: 351093 - DNA, 25 bp, Mus musculus
ccgtgagttgaagactttcttcttg

SEQ ID NO: 351094 - DNA, 25 bp, Mus musculus
ccgtgatacacacgaggtgccctta

SEQ ID NO: 351095 - DNA, 25 bp, Mus musculus
ccgtgatacacaggaggtgccctta

SEQ ID NO: 351096 - DNA, 25 bp, Mus musculus
ccgtgatatcacagtccaaccaaat

SEQ ID NO: 351097 - DNA, 25 bp, Mus musculus
ccgtgatatcactgtccaaccaaat

SEQ ID NO: 351098 - DNA, 25 bp, Mus musculus
ccgtgatcctatccggtggagcgtt

SEQ ID NO: 351099 - DNA, 25 bp, Mus musculus
ccgtgatcctatgcggtggagcgtt

SEQ ID NO: 351100 - DNA, 25 bp, Mus musculus
ccgtgatctcctagcacagaattgc

SEQ ID NO: 351101 - DNA, 25 bp, Mus musculus
ccgtgatctccttgcacagaattgc

SEQ ID NO: 351102 - DNA, 25 bp, Mus musculus
ccgtgatgaaaaagcccgaggatga

SEQ ID NO: 351103 - DNA, 25 bp, Mus musculus
ccgtgatgaaaatgcccgaggatga

SEQ ID NO: 351104 - DNA, 25 bp, Mus musculus
ccgtgatgaactacctgggcccaaa

SEQ ID NO: 351105 - DNA, 25 bp, Mus musculus
ccgtgatgaacttcctgggcccaaa

SEQ ID NO: 351106 - DNA, 25 bp, Mus musculus
ccgtgattgaacagggagggcctct

SEQ ID NO: 351107 - DNA, 25 bp, Mus musculus
ccgtgattgaactgggagggcctct

SEQ ID NO: 351108 - DNA, 25 bp, Mus musculus
ccgtgcaagtgtactcaaggtccga

SEQ ID NO: 351109 - DNA, 25 bp, Mus musculus
ccgtgcaagtgttctcaaggtccga

SEQ ID NO: 351110 - DNA, 25 bp, Mus musculus
ccgtgcacaggcaggctgttcagaa

SEQ ID NO: 351111 - DNA, 25 bp, Mus musculus
ccgtgcacaggctggctgttcagaa

SEQ ID NO: 351112 - DNA, 25 bp, Mus musculus
ccgtgcacctaccacgcctgcagga

SEQ ID NO: 351113 - DNA, 25 bp, Mus musculus
ccgtgcacctacgacgcctgcagga

SEQ ID NO: 351114 - DNA, 25 bp, Mus musculus
ccgtgcactctgctaatgggtcata

SEQ ID NO: 351115 - DNA, 25 bp, Mus musculus
ccgtgcactctggtaatgggtcata

SEQ ID NO: 351116 - DNA, 25 bp, Mus musculus
ccgtgcagtgcaagtctctagagac

SEQ ID NO: 351117 - DNA, 25 bp, Mus musculus
ccgtgcagtgcatgtctctagagac

SEQ ID NO: 351118 - DNA, 25 bp, Mus musculus
ccgtgccaaaagaagctgagttttc

SEQ ID NO: 351119 - DNA, 25 bp, Mus musculus
ccgtgccaaaagtagctgagttttc

SEQ ID NO: 351120 - DNA, 25 bp, Mus musculus
ccgtgccaagcacggccagagttta

SEQ ID NO: 351121 - DNA, 25 bp, Mus musculus
ccgtgccaagcagggccagagttta

SEQ ID NO: 351122 - DNA, 25 bp, Mus musculus
ccgtgccacctgatcctggaagaga

SEQ ID NO: 351123 - DNA, 25 bp, Mus musculus
ccgtgccacctgttcctggaagaga

SEQ ID NO: 351124 - DNA, 25 bp, Mus musculus
ccgtgccactaacacttaaatgtga

SEQ ID NO: 351125 - DNA, 25 bp, Mus musculus
ccgtgccactaagacttaaatgtga

SEQ ID NO: 351126 - DNA, 25 bp, Mus musculus
ccgtgccactagagaacatctgaag

SEQ ID NO: 351127 - DNA, 25 bp, Mus musculus
ccgtgccactagtgaacatctgaag

SEQ ID NO: 351128 - DNA, 25 bp, Mus musculus
ccgtgccagggacgctgagaaacaa

SEQ ID NO: 351129 - DNA, 25 bp, Mus musculus
ccgtgccagggaggctgagaaacaa

SEQ ID NO: 351130 - DNA, 25 bp, Mus musculus
ccgtgccccgcacaagtgaaagttt

SEQ ID NO: 351131 - DNA, 25 bp, Mus musculus
ccgtgccccgcagaagtgaaagttt

SEQ ID NO: 351132 - DNA, 25 bp, Mus musculus
ccgtgcctagtcctgagcagaatta

SEQ ID NO: 351133 - DNA, 25 bp, Mus musculus
ccgtgcctagtcgtgagcagaatta

SEQ ID NO: 351134 - DNA, 25 bp, Mus musculus
ccgtgcctgtgaatacgcagaacca

SEQ ID NO: 351135 - DNA, 25 bp, Mus musculus
ccgtgcctgtgattacgcagaacca

SEQ ID NO: 351136 - DNA, 25 bp, Mus musculus
ccgtgccttacgagcagctgatgaa

SEQ ID NO: 351137 - DNA, 25 bp, Mus musculus
ccgtgccttacgtgcagctgatgaa

SEQ ID NO: 351138 - DNA, 25 bp, Mus musculus
ccgtgcctttggagtttgtgcagca

SEQ ID NO: 351139 - DNA, 25 bp, Mus musculus
ccgtgcctttggtgtttgtgcagca

SEQ ID NO: 351140 - DNA, 25 bp, Mus musculus
ccgtgcgcatcaaggcggagagcaa

SEQ ID NO: 351141 - DNA, 25 bp, Mus musculus
ccgtgcgcatcatggcggagagcaa

SEQ ID NO: 351142 - DNA, 25 bp, Mus musculus
ccgtgcgggtggcattctgtcttct

SEQ ID NO: 351143 - DNA, 25 bp, Mus musculus
ccgtgcgggtgggattctgtcttct

SEQ ID NO: 351144 - DNA, 25 bp, Mus musculus
ccgtgcgtacatcgtcaccaagggt

SEQ ID NO: 351145 - DNA, 25 bp, Mus musculus
ccgtgcgtacatggtcaccaagggt

SEQ ID NO: 351146 - DNA, 25 bp, Mus musculus
ccgtgctaatggagtctttttgaag

SEQ ID NO: 351147 - DNA, 25 bp, Mus musculus
ccgtgctaatggtgtctttttgaag

SEQ ID NO: 351148 - DNA, 25 bp, Mus musculus
ccgtgctatgtgattcagatacgca

SEQ ID NO: 351149 - DNA, 25 bp, Mus musculus
ccgtgctatgtgtttcagatacgca

SEQ ID NO: 351150 - DNA, 25 bp, Mus musculus
ccgtgctcctgtcctgagacagaag

SEQ ID NO: 351151 - DNA, 25 bp, Mus musculus
ccgtgctcctgtgctgagacagaag

SEQ ID NO: 351152 - DNA, 25 bp, Mus musculus
ccgtgctccttaaataattgttgtg

SEQ ID NO: 351153 - DNA, 25 bp, Mus musculus
ccgtgctccttatataattgttgtg

SEQ ID NO: 351154 - DNA, 25 bp, Mus musculus
ccgtgctctcacagaactttctgag

SEQ ID NO: 351155 - DNA, 25 bp, Mus musculus
ccgtgctctcactgaactttctgag

SEQ ID NO: 351156 - DNA, 25 bp, Mus musculus
ccgtgctgacctccaagtaccgtta

SEQ ID NO: 351157 - DNA, 25 bp, Mus musculus
ccgtgctgacctgcaagtaccgtta

SEQ ID NO: 351158 - DNA, 25 bp, Mus musculus
ccgtgctgataaaattgggctgtgt

SEQ ID NO: 351159 - DNA, 25 bp, Mus musculus
ccgtgctgataatattgggctgtgt

SEQ ID NO: 351160 - DNA, 25 bp, Mus musculus
ccgtgcttcgtgcaaagtttgctgc

SEQ ID NO: 351161 - DNA, 25 bp, Mus musculus
ccgtgcttcgtggaaagtttgctgc

SEQ ID NO: 351162 - DNA, 25 bp, Mus musculus
ccgtgcttgcatatgtatggttaaa

SEQ ID NO: 351163 - DNA, 25 bp, Mus musculus
ccgtgcttgcatttgtatggttaaa

SEQ ID NO: 351164 - DNA, 25 bp, Mus musculus
ccgtgcttgggaataggttttgcca

SEQ ID NO: 351165 - DNA, 25 bp, Mus musculus
ccgtgcttgggattaggttttgcca

SEQ ID NO: 351166 - DNA, 25 bp, Mus musculus
ccgtggaacaaaaggcagcttatga

SEQ ID NO: 351167 - DNA, 25 bp, Mus musculus
ccgtggaacaaatggcagcttatga

SEQ ID NO: 351168 - DNA, 25 bp, Mus musculus
ccgtggaatacaatacccagctgct

SEQ ID NO: 351169 - DNA, 25 bp, Mus musculus
ccgtggaatacattacccagctgct

SEQ ID NO: 351170 - DNA, 25 bp, Mus musculus
ccgtggacagagcaggtgttccctt

SEQ ID NO: 351171 - DNA, 25 bp, Mus musculus
ccgtggacagaggaggtgttccctt

SEQ ID NO: 351172 - DNA, 25 bp, Mus musculus
ccgtggacaggacccgagtctatta

SEQ ID NO: 351173 - DNA, 25 bp, Mus musculus
ccgtggacaggagccgagtctatta

SEQ ID NO: 351174 - DNA, 25 bp, Mus musculus
ccgtggacagttaggtggcctattc

SEQ ID NO: 351175 - DNA, 25 bp, Mus musculus
ccgtggacagtttggtggcctattc

SEQ ID NO: 351176 - DNA, 25 bp, Mus musculus
ccgtggactcaacgtgcatctgcta

SEQ ID NO: 351177 - DNA, 25 bp, Mus musculus
ccgtggactcaaggtgcatctgcta

SEQ ID NO: 351178 - DNA, 25 bp, Mus musculus
ccgtggactctcatgtcatttgaag

SEQ ID NO: 351179 - DNA, 25 bp, Mus musculus
ccgtggactctcttgtcatttgaag

SEQ ID NO: 351180 - DNA, 25 bp, Mus musculus
ccgtggatacatcgacccaggctgc

SEQ ID NO: 351181 - DNA, 25 bp, Mus musculus
ccgtggatacatggacccaggctgc

SEQ ID NO: 351182 - DNA, 25 bp, Mus musculus
ccgtggattgtcacgttggtggtca

SEQ ID NO: 351183 - DNA, 25 bp, Mus musculus
ccgtggattgtctcgttggtggtca

SEQ ID NO: 351184 - DNA, 25 bp, Mus musculus
ccgtggcaaaatcggactgatagcg

SEQ ID NO: 351185 - DNA, 25 bp, Mus musculus
ccgtggcaaaatgggactgatagcg

SEQ ID NO: 351186 - DNA, 25 bp, Mus musculus
ccgtggcaagggagggtgtccccat

SEQ ID NO: 351187 - DNA, 25 bp, Mus musculus
ccgtggcaagggtgggtgtccccat

SEQ ID NO: 351188 - DNA, 25 bp, Mus musculus
ccgtggcaccacagctatgtagtag

SEQ ID NO: 351189 - DNA, 25 bp, Mus musculus
ccgtggcaccactgctatgtagtag

SEQ ID NO: 351190 - DNA, 25 bp, Mus musculus
ccgtggcagtacattctctgaacaa

SEQ ID NO: 351191 - DNA, 25 bp, Mus musculus
ccgtggcagtactttctctgaacaa

SEQ ID NO: 351192 - DNA, 25 bp, Mus musculus
ccgtggccaggacactgctgtagat

SEQ ID NO: 351193 - DNA, 25 bp, Mus musculus
ccgtggccaggagactgctgtagat

SEQ ID NO: 351194 - DNA, 25 bp, Mus musculus
ccgtggccattactgctgaatgccc

SEQ ID NO: 351195 - DNA, 25 bp, Mus musculus
ccgtggccattagtgctgaatgccc

SEQ ID NO: 351196 - DNA, 25 bp, Mus musculus
ccgtggcccagactatcatgaacaa

SEQ ID NO: 351197 - DNA, 25 bp, Mus musculus
ccgtggcccagagtatcatgaacaa

SEQ ID NO: 351198 - DNA, 25 bp, Mus musculus
ccgtggctcaagaggtcctgaaatg

SEQ ID NO: 351199 - DNA, 25 bp, Mus musculus
ccgtggctcaagtggtcctgaaatg

SEQ ID NO: 351200 - DNA, 25 bp, Mus musculus
ccgtggctctgcattgaagtgtcag

SEQ ID NO: 351201 - DNA, 25 bp, Mus musculus
ccgtggctctgctttgaagtgtcag

SEQ ID NO: 351202 - DNA, 25 bp, Mus musculus
ccgtggctgagcacaccaagggagc

SEQ ID NO: 351203 - DNA, 25 bp, Mus musculus
ccgtggctgagctcaccaagggagc

SEQ ID NO: 351204 - DNA, 25 bp, Mus musculus
ccgtgggcaccaagcatatatgtgg

SEQ ID NO: 351205 - DNA, 25 bp, Mus musculus
ccgtgggcaccatgcatatatgtgg

SEQ ID NO: 351206 - DNA, 25 bp, Mus musculus
ccgtgggcatcaatgtcaacaagca

SEQ ID NO: 351207 - DNA, 25 bp, Mus musculus
ccgtgggcatcattgtcaacaagca

SEQ ID NO: 351208 - DNA, 25 bp, Mus musculus
ccgtgggcccggacagacatggaca

SEQ ID NO: 351209 - DNA, 25 bp, Mus musculus
ccgtgggcccggtcagacatggaca

SEQ ID NO: 351210 - DNA, 25 bp, Mus musculus
ccgtggggctgcccagaacatcatc

SEQ ID NO: 351211 - DNA, 25 bp, Mus musculus
ccgtggggctgcgcagaacatcatc

SEQ ID NO: 351212 - DNA, 25 bp, Mus musculus
ccgtgggttgggatgtctctcgcta

SEQ ID NO: 351213 - DNA, 25 bp, Mus musculus
ccgtgggttgggttgtctctcgcta

SEQ ID NO: 351214 - DNA, 25 bp, Mus musculus
ccgtggtcaatcactttttctctct

SEQ ID NO: 351215 - DNA, 25 bp, Mus musculus
ccgtggtcaatctctttttctctct

SEQ ID NO: 351216 - DNA, 25 bp, Mus musculus
ccgtggtgccctccattaagagcta

SEQ ID NO: 351217 - DNA, 25 bp, Mus musculus
ccgtggtgccctgcattaagagcta

SEQ ID NO: 351218 - DNA, 25 bp, Mus musculus
ccgtggtgtgggatcattaatctaa

SEQ ID NO: 351219 - DNA, 25 bp, Mus musculus
ccgtggtgtgggttcattaatctaa

SEQ ID NO: 351220 - DNA, 25 bp, Mus musculus
ccgtggttatgtactggatctccaa

SEQ ID NO: 351221 - DNA, 25 bp, Mus musculus
ccgtggttatgttctggatctccaa

SEQ ID NO: 351222 - DNA, 25 bp, Mus musculus
ccgtgtacgcggaggtggataccat

SEQ ID NO: 351223 - DNA, 25 bp, Mus musculus
ccgtgtacgcggtggtggataccat

SEQ ID NO: 351224 - DNA, 25 bp, Mus musculus
ccgtgtactatgaatcacaatagta

SEQ ID NO: 351225 - DNA, 25 bp, Mus musculus
ccgtgtactatgtatcacaatagta

SEQ ID NO: 351226 - DNA, 25 bp, Mus musculus
ccgtgtagatgacgccatggccccg

SEQ ID NO: 351227 - DNA, 25 bp, Mus musculus
ccgtgtagatgaggccatggccccg

SEQ ID NO: 351228 - DNA, 25 bp, Mus musculus
ccgtgtcaagccagtgagggtctta

SEQ ID NO: 351229 - DNA, 25 bp, Mus musculus
ccgtgtcaagcctgtgagggtctta

SEQ ID NO: 351230 - DNA, 25 bp, Mus musculus
ccgtgtcacaagatgcagtttgcca

SEQ ID NO: 351231 - DNA, 25 bp, Mus musculus
ccgtgtcacaagttgcagtttgcca

SEQ ID NO: 351232 - DNA, 25 bp, Mus musculus
ccgtgtcaccataaagttcctatct

SEQ ID NO: 351233 - DNA, 25 bp, Mus musculus
ccgtgtcaccattaagttcctatct

SEQ ID NO: 351234 - DNA, 25 bp, Mus musculus
ccgtgtcactgaagtcggaccagga

SEQ ID NO: 351235 - DNA, 25 bp, Mus musculus
ccgtgtcactgatgtcggaccagga

SEQ ID NO: 351236 - DNA, 25 bp, Mus musculus
ccgtgtccaggcatgtggatggctt

SEQ ID NO: 351237 - DNA, 25 bp, Mus musculus
ccgtgtccaggcttgtggatggctt

SEQ ID NO: 351238 - DNA, 25 bp, Mus musculus
ccgtgtcccaggaagcgtggcgcag

SEQ ID NO: 351239 - DNA, 25 bp, Mus musculus
ccgtgtcccaggtagcgtggcgcag

SEQ ID NO: 351240 - DNA, 25 bp, Mus musculus
ccgtgtcctcggcacaggaaggcag

SEQ ID NO: 351241 - DNA, 25 bp, Mus musculus
ccgtgtcctcgggacaggaaggcag

SEQ ID NO: 351242 - DNA, 25 bp, Mus musculus
ccgtgtcgaaatcaggatggctgtc

SEQ ID NO: 351243 - DNA, 25 bp, Mus musculus
ccgtgtcgaaatgaggatggctgtc

SEQ ID NO: 351244 - DNA, 25 bp, Mus musculus
ccgtgtcgaatgctgtactttaata

SEQ ID NO: 351245 - DNA, 25 bp, Mus musculus
ccgtgtcgaatggtgtactttaata

SEQ ID NO: 351246 - DNA, 25 bp, Mus musculus
ccgtgtctcaccattgatatgtcag

SEQ ID NO: 351247 - DNA, 25 bp, Mus musculus
ccgtgtctcacctttgatatgtcag

SEQ ID NO: 351248 - DNA, 25 bp, Mus musculus
ccgtgtcttggaacttggtgctgat

SEQ ID NO: 351249 - DNA, 25 bp, Mus musculus
ccgtgtcttggatcttggtgctgat

SEQ ID NO: 351250 - DNA, 25 bp, Mus musculus
ccgtgtgctcgcatggagtgcctga

SEQ ID NO: 351251 - DNA, 25 bp, Mus musculus
ccgtgtgctcgcttggagtgcctga

SEQ ID NO: 351252 - DNA, 25 bp, Mus musculus
ccgtgtgctgagcaccacgggatat

SEQ ID NO: 351253 - DNA, 25 bp, Mus musculus
ccgtgtgctgagcagagctctgata

SEQ ID NO: 351254 - DNA, 25 bp, Mus musculus
ccgtgtgctgaggaccacgggatat

SEQ ID NO: 351255 - DNA, 25 bp, Mus musculus
ccgtgtgctgaggagagctctgata

SEQ ID NO: 351256 - DNA, 25 bp, Mus musculus
ccgtgtggaggtctgcagcagggcc

SEQ ID NO: 351257 - DNA, 25 bp, Mus musculus
ccgtgtggaggtgtgcagcagggcc

SEQ ID NO: 351258 - DNA, 25 bp, Mus musculus
ccgtgtggtaaaaaactggcattct

SEQ ID NO: 351259 - DNA, 25 bp, Mus musculus
ccgtgtggtaaataactggcattct

SEQ ID NO: 351260 - DNA, 25 bp, Mus musculus
ccgtgtgtatatataagaccctgtt

SEQ ID NO: 351261 - DNA, 25 bp, Mus musculus
ccgtgtgtatatttaagaccctgtt

SEQ ID NO: 351262 - DNA, 25 bp, Mus musculus
ccgtgtgtgacacctgacagtggta

SEQ ID NO: 351263 - DNA, 25 bp, Mus musculus
ccgtgtgtgacagctgacagtggta

SEQ ID NO: 351264 - DNA, 25 bp, Mus musculus
ccgtgtgtgtctctgtaagtgcaag

SEQ ID NO: 351265 - DNA, 25 bp, Mus musculus
ccgtgtgtgtctgtgtaagtgcaag

SEQ ID NO: 351266 - DNA, 25 bp, Mus musculus
ccgtgtgtttttcccagttctctag

SEQ ID NO: 351267 - DNA, 25 bp, Mus musculus
ccgtgtgtttttgccagttctctag

SEQ ID NO: 351268 - DNA, 25 bp, Mus musculus
ccgtgttatattcaatggtctgtaa

SEQ ID NO: 351269 - DNA, 25 bp, Mus musculus
ccgtgttatattgaatggtctgtaa

SEQ ID NO: 351270 - DNA, 25 bp, Mus musculus
ccgtgttatttacagcgttctgaca

SEQ ID NO: 351271 - DNA, 25 bp, Mus musculus
ccgtgttatttagagcgttctgaca

SEQ ID NO: 351272 - DNA, 25 bp, Mus musculus
ccgtgttcaccgacatggcgctggg

SEQ ID NO: 351273 - DNA, 25 bp, Mus musculus
ccgtgttcaccgtcatggcgctggg

SEQ ID NO: 351274 - DNA, 25 bp, Mus musculus
ccgtgttcatgcactctatgtgtga

SEQ ID NO: 351275 - DNA, 25 bp, Mus musculus
ccgtgttcatgctctctatgtgtga

SEQ ID NO: 351276 - DNA, 25 bp, Mus musculus
ccgtgttcttttacatccaaacatt

SEQ ID NO: 351277 - DNA, 25 bp, Mus musculus
ccgtgttctttttcatccaaacatt

SEQ ID NO: 351278 - DNA, 25 bp, Mus musculus
ccgtgttgtaagaacccgtggaatg

SEQ ID NO: 351279 - DNA, 25 bp, Mus musculus
ccgtgttgtaagtacccgtggaatg

SEQ ID NO: 351280 - DNA, 25 bp, Mus musculus
ccgtgtttagccctgagcactgagc

SEQ ID NO: 351281 - DNA, 25 bp, Mus musculus
ccgtgtttagccgtgagcactgagc

SEQ ID NO: 351282 - DNA, 25 bp, Mus musculus
ccgtgtttcctaagactgtctcaga

SEQ ID NO: 351283 - DNA, 25 bp, Mus musculus
ccgtgtttcctatgactgtctcaga

SEQ ID NO: 351284 - DNA, 25 bp, Mus musculus
ccgtgtttcctgatgggacagtgaa

SEQ ID NO: 351285 - DNA, 25 bp, Mus musculus
ccgtgtttcctgttgggacagtgaa

SEQ ID NO: 351286 - DNA, 25 bp, Mus musculus
ccgtgtttgcttaccgagcagtgaa

SEQ ID NO: 351287 - DNA, 25 bp, Mus musculus
ccgtgtttgctttccgagcagtgaa

SEQ ID NO: 351288 - DNA, 25 bp, Mus musculus
ccgtgtttgtgactactacagcaat

SEQ ID NO: 351289 - DNA, 25 bp, Mus musculus
ccgtgtttgtgagtactacagcaat

SEQ ID NO: 351290 - DNA, 25 bp, Mus musculus
ccgtgttttccgagtattccagtag

SEQ ID NO: 351291 - DNA, 25 bp, Mus musculus
ccgtgttttccgtgtattccagtag

SEQ ID NO: 351292 - DNA, 25 bp, Mus musculus
ccgtgttttcgtcccgatcgtctca

SEQ ID NO: 351293 - DNA, 25 bp, Mus musculus
ccgtgttttcgtgccgatcgtctca

SEQ ID NO: 351294 - DNA, 25 bp, Mus musculus
ccgttacaactcacctcatgaagat

SEQ ID NO: 351295 - DNA, 25 bp, Mus musculus
ccgttacaactctcctcatgaagat

SEQ ID NO: 351296 - DNA, 25 bp, Mus musculus
ccgttaccggtcacacagtgtgtgg

SEQ ID NO: 351297 - DNA, 25 bp, Mus musculus
ccgttaccggtctcacagtgtgtgg

SEQ ID NO: 351298 - DNA, 25 bp, Mus musculus
ccgttactccctctggtatagatgt

SEQ ID NO: 351299 - DNA, 25 bp, Mus musculus
ccgttactccctgtggtatagatgt

SEQ ID NO: 351300 - DNA, 25 bp, Mus musculus
ccgttactgtggcattgactgggtt

SEQ ID NO: 351301 - DNA, 25 bp, Mus musculus
ccgttactgtgggattgactgggtt

SEQ ID NO: 351302 - DNA, 25 bp, Mus musculus
ccgttagccattctgtattcccata

SEQ ID NO: 351303 - DNA, 25 bp, Mus musculus
ccgttagccattgtgtattcccata

SEQ ID NO: 351304 - DNA, 25 bp, Mus musculus
ccgttagttcagatttctgactggt

SEQ ID NO: 351305 - DNA, 25 bp, Mus musculus
ccgttagttcagttttctgactggt

SEQ ID NO: 351306 - DNA, 25 bp, Mus musculus
ccgttcacatacctgccctttggag

SEQ ID NO: 351307 - DNA, 25 bp, Mus musculus
ccgttcacatacgtgccctttggag

SEQ ID NO: 351308 - DNA, 25 bp, Mus musculus
ccgttcacgtttaagatcagacgta

SEQ ID NO: 351309 - DNA, 25 bp, Mus musculus
ccgttcacgttttagatcagacgta

SEQ ID NO: 351310 - DNA, 25 bp, Mus musculus
ccgttcactttacgcagatcacact

SEQ ID NO: 351311 - DNA, 25 bp, Mus musculus
ccgttcactttaggcagatcacact

SEQ ID NO: 351312 - DNA, 25 bp, Mus musculus
ccgttcagtacgcatatgagcttga

SEQ ID NO: 351313 - DNA, 25 bp, Mus musculus
ccgttcagtacggatatgagcttga

SEQ ID NO: 351314 - DNA, 25 bp, Mus musculus
ccgttcagtgcacacagggcttggc

SEQ ID NO: 351315 - DNA, 25 bp, Mus musculus
ccgttcagtgcagacagggcttggc

SEQ ID NO: 351316 - DNA, 25 bp, Mus musculus
ccgttcatttgaccatcggaatttc

SEQ ID NO: 351317 - DNA, 25 bp, Mus musculus
ccgttcatttgagcatcggaatttc

SEQ ID NO: 351318 - DNA, 25 bp, Mus musculus
ccgttccatgaaatcgcggatgtgg

SEQ ID NO: 351319 - DNA, 25 bp, Mus musculus
ccgttccatgaattcgcggatgtgg

SEQ ID NO: 351320 - DNA, 25 bp, Mus musculus
ccgttccctctcagcttaagcatga

SEQ ID NO: 351321 - DNA, 25 bp, Mus musculus
ccgttccctctctgcttaagcatga

SEQ ID NO: 351322 - DNA, 25 bp, Mus musculus
ccgttcctggtgacagtgctgttaa

SEQ ID NO: 351323 - DNA, 25 bp, Mus musculus
ccgttcctggtgtcagtgctgttaa

SEQ ID NO: 351324 - DNA, 25 bp, Mus musculus
ccgttcctttagctatcagtttggg

SEQ ID NO: 351325 - DNA, 25 bp, Mus musculus
ccgttcctttaggtatcagtttggg

SEQ ID NO: 351326 - DNA, 25 bp, Mus musculus
ccgttcgagaggctgacgtgctcac

SEQ ID NO: 351327 - DNA, 25 bp, Mus musculus
ccgttcgagagggtgacgtgctcac

SEQ ID NO: 351328 - DNA, 25 bp, Mus musculus
ccgttcgggcggcaacagcatgttt

SEQ ID NO: 351329 - DNA, 25 bp, Mus musculus
ccgttcgggcgggaacagcatgttt

SEQ ID NO: 351330 - DNA, 25 bp, Mus musculus
ccgttctagttcaaaggctgcctgc

SEQ ID NO: 351331 - DNA, 25 bp, Mus musculus
ccgttctagttctaaggctgcctgc

SEQ ID NO: 351332 - DNA, 25 bp, Mus musculus
ccgttctctcgtcattgcaagatgt

SEQ ID NO: 351333 - DNA, 25 bp, Mus musculus
ccgttctctcgtgattgcaagatgt

SEQ ID NO: 351334 - DNA, 25 bp, Mus musculus
ccgttctcttagaagggttcatagg

SEQ ID NO: 351335 - DNA, 25 bp, Mus musculus
ccgttctcttagtagggttcatagg

SEQ ID NO: 351336 - DNA, 25 bp, Mus musculus
ccgttcttccagctgatctgggttt

SEQ ID NO: 351337 - DNA, 25 bp, Mus musculus
ccgttcttccaggtgatctgggttt

SEQ ID NO: 351338 - DNA, 25 bp, Mus musculus
ccgttgaatgggaatcttgtataat

SEQ ID NO: 351339 - DNA, 25 bp, Mus musculus
ccgttgaatgggtatcttgtataat

SEQ ID NO: 351340 - DNA, 25 bp, Mus musculus
ccgttgccacatacgcagggattga

SEQ ID NO: 351341 - DNA, 25 bp, Mus musculus
ccgttgccacattcgcagggattga

SEQ ID NO: 351342 - DNA, 25 bp, Mus musculus
ccgttgcctttgacctgggcctggg

SEQ ID NO: 351343 - DNA, 25 bp, Mus musculus
ccgttgcctttgtcctgggcctggg

SEQ ID NO: 351344 - DNA, 25 bp, Mus musculus
ccgttggagctaatgggcaccatct

SEQ ID NO: 351345 - DNA, 25 bp, Mus musculus
ccgttggagctattgggcaccatct

SEQ ID NO: 351346 - DNA, 25 bp, Mus musculus
ccgttggcagtgagggcacttatat

SEQ ID NO: 351347 - DNA, 25 bp, Mus musculus
ccgttggcagtgtgggcacttatat

SEQ ID NO: 351348 - DNA, 25 bp, Mus musculus
ccgttggcttcacgcaagctagcct

SEQ ID NO: 351349 - DNA, 25 bp, Mus musculus
ccgttggcttcaggcaagctagcct

SEQ ID NO: 351350 - DNA, 25 bp, Mus musculus
ccgttgggactgcagcatggctaaa

SEQ ID NO: 351351 - DNA, 25 bp, Mus musculus
ccgttgggactggagcatggctaaa

SEQ ID NO: 351352 - DNA, 25 bp, Mus musculus
ccgttgggctggctcatactctgaa

SEQ ID NO: 351353 - DNA, 25 bp, Mus musculus
ccgttgggctgggtcatactctgaa

SEQ ID NO: 351354 - DNA, 25 bp, Mus musculus
ccgttggtatgtagaacacttgctt

SEQ ID NO: 351355 - DNA, 25 bp, Mus musculus
ccgttggtatgttgaacacttgctt

SEQ ID NO: 351356 - DNA, 25 bp, Mus musculus
ccgttggtgtgtaacatggtgcagt

SEQ ID NO: 351357 - DNA, 25 bp, Mus musculus
ccgttggtgtgttacatggtgcagt

SEQ ID NO: 351358 - DNA, 25 bp, Mus musculus
ccgttgtaacagcagaggtgacctt

SEQ ID NO: 351359 - DNA, 25 bp, Mus musculus
ccgttgtaacaggagaggtgacctt

SEQ ID NO: 351360 - DNA, 25 bp, Mus musculus
ccgttgttcttgatcttcgtgctgg

SEQ ID NO: 351361 - DNA, 25 bp, Mus musculus
ccgttgttcttgttcttcgtgctgg

SEQ ID NO: 351362 - DNA, 25 bp, Mus musculus
ccgttgttgcagatcttgttactca

SEQ ID NO: 351363 - DNA, 25 bp, Mus musculus
ccgttgttgcagttcttgttactca

SEQ ID NO: 351364 - DNA, 25 bp, Mus musculus
ccgttgttgcggacatctttataag

SEQ ID NO: 351365 - DNA, 25 bp, Mus musculus
ccgttgttgcggtcatctttataag

SEQ ID NO: 351366 - DNA, 25 bp, Mus musculus
ccgtttaagcttaggctcaaactgt

SEQ ID NO: 351367 - DNA, 25 bp, Mus musculus
ccgtttaagctttggctcaaactgt

SEQ ID NO: 351368 - DNA, 25 bp, Mus musculus
ccgtttacctcaattgtatcatagt

SEQ ID NO: 351369 - DNA, 25 bp, Mus musculus
ccgtttacctcatttgtatcatagt

SEQ ID NO: 351370 - DNA, 25 bp, Mus musculus
ccgtttactttcacttcattgttga

SEQ ID NO: 351371 - DNA, 25 bp, Mus musculus
ccgtttactttctcttcattgttga

SEQ ID NO: 351372 - DNA, 25 bp, Mus musculus
ccgtttagagacagcagcacgtggg

SEQ ID NO: 351373 - DNA, 25 bp, Mus musculus
ccgtttagagactgcagcacgtggg

SEQ ID NO: 351374 - DNA, 25 bp, Mus musculus
ccgtttatgtgaagtgtattccatt

SEQ ID NO: 351375 - DNA, 25 bp, Mus musculus
ccgtttatgtgatgtgtattccatt

SEQ ID NO: 351376 - DNA, 25 bp, Mus musculus
ccgtttcaattcacaggactcctga

SEQ ID NO: 351377 - DNA, 25 bp, Mus musculus
ccgtttcaattctcaggactcctga

SEQ ID NO: 351378 - DNA, 25 bp, Mus musculus
ccgtttccaaccagctgcttctttt

SEQ ID NO: 351379 - DNA, 25 bp, Mus musculus
ccgtttccaacctgctgcttctttt

SEQ ID NO: 351380 - DNA, 25 bp, Mus musculus
ccgtttccatcaagcttttcagtag

SEQ ID NO: 351381 - DNA, 25 bp, Mus musculus
ccgtttccatcatgcttttcagtag

SEQ ID NO: 351382 - DNA, 25 bp, Mus musculus
ccgtttccccatattatgtcataca

SEQ ID NO: 351383 - DNA, 25 bp, Mus musculus
ccgtttccccattttatgtcataca

SEQ ID NO: 351384 - DNA, 25 bp, Mus musculus
ccgtttcctgcgcttcaaactgaag

SEQ ID NO: 351385 - DNA, 25 bp, Mus musculus
ccgtttcctgcggttcaaactgaag

SEQ ID NO: 351386 - DNA, 25 bp, Mus musculus
ccgtttcgaggtagacattagggag

SEQ ID NO: 351387 - DNA, 25 bp, Mus musculus
ccgtttcgaggttgacattagggag

SEQ ID NO: 351388 - DNA, 25 bp, Mus musculus
ccgtttcttcacatgtaggcagcta

SEQ ID NO: 351389 - DNA, 25 bp, Mus musculus
ccgtttcttcacttgtaggcagcta

SEQ ID NO: 351390 - DNA, 25 bp, Mus musculus
ccgtttcttcgtctctaggaattat

SEQ ID NO: 351391 - DNA, 25 bp, Mus musculus
ccgtttcttcgtgtctaggaattat

SEQ ID NO: 351392 - DNA, 25 bp, Mus musculus
ccgtttgaccagcacagaaatatta

SEQ ID NO: 351393 - DNA, 25 bp, Mus musculus
ccgtttgaccaggacagaaatatta

SEQ ID NO: 351394 - DNA, 25 bp, Mus musculus
ccgtttgagccactgaaatctcctg

SEQ ID NO: 351395 - DNA, 25 bp, Mus musculus
ccgtttgagccagtgaaatctcctg

SEQ ID NO: 351396 - DNA, 25 bp, Mus musculus
ccgtttgcatctctgggactgggat

SEQ ID NO: 351397 - DNA, 25 bp, Mus musculus
ccgtttgcatctgtgggactgggat

SEQ ID NO: 351398 - DNA, 25 bp, Mus musculus
ccgtttgcctcacctatttgtggga

SEQ ID NO: 351399 - DNA, 25 bp, Mus musculus
ccgtttgcctcagctatttgtggga

SEQ ID NO: 351400 - DNA, 25 bp, Mus musculus
ccgtttgcctgccagagtcattaca

SEQ ID NO: 351401 - DNA, 25 bp, Mus musculus
ccgtttgcctgcgagagtcattaca

SEQ ID NO: 351402 - DNA, 25 bp, Mus musculus
ccgtttgcttttctgaccaaaggat

SEQ ID NO: 351403 - DNA, 25 bp, Mus musculus
ccgtttgcttttgtgaccaaaggat

SEQ ID NO: 351404 - DNA, 25 bp, Mus musculus
ccgtttggtacgaatcagtgaatta

SEQ ID NO: 351405 - DNA, 25 bp, Mus musculus
ccgtttggtacgtatcagtgaatta

SEQ ID NO: 351406 - DNA, 25 bp, Mus musculus
ccgtttgtctccagtctggtgccag

SEQ ID NO: 351407 - DNA, 25 bp, Mus musculus
ccgtttgtctcctgtctggtgccag

SEQ ID NO: 351408 - DNA, 25 bp, Mus musculus
ccgtttgttggtacccattgtgtat

SEQ ID NO: 351409 - DNA, 25 bp, Mus musculus
ccgtttgttggttcccattgtgtat

SEQ ID NO: 351410 - DNA, 25 bp, Mus musculus
ccgttttcacagctcacatgttgga

SEQ ID NO: 351411 - DNA, 25 bp, Mus musculus
ccgttttcacaggtcacatgttgga

SEQ ID NO: 351412 - DNA, 25 bp, Mus musculus
ccgttttcaggaatagagttcacac

SEQ ID NO: 351413 - DNA, 25 bp, Mus musculus
ccgttttcaggattagagttcacac

SEQ ID NO: 351414 - DNA, 25 bp, Mus musculus
ccgttttcctctctgtagctctcat

SEQ ID NO: 351415 - DNA, 25 bp, Mus musculus
ccgttttcctctgtgtagctctcat

SEQ ID NO: 351416 - DNA, 25 bp, Mus musculus
ccgttttcggcgagacgtagctgta

SEQ ID NO: 351417 - DNA, 25 bp, Mus musculus
ccgttttcggcgtgacgtagctgta

SEQ ID NO: 351418 - DNA, 25 bp, Mus musculus
ccgttttctacacaagggtctcaat

SEQ ID NO: 351419 - DNA, 25 bp, Mus musculus
ccgttttctacagaagggtctcaat

SEQ ID NO: 351420 - DNA, 25 bp, Mus musculus
ccgttttgaactccacgaggaccaa

SEQ ID NO: 351421 - DNA, 25 bp, Mus musculus
ccgttttgaactgcacgaggaccaa

SEQ ID NO: 351422 - DNA, 25 bp, Mus musculus
ccgttttgcttcaaggctctatagc

SEQ ID NO: 351423 - DNA, 25 bp, Mus musculus
ccgttttgcttctaggctctatagc

SEQ ID NO: 351424 - DNA, 25 bp, Mus musculus
ccgttttggcttctctggaggtaga

SEQ ID NO: 351425 - DNA, 25 bp, Mus musculus
ccgttttggcttgtctggaggtaga

SEQ ID NO: 351426 - DNA, 25 bp, Mus musculus
ccgttttgtagacttagaccattca

SEQ ID NO: 351427 - DNA, 25 bp, Mus musculus
ccgttttgtagagttagaccattca

SEQ ID NO: 351428 - DNA, 25 bp, Mus musculus
ccgttttgtgacagtagacatgcct

SEQ ID NO: 351429 - DNA, 25 bp, Mus musculus
ccgttttgtgactgtagacatgcct

SEQ ID NO: 351430 - DNA, 25 bp, Mus musculus
ccgttttttcatactttatcctcag

SEQ ID NO: 351431 - DNA, 25 bp, Mus musculus
ccgttttttcattctttatcctcag

SEQ ID NO: 351432 - DNA, 25 bp, Mus musculus
ccgtttttttgtactgatgccaaat

SEQ ID NO: 351433 - DNA, 25 bp, Mus musculus
ccgtttttttgttctgatgccaaat

SEQ ID NO: 351434 - DNA, 25 bp, Mus musculus
cctaaaaactagaacatcgctgggc

SEQ ID NO: 351435 - DNA, 25 bp, Mus musculus
cctaaaaactagtacatcgctgggc

SEQ ID NO: 351436 - DNA, 25 bp, Mus musculus
cctaaaaactataccatttctgtgg

SEQ ID NO: 351437 - DNA, 25 bp, Mus musculus
cctaaaaactattccatttctgtgg

SEQ ID NO: 351438 - DNA, 25 bp, Mus musculus
cctaaaaccgtactctgtgcacaaa

SEQ ID NO: 351439 - DNA, 25 bp, Mus musculus
cctaaaaccgtagtctgtgcacaaa

SEQ ID NO: 351440 - DNA, 25 bp, Mus musculus
cctaaaactacacgctacagtgaat

SEQ ID NO: 351441 - DNA, 25 bp, Mus musculus
cctaaaactacaggctacagtgaat

SEQ ID NO: 351442 - DNA, 25 bp, Mus musculus
cctaaaactcacaggctggcatcga

SEQ ID NO: 351443 - DNA, 25 bp, Mus musculus
cctaaaactcactggctggcatcga

SEQ ID NO: 351444 - DNA, 25 bp, Mus musculus
cctaaaagttcaccccactcagtga

SEQ ID NO: 351445 - DNA, 25 bp, Mus musculus
cctaaaagttcagcccactcagtga

SEQ ID NO: 351446 - DNA, 25 bp, Mus musculus
cctaaaatccgtccatggagatata

SEQ ID NO: 351447 - DNA, 25 bp, Mus musculus
cctaaaatccgtgcatggagatata

SEQ ID NO: 351448 - DNA, 25 bp, Mus musculus
cctaaaattcctcggcaggcacagg

SEQ ID NO: 351449 - DNA, 25 bp, Mus musculus
cctaaaattcctgggcaggcacagg

SEQ ID NO: 351450 - DNA, 25 bp, Mus musculus
cctaaacaagggacaggcgatctta

SEQ ID NO: 351451 - DNA, 25 bp, Mus musculus
cctaaacaagggtcaggcgatctta

SEQ ID NO: 351452 - DNA, 25 bp, Mus musculus
cctaaacacagcacctctggtggct

SEQ ID NO: 351453 - DNA, 25 bp, Mus musculus
cctaaacacagctcctctggtggct

SEQ ID NO: 351454 - DNA, 25 bp, Mus musculus
cctaaacactgtaggccaggtcctc

SEQ ID NO: 351455 - DNA, 25 bp, Mus musculus
cctaaacactgttggccaggtcctc

SEQ ID NO: 351456 - DNA, 25 bp, Mus musculus
cctaaacccttacccatgtgggaca

SEQ ID NO: 351457 - DNA, 25 bp, Mus musculus
cctaaacccttagccatgtgggaca

SEQ ID NO: 351458 - DNA, 25 bp, Mus musculus
cctaaactgatcacaccttgtgtgt

SEQ ID NO: 351459 - DNA, 25 bp, Mus musculus
cctaaactgatctcaccttgtgtgt

SEQ ID NO: 351460 - DNA, 25 bp, Mus musculus
cctaaacttagcagggtgtggtctt

SEQ ID NO: 351461 - DNA, 25 bp, Mus musculus
cctaaacttagctgggtgtggtctt

SEQ ID NO: 351462 - DNA, 25 bp, Mus musculus
cctaaacttgacctgggtgtaacat

SEQ ID NO: 351463 - DNA, 25 bp, Mus musculus
cctaaacttgacgtgggtgtaacat

SEQ ID NO: 351464 - DNA, 25 bp, Mus musculus
cctaaagagtgtctagttctgcatt

SEQ ID NO: 351465 - DNA, 25 bp, Mus musculus
cctaaagagtgtgtagttctgcatt

SEQ ID NO: 351466 - DNA, 25 bp, Mus musculus
cctaaagagttccatgttagtcaga

SEQ ID NO: 351467 - DNA, 25 bp, Mus musculus
cctaaagagttcgatgttagtcaga

SEQ ID NO: 351468 - DNA, 25 bp, Mus musculus
cctaaagattttcacttcctgttct

SEQ ID NO: 351469 - DNA, 25 bp, Mus musculus
cctaaagattttgacttcctgttct

SEQ ID NO: 351470 - DNA, 25 bp, Mus musculus
cctaaaggttacagcttcattcaaa

SEQ ID NO: 351471 - DNA, 25 bp, Mus musculus
cctaaaggttactgcttcattcaaa

SEQ ID NO: 351472 - DNA, 25 bp, Mus musculus
cctaaagtcaacctacagcctgcat

SEQ ID NO: 351473 - DNA, 25 bp, Mus musculus
cctaaagtcaacgtacagcctgcat

SEQ ID NO: 351474 - DNA, 25 bp, Mus musculus
cctaaagttttgcacctgcaggagt

SEQ ID NO: 351475 - DNA, 25 bp, Mus musculus
cctaaagttttggacctgcaggagt

SEQ ID NO: 351476 - DNA, 25 bp, Mus musculus
cctaaatagctgaggttgttttcct

SEQ ID NO: 351477 - DNA, 25 bp, Mus musculus
cctaaatagctgtggttgttttcct

SEQ ID NO: 351478 - DNA, 25 bp, Mus musculus
cctaaatgttctctctggactctga

SEQ ID NO: 351479 - DNA, 25 bp, Mus musculus
cctaaatgttctgtctggactctga

SEQ ID NO: 351480 - DNA, 25 bp, Mus musculus
cctaaatgttgcctctggacacaag

SEQ ID NO: 351481 - DNA, 25 bp, Mus musculus
cctaaatgttgcgtctggacacaag

SEQ ID NO: 351482 - DNA, 25 bp, Mus musculus
cctaaattatttatagcgtggaatc

SEQ ID NO: 351483 - DNA, 25 bp, Mus musculus
cctaaattatttttagcgtggaatc

SEQ ID NO: 351484 - DNA, 25 bp, Mus musculus
cctaaattccctaactgatgtttat

SEQ ID NO: 351485 - DNA, 25 bp, Mus musculus
cctaaattcccttactgatgtttat

SEQ ID NO: 351486 - DNA, 25 bp, Mus musculus
cctaaattcctgaatggacttgaga

SEQ ID NO: 351487 - DNA, 25 bp, Mus musculus
cctaaattcctgtatggacttgaga

SEQ ID NO: 351488 - DNA, 25 bp, Mus musculus
cctaaatttgacagtgcctcttgac

SEQ ID NO: 351489 - DNA, 25 bp, Mus musculus
cctaaatttgactgtgcctcttgac

SEQ ID NO: 351490 - DNA, 25 bp, Mus musculus
cctaacaccttaactaacaaaatct

SEQ ID NO: 351491 - DNA, 25 bp, Mus musculus
cctaacaccttatctaacaaaatct

SEQ ID NO: 351492 - DNA, 25 bp, Mus musculus
cctaacacttccacttcagatagaa

SEQ ID NO: 351493 - DNA, 25 bp, Mus musculus
cctaacacttcctcttcagatagaa

SEQ ID NO: 351494 - DNA, 25 bp, Mus musculus
cctaacagtctgagctcaatcccag

SEQ ID NO: 351495 - DNA, 25 bp, Mus musculus
cctaacagtctgtgctcaatcccag

SEQ ID NO: 351496 - DNA, 25 bp, Mus musculus
cctaacagttctcacaatgtccttt

SEQ ID NO: 351497 - DNA, 25 bp, Mus musculus
cctaacagttctgacaatgtccttt

SEQ ID NO: 351498 - DNA, 25 bp, Mus musculus
cctaacatactgactgctgcgacaa

SEQ ID NO: 351499 - DNA, 25 bp, Mus musculus
cctaacatactgtctgctgcgacaa

SEQ ID NO: 351500 - DNA, 25 bp, Mus musculus
cctaacataggaagggtctatctaa

SEQ ID NO: 351501 - DNA, 25 bp, Mus musculus
cctaacataggatgggtctatctaa

SEQ ID NO: 351502 - DNA, 25 bp, Mus musculus
cctaacatggtcacacaggccctga

SEQ ID NO: 351503 - DNA, 25 bp, Mus musculus
cctaacatggtctcacaggccctga

SEQ ID NO: 351504 - DNA, 25 bp, Mus musculus
cctaacatttctccagctctgtaaa

SEQ ID NO: 351505 - DNA, 25 bp, Mus musculus
cctaacatttctgcagctctgtaaa

SEQ ID NO: 351506 - DNA, 25 bp, Mus musculus
cctaaccaacttcctatggagtgtt

SEQ ID NO: 351507 - DNA, 25 bp, Mus musculus
cctaaccaacttgctatggagtgtt

SEQ ID NO: 351508 - DNA, 25 bp, Mus musculus
cctaacccagcgaggtgacacatga

SEQ ID NO: 351509 - DNA, 25 bp, Mus musculus
cctaacccagcgtggtgacacatga

SEQ ID NO: 351510 - DNA, 25 bp, Mus musculus
cctaaccctactcatgttcttgaat

SEQ ID NO: 351511 - DNA, 25 bp, Mus musculus
cctaaccctactgatgttcttgaat

SEQ ID NO: 351512 - DNA, 25 bp, Mus musculus
cctaaccctatcatcagcaagacaa

SEQ ID NO: 351513 - DNA, 25 bp, Mus musculus
cctaaccctatcttcagcaagacaa

SEQ ID NO: 351514 - DNA, 25 bp, Mus musculus
cctaaccctgggagcttgcagcttc

SEQ ID NO: 351515 - DNA, 25 bp, Mus musculus
cctaaccctgggtgcttgcagcttc

SEQ ID NO: 351516 - DNA, 25 bp, Mus musculus
cctaacctagaaagatggacataaa

SEQ ID NO: 351517 - DNA, 25 bp, Mus musculus
cctaacctagaatgatggacataaa

SEQ ID NO: 351518 - DNA, 25 bp, Mus musculus
cctaacctgctcagggctaaagatg

SEQ ID NO: 351519 - DNA, 25 bp, Mus musculus
cctaacctgctctgggctaaagatg

SEQ ID NO: 351520 - DNA, 25 bp, Mus musculus
cctaacgaggtcagatcactgatca

SEQ ID NO: 351521 - DNA, 25 bp, Mus musculus
cctaacgaggtctgatcactgatca

SEQ ID NO: 351522 - DNA, 25 bp, Mus musculus
cctaactagaatctggactgggttg

SEQ ID NO: 351523 - DNA, 25 bp, Mus musculus
cctaactagaatgtggactgggttg

SEQ ID NO: 351524 - DNA, 25 bp, Mus musculus
cctaactagttcattttacatgttc

SEQ ID NO: 351525 - DNA, 25 bp, Mus musculus
cctaactagttctttttacatgttc

SEQ ID NO: 351526 - DNA, 25 bp, Mus musculus
cctaactcaaatcgaaacagctatg

SEQ ID NO: 351527 - DNA, 25 bp, Mus musculus
cctaactcaaatggaaacagctatg

SEQ ID NO: 351528 - DNA, 25 bp, Mus musculus
cctaactcaccccagtcattaaaga

SEQ ID NO: 351529 - DNA, 25 bp, Mus musculus
cctaactcacccgagtcattaaaga

SEQ ID NO: 351530 - DNA, 25 bp, Mus musculus
cctaactcatgcatcctgaatcaaa

SEQ ID NO: 351531 - DNA, 25 bp, Mus musculus
cctaactcatgcttcctgaatcaaa

SEQ ID NO: 351532 - DNA, 25 bp, Mus musculus
cctaactcctatactggcaggcagt

SEQ ID NO: 351533 - DNA, 25 bp, Mus musculus
cctaactcctattctggcaggcagt

SEQ ID NO: 351534 - DNA, 25 bp, Mus musculus
cctaactgggttcctatggactact

SEQ ID NO: 351535 - DNA, 25 bp, Mus musculus
cctaactgggttgctatggactact

SEQ ID NO: 351536 - DNA, 25 bp, Mus musculus
cctaactttgtgaccagtccagcac

SEQ ID NO: 351537 - DNA, 25 bp, Mus musculus
cctaactttgtgtccagtccagcac

SEQ ID NO: 351538 - DNA, 25 bp, Mus musculus
cctaagaaacttctcctcgcttggg

SEQ ID NO: 351539 - DNA, 25 bp, Mus musculus
cctaagaaacttgtcctcgcttggg

SEQ ID NO: 351540 - DNA, 25 bp, Mus musculus
cctaagacatgcaggctgggaagcc

SEQ ID NO: 351541 - DNA, 25 bp, Mus musculus
cctaagacatgctggctgggaagcc

SEQ ID NO: 351542 - DNA, 25 bp, Mus musculus
cctaagacctgcccctggatgcata

SEQ ID NO: 351543 - DNA, 25 bp, Mus musculus
cctaagacctgcgcctggatgcata

SEQ ID NO: 351544 - DNA, 25 bp, Mus musculus
cctaagaggaggatggtcgcgtcca

SEQ ID NO: 351545 - DNA, 25 bp, Mus musculus
cctaagaggaggttggtcgcgtcca

SEQ ID NO: 351546 - DNA, 25 bp, Mus musculus
cctaagatactgagcagggacgtct

SEQ ID NO: 351547 - DNA, 25 bp, Mus musculus
cctaagatactgtgcagggacgtct

SEQ ID NO: 351548 - DNA, 25 bp, Mus musculus
cctaagatagctcctacacttgact

SEQ ID NO: 351549 - DNA, 25 bp, Mus musculus
cctaagatagctgctacacttgact

SEQ ID NO: 351550 - DNA, 25 bp, Mus musculus
cctaagcagataaaaatggctggtt

SEQ ID NO: 351551 - DNA, 25 bp, Mus musculus
cctaagcagatataaatggctggtt

SEQ ID NO: 351552 - DNA, 25 bp, Mus musculus
cctaagcctggcctctttcttctag

SEQ ID NO: 351553 - DNA, 25 bp, Mus musculus
cctaagcctggcgtctttcttctag

SEQ ID NO: 351554 - DNA, 25 bp, Mus musculus
cctaagctgatcacatattgttaga

SEQ ID NO: 351555 - DNA, 25 bp, Mus musculus
cctaagctgatctcatattgttaga

SEQ ID NO: 351556 - DNA, 25 bp, Mus musculus
cctaagctggttcgcaagtgggacc

SEQ ID NO: 351557 - DNA, 25 bp, Mus musculus
cctaagctggttggcaagtgggacc

SEQ ID NO: 351558 - DNA, 25 bp, Mus musculus
cctaagctgtccactggagacattt

SEQ ID NO: 351559 - DNA, 25 bp, Mus musculus
cctaagctgtcctctggagacattt

SEQ ID NO: 351560 - DNA, 25 bp, Mus musculus
cctaagcttggtcgtcccaggagga

SEQ ID NO: 351561 - DNA, 25 bp, Mus musculus
cctaagcttggtggtcccaggagga

SEQ ID NO: 351562 - DNA, 25 bp, Mus musculus
cctaaggactacctgaactgggagt

SEQ ID NO: 351563 - DNA, 25 bp, Mus musculus
cctaaggactacgtgaactgggagt

SEQ ID NO: 351564 - DNA, 25 bp, Mus musculus
cctaaggaggacaatagatgagatt

SEQ ID NO: 351565 - DNA, 25 bp, Mus musculus
cctaaggaggactatagatgagatt

SEQ ID NO: 351566 - DNA, 25 bp, Mus musculus
cctaagggcgatattctttgagatc

SEQ ID NO: 351567 - DNA, 25 bp, Mus musculus
cctaagggcgattttctttgagatc

SEQ ID NO: 351568 - DNA, 25 bp, Mus musculus
cctaagggtatcacatggtagagaa

SEQ ID NO: 351569 - DNA, 25 bp, Mus musculus
cctaagggtatctcatggtagagaa

SEQ ID NO: 351570 - DNA, 25 bp, Mus musculus
cctaaggttataataagctggtgct

SEQ ID NO: 351571 - DNA, 25 bp, Mus musculus
cctaaggttatattaagctggtgct

SEQ ID NO: 351572 - DNA, 25 bp, Mus musculus
cctaagtagatcagagttggcacat

SEQ ID NO: 351573 - DNA, 25 bp, Mus musculus
cctaagtagatctgagttggcacat

SEQ ID NO: 351574 - DNA, 25 bp, Mus musculus
cctaagtatcggctgtcccatagat

SEQ ID NO: 351575 - DNA, 25 bp, Mus musculus
cctaagtatcgggtgtcccatagat

SEQ ID NO: 351576 - DNA, 25 bp, Mus musculus
cctaagtctcgcctggctgctggaa

SEQ ID NO: 351577 - DNA, 25 bp, Mus musculus
cctaagtctcgcgtggctgctggaa

SEQ ID NO: 351578 - DNA, 25 bp, Mus musculus
cctaagtgaatgacccttgctggaa

SEQ ID NO: 351579 - DNA, 25 bp, Mus musculus
cctaagtgaatgtcccttgctggaa

SEQ ID NO: 351580 - DNA, 25 bp, Mus musculus
cctaagtgactaccccagactggaa

SEQ ID NO: 351581 - DNA, 25 bp, Mus musculus
cctaagtgactagcccagactggaa

SEQ ID NO: 351582 - DNA, 25 bp, Mus musculus
cctaagtggatcaatgctactgacc

SEQ ID NO: 351583 - DNA, 25 bp, Mus musculus
cctaagtggatctatgctactgacc

SEQ ID NO: 351584 - DNA, 25 bp, Mus musculus
cctaagttcaatcttcagcagcacc

SEQ ID NO: 351585 - DNA, 25 bp, Mus musculus
cctaagttcaatgttcagcagcacc

SEQ ID NO: 351586 - DNA, 25 bp, Mus musculus
cctaagtttatgcacctatgctcat

SEQ ID NO: 351587 - DNA, 25 bp, Mus musculus
cctaagtttatggacctatgctcat

SEQ ID NO: 351588 - DNA, 25 bp, Mus musculus
cctaataattttcagctttatctgt

SEQ ID NO: 351589 - DNA, 25 bp, Mus musculus
cctaataattttgagctttatctgt

SEQ ID NO: 351590 - DNA, 25 bp, Mus musculus
cctaatacagaaagtgggtgctggt

SEQ ID NO: 351591 - DNA, 25 bp, Mus musculus
cctaatacagaatgtgggtgctggt

SEQ ID NO: 351592 - DNA, 25 bp, Mus musculus
cctaatactcatcctagatatggta

SEQ ID NO: 351593 - DNA, 25 bp, Mus musculus
cctaatactcatgctagatatggta

SEQ ID NO: 351594 - DNA, 25 bp, Mus musculus
cctaatagtggtcgtactaagtaca

SEQ ID NO: 351595 - DNA, 25 bp, Mus musculus
cctaatagtggtggtactaagtaca

SEQ ID NO: 351596 - DNA, 25 bp, Mus musculus
cctaatatacctctgcaaacaatct

SEQ ID NO: 351597 - DNA, 25 bp, Mus musculus
cctaatatacctgtgcaaacaatct

SEQ ID NO: 351598 - DNA, 25 bp, Mus musculus
cctaatatagtgctcataaggctag

SEQ ID NO: 351599 - DNA, 25 bp, Mus musculus
cctaatatagtggtcataaggctag

SEQ ID NO: 351600 - DNA, 25 bp, Mus musculus
cctaatatttctcaggtgtggatat

SEQ ID NO: 351601 - DNA, 25 bp, Mus musculus
cctaatatttctgaggtgtggatat

SEQ ID NO: 351602 - DNA, 25 bp, Mus musculus
cctaatctctgaagactgtagcttg

SEQ ID NO: 351603 - DNA, 25 bp, Mus musculus
cctaatctctgatgactgtagcttg

SEQ ID NO: 351604 - DNA, 25 bp, Mus musculus
cctaatcttcaccatctcttattaa

SEQ ID NO: 351605 - DNA, 25 bp, Mus musculus
cctaatcttcacgatctcttattaa

SEQ ID NO: 351606 - DNA, 25 bp, Mus musculus
cctaatcttgacagagtgcttattt

SEQ ID NO: 351607 - DNA, 25 bp, Mus musculus
cctaatcttgactgagtgcttattt

SEQ ID NO: 351608 - DNA, 25 bp, Mus musculus
cctaatgaccttacacatagtggct

SEQ ID NO: 351609 - DNA, 25 bp, Mus musculus
cctaatgacctttcacatagtggct

SEQ ID NO: 351610 - DNA, 25 bp, Mus musculus
cctaatgacgttagttgaatttcca

SEQ ID NO: 351611 - DNA, 25 bp, Mus musculus
cctaatgacgtttgttgaatttcca

SEQ ID NO: 351612 - DNA, 25 bp, Mus musculus
cctaatgatataatccccttagcca

SEQ ID NO: 351613 - DNA, 25 bp, Mus musculus
cctaatgatatattccccttagcca

SEQ ID NO: 351614 - DNA, 25 bp, Mus musculus
cctaatgcaactactctgcctgctg

SEQ ID NO: 351615 - DNA, 25 bp, Mus musculus
cctaatgcaacttctctgcctgctg

SEQ ID NO: 351616 - DNA, 25 bp, Mus musculus
cctaatgcccttacctaaatagatt

SEQ ID NO: 351617 - DNA, 25 bp, Mus musculus
cctaatgccctttcctaaatagatt

SEQ ID NO: 351618 - DNA, 25 bp, Mus musculus
cctaatgctaatctgggtctccttc

SEQ ID NO: 351619 - DNA, 25 bp, Mus musculus
cctaatgctaatgtgggtctccttc

SEQ ID NO: 351620 - DNA, 25 bp, Mus musculus
cctaatgtaattcggtctccaccaa

SEQ ID NO: 351621 - DNA, 25 bp, Mus musculus
cctaatgtaattgggtctccaccaa

SEQ ID NO: 351622 - DNA, 25 bp, Mus musculus
cctaatgtcatcagtatcttcttcc

SEQ ID NO: 351623 - DNA, 25 bp, Mus musculus
cctaatgtcatctgtatcttcttcc

SEQ ID NO: 351624 - DNA, 25 bp, Mus musculus
cctaattacccgaactgtggaaatg

SEQ ID NO: 351625 - DNA, 25 bp, Mus musculus
cctaattacccgtactgtggaaatg

SEQ ID NO: 351626 - DNA, 25 bp, Mus musculus
cctaattcattacgctaattcatta

SEQ ID NO: 351627 - DNA, 25 bp, Mus musculus
cctaattcattaggctaattcatta

SEQ ID NO: 351628 - DNA, 25 bp, Mus musculus
cctaattccaggaattttgtcacat

SEQ ID NO: 351629 - DNA, 25 bp, Mus musculus
cctaattccaggtattttgtcacat

SEQ ID NO: 351630 - DNA, 25 bp, Mus musculus
cctaattcctcacaggctggcagaa

SEQ ID NO: 351631 - DNA, 25 bp, Mus musculus
cctaattcctcagaggctggcagaa

SEQ ID NO: 351632 - DNA, 25 bp, Mus musculus
cctaattggctgaagccacgtgcct

SEQ ID NO: 351633 - DNA, 25 bp, Mus musculus
cctaattggctgtagccacgtgcct

SEQ ID NO: 351634 - DNA, 25 bp, Mus musculus
cctaattgttctcttttgggactgc

SEQ ID NO: 351635 - DNA, 25 bp, Mus musculus
cctaattgttctgttttgggactgc

SEQ ID NO: 351636 - DNA, 25 bp, Mus musculus
cctaattgtttcacaactccattac

SEQ ID NO: 351637 - DNA, 25 bp, Mus musculus
cctaattgtttctcaactccattac

SEQ ID NO: 351638 - DNA, 25 bp, Mus musculus
cctaatttgaccacaaatgacctta

SEQ ID NO: 351639 - DNA, 25 bp, Mus musculus
cctaatttgacctcaaatgacctta

SEQ ID NO: 351640 - DNA, 25 bp, Mus musculus
cctaattttatcctggtgaatgatg

SEQ ID NO: 351641 - DNA, 25 bp, Mus musculus
cctaattttatcgtggtgaatgatg

SEQ ID NO: 351642 - DNA, 25 bp, Mus musculus
cctacaactttgatccaatgatatt

SEQ ID NO: 351643 - DNA, 25 bp, Mus musculus
cctacaactttgttccaatgatatt

SEQ ID NO: 351644 - DNA, 25 bp, Mus musculus
cctacaagtactatggctcctcgaa

SEQ ID NO: 351645 - DNA, 25 bp, Mus musculus
cctacaagtactttggctcctcgaa

SEQ ID NO: 351646 - DNA, 25 bp, Mus musculus
cctacaagtccaagagagtctctct

SEQ ID NO: 351647 - DNA, 25 bp, Mus musculus
cctacaagtccatgagagtctctct

SEQ ID NO: 351648 - DNA, 25 bp, Mus musculus
cctacaagtgccacatgtgtggcaa

SEQ ID NO: 351649 - DNA, 25 bp, Mus musculus
cctacaagtgcctcatgtgtggcaa

SEQ ID NO: 351650 - DNA, 25 bp, Mus musculus
cctacaattcgcagccagtacttgg

SEQ ID NO: 351651 - DNA, 25 bp, Mus musculus
cctacaattcgctgccagtacttgg

SEQ ID NO: 351652 - DNA, 25 bp, Mus musculus
cctacaccaagtatgctagcatgat

SEQ ID NO: 351653 - DNA, 25 bp, Mus musculus
cctacaccaagtttgctagcatgat

SEQ ID NO: 351654 - DNA, 25 bp, Mus musculus
cctacacctggcattgcaagtgtaa

SEQ ID NO: 351655 - DNA, 25 bp, Mus musculus
cctacacctggctttgcaagtgtaa

SEQ ID NO: 351656 - DNA, 25 bp, Mus musculus
cctacacggattacaggtttgcttc

SEQ ID NO: 351657 - DNA, 25 bp, Mus musculus
cctacacggatttcaggtttgcttc

SEQ ID NO: 351658 - DNA, 25 bp, Mus musculus
cctacactaacgagggaaggacagg

SEQ ID NO: 351659 - DNA, 25 bp, Mus musculus
cctacactaacgtgggaaggacagg

SEQ ID NO: 351660 - DNA, 25 bp, Mus musculus
cctacactaagcacctggtatttga

SEQ ID NO: 351661 - DNA, 25 bp, Mus musculus
cctacactaagctcctggtatttga

SEQ ID NO: 351662 - DNA, 25 bp, Mus musculus
cctacactgactccggcctggcatc

SEQ ID NO: 351663 - DNA, 25 bp, Mus musculus
cctacactgactgcggcctggcatc

SEQ ID NO: 351664 - DNA, 25 bp, Mus musculus
cctacactgcccattaccttgtggg

SEQ ID NO: 351665 - DNA, 25 bp, Mus musculus
cctacactgccctttaccttgtggg

SEQ ID NO: 351666 - DNA, 25 bp, Mus musculus
cctacactgcttctggctatatttt

SEQ ID NO: 351667 - DNA, 25 bp, Mus musculus
cctacactgcttgtggctatatttt

SEQ ID NO: 351668 - DNA, 25 bp, Mus musculus
cctacacttgacattcttcagattc

SEQ ID NO: 351669 - DNA, 25 bp, Mus musculus
cctacacttgactttcttcagattc

SEQ ID NO: 351670 - DNA, 25 bp, Mus musculus
cctacagaaagcatagtggctggga

SEQ ID NO: 351671 - DNA, 25 bp, Mus musculus
cctacagaaagcttagtggctggga

SEQ ID NO: 351672 - DNA, 25 bp, Mus musculus
cctacagagaggcacagccgggacc

SEQ ID NO: 351673 - DNA, 25 bp, Mus musculus
cctacagagagggacagccgggacc

SEQ ID NO: 351674 - DNA, 25 bp, Mus musculus
cctacagagtgccatgccctggaag

SEQ ID NO: 351675 - DNA, 25 bp, Mus musculus
cctacagagtgcgatgccctggaag

SEQ ID NO: 351676 - DNA, 25 bp, Mus musculus
cctacagccaggaactttgtcatca

SEQ ID NO: 351677 - DNA, 25 bp, Mus musculus
cctacagccaggtactttgtcatca

SEQ ID NO: 351678 - DNA, 25 bp, Mus musculus
cctacagccggcacaatgagttcgt

SEQ ID NO: 351679 - DNA, 25 bp, Mus musculus
cctacagccggctcaatgagttcgt

SEQ ID NO: 351680 - DNA, 25 bp, Mus musculus
cctacagcctggacgcacggacgga

SEQ ID NO: 351681 - DNA, 25 bp, Mus musculus
cctacagcctggtcgcacggacgga

SEQ ID NO: 351682 - DNA, 25 bp, Mus musculus
cctacaggatgaaacggcagaggcc

SEQ ID NO: 351683 - DNA, 25 bp, Mus musculus
cctacaggatgatacggcagaggcc

SEQ ID NO: 351684 - DNA, 25 bp, Mus musculus
cctacagggtcaatgaactgcttgt

SEQ ID NO: 351685 - DNA, 25 bp, Mus musculus
cctacagggtcattgaactgcttgt

SEQ ID NO: 351686 - DNA, 25 bp, Mus musculus
cctacaggtatccaggctttatgcc

SEQ ID NO: 351687 - DNA, 25 bp, Mus musculus
cctacaggtatcgaggctttatgcc

SEQ ID NO: 351688 - DNA, 25 bp, Mus musculus
cctacagtgcccatggttaaattag

SEQ ID NO: 351689 - DNA, 25 bp, Mus musculus
cctacagtgcccttggttaaattag

SEQ ID NO: 351690 - DNA, 25 bp, Mus musculus
cctacagtgggcaagtgagcttcct

SEQ ID NO: 351691 - DNA, 25 bp, Mus musculus
cctacagtgggctagtgagcttcct

SEQ ID NO: 351692 - DNA, 25 bp, Mus musculus
cctacagttagaagaagtttttctg

SEQ ID NO: 351693 - DNA, 25 bp, Mus musculus
cctacagttagatgaagtttttctg

SEQ ID NO: 351694 - DNA, 25 bp, Mus musculus
cctacagttcgtcaagatctccaga

SEQ ID NO: 351695 - DNA, 25 bp, Mus musculus
cctacagttcgtgaagatctccaga

SEQ ID NO: 351696 - DNA, 25 bp, Mus musculus
cctacatagaagcatggtggagcac

SEQ ID NO: 351697 - DNA, 25 bp, Mus musculus
cctacatagaaggatggtggagcac

SEQ ID NO: 351698 - DNA, 25 bp, Mus musculus
cctacatcatctcgcttatattggg

SEQ ID NO: 351699 - DNA, 25 bp, Mus musculus
cctacatcatctggcttatattggg

SEQ ID NO: 351700 - DNA, 25 bp, Mus musculus
cctacatccccacagttgatcggga

SEQ ID NO: 351701 - DNA, 25 bp, Mus musculus
cctacatccccagagttgatcggga

SEQ ID NO: 351702 - DNA, 25 bp, Mus musculus
cctacatcgtacatccaccatctta

SEQ ID NO: 351703 - DNA, 25 bp, Mus musculus
cctacatcgtacttccaccatctta

SEQ ID NO: 351704 - DNA, 25 bp, Mus musculus
cctacatgatttactttgtcgtggt

SEQ ID NO: 351705 - DNA, 25 bp, Mus musculus
cctacatgattttctttgtcgtggt

SEQ ID NO: 351706 - DNA, 25 bp, Mus musculus
cctacattcactcttgccttgaact

SEQ ID NO: 351707 - DNA, 25 bp, Mus musculus
cctacattcactgttgccttgaact

SEQ ID NO: 351708 - DNA, 25 bp, Mus musculus
cctacattgcttatttgtattgtgt

SEQ ID NO: 351709 - DNA, 25 bp, Mus musculus
cctacattgcttttttgtattgtgt

SEQ ID NO: 351710 - DNA, 25 bp, Mus musculus
cctacattgtctaagcaccggcaaa

SEQ ID NO: 351711 - DNA, 25 bp, Mus musculus
cctacattgtcttagcaccggcaaa

SEQ ID NO: 351712 - DNA, 25 bp, Mus musculus
cctaccaaatccaaagtctttagag

SEQ ID NO: 351713 - DNA, 25 bp, Mus musculus
cctaccaaatcctaagtctttagag

SEQ ID NO: 351714 - DNA, 25 bp, Mus musculus
cctaccaagcctccagtttataatt

SEQ ID NO: 351715 - DNA, 25 bp, Mus musculus
cctaccaagcctgcagtttataatt

SEQ ID NO: 351716 - DNA, 25 bp, Mus musculus
cctaccaattaccacaagctcaaaa

SEQ ID NO: 351717 - DNA, 25 bp, Mus musculus
cctaccaattacgacaagctcaaaa

SEQ ID NO: 351718 - DNA, 25 bp, Mus musculus
cctaccagatggatttcaacattta

SEQ ID NO: 351719 - DNA, 25 bp, Mus musculus
cctaccagatggttttcaacattta

SEQ ID NO: 351720 - DNA, 25 bp, Mus musculus
cctaccagcggcctggctatgggaa

SEQ ID NO: 351721 - DNA, 25 bp, Mus musculus
cctaccagcggcgtggctatgggaa

SEQ ID NO: 351722 - DNA, 25 bp, Mus musculus
cctaccaggagcagctttctataga

SEQ ID NO: 351723 - DNA, 25 bp, Mus musculus
cctaccaggagctgctttctataga

SEQ ID NO: 351724 - DNA, 25 bp, Mus musculus
cctaccaggctgcacaatttagttt

SEQ ID NO: 351725 - DNA, 25 bp, Mus musculus
cctaccaggctggacaatttagttt

SEQ ID NO: 351726 - DNA, 25 bp, Mus musculus
cctaccatcctactttgccaaaagt

SEQ ID NO: 351727 - DNA, 25 bp, Mus musculus
cctaccatcctagtttgccaaaagt

SEQ ID NO: 351728 - DNA, 25 bp, Mus musculus
cctaccatgatgatctgattcttta

SEQ ID NO: 351729 - DNA, 25 bp, Mus musculus
cctaccatgatgttctgattcttta

SEQ ID NO: 351730 - DNA, 25 bp, Mus musculus
cctaccatgctgactgatgtcatta

SEQ ID NO: 351731 - DNA, 25 bp, Mus musculus
cctaccatgctgtctgatgtcatta

SEQ ID NO: 351732 - DNA, 25 bp, Mus musculus
cctaccatgtttattatgtgaatat

SEQ ID NO: 351733 - DNA, 25 bp, Mus musculus
cctaccatgttttttatgtgaatat

SEQ ID NO: 351734 - DNA, 25 bp, Mus musculus
cctacccaaataatgactgcacttc

SEQ ID NO: 351735 - DNA, 25 bp, Mus musculus
cctacccaaatattgactgcacttc

SEQ ID NO: 351736 - DNA, 25 bp, Mus musculus
cctacccaccttataatgactcgag

SEQ ID NO: 351737 - DNA, 25 bp, Mus musculus
cctacccaccttttaatgactcgag

SEQ ID NO: 351738 - DNA, 25 bp, Mus musculus
cctacccacttgcattctattagta

SEQ ID NO: 351739 - DNA, 25 bp, Mus musculus
cctacccacttgctcttgagaagag

SEQ ID NO: 351740 - DNA, 25 bp, Mus musculus
cctacccacttggattctattagta

SEQ ID NO: 351741 - DNA, 25 bp, Mus musculus
cctacccacttggtcttgagaagag

SEQ ID NO: 351742 - DNA, 25 bp, Mus musculus
cctacccataatattatccctcttt

SEQ ID NO: 351743 - DNA, 25 bp, Mus musculus
cctacccataattttatccctcttt

SEQ ID NO: 351744 - DNA, 25 bp, Mus musculus
cctacccatggaccctgagacttgg

SEQ ID NO: 351745 - DNA, 25 bp, Mus musculus
cctacccatggagcctgagacttgg

SEQ ID NO: 351746 - DNA, 25 bp, Mus musculus
cctaccccgggtatcagtgttctgg

SEQ ID NO: 351747 - DNA, 25 bp, Mus musculus
cctaccccgggtttcagtgttctgg

SEQ ID NO: 351748 - DNA, 25 bp, Mus musculus
cctacccctgaaatcttacaagctg

SEQ ID NO: 351749 - DNA, 25 bp, Mus musculus
cctacccctgaattcttacaagctg

SEQ ID NO: 351750 - DNA, 25 bp, Mus musculus
cctacccggttcatcagcattagat

SEQ ID NO: 351751 - DNA, 25 bp, Mus musculus
cctacccggttcttcagcattagat

SEQ ID NO: 351752 - DNA, 25 bp, Mus musculus
cctaccctcatcctggttattgtgt

SEQ ID NO: 351753 - DNA, 25 bp, Mus musculus
cctaccctcatcgtggttattgtgt

SEQ ID NO: 351754 - DNA, 25 bp, Mus musculus
cctaccctgaggacaatgagccgaa

SEQ ID NO: 351755 - DNA, 25 bp, Mus musculus
cctaccctgaggtcaatgagccgaa

SEQ ID NO: 351756 - DNA, 25 bp, Mus musculus
cctaccgactggagactctttgaaa

SEQ ID NO: 351757 - DNA, 25 bp, Mus musculus
cctaccgactggtgactctttgaaa

SEQ ID NO: 351758 - DNA, 25 bp, Mus musculus
cctaccgagtatatcctcagtactt

SEQ ID NO: 351759 - DNA, 25 bp, Mus musculus
cctaccgagtatttcctcagtactt

SEQ ID NO: 351760 - DNA, 25 bp, Mus musculus
cctaccgcctacagtcaagaaatga

SEQ ID NO: 351761 - DNA, 25 bp, Mus musculus
cctaccgcctactgtcaagaaatga

SEQ ID NO: 351762 - DNA, 25 bp, Mus musculus
cctaccgctgggactgtgagacaaa

SEQ ID NO: 351763 - DNA, 25 bp, Mus musculus
cctaccgctgggtctgtgagacaaa

SEQ ID NO: 351764 - DNA, 25 bp, Mus musculus
cctacctatcttagtcttgaaccaa

SEQ ID NO: 351765 - DNA, 25 bp, Mus musculus
cctacctatctttgtcttgaaccaa

SEQ ID NO: 351766 - DNA, 25 bp, Mus musculus
cctacctcagtgataacaagtctct

SEQ ID NO: 351767 - DNA, 25 bp, Mus musculus
cctacctcagtgttaacaagtctct

SEQ ID NO: 351768 - DNA, 25 bp, Mus musculus
cctacctcatagacctgctttgaaa

SEQ ID NO: 351769 - DNA, 25 bp, Mus musculus
cctacctcatagtcctgctttgaaa

SEQ ID NO: 351770 - DNA, 25 bp, Mus musculus
cctacctccctaaatcaagcatgat

SEQ ID NO: 351771 - DNA, 25 bp, Mus musculus
cctacctccctatatcaagcatgat

SEQ ID NO: 351772 - DNA, 25 bp, Mus musculus
cctacctcgagtatgtgcgtctgta

SEQ ID NO: 351773 - DNA, 25 bp, Mus musculus
cctacctcgagtttgtgcgtctgta

SEQ ID NO: 351774 - DNA, 25 bp, Mus musculus
cctacctctggcacagtcagataac

SEQ ID NO: 351775 - DNA, 25 bp, Mus musculus
cctacctctggctcagtcagataac

SEQ ID NO: 351776 - DNA, 25 bp, Mus musculus
cctacctgaaggcagactgcgtgga

SEQ ID NO: 351777 - DNA, 25 bp, Mus musculus
cctacctgaagggagactgcgtgga

SEQ ID NO: 351778 - DNA, 25 bp, Mus musculus
cctacctgcgggacatgaagtttcg

SEQ ID NO: 351779 - DNA, 25 bp, Mus musculus
cctacctgcgggtcatgaagtttcg

SEQ ID NO: 351780 - DNA, 25 bp, Mus musculus
cctacctgcttcactaatctttttt

SEQ ID NO: 351781 - DNA, 25 bp, Mus musculus
cctacctgcttctctaatctttttt

SEQ ID NO: 351782 - DNA, 25 bp, Mus musculus
cctacctgggctagtaattctggac

SEQ ID NO: 351783 - DNA, 25 bp, Mus musculus
cctacctgggcttgtaattctggac

SEQ ID NO: 351784 - DNA, 25 bp, Mus musculus
cctacctggttcacatcatgtgcaa

SEQ ID NO: 351785 - DNA, 25 bp, Mus musculus
cctacctggttctcatcatgtgcaa

SEQ ID NO: 351786 - DNA, 25 bp, Mus musculus
cctaccttacatcctctgggagatt

SEQ ID NO: 351787 - DNA, 25 bp, Mus musculus
cctaccttacatgctctgggagatt

SEQ ID NO: 351788 - DNA, 25 bp, Mus musculus
cctaccttattaacctctaacactg

SEQ ID NO: 351789 - DNA, 25 bp, Mus musculus
cctaccttattatcctctaacactg

SEQ ID NO: 351790 - DNA, 25 bp, Mus musculus
cctacctttcccattgttcataaat

SEQ ID NO: 351791 - DNA, 25 bp, Mus musculus
cctacctttccctttgttcataaat

SEQ ID NO: 351792 - DNA, 25 bp, Mus musculus
cctacctttcttctgctttatgaaa

SEQ ID NO: 351793 - DNA, 25 bp, Mus musculus
cctacctttcttgtgctttatgaaa

SEQ ID NO: 351794 - DNA, 25 bp, Mus musculus
cctacctttgagcagcatgaagcca

SEQ ID NO: 351795 - DNA, 25 bp, Mus musculus
cctacctttgaggagcatgaagcca

SEQ ID NO: 351796 - DNA, 25 bp, Mus musculus
cctaccttttccaactgatatgctg

SEQ ID NO: 351797 - DNA, 25 bp, Mus musculus
cctaccttttcctactgatatgctg

SEQ ID NO: 351798 - DNA, 25 bp, Mus musculus
cctaccttttctctaccagggcaag

SEQ ID NO: 351799 - DNA, 25 bp, Mus musculus
cctaccttttctgtaccagggcaag

SEQ ID NO: 351800 - DNA, 25 bp, Mus musculus
cctaccttttgacgacttgatcctt

SEQ ID NO: 351801 - DNA, 25 bp, Mus musculus
cctaccttttgaggacttgatcctt

SEQ ID NO: 351802 - DNA, 25 bp, Mus musculus
cctacgaagcccatgtgtatatgtt

SEQ ID NO: 351803 - DNA, 25 bp, Mus musculus
cctacgaagcccttgtgtatatgtt

SEQ ID NO: 351804 - DNA, 25 bp, Mus musculus
cctacgacaagtccctggaggaggt

SEQ ID NO: 351805 - DNA, 25 bp, Mus musculus
cctacgacaagtgcctggaggaggt

SEQ ID NO: 351806 - DNA, 25 bp, Mus musculus
cctacgacgaggagtctgagaacct

SEQ ID NO: 351807 - DNA, 25 bp, Mus musculus
cctacgacgaggtgtctgagaacct

SEQ ID NO: 351808 - DNA, 25 bp, Mus musculus
cctacgagcggccagccatggagtt

SEQ ID NO: 351809 - DNA, 25 bp, Mus musculus
cctacgagcggcgagccatggagtt

SEQ ID NO: 351810 - DNA, 25 bp, Mus musculus
cctacgagtatgagcgtgatgggct

SEQ ID NO: 351811 - DNA, 25 bp, Mus musculus
cctacgagtatgtgcgtgatgggct

SEQ ID NO: 351812 - DNA, 25 bp, Mus musculus
cctacgattcagccataattttata

SEQ ID NO: 351813 - DNA, 25 bp, Mus musculus
cctacgattcaggcataattttata

SEQ ID NO: 351814 - DNA, 25 bp, Mus musculus
cctacgattgatatgggcccgcagt

SEQ ID NO: 351815 - DNA, 25 bp, Mus musculus
cctacgattgatttgggcccgcagt

SEQ ID NO: 351816 - DNA, 25 bp, Mus musculus
cctacgcagacgatgctgttgggtg

SEQ ID NO: 351817 - DNA, 25 bp, Mus musculus
cctacgcagacgttgctgttgggtg

SEQ ID NO: 351818 - DNA, 25 bp, Mus musculus
cctacgcaggtacgcagtgactgag

SEQ ID NO: 351819 - DNA, 25 bp, Mus musculus
cctacgcaggtaggcagtgactgag

SEQ ID NO: 351820 - DNA, 25 bp, Mus musculus
cctacgcagtctattgggcagacaa

SEQ ID NO: 351821 - DNA, 25 bp, Mus musculus
cctacgcagtcttttgggcagacaa

SEQ ID NO: 351822 - DNA, 25 bp, Mus musculus
cctacgccgtacacaggagcaggtg

SEQ ID NO: 351823 - DNA, 25 bp, Mus musculus
cctacgccgtactcaggagcaggtg

SEQ ID NO: 351824 - DNA, 25 bp, Mus musculus
cctacgctaggacattgggttttca

SEQ ID NO: 351825 - DNA, 25 bp, Mus musculus
cctacgctaggagattgggttttca

SEQ ID NO: 351826 - DNA, 25 bp, Mus musculus
cctacgctgtttctttacctgtgag

SEQ ID NO: 351827 - DNA, 25 bp, Mus musculus
cctacgctgtttgtttacctgtgag

SEQ ID NO: 351828 - DNA, 25 bp, Mus musculus
cctacgggctcaatgtgaggaactg

SEQ ID NO: 351829 - DNA, 25 bp, Mus musculus
cctacgggctcattgtgaggaactg

SEQ ID NO: 351830 - DNA, 25 bp, Mus musculus
cctacggtgtctccattttgtggta

SEQ ID NO: 351831 - DNA, 25 bp, Mus musculus
cctacggtgtctgcattttgtggta

SEQ ID NO: 351832 - DNA, 25 bp, Mus musculus
cctacgtgggtgactggagtttgat

SEQ ID NO: 351833 - DNA, 25 bp, Mus musculus
cctacgtgggtgtctggagtttgat

SEQ ID NO: 351834 - DNA, 25 bp, Mus musculus
cctacgtggtttacagctactgcat

SEQ ID NO: 351835 - DNA, 25 bp, Mus musculus
cctacgtggttttcagctactgcat

SEQ ID NO: 351836 - DNA, 25 bp, Mus musculus
cctacgttgggcatgggactgatgc

SEQ ID NO: 351837 - DNA, 25 bp, Mus musculus
cctacgttgggcttgggactgatgc

SEQ ID NO: 351838 - DNA, 25 bp, Mus musculus
cctactaaaactcctgaggctgttg

SEQ ID NO: 351839 - DNA, 25 bp, Mus musculus
cctactaaaactgctgaggctgttg

SEQ ID NO: 351840 - DNA, 25 bp, Mus musculus
cctactaacataacacttcttttcc

SEQ ID NO: 351841 - DNA, 25 bp, Mus musculus
cctactaacatatcacttcttttcc

SEQ ID NO: 351842 - DNA, 25 bp, Mus musculus
cctactacagcactagtcctggaaa

SEQ ID NO: 351843 - DNA, 25 bp, Mus musculus
cctactacagcagtagtcctggaaa

SEQ ID NO: 351844 - DNA, 25 bp, Mus musculus
cctactacccttactgtcatattga

SEQ ID NO: 351845 - DNA, 25 bp, Mus musculus
cctactaccctttctgtcatattga

SEQ ID NO: 351846 - DNA, 25 bp, Mus musculus
cctactacttacatgatactcatgt

SEQ ID NO: 351847 - DNA, 25 bp, Mus musculus
cctactacttacttgatactcatgt

SEQ ID NO: 351848 - DNA, 25 bp, Mus musculus
cctactatttagcaggccgagagga

SEQ ID NO: 351849 - DNA, 25 bp, Mus musculus
cctactatttaggaggccgagagga

SEQ ID NO: 351850 - DNA, 25 bp, Mus musculus
cctactcaagtgctgctctcaataa

SEQ ID NO: 351851 - DNA, 25 bp, Mus musculus
cctactcaagtggtgctctcaataa

SEQ ID NO: 351852 - DNA, 25 bp, Mus musculus
cctactcacagcatcgaacacatat

SEQ ID NO: 351853 - DNA, 25 bp, Mus musculus
cctactcacagcttcgaacacatat

SEQ ID NO: 351854 - DNA, 25 bp, Mus musculus
cctactccagaaagggttacttggt

SEQ ID NO: 351855 - DNA, 25 bp, Mus musculus
cctactccagaatgggttacttggt

SEQ ID NO: 351856 - DNA, 25 bp, Mus musculus
cctactcctggacggtccgagtgag

SEQ ID NO: 351857 - DNA, 25 bp, Mus musculus
cctactcctggagggtccgagtgag

SEQ ID NO: 351858 - DNA, 25 bp, Mus musculus
cctactcgctcgagcaggagcagct

SEQ ID NO: 351859 - DNA, 25 bp, Mus musculus
cctactcgctcgtgcaggagcagct

SEQ ID NO: 351860 - DNA, 25 bp, Mus musculus
cctactctacaaatgttggcagcgc

SEQ ID NO: 351861 - DNA, 25 bp, Mus musculus
cctactctacaattgttggcagcgc

SEQ ID NO: 351862 - DNA, 25 bp, Mus musculus
cctactctcttcatctctattagat

SEQ ID NO: 351863 - DNA, 25 bp, Mus musculus
cctactctcttcttctctattagat

SEQ ID NO: 351864 - DNA, 25 bp, Mus musculus
cctactctgcaaccggacgggaata

SEQ ID NO: 351865 - DNA, 25 bp, Mus musculus
cctactctgcaagcggacgggaata

SEQ ID NO: 351866 - DNA, 25 bp, Mus musculus
cctactgacggactgcttggatatc

SEQ ID NO: 351867 - DNA, 25 bp, Mus musculus
cctactgacggagtgcttggatatc

SEQ ID NO: 351868 - DNA, 25 bp, Mus musculus
cctactgcagtacaaccatcggatg

SEQ ID NO: 351869 - DNA, 25 bp, Mus musculus
cctactgcagtagaaccatcggatg

SEQ ID NO: 351870 - DNA, 25 bp, Mus musculus
cctactgcccagatgtttgggacat

SEQ ID NO: 351871 - DNA, 25 bp, Mus musculus
cctactgcccagttgtttgggacat

SEQ ID NO: 351872 - DNA, 25 bp, Mus musculus
cctactgctgcaaggacagggctta

SEQ ID NO: 351873 - DNA, 25 bp, Mus musculus
cctactgctgcatggacagggctta

SEQ ID NO: 351874 - DNA, 25 bp, Mus musculus
cctactgcttggctgtaaaggtgta

SEQ ID NO: 351875 - DNA, 25 bp, Mus musculus
cctactgcttgggtgtaaaggtgta

SEQ ID NO: 351876 - DNA, 25 bp, Mus musculus
cctactgctttcattttctgtgggt

SEQ ID NO: 351877 - DNA, 25 bp, Mus musculus
cctactgctttctttttctgtgggt

SEQ ID NO: 351878 - DNA, 25 bp, Mus musculus
cctactggactactgctggtgagaa

SEQ ID NO: 351879 - DNA, 25 bp, Mus musculus
cctactggactagtgctggtgagaa

SEQ ID NO: 351880 - DNA, 25 bp, Mus musculus
cctactgggttaaaattttcatcat

SEQ ID NO: 351881 - DNA, 25 bp, Mus musculus
cctactgggttataattttcatcat

SEQ ID NO: 351882 - DNA, 25 bp, Mus musculus
cctactggtctcctgaaggcagtga

SEQ ID NO: 351883 - DNA, 25 bp, Mus musculus
cctactggtctcgtgaaggcagtga

SEQ ID NO: 351884 - DNA, 25 bp, Mus musculus
cctactgtatacctgtgggcgatga

SEQ ID NO: 351885 - DNA, 25 bp, Mus musculus
cctactgtatacgtgtgggcgatga

SEQ ID NO: 351886 - DNA, 25 bp, Mus musculus
cctactgtcactattcatgtaaaat

SEQ ID NO: 351887 - DNA, 25 bp, Mus musculus
cctactgtcacttttcatgtaaaat

SEQ ID NO: 351888 - DNA, 25 bp, Mus musculus
cctactgtcctcattgtgtgctaaa

SEQ ID NO: 351889 - DNA, 25 bp, Mus musculus
cctactgtcctctttgtgtgctaaa

SEQ ID NO: 351890 - DNA, 25 bp, Mus musculus
cctactgtctgtaatttgcttttat

SEQ ID NO: 351891 - DNA, 25 bp, Mus musculus
cctactgtctgttatttgcttttat

SEQ ID NO: 351892 - DNA, 25 bp, Mus musculus
cctactgtggtcctgatgagattga

SEQ ID NO: 351893 - DNA, 25 bp, Mus musculus
cctactgtggtcgtgatgagattga

SEQ ID NO: 351894 - DNA, 25 bp, Mus musculus
cctactgttatcacctttgagtgtg

SEQ ID NO: 351895 - DNA, 25 bp, Mus musculus
cctactgttatctcctttgagtgtg

SEQ ID NO: 351896 - DNA, 25 bp, Mus musculus
cctactgttcatagtaaagggtcag

SEQ ID NO: 351897 - DNA, 25 bp, Mus musculus
cctactgttcattgtaaagggtcag

SEQ ID NO: 351898 - DNA, 25 bp, Mus musculus
cctacttaagtacggcttgccccag

SEQ ID NO: 351899 - DNA, 25 bp, Mus musculus
cctacttaagtagggcttgccccag

SEQ ID NO: 351900 - DNA, 25 bp, Mus musculus
cctacttagttgatcttgggatggt

SEQ ID NO: 351901 - DNA, 25 bp, Mus musculus
cctacttagttgttcttgggatggt

SEQ ID NO: 351902 - DNA, 25 bp, Mus musculus
cctacttatccccaggatctggatt

SEQ ID NO: 351903 - DNA, 25 bp, Mus musculus
cctacttatcccgaggatctggatt

SEQ ID NO: 351904 - DNA, 25 bp, Mus musculus
cctacttcaagacaaaggtgatcca

SEQ ID NO: 351905 - DNA, 25 bp, Mus musculus
cctacttcaagagaaaggtgatcca

SEQ ID NO: 351906 - DNA, 25 bp, Mus musculus
cctacttcatctatggaaattagtg

SEQ ID NO: 351907 - DNA, 25 bp, Mus musculus
cctacttcatctttggaaattagtg

SEQ ID NO: 351908 - DNA, 25 bp, Mus musculus
cctacttccattacaccaaaattat

SEQ ID NO: 351909 - DNA, 25 bp, Mus musculus
cctacttccatttcaccaaaattat

SEQ ID NO: 351910 - DNA, 25 bp, Mus musculus
cctacttcctttcttataaagctat

SEQ ID NO: 351911 - DNA, 25 bp, Mus musculus
cctacttcctttgttataaagctat

SEQ ID NO: 351912 - DNA, 25 bp, Mus musculus
cctacttctgctatctttgggcaat

SEQ ID NO: 351913 - DNA, 25 bp, Mus musculus
cctacttctgctttctttgggcaat

SEQ ID NO: 351914 - DNA, 25 bp, Mus musculus
cctacttcttctacgacatcgttta

SEQ ID NO: 351915 - DNA, 25 bp, Mus musculus
cctacttcttcttcgacatcgttta

SEQ ID NO: 351916 - DNA, 25 bp, Mus musculus
cctacttgttctcccatctgagaaa

SEQ ID NO: 351917 - DNA, 25 bp, Mus musculus
cctacttgttctgccatctgagaaa

SEQ ID NO: 351918 - DNA, 25 bp, Mus musculus
cctactttcctactttctgactgta

SEQ ID NO: 351919 - DNA, 25 bp, Mus musculus
cctactttcctagtttctgactgta

SEQ ID NO: 351920 - DNA, 25 bp, Mus musculus
cctactttcttgaactgggtattca

SEQ ID NO: 351921 - DNA, 25 bp, Mus musculus
cctactttcttgatatatgcaataa

SEQ ID NO: 351922 - DNA, 25 bp, Mus musculus
cctactttcttgtactgggtattca

SEQ ID NO: 351923 - DNA, 25 bp, Mus musculus
cctactttcttgttatatgcaataa

SEQ ID NO: 351924 - DNA, 25 bp, Mus musculus
cctactttgactatctgctagataa

SEQ ID NO: 351925 - DNA, 25 bp, Mus musculus
cctactttgactttctgctagataa

SEQ ID NO: 351926 - DNA, 25 bp, Mus musculus
cctacttttctcacgcaaatctaaa

SEQ ID NO: 351927 - DNA, 25 bp, Mus musculus
cctacttttctctcgcaaatctaaa

SEQ ID NO: 351928 - DNA, 25 bp, Mus musculus
cctacttttgatccaacatctggga

SEQ ID NO: 351929 - DNA, 25 bp, Mus musculus
cctacttttgatgcaacatctggga

SEQ ID NO: 351930 - DNA, 25 bp, Mus musculus
cctactttttctatgactggatggt

SEQ ID NO: 351931 - DNA, 25 bp, Mus musculus
cctactttttctttgactggatggt

SEQ ID NO: 351932 - DNA, 25 bp, Mus musculus
cctagaaaccctctgtaaaagtgat

SEQ ID NO: 351933 - DNA, 25 bp, Mus musculus
cctagaaaccctgtgtaaaagtgat

SEQ ID NO: 351934 - DNA, 25 bp, Mus musculus
cctagaacccatctcccaataaatt

SEQ ID NO: 351935 - DNA, 25 bp, Mus musculus
cctagaacccatgtcccaataaatt

SEQ ID NO: 351936 - DNA, 25 bp, Mus musculus
cctagaactcacatgctgggagaga

SEQ ID NO: 351937 - DNA, 25 bp, Mus musculus
cctagaactcacttgctgggagaga

SEQ ID NO: 351938 - DNA, 25 bp, Mus musculus
cctagaactgtacctgtggatggtt

SEQ ID NO: 351939 - DNA, 25 bp, Mus musculus
cctagaactgtagctgtggatggtt

SEQ ID NO: 351940 - DNA, 25 bp, Mus musculus
cctagaacttgccttgaatttacag

SEQ ID NO: 351941 - DNA, 25 bp, Mus musculus
cctagaacttgcgttgaatttacag

SEQ ID NO: 351942 - DNA, 25 bp, Mus musculus
cctagaagatgactcagcacataaa

SEQ ID NO: 351943 - DNA, 25 bp, Mus musculus
cctagaagatgagtcagcacataaa

SEQ ID NO: 351944 - DNA, 25 bp, Mus musculus
cctagaagcatcacgagagaacaat

SEQ ID NO: 351945 - DNA, 25 bp, Mus musculus
cctagaagcatctcgagagaacaat

SEQ ID NO: 351946 - DNA, 25 bp, Mus musculus
cctagaagtgagcacccttgctgac

SEQ ID NO: 351947 - DNA, 25 bp, Mus musculus
cctagaagtgaggacccttgctgac

SEQ ID NO: 351948 - DNA, 25 bp, Mus musculus
cctagaatagtaacttccccagttc

SEQ ID NO: 351949 - DNA, 25 bp, Mus musculus
cctagaatagtatcttccccagttc

SEQ ID NO: 351950 - DNA, 25 bp, Mus musculus
cctagaatatgtactcgctcatagt

SEQ ID NO: 351951 - DNA, 25 bp, Mus musculus
cctagaatatgttctcgctcatagt

SEQ ID NO: 351952 - DNA, 25 bp, Mus musculus
cctagaattctgagaggaacttaac

SEQ ID NO: 351953 - DNA, 25 bp, Mus musculus
cctagaattctgtgaggaacttaac

SEQ ID NO: 351954 - DNA, 25 bp, Mus musculus
cctagaattgttatgttgggcatca

SEQ ID NO: 351955 - DNA, 25 bp, Mus musculus
cctagaattgttttgttgggcatca

SEQ ID NO: 351956 - DNA, 25 bp, Mus musculus
cctagaccacggcaagtgagttaga

SEQ ID NO: 351957 - DNA, 25 bp, Mus musculus
cctagaccacgggaagtgagttaga

SEQ ID NO: 351958 - DNA, 25 bp, Mus musculus
cctagaccaggtagtttgtttcaca

SEQ ID NO: 351959 - DNA, 25 bp, Mus musculus
cctagaccaggttgtttgtttcaca

SEQ ID NO: 351960 - DNA, 25 bp, Mus musculus
cctagacggagacaaaatcagaaag

SEQ ID NO: 351961 - DNA, 25 bp, Mus musculus
cctagacggagagaaaatcagaaag

SEQ ID NO: 351962 - DNA, 25 bp, Mus musculus
cctagagaacctcagcatccgggag

SEQ ID NO: 351963 - DNA, 25 bp, Mus musculus
cctagagaacctgagcatccgggag

SEQ ID NO: 351964 - DNA, 25 bp, Mus musculus
cctagagaagtgaccgctggagcct

SEQ ID NO: 351965 - DNA, 25 bp, Mus musculus
cctagagaagtgtccgctggagcct

SEQ ID NO: 351966 - DNA, 25 bp, Mus musculus
cctagagattatcggccaggccata

SEQ ID NO: 351967 - DNA, 25 bp, Mus musculus
cctagagattatgggccaggccata

SEQ ID NO: 351968 - DNA, 25 bp, Mus musculus
cctagagcacctctgtttttctctt

SEQ ID NO: 351969 - DNA, 25 bp, Mus musculus
cctagagcacctgtgtttttctctt

SEQ ID NO: 351970 - DNA, 25 bp, Mus musculus
cctagagccatgatgacggcgatat

SEQ ID NO: 351971 - DNA, 25 bp, Mus musculus
cctagagccatgttgacggcgatat

SEQ ID NO: 351972 - DNA, 25 bp, Mus musculus
cctagagcggctagtcactgagtac

SEQ ID NO: 351973 - DNA, 25 bp, Mus musculus
cctagagcggcttgtcactgagtac

SEQ ID NO: 351974 - DNA, 25 bp, Mus musculus
cctagagctctaattgtttgttttg

SEQ ID NO: 351975 - DNA, 25 bp, Mus musculus
cctagagctctatttgtttgttttg

SEQ ID NO: 351976 - DNA, 25 bp, Mus musculus
cctagagcttccctttttatgttgg

SEQ ID NO: 351977 - DNA, 25 bp, Mus musculus
cctagagcttccgtttttatgttgg

SEQ ID NO: 351978 - DNA, 25 bp, Mus musculus
cctagaggactgctcagcttcttaa

SEQ ID NO: 351979 - DNA, 25 bp, Mus musculus
cctagaggactggtcagcttcttaa

SEQ ID NO: 351980 - DNA, 25 bp, Mus musculus
cctagaggagatacttaagctcact

SEQ ID NO: 351981 - DNA, 25 bp, Mus musculus
cctagaggagattcttaagctcact

SEQ ID NO: 351982 - DNA, 25 bp, Mus musculus
cctagagggccacgatatggaagaa

SEQ ID NO: 351983 - DNA, 25 bp, Mus musculus
cctagagggccaggatatggaagaa

SEQ ID NO: 351984 - DNA, 25 bp, Mus musculus
cctagagtagtgaatttgctttgtt

SEQ ID NO: 351985 - DNA, 25 bp, Mus musculus
cctagagtagtgtatttgctttgtt

SEQ ID NO: 351986 - DNA, 25 bp, Mus musculus
cctagagtgtcacattcatagaaaa

SEQ ID NO: 351987 - DNA, 25 bp, Mus musculus
cctagagtgtcagattcatagaaaa

SEQ ID NO: 351988 - DNA, 25 bp, Mus musculus
cctagagttactatcattcacccca

SEQ ID NO: 351989 - DNA, 25 bp, Mus musculus
cctagagttactttcattcacccca

SEQ ID NO: 351990 - DNA, 25 bp, Mus musculus
cctagagttttaatcccatggcgat

SEQ ID NO: 351991 - DNA, 25 bp, Mus musculus
cctagagttttattcccatggcgat

SEQ ID NO: 351992 - DNA, 25 bp, Mus musculus
cctagatcacaccagtcctgtgaga

SEQ ID NO: 351993 - DNA, 25 bp, Mus musculus
cctagatcacacgagtcctgtgaga

SEQ ID NO: 351994 - DNA, 25 bp, Mus musculus
cctagatccctgctgagtgagcatt

SEQ ID NO: 351995 - DNA, 25 bp, Mus musculus
cctagatccctggtgagtgagcatt

SEQ ID NO: 351996 - DNA, 25 bp, Mus musculus
cctagatcttatcacccccataagt

SEQ ID NO: 351997 - DNA, 25 bp, Mus musculus
cctagatcttatgacccccataagt

SEQ ID NO: 351998 - DNA, 25 bp, Mus musculus
cctagatggctaagaaaatggagta

SEQ ID NO: 351999 - DNA, 25 bp, Mus musculus
cctagatggctatgaaaatggagta

SEQ ID NO: 352000 - DNA, 25 bp, Mus musculus
cctagatgggtgctatatgggactc

SEQ ID NO: 352001 - DNA, 25 bp, Mus musculus
cctagatgggtggtatatgggactc

SEQ ID NO: 352002 - DNA, 25 bp, Mus musculus
cctagattcagaccctgaagtgctc

SEQ ID NO: 352003 - DNA, 25 bp, Mus musculus
cctagattcagagcctgaagtgctc

SEQ ID NO: 352004 - DNA, 25 bp, Mus musculus
cctagattctgcatattatgggtta

SEQ ID NO: 352005 - DNA, 25 bp, Mus musculus
cctagattctgcttattatgggtta

SEQ ID NO: 352006 - DNA, 25 bp, Mus musculus
cctagcaaccagacccaagaggtgg

SEQ ID NO: 352007 - DNA, 25 bp, Mus musculus
cctagcaaccagtcccaagaggtgg

SEQ ID NO: 352008 - DNA, 25 bp, Mus musculus
cctagcactaggactttggagacag

SEQ ID NO: 352009 - DNA, 25 bp, Mus musculus
cctagcactaggtctttggagacag

SEQ ID NO: 352010 - DNA, 25 bp, Mus musculus
cctagcactctgcaatcagtggatc

SEQ ID NO: 352011 - DNA, 25 bp, Mus musculus
cctagcactctggaatcagtggatc

SEQ ID NO: 352012 - DNA, 25 bp, Mus musculus
cctagcagaggccaagtggtttgaa

SEQ ID NO: 352013 - DNA, 25 bp, Mus musculus
cctagcagaggcgaagtggtttgaa

SEQ ID NO: 352014 - DNA, 25 bp, Mus musculus
cctagcagcacccaaagtctatttt

SEQ ID NO: 352015 - DNA, 25 bp, Mus musculus
cctagcagcaccgaaagtctatttt

SEQ ID NO: 352016 - DNA, 25 bp, Mus musculus
cctagcagggtcacgggccgccggg

SEQ ID NO: 352017 - DNA, 25 bp, Mus musculus
cctagcagggtctcgggccgccggg

SEQ ID NO: 352018 - DNA, 25 bp, Mus musculus
cctagcagttagatgggagccacca

SEQ ID NO: 352019 - DNA, 25 bp, Mus musculus
cctagcagttagttgggagccacca

SEQ ID NO: 352020 - DNA, 25 bp, Mus musculus
cctagcataacactgcccatatcta

SEQ ID NO: 352021 - DNA, 25 bp, Mus musculus
cctagcataacagtgcccatatcta

SEQ ID NO: 352022 - DNA, 25 bp, Mus musculus
cctagcatgcatatagcccaggctt

SEQ ID NO: 352023 - DNA, 25 bp, Mus musculus
cctagcatgcatttagcccaggctt

SEQ ID NO: 352024 - DNA, 25 bp, Mus musculus
cctagcatggttcaggatgagtctt

SEQ ID NO: 352025 - DNA, 25 bp, Mus musculus
cctagcatggttgaggatgagtctt

SEQ ID NO: 352026 - DNA, 25 bp, Mus musculus
cctagcatgttccagaaggagtcat

SEQ ID NO: 352027 - DNA, 25 bp, Mus musculus
cctagcatgttcgagaaggagtcat

SEQ ID NO: 352028 - DNA, 25 bp, Mus musculus
cctagcatttgccacaaccgagaag

SEQ ID NO: 352029 - DNA, 25 bp, Mus musculus
cctagcatttgcgacaaccgagaag

SEQ ID NO: 352030 - DNA, 25 bp, Mus musculus
cctagccactgtaccttgcacagaa

SEQ ID NO: 352031 - DNA, 25 bp, Mus musculus
cctagccactgttccttgcacagaa

SEQ ID NO: 352032 - DNA, 25 bp, Mus musculus
cctagcccagagactgtcgcaggat

SEQ ID NO: 352033 - DNA, 25 bp, Mus musculus
cctagcccagagtctgtcgcaggat

SEQ ID NO: 352034 - DNA, 25 bp, Mus musculus
cctagcccagccatattcaaataac

SEQ ID NO: 352035 - DNA, 25 bp, Mus musculus
cctagcccagccttattcaaataac

SEQ ID NO: 352036 - DNA, 25 bp, Mus musculus
cctagcccaggtcaatcggacaaat

SEQ ID NO: 352037 - DNA, 25 bp, Mus musculus
cctagcccaggtgaatcggacaaat

SEQ ID NO: 352038 - DNA, 25 bp, Mus musculus
cctagccgaagtcaggagaacctct

SEQ ID NO: 352039 - DNA, 25 bp, Mus musculus
cctagccgaagtgaggagaacctct

SEQ ID NO: 352040 - DNA, 25 bp, Mus musculus
cctagcctccctcgttatgtattaa

SEQ ID NO: 352041 - DNA, 25 bp, Mus musculus
cctagcctccctggttatgtattaa

SEQ ID NO: 352042 - DNA, 25 bp, Mus musculus
cctagcctccttaatttcatacaga

SEQ ID NO: 352043 - DNA, 25 bp, Mus musculus
cctagcctcctttatttcatacaga

SEQ ID NO: 352044 - DNA, 25 bp, Mus musculus
cctagcctcttacaatatgagctga

SEQ ID NO: 352045 - DNA, 25 bp, Mus musculus
cctagcctcttagaatatgagctga

SEQ ID NO: 352046 - DNA, 25 bp, Mus musculus
cctagccttatgaatcctgtgatat

SEQ ID NO: 352047 - DNA, 25 bp, Mus musculus
cctagccttatgtatcctgtgatat

SEQ ID NO: 352048 - DNA, 25 bp, Mus musculus
cctagccttgagaatcctctgtttt

SEQ ID NO: 352049 - DNA, 25 bp, Mus musculus
cctagccttgagtatcctctgtttt

SEQ ID NO: 352050 - DNA, 25 bp, Mus musculus
cctagcgtgctaagagggtcaccat

SEQ ID NO: 352051 - DNA, 25 bp, Mus musculus
cctagcgtgctatgagggtcaccat

SEQ ID NO: 352052 - DNA, 25 bp, Mus musculus
cctagctaaggactgcttccttgga

SEQ ID NO: 352053 - DNA, 25 bp, Mus musculus
cctagctaaggagtgcttccttgga

SEQ ID NO: 352054 - DNA, 25 bp, Mus musculus
cctagctcacccaagacacaagtgg

SEQ ID NO: 352055 - DNA, 25 bp, Mus musculus
cctagctcaccctagacacaagtgg

SEQ ID NO: 352056 - DNA, 25 bp, Mus musculus
cctagctcagtcacagcatggacaa

SEQ ID NO: 352057 - DNA, 25 bp, Mus musculus
cctagctcagtctcagcatggacaa

SEQ ID NO: 352058 - DNA, 25 bp, Mus musculus
cctagctccagaatcatcattttgc

SEQ ID NO: 352059 - DNA, 25 bp, Mus musculus
cctagctccagattcatcattttgc

SEQ ID NO: 352060 - DNA, 25 bp, Mus musculus
cctagctctagcactgtcagatacg

SEQ ID NO: 352061 - DNA, 25 bp, Mus musculus
cctagctctagctctgtcagatacg

SEQ ID NO: 352062 - DNA, 25 bp, Mus musculus
cctagctctccaatttcactggaaa

SEQ ID NO: 352063 - DNA, 25 bp, Mus musculus
cctagctctccattttcactggaaa

SEQ ID NO: 352064 - DNA, 25 bp, Mus musculus
cctagctgacctcgaatctgctatg

SEQ ID NO: 352065 - DNA, 25 bp, Mus musculus
cctagctgacctggaatctgctatg

SEQ ID NO: 352066 - DNA, 25 bp, Mus musculus
cctagctgcagtcgcacatacctat

SEQ ID NO: 352067 - DNA, 25 bp, Mus musculus
cctagctgcagtggcacatacctat

SEQ ID NO: 352068 - DNA, 25 bp, Mus musculus
cctagcttcgcaaggctgttgagat

SEQ ID NO: 352069 - DNA, 25 bp, Mus musculus
cctagcttcgcatggctgttgagat

SEQ ID NO: 352070 - DNA, 25 bp, Mus musculus
cctagcttctggagcattggtgaca

SEQ ID NO: 352071 - DNA, 25 bp, Mus musculus
cctagcttctggtgcattggtgaca

SEQ ID NO: 352072 - DNA, 25 bp, Mus musculus
cctagcttgctaattttcttgattt

SEQ ID NO: 352073 - DNA, 25 bp, Mus musculus
cctagcttgctatttttcttgattt

SEQ ID NO: 352074 - DNA, 25 bp, Mus musculus
cctagcttgctcaccacaataataa

SEQ ID NO: 352075 - DNA, 25 bp, Mus musculus
cctagcttgctctccacaataataa

SEQ ID NO: 352076 - DNA, 25 bp, Mus musculus
cctagcttgttgctttacccagtat

SEQ ID NO: 352077 - DNA, 25 bp, Mus musculus
cctagcttgttggtttacccagtat

SEQ ID NO: 352078 - DNA, 25 bp, Mus musculus
cctagctttgctatctcaaccagcc

SEQ ID NO: 352079 - DNA, 25 bp, Mus musculus
cctagctttgctttctcaaccagcc

SEQ ID NO: 352080 - DNA, 25 bp, Mus musculus
cctaggaatctaatactttcaattt

SEQ ID NO: 352081 - DNA, 25 bp, Mus musculus
cctaggaatctattactttcaattt

SEQ ID NO: 352082 - DNA, 25 bp, Mus musculus
cctaggaatgaacatggccagctga

SEQ ID NO: 352083 - DNA, 25 bp, Mus musculus
cctaggaatgaagatggccagctga

SEQ ID NO: 352084 - DNA, 25 bp, Mus musculus
cctaggaatgtgatggccagaggta

SEQ ID NO: 352085 - DNA, 25 bp, Mus musculus
cctaggaatgtgttggccagaggta

SEQ ID NO: 352086 - DNA, 25 bp, Mus musculus
cctaggaccataagtagacttcatg

SEQ ID NO: 352087 - DNA, 25 bp, Mus musculus
cctaggaccatatgtagacttcatg

SEQ ID NO: 352088 - DNA, 25 bp, Mus musculus
cctaggacttagaacatgctgggca

SEQ ID NO: 352089 - DNA, 25 bp, Mus musculus
cctaggacttagtacatgctgggca

SEQ ID NO: 352090 - DNA, 25 bp, Mus musculus
cctaggagaaggaagctttgcagac

SEQ ID NO: 352091 - DNA, 25 bp, Mus musculus
cctaggagaaggtagctttgcagac

SEQ ID NO: 352092 - DNA, 25 bp, Mus musculus
cctaggagcttcatggcgtttatat

SEQ ID NO: 352093 - DNA, 25 bp, Mus musculus
cctaggagcttcttggcgtttatat

SEQ ID NO: 352094 - DNA, 25 bp, Mus musculus
cctaggaggaggcagtacatgattt

SEQ ID NO: 352095 - DNA, 25 bp, Mus musculus
cctaggaggagggagtacatgattt

SEQ ID NO: 352096 - DNA, 25 bp, Mus musculus
cctaggagttgcattactctgtcag

SEQ ID NO: 352097 - DNA, 25 bp, Mus musculus
cctaggagttgctttactctgtcag

SEQ ID NO: 352098 - DNA, 25 bp, Mus musculus
cctaggatagctcccatatgatact

SEQ ID NO: 352099 - DNA, 25 bp, Mus musculus
cctaggatagctgccatatgatact

SEQ ID NO: 352100 - DNA, 25 bp, Mus musculus
cctaggatttcacccatgtgcgtgt

SEQ ID NO: 352101 - DNA, 25 bp, Mus musculus
cctaggatttcagccatgtgcgtgt

SEQ ID NO: 352102 - DNA, 25 bp, Mus musculus
cctaggcaatggatgttctctttaa

SEQ ID NO: 352103 - DNA, 25 bp, Mus musculus
cctaggcaatggttgttctctttaa

SEQ ID NO: 352104 - DNA, 25 bp, Mus musculus
cctaggcagcctcaaacagctggat

SEQ ID NO: 352105 - DNA, 25 bp, Mus musculus
cctaggcagcctgaaacagctggat

SEQ ID NO: 352106 - DNA, 25 bp, Mus musculus
cctaggcatgccagaagctgtacta

SEQ ID NO: 352107 - DNA, 25 bp, Mus musculus
cctaggcatgcctgaagctgtacta

SEQ ID NO: 352108 - DNA, 25 bp, Mus musculus
cctaggcatgggagtacagtggtac

SEQ ID NO: 352109 - DNA, 25 bp, Mus musculus
cctaggcatgggtgtacagtggtac

SEQ ID NO: 352110 - DNA, 25 bp, Mus musculus
cctaggcatttgctactggtttgat

SEQ ID NO: 352111 - DNA, 25 bp, Mus musculus
cctaggcatttggtactggtttgat

SEQ ID NO: 352112 - DNA, 25 bp, Mus musculus
cctaggcccatgcagatgcattgtg

SEQ ID NO: 352113 - DNA, 25 bp, Mus musculus
cctaggcccatggagatgcattgtg

SEQ ID NO: 352114 - DNA, 25 bp, Mus musculus
cctaggcctgttagttagcctggtt

SEQ ID NO: 352115 - DNA, 25 bp, Mus musculus
cctaggcctgtttgttagcctggtt

SEQ ID NO: 352116 - DNA, 25 bp, Mus musculus
cctaggccttctcagtgtcaggaaa

SEQ ID NO: 352117 - DNA, 25 bp, Mus musculus
cctaggccttctgagtgtcaggaaa

SEQ ID NO: 352118 - DNA, 25 bp, Mus musculus
cctaggcgggtcacaaacatctgga

SEQ ID NO: 352119 - DNA, 25 bp, Mus musculus
cctaggcgggtctcaaacatctgga

SEQ ID NO: 352120 - DNA, 25 bp, Mus musculus
cctaggctaaacattggcttgctga

SEQ ID NO: 352121 - DNA, 25 bp, Mus musculus
cctaggctaaactttggcttgctga

SEQ ID NO: 352122 - DNA, 25 bp, Mus musculus
cctaggctcaggcatgcttgcagtg

SEQ ID NO: 352123 - DNA, 25 bp, Mus musculus
cctaggctcagggatgcttgcagtg

SEQ ID NO: 352124 - DNA, 25 bp, Mus musculus
cctaggctcattcctggtgtggcat

SEQ ID NO: 352125 - DNA, 25 bp, Mus musculus
cctaggctcattgctggtgtggcat

SEQ ID NO: 352126 - DNA, 25 bp, Mus musculus
cctaggctcgtcacttcctgttctt

SEQ ID NO: 352127 - DNA, 25 bp, Mus musculus
cctaggctcgtctcttcctgttctt

SEQ ID NO: 352128 - DNA, 25 bp, Mus musculus
cctaggctctagatgggaattgtct

SEQ ID NO: 352129 - DNA, 25 bp, Mus musculus
cctaggctctagttgggaattgtct

SEQ ID NO: 352130 - DNA, 25 bp, Mus musculus
cctaggctctgtacctttgacagaa

SEQ ID NO: 352131 - DNA, 25 bp, Mus musculus
cctaggctctgttcctttgacagaa

SEQ ID NO: 352132 - DNA, 25 bp, Mus musculus
cctaggctgctgattgagaatgaat

SEQ ID NO: 352133 - DNA, 25 bp, Mus musculus
cctaggctgctgtttgagaatgaat

SEQ ID NO: 352134 - DNA, 25 bp, Mus musculus
cctaggctgggcatctcatcgagaa

SEQ ID NO: 352135 - DNA, 25 bp, Mus musculus
cctaggctgggcttctcatcgagaa

SEQ ID NO: 352136 - DNA, 25 bp, Mus musculus
cctaggcttaggaaactttctgata

SEQ ID NO: 352137 - DNA, 25 bp, Mus musculus
cctaggcttaggtaactttctgata

SEQ ID NO: 352138 - DNA, 25 bp, Mus musculus
cctaggcttgagatttcatctgctc

SEQ ID NO: 352139 - DNA, 25 bp, Mus musculus
cctaggcttgagttttcatctgctc

SEQ ID NO: 352140 - DNA, 25 bp, Mus musculus
cctaggcttggaatacacagtgctg

SEQ ID NO: 352141 - DNA, 25 bp, Mus musculus
cctaggcttggattacacagtgctg

SEQ ID NO: 352142 - DNA, 25 bp, Mus musculus
cctagggaccctcgaagagcggcca

SEQ ID NO: 352143 - DNA, 25 bp, Mus musculus
cctagggaccctggaagagcggcca

SEQ ID NO: 352144 - DNA, 25 bp, Mus musculus
cctagggaccttacatctgggtcaa

SEQ ID NO: 352145 - DNA, 25 bp, Mus musculus
cctagggacctttcatctgggtcaa

SEQ ID NO: 352146 - DNA, 25 bp, Mus musculus
cctagggaggttaccatctcaaaag

SEQ ID NO: 352147 - DNA, 25 bp, Mus musculus
cctagggaggtttccatctcaaaag

SEQ ID NO: 352148 - DNA, 25 bp, Mus musculus
cctagggagttcctggttggtcatt

SEQ ID NO: 352149 - DNA, 25 bp, Mus musculus
cctagggagttcgtggttggtcatt

SEQ ID NO: 352150 - DNA, 25 bp, Mus musculus
cctagggatagtaccatcttgctaa

SEQ ID NO: 352151 - DNA, 25 bp, Mus musculus
cctagggatagttccatcttgctaa

SEQ ID NO: 352152 - DNA, 25 bp, Mus musculus
cctagggatgttaggccagagcttc

SEQ ID NO: 352153 - DNA, 25 bp, Mus musculus
cctagggatgtttggccagagcttc

SEQ ID NO: 352154 - DNA, 25 bp, Mus musculus
cctagggcaccgcaggtttaaactg

SEQ ID NO: 352155 - DNA, 25 bp, Mus musculus
cctagggcaccggaggtttaaactg

SEQ ID NO: 352156 - DNA, 25 bp, Mus musculus
cctagggcattgaagctgggctcag

SEQ ID NO: 352157 - DNA, 25 bp, Mus musculus
cctagggcattgtagctgggctcag

SEQ ID NO: 352158 - DNA, 25 bp, Mus musculus
cctagggctgggaccctggatatgt

SEQ ID NO: 352159 - DNA, 25 bp, Mus musculus
cctagggctgggtccctggatatgt

SEQ ID NO: 352160 - DNA, 25 bp, Mus musculus
cctagggtagtcacagctttgcaga

SEQ ID NO: 352161 - DNA, 25 bp, Mus musculus
cctagggtagtctcagctttgcaga

SEQ ID NO: 352162 - DNA, 25 bp, Mus musculus
cctagggtcccaaatggtatagtca

SEQ ID NO: 352163 - DNA, 25 bp, Mus musculus
cctagggtcccatatggtatagtca

SEQ ID NO: 352164 - DNA, 25 bp, Mus musculus
cctagggtcctcagactcgagagtt

SEQ ID NO: 352165 - DNA, 25 bp, Mus musculus
cctagggtcctctgactcgagagtt

SEQ ID NO: 352166 - DNA, 25 bp, Mus musculus
cctaggtaatatcgcatggtcgcag

SEQ ID NO: 352167 - DNA, 25 bp, Mus musculus
cctaggtaatatggcatggtcgcag

SEQ ID NO: 352168 - DNA, 25 bp, Mus musculus
cctaggtactcactatcacgcatct

SEQ ID NO: 352169 - DNA, 25 bp, Mus musculus
cctaggtactcagtatcacgcatct

SEQ ID NO: 352170 - DNA, 25 bp, Mus musculus
cctaggtcaagaaggttgtaaatcc

SEQ ID NO: 352171 - DNA, 25 bp, Mus musculus
cctaggtcaagatggttgtaaatcc

SEQ ID NO: 352172 - DNA, 25 bp, Mus musculus
cctaggtcacagacatttaagcgct

SEQ ID NO: 352173 - DNA, 25 bp, Mus musculus
cctaggtcacagattctttctcaga

SEQ ID NO: 352174 - DNA, 25 bp, Mus musculus
cctaggtcacagtcatttaagcgct

SEQ ID NO: 352175 - DNA, 25 bp, Mus musculus
cctaggtcacagtttctttctcaga

SEQ ID NO: 352176 - DNA, 25 bp, Mus musculus
cctaggtccccacccaagagaggaa

SEQ ID NO: 352177 - DNA, 25 bp, Mus musculus
cctaggtccccagccaagagaggaa

SEQ ID NO: 352178 - DNA, 25 bp, Mus musculus
cctaggtctccacagcttggttgag

SEQ ID NO: 352179 - DNA, 25 bp, Mus musculus
cctaggtctccagagcttggttgag

SEQ ID NO: 352180 - DNA, 25 bp, Mus musculus
cctaggtctctaaatcttcaacgat

SEQ ID NO: 352181 - DNA, 25 bp, Mus musculus
cctaggtctctatatcttcaacgat

SEQ ID NO: 352182 - DNA, 25 bp, Mus musculus
cctaggtctgaaagttggtttttct

SEQ ID NO: 352183 - DNA, 25 bp, Mus musculus
cctaggtctgaatgttggtttttct

SEQ ID NO: 352184 - DNA, 25 bp, Mus musculus
cctaggtgctaaagggtctgcaacc

SEQ ID NO: 352185 - DNA, 25 bp, Mus musculus
cctaggtgctaatgggtctgcaacc

SEQ ID NO: 352186 - DNA, 25 bp, Mus musculus
cctaggtgttctcacttgtgaattt

SEQ ID NO: 352187 - DNA, 25 bp, Mus musculus
cctaggtgttctgacttgtgaattt

SEQ ID NO: 352188 - DNA, 25 bp, Mus musculus
cctaggttaaggaccccagagctga

SEQ ID NO: 352189 - DNA, 25 bp, Mus musculus
cctaggttaaggtccccagagctga

SEQ ID NO: 352190 - DNA, 25 bp, Mus musculus
cctaggttcccaatgctttatacat

SEQ ID NO: 352191 - DNA, 25 bp, Mus musculus
cctaggttcccattgctttatacat

SEQ ID NO: 352192 - DNA, 25 bp, Mus musculus
cctaggttccttccttatacatttt

SEQ ID NO: 352193 - DNA, 25 bp, Mus musculus
cctaggttccttgcttatacatttt

SEQ ID NO: 352194 - DNA, 25 bp, Mus musculus
cctaggttctgactgcatgtgggta

SEQ ID NO: 352195 - DNA, 25 bp, Mus musculus
cctaggttctgagtgcatgtgggta

SEQ ID NO: 352196 - DNA, 25 bp, Mus musculus
cctaggttcttcagttgcagttgaa

SEQ ID NO: 352197 - DNA, 25 bp, Mus musculus
cctaggttcttctgttgcagttgaa

SEQ ID NO: 352198 - DNA, 25 bp, Mus musculus
cctaggttcttgcagtttgattttt

SEQ ID NO: 352199 - DNA, 25 bp, Mus musculus
cctaggttcttggagtttgattttt

SEQ ID NO: 352200 - DNA, 25 bp, Mus musculus
cctaggtttaggaggtgctccctga

SEQ ID NO: 352201 - DNA, 25 bp, Mus musculus
cctaggtttaggtggtgctccctga

SEQ ID NO: 352202 - DNA, 25 bp, Mus musculus
cctaggtttctacgttactgataga

SEQ ID NO: 352203 - DNA, 25 bp, Mus musculus
cctaggtttctaggttactgataga

SEQ ID NO: 352204 - DNA, 25 bp, Mus musculus
cctagtaaatcaagtctccttttcc

SEQ ID NO: 352205 - DNA, 25 bp, Mus musculus
cctagtaaatcatgtctccttttcc

SEQ ID NO: 352206 - DNA, 25 bp, Mus musculus
cctagtaccaaacagtaataatgct

SEQ ID NO: 352207 - DNA, 25 bp, Mus musculus
cctagtaccaaagagtaataatgct

SEQ ID NO: 352208 - DNA, 25 bp, Mus musculus
cctagtactcatctattgcttcaca

SEQ ID NO: 352209 - DNA, 25 bp, Mus musculus
cctagtactcatgtattgcttcaca

SEQ ID NO: 352210 - DNA, 25 bp, Mus musculus
cctagtacttagcagcctgagcagg

SEQ ID NO: 352211 - DNA, 25 bp, Mus musculus
cctagtacttaggagcctgagcagg

SEQ ID NO: 352212 - DNA, 25 bp, Mus musculus
cctagtagctctcagtgatgggaaa

SEQ ID NO: 352213 - DNA, 25 bp, Mus musculus
cctagtagctctgagtgatgggaaa

SEQ ID NO: 352214 - DNA, 25 bp, Mus musculus
cctagtatgggcactttacgttcaa

SEQ ID NO: 352215 - DNA, 25 bp, Mus musculus
cctagtatgggctctttacgttcaa

SEQ ID NO: 352216 - DNA, 25 bp, Mus musculus
cctagtcaatgccactttgggtatt

SEQ ID NO: 352217 - DNA, 25 bp, Mus musculus
cctagtcaatgcgactttgggtatt

SEQ ID NO: 352218 - DNA, 25 bp, Mus musculus
cctagtcactgccaaagctcttaaa

SEQ ID NO: 352219 - DNA, 25 bp, Mus musculus
cctagtcactgcgaaagctcttaaa

SEQ ID NO: 352220 - DNA, 25 bp, Mus musculus
cctagtccatttctgtaacggaaat

SEQ ID NO: 352221 - DNA, 25 bp, Mus musculus
cctagtccatttgtgtaacggaaat

SEQ ID NO: 352222 - DNA, 25 bp, Mus musculus
cctagtcccatcctcatttgatata

SEQ ID NO: 352223 - DNA, 25 bp, Mus musculus
cctagtcccatcgtcatttgatata

SEQ ID NO: 352224 - DNA, 25 bp, Mus musculus
cctagtcctggtccttgggcatggt

SEQ ID NO: 352225 - DNA, 25 bp, Mus musculus
cctagtcctggtgcttgggcatggt

SEQ ID NO: 352226 - DNA, 25 bp, Mus musculus
cctagtctacacagttacttccagg

SEQ ID NO: 352227 - DNA, 25 bp, Mus musculus
cctagtctacactgttacttccagg

SEQ ID NO: 352228 - DNA, 25 bp, Mus musculus
cctagtctagacacggtgaggaact

SEQ ID NO: 352229 - DNA, 25 bp, Mus musculus
cctagtctagactcggtgaggaact

SEQ ID NO: 352230 - DNA, 25 bp, Mus musculus
cctagtctatctactatcccctttt

SEQ ID NO: 352231 - DNA, 25 bp, Mus musculus
cctagtctatcttctatcccctttt

SEQ ID NO: 352232 - DNA, 25 bp, Mus musculus
cctagtctccgcctttgaggaagta

SEQ ID NO: 352233 - DNA, 25 bp, Mus musculus
cctagtctccgcgtttgaggaagta

SEQ ID NO: 352234 - DNA, 25 bp, Mus musculus
cctagtctgcggaggtttgtgttac

SEQ ID NO: 352235 - DNA, 25 bp, Mus musculus
cctagtctgcggtggtttgtgttac

SEQ ID NO: 352236 - DNA, 25 bp, Mus musculus
cctagtcttaaacactgaccagtga

SEQ ID NO: 352237 - DNA, 25 bp, Mus musculus
cctagtcttaaagactgaccagtga

SEQ ID NO: 352238 - DNA, 25 bp, Mus musculus
cctagtcttccaccctcataattat

SEQ ID NO: 352239 - DNA, 25 bp, Mus musculus
cctagtcttccagcctcataattat

SEQ ID NO: 352240 - DNA, 25 bp, Mus musculus
cctagtgatcctactttaagaatta

SEQ ID NO: 352241 - DNA, 25 bp, Mus musculus
cctagtgatccttctttaagaatta

SEQ ID NO: 352242 - DNA, 25 bp, Mus musculus
cctagtgatgtacaaatggcctcat

SEQ ID NO: 352243 - DNA, 25 bp, Mus musculus
cctagtgatgtagaaatggcctcat

SEQ ID NO: 352244 - DNA, 25 bp, Mus musculus
cctagtgatttgaatgagttctcga

SEQ ID NO: 352245 - DNA, 25 bp, Mus musculus
cctagtgatttgtatgagttctcga

SEQ ID NO: 352246 - DNA, 25 bp, Mus musculus
cctagtgcccctatgttacagatga

SEQ ID NO: 352247 - DNA, 25 bp, Mus musculus
cctagtgcccctttgttacagatga

SEQ ID NO: 352248 - DNA, 25 bp, Mus musculus
cctagtggctacctaccattccttt

SEQ ID NO: 352249 - DNA, 25 bp, Mus musculus
cctagtggctacctgatgctcagag

SEQ ID NO: 352250 - DNA, 25 bp, Mus musculus
cctagtggctacgtaccattccttt

SEQ ID NO: 352251 - DNA, 25 bp, Mus musculus
cctagtggctacgtgatgctcagag

SEQ ID NO: 352252 - DNA, 25 bp, Mus musculus
cctagtggctcaaggtgctttcaat

SEQ ID NO: 352253 - DNA, 25 bp, Mus musculus
cctagtggctcatggtgctttcaat

SEQ ID NO: 352254 - DNA, 25 bp, Mus musculus
cctagtggtactctggcttgatcgt

SEQ ID NO: 352255 - DNA, 25 bp, Mus musculus
cctagtggtactgtggcttgatcgt

SEQ ID NO: 352256 - DNA, 25 bp, Mus musculus
cctagtgtctagctacatctttttt

SEQ ID NO: 352257 - DNA, 25 bp, Mus musculus
cctagtgtctaggtacatctttttt

SEQ ID NO: 352258 - DNA, 25 bp, Mus musculus
cctagtgtcttgactatagctgtat

SEQ ID NO: 352259 - DNA, 25 bp, Mus musculus
cctagtgtcttgtctatagctgtat

SEQ ID NO: 352260 - DNA, 25 bp, Mus musculus
cctagtgtgcacagctttcattcag

SEQ ID NO: 352261 - DNA, 25 bp, Mus musculus
cctagtgtgcactgctttcattcag

SEQ ID NO: 352262 - DNA, 25 bp, Mus musculus
cctagtgtgcctaaggcctagggtc

SEQ ID NO: 352263 - DNA, 25 bp, Mus musculus
cctagtgtgccttaggcctagggtc

SEQ ID NO: 352264 - DNA, 25 bp, Mus musculus
cctagtgttgatcggtttggtgaat

SEQ ID NO: 352265 - DNA, 25 bp, Mus musculus
cctagtgttgatgggtttggtgaat

SEQ ID NO: 352266 - DNA, 25 bp, Mus musculus
cctagttaaattccgttgtgtgctt

SEQ ID NO: 352267 - DNA, 25 bp, Mus musculus
cctagttaaattgcgttgtgtgctt

SEQ ID NO: 352268 - DNA, 25 bp, Mus musculus
cctagttaagggacaacactggtag

SEQ ID NO: 352269 - DNA, 25 bp, Mus musculus
cctagttaagggtcaacactggtag

SEQ ID NO: 352270 - DNA, 25 bp, Mus musculus
cctagttaagtcactctgaagaaaa

SEQ ID NO: 352271 - DNA, 25 bp, Mus musculus
cctagttaagtctctctgaagaaaa

SEQ ID NO: 352272 - DNA, 25 bp, Mus musculus
cctagttagcgccacataaggattg

SEQ ID NO: 352273 - DNA, 25 bp, Mus musculus
cctagttagcgcgacataaggattg

SEQ ID NO: 352274 - DNA, 25 bp, Mus musculus
cctagttcatctacataccttgttg

SEQ ID NO: 352275 - DNA, 25 bp, Mus musculus
cctagttcatcttcataccttgttg

SEQ ID NO: 352276 - DNA, 25 bp, Mus musculus
cctagttccataatccctgaggcag

SEQ ID NO: 352277 - DNA, 25 bp, Mus musculus
cctagttccatattccctgaggcag

SEQ ID NO: 352278 - DNA, 25 bp, Mus musculus
cctagttgcaagatgggagtggcca

SEQ ID NO: 352279 - DNA, 25 bp, Mus musculus
cctagttgcaagttgggagtggcca

SEQ ID NO: 352280 - DNA, 25 bp, Mus musculus
cctagttggtgaagtttctgccaga

SEQ ID NO: 352281 - DNA, 25 bp, Mus musculus
cctagttggtgatgtttctgccaga

SEQ ID NO: 352282 - DNA, 25 bp, Mus musculus
cctagttgtatcagtgagtgcccaa

SEQ ID NO: 352283 - DNA, 25 bp, Mus musculus
cctagttgtatctgtgagtgcccaa

SEQ ID NO: 352284 - DNA, 25 bp, Mus musculus
cctagtttccagacttctgtttgaa

SEQ ID NO: 352285 - DNA, 25 bp, Mus musculus
cctagtttccagtcttctgtttgaa

SEQ ID NO: 352286 - DNA, 25 bp, Mus musculus
cctagtttctctatacatttcagcc

SEQ ID NO: 352287 - DNA, 25 bp, Mus musculus
cctagtttctctttacatttcagcc

SEQ ID NO: 352288 - DNA, 25 bp, Mus musculus
cctagtttgtaaatccattttggag

SEQ ID NO: 352289 - DNA, 25 bp, Mus musculus
cctagtttgtaattccattttggag

SEQ ID NO: 352290 - DNA, 25 bp, Mus musculus
cctagttttaggcagcgtcatggat

SEQ ID NO: 352291 - DNA, 25 bp, Mus musculus
cctagttttagggagcgtcatggat

SEQ ID NO: 352292 - DNA, 25 bp, Mus musculus
cctagttttctgcattggtacctga

SEQ ID NO: 352293 - DNA, 25 bp, Mus musculus
cctagttttctggattggtacctga

SEQ ID NO: 352294 - DNA, 25 bp, Mus musculus
cctataagaatgagacagacgtcgt

SEQ ID NO: 352295 - DNA, 25 bp, Mus musculus
cctataagaatgtgacagacgtcgt

SEQ ID NO: 352296 - DNA, 25 bp, Mus musculus
cctataaggctgactgtgtcatttt

SEQ ID NO: 352297 - DNA, 25 bp, Mus musculus
cctataaggctgtctgtgtcatttt

SEQ ID NO: 352298 - DNA, 25 bp, Mus musculus
cctataagggcaaggagctgagctt

SEQ ID NO: 352299 - DNA, 25 bp, Mus musculus
cctataagggcatggagctgagctt

SEQ ID NO: 352300 - DNA, 25 bp, Mus musculus
cctataatcctgctactcaggagat

SEQ ID NO: 352301 - DNA, 25 bp, Mus musculus
cctataatcctggtactcaggagat

SEQ ID NO: 352302 - DNA, 25 bp, Mus musculus
cctatactatgcagtcttcctagct

SEQ ID NO: 352303 - DNA, 25 bp, Mus musculus
cctatactatgctgtcttcctagct

SEQ ID NO: 352304 - DNA, 25 bp, Mus musculus
cctatacttcctagttgctctataa

SEQ ID NO: 352305 - DNA, 25 bp, Mus musculus
cctatacttccttgttgctctataa

SEQ ID NO: 352306 - DNA, 25 bp, Mus musculus
cctatagaagctctgtctatctctc

SEQ ID NO: 352307 - DNA, 25 bp, Mus musculus
cctatagaagctgtgtctatctctc

SEQ ID NO: 352308 - DNA, 25 bp, Mus musculus
cctatagtagtgagatctggtgcct

SEQ ID NO: 352309 - DNA, 25 bp, Mus musculus
cctatagtagtgtgatctggtgcct

SEQ ID NO: 352310 - DNA, 25 bp, Mus musculus
cctatagtttcacggcatttttccg

SEQ ID NO: 352311 - DNA, 25 bp, Mus musculus
cctatagtttcagggcatttttccg

SEQ ID NO: 352312 - DNA, 25 bp, Mus musculus
cctatataaactcggccttttctct

SEQ ID NO: 352313 - DNA, 25 bp, Mus musculus
cctatataaactgggccttttctct

SEQ ID NO: 352314 - DNA, 25 bp, Mus musculus
cctatataggatatgctctggatgt

SEQ ID NO: 352315 - DNA, 25 bp, Mus musculus
cctatataggatttgctctggatgt

SEQ ID NO: 352316 - DNA, 25 bp, Mus musculus
cctatatgcctgcaagccataagaa

SEQ ID NO: 352317 - DNA, 25 bp, Mus musculus
cctatatgcctggaagccataagaa

SEQ ID NO: 352318 - DNA, 25 bp, Mus musculus
cctatcacgtgactcctgaggagga

SEQ ID NO: 352319 - DNA, 25 bp, Mus musculus
cctatcacgtgagtcctgaggagga

SEQ ID NO: 352320 - DNA, 25 bp, Mus musculus
cctatcagcttccagagtatcctag

SEQ ID NO: 352321 - DNA, 25 bp, Mus musculus
cctatcagcttcgagagtatcctag

SEQ ID NO: 352322 - DNA, 25 bp, Mus musculus
cctatcaggtgacaaaggctttgaa

SEQ ID NO: 352323 - DNA, 25 bp, Mus musculus
cctatcaggtgagaaaggctttgaa

SEQ ID NO: 352324 - DNA, 25 bp, Mus musculus
cctatcattatcatttctgcccaaa

SEQ ID NO: 352325 - DNA, 25 bp, Mus musculus
cctatcattatcttttctgcccaaa

SEQ ID NO: 352326 - DNA, 25 bp, Mus musculus
cctatccagtgccagaagaggaact

SEQ ID NO: 352327 - DNA, 25 bp, Mus musculus
cctatccagtgcgagaagaggaact

SEQ ID NO: 352328 - DNA, 25 bp, Mus musculus
cctatccataacagtcacccagtga

SEQ ID NO: 352329 - DNA, 25 bp, Mus musculus
cctatccataactgtcacccagtga

SEQ ID NO: 352330 - DNA, 25 bp, Mus musculus
cctatccatatccattgaggctata

SEQ ID NO: 352331 - DNA, 25 bp, Mus musculus
cctatccatatcgattgaggctata

SEQ ID NO: 352332 - DNA, 25 bp, Mus musculus
cctatcccaacacactactttgtgg

SEQ ID NO: 352333 - DNA, 25 bp, Mus musculus
cctatcccaacagactactttgtgg

SEQ ID NO: 352334 - DNA, 25 bp, Mus musculus
cctatccctctcagtctgtttcttt

SEQ ID NO: 352335 - DNA, 25 bp, Mus musculus
cctatccctctctgtctgtttcttt

SEQ ID NO: 352336 - DNA, 25 bp, Mus musculus
cctatccctggaactgagtgcatgg

SEQ ID NO: 352337 - DNA, 25 bp, Mus musculus
cctatccctggatctgagtgcatgg

SEQ ID NO: 352338 - DNA, 25 bp, Mus musculus
cctatcctaggacgctggtttggca

SEQ ID NO: 352339 - DNA, 25 bp, Mus musculus
cctatcctaggaggctggtttggca

SEQ ID NO: 352340 - DNA, 25 bp, Mus musculus
cctatcctctagaaagtttcttgaa

SEQ ID NO: 352341 - DNA, 25 bp, Mus musculus
cctatcctctagtaagtttcttgaa

SEQ ID NO: 352342 - DNA, 25 bp, Mus musculus
cctatcctgggaagatcactggtaa

SEQ ID NO: 352343 - DNA, 25 bp, Mus musculus
cctatcctgggatgatcactggtaa

SEQ ID NO: 352344 - DNA, 25 bp, Mus musculus
cctatcctgggcctgcaagaggatt

SEQ ID NO: 352345 - DNA, 25 bp, Mus musculus
cctatcctgggcgtgcaagaggatt

SEQ ID NO: 352346 - DNA, 25 bp, Mus musculus
cctatccttcaaagcatgggtaaca

SEQ ID NO: 352347 - DNA, 25 bp, Mus musculus
cctatccttcaatgcatgggtaaca

SEQ ID NO: 352348 - DNA, 25 bp, Mus musculus
cctatcctttatcatcttgcatttc

SEQ ID NO: 352349 - DNA, 25 bp, Mus musculus
cctatcctttatgatcttgcatttc

SEQ ID NO: 352350 - DNA, 25 bp, Mus musculus
cctatcgattctcaggcctgtggtt

SEQ ID NO: 352351 - DNA, 25 bp, Mus musculus
cctatcgattctgaggcctgtggtt

SEQ ID NO: 352352 - DNA, 25 bp, Mus musculus
cctatcggaatgagctaaaaatgtt

SEQ ID NO: 352353 - DNA, 25 bp, Mus musculus
cctatcggaatgtgctaaaaatgtt

SEQ ID NO: 352354 - DNA, 25 bp, Mus musculus
cctatctcattcaccacaaacatag

SEQ ID NO: 352355 - DNA, 25 bp, Mus musculus
cctatctcattctccacaaacatag

SEQ ID NO: 352356 - DNA, 25 bp, Mus musculus
cctatctccatgcattgcaacaaga

SEQ ID NO: 352357 - DNA, 25 bp, Mus musculus
cctatctccatggattgcaacaaga

SEQ ID NO: 352358 - DNA, 25 bp, Mus musculus
cctatctccctaattaccacataaa

SEQ ID NO: 352359 - DNA, 25 bp, Mus musculus
cctatctccctatttaccacataaa

SEQ ID NO: 352360 - DNA, 25 bp, Mus musculus
cctatctctagaccccattaaggat

SEQ ID NO: 352361 - DNA, 25 bp, Mus musculus
cctatctctagagcccattaaggat

SEQ ID NO: 352362 - DNA, 25 bp, Mus musculus
cctatctctcaccactaagcattaa

SEQ ID NO: 352363 - DNA, 25 bp, Mus musculus
cctatctctcacgactaagcattaa

SEQ ID NO: 352364 - DNA, 25 bp, Mus musculus
cctatctgtgaacccggctctggag

SEQ ID NO: 352365 - DNA, 25 bp, Mus musculus
cctatctgtgaagccggctctggag

SEQ ID NO: 352366 - DNA, 25 bp, Mus musculus
cctatctgtgttactgtcagtcaac

SEQ ID NO: 352367 - DNA, 25 bp, Mus musculus
cctatctgtgtttctgtcagtcaac

SEQ ID NO: 352368 - DNA, 25 bp, Mus musculus
cctatctgtttgagagggtggccag

SEQ ID NO: 352369 - DNA, 25 bp, Mus musculus
cctatctgtttgtgagggtggccag

SEQ ID NO: 352370 - DNA, 25 bp, Mus musculus
cctatcttagagaccatcagagaac

SEQ ID NO: 352371 - DNA, 25 bp, Mus musculus
cctatcttagagtccatcagagaac

SEQ ID NO: 352372 - DNA, 25 bp, Mus musculus
cctatcttagctatcacaccggaag

SEQ ID NO: 352373 - DNA, 25 bp, Mus musculus
cctatcttagctttcacaccggaag

SEQ ID NO: 352374 - DNA, 25 bp, Mus musculus
cctatcttgttgccgtgacacatac

SEQ ID NO: 352375 - DNA, 25 bp, Mus musculus
cctatcttgttggcgtgacacatac

SEQ ID NO: 352376 - DNA, 25 bp, Mus musculus
cctatctttagtcaaaatggatgag

SEQ ID NO: 352377 - DNA, 25 bp, Mus musculus
cctatctttagtgaaaatggatgag

SEQ ID NO: 352378 - DNA, 25 bp, Mus musculus
cctatctttgagatgcggatcccaa

SEQ ID NO: 352379 - DNA, 25 bp, Mus musculus
cctatctttgagttgcggatcccaa

SEQ ID NO: 352380 - DNA, 25 bp, Mus musculus
cctatgacaagtatgaccccaacat

SEQ ID NO: 352381 - DNA, 25 bp, Mus musculus
cctatgacaagtttgaccccaacat

SEQ ID NO: 352382 - DNA, 25 bp, Mus musculus
cctatgaggtgaccagggccactga

SEQ ID NO: 352383 - DNA, 25 bp, Mus musculus
cctatgaggtgagcagggccactga

SEQ ID NO: 352384 - DNA, 25 bp, Mus musculus
cctatgatgcttatcttcaaacggg

SEQ ID NO: 352385 - DNA, 25 bp, Mus musculus
cctatgatgcttttcttcaaacggg

SEQ ID NO: 352386 - DNA, 25 bp, Mus musculus
cctatgatgggcagcattgtatccc

SEQ ID NO: 352387 - DNA, 25 bp, Mus musculus
cctatgatgggctgcattgtatccc

SEQ ID NO: 352388 - DNA, 25 bp, Mus musculus
cctatgattacaccgcgggctacag

SEQ ID NO: 352389 - DNA, 25 bp, Mus musculus
cctatgattacagcgcgggctacag

SEQ ID NO: 352390 - DNA, 25 bp, Mus musculus
cctatgattcaactgtttccaaatc

SEQ ID NO: 352391 - DNA, 25 bp, Mus musculus
cctatgattcaagtgtttccaaatc

SEQ ID NO: 352392 - DNA, 25 bp, Mus musculus
cctatgattgcacctggcttattta

SEQ ID NO: 352393 - DNA, 25 bp, Mus musculus
cctatgattgcagctggcttattta

SEQ ID NO: 352394 - DNA, 25 bp, Mus musculus
cctatgattggccagcagctgcaga

SEQ ID NO: 352395 - DNA, 25 bp, Mus musculus
cctatgattggcgagcagctgcaga

SEQ ID NO: 352396 - DNA, 25 bp, Mus musculus
cctatgcaggtgctcctctgattat

SEQ ID NO: 352397 - DNA, 25 bp, Mus musculus
cctatgcaggtggtcctctgattat

SEQ ID NO: 352398 - DNA, 25 bp, Mus musculus
cctatgcagttcatgcggagtgaca

SEQ ID NO: 352399 - DNA, 25 bp, Mus musculus
cctatgcagttcttgcggagtgaca

SEQ ID NO: 352400 - DNA, 25 bp, Mus musculus
cctatgccatcaacgtgtctcaaaa

SEQ ID NO: 352401 - DNA, 25 bp, Mus musculus
cctatgccatcatcgtgtctcaaaa

SEQ ID NO: 352402 - DNA, 25 bp, Mus musculus
cctatgccatgccttggaaacagca

SEQ ID NO: 352403 - DNA, 25 bp, Mus musculus
cctatgccatgcgttggaaacagca

SEQ ID NO: 352404 - DNA, 25 bp, Mus musculus
cctatgcgggaaatttgccaaaaat

SEQ ID NO: 352405 - DNA, 25 bp, Mus musculus
cctatgcgggaattttgccaaaaat

SEQ ID NO: 352406 - DNA, 25 bp, Mus musculus
cctatgctactgattctgggaatta

SEQ ID NO: 352407 - DNA, 25 bp, Mus musculus
cctatgctactgtttctgggaatta

SEQ ID NO: 352408 - DNA, 25 bp, Mus musculus
cctatgctccctcaaatatgtatct

SEQ ID NO: 352409 - DNA, 25 bp, Mus musculus
cctatgctccctgaaatatgtatct

SEQ ID NO: 352410 - DNA, 25 bp, Mus musculus
cctatgctgattcgtgatggctcaa

SEQ ID NO: 352411 - DNA, 25 bp, Mus musculus
cctatgctgattggtgatggctcaa

SEQ ID NO: 352412 - DNA, 25 bp, Mus musculus
cctatgctgttcacatttgtttttc

SEQ ID NO: 352413 - DNA, 25 bp, Mus musculus
cctatgctgttctcatttgtttttc

SEQ ID NO: 352414 - DNA, 25 bp, Mus musculus
cctatgcttccacggcaatttggag

SEQ ID NO: 352415 - DNA, 25 bp, Mus musculus
cctatgcttccagggcaatttggag

SEQ ID NO: 352416 - DNA, 25 bp, Mus musculus
cctatgcttgccattgttctgtgat

SEQ ID NO: 352417 - DNA, 25 bp, Mus musculus
cctatgcttgcctttgttctgtgat

SEQ ID NO: 352418 - DNA, 25 bp, Mus musculus
cctatgcttttaatctctgcacttg

SEQ ID NO: 352419 - DNA, 25 bp, Mus musculus
cctatgcttttattctctgcacttg

SEQ ID NO: 352420 - DNA, 25 bp, Mus musculus
cctatggaggatctaccagcggctg

SEQ ID NO: 352421 - DNA, 25 bp, Mus musculus
cctatggaggatgtaccagcggctg

SEQ ID NO: 352422 - DNA, 25 bp, Mus musculus
cctatggagtatatgggcagccgtg

SEQ ID NO: 352423 - DNA, 25 bp, Mus musculus
cctatggagtatttgggcagccgtg

SEQ ID NO: 352424 - DNA, 25 bp, Mus musculus
cctatggatgtgatataactggcta

SEQ ID NO: 352425 - DNA, 25 bp, Mus musculus
cctatggatgtgttataactggcta

SEQ ID NO: 352426 - DNA, 25 bp, Mus musculus
cctatggatgttcctatactggcat

SEQ ID NO: 352427 - DNA, 25 bp, Mus musculus
cctatggatgttgctatactggcat

SEQ ID NO: 352428 - DNA, 25 bp, Mus musculus
cctatggattttactgcaggctcca

SEQ ID NO: 352429 - DNA, 25 bp, Mus musculus
cctatggatttttctgcaggctcca

SEQ ID NO: 352430 - DNA, 25 bp, Mus musculus
cctatggcagcacaattctctctgt

SEQ ID NO: 352431 - DNA, 25 bp, Mus musculus
cctatggcagcagaattctctctgt

SEQ ID NO: 352432 - DNA, 25 bp, Mus musculus
cctatggcctttccggagtggatgt

SEQ ID NO: 352433 - DNA, 25 bp, Mus musculus
cctatggcctttgcggagtggatgt

SEQ ID NO: 352434 - DNA, 25 bp, Mus musculus
cctatggcggcgagctctacggcag

SEQ ID NO: 352435 - DNA, 25 bp, Mus musculus
cctatggcggcgtgctctacggcag

SEQ ID NO: 352436 - DNA, 25 bp, Mus musculus
cctatggctggactgctcctctgct

SEQ ID NO: 352437 - DNA, 25 bp, Mus musculus
cctatggctggagtgctcctctgct

SEQ ID NO: 352438 - DNA, 25 bp, Mus musculus
cctatggctgggactccaaatcatt

SEQ ID NO: 352439 - DNA, 25 bp, Mus musculus
cctatggctgggtctccaaatcatt

SEQ ID NO: 352440 - DNA, 25 bp, Mus musculus
cctatggtctcaccatatggagtaa

SEQ ID NO: 352441 - DNA, 25 bp, Mus musculus
cctatggtctcagcatatggagtaa

SEQ ID NO: 352442 - DNA, 25 bp, Mus musculus
cctatggtgagtccccagcttgata

SEQ ID NO: 352443 - DNA, 25 bp, Mus musculus
cctatggtgagtgcccagcttgata

SEQ ID NO: 352444 - DNA, 25 bp, Mus musculus
cctatggtttacaagcctttggctt

SEQ ID NO: 352445 - DNA, 25 bp, Mus musculus
cctatggtttactagcctttggctt

SEQ ID NO: 352446 - DNA, 25 bp, Mus musculus
cctatgtaaccaagtatgcataaca

SEQ ID NO: 352447 - DNA, 25 bp, Mus musculus
cctatgtaaccatgtatgcataaca

SEQ ID NO: 352448 - DNA, 25 bp, Mus musculus
cctatgtaatacacgctgctggcag

SEQ ID NO: 352449 - DNA, 25 bp, Mus musculus
cctatgtaatactcgctgctggcag

SEQ ID NO: 352450 - DNA, 25 bp, Mus musculus
cctatgtaatctagctgaccagtgt

SEQ ID NO: 352451 - DNA, 25 bp, Mus musculus
cctatgtaatcttgctgaccagtgt

SEQ ID NO: 352452 - DNA, 25 bp, Mus musculus
cctatgtgaagtagttggagagcca

SEQ ID NO: 352453 - DNA, 25 bp, Mus musculus
cctatgtgaagttgttggagagcca

SEQ ID NO: 352454 - DNA, 25 bp, Mus musculus
cctatgtgggacatggagctgcttt

SEQ ID NO: 352455 - DNA, 25 bp, Mus musculus
cctatgtgggacttggagctgcttt

SEQ ID NO: 352456 - DNA, 25 bp, Mus musculus
cctatgtgtacaataatggccaatt

SEQ ID NO: 352457 - DNA, 25 bp, Mus musculus
cctatgtgtacattaatggccaatt

SEQ ID NO: 352458 - DNA, 25 bp, Mus musculus
cctatgttagctagagttgatgttg

SEQ ID NO: 352459 - DNA, 25 bp, Mus musculus
cctatgttagcttgagttgatgttg

SEQ ID NO: 352460 - DNA, 25 bp, Mus musculus
cctatgttatatcctggtcccacag

SEQ ID NO: 352461 - DNA, 25 bp, Mus musculus
cctatgttatatgctggtcccacag

SEQ ID NO: 352462 - DNA, 25 bp, Mus musculus
cctatgtttacaacgcttccaatga

SEQ ID NO: 352463 - DNA, 25 bp, Mus musculus
cctatgtttacatcgcttccaatga

SEQ ID NO: 352464 - DNA, 25 bp, Mus musculus
cctattaccacgcatcacattgatt

SEQ ID NO: 352465 - DNA, 25 bp, Mus musculus
cctattaccacggatcacattgatt

SEQ ID NO: 352466 - DNA, 25 bp, Mus musculus
cctattactcttctcctctttatat

SEQ ID NO: 352467 - DNA, 25 bp, Mus musculus
cctattactcttgtcctctttatat

SEQ ID NO: 352468 - DNA, 25 bp, Mus musculus
cctattatactcagctttattgaaa

SEQ ID NO: 352469 - DNA, 25 bp, Mus musculus
cctattatactctgctttattgaaa

SEQ ID NO: 352470 - DNA, 25 bp, Mus musculus
cctattattttaacccaatgtgaaa

SEQ ID NO: 352471 - DNA, 25 bp, Mus musculus
cctattattttatcccaatgtgaaa

SEQ ID NO: 352472 - DNA, 25 bp, Mus musculus
cctattcaccccaagttgtttgaga

SEQ ID NO: 352473 - DNA, 25 bp, Mus musculus
cctattcacccctagttgtttgaga

SEQ ID NO: 352474 - DNA, 25 bp, Mus musculus
cctattcactgtagatatgtatgta

SEQ ID NO: 352475 - DNA, 25 bp, Mus musculus
cctattcactgttgatatgtatgta

SEQ ID NO: 352476 - DNA, 25 bp, Mus musculus
cctattcagatgaggttgtgcattt

SEQ ID NO: 352477 - DNA, 25 bp, Mus musculus
cctattcagatgtggttgtgcattt

SEQ ID NO: 352478 - DNA, 25 bp, Mus musculus
cctattccacacctttggttggtat

SEQ ID NO: 352479 - DNA, 25 bp, Mus musculus
cctattccacacgtttggttggtat

SEQ ID NO: 352480 - DNA, 25 bp, Mus musculus
cctattccagttactctacttgaag

SEQ ID NO: 352481 - DNA, 25 bp, Mus musculus
cctattccagtttctctacttgaag

SEQ ID NO: 352482 - DNA, 25 bp, Mus musculus
cctattccatgcaccctgacacaga

SEQ ID NO: 352483 - DNA, 25 bp, Mus musculus
cctattccatgctccctgacacaga

SEQ ID NO: 352484 - DNA, 25 bp, Mus musculus
cctattccggtacagtattcttata

SEQ ID NO: 352485 - DNA, 25 bp, Mus musculus
cctattccggtagagtattcttata

SEQ ID NO: 352486 - DNA, 25 bp, Mus musculus
cctattccggttcctgaagacactg

SEQ ID NO: 352487 - DNA, 25 bp, Mus musculus
cctattccggttgctgaagacactg

SEQ ID NO: 352488 - DNA, 25 bp, Mus musculus
cctattcctcagaggatccggatga

SEQ ID NO: 352489 - DNA, 25 bp, Mus musculus
cctattcctcagtggatccggatga

SEQ ID NO: 352490 - DNA, 25 bp, Mus musculus
cctattctcaagctatggcttaatg

SEQ ID NO: 352491 - DNA, 25 bp, Mus musculus
cctattctcaaggtatggcttaatg

SEQ ID NO: 352492 - DNA, 25 bp, Mus musculus
cctattctcgacctccaggacaaag

SEQ ID NO: 352493 - DNA, 25 bp, Mus musculus
cctattctcgacgtccaggacaaag

SEQ ID NO: 352494 - DNA, 25 bp, Mus musculus
cctattctgagaaggctggctggga

SEQ ID NO: 352495 - DNA, 25 bp, Mus musculus
cctattctgagatggctggctggga

SEQ ID NO: 352496 - DNA, 25 bp, Mus musculus
cctattcttattatggagtgcccac

SEQ ID NO: 352497 - DNA, 25 bp, Mus musculus
cctattcttattttggagtgcccac

SEQ ID NO: 352498 - DNA, 25 bp, Mus musculus
cctattgacaaaccctggcagctgt

SEQ ID NO: 352499 - DNA, 25 bp, Mus musculus
cctattgacaaagcctggcagctgt

SEQ ID NO: 352500 - DNA, 25 bp, Mus musculus
cctattgacaacctgaaattcccca

SEQ ID NO: 352501 - DNA, 25 bp, Mus musculus
cctattgacaacgtgaaattcccca

SEQ ID NO: 352502 - DNA, 25 bp, Mus musculus
cctattgatgacagttggccttcca

SEQ ID NO: 352503 - DNA, 25 bp, Mus musculus
cctattgatgactgttggccttcca

SEQ ID NO: 352504 - DNA, 25 bp, Mus musculus
cctattgcacgccaagctgaatgtg

SEQ ID NO: 352505 - DNA, 25 bp, Mus musculus
cctattgcacgcgaagctgaatgtg

SEQ ID NO: 352506 - DNA, 25 bp, Mus musculus
cctattgctgaaacccagaaaacat

SEQ ID NO: 352507 - DNA, 25 bp, Mus musculus
cctattgctgaatcccagaaaacat

SEQ ID NO: 352508 - DNA, 25 bp, Mus musculus
cctattgctgggagttgaatgacag

SEQ ID NO: 352509 - DNA, 25 bp, Mus musculus
cctattgctgggtgttgaatgacag

SEQ ID NO: 352510 - DNA, 25 bp, Mus musculus
cctattgcttcaacttatgtccttg

SEQ ID NO: 352511 - DNA, 25 bp, Mus musculus
cctattgcttcatcttatgtccttg

SEQ ID NO: 352512 - DNA, 25 bp, Mus musculus
cctattggagaacatctgtctctaa

SEQ ID NO: 352513 - DNA, 25 bp, Mus musculus
cctattggagaagatctgtctctaa

SEQ ID NO: 352514 - DNA, 25 bp, Mus musculus
cctattggtgagatggcagtccgtc

SEQ ID NO: 352515 - DNA, 25 bp, Mus musculus
cctattggtgagttggcagtccgtc

SEQ ID NO: 352516 - DNA, 25 bp, Mus musculus
cctattgtaactacccagaagttca

SEQ ID NO: 352517 - DNA, 25 bp, Mus musculus
cctattgtaacttcccagaagttca

SEQ ID NO: 352518 - DNA, 25 bp, Mus musculus
cctattgtatttatgcacgtgtgct

SEQ ID NO: 352519 - DNA, 25 bp, Mus musculus
cctattgtatttttgcacgtgtgct

SEQ ID NO: 352520 - DNA, 25 bp, Mus musculus
cctattgtctacaagtactgttact

SEQ ID NO: 352521 - DNA, 25 bp, Mus musculus
cctattgtctactagtactgttact

SEQ ID NO: 352522 - DNA, 25 bp, Mus musculus
cctattgtttgacgacccactgagt

SEQ ID NO: 352523 - DNA, 25 bp, Mus musculus
cctattgtttgaggacccactgagt

SEQ ID NO: 352524 - DNA, 25 bp, Mus musculus
cctatttaagcccagcgtttagaga

SEQ ID NO: 352525 - DNA, 25 bp, Mus musculus
cctatttaagccgagcgtttagaga

SEQ ID NO: 352526 - DNA, 25 bp, Mus musculus
cctatttactgacaaaggaatccgt

SEQ ID NO: 352527 - DNA, 25 bp, Mus musculus
cctatttactgagaaaggaatccgt

SEQ ID NO: 352528 - DNA, 25 bp, Mus musculus
cctatttatcggatggcctgcattt

SEQ ID NO: 352529 - DNA, 25 bp, Mus musculus
cctatttatcggttggcctgcattt

SEQ ID NO: 352530 - DNA, 25 bp, Mus musculus
cctatttatgctcatttacctcaag

SEQ ID NO: 352531 - DNA, 25 bp, Mus musculus
cctatttatgctgatttacctcaag

SEQ ID NO: 352532 - DNA, 25 bp, Mus musculus
cctatttcatgtatagcacttggat

SEQ ID NO: 352533 - DNA, 25 bp, Mus musculus
cctatttcatgtttagcacttggat

SEQ ID NO: 352534 - DNA, 25 bp, Mus musculus
cctatttcctgccttagttcattgg

SEQ ID NO: 352535 - DNA, 25 bp, Mus musculus
cctatttcctgcgttagttcattgg

SEQ ID NO: 352536 - DNA, 25 bp, Mus musculus
cctatttccttccagtgttgtatat

SEQ ID NO: 352537 - DNA, 25 bp, Mus musculus
cctatttccttcgagtgttgtatat

SEQ ID NO: 352538 - DNA, 25 bp, Mus musculus
cctatttgatggatttggatatgcc

SEQ ID NO: 352539 - DNA, 25 bp, Mus musculus
cctatttgatggttttggatatgcc

SEQ ID NO: 352540 - DNA, 25 bp, Mus musculus
cctatttggaggagacacggttgag

SEQ ID NO: 352541 - DNA, 25 bp, Mus musculus
cctatttggaggtgacacggttgag

SEQ ID NO: 352542 - DNA, 25 bp, Mus musculus
cctatttgggatcttatgtggactc

SEQ ID NO: 352543 - DNA, 25 bp, Mus musculus
cctatttgggatgttatgtggactc

SEQ ID NO: 352544 - DNA, 25 bp, Mus musculus
cctattttaaggagtcatctcggta

SEQ ID NO: 352545 - DNA, 25 bp, Mus musculus
cctattttaaggtgtcatctcggta

SEQ ID NO: 352546 - DNA, 25 bp, Mus musculus
cctattttaggcatgcattcagaaa

SEQ ID NO: 352547 - DNA, 25 bp, Mus musculus
cctattttaggcttgcattcagaaa

SEQ ID NO: 352548 - DNA, 25 bp, Mus musculus
cctattttatatatacttcttggat

SEQ ID NO: 352549 - DNA, 25 bp, Mus musculus
cctattttatatttacttcttggat

SEQ ID NO: 352550 - DNA, 25 bp, Mus musculus
cctattttgattccacgtggaaagt

SEQ ID NO: 352551 - DNA, 25 bp, Mus musculus
cctattttgattgcacgtggaaagt

SEQ ID NO: 352552 - DNA, 25 bp, Mus musculus
cctatttttcatctttgttacttct

SEQ ID NO: 352553 - DNA, 25 bp, Mus musculus
cctatttttcatgtttgttacttct

SEQ ID NO: 352554 - DNA, 25 bp, Mus musculus
cctcaaactcacaagagagctgcct

SEQ ID NO: 352555 - DNA, 25 bp, Mus musculus
cctcaaactcactagagagctgcct

SEQ ID NO: 352556 - DNA, 25 bp, Mus musculus
cctcaaactcggaaggaacgtactg

SEQ ID NO: 352557 - DNA, 25 bp, Mus musculus
cctcaaactcggtaggaacgtactg

SEQ ID NO: 352558 - DNA, 25 bp, Mus musculus
cctcaaagtcacaccagtaaccagt

SEQ ID NO: 352559 - DNA, 25 bp, Mus musculus
cctcaaagtcactccagtaaccagt

SEQ ID NO: 352560 - DNA, 25 bp, Mus musculus
cctcaaagtgccacgatgacctgct

SEQ ID NO: 352561 - DNA, 25 bp, Mus musculus
cctcaaagtgcctcgatgacctgct

SEQ ID NO: 352562 - DNA, 25 bp, Mus musculus
cctcaaagttcaccaattcggcaac

SEQ ID NO: 352563 - DNA, 25 bp, Mus musculus
cctcaaagttcagcaattcggcaac

SEQ ID NO: 352564 - DNA, 25 bp, Mus musculus
cctcaaatgtttagcattccttcct

SEQ ID NO: 352565 - DNA, 25 bp, Mus musculus
cctcaaatgttttgcattccttcct

SEQ ID NO: 352566 - DNA, 25 bp, Mus musculus
cctcaacaaggaaggctgtatcacg

SEQ ID NO: 352567 - DNA, 25 bp, Mus musculus
cctcaacaaggatggctgtatcacg

SEQ ID NO: 352568 - DNA, 25 bp, Mus musculus
cctcaacagggcagccaactttggg

SEQ ID NO: 352569 - DNA, 25 bp, Mus musculus
cctcaacagggctgccaactttggg

SEQ ID NO: 352570 - DNA, 25 bp, Mus musculus
cctcaacatccccagtagtataagt

SEQ ID NO: 352571 - DNA, 25 bp, Mus musculus
cctcaacatcccgagtagtataagt

SEQ ID NO: 352572 - DNA, 25 bp, Mus musculus
cctcaaccagagcatctttgtatta

SEQ ID NO: 352573 - DNA, 25 bp, Mus musculus
cctcaaccagaggatctttgtatta

SEQ ID NO: 352574 - DNA, 25 bp, Mus musculus
cctcaactgtgcaactgaatccctt

SEQ ID NO: 352575 - DNA, 25 bp, Mus musculus
cctcaactgtgctactgaatccctt

SEQ ID NO: 352576 - DNA, 25 bp, Mus musculus
cctcaacttgacacgcaggtgggct

SEQ ID NO: 352577 - DNA, 25 bp, Mus musculus
cctcaacttgactcgcaggtgggct

SEQ ID NO: 352578 - DNA, 25 bp, Mus musculus
cctcaagatatccagtggctggtga

SEQ ID NO: 352579 - DNA, 25 bp, Mus musculus
cctcaagatatcgagtggctggtga

SEQ ID NO: 352580 - DNA, 25 bp, Mus musculus
cctcaagcagcaagacaattaaaac

SEQ ID NO: 352581 - DNA, 25 bp, Mus musculus
cctcaagcagcatgacaattaaaac

SEQ ID NO: 352582 - DNA, 25 bp, Mus musculus
cctcaagccttacctgcagaaacag

SEQ ID NO: 352583 - DNA, 25 bp, Mus musculus
cctcaagccttagctgcagaaacag

SEQ ID NO: 352584 - DNA, 25 bp, Mus musculus
cctcaagctctgagtgtattctagc

SEQ ID NO: 352585 - DNA, 25 bp, Mus musculus
cctcaagctctgtgtgtattctagc

SEQ ID NO: 352586 - DNA, 25 bp, Mus musculus
cctcaagctgtaatacagggcaata

SEQ ID NO: 352587 - DNA, 25 bp, Mus musculus
cctcaagctgtattacagggcaata

SEQ ID NO: 352588 - DNA, 25 bp, Mus musculus
cctcaaggtttcctcagctctagaa

SEQ ID NO: 352589 - DNA, 25 bp, Mus musculus
cctcaaggtttcgtcagctctagaa

SEQ ID NO: 352590 - DNA, 25 bp, Mus musculus
cctcaagtcaccaatcacaaacaag

SEQ ID NO: 352591 - DNA, 25 bp, Mus musculus
cctcaagtcacctatcacaaacaag

SEQ ID NO: 352592 - DNA, 25 bp, Mus musculus
cctcaagtgtgccatcatgcttctg

SEQ ID NO: 352593 - DNA, 25 bp, Mus musculus
cctcaagtgtgcgatcatgcttctg

SEQ ID NO: 352594 - DNA, 25 bp, Mus musculus
cctcaagttcctaggttttgtgaag

SEQ ID NO: 352595 - DNA, 25 bp, Mus musculus
cctcaagttccttggttttgtgaag

SEQ ID NO: 352596 - DNA, 25 bp, Mus musculus
cctcaagttgcacaacgaacgcggg

SEQ ID NO: 352597 - DNA, 25 bp, Mus musculus
cctcaagttgcagaacgaacgcggg

SEQ ID NO: 352598 - DNA, 25 bp, Mus musculus
cctcaagtttcaccacatggattat

SEQ ID NO: 352599 - DNA, 25 bp, Mus musculus
cctcaagtttcagcacatggattat

SEQ ID NO: 352600 - DNA, 25 bp, Mus musculus
cctcaataaggcaccagatccaggc

SEQ ID NO: 352601 - DNA, 25 bp, Mus musculus
cctcaataaggctccagatccaggc

SEQ ID NO: 352602 - DNA, 25 bp, Mus musculus
cctcaatcatggactctaccacagt

SEQ ID NO: 352603 - DNA, 25 bp, Mus musculus
cctcaatcatggtctctaccacagt

SEQ ID NO: 352604 - DNA, 25 bp, Mus musculus
cctcaatccttacttttcttccatg

SEQ ID NO: 352605 - DNA, 25 bp, Mus musculus
cctcaatccttagttttcttccatg

SEQ ID NO: 352606 - DNA, 25 bp, Mus musculus
cctcaatcttggaatttctcccagg

SEQ ID NO: 352607 - DNA, 25 bp, Mus musculus
cctcaatcttggtatttctcccagg

SEQ ID NO: 352608 - DNA, 25 bp, Mus musculus
cctcaatgaggccacatataaattt

SEQ ID NO: 352609 - DNA, 25 bp, Mus musculus
cctcaatgaggcgacatataaattt

SEQ ID NO: 352610 - DNA, 25 bp, Mus musculus
cctcaattcctccatttgtgaaatg

SEQ ID NO: 352611 - DNA, 25 bp, Mus musculus
cctcaattcctcgatttgtgaaatg

SEQ ID NO: 352612 - DNA, 25 bp, Mus musculus
cctcaatttgttctacactgtaatg

SEQ ID NO: 352613 - DNA, 25 bp, Mus musculus
cctcaatttgttgtacactgtaatg

SEQ ID NO: 352614 - DNA, 25 bp, Mus musculus
cctcacaaagctaggcacatggcct

SEQ ID NO: 352615 - DNA, 25 bp, Mus musculus
cctcacaaagcttggcacatggcct

SEQ ID NO: 352616 - DNA, 25 bp, Mus musculus
cctcacaaccccaggtgagtgagaa

SEQ ID NO: 352617 - DNA, 25 bp, Mus musculus
cctcacaaccccatgtcaaagttaa

SEQ ID NO: 352618 - DNA, 25 bp, Mus musculus
cctcacaacccctggtgagtgagaa

SEQ ID NO: 352619 - DNA, 25 bp, Mus musculus
cctcacaaccccttgtcaaagttaa

SEQ ID NO: 352620 - DNA, 25 bp, Mus musculus
cctcacaatctaaagccgggtctga

SEQ ID NO: 352621 - DNA, 25 bp, Mus musculus
cctcacaatctatagccgggtctga

SEQ ID NO: 352622 - DNA, 25 bp, Mus musculus
cctcacaattctatccttgttcata

SEQ ID NO: 352623 - DNA, 25 bp, Mus musculus
cctcacaattctttccttgttcata

SEQ ID NO: 352624 - DNA, 25 bp, Mus musculus
cctcacacactgagactattgggag

SEQ ID NO: 352625 - DNA, 25 bp, Mus musculus
cctcacacactgtgactattgggag

SEQ ID NO: 352626 - DNA, 25 bp, Mus musculus
cctcacacacttagtctactgaagc

SEQ ID NO: 352627 - DNA, 25 bp, Mus musculus
cctcacacactttgtctactgaagc

SEQ ID NO: 352628 - DNA, 25 bp, Mus musculus
cctcacaccagaaatagtatttttt

SEQ ID NO: 352629 - DNA, 25 bp, Mus musculus
cctcacaccagatatagtatttttt

SEQ ID NO: 352630 - DNA, 25 bp, Mus musculus
cctcacactgtcataaagccatttc

SEQ ID NO: 352631 - DNA, 25 bp, Mus musculus
cctcacactgtcttaaagccatttc

SEQ ID NO: 352632 - DNA, 25 bp, Mus musculus
cctcacagatccagttttgggaaag

SEQ ID NO: 352633 - DNA, 25 bp, Mus musculus
cctcacagatcctgttttgggaaag

SEQ ID NO: 352634 - DNA, 25 bp, Mus musculus
cctcacaggatcaagctggctattg

SEQ ID NO: 352635 - DNA, 25 bp, Mus musculus
cctcacaggatctagctggctattg

SEQ ID NO: 352636 - DNA, 25 bp, Mus musculus
cctcacagtcccatttggctttgat

SEQ ID NO: 352637 - DNA, 25 bp, Mus musculus
cctcacagtcccttttggctttgat

SEQ ID NO: 352638 - DNA, 25 bp, Mus musculus
cctcacagttacctgactatagcca

SEQ ID NO: 352639 - DNA, 25 bp, Mus musculus
cctcacagttacgtgactatagcca

SEQ ID NO: 352640 - DNA, 25 bp, Mus musculus
cctcacatacagaacactcacatga

SEQ ID NO: 352641 - DNA, 25 bp, Mus musculus
cctcacatacagtacactcacatga

SEQ ID NO: 352642 - DNA, 25 bp, Mus musculus
cctcacatccataatgttctttttt

SEQ ID NO: 352643 - DNA, 25 bp, Mus musculus
cctcacatccattatgttctttttt

SEQ ID NO: 352644 - DNA, 25 bp, Mus musculus
cctcacattacaaatccacagaaat

SEQ ID NO: 352645 - DNA, 25 bp, Mus musculus
cctcacattacatatccacagaaat

SEQ ID NO: 352646 - DNA, 25 bp, Mus musculus
cctcacattattcaatcctaaattt

SEQ ID NO: 352647 - DNA, 25 bp, Mus musculus
cctcacattattgaatcctaaattt

SEQ ID NO: 352648 - DNA, 25 bp, Mus musculus
cctcacattcttaagtttctttggt

SEQ ID NO: 352649 - DNA, 25 bp, Mus musculus
cctcacattctttagtttctttggt

SEQ ID NO: 352650 - DNA, 25 bp, Mus musculus
cctcacattgaacttccaggccaga

SEQ ID NO: 352651 - DNA, 25 bp, Mus musculus
cctcacattgaagttccaggccaga

SEQ ID NO: 352652 - DNA, 25 bp, Mus musculus
cctcaccactgaccattggatgtct

SEQ ID NO: 352653 - DNA, 25 bp, Mus musculus
cctcaccactgagcattggatgtct

SEQ ID NO: 352654 - DNA, 25 bp, Mus musculus
cctcaccagattatttaattttcta

SEQ ID NO: 352655 - DNA, 25 bp, Mus musculus
cctcaccagattttttaattttcta

SEQ ID NO: 352656 - DNA, 25 bp, Mus musculus
cctcaccagtggcatttcaaagcca

SEQ ID NO: 352657 - DNA, 25 bp, Mus musculus
cctcaccagtgggatttcaaagcca

SEQ ID NO: 352658 - DNA, 25 bp, Mus musculus
cctcaccatctcattttcaatacat

SEQ ID NO: 352659 - DNA, 25 bp, Mus musculus
cctcaccatctctttttcaatacat

SEQ ID NO: 352660 - DNA, 25 bp, Mus musculus
cctcaccatctgatagcttatttca

SEQ ID NO: 352661 - DNA, 25 bp, Mus musculus
cctcaccatctgttagcttatttca

SEQ ID NO: 352662 - DNA, 25 bp, Mus musculus
cctcaccgaatcaccttaggaaggg

SEQ ID NO: 352663 - DNA, 25 bp, Mus musculus
cctcaccgaatctccttaggaaggg

SEQ ID NO: 352664 - DNA, 25 bp, Mus musculus
cctcacctcctaaagtctagcagta

SEQ ID NO: 352665 - DNA, 25 bp, Mus musculus
cctcacctcctatagtctagcagta

SEQ ID NO: 352666 - DNA, 25 bp, Mus musculus
cctcacctggcactagagaatgtgg

SEQ ID NO: 352667 - DNA, 25 bp, Mus musculus
cctcacctggcagtagagaatgtgg

SEQ ID NO: 352668 - DNA, 25 bp, Mus musculus
cctcaccttctcagtctcaaatgga

SEQ ID NO: 352669 - DNA, 25 bp, Mus musculus
cctcaccttctctgtctcaaatgga

SEQ ID NO: 352670 - DNA, 25 bp, Mus musculus
cctcacgacgctcgaactctaagaa

SEQ ID NO: 352671 - DNA, 25 bp, Mus musculus
cctcacgacgctggaactctaagaa

SEQ ID NO: 352672 - DNA, 25 bp, Mus musculus
cctcacgagataccatggctgtttt

SEQ ID NO: 352673 - DNA, 25 bp, Mus musculus
cctcacgagatagcatggctgtttt

SEQ ID NO: 352674 - DNA, 25 bp, Mus musculus
cctcacgatatgctacccagaatat

SEQ ID NO: 352675 - DNA, 25 bp, Mus musculus
cctcacgatatggtacccagaatat

SEQ ID NO: 352676 - DNA, 25 bp, Mus musculus
cctcacgccatcctgcgtctggact

SEQ ID NO: 352677 - DNA, 25 bp, Mus musculus
cctcacgccatcgtgcgtctggact

SEQ ID NO: 352678 - DNA, 25 bp, Mus musculus
cctcacggacagagggtttggaact

SEQ ID NO: 352679 - DNA, 25 bp, Mus musculus
cctcacggacagtgggtttggaact

SEQ ID NO: 352680 - DNA, 25 bp, Mus musculus
cctcacggacggcagaattccagca

SEQ ID NO: 352681 - DNA, 25 bp, Mus musculus
cctcacggacgggagaattccagca

SEQ ID NO: 352682 - DNA, 25 bp, Mus musculus
cctcacggacgtcatggagcagatc

SEQ ID NO: 352683 - DNA, 25 bp, Mus musculus
cctcacggacgtgatggagcagatc

SEQ ID NO: 352684 - DNA, 25 bp, Mus musculus
cctcacgtacctcagtttttgtaag

SEQ ID NO: 352685 - DNA, 25 bp, Mus musculus
cctcacgtacctgagtttttgtaag

SEQ ID NO: 352686 - DNA, 25 bp, Mus musculus
cctcacgtggaaccaagggacgagt

SEQ ID NO: 352687 - DNA, 25 bp, Mus musculus
cctcacgtggaagcaagggacgagt

SEQ ID NO: 352688 - DNA, 25 bp, Mus musculus
cctcacgtgggcaccgagtgggata

SEQ ID NO: 352689 - DNA, 25 bp, Mus musculus
cctcacgtgggctccgagtgggata

SEQ ID NO: 352690 - DNA, 25 bp, Mus musculus
cctcacgttgagcacacctttgaca

SEQ ID NO: 352691 - DNA, 25 bp, Mus musculus
cctcacgttgaggacacctttgaca

SEQ ID NO: 352692 - DNA, 25 bp, Mus musculus
cctcactaaagtatgttctggcaca

SEQ ID NO: 352693 - DNA, 25 bp, Mus musculus
cctcactaaagtttgttctggcaca

SEQ ID NO: 352694 - DNA, 25 bp, Mus musculus
cctcactaagctacagacctggatc

SEQ ID NO: 352695 - DNA, 25 bp, Mus musculus
cctcactaagcttcagacctggatc

SEQ ID NO: 352696 - DNA, 25 bp, Mus musculus
cctcactaccacactgaacataaga

SEQ ID NO: 352697 - DNA, 25 bp, Mus musculus
cctcactaccactctgaacataaga

SEQ ID NO: 352698 - DNA, 25 bp, Mus musculus
cctcactatatacttttagctctgt

SEQ ID NO: 352699 - DNA, 25 bp, Mus musculus
cctcactatatagttttagctctgt

SEQ ID NO: 352700 - DNA, 25 bp, Mus musculus
cctcactcaggtacaggagccagct

SEQ ID NO: 352701 - DNA, 25 bp, Mus musculus
cctcactcaggttcaggagccagct

SEQ ID NO: 352702 - DNA, 25 bp, Mus musculus
cctcactcctctctaaaagatcttt

SEQ ID NO: 352703 - DNA, 25 bp, Mus musculus
cctcactcctctgtaaaagatcttt

SEQ ID NO: 352704 - DNA, 25 bp, Mus musculus
cctcactctaaaccccattggaaat

SEQ ID NO: 352705 - DNA, 25 bp, Mus musculus
cctcactctaaagcccattggaaat

SEQ ID NO: 352706 - DNA, 25 bp, Mus musculus
cctcactctgtcaccatttttaaga

SEQ ID NO: 352707 - DNA, 25 bp, Mus musculus
cctcactctgtctccatttttaaga

SEQ ID NO: 352708 - DNA, 25 bp, Mus musculus
cctcactgatagattccgaagacag

SEQ ID NO: 352709 - DNA, 25 bp, Mus musculus
cctcactgatagtttccgaagacag

SEQ ID NO: 352710 - DNA, 25 bp, Mus musculus
cctcactgatgaaagcaattgtttt

SEQ ID NO: 352711 - DNA, 25 bp, Mus musculus
cctcactgatgatagcaattgtttt

SEQ ID NO: 352712 - DNA, 25 bp, Mus musculus
cctcactgcaagctcgattgtgatt

SEQ ID NO: 352713 - DNA, 25 bp, Mus musculus
cctcactgcaaggtcgattgtgatt

SEQ ID NO: 352714 - DNA, 25 bp, Mus musculus
cctcactggaggaaactgctatcat

SEQ ID NO: 352715 - DNA, 25 bp, Mus musculus
cctcactggaggtaactgctatcat

SEQ ID NO: 352716 - DNA, 25 bp, Mus musculus
cctcactggctgctggtgtgaagtt

SEQ ID NO: 352717 - DNA, 25 bp, Mus musculus
cctcactggctggtggtgtgaagtt

SEQ ID NO: 352718 - DNA, 25 bp, Mus musculus
cctcactgggtcacagcactgagag

SEQ ID NO: 352719 - DNA, 25 bp, Mus musculus
cctcactgggtctcagcactgagag

SEQ ID NO: 352720 - DNA, 25 bp, Mus musculus
cctcactgtgtcatcctattggtaa

SEQ ID NO: 352721 - DNA, 25 bp, Mus musculus
cctcactgtgtcttcctattggtaa

SEQ ID NO: 352722 - DNA, 25 bp, Mus musculus
cctcactgttggcaaaattcaaacc

SEQ ID NO: 352723 - DNA, 25 bp, Mus musculus
cctcactgttgggaaaattcaaacc

SEQ ID NO: 352724 - DNA, 25 bp, Mus musculus
cctcactgtttgaaaatgctgtgat

SEQ ID NO: 352725 - DNA, 25 bp, Mus musculus
cctcactgtttgtaaatgctgtgat

SEQ ID NO: 352726 - DNA, 25 bp, Mus musculus
cctcacttaccccagactagagaat

SEQ ID NO: 352727 - DNA, 25 bp, Mus musculus
cctcacttacccgagactagagaat

SEQ ID NO: 352728 - DNA, 25 bp, Mus musculus
cctcacttacggatatggcaatgca

SEQ ID NO: 352729 - DNA, 25 bp, Mus musculus
cctcacttacggttatggcaatgca

SEQ ID NO: 352730 - DNA, 25 bp, Mus musculus
cctcacttccatcccaagaataaga

SEQ ID NO: 352731 - DNA, 25 bp, Mus musculus
cctcacttccatgccaagaataaga

SEQ ID NO: 352732 - DNA, 25 bp, Mus musculus
cctcacttctacagcctgacaagga

SEQ ID NO: 352733 - DNA, 25 bp, Mus musculus
cctcacttctactgcctgacaagga

SEQ ID NO: 352734 - DNA, 25 bp, Mus musculus
cctcacttctcacttgcttatagta

SEQ ID NO: 352735 - DNA, 25 bp, Mus musculus
cctcacttctcagttgcttatagta

SEQ ID NO: 352736 - DNA, 25 bp, Mus musculus
cctcactttgatctaagccacggct

SEQ ID NO: 352737 - DNA, 25 bp, Mus musculus
cctcactttgatgtaagccacggct

SEQ ID NO: 352738 - DNA, 25 bp, Mus musculus
cctcactttttgacatttccactag

SEQ ID NO: 352739 - DNA, 25 bp, Mus musculus
cctcactttttgtcatttccactag

SEQ ID NO: 352740 - DNA, 25 bp, Mus musculus
cctcagaaagatatggaataacact

SEQ ID NO: 352741 - DNA, 25 bp, Mus musculus
cctcagaaagatttggaataacact

SEQ ID NO: 352742 - DNA, 25 bp, Mus musculus
cctcagaaatcaaccgcctttagga

SEQ ID NO: 352743 - DNA, 25 bp, Mus musculus
cctcagaaatcatccgcctttagga

SEQ ID NO: 352744 - DNA, 25 bp, Mus musculus
cctcagaacatcagccaggtcttgt

SEQ ID NO: 352745 - DNA, 25 bp, Mus musculus
cctcagaacatctgccaggtcttgt

SEQ ID NO: 352746 - DNA, 25 bp, Mus musculus
cctcagaaggttatgtggcgataca

SEQ ID NO: 352747 - DNA, 25 bp, Mus musculus
cctcagaaggttttgtggcgataca

SEQ ID NO: 352748 - DNA, 25 bp, Mus musculus
cctcagaattctatggctggttctt

SEQ ID NO: 352749 - DNA, 25 bp, Mus musculus
cctcagaattctttggctggttctt

SEQ ID NO: 352750 - DNA, 25 bp, Mus musculus
cctcagacgggaagctgccttaaag

SEQ ID NO: 352751 - DNA, 25 bp, Mus musculus
cctcagacgggatgctgccttaaag

SEQ ID NO: 352752 - DNA, 25 bp, Mus musculus
cctcagactacacagggttgatcat

SEQ ID NO: 352753 - DNA, 25 bp, Mus musculus
cctcagactacagagggttgatcat

SEQ ID NO: 352754 - DNA, 25 bp, Mus musculus
cctcagactcaccaagatccaagtg

SEQ ID NO: 352755 - DNA, 25 bp, Mus musculus
cctcagactcacgaagatccaagtg

SEQ ID NO: 352756 - DNA, 25 bp, Mus musculus
cctcagagacctccaggttgtgtgg

SEQ ID NO: 352757 - DNA, 25 bp, Mus musculus
cctcagagacctgcaggttgtgtgg

SEQ ID NO: 352758 - DNA, 25 bp, Mus musculus
cctcagagaggtcaaagtggccaga

SEQ ID NO: 352759 - DNA, 25 bp, Mus musculus
cctcagagaggtgaaagtggccaga

SEQ ID NO: 352760 - DNA, 25 bp, Mus musculus
cctcagagctgccacatgctaggga

SEQ ID NO: 352761 - DNA, 25 bp, Mus musculus
cctcagagctgcgacatgctaggga

SEQ ID NO: 352762 - DNA, 25 bp, Mus musculus
cctcagaggtgtcgtcagcatccga

SEQ ID NO: 352763 - DNA, 25 bp, Mus musculus
cctcagaggtgtggtcagcatccga

SEQ ID NO: 352764 - DNA, 25 bp, Mus musculus
cctcagataggactgtgtcccgggt

SEQ ID NO: 352765 - DNA, 25 bp, Mus musculus
cctcagataggagtgtgtcccgggt

SEQ ID NO: 352766 - DNA, 25 bp, Mus musculus
cctcagatcctgatagttagatagt

SEQ ID NO: 352767 - DNA, 25 bp, Mus musculus
cctcagatcctgttagttagatagt

SEQ ID NO: 352768 - DNA, 25 bp, Mus musculus
cctcagatgctgactcaacagtcag

SEQ ID NO: 352769 - DNA, 25 bp, Mus musculus
cctcagatgctgtctcaacagtcag

SEQ ID NO: 352770 - DNA, 25 bp, Mus musculus
cctcagattctgcatttacatgtaa

SEQ ID NO: 352771 - DNA, 25 bp, Mus musculus
cctcagattctggatttacatgtaa

SEQ ID NO: 352772 - DNA, 25 bp, Mus musculus
cctcagattgacacgcatggaaaca

SEQ ID NO: 352773 - DNA, 25 bp, Mus musculus
cctcagattgactcgcatggaaaca

SEQ ID NO: 352774 - DNA, 25 bp, Mus musculus
cctcagattgccctggaactagagg

SEQ ID NO: 352775 - DNA, 25 bp, Mus musculus
cctcagattgccgtggaactagagg

SEQ ID NO: 352776 - DNA, 25 bp, Mus musculus
cctcagattttcatcgatcaaggaa

SEQ ID NO: 352777 - DNA, 25 bp, Mus musculus
cctcagattttcttcgatcaaggaa

SEQ ID NO: 352778 - DNA, 25 bp, Mus musculus
cctcagcaccggcatcataatactg

SEQ ID NO: 352779 - DNA, 25 bp, Mus musculus
cctcagcaccgggatcataatactg

SEQ ID NO: 352780 - DNA, 25 bp, Mus musculus
cctcagcaggaaagtgcagtagaag

SEQ ID NO: 352781 - DNA, 25 bp, Mus musculus
cctcagcaggaatgtgcagtagaag

SEQ ID NO: 352782 - DNA, 25 bp, Mus musculus
cctcagcatctcaagttacagtaag

SEQ ID NO: 352783 - DNA, 25 bp, Mus musculus
cctcagcatctctagttacagtaag

SEQ ID NO: 352784 - DNA, 25 bp, Mus musculus
cctcagcatcttaccttaatcaaaa

SEQ ID NO: 352785 - DNA, 25 bp, Mus musculus
cctcagcatctttccttaatcaaaa

SEQ ID NO: 352786 - DNA, 25 bp, Mus musculus
cctcagcatgaaccaagcatgaatg

SEQ ID NO: 352787 - DNA, 25 bp, Mus musculus
cctcagcatgaagcaagcatgaatg

SEQ ID NO: 352788 - DNA, 25 bp, Mus musculus
cctcagccaggcatgggtcaggaat

SEQ ID NO: 352789 - DNA, 25 bp, Mus musculus
cctcagccaggcttgggtcaggaat

SEQ ID NO: 352790 - DNA, 25 bp, Mus musculus
cctcagctagggagggaggacactt

SEQ ID NO: 352791 - DNA, 25 bp, Mus musculus
cctcagctagggtgggaggacactt

SEQ ID NO: 352792 - DNA, 25 bp, Mus musculus
cctcagctcaggatgcctagtgaga

SEQ ID NO: 352793 - DNA, 25 bp, Mus musculus
cctcagctcaggttgcctagtgaga

SEQ ID NO: 352794 - DNA, 25 bp, Mus musculus
cctcagctcgacatgaaacggcaat

SEQ ID NO: 352795 - DNA, 25 bp, Mus musculus
cctcagctcgacttgaaacggcaat

SEQ ID NO: 352796 - DNA, 25 bp, Mus musculus
cctcagctctcaccatgtttgtggt

SEQ ID NO: 352797 - DNA, 25 bp, Mus musculus
cctcagctctcagcatgtttgtggt

SEQ ID NO: 352798 - DNA, 25 bp, Mus musculus
cctcagctgaccattgcaagactag

SEQ ID NO: 352799 - DNA, 25 bp, Mus musculus
cctcagctgacctttgcaagactag

SEQ ID NO: 352800 - DNA, 25 bp, Mus musculus
cctcagctgaggaggcggtggaaat

SEQ ID NO: 352801 - DNA, 25 bp, Mus musculus
cctcagctgaggcatgacacaggcc

SEQ ID NO: 352802 - DNA, 25 bp, Mus musculus
cctcagctgagggatgacacaggcc

SEQ ID NO: 352803 - DNA, 25 bp, Mus musculus
cctcagctgaggtggcggtggaaat

SEQ ID NO: 352804 - DNA, 25 bp, Mus musculus
cctcagctggctctatggaaatgca

SEQ ID NO: 352805 - DNA, 25 bp, Mus musculus
cctcagctggctgtatggaaatgca

SEQ ID NO: 352806 - DNA, 25 bp, Mus musculus
cctcagcttcagagacttcatatca

SEQ ID NO: 352807 - DNA, 25 bp, Mus musculus
cctcagcttcagtgacttcatatca

SEQ ID NO: 352808 - DNA, 25 bp, Mus musculus
cctcaggacctgaagattgacttgg

SEQ ID NO: 352809 - DNA, 25 bp, Mus musculus
cctcaggacctgtagattgacttgg

SEQ ID NO: 352810 - DNA, 25 bp, Mus musculus
cctcaggactctaagtggttctata

SEQ ID NO: 352811 - DNA, 25 bp, Mus musculus
cctcaggactcttagtggttctata

SEQ ID NO: 352812 - DNA, 25 bp, Mus musculus
cctcaggagcagaacaggctagtgc

SEQ ID NO: 352813 - DNA, 25 bp, Mus musculus
cctcaggagcagtacaggctagtgc

SEQ ID NO: 352814 - DNA, 25 bp, Mus musculus
cctcaggagcttagcaccatgaacc

SEQ ID NO: 352815 - DNA, 25 bp, Mus musculus
cctcaggagctttgcaccatgaacc

SEQ ID NO: 352816 - DNA, 25 bp, Mus musculus
cctcaggccatcacagcagaaaaat

SEQ ID NO: 352817 - DNA, 25 bp, Mus musculus
cctcaggccatctcagcagaaaaat

SEQ ID NO: 352818 - DNA, 25 bp, Mus musculus
cctcaggcccagatacatgcatata

SEQ ID NO: 352819 - DNA, 25 bp, Mus musculus
cctcaggcccagttacatgcatata

SEQ ID NO: 352820 - DNA, 25 bp, Mus musculus
cctcaggcctaaaccagtcttaaat

SEQ ID NO: 352821 - DNA, 25 bp, Mus musculus
cctcaggcctaatccagtcttaaat

SEQ ID NO: 352822 - DNA, 25 bp, Mus musculus
cctcaggcctacaaggagagcaatt

SEQ ID NO: 352823 - DNA, 25 bp, Mus musculus
cctcaggcctactaggagagcaatt

SEQ ID NO: 352824 - DNA, 25 bp, Mus musculus
cctcaggctaagatggatgcttata

SEQ ID NO: 352825 - DNA, 25 bp, Mus musculus
cctcaggctaagttggatgcttata

SEQ ID NO: 352826 - DNA, 25 bp, Mus musculus
cctcaggctagcactatatactcag

SEQ ID NO: 352827 - DNA, 25 bp, Mus musculus
cctcaggctagctctatatactcag

SEQ ID NO: 352828 - DNA, 25 bp, Mus musculus
cctcaggctctcattctggtgtgat

SEQ ID NO: 352829 - DNA, 25 bp, Mus musculus
cctcaggctctctttctggtgtgat

SEQ ID NO: 352830 - DNA, 25 bp, Mus musculus
cctcaggctgcacacaagttttgaa

SEQ ID NO: 352831 - DNA, 25 bp, Mus musculus
cctcaggctgcagacaagttttgaa

SEQ ID NO: 352832 - DNA, 25 bp, Mus musculus
cctcaggctgggagtaagtgtatag

SEQ ID NO: 352833 - DNA, 25 bp, Mus musculus
cctcaggctgggtgtaagtgtatag

SEQ ID NO: 352834 - DNA, 25 bp, Mus musculus
cctcagggaagtaatcagccatact

SEQ ID NO: 352835 - DNA, 25 bp, Mus musculus
cctcagggaagttatcagccatact

SEQ ID NO: 352836 - DNA, 25 bp, Mus musculus
cctcagggagccagggtttctcagg

SEQ ID NO: 352837 - DNA, 25 bp, Mus musculus
cctcagggagcctgggtttctcagg

SEQ ID NO: 352838 - DNA, 25 bp, Mus musculus
cctcagggagtcacggcctggtgaa

SEQ ID NO: 352839 - DNA, 25 bp, Mus musculus
cctcagggagtctcggcctggtgaa

SEQ ID NO: 352840 - DNA, 25 bp, Mus musculus
cctcagggcaggattcagttagtca

SEQ ID NO: 352841 - DNA, 25 bp, Mus musculus
cctcagggcaggtttcagttagtca

SEQ ID NO: 352842 - DNA, 25 bp, Mus musculus
cctcagggcttgcaaattggttttg

SEQ ID NO: 352843 - DNA, 25 bp, Mus musculus
cctcagggcttggaaattggttttg

SEQ ID NO: 352844 - DNA, 25 bp, Mus musculus
cctcagggtcctaatttttcaggca

SEQ ID NO: 352845 - DNA, 25 bp, Mus musculus
cctcagggtccttatttttcaggca

SEQ ID NO: 352846 - DNA, 25 bp, Mus musculus
cctcagggtttcatgatttatgaaa

SEQ ID NO: 352847 - DNA, 25 bp, Mus musculus
cctcagggtttcttgatttatgaaa

SEQ ID NO: 352848 - DNA, 25 bp, Mus musculus
cctcaggtcagaatgtccagataag

SEQ ID NO: 352849 - DNA, 25 bp, Mus musculus
cctcaggtcagattgtccagataag

SEQ ID NO: 352850 - DNA, 25 bp, Mus musculus
cctcaggtccccatagcactgggag

SEQ ID NO: 352851 - DNA, 25 bp, Mus musculus
cctcaggtccccttagcactgggag

SEQ ID NO: 352852 - DNA, 25 bp, Mus musculus
cctcaggtcctgattagtttctaag

SEQ ID NO: 352853 - DNA, 25 bp, Mus musculus
cctcaggtcctgtttagtttctaag

SEQ ID NO: 352854 - DNA, 25 bp, Mus musculus
cctcaggtgattatagccattggct

SEQ ID NO: 352855 - DNA, 25 bp, Mus musculus
cctcaggtgattccaggcgctatga

SEQ ID NO: 352856 - DNA, 25 bp, Mus musculus
cctcaggtgattgcaggcgctatga

SEQ ID NO: 352857 - DNA, 25 bp, Mus musculus
cctcaggtgattttagccattggct

SEQ ID NO: 352858 - DNA, 25 bp, Mus musculus
cctcaggtgggtattgagctaatgt

SEQ ID NO: 352859 - DNA, 25 bp, Mus musculus
cctcaggtgggttttgagctaatgt

SEQ ID NO: 352860 - DNA, 25 bp, Mus musculus
cctcagtaggcactggacccattga

SEQ ID NO: 352861 - DNA, 25 bp, Mus musculus
cctcagtaggcagtggacccattga

SEQ ID NO: 352862 - DNA, 25 bp, Mus musculus
cctcagtagggtactctcaaatcac

SEQ ID NO: 352863 - DNA, 25 bp, Mus musculus
cctcagtagggttctctcaaatcac

SEQ ID NO: 352864 - DNA, 25 bp, Mus musculus
cctcagtatattacttcggttccat

SEQ ID NO: 352865 - DNA, 25 bp, Mus musculus
cctcagtatatttcttcggttccat

SEQ ID NO: 352866 - DNA, 25 bp, Mus musculus
cctcagtcctcccatatgtaaaatg

SEQ ID NO: 352867 - DNA, 25 bp, Mus musculus
cctcagtcctccgatatgtaaaatg

SEQ ID NO: 352868 - DNA, 25 bp, Mus musculus
cctcagtcctgaaatggtgattttt

SEQ ID NO: 352869 - DNA, 25 bp, Mus musculus
cctcagtcctgatatggtgattttt

SEQ ID NO: 352870 - DNA, 25 bp, Mus musculus
cctcagtctcctatggcaacaaaag

SEQ ID NO: 352871 - DNA, 25 bp, Mus musculus
cctcagtctcctttggcaacaaaag

SEQ ID NO: 352872 - DNA, 25 bp, Mus musculus
cctcagtcttccatgaaaggctcat

SEQ ID NO: 352873 - DNA, 25 bp, Mus musculus
cctcagtcttccttgaaaggctcat

SEQ ID NO: 352874 - DNA, 25 bp, Mus musculus
cctcagtgatcccattttaaataaa

SEQ ID NO: 352875 - DNA, 25 bp, Mus musculus
cctcagtgatccgattttaaataaa

SEQ ID NO: 352876 - DNA, 25 bp, Mus musculus
cctcagtgatggaaggaaaccttta

SEQ ID NO: 352877 - DNA, 25 bp, Mus musculus
cctcagtgatggtaggaaaccttta

SEQ ID NO: 352878 - DNA, 25 bp, Mus musculus
cctcagtgcagcagggttgctagaa

SEQ ID NO: 352879 - DNA, 25 bp, Mus musculus
cctcagtgcagctgggttgctagaa

SEQ ID NO: 352880 - DNA, 25 bp, Mus musculus
cctcagtgccgtccagaagatgact

SEQ ID NO: 352881 - DNA, 25 bp, Mus musculus
cctcagtgccgtgcagaagatgact

SEQ ID NO: 352882 - DNA, 25 bp, Mus musculus
cctcagtgctgacagataggtgttg

SEQ ID NO: 352883 - DNA, 25 bp, Mus musculus
cctcagtgctgagagataggtgttg

SEQ ID NO: 352884 - DNA, 25 bp, Mus musculus
cctcagtggtctacttgcatatcat

SEQ ID NO: 352885 - DNA, 25 bp, Mus musculus
cctcagtggtcttcttgcatatcat

SEQ ID NO: 352886 - DNA, 25 bp, Mus musculus
cctcagtgtcagatggtggatggga

SEQ ID NO: 352887 - DNA, 25 bp, Mus musculus
cctcagtgtcagttggtggatggga

SEQ ID NO: 352888 - DNA, 25 bp, Mus musculus
cctcagtgtgaaaaggccctgattt

SEQ ID NO: 352889 - DNA, 25 bp, Mus musculus
cctcagtgtgaataggccctgattt

SEQ ID NO: 352890 - DNA, 25 bp, Mus musculus
cctcagttatggctgctggacgcaa

SEQ ID NO: 352891 - DNA, 25 bp, Mus musculus
cctcagttatgggtgctggacgcaa

SEQ ID NO: 352892 - DNA, 25 bp, Mus musculus
cctcagttcactacagcagtgcaag

SEQ ID NO: 352893 - DNA, 25 bp, Mus musculus
cctcagttcacttcagcagtgcaag

SEQ ID NO: 352894 - DNA, 25 bp, Mus musculus
cctcagttcattacttttgaccttc

SEQ ID NO: 352895 - DNA, 25 bp, Mus musculus
cctcagttcatttcttttgaccttc

SEQ ID NO: 352896 - DNA, 25 bp, Mus musculus
cctcagttgacaattccttcataat

SEQ ID NO: 352897 - DNA, 25 bp, Mus musculus
cctcagttgacatttccttcataat

SEQ ID NO: 352898 - DNA, 25 bp, Mus musculus
cctcagttgctcaggctattgacaa

SEQ ID NO: 352899 - DNA, 25 bp, Mus musculus
cctcagttgctctggctattgacaa

SEQ ID NO: 352900 - DNA, 25 bp, Mus musculus
cctcagtttcccctactgtaagata

SEQ ID NO: 352901 - DNA, 25 bp, Mus musculus
cctcagtttcccgtactgtaagata

SEQ ID NO: 352902 - DNA, 25 bp, Mus musculus
cctcagtttcttcattggtaataac

SEQ ID NO: 352903 - DNA, 25 bp, Mus musculus
cctcagtttcttgattggtaataac

SEQ ID NO: 352904 - DNA, 25 bp, Mus musculus
cctcagtttgaccagatagcgctca

SEQ ID NO: 352905 - DNA, 25 bp, Mus musculus
cctcagtttgacgagatagcgctca

SEQ ID NO: 352906 - DNA, 25 bp, Mus musculus
cctcagtttggtcttgctagtggaa

SEQ ID NO: 352907 - DNA, 25 bp, Mus musculus
cctcagtttggtgttgctagtggaa

SEQ ID NO: 352908 - DNA, 25 bp, Mus musculus
cctcataaaggaagagtccctggag

SEQ ID NO: 352909 - DNA, 25 bp, Mus musculus
cctcataaaggatgagtccctggag

SEQ ID NO: 352910 - DNA, 25 bp, Mus musculus
cctcataaatgcattgtaattgtga

SEQ ID NO: 352911 - DNA, 25 bp, Mus musculus
cctcataaatgctttgtaattgtga

SEQ ID NO: 352912 - DNA, 25 bp, Mus musculus
cctcatacacctatttaacatcctt

SEQ ID NO: 352913 - DNA, 25 bp, Mus musculus
cctcatacacctttttaacatcctt

SEQ ID NO: 352914 - DNA, 25 bp, Mus musculus
cctcataccaggcagacactgggtg

SEQ ID NO: 352915 - DNA, 25 bp, Mus musculus
cctcataccagggagacactgggtg

SEQ ID NO: 352916 - DNA, 25 bp, Mus musculus
cctcatactgagctttttgcactga

SEQ ID NO: 352917 - DNA, 25 bp, Mus musculus
cctcatactgaggtttttgcactga

SEQ ID NO: 352918 - DNA, 25 bp, Mus musculus
cctcatatgtctactcttgatagtg

SEQ ID NO: 352919 - DNA, 25 bp, Mus musculus
cctcatatgtcttctcttgatagtg

SEQ ID NO: 352920 - DNA, 25 bp, Mus musculus
cctcatcacatgcatttgcacttta

SEQ ID NO: 352921 - DNA, 25 bp, Mus musculus
cctcatcacatggatttgcacttta

SEQ ID NO: 352922 - DNA, 25 bp, Mus musculus
cctcatcaccagcacagatatcttg

SEQ ID NO: 352923 - DNA, 25 bp, Mus musculus
cctcatcaccaggacagatatcttg

SEQ ID NO: 352924 - DNA, 25 bp, Mus musculus
cctcatcattatattgtggccacac

SEQ ID NO: 352925 - DNA, 25 bp, Mus musculus
cctcatcattattttgtggccacac

SEQ ID NO: 352926 - DNA, 25 bp, Mus musculus
cctcatccagcgcatgggtagaact

SEQ ID NO: 352927 - DNA, 25 bp, Mus musculus
cctcatccagcggatgggtagaact

SEQ ID NO: 352928 - DNA, 25 bp, Mus musculus
cctcatcctaacatctgagcaattc

SEQ ID NO: 352929 - DNA, 25 bp, Mus musculus
cctcatcctaacttctgagcaattc

SEQ ID NO: 352930 - DNA, 25 bp, Mus musculus
cctcatcctggaagtcttctgtggg

SEQ ID NO: 352931 - DNA, 25 bp, Mus musculus
cctcatcctggatgtcttctgtggg

SEQ ID NO: 352932 - DNA, 25 bp, Mus musculus
cctcatccttaaaatgttatttcta

SEQ ID NO: 352933 - DNA, 25 bp, Mus musculus
cctcatccttaatatgttatttcta

SEQ ID NO: 352934 - DNA, 25 bp, Mus musculus
cctcatcgtacaccagagaactcat

SEQ ID NO: 352935 - DNA, 25 bp, Mus musculus
cctcatcgtacagcagagaactcat

SEQ ID NO: 352936 - DNA, 25 bp, Mus musculus
cctcatctaccaatgactctctaaa

SEQ ID NO: 352937 - DNA, 25 bp, Mus musculus
cctcatctaccattgactctctaaa

SEQ ID NO: 352938 - DNA, 25 bp, Mus musculus
cctcatctactactccctgaaggag

SEQ ID NO: 352939 - DNA, 25 bp, Mus musculus
cctcatctactagtccctgaaggag

SEQ ID NO: 352940 - DNA, 25 bp, Mus musculus
cctcatctctgcctaagaactgtaa

SEQ ID NO: 352941 - DNA, 25 bp, Mus musculus
cctcatctctgcgtaagaactgtaa

SEQ ID NO: 352942 - DNA, 25 bp, Mus musculus
cctcatctgggactgttggtttagt

SEQ ID NO: 352943 - DNA, 25 bp, Mus musculus
cctcatctgggagtgttggtttagt

SEQ ID NO: 352944 - DNA, 25 bp, Mus musculus
cctcatctgggtcgtggacagcgcc

SEQ ID NO: 352945 - DNA, 25 bp, Mus musculus
cctcatctgggtggtggacagcgcc

SEQ ID NO: 352946 - DNA, 25 bp, Mus musculus
cctcatcttcagcttttgtctgtgt

SEQ ID NO: 352947 - DNA, 25 bp, Mus musculus
cctcatcttcaggttttgtctgtgt

SEQ ID NO: 352948 - DNA, 25 bp, Mus musculus
cctcatcttcttatcccaactgtga

SEQ ID NO: 352949 - DNA, 25 bp, Mus musculus
cctcatcttcttttcccaactgtga

SEQ ID NO: 352950 - DNA, 25 bp, Mus musculus
cctcatgaacccctgcttagcatgg

SEQ ID NO: 352951 - DNA, 25 bp, Mus musculus
cctcatgaacccgtgcttagcatgg

SEQ ID NO: 352952 - DNA, 25 bp, Mus musculus
cctcatgagggcatttaagacttct

SEQ ID NO: 352953 - DNA, 25 bp, Mus musculus
cctcatgagggcttttaagacttct

SEQ ID NO: 352954 - DNA, 25 bp, Mus musculus
cctcatgagggtccagtcagtggac

SEQ ID NO: 352955 - DNA, 25 bp, Mus musculus
cctcatgagggtgcagtcagtggac

SEQ ID NO: 352956 - DNA, 25 bp, Mus musculus
cctcatgagtgtccagggactgaat

SEQ ID NO: 352957 - DNA, 25 bp, Mus musculus
cctcatgagtgtgcagggactgaat

SEQ ID NO: 352958 - DNA, 25 bp, Mus musculus
cctcatgataggaaacagcagaaaa

SEQ ID NO: 352959 - DNA, 25 bp, Mus musculus
cctcatgataggtaacagcagaaaa

SEQ ID NO: 352960 - DNA, 25 bp, Mus musculus
cctcatgatgggatgtggaagtgta

SEQ ID NO: 352961 - DNA, 25 bp, Mus musculus
cctcatgatgggttgtggaagtgta

SEQ ID NO: 352962 - DNA, 25 bp, Mus musculus
cctcatgattctaccaaaattttta

SEQ ID NO: 352963 - DNA, 25 bp, Mus musculus
cctcatgattcttccaaaattttta

SEQ ID NO: 352964 - DNA, 25 bp, Mus musculus
cctcatgccaaccttatacaatctt

SEQ ID NO: 352965 - DNA, 25 bp, Mus musculus
cctcatgccaacgttatacaatctt

SEQ ID NO: 352966 - DNA, 25 bp, Mus musculus
cctcatgccttaatcagcatcacaa

SEQ ID NO: 352967 - DNA, 25 bp, Mus musculus
cctcatgccttattcagcatcacaa

SEQ ID NO: 352968 - DNA, 25 bp, Mus musculus
cctcatgctcctctgtggaaagatc

SEQ ID NO: 352969 - DNA, 25 bp, Mus musculus
cctcatgctcctgtgtggaaagatc

SEQ ID NO: 352970 - DNA, 25 bp, Mus musculus
cctcatgctggtagtggtgtgacac

SEQ ID NO: 352971 - DNA, 25 bp, Mus musculus
cctcatgctggttgtggtgtgacac

SEQ ID NO: 352972 - DNA, 25 bp, Mus musculus
cctcatgcttttcttggtcacataa

SEQ ID NO: 352973 - DNA, 25 bp, Mus musculus
cctcatgcttttgttggtcacataa

SEQ ID NO: 352974 - DNA, 25 bp, Mus musculus
cctcatggccttaacgaacgaaact

SEQ ID NO: 352975 - DNA, 25 bp, Mus musculus
cctcatggcctttacgaacgaaact

SEQ ID NO: 352976 - DNA, 25 bp, Mus musculus
cctcatggctctagttgttgccaag

SEQ ID NO: 352977 - DNA, 25 bp, Mus musculus
cctcatggctcttgttgttgccaag

SEQ ID NO: 352978 - DNA, 25 bp, Mus musculus
cctcatggtctgctatatatacaat

SEQ ID NO: 352979 - DNA, 25 bp, Mus musculus
cctcatggtctggtatatatacaat

SEQ ID NO: 352980 - DNA, 25 bp, Mus musculus
cctcatgtcactcctggtgtatata

SEQ ID NO: 352981 - DNA, 25 bp, Mus musculus
cctcatgtcactgctggtgtatata

SEQ ID NO: 352982 - DNA, 25 bp, Mus musculus
cctcatgtcagacaggaaacagagc

SEQ ID NO: 352983 - DNA, 25 bp, Mus musculus
cctcatgtcagagaggaaacagagc

SEQ ID NO: 352984 - DNA, 25 bp, Mus musculus
cctcatgtctctccttgaatactta

SEQ ID NO: 352985 - DNA, 25 bp, Mus musculus
cctcatgtctctgcttgaatactta

SEQ ID NO: 352986 - DNA, 25 bp, Mus musculus
cctcatgtctgtcgctgaagtccga

SEQ ID NO: 352987 - DNA, 25 bp, Mus musculus
cctcatgtctgtggctgaagtccga

SEQ ID NO: 352988 - DNA, 25 bp, Mus musculus
cctcatgtctttcgtaacttgtatt

SEQ ID NO: 352989 - DNA, 25 bp, Mus musculus
cctcatgtctttggtaacttgtatt

SEQ ID NO: 352990 - DNA, 25 bp, Mus musculus
cctcatgttacacttccaccttaaa

SEQ ID NO: 352991 - DNA, 25 bp, Mus musculus
cctcatgttacagttccaccttaaa

SEQ ID NO: 352992 - DNA, 25 bp, Mus musculus
cctcattacagtcgtgtggacccca

SEQ ID NO: 352993 - DNA, 25 bp, Mus musculus
cctcattacagtggtgtggacccca

SEQ ID NO: 352994 - DNA, 25 bp, Mus musculus
cctcattatggcctttccatctact

SEQ ID NO: 352995 - DNA, 25 bp, Mus musculus
cctcattatggcgtttccatctact

SEQ ID NO: 352996 - DNA, 25 bp, Mus musculus
cctcattattctactggaacccaga

SEQ ID NO: 352997 - DNA, 25 bp, Mus musculus
cctcattattcttctggaacccaga

SEQ ID NO: 352998 - DNA, 25 bp, Mus musculus
cctcattcgtgactgggtagcagca

SEQ ID NO: 352999 - DNA, 25 bp, Mus musculus
cctcattcgtgagtgggtagcagca

SEQ ID NO: 353000 - DNA, 25 bp, Mus musculus
cctcattctctaccgtgaagacagc

SEQ ID NO: 353001 - DNA, 25 bp, Mus musculus
cctcattctctagcgtgaagacagc

SEQ ID NO: 353002 - DNA, 25 bp, Mus musculus
cctcattgacctatgattccagttg

SEQ ID NO: 353003 - DNA, 25 bp, Mus musculus
cctcattgacctttgattccagttg

SEQ ID NO: 353004 - DNA, 25 bp, Mus musculus
cctcattgatacactcctggatgga

SEQ ID NO: 353005 - DNA, 25 bp, Mus musculus
cctcattgatactctcctggatgga

SEQ ID NO: 353006 - DNA, 25 bp, Mus musculus
cctcattgctgccatcatgtccaag

SEQ ID NO: 353007 - DNA, 25 bp, Mus musculus
cctcattgctgcgatcatgtccaag

SEQ ID NO: 353008 - DNA, 25 bp, Mus musculus
cctcattgttatctctaccttgtgt

SEQ ID NO: 353009 - DNA, 25 bp, Mus musculus
cctcattgttatgtctaccttgtgt

SEQ ID NO: 353010 - DNA, 25 bp, Mus musculus
cctcatttactaagaatccctccaa

SEQ ID NO: 353011 - DNA, 25 bp, Mus musculus
cctcatttactatgaatccctccaa

SEQ ID NO: 353012 - DNA, 25 bp, Mus musculus
cctcatttatagctttcctctcata

SEQ ID NO: 353013 - DNA, 25 bp, Mus musculus
cctcatttataggtttcctctcata

SEQ ID NO: 353014 - DNA, 25 bp, Mus musculus
cctcattttcctccgtgcttaagat

SEQ ID NO: 353015 - DNA, 25 bp, Mus musculus
cctcattttcctgcgtgcttaagat

SEQ ID NO: 353016 - DNA, 25 bp, Mus musculus
cctccaaacttcacacaagtgctat

SEQ ID NO: 353017 - DNA, 25 bp, Mus musculus
cctccaaacttctcacaagtgctat

SEQ ID NO: 353018 - DNA, 25 bp, Mus musculus
cctccaaagatccattactaatgcc

SEQ ID NO: 353019 - DNA, 25 bp, Mus musculus
cctccaaagatcgattactaatgcc

SEQ ID NO: 353020 - DNA, 25 bp, Mus musculus
cctccaaatctactcttcttttaag

SEQ ID NO: 353021 - DNA, 25 bp, Mus musculus
cctccaaatctagtcttcttttaag

SEQ ID NO: 353022 - DNA, 25 bp, Mus musculus
cctccaaattgcaggaatcactcag

SEQ ID NO: 353023 - DNA, 25 bp, Mus musculus
cctccaaattgctggaatcactcag

SEQ ID NO: 353024 - DNA, 25 bp, Mus musculus
cctccaacaaggctactccatatgg

SEQ ID NO: 353025 - DNA, 25 bp, Mus musculus
cctccaacaagggtactccatatgg

SEQ ID NO: 353026 - DNA, 25 bp, Mus musculus
cctccaacaggtacagctcatatat

SEQ ID NO: 353027 - DNA, 25 bp, Mus musculus
cctccaacaggttcagctcatatat

SEQ ID NO: 353028 - DNA, 25 bp, Mus musculus
cctccaacctggctgtctagaagtg

SEQ ID NO: 353029 - DNA, 25 bp, Mus musculus
cctccaacctgggtgtctagaagtg

SEQ ID NO: 353030 - DNA, 25 bp, Mus musculus
cctccaagagctctgctcttaaggg

SEQ ID NO: 353031 - DNA, 25 bp, Mus musculus
cctccaagagctgtgctcttaaggg

SEQ ID NO: 353032 - DNA, 25 bp, Mus musculus
cctccaagttccagagctttttcaa

SEQ ID NO: 353033 - DNA, 25 bp, Mus musculus
cctccaagttcctgagctttttcaa

SEQ ID NO: 353034 - DNA, 25 bp, Mus musculus
cctccaatggagactgtcaagcaca

SEQ ID NO: 353035 - DNA, 25 bp, Mus musculus
cctccaatggagtctgtcaagcaca

SEQ ID NO: 353036 - DNA, 25 bp, Mus musculus
cctccaattactcctgactattcta

SEQ ID NO: 353037 - DNA, 25 bp, Mus musculus
cctccaattactgctgactattcta

SEQ ID NO: 353038 - DNA, 25 bp, Mus musculus
cctccaattcccctagtactgtaat

SEQ ID NO: 353039 - DNA, 25 bp, Mus musculus
cctccaattcccgtagtactgtaat

SEQ ID NO: 353040 - DNA, 25 bp, Mus musculus
cctccacaagacatgtcagagcctt

SEQ ID NO: 353041 - DNA, 25 bp, Mus musculus
cctccacaagacttgtcagagcctt

SEQ ID NO: 353042 - DNA, 25 bp, Mus musculus
cctccacactaaaccttctaaatgg

SEQ ID NO: 353043 - DNA, 25 bp, Mus musculus
cctccacactaatccttctaaatgg

SEQ ID NO: 353044 - DNA, 25 bp, Mus musculus
cctccacactggattcatgcaatga

SEQ ID NO: 353045 - DNA, 25 bp, Mus musculus
cctccacactggtttcatgcaatga

SEQ ID NO: 353046 - DNA, 25 bp, Mus musculus
cctccacagatgatttctatgactg

SEQ ID NO: 353047 - DNA, 25 bp, Mus musculus
cctccacagatgttttctatgactg

SEQ ID NO: 353048 - DNA, 25 bp, Mus musculus
cctccaccaagactgggaagtttat

SEQ ID NO: 353049 - DNA, 25 bp, Mus musculus
cctccaccaagagtgggaagtttat

SEQ ID NO: 353050 - DNA, 25 bp, Mus musculus
cctccacccgtgaatgagctttttt

SEQ ID NO: 353051 - DNA, 25 bp, Mus musculus
cctccacccgtgtatgagctttttt

SEQ ID NO: 353052 - DNA, 25 bp, Mus musculus
cctccacctgcacagatgagtcaag

SEQ ID NO: 353053 - DNA, 25 bp, Mus musculus
cctccacctgcagagatgagtcaag

SEQ ID NO: 353054 - DNA, 25 bp, Mus musculus
cctccaccttttcttcaggcaaaat

SEQ ID NO: 353055 - DNA, 25 bp, Mus musculus
cctccaccttttgttcaggcaaaat

SEQ ID NO: 353056 - DNA, 25 bp, Mus musculus
cctccacgtttccattttgaacaca

SEQ ID NO: 353057 - DNA, 25 bp, Mus musculus
cctccacgtttcgattttgaacaca

SEQ ID NO: 353058 - DNA, 25 bp, Mus musculus
cctccactatcgacttcaatatttg

SEQ ID NO: 353059 - DNA, 25 bp, Mus musculus
cctccactatcgtcttcaatatttg

SEQ ID NO: 353060 - DNA, 25 bp, Mus musculus
cctccactcccaatggcaaaatgat

SEQ ID NO: 353061 - DNA, 25 bp, Mus musculus
cctccactcccattggcaaaatgat

SEQ ID NO: 353062 - DNA, 25 bp, Mus musculus
cctccactgcatcgtgaacggtcag

SEQ ID NO: 353063 - DNA, 25 bp, Mus musculus
cctccactgcatggtgaacggtcag

SEQ ID NO: 353064 - DNA, 25 bp, Mus musculus
cctccactggagacagctgttggat

SEQ ID NO: 353065 - DNA, 25 bp, Mus musculus
cctccactggagtcagctgttggat

SEQ ID NO: 353066 - DNA, 25 bp, Mus musculus
cctccacttgtgcacacttgagtga

SEQ ID NO: 353067 - DNA, 25 bp, Mus musculus
cctccacttgtggacacttgagtga

SEQ ID NO: 353068 - DNA, 25 bp, Mus musculus
cctccagaaaatatcgtgctgtggt

SEQ ID NO: 353069 - DNA, 25 bp, Mus musculus
cctccagaaaatttcgtgctgtggt

SEQ ID NO: 353070 - DNA, 25 bp, Mus musculus
cctccagaaagaccagccgtatgta

SEQ ID NO: 353071 - DNA, 25 bp, Mus musculus
cctccagaaagagcagccgtatgta

SEQ ID NO: 353072 - DNA, 25 bp, Mus musculus
cctccagacagtccagggcaggtgc

SEQ ID NO: 353073 - DNA, 25 bp, Mus musculus
cctccagacagtgcagggcaggtgc

SEQ ID NO: 353074 - DNA, 25 bp, Mus musculus
cctccagaccaacgttgggtggcta

SEQ ID NO: 353075 - DNA, 25 bp, Mus musculus
cctccagaccaaggttgggtggcta

SEQ ID NO: 353076 - DNA, 25 bp, Mus musculus
cctccagagcagagtcctgttggaa

SEQ ID NO: 353077 - DNA, 25 bp, Mus musculus
cctccagagcagtgtcctgttggaa

SEQ ID NO: 353078 - DNA, 25 bp, Mus musculus
cctccagaggcaagtccacttgtgt

SEQ ID NO: 353079 - DNA, 25 bp, Mus musculus
cctccagaggcatgtccacttgtgt

SEQ ID NO: 353080 - DNA, 25 bp, Mus musculus
cctccagagggcacagcttggtatt

SEQ ID NO: 353081 - DNA, 25 bp, Mus musculus
cctccagagggctcagcttggtatt

SEQ ID NO: 353082 - DNA, 25 bp, Mus musculus
cctccagagtttctggtgttacagt

SEQ ID NO: 353083 - DNA, 25 bp, Mus musculus
cctccagagtttgtggtgttacagt

SEQ ID NO: 353084 - DNA, 25 bp, Mus musculus
cctccagataggaacagatatccaa

SEQ ID NO: 353085 - DNA, 25 bp, Mus musculus
cctccagataggtacagatatccaa

SEQ ID NO: 353086 - DNA, 25 bp, Mus musculus
cctccagatgagaatgtccttgttg

SEQ ID NO: 353087 - DNA, 25 bp, Mus musculus
cctccagatgagtatgtccttgttg

SEQ ID NO: 353088 - DNA, 25 bp, Mus musculus
cctccagatggacccagtgaactat

SEQ ID NO: 353089 - DNA, 25 bp, Mus musculus
cctccagatggagccagtgaactat

SEQ ID NO: 353090 - DNA, 25 bp, Mus musculus
cctccagatggtaagtagtttattc

SEQ ID NO: 353091 - DNA, 25 bp, Mus musculus
cctccagatggttagtagtttattc

SEQ ID NO: 353092 - DNA, 25 bp, Mus musculus
cctccagctgtcactaacaggtatt

SEQ ID NO: 353093 - DNA, 25 bp, Mus musculus
cctccagctgtcattcatttacaaa

SEQ ID NO: 353094 - DNA, 25 bp, Mus musculus
cctccagctgtctctaacaggtatt

SEQ ID NO: 353095 - DNA, 25 bp, Mus musculus
cctccagctgtctttcatttacaaa

SEQ ID NO: 353096 - DNA, 25 bp, Mus musculus
cctccaggctggatatggtcattgc

SEQ ID NO: 353097 - DNA, 25 bp, Mus musculus
cctccaggctggttatggtcattgc

SEQ ID NO: 353098 - DNA, 25 bp, Mus musculus
cctccaggcttgacgaaatctcaag

SEQ ID NO: 353099 - DNA, 25 bp, Mus musculus
cctccaggcttgtcgaaatctcaag

SEQ ID NO: 353100 - DNA, 25 bp, Mus musculus
cctccagggccaccgcaagttgtgg

SEQ ID NO: 353101 - DNA, 25 bp, Mus musculus
cctccagggccagcgcaagttgtgg

SEQ ID NO: 353102 - DNA, 25 bp, Mus musculus
cctccagggcgcaggtgttaaaggt

SEQ ID NO: 353103 - DNA, 25 bp, Mus musculus
cctccagggcgctggtgttaaaggt

SEQ ID NO: 353104 - DNA, 25 bp, Mus musculus
cctccaggtatccatactcatgtgt

SEQ ID NO: 353105 - DNA, 25 bp, Mus musculus
cctccaggtatcgatactcatgtgt

SEQ ID NO: 353106 - DNA, 25 bp, Mus musculus
cctccaggtgatacttgtcacttag

SEQ ID NO: 353107 - DNA, 25 bp, Mus musculus
cctccaggtgattcttgtcacttag

SEQ ID NO: 353108 - DNA, 25 bp, Mus musculus
cctccaggtgttcatctgtacattg

SEQ ID NO: 353109 - DNA, 25 bp, Mus musculus
cctccaggtgttgatctgtacattg

SEQ ID NO: 353110 - DNA, 25 bp, Mus musculus
cctccagtaattcctatacagaagg

SEQ ID NO: 353111 - DNA, 25 bp, Mus musculus
cctccagtaattgctatacagaagg

SEQ ID NO: 353112 - DNA, 25 bp, Mus musculus
cctccagtcaagaacctgattctaa

SEQ ID NO: 353113 - DNA, 25 bp, Mus musculus
cctccagtcaagctcagtccagtaa

SEQ ID NO: 353114 - DNA, 25 bp, Mus musculus
cctccagtcaaggtcagtccagtaa

SEQ ID NO: 353115 - DNA, 25 bp, Mus musculus
cctccagtcaagtacctgattctaa

SEQ ID NO: 353116 - DNA, 25 bp, Mus musculus
cctccagtcacgatatcagcattat

SEQ ID NO: 353117 - DNA, 25 bp, Mus musculus
cctccagtcacgttatcagcattat

SEQ ID NO: 353118 - DNA, 25 bp, Mus musculus
cctccagtccctactagaagtattt

SEQ ID NO: 353119 - DNA, 25 bp, Mus musculus
cctccagtcccttctagaagtattt

SEQ ID NO: 353120 - DNA, 25 bp, Mus musculus
cctccagtctggattgttgctagta

SEQ ID NO: 353121 - DNA, 25 bp, Mus musculus
cctccagtctggtttgttgctagta

SEQ ID NO: 353122 - DNA, 25 bp, Mus musculus
cctccagtgttgactacagttgcaa

SEQ ID NO: 353123 - DNA, 25 bp, Mus musculus
cctccagtgttgtctacagttgcaa

SEQ ID NO: 353124 - DNA, 25 bp, Mus musculus
cctccagttatgctttctaaactaa

SEQ ID NO: 353125 - DNA, 25 bp, Mus musculus
cctccagttatggtttctaaactaa

SEQ ID NO: 353126 - DNA, 25 bp, Mus musculus
cctccagttcaaaggcacccaataa

SEQ ID NO: 353127 - DNA, 25 bp, Mus musculus
cctccagttcaatggcacccaataa

SEQ ID NO: 353128 - DNA, 25 bp, Mus musculus
cctccatacattacagtggtgccca

SEQ ID NO: 353129 - DNA, 25 bp, Mus musculus
cctccatacatttcagtggtgccca

SEQ ID NO: 353130 - DNA, 25 bp, Mus musculus
cctccataccttcttctaaacgtat

SEQ ID NO: 353131 - DNA, 25 bp, Mus musculus
cctccataccttgttctaaacgtat

SEQ ID NO: 353132 - DNA, 25 bp, Mus musculus
cctccatatcctccatttgagtggg

SEQ ID NO: 353133 - DNA, 25 bp, Mus musculus
cctccatatcctgcatttgagtggg

SEQ ID NO: 353134 - DNA, 25 bp, Mus musculus
cctccatcatcaactttagtacaac

SEQ ID NO: 353135 - DNA, 25 bp, Mus musculus
cctccatcatcatctttagtacaac

SEQ ID NO: 353136 - DNA, 25 bp, Mus musculus
cctccatccaagctggtgcaaggga

SEQ ID NO: 353137 - DNA, 25 bp, Mus musculus
cctccatccaaggtggtgcaaggga

SEQ ID NO: 353138 - DNA, 25 bp, Mus musculus
cctccatccagccaagagagcaaat

SEQ ID NO: 353139 - DNA, 25 bp, Mus musculus
cctccatccagcgaagagagcaaat

SEQ ID NO: 353140 - DNA, 25 bp, Mus musculus
cctccatcccagagaacggaactgg

SEQ ID NO: 353141 - DNA, 25 bp, Mus musculus
cctccatcccagtgaacggaactgg

SEQ ID NO: 353142 - DNA, 25 bp, Mus musculus
cctccatccttaattctagactttt

SEQ ID NO: 353143 - DNA, 25 bp, Mus musculus
cctccatccttatttctagactttt

SEQ ID NO: 353144 - DNA, 25 bp, Mus musculus
cctccatctgacatcataccaaaga

SEQ ID NO: 353145 - DNA, 25 bp, Mus musculus
cctccatctgacttcataccaaaga

SEQ ID NO: 353146 - DNA, 25 bp, Mus musculus
cctccatctgagacaccagtcataa

SEQ ID NO: 353147 - DNA, 25 bp, Mus musculus
cctccatctgagtcaccagtcataa

SEQ ID NO: 353148 - DNA, 25 bp, Mus musculus
cctccatgaactcctgctgaagaaa

SEQ ID NO: 353149 - DNA, 25 bp, Mus musculus
cctccatgaactgctgctgaagaaa

SEQ ID NO: 353150 - DNA, 25 bp, Mus musculus
cctccatgagccaccgtaaaatata

SEQ ID NO: 353151 - DNA, 25 bp, Mus musculus
cctccatgagcctccgtaaaatata

SEQ ID NO: 353152 - DNA, 25 bp, Mus musculus
cctccatgatggctgtgccttgagt

SEQ ID NO: 353153 - DNA, 25 bp, Mus musculus
cctccatgatgggtgtgccttgagt

SEQ ID NO: 353154 - DNA, 25 bp, Mus musculus
cctccatgccagaacaatgccttta

SEQ ID NO: 353155 - DNA, 25 bp, Mus musculus
cctccatgccagtacaatgccttta

SEQ ID NO: 353156 - DNA, 25 bp, Mus musculus
cctccatgggctatttctttttgct

SEQ ID NO: 353157 - DNA, 25 bp, Mus musculus
cctccatgggctttttctttttgct

SEQ ID NO: 353158 - DNA, 25 bp, Mus musculus
cctccatgggtcatatgaaggctat

SEQ ID NO: 353159 - DNA, 25 bp, Mus musculus
cctccatgggtcttatgaaggctat

SEQ ID NO: 353160 - DNA, 25 bp, Mus musculus
cctccatgtgtactccttggttgat

SEQ ID NO: 353161 - DNA, 25 bp, Mus musculus
cctccatgtgtagtccttggttgat

SEQ ID NO: 353162 - DNA, 25 bp, Mus musculus
cctccattagcaagtgttggtgcac

SEQ ID NO: 353163 - DNA, 25 bp, Mus musculus
cctccattagcatgtgttggtgcac

SEQ ID NO: 353164 - DNA, 25 bp, Mus musculus
cctccattagtacagacctgttagt

SEQ ID NO: 353165 - DNA, 25 bp, Mus musculus
cctccattagtagagacctgttagt

SEQ ID NO: 353166 - DNA, 25 bp, Mus musculus
cctccattatggcacgtcctgtgaa

SEQ ID NO: 353167 - DNA, 25 bp, Mus musculus
cctccattatgggacgtcctgtgaa

SEQ ID NO: 353168 - DNA, 25 bp, Mus musculus
cctccattgctgctgaacttacaca

SEQ ID NO: 353169 - DNA, 25 bp, Mus musculus
cctccattgctggtgaacttacaca

SEQ ID NO: 353170 - DNA, 25 bp, Mus musculus
cctcccaaattccttatcacctgaa

SEQ ID NO: 353171 - DNA, 25 bp, Mus musculus
cctcccaaattcgttatcacctgaa

SEQ ID NO: 353172 - DNA, 25 bp, Mus musculus
cctcccaactgccatgtgtatgtga

SEQ ID NO: 353173 - DNA, 25 bp, Mus musculus
cctcccaactgcgatgtgtatgtga

SEQ ID NO: 353174 - DNA, 25 bp, Mus musculus
cctcccaagaagatcgagatatccc

SEQ ID NO: 353175 - DNA, 25 bp, Mus musculus
cctcccaagaagttcgagatatccc

SEQ ID NO: 353176 - DNA, 25 bp, Mus musculus
cctcccaagggacaataagtatgtg

SEQ ID NO: 353177 - DNA, 25 bp, Mus musculus
cctcccaagggagaataagtatgtg

SEQ ID NO: 353178 - DNA, 25 bp, Mus musculus
cctcccaagtagaactaagcagtta

SEQ ID NO: 353179 - DNA, 25 bp, Mus musculus
cctcccaagtagtactaagcagtta

SEQ ID NO: 353180 - DNA, 25 bp, Mus musculus
cctcccacatgcagataaggtatct

SEQ ID NO: 353181 - DNA, 25 bp, Mus musculus
cctcccacatgctgataaggtatct

SEQ ID NO: 353182 - DNA, 25 bp, Mus musculus
cctcccactctcatgacatatttat

SEQ ID NO: 353183 - DNA, 25 bp, Mus musculus
cctcccactctcttgacatatttat

SEQ ID NO: 353184 - DNA, 25 bp, Mus musculus
cctcccactttcagcaagcaataag

SEQ ID NO: 353185 - DNA, 25 bp, Mus musculus
cctcccactttctgcaagcaataag

SEQ ID NO: 353186 - DNA, 25 bp, Mus musculus
cctcccagaccgagtttttggaatg

SEQ ID NO: 353187 - DNA, 25 bp, Mus musculus
cctcccagaccgtgtttttggaatg

SEQ ID NO: 353188 - DNA, 25 bp, Mus musculus
cctcccagcataagctctgatttag

SEQ ID NO: 353189 - DNA, 25 bp, Mus musculus
cctcccagcatatgctctgatttag

SEQ ID NO: 353190 - DNA, 25 bp, Mus musculus
cctcccagccgcagtgagggtgaca

SEQ ID NO: 353191 - DNA, 25 bp, Mus musculus
cctcccagccgctgtgagggtgaca

SEQ ID NO: 353192 - DNA, 25 bp, Mus musculus
cctcccagcgggatatttattgtag

SEQ ID NO: 353193 - DNA, 25 bp, Mus musculus
cctcccagcgggttatttattgtag

SEQ ID NO: 353194 - DNA, 25 bp, Mus musculus
cctcccaggcctaactcatgagaag

SEQ ID NO: 353195 - DNA, 25 bp, Mus musculus
cctcccaggccttactcatgagaag

SEQ ID NO: 353196 - DNA, 25 bp, Mus musculus
cctcccaggtctaattgcagtaata

SEQ ID NO: 353197 - DNA, 25 bp, Mus musculus
cctcccaggtcttattgcagtaata

SEQ ID NO: 353198 - DNA, 25 bp, Mus musculus
cctcccagtgccctaatgtaattgg

SEQ ID NO: 353199 - DNA, 25 bp, Mus musculus
cctcccagtgccgtaatgtaattgg

SEQ ID NO: 353200 - DNA, 25 bp, Mus musculus
cctcccagtttcaatagagagactt

SEQ ID NO: 353201 - DNA, 25 bp, Mus musculus
cctcccagtttctatagagagactt

SEQ ID NO: 353202 - DNA, 25 bp, Mus musculus
cctcccatacacaaaaatttagtct

SEQ ID NO: 353203 - DNA, 25 bp, Mus musculus
cctcccatacactaaaatttagtct

SEQ ID NO: 353204 - DNA, 25 bp, Mus musculus
cctcccataggtagcagagctcaaa

SEQ ID NO: 353205 - DNA, 25 bp, Mus musculus
cctcccataggttgcagagctcaaa

SEQ ID NO: 353206 - DNA, 25 bp, Mus musculus
cctcccatcgacaggagcagttaaa

SEQ ID NO: 353207 - DNA, 25 bp, Mus musculus
cctcccatcgactggagcagttaaa

SEQ ID NO: 353208 - DNA, 25 bp, Mus musculus
cctcccatcgtcctgttatatatat

SEQ ID NO: 353209 - DNA, 25 bp, Mus musculus
cctcccatcgtcgtgttatatatat

SEQ ID NO: 353210 - DNA, 25 bp, Mus musculus
cctcccatctggaaaacatacttga

SEQ ID NO: 353211 - DNA, 25 bp, Mus musculus
cctcccatctggtaaacatacttga

SEQ ID NO: 353212 - DNA, 25 bp, Mus musculus
cctcccatgagtatctgatgttttc

SEQ ID NO: 353213 - DNA, 25 bp, Mus musculus
cctcccatgagtttctgatgttttc

SEQ ID NO: 353214 - DNA, 25 bp, Mus musculus
cctcccatggcacattttgaatctg

SEQ ID NO: 353215 - DNA, 25 bp, Mus musculus
cctcccatggcagattttgaatctg

SEQ ID NO: 353216 - DNA, 25 bp, Mus musculus
cctcccatgttactatctgataata

SEQ ID NO: 353217 - DNA, 25 bp, Mus musculus
cctcccatgttagtatctgataata

SEQ ID NO: 353218 - DNA, 25 bp, Mus musculus
cctccccaaagtatcttgagatcag

SEQ ID NO: 353219 - DNA, 25 bp, Mus musculus
cctccccaaagtttcttgagatcag

SEQ ID NO: 353220 - DNA, 25 bp, Mus musculus
cctccccaaataacagatgtttttt

SEQ ID NO: 353221 - DNA, 25 bp, Mus musculus
cctccccaaatatcagatgtttttt

SEQ ID NO: 353222 - DNA, 25 bp, Mus musculus
cctccccacacactatttgcagatg

SEQ ID NO: 353223 - DNA, 25 bp, Mus musculus
cctccccacacagtatttgcagatg

SEQ ID NO: 353224 - DNA, 25 bp, Mus musculus
cctccccactgtagatgtgattggg

SEQ ID NO: 353225 - DNA, 25 bp, Mus musculus
cctccccactgttgatgtgattggg

SEQ ID NO: 353226 - DNA, 25 bp, Mus musculus
cctccccaggatcgtgcaataatag

SEQ ID NO: 353227 - DNA, 25 bp, Mus musculus
cctccccaggatggtgcaataatag

SEQ ID NO: 353228 - DNA, 25 bp, Mus musculus
cctccccagggaatatagtcagcac

SEQ ID NO: 353229 - DNA, 25 bp, Mus musculus
cctccccagggattatagtcagcac

SEQ ID NO: 353230 - DNA, 25 bp, Mus musculus
cctccccagtgaatagtgtgttaca

SEQ ID NO: 353231 - DNA, 25 bp, Mus musculus
cctccccagtgacggacattttttg

SEQ ID NO: 353232 - DNA, 25 bp, Mus musculus
cctccccagtgagggacattttttg

SEQ ID NO: 353233 - DNA, 25 bp, Mus musculus
cctccccagtgattagtgtgttaca

SEQ ID NO: 353234 - DNA, 25 bp, Mus musculus
cctccccatgggacttattgttaca

SEQ ID NO: 353235 - DNA, 25 bp, Mus musculus
cctccccatgggtcttattgttaca

SEQ ID NO: 353236 - DNA, 25 bp, Mus musculus
cctccccattgcaaaatggcttcta

SEQ ID NO: 353237 - DNA, 25 bp, Mus musculus
cctccccattgctaaatggcttcta

SEQ ID NO: 353238 - DNA, 25 bp, Mus musculus
cctccccggctgctgggagataaat

SEQ ID NO: 353239 - DNA, 25 bp, Mus musculus
cctccccggctggtgggagataaat

SEQ ID NO: 353240 - DNA, 25 bp, Mus musculus
cctcccctaaagaagtgttctgacg

SEQ ID NO: 353241 - DNA, 25 bp, Mus musculus
cctcccctaaagtagtgttctgacg

SEQ ID NO: 353242 - DNA, 25 bp, Mus musculus
cctcccctcctgagtgacaatgacc

SEQ ID NO: 353243 - DNA, 25 bp, Mus musculus
cctcccctcctgtgtgacaatgacc

SEQ ID NO: 353244 - DNA, 25 bp, Mus musculus
cctcccctgtaacatcagcagtaga

SEQ ID NO: 353245 - DNA, 25 bp, Mus musculus
cctcccctgtaagatcagcagtaga

SEQ ID NO: 353246 - DNA, 25 bp, Mus musculus
cctcccctgtacagtattatttatt

SEQ ID NO: 353247 - DNA, 25 bp, Mus musculus
cctcccctgtactgtattatttatt

SEQ ID NO: 353248 - DNA, 25 bp, Mus musculus
cctccccttaaaccccagaagatga

SEQ ID NO: 353249 - DNA, 25 bp, Mus musculus
cctccccttaaagcccagaagatga

SEQ ID NO: 353250 - DNA, 25 bp, Mus musculus
cctccccttcaaatgctgtaattaa

SEQ ID NO: 353251 - DNA, 25 bp, Mus musculus
cctccccttcaattgctgtaattaa

SEQ ID NO: 353252 - DNA, 25 bp, Mus musculus
cctccccttctcagattattagtta

SEQ ID NO: 353253 - DNA, 25 bp, Mus musculus
cctccccttctctgattattagtta

SEQ ID NO: 353254 - DNA, 25 bp, Mus musculus
cctcccgaattcaagaccaaatctg

SEQ ID NO: 353255 - DNA, 25 bp, Mus musculus
cctcccgaattctagaccaaatctg

SEQ ID NO: 353256 - DNA, 25 bp, Mus musculus
cctcccgcttagctttctgtgtgat

SEQ ID NO: 353257 - DNA, 25 bp, Mus musculus
cctcccgcttaggtttctgtgtgat

SEQ ID NO: 353258 - DNA, 25 bp, Mus musculus
cctcccggagcacgcccaggagcag

SEQ ID NO: 353259 - DNA, 25 bp, Mus musculus
cctcccggagcaggcccaggagcag

SEQ ID NO: 353260 - DNA, 25 bp, Mus musculus
cctcccgtgtgaactgcaaactata

SEQ ID NO: 353261 - DNA, 25 bp, Mus musculus
cctcccgtgtgatctgcaaactata

SEQ ID NO: 353262 - DNA, 25 bp, Mus musculus
cctccctaggtcatgtgtcaataaa

SEQ ID NO: 353263 - DNA, 25 bp, Mus musculus
cctccctaggtcttgtgtcaataaa

SEQ ID NO: 353264 - DNA, 25 bp, Mus musculus
cctccctataatctctgtgtcatag

SEQ ID NO: 353265 - DNA, 25 bp, Mus musculus
cctccctataatgtctgtgtcatag

SEQ ID NO: 353266 - DNA, 25 bp, Mus musculus
cctccctcagaaatggagccactga

SEQ ID NO: 353267 - DNA, 25 bp, Mus musculus
cctccctcagaattggagccactga

SEQ ID NO: 353268 - DNA, 25 bp, Mus musculus
cctccctccagactaatcaggaatg

SEQ ID NO: 353269 - DNA, 25 bp, Mus musculus
cctccctccagagtaatcaggaatg

SEQ ID NO: 353270 - DNA, 25 bp, Mus musculus
cctccctcccgaaaggatagtgtat

SEQ ID NO: 353271 - DNA, 25 bp, Mus musculus
cctccctcccgataggatagtgtat

SEQ ID NO: 353272 - DNA, 25 bp, Mus musculus
cctccctcccttagagaggaggcag

SEQ ID NO: 353273 - DNA, 25 bp, Mus musculus
cctccctccctttgagaggaggcag

SEQ ID NO: 353274 - DNA, 25 bp, Mus musculus
cctccctcgaatagatgcgctttta

SEQ ID NO: 353275 - DNA, 25 bp, Mus musculus
cctccctcgaattgatgcgctttta

SEQ ID NO: 353276 - DNA, 25 bp, Mus musculus
cctccctgacaaaacttttaccatg

SEQ ID NO: 353277 - DNA, 25 bp, Mus musculus
cctccctgacaatacttttaccatg

SEQ ID NO: 353278 - DNA, 25 bp, Mus musculus
cctccctgacctcactgtaaataat

SEQ ID NO: 353279 - DNA, 25 bp, Mus musculus
cctccctgacctgactgtaaataat

SEQ ID NO: 353280 - DNA, 25 bp, Mus musculus
cctccctgctaaatcttaacatttg

SEQ ID NO: 353281 - DNA, 25 bp, Mus musculus
cctccctgctaattcttaacatttg

SEQ ID NO: 353282 - DNA, 25 bp, Mus musculus
cctccctgctgacacacaatgaaaa

SEQ ID NO: 353283 - DNA, 25 bp, Mus musculus
cctccctgctgagacacaatgaaaa

SEQ ID NO: 353284 - DNA, 25 bp, Mus musculus
cctccctgctgtaaagcacttggca

SEQ ID NO: 353285 - DNA, 25 bp, Mus musculus
cctccctgctgttaagcacttggca

SEQ ID NO: 353286 - DNA, 25 bp, Mus musculus
cctccctggctactgggtcaataat

SEQ ID NO: 353287 - DNA, 25 bp, Mus musculus
cctccctggctagtgggtcaataat

SEQ ID NO: 353288 - DNA, 25 bp, Mus musculus
cctccctggctgagaggctagggat

SEQ ID NO: 353289 - DNA, 25 bp, Mus musculus
cctccctggctgtgaggctagggat

SEQ ID NO: 353290 - DNA, 25 bp, Mus musculus
cctcccttcagaaatacttggcact

SEQ ID NO: 353291 - DNA, 25 bp, Mus musculus
cctcccttcagatatacttggcact

SEQ ID NO: 353292 - DNA, 25 bp, Mus musculus
cctcccttcagcaaactgacaagag

SEQ ID NO: 353293 - DNA, 25 bp, Mus musculus
cctcccttcagctaactgacaagag

SEQ ID NO: 353294 - DNA, 25 bp, Mus musculus
cctcccttcagtctgttggtaaaat

SEQ ID NO: 353295 - DNA, 25 bp, Mus musculus
cctcccttcagtgtgttggtaaaat

SEQ ID NO: 353296 - DNA, 25 bp, Mus musculus
cctcccttcatgaactcttattttg

SEQ ID NO: 353297 - DNA, 25 bp, Mus musculus
cctcccttcatgtactcttattttg

SEQ ID NO: 353298 - DNA, 25 bp, Mus musculus
cctcccttcctcagtttatatgaag

SEQ ID NO: 353299 - DNA, 25 bp, Mus musculus
cctcccttcctctgtttatatgaag

SEQ ID NO: 353300 - DNA, 25 bp, Mus musculus
cctcccttccttctgatgtgataat

SEQ ID NO: 353301 - DNA, 25 bp, Mus musculus
cctcccttccttgtgatgtgataat

SEQ ID NO: 353302 - DNA, 25 bp, Mus musculus
cctcccttctgtccccagttgggag

SEQ ID NO: 353303 - DNA, 25 bp, Mus musculus
cctcccttctgtgcccagttgggag

SEQ ID NO: 353304 - DNA, 25 bp, Mus musculus
cctcccttcttcaagtaggcagaaa

SEQ ID NO: 353305 - DNA, 25 bp, Mus musculus
cctcccttcttctagtaggcagaaa

SEQ ID NO: 353306 - DNA, 25 bp, Mus musculus
cctcccttggtaataaagctgcttg

SEQ ID NO: 353307 - DNA, 25 bp, Mus musculus
cctcccttggtattaaagctgcttg

SEQ ID NO: 353308 - DNA, 25 bp, Mus musculus
cctccctttgaacatctgtccatat

SEQ ID NO: 353309 - DNA, 25 bp, Mus musculus
cctccctttgaagatctgtccatat

SEQ ID NO: 353310 - DNA, 25 bp, Mus musculus
cctccctttgttcgtgctatgaaat

SEQ ID NO: 353311 - DNA, 25 bp, Mus musculus
cctccctttgttggtgctatgaaat

SEQ ID NO: 353312 - DNA, 25 bp, Mus musculus
cctcccttttctaggactactatat

SEQ ID NO: 353313 - DNA, 25 bp, Mus musculus
cctcccttttcttggactactatat

SEQ ID NO: 353314 - DNA, 25 bp, Mus musculus
cctccgaaaaatagggatgctctaa

SEQ ID NO: 353315 - DNA, 25 bp, Mus musculus
cctccgaaaaattgggatgctctaa

SEQ ID NO: 353316 - DNA, 25 bp, Mus musculus
cctccgaaggccagaagtgtttggt

SEQ ID NO: 353317 - DNA, 25 bp, Mus musculus
cctccgaaggcctgaagtgtttggt

SEQ ID NO: 353318 - DNA, 25 bp, Mus musculus
cctccgaagtttcctgacaacgtat

SEQ ID NO: 353319 - DNA, 25 bp, Mus musculus
cctccgaagtttgctgacaacgtat

SEQ ID NO: 353320 - DNA, 25 bp, Mus musculus
cctccgactgagctaaacttttcta

SEQ ID NO: 353321 - DNA, 25 bp, Mus musculus
cctccgactgaggtaaacttttcta

SEQ ID NO: 353322 - DNA, 25 bp, Mus musculus
cctccgagacagcaaaataatcata

SEQ ID NO: 353323 - DNA, 25 bp, Mus musculus
cctccgagacaggaaaataatcata

SEQ ID NO: 353324 - DNA, 25 bp, Mus musculus
cctccgagaccccagctggtgaaga

SEQ ID NO: 353325 - DNA, 25 bp, Mus musculus
cctccgagacccgagctggtgaaga

SEQ ID NO: 353326 - DNA, 25 bp, Mus musculus
cctccgagatgtaggctttggttat

SEQ ID NO: 353327 - DNA, 25 bp, Mus musculus
cctccgagatgttggctttggttat

SEQ ID NO: 353328 - DNA, 25 bp, Mus musculus
cctccgatactacatgctcaacata

SEQ ID NO: 353329 - DNA, 25 bp, Mus musculus
cctccgatactagatgctcaacata

SEQ ID NO: 353330 - DNA, 25 bp, Mus musculus
cctccgcatgtactcaactatgtta

SEQ ID NO: 353331 - DNA, 25 bp, Mus musculus
cctccgcatgtagtcaactatgtta

SEQ ID NO: 353332 - DNA, 25 bp, Mus musculus
cctccgcgcttgaaagttaacatgt

SEQ ID NO: 353333 - DNA, 25 bp, Mus musculus
cctccgcgcttgtaagttaacatgt

SEQ ID NO: 353334 - DNA, 25 bp, Mus musculus
cctccgctagccacttatttgaaga

SEQ ID NO: 353335 - DNA, 25 bp, Mus musculus
cctccgctagcctcttatttgaaga

SEQ ID NO: 353336 - DNA, 25 bp, Mus musculus
cctccggaattcattacgcgttgat

SEQ ID NO: 353337 - DNA, 25 bp, Mus musculus
cctccggaattctttacgcgttgat

SEQ ID NO: 353338 - DNA, 25 bp, Mus musculus
cctccggagcagctgcatgcaaatt

SEQ ID NO: 353339 - DNA, 25 bp, Mus musculus
cctccggagcaggtgcatgcaaatt

SEQ ID NO: 353340 - DNA, 25 bp, Mus musculus
cctccggatctaagcactcattggt

SEQ ID NO: 353341 - DNA, 25 bp, Mus musculus
cctccggatctatgcactcattggt

SEQ ID NO: 353342 - DNA, 25 bp, Mus musculus
cctccggcatctaaaatcttctttg

SEQ ID NO: 353343 - DNA, 25 bp, Mus musculus
cctccggcatcttaaatcttctttg

SEQ ID NO: 353344 - DNA, 25 bp, Mus musculus
cctccggctgaaccaccaaagttgg

SEQ ID NO: 353345 - DNA, 25 bp, Mus musculus
cctccggctgaagcaccaaagttgg

SEQ ID NO: 353346 - DNA, 25 bp, Mus musculus
cctccggctgctaaataatggcgtg

SEQ ID NO: 353347 - DNA, 25 bp, Mus musculus
cctccggctgcttaataatggcgtg

SEQ ID NO: 353348 - DNA, 25 bp, Mus musculus
cctccgggttgtcattgagcacgta

SEQ ID NO: 353349 - DNA, 25 bp, Mus musculus
cctccgggttgtgattgagcacgta

SEQ ID NO: 353350 - DNA, 25 bp, Mus musculus
cctccggtccttctgaagaacaaat

SEQ ID NO: 353351 - DNA, 25 bp, Mus musculus
cctccggtccttgtgaagaacaaat

SEQ ID NO: 353352 - DNA, 25 bp, Mus musculus
cctccgtccattattcagctggaag

SEQ ID NO: 353353 - DNA, 25 bp, Mus musculus
cctccgtccatttttcagctggaag

SEQ ID NO: 353354 - DNA, 25 bp, Mus musculus
cctccgtctggaattaatcttggtt

SEQ ID NO: 353355 - DNA, 25 bp, Mus musculus
cctccgtctggatttaatcttggtt

SEQ ID NO: 353356 - DNA, 25 bp, Mus musculus
cctccgtggaggcagtttactgtat

SEQ ID NO: 353357 - DNA, 25 bp, Mus musculus
cctccgtggagggagtttactgtat

SEQ ID NO: 353358 - DNA, 25 bp, Mus musculus
cctccgtggcttctttggctctgaa

SEQ ID NO: 353359 - DNA, 25 bp, Mus musculus
cctccgtggcttgtttggctctgaa

SEQ ID NO: 353360 - DNA, 25 bp, Mus musculus
cctccgtttatcatgaacaccttgg

SEQ ID NO: 353361 - DNA, 25 bp, Mus musculus
cctccgtttatcttgaacaccttgg

SEQ ID NO: 353362 - DNA, 25 bp, Mus musculus
cctccgtttccaccatagtcaaaat

SEQ ID NO: 353363 - DNA, 25 bp, Mus musculus
cctccgtttccagcatagtcaaaat

SEQ ID NO: 353364 - DNA, 25 bp, Mus musculus
cctcctaaaggcatgcttattaaat

SEQ ID NO: 353365 - DNA, 25 bp, Mus musculus
cctcctaaaggcttgcttattaaat

SEQ ID NO: 353366 - DNA, 25 bp, Mus musculus
cctcctaaattcctgtatggacttg

SEQ ID NO: 353367 - DNA, 25 bp, Mus musculus
cctcctaaattcgtgtatggacttg

SEQ ID NO: 353368 - DNA, 25 bp, Mus musculus
cctcctaatagtacctgggctcttt

SEQ ID NO: 353369 - DNA, 25 bp, Mus musculus
cctcctaatagttcctgggctcttt

SEQ ID NO: 353370 - DNA, 25 bp, Mus musculus
cctcctacacttagctagcttatga

SEQ ID NO: 353371 - DNA, 25 bp, Mus musculus
cctcctacacttattgccagtttat

SEQ ID NO: 353372 - DNA, 25 bp, Mus musculus
cctcctacactttgctagcttatga

SEQ ID NO: 353373 - DNA, 25 bp, Mus musculus
cctcctacactttttgccagtttat

SEQ ID NO: 353374 - DNA, 25 bp, Mus musculus
cctcctaccaacacagtggatttca

SEQ ID NO: 353375 - DNA, 25 bp, Mus musculus
cctcctaccaactcagtggatttca

SEQ ID NO: 353376 - DNA, 25 bp, Mus musculus
cctcctactattaacattccctaag

SEQ ID NO: 353377 - DNA, 25 bp, Mus musculus
cctcctactatttacattccctaag

SEQ ID NO: 353378 - DNA, 25 bp, Mus musculus
cctcctagccctaactgaagatttt

SEQ ID NO: 353379 - DNA, 25 bp, Mus musculus
cctcctagcccttactgaagatttt

SEQ ID NO: 353380 - DNA, 25 bp, Mus musculus
cctcctagctgcctgagagattcag

SEQ ID NO: 353381 - DNA, 25 bp, Mus musculus
cctcctagctgcgtgagagattcag

SEQ ID NO: 353382 - DNA, 25 bp, Mus musculus
cctcctaggaagctcgagcgaccag

SEQ ID NO: 353383 - DNA, 25 bp, Mus musculus
cctcctaggaaggtcgagcgaccag

SEQ ID NO: 353384 - DNA, 25 bp, Mus musculus
cctcctaggcttagtcacacaggga

SEQ ID NO: 353385 - DNA, 25 bp, Mus musculus
cctcctaggctttgtcacacaggga

SEQ ID NO: 353386 - DNA, 25 bp, Mus musculus
cctcctagtctcctagcaatgttag

SEQ ID NO: 353387 - DNA, 25 bp, Mus musculus
cctcctagtctcgtagcaatgttag

SEQ ID NO: 353388 - DNA, 25 bp, Mus musculus
cctcctagttgaaactcctgtctat

SEQ ID NO: 353389 - DNA, 25 bp, Mus musculus
cctcctagttgatactcctgtctat

SEQ ID NO: 353390 - DNA, 25 bp, Mus musculus
cctcctagttggaatttggacttca

SEQ ID NO: 353391 - DNA, 25 bp, Mus musculus
cctcctagttggtatttggacttca

SEQ ID NO: 353392 - DNA, 25 bp, Mus musculus
cctcctatgcggagggtctggcagc

SEQ ID NO: 353393 - DNA, 25 bp, Mus musculus
cctcctatgcggtgggtctggcagc

SEQ ID NO: 353394 - DNA, 25 bp, Mus musculus
cctcctattctcaaccaggtagtag

SEQ ID NO: 353395 - DNA, 25 bp, Mus musculus
cctcctattctctaccaggtagtag

SEQ ID NO: 353396 - DNA, 25 bp, Mus musculus
cctcctatttataccatttaccagc

SEQ ID NO: 353397 - DNA, 25 bp, Mus musculus
cctcctatttattccatttaccagc

SEQ ID NO: 353398 - DNA, 25 bp, Mus musculus
cctcctcaacagcaactttatgtgg

SEQ ID NO: 353399 - DNA, 25 bp, Mus musculus
cctcctcaacaggaactttatgtgg

SEQ ID NO: 353400 - DNA, 25 bp, Mus musculus
cctcctcaacttccttttggtcatg

SEQ ID NO: 353401 - DNA, 25 bp, Mus musculus
cctcctcaacttgcttttggtcatg

SEQ ID NO: 353402 - DNA, 25 bp, Mus musculus
cctcctcaatttactaggcttttgc

SEQ ID NO: 353403 - DNA, 25 bp, Mus musculus
cctcctcaattttctaggcttttgc

SEQ ID NO: 353404 - DNA, 25 bp, Mus musculus
cctcctcacacccagttttatttat

SEQ ID NO: 353405 - DNA, 25 bp, Mus musculus
cctcctcacaccgagttttatttat

SEQ ID NO: 353406 - DNA, 25 bp, Mus musculus
cctcctcacagaagctttcatcaag

SEQ ID NO: 353407 - DNA, 25 bp, Mus musculus
cctcctcacagatgctttcatcaag

SEQ ID NO: 353408 - DNA, 25 bp, Mus musculus
cctcctcacgaaagcctgattgtta

SEQ ID NO: 353409 - DNA, 25 bp, Mus musculus
cctcctcacgaatgcctgattgtta

SEQ ID NO: 353410 - DNA, 25 bp, Mus musculus
cctcctcacgatactgtgttgggaa

SEQ ID NO: 353411 - DNA, 25 bp, Mus musculus
cctcctcacgattctgtgttgggaa

SEQ ID NO: 353412 - DNA, 25 bp, Mus musculus
cctcctcacggactaagaaactcaa

SEQ ID NO: 353413 - DNA, 25 bp, Mus musculus
cctcctcacggagtaagaaactcaa

SEQ ID NO: 353414 - DNA, 25 bp, Mus musculus
cctcctcaggtccactggataaagg

SEQ ID NO: 353415 - DNA, 25 bp, Mus musculus
cctcctcaggtcgactggataaagg

SEQ ID NO: 353416 - DNA, 25 bp, Mus musculus
cctcctcagttaagtagagctataa

SEQ ID NO: 353417 - DNA, 25 bp, Mus musculus
cctcctcagttatgtagagctataa

SEQ ID NO: 353418 - DNA, 25 bp, Mus musculus
cctcctcataccaagtttataggta

SEQ ID NO: 353419 - DNA, 25 bp, Mus musculus
cctcctcatacctagtttataggta

SEQ ID NO: 353420 - DNA, 25 bp, Mus musculus
cctcctcatcttatggagccatgat

SEQ ID NO: 353421 - DNA, 25 bp, Mus musculus
cctcctcatcttttggagccatgat

SEQ ID NO: 353422 - DNA, 25 bp, Mus musculus
cctcctcattgaagggtgttttagg

SEQ ID NO: 353423 - DNA, 25 bp, Mus musculus
cctcctcattgatgggtgttttagg

SEQ ID NO: 353424 - DNA, 25 bp, Mus musculus
cctcctccacagaaagctatagatt

SEQ ID NO: 353425 - DNA, 25 bp, Mus musculus
cctcctccacagtaagctatagatt

SEQ ID NO: 353426 - DNA, 25 bp, Mus musculus
cctcctccattcatctgcatggagg

SEQ ID NO: 353427 - DNA, 25 bp, Mus musculus
cctcctccattcttctgcatggagg

SEQ ID NO: 353428 - DNA, 25 bp, Mus musculus
cctcctcccaacaaggtgattttga

SEQ ID NO: 353429 - DNA, 25 bp, Mus musculus
cctcctcccaactaggtgattttga

SEQ ID NO: 353430 - DNA, 25 bp, Mus musculus
cctcctccgtgtacatgttgtgaaa

SEQ ID NO: 353431 - DNA, 25 bp, Mus musculus
cctcctccgtgttcatgttgtgaaa

SEQ ID NO: 353432 - DNA, 25 bp, Mus musculus
cctcctcctaacaactagggcagat

SEQ ID NO: 353433 - DNA, 25 bp, Mus musculus
cctcctcctaactactagggcagat

SEQ ID NO: 353434 - DNA, 25 bp, Mus musculus
cctcctcctcttagagcaattttta

SEQ ID NO: 353435 - DNA, 25 bp, Mus musculus
cctcctcctctttgagcaattttta

SEQ ID NO: 353436 - DNA, 25 bp, Mus musculus
cctcctcctggtatgtagctgttgt

SEQ ID NO: 353437 - DNA, 25 bp, Mus musculus
cctcctcctggtttgtagctgttgt

SEQ ID NO: 353438 - DNA, 25 bp, Mus musculus
cctcctccttaaacatgtgtgtgac

SEQ ID NO: 353439 - DNA, 25 bp, Mus musculus
cctcctccttaatcatgtgtgtgac

SEQ ID NO: 353440 - DNA, 25 bp, Mus musculus
cctcctcgatgaactctctgaatga

SEQ ID NO: 353441 - DNA, 25 bp, Mus musculus
cctcctcgatgatctctctgaatga

SEQ ID NO: 353442 - DNA, 25 bp, Mus musculus
cctcctcgcccacaatttataaaga

SEQ ID NO: 353443 - DNA, 25 bp, Mus musculus
cctcctcgcccagaatttataaaga

SEQ ID NO: 353444 - DNA, 25 bp, Mus musculus
cctcctcgctagagactggatgtga

SEQ ID NO: 353445 - DNA, 25 bp, Mus musculus
cctcctcgctagtgactggatgtga

SEQ ID NO: 353446 - DNA, 25 bp, Mus musculus
cctcctcggcgtcctgtggaagctg

SEQ ID NO: 353447 - DNA, 25 bp, Mus musculus
cctcctcggcgtgctgtggaagctg

SEQ ID NO: 353448 - DNA, 25 bp, Mus musculus
cctcctcggtggctgagtaaactag

SEQ ID NO: 353449 - DNA, 25 bp, Mus musculus
cctcctcggtgggtgagtaaactag

SEQ ID NO: 353450 - DNA, 25 bp, Mus musculus
cctcctcgttttctacaaacactag

SEQ ID NO: 353451 - DNA, 25 bp, Mus musculus
cctcctcgttttgtacaaacactag

SEQ ID NO: 353452 - DNA, 25 bp, Mus musculus
cctcctctcaggattgaactagtgc

SEQ ID NO: 353453 - DNA, 25 bp, Mus musculus
cctcctctcaggtttgaactagtgc

SEQ ID NO: 353454 - DNA, 25 bp, Mus musculus
cctcctctcatgctatatcagggtg

SEQ ID NO: 353455 - DNA, 25 bp, Mus musculus
cctcctctcatggtatatcagggtg

SEQ ID NO: 353456 - DNA, 25 bp, Mus musculus
cctcctctcccaagtggagatgtaa

SEQ ID NO: 353457 - DNA, 25 bp, Mus musculus
cctcctctcccatgtggagatgtaa

SEQ ID NO: 353458 - DNA, 25 bp, Mus musculus
cctcctctccggattgatgagtaag

SEQ ID NO: 353459 - DNA, 25 bp, Mus musculus
cctcctctccggtttgatgagtaag

SEQ ID NO: 353460 - DNA, 25 bp, Mus musculus
cctcctctcgttcgatgtgagctcg

SEQ ID NO: 353461 - DNA, 25 bp, Mus musculus
cctcctctcgttggatgtgagctcg

SEQ ID NO: 353462 - DNA, 25 bp, Mus musculus
cctcctctgctaaggagtccagaaa

SEQ ID NO: 353463 - DNA, 25 bp, Mus musculus
cctcctctgctatggagtccagaaa

SEQ ID NO: 353464 - DNA, 25 bp, Mus musculus
cctcctctgctgctgtgatgataaa

SEQ ID NO: 353465 - DNA, 25 bp, Mus musculus
cctcctctgctggtgtgatgataaa

SEQ ID NO: 353466 - DNA, 25 bp, Mus musculus
cctcctctgtagctgggtttgatga

SEQ ID NO: 353467 - DNA, 25 bp, Mus musculus
cctcctctgtaggtgggtttgatga

SEQ ID NO: 353468 - DNA, 25 bp, Mus musculus
cctcctcttaccattagaaccgtat

SEQ ID NO: 353469 - DNA, 25 bp, Mus musculus
cctcctcttacctttagaaccgtat

SEQ ID NO: 353470 - DNA, 25 bp, Mus musculus
cctcctcttactctgaactttgtag

SEQ ID NO: 353471 - DNA, 25 bp, Mus musculus
cctcctcttactgtgaactttgtag

SEQ ID NO: 353472 - DNA, 25 bp, Mus musculus
cctcctcttggtcctgttatttgaa

SEQ ID NO: 353473 - DNA, 25 bp, Mus musculus
cctcctcttggtgctgttatttgaa

SEQ ID NO: 353474 - DNA, 25 bp, Mus musculus
cctcctctttatactcacgatgtga

SEQ ID NO: 353475 - DNA, 25 bp, Mus musculus
cctcctctttattctcacgatgtga

SEQ ID NO: 353476 - DNA, 25 bp, Mus musculus
cctcctctttgaacccagaataatg

SEQ ID NO: 353477 - DNA, 25 bp, Mus musculus
cctcctctttgatcccagaataatg

SEQ ID NO: 353478 - DNA, 25 bp, Mus musculus
cctcctctttggctgttgtaattat

SEQ ID NO: 353479 - DNA, 25 bp, Mus musculus
cctcctctttgggtgttgtaattat

SEQ ID NO: 353480 - DNA, 25 bp, Mus musculus
cctcctgacgtgagctgttctatca

SEQ ID NO: 353481 - DNA, 25 bp, Mus musculus
cctcctgacgtgtgctgttctatca

SEQ ID NO: 353482 - DNA, 25 bp, Mus musculus
cctcctgagggcaacaatgaggtgg

SEQ ID NO: 353483 - DNA, 25 bp, Mus musculus
cctcctgagggctacaatgaggtgg

SEQ ID NO: 353484 - DNA, 25 bp, Mus musculus
cctcctgaggtcacacaggcagtag

SEQ ID NO: 353485 - DNA, 25 bp, Mus musculus
cctcctgaggtctcacaggcagtag

SEQ ID NO: 353486 - DNA, 25 bp, Mus musculus
cctcctgatgatattctctagtaac

SEQ ID NO: 353487 - DNA, 25 bp, Mus musculus
cctcctgatgattttctctagtaac

SEQ ID NO: 353488 - DNA, 25 bp, Mus musculus
cctcctgattgcagagactgtgcca

SEQ ID NO: 353489 - DNA, 25 bp, Mus musculus
cctcctgattgctgagactgtgcca

SEQ ID NO: 353490 - DNA, 25 bp, Mus musculus
cctcctgcaaaactggtgtctgatc

SEQ ID NO: 353491 - DNA, 25 bp, Mus musculus
cctcctgcaaaagtggtgtctgatc

SEQ ID NO: 353492 - DNA, 25 bp, Mus musculus
cctcctgcacaaactgattgctgga

SEQ ID NO: 353493 - DNA, 25 bp, Mus musculus
cctcctgcacaaagagtttctgcct

SEQ ID NO: 353494 - DNA, 25 bp, Mus musculus
cctcctgcacaatctgattgctgga

SEQ ID NO: 353495 - DNA, 25 bp, Mus musculus
cctcctgcacaatgagtttctgcct

SEQ ID NO: 353496 - DNA, 25 bp, Mus musculus
cctcctgcacctaaggtgttacact

SEQ ID NO: 353497 - DNA, 25 bp, Mus musculus
cctcctgcaccttaggtgttacact

SEQ ID NO: 353498 - DNA, 25 bp, Mus musculus
cctcctgccacaatcagtttttatg

SEQ ID NO: 353499 - DNA, 25 bp, Mus musculus
cctcctgccacattcagtttttatg

SEQ ID NO: 353500 - DNA, 25 bp, Mus musculus
cctcctgcccacaatctgaatgaag

SEQ ID NO: 353501 - DNA, 25 bp, Mus musculus
cctcctgcccactatctgaatgaag

SEQ ID NO: 353502 - DNA, 25 bp, Mus musculus
cctcctgccttgcagatactgctga

SEQ ID NO: 353503 - DNA, 25 bp, Mus musculus
cctcctgccttggagatactgctga

SEQ ID NO: 353504 - DNA, 25 bp, Mus musculus
cctcctgcgtgtagagatgacaggt

SEQ ID NO: 353505 - DNA, 25 bp, Mus musculus
cctcctgcgtgttgagatgacaggt

SEQ ID NO: 353506 - DNA, 25 bp, Mus musculus
cctcctgctgtgatcaaaggcgtgt

SEQ ID NO: 353507 - DNA, 25 bp, Mus musculus
cctcctgctgtgttcaaaggcgtgt

SEQ ID NO: 353508 - DNA, 25 bp, Mus musculus
cctcctggaaggcaatcacgccaag

SEQ ID NO: 353509 - DNA, 25 bp, Mus musculus
cctcctggaagggaatcacgccaag

SEQ ID NO: 353510 - DNA, 25 bp, Mus musculus
cctcctggaggacggctacacagca

SEQ ID NO: 353511 - DNA, 25 bp, Mus musculus
cctcctggaggagggctacacagca

SEQ ID NO: 353512 - DNA, 25 bp, Mus musculus
cctcctggcgtaccttgtcaaatat

SEQ ID NO: 353513 - DNA, 25 bp, Mus musculus
cctcctggcgtagcttgtcaaatat

SEQ ID NO: 353514 - DNA, 25 bp, Mus musculus
cctcctgggataagtgtgagagcca

SEQ ID NO: 353515 - DNA, 25 bp, Mus musculus
cctcctgggatatgtgtgagagcca

SEQ ID NO: 353516 - DNA, 25 bp, Mus musculus
cctcctgggttgcatacatctgacg

SEQ ID NO: 353517 - DNA, 25 bp, Mus musculus
cctcctgggttggatacatctgacg

SEQ ID NO: 353518 - DNA, 25 bp, Mus musculus
cctcctgggtttaacaagattcttg

SEQ ID NO: 353519 - DNA, 25 bp, Mus musculus
cctcctgggttttacaagattcttg

SEQ ID NO: 353520 - DNA, 25 bp, Mus musculus
cctcctggtagcaacaactttctaa

SEQ ID NO: 353521 - DNA, 25 bp, Mus musculus
cctcctggtagctacaactttctaa

SEQ ID NO: 353522 - DNA, 25 bp, Mus musculus
cctcctggttgcctgtggaagagaa

SEQ ID NO: 353523 - DNA, 25 bp, Mus musculus
cctcctggttgcgtgtggaagagaa

SEQ ID NO: 353524 - DNA, 25 bp, Mus musculus
cctcctgtagctagtaaaatggcat

SEQ ID NO: 353525 - DNA, 25 bp, Mus musculus
cctcctgtagcttgtaaaatggcat

SEQ ID NO: 353526 - DNA, 25 bp, Mus musculus
cctcctgtcaataactgtcttcata

SEQ ID NO: 353527 - DNA, 25 bp, Mus musculus
cctcctgtcaattactgtcttcata

SEQ ID NO: 353528 - DNA, 25 bp, Mus musculus
cctcctgtcccaaattttaactcag

SEQ ID NO: 353529 - DNA, 25 bp, Mus musculus
cctcctgtcccatattttaactcag

SEQ ID NO: 353530 - DNA, 25 bp, Mus musculus
cctcctgtcggtatgttatctattc

SEQ ID NO: 353531 - DNA, 25 bp, Mus musculus
cctcctgtcggtttgttatctattc

SEQ ID NO: 353532 - DNA, 25 bp, Mus musculus
cctcctgtgaggataatatctggtg

SEQ ID NO: 353533 - DNA, 25 bp, Mus musculus
cctcctgtgaggttaatatctggtg

SEQ ID NO: 353534 - DNA, 25 bp, Mus musculus
cctcctgtggcccatgcagaggaag

SEQ ID NO: 353535 - DNA, 25 bp, Mus musculus
cctcctgtggccgatgcagaggaag

SEQ ID NO: 353536 - DNA, 25 bp, Mus musculus
cctcctgtgggactgaggactctaa

SEQ ID NO: 353537 - DNA, 25 bp, Mus musculus
cctcctgtgggagtgaggactctaa

SEQ ID NO: 353538 - DNA, 25 bp, Mus musculus
cctcctgtgtgtaaattatccccat

SEQ ID NO: 353539 - DNA, 25 bp, Mus musculus
cctcctgtgtgttaattatccccat

SEQ ID NO: 353540 - DNA, 25 bp, Mus musculus
cctcctgttatgaaaattccacctc

SEQ ID NO: 353541 - DNA, 25 bp, Mus musculus
cctcctgttatgtaaattccacctc

SEQ ID NO: 353542 - DNA, 25 bp, Mus musculus
cctcctgttgagatcaacagctttc

SEQ ID NO: 353543 - DNA, 25 bp, Mus musculus
cctcctgttgagttcaacagctttc

SEQ ID NO: 353544 - DNA, 25 bp, Mus musculus
cctcctgttgcaagggtctggttta

SEQ ID NO: 353545 - DNA, 25 bp, Mus musculus
cctcctgttgcatgggtctggttta

SEQ ID NO: 353546 - DNA, 25 bp, Mus musculus
cctccttacctaagctatgggtttt

SEQ ID NO: 353547 - DNA, 25 bp, Mus musculus
cctccttacctatgctatgggtttt

SEQ ID NO: 353548 - DNA, 25 bp, Mus musculus
cctccttaggccaacctagtagaga

SEQ ID NO: 353549 - DNA, 25 bp, Mus musculus
cctccttaggcctacctagtagaga

SEQ ID NO: 353550 - DNA, 25 bp, Mus musculus
cctccttattcccaggttgaattgg

SEQ ID NO: 353551 - DNA, 25 bp, Mus musculus
cctccttattccgaggttgaattgg

SEQ ID NO: 353552 - DNA, 25 bp, Mus musculus
cctccttcatccagttactgagaga

SEQ ID NO: 353553 - DNA, 25 bp, Mus musculus
cctccttcatcctgttactgagaga

SEQ ID NO: 353554 - DNA, 25 bp, Mus musculus
cctccttctatacagactgttgtag

SEQ ID NO: 353555 - DNA, 25 bp, Mus musculus
cctccttctatagagactgttgtag

SEQ ID NO: 353556 - DNA, 25 bp, Mus musculus
cctccttgaattcttcttgaaaact

SEQ ID NO: 353557 - DNA, 25 bp, Mus musculus
cctccttgaattgttcttgaaaact

SEQ ID NO: 353558 - DNA, 25 bp, Mus musculus
cctccttgcagactttaaaaaatgg

SEQ ID NO: 353559 - DNA, 25 bp, Mus musculus
cctccttgcagagtttaaaaaatgg

SEQ ID NO: 353560 - DNA, 25 bp, Mus musculus
cctccttgccaacataaactactgt

SEQ ID NO: 353561 - DNA, 25 bp, Mus musculus
cctccttgccaagataaactactgt

SEQ ID NO: 353562 - DNA, 25 bp, Mus musculus
cctccttgctcaatctgaagtcaga

SEQ ID NO: 353563 - DNA, 25 bp, Mus musculus
cctccttgctcattctgaagtcaga

SEQ ID NO: 353564 - DNA, 25 bp, Mus musculus
cctccttggaaccttaatgcatgtg

SEQ ID NO: 353565 - DNA, 25 bp, Mus musculus
cctccttggaacgttaatgcatgtg

SEQ ID NO: 353566 - DNA, 25 bp, Mus musculus
cctccttggcatcgacagggaactg

SEQ ID NO: 353567 - DNA, 25 bp, Mus musculus
cctccttggcatggacagggaactg

SEQ ID NO: 353568 - DNA, 25 bp, Mus musculus
cctccttgtaagagcttcaacccaa

SEQ ID NO: 353569 - DNA, 25 bp, Mus musculus
cctccttgtaagtgcttcaacccaa

SEQ ID NO: 353570 - DNA, 25 bp, Mus musculus
cctccttgtctacttgggcttcagt

SEQ ID NO: 353571 - DNA, 25 bp, Mus musculus
cctccttgtctagttgggcttcagt

SEQ ID NO: 353572 - DNA, 25 bp, Mus musculus
cctcctttagacatctgacttacag

SEQ ID NO: 353573 - DNA, 25 bp, Mus musculus
cctcctttagacttctgacttacag

SEQ ID NO: 353574 - DNA, 25 bp, Mus musculus
cctcctttattcatgatgtgaaaag

SEQ ID NO: 353575 - DNA, 25 bp, Mus musculus
cctcctttattcttgatgtgaaaag

SEQ ID NO: 353576 - DNA, 25 bp, Mus musculus
cctcctttcacaacaaactttcaaa

SEQ ID NO: 353577 - DNA, 25 bp, Mus musculus
cctcctttcacatcaaactttcaaa

SEQ ID NO: 353578 - DNA, 25 bp, Mus musculus
cctcctttcctcagataagctggaa

SEQ ID NO: 353579 - DNA, 25 bp, Mus musculus
cctcctttcctctgataagctggaa

SEQ ID NO: 353580 - DNA, 25 bp, Mus musculus
cctcctttggatctcccagggttca

SEQ ID NO: 353581 - DNA, 25 bp, Mus musculus
cctcctttggatgtcccagggttca

SEQ ID NO: 353582 - DNA, 25 bp, Mus musculus
cctccttttaggcagttgtttctca

SEQ ID NO: 353583 - DNA, 25 bp, Mus musculus
cctccttttagggagttgtttctca

SEQ ID NO: 353584 - DNA, 25 bp, Mus musculus
cctccttttgccagagctgggaagt

SEQ ID NO: 353585 - DNA, 25 bp, Mus musculus
cctccttttgcctgagctgggaagt

SEQ ID NO: 353586 - DNA, 25 bp, Mus musculus
cctcctttttatcattgatgagtta

SEQ ID NO: 353587 - DNA, 25 bp, Mus musculus
cctcctttttatgattgatgagtta

SEQ ID NO: 353588 - DNA, 25 bp, Mus musculus
cctcctttttgtcctgagctcatga

SEQ ID NO: 353589 - DNA, 25 bp, Mus musculus
cctcctttttgtgctgagctcatga

SEQ ID NO: 353590 - DNA, 25 bp, Mus musculus
cctcgaagctggaaggttttctgat

SEQ ID NO: 353591 - DNA, 25 bp, Mus musculus
cctcgaagctggtaggttttctgat

SEQ ID NO: 353592 - DNA, 25 bp, Mus musculus
cctcgacgagtcatgtatgttctta

SEQ ID NO: 353593 - DNA, 25 bp, Mus musculus
cctcgacgagtcttgtatgttctta

SEQ ID NO: 353594 - DNA, 25 bp, Mus musculus
cctcgactgacaccgtggttatgat

SEQ ID NO: 353595 - DNA, 25 bp, Mus musculus
cctcgactgacagcgtggttatgat

SEQ ID NO: 353596 - DNA, 25 bp, Mus musculus
cctcgactgccaactaaatcattga

SEQ ID NO: 353597 - DNA, 25 bp, Mus musculus
cctcgactgccatctaaatcattga

SEQ ID NO: 353598 - DNA, 25 bp, Mus musculus
cctcgacttacccagcagtagtaga

SEQ ID NO: 353599 - DNA, 25 bp, Mus musculus
cctcgacttaccgagcagtagtaga

SEQ ID NO: 353600 - DNA, 25 bp, Mus musculus
cctcgagaaaagcagtagccattaa

SEQ ID NO: 353601 - DNA, 25 bp, Mus musculus
cctcgagaaaaggagtagccattaa

SEQ ID NO: 353602 - DNA, 25 bp, Mus musculus
cctcgagcccatctgtgatgcagat

SEQ ID NO: 353603 - DNA, 25 bp, Mus musculus
cctcgagcccatgtgtgatgcagat

SEQ ID NO: 353604 - DNA, 25 bp, Mus musculus
cctcgagccgagacatatctcttat

SEQ ID NO: 353605 - DNA, 25 bp, Mus musculus
cctcgagccgagtcatatctcttat

SEQ ID NO: 353606 - DNA, 25 bp, Mus musculus
cctcgagctgttactgcctgtacgg

SEQ ID NO: 353607 - DNA, 25 bp, Mus musculus
cctcgagctgtttctgcctgtacgg

SEQ ID NO: 353608 - DNA, 25 bp, Mus musculus
cctcgagtggctccaatctgggtgt

SEQ ID NO: 353609 - DNA, 25 bp, Mus musculus
cctcgagtggctgcaatctgggtgt

SEQ ID NO: 353610 - DNA, 25 bp, Mus musculus
cctcgagttgataggattgttcccc

SEQ ID NO: 353611 - DNA, 25 bp, Mus musculus
cctcgagttgattggattgttcccc

SEQ ID NO: 353612 - DNA, 25 bp, Mus musculus
cctcgagtttcacaacgatcgcggg

SEQ ID NO: 353613 - DNA, 25 bp, Mus musculus
cctcgagtttcagaacgatcgcggg

SEQ ID NO: 353614 - DNA, 25 bp, Mus musculus
cctcgatctcgtctgctgggactga

SEQ ID NO: 353615 - DNA, 25 bp, Mus musculus
cctcgatctcgtgtgctgggactga

SEQ ID NO: 353616 - DNA, 25 bp, Mus musculus
cctcgatgccaaatctcggaagcaa

SEQ ID NO: 353617 - DNA, 25 bp, Mus musculus
cctcgatgccaattctcggaagcaa

SEQ ID NO: 353618 - DNA, 25 bp, Mus musculus
cctcgatgccggatagtttgtactg

SEQ ID NO: 353619 - DNA, 25 bp, Mus musculus
cctcgatgccggttagtttgtactg

SEQ ID NO: 353620 - DNA, 25 bp, Mus musculus
cctcgatgttaacgctgggctttca

SEQ ID NO: 353621 - DNA, 25 bp, Mus musculus
cctcgatgttaaggctgggctttca

SEQ ID NO: 353622 - DNA, 25 bp, Mus musculus
cctcgattagaaattataggactat

SEQ ID NO: 353623 - DNA, 25 bp, Mus musculus
cctcgattagaatttataggactat

SEQ ID NO: 353624 - DNA, 25 bp, Mus musculus
cctcgcaaacccagaactttgttat

SEQ ID NO: 353625 - DNA, 25 bp, Mus musculus
cctcgcaaaccctgaactttgttat

SEQ ID NO: 353626 - DNA, 25 bp, Mus musculus
cctcgcagtataccaggtgtctgga

SEQ ID NO: 353627 - DNA, 25 bp, Mus musculus
cctcgcagtatagcaggtgtctgga

SEQ ID NO: 353628 - DNA, 25 bp, Mus musculus
cctcgcattttacggcttctttgag

SEQ ID NO: 353629 - DNA, 25 bp, Mus musculus
cctcgcattttagggcttctttgag

SEQ ID NO: 353630 - DNA, 25 bp, Mus musculus
cctcgccgggtgaggtaacacacac

SEQ ID NO: 353631 - DNA, 25 bp, Mus musculus
cctcgccgggtgtggtaacacacac

SEQ ID NO: 353632 - DNA, 25 bp, Mus musculus
cctcgccttacgcatgggaagctga

SEQ ID NO: 353633 - DNA, 25 bp, Mus musculus
cctcgccttacggatgggaagctga

SEQ ID NO: 353634 - DNA, 25 bp, Mus musculus
cctcgctataataatgcccatgatt

SEQ ID NO: 353635 - DNA, 25 bp, Mus musculus
cctcgctataattatgcccatgatt

SEQ ID NO: 353636 - DNA, 25 bp, Mus musculus
cctcgctccttcataaattcatgat

SEQ ID NO: 353637 - DNA, 25 bp, Mus musculus
cctcgctccttcttaaattcatgat

SEQ ID NO: 353638 - DNA, 25 bp, Mus musculus
cctcgctctgcacaagtgagggtga

SEQ ID NO: 353639 - DNA, 25 bp, Mus musculus
cctcgctctgcagaagtgagggtga

SEQ ID NO: 353640 - DNA, 25 bp, Mus musculus
cctcgctgagcgaagggcatgacct

SEQ ID NO: 353641 - DNA, 25 bp, Mus musculus
cctcgctgagcgtagggcatgacct

SEQ ID NO: 353642 - DNA, 25 bp, Mus musculus
cctcgcttggttctctatatttact

SEQ ID NO: 353643 - DNA, 25 bp, Mus musculus
cctcgcttggttgtctatatttact

SEQ ID NO: 353644 - DNA, 25 bp, Mus musculus
cctcgcttgtctaggccgtatggga

SEQ ID NO: 353645 - DNA, 25 bp, Mus musculus
cctcgcttgtcttggccgtatggga

SEQ ID NO: 353646 - DNA, 25 bp, Mus musculus
cctcgcttgtgaattttcagggcaa

SEQ ID NO: 353647 - DNA, 25 bp, Mus musculus
cctcgcttgtgatttttcagggcaa

SEQ ID NO: 353648 - DNA, 25 bp, Mus musculus
cctcgctttacaatctaacgcacag

SEQ ID NO: 353649 - DNA, 25 bp, Mus musculus
cctcgctttacattctaacgcacag

SEQ ID NO: 353650 - DNA, 25 bp, Mus musculus
cctcgctttgacctgactcttatta

SEQ ID NO: 353651 - DNA, 25 bp, Mus musculus
cctcgctttgacgtgactcttatta

SEQ ID NO: 353652 - DNA, 25 bp, Mus musculus
cctcggaagagtccgcccaggagaa

SEQ ID NO: 353653 - DNA, 25 bp, Mus musculus
cctcggaagagtgcgcccaggagaa

SEQ ID NO: 353654 - DNA, 25 bp, Mus musculus
cctcggacatgtcatggtgaatggc

SEQ ID NO: 353655 - DNA, 25 bp, Mus musculus
cctcggacatgtgatggtgaatggc

SEQ ID NO: 353656 - DNA, 25 bp, Mus musculus
cctcggaccatacactgttccatag

SEQ ID NO: 353657 - DNA, 25 bp, Mus musculus
cctcggaccatagactgttccatag

SEQ ID NO: 353658 - DNA, 25 bp, Mus musculus
cctcggactcagactcatgcaatag

SEQ ID NO: 353659 - DNA, 25 bp, Mus musculus
cctcggactcagtctcatgcaatag

SEQ ID NO: 353660 - DNA, 25 bp, Mus musculus
cctcggagcagaccgatcagcagct

SEQ ID NO: 353661 - DNA, 25 bp, Mus musculus
cctcggagcagagcgatcagcagct

SEQ ID NO: 353662 - DNA, 25 bp, Mus musculus
cctcggatcctgactactttaaaca

SEQ ID NO: 353663 - DNA, 25 bp, Mus musculus
cctcggatcctgtctactttaaaca

SEQ ID NO: 353664 - DNA, 25 bp, Mus musculus
cctcggatgctgatttcggtgattt

SEQ ID NO: 353665 - DNA, 25 bp, Mus musculus
cctcggatgctgttttcggtgattt

SEQ ID NO: 353666 - DNA, 25 bp, Mus musculus
cctcggattattcaagtcgcacctc

SEQ ID NO: 353667 - DNA, 25 bp, Mus musculus
cctcggattattgaagtcgcacctc

SEQ ID NO: 353668 - DNA, 25 bp, Mus musculus
cctcggattgttatctccatctgat

SEQ ID NO: 353669 - DNA, 25 bp, Mus musculus
cctcggattgttttctccatctgat

SEQ ID NO: 353670 - DNA, 25 bp, Mus musculus
cctcggcagagcatgtggacagaat

SEQ ID NO: 353671 - DNA, 25 bp, Mus musculus
cctcggcagagcttgtggacagaat

SEQ ID NO: 353672 - DNA, 25 bp, Mus musculus
cctcggcgtcttagtacacagattg

SEQ ID NO: 353673 - DNA, 25 bp, Mus musculus
cctcggcgtctttgtacacagattg

SEQ ID NO: 353674 - DNA, 25 bp, Mus musculus
cctcggctatacatatacctcattc

SEQ ID NO: 353675 - DNA, 25 bp, Mus musculus
cctcggctatacttatacctcattc

SEQ ID NO: 353676 - DNA, 25 bp, Mus musculus
cctcggctcctgcagatgcagagca

SEQ ID NO: 353677 - DNA, 25 bp, Mus musculus
cctcggctcctggagatgcagagca

SEQ ID NO: 353678 - DNA, 25 bp, Mus musculus
cctcggctgggtccttgatcttcaa

SEQ ID NO: 353679 - DNA, 25 bp, Mus musculus
cctcggctgggtgcttgatcttcaa

SEQ ID NO: 353680 - DNA, 25 bp, Mus musculus
cctcggcttgagcaactgtcgacaa

SEQ ID NO: 353681 - DNA, 25 bp, Mus musculus
cctcggcttgaggaactgtcgacaa

SEQ ID NO: 353682 - DNA, 25 bp, Mus musculus
cctcgggagggcaggggaacattgt

SEQ ID NO: 353683 - DNA, 25 bp, Mus musculus
cctcgggagggctggggaacattgt

SEQ ID NO: 353684 - DNA, 25 bp, Mus musculus
cctcgggatcttacttgatgtctta

SEQ ID NO: 353685 - DNA, 25 bp, Mus musculus
cctcgggatctttcttgatgtctta

SEQ ID NO: 353686 - DNA, 25 bp, Mus musculus
cctcgggcactcagagcaggtgaga

SEQ ID NO: 353687 - DNA, 25 bp, Mus musculus
cctcgggcactctgagcaggtgaga

SEQ ID NO: 353688 - DNA, 25 bp, Mus musculus
cctcgggcatctcgcttggactaga

SEQ ID NO: 353689 - DNA, 25 bp, Mus musculus
cctcgggcatctggcttggactaga

SEQ ID NO: 353690 - DNA, 25 bp, Mus musculus
cctcgggctgctctcattgctgtga

SEQ ID NO: 353691 - DNA, 25 bp, Mus musculus
cctcgggctgctgtcattgctgtga

SEQ ID NO: 353692 - DNA, 25 bp, Mus musculus
cctcgggcttctattctatattaat

SEQ ID NO: 353693 - DNA, 25 bp, Mus musculus
cctcgggcttcttttctatattaat

SEQ ID NO: 353694 - DNA, 25 bp, Mus musculus
cctcgggtcataaaaacccttgaga

SEQ ID NO: 353695 - DNA, 25 bp, Mus musculus
cctcgggtcatataaacccttgaga

SEQ ID NO: 353696 - DNA, 25 bp, Mus musculus
cctcgggtgaccatatataaagtat

SEQ ID NO: 353697 - DNA, 25 bp, Mus musculus
cctcgggtgaccttatataaagtat

SEQ ID NO: 353698 - DNA, 25 bp, Mus musculus
cctcgggtgcctctgctaagttggg

SEQ ID NO: 353699 - DNA, 25 bp, Mus musculus
cctcgggtgcctgtgctaagttggg

SEQ ID NO: 353700 - DNA, 25 bp, Mus musculus
cctcggtcaggaaccctaaggattt

SEQ ID NO: 353701 - DNA, 25 bp, Mus musculus
cctcggtcaggatccctaaggattt

SEQ ID NO: 353702 - DNA, 25 bp, Mus musculus
cctcggtctaagcactcatgatttt

SEQ ID NO: 353703 - DNA, 25 bp, Mus musculus
cctcggtctaaggactcatgatttt

SEQ ID NO: 353704 - DNA, 25 bp, Mus musculus
cctcggtctgttcggaaagctggac

SEQ ID NO: 353705 - DNA, 25 bp, Mus musculus
cctcggtctgttgggaaagctggac

SEQ ID NO: 353706 - DNA, 25 bp, Mus musculus
cctcggtcttttcgttcacatcaag

SEQ ID NO: 353707 - DNA, 25 bp, Mus musculus
cctcggtcttttggttcacatcaag

SEQ ID NO: 353708 - DNA, 25 bp, Mus musculus
cctcggtgacagaatggaacagcag

SEQ ID NO: 353709 - DNA, 25 bp, Mus musculus
cctcggtgacagtatggaacagcag

SEQ ID NO: 353710 - DNA, 25 bp, Mus musculus
cctcggtgaggcacggtggctcttc

SEQ ID NO: 353711 - DNA, 25 bp, Mus musculus
cctcggtgaggctcggtggctcttc

SEQ ID NO: 353712 - DNA, 25 bp, Mus musculus
cctcggtgcttgaccagtcctgagt

SEQ ID NO: 353713 - DNA, 25 bp, Mus musculus
cctcggtgcttgtccagtcctgagt

SEQ ID NO: 353714 - DNA, 25 bp, Mus musculus
cctcgtagtagtaacctctggtatt

SEQ ID NO: 353715 - DNA, 25 bp, Mus musculus
cctcgtagtagttacctctggtatt

SEQ ID NO: 353716 - DNA, 25 bp, Mus musculus
cctcgtatagagataacaacttacg

SEQ ID NO: 353717 - DNA, 25 bp, Mus musculus
cctcgtatagagttaacaacttacg

SEQ ID NO: 353718 - DNA, 25 bp, Mus musculus
cctcgtcagagtccggagcctttaa

SEQ ID NO: 353719 - DNA, 25 bp, Mus musculus
cctcgtcagagtgcggagcctttaa

SEQ ID NO: 353720 - DNA, 25 bp, Mus musculus
cctcgtcctgacagtactgttggag

SEQ ID NO: 353721 - DNA, 25 bp, Mus musculus
cctcgtcctgactgtactgttggag

SEQ ID NO: 353722 - DNA, 25 bp, Mus musculus
cctcgtctcttcaataatgagccat

SEQ ID NO: 353723 - DNA, 25 bp, Mus musculus
cctcgtctcttctataatgagccat

SEQ ID NO: 353724 - DNA, 25 bp, Mus musculus
cctcgtctgcagacatgagaagccc

SEQ ID NO: 353725 - DNA, 25 bp, Mus musculus
cctcgtctgcagtcatgagaagccc

SEQ ID NO: 353726 - DNA, 25 bp, Mus musculus
cctcgtgagacacgcaggaagccct

SEQ ID NO: 353727 - DNA, 25 bp, Mus musculus
cctcgtgagacaggcaggaagccct

SEQ ID NO: 353728 - DNA, 25 bp, Mus musculus
cctcgtgagggtatcctgggtgtct

SEQ ID NO: 353729 - DNA, 25 bp, Mus musculus
cctcgtgagggtttcctgggtgtct

SEQ ID NO: 353730 - DNA, 25 bp, Mus musculus
cctcgtggatgactcttaactttaa

SEQ ID NO: 353731 - DNA, 25 bp, Mus musculus
cctcgtggatgagtcttaactttaa

SEQ ID NO: 353732 - DNA, 25 bp, Mus musculus
cctcgtggtttaacctggcaatgat

SEQ ID NO: 353733 - DNA, 25 bp, Mus musculus
cctcgtggtttatcctggcaatgat

SEQ ID NO: 353734 - DNA, 25 bp, Mus musculus
cctcgtgtgtgacaacaaagcttat

SEQ ID NO: 353735 - DNA, 25 bp, Mus musculus
cctcgtgtgtgagaacaaagcttat

SEQ ID NO: 353736 - DNA, 25 bp, Mus musculus
cctcgttcaatgaggcatttttata

SEQ ID NO: 353737 - DNA, 25 bp, Mus musculus
cctcgttcaatgtggcatttttata

SEQ ID NO: 353738 - DNA, 25 bp, Mus musculus
cctcgttgcttacgtgctttttcct

SEQ ID NO: 353739 - DNA, 25 bp, Mus musculus
cctcgttgcttaggtgctttttcct

SEQ ID NO: 353740 - DNA, 25 bp, Mus musculus
cctctaaagaacctcagtgcagaag

SEQ ID NO: 353741 - DNA, 25 bp, Mus musculus
cctctaaagaacgtcagtgcagaag

SEQ ID NO: 353742 - DNA, 25 bp, Mus musculus
cctctaaagcgccttttgtgacatt

SEQ ID NO: 353743 - DNA, 25 bp, Mus musculus
cctctaaagcgcgttttgtgacatt

SEQ ID NO: 353744 - DNA, 25 bp, Mus musculus
cctctaactgcacccgggaatggac

SEQ ID NO: 353745 - DNA, 25 bp, Mus musculus
cctctaactgcagccgggaatggac

SEQ ID NO: 353746 - DNA, 25 bp, Mus musculus
cctctaacttcccaagaacacttgg

SEQ ID NO: 353747 - DNA, 25 bp, Mus musculus
cctctaacttccgaagaacacttgg

SEQ ID NO: 353748 - DNA, 25 bp, Mus musculus
cctctaaggatcaccagttctgaga

SEQ ID NO: 353749 - DNA, 25 bp, Mus musculus
cctctaaggatctccagttctgaga

SEQ ID NO: 353750 - DNA, 25 bp, Mus musculus
cctctaagtctgacttacctgtacc

SEQ ID NO: 353751 - DNA, 25 bp, Mus musculus
cctctaagtctgtcttacctgtacc

SEQ ID NO: 353752 - DNA, 25 bp, Mus musculus
cctctaatcctacctgatctttaac

SEQ ID NO: 353753 - DNA, 25 bp, Mus musculus
cctctaatcctagctgatctttaac

SEQ ID NO: 353754 - DNA, 25 bp, Mus musculus
cctctacagcaacctcactgtggat

SEQ ID NO: 353755 - DNA, 25 bp, Mus musculus
cctctacagcaagctcactgtggat

SEQ ID NO: 353756 - DNA, 25 bp, Mus musculus
cctctacattcactggcagacatcc

SEQ ID NO: 353757 - DNA, 25 bp, Mus musculus
cctctacattcagtggcagacatcc

SEQ ID NO: 353758 - DNA, 25 bp, Mus musculus
cctctaccctgactcaattctagtg

SEQ ID NO: 353759 - DNA, 25 bp, Mus musculus
cctctaccctgagtcaattctagtg

SEQ ID NO: 353760 - DNA, 25 bp, Mus musculus
cctctacctagtatgtttcttctga

SEQ ID NO: 353761 - DNA, 25 bp, Mus musculus
cctctacctagtttgtttcttctga

SEQ ID NO: 353762 - DNA, 25 bp, Mus musculus
cctctacctcccattagtactaaat

SEQ ID NO: 353763 - DNA, 25 bp, Mus musculus
cctctacctccctttagtactaaat

SEQ ID NO: 353764 - DNA, 25 bp, Mus musculus
cctctacctggcagaattttagtaa

SEQ ID NO: 353765 - DNA, 25 bp, Mus musculus
cctctacctggctgaattttagtaa

SEQ ID NO: 353766 - DNA, 25 bp, Mus musculus
cctctacgcttgagattcctgtggg

SEQ ID NO: 353767 - DNA, 25 bp, Mus musculus
cctctacgcttgtgattcctgtggg

SEQ ID NO: 353768 - DNA, 25 bp, Mus musculus
cctctacgggttcggcggctaagct

SEQ ID NO: 353769 - DNA, 25 bp, Mus musculus
cctctacgggttgggcggctaagct

SEQ ID NO: 353770 - DNA, 25 bp, Mus musculus
cctctactcatacaaatcgcagcat

SEQ ID NO: 353771 - DNA, 25 bp, Mus musculus
cctctactcatagaaatcgcagcat

SEQ ID NO: 353772 - DNA, 25 bp, Mus musculus
cctctactctctctacttgttaaat

SEQ ID NO: 353773 - DNA, 25 bp, Mus musculus
cctctactctctgtacttgttaaat

SEQ ID NO: 353774 - DNA, 25 bp, Mus musculus
cctctactctgcatcataggttggt

SEQ ID NO: 353775 - DNA, 25 bp, Mus musculus
cctctactctgcttcataggttggt

SEQ ID NO: 353776 - DNA, 25 bp, Mus musculus
cctctacttatccaatctgctgtga

SEQ ID NO: 353777 - DNA, 25 bp, Mus musculus
cctctacttatcgaatctgctgtga

SEQ ID NO: 353778 - DNA, 25 bp, Mus musculus
cctctactttttccttcaagctatt

SEQ ID NO: 353779 - DNA, 25 bp, Mus musculus
cctctactttttgcttcaagctatt

SEQ ID NO: 353780 - DNA, 25 bp, Mus musculus
cctctagagagaagtgtgtgcgtgt

SEQ ID NO: 353781 - DNA, 25 bp, Mus musculus
cctctagagagatgtgtgtgcgtgt

SEQ ID NO: 353782 - DNA, 25 bp, Mus musculus
cctctagcccgtcaatctgaaatag

SEQ ID NO: 353783 - DNA, 25 bp, Mus musculus
cctctagcccgtgaatctgaaatag

SEQ ID NO: 353784 - DNA, 25 bp, Mus musculus
cctctaggctggctatgatgtattc

SEQ ID NO: 353785 - DNA, 25 bp, Mus musculus
cctctaggctgggtatgatgtattc

SEQ ID NO: 353786 - DNA, 25 bp, Mus musculus
cctctagtctttcgtctgcattcaa

SEQ ID NO: 353787 - DNA, 25 bp, Mus musculus
cctctagtctttggtctgcattcaa

SEQ ID NO: 353788 - DNA, 25 bp, Mus musculus
cctctagttgcacgtagttacctac

SEQ ID NO: 353789 - DNA, 25 bp, Mus musculus
cctctagttgcaggtagttacctac

SEQ ID NO: 353790 - DNA, 25 bp, Mus musculus
cctctagttggaactgtgtgacaag

SEQ ID NO: 353791 - DNA, 25 bp, Mus musculus
cctctagttggatctgtgtgacaag

SEQ ID NO: 353792 - DNA, 25 bp, Mus musculus
cctctataaaacaggctggcctcaa

SEQ ID NO: 353793 - DNA, 25 bp, Mus musculus
cctctataaaactggctggcctcaa

SEQ ID NO: 353794 - DNA, 25 bp, Mus musculus
cctctatcgggcagtgctgagcaag

SEQ ID NO: 353795 - DNA, 25 bp, Mus musculus
cctctatcgggctgtgctgagcaag

SEQ ID NO: 353796 - DNA, 25 bp, Mus musculus
cctctatgactcactacctttttaa

SEQ ID NO: 353797 - DNA, 25 bp, Mus musculus
cctctatgactctctacctttttaa

SEQ ID NO: 353798 - DNA, 25 bp, Mus musculus
cctctatgcactatggctgtttctg

SEQ ID NO: 353799 - DNA, 25 bp, Mus musculus
cctctatgcactttggctgtttctg

SEQ ID NO: 353800 - DNA, 25 bp, Mus musculus
cctctatgccagatctagactttca

SEQ ID NO: 353801 - DNA, 25 bp, Mus musculus
cctctatgccagttctagactttca

SEQ ID NO: 353802 - DNA, 25 bp, Mus musculus
cctctatgtcgaaatttggatctag

SEQ ID NO: 353803 - DNA, 25 bp, Mus musculus
cctctatgtcgatatttggatctag

SEQ ID NO: 353804 - DNA, 25 bp, Mus musculus
cctctattacccacaaggtgaatat

SEQ ID NO: 353805 - DNA, 25 bp, Mus musculus
cctctattaccctcaaggtgaatat

SEQ ID NO: 353806 - DNA, 25 bp, Mus musculus
cctctattcaggaccccttcctgaa

SEQ ID NO: 353807 - DNA, 25 bp, Mus musculus
cctctattcaggtccccttcctgaa

SEQ ID NO: 353808 - DNA, 25 bp, Mus musculus
cctctattcttccatcagtgtaaca

SEQ ID NO: 353809 - DNA, 25 bp, Mus musculus
cctctattcttcgatcagtgtaaca

SEQ ID NO: 353810 - DNA, 25 bp, Mus musculus
cctctcaaactcattgcagcagata

SEQ ID NO: 353811 - DNA, 25 bp, Mus musculus
cctctcaaactctttgcagcagata

SEQ ID NO: 353812 - DNA, 25 bp, Mus musculus
cctctcaacttcatacatggtggcc

SEQ ID NO: 353813 - DNA, 25 bp, Mus musculus
cctctcaacttcttacatggtggcc

SEQ ID NO: 353814 - DNA, 25 bp, Mus musculus
cctctcaagaagaggcagcttgatg

SEQ ID NO: 353815 - DNA, 25 bp, Mus musculus
cctctcaagaagtggcagcttgatg

SEQ ID NO: 353816 - DNA, 25 bp, Mus musculus
cctctcaagggaagcatagcgaagt

SEQ ID NO: 353817 - DNA, 25 bp, Mus musculus
cctctcaagggatgcatagcgaagt

SEQ ID NO: 353818 - DNA, 25 bp, Mus musculus
cctctcaatgggagtgtacacacca

SEQ ID NO: 353819 - DNA, 25 bp, Mus musculus
cctctcaatgggtgtgtacacacca

SEQ ID NO: 353820 - DNA, 25 bp, Mus musculus
cctctcaccactaacaagggactga

SEQ ID NO: 353821 - DNA, 25 bp, Mus musculus
cctctcaccacttacaagggactga

SEQ ID NO: 353822 - DNA, 25 bp, Mus musculus
cctctcacccatatatttaaattaa

SEQ ID NO: 353823 - DNA, 25 bp, Mus musculus
cctctcacccatttatttaaattaa

SEQ ID NO: 353824 - DNA, 25 bp, Mus musculus
cctctcactaatcgcaagatgtcag

SEQ ID NO: 353825 - DNA, 25 bp, Mus musculus
cctctcactaatggcaagatgtcag

SEQ ID NO: 353826 - DNA, 25 bp, Mus musculus
cctctcactgtcagcatatcagttg

SEQ ID NO: 353827 - DNA, 25 bp, Mus musculus
cctctcactgtctgcatatcagttg

SEQ ID NO: 353828 - DNA, 25 bp, Mus musculus
cctctcagccttatggcacaattta

SEQ ID NO: 353829 - DNA, 25 bp, Mus musculus
cctctcagccttttggcacaattta

SEQ ID NO: 353830 - DNA, 25 bp, Mus musculus
cctctcaggacacttagcacgctaa

SEQ ID NO: 353831 - DNA, 25 bp, Mus musculus
cctctcaggacagttagcacgctaa

SEQ ID NO: 353832 - DNA, 25 bp, Mus musculus
cctctcaggagaccagcagtgcggt

SEQ ID NO: 353833 - DNA, 25 bp, Mus musculus
cctctcaggagagcagcagtgcggt

SEQ ID NO: 353834 - DNA, 25 bp, Mus musculus
cctctcagggtcaagagttgcagct

SEQ ID NO: 353835 - DNA, 25 bp, Mus musculus
cctctcagggtctagagttgcagct

SEQ ID NO: 353836 - DNA, 25 bp, Mus musculus
cctctcagtacaagctgggtcttgg

SEQ ID NO: 353837 - DNA, 25 bp, Mus musculus
cctctcagtacatgctgggtcttgg

SEQ ID NO: 353838 - DNA, 25 bp, Mus musculus
cctctcataactcgtcaacgactgt

SEQ ID NO: 353839 - DNA, 25 bp, Mus musculus
cctctcataactggtcaacgactgt

SEQ ID NO: 353840 - DNA, 25 bp, Mus musculus
cctctcatatttcatgccacatggg

SEQ ID NO: 353841 - DNA, 25 bp, Mus musculus
cctctcatatttgatgccacatggg

SEQ ID NO: 353842 - DNA, 25 bp, Mus musculus
cctctcatccagctcagattgtcaa

SEQ ID NO: 353843 - DNA, 25 bp, Mus musculus
cctctcatccaggtcagattgtcaa

SEQ ID NO: 353844 - DNA, 25 bp, Mus musculus
cctctcatgtggagttagtgacgga

SEQ ID NO: 353845 - DNA, 25 bp, Mus musculus
cctctcatgtggtgttagtgacgga

SEQ ID NO: 353846 - DNA, 25 bp, Mus musculus
cctctcattgcgacattatctgtga

SEQ ID NO: 353847 - DNA, 25 bp, Mus musculus
cctctcattgcgtcattatctgtga

SEQ ID NO: 353848 - DNA, 25 bp, Mus musculus
cctctccacacacctttttatataa

SEQ ID NO: 353849 - DNA, 25 bp, Mus musculus
cctctccacacagctttttatataa

SEQ ID NO: 353850 - DNA, 25 bp, Mus musculus
cctctccaccttatagcattttagg

SEQ ID NO: 353851 - DNA, 25 bp, Mus musculus
cctctccaccttttagcattttagg

SEQ ID NO: 353852 - DNA, 25 bp, Mus musculus
cctctccacttaccagacttggaat

SEQ ID NO: 353853 - DNA, 25 bp, Mus musculus
cctctccacttagcagacttggaat

SEQ ID NO: 353854 - DNA, 25 bp, Mus musculus
cctctccagaggaggctattacgtt

SEQ ID NO: 353855 - DNA, 25 bp, Mus musculus
cctctccagaggtggctattacgtt

SEQ ID NO: 353856 - DNA, 25 bp, Mus musculus
cctctccagcatcagatagaaggct

SEQ ID NO: 353857 - DNA, 25 bp, Mus musculus
cctctccagcatgagatagaaggct

SEQ ID NO: 353858 - DNA, 25 bp, Mus musculus
cctctccatttcattacattttgaa

SEQ ID NO: 353859 - DNA, 25 bp, Mus musculus
cctctccatttctttacattttgaa

SEQ ID NO: 353860 - DNA, 25 bp, Mus musculus
cctctccctacgctaaatgtcattt

SEQ ID NO: 353861 - DNA, 25 bp, Mus musculus
cctctccctacggtaaatgtcattt

SEQ ID NO: 353862 - DNA, 25 bp, Mus musculus
cctctccctgctcgttaaagtttag

SEQ ID NO: 353863 - DNA, 25 bp, Mus musculus
cctctccctgctggttaaagtttag

SEQ ID NO: 353864 - DNA, 25 bp, Mus musculus
cctctccctggaatctgagtttaga

SEQ ID NO: 353865 - DNA, 25 bp, Mus musculus
cctctccctggattctgagtttaga

SEQ ID NO: 353866 - DNA, 25 bp, Mus musculus
cctctcctactcatctgttgatgac

SEQ ID NO: 353867 - DNA, 25 bp, Mus musculus
cctctcctactcttctgttgatgac

SEQ ID NO: 353868 - DNA, 25 bp, Mus musculus
cctctcctcgatatgttgtgatcga

SEQ ID NO: 353869 - DNA, 25 bp, Mus musculus
cctctcctcgatttgttgtgatcga

SEQ ID NO: 353870 - DNA, 25 bp, Mus musculus
cctctcctcttgacttgtattttac

SEQ ID NO: 353871 - DNA, 25 bp, Mus musculus
cctctcctcttgtcttgtattttac

SEQ ID NO: 353872 - DNA, 25 bp, Mus musculus
cctctcctctttacatcttattgtt

SEQ ID NO: 353873 - DNA, 25 bp, Mus musculus
cctctcctcttttcatcttattgtt

SEQ ID NO: 353874 - DNA, 25 bp, Mus musculus
cctctcctgagacggcagttacagc

SEQ ID NO: 353875 - DNA, 25 bp, Mus musculus
cctctcctgagagggcagttacagc

SEQ ID NO: 353876 - DNA, 25 bp, Mus musculus
cctctcctgctgatctctaaattag

SEQ ID NO: 353877 - DNA, 25 bp, Mus musculus
cctctcctgctgttctctaaattag

SEQ ID NO: 353878 - DNA, 25 bp, Mus musculus
cctctcctgggcagttctgagatgt

SEQ ID NO: 353879 - DNA, 25 bp, Mus musculus
cctctcctgggctgttctgagatgt

SEQ ID NO: 353880 - DNA, 25 bp, Mus musculus
cctctccttcctcgcagagataaaa

SEQ ID NO: 353881 - DNA, 25 bp, Mus musculus
cctctccttcctggcagagataaaa

SEQ ID NO: 353882 - DNA, 25 bp, Mus musculus
cctctccttctacctatggagtgtt

SEQ ID NO: 353883 - DNA, 25 bp, Mus musculus
cctctccttctagctatggagtgtt

SEQ ID NO: 353884 - DNA, 25 bp, Mus musculus
cctctccttcttataagatgcacca

SEQ ID NO: 353885 - DNA, 25 bp, Mus musculus
cctctccttcttttaagatgcacca

SEQ ID NO: 353886 - DNA, 25 bp, Mus musculus
cctctcgagcttcatcctgttttga

SEQ ID NO: 353887 - DNA, 25 bp, Mus musculus
cctctcgagcttgatcctgttttga

SEQ ID NO: 353888 - DNA, 25 bp, Mus musculus
cctctcgcttcactcatcaatggag

SEQ ID NO: 353889 - DNA, 25 bp, Mus musculus
cctctcgcttcagtcatcaatggag

SEQ ID NO: 353890 - DNA, 25 bp, Mus musculus
cctctcggccagatcttgcaaaaaa

SEQ ID NO: 353891 - DNA, 25 bp, Mus musculus
cctctcggccagatgtgatgtttat

SEQ ID NO: 353892 - DNA, 25 bp, Mus musculus
cctctcggccagttcttgcaaaaaa

SEQ ID NO: 353893 - DNA, 25 bp, Mus musculus
cctctcggccagttgtgatgtttat

SEQ ID NO: 353894 - DNA, 25 bp, Mus musculus
cctctcgggcttactgggcaggaga

SEQ ID NO: 353895 - DNA, 25 bp, Mus musculus
cctctcgggctttctgggcaggaga

SEQ ID NO: 353896 - DNA, 25 bp, Mus musculus
cctctcgggtgaaggcacacgttag

SEQ ID NO: 353897 - DNA, 25 bp, Mus musculus
cctctcgggtgatggcacacgttag

SEQ ID NO: 353898 - DNA, 25 bp, Mus musculus
cctctcgttggtccttccagtgaca

SEQ ID NO: 353899 - DNA, 25 bp, Mus musculus
cctctcgttggtgcttccagtgaca

SEQ ID NO: 353900 - DNA, 25 bp, Mus musculus
cctctctaacctcagtattcactta

SEQ ID NO: 353901 - DNA, 25 bp, Mus musculus
cctctctaacctgagtattcactta

SEQ ID NO: 353902 - DNA, 25 bp, Mus musculus
cctctctacctactgatattgctga

SEQ ID NO: 353903 - DNA, 25 bp, Mus musculus
cctctctacctagtgatattgctga

SEQ ID NO: 353904 - DNA, 25 bp, Mus musculus
cctctctacttcaccagataacttt

SEQ ID NO: 353905 - DNA, 25 bp, Mus musculus
cctctctacttctccagataacttt

SEQ ID NO: 353906 - DNA, 25 bp, Mus musculus
cctctctagggtctttatggtcttt

SEQ ID NO: 353907 - DNA, 25 bp, Mus musculus
cctctctagggtgtttatggtcttt

SEQ ID NO: 353908 - DNA, 25 bp, Mus musculus
cctctctagtctcatcaaagccaaa

SEQ ID NO: 353909 - DNA, 25 bp, Mus musculus
cctctctagtctgatcaaagccaaa

SEQ ID NO: 353910 - DNA, 25 bp, Mus musculus
cctctctatgccattatttcattca

SEQ ID NO: 353911 - DNA, 25 bp, Mus musculus
cctctctatgcctttatttcattca

SEQ ID NO: 353912 - DNA, 25 bp, Mus musculus
cctctctcaagaagctagtatctat

SEQ ID NO: 353913 - DNA, 25 bp, Mus musculus
cctctctcaagatgctagtatctat

SEQ ID NO: 353914 - DNA, 25 bp, Mus musculus
cctctctcaggtacttaattctttc

SEQ ID NO: 353915 - DNA, 25 bp, Mus musculus
cctctctcaggttcttaattctttc

SEQ ID NO: 353916 - DNA, 25 bp, Mus musculus
cctctctcagtaactgaacctttca

SEQ ID NO: 353917 - DNA, 25 bp, Mus musculus
cctctctcagtatctgaacctttca

SEQ ID NO: 353918 - DNA, 25 bp, Mus musculus
cctctctcattcagtgatgggtata

SEQ ID NO: 353919 - DNA, 25 bp, Mus musculus
cctctctcattctgtgatgggtata

SEQ ID NO: 353920 - DNA, 25 bp, Mus musculus
cctctctccccaagttttagataaa

SEQ ID NO: 353921 - DNA, 25 bp, Mus musculus
cctctctccccatgttttagataaa

SEQ ID NO: 353922 - DNA, 25 bp, Mus musculus
cctctctcctcgagctaagctggat

SEQ ID NO: 353923 - DNA, 25 bp, Mus musculus
cctctctcctcgtgctaagctggat

SEQ ID NO: 353924 - DNA, 25 bp, Mus musculus
cctctctctaaaactgaactgccag

SEQ ID NO: 353925 - DNA, 25 bp, Mus musculus
cctctctctaaatctgaactgccag

SEQ ID NO: 353926 - DNA, 25 bp, Mus musculus
cctctctctagccatgggatttgat

SEQ ID NO: 353927 - DNA, 25 bp, Mus musculus
cctctctctagcgatgggatttgat

SEQ ID NO: 353928 - DNA, 25 bp, Mus musculus
cctctctctcatacaatcagttaac

SEQ ID NO: 353929 - DNA, 25 bp, Mus musculus
cctctctctcattcaatcagttaac

SEQ ID NO: 353930 - DNA, 25 bp, Mus musculus
cctctctctctcagatagatatggc

SEQ ID NO: 353931 - DNA, 25 bp, Mus musculus
cctctctctctctgatagatatggc

SEQ ID NO: 353932 - DNA, 25 bp, Mus musculus
cctctctctcttaccgagagaagtt

SEQ ID NO: 353933 - DNA, 25 bp, Mus musculus
cctctctctctttccgagagaagtt

SEQ ID NO: 353934 - DNA, 25 bp, Mus musculus
cctctctctgttatagtactctgtt

SEQ ID NO: 353935 - DNA, 25 bp, Mus musculus
cctctctctgttttagtactctgtt

SEQ ID NO: 353936 - DNA, 25 bp, Mus musculus
cctctctcttggacaggtgggcaga

SEQ ID NO: 353937 - DNA, 25 bp, Mus musculus
cctctctcttggtcaggtgggcaga

SEQ ID NO: 353938 - DNA, 25 bp, Mus musculus
cctctctgaatgacgcactgtattg

SEQ ID NO: 353939 - DNA, 25 bp, Mus musculus
cctctctgaatgtcgcactgtattg

SEQ ID NO: 353940 - DNA, 25 bp, Mus musculus
cctctctgagagcttcttggagcag

SEQ ID NO: 353941 - DNA, 25 bp, Mus musculus
cctctctgagaggttcttggagcag

SEQ ID NO: 353942 - DNA, 25 bp, Mus musculus
cctctctgagggaaggatcaactac

SEQ ID NO: 353943 - DNA, 25 bp, Mus musculus
cctctctgagggtaggatcaactac

SEQ ID NO: 353944 - DNA, 25 bp, Mus musculus
cctctctgatacctaaaatatttgt

SEQ ID NO: 353945 - DNA, 25 bp, Mus musculus
cctctctgatacgtaaaatatttgt

SEQ ID NO: 353946 - DNA, 25 bp, Mus musculus
cctctctgcaggatgtagttgtgta

SEQ ID NO: 353947 - DNA, 25 bp, Mus musculus
cctctctgcaggttgtagttgtgta

SEQ ID NO: 353948 - DNA, 25 bp, Mus musculus
cctctctgcgtacgtgtcctatggg

SEQ ID NO: 353949 - DNA, 25 bp, Mus musculus
cctctctgcgtaggtgtcctatggg

SEQ ID NO: 353950 - DNA, 25 bp, Mus musculus
cctctctgggaaaatccaacataat

SEQ ID NO: 353951 - DNA, 25 bp, Mus musculus
cctctctgggaatatccaacataat

SEQ ID NO: 353952 - DNA, 25 bp, Mus musculus
cctctctggtgacatttggaatatt

SEQ ID NO: 353953 - DNA, 25 bp, Mus musculus
cctctctggtgagatttggaatatt

SEQ ID NO: 353954 - DNA, 25 bp, Mus musculus
cctctctgtcatcacaaatgcacat

SEQ ID NO: 353955 - DNA, 25 bp, Mus musculus
cctctctgtcatgacaaatgcacat

SEQ ID NO: 353956 - DNA, 25 bp, Mus musculus
cctctctgtctgcattttgcggata

SEQ ID NO: 353957 - DNA, 25 bp, Mus musculus
cctctctgtctggattttgcggata

SEQ ID NO: 353958 - DNA, 25 bp, Mus musculus
cctctctgtgacaatgggctaaaac

SEQ ID NO: 353959 - DNA, 25 bp, Mus musculus
cctctctgtgactatgggctaaaac

SEQ ID NO: 353960 - DNA, 25 bp, Mus musculus
cctctctgtttcaccagtgctaaga

SEQ ID NO: 353961 - DNA, 25 bp, Mus musculus
cctctctgtttctccagtgctaaga

SEQ ID NO: 353962 - DNA, 25 bp, Mus musculus
cctctcttatcacgccagcaaggat

SEQ ID NO: 353963 - DNA, 25 bp, Mus musculus
cctctcttatcaggccagcaaggat

SEQ ID NO: 353964 - DNA, 25 bp, Mus musculus
cctctcttattcacaataccttttg

SEQ ID NO: 353965 - DNA, 25 bp, Mus musculus
cctctcttattctcaataccttttg

SEQ ID NO: 353966 - DNA, 25 bp, Mus musculus
cctctcttcaatattacaggctaag

SEQ ID NO: 353967 - DNA, 25 bp, Mus musculus
cctctcttcaattttacaggctaag

SEQ ID NO: 353968 - DNA, 25 bp, Mus musculus
cctctcttctcaccatatattcttg

SEQ ID NO: 353969 - DNA, 25 bp, Mus musculus
cctctcttctcagcatatattcttg

SEQ ID NO: 353970 - DNA, 25 bp, Mus musculus
cctctcttcttcaggagactttata

SEQ ID NO: 353971 - DNA, 25 bp, Mus musculus
cctctcttcttctggagactttata

SEQ ID NO: 353972 - DNA, 25 bp, Mus musculus
cctctcttgctgagaactggtgtca

SEQ ID NO: 353973 - DNA, 25 bp, Mus musculus
cctctcttgctgcatgtgctcagaa

SEQ ID NO: 353974 - DNA, 25 bp, Mus musculus
cctctcttgctggatgtgctcagaa

SEQ ID NO: 353975 - DNA, 25 bp, Mus musculus
cctctcttgctgtgaactggtgtca

SEQ ID NO: 353976 - DNA, 25 bp, Mus musculus
cctctgaaacataactaagcctaga

SEQ ID NO: 353977 - DNA, 25 bp, Mus musculus
cctctgaaacattactaagcctaga

SEQ ID NO: 353978 - DNA, 25 bp, Mus musculus
cctctgaacattatggcatccacat

SEQ ID NO: 353979 - DNA, 25 bp, Mus musculus
cctctgaacattttggcatccacat

SEQ ID NO: 353980 - DNA, 25 bp, Mus musculus
cctctgaactggaatcggttattca

SEQ ID NO: 353981 - DNA, 25 bp, Mus musculus
cctctgaactggtatcggttattca

SEQ ID NO: 353982 - DNA, 25 bp, Mus musculus
cctctgaagcacataggagctactg

SEQ ID NO: 353983 - DNA, 25 bp, Mus musculus
cctctgaagcacttaggagctactg

SEQ ID NO: 353984 - DNA, 25 bp, Mus musculus
cctctgaagcagccactctgtccct

SEQ ID NO: 353985 - DNA, 25 bp, Mus musculus
cctctgaagcagcttagcattgaag

SEQ ID NO: 353986 - DNA, 25 bp, Mus musculus
cctctgaagcaggcactctgtccct

SEQ ID NO: 353987 - DNA, 25 bp, Mus musculus
cctctgaagcaggttagcattgaag

SEQ ID NO: 353988 - DNA, 25 bp, Mus musculus
cctctgaagctgatgtggcgttgga

SEQ ID NO: 353989 - DNA, 25 bp, Mus musculus
cctctgaagctgttgtggcgttgga

SEQ ID NO: 353990 - DNA, 25 bp, Mus musculus
cctctgaaggttacctggttggagg

SEQ ID NO: 353991 - DNA, 25 bp, Mus musculus
cctctgaaggtttcctggttggagg

SEQ ID NO: 353992 - DNA, 25 bp, Mus musculus
cctctgaagtcaacctattttagct

SEQ ID NO: 353993 - DNA, 25 bp, Mus musculus
cctctgaagtcatcctattttagct

SEQ ID NO: 353994 - DNA, 25 bp, Mus musculus
cctctgaatcccaaagtgcagcatt

SEQ ID NO: 353995 - DNA, 25 bp, Mus musculus
cctctgaatccctaagtgcagcatt

SEQ ID NO: 353996 - DNA, 25 bp, Mus musculus
cctctgacactgaaggtgggcttca

SEQ ID NO: 353997 - DNA, 25 bp, Mus musculus
cctctgacactgtaggtgggcttca

SEQ ID NO: 353998 - DNA, 25 bp, Mus musculus
cctctgacatgcacttataagcaat

SEQ ID NO: 353999 - DNA, 25 bp, Mus musculus
cctctgacatgctcttataagcaat

SEQ ID NO: 354000 - DNA, 25 bp, Mus musculus
cctctgacccagcaacagctcatcc

SEQ ID NO: 354001 - DNA, 25 bp, Mus musculus
cctctgacccagcattgagttttaa

SEQ ID NO: 354002 - DNA, 25 bp, Mus musculus
cctctgacccaggaacagctcatcc

SEQ ID NO: 354003 - DNA, 25 bp, Mus musculus
cctctgacccaggattgagttttaa

SEQ ID NO: 354004 - DNA, 25 bp, Mus musculus
cctctgaccgatccttgtgaattgt

SEQ ID NO: 354005 - DNA, 25 bp, Mus musculus
cctctgaccgatgcttgtgaattgt

SEQ ID NO: 354006 - DNA, 25 bp, Mus musculus
cctctgacctctatgggaaggagat

SEQ ID NO: 354007 - DNA, 25 bp, Mus musculus
cctctgacctctttgggaaggagat

SEQ ID NO: 354008 - DNA, 25 bp, Mus musculus
cctctgacgtaaatcaggcgtgatt

SEQ ID NO: 354009 - DNA, 25 bp, Mus musculus
cctctgacgtaattcaggcgtgatt

SEQ ID NO: 354010 - DNA, 25 bp, Mus musculus
cctctgactttcactttattggtaa

SEQ ID NO: 354011 - DNA, 25 bp, Mus musculus
cctctgactttctctttattggtaa

SEQ ID NO: 354012 - DNA, 25 bp, Mus musculus
cctctgagacttactacaccttggg

SEQ ID NO: 354013 - DNA, 25 bp, Mus musculus
cctctgagactttctacaccttggg

SEQ ID NO: 354014 - DNA, 25 bp, Mus musculus
cctctgagagacctgctggaaatca

SEQ ID NO: 354015 - DNA, 25 bp, Mus musculus
cctctgagagacgtgctggaaatca

SEQ ID NO: 354016 - DNA, 25 bp, Mus musculus
cctctgagctagagaatgaatgtac

SEQ ID NO: 354017 - DNA, 25 bp, Mus musculus
cctctgagctagtgaatgaatgtac

SEQ ID NO: 354018 - DNA, 25 bp, Mus musculus
cctctgaggcgaaggaccaggtgca

SEQ ID NO: 354019 - DNA, 25 bp, Mus musculus
cctctgaggcgatggaccaggtgca

SEQ ID NO: 354020 - DNA, 25 bp, Mus musculus
cctctgagtgtcatcatgtatagaa

SEQ ID NO: 354021 - DNA, 25 bp, Mus musculus
cctctgagtgtcttcatgtatagaa

SEQ ID NO: 354022 - DNA, 25 bp, Mus musculus
cctctgagttttcccatatccaaga

SEQ ID NO: 354023 - DNA, 25 bp, Mus musculus
cctctgagttttgccatatccaaga

SEQ ID NO: 354024 - DNA, 25 bp, Mus musculus
cctctgatacatccggctggagcca

SEQ ID NO: 354025 - DNA, 25 bp, Mus musculus
cctctgatacatgcggctggagcca

SEQ ID NO: 354026 - DNA, 25 bp, Mus musculus
cctctgatctctagcaacatgtttt

SEQ ID NO: 354027 - DNA, 25 bp, Mus musculus
cctctgatctcttgcaacatgtttt

SEQ ID NO: 354028 - DNA, 25 bp, Mus musculus
cctctgatgctgcattttaattaga

SEQ ID NO: 354029 - DNA, 25 bp, Mus musculus
cctctgatgctggattttaattaga

SEQ ID NO: 354030 - DNA, 25 bp, Mus musculus
cctctgatggatatcctgtgaacct

SEQ ID NO: 354031 - DNA, 25 bp, Mus musculus
cctctgatggatttcctgtgaacct

SEQ ID NO: 354032 - DNA, 25 bp, Mus musculus
cctctgatggtgatagcaatttgaa

SEQ ID NO: 354033 - DNA, 25 bp, Mus musculus
cctctgatggtgttagcaatttgaa

SEQ ID NO: 354034 - DNA, 25 bp, Mus musculus
cctctgatggttacgtgctagtgca

SEQ ID NO: 354035 - DNA, 25 bp, Mus musculus
cctctgatggtttcgtgctagtgca

SEQ ID NO: 354036 - DNA, 25 bp, Mus musculus
cctctgatgtgcctagcatggaaaa

SEQ ID NO: 354037 - DNA, 25 bp, Mus musculus
cctctgatgtgcgtagcatggaaaa

SEQ ID NO: 354038 - DNA, 25 bp, Mus musculus
cctctgattgtgattgctatgctgg

SEQ ID NO: 354039 - DNA, 25 bp, Mus musculus
cctctgattgtgtttgctatgctgg

SEQ ID NO: 354040 - DNA, 25 bp, Mus musculus
cctctgcaacagaagttagcggcta

SEQ ID NO: 354041 - DNA, 25 bp, Mus musculus
cctctgcaacagtagttagcggcta

SEQ ID NO: 354042 - DNA, 25 bp, Mus musculus
cctctgcaagaaaagcttagtgctc

SEQ ID NO: 354043 - DNA, 25 bp, Mus musculus
cctctgcaagaatagcttagtgctc

SEQ ID NO: 354044 - DNA, 25 bp, Mus musculus
cctctgcaatttcactttgggtcag

SEQ ID NO: 354045 - DNA, 25 bp, Mus musculus
cctctgcaatttgactttgggtcag

SEQ ID NO: 354046 - DNA, 25 bp, Mus musculus
cctctgcacattaacccatacatag

SEQ ID NO: 354047 - DNA, 25 bp, Mus musculus
cctctgcacatttacccatacatag

SEQ ID NO: 354048 - DNA, 25 bp, Mus musculus
cctctgcactctacatggcgaagaa

SEQ ID NO: 354049 - DNA, 25 bp, Mus musculus
cctctgcactcttcatggcgaagaa

SEQ ID NO: 354050 - DNA, 25 bp, Mus musculus
cctctgcactggatagatttgtacg

SEQ ID NO: 354051 - DNA, 25 bp, Mus musculus
cctctgcactggttagatttgtacg

SEQ ID NO: 354052 - DNA, 25 bp, Mus musculus
cctctgcacttgaacttatcatctt

SEQ ID NO: 354053 - DNA, 25 bp, Mus musculus
cctctgcacttgtacttatcatctt

SEQ ID NO: 354054 - DNA, 25 bp, Mus musculus
cctctgcagcatcttttggttagtt

SEQ ID NO: 354055 - DNA, 25 bp, Mus musculus
cctctgcagcatgttttggttagtt

SEQ ID NO: 354056 - DNA, 25 bp, Mus musculus
cctctgcagccaaggaggctaagga

SEQ ID NO: 354057 - DNA, 25 bp, Mus musculus
cctctgcagccatggaggctaagga

SEQ ID NO: 354058 - DNA, 25 bp, Mus musculus
cctctgcagtgtcgtgcatccaaaa

SEQ ID NO: 354059 - DNA, 25 bp, Mus musculus
cctctgcagtgtggtgcatccaaaa

SEQ ID NO: 354060 - DNA, 25 bp, Mus musculus
cctctgcatatcagccacttaagag

SEQ ID NO: 354061 - DNA, 25 bp, Mus musculus
cctctgcatatctgccacttaagag

SEQ ID NO: 354062 - DNA, 25 bp, Mus musculus
cctctgccaatgagctgggaagact

SEQ ID NO: 354063 - DNA, 25 bp, Mus musculus
cctctgccaatgtgctgggaagact

SEQ ID NO: 354064 - DNA, 25 bp, Mus musculus
cctctgccactactggcggtgatgg

SEQ ID NO: 354065 - DNA, 25 bp, Mus musculus
cctctgccactagtggcggtgatgg

SEQ ID NO: 354066 - DNA, 25 bp, Mus musculus
cctctgcccagaagacctgtatata

SEQ ID NO: 354067 - DNA, 25 bp, Mus musculus
cctctgcccagatgacctgtatata

SEQ ID NO: 354068 - DNA, 25 bp, Mus musculus
cctctgccccaaagtttcttctgat

SEQ ID NO: 354069 - DNA, 25 bp, Mus musculus
cctctgccccaatgtttcttctgat

SEQ ID NO: 354070 - DNA, 25 bp, Mus musculus
cctctgccccacatagtttgagaag

SEQ ID NO: 354071 - DNA, 25 bp, Mus musculus
cctctgccccacttagtttgagaag

SEQ ID NO: 354072 - DNA, 25 bp, Mus musculus
cctctgcccctgagtgttgagaaga

SEQ ID NO: 354073 - DNA, 25 bp, Mus musculus
cctctgcccctgtgtgttgagaaga

SEQ ID NO: 354074 - DNA, 25 bp, Mus musculus
cctctgccctgactttaaagacagc

SEQ ID NO: 354075 - DNA, 25 bp, Mus musculus
cctctgccctgagtttaaagacagc

SEQ ID NO: 354076 - DNA, 25 bp, Mus musculus
cctctgcctgatcacattatgtagc

SEQ ID NO: 354077 - DNA, 25 bp, Mus musculus
cctctgcctgatgacattatgtagc

SEQ ID NO: 354078 - DNA, 25 bp, Mus musculus
cctctgcctgtcagaaggaggccaa

SEQ ID NO: 354079 - DNA, 25 bp, Mus musculus
cctctgcctgtctgaaggaggccaa

SEQ ID NO: 354080 - DNA, 25 bp, Mus musculus
cctctgcgcaacacctgaagaatat

SEQ ID NO: 354081 - DNA, 25 bp, Mus musculus
cctctgcgcaactcctgaagaatat

SEQ ID NO: 354082 - DNA, 25 bp, Mus musculus
cctctgctcgctccgaaaatttatt

SEQ ID NO: 354083 - DNA, 25 bp, Mus musculus
cctctgctcgctgcgaaaatttatt

SEQ ID NO: 354084 - DNA, 25 bp, Mus musculus
cctctgctctcactgtgtgaagaca

SEQ ID NO: 354085 - DNA, 25 bp, Mus musculus
cctctgctctcagtgtgtgaagaca

SEQ ID NO: 354086 - DNA, 25 bp, Mus musculus
cctctgctggagagcaggtgcacat

SEQ ID NO: 354087 - DNA, 25 bp, Mus musculus
cctctgctggagtgcaggtgcacat

SEQ ID NO: 354088 - DNA, 25 bp, Mus musculus
cctctgctggttattgtcaactcaa

SEQ ID NO: 354089 - DNA, 25 bp, Mus musculus
cctctgctggtttttgtcaactcaa

SEQ ID NO: 354090 - DNA, 25 bp, Mus musculus
cctctgctgtccatgtgtagtgatt

SEQ ID NO: 354091 - DNA, 25 bp, Mus musculus
cctctgctgtccttgtgtagtgatt

SEQ ID NO: 354092 - DNA, 25 bp, Mus musculus
cctctgctgtgcaaactggctaata

SEQ ID NO: 354093 - DNA, 25 bp, Mus musculus
cctctgctgtgctaactggctaata

SEQ ID NO: 354094 - DNA, 25 bp, Mus musculus
cctctgcttattataggccccatta

SEQ ID NO: 354095 - DNA, 25 bp, Mus musculus
cctctgcttattttaggccccatta

SEQ ID NO: 354096 - DNA, 25 bp, Mus musculus
cctctgcttcagctcaaatgaatgt

SEQ ID NO: 354097 - DNA, 25 bp, Mus musculus
cctctgcttcaggtcaaatgaatgt

SEQ ID NO: 354098 - DNA, 25 bp, Mus musculus
cctctgcttcataggtgttctgcat

SEQ ID NO: 354099 - DNA, 25 bp, Mus musculus
cctctgcttcattggtgttctgcat

SEQ ID NO: 354100 - DNA, 25 bp, Mus musculus
cctctgcttttcaagtgctagaatc

SEQ ID NO: 354101 - DNA, 25 bp, Mus musculus
cctctgcttttctagtgctagaatc

SEQ ID NO: 354102 - DNA, 25 bp, Mus musculus
cctctggaattaaatgggcttggta

SEQ ID NO: 354103 - DNA, 25 bp, Mus musculus
cctctggaattatatgggcttggta

SEQ ID NO: 354104 - DNA, 25 bp, Mus musculus
cctctggacacacctactgctgttt

SEQ ID NO: 354105 - DNA, 25 bp, Mus musculus
cctctggacacagctactgctgttt

SEQ ID NO: 354106 - DNA, 25 bp, Mus musculus
cctctggactcgagggagagtgtct

SEQ ID NO: 354107 - DNA, 25 bp, Mus musculus
cctctggactcgtgggagagtgtct

SEQ ID NO: 354108 - DNA, 25 bp, Mus musculus
cctctggagacaagaagtcatttcc

SEQ ID NO: 354109 - DNA, 25 bp, Mus musculus
cctctggagacaaggtgcacatctg

SEQ ID NO: 354110 - DNA, 25 bp, Mus musculus
cctctggagacatgaagtcatttcc

SEQ ID NO: 354111 - DNA, 25 bp, Mus musculus
cctctggagacatggtgcacatctg

SEQ ID NO: 354112 - DNA, 25 bp, Mus musculus
cctctggagaccaggctttgtaaca

SEQ ID NO: 354113 - DNA, 25 bp, Mus musculus
cctctggagacctggctttgtaaca

SEQ ID NO: 354114 - DNA, 25 bp, Mus musculus
cctctggaggcaccggtttctcaga

SEQ ID NO: 354115 - DNA, 25 bp, Mus musculus
cctctggaggcagcggtttctcaga

SEQ ID NO: 354116 - DNA, 25 bp, Mus musculus
cctctggaggttctgtctacagcac

SEQ ID NO: 354117 - DNA, 25 bp, Mus musculus
cctctggaggttgtgtctacagcac

SEQ ID NO: 354118 - DNA, 25 bp, Mus musculus
cctctggatattactatgtgggcaa

SEQ ID NO: 354119 - DNA, 25 bp, Mus musculus
cctctggatatttctatgtgggcaa

SEQ ID NO: 354120 - DNA, 25 bp, Mus musculus
cctctggatcagaacatggcttgca

SEQ ID NO: 354121 - DNA, 25 bp, Mus musculus
cctctggatcagtacatggcttgca

SEQ ID NO: 354122 - DNA, 25 bp, Mus musculus
cctctggatcatcctggcgctttct

SEQ ID NO: 354123 - DNA, 25 bp, Mus musculus
cctctggatcatgctggcgctttct

SEQ ID NO: 354124 - DNA, 25 bp, Mus musculus
cctctggattctagataccctgaaa

SEQ ID NO: 354125 - DNA, 25 bp, Mus musculus
cctctggattcttgataccctgaaa

SEQ ID NO: 354126 - DNA, 25 bp, Mus musculus
cctctggcaaggaaggctggcatca

SEQ ID NO: 354127 - DNA, 25 bp, Mus musculus
cctctggcaaggtaggctggcatca

SEQ ID NO: 354128 - DNA, 25 bp, Mus musculus
cctctggcaccaagaactgtggaca

SEQ ID NO: 354129 - DNA, 25 bp, Mus musculus
cctctggcaccatgaactgtggaca

SEQ ID NO: 354130 - DNA, 25 bp, Mus musculus
cctctggcagcgaaaagaccccgga

SEQ ID NO: 354131 - DNA, 25 bp, Mus musculus
cctctggcagcgtaaagaccccgga

SEQ ID NO: 354132 - DNA, 25 bp, Mus musculus
cctctggcagctagcagggcaattg

SEQ ID NO: 354133 - DNA, 25 bp, Mus musculus
cctctggcagcttgcagggcaattg

SEQ ID NO: 354134 - DNA, 25 bp, Mus musculus
cctctggcatctacaccttgtagaa

SEQ ID NO: 354135 - DNA, 25 bp, Mus musculus
cctctggcatcttcaccttgtagaa

SEQ ID NO: 354136 - DNA, 25 bp, Mus musculus
cctctggccacacatgctggtggag

SEQ ID NO: 354137 - DNA, 25 bp, Mus musculus
cctctggccacagatgctggtggag

SEQ ID NO: 354138 - DNA, 25 bp, Mus musculus
cctctggctcatacaatatttgttt

SEQ ID NO: 354139 - DNA, 25 bp, Mus musculus
cctctggctcattcaatatttgttt

SEQ ID NO: 354140 - DNA, 25 bp, Mus musculus
cctctggcttatcggatggttggtc

SEQ ID NO: 354141 - DNA, 25 bp, Mus musculus
cctctggcttatgggatggttggtc

SEQ ID NO: 354142 - DNA, 25 bp, Mus musculus
cctctggctttacctcctgtatgtt

SEQ ID NO: 354143 - DNA, 25 bp, Mus musculus
cctctggctttagctcctgtatgtt

SEQ ID NO: 354144 - DNA, 25 bp, Mus musculus
cctctgggagctcttcagtttgagg

SEQ ID NO: 354145 - DNA, 25 bp, Mus musculus
cctctgggagctgttcagtttgagg

SEQ ID NO: 354146 - DNA, 25 bp, Mus musculus
cctctgggatggcttagctctctga

SEQ ID NO: 354147 - DNA, 25 bp, Mus musculus
cctctgggatgggttagctctctga

SEQ ID NO: 354148 - DNA, 25 bp, Mus musculus
cctctgggctgtaggcaaggatcga

SEQ ID NO: 354149 - DNA, 25 bp, Mus musculus
cctctgggctgttggcaaggatcga

SEQ ID NO: 354150 - DNA, 25 bp, Mus musculus
cctctgggtttaaggcttctgtgac

SEQ ID NO: 354151 - DNA, 25 bp, Mus musculus
cctctgggtttatggcttctgtgac

SEQ ID NO: 354152 - DNA, 25 bp, Mus musculus
cctctggtatggctttgtgtttgta

SEQ ID NO: 354153 - DNA, 25 bp, Mus musculus
cctctggtatgggtttgtgtttgta

SEQ ID NO: 354154 - DNA, 25 bp, Mus musculus
cctctggtctctagaatgtagcccc

SEQ ID NO: 354155 - DNA, 25 bp, Mus musculus
cctctggtctcttgaatgtagcccc

SEQ ID NO: 354156 - DNA, 25 bp, Mus musculus
cctctggtggtgacttgtgttagtg

SEQ ID NO: 354157 - DNA, 25 bp, Mus musculus
cctctggtggtgtcttgtgttagtg

SEQ ID NO: 354158 - DNA, 25 bp, Mus musculus
cctctggttagcatcgtcactcact

SEQ ID NO: 354159 - DNA, 25 bp, Mus musculus
cctctggttagcttcgtcactcact

SEQ ID NO: 354160 - DNA, 25 bp, Mus musculus
cctctggttcatatagctgtttggc

SEQ ID NO: 354161 - DNA, 25 bp, Mus musculus
cctctggttcatttagctgtttggc

SEQ ID NO: 354162 - DNA, 25 bp, Mus musculus
cctctgtaccatctgtgggctgaaa

SEQ ID NO: 354163 - DNA, 25 bp, Mus musculus
cctctgtaccatgtgtgggctgaaa

SEQ ID NO: 354164 - DNA, 25 bp, Mus musculus
cctctgtacgagcagcaggtattct

SEQ ID NO: 354165 - DNA, 25 bp, Mus musculus
cctctgtacgaggagcaggtattct

SEQ ID NO: 354166 - DNA, 25 bp, Mus musculus
cctctgtagacccaagtaactgctg

SEQ ID NO: 354167 - DNA, 25 bp, Mus musculus
cctctgtagaccgaagtaactgctg

SEQ ID NO: 354168 - DNA, 25 bp, Mus musculus
cctctgtaggacacggtttgggctg

SEQ ID NO: 354169 - DNA, 25 bp, Mus musculus
cctctgtaggactcggtttgggctg

SEQ ID NO: 354170 - DNA, 25 bp, Mus musculus
cctctgtaggagctcgtgtatatgt

SEQ ID NO: 354171 - DNA, 25 bp, Mus musculus
cctctgtaggaggtcgtgtatatgt

SEQ ID NO: 354172 - DNA, 25 bp, Mus musculus
cctctgtagttaccggaatgtatcc

SEQ ID NO: 354173 - DNA, 25 bp, Mus musculus
cctctgtagttagcggaatgtatcc

SEQ ID NO: 354174 - DNA, 25 bp, Mus musculus
cctctgtatggtacacttttgttgt

SEQ ID NO: 354175 - DNA, 25 bp, Mus musculus
cctctgtatggttcacttttgttgt

SEQ ID NO: 354176 - DNA, 25 bp, Mus musculus
cctctgtcaactcctgtgaatgctg

SEQ ID NO: 354177 - DNA, 25 bp, Mus musculus
cctctgtcaactgctgtgaatgctg

SEQ ID NO: 354178 - DNA, 25 bp, Mus musculus
cctctgtcacctacaaacatttctg

SEQ ID NO: 354179 - DNA, 25 bp, Mus musculus
cctctgtcaccttcaaacatttctg

SEQ ID NO: 354180 - DNA, 25 bp, Mus musculus
cctctgtccagaatgaatggcaagc

SEQ ID NO: 354181 - DNA, 25 bp, Mus musculus
cctctgtccagattgaatggcaagc

SEQ ID NO: 354182 - DNA, 25 bp, Mus musculus
cctctgtcgggtaatctttttctct

SEQ ID NO: 354183 - DNA, 25 bp, Mus musculus
cctctgtcgggttatctttttctct

SEQ ID NO: 354184 - DNA, 25 bp, Mus musculus
cctctgtcgtctctgggaatgattc

SEQ ID NO: 354185 - DNA, 25 bp, Mus musculus
cctctgtcgtctgtgggaatgattc

SEQ ID NO: 354186 - DNA, 25 bp, Mus musculus
cctctgtcgtgcactgagtacttaa

SEQ ID NO: 354187 - DNA, 25 bp, Mus musculus
cctctgtcgtgctctgagtacttaa

SEQ ID NO: 354188 - DNA, 25 bp, Mus musculus
cctctgtctaggaagctgatatatt

SEQ ID NO: 354189 - DNA, 25 bp, Mus musculus
cctctgtctaggtagctgatatatt

SEQ ID NO: 354190 - DNA, 25 bp, Mus musculus
cctctgtctattacatgatctctga

SEQ ID NO: 354191 - DNA, 25 bp, Mus musculus
cctctgtctatttcatgatctctga

SEQ ID NO: 354192 - DNA, 25 bp, Mus musculus
cctctgtctcctaaggaaataatgt

SEQ ID NO: 354193 - DNA, 25 bp, Mus musculus
cctctgtctccttaggaaataatgt

SEQ ID NO: 354194 - DNA, 25 bp, Mus musculus
cctctgtctgccaacgcaaagaaat

SEQ ID NO: 354195 - DNA, 25 bp, Mus musculus
cctctgtctgcctacgcaaagaaat

SEQ ID NO: 354196 - DNA, 25 bp, Mus musculus
cctctgtctgtaaggctttgatgga

SEQ ID NO: 354197 - DNA, 25 bp, Mus musculus
cctctgtctgtatggctttgatgga

SEQ ID NO: 354198 - DNA, 25 bp, Mus musculus
cctctgtctttcctatgatttatga

SEQ ID NO: 354199 - DNA, 25 bp, Mus musculus
cctctgtctttcgtatgatttatga

SEQ ID NO: 354200 - DNA, 25 bp, Mus musculus
cctctgtgagaaaagctttattcag

SEQ ID NO: 354201 - DNA, 25 bp, Mus musculus
cctctgtgagaatagctttattcag

SEQ ID NO: 354202 - DNA, 25 bp, Mus musculus
cctctgtgagatcgcgcacctgggt

SEQ ID NO: 354203 - DNA, 25 bp, Mus musculus
cctctgtgagatggcgcacctgggt

SEQ ID NO: 354204 - DNA, 25 bp, Mus musculus
cctctgtgcccaatgccaagcttaa

SEQ ID NO: 354205 - DNA, 25 bp, Mus musculus
cctctgtgcccattgccaagcttaa

SEQ ID NO: 354206 - DNA, 25 bp, Mus musculus
cctctgtgccttagcactcaagaag

SEQ ID NO: 354207 - DNA, 25 bp, Mus musculus
cctctgtgcctttgcactcaagaag

SEQ ID NO: 354208 - DNA, 25 bp, Mus musculus
cctctgtgctatatctttgtgccaa

SEQ ID NO: 354209 - DNA, 25 bp, Mus musculus
cctctgtgctatttctttgtgccaa

SEQ ID NO: 354210 - DNA, 25 bp, Mus musculus
cctctgtgctggacgtctatttata

SEQ ID NO: 354211 - DNA, 25 bp, Mus musculus
cctctgtgctggtcgtctatttata

SEQ ID NO: 354212 - DNA, 25 bp, Mus musculus
cctctgtgctgtatttgccaatgaa

SEQ ID NO: 354213 - DNA, 25 bp, Mus musculus
cctctgtgctgtttttgccaatgaa

SEQ ID NO: 354214 - DNA, 25 bp, Mus musculus
cctctgtggccgaactgtaatatca

SEQ ID NO: 354215 - DNA, 25 bp, Mus musculus
cctctgtggccgtactgtaatatca

SEQ ID NO: 354216 - DNA, 25 bp, Mus musculus
cctctgtggtagagcacttgtagtc

SEQ ID NO: 354217 - DNA, 25 bp, Mus musculus
cctctgtggtagtgcacttgtagtc

SEQ ID NO: 354218 - DNA, 25 bp, Mus musculus
cctctgtgtggtccctgatcattgt

SEQ ID NO: 354219 - DNA, 25 bp, Mus musculus
cctctgtgtggtgcctgatcattgt

SEQ ID NO: 354220 - DNA, 25 bp, Mus musculus
cctctgtgttctctgaatgggaagt

SEQ ID NO: 354221 - DNA, 25 bp, Mus musculus
cctctgtgttctgtgaatgggaagt

SEQ ID NO: 354222 - DNA, 25 bp, Mus musculus
cctctgttatcccatgactttgaca

SEQ ID NO: 354223 - DNA, 25 bp, Mus musculus
cctctgttatccgatgactttgaca

SEQ ID NO: 354224 - DNA, 25 bp, Mus musculus
cctctgttcaccctacatagaaaca

SEQ ID NO: 354225 - DNA, 25 bp, Mus musculus
cctctgttcaccgtacatagaaaca

SEQ ID NO: 354226 - DNA, 25 bp, Mus musculus
cctctgtttaggagtgtagcaaatt

SEQ ID NO: 354227 - DNA, 25 bp, Mus musculus
cctctgtttaggtgtgtagcaaatt

SEQ ID NO: 354228 - DNA, 25 bp, Mus musculus
cctctgtttcaacgttgactctaag

SEQ ID NO: 354229 - DNA, 25 bp, Mus musculus
cctctgtttcaaggttgactctaag

SEQ ID NO: 354230 - DNA, 25 bp, Mus musculus
cctctgtttgatatccagtacccac

SEQ ID NO: 354231 - DNA, 25 bp, Mus musculus
cctctgtttgatttccagtacccac

SEQ ID NO: 354232 - DNA, 25 bp, Mus musculus
cctctgtttggtcgactttgtgact

SEQ ID NO: 354233 - DNA, 25 bp, Mus musculus
cctctgtttggtggactttgtgact

SEQ ID NO: 354234 - DNA, 25 bp, Mus musculus
cctctgttttatcctggtgggtctt

SEQ ID NO: 354235 - DNA, 25 bp, Mus musculus
cctctgttttatgctggtgggtctt

SEQ ID NO: 354236 - DNA, 25 bp, Mus musculus
cctcttaacgttcgctttctgtcac

SEQ ID NO: 354237 - DNA, 25 bp, Mus musculus
cctcttaacgttggctttctgtcac

SEQ ID NO: 354238 - DNA, 25 bp, Mus musculus
cctcttaactgactaggttcttctt

SEQ ID NO: 354239 - DNA, 25 bp, Mus musculus
cctcttaactgagtaggttcttctt

SEQ ID NO: 354240 - DNA, 25 bp, Mus musculus
cctcttaattggaagtttctgactc

SEQ ID NO: 354241 - DNA, 25 bp, Mus musculus
cctcttaattggtagtttctgactc

SEQ ID NO: 354242 - DNA, 25 bp, Mus musculus
cctcttacagctcacaaagaaagtg

SEQ ID NO: 354243 - DNA, 25 bp, Mus musculus
cctcttacagctgacaaagaaagtg

SEQ ID NO: 354244 - DNA, 25 bp, Mus musculus
cctcttactttaccctaccatgtag

SEQ ID NO: 354245 - DNA, 25 bp, Mus musculus
cctcttactttagcctaccatgtag

SEQ ID NO: 354246 - DNA, 25 bp, Mus musculus
cctcttaggaagacaatctgggtct

SEQ ID NO: 354247 - DNA, 25 bp, Mus musculus
cctcttaggaagtcaatctgggtct

SEQ ID NO: 354248 - DNA, 25 bp, Mus musculus
cctcttagtgcgcaactgttgctaa

SEQ ID NO: 354249 - DNA, 25 bp, Mus musculus
cctcttagtgcggaactgttgctaa

SEQ ID NO: 354250 - DNA, 25 bp, Mus musculus
cctcttagttcaaacgattcttttt

SEQ ID NO: 354251 - DNA, 25 bp, Mus musculus
cctcttagttcatacgattcttttt

SEQ ID NO: 354252 - DNA, 25 bp, Mus musculus
cctcttatagagctgcagccactgg

SEQ ID NO: 354253 - DNA, 25 bp, Mus musculus
cctcttatagaggtgcagccactgg

SEQ ID NO: 354254 - DNA, 25 bp, Mus musculus
cctcttatgcctacaatgcacttat

SEQ ID NO: 354255 - DNA, 25 bp, Mus musculus
cctcttatgccttcaatgcacttat

SEQ ID NO: 354256 - DNA, 25 bp, Mus musculus
cctcttatggcaccgataatctgta

SEQ ID NO: 354257 - DNA, 25 bp, Mus musculus
cctcttatggcagcgataatctgta

SEQ ID NO: 354258 - DNA, 25 bp, Mus musculus
cctcttatgggtctggcagtattac

SEQ ID NO: 354259 - DNA, 25 bp, Mus musculus
cctcttatgggtgtggcagtattac

SEQ ID NO: 354260 - DNA, 25 bp, Mus musculus
cctcttattattcttacccggatca

SEQ ID NO: 354261 - DNA, 25 bp, Mus musculus
cctcttattattgttacccggatca

SEQ ID NO: 354262 - DNA, 25 bp, Mus musculus
cctcttcaaggcctggatacagact

SEQ ID NO: 354263 - DNA, 25 bp, Mus musculus
cctcttcaaggcgtggatacagact

SEQ ID NO: 354264 - DNA, 25 bp, Mus musculus
cctcttcaatgccagtcaggcctaa

SEQ ID NO: 354265 - DNA, 25 bp, Mus musculus
cctcttcaatgcgagtcaggcctaa

SEQ ID NO: 354266 - DNA, 25 bp, Mus musculus
cctcttcactgcctttttccaaaag

SEQ ID NO: 354267 - DNA, 25 bp, Mus musculus
cctcttcactgcgtttttccaaaag

SEQ ID NO: 354268 - DNA, 25 bp, Mus musculus
cctcttcataagcttgtcatttgga

SEQ ID NO: 354269 - DNA, 25 bp, Mus musculus
cctcttcataaggttgtcatttgga

SEQ ID NO: 354270 - DNA, 25 bp, Mus musculus
cctcttcatgggacatctgggcaga

SEQ ID NO: 354271 - DNA, 25 bp, Mus musculus
cctcttcatgggtcatctgggcaga

SEQ ID NO: 354272 - DNA, 25 bp, Mus musculus
cctcttcattgcagcgctgttgggt

SEQ ID NO: 354273 - DNA, 25 bp, Mus musculus
cctcttcattgctgcgctgttgggt

SEQ ID NO: 354274 - DNA, 25 bp, Mus musculus
cctcttcccaatctcttgcaaaaaa

SEQ ID NO: 354275 - DNA, 25 bp, Mus musculus
cctcttcccaatgtcttgcaaaaaa

SEQ ID NO: 354276 - DNA, 25 bp, Mus musculus
cctcttcccactatttaaatcatgt

SEQ ID NO: 354277 - DNA, 25 bp, Mus musculus
cctcttcccactttttaaatcatgt

SEQ ID NO: 354278 - DNA, 25 bp, Mus musculus
cctcttcctagaaacatttgcttcc

SEQ ID NO: 354279 - DNA, 25 bp, Mus musculus
cctcttcctagatacatttgcttcc

SEQ ID NO: 354280 - DNA, 25 bp, Mus musculus
cctcttcctatactttttgggtgtg

SEQ ID NO: 354281 - DNA, 25 bp, Mus musculus
cctcttcctatagtttttgggtgtg

SEQ ID NO: 354282 - DNA, 25 bp, Mus musculus
cctcttcctcagagtatgtaatcaa

SEQ ID NO: 354283 - DNA, 25 bp, Mus musculus
cctcttcctcagtgtatgtaatcaa

SEQ ID NO: 354284 - DNA, 25 bp, Mus musculus
cctcttctagaccaaagctgccaaa

SEQ ID NO: 354285 - DNA, 25 bp, Mus musculus
cctcttctagacgaaagctgccaaa

SEQ ID NO: 354286 - DNA, 25 bp, Mus musculus
cctcttctagtcaccaccataaagg

SEQ ID NO: 354287 - DNA, 25 bp, Mus musculus
cctcttctagtctccaccataaagg

SEQ ID NO: 354288 - DNA, 25 bp, Mus musculus
cctcttctcaggatctgcgggaaaa

SEQ ID NO: 354289 - DNA, 25 bp, Mus musculus
cctcttctcaggttctgcgggaaaa

SEQ ID NO: 354290 - DNA, 25 bp, Mus musculus
cctcttctccgaagctagaatttca

SEQ ID NO: 354291 - DNA, 25 bp, Mus musculus
cctcttctccgatgctagaatttca

SEQ ID NO: 354292 - DNA, 25 bp, Mus musculus
cctcttctgactataacctcttaat

SEQ ID NO: 354293 - DNA, 25 bp, Mus musculus
cctcttctgactttaacctcttaat

SEQ ID NO: 354294 - DNA, 25 bp, Mus musculus
cctcttctggtcaatgtggcatgca

SEQ ID NO: 354295 - DNA, 25 bp, Mus musculus
cctcttctggtctatgtggcatgca

SEQ ID NO: 354296 - DNA, 25 bp, Mus musculus
cctcttctgtgaaaacaaccggcca

SEQ ID NO: 354297 - DNA, 25 bp, Mus musculus
cctcttctgtgataacaaccggcca

SEQ ID NO: 354298 - DNA, 25 bp, Mus musculus
cctcttcttcccaagtgctaaattt

SEQ ID NO: 354299 - DNA, 25 bp, Mus musculus
cctcttcttccctagtgctaaattt

SEQ ID NO: 354300 - DNA, 25 bp, Mus musculus
cctcttcttgctaagacttttctat

SEQ ID NO: 354301 - DNA, 25 bp, Mus musculus
cctcttcttgcttagacttttctat

SEQ ID NO: 354302 - DNA, 25 bp, Mus musculus
cctcttcttgttagcttactctgta

SEQ ID NO: 354303 - DNA, 25 bp, Mus musculus
cctcttcttgtttgcttactctgta

SEQ ID NO: 354304 - DNA, 25 bp, Mus musculus
cctcttctttctcgcagctatttta

SEQ ID NO: 354305 - DNA, 25 bp, Mus musculus
cctcttctttctggcagctatttta

SEQ ID NO: 354306 - DNA, 25 bp, Mus musculus
cctcttctttgtaaagaccctcgct

SEQ ID NO: 354307 - DNA, 25 bp, Mus musculus
cctcttctttgttaagaccctcgct

SEQ ID NO: 354308 - DNA, 25 bp, Mus musculus
cctcttgacctaagcatctttagct

SEQ ID NO: 354309 - DNA, 25 bp, Mus musculus
cctcttgacctatgcatctttagct

SEQ ID NO: 354310 - DNA, 25 bp, Mus musculus
cctcttgagttcatccttcttttgg

SEQ ID NO: 354311 - DNA, 25 bp, Mus musculus
cctcttgagttcttccttcttttgg

SEQ ID NO: 354312 - DNA, 25 bp, Mus musculus
cctcttgatgtaaatgctgcttgcc

SEQ ID NO: 354313 - DNA, 25 bp, Mus musculus
cctcttgatgtatatgctgcttgcc

SEQ ID NO: 354314 - DNA, 25 bp, Mus musculus
cctcttgccctgactaagaacagca

SEQ ID NO: 354315 - DNA, 25 bp, Mus musculus
cctcttgccctgtctaagaacagca

SEQ ID NO: 354316 - DNA, 25 bp, Mus musculus
cctcttgctaacattcatctcttga

SEQ ID NO: 354317 - DNA, 25 bp, Mus musculus
cctcttgctaactttcatctcttga

SEQ ID NO: 354318 - DNA, 25 bp, Mus musculus
cctcttgctctcatttagtttggga

SEQ ID NO: 354319 - DNA, 25 bp, Mus musculus
cctcttgctctcttttagtttggga

SEQ ID NO: 354320 - DNA, 25 bp, Mus musculus
cctcttgctgccagttgactttgga

SEQ ID NO: 354321 - DNA, 25 bp, Mus musculus
cctcttgctgcctgttgactttgga

SEQ ID NO: 354322 - DNA, 25 bp, Mus musculus
cctcttgcttatcctcatattgcta

SEQ ID NO: 354323 - DNA, 25 bp, Mus musculus
cctcttgcttatgctcatattgcta

SEQ ID NO: 354324 - DNA, 25 bp, Mus musculus
cctcttggaaaaaagggccgtgcgg

SEQ ID NO: 354325 - DNA, 25 bp, Mus musculus
cctcttggaaaatagggccgtgcgg

SEQ ID NO: 354326 - DNA, 25 bp, Mus musculus
cctcttggagacatggtgattttca

SEQ ID NO: 354327 - DNA, 25 bp, Mus musculus
cctcttggagacttggtgattttca

SEQ ID NO: 354328 - DNA, 25 bp, Mus musculus
cctcttggatggcatgcagtttaca

SEQ ID NO: 354329 - DNA, 25 bp, Mus musculus
cctcttggatgggatgcagtttaca

SEQ ID NO: 354330 - DNA, 25 bp, Mus musculus
cctcttggcagcctcaagcagttga

SEQ ID NO: 354331 - DNA, 25 bp, Mus musculus
cctcttggcagcgtcaagcagttga

SEQ ID NO: 354332 - DNA, 25 bp, Mus musculus
cctcttggcagtaatctgtgggcag

SEQ ID NO: 354333 - DNA, 25 bp, Mus musculus
cctcttggcagttatctgtgggcag

SEQ ID NO: 354334 - DNA, 25 bp, Mus musculus
cctcttggccaacaagtttgaccca

SEQ ID NO: 354335 - DNA, 25 bp, Mus musculus
cctcttggccaagaagtttgaccca

SEQ ID NO: 354336 - DNA, 25 bp, Mus musculus
cctcttgggcacacttctgatttta

SEQ ID NO: 354337 - DNA, 25 bp, Mus musculus
cctcttgggcactcttctgatttta

SEQ ID NO: 354338 - DNA, 25 bp, Mus musculus
cctcttgggtttcgagtagctcaag

SEQ ID NO: 354339 - DNA, 25 bp, Mus musculus
cctcttgggtttggagtagctcaag

SEQ ID NO: 354340 - DNA, 25 bp, Mus musculus
cctcttggtcatattggtggtggcc

SEQ ID NO: 354341 - DNA, 25 bp, Mus musculus
cctcttggtcattttggtggtggcc

SEQ ID NO: 354342 - DNA, 25 bp, Mus musculus
cctcttggtctccagtggaattata

SEQ ID NO: 354343 - DNA, 25 bp, Mus musculus
cctcttggtctcgagtggaattata

SEQ ID NO: 354344 - DNA, 25 bp, Mus musculus
cctcttggtgccattctactgtaaa

SEQ ID NO: 354345 - DNA, 25 bp, Mus musculus
cctcttggtgcctttctactgtaaa

SEQ ID NO: 354346 - DNA, 25 bp, Mus musculus
cctcttgtagccatctctgtattag

SEQ ID NO: 354347 - DNA, 25 bp, Mus musculus
cctcttgtagccttctctgtattag

SEQ ID NO: 354348 - DNA, 25 bp, Mus musculus
cctcttgtcatgctcaactgctgaa

SEQ ID NO: 354349 - DNA, 25 bp, Mus musculus
cctcttgtcatggtcaactgctgaa

SEQ ID NO: 354350 - DNA, 25 bp, Mus musculus
cctcttgtgaaaccgtagtgtcatt

SEQ ID NO: 354351 - DNA, 25 bp, Mus musculus
cctcttgtgaaagcgtagtgtcatt

SEQ ID NO: 354352 - DNA, 25 bp, Mus musculus
cctcttgtgaatacaggtccaatct

SEQ ID NO: 354353 - DNA, 25 bp, Mus musculus
cctcttgtgaattcaggtccaatct

SEQ ID NO: 354354 - DNA, 25 bp, Mus musculus
cctcttgtgcttatttgcttgggaa

SEQ ID NO: 354355 - DNA, 25 bp, Mus musculus
cctcttgtgcttttttgcttgggaa

SEQ ID NO: 354356 - DNA, 25 bp, Mus musculus
cctcttgtgtgcagtaattaaagac

SEQ ID NO: 354357 - DNA, 25 bp, Mus musculus
cctcttgtgtgctgtaattaaagac

SEQ ID NO: 354358 - DNA, 25 bp, Mus musculus
cctcttgtttatctggctgtgggac

SEQ ID NO: 354359 - DNA, 25 bp, Mus musculus
cctcttgtttatgtggctgtgggac

SEQ ID NO: 354360 - DNA, 25 bp, Mus musculus
cctcttgtttttcggctaggaccat

SEQ ID NO: 354361 - DNA, 25 bp, Mus musculus
cctcttgtttttgggctaggaccat

SEQ ID NO: 354362 - DNA, 25 bp, Mus musculus
cctctttatactcccttgggaatct

SEQ ID NO: 354363 - DNA, 25 bp, Mus musculus
cctctttatactgccttgggaatct

SEQ ID NO: 354364 - DNA, 25 bp, Mus musculus
cctctttcacgccacattgaagtta

SEQ ID NO: 354365 - DNA, 25 bp, Mus musculus
cctctttcacgcgacattgaagtta

SEQ ID NO: 354366 - DNA, 25 bp, Mus musculus
cctctttcacgtacacaggattcag

SEQ ID NO: 354367 - DNA, 25 bp, Mus musculus
cctctttcacgttcacaggattcag

SEQ ID NO: 354368 - DNA, 25 bp, Mus musculus
cctctttcactaatatatcttttgg

SEQ ID NO: 354369 - DNA, 25 bp, Mus musculus
cctctttcactattatatcttttgg

SEQ ID NO: 354370 - DNA, 25 bp, Mus musculus
cctctttcatgtctgggctacttaa

SEQ ID NO: 354371 - DNA, 25 bp, Mus musculus
cctctttcatgtgtgggctacttaa

SEQ ID NO: 354372 - DNA, 25 bp, Mus musculus
cctctttccctgctagaatggaagg

SEQ ID NO: 354373 - DNA, 25 bp, Mus musculus
cctctttccctggtagaatggaagg

SEQ ID NO: 354374 - DNA, 25 bp, Mus musculus
cctctttcctacagatagcttctgt

SEQ ID NO: 354375 - DNA, 25 bp, Mus musculus
cctctttcctactgatagcttctgt

SEQ ID NO: 354376 - DNA, 25 bp, Mus musculus
cctctttcctagcacctatctgaat

SEQ ID NO: 354377 - DNA, 25 bp, Mus musculus
cctctttcctaggacctatctgaat

SEQ ID NO: 354378 - DNA, 25 bp, Mus musculus
cctctttctcacacttgttacatat

SEQ ID NO: 354379 - DNA, 25 bp, Mus musculus
cctctttctcactcttgttacatat

SEQ ID NO: 354380 - DNA, 25 bp, Mus musculus
cctctttctgatacttgttcgtgta

SEQ ID NO: 354381 - DNA, 25 bp, Mus musculus
cctctttctgattcttgttcgtgta

SEQ ID NO: 354382 - DNA, 25 bp, Mus musculus
cctctttcttgcaggtgtttctaaa

SEQ ID NO: 354383 - DNA, 25 bp, Mus musculus
cctctttcttgctggtgtttctaaa

SEQ ID NO: 354384 - DNA, 25 bp, Mus musculus
cctctttctttcagcttccaatgaa

SEQ ID NO: 354385 - DNA, 25 bp, Mus musculus
cctctttctttctgcttccaatgaa

SEQ ID NO: 354386 - DNA, 25 bp, Mus musculus
cctctttgagctcattcttatggag

SEQ ID NO: 354387 - DNA, 25 bp, Mus musculus
cctctttgagctgattcttatggag

SEQ ID NO: 354388 - DNA, 25 bp, Mus musculus
cctctttgaggccatgtgcaattag

SEQ ID NO: 354389 - DNA, 25 bp, Mus musculus
cctctttgaggcgatgtgcaattag

SEQ ID NO: 354390 - DNA, 25 bp, Mus musculus
cctctttgctttctgctgtgtacac

SEQ ID NO: 354391 - DNA, 25 bp, Mus musculus
cctctttgctttgtgctgtgtacac

SEQ ID NO: 354392 - DNA, 25 bp, Mus musculus
cctctttggcagacatttgagtagt

SEQ ID NO: 354393 - DNA, 25 bp, Mus musculus
cctctttggcagtcatttgagtagt

SEQ ID NO: 354394 - DNA, 25 bp, Mus musculus
cctctttgtaaaaatgttggtgtgc

SEQ ID NO: 354395 - DNA, 25 bp, Mus musculus
cctctttgtaaatatgttggtgtgc

SEQ ID NO: 354396 - DNA, 25 bp, Mus musculus
cctctttgtcacactatatcttatt

SEQ ID NO: 354397 - DNA, 25 bp, Mus musculus
cctctttgtcactctatatcttatt

SEQ ID NO: 354398 - DNA, 25 bp, Mus musculus
cctctttgtcctcatgctactagaa

SEQ ID NO: 354399 - DNA, 25 bp, Mus musculus
cctctttgtcctgatgctactagaa

SEQ ID NO: 354400 - DNA, 25 bp, Mus musculus
cctctttgtgtacttcaagtcttgg

SEQ ID NO: 354401 - DNA, 25 bp, Mus musculus
cctctttgtgtagttcaagtcttgg

SEQ ID NO: 354402 - DNA, 25 bp, Mus musculus
cctctttgtttgatgcttagtttta

SEQ ID NO: 354403 - DNA, 25 bp, Mus musculus
cctctttgtttgttgcttagtttta

SEQ ID NO: 354404 - DNA, 25 bp, Mus musculus
cctcttttagaactcagtgggttga

SEQ ID NO: 354405 - DNA, 25 bp, Mus musculus
cctcttttagaagtcagtgggttga

SEQ ID NO: 354406 - DNA, 25 bp, Mus musculus
cctcttttctgcagcgtgtgtaccg

SEQ ID NO: 354407 - DNA, 25 bp, Mus musculus
cctcttttctgctgcgtgtgtaccg

SEQ ID NO: 354408 - DNA, 25 bp, Mus musculus
cctcttttggtcatcatgaatatat

SEQ ID NO: 354409 - DNA, 25 bp, Mus musculus
cctcttttggtcttcatgaatatat

SEQ ID NO: 354410 - DNA, 25 bp, Mus musculus
cctctttttaacctgcctcttgaat

SEQ ID NO: 354411 - DNA, 25 bp, Mus musculus
cctctttttaacgtgcctcttgaat

SEQ ID NO: 354412 - DNA, 25 bp, Mus musculus
cctctttttctcagagctctttaga

SEQ ID NO: 354413 - DNA, 25 bp, Mus musculus
cctctttttctctgagctctttaga

SEQ ID NO: 354414 - DNA, 25 bp, Mus musculus
cctctttttgttctgggtggcagtg

SEQ ID NO: 354415 - DNA, 25 bp, Mus musculus
cctctttttgttgtgggtggcagtg

SEQ ID NO: 354416 - DNA, 25 bp, Mus musculus
cctgaaaaacagctcatgatctttg

SEQ ID NO: 354417 - DNA, 25 bp, Mus musculus
cctgaaaaacaggtcatgatctttg

SEQ ID NO: 354418 - DNA, 25 bp, Mus musculus
cctgaaaactgcacccctacaaaga

SEQ ID NO: 354419 - DNA, 25 bp, Mus musculus
cctgaaaactgctcccctacaaaga

SEQ ID NO: 354420 - DNA, 25 bp, Mus musculus
cctgaaaatggacccagctttggga

SEQ ID NO: 354421 - DNA, 25 bp, Mus musculus
cctgaaaatggagccagctttggga

SEQ ID NO: 354422 - DNA, 25 bp, Mus musculus
cctgaaacagtaacgggctggccct

SEQ ID NO: 354423 - DNA, 25 bp, Mus musculus
cctgaaacagtatcgggctggccct

SEQ ID NO: 354424 - DNA, 25 bp, Mus musculus
cctgaaagggcaatttggctccggg

SEQ ID NO: 354425 - DNA, 25 bp, Mus musculus
cctgaaagggcaccagcatgtattg

SEQ ID NO: 354426 - DNA, 25 bp, Mus musculus
cctgaaagggcagcagcatgtattg

SEQ ID NO: 354427 - DNA, 25 bp, Mus musculus
cctgaaagggcattttggctccggg

SEQ ID NO: 354428 - DNA, 25 bp, Mus musculus
cctgaaataaggattgccgtgcaaa

SEQ ID NO: 354429 - DNA, 25 bp, Mus musculus
cctgaaataaggtttgccgtgcaaa

SEQ ID NO: 354430 - DNA, 25 bp, Mus musculus
cctgaaatcccgcagaagagcctgg

SEQ ID NO: 354431 - DNA, 25 bp, Mus musculus
cctgaaatcccggagaagagcctgg

SEQ ID NO: 354432 - DNA, 25 bp, Mus musculus
cctgaaatggtcacatgtggaacaa

SEQ ID NO: 354433 - DNA, 25 bp, Mus musculus
cctgaaatggtctcatgtggaacaa

SEQ ID NO: 354434 - DNA, 25 bp, Mus musculus
cctgaaatgtagagcgcccctcgat

SEQ ID NO: 354435 - DNA, 25 bp, Mus musculus
cctgaaatgtagtgcgcccctcgat

SEQ ID NO: 354436 - DNA, 25 bp, Mus musculus
cctgaaatgtctcattctgtgcaca

SEQ ID NO: 354437 - DNA, 25 bp, Mus musculus
cctgaaatgtctgattctgtgcaca

SEQ ID NO: 354438 - DNA, 25 bp, Mus musculus
cctgaaattccaagctccaacatag

SEQ ID NO: 354439 - DNA, 25 bp, Mus musculus
cctgaaattccatgctccaacatag

SEQ ID NO: 354440 - DNA, 25 bp, Mus musculus
cctgaaattcttaggtactgtgtga

SEQ ID NO: 354441 - DNA, 25 bp, Mus musculus
cctgaaattctttggtactgtgtga

SEQ ID NO: 354442 - DNA, 25 bp, Mus musculus
cctgaaatttacaatgtagaccagg

SEQ ID NO: 354443 - DNA, 25 bp, Mus musculus
cctgaaatttactatgtagaccagg

SEQ ID NO: 354444 - DNA, 25 bp, Mus musculus
cctgaacacattcccacaagacttt

SEQ ID NO: 354445 - DNA, 25 bp, Mus musculus
cctgaacacattgccacaagacttt

SEQ ID NO: 354446 - DNA, 25 bp, Mus musculus
cctgaaccagacagtggaggagttt

SEQ ID NO: 354447 - DNA, 25 bp, Mus musculus
cctgaaccagactgtggaggagttt

SEQ ID NO: 354448 - DNA, 25 bp, Mus musculus
cctgaaccaggaagccaaacttgta

SEQ ID NO: 354449 - DNA, 25 bp, Mus musculus
cctgaaccaggatgccaaacttgta

SEQ ID NO: 354450 - DNA, 25 bp, Mus musculus
cctgaactaatacctagtaaagaat

SEQ ID NO: 354451 - DNA, 25 bp, Mus musculus
cctgaactaatagctagtaaagaat

SEQ ID NO: 354452 - DNA, 25 bp, Mus musculus
cctgaactagtccactgtgtaacaa

SEQ ID NO: 354453 - DNA, 25 bp, Mus musculus
cctgaactagtcgactgtgtaacaa

SEQ ID NO: 354454 - DNA, 25 bp, Mus musculus
cctgaactcactcaacctgtaagac

SEQ ID NO: 354455 - DNA, 25 bp, Mus musculus
cctgaactcactgaacctgtaagac

SEQ ID NO: 354456 - DNA, 25 bp, Mus musculus
cctgaactcagtagttggtgaatat

SEQ ID NO: 354457 - DNA, 25 bp, Mus musculus
cctgaactcagttgttggtgaatat

SEQ ID NO: 354458 - DNA, 25 bp, Mus musculus
cctgaactctttatccacatcttta

SEQ ID NO: 354459 - DNA, 25 bp, Mus musculus
cctgaactctttttccacatcttta

SEQ ID NO: 354460 - DNA, 25 bp, Mus musculus
cctgaactgtgaagagtcgtgagct

SEQ ID NO: 354461 - DNA, 25 bp, Mus musculus
cctgaactgtgatgagtcgtgagct

SEQ ID NO: 354462 - DNA, 25 bp, Mus musculus
cctgaacttcatcaagaggctccct

SEQ ID NO: 354463 - DNA, 25 bp, Mus musculus
cctgaacttcatgaagaggctccct

SEQ ID NO: 354464 - DNA, 25 bp, Mus musculus
cctgaactttctcggtcttagctat

SEQ ID NO: 354465 - DNA, 25 bp, Mus musculus
cctgaactttctgggtcttagctat

SEQ ID NO: 354466 - DNA, 25 bp, Mus musculus
cctgaagacactaggcgagaaagcc

SEQ ID NO: 354467 - DNA, 25 bp, Mus musculus
cctgaagacacttggcgagaaagcc

SEQ ID NO: 354468 - DNA, 25 bp, Mus musculus
cctgaagacagccaactgagacctg

SEQ ID NO: 354469 - DNA, 25 bp, Mus musculus
cctgaagacagcgaactgagacctg

SEQ ID NO: 354470 - DNA, 25 bp, Mus musculus
cctgaagaccttcgattgtttccaa

SEQ ID NO: 354471 - DNA, 25 bp, Mus musculus
cctgaagaccttggattgtttccaa

SEQ ID NO: 354472 - DNA, 25 bp, Mus musculus
cctgaagactgtccgggccatttgg

SEQ ID NO: 354473 - DNA, 25 bp, Mus musculus
cctgaagactgtgcgggccatttgg

SEQ ID NO: 354474 - DNA, 25 bp, Mus musculus
cctgaagagctaaccatggaggaca

SEQ ID NO: 354475 - DNA, 25 bp, Mus musculus
cctgaagagctaacgcctgtgtgat

SEQ ID NO: 354476 - DNA, 25 bp, Mus musculus
cctgaagagctatccatggaggaca

SEQ ID NO: 354477 - DNA, 25 bp, Mus musculus
cctgaagagctatcgcctgtgtgat

SEQ ID NO: 354478 - DNA, 25 bp, Mus musculus
cctgaagcccatatgcttttccttg

SEQ ID NO: 354479 - DNA, 25 bp, Mus musculus
cctgaagcccatttgcttttccttg

SEQ ID NO: 354480 - DNA, 25 bp, Mus musculus
cctgaagcctgaagcggcgagacct

SEQ ID NO: 354481 - DNA, 25 bp, Mus musculus
cctgaagcctgactctgagcatagc

SEQ ID NO: 354482 - DNA, 25 bp, Mus musculus
cctgaagcctgagtctgagcatagc

SEQ ID NO: 354483 - DNA, 25 bp, Mus musculus
cctgaagcctgatgcggcgagacct

SEQ ID NO: 354484 - DNA, 25 bp, Mus musculus
cctgaagccttcatgagcgactagg

SEQ ID NO: 354485 - DNA, 25 bp, Mus musculus
cctgaagccttcttgagcgactagg

SEQ ID NO: 354486 - DNA, 25 bp, Mus musculus
cctgaaggactccatgggacgtgaa

SEQ ID NO: 354487 - DNA, 25 bp, Mus musculus
cctgaaggactcgatgggacgtgaa

SEQ ID NO: 354488 - DNA, 25 bp, Mus musculus
cctgaagggctcaccatgcaggatg

SEQ ID NO: 354489 - DNA, 25 bp, Mus musculus
cctgaagggctctccatgcaggatg

SEQ ID NO: 354490 - DNA, 25 bp, Mus musculus
cctgaaggtctacgcctgtgagtga

SEQ ID NO: 354491 - DNA, 25 bp, Mus musculus
cctgaaggtctaggcctgtgagtga

SEQ ID NO: 354492 - DNA, 25 bp, Mus musculus
cctgaaggtgaaactggccagactt

SEQ ID NO: 354493 - DNA, 25 bp, Mus musculus
cctgaaggtgaatctggccagactt

SEQ ID NO: 354494 - DNA, 25 bp, Mus musculus
cctgaaggtggcatgctagcattct

SEQ ID NO: 354495 - DNA, 25 bp, Mus musculus
cctgaaggtggcttgctagcattct

SEQ ID NO: 354496 - DNA, 25 bp, Mus musculus
cctgaagtacagaggtgggctagtc

SEQ ID NO: 354497 - DNA, 25 bp, Mus musculus
cctgaagtacagagtgggtcctaag

SEQ ID NO: 354498 - DNA, 25 bp, Mus musculus
cctgaagtacagtggtgggctagtc

SEQ ID NO: 354499 - DNA, 25 bp, Mus musculus
cctgaagtacagtgtgggtcctaag

SEQ ID NO: 354500 - DNA, 25 bp, Mus musculus
cctgaagtgcccagcagtggtagca

SEQ ID NO: 354501 - DNA, 25 bp, Mus musculus
cctgaagtgccctgcagtggtagca

SEQ ID NO: 354502 - DNA, 25 bp, Mus musculus
cctgaatacaggcatctcttggata

SEQ ID NO: 354503 - DNA, 25 bp, Mus musculus
cctgaatacagggatctcttggata

SEQ ID NO: 354504 - DNA, 25 bp, Mus musculus
cctgaataccagctgcagcttacat

SEQ ID NO: 354505 - DNA, 25 bp, Mus musculus
cctgaataccaggtgcagcttacat

SEQ ID NO: 354506 - DNA, 25 bp, Mus musculus
cctgaatatcagaggttgtgtgtgt

SEQ ID NO: 354507 - DNA, 25 bp, Mus musculus
cctgaatatcagtggttgtgtgtgt

SEQ ID NO: 354508 - DNA, 25 bp, Mus musculus
cctgaatcagggaggcttatggcaa

SEQ ID NO: 354509 - DNA, 25 bp, Mus musculus
cctgaatcagggtggcttatggcaa

SEQ ID NO: 354510 - DNA, 25 bp, Mus musculus
cctgaatcccctcagaattcttagg

SEQ ID NO: 354511 - DNA, 25 bp, Mus musculus
cctgaatcccctgagaattcttagg

SEQ ID NO: 354512 - DNA, 25 bp, Mus musculus
cctgaatcgtgtattgcttcgggac

SEQ ID NO: 354513 - DNA, 25 bp, Mus musculus
cctgaatcgtgttttgcttcgggac

SEQ ID NO: 354514 - DNA, 25 bp, Mus musculus
cctgaatctggcattgtaggtcatt

SEQ ID NO: 354515 - DNA, 25 bp, Mus musculus
cctgaatctggctttgtaggtcatt

SEQ ID NO: 354516 - DNA, 25 bp, Mus musculus
cctgaatgataacagcctggagttt

SEQ ID NO: 354517 - DNA, 25 bp, Mus musculus
cctgaatgataagagcctggagttt

SEQ ID NO: 354518 - DNA, 25 bp, Mus musculus
cctgaatgcaccataattgctgtat

SEQ ID NO: 354519 - DNA, 25 bp, Mus musculus
cctgaatgcaccttaattgctgtat

SEQ ID NO: 354520 - DNA, 25 bp, Mus musculus
cctgaatgctagcatcgaagatatt

SEQ ID NO: 354521 - DNA, 25 bp, Mus musculus
cctgaatgctaggatcgaagatatt

SEQ ID NO: 354522 - DNA, 25 bp, Mus musculus
cctgaatgctgtattgacgtccgtc

SEQ ID NO: 354523 - DNA, 25 bp, Mus musculus
cctgaatgctgttttgacgtccgtc

SEQ ID NO: 354524 - DNA, 25 bp, Mus musculus
cctgaatgtggtcggctgcgatctt

SEQ ID NO: 354525 - DNA, 25 bp, Mus musculus
cctgaatgtggtgggctgcgatctt

SEQ ID NO: 354526 - DNA, 25 bp, Mus musculus
cctgaatgttgacctctctgggagt

SEQ ID NO: 354527 - DNA, 25 bp, Mus musculus
cctgaatgttgagctctctgggagt

SEQ ID NO: 354528 - DNA, 25 bp, Mus musculus
cctgaattcaaaaccagcaccacat

SEQ ID NO: 354529 - DNA, 25 bp, Mus musculus
cctgaattcaaatccagcaccacat

SEQ ID NO: 354530 - DNA, 25 bp, Mus musculus
cctgaattcactatcatcagaggaa

SEQ ID NO: 354531 - DNA, 25 bp, Mus musculus
cctgaattcactttcatcagaggaa

SEQ ID NO: 354532 - DNA, 25 bp, Mus musculus
cctgaattccctactctctaattat

SEQ ID NO: 354533 - DNA, 25 bp, Mus musculus
cctgaattcccttctctctaattat

SEQ ID NO: 354534 - DNA, 25 bp, Mus musculus
cctgaattcctaagagctagctgtt

SEQ ID NO: 354535 - DNA, 25 bp, Mus musculus
cctgaattcctatgagctagctgtt

SEQ ID NO: 354536 - DNA, 25 bp, Mus musculus
cctgaattgcagaatctccattgta

SEQ ID NO: 354537 - DNA, 25 bp, Mus musculus
cctgaattgcagtatctccattgta

SEQ ID NO: 354538 - DNA, 25 bp, Mus musculus
cctgaattgtggatcttaagatgaa

SEQ ID NO: 354539 - DNA, 25 bp, Mus musculus
cctgaattgtggttcttaagatgaa

SEQ ID NO: 354540 - DNA, 25 bp, Mus musculus
cctgaatttacaagggttttatatt

SEQ ID NO: 354541 - DNA, 25 bp, Mus musculus
cctgaatttacatgggttttatatt

SEQ ID NO: 354542 - DNA, 25 bp, Mus musculus
cctgaatttcccatcaaaggacagt

SEQ ID NO: 354543 - DNA, 25 bp, Mus musculus
cctgaatttcccttcaaaggacagt

SEQ ID NO: 354544 - DNA, 25 bp, Mus musculus
cctgacaagcggctcaaggcagagc

SEQ ID NO: 354545 - DNA, 25 bp, Mus musculus
cctgacaagcgggtcaaggcagagc

SEQ ID NO: 354546 - DNA, 25 bp, Mus musculus
cctgacaaggtcattctctgctata

SEQ ID NO: 354547 - DNA, 25 bp, Mus musculus
cctgacaaggtctttctctgctata

SEQ ID NO: 354548 - DNA, 25 bp, Mus musculus
cctgacacagggactgggaactgaa

SEQ ID NO: 354549 - DNA, 25 bp, Mus musculus
cctgacacagggtctgggaactgaa

SEQ ID NO: 354550 - DNA, 25 bp, Mus musculus
cctgacaccaagaagacctactgct

SEQ ID NO: 354551 - DNA, 25 bp, Mus musculus
cctgacaccaagtagacctactgct

SEQ ID NO: 354552 - DNA, 25 bp, Mus musculus
cctgacaccaccaggagtgcctttt

SEQ ID NO: 354553 - DNA, 25 bp, Mus musculus
cctgacaccacctggagtgcctttt

SEQ ID NO: 354554 - DNA, 25 bp, Mus musculus
cctgacacccaaagcttcttttgaa

SEQ ID NO: 354555 - DNA, 25 bp, Mus musculus
cctgacacccaatgcttcttttgaa

SEQ ID NO: 354556 - DNA, 25 bp, Mus musculus
cctgacaccctgcagtggtattcta

SEQ ID NO: 354557 - DNA, 25 bp, Mus musculus
cctgacaccctggagtggtattcta

SEQ ID NO: 354558 - DNA, 25 bp, Mus musculus
cctgacacgtttcacagtgaagaca

SEQ ID NO: 354559 - DNA, 25 bp, Mus musculus
cctgacacgtttgacagtgaagaca

SEQ ID NO: 354560 - DNA, 25 bp, Mus musculus
cctgacactgacaatttcttgcaca

SEQ ID NO: 354561 - DNA, 25 bp, Mus musculus
cctgacactgactatttcttgcaca

SEQ ID NO: 354562 - DNA, 25 bp, Mus musculus
cctgacagagccaggccaataccag

SEQ ID NO: 354563 - DNA, 25 bp, Mus musculus
cctgacagagcctggccaataccag

SEQ ID NO: 354564 - DNA, 25 bp, Mus musculus
cctgacagatttcaagtgattcgga

SEQ ID NO: 354565 - DNA, 25 bp, Mus musculus
cctgacagatttgaagtgattcgga

SEQ ID NO: 354566 - DNA, 25 bp, Mus musculus
cctgacagcacgcatatgggcagca

SEQ ID NO: 354567 - DNA, 25 bp, Mus musculus
cctgacagcacggatatgggcagca

SEQ ID NO: 354568 - DNA, 25 bp, Mus musculus
cctgacagctttctgacggcaacat

SEQ ID NO: 354569 - DNA, 25 bp, Mus musculus
cctgacagctttgtgacggcaacat

SEQ ID NO: 354570 - DNA, 25 bp, Mus musculus
cctgacaggatcagatttacctacg

SEQ ID NO: 354571 - DNA, 25 bp, Mus musculus
cctgacaggatctgatttacctacg

SEQ ID NO: 354572 - DNA, 25 bp, Mus musculus
cctgacaggccgagccagtgacaaa

SEQ ID NO: 354573 - DNA, 25 bp, Mus musculus
cctgacaggccgtgccagtgacaaa

SEQ ID NO: 354574 - DNA, 25 bp, Mus musculus
cctgacatctgtccgcttggcaagg

SEQ ID NO: 354575 - DNA, 25 bp, Mus musculus
cctgacatctgtgcgcttggcaagg

SEQ ID NO: 354576 - DNA, 25 bp, Mus musculus
cctgacatggctcgatataactgga

SEQ ID NO: 354577 - DNA, 25 bp, Mus musculus
cctgacatggctggatataactgga

SEQ ID NO: 354578 - DNA, 25 bp, Mus musculus
cctgacattattctaaagcttcccc

SEQ ID NO: 354579 - DNA, 25 bp, Mus musculus
cctgacattattgtaaagcttcccc

SEQ ID NO: 354580 - DNA, 25 bp, Mus musculus
cctgacattcagattcttcgattgc

SEQ ID NO: 354581 - DNA, 25 bp, Mus musculus
cctgacattcagtttcttcgattgc

SEQ ID NO: 354582 - DNA, 25 bp, Mus musculus
cctgacattcttactggtactctgt

SEQ ID NO: 354583 - DNA, 25 bp, Mus musculus
cctgacattctttctggtactctgt

SEQ ID NO: 354584 - DNA, 25 bp, Mus musculus
cctgacattgtaaccgtgtccaaag

SEQ ID NO: 354585 - DNA, 25 bp, Mus musculus
cctgacattgtatccgtgtccaaag

SEQ ID NO: 354586 - DNA, 25 bp, Mus musculus
cctgaccaagcacttacttgtgttt

SEQ ID NO: 354587 - DNA, 25 bp, Mus musculus
cctgaccaagcagttacttgtgttt

SEQ ID NO: 354588 - DNA, 25 bp, Mus musculus
cctgaccaggatcctgcatcttata

SEQ ID NO: 354589 - DNA, 25 bp, Mus musculus
cctgaccaggatgctgcatcttata

SEQ ID NO: 354590 - DNA, 25 bp, Mus musculus
cctgacccagtcatatgaagcttta

SEQ ID NO: 354591 - DNA, 25 bp, Mus musculus
cctgacccagtcttatgaagcttta

SEQ ID NO: 354592 - DNA, 25 bp, Mus musculus
cctgaccccgagatatttctgattg

SEQ ID NO: 354593 - DNA, 25 bp, Mus musculus
cctgaccccgagttatttctgattg

SEQ ID NO: 354594 - DNA, 25 bp, Mus musculus
cctgaccccttgcatcaacaatgga

SEQ ID NO: 354595 - DNA, 25 bp, Mus musculus
cctgaccccttggatcaacaatgga

SEQ ID NO: 354596 - DNA, 25 bp, Mus musculus
cctgaccctcataacctcagactta

SEQ ID NO: 354597 - DNA, 25 bp, Mus musculus
cctgaccctcattacctcagactta

SEQ ID NO: 354598 - DNA, 25 bp, Mus musculus
cctgaccctgctatatggactgttt

SEQ ID NO: 354599 - DNA, 25 bp, Mus musculus
cctgaccctgctttatggactgttt

SEQ ID NO: 354600 - DNA, 25 bp, Mus musculus
cctgaccgaggtaaacgcctgtaat

SEQ ID NO: 354601 - DNA, 25 bp, Mus musculus
cctgaccgaggttaacgcctgtaat

SEQ ID NO: 354602 - DNA, 25 bp, Mus musculus
cctgaccgtcgccagaagaggttga

SEQ ID NO: 354603 - DNA, 25 bp, Mus musculus
cctgaccgtcgcgagaagaggttga

SEQ ID NO: 354604 - DNA, 25 bp, Mus musculus
cctgacctccacagatgtttgtgaa

SEQ ID NO: 354605 - DNA, 25 bp, Mus musculus
cctgacctccactgatgtttgtgaa

SEQ ID NO: 354606 - DNA, 25 bp, Mus musculus
cctgacctgcttcccgatgactttg

SEQ ID NO: 354607 - DNA, 25 bp, Mus musculus
cctgacctgcttgccgatgactttg

SEQ ID NO: 354608 - DNA, 25 bp, Mus musculus
cctgacctggaaagcacacacctga

SEQ ID NO: 354609 - DNA, 25 bp, Mus musculus
cctgacctggaatgcacacacctga

SEQ ID NO: 354610 - DNA, 25 bp, Mus musculus
cctgacctgggcaagtggacagagt

SEQ ID NO: 354611 - DNA, 25 bp, Mus musculus
cctgacctgggctagtggacagagt

SEQ ID NO: 354612 - DNA, 25 bp, Mus musculus
cctgacctgtaaatggagtttttca

SEQ ID NO: 354613 - DNA, 25 bp, Mus musculus
cctgacctgtaattggagtttttca

SEQ ID NO: 354614 - DNA, 25 bp, Mus musculus
cctgaccttgcgaagattcttggca

SEQ ID NO: 354615 - DNA, 25 bp, Mus musculus
cctgaccttgcgtagattcttggca

SEQ ID NO: 354616 - DNA, 25 bp, Mus musculus
cctgacctttgtcgagtcaaaattg

SEQ ID NO: 354617 - DNA, 25 bp, Mus musculus
cctgacctttgtggagtcaaaattg

SEQ ID NO: 354618 - DNA, 25 bp, Mus musculus
cctgacgatgagaagccaccacctg

SEQ ID NO: 354619 - DNA, 25 bp, Mus musculus
cctgacgatgagtagccaccacctg

SEQ ID NO: 354620 - DNA, 25 bp, Mus musculus
cctgacgggcagagtatattcttct

SEQ ID NO: 354621 - DNA, 25 bp, Mus musculus
cctgacgggcagtgtatattcttct

SEQ ID NO: 354622 - DNA, 25 bp, Mus musculus
cctgacgtgctccatccctaggagt

SEQ ID NO: 354623 - DNA, 25 bp, Mus musculus
cctgacgtgctcgatccctaggagt

SEQ ID NO: 354624 - DNA, 25 bp, Mus musculus
cctgactaagtcagctgattttata

SEQ ID NO: 354625 - DNA, 25 bp, Mus musculus
cctgactaagtctgctgattttata

SEQ ID NO: 354626 - DNA, 25 bp, Mus musculus
cctgactaatgcatttggaagtttt

SEQ ID NO: 354627 - DNA, 25 bp, Mus musculus
cctgactaatgcttttggaagtttt

SEQ ID NO: 354628 - DNA, 25 bp, Mus musculus
cctgactacaagaggacctaccaga

SEQ ID NO: 354629 - DNA, 25 bp, Mus musculus
cctgactacaagtggacctaccaga

SEQ ID NO: 354630 - DNA, 25 bp, Mus musculus
cctgactactggcatcaaagacact

SEQ ID NO: 354631 - DNA, 25 bp, Mus musculus
cctgactactgggatcaaagacact

SEQ ID NO: 354632 - DNA, 25 bp, Mus musculus
cctgactatatcaactttctcaagg

SEQ ID NO: 354633 - DNA, 25 bp, Mus musculus
cctgactatatctactttctcaagg

SEQ ID NO: 354634 - DNA, 25 bp, Mus musculus
cctgactattttacctgctgacctt

SEQ ID NO: 354635 - DNA, 25 bp, Mus musculus
cctgactatttttcctgctgacctt

SEQ ID NO: 354636 - DNA, 25 bp, Mus musculus
cctgactccctcaagtgacagacag

SEQ ID NO: 354637 - DNA, 25 bp, Mus musculus
cctgactccctctagtgacagacag

SEQ ID NO: 354638 - DNA, 25 bp, Mus musculus
cctgactcctttaagcttctttata

SEQ ID NO: 354639 - DNA, 25 bp, Mus musculus
cctgactccttttagcttctttata

SEQ ID NO: 354640 - DNA, 25 bp, Mus musculus
cctgactcgatgctgaacctgttaa

SEQ ID NO: 354641 - DNA, 25 bp, Mus musculus
cctgactcgatggtgaacctgttaa

SEQ ID NO: 354642 - DNA, 25 bp, Mus musculus
cctgactctaacatcctgtttggat

SEQ ID NO: 354643 - DNA, 25 bp, Mus musculus
cctgactctaacttcctgtttggat

SEQ ID NO: 354644 - DNA, 25 bp, Mus musculus
cctgactctagtagtctgttgctgc

SEQ ID NO: 354645 - DNA, 25 bp, Mus musculus
cctgactctagttgtctgttgctgc

SEQ ID NO: 354646 - DNA, 25 bp, Mus musculus
cctgactctcctatgtggatagaca

SEQ ID NO: 354647 - DNA, 25 bp, Mus musculus
cctgactctcctttgtggatagaca

SEQ ID NO: 354648 - DNA, 25 bp, Mus musculus
cctgactgacctagtacttgctatg

SEQ ID NO: 354649 - DNA, 25 bp, Mus musculus
cctgactgaccttgtacttgctatg

SEQ ID NO: 354650 - DNA, 25 bp, Mus musculus
cctgactgagccctgccatgtggac

SEQ ID NO: 354651 - DNA, 25 bp, Mus musculus
cctgactgagccgtgccatgtggac

SEQ ID NO: 354652 - DNA, 25 bp, Mus musculus
cctgactgattcacatcgggtaaaa

SEQ ID NO: 354653 - DNA, 25 bp, Mus musculus
cctgactgattctcatcgggtaaaa

SEQ ID NO: 354654 - DNA, 25 bp, Mus musculus
cctgactggtggaaattggcctgta

SEQ ID NO: 354655 - DNA, 25 bp, Mus musculus
cctgactggtggtaattggcctgta

SEQ ID NO: 354656 - DNA, 25 bp, Mus musculus
cctgacttagagcagcactgggttt

SEQ ID NO: 354657 - DNA, 25 bp, Mus musculus
cctgacttagaggagcactgggttt

SEQ ID NO: 354658 - DNA, 25 bp, Mus musculus
cctgacttgcctatagttcactttt

SEQ ID NO: 354659 - DNA, 25 bp, Mus musculus
cctgacttgcctttagttcactttt

SEQ ID NO: 354660 - DNA, 25 bp, Mus musculus
cctgacttgtcactttgtagccaaa

SEQ ID NO: 354661 - DNA, 25 bp, Mus musculus
cctgacttgtcagtttgtagccaaa

SEQ ID NO: 354662 - DNA, 25 bp, Mus musculus
cctgacttgtgacgatggcttgttc

SEQ ID NO: 354663 - DNA, 25 bp, Mus musculus
cctgacttgtgaggatggcttgttc

SEQ ID NO: 354664 - DNA, 25 bp, Mus musculus
cctgactttcgtcatgcccttgaac

SEQ ID NO: 354665 - DNA, 25 bp, Mus musculus
cctgactttcgtgatgcccttgaac

SEQ ID NO: 354666 - DNA, 25 bp, Mus musculus
cctgactttggtctgcaacctttaa

SEQ ID NO: 354667 - DNA, 25 bp, Mus musculus
cctgactttggtgtgcaacctttaa

SEQ ID NO: 354668 - DNA, 25 bp, Mus musculus
cctgactttgtgattgtgggcatat

SEQ ID NO: 354669 - DNA, 25 bp, Mus musculus
cctgactttgtgtttgtgggcatat

SEQ ID NO: 354670 - DNA, 25 bp, Mus musculus
cctgagaactccaccagacttggga

SEQ ID NO: 354671 - DNA, 25 bp, Mus musculus
cctgagaactcctccagacttggga

SEQ ID NO: 354672 - DNA, 25 bp, Mus musculus
cctgagaagaacagaggtgaccgca

SEQ ID NO: 354673 - DNA, 25 bp, Mus musculus
cctgagaagaactgaggtgaccgca

SEQ ID NO: 354674 - DNA, 25 bp, Mus musculus
cctgagaagttgaggagtttctggt

SEQ ID NO: 354675 - DNA, 25 bp, Mus musculus
cctgagaagttgtggagtttctggt

SEQ ID NO: 354676 - DNA, 25 bp, Mus musculus
cctgagaataaacttgccataagtt

SEQ ID NO: 354677 - DNA, 25 bp, Mus musculus
cctgagaataaagttgccataagtt

SEQ ID NO: 354678 - DNA, 25 bp, Mus musculus
cctgagaatcgtcgacctaaatgtt

SEQ ID NO: 354679 - DNA, 25 bp, Mus musculus
cctgagaatcgtggacctaaatgtt

SEQ ID NO: 354680 - DNA, 25 bp, Mus musculus
cctgagaatgctctgatgctggaca

SEQ ID NO: 354681 - DNA, 25 bp, Mus musculus
cctgagaatgctgtgatgctggaca

SEQ ID NO: 354682 - DNA, 25 bp, Mus musculus
cctgagacaactactataccacaca

SEQ ID NO: 354683 - DNA, 25 bp, Mus musculus
cctgagacaacttctataccacaca

SEQ ID NO: 354684 - DNA, 25 bp, Mus musculus
cctgagacacagagaataacctata

SEQ ID NO: 354685 - DNA, 25 bp, Mus musculus
cctgagacacagtgaataacctata

SEQ ID NO: 354686 - DNA, 25 bp, Mus musculus
cctgagacatcccaaaagacaccta

SEQ ID NO: 354687 - DNA, 25 bp, Mus musculus
cctgagacatccgaaaagacaccta

SEQ ID NO: 354688 - DNA, 25 bp, Mus musculus
cctgagacatgtcggaaccggatgc

SEQ ID NO: 354689 - DNA, 25 bp, Mus musculus
cctgagacatgtgggaaccggatgc

SEQ ID NO: 354690 - DNA, 25 bp, Mus musculus
cctgagactgcaaataaacataaat

SEQ ID NO: 354691 - DNA, 25 bp, Mus musculus
cctgagactgcatataaacataaat

SEQ ID NO: 354692 - DNA, 25 bp, Mus musculus
cctgagacttttcagcctggcctgt

SEQ ID NO: 354693 - DNA, 25 bp, Mus musculus
cctgagacttttgagcctggcctgt

SEQ ID NO: 354694 - DNA, 25 bp, Mus musculus
cctgagagacaacctgacgctgtgg

SEQ ID NO: 354695 - DNA, 25 bp, Mus musculus
cctgagagacaagctgacgctgtgg

SEQ ID NO: 354696 - DNA, 25 bp, Mus musculus
cctgagagaggaccttctccggaag

SEQ ID NO: 354697 - DNA, 25 bp, Mus musculus
cctgagagaggagcttctccggaag

SEQ ID NO: 354698 - DNA, 25 bp, Mus musculus
cctgagagatcaaactgtgattttt

SEQ ID NO: 354699 - DNA, 25 bp, Mus musculus
cctgagagatcatactgtgattttt

SEQ ID NO: 354700 - DNA, 25 bp, Mus musculus
cctgagagcaaaactcctgcgactt

SEQ ID NO: 354701 - DNA, 25 bp, Mus musculus
cctgagagcaaatctcctgcgactt

SEQ ID NO: 354702 - DNA, 25 bp, Mus musculus
cctgagaggcttacggcagaagcta

SEQ ID NO: 354703 - DNA, 25 bp, Mus musculus
cctgagaggctttcggcagaagcta

SEQ ID NO: 354704 - DNA, 25 bp, Mus musculus
cctgagagtgccatcactatcatac

SEQ ID NO: 354705 - DNA, 25 bp, Mus musculus
cctgagagtgccttcactatcatac

SEQ ID NO: 354706 - DNA, 25 bp, Mus musculus
cctgagatcaggatggtgcccactt

SEQ ID NO: 354707 - DNA, 25 bp, Mus musculus
cctgagatcaggttggtgcccactt

SEQ ID NO: 354708 - DNA, 25 bp, Mus musculus
cctgagattccaccagcccttggga

SEQ ID NO: 354709 - DNA, 25 bp, Mus musculus
cctgagattccagcagcccttggga

SEQ ID NO: 354710 - DNA, 25 bp, Mus musculus
cctgagattggactatggaattcat

SEQ ID NO: 354711 - DNA, 25 bp, Mus musculus
cctgagattggagtatggaattcat

SEQ ID NO: 354712 - DNA, 25 bp, Mus musculus
cctgagcacaggaaattagccatgt

SEQ ID NO: 354713 - DNA, 25 bp, Mus musculus
cctgagcacaggtaattagccatgt

SEQ ID NO: 354714 - DNA, 25 bp, Mus musculus
cctgagcagattcagtggcctttct

SEQ ID NO: 354715 - DNA, 25 bp, Mus musculus
cctgagcagattgagtggcctttct

SEQ ID NO: 354716 - DNA, 25 bp, Mus musculus
cctgagcagcggaccactttggaga

SEQ ID NO: 354717 - DNA, 25 bp, Mus musculus
cctgagcagcggtccactttggaga

SEQ ID NO: 354718 - DNA, 25 bp, Mus musculus
cctgagcatctgagcggccaaagta

SEQ ID NO: 354719 - DNA, 25 bp, Mus musculus
cctgagcatctgtgcggccaaagta

SEQ ID NO: 354720 - DNA, 25 bp, Mus musculus
cctgagcatggcatgtgggcagcaa

SEQ ID NO: 354721 - DNA, 25 bp, Mus musculus
cctgagcatggcttgtgggcagcaa

SEQ ID NO: 354722 - DNA, 25 bp, Mus musculus
cctgagcattggcaatgggcaaatc

SEQ ID NO: 354723 - DNA, 25 bp, Mus musculus
cctgagcattgggaatgggcaaatc

SEQ ID NO: 354724 - DNA, 25 bp, Mus musculus
cctgagccacggaggattgcggcaa

SEQ ID NO: 354725 - DNA, 25 bp, Mus musculus
cctgagccacggtggattgcggcaa

SEQ ID NO: 354726 - DNA, 25 bp, Mus musculus
cctgagcccagcactggaatcaaaa

SEQ ID NO: 354727 - DNA, 25 bp, Mus musculus
cctgagcccagctctggaatcaaaa

SEQ ID NO: 354728 - DNA, 25 bp, Mus musculus
cctgagccccgaaggagtcttgtgg

SEQ ID NO: 354729 - DNA, 25 bp, Mus musculus
cctgagccccgatggagtcttgtgg

SEQ ID NO: 354730 - DNA, 25 bp, Mus musculus
cctgagccctatcggcagaggctct

SEQ ID NO: 354731 - DNA, 25 bp, Mus musculus
cctgagccctatgggcagaggctct

SEQ ID NO: 354732 - DNA, 25 bp, Mus musculus
cctgagccgactactgctgctgcag

SEQ ID NO: 354733 - DNA, 25 bp, Mus musculus
cctgagccgacttctgctgctgcag

SEQ ID NO: 354734 - DNA, 25 bp, Mus musculus
cctgagcctagaatgatgtcaccgc

SEQ ID NO: 354735 - DNA, 25 bp, Mus musculus
cctgagcctagattgatgtcaccgc

SEQ ID NO: 354736 - DNA, 25 bp, Mus musculus
cctgagcgcaagaactctgtgtgga

SEQ ID NO: 354737 - DNA, 25 bp, Mus musculus
cctgagcgcaagtactctgtgtgga

SEQ ID NO: 354738 - DNA, 25 bp, Mus musculus
cctgagcgcaatactcttataaaaa

SEQ ID NO: 354739 - DNA, 25 bp, Mus musculus
cctgagcgcaattctcttataaaaa

SEQ ID NO: 354740 - DNA, 25 bp, Mus musculus
cctgagcgccggcattacaaatgtg

SEQ ID NO: 354741 - DNA, 25 bp, Mus musculus
cctgagcgccgggattacaaatgtg

SEQ ID NO: 354742 - DNA, 25 bp, Mus musculus
cctgagctatctcggacttttgttc

SEQ ID NO: 354743 - DNA, 25 bp, Mus musculus
cctgagctatctgggacttttgttc

SEQ ID NO: 354744 - DNA, 25 bp, Mus musculus
cctgagctccctcacaaatgtttgt

SEQ ID NO: 354745 - DNA, 25 bp, Mus musculus
cctgagctccctgacaaatgtttgt

SEQ ID NO: 354746 - DNA, 25 bp, Mus musculus
cctgagctctgccttaaactgatat

SEQ ID NO: 354747 - DNA, 25 bp, Mus musculus
cctgagctctgcgttaaactgatat

SEQ ID NO: 354748 - DNA, 25 bp, Mus musculus
cctgagctggcacgaagcctggcca

SEQ ID NO: 354749 - DNA, 25 bp, Mus musculus
cctgagctggcaggaagcctggcca

SEQ ID NO: 354750 - DNA, 25 bp, Mus musculus
cctgagctgtctcatcctctatata

SEQ ID NO: 354751 - DNA, 25 bp, Mus musculus
cctgagctgtctccccgctgtgtgt

SEQ ID NO: 354752 - DNA, 25 bp, Mus musculus
cctgagctgtctgatcctctatata

SEQ ID NO: 354753 - DNA, 25 bp, Mus musculus
cctgagctgtctgcccgctgtgtgt

SEQ ID NO: 354754 - DNA, 25 bp, Mus musculus
cctgagctgtggaacagcccttaaa

SEQ ID NO: 354755 - DNA, 25 bp, Mus musculus
cctgagctgtggcatgtgcctacat

SEQ ID NO: 354756 - DNA, 25 bp, Mus musculus
cctgagctgtgggatgtgcctacat

SEQ ID NO: 354757 - DNA, 25 bp, Mus musculus
cctgagctgtggtacagcccttaaa

SEQ ID NO: 354758 - DNA, 25 bp, Mus musculus
cctgagcttactactgagtcctggc

SEQ ID NO: 354759 - DNA, 25 bp, Mus musculus
cctgagcttacttctgagtcctggc

SEQ ID NO: 354760 - DNA, 25 bp, Mus musculus
cctgagctttcaccggcttccaagt

SEQ ID NO: 354761 - DNA, 25 bp, Mus musculus
cctgagctttcagcggcttccaagt

SEQ ID NO: 354762 - DNA, 25 bp, Mus musculus
cctgaggaaccacctaaaccaggtg

SEQ ID NO: 354763 - DNA, 25 bp, Mus musculus
cctgaggaaccagctaaaccaggtg

SEQ ID NO: 354764 - DNA, 25 bp, Mus musculus
cctgaggaagcaactgacacctgat

SEQ ID NO: 354765 - DNA, 25 bp, Mus musculus
cctgaggaagcatctgacacctgat

SEQ ID NO: 354766 - DNA, 25 bp, Mus musculus
cctgaggacacaattaccgtcacct

SEQ ID NO: 354767 - DNA, 25 bp, Mus musculus
cctgaggacacatttaccgtcacct

SEQ ID NO: 354768 - DNA, 25 bp, Mus musculus
cctgaggacaggaaatttggttaag

SEQ ID NO: 354769 - DNA, 25 bp, Mus musculus
cctgaggacaggtaatttggttaag

SEQ ID NO: 354770 - DNA, 25 bp, Mus musculus
cctgaggacttgagccccagggagt

SEQ ID NO: 354771 - DNA, 25 bp, Mus musculus
cctgaggacttgatttgcttggctt

SEQ ID NO: 354772 - DNA, 25 bp, Mus musculus
cctgaggacttgtgccccagggagt

SEQ ID NO: 354773 - DNA, 25 bp, Mus musculus
cctgaggacttgttttgcttggctt

SEQ ID NO: 354774 - DNA, 25 bp, Mus musculus
cctgaggagcggaccttccacagca

SEQ ID NO: 354775 - DNA, 25 bp, Mus musculus
cctgaggagcggtccttccacagca

SEQ ID NO: 354776 - DNA, 25 bp, Mus musculus
cctgaggataatcggcatcaagaag

SEQ ID NO: 354777 - DNA, 25 bp, Mus musculus
cctgaggataatgggcatcaagaag

SEQ ID NO: 354778 - DNA, 25 bp, Mus musculus
cctgaggatcctacattttgggact

SEQ ID NO: 354779 - DNA, 25 bp, Mus musculus
cctgaggatccttcattttgggact

SEQ ID NO: 354780 - DNA, 25 bp, Mus musculus
cctgaggatcgcaaagtatacacat

SEQ ID NO: 354781 - DNA, 25 bp, Mus musculus
cctgaggatcgctaagtatacacat

SEQ ID NO: 354782 - DNA, 25 bp, Mus musculus
cctgaggcaggtagacggtttctaa

SEQ ID NO: 354783 - DNA, 25 bp, Mus musculus
cctgaggcaggttgacggtttctaa

SEQ ID NO: 354784 - DNA, 25 bp, Mus musculus
cctgaggccataccccaaggaagaa

SEQ ID NO: 354785 - DNA, 25 bp, Mus musculus
cctgaggccatagcccaaggaagaa

SEQ ID NO: 354786 - DNA, 25 bp, Mus musculus
cctgaggcgcagaagtaacttagtc

SEQ ID NO: 354787 - DNA, 25 bp, Mus musculus
cctgaggcgcagtagtaacttagtc

SEQ ID NO: 354788 - DNA, 25 bp, Mus musculus
cctgaggctaggaataatgtctgaa

SEQ ID NO: 354789 - DNA, 25 bp, Mus musculus
cctgaggctaggtataatgtctgaa

SEQ ID NO: 354790 - DNA, 25 bp, Mus musculus
cctgaggctgacctcatgtctgatg

SEQ ID NO: 354791 - DNA, 25 bp, Mus musculus
cctgaggctgacgtcatgtctgatg

SEQ ID NO: 354792 - DNA, 25 bp, Mus musculus
cctgaggctgtccatgtacgttaag

SEQ ID NO: 354793 - DNA, 25 bp, Mus musculus
cctgaggctgtcgatgtacgttaag

SEQ ID NO: 354794 - DNA, 25 bp, Mus musculus
cctgagggcaggcaatcttgagtaa

SEQ ID NO: 354795 - DNA, 25 bp, Mus musculus
cctgagggcagggaatcttgagtaa

SEQ ID NO: 354796 - DNA, 25 bp, Mus musculus
cctgagggccatactctacttgaac

SEQ ID NO: 354797 - DNA, 25 bp, Mus musculus
cctgagggccattctctacttgaac

SEQ ID NO: 354798 - DNA, 25 bp, Mus musculus
cctgagggcgctagttcaacatttt

SEQ ID NO: 354799 - DNA, 25 bp, Mus musculus
cctgagggcgcttgttcaacatttt

SEQ ID NO: 354800 - DNA, 25 bp, Mus musculus
cctgagggtactcacttagtgttaa

SEQ ID NO: 354801 - DNA, 25 bp, Mus musculus
cctgagggtactgacttagtgttaa

SEQ ID NO: 354802 - DNA, 25 bp, Mus musculus
cctgagggtagtcccagccaactgg

SEQ ID NO: 354803 - DNA, 25 bp, Mus musculus
cctgagggtagtgccagccaactgg

SEQ ID NO: 354804 - DNA, 25 bp, Mus musculus
cctgagggtcatagtgccatctgaa

SEQ ID NO: 354805 - DNA, 25 bp, Mus musculus
cctgagggtcattgtgccatctgaa

SEQ ID NO: 354806 - DNA, 25 bp, Mus musculus
cctgagggtgggacctgcagctcct

SEQ ID NO: 354807 - DNA, 25 bp, Mus musculus
cctgagggtgggtcctgcagctcct

SEQ ID NO: 354808 - DNA, 25 bp, Mus musculus
cctgaggtactcaggtagctggcaa

SEQ ID NO: 354809 - DNA, 25 bp, Mus musculus
cctgaggtactctggtagctggcaa

SEQ ID NO: 354810 - DNA, 25 bp, Mus musculus
cctgaggtcacaagttgccatctac

SEQ ID NO: 354811 - DNA, 25 bp, Mus musculus
cctgaggtcacatgttgccatctac

SEQ ID NO: 354812 - DNA, 25 bp, Mus musculus
cctgaggtccgaaccgctggtgtgt

SEQ ID NO: 354813 - DNA, 25 bp, Mus musculus
cctgaggtccgatccgctggtgtgt

SEQ ID NO: 354814 - DNA, 25 bp, Mus musculus
cctgaggttgtcatgattgctggct

SEQ ID NO: 354815 - DNA, 25 bp, Mus musculus
cctgaggttgtcttgattgctggct

SEQ ID NO: 354816 - DNA, 25 bp, Mus musculus
cctgagtaaggcccgtttatttcca

SEQ ID NO: 354817 - DNA, 25 bp, Mus musculus
cctgagtaaggcgcgtttatttcca

SEQ ID NO: 354818 - DNA, 25 bp, Mus musculus
cctgagtacagaattctcctcccaa

SEQ ID NO: 354819 - DNA, 25 bp, Mus musculus
cctgagtacagatttctcctcccaa

SEQ ID NO: 354820 - DNA, 25 bp, Mus musculus
cctgagtacctcatgctgttatgaa

SEQ ID NO: 354821 - DNA, 25 bp, Mus musculus
cctgagtacctcttgctgttatgaa

SEQ ID NO: 354822 - DNA, 25 bp, Mus musculus
cctgagtactatccccagcattgta

SEQ ID NO: 354823 - DNA, 25 bp, Mus musculus
cctgagtactatgcccagcattgta

SEQ ID NO: 354824 - DNA, 25 bp, Mus musculus
cctgagtcctctcaatctgagtctg

SEQ ID NO: 354825 - DNA, 25 bp, Mus musculus
cctgagtcctctgaatctgagtctg

SEQ ID NO: 354826 - DNA, 25 bp, Mus musculus
cctgagtctagcattgggaagttcc

SEQ ID NO: 354827 - DNA, 25 bp, Mus musculus
cctgagtctagctttgggaagttcc

SEQ ID NO: 354828 - DNA, 25 bp, Mus musculus
cctgagtctgatagacaagatgctt

SEQ ID NO: 354829 - DNA, 25 bp, Mus musculus
cctgagtctgattgacaagatgctt

SEQ ID NO: 354830 - DNA, 25 bp, Mus musculus
cctgagtctggaatcacttgtgatg

SEQ ID NO: 354831 - DNA, 25 bp, Mus musculus
cctgagtctggattcacttgtgatg

SEQ ID NO: 354832 - DNA, 25 bp, Mus musculus
cctgagtgaagtcggctgtgctcct

SEQ ID NO: 354833 - DNA, 25 bp, Mus musculus
cctgagtgaagtgggctgtgctcct

SEQ ID NO: 354834 - DNA, 25 bp, Mus musculus
cctgagtgacgtacaggacatacgt

SEQ ID NO: 354835 - DNA, 25 bp, Mus musculus
cctgagtgacgttcaggacatacgt

SEQ ID NO: 354836 - DNA, 25 bp, Mus musculus
cctgagtgatcacagcagtaaatgt

SEQ ID NO: 354837 - DNA, 25 bp, Mus musculus
cctgagtgatcagagcagtaaatgt

SEQ ID NO: 354838 - DNA, 25 bp, Mus musculus
cctgagtggatgatgccccactggt

SEQ ID NO: 354839 - DNA, 25 bp, Mus musculus
cctgagtggatgttgccccactggt

SEQ ID NO: 354840 - DNA, 25 bp, Mus musculus
cctgagtggcacattcttttagaat

SEQ ID NO: 354841 - DNA, 25 bp, Mus musculus
cctgagtggcactttcttttagaat

SEQ ID NO: 354842 - DNA, 25 bp, Mus musculus
cctgagtgtcacaggtatgggtaac

SEQ ID NO: 354843 - DNA, 25 bp, Mus musculus
cctgagtgtcactggtatgggtaac

SEQ ID NO: 354844 - DNA, 25 bp, Mus musculus
cctgagtgtcatacaagtgcagtcc

SEQ ID NO: 354845 - DNA, 25 bp, Mus musculus
cctgagtgtcattcaagtgcagtcc

SEQ ID NO: 354846 - DNA, 25 bp, Mus musculus
cctgagtgtggtcggacatacttta

SEQ ID NO: 354847 - DNA, 25 bp, Mus musculus
cctgagtgtggtgggacatacttta

SEQ ID NO: 354848 - DNA, 25 bp, Mus musculus
cctgagttacggagcccctgtggta

SEQ ID NO: 354849 - DNA, 25 bp, Mus musculus
cctgagttacggtgcccctgtggta

SEQ ID NO: 354850 - DNA, 25 bp, Mus musculus
cctgagttactgcagctctaaggct

SEQ ID NO: 354851 - DNA, 25 bp, Mus musculus
cctgagttactggagctctaaggct

SEQ ID NO: 354852 - DNA, 25 bp, Mus musculus
cctgagttatacaagctagacccat

SEQ ID NO: 354853 - DNA, 25 bp, Mus musculus
cctgagttatactagctagacccat

SEQ ID NO: 354854 - DNA, 25 bp, Mus musculus
cctgagttcaatacttggtactgtt

SEQ ID NO: 354855 - DNA, 25 bp, Mus musculus
cctgagttcaattcttggtactgtt

SEQ ID NO: 354856 - DNA, 25 bp, Mus musculus
cctgagttccaaccagatccgaggt

SEQ ID NO: 354857 - DNA, 25 bp, Mus musculus
cctgagttccaagcagatccgaggt

SEQ ID NO: 354858 - DNA, 25 bp, Mus musculus
cctgagttctgacggcagtgccctt

SEQ ID NO: 354859 - DNA, 25 bp, Mus musculus
cctgagttctgagggcagtgccctt

SEQ ID NO: 354860 - DNA, 25 bp, Mus musculus
cctgagttcttcaagccatataccc

SEQ ID NO: 354861 - DNA, 25 bp, Mus musculus
cctgagttcttctagccatataccc

SEQ ID NO: 354862 - DNA, 25 bp, Mus musculus
cctgagttctttctccacgatgaga

SEQ ID NO: 354863 - DNA, 25 bp, Mus musculus
cctgagttctttgtccacgatgaga

SEQ ID NO: 354864 - DNA, 25 bp, Mus musculus
cctgagtttcagaatcttcacaaaa

SEQ ID NO: 354865 - DNA, 25 bp, Mus musculus
cctgagtttcagtatcttcacaaaa

SEQ ID NO: 354866 - DNA, 25 bp, Mus musculus
cctgagtttgagacatggtagtata

SEQ ID NO: 354867 - DNA, 25 bp, Mus musculus
cctgagtttgagtcatggtagtata

SEQ ID NO: 354868 - DNA, 25 bp, Mus musculus
cctgagtttgatcctatagatgaac

SEQ ID NO: 354869 - DNA, 25 bp, Mus musculus
cctgagtttgatgctatagatgaac

SEQ ID NO: 354870 - DNA, 25 bp, Mus musculus
cctgagttttggaccagttgggctg

SEQ ID NO: 354871 - DNA, 25 bp, Mus musculus
cctgagttttggtccagttgggctg

SEQ ID NO: 354872 - DNA, 25 bp, Mus musculus
cctgataaccacagtatttcttttt

SEQ ID NO: 354873 - DNA, 25 bp, Mus musculus
cctgataaccactgtatttcttttt

SEQ ID NO: 354874 - DNA, 25 bp, Mus musculus
cctgataacttcatagctgcctgca

SEQ ID NO: 354875 - DNA, 25 bp, Mus musculus
cctgataacttcttagctgcctgca

SEQ ID NO: 354876 - DNA, 25 bp, Mus musculus
cctgataagcagctccttggactgg

SEQ ID NO: 354877 - DNA, 25 bp, Mus musculus
cctgataagcaggtccttggactgg

SEQ ID NO: 354878 - DNA, 25 bp, Mus musculus
cctgataatgctcccactatatttt

SEQ ID NO: 354879 - DNA, 25 bp, Mus musculus
cctgataatgctgccactatatttt

SEQ ID NO: 354880 - DNA, 25 bp, Mus musculus
cctgatacatgtagggcttctgcac

SEQ ID NO: 354881 - DNA, 25 bp, Mus musculus
cctgatacatgttgggcttctgcac

SEQ ID NO: 354882 - DNA, 25 bp, Mus musculus
cctgataggaccacactggagtgca

SEQ ID NO: 354883 - DNA, 25 bp, Mus musculus
cctgataggacctcactggagtgca

SEQ ID NO: 354884 - DNA, 25 bp, Mus musculus
cctgatagggacagaggcaatgtag

SEQ ID NO: 354885 - DNA, 25 bp, Mus musculus
cctgatagggactgaggcaatgtag

SEQ ID NO: 354886 - DNA, 25 bp, Mus musculus
cctgatagtggcactgattcatggt

SEQ ID NO: 354887 - DNA, 25 bp, Mus musculus
cctgatagtggctctgattcatggt

SEQ ID NO: 354888 - DNA, 25 bp, Mus musculus
cctgatatttttcatgctggtcatg

SEQ ID NO: 354889 - DNA, 25 bp, Mus musculus
cctgatatttttgatgctggtcatg

SEQ ID NO: 354890 - DNA, 25 bp, Mus musculus
cctgatcaaggacagcaagcccgag

SEQ ID NO: 354891 - DNA, 25 bp, Mus musculus
cctgatcaaggagagcaagcccgag

SEQ ID NO: 354892 - DNA, 25 bp, Mus musculus
cctgatcacatcactgatcacggca

SEQ ID NO: 354893 - DNA, 25 bp, Mus musculus
cctgatcacatctctgatcacggca

SEQ ID NO: 354894 - DNA, 25 bp, Mus musculus
cctgatcagggcaatggtcactgct

SEQ ID NO: 354895 - DNA, 25 bp, Mus musculus
cctgatcagggctatggtcactgct

SEQ ID NO: 354896 - DNA, 25 bp, Mus musculus
cctgatcagtagactctgtcacagt

SEQ ID NO: 354897 - DNA, 25 bp, Mus musculus
cctgatcagtagtctctgtcacagt

SEQ ID NO: 354898 - DNA, 25 bp, Mus musculus
cctgatcagtttccttgattattgt

SEQ ID NO: 354899 - DNA, 25 bp, Mus musculus
cctgatcagtttgcttgattattgt

SEQ ID NO: 354900 - DNA, 25 bp, Mus musculus
cctgatcatatacatgagactgcta

SEQ ID NO: 354901 - DNA, 25 bp, Mus musculus
cctgatcatatagatgagactgcta

SEQ ID NO: 354902 - DNA, 25 bp, Mus musculus
cctgatccaattctgttcttctcca

SEQ ID NO: 354903 - DNA, 25 bp, Mus musculus
cctgatccaattgtgttcttctcca

SEQ ID NO: 354904 - DNA, 25 bp, Mus musculus
cctgatctataaagagccttcttgc

SEQ ID NO: 354905 - DNA, 25 bp, Mus musculus
cctgatctataatgagccttcttgc

SEQ ID NO: 354906 - DNA, 25 bp, Mus musculus
cctgatctcagcagacgacgagatg

SEQ ID NO: 354907 - DNA, 25 bp, Mus musculus
cctgatctcagctgacgacgagatg

SEQ ID NO: 354908 - DNA, 25 bp, Mus musculus
cctgatctcatcagaaatgtcaccc

SEQ ID NO: 354909 - DNA, 25 bp, Mus musculus
cctgatctcatctgaaatgtcaccc

SEQ ID NO: 354910 - DNA, 25 bp, Mus musculus
cctgatctcggacgtggagcatcct

SEQ ID NO: 354911 - DNA, 25 bp, Mus musculus
cctgatctcggaggtggagcatcct

SEQ ID NO: 354912 - DNA, 25 bp, Mus musculus
cctgatctctccattatgcttttaa

SEQ ID NO: 354913 - DNA, 25 bp, Mus musculus
cctgatctctcctttatgcttttaa

SEQ ID NO: 354914 - DNA, 25 bp, Mus musculus
cctgatctgggcctatgtgagatag

SEQ ID NO: 354915 - DNA, 25 bp, Mus musculus
cctgatctgggcgtatgtgagatag

SEQ ID NO: 354916 - DNA, 25 bp, Mus musculus
cctgatcttaggcaagttcttggag

SEQ ID NO: 354917 - DNA, 25 bp, Mus musculus
cctgatcttagggaagttcttggag

SEQ ID NO: 354918 - DNA, 25 bp, Mus musculus
cctgatcttgataccaagccagtct

SEQ ID NO: 354919 - DNA, 25 bp, Mus musculus
cctgatcttgattccaagccagtct

SEQ ID NO: 354920 - DNA, 25 bp, Mus musculus
cctgatgaaatgctcttcttcccgt

SEQ ID NO: 354921 - DNA, 25 bp, Mus musculus
cctgatgaaatggtcttcttcccgt

SEQ ID NO: 354922 - DNA, 25 bp, Mus musculus
cctgatgaaattagtagttacattg

SEQ ID NO: 354923 - DNA, 25 bp, Mus musculus
cctgatgaaatttgtagttacattg

SEQ ID NO: 354924 - DNA, 25 bp, Mus musculus
cctgatgaagaacaacccttgggta

SEQ ID NO: 354925 - DNA, 25 bp, Mus musculus
cctgatgaagaagaacccttgggta

SEQ ID NO: 354926 - DNA, 25 bp, Mus musculus
cctgatgaagctagagagatttgaa

SEQ ID NO: 354927 - DNA, 25 bp, Mus musculus
cctgatgaagcttgagagatttgaa

SEQ ID NO: 354928 - DNA, 25 bp, Mus musculus
cctgatgaccttagacctacatatg

SEQ ID NO: 354929 - DNA, 25 bp, Mus musculus
cctgatgacctttgacctacatatg

SEQ ID NO: 354930 - DNA, 25 bp, Mus musculus
cctgatgactgacggcgccgcattt

SEQ ID NO: 354931 - DNA, 25 bp, Mus musculus
cctgatgactgagggcgccgcattt

SEQ ID NO: 354932 - DNA, 25 bp, Mus musculus
cctgatgactgcatagggtttgctt

SEQ ID NO: 354933 - DNA, 25 bp, Mus musculus
cctgatgactgcttagggtttgctt

SEQ ID NO: 354934 - DNA, 25 bp, Mus musculus
cctgatgataggattttaacttaac

SEQ ID NO: 354935 - DNA, 25 bp, Mus musculus
cctgatgataggtttttaacttaac

SEQ ID NO: 354936 - DNA, 25 bp, Mus musculus
cctgatgatcccaccgcagctacca

SEQ ID NO: 354937 - DNA, 25 bp, Mus musculus
cctgatgatccctccgcagctacca

SEQ ID NO: 354938 - DNA, 25 bp, Mus musculus
cctgatgatgcgcttgctctttcct

SEQ ID NO: 354939 - DNA, 25 bp, Mus musculus
cctgatgatgcggttgctctttcct

SEQ ID NO: 354940 - DNA, 25 bp, Mus musculus
cctgatgattttctctagtaacttc

SEQ ID NO: 354941 - DNA, 25 bp, Mus musculus
cctgatgattttgtctagtaacttc

SEQ ID NO: 354942 - DNA, 25 bp, Mus musculus
cctgatgcacatagctgagctggat

SEQ ID NO: 354943 - DNA, 25 bp, Mus musculus
cctgatgcacattgctgagctggat

SEQ ID NO: 354944 - DNA, 25 bp, Mus musculus
cctgatgccgtgacattaggaatat

SEQ ID NO: 354945 - DNA, 25 bp, Mus musculus
cctgatgccgtgtcattaggaatat

SEQ ID NO: 354946 - DNA, 25 bp, Mus musculus
cctgatgcctctataatactcgaac

SEQ ID NO: 354947 - DNA, 25 bp, Mus musculus
cctgatgcctctttaatactcgaac

SEQ ID NO: 354948 - DNA, 25 bp, Mus musculus
cctgatgctgtacactgaacaagta

SEQ ID NO: 354949 - DNA, 25 bp, Mus musculus
cctgatgctgtagactgaacaagta

SEQ ID NO: 354950 - DNA, 25 bp, Mus musculus
cctgatgcttcaaacaatacctcct

SEQ ID NO: 354951 - DNA, 25 bp, Mus musculus
cctgatgcttcatacaatacctcct

SEQ ID NO: 354952 - DNA, 25 bp, Mus musculus
cctgatgcttctctaactggcagaa

SEQ ID NO: 354953 - DNA, 25 bp, Mus musculus
cctgatgcttctgtaactggcagaa

SEQ ID NO: 354954 - DNA, 25 bp, Mus musculus
cctgatggacatccggtgccagcca

SEQ ID NO: 354955 - DNA, 25 bp, Mus musculus
cctgatggacatgcggtgccagcca

SEQ ID NO: 354956 - DNA, 25 bp, Mus musculus
cctgatggatgaatattgctggcta

SEQ ID NO: 354957 - DNA, 25 bp, Mus musculus
cctgatggatgattattgctggcta

SEQ ID NO: 354958 - DNA, 25 bp, Mus musculus
cctgatggcctcactaactggaaga

SEQ ID NO: 354959 - DNA, 25 bp, Mus musculus
cctgatggcctctctaactggaaga

SEQ ID NO: 354960 - DNA, 25 bp, Mus musculus
cctgatgggcctatgagtggccagt

SEQ ID NO: 354961 - DNA, 25 bp, Mus musculus
cctgatgggcctttgagtggccagt

SEQ ID NO: 354962 - DNA, 25 bp, Mus musculus
cctgatggtgatagctggactccaa

SEQ ID NO: 354963 - DNA, 25 bp, Mus musculus
cctgatggtgattgctggactccaa

SEQ ID NO: 354964 - DNA, 25 bp, Mus musculus
cctgatggtgtaaccattcccaaat

SEQ ID NO: 354965 - DNA, 25 bp, Mus musculus
cctgatggtgtatccattcccaaat

SEQ ID NO: 354966 - DNA, 25 bp, Mus musculus
cctgatggttatactccgttctcct

SEQ ID NO: 354967 - DNA, 25 bp, Mus musculus
cctgatggttattctccgttctcct

SEQ ID NO: 354968 - DNA, 25 bp, Mus musculus
cctgatggtttactccagtttccca

SEQ ID NO: 354969 - DNA, 25 bp, Mus musculus
cctgatggtttagtccagtttccca

SEQ ID NO: 354970 - DNA, 25 bp, Mus musculus
cctgatgtacatccttatttattaa

SEQ ID NO: 354971 - DNA, 25 bp, Mus musculus
cctgatgtacatgcttatttattaa

SEQ ID NO: 354972 - DNA, 25 bp, Mus musculus
cctgatgtagtgaccagcccagcag

SEQ ID NO: 354973 - DNA, 25 bp, Mus musculus
cctgatgtagtgtccagcccagcag

SEQ ID NO: 354974 - DNA, 25 bp, Mus musculus
cctgatgtatttagcttattgggtt

SEQ ID NO: 354975 - DNA, 25 bp, Mus musculus
cctgatgtatttatgttcactattt

SEQ ID NO: 354976 - DNA, 25 bp, Mus musculus
cctgatgtattttgcttattgggtt

SEQ ID NO: 354977 - DNA, 25 bp, Mus musculus
cctgatgtatttttgttcactattt

SEQ ID NO: 354978 - DNA, 25 bp, Mus musculus
cctgatgtcgccaacaggcagggat

SEQ ID NO: 354979 - DNA, 25 bp, Mus musculus
cctgatgtcgcctacaggcagggat

SEQ ID NO: 354980 - DNA, 25 bp, Mus musculus
cctgatgtgcttatggtatctgact

SEQ ID NO: 354981 - DNA, 25 bp, Mus musculus
cctgatgtgcttttggtatctgact

SEQ ID NO: 354982 - DNA, 25 bp, Mus musculus
cctgatgtgtatccccaacttgaaa

SEQ ID NO: 354983 - DNA, 25 bp, Mus musculus
cctgatgtgtatgcccaacttgaaa

SEQ ID NO: 354984 - DNA, 25 bp, Mus musculus
cctgatgttcgaagccctagttaaa

SEQ ID NO: 354985 - DNA, 25 bp, Mus musculus
cctgatgttcgatgccctagttaaa

SEQ ID NO: 354986 - DNA, 25 bp, Mus musculus
cctgattaaggcagcgagggccgcc

SEQ ID NO: 354987 - DNA, 25 bp, Mus musculus
cctgattaaggctgcgagggccgcc

SEQ ID NO: 354988 - DNA, 25 bp, Mus musculus
cctgattaagtactgtgctgctaat

SEQ ID NO: 354989 - DNA, 25 bp, Mus musculus
cctgattaagtagtgtgctgctaat

SEQ ID NO: 354990 - DNA, 25 bp, Mus musculus
cctgattacaccctttgaactaact

SEQ ID NO: 354991 - DNA, 25 bp, Mus musculus
cctgattacaccgtttgaactaact

SEQ ID NO: 354992 - DNA, 25 bp, Mus musculus
cctgattaccagaggcttcaccaag

SEQ ID NO: 354993 - DNA, 25 bp, Mus musculus
cctgattaccagtggcttcaccaag

SEQ ID NO: 354994 - DNA, 25 bp, Mus musculus
cctgattcagcaccgaagggttcat

SEQ ID NO: 354995 - DNA, 25 bp, Mus musculus
cctgattcagcagcgaagggttcat

SEQ ID NO: 354996 - DNA, 25 bp, Mus musculus
cctgattccaccatctagtatgttg

SEQ ID NO: 354997 - DNA, 25 bp, Mus musculus
cctgattccaccttctagtatgttg

SEQ ID NO: 354998 - DNA, 25 bp, Mus musculus
cctgattccattctcttcaactaga

SEQ ID NO: 354999 - DNA, 25 bp, Mus musculus
cctgattccattgtcttcaactaga

SEQ ID NO: 355000 - DNA, 25 bp, Mus musculus
cctgattccctccttttaaagcaat

SEQ ID NO: 355001 - DNA, 25 bp, Mus musculus
cctgattccctcgttttaaagcaat

SEQ ID NO: 355002 - DNA, 25 bp, Mus musculus
cctgattcctataccctaaagcata

SEQ ID NO: 355003 - DNA, 25 bp, Mus musculus
cctgattcctattccctaaagcata

SEQ ID NO: 355004 - DNA, 25 bp, Mus musculus
cctgattccttcctgaggctataga

SEQ ID NO: 355005 - DNA, 25 bp, Mus musculus
cctgattccttcgtgaggctataga

SEQ ID NO: 355006 - DNA, 25 bp, Mus musculus
cctgattctgtcatcctggttataa

SEQ ID NO: 355007 - DNA, 25 bp, Mus musculus
cctgattctgtcttcctggttataa

SEQ ID NO: 355008 - DNA, 25 bp, Mus musculus
cctgattgaatcaaacctcatccag

SEQ ID NO: 355009 - DNA, 25 bp, Mus musculus
cctgattgaatctaacctcatccag

SEQ ID NO: 355010 - DNA, 25 bp, Mus musculus
cctgattgacatccagcagtggaaa

SEQ ID NO: 355011 - DNA, 25 bp, Mus musculus
cctgattgacatgcagcagtggaaa

SEQ ID NO: 355012 - DNA, 25 bp, Mus musculus
cctgattgcagacactgtgccagaa

SEQ ID NO: 355013 - DNA, 25 bp, Mus musculus
cctgattgcagagactgtgccagaa

SEQ ID NO: 355014 - DNA, 25 bp, Mus musculus
cctgattgccagctgtgagactgta

SEQ ID NO: 355015 - DNA, 25 bp, Mus musculus
cctgattgccaggtgtgagactgta

SEQ ID NO: 355016 - DNA, 25 bp, Mus musculus
cctgattggcttcttttcgttctaa

SEQ ID NO: 355017 - DNA, 25 bp, Mus musculus
cctgattggcttgttttcgttctaa

SEQ ID NO: 355018 - DNA, 25 bp, Mus musculus
cctgattgggacacgcggctattag

SEQ ID NO: 355019 - DNA, 25 bp, Mus musculus
cctgattgggactcgcggctattag

SEQ ID NO: 355020 - DNA, 25 bp, Mus musculus
cctgattggtttcctgctaaaggca

SEQ ID NO: 355021 - DNA, 25 bp, Mus musculus
cctgattggtttgctgctaaaggca

SEQ ID NO: 355022 - DNA, 25 bp, Mus musculus
cctgatttaaaaccttggctacaag

SEQ ID NO: 355023 - DNA, 25 bp, Mus musculus
cctgatttaaaagcttggctacaag

SEQ ID NO: 355024 - DNA, 25 bp, Mus musculus
cctgatttacagaggataaaggata

SEQ ID NO: 355025 - DNA, 25 bp, Mus musculus
cctgatttacagctctctgacactg

SEQ ID NO: 355026 - DNA, 25 bp, Mus musculus
cctgatttacaggtctctgacactg

SEQ ID NO: 355027 - DNA, 25 bp, Mus musculus
cctgatttacagtggataaaggata

SEQ ID NO: 355028 - DNA, 25 bp, Mus musculus
cctgatttcggtatgctatttttct

SEQ ID NO: 355029 - DNA, 25 bp, Mus musculus
cctgatttcggtttgctatttttct

SEQ ID NO: 355030 - DNA, 25 bp, Mus musculus
cctgatttgtatctctgtctggtga

SEQ ID NO: 355031 - DNA, 25 bp, Mus musculus
cctgatttgtatgtctgtctggtga

SEQ ID NO: 355032 - DNA, 25 bp, Mus musculus
cctgattttaatccttgagtctgtg

SEQ ID NO: 355033 - DNA, 25 bp, Mus musculus
cctgattttaatgcttgagtctgtg

SEQ ID NO: 355034 - DNA, 25 bp, Mus musculus
cctgatttttagctttctggtacac

SEQ ID NO: 355035 - DNA, 25 bp, Mus musculus
cctgatttttaggtttctggtacac

SEQ ID NO: 355036 - DNA, 25 bp, Mus musculus
cctgcaaaatacacaccacgttttc

SEQ ID NO: 355037 - DNA, 25 bp, Mus musculus
cctgcaaaatactcaccacgttttc

SEQ ID NO: 355038 - DNA, 25 bp, Mus musculus
cctgcaaaatggcttcacactgaaa

SEQ ID NO: 355039 - DNA, 25 bp, Mus musculus
cctgcaaaatgggttcacactgaaa

SEQ ID NO: 355040 - DNA, 25 bp, Mus musculus
cctgcaaaggccaggaactggctgt

SEQ ID NO: 355041 - DNA, 25 bp, Mus musculus
cctgcaaaggcctggaactggctgt

SEQ ID NO: 355042 - DNA, 25 bp, Mus musculus
cctgcaaatatgaatgtgactgttg

SEQ ID NO: 355043 - DNA, 25 bp, Mus musculus
cctgcaaatatgtatgtgactgttg

SEQ ID NO: 355044 - DNA, 25 bp, Mus musculus
cctgcaaatcagagttgactgtagc

SEQ ID NO: 355045 - DNA, 25 bp, Mus musculus
cctgcaaatcagtgttgactgtagc

SEQ ID NO: 355046 - DNA, 25 bp, Mus musculus
cctgcaaatgggagtgtggtatgat

SEQ ID NO: 355047 - DNA, 25 bp, Mus musculus
cctgcaaatgggtgtgtggtatgat

SEQ ID NO: 355048 - DNA, 25 bp, Mus musculus
cctgcaacatggcttcgaagtctta

SEQ ID NO: 355049 - DNA, 25 bp, Mus musculus
cctgcaacatgggttcgaagtctta

SEQ ID NO: 355050 - DNA, 25 bp, Mus musculus
cctgcaaccaccagttctaatgagc

SEQ ID NO: 355051 - DNA, 25 bp, Mus musculus
cctgcaaccacctgttctaatgagc

SEQ ID NO: 355052 - DNA, 25 bp, Mus musculus
cctgcaacggatacagaagcagcga

SEQ ID NO: 355053 - DNA, 25 bp, Mus musculus
cctgcaacggattcagaagcagcga

SEQ ID NO: 355054 - DNA, 25 bp, Mus musculus
cctgcaactatcagtggctggaata

SEQ ID NO: 355055 - DNA, 25 bp, Mus musculus
cctgcaactatctgtggctggaata

SEQ ID NO: 355056 - DNA, 25 bp, Mus musculus
cctgcaactatgcaagtggctctta

SEQ ID NO: 355057 - DNA, 25 bp, Mus musculus
cctgcaactatggaagtggctctta

SEQ ID NO: 355058 - DNA, 25 bp, Mus musculus
cctgcaagagtgctgcgtgggctgt

SEQ ID NO: 355059 - DNA, 25 bp, Mus musculus
cctgcaagagtggtgcgtgggctgt

SEQ ID NO: 355060 - DNA, 25 bp, Mus musculus
cctgcaagatgcagcgcgcccgcgg

SEQ ID NO: 355061 - DNA, 25 bp, Mus musculus
cctgcaagatgctgcgcgcccgcgg

SEQ ID NO: 355062 - DNA, 25 bp, Mus musculus
cctgcaaggtccatattaaacctga

SEQ ID NO: 355063 - DNA, 25 bp, Mus musculus
cctgcaaggtccttattaaacctga

SEQ ID NO: 355064 - DNA, 25 bp, Mus musculus
cctgcaagttgtaatctggcttcca

SEQ ID NO: 355065 - DNA, 25 bp, Mus musculus
cctgcaagttgttatctggcttcca

SEQ ID NO: 355066 - DNA, 25 bp, Mus musculus
cctgcaatctttccaaatgccaatt

SEQ ID NO: 355067 - DNA, 25 bp, Mus musculus
cctgcaatctttgcaaatgccaatt

SEQ ID NO: 355068 - DNA, 25 bp, Mus musculus
cctgcaatgtcgctgcaacctgaag

SEQ ID NO: 355069 - DNA, 25 bp, Mus musculus
cctgcaatgtcggtgcaacctgaag

SEQ ID NO: 355070 - DNA, 25 bp, Mus musculus
cctgcacagaaacagccatggagta

SEQ ID NO: 355071 - DNA, 25 bp, Mus musculus
cctgcacagaaagagccatggagta

SEQ ID NO: 355072 - DNA, 25 bp, Mus musculus
cctgcacagcttctgacttcaacat

SEQ ID NO: 355073 - DNA, 25 bp, Mus musculus
cctgcacagcttgtgacttcaacat

SEQ ID NO: 355074 - DNA, 25 bp, Mus musculus
cctgcacagggcaagccctttagga

SEQ ID NO: 355075 - DNA, 25 bp, Mus musculus
cctgcacagggctagccctttagga

SEQ ID NO: 355076 - DNA, 25 bp, Mus musculus
cctgcacccaacaggcaaggagcag

SEQ ID NO: 355077 - DNA, 25 bp, Mus musculus
cctgcacccaactggcaaggagcag

SEQ ID NO: 355078 - DNA, 25 bp, Mus musculus
cctgcacccaagatttgagggcaag

SEQ ID NO: 355079 - DNA, 25 bp, Mus musculus
cctgcacccaagttttgagggcaag

SEQ ID NO: 355080 - DNA, 25 bp, Mus musculus
cctgcaccgactagaggctgggcga

SEQ ID NO: 355081 - DNA, 25 bp, Mus musculus
cctgcaccgacttgaggctgggcga

SEQ ID NO: 355082 - DNA, 25 bp, Mus musculus
cctgcaccgtctctaggacacaaat

SEQ ID NO: 355083 - DNA, 25 bp, Mus musculus
cctgcaccgtctgtaggacacaaat

SEQ ID NO: 355084 - DNA, 25 bp, Mus musculus
cctgcacctctgaaactgtgtaaca

SEQ ID NO: 355085 - DNA, 25 bp, Mus musculus
cctgcacctctgtaactgtgtaaca

SEQ ID NO: 355086 - DNA, 25 bp, Mus musculus
cctgcacctgtgcagattgctgttg

SEQ ID NO: 355087 - DNA, 25 bp, Mus musculus
cctgcacctgtggagattgctgttg

SEQ ID NO: 355088 - DNA, 25 bp, Mus musculus
cctgcaccttcaatattcaagcttg

SEQ ID NO: 355089 - DNA, 25 bp, Mus musculus
cctgcaccttcattattcaagcttg

SEQ ID NO: 355090 - DNA, 25 bp, Mus musculus
cctgcacgcaggctagtggcattgt

SEQ ID NO: 355091 - DNA, 25 bp, Mus musculus
cctgcacgcagggtagtggcattgt

SEQ ID NO: 355092 - DNA, 25 bp, Mus musculus
cctgcacgttgcagttgacatgtac

SEQ ID NO: 355093 - DNA, 25 bp, Mus musculus
cctgcacgttgctgttgacatgtac

SEQ ID NO: 355094 - DNA, 25 bp, Mus musculus
cctgcactaaccaaacacgggatga

SEQ ID NO: 355095 - DNA, 25 bp, Mus musculus
cctgcactaacctaacacgggatga

SEQ ID NO: 355096 - DNA, 25 bp, Mus musculus
cctgcactaatgagcacatttccta

SEQ ID NO: 355097 - DNA, 25 bp, Mus musculus
cctgcactaatgtgcacatttccta

SEQ ID NO: 355098 - DNA, 25 bp, Mus musculus
cctgcactcaggcacttctgaggac

SEQ ID NO: 355099 - DNA, 25 bp, Mus musculus
cctgcactcagggacttctgaggac

SEQ ID NO: 355100 - DNA, 25 bp, Mus musculus
cctgcactcgggaggagaccagaca

SEQ ID NO: 355101 - DNA, 25 bp, Mus musculus
cctgcactcgggtggagaccagaca

SEQ ID NO: 355102 - DNA, 25 bp, Mus musculus
cctgcactgcttctgagtgtttttt

SEQ ID NO: 355103 - DNA, 25 bp, Mus musculus
cctgcactgcttgtgagtgtttttt

SEQ ID NO: 355104 - DNA, 25 bp, Mus musculus
cctgcactgtatatgtgtacaatag

SEQ ID NO: 355105 - DNA, 25 bp, Mus musculus
cctgcactgtatttgtgtacaatag

SEQ ID NO: 355106 - DNA, 25 bp, Mus musculus
cctgcactgtggactatctgtggat

SEQ ID NO: 355107 - DNA, 25 bp, Mus musculus
cctgcactgtggtctatctgtggat

SEQ ID NO: 355108 - DNA, 25 bp, Mus musculus
cctgcactttgcattgctaggagct

SEQ ID NO: 355109 - DNA, 25 bp, Mus musculus
cctgcactttgctttgctaggagct

SEQ ID NO: 355110 - DNA, 25 bp, Mus musculus
cctgcagaatcgatggagtcccaca

SEQ ID NO: 355111 - DNA, 25 bp, Mus musculus
cctgcagaatcgttggagtcccaca

SEQ ID NO: 355112 - DNA, 25 bp, Mus musculus
cctgcagacattacttggtggatca

SEQ ID NO: 355113 - DNA, 25 bp, Mus musculus
cctgcagacatttcttggtggatca

SEQ ID NO: 355114 - DNA, 25 bp, Mus musculus
cctgcagagaatcgagtagacgacc

SEQ ID NO: 355115 - DNA, 25 bp, Mus musculus
cctgcagagaatggagtagacgacc

SEQ ID NO: 355116 - DNA, 25 bp, Mus musculus
cctgcagagatcatttgggtttatt

SEQ ID NO: 355117 - DNA, 25 bp, Mus musculus
cctgcagagatcttttgggtttatt

SEQ ID NO: 355118 - DNA, 25 bp, Mus musculus
cctgcagagcgcatgagctacctgg

SEQ ID NO: 355119 - DNA, 25 bp, Mus musculus
cctgcagagcgcttgagctacctgg

SEQ ID NO: 355120 - DNA, 25 bp, Mus musculus
cctgcagatgaccttattaataaaa

SEQ ID NO: 355121 - DNA, 25 bp, Mus musculus
cctgcagatgacgttattaataaaa

SEQ ID NO: 355122 - DNA, 25 bp, Mus musculus
cctgcagatgctctgctctatggag

SEQ ID NO: 355123 - DNA, 25 bp, Mus musculus
cctgcagatgctgtgctctatggag

SEQ ID NO: 355124 - DNA, 25 bp, Mus musculus
cctgcagcagatcactgaccagaaa

SEQ ID NO: 355125 - DNA, 25 bp, Mus musculus
cctgcagcagatgactgaccagaaa

SEQ ID NO: 355126 - DNA, 25 bp, Mus musculus
cctgcagccacaacttgtgtaggga

SEQ ID NO: 355127 - DNA, 25 bp, Mus musculus
cctgcagccacatcttgtgtaggga

SEQ ID NO: 355128 - DNA, 25 bp, Mus musculus
cctgcagccaccaaagagtgtaggt

SEQ ID NO: 355129 - DNA, 25 bp, Mus musculus
cctgcagccacctaagagtgtaggt

SEQ ID NO: 355130 - DNA, 25 bp, Mus musculus
cctgcagcccatacggtagctagag

SEQ ID NO: 355131 - DNA, 25 bp, Mus musculus
cctgcagcccattcggtagctagag

SEQ ID NO: 355132 - DNA, 25 bp, Mus musculus
cctgcagcccttaaagatggccatt

SEQ ID NO: 355133 - DNA, 25 bp, Mus musculus
cctgcagccctttaagatggccatt

SEQ ID NO: 355134 - DNA, 25 bp, Mus musculus
cctgcagcctttcgtgccagtgtgg

SEQ ID NO: 355135 - DNA, 25 bp, Mus musculus
cctgcagcctttggtgccagtgtgg

SEQ ID NO: 355136 - DNA, 25 bp, Mus musculus
cctgcagctgcgactggatgaagct

SEQ ID NO: 355137 - DNA, 25 bp, Mus musculus
cctgcagctgcgtctggatgaagct

SEQ ID NO: 355138 - DNA, 25 bp, Mus musculus
cctgcagctggaatacgcaacagta

SEQ ID NO: 355139 - DNA, 25 bp, Mus musculus
cctgcagctggactggatgaaatta

SEQ ID NO: 355140 - DNA, 25 bp, Mus musculus
cctgcagctggagtggatgaaatta

SEQ ID NO: 355141 - DNA, 25 bp, Mus musculus
cctgcagctggattacgcaacagta

SEQ ID NO: 355142 - DNA, 25 bp, Mus musculus
cctgcagctgttcgcccgggagatc

SEQ ID NO: 355143 - DNA, 25 bp, Mus musculus
cctgcagctgttggcccgggagatc

SEQ ID NO: 355144 - DNA, 25 bp, Mus musculus
cctgcagcttttacttaaccctgta

SEQ ID NO: 355145 - DNA, 25 bp, Mus musculus
cctgcagctttttcttaaccctgta

SEQ ID NO: 355146 - DNA, 25 bp, Mus musculus
cctgcaggagtccagttggcacaat

SEQ ID NO: 355147 - DNA, 25 bp, Mus musculus
cctgcaggagtcgagttggcacaat

SEQ ID NO: 355148 - DNA, 25 bp, Mus musculus
cctgcaggcaccaagatttctggtt

SEQ ID NO: 355149 - DNA, 25 bp, Mus musculus
cctgcaggcacctagatttctggtt

SEQ ID NO: 355150 - DNA, 25 bp, Mus musculus
cctgcaggcggacctacagtcacag

SEQ ID NO: 355151 - DNA, 25 bp, Mus musculus
cctgcaggcggagctacagtcacag

SEQ ID NO: 355152 - DNA, 25 bp, Mus musculus
cctgcaggtttaacatctgccacag

SEQ ID NO: 355153 - DNA, 25 bp, Mus musculus
cctgcaggtttatcatctgccacag

SEQ ID NO: 355154 - DNA, 25 bp, Mus musculus
cctgcagtacatatatcagctatag

SEQ ID NO: 355155 - DNA, 25 bp, Mus musculus
cctgcagtacatttatcagctatag

SEQ ID NO: 355156 - DNA, 25 bp, Mus musculus
cctgcagtacggaatcctggagtgc

SEQ ID NO: 355157 - DNA, 25 bp, Mus musculus
cctgcagtacggtatcctggagtgc

SEQ ID NO: 355158 - DNA, 25 bp, Mus musculus
cctgcagtactgagtggcgtttcac

SEQ ID NO: 355159 - DNA, 25 bp, Mus musculus
cctgcagtactgtgtggcgtttcac

SEQ ID NO: 355160 - DNA, 25 bp, Mus musculus
cctgcagtcaaaccattcggtggta

SEQ ID NO: 355161 - DNA, 25 bp, Mus musculus
cctgcagtcaaagcattcggtggta

SEQ ID NO: 355162 - DNA, 25 bp, Mus musculus
cctgcagttagtcctcgaaagcatg

SEQ ID NO: 355163 - DNA, 25 bp, Mus musculus
cctgcagttagtgctcgaaagcatg

SEQ ID NO: 355164 - DNA, 25 bp, Mus musculus
cctgcagttgcaaacatctccaaag

SEQ ID NO: 355165 - DNA, 25 bp, Mus musculus
cctgcagttgcatacatctccaaag

SEQ ID NO: 355166 - DNA, 25 bp, Mus musculus
cctgcagttggaacttgggccttca

SEQ ID NO: 355167 - DNA, 25 bp, Mus musculus
cctgcagttggatcttgggccttca

SEQ ID NO: 355168 - DNA, 25 bp, Mus musculus
cctgcataacaaacatcagtagtat

SEQ ID NO: 355169 - DNA, 25 bp, Mus musculus
cctgcataacaatcatcagtagtat

SEQ ID NO: 355170 - DNA, 25 bp, Mus musculus
cctgcatagcctcacattttggatg

SEQ ID NO: 355171 - DNA, 25 bp, Mus musculus
cctgcatagcctgacattttggatg

SEQ ID NO: 355172 - DNA, 25 bp, Mus musculus
cctgcatagggtccacaacttcaga

SEQ ID NO: 355173 - DNA, 25 bp, Mus musculus
cctgcatagggtgcacaacttcaga

SEQ ID NO: 355174 - DNA, 25 bp, Mus musculus
cctgcatatatgcttggtacctcaa

SEQ ID NO: 355175 - DNA, 25 bp, Mus musculus
cctgcatatatggttggtacctcaa

SEQ ID NO: 355176 - DNA, 25 bp, Mus musculus
cctgcatcagcaactatttccttaa

SEQ ID NO: 355177 - DNA, 25 bp, Mus musculus
cctgcatcagcatctatttccttaa

SEQ ID NO: 355178 - DNA, 25 bp, Mus musculus
cctgcatccatgactgatgggtcat

SEQ ID NO: 355179 - DNA, 25 bp, Mus musculus
cctgcatccatgtctgatgggtcat

SEQ ID NO: 355180 - DNA, 25 bp, Mus musculus
cctgcatcccaaatacagctggtat

SEQ ID NO: 355181 - DNA, 25 bp, Mus musculus
cctgcatcccaattacagctggtat

SEQ ID NO: 355182 - DNA, 25 bp, Mus musculus
cctgcatccctgagcggcgcttggg

SEQ ID NO: 355183 - DNA, 25 bp, Mus musculus
cctgcatccctgtgcggcgcttggg

SEQ ID NO: 355184 - DNA, 25 bp, Mus musculus
cctgcatcctccagaagaggtcata

SEQ ID NO: 355185 - DNA, 25 bp, Mus musculus
cctgcatcctcctgaagaggtcata

SEQ ID NO: 355186 - DNA, 25 bp, Mus musculus
cctgcatcctgcatgtgtcaaaaca

SEQ ID NO: 355187 - DNA, 25 bp, Mus musculus
cctgcatcctgcttgtgtcaaaaca

SEQ ID NO: 355188 - DNA, 25 bp, Mus musculus
cctgcatcctttaatttaagacaat

SEQ ID NO: 355189 - DNA, 25 bp, Mus musculus
cctgcatcctttcgttgacaattct

SEQ ID NO: 355190 - DNA, 25 bp, Mus musculus
cctgcatcctttggttgacaattct

SEQ ID NO: 355191 - DNA, 25 bp, Mus musculus
cctgcatccttttatttaagacaat

SEQ ID NO: 355192 - DNA, 25 bp, Mus musculus
cctgcatcgcttacatacacataat

SEQ ID NO: 355193 - DNA, 25 bp, Mus musculus
cctgcatcgctttcatacacataat

SEQ ID NO: 355194 - DNA, 25 bp, Mus musculus
cctgcatctgaccttgtctatacta

SEQ ID NO: 355195 - DNA, 25 bp, Mus musculus
cctgcatctgacgttgtctatacta

SEQ ID NO: 355196 - DNA, 25 bp, Mus musculus
cctgcatctgcgcctttggtcgaaa

SEQ ID NO: 355197 - DNA, 25 bp, Mus musculus
cctgcatctgcggctttggtcgaaa

SEQ ID NO: 355198 - DNA, 25 bp, Mus musculus
cctgcatctgtgcaaaagtccccag

SEQ ID NO: 355199 - DNA, 25 bp, Mus musculus
cctgcatctgtggaaaagtccccag

SEQ ID NO: 355200 - DNA, 25 bp, Mus musculus
cctgcatgccatcatcaaagctgaa

SEQ ID NO: 355201 - DNA, 25 bp, Mus musculus
cctgcatgccatgatcaaagctgaa

SEQ ID NO: 355202 - DNA, 25 bp, Mus musculus
cctgcatgcgctattagtttctagt

SEQ ID NO: 355203 - DNA, 25 bp, Mus musculus
cctgcatgcgcttttagtttctagt

SEQ ID NO: 355204 - DNA, 25 bp, Mus musculus
cctgcatgggacaggcctgggccct

SEQ ID NO: 355205 - DNA, 25 bp, Mus musculus
cctgcatgggactggcctgggccct

SEQ ID NO: 355206 - DNA, 25 bp, Mus musculus
cctgcatgggcgagctgatgacctc

SEQ ID NO: 355207 - DNA, 25 bp, Mus musculus
cctgcatgggcgtgctgatgacctc

SEQ ID NO: 355208 - DNA, 25 bp, Mus musculus
cctgcatgtgtaagtaccgtgcatg

SEQ ID NO: 355209 - DNA, 25 bp, Mus musculus
cctgcatgtgtatgtaccgtgcatg

SEQ ID NO: 355210 - DNA, 25 bp, Mus musculus
cctgcatgttggaatctgtactgtt

SEQ ID NO: 355211 - DNA, 25 bp, Mus musculus
cctgcatgttggtatctgtactgtt

SEQ ID NO: 355212 - DNA, 25 bp, Mus musculus
cctgcattcacacggtgtacataca

SEQ ID NO: 355213 - DNA, 25 bp, Mus musculus
cctgcattcacagggtgtacataca

SEQ ID NO: 355214 - DNA, 25 bp, Mus musculus
cctgcattgcccctaaactgtagaa

SEQ ID NO: 355215 - DNA, 25 bp, Mus musculus
cctgcattgcccgtaaactgtagaa

SEQ ID NO: 355216 - DNA, 25 bp, Mus musculus
cctgccaaaaccacgtgggtagctg

SEQ ID NO: 355217 - DNA, 25 bp, Mus musculus
cctgccaaaacctcgtgggtagctg

SEQ ID NO: 355218 - DNA, 25 bp, Mus musculus
cctgccaaagcaaagatacctcaaa

SEQ ID NO: 355219 - DNA, 25 bp, Mus musculus
cctgccaaagcatagatacctcaaa

SEQ ID NO: 355220 - DNA, 25 bp, Mus musculus
cctgccaaggttagctccatggaaa

SEQ ID NO: 355221 - DNA, 25 bp, Mus musculus
cctgccaaggtttgctccatggaaa

SEQ ID NO: 355222 - DNA, 25 bp, Mus musculus
cctgccaatgtaatcacttcactaa

SEQ ID NO: 355223 - DNA, 25 bp, Mus musculus
cctgccaatgtattcacttcactaa

SEQ ID NO: 355224 - DNA, 25 bp, Mus musculus
cctgccacattgagatgatcctcac

SEQ ID NO: 355225 - DNA, 25 bp, Mus musculus
cctgccacattgtgatgatcctcac

SEQ ID NO: 355226 - DNA, 25 bp, Mus musculus
cctgccacccagctatggacagatg

SEQ ID NO: 355227 - DNA, 25 bp, Mus musculus
cctgccacccaggtatggacagatg

SEQ ID NO: 355228 - DNA, 25 bp, Mus musculus
cctgccacctttctgtcttaaatat

SEQ ID NO: 355229 - DNA, 25 bp, Mus musculus
cctgccacctttgtgtcttaaatat

SEQ ID NO: 355230 - DNA, 25 bp, Mus musculus
cctgccacgtgccagggcgtgcgga

SEQ ID NO: 355231 - DNA, 25 bp, Mus musculus
cctgccacgtgcgagggcgtgcgga

SEQ ID NO: 355232 - DNA, 25 bp, Mus musculus
cctgccactgacaggttaggactct

SEQ ID NO: 355233 - DNA, 25 bp, Mus musculus
cctgccactgactggttaggactct

SEQ ID NO: 355234 - DNA, 25 bp, Mus musculus
cctgccagaacaccatctttttgtt

SEQ ID NO: 355235 - DNA, 25 bp, Mus musculus
cctgccagaacagcatctttttgtt

SEQ ID NO: 355236 - DNA, 25 bp, Mus musculus
cctgccagcatgaactttgttgttg

SEQ ID NO: 355237 - DNA, 25 bp, Mus musculus
cctgccagcatgtactttgttgttg

SEQ ID NO: 355238 - DNA, 25 bp, Mus musculus
cctgccaggcagactcggtggagca

SEQ ID NO: 355239 - DNA, 25 bp, Mus musculus
cctgccaggcagtctcggtggagca

SEQ ID NO: 355240 - DNA, 25 bp, Mus musculus
cctgccagggaacggctcttctagt

SEQ ID NO: 355241 - DNA, 25 bp, Mus musculus
cctgccagggaagggctcttctagt

SEQ ID NO: 355242 - DNA, 25 bp, Mus musculus
cctgccagtcctcttttttactttg

SEQ ID NO: 355243 - DNA, 25 bp, Mus musculus
cctgccagtcctgttttttactttg

SEQ ID NO: 355244 - DNA, 25 bp, Mus musculus
cctgccagtcttcgtctcgtcttga

SEQ ID NO: 355245 - DNA, 25 bp, Mus musculus
cctgccagtcttggtctcgtcttga

SEQ ID NO: 355246 - DNA, 25 bp, Mus musculus
cctgccatagagctgggatattgtt

SEQ ID NO: 355247 - DNA, 25 bp, Mus musculus
cctgccatagaggtgggatattgtt

SEQ ID NO: 355248 - DNA, 25 bp, Mus musculus
cctgccatcataatcaagataagag

SEQ ID NO: 355249 - DNA, 25 bp, Mus musculus
cctgccatcatattcaagataagag

SEQ ID NO: 355250 - DNA, 25 bp, Mus musculus
cctgccatctcacctggactagata

SEQ ID NO: 355251 - DNA, 25 bp, Mus musculus
cctgccatctcagctggactagata

SEQ ID NO: 355252 - DNA, 25 bp, Mus musculus
cctgccatgaaactttcaccgtggg

SEQ ID NO: 355253 - DNA, 25 bp, Mus musculus
cctgccatgaaagtttcaccgtggg

SEQ ID NO: 355254 - DNA, 25 bp, Mus musculus
cctgccatgagtactttgaacatga

SEQ ID NO: 355255 - DNA, 25 bp, Mus musculus
cctgccatgagttctttgaacatga

SEQ ID NO: 355256 - DNA, 25 bp, Mus musculus
cctgccattcctaatgttctggaga

SEQ ID NO: 355257 - DNA, 25 bp, Mus musculus
cctgccattccttatgttctggaga

SEQ ID NO: 355258 - DNA, 25 bp, Mus musculus
cctgccattcgtcgcttagggaaaa

SEQ ID NO: 355259 - DNA, 25 bp, Mus musculus
cctgccattcgtggcttagggaaaa

SEQ ID NO: 355260 - DNA, 25 bp, Mus musculus
cctgccattggacttgtcagctaat

SEQ ID NO: 355261 - DNA, 25 bp, Mus musculus
cctgccattggagttgtcagctaat

SEQ ID NO: 355262 - DNA, 25 bp, Mus musculus
cctgccattggcctgtgtagagatg

SEQ ID NO: 355263 - DNA, 25 bp, Mus musculus
cctgccattggcgtgtgtagagatg

SEQ ID NO: 355264 - DNA, 25 bp, Mus musculus
cctgccatttgtccttgcaaactaa

SEQ ID NO: 355265 - DNA, 25 bp, Mus musculus
cctgccatttgtgcttgcaaactaa

SEQ ID NO: 355266 - DNA, 25 bp, Mus musculus
cctgccatttttcaagaatattctt

SEQ ID NO: 355267 - DNA, 25 bp, Mus musculus
cctgccatttttgaagaatattctt

SEQ ID NO: 355268 - DNA, 25 bp, Mus musculus
cctgcccaaaggactcgggttgtct

SEQ ID NO: 355269 - DNA, 25 bp, Mus musculus
cctgcccaaaggtctcgggttgtct

SEQ ID NO: 355270 - DNA, 25 bp, Mus musculus
cctgcccaaggaacagactctgagt

SEQ ID NO: 355271 - DNA, 25 bp, Mus musculus
cctgcccaaggatcagactctgagt

SEQ ID NO: 355272 - DNA, 25 bp, Mus musculus
cctgcccaatgaccggagaccggga

SEQ ID NO: 355273 - DNA, 25 bp, Mus musculus
cctgcccaatgagcggagaccggga

SEQ ID NO: 355274 - DNA, 25 bp, Mus musculus
cctgcccaatgtattgttcccaaat

SEQ ID NO: 355275 - DNA, 25 bp, Mus musculus
cctgcccaatgttttgttcccaaat

SEQ ID NO: 355276 - DNA, 25 bp, Mus musculus
cctgcccacgaacgagtcaaaactg

SEQ ID NO: 355277 - DNA, 25 bp, Mus musculus
cctgcccacgaaggagtcaaaactg

SEQ ID NO: 355278 - DNA, 25 bp, Mus musculus
cctgcccagggccagttcaaattaa

SEQ ID NO: 355279 - DNA, 25 bp, Mus musculus
cctgcccagggcgagttcaaattaa

SEQ ID NO: 355280 - DNA, 25 bp, Mus musculus
cctgcccagtttaaagtgtgatgta

SEQ ID NO: 355281 - DNA, 25 bp, Mus musculus
cctgcccagttttaagtgtgatgta

SEQ ID NO: 355282 - DNA, 25 bp, Mus musculus
cctgccccacctatgtgtgaaataa

SEQ ID NO: 355283 - DNA, 25 bp, Mus musculus
cctgccccacctttgtgtgaaataa

SEQ ID NO: 355284 - DNA, 25 bp, Mus musculus
cctgccccagtgcatacagtggaag

SEQ ID NO: 355285 - DNA, 25 bp, Mus musculus
cctgccccagtggatacagtggaag

SEQ ID NO: 355286 - DNA, 25 bp, Mus musculus
cctgccccatggaacaacttgagag

SEQ ID NO: 355287 - DNA, 25 bp, Mus musculus
cctgccccatggtacaacttgagag

SEQ ID NO: 355288 - DNA, 25 bp, Mus musculus
cctgcccctgagatggaccatgaat

SEQ ID NO: 355289 - DNA, 25 bp, Mus musculus
cctgcccctgagttggaccatgaat

SEQ ID NO: 355290 - DNA, 25 bp, Mus musculus
cctgcccgaaggacaacttctacat

SEQ ID NO: 355291 - DNA, 25 bp, Mus musculus
cctgcccgaaggtcaacttctacat

SEQ ID NO: 355292 - DNA, 25 bp, Mus musculus
cctgcccgagcaaatctggaaattc

SEQ ID NO: 355293 - DNA, 25 bp, Mus musculus
cctgcccgagcatatctggaaattc

SEQ ID NO: 355294 - DNA, 25 bp, Mus musculus
cctgcccgagtgcattgacttgtaa

SEQ ID NO: 355295 - DNA, 25 bp, Mus musculus
cctgcccgagtggattgacttgtaa

SEQ ID NO: 355296 - DNA, 25 bp, Mus musculus
cctgcccgctggcagaagatggctt

SEQ ID NO: 355297 - DNA, 25 bp, Mus musculus
cctgcccgctgggagaagatggctt

SEQ ID NO: 355298 - DNA, 25 bp, Mus musculus
cctgccctacagcatccatgtgaag

SEQ ID NO: 355299 - DNA, 25 bp, Mus musculus
cctgccctacaggatccatgtgaag

SEQ ID NO: 355300 - DNA, 25 bp, Mus musculus
cctgccctagagactcctatttttt

SEQ ID NO: 355301 - DNA, 25 bp, Mus musculus
cctgccctagagtctcctatttttt

SEQ ID NO: 355302 - DNA, 25 bp, Mus musculus
cctgccctaggaactcctgggtgga

SEQ ID NO: 355303 - DNA, 25 bp, Mus musculus
cctgccctaggatctcctgggtgga

SEQ ID NO: 355304 - DNA, 25 bp, Mus musculus
cctgccctatcacagtctgacttga

SEQ ID NO: 355305 - DNA, 25 bp, Mus musculus
cctgccctatcagagtctgacttga

SEQ ID NO: 355306 - DNA, 25 bp, Mus musculus
cctgccctcagaatctatagactag

SEQ ID NO: 355307 - DNA, 25 bp, Mus musculus
cctgccctcagattctatagactag

SEQ ID NO: 355308 - DNA, 25 bp, Mus musculus
cctgccctcattatagttggctaaa

SEQ ID NO: 355309 - DNA, 25 bp, Mus musculus
cctgccctcattttagttggctaaa

SEQ ID NO: 355310 - DNA, 25 bp, Mus musculus
cctgccctgaacagccagggtggag

SEQ ID NO: 355311 - DNA, 25 bp, Mus musculus
cctgccctgaactgccagggtggag

SEQ ID NO: 355312 - DNA, 25 bp, Mus musculus
cctgccctggccctgtagagctgga

SEQ ID NO: 355313 - DNA, 25 bp, Mus musculus
cctgccctggccgtgtagagctgga

SEQ ID NO: 355314 - DNA, 25 bp, Mus musculus
cctgccctgtcaatcactgattagg

SEQ ID NO: 355315 - DNA, 25 bp, Mus musculus
cctgccctgtcattcactgattagg

SEQ ID NO: 355316 - DNA, 25 bp, Mus musculus
cctgccctgtttatctttgagatta

SEQ ID NO: 355317 - DNA, 25 bp, Mus musculus
cctgccctgtttttctttgagatta

SEQ ID NO: 355318 - DNA, 25 bp, Mus musculus
cctgcccttccaaactgtgtttaat

SEQ ID NO: 355319 - DNA, 25 bp, Mus musculus
cctgcccttccatactgtgtttaat

SEQ ID NO: 355320 - DNA, 25 bp, Mus musculus
cctgcccttctgcatagggtagctg

SEQ ID NO: 355321 - DNA, 25 bp, Mus musculus
cctgcccttctggatagggtagctg

SEQ ID NO: 355322 - DNA, 25 bp, Mus musculus
cctgccctttgtcagacagtgatga

SEQ ID NO: 355323 - DNA, 25 bp, Mus musculus
cctgccctttgtgagacagtgatga

SEQ ID NO: 355324 - DNA, 25 bp, Mus musculus
cctgccgaatatatctggtgggatt

SEQ ID NO: 355325 - DNA, 25 bp, Mus musculus
cctgccgaatatttctggtgggatt

SEQ ID NO: 355326 - DNA, 25 bp, Mus musculus
cctgccgcatctccgatgactttgg

SEQ ID NO: 355327 - DNA, 25 bp, Mus musculus
cctgccgcatctgcgatgactttgg

SEQ ID NO: 355328 - DNA, 25 bp, Mus musculus
cctgccgggtgaatgctgcagactg

SEQ ID NO: 355329 - DNA, 25 bp, Mus musculus
cctgccgggtgattgctgcagactg

SEQ ID NO: 355330 - DNA, 25 bp, Mus musculus
cctgccgtctgaacatgggtggtca

SEQ ID NO: 355331 - DNA, 25 bp, Mus musculus
cctgccgtctgatcatgggtggtca

SEQ ID NO: 355332 - DNA, 25 bp, Mus musculus
cctgccgtctgtcttaggcattttt

SEQ ID NO: 355333 - DNA, 25 bp, Mus musculus
cctgccgtctgtgttaggcattttt

SEQ ID NO: 355334 - DNA, 25 bp, Mus musculus
cctgcctaaaagcttacacgttatg

SEQ ID NO: 355335 - DNA, 25 bp, Mus musculus
cctgcctaaaaggttacacgttatg

SEQ ID NO: 355336 - DNA, 25 bp, Mus musculus
cctgcctaccatagcttgtgggaga

SEQ ID NO: 355337 - DNA, 25 bp, Mus musculus
cctgcctaccattgcttgtgggaga

SEQ ID NO: 355338 - DNA, 25 bp, Mus musculus
cctgcctacctgatgcataaggatg

SEQ ID NO: 355339 - DNA, 25 bp, Mus musculus
cctgcctacctgttgcataaggatg

SEQ ID NO: 355340 - DNA, 25 bp, Mus musculus
cctgcctagccaagggtatggtgaa

SEQ ID NO: 355341 - DNA, 25 bp, Mus musculus
cctgcctagccatgggtatggtgaa

SEQ ID NO: 355342 - DNA, 25 bp, Mus musculus
cctgcctaggtccttgcagggaact

SEQ ID NO: 355343 - DNA, 25 bp, Mus musculus
cctgcctaggtcgttgcagggaact

SEQ ID NO: 355344 - DNA, 25 bp, Mus musculus
cctgcctagtttacaaatgccaaga

SEQ ID NO: 355345 - DNA, 25 bp, Mus musculus
cctgcctagttttcaaatgccaaga

SEQ ID NO: 355346 - DNA, 25 bp, Mus musculus
cctgcctatccgataacttatttat

SEQ ID NO: 355347 - DNA, 25 bp, Mus musculus
cctgcctatccgttaacttatttat

SEQ ID NO: 355348 - DNA, 25 bp, Mus musculus
cctgcctcctatcactcgagagaaa

SEQ ID NO: 355349 - DNA, 25 bp, Mus musculus
cctgcctcctatgactcgagagaaa

SEQ ID NO: 355350 - DNA, 25 bp, Mus musculus
cctgcctccttcaagaaactttagg

SEQ ID NO: 355351 - DNA, 25 bp, Mus musculus
cctgcctccttctagaaactttagg

SEQ ID NO: 355352 - DNA, 25 bp, Mus musculus
cctgcctctataacctgagtgtggg

SEQ ID NO: 355353 - DNA, 25 bp, Mus musculus
cctgcctctatatcctgagtgtggg

SEQ ID NO: 355354 - DNA, 25 bp, Mus musculus
cctgcctctggaagactggatatgt

SEQ ID NO: 355355 - DNA, 25 bp, Mus musculus
cctgcctctggatgactggatatgt

SEQ ID NO: 355356 - DNA, 25 bp, Mus musculus
cctgcctcttccatggtaatgaata

SEQ ID NO: 355357 - DNA, 25 bp, Mus musculus
cctgcctcttccttggtaatgaata

SEQ ID NO: 355358 - DNA, 25 bp, Mus musculus
cctgcctgaatcaaaccttggacaa

SEQ ID NO: 355359 - DNA, 25 bp, Mus musculus
cctgcctgaatctaaccttggacaa

SEQ ID NO: 355360 - DNA, 25 bp, Mus musculus
cctgcctgacatcggcctgagaagg

SEQ ID NO: 355361 - DNA, 25 bp, Mus musculus
cctgcctgacatgggcctgagaagg

SEQ ID NO: 355362 - DNA, 25 bp, Mus musculus
cctgcctgagcccacagagctggga

SEQ ID NO: 355363 - DNA, 25 bp, Mus musculus
cctgcctgagccgacagagctggga

SEQ ID NO: 355364 - DNA, 25 bp, Mus musculus
cctgcctgcaaaattcaggtgatga

SEQ ID NO: 355365 - DNA, 25 bp, Mus musculus
cctgcctgcaaatttcaggtgatga

SEQ ID NO: 355366 - DNA, 25 bp, Mus musculus
cctgcctgcctacctggttgtgaag

SEQ ID NO: 355367 - DNA, 25 bp, Mus musculus
cctgcctgcctagctggttgtgaag

SEQ ID NO: 355368 - DNA, 25 bp, Mus musculus
cctgcctgcctcaagatgtagctga

SEQ ID NO: 355369 - DNA, 25 bp, Mus musculus
cctgcctgcctctagatgtagctga

SEQ ID NO: 355370 - DNA, 25 bp, Mus musculus
cctgcctgctaaaacggtctgatta

SEQ ID NO: 355371 - DNA, 25 bp, Mus musculus
cctgcctgctaatacggtctgatta

SEQ ID NO: 355372 - DNA, 25 bp, Mus musculus
cctgcctggaatatcacttcattca

SEQ ID NO: 355373 - DNA, 25 bp, Mus musculus
cctgcctggaatatggtaggaccct

SEQ ID NO: 355374 - DNA, 25 bp, Mus musculus
cctgcctggaatttcacttcattca

SEQ ID NO: 355375 - DNA, 25 bp, Mus musculus
cctgcctggaatttggtaggaccct

SEQ ID NO: 355376 - DNA, 25 bp, Mus musculus
cctgcctggctacttttttaacata

SEQ ID NO: 355377 - DNA, 25 bp, Mus musculus
cctgcctggctagttttttaacata

SEQ ID NO: 355378 - DNA, 25 bp, Mus musculus
cctgcctggctcaagggagatggat

SEQ ID NO: 355379 - DNA, 25 bp, Mus musculus
cctgcctggctcatggttagaagac

SEQ ID NO: 355380 - DNA, 25 bp, Mus musculus
cctgcctggctctagggagatggat

SEQ ID NO: 355381 - DNA, 25 bp, Mus musculus
cctgcctggctcttggttagaagac

SEQ ID NO: 355382 - DNA, 25 bp, Mus musculus
cctgcctgggacatgaactgtgatg

SEQ ID NO: 355383 - DNA, 25 bp, Mus musculus
cctgcctgggacttgaactgtgatg

SEQ ID NO: 355384 - DNA, 25 bp, Mus musculus
cctgcctgggcaatattgaaacctg

SEQ ID NO: 355385 - DNA, 25 bp, Mus musculus
cctgcctgggcattattgaaacctg

SEQ ID NO: 355386 - DNA, 25 bp, Mus musculus
cctgcctgggccaagaaagtgggta

SEQ ID NO: 355387 - DNA, 25 bp, Mus musculus
cctgcctgggcctagaaagtgggta

SEQ ID NO: 355388 - DNA, 25 bp, Mus musculus
cctgcctggtctcgctttgacacaa

SEQ ID NO: 355389 - DNA, 25 bp, Mus musculus
cctgcctggtctggctttgacacaa

SEQ ID NO: 355390 - DNA, 25 bp, Mus musculus
cctgcctgtttccaagtagtagtcg

SEQ ID NO: 355391 - DNA, 25 bp, Mus musculus
cctgcctgtttcgaagtagtagtcg

SEQ ID NO: 355392 - DNA, 25 bp, Mus musculus
cctgccttaccacaggcacaaggac

SEQ ID NO: 355393 - DNA, 25 bp, Mus musculus
cctgccttaccagaggcacaaggac

SEQ ID NO: 355394 - DNA, 25 bp, Mus musculus
cctgccttccaaatgttcatggttt

SEQ ID NO: 355395 - DNA, 25 bp, Mus musculus
cctgccttccaattgttcatggttt

SEQ ID NO: 355396 - DNA, 25 bp, Mus musculus
cctgccttcgctcacatagacatga

SEQ ID NO: 355397 - DNA, 25 bp, Mus musculus
cctgccttcgctgacatagacatga

SEQ ID NO: 355398 - DNA, 25 bp, Mus musculus
cctgccttctatcttggtgtttaat

SEQ ID NO: 355399 - DNA, 25 bp, Mus musculus
cctgccttctatgttggtgtttaat

SEQ ID NO: 355400 - DNA, 25 bp, Mus musculus
cctgccttgagcctattaaacagcc

SEQ ID NO: 355401 - DNA, 25 bp, Mus musculus
cctgccttgagcgtattaaacagcc

SEQ ID NO: 355402 - DNA, 25 bp, Mus musculus
cctgccttgattcgctggacctatg

SEQ ID NO: 355403 - DNA, 25 bp, Mus musculus
cctgccttgattggctggacctatg

SEQ ID NO: 355404 - DNA, 25 bp, Mus musculus
cctgccttgctcatggaagactgag

SEQ ID NO: 355405 - DNA, 25 bp, Mus musculus
cctgccttgctcttggaagactgag

SEQ ID NO: 355406 - DNA, 25 bp, Mus musculus
cctgccttgtcacagattatcttta

SEQ ID NO: 355407 - DNA, 25 bp, Mus musculus
cctgccttgtcagagattatcttta

SEQ ID NO: 355408 - DNA, 25 bp, Mus musculus
cctgcctttcccaattcctgaaata

SEQ ID NO: 355409 - DNA, 25 bp, Mus musculus
cctgcctttccctattcctgaaata

SEQ ID NO: 355410 - DNA, 25 bp, Mus musculus
cctgcctttgctaatgaacctatta

SEQ ID NO: 355411 - DNA, 25 bp, Mus musculus
cctgcctttgcttatgaacctatta

SEQ ID NO: 355412 - DNA, 25 bp, Mus musculus
cctgcctttgttatgatttctgttg

SEQ ID NO: 355413 - DNA, 25 bp, Mus musculus
cctgcctttgttttgatttctgttg

SEQ ID NO: 355414 - DNA, 25 bp, Mus musculus
cctgccttttatactcatttaacct

SEQ ID NO: 355415 - DNA, 25 bp, Mus musculus
cctgccttttattctcatttaacct

SEQ ID NO: 355416 - DNA, 25 bp, Mus musculus
cctgcgaacatgctgaacgtgccta

SEQ ID NO: 355417 - DNA, 25 bp, Mus musculus
cctgcgaacatggtgaacgtgccta

SEQ ID NO: 355418 - DNA, 25 bp, Mus musculus
cctgcgaattccacgggcgtaagat

SEQ ID NO: 355419 - DNA, 25 bp, Mus musculus
cctgcgaattcctcgggcgtaagat

SEQ ID NO: 355420 - DNA, 25 bp, Mus musculus
cctgcgacctctatcaagtagggaa

SEQ ID NO: 355421 - DNA, 25 bp, Mus musculus
cctgcgacctctttcaagtagggaa

SEQ ID NO: 355422 - DNA, 25 bp, Mus musculus
cctgcgacctgtccgggaaaacata

SEQ ID NO: 355423 - DNA, 25 bp, Mus musculus
cctgcgacctgtgcgggaaaacata

SEQ ID NO: 355424 - DNA, 25 bp, Mus musculus
cctgcgaggagtcctggagctcttt

SEQ ID NO: 355425 - DNA, 25 bp, Mus musculus
cctgcgaggagtgctggagctcttt

SEQ ID NO: 355426 - DNA, 25 bp, Mus musculus
cctgcgagggaaccctaacttcaca

SEQ ID NO: 355427 - DNA, 25 bp, Mus musculus
cctgcgagggaagcctaacttcaca

SEQ ID NO: 355428 - DNA, 25 bp, Mus musculus
cctgcgatctgtaagtcctgtgtta

SEQ ID NO: 355429 - DNA, 25 bp, Mus musculus
cctgcgatctgttagtcctgtgtta

SEQ ID NO: 355430 - DNA, 25 bp, Mus musculus
cctgcgatgctacttttcttaggtt

SEQ ID NO: 355431 - DNA, 25 bp, Mus musculus
cctgcgatgctagttttcttaggtt

SEQ ID NO: 355432 - DNA, 25 bp, Mus musculus
cctgcgattgagcatgagcacctaa

SEQ ID NO: 355433 - DNA, 25 bp, Mus musculus
cctgcgattgaggatgagcacctaa

SEQ ID NO: 355434 - DNA, 25 bp, Mus musculus
cctgcgcagcaaccgtgctgagcaa

SEQ ID NO: 355435 - DNA, 25 bp, Mus musculus
cctgcgcagcaagcgtgctgagcaa

SEQ ID NO: 355436 - DNA, 25 bp, Mus musculus
cctgcgcagttactcttggacttaa

SEQ ID NO: 355437 - DNA, 25 bp, Mus musculus
cctgcgcagttagtcttggacttaa

SEQ ID NO: 355438 - DNA, 25 bp, Mus musculus
cctgcgccacagaaaagtgtgttgg

SEQ ID NO: 355439 - DNA, 25 bp, Mus musculus
cctgcgccacagtaaagtgtgttgg

SEQ ID NO: 355440 - DNA, 25 bp, Mus musculus
cctgcgcctgaaccagagcgggaaa

SEQ ID NO: 355441 - DNA, 25 bp, Mus musculus
cctgcgcctgaagcagagcgggaaa

SEQ ID NO: 355442 - DNA, 25 bp, Mus musculus
cctgcgctctcaatggtatctttag

SEQ ID NO: 355443 - DNA, 25 bp, Mus musculus
cctgcgctctcattggtatctttag

SEQ ID NO: 355444 - DNA, 25 bp, Mus musculus
cctgcgctggccaccttacttagtg

SEQ ID NO: 355445 - DNA, 25 bp, Mus musculus
cctgcgctggcctccttacttagtg

SEQ ID NO: 355446 - DNA, 25 bp, Mus musculus
cctgcgcttcctcggtagagagaaa

SEQ ID NO: 355447 - DNA, 25 bp, Mus musculus
cctgcgcttcctgggtagagagaaa

SEQ ID NO: 355448 - DNA, 25 bp, Mus musculus
cctgcgcttgatacggcctggacgg

SEQ ID NO: 355449 - DNA, 25 bp, Mus musculus
cctgcgcttgattcggcctggacgg

SEQ ID NO: 355450 - DNA, 25 bp, Mus musculus
cctgcgctttctccaataagtctga

SEQ ID NO: 355451 - DNA, 25 bp, Mus musculus
cctgcgctttctgcaataagtctga

SEQ ID NO: 355452 - DNA, 25 bp, Mus musculus
cctgcggacactatgtgttcaaatt

SEQ ID NO: 355453 - DNA, 25 bp, Mus musculus
cctgcggacactttgtgttcaaatt

SEQ ID NO: 355454 - DNA, 25 bp, Mus musculus
cctgcggacggtactggcttttgat

SEQ ID NO: 355455 - DNA, 25 bp, Mus musculus
cctgcggacggttctggcttttgat

SEQ ID NO: 355456 - DNA, 25 bp, Mus musculus
cctgcggagactacctggtattagt

SEQ ID NO: 355457 - DNA, 25 bp, Mus musculus
cctgcggagacttcctggtattagt

SEQ ID NO: 355458 - DNA, 25 bp, Mus musculus
cctgcggagttgagcctgatgtatc

SEQ ID NO: 355459 - DNA, 25 bp, Mus musculus
cctgcggagttgtgcctgatgtatc

SEQ ID NO: 355460 - DNA, 25 bp, Mus musculus
cctgcggcccctccgacccttgcaa

SEQ ID NO: 355461 - DNA, 25 bp, Mus musculus
cctgcggcccctgcgacccttgcaa

SEQ ID NO: 355462 - DNA, 25 bp, Mus musculus
cctgcggcggtgaccagaccgtctg

SEQ ID NO: 355463 - DNA, 25 bp, Mus musculus
cctgcggcggtgtccagaccgtctg

SEQ ID NO: 355464 - DNA, 25 bp, Mus musculus
cctgcggctattaccaagtggtgaa

SEQ ID NO: 355465 - DNA, 25 bp, Mus musculus
cctgcggctatttccaagtggtgaa

SEQ ID NO: 355466 - DNA, 25 bp, Mus musculus
cctgcggctcaactgggcattagca

SEQ ID NO: 355467 - DNA, 25 bp, Mus musculus
cctgcggctcaagtgggcattagca

SEQ ID NO: 355468 - DNA, 25 bp, Mus musculus
cctgcgggaccaacagtggttgact

SEQ ID NO: 355469 - DNA, 25 bp, Mus musculus
cctgcgggaccatcagtggttgact

SEQ ID NO: 355470 - DNA, 25 bp, Mus musculus
cctgcggtgactactccaaactgaa

SEQ ID NO: 355471 - DNA, 25 bp, Mus musculus
cctgcggtgacttctccaaactgaa

SEQ ID NO: 355472 - DNA, 25 bp, Mus musculus
cctgcggttgggagaagctatgcca

SEQ ID NO: 355473 - DNA, 25 bp, Mus musculus
cctgcggttgggtgaagctatgcca

SEQ ID NO: 355474 - DNA, 25 bp, Mus musculus
cctgcgtgagaaatttaccagactt

SEQ ID NO: 355475 - DNA, 25 bp, Mus musculus
cctgcgtgagaattttaccagactt

SEQ ID NO: 355476 - DNA, 25 bp, Mus musculus
cctgcgtgatttagagcaagcttca

SEQ ID NO: 355477 - DNA, 25 bp, Mus musculus
cctgcgtgattttgagcaagcttca

SEQ ID NO: 355478 - DNA, 25 bp, Mus musculus
cctgcgtgcattctttgaggtgagc

SEQ ID NO: 355479 - DNA, 25 bp, Mus musculus
cctgcgtgcattgtttgaggtgagc

SEQ ID NO: 355480 - DNA, 25 bp, Mus musculus
cctgcgtgctccagctgtatgtaga

SEQ ID NO: 355481 - DNA, 25 bp, Mus musculus
cctgcgtgctcctgctgtatgtaga

SEQ ID NO: 355482 - DNA, 25 bp, Mus musculus
cctgcgttgattccggtcctgagac

SEQ ID NO: 355483 - DNA, 25 bp, Mus musculus
cctgcgttgattgcggtcctgagac

SEQ ID NO: 355484 - DNA, 25 bp, Mus musculus
cctgcgttgtgtatagtagctctgc

SEQ ID NO: 355485 - DNA, 25 bp, Mus musculus
cctgcgttgtgtttagtagctctgc

SEQ ID NO: 355486 - DNA, 25 bp, Mus musculus
cctgctaaagccctatgggaatgag

SEQ ID NO: 355487 - DNA, 25 bp, Mus musculus
cctgctaaagccgtatgggaatgag

SEQ ID NO: 355488 - DNA, 25 bp, Mus musculus
cctgctaaagtaaatgattaaactg

SEQ ID NO: 355489 - DNA, 25 bp, Mus musculus
cctgctaaagtatatgattaaactg

SEQ ID NO: 355490 - DNA, 25 bp, Mus musculus
cctgctaacacccttggaaaactgg

SEQ ID NO: 355491 - DNA, 25 bp, Mus musculus
cctgctaacaccgttggaaaactgg

SEQ ID NO: 355492 - DNA, 25 bp, Mus musculus
cctgctaaccagaggaagtggccaa

SEQ ID NO: 355493 - DNA, 25 bp, Mus musculus
cctgctaaccagtggaagtggccaa

SEQ ID NO: 355494 - DNA, 25 bp, Mus musculus
cctgctaagaggcatgcatggctgc

SEQ ID NO: 355495 - DNA, 25 bp, Mus musculus
cctgctaagagggatgcatggctgc

SEQ ID NO: 355496 - DNA, 25 bp, Mus musculus
cctgctaagtttcataattggtggt

SEQ ID NO: 355497 - DNA, 25 bp, Mus musculus
cctgctaagtttgataattggtggt

SEQ ID NO: 355498 - DNA, 25 bp, Mus musculus
cctgctaatcttactacctctattt

SEQ ID NO: 355499 - DNA, 25 bp, Mus musculus
cctgctaatctttctacctctattt

SEQ ID NO: 355500 - DNA, 25 bp, Mus musculus
cctgctacaattcggtttggcatgg

SEQ ID NO: 355501 - DNA, 25 bp, Mus musculus
cctgctacaattgggtttggcatgg

SEQ ID NO: 355502 - DNA, 25 bp, Mus musculus
cctgctacatcactggcgatgttcg

SEQ ID NO: 355503 - DNA, 25 bp, Mus musculus
cctgctacatcagtggcgatgttcg

SEQ ID NO: 355504 - DNA, 25 bp, Mus musculus
cctgctacgcggatctagagagtca

SEQ ID NO: 355505 - DNA, 25 bp, Mus musculus
cctgctacgcggttctagagagtca

SEQ ID NO: 355506 - DNA, 25 bp, Mus musculus
cctgctacgtggcattttttataag

SEQ ID NO: 355507 - DNA, 25 bp, Mus musculus
cctgctacgtgggattttttataag

SEQ ID NO: 355508 - DNA, 25 bp, Mus musculus
cctgctagctagctcaactattggg

SEQ ID NO: 355509 - DNA, 25 bp, Mus musculus
cctgctagctaggtcaactattggg

SEQ ID NO: 355510 - DNA, 25 bp, Mus musculus
cctgctaggtgtacttggtattgaa

SEQ ID NO: 355511 - DNA, 25 bp, Mus musculus
cctgctaggtgttcttggtattgaa

SEQ ID NO: 355512 - DNA, 25 bp, Mus musculus
cctgctagtctgctgcaatgtctga

SEQ ID NO: 355513 - DNA, 25 bp, Mus musculus
cctgctagtctggtgcaatgtctga

SEQ ID NO: 355514 - DNA, 25 bp, Mus musculus
cctgctagtgttaatttatccgagt

SEQ ID NO: 355515 - DNA, 25 bp, Mus musculus
cctgctagtgtttatttatccgagt

SEQ ID NO: 355516 - DNA, 25 bp, Mus musculus
cctgctatacagcagccgaggctag

SEQ ID NO: 355517 - DNA, 25 bp, Mus musculus
cctgctatacaggagccgaggctag

SEQ ID NO: 355518 - DNA, 25 bp, Mus musculus
cctgctatcaataccttgttggtta

SEQ ID NO: 355519 - DNA, 25 bp, Mus musculus
cctgctatcaattccttgttggtta

SEQ ID NO: 355520 - DNA, 25 bp, Mus musculus
cctgctatctgcacacattaggacc

SEQ ID NO: 355521 - DNA, 25 bp, Mus musculus
cctgctatctgctcacattaggacc

SEQ ID NO: 355522 - DNA, 25 bp, Mus musculus
cctgctatgtaacaggtgctcaata

SEQ ID NO: 355523 - DNA, 25 bp, Mus musculus
cctgctatgtaagaggtgctcaata

SEQ ID NO: 355524 - DNA, 25 bp, Mus musculus
cctgctattccaccctcagagaaaa

SEQ ID NO: 355525 - DNA, 25 bp, Mus musculus
cctgctattccagcctcagagaaaa

SEQ ID NO: 355526 - DNA, 25 bp, Mus musculus
cctgctattcttaccaggcaactga

SEQ ID NO: 355527 - DNA, 25 bp, Mus musculus
cctgctattctttccaggcaactga

SEQ ID NO: 355528 - DNA, 25 bp, Mus musculus
cctgctattgataaggttatacctg

SEQ ID NO: 355529 - DNA, 25 bp, Mus musculus
cctgctattgattaggttatacctg

SEQ ID NO: 355530 - DNA, 25 bp, Mus musculus
cctgctattgcacgccaagtataga

SEQ ID NO: 355531 - DNA, 25 bp, Mus musculus
cctgctattgcaggccaagtataga

SEQ ID NO: 355532 - DNA, 25 bp, Mus musculus
cctgctcaacatatcctggtggaaa

SEQ ID NO: 355533 - DNA, 25 bp, Mus musculus
cctgctcaacatttcctggtggaaa

SEQ ID NO: 355534 - DNA, 25 bp, Mus musculus
cctgctcaagggaacactgcctttc

SEQ ID NO: 355535 - DNA, 25 bp, Mus musculus
cctgctcaagggtacactgcctttc

SEQ ID NO: 355536 - DNA, 25 bp, Mus musculus
cctgctcactaaatgactattgaaa

SEQ ID NO: 355537 - DNA, 25 bp, Mus musculus
cctgctcactaattgactattgaaa

SEQ ID NO: 355538 - DNA, 25 bp, Mus musculus
cctgctcatccgctgtcaaataaaa

SEQ ID NO: 355539 - DNA, 25 bp, Mus musculus
cctgctcatccggtgtcaaataaaa

SEQ ID NO: 355540 - DNA, 25 bp, Mus musculus
cctgctccaaagcagggtaaccctg

SEQ ID NO: 355541 - DNA, 25 bp, Mus musculus
cctgctccaaaggagggtaaccctg

SEQ ID NO: 355542 - DNA, 25 bp, Mus musculus
cctgctccaagacactgtagatgct

SEQ ID NO: 355543 - DNA, 25 bp, Mus musculus
cctgctccaagagactgtagatgct

SEQ ID NO: 355544 - DNA, 25 bp, Mus musculus
cctgctccaggaatcaaaactcttg

SEQ ID NO: 355545 - DNA, 25 bp, Mus musculus
cctgctccaggattcaaaactcttg

SEQ ID NO: 355546 - DNA, 25 bp, Mus musculus
cctgctccatgacaagcggtatctc

SEQ ID NO: 355547 - DNA, 25 bp, Mus musculus
cctgctccatgagaagcggtatctc

SEQ ID NO: 355548 - DNA, 25 bp, Mus musculus
cctgctcccatacccaggtttggtt

SEQ ID NO: 355549 - DNA, 25 bp, Mus musculus
cctgctcccatagccaggtttggtt

SEQ ID NO: 355550 - DNA, 25 bp, Mus musculus
cctgctcccgaacgatgctagacta

SEQ ID NO: 355551 - DNA, 25 bp, Mus musculus
cctgctcccgaaggatgctagacta

SEQ ID NO: 355552 - DNA, 25 bp, Mus musculus
cctgctccgcttacaaattcaatag

SEQ ID NO: 355553 - DNA, 25 bp, Mus musculus
cctgctccgctttcaaattcaatag

SEQ ID NO: 355554 - DNA, 25 bp, Mus musculus
cctgctccgggtagggatgcataga

SEQ ID NO: 355555 - DNA, 25 bp, Mus musculus
cctgctccgggttgggatgcataga

SEQ ID NO: 355556 - DNA, 25 bp, Mus musculus
cctgctcctgacaaaaacacacaaa

SEQ ID NO: 355557 - DNA, 25 bp, Mus musculus
cctgctcctgactaaaacacacaaa

SEQ ID NO: 355558 - DNA, 25 bp, Mus musculus
cctgctccttcactagtggtgatat

SEQ ID NO: 355559 - DNA, 25 bp, Mus musculus
cctgctccttcagtagtggtgatat

SEQ ID NO: 355560 - DNA, 25 bp, Mus musculus
cctgctccttgaacattaccaaaga

SEQ ID NO: 355561 - DNA, 25 bp, Mus musculus
cctgctccttgatcattaccaaaga

SEQ ID NO: 355562 - DNA, 25 bp, Mus musculus
cctgctccttggatagctttttcaa

SEQ ID NO: 355563 - DNA, 25 bp, Mus musculus
cctgctccttggcaagtctttggac

SEQ ID NO: 355564 - DNA, 25 bp, Mus musculus
cctgctccttgggaagtctttggac

SEQ ID NO: 355565 - DNA, 25 bp, Mus musculus
cctgctccttggttagctttttcaa

SEQ ID NO: 355566 - DNA, 25 bp, Mus musculus
cctgctccttttaacctgtttgatg

SEQ ID NO: 355567 - DNA, 25 bp, Mus musculus
cctgctcctttttacctgtttgatg

SEQ ID NO: 355568 - DNA, 25 bp, Mus musculus
cctgctcgtgccacagttgtcacag

SEQ ID NO: 355569 - DNA, 25 bp, Mus musculus
cctgctcgtgcctcagttgtcacag

SEQ ID NO: 355570 - DNA, 25 bp, Mus musculus
cctgctctaaccatgacagttcgga

SEQ ID NO: 355571 - DNA, 25 bp, Mus musculus
cctgctctaaccttgacagttcgga

SEQ ID NO: 355572 - DNA, 25 bp, Mus musculus
cctgctctaggcagggatggccaag

SEQ ID NO: 355573 - DNA, 25 bp, Mus musculus
cctgctctaggctgggatggccaag

SEQ ID NO: 355574 - DNA, 25 bp, Mus musculus
cctgctctcctcaggagttagtggg

SEQ ID NO: 355575 - DNA, 25 bp, Mus musculus
cctgctctcctctggagttagtggg

SEQ ID NO: 355576 - DNA, 25 bp, Mus musculus
cctgctctctggagtgctgtatata

SEQ ID NO: 355577 - DNA, 25 bp, Mus musculus
cctgctctctggtgtgctgtatata

SEQ ID NO: 355578 - DNA, 25 bp, Mus musculus
cctgctctgaatagctccaacttca

SEQ ID NO: 355579 - DNA, 25 bp, Mus musculus
cctgctctgaattgctccaacttca

SEQ ID NO: 355580 - DNA, 25 bp, Mus musculus
cctgctctgcttagttgtcgtgtct

SEQ ID NO: 355581 - DNA, 25 bp, Mus musculus
cctgctctgctttgttgtcgtgtct

SEQ ID NO: 355582 - DNA, 25 bp, Mus musculus
cctgctctgggtcggcatctacgta

SEQ ID NO: 355583 - DNA, 25 bp, Mus musculus
cctgctctgggtgggcatctacgta

SEQ ID NO: 355584 - DNA, 25 bp, Mus musculus
cctgctctggtcatctgaatctaga

SEQ ID NO: 355585 - DNA, 25 bp, Mus musculus
cctgctctggtcttctgaatctaga

SEQ ID NO: 355586 - DNA, 25 bp, Mus musculus
cctgctctgtaaacattcccttaat

SEQ ID NO: 355587 - DNA, 25 bp, Mus musculus
cctgctctgtaatcattcccttaat

SEQ ID NO: 355588 - DNA, 25 bp, Mus musculus
cctgctctgtagagatatgtcttaa

SEQ ID NO: 355589 - DNA, 25 bp, Mus musculus
cctgctctgtagtgatatgtcttaa

SEQ ID NO: 355590 - DNA, 25 bp, Mus musculus
cctgctctgtggcttggcatgagat

SEQ ID NO: 355591 - DNA, 25 bp, Mus musculus
cctgctctgtgggttggcatgagat

SEQ ID NO: 355592 - DNA, 25 bp, Mus musculus
cctgctcttaggacaagttgtgttc

SEQ ID NO: 355593 - DNA, 25 bp, Mus musculus
cctgctcttaggtcaagttgtgttc

SEQ ID NO: 355594 - DNA, 25 bp, Mus musculus
cctgctcttgagagttgtcagactt

SEQ ID NO: 355595 - DNA, 25 bp, Mus musculus
cctgctcttgagtgttgtcagactt

SEQ ID NO: 355596 - DNA, 25 bp, Mus musculus
cctgctctttcaaagtcaagcttgc

SEQ ID NO: 355597 - DNA, 25 bp, Mus musculus
cctgctctttcatagtcaagcttgc

SEQ ID NO: 355598 - DNA, 25 bp, Mus musculus
cctgctgaaacgctggactgtggtc

SEQ ID NO: 355599 - DNA, 25 bp, Mus musculus
cctgctgaaacggtggactgtggtc

SEQ ID NO: 355600 - DNA, 25 bp, Mus musculus
cctgctgaagccagccgcctgcacc

SEQ ID NO: 355601 - DNA, 25 bp, Mus musculus
cctgctgaagcctgccgcctgcacc

SEQ ID NO: 355602 - DNA, 25 bp, Mus musculus
cctgctgacgtgatggcctgaagtt

SEQ ID NO: 355603 - DNA, 25 bp, Mus musculus
cctgctgacgtgttggcctgaagtt

SEQ ID NO: 355604 - DNA, 25 bp, Mus musculus
cctgctgactatatgtggtttaaaa

SEQ ID NO: 355605 - DNA, 25 bp, Mus musculus
cctgctgactatttgtggtttaaaa

SEQ ID NO: 355606 - DNA, 25 bp, Mus musculus
cctgctgactgaagctgtgtgccat

SEQ ID NO: 355607 - DNA, 25 bp, Mus musculus
cctgctgactgatgctgtgtgccat

SEQ ID NO: 355608 - DNA, 25 bp, Mus musculus
cctgctgagggacaatttacggctg

SEQ ID NO: 355609 - DNA, 25 bp, Mus musculus
cctgctgagggagaatttacggctg

SEQ ID NO: 355610 - DNA, 25 bp, Mus musculus
cctgctgagtaaacacaaggtggct

SEQ ID NO: 355611 - DNA, 25 bp, Mus musculus
cctgctgagtaatcacaaggtggct

SEQ ID NO: 355612 - DNA, 25 bp, Mus musculus
cctgctgataaaccagatttcttca

SEQ ID NO: 355613 - DNA, 25 bp, Mus musculus
cctgctgataaagcagatttcttca

SEQ ID NO: 355614 - DNA, 25 bp, Mus musculus
cctgctgcaaggcattgctgactac

SEQ ID NO: 355615 - DNA, 25 bp, Mus musculus
cctgctgcaagggattgctgactac

SEQ ID NO: 355616 - DNA, 25 bp, Mus musculus
cctgctgcacacctggtaaaataac

SEQ ID NO: 355617 - DNA, 25 bp, Mus musculus
cctgctgcacacgtggtaaaataac

SEQ ID NO: 355618 - DNA, 25 bp, Mus musculus
cctgctgcaccaagaacttcgcaaa

SEQ ID NO: 355619 - DNA, 25 bp, Mus musculus
cctgctgcaccatgaacttcgcaaa

SEQ ID NO: 355620 - DNA, 25 bp, Mus musculus
cctgctgcactgaatatggttctag

SEQ ID NO: 355621 - DNA, 25 bp, Mus musculus
cctgctgcactgtatatggttctag

SEQ ID NO: 355622 - DNA, 25 bp, Mus musculus
cctgctgcagccatgggcatatatt

SEQ ID NO: 355623 - DNA, 25 bp, Mus musculus
cctgctgcagccttgggcatatatt

SEQ ID NO: 355624 - DNA, 25 bp, Mus musculus
cctgctgcaggtcatcttgaacaag

SEQ ID NO: 355625 - DNA, 25 bp, Mus musculus
cctgctgcaggtgatcttgaacaag

SEQ ID NO: 355626 - DNA, 25 bp, Mus musculus
cctgctgcagtgcaagacgggcgtg

SEQ ID NO: 355627 - DNA, 25 bp, Mus musculus
cctgctgcagtggaagacgggcgtg

SEQ ID NO: 355628 - DNA, 25 bp, Mus musculus
cctgctgcatctcagattcaatacc

SEQ ID NO: 355629 - DNA, 25 bp, Mus musculus
cctgctgcatctgagattcaatacc

SEQ ID NO: 355630 - DNA, 25 bp, Mus musculus
cctgctgccaatatctaatctacat

SEQ ID NO: 355631 - DNA, 25 bp, Mus musculus
cctgctgccaatttctaatctacat

SEQ ID NO: 355632 - DNA, 25 bp, Mus musculus
cctgctgcccataggacttaggaaa

SEQ ID NO: 355633 - DNA, 25 bp, Mus musculus
cctgctgcccattggacttaggaaa

SEQ ID NO: 355634 - DNA, 25 bp, Mus musculus
cctgctgccggaagttattttactg

SEQ ID NO: 355635 - DNA, 25 bp, Mus musculus
cctgctgccggatgttattttactg

SEQ ID NO: 355636 - DNA, 25 bp, Mus musculus
cctgctgcctgcctgggagaaagta

SEQ ID NO: 355637 - DNA, 25 bp, Mus musculus
cctgctgcctgcgtgggagaaagta

SEQ ID NO: 355638 - DNA, 25 bp, Mus musculus
cctgctgcgattctctgtaatgtta

SEQ ID NO: 355639 - DNA, 25 bp, Mus musculus
cctgctgcgattgtctgtaatgtta

SEQ ID NO: 355640 - DNA, 25 bp, Mus musculus
cctgctgctatcagctttcaagaaa

SEQ ID NO: 355641 - DNA, 25 bp, Mus musculus
cctgctgctatctgctttcaagaaa

SEQ ID NO: 355642 - DNA, 25 bp, Mus musculus
cctgctgctgagaactttcttgaac

SEQ ID NO: 355643 - DNA, 25 bp, Mus musculus
cctgctgctgagactgtctgatgtt

SEQ ID NO: 355644 - DNA, 25 bp, Mus musculus
cctgctgctgagtactttcttgaac

SEQ ID NO: 355645 - DNA, 25 bp, Mus musculus
cctgctgctgagtctgtctgatgtt

SEQ ID NO: 355646 - DNA, 25 bp, Mus musculus
cctgctgctgctagaaaatgattca

SEQ ID NO: 355647 - DNA, 25 bp, Mus musculus
cctgctgctgcttgaaaatgattca

SEQ ID NO: 355648 - DNA, 25 bp, Mus musculus
cctgctgctgttcctagtaagatat

SEQ ID NO: 355649 - DNA, 25 bp, Mus musculus
cctgctgctgttgctagtaagatat

SEQ ID NO: 355650 - DNA, 25 bp, Mus musculus
cctgctggaagtattcttctgcttt

SEQ ID NO: 355651 - DNA, 25 bp, Mus musculus
cctgctggaagttttcttctgcttt

SEQ ID NO: 355652 - DNA, 25 bp, Mus musculus
cctgctggacctcaggttagcaaac

SEQ ID NO: 355653 - DNA, 25 bp, Mus musculus
cctgctggacctgaggttagcaaac

SEQ ID NO: 355654 - DNA, 25 bp, Mus musculus
cctgctggactgcattctgtggctg

SEQ ID NO: 355655 - DNA, 25 bp, Mus musculus
cctgctggactggattctgtggctg

SEQ ID NO: 355656 - DNA, 25 bp, Mus musculus
cctgctggagtcatctagtgtgatc

SEQ ID NO: 355657 - DNA, 25 bp, Mus musculus
cctgctggagtcttctagtgtgatc

SEQ ID NO: 355658 - DNA, 25 bp, Mus musculus
cctgctggatgtagcttttcttgtg

SEQ ID NO: 355659 - DNA, 25 bp, Mus musculus
cctgctggatgttgcttttcttgtg

SEQ ID NO: 355660 - DNA, 25 bp, Mus musculus
cctgctggcagtcgtcctggttttg

SEQ ID NO: 355661 - DNA, 25 bp, Mus musculus
cctgctggcagtggtcctggttttg

SEQ ID NO: 355662 - DNA, 25 bp, Mus musculus
cctgctggcatgaacgctgtatgtc

SEQ ID NO: 355663 - DNA, 25 bp, Mus musculus
cctgctggcatgagggaacagtgta

SEQ ID NO: 355664 - DNA, 25 bp, Mus musculus
cctgctggcatgtacgctgtatgtc

SEQ ID NO: 355665 - DNA, 25 bp, Mus musculus
cctgctggcatgtgggaacagtgta

SEQ ID NO: 355666 - DNA, 25 bp, Mus musculus
cctgctggccagagcagtgcagtga

SEQ ID NO: 355667 - DNA, 25 bp, Mus musculus
cctgctggccagtgcagtgcagtga

SEQ ID NO: 355668 - DNA, 25 bp, Mus musculus
cctgctggctttaatacccttattt

SEQ ID NO: 355669 - DNA, 25 bp, Mus musculus
cctgctggctttagtgtcactactg

SEQ ID NO: 355670 - DNA, 25 bp, Mus musculus
cctgctggcttttatacccttattt

SEQ ID NO: 355671 - DNA, 25 bp, Mus musculus
cctgctggcttttgtgtcactactg

SEQ ID NO: 355672 - DNA, 25 bp, Mus musculus
cctgctgggatgcgcttacctacct

SEQ ID NO: 355673 - DNA, 25 bp, Mus musculus
cctgctgggatgcttgtcactggat

SEQ ID NO: 355674 - DNA, 25 bp, Mus musculus
cctgctgggatgggcttacctacct

SEQ ID NO: 355675 - DNA, 25 bp, Mus musculus
cctgctgggatggttgtcactggat

SEQ ID NO: 355676 - DNA, 25 bp, Mus musculus
cctgctgggcctcaaggaccgagag

SEQ ID NO: 355677 - DNA, 25 bp, Mus musculus
cctgctgggcctgaaggaccgagag

SEQ ID NO: 355678 - DNA, 25 bp, Mus musculus
cctgctgggtagctaggtgctctaa

SEQ ID NO: 355679 - DNA, 25 bp, Mus musculus
cctgctgggtaggtaggtgctctaa

SEQ ID NO: 355680 - DNA, 25 bp, Mus musculus
cctgctgtaaagaccatgttgtttt

SEQ ID NO: 355681 - DNA, 25 bp, Mus musculus
cctgctgtaaagtccatgttgtttt

SEQ ID NO: 355682 - DNA, 25 bp, Mus musculus
cctgctgtaattcatggttcgattc

SEQ ID NO: 355683 - DNA, 25 bp, Mus musculus
cctgctgtaattgatggttcgattc

SEQ ID NO: 355684 - DNA, 25 bp, Mus musculus
cctgctgtcactagtgcatgggaag

SEQ ID NO: 355685 - DNA, 25 bp, Mus musculus
cctgctgtcactctctgctctgggt

SEQ ID NO: 355686 - DNA, 25 bp, Mus musculus
cctgctgtcactgtctgctctgggt

SEQ ID NO: 355687 - DNA, 25 bp, Mus musculus
cctgctgtcacttgtgcatgggaag

SEQ ID NO: 355688 - DNA, 25 bp, Mus musculus
cctgctgtcaggatcacaggctgaa

SEQ ID NO: 355689 - DNA, 25 bp, Mus musculus
cctgctgtcaggttcacaggctgaa

SEQ ID NO: 355690 - DNA, 25 bp, Mus musculus
cctgctgtcataagtttcccatcat

SEQ ID NO: 355691 - DNA, 25 bp, Mus musculus
cctgctgtcatatgtttcccatcat

SEQ ID NO: 355692 - DNA, 25 bp, Mus musculus
cctgctgtcctcagtgtgattagga

SEQ ID NO: 355693 - DNA, 25 bp, Mus musculus
cctgctgtcctcatttaaccaaagt

SEQ ID NO: 355694 - DNA, 25 bp, Mus musculus
cctgctgtcctctgtgtgattagga

SEQ ID NO: 355695 - DNA, 25 bp, Mus musculus
cctgctgtcctcttttaaccaaagt

SEQ ID NO: 355696 - DNA, 25 bp, Mus musculus
cctgctgtcttcatttgctgtgaat

SEQ ID NO: 355697 - DNA, 25 bp, Mus musculus
cctgctgtcttcttttgctgtgaat

SEQ ID NO: 355698 - DNA, 25 bp, Mus musculus
cctgctgtgaacctgccacttgaat

SEQ ID NO: 355699 - DNA, 25 bp, Mus musculus
cctgctgtgaacgtgccacttgaat

SEQ ID NO: 355700 - DNA, 25 bp, Mus musculus
cctgctgtgcaaactcattctgatg

SEQ ID NO: 355701 - DNA, 25 bp, Mus musculus
cctgctgtgcaatctcattctgatg

SEQ ID NO: 355702 - DNA, 25 bp, Mus musculus
cctgctgtgcatctggcttttttaa

SEQ ID NO: 355703 - DNA, 25 bp, Mus musculus
cctgctgtgcatgtggcttttttaa

SEQ ID NO: 355704 - DNA, 25 bp, Mus musculus
cctgctgtgcttcaattttggctaa

SEQ ID NO: 355705 - DNA, 25 bp, Mus musculus
cctgctgtgcttgaattttggctaa

SEQ ID NO: 355706 - DNA, 25 bp, Mus musculus
cctgctgtggatcactgctgcaaaa

SEQ ID NO: 355707 - DNA, 25 bp, Mus musculus
cctgctgtggatgactgctgcaaaa

SEQ ID NO: 355708 - DNA, 25 bp, Mus musculus
cctgctgtgtgacaagccctttgct

SEQ ID NO: 355709 - DNA, 25 bp, Mus musculus
cctgctgtgtgagaagccctttgct

SEQ ID NO: 355710 - DNA, 25 bp, Mus musculus
cctgctgttacaatctcttggagag

SEQ ID NO: 355711 - DNA, 25 bp, Mus musculus
cctgctgttacattctcttggagag

SEQ ID NO: 355712 - DNA, 25 bp, Mus musculus
cctgctgttcatcaggctgcgggtc

SEQ ID NO: 355713 - DNA, 25 bp, Mus musculus
cctgctgttcatgaggctgcgggtc

SEQ ID NO: 355714 - DNA, 25 bp, Mus musculus
cctgctgttccaaagctgtaggagt

SEQ ID NO: 355715 - DNA, 25 bp, Mus musculus
cctgctgttccatagctgtaggagt

SEQ ID NO: 355716 - DNA, 25 bp, Mus musculus
cctgctgttcctctggtgcccatag

SEQ ID NO: 355717 - DNA, 25 bp, Mus musculus
cctgctgttcctgtggtgcccatag

SEQ ID NO: 355718 - DNA, 25 bp, Mus musculus
cctgcttacaaaacacaagggaata

SEQ ID NO: 355719 - DNA, 25 bp, Mus musculus
cctgcttacaaatcacaagggaata

SEQ ID NO: 355720 - DNA, 25 bp, Mus musculus
cctgcttacatgaaggccggagcat

SEQ ID NO: 355721 - DNA, 25 bp, Mus musculus
cctgcttacatgtaggccggagcat

SEQ ID NO: 355722 - DNA, 25 bp, Mus musculus
cctgcttatcctagggttcaaaatt

SEQ ID NO: 355723 - DNA, 25 bp, Mus musculus
cctgcttatccttgggttcaaaatt

SEQ ID NO: 355724 - DNA, 25 bp, Mus musculus
cctgcttcagatatctaccttgact

SEQ ID NO: 355725 - DNA, 25 bp, Mus musculus
cctgcttcagatttctaccttgact

SEQ ID NO: 355726 - DNA, 25 bp, Mus musculus
cctgcttcagcacagataattaatt

SEQ ID NO: 355727 - DNA, 25 bp, Mus musculus
cctgcttcagcagagataattaatt

SEQ ID NO: 355728 - DNA, 25 bp, Mus musculus
cctgcttcaggcatgtgggatacta

SEQ ID NO: 355729 - DNA, 25 bp, Mus musculus
cctgcttcaggcttgtgggatacta

SEQ ID NO: 355730 - DNA, 25 bp, Mus musculus
cctgcttcattccacagagtgatgt

SEQ ID NO: 355731 - DNA, 25 bp, Mus musculus
cctgcttcattcgacagagtgatgt

SEQ ID NO: 355732 - DNA, 25 bp, Mus musculus
cctgcttccagccttgcgcctggag

SEQ ID NO: 355733 - DNA, 25 bp, Mus musculus
cctgcttccagcgttgcgcctggag

SEQ ID NO: 355734 - DNA, 25 bp, Mus musculus
cctgcttcccatcagttctagaagt

SEQ ID NO: 355735 - DNA, 25 bp, Mus musculus
cctgcttcccatgagttctagaagt

SEQ ID NO: 355736 - DNA, 25 bp, Mus musculus
cctgcttcctgacctgacagaaaaa

SEQ ID NO: 355737 - DNA, 25 bp, Mus musculus
cctgcttcctgagctgacagaaaaa

SEQ ID NO: 355738 - DNA, 25 bp, Mus musculus
cctgcttccttaagaagctatgagc

SEQ ID NO: 355739 - DNA, 25 bp, Mus musculus
cctgcttccttatgaagctatgagc

SEQ ID NO: 355740 - DNA, 25 bp, Mus musculus
cctgcttcctttatgaaactgcatt

SEQ ID NO: 355741 - DNA, 25 bp, Mus musculus
cctgcttcctttttgaaactgcatt

SEQ ID NO: 355742 - DNA, 25 bp, Mus musculus
cctgcttcgctcagtgggcaataaa

SEQ ID NO: 355743 - DNA, 25 bp, Mus musculus
cctgcttcgctctgtgggcaataaa

SEQ ID NO: 355744 - DNA, 25 bp, Mus musculus
cctgcttctcacctatgactgggtt

SEQ ID NO: 355745 - DNA, 25 bp, Mus musculus
cctgcttctcacgtatgactgggtt

SEQ ID NO: 355746 - DNA, 25 bp, Mus musculus
cctgcttctgaaagtcttgtcttaa

SEQ ID NO: 355747 - DNA, 25 bp, Mus musculus
cctgcttctgaatgtcttgtcttaa

SEQ ID NO: 355748 - DNA, 25 bp, Mus musculus
cctgcttcttggcatacttggagtg

SEQ ID NO: 355749 - DNA, 25 bp, Mus musculus
cctgcttcttgggatacttggagtg

SEQ ID NO: 355750 - DNA, 25 bp, Mus musculus
cctgcttgagatcctttttcttcta

SEQ ID NO: 355751 - DNA, 25 bp, Mus musculus
cctgcttgagatgctttttcttcta

SEQ ID NO: 355752 - DNA, 25 bp, Mus musculus
cctgcttggagacagtcttcattca

SEQ ID NO: 355753 - DNA, 25 bp, Mus musculus
cctgcttggagagagtcttcattca

SEQ ID NO: 355754 - DNA, 25 bp, Mus musculus
cctgcttggcgaaaatgccctttta

SEQ ID NO: 355755 - DNA, 25 bp, Mus musculus
cctgcttggcgataatgccctttta

SEQ ID NO: 355756 - DNA, 25 bp, Mus musculus
cctgcttgggccacagactggtgaa

SEQ ID NO: 355757 - DNA, 25 bp, Mus musculus
cctgcttgggccctaggaatgaaga

SEQ ID NO: 355758 - DNA, 25 bp, Mus musculus
cctgcttgggccgtaggaatgaaga

SEQ ID NO: 355759 - DNA, 25 bp, Mus musculus
cctgcttgggcctcagactggtgaa

SEQ ID NO: 355760 - DNA, 25 bp, Mus musculus
cctgcttggtccatgctcaatgtgc

SEQ ID NO: 355761 - DNA, 25 bp, Mus musculus
cctgcttggtccttgctcaatgtgc

SEQ ID NO: 355762 - DNA, 25 bp, Mus musculus
cctgcttgtgcaaaagcttcccctg

SEQ ID NO: 355763 - DNA, 25 bp, Mus musculus
cctgcttgtgcataagcttcccctg

SEQ ID NO: 355764 - DNA, 25 bp, Mus musculus
cctgctttacttcccttatcttaga

SEQ ID NO: 355765 - DNA, 25 bp, Mus musculus
cctgctttacttgccttatcttaga

SEQ ID NO: 355766 - DNA, 25 bp, Mus musculus
cctgctttagagctaggtactgggt

SEQ ID NO: 355767 - DNA, 25 bp, Mus musculus
cctgctttagaggtaggtactgggt

SEQ ID NO: 355768 - DNA, 25 bp, Mus musculus
cctgctttatccatgctagaaccat

SEQ ID NO: 355769 - DNA, 25 bp, Mus musculus
cctgctttatccttgctagaaccat

SEQ ID NO: 355770 - DNA, 25 bp, Mus musculus
cctgctttcagaagttccattcaga

SEQ ID NO: 355771 - DNA, 25 bp, Mus musculus
cctgctttcagatgttccattcaga

SEQ ID NO: 355772 - DNA, 25 bp, Mus musculus
cctgctttctgtaacatccagaact

SEQ ID NO: 355773 - DNA, 25 bp, Mus musculus
cctgctttctgtagcctttttgaaa

SEQ ID NO: 355774 - DNA, 25 bp, Mus musculus
cctgctttctgttacatccagaact

SEQ ID NO: 355775 - DNA, 25 bp, Mus musculus
cctgctttctgttgcctttttgaaa

SEQ ID NO: 355776 - DNA, 25 bp, Mus musculus
cctgctttgctgagagagtctcatg

SEQ ID NO: 355777 - DNA, 25 bp, Mus musculus
cctgctttgctgtgagagtctcatg

SEQ ID NO: 355778 - DNA, 25 bp, Mus musculus
cctgctttggctcccaggcttctgg

SEQ ID NO: 355779 - DNA, 25 bp, Mus musculus
cctgctttggctgccaggcttctgg

SEQ ID NO: 355780 - DNA, 25 bp, Mus musculus
cctgctttgtcaccgctagaaacaa

SEQ ID NO: 355781 - DNA, 25 bp, Mus musculus
cctgctttgtcagcgctagaaacaa

SEQ ID NO: 355782 - DNA, 25 bp, Mus musculus
cctgctttgtgacttaggcgtgctg

SEQ ID NO: 355783 - DNA, 25 bp, Mus musculus
cctgctttgtgagttaggcgtgctg

SEQ ID NO: 355784 - DNA, 25 bp, Mus musculus
cctgcttttaatccccaggaaatat

SEQ ID NO: 355785 - DNA, 25 bp, Mus musculus
cctgcttttaatgcccaggaaatat

SEQ ID NO: 355786 - DNA, 25 bp, Mus musculus
cctgcttttactccctcagtgctgg

SEQ ID NO: 355787 - DNA, 25 bp, Mus musculus
cctgcttttactgcctcagtgctgg

SEQ ID NO: 355788 - DNA, 25 bp, Mus musculus
cctgcttttcaaaaggtgctgaaga

SEQ ID NO: 355789 - DNA, 25 bp, Mus musculus
cctgcttttcaataggtgctgaaga

SEQ ID NO: 355790 - DNA, 25 bp, Mus musculus
cctgcttttcatatggatttcaatt

SEQ ID NO: 355791 - DNA, 25 bp, Mus musculus
cctgcttttcatttggatttcaatt

SEQ ID NO: 355792 - DNA, 25 bp, Mus musculus
cctgcttttgacctgaatgctggtt

SEQ ID NO: 355793 - DNA, 25 bp, Mus musculus
cctgcttttgacgtgaatgctggtt

SEQ ID NO: 355794 - DNA, 25 bp, Mus musculus
cctgcttttgatcgagacacacgta

SEQ ID NO: 355795 - DNA, 25 bp, Mus musculus
cctgcttttgatggagacacacgta

SEQ ID NO: 355796 - DNA, 25 bp, Mus musculus
cctgcttttgggaaggctcctatgg

SEQ ID NO: 355797 - DNA, 25 bp, Mus musculus
cctgcttttgggtaggctcctatgg

SEQ ID NO: 355798 - DNA, 25 bp, Mus musculus
cctgcttttgtgactttaaagtttg

SEQ ID NO: 355799 - DNA, 25 bp, Mus musculus
cctgcttttgtgtctttaaagtttg

SEQ ID NO: 355800 - DNA, 25 bp, Mus musculus
cctggaaacatgattctcttcctgc

SEQ ID NO: 355801 - DNA, 25 bp, Mus musculus
cctggaaacatgtttctcttcctgc

SEQ ID NO: 355802 - DNA, 25 bp, Mus musculus
cctggaaagactagtgtggccggcc

SEQ ID NO: 355803 - DNA, 25 bp, Mus musculus
cctggaaagacttgtgtggccggcc

SEQ ID NO: 355804 - DNA, 25 bp, Mus musculus
cctggaaaggccagaatgtggagat

SEQ ID NO: 355805 - DNA, 25 bp, Mus musculus
cctggaaaggcctgaatgtggagat

SEQ ID NO: 355806 - DNA, 25 bp, Mus musculus
cctggaaataagaattctgggcatg

SEQ ID NO: 355807 - DNA, 25 bp, Mus musculus
cctggaaataagtattctgggcatg

SEQ ID NO: 355808 - DNA, 25 bp, Mus musculus
cctggaacaactacaggaccctcta

SEQ ID NO: 355809 - DNA, 25 bp, Mus musculus
cctggaacaacttcaggaccctcta

SEQ ID NO: 355810 - DNA, 25 bp, Mus musculus
cctggaacccggagtacagtgactt

SEQ ID NO: 355811 - DNA, 25 bp, Mus musculus
cctggaacccggtgtacagtgactt

SEQ ID NO: 355812 - DNA, 25 bp, Mus musculus
cctggaaccttgacccttgaggcta

SEQ ID NO: 355813 - DNA, 25 bp, Mus musculus
cctggaaccttgtcccttgaggcta

SEQ ID NO: 355814 - DNA, 25 bp, Mus musculus
cctggaacggcacatcacagagcag

SEQ ID NO: 355815 - DNA, 25 bp, Mus musculus
cctggaacggcagatcacagagcag

SEQ ID NO: 355816 - DNA, 25 bp, Mus musculus
cctggaactggaatcgcaagcaatt

SEQ ID NO: 355817 - DNA, 25 bp, Mus musculus
cctggaactggattcgcaagcaatt

SEQ ID NO: 355818 - DNA, 25 bp, Mus musculus
cctggaagaaatcagaagactcccc

SEQ ID NO: 355819 - DNA, 25 bp, Mus musculus
cctggaagaaatgagaagactcccc

SEQ ID NO: 355820 - DNA, 25 bp, Mus musculus
cctggaagacatagggacagcagct

SEQ ID NO: 355821 - DNA, 25 bp, Mus musculus
cctggaagacattgggacagcagct

SEQ ID NO: 355822 - DNA, 25 bp, Mus musculus
cctggaagatggctgtttttgcaaa

SEQ ID NO: 355823 - DNA, 25 bp, Mus musculus
cctggaagatgggtgtttttgcaaa

SEQ ID NO: 355824 - DNA, 25 bp, Mus musculus
cctggaagctaacctgctgcagaca

SEQ ID NO: 355825 - DNA, 25 bp, Mus musculus
cctggaagctaagctgctgcagaca

SEQ ID NO: 355826 - DNA, 25 bp, Mus musculus
cctggaaggcaacagcagtcttctt

SEQ ID NO: 355827 - DNA, 25 bp, Mus musculus
cctggaaggcaagagcagtcttctt

SEQ ID NO: 355828 - DNA, 25 bp, Mus musculus
cctggaaggctcctgggaaagcaca

SEQ ID NO: 355829 - DNA, 25 bp, Mus musculus
cctggaaggctcgtgggaaagcaca

SEQ ID NO: 355830 - DNA, 25 bp, Mus musculus
cctggaagtctgatgctttaaaagc

SEQ ID NO: 355831 - DNA, 25 bp, Mus musculus
cctggaagtctgttgctttaaaagc

SEQ ID NO: 355832 - DNA, 25 bp, Mus musculus
cctggaatacaaccagatatccctt

SEQ ID NO: 355833 - DNA, 25 bp, Mus musculus
cctggaatacaagcagatatccctt

SEQ ID NO: 355834 - DNA, 25 bp, Mus musculus
cctggaatacttaattcagtcattt

SEQ ID NO: 355835 - DNA, 25 bp, Mus musculus
cctggaatactttattcagtcattt

SEQ ID NO: 355836 - DNA, 25 bp, Mus musculus
cctggaatatggacgttggcttaaa

SEQ ID NO: 355837 - DNA, 25 bp, Mus musculus
cctggaatatggtcgttggcttaaa

SEQ ID NO: 355838 - DNA, 25 bp, Mus musculus
cctggaatcggtatctgctgttcac

SEQ ID NO: 355839 - DNA, 25 bp, Mus musculus
cctggaatcggtttctgctgttcac

SEQ ID NO: 355840 - DNA, 25 bp, Mus musculus
cctggaatctacagagctggagaca

SEQ ID NO: 355841 - DNA, 25 bp, Mus musculus
cctggaatctactgagctggagaca

SEQ ID NO: 355842 - DNA, 25 bp, Mus musculus
cctggaatgtcccttaatacgatga

SEQ ID NO: 355843 - DNA, 25 bp, Mus musculus
cctggaatgtccgttaatacgatga

SEQ ID NO: 355844 - DNA, 25 bp, Mus musculus
cctggaattccaatgtgctttcaat

SEQ ID NO: 355845 - DNA, 25 bp, Mus musculus
cctggaattccaccaacagcttggg

SEQ ID NO: 355846 - DNA, 25 bp, Mus musculus
cctggaattccagcaacagcttggg

SEQ ID NO: 355847 - DNA, 25 bp, Mus musculus
cctggaattccattgtgctttcaat

SEQ ID NO: 355848 - DNA, 25 bp, Mus musculus
cctggaattgcacaagagcttggaa

SEQ ID NO: 355849 - DNA, 25 bp, Mus musculus
cctggaattgcagaagagcttggaa

SEQ ID NO: 355850 - DNA, 25 bp, Mus musculus
cctggacaacccatggagcttgtag

SEQ ID NO: 355851 - DNA, 25 bp, Mus musculus
cctggacaacccttggagcttgtag

SEQ ID NO: 355852 - DNA, 25 bp, Mus musculus
cctggacaactgaacttggaaactt

SEQ ID NO: 355853 - DNA, 25 bp, Mus musculus
cctggacaactgtacttggaaactt

SEQ ID NO: 355854 - DNA, 25 bp, Mus musculus
cctggacaaggcctggaagctctcc

SEQ ID NO: 355855 - DNA, 25 bp, Mus musculus
cctggacaaggcgtggaagctctcc

SEQ ID NO: 355856 - DNA, 25 bp, Mus musculus
cctggacaatgacatgcagcagttg

SEQ ID NO: 355857 - DNA, 25 bp, Mus musculus
cctggacaatgagatgcagcagttg

SEQ ID NO: 355858 - DNA, 25 bp, Mus musculus
cctggacagagaaacgatcgctact

SEQ ID NO: 355859 - DNA, 25 bp, Mus musculus
cctggacagagatacgatcgctact

SEQ ID NO: 355860 - DNA, 25 bp, Mus musculus
cctggacagagcatttgaaggctat

SEQ ID NO: 355861 - DNA, 25 bp, Mus musculus
cctggacagagcttttgaaggctat

SEQ ID NO: 355862 - DNA, 25 bp, Mus musculus
cctggacagcgcacgcagaagagct

SEQ ID NO: 355863 - DNA, 25 bp, Mus musculus
cctggacagcgctcgcagaagagct

SEQ ID NO: 355864 - DNA, 25 bp, Mus musculus
cctggacagctgaagtttggacgtg

SEQ ID NO: 355865 - DNA, 25 bp, Mus musculus
cctggacagctgacatggaagaact

SEQ ID NO: 355866 - DNA, 25 bp, Mus musculus
cctggacagctgatatttgcacatg

SEQ ID NO: 355867 - DNA, 25 bp, Mus musculus
cctggacagctgtagtttggacgtg

SEQ ID NO: 355868 - DNA, 25 bp, Mus musculus
cctggacagctgtcatggaagaact

SEQ ID NO: 355869 - DNA, 25 bp, Mus musculus
cctggacagctgttatttgcacatg

SEQ ID NO: 355870 - DNA, 25 bp, Mus musculus
cctggacatcagctggcagacacac

SEQ ID NO: 355871 - DNA, 25 bp, Mus musculus
cctggacatcaggtggcagacacac

SEQ ID NO: 355872 - DNA, 25 bp, Mus musculus
cctggacattgaaggtgactggaac

SEQ ID NO: 355873 - DNA, 25 bp, Mus musculus
cctggacattgatggtgactggaac

SEQ ID NO: 355874 - DNA, 25 bp, Mus musculus
cctggacatttgcactgactttttc

SEQ ID NO: 355875 - DNA, 25 bp, Mus musculus
cctggacatttggactgactttttc

SEQ ID NO: 355876 - DNA, 25 bp, Mus musculus
cctggaccagcacccggaggacaga

SEQ ID NO: 355877 - DNA, 25 bp, Mus musculus
cctggaccagcagccggaggacaga

SEQ ID NO: 355878 - DNA, 25 bp, Mus musculus
cctggaccaggacttggaagttgag

SEQ ID NO: 355879 - DNA, 25 bp, Mus musculus
cctggaccaggagttggaagttgag

SEQ ID NO: 355880 - DNA, 25 bp, Mus musculus
cctggacccaatatggatccctaga

SEQ ID NO: 355881 - DNA, 25 bp, Mus musculus
cctggacccaatttggatccctaga

SEQ ID NO: 355882 - DNA, 25 bp, Mus musculus
cctggaccctgcagtgtggagagac

SEQ ID NO: 355883 - DNA, 25 bp, Mus musculus
cctggaccctgctgtgtggagagac

SEQ ID NO: 355884 - DNA, 25 bp, Mus musculus
cctggaccggctcgagagacacgat

SEQ ID NO: 355885 - DNA, 25 bp, Mus musculus
cctggaccggctggagagacacgat

SEQ ID NO: 355886 - DNA, 25 bp, Mus musculus
cctggacctggacattttcattagt

SEQ ID NO: 355887 - DNA, 25 bp, Mus musculus
cctggacctggagattttcattagt

SEQ ID NO: 355888 - DNA, 25 bp, Mus musculus
cctggacctgtcaacctgaggagct

SEQ ID NO: 355889 - DNA, 25 bp, Mus musculus
cctggacctgtctacctgaggagct

SEQ ID NO: 355890 - DNA, 25 bp, Mus musculus
cctggacgatgacgaagatgcttct

SEQ ID NO: 355891 - DNA, 25 bp, Mus musculus
cctggacgatgaggaagatgcttct

SEQ ID NO: 355892 - DNA, 25 bp, Mus musculus
cctggacgcacaacctcaagggaaa

SEQ ID NO: 355893 - DNA, 25 bp, Mus musculus
cctggacgcacatcctcaagggaaa

SEQ ID NO: 355894 - DNA, 25 bp, Mus musculus
cctggacgcagtatgattggttaaa

SEQ ID NO: 355895 - DNA, 25 bp, Mus musculus
cctggacgcagtttgattggttaaa

SEQ ID NO: 355896 - DNA, 25 bp, Mus musculus
cctggacgccttagtttttagccat

SEQ ID NO: 355897 - DNA, 25 bp, Mus musculus
cctggacgcctttgtttttagccat

SEQ ID NO: 355898 - DNA, 25 bp, Mus musculus
cctggacgctttcactacattggcc

SEQ ID NO: 355899 - DNA, 25 bp, Mus musculus
cctggacgctttgactacattggcc

SEQ ID NO: 355900 - DNA, 25 bp, Mus musculus
cctggactactcactggttttatga

SEQ ID NO: 355901 - DNA, 25 bp, Mus musculus
cctggactactctctggttttatga

SEQ ID NO: 355902 - DNA, 25 bp, Mus musculus
cctggactcgttagcgttttccatt

SEQ ID NO: 355903 - DNA, 25 bp, Mus musculus
cctggactcgtttgcgttttccatt

SEQ ID NO: 355904 - DNA, 25 bp, Mus musculus
cctggactgaggatcgaagttgaga

SEQ ID NO: 355905 - DNA, 25 bp, Mus musculus
cctggactgaggttcgaagttgaga

SEQ ID NO: 355906 - DNA, 25 bp, Mus musculus
cctggactgcgaagtgattgtagct

SEQ ID NO: 355907 - DNA, 25 bp, Mus musculus
cctggactgcgatgtgattgtagct

SEQ ID NO: 355908 - DNA, 25 bp, Mus musculus
cctggactgcttatttacctcattt

SEQ ID NO: 355909 - DNA, 25 bp, Mus musculus
cctggactgcttttttacctcattt

SEQ ID NO: 355910 - DNA, 25 bp, Mus musculus
cctggactggacatactccctgttg

SEQ ID NO: 355911 - DNA, 25 bp, Mus musculus
cctggactggacttactccctgttg

SEQ ID NO: 355912 - DNA, 25 bp, Mus musculus
cctggactggagaaaggttccttca

SEQ ID NO: 355913 - DNA, 25 bp, Mus musculus
cctggactggagatacctgggcaga

SEQ ID NO: 355914 - DNA, 25 bp, Mus musculus
cctggactggagtaaggttccttca

SEQ ID NO: 355915 - DNA, 25 bp, Mus musculus
cctggactggagttacctgggcaga

SEQ ID NO: 355916 - DNA, 25 bp, Mus musculus
cctggactggctctcaggtgcagca

SEQ ID NO: 355917 - DNA, 25 bp, Mus musculus
cctggactggctgtcaggtgcagca

SEQ ID NO: 355918 - DNA, 25 bp, Mus musculus
cctggacttcaaattctatatacaa

SEQ ID NO: 355919 - DNA, 25 bp, Mus musculus
cctggacttcaatttctatatacaa

SEQ ID NO: 355920 - DNA, 25 bp, Mus musculus
cctggacttgacctcaatcacaaac

SEQ ID NO: 355921 - DNA, 25 bp, Mus musculus
cctggacttgacgtcaatcacaaac

SEQ ID NO: 355922 - DNA, 25 bp, Mus musculus
cctggacttgtgagtggaagttatg

SEQ ID NO: 355923 - DNA, 25 bp, Mus musculus
cctggacttgtgtgtggaagttatg

SEQ ID NO: 355924 - DNA, 25 bp, Mus musculus
cctggagaaaccaacttatcaccta

SEQ ID NO: 355925 - DNA, 25 bp, Mus musculus
cctggagaaacctacttatcaccta

SEQ ID NO: 355926 - DNA, 25 bp, Mus musculus
cctggagaaataatcaccggttaag

SEQ ID NO: 355927 - DNA, 25 bp, Mus musculus
cctggagaaatattcaccggttaag

SEQ ID NO: 355928 - DNA, 25 bp, Mus musculus
cctggagaatacacacctgcttgag

SEQ ID NO: 355929 - DNA, 25 bp, Mus musculus
cctggagaatactcacctgcttgag

SEQ ID NO: 355930 - DNA, 25 bp, Mus musculus
cctggagaatccagaggatacagaa

SEQ ID NO: 355931 - DNA, 25 bp, Mus musculus
cctggagaatcctgaggatacagaa

SEQ ID NO: 355932 - DNA, 25 bp, Mus musculus
cctggagaattgatttcagcagtgt

SEQ ID NO: 355933 - DNA, 25 bp, Mus musculus
cctggagaattgttttcagcagtgt

SEQ ID NO: 355934 - DNA, 25 bp, Mus musculus
cctggagacaccagaaaccttgcta

SEQ ID NO: 355935 - DNA, 25 bp, Mus musculus
cctggagacacctgaaaccttgcta

SEQ ID NO: 355936 - DNA, 25 bp, Mus musculus
cctggagaccgtagaccctggtggt

SEQ ID NO: 355937 - DNA, 25 bp, Mus musculus
cctggagaccgttgaccctggtggt

SEQ ID NO: 355938 - DNA, 25 bp, Mus musculus
cctggagaccttcggcttcctgaac

SEQ ID NO: 355939 - DNA, 25 bp, Mus musculus
cctggagaccttgggcttcctgaac

SEQ ID NO: 355940 - DNA, 25 bp, Mus musculus
cctggagacggaagatcttttattt

SEQ ID NO: 355941 - DNA, 25 bp, Mus musculus
cctggagacggatgatcttttattt

SEQ ID NO: 355942 - DNA, 25 bp, Mus musculus
cctggagagtgaccacctaataatg

SEQ ID NO: 355943 - DNA, 25 bp, Mus musculus
cctggagagtgagcacctaataatg

SEQ ID NO: 355944 - DNA, 25 bp, Mus musculus
cctggagatgcccacttgatggaca

SEQ ID NO: 355945 - DNA, 25 bp, Mus musculus
cctggagatgccgacttgatggaca

SEQ ID NO: 355946 - DNA, 25 bp, Mus musculus
cctggagattccataagcacccgga

SEQ ID NO: 355947 - DNA, 25 bp, Mus musculus
cctggagattccttaagcacccgga

SEQ ID NO: 355948 - DNA, 25 bp, Mus musculus
cctggagcagcaaatgtcaagattt

SEQ ID NO: 355949 - DNA, 25 bp, Mus musculus
cctggagcagcatatgtcaagattt

SEQ ID NO: 355950 - DNA, 25 bp, Mus musculus
cctggagcaggcaatgggacaagta

SEQ ID NO: 355951 - DNA, 25 bp, Mus musculus
cctggagcaggctatgggacaagta

SEQ ID NO: 355952 - DNA, 25 bp, Mus musculus
cctggagcagggaaacactctgatt

SEQ ID NO: 355953 - DNA, 25 bp, Mus musculus
cctggagcagggacataattgttct

SEQ ID NO: 355954 - DNA, 25 bp, Mus musculus
cctggagcagggatgtcattacatt

SEQ ID NO: 355955 - DNA, 25 bp, Mus musculus
cctggagcagggtaacactctgatt

SEQ ID NO: 355956 - DNA, 25 bp, Mus musculus
cctggagcagggtcataattgttct

SEQ ID NO: 355957 - DNA, 25 bp, Mus musculus
cctggagcagggttgtcattacatt

SEQ ID NO: 355958 - DNA, 25 bp, Mus musculus
cctggagcagttaggcatctccgag

SEQ ID NO: 355959 - DNA, 25 bp, Mus musculus
cctggagcagtttggcatctccgag

SEQ ID NO: 355960 - DNA, 25 bp, Mus musculus
cctggagcctgaatgtgtgttgcgc

SEQ ID NO: 355961 - DNA, 25 bp, Mus musculus
cctggagcctgattgtgtgttgcgc

SEQ ID NO: 355962 - DNA, 25 bp, Mus musculus
cctggagccttcacaatcaccagag

SEQ ID NO: 355963 - DNA, 25 bp, Mus musculus
cctggagccttctcaatcaccagag

SEQ ID NO: 355964 - DNA, 25 bp, Mus musculus
cctggagcggctctccgacagactg

SEQ ID NO: 355965 - DNA, 25 bp, Mus musculus
cctggagcggctgtccgacagactg

SEQ ID NO: 355966 - DNA, 25 bp, Mus musculus
cctggagctacacgatgtccatgct

SEQ ID NO: 355967 - DNA, 25 bp, Mus musculus
cctggagctacaggatgtccatgct

SEQ ID NO: 355968 - DNA, 25 bp, Mus musculus
cctggagctcagacttcagttcaga

SEQ ID NO: 355969 - DNA, 25 bp, Mus musculus
cctggagctcagtcttcagttcaga

SEQ ID NO: 355970 - DNA, 25 bp, Mus musculus
cctggagctcatcggagatctcatt

SEQ ID NO: 355971 - DNA, 25 bp, Mus musculus
cctggagctcatgggagatctcatt

SEQ ID NO: 355972 - DNA, 25 bp, Mus musculus
cctggagctcccataaatcagagcg

SEQ ID NO: 355973 - DNA, 25 bp, Mus musculus
cctggagctcccttaaatcagagcg

SEQ ID NO: 355974 - DNA, 25 bp, Mus musculus
cctggagctgaactgcagtgctatg

SEQ ID NO: 355975 - DNA, 25 bp, Mus musculus
cctggagctgaagtgcagtgctatg

SEQ ID NO: 355976 - DNA, 25 bp, Mus musculus
cctggagctgacaagaaagctgagg

SEQ ID NO: 355977 - DNA, 25 bp, Mus musculus
cctggagctgactagaaagctgagg

SEQ ID NO: 355978 - DNA, 25 bp, Mus musculus
cctggagctggcaatacctgtggca

SEQ ID NO: 355979 - DNA, 25 bp, Mus musculus
cctggagctggctatacctgtggca

SEQ ID NO: 355980 - DNA, 25 bp, Mus musculus
cctggagctgggatgacattgagtt

SEQ ID NO: 355981 - DNA, 25 bp, Mus musculus
cctggagctgggttgacattgagtt

SEQ ID NO: 355982 - DNA, 25 bp, Mus musculus
cctggaggacacacttcactgatat

SEQ ID NO: 355983 - DNA, 25 bp, Mus musculus
cctggaggacactcttcactgatat

SEQ ID NO: 355984 - DNA, 25 bp, Mus musculus
cctggaggatttcagcttgagctgt

SEQ ID NO: 355985 - DNA, 25 bp, Mus musculus
cctggaggatttgagcttgagctgt

SEQ ID NO: 355986 - DNA, 25 bp, Mus musculus
cctggaggcatactgcaacctcaag

SEQ ID NO: 355987 - DNA, 25 bp, Mus musculus
cctggaggcatagtgcaacctcaag

SEQ ID NO: 355988 - DNA, 25 bp, Mus musculus
cctggaggccggatgctctggcttc

SEQ ID NO: 355989 - DNA, 25 bp, Mus musculus
cctggaggccggttgctctggcttc

SEQ ID NO: 355990 - DNA, 25 bp, Mus musculus
cctggagggcagcactatcttgcta

SEQ ID NO: 355991 - DNA, 25 bp, Mus musculus
cctggagggcaggactatcttgcta

SEQ ID NO: 355992 - DNA, 25 bp, Mus musculus
cctggagtccagcatgcatggtcat

SEQ ID NO: 355993 - DNA, 25 bp, Mus musculus
cctggagtccaggatgcatggtcat

SEQ ID NO: 355994 - DNA, 25 bp, Mus musculus
cctggagtctcaccttcactggaca

SEQ ID NO: 355995 - DNA, 25 bp, Mus musculus
cctggagtctcagcttcactggaca

SEQ ID NO: 355996 - DNA, 25 bp, Mus musculus
cctggagtgccaagcccgggtagca

SEQ ID NO: 355997 - DNA, 25 bp, Mus musculus
cctggagtgccacaaataatactga

SEQ ID NO: 355998 - DNA, 25 bp, Mus musculus
cctggagtgccagaaataatactga

SEQ ID NO: 355999 - DNA, 25 bp, Mus musculus
cctggagtgccatgcccgggtagca

SEQ ID NO: 356000 - DNA, 25 bp, Mus musculus
cctggagttatcctctaggcatgaa

SEQ ID NO: 356001 - DNA, 25 bp, Mus musculus
cctggagttatcgtctaggcatgaa

SEQ ID NO: 356002 - DNA, 25 bp, Mus musculus
cctggagttcttagactggcttggt

SEQ ID NO: 356003 - DNA, 25 bp, Mus musculus
cctggagttctttgactggcttggt

SEQ ID NO: 356004 - DNA, 25 bp, Mus musculus
cctggagttgggacagtatcttaac

SEQ ID NO: 356005 - DNA, 25 bp, Mus musculus
cctggagttgggactttctctctaa

SEQ ID NO: 356006 - DNA, 25 bp, Mus musculus
cctggagttgggtcagtatcttaac

SEQ ID NO: 356007 - DNA, 25 bp, Mus musculus
cctggagttgggtctttctctctaa

SEQ ID NO: 356008 - DNA, 25 bp, Mus musculus
cctggagttgtcatcaagggaacag

SEQ ID NO: 356009 - DNA, 25 bp, Mus musculus
cctggagttgtcttcaagggaacag

SEQ ID NO: 356010 - DNA, 25 bp, Mus musculus
cctggagttgttatggctagaatga

SEQ ID NO: 356011 - DNA, 25 bp, Mus musculus
cctggagttgttttggctagaatga

SEQ ID NO: 356012 - DNA, 25 bp, Mus musculus
cctggataaaccctcggcagaggct

SEQ ID NO: 356013 - DNA, 25 bp, Mus musculus
cctggataaaccgtcggcagaggct

SEQ ID NO: 356014 - DNA, 25 bp, Mus musculus
cctggataagtacgcagcttgccgt

SEQ ID NO: 356015 - DNA, 25 bp, Mus musculus
cctggataagtaggcagcttgccgt

SEQ ID NO: 356016 - DNA, 25 bp, Mus musculus
cctggatacataaatcttgggcccc

SEQ ID NO: 356017 - DNA, 25 bp, Mus musculus
cctggatacatatatcttgggcccc

SEQ ID NO: 356018 - DNA, 25 bp, Mus musculus
cctggataccccaatacactggaaa

SEQ ID NO: 356019 - DNA, 25 bp, Mus musculus
cctggatacccctatacactggaaa

SEQ ID NO: 356020 - DNA, 25 bp, Mus musculus
cctggatatttgctgaccttaaatg

SEQ ID NO: 356021 - DNA, 25 bp, Mus musculus
cctggatatttggtgaccttaaatg

SEQ ID NO: 356022 - DNA, 25 bp, Mus musculus
cctggatcaaggagctctatgactt

SEQ ID NO: 356023 - DNA, 25 bp, Mus musculus
cctggatcaaggtgctctatgactt

SEQ ID NO: 356024 - DNA, 25 bp, Mus musculus
cctggatcatagagccttatgggcc

SEQ ID NO: 356025 - DNA, 25 bp, Mus musculus
cctggatcatagtgccttatgggcc

SEQ ID NO: 356026 - DNA, 25 bp, Mus musculus
cctggatcctgtactttgtgttata

SEQ ID NO: 356027 - DNA, 25 bp, Mus musculus
cctggatcctgttctttgtgttata

SEQ ID NO: 356028 - DNA, 25 bp, Mus musculus
cctggatctcccagatttgtgagga

SEQ ID NO: 356029 - DNA, 25 bp, Mus musculus
cctggatctccctgatttgtgagga

SEQ ID NO: 356030 - DNA, 25 bp, Mus musculus
cctggatctgcacgaattgcccctg

SEQ ID NO: 356031 - DNA, 25 bp, Mus musculus
cctggatctgcaggaattgcccctg

SEQ ID NO: 356032 - DNA, 25 bp, Mus musculus
cctggatcttccaaggtatcttgta

SEQ ID NO: 356033 - DNA, 25 bp, Mus musculus
cctggatcttcctaggtatcttgta

SEQ ID NO: 356034 - DNA, 25 bp, Mus musculus
cctggatcttttctggcgttattgc

SEQ ID NO: 356035 - DNA, 25 bp, Mus musculus
cctggatcttttgtggcgttattgc

SEQ ID NO: 356036 - DNA, 25 bp, Mus musculus
cctggatgctcaatttccaccttga

SEQ ID NO: 356037 - DNA, 25 bp, Mus musculus
cctggatgctcattttccaccttga

SEQ ID NO: 356038 - DNA, 25 bp, Mus musculus
cctggatgctccaaggccaatgttg

SEQ ID NO: 356039 - DNA, 25 bp, Mus musculus
cctggatgctcctaggccaatgttg

SEQ ID NO: 356040 - DNA, 25 bp, Mus musculus
cctggatgctgtcaacctgttagct

SEQ ID NO: 356041 - DNA, 25 bp, Mus musculus
cctggatgctgtgaacctgttagct

SEQ ID NO: 356042 - DNA, 25 bp, Mus musculus
cctggatggacacccaagggccata

SEQ ID NO: 356043 - DNA, 25 bp, Mus musculus
cctggatggacagccaagggccata

SEQ ID NO: 356044 - DNA, 25 bp, Mus musculus
cctggatggcaccttctggtcctat

SEQ ID NO: 356045 - DNA, 25 bp, Mus musculus
cctggatggcacgttctggtcctat

SEQ ID NO: 356046 - DNA, 25 bp, Mus musculus
cctggatggcttccggcaccaggca

SEQ ID NO: 356047 - DNA, 25 bp, Mus musculus
cctggatggcttgcggcaccaggca

SEQ ID NO: 356048 - DNA, 25 bp, Mus musculus
cctggatgggaacggaggcctcctt

SEQ ID NO: 356049 - DNA, 25 bp, Mus musculus
cctggatgggaagggaggcctcctt

SEQ ID NO: 356050 - DNA, 25 bp, Mus musculus
cctggatgtcgtacgggagctaaaa

SEQ ID NO: 356051 - DNA, 25 bp, Mus musculus
cctggatgtcgttcgggagctaaaa

SEQ ID NO: 356052 - DNA, 25 bp, Mus musculus
cctggatgtgccctgtgtgtgacaa

SEQ ID NO: 356053 - DNA, 25 bp, Mus musculus
cctggatgtgccgtgtgtgtgacaa

SEQ ID NO: 356054 - DNA, 25 bp, Mus musculus
cctggatgtgtgactctgtaccatt

SEQ ID NO: 356055 - DNA, 25 bp, Mus musculus
cctggatgtgtgtctctgtaccatt

SEQ ID NO: 356056 - DNA, 25 bp, Mus musculus
cctggattaggccaaagccatcatc

SEQ ID NO: 356057 - DNA, 25 bp, Mus musculus
cctggattaggcgaaagccatcatc

SEQ ID NO: 356058 - DNA, 25 bp, Mus musculus
cctggattagttactttgtcggcgc

SEQ ID NO: 356059 - DNA, 25 bp, Mus musculus
cctggattagtttctttgtcggcgc

SEQ ID NO: 356060 - DNA, 25 bp, Mus musculus
cctggattccctactaatcattgaa

SEQ ID NO: 356061 - DNA, 25 bp, Mus musculus
cctggattcccttctaatcattgaa

SEQ ID NO: 356062 - DNA, 25 bp, Mus musculus
cctggattcctcataggcagaactc

SEQ ID NO: 356063 - DNA, 25 bp, Mus musculus
cctggattcctcttaggcagaactc

SEQ ID NO: 356064 - DNA, 25 bp, Mus musculus
cctggattctccactgaggccttgg

SEQ ID NO: 356065 - DNA, 25 bp, Mus musculus
cctggattctcctctgaggccttgg

SEQ ID NO: 356066 - DNA, 25 bp, Mus musculus
cctggattgaagacatctcgggtcc

SEQ ID NO: 356067 - DNA, 25 bp, Mus musculus
cctggattgaagtcatctcgggtcc

SEQ ID NO: 356068 - DNA, 25 bp, Mus musculus
cctggattggcaactatacagtcaa

SEQ ID NO: 356069 - DNA, 25 bp, Mus musculus
cctggattggcatctatacagtcaa

SEQ ID NO: 356070 - DNA, 25 bp, Mus musculus
cctggattgggaatttgctcatttt

SEQ ID NO: 356071 - DNA, 25 bp, Mus musculus
cctggattgggattttgctcatttt

SEQ ID NO: 356072 - DNA, 25 bp, Mus musculus
cctggattgggcattggaacttctg

SEQ ID NO: 356073 - DNA, 25 bp, Mus musculus
cctggattgggctttggaacttctg

SEQ ID NO: 356074 - DNA, 25 bp, Mus musculus
cctggatttaacctctagcactaca

SEQ ID NO: 356075 - DNA, 25 bp, Mus musculus
cctggatttaacgtctagcactaca

SEQ ID NO: 356076 - DNA, 25 bp, Mus musculus
cctggatttgggagtttgctttcat

SEQ ID NO: 356077 - DNA, 25 bp, Mus musculus
cctggatttgggtgtttgctttcat

SEQ ID NO: 356078 - DNA, 25 bp, Mus musculus
cctggcaagttcctcacataatcaa

SEQ ID NO: 356079 - DNA, 25 bp, Mus musculus
cctggcaagttcgtcacataatcaa

SEQ ID NO: 356080 - DNA, 25 bp, Mus musculus
cctggcacagggaactatcgggtag

SEQ ID NO: 356081 - DNA, 25 bp, Mus musculus
cctggcacagggtactatcgggtag

SEQ ID NO: 356082 - DNA, 25 bp, Mus musculus
cctggcacagtcaccaaagtgttga

SEQ ID NO: 356083 - DNA, 25 bp, Mus musculus
cctggcacagtctccaaagtgttga

SEQ ID NO: 356084 - DNA, 25 bp, Mus musculus
cctggcaccaaacttttgtcactga

SEQ ID NO: 356085 - DNA, 25 bp, Mus musculus
cctggcaccaaagttttgtcactga

SEQ ID NO: 356086 - DNA, 25 bp, Mus musculus
cctggcacccagaagtacgtgggac

SEQ ID NO: 356087 - DNA, 25 bp, Mus musculus
cctggcacccagtagtacgtgggac

SEQ ID NO: 356088 - DNA, 25 bp, Mus musculus
cctggcacccgcaagattgagttat

SEQ ID NO: 356089 - DNA, 25 bp, Mus musculus
cctggcacccgctagattgagttat

SEQ ID NO: 356090 - DNA, 25 bp, Mus musculus
cctggcacctggaagatttcacaaa

SEQ ID NO: 356091 - DNA, 25 bp, Mus musculus
cctggcacctggtagatttcacaaa

SEQ ID NO: 356092 - DNA, 25 bp, Mus musculus
cctggcacggtgacacatgacttta

SEQ ID NO: 356093 - DNA, 25 bp, Mus musculus
cctggcacggtgtcacatgacttta

SEQ ID NO: 356094 - DNA, 25 bp, Mus musculus
cctggcactcctacttagaacaaag

SEQ ID NO: 356095 - DNA, 25 bp, Mus musculus
cctggcactccttcttagaacaaag

SEQ ID NO: 356096 - DNA, 25 bp, Mus musculus
cctggcagaataacctctttgggaa

SEQ ID NO: 356097 - DNA, 25 bp, Mus musculus
cctggcagaatatcctctttgggaa

SEQ ID NO: 356098 - DNA, 25 bp, Mus musculus
cctggcagcctgattgtgtagtgta

SEQ ID NO: 356099 - DNA, 25 bp, Mus musculus
cctggcagcctgtttgtgtagtgta

SEQ ID NO: 356100 - DNA, 25 bp, Mus musculus
cctggcagcttgagatggttttcat

SEQ ID NO: 356101 - DNA, 25 bp, Mus musculus
cctggcagcttgtgatggttttcat

SEQ ID NO: 356102 - DNA, 25 bp, Mus musculus
cctggcaggatgatgttgaatggtt

SEQ ID NO: 356103 - DNA, 25 bp, Mus musculus
cctggcaggatgttgttgaatggtt

SEQ ID NO: 356104 - DNA, 25 bp, Mus musculus
cctggcaggcacaccaaatgttgtg

SEQ ID NO: 356105 - DNA, 25 bp, Mus musculus
cctggcaggcactccaaatgttgtg

SEQ ID NO: 356106 - DNA, 25 bp, Mus musculus
cctggcaggctacggctgacaccat

SEQ ID NO: 356107 - DNA, 25 bp, Mus musculus
cctggcaggctagggctgacaccat

SEQ ID NO: 356108 - DNA, 25 bp, Mus musculus
cctggcagtaggattgtaacttgtg

SEQ ID NO: 356109 - DNA, 25 bp, Mus musculus
cctggcagtaggtttgtaacttgtg

SEQ ID NO: 356110 - DNA, 25 bp, Mus musculus
cctggcagtgccacatttattgttg

SEQ ID NO: 356111 - DNA, 25 bp, Mus musculus
cctggcagtgcctcatttattgttg

SEQ ID NO: 356112 - DNA, 25 bp, Mus musculus
cctggcatcaggcagagaaagtacc

SEQ ID NO: 356113 - DNA, 25 bp, Mus musculus
cctggcatcagggagagaaagtacc

SEQ ID NO: 356114 - DNA, 25 bp, Mus musculus
cctggcatccagcagttagagacct

SEQ ID NO: 356115 - DNA, 25 bp, Mus musculus
cctggcatccaggagttagagacct

SEQ ID NO: 356116 - DNA, 25 bp, Mus musculus
cctggcatcttgctggcatcttgat

SEQ ID NO: 356117 - DNA, 25 bp, Mus musculus
cctggcatcttggtggcatcttgat

SEQ ID NO: 356118 - DNA, 25 bp, Mus musculus
cctggcatctttcaatggtaacaga

SEQ ID NO: 356119 - DNA, 25 bp, Mus musculus
cctggcatctttgaatggtaacaga

SEQ ID NO: 356120 - DNA, 25 bp, Mus musculus
cctggcatggtaatgggctttgatg

SEQ ID NO: 356121 - DNA, 25 bp, Mus musculus
cctggcatggtattgggctttgatg

SEQ ID NO: 356122 - DNA, 25 bp, Mus musculus
cctggcatgtgaagtttccctcagc

SEQ ID NO: 356123 - DNA, 25 bp, Mus musculus
cctggcatgtgaccccgggaccaaa

SEQ ID NO: 356124 - DNA, 25 bp, Mus musculus
cctggcatgtgagcccgggaccaaa

SEQ ID NO: 356125 - DNA, 25 bp, Mus musculus
cctggcatgtgatgtttccctcagc

SEQ ID NO: 356126 - DNA, 25 bp, Mus musculus
cctggcatgttaaatcaagccttta

SEQ ID NO: 356127 - DNA, 25 bp, Mus musculus
cctggcatgttatatcaagccttta

SEQ ID NO: 356128 - DNA, 25 bp, Mus musculus
cctggcattaaccttactggagtcc

SEQ ID NO: 356129 - DNA, 25 bp, Mus musculus
cctggcattaacgttactggagtcc

SEQ ID NO: 356130 - DNA, 25 bp, Mus musculus
cctggccacaagcttgaagacccgg

SEQ ID NO: 356131 - DNA, 25 bp, Mus musculus
cctggccacaaggttgaagacccgg

SEQ ID NO: 356132 - DNA, 25 bp, Mus musculus
cctggccacacacttgcagatggaa

SEQ ID NO: 356133 - DNA, 25 bp, Mus musculus
cctggccacacagttgcagatggaa

SEQ ID NO: 356134 - DNA, 25 bp, Mus musculus
cctggccaccatctcaatgtttgat

SEQ ID NO: 356135 - DNA, 25 bp, Mus musculus
cctggccaccatgtcaatgtttgat

SEQ ID NO: 356136 - DNA, 25 bp, Mus musculus
cctggccacctgactgggcaaagtg

SEQ ID NO: 356137 - DNA, 25 bp, Mus musculus
cctggccacctgtctgggcaaagtg

SEQ ID NO: 356138 - DNA, 25 bp, Mus musculus
cctggccacggaccagagcttttaa

SEQ ID NO: 356139 - DNA, 25 bp, Mus musculus
cctggccacggagcagagcttttaa

SEQ ID NO: 356140 - DNA, 25 bp, Mus musculus
cctggccagggtacttgggaagcac

SEQ ID NO: 356141 - DNA, 25 bp, Mus musculus
cctggccagggttcttgggaagcac

SEQ ID NO: 356142 - DNA, 25 bp, Mus musculus
cctggccagtagagactactctctg

SEQ ID NO: 356143 - DNA, 25 bp, Mus musculus
cctggccagtagtgactactctctg

SEQ ID NO: 356144 - DNA, 25 bp, Mus musculus
cctggccatgcccatgaggtatatg

SEQ ID NO: 356145 - DNA, 25 bp, Mus musculus
cctggccatgccgatgaggtatatg

SEQ ID NO: 356146 - DNA, 25 bp, Mus musculus
cctggccatggcattaagacaatac

SEQ ID NO: 356147 - DNA, 25 bp, Mus musculus
cctggccatggctttaagacaatac

SEQ ID NO: 356148 - DNA, 25 bp, Mus musculus
cctggccctgaaagctatcaatttg

SEQ ID NO: 356149 - DNA, 25 bp, Mus musculus
cctggccctgaatgctatcaatttg

SEQ ID NO: 356150 - DNA, 25 bp, Mus musculus
cctggccctggacttgtcttcaagg

SEQ ID NO: 356151 - DNA, 25 bp, Mus musculus
cctggccctggagttgtcttcaagg

SEQ ID NO: 356152 - DNA, 25 bp, Mus musculus
cctggcccttcaaggaacctgtgaa

SEQ ID NO: 356153 - DNA, 25 bp, Mus musculus
cctggcccttcatggaacctgtgaa

SEQ ID NO: 356154 - DNA, 25 bp, Mus musculus
cctggcccttttcatcagatacaag

SEQ ID NO: 356155 - DNA, 25 bp, Mus musculus
cctggcccttttgatcagatacaag

SEQ ID NO: 356156 - DNA, 25 bp, Mus musculus
cctggcctactgagtggacttctgt

SEQ ID NO: 356157 - DNA, 25 bp, Mus musculus
cctggcctactgtgtggacttctgt

SEQ ID NO: 356158 - DNA, 25 bp, Mus musculus
cctggcctcttgctagaggttcttc

SEQ ID NO: 356159 - DNA, 25 bp, Mus musculus
cctggcctcttggtagaggttcttc

SEQ ID NO: 356160 - DNA, 25 bp, Mus musculus
cctggcctgacaaggcatctcttgc

SEQ ID NO: 356161 - DNA, 25 bp, Mus musculus
cctggcctgacatggcatctcttgc

SEQ ID NO: 356162 - DNA, 25 bp, Mus musculus
cctggcctggagagcagaggaagca

SEQ ID NO: 356163 - DNA, 25 bp, Mus musculus
cctggcctggagtgcagaggaagca

SEQ ID NO: 356164 - DNA, 25 bp, Mus musculus
cctggcctgtctcttgatgctggga

SEQ ID NO: 356165 - DNA, 25 bp, Mus musculus
cctggcctgtctgttgatgctggga

SEQ ID NO: 356166 - DNA, 25 bp, Mus musculus
cctggccttggaaccgacatgaaag

SEQ ID NO: 356167 - DNA, 25 bp, Mus musculus
cctggccttggatccgacatgaaag

SEQ ID NO: 356168 - DNA, 25 bp, Mus musculus
cctggccttgtgcttacattgggta

SEQ ID NO: 356169 - DNA, 25 bp, Mus musculus
cctggccttgtggttacattgggta

SEQ ID NO: 356170 - DNA, 25 bp, Mus musculus
cctggcgaaggtatgaagtgatttg

SEQ ID NO: 356171 - DNA, 25 bp, Mus musculus
cctggcgaaggtttgaagtgatttg

SEQ ID NO: 356172 - DNA, 25 bp, Mus musculus
cctggcgatccaccaattaggctag

SEQ ID NO: 356173 - DNA, 25 bp, Mus musculus
cctggcgatccagcaattaggctag

SEQ ID NO: 356174 - DNA, 25 bp, Mus musculus
cctggcggactaattgcgtttgtgt

SEQ ID NO: 356175 - DNA, 25 bp, Mus musculus
cctggcggactatttgcgtttgtgt

SEQ ID NO: 356176 - DNA, 25 bp, Mus musculus
cctggcgtccatagctacagtttta

SEQ ID NO: 356177 - DNA, 25 bp, Mus musculus
cctggcgtccattgctacagtttta

SEQ ID NO: 356178 - DNA, 25 bp, Mus musculus
cctggcgtgcgtctttggattgaac

SEQ ID NO: 356179 - DNA, 25 bp, Mus musculus
cctggcgtgcgtgtttggattgaac

SEQ ID NO: 356180 - DNA, 25 bp, Mus musculus
cctggcgttacacagagttcgctat

SEQ ID NO: 356181 - DNA, 25 bp, Mus musculus
cctggcgttacagagagttcgctat

SEQ ID NO: 356182 - DNA, 25 bp, Mus musculus
cctggctaagggagtgtgctgctcc

SEQ ID NO: 356183 - DNA, 25 bp, Mus musculus
cctggctaagggtgtgtgctgctcc

SEQ ID NO: 356184 - DNA, 25 bp, Mus musculus
cctggctacctgcacattctgtctg

SEQ ID NO: 356185 - DNA, 25 bp, Mus musculus
cctggctacctggacattctgtctg

SEQ ID NO: 356186 - DNA, 25 bp, Mus musculus
cctggctacgctatatcttctggct

SEQ ID NO: 356187 - DNA, 25 bp, Mus musculus
cctggctacgctttatcttctggct

SEQ ID NO: 356188 - DNA, 25 bp, Mus musculus
cctggctactaaatgtgttctggac

SEQ ID NO: 356189 - DNA, 25 bp, Mus musculus
cctggctactaattgtgttctggac

SEQ ID NO: 356190 - DNA, 25 bp, Mus musculus
cctggctacttgctttgaggcctag

SEQ ID NO: 356191 - DNA, 25 bp, Mus musculus
cctggctacttggtttgaggcctag

SEQ ID NO: 356192 - DNA, 25 bp, Mus musculus
cctggctatactcggatctaataaa

SEQ ID NO: 356193 - DNA, 25 bp, Mus musculus
cctggctatactgggatctaataaa

SEQ ID NO: 356194 - DNA, 25 bp, Mus musculus
cctggctatcgtatgtctatcttaa

SEQ ID NO: 356195 - DNA, 25 bp, Mus musculus
cctggctatcgtttgtctatcttaa

SEQ ID NO: 356196 - DNA, 25 bp, Mus musculus
cctggctatgatatttatgaacggt

SEQ ID NO: 356197 - DNA, 25 bp, Mus musculus
cctggctatgatttttatgaacggt

SEQ ID NO: 356198 - DNA, 25 bp, Mus musculus
cctggctcagctacacaattggtac

SEQ ID NO: 356199 - DNA, 25 bp, Mus musculus
cctggctcagcttcacaattggtac

SEQ ID NO: 356200 - DNA, 25 bp, Mus musculus
cctggctccaaaccatcgcagagaa

SEQ ID NO: 356201 - DNA, 25 bp, Mus musculus
cctggctccaaagcatcgcagagaa

SEQ ID NO: 356202 - DNA, 25 bp, Mus musculus
cctggctccattaacctaaatgtag

SEQ ID NO: 356203 - DNA, 25 bp, Mus musculus
cctggctccatttacctaaatgtag

SEQ ID NO: 356204 - DNA, 25 bp, Mus musculus
cctggctcccaacaacaactgtgga

SEQ ID NO: 356205 - DNA, 25 bp, Mus musculus
cctggctcccaagaacaactgtgga

SEQ ID NO: 356206 - DNA, 25 bp, Mus musculus
cctggctcctccctagtttatgaag

SEQ ID NO: 356207 - DNA, 25 bp, Mus musculus
cctggctcctccgtagtttatgaag

SEQ ID NO: 356208 - DNA, 25 bp, Mus musculus
cctggctccttaatcaggcagcttc

SEQ ID NO: 356209 - DNA, 25 bp, Mus musculus
cctggctccttattcaggcagcttc

SEQ ID NO: 356210 - DNA, 25 bp, Mus musculus
cctggctccttgaggcttttgtgag

SEQ ID NO: 356211 - DNA, 25 bp, Mus musculus
cctggctccttgtggcttttgtgag

SEQ ID NO: 356212 - DNA, 25 bp, Mus musculus
cctggctcctttatatatgttcaac

SEQ ID NO: 356213 - DNA, 25 bp, Mus musculus
cctggctcctttcctacatgtgaag

SEQ ID NO: 356214 - DNA, 25 bp, Mus musculus
cctggctcctttgctacatgtgaag

SEQ ID NO: 356215 - DNA, 25 bp, Mus musculus
cctggctcctttttatatgttcaac

SEQ ID NO: 356216 - DNA, 25 bp, Mus musculus
cctggctctaggcagatggatcaca

SEQ ID NO: 356217 - DNA, 25 bp, Mus musculus
cctggctctagggagatggatcaca

SEQ ID NO: 356218 - DNA, 25 bp, Mus musculus
cctggctctattacctggcaattga

SEQ ID NO: 356219 - DNA, 25 bp, Mus musculus
cctggctctatttcctggcaattga

SEQ ID NO: 356220 - DNA, 25 bp, Mus musculus
cctggctctcagagaactttggtat

SEQ ID NO: 356221 - DNA, 25 bp, Mus musculus
cctggctctcagtgaactttggtat

SEQ ID NO: 356222 - DNA, 25 bp, Mus musculus
cctggctctcatatcaatggattaa

SEQ ID NO: 356223 - DNA, 25 bp, Mus musculus
cctggctctcatttcaatggattaa

SEQ ID NO: 356224 - DNA, 25 bp, Mus musculus
cctggctctggtcactataccttaa

SEQ ID NO: 356225 - DNA, 25 bp, Mus musculus
cctggctctggtgactataccttaa

SEQ ID NO: 356226 - DNA, 25 bp, Mus musculus
cctggctcttcacttcagagatggg

SEQ ID NO: 356227 - DNA, 25 bp, Mus musculus
cctggctcttcagttcagagatggg

SEQ ID NO: 356228 - DNA, 25 bp, Mus musculus
cctggctcttttagacctgaaatca

SEQ ID NO: 356229 - DNA, 25 bp, Mus musculus
cctggctctttttgacctgaaatca

SEQ ID NO: 356230 - DNA, 25 bp, Mus musculus
cctggctgatgtcatagtttgtctc

SEQ ID NO: 356231 - DNA, 25 bp, Mus musculus
cctggctgatgtgatagtttgtctc

SEQ ID NO: 356232 - DNA, 25 bp, Mus musculus
cctggctgcaaaccccatgcttgga

SEQ ID NO: 356233 - DNA, 25 bp, Mus musculus
cctggctgcaaagcccatgcttgga

SEQ ID NO: 356234 - DNA, 25 bp, Mus musculus
cctggctgcaggaagttgggcctat

SEQ ID NO: 356235 - DNA, 25 bp, Mus musculus
cctggctgcaggtagttgggcctat

SEQ ID NO: 356236 - DNA, 25 bp, Mus musculus
cctggctgccttctgggaataaaat

SEQ ID NO: 356237 - DNA, 25 bp, Mus musculus
cctggctgccttgtgggaataaaat

SEQ ID NO: 356238 - DNA, 25 bp, Mus musculus
cctggctgctaacgtcagtggaccc

SEQ ID NO: 356239 - DNA, 25 bp, Mus musculus
cctggctgctaaggtcagtggaccc

SEQ ID NO: 356240 - DNA, 25 bp, Mus musculus
cctggctgctcaacgggaagtgcat

SEQ ID NO: 356241 - DNA, 25 bp, Mus musculus
cctggctgctcatcgggaagtgcat

SEQ ID NO: 356242 - DNA, 25 bp, Mus musculus
cctggctggagtaggtgttctgatc

SEQ ID NO: 356243 - DNA, 25 bp, Mus musculus
cctggctggagttggtgttctgatc

SEQ ID NO: 356244 - DNA, 25 bp, Mus musculus
cctggctggatactttatggctggc

SEQ ID NO: 356245 - DNA, 25 bp, Mus musculus
cctggctggatagtttatggctggc

SEQ ID NO: 356246 - DNA, 25 bp, Mus musculus
cctggctggcctcgcttgtagagtt

SEQ ID NO: 356247 - DNA, 25 bp, Mus musculus
cctggctggcctggcttgtagagtt

SEQ ID NO: 356248 - DNA, 25 bp, Mus musculus
cctggctggctccaaactcactaag

SEQ ID NO: 356249 - DNA, 25 bp, Mus musculus
cctggctggctcgaaactcactaag

SEQ ID NO: 356250 - DNA, 25 bp, Mus musculus
cctggctggtggacagttagctgcc

SEQ ID NO: 356251 - DNA, 25 bp, Mus musculus
cctggctggtggtcagttagctgcc

SEQ ID NO: 356252 - DNA, 25 bp, Mus musculus
cctggctgtacgcaattcacaagtg

SEQ ID NO: 356253 - DNA, 25 bp, Mus musculus
cctggctgtacggaattcacaagtg

SEQ ID NO: 356254 - DNA, 25 bp, Mus musculus
cctggctgtagcactgatgtatcgc

SEQ ID NO: 356255 - DNA, 25 bp, Mus musculus
cctggctgtagctctgatgtatcgc

SEQ ID NO: 356256 - DNA, 25 bp, Mus musculus
cctggctgtcatagaatttgcttat

SEQ ID NO: 356257 - DNA, 25 bp, Mus musculus
cctggctgtcatatcagttgcttaa

SEQ ID NO: 356258 - DNA, 25 bp, Mus musculus
cctggctgtcattgaatttgcttat

SEQ ID NO: 356259 - DNA, 25 bp, Mus musculus
cctggctgtcatttcagttgcttaa

SEQ ID NO: 356260 - DNA, 25 bp, Mus musculus
cctggctgtctgagtcccgtgggaa

SEQ ID NO: 356261 - DNA, 25 bp, Mus musculus
cctggctgtctgtgtcccgtgggaa

SEQ ID NO: 356262 - DNA, 25 bp, Mus musculus
cctggctgttatctggcagtggtat

SEQ ID NO: 356263 - DNA, 25 bp, Mus musculus
cctggctgttatgtggcagtggtat

SEQ ID NO: 356264 - DNA, 25 bp, Mus musculus
cctggcttaggcacacattaccaaa

SEQ ID NO: 356265 - DNA, 25 bp, Mus musculus
cctggcttaggctcacattaccaaa

SEQ ID NO: 356266 - DNA, 25 bp, Mus musculus
cctggcttccaacaggactgtcact

SEQ ID NO: 356267 - DNA, 25 bp, Mus musculus
cctggcttccaagaggactgtcact

SEQ ID NO: 356268 - DNA, 25 bp, Mus musculus
cctggcttccacaaacgaggcactg

SEQ ID NO: 356269 - DNA, 25 bp, Mus musculus
cctggcttccacagcgatgtttctg

SEQ ID NO: 356270 - DNA, 25 bp, Mus musculus
cctggcttccactaacgaggcactg

SEQ ID NO: 356271 - DNA, 25 bp, Mus musculus
cctggcttccactgcgatgtttctg

SEQ ID NO: 356272 - DNA, 25 bp, Mus musculus
cctggcttggcgagtgtgtgaccac

SEQ ID NO: 356273 - DNA, 25 bp, Mus musculus
cctggcttggcgtgtgtgtgaccac

SEQ ID NO: 356274 - DNA, 25 bp, Mus musculus
cctggcttggctacaggacctccag

SEQ ID NO: 356275 - DNA, 25 bp, Mus musculus
cctggcttggcttcaggacctccag

SEQ ID NO: 356276 - DNA, 25 bp, Mus musculus
cctggcttgggaagtcttttctgga

SEQ ID NO: 356277 - DNA, 25 bp, Mus musculus
cctggcttgggatgtcttttctgga

SEQ ID NO: 356278 - DNA, 25 bp, Mus musculus
cctggcttgtagcaggaccacacaa

SEQ ID NO: 356279 - DNA, 25 bp, Mus musculus
cctggcttgtaggaggaccacacaa

SEQ ID NO: 356280 - DNA, 25 bp, Mus musculus
cctggcttgtctcgatctttctaag

SEQ ID NO: 356281 - DNA, 25 bp, Mus musculus
cctggcttgtctggatctttctaag

SEQ ID NO: 356282 - DNA, 25 bp, Mus musculus
cctggctttagacaagccttccatg

SEQ ID NO: 356283 - DNA, 25 bp, Mus musculus
cctggctttagagaagccttccatg

SEQ ID NO: 356284 - DNA, 25 bp, Mus musculus
cctggctttcagatgtgatggcgaa

SEQ ID NO: 356285 - DNA, 25 bp, Mus musculus
cctggctttcagttgtgatggcgaa

SEQ ID NO: 356286 - DNA, 25 bp, Mus musculus
cctggctttccaaggtgtgagcatt

SEQ ID NO: 356287 - DNA, 25 bp, Mus musculus
cctggctttccatggtgtgagcatt

SEQ ID NO: 356288 - DNA, 25 bp, Mus musculus
cctggctttctcagattctgtgatt

SEQ ID NO: 356289 - DNA, 25 bp, Mus musculus
cctggctttctctgattctgtgatt

SEQ ID NO: 356290 - DNA, 25 bp, Mus musculus
cctggctttgaaataggagtggcta

SEQ ID NO: 356291 - DNA, 25 bp, Mus musculus
cctggctttgaattaggagtggcta

SEQ ID NO: 356292 - DNA, 25 bp, Mus musculus
cctggctttgagctgtcagcatctg

SEQ ID NO: 356293 - DNA, 25 bp, Mus musculus
cctggctttgaggtgtcagcatctg

SEQ ID NO: 356294 - DNA, 25 bp, Mus musculus
cctggctttgtactagctcatgcta

SEQ ID NO: 356295 - DNA, 25 bp, Mus musculus
cctggctttgtagtagctcatgcta

SEQ ID NO: 356296 - DNA, 25 bp, Mus musculus
cctgggaaagacatgcagtgtagat

SEQ ID NO: 356297 - DNA, 25 bp, Mus musculus
cctgggaaagacttgcagtgtagat

SEQ ID NO: 356298 - DNA, 25 bp, Mus musculus
cctgggaaaggcctcatgtcatgta

SEQ ID NO: 356299 - DNA, 25 bp, Mus musculus
cctgggaaaggcgtcatgtcatgta

SEQ ID NO: 356300 - DNA, 25 bp, Mus musculus
cctgggaaatgtcccctccaaggcc

SEQ ID NO: 356301 - DNA, 25 bp, Mus musculus
cctgggaaatgtgccctccaaggcc

SEQ ID NO: 356302 - DNA, 25 bp, Mus musculus
cctgggaagaatcaaactgatgcat

SEQ ID NO: 356303 - DNA, 25 bp, Mus musculus
cctgggaagaatgaaactgatgcat

SEQ ID NO: 356304 - DNA, 25 bp, Mus musculus
cctgggaagagactgttttgtgttt

SEQ ID NO: 356305 - DNA, 25 bp, Mus musculus
cctgggaagagagtgttttgtgttt

SEQ ID NO: 356306 - DNA, 25 bp, Mus musculus
cctgggaagagcagcagccccggaa

SEQ ID NO: 356307 - DNA, 25 bp, Mus musculus
cctgggaagagctgcagccccggaa

SEQ ID NO: 356308 - DNA, 25 bp, Mus musculus
cctgggaaggccagggccctagcct

SEQ ID NO: 356309 - DNA, 25 bp, Mus musculus
cctgggaaggcctgggccctagcct

SEQ ID NO: 356310 - DNA, 25 bp, Mus musculus
cctgggaatcaacggacaagccagt

SEQ ID NO: 356311 - DNA, 25 bp, Mus musculus
cctgggaatcaagggacaagccagt

SEQ ID NO: 356312 - DNA, 25 bp, Mus musculus
cctgggaatgttactgtaatcccat

SEQ ID NO: 356313 - DNA, 25 bp, Mus musculus
cctgggaatgtttctgtaatcccat

SEQ ID NO: 356314 - DNA, 25 bp, Mus musculus
cctgggaattgtctttggaccgaca

SEQ ID NO: 356315 - DNA, 25 bp, Mus musculus
cctgggaattgtgtttggaccgaca

SEQ ID NO: 356316 - DNA, 25 bp, Mus musculus
cctgggacacgcagcgaccggaagt

SEQ ID NO: 356317 - DNA, 25 bp, Mus musculus
cctgggacacgctgcgaccggaagt

SEQ ID NO: 356318 - DNA, 25 bp, Mus musculus
cctgggacagatcattggtagcact

SEQ ID NO: 356319 - DNA, 25 bp, Mus musculus
cctgggacagatgattggtagcact

SEQ ID NO: 356320 - DNA, 25 bp, Mus musculus
cctgggacattgcagaccctcaagt

SEQ ID NO: 356321 - DNA, 25 bp, Mus musculus
cctgggacattggagaccctcaagt

SEQ ID NO: 356322 - DNA, 25 bp, Mus musculus
cctgggacctaaaggtgaagatgct

SEQ ID NO: 356323 - DNA, 25 bp, Mus musculus
cctgggacctaatggtgaagatgct

SEQ ID NO: 356324 - DNA, 25 bp, Mus musculus
cctgggaccttgagcttgataggca

SEQ ID NO: 356325 - DNA, 25 bp, Mus musculus
cctgggaccttgtgcttgataggca

SEQ ID NO: 356326 - DNA, 25 bp, Mus musculus
cctgggacgtttccttatcttttga

SEQ ID NO: 356327 - DNA, 25 bp, Mus musculus
cctgggacgtttgcttatcttttga

SEQ ID NO: 356328 - DNA, 25 bp, Mus musculus
cctgggactcttcactggtgatgaa

SEQ ID NO: 356329 - DNA, 25 bp, Mus musculus
cctgggactcttgactggtgatgaa

SEQ ID NO: 356330 - DNA, 25 bp, Mus musculus
cctgggactgaaacggcctgtgctg

SEQ ID NO: 356331 - DNA, 25 bp, Mus musculus
cctgggactgaatcggcctgtgctg

SEQ ID NO: 356332 - DNA, 25 bp, Mus musculus
cctgggactgtccaagaaatactgg

SEQ ID NO: 356333 - DNA, 25 bp, Mus musculus
cctgggactgtcgaagaaatactgg

SEQ ID NO: 356334 - DNA, 25 bp, Mus musculus
cctgggactgtgaaaccttgtgggt

SEQ ID NO: 356335 - DNA, 25 bp, Mus musculus
cctgggactgtgtaaccttgtgggt

SEQ ID NO: 356336 - DNA, 25 bp, Mus musculus
cctgggacttgtaagctgaagaaaa

SEQ ID NO: 356337 - DNA, 25 bp, Mus musculus
cctgggacttgtcccgtctataaga

SEQ ID NO: 356338 - DNA, 25 bp, Mus musculus
cctgggacttgtgccgtctataaga

SEQ ID NO: 356339 - DNA, 25 bp, Mus musculus
cctgggacttgttagctgaagaaaa

SEQ ID NO: 356340 - DNA, 25 bp, Mus musculus
cctgggagagttctacggctaagca

SEQ ID NO: 356341 - DNA, 25 bp, Mus musculus
cctgggagagttgtacggctaagca

SEQ ID NO: 356342 - DNA, 25 bp, Mus musculus
cctgggagccaaagggcgagatccc

SEQ ID NO: 356343 - DNA, 25 bp, Mus musculus
cctgggagccaatgggcgagatccc

SEQ ID NO: 356344 - DNA, 25 bp, Mus musculus
cctgggagccagaaattccacttgt

SEQ ID NO: 356345 - DNA, 25 bp, Mus musculus
cctgggagccagcaagacctcagat

SEQ ID NO: 356346 - DNA, 25 bp, Mus musculus
cctgggagccaggaagacctcagat

SEQ ID NO: 356347 - DNA, 25 bp, Mus musculus
cctgggagccagtaattccacttgt

SEQ ID NO: 356348 - DNA, 25 bp, Mus musculus
cctgggaggcacaaggaccctgaac

SEQ ID NO: 356349 - DNA, 25 bp, Mus musculus
cctgggaggcactaggaccctgaac

SEQ ID NO: 356350 - DNA, 25 bp, Mus musculus
cctgggagggtcatttagcgcatat

SEQ ID NO: 356351 - DNA, 25 bp, Mus musculus
cctgggagggtcttttagcgcatat

SEQ ID NO: 356352 - DNA, 25 bp, Mus musculus
cctgggagtgagcagcatgactggt

SEQ ID NO: 356353 - DNA, 25 bp, Mus musculus
cctgggagtgaggagcatgactggt

SEQ ID NO: 356354 - DNA, 25 bp, Mus musculus
cctgggatacacatggcagctgggt

SEQ ID NO: 356355 - DNA, 25 bp, Mus musculus
cctgggatacacttggcagctgggt

SEQ ID NO: 356356 - DNA, 25 bp, Mus musculus
cctgggatccacattagcagaaggg

SEQ ID NO: 356357 - DNA, 25 bp, Mus musculus
cctgggatccactttagcagaaggg

SEQ ID NO: 356358 - DNA, 25 bp, Mus musculus
cctgggatccagacgaatcttgtca

SEQ ID NO: 356359 - DNA, 25 bp, Mus musculus
cctgggatccagtcgaatcttgtca

SEQ ID NO: 356360 - DNA, 25 bp, Mus musculus
cctgggatgctgctttctttgtata

SEQ ID NO: 356361 - DNA, 25 bp, Mus musculus
cctgggatgctggtttctttgtata

SEQ ID NO: 356362 - DNA, 25 bp, Mus musculus
cctgggatgtgaccctggttcagaa

SEQ ID NO: 356363 - DNA, 25 bp, Mus musculus
cctgggatgtgagcctggttcagaa

SEQ ID NO: 356364 - DNA, 25 bp, Mus musculus
cctgggatgtggactggtacataca

SEQ ID NO: 356365 - DNA, 25 bp, Mus musculus
cctgggatgtggtctggtacataca

SEQ ID NO: 356366 - DNA, 25 bp, Mus musculus
cctgggattgatcttgggtgcattt

SEQ ID NO: 356367 - DNA, 25 bp, Mus musculus
cctgggattgatgttgggtgcattt

SEQ ID NO: 356368 - DNA, 25 bp, Mus musculus
cctgggcacctgacagaggttcctg

SEQ ID NO: 356369 - DNA, 25 bp, Mus musculus
cctgggcacctgtcagaggttcctg

SEQ ID NO: 356370 - DNA, 25 bp, Mus musculus
cctgggcacgtgatggctacaactg

SEQ ID NO: 356371 - DNA, 25 bp, Mus musculus
cctgggcacgtgttggctacaactg

SEQ ID NO: 356372 - DNA, 25 bp, Mus musculus
cctgggcagcaccagtagccaagtg

SEQ ID NO: 356373 - DNA, 25 bp, Mus musculus
cctgggcagcacgagtagccaagtg

SEQ ID NO: 356374 - DNA, 25 bp, Mus musculus
cctgggcagcgaccttgctggacat

SEQ ID NO: 356375 - DNA, 25 bp, Mus musculus
cctgggcagcgagcttgctggacat

SEQ ID NO: 356376 - DNA, 25 bp, Mus musculus
cctgggcagggcattccgtgttagt

SEQ ID NO: 356377 - DNA, 25 bp, Mus musculus
cctgggcagggctttccgtgttagt

SEQ ID NO: 356378 - DNA, 25 bp, Mus musculus
cctgggcagtaccatttctttttgt

SEQ ID NO: 356379 - DNA, 25 bp, Mus musculus
cctgggcagtacgatttctttttgt

SEQ ID NO: 356380 - DNA, 25 bp, Mus musculus
cctgggcatctaaccctagaagaca

SEQ ID NO: 356381 - DNA, 25 bp, Mus musculus
cctgggcatctatccctagaagaca

SEQ ID NO: 356382 - DNA, 25 bp, Mus musculus
cctgggcatgatataccttggcttt

SEQ ID NO: 356383 - DNA, 25 bp, Mus musculus
cctgggcatgatttaccttggcttt

SEQ ID NO: 356384 - DNA, 25 bp, Mus musculus
cctgggcatgcactgggattcaaga

SEQ ID NO: 356385 - DNA, 25 bp, Mus musculus
cctgggcatgcagtgggattcaaga

SEQ ID NO: 356386 - DNA, 25 bp, Mus musculus
cctgggcatggaatacgtacctgta

SEQ ID NO: 356387 - DNA, 25 bp, Mus musculus
cctgggcatggattacgtacctgta

SEQ ID NO: 356388 - DNA, 25 bp, Mus musculus
cctgggcattctcacagcaaatgtt

SEQ ID NO: 356389 - DNA, 25 bp, Mus musculus
cctgggcattctcacttcaggtact

SEQ ID NO: 356390 - DNA, 25 bp, Mus musculus
cctgggcattctgacagcaaatgtt

SEQ ID NO: 356391 - DNA, 25 bp, Mus musculus
cctgggcattctgacttcaggtact

SEQ ID NO: 356392 - DNA, 25 bp, Mus musculus
cctgggccatcactagcaacaatag

SEQ ID NO: 356393 - DNA, 25 bp, Mus musculus
cctgggccatcagtagcaacaatag

SEQ ID NO: 356394 - DNA, 25 bp, Mus musculus
cctgggccatttctcaaacatgcct

SEQ ID NO: 356395 - DNA, 25 bp, Mus musculus
cctgggccatttgtcaaacatgcct

SEQ ID NO: 356396 - DNA, 25 bp, Mus musculus
cctgggcccaagactggagcctgtg

SEQ ID NO: 356397 - DNA, 25 bp, Mus musculus
cctgggcccaagtctggagcctgtg

SEQ ID NO: 356398 - DNA, 25 bp, Mus musculus
cctgggccccatactggaggagcaa

SEQ ID NO: 356399 - DNA, 25 bp, Mus musculus
cctgggccccattctggaggagcaa

SEQ ID NO: 356400 - DNA, 25 bp, Mus musculus
cctgggccggtcaggatagttacct

SEQ ID NO: 356401 - DNA, 25 bp, Mus musculus
cctgggccggtctggatagttacct

SEQ ID NO: 356402 - DNA, 25 bp, Mus musculus
cctgggcctcataatttcgcaaaag

SEQ ID NO: 356403 - DNA, 25 bp, Mus musculus
cctgggcctcattatttcgcaaaag

SEQ ID NO: 356404 - DNA, 25 bp, Mus musculus
cctgggccttatcctggacatggtg

SEQ ID NO: 356405 - DNA, 25 bp, Mus musculus
cctgggccttatgctggacatggtg

SEQ ID NO: 356406 - DNA, 25 bp, Mus musculus
cctgggcgcaaactgactgctgaag

SEQ ID NO: 356407 - DNA, 25 bp, Mus musculus
cctgggcgcaaagtgactgctgaag

SEQ ID NO: 356408 - DNA, 25 bp, Mus musculus
cctgggcgctgtactgtatgagatg

SEQ ID NO: 356409 - DNA, 25 bp, Mus musculus
cctgggcgctgttctgtatgagatg

SEQ ID NO: 356410 - DNA, 25 bp, Mus musculus
cctgggcggagcatttgtggcattt

SEQ ID NO: 356411 - DNA, 25 bp, Mus musculus
cctgggcggagcttttgtggcattt

SEQ ID NO: 356412 - DNA, 25 bp, Mus musculus
cctgggcggtaactaagtgcttgtt

SEQ ID NO: 356413 - DNA, 25 bp, Mus musculus
cctgggcggtaagtaagtgcttgtt

SEQ ID NO: 356414 - DNA, 25 bp, Mus musculus
cctgggctcacaccagctctgtgta

SEQ ID NO: 356415 - DNA, 25 bp, Mus musculus
cctgggctcacagcagctctgtgta

SEQ ID NO: 356416 - DNA, 25 bp, Mus musculus
cctgggctcacgcttgagtgcagaa

SEQ ID NO: 356417 - DNA, 25 bp, Mus musculus
cctgggctcacggttgagtgcagaa

SEQ ID NO: 356418 - DNA, 25 bp, Mus musculus
cctgggctctatcagcaatcagctg

SEQ ID NO: 356419 - DNA, 25 bp, Mus musculus
cctgggctctatgagcaatcagctg

SEQ ID NO: 356420 - DNA, 25 bp, Mus musculus
cctgggctctggctgatagctacaa

SEQ ID NO: 356421 - DNA, 25 bp, Mus musculus
cctgggctctgggtgatagctacaa

SEQ ID NO: 356422 - DNA, 25 bp, Mus musculus
cctgggctctgtcttgctcaaagca

SEQ ID NO: 356423 - DNA, 25 bp, Mus musculus
cctgggctctgtgttgctcaaagca

SEQ ID NO: 356424 - DNA, 25 bp, Mus musculus
cctgggctgcctcaactggtgtaaa

SEQ ID NO: 356425 - DNA, 25 bp, Mus musculus
cctgggctgcctgaactggtgtaaa

SEQ ID NO: 356426 - DNA, 25 bp, Mus musculus
cctgggctggtaacttgggctctat

SEQ ID NO: 356427 - DNA, 25 bp, Mus musculus
cctgggctggtatcttgggctctat

SEQ ID NO: 356428 - DNA, 25 bp, Mus musculus
cctgggctgtagagtgagtccaaat

SEQ ID NO: 356429 - DNA, 25 bp, Mus musculus
cctgggctgtagtgtgagtccaaat

SEQ ID NO: 356430 - DNA, 25 bp, Mus musculus
cctgggcttcaaagtgcaagcttgt

SEQ ID NO: 356431 - DNA, 25 bp, Mus musculus
cctgggcttcaatgtgcaagcttgt

SEQ ID NO: 356432 - DNA, 25 bp, Mus musculus
cctgggcttcagctgaaaaacgaat

SEQ ID NO: 356433 - DNA, 25 bp, Mus musculus
cctgggcttcaggtgaaaaacgaat

SEQ ID NO: 356434 - DNA, 25 bp, Mus musculus
cctgggcttgatctcctgttagtgg

SEQ ID NO: 356435 - DNA, 25 bp, Mus musculus
cctgggcttgatgtcctgttagtgg

SEQ ID NO: 356436 - DNA, 25 bp, Mus musculus
cctgggcttggcagccatcaagagg

SEQ ID NO: 356437 - DNA, 25 bp, Mus musculus
cctgggcttggctgccatcaagagg

SEQ ID NO: 356438 - DNA, 25 bp, Mus musculus
cctgggcttggtagtagttgctcac

SEQ ID NO: 356439 - DNA, 25 bp, Mus musculus
cctgggcttggttgtagttgctcac

SEQ ID NO: 356440 - DNA, 25 bp, Mus musculus
cctgggtaacctcactgaactgaac

SEQ ID NO: 356441 - DNA, 25 bp, Mus musculus
cctgggtaacctgactgaactgaac

SEQ ID NO: 356442 - DNA, 25 bp, Mus musculus
cctgggtaaggactgcatcgtgcat

SEQ ID NO: 356443 - DNA, 25 bp, Mus musculus
cctgggtaaggagtgcatcgtgcat

SEQ ID NO: 356444 - DNA, 25 bp, Mus musculus
cctgggtactcaaccgagagggtta

SEQ ID NO: 356445 - DNA, 25 bp, Mus musculus
cctgggtactcatccgagagggtta

SEQ ID NO: 356446 - DNA, 25 bp, Mus musculus
cctgggtagaatcatcttggaggat

SEQ ID NO: 356447 - DNA, 25 bp, Mus musculus
cctgggtagaatgatcttggaggat

SEQ ID NO: 356448 - DNA, 25 bp, Mus musculus
cctgggtagtgtcagatggatcaca

SEQ ID NO: 356449 - DNA, 25 bp, Mus musculus
cctgggtagtgtgagatggatcaca

SEQ ID NO: 356450 - DNA, 25 bp, Mus musculus
cctgggtatgacagggatgctgcct

SEQ ID NO: 356451 - DNA, 25 bp, Mus musculus
cctgggtatgactgggatgctgcct

SEQ ID NO: 356452 - DNA, 25 bp, Mus musculus
cctgggtatgcacggctctgttttg

SEQ ID NO: 356453 - DNA, 25 bp, Mus musculus
cctgggtatgcagggctctgttttg

SEQ ID NO: 356454 - DNA, 25 bp, Mus musculus
cctgggtcaaggctgcaattagaat

SEQ ID NO: 356455 - DNA, 25 bp, Mus musculus
cctgggtcaagggtgcaattagaat

SEQ ID NO: 356456 - DNA, 25 bp, Mus musculus
cctgggtcagggaacactctcgaag

SEQ ID NO: 356457 - DNA, 25 bp, Mus musculus
cctgggtcagggtacactctcgaag

SEQ ID NO: 356458 - DNA, 25 bp, Mus musculus
cctgggtcctatccgagaactgaag

SEQ ID NO: 356459 - DNA, 25 bp, Mus musculus
cctgggtcctatgcgagaactgaag

SEQ ID NO: 356460 - DNA, 25 bp, Mus musculus
cctgggtcctcacctgggcctgaga

SEQ ID NO: 356461 - DNA, 25 bp, Mus musculus
cctgggtcctcagctgggcctgaga

SEQ ID NO: 356462 - DNA, 25 bp, Mus musculus
cctgggtcggagcagatcttgtaat

SEQ ID NO: 356463 - DNA, 25 bp, Mus musculus
cctgggtcggaggagatcttgtaat

SEQ ID NO: 356464 - DNA, 25 bp, Mus musculus
cctgggtcgtgaccctaatcagagg

SEQ ID NO: 356465 - DNA, 25 bp, Mus musculus
cctgggtcgtgagcctaatcagagg

SEQ ID NO: 356466 - DNA, 25 bp, Mus musculus
cctgggtcttagcaggtctagctaa

SEQ ID NO: 356467 - DNA, 25 bp, Mus musculus
cctgggtcttaggaggtctagctaa

SEQ ID NO: 356468 - DNA, 25 bp, Mus musculus
cctgggtgaccgccatgtcatgaga

SEQ ID NO: 356469 - DNA, 25 bp, Mus musculus
cctgggtgaccggcatgtcatgaga

SEQ ID NO: 356470 - DNA, 25 bp, Mus musculus
cctgggtgaggaagacttcaaacaa

SEQ ID NO: 356471 - DNA, 25 bp, Mus musculus
cctgggtgaggatgacttcaaacaa

SEQ ID NO: 356472 - DNA, 25 bp, Mus musculus
cctgggtgccacctgctgacctaat

SEQ ID NO: 356473 - DNA, 25 bp, Mus musculus
cctgggtgccacgtgctgacctaat

SEQ ID NO: 356474 - DNA, 25 bp, Mus musculus
cctgggtgccagatttttaatcact

SEQ ID NO: 356475 - DNA, 25 bp, Mus musculus
cctgggtgccagttttttaatcact

SEQ ID NO: 356476 - DNA, 25 bp, Mus musculus
cctgggtgccctcttgtacaattat

SEQ ID NO: 356477 - DNA, 25 bp, Mus musculus
cctgggtgccctgttgtacaattat

SEQ ID NO: 356478 - DNA, 25 bp, Mus musculus
cctgggtgctaccattaaaaaagat

SEQ ID NO: 356479 - DNA, 25 bp, Mus musculus
cctgggtgctacgattaaaaaagat

SEQ ID NO: 356480 - DNA, 25 bp, Mus musculus
cctgggtgctgcactgagatatgca

SEQ ID NO: 356481 - DNA, 25 bp, Mus musculus
cctgggtgctgcagggcccctgaaa

SEQ ID NO: 356482 - DNA, 25 bp, Mus musculus
cctgggtgctgctctgagatatgca

SEQ ID NO: 356483 - DNA, 25 bp, Mus musculus
cctgggtgctgctgggcccctgaaa

SEQ ID NO: 356484 - DNA, 25 bp, Mus musculus
cctgggtgctgtcagaaatcagact

SEQ ID NO: 356485 - DNA, 25 bp, Mus musculus
cctgggtgctgtgagaaatcagact

SEQ ID NO: 356486 - DNA, 25 bp, Mus musculus
cctgggtggtagaagtgcacacctt

SEQ ID NO: 356487 - DNA, 25 bp, Mus musculus
cctgggtggtagtagtgcacacctt

SEQ ID NO: 356488 - DNA, 25 bp, Mus musculus
cctgggtgtagccagttcagcatcg

SEQ ID NO: 356489 - DNA, 25 bp, Mus musculus
cctgggtgtagcgagttcagcatcg

SEQ ID NO: 356490 - DNA, 25 bp, Mus musculus
cctgggtgtcttatgtttcttctgt

SEQ ID NO: 356491 - DNA, 25 bp, Mus musculus
cctgggtgtcttttgtttcttctgt

SEQ ID NO: 356492 - DNA, 25 bp, Mus musculus
cctgggtgtgttcacgccatctgct

SEQ ID NO: 356493 - DNA, 25 bp, Mus musculus
cctgggtgtgttgacgccatctgct

SEQ ID NO: 356494 - DNA, 25 bp, Mus musculus
cctgggtgttctcgtgctgatagta

SEQ ID NO: 356495 - DNA, 25 bp, Mus musculus
cctgggtgttctggtgctgatagta

SEQ ID NO: 356496 - DNA, 25 bp, Mus musculus
cctgggttattcatattccttggga

SEQ ID NO: 356497 - DNA, 25 bp, Mus musculus
cctgggttattcttattccttggga

SEQ ID NO: 356498 - DNA, 25 bp, Mus musculus
cctgggttcagtctgttgtactttt

SEQ ID NO: 356499 - DNA, 25 bp, Mus musculus
cctgggttcagtgtgttgtactttt

SEQ ID NO: 356500 - DNA, 25 bp, Mus musculus
cctgggttccaacgcttcatctgaa

SEQ ID NO: 356501 - DNA, 25 bp, Mus musculus
cctgggttccaaggcttcatctgaa

SEQ ID NO: 356502 - DNA, 25 bp, Mus musculus
cctgggttccatccttggtattagg

SEQ ID NO: 356503 - DNA, 25 bp, Mus musculus
cctgggttccatgcttggtattagg

SEQ ID NO: 356504 - DNA, 25 bp, Mus musculus
cctgggttctatacctatcatttgc

SEQ ID NO: 356505 - DNA, 25 bp, Mus musculus
cctgggttctatatctattcactga

SEQ ID NO: 356506 - DNA, 25 bp, Mus musculus
cctgggttctattcctatcatttgc

SEQ ID NO: 356507 - DNA, 25 bp, Mus musculus
cctgggttctatttctattcactga

SEQ ID NO: 356508 - DNA, 25 bp, Mus musculus
cctgggttggagatgctactttcta

SEQ ID NO: 356509 - DNA, 25 bp, Mus musculus
cctgggttggagttgctactttcta

SEQ ID NO: 356510 - DNA, 25 bp, Mus musculus
cctgggttggatacatctgacggac

SEQ ID NO: 356511 - DNA, 25 bp, Mus musculus
cctgggttggattcatctgacggac

SEQ ID NO: 356512 - DNA, 25 bp, Mus musculus
cctgggttgtgtctgctctagtcta

SEQ ID NO: 356513 - DNA, 25 bp, Mus musculus
cctgggttgtgtgtgctctagtcta

SEQ ID NO: 356514 - DNA, 25 bp, Mus musculus
cctgggtttaatactcaagagacta

SEQ ID NO: 356515 - DNA, 25 bp, Mus musculus
cctgggtttaattctcaagagacta

SEQ ID NO: 356516 - DNA, 25 bp, Mus musculus
cctgggtttacaacccttcatgaac

SEQ ID NO: 356517 - DNA, 25 bp, Mus musculus
cctgggtttacatcccttcatgaac

SEQ ID NO: 356518 - DNA, 25 bp, Mus musculus
cctgggtttagtacctatggtggag

SEQ ID NO: 356519 - DNA, 25 bp, Mus musculus
cctgggtttagttcctatggtggag

SEQ ID NO: 356520 - DNA, 25 bp, Mus musculus
cctgggtttgccacactggtctagg

SEQ ID NO: 356521 - DNA, 25 bp, Mus musculus
cctgggtttgcctcactggtctagg

SEQ ID NO: 356522 - DNA, 25 bp, Mus musculus
cctgggttttagctatttaatagat

SEQ ID NO: 356523 - DNA, 25 bp, Mus musculus
cctgggttttaggtatttaatagat

SEQ ID NO: 356524 - DNA, 25 bp, Mus musculus
cctgggttttggcatgagtagcatc

SEQ ID NO: 356525 - DNA, 25 bp, Mus musculus
cctgggttttgggatgagtagcatc

SEQ ID NO: 356526 - DNA, 25 bp, Mus musculus
cctggtaatgcactttggatgggaa

SEQ ID NO: 356527 - DNA, 25 bp, Mus musculus
cctggtaatgcagtttggatgggaa

SEQ ID NO: 356528 - DNA, 25 bp, Mus musculus
cctggtaccgtgcagctttattttg

SEQ ID NO: 356529 - DNA, 25 bp, Mus musculus
cctggtaccgtggagctttattttg

SEQ ID NO: 356530 - DNA, 25 bp, Mus musculus
cctggtacgtttacatctgttgaag

SEQ ID NO: 356531 - DNA, 25 bp, Mus musculus
cctggtacgttttcatctgttgaag

SEQ ID NO: 356532 - DNA, 25 bp, Mus musculus
cctggtactggaatacttcattcag

SEQ ID NO: 356533 - DNA, 25 bp, Mus musculus
cctggtactggattacttcattcag

SEQ ID NO: 356534 - DNA, 25 bp, Mus musculus
cctggtacttctatgtgctagacac

SEQ ID NO: 356535 - DNA, 25 bp, Mus musculus
cctggtacttctttgtgctagacac

SEQ ID NO: 356536 - DNA, 25 bp, Mus musculus
cctggtagacctaaaagactggcaa

SEQ ID NO: 356537 - DNA, 25 bp, Mus musculus
cctggtagaccttaaagactggcaa

SEQ ID NO: 356538 - DNA, 25 bp, Mus musculus
cctggtagctgacgggcacctgatt

SEQ ID NO: 356539 - DNA, 25 bp, Mus musculus
cctggtagctgaggggcacctgatt

SEQ ID NO: 356540 - DNA, 25 bp, Mus musculus
cctggtaggcagaggctccagatgt

SEQ ID NO: 356541 - DNA, 25 bp, Mus musculus
cctggtaggcagtggctccagatgt

SEQ ID NO: 356542 - DNA, 25 bp, Mus musculus
cctggtagttctcagctggctcaaa

SEQ ID NO: 356543 - DNA, 25 bp, Mus musculus
cctggtagttctgagctggctcaaa

SEQ ID NO: 356544 - DNA, 25 bp, Mus musculus
cctggtatgccaatgaatccggctc

SEQ ID NO: 356545 - DNA, 25 bp, Mus musculus
cctggtatgccattgaatccggctc

SEQ ID NO: 356546 - DNA, 25 bp, Mus musculus
cctggtattgaaccagcagaatcta

SEQ ID NO: 356547 - DNA, 25 bp, Mus musculus
cctggtattgaagcagcagaatcta

SEQ ID NO: 356548 - DNA, 25 bp, Mus musculus
cctggtcaactaaactactgtgatg

SEQ ID NO: 356549 - DNA, 25 bp, Mus musculus
cctggtcaactatactactgtgatg

SEQ ID NO: 356550 - DNA, 25 bp, Mus musculus
cctggtcacagaaggttctggaata

SEQ ID NO: 356551 - DNA, 25 bp, Mus musculus
cctggtcacagatggttctggaata

SEQ ID NO: 356552 - DNA, 25 bp, Mus musculus
cctggtcagcacatcagctttggtt

SEQ ID NO: 356553 - DNA, 25 bp, Mus musculus
cctggtcagcacttcagctttggtt

SEQ ID NO: 356554 - DNA, 25 bp, Mus musculus
cctggtcaggccaagtgagcaagat

SEQ ID NO: 356555 - DNA, 25 bp, Mus musculus
cctggtcaggcctagtgagcaagat

SEQ ID NO: 356556 - DNA, 25 bp, Mus musculus
cctggtcagggaataaggtcacaga

SEQ ID NO: 356557 - DNA, 25 bp, Mus musculus
cctggtcagggattaaggtcacaga

SEQ ID NO: 356558 - DNA, 25 bp, Mus musculus
cctggtcccaagatgttctcaatga

SEQ ID NO: 356559 - DNA, 25 bp, Mus musculus
cctggtcccaagttgttctcaatga

SEQ ID NO: 356560 - DNA, 25 bp, Mus musculus
cctggtcccagcctgcactgtatat

SEQ ID NO: 356561 - DNA, 25 bp, Mus musculus
cctggtcccagcgtgcactgtatat

SEQ ID NO: 356562 - DNA, 25 bp, Mus musculus
cctggtcccatacagagctcagaag

SEQ ID NO: 356563 - DNA, 25 bp, Mus musculus
cctggtcccatagagagctcagaag

SEQ ID NO: 356564 - DNA, 25 bp, Mus musculus
cctggtcctccaaaaagcattgttt

SEQ ID NO: 356565 - DNA, 25 bp, Mus musculus
cctggtcctccataaagcattgttt

SEQ ID NO: 356566 - DNA, 25 bp, Mus musculus
cctggtcgcattcgcctgagattat

SEQ ID NO: 356567 - DNA, 25 bp, Mus musculus
cctggtcgcattggcctgagattat

SEQ ID NO: 356568 - DNA, 25 bp, Mus musculus
cctggtcggatcattgctgtcagac

SEQ ID NO: 356569 - DNA, 25 bp, Mus musculus
cctggtcggatctttgctgtcagac

SEQ ID NO: 356570 - DNA, 25 bp, Mus musculus
cctggtctaaggatatgctggtcac

SEQ ID NO: 356571 - DNA, 25 bp, Mus musculus
cctggtctaaggttatgctggtcac

SEQ ID NO: 356572 - DNA, 25 bp, Mus musculus
cctggtctagagacctggtctagga

SEQ ID NO: 356573 - DNA, 25 bp, Mus musculus
cctggtctagagtcctggtctagga

SEQ ID NO: 356574 - DNA, 25 bp, Mus musculus
cctggtctagggagcaagtttcaga

SEQ ID NO: 356575 - DNA, 25 bp, Mus musculus
cctggtctagggtgcaagtttcaga

SEQ ID NO: 356576 - DNA, 25 bp, Mus musculus
cctggtctatcacctctcaaggaga

SEQ ID NO: 356577 - DNA, 25 bp, Mus musculus
cctggtctatcagctctcaaggaga

SEQ ID NO: 356578 - DNA, 25 bp, Mus musculus
cctggtctctctagggctgttggaa

SEQ ID NO: 356579 - DNA, 25 bp, Mus musculus
cctggtctctcttgggctgttggaa

SEQ ID NO: 356580 - DNA, 25 bp, Mus musculus
cctggtctcttaacgtttaatcaat

SEQ ID NO: 356581 - DNA, 25 bp, Mus musculus
cctggtctcttatcgtttaatcaat

SEQ ID NO: 356582 - DNA, 25 bp, Mus musculus
cctggtctcttcacgctcgggacag

SEQ ID NO: 356583 - DNA, 25 bp, Mus musculus
cctggtctcttctcgctcgggacag

SEQ ID NO: 356584 - DNA, 25 bp, Mus musculus
cctggtctgaccacacaactttggt

SEQ ID NO: 356585 - DNA, 25 bp, Mus musculus
cctggtctgacctcacaactttggt

SEQ ID NO: 356586 - DNA, 25 bp, Mus musculus
cctggtctgcatacactccataaaa

SEQ ID NO: 356587 - DNA, 25 bp, Mus musculus
cctggtctgcattcactccataaaa

SEQ ID NO: 356588 - DNA, 25 bp, Mus musculus
cctggtctggagagtctgaagacag

SEQ ID NO: 356589 - DNA, 25 bp, Mus musculus
cctggtctggagtgtctgaagacag

SEQ ID NO: 356590 - DNA, 25 bp, Mus musculus
cctggtctgtgaagcctagactgag

SEQ ID NO: 356591 - DNA, 25 bp, Mus musculus
cctggtctgtgatgcctagactgag

SEQ ID NO: 356592 - DNA, 25 bp, Mus musculus
cctggtcttggactcactatcataa

SEQ ID NO: 356593 - DNA, 25 bp, Mus musculus
cctggtcttggagtcactatcataa

SEQ ID NO: 356594 - DNA, 25 bp, Mus musculus
cctggtgaaggcacatcctctctgg

SEQ ID NO: 356595 - DNA, 25 bp, Mus musculus
cctggtgaaggcctatgtggacaaa

SEQ ID NO: 356596 - DNA, 25 bp, Mus musculus
cctggtgaaggcgtatgtggacaaa

SEQ ID NO: 356597 - DNA, 25 bp, Mus musculus
cctggtgaaggctcatcctctctgg

SEQ ID NO: 356598 - DNA, 25 bp, Mus musculus
cctggtgacaaacaaagctgacttt

SEQ ID NO: 356599 - DNA, 25 bp, Mus musculus
cctggtgacaaagaaagctgacttt

SEQ ID NO: 356600 - DNA, 25 bp, Mus musculus
cctggtgacaggcaatctattggtt

SEQ ID NO: 356601 - DNA, 25 bp, Mus musculus
cctggtgacagggaatctattggtt

SEQ ID NO: 356602 - DNA, 25 bp, Mus musculus
cctggtgacccacttagcacatacc

SEQ ID NO: 356603 - DNA, 25 bp, Mus musculus
cctggtgacccagttagcacatacc

SEQ ID NO: 356604 - DNA, 25 bp, Mus musculus
cctggtgacctgacacgggacaagg

SEQ ID NO: 356605 - DNA, 25 bp, Mus musculus
cctggtgacctgtcacgggacaagg

SEQ ID NO: 356606 - DNA, 25 bp, Mus musculus
cctggtgactccattttatatatct

SEQ ID NO: 356607 - DNA, 25 bp, Mus musculus
cctggtgactcctttttatatatct

SEQ ID NO: 356608 - DNA, 25 bp, Mus musculus
cctggtgactggaccccatcctggg

SEQ ID NO: 356609 - DNA, 25 bp, Mus musculus
cctggtgactggtccccatcctggg

SEQ ID NO: 356610 - DNA, 25 bp, Mus musculus
cctggtgagaacagttcaggatact

SEQ ID NO: 356611 - DNA, 25 bp, Mus musculus
cctggtgagaactgttcaggatact

SEQ ID NO: 356612 - DNA, 25 bp, Mus musculus
cctggtgagacgatccatgtctgaa

SEQ ID NO: 356613 - DNA, 25 bp, Mus musculus
cctggtgagacgttccatgtctgaa

SEQ ID NO: 356614 - DNA, 25 bp, Mus musculus
cctggtgatattactaaggcgtcat

SEQ ID NO: 356615 - DNA, 25 bp, Mus musculus
cctggtgatatttctaaggcgtcat

SEQ ID NO: 356616 - DNA, 25 bp, Mus musculus
cctggtgatcacagtcttctgtggt

SEQ ID NO: 356617 - DNA, 25 bp, Mus musculus
cctggtgatcactgtcttctgtggt

SEQ ID NO: 356618 - DNA, 25 bp, Mus musculus
cctggtgatcttctctcagctggaa

SEQ ID NO: 356619 - DNA, 25 bp, Mus musculus
cctggtgatcttgtctcagctggaa

SEQ ID NO: 356620 - DNA, 25 bp, Mus musculus
cctggtgcaattcgtcggtttgttt

SEQ ID NO: 356621 - DNA, 25 bp, Mus musculus
cctggtgcaattggtcggtttgttt

SEQ ID NO: 356622 - DNA, 25 bp, Mus musculus
cctggtgcacggagaatgtagaatg

SEQ ID NO: 356623 - DNA, 25 bp, Mus musculus
cctggtgcacggtgaatgtagaatg

SEQ ID NO: 356624 - DNA, 25 bp, Mus musculus
cctggtgcactgctctcactgaggg

SEQ ID NO: 356625 - DNA, 25 bp, Mus musculus
cctggtgcactggtctcactgaggg

SEQ ID NO: 356626 - DNA, 25 bp, Mus musculus
cctggtgcaggtatgtatgtattta

SEQ ID NO: 356627 - DNA, 25 bp, Mus musculus
cctggtgcaggtttgtatgtattta

SEQ ID NO: 356628 - DNA, 25 bp, Mus musculus
cctggtgcagtccaaaatggcagca

SEQ ID NO: 356629 - DNA, 25 bp, Mus musculus
cctggtgcagtcgaaaatggcagca

SEQ ID NO: 356630 - DNA, 25 bp, Mus musculus
cctggtgccctgcagtgaatggaat

SEQ ID NO: 356631 - DNA, 25 bp, Mus musculus
cctggtgccctggagtgaatggaat

SEQ ID NO: 356632 - DNA, 25 bp, Mus musculus
cctggtgcccttcgttattaaatag

SEQ ID NO: 356633 - DNA, 25 bp, Mus musculus
cctggtgcccttggttattaaatag

SEQ ID NO: 356634 - DNA, 25 bp, Mus musculus
cctggtgcgagcattcaaccctaaa

SEQ ID NO: 356635 - DNA, 25 bp, Mus musculus
cctggtgcgagctttcaaccctaaa

SEQ ID NO: 356636 - DNA, 25 bp, Mus musculus
cctggtgctaccaacattcggaaga

SEQ ID NO: 356637 - DNA, 25 bp, Mus musculus
cctggtgctacctacattcggaaga

SEQ ID NO: 356638 - DNA, 25 bp, Mus musculus
cctggtgctcagatatgtcaatggt

SEQ ID NO: 356639 - DNA, 25 bp, Mus musculus
cctggtgctcagttatgtcaatggt

SEQ ID NO: 356640 - DNA, 25 bp, Mus musculus
cctggtgctggaatgtatctagtgc

SEQ ID NO: 356641 - DNA, 25 bp, Mus musculus
cctggtgctggattgtatctagtgc

SEQ ID NO: 356642 - DNA, 25 bp, Mus musculus
cctggtgctggcactctcgggaagc

SEQ ID NO: 356643 - DNA, 25 bp, Mus musculus
cctggtgctggctctctcgggaagc

SEQ ID NO: 356644 - DNA, 25 bp, Mus musculus
cctggtgcttcacttgtcttgttaa

SEQ ID NO: 356645 - DNA, 25 bp, Mus musculus
cctggtgcttcagttgtcttgttaa

SEQ ID NO: 356646 - DNA, 25 bp, Mus musculus
cctggtgctttgaactactggttca

SEQ ID NO: 356647 - DNA, 25 bp, Mus musculus
cctggtgctttgtactactggttca

SEQ ID NO: 356648 - DNA, 25 bp, Mus musculus
cctggtgcttttccttaacatggtg

SEQ ID NO: 356649 - DNA, 25 bp, Mus musculus
cctggtgcttttgcttaacatggtg

SEQ ID NO: 356650 - DNA, 25 bp, Mus musculus
cctggtggacagcaagcagtttcct

SEQ ID NO: 356651 - DNA, 25 bp, Mus musculus
cctggtggacaggaagcagtttcct

SEQ ID NO: 356652 - DNA, 25 bp, Mus musculus
cctggtggagaaagcattggcctat

SEQ ID NO: 356653 - DNA, 25 bp, Mus musculus
cctggtggagaacactttcttcctc

SEQ ID NO: 356654 - DNA, 25 bp, Mus musculus
cctggtggagaagactttcttcctc

SEQ ID NO: 356655 - DNA, 25 bp, Mus musculus
cctggtggagaatgcattggcctat

SEQ ID NO: 356656 - DNA, 25 bp, Mus musculus
cctggtggattgatggtgttacctt

SEQ ID NO: 356657 - DNA, 25 bp, Mus musculus
cctggtggattgttggtgttacctt

SEQ ID NO: 356658 - DNA, 25 bp, Mus musculus
cctggtggcaaaagagctatcctct

SEQ ID NO: 356659 - DNA, 25 bp, Mus musculus
cctggtggcaaatgagctatcctct

SEQ ID NO: 356660 - DNA, 25 bp, Mus musculus
cctggtggctgtccatgcagtgatt

SEQ ID NO: 356661 - DNA, 25 bp, Mus musculus
cctggtggctgtgcatgcagtgatt

SEQ ID NO: 356662 - DNA, 25 bp, Mus musculus
cctggtgggcgtatcttcttgtatt

SEQ ID NO: 356663 - DNA, 25 bp, Mus musculus
cctggtgggcgtttcttcttgtatt

SEQ ID NO: 356664 - DNA, 25 bp, Mus musculus
cctggtgggttaagctccattataa

SEQ ID NO: 356665 - DNA, 25 bp, Mus musculus
cctggtgggttatgctccattataa

SEQ ID NO: 356666 - DNA, 25 bp, Mus musculus
cctggtggtagtctggtcctagcac

SEQ ID NO: 356667 - DNA, 25 bp, Mus musculus
cctggtggtagtgtggtcctagcac

SEQ ID NO: 356668 - DNA, 25 bp, Mus musculus
cctggtggtattatcaatagccact

SEQ ID NO: 356669 - DNA, 25 bp, Mus musculus
cctggtggtattttcaatagccact

SEQ ID NO: 356670 - DNA, 25 bp, Mus musculus
cctggtggtctgctaatttctcaac

SEQ ID NO: 356671 - DNA, 25 bp, Mus musculus
cctggtggtctggtaatttctcaac

SEQ ID NO: 356672 - DNA, 25 bp, Mus musculus
cctggtggtgttcagtgattcatgc

SEQ ID NO: 356673 - DNA, 25 bp, Mus musculus
cctggtggtgttgagtgattcatgc

SEQ ID NO: 356674 - DNA, 25 bp, Mus musculus
cctggtggtttacctcatgacattt

SEQ ID NO: 356675 - DNA, 25 bp, Mus musculus
cctggtggtttagctcatgacattt

SEQ ID NO: 356676 - DNA, 25 bp, Mus musculus
cctggtgtatgtctccctattgaac

SEQ ID NO: 356677 - DNA, 25 bp, Mus musculus
cctggtgtatgtgtccctattgaac

SEQ ID NO: 356678 - DNA, 25 bp, Mus musculus
cctggtgtatttaaactagcaactc

SEQ ID NO: 356679 - DNA, 25 bp, Mus musculus
cctggtgtattttaactagcaactc

SEQ ID NO: 356680 - DNA, 25 bp, Mus musculus
cctggtgtcacaacctggaagggat

SEQ ID NO: 356681 - DNA, 25 bp, Mus musculus
cctggtgtcacatcctggaagggat

SEQ ID NO: 356682 - DNA, 25 bp, Mus musculus
cctggtgtccgtcagggttgatatt

SEQ ID NO: 356683 - DNA, 25 bp, Mus musculus
cctggtgtccgtgagggttgatatt

SEQ ID NO: 356684 - DNA, 25 bp, Mus musculus
cctggtgtccttccctacatatttg

SEQ ID NO: 356685 - DNA, 25 bp, Mus musculus
cctggtgtccttgcctacatatttg

SEQ ID NO: 356686 - DNA, 25 bp, Mus musculus
cctggtgtctgcactgacggctctc

SEQ ID NO: 356687 - DNA, 25 bp, Mus musculus
cctggtgtctgctctgacggctctc

SEQ ID NO: 356688 - DNA, 25 bp, Mus musculus
cctggtgtgaagaacttggccgcct

SEQ ID NO: 356689 - DNA, 25 bp, Mus musculus
cctggtgtgaagtacttggccgcct

SEQ ID NO: 356690 - DNA, 25 bp, Mus musculus
cctggtgtgatgagcactaggccca

SEQ ID NO: 356691 - DNA, 25 bp, Mus musculus
cctggtgtgatgtgcactaggccca

SEQ ID NO: 356692 - DNA, 25 bp, Mus musculus
cctggtgtggtacaaagtcggatat

SEQ ID NO: 356693 - DNA, 25 bp, Mus musculus
cctggtgtggtagaaagtcggatat

SEQ ID NO: 356694 - DNA, 25 bp, Mus musculus
cctggtgtggttcctctgtgtcaaa

SEQ ID NO: 356695 - DNA, 25 bp, Mus musculus
cctggtgtggttgctctgtgtcaaa

SEQ ID NO: 356696 - DNA, 25 bp, Mus musculus
cctggtgtgtggcacattttacaag

SEQ ID NO: 356697 - DNA, 25 bp, Mus musculus
cctggtgtgtgggacattttacaag

SEQ ID NO: 356698 - DNA, 25 bp, Mus musculus
cctggtgtgttgactgggtagctaa

SEQ ID NO: 356699 - DNA, 25 bp, Mus musculus
cctggtgtgttgtctgggtagctaa

SEQ ID NO: 356700 - DNA, 25 bp, Mus musculus
cctggtgttccactgcggccatgga

SEQ ID NO: 356701 - DNA, 25 bp, Mus musculus
cctggtgttccagtgcggccatgga

SEQ ID NO: 356702 - DNA, 25 bp, Mus musculus
cctggtgttctcagtaatgggagga

SEQ ID NO: 356703 - DNA, 25 bp, Mus musculus
cctggtgttctctgtaatgggagga

SEQ ID NO: 356704 - DNA, 25 bp, Mus musculus
cctggttagttgattctctgggctt

SEQ ID NO: 356705 - DNA, 25 bp, Mus musculus
cctggttagttgtttctctgggctt

SEQ ID NO: 356706 - DNA, 25 bp, Mus musculus
cctggttatcacatacattccgtaa

SEQ ID NO: 356707 - DNA, 25 bp, Mus musculus
cctggttatcacttacattccgtaa

SEQ ID NO: 356708 - DNA, 25 bp, Mus musculus
cctggttatttaaatggcttgtcac

SEQ ID NO: 356709 - DNA, 25 bp, Mus musculus
cctggttatttatatggcttgtcac

SEQ ID NO: 356710 - DNA, 25 bp, Mus musculus
cctggttcaccacttggcttgcaga

SEQ ID NO: 356711 - DNA, 25 bp, Mus musculus
cctggttcaccagttggcttgcaga

SEQ ID NO: 356712 - DNA, 25 bp, Mus musculus
cctggttccactagaaaagcagcta

SEQ ID NO: 356713 - DNA, 25 bp, Mus musculus
cctggttccacttgaaaagcagcta

SEQ ID NO: 356714 - DNA, 25 bp, Mus musculus
cctggttcccagagagtgatgatgt

SEQ ID NO: 356715 - DNA, 25 bp, Mus musculus
cctggttcccagtgagtgatgatgt

SEQ ID NO: 356716 - DNA, 25 bp, Mus musculus
cctggttgatgtatagctctcagct

SEQ ID NO: 356717 - DNA, 25 bp, Mus musculus
cctggttgatgtttagctctcagct

SEQ ID NO: 356718 - DNA, 25 bp, Mus musculus
cctggttgcaggacccagcaggtgc

SEQ ID NO: 356719 - DNA, 25 bp, Mus musculus
cctggttgcaggtcccagcaggtgc

SEQ ID NO: 356720 - DNA, 25 bp, Mus musculus
cctggttggcgcaggcagcctggcc

SEQ ID NO: 356721 - DNA, 25 bp, Mus musculus
cctggttggcgctggcagcctggcc

SEQ ID NO: 356722 - DNA, 25 bp, Mus musculus
cctggttggtgtcacccctccaaga

SEQ ID NO: 356723 - DNA, 25 bp, Mus musculus
cctggttggtgtgacccctccaaga

SEQ ID NO: 356724 - DNA, 25 bp, Mus musculus
cctggttgtggcagggcactcaaaa

SEQ ID NO: 356725 - DNA, 25 bp, Mus musculus
cctggttgtggctgggcactcaaaa

SEQ ID NO: 356726 - DNA, 25 bp, Mus musculus
cctggtttcaagcagatctggtctg

SEQ ID NO: 356727 - DNA, 25 bp, Mus musculus
cctggtttcaaggagatctggtctg

SEQ ID NO: 356728 - DNA, 25 bp, Mus musculus
cctggtttcagaaattttacctttg

SEQ ID NO: 356729 - DNA, 25 bp, Mus musculus
cctggtttcagatattttacctttg

SEQ ID NO: 356730 - DNA, 25 bp, Mus musculus
cctggtttcaggcacttatctcaat

SEQ ID NO: 356731 - DNA, 25 bp, Mus musculus
cctggtttcaggcatgccagcaagt

SEQ ID NO: 356732 - DNA, 25 bp, Mus musculus
cctggtttcagggacttatctcaat

SEQ ID NO: 356733 - DNA, 25 bp, Mus musculus
cctggtttcagggatgccagcaagt

SEQ ID NO: 356734 - DNA, 25 bp, Mus musculus
cctggtttccctcatagcattgtaa

SEQ ID NO: 356735 - DNA, 25 bp, Mus musculus
cctggtttccctgatagcattgtaa

SEQ ID NO: 356736 - DNA, 25 bp, Mus musculus
cctggtttcctacctgaatcatctt

SEQ ID NO: 356737 - DNA, 25 bp, Mus musculus
cctggtttcctagctgaatcatctt

SEQ ID NO: 356738 - DNA, 25 bp, Mus musculus
cctggtttctgccagtccttttgta

SEQ ID NO: 356739 - DNA, 25 bp, Mus musculus
cctggtttctgcgagtccttttgta

SEQ ID NO: 356740 - DNA, 25 bp, Mus musculus
cctggtttgaaccttcctctgataa

SEQ ID NO: 356741 - DNA, 25 bp, Mus musculus
cctggtttgaacgttcctctgataa

SEQ ID NO: 356742 - DNA, 25 bp, Mus musculus
cctggtttgaagctggactttcttt

SEQ ID NO: 356743 - DNA, 25 bp, Mus musculus
cctggtttgaaggtggactttcttt

SEQ ID NO: 356744 - DNA, 25 bp, Mus musculus
cctggtttgcctccggtttaatatg

SEQ ID NO: 356745 - DNA, 25 bp, Mus musculus
cctggtttgcctgcggtttaatatg

SEQ ID NO: 356746 - DNA, 25 bp, Mus musculus
cctggtttgggcatgcacctagaaa

SEQ ID NO: 356747 - DNA, 25 bp, Mus musculus
cctggtttgggcttgcacctagaaa

SEQ ID NO: 356748 - DNA, 25 bp, Mus musculus
cctggtttgtttaaaagcagccaca

SEQ ID NO: 356749 - DNA, 25 bp, Mus musculus
cctggtttgttttaaagcagccaca

SEQ ID NO: 356750 - DNA, 25 bp, Mus musculus
cctggttttcccaggcacatttcac

SEQ ID NO: 356751 - DNA, 25 bp, Mus musculus
cctggttttccctggcacatttcac

SEQ ID NO: 356752 - DNA, 25 bp, Mus musculus
cctggttttctgaggatttcgaaca

SEQ ID NO: 356753 - DNA, 25 bp, Mus musculus
cctggttttctgtggatttcgaaca

SEQ ID NO: 356754 - DNA, 25 bp, Mus musculus
cctggttttggcctcaaggaagcaa

SEQ ID NO: 356755 - DNA, 25 bp, Mus musculus
cctggttttggcgtcaaggaagcaa

SEQ ID NO: 356756 - DNA, 25 bp, Mus musculus
cctggtttttatcacccacattctt

SEQ ID NO: 356757 - DNA, 25 bp, Mus musculus
cctggtttttatgacccacattctt

SEQ ID NO: 356758 - DNA, 25 bp, Mus musculus
cctgtaaaacctcttgtaagcagtg

SEQ ID NO: 356759 - DNA, 25 bp, Mus musculus
cctgtaaaacctgttgtaagcagtg

SEQ ID NO: 356760 - DNA, 25 bp, Mus musculus
cctgtaaatcagagtgggtgccttg

SEQ ID NO: 356761 - DNA, 25 bp, Mus musculus
cctgtaaatcagtgtgggtgccttg

SEQ ID NO: 356762 - DNA, 25 bp, Mus musculus
cctgtaaatcttcaatgtagcgcta

SEQ ID NO: 356763 - DNA, 25 bp, Mus musculus
cctgtaaatcttgaatgtagcgcta

SEQ ID NO: 356764 - DNA, 25 bp, Mus musculus
cctgtaacatacaagtctttacaac

SEQ ID NO: 356765 - DNA, 25 bp, Mus musculus
cctgtaacatactagtctttacaac

SEQ ID NO: 356766 - DNA, 25 bp, Mus musculus
cctgtaacctggaggtgcttggact

SEQ ID NO: 356767 - DNA, 25 bp, Mus musculus
cctgtaacctggtggtgcttggact

SEQ ID NO: 356768 - DNA, 25 bp, Mus musculus
cctgtaagggttatagattctctga

SEQ ID NO: 356769 - DNA, 25 bp, Mus musculus
cctgtaagggttttagattctctga

SEQ ID NO: 356770 - DNA, 25 bp, Mus musculus
cctgtaagtgtgactgtgcactgcc

SEQ ID NO: 356771 - DNA, 25 bp, Mus musculus
cctgtaagtgtgtctgtgcactgcc

SEQ ID NO: 356772 - DNA, 25 bp, Mus musculus
cctgtaataacaagcccgagatccc

SEQ ID NO: 356773 - DNA, 25 bp, Mus musculus
cctgtaataacatgcccgagatccc

SEQ ID NO: 356774 - DNA, 25 bp, Mus musculus
cctgtacacgctcctgaaggagagc

SEQ ID NO: 356775 - DNA, 25 bp, Mus musculus
cctgtacacgctgctgaaggagagc

SEQ ID NO: 356776 - DNA, 25 bp, Mus musculus
cctgtacaggagctcaaccacatta

SEQ ID NO: 356777 - DNA, 25 bp, Mus musculus
cctgtacaggaggtcaaccacatta

SEQ ID NO: 356778 - DNA, 25 bp, Mus musculus
cctgtacatttgcactaactccggg

SEQ ID NO: 356779 - DNA, 25 bp, Mus musculus
cctgtacatttggactaactccggg

SEQ ID NO: 356780 - DNA, 25 bp, Mus musculus
cctgtacctaacagccagcaagaaa

SEQ ID NO: 356781 - DNA, 25 bp, Mus musculus
cctgtacctaactgccagcaagaaa

SEQ ID NO: 356782 - DNA, 25 bp, Mus musculus
cctgtacctaggatgtcaatccagt

SEQ ID NO: 356783 - DNA, 25 bp, Mus musculus
cctgtacctaggttgtcaatccagt

SEQ ID NO: 356784 - DNA, 25 bp, Mus musculus
cctgtacctgccacactatgttaga

SEQ ID NO: 356785 - DNA, 25 bp, Mus musculus
cctgtacctgcctcactatgttaga

SEQ ID NO: 356786 - DNA, 25 bp, Mus musculus
cctgtacgaaggacttccgggagct

SEQ ID NO: 356787 - DNA, 25 bp, Mus musculus
cctgtacgaaggtcttccgggagct

SEQ ID NO: 356788 - DNA, 25 bp, Mus musculus
cctgtacgtgccccggaaatgctcc

SEQ ID NO: 356789 - DNA, 25 bp, Mus musculus
cctgtacgtgccgcggaaatgctcc

SEQ ID NO: 356790 - DNA, 25 bp, Mus musculus
cctgtactccaacctactctatttt

SEQ ID NO: 356791 - DNA, 25 bp, Mus musculus
cctgtactccaagctactctatttt

SEQ ID NO: 356792 - DNA, 25 bp, Mus musculus
cctgtactgcccaaagaaatctgat

SEQ ID NO: 356793 - DNA, 25 bp, Mus musculus
cctgtactgccctaagaaatctgat

SEQ ID NO: 356794 - DNA, 25 bp, Mus musculus
cctgtactgggcatcgtgagactga

SEQ ID NO: 356795 - DNA, 25 bp, Mus musculus
cctgtactgggcttcgtgagactga

SEQ ID NO: 356796 - DNA, 25 bp, Mus musculus
cctgtacttagacgctgttttggaa

SEQ ID NO: 356797 - DNA, 25 bp, Mus musculus
cctgtacttagaggctgttttggaa

SEQ ID NO: 356798 - DNA, 25 bp, Mus musculus
cctgtactttgaaacctctggatat

SEQ ID NO: 356799 - DNA, 25 bp, Mus musculus
cctgtactttgatacctctggatat

SEQ ID NO: 356800 - DNA, 25 bp, Mus musculus
cctgtagaagttcctgttccttttg

SEQ ID NO: 356801 - DNA, 25 bp, Mus musculus
cctgtagaagttgctgttccttttg

SEQ ID NO: 356802 - DNA, 25 bp, Mus musculus
cctgtagacgtaaagattattccat

SEQ ID NO: 356803 - DNA, 25 bp, Mus musculus
cctgtagacgtatagattattccat

SEQ ID NO: 356804 - DNA, 25 bp, Mus musculus
cctgtagactggaagatagattctt

SEQ ID NO: 356805 - DNA, 25 bp, Mus musculus
cctgtagactggtagatagattctt

SEQ ID NO: 356806 - DNA, 25 bp, Mus musculus
cctgtagcatatccccactcgggga

SEQ ID NO: 356807 - DNA, 25 bp, Mus musculus
cctgtagcatatgcccactcgggga

SEQ ID NO: 356808 - DNA, 25 bp, Mus musculus
cctgtagccaggaccttggaggcat

SEQ ID NO: 356809 - DNA, 25 bp, Mus musculus
cctgtagccaggtccttggaggcat

SEQ ID NO: 356810 - DNA, 25 bp, Mus musculus
cctgtagccgctacagaggattgga

SEQ ID NO: 356811 - DNA, 25 bp, Mus musculus
cctgtagccgcttcagaggattgga

SEQ ID NO: 356812 - DNA, 25 bp, Mus musculus
cctgtagctcctcaacaacgtagta

SEQ ID NO: 356813 - DNA, 25 bp, Mus musculus
cctgtagctcctgaacaacgtagta

SEQ ID NO: 356814 - DNA, 25 bp, Mus musculus
cctgtagctcttcttgacctgcctg

SEQ ID NO: 356815 - DNA, 25 bp, Mus musculus
cctgtagctcttgttgacctgcctg

SEQ ID NO: 356816 - DNA, 25 bp, Mus musculus
cctgtagctggtagcatccctcctt

SEQ ID NO: 356817 - DNA, 25 bp, Mus musculus
cctgtagctggttgcatccctcctt

SEQ ID NO: 356818 - DNA, 25 bp, Mus musculus
cctgtaggcgccatgttcctttctg

SEQ ID NO: 356819 - DNA, 25 bp, Mus musculus
cctgtaggcgccttgttcctttctg

SEQ ID NO: 356820 - DNA, 25 bp, Mus musculus
cctgtaggctaaccagcttctatta

SEQ ID NO: 356821 - DNA, 25 bp, Mus musculus
cctgtaggctaagcagcttctatta

SEQ ID NO: 356822 - DNA, 25 bp, Mus musculus
cctgtagggcttaaatgatatgatc

SEQ ID NO: 356823 - DNA, 25 bp, Mus musculus
cctgtagggctttaatgatatgatc

SEQ ID NO: 356824 - DNA, 25 bp, Mus musculus
cctgtaggtgacacattctagaata

SEQ ID NO: 356825 - DNA, 25 bp, Mus musculus
cctgtaggtgactcattctagaata

SEQ ID NO: 356826 - DNA, 25 bp, Mus musculus
cctgtagtctgaatgttgctttaat

SEQ ID NO: 356827 - DNA, 25 bp, Mus musculus
cctgtagtctgattgttgctttaat

SEQ ID NO: 356828 - DNA, 25 bp, Mus musculus
cctgtagtcttccacatgctattat

SEQ ID NO: 356829 - DNA, 25 bp, Mus musculus
cctgtagtcttcgacatgctattat

SEQ ID NO: 356830 - DNA, 25 bp, Mus musculus
cctgtagtgtgacttcagccttcat

SEQ ID NO: 356831 - DNA, 25 bp, Mus musculus
cctgtagtgtgagttcagccttcat

SEQ ID NO: 356832 - DNA, 25 bp, Mus musculus
cctgtagttccacctggggacatgg

SEQ ID NO: 356833 - DNA, 25 bp, Mus musculus
cctgtagttccagctggggacatgg

SEQ ID NO: 356834 - DNA, 25 bp, Mus musculus
cctgtagtttctcgacgtttgtgca

SEQ ID NO: 356835 - DNA, 25 bp, Mus musculus
cctgtagtttctggacgtttgtgca

SEQ ID NO: 356836 - DNA, 25 bp, Mus musculus
cctgtagttttgatgtaattcattg

SEQ ID NO: 356837 - DNA, 25 bp, Mus musculus
cctgtagttttgttgtaattcattg

SEQ ID NO: 356838 - DNA, 25 bp, Mus musculus
cctgtataacccaaaattcatccca

SEQ ID NO: 356839 - DNA, 25 bp, Mus musculus
cctgtataaccctaaattcatccca

SEQ ID NO: 356840 - DNA, 25 bp, Mus musculus
cctgtataatctaaagtgttcctct

SEQ ID NO: 356841 - DNA, 25 bp, Mus musculus
cctgtataatcttaagtgttcctct

SEQ ID NO: 356842 - DNA, 25 bp, Mus musculus
cctgtatacagacatgcggctgact

SEQ ID NO: 356843 - DNA, 25 bp, Mus musculus
cctgtatacagagatgcggctgact

SEQ ID NO: 356844 - DNA, 25 bp, Mus musculus
cctgtatacttccatttggcaccaa

SEQ ID NO: 356845 - DNA, 25 bp, Mus musculus
cctgtatacttcgatttggcaccaa

SEQ ID NO: 356846 - DNA, 25 bp, Mus musculus
cctgtatatacccatctgtgagtga

SEQ ID NO: 356847 - DNA, 25 bp, Mus musculus
cctgtatataccgatctgtgagtga

SEQ ID NO: 356848 - DNA, 25 bp, Mus musculus
cctgtatcctgcattggtggtttat

SEQ ID NO: 356849 - DNA, 25 bp, Mus musculus
cctgtatcctgctttggtggtttat

SEQ ID NO: 356850 - DNA, 25 bp, Mus musculus
cctgtatctgcaaccctagggggaa

SEQ ID NO: 356851 - DNA, 25 bp, Mus musculus
cctgtatctgcatccctagggggaa

SEQ ID NO: 356852 - DNA, 25 bp, Mus musculus
cctgtatgagtgcagggatagttta

SEQ ID NO: 356853 - DNA, 25 bp, Mus musculus
cctgtatgagtggagggatagttta

SEQ ID NO: 356854 - DNA, 25 bp, Mus musculus
cctgtatgccaaatgggattcccat

SEQ ID NO: 356855 - DNA, 25 bp, Mus musculus
cctgtatgccaattgggattcccat

SEQ ID NO: 356856 - DNA, 25 bp, Mus musculus
cctgtatgtctcaaaactggctagc

SEQ ID NO: 356857 - DNA, 25 bp, Mus musculus
cctgtatgtctctaaactggctagc

SEQ ID NO: 356858 - DNA, 25 bp, Mus musculus
cctgtatgtcttatgccctttataa

SEQ ID NO: 356859 - DNA, 25 bp, Mus musculus
cctgtatgtcttttgccctttataa

SEQ ID NO: 356860 - DNA, 25 bp, Mus musculus
cctgtatgtgggaagctggctctga

SEQ ID NO: 356861 - DNA, 25 bp, Mus musculus
cctgtatgtgggtagctggctctga

SEQ ID NO: 356862 - DNA, 25 bp, Mus musculus
cctgtatgtgtcaacatctggaaaa

SEQ ID NO: 356863 - DNA, 25 bp, Mus musculus
cctgtatgtgtctacatctggaaaa

SEQ ID NO: 356864 - DNA, 25 bp, Mus musculus
cctgtatgttcaagcagacaatccg

SEQ ID NO: 356865 - DNA, 25 bp, Mus musculus
cctgtatgttcatgcagacaatccg

SEQ ID NO: 356866 - DNA, 25 bp, Mus musculus
cctgtattcaccacaacttatgcaa

SEQ ID NO: 356867 - DNA, 25 bp, Mus musculus
cctgtattcacctcaacttatgcaa

SEQ ID NO: 356868 - DNA, 25 bp, Mus musculus
cctgtattccccaaagaaattcctg

SEQ ID NO: 356869 - DNA, 25 bp, Mus musculus
cctgtattcccctaagaaattcctg

SEQ ID NO: 356870 - DNA, 25 bp, Mus musculus
cctgtatttaccactgaatagatac

SEQ ID NO: 356871 - DNA, 25 bp, Mus musculus
cctgtatttacctctgaatagatac

SEQ ID NO: 356872 - DNA, 25 bp, Mus musculus
cctgtatttcagagtgctttccaag

SEQ ID NO: 356873 - DNA, 25 bp, Mus musculus
cctgtatttcagtgtgctttccaag

SEQ ID NO: 356874 - DNA, 25 bp, Mus musculus
cctgtatttgcactggtgtaaaagc

SEQ ID NO: 356875 - DNA, 25 bp, Mus musculus
cctgtatttgcagtggtgtaaaagc

SEQ ID NO: 356876 - DNA, 25 bp, Mus musculus
cctgtcaaaaatagagtcacgtccg

SEQ ID NO: 356877 - DNA, 25 bp, Mus musculus
cctgtcaaaaattgagtcacgtccg

SEQ ID NO: 356878 - DNA, 25 bp, Mus musculus
cctgtcaaacctaggattccctatt

SEQ ID NO: 356879 - DNA, 25 bp, Mus musculus
cctgtcaaaccttggattccctatt

SEQ ID NO: 356880 - DNA, 25 bp, Mus musculus
cctgtcaagaagctgccggtggtac

SEQ ID NO: 356881 - DNA, 25 bp, Mus musculus
cctgtcaagaaggtgccggtggtac

SEQ ID NO: 356882 - DNA, 25 bp, Mus musculus
cctgtcaagcccaattacgacgtga

SEQ ID NO: 356883 - DNA, 25 bp, Mus musculus
cctgtcaagccctattacgacgtga

SEQ ID NO: 356884 - DNA, 25 bp, Mus musculus
cctgtcaataataggcggccgcgaa

SEQ ID NO: 356885 - DNA, 25 bp, Mus musculus
cctgtcaataattggcggccgcgaa

SEQ ID NO: 356886 - DNA, 25 bp, Mus musculus
cctgtcaatggcaatgggctaaaga

SEQ ID NO: 356887 - DNA, 25 bp, Mus musculus
cctgtcaatggctatgggctaaaga

SEQ ID NO: 356888 - DNA, 25 bp, Mus musculus
cctgtcacacctcgaaggctaagaa

SEQ ID NO: 356889 - DNA, 25 bp, Mus musculus
cctgtcacacctggaaggctaagaa

SEQ ID NO: 356890 - DNA, 25 bp, Mus musculus
cctgtcacagccctttggaggagaa

SEQ ID NO: 356891 - DNA, 25 bp, Mus musculus
cctgtcacagccgtttggaggagaa

SEQ ID NO: 356892 - DNA, 25 bp, Mus musculus
cctgtcacagtacaatcagccttgt

SEQ ID NO: 356893 - DNA, 25 bp, Mus musculus
cctgtcacagtagaatcagccttgt

SEQ ID NO: 356894 - DNA, 25 bp, Mus musculus
cctgtcacatctctttaaagcctga

SEQ ID NO: 356895 - DNA, 25 bp, Mus musculus
cctgtcacatctgtttaaagcctga

SEQ ID NO: 356896 - DNA, 25 bp, Mus musculus
cctgtcacatgccaattcagttgtc

SEQ ID NO: 356897 - DNA, 25 bp, Mus musculus
cctgtcacatgcgaattcagttgtc

SEQ ID NO: 356898 - DNA, 25 bp, Mus musculus
cctgtcacattgccgactgatgaag

SEQ ID NO: 356899 - DNA, 25 bp, Mus musculus
cctgtcacattggcgactgatgaag

SEQ ID NO: 356900 - DNA, 25 bp, Mus musculus
cctgtcaccagcacttatgatggtt

SEQ ID NO: 356901 - DNA, 25 bp, Mus musculus
cctgtcaccagctcttatgatggtt

SEQ ID NO: 356902 - DNA, 25 bp, Mus musculus
cctgtcagaagtctgagcagccctt

SEQ ID NO: 356903 - DNA, 25 bp, Mus musculus
cctgtcagaagtgtgagcagccctt

SEQ ID NO: 356904 - DNA, 25 bp, Mus musculus
cctgtcagacagagtttttccaatc

SEQ ID NO: 356905 - DNA, 25 bp, Mus musculus
cctgtcagacagtgtttttccaatc

SEQ ID NO: 356906 - DNA, 25 bp, Mus musculus
cctgtcagacttagtctcctaattt

SEQ ID NO: 356907 - DNA, 25 bp, Mus musculus
cctgtcagactttgtctcctaattt

SEQ ID NO: 356908 - DNA, 25 bp, Mus musculus
cctgtcagggcacctttagtgaggc

SEQ ID NO: 356909 - DNA, 25 bp, Mus musculus
cctgtcagggcagctttagtgaggc

SEQ ID NO: 356910 - DNA, 25 bp, Mus musculus
cctgtcaggtggagaatttcatatt

SEQ ID NO: 356911 - DNA, 25 bp, Mus musculus
cctgtcaggtggtgaatttcatatt

SEQ ID NO: 356912 - DNA, 25 bp, Mus musculus
cctgtcagtatcatggagcgtttat

SEQ ID NO: 356913 - DNA, 25 bp, Mus musculus
cctgtcagtatcttggagcgtttat

SEQ ID NO: 356914 - DNA, 25 bp, Mus musculus
cctgtcagtgttctgttcttgtcat

SEQ ID NO: 356915 - DNA, 25 bp, Mus musculus
cctgtcagtgttcttcatcatggcc

SEQ ID NO: 356916 - DNA, 25 bp, Mus musculus
cctgtcagtgttgtgttcttgtcat

SEQ ID NO: 356917 - DNA, 25 bp, Mus musculus
cctgtcagtgttgttcatcatggcc

SEQ ID NO: 356918 - DNA, 25 bp, Mus musculus
cctgtcatctctacagtactgtgga

SEQ ID NO: 356919 - DNA, 25 bp, Mus musculus
cctgtcatctcttcagtactgtgga

SEQ ID NO: 356920 - DNA, 25 bp, Mus musculus
cctgtcatctttatgtaaaccttca

SEQ ID NO: 356921 - DNA, 25 bp, Mus musculus
cctgtcatctttttgtaaaccttca

SEQ ID NO: 356922 - DNA, 25 bp, Mus musculus
cctgtcatgccccatcaaaaagcat

SEQ ID NO: 356923 - DNA, 25 bp, Mus musculus
cctgtcatgcccgatcaaaaagcat

SEQ ID NO: 356924 - DNA, 25 bp, Mus musculus
cctgtcatgtaaaaccagctatttt

SEQ ID NO: 356925 - DNA, 25 bp, Mus musculus
cctgtcatgtaataccagctatttt

SEQ ID NO: 356926 - DNA, 25 bp, Mus musculus
cctgtcattcccaaattcactaaga

SEQ ID NO: 356927 - DNA, 25 bp, Mus musculus
cctgtcattccctaattcactaaga

SEQ ID NO: 356928 - DNA, 25 bp, Mus musculus
cctgtccaccagcgttcagctgtag

SEQ ID NO: 356929 - DNA, 25 bp, Mus musculus
cctgtccaccagggttcagctgtag

SEQ ID NO: 356930 - DNA, 25 bp, Mus musculus
cctgtccactttcctgagggtcaga

SEQ ID NO: 356931 - DNA, 25 bp, Mus musculus
cctgtccactttgctgagggtcaga

SEQ ID NO: 356932 - DNA, 25 bp, Mus musculus
cctgtccagcttctttgtttgggaa

SEQ ID NO: 356933 - DNA, 25 bp, Mus musculus
cctgtccagcttgtttgtttgggaa

SEQ ID NO: 356934 - DNA, 25 bp, Mus musculus
cctgtccaggcactgtattgttttg

SEQ ID NO: 356935 - DNA, 25 bp, Mus musculus
cctgtccaggcagtgtattgttttg

SEQ ID NO: 356936 - DNA, 25 bp, Mus musculus
cctgtccagtggagatttacatgta

SEQ ID NO: 356937 - DNA, 25 bp, Mus musculus
cctgtccagtggtgatttacatgta

SEQ ID NO: 356938 - DNA, 25 bp, Mus musculus
cctgtccagtttctgctgtacatta

SEQ ID NO: 356939 - DNA, 25 bp, Mus musculus
cctgtccagtttgtgctgtacatta

SEQ ID NO: 356940 - DNA, 25 bp, Mus musculus
cctgtcccatgtccatcttatttaa

SEQ ID NO: 356941 - DNA, 25 bp, Mus musculus
cctgtcccatgtgcatcttatttaa

SEQ ID NO: 356942 - DNA, 25 bp, Mus musculus
cctgtcccgacgattatggatccat

SEQ ID NO: 356943 - DNA, 25 bp, Mus musculus
cctgtcccgacgtttatggatccat

SEQ ID NO: 356944 - DNA, 25 bp, Mus musculus
cctgtcccgtccattgtgaaattat

SEQ ID NO: 356945 - DNA, 25 bp, Mus musculus
cctgtcccgtcctttgtgaaattat

SEQ ID NO: 356946 - DNA, 25 bp, Mus musculus
cctgtccctgtgagtaacttccagt

SEQ ID NO: 356947 - DNA, 25 bp, Mus musculus
cctgtccctgtgtgtaacttccagt

SEQ ID NO: 356948 - DNA, 25 bp, Mus musculus
cctgtccgaaggctgtcactactgg

SEQ ID NO: 356949 - DNA, 25 bp, Mus musculus
cctgtccgaagggtgtcactactgg

SEQ ID NO: 356950 - DNA, 25 bp, Mus musculus
cctgtccggaccctccaagtggaga

SEQ ID NO: 356951 - DNA, 25 bp, Mus musculus
cctgtccggaccgtccaagtggaga

SEQ ID NO: 356952 - DNA, 25 bp, Mus musculus
cctgtccggtatctacattcacagt

SEQ ID NO: 356953 - DNA, 25 bp, Mus musculus
cctgtccggtatgtacattcacagt

SEQ ID NO: 356954 - DNA, 25 bp, Mus musculus
cctgtcctccagaattgcacctgta

SEQ ID NO: 356955 - DNA, 25 bp, Mus musculus
cctgtcctccagtattgcacctgta

SEQ ID NO: 356956 - DNA, 25 bp, Mus musculus
cctgtcctcccaaggtttgaaacaa

SEQ ID NO: 356957 - DNA, 25 bp, Mus musculus
cctgtcctcccatggtttgaaacaa

SEQ ID NO: 356958 - DNA, 25 bp, Mus musculus
cctgtcctctttcttgctcagataa

SEQ ID NO: 356959 - DNA, 25 bp, Mus musculus
cctgtcctctttgttgctcagataa

SEQ ID NO: 356960 - DNA, 25 bp, Mus musculus
cctgtcctgaccactctgaataaaa

SEQ ID NO: 356961 - DNA, 25 bp, Mus musculus
cctgtcctgacctctctgaataaaa

SEQ ID NO: 356962 - DNA, 25 bp, Mus musculus
cctgtcctgactctggcaagagcta

SEQ ID NO: 356963 - DNA, 25 bp, Mus musculus
cctgtcctgactgtggcaagagcta

SEQ ID NO: 356964 - DNA, 25 bp, Mus musculus
cctgtcctgattctggtcgtagcca

SEQ ID NO: 356965 - DNA, 25 bp, Mus musculus
cctgtcctgattgtggtcgtagcca

SEQ ID NO: 356966 - DNA, 25 bp, Mus musculus
cctgtcctgggcagcaattagagag

SEQ ID NO: 356967 - DNA, 25 bp, Mus musculus
cctgtcctgggctgcaattagagag

SEQ ID NO: 356968 - DNA, 25 bp, Mus musculus
cctgtcctgtctatgaaatgggcta

SEQ ID NO: 356969 - DNA, 25 bp, Mus musculus
cctgtcctgtctttgaaatgggcta

SEQ ID NO: 356970 - DNA, 25 bp, Mus musculus
cctgtcctgtgcagatttgccttaa

SEQ ID NO: 356971 - DNA, 25 bp, Mus musculus
cctgtcctgtgctgatttgccttaa

SEQ ID NO: 356972 - DNA, 25 bp, Mus musculus
cctgtcctgttcagagtggccttga

SEQ ID NO: 356973 - DNA, 25 bp, Mus musculus
cctgtcctgttctgagtggccttga

SEQ ID NO: 356974 - DNA, 25 bp, Mus musculus
cctgtccttaacaggattctcacag

SEQ ID NO: 356975 - DNA, 25 bp, Mus musculus
cctgtccttaactggattctcacag

SEQ ID NO: 356976 - DNA, 25 bp, Mus musculus
cctgtccttaggaagtaattgaata

SEQ ID NO: 356977 - DNA, 25 bp, Mus musculus
cctgtccttaggtagtaattgaata

SEQ ID NO: 356978 - DNA, 25 bp, Mus musculus
cctgtccttctgaagaggctgttga

SEQ ID NO: 356979 - DNA, 25 bp, Mus musculus
cctgtccttctgtagaggctgttga

SEQ ID NO: 356980 - DNA, 25 bp, Mus musculus
cctgtccttgaaccctgatgaagct

SEQ ID NO: 356981 - DNA, 25 bp, Mus musculus
cctgtccttgaagcctgatgaagct

SEQ ID NO: 356982 - DNA, 25 bp, Mus musculus
cctgtcctttttcactcttaagtag

SEQ ID NO: 356983 - DNA, 25 bp, Mus musculus
cctgtcctttttgactcttaagtag

SEQ ID NO: 356984 - DNA, 25 bp, Mus musculus
cctgtcggacagagaacccattggg

SEQ ID NO: 356985 - DNA, 25 bp, Mus musculus
cctgtcggacagtgaacccattggg

SEQ ID NO: 356986 - DNA, 25 bp, Mus musculus
cctgtcgtgcagaatttgagtcctt

SEQ ID NO: 356987 - DNA, 25 bp, Mus musculus
cctgtcgtgcagtatttgagtcctt

SEQ ID NO: 356988 - DNA, 25 bp, Mus musculus
cctgtctacacacttggctttgaga

SEQ ID NO: 356989 - DNA, 25 bp, Mus musculus
cctgtctacacagttggctttgaga

SEQ ID NO: 356990 - DNA, 25 bp, Mus musculus
cctgtctacttgagatccttctaga

SEQ ID NO: 356991 - DNA, 25 bp, Mus musculus
cctgtctacttgtgatccttctaga

SEQ ID NO: 356992 - DNA, 25 bp, Mus musculus
cctgtctagacgatggttctggatt

SEQ ID NO: 356993 - DNA, 25 bp, Mus musculus
cctgtctagacgttggttctggatt

SEQ ID NO: 356994 - DNA, 25 bp, Mus musculus
cctgtctagtctctcagactggcag

SEQ ID NO: 356995 - DNA, 25 bp, Mus musculus
cctgtctagtctgtcagactggcag

SEQ ID NO: 356996 - DNA, 25 bp, Mus musculus
cctgtctataaacagcttgttcttc

SEQ ID NO: 356997 - DNA, 25 bp, Mus musculus
cctgtctataaagagcttgttcttc

SEQ ID NO: 356998 - DNA, 25 bp, Mus musculus
cctgtctatgatcgctcctgggtag

SEQ ID NO: 356999 - DNA, 25 bp, Mus musculus
cctgtctatgatggctcctgggtag

SEQ ID NO: 357000 - DNA, 25 bp, Mus musculus
cctgtctattggagatactgcgaag

SEQ ID NO: 357001 - DNA, 25 bp, Mus musculus
cctgtctattggtgatactgcgaag

SEQ ID NO: 357002 - DNA, 25 bp, Mus musculus
cctgtctccgaactaacgccatgaa

SEQ ID NO: 357003 - DNA, 25 bp, Mus musculus
cctgtctccgaagtaacgccatgaa

SEQ ID NO: 357004 - DNA, 25 bp, Mus musculus
cctgtctcctctcttaagggtgatg

SEQ ID NO: 357005 - DNA, 25 bp, Mus musculus
cctgtctcctctgttaagggtgatg

SEQ ID NO: 357006 - DNA, 25 bp, Mus musculus
cctgtctctgtcatcattaccatga

SEQ ID NO: 357007 - DNA, 25 bp, Mus musculus
cctgtctctgtcttcattaccatga

SEQ ID NO: 357008 - DNA, 25 bp, Mus musculus
cctgtctcttaccacgaattttaag

SEQ ID NO: 357009 - DNA, 25 bp, Mus musculus
cctgtctcttacgacgaattttaag

SEQ ID NO: 357010 - DNA, 25 bp, Mus musculus
cctgtctcttttctctagatgatga

SEQ ID NO: 357011 - DNA, 25 bp, Mus musculus
cctgtctcttttgtctagatgatga

SEQ ID NO: 357012 - DNA, 25 bp, Mus musculus
cctgtctgaagaatggcaccacctt

SEQ ID NO: 357013 - DNA, 25 bp, Mus musculus
cctgtctgaagattggcaccacctt

SEQ ID NO: 357014 - DNA, 25 bp, Mus musculus
cctgtctgagtaagccagggtggca

SEQ ID NO: 357015 - DNA, 25 bp, Mus musculus
cctgtctgagtatgccagggtggca

SEQ ID NO: 357016 - DNA, 25 bp, Mus musculus
cctgtctgcccaacatatagaagaa

SEQ ID NO: 357017 - DNA, 25 bp, Mus musculus
cctgtctgcccatcatatagaagaa

SEQ ID NO: 357018 - DNA, 25 bp, Mus musculus
cctgtctgccgtcagtagaaaccaa

SEQ ID NO: 357019 - DNA, 25 bp, Mus musculus
cctgtctgccgtgagtagaaaccaa

SEQ ID NO: 357020 - DNA, 25 bp, Mus musculus
cctgtctgctgtaagctctgtgaag

SEQ ID NO: 357021 - DNA, 25 bp, Mus musculus
cctgtctgctgttagctctgtgaag

SEQ ID NO: 357022 - DNA, 25 bp, Mus musculus
cctgtctgtagtatggtaaagccca

SEQ ID NO: 357023 - DNA, 25 bp, Mus musculus
cctgtctgtagtttggtaaagccca

SEQ ID NO: 357024 - DNA, 25 bp, Mus musculus
cctgtctgtatgcaaatgtggtcac

SEQ ID NO: 357025 - DNA, 25 bp, Mus musculus
cctgtctgtatggaaatgtggtcac

SEQ ID NO: 357026 - DNA, 25 bp, Mus musculus
cctgtctgtcatccatcacgtttga

SEQ ID NO: 357027 - DNA, 25 bp, Mus musculus
cctgtctgtcatgcatcacgtttga

SEQ ID NO: 357028 - DNA, 25 bp, Mus musculus
cctgtctgtcctctagggatgattt

SEQ ID NO: 357029 - DNA, 25 bp, Mus musculus
cctgtctgtcctgtagggatgattt

SEQ ID NO: 357030 - DNA, 25 bp, Mus musculus
cctgtctgtgggatatgttcggcta

SEQ ID NO: 357031 - DNA, 25 bp, Mus musculus
cctgtctgtgggttatgttcggcta

SEQ ID NO: 357032 - DNA, 25 bp, Mus musculus
cctgtctgttctcaagtgttagcta

SEQ ID NO: 357033 - DNA, 25 bp, Mus musculus
cctgtctgttctgaagtgttagcta

SEQ ID NO: 357034 - DNA, 25 bp, Mus musculus
cctgtcttaccccttgaaggacaag

SEQ ID NO: 357035 - DNA, 25 bp, Mus musculus
cctgtcttacccgttgaaggacaag

SEQ ID NO: 357036 - DNA, 25 bp, Mus musculus
cctgtcttcaatccattccatggca

SEQ ID NO: 357037 - DNA, 25 bp, Mus musculus
cctgtcttcaatgcattccatggca

SEQ ID NO: 357038 - DNA, 25 bp, Mus musculus
cctgtcttccatatttgattgcttg

SEQ ID NO: 357039 - DNA, 25 bp, Mus musculus
cctgtcttccatttttgattgcttg

SEQ ID NO: 357040 - DNA, 25 bp, Mus musculus
cctgtcttctctcaggctttgaaag

SEQ ID NO: 357041 - DNA, 25 bp, Mus musculus
cctgtcttctctgaggctttgaaag

SEQ ID NO: 357042 - DNA, 25 bp, Mus musculus
cctgtcttctgactccttgggatta

SEQ ID NO: 357043 - DNA, 25 bp, Mus musculus
cctgtcttctgagtccttgggatta

SEQ ID NO: 357044 - DNA, 25 bp, Mus musculus
cctgtcttgcagcaaccctttagag

SEQ ID NO: 357045 - DNA, 25 bp, Mus musculus
cctgtcttgcaggaaccctttagag

SEQ ID NO: 357046 - DNA, 25 bp, Mus musculus
cctgtcttgtctacttttagcttca

SEQ ID NO: 357047 - DNA, 25 bp, Mus musculus
cctgtcttgtcttcttttagcttca

SEQ ID NO: 357048 - DNA, 25 bp, Mus musculus
cctgtctttacacatgtttgtttgc

SEQ ID NO: 357049 - DNA, 25 bp, Mus musculus
cctgtctttacagatgtttgtttgc

SEQ ID NO: 357050 - DNA, 25 bp, Mus musculus
cctgtctttatgctcctaaacttac

SEQ ID NO: 357051 - DNA, 25 bp, Mus musculus
cctgtctttatggtcctaaacttac

SEQ ID NO: 357052 - DNA, 25 bp, Mus musculus
cctgtctttgctccttagcctgaac

SEQ ID NO: 357053 - DNA, 25 bp, Mus musculus
cctgtctttgctgcttagcctgaac

SEQ ID NO: 357054 - DNA, 25 bp, Mus musculus
cctgtctttttcatacaggagcctc

SEQ ID NO: 357055 - DNA, 25 bp, Mus musculus
cctgtctttttcttacaggagcctc

SEQ ID NO: 357056 - DNA, 25 bp, Mus musculus
cctgtgaaacacataaaatcttaat

SEQ ID NO: 357057 - DNA, 25 bp, Mus musculus
cctgtgaaacacttaaaatcttaat

SEQ ID NO: 357058 - DNA, 25 bp, Mus musculus
cctgtgaaacttcctgtccaaaaag

SEQ ID NO: 357059 - DNA, 25 bp, Mus musculus
cctgtgaaacttgctgtccaaaaag

SEQ ID NO: 357060 - DNA, 25 bp, Mus musculus
cctgtgaaccagaatacacttaaat

SEQ ID NO: 357061 - DNA, 25 bp, Mus musculus
cctgtgaaccagtatacacttaaat

SEQ ID NO: 357062 - DNA, 25 bp, Mus musculus
cctgtgaagagtcagcgcgcgctta

SEQ ID NO: 357063 - DNA, 25 bp, Mus musculus
cctgtgaagagtgagcgcgcgctta

SEQ ID NO: 357064 - DNA, 25 bp, Mus musculus
cctgtgaagttccatatgagtgtta

SEQ ID NO: 357065 - DNA, 25 bp, Mus musculus
cctgtgaagttcgatatgagtgtta

SEQ ID NO: 357066 - DNA, 25 bp, Mus musculus
cctgtgaatagcacttgggctggga

SEQ ID NO: 357067 - DNA, 25 bp, Mus musculus
cctgtgaatagctcttgggctggga

SEQ ID NO: 357068 - DNA, 25 bp, Mus musculus
cctgtgaatgagaactaagagccct

SEQ ID NO: 357069 - DNA, 25 bp, Mus musculus
cctgtgaatgagtactaagagccct

SEQ ID NO: 357070 - DNA, 25 bp, Mus musculus
cctgtgacactcattcttgaaagct

SEQ ID NO: 357071 - DNA, 25 bp, Mus musculus
cctgtgacactctttcttgaaagct

SEQ ID NO: 357072 - DNA, 25 bp, Mus musculus
cctgtgaccaatccccaagtggaaa

SEQ ID NO: 357073 - DNA, 25 bp, Mus musculus
cctgtgaccaatgcccaagtggaaa

SEQ ID NO: 357074 - DNA, 25 bp, Mus musculus
cctgtgacccagctagatggaagat

SEQ ID NO: 357075 - DNA, 25 bp, Mus musculus
cctgtgacccaggtagatggaagat

SEQ ID NO: 357076 - DNA, 25 bp, Mus musculus
cctgtgacctgaactctgggcgttt

SEQ ID NO: 357077 - DNA, 25 bp, Mus musculus
cctgtgacctgatctctgggcgttt

SEQ ID NO: 357078 - DNA, 25 bp, Mus musculus
cctgtgacctgtccggagacactag

SEQ ID NO: 357079 - DNA, 25 bp, Mus musculus
cctgtgacctgtgcggagacactag

SEQ ID NO: 357080 - DNA, 25 bp, Mus musculus
cctgtgacctttactcagcaacaca

SEQ ID NO: 357081 - DNA, 25 bp, Mus musculus
cctgtgaccttttctcagcaacaca

SEQ ID NO: 357082 - DNA, 25 bp, Mus musculus
cctgtgactctcctttgcctttttt

SEQ ID NO: 357083 - DNA, 25 bp, Mus musculus
cctgtgactctcgtttgcctttttt

SEQ ID NO: 357084 - DNA, 25 bp, Mus musculus
cctgtgacttctaccgctgttgggc

SEQ ID NO: 357085 - DNA, 25 bp, Mus musculus
cctgtgacttcttccgctgttgggc

SEQ ID NO: 357086 - DNA, 25 bp, Mus musculus
cctgtgacttttctactgctggaga

SEQ ID NO: 357087 - DNA, 25 bp, Mus musculus
cctgtgacttttgtactgctggaga

SEQ ID NO: 357088 - DNA, 25 bp, Mus musculus
cctgtgagacttagctcgggagaaa

SEQ ID NO: 357089 - DNA, 25 bp, Mus musculus
cctgtgagactttgctcgggagaaa

SEQ ID NO: 357090 - DNA, 25 bp, Mus musculus
cctgtgagagtcatgggaaccggtt

SEQ ID NO: 357091 - DNA, 25 bp, Mus musculus
cctgtgagagtcttgggaaccggtt

SEQ ID NO: 357092 - DNA, 25 bp, Mus musculus
cctgtgagcacaccatatcctgaat

SEQ ID NO: 357093 - DNA, 25 bp, Mus musculus
cctgtgagcacagcatatcctgaat

SEQ ID NO: 357094 - DNA, 25 bp, Mus musculus
cctgtgagctctcaggtagggccat

SEQ ID NO: 357095 - DNA, 25 bp, Mus musculus
cctgtgagctctgaggtagggccat

SEQ ID NO: 357096 - DNA, 25 bp, Mus musculus
cctgtgagcttacagacttctggag

SEQ ID NO: 357097 - DNA, 25 bp, Mus musculus
cctgtgagcttagagacttctggag

SEQ ID NO: 357098 - DNA, 25 bp, Mus musculus
cctgtgagcttgacctatctatttt

SEQ ID NO: 357099 - DNA, 25 bp, Mus musculus
cctgtgagcttgtcctatctatttt

SEQ ID NO: 357100 - DNA, 25 bp, Mus musculus
cctgtgaggactcttacatgggtgt

SEQ ID NO: 357101 - DNA, 25 bp, Mus musculus
cctgtgaggactgttacatgggtgt

SEQ ID NO: 357102 - DNA, 25 bp, Mus musculus
cctgtgagtcagataaaggaccgaa

SEQ ID NO: 357103 - DNA, 25 bp, Mus musculus
cctgtgagtcagttaaaggaccgaa

SEQ ID NO: 357104 - DNA, 25 bp, Mus musculus
cctgtgagtcgactgcttagaaagc

SEQ ID NO: 357105 - DNA, 25 bp, Mus musculus
cctgtgagtcgagtgcttagaaagc

SEQ ID NO: 357106 - DNA, 25 bp, Mus musculus
cctgtgatcttgattgtgtattctt

SEQ ID NO: 357107 - DNA, 25 bp, Mus musculus
cctgtgatcttgtttgtgtattctt

SEQ ID NO: 357108 - DNA, 25 bp, Mus musculus
cctgtgattccccatgatggatgtt

SEQ ID NO: 357109 - DNA, 25 bp, Mus musculus
cctgtgattcccgatgatggatgtt

SEQ ID NO: 357110 - DNA, 25 bp, Mus musculus
cctgtgatttggagacatgggtgtt

SEQ ID NO: 357111 - DNA, 25 bp, Mus musculus
cctgtgatttggtgacatgggtgtt

SEQ ID NO: 357112 - DNA, 25 bp, Mus musculus
cctgtgcacagtcccatggatggct

SEQ ID NO: 357113 - DNA, 25 bp, Mus musculus
cctgtgcacagtgccatggatggct

SEQ ID NO: 357114 - DNA, 25 bp, Mus musculus
cctgtgcacgtaattatgagcctgt

SEQ ID NO: 357115 - DNA, 25 bp, Mus musculus
cctgtgcacgtatttatgagcctgt

SEQ ID NO: 357116 - DNA, 25 bp, Mus musculus
cctgtgcataccatcttgtgataga

SEQ ID NO: 357117 - DNA, 25 bp, Mus musculus
cctgtgcataccttcttgtgataga

SEQ ID NO: 357118 - DNA, 25 bp, Mus musculus
cctgtgcatttgcaacatttgtttt

SEQ ID NO: 357119 - DNA, 25 bp, Mus musculus
cctgtgcatttggaacatttgtttt

SEQ ID NO: 357120 - DNA, 25 bp, Mus musculus
cctgtgccagacatcactgttatga

SEQ ID NO: 357121 - DNA, 25 bp, Mus musculus
cctgtgccagacttcactgttatga

SEQ ID NO: 357122 - DNA, 25 bp, Mus musculus
cctgtgcccattctatgcagtggga

SEQ ID NO: 357123 - DNA, 25 bp, Mus musculus
cctgtgcccattgtatgcagtggga

SEQ ID NO: 357124 - DNA, 25 bp, Mus musculus
cctgtgccctaaacgatgttgtgta

SEQ ID NO: 357125 - DNA, 25 bp, Mus musculus
cctgtgccctaatcgatgttgtgta

SEQ ID NO: 357126 - DNA, 25 bp, Mus musculus
cctgtgccctggagtcgtttgtcgg

SEQ ID NO: 357127 - DNA, 25 bp, Mus musculus
cctgtgccctggtgtcgtttgtcgg

SEQ ID NO: 357128 - DNA, 25 bp, Mus musculus
cctgtgccgatacgtgtgctgtgca

SEQ ID NO: 357129 - DNA, 25 bp, Mus musculus
cctgtgccgataggtgtgctgtgca

SEQ ID NO: 357130 - DNA, 25 bp, Mus musculus
cctgtgccgcctcgatttatgggtg

SEQ ID NO: 357131 - DNA, 25 bp, Mus musculus
cctgtgccgcctggatttatgggtg

SEQ ID NO: 357132 - DNA, 25 bp, Mus musculus
cctgtgccgggtcacttaggaccag

SEQ ID NO: 357133 - DNA, 25 bp, Mus musculus
cctgtgccgggtgacttaggaccag

SEQ ID NO: 357134 - DNA, 25 bp, Mus musculus
cctgtgcctagcaatatttccactt

SEQ ID NO: 357135 - DNA, 25 bp, Mus musculus
cctgtgcctagctatatttccactt

SEQ ID NO: 357136 - DNA, 25 bp, Mus musculus
cctgtgcctatgagtttggtaacaa

SEQ ID NO: 357137 - DNA, 25 bp, Mus musculus
cctgtgcctatgatcttgggatttt

SEQ ID NO: 357138 - DNA, 25 bp, Mus musculus
cctgtgcctatgtgtttggtaacaa

SEQ ID NO: 357139 - DNA, 25 bp, Mus musculus
cctgtgcctatgttcttgggatttt

SEQ ID NO: 357140 - DNA, 25 bp, Mus musculus
cctgtgcctccaagtgatgttctga

SEQ ID NO: 357141 - DNA, 25 bp, Mus musculus
cctgtgcctccatgtgatgttctga

SEQ ID NO: 357142 - DNA, 25 bp, Mus musculus
cctgtgcctgggacgggttatagaa

SEQ ID NO: 357143 - DNA, 25 bp, Mus musculus
cctgtgcctgggtcgggttatagaa

SEQ ID NO: 357144 - DNA, 25 bp, Mus musculus
cctgtgcctgtcagtatgcaaatgt

SEQ ID NO: 357145 - DNA, 25 bp, Mus musculus
cctgtgcctgtctgtatgcaaatgt

SEQ ID NO: 357146 - DNA, 25 bp, Mus musculus
cctgtgccttgtatgcatctgagga

SEQ ID NO: 357147 - DNA, 25 bp, Mus musculus
cctgtgccttgtccctgaaaatcaa

SEQ ID NO: 357148 - DNA, 25 bp, Mus musculus
cctgtgccttgtgcctgaaaatcaa

SEQ ID NO: 357149 - DNA, 25 bp, Mus musculus
cctgtgccttgtttgcatctgagga

SEQ ID NO: 357150 - DNA, 25 bp, Mus musculus
cctgtgcgggttcccgatgctgcta

SEQ ID NO: 357151 - DNA, 25 bp, Mus musculus
cctgtgcgggttgccgatgctgcta

SEQ ID NO: 357152 - DNA, 25 bp, Mus musculus
cctgtgcgtctgaagtgctggaatt

SEQ ID NO: 357153 - DNA, 25 bp, Mus musculus
cctgtgcgtctgtagtgctggaatt

SEQ ID NO: 357154 - DNA, 25 bp, Mus musculus
cctgtgctacataattaagatcttg

SEQ ID NO: 357155 - DNA, 25 bp, Mus musculus
cctgtgctacattattaagatcttg

SEQ ID NO: 357156 - DNA, 25 bp, Mus musculus
cctgtgctaggcaaggattgtatcc

SEQ ID NO: 357157 - DNA, 25 bp, Mus musculus
cctgtgctaggctaggattgtatcc

SEQ ID NO: 357158 - DNA, 25 bp, Mus musculus
cctgtgctcagcaacactgtatcag

SEQ ID NO: 357159 - DNA, 25 bp, Mus musculus
cctgtgctcagctacactgtatcag

SEQ ID NO: 357160 - DNA, 25 bp, Mus musculus
cctgtgctcagtcattctgagagca

SEQ ID NO: 357161 - DNA, 25 bp, Mus musculus
cctgtgctcagtgattctgagagca

SEQ ID NO: 357162 - DNA, 25 bp, Mus musculus
cctgtgctctgaaatgccacttggg

SEQ ID NO: 357163 - DNA, 25 bp, Mus musculus
cctgtgctctgatatgccacttggg

SEQ ID NO: 357164 - DNA, 25 bp, Mus musculus
cctgtgctgccacatacctggatta

SEQ ID NO: 357165 - DNA, 25 bp, Mus musculus
cctgtgctgccagatacctggatta

SEQ ID NO: 357166 - DNA, 25 bp, Mus musculus
cctgtgctgctgaagactgtgtcaa

SEQ ID NO: 357167 - DNA, 25 bp, Mus musculus
cctgtgctgctgtagactgtgtcaa

SEQ ID NO: 357168 - DNA, 25 bp, Mus musculus
cctgtgctggacatacgatgtggag

SEQ ID NO: 357169 - DNA, 25 bp, Mus musculus
cctgtgctggacttacgatgtggag

SEQ ID NO: 357170 - DNA, 25 bp, Mus musculus
cctgtgctgttaccattctcgataa

SEQ ID NO: 357171 - DNA, 25 bp, Mus musculus
cctgtgctgttagcattctcgataa

SEQ ID NO: 357172 - DNA, 25 bp, Mus musculus
cctgtgcttcacacaagcagctgaa

SEQ ID NO: 357173 - DNA, 25 bp, Mus musculus
cctgtgcttcactcaagcagctgaa

SEQ ID NO: 357174 - DNA, 25 bp, Mus musculus
cctgtgcttggtaaactgtggactc

SEQ ID NO: 357175 - DNA, 25 bp, Mus musculus
cctgtgcttggttaactgtggactc

SEQ ID NO: 357176 - DNA, 25 bp, Mus musculus
cctgtggaagatcggcttcttccgc

SEQ ID NO: 357177 - DNA, 25 bp, Mus musculus
cctgtggaagatgggcttcttccgc

SEQ ID NO: 357178 - DNA, 25 bp, Mus musculus
cctgtggagccaagtactttctgag

SEQ ID NO: 357179 - DNA, 25 bp, Mus musculus
cctgtggagccatgtactttctgag

SEQ ID NO: 357180 - DNA, 25 bp, Mus musculus
cctgtggagggtcttagattccctg

SEQ ID NO: 357181 - DNA, 25 bp, Mus musculus
cctgtggagggtgttagattccctg

SEQ ID NO: 357182 - DNA, 25 bp, Mus musculus
cctgtggcaaaaatgtttctttctt

SEQ ID NO: 357183 - DNA, 25 bp, Mus musculus
cctgtggcaaaattgtttctttctt

SEQ ID NO: 357184 - DNA, 25 bp, Mus musculus
cctgtggcaaagctagagttctggc

SEQ ID NO: 357185 - DNA, 25 bp, Mus musculus
cctgtggcaaaggtagagttctggc

SEQ ID NO: 357186 - DNA, 25 bp, Mus musculus
cctgtggcacaccaaaagtaagaac

SEQ ID NO: 357187 - DNA, 25 bp, Mus musculus
cctgtggcacacgaaaagtaagaac

SEQ ID NO: 357188 - DNA, 25 bp, Mus musculus
cctgtggcaggcatgactaaatgat

SEQ ID NO: 357189 - DNA, 25 bp, Mus musculus
cctgtggcaggcttgactaaatgat

SEQ ID NO: 357190 - DNA, 25 bp, Mus musculus
cctgtggccgatactttgcatttaa

SEQ ID NO: 357191 - DNA, 25 bp, Mus musculus
cctgtggccgattctttgcatttaa

SEQ ID NO: 357192 - DNA, 25 bp, Mus musculus
cctgtggcctggattgaacgttcct

SEQ ID NO: 357193 - DNA, 25 bp, Mus musculus
cctgtggcctggtttgaacgttcct

SEQ ID NO: 357194 - DNA, 25 bp, Mus musculus
cctgtggcctttactcaaagatgcc

SEQ ID NO: 357195 - DNA, 25 bp, Mus musculus
cctgtggccttttctcaaagatgcc

SEQ ID NO: 357196 - DNA, 25 bp, Mus musculus
cctgtggctcataggtaccagtgga

SEQ ID NO: 357197 - DNA, 25 bp, Mus musculus
cctgtggctcattggtaccagtgga

SEQ ID NO: 357198 - DNA, 25 bp, Mus musculus
cctgtggctgtcagtggcactggct

SEQ ID NO: 357199 - DNA, 25 bp, Mus musculus
cctgtggctgtctgtggcactggct

SEQ ID NO: 357200 - DNA, 25 bp, Mus musculus
cctgtggcttctcaaagactctaca

SEQ ID NO: 357201 - DNA, 25 bp, Mus musculus
cctgtggcttctgaaagactctaca

SEQ ID NO: 357202 - DNA, 25 bp, Mus musculus
cctgtgggaaccacccaatttgtga

SEQ ID NO: 357203 - DNA, 25 bp, Mus musculus
cctgtgggaacctcccaatttgtga

SEQ ID NO: 357204 - DNA, 25 bp, Mus musculus
cctgtgggagagaagaaaatcctgt

SEQ ID NO: 357205 - DNA, 25 bp, Mus musculus
cctgtgggagagtagaaaatcctgt

SEQ ID NO: 357206 - DNA, 25 bp, Mus musculus
cctgtgggccttcccaaatggtttg

SEQ ID NO: 357207 - DNA, 25 bp, Mus musculus
cctgtgggccttgccaaatggtttg

SEQ ID NO: 357208 - DNA, 25 bp, Mus musculus
cctgtgggcgtcctcagacttaaca

SEQ ID NO: 357209 - DNA, 25 bp, Mus musculus
cctgtgggcgtcgtcagacttaaca

SEQ ID NO: 357210 - DNA, 25 bp, Mus musculus
cctgtggggaacactcaagaaggcc

SEQ ID NO: 357211 - DNA, 25 bp, Mus musculus
cctgtggggaactctcaagaaggcc

SEQ ID NO: 357212 - DNA, 25 bp, Mus musculus
cctgtgggtcctctgactacagtga

SEQ ID NO: 357213 - DNA, 25 bp, Mus musculus
cctgtgggtcctgtgactacagtga

SEQ ID NO: 357214 - DNA, 25 bp, Mus musculus
cctgtgggtcgtcagtggtacctaa

SEQ ID NO: 357215 - DNA, 25 bp, Mus musculus
cctgtgggtcgtgagtggtacctaa

SEQ ID NO: 357216 - DNA, 25 bp, Mus musculus
cctgtgggtttgaactcctgggttg

SEQ ID NO: 357217 - DNA, 25 bp, Mus musculus
cctgtgggtttgactggtctggcaa

SEQ ID NO: 357218 - DNA, 25 bp, Mus musculus
cctgtgggtttgtactcctgggttg

SEQ ID NO: 357219 - DNA, 25 bp, Mus musculus
cctgtgggtttgtctggtctggcaa

SEQ ID NO: 357220 - DNA, 25 bp, Mus musculus
cctgtggtagaacccactgcgtttt

SEQ ID NO: 357221 - DNA, 25 bp, Mus musculus
cctgtggtagaagccactgcgtttt

SEQ ID NO: 357222 - DNA, 25 bp, Mus musculus
cctgtggtagtccagattcaacacc

SEQ ID NO: 357223 - DNA, 25 bp, Mus musculus
cctgtggtagtcgagattcaacacc

SEQ ID NO: 357224 - DNA, 25 bp, Mus musculus
cctgtggtatctactgtttcataca

SEQ ID NO: 357225 - DNA, 25 bp, Mus musculus
cctgtggtatctccgagactgtcca

SEQ ID NO: 357226 - DNA, 25 bp, Mus musculus
cctgtggtatctcctattaactgta

SEQ ID NO: 357227 - DNA, 25 bp, Mus musculus
cctgtggtatctgcgagactgtcca

SEQ ID NO: 357228 - DNA, 25 bp, Mus musculus
cctgtggtatctgctattaactgta

SEQ ID NO: 357229 - DNA, 25 bp, Mus musculus
cctgtggtatcttctgtttcataca

SEQ ID NO: 357230 - DNA, 25 bp, Mus musculus
cctgtggtccagccacattgagggt

SEQ ID NO: 357231 - DNA, 25 bp, Mus musculus
cctgtggtccaggcacattgagggt

SEQ ID NO: 357232 - DNA, 25 bp, Mus musculus
cctgtggtcctgctgttgggcaaag

SEQ ID NO: 357233 - DNA, 25 bp, Mus musculus
cctgtggtcctggtgttgggcaaag

SEQ ID NO: 357234 - DNA, 25 bp, Mus musculus
cctgtggtcgtcagggaactatgga

SEQ ID NO: 357235 - DNA, 25 bp, Mus musculus
cctgtggtcgtctgggaactatgga

SEQ ID NO: 357236 - DNA, 25 bp, Mus musculus
cctgtggtctccagctggcatgtga

SEQ ID NO: 357237 - DNA, 25 bp, Mus musculus
cctgtggtctcctgctggcatgtga

SEQ ID NO: 357238 - DNA, 25 bp, Mus musculus
cctgtggtgtctctagctagctatg

SEQ ID NO: 357239 - DNA, 25 bp, Mus musculus
cctgtggtgtctgtagctagctatg

SEQ ID NO: 357240 - DNA, 25 bp, Mus musculus
cctgtggtgttgctctccctctttc

SEQ ID NO: 357241 - DNA, 25 bp, Mus musculus
cctgtggtgttggtctccctctttc

SEQ ID NO: 357242 - DNA, 25 bp, Mus musculus
cctgtgtaaggcacatctgttggaa

SEQ ID NO: 357243 - DNA, 25 bp, Mus musculus
cctgtgtaaggctcatctgttggaa

SEQ ID NO: 357244 - DNA, 25 bp, Mus musculus
cctgtgtacaccagtatttggcatt

SEQ ID NO: 357245 - DNA, 25 bp, Mus musculus
cctgtgtacacctgtatttggcatt

SEQ ID NO: 357246 - DNA, 25 bp, Mus musculus
cctgtgtagcacaagtttgaccctg

SEQ ID NO: 357247 - DNA, 25 bp, Mus musculus
cctgtgtagcactagtttgaccctg

SEQ ID NO: 357248 - DNA, 25 bp, Mus musculus
cctgtgtagctgatctgcatgtgaa

SEQ ID NO: 357249 - DNA, 25 bp, Mus musculus
cctgtgtagctgttctgcatgtgaa

SEQ ID NO: 357250 - DNA, 25 bp, Mus musculus
cctgtgtatatgacccaacctgtga

SEQ ID NO: 357251 - DNA, 25 bp, Mus musculus
cctgtgtatatgtcccaacctgtga

SEQ ID NO: 357252 - DNA, 25 bp, Mus musculus
cctgtgtatcgacagaactgggctg

SEQ ID NO: 357253 - DNA, 25 bp, Mus musculus
cctgtgtatcgagagaactgggctg

SEQ ID NO: 357254 - DNA, 25 bp, Mus musculus
cctgtgtatttcaggagccttgcta

SEQ ID NO: 357255 - DNA, 25 bp, Mus musculus
cctgtgtatttctggagccttgcta

SEQ ID NO: 357256 - DNA, 25 bp, Mus musculus
cctgtgtcaccgagtagtgtcatag

SEQ ID NO: 357257 - DNA, 25 bp, Mus musculus
cctgtgtcaccgtgtagtgtcatag

SEQ ID NO: 357258 - DNA, 25 bp, Mus musculus
cctgtgtccaggagtaatggccaaa

SEQ ID NO: 357259 - DNA, 25 bp, Mus musculus
cctgtgtccaggtgtaatggccaaa

SEQ ID NO: 357260 - DNA, 25 bp, Mus musculus
cctgtgtccataaatatggcatgat

SEQ ID NO: 357261 - DNA, 25 bp, Mus musculus
cctgtgtccatatatatggcatgat

SEQ ID NO: 357262 - DNA, 25 bp, Mus musculus
cctgtgtcgggtactgggtcactga

SEQ ID NO: 357263 - DNA, 25 bp, Mus musculus
cctgtgtcgggttctgggtcactga

SEQ ID NO: 357264 - DNA, 25 bp, Mus musculus
cctgtgtcgtggattatactggata

SEQ ID NO: 357265 - DNA, 25 bp, Mus musculus
cctgtgtcgtggtttatactggata

SEQ ID NO: 357266 - DNA, 25 bp, Mus musculus
cctgtgtctacgagggctggaaaat

SEQ ID NO: 357267 - DNA, 25 bp, Mus musculus
cctgtgtctacgtgggctggaaaat

SEQ ID NO: 357268 - DNA, 25 bp, Mus musculus
cctgtgtcttgaattggagcttagc

SEQ ID NO: 357269 - DNA, 25 bp, Mus musculus
cctgtgtcttgatttggagcttagc

SEQ ID NO: 357270 - DNA, 25 bp, Mus musculus
cctgtgtcttggagctagtttcaag

SEQ ID NO: 357271 - DNA, 25 bp, Mus musculus
cctgtgtcttggtgctagtttcaag

SEQ ID NO: 357272 - DNA, 25 bp, Mus musculus
cctgtgtgacacctggctgccaagt

SEQ ID NO: 357273 - DNA, 25 bp, Mus musculus
cctgtgtgacacgtggctgccaagt

SEQ ID NO: 357274 - DNA, 25 bp, Mus musculus
cctgtgtgactgctatgctcaattt

SEQ ID NO: 357275 - DNA, 25 bp, Mus musculus
cctgtgtgactggtatgctcaattt

SEQ ID NO: 357276 - DNA, 25 bp, Mus musculus
cctgtgtgacttcgcctaggaacta

SEQ ID NO: 357277 - DNA, 25 bp, Mus musculus
cctgtgtgacttggcctaggaacta

SEQ ID NO: 357278 - DNA, 25 bp, Mus musculus
cctgtgtgatgtcggtgtctattga

SEQ ID NO: 357279 - DNA, 25 bp, Mus musculus
cctgtgtgatgtgggtgtctattga

SEQ ID NO: 357280 - DNA, 25 bp, Mus musculus
cctgtgtgcaccaccctttttggag

SEQ ID NO: 357281 - DNA, 25 bp, Mus musculus
cctgtgtgcacctccctttttggag

SEQ ID NO: 357282 - DNA, 25 bp, Mus musculus
cctgtgtggaaaattcttacggaga

SEQ ID NO: 357283 - DNA, 25 bp, Mus musculus
cctgtgtggaaatttcttacggaga

SEQ ID NO: 357284 - DNA, 25 bp, Mus musculus
cctgtgtggatgctaccagcagact

SEQ ID NO: 357285 - DNA, 25 bp, Mus musculus
cctgtgtggatggtaccagcagact

SEQ ID NO: 357286 - DNA, 25 bp, Mus musculus
cctgtgtggctaagaatgacggtca

SEQ ID NO: 357287 - DNA, 25 bp, Mus musculus
cctgtgtggctatgaatgacggtca

SEQ ID NO: 357288 - DNA, 25 bp, Mus musculus
cctgtgtgggacaggctactgtatt

SEQ ID NO: 357289 - DNA, 25 bp, Mus musculus
cctgtgtgggactggctactgtatt

SEQ ID NO: 357290 - DNA, 25 bp, Mus musculus
cctgtgtggtacaagcatggagacc

SEQ ID NO: 357291 - DNA, 25 bp, Mus musculus
cctgtgtggtactagcatggagacc

SEQ ID NO: 357292 - DNA, 25 bp, Mus musculus
cctgtgtggtatcaggcacaataaa

SEQ ID NO: 357293 - DNA, 25 bp, Mus musculus
cctgtgtggtatgaggcacaataaa

SEQ ID NO: 357294 - DNA, 25 bp, Mus musculus
cctgtgtgtgaaacccttgtgtaga

SEQ ID NO: 357295 - DNA, 25 bp, Mus musculus
cctgtgtgtgaatcccttgtgtaga

SEQ ID NO: 357296 - DNA, 25 bp, Mus musculus
cctgtgtgtgctactatgtacagca

SEQ ID NO: 357297 - DNA, 25 bp, Mus musculus
cctgtgtgtgctctttgacttgtta

SEQ ID NO: 357298 - DNA, 25 bp, Mus musculus
cctgtgtgtgctgtttgacttgtta

SEQ ID NO: 357299 - DNA, 25 bp, Mus musculus
cctgtgtgtgcttctatgtacagca

SEQ ID NO: 357300 - DNA, 25 bp, Mus musculus
cctgtgtgtgtactatggtctcccc

SEQ ID NO: 357301 - DNA, 25 bp, Mus musculus
cctgtgtgtgtagtatggtctcccc

SEQ ID NO: 357302 - DNA, 25 bp, Mus musculus
cctgtgtgttcaactcaaatgtgat

SEQ ID NO: 357303 - DNA, 25 bp, Mus musculus
cctgtgtgttcatctcaaatgtgat

SEQ ID NO: 357304 - DNA, 25 bp, Mus musculus
cctgtgttatctattcagaatgtaa

SEQ ID NO: 357305 - DNA, 25 bp, Mus musculus
cctgtgttatcttttcagaatgtaa

SEQ ID NO: 357306 - DNA, 25 bp, Mus musculus
cctgtgttcaagaaggttcaggatg

SEQ ID NO: 357307 - DNA, 25 bp, Mus musculus
cctgtgttcaagtaggttcaggatg

SEQ ID NO: 357308 - DNA, 25 bp, Mus musculus
cctgtgttcagtagcatggttaatg

SEQ ID NO: 357309 - DNA, 25 bp, Mus musculus
cctgtgttcagttgcatggttaatg

SEQ ID NO: 357310 - DNA, 25 bp, Mus musculus
cctgtgttccttaatctattttgag

SEQ ID NO: 357311 - DNA, 25 bp, Mus musculus
cctgtgttcctttatctattttgag

SEQ ID NO: 357312 - DNA, 25 bp, Mus musculus
cctgtgttcgtgcactgatttatca

SEQ ID NO: 357313 - DNA, 25 bp, Mus musculus
cctgtgttcgtggactgatttatca

SEQ ID NO: 357314 - DNA, 25 bp, Mus musculus
cctgtgttcttcaacatggtgcaaa

SEQ ID NO: 357315 - DNA, 25 bp, Mus musculus
cctgtgttcttctacatggtgcaaa

SEQ ID NO: 357316 - DNA, 25 bp, Mus musculus
cctgtgtttatccagtctccaaaaa

SEQ ID NO: 357317 - DNA, 25 bp, Mus musculus
cctgtgtttatcgagtctccaaaaa

SEQ ID NO: 357318 - DNA, 25 bp, Mus musculus
cctgtgtttgacctcagtcacgatg

SEQ ID NO: 357319 - DNA, 25 bp, Mus musculus
cctgtgtttgacgtcagtcacgatg

SEQ ID NO: 357320 - DNA, 25 bp, Mus musculus
cctgtgtttgtaaggaacccaactc

SEQ ID NO: 357321 - DNA, 25 bp, Mus musculus
cctgtgtttgtatggaacccaactc

SEQ ID NO: 357322 - DNA, 25 bp, Mus musculus
cctgtgttttctcccataaattatt

SEQ ID NO: 357323 - DNA, 25 bp, Mus musculus
cctgtgttttctgccataaattatt

SEQ ID NO: 357324 - DNA, 25 bp, Mus musculus
cctgttaaagttcacagcattttta

SEQ ID NO: 357325 - DNA, 25 bp, Mus musculus
cctgttaaagttgacagcattttta

SEQ ID NO: 357326 - DNA, 25 bp, Mus musculus
cctgttacaccacacgggatagagg

SEQ ID NO: 357327 - DNA, 25 bp, Mus musculus
cctgttacaccagacgggatagagg

SEQ ID NO: 357328 - DNA, 25 bp, Mus musculus
cctgttaccacacctttagcagttg

SEQ ID NO: 357329 - DNA, 25 bp, Mus musculus
cctgttaccacagctttagcagttg

SEQ ID NO: 357330 - DNA, 25 bp, Mus musculus
cctgttaccttcaaatgctgtcttt

SEQ ID NO: 357331 - DNA, 25 bp, Mus musculus
cctgttaccttctaatgctgtcttt

SEQ ID NO: 357332 - DNA, 25 bp, Mus musculus
cctgttacggtcattgtggatgctc

SEQ ID NO: 357333 - DNA, 25 bp, Mus musculus
cctgttacggtctttgtggatgctc

SEQ ID NO: 357334 - DNA, 25 bp, Mus musculus
cctgttactcatacattttgtgttt

SEQ ID NO: 357335 - DNA, 25 bp, Mus musculus
cctgttactcattcattttgtgttt

SEQ ID NO: 357336 - DNA, 25 bp, Mus musculus
cctgttactctccatgactaactgt

SEQ ID NO: 357337 - DNA, 25 bp, Mus musculus
cctgttactctcgatgactaactgt

SEQ ID NO: 357338 - DNA, 25 bp, Mus musculus
cctgttactttcaagcagttgcttt

SEQ ID NO: 357339 - DNA, 25 bp, Mus musculus
cctgttactttctagcagttgcttt

SEQ ID NO: 357340 - DNA, 25 bp, Mus musculus
cctgttagacatcttaagcctggaa

SEQ ID NO: 357341 - DNA, 25 bp, Mus musculus
cctgttagacatgttaagcctggaa

SEQ ID NO: 357342 - DNA, 25 bp, Mus musculus
cctgttagcaggcacatctgtgtaa

SEQ ID NO: 357343 - DNA, 25 bp, Mus musculus
cctgttagcagggacatctgtgtaa

SEQ ID NO: 357344 - DNA, 25 bp, Mus musculus
cctgttagtcaacgcctggaggaca

SEQ ID NO: 357345 - DNA, 25 bp, Mus musculus
cctgttagtcaaggcctggaggaca

SEQ ID NO: 357346 - DNA, 25 bp, Mus musculus
cctgttagtgtgaggattctcccca

SEQ ID NO: 357347 - DNA, 25 bp, Mus musculus
cctgttagtgtgatctgtggagaat

SEQ ID NO: 357348 - DNA, 25 bp, Mus musculus
cctgttagtgtgtggattctcccca

SEQ ID NO: 357349 - DNA, 25 bp, Mus musculus
cctgttagtgtgttctgtggagaat

SEQ ID NO: 357350 - DNA, 25 bp, Mus musculus
cctgttatccccaattaccatgtaa

SEQ ID NO: 357351 - DNA, 25 bp, Mus musculus
cctgttatcccctattaccatgtaa

SEQ ID NO: 357352 - DNA, 25 bp, Mus musculus
cctgttatctgtccccatgggaaat

SEQ ID NO: 357353 - DNA, 25 bp, Mus musculus
cctgttatctgtgcccatgggaaat

SEQ ID NO: 357354 - DNA, 25 bp, Mus musculus
cctgttatgtaaattccacctctca

SEQ ID NO: 357355 - DNA, 25 bp, Mus musculus
cctgttatgtaatttccacctctca

SEQ ID NO: 357356 - DNA, 25 bp, Mus musculus
cctgttattttcatgcctggatggt

SEQ ID NO: 357357 - DNA, 25 bp, Mus musculus
cctgttattttcttgcctggatggt

SEQ ID NO: 357358 - DNA, 25 bp, Mus musculus
cctgttcaaagcatttgcatgctta

SEQ ID NO: 357359 - DNA, 25 bp, Mus musculus
cctgttcaaagcttttgcatgctta

SEQ ID NO: 357360 - DNA, 25 bp, Mus musculus
cctgttcacacaagatcctggttta

SEQ ID NO: 357361 - DNA, 25 bp, Mus musculus
cctgttcacacatgatcctggttta

SEQ ID NO: 357362 - DNA, 25 bp, Mus musculus
cctgttcacatgcactatttcctat

SEQ ID NO: 357363 - DNA, 25 bp, Mus musculus
cctgttcacatggactatttcctat

SEQ ID NO: 357364 - DNA, 25 bp, Mus musculus
cctgttcaccagcactaaatgcact

SEQ ID NO: 357365 - DNA, 25 bp, Mus musculus
cctgttcaccaggactaaatgcact

SEQ ID NO: 357366 - DNA, 25 bp, Mus musculus
cctgttcactggctgagggcagact

SEQ ID NO: 357367 - DNA, 25 bp, Mus musculus
cctgttcactgggtgagggcagact

SEQ ID NO: 357368 - DNA, 25 bp, Mus musculus
cctgttcagagtcgccttgagctgt

SEQ ID NO: 357369 - DNA, 25 bp, Mus musculus
cctgttcagagtggccttgagctgt

SEQ ID NO: 357370 - DNA, 25 bp, Mus musculus
cctgttcatcccaccacaaaagtta

SEQ ID NO: 357371 - DNA, 25 bp, Mus musculus
cctgttcatccctccacaaaagtta

SEQ ID NO: 357372 - DNA, 25 bp, Mus musculus
cctgttcatgtgacacaaacttaag

SEQ ID NO: 357373 - DNA, 25 bp, Mus musculus
cctgttcatgtgtcacaaacttaag

SEQ ID NO: 357374 - DNA, 25 bp, Mus musculus
cctgttccaaaaaggctccagatga

SEQ ID NO: 357375 - DNA, 25 bp, Mus musculus
cctgttccaaaatggctccagatga

SEQ ID NO: 357376 - DNA, 25 bp, Mus musculus
cctgttccagccaaaccatgaatga

SEQ ID NO: 357377 - DNA, 25 bp, Mus musculus
cctgttccagcctaaccatgaatga

SEQ ID NO: 357378 - DNA, 25 bp, Mus musculus
cctgttccagtaactcagcatttga

SEQ ID NO: 357379 - DNA, 25 bp, Mus musculus
cctgttccagtatctcagcatttga

SEQ ID NO: 357380 - DNA, 25 bp, Mus musculus
cctgttcccaagagatagctctaca

SEQ ID NO: 357381 - DNA, 25 bp, Mus musculus
cctgttcccaagtgatagctctaca

SEQ ID NO: 357382 - DNA, 25 bp, Mus musculus
cctgttcctcaaataccaaagccga

SEQ ID NO: 357383 - DNA, 25 bp, Mus musculus
cctgttcctcaattaccaaagccga

SEQ ID NO: 357384 - DNA, 25 bp, Mus musculus
cctgttcctgtcaaaacatttaaca

SEQ ID NO: 357385 - DNA, 25 bp, Mus musculus
cctgttcctgtctaaacatttaaca

SEQ ID NO: 357386 - DNA, 25 bp, Mus musculus
cctgttccttaccattcaaactagg

SEQ ID NO: 357387 - DNA, 25 bp, Mus musculus
cctgttccttacgattcaaactagg

SEQ ID NO: 357388 - DNA, 25 bp, Mus musculus
cctgttctcaaaaccctggattcaa

SEQ ID NO: 357389 - DNA, 25 bp, Mus musculus
cctgttctcaaatccctggattcaa

SEQ ID NO: 357390 - DNA, 25 bp, Mus musculus
cctgttctcagcctcattgaataaa

SEQ ID NO: 357391 - DNA, 25 bp, Mus musculus
cctgttctcagcgtcattgaataaa

SEQ ID NO: 357392 - DNA, 25 bp, Mus musculus
cctgttctcaggctctccagaagag

SEQ ID NO: 357393 - DNA, 25 bp, Mus musculus
cctgttctcagggtctccagaagag

SEQ ID NO: 357394 - DNA, 25 bp, Mus musculus
cctgttctctgcatttagaagtata

SEQ ID NO: 357395 - DNA, 25 bp, Mus musculus
cctgttctctgcttttagaagtata

SEQ ID NO: 357396 - DNA, 25 bp, Mus musculus
cctgttctggacacttcctataaat

SEQ ID NO: 357397 - DNA, 25 bp, Mus musculus
cctgttctggactcttcctataaat

SEQ ID NO: 357398 - DNA, 25 bp, Mus musculus
cctgttctggctaatctgtttttca

SEQ ID NO: 357399 - DNA, 25 bp, Mus musculus
cctgttctggctcccgtgttagcga

SEQ ID NO: 357400 - DNA, 25 bp, Mus musculus
cctgttctggctgccgtgttagcga

SEQ ID NO: 357401 - DNA, 25 bp, Mus musculus
cctgttctggcttatctgtttttca

SEQ ID NO: 357402 - DNA, 25 bp, Mus musculus
cctgttctgtttctggttgtttcac

SEQ ID NO: 357403 - DNA, 25 bp, Mus musculus
cctgttctgtttgtggttgtttcac

SEQ ID NO: 357404 - DNA, 25 bp, Mus musculus
cctgttcttacacatcatcctagat

SEQ ID NO: 357405 - DNA, 25 bp, Mus musculus
cctgttcttacagatcatcctagat

SEQ ID NO: 357406 - DNA, 25 bp, Mus musculus
cctgttcttaggactggtgatctgt

SEQ ID NO: 357407 - DNA, 25 bp, Mus musculus
cctgttcttaggtctggtgatctgt

SEQ ID NO: 357408 - DNA, 25 bp, Mus musculus
cctgttcttcccatagggactgtta

SEQ ID NO: 357409 - DNA, 25 bp, Mus musculus
cctgttcttcccttagggactgtta

SEQ ID NO: 357410 - DNA, 25 bp, Mus musculus
cctgttctttgtccacaagtgtatc

SEQ ID NO: 357411 - DNA, 25 bp, Mus musculus
cctgttctttgtgcacaagtgtatc

SEQ ID NO: 357412 - DNA, 25 bp, Mus musculus
cctgttgaaggcatgggagcgtcca

SEQ ID NO: 357413 - DNA, 25 bp, Mus musculus
cctgttgaaggcttgggagcgtcca

SEQ ID NO: 357414 - DNA, 25 bp, Mus musculus
cctgttgaagtcagttgaaggcaag

SEQ ID NO: 357415 - DNA, 25 bp, Mus musculus
cctgttgaagtctgttgaaggcaag

SEQ ID NO: 357416 - DNA, 25 bp, Mus musculus
cctgttgagacactgatggcacccc

SEQ ID NO: 357417 - DNA, 25 bp, Mus musculus
cctgttgagacagtgatggcacccc

SEQ ID NO: 357418 - DNA, 25 bp, Mus musculus
cctgttgagatcaacagctttctga

SEQ ID NO: 357419 - DNA, 25 bp, Mus musculus
cctgttgagatctacagctttctga

SEQ ID NO: 357420 - DNA, 25 bp, Mus musculus
cctgttgagggtatctctttggcta

SEQ ID NO: 357421 - DNA, 25 bp, Mus musculus
cctgttgagggtttctctttggcta

SEQ ID NO: 357422 - DNA, 25 bp, Mus musculus
cctgttgattggacctcaggtacag

SEQ ID NO: 357423 - DNA, 25 bp, Mus musculus
cctgttgattggtcctcaggtacag

SEQ ID NO: 357424 - DNA, 25 bp, Mus musculus
cctgttgcaggtcatgtgggccatc

SEQ ID NO: 357425 - DNA, 25 bp, Mus musculus
cctgttgcaggtgatgtgggccatc

SEQ ID NO: 357426 - DNA, 25 bp, Mus musculus
cctgttgcagttcgtatcatctgag

SEQ ID NO: 357427 - DNA, 25 bp, Mus musculus
cctgttgcagttggtatcatctgag

SEQ ID NO: 357428 - DNA, 25 bp, Mus musculus
cctgttgccactcgatggctttaga

SEQ ID NO: 357429 - DNA, 25 bp, Mus musculus
cctgttgccactggatggctttaga

SEQ ID NO: 357430 - DNA, 25 bp, Mus musculus
cctgttgccagtacttatttagaaa

SEQ ID NO: 357431 - DNA, 25 bp, Mus musculus
cctgttgccagttcttatttagaaa

SEQ ID NO: 357432 - DNA, 25 bp, Mus musculus
cctgttgcctcacgtgtatatcaac

SEQ ID NO: 357433 - DNA, 25 bp, Mus musculus
cctgttgcctcaggtgtatatcaac

SEQ ID NO: 357434 - DNA, 25 bp, Mus musculus
cctgttgcctgactacacaatgcac

SEQ ID NO: 357435 - DNA, 25 bp, Mus musculus
cctgttgcctgagtacacaatgcac

SEQ ID NO: 357436 - DNA, 25 bp, Mus musculus
cctgttgcctgtcctgaacaagaat

SEQ ID NO: 357437 - DNA, 25 bp, Mus musculus
cctgttgcctgtgctgaacaagaat

SEQ ID NO: 357438 - DNA, 25 bp, Mus musculus
cctgttgctacaacattctgttaag

SEQ ID NO: 357439 - DNA, 25 bp, Mus musculus
cctgttgctacatcattctgttaag

SEQ ID NO: 357440 - DNA, 25 bp, Mus musculus
cctgttgctaggatgtgaccactga

SEQ ID NO: 357441 - DNA, 25 bp, Mus musculus
cctgttgctaggttgtgaccactga

SEQ ID NO: 357442 - DNA, 25 bp, Mus musculus
cctgttgctatcagatgtgttccca

SEQ ID NO: 357443 - DNA, 25 bp, Mus musculus
cctgttgctatctgatgtgttccca

SEQ ID NO: 357444 - DNA, 25 bp, Mus musculus
cctgttgctgtccttctttaaatga

SEQ ID NO: 357445 - DNA, 25 bp, Mus musculus
cctgttgctgtcgttctttaaatga

SEQ ID NO: 357446 - DNA, 25 bp, Mus musculus
cctgttggcctcagattttagagag

SEQ ID NO: 357447 - DNA, 25 bp, Mus musculus
cctgttggcctctgattttagagag

SEQ ID NO: 357448 - DNA, 25 bp, Mus musculus
cctgttggcttaagtaataaatact

SEQ ID NO: 357449 - DNA, 25 bp, Mus musculus
cctgttggcttatgtaataaatact

SEQ ID NO: 357450 - DNA, 25 bp, Mus musculus
cctgttgggccaaagtgtaagtcat

SEQ ID NO: 357451 - DNA, 25 bp, Mus musculus
cctgttgggccatagtgtaagtcat

SEQ ID NO: 357452 - DNA, 25 bp, Mus musculus
cctgttggtcacaggattcctactg

SEQ ID NO: 357453 - DNA, 25 bp, Mus musculus
cctgttggtcactggattcctactg

SEQ ID NO: 357454 - DNA, 25 bp, Mus musculus
cctgttggtggaatactgggcctat

SEQ ID NO: 357455 - DNA, 25 bp, Mus musculus
cctgttggtggattactgggcctat

SEQ ID NO: 357456 - DNA, 25 bp, Mus musculus
cctgttggttccagtttcactggct

SEQ ID NO: 357457 - DNA, 25 bp, Mus musculus
cctgttggttcctgtttcactggct

SEQ ID NO: 357458 - DNA, 25 bp, Mus musculus
cctgttggttgtaccccgacagaga

SEQ ID NO: 357459 - DNA, 25 bp, Mus musculus
cctgttggttgttccccgacagaga

SEQ ID NO: 357460 - DNA, 25 bp, Mus musculus
cctgttgtaccacatcttgggccat

SEQ ID NO: 357461 - DNA, 25 bp, Mus musculus
cctgttgtaccagatcttgggccat

SEQ ID NO: 357462 - DNA, 25 bp, Mus musculus
cctgttgtacttagattcagagatg

SEQ ID NO: 357463 - DNA, 25 bp, Mus musculus
cctgttgtactttgattcagagatg

SEQ ID NO: 357464 - DNA, 25 bp, Mus musculus
cctgttgtagcaattggacggccat

SEQ ID NO: 357465 - DNA, 25 bp, Mus musculus
cctgttgtagcatttggacggccat

SEQ ID NO: 357466 - DNA, 25 bp, Mus musculus
cctgttgtaggtatcgcataaagta

SEQ ID NO: 357467 - DNA, 25 bp, Mus musculus
cctgttgtaggtttcgcataaagta

SEQ ID NO: 357468 - DNA, 25 bp, Mus musculus
cctgttgtagtcacatggtgtttct

SEQ ID NO: 357469 - DNA, 25 bp, Mus musculus
cctgttgtagtctcatggtgtttct

SEQ ID NO: 357470 - DNA, 25 bp, Mus musculus
cctgttgtgacaattgatggagttc

SEQ ID NO: 357471 - DNA, 25 bp, Mus musculus
cctgttgtgacatttgatggagttc

SEQ ID NO: 357472 - DNA, 25 bp, Mus musculus
cctgttgtgagcctccagtttgatg

SEQ ID NO: 357473 - DNA, 25 bp, Mus musculus
cctgttgtgagcgtccagtttgatg

SEQ ID NO: 357474 - DNA, 25 bp, Mus musculus
cctgttgtgagtactgtgtatgtaa

SEQ ID NO: 357475 - DNA, 25 bp, Mus musculus
cctgttgtgagttctgtgtatgtaa

SEQ ID NO: 357476 - DNA, 25 bp, Mus musculus
cctgttgttattctactctgagaat

SEQ ID NO: 357477 - DNA, 25 bp, Mus musculus
cctgttgttattgtactctgagaat

SEQ ID NO: 357478 - DNA, 25 bp, Mus musculus
cctgtttaaaggagatcactagtga

SEQ ID NO: 357479 - DNA, 25 bp, Mus musculus
cctgtttaaaggtgatcactagtga

SEQ ID NO: 357480 - DNA, 25 bp, Mus musculus
cctgtttaacagagaccttcattca

SEQ ID NO: 357481 - DNA, 25 bp, Mus musculus
cctgtttaacagtgaccttcattca

SEQ ID NO: 357482 - DNA, 25 bp, Mus musculus
cctgtttaacctctactgccagaaa

SEQ ID NO: 357483 - DNA, 25 bp, Mus musculus
cctgtttaacctgtactgccagaaa

SEQ ID NO: 357484 - DNA, 25 bp, Mus musculus
cctgtttaggccaaccacgtaagat

SEQ ID NO: 357485 - DNA, 25 bp, Mus musculus
cctgtttaggcctaccacgtaagat

SEQ ID NO: 357486 - DNA, 25 bp, Mus musculus
cctgtttattccaagggtgacacct

SEQ ID NO: 357487 - DNA, 25 bp, Mus musculus
cctgtttattcctagggtgacacct

SEQ ID NO: 357488 - DNA, 25 bp, Mus musculus
cctgtttcaaacaaagtagatggca

SEQ ID NO: 357489 - DNA, 25 bp, Mus musculus
cctgtttcaaactaagtagatggca

SEQ ID NO: 357490 - DNA, 25 bp, Mus musculus
cctgtttcaggactgatgttcatga

SEQ ID NO: 357491 - DNA, 25 bp, Mus musculus
cctgtttcaggagtgatgttcatga

SEQ ID NO: 357492 - DNA, 25 bp, Mus musculus
cctgtttccagacatgtgctatgaa

SEQ ID NO: 357493 - DNA, 25 bp, Mus musculus
cctgtttccagagatgtgctatgaa

SEQ ID NO: 357494 - DNA, 25 bp, Mus musculus
cctgtttccggaatagtgttcacaa

SEQ ID NO: 357495 - DNA, 25 bp, Mus musculus
cctgtttccggattagtgttcacaa

SEQ ID NO: 357496 - DNA, 25 bp, Mus musculus
cctgtttcctgtagtggtagaaaat

SEQ ID NO: 357497 - DNA, 25 bp, Mus musculus
cctgtttcctgttgtggtagaaaat

SEQ ID NO: 357498 - DNA, 25 bp, Mus musculus
cctgtttctctgagtaggtatctga

SEQ ID NO: 357499 - DNA, 25 bp, Mus musculus
cctgtttctctgtgtaggtatctga

SEQ ID NO: 357500 - DNA, 25 bp, Mus musculus
cctgtttcttggctgaagatgacaa

SEQ ID NO: 357501 - DNA, 25 bp, Mus musculus
cctgtttcttgggtgaagatgacaa

SEQ ID NO: 357502 - DNA, 25 bp, Mus musculus
cctgtttgaactagtttgtctgttg

SEQ ID NO: 357503 - DNA, 25 bp, Mus musculus
cctgtttgaacttgtttgtctgttg

SEQ ID NO: 357504 - DNA, 25 bp, Mus musculus
cctgtttgaatccatttcgtttatt

SEQ ID NO: 357505 - DNA, 25 bp, Mus musculus
cctgtttgaatcgatttcgtttatt

SEQ ID NO: 357506 - DNA, 25 bp, Mus musculus
cctgtttgacttaatggactgacat

SEQ ID NO: 357507 - DNA, 25 bp, Mus musculus
cctgtttgactttatggactgacat

SEQ ID NO: 357508 - DNA, 25 bp, Mus musculus
cctgtttgcaagagtgtgagcgaaa

SEQ ID NO: 357509 - DNA, 25 bp, Mus musculus
cctgtttgcaagtgtgtgagcgaaa

SEQ ID NO: 357510 - DNA, 25 bp, Mus musculus
cctgtttgcagcaaaagtttaatca

SEQ ID NO: 357511 - DNA, 25 bp, Mus musculus
cctgtttgcagctaaagtttaatca

SEQ ID NO: 357512 - DNA, 25 bp, Mus musculus
cctgtttgcaggataaagctggtta

SEQ ID NO: 357513 - DNA, 25 bp, Mus musculus
cctgtttgcaggttaaagctggtta

SEQ ID NO: 357514 - DNA, 25 bp, Mus musculus
cctgtttgcatcaccacgagccata

SEQ ID NO: 357515 - DNA, 25 bp, Mus musculus
cctgtttgcatctccacgagccata

SEQ ID NO: 357516 - DNA, 25 bp, Mus musculus
cctgtttgctgacagctctagctat

SEQ ID NO: 357517 - DNA, 25 bp, Mus musculus
cctgtttgctgagagctctagctat

SEQ ID NO: 357518 - DNA, 25 bp, Mus musculus
cctgtttggctcatcagtgcagaaa

SEQ ID NO: 357519 - DNA, 25 bp, Mus musculus
cctgtttggctcttcagtgcagaaa

SEQ ID NO: 357520 - DNA, 25 bp, Mus musculus
cctgtttgtacacatgtgacctgtt

SEQ ID NO: 357521 - DNA, 25 bp, Mus musculus
cctgtttgtacagatgtgacctgtt

SEQ ID NO: 357522 - DNA, 25 bp, Mus musculus
cctgtttgtgtgactcttggtataa

SEQ ID NO: 357523 - DNA, 25 bp, Mus musculus
cctgtttgtgtgtctcttggtataa

SEQ ID NO: 357524 - DNA, 25 bp, Mus musculus
cctgttttaagtcagcatccacact

SEQ ID NO: 357525 - DNA, 25 bp, Mus musculus
cctgttttaagtgagcatccacact

SEQ ID NO: 357526 - DNA, 25 bp, Mus musculus
cctgttttacttctcacctttcaat

SEQ ID NO: 357527 - DNA, 25 bp, Mus musculus
cctgttttacttgtcacctttcaat

SEQ ID NO: 357528 - DNA, 25 bp, Mus musculus
cctgttttcaatacctttcctcgtg

SEQ ID NO: 357529 - DNA, 25 bp, Mus musculus
cctgttttcaattcctttcctcgtg

SEQ ID NO: 357530 - DNA, 25 bp, Mus musculus
cctgttttcaggcttgctggaggac

SEQ ID NO: 357531 - DNA, 25 bp, Mus musculus
cctgttttcagggttgctggaggac

SEQ ID NO: 357532 - DNA, 25 bp, Mus musculus
cctgttttcctgatttctctgaagg

SEQ ID NO: 357533 - DNA, 25 bp, Mus musculus
cctgttttcctgttttctctgaagg

SEQ ID NO: 357534 - DNA, 25 bp, Mus musculus
cctgttttcttacgtaatgtgtgta

SEQ ID NO: 357535 - DNA, 25 bp, Mus musculus
cctgttttcttaggtaatgtgtgta

SEQ ID NO: 357536 - DNA, 25 bp, Mus musculus
cctgttttgctcagaaaatcgccca

SEQ ID NO: 357537 - DNA, 25 bp, Mus musculus
cctgttttgctctgaaaatcgccca

SEQ ID NO: 357538 - DNA, 25 bp, Mus musculus
cctgttttgtcactaagcatccatc

SEQ ID NO: 357539 - DNA, 25 bp, Mus musculus
cctgttttgtcagtaagcatccatc

SEQ ID NO: 357540 - DNA, 25 bp, Mus musculus
cctgtttttggacgttgtgccatta

SEQ ID NO: 357541 - DNA, 25 bp, Mus musculus
cctgtttttggaggttgtgccatta

SEQ ID NO: 357542 - DNA, 25 bp, Mus musculus
cctgtttttggcagcagtgacatct

SEQ ID NO: 357543 - DNA, 25 bp, Mus musculus
cctgtttttggctgcagtgacatct

SEQ ID NO: 357544 - DNA, 25 bp, Mus musculus
cctgtttttgttactcgtcaagcat

SEQ ID NO: 357545 - DNA, 25 bp, Mus musculus
cctgtttttgtttctcgtcaagcat

SEQ ID NO: 357546 - DNA, 25 bp, Mus musculus
ccttaaaagtatacagtggcctgtg

SEQ ID NO: 357547 - DNA, 25 bp, Mus musculus
ccttaaaagtattcagtggcctgtg

SEQ ID NO: 357548 - DNA, 25 bp, Mus musculus
ccttaaactctcctcttatttgtag

SEQ ID NO: 357549 - DNA, 25 bp, Mus musculus
ccttaaactctcgtcttatttgtag

SEQ ID NO: 357550 - DNA, 25 bp, Mus musculus
ccttaaactggcacctgtcaaagat

SEQ ID NO: 357551 - DNA, 25 bp, Mus musculus
ccttaaactggctcctgtcaaagat

SEQ ID NO: 357552 - DNA, 25 bp, Mus musculus
ccttaaagaatcactctgggctgga

SEQ ID NO: 357553 - DNA, 25 bp, Mus musculus
ccttaaagaatctctctgggctgga

SEQ ID NO: 357554 - DNA, 25 bp, Mus musculus
ccttaaatgtggctggatggtcttg

SEQ ID NO: 357555 - DNA, 25 bp, Mus musculus
ccttaaatgtgggtggatggtcttg

SEQ ID NO: 357556 - DNA, 25 bp, Mus musculus
ccttaaccagtaccttggaagacca

SEQ ID NO: 357557 - DNA, 25 bp, Mus musculus
ccttaaccagtagcttggaagacca

SEQ ID NO: 357558 - DNA, 25 bp, Mus musculus
ccttaacccttgatggacacggact

SEQ ID NO: 357559 - DNA, 25 bp, Mus musculus
ccttaacccttgttggacacggact

SEQ ID NO: 357560 - DNA, 25 bp, Mus musculus
ccttaacggcagagtgtcagttaaa

SEQ ID NO: 357561 - DNA, 25 bp, Mus musculus
ccttaacggcagtgtgtcagttaaa

SEQ ID NO: 357562 - DNA, 25 bp, Mus musculus
ccttaactctatcgacctcatttca

SEQ ID NO: 357563 - DNA, 25 bp, Mus musculus
ccttaactctatggacctcatttca

SEQ ID NO: 357564 - DNA, 25 bp, Mus musculus
ccttaactgtggcaaaaataatgac

SEQ ID NO: 357565 - DNA, 25 bp, Mus musculus
ccttaactgtgggaaaaataatgac

SEQ ID NO: 357566 - DNA, 25 bp, Mus musculus
ccttaactgtgtatgtttgccttga

SEQ ID NO: 357567 - DNA, 25 bp, Mus musculus
ccttaactgtgtttgtttgccttga

SEQ ID NO: 357568 - DNA, 25 bp, Mus musculus
ccttaagaaaggctacctgaccctg

SEQ ID NO: 357569 - DNA, 25 bp, Mus musculus
ccttaagaaagggtacctgaccctg

SEQ ID NO: 357570 - DNA, 25 bp, Mus musculus
ccttaagaggtaagtcacttcctgt

SEQ ID NO: 357571 - DNA, 25 bp, Mus musculus
ccttaagaggtatgtcacttcctgt

SEQ ID NO: 357572 - DNA, 25 bp, Mus musculus
ccttaagctgtcattcaatgagaat

SEQ ID NO: 357573 - DNA, 25 bp, Mus musculus
ccttaagctgtctttcaatgagaat

SEQ ID NO: 357574 - DNA, 25 bp, Mus musculus
ccttaaggccttcgtcaaactgaag

SEQ ID NO: 357575 - DNA, 25 bp, Mus musculus
ccttaaggccttggtcaaactgaag

SEQ ID NO: 357576 - DNA, 25 bp, Mus musculus
ccttaagggaaactcagtgccccat

SEQ ID NO: 357577 - DNA, 25 bp, Mus musculus
ccttaagggaaagtcagtgccccat

SEQ ID NO: 357578 - DNA, 25 bp, Mus musculus
ccttaagtgtgcagtgagtttactt

SEQ ID NO: 357579 - DNA, 25 bp, Mus musculus
ccttaagtgtgctgtgagtttactt

SEQ ID NO: 357580 - DNA, 25 bp, Mus musculus
ccttaagttagaaactgggaccatt

SEQ ID NO: 357581 - DNA, 25 bp, Mus musculus
ccttaagttagatactgggaccatt

SEQ ID NO: 357582 - DNA, 25 bp, Mus musculus
ccttaattgcagatgtttgctccat

SEQ ID NO: 357583 - DNA, 25 bp, Mus musculus
ccttaattgcagttgtttgctccat

SEQ ID NO: 357584 - DNA, 25 bp, Mus musculus
ccttaatttggaaactggccacttg

SEQ ID NO: 357585 - DNA, 25 bp, Mus musculus
ccttaatttggatactggccacttg

SEQ ID NO: 357586 - DNA, 25 bp, Mus musculus
ccttacaagtaacgagggctggctg

SEQ ID NO: 357587 - DNA, 25 bp, Mus musculus
ccttacaagtaaggagggctggctg

SEQ ID NO: 357588 - DNA, 25 bp, Mus musculus
ccttacaccatgacaaacaccttag

SEQ ID NO: 357589 - DNA, 25 bp, Mus musculus
ccttacaccatgtcaaacaccttag

SEQ ID NO: 357590 - DNA, 25 bp, Mus musculus
ccttacagatgccaaatcttgggaa

SEQ ID NO: 357591 - DNA, 25 bp, Mus musculus
ccttacagatgcgaaatcttgggaa

SEQ ID NO: 357592 - DNA, 25 bp, Mus musculus
ccttacagctggctacgctttgagt

SEQ ID NO: 357593 - DNA, 25 bp, Mus musculus
ccttacagctgggtacgctttgagt

SEQ ID NO: 357594 - DNA, 25 bp, Mus musculus
ccttacatgtatacggtttctctcc

SEQ ID NO: 357595 - DNA, 25 bp, Mus musculus
ccttacatgtattcggtttctctcc

SEQ ID NO: 357596 - DNA, 25 bp, Mus musculus
ccttacattgccatatgctttgttt

SEQ ID NO: 357597 - DNA, 25 bp, Mus musculus
ccttacattgccttatgctttgttt

SEQ ID NO: 357598 - DNA, 25 bp, Mus musculus
ccttacatttggacacagcatacat

SEQ ID NO: 357599 - DNA, 25 bp, Mus musculus
ccttacatttggtcacagcatacat

SEQ ID NO: 357600 - DNA, 25 bp, Mus musculus
ccttaccaacaaccctatcaatatt

SEQ ID NO: 357601 - DNA, 25 bp, Mus musculus
ccttaccaacaagcctatcaatatt

SEQ ID NO: 357602 - DNA, 25 bp, Mus musculus
ccttaccaatcgctcacttaaagca

SEQ ID NO: 357603 - DNA, 25 bp, Mus musculus
ccttaccaatcggtcacttaaagca

SEQ ID NO: 357604 - DNA, 25 bp, Mus musculus
ccttaccatctaccatataaagaga

SEQ ID NO: 357605 - DNA, 25 bp, Mus musculus
ccttaccatctagcatataaagaga

SEQ ID NO: 357606 - DNA, 25 bp, Mus musculus
ccttacccaattacttgccatttat

SEQ ID NO: 357607 - DNA, 25 bp, Mus musculus
ccttacccaatttcttgccatttat

SEQ ID NO: 357608 - DNA, 25 bp, Mus musculus
ccttacccactcaactttatgttct

SEQ ID NO: 357609 - DNA, 25 bp, Mus musculus
ccttacccactctactttatgttct

SEQ ID NO: 357610 - DNA, 25 bp, Mus musculus
ccttacccagggaatcatagttcta

SEQ ID NO: 357611 - DNA, 25 bp, Mus musculus
ccttacccagggtatcatagttcta

SEQ ID NO: 357612 - DNA, 25 bp, Mus musculus
ccttaccctggtcctgagtgaaaca

SEQ ID NO: 357613 - DNA, 25 bp, Mus musculus
ccttaccctggtgctgagtgaaaca

SEQ ID NO: 357614 - DNA, 25 bp, Mus musculus
ccttacctaggtccagaatggaaca

SEQ ID NO: 357615 - DNA, 25 bp, Mus musculus
ccttacctaggtgcagaatggaaca

SEQ ID NO: 357616 - DNA, 25 bp, Mus musculus
ccttacctcctgagggctacaatga

SEQ ID NO: 357617 - DNA, 25 bp, Mus musculus
ccttacctcctgtgggctacaatga

SEQ ID NO: 357618 - DNA, 25 bp, Mus musculus
ccttacctcggtcgacttgtatata

SEQ ID NO: 357619 - DNA, 25 bp, Mus musculus
ccttacctcggtggacttgtatata

SEQ ID NO: 357620 - DNA, 25 bp, Mus musculus
ccttacctgctgcttaaccaaagag

SEQ ID NO: 357621 - DNA, 25 bp, Mus musculus
ccttacctgctggttaaccaaagag

SEQ ID NO: 357622 - DNA, 25 bp, Mus musculus
ccttacctgtctccatgaaatgtct

SEQ ID NO: 357623 - DNA, 25 bp, Mus musculus
ccttacctgtctgcatgaaatgtct

SEQ ID NO: 357624 - DNA, 25 bp, Mus musculus
ccttaccttctacaactttgctgac

SEQ ID NO: 357625 - DNA, 25 bp, Mus musculus
ccttaccttctagaactttgctgac

SEQ ID NO: 357626 - DNA, 25 bp, Mus musculus
ccttacgaacgacggcatccagtat

SEQ ID NO: 357627 - DNA, 25 bp, Mus musculus
ccttacgaacgagggcatccagtat

SEQ ID NO: 357628 - DNA, 25 bp, Mus musculus
ccttacgctgccaggatatttgtgt

SEQ ID NO: 357629 - DNA, 25 bp, Mus musculus
ccttacgctgcctggatatttgtgt

SEQ ID NO: 357630 - DNA, 25 bp, Mus musculus
ccttactaaatgatacagccccctg

SEQ ID NO: 357631 - DNA, 25 bp, Mus musculus
ccttactaaatgttacagccccctg

SEQ ID NO: 357632 - DNA, 25 bp, Mus musculus
ccttactcaggcaaattgtgcactg

SEQ ID NO: 357633 - DNA, 25 bp, Mus musculus
ccttactcaggctaattgtgcactg

SEQ ID NO: 357634 - DNA, 25 bp, Mus musculus
ccttactcttgcatccaggaaaact

SEQ ID NO: 357635 - DNA, 25 bp, Mus musculus
ccttactcttgcttccaggaaaact

SEQ ID NO: 357636 - DNA, 25 bp, Mus musculus
ccttactgagtcattgggcagggtg

SEQ ID NO: 357637 - DNA, 25 bp, Mus musculus
ccttactgagtctttgggcagggtg

SEQ ID NO: 357638 - DNA, 25 bp, Mus musculus
ccttactgcagacccttctgtttgg

SEQ ID NO: 357639 - DNA, 25 bp, Mus musculus
ccttactgcagagccttctgtttgg

SEQ ID NO: 357640 - DNA, 25 bp, Mus musculus
ccttactggaaacacccaaataatg

SEQ ID NO: 357641 - DNA, 25 bp, Mus musculus
ccttactggaaagacccaaataatg

SEQ ID NO: 357642 - DNA, 25 bp, Mus musculus
ccttacttaattacagcctttctct

SEQ ID NO: 357643 - DNA, 25 bp, Mus musculus
ccttacttaatttcagcctttctct

SEQ ID NO: 357644 - DNA, 25 bp, Mus musculus
ccttacttcagtcttggtttggcta

SEQ ID NO: 357645 - DNA, 25 bp, Mus musculus
ccttacttcagtgttggtttggcta

SEQ ID NO: 357646 - DNA, 25 bp, Mus musculus
ccttactttaccatcatcctgtgtt

SEQ ID NO: 357647 - DNA, 25 bp, Mus musculus
ccttactttaccttcatcctgtgtt

SEQ ID NO: 357648 - DNA, 25 bp, Mus musculus
ccttactttaggctggttatcatgc

SEQ ID NO: 357649 - DNA, 25 bp, Mus musculus
ccttactttagggtggttatcatgc

SEQ ID NO: 357650 - DNA, 25 bp, Mus musculus
ccttactttgtaacctggctgataa

SEQ ID NO: 357651 - DNA, 25 bp, Mus musculus
ccttactttgtatcctggctgataa

SEQ ID NO: 357652 - DNA, 25 bp, Mus musculus
ccttagacacttagcctggcggtaa

SEQ ID NO: 357653 - DNA, 25 bp, Mus musculus
ccttagacactttgcctggcggtaa

SEQ ID NO: 357654 - DNA, 25 bp, Mus musculus
ccttagactcttcactgtagagagt

SEQ ID NO: 357655 - DNA, 25 bp, Mus musculus
ccttagactcttgactgtagagagt

SEQ ID NO: 357656 - DNA, 25 bp, Mus musculus
ccttagagatacaaccctgggcttt

SEQ ID NO: 357657 - DNA, 25 bp, Mus musculus
ccttagagatactaccctgggcttt

SEQ ID NO: 357658 - DNA, 25 bp, Mus musculus
ccttagagtagactgggctttagaa

SEQ ID NO: 357659 - DNA, 25 bp, Mus musculus
ccttagagtagagtgggctttagaa

SEQ ID NO: 357660 - DNA, 25 bp, Mus musculus
ccttagatctctctcttagggctct

SEQ ID NO: 357661 - DNA, 25 bp, Mus musculus
ccttagatctctgtcttagggctct

SEQ ID NO: 357662 - DNA, 25 bp, Mus musculus
ccttagcaaccccaacgtggaagtg

SEQ ID NO: 357663 - DNA, 25 bp, Mus musculus
ccttagcaacccgaacgtggaagtg

SEQ ID NO: 357664 - DNA, 25 bp, Mus musculus
ccttagcaatctacaagcagaaatg

SEQ ID NO: 357665 - DNA, 25 bp, Mus musculus
ccttagcaatcttcaagcagaaatg

SEQ ID NO: 357666 - DNA, 25 bp, Mus musculus
ccttagccaggtagtattgtcattc

SEQ ID NO: 357667 - DNA, 25 bp, Mus musculus
ccttagccaggttgtattgtcattc

SEQ ID NO: 357668 - DNA, 25 bp, Mus musculus
ccttagccagtcaggtaacataata

SEQ ID NO: 357669 - DNA, 25 bp, Mus musculus
ccttagccagtctggtaacataata

SEQ ID NO: 357670 - DNA, 25 bp, Mus musculus
ccttagccgtgccttgtcaggaaaa

SEQ ID NO: 357671 - DNA, 25 bp, Mus musculus
ccttagccgtgcgttgtcaggaaaa

SEQ ID NO: 357672 - DNA, 25 bp, Mus musculus
ccttagcctcgcagtagagacttct

SEQ ID NO: 357673 - DNA, 25 bp, Mus musculus
ccttagcctcgctgtagagacttct

SEQ ID NO: 357674 - DNA, 25 bp, Mus musculus
ccttagctactgcttccaaacattt

SEQ ID NO: 357675 - DNA, 25 bp, Mus musculus
ccttagctactggttccaaacattt

SEQ ID NO: 357676 - DNA, 25 bp, Mus musculus
ccttagctcgtccgacgctttagat

SEQ ID NO: 357677 - DNA, 25 bp, Mus musculus
ccttagctcgtcggacgctttagat

SEQ ID NO: 357678 - DNA, 25 bp, Mus musculus
ccttagcttactcaccttacttgaa

SEQ ID NO: 357679 - DNA, 25 bp, Mus musculus
ccttagcttactgaccttacttgaa

SEQ ID NO: 357680 - DNA, 25 bp, Mus musculus
ccttagcttcagagtccactgggat

SEQ ID NO: 357681 - DNA, 25 bp, Mus musculus
ccttagcttcagtgtccactgggat

SEQ ID NO: 357682 - DNA, 25 bp, Mus musculus
ccttaggaacctcctctgggacaga

SEQ ID NO: 357683 - DNA, 25 bp, Mus musculus
ccttaggaacctgctctgggacaga

SEQ ID NO: 357684 - DNA, 25 bp, Mus musculus
ccttaggactgtctttagcagcact

SEQ ID NO: 357685 - DNA, 25 bp, Mus musculus
ccttaggactgtgtttagcagcact

SEQ ID NO: 357686 - DNA, 25 bp, Mus musculus
ccttaggatttcactgcactttata

SEQ ID NO: 357687 - DNA, 25 bp, Mus musculus
ccttaggatttctctgcactttata

SEQ ID NO: 357688 - DNA, 25 bp, Mus musculus
ccttaggcaggacatatggtcccct

SEQ ID NO: 357689 - DNA, 25 bp, Mus musculus
ccttaggcaggagatatggtcccct

SEQ ID NO: 357690 - DNA, 25 bp, Mus musculus
ccttaggctcagactctgacactga

SEQ ID NO: 357691 - DNA, 25 bp, Mus musculus
ccttaggctcagtctctgacactga

SEQ ID NO: 357692 - DNA, 25 bp, Mus musculus
ccttaggctcctcccagagtcactg

SEQ ID NO: 357693 - DNA, 25 bp, Mus musculus
ccttaggctcctgccagagtcactg

SEQ ID NO: 357694 - DNA, 25 bp, Mus musculus
ccttagggaccaatgtcaggccctt

SEQ ID NO: 357695 - DNA, 25 bp, Mus musculus
ccttagggaccattgtcaggccctt

SEQ ID NO: 357696 - DNA, 25 bp, Mus musculus
ccttagggtcaaactccagcatttt

SEQ ID NO: 357697 - DNA, 25 bp, Mus musculus
ccttagggtcaatctccagcatttt

SEQ ID NO: 357698 - DNA, 25 bp, Mus musculus
ccttagggttggcatgtgttcacac

SEQ ID NO: 357699 - DNA, 25 bp, Mus musculus
ccttagggttgggatgtgttcacac

SEQ ID NO: 357700 - DNA, 25 bp, Mus musculus
ccttaggtctaaaaaattcactgtg

SEQ ID NO: 357701 - DNA, 25 bp, Mus musculus
ccttaggtctaataaattcactgtg

SEQ ID NO: 357702 - DNA, 25 bp, Mus musculus
ccttaggtctccataggatgatttt

SEQ ID NO: 357703 - DNA, 25 bp, Mus musculus
ccttaggtctccttaggatgatttt

SEQ ID NO: 357704 - DNA, 25 bp, Mus musculus
ccttagtaccctaagtggctgttgg

SEQ ID NO: 357705 - DNA, 25 bp, Mus musculus
ccttagtacccttagtggctgttgg

SEQ ID NO: 357706 - DNA, 25 bp, Mus musculus
ccttagtactgcacaaactggagat

SEQ ID NO: 357707 - DNA, 25 bp, Mus musculus
ccttagtactgctcaaactggagat

SEQ ID NO: 357708 - DNA, 25 bp, Mus musculus
ccttagtagaggaggcactggccca

SEQ ID NO: 357709 - DNA, 25 bp, Mus musculus
ccttagtagaggtggcactggccca

SEQ ID NO: 357710 - DNA, 25 bp, Mus musculus
ccttagtcaactacttggatctcct

SEQ ID NO: 357711 - DNA, 25 bp, Mus musculus
ccttagtcaacttcttggatctcct

SEQ ID NO: 357712 - DNA, 25 bp, Mus musculus
ccttagtcattcattctcttatcct

SEQ ID NO: 357713 - DNA, 25 bp, Mus musculus
ccttagtcattctttctcttatcct

SEQ ID NO: 357714 - DNA, 25 bp, Mus musculus
ccttagtcggatcttttgccagagt

SEQ ID NO: 357715 - DNA, 25 bp, Mus musculus
ccttagtcggatgttttgccagagt

SEQ ID NO: 357716 - DNA, 25 bp, Mus musculus
ccttagtcttgtcggagtccgtgaa

SEQ ID NO: 357717 - DNA, 25 bp, Mus musculus
ccttagtcttgtgggagtccgtgaa

SEQ ID NO: 357718 - DNA, 25 bp, Mus musculus
ccttagtctttcctgtctgaagcac

SEQ ID NO: 357719 - DNA, 25 bp, Mus musculus
ccttagtctttcgtgtctgaagcac

SEQ ID NO: 357720 - DNA, 25 bp, Mus musculus
ccttagtgggagatctttctgtatt

SEQ ID NO: 357721 - DNA, 25 bp, Mus musculus
ccttagtgggagttctttctgtatt

SEQ ID NO: 357722 - DNA, 25 bp, Mus musculus
ccttagtgtcagaatgttggtcttt

SEQ ID NO: 357723 - DNA, 25 bp, Mus musculus
ccttagtgtcagtatgttggtcttt

SEQ ID NO: 357724 - DNA, 25 bp, Mus musculus
ccttagtgttctcttaggcagaagt

SEQ ID NO: 357725 - DNA, 25 bp, Mus musculus
ccttagtgttctgttaggcagaagt

SEQ ID NO: 357726 - DNA, 25 bp, Mus musculus
ccttagtgttgtaatgtccctcttt

SEQ ID NO: 357727 - DNA, 25 bp, Mus musculus
ccttagtgttgttatgtccctcttt

SEQ ID NO: 357728 - DNA, 25 bp, Mus musculus
ccttagttaccaagcaagttcattc

SEQ ID NO: 357729 - DNA, 25 bp, Mus musculus
ccttagttaccatgcaagttcattc

SEQ ID NO: 357730 - DNA, 25 bp, Mus musculus
ccttagttcattcgccattggcttt

SEQ ID NO: 357731 - DNA, 25 bp, Mus musculus
ccttagttcattggccattggcttt

SEQ ID NO: 357732 - DNA, 25 bp, Mus musculus
ccttatatctctcaagttctatatt

SEQ ID NO: 357733 - DNA, 25 bp, Mus musculus
ccttatatctctgaagttctatatt

SEQ ID NO: 357734 - DNA, 25 bp, Mus musculus
ccttatatttccacagttatccggc

SEQ ID NO: 357735 - DNA, 25 bp, Mus musculus
ccttatatttcctcagttatccggc

SEQ ID NO: 357736 - DNA, 25 bp, Mus musculus
ccttatcagaggagagaccttttat

SEQ ID NO: 357737 - DNA, 25 bp, Mus musculus
ccttatcagaggtgagaccttttat

SEQ ID NO: 357738 - DNA, 25 bp, Mus musculus
ccttatccagatccttgtaaatgct

SEQ ID NO: 357739 - DNA, 25 bp, Mus musculus
ccttatccagatgcttgtaaatgct

SEQ ID NO: 357740 - DNA, 25 bp, Mus musculus
ccttatccagtactgtattcatggt

SEQ ID NO: 357741 - DNA, 25 bp, Mus musculus
ccttatccagtagtgtattcatggt

SEQ ID NO: 357742 - DNA, 25 bp, Mus musculus
ccttatcccaagactgttagccttg

SEQ ID NO: 357743 - DNA, 25 bp, Mus musculus
ccttatcccaagtctgttagccttg

SEQ ID NO: 357744 - DNA, 25 bp, Mus musculus
ccttatctcaacagaagactggtaa

SEQ ID NO: 357745 - DNA, 25 bp, Mus musculus
ccttatctcaactgaagactggtaa

SEQ ID NO: 357746 - DNA, 25 bp, Mus musculus
ccttatctcttcacaatgcacttta

SEQ ID NO: 357747 - DNA, 25 bp, Mus musculus
ccttatctcttctcaatgcacttta

SEQ ID NO: 357748 - DNA, 25 bp, Mus musculus
ccttatctgtggactactgtgattc

SEQ ID NO: 357749 - DNA, 25 bp, Mus musculus
ccttatctgtggtctactgtgattc

SEQ ID NO: 357750 - DNA, 25 bp, Mus musculus
ccttatgaagctctgatccaggaca

SEQ ID NO: 357751 - DNA, 25 bp, Mus musculus
ccttatgaagctgtgatccaggaca

SEQ ID NO: 357752 - DNA, 25 bp, Mus musculus
ccttatgagggcatgctgttacagt

SEQ ID NO: 357753 - DNA, 25 bp, Mus musculus
ccttatgagggcttgctgttacagt

SEQ ID NO: 357754 - DNA, 25 bp, Mus musculus
ccttatgcaaggatctacacaaatc

SEQ ID NO: 357755 - DNA, 25 bp, Mus musculus
ccttatgcaaggttctacacaaatc

SEQ ID NO: 357756 - DNA, 25 bp, Mus musculus
ccttatggagttctggcccagggct

SEQ ID NO: 357757 - DNA, 25 bp, Mus musculus
ccttatggagttgtggcccagggct

SEQ ID NO: 357758 - DNA, 25 bp, Mus musculus
ccttatggatagctgtgatcccaaa

SEQ ID NO: 357759 - DNA, 25 bp, Mus musculus
ccttatggataggtgtgatcccaaa

SEQ ID NO: 357760 - DNA, 25 bp, Mus musculus
ccttatggccaaaggtcagttggtg

SEQ ID NO: 357761 - DNA, 25 bp, Mus musculus
ccttatggccaatggtcagttggtg

SEQ ID NO: 357762 - DNA, 25 bp, Mus musculus
ccttatgtctcacgaaacacttttt

SEQ ID NO: 357763 - DNA, 25 bp, Mus musculus
ccttatgtctcaggaaacacttttt

SEQ ID NO: 357764 - DNA, 25 bp, Mus musculus
ccttatgtctctctgccacaaaaga

SEQ ID NO: 357765 - DNA, 25 bp, Mus musculus
ccttatgtctctgtgccacaaaaga

SEQ ID NO: 357766 - DNA, 25 bp, Mus musculus
ccttatgtctgtctgggcaatttgg

SEQ ID NO: 357767 - DNA, 25 bp, Mus musculus
ccttatgtctgtgtgggcaatttgg

SEQ ID NO: 357768 - DNA, 25 bp, Mus musculus
ccttatgtgccacaaacttcggttt

SEQ ID NO: 357769 - DNA, 25 bp, Mus musculus
ccttatgtgccagaaacttcggttt

SEQ ID NO: 357770 - DNA, 25 bp, Mus musculus
ccttatgtgcttcctggtgtttggt

SEQ ID NO: 357771 - DNA, 25 bp, Mus musculus
ccttatgtgcttgctggtgtttggt

SEQ ID NO: 357772 - DNA, 25 bp, Mus musculus
ccttatgtggtgattattgctgctc

SEQ ID NO: 357773 - DNA, 25 bp, Mus musculus
ccttatgtggtgtttattgctgctc

SEQ ID NO: 357774 - DNA, 25 bp, Mus musculus
ccttattcacagaggacacatgtaa

SEQ ID NO: 357775 - DNA, 25 bp, Mus musculus
ccttattcacagtggacacatgtaa

SEQ ID NO: 357776 - DNA, 25 bp, Mus musculus
ccttattcatcaaccttagttcgtc

SEQ ID NO: 357777 - DNA, 25 bp, Mus musculus
ccttattcatcatccttagttcgtc

SEQ ID NO: 357778 - DNA, 25 bp, Mus musculus
ccttattctgtaatgggaatggagg

SEQ ID NO: 357779 - DNA, 25 bp, Mus musculus
ccttattctgtattgggaatggagg

SEQ ID NO: 357780 - DNA, 25 bp, Mus musculus
ccttattcttaactcatgggccggt

SEQ ID NO: 357781 - DNA, 25 bp, Mus musculus
ccttattcttaagtcatgggccggt

SEQ ID NO: 357782 - DNA, 25 bp, Mus musculus
ccttattctttcattggcatggaac

SEQ ID NO: 357783 - DNA, 25 bp, Mus musculus
ccttattctttctttggcatggaac

SEQ ID NO: 357784 - DNA, 25 bp, Mus musculus
ccttattgatcaaatactttctctg

SEQ ID NO: 357785 - DNA, 25 bp, Mus musculus
ccttattgatcatatactttctctg

SEQ ID NO: 357786 - DNA, 25 bp, Mus musculus
ccttattgcagtcgattgatttgat

SEQ ID NO: 357787 - DNA, 25 bp, Mus musculus
ccttattgcagtggattgatttgat

SEQ ID NO: 357788 - DNA, 25 bp, Mus musculus
ccttatttaattaacctcctatgca

SEQ ID NO: 357789 - DNA, 25 bp, Mus musculus
ccttatttaatttacctcctatgca

SEQ ID NO: 357790 - DNA, 25 bp, Mus musculus
ccttatttgtgactggccgagatgc

SEQ ID NO: 357791 - DNA, 25 bp, Mus musculus
ccttatttgtgagtggccgagatgc

SEQ ID NO: 357792 - DNA, 25 bp, Mus musculus
ccttattttgatcagcatagttgta

SEQ ID NO: 357793 - DNA, 25 bp, Mus musculus
ccttattttgatgagcatagttgta

SEQ ID NO: 357794 - DNA, 25 bp, Mus musculus
ccttcaacacttacaaagatggaga

SEQ ID NO: 357795 - DNA, 25 bp, Mus musculus
ccttcaacactttcaaagatggaga

SEQ ID NO: 357796 - DNA, 25 bp, Mus musculus
ccttcaacatggacactcgtgctct

SEQ ID NO: 357797 - DNA, 25 bp, Mus musculus
ccttcaacatggtcactcgtgctct

SEQ ID NO: 357798 - DNA, 25 bp, Mus musculus
ccttcaacatgtcgcccttgacagg

SEQ ID NO: 357799 - DNA, 25 bp, Mus musculus
ccttcaacatgtggcccttgacagg

SEQ ID NO: 357800 - DNA, 25 bp, Mus musculus
ccttcaactgtaattattgctgcgt

SEQ ID NO: 357801 - DNA, 25 bp, Mus musculus
ccttcaactgtatttattgctgcgt

SEQ ID NO: 357802 - DNA, 25 bp, Mus musculus
ccttcaagacaaaggcatgagtaag

SEQ ID NO: 357803 - DNA, 25 bp, Mus musculus
ccttcaagacaatggcatgagtaag

SEQ ID NO: 357804 - DNA, 25 bp, Mus musculus
ccttcaagatttactgtgatgattt

SEQ ID NO: 357805 - DNA, 25 bp, Mus musculus
ccttcaagattttctgtgatgattt

SEQ ID NO: 357806 - DNA, 25 bp, Mus musculus
ccttcaagctgcaagatgaaagcta

SEQ ID NO: 357807 - DNA, 25 bp, Mus musculus
ccttcaagctgctagatgaaagcta

SEQ ID NO: 357808 - DNA, 25 bp, Mus musculus
ccttcaagtccaaggcgtattcgga

SEQ ID NO: 357809 - DNA, 25 bp, Mus musculus
ccttcaagtccatggcgtattcgga

SEQ ID NO: 357810 - DNA, 25 bp, Mus musculus
ccttcaataaaaaagtgcatagatg

SEQ ID NO: 357811 - DNA, 25 bp, Mus musculus
ccttcaataaaatagtgcatagatg

SEQ ID NO: 357812 - DNA, 25 bp, Mus musculus
ccttcaatacccatgaggctacagg

SEQ ID NO: 357813 - DNA, 25 bp, Mus musculus
ccttcaatacccttgaggctacagg

SEQ ID NO: 357814 - DNA, 25 bp, Mus musculus
ccttcaatacgaagcaatcccagct

SEQ ID NO: 357815 - DNA, 25 bp, Mus musculus
ccttcaatacgatgcaatcccagct

SEQ ID NO: 357816 - DNA, 25 bp, Mus musculus
ccttcaatccttatcctaagcaatc

SEQ ID NO: 357817 - DNA, 25 bp, Mus musculus
ccttcaatccttttcctaagcaatc

SEQ ID NO: 357818 - DNA, 25 bp, Mus musculus
ccttcaatgcttccctataatcaga

SEQ ID NO: 357819 - DNA, 25 bp, Mus musculus
ccttcaatgcttgcctataatcaga

SEQ ID NO: 357820 - DNA, 25 bp, Mus musculus
ccttcacaatctccttaacaagtca

SEQ ID NO: 357821 - DNA, 25 bp, Mus musculus
ccttcacaatctgcttaacaagtca

SEQ ID NO: 357822 - DNA, 25 bp, Mus musculus
ccttcacacaccacttcattatgaa

SEQ ID NO: 357823 - DNA, 25 bp, Mus musculus
ccttcacacacctcttcattatgaa

SEQ ID NO: 357824 - DNA, 25 bp, Mus musculus
ccttcacacaggactttggcggaaa

SEQ ID NO: 357825 - DNA, 25 bp, Mus musculus
ccttcacacaggtctttggcggaaa

SEQ ID NO: 357826 - DNA, 25 bp, Mus musculus
ccttcacagacccacatgtagatag

SEQ ID NO: 357827 - DNA, 25 bp, Mus musculus
ccttcacagaccgacatgtagatag

SEQ ID NO: 357828 - DNA, 25 bp, Mus musculus
ccttcaccaggacaactcaattcta

SEQ ID NO: 357829 - DNA, 25 bp, Mus musculus
ccttcaccaggagaactcaattcta

SEQ ID NO: 357830 - DNA, 25 bp, Mus musculus
ccttcacccctacagaggccatggc

SEQ ID NO: 357831 - DNA, 25 bp, Mus musculus
ccttcacccctagagaggccatggc

SEQ ID NO: 357832 - DNA, 25 bp, Mus musculus
ccttcacccttgacctaagaatgtt

SEQ ID NO: 357833 - DNA, 25 bp, Mus musculus
ccttcacccttgtcctaagaatgtt

SEQ ID NO: 357834 - DNA, 25 bp, Mus musculus
ccttcacctggcagttcctgttggt

SEQ ID NO: 357835 - DNA, 25 bp, Mus musculus
ccttcacctggctgttcctgttggt

SEQ ID NO: 357836 - DNA, 25 bp, Mus musculus
ccttcacctttgcacatacaggaat

SEQ ID NO: 357837 - DNA, 25 bp, Mus musculus
ccttcacctttggacatacaggaat

SEQ ID NO: 357838 - DNA, 25 bp, Mus musculus
ccttcacgctatattgtggctttgt

SEQ ID NO: 357839 - DNA, 25 bp, Mus musculus
ccttcacgctattttgtggctttgt

SEQ ID NO: 357840 - DNA, 25 bp, Mus musculus
ccttcacggcgtagggacttgttgt

SEQ ID NO: 357841 - DNA, 25 bp, Mus musculus
ccttcacggcgttgggacttgttgt

SEQ ID NO: 357842 - DNA, 25 bp, Mus musculus
ccttcacgtcttacatgacagtgtc

SEQ ID NO: 357843 - DNA, 25 bp, Mus musculus
ccttcacgtctttcatgacagtgtc

SEQ ID NO: 357844 - DNA, 25 bp, Mus musculus
ccttcacgtgggatagggagcactg

SEQ ID NO: 357845 - DNA, 25 bp, Mus musculus
ccttcacgtgggttagggagcactg

SEQ ID NO: 357846 - DNA, 25 bp, Mus musculus
ccttcactcagcattttgaaagaga

SEQ ID NO: 357847 - DNA, 25 bp, Mus musculus
ccttcactcagctttttgaaagaga

SEQ ID NO: 357848 - DNA, 25 bp, Mus musculus
ccttcactcataagtctgacctgat

SEQ ID NO: 357849 - DNA, 25 bp, Mus musculus
ccttcactcatatgtctgacctgat

SEQ ID NO: 357850 - DNA, 25 bp, Mus musculus
ccttcactcatgcaagtttgggttt

SEQ ID NO: 357851 - DNA, 25 bp, Mus musculus
ccttcactcatggaagtttgggttt

SEQ ID NO: 357852 - DNA, 25 bp, Mus musculus
ccttcactcttacctccagaataga

SEQ ID NO: 357853 - DNA, 25 bp, Mus musculus
ccttcactcttagctccagaataga

SEQ ID NO: 357854 - DNA, 25 bp, Mus musculus
ccttcactgcacaaattacgctgga

SEQ ID NO: 357855 - DNA, 25 bp, Mus musculus
ccttcactgcactaattacgctgga

SEQ ID NO: 357856 - DNA, 25 bp, Mus musculus
ccttcactgcggatctatactacat

SEQ ID NO: 357857 - DNA, 25 bp, Mus musculus
ccttcactgcggttctatactacat

SEQ ID NO: 357858 - DNA, 25 bp, Mus musculus
ccttcactgtaaccccattttaatg

SEQ ID NO: 357859 - DNA, 25 bp, Mus musculus
ccttcactgtaagcccattttaatg

SEQ ID NO: 357860 - DNA, 25 bp, Mus musculus
ccttcacttaggaatagaccccagt

SEQ ID NO: 357861 - DNA, 25 bp, Mus musculus
ccttcacttaggtatagaccccagt

SEQ ID NO: 357862 - DNA, 25 bp, Mus musculus
ccttcacttatgaatcccaccatgg

SEQ ID NO: 357863 - DNA, 25 bp, Mus musculus
ccttcacttatgtatcccaccatgg

SEQ ID NO: 357864 - DNA, 25 bp, Mus musculus
ccttcacttcccctaatagctaatg

SEQ ID NO: 357865 - DNA, 25 bp, Mus musculus
ccttcacttcccgtaatagctaatg

SEQ ID NO: 357866 - DNA, 25 bp, Mus musculus
ccttcacttgcactctttaactatt

SEQ ID NO: 357867 - DNA, 25 bp, Mus musculus
ccttcacttgcagtctttaactatt

SEQ ID NO: 357868 - DNA, 25 bp, Mus musculus
ccttcagaaaaccactttgcctcat

SEQ ID NO: 357869 - DNA, 25 bp, Mus musculus
ccttcagaaaacgactttgcctcat

SEQ ID NO: 357870 - DNA, 25 bp, Mus musculus
ccttcagaaattcactggttccttc

SEQ ID NO: 357871 - DNA, 25 bp, Mus musculus
ccttcagaaattgactggttccttc

SEQ ID NO: 357872 - DNA, 25 bp, Mus musculus
ccttcagaactcaatctcagcatga

SEQ ID NO: 357873 - DNA, 25 bp, Mus musculus
ccttcagaactctatctcagcatga

SEQ ID NO: 357874 - DNA, 25 bp, Mus musculus
ccttcagaaggcacggtatctatgt

SEQ ID NO: 357875 - DNA, 25 bp, Mus musculus
ccttcagaaggctcggtatctatgt

SEQ ID NO: 357876 - DNA, 25 bp, Mus musculus
ccttcagacaggaaatgactggagt

SEQ ID NO: 357877 - DNA, 25 bp, Mus musculus
ccttcagacaggtaatgactggagt

SEQ ID NO: 357878 - DNA, 25 bp, Mus musculus
ccttcagaccttacagctctagaaa

SEQ ID NO: 357879 - DNA, 25 bp, Mus musculus
ccttcagacctttcagctctagaaa

SEQ ID NO: 357880 - DNA, 25 bp, Mus musculus
ccttcagagatgaacactgtgcccc

SEQ ID NO: 357881 - DNA, 25 bp, Mus musculus
ccttcagagatgtacactgtgcccc

SEQ ID NO: 357882 - DNA, 25 bp, Mus musculus
ccttcagaggacaagggaggcctac

SEQ ID NO: 357883 - DNA, 25 bp, Mus musculus
ccttcagaggactagggaggcctac

SEQ ID NO: 357884 - DNA, 25 bp, Mus musculus
ccttcagagtaacagcagccagaca

SEQ ID NO: 357885 - DNA, 25 bp, Mus musculus
ccttcagagtaagagcagccagaca

SEQ ID NO: 357886 - DNA, 25 bp, Mus musculus
ccttcagcaggtatgtgaggtcaaa

SEQ ID NO: 357887 - DNA, 25 bp, Mus musculus
ccttcagcaggtttgtgaggtcaaa

SEQ ID NO: 357888 - DNA, 25 bp, Mus musculus
ccttcagcagtgcagaggcttgaga

SEQ ID NO: 357889 - DNA, 25 bp, Mus musculus
ccttcagcagtggagaggcttgaga

SEQ ID NO: 357890 - DNA, 25 bp, Mus musculus
ccttcagcagttatgaccactctaa

SEQ ID NO: 357891 - DNA, 25 bp, Mus musculus
ccttcagcagttttgaccactctaa

SEQ ID NO: 357892 - DNA, 25 bp, Mus musculus
ccttcagctacacccaggttgagaa

SEQ ID NO: 357893 - DNA, 25 bp, Mus musculus
ccttcagctacagccaggttgagaa

SEQ ID NO: 357894 - DNA, 25 bp, Mus musculus
ccttcagctgtgacagccaggttag

SEQ ID NO: 357895 - DNA, 25 bp, Mus musculus
ccttcagctgtgtcagccaggttag

SEQ ID NO: 357896 - DNA, 25 bp, Mus musculus
ccttcaggaaagcacctagcaggaa

SEQ ID NO: 357897 - DNA, 25 bp, Mus musculus
ccttcaggaaaggacctagcaggaa

SEQ ID NO: 357898 - DNA, 25 bp, Mus musculus
ccttcaggacctcacatatgtgcca

SEQ ID NO: 357899 - DNA, 25 bp, Mus musculus
ccttcaggacctgacatatgtgcca

SEQ ID NO: 357900 - DNA, 25 bp, Mus musculus
ccttcaggatatcatgaggcttcct

SEQ ID NO: 357901 - DNA, 25 bp, Mus musculus
ccttcaggatatgatgaggcttcct

SEQ ID NO: 357902 - DNA, 25 bp, Mus musculus
ccttcaggcaatcgtgggtttctag

SEQ ID NO: 357903 - DNA, 25 bp, Mus musculus
ccttcaggcaatggtgggtttctag

SEQ ID NO: 357904 - DNA, 25 bp, Mus musculus
ccttcaggccaactctgcaatcaga

SEQ ID NO: 357905 - DNA, 25 bp, Mus musculus
ccttcaggccaagtctgcaatcaga

SEQ ID NO: 357906 - DNA, 25 bp, Mus musculus
ccttcaggctatatctactttctct

SEQ ID NO: 357907 - DNA, 25 bp, Mus musculus
ccttcaggctatttctactttctct

SEQ ID NO: 357908 - DNA, 25 bp, Mus musculus
ccttcagggcgcacttagcatggag

SEQ ID NO: 357909 - DNA, 25 bp, Mus musculus
ccttcagggcgctcttagcatggag

SEQ ID NO: 357910 - DNA, 25 bp, Mus musculus
ccttcagggttgaaccacatgcagc

SEQ ID NO: 357911 - DNA, 25 bp, Mus musculus
ccttcagggttgtaccacatgcagc

SEQ ID NO: 357912 - DNA, 25 bp, Mus musculus
ccttcaggtgtccagtctaagcagg

SEQ ID NO: 357913 - DNA, 25 bp, Mus musculus
ccttcaggtgtcgagtctaagcagg

SEQ ID NO: 357914 - DNA, 25 bp, Mus musculus
ccttcaggtgttatgtgtcatcaaa

SEQ ID NO: 357915 - DNA, 25 bp, Mus musculus
ccttcaggtgttttgtgtcatcaaa

SEQ ID NO: 357916 - DNA, 25 bp, Mus musculus
ccttcagtactaaccgcagggagat

SEQ ID NO: 357917 - DNA, 25 bp, Mus musculus
ccttcagtactatccgcagggagat

SEQ ID NO: 357918 - DNA, 25 bp, Mus musculus
ccttcagtagccattcatcgtttat

SEQ ID NO: 357919 - DNA, 25 bp, Mus musculus
ccttcagtagcctttcatcgtttat

SEQ ID NO: 357920 - DNA, 25 bp, Mus musculus
ccttcagtatagcttctggtaatca

SEQ ID NO: 357921 - DNA, 25 bp, Mus musculus
ccttcagtataggttctggtaatca

SEQ ID NO: 357922 - DNA, 25 bp, Mus musculus
ccttcagtcagacgtcggtacttac

SEQ ID NO: 357923 - DNA, 25 bp, Mus musculus
ccttcagtcagaggtcggtacttac

SEQ ID NO: 357924 - DNA, 25 bp, Mus musculus
ccttcagtccctccagtattttact

SEQ ID NO: 357925 - DNA, 25 bp, Mus musculus
ccttcagtccctgcagtattttact

SEQ ID NO: 357926 - DNA, 25 bp, Mus musculus
ccttcagtgaccactatagtagata

SEQ ID NO: 357927 - DNA, 25 bp, Mus musculus
ccttcagtgacctctatagtagata

SEQ ID NO: 357928 - DNA, 25 bp, Mus musculus
ccttcagtgtgaagctggcaataga

SEQ ID NO: 357929 - DNA, 25 bp, Mus musculus
ccttcagtgtgatgctggcaataga

SEQ ID NO: 357930 - DNA, 25 bp, Mus musculus
ccttcagtttcccaaaggtgatggg

SEQ ID NO: 357931 - DNA, 25 bp, Mus musculus
ccttcagtttccgaaaggtgatggg

SEQ ID NO: 357932 - DNA, 25 bp, Mus musculus
ccttcataaggcatagccagctaac

SEQ ID NO: 357933 - DNA, 25 bp, Mus musculus
ccttcataaggcttagccagctaac

SEQ ID NO: 357934 - DNA, 25 bp, Mus musculus
ccttcatacattaccttgattctcc

SEQ ID NO: 357935 - DNA, 25 bp, Mus musculus
ccttcatacatttccttgattctcc

SEQ ID NO: 357936 - DNA, 25 bp, Mus musculus
ccttcatcccatcgaccatggatgg

SEQ ID NO: 357937 - DNA, 25 bp, Mus musculus
ccttcatcccatggaccatggatgg

SEQ ID NO: 357938 - DNA, 25 bp, Mus musculus
ccttcatccttcactggaataaata

SEQ ID NO: 357939 - DNA, 25 bp, Mus musculus
ccttcatccttctctggaataaata

SEQ ID NO: 357940 - DNA, 25 bp, Mus musculus
ccttcatcttccatttggtctacaa

SEQ ID NO: 357941 - DNA, 25 bp, Mus musculus
ccttcatcttccttttggtctacaa

SEQ ID NO: 357942 - DNA, 25 bp, Mus musculus
ccttcatgccatactttgggattac

SEQ ID NO: 357943 - DNA, 25 bp, Mus musculus
ccttcatgccatatcctagtcagaa

SEQ ID NO: 357944 - DNA, 25 bp, Mus musculus
ccttcatgccattctttgggattac

SEQ ID NO: 357945 - DNA, 25 bp, Mus musculus
ccttcatgccatttcctagtcagaa

SEQ ID NO: 357946 - DNA, 25 bp, Mus musculus
ccttcatgctggcttcaggcaaact

SEQ ID NO: 357947 - DNA, 25 bp, Mus musculus
ccttcatgctgggttcaggcaaact

SEQ ID NO: 357948 - DNA, 25 bp, Mus musculus
ccttcatggagaatagcagctggct

SEQ ID NO: 357949 - DNA, 25 bp, Mus musculus
ccttcatggagattagcagctggct

SEQ ID NO: 357950 - DNA, 25 bp, Mus musculus
ccttcatggcagcaaccagagaggt

SEQ ID NO: 357951 - DNA, 25 bp, Mus musculus
ccttcatggcaggaaccagagaggt

SEQ ID NO: 357952 - DNA, 25 bp, Mus musculus
ccttcatgggtaacaggcaagcaca

SEQ ID NO: 357953 - DNA, 25 bp, Mus musculus
ccttcatgggtatcaggcaagcaca

SEQ ID NO: 357954 - DNA, 25 bp, Mus musculus
ccttcatggtcgctgtttgaccttt

SEQ ID NO: 357955 - DNA, 25 bp, Mus musculus
ccttcatggtcggtgtttgaccttt

SEQ ID NO: 357956 - DNA, 25 bp, Mus musculus
ccttcatggttaagtatatctccct

SEQ ID NO: 357957 - DNA, 25 bp, Mus musculus
ccttcatggttatgtatatctccct

SEQ ID NO: 357958 - DNA, 25 bp, Mus musculus
ccttcatgtactctctattttgggt

SEQ ID NO: 357959 - DNA, 25 bp, Mus musculus
ccttcatgtactgtctattttgggt

SEQ ID NO: 357960 - DNA, 25 bp, Mus musculus
ccttcatgtgcgatccagacattga

SEQ ID NO: 357961 - DNA, 25 bp, Mus musculus
ccttcatgtgcgttccagacattga

SEQ ID NO: 357962 - DNA, 25 bp, Mus musculus
ccttcatgtttaatcctctcttcaa

SEQ ID NO: 357963 - DNA, 25 bp, Mus musculus
ccttcatgtttattcctctcttcaa

SEQ ID NO: 357964 - DNA, 25 bp, Mus musculus
ccttcattaaggcaggcttggctcg

SEQ ID NO: 357965 - DNA, 25 bp, Mus musculus
ccttcattaagggaggcttggctcg

SEQ ID NO: 357966 - DNA, 25 bp, Mus musculus
ccttcattacttagggttcttatat

SEQ ID NO: 357967 - DNA, 25 bp, Mus musculus
ccttcattactttgggttcttatat

SEQ ID NO: 357968 - DNA, 25 bp, Mus musculus
ccttcattatcacttgaccgtctaa

SEQ ID NO: 357969 - DNA, 25 bp, Mus musculus
ccttcattatcagttgaccgtctaa

SEQ ID NO: 357970 - DNA, 25 bp, Mus musculus
ccttcattattgagggacttgtgca

SEQ ID NO: 357971 - DNA, 25 bp, Mus musculus
ccttcattattgtgggacttgtgca

SEQ ID NO: 357972 - DNA, 25 bp, Mus musculus
ccttcattcagtctctgagggttgg

SEQ ID NO: 357973 - DNA, 25 bp, Mus musculus
ccttcattcagtgtctgagggttgg

SEQ ID NO: 357974 - DNA, 25 bp, Mus musculus
ccttcattcatccttaacggtgtgg

SEQ ID NO: 357975 - DNA, 25 bp, Mus musculus
ccttcattcatcgttaacggtgtgg

SEQ ID NO: 357976 - DNA, 25 bp, Mus musculus
ccttcattgaccacaactacatggt

SEQ ID NO: 357977 - DNA, 25 bp, Mus musculus
ccttcattgacctcaactacatggt

SEQ ID NO: 357978 - DNA, 25 bp, Mus musculus
ccttcattgtggatgtggctttcaa

SEQ ID NO: 357979 - DNA, 25 bp, Mus musculus
ccttcattgtggttgtggctttcaa

SEQ ID NO: 357980 - DNA, 25 bp, Mus musculus
ccttcatttttcaatgaacccgaga

SEQ ID NO: 357981 - DNA, 25 bp, Mus musculus
ccttcatttttctatgaacccgaga

SEQ ID NO: 357982 - DNA, 25 bp, Mus musculus
ccttccaagggcagcaccaagaaaa

SEQ ID NO: 357983 - DNA, 25 bp, Mus musculus
ccttccaagggctgcaccaagaaaa

SEQ ID NO: 357984 - DNA, 25 bp, Mus musculus
ccttccaaggttagccccaagagca

SEQ ID NO: 357985 - DNA, 25 bp, Mus musculus
ccttccaaggtttgccccaagagca

SEQ ID NO: 357986 - DNA, 25 bp, Mus musculus
ccttccacactcatcaatggagtac

SEQ ID NO: 357987 - DNA, 25 bp, Mus musculus
ccttccacactcttcaatggagtac

SEQ ID NO: 357988 - DNA, 25 bp, Mus musculus
ccttccacagacatctatggtcaca

SEQ ID NO: 357989 - DNA, 25 bp, Mus musculus
ccttccacagacttctatggtcaca

SEQ ID NO: 357990 - DNA, 25 bp, Mus musculus
ccttccacaggcactgaggcatagt

SEQ ID NO: 357991 - DNA, 25 bp, Mus musculus
ccttccacaggctctgaggcatagt

SEQ ID NO: 357992 - DNA, 25 bp, Mus musculus
ccttccaccaccacaagtaaagttg

SEQ ID NO: 357993 - DNA, 25 bp, Mus musculus
ccttccaccacctcaagtaaagttg

SEQ ID NO: 357994 - DNA, 25 bp, Mus musculus
ccttccaccaggatcatactgcaat

SEQ ID NO: 357995 - DNA, 25 bp, Mus musculus
ccttccaccaggttcatactgcaat

SEQ ID NO: 357996 - DNA, 25 bp, Mus musculus
ccttccaccttcatttcccaagtgc

SEQ ID NO: 357997 - DNA, 25 bp, Mus musculus
ccttccaccttcttttcccaagtgc

SEQ ID NO: 357998 - DNA, 25 bp, Mus musculus
ccttccacgatgctgctactctggg

SEQ ID NO: 357999 - DNA, 25 bp, Mus musculus
ccttccacgatggtgctactctggg

SEQ ID NO: 358000 - DNA, 25 bp, Mus musculus
ccttccactgagcatgacaagcaca

SEQ ID NO: 358001 - DNA, 25 bp, Mus musculus
ccttccactgaggatgacaagcaca

SEQ ID NO: 358002 - DNA, 25 bp, Mus musculus
ccttccagaatgagagcggcctaga

SEQ ID NO: 358003 - DNA, 25 bp, Mus musculus
ccttccagaatgtgagcggcctaga

SEQ ID NO: 358004 - DNA, 25 bp, Mus musculus
ccttccagcgtgataagtcctttgc

SEQ ID NO: 358005 - DNA, 25 bp, Mus musculus
ccttccagcgtgttaagtcctttgc

SEQ ID NO: 358006 - DNA, 25 bp, Mus musculus
ccttccaggcatctacattgtccaa

SEQ ID NO: 358007 - DNA, 25 bp, Mus musculus
ccttccaggcatgtacattgtccaa

SEQ ID NO: 358008 - DNA, 25 bp, Mus musculus
ccttccaggtctaagtaacttgcac

SEQ ID NO: 358009 - DNA, 25 bp, Mus musculus
ccttccaggtcttagtaacttgcac

SEQ ID NO: 358010 - DNA, 25 bp, Mus musculus
ccttccaggtttcgagatggccttg

SEQ ID NO: 358011 - DNA, 25 bp, Mus musculus
ccttccaggtttggagatggccttg

SEQ ID NO: 358012 - DNA, 25 bp, Mus musculus
ccttccagtgacagtcaagacattt

SEQ ID NO: 358013 - DNA, 25 bp, Mus musculus
ccttccagtgactgtcaagacattt

SEQ ID NO: 358014 - DNA, 25 bp, Mus musculus
ccttccatagacacagttgctctga

SEQ ID NO: 358015 - DNA, 25 bp, Mus musculus
ccttccatagactcagttgctctga

SEQ ID NO: 358016 - DNA, 25 bp, Mus musculus
ccttccatatccatccaactttaag

SEQ ID NO: 358017 - DNA, 25 bp, Mus musculus
ccttccatatccttccaactttaag

SEQ ID NO: 358018 - DNA, 25 bp, Mus musculus
ccttccatcaggactacaatctgac

SEQ ID NO: 358019 - DNA, 25 bp, Mus musculus
ccttccatcaggtctacaatctgac

SEQ ID NO: 358020 - DNA, 25 bp, Mus musculus
ccttccatcatgctttgctcaaagt

SEQ ID NO: 358021 - DNA, 25 bp, Mus musculus
ccttccatcatggtttgctcaaagt

SEQ ID NO: 358022 - DNA, 25 bp, Mus musculus
ccttccatcattaacagtgtctcaa

SEQ ID NO: 358023 - DNA, 25 bp, Mus musculus
ccttccatcatttacagtgtctcaa

SEQ ID NO: 358024 - DNA, 25 bp, Mus musculus
ccttccatcctaagtatgctttctg

SEQ ID NO: 358025 - DNA, 25 bp, Mus musculus
ccttccatcctatgtatgctttctg

SEQ ID NO: 358026 - DNA, 25 bp, Mus musculus
ccttccatccttccctagaaaagtt

SEQ ID NO: 358027 - DNA, 25 bp, Mus musculus
ccttccatccttgcctagaaaagtt

SEQ ID NO: 358028 - DNA, 25 bp, Mus musculus
ccttccatcttcagtgtgtcataaa

SEQ ID NO: 358029 - DNA, 25 bp, Mus musculus
ccttccatcttctgtgtgtcataaa

SEQ ID NO: 358030 - DNA, 25 bp, Mus musculus
ccttccatgagcacccaagaacaag

SEQ ID NO: 358031 - DNA, 25 bp, Mus musculus
ccttccatgagctcccaagaacaag

SEQ ID NO: 358032 - DNA, 25 bp, Mus musculus
ccttccatttacactgtgagggttt

SEQ ID NO: 358033 - DNA, 25 bp, Mus musculus
ccttccatttactctgtgagggttt

SEQ ID NO: 358034 - DNA, 25 bp, Mus musculus
ccttccatttagctgtaagagatgt

SEQ ID NO: 358035 - DNA, 25 bp, Mus musculus
ccttccatttaggtgtaagagatgt

SEQ ID NO: 358036 - DNA, 25 bp, Mus musculus
ccttccatttgtattccaggacttg

SEQ ID NO: 358037 - DNA, 25 bp, Mus musculus
ccttccatttgttttccaggacttg

SEQ ID NO: 358038 - DNA, 25 bp, Mus musculus
ccttccattttaacatccgcatgac

SEQ ID NO: 358039 - DNA, 25 bp, Mus musculus
ccttccattttatcatccgcatgac

SEQ ID NO: 358040 - DNA, 25 bp, Mus musculus
ccttcccaaagtattaatgttgtgc

SEQ ID NO: 358041 - DNA, 25 bp, Mus musculus
ccttcccaaagttttaatgttgtgc

SEQ ID NO: 358042 - DNA, 25 bp, Mus musculus
ccttcccactggcattttatacttg

SEQ ID NO: 358043 - DNA, 25 bp, Mus musculus
ccttcccactgggattttatacttg

SEQ ID NO: 358044 - DNA, 25 bp, Mus musculus
ccttcccataagagtgttcgctatg

SEQ ID NO: 358045 - DNA, 25 bp, Mus musculus
ccttcccataagtgtgttcgctatg

SEQ ID NO: 358046 - DNA, 25 bp, Mus musculus
ccttcccatgctcttgacctataaa

SEQ ID NO: 358047 - DNA, 25 bp, Mus musculus
ccttcccatgctgttgacctataaa

SEQ ID NO: 358048 - DNA, 25 bp, Mus musculus
ccttcccatgggactaagagcagtg

SEQ ID NO: 358049 - DNA, 25 bp, Mus musculus
ccttcccatgggtctaagagcagtg

SEQ ID NO: 358050 - DNA, 25 bp, Mus musculus
ccttcccattcacatatgtgcgaga

SEQ ID NO: 358051 - DNA, 25 bp, Mus musculus
ccttcccattcagatatgtgcgaga

SEQ ID NO: 358052 - DNA, 25 bp, Mus musculus
ccttccccacagacgtgtatatata

SEQ ID NO: 358053 - DNA, 25 bp, Mus musculus
ccttccccacagtcgtgtatatata

SEQ ID NO: 358054 - DNA, 25 bp, Mus musculus
ccttccccatacacggagaggagtt

SEQ ID NO: 358055 - DNA, 25 bp, Mus musculus
ccttccccatactcggagaggagtt

SEQ ID NO: 358056 - DNA, 25 bp, Mus musculus
ccttcccctgaaacagcgttgtgtt

SEQ ID NO: 358057 - DNA, 25 bp, Mus musculus
ccttcccctgaatcagcgttgtgtt

SEQ ID NO: 358058 - DNA, 25 bp, Mus musculus
ccttcccctttgagcacaagtgttg

SEQ ID NO: 358059 - DNA, 25 bp, Mus musculus
ccttcccctttgtgcacaagtgttg

SEQ ID NO: 358060 - DNA, 25 bp, Mus musculus
ccttccctaagtcaggattgtccct

SEQ ID NO: 358061 - DNA, 25 bp, Mus musculus
ccttccctaagtgaggattgtccct

SEQ ID NO: 358062 - DNA, 25 bp, Mus musculus
ccttccctacatatactggtgcaaa

SEQ ID NO: 358063 - DNA, 25 bp, Mus musculus
ccttccctacatttactggtgcaaa

SEQ ID NO: 358064 - DNA, 25 bp, Mus musculus
ccttccctcaagaatcctgttattt

SEQ ID NO: 358065 - DNA, 25 bp, Mus musculus
ccttccctcaagtatcctgttattt

SEQ ID NO: 358066 - DNA, 25 bp, Mus musculus
ccttccctctttagagagactggtt

SEQ ID NO: 358067 - DNA, 25 bp, Mus musculus
ccttccctcttttgagagactggtt

SEQ ID NO: 358068 - DNA, 25 bp, Mus musculus
ccttccctgagtcctcaggttagag

SEQ ID NO: 358069 - DNA, 25 bp, Mus musculus
ccttccctgagtgctcaggttagag

SEQ ID NO: 358070 - DNA, 25 bp, Mus musculus
ccttccctgctacactgctaaatta

SEQ ID NO: 358071 - DNA, 25 bp, Mus musculus
ccttccctgctagactgctaaatta

SEQ ID NO: 358072 - DNA, 25 bp, Mus musculus
ccttccctgctgcatacaaagaatt

SEQ ID NO: 358073 - DNA, 25 bp, Mus musculus
ccttccctgctggatacaaagaatt

SEQ ID NO: 358074 - DNA, 25 bp, Mus musculus
ccttccctggcaatttatttggaga

SEQ ID NO: 358075 - DNA, 25 bp, Mus musculus
ccttccctggcattttatttggaga

SEQ ID NO: 358076 - DNA, 25 bp, Mus musculus
ccttccctgtacctggttaaatatg

SEQ ID NO: 358077 - DNA, 25 bp, Mus musculus
ccttccctgtacgtggttaaatatg

SEQ ID NO: 358078 - DNA, 25 bp, Mus musculus
ccttcccttagccatattcagaatg

SEQ ID NO: 358079 - DNA, 25 bp, Mus musculus
ccttcccttagcgatattcagaatg

SEQ ID NO: 358080 - DNA, 25 bp, Mus musculus
ccttcccttcctcataagaacatta

SEQ ID NO: 358081 - DNA, 25 bp, Mus musculus
ccttcccttcctgataagaacatta

SEQ ID NO: 358082 - DNA, 25 bp, Mus musculus
ccttcccttggcatagtcagactgg

SEQ ID NO: 358083 - DNA, 25 bp, Mus musculus
ccttcccttggcttagtcagactgg

SEQ ID NO: 358084 - DNA, 25 bp, Mus musculus
ccttcccttgtaaaaagtgcggcag

SEQ ID NO: 358085 - DNA, 25 bp, Mus musculus
ccttcccttgtataaagtgcggcag

SEQ ID NO: 358086 - DNA, 25 bp, Mus musculus
ccttccgacctgagactcaagagga

SEQ ID NO: 358087 - DNA, 25 bp, Mus musculus
ccttccgacctgtgactcaagagga

SEQ ID NO: 358088 - DNA, 25 bp, Mus musculus
ccttccgagaccatcactggcaata

SEQ ID NO: 358089 - DNA, 25 bp, Mus musculus
ccttccgagaccttcactggcaata

SEQ ID NO: 358090 - DNA, 25 bp, Mus musculus
ccttccgagggaaagaattgccagt

SEQ ID NO: 358091 - DNA, 25 bp, Mus musculus
ccttccgagggatagaattgccagt

SEQ ID NO: 358092 - DNA, 25 bp, Mus musculus
ccttccgcaatgagcagttcacttt

SEQ ID NO: 358093 - DNA, 25 bp, Mus musculus
ccttccgcaatgtgcagttcacttt

SEQ ID NO: 358094 - DNA, 25 bp, Mus musculus
ccttccggtggtatcagtgatttca

SEQ ID NO: 358095 - DNA, 25 bp, Mus musculus
ccttccggtggtttcagtgatttca

SEQ ID NO: 358096 - DNA, 25 bp, Mus musculus
ccttccgtagaaaatgtgcagctta

SEQ ID NO: 358097 - DNA, 25 bp, Mus musculus
ccttccgtagaatatgtgcagctta

SEQ ID NO: 358098 - DNA, 25 bp, Mus musculus
ccttccgtatgcactgtatcattga

SEQ ID NO: 358099 - DNA, 25 bp, Mus musculus
ccttccgtatgctctgtatcattga

SEQ ID NO: 358100 - DNA, 25 bp, Mus musculus
ccttccgtcgtcatctgtgtagcta

SEQ ID NO: 358101 - DNA, 25 bp, Mus musculus
ccttccgtcgtcttctgtgtagcta

SEQ ID NO: 358102 - DNA, 25 bp, Mus musculus
ccttcctaacgcagagactctttaa

SEQ ID NO: 358103 - DNA, 25 bp, Mus musculus
ccttcctaacgctgagactctttaa

SEQ ID NO: 358104 - DNA, 25 bp, Mus musculus
ccttcctaagtactctttccactag

SEQ ID NO: 358105 - DNA, 25 bp, Mus musculus
ccttcctaagtagtctttccactag

SEQ ID NO: 358106 - DNA, 25 bp, Mus musculus
ccttcctaatgcatttaaatacgct

SEQ ID NO: 358107 - DNA, 25 bp, Mus musculus
ccttcctaatgccttacatgggctg

SEQ ID NO: 358108 - DNA, 25 bp, Mus musculus
ccttcctaatgcgttacatgggctg

SEQ ID NO: 358109 - DNA, 25 bp, Mus musculus
ccttcctaatgcttttaaatacgct

SEQ ID NO: 358110 - DNA, 25 bp, Mus musculus
ccttcctacatgatcctatttcata

SEQ ID NO: 358111 - DNA, 25 bp, Mus musculus
ccttcctacatgttcctatttcata

SEQ ID NO: 358112 - DNA, 25 bp, Mus musculus
ccttcctatctcatagcccattgtg

SEQ ID NO: 358113 - DNA, 25 bp, Mus musculus
ccttcctatctcttagcccattgtg

SEQ ID NO: 358114 - DNA, 25 bp, Mus musculus
ccttcctatggtcgtcagacagcct

SEQ ID NO: 358115 - DNA, 25 bp, Mus musculus
ccttcctatggtggtcagacagcct

SEQ ID NO: 358116 - DNA, 25 bp, Mus musculus
ccttcctcaaataggcttgcctgaa

SEQ ID NO: 358117 - DNA, 25 bp, Mus musculus
ccttcctcaaattggcttgcctgaa

SEQ ID NO: 358118 - DNA, 25 bp, Mus musculus
ccttcctcaccacagtatctaaaaa

SEQ ID NO: 358119 - DNA, 25 bp, Mus musculus
ccttcctcaccagagtatctaaaaa

SEQ ID NO: 358120 - DNA, 25 bp, Mus musculus
ccttcctcagatatcctgacttgtg

SEQ ID NO: 358121 - DNA, 25 bp, Mus musculus
ccttcctcagatttcctgacttgtg

SEQ ID NO: 358122 - DNA, 25 bp, Mus musculus
ccttcctcccatatgtgattttgtg

SEQ ID NO: 358123 - DNA, 25 bp, Mus musculus
ccttcctcccatttgtgattttgtg

SEQ ID NO: 358124 - DNA, 25 bp, Mus musculus
ccttcctcctataatccagggtagg

SEQ ID NO: 358125 - DNA, 25 bp, Mus musculus
ccttcctcctattatccagggtagg

SEQ ID NO: 358126 - DNA, 25 bp, Mus musculus
ccttcctctggcagactttcaaaaa

SEQ ID NO: 358127 - DNA, 25 bp, Mus musculus
ccttcctctggctgactttcaaaaa

SEQ ID NO: 358128 - DNA, 25 bp, Mus musculus
ccttcctgaaacctcattgttcatt

SEQ ID NO: 358129 - DNA, 25 bp, Mus musculus
ccttcctgaaacgtcattgttcatt

SEQ ID NO: 358130 - DNA, 25 bp, Mus musculus
ccttcctgaatccattctttgcata

SEQ ID NO: 358131 - DNA, 25 bp, Mus musculus
ccttcctgaatcgattctttgcata

SEQ ID NO: 358132 - DNA, 25 bp, Mus musculus
ccttcctgagaactactgcatcgaa

SEQ ID NO: 358133 - DNA, 25 bp, Mus musculus
ccttcctgagaagtactgcatcgaa

SEQ ID NO: 358134 - DNA, 25 bp, Mus musculus
ccttcctgagctctttgctgctgca

SEQ ID NO: 358135 - DNA, 25 bp, Mus musculus
ccttcctgagctgtttgctgctgca

SEQ ID NO: 358136 - DNA, 25 bp, Mus musculus
ccttcctgagggaatcaacttcgtg

SEQ ID NO: 358137 - DNA, 25 bp, Mus musculus
ccttcctgagggtatcaacttcgtg

SEQ ID NO: 358138 - DNA, 25 bp, Mus musculus
ccttcctgatacatggttgtatttc

SEQ ID NO: 358139 - DNA, 25 bp, Mus musculus
ccttcctgatacttggttgtatttc

SEQ ID NO: 358140 - DNA, 25 bp, Mus musculus
ccttcctgatatagtcctttgctaa

SEQ ID NO: 358141 - DNA, 25 bp, Mus musculus
ccttcctgatattgtcctttgctaa

SEQ ID NO: 358142 - DNA, 25 bp, Mus musculus
ccttcctgatttcttatcagtcttt

SEQ ID NO: 358143 - DNA, 25 bp, Mus musculus
ccttcctgatttgttatcagtcttt

SEQ ID NO: 358144 - DNA, 25 bp, Mus musculus
ccttcctgcatcacagaggagggca

SEQ ID NO: 358145 - DNA, 25 bp, Mus musculus
ccttcctgcatctcagaggagggca

SEQ ID NO: 358146 - DNA, 25 bp, Mus musculus
ccttcctgccatatcttaacagatg

SEQ ID NO: 358147 - DNA, 25 bp, Mus musculus
ccttcctgccatttcttaacagatg

SEQ ID NO: 358148 - DNA, 25 bp, Mus musculus
ccttcctgcctacaggtactggagt

SEQ ID NO: 358149 - DNA, 25 bp, Mus musculus
ccttcctgcctagaggtactggagt

SEQ ID NO: 358150 - DNA, 25 bp, Mus musculus
ccttcctgctataagagccttcatt

SEQ ID NO: 358151 - DNA, 25 bp, Mus musculus
ccttcctgctattagagccttcatt

SEQ ID NO: 358152 - DNA, 25 bp, Mus musculus
ccttcctgctcactaggctgaagat

SEQ ID NO: 358153 - DNA, 25 bp, Mus musculus
ccttcctgctcagtaggctgaagat

SEQ ID NO: 358154 - DNA, 25 bp, Mus musculus
ccttcctggaacagtttcgcaagga

SEQ ID NO: 358155 - DNA, 25 bp, Mus musculus
ccttcctggaactgtttcgcaagga

SEQ ID NO: 358156 - DNA, 25 bp, Mus musculus
ccttcctggaataccggagatccag

SEQ ID NO: 358157 - DNA, 25 bp, Mus musculus
ccttcctggaattccggagatccag

SEQ ID NO: 358158 - DNA, 25 bp, Mus musculus
ccttcctggagacttttctacacat

SEQ ID NO: 358159 - DNA, 25 bp, Mus musculus
ccttcctggagagttttctacacat

SEQ ID NO: 358160 - DNA, 25 bp, Mus musculus
ccttcctggcggagaatgtctatca

SEQ ID NO: 358161 - DNA, 25 bp, Mus musculus
ccttcctggcggtgaatgtctatca

SEQ ID NO: 358162 - DNA, 25 bp, Mus musculus
ccttcctggtctagttttcgagaga

SEQ ID NO: 358163 - DNA, 25 bp, Mus musculus
ccttcctggtcttgttttcgagaga

SEQ ID NO: 358164 - DNA, 25 bp, Mus musculus
ccttcctgtaagaaaattaactgct

SEQ ID NO: 358165 - DNA, 25 bp, Mus musculus
ccttcctgtaagtaaattaactgct

SEQ ID NO: 358166 - DNA, 25 bp, Mus musculus
ccttcctgtaggaagcttcagacat

SEQ ID NO: 358167 - DNA, 25 bp, Mus musculus
ccttcctgtaggtagcttcagacat

SEQ ID NO: 358168 - DNA, 25 bp, Mus musculus
ccttcctgtatacatgtgtaccatg

SEQ ID NO: 358169 - DNA, 25 bp, Mus musculus
ccttcctgtatagatgtgtaccatg

SEQ ID NO: 358170 - DNA, 25 bp, Mus musculus
ccttcctgtcacatctggagagtga

SEQ ID NO: 358171 - DNA, 25 bp, Mus musculus
ccttcctgtcacttctggagagtga

SEQ ID NO: 358172 - DNA, 25 bp, Mus musculus
ccttcctgtccaacaaattctttta

SEQ ID NO: 358173 - DNA, 25 bp, Mus musculus
ccttcctgtccatcaaattctttta

SEQ ID NO: 358174 - DNA, 25 bp, Mus musculus
ccttcctgtcttagcatgacttgta

SEQ ID NO: 358175 - DNA, 25 bp, Mus musculus
ccttcctgtctttgcatgacttgta

SEQ ID NO: 358176 - DNA, 25 bp, Mus musculus
ccttcctgtgtaattattcaaggtg

SEQ ID NO: 358177 - DNA, 25 bp, Mus musculus
ccttcctgtgtatttattcaaggtg

SEQ ID NO: 358178 - DNA, 25 bp, Mus musculus
ccttcctgtgttcgctgggaagcgg

SEQ ID NO: 358179 - DNA, 25 bp, Mus musculus
ccttcctgtgttggctgggaagcgg

SEQ ID NO: 358180 - DNA, 25 bp, Mus musculus
ccttcctgttttcatgagattccaa

SEQ ID NO: 358181 - DNA, 25 bp, Mus musculus
ccttcctgttttgatgagattccaa

SEQ ID NO: 358182 - DNA, 25 bp, Mus musculus
ccttccttactgctatttaagcact

SEQ ID NO: 358183 - DNA, 25 bp, Mus musculus
ccttccttactggtatttaagcact

SEQ ID NO: 358184 - DNA, 25 bp, Mus musculus
ccttccttcaatatggagccttctc

SEQ ID NO: 358185 - DNA, 25 bp, Mus musculus
ccttccttcaatttggagccttctc

SEQ ID NO: 358186 - DNA, 25 bp, Mus musculus
ccttccttcatgactctacttggag

SEQ ID NO: 358187 - DNA, 25 bp, Mus musculus
ccttccttcatgtctctacttggag

SEQ ID NO: 358188 - DNA, 25 bp, Mus musculus
ccttccttcgtcagttttcttcaca

SEQ ID NO: 358189 - DNA, 25 bp, Mus musculus
ccttccttcgtctgttttcttcaca

SEQ ID NO: 358190 - DNA, 25 bp, Mus musculus
ccttccttctacagtttgcaaactc

SEQ ID NO: 358191 - DNA, 25 bp, Mus musculus
ccttccttctactgtttgcaaactc

SEQ ID NO: 358192 - DNA, 25 bp, Mus musculus
ccttccttctgaattgcctgcccat

SEQ ID NO: 358193 - DNA, 25 bp, Mus musculus
ccttccttctgatttgcctgcccat

SEQ ID NO: 358194 - DNA, 25 bp, Mus musculus
ccttccttctgcattgtttacattg

SEQ ID NO: 358195 - DNA, 25 bp, Mus musculus
ccttccttctgctttgtttacattg

SEQ ID NO: 358196 - DNA, 25 bp, Mus musculus
ccttccttgggactcatattgatcc

SEQ ID NO: 358197 - DNA, 25 bp, Mus musculus
ccttccttgggagtcatattgatcc

SEQ ID NO: 358198 - DNA, 25 bp, Mus musculus
ccttccttgggtccaggggctctga

SEQ ID NO: 358199 - DNA, 25 bp, Mus musculus
ccttccttgggtgcaggggctctga

SEQ ID NO: 358200 - DNA, 25 bp, Mus musculus
ccttccttgtttcctggtgctcaga

SEQ ID NO: 358201 - DNA, 25 bp, Mus musculus
ccttccttgtttgctggtgctcaga

SEQ ID NO: 358202 - DNA, 25 bp, Mus musculus
ccttcctttaggctatggtgcattg

SEQ ID NO: 358203 - DNA, 25 bp, Mus musculus
ccttcctttagggtatggtgcattg

SEQ ID NO: 358204 - DNA, 25 bp, Mus musculus
ccttcctttagtacccagagagcag

SEQ ID NO: 358205 - DNA, 25 bp, Mus musculus
ccttcctttagttcccagagagcag

SEQ ID NO: 358206 - DNA, 25 bp, Mus musculus
ccttcctttcacagaaggagacatt

SEQ ID NO: 358207 - DNA, 25 bp, Mus musculus
ccttcctttcactgaaggagacatt

SEQ ID NO: 358208 - DNA, 25 bp, Mus musculus
ccttcctttccaacaagatcttcat

SEQ ID NO: 358209 - DNA, 25 bp, Mus musculus
ccttcctttccatcaagatcttcat

SEQ ID NO: 358210 - DNA, 25 bp, Mus musculus
ccttcctttgtgctagcactagcat

SEQ ID NO: 358211 - DNA, 25 bp, Mus musculus
ccttcctttgtggtagcactagcat

SEQ ID NO: 358212 - DNA, 25 bp, Mus musculus
ccttccttttaacctcagctgttga

SEQ ID NO: 358213 - DNA, 25 bp, Mus musculus
ccttccttttaagctcagctgttga

SEQ ID NO: 358214 - DNA, 25 bp, Mus musculus
ccttccttttgacatcctaaaagct

SEQ ID NO: 358215 - DNA, 25 bp, Mus musculus
ccttccttttgagatcctaaaagct

SEQ ID NO: 358216 - DNA, 25 bp, Mus musculus
ccttcgagatggcagtggctttaca

SEQ ID NO: 358217 - DNA, 25 bp, Mus musculus
ccttcgagatgggagtggctttaca

SEQ ID NO: 358218 - DNA, 25 bp, Mus musculus
ccttcgagcgagctgcagatctaca

SEQ ID NO: 358219 - DNA, 25 bp, Mus musculus
ccttcgagcgaggtgcagatctaca

SEQ ID NO: 358220 - DNA, 25 bp, Mus musculus
ccttcgatgaggaggaggacagcct

SEQ ID NO: 358221 - DNA, 25 bp, Mus musculus
ccttcgatgaggtggaggacagcct

SEQ ID NO: 358222 - DNA, 25 bp, Mus musculus
ccttcgatgtatccatgcaactctt

SEQ ID NO: 358223 - DNA, 25 bp, Mus musculus
ccttcgatgtatgcatgcaactctt

SEQ ID NO: 358224 - DNA, 25 bp, Mus musculus
ccttcgcaaaggagttgttggagcc

SEQ ID NO: 358225 - DNA, 25 bp, Mus musculus
ccttcgcaaaggtgttgttggagcc

SEQ ID NO: 358226 - DNA, 25 bp, Mus musculus
ccttcgcatgaaaggtccttagaca

SEQ ID NO: 358227 - DNA, 25 bp, Mus musculus
ccttcgcatgaatggtccttagaca

SEQ ID NO: 358228 - DNA, 25 bp, Mus musculus
ccttcgcctttcactcagattaaag

SEQ ID NO: 358229 - DNA, 25 bp, Mus musculus
ccttcgcctttctctcagattaaag

SEQ ID NO: 358230 - DNA, 25 bp, Mus musculus
ccttcggaggccagttacagagact

SEQ ID NO: 358231 - DNA, 25 bp, Mus musculus
ccttcggaggcctgttacagagact

SEQ ID NO: 358232 - DNA, 25 bp, Mus musculus
ccttcggtatccaccaggatttgat

SEQ ID NO: 358233 - DNA, 25 bp, Mus musculus
ccttcggtatcctccaggatttgat

SEQ ID NO: 358234 - DNA, 25 bp, Mus musculus
ccttcgtgaggaccttcctgaagag

SEQ ID NO: 358235 - DNA, 25 bp, Mus musculus
ccttcgtgaggagcttcctgaagag

SEQ ID NO: 358236 - DNA, 25 bp, Mus musculus
ccttcgtggtgactggtttgactat

SEQ ID NO: 358237 - DNA, 25 bp, Mus musculus
ccttcgtggtgagtggtttgactat

SEQ ID NO: 358238 - DNA, 25 bp, Mus musculus
ccttctaaaagtagtgtccagagat

SEQ ID NO: 358239 - DNA, 25 bp, Mus musculus
ccttctaaaagttgtgtccagagat

SEQ ID NO: 358240 - DNA, 25 bp, Mus musculus
ccttctaagaagcacccaagtatct

SEQ ID NO: 358241 - DNA, 25 bp, Mus musculus
ccttctaagaaggacccaagtatct

SEQ ID NO: 358242 - DNA, 25 bp, Mus musculus
ccttctacaatgagctgcgtgtggc

SEQ ID NO: 358243 - DNA, 25 bp, Mus musculus
ccttctacaatgtgctgcgtgtggc

SEQ ID NO: 358244 - DNA, 25 bp, Mus musculus
ccttctacagagacccaggcagatt

SEQ ID NO: 358245 - DNA, 25 bp, Mus musculus
ccttctacagagtcccaggcagatt

SEQ ID NO: 358246 - DNA, 25 bp, Mus musculus
ccttctacttctacatcatcagagt

SEQ ID NO: 358247 - DNA, 25 bp, Mus musculus
ccttctacttcttcatcatcagagt

SEQ ID NO: 358248 - DNA, 25 bp, Mus musculus
ccttctaggtgaaccctcagagact

SEQ ID NO: 358249 - DNA, 25 bp, Mus musculus
ccttctaggtgatccctcagagact

SEQ ID NO: 358250 - DNA, 25 bp, Mus musculus
ccttctagtgctactaatgactgaa

SEQ ID NO: 358251 - DNA, 25 bp, Mus musculus
ccttctagtgcttctaatgactgaa

SEQ ID NO: 358252 - DNA, 25 bp, Mus musculus
ccttctagttacaactgctccttaa

SEQ ID NO: 358253 - DNA, 25 bp, Mus musculus
ccttctagttactactgctccttaa

SEQ ID NO: 358254 - DNA, 25 bp, Mus musculus
ccttctataacccagtaccatgtac

SEQ ID NO: 358255 - DNA, 25 bp, Mus musculus
ccttctataaccgagtaccatgtac

SEQ ID NO: 358256 - DNA, 25 bp, Mus musculus
ccttctatgaagctgacgatgggac

SEQ ID NO: 358257 - DNA, 25 bp, Mus musculus
ccttctatgaaggtgacgatgggac

SEQ ID NO: 358258 - DNA, 25 bp, Mus musculus
ccttctattatgcactttaggagtt

SEQ ID NO: 358259 - DNA, 25 bp, Mus musculus
ccttctattatggactttaggagtt

SEQ ID NO: 358260 - DNA, 25 bp, Mus musculus
ccttctcaacgtcgactggtcttta

SEQ ID NO: 358261 - DNA, 25 bp, Mus musculus
ccttctcaacgtggactggtcttta

SEQ ID NO: 358262 - DNA, 25 bp, Mus musculus
ccttctcacagcaggagccgggaag

SEQ ID NO: 358263 - DNA, 25 bp, Mus musculus
ccttctcacagctggagccgggaag

SEQ ID NO: 358264 - DNA, 25 bp, Mus musculus
ccttctcacctgagagtgctagaga

SEQ ID NO: 358265 - DNA, 25 bp, Mus musculus
ccttctcacctgtgagtgctagaga

SEQ ID NO: 358266 - DNA, 25 bp, Mus musculus
ccttctcactccacatggaagcatg

SEQ ID NO: 358267 - DNA, 25 bp, Mus musculus
ccttctcactcctcatggaagcatg

SEQ ID NO: 358268 - DNA, 25 bp, Mus musculus
ccttctcacttacctggtctctaaa

SEQ ID NO: 358269 - DNA, 25 bp, Mus musculus
ccttctcacttagctggtctctaaa

SEQ ID NO: 358270 - DNA, 25 bp, Mus musculus
ccttctcaggctacttttgactgtt

SEQ ID NO: 358271 - DNA, 25 bp, Mus musculus
ccttctcaggcttcttttgactgtt

SEQ ID NO: 358272 - DNA, 25 bp, Mus musculus
ccttctcataggctgaacgttttca

SEQ ID NO: 358273 - DNA, 25 bp, Mus musculus
ccttctcatagggtgaacgttttca

SEQ ID NO: 358274 - DNA, 25 bp, Mus musculus
ccttctcatcttatcatccaagatc

SEQ ID NO: 358275 - DNA, 25 bp, Mus musculus
ccttctcatcttttcatccaagatc

SEQ ID NO: 358276 - DNA, 25 bp, Mus musculus
ccttctccactcatgagactgaaga

SEQ ID NO: 358277 - DNA, 25 bp, Mus musculus
ccttctccactcttgagactgaaga

SEQ ID NO: 358278 - DNA, 25 bp, Mus musculus
ccttctccagctcatttatttggca

SEQ ID NO: 358279 - DNA, 25 bp, Mus musculus
ccttctccagctgatttatttggca

SEQ ID NO: 358280 - DNA, 25 bp, Mus musculus
ccttctcctggacgtgtgaggctag

SEQ ID NO: 358281 - DNA, 25 bp, Mus musculus
ccttctcctggaggtgtgaggctag

SEQ ID NO: 358282 - DNA, 25 bp, Mus musculus
ccttctccttaaatcaccacatttt

SEQ ID NO: 358283 - DNA, 25 bp, Mus musculus
ccttctccttaattcaccacatttt

SEQ ID NO: 358284 - DNA, 25 bp, Mus musculus
ccttctcgaagcctctatttagatc

SEQ ID NO: 358285 - DNA, 25 bp, Mus musculus
ccttctcgaagcgtctatttagatc

SEQ ID NO: 358286 - DNA, 25 bp, Mus musculus
ccttctcggcctaacagagtcaaaa

SEQ ID NO: 358287 - DNA, 25 bp, Mus musculus
ccttctcggccttacagagtcaaaa

SEQ ID NO: 358288 - DNA, 25 bp, Mus musculus
ccttctctaaccctgtgtactaaat

SEQ ID NO: 358289 - DNA, 25 bp, Mus musculus
ccttctctaaccgtgtgtactaaat

SEQ ID NO: 358290 - DNA, 25 bp, Mus musculus
ccttctctaactatgtgtgtaggac

SEQ ID NO: 358291 - DNA, 25 bp, Mus musculus
ccttctctaactttgtgtgtaggac

SEQ ID NO: 358292 - DNA, 25 bp, Mus musculus
ccttctctcagtaatgtgaccttta

SEQ ID NO: 358293 - DNA, 25 bp, Mus musculus
ccttctctcagttatgtgaccttta

SEQ ID NO: 358294 - DNA, 25 bp, Mus musculus
ccttctctccggattcaagattcaa

SEQ ID NO: 358295 - DNA, 25 bp, Mus musculus
ccttctctccggtttcaagattcaa

SEQ ID NO: 358296 - DNA, 25 bp, Mus musculus
ccttctctctgtatacaggagctga

SEQ ID NO: 358297 - DNA, 25 bp, Mus musculus
ccttctctctgtttacaggagctga

SEQ ID NO: 358298 - DNA, 25 bp, Mus musculus
ccttctctgaacactggcatacata

SEQ ID NO: 358299 - DNA, 25 bp, Mus musculus
ccttctctgaactctggcatacata

SEQ ID NO: 358300 - DNA, 25 bp, Mus musculus
ccttctctgactacagacagtaata

SEQ ID NO: 358301 - DNA, 25 bp, Mus musculus
ccttctctgacttcagacagtaata

SEQ ID NO: 358302 - DNA, 25 bp, Mus musculus
ccttctctgaggacagcagctattt

SEQ ID NO: 358303 - DNA, 25 bp, Mus musculus
ccttctctgaggtcagcagctattt

SEQ ID NO: 358304 - DNA, 25 bp, Mus musculus
ccttctctggcaatccctggttcta

SEQ ID NO: 358305 - DNA, 25 bp, Mus musculus
ccttctctggcattccctggttcta

SEQ ID NO: 358306 - DNA, 25 bp, Mus musculus
ccttctcttagaacgtgcatttcca

SEQ ID NO: 358307 - DNA, 25 bp, Mus musculus
ccttctcttagatcgtgcatttcca

SEQ ID NO: 358308 - DNA, 25 bp, Mus musculus
ccttctctttatcgtgggactcaca

SEQ ID NO: 358309 - DNA, 25 bp, Mus musculus
ccttctctttatggtgggactcaca

SEQ ID NO: 358310 - DNA, 25 bp, Mus musculus
ccttctctttcaagtgcacttgtta

SEQ ID NO: 358311 - DNA, 25 bp, Mus musculus
ccttctctttcatgtgcacttgtta

SEQ ID NO: 358312 - DNA, 25 bp, Mus musculus
ccttctctttgtcccatttcagatt

SEQ ID NO: 358313 - DNA, 25 bp, Mus musculus
ccttctctttgtctactcactggaa

SEQ ID NO: 358314 - DNA, 25 bp, Mus musculus
ccttctctttgtgccatttcagatt

SEQ ID NO: 358315 - DNA, 25 bp, Mus musculus
ccttctctttgtgtactcactggaa

SEQ ID NO: 358316 - DNA, 25 bp, Mus musculus
ccttctcttttcacatcagatacca

SEQ ID NO: 358317 - DNA, 25 bp, Mus musculus
ccttctcttttctcatcagatacca

SEQ ID NO: 358318 - DNA, 25 bp, Mus musculus
ccttctgaatgaattttggcatctc

SEQ ID NO: 358319 - DNA, 25 bp, Mus musculus
ccttctgaatgatttttggcatctc

SEQ ID NO: 358320 - DNA, 25 bp, Mus musculus
ccttctgaattcaacaagcatattt

SEQ ID NO: 358321 - DNA, 25 bp, Mus musculus
ccttctgaattctacaagcatattt

SEQ ID NO: 358322 - DNA, 25 bp, Mus musculus
ccttctgagcccaactagaggagta

SEQ ID NO: 358323 - DNA, 25 bp, Mus musculus
ccttctgagccctactagaggagta

SEQ ID NO: 358324 - DNA, 25 bp, Mus musculus
ccttctgaggtacgcagcagccagt

SEQ ID NO: 358325 - DNA, 25 bp, Mus musculus
ccttctgaggtaggcagcagccagt

SEQ ID NO: 358326 - DNA, 25 bp, Mus musculus
ccttctgatcaactggtgcacaggt

SEQ ID NO: 358327 - DNA, 25 bp, Mus musculus
ccttctgatcaagtggtgcacaggt

SEQ ID NO: 358328 - DNA, 25 bp, Mus musculus
ccttctgcacaaaccatcagtgtta

SEQ ID NO: 358329 - DNA, 25 bp, Mus musculus
ccttctgcacaatccatcagtgtta

SEQ ID NO: 358330 - DNA, 25 bp, Mus musculus
ccttctgcactgacttccagaaaat

SEQ ID NO: 358331 - DNA, 25 bp, Mus musculus
ccttctgcactgtcttccagaaaat

SEQ ID NO: 358332 - DNA, 25 bp, Mus musculus
ccttctgccctaagttatagttaat

SEQ ID NO: 358333 - DNA, 25 bp, Mus musculus
ccttctgccctatgttatagttaat

SEQ ID NO: 358334 - DNA, 25 bp, Mus musculus
ccttctgccctgactgtataaatct

SEQ ID NO: 358335 - DNA, 25 bp, Mus musculus
ccttctgccctgtctgtataaatct

SEQ ID NO: 358336 - DNA, 25 bp, Mus musculus
ccttctgcctgcctcttaaaaaata

SEQ ID NO: 358337 - DNA, 25 bp, Mus musculus
ccttctgcctgcgtcttaaaaaata

SEQ ID NO: 358338 - DNA, 25 bp, Mus musculus
ccttctgccttcaacaatagtccaa

SEQ ID NO: 358339 - DNA, 25 bp, Mus musculus
ccttctgccttctacaatagtccaa

SEQ ID NO: 358340 - DNA, 25 bp, Mus musculus
ccttctgcctttagtggatcagcaa

SEQ ID NO: 358341 - DNA, 25 bp, Mus musculus
ccttctgccttttgtggatcagcaa

SEQ ID NO: 358342 - DNA, 25 bp, Mus musculus
ccttctgctcatatttcctgagtca

SEQ ID NO: 358343 - DNA, 25 bp, Mus musculus
ccttctgctcatttttcctgagtca

SEQ ID NO: 358344 - DNA, 25 bp, Mus musculus
ccttctgctgtactctgaaatgctt

SEQ ID NO: 358345 - DNA, 25 bp, Mus musculus
ccttctgctgtagtctgaaatgctt

SEQ ID NO: 358346 - DNA, 25 bp, Mus musculus
ccttctggaagccatcttggtcata

SEQ ID NO: 358347 - DNA, 25 bp, Mus musculus
ccttctggaagcgatcttggtcata

SEQ ID NO: 358348 - DNA, 25 bp, Mus musculus
ccttctggaaggcataactggcttt

SEQ ID NO: 358349 - DNA, 25 bp, Mus musculus
ccttctggaagggataactggcttt

SEQ ID NO: 358350 - DNA, 25 bp, Mus musculus
ccttctgggacgatcctgtagtggt

SEQ ID NO: 358351 - DNA, 25 bp, Mus musculus
ccttctgggacgttcctgtagtggt

SEQ ID NO: 358352 - DNA, 25 bp, Mus musculus
ccttctgggattctgttggtaacaa

SEQ ID NO: 358353 - DNA, 25 bp, Mus musculus
ccttctgggattgtgttggtaacaa

SEQ ID NO: 358354 - DNA, 25 bp, Mus musculus
ccttctgggtatctctttcttctaa

SEQ ID NO: 358355 - DNA, 25 bp, Mus musculus
ccttctgggtatgtctttcttctaa

SEQ ID NO: 358356 - DNA, 25 bp, Mus musculus
ccttctggtagtaggagcttcaaaa

SEQ ID NO: 358357 - DNA, 25 bp, Mus musculus
ccttctggtagttggagcttcaaaa

SEQ ID NO: 358358 - DNA, 25 bp, Mus musculus
ccttctggtgatatctctaatatgc

SEQ ID NO: 358359 - DNA, 25 bp, Mus musculus
ccttctggtgatttctctaatatgc

SEQ ID NO: 358360 - DNA, 25 bp, Mus musculus
ccttctggtggtaaacatgcctttt

SEQ ID NO: 358361 - DNA, 25 bp, Mus musculus
ccttctggtggttaacatgcctttt

SEQ ID NO: 358362 - DNA, 25 bp, Mus musculus
ccttctgtaaggcagatagcgcctt

SEQ ID NO: 358363 - DNA, 25 bp, Mus musculus
ccttctgtaagggagatagcgcctt

SEQ ID NO: 358364 - DNA, 25 bp, Mus musculus
ccttctgtagtgcacaccgggctga

SEQ ID NO: 358365 - DNA, 25 bp, Mus musculus
ccttctgtagtggacaccgggctga

SEQ ID NO: 358366 - DNA, 25 bp, Mus musculus
ccttctgtatggcttttcgtgatca

SEQ ID NO: 358367 - DNA, 25 bp, Mus musculus
ccttctgtatgggttttcgtgatca

SEQ ID NO: 358368 - DNA, 25 bp, Mus musculus
ccttctgtccaaaattcactattcc

SEQ ID NO: 358369 - DNA, 25 bp, Mus musculus
ccttctgtccaatattcactattcc

SEQ ID NO: 358370 - DNA, 25 bp, Mus musculus
ccttctgtgagtacaagagcctggg

SEQ ID NO: 358371 - DNA, 25 bp, Mus musculus
ccttctgtgagttcaagagcctggg

SEQ ID NO: 358372 - DNA, 25 bp, Mus musculus
ccttctgtgcagagcttatgatcca

SEQ ID NO: 358373 - DNA, 25 bp, Mus musculus
ccttctgtgcagtgcttatgatcca

SEQ ID NO: 358374 - DNA, 25 bp, Mus musculus
ccttctgtgggaaaagctctctgac

SEQ ID NO: 358375 - DNA, 25 bp, Mus musculus
ccttctgtgggataagctctctgac

SEQ ID NO: 358376 - DNA, 25 bp, Mus musculus
ccttctgtgtctccgaggccaatgc

SEQ ID NO: 358377 - DNA, 25 bp, Mus musculus
ccttctgtgtctgcgaggccaatgc

SEQ ID NO: 358378 - DNA, 25 bp, Mus musculus
ccttctgttctgagttttgtagcaa

SEQ ID NO: 358379 - DNA, 25 bp, Mus musculus
ccttctgttctgtgttttgtagcaa

SEQ ID NO: 358380 - DNA, 25 bp, Mus musculus
ccttctgtttccagttctcttcaca

SEQ ID NO: 358381 - DNA, 25 bp, Mus musculus
ccttctgtttcctgttctcttcaca

SEQ ID NO: 358382 - DNA, 25 bp, Mus musculus
ccttctgtttctagagatagcttca

SEQ ID NO: 358383 - DNA, 25 bp, Mus musculus
ccttctgtttcttgagatagcttca

SEQ ID NO: 358384 - DNA, 25 bp, Mus musculus
ccttcttaactcaaataactactct

SEQ ID NO: 358385 - DNA, 25 bp, Mus musculus
ccttcttaactctaataactactct

SEQ ID NO: 358386 - DNA, 25 bp, Mus musculus
ccttcttaccacaatgttttggcat

SEQ ID NO: 358387 - DNA, 25 bp, Mus musculus
ccttcttaccactatgttttggcat

SEQ ID NO: 358388 - DNA, 25 bp, Mus musculus
ccttcttactgtcactcattctaaa

SEQ ID NO: 358389 - DNA, 25 bp, Mus musculus
ccttcttactgtgactcattctaaa

SEQ ID NO: 358390 - DNA, 25 bp, Mus musculus
ccttcttagaataggcgtggccttg

SEQ ID NO: 358391 - DNA, 25 bp, Mus musculus
ccttcttagaattggcgtggccttg

SEQ ID NO: 358392 - DNA, 25 bp, Mus musculus
ccttcttagcttcatctgcagatgt

SEQ ID NO: 358393 - DNA, 25 bp, Mus musculus
ccttcttagcttgatctgcagatgt

SEQ ID NO: 358394 - DNA, 25 bp, Mus musculus
ccttcttagtagaaggcctggactc

SEQ ID NO: 358395 - DNA, 25 bp, Mus musculus
ccttcttagtagtaggcctggactc

SEQ ID NO: 358396 - DNA, 25 bp, Mus musculus
ccttcttcaatgactggttcagcgg

SEQ ID NO: 358397 - DNA, 25 bp, Mus musculus
ccttcttcaatgtctggttcagcgg

SEQ ID NO: 358398 - DNA, 25 bp, Mus musculus
ccttcttcacacatcagattcatag

SEQ ID NO: 358399 - DNA, 25 bp, Mus musculus
ccttcttcacacttcagattcatag

SEQ ID NO: 358400 - DNA, 25 bp, Mus musculus
ccttcttcagagctgtagtgtcctg

SEQ ID NO: 358401 - DNA, 25 bp, Mus musculus
ccttcttcagaggtgtagtgtcctg

SEQ ID NO: 358402 - DNA, 25 bp, Mus musculus
ccttcttcaggacgatcgactggga

SEQ ID NO: 358403 - DNA, 25 bp, Mus musculus
ccttcttcaggaggatcgactggga

SEQ ID NO: 358404 - DNA, 25 bp, Mus musculus
ccttcttcatctctcagacactgga

SEQ ID NO: 358405 - DNA, 25 bp, Mus musculus
ccttcttcatctgtcagacactgga

SEQ ID NO: 358406 - DNA, 25 bp, Mus musculus
ccttcttcccaaataatctccaagt

SEQ ID NO: 358407 - DNA, 25 bp, Mus musculus
ccttcttcccaattaatctccaagt

SEQ ID NO: 358408 - DNA, 25 bp, Mus musculus
ccttcttcccacctgatcataattt

SEQ ID NO: 358409 - DNA, 25 bp, Mus musculus
ccttcttcccacgtgatcataattt

SEQ ID NO: 358410 - DNA, 25 bp, Mus musculus
ccttcttcctgactatgcatacata

SEQ ID NO: 358411 - DNA, 25 bp, Mus musculus
ccttcttcctgagtatgcatacata

SEQ ID NO: 358412 - DNA, 25 bp, Mus musculus
ccttcttcgtatcttgttttgtaat

SEQ ID NO: 358413 - DNA, 25 bp, Mus musculus
ccttcttcgtatgttgttttgtaat

SEQ ID NO: 358414 - DNA, 25 bp, Mus musculus
ccttcttctccaatgctggatagag

SEQ ID NO: 358415 - DNA, 25 bp, Mus musculus
ccttcttctccattgctggatagag

SEQ ID NO: 358416 - DNA, 25 bp, Mus musculus
ccttcttctgaacatcatgtcccta

SEQ ID NO: 358417 - DNA, 25 bp, Mus musculus
ccttcttctgaagatcatgtcccta

SEQ ID NO: 358418 - DNA, 25 bp, Mus musculus
ccttcttctgtaactgttgccatag

SEQ ID NO: 358419 - DNA, 25 bp, Mus musculus
ccttcttctgtatctgttgccatag

SEQ ID NO: 358420 - DNA, 25 bp, Mus musculus
ccttcttgacatcagttgctttaaa

SEQ ID NO: 358421 - DNA, 25 bp, Mus musculus
ccttcttgacatgagttgctttaaa

SEQ ID NO: 358422 - DNA, 25 bp, Mus musculus
ccttcttgccttagcagtcaggaaa

SEQ ID NO: 358423 - DNA, 25 bp, Mus musculus
ccttcttgcctttgcagtcaggaaa

SEQ ID NO: 358424 - DNA, 25 bp, Mus musculus
ccttcttgctgcacggtgttctttg

SEQ ID NO: 358425 - DNA, 25 bp, Mus musculus
ccttcttgctgctcggtgttctttg

SEQ ID NO: 358426 - DNA, 25 bp, Mus musculus
ccttcttggtagcttacagttatct

SEQ ID NO: 358427 - DNA, 25 bp, Mus musculus
ccttcttggtaggttacagttatct

SEQ ID NO: 358428 - DNA, 25 bp, Mus musculus
ccttcttgttttcatcctgggaaat

SEQ ID NO: 358429 - DNA, 25 bp, Mus musculus
ccttcttgttttgatcctgggaaat

SEQ ID NO: 358430 - DNA, 25 bp, Mus musculus
ccttctttactgccctggtgaaata

SEQ ID NO: 358431 - DNA, 25 bp, Mus musculus
ccttctttactggcctggtgaaata

SEQ ID NO: 358432 - DNA, 25 bp, Mus musculus
ccttctttaggaccagcgcaacact

SEQ ID NO: 358433 - DNA, 25 bp, Mus musculus
ccttctttaggagcagcgcaacact

SEQ ID NO: 358434 - DNA, 25 bp, Mus musculus
ccttctttccatcatgctgggtaaa

SEQ ID NO: 358435 - DNA, 25 bp, Mus musculus
ccttctttccatgatgctgggtaaa

SEQ ID NO: 358436 - DNA, 25 bp, Mus musculus
ccttctttcgccattgcaccagagt

SEQ ID NO: 358437 - DNA, 25 bp, Mus musculus
ccttctttcgcctttgcaccagagt

SEQ ID NO: 358438 - DNA, 25 bp, Mus musculus
ccttctttgaccaaggcattgtttt

SEQ ID NO: 358439 - DNA, 25 bp, Mus musculus
ccttctttgacctaggcattgtttt

SEQ ID NO: 358440 - DNA, 25 bp, Mus musculus
ccttctttgactctcagggctgata

SEQ ID NO: 358441 - DNA, 25 bp, Mus musculus
ccttctttgactgtcagggctgata

SEQ ID NO: 358442 - DNA, 25 bp, Mus musculus
ccttctttgaggctgactgttggga

SEQ ID NO: 358443 - DNA, 25 bp, Mus musculus
ccttctttgaggcttcatgaatatt

SEQ ID NO: 358444 - DNA, 25 bp, Mus musculus
ccttctttgagggtgactgttggga

SEQ ID NO: 358445 - DNA, 25 bp, Mus musculus
ccttctttgagggttcatgaatatt

SEQ ID NO: 358446 - DNA, 25 bp, Mus musculus
ccttctttgcttactttacacacaa

SEQ ID NO: 358447 - DNA, 25 bp, Mus musculus
ccttctttgctttctttacacacaa

SEQ ID NO: 358448 - DNA, 25 bp, Mus musculus
ccttctttgtcacacagccaaactg

SEQ ID NO: 358449 - DNA, 25 bp, Mus musculus
ccttctttgtcagacagccaaactg

SEQ ID NO: 358450 - DNA, 25 bp, Mus musculus
ccttctttgtgactggctcagaact

SEQ ID NO: 358451 - DNA, 25 bp, Mus musculus
ccttctttgtgagtggctcagaact

SEQ ID NO: 358452 - DNA, 25 bp, Mus musculus
ccttctttttgtaatgttgtcacca

SEQ ID NO: 358453 - DNA, 25 bp, Mus musculus
ccttctttttgttatgttgtcacca

SEQ ID NO: 358454 - DNA, 25 bp, Mus musculus
ccttgaaagcacatcatgtttaata

SEQ ID NO: 358455 - DNA, 25 bp, Mus musculus
ccttgaaagcacttcatgtttaata

SEQ ID NO: 358456 - DNA, 25 bp, Mus musculus
ccttgaacaagcagtggtttattag

SEQ ID NO: 358457 - DNA, 25 bp, Mus musculus
ccttgaacaagctgtggtttattag

SEQ ID NO: 358458 - DNA, 25 bp, Mus musculus
ccttgaacacacagctgtttgagca

SEQ ID NO: 358459 - DNA, 25 bp, Mus musculus
ccttgaacacactgctgtttgagca

SEQ ID NO: 358460 - DNA, 25 bp, Mus musculus
ccttgaacagcacctccttggcagg

SEQ ID NO: 358461 - DNA, 25 bp, Mus musculus
ccttgaacagcagctccttggcagg

SEQ ID NO: 358462 - DNA, 25 bp, Mus musculus
ccttgaacattaccaaagagaatgg

SEQ ID NO: 358463 - DNA, 25 bp, Mus musculus
ccttgaacattagcaaagagaatgg

SEQ ID NO: 358464 - DNA, 25 bp, Mus musculus
ccttgaacatttccctctctgagaa

SEQ ID NO: 358465 - DNA, 25 bp, Mus musculus
ccttgaacatttgcctctctgagaa

SEQ ID NO: 358466 - DNA, 25 bp, Mus musculus
ccttgaacccaaagttaggctggat

SEQ ID NO: 358467 - DNA, 25 bp, Mus musculus
ccttgaacccaatgttaggctggat

SEQ ID NO: 358468 - DNA, 25 bp, Mus musculus
ccttgaaccttcacacctgagttaa

SEQ ID NO: 358469 - DNA, 25 bp, Mus musculus
ccttgaaccttctcacctgagttaa

SEQ ID NO: 358470 - DNA, 25 bp, Mus musculus
ccttgaactttcagtatgtcataga

SEQ ID NO: 358471 - DNA, 25 bp, Mus musculus
ccttgaactttctgtatgtcataga

SEQ ID NO: 358472 - DNA, 25 bp, Mus musculus
ccttgaactttgctgcgtagctgag

SEQ ID NO: 358473 - DNA, 25 bp, Mus musculus
ccttgaactttggtgcgtagctgag

SEQ ID NO: 358474 - DNA, 25 bp, Mus musculus
ccttgaagacttcagcaggctgtaa

SEQ ID NO: 358475 - DNA, 25 bp, Mus musculus
ccttgaagacttgagcaggctgtaa

SEQ ID NO: 358476 - DNA, 25 bp, Mus musculus
ccttgaagaggcagttgagagccca

SEQ ID NO: 358477 - DNA, 25 bp, Mus musculus
ccttgaagaggctgttgagagccca

SEQ ID NO: 358478 - DNA, 25 bp, Mus musculus
ccttgaagcttcctttatcctaact

SEQ ID NO: 358479 - DNA, 25 bp, Mus musculus
ccttgaagcttcgtttatcctaact

SEQ ID NO: 358480 - DNA, 25 bp, Mus musculus
ccttgaagtggtatttgtgggtgtg

SEQ ID NO: 358481 - DNA, 25 bp, Mus musculus
ccttgaagtggtttttgtgggtgtg

SEQ ID NO: 358482 - DNA, 25 bp, Mus musculus
ccttgaattacgactgcagctgaaa

SEQ ID NO: 358483 - DNA, 25 bp, Mus musculus
ccttgaattacgtctgcagctgaaa

SEQ ID NO: 358484 - DNA, 25 bp, Mus musculus
ccttgaattcaaccacgtgggaagt

SEQ ID NO: 358485 - DNA, 25 bp, Mus musculus
ccttgaattcaagcacgtgggaagt

SEQ ID NO: 358486 - DNA, 25 bp, Mus musculus
ccttgaatttcccttgcatacacaa

SEQ ID NO: 358487 - DNA, 25 bp, Mus musculus
ccttgaatttccgttgcatacacaa

SEQ ID NO: 358488 - DNA, 25 bp, Mus musculus
ccttgacagaatacatccatcattt

SEQ ID NO: 358489 - DNA, 25 bp, Mus musculus
ccttgacagaattcatccatcattt

SEQ ID NO: 358490 - DNA, 25 bp, Mus musculus
ccttgacattggagctatcttcttt

SEQ ID NO: 358491 - DNA, 25 bp, Mus musculus
ccttgacattggtgctatcttcttt

SEQ ID NO: 358492 - DNA, 25 bp, Mus musculus
ccttgaccctgcacttagaattggt

SEQ ID NO: 358493 - DNA, 25 bp, Mus musculus
ccttgaccctgctcttagaattggt

SEQ ID NO: 358494 - DNA, 25 bp, Mus musculus
ccttgacccttgaatacagtttctc

SEQ ID NO: 358495 - DNA, 25 bp, Mus musculus
ccttgacccttgtatacagtttctc

SEQ ID NO: 358496 - DNA, 25 bp, Mus musculus
ccttgacctccaatctaatctcaaa

SEQ ID NO: 358497 - DNA, 25 bp, Mus musculus
ccttgacctccattctaatctcaaa

SEQ ID NO: 358498 - DNA, 25 bp, Mus musculus
ccttgacctcccagtaaacacaatt

SEQ ID NO: 358499 - DNA, 25 bp, Mus musculus
ccttgacctccctgtaaacacaatt

SEQ ID NO: 358500 - DNA, 25 bp, Mus musculus
ccttgaccttgaccctgtgttaaag

SEQ ID NO: 358501 - DNA, 25 bp, Mus musculus
ccttgaccttgagcctgtgttaaag

SEQ ID NO: 358502 - DNA, 25 bp, Mus musculus
ccttgaccttgtactaacatacctc

SEQ ID NO: 358503 - DNA, 25 bp, Mus musculus
ccttgaccttgttctaacatacctc

SEQ ID NO: 358504 - DNA, 25 bp, Mus musculus
ccttgaccttttccataattttcat

SEQ ID NO: 358505 - DNA, 25 bp, Mus musculus
ccttgaccttttgcataattttcat

SEQ ID NO: 358506 - DNA, 25 bp, Mus musculus
ccttgactaagccactgactgactg

SEQ ID NO: 358507 - DNA, 25 bp, Mus musculus
ccttgactaagcgactgactgactg

SEQ ID NO: 358508 - DNA, 25 bp, Mus musculus
ccttgactacaaacatttcgctctg

SEQ ID NO: 358509 - DNA, 25 bp, Mus musculus
ccttgactacaatcatttcgctctg

SEQ ID NO: 358510 - DNA, 25 bp, Mus musculus
ccttgactcaagcaccggcaaaaga

SEQ ID NO: 358511 - DNA, 25 bp, Mus musculus
ccttgactcaaggaccggcaaaaga

SEQ ID NO: 358512 - DNA, 25 bp, Mus musculus
ccttgactctgaacttcaggtggca

SEQ ID NO: 358513 - DNA, 25 bp, Mus musculus
ccttgactctgatcttcaggtggca

SEQ ID NO: 358514 - DNA, 25 bp, Mus musculus
ccttgactgtacagggtctgtgaag

SEQ ID NO: 358515 - DNA, 25 bp, Mus musculus
ccttgactgtactgggtctgtgaag

SEQ ID NO: 358516 - DNA, 25 bp, Mus musculus
ccttgactttcacatcagaacccat

SEQ ID NO: 358517 - DNA, 25 bp, Mus musculus
ccttgactttcagatcagaacccat

SEQ ID NO: 358518 - DNA, 25 bp, Mus musculus
ccttgactttccctaaagcaaccag

SEQ ID NO: 358519 - DNA, 25 bp, Mus musculus
ccttgactttccgtaaagcaaccag

SEQ ID NO: 358520 - DNA, 25 bp, Mus musculus
ccttgagaaataccactgtaatagt

SEQ ID NO: 358521 - DNA, 25 bp, Mus musculus
ccttgagaaatagcactgtaatagt

SEQ ID NO: 358522 - DNA, 25 bp, Mus musculus
ccttgagaagttattattacctagc

SEQ ID NO: 358523 - DNA, 25 bp, Mus musculus
ccttgagaagtttttattacctagc

SEQ ID NO: 358524 - DNA, 25 bp, Mus musculus
ccttgagaatttacagacttacaat

SEQ ID NO: 358525 - DNA, 25 bp, Mus musculus
ccttgagaattttcagacttacaat

SEQ ID NO: 358526 - DNA, 25 bp, Mus musculus
ccttgagactatctgatgttggctt

SEQ ID NO: 358527 - DNA, 25 bp, Mus musculus
ccttgagactatgtgatgttggctt

SEQ ID NO: 358528 - DNA, 25 bp, Mus musculus
ccttgagagaggaagaaattgttca

SEQ ID NO: 358529 - DNA, 25 bp, Mus musculus
ccttgagagaggtagaaattgttca

SEQ ID NO: 358530 - DNA, 25 bp, Mus musculus
ccttgagagcatatgcaagaatgct

SEQ ID NO: 358531 - DNA, 25 bp, Mus musculus
ccttgagagcatttgcaagaatgct

SEQ ID NO: 358532 - DNA, 25 bp, Mus musculus
ccttgagaggatcttcccagtgtca

SEQ ID NO: 358533 - DNA, 25 bp, Mus musculus
ccttgagaggatgttcccagtgtca

SEQ ID NO: 358534 - DNA, 25 bp, Mus musculus
ccttgagagtggatggtgcctttga

SEQ ID NO: 358535 - DNA, 25 bp, Mus musculus
ccttgagagtggttggtgcctttga

SEQ ID NO: 358536 - DNA, 25 bp, Mus musculus
ccttgagattgcacactcagtgacc

SEQ ID NO: 358537 - DNA, 25 bp, Mus musculus
ccttgagattgctcactcagtgacc

SEQ ID NO: 358538 - DNA, 25 bp, Mus musculus
ccttgagcacctcagggacattttt

SEQ ID NO: 358539 - DNA, 25 bp, Mus musculus
ccttgagcacctgagggacattttt

SEQ ID NO: 358540 - DNA, 25 bp, Mus musculus
ccttgagctggaactgccagtactt

SEQ ID NO: 358541 - DNA, 25 bp, Mus musculus
ccttgagctggatctgccagtactt

SEQ ID NO: 358542 - DNA, 25 bp, Mus musculus
ccttgagctttgctgtgaacaaccc

SEQ ID NO: 358543 - DNA, 25 bp, Mus musculus
ccttgagctttggtgtgaacaaccc

SEQ ID NO: 358544 - DNA, 25 bp, Mus musculus
ccttgaggacataattccttaaatt

SEQ ID NO: 358545 - DNA, 25 bp, Mus musculus
ccttgaggacattattccttaaatt

SEQ ID NO: 358546 - DNA, 25 bp, Mus musculus
ccttgaggatgaccagtgaactgca

SEQ ID NO: 358547 - DNA, 25 bp, Mus musculus
ccttgaggatgagcagtgaactgca

SEQ ID NO: 358548 - DNA, 25 bp, Mus musculus
ccttgaggatggaagagcttaggat

SEQ ID NO: 358549 - DNA, 25 bp, Mus musculus
ccttgaggatggtagagcttaggat

SEQ ID NO: 358550 - DNA, 25 bp, Mus musculus
ccttgaggccagaaaattattcttg

SEQ ID NO: 358551 - DNA, 25 bp, Mus musculus
ccttgaggccagtaaattattcttg

SEQ ID NO: 358552 - DNA, 25 bp, Mus musculus
ccttgaggccctaataacgttcatg

SEQ ID NO: 358553 - DNA, 25 bp, Mus musculus
ccttgaggcccttataacgttcatg

SEQ ID NO: 358554 - DNA, 25 bp, Mus musculus
ccttgagggaaacccatgtgacgtt

SEQ ID NO: 358555 - DNA, 25 bp, Mus musculus
ccttgagggaaagccatgtgacgtt

SEQ ID NO: 358556 - DNA, 25 bp, Mus musculus
ccttgaggtagacacaggccgagtt

SEQ ID NO: 358557 - DNA, 25 bp, Mus musculus
ccttgaggtagagacaggccgagtt

SEQ ID NO: 358558 - DNA, 25 bp, Mus musculus
ccttgaggttttccggcgatttgtg

SEQ ID NO: 358559 - DNA, 25 bp, Mus musculus
ccttgaggttttgcggcgatttgtg

SEQ ID NO: 358560 - DNA, 25 bp, Mus musculus
ccttgatactacaccagttgccaat

SEQ ID NO: 358561 - DNA, 25 bp, Mus musculus
ccttgatactactccagttgccaat

SEQ ID NO: 358562 - DNA, 25 bp, Mus musculus
ccttgatactgtctgagagaaaact

SEQ ID NO: 358563 - DNA, 25 bp, Mus musculus
ccttgatactgtgtgagagaaaact

SEQ ID NO: 358564 - DNA, 25 bp, Mus musculus
ccttgatctgtaaactgtatccaat

SEQ ID NO: 358565 - DNA, 25 bp, Mus musculus
ccttgatctgtatactgtatccaat

SEQ ID NO: 358566 - DNA, 25 bp, Mus musculus
ccttgatcttctagagactagacag

SEQ ID NO: 358567 - DNA, 25 bp, Mus musculus
ccttgatcttcttgagactagacag

SEQ ID NO: 358568 - DNA, 25 bp, Mus musculus
ccttgatgccctcacattttaggaa

SEQ ID NO: 358569 - DNA, 25 bp, Mus musculus
ccttgatgccctgacattttaggaa

SEQ ID NO: 358570 - DNA, 25 bp, Mus musculus
ccttgatgtaagcaagcctctcttc

SEQ ID NO: 358571 - DNA, 25 bp, Mus musculus
ccttgatgtaaggaagcctctcttc

SEQ ID NO: 358572 - DNA, 25 bp, Mus musculus
ccttgatgtgggatttcgtggcttg

SEQ ID NO: 358573 - DNA, 25 bp, Mus musculus
ccttgatgtgggttttcgtggcttg

SEQ ID NO: 358574 - DNA, 25 bp, Mus musculus
ccttgatgtgtcaggcctctctgaa

SEQ ID NO: 358575 - DNA, 25 bp, Mus musculus
ccttgatgtgtctggcctctctgaa

SEQ ID NO: 358576 - DNA, 25 bp, Mus musculus
ccttgatgttgaatccagtccggag

SEQ ID NO: 358577 - DNA, 25 bp, Mus musculus
ccttgatgttgattccagtccggag

SEQ ID NO: 358578 - DNA, 25 bp, Mus musculus
ccttgattccaaatactcgctctaa

SEQ ID NO: 358579 - DNA, 25 bp, Mus musculus
ccttgattccaattactcgctctaa

SEQ ID NO: 358580 - DNA, 25 bp, Mus musculus
ccttgattctcccttctcttattaa

SEQ ID NO: 358581 - DNA, 25 bp, Mus musculus
ccttgattctccgttctcttattaa

SEQ ID NO: 358582 - DNA, 25 bp, Mus musculus
ccttgattgaataccttacagccta

SEQ ID NO: 358583 - DNA, 25 bp, Mus musculus
ccttgattgaattccttacagccta

SEQ ID NO: 358584 - DNA, 25 bp, Mus musculus
ccttgattgatcagtaatattgcca

SEQ ID NO: 358585 - DNA, 25 bp, Mus musculus
ccttgattgatctgtaatattgcca

SEQ ID NO: 358586 - DNA, 25 bp, Mus musculus
ccttgattggctatatggttatgga

SEQ ID NO: 358587 - DNA, 25 bp, Mus musculus
ccttgattggctttatggttatgga

SEQ ID NO: 358588 - DNA, 25 bp, Mus musculus
ccttgattttccaggtcagggtgaa

SEQ ID NO: 358589 - DNA, 25 bp, Mus musculus
ccttgattttcctggtcagggtgaa

SEQ ID NO: 358590 - DNA, 25 bp, Mus musculus
ccttgatttttgaaactcaaagaat

SEQ ID NO: 358591 - DNA, 25 bp, Mus musculus
ccttgatttttgtaactcaaagaat

SEQ ID NO: 358592 - DNA, 25 bp, Mus musculus
ccttgcaacgcgctgaatggaagaa

SEQ ID NO: 358593 - DNA, 25 bp, Mus musculus
ccttgcaacgcggtgaatggaagaa

SEQ ID NO: 358594 - DNA, 25 bp, Mus musculus
ccttgcaactgaattcatttctaat

SEQ ID NO: 358595 - DNA, 25 bp, Mus musculus
ccttgcaactgatttcatttctaat

SEQ ID NO: 358596 - DNA, 25 bp, Mus musculus
ccttgcacagggactttaccttgca

SEQ ID NO: 358597 - DNA, 25 bp, Mus musculus
ccttgcacagggatgacatagaaag

SEQ ID NO: 358598 - DNA, 25 bp, Mus musculus
ccttgcacagggtctttaccttgca

SEQ ID NO: 358599 - DNA, 25 bp, Mus musculus
ccttgcacagggttgacatagaaag

SEQ ID NO: 358600 - DNA, 25 bp, Mus musculus
ccttgcacaggtccgtgtgactcat

SEQ ID NO: 358601 - DNA, 25 bp, Mus musculus
ccttgcacaggtgcgtgtgactcat

SEQ ID NO: 358602 - DNA, 25 bp, Mus musculus
ccttgcaccgatcggctttcatgat

SEQ ID NO: 358603 - DNA, 25 bp, Mus musculus
ccttgcaccgatgggctttcatgat

SEQ ID NO: 358604 - DNA, 25 bp, Mus musculus
ccttgcactcctctttattcttaaa

SEQ ID NO: 358605 - DNA, 25 bp, Mus musculus
ccttgcactcctgtttattcttaaa

SEQ ID NO: 358606 - DNA, 25 bp, Mus musculus
ccttgcacttaaacctcttacttta

SEQ ID NO: 358607 - DNA, 25 bp, Mus musculus
ccttgcacttaatcctcttacttta

SEQ ID NO: 358608 - DNA, 25 bp, Mus musculus
ccttgcagactaagccgacgatggt

SEQ ID NO: 358609 - DNA, 25 bp, Mus musculus
ccttgcagactatgccgacgatggt

SEQ ID NO: 358610 - DNA, 25 bp, Mus musculus
ccttgcagattgagagatgtaatga

SEQ ID NO: 358611 - DNA, 25 bp, Mus musculus
ccttgcagattgtgagatgtaatga

SEQ ID NO: 358612 - DNA, 25 bp, Mus musculus
ccttgcagccctacgtgttgaggtt

SEQ ID NO: 358613 - DNA, 25 bp, Mus musculus
ccttgcagcccttcgtgttgaggtt

SEQ ID NO: 358614 - DNA, 25 bp, Mus musculus
ccttgcagcgggagaaagtgaagcc

SEQ ID NO: 358615 - DNA, 25 bp, Mus musculus
ccttgcagcgggtgaaagtgaagcc

SEQ ID NO: 358616 - DNA, 25 bp, Mus musculus
ccttgcagcgtaagcaggagaggac

SEQ ID NO: 358617 - DNA, 25 bp, Mus musculus
ccttgcagcgtatgcaggagaggac

SEQ ID NO: 358618 - DNA, 25 bp, Mus musculus
ccttgcaggctgcagggctttagca

SEQ ID NO: 358619 - DNA, 25 bp, Mus musculus
ccttgcaggctggagggctttagca

SEQ ID NO: 358620 - DNA, 25 bp, Mus musculus
ccttgcaggtttatggccgtcagga

SEQ ID NO: 358621 - DNA, 25 bp, Mus musculus
ccttgcaggtttttggccgtcagga

SEQ ID NO: 358622 - DNA, 25 bp, Mus musculus
ccttgcagtgggacagggttactca

SEQ ID NO: 358623 - DNA, 25 bp, Mus musculus
ccttgcagtgggtcagggttactca

SEQ ID NO: 358624 - DNA, 25 bp, Mus musculus
ccttgcagtttcatgtggtgtacaa

SEQ ID NO: 358625 - DNA, 25 bp, Mus musculus
ccttgcagtttcttgtggtgtacaa

SEQ ID NO: 358626 - DNA, 25 bp, Mus musculus
ccttgcatacagaaggcgcccaata

SEQ ID NO: 358627 - DNA, 25 bp, Mus musculus
ccttgcatacagtaggcgcccaata

SEQ ID NO: 358628 - DNA, 25 bp, Mus musculus
ccttgcatcataactgtccaggcta

SEQ ID NO: 358629 - DNA, 25 bp, Mus musculus
ccttgcatcatatctgtccaggcta

SEQ ID NO: 358630 - DNA, 25 bp, Mus musculus
ccttgcatccaacccgaatatgtag

SEQ ID NO: 358631 - DNA, 25 bp, Mus musculus
ccttgcatccaagccgaatatgtag

SEQ ID NO: 358632 - DNA, 25 bp, Mus musculus
ccttgcatctccagctttgttaata

SEQ ID NO: 358633 - DNA, 25 bp, Mus musculus
ccttgcatctcctgctttgttaata

SEQ ID NO: 358634 - DNA, 25 bp, Mus musculus
ccttgccaagctactcttaggattg

SEQ ID NO: 358635 - DNA, 25 bp, Mus musculus
ccttgccaagcttctcttaggattg

SEQ ID NO: 358636 - DNA, 25 bp, Mus musculus
ccttgccacaaccttctgaagagaa

SEQ ID NO: 358637 - DNA, 25 bp, Mus musculus
ccttgccacaacgttctgaagagaa

SEQ ID NO: 358638 - DNA, 25 bp, Mus musculus
ccttgccacaggcactgtaccttaa

SEQ ID NO: 358639 - DNA, 25 bp, Mus musculus
ccttgccacagggactgtaccttaa

SEQ ID NO: 358640 - DNA, 25 bp, Mus musculus
ccttgccagtgtacgaggttttcga

SEQ ID NO: 358641 - DNA, 25 bp, Mus musculus
ccttgccagtgttcgaggttttcga

SEQ ID NO: 358642 - DNA, 25 bp, Mus musculus
ccttgccatcaactccatgtggtgg

SEQ ID NO: 358643 - DNA, 25 bp, Mus musculus
ccttgccatcaagtccatgtggtgg

SEQ ID NO: 358644 - DNA, 25 bp, Mus musculus
ccttgcccaggtaaattatttgatg

SEQ ID NO: 358645 - DNA, 25 bp, Mus musculus
ccttgcccaggttaattatttgatg

SEQ ID NO: 358646 - DNA, 25 bp, Mus musculus
ccttgcccagtgctgacctagtgtg

SEQ ID NO: 358647 - DNA, 25 bp, Mus musculus
ccttgcccagtggtgacctagtgtg

SEQ ID NO: 358648 - DNA, 25 bp, Mus musculus
ccttgccccttacagcatggaggta

SEQ ID NO: 358649 - DNA, 25 bp, Mus musculus
ccttgccccttagagcatggaggta

SEQ ID NO: 358650 - DNA, 25 bp, Mus musculus
ccttgcccggctcgactatcataag

SEQ ID NO: 358651 - DNA, 25 bp, Mus musculus
ccttgcccggctggactatcataag

SEQ ID NO: 358652 - DNA, 25 bp, Mus musculus
ccttgccctagacctagctttagaa

SEQ ID NO: 358653 - DNA, 25 bp, Mus musculus
ccttgccctagagctagctttagaa

SEQ ID NO: 358654 - DNA, 25 bp, Mus musculus
ccttgccctagtcgatcagttacag

SEQ ID NO: 358655 - DNA, 25 bp, Mus musculus
ccttgccctagtggatcagttacag

SEQ ID NO: 358656 - DNA, 25 bp, Mus musculus
ccttgccctgtcagaactgtgatgt

SEQ ID NO: 358657 - DNA, 25 bp, Mus musculus
ccttgccctgtctgaactgtgatgt

SEQ ID NO: 358658 - DNA, 25 bp, Mus musculus
ccttgccgccgaacagataaactta

SEQ ID NO: 358659 - DNA, 25 bp, Mus musculus
ccttgccgccgatcagataaactta

SEQ ID NO: 358660 - DNA, 25 bp, Mus musculus
ccttgccgtgcaaggaaacctggag

SEQ ID NO: 358661 - DNA, 25 bp, Mus musculus
ccttgccgtgcatggaaacctggag

SEQ ID NO: 358662 - DNA, 25 bp, Mus musculus
ccttgcctactgagaatgtatttta

SEQ ID NO: 358663 - DNA, 25 bp, Mus musculus
ccttgcctactgtgaatgtatttta

SEQ ID NO: 358664 - DNA, 25 bp, Mus musculus
ccttgcctcagtcgtcggagatgga

SEQ ID NO: 358665 - DNA, 25 bp, Mus musculus
ccttgcctcagtggtcggagatgga

SEQ ID NO: 358666 - DNA, 25 bp, Mus musculus
ccttgcctcttactctaatgcttaa

SEQ ID NO: 358667 - DNA, 25 bp, Mus musculus
ccttgcctcttagtctaatgcttaa

SEQ ID NO: 358668 - DNA, 25 bp, Mus musculus
ccttgcctgagcatgcgcagtgaaa

SEQ ID NO: 358669 - DNA, 25 bp, Mus musculus
ccttgcctgagcttgcgcagtgaaa

SEQ ID NO: 358670 - DNA, 25 bp, Mus musculus
ccttgcctgcttcctaagtgaattt

SEQ ID NO: 358671 - DNA, 25 bp, Mus musculus
ccttgcctgcttgctaagtgaattt

SEQ ID NO: 358672 - DNA, 25 bp, Mus musculus
ccttgcctggatagagacgtggttc

SEQ ID NO: 358673 - DNA, 25 bp, Mus musculus
ccttgcctggattgagacgtggttc

SEQ ID NO: 358674 - DNA, 25 bp, Mus musculus
ccttgccttcttccagagttgtaat

SEQ ID NO: 358675 - DNA, 25 bp, Mus musculus
ccttgccttcttgcagagttgtaat

SEQ ID NO: 358676 - DNA, 25 bp, Mus musculus
ccttgcgccggaacatggcagtgaa

SEQ ID NO: 358677 - DNA, 25 bp, Mus musculus
ccttgcgccggatcatggcagtgaa

SEQ ID NO: 358678 - DNA, 25 bp, Mus musculus
ccttgcgcgggtaagatatcagatg

SEQ ID NO: 358679 - DNA, 25 bp, Mus musculus
ccttgcgcgggttagatatcagatg

SEQ ID NO: 358680 - DNA, 25 bp, Mus musculus
ccttgcgcggtgcagagactagact

SEQ ID NO: 358681 - DNA, 25 bp, Mus musculus
ccttgcgcggtggagagactagact

SEQ ID NO: 358682 - DNA, 25 bp, Mus musculus
ccttgcggcctgaaaggttgaccgg

SEQ ID NO: 358683 - DNA, 25 bp, Mus musculus
ccttgcggcctgtaaggttgaccgg

SEQ ID NO: 358684 - DNA, 25 bp, Mus musculus
ccttgcgtttacaccgtatttatgg

SEQ ID NO: 358685 - DNA, 25 bp, Mus musculus
ccttgcgtttactccgtatttatgg

SEQ ID NO: 358686 - DNA, 25 bp, Mus musculus
ccttgctacaaactgagttctttga

SEQ ID NO: 358687 - DNA, 25 bp, Mus musculus
ccttgctacaaagtgagttctttga

SEQ ID NO: 358688 - DNA, 25 bp, Mus musculus
ccttgctacggaaccagcctaagat

SEQ ID NO: 358689 - DNA, 25 bp, Mus musculus
ccttgctacggatccagcctaagat

SEQ ID NO: 358690 - DNA, 25 bp, Mus musculus
ccttgctagcttcggcccaaagatt

SEQ ID NO: 358691 - DNA, 25 bp, Mus musculus
ccttgctagcttgggcccaaagatt

SEQ ID NO: 358692 - DNA, 25 bp, Mus musculus
ccttgctagtccatctatctttaag

SEQ ID NO: 358693 - DNA, 25 bp, Mus musculus
ccttgctagtccttctatctttaag

SEQ ID NO: 358694 - DNA, 25 bp, Mus musculus
ccttgctagttccttattgtactgc

SEQ ID NO: 358695 - DNA, 25 bp, Mus musculus
ccttgctagttcgttattgtactgc

SEQ ID NO: 358696 - DNA, 25 bp, Mus musculus
ccttgctcacctacgacagataaag

SEQ ID NO: 358697 - DNA, 25 bp, Mus musculus
ccttgctcaccttcgacagataaag

SEQ ID NO: 358698 - DNA, 25 bp, Mus musculus
ccttgctcagacatacacctgactt

SEQ ID NO: 358699 - DNA, 25 bp, Mus musculus
ccttgctcagacttacacctgactt

SEQ ID NO: 358700 - DNA, 25 bp, Mus musculus
ccttgctcgggaaaggttgcaggat

SEQ ID NO: 358701 - DNA, 25 bp, Mus musculus
ccttgctcgggataggttgcaggat

SEQ ID NO: 358702 - DNA, 25 bp, Mus musculus
ccttgctcgtagatctgggcttaca

SEQ ID NO: 358703 - DNA, 25 bp, Mus musculus
ccttgctcgtagttctgggcttaca

SEQ ID NO: 358704 - DNA, 25 bp, Mus musculus
ccttgctcttgaacctctcattgta

SEQ ID NO: 358705 - DNA, 25 bp, Mus musculus
ccttgctcttgatcctctcattgta

SEQ ID NO: 358706 - DNA, 25 bp, Mus musculus
ccttgctctttacattaagctgcag

SEQ ID NO: 358707 - DNA, 25 bp, Mus musculus
ccttgctctttagattaagctgcag

SEQ ID NO: 358708 - DNA, 25 bp, Mus musculus
ccttgctgagggatctaattgccga

SEQ ID NO: 358709 - DNA, 25 bp, Mus musculus
ccttgctgagggttctaattgccga

SEQ ID NO: 358710 - DNA, 25 bp, Mus musculus
ccttgctgcaggctgtcacaaacac

SEQ ID NO: 358711 - DNA, 25 bp, Mus musculus
ccttgctgcagggtgtcacaaacac

SEQ ID NO: 358712 - DNA, 25 bp, Mus musculus
ccttgctgctctagacattctagaa

SEQ ID NO: 358713 - DNA, 25 bp, Mus musculus
ccttgctgctcttgacattctagaa

SEQ ID NO: 358714 - DNA, 25 bp, Mus musculus
ccttgctgggttataattcttcagg

SEQ ID NO: 358715 - DNA, 25 bp, Mus musculus
ccttgctgggttttaattcttcagg

SEQ ID NO: 358716 - DNA, 25 bp, Mus musculus
ccttgctggtggacccactgaggag

SEQ ID NO: 358717 - DNA, 25 bp, Mus musculus
ccttgctggtggtcccactgaggag

SEQ ID NO: 358718 - DNA, 25 bp, Mus musculus
ccttgctgtccgagtgaattcatta

SEQ ID NO: 358719 - DNA, 25 bp, Mus musculus
ccttgctgtccgtgtgaattcatta

SEQ ID NO: 358720 - DNA, 25 bp, Mus musculus
ccttgctgtctacttgtgtaacttt

SEQ ID NO: 358721 - DNA, 25 bp, Mus musculus
ccttgctgtctagttgtgtaacttt

SEQ ID NO: 358722 - DNA, 25 bp, Mus musculus
ccttgctgtctcagattggaacttg

SEQ ID NO: 358723 - DNA, 25 bp, Mus musculus
ccttgctgtctctgattggaacttg

SEQ ID NO: 358724 - DNA, 25 bp, Mus musculus
ccttgctgtgcaaggtggccgtgtc

SEQ ID NO: 358725 - DNA, 25 bp, Mus musculus
ccttgctgtgcatggtggccgtgtc

SEQ ID NO: 358726 - DNA, 25 bp, Mus musculus
ccttgctgtggtagttccagctgtt

SEQ ID NO: 358727 - DNA, 25 bp, Mus musculus
ccttgctgtggttgttccagctgtt

SEQ ID NO: 358728 - DNA, 25 bp, Mus musculus
ccttgctgtttgctgatcgtgagac

SEQ ID NO: 358729 - DNA, 25 bp, Mus musculus
ccttgctgtttggtgatcgtgagac

SEQ ID NO: 358730 - DNA, 25 bp, Mus musculus
ccttgcttaacacgactctggaagt

SEQ ID NO: 358731 - DNA, 25 bp, Mus musculus
ccttgcttaacaggactctggaagt

SEQ ID NO: 358732 - DNA, 25 bp, Mus musculus
ccttgcttaccacattgttaactgt

SEQ ID NO: 358733 - DNA, 25 bp, Mus musculus
ccttgcttaccagattgttaactgt

SEQ ID NO: 358734 - DNA, 25 bp, Mus musculus
ccttgcttagccaccagaaacagaa

SEQ ID NO: 358735 - DNA, 25 bp, Mus musculus
ccttgcttagcctccagaaacagaa

SEQ ID NO: 358736 - DNA, 25 bp, Mus musculus
ccttgcttattgagtttttacgcgg

SEQ ID NO: 358737 - DNA, 25 bp, Mus musculus
ccttgcttattgtgtttttacgcgg

SEQ ID NO: 358738 - DNA, 25 bp, Mus musculus
ccttgcttgcatctcttccaaatga

SEQ ID NO: 358739 - DNA, 25 bp, Mus musculus
ccttgcttgcatgtcttccaaatga

SEQ ID NO: 358740 - DNA, 25 bp, Mus musculus
ccttgcttggctatggagatgtctt

SEQ ID NO: 358741 - DNA, 25 bp, Mus musculus
ccttgcttggctttggagatgtctt

SEQ ID NO: 358742 - DNA, 25 bp, Mus musculus
ccttgctttatcatgacatcagtgt

SEQ ID NO: 358743 - DNA, 25 bp, Mus musculus
ccttgctttatcttgacatcagtgt

SEQ ID NO: 358744 - DNA, 25 bp, Mus musculus
ccttgctttcttcgaaggaccagct

SEQ ID NO: 358745 - DNA, 25 bp, Mus musculus
ccttgctttcttggaaggaccagct

SEQ ID NO: 358746 - DNA, 25 bp, Mus musculus
ccttgctttgtaaggctgaatggcc

SEQ ID NO: 358747 - DNA, 25 bp, Mus musculus
ccttgctttgtatggctgaatggcc

SEQ ID NO: 358748 - DNA, 25 bp, Mus musculus
ccttggaactgtactcattgccatg

SEQ ID NO: 358749 - DNA, 25 bp, Mus musculus
ccttggaactgttctcattgccatg

SEQ ID NO: 358750 - DNA, 25 bp, Mus musculus
ccttggaagctcaaatcattgcctt

SEQ ID NO: 358751 - DNA, 25 bp, Mus musculus
ccttggaagctctaatcattgcctt

SEQ ID NO: 358752 - DNA, 25 bp, Mus musculus
ccttggaaggaccacctctgtccag

SEQ ID NO: 358753 - DNA, 25 bp, Mus musculus
ccttggaaggacgacctctgtccag

SEQ ID NO: 358754 - DNA, 25 bp, Mus musculus
ccttggacagaacagacatgctgaa

SEQ ID NO: 358755 - DNA, 25 bp, Mus musculus
ccttggacagaagagacatgctgaa

SEQ ID NO: 358756 - DNA, 25 bp, Mus musculus
ccttggacagagaaagatcctcaac

SEQ ID NO: 358757 - DNA, 25 bp, Mus musculus
ccttggacagagtaagatcctcaac

SEQ ID NO: 358758 - DNA, 25 bp, Mus musculus
ccttggacagttacctggccgtcga

SEQ ID NO: 358759 - DNA, 25 bp, Mus musculus
ccttggacagtttcctggccgtcga

SEQ ID NO: 358760 - DNA, 25 bp, Mus musculus
ccttggacatggattgcaccttctg

SEQ ID NO: 358761 - DNA, 25 bp, Mus musculus
ccttggacatggtttgcaccttctg

SEQ ID NO: 358762 - DNA, 25 bp, Mus musculus
ccttggacatttccattgcctacct

SEQ ID NO: 358763 - DNA, 25 bp, Mus musculus
ccttggacatttgcattgcctacct

SEQ ID NO: 358764 - DNA, 25 bp, Mus musculus
ccttggaccctgaggagaggcctaa

SEQ ID NO: 358765 - DNA, 25 bp, Mus musculus
ccttggaccctgtggagaggcctaa

SEQ ID NO: 358766 - DNA, 25 bp, Mus musculus
ccttggactggtcctcgtccgtggt

SEQ ID NO: 358767 - DNA, 25 bp, Mus musculus
ccttggactggtgctcgtccgtggt

SEQ ID NO: 358768 - DNA, 25 bp, Mus musculus
ccttggagaataattcaggtagatt

SEQ ID NO: 358769 - DNA, 25 bp, Mus musculus
ccttggagaatatttcaggtagatt

SEQ ID NO: 358770 - DNA, 25 bp, Mus musculus
ccttggagacacagggaacacggaa

SEQ ID NO: 358771 - DNA, 25 bp, Mus musculus
ccttggagacactgggaacacggaa

SEQ ID NO: 358772 - DNA, 25 bp, Mus musculus
ccttggagactcaagagactcggaa

SEQ ID NO: 358773 - DNA, 25 bp, Mus musculus
ccttggagactctagagactcggaa

SEQ ID NO: 358774 - DNA, 25 bp, Mus musculus
ccttggagatatattgttggttcac

SEQ ID NO: 358775 - DNA, 25 bp, Mus musculus
ccttggagatattttgttggttcac

SEQ ID NO: 358776 - DNA, 25 bp, Mus musculus
ccttggagattaccagagcctctgt

SEQ ID NO: 358777 - DNA, 25 bp, Mus musculus
ccttggagattagcagagcctctgt

SEQ ID NO: 358778 - DNA, 25 bp, Mus musculus
ccttggagctgcaatagtcactgga

SEQ ID NO: 358779 - DNA, 25 bp, Mus musculus
ccttggagctgctatagtcactgga

SEQ ID NO: 358780 - DNA, 25 bp, Mus musculus
ccttggagctggatcattggattca

SEQ ID NO: 358781 - DNA, 25 bp, Mus musculus
ccttggagctggttcattggattca

SEQ ID NO: 358782 - DNA, 25 bp, Mus musculus
ccttggagctgtatcctgatgatga

SEQ ID NO: 358783 - DNA, 25 bp, Mus musculus
ccttggagctgtttcctgatgatga

SEQ ID NO: 358784 - DNA, 25 bp, Mus musculus
ccttggaggtcaatcttggcagtgg

SEQ ID NO: 358785 - DNA, 25 bp, Mus musculus
ccttggaggtcattcttggcagtgg

SEQ ID NO: 358786 - DNA, 25 bp, Mus musculus
ccttggagtctacgtgcagcagctt

SEQ ID NO: 358787 - DNA, 25 bp, Mus musculus
ccttggagtctaggtgcagcagctt

SEQ ID NO: 358788 - DNA, 25 bp, Mus musculus
ccttggagtctcaagagtaccagag

SEQ ID NO: 358789 - DNA, 25 bp, Mus musculus
ccttggagtctctagagtaccagag

SEQ ID NO: 358790 - DNA, 25 bp, Mus musculus
ccttggataaccatgattttagtct

SEQ ID NO: 358791 - DNA, 25 bp, Mus musculus
ccttggataaccttgattttagtct

SEQ ID NO: 358792 - DNA, 25 bp, Mus musculus
ccttggatatccagctgaaatagta

SEQ ID NO: 358793 - DNA, 25 bp, Mus musculus
ccttggatatcctgctgaaatagta

SEQ ID NO: 358794 - DNA, 25 bp, Mus musculus
ccttggatcaacaatggatgctcaa

SEQ ID NO: 358795 - DNA, 25 bp, Mus musculus
ccttggatcaactatggatgctcaa

SEQ ID NO: 358796 - DNA, 25 bp, Mus musculus
ccttggatgattccccccactgaat

SEQ ID NO: 358797 - DNA, 25 bp, Mus musculus
ccttggatgattgcccccactgaat

SEQ ID NO: 358798 - DNA, 25 bp, Mus musculus
ccttggatgcctcattgctttgaat

SEQ ID NO: 358799 - DNA, 25 bp, Mus musculus
ccttggatgcctgattgctttgaat

SEQ ID NO: 358800 - DNA, 25 bp, Mus musculus
ccttggatggataggtacagtattt

SEQ ID NO: 358801 - DNA, 25 bp, Mus musculus
ccttggatggattggtacagtattt

SEQ ID NO: 358802 - DNA, 25 bp, Mus musculus
ccttggatgtagagaccggcctcaa

SEQ ID NO: 358803 - DNA, 25 bp, Mus musculus
ccttggatgtagtgaccggcctcaa

SEQ ID NO: 358804 - DNA, 25 bp, Mus musculus
ccttggatgtctcccctactgaata

SEQ ID NO: 358805 - DNA, 25 bp, Mus musculus
ccttggatgtctgccctactgaata

SEQ ID NO: 358806 - DNA, 25 bp, Mus musculus
ccttggatttatctattggattctt

SEQ ID NO: 358807 - DNA, 25 bp, Mus musculus
ccttggatttatgtattggattctt

SEQ ID NO: 358808 - DNA, 25 bp, Mus musculus
ccttggcaaataccctcagattatc

SEQ ID NO: 358809 - DNA, 25 bp, Mus musculus
ccttggcaaatagcctcagattatc

SEQ ID NO: 358810 - DNA, 25 bp, Mus musculus
ccttggcaattgacacagtaaattg

SEQ ID NO: 358811 - DNA, 25 bp, Mus musculus
ccttggcaattgtcacagtaaattg

SEQ ID NO: 358812 - DNA, 25 bp, Mus musculus
ccttggcactcaccgtcagtttaga

SEQ ID NO: 358813 - DNA, 25 bp, Mus musculus
ccttggcactcagcgtcagtttaga

SEQ ID NO: 358814 - DNA, 25 bp, Mus musculus
ccttggcagctacagggcgtgtaga

SEQ ID NO: 358815 - DNA, 25 bp, Mus musculus
ccttggcagctagagggcgtgtaga

SEQ ID NO: 358816 - DNA, 25 bp, Mus musculus
ccttggcagctccaggagccatgat

SEQ ID NO: 358817 - DNA, 25 bp, Mus musculus
ccttggcagctcgaggagccatgat

SEQ ID NO: 358818 - DNA, 25 bp, Mus musculus
ccttggcaggggatgagaaacactc

SEQ ID NO: 358819 - DNA, 25 bp, Mus musculus
ccttggcaggggttgagaaacactc

SEQ ID NO: 358820 - DNA, 25 bp, Mus musculus
ccttggcatagaaatgtgcgttcct

SEQ ID NO: 358821 - DNA, 25 bp, Mus musculus
ccttggcatagatatgtgcgttcct

SEQ ID NO: 358822 - DNA, 25 bp, Mus musculus
ccttggcatatgattgcacttgatt

SEQ ID NO: 358823 - DNA, 25 bp, Mus musculus
ccttggcatatgtttgcacttgatt

SEQ ID NO: 358824 - DNA, 25 bp, Mus musculus
ccttggcatgttatgtatcagcgat

SEQ ID NO: 358825 - DNA, 25 bp, Mus musculus
ccttggcatgttttgtatcagcgat

SEQ ID NO: 358826 - DNA, 25 bp, Mus musculus
ccttggcattaaaccctcggaggga

SEQ ID NO: 358827 - DNA, 25 bp, Mus musculus
ccttggcattaatccctcggaggga

SEQ ID NO: 358828 - DNA, 25 bp, Mus musculus
ccttggcatttaaaccaacatttat

SEQ ID NO: 358829 - DNA, 25 bp, Mus musculus
ccttggcatttacatcactggtgtg

SEQ ID NO: 358830 - DNA, 25 bp, Mus musculus
ccttggcatttagatcactggtgtg

SEQ ID NO: 358831 - DNA, 25 bp, Mus musculus
ccttggcatttataccaacatttat

SEQ ID NO: 358832 - DNA, 25 bp, Mus musculus
ccttggccaaatacagcttctttga

SEQ ID NO: 358833 - DNA, 25 bp, Mus musculus
ccttggccaaattcagcttctttga

SEQ ID NO: 358834 - DNA, 25 bp, Mus musculus
ccttggccagacagttgccttgaaa

SEQ ID NO: 358835 - DNA, 25 bp, Mus musculus
ccttggccagactgttgccttgaaa

SEQ ID NO: 358836 - DNA, 25 bp, Mus musculus
ccttggccatagacactttgctcat

SEQ ID NO: 358837 - DNA, 25 bp, Mus musculus
ccttggccatagcaattggactatt

SEQ ID NO: 358838 - DNA, 25 bp, Mus musculus
ccttggccataggaattggactatt

SEQ ID NO: 358839 - DNA, 25 bp, Mus musculus
ccttggccatagtcactttgctcat

SEQ ID NO: 358840 - DNA, 25 bp, Mus musculus
ccttggccatgtctgaccgtgtctg

SEQ ID NO: 358841 - DNA, 25 bp, Mus musculus
ccttggccatgtgtgaccgtgtctg

SEQ ID NO: 358842 - DNA, 25 bp, Mus musculus
ccttggccttgcagtatggttgagg

SEQ ID NO: 358843 - DNA, 25 bp, Mus musculus
ccttggccttgctgtatggttgagg

SEQ ID NO: 358844 - DNA, 25 bp, Mus musculus
ccttggcgaggactttctgatggac

SEQ ID NO: 358845 - DNA, 25 bp, Mus musculus
ccttggcgaggagtttctgatggac

SEQ ID NO: 358846 - DNA, 25 bp, Mus musculus
ccttggcgatttatcctcccattct

SEQ ID NO: 358847 - DNA, 25 bp, Mus musculus
ccttggcgatttttcctcccattct

SEQ ID NO: 358848 - DNA, 25 bp, Mus musculus
ccttggctacaacttttaatagaat

SEQ ID NO: 358849 - DNA, 25 bp, Mus musculus
ccttggctacaagttttaatagaat

SEQ ID NO: 358850 - DNA, 25 bp, Mus musculus
ccttggctacagcaggagtgtaaga

SEQ ID NO: 358851 - DNA, 25 bp, Mus musculus
ccttggctacaggaggagtgtaaga

SEQ ID NO: 358852 - DNA, 25 bp, Mus musculus
ccttggctacataagataggaacaa

SEQ ID NO: 358853 - DNA, 25 bp, Mus musculus
ccttggctacattagataggaacaa

SEQ ID NO: 358854 - DNA, 25 bp, Mus musculus
ccttggctacttccagtttatgttt

SEQ ID NO: 358855 - DNA, 25 bp, Mus musculus
ccttggctacttgcagtttatgttt

SEQ ID NO: 358856 - DNA, 25 bp, Mus musculus
ccttggctgcttcctggagtgggtc

SEQ ID NO: 358857 - DNA, 25 bp, Mus musculus
ccttggctgcttgctggagtgggtc

SEQ ID NO: 358858 - DNA, 25 bp, Mus musculus
ccttggctggttatctcttttgctc

SEQ ID NO: 358859 - DNA, 25 bp, Mus musculus
ccttggctggttttctcttttgctc

SEQ ID NO: 358860 - DNA, 25 bp, Mus musculus
ccttggctgtctacacttcaggaaa

SEQ ID NO: 358861 - DNA, 25 bp, Mus musculus
ccttggctgtcttcacttcaggaaa

SEQ ID NO: 358862 - DNA, 25 bp, Mus musculus
ccttggcttataaggactgctgtta

SEQ ID NO: 358863 - DNA, 25 bp, Mus musculus
ccttggcttatatggactgctgtta

SEQ ID NO: 358864 - DNA, 25 bp, Mus musculus
ccttggcttgaactcattgctgtct

SEQ ID NO: 358865 - DNA, 25 bp, Mus musculus
ccttggcttgaagtcattgctgtct

SEQ ID NO: 358866 - DNA, 25 bp, Mus musculus
ccttggcttttaacatgctaatatt

SEQ ID NO: 358867 - DNA, 25 bp, Mus musculus
ccttggcttttatcatgctaatatt

SEQ ID NO: 358868 - DNA, 25 bp, Mus musculus
ccttgggaagacatgctttgcattc

SEQ ID NO: 358869 - DNA, 25 bp, Mus musculus
ccttgggaagacttgctttgcattc

SEQ ID NO: 358870 - DNA, 25 bp, Mus musculus
ccttgggaagcaagcctgggtgaat

SEQ ID NO: 358871 - DNA, 25 bp, Mus musculus
ccttgggaagcatgcctgggtgaat

SEQ ID NO: 358872 - DNA, 25 bp, Mus musculus
ccttgggacaatagccagtctggga

SEQ ID NO: 358873 - DNA, 25 bp, Mus musculus
ccttgggacaatccacttcaatctg

SEQ ID NO: 358874 - DNA, 25 bp, Mus musculus
ccttgggacaatgcacttcaatctg

SEQ ID NO: 358875 - DNA, 25 bp, Mus musculus
ccttgggacaattgccagtctggga

SEQ ID NO: 358876 - DNA, 25 bp, Mus musculus
ccttgggacattattgtggagtagt

SEQ ID NO: 358877 - DNA, 25 bp, Mus musculus
ccttgggacatttttgtggagtagt

SEQ ID NO: 358878 - DNA, 25 bp, Mus musculus
ccttgggatataccctggtcttaga

SEQ ID NO: 358879 - DNA, 25 bp, Mus musculus
ccttgggatatagcctggtcttaga

SEQ ID NO: 358880 - DNA, 25 bp, Mus musculus
ccttgggattatcgcgtcgctgttc

SEQ ID NO: 358881 - DNA, 25 bp, Mus musculus
ccttgggattatggcgtcgctgttc

SEQ ID NO: 358882 - DNA, 25 bp, Mus musculus
ccttgggcaactaaatctctcaaag

SEQ ID NO: 358883 - DNA, 25 bp, Mus musculus
ccttgggcaacttaatctctcaaag

SEQ ID NO: 358884 - DNA, 25 bp, Mus musculus
ccttgggcacaacgcatacaacttg

SEQ ID NO: 358885 - DNA, 25 bp, Mus musculus
ccttgggcacaaggcatacaacttg

SEQ ID NO: 358886 - DNA, 25 bp, Mus musculus
ccttgggcagtgacaggtccacaaa

SEQ ID NO: 358887 - DNA, 25 bp, Mus musculus
ccttgggcagtgtcaggtccacaaa

SEQ ID NO: 358888 - DNA, 25 bp, Mus musculus
ccttgggcattcatgtatctcctgt

SEQ ID NO: 358889 - DNA, 25 bp, Mus musculus
ccttgggcattcttgtatctcctgt

SEQ ID NO: 358890 - DNA, 25 bp, Mus musculus
ccttgggcattgatgctgggacctg

SEQ ID NO: 358891 - DNA, 25 bp, Mus musculus
ccttgggcattgttgctgggacctg

SEQ ID NO: 358892 - DNA, 25 bp, Mus musculus
ccttgggcctgactgtgtttgaaac

SEQ ID NO: 358893 - DNA, 25 bp, Mus musculus
ccttgggcctgagtgtgtttgaaac

SEQ ID NO: 358894 - DNA, 25 bp, Mus musculus
ccttgggcgtacacaggtagtcagg

SEQ ID NO: 358895 - DNA, 25 bp, Mus musculus
ccttgggcgtactcaggtagtcagg

SEQ ID NO: 358896 - DNA, 25 bp, Mus musculus
ccttgggctgtaattgggaaatcta

SEQ ID NO: 358897 - DNA, 25 bp, Mus musculus
ccttgggctgtatttgggaaatcta

SEQ ID NO: 358898 - DNA, 25 bp, Mus musculus
ccttgggcttgtctgcatagtagca

SEQ ID NO: 358899 - DNA, 25 bp, Mus musculus
ccttgggcttgtgtgcatagtagca

SEQ ID NO: 358900 - DNA, 25 bp, Mus musculus
ccttgggctttgcacacaacggaca

SEQ ID NO: 358901 - DNA, 25 bp, Mus musculus
ccttgggctttggacacaacggaca

SEQ ID NO: 358902 - DNA, 25 bp, Mus musculus
ccttgggtacacatggctttggcat

SEQ ID NO: 358903 - DNA, 25 bp, Mus musculus
ccttgggtacacttggctttggcat

SEQ ID NO: 358904 - DNA, 25 bp, Mus musculus
ccttgggtaccgctaccagtgagat

SEQ ID NO: 358905 - DNA, 25 bp, Mus musculus
ccttgggtaccggtaccagtgagat

SEQ ID NO: 358906 - DNA, 25 bp, Mus musculus
ccttgggtcccaaatgtgataccac

SEQ ID NO: 358907 - DNA, 25 bp, Mus musculus
ccttgggtcccatatgtgataccac

SEQ ID NO: 358908 - DNA, 25 bp, Mus musculus
ccttgggtgaccagctggtatagag

SEQ ID NO: 358909 - DNA, 25 bp, Mus musculus
ccttgggtgacctgctggtatagag

SEQ ID NO: 358910 - DNA, 25 bp, Mus musculus
ccttgggttctgagtctgtcaccac

SEQ ID NO: 358911 - DNA, 25 bp, Mus musculus
ccttgggttctgtgtctgtcaccac

SEQ ID NO: 358912 - DNA, 25 bp, Mus musculus
ccttgggtttatatgcatggttcat

SEQ ID NO: 358913 - DNA, 25 bp, Mus musculus
ccttgggtttatttgcatggttcat

SEQ ID NO: 358914 - DNA, 25 bp, Mus musculus
ccttggtaaccaaggccaaagctta

SEQ ID NO: 358915 - DNA, 25 bp, Mus musculus
ccttggtaaccatggccaaagctta

SEQ ID NO: 358916 - DNA, 25 bp, Mus musculus
ccttggtaactgaaacagaaacttg

SEQ ID NO: 358917 - DNA, 25 bp, Mus musculus
ccttggtaactgtaacagaaacttg

SEQ ID NO: 358918 - DNA, 25 bp, Mus musculus
ccttggtcaggaaggcgatgttaac

SEQ ID NO: 358919 - DNA, 25 bp, Mus musculus
ccttggtcaggatggcgatgttaac

SEQ ID NO: 358920 - DNA, 25 bp, Mus musculus
ccttggtcatacagtgaatgaatgg

SEQ ID NO: 358921 - DNA, 25 bp, Mus musculus
ccttggtcatactgtgaatgaatgg

SEQ ID NO: 358922 - DNA, 25 bp, Mus musculus
ccttggtccaggattcgacagagaa

SEQ ID NO: 358923 - DNA, 25 bp, Mus musculus
ccttggtccaggtttcgacagagaa

SEQ ID NO: 358924 - DNA, 25 bp, Mus musculus
ccttggtgacctcgtgacctgggta

SEQ ID NO: 358925 - DNA, 25 bp, Mus musculus
ccttggtgacctggtgacctgggta

SEQ ID NO: 358926 - DNA, 25 bp, Mus musculus
ccttggtgacgcatgcagtagctca

SEQ ID NO: 358927 - DNA, 25 bp, Mus musculus
ccttggtgacgcttgcagtagctca

SEQ ID NO: 358928 - DNA, 25 bp, Mus musculus
ccttggtgacttaggctgtggtcca

SEQ ID NO: 358929 - DNA, 25 bp, Mus musculus
ccttggtgactttggctgtggtcca

SEQ ID NO: 358930 - DNA, 25 bp, Mus musculus
ccttggtgatgaaactgtcccggca

SEQ ID NO: 358931 - DNA, 25 bp, Mus musculus
ccttggtgatgatactgtcccggca

SEQ ID NO: 358932 - DNA, 25 bp, Mus musculus
ccttggtgatttatttttcctggag

SEQ ID NO: 358933 - DNA, 25 bp, Mus musculus
ccttggtgatttttttttcctggag

SEQ ID NO: 358934 - DNA, 25 bp, Mus musculus
ccttggtggtctcaaataattgaaa

SEQ ID NO: 358935 - DNA, 25 bp, Mus musculus
ccttggtggtctgaaataattgaaa

SEQ ID NO: 358936 - DNA, 25 bp, Mus musculus
ccttggtgtcctcttatgttcagaa

SEQ ID NO: 358937 - DNA, 25 bp, Mus musculus
ccttggtgtcctgttatgttcagaa

SEQ ID NO: 358938 - DNA, 25 bp, Mus musculus
ccttggtgtctaatctgtgccagaa

SEQ ID NO: 358939 - DNA, 25 bp, Mus musculus
ccttggtgtctattctgtgccagaa

SEQ ID NO: 358940 - DNA, 25 bp, Mus musculus
ccttggtgttccattgggatggcat

SEQ ID NO: 358941 - DNA, 25 bp, Mus musculus
ccttggtgttcctttgggatggcat

SEQ ID NO: 358942 - DNA, 25 bp, Mus musculus
ccttggttggacagcttagttttct

SEQ ID NO: 358943 - DNA, 25 bp, Mus musculus
ccttggttggactgcttagttttct

SEQ ID NO: 358944 - DNA, 25 bp, Mus musculus
ccttggttggtccactctagtgtaa

SEQ ID NO: 358945 - DNA, 25 bp, Mus musculus
ccttggttggtcgactctagtgtaa

SEQ ID NO: 358946 - DNA, 25 bp, Mus musculus
ccttggttgtcaccctgaggaggaa

SEQ ID NO: 358947 - DNA, 25 bp, Mus musculus
ccttggttgtcagcctgaggaggaa

SEQ ID NO: 358948 - DNA, 25 bp, Mus musculus
ccttggtttatgactgtctgttctt

SEQ ID NO: 358949 - DNA, 25 bp, Mus musculus
ccttggtttatgtctgtctgttctt

SEQ ID NO: 358950 - DNA, 25 bp, Mus musculus
ccttggttttacatctggcagagtg

SEQ ID NO: 358951 - DNA, 25 bp, Mus musculus
ccttggttttacttctggcagagtg

SEQ ID NO: 358952 - DNA, 25 bp, Mus musculus
ccttggttttctagtgacttcactg

SEQ ID NO: 358953 - DNA, 25 bp, Mus musculus
ccttggttttcttgtgacttcactg

SEQ ID NO: 358954 - DNA, 25 bp, Mus musculus
ccttggttttggcaatattctatgc

SEQ ID NO: 358955 - DNA, 25 bp, Mus musculus
ccttggttttgggaatattctatgc

SEQ ID NO: 358956 - DNA, 25 bp, Mus musculus
ccttgtaaaccaaatagcctaaaat

SEQ ID NO: 358957 - DNA, 25 bp, Mus musculus
ccttgtaaaccatatagcctaaaat

SEQ ID NO: 358958 - DNA, 25 bp, Mus musculus
ccttgtaaccatcgacacttcaact

SEQ ID NO: 358959 - DNA, 25 bp, Mus musculus
ccttgtaaccatggacacttcaact

SEQ ID NO: 358960 - DNA, 25 bp, Mus musculus
ccttgtaacccaacactgtggtaag

SEQ ID NO: 358961 - DNA, 25 bp, Mus musculus
ccttgtaacccatcactgtggtaag

SEQ ID NO: 358962 - DNA, 25 bp, Mus musculus
ccttgtaagcagcagctctctacct

SEQ ID NO: 358963 - DNA, 25 bp, Mus musculus
ccttgtaagcaggagctctctacct

SEQ ID NO: 358964 - DNA, 25 bp, Mus musculus
ccttgtacccatattgtgtagatat

SEQ ID NO: 358965 - DNA, 25 bp, Mus musculus
ccttgtacccattttgtgtagatat

SEQ ID NO: 358966 - DNA, 25 bp, Mus musculus
ccttgtaccctcatcagagggatca

SEQ ID NO: 358967 - DNA, 25 bp, Mus musculus
ccttgtaccctcttcagagggatca

SEQ ID NO: 358968 - DNA, 25 bp, Mus musculus
ccttgtacctgcaccggaaggcttg

SEQ ID NO: 358969 - DNA, 25 bp, Mus musculus
ccttgtacctgctccggaaggcttg

SEQ ID NO: 358970 - DNA, 25 bp, Mus musculus
ccttgtactcacacttctgtggtaa

SEQ ID NO: 358971 - DNA, 25 bp, Mus musculus
ccttgtactcactcttctgtggtaa

SEQ ID NO: 358972 - DNA, 25 bp, Mus musculus
ccttgtactgagagctggttgtcac

SEQ ID NO: 358973 - DNA, 25 bp, Mus musculus
ccttgtactgagtgctggttgtcac

SEQ ID NO: 358974 - DNA, 25 bp, Mus musculus
ccttgtaggcttcgcatgctgctgc

SEQ ID NO: 358975 - DNA, 25 bp, Mus musculus
ccttgtaggcttggcatgctgctgc

SEQ ID NO: 358976 - DNA, 25 bp, Mus musculus
ccttgtagttcaacctgcgtaggta

SEQ ID NO: 358977 - DNA, 25 bp, Mus musculus
ccttgtagttcatcctgcgtaggta

SEQ ID NO: 358978 - DNA, 25 bp, Mus musculus
ccttgtatagtgacgtgttgtgtaa

SEQ ID NO: 358979 - DNA, 25 bp, Mus musculus
ccttgtatagtgtcgtgttgtgtaa

SEQ ID NO: 358980 - DNA, 25 bp, Mus musculus
ccttgtatcacgaagctgttgcata

SEQ ID NO: 358981 - DNA, 25 bp, Mus musculus
ccttgtatcacgtagctgttgcata

SEQ ID NO: 358982 - DNA, 25 bp, Mus musculus
ccttgtatcttcattgcctttgttt

SEQ ID NO: 358983 - DNA, 25 bp, Mus musculus
ccttgtatcttctttgcctttgttt

SEQ ID NO: 358984 - DNA, 25 bp, Mus musculus
ccttgtatcttgctctccttttata

SEQ ID NO: 358985 - DNA, 25 bp, Mus musculus
ccttgtatcttggtctccttttata

SEQ ID NO: 358986 - DNA, 25 bp, Mus musculus
ccttgtatgtaaccccacgtcaata

SEQ ID NO: 358987 - DNA, 25 bp, Mus musculus
ccttgtatgtaagcccacgtcaata

SEQ ID NO: 358988 - DNA, 25 bp, Mus musculus
ccttgtatgtataagggctgaacct

SEQ ID NO: 358989 - DNA, 25 bp, Mus musculus
ccttgtatgtattagggctgaacct

SEQ ID NO: 358990 - DNA, 25 bp, Mus musculus
ccttgtattgaacataacctatgac

SEQ ID NO: 358991 - DNA, 25 bp, Mus musculus
ccttgtattgaagataacctatgac

SEQ ID NO: 358992 - DNA, 25 bp, Mus musculus
ccttgtattgctattggttttccat

SEQ ID NO: 358993 - DNA, 25 bp, Mus musculus
ccttgtattgcttttggttttccat

SEQ ID NO: 358994 - DNA, 25 bp, Mus musculus
ccttgtcacccaaacagcaaaataa

SEQ ID NO: 358995 - DNA, 25 bp, Mus musculus
ccttgtcacccacacgttgatggat

SEQ ID NO: 358996 - DNA, 25 bp, Mus musculus
ccttgtcacccagacgttgatggat

SEQ ID NO: 358997 - DNA, 25 bp, Mus musculus
ccttgtcacccatacagcaaaataa

SEQ ID NO: 358998 - DNA, 25 bp, Mus musculus
ccttgtcagatgcactcgatggcca

SEQ ID NO: 358999 - DNA, 25 bp, Mus musculus
ccttgtcagatggactcgatggcca

SEQ ID NO: 359000 - DNA, 25 bp, Mus musculus
ccttgtcagtgcatgggtattggtg

SEQ ID NO: 359001 - DNA, 25 bp, Mus musculus
ccttgtcagtgcttgggtattggtg

SEQ ID NO: 359002 - DNA, 25 bp, Mus musculus
ccttgtcatcctctgttcattcaaa

SEQ ID NO: 359003 - DNA, 25 bp, Mus musculus
ccttgtcatcctgtgttcattcaaa

SEQ ID NO: 359004 - DNA, 25 bp, Mus musculus
ccttgtcatctcaagccaggatatt

SEQ ID NO: 359005 - DNA, 25 bp, Mus musculus
ccttgtcatctctagccaggatatt

SEQ ID NO: 359006 - DNA, 25 bp, Mus musculus
ccttgtcatgttatgagcctttggc

SEQ ID NO: 359007 - DNA, 25 bp, Mus musculus
ccttgtcatgttttgagcctttggc

SEQ ID NO: 359008 - DNA, 25 bp, Mus musculus
ccttgtccgtgtcgccacttaatca

SEQ ID NO: 359009 - DNA, 25 bp, Mus musculus
ccttgtccgtgtggccacttaatca

SEQ ID NO: 359010 - DNA, 25 bp, Mus musculus
ccttgtcctatgactttacattttc

SEQ ID NO: 359011 - DNA, 25 bp, Mus musculus
ccttgtcctatgtctttacattttc

SEQ ID NO: 359012 - DNA, 25 bp, Mus musculus
ccttgtcctgacatcagcatcaaca

SEQ ID NO: 359013 - DNA, 25 bp, Mus musculus
ccttgtcctgacttcagcatcaaca

SEQ ID NO: 359014 - DNA, 25 bp, Mus musculus
ccttgtcctgccaagttcatgaata

SEQ ID NO: 359015 - DNA, 25 bp, Mus musculus
ccttgtcctgcctagttcatgaata

SEQ ID NO: 359016 - DNA, 25 bp, Mus musculus
ccttgtccttgcacctatgatttat

SEQ ID NO: 359017 - DNA, 25 bp, Mus musculus
ccttgtccttgctcctatgatttat

SEQ ID NO: 359018 - DNA, 25 bp, Mus musculus
ccttgtcctttacccttagcagtgg

SEQ ID NO: 359019 - DNA, 25 bp, Mus musculus
ccttgtcctttagccttagcagtgg

SEQ ID NO: 359020 - DNA, 25 bp, Mus musculus
ccttgtcgagctaataaatgcaatt

SEQ ID NO: 359021 - DNA, 25 bp, Mus musculus
ccttgtcgagcttataaatgcaatt

SEQ ID NO: 359022 - DNA, 25 bp, Mus musculus
ccttgtcgcttacatgcaaacttaa

SEQ ID NO: 359023 - DNA, 25 bp, Mus musculus
ccttgtcgcttagatgcaaacttaa

SEQ ID NO: 359024 - DNA, 25 bp, Mus musculus
ccttgtcggtcacaactttccatta

SEQ ID NO: 359025 - DNA, 25 bp, Mus musculus
ccttgtcggtcagaactttccatta

SEQ ID NO: 359026 - DNA, 25 bp, Mus musculus
ccttgtctacatatggattgtgtgt

SEQ ID NO: 359027 - DNA, 25 bp, Mus musculus
ccttgtctacatttggattgtgtgt

SEQ ID NO: 359028 - DNA, 25 bp, Mus musculus
ccttgtctacttcggcttcagtgtt

SEQ ID NO: 359029 - DNA, 25 bp, Mus musculus
ccttgtctacttgggcttcagtgtt

SEQ ID NO: 359030 - DNA, 25 bp, Mus musculus
ccttgtctcccaattgacttgagta

SEQ ID NO: 359031 - DNA, 25 bp, Mus musculus
ccttgtctcccatttgacttgagta

SEQ ID NO: 359032 - DNA, 25 bp, Mus musculus
ccttgtctcgggaggactcaagtta

SEQ ID NO: 359033 - DNA, 25 bp, Mus musculus
ccttgtctcgggtggactcaagtta

SEQ ID NO: 359034 - DNA, 25 bp, Mus musculus
ccttgtcttgttcccagtcttagtg

SEQ ID NO: 359035 - DNA, 25 bp, Mus musculus
ccttgtcttgttgccagtcttagtg

SEQ ID NO: 359036 - DNA, 25 bp, Mus musculus
ccttgtgaacaacgcaccagtggct

SEQ ID NO: 359037 - DNA, 25 bp, Mus musculus
ccttgtgaacaaggcaccagtggct

SEQ ID NO: 359038 - DNA, 25 bp, Mus musculus
ccttgtgaagggaggctcagctcct

SEQ ID NO: 359039 - DNA, 25 bp, Mus musculus
ccttgtgaagggtggctcagctcct

SEQ ID NO: 359040 - DNA, 25 bp, Mus musculus
ccttgtgacctcaagtttcctgtgt

SEQ ID NO: 359041 - DNA, 25 bp, Mus musculus
ccttgtgacctctagtttcctgtgt

SEQ ID NO: 359042 - DNA, 25 bp, Mus musculus
ccttgtgactctaactggttctgga

SEQ ID NO: 359043 - DNA, 25 bp, Mus musculus
ccttgtgactctcattcaacaatct

SEQ ID NO: 359044 - DNA, 25 bp, Mus musculus
ccttgtgactctgattcaacaatct

SEQ ID NO: 359045 - DNA, 25 bp, Mus musculus
ccttgtgactcttactggttctgga

SEQ ID NO: 359046 - DNA, 25 bp, Mus musculus
ccttgtgagacaagctgtcgtgaca

SEQ ID NO: 359047 - DNA, 25 bp, Mus musculus
ccttgtgagacatgctgtcgtgaca

SEQ ID NO: 359048 - DNA, 25 bp, Mus musculus
ccttgtgaggcactttgttgactga

SEQ ID NO: 359049 - DNA, 25 bp, Mus musculus
ccttgtgaggcagtttgttgactga

SEQ ID NO: 359050 - DNA, 25 bp, Mus musculus
ccttgtgaggtaaccagccctagaa

SEQ ID NO: 359051 - DNA, 25 bp, Mus musculus
ccttgtgaggtatccagccctagaa

SEQ ID NO: 359052 - DNA, 25 bp, Mus musculus
ccttgtgagtccagcatcatttgaa

SEQ ID NO: 359053 - DNA, 25 bp, Mus musculus
ccttgtgagtcctgcatcatttgaa

SEQ ID NO: 359054 - DNA, 25 bp, Mus musculus
ccttgtgatacaagaatttggtcga

SEQ ID NO: 359055 - DNA, 25 bp, Mus musculus
ccttgtgatacatgaatttggtcga

SEQ ID NO: 359056 - DNA, 25 bp, Mus musculus
ccttgtgatcacagaggcattgaaa

SEQ ID NO: 359057 - DNA, 25 bp, Mus musculus
ccttgtgatcactgaggcattgaaa

SEQ ID NO: 359058 - DNA, 25 bp, Mus musculus
ccttgtgattttagccgtggcgtat

SEQ ID NO: 359059 - DNA, 25 bp, Mus musculus
ccttgtgatttttgccgtggcgtat

SEQ ID NO: 359060 - DNA, 25 bp, Mus musculus
ccttgtgcaccgctttttctaaagt

SEQ ID NO: 359061 - DNA, 25 bp, Mus musculus
ccttgtgcaccggtttttctaaagt

SEQ ID NO: 359062 - DNA, 25 bp, Mus musculus
ccttgtgcagtcatctcgctgagat

SEQ ID NO: 359063 - DNA, 25 bp, Mus musculus
ccttgtgcagtcttctcgctgagat

SEQ ID NO: 359064 - DNA, 25 bp, Mus musculus
ccttgtgcatctaggctgcagctgt

SEQ ID NO: 359065 - DNA, 25 bp, Mus musculus
ccttgtgcatcttggctgcagctgt

SEQ ID NO: 359066 - DNA, 25 bp, Mus musculus
ccttgtgccatccaacattttgtat

SEQ ID NO: 359067 - DNA, 25 bp, Mus musculus
ccttgtgccatcgaacattttgtat

SEQ ID NO: 359068 - DNA, 25 bp, Mus musculus
ccttgtgcccctagtagcaggaata

SEQ ID NO: 359069 - DNA, 25 bp, Mus musculus
ccttgtgccccttgtagcaggaata

SEQ ID NO: 359070 - DNA, 25 bp, Mus musculus
ccttgtgccgtactctgtctccggg

SEQ ID NO: 359071 - DNA, 25 bp, Mus musculus
ccttgtgccgtagtctgtctccggg

SEQ ID NO: 359072 - DNA, 25 bp, Mus musculus
ccttgtgcctgacacagcggaattt

SEQ ID NO: 359073 - DNA, 25 bp, Mus musculus
ccttgtgcctgagacagcggaattt

SEQ ID NO: 359074 - DNA, 25 bp, Mus musculus
ccttgtgctcacaactcagtaaatt

SEQ ID NO: 359075 - DNA, 25 bp, Mus musculus
ccttgtgctcactactcagtaaatt

SEQ ID NO: 359076 - DNA, 25 bp, Mus musculus
ccttgtgcttgtacttgggtgtgat

SEQ ID NO: 359077 - DNA, 25 bp, Mus musculus
ccttgtgcttgttcttgggtgtgat

SEQ ID NO: 359078 - DNA, 25 bp, Mus musculus
ccttgtggaaacacatgttctcagc

SEQ ID NO: 359079 - DNA, 25 bp, Mus musculus
ccttgtggaaactcatgttctcagc

SEQ ID NO: 359080 - DNA, 25 bp, Mus musculus
ccttgtggaacgaggcaggctttgc

SEQ ID NO: 359081 - DNA, 25 bp, Mus musculus
ccttgtggaacgtggcaggctttgc

SEQ ID NO: 359082 - DNA, 25 bp, Mus musculus
ccttgtggatccacttggcttaaat

SEQ ID NO: 359083 - DNA, 25 bp, Mus musculus
ccttgtggatcctcttggcttaaat

SEQ ID NO: 359084 - DNA, 25 bp, Mus musculus
ccttgtggatgtcaagatgctctct

SEQ ID NO: 359085 - DNA, 25 bp, Mus musculus
ccttgtggatgtgaagatgctctct

SEQ ID NO: 359086 - DNA, 25 bp, Mus musculus
ccttgtggctttagtgagagtgatc

SEQ ID NO: 359087 - DNA, 25 bp, Mus musculus
ccttgtggcttttgtgagagtgatc

SEQ ID NO: 359088 - DNA, 25 bp, Mus musculus
ccttgtgggatcactgagcctgaag

SEQ ID NO: 359089 - DNA, 25 bp, Mus musculus
ccttgtgggatctctgagcctgaag

SEQ ID NO: 359090 - DNA, 25 bp, Mus musculus
ccttgtgggccaaatgtatccgttg

SEQ ID NO: 359091 - DNA, 25 bp, Mus musculus
ccttgtgggccatatgtatccgttg

SEQ ID NO: 359092 - DNA, 25 bp, Mus musculus
ccttgtggggttcctgttgctgaga

SEQ ID NO: 359093 - DNA, 25 bp, Mus musculus
ccttgtggggttgctgttgctgaga

SEQ ID NO: 359094 - DNA, 25 bp, Mus musculus
ccttgtgggttgctactgataagca

SEQ ID NO: 359095 - DNA, 25 bp, Mus musculus
ccttgtgggttggtactgataagca

SEQ ID NO: 359096 - DNA, 25 bp, Mus musculus
ccttgtggtacccagtgtccctgag

SEQ ID NO: 359097 - DNA, 25 bp, Mus musculus
ccttgtggtaccgagtgtccctgag

SEQ ID NO: 359098 - DNA, 25 bp, Mus musculus
ccttgtggtggactggcctcataaa

SEQ ID NO: 359099 - DNA, 25 bp, Mus musculus
ccttgtggtggagtggcctcataaa

SEQ ID NO: 359100 - DNA, 25 bp, Mus musculus
ccttgtggtgtgctagaacagtttt

SEQ ID NO: 359101 - DNA, 25 bp, Mus musculus
ccttgtggtgtggtagaacagtttt

SEQ ID NO: 359102 - DNA, 25 bp, Mus musculus
ccttgtggttacaatagctctgatt

SEQ ID NO: 359103 - DNA, 25 bp, Mus musculus
ccttgtggttactatagctctgatt

SEQ ID NO: 359104 - DNA, 25 bp, Mus musculus
ccttgtgtagtgatttggtgagaga

SEQ ID NO: 359105 - DNA, 25 bp, Mus musculus
ccttgtgtagtgttttggtgagaga

SEQ ID NO: 359106 - DNA, 25 bp, Mus musculus
ccttgtgtccagaatcccagatggg

SEQ ID NO: 359107 - DNA, 25 bp, Mus musculus
ccttgtgtccagtatcccagatggg

SEQ ID NO: 359108 - DNA, 25 bp, Mus musculus
ccttgtgtccttagaggcaatccta

SEQ ID NO: 359109 - DNA, 25 bp, Mus musculus
ccttgtgtcctttgaggcaatccta

SEQ ID NO: 359110 - DNA, 25 bp, Mus musculus
ccttgtgtgatgagggcagtgttaa

SEQ ID NO: 359111 - DNA, 25 bp, Mus musculus
ccttgtgtgatgtgggcagtgttaa

SEQ ID NO: 359112 - DNA, 25 bp, Mus musculus
ccttgtgtgcggagttgtttgtgaa

SEQ ID NO: 359113 - DNA, 25 bp, Mus musculus
ccttgtgtgcggtgttgtttgtgaa

SEQ ID NO: 359114 - DNA, 25 bp, Mus musculus
ccttgtgtgctcaggctggtgtgct

SEQ ID NO: 359115 - DNA, 25 bp, Mus musculus
ccttgtgtgctctggctggtgtgct

SEQ ID NO: 359116 - DNA, 25 bp, Mus musculus
ccttgtgtgggtctactcacattta

SEQ ID NO: 359117 - DNA, 25 bp, Mus musculus
ccttgtgtgggtgtactcacattta

SEQ ID NO: 359118 - DNA, 25 bp, Mus musculus
ccttgtgttcaaacgggccagtaag

SEQ ID NO: 359119 - DNA, 25 bp, Mus musculus
ccttgtgttcaatcgggccagtaag

SEQ ID NO: 359120 - DNA, 25 bp, Mus musculus
ccttgtgttctcaattccagaaata

SEQ ID NO: 359121 - DNA, 25 bp, Mus musculus
ccttgtgttctctattccagaaata

SEQ ID NO: 359122 - DNA, 25 bp, Mus musculus
ccttgtgttcttctggtatggaaat

SEQ ID NO: 359123 - DNA, 25 bp, Mus musculus
ccttgtgttcttgtggtatggaaat

SEQ ID NO: 359124 - DNA, 25 bp, Mus musculus
ccttgtgttgatatgagattttcgc

SEQ ID NO: 359125 - DNA, 25 bp, Mus musculus
ccttgtgttgatttgagattttcgc

SEQ ID NO: 359126 - DNA, 25 bp, Mus musculus
ccttgtgtttctcccttgatgttac

SEQ ID NO: 359127 - DNA, 25 bp, Mus musculus
ccttgtgtttctgccttgatgttac

SEQ ID NO: 359128 - DNA, 25 bp, Mus musculus
ccttgtgtttttctgtgagtgaaca

SEQ ID NO: 359129 - DNA, 25 bp, Mus musculus
ccttgtgtttttgtgtgagtgaaca

SEQ ID NO: 359130 - DNA, 25 bp, Mus musculus
ccttgttacatgctataaatggact

SEQ ID NO: 359131 - DNA, 25 bp, Mus musculus
ccttgttacatggtataaatggact

SEQ ID NO: 359132 - DNA, 25 bp, Mus musculus
ccttgttactttccacttctcaata

SEQ ID NO: 359133 - DNA, 25 bp, Mus musculus
ccttgttactttgcacttctcaata

SEQ ID NO: 359134 - DNA, 25 bp, Mus musculus
ccttgttaggtgcttagtaatctat

SEQ ID NO: 359135 - DNA, 25 bp, Mus musculus
ccttgttaggtggttagtaatctat

SEQ ID NO: 359136 - DNA, 25 bp, Mus musculus
ccttgttcagcaccaatggcatagt

SEQ ID NO: 359137 - DNA, 25 bp, Mus musculus
ccttgttcagcagcaatggcatagt

SEQ ID NO: 359138 - DNA, 25 bp, Mus musculus
ccttgttccccaattgtagaataag

SEQ ID NO: 359139 - DNA, 25 bp, Mus musculus
ccttgttccccatttgtagaataag

SEQ ID NO: 359140 - DNA, 25 bp, Mus musculus
ccttgttccgttctggaggttcagc

SEQ ID NO: 359141 - DNA, 25 bp, Mus musculus
ccttgttccgttgtggaggttcagc

SEQ ID NO: 359142 - DNA, 25 bp, Mus musculus
ccttgttccttaattgaaccgctgt

SEQ ID NO: 359143 - DNA, 25 bp, Mus musculus
ccttgttccttatttgaaccgctgt

SEQ ID NO: 359144 - DNA, 25 bp, Mus musculus
ccttgttcgagacaccagcagttct

SEQ ID NO: 359145 - DNA, 25 bp, Mus musculus
ccttgttcgagagaccagcagttct

SEQ ID NO: 359146 - DNA, 25 bp, Mus musculus
ccttgttctaggctgactggattgt

SEQ ID NO: 359147 - DNA, 25 bp, Mus musculus
ccttgttctagggtgactggattgt

SEQ ID NO: 359148 - DNA, 25 bp, Mus musculus
ccttgttctcatcgaagttcccatt

SEQ ID NO: 359149 - DNA, 25 bp, Mus musculus
ccttgttctcatggaagttcccatt

SEQ ID NO: 359150 - DNA, 25 bp, Mus musculus
ccttgttgcgtgagtctgattataa

SEQ ID NO: 359151 - DNA, 25 bp, Mus musculus
ccttgttgcgtgtgtctgattataa

SEQ ID NO: 359152 - DNA, 25 bp, Mus musculus
ccttgttgcttgaggctaagactct

SEQ ID NO: 359153 - DNA, 25 bp, Mus musculus
ccttgttgcttgtggctaagactct

SEQ ID NO: 359154 - DNA, 25 bp, Mus musculus
ccttgttggctgagactgtaaatac

SEQ ID NO: 359155 - DNA, 25 bp, Mus musculus
ccttgttggctgtgactgtaaatac

SEQ ID NO: 359156 - DNA, 25 bp, Mus musculus
ccttgttgttgtcttatctgctcag

SEQ ID NO: 359157 - DNA, 25 bp, Mus musculus
ccttgttgttgtgttatctgctcag

SEQ ID NO: 359158 - DNA, 25 bp, Mus musculus
ccttgtttagccctgctttgattat

SEQ ID NO: 359159 - DNA, 25 bp, Mus musculus
ccttgtttagccgtgctttgattat

SEQ ID NO: 359160 - DNA, 25 bp, Mus musculus
ccttgtttcaacagtttgtctccac

SEQ ID NO: 359161 - DNA, 25 bp, Mus musculus
ccttgtttcaactgtttgtctccac

SEQ ID NO: 359162 - DNA, 25 bp, Mus musculus
ccttgtttcaatcgctttcttccct

SEQ ID NO: 359163 - DNA, 25 bp, Mus musculus
ccttgtttcaatggctttcttccct

SEQ ID NO: 359164 - DNA, 25 bp, Mus musculus
ccttgtttcctgacatggtttgttt

SEQ ID NO: 359165 - DNA, 25 bp, Mus musculus
ccttgtttcctgtcatggtttgttt

SEQ ID NO: 359166 - DNA, 25 bp, Mus musculus
ccttgtttccttagagggtagactg

SEQ ID NO: 359167 - DNA, 25 bp, Mus musculus
ccttgtttcctttgagggtagactg

SEQ ID NO: 359168 - DNA, 25 bp, Mus musculus
ccttgtttgtaaatccttagacgct

SEQ ID NO: 359169 - DNA, 25 bp, Mus musculus
ccttgtttgtaattccttagacgct

SEQ ID NO: 359170 - DNA, 25 bp, Mus musculus
ccttgtttgtggattaaaatatgac

SEQ ID NO: 359171 - DNA, 25 bp, Mus musculus
ccttgtttgtggtttaaaatatgac

SEQ ID NO: 359172 - DNA, 25 bp, Mus musculus
ccttgttttcagactagtgagcctg

SEQ ID NO: 359173 - DNA, 25 bp, Mus musculus
ccttgttttcagtctagtgagcctg

SEQ ID NO: 359174 - DNA, 25 bp, Mus musculus
ccttgttttgtgattgggctctcgg

SEQ ID NO: 359175 - DNA, 25 bp, Mus musculus
ccttgttttgtgtttgggctctcgg

SEQ ID NO: 359176 - DNA, 25 bp, Mus musculus
cctttaactactagctttgatatga

SEQ ID NO: 359177 - DNA, 25 bp, Mus musculus
cctttaactacttgctttgatatga

SEQ ID NO: 359178 - DNA, 25 bp, Mus musculus
cctttaagcttcagattccaccttt

SEQ ID NO: 359179 - DNA, 25 bp, Mus musculus
cctttaagcttctgattccaccttt

SEQ ID NO: 359180 - DNA, 25 bp, Mus musculus
cctttaatagatcgagcccgggctt

SEQ ID NO: 359181 - DNA, 25 bp, Mus musculus
cctttaatagatggagcccgggctt

SEQ ID NO: 359182 - DNA, 25 bp, Mus musculus
cctttaatagttactcctgttgtag

SEQ ID NO: 359183 - DNA, 25 bp, Mus musculus
cctttaatagtttctcctgttgtag

SEQ ID NO: 359184 - DNA, 25 bp, Mus musculus
cctttaatgacccatactgagacct

SEQ ID NO: 359185 - DNA, 25 bp, Mus musculus
cctttaatgaccgatactgagacct

SEQ ID NO: 359186 - DNA, 25 bp, Mus musculus
cctttacaagctaccaggaagtcat

SEQ ID NO: 359187 - DNA, 25 bp, Mus musculus
cctttacaagcttccaggaagtcat

SEQ ID NO: 359188 - DNA, 25 bp, Mus musculus
cctttacactcacgagggtttgctc

SEQ ID NO: 359189 - DNA, 25 bp, Mus musculus
cctttacactcaggagggtttgctc

SEQ ID NO: 359190 - DNA, 25 bp, Mus musculus
cctttaccagatcttcagcctcttg

SEQ ID NO: 359191 - DNA, 25 bp, Mus musculus
cctttaccagatgttcagcctcttg

SEQ ID NO: 359192 - DNA, 25 bp, Mus musculus
cctttaccattacagcatacacagc

SEQ ID NO: 359193 - DNA, 25 bp, Mus musculus
cctttaccattagagcatacacagc

SEQ ID NO: 359194 - DNA, 25 bp, Mus musculus
cctttacccaatctagctgatattt

SEQ ID NO: 359195 - DNA, 25 bp, Mus musculus
cctttacccaatgtagctgatattt

SEQ ID NO: 359196 - DNA, 25 bp, Mus musculus
cctttactcgcaccacagtgatgaa

SEQ ID NO: 359197 - DNA, 25 bp, Mus musculus
cctttactcgcagcacagtgatgaa

SEQ ID NO: 359198 - DNA, 25 bp, Mus musculus
cctttactgcagattttcaggagcg

SEQ ID NO: 359199 - DNA, 25 bp, Mus musculus
cctttactgcagtttttcaggagcg

SEQ ID NO: 359200 - DNA, 25 bp, Mus musculus
cctttactgcttctgaccagtgagt

SEQ ID NO: 359201 - DNA, 25 bp, Mus musculus
cctttactgcttgtgaccagtgagt

SEQ ID NO: 359202 - DNA, 25 bp, Mus musculus
cctttacttgtgctgcttgtggcaa

SEQ ID NO: 359203 - DNA, 25 bp, Mus musculus
cctttacttgtggtgcttgtggcaa

SEQ ID NO: 359204 - DNA, 25 bp, Mus musculus
cctttactttgcaactcaccagcaa

SEQ ID NO: 359205 - DNA, 25 bp, Mus musculus
cctttactttgctactcaccagcaa

SEQ ID NO: 359206 - DNA, 25 bp, Mus musculus
cctttagactaaacagcctgggcat

SEQ ID NO: 359207 - DNA, 25 bp, Mus musculus
cctttagactaatcagcctgggcat

SEQ ID NO: 359208 - DNA, 25 bp, Mus musculus
cctttagactgtatcagagccaatg

SEQ ID NO: 359209 - DNA, 25 bp, Mus musculus
cctttagactgtttcagagccaatg

SEQ ID NO: 359210 - DNA, 25 bp, Mus musculus
cctttagcatgaactgggtaggtaa

SEQ ID NO: 359211 - DNA, 25 bp, Mus musculus
cctttagcatgatctgggtaggtaa

SEQ ID NO: 359212 - DNA, 25 bp, Mus musculus
cctttaggagggagcgctcccatcc

SEQ ID NO: 359213 - DNA, 25 bp, Mus musculus
cctttaggagggtgcgctcccatcc

SEQ ID NO: 359214 - DNA, 25 bp, Mus musculus
cctttagtaacacctcatggatcat

SEQ ID NO: 359215 - DNA, 25 bp, Mus musculus
cctttagtaacagctcatggatcat

SEQ ID NO: 359216 - DNA, 25 bp, Mus musculus
cctttagtcttgagtacccttcctg

SEQ ID NO: 359217 - DNA, 25 bp, Mus musculus
cctttagtcttgtgtacccttcctg

SEQ ID NO: 359218 - DNA, 25 bp, Mus musculus
cctttagtgaagaagtatgccgctg

SEQ ID NO: 359219 - DNA, 25 bp, Mus musculus
cctttagtgaagtagtatgccgctg

SEQ ID NO: 359220 - DNA, 25 bp, Mus musculus
cctttagtgagcaccctgttgggaa

SEQ ID NO: 359221 - DNA, 25 bp, Mus musculus
cctttagtgagctccctgttgggaa

SEQ ID NO: 359222 - DNA, 25 bp, Mus musculus
cctttatcacacagttctgaaaatc

SEQ ID NO: 359223 - DNA, 25 bp, Mus musculus
cctttatcacactgttctgaaaatc

SEQ ID NO: 359224 - DNA, 25 bp, Mus musculus
cctttatccagccttcaaatcttat

SEQ ID NO: 359225 - DNA, 25 bp, Mus musculus
cctttatccagcgttcaaatcttat

SEQ ID NO: 359226 - DNA, 25 bp, Mus musculus
cctttatcccaacctttcttcaagt

SEQ ID NO: 359227 - DNA, 25 bp, Mus musculus
cctttatcccaagctttcttcaagt

SEQ ID NO: 359228 - DNA, 25 bp, Mus musculus
cctttatcccttacaagctatgcaa

SEQ ID NO: 359229 - DNA, 25 bp, Mus musculus
cctttatccctttcaagctatgcaa

SEQ ID NO: 359230 - DNA, 25 bp, Mus musculus
cctttatccttaactaaactattag

SEQ ID NO: 359231 - DNA, 25 bp, Mus musculus
cctttatccttatctaaactattag

SEQ ID NO: 359232 - DNA, 25 bp, Mus musculus
cctttatcctttagagcagcttgac

SEQ ID NO: 359233 - DNA, 25 bp, Mus musculus
cctttatccttttgagcagcttgac

SEQ ID NO: 359234 - DNA, 25 bp, Mus musculus
cctttatcggtaaggagtctgcggg

SEQ ID NO: 359235 - DNA, 25 bp, Mus musculus
cctttatcggtatggagtctgcggg

SEQ ID NO: 359236 - DNA, 25 bp, Mus musculus
cctttatgaaccacaggattgggaa

SEQ ID NO: 359237 - DNA, 25 bp, Mus musculus
cctttatgaaccatgtgattgacga

SEQ ID NO: 359238 - DNA, 25 bp, Mus musculus
cctttatgaacctcaggattgggaa

SEQ ID NO: 359239 - DNA, 25 bp, Mus musculus
cctttatgaaccttgtgattgacga

SEQ ID NO: 359240 - DNA, 25 bp, Mus musculus
cctttatgactgctctggtgccaga

SEQ ID NO: 359241 - DNA, 25 bp, Mus musculus
cctttatgactggtctggtgccaga

SEQ ID NO: 359242 - DNA, 25 bp, Mus musculus
cctttatgagatcttgcggttatga

SEQ ID NO: 359243 - DNA, 25 bp, Mus musculus
cctttatgagatgttgcggttatga

SEQ ID NO: 359244 - DNA, 25 bp, Mus musculus
cctttatggaacaccgacttaatga

SEQ ID NO: 359245 - DNA, 25 bp, Mus musculus
cctttatggaactccgacttaatga

SEQ ID NO: 359246 - DNA, 25 bp, Mus musculus
cctttatgggatctttgtgttacta

SEQ ID NO: 359247 - DNA, 25 bp, Mus musculus
cctttatgggatgtttgtgttacta

SEQ ID NO: 359248 - DNA, 25 bp, Mus musculus
cctttatggtcaccgctggcttcag

SEQ ID NO: 359249 - DNA, 25 bp, Mus musculus
cctttatggtcagcgctggcttcag

SEQ ID NO: 359250 - DNA, 25 bp, Mus musculus
cctttatgtctaaccagtcactcaa

SEQ ID NO: 359251 - DNA, 25 bp, Mus musculus
cctttatgtctatccagtcactcaa

SEQ ID NO: 359252 - DNA, 25 bp, Mus musculus
cctttatttgggagtgcgctgccac

SEQ ID NO: 359253 - DNA, 25 bp, Mus musculus
cctttatttgggtgtgcgctgccac

SEQ ID NO: 359254 - DNA, 25 bp, Mus musculus
cctttcaactttcccaatccattag

SEQ ID NO: 359255 - DNA, 25 bp, Mus musculus
cctttcaactttgccaatccattag

SEQ ID NO: 359256 - DNA, 25 bp, Mus musculus
cctttcacaacaccctcaaatgata

SEQ ID NO: 359257 - DNA, 25 bp, Mus musculus
cctttcacaacagcctcaaatgata

SEQ ID NO: 359258 - DNA, 25 bp, Mus musculus
cctttcaccatgaggatcttgggtt

SEQ ID NO: 359259 - DNA, 25 bp, Mus musculus
cctttcaccatgtggatcttgggtt

SEQ ID NO: 359260 - DNA, 25 bp, Mus musculus
cctttcactactcggaattaatact

SEQ ID NO: 359261 - DNA, 25 bp, Mus musculus
cctttcactactgggaattaatact

SEQ ID NO: 359262 - DNA, 25 bp, Mus musculus
cctttcactcttaggtctgatggga

SEQ ID NO: 359263 - DNA, 25 bp, Mus musculus
cctttcactctttggtctgatggga

SEQ ID NO: 359264 - DNA, 25 bp, Mus musculus
cctttcacttatctggacagtcacc

SEQ ID NO: 359265 - DNA, 25 bp, Mus musculus
cctttcacttatgtggacagtcacc

SEQ ID NO: 359266 - DNA, 25 bp, Mus musculus
cctttcagaagaaccacgaggctct

SEQ ID NO: 359267 - DNA, 25 bp, Mus musculus
cctttcagaagatccacgaggctct

SEQ ID NO: 359268 - DNA, 25 bp, Mus musculus
cctttcagcccgaggatgaggatag

SEQ ID NO: 359269 - DNA, 25 bp, Mus musculus
cctttcagcccgtggatgaggatag

SEQ ID NO: 359270 - DNA, 25 bp, Mus musculus
cctttcaggaaaagggattctactt

SEQ ID NO: 359271 - DNA, 25 bp, Mus musculus
cctttcaggaaatgggattctactt

SEQ ID NO: 359272 - DNA, 25 bp, Mus musculus
cctttcaggatcaattttttggagg

SEQ ID NO: 359273 - DNA, 25 bp, Mus musculus
cctttcaggatctattttttggagg

SEQ ID NO: 359274 - DNA, 25 bp, Mus musculus
cctttcagggtcaaaatggctccta

SEQ ID NO: 359275 - DNA, 25 bp, Mus musculus
cctttcagggtctaaatggctccta

SEQ ID NO: 359276 - DNA, 25 bp, Mus musculus
cctttcaggtgtaccgagtgtggga

SEQ ID NO: 359277 - DNA, 25 bp, Mus musculus
cctttcaggtgttccgagtgtggga

SEQ ID NO: 359278 - DNA, 25 bp, Mus musculus
cctttcagtaagatgggccatggaa

SEQ ID NO: 359279 - DNA, 25 bp, Mus musculus
cctttcagtaagttgggccatggaa

SEQ ID NO: 359280 - DNA, 25 bp, Mus musculus
cctttcagttcactcttgggctaat

SEQ ID NO: 359281 - DNA, 25 bp, Mus musculus
cctttcagttcagtcttgggctaat

SEQ ID NO: 359282 - DNA, 25 bp, Mus musculus
cctttcataactattctgctgcata

SEQ ID NO: 359283 - DNA, 25 bp, Mus musculus
cctttcataacttttctgctgcata

SEQ ID NO: 359284 - DNA, 25 bp, Mus musculus
cctttcataagacctgccttggtca

SEQ ID NO: 359285 - DNA, 25 bp, Mus musculus
cctttcataagagctgccttggtca

SEQ ID NO: 359286 - DNA, 25 bp, Mus musculus
cctttcatcagacacccacatgtga

SEQ ID NO: 359287 - DNA, 25 bp, Mus musculus
cctttcatcagagacccacatgtga

SEQ ID NO: 359288 - DNA, 25 bp, Mus musculus
cctttcatccctaggattagctcta

SEQ ID NO: 359289 - DNA, 25 bp, Mus musculus
cctttcatcccttggattagctcta

SEQ ID NO: 359290 - DNA, 25 bp, Mus musculus
cctttcatcttcacctagtcaataa

SEQ ID NO: 359291 - DNA, 25 bp, Mus musculus
cctttcatcttctcctagtcaataa

SEQ ID NO: 359292 - DNA, 25 bp, Mus musculus
cctttcatgcacatggattgtggat

SEQ ID NO: 359293 - DNA, 25 bp, Mus musculus
cctttcatgcacttggattgtggat

SEQ ID NO: 359294 - DNA, 25 bp, Mus musculus
cctttcatggcgctgtagctcaaag

SEQ ID NO: 359295 - DNA, 25 bp, Mus musculus
cctttcatggcggtgtagctcaaag

SEQ ID NO: 359296 - DNA, 25 bp, Mus musculus
cctttcatgtataaaaatgcttaat

SEQ ID NO: 359297 - DNA, 25 bp, Mus musculus
cctttcatgtattaaaatgcttaat

SEQ ID NO: 359298 - DNA, 25 bp, Mus musculus
cctttcattggtaggtatggagagc

SEQ ID NO: 359299 - DNA, 25 bp, Mus musculus
cctttcattggttggtatggagagc

SEQ ID NO: 359300 - DNA, 25 bp, Mus musculus
cctttcatttctattcatgggatag

SEQ ID NO: 359301 - DNA, 25 bp, Mus musculus
cctttcatttcttttcatgggatag

SEQ ID NO: 359302 - DNA, 25 bp, Mus musculus
cctttccaaagtcccagcatcctga

SEQ ID NO: 359303 - DNA, 25 bp, Mus musculus
cctttccaaagtgccagcatcctga

SEQ ID NO: 359304 - DNA, 25 bp, Mus musculus
cctttccaacttcttgctgacaaat

SEQ ID NO: 359305 - DNA, 25 bp, Mus musculus
cctttccaacttgttgctgacaaat

SEQ ID NO: 359306 - DNA, 25 bp, Mus musculus
cctttccaaggaatcacactctaat

SEQ ID NO: 359307 - DNA, 25 bp, Mus musculus
cctttccaaggattcacactctaat

SEQ ID NO: 359308 - DNA, 25 bp, Mus musculus
cctttccaataaagttgaacatctt

SEQ ID NO: 359309 - DNA, 25 bp, Mus musculus
cctttccaataatgttgaacatctt

SEQ ID NO: 359310 - DNA, 25 bp, Mus musculus
cctttccatgttagtgggctctgtt

SEQ ID NO: 359311 - DNA, 25 bp, Mus musculus
cctttccatgtttgtgggctctgtt

SEQ ID NO: 359312 - DNA, 25 bp, Mus musculus
cctttcccagagacgtttacatatt

SEQ ID NO: 359313 - DNA, 25 bp, Mus musculus
cctttcccagagtcgtttacatatt

SEQ ID NO: 359314 - DNA, 25 bp, Mus musculus
cctttcccagcaagagattgtttat

SEQ ID NO: 359315 - DNA, 25 bp, Mus musculus
cctttcccagcatgagattgtttat

SEQ ID NO: 359316 - DNA, 25 bp, Mus musculus
cctttcccatctattttgtctgtga

SEQ ID NO: 359317 - DNA, 25 bp, Mus musculus
cctttcccatcttttttgtctgtga

SEQ ID NO: 359318 - DNA, 25 bp, Mus musculus
cctttccccaagatatctgagttca

SEQ ID NO: 359319 - DNA, 25 bp, Mus musculus
cctttccccaagttatctgagttca

SEQ ID NO: 359320 - DNA, 25 bp, Mus musculus
cctttccggtttccattggcaggga

SEQ ID NO: 359321 - DNA, 25 bp, Mus musculus
cctttccggtttgcattggcaggga

SEQ ID NO: 359322 - DNA, 25 bp, Mus musculus
cctttccgtactcgatgctgttatg

SEQ ID NO: 359323 - DNA, 25 bp, Mus musculus
cctttccgtactggatgctgttatg

SEQ ID NO: 359324 - DNA, 25 bp, Mus musculus
cctttcctaaggactgttgtatgtt

SEQ ID NO: 359325 - DNA, 25 bp, Mus musculus
cctttcctaaggtctgttgtatgtt

SEQ ID NO: 359326 - DNA, 25 bp, Mus musculus
cctttcctaagtatccattcctttg

SEQ ID NO: 359327 - DNA, 25 bp, Mus musculus
cctttcctaagtttccattcctttg

SEQ ID NO: 359328 - DNA, 25 bp, Mus musculus
cctttcctacctattaacatgcttg

SEQ ID NO: 359329 - DNA, 25 bp, Mus musculus
cctttcctaccttttaacatgcttg

SEQ ID NO: 359330 - DNA, 25 bp, Mus musculus
cctttcctagacacatggcaatcct

SEQ ID NO: 359331 - DNA, 25 bp, Mus musculus
cctttcctagactcatggcaatcct

SEQ ID NO: 359332 - DNA, 25 bp, Mus musculus
cctttcctcagactcgcagggatga

SEQ ID NO: 359333 - DNA, 25 bp, Mus musculus
cctttcctcagagtcgcagggatga

SEQ ID NO: 359334 - DNA, 25 bp, Mus musculus
cctttcctccttacattacatttgg

SEQ ID NO: 359335 - DNA, 25 bp, Mus musculus
cctttcctcctttcattacatttgg

SEQ ID NO: 359336 - DNA, 25 bp, Mus musculus
cctttcctctgcaagtgactggttc

SEQ ID NO: 359337 - DNA, 25 bp, Mus musculus
cctttcctctgctagtgactggttc

SEQ ID NO: 359338 - DNA, 25 bp, Mus musculus
cctttcctgacacttgatccctttg

SEQ ID NO: 359339 - DNA, 25 bp, Mus musculus
cctttcctgacagttgatccctttg

SEQ ID NO: 359340 - DNA, 25 bp, Mus musculus
cctttcctgaccactcattttaaat

SEQ ID NO: 359341 - DNA, 25 bp, Mus musculus
cctttcctgacctctcattttaaat

SEQ ID NO: 359342 - DNA, 25 bp, Mus musculus
cctttcctgaggattaggctgttgt

SEQ ID NO: 359343 - DNA, 25 bp, Mus musculus
cctttcctgaggtttaggctgttgt

SEQ ID NO: 359344 - DNA, 25 bp, Mus musculus
cctttcctgataaggctgcctgcaa

SEQ ID NO: 359345 - DNA, 25 bp, Mus musculus
cctttcctgatatggctgcctgcaa

SEQ ID NO: 359346 - DNA, 25 bp, Mus musculus
cctttcctgattactttgtatcagt

SEQ ID NO: 359347 - DNA, 25 bp, Mus musculus
cctttcctgatttctttgtatcagt

SEQ ID NO: 359348 - DNA, 25 bp, Mus musculus
cctttcctgtaaaattctctcatgc

SEQ ID NO: 359349 - DNA, 25 bp, Mus musculus
cctttcctgtaatattctctcatgc

SEQ ID NO: 359350 - DNA, 25 bp, Mus musculus
cctttcctgttcattatctgggatg

SEQ ID NO: 359351 - DNA, 25 bp, Mus musculus
cctttcctgttctttatctgggatg

SEQ ID NO: 359352 - DNA, 25 bp, Mus musculus
cctttcctgtttaaaggagatcact

SEQ ID NO: 359353 - DNA, 25 bp, Mus musculus
cctttcctgttttaaggagatcact

SEQ ID NO: 359354 - DNA, 25 bp, Mus musculus
cctttccttcaacaatgggcactac

SEQ ID NO: 359355 - DNA, 25 bp, Mus musculus
cctttccttcaagaatgggcactac

SEQ ID NO: 359356 - DNA, 25 bp, Mus musculus
cctttccttgatcggacacttgaac

SEQ ID NO: 359357 - DNA, 25 bp, Mus musculus
cctttccttgatgggacacttgaac

SEQ ID NO: 359358 - DNA, 25 bp, Mus musculus
cctttccttgcactcagaggctttt

SEQ ID NO: 359359 - DNA, 25 bp, Mus musculus
cctttccttgcagtcagaggctttt

SEQ ID NO: 359360 - DNA, 25 bp, Mus musculus
cctttccttggcatttatcatgcta

SEQ ID NO: 359361 - DNA, 25 bp, Mus musculus
cctttccttggcttttatcatgcta

SEQ ID NO: 359362 - DNA, 25 bp, Mus musculus
cctttcctttttaagcatctacgtg

SEQ ID NO: 359363 - DNA, 25 bp, Mus musculus
cctttccttttttagcatctacgtg

SEQ ID NO: 359364 - DNA, 25 bp, Mus musculus
cctttcgaatggcactaccttaggg

SEQ ID NO: 359365 - DNA, 25 bp, Mus musculus
cctttcgaatgggactaccttaggg

SEQ ID NO: 359366 - DNA, 25 bp, Mus musculus
cctttcgactccaccatagaactgg

SEQ ID NO: 359367 - DNA, 25 bp, Mus musculus
cctttcgactcctccatagaactgg

SEQ ID NO: 359368 - DNA, 25 bp, Mus musculus
cctttcggcctgacattgtggttaa

SEQ ID NO: 359369 - DNA, 25 bp, Mus musculus
cctttcggcctgtcattgtggttaa

SEQ ID NO: 359370 - DNA, 25 bp, Mus musculus
cctttcgtcccaagtaggtagaaat

SEQ ID NO: 359371 - DNA, 25 bp, Mus musculus
cctttcgtcccatgtaggtagaaat

SEQ ID NO: 359372 - DNA, 25 bp, Mus musculus
cctttcgtgctaccgtgaccattac

SEQ ID NO: 359373 - DNA, 25 bp, Mus musculus
cctttcgtgctagcgtgaccattac

SEQ ID NO: 359374 - DNA, 25 bp, Mus musculus
cctttctccacacactagtttttat

SEQ ID NO: 359375 - DNA, 25 bp, Mus musculus
cctttctccacagactagtttttat

SEQ ID NO: 359376 - DNA, 25 bp, Mus musculus
cctttctccataagacttcaactgg

SEQ ID NO: 359377 - DNA, 25 bp, Mus musculus
cctttctccatatgacttcaactgg

SEQ ID NO: 359378 - DNA, 25 bp, Mus musculus
cctttctccatcatttggtcactac

SEQ ID NO: 359379 - DNA, 25 bp, Mus musculus
cctttctccatcttttggtcactac

SEQ ID NO: 359380 - DNA, 25 bp, Mus musculus
cctttctcccatctaattggactgg

SEQ ID NO: 359381 - DNA, 25 bp, Mus musculus
cctttctcccatgtaattggactgg

SEQ ID NO: 359382 - DNA, 25 bp, Mus musculus
cctttctccctcattgagtggtgca

SEQ ID NO: 359383 - DNA, 25 bp, Mus musculus
cctttctccctctttgagtggtgca

SEQ ID NO: 359384 - DNA, 25 bp, Mus musculus
cctttctccgctagggatcctggaa

SEQ ID NO: 359385 - DNA, 25 bp, Mus musculus
cctttctccgcttgggatcctggaa

SEQ ID NO: 359386 - DNA, 25 bp, Mus musculus
cctttctccttaatgtagagattat

SEQ ID NO: 359387 - DNA, 25 bp, Mus musculus
cctttctccttattgtagagattat

SEQ ID NO: 359388 - DNA, 25 bp, Mus musculus
cctttctctatcattatggacttca

SEQ ID NO: 359389 - DNA, 25 bp, Mus musculus
cctttctctatctttatggacttca

SEQ ID NO: 359390 - DNA, 25 bp, Mus musculus
cctttctctcataaatatcaccctg

SEQ ID NO: 359391 - DNA, 25 bp, Mus musculus
cctttctctcattaatatcaccctg

SEQ ID NO: 359392 - DNA, 25 bp, Mus musculus
cctttctcttacacactacagatgt

SEQ ID NO: 359393 - DNA, 25 bp, Mus musculus
cctttctcttactcactacagatgt

SEQ ID NO: 359394 - DNA, 25 bp, Mus musculus
cctttctgaccccagaggtacattt

SEQ ID NO: 359395 - DNA, 25 bp, Mus musculus
cctttctgacccgagaggtacattt

SEQ ID NO: 359396 - DNA, 25 bp, Mus musculus
cctttctgcacacgtatggcagcgt

SEQ ID NO: 359397 - DNA, 25 bp, Mus musculus
cctttctgcacaggtatggcagcgt

SEQ ID NO: 359398 - DNA, 25 bp, Mus musculus
cctttctgcgtcagggagcttggaa

SEQ ID NO: 359399 - DNA, 25 bp, Mus musculus
cctttctgcgtctgggagcttggaa

SEQ ID NO: 359400 - DNA, 25 bp, Mus musculus
cctttctgcttcagtttggcatagt

SEQ ID NO: 359401 - DNA, 25 bp, Mus musculus
cctttctgcttctgtttggcatagt

SEQ ID NO: 359402 - DNA, 25 bp, Mus musculus
cctttctggcttcagtggaaagtag

SEQ ID NO: 359403 - DNA, 25 bp, Mus musculus
cctttctggcttgagtggaaagtag

SEQ ID NO: 359404 - DNA, 25 bp, Mus musculus
cctttctggtagctctgggctctga

SEQ ID NO: 359405 - DNA, 25 bp, Mus musculus
cctttctggtaggtctgggctctga

SEQ ID NO: 359406 - DNA, 25 bp, Mus musculus
cctttctggtcactgttgactagca

SEQ ID NO: 359407 - DNA, 25 bp, Mus musculus
cctttctggtcagtgttgactagca

SEQ ID NO: 359408 - DNA, 25 bp, Mus musculus
cctttctggtccatcaacttttgaa

SEQ ID NO: 359409 - DNA, 25 bp, Mus musculus
cctttctggtccttcaacttttgaa

SEQ ID NO: 359410 - DNA, 25 bp, Mus musculus
cctttctggtgtaagtcagggaatc

SEQ ID NO: 359411 - DNA, 25 bp, Mus musculus
cctttctggtgttagtcagggaatc

SEQ ID NO: 359412 - DNA, 25 bp, Mus musculus
cctttctggtttcatgtcatctttt

SEQ ID NO: 359413 - DNA, 25 bp, Mus musculus
cctttctggtttgatgtcatctttt

SEQ ID NO: 359414 - DNA, 25 bp, Mus musculus
cctttctgtagtcactgtgcaggtt

SEQ ID NO: 359415 - DNA, 25 bp, Mus musculus
cctttctgtagtgactgtgcaggtt

SEQ ID NO: 359416 - DNA, 25 bp, Mus musculus
cctttcttagaaaagtacaggcaga

SEQ ID NO: 359417 - DNA, 25 bp, Mus musculus
cctttcttagaatagtacaggcaga

SEQ ID NO: 359418 - DNA, 25 bp, Mus musculus
cctttcttcatacgtgttctcaaaa

SEQ ID NO: 359419 - DNA, 25 bp, Mus musculus
cctttcttcataggtgttctcaaaa

SEQ ID NO: 359420 - DNA, 25 bp, Mus musculus
cctttcttccacaattggtaatggt

SEQ ID NO: 359421 - DNA, 25 bp, Mus musculus
cctttcttccactattggtaatggt

SEQ ID NO: 359422 - DNA, 25 bp, Mus musculus
cctttcttctatattatgtctctaa

SEQ ID NO: 359423 - DNA, 25 bp, Mus musculus
cctttcttctattttatgtctctaa

SEQ ID NO: 359424 - DNA, 25 bp, Mus musculus
cctttcttctcacctctgaatttgt

SEQ ID NO: 359425 - DNA, 25 bp, Mus musculus
cctttcttctcagctctgaatttgt

SEQ ID NO: 359426 - DNA, 25 bp, Mus musculus
cctttcttgggaacttgtagactag

SEQ ID NO: 359427 - DNA, 25 bp, Mus musculus
cctttcttgggatcttgtagactag

SEQ ID NO: 359428 - DNA, 25 bp, Mus musculus
cctttcttgtgtctgtgtcagtaaa

SEQ ID NO: 359429 - DNA, 25 bp, Mus musculus
cctttcttgtgtgtgtgtcagtaaa

SEQ ID NO: 359430 - DNA, 25 bp, Mus musculus
cctttcttgttcacttcgccatagt

SEQ ID NO: 359431 - DNA, 25 bp, Mus musculus
cctttcttgttctcttcgccatagt

SEQ ID NO: 359432 - DNA, 25 bp, Mus musculus
cctttcttgttgcatacttcagagg

SEQ ID NO: 359433 - DNA, 25 bp, Mus musculus
cctttcttgttggatacttcagagg

SEQ ID NO: 359434 - DNA, 25 bp, Mus musculus
cctttcttgtttcttagctgtgagt

SEQ ID NO: 359435 - DNA, 25 bp, Mus musculus
cctttcttgtttgttagctgtgagt

SEQ ID NO: 359436 - DNA, 25 bp, Mus musculus
cctttctttatgcatccctggttag

SEQ ID NO: 359437 - DNA, 25 bp, Mus musculus
cctttctttatggatccctggttag

SEQ ID NO: 359438 - DNA, 25 bp, Mus musculus
cctttctttcagctacttaagccat

SEQ ID NO: 359439 - DNA, 25 bp, Mus musculus
cctttctttcaggtacttaagccat

SEQ ID NO: 359440 - DNA, 25 bp, Mus musculus
cctttctttctacgtgtctctcaaa

SEQ ID NO: 359441 - DNA, 25 bp, Mus musculus
cctttctttctaggtgtctctcaaa

SEQ ID NO: 359442 - DNA, 25 bp, Mus musculus
cctttctttgctcctacagtttaag

SEQ ID NO: 359443 - DNA, 25 bp, Mus musculus
cctttctttgctgctacagtttaag

SEQ ID NO: 359444 - DNA, 25 bp, Mus musculus
cctttctttggtaattgttggatgg

SEQ ID NO: 359445 - DNA, 25 bp, Mus musculus
cctttctttggttattgttggatgg

SEQ ID NO: 359446 - DNA, 25 bp, Mus musculus
cctttctttgtgacagatgggttaa

SEQ ID NO: 359447 - DNA, 25 bp, Mus musculus
cctttctttgtgtcagatgggttaa

SEQ ID NO: 359448 - DNA, 25 bp, Mus musculus
cctttgaaagaaacaggctgctcag

SEQ ID NO: 359449 - DNA, 25 bp, Mus musculus
cctttgaaagaatcaggctgctcag

SEQ ID NO: 359450 - DNA, 25 bp, Mus musculus
cctttgaaatgacttggcactaaat

SEQ ID NO: 359451 - DNA, 25 bp, Mus musculus
cctttgaaatgagttggcactaaat

SEQ ID NO: 359452 - DNA, 25 bp, Mus musculus
cctttgaactgcaggagggttgtta

SEQ ID NO: 359453 - DNA, 25 bp, Mus musculus
cctttgaactgctggagggttgtta

SEQ ID NO: 359454 - DNA, 25 bp, Mus musculus
cctttgaattgtaaccaagtgaact

SEQ ID NO: 359455 - DNA, 25 bp, Mus musculus
cctttgaattgttaccaagtgaact

SEQ ID NO: 359456 - DNA, 25 bp, Mus musculus
cctttgacaaacatgatcctccatt

SEQ ID NO: 359457 - DNA, 25 bp, Mus musculus
cctttgacaaacttgatcctccatt

SEQ ID NO: 359458 - DNA, 25 bp, Mus musculus
cctttgacagtacgcgtgcacaaca

SEQ ID NO: 359459 - DNA, 25 bp, Mus musculus
cctttgacagtaggcgtgcacaaca

SEQ ID NO: 359460 - DNA, 25 bp, Mus musculus
cctttgacatagagggcccatctgt

SEQ ID NO: 359461 - DNA, 25 bp, Mus musculus
cctttgacatagtgggcccatctgt

SEQ ID NO: 359462 - DNA, 25 bp, Mus musculus
cctttgacatgaccataaacagatg

SEQ ID NO: 359463 - DNA, 25 bp, Mus musculus
cctttgacatgagcataaacagatg

SEQ ID NO: 359464 - DNA, 25 bp, Mus musculus
cctttgaccagaagaccattgatga

SEQ ID NO: 359465 - DNA, 25 bp, Mus musculus
cctttgaccagatgaccattgatga

SEQ ID NO: 359466 - DNA, 25 bp, Mus musculus
cctttgacccctaacattatttgca

SEQ ID NO: 359467 - DNA, 25 bp, Mus musculus
cctttgaccccttacattatttgca

SEQ ID NO: 359468 - DNA, 25 bp, Mus musculus
cctttgaccttaattgtggtttctg

SEQ ID NO: 359469 - DNA, 25 bp, Mus musculus
cctttgaccttatttgtggtttctg

SEQ ID NO: 359470 - DNA, 25 bp, Mus musculus
cctttgagatgacttgagcaagcta

SEQ ID NO: 359471 - DNA, 25 bp, Mus musculus
cctttgagatgagttgagcaagcta

SEQ ID NO: 359472 - DNA, 25 bp, Mus musculus
cctttgagcatgctacgtgcttacc

SEQ ID NO: 359473 - DNA, 25 bp, Mus musculus
cctttgagcatggtacgtgcttacc

SEQ ID NO: 359474 - DNA, 25 bp, Mus musculus
cctttgagctcacgcttgtgtttaa

SEQ ID NO: 359475 - DNA, 25 bp, Mus musculus
cctttgagctcaggcttgtgtttaa

SEQ ID NO: 359476 - DNA, 25 bp, Mus musculus
cctttgagggagcgatgcagtaaat

SEQ ID NO: 359477 - DNA, 25 bp, Mus musculus
cctttgagggagggatgcagtaaat

SEQ ID NO: 359478 - DNA, 25 bp, Mus musculus
cctttgagggtaaacaagccagtat

SEQ ID NO: 359479 - DNA, 25 bp, Mus musculus
cctttgagggtatacaagccagtat

SEQ ID NO: 359480 - DNA, 25 bp, Mus musculus
cctttgatatcccaggcttttatga

SEQ ID NO: 359481 - DNA, 25 bp, Mus musculus
cctttgatatccgaggcttttatga

SEQ ID NO: 359482 - DNA, 25 bp, Mus musculus
cctttgatcccaagattgcctgtaa

SEQ ID NO: 359483 - DNA, 25 bp, Mus musculus
cctttgatcccatgattgcctgtaa

SEQ ID NO: 359484 - DNA, 25 bp, Mus musculus
cctttgatcctaccatgtatggaag

SEQ ID NO: 359485 - DNA, 25 bp, Mus musculus
cctttgatcctagcatgtatggaag

SEQ ID NO: 359486 - DNA, 25 bp, Mus musculus
cctttgatcttgaccactcatggaa

SEQ ID NO: 359487 - DNA, 25 bp, Mus musculus
cctttgatcttgtccactcatggaa

SEQ ID NO: 359488 - DNA, 25 bp, Mus musculus
cctttgatgaatctgggcattgaat

SEQ ID NO: 359489 - DNA, 25 bp, Mus musculus
cctttgatgaatgtgggcattgaat

SEQ ID NO: 359490 - DNA, 25 bp, Mus musculus
cctttgattctaccacttaggaggc

SEQ ID NO: 359491 - DNA, 25 bp, Mus musculus
cctttgattctagcacttaggaggc

SEQ ID NO: 359492 - DNA, 25 bp, Mus musculus
cctttgattggtcagctttaccatt

SEQ ID NO: 359493 - DNA, 25 bp, Mus musculus
cctttgattggtgagctttaccatt

SEQ ID NO: 359494 - DNA, 25 bp, Mus musculus
cctttgcaacttacagctggagcat

SEQ ID NO: 359495 - DNA, 25 bp, Mus musculus
cctttgcaactttcagctggagcat

SEQ ID NO: 359496 - DNA, 25 bp, Mus musculus
cctttgcaagtcatccatgtcattc

SEQ ID NO: 359497 - DNA, 25 bp, Mus musculus
cctttgcaagtcttccatgtcattc

SEQ ID NO: 359498 - DNA, 25 bp, Mus musculus
cctttgcacaagctacgaggagaaa

SEQ ID NO: 359499 - DNA, 25 bp, Mus musculus
cctttgcacaaggtacgaggagaaa

SEQ ID NO: 359500 - DNA, 25 bp, Mus musculus
cctttgcacaggctacttcatagta

SEQ ID NO: 359501 - DNA, 25 bp, Mus musculus
cctttgcacagggtacttcatagta

SEQ ID NO: 359502 - DNA, 25 bp, Mus musculus
cctttgcacctcacagtgaagtgac

SEQ ID NO: 359503 - DNA, 25 bp, Mus musculus
cctttgcacctctcagtgaagtgac

SEQ ID NO: 359504 - DNA, 25 bp, Mus musculus
cctttgcagatgctcttgggagtgt

SEQ ID NO: 359505 - DNA, 25 bp, Mus musculus
cctttgcagatggtcttgggagtgt

SEQ ID NO: 359506 - DNA, 25 bp, Mus musculus
cctttgcaggctatgttggtggagt

SEQ ID NO: 359507 - DNA, 25 bp, Mus musculus
cctttgcaggctttgttggtggagt

SEQ ID NO: 359508 - DNA, 25 bp, Mus musculus
cctttgcagtcacagcatagcttgt

SEQ ID NO: 359509 - DNA, 25 bp, Mus musculus
cctttgcagtcagagcatagcttgt

SEQ ID NO: 359510 - DNA, 25 bp, Mus musculus
cctttgcattctcggtgttctacta

SEQ ID NO: 359511 - DNA, 25 bp, Mus musculus
cctttgcattctgggtgttctacta

SEQ ID NO: 359512 - DNA, 25 bp, Mus musculus
cctttgccagaactgtaaatctgag

SEQ ID NO: 359513 - DNA, 25 bp, Mus musculus
cctttgccagaagtgtaaatctgag

SEQ ID NO: 359514 - DNA, 25 bp, Mus musculus
cctttgccagacatcttgatgtgtt

SEQ ID NO: 359515 - DNA, 25 bp, Mus musculus
cctttgccagacttcttgatgtgtt

SEQ ID NO: 359516 - DNA, 25 bp, Mus musculus
cctttgccatggcaatgacctgttt

SEQ ID NO: 359517 - DNA, 25 bp, Mus musculus
cctttgccatgggaatgacctgttt

SEQ ID NO: 359518 - DNA, 25 bp, Mus musculus
cctttgcccttcaaactgcagattt

SEQ ID NO: 359519 - DNA, 25 bp, Mus musculus
cctttgcccttctaactgcagattt

SEQ ID NO: 359520 - DNA, 25 bp, Mus musculus
cctttgcctagccttagtcgagagt

SEQ ID NO: 359521 - DNA, 25 bp, Mus musculus
cctttgcctagcgttagtcgagagt

SEQ ID NO: 359522 - DNA, 25 bp, Mus musculus
cctttgcctatcagaatgggaacta

SEQ ID NO: 359523 - DNA, 25 bp, Mus musculus
cctttgcctatctgaatgggaacta

SEQ ID NO: 359524 - DNA, 25 bp, Mus musculus
cctttgcctgcacgtcagttgtaat

SEQ ID NO: 359525 - DNA, 25 bp, Mus musculus
cctttgcctgcaggtcagttgtaat

SEQ ID NO: 359526 - DNA, 25 bp, Mus musculus
cctttgccttttctattaccgagat

SEQ ID NO: 359527 - DNA, 25 bp, Mus musculus
cctttgccttttgtattaccgagat

SEQ ID NO: 359528 - DNA, 25 bp, Mus musculus
cctttgcgggcgagaaaatgtacca

SEQ ID NO: 359529 - DNA, 25 bp, Mus musculus
cctttgcgggcgtgaaaatgtacca

SEQ ID NO: 359530 - DNA, 25 bp, Mus musculus
cctttgcggtttcgcgttagagaag

SEQ ID NO: 359531 - DNA, 25 bp, Mus musculus
cctttgcggtttggcgttagagaag

SEQ ID NO: 359532 - DNA, 25 bp, Mus musculus
cctttgctaagtccaccttcctgtg

SEQ ID NO: 359533 - DNA, 25 bp, Mus musculus
cctttgctaagtgcaccttcctgtg

SEQ ID NO: 359534 - DNA, 25 bp, Mus musculus
cctttgctaatcacatgctcttttc

SEQ ID NO: 359535 - DNA, 25 bp, Mus musculus
cctttgctaatctcatgctcttttc

SEQ ID NO: 359536 - DNA, 25 bp, Mus musculus
cctttgctactgctttaacaaagaa

SEQ ID NO: 359537 - DNA, 25 bp, Mus musculus
cctttgctactggtttaacaaagaa

SEQ ID NO: 359538 - DNA, 25 bp, Mus musculus
cctttgctatacctcaatttttgga

SEQ ID NO: 359539 - DNA, 25 bp, Mus musculus
cctttgctatacgtcaatttttgga

SEQ ID NO: 359540 - DNA, 25 bp, Mus musculus
cctttgctcatactaaaatgtgcac

SEQ ID NO: 359541 - DNA, 25 bp, Mus musculus
cctttgctcatagtaaaatgtgcac

SEQ ID NO: 359542 - DNA, 25 bp, Mus musculus
cctttgctcattagaactgtgtaga

SEQ ID NO: 359543 - DNA, 25 bp, Mus musculus
cctttgctcattctcctggagtgat

SEQ ID NO: 359544 - DNA, 25 bp, Mus musculus
cctttgctcattgtcctggagtgat

SEQ ID NO: 359545 - DNA, 25 bp, Mus musculus
cctttgctcatttgaactgtgtaga

SEQ ID NO: 359546 - DNA, 25 bp, Mus musculus
cctttgctccttctctgtgaattgc

SEQ ID NO: 359547 - DNA, 25 bp, Mus musculus
cctttgctccttgtctgtgaattgc

SEQ ID NO: 359548 - DNA, 25 bp, Mus musculus
cctttgctcttaaacagcgagtact

SEQ ID NO: 359549 - DNA, 25 bp, Mus musculus
cctttgctcttatacagcgagtact

SEQ ID NO: 359550 - DNA, 25 bp, Mus musculus
cctttgctctttcgctctgtgaata

SEQ ID NO: 359551 - DNA, 25 bp, Mus musculus
cctttgctctttggctctgtgaata

SEQ ID NO: 359552 - DNA, 25 bp, Mus musculus
cctttgctgaccactctaatatgga

SEQ ID NO: 359553 - DNA, 25 bp, Mus musculus
cctttgctgacctctctaatatgga

SEQ ID NO: 359554 - DNA, 25 bp, Mus musculus
cctttgctgagcagtgtatctagaa

SEQ ID NO: 359555 - DNA, 25 bp, Mus musculus
cctttgctgagctgtgtatctagaa

SEQ ID NO: 359556 - DNA, 25 bp, Mus musculus
cctttgctgcccacttgtaagttta

SEQ ID NO: 359557 - DNA, 25 bp, Mus musculus
cctttgctgccctcttgtaagttta

SEQ ID NO: 359558 - DNA, 25 bp, Mus musculus
cctttgctgctcctgaaagctcgga

SEQ ID NO: 359559 - DNA, 25 bp, Mus musculus
cctttgctgctcgtgaaagctcgga

SEQ ID NO: 359560 - DNA, 25 bp, Mus musculus
cctttgctggcactcgtgcaataaa

SEQ ID NO: 359561 - DNA, 25 bp, Mus musculus
cctttgctggcagtcgtgcaataaa

SEQ ID NO: 359562 - DNA, 25 bp, Mus musculus
cctttgctgtgtcggcagtactctg

SEQ ID NO: 359563 - DNA, 25 bp, Mus musculus
cctttgctgtgtgggcagtactctg

SEQ ID NO: 359564 - DNA, 25 bp, Mus musculus
cctttgctgttacgagaccataaat

SEQ ID NO: 359565 - DNA, 25 bp, Mus musculus
cctttgctgttaggagaccataaat

SEQ ID NO: 359566 - DNA, 25 bp, Mus musculus
cctttgcttatgacgtcacatgtac

SEQ ID NO: 359567 - DNA, 25 bp, Mus musculus
cctttgcttatgtcgtcacatgtac

SEQ ID NO: 359568 - DNA, 25 bp, Mus musculus
cctttgcttctaattgactgtctct

SEQ ID NO: 359569 - DNA, 25 bp, Mus musculus
cctttgcttctatttgactgtctct

SEQ ID NO: 359570 - DNA, 25 bp, Mus musculus
cctttgcttcttataatgagtgcga

SEQ ID NO: 359571 - DNA, 25 bp, Mus musculus
cctttgcttcttttaatgagtgcga

SEQ ID NO: 359572 - DNA, 25 bp, Mus musculus
cctttggaagatactctgttctggg

SEQ ID NO: 359573 - DNA, 25 bp, Mus musculus
cctttggaagattctctgttctggg

SEQ ID NO: 359574 - DNA, 25 bp, Mus musculus
cctttggaagtgatgcagctgctga

SEQ ID NO: 359575 - DNA, 25 bp, Mus musculus
cctttggaagtgttgcagctgctga

SEQ ID NO: 359576 - DNA, 25 bp, Mus musculus
cctttggacactccagctctgtaca

SEQ ID NO: 359577 - DNA, 25 bp, Mus musculus
cctttggacactgcagctctgtaca

SEQ ID NO: 359578 - DNA, 25 bp, Mus musculus
cctttggaggctcagttggtactta

SEQ ID NO: 359579 - DNA, 25 bp, Mus musculus
cctttggaggctgagttggtactta

SEQ ID NO: 359580 - DNA, 25 bp, Mus musculus
cctttggagtccagctgggattgaa

SEQ ID NO: 359581 - DNA, 25 bp, Mus musculus
cctttggagtcctgctgggattgaa

SEQ ID NO: 359582 - DNA, 25 bp, Mus musculus
cctttggatgcaactgaagactcaa

SEQ ID NO: 359583 - DNA, 25 bp, Mus musculus
cctttggatgcatctgaagactcaa

SEQ ID NO: 359584 - DNA, 25 bp, Mus musculus
cctttggatgctaagctcgtgtctc

SEQ ID NO: 359585 - DNA, 25 bp, Mus musculus
cctttggatgcttagctcgtgtctc

SEQ ID NO: 359586 - DNA, 25 bp, Mus musculus
cctttggccagtagcgatactgcag

SEQ ID NO: 359587 - DNA, 25 bp, Mus musculus
cctttggccagttgcgatactgcag

SEQ ID NO: 359588 - DNA, 25 bp, Mus musculus
cctttggccggaagctggaattcag

SEQ ID NO: 359589 - DNA, 25 bp, Mus musculus
cctttggccggatgctggaattcag

SEQ ID NO: 359590 - DNA, 25 bp, Mus musculus
cctttggcctgaaagcttgaggtca

SEQ ID NO: 359591 - DNA, 25 bp, Mus musculus
cctttggcctgatagcttgaggtca

SEQ ID NO: 359592 - DNA, 25 bp, Mus musculus
cctttggcttctcgaacatctaaaa

SEQ ID NO: 359593 - DNA, 25 bp, Mus musculus
cctttggcttctggaacatctaaaa

SEQ ID NO: 359594 - DNA, 25 bp, Mus musculus
cctttggctttgagtagagtagggt

SEQ ID NO: 359595 - DNA, 25 bp, Mus musculus
cctttggctttgtgtagagtagggt

SEQ ID NO: 359596 - DNA, 25 bp, Mus musculus
cctttgggccctcacaagtgaaatc

SEQ ID NO: 359597 - DNA, 25 bp, Mus musculus
cctttgggccctgacaagtgaaatc

SEQ ID NO: 359598 - DNA, 25 bp, Mus musculus
cctttgggcgggatgattgcattcg

SEQ ID NO: 359599 - DNA, 25 bp, Mus musculus
cctttgggcgggttgattgcattcg

SEQ ID NO: 359600 - DNA, 25 bp, Mus musculus
cctttggtaagcctcgcaacaagac

SEQ ID NO: 359601 - DNA, 25 bp, Mus musculus
cctttggtaagcgtcgcaacaagac

SEQ ID NO: 359602 - DNA, 25 bp, Mus musculus
cctttggtaattcttgagagctttc

SEQ ID NO: 359603 - DNA, 25 bp, Mus musculus
cctttggtaattgttgagagctttc

SEQ ID NO: 359604 - DNA, 25 bp, Mus musculus
cctttggtatttcacctctcagaaa

SEQ ID NO: 359605 - DNA, 25 bp, Mus musculus
cctttggtatttgacctctcagaaa

SEQ ID NO: 359606 - DNA, 25 bp, Mus musculus
cctttggtctccacacttagaggtg

SEQ ID NO: 359607 - DNA, 25 bp, Mus musculus
cctttggtctcctcacttagaggtg

SEQ ID NO: 359608 - DNA, 25 bp, Mus musculus
cctttggttgtcagagctgtccgaa

SEQ ID NO: 359609 - DNA, 25 bp, Mus musculus
cctttggttgtctgagctgtccgaa

SEQ ID NO: 359610 - DNA, 25 bp, Mus musculus
cctttggtttgacacactttgccac

SEQ ID NO: 359611 - DNA, 25 bp, Mus musculus
cctttggtttgagacactttgccac

SEQ ID NO: 359612 - DNA, 25 bp, Mus musculus
cctttgtaagggattgaacactgct

SEQ ID NO: 359613 - DNA, 25 bp, Mus musculus
cctttgtaagggtttgaacactgct

SEQ ID NO: 359614 - DNA, 25 bp, Mus musculus
cctttgtactacaggaggagtgttg

SEQ ID NO: 359615 - DNA, 25 bp, Mus musculus
cctttgtactactggaggagtgttg

SEQ ID NO: 359616 - DNA, 25 bp, Mus musculus
cctttgtactttaatacaggtgagt

SEQ ID NO: 359617 - DNA, 25 bp, Mus musculus
cctttgtacttttatacaggtgagt

SEQ ID NO: 359618 - DNA, 25 bp, Mus musculus
cctttgtagggcagcattgtgcgct

SEQ ID NO: 359619 - DNA, 25 bp, Mus musculus
cctttgtagggctgcattgtgcgct

SEQ ID NO: 359620 - DNA, 25 bp, Mus musculus
cctttgtatacaattcctaatttca

SEQ ID NO: 359621 - DNA, 25 bp, Mus musculus
cctttgtatacatttcctaatttca

SEQ ID NO: 359622 - DNA, 25 bp, Mus musculus
cctttgtattctcaacattgtttgt

SEQ ID NO: 359623 - DNA, 25 bp, Mus musculus
cctttgtattctgaacattgtttgt

SEQ ID NO: 359624 - DNA, 25 bp, Mus musculus
cctttgtattgaagtatgtgccaat

SEQ ID NO: 359625 - DNA, 25 bp, Mus musculus
cctttgtattgatgtatgtgccaat

SEQ ID NO: 359626 - DNA, 25 bp, Mus musculus
cctttgtcaaggcatgccctcatga

SEQ ID NO: 359627 - DNA, 25 bp, Mus musculus
cctttgtcaagggatgccctcatga

SEQ ID NO: 359628 - DNA, 25 bp, Mus musculus
cctttgtcacagaacgttttgtaat

SEQ ID NO: 359629 - DNA, 25 bp, Mus musculus
cctttgtcacagtacgttttgtaat

SEQ ID NO: 359630 - DNA, 25 bp, Mus musculus
cctttgtcacggcaactaaaatgat

SEQ ID NO: 359631 - DNA, 25 bp, Mus musculus
cctttgtcacgggaactaaaatgat

SEQ ID NO: 359632 - DNA, 25 bp, Mus musculus
cctttgtccgctattttgtggagat

SEQ ID NO: 359633 - DNA, 25 bp, Mus musculus
cctttgtccgcttttttgtggagat

SEQ ID NO: 359634 - DNA, 25 bp, Mus musculus
cctttgtccggcacgtgcagagata

SEQ ID NO: 359635 - DNA, 25 bp, Mus musculus
cctttgtccggctcgtgcagagata

SEQ ID NO: 359636 - DNA, 25 bp, Mus musculus
cctttgtcctcaccgaggtgatttt

SEQ ID NO: 359637 - DNA, 25 bp, Mus musculus
cctttgtcctcagcgaggtgatttt

SEQ ID NO: 359638 - DNA, 25 bp, Mus musculus
cctttgtcctgacttatgaacccac

SEQ ID NO: 359639 - DNA, 25 bp, Mus musculus
cctttgtcctgagttatgaacccac

SEQ ID NO: 359640 - DNA, 25 bp, Mus musculus
cctttgtcggtacccctgtggagga

SEQ ID NO: 359641 - DNA, 25 bp, Mus musculus
cctttgtcggtagccctgtggagga

SEQ ID NO: 359642 - DNA, 25 bp, Mus musculus
cctttgtctctgcaattacattaca

SEQ ID NO: 359643 - DNA, 25 bp, Mus musculus
cctttgtctctggaattacattaca

SEQ ID NO: 359644 - DNA, 25 bp, Mus musculus
cctttgtctgggaacaactcctgaa

SEQ ID NO: 359645 - DNA, 25 bp, Mus musculus
cctttgtctgggtacaactcctgaa

SEQ ID NO: 359646 - DNA, 25 bp, Mus musculus
cctttgtctgttattagattcttga

SEQ ID NO: 359647 - DNA, 25 bp, Mus musculus
cctttgtctgtttttagattcttga

SEQ ID NO: 359648 - DNA, 25 bp, Mus musculus
cctttgtgaccacagctgagagaga

SEQ ID NO: 359649 - DNA, 25 bp, Mus musculus
cctttgtgaccagagctgagagaga

SEQ ID NO: 359650 - DNA, 25 bp, Mus musculus
cctttgtgagtcaggtgtttctcat

SEQ ID NO: 359651 - DNA, 25 bp, Mus musculus
cctttgtgagtctggtgtttctcat

SEQ ID NO: 359652 - DNA, 25 bp, Mus musculus
cctttgtgatgtacctgggatatgc

SEQ ID NO: 359653 - DNA, 25 bp, Mus musculus
cctttgtgatgttcctgggatatgc

SEQ ID NO: 359654 - DNA, 25 bp, Mus musculus
cctttgtgattaaggtgtctcttct

SEQ ID NO: 359655 - DNA, 25 bp, Mus musculus
cctttgtgattatggtgtctcttct

SEQ ID NO: 359656 - DNA, 25 bp, Mus musculus
cctttgtgttctacttgggttggca

SEQ ID NO: 359657 - DNA, 25 bp, Mus musculus
cctttgtgttcttcttgggttggca

SEQ ID NO: 359658 - DNA, 25 bp, Mus musculus
cctttgttaaatagtatggctgtgc

SEQ ID NO: 359659 - DNA, 25 bp, Mus musculus
cctttgttaaattgtatggctgtgc

SEQ ID NO: 359660 - DNA, 25 bp, Mus musculus
cctttgttcaggaatgttttccaat

SEQ ID NO: 359661 - DNA, 25 bp, Mus musculus
cctttgttcaggtatgttttccaat

SEQ ID NO: 359662 - DNA, 25 bp, Mus musculus
cctttgttgttaacctatgtattat

SEQ ID NO: 359663 - DNA, 25 bp, Mus musculus
cctttgttgttatcctatgtattat

SEQ ID NO: 359664 - DNA, 25 bp, Mus musculus
cctttgtttcatatctactcaatgg

SEQ ID NO: 359665 - DNA, 25 bp, Mus musculus
cctttgtttcatttctactcaatgg

SEQ ID NO: 359666 - DNA, 25 bp, Mus musculus
cctttgtttctcatgctatactttg

SEQ ID NO: 359667 - DNA, 25 bp, Mus musculus
cctttgtttctcttgctatactttg

SEQ ID NO: 359668 - DNA, 25 bp, Mus musculus
cctttgtttctgcatctctagtgta

SEQ ID NO: 359669 - DNA, 25 bp, Mus musculus
cctttgtttctggatctctagtgta

SEQ ID NO: 359670 - DNA, 25 bp, Mus musculus
cctttgtttgaaatacttaagcaag

SEQ ID NO: 359671 - DNA, 25 bp, Mus musculus
cctttgtttgaattacttaagcaag

SEQ ID NO: 359672 - DNA, 25 bp, Mus musculus
cctttgtttgccagcactctaaaga

SEQ ID NO: 359673 - DNA, 25 bp, Mus musculus
cctttgtttgcctgcactctaaaga

SEQ ID NO: 359674 - DNA, 25 bp, Mus musculus
cctttgtttttgacgtggctgactt

SEQ ID NO: 359675 - DNA, 25 bp, Mus musculus
cctttgtttttgtcgtggctgactt

SEQ ID NO: 359676 - DNA, 25 bp, Mus musculus
ccttttaatctcaattcatcttttt

SEQ ID NO: 359677 - DNA, 25 bp, Mus musculus
ccttttaatctctattcatcttttt

SEQ ID NO: 359678 - DNA, 25 bp, Mus musculus
ccttttaggctgcatggtgcattga

SEQ ID NO: 359679 - DNA, 25 bp, Mus musculus
ccttttaggctggatggtgcattga

SEQ ID NO: 359680 - DNA, 25 bp, Mus musculus
ccttttataagcatcattatttatc

SEQ ID NO: 359681 - DNA, 25 bp, Mus musculus
ccttttataagcttcattatttatc

SEQ ID NO: 359682 - DNA, 25 bp, Mus musculus
ccttttataatactccaggaaacat

SEQ ID NO: 359683 - DNA, 25 bp, Mus musculus
ccttttataatagtccaggaaacat

SEQ ID NO: 359684 - DNA, 25 bp, Mus musculus
ccttttataatgctcctgggcctgt

SEQ ID NO: 359685 - DNA, 25 bp, Mus musculus
ccttttataatggtcctgggcctgt

SEQ ID NO: 359686 - DNA, 25 bp, Mus musculus
ccttttatattgatcatgtctttat

SEQ ID NO: 359687 - DNA, 25 bp, Mus musculus
ccttttatattgttcatgtctttat

SEQ ID NO: 359688 - DNA, 25 bp, Mus musculus
ccttttatctctcaactgctgacat

SEQ ID NO: 359689 - DNA, 25 bp, Mus musculus
ccttttatctctgaactgctgacat

SEQ ID NO: 359690 - DNA, 25 bp, Mus musculus
ccttttatgggaaaatatgttgcca

SEQ ID NO: 359691 - DNA, 25 bp, Mus musculus
ccttttatgggataatatgttgcca

SEQ ID NO: 359692 - DNA, 25 bp, Mus musculus
ccttttatggtgctgttgtgtctta

SEQ ID NO: 359693 - DNA, 25 bp, Mus musculus
ccttttatggtggtgttgtgtctta

SEQ ID NO: 359694 - DNA, 25 bp, Mus musculus
ccttttcacaatcatgtaccgggaa

SEQ ID NO: 359695 - DNA, 25 bp, Mus musculus
ccttttcacaatgatgtaccgggaa

SEQ ID NO: 359696 - DNA, 25 bp, Mus musculus
ccttttcaccacatggagcgactgt

SEQ ID NO: 359697 - DNA, 25 bp, Mus musculus
ccttttcaccacttggagcgactgt

SEQ ID NO: 359698 - DNA, 25 bp, Mus musculus
ccttttcactgtagctttctatgta

SEQ ID NO: 359699 - DNA, 25 bp, Mus musculus
ccttttcactgttgctttctatgta

SEQ ID NO: 359700 - DNA, 25 bp, Mus musculus
ccttttcagaggagtcagcttaaaa

SEQ ID NO: 359701 - DNA, 25 bp, Mus musculus
ccttttcagaggtgtcagcttaaaa

SEQ ID NO: 359702 - DNA, 25 bp, Mus musculus
ccttttcaggtgagggtctcaatca

SEQ ID NO: 359703 - DNA, 25 bp, Mus musculus
ccttttcaggtgtgggtctcaatca

SEQ ID NO: 359704 - DNA, 25 bp, Mus musculus
ccttttcagtcacgcactttttgga

SEQ ID NO: 359705 - DNA, 25 bp, Mus musculus
ccttttcagtcactgtcatctagaa

SEQ ID NO: 359706 - DNA, 25 bp, Mus musculus
ccttttcagtcaggcactttttgga

SEQ ID NO: 359707 - DNA, 25 bp, Mus musculus
ccttttcagtcagtgtcatctagaa

SEQ ID NO: 359708 - DNA, 25 bp, Mus musculus
ccttttcatagaattatccagagac

SEQ ID NO: 359709 - DNA, 25 bp, Mus musculus
ccttttcatagacttccttgtacag

SEQ ID NO: 359710 - DNA, 25 bp, Mus musculus
ccttttcatagagttccttgtacag

SEQ ID NO: 359711 - DNA, 25 bp, Mus musculus
ccttttcatagatttatccagagac

SEQ ID NO: 359712 - DNA, 25 bp, Mus musculus
ccttttcataggcattctggtgttg

SEQ ID NO: 359713 - DNA, 25 bp, Mus musculus
ccttttcatagggattctggtgttg

SEQ ID NO: 359714 - DNA, 25 bp, Mus musculus
ccttttcatcatataaactgtagca

SEQ ID NO: 359715 - DNA, 25 bp, Mus musculus
ccttttcatcatttaaactgtagca

SEQ ID NO: 359716 - DNA, 25 bp, Mus musculus
ccttttcattttcacagtgctatta

SEQ ID NO: 359717 - DNA, 25 bp, Mus musculus
ccttttcattttgacagtgctatta

SEQ ID NO: 359718 - DNA, 25 bp, Mus musculus
ccttttccactgatttccattagag

SEQ ID NO: 359719 - DNA, 25 bp, Mus musculus
ccttttccactgttttccattagag

SEQ ID NO: 359720 - DNA, 25 bp, Mus musculus
ccttttccagacagccttcagacaa

SEQ ID NO: 359721 - DNA, 25 bp, Mus musculus
ccttttccagactgccttcagacaa

SEQ ID NO: 359722 - DNA, 25 bp, Mus musculus
ccttttccagatcccatgctttgaa

SEQ ID NO: 359723 - DNA, 25 bp, Mus musculus
ccttttccagatgccatgctttgaa

SEQ ID NO: 359724 - DNA, 25 bp, Mus musculus
ccttttccagccattttgcattgtt

SEQ ID NO: 359725 - DNA, 25 bp, Mus musculus
ccttttccagcctttttgcattgtt

SEQ ID NO: 359726 - DNA, 25 bp, Mus musculus
ccttttccaggtaacacatggtagc

SEQ ID NO: 359727 - DNA, 25 bp, Mus musculus
ccttttccaggttacacatggtagc

SEQ ID NO: 359728 - DNA, 25 bp, Mus musculus
ccttttccatgtagtacttcacttg

SEQ ID NO: 359729 - DNA, 25 bp, Mus musculus
ccttttccatgttgtacttcacttg

SEQ ID NO: 359730 - DNA, 25 bp, Mus musculus
ccttttcccaaaagactagcttctt

SEQ ID NO: 359731 - DNA, 25 bp, Mus musculus
ccttttcccaaatgactagcttctt

SEQ ID NO: 359732 - DNA, 25 bp, Mus musculus
ccttttcccatcagagtggcaagta

SEQ ID NO: 359733 - DNA, 25 bp, Mus musculus
ccttttcccatcagatttactctag

SEQ ID NO: 359734 - DNA, 25 bp, Mus musculus
ccttttcccatctgagtggcaagta

SEQ ID NO: 359735 - DNA, 25 bp, Mus musculus
ccttttcccatctgatttactctag

SEQ ID NO: 359736 - DNA, 25 bp, Mus musculus
ccttttcccatgatcatagcctgga

SEQ ID NO: 359737 - DNA, 25 bp, Mus musculus
ccttttcccatgttcatagcctgga

SEQ ID NO: 359738 - DNA, 25 bp, Mus musculus
ccttttcctcttatttctgcattag

SEQ ID NO: 359739 - DNA, 25 bp, Mus musculus
ccttttcctcttttttctgcattag

SEQ ID NO: 359740 - DNA, 25 bp, Mus musculus
ccttttcctgataaatgcagccagt

SEQ ID NO: 359741 - DNA, 25 bp, Mus musculus
ccttttcctgatcatcagttagagt

SEQ ID NO: 359742 - DNA, 25 bp, Mus musculus
ccttttcctgatgatcagttagagt

SEQ ID NO: 359743 - DNA, 25 bp, Mus musculus
ccttttcctgattaatgcagccagt

SEQ ID NO: 359744 - DNA, 25 bp, Mus musculus
ccttttcctggcacagaagtattga

SEQ ID NO: 359745 - DNA, 25 bp, Mus musculus
ccttttcctggctcagaagtattga

SEQ ID NO: 359746 - DNA, 25 bp, Mus musculus
ccttttcctgtgaaatttagtagat

SEQ ID NO: 359747 - DNA, 25 bp, Mus musculus
ccttttcctgtgtaatttagtagat

SEQ ID NO: 359748 - DNA, 25 bp, Mus musculus
ccttttctaactcacttgggaacat

SEQ ID NO: 359749 - DNA, 25 bp, Mus musculus
ccttttctaactgacttgggaacat

SEQ ID NO: 359750 - DNA, 25 bp, Mus musculus
ccttttctatctactatacggttat

SEQ ID NO: 359751 - DNA, 25 bp, Mus musculus
ccttttctatcttctatacggttat

SEQ ID NO: 359752 - DNA, 25 bp, Mus musculus
ccttttctcactactgatagcatca

SEQ ID NO: 359753 - DNA, 25 bp, Mus musculus
ccttttctcacttctgatagcatca

SEQ ID NO: 359754 - DNA, 25 bp, Mus musculus
ccttttctccttctgaaggtggcaa

SEQ ID NO: 359755 - DNA, 25 bp, Mus musculus
ccttttctccttgtgaaggtggcaa

SEQ ID NO: 359756 - DNA, 25 bp, Mus musculus
ccttttctctatcctgttcgtgttg

SEQ ID NO: 359757 - DNA, 25 bp, Mus musculus
ccttttctctatgctgttcgtgttg

SEQ ID NO: 359758 - DNA, 25 bp, Mus musculus
ccttttctctctcggaaccaacaag

SEQ ID NO: 359759 - DNA, 25 bp, Mus musculus
ccttttctctctgggaaccaacaag

SEQ ID NO: 359760 - DNA, 25 bp, Mus musculus
ccttttctcttacctttttcactga

SEQ ID NO: 359761 - DNA, 25 bp, Mus musculus
ccttttctcttacttgatgaacact

SEQ ID NO: 359762 - DNA, 25 bp, Mus musculus
ccttttctcttagctttttcactga

SEQ ID NO: 359763 - DNA, 25 bp, Mus musculus
ccttttctcttagttgatgaacact

SEQ ID NO: 359764 - DNA, 25 bp, Mus musculus
ccttttctcttgaatggtaggacat

SEQ ID NO: 359765 - DNA, 25 bp, Mus musculus
ccttttctcttgtatggtaggacat

SEQ ID NO: 359766 - DNA, 25 bp, Mus musculus
ccttttctgcaaactgaggtctgtc

SEQ ID NO: 359767 - DNA, 25 bp, Mus musculus
ccttttctgcaatctgaggtctgtc

SEQ ID NO: 359768 - DNA, 25 bp, Mus musculus
ccttttctggatcctttgtacacat

SEQ ID NO: 359769 - DNA, 25 bp, Mus musculus
ccttttctggatgctttgtacacat

SEQ ID NO: 359770 - DNA, 25 bp, Mus musculus
ccttttctggtgcattttcattgtt

SEQ ID NO: 359771 - DNA, 25 bp, Mus musculus
ccttttctggtggattttcattgtt

SEQ ID NO: 359772 - DNA, 25 bp, Mus musculus
ccttttcttatcagctcagtttgtc

SEQ ID NO: 359773 - DNA, 25 bp, Mus musculus
ccttttcttatctgctcagtttgtc

SEQ ID NO: 359774 - DNA, 25 bp, Mus musculus
ccttttctttctctagatgaaagct

SEQ ID NO: 359775 - DNA, 25 bp, Mus musculus
ccttttctttctgtagatgaaagct

SEQ ID NO: 359776 - DNA, 25 bp, Mus musculus
ccttttcttttgacggaccagagat

SEQ ID NO: 359777 - DNA, 25 bp, Mus musculus
ccttttcttttgtcggaccagagat

SEQ ID NO: 359778 - DNA, 25 bp, Mus musculus
ccttttgactctcgccttatgggaa

SEQ ID NO: 359779 - DNA, 25 bp, Mus musculus
ccttttgactctggccttatgggaa

SEQ ID NO: 359780 - DNA, 25 bp, Mus musculus
ccttttgactgacggaccatggcaa

SEQ ID NO: 359781 - DNA, 25 bp, Mus musculus
ccttttgactgagggaccatggcaa

SEQ ID NO: 359782 - DNA, 25 bp, Mus musculus
ccttttgatacacaattggctaatg

SEQ ID NO: 359783 - DNA, 25 bp, Mus musculus
ccttttgatacagaattggctaatg

SEQ ID NO: 359784 - DNA, 25 bp, Mus musculus
ccttttgatgttcagttactgtgct

SEQ ID NO: 359785 - DNA, 25 bp, Mus musculus
ccttttgatgttgagttactgtgct

SEQ ID NO: 359786 - DNA, 25 bp, Mus musculus
ccttttgattggattgtttgcagat

SEQ ID NO: 359787 - DNA, 25 bp, Mus musculus
ccttttgattggtttgtttgcagat

SEQ ID NO: 359788 - DNA, 25 bp, Mus musculus
ccttttgcatatactttcaccgttt

SEQ ID NO: 359789 - DNA, 25 bp, Mus musculus
ccttttgcatattctttcaccgttt

SEQ ID NO: 359790 - DNA, 25 bp, Mus musculus
ccttttgctctaaactgtggcctaa

SEQ ID NO: 359791 - DNA, 25 bp, Mus musculus
ccttttgctctatactgtggcctaa

SEQ ID NO: 359792 - DNA, 25 bp, Mus musculus
ccttttgcttaaacttattggagat

SEQ ID NO: 359793 - DNA, 25 bp, Mus musculus
ccttttgcttaatcttattggagat

SEQ ID NO: 359794 - DNA, 25 bp, Mus musculus
ccttttgcttcacaaatctgaaaga

SEQ ID NO: 359795 - DNA, 25 bp, Mus musculus
ccttttgcttcagaaatctgaaaga

SEQ ID NO: 359796 - DNA, 25 bp, Mus musculus
ccttttggcctcagtgagaatattt

SEQ ID NO: 359797 - DNA, 25 bp, Mus musculus
ccttttggcctctgtgagaatattt

SEQ ID NO: 359798 - DNA, 25 bp, Mus musculus
ccttttggcgaacccttttctgaag

SEQ ID NO: 359799 - DNA, 25 bp, Mus musculus
ccttttggcgaagccttttctgaag

SEQ ID NO: 359800 - DNA, 25 bp, Mus musculus
ccttttggcttaactgtaactgcta

SEQ ID NO: 359801 - DNA, 25 bp, Mus musculus
ccttttggcttatctgtaactgcta

SEQ ID NO: 359802 - DNA, 25 bp, Mus musculus
ccttttgggtgtattttgctaagtg

SEQ ID NO: 359803 - DNA, 25 bp, Mus musculus
ccttttgggtgttttttgctaagtg

SEQ ID NO: 359804 - DNA, 25 bp, Mus musculus
ccttttggttcacacatgaccttga

SEQ ID NO: 359805 - DNA, 25 bp, Mus musculus
ccttttggttcagacatgaccttga

SEQ ID NO: 359806 - DNA, 25 bp, Mus musculus
ccttttggttgcactggctgggact

SEQ ID NO: 359807 - DNA, 25 bp, Mus musculus
ccttttggttgctctggctgggact

SEQ ID NO: 359808 - DNA, 25 bp, Mus musculus
ccttttgtagctcatgtagctgttt

SEQ ID NO: 359809 - DNA, 25 bp, Mus musculus
ccttttgtagctgatgtagctgttt

SEQ ID NO: 359810 - DNA, 25 bp, Mus musculus
ccttttgtcctaagttttggttcat

SEQ ID NO: 359811 - DNA, 25 bp, Mus musculus
ccttttgtcctatgttttggttcat

SEQ ID NO: 359812 - DNA, 25 bp, Mus musculus
ccttttgtcggtatcttgttatgtt

SEQ ID NO: 359813 - DNA, 25 bp, Mus musculus
ccttttgtcggtttcttgttatgtt

SEQ ID NO: 359814 - DNA, 25 bp, Mus musculus
ccttttgtctctccctctgaataaa

SEQ ID NO: 359815 - DNA, 25 bp, Mus musculus
ccttttgtctctgcctctgaataaa

SEQ ID NO: 359816 - DNA, 25 bp, Mus musculus
ccttttgtgcctatgaacatgtgtg

SEQ ID NO: 359817 - DNA, 25 bp, Mus musculus
ccttttgtgcctttgaacatgtgtg

SEQ ID NO: 359818 - DNA, 25 bp, Mus musculus
ccttttgtgctgagattatgggctt

SEQ ID NO: 359819 - DNA, 25 bp, Mus musculus
ccttttgtgctgtgattatgggctt

SEQ ID NO: 359820 - DNA, 25 bp, Mus musculus
ccttttgtggtcatcattagcatga

SEQ ID NO: 359821 - DNA, 25 bp, Mus musculus
ccttttgtggtcttcattagcatga

SEQ ID NO: 359822 - DNA, 25 bp, Mus musculus
ccttttgtgtgtctcgctgctgccg

SEQ ID NO: 359823 - DNA, 25 bp, Mus musculus
ccttttgtgtgtgtcgctgctgccg

SEQ ID NO: 359824 - DNA, 25 bp, Mus musculus
ccttttgtgttgatgggtcaatgga

SEQ ID NO: 359825 - DNA, 25 bp, Mus musculus
ccttttgtgttgttgggtcaatgga

SEQ ID NO: 359826 - DNA, 25 bp, Mus musculus
ccttttgttaccacctcagtagagg

SEQ ID NO: 359827 - DNA, 25 bp, Mus musculus
ccttttgttacctcctcagtagagg

SEQ ID NO: 359828 - DNA, 25 bp, Mus musculus
ccttttgttggcagtaagtatcttt

SEQ ID NO: 359829 - DNA, 25 bp, Mus musculus
ccttttgttggctgtaagtatcttt

SEQ ID NO: 359830 - DNA, 25 bp, Mus musculus
ccttttgttgtacttgtgtggctgt

SEQ ID NO: 359831 - DNA, 25 bp, Mus musculus
ccttttgttgtagttgtgtggctgt

SEQ ID NO: 359832 - DNA, 25 bp, Mus musculus
cctttttaacttatctcatacatcg

SEQ ID NO: 359833 - DNA, 25 bp, Mus musculus
cctttttaacttttctcatacatcg

SEQ ID NO: 359834 - DNA, 25 bp, Mus musculus
cctttttcaaacagacctccttcat

SEQ ID NO: 359835 - DNA, 25 bp, Mus musculus
cctttttcaaactgacctccttcat

SEQ ID NO: 359836 - DNA, 25 bp, Mus musculus
cctttttcatgtcctcagtaactca

SEQ ID NO: 359837 - DNA, 25 bp, Mus musculus
cctttttcatgtgctcagtaactca

SEQ ID NO: 359838 - DNA, 25 bp, Mus musculus
cctttttccggcacatcaattggga

SEQ ID NO: 359839 - DNA, 25 bp, Mus musculus
cctttttccggctcatcaattggga

SEQ ID NO: 359840 - DNA, 25 bp, Mus musculus
cctttttccttcagcccagcaattg

SEQ ID NO: 359841 - DNA, 25 bp, Mus musculus
cctttttccttctgcccagcaattg

SEQ ID NO: 359842 - DNA, 25 bp, Mus musculus
cctttttctctaacttcacacaata

SEQ ID NO: 359843 - DNA, 25 bp, Mus musculus
cctttttctctatcttcacacaata

SEQ ID NO: 359844 - DNA, 25 bp, Mus musculus
cctttttctctgaaagcatcgtaaa

SEQ ID NO: 359845 - DNA, 25 bp, Mus musculus
cctttttctctgtaagcatcgtaaa

SEQ ID NO: 359846 - DNA, 25 bp, Mus musculus
cctttttcttctacgttatcgtcat

SEQ ID NO: 359847 - DNA, 25 bp, Mus musculus
cctttttcttcttcgttatcgtcat

SEQ ID NO: 359848 - DNA, 25 bp, Mus musculus
cctttttgacaccagcctactgaat

SEQ ID NO: 359849 - DNA, 25 bp, Mus musculus
cctttttgacacgagcctactgaat

SEQ ID NO: 359850 - DNA, 25 bp, Mus musculus
cctttttgactaatcatcctcagaa

SEQ ID NO: 359851 - DNA, 25 bp, Mus musculus
cctttttgactattcatcctcagaa

SEQ ID NO: 359852 - DNA, 25 bp, Mus musculus
cctttttgagatcggattcttggtc

SEQ ID NO: 359853 - DNA, 25 bp, Mus musculus
cctttttgagatgggattcttggtc

SEQ ID NO: 359854 - DNA, 25 bp, Mus musculus
cctttttggaccaggtagcgatggt

SEQ ID NO: 359855 - DNA, 25 bp, Mus musculus
cctttttggacctggtagcgatggt

SEQ ID NO: 359856 - DNA, 25 bp, Mus musculus
cctttttggagtaggcaagtcactg

SEQ ID NO: 359857 - DNA, 25 bp, Mus musculus
cctttttggagttggcaagtcactg

SEQ ID NO: 359858 - DNA, 25 bp, Mus musculus
cctttttggtaccagagctacgtgg

SEQ ID NO: 359859 - DNA, 25 bp, Mus musculus
cctttttggtacgagagctacgtgg

SEQ ID NO: 359860 - DNA, 25 bp, Mus musculus
cctttttgtactatcttggctgcaa

SEQ ID NO: 359861 - DNA, 25 bp, Mus musculus
cctttttgtactttcttggctgcaa

SEQ ID NO: 359862 - DNA, 25 bp, Mus musculus
cctttttgtggccttatgttttgat

SEQ ID NO: 359863 - DNA, 25 bp, Mus musculus
cctttttgtggcgttatgttttgat

SEQ ID NO: 359864 - DNA, 25 bp, Mus musculus
ccttttttcatccactttacagcag

SEQ ID NO: 359865 - DNA, 25 bp, Mus musculus
ccttttttcatcgactttacagcag

SEQ ID NO: 359866 - DNA, 25 bp, Mus musculus
ccttttttccgaagcatcacaaaat

SEQ ID NO: 359867 - DNA, 25 bp, Mus musculus
ccttttttccgatgcatcacaaaat

SEQ ID NO: 359868 - DNA, 25 bp, Mus musculus
ccttttttggcaaggtgctgacctt

SEQ ID NO: 359869 - DNA, 25 bp, Mus musculus
ccttttttggcatggtgctgacctt

SEQ ID NO: 359870 - DNA, 25 bp, Mus musculus
ccttttttggccaatgaagacatgg

SEQ ID NO: 359871 - DNA, 25 bp, Mus musculus
ccttttttggcctatgaagacatgg

SEQ ID NO: 359872 - DNA, 25 bp, Mus musculus
ccttttttgtgcaagctttgagttt

SEQ ID NO: 359873 - DNA, 25 bp, Mus musculus
ccttttttgtgctagctttgagttt

SEQ ID NO: 359874 - DNA, 25 bp, Mus musculus
cgaaaaaatagtcttgctcctccca

SEQ ID NO: 359875 - DNA, 25 bp, Mus musculus
cgaaaaaatagtgttgctcctccca

SEQ ID NO: 359876 - DNA, 25 bp, Mus musculus
cgaaaaactgctcggcacactgtaa

SEQ ID NO: 359877 - DNA, 25 bp, Mus musculus
cgaaaaactgctgggcacactgtaa

SEQ ID NO: 359878 - DNA, 25 bp, Mus musculus
cgaaaaatagggatgctctaaacgt

SEQ ID NO: 359879 - DNA, 25 bp, Mus musculus
cgaaaaatagggttgctctaaacgt

SEQ ID NO: 359880 - DNA, 25 bp, Mus musculus
cgaaaaccaaatcaaggcgccgatg

SEQ ID NO: 359881 - DNA, 25 bp, Mus musculus
cgaaaaccaaatgaaggcgccgatg

SEQ ID NO: 359882 - DNA, 25 bp, Mus musculus
cgaaaaccatgacatccagccgtat

SEQ ID NO: 359883 - DNA, 25 bp, Mus musculus
cgaaaaccatgagatccagccgtat

SEQ ID NO: 359884 - DNA, 25 bp, Mus musculus
cgaaaactgtgactcccagcggtgt

SEQ ID NO: 359885 - DNA, 25 bp, Mus musculus
cgaaaactgtgagtcccagcggtgt

SEQ ID NO: 359886 - DNA, 25 bp, Mus musculus
cgaaaagacatgaccttcttggagt

SEQ ID NO: 359887 - DNA, 25 bp, Mus musculus
cgaaaagacatgtccttcttggagt

SEQ ID NO: 359888 - DNA, 25 bp, Mus musculus
cgaaaagcacaaagtctcttctggg

SEQ ID NO: 359889 - DNA, 25 bp, Mus musculus
cgaaaagcacaatgtctcttctggg

SEQ ID NO: 359890 - DNA, 25 bp, Mus musculus
cgaaaatacatcatgccttctgtcc

SEQ ID NO: 359891 - DNA, 25 bp, Mus musculus
cgaaaatacatcttgccttctgtcc

SEQ ID NO: 359892 - DNA, 25 bp, Mus musculus
cgaaaatgcaggcttttgtaacgtg

SEQ ID NO: 359893 - DNA, 25 bp, Mus musculus
cgaaaatgcagggttttgtaacgtg

SEQ ID NO: 359894 - DNA, 25 bp, Mus musculus
cgaaacaactaccaggccctgaact

SEQ ID NO: 359895 - DNA, 25 bp, Mus musculus
cgaaacaactacgaggccctgaact

SEQ ID NO: 359896 - DNA, 25 bp, Mus musculus
cgaaacactcctactggctggatct

SEQ ID NO: 359897 - DNA, 25 bp, Mus musculus
cgaaacactccttctggctggatct

SEQ ID NO: 359898 - DNA, 25 bp, Mus musculus
cgaaacagcctcctggttgtagctt

SEQ ID NO: 359899 - DNA, 25 bp, Mus musculus
cgaaacagcctcgtggttgtagctt

SEQ ID NO: 359900 - DNA, 25 bp, Mus musculus
cgaaacattgtgcaactgctttgta

SEQ ID NO: 359901 - DNA, 25 bp, Mus musculus
cgaaacattgtggaactgctttgta

SEQ ID NO: 359902 - DNA, 25 bp, Mus musculus
cgaaacccactgcttcaccaagttg

SEQ ID NO: 359903 - DNA, 25 bp, Mus musculus
cgaaacccactggttcaccaagttg

SEQ ID NO: 359904 - DNA, 25 bp, Mus musculus
cgaaaccctcatccgggatatgtta

SEQ ID NO: 359905 - DNA, 25 bp, Mus musculus
cgaaaccctcatgcgggatatgtta

SEQ ID NO: 359906 - DNA, 25 bp, Mus musculus
cgaaactactatcgctgcgggcaga

SEQ ID NO: 359907 - DNA, 25 bp, Mus musculus
cgaaactactatggctgcgggcaga

SEQ ID NO: 359908 - DNA, 25 bp, Mus musculus
cgaaactcagggaaggacttgccat

SEQ ID NO: 359909 - DNA, 25 bp, Mus musculus
cgaaactcagggtaggacttgccat

SEQ ID NO: 359910 - DNA, 25 bp, Mus musculus
cgaaactctcagatggagccagaca

SEQ ID NO: 359911 - DNA, 25 bp, Mus musculus
cgaaactctcagttggagccagaca

SEQ ID NO: 359912 - DNA, 25 bp, Mus musculus
cgaaacttccaaacagccctatata

SEQ ID NO: 359913 - DNA, 25 bp, Mus musculus
cgaaacttccaatcagccctatata

SEQ ID NO: 359914 - DNA, 25 bp, Mus musculus
cgaaagaagtctcttgttttagcaa

SEQ ID NO: 359915 - DNA, 25 bp, Mus musculus
cgaaagaagtctgttgttttagcaa

SEQ ID NO: 359916 - DNA, 25 bp, Mus musculus
cgaaagacagtaatctggctacctt

SEQ ID NO: 359917 - DNA, 25 bp, Mus musculus
cgaaagacagtattctggctacctt

SEQ ID NO: 359918 - DNA, 25 bp, Mus musculus
cgaaagagcagtcggtgcccttagc

SEQ ID NO: 359919 - DNA, 25 bp, Mus musculus
cgaaagagcagtgggtgcccttagc

SEQ ID NO: 359920 - DNA, 25 bp, Mus musculus
cgaaagagtcaacccgggagctcta

SEQ ID NO: 359921 - DNA, 25 bp, Mus musculus
cgaaagagtcaagccgggagctcta

SEQ ID NO: 359922 - DNA, 25 bp, Mus musculus
cgaaagattacacagccgattgcta

SEQ ID NO: 359923 - DNA, 25 bp, Mus musculus
cgaaagattacagagccgattgcta

SEQ ID NO: 359924 - DNA, 25 bp, Mus musculus
cgaaagcaagagagccttttccgtt

SEQ ID NO: 359925 - DNA, 25 bp, Mus musculus
cgaaagcaagagtgccttttccgtt

SEQ ID NO: 359926 - DNA, 25 bp, Mus musculus
cgaaagcgatgccaacctgcagaat

SEQ ID NO: 359927 - DNA, 25 bp, Mus musculus
cgaaagcgatgcgaacctgcagaat

SEQ ID NO: 359928 - DNA, 25 bp, Mus musculus
cgaaagctgttcactaggatcaata

SEQ ID NO: 359929 - DNA, 25 bp, Mus musculus
cgaaagctgttctctaggatcaata

SEQ ID NO: 359930 - DNA, 25 bp, Mus musculus
cgaaaggatgtcaggttgtggcttt

SEQ ID NO: 359931 - DNA, 25 bp, Mus musculus
cgaaaggatgtctggttgtggcttt

SEQ ID NO: 359932 - DNA, 25 bp, Mus musculus
cgaaaggctgccagttggaactaag

SEQ ID NO: 359933 - DNA, 25 bp, Mus musculus
cgaaaggctgcctgttggaactaag

SEQ ID NO: 359934 - DNA, 25 bp, Mus musculus
cgaaaggtcctgctgtgccctgagc

SEQ ID NO: 359935 - DNA, 25 bp, Mus musculus
cgaaaggtcctggtgtgccctgagc

SEQ ID NO: 359936 - DNA, 25 bp, Mus musculus
cgaaagtgagggacgcacgctgtct

SEQ ID NO: 359937 - DNA, 25 bp, Mus musculus
cgaaagtgagggtcgcacgctgtct

SEQ ID NO: 359938 - DNA, 25 bp, Mus musculus
cgaaagtgcaccaggaatcgtgggt

SEQ ID NO: 359939 - DNA, 25 bp, Mus musculus
cgaaagtgcacctggaatcgtgggt

SEQ ID NO: 359940 - DNA, 25 bp, Mus musculus
cgaaagtgcgttactggagtgtgcc

SEQ ID NO: 359941 - DNA, 25 bp, Mus musculus
cgaaagtgcgtttctggagtgtgcc

SEQ ID NO: 359942 - DNA, 25 bp, Mus musculus
cgaaatatctgtaagactttgtgat

SEQ ID NO: 359943 - DNA, 25 bp, Mus musculus
cgaaatatctgttagactttgtgat

SEQ ID NO: 359944 - DNA, 25 bp, Mus musculus
cgaaatggtctcaaagcccgctagg

SEQ ID NO: 359945 - DNA, 25 bp, Mus musculus
cgaaatggtctctaagcccgctagg

SEQ ID NO: 359946 - DNA, 25 bp, Mus musculus
cgaacaaaattcatccagcctaggg

SEQ ID NO: 359947 - DNA, 25 bp, Mus musculus
cgaacaaaattcttccagcctaggg

SEQ ID NO: 359948 - DNA, 25 bp, Mus musculus
cgaacaggagccagcttccagcagg

SEQ ID NO: 359949 - DNA, 25 bp, Mus musculus
cgaacaggagcctgcttccagcagg

SEQ ID NO: 359950 - DNA, 25 bp, Mus musculus
cgaacatccatacgagttccctatc

SEQ ID NO: 359951 - DNA, 25 bp, Mus musculus
cgaacatccataggagttccctatc

SEQ ID NO: 359952 - DNA, 25 bp, Mus musculus
cgaacatctaacaccagagactacc

SEQ ID NO: 359953 - DNA, 25 bp, Mus musculus
cgaacatctaactccagagactacc

SEQ ID NO: 359954 - DNA, 25 bp, Mus musculus
cgaacatctggaacggcgatggaga

SEQ ID NO: 359955 - DNA, 25 bp, Mus musculus
cgaacatctggatcggcgatggaga

SEQ ID NO: 359956 - DNA, 25 bp, Mus musculus
cgaacatgttgcataccgcaccatt

SEQ ID NO: 359957 - DNA, 25 bp, Mus musculus
cgaacatgttgcttaccgcaccatt

SEQ ID NO: 359958 - DNA, 25 bp, Mus musculus
cgaaccacttcacccaggtgtggtg

SEQ ID NO: 359959 - DNA, 25 bp, Mus musculus
cgaaccacttcagccaggtgtggtg

SEQ ID NO: 359960 - DNA, 25 bp, Mus musculus
cgaaccatacctctggatttgatgt

SEQ ID NO: 359961 - DNA, 25 bp, Mus musculus
cgaaccatacctgtggatttgatgt

SEQ ID NO: 359962 - DNA, 25 bp, Mus musculus
cgaaccattgtaccgccaacgtatg

SEQ ID NO: 359963 - DNA, 25 bp, Mus musculus
cgaaccattgtagcgccaacgtatg

SEQ ID NO: 359964 - DNA, 25 bp, Mus musculus
cgaacccatgggaggatggctgcac

SEQ ID NO: 359965 - DNA, 25 bp, Mus musculus
cgaacccatgggtggatggctgcac

SEQ ID NO: 359966 - DNA, 25 bp, Mus musculus
cgaaccgcagacagattcctttgtt

SEQ ID NO: 359967 - DNA, 25 bp, Mus musculus
cgaaccgcagactgattcctttgtt

SEQ ID NO: 359968 - DNA, 25 bp, Mus musculus
cgaaccggaactcctgcctggcaaa

SEQ ID NO: 359969 - DNA, 25 bp, Mus musculus
cgaaccggaactgctgcctggcaaa

SEQ ID NO: 359970 - DNA, 25 bp, Mus musculus
cgaacctacgacatctactacatgg

SEQ ID NO: 359971 - DNA, 25 bp, Mus musculus
cgaacctacgacttctactacatgg

SEQ ID NO: 359972 - DNA, 25 bp, Mus musculus
cgaacctactggaggtgaagtgact

SEQ ID NO: 359973 - DNA, 25 bp, Mus musculus
cgaacctactggtggtgaagtgact

SEQ ID NO: 359974 - DNA, 25 bp, Mus musculus
cgaacctgattgatcagtttttcat

SEQ ID NO: 359975 - DNA, 25 bp, Mus musculus
cgaacctgattgttcagtttttcat

SEQ ID NO: 359976 - DNA, 25 bp, Mus musculus
cgaaccttagacacggtggcactgt

SEQ ID NO: 359977 - DNA, 25 bp, Mus musculus
cgaaccttagactcggtggcactgt

SEQ ID NO: 359978 - DNA, 25 bp, Mus musculus
cgaacctttcatcattgctggtaaa

SEQ ID NO: 359979 - DNA, 25 bp, Mus musculus
cgaacctttcatgattgctggtaaa

SEQ ID NO: 359980 - DNA, 25 bp, Mus musculus
cgaaccttttctcctctataggcca

SEQ ID NO: 359981 - DNA, 25 bp, Mus musculus
cgaaccttttctgctctataggcca

SEQ ID NO: 359982 - DNA, 25 bp, Mus musculus
cgaacgaaacttatgtatgatacat

SEQ ID NO: 359983 - DNA, 25 bp, Mus musculus
cgaacgaaacttttgtatgatacat

SEQ ID NO: 359984 - DNA, 25 bp, Mus musculus
cgaacgtggacacccggcagaagca

SEQ ID NO: 359985 - DNA, 25 bp, Mus musculus
cgaacgtggacagccggcagaagca

SEQ ID NO: 359986 - DNA, 25 bp, Mus musculus
cgaacgtgttcccagagccgaagcg

SEQ ID NO: 359987 - DNA, 25 bp, Mus musculus
cgaacgtgttccgagagccgaagcg

SEQ ID NO: 359988 - DNA, 25 bp, Mus musculus
cgaactaagtttcgtacagagtgat

SEQ ID NO: 359989 - DNA, 25 bp, Mus musculus
cgaactaagtttggtacagagtgat

SEQ ID NO: 359990 - DNA, 25 bp, Mus musculus
cgaactacatcgagaccctgagagt

SEQ ID NO: 359991 - DNA, 25 bp, Mus musculus
cgaactacatcgtgaccctgagagt

SEQ ID NO: 359992 - DNA, 25 bp, Mus musculus
cgaactccggagattagaaagatgg

SEQ ID NO: 359993 - DNA, 25 bp, Mus musculus
cgaactccggagtttagaaagatgg

SEQ ID NO: 359994 - DNA, 25 bp, Mus musculus
cgaactcggataacgttgagacgtt

SEQ ID NO: 359995 - DNA, 25 bp, Mus musculus
cgaactcggatatcgttgagacgtt

SEQ ID NO: 359996 - DNA, 25 bp, Mus musculus
cgaactctggctaatcaactagcag

SEQ ID NO: 359997 - DNA, 25 bp, Mus musculus
cgaactctggcttatcaactagcag

SEQ ID NO: 359998 - DNA, 25 bp, Mus musculus
cgaactctgtcaccttcaaaagcat

SEQ ID NO: 359999 - DNA, 25 bp, Mus musculus
cgaactctgtcagcttcaaaagcat

SEQ ID NO: 360000 - DNA, 25 bp, Mus musculus
cgaactgtgcgcaccgaggacaaaa

SEQ ID NO: 360001 - DNA, 25 bp, Mus musculus
cgaactgtgcgctccgaggacaaaa

SEQ ID NO: 360002 - DNA, 25 bp, Mus musculus
cgaactgtgggtctatccaagaaga

SEQ ID NO: 360003 - DNA, 25 bp, Mus musculus
cgaactgtgggtgtatccaagaaga

SEQ ID NO: 360004 - DNA, 25 bp, Mus musculus
cgaactgttcttcggctgacatggt

SEQ ID NO: 360005 - DNA, 25 bp, Mus musculus
cgaactgttcttgggctgacatggt

SEQ ID NO: 360006 - DNA, 25 bp, Mus musculus
cgaactgtttctcagctaggagccc

SEQ ID NO: 360007 - DNA, 25 bp, Mus musculus
cgaactgtttctgagctaggagccc

SEQ ID NO: 360008 - DNA, 25 bp, Mus musculus
cgaacttaaggtaacctggctgcat

SEQ ID NO: 360009 - DNA, 25 bp, Mus musculus
cgaacttaaggttacctggctgcat

SEQ ID NO: 360010 - DNA, 25 bp, Mus musculus
cgaactttgtgacagcgcggccaga

SEQ ID NO: 360011 - DNA, 25 bp, Mus musculus
cgaactttgtgagagcgcggccaga

SEQ ID NO: 360012 - DNA, 25 bp, Mus musculus
cgaagacaaattcctccgagatgat

SEQ ID NO: 360013 - DNA, 25 bp, Mus musculus
cgaagacaaattgctccgagatgat

SEQ ID NO: 360014 - DNA, 25 bp, Mus musculus
cgaagacagaacctgctggatgacc

SEQ ID NO: 360015 - DNA, 25 bp, Mus musculus
cgaagacagaacgtgctggatgacc

SEQ ID NO: 360016 - DNA, 25 bp, Mus musculus
cgaagactccccaatgcctgattct

SEQ ID NO: 360017 - DNA, 25 bp, Mus musculus
cgaagactcccctatgcctgattct

SEQ ID NO: 360018 - DNA, 25 bp, Mus musculus
cgaagagccattaggacagagaaag

SEQ ID NO: 360019 - DNA, 25 bp, Mus musculus
cgaagagccatttggacagagaaag

SEQ ID NO: 360020 - DNA, 25 bp, Mus musculus
cgaagagcctttaattctttgggca

SEQ ID NO: 360021 - DNA, 25 bp, Mus musculus
cgaagagccttttattctttgggca

SEQ ID NO: 360022 - DNA, 25 bp, Mus musculus
cgaagagcgtttaatgttttgacat

SEQ ID NO: 360023 - DNA, 25 bp, Mus musculus
cgaagagcgttttatgttttgacat

SEQ ID NO: 360024 - DNA, 25 bp, Mus musculus
cgaagaggattcacctgcagccaaa

SEQ ID NO: 360025 - DNA, 25 bp, Mus musculus
cgaagaggattctcctgcagccaaa

SEQ ID NO: 360026 - DNA, 25 bp, Mus musculus
cgaagaggtcctcataagactgaat

SEQ ID NO: 360027 - DNA, 25 bp, Mus musculus
cgaagaggtcctgataagactgaat

SEQ ID NO: 360028 - DNA, 25 bp, Mus musculus
cgaagagtatgtcaccttgattgtt

SEQ ID NO: 360029 - DNA, 25 bp, Mus musculus
cgaagagtatgtgaccttgattgtt

SEQ ID NO: 360030 - DNA, 25 bp, Mus musculus
cgaagagtgattcatccaagtgcag

SEQ ID NO: 360031 - DNA, 25 bp, Mus musculus
cgaagagtgattgatccaagtgcag

SEQ ID NO: 360032 - DNA, 25 bp, Mus musculus
cgaagagttttaaagtgcatgtgct

SEQ ID NO: 360033 - DNA, 25 bp, Mus musculus
cgaagagttttatagtgcatgtgct

SEQ ID NO: 360034 - DNA, 25 bp, Mus musculus
cgaagagttttgctaaccaaatcaa

SEQ ID NO: 360035 - DNA, 25 bp, Mus musculus
cgaagagttttggtaaccaaatcaa

SEQ ID NO: 360036 - DNA, 25 bp, Mus musculus
cgaagatagaaaagcccctgccctt

SEQ ID NO: 360037 - DNA, 25 bp, Mus musculus
cgaagatagaaatgcccctgccctt

SEQ ID NO: 360038 - DNA, 25 bp, Mus musculus
cgaagatatttcagcaaagtggact

SEQ ID NO: 360039 - DNA, 25 bp, Mus musculus
cgaagatatttctgcaaagtggact

SEQ ID NO: 360040 - DNA, 25 bp, Mus musculus
cgaagattagagcaatgcctgtaat

SEQ ID NO: 360041 - DNA, 25 bp, Mus musculus
cgaagattagaggaatgcctgtaat

SEQ ID NO: 360042 - DNA, 25 bp, Mus musculus
cgaagcaataaaaccgggccggccg

SEQ ID NO: 360043 - DNA, 25 bp, Mus musculus
cgaagcaataaatccgggccggccg

SEQ ID NO: 360044 - DNA, 25 bp, Mus musculus
cgaagcacacctctacgggaccggg

SEQ ID NO: 360045 - DNA, 25 bp, Mus musculus
cgaagcacacctgtacgggaccggg

SEQ ID NO: 360046 - DNA, 25 bp, Mus musculus
cgaagcacgagtactccgtggacat

SEQ ID NO: 360047 - DNA, 25 bp, Mus musculus
cgaagcacgagttctccgtggacat

SEQ ID NO: 360048 - DNA, 25 bp, Mus musculus
cgaagcactgctaaggttctgaggt

SEQ ID NO: 360049 - DNA, 25 bp, Mus musculus
cgaagcactgcttaggttctgaggt

SEQ ID NO: 360050 - DNA, 25 bp, Mus musculus
cgaagcagaggacgcaagcgtcact

SEQ ID NO: 360051 - DNA, 25 bp, Mus musculus
cgaagcagaggaggcaagcgtcact

SEQ ID NO: 360052 - DNA, 25 bp, Mus musculus
cgaagcagctagaccttggaaagta

SEQ ID NO: 360053 - DNA, 25 bp, Mus musculus
cgaagcagctagtccttggaaagta

SEQ ID NO: 360054 - DNA, 25 bp, Mus musculus
cgaagcatcgctccagttgaaattg

SEQ ID NO: 360055 - DNA, 25 bp, Mus musculus
cgaagcatcgctgcagttgaaattg

SEQ ID NO: 360056 - DNA, 25 bp, Mus musculus
cgaagcattgtgagcatgtttcccc

SEQ ID NO: 360057 - DNA, 25 bp, Mus musculus
cgaagcattgtgtgcatgtttcccc

SEQ ID NO: 360058 - DNA, 25 bp, Mus musculus
cgaagccaacctcgtacagtgagtt

SEQ ID NO: 360059 - DNA, 25 bp, Mus musculus
cgaagccaacctggtacagtgagtt

SEQ ID NO: 360060 - DNA, 25 bp, Mus musculus
cgaagccactgtcttacagaggaag

SEQ ID NO: 360061 - DNA, 25 bp, Mus musculus
cgaagccactgtgttacagaggaag

SEQ ID NO: 360062 - DNA, 25 bp, Mus musculus
cgaagcccaggtcgctcagcatctt

SEQ ID NO: 360063 - DNA, 25 bp, Mus musculus
cgaagcccaggtggctcagcatctt

SEQ ID NO: 360064 - DNA, 25 bp, Mus musculus
cgaagccctatgcaggagcccttgg

SEQ ID NO: 360065 - DNA, 25 bp, Mus musculus
cgaagccctatggaggagcccttgg

SEQ ID NO: 360066 - DNA, 25 bp, Mus musculus
cgaagcccttgtcctctgagtaaat

SEQ ID NO: 360067 - DNA, 25 bp, Mus musculus
cgaagcccttgtgctctgagtaaat

SEQ ID NO: 360068 - DNA, 25 bp, Mus musculus
cgaagcctgttcataccccagcggg

SEQ ID NO: 360069 - DNA, 25 bp, Mus musculus
cgaagcctgttcttaccccagcggg

SEQ ID NO: 360070 - DNA, 25 bp, Mus musculus
cgaagcgattcgaattctggctggg

SEQ ID NO: 360071 - DNA, 25 bp, Mus musculus
cgaagcgattcgtattctggctggg

SEQ ID NO: 360072 - DNA, 25 bp, Mus musculus
cgaagctaggttaactgtgctcgcc

SEQ ID NO: 360073 - DNA, 25 bp, Mus musculus
cgaagctaggtttactgtgctcgcc

SEQ ID NO: 360074 - DNA, 25 bp, Mus musculus
cgaagctctgttagatgctggcata

SEQ ID NO: 360075 - DNA, 25 bp, Mus musculus
cgaagctctgtttgatgctggcata

SEQ ID NO: 360076 - DNA, 25 bp, Mus musculus
cgaagctgagagagccttcctgaga

SEQ ID NO: 360077 - DNA, 25 bp, Mus musculus
cgaagctgagagtgccttcctgaga

SEQ ID NO: 360078 - DNA, 25 bp, Mus musculus
cgaagctgctgacgcctggatatta

SEQ ID NO: 360079 - DNA, 25 bp, Mus musculus
cgaagctgctgaggcctggatatta

SEQ ID NO: 360080 - DNA, 25 bp, Mus musculus
cgaaggaaatatagccaccgagggc

SEQ ID NO: 360081 - DNA, 25 bp, Mus musculus
cgaaggaaatattgccaccgagggc

SEQ ID NO: 360082 - DNA, 25 bp, Mus musculus
cgaaggagttcaatagatttgcttt

SEQ ID NO: 360083 - DNA, 25 bp, Mus musculus
cgaaggagttcattagatttgcttt

SEQ ID NO: 360084 - DNA, 25 bp, Mus musculus
cgaaggatgtttcgcatctcggtct

SEQ ID NO: 360085 - DNA, 25 bp, Mus musculus
cgaaggatgtttggcatctcggtct

SEQ ID NO: 360086 - DNA, 25 bp, Mus musculus
cgaaggcatatactggcgcataaaa

SEQ ID NO: 360087 - DNA, 25 bp, Mus musculus
cgaaggcatatagtggcgcataaaa

SEQ ID NO: 360088 - DNA, 25 bp, Mus musculus
cgaaggcttttgactggtgaccagt

SEQ ID NO: 360089 - DNA, 25 bp, Mus musculus
cgaaggcttttgtctggtgaccagt

SEQ ID NO: 360090 - DNA, 25 bp, Mus musculus
cgaagggaacaacacccagattcat

SEQ ID NO: 360091 - DNA, 25 bp, Mus musculus
cgaagggaacaagacccagattcat

SEQ ID NO: 360092 - DNA, 25 bp, Mus musculus
cgaagggatgtacccagcgcacttt

SEQ ID NO: 360093 - DNA, 25 bp, Mus musculus
cgaagggatgtagccagcgcacttt

SEQ ID NO: 360094 - DNA, 25 bp, Mus musculus
cgaagggcagacaagccatggaccc

SEQ ID NO: 360095 - DNA, 25 bp, Mus musculus
cgaagggcagactagccatggaccc

SEQ ID NO: 360096 - DNA, 25 bp, Mus musculus
cgaagggcctgacggcattccacct

SEQ ID NO: 360097 - DNA, 25 bp, Mus musculus
cgaagggcctgagggcattccacct

SEQ ID NO: 360098 - DNA, 25 bp, Mus musculus
cgaagggtctctcatttcattgcct

SEQ ID NO: 360099 - DNA, 25 bp, Mus musculus
cgaagggtctctgatttcattgcct

SEQ ID NO: 360100 - DNA, 25 bp, Mus musculus
cgaaggtgcagtcctggcgtcatct

SEQ ID NO: 360101 - DNA, 25 bp, Mus musculus
cgaaggtgcagtgctggcgtcatct

SEQ ID NO: 360102 - DNA, 25 bp, Mus musculus
cgaagtatgtatcgccggagctccc

SEQ ID NO: 360103 - DNA, 25 bp, Mus musculus
cgaagtatgtatggccggagctccc

SEQ ID NO: 360104 - DNA, 25 bp, Mus musculus
cgaagtattgtaaacctcgattcca

SEQ ID NO: 360105 - DNA, 25 bp, Mus musculus
cgaagtattgtatacctcgattcca

SEQ ID NO: 360106 - DNA, 25 bp, Mus musculus
cgaagtatttctagtacacactcta

SEQ ID NO: 360107 - DNA, 25 bp, Mus musculus
cgaagtatttcttgtacacactcta

SEQ ID NO: 360108 - DNA, 25 bp, Mus musculus
cgaagtcacactattgtagtacaaa

SEQ ID NO: 360109 - DNA, 25 bp, Mus musculus
cgaagtcacacttttgtagtacaaa

SEQ ID NO: 360110 - DNA, 25 bp, Mus musculus
cgaagtcactcgaacaagcgcagcc

SEQ ID NO: 360111 - DNA, 25 bp, Mus musculus
cgaagtcactcgtacaagcgcagcc

SEQ ID NO: 360112 - DNA, 25 bp, Mus musculus
cgaagtccatcaacagaggccgtgc

SEQ ID NO: 360113 - DNA, 25 bp, Mus musculus
cgaagtccatcatcagaggccgtgc

SEQ ID NO: 360114 - DNA, 25 bp, Mus musculus
cgaagtctgcatatttttgtggagt

SEQ ID NO: 360115 - DNA, 25 bp, Mus musculus
cgaagtctgcatttttttgtggagt

SEQ ID NO: 360116 - DNA, 25 bp, Mus musculus
cgaagtcttagtccggcttacaggg

SEQ ID NO: 360117 - DNA, 25 bp, Mus musculus
cgaagtcttagtgcggcttacaggg

SEQ ID NO: 360118 - DNA, 25 bp, Mus musculus
cgaagtgcccttcattctgattaaa

SEQ ID NO: 360119 - DNA, 25 bp, Mus musculus
cgaagtgcccttgattctgattaaa

SEQ ID NO: 360120 - DNA, 25 bp, Mus musculus
cgaagtgccgctctgtgtgagatat

SEQ ID NO: 360121 - DNA, 25 bp, Mus musculus
cgaagtgccgctgtgtgtgagatat

SEQ ID NO: 360122 - DNA, 25 bp, Mus musculus
cgaagtgctcacatgctgctccaga

SEQ ID NO: 360123 - DNA, 25 bp, Mus musculus
cgaagtgctcacttgctgctccaga

SEQ ID NO: 360124 - DNA, 25 bp, Mus musculus
cgaagtgctctgaaggtgagtccaa

SEQ ID NO: 360125 - DNA, 25 bp, Mus musculus
cgaagtgctctgtaggtgagtccaa

SEQ ID NO: 360126 - DNA, 25 bp, Mus musculus
cgaagtggcactacgggcactggca

SEQ ID NO: 360127 - DNA, 25 bp, Mus musculus
cgaagtggcacttcgggcactggca

SEQ ID NO: 360128 - DNA, 25 bp, Mus musculus
cgaagtgttgcaaaaatgtccccaa

SEQ ID NO: 360129 - DNA, 25 bp, Mus musculus
cgaagtgttgcataaatgtccccaa

SEQ ID NO: 360130 - DNA, 25 bp, Mus musculus
cgaagttcaagaagtgtccctgctt

SEQ ID NO: 360131 - DNA, 25 bp, Mus musculus
cgaagttcaagatgtgtccctgctt

SEQ ID NO: 360132 - DNA, 25 bp, Mus musculus
cgaagttcacagaggttcccaaagc

SEQ ID NO: 360133 - DNA, 25 bp, Mus musculus
cgaagttcacagtggttcccaaagc

SEQ ID NO: 360134 - DNA, 25 bp, Mus musculus
cgaagttgttgaagtggccaccgga

SEQ ID NO: 360135 - DNA, 25 bp, Mus musculus
cgaagttgttgatgtggccaccgga

SEQ ID NO: 360136 - DNA, 25 bp, Mus musculus
cgaagtttaacacgcagcctccttt

SEQ ID NO: 360137 - DNA, 25 bp, Mus musculus
cgaagtttaacaggcagcctccttt

SEQ ID NO: 360138 - DNA, 25 bp, Mus musculus
cgaagtttagagctgggctgccata

SEQ ID NO: 360139 - DNA, 25 bp, Mus musculus
cgaagtttagaggtgggctgccata

SEQ ID NO: 360140 - DNA, 25 bp, Mus musculus
cgaagtttcatcatagcgtgtcaag

SEQ ID NO: 360141 - DNA, 25 bp, Mus musculus
cgaagtttcatcttagcgtgtcaag

SEQ ID NO: 360142 - DNA, 25 bp, Mus musculus
cgaagtttgagaacatcaccgccac

SEQ ID NO: 360143 - DNA, 25 bp, Mus musculus
cgaagtttgagatcatcaccgccac

SEQ ID NO: 360144 - DNA, 25 bp, Mus musculus
cgaatacattctcagcacacggctg

SEQ ID NO: 360145 - DNA, 25 bp, Mus musculus
cgaatacattctgagcacacggctg

SEQ ID NO: 360146 - DNA, 25 bp, Mus musculus
cgaatacccgagatggattgtccag

SEQ ID NO: 360147 - DNA, 25 bp, Mus musculus
cgaatacccgagttggattgtccag

SEQ ID NO: 360148 - DNA, 25 bp, Mus musculus
cgaatacctacacgcccctttgaag

SEQ ID NO: 360149 - DNA, 25 bp, Mus musculus
cgaatacctacaggcccctttgaag

SEQ ID NO: 360150 - DNA, 25 bp, Mus musculus
cgaatacggttcacctgggtcctag

SEQ ID NO: 360151 - DNA, 25 bp, Mus musculus
cgaatacggttctcctgggtcctag

SEQ ID NO: 360152 - DNA, 25 bp, Mus musculus
cgaatatacgcaacttcgcagtggc

SEQ ID NO: 360153 - DNA, 25 bp, Mus musculus
cgaatatacgcatcttcgcagtggc

SEQ ID NO: 360154 - DNA, 25 bp, Mus musculus
cgaatcacactcagaaccttggctg

SEQ ID NO: 360155 - DNA, 25 bp, Mus musculus
cgaatcacactctgaaccttggctg

SEQ ID NO: 360156 - DNA, 25 bp, Mus musculus
cgaatcacatggcacagatgtgaaa

SEQ ID NO: 360157 - DNA, 25 bp, Mus musculus
cgaatcacatgggacagatgtgaaa

SEQ ID NO: 360158 - DNA, 25 bp, Mus musculus
cgaatcacccacatgttgtctgtat

SEQ ID NO: 360159 - DNA, 25 bp, Mus musculus
cgaatcacccacttgttgtctgtat

SEQ ID NO: 360160 - DNA, 25 bp, Mus musculus
cgaatcagcgccacgggagctcaag

SEQ ID NO: 360161 - DNA, 25 bp, Mus musculus
cgaatcagcgcctcgggagctcaag

SEQ ID NO: 360162 - DNA, 25 bp, Mus musculus
cgaatcaggttcaggccacgttccc

SEQ ID NO: 360163 - DNA, 25 bp, Mus musculus
cgaatcaggttctggccacgttccc

SEQ ID NO: 360164 - DNA, 25 bp, Mus musculus
cgaatcagtgccagtgtgcaccagg

SEQ ID NO: 360165 - DNA, 25 bp, Mus musculus
cgaatcagtgcctgtgtgcaccagg

SEQ ID NO: 360166 - DNA, 25 bp, Mus musculus
cgaatcagtttcattcaccgacaat

SEQ ID NO: 360167 - DNA, 25 bp, Mus musculus
cgaatcagtttctttcaccgacaat

SEQ ID NO: 360168 - DNA, 25 bp, Mus musculus
cgaatccattcccttgttgctgaat

SEQ ID NO: 360169 - DNA, 25 bp, Mus musculus
cgaatccattccgttgttgctgaat

SEQ ID NO: 360170 - DNA, 25 bp, Mus musculus
cgaatcccacggaagaagacactga

SEQ ID NO: 360171 - DNA, 25 bp, Mus musculus
cgaatcccacggtagaagacactga

SEQ ID NO: 360172 - DNA, 25 bp, Mus musculus
cgaatccgggacaccgcatgccggg

SEQ ID NO: 360173 - DNA, 25 bp, Mus musculus
cgaatccgggactccgcatgccggg

SEQ ID NO: 360174 - DNA, 25 bp, Mus musculus
cgaatcctacacacagagctttcag

SEQ ID NO: 360175 - DNA, 25 bp, Mus musculus
cgaatcctacactcagagctttcag

SEQ ID NO: 360176 - DNA, 25 bp, Mus musculus
cgaatcctgggacccgagtcgtgca

SEQ ID NO: 360177 - DNA, 25 bp, Mus musculus
cgaatcctgggagccgagtcgtgca

SEQ ID NO: 360178 - DNA, 25 bp, Mus musculus
cgaatcttcctgcaggatataaaga

SEQ ID NO: 360179 - DNA, 25 bp, Mus musculus
cgaatcttcctggaggatataaaga

SEQ ID NO: 360180 - DNA, 25 bp, Mus musculus
cgaatgatgcagacaaggcgcctat

SEQ ID NO: 360181 - DNA, 25 bp, Mus musculus
cgaatgatgcagtcaaggcgcctat

SEQ ID NO: 360182 - DNA, 25 bp, Mus musculus
cgaatgccatttatactgttactgc

SEQ ID NO: 360183 - DNA, 25 bp, Mus musculus
cgaatgccatttttactgttactgc

SEQ ID NO: 360184 - DNA, 25 bp, Mus musculus
cgaatggaggctctagatgctgcca

SEQ ID NO: 360185 - DNA, 25 bp, Mus musculus
cgaatggaggctgtagatgctgcca

SEQ ID NO: 360186 - DNA, 25 bp, Mus musculus
cgaatggatcggacgggttctgttt

SEQ ID NO: 360187 - DNA, 25 bp, Mus musculus
cgaatggatcggtcgggttctgttt

SEQ ID NO: 360188 - DNA, 25 bp, Mus musculus
cgaatggctcataaaatcagttatg

SEQ ID NO: 360189 - DNA, 25 bp, Mus musculus
cgaatggctcattaaatcagttatg

SEQ ID NO: 360190 - DNA, 25 bp, Mus musculus
cgaatgggaggtatgctgttttgac

SEQ ID NO: 360191 - DNA, 25 bp, Mus musculus
cgaatgggaggtttgctgttttgac

SEQ ID NO: 360192 - DNA, 25 bp, Mus musculus
cgaatgtagtaaagttgtttcacaa

SEQ ID NO: 360193 - DNA, 25 bp, Mus musculus
cgaatgtagtaatgttgtttcacaa

SEQ ID NO: 360194 - DNA, 25 bp, Mus musculus
cgaatgtggaagaggtctgccgctt

SEQ ID NO: 360195 - DNA, 25 bp, Mus musculus
cgaatgtggaagtggtctgccgctt

SEQ ID NO: 360196 - DNA, 25 bp, Mus musculus
cgaattactttacccatagtcgttg

SEQ ID NO: 360197 - DNA, 25 bp, Mus musculus
cgaattactttagccatagtcgttg

SEQ ID NO: 360198 - DNA, 25 bp, Mus musculus
cgaattattagcagtcactcattga

SEQ ID NO: 360199 - DNA, 25 bp, Mus musculus
cgaattattagctgtcactcattga

SEQ ID NO: 360200 - DNA, 25 bp, Mus musculus
cgaattccatccaagccaaatcgag

SEQ ID NO: 360201 - DNA, 25 bp, Mus musculus
cgaattccatcctagccaaatcgag

SEQ ID NO: 360202 - DNA, 25 bp, Mus musculus
cgaattccatgtaccgttgcggaaa

SEQ ID NO: 360203 - DNA, 25 bp, Mus musculus
cgaattccatgttccgttgcggaaa

SEQ ID NO: 360204 - DNA, 25 bp, Mus musculus
cgaattctgagcaatggccctgatt

SEQ ID NO: 360205 - DNA, 25 bp, Mus musculus
cgaattctgagctatggccctgatt

SEQ ID NO: 360206 - DNA, 25 bp, Mus musculus
cgaattctggtcatgaggctagtca

SEQ ID NO: 360207 - DNA, 25 bp, Mus musculus
cgaattctggtcttgaggctagtca

SEQ ID NO: 360208 - DNA, 25 bp, Mus musculus
cgaattgatctgatgtagcttcaca

SEQ ID NO: 360209 - DNA, 25 bp, Mus musculus
cgaattgatctgttgtagcttcaca

SEQ ID NO: 360210 - DNA, 25 bp, Mus musculus
cgaattggagccagagaaggacttc

SEQ ID NO: 360211 - DNA, 25 bp, Mus musculus
cgaattggagcctgagaaggacttc

SEQ ID NO: 360212 - DNA, 25 bp, Mus musculus
cgaattggcctccatcataatgact

SEQ ID NO: 360213 - DNA, 25 bp, Mus musculus
cgaattggcctcgatcataatgact

SEQ ID NO: 360214 - DNA, 25 bp, Mus musculus
cgaatttcagctacagctctggtgg

SEQ ID NO: 360215 - DNA, 25 bp, Mus musculus
cgaatttcagcttcagctctggtgg

SEQ ID NO: 360216 - DNA, 25 bp, Mus musculus
cgacaaagcgctagcttcatctcaa

SEQ ID NO: 360217 - DNA, 25 bp, Mus musculus
cgacaaagcgcttgcttcatctcaa

SEQ ID NO: 360218 - DNA, 25 bp, Mus musculus
cgacaactgccacggactgctaggt

SEQ ID NO: 360219 - DNA, 25 bp, Mus musculus
cgacaactgccagggactgctaggt

SEQ ID NO: 360220 - DNA, 25 bp, Mus musculus
cgacaactggatcaagccgtgggca

SEQ ID NO: 360221 - DNA, 25 bp, Mus musculus
cgacaactggatgaagccgtgggca

SEQ ID NO: 360222 - DNA, 25 bp, Mus musculus
cgacaacttccacgcatttgtgtgg

SEQ ID NO: 360223 - DNA, 25 bp, Mus musculus
cgacaacttccaggcatttgtgtgg

SEQ ID NO: 360224 - DNA, 25 bp, Mus musculus
cgacaaggactcacagtgcggagga

SEQ ID NO: 360225 - DNA, 25 bp, Mus musculus
cgacaaggactctcagtgcggagga

SEQ ID NO: 360226 - DNA, 25 bp, Mus musculus
cgacaaggtggcacagggttaaaag

SEQ ID NO: 360227 - DNA, 25 bp, Mus musculus
cgacaaggtggctcagggttaaaag

SEQ ID NO: 360228 - DNA, 25 bp, Mus musculus
cgacaaggttacatggccacgaaat

SEQ ID NO: 360229 - DNA, 25 bp, Mus musculus
cgacaaggttacttggccacgaaat

SEQ ID NO: 360230 - DNA, 25 bp, Mus musculus
cgacacagggtaatcatcttatgtt

SEQ ID NO: 360231 - DNA, 25 bp, Mus musculus
cgacacagggtattcatcttatgtt

SEQ ID NO: 360232 - DNA, 25 bp, Mus musculus
cgacacagtattactgttctttggc

SEQ ID NO: 360233 - DNA, 25 bp, Mus musculus
cgacacagtatttctgttctttggc

SEQ ID NO: 360234 - DNA, 25 bp, Mus musculus
cgacaccattagattcacactgagt

SEQ ID NO: 360235 - DNA, 25 bp, Mus musculus
cgacaccattagtttcacactgagt

SEQ ID NO: 360236 - DNA, 25 bp, Mus musculus
cgacacctgcctcctgtataatgag

SEQ ID NO: 360237 - DNA, 25 bp, Mus musculus
cgacacctgcctgctgtataatgag

SEQ ID NO: 360238 - DNA, 25 bp, Mus musculus
cgacactacagaaccaccttatcaa

SEQ ID NO: 360239 - DNA, 25 bp, Mus musculus
cgacactacagatccaccttatcaa

SEQ ID NO: 360240 - DNA, 25 bp, Mus musculus
cgacactcattcatggtcctatgtt

SEQ ID NO: 360241 - DNA, 25 bp, Mus musculus
cgacactcattcttggtcctatgtt

SEQ ID NO: 360242 - DNA, 25 bp, Mus musculus
cgacactccaaacagacacatgact

SEQ ID NO: 360243 - DNA, 25 bp, Mus musculus
cgacactccaaacgcgcgtgtgcag

SEQ ID NO: 360244 - DNA, 25 bp, Mus musculus
cgacactccaaagagacacatgact

SEQ ID NO: 360245 - DNA, 25 bp, Mus musculus
cgacactccaaaggcgcgtgtgcag

SEQ ID NO: 360246 - DNA, 25 bp, Mus musculus
cgacactgatatctgaccagtggat

SEQ ID NO: 360247 - DNA, 25 bp, Mus musculus
cgacactgatatgtgaccagtggat

SEQ ID NO: 360248 - DNA, 25 bp, Mus musculus
cgacactggaggcttaacatcaaat

SEQ ID NO: 360249 - DNA, 25 bp, Mus musculus
cgacactggagggttaacatcaaat

SEQ ID NO: 360250 - DNA, 25 bp, Mus musculus
cgacagacagagcaggtgactacat

SEQ ID NO: 360251 - DNA, 25 bp, Mus musculus
cgacagacagaggaggtgactacat

SEQ ID NO: 360252 - DNA, 25 bp, Mus musculus
cgacagagcctcagcacggagagca

SEQ ID NO: 360253 - DNA, 25 bp, Mus musculus
cgacagagcctctgcacggagagca

SEQ ID NO: 360254 - DNA, 25 bp, Mus musculus
cgacagagctggcaggcgccttcac

SEQ ID NO: 360255 - DNA, 25 bp, Mus musculus
cgacagagctgggaggcgccttcac

SEQ ID NO: 360256 - DNA, 25 bp, Mus musculus
cgacagatcttcactcaacagcaac

SEQ ID NO: 360257 - DNA, 25 bp, Mus musculus
cgacagatcttctctcaacagcaac

SEQ ID NO: 360258 - DNA, 25 bp, Mus musculus
cgacagatgtcccttcttcgagagg

SEQ ID NO: 360259 - DNA, 25 bp, Mus musculus
cgacagatgtccgttcttcgagagg

SEQ ID NO: 360260 - DNA, 25 bp, Mus musculus
cgacagcaatgccaaagttgaaaca

SEQ ID NO: 360261 - DNA, 25 bp, Mus musculus
cgacagcaatgcgaaagttgaaaca

SEQ ID NO: 360262 - DNA, 25 bp, Mus musculus
cgacagcagatgatctcagggccat

SEQ ID NO: 360263 - DNA, 25 bp, Mus musculus
cgacagcagatgttctcagggccat

SEQ ID NO: 360264 - DNA, 25 bp, Mus musculus
cgacagctacgaccagaacacactg

SEQ ID NO: 360265 - DNA, 25 bp, Mus musculus
cgacagctacgagcagaacacactg

SEQ ID NO: 360266 - DNA, 25 bp, Mus musculus
cgacagctattcctgggttccagag

SEQ ID NO: 360267 - DNA, 25 bp, Mus musculus
cgacagctattcgtgggttccagag

SEQ ID NO: 360268 - DNA, 25 bp, Mus musculus
cgacaggactgccattgtcctgggc

SEQ ID NO: 360269 - DNA, 25 bp, Mus musculus
cgacaggactgcgattgtcctgggc

SEQ ID NO: 360270 - DNA, 25 bp, Mus musculus
cgacaggagctgcatgagttgcatc

SEQ ID NO: 360271 - DNA, 25 bp, Mus musculus
cgacaggagctggatgagttgcatc

SEQ ID NO: 360272 - DNA, 25 bp, Mus musculus
cgacaggcatcaccctctagcatta

SEQ ID NO: 360273 - DNA, 25 bp, Mus musculus
cgacaggcatcagcctctagcatta

SEQ ID NO: 360274 - DNA, 25 bp, Mus musculus
cgacaggcggtgcaggttctccaac

SEQ ID NO: 360275 - DNA, 25 bp, Mus musculus
cgacaggcggtggaggttctccaac

SEQ ID NO: 360276 - DNA, 25 bp, Mus musculus
cgacagggacgaacgccggctgcct

SEQ ID NO: 360277 - DNA, 25 bp, Mus musculus
cgacagggacgatcgccggctgcct

SEQ ID NO: 360278 - DNA, 25 bp, Mus musculus
cgacagggcttgacagcaaggacgc

SEQ ID NO: 360279 - DNA, 25 bp, Mus musculus
cgacagggcttgtcagcaaggacgc

SEQ ID NO: 360280 - DNA, 25 bp, Mus musculus
cgacaggtctggagcaagggatctc

SEQ ID NO: 360281 - DNA, 25 bp, Mus musculus
cgacaggtctggtgcaagggatctc

SEQ ID NO: 360282 - DNA, 25 bp, Mus musculus
cgacagtatcctcgtcaagaccgtg

SEQ ID NO: 360283 - DNA, 25 bp, Mus musculus
cgacagtatcctggtcaagaccgtg

SEQ ID NO: 360284 - DNA, 25 bp, Mus musculus
cgacagtatgtcaagtgctgtacca

SEQ ID NO: 360285 - DNA, 25 bp, Mus musculus
cgacagtatgtctagtgctgtacca

SEQ ID NO: 360286 - DNA, 25 bp, Mus musculus
cgacagttagagatgctgatttttt

SEQ ID NO: 360287 - DNA, 25 bp, Mus musculus
cgacagttagagttgctgatttttt

SEQ ID NO: 360288 - DNA, 25 bp, Mus musculus
cgacatcacatacgcagacctgaat

SEQ ID NO: 360289 - DNA, 25 bp, Mus musculus
cgacatcacataggcagacctgaat

SEQ ID NO: 360290 - DNA, 25 bp, Mus musculus
cgacatcatccaacatccaagtaat

SEQ ID NO: 360291 - DNA, 25 bp, Mus musculus
cgacatcatccatcatccaagtaat

SEQ ID NO: 360292 - DNA, 25 bp, Mus musculus
cgacatcgcgtcagcgggcgaagac

SEQ ID NO: 360293 - DNA, 25 bp, Mus musculus
cgacatcgcgtctgcgggcgaagac

SEQ ID NO: 360294 - DNA, 25 bp, Mus musculus
cgacatcgctatcaggtgaacccta

SEQ ID NO: 360295 - DNA, 25 bp, Mus musculus
cgacatcgctatgaggtgaacccta

SEQ ID NO: 360296 - DNA, 25 bp, Mus musculus
cgacatctctctctttcagattttt

SEQ ID NO: 360297 - DNA, 25 bp, Mus musculus
cgacatctctctgtttcagattttt

SEQ ID NO: 360298 - DNA, 25 bp, Mus musculus
cgacatgcgtgtcgccgacatgcct

SEQ ID NO: 360299 - DNA, 25 bp, Mus musculus
cgacatgcgtgtggccgacatgcct

SEQ ID NO: 360300 - DNA, 25 bp, Mus musculus
cgacatgttgcacggcatcatgggt

SEQ ID NO: 360301 - DNA, 25 bp, Mus musculus
cgacatgttgcagggcatcatgggt

SEQ ID NO: 360302 - DNA, 25 bp, Mus musculus
cgacattcaacactcctttaagcta

SEQ ID NO: 360303 - DNA, 25 bp, Mus musculus
cgacattcaacagtcctttaagcta

SEQ ID NO: 360304 - DNA, 25 bp, Mus musculus
cgacattctgccaacaaatcaccaa

SEQ ID NO: 360305 - DNA, 25 bp, Mus musculus
cgacattctgcctacaaatcaccaa

SEQ ID NO: 360306 - DNA, 25 bp, Mus musculus
cgacattgctcacgtgaatctcaaa

SEQ ID NO: 360307 - DNA, 25 bp, Mus musculus
cgacattgctcaggtgaatctcaaa

SEQ ID NO: 360308 - DNA, 25 bp, Mus musculus
cgacatttcaggccagagcttgagg

SEQ ID NO: 360309 - DNA, 25 bp, Mus musculus
cgacatttcagggcagagcttgagg

SEQ ID NO: 360310 - DNA, 25 bp, Mus musculus
cgacattttgagcaccctccaaatt

SEQ ID NO: 360311 - DNA, 25 bp, Mus musculus
cgacattttgaggaccctccaaatt

SEQ ID NO: 360312 - DNA, 25 bp, Mus musculus
cgaccaaactgtccggtggaggcat

SEQ ID NO: 360313 - DNA, 25 bp, Mus musculus
cgaccaaactgtgcggtggaggcat

SEQ ID NO: 360314 - DNA, 25 bp, Mus musculus
cgaccaagtgtcaggctctatgtgc

SEQ ID NO: 360315 - DNA, 25 bp, Mus musculus
cgaccaagtgtctggctctatgtgc

SEQ ID NO: 360316 - DNA, 25 bp, Mus musculus
cgaccaatgggcctaatcactttga

SEQ ID NO: 360317 - DNA, 25 bp, Mus musculus
cgaccaatgggcgtaatcactttga

SEQ ID NO: 360318 - DNA, 25 bp, Mus musculus
cgaccagagctgctcgccaataaat

SEQ ID NO: 360319 - DNA, 25 bp, Mus musculus
cgaccagagctggtcgccaataaat

SEQ ID NO: 360320 - DNA, 25 bp, Mus musculus
cgaccagagtggagggctccgcaat

SEQ ID NO: 360321 - DNA, 25 bp, Mus musculus
cgaccagagtggtgggctccgcaat

SEQ ID NO: 360322 - DNA, 25 bp, Mus musculus
cgaccagcaggcactagtgggaaaa

SEQ ID NO: 360323 - DNA, 25 bp, Mus musculus
cgaccagcaggctctagtgggaaaa

SEQ ID NO: 360324 - DNA, 25 bp, Mus musculus
cgaccagctagcatttatcgaagag

SEQ ID NO: 360325 - DNA, 25 bp, Mus musculus
cgaccagctagcttttatcgaagag

SEQ ID NO: 360326 - DNA, 25 bp, Mus musculus
cgaccagttcttcggagagcacctg

SEQ ID NO: 360327 - DNA, 25 bp, Mus musculus
cgaccagttcttgggagagcacctg

SEQ ID NO: 360328 - DNA, 25 bp, Mus musculus
cgaccagttgtaaagctgctttcaa

SEQ ID NO: 360329 - DNA, 25 bp, Mus musculus
cgaccagttgtatagctgctttcaa

SEQ ID NO: 360330 - DNA, 25 bp, Mus musculus
cgaccagttgttctcttacttctga

SEQ ID NO: 360331 - DNA, 25 bp, Mus musculus
cgaccagttgttgtcttacttctga

SEQ ID NO: 360332 - DNA, 25 bp, Mus musculus
cgaccagtttttcggagccatgtac

SEQ ID NO: 360333 - DNA, 25 bp, Mus musculus
cgaccagtttttgggagccatgtac

SEQ ID NO: 360334 - DNA, 25 bp, Mus musculus
cgaccataacataggcatttacagc

SEQ ID NO: 360335 - DNA, 25 bp, Mus musculus
cgaccataacattggcatttacagc

SEQ ID NO: 360336 - DNA, 25 bp, Mus musculus
cgaccatggtgtccgccggcggcga

SEQ ID NO: 360337 - DNA, 25 bp, Mus musculus
cgaccatggtgtgcgccggcggcga

SEQ ID NO: 360338 - DNA, 25 bp, Mus musculus
cgaccattcgtgagtctgtgttcca

SEQ ID NO: 360339 - DNA, 25 bp, Mus musculus
cgaccattcgtgtgtctgtgttcca

SEQ ID NO: 360340 - DNA, 25 bp, Mus musculus
cgaccattgctgatgtggttgacct

SEQ ID NO: 360341 - DNA, 25 bp, Mus musculus
cgaccattgctgttgtggttgacct

SEQ ID NO: 360342 - DNA, 25 bp, Mus musculus
cgaccatttgtcctgttctaattat

SEQ ID NO: 360343 - DNA, 25 bp, Mus musculus
cgaccatttgtcgtgttctaattat

SEQ ID NO: 360344 - DNA, 25 bp, Mus musculus
cgacccagactgcaaaacgttcctg

SEQ ID NO: 360345 - DNA, 25 bp, Mus musculus
cgacccagactggaaaacgttcctg

SEQ ID NO: 360346 - DNA, 25 bp, Mus musculus
cgacccattgagaacaactgatgta

SEQ ID NO: 360347 - DNA, 25 bp, Mus musculus
cgacccattgagtacaactgatgta

SEQ ID NO: 360348 - DNA, 25 bp, Mus musculus
cgaccccacaatctgttttctgtaa

SEQ ID NO: 360349 - DNA, 25 bp, Mus musculus
cgaccccacaatgtgttttctgtaa

SEQ ID NO: 360350 - DNA, 25 bp, Mus musculus
cgaccccatcttaattgtacactgt

SEQ ID NO: 360351 - DNA, 25 bp, Mus musculus
cgaccccatctttattgtacactgt

SEQ ID NO: 360352 - DNA, 25 bp, Mus musculus
cgaccccatggcattgcataagcaa

SEQ ID NO: 360353 - DNA, 25 bp, Mus musculus
cgaccccatggctttgcataagcaa

SEQ ID NO: 360354 - DNA, 25 bp, Mus musculus
cgacccggagctccttgaagagagt

SEQ ID NO: 360355 - DNA, 25 bp, Mus musculus
cgacccggagctgcttgaagagagt

SEQ ID NO: 360356 - DNA, 25 bp, Mus musculus
cgacccggctggagtcccttcgtgt

SEQ ID NO: 360357 - DNA, 25 bp, Mus musculus
cgacccggctggtgtcccttcgtgt

SEQ ID NO: 360358 - DNA, 25 bp, Mus musculus
cgacccgtctgcaccggaagagaga

SEQ ID NO: 360359 - DNA, 25 bp, Mus musculus
cgacccgtctgctccggaagagaga

SEQ ID NO: 360360 - DNA, 25 bp, Mus musculus
cgaccctaatcaaattgatgagctt

SEQ ID NO: 360361 - DNA, 25 bp, Mus musculus
cgaccctaatcatattgatgagctt

SEQ ID NO: 360362 - DNA, 25 bp, Mus musculus
cgaccctagcgcatgggtggtagaa

SEQ ID NO: 360363 - DNA, 25 bp, Mus musculus
cgaccctagcgcttgggtggtagaa

SEQ ID NO: 360364 - DNA, 25 bp, Mus musculus
cgaccctgagtcagccttctcggag

SEQ ID NO: 360365 - DNA, 25 bp, Mus musculus
cgaccctgagtctgccttctcggag

SEQ ID NO: 360366 - DNA, 25 bp, Mus musculus
cgaccctgttgaacctgataaattg

SEQ ID NO: 360367 - DNA, 25 bp, Mus musculus
cgaccctgttgatcctgataaattg

SEQ ID NO: 360368 - DNA, 25 bp, Mus musculus
cgacccttttgaaacaggtttgaat

SEQ ID NO: 360369 - DNA, 25 bp, Mus musculus
cgacccttttgatacaggtttgaat

SEQ ID NO: 360370 - DNA, 25 bp, Mus musculus
cgaccgcagcatcgtggaggtacta

SEQ ID NO: 360371 - DNA, 25 bp, Mus musculus
cgaccgcagcatggtggaggtacta

SEQ ID NO: 360372 - DNA, 25 bp, Mus musculus
cgaccggaagctatacccgtgaagt

SEQ ID NO: 360373 - DNA, 25 bp, Mus musculus
cgaccggaagctttacccgtgaagt

SEQ ID NO: 360374 - DNA, 25 bp, Mus musculus
cgaccggtcactacatgggcaagaa

SEQ ID NO: 360375 - DNA, 25 bp, Mus musculus
cgaccggtcacttcatgggcaagaa

SEQ ID NO: 360376 - DNA, 25 bp, Mus musculus
cgaccgtcaactacctgcagaagca

SEQ ID NO: 360377 - DNA, 25 bp, Mus musculus
cgaccgtcaacttcctgcagaagca

SEQ ID NO: 360378 - DNA, 25 bp, Mus musculus
cgacctacaaggagtgcgcagcatc

SEQ ID NO: 360379 - DNA, 25 bp, Mus musculus
cgacctacaaggtgtgcgcagcatc

SEQ ID NO: 360380 - DNA, 25 bp, Mus musculus
cgacctatatgcctgtgctgttgtg

SEQ ID NO: 360381 - DNA, 25 bp, Mus musculus
cgacctatatgcgtgtgctgttgtg

SEQ ID NO: 360382 - DNA, 25 bp, Mus musculus
cgacctcagcgtcggctttgacacg

SEQ ID NO: 360383 - DNA, 25 bp, Mus musculus
cgacctcagcgtgggctttgacacg

SEQ ID NO: 360384 - DNA, 25 bp, Mus musculus
cgacctcatttaattctgcttcatt

SEQ ID NO: 360385 - DNA, 25 bp, Mus musculus
cgacctcatttatttctgcttcatt

SEQ ID NO: 360386 - DNA, 25 bp, Mus musculus
cgacctcgtctcagagtaccagcag

SEQ ID NO: 360387 - DNA, 25 bp, Mus musculus
cgacctcgtctctgagtaccagcag

SEQ ID NO: 360388 - DNA, 25 bp, Mus musculus
cgacctcgttacaacctgctatggg

SEQ ID NO: 360389 - DNA, 25 bp, Mus musculus
cgacctcgttactacctgctatggg

SEQ ID NO: 360390 - DNA, 25 bp, Mus musculus
cgacctggaaacagtacttcagaat

SEQ ID NO: 360391 - DNA, 25 bp, Mus musculus
cgacctggaaactgtacttcagaat

SEQ ID NO: 360392 - DNA, 25 bp, Mus musculus
cgacctggaagactatgtggcccgt

SEQ ID NO: 360393 - DNA, 25 bp, Mus musculus
cgacctggaagagtatgtggcccgt

SEQ ID NO: 360394 - DNA, 25 bp, Mus musculus
cgacctgggtagagtcagatggatc

SEQ ID NO: 360395 - DNA, 25 bp, Mus musculus
cgacctgggtagtgtcagatggatc

SEQ ID NO: 360396 - DNA, 25 bp, Mus musculus
cgaccttagttgacagctgggcgga

SEQ ID NO: 360397 - DNA, 25 bp, Mus musculus
cgaccttagttgtcagctgggcgga

SEQ ID NO: 360398 - DNA, 25 bp, Mus musculus
cgaccttctgtgagacattagtttg

SEQ ID NO: 360399 - DNA, 25 bp, Mus musculus
cgaccttctgtgtgacattagtttg

SEQ ID NO: 360400 - DNA, 25 bp, Mus musculus
cgaccttgccccaggatgaaatggt

SEQ ID NO: 360401 - DNA, 25 bp, Mus musculus
cgaccttgcccctggatgaaatggt

SEQ ID NO: 360402 - DNA, 25 bp, Mus musculus
cgaccttgctgtagatgccatgtta

SEQ ID NO: 360403 - DNA, 25 bp, Mus musculus
cgaccttgctgttgatgccatgtta

SEQ ID NO: 360404 - DNA, 25 bp, Mus musculus
cgacctttctacatttgcgagctta

SEQ ID NO: 360405 - DNA, 25 bp, Mus musculus
cgacctttctacttttgcgagctta

SEQ ID NO: 360406 - DNA, 25 bp, Mus musculus
cgacctttttgtcactgagaaccaa

SEQ ID NO: 360407 - DNA, 25 bp, Mus musculus
cgacctttttgtgactgagaaccaa

SEQ ID NO: 360408 - DNA, 25 bp, Mus musculus
cgacgaaaacatctggctctccaac

SEQ ID NO: 360409 - DNA, 25 bp, Mus musculus
cgacgaaaacatgtggctctccaac

SEQ ID NO: 360410 - DNA, 25 bp, Mus musculus
cgacgaatgccacacacggatgagg

SEQ ID NO: 360411 - DNA, 25 bp, Mus musculus
cgacgaatgccagacacggatgagg

SEQ ID NO: 360412 - DNA, 25 bp, Mus musculus
cgacgacaaaacaataccaccacat

SEQ ID NO: 360413 - DNA, 25 bp, Mus musculus
cgacgacaaaactataccaccacat

SEQ ID NO: 360414 - DNA, 25 bp, Mus musculus
cgacgacagcgtatgaatatgaaga

SEQ ID NO: 360415 - DNA, 25 bp, Mus musculus
cgacgacagcgtttgaatatgaaga

SEQ ID NO: 360416 - DNA, 25 bp, Mus musculus
cgacgacgagggcttctgcgacttc

SEQ ID NO: 360417 - DNA, 25 bp, Mus musculus
cgacgacgaggggttctgcgacttc

SEQ ID NO: 360418 - DNA, 25 bp, Mus musculus
cgacgacgtctcaagagagcgccaa

SEQ ID NO: 360419 - DNA, 25 bp, Mus musculus
cgacgacgtctctagagagcgccaa

SEQ ID NO: 360420 - DNA, 25 bp, Mus musculus
cgacgagagcggattcatgaacgat

SEQ ID NO: 360421 - DNA, 25 bp, Mus musculus
cgacgagagcggtttcatgaacgat

SEQ ID NO: 360422 - DNA, 25 bp, Mus musculus
cgacgagggcatccctgttcaagaa

SEQ ID NO: 360423 - DNA, 25 bp, Mus musculus
cgacgagggcatgcctgttcaagaa

SEQ ID NO: 360424 - DNA, 25 bp, Mus musculus
cgacgaggtcatcaacaggcccagc

SEQ ID NO: 360425 - DNA, 25 bp, Mus musculus
cgacgaggtcatgaacaggcccagc

SEQ ID NO: 360426 - DNA, 25 bp, Mus musculus
cgacgagtgtgcaccaagtacattc

SEQ ID NO: 360427 - DNA, 25 bp, Mus musculus
cgacgagtgtgctccaagtacattc

SEQ ID NO: 360428 - DNA, 25 bp, Mus musculus
cgacgagttcgacgagtttcccgcg

SEQ ID NO: 360429 - DNA, 25 bp, Mus musculus
cgacgagttcgaggagtttcccgcg

SEQ ID NO: 360430 - DNA, 25 bp, Mus musculus
cgacgatactggagtttgcgtaaca

SEQ ID NO: 360431 - DNA, 25 bp, Mus musculus
cgacgatactggtgtttgcgtaaca

SEQ ID NO: 360432 - DNA, 25 bp, Mus musculus
cgacgatcgccaagttccatcttcg

SEQ ID NO: 360433 - DNA, 25 bp, Mus musculus
cgacgatcgccatgttccatcttcg

SEQ ID NO: 360434 - DNA, 25 bp, Mus musculus
cgacgatgccttctatgatgatgag

SEQ ID NO: 360435 - DNA, 25 bp, Mus musculus
cgacgatgccttgtatgatgatgag

SEQ ID NO: 360436 - DNA, 25 bp, Mus musculus
cgacgcattccacaaagcatttctt

SEQ ID NO: 360437 - DNA, 25 bp, Mus musculus
cgacgcattccagaaagcatttctt

SEQ ID NO: 360438 - DNA, 25 bp, Mus musculus
cgacgccagaccacgcggttggagt

SEQ ID NO: 360439 - DNA, 25 bp, Mus musculus
cgacgccagacctcgcggttggagt

SEQ ID NO: 360440 - DNA, 25 bp, Mus musculus
cgacgctgaactcagccatgaggct

SEQ ID NO: 360441 - DNA, 25 bp, Mus musculus
cgacgctgaactgagccatgaggct

SEQ ID NO: 360442 - DNA, 25 bp, Mus musculus
cgacgcttgtctcttcagactcacg

SEQ ID NO: 360443 - DNA, 25 bp, Mus musculus
cgacgcttgtctgttcagactcacg

SEQ ID NO: 360444 - DNA, 25 bp, Mus musculus
cgacggccctcacaagctattgaag

SEQ ID NO: 360445 - DNA, 25 bp, Mus musculus
cgacggccctcagaagctattgaag

SEQ ID NO: 360446 - DNA, 25 bp, Mus musculus
cgacggctggtcaataagtttggga

SEQ ID NO: 360447 - DNA, 25 bp, Mus musculus
cgacggctggtctataagtttggga

SEQ ID NO: 360448 - DNA, 25 bp, Mus musculus
cgacgtcactaaatggatgggtttt

SEQ ID NO: 360449 - DNA, 25 bp, Mus musculus
cgacgtcactaattggatgggtttt

SEQ ID NO: 360450 - DNA, 25 bp, Mus musculus
cgacgtccattcattcaatctcctg

SEQ ID NO: 360451 - DNA, 25 bp, Mus musculus
cgacgtccattctttcaatctcctg

SEQ ID NO: 360452 - DNA, 25 bp, Mus musculus
cgacgtctgcgacggcggcgggctg

SEQ ID NO: 360453 - DNA, 25 bp, Mus musculus
cgacgtctgcgagggcggcgggctg

SEQ ID NO: 360454 - DNA, 25 bp, Mus musculus
cgacgtgaggtactggcctgaacaa

SEQ ID NO: 360455 - DNA, 25 bp, Mus musculus
cgacgtgaggtagtggcctgaacaa

SEQ ID NO: 360456 - DNA, 25 bp, Mus musculus
cgacgtggagcacttttgcccgaga

SEQ ID NO: 360457 - DNA, 25 bp, Mus musculus
cgacgtggagcagttttgcccgaga

SEQ ID NO: 360458 - DNA, 25 bp, Mus musculus
cgacgtggctttcatctcaggttaa

SEQ ID NO: 360459 - DNA, 25 bp, Mus musculus
cgacgtggctttgatctcaggttaa

SEQ ID NO: 360460 - DNA, 25 bp, Mus musculus
cgacgtgtctccacgactagggaga

SEQ ID NO: 360461 - DNA, 25 bp, Mus musculus
cgacgtgtctcctcgactagggaga

SEQ ID NO: 360462 - DNA, 25 bp, Mus musculus
cgacgttccccactcccagcgtgct

SEQ ID NO: 360463 - DNA, 25 bp, Mus musculus
cgacgttccccagtcccagcgtgct

SEQ ID NO: 360464 - DNA, 25 bp, Mus musculus
cgacgttcgatcatgcatggagcaa

SEQ ID NO: 360465 - DNA, 25 bp, Mus musculus
cgacgttcgatcttgcatggagcaa

SEQ ID NO: 360466 - DNA, 25 bp, Mus musculus
cgactaacacccattatccaatggt

SEQ ID NO: 360467 - DNA, 25 bp, Mus musculus
cgactaacaccctttatccaatggt

SEQ ID NO: 360468 - DNA, 25 bp, Mus musculus
cgactagggccaagctgcccctcgc

SEQ ID NO: 360469 - DNA, 25 bp, Mus musculus
cgactagggccatgctgcccctcgc

SEQ ID NO: 360470 - DNA, 25 bp, Mus musculus
cgactagtttctcttccgtttgttg

SEQ ID NO: 360471 - DNA, 25 bp, Mus musculus
cgactagtttctgttccgtttgttg

SEQ ID NO: 360472 - DNA, 25 bp, Mus musculus
cgactatattttctactatggtggc

SEQ ID NO: 360473 - DNA, 25 bp, Mus musculus
cgactatattttgtactatggtggc

SEQ ID NO: 360474 - DNA, 25 bp, Mus musculus
cgactatggccacgcgcaagacgaa

SEQ ID NO: 360475 - DNA, 25 bp, Mus musculus
cgactatggccaggcgcaagacgaa

SEQ ID NO: 360476 - DNA, 25 bp, Mus musculus
cgactcacgagccttttggatctgt

SEQ ID NO: 360477 - DNA, 25 bp, Mus musculus
cgactcacgagcgttttggatctgt

SEQ ID NO: 360478 - DNA, 25 bp, Mus musculus
cgactcactgagcttcaaataagat

SEQ ID NO: 360479 - DNA, 25 bp, Mus musculus
cgactcactgaggttcaaataagat

SEQ ID NO: 360480 - DNA, 25 bp, Mus musculus
cgactcactttcatggttgatctct

SEQ ID NO: 360481 - DNA, 25 bp, Mus musculus
cgactcactttcttggttgatctct

SEQ ID NO: 360482 - DNA, 25 bp, Mus musculus
cgactcattctcagctttattcact

SEQ ID NO: 360483 - DNA, 25 bp, Mus musculus
cgactcattctctgctttattcact

SEQ ID NO: 360484 - DNA, 25 bp, Mus musculus
cgactccatatgatttagggctcct

SEQ ID NO: 360485 - DNA, 25 bp, Mus musculus
cgactccatatgttttagggctcct

SEQ ID NO: 360486 - DNA, 25 bp, Mus musculus
cgactccattccagattagtctgga

SEQ ID NO: 360487 - DNA, 25 bp, Mus musculus
cgactccattcctgattagtctgga

SEQ ID NO: 360488 - DNA, 25 bp, Mus musculus
cgactccgggagaaactgtgctgta

SEQ ID NO: 360489 - DNA, 25 bp, Mus musculus
cgactccgggagtaactgtgctgta

SEQ ID NO: 360490 - DNA, 25 bp, Mus musculus
cgactcctagttcccttgaaagcca

SEQ ID NO: 360491 - DNA, 25 bp, Mus musculus
cgactcctagttgccttgaaagcca

SEQ ID NO: 360492 - DNA, 25 bp, Mus musculus
cgactcctcagtctgggctatagac

SEQ ID NO: 360493 - DNA, 25 bp, Mus musculus
cgactcctcagtgtgggctatagac

SEQ ID NO: 360494 - DNA, 25 bp, Mus musculus
cgactcctccttaaagaaacaccag

SEQ ID NO: 360495 - DNA, 25 bp, Mus musculus
cgactcctcctttaagaaacaccag

SEQ ID NO: 360496 - DNA, 25 bp, Mus musculus
cgactcctgtttcgtgacatcccat

SEQ ID NO: 360497 - DNA, 25 bp, Mus musculus
cgactcctgtttggtgacatcccat

SEQ ID NO: 360498 - DNA, 25 bp, Mus musculus
cgactctacattaactggctttctt

SEQ ID NO: 360499 - DNA, 25 bp, Mus musculus
cgactctacatttactggctttctt

SEQ ID NO: 360500 - DNA, 25 bp, Mus musculus
cgactctcactccagcagaagaaga

SEQ ID NO: 360501 - DNA, 25 bp, Mus musculus
cgactctcactcgagcagaagaaga

SEQ ID NO: 360502 - DNA, 25 bp, Mus musculus
cgactctgtggtctattattgtgca

SEQ ID NO: 360503 - DNA, 25 bp, Mus musculus
cgactctgtggtgtattattgtgca

SEQ ID NO: 360504 - DNA, 25 bp, Mus musculus
cgactcttcagaatgttctccggaa

SEQ ID NO: 360505 - DNA, 25 bp, Mus musculus
cgactcttcagattgttctccggaa

SEQ ID NO: 360506 - DNA, 25 bp, Mus musculus
cgactgaggaacaatggcctgccat

SEQ ID NO: 360507 - DNA, 25 bp, Mus musculus
cgactgaggaactatggcctgccat

SEQ ID NO: 360508 - DNA, 25 bp, Mus musculus
cgactgagtatgcgttcctcggact

SEQ ID NO: 360509 - DNA, 25 bp, Mus musculus
cgactgagtatgggttcctcggact

SEQ ID NO: 360510 - DNA, 25 bp, Mus musculus
cgactgatccagattgaacctcaaa

SEQ ID NO: 360511 - DNA, 25 bp, Mus musculus
cgactgatccagtttgaacctcaaa

SEQ ID NO: 360512 - DNA, 25 bp, Mus musculus
cgactgatgatcatagacgtgggca

SEQ ID NO: 360513 - DNA, 25 bp, Mus musculus
cgactgatgatcttagacgtgggca

SEQ ID NO: 360514 - DNA, 25 bp, Mus musculus
cgactgatggagctaatgattggat

SEQ ID NO: 360515 - DNA, 25 bp, Mus musculus
cgactgatggaggtaatgattggat

SEQ ID NO: 360516 - DNA, 25 bp, Mus musculus
cgactgcagagaccgcatcagggat

SEQ ID NO: 360517 - DNA, 25 bp, Mus musculus
cgactgcagagagcgcatcagggat

SEQ ID NO: 360518 - DNA, 25 bp, Mus musculus
cgactgcagttacccctcaaggaga

SEQ ID NO: 360519 - DNA, 25 bp, Mus musculus
cgactgcagttagccctcaaggaga

SEQ ID NO: 360520 - DNA, 25 bp, Mus musculus
cgactgccgtgtaagtccctataac

SEQ ID NO: 360521 - DNA, 25 bp, Mus musculus
cgactgccgtgttagtccctataac

SEQ ID NO: 360522 - DNA, 25 bp, Mus musculus
cgactgctcttccgaaggtccagag

SEQ ID NO: 360523 - DNA, 25 bp, Mus musculus
cgactgctcttcggaaggtccagag

SEQ ID NO: 360524 - DNA, 25 bp, Mus musculus
cgactggatgtcaaagctgtgttcc

SEQ ID NO: 360525 - DNA, 25 bp, Mus musculus
cgactggatgtctaagctgtgttcc

SEQ ID NO: 360526 - DNA, 25 bp, Mus musculus
cgactggcgaccatcagagtgcggc

SEQ ID NO: 360527 - DNA, 25 bp, Mus musculus
cgactggcgaccttcagagtgcggc

SEQ ID NO: 360528 - DNA, 25 bp, Mus musculus
cgactgtaattaaccgcgcgttttg

SEQ ID NO: 360529 - DNA, 25 bp, Mus musculus
cgactgtaattatccgcgcgttttg

SEQ ID NO: 360530 - DNA, 25 bp, Mus musculus
cgactgtgccctaatgtgccagaaa

SEQ ID NO: 360531 - DNA, 25 bp, Mus musculus
cgactgtgcccttatgtgccagaaa

SEQ ID NO: 360532 - DNA, 25 bp, Mus musculus
cgacttacgttcctagttgcacaaa

SEQ ID NO: 360533 - DNA, 25 bp, Mus musculus
cgacttacgttcgtagttgcacaaa

SEQ ID NO: 360534 - DNA, 25 bp, Mus musculus
cgacttagatcaagagcaagggtaa

SEQ ID NO: 360535 - DNA, 25 bp, Mus musculus
cgacttagatcatgagcaagggtaa

SEQ ID NO: 360536 - DNA, 25 bp, Mus musculus
cgacttattcaacaacaactgacct

SEQ ID NO: 360537 - DNA, 25 bp, Mus musculus
cgacttattcaagaacaactgacct

SEQ ID NO: 360538 - DNA, 25 bp, Mus musculus
cgacttcacagtctacatgatcaaa

SEQ ID NO: 360539 - DNA, 25 bp, Mus musculus
cgacttcacagtgtacatgatcaaa

SEQ ID NO: 360540 - DNA, 25 bp, Mus musculus
cgacttccagctcccatgtgtgtta

SEQ ID NO: 360541 - DNA, 25 bp, Mus musculus
cgacttccagctgccatgtgtgtta

SEQ ID NO: 360542 - DNA, 25 bp, Mus musculus
cgacttcttgagagtctctggagct

SEQ ID NO: 360543 - DNA, 25 bp, Mus musculus
cgacttcttgagtgtctctggagct

SEQ ID NO: 360544 - DNA, 25 bp, Mus musculus
cgacttgcctagagacatcgaagaa

SEQ ID NO: 360545 - DNA, 25 bp, Mus musculus
cgacttgcctagtgacatcgaagaa

SEQ ID NO: 360546 - DNA, 25 bp, Mus musculus
cgacttgctcgacgaggagatcacc

SEQ ID NO: 360547 - DNA, 25 bp, Mus musculus
cgacttgctcgaggaggagatcacc

SEQ ID NO: 360548 - DNA, 25 bp, Mus musculus
cgacttggcgttagcacaggcactg

SEQ ID NO: 360549 - DNA, 25 bp, Mus musculus
cgacttggcgtttgcacaggcactg

SEQ ID NO: 360550 - DNA, 25 bp, Mus musculus
cgacttgttcccaccaggataaata

SEQ ID NO: 360551 - DNA, 25 bp, Mus musculus
cgacttgttccctccaggataaata

SEQ ID NO: 360552 - DNA, 25 bp, Mus musculus
cgactttaccatcgcggctaccgat

SEQ ID NO: 360553 - DNA, 25 bp, Mus musculus
cgactttaccatggcggctaccgat

SEQ ID NO: 360554 - DNA, 25 bp, Mus musculus
cgactttagtccagagctcttgtga

SEQ ID NO: 360555 - DNA, 25 bp, Mus musculus
cgactttagtcctgagctcttgtga

SEQ ID NO: 360556 - DNA, 25 bp, Mus musculus
cgactttccatcatcaactttcttg

SEQ ID NO: 360557 - DNA, 25 bp, Mus musculus
cgactttccatcttcaactttcttg

SEQ ID NO: 360558 - DNA, 25 bp, Mus musculus
cgactttgctgacgagtgccccaag

SEQ ID NO: 360559 - DNA, 25 bp, Mus musculus
cgactttgctgaggagtgccccaag

SEQ ID NO: 360560 - DNA, 25 bp, Mus musculus
cgactttgggatctcccgcgaagaa

SEQ ID NO: 360561 - DNA, 25 bp, Mus musculus
cgactttgggatgtcccgcgaagaa

SEQ ID NO: 360562 - DNA, 25 bp, Mus musculus
cgagaaaatgccaagcagcccacgg

SEQ ID NO: 360563 - DNA, 25 bp, Mus musculus
cgagaaaatgcctagcagcccacgg

SEQ ID NO: 360564 - DNA, 25 bp, Mus musculus
cgagaacaacgactatctccagtgt

SEQ ID NO: 360565 - DNA, 25 bp, Mus musculus
cgagaacaacgagtatctccagtgt

SEQ ID NO: 360566 - DNA, 25 bp, Mus musculus
cgagaacaagacagccgtggttgtg

SEQ ID NO: 360567 - DNA, 25 bp, Mus musculus
cgagaacaagactgccgtggttgtg

SEQ ID NO: 360568 - DNA, 25 bp, Mus musculus
cgagaacctgcccttttggatgagg

SEQ ID NO: 360569 - DNA, 25 bp, Mus musculus
cgagaacctgccgttttggatgagg

SEQ ID NO: 360570 - DNA, 25 bp, Mus musculus
cgagaacctgctcaggctgtgcaaa

SEQ ID NO: 360571 - DNA, 25 bp, Mus musculus
cgagaacctgctgaggctgtgcaaa

SEQ ID NO: 360572 - DNA, 25 bp, Mus musculus
cgagaacgtgaacgccaagatccag

SEQ ID NO: 360573 - DNA, 25 bp, Mus musculus
cgagaacgtgaaggccaagatccag

SEQ ID NO: 360574 - DNA, 25 bp, Mus musculus
cgagaagaccacagttagcagtggg

SEQ ID NO: 360575 - DNA, 25 bp, Mus musculus
cgagaagaccactgttagcagtggg

SEQ ID NO: 360576 - DNA, 25 bp, Mus musculus
cgagaagagtacagttccagttcac

SEQ ID NO: 360577 - DNA, 25 bp, Mus musculus
cgagaagagtactgttccagttcac

SEQ ID NO: 360578 - DNA, 25 bp, Mus musculus
cgagaagatgccatttacaccaccc

SEQ ID NO: 360579 - DNA, 25 bp, Mus musculus
cgagaagatgccttttacaccaccc

SEQ ID NO: 360580 - DNA, 25 bp, Mus musculus
cgagaagccacccatgagccctttc

SEQ ID NO: 360581 - DNA, 25 bp, Mus musculus
cgagaagccaccgatgagccctttc

SEQ ID NO: 360582 - DNA, 25 bp, Mus musculus
cgagaagccagcagggtcctctgtg

SEQ ID NO: 360583 - DNA, 25 bp, Mus musculus
cgagaagccagctgggtcctctgtg

SEQ ID NO: 360584 - DNA, 25 bp, Mus musculus
cgagaagctcgtctggttttttgtt

SEQ ID NO: 360585 - DNA, 25 bp, Mus musculus
cgagaagctcgtgtggttttttgtt

SEQ ID NO: 360586 - DNA, 25 bp, Mus musculus
cgagaagctctcagttttgctaaat

SEQ ID NO: 360587 - DNA, 25 bp, Mus musculus
cgagaagctctctgttttgctaaat

SEQ ID NO: 360588 - DNA, 25 bp, Mus musculus
cgagaagtatttccccggcagctga

SEQ ID NO: 360589 - DNA, 25 bp, Mus musculus
cgagaagtatttgcccggcagctga

SEQ ID NO: 360590 - DNA, 25 bp, Mus musculus
cgagaatatctgaaatctggttcca

SEQ ID NO: 360591 - DNA, 25 bp, Mus musculus
cgagaatatctgtaatctggttcca

SEQ ID NO: 360592 - DNA, 25 bp, Mus musculus
cgagaatatttgaagcaccatgtgc

SEQ ID NO: 360593 - DNA, 25 bp, Mus musculus
cgagaatatttgtagcaccatgtgc

SEQ ID NO: 360594 - DNA, 25 bp, Mus musculus
cgagaatctgggatgtatgctccta

SEQ ID NO: 360595 - DNA, 25 bp, Mus musculus
cgagaatctgggttgtatgctccta

SEQ ID NO: 360596 - DNA, 25 bp, Mus musculus
cgagaatcttgtcaagtgcttcggg

SEQ ID NO: 360597 - DNA, 25 bp, Mus musculus
cgagaatcttgtgaagtgcttcggg

SEQ ID NO: 360598 - DNA, 25 bp, Mus musculus
cgagaatgcttcagtaatcctataa

SEQ ID NO: 360599 - DNA, 25 bp, Mus musculus
cgagaatgcttctgtaatcctataa

SEQ ID NO: 360600 - DNA, 25 bp, Mus musculus
cgagacagtacccagcgacttttct

SEQ ID NO: 360601 - DNA, 25 bp, Mus musculus
cgagacagtaccgagcgacttttct

SEQ ID NO: 360602 - DNA, 25 bp, Mus musculus
cgagacattgacctggttagaccaa

SEQ ID NO: 360603 - DNA, 25 bp, Mus musculus
cgagacattgacgtggttagaccaa

SEQ ID NO: 360604 - DNA, 25 bp, Mus musculus
cgagaccacagtagaccccaatgat

SEQ ID NO: 360605 - DNA, 25 bp, Mus musculus
cgagaccacagttgaccccaatgat

SEQ ID NO: 360606 - DNA, 25 bp, Mus musculus
cgagaccccagcaaaagtaccattt

SEQ ID NO: 360607 - DNA, 25 bp, Mus musculus
cgagaccccagctaaagtaccattt

SEQ ID NO: 360608 - DNA, 25 bp, Mus musculus
cgagacgacgacagcggtgggtgct

SEQ ID NO: 360609 - DNA, 25 bp, Mus musculus
cgagacgacgactgcggtgggtgct

SEQ ID NO: 360610 - DNA, 25 bp, Mus musculus
cgagactgttctcccatttcttttg

SEQ ID NO: 360611 - DNA, 25 bp, Mus musculus
cgagactgttctgccatttcttttg

SEQ ID NO: 360612 - DNA, 25 bp, Mus musculus
cgagagagtgtgctttcatgtgtgt

SEQ ID NO: 360613 - DNA, 25 bp, Mus musculus
cgagagagtgtggtttcatgtgtgt

SEQ ID NO: 360614 - DNA, 25 bp, Mus musculus
cgagagatgccactccgcctgtgaa

SEQ ID NO: 360615 - DNA, 25 bp, Mus musculus
cgagagatgccagtccgcctgtgaa

SEQ ID NO: 360616 - DNA, 25 bp, Mus musculus
cgagagcactcgaagatggttcttt

SEQ ID NO: 360617 - DNA, 25 bp, Mus musculus
cgagagcactcgtagatggttcttt

SEQ ID NO: 360618 - DNA, 25 bp, Mus musculus
cgagagcccggacaacatgattatc

SEQ ID NO: 360619 - DNA, 25 bp, Mus musculus
cgagagcccggagaacatgattatc

SEQ ID NO: 360620 - DNA, 25 bp, Mus musculus
cgagagcgccggagcccaccaggat

SEQ ID NO: 360621 - DNA, 25 bp, Mus musculus
cgagagcgccggtgcccaccaggat

SEQ ID NO: 360622 - DNA, 25 bp, Mus musculus
cgagagctgcgacaagattccatca

SEQ ID NO: 360623 - DNA, 25 bp, Mus musculus
cgagagctgcgagaagattccatca

SEQ ID NO: 360624 - DNA, 25 bp, Mus musculus
cgagagctgcgcatggcagattgca

SEQ ID NO: 360625 - DNA, 25 bp, Mus musculus
cgagagctgcgcttggcagattgca

SEQ ID NO: 360626 - DNA, 25 bp, Mus musculus
cgagagctgggtcctgtaatcgacc

SEQ ID NO: 360627 - DNA, 25 bp, Mus musculus
cgagagctgggtgctgtaatcgacc

SEQ ID NO: 360628 - DNA, 25 bp, Mus musculus
cgagagcttgaactgtgccatggca

SEQ ID NO: 360629 - DNA, 25 bp, Mus musculus
cgagagcttgaagtgtgccatggca

SEQ ID NO: 360630 - DNA, 25 bp, Mus musculus
cgagaggtatcgacacttaactttc

SEQ ID NO: 360631 - DNA, 25 bp, Mus musculus
cgagaggtatcgtcacttaactttc

SEQ ID NO: 360632 - DNA, 25 bp, Mus musculus
cgagaggttcatccgtgggtccaca

SEQ ID NO: 360633 - DNA, 25 bp, Mus musculus
cgagaggttcatgcgtgggtccaca

SEQ ID NO: 360634 - DNA, 25 bp, Mus musculus
cgagagtgctcgagatccagtggaa

SEQ ID NO: 360635 - DNA, 25 bp, Mus musculus
cgagagtgctcgtgatccagtggaa

SEQ ID NO: 360636 - DNA, 25 bp, Mus musculus
cgagagttataaatacccatgtgaa

SEQ ID NO: 360637 - DNA, 25 bp, Mus musculus
cgagagttataattacccatgtgaa

SEQ ID NO: 360638 - DNA, 25 bp, Mus musculus
cgagagttcgagaacagcctgagct

SEQ ID NO: 360639 - DNA, 25 bp, Mus musculus
cgagagttcgagtacagcctgagct

SEQ ID NO: 360640 - DNA, 25 bp, Mus musculus
cgagataattaaagtatgccaatga

SEQ ID NO: 360641 - DNA, 25 bp, Mus musculus
cgagataattaatgtatgccaatga

SEQ ID NO: 360642 - DNA, 25 bp, Mus musculus
cgagatatcacaaagccctgctatt

SEQ ID NO: 360643 - DNA, 25 bp, Mus musculus
cgagatatcacatagccctgctatt

SEQ ID NO: 360644 - DNA, 25 bp, Mus musculus
cgagatatggcccgcgctggagttt

SEQ ID NO: 360645 - DNA, 25 bp, Mus musculus
cgagatatggccggcgctggagttt

SEQ ID NO: 360646 - DNA, 25 bp, Mus musculus
cgagatcaacgacaagagccctttt

SEQ ID NO: 360647 - DNA, 25 bp, Mus musculus
cgagatcaacgagaagagccctttt

SEQ ID NO: 360648 - DNA, 25 bp, Mus musculus
cgagatcccgctatactggacaaac

SEQ ID NO: 360649 - DNA, 25 bp, Mus musculus
cgagatcccgctttactggacaaac

SEQ ID NO: 360650 - DNA, 25 bp, Mus musculus
cgagatctctggaactaagctgtgt

SEQ ID NO: 360651 - DNA, 25 bp, Mus musculus
cgagatctctggtactaagctgtgt

SEQ ID NO: 360652 - DNA, 25 bp, Mus musculus
cgagatcttgttccttggagtcgga

SEQ ID NO: 360653 - DNA, 25 bp, Mus musculus
cgagatcttgttgcttggagtcgga

SEQ ID NO: 360654 - DNA, 25 bp, Mus musculus
cgagatctttcaaacacttgtcccc

SEQ ID NO: 360655 - DNA, 25 bp, Mus musculus
cgagatctttcatacacttgtcccc

SEQ ID NO: 360656 - DNA, 25 bp, Mus musculus
cgagatgaacagagggcagaagaat

SEQ ID NO: 360657 - DNA, 25 bp, Mus musculus
cgagatgaacagtgggcagaagaat

SEQ ID NO: 360658 - DNA, 25 bp, Mus musculus
cgagatgcctgcagaccttcatatt

SEQ ID NO: 360659 - DNA, 25 bp, Mus musculus
cgagatgcctgctgaccttcatatt

SEQ ID NO: 360660 - DNA, 25 bp, Mus musculus
cgagatggacacctccagggagatt

SEQ ID NO: 360661 - DNA, 25 bp, Mus musculus
cgagatggacacgtccagggagatt

SEQ ID NO: 360662 - DNA, 25 bp, Mus musculus
cgagatgggactagcttgtgtacca

SEQ ID NO: 360663 - DNA, 25 bp, Mus musculus
cgagatgggacttgcttgtgtacca

SEQ ID NO: 360664 - DNA, 25 bp, Mus musculus
cgagatgtacgcagtgaagttgaga

SEQ ID NO: 360665 - DNA, 25 bp, Mus musculus
cgagatgtacgctgtgaagttgaga

SEQ ID NO: 360666 - DNA, 25 bp, Mus musculus
cgagattatcctccgctttgaagag

SEQ ID NO: 360667 - DNA, 25 bp, Mus musculus
cgagattatcctgcgctttgaagag

SEQ ID NO: 360668 - DNA, 25 bp, Mus musculus
cgagattcctttctaacccaagtag

SEQ ID NO: 360669 - DNA, 25 bp, Mus musculus
cgagattcctttgtaacccaagtag

SEQ ID NO: 360670 - DNA, 25 bp, Mus musculus
cgagattgctctccttgagcacaaa

SEQ ID NO: 360671 - DNA, 25 bp, Mus musculus
cgagattgctctgcttgagcacaaa

SEQ ID NO: 360672 - DNA, 25 bp, Mus musculus
cgagatttcaggatatgggttggtc

SEQ ID NO: 360673 - DNA, 25 bp, Mus musculus
cgagatttcaggttatgggttggtc

SEQ ID NO: 360674 - DNA, 25 bp, Mus musculus
cgagatttctcactagcaggccaga

SEQ ID NO: 360675 - DNA, 25 bp, Mus musculus
cgagatttctcagtagcaggccaga

SEQ ID NO: 360676 - DNA, 25 bp, Mus musculus
cgagatttgtagcttgtctgcccgg

SEQ ID NO: 360677 - DNA, 25 bp, Mus musculus
cgagatttgtaggttgtctgcccgg

SEQ ID NO: 360678 - DNA, 25 bp, Mus musculus
cgagcaagcactcgccctctattag

SEQ ID NO: 360679 - DNA, 25 bp, Mus musculus
cgagcaagcactggccctctattag

SEQ ID NO: 360680 - DNA, 25 bp, Mus musculus
cgagcaccaaaaagtatacctactt

SEQ ID NO: 360681 - DNA, 25 bp, Mus musculus
cgagcaccaaaatgtatacctactt

SEQ ID NO: 360682 - DNA, 25 bp, Mus musculus
cgagcaccaccacttggctgaagtt

SEQ ID NO: 360683 - DNA, 25 bp, Mus musculus
cgagcaccaccagttggctgaagtt

SEQ ID NO: 360684 - DNA, 25 bp, Mus musculus
cgagcacccctgcacatagtcagag

SEQ ID NO: 360685 - DNA, 25 bp, Mus musculus
cgagcacccctggacatagtcagag

SEQ ID NO: 360686 - DNA, 25 bp, Mus musculus
cgagcacgctcgcagactgattgag

SEQ ID NO: 360687 - DNA, 25 bp, Mus musculus
cgagcacgctcggagactgattgag

SEQ ID NO: 360688 - DNA, 25 bp, Mus musculus
cgagcacgtcgacgcggcgcagcgg

SEQ ID NO: 360689 - DNA, 25 bp, Mus musculus
cgagcacgtcgaggcggcgcagcgg

SEQ ID NO: 360690 - DNA, 25 bp, Mus musculus
cgagcactgctgatcccagagggat

SEQ ID NO: 360691 - DNA, 25 bp, Mus musculus
cgagcactgctgttcccagagggat

SEQ ID NO: 360692 - DNA, 25 bp, Mus musculus
cgagcactgtacaccaaagcactat

SEQ ID NO: 360693 - DNA, 25 bp, Mus musculus
cgagcactgtactccaaagcactat

SEQ ID NO: 360694 - DNA, 25 bp, Mus musculus
cgagcagacgagctcacctggctga

SEQ ID NO: 360695 - DNA, 25 bp, Mus musculus
cgagcagacgaggtcacctggctga

SEQ ID NO: 360696 - DNA, 25 bp, Mus musculus
cgagcagactttccctcaggtttct

SEQ ID NO: 360697 - DNA, 25 bp, Mus musculus
cgagcagactttgcctcaggtttct

SEQ ID NO: 360698 - DNA, 25 bp, Mus musculus
cgagcagatgaacgaacagactcag

SEQ ID NO: 360699 - DNA, 25 bp, Mus musculus
cgagcagatgaaggaacagactcag

SEQ ID NO: 360700 - DNA, 25 bp, Mus musculus
cgagcagcagccctagtgaacaccg

SEQ ID NO: 360701 - DNA, 25 bp, Mus musculus
cgagcagcagccgtagtgaacaccg

SEQ ID NO: 360702 - DNA, 25 bp, Mus musculus
cgagcagcatcacttcagctgtctg

SEQ ID NO: 360703 - DNA, 25 bp, Mus musculus
cgagcagcatcagttcagctgtctg

SEQ ID NO: 360704 - DNA, 25 bp, Mus musculus
cgagcagctcaccacggataaggga

SEQ ID NO: 360705 - DNA, 25 bp, Mus musculus
cgagcagctcacgacggataaggga

SEQ ID NO: 360706 - DNA, 25 bp, Mus musculus
cgagcagctgaaatgatggcatcat

SEQ ID NO: 360707 - DNA, 25 bp, Mus musculus
cgagcagctgaattgatggcatcat

SEQ ID NO: 360708 - DNA, 25 bp, Mus musculus
cgagcagctggcaaacatgaggatc

SEQ ID NO: 360709 - DNA, 25 bp, Mus musculus
cgagcagctggctaacatgaggatc

SEQ ID NO: 360710 - DNA, 25 bp, Mus musculus
cgagcagtcacaccgcaatagcagt

SEQ ID NO: 360711 - DNA, 25 bp, Mus musculus
cgagcagtcacagcgcaatagcagt

SEQ ID NO: 360712 - DNA, 25 bp, Mus musculus
cgagcataccccaggaagcttggcg

SEQ ID NO: 360713 - DNA, 25 bp, Mus musculus
cgagcatacccctggaagcttggcg

SEQ ID NO: 360714 - DNA, 25 bp, Mus musculus
cgagcattcttacccgttgtgatat

SEQ ID NO: 360715 - DNA, 25 bp, Mus musculus
cgagcattcttagccgttgtgatat

SEQ ID NO: 360716 - DNA, 25 bp, Mus musculus
cgagccacagctattcaagtcacag

SEQ ID NO: 360717 - DNA, 25 bp, Mus musculus
cgagccacagcttttcaagtcacag

SEQ ID NO: 360718 - DNA, 25 bp, Mus musculus
cgagccagccaaacagatggtcaag

SEQ ID NO: 360719 - DNA, 25 bp, Mus musculus
cgagccagccaatcagatggtcaag

SEQ ID NO: 360720 - DNA, 25 bp, Mus musculus
cgagccagcctccttagagtattaa

SEQ ID NO: 360721 - DNA, 25 bp, Mus musculus
cgagccagcctcgttagagtattaa

SEQ ID NO: 360722 - DNA, 25 bp, Mus musculus
cgagccagcggcacgtgtcaagaga

SEQ ID NO: 360723 - DNA, 25 bp, Mus musculus
cgagccagcggctcgtgtcaagaga

SEQ ID NO: 360724 - DNA, 25 bp, Mus musculus
cgagccaggcatcctatgcctctgt

SEQ ID NO: 360725 - DNA, 25 bp, Mus musculus
cgagccaggcatgctatgcctctgt

SEQ ID NO: 360726 - DNA, 25 bp, Mus musculus
cgagccagtgtcaatctgtgtaact

SEQ ID NO: 360727 - DNA, 25 bp, Mus musculus
cgagccagtgtctatctgtgtaact

SEQ ID NO: 360728 - DNA, 25 bp, Mus musculus
cgagccagttttacccaggcagtaa

SEQ ID NO: 360729 - DNA, 25 bp, Mus musculus
cgagccagtttttcccaggcagtaa

SEQ ID NO: 360730 - DNA, 25 bp, Mus musculus
cgagccatatccaagccttggatag

SEQ ID NO: 360731 - DNA, 25 bp, Mus musculus
cgagccatatcctagccttggatag

SEQ ID NO: 360732 - DNA, 25 bp, Mus musculus
cgagcccacgccattagcaagatgc

SEQ ID NO: 360733 - DNA, 25 bp, Mus musculus
cgagcccacgcctttagcaagatgc

SEQ ID NO: 360734 - DNA, 25 bp, Mus musculus
cgagcccagggaagtccagacccaa

SEQ ID NO: 360735 - DNA, 25 bp, Mus musculus
cgagcccagggatgtccagacccaa

SEQ ID NO: 360736 - DNA, 25 bp, Mus musculus
cgagcccagtgtaaccaccaagaag

SEQ ID NO: 360737 - DNA, 25 bp, Mus musculus
cgagcccagtgttaccaccaagaag

SEQ ID NO: 360738 - DNA, 25 bp, Mus musculus
cgagcccatctgacgacagtttcca

SEQ ID NO: 360739 - DNA, 25 bp, Mus musculus
cgagcccatctgtcgacagtttcca

SEQ ID NO: 360740 - DNA, 25 bp, Mus musculus
cgagcccctagcagtatatacacta

SEQ ID NO: 360741 - DNA, 25 bp, Mus musculus
cgagcccctagctgtatatacacta

SEQ ID NO: 360742 - DNA, 25 bp, Mus musculus
cgagcccgagggacaggatattgat

SEQ ID NO: 360743 - DNA, 25 bp, Mus musculus
cgagcccgagggtcaggatattgat

SEQ ID NO: 360744 - DNA, 25 bp, Mus musculus
cgagcccgcaatctcgggccccaac

SEQ ID NO: 360745 - DNA, 25 bp, Mus musculus
cgagcccgcaatgtcgggccccaac

SEQ ID NO: 360746 - DNA, 25 bp, Mus musculus
cgagcccgcagacgagtcgccatga

SEQ ID NO: 360747 - DNA, 25 bp, Mus musculus
cgagcccgcagaggagtcgccatga

SEQ ID NO: 360748 - DNA, 25 bp, Mus musculus
cgagccggtgtgagcagtatagtca

SEQ ID NO: 360749 - DNA, 25 bp, Mus musculus
cgagccggtgtgtgcagtatagtca

SEQ ID NO: 360750 - DNA, 25 bp, Mus musculus
cgagccggttttcctgtgcaccttt

SEQ ID NO: 360751 - DNA, 25 bp, Mus musculus
cgagccggttttgctgtgcaccttt

SEQ ID NO: 360752 - DNA, 25 bp, Mus musculus
cgagcctactgaatgctgtgtatat

SEQ ID NO: 360753 - DNA, 25 bp, Mus musculus
cgagcctactgattgctgtgtatat

SEQ ID NO: 360754 - DNA, 25 bp, Mus musculus
cgagcctcctggaacgacatttgga

SEQ ID NO: 360755 - DNA, 25 bp, Mus musculus
cgagcctcctggtacgacatttgga

SEQ ID NO: 360756 - DNA, 25 bp, Mus musculus
cgagcctctaaacggttcagatata

SEQ ID NO: 360757 - DNA, 25 bp, Mus musculus
cgagcctctaaagggttcagatata

SEQ ID NO: 360758 - DNA, 25 bp, Mus musculus
cgagcctcttgtctgcaccagagag

SEQ ID NO: 360759 - DNA, 25 bp, Mus musculus
cgagcctcttgtgtgcaccagagag

SEQ ID NO: 360760 - DNA, 25 bp, Mus musculus
cgagcctgaggccacatatgcagta

SEQ ID NO: 360761 - DNA, 25 bp, Mus musculus
cgagcctgaggcgacatatgcagta

SEQ ID NO: 360762 - DNA, 25 bp, Mus musculus
cgagcctgcactacttgtagatgga

SEQ ID NO: 360763 - DNA, 25 bp, Mus musculus
cgagcctgcacttcttgtagatgga

SEQ ID NO: 360764 - DNA, 25 bp, Mus musculus
cgagcctgccgcaggtaaagagaca

SEQ ID NO: 360765 - DNA, 25 bp, Mus musculus
cgagcctgccgctggtaaagagaca

SEQ ID NO: 360766 - DNA, 25 bp, Mus musculus
cgagcctgcttaaacatacaatgtt

SEQ ID NO: 360767 - DNA, 25 bp, Mus musculus
cgagcctgcttatacatacaatgtt

SEQ ID NO: 360768 - DNA, 25 bp, Mus musculus
cgagcctggctgatcgaaccaagaa

SEQ ID NO: 360769 - DNA, 25 bp, Mus musculus
cgagcctggctgttcgaaccaagaa

SEQ ID NO: 360770 - DNA, 25 bp, Mus musculus
cgagcctgtctgcatgatttattac

SEQ ID NO: 360771 - DNA, 25 bp, Mus musculus
cgagcctgtctggatgatttattac

SEQ ID NO: 360772 - DNA, 25 bp, Mus musculus
cgagcctttcagagcgacgcccagg

SEQ ID NO: 360773 - DNA, 25 bp, Mus musculus
cgagcctttcagtgcgacgcccagg

SEQ ID NO: 360774 - DNA, 25 bp, Mus musculus
cgagcgcctttacctgtagatgagt

SEQ ID NO: 360775 - DNA, 25 bp, Mus musculus
cgagcgcctttagctgtagatgagt

SEQ ID NO: 360776 - DNA, 25 bp, Mus musculus
cgagcgctaatgaccttcctcattt

SEQ ID NO: 360777 - DNA, 25 bp, Mus musculus
cgagcgctaatgtccttcctcattt

SEQ ID NO: 360778 - DNA, 25 bp, Mus musculus
cgagcgctccgcatcaagcgtggag

SEQ ID NO: 360779 - DNA, 25 bp, Mus musculus
cgagcgctccgcttcaagcgtggag

SEQ ID NO: 360780 - DNA, 25 bp, Mus musculus
cgagcgcttcacatcctggaaaaag

SEQ ID NO: 360781 - DNA, 25 bp, Mus musculus
cgagcgcttcacttcctggaaaaag

SEQ ID NO: 360782 - DNA, 25 bp, Mus musculus
cgagcggccattcctttcagtggga

SEQ ID NO: 360783 - DNA, 25 bp, Mus musculus
cgagcggccattgctttcagtggga

SEQ ID NO: 360784 - DNA, 25 bp, Mus musculus
cgagctagtacccaccaatgtttaa

SEQ ID NO: 360785 - DNA, 25 bp, Mus musculus
cgagctagtaccgaccaatgtttaa

SEQ ID NO: 360786 - DNA, 25 bp, Mus musculus
cgagctagtagcaggagagacactt

SEQ ID NO: 360787 - DNA, 25 bp, Mus musculus
cgagctagtagctggagagacactt

SEQ ID NO: 360788 - DNA, 25 bp, Mus musculus
cgagctcacatcataggctacttgg

SEQ ID NO: 360789 - DNA, 25 bp, Mus musculus
cgagctcacatcttaggctacttgg

SEQ ID NO: 360790 - DNA, 25 bp, Mus musculus
cgagctcacattccaaaaccgaaac

SEQ ID NO: 360791 - DNA, 25 bp, Mus musculus
cgagctcacattgcaaaaccgaaac

SEQ ID NO: 360792 - DNA, 25 bp, Mus musculus
cgagctcaccaccttaacattttgg

SEQ ID NO: 360793 - DNA, 25 bp, Mus musculus
cgagctcaccacgttaacattttgg

SEQ ID NO: 360794 - DNA, 25 bp, Mus musculus
cgagctcagcggaatgcatgttact

SEQ ID NO: 360795 - DNA, 25 bp, Mus musculus
cgagctcagcggtatgcatgttact

SEQ ID NO: 360796 - DNA, 25 bp, Mus musculus
cgagctcctcacaagggcgtcaaga

SEQ ID NO: 360797 - DNA, 25 bp, Mus musculus
cgagctcctcactagggcgtcaaga

SEQ ID NO: 360798 - DNA, 25 bp, Mus musculus
cgagctctagtgagtcctgtttgta

SEQ ID NO: 360799 - DNA, 25 bp, Mus musculus
cgagctctagtgtgtcctgtttgta

SEQ ID NO: 360800 - DNA, 25 bp, Mus musculus
cgagctcttcataaaacccaacaaa

SEQ ID NO: 360801 - DNA, 25 bp, Mus musculus
cgagctcttcattaaacccaacaaa

SEQ ID NO: 360802 - DNA, 25 bp, Mus musculus
cgagctcttgtgatgaaagtgtcca

SEQ ID NO: 360803 - DNA, 25 bp, Mus musculus
cgagctcttgtgttgaaagtgtcca

SEQ ID NO: 360804 - DNA, 25 bp, Mus musculus
cgagctgagctgaaccttatggaaa

SEQ ID NO: 360805 - DNA, 25 bp, Mus musculus
cgagctgagctgtaccttatggaaa

SEQ ID NO: 360806 - DNA, 25 bp, Mus musculus
cgagctgagggaacccaggtttaat

SEQ ID NO: 360807 - DNA, 25 bp, Mus musculus
cgagctgagggatcccaggtttaat

SEQ ID NO: 360808 - DNA, 25 bp, Mus musculus
cgagctgagtcacatgtttccttcc

SEQ ID NO: 360809 - DNA, 25 bp, Mus musculus
cgagctgagtcagatgtttccttcc

SEQ ID NO: 360810 - DNA, 25 bp, Mus musculus
cgagctgagtgtcagatccttcaac

SEQ ID NO: 360811 - DNA, 25 bp, Mus musculus
cgagctgagtgtgagatccttcaac

SEQ ID NO: 360812 - DNA, 25 bp, Mus musculus
cgagctgatcgacttctacgggata

SEQ ID NO: 360813 - DNA, 25 bp, Mus musculus
cgagctgatcgagttctacgggata

SEQ ID NO: 360814 - DNA, 25 bp, Mus musculus
cgagctgatgttccgggaagatttt

SEQ ID NO: 360815 - DNA, 25 bp, Mus musculus
cgagctgatgttgcgggaagatttt

SEQ ID NO: 360816 - DNA, 25 bp, Mus musculus
cgagctgcagttaagtagccctact

SEQ ID NO: 360817 - DNA, 25 bp, Mus musculus
cgagctgcagtttagtagccctact

SEQ ID NO: 360818 - DNA, 25 bp, Mus musculus
cgagctgctgatccgcaagctgccg

SEQ ID NO: 360819 - DNA, 25 bp, Mus musculus
cgagctgctgatgcgcaagctgccg

SEQ ID NO: 360820 - DNA, 25 bp, Mus musculus
cgagctgggctgaaatgtactgtga

SEQ ID NO: 360821 - DNA, 25 bp, Mus musculus
cgagctgggctgtaatgtactgtga

SEQ ID NO: 360822 - DNA, 25 bp, Mus musculus
cgagctggttcgatgaggccaagtt

SEQ ID NO: 360823 - DNA, 25 bp, Mus musculus
cgagctggttcgttgaggccaagtt

SEQ ID NO: 360824 - DNA, 25 bp, Mus musculus
cgagctgtaagacaggaatctagac

SEQ ID NO: 360825 - DNA, 25 bp, Mus musculus
cgagctgtaagagaggaatctagac

SEQ ID NO: 360826 - DNA, 25 bp, Mus musculus
cgagctgtacaaaccgtcgctaaat

SEQ ID NO: 360827 - DNA, 25 bp, Mus musculus
cgagctgtacaatccgtcgctaaat

SEQ ID NO: 360828 - DNA, 25 bp, Mus musculus
cgagctgtctttaacacccttgaat

SEQ ID NO: 360829 - DNA, 25 bp, Mus musculus
cgagctgtcttttacacccttgaat

SEQ ID NO: 360830 - DNA, 25 bp, Mus musculus
cgagctgttagaattcagagtgcta

SEQ ID NO: 360831 - DNA, 25 bp, Mus musculus
cgagctgttagatttcagagtgcta

SEQ ID NO: 360832 - DNA, 25 bp, Mus musculus
cgagcttccgcaatttgctgggaaa

SEQ ID NO: 360833 - DNA, 25 bp, Mus musculus
cgagcttccgcattttgctgggaaa

SEQ ID NO: 360834 - DNA, 25 bp, Mus musculus
cgagcttcctgacggccacctggag

SEQ ID NO: 360835 - DNA, 25 bp, Mus musculus
cgagcttcctgagggccacctggag

SEQ ID NO: 360836 - DNA, 25 bp, Mus musculus
cgagcttgagccaccgggagagcac

SEQ ID NO: 360837 - DNA, 25 bp, Mus musculus
cgagcttgagcctccgggagagcac

SEQ ID NO: 360838 - DNA, 25 bp, Mus musculus
cgagcttgatccagttttgaatttt

SEQ ID NO: 360839 - DNA, 25 bp, Mus musculus
cgagcttgatcctgttttgaatttt

SEQ ID NO: 360840 - DNA, 25 bp, Mus musculus
cgagcttgtgcccaattgtaacact

SEQ ID NO: 360841 - DNA, 25 bp, Mus musculus
cgagcttgtgccgaattgtaacact

SEQ ID NO: 360842 - DNA, 25 bp, Mus musculus
cgagctttaagcaatctccaggaaa

SEQ ID NO: 360843 - DNA, 25 bp, Mus musculus
cgagctttaagctatctccaggaaa

SEQ ID NO: 360844 - DNA, 25 bp, Mus musculus
cgagcttttggcattctgcgaaacg

SEQ ID NO: 360845 - DNA, 25 bp, Mus musculus
cgagcttttggctttctgcgaaacg

SEQ ID NO: 360846 - DNA, 25 bp, Mus musculus
cgaggaaagaaaaacgattccgatt

SEQ ID NO: 360847 - DNA, 25 bp, Mus musculus
cgaggaaagaaatacgattccgatt

SEQ ID NO: 360848 - DNA, 25 bp, Mus musculus
cgaggaaatgctcagtgtgtctatt

SEQ ID NO: 360849 - DNA, 25 bp, Mus musculus
cgaggaaatgctgagtgtgtctatt

SEQ ID NO: 360850 - DNA, 25 bp, Mus musculus
cgaggaagcgacagccgacagccga

SEQ ID NO: 360851 - DNA, 25 bp, Mus musculus
cgaggaagcgactgccgacagccga

SEQ ID NO: 360852 - DNA, 25 bp, Mus musculus
cgaggaattcctagaaagcaataaa

SEQ ID NO: 360853 - DNA, 25 bp, Mus musculus
cgaggaattccttgaaagcaataaa

SEQ ID NO: 360854 - DNA, 25 bp, Mus musculus
cgaggacaaacaactgagactgtgt

SEQ ID NO: 360855 - DNA, 25 bp, Mus musculus
cgaggacaaacatctgagactgtgt

SEQ ID NO: 360856 - DNA, 25 bp, Mus musculus
cgaggacacgcgagccgacacgacg

SEQ ID NO: 360857 - DNA, 25 bp, Mus musculus
cgaggacacgcgtgccgacacgacg

SEQ ID NO: 360858 - DNA, 25 bp, Mus musculus
cgaggaccgggaccacgaacgctca

SEQ ID NO: 360859 - DNA, 25 bp, Mus musculus
cgaggaccgggagcacgaacgctca

SEQ ID NO: 360860 - DNA, 25 bp, Mus musculus
cgaggactatctccagtgctgggcc

SEQ ID NO: 360861 - DNA, 25 bp, Mus musculus
cgaggactatctgcagtgctgggcc

SEQ ID NO: 360862 - DNA, 25 bp, Mus musculus
cgaggactcggacagtttacttctt

SEQ ID NO: 360863 - DNA, 25 bp, Mus musculus
cgaggactcggagagtttacttctt

SEQ ID NO: 360864 - DNA, 25 bp, Mus musculus
cgaggactgtggcatgttttcttat

SEQ ID NO: 360865 - DNA, 25 bp, Mus musculus
cgaggactgtgggatgttttcttat

SEQ ID NO: 360866 - DNA, 25 bp, Mus musculus
cgaggacttcatatgcaactgtgac

SEQ ID NO: 360867 - DNA, 25 bp, Mus musculus
cgaggacttcatttgcaactgtgac

SEQ ID NO: 360868 - DNA, 25 bp, Mus musculus
cgaggagaaaccaccgcaatgactt

SEQ ID NO: 360869 - DNA, 25 bp, Mus musculus
cgaggagaaacctccgcaatgactt

SEQ ID NO: 360870 - DNA, 25 bp, Mus musculus
cgaggagagcaaacagagatatcaa

SEQ ID NO: 360871 - DNA, 25 bp, Mus musculus
cgaggagagcaatcagagatatcaa

SEQ ID NO: 360872 - DNA, 25 bp, Mus musculus
cgaggagagtacacagtgtgtgaca

SEQ ID NO: 360873 - DNA, 25 bp, Mus musculus
cgaggagagtactcagtgtgtgaca

SEQ ID NO: 360874 - DNA, 25 bp, Mus musculus
cgaggagcatccaactctactgtag

SEQ ID NO: 360875 - DNA, 25 bp, Mus musculus
cgaggagcatcctactctactgtag

SEQ ID NO: 360876 - DNA, 25 bp, Mus musculus
cgaggagccagtccttacacgggat

SEQ ID NO: 360877 - DNA, 25 bp, Mus musculus
cgaggagccagtgcttacacgggat

SEQ ID NO: 360878 - DNA, 25 bp, Mus musculus
cgaggaggctccctgctgagaaact

SEQ ID NO: 360879 - DNA, 25 bp, Mus musculus
cgaggaggctccgtgctgagaaact

SEQ ID NO: 360880 - DNA, 25 bp, Mus musculus
cgaggaggtggacatggactgagct

SEQ ID NO: 360881 - DNA, 25 bp, Mus musculus
cgaggaggtggagatggactgagct

SEQ ID NO: 360882 - DNA, 25 bp, Mus musculus
cgaggagtactaacggatcgtctta

SEQ ID NO: 360883 - DNA, 25 bp, Mus musculus
cgaggagtactatcggatcgtctta

SEQ ID NO: 360884 - DNA, 25 bp, Mus musculus
cgaggagtataaagaagcccgtgta

SEQ ID NO: 360885 - DNA, 25 bp, Mus musculus
cgaggagtataatgaagcccgtgta

SEQ ID NO: 360886 - DNA, 25 bp, Mus musculus
cgaggagtcaaccttctaggaagct

SEQ ID NO: 360887 - DNA, 25 bp, Mus musculus
cgaggagtcaacgttctaggaagct

SEQ ID NO: 360888 - DNA, 25 bp, Mus musculus
cgaggagtcaatagagcaagactta

SEQ ID NO: 360889 - DNA, 25 bp, Mus musculus
cgaggagtcaattgagcaagactta

SEQ ID NO: 360890 - DNA, 25 bp, Mus musculus
cgaggagttaaaagtcactgagttt

SEQ ID NO: 360891 - DNA, 25 bp, Mus musculus
cgaggagttaaatgtcactgagttt

SEQ ID NO: 360892 - DNA, 25 bp, Mus musculus
cgaggagttcttatggctcagcact

SEQ ID NO: 360893 - DNA, 25 bp, Mus musculus
cgaggagttcttttggctcagcact

SEQ ID NO: 360894 - DNA, 25 bp, Mus musculus
cgaggatgaggcatgagttccccag

SEQ ID NO: 360895 - DNA, 25 bp, Mus musculus
cgaggatgaggcttgagttccccag

SEQ ID NO: 360896 - DNA, 25 bp, Mus musculus
cgaggatgagtcagtctaaagttac

SEQ ID NO: 360897 - DNA, 25 bp, Mus musculus
cgaggatgagtccaccccggaaaag

SEQ ID NO: 360898 - DNA, 25 bp, Mus musculus
cgaggatgagtcgaccccggaaaag

SEQ ID NO: 360899 - DNA, 25 bp, Mus musculus
cgaggatgagtctgtctaaagttac

SEQ ID NO: 360900 - DNA, 25 bp, Mus musculus
cgaggatgccgacgaataccctcct

SEQ ID NO: 360901 - DNA, 25 bp, Mus musculus
cgaggatgccgaggaataccctcct

SEQ ID NO: 360902 - DNA, 25 bp, Mus musculus
cgaggatgcttacagccatcgctct

SEQ ID NO: 360903 - DNA, 25 bp, Mus musculus
cgaggatgcttagagccatcgctct

SEQ ID NO: 360904 - DNA, 25 bp, Mus musculus
cgaggcaagcatagcatggcggcat

SEQ ID NO: 360905 - DNA, 25 bp, Mus musculus
cgaggcaagcattgcatggcggcat

SEQ ID NO: 360906 - DNA, 25 bp, Mus musculus
cgaggcacccatcttcccagaagta

SEQ ID NO: 360907 - DNA, 25 bp, Mus musculus
cgaggcacccatgttcccagaagta

SEQ ID NO: 360908 - DNA, 25 bp, Mus musculus
cgaggcagcagcagttgctaaagaa

SEQ ID NO: 360909 - DNA, 25 bp, Mus musculus
cgaggcagcagctgttgctaaagaa

SEQ ID NO: 360910 - DNA, 25 bp, Mus musculus
cgaggcagccgaaaggtctacaatt

SEQ ID NO: 360911 - DNA, 25 bp, Mus musculus
cgaggcagccgataggtctacaatt

SEQ ID NO: 360912 - DNA, 25 bp, Mus musculus
cgaggcaggtgtcactcagcaagca

SEQ ID NO: 360913 - DNA, 25 bp, Mus musculus
cgaggcaggtgtgactcagcaagca

SEQ ID NO: 360914 - DNA, 25 bp, Mus musculus
cgaggcagtgccaccatggtccaga

SEQ ID NO: 360915 - DNA, 25 bp, Mus musculus
cgaggcagtgcctccatggtccaga

SEQ ID NO: 360916 - DNA, 25 bp, Mus musculus
cgaggcatgtctatacactttattt

SEQ ID NO: 360917 - DNA, 25 bp, Mus musculus
cgaggcatgtctttacactttattt

SEQ ID NO: 360918 - DNA, 25 bp, Mus musculus
cgaggccatggcatttaaacggtat

SEQ ID NO: 360919 - DNA, 25 bp, Mus musculus
cgaggccatggcttttaaacggtat

SEQ ID NO: 360920 - DNA, 25 bp, Mus musculus
cgaggccctgacaccggcttggtac

SEQ ID NO: 360921 - DNA, 25 bp, Mus musculus
cgaggccctgactccggcttggtac

SEQ ID NO: 360922 - DNA, 25 bp, Mus musculus
cgaggccgcctaccgagagaagaac

SEQ ID NO: 360923 - DNA, 25 bp, Mus musculus
cgaggccgcctagcgagagaagaac

SEQ ID NO: 360924 - DNA, 25 bp, Mus musculus
cgaggccggctgaacgaggaaataa

SEQ ID NO: 360925 - DNA, 25 bp, Mus musculus
cgaggccggctgtacgaggaaataa

SEQ ID NO: 360926 - DNA, 25 bp, Mus musculus
cgaggcctggataaatcaattcact

SEQ ID NO: 360927 - DNA, 25 bp, Mus musculus
cgaggcctggattaatcaattcact

SEQ ID NO: 360928 - DNA, 25 bp, Mus musculus
cgaggcctgggcagttagcagttaa

SEQ ID NO: 360929 - DNA, 25 bp, Mus musculus
cgaggcctgggctgttagcagttaa

SEQ ID NO: 360930 - DNA, 25 bp, Mus musculus
cgaggccttcggactataatggaaa

SEQ ID NO: 360931 - DNA, 25 bp, Mus musculus
cgaggccttcggtctataatggaaa

SEQ ID NO: 360932 - DNA, 25 bp, Mus musculus
cgaggcgctgggatccctcttcagc

SEQ ID NO: 360933 - DNA, 25 bp, Mus musculus
cgaggcgctgggttccctcttcagc

SEQ ID NO: 360934 - DNA, 25 bp, Mus musculus
cgaggcggaggacaatcctccataa

SEQ ID NO: 360935 - DNA, 25 bp, Mus musculus
cgaggcggaggagaatcctccataa

SEQ ID NO: 360936 - DNA, 25 bp, Mus musculus
cgaggcgtccgtcgcgtgtccggcg

SEQ ID NO: 360937 - DNA, 25 bp, Mus musculus
cgaggcgtccgtggcgtgtccggcg

SEQ ID NO: 360938 - DNA, 25 bp, Mus musculus
cgaggctaggcgatggtgacccata

SEQ ID NO: 360939 - DNA, 25 bp, Mus musculus
cgaggctaggcgttggtgacccata

SEQ ID NO: 360940 - DNA, 25 bp, Mus musculus
cgaggctatacgaccaagattgcag

SEQ ID NO: 360941 - DNA, 25 bp, Mus musculus
cgaggctatacgtccaagattgcag

SEQ ID NO: 360942 - DNA, 25 bp, Mus musculus
cgaggctcagctcttgggcaagttg

SEQ ID NO: 360943 - DNA, 25 bp, Mus musculus
cgaggctcagctgttgggcaagttg

SEQ ID NO: 360944 - DNA, 25 bp, Mus musculus
cgaggctccatactggtgttggcat

SEQ ID NO: 360945 - DNA, 25 bp, Mus musculus
cgaggctccatagtggtgttggcat

SEQ ID NO: 360946 - DNA, 25 bp, Mus musculus
cgaggctccgtcatcatcatggttg

SEQ ID NO: 360947 - DNA, 25 bp, Mus musculus
cgaggctccgtcttcatcatggttg

SEQ ID NO: 360948 - DNA, 25 bp, Mus musculus
cgaggctcggagattgtatttaaat

SEQ ID NO: 360949 - DNA, 25 bp, Mus musculus
cgaggctcggagtttgtatttaaat

SEQ ID NO: 360950 - DNA, 25 bp, Mus musculus
cgaggctcgtcacatatccggttga

SEQ ID NO: 360951 - DNA, 25 bp, Mus musculus
cgaggctcgtcagatatccggttga

SEQ ID NO: 360952 - DNA, 25 bp, Mus musculus
cgaggctctactacctggagactgg

SEQ ID NO: 360953 - DNA, 25 bp, Mus musculus
cgaggctctacttcctggagactgg

SEQ ID NO: 360954 - DNA, 25 bp, Mus musculus
cgaggctgcatgaggctgaccccca

SEQ ID NO: 360955 - DNA, 25 bp, Mus musculus
cgaggctgcatgtggctgaccccca

SEQ ID NO: 360956 - DNA, 25 bp, Mus musculus
cgaggctgtacacccattgtgttcc

SEQ ID NO: 360957 - DNA, 25 bp, Mus musculus
cgaggctgtacagccattgtgttcc

SEQ ID NO: 360958 - DNA, 25 bp, Mus musculus
cgaggctgtcgactataaatctcaa

SEQ ID NO: 360959 - DNA, 25 bp, Mus musculus
cgaggctgtcgagtataaatctcaa

SEQ ID NO: 360960 - DNA, 25 bp, Mus musculus
cgaggcttaccaacagcaaacaggg

SEQ ID NO: 360961 - DNA, 25 bp, Mus musculus
cgaggcttaccatcagcaaacaggg

SEQ ID NO: 360962 - DNA, 25 bp, Mus musculus
cgagggaaagccactgctccagaga

SEQ ID NO: 360963 - DNA, 25 bp, Mus musculus
cgagggaaagcctctgctccagaga

SEQ ID NO: 360964 - DNA, 25 bp, Mus musculus
cgagggaaccacagcatccagggat

SEQ ID NO: 360965 - DNA, 25 bp, Mus musculus
cgagggaaccactgcatccagggat

SEQ ID NO: 360966 - DNA, 25 bp, Mus musculus
cgagggaattacagacaacatacca

SEQ ID NO: 360967 - DNA, 25 bp, Mus musculus
cgagggaattactgacaacatacca

SEQ ID NO: 360968 - DNA, 25 bp, Mus musculus
cgagggacagacaggatgccattat

SEQ ID NO: 360969 - DNA, 25 bp, Mus musculus
cgagggacagactggatgccattat

SEQ ID NO: 360970 - DNA, 25 bp, Mus musculus
cgagggcaagcgctcctactccatg

SEQ ID NO: 360971 - DNA, 25 bp, Mus musculus
cgagggcaagcggtcctactccatg

SEQ ID NO: 360972 - DNA, 25 bp, Mus musculus
cgagggcactggatcaggacataga

SEQ ID NO: 360973 - DNA, 25 bp, Mus musculus
cgagggcactggttcaggacataga

SEQ ID NO: 360974 - DNA, 25 bp, Mus musculus
cgagggcatagactctgcaggacct

SEQ ID NO: 360975 - DNA, 25 bp, Mus musculus
cgagggcatagagtctgcaggacct

SEQ ID NO: 360976 - DNA, 25 bp, Mus musculus
cgagggctctcaaccaaatgacgac

SEQ ID NO: 360977 - DNA, 25 bp, Mus musculus
cgagggctctcatccaaatgacgac

SEQ ID NO: 360978 - DNA, 25 bp, Mus musculus
cgagggctgaaaccccatgagttta

SEQ ID NO: 360979 - DNA, 25 bp, Mus musculus
cgagggctgaaagcccatgagttta

SEQ ID NO: 360980 - DNA, 25 bp, Mus musculus
cgagggtgaggcaccgtttcgaact

SEQ ID NO: 360981 - DNA, 25 bp, Mus musculus
cgagggtgaggctccgtttcgaact

SEQ ID NO: 360982 - DNA, 25 bp, Mus musculus
cgagggtgctccagcctttgtgatt

SEQ ID NO: 360983 - DNA, 25 bp, Mus musculus
cgagggtgctcctgcctttgtgatt

SEQ ID NO: 360984 - DNA, 25 bp, Mus musculus
cgaggtaacctgagcactgagcagt

SEQ ID NO: 360985 - DNA, 25 bp, Mus musculus
cgaggtaacctgtgcactgagcagt

SEQ ID NO: 360986 - DNA, 25 bp, Mus musculus
cgaggtcagctgagccagtctagag

SEQ ID NO: 360987 - DNA, 25 bp, Mus musculus
cgaggtcagctgtgccagtctagag

SEQ ID NO: 360988 - DNA, 25 bp, Mus musculus
cgaggtccaactattaaggcttgaa

SEQ ID NO: 360989 - DNA, 25 bp, Mus musculus
cgaggtccaacttttaaggcttgaa

SEQ ID NO: 360990 - DNA, 25 bp, Mus musculus
cgaggtcgccctcgctatagagtga

SEQ ID NO: 360991 - DNA, 25 bp, Mus musculus
cgaggtcgccctggctatagagtga

SEQ ID NO: 360992 - DNA, 25 bp, Mus musculus
cgaggtcgttctcgaagtcgatcga

SEQ ID NO: 360993 - DNA, 25 bp, Mus musculus
cgaggtcgttctggaagtcgatcga

SEQ ID NO: 360994 - DNA, 25 bp, Mus musculus
cgaggtctagctccgcgcagtatat

SEQ ID NO: 360995 - DNA, 25 bp, Mus musculus
cgaggtctagctgcgcgcagtatat

SEQ ID NO: 360996 - DNA, 25 bp, Mus musculus
cgaggtgaccaccatgacagtttgc

SEQ ID NO: 360997 - DNA, 25 bp, Mus musculus
cgaggtgaccacgatgacagtttgc

SEQ ID NO: 360998 - DNA, 25 bp, Mus musculus
cgaggtggctgcagacccctagaga

SEQ ID NO: 360999 - DNA, 25 bp, Mus musculus
cgaggtggctgctgacccctagaga

SEQ ID NO: 361000 - DNA, 25 bp, Mus musculus
cgaggtggcttcagcaactttatgc

SEQ ID NO: 361001 - DNA, 25 bp, Mus musculus
cgaggtggcttctgcaactttatgc

SEQ ID NO: 361002 - DNA, 25 bp, Mus musculus
cgaggtgggtggacaatcaatctga

SEQ ID NO: 361003 - DNA, 25 bp, Mus musculus
cgaggtgggtggtcaatcaatctga

SEQ ID NO: 361004 - DNA, 25 bp, Mus musculus
cgaggtgtgcacattttgctggacc

SEQ ID NO: 361005 - DNA, 25 bp, Mus musculus
cgaggtgtgcactttttgctggacc

SEQ ID NO: 361006 - DNA, 25 bp, Mus musculus
cgaggttagaggcacttccacggaa

SEQ ID NO: 361007 - DNA, 25 bp, Mus musculus
cgaggttagagggacttccacggaa

SEQ ID NO: 361008 - DNA, 25 bp, Mus musculus
cgaggttctgccagcaagtacactg

SEQ ID NO: 361009 - DNA, 25 bp, Mus musculus
cgaggttctgcctgcaagtacactg

SEQ ID NO: 361010 - DNA, 25 bp, Mus musculus
cgaggtttatacatgttgtacttgt

SEQ ID NO: 361011 - DNA, 25 bp, Mus musculus
cgaggtttatacttgttgtacttgt

SEQ ID NO: 361012 - DNA, 25 bp, Mus musculus
cgaggtttcgggatgcacagactgc

SEQ ID NO: 361013 - DNA, 25 bp, Mus musculus
cgaggtttcgggttgcacagactgc

SEQ ID NO: 361014 - DNA, 25 bp, Mus musculus
cgaggtttgggaacgcccaaagatt

SEQ ID NO: 361015 - DNA, 25 bp, Mus musculus
cgaggtttgggatcgcccaaagatt

SEQ ID NO: 361016 - DNA, 25 bp, Mus musculus
cgaggtttgtcccacgttagtgaca

SEQ ID NO: 361017 - DNA, 25 bp, Mus musculus
cgaggtttgtccgacgttagtgaca

SEQ ID NO: 361018 - DNA, 25 bp, Mus musculus
cgagtaagtcttctcagcattaaaa

SEQ ID NO: 361019 - DNA, 25 bp, Mus musculus
cgagtaagtcttgtcagcattaaaa

SEQ ID NO: 361020 - DNA, 25 bp, Mus musculus
cgagtacacggcagcgggacaaggc

SEQ ID NO: 361021 - DNA, 25 bp, Mus musculus
cgagtacacggctgcgggacaaggc

SEQ ID NO: 361022 - DNA, 25 bp, Mus musculus
cgagtaccaggaccttatgaacgtc

SEQ ID NO: 361023 - DNA, 25 bp, Mus musculus
cgagtaccaggagcttatgaacgtc

SEQ ID NO: 361024 - DNA, 25 bp, Mus musculus
cgagtactacaaatgcgccagcatc

SEQ ID NO: 361025 - DNA, 25 bp, Mus musculus
cgagtactacaattgcgccagcatc

SEQ ID NO: 361026 - DNA, 25 bp, Mus musculus
cgagtagtgcgtattccgtgaatgt

SEQ ID NO: 361027 - DNA, 25 bp, Mus musculus
cgagtagtgcgttttccgtgaatgt

SEQ ID NO: 361028 - DNA, 25 bp, Mus musculus
cgagtatggttcagtaaccggcgcc

SEQ ID NO: 361029 - DNA, 25 bp, Mus musculus
cgagtatggttctgtaaccggcgcc

SEQ ID NO: 361030 - DNA, 25 bp, Mus musculus
cgagtattaagtcgtatctcctaaa

SEQ ID NO: 361031 - DNA, 25 bp, Mus musculus
cgagtattaagtggtatctcctaaa

SEQ ID NO: 361032 - DNA, 25 bp, Mus musculus
cgagtatttcctcagtactttacag

SEQ ID NO: 361033 - DNA, 25 bp, Mus musculus
cgagtatttcctgagtactttacag

SEQ ID NO: 361034 - DNA, 25 bp, Mus musculus
cgagtcaagggacttttcggagcca

SEQ ID NO: 361035 - DNA, 25 bp, Mus musculus
cgagtcaagggagttttcggagcca

SEQ ID NO: 361036 - DNA, 25 bp, Mus musculus
cgagtcacaaaaccgtacctggata

SEQ ID NO: 361037 - DNA, 25 bp, Mus musculus
cgagtcacaaaagcgtacctggata

SEQ ID NO: 361038 - DNA, 25 bp, Mus musculus
cgagtcacactgctaatcgtttagc

SEQ ID NO: 361039 - DNA, 25 bp, Mus musculus
cgagtcacactggtaatcgtttagc

SEQ ID NO: 361040 - DNA, 25 bp, Mus musculus
cgagtcacgtggcattgctaaaaca

SEQ ID NO: 361041 - DNA, 25 bp, Mus musculus
cgagtcacgtgggattgctaaaaca

SEQ ID NO: 361042 - DNA, 25 bp, Mus musculus
cgagtcagaaatcccacgaaggatc

SEQ ID NO: 361043 - DNA, 25 bp, Mus musculus
cgagtcagaaatgccacgaaggatc

SEQ ID NO: 361044 - DNA, 25 bp, Mus musculus
cgagtcagatgaatttattttccga

SEQ ID NO: 361045 - DNA, 25 bp, Mus musculus
cgagtcagatgattttattttccga

SEQ ID NO: 361046 - DNA, 25 bp, Mus musculus
cgagtcagtcgcagggcatccagca

SEQ ID NO: 361047 - DNA, 25 bp, Mus musculus
cgagtcagtcgctgggcatccagca

SEQ ID NO: 361048 - DNA, 25 bp, Mus musculus
cgagtccctgggactacatggtagg

SEQ ID NO: 361049 - DNA, 25 bp, Mus musculus
cgagtccctgggtctacatggtagg

SEQ ID NO: 361050 - DNA, 25 bp, Mus musculus
cgagtcctatctagtggccttaagg

SEQ ID NO: 361051 - DNA, 25 bp, Mus musculus
cgagtcctatcttgtggccttaagg

SEQ ID NO: 361052 - DNA, 25 bp, Mus musculus
cgagtcctggtgatccccatggaaa

SEQ ID NO: 361053 - DNA, 25 bp, Mus musculus
cgagtcctggtgttccccatggaaa

SEQ ID NO: 361054 - DNA, 25 bp, Mus musculus
cgagtcgcagtcatatgatgtgtat

SEQ ID NO: 361055 - DNA, 25 bp, Mus musculus
cgagtcgcagtcttatgatgtgtat

SEQ ID NO: 361056 - DNA, 25 bp, Mus musculus
cgagtcgtcttcagggagtcagagc

SEQ ID NO: 361057 - DNA, 25 bp, Mus musculus
cgagtcgtcttctgggagtcagagc

SEQ ID NO: 361058 - DNA, 25 bp, Mus musculus
cgagtctcaaccagctgatgtttta

SEQ ID NO: 361059 - DNA, 25 bp, Mus musculus
cgagtctcaacctgctgatgtttta

SEQ ID NO: 361060 - DNA, 25 bp, Mus musculus
cgagtctgtgtcactctggtacaga

SEQ ID NO: 361061 - DNA, 25 bp, Mus musculus
cgagtctgtgtctctctggtacaga

SEQ ID NO: 361062 - DNA, 25 bp, Mus musculus
cgagtcttcaagctgctgctgagca

SEQ ID NO: 361063 - DNA, 25 bp, Mus musculus
cgagtcttcaaggtgctgctgagca

SEQ ID NO: 361064 - DNA, 25 bp, Mus musculus
cgagtctttgacaatgacctggact

SEQ ID NO: 361065 - DNA, 25 bp, Mus musculus
cgagtctttgactatgacctggact

SEQ ID NO: 361066 - DNA, 25 bp, Mus musculus
cgagtgaatgtgccagttaaacata

SEQ ID NO: 361067 - DNA, 25 bp, Mus musculus
cgagtgaatgtggcagttaaacata

SEQ ID NO: 361068 - DNA, 25 bp, Mus musculus
cgagtgacacagaatgtaggctgct

SEQ ID NO: 361069 - DNA, 25 bp, Mus musculus
cgagtgacacagtatgtaggctgct

SEQ ID NO: 361070 - DNA, 25 bp, Mus musculus
cgagtgacagccaggcagggacctt

SEQ ID NO: 361071 - DNA, 25 bp, Mus musculus
cgagtgacagcctggcagggacctt

SEQ ID NO: 361072 - DNA, 25 bp, Mus musculus
cgagtgacgagaccccagcagacat

SEQ ID NO: 361073 - DNA, 25 bp, Mus musculus
cgagtgacgagagcccagcagacat

SEQ ID NO: 361074 - DNA, 25 bp, Mus musculus
cgagtgactccgaagatttaccaga

SEQ ID NO: 361075 - DNA, 25 bp, Mus musculus
cgagtgactccgtagatttaccaga

SEQ ID NO: 361076 - DNA, 25 bp, Mus musculus
cgagtgactgctcaagtctctggca

SEQ ID NO: 361077 - DNA, 25 bp, Mus musculus
cgagtgactgctgaagtctctggca

SEQ ID NO: 361078 - DNA, 25 bp, Mus musculus
cgagtgcaaagtccgcccgaaggat

SEQ ID NO: 361079 - DNA, 25 bp, Mus musculus
cgagtgcaaagtgcgcccgaaggat

SEQ ID NO: 361080 - DNA, 25 bp, Mus musculus
cgagtgcccggcaagcagcgattcg

SEQ ID NO: 361081 - DNA, 25 bp, Mus musculus
cgagtgcccggctagcagcgattcg

SEQ ID NO: 361082 - DNA, 25 bp, Mus musculus
cgagtggctgttagcttttctttta

SEQ ID NO: 361083 - DNA, 25 bp, Mus musculus
cgagtggctgtttgcttttctttta

SEQ ID NO: 361084 - DNA, 25 bp, Mus musculus
cgagtgtgccacaatacatgtttat

SEQ ID NO: 361085 - DNA, 25 bp, Mus musculus
cgagtgtgccactatacatgtttat

SEQ ID NO: 361086 - DNA, 25 bp, Mus musculus
cgagtgtttgcacaccaaaggtcaa

SEQ ID NO: 361087 - DNA, 25 bp, Mus musculus
cgagtgtttgcagaccaaaggtcaa

SEQ ID NO: 361088 - DNA, 25 bp, Mus musculus
cgagttaaaactctccaggctctta

SEQ ID NO: 361089 - DNA, 25 bp, Mus musculus
cgagttaaaactgtccaggctctta

SEQ ID NO: 361090 - DNA, 25 bp, Mus musculus
cgagttacaaccatctatcatctaa

SEQ ID NO: 361091 - DNA, 25 bp, Mus musculus
cgagttacaaccttctatcatctaa

SEQ ID NO: 361092 - DNA, 25 bp, Mus musculus
cgagttagagatccttagtacgcct

SEQ ID NO: 361093 - DNA, 25 bp, Mus musculus
cgagttagagatgcttagtacgcct

SEQ ID NO: 361094 - DNA, 25 bp, Mus musculus
cgagttagccgccacgaccgtacat

SEQ ID NO: 361095 - DNA, 25 bp, Mus musculus
cgagttagccgcgacgaccgtacat

SEQ ID NO: 361096 - DNA, 25 bp, Mus musculus
cgagttatcatgattcctcttgcgc

SEQ ID NO: 361097 - DNA, 25 bp, Mus musculus
cgagttatcatgtttcctcttgcgc

SEQ ID NO: 361098 - DNA, 25 bp, Mus musculus
cgagttatgagacctgagctgcaga

SEQ ID NO: 361099 - DNA, 25 bp, Mus musculus
cgagttatgagagctgagctgcaga

SEQ ID NO: 361100 - DNA, 25 bp, Mus musculus
cgagttatgtgaaaattttcttaca

SEQ ID NO: 361101 - DNA, 25 bp, Mus musculus
cgagttatgtgataattttcttaca

SEQ ID NO: 361102 - DNA, 25 bp, Mus musculus
cgagttcaaacccagcaaccacatg

SEQ ID NO: 361103 - DNA, 25 bp, Mus musculus
cgagttcaaaccgagcaaccacatg

SEQ ID NO: 361104 - DNA, 25 bp, Mus musculus
cgagttcaatccacactgctgaaaa

SEQ ID NO: 361105 - DNA, 25 bp, Mus musculus
cgagttcaatcctcactgctgaaaa

SEQ ID NO: 361106 - DNA, 25 bp, Mus musculus
cgagttctatagagtgagcatgtca

SEQ ID NO: 361107 - DNA, 25 bp, Mus musculus
cgagttctatagtgtgagcatgtca

SEQ ID NO: 361108 - DNA, 25 bp, Mus musculus
cgagttctttctaacgagtttgccg

SEQ ID NO: 361109 - DNA, 25 bp, Mus musculus
cgagttctttcttacgagtttgccg

SEQ ID NO: 361110 - DNA, 25 bp, Mus musculus
cgagttggtgcacctggaactgttc

SEQ ID NO: 361111 - DNA, 25 bp, Mus musculus
cgagttggtgcagctggaactgttc

SEQ ID NO: 361112 - DNA, 25 bp, Mus musculus
cgagttgtgtcgacgataggttcga

SEQ ID NO: 361113 - DNA, 25 bp, Mus musculus
cgagttgtgtcgtcgataggttcga

SEQ ID NO: 361114 - DNA, 25 bp, Mus musculus
cgagttgttccgaaggattttacag

SEQ ID NO: 361115 - DNA, 25 bp, Mus musculus
cgagttgttccgtaggattttacag

SEQ ID NO: 361116 - DNA, 25 bp, Mus musculus
cgagtttacagactgcttataggta

SEQ ID NO: 361117 - DNA, 25 bp, Mus musculus
cgagtttacagagtgcttataggta

SEQ ID NO: 361118 - DNA, 25 bp, Mus musculus
cgagtttcagcaccggagtcctgtt

SEQ ID NO: 361119 - DNA, 25 bp, Mus musculus
cgagtttcagcagcggagtcctgtt

SEQ ID NO: 361120 - DNA, 25 bp, Mus musculus
cgagtttctgaaaagctaccgaagg

SEQ ID NO: 361121 - DNA, 25 bp, Mus musculus
cgagtttctgaatagctaccgaagg

SEQ ID NO: 361122 - DNA, 25 bp, Mus musculus
cgagttttcttactgacatgacaat

SEQ ID NO: 361123 - DNA, 25 bp, Mus musculus
cgagttttcttagtgacatgacaat

SEQ ID NO: 361124 - DNA, 25 bp, Mus musculus
cgagttttttggctagattgggcta

SEQ ID NO: 361125 - DNA, 25 bp, Mus musculus
cgagttttttgggtagattgggcta

SEQ ID NO: 361126 - DNA, 25 bp, Mus musculus
cgataaaaagttctatgcaccctat

SEQ ID NO: 361127 - DNA, 25 bp, Mus musculus
cgataaaaagttgtatgcaccctat

SEQ ID NO: 361128 - DNA, 25 bp, Mus musculus
cgataaaggtcaaaaaccgatggag

SEQ ID NO: 361129 - DNA, 25 bp, Mus musculus
cgataaaggtcataaaccgatggag

SEQ ID NO: 361130 - DNA, 25 bp, Mus musculus
cgataacgtctgaatggcctttgca

SEQ ID NO: 361131 - DNA, 25 bp, Mus musculus
cgataacgtctgtatggcctttgca

SEQ ID NO: 361132 - DNA, 25 bp, Mus musculus
cgataactgcagcaccacgcaaagt

SEQ ID NO: 361133 - DNA, 25 bp, Mus musculus
cgataactgcaggaccacgcaaagt

SEQ ID NO: 361134 - DNA, 25 bp, Mus musculus
cgataatgatatccccttccacttt

SEQ ID NO: 361135 - DNA, 25 bp, Mus musculus
cgataatgatatgcccttccacttt

SEQ ID NO: 361136 - DNA, 25 bp, Mus musculus
cgatacaagacacggaagaacaaat

SEQ ID NO: 361137 - DNA, 25 bp, Mus musculus
cgatacaagacagggaagaacaaat

SEQ ID NO: 361138 - DNA, 25 bp, Mus musculus
cgatacagacatcgcctggacctga

SEQ ID NO: 361139 - DNA, 25 bp, Mus musculus
cgatacagacatggcctggacctga

SEQ ID NO: 361140 - DNA, 25 bp, Mus musculus
cgatacccttctcactgaaaacgat

SEQ ID NO: 361141 - DNA, 25 bp, Mus musculus
cgatacccttctgactgaaaacgat

SEQ ID NO: 361142 - DNA, 25 bp, Mus musculus
cgataccttccaccagagttccttg

SEQ ID NO: 361143 - DNA, 25 bp, Mus musculus
cgataccttccagcagagttccttg

SEQ ID NO: 361144 - DNA, 25 bp, Mus musculus
cgatagaggtacacttttccagact

SEQ ID NO: 361145 - DNA, 25 bp, Mus musculus
cgatagaggtactcttttccagact

SEQ ID NO: 361146 - DNA, 25 bp, Mus musculus
cgataggttaccatcacatctttac

SEQ ID NO: 361147 - DNA, 25 bp, Mus musculus
cgataggttaccttcacatctttac

SEQ ID NO: 361148 - DNA, 25 bp, Mus musculus
cgatatccagtcaggctgcaacggt

SEQ ID NO: 361149 - DNA, 25 bp, Mus musculus
cgatatccagtctggctgcaacggt

SEQ ID NO: 361150 - DNA, 25 bp, Mus musculus
cgatatccccaacgacaagtccgag

SEQ ID NO: 361151 - DNA, 25 bp, Mus musculus
cgatatccccaaggacaagtccgag

SEQ ID NO: 361152 - DNA, 25 bp, Mus musculus
cgatatcgacgacggacatttccaa

SEQ ID NO: 361153 - DNA, 25 bp, Mus musculus
cgatatcgacgagggacatttccaa

SEQ ID NO: 361154 - DNA, 25 bp, Mus musculus
cgatatctccctatttagatcctac

SEQ ID NO: 361155 - DNA, 25 bp, Mus musculus
cgatatctccctttttagatcctac

SEQ ID NO: 361156 - DNA, 25 bp, Mus musculus
cgatatgagagtatctgcacagttt

SEQ ID NO: 361157 - DNA, 25 bp, Mus musculus
cgatatgagagtttctgcacagttt

SEQ ID NO: 361158 - DNA, 25 bp, Mus musculus
cgatattctttgagatcatggaggc

SEQ ID NO: 361159 - DNA, 25 bp, Mus musculus
cgatattctttgtgatcatggaggc

SEQ ID NO: 361160 - DNA, 25 bp, Mus musculus
cgatcaaatcacaggcagacattga

SEQ ID NO: 361161 - DNA, 25 bp, Mus musculus
cgatcaaatcactggcagacattga

SEQ ID NO: 361162 - DNA, 25 bp, Mus musculus
cgatcaagtcatcctgccatagttg

SEQ ID NO: 361163 - DNA, 25 bp, Mus musculus
cgatcaagtcatgctgccatagttg

SEQ ID NO: 361164 - DNA, 25 bp, Mus musculus
cgatcacagaacctattgcacctca

SEQ ID NO: 361165 - DNA, 25 bp, Mus musculus
cgatcacagaacgtattgcacctca

SEQ ID NO: 361166 - DNA, 25 bp, Mus musculus
cgatcacagagtctcagtttccttc

SEQ ID NO: 361167 - DNA, 25 bp, Mus musculus
cgatcacagagtgtcagtttccttc

SEQ ID NO: 361168 - DNA, 25 bp, Mus musculus
cgatcacatcggaggctacagactt

SEQ ID NO: 361169 - DNA, 25 bp, Mus musculus
cgatcacatcggtggctacagactt

SEQ ID NO: 361170 - DNA, 25 bp, Mus musculus
cgatcactaggaactccccaggtca

SEQ ID NO: 361171 - DNA, 25 bp, Mus musculus
cgatcactaggatctccccaggtca

SEQ ID NO: 361172 - DNA, 25 bp, Mus musculus
cgatcagaggatccggagctacctt

SEQ ID NO: 361173 - DNA, 25 bp, Mus musculus
cgatcagaggatgcggagctacctt

SEQ ID NO: 361174 - DNA, 25 bp, Mus musculus
cgatcagataccctcgtagttccga

SEQ ID NO: 361175 - DNA, 25 bp, Mus musculus
cgatcagataccgtcgtagttccga

SEQ ID NO: 361176 - DNA, 25 bp, Mus musculus
cgatcagtgcggatggctggttcca

SEQ ID NO: 361177 - DNA, 25 bp, Mus musculus
cgatcagtgcggttggctggttcca

SEQ ID NO: 361178 - DNA, 25 bp, Mus musculus
cgatcagttccaacatcagctcaag

SEQ ID NO: 361179 - DNA, 25 bp, Mus musculus
cgatcagttccatcatcagctcaag

SEQ ID NO: 361180 - DNA, 25 bp, Mus musculus
cgatcatgttggaaactggcccaga

SEQ ID NO: 361181 - DNA, 25 bp, Mus musculus
cgatcatgttggtaactggcccaga

SEQ ID NO: 361182 - DNA, 25 bp, Mus musculus
cgatcattctccactttacagatgt

SEQ ID NO: 361183 - DNA, 25 bp, Mus musculus
cgatcattctcctctttacagatgt

SEQ ID NO: 361184 - DNA, 25 bp, Mus musculus
cgatccacaccaaacgtgcatgtaa

SEQ ID NO: 361185 - DNA, 25 bp, Mus musculus
cgatccacaccatacgtgcatgtaa

SEQ ID NO: 361186 - DNA, 25 bp, Mus musculus
cgatccctttggatcctggaagaga

SEQ ID NO: 361187 - DNA, 25 bp, Mus musculus
cgatccctttggttcctggaagaga

SEQ ID NO: 361188 - DNA, 25 bp, Mus musculus
cgatccggacgaaggacagggtctt

SEQ ID NO: 361189 - DNA, 25 bp, Mus musculus
cgatccggacgatggacagggtctt

SEQ ID NO: 361190 - DNA, 25 bp, Mus musculus
cgatccggttatctggctgagctca

SEQ ID NO: 361191 - DNA, 25 bp, Mus musculus
cgatccggttatgtggctgagctca

SEQ ID NO: 361192 - DNA, 25 bp, Mus musculus
cgatcctaaggtacttccttccaat

SEQ ID NO: 361193 - DNA, 25 bp, Mus musculus
cgatcctaaggttcttccttccaat

SEQ ID NO: 361194 - DNA, 25 bp, Mus musculus
cgatcctcgtcacgtgcaggtcagc

SEQ ID NO: 361195 - DNA, 25 bp, Mus musculus
cgatcctcgtcaggtgcaggtcagc

SEQ ID NO: 361196 - DNA, 25 bp, Mus musculus
cgatcctgcagtaagctgactgttt

SEQ ID NO: 361197 - DNA, 25 bp, Mus musculus
cgatcctgcagttagctgactgttt

SEQ ID NO: 361198 - DNA, 25 bp, Mus musculus
cgatcctgcgacaagtatcatcaca

SEQ ID NO: 361199 - DNA, 25 bp, Mus musculus
cgatcctgcgactagtatcatcaca

SEQ ID NO: 361200 - DNA, 25 bp, Mus musculus
cgatcctggcctccttgaacaatgg

SEQ ID NO: 361201 - DNA, 25 bp, Mus musculus
cgatcctggcctgcttgaacaatgg

SEQ ID NO: 361202 - DNA, 25 bp, Mus musculus
cgatccttctcaccagtgtgtttta

SEQ ID NO: 361203 - DNA, 25 bp, Mus musculus
cgatccttctcagcagtgtgtttta

SEQ ID NO: 361204 - DNA, 25 bp, Mus musculus
cgatcctttgggaggacatctctga

SEQ ID NO: 361205 - DNA, 25 bp, Mus musculus
cgatcctttgggtggacatctctga

SEQ ID NO: 361206 - DNA, 25 bp, Mus musculus
cgatcgaaacgtacaggcagcagca

SEQ ID NO: 361207 - DNA, 25 bp, Mus musculus
cgatcgaaacgttcaggcagcagca

SEQ ID NO: 361208 - DNA, 25 bp, Mus musculus
cgatcgagtgttatggcgttaggat

SEQ ID NO: 361209 - DNA, 25 bp, Mus musculus
cgatcgagtgttttggcgttaggat

SEQ ID NO: 361210 - DNA, 25 bp, Mus musculus
cgatcgatacagcattgggtgacaa

SEQ ID NO: 361211 - DNA, 25 bp, Mus musculus
cgatcgatacaggattgggtgacaa

SEQ ID NO: 361212 - DNA, 25 bp, Mus musculus
cgatcgcaagcaatcactcattcat

SEQ ID NO: 361213 - DNA, 25 bp, Mus musculus
cgatcgcaagcacagtggctacggt

SEQ ID NO: 361214 - DNA, 25 bp, Mus musculus
cgatcgcaagcagagtggctacggt

SEQ ID NO: 361215 - DNA, 25 bp, Mus musculus
cgatcgcaagcattcactcattcat

SEQ ID NO: 361216 - DNA, 25 bp, Mus musculus
cgatcgctcgggattgtgttaagtt

SEQ ID NO: 361217 - DNA, 25 bp, Mus musculus
cgatcgctcgggtttgtgttaagtt

SEQ ID NO: 361218 - DNA, 25 bp, Mus musculus
cgatctcaggtcaaacactcaggtt

SEQ ID NO: 361219 - DNA, 25 bp, Mus musculus
cgatctcaggtctaacactcaggtt

SEQ ID NO: 361220 - DNA, 25 bp, Mus musculus
cgatctcgatctagggacagacact

SEQ ID NO: 361221 - DNA, 25 bp, Mus musculus
cgatctcgatcttgggacagacact

SEQ ID NO: 361222 - DNA, 25 bp, Mus musculus
cgatctctagccagagtgtggcagg

SEQ ID NO: 361223 - DNA, 25 bp, Mus musculus
cgatctctagcctgagtgtggcagg

SEQ ID NO: 361224 - DNA, 25 bp, Mus musculus
cgatctctggacatgtatacttctt

SEQ ID NO: 361225 - DNA, 25 bp, Mus musculus
cgatctctggacttgtatacttctt

SEQ ID NO: 361226 - DNA, 25 bp, Mus musculus
cgatctgcgcataggtcggcaacag

SEQ ID NO: 361227 - DNA, 25 bp, Mus musculus
cgatctgcgcattggtcggcaacag

SEQ ID NO: 361228 - DNA, 25 bp, Mus musculus
cgatctgcgggtagcgcccatgcag

SEQ ID NO: 361229 - DNA, 25 bp, Mus musculus
cgatctgcgggttgcgcccatgcag

SEQ ID NO: 361230 - DNA, 25 bp, Mus musculus
cgatctgctgcacactgacctttaa

SEQ ID NO: 361231 - DNA, 25 bp, Mus musculus
cgatctgctgcagactgacctttaa

SEQ ID NO: 361232 - DNA, 25 bp, Mus musculus
cgatctggagacagtgctagcctct

SEQ ID NO: 361233 - DNA, 25 bp, Mus musculus
cgatctggagactgtgctagcctct

SEQ ID NO: 361234 - DNA, 25 bp, Mus musculus
cgatctgggagacgagtggtgggag

SEQ ID NO: 361235 - DNA, 25 bp, Mus musculus
cgatctgggagaggagtggtgggag

SEQ ID NO: 361236 - DNA, 25 bp, Mus musculus
cgatctgtatgtcttggtcccttgt

SEQ ID NO: 361237 - DNA, 25 bp, Mus musculus
cgatctgtatgtgttggtcccttgt

SEQ ID NO: 361238 - DNA, 25 bp, Mus musculus
cgatctgttgttatgtaatgcttga

SEQ ID NO: 361239 - DNA, 25 bp, Mus musculus
cgatctgttgttttgtaatgcttga

SEQ ID NO: 361240 - DNA, 25 bp, Mus musculus
cgatcttgatgtcttagcctttaat

SEQ ID NO: 361241 - DNA, 25 bp, Mus musculus
cgatcttgatgtgttagcctttaat

SEQ ID NO: 361242 - DNA, 25 bp, Mus musculus
cgatcttgtgacaccggagtctgag

SEQ ID NO: 361243 - DNA, 25 bp, Mus musculus
cgatcttgtgactccggagtctgag

SEQ ID NO: 361244 - DNA, 25 bp, Mus musculus
cgatctttgtcaaatcacttccttc

SEQ ID NO: 361245 - DNA, 25 bp, Mus musculus
cgatctttgtcatatcacttccttc

SEQ ID NO: 361246 - DNA, 25 bp, Mus musculus
cgatcttttggacccgcagttatca

SEQ ID NO: 361247 - DNA, 25 bp, Mus musculus
cgatcttttggagccgcagttatca

SEQ ID NO: 361248 - DNA, 25 bp, Mus musculus
cgatgaactcttatgctgggtggtg

SEQ ID NO: 361249 - DNA, 25 bp, Mus musculus
cgatgaactcttttgctgggtggtg

SEQ ID NO: 361250 - DNA, 25 bp, Mus musculus
cgatgacaacaaccctgctttgaga

SEQ ID NO: 361251 - DNA, 25 bp, Mus musculus
cgatgacaacaagcctgctttgaga

SEQ ID NO: 361252 - DNA, 25 bp, Mus musculus
cgatgacaccatcggcgacttgaag

SEQ ID NO: 361253 - DNA, 25 bp, Mus musculus
cgatgacaccatgggcgacttgaag

SEQ ID NO: 361254 - DNA, 25 bp, Mus musculus
cgatgacattgtcctgtgccggtac

SEQ ID NO: 361255 - DNA, 25 bp, Mus musculus
cgatgacattgtgctgtgccggtac

SEQ ID NO: 361256 - DNA, 25 bp, Mus musculus
cgatgacattttccaggttcaatat

SEQ ID NO: 361257 - DNA, 25 bp, Mus musculus
cgatgacattttgcaggttcaatat

SEQ ID NO: 361258 - DNA, 25 bp, Mus musculus
cgatgacctcaaacagtttactgtt

SEQ ID NO: 361259 - DNA, 25 bp, Mus musculus
cgatgacctcaatcagtttactgtt

SEQ ID NO: 361260 - DNA, 25 bp, Mus musculus
cgatgacctggtacagtctgtccta

SEQ ID NO: 361261 - DNA, 25 bp, Mus musculus
cgatgacctggttcagtctgtccta

SEQ ID NO: 361262 - DNA, 25 bp, Mus musculus
cgatgacgtggcaatcgtgggccac

SEQ ID NO: 361263 - DNA, 25 bp, Mus musculus
cgatgacgtggctatcgtgggccac

SEQ ID NO: 361264 - DNA, 25 bp, Mus musculus
cgatgactggctcggcgtcccacag

SEQ ID NO: 361265 - DNA, 25 bp, Mus musculus
cgatgactggctgggcgtcccacag

SEQ ID NO: 361266 - DNA, 25 bp, Mus musculus
cgatgactgtccctgtgtgcaagat

SEQ ID NO: 361267 - DNA, 25 bp, Mus musculus
cgatgactgtccgtgtgtgcaagat

SEQ ID NO: 361268 - DNA, 25 bp, Mus musculus
cgatgacttccgcatcttctgcggg

SEQ ID NO: 361269 - DNA, 25 bp, Mus musculus
cgatgacttccggatcttctgcggg

SEQ ID NO: 361270 - DNA, 25 bp, Mus musculus
cgatgacttcgaagagtgcttgctt

SEQ ID NO: 361271 - DNA, 25 bp, Mus musculus
cgatgacttcgatgagtgcttgctt

SEQ ID NO: 361272 - DNA, 25 bp, Mus musculus
cgatgagcaaatcccttcctgtgtg

SEQ ID NO: 361273 - DNA, 25 bp, Mus musculus
cgatgagcaaatgccttcctgtgtg

SEQ ID NO: 361274 - DNA, 25 bp, Mus musculus
cgatgagcttccattgagtgcaaca

SEQ ID NO: 361275 - DNA, 25 bp, Mus musculus
cgatgagcttcctttgagtgcaaca

SEQ ID NO: 361276 - DNA, 25 bp, Mus musculus
cgatgaggccgtctgtttctgtaac

SEQ ID NO: 361277 - DNA, 25 bp, Mus musculus
cgatgaggccgtgtgtttctgtaac

SEQ ID NO: 361278 - DNA, 25 bp, Mus musculus
cgatgaggttggcttcaatgctgat

SEQ ID NO: 361279 - DNA, 25 bp, Mus musculus
cgatgaggttgggttcaatgctgat

SEQ ID NO: 361280 - DNA, 25 bp, Mus musculus
cgatgagtacgaagaccccgcggtt

SEQ ID NO: 361281 - DNA, 25 bp, Mus musculus
cgatgagtacgatgaccccgcggtt

SEQ ID NO: 361282 - DNA, 25 bp, Mus musculus
cgatgagtcgttattcagtctatag

SEQ ID NO: 361283 - DNA, 25 bp, Mus musculus
cgatgagtcgtttttcagtctatag

SEQ ID NO: 361284 - DNA, 25 bp, Mus musculus
cgatgataagccagactactcctac

SEQ ID NO: 361285 - DNA, 25 bp, Mus musculus
cgatgataagcctgactactcctac

SEQ ID NO: 361286 - DNA, 25 bp, Mus musculus
cgatgatacaggactctagcaggag

SEQ ID NO: 361287 - DNA, 25 bp, Mus musculus
cgatgatacaggtctctagcaggag

SEQ ID NO: 361288 - DNA, 25 bp, Mus musculus
cgatgatgacgacgacaggcttgtc

SEQ ID NO: 361289 - DNA, 25 bp, Mus musculus
cgatgatgacgaggacaggcttgtc

SEQ ID NO: 361290 - DNA, 25 bp, Mus musculus
cgatgatgctccacactgtgtatgg

SEQ ID NO: 361291 - DNA, 25 bp, Mus musculus
cgatgatgctcctcactgtgtatgg

SEQ ID NO: 361292 - DNA, 25 bp, Mus musculus
cgatgatggtttaccgtccctgtat

SEQ ID NO: 361293 - DNA, 25 bp, Mus musculus
cgatgatggttttccgtccctgtat

SEQ ID NO: 361294 - DNA, 25 bp, Mus musculus
cgatgatgtgaacgcagaccccggt

SEQ ID NO: 361295 - DNA, 25 bp, Mus musculus
cgatgatgtgaaggcagaccccggt

SEQ ID NO: 361296 - DNA, 25 bp, Mus musculus
cgatgattgacaccggaagcgacga

SEQ ID NO: 361297 - DNA, 25 bp, Mus musculus
cgatgattgacagcggaagcgacga

SEQ ID NO: 361298 - DNA, 25 bp, Mus musculus
cgatgcaaaaaaccggggctacctg

SEQ ID NO: 361299 - DNA, 25 bp, Mus musculus
cgatgcaaaaaagcggggctacctg

SEQ ID NO: 361300 - DNA, 25 bp, Mus musculus
cgatgcagtgccatggtgtgtgaca

SEQ ID NO: 361301 - DNA, 25 bp, Mus musculus
cgatgcagtgccttggtgtgtgaca

SEQ ID NO: 361302 - DNA, 25 bp, Mus musculus
cgatgcagttctcggcgttctccac

SEQ ID NO: 361303 - DNA, 25 bp, Mus musculus
cgatgcagttctgggcgttctccac

SEQ ID NO: 361304 - DNA, 25 bp, Mus musculus
cgatgcatcttacctttttcaacaa

SEQ ID NO: 361305 - DNA, 25 bp, Mus musculus
cgatgcatcttagctttttcaacaa

SEQ ID NO: 361306 - DNA, 25 bp, Mus musculus
cgatgccaattcacggaagcaagaa

SEQ ID NO: 361307 - DNA, 25 bp, Mus musculus
cgatgccaattctcggaagcaagaa

SEQ ID NO: 361308 - DNA, 25 bp, Mus musculus
cgatgccagcccctaggtgccggga

SEQ ID NO: 361309 - DNA, 25 bp, Mus musculus
cgatgccagcccgtaggtgccggga

SEQ ID NO: 361310 - DNA, 25 bp, Mus musculus
cgatgccccaacagtggaacccatt

SEQ ID NO: 361311 - DNA, 25 bp, Mus musculus
cgatgccccaactgtggaacccatt

SEQ ID NO: 361312 - DNA, 25 bp, Mus musculus
cgatgcctcagcctagggatcttaa

SEQ ID NO: 361313 - DNA, 25 bp, Mus musculus
cgatgcctcagcgtagggatcttaa

SEQ ID NO: 361314 - DNA, 25 bp, Mus musculus
cgatgcctctgtcgaagctgcagaa

SEQ ID NO: 361315 - DNA, 25 bp, Mus musculus
cgatgcctctgtggaagctgcagaa

SEQ ID NO: 361316 - DNA, 25 bp, Mus musculus
cgatgcctgcggacgcgcgagaacc

SEQ ID NO: 361317 - DNA, 25 bp, Mus musculus
cgatgcctgcggtcgcgcgagaacc

SEQ ID NO: 361318 - DNA, 25 bp, Mus musculus
cgatgcctgtggagaaggcgacccc

SEQ ID NO: 361319 - DNA, 25 bp, Mus musculus
cgatgcctgtggtgaaggcgacccc

SEQ ID NO: 361320 - DNA, 25 bp, Mus musculus
cgatgcctttttaacagccaggaaa

SEQ ID NO: 361321 - DNA, 25 bp, Mus musculus
cgatgccttttttacagccaggaaa

SEQ ID NO: 361322 - DNA, 25 bp, Mus musculus
cgatgcgatcgccaaaagacatttt

SEQ ID NO: 361323 - DNA, 25 bp, Mus musculus
cgatgcgatcgcgaaaagacatttt

SEQ ID NO: 361324 - DNA, 25 bp, Mus musculus
cgatgcggcggccttattcccatga

SEQ ID NO: 361325 - DNA, 25 bp, Mus musculus
cgatgcggcggcgttattcccatga

SEQ ID NO: 361326 - DNA, 25 bp, Mus musculus
cgatgcgttgtaaaggtggctgcca

SEQ ID NO: 361327 - DNA, 25 bp, Mus musculus
cgatgcgttgtataggtggctgcca

SEQ ID NO: 361328 - DNA, 25 bp, Mus musculus
cgatgctaattacggctaggatgcc

SEQ ID NO: 361329 - DNA, 25 bp, Mus musculus
cgatgctaattagggctaggatgcc

SEQ ID NO: 361330 - DNA, 25 bp, Mus musculus
cgatgctatcatctccataggaggt

SEQ ID NO: 361331 - DNA, 25 bp, Mus musculus
cgatgctatcatgtccataggaggt

SEQ ID NO: 361332 - DNA, 25 bp, Mus musculus
cgatgctgagtacgccacgtggaac

SEQ ID NO: 361333 - DNA, 25 bp, Mus musculus
cgatgctgagtaggccacgtggaac

SEQ ID NO: 361334 - DNA, 25 bp, Mus musculus
cgatgctgccctcaccagtgtgcag

SEQ ID NO: 361335 - DNA, 25 bp, Mus musculus
cgatgctgccctgaccagtgtgcag

SEQ ID NO: 361336 - DNA, 25 bp, Mus musculus
cgatgctgctgtcggtcacacaagc

SEQ ID NO: 361337 - DNA, 25 bp, Mus musculus
cgatgctgctgtgggtcacacaagc

SEQ ID NO: 361338 - DNA, 25 bp, Mus musculus
cgatgctggtcaacacagcttcagc

SEQ ID NO: 361339 - DNA, 25 bp, Mus musculus
cgatgctggtcatcacagcttcagc

SEQ ID NO: 361340 - DNA, 25 bp, Mus musculus
cgatgcttagcgcttataagcacta

SEQ ID NO: 361341 - DNA, 25 bp, Mus musculus
cgatgcttagcggttataagcacta

SEQ ID NO: 361342 - DNA, 25 bp, Mus musculus
cgatgcttccggatctgagtacaaa

SEQ ID NO: 361343 - DNA, 25 bp, Mus musculus
cgatgcttccggttctgagtacaaa

SEQ ID NO: 361344 - DNA, 25 bp, Mus musculus
cgatgcttccttctttactggacat

SEQ ID NO: 361345 - DNA, 25 bp, Mus musculus
cgatgcttccttgtttactggacat

SEQ ID NO: 361346 - DNA, 25 bp, Mus musculus
cgatggagaacactttgtccggtgt

SEQ ID NO: 361347 - DNA, 25 bp, Mus musculus
cgatggagaacagtttgtccggtgt

SEQ ID NO: 361348 - DNA, 25 bp, Mus musculus
cgatggagccgtcgtaaccgatgct

SEQ ID NO: 361349 - DNA, 25 bp, Mus musculus
cgatggagccgtggtaaccgatgct

SEQ ID NO: 361350 - DNA, 25 bp, Mus musculus
cgatggagtcgaagtgtgctttttt

SEQ ID NO: 361351 - DNA, 25 bp, Mus musculus
cgatggagtcgatgtgtgctttttt

SEQ ID NO: 361352 - DNA, 25 bp, Mus musculus
cgatggattgttcccaaccttagta

SEQ ID NO: 361353 - DNA, 25 bp, Mus musculus
cgatggattgttgccaaccttagta

SEQ ID NO: 361354 - DNA, 25 bp, Mus musculus
cgatggcatcgtcgccgactgacag

SEQ ID NO: 361355 - DNA, 25 bp, Mus musculus
cgatggcatcgtggccgactgacag

SEQ ID NO: 361356 - DNA, 25 bp, Mus musculus
cgatggcgacccagcagcgaagaga

SEQ ID NO: 361357 - DNA, 25 bp, Mus musculus
cgatggcgaccctgcagcgaagaga

SEQ ID NO: 361358 - DNA, 25 bp, Mus musculus
cgatgggctgcaatttgccatggca

SEQ ID NO: 361359 - DNA, 25 bp, Mus musculus
cgatgggctgcattttgccatggca

SEQ ID NO: 361360 - DNA, 25 bp, Mus musculus
cgatgggtgcctagcagcagagacc

SEQ ID NO: 361361 - DNA, 25 bp, Mus musculus
cgatgggtgccttgcagcagagacc

SEQ ID NO: 361362 - DNA, 25 bp, Mus musculus
cgatggtagggacaggttcctctct

SEQ ID NO: 361363 - DNA, 25 bp, Mus musculus
cgatggtagggagaggttcctctct

SEQ ID NO: 361364 - DNA, 25 bp, Mus musculus
cgatggtatccaccgtttagaaaga

SEQ ID NO: 361365 - DNA, 25 bp, Mus musculus
cgatggtatccagcgtttagaaaga

SEQ ID NO: 361366 - DNA, 25 bp, Mus musculus
cgatggtgcggtagctacggaaaca

SEQ ID NO: 361367 - DNA, 25 bp, Mus musculus
cgatggtgcggttgctacggaaaca

SEQ ID NO: 361368 - DNA, 25 bp, Mus musculus
cgatggttatttccaggagctgctg

SEQ ID NO: 361369 - DNA, 25 bp, Mus musculus
cgatggttatttgcaggagctgctg

SEQ ID NO: 361370 - DNA, 25 bp, Mus musculus
cgatgtaagagaccccgggccccag

SEQ ID NO: 361371 - DNA, 25 bp, Mus musculus
cgatgtaagagagcccgggccccag

SEQ ID NO: 361372 - DNA, 25 bp, Mus musculus
cgatgtcatactccagacttaaaat

SEQ ID NO: 361373 - DNA, 25 bp, Mus musculus
cgatgtcatactgcagacttaaaat

SEQ ID NO: 361374 - DNA, 25 bp, Mus musculus
cgatgtcatcgtcggcctggcgatc

SEQ ID NO: 361375 - DNA, 25 bp, Mus musculus
cgatgtcatcgtgggcctggcgatc

SEQ ID NO: 361376 - DNA, 25 bp, Mus musculus
cgatgtccacgcattctgaagtaag

SEQ ID NO: 361377 - DNA, 25 bp, Mus musculus
cgatgtccacgctttctgaagtaag

SEQ ID NO: 361378 - DNA, 25 bp, Mus musculus
cgatgtcctcaacgctgtgggcttc

SEQ ID NO: 361379 - DNA, 25 bp, Mus musculus
cgatgtcctcaaggctgtgggcttc

SEQ ID NO: 361380 - DNA, 25 bp, Mus musculus
cgatgtcgtcggactcactttgtct

SEQ ID NO: 361381 - DNA, 25 bp, Mus musculus
cgatgtcgtcggtctcactttgtct

SEQ ID NO: 361382 - DNA, 25 bp, Mus musculus
cgatgtctgcatcccaggtttttgg

SEQ ID NO: 361383 - DNA, 25 bp, Mus musculus
cgatgtctgcatgccaggtttttgg

SEQ ID NO: 361384 - DNA, 25 bp, Mus musculus
cgatgtcttcatagtgccgtccgag

SEQ ID NO: 361385 - DNA, 25 bp, Mus musculus
cgatgtcttcattgtgccgtccgag

SEQ ID NO: 361386 - DNA, 25 bp, Mus musculus
cgatgtcttcgtaaggtcctgaatt

SEQ ID NO: 361387 - DNA, 25 bp, Mus musculus
cgatgtcttcgttaggtcctgaatt

SEQ ID NO: 361388 - DNA, 25 bp, Mus musculus
cgatgtgaaactcaaggtcaataaa

SEQ ID NO: 361389 - DNA, 25 bp, Mus musculus
cgatgtgaaactgaaggtcaataaa

SEQ ID NO: 361390 - DNA, 25 bp, Mus musculus
cgatgtgactggagcaggaccctca

SEQ ID NO: 361391 - DNA, 25 bp, Mus musculus
cgatgtgactggtgcaggaccctca

SEQ ID NO: 361392 - DNA, 25 bp, Mus musculus
cgatgtgatggaccggcttagctac

SEQ ID NO: 361393 - DNA, 25 bp, Mus musculus
cgatgtgatggagcggcttagctac

SEQ ID NO: 361394 - DNA, 25 bp, Mus musculus
cgatgtgattcaccggtcttctaat

SEQ ID NO: 361395 - DNA, 25 bp, Mus musculus
cgatgtgattcagcggtcttctaat

SEQ ID NO: 361396 - DNA, 25 bp, Mus musculus
cgatgtgggcacatgctcttagtat

SEQ ID NO: 361397 - DNA, 25 bp, Mus musculus
cgatgtgggcacttgctcttagtat

SEQ ID NO: 361398 - DNA, 25 bp, Mus musculus
cgatgtgggcagactctctgcattt

SEQ ID NO: 361399 - DNA, 25 bp, Mus musculus
cgatgtgggcagtctctctgcattt

SEQ ID NO: 361400 - DNA, 25 bp, Mus musculus
cgatgtgtaacaccttgggaggtat

SEQ ID NO: 361401 - DNA, 25 bp, Mus musculus
cgatgtgtaacagcttgggaggtat

SEQ ID NO: 361402 - DNA, 25 bp, Mus musculus
cgatgttcaaagagcccagattcct

SEQ ID NO: 361403 - DNA, 25 bp, Mus musculus
cgatgttcaaagtgcccagattcct

SEQ ID NO: 361404 - DNA, 25 bp, Mus musculus
cgatgttctgatccgtctctgtgtg

SEQ ID NO: 361405 - DNA, 25 bp, Mus musculus
cgatgttctgatgcgtctctgtgtg

SEQ ID NO: 361406 - DNA, 25 bp, Mus musculus
cgatgtttacggagcttcagccaaa

SEQ ID NO: 361407 - DNA, 25 bp, Mus musculus
cgatgtttacggtgcttcagccaaa

SEQ ID NO: 361408 - DNA, 25 bp, Mus musculus
cgattaagtggtacccacacacaag

SEQ ID NO: 361409 - DNA, 25 bp, Mus musculus
cgattaagtggttcccacacacaag

SEQ ID NO: 361410 - DNA, 25 bp, Mus musculus
cgattatcagtaacagaattcctcc

SEQ ID NO: 361411 - DNA, 25 bp, Mus musculus
cgattatcagtatcagaattcctcc

SEQ ID NO: 361412 - DNA, 25 bp, Mus musculus
cgattatccctgatgtgttttagct

SEQ ID NO: 361413 - DNA, 25 bp, Mus musculus
cgattatccctgttgtgttttagct

SEQ ID NO: 361414 - DNA, 25 bp, Mus musculus
cgattattgaggaggtgacacctga

SEQ ID NO: 361415 - DNA, 25 bp, Mus musculus
cgattattgaggtggtgacacctga

SEQ ID NO: 361416 - DNA, 25 bp, Mus musculus
cgattattgctacccacaatttgac

SEQ ID NO: 361417 - DNA, 25 bp, Mus musculus
cgattattgctagccacaatttgac

SEQ ID NO: 361418 - DNA, 25 bp, Mus musculus
cgattattgtagaacacctgagctg

SEQ ID NO: 361419 - DNA, 25 bp, Mus musculus
cgattattgtagtacacctgagctg

SEQ ID NO: 361420 - DNA, 25 bp, Mus musculus
cgattcacgcttcctgttatgtata

SEQ ID NO: 361421 - DNA, 25 bp, Mus musculus
cgattcacgcttgctgttatgtata

SEQ ID NO: 361422 - DNA, 25 bp, Mus musculus
cgattcactgaaatactgggagaga

SEQ ID NO: 361423 - DNA, 25 bp, Mus musculus
cgattcactgaattactgggagaga

SEQ ID NO: 361424 - DNA, 25 bp, Mus musculus
cgattcagaagaagatcatggacca

SEQ ID NO: 361425 - DNA, 25 bp, Mus musculus
cgattcagaagatgatcatggacca

SEQ ID NO: 361426 - DNA, 25 bp, Mus musculus
cgattccaggttattgtctctgaga

SEQ ID NO: 361427 - DNA, 25 bp, Mus musculus
cgattccaggtttttgtctctgaga

SEQ ID NO: 361428 - DNA, 25 bp, Mus musculus
cgattccccactcctttagagaagg

SEQ ID NO: 361429 - DNA, 25 bp, Mus musculus
cgattccccactgctttagagaagg

SEQ ID NO: 361430 - DNA, 25 bp, Mus musculus
cgattcctaacaaatttctgtcttt

SEQ ID NO: 361431 - DNA, 25 bp, Mus musculus
cgattcctaacatatttctgtcttt

SEQ ID NO: 361432 - DNA, 25 bp, Mus musculus
cgattcctacttcgcttaaacctag

SEQ ID NO: 361433 - DNA, 25 bp, Mus musculus
cgattcctacttggcttaaacctag

SEQ ID NO: 361434 - DNA, 25 bp, Mus musculus
cgattccttcttacagcatgcagaa

SEQ ID NO: 361435 - DNA, 25 bp, Mus musculus
cgattccttctttcagcatgcagaa

SEQ ID NO: 361436 - DNA, 25 bp, Mus musculus
cgattcggcctaaattgatttgtat

SEQ ID NO: 361437 - DNA, 25 bp, Mus musculus
cgattcggcctatattgatttgtat

SEQ ID NO: 361438 - DNA, 25 bp, Mus musculus
cgattctgggacagctcacaagaca

SEQ ID NO: 361439 - DNA, 25 bp, Mus musculus
cgattctgggactgctcacaagaca

SEQ ID NO: 361440 - DNA, 25 bp, Mus musculus
cgattctgttaaacgaacgtcttca

SEQ ID NO: 361441 - DNA, 25 bp, Mus musculus
cgattctgttaatcgaacgtcttca

SEQ ID NO: 361442 - DNA, 25 bp, Mus musculus
cgattgaacggcagcgggacaagaa

SEQ ID NO: 361443 - DNA, 25 bp, Mus musculus
cgattgaacggctgcgggacaagaa

SEQ ID NO: 361444 - DNA, 25 bp, Mus musculus
cgattgacaggaaagagatggccat

SEQ ID NO: 361445 - DNA, 25 bp, Mus musculus
cgattgacaggatagagatggccat

SEQ ID NO: 361446 - DNA, 25 bp, Mus musculus
cgattgagctgtactttagggtgca

SEQ ID NO: 361447 - DNA, 25 bp, Mus musculus
cgattgagctgttctttagggtgca

SEQ ID NO: 361448 - DNA, 25 bp, Mus musculus
cgattgcagtacatggcctccgaaa

SEQ ID NO: 361449 - DNA, 25 bp, Mus musculus
cgattgcagtacttggcctccgaaa

SEQ ID NO: 361450 - DNA, 25 bp, Mus musculus
cgattgctcatcagttcacctttga

SEQ ID NO: 361451 - DNA, 25 bp, Mus musculus
cgattgctcatctgttcacctttga

SEQ ID NO: 361452 - DNA, 25 bp, Mus musculus
cgattgcttttactagcgtttaaat

SEQ ID NO: 361453 - DNA, 25 bp, Mus musculus
cgattgcttttagtagcgtttaaat

SEQ ID NO: 361454 - DNA, 25 bp, Mus musculus
cgattggctttaattgcttgaagac

SEQ ID NO: 361455 - DNA, 25 bp, Mus musculus
cgattggctttatttgcttgaagac

SEQ ID NO: 361456 - DNA, 25 bp, Mus musculus
cgattgtaattcaccacaggctgca

SEQ ID NO: 361457 - DNA, 25 bp, Mus musculus
cgattgtaattctccacaggctgca

SEQ ID NO: 361458 - DNA, 25 bp, Mus musculus
cgattgtcaatccatgccatcgccg

SEQ ID NO: 361459 - DNA, 25 bp, Mus musculus
cgattgtcaatcgatgccatcgccg

SEQ ID NO: 361460 - DNA, 25 bp, Mus musculus
cgattgtccaaaaaactgcgaagat

SEQ ID NO: 361461 - DNA, 25 bp, Mus musculus
cgattgtccaaataactgcgaagat

SEQ ID NO: 361462 - DNA, 25 bp, Mus musculus
cgattgttactaagttgctatttgt

SEQ ID NO: 361463 - DNA, 25 bp, Mus musculus
cgattgttactatgttgctatttgt

SEQ ID NO: 361464 - DNA, 25 bp, Mus musculus
cgattgtttgaaattcagtttagtt

SEQ ID NO: 361465 - DNA, 25 bp, Mus musculus
cgattgtttgaatttcagtttagtt

SEQ ID NO: 361466 - DNA, 25 bp, Mus musculus
cgatttaaagtaagtgcccgctaga

SEQ ID NO: 361467 - DNA, 25 bp, Mus musculus
cgatttaaagtatgtgcccgctaga

SEQ ID NO: 361468 - DNA, 25 bp, Mus musculus
cgatttaaccctagatcgggctgaa

SEQ ID NO: 361469 - DNA, 25 bp, Mus musculus
cgatttaacccttgatcgggctgaa

SEQ ID NO: 361470 - DNA, 25 bp, Mus musculus
cgatttacaagtacttaaagcacgt

SEQ ID NO: 361471 - DNA, 25 bp, Mus musculus
cgatttacaagttcttaaagcacgt

SEQ ID NO: 361472 - DNA, 25 bp, Mus musculus
cgatttccccatcggcttctaaaat

SEQ ID NO: 361473 - DNA, 25 bp, Mus musculus
cgatttccccatgggcttctaaaat

SEQ ID NO: 361474 - DNA, 25 bp, Mus musculus
cgatttctagttacctgacatgttt

SEQ ID NO: 361475 - DNA, 25 bp, Mus musculus
cgatttctagtttcctgacatgttt

SEQ ID NO: 361476 - DNA, 25 bp, Mus musculus
cgatttcttaccaattggagaacat

SEQ ID NO: 361477 - DNA, 25 bp, Mus musculus
cgatttcttacctattggagaacat

SEQ ID NO: 361478 - DNA, 25 bp, Mus musculus
cgatttgggctgctcactggacctc

SEQ ID NO: 361479 - DNA, 25 bp, Mus musculus
cgatttgggctggtcactggacctc

SEQ ID NO: 361480 - DNA, 25 bp, Mus musculus
cgatttggttgcatgtgataaacat

SEQ ID NO: 361481 - DNA, 25 bp, Mus musculus
cgatttggttgcttgtgataaacat

SEQ ID NO: 361482 - DNA, 25 bp, Mus musculus
cgatttgtatatctgctgttcatta

SEQ ID NO: 361483 - DNA, 25 bp, Mus musculus
cgatttgtatatgtgctgttcatta

SEQ ID NO: 361484 - DNA, 25 bp, Mus musculus
cgattttaaatccagcagcatgttt

SEQ ID NO: 361485 - DNA, 25 bp, Mus musculus
cgattttaaatcgagcagcatgttt

SEQ ID NO: 361486 - DNA, 25 bp, Mus musculus
cgattttaatctccggtttcctgca

SEQ ID NO: 361487 - DNA, 25 bp, Mus musculus
cgattttaatctgcggtttcctgca

SEQ ID NO: 361488 - DNA, 25 bp, Mus musculus
cgattttctctcacatgtacagctg

SEQ ID NO: 361489 - DNA, 25 bp, Mus musculus
cgattttctctctcatgtacagctg

SEQ ID NO: 361490 - DNA, 25 bp, Mus musculus
cgattttgccttcaattcctggtga

SEQ ID NO: 361491 - DNA, 25 bp, Mus musculus
cgattttgccttgaattcctggtga

SEQ ID NO: 361492 - DNA, 25 bp, Mus musculus
cgatttttcatcattcactttggga

SEQ ID NO: 361493 - DNA, 25 bp, Mus musculus
cgatttttcatctttcactttggga

SEQ ID NO: 361494 - DNA, 25 bp, Mus musculus
cgatttttgagtacagggcctgcct

SEQ ID NO: 361495 - DNA, 25 bp, Mus musculus
cgatttttgagttcagggcctgcct

SEQ ID NO: 361496 - DNA, 25 bp, Mus musculus
cgcaaacaacccagagaagaactga

SEQ ID NO: 361497 - DNA, 25 bp, Mus musculus
cgcaaacaaccctgagaagaactga

SEQ ID NO: 361498 - DNA, 25 bp, Mus musculus
cgcaaacgaagcagtcccagcaact

SEQ ID NO: 361499 - DNA, 25 bp, Mus musculus
cgcaaacgaagctgtcccagcaact

SEQ ID NO: 361500 - DNA, 25 bp, Mus musculus
cgcaacaaacctccgtttctatatt

SEQ ID NO: 361501 - DNA, 25 bp, Mus musculus
cgcaacaaacctgcgtttctatatt

SEQ ID NO: 361502 - DNA, 25 bp, Mus musculus
cgcaacacttgcaaattttcatgaa

SEQ ID NO: 361503 - DNA, 25 bp, Mus musculus
cgcaacacttgctaattttcatgaa

SEQ ID NO: 361504 - DNA, 25 bp, Mus musculus
cgcaacagtaaaaccttacaccttc

SEQ ID NO: 361505 - DNA, 25 bp, Mus musculus
cgcaacagtaaatccttacaccttc

SEQ ID NO: 361506 - DNA, 25 bp, Mus musculus
cgcaaccttgcgatgtgaactctga

SEQ ID NO: 361507 - DNA, 25 bp, Mus musculus
cgcaaccttgcgttgtgaactctga

SEQ ID NO: 361508 - DNA, 25 bp, Mus musculus
cgcaacgcatttactgtatgtttat

SEQ ID NO: 361509 - DNA, 25 bp, Mus musculus
cgcaacgcattttctgtatgtttat

SEQ ID NO: 361510 - DNA, 25 bp, Mus musculus
cgcaacgtgcgcactttgtgaaggg

SEQ ID NO: 361511 - DNA, 25 bp, Mus musculus
cgcaacgtgcgctctttgtgaaggg

SEQ ID NO: 361512 - DNA, 25 bp, Mus musculus
cgcaactcatttcacatcgaatgaa

SEQ ID NO: 361513 - DNA, 25 bp, Mus musculus
cgcaactcatttgacatcgaatgaa

SEQ ID NO: 361514 - DNA, 25 bp, Mus musculus
cgcaacttaagtacggctgtctgtt

SEQ ID NO: 361515 - DNA, 25 bp, Mus musculus
cgcaacttaagttcggctgtctgtt

SEQ ID NO: 361516 - DNA, 25 bp, Mus musculus
cgcaacttctgcaatggtggcatta

SEQ ID NO: 361517 - DNA, 25 bp, Mus musculus
cgcaacttctgctatggtggcatta

SEQ ID NO: 361518 - DNA, 25 bp, Mus musculus
cgcaagaagtggagccgaaaacccg

SEQ ID NO: 361519 - DNA, 25 bp, Mus musculus
cgcaagaagtggtgccgaaaacccg

SEQ ID NO: 361520 - DNA, 25 bp, Mus musculus
cgcaagagggcacaccgatagaatc

SEQ ID NO: 361521 - DNA, 25 bp, Mus musculus
cgcaagagggcagaccgatagaatc

SEQ ID NO: 361522 - DNA, 25 bp, Mus musculus
cgcaagcatttacaggagcactcct

SEQ ID NO: 361523 - DNA, 25 bp, Mus musculus
cgcaagcatttagaggagcactcct

SEQ ID NO: 361524 - DNA, 25 bp, Mus musculus
cgcaagccctgtccctatgaacagg

SEQ ID NO: 361525 - DNA, 25 bp, Mus musculus
cgcaagccctgtgcctatgaacagg

SEQ ID NO: 361526 - DNA, 25 bp, Mus musculus
cgcaagcctgctctggaactggaag

SEQ ID NO: 361527 - DNA, 25 bp, Mus musculus
cgcaagcctgctgtggaactggaag

SEQ ID NO: 361528 - DNA, 25 bp, Mus musculus
cgcaagcgtgaacagctgctgaatt

SEQ ID NO: 361529 - DNA, 25 bp, Mus musculus
cgcaagcgtgaagagctgctgaatt

SEQ ID NO: 361530 - DNA, 25 bp, Mus musculus
cgcaagctaaagactcatggcatga

SEQ ID NO: 361531 - DNA, 25 bp, Mus musculus
cgcaagctaaagtctcatggcatga

SEQ ID NO: 361532 - DNA, 25 bp, Mus musculus
cgcaaggaaggtcctacgccttcat

SEQ ID NO: 361533 - DNA, 25 bp, Mus musculus
cgcaaggaaggtgctacgccttcat

SEQ ID NO: 361534 - DNA, 25 bp, Mus musculus
cgcaaggcacccagggattcgtagt

SEQ ID NO: 361535 - DNA, 25 bp, Mus musculus
cgcaaggcaccctgggattcgtagt

SEQ ID NO: 361536 - DNA, 25 bp, Mus musculus
cgcaaggctgagcagaggtttccct

SEQ ID NO: 361537 - DNA, 25 bp, Mus musculus
cgcaaggctgaggagaggtttccct

SEQ ID NO: 361538 - DNA, 25 bp, Mus musculus
cgcaagggaccacatccttttcctg

SEQ ID NO: 361539 - DNA, 25 bp, Mus musculus
cgcaagggaccagatccttttcctg

SEQ ID NO: 361540 - DNA, 25 bp, Mus musculus
cgcaagtgcttcaaggcggactgtt

SEQ ID NO: 361541 - DNA, 25 bp, Mus musculus
cgcaagtgcttctaggcggactgtt

SEQ ID NO: 361542 - DNA, 25 bp, Mus musculus
cgcaagtgtgctccttccaattgca

SEQ ID NO: 361543 - DNA, 25 bp, Mus musculus
cgcaagtgtgctgcttccaattgca

SEQ ID NO: 361544 - DNA, 25 bp, Mus musculus
cgcaataagaatcagctggagggct

SEQ ID NO: 361545 - DNA, 25 bp, Mus musculus
cgcaataagaatgagctggagggct

SEQ ID NO: 361546 - DNA, 25 bp, Mus musculus
cgcaataccttcatcttctcctttt

SEQ ID NO: 361547 - DNA, 25 bp, Mus musculus
cgcaataccttcttcttctcctttt

SEQ ID NO: 361548 - DNA, 25 bp, Mus musculus
cgcaatagcgacccgctggcgttac

SEQ ID NO: 361549 - DNA, 25 bp, Mus musculus
cgcaatagcgacgcgctggcgttac

SEQ ID NO: 361550 - DNA, 25 bp, Mus musculus
cgcaatatctctacctagtaccaaa

SEQ ID NO: 361551 - DNA, 25 bp, Mus musculus
cgcaatatctcttcctagtaccaaa

SEQ ID NO: 361552 - DNA, 25 bp, Mus musculus
cgcaatcaagatctctactctcatg

SEQ ID NO: 361553 - DNA, 25 bp, Mus musculus
cgcaatcaagatgtctactctcatg

SEQ ID NO: 361554 - DNA, 25 bp, Mus musculus
cgcaatcggcatatcaacatttttt

SEQ ID NO: 361555 - DNA, 25 bp, Mus musculus
cgcaatcggcatttcaacatttttt

SEQ ID NO: 361556 - DNA, 25 bp, Mus musculus
cgcaatctcctgaatattttcttaa

SEQ ID NO: 361557 - DNA, 25 bp, Mus musculus
cgcaatctcctgtatattttcttaa

SEQ ID NO: 361558 - DNA, 25 bp, Mus musculus
cgcaatgcccgcacgtaacaggaag

SEQ ID NO: 361559 - DNA, 25 bp, Mus musculus
cgcaatgcccgctcgtaacaggaag

SEQ ID NO: 361560 - DNA, 25 bp, Mus musculus
cgcaatgccggtcacttcagtaata

SEQ ID NO: 361561 - DNA, 25 bp, Mus musculus
cgcaatgccggtgacttcagtaata

SEQ ID NO: 361562 - DNA, 25 bp, Mus musculus
cgcaatgctgccacctttaaggaag

SEQ ID NO: 361563 - DNA, 25 bp, Mus musculus
cgcaatgctgcctcctttaaggaag

SEQ ID NO: 361564 - DNA, 25 bp, Mus musculus
cgcaatgtcactatggaaacagaat

SEQ ID NO: 361565 - DNA, 25 bp, Mus musculus
cgcaatgtcactttggaaacagaat

SEQ ID NO: 361566 - DNA, 25 bp, Mus musculus
cgcaattactacaacgacgtggtta

SEQ ID NO: 361567 - DNA, 25 bp, Mus musculus
cgcaattactactacgacgtggtta

SEQ ID NO: 361568 - DNA, 25 bp, Mus musculus
cgcaatttagagatgcgccccagcg

SEQ ID NO: 361569 - DNA, 25 bp, Mus musculus
cgcaatttagagttgcgccccagcg

SEQ ID NO: 361570 - DNA, 25 bp, Mus musculus
cgcacaatgttcagatgtccctgaa

SEQ ID NO: 361571 - DNA, 25 bp, Mus musculus
cgcacaatgttctgatgtccctgaa

SEQ ID NO: 361572 - DNA, 25 bp, Mus musculus
cgcacacatcctagggcttgtaaaa

SEQ ID NO: 361573 - DNA, 25 bp, Mus musculus
cgcacacatccttgggcttgtaaaa

SEQ ID NO: 361574 - DNA, 25 bp, Mus musculus
cgcacaccgggtagcggctcttgca

SEQ ID NO: 361575 - DNA, 25 bp, Mus musculus
cgcacaccgggttgcggctcttgca

SEQ ID NO: 361576 - DNA, 25 bp, Mus musculus
cgcacactagacatgccatctaacg

SEQ ID NO: 361577 - DNA, 25 bp, Mus musculus
cgcacactagacttgccatctaacg

SEQ ID NO: 361578 - DNA, 25 bp, Mus musculus
cgcacactatgaccaacatgcagat

SEQ ID NO: 361579 - DNA, 25 bp, Mus musculus
cgcacactatgagcaacatgcagat

SEQ ID NO: 361580 - DNA, 25 bp, Mus musculus
cgcacactgcaaacatctctttaaa

SEQ ID NO: 361581 - DNA, 25 bp, Mus musculus
cgcacactgcaatcatctctttaaa

SEQ ID NO: 361582 - DNA, 25 bp, Mus musculus
cgcacacttgttagctgtattttca

SEQ ID NO: 361583 - DNA, 25 bp, Mus musculus
cgcacacttgtttgctgtattttca

SEQ ID NO: 361584 - DNA, 25 bp, Mus musculus
cgcacagcagttcctctttctttga

SEQ ID NO: 361585 - DNA, 25 bp, Mus musculus
cgcacagcagttgctctttctttga

SEQ ID NO: 361586 - DNA, 25 bp, Mus musculus
cgcacagccagacacaatcttttga

SEQ ID NO: 361587 - DNA, 25 bp, Mus musculus
cgcacagccagagacaatcttttga

SEQ ID NO: 361588 - DNA, 25 bp, Mus musculus
cgcacagctgggaactaccatttat

SEQ ID NO: 361589 - DNA, 25 bp, Mus musculus
cgcacagctgggtactaccatttat

SEQ ID NO: 361590 - DNA, 25 bp, Mus musculus
cgcacagtccttcccatggttagaa

SEQ ID NO: 361591 - DNA, 25 bp, Mus musculus
cgcacagtccttgccatggttagaa

SEQ ID NO: 361592 - DNA, 25 bp, Mus musculus
cgcacatccacaagtctctgattgg

SEQ ID NO: 361593 - DNA, 25 bp, Mus musculus
cgcacatccacatgtctctgattgg

SEQ ID NO: 361594 - DNA, 25 bp, Mus musculus
cgcacattgccccactggagaacaa

SEQ ID NO: 361595 - DNA, 25 bp, Mus musculus
cgcacattgcccgactggagaacaa

SEQ ID NO: 361596 - DNA, 25 bp, Mus musculus
cgcaccaccatacctgactaaaaaa

SEQ ID NO: 361597 - DNA, 25 bp, Mus musculus
cgcaccaccatagctgactaaaaaa

SEQ ID NO: 361598 - DNA, 25 bp, Mus musculus
cgcaccagagcccatagaaaggata

SEQ ID NO: 361599 - DNA, 25 bp, Mus musculus
cgcaccagagccgatagaaaggata

SEQ ID NO: 361600 - DNA, 25 bp, Mus musculus
cgcaccatttggactggaatgcttt

SEQ ID NO: 361601 - DNA, 25 bp, Mus musculus
cgcaccatttggtctggaatgcttt

SEQ ID NO: 361602 - DNA, 25 bp, Mus musculus
cgcacccaggacagtctgctgcagg

SEQ ID NO: 361603 - DNA, 25 bp, Mus musculus
cgcacccaggactgtctgctgcagg

SEQ ID NO: 361604 - DNA, 25 bp, Mus musculus
cgcacccgaaaacccaacaagatat

SEQ ID NO: 361605 - DNA, 25 bp, Mus musculus
cgcacccgaaaagccaacaagatat

SEQ ID NO: 361606 - DNA, 25 bp, Mus musculus
cgcaccgaagaactgatcatttcca

SEQ ID NO: 361607 - DNA, 25 bp, Mus musculus
cgcaccgaagaagtgatcatttcca

SEQ ID NO: 361608 - DNA, 25 bp, Mus musculus
cgcaccgaggatcgcttcagtctga

SEQ ID NO: 361609 - DNA, 25 bp, Mus musculus
cgcaccgaggatggcttcagtctga

SEQ ID NO: 361610 - DNA, 25 bp, Mus musculus
cgcaccgtttgtatcctatatacag

SEQ ID NO: 361611 - DNA, 25 bp, Mus musculus
cgcaccgtttgtttcctatatacag

SEQ ID NO: 361612 - DNA, 25 bp, Mus musculus
cgcacctacatccttggcaagttag

SEQ ID NO: 361613 - DNA, 25 bp, Mus musculus
cgcacctacatcgttggcaagttag

SEQ ID NO: 361614 - DNA, 25 bp, Mus musculus
cgcacctcagtcagtcactaagaga

SEQ ID NO: 361615 - DNA, 25 bp, Mus musculus
cgcacctcagtctgtcactaagaga

SEQ ID NO: 361616 - DNA, 25 bp, Mus musculus
cgcaccttcagcaacatcaggaata

SEQ ID NO: 361617 - DNA, 25 bp, Mus musculus
cgcaccttcagctacatcaggaata

SEQ ID NO: 361618 - DNA, 25 bp, Mus musculus
cgcacgacgcgtacagcgagagcga

SEQ ID NO: 361619 - DNA, 25 bp, Mus musculus
cgcacgacgcgttcagcgagagcga

SEQ ID NO: 361620 - DNA, 25 bp, Mus musculus
cgcacgggccgcaggcatccgaaga

SEQ ID NO: 361621 - DNA, 25 bp, Mus musculus
cgcacgggccgctggcatccgaaga

SEQ ID NO: 361622 - DNA, 25 bp, Mus musculus
cgcacggtatatctggagttgctcc

SEQ ID NO: 361623 - DNA, 25 bp, Mus musculus
cgcacggtatatgtggagttgctcc

SEQ ID NO: 361624 - DNA, 25 bp, Mus musculus
cgcacgtgcatacatacctgctgct

SEQ ID NO: 361625 - DNA, 25 bp, Mus musculus
cgcacgtgcatagatacctgctgct

SEQ ID NO: 361626 - DNA, 25 bp, Mus musculus
cgcacgtgtggacctccggagaaac

SEQ ID NO: 361627 - DNA, 25 bp, Mus musculus
cgcacgtgtggagctccggagaaac

SEQ ID NO: 361628 - DNA, 25 bp, Mus musculus
cgcacgtttggtcgcctctagaaat

SEQ ID NO: 361629 - DNA, 25 bp, Mus musculus
cgcacgtttggtggcctctagaaat

SEQ ID NO: 361630 - DNA, 25 bp, Mus musculus
cgcactaagagtagctttctctcgt

SEQ ID NO: 361631 - DNA, 25 bp, Mus musculus
cgcactaagagttgctttctctcgt

SEQ ID NO: 361632 - DNA, 25 bp, Mus musculus
cgcactatcacgacgagacctcaga

SEQ ID NO: 361633 - DNA, 25 bp, Mus musculus
cgcactatcacgtcgagacctcaga

SEQ ID NO: 361634 - DNA, 25 bp, Mus musculus
cgcactatgcacacttcacaatgag

SEQ ID NO: 361635 - DNA, 25 bp, Mus musculus
cgcactatgcactcttcacaatgag

SEQ ID NO: 361636 - DNA, 25 bp, Mus musculus
cgcactccggttaggtgattctcaa

SEQ ID NO: 361637 - DNA, 25 bp, Mus musculus
cgcactccggtttggtgattctcaa

SEQ ID NO: 361638 - DNA, 25 bp, Mus musculus
cgcactgaaggacgcgctcagtatt

SEQ ID NO: 361639 - DNA, 25 bp, Mus musculus
cgcactgaaggaggcgctcagtatt

SEQ ID NO: 361640 - DNA, 25 bp, Mus musculus
cgcactgacaagatggacggctttt

SEQ ID NO: 361641 - DNA, 25 bp, Mus musculus
cgcactgacaagttggacggctttt

SEQ ID NO: 361642 - DNA, 25 bp, Mus musculus
cgcactgacctcatctgaggcatgg

SEQ ID NO: 361643 - DNA, 25 bp, Mus musculus
cgcactgacctcttctgaggcatgg

SEQ ID NO: 361644 - DNA, 25 bp, Mus musculus
cgcactgagcgcctcatgttgagga

SEQ ID NO: 361645 - DNA, 25 bp, Mus musculus
cgcactgagcgcgtcatgttgagga

SEQ ID NO: 361646 - DNA, 25 bp, Mus musculus
cgcactgagcggacttgtcgacaga

SEQ ID NO: 361647 - DNA, 25 bp, Mus musculus
cgcactgagcggtcttgtcgacaga

SEQ ID NO: 361648 - DNA, 25 bp, Mus musculus
cgcactgtgactcatggatccgaat

SEQ ID NO: 361649 - DNA, 25 bp, Mus musculus
cgcactgtgactgatggatccgaat

SEQ ID NO: 361650 - DNA, 25 bp, Mus musculus
cgcacttcagcaataccgtggaggt

SEQ ID NO: 361651 - DNA, 25 bp, Mus musculus
cgcacttcagcattaccgtggaggt

SEQ ID NO: 361652 - DNA, 25 bp, Mus musculus
cgcactttcctaactgctgaattaa

SEQ ID NO: 361653 - DNA, 25 bp, Mus musculus
cgcactttcctatctgctgaattaa

SEQ ID NO: 361654 - DNA, 25 bp, Mus musculus
cgcagaaccagcatgtgcatgtagt

SEQ ID NO: 361655 - DNA, 25 bp, Mus musculus
cgcagaaccagcttgtgcatgtagt

SEQ ID NO: 361656 - DNA, 25 bp, Mus musculus
cgcagaagcgttagctccagatcca

SEQ ID NO: 361657 - DNA, 25 bp, Mus musculus
cgcagaagcgtttgctccagatcca

SEQ ID NO: 361658 - DNA, 25 bp, Mus musculus
cgcagaatgtcccttcagcactgtg

SEQ ID NO: 361659 - DNA, 25 bp, Mus musculus
cgcagaatgtccgttcagcactgtg

SEQ ID NO: 361660 - DNA, 25 bp, Mus musculus
cgcagaccgattcctttccaagtca

SEQ ID NO: 361661 - DNA, 25 bp, Mus musculus
cgcagaccgattgctttccaagtca

SEQ ID NO: 361662 - DNA, 25 bp, Mus musculus
cgcagaccttacaatagcagacctt

SEQ ID NO: 361663 - DNA, 25 bp, Mus musculus
cgcagaccttactatagcagacctt

SEQ ID NO: 361664 - DNA, 25 bp, Mus musculus
cgcagacttgtcagccaggtggtag

SEQ ID NO: 361665 - DNA, 25 bp, Mus musculus
cgcagacttgtctgccaggtggtag

SEQ ID NO: 361666 - DNA, 25 bp, Mus musculus
cgcagagagcatacccctggaggga

SEQ ID NO: 361667 - DNA, 25 bp, Mus musculus
cgcagagagcattcccctggaggga

SEQ ID NO: 361668 - DNA, 25 bp, Mus musculus
cgcagagccaggcttgtttcaggac

SEQ ID NO: 361669 - DNA, 25 bp, Mus musculus
cgcagagccagggttgtttcaggac

SEQ ID NO: 361670 - DNA, 25 bp, Mus musculus
cgcagaggcacgctgatccctgtga

SEQ ID NO: 361671 - DNA, 25 bp, Mus musculus
cgcagaggcacggtgatccctgtga

SEQ ID NO: 361672 - DNA, 25 bp, Mus musculus
cgcagagtctctcgcgaacgcggaa

SEQ ID NO: 361673 - DNA, 25 bp, Mus musculus
cgcagagtctctggcgaacgcggaa

SEQ ID NO: 361674 - DNA, 25 bp, Mus musculus
cgcagatacggcactggactcggct

SEQ ID NO: 361675 - DNA, 25 bp, Mus musculus
cgcagatacggctctggactcggct

SEQ ID NO: 361676 - DNA, 25 bp, Mus musculus
cgcagatcttctctgagcggcgcag

SEQ ID NO: 361677 - DNA, 25 bp, Mus musculus
cgcagatcttctgtgagcggcgcag

SEQ ID NO: 361678 - DNA, 25 bp, Mus musculus
cgcagcaaactgccgtgctggcagg

SEQ ID NO: 361679 - DNA, 25 bp, Mus musculus
cgcagcaaactggcgtgctggcagg

SEQ ID NO: 361680 - DNA, 25 bp, Mus musculus
cgcagcaagattcccatagaaaccc

SEQ ID NO: 361681 - DNA, 25 bp, Mus musculus
cgcagcaagattgccatagaaaccc

SEQ ID NO: 361682 - DNA, 25 bp, Mus musculus
cgcagcacaagaaggcgcacacctt

SEQ ID NO: 361683 - DNA, 25 bp, Mus musculus
cgcagcacaagatggcgcacacctt

SEQ ID NO: 361684 - DNA, 25 bp, Mus musculus
cgcagcatcaggacccgaatgagat

SEQ ID NO: 361685 - DNA, 25 bp, Mus musculus
cgcagcatcaggtcccgaatgagat

SEQ ID NO: 361686 - DNA, 25 bp, Mus musculus
cgcagcatgggacaagaggttccta

SEQ ID NO: 361687 - DNA, 25 bp, Mus musculus
cgcagcatgggagaagaggttccta

SEQ ID NO: 361688 - DNA, 25 bp, Mus musculus
cgcagcattggcctcggtgttgaaa

SEQ ID NO: 361689 - DNA, 25 bp, Mus musculus
cgcagcattggcgtcggtgttgaaa

SEQ ID NO: 361690 - DNA, 25 bp, Mus musculus
cgcagccgaattccatttgaacttc

SEQ ID NO: 361691 - DNA, 25 bp, Mus musculus
cgcagccgaattgcatttgaacttc

SEQ ID NO: 361692 - DNA, 25 bp, Mus musculus
cgcagccgccgaccacaagttggaa

SEQ ID NO: 361693 - DNA, 25 bp, Mus musculus
cgcagccgccgagcacaagttggaa

SEQ ID NO: 361694 - DNA, 25 bp, Mus musculus
cgcagccgcgtgacctggttgctga

SEQ ID NO: 361695 - DNA, 25 bp, Mus musculus
cgcagccgcgtgtcctggttgctga

SEQ ID NO: 361696 - DNA, 25 bp, Mus musculus
cgcagcgcaggcaaatcaacgagga

SEQ ID NO: 361697 - DNA, 25 bp, Mus musculus
cgcagcgcaggctaatcaacgagga

SEQ ID NO: 361698 - DNA, 25 bp, Mus musculus
cgcagcgttactccctgtgtatagt

SEQ ID NO: 361699 - DNA, 25 bp, Mus musculus
cgcagcgttactgcctgtgtatagt

SEQ ID NO: 361700 - DNA, 25 bp, Mus musculus
cgcagctatgacacggactttactg

SEQ ID NO: 361701 - DNA, 25 bp, Mus musculus
cgcagctatgactcggactttactg

SEQ ID NO: 361702 - DNA, 25 bp, Mus musculus
cgcagctgcagtatggctggacaga

SEQ ID NO: 361703 - DNA, 25 bp, Mus musculus
cgcagctgcagtttggctggacaga

SEQ ID NO: 361704 - DNA, 25 bp, Mus musculus
cgcagctgccagatcttgaatacaa

SEQ ID NO: 361705 - DNA, 25 bp, Mus musculus
cgcagctgccagttcttgaatacaa

SEQ ID NO: 361706 - DNA, 25 bp, Mus musculus
cgcagctgtgacatggagggtaaac

SEQ ID NO: 361707 - DNA, 25 bp, Mus musculus
cgcagctgtgacttggagggtaaac

SEQ ID NO: 361708 - DNA, 25 bp, Mus musculus
cgcagctgttcgatctgtacgagaa

SEQ ID NO: 361709 - DNA, 25 bp, Mus musculus
cgcagctgttcgttctgtacgagaa

SEQ ID NO: 361710 - DNA, 25 bp, Mus musculus
cgcagcttccatcttgacacaagga

SEQ ID NO: 361711 - DNA, 25 bp, Mus musculus
cgcagcttccatgttgacacaagga

SEQ ID NO: 361712 - DNA, 25 bp, Mus musculus
cgcagcttcggtcggcttgtcagac

SEQ ID NO: 361713 - DNA, 25 bp, Mus musculus
cgcagcttcggtgggcttgtcagac

SEQ ID NO: 361714 - DNA, 25 bp, Mus musculus
cgcagcttctctaacactgtatggg

SEQ ID NO: 361715 - DNA, 25 bp, Mus musculus
cgcagcttctcttacactgtatggg

SEQ ID NO: 361716 - DNA, 25 bp, Mus musculus
cgcagctttctacctcggagataga

SEQ ID NO: 361717 - DNA, 25 bp, Mus musculus
cgcagctttctagctcggagataga

SEQ ID NO: 361718 - DNA, 25 bp, Mus musculus
cgcaggaattccatttcaccgcaga

SEQ ID NO: 361719 - DNA, 25 bp, Mus musculus
cgcaggaattccttttcaccgcaga

SEQ ID NO: 361720 - DNA, 25 bp, Mus musculus
cgcaggacctttattgcgctgctgc

SEQ ID NO: 361721 - DNA, 25 bp, Mus musculus
cgcaggaccttttttgcgctgctgc

SEQ ID NO: 361722 - DNA, 25 bp, Mus musculus
cgcaggacgggactctaggcattat

SEQ ID NO: 361723 - DNA, 25 bp, Mus musculus
cgcaggacgggagtctaggcattat

SEQ ID NO: 361724 - DNA, 25 bp, Mus musculus
cgcaggaggcccattcagttggaga

SEQ ID NO: 361725 - DNA, 25 bp, Mus musculus
cgcaggaggccctttcagttggaga

SEQ ID NO: 361726 - DNA, 25 bp, Mus musculus
cgcaggcacgttctcgtatatcaag

SEQ ID NO: 361727 - DNA, 25 bp, Mus musculus
cgcaggcacgttgtcgtatatcaag

SEQ ID NO: 361728 - DNA, 25 bp, Mus musculus
cgcaggcagcgactccgagtgctca

SEQ ID NO: 361729 - DNA, 25 bp, Mus musculus
cgcaggcagcgagtccgagtgctca

SEQ ID NO: 361730 - DNA, 25 bp, Mus musculus
cgcaggccctgcagttgagcatgga

SEQ ID NO: 361731 - DNA, 25 bp, Mus musculus
cgcaggccctgctgttgagcatgga

SEQ ID NO: 361732 - DNA, 25 bp, Mus musculus
cgcaggctctgaacctggtgcagct

SEQ ID NO: 361733 - DNA, 25 bp, Mus musculus
cgcaggctctgatcctggtgcagct

SEQ ID NO: 361734 - DNA, 25 bp, Mus musculus
cgcagggaaggcagcaccacggaca

SEQ ID NO: 361735 - DNA, 25 bp, Mus musculus
cgcagggaaggctgcaccacggaca

SEQ ID NO: 361736 - DNA, 25 bp, Mus musculus
cgcagggcaattcgagccgatgcac

SEQ ID NO: 361737 - DNA, 25 bp, Mus musculus
cgcagggcaattggagccgatgcac

SEQ ID NO: 361738 - DNA, 25 bp, Mus musculus
cgcaggtacgcgagatgggtccatt

SEQ ID NO: 361739 - DNA, 25 bp, Mus musculus
cgcaggtacgcgtgatgggtccatt

SEQ ID NO: 361740 - DNA, 25 bp, Mus musculus
cgcaggtagcacaagatgctcctaa

SEQ ID NO: 361741 - DNA, 25 bp, Mus musculus
cgcaggtagcactagatgctcctaa

SEQ ID NO: 361742 - DNA, 25 bp, Mus musculus
cgcagtaaacagaagcagggagctt

SEQ ID NO: 361743 - DNA, 25 bp, Mus musculus
cgcagtaaacagtagcagggagctt

SEQ ID NO: 361744 - DNA, 25 bp, Mus musculus
cgcagtaatagtcgccttgtcttca

SEQ ID NO: 361745 - DNA, 25 bp, Mus musculus
cgcagtaatagtggccttgtcttca

SEQ ID NO: 361746 - DNA, 25 bp, Mus musculus
cgcagtcggatcaggaccttaacta

SEQ ID NO: 361747 - DNA, 25 bp, Mus musculus
cgcagtcggatctggaccttaacta

SEQ ID NO: 361748 - DNA, 25 bp, Mus musculus
cgcagtctgtttccccacctgtaaa

SEQ ID NO: 361749 - DNA, 25 bp, Mus musculus
cgcagtctgtttgcccacctgtaaa

SEQ ID NO: 361750 - DNA, 25 bp, Mus musculus
cgcagtcttcatactaatccttatg

SEQ ID NO: 361751 - DNA, 25 bp, Mus musculus
cgcagtcttcattctaatccttatg

SEQ ID NO: 361752 - DNA, 25 bp, Mus musculus
cgcagtgaagacagttcctgcactt

SEQ ID NO: 361753 - DNA, 25 bp, Mus musculus
cgcagtgaagactgttcctgcactt

SEQ ID NO: 361754 - DNA, 25 bp, Mus musculus
cgcagtgacaccatctccagcaagg

SEQ ID NO: 361755 - DNA, 25 bp, Mus musculus
cgcagtgacaccttctccagcaagg

SEQ ID NO: 361756 - DNA, 25 bp, Mus musculus
cgcagtgagtgtagtctgtaacgtc

SEQ ID NO: 361757 - DNA, 25 bp, Mus musculus
cgcagtgagtgttgtctgtaacgtc

SEQ ID NO: 361758 - DNA, 25 bp, Mus musculus
cgcagtgcagccagggaaggaacca

SEQ ID NO: 361759 - DNA, 25 bp, Mus musculus
cgcagtgcagcctgggaaggaacca

SEQ ID NO: 361760 - DNA, 25 bp, Mus musculus
cgcagtgcttatacgaattctgact

SEQ ID NO: 361761 - DNA, 25 bp, Mus musculus
cgcagtgcttattcgaattctgact

SEQ ID NO: 361762 - DNA, 25 bp, Mus musculus
cgcagtggcctgactcatgggaaat

SEQ ID NO: 361763 - DNA, 25 bp, Mus musculus
cgcagtggcctgtctcatgggaaat

SEQ ID NO: 361764 - DNA, 25 bp, Mus musculus
cgcagtggtcaccagctgttttgat

SEQ ID NO: 361765 - DNA, 25 bp, Mus musculus
cgcagtggtcacgagctgttttgat

SEQ ID NO: 361766 - DNA, 25 bp, Mus musculus
cgcagtgtgcagaaagcgggacttt

SEQ ID NO: 361767 - DNA, 25 bp, Mus musculus
cgcagtgtgcagtaagcgggacttt

SEQ ID NO: 361768 - DNA, 25 bp, Mus musculus
cgcagtttcatgacccataaatctt

SEQ ID NO: 361769 - DNA, 25 bp, Mus musculus
cgcagtttcatgtcccataaatctt

SEQ ID NO: 361770 - DNA, 25 bp, Mus musculus
cgcagtttgtggcttcctcactaaa

SEQ ID NO: 361771 - DNA, 25 bp, Mus musculus
cgcagtttgtgggttcctcactaaa

SEQ ID NO: 361772 - DNA, 25 bp, Mus musculus
cgcagttttcttcgctgtgggatga

SEQ ID NO: 361773 - DNA, 25 bp, Mus musculus
cgcagttttcttggctgtgggatga

SEQ ID NO: 361774 - DNA, 25 bp, Mus musculus
cgcataacgctcacctgcagtggaa

SEQ ID NO: 361775 - DNA, 25 bp, Mus musculus
cgcataacgctctcctgcagtggaa

SEQ ID NO: 361776 - DNA, 25 bp, Mus musculus
cgcatacagacaaccaagcacacgt

SEQ ID NO: 361777 - DNA, 25 bp, Mus musculus
cgcatacagacatccaagcacacgt

SEQ ID NO: 361778 - DNA, 25 bp, Mus musculus
cgcataccctagcttctctgaatgg

SEQ ID NO: 361779 - DNA, 25 bp, Mus musculus
cgcataccctaggttctctgaatgg

SEQ ID NO: 361780 - DNA, 25 bp, Mus musculus
cgcatagtctaactggctcgttcct

SEQ ID NO: 361781 - DNA, 25 bp, Mus musculus
cgcatagtctaagtggctcgttcct

SEQ ID NO: 361782 - DNA, 25 bp, Mus musculus
cgcatatccctgatacccatacact

SEQ ID NO: 361783 - DNA, 25 bp, Mus musculus
cgcatatccctgttacccatacact

SEQ ID NO: 361784 - DNA, 25 bp, Mus musculus
cgcatcaacattacgggttttggct

SEQ ID NO: 361785 - DNA, 25 bp, Mus musculus
cgcatcaacatttcgggttttggct

SEQ ID NO: 361786 - DNA, 25 bp, Mus musculus
cgcatcaccctccagttggacagtg

SEQ ID NO: 361787 - DNA, 25 bp, Mus musculus
cgcatcaccctcgagttggacagtg

SEQ ID NO: 361788 - DNA, 25 bp, Mus musculus
cgcatcatttgaatgttccggttac

SEQ ID NO: 361789 - DNA, 25 bp, Mus musculus
cgcatcatttgattgttccggttac

SEQ ID NO: 361790 - DNA, 25 bp, Mus musculus
cgcatccaagcaaggtggcgtggca

SEQ ID NO: 361791 - DNA, 25 bp, Mus musculus
cgcatccaagcatggtggcgtggca

SEQ ID NO: 361792 - DNA, 25 bp, Mus musculus
cgcatcctgtctatatagagcagtc

SEQ ID NO: 361793 - DNA, 25 bp, Mus musculus
cgcatcctgtctttatagagcagtc

SEQ ID NO: 361794 - DNA, 25 bp, Mus musculus
cgcatcgtcatcaacattgaccggg

SEQ ID NO: 361795 - DNA, 25 bp, Mus musculus
cgcatcgtcatctacattgaccggg

SEQ ID NO: 361796 - DNA, 25 bp, Mus musculus
cgcatctcagtgaataaaggtgctt

SEQ ID NO: 361797 - DNA, 25 bp, Mus musculus
cgcatctcagtgtataaaggtgctt

SEQ ID NO: 361798 - DNA, 25 bp, Mus musculus
cgcatctcgtctacttacaacatga

SEQ ID NO: 361799 - DNA, 25 bp, Mus musculus
cgcatctcgtcttcttacaacatga

SEQ ID NO: 361800 - DNA, 25 bp, Mus musculus
cgcatctctcttcgcagtgggttgt

SEQ ID NO: 361801 - DNA, 25 bp, Mus musculus
cgcatctctcttggcagtgggttgt

SEQ ID NO: 361802 - DNA, 25 bp, Mus musculus
cgcatctgcgtaacgtgatttcttc

SEQ ID NO: 361803 - DNA, 25 bp, Mus musculus
cgcatctgcgtatcgtgatttcttc

SEQ ID NO: 361804 - DNA, 25 bp, Mus musculus
cgcatctgcttgaggaaggtggact

SEQ ID NO: 361805 - DNA, 25 bp, Mus musculus
cgcatctgcttgtggaaggtggact

SEQ ID NO: 361806 - DNA, 25 bp, Mus musculus
cgcatgagcagtattccttcccaga

SEQ ID NO: 361807 - DNA, 25 bp, Mus musculus
cgcatgagcagttttccttcccaga

SEQ ID NO: 361808 - DNA, 25 bp, Mus musculus
cgcatgattttgaccccacagatag

SEQ ID NO: 361809 - DNA, 25 bp, Mus musculus
cgcatgattttgtccccacagatag

SEQ ID NO: 361810 - DNA, 25 bp, Mus musculus
cgcatgcatccacgggatctgatat

SEQ ID NO: 361811 - DNA, 25 bp, Mus musculus
cgcatgcatccaggggatctgatat

SEQ ID NO: 361812 - DNA, 25 bp, Mus musculus
cgcatggaccaaacacaaccttcat

SEQ ID NO: 361813 - DNA, 25 bp, Mus musculus
cgcatggaccaatcacaaccttcat

SEQ ID NO: 361814 - DNA, 25 bp, Mus musculus
cgcatggtcgcacttgtcatacaga

SEQ ID NO: 361815 - DNA, 25 bp, Mus musculus
cgcatggtcgcagttgtcatacaga

SEQ ID NO: 361816 - DNA, 25 bp, Mus musculus
cgcatggtggttatgatatttacta

SEQ ID NO: 361817 - DNA, 25 bp, Mus musculus
cgcatggtggttttgatatttacta

SEQ ID NO: 361818 - DNA, 25 bp, Mus musculus
cgcatgtgcaagacgatgtgaacaa

SEQ ID NO: 361819 - DNA, 25 bp, Mus musculus
cgcatgtgcaagtcgatgtgaacaa

SEQ ID NO: 361820 - DNA, 25 bp, Mus musculus
cgcatgtgcagtcgaccttccaagg

SEQ ID NO: 361821 - DNA, 25 bp, Mus musculus
cgcatgtgcagtggaccttccaagg

SEQ ID NO: 361822 - DNA, 25 bp, Mus musculus
cgcattatgactatggttgacccca

SEQ ID NO: 361823 - DNA, 25 bp, Mus musculus
cgcattatgactttggttgacccca

SEQ ID NO: 361824 - DNA, 25 bp, Mus musculus
cgcattcattttaccataattgtgg

SEQ ID NO: 361825 - DNA, 25 bp, Mus musculus
cgcattcatttttccataattgtgg

SEQ ID NO: 361826 - DNA, 25 bp, Mus musculus
cgcattcctcatcccagtatgagag

SEQ ID NO: 361827 - DNA, 25 bp, Mus musculus
cgcattcctcatgccagtatgagag

SEQ ID NO: 361828 - DNA, 25 bp, Mus musculus
cgcattctggaaccctggcatcctt

SEQ ID NO: 361829 - DNA, 25 bp, Mus musculus
cgcattctggaagcctggcatcctt

SEQ ID NO: 361830 - DNA, 25 bp, Mus musculus
cgcattggcctgagattattcaata

SEQ ID NO: 361831 - DNA, 25 bp, Mus musculus
cgcattggcctgtgattattcaata

SEQ ID NO: 361832 - DNA, 25 bp, Mus musculus
cgcattgtttttcaatcaggcacag

SEQ ID NO: 361833 - DNA, 25 bp, Mus musculus
cgcattgtttttgaatcaggcacag

SEQ ID NO: 361834 - DNA, 25 bp, Mus musculus
cgcatttggatcactgtatcgagat

SEQ ID NO: 361835 - DNA, 25 bp, Mus musculus
cgcatttggatctctgtatcgagat

SEQ ID NO: 361836 - DNA, 25 bp, Mus musculus
cgccaactatcactccaggtttaaa

SEQ ID NO: 361837 - DNA, 25 bp, Mus musculus
cgccaactatcagtccaggtttaaa

SEQ ID NO: 361838 - DNA, 25 bp, Mus musculus
cgccaactcagaatcgatgtacatt

SEQ ID NO: 361839 - DNA, 25 bp, Mus musculus
cgccaactcagattcgatgtacatt

SEQ ID NO: 361840 - DNA, 25 bp, Mus musculus
cgccaagagtttccgcgccgagatt

SEQ ID NO: 361841 - DNA, 25 bp, Mus musculus
cgccaagagtttgcgcgccgagatt

SEQ ID NO: 361842 - DNA, 25 bp, Mus musculus
cgccaagatcgtcaagcccaatggc

SEQ ID NO: 361843 - DNA, 25 bp, Mus musculus
cgccaagatcgtgaagcccaatggc

SEQ ID NO: 361844 - DNA, 25 bp, Mus musculus
cgccaagcagaaccactgtgtatta

SEQ ID NO: 361845 - DNA, 25 bp, Mus musculus
cgccaagcagaagcactgtgtatta

SEQ ID NO: 361846 - DNA, 25 bp, Mus musculus
cgccaagcgctacagttacctaaaa

SEQ ID NO: 361847 - DNA, 25 bp, Mus musculus
cgccaagcgctagagttacctaaaa

SEQ ID NO: 361848 - DNA, 25 bp, Mus musculus
cgccaagctgaaagtgagtgacagg

SEQ ID NO: 361849 - DNA, 25 bp, Mus musculus
cgccaagctgaatgtgagtgacagg

SEQ ID NO: 361850 - DNA, 25 bp, Mus musculus
cgccaaggaccacaacgagctgtta

SEQ ID NO: 361851 - DNA, 25 bp, Mus musculus
cgccaaggaccagaacgagctgtta

SEQ ID NO: 361852 - DNA, 25 bp, Mus musculus
cgccaaggccacacggagactcagg

SEQ ID NO: 361853 - DNA, 25 bp, Mus musculus
cgccaaggccactcggagactcagg

SEQ ID NO: 361854 - DNA, 25 bp, Mus musculus
cgccaaggtggtcatcttgaaaaag

SEQ ID NO: 361855 - DNA, 25 bp, Mus musculus
cgccaaggtggtgatcttgaaaaag

SEQ ID NO: 361856 - DNA, 25 bp, Mus musculus
cgccaccaccaaacaattttcagga

SEQ ID NO: 361857 - DNA, 25 bp, Mus musculus
cgccaccaccaatcaattttcagga

SEQ ID NO: 361858 - DNA, 25 bp, Mus musculus
cgccacccagttcatggaatttgaa

SEQ ID NO: 361859 - DNA, 25 bp, Mus musculus
cgccacccagttgatggaatttgaa

SEQ ID NO: 361860 - DNA, 25 bp, Mus musculus
cgccacccatgcctttgtattattg

SEQ ID NO: 361861 - DNA, 25 bp, Mus musculus
cgccacccatgcgtttgtattattg

SEQ ID NO: 361862 - DNA, 25 bp, Mus musculus
cgccacgcctgtctggagccaagag

SEQ ID NO: 361863 - DNA, 25 bp, Mus musculus
cgccacgcctgtgtggagccaagag

SEQ ID NO: 361864 - DNA, 25 bp, Mus musculus
cgccacgtggaaccgagactaccag

SEQ ID NO: 361865 - DNA, 25 bp, Mus musculus
cgccacgtggaagcgagactaccag

SEQ ID NO: 361866 - DNA, 25 bp, Mus musculus
cgccactctgagacatcagttctgt

SEQ ID NO: 361867 - DNA, 25 bp, Mus musculus
cgccactctgagtcatcagttctgt

SEQ ID NO: 361868 - DNA, 25 bp, Mus musculus
cgccactggcttatgttgacttttt

SEQ ID NO: 361869 - DNA, 25 bp, Mus musculus
cgccactggcttttgttgacttttt

SEQ ID NO: 361870 - DNA, 25 bp, Mus musculus
cgccagaggagcagcggctttacaa

SEQ ID NO: 361871 - DNA, 25 bp, Mus musculus
cgccagaggagctgcggctttacaa

SEQ ID NO: 361872 - DNA, 25 bp, Mus musculus
cgccagaggcgacgtgatcatagtc

SEQ ID NO: 361873 - DNA, 25 bp, Mus musculus
cgccagaggcgaggtgatcatagtc

SEQ ID NO: 361874 - DNA, 25 bp, Mus musculus
cgccagatgccaatggtaaagttgt

SEQ ID NO: 361875 - DNA, 25 bp, Mus musculus
cgccagatgccattggtaaagttgt

SEQ ID NO: 361876 - DNA, 25 bp, Mus musculus
cgccagatgtctctggcaacttaga

SEQ ID NO: 361877 - DNA, 25 bp, Mus musculus
cgccagatgtctgtggcaacttaga

SEQ ID NO: 361878 - DNA, 25 bp, Mus musculus
cgccagcatagcacaagccaggaag

SEQ ID NO: 361879 - DNA, 25 bp, Mus musculus
cgccagcatagctcaagccaggaag

SEQ ID NO: 361880 - DNA, 25 bp, Mus musculus
cgccagccccatcagtacatttttt

SEQ ID NO: 361881 - DNA, 25 bp, Mus musculus
cgccagccccatgagtacatttttt

SEQ ID NO: 361882 - DNA, 25 bp, Mus musculus
cgccagccggtactgggctctgttt

SEQ ID NO: 361883 - DNA, 25 bp, Mus musculus
cgccagccggtagtgggctctgttt

SEQ ID NO: 361884 - DNA, 25 bp, Mus musculus
cgccagcgcctgacaaacaggagat

SEQ ID NO: 361885 - DNA, 25 bp, Mus musculus
cgccagcgcctgtcaaacaggagat

SEQ ID NO: 361886 - DNA, 25 bp, Mus musculus
cgccagcggtaacggcgggtggctg

SEQ ID NO: 361887 - DNA, 25 bp, Mus musculus
cgccagcggtaagggcgggtggctg

SEQ ID NO: 361888 - DNA, 25 bp, Mus musculus
cgccagctggggcttgatattgtac

SEQ ID NO: 361889 - DNA, 25 bp, Mus musculus
cgccagctgggggttgatattgtac

SEQ ID NO: 361890 - DNA, 25 bp, Mus musculus
cgccagctgtgacattctgtccaga

SEQ ID NO: 361891 - DNA, 25 bp, Mus musculus
cgccagctgtgagattctgtccaga

SEQ ID NO: 361892 - DNA, 25 bp, Mus musculus
cgccaggaacagattgccaagagac

SEQ ID NO: 361893 - DNA, 25 bp, Mus musculus
cgccaggaacagtttgccaagagac

SEQ ID NO: 361894 - DNA, 25 bp, Mus musculus
cgccaggcagagatagcaccagcag

SEQ ID NO: 361895 - DNA, 25 bp, Mus musculus
cgccaggcagagttagcaccagcag

SEQ ID NO: 361896 - DNA, 25 bp, Mus musculus
cgccagtaatgccagacgcatggat

SEQ ID NO: 361897 - DNA, 25 bp, Mus musculus
cgccagtaatgcgagacgcatggat

SEQ ID NO: 361898 - DNA, 25 bp, Mus musculus
cgccagtagttcatttcgataaaaa

SEQ ID NO: 361899 - DNA, 25 bp, Mus musculus
cgccagtagttcttttcgataaaaa

SEQ ID NO: 361900 - DNA, 25 bp, Mus musculus
cgccagtatgataggcatgtgccaa

SEQ ID NO: 361901 - DNA, 25 bp, Mus musculus
cgccagtatgattggcatgtgccaa

SEQ ID NO: 361902 - DNA, 25 bp, Mus musculus
cgccagtgctgtagagtgacgtgtt

SEQ ID NO: 361903 - DNA, 25 bp, Mus musculus
cgccagtgctgttgagtgacgtgtt

SEQ ID NO: 361904 - DNA, 25 bp, Mus musculus
cgccagttgtgcacttttacaagcc

SEQ ID NO: 361905 - DNA, 25 bp, Mus musculus
cgccagttgtgctcttttacaagcc

SEQ ID NO: 361906 - DNA, 25 bp, Mus musculus
cgccagtttgtaacttggtgaaaat

SEQ ID NO: 361907 - DNA, 25 bp, Mus musculus
cgccagtttgtatcttggtgaaaat

SEQ ID NO: 361908 - DNA, 25 bp, Mus musculus
cgccatatacatctctaaaagagta

SEQ ID NO: 361909 - DNA, 25 bp, Mus musculus
cgccatatacatgtctaaaagagta

SEQ ID NO: 361910 - DNA, 25 bp, Mus musculus
cgccatattctcacggttcatacaa

SEQ ID NO: 361911 - DNA, 25 bp, Mus musculus
cgccatattctctcggttcatacaa

SEQ ID NO: 361912 - DNA, 25 bp, Mus musculus
cgccatcactacaaatatcttccat

SEQ ID NO: 361913 - DNA, 25 bp, Mus musculus
cgccatcactactaatatcttccat

SEQ ID NO: 361914 - DNA, 25 bp, Mus musculus
cgccatccaggacgtgcagcagaag

SEQ ID NO: 361915 - DNA, 25 bp, Mus musculus
cgccatccaggaggtgcagcagaag

SEQ ID NO: 361916 - DNA, 25 bp, Mus musculus
cgccatctctggaacatctctaaat

SEQ ID NO: 361917 - DNA, 25 bp, Mus musculus
cgccatctctggtacatctctaaat

SEQ ID NO: 361918 - DNA, 25 bp, Mus musculus
cgccatctgctgacgaggctaagaa

SEQ ID NO: 361919 - DNA, 25 bp, Mus musculus
cgccatctgctgtcgaggctaagaa

SEQ ID NO: 361920 - DNA, 25 bp, Mus musculus
cgccatcttatgataatgtctgtga

SEQ ID NO: 361921 - DNA, 25 bp, Mus musculus
cgccatcttatgttaatgtctgtga

SEQ ID NO: 361922 - DNA, 25 bp, Mus musculus
cgccatgccatccagactgaggaag

SEQ ID NO: 361923 - DNA, 25 bp, Mus musculus
cgccatgccatccagtttacatgag

SEQ ID NO: 361924 - DNA, 25 bp, Mus musculus
cgccatgccatcgagactgaggaag

SEQ ID NO: 361925 - DNA, 25 bp, Mus musculus
cgccatgccatcgagtttacatgag

SEQ ID NO: 361926 - DNA, 25 bp, Mus musculus
cgccatgcccggaacgatccgtggg

SEQ ID NO: 361927 - DNA, 25 bp, Mus musculus
cgccatgcccggtacgatccgtggg

SEQ ID NO: 361928 - DNA, 25 bp, Mus musculus
cgccatggccgacgaaggcatagct

SEQ ID NO: 361929 - DNA, 25 bp, Mus musculus
cgccatggccgaggaaggcatagct

SEQ ID NO: 361930 - DNA, 25 bp, Mus musculus
cgccatggtattattccgaaagact

SEQ ID NO: 361931 - DNA, 25 bp, Mus musculus
cgccatggtatttttccgaaagact

SEQ ID NO: 361932 - DNA, 25 bp, Mus musculus
cgccatggtgaacctgagcaaagaa

SEQ ID NO: 361933 - DNA, 25 bp, Mus musculus
cgccatggtgaagctgagcaaagaa

SEQ ID NO: 361934 - DNA, 25 bp, Mus musculus
cgccatgtctaactctgccgggatg

SEQ ID NO: 361935 - DNA, 25 bp, Mus musculus
cgccatgtctaagtctgccgggatg

SEQ ID NO: 361936 - DNA, 25 bp, Mus musculus
cgccattatccccagcaagaagctt

SEQ ID NO: 361937 - DNA, 25 bp, Mus musculus
cgccattatcccgagcaagaagctt

SEQ ID NO: 361938 - DNA, 25 bp, Mus musculus
cgccattctggtagtctgtgcagaa

SEQ ID NO: 361939 - DNA, 25 bp, Mus musculus
cgccattctggttgtctgtgcagaa

SEQ ID NO: 361940 - DNA, 25 bp, Mus musculus
cgccattgaactcttgcatcacata

SEQ ID NO: 361941 - DNA, 25 bp, Mus musculus
cgccattgaactgttgcatcacata

SEQ ID NO: 361942 - DNA, 25 bp, Mus musculus
cgccatttagccatgtagttcccag

SEQ ID NO: 361943 - DNA, 25 bp, Mus musculus
cgccatttagccttgtagttcccag

SEQ ID NO: 361944 - DNA, 25 bp, Mus musculus
cgcccaacctgtcaagcaaatgatt

SEQ ID NO: 361945 - DNA, 25 bp, Mus musculus
cgcccaacctgtgaagcaaatgatt

SEQ ID NO: 361946 - DNA, 25 bp, Mus musculus
cgcccaacttcacaagtatccataa

SEQ ID NO: 361947 - DNA, 25 bp, Mus musculus
cgcccaacttcagaagtatccataa

SEQ ID NO: 361948 - DNA, 25 bp, Mus musculus
cgcccacactgtataaagcccaaat

SEQ ID NO: 361949 - DNA, 25 bp, Mus musculus
cgcccacactgtttaaagcccaaat

SEQ ID NO: 361950 - DNA, 25 bp, Mus musculus
cgcccacaggttaacacacaagttt

SEQ ID NO: 361951 - DNA, 25 bp, Mus musculus
cgcccacaggtttacacacaagttt

SEQ ID NO: 361952 - DNA, 25 bp, Mus musculus
cgcccactctatctgctgggaagta

SEQ ID NO: 361953 - DNA, 25 bp, Mus musculus
cgcccactctatgtgctgggaagta

SEQ ID NO: 361954 - DNA, 25 bp, Mus musculus
cgcccagcacagctcaattctttgt

SEQ ID NO: 361955 - DNA, 25 bp, Mus musculus
cgcccagcacaggtcaattctttgt

SEQ ID NO: 361956 - DNA, 25 bp, Mus musculus
cgcccagcggacacatttgaaacta

SEQ ID NO: 361957 - DNA, 25 bp, Mus musculus
cgcccagcggactcatttgaaacta

SEQ ID NO: 361958 - DNA, 25 bp, Mus musculus
cgcccaggtgttatgttgcagttta

SEQ ID NO: 361959 - DNA, 25 bp, Mus musculus
cgcccaggtgttttgttgcagttta

SEQ ID NO: 361960 - DNA, 25 bp, Mus musculus
cgcccagtgcaaatttttccaggat

SEQ ID NO: 361961 - DNA, 25 bp, Mus musculus
cgcccagtgcaattttttccaggat

SEQ ID NO: 361962 - DNA, 25 bp, Mus musculus
cgcccagtggctacacaagctgtac

SEQ ID NO: 361963 - DNA, 25 bp, Mus musculus
cgcccagtggcttcacaagctgtac

SEQ ID NO: 361964 - DNA, 25 bp, Mus musculus
cgcccagttcagctaagcagcagag

SEQ ID NO: 361965 - DNA, 25 bp, Mus musculus
cgcccagttcaggtaagcagcagag

SEQ ID NO: 361966 - DNA, 25 bp, Mus musculus
cgcccataattcctttcagagtact

SEQ ID NO: 361967 - DNA, 25 bp, Mus musculus
cgcccataattcgtttcagagtact

SEQ ID NO: 361968 - DNA, 25 bp, Mus musculus
cgcccatccttcacaatatgctaaa

SEQ ID NO: 361969 - DNA, 25 bp, Mus musculus
cgcccatccttctcaatatgctaaa

SEQ ID NO: 361970 - DNA, 25 bp, Mus musculus
cgccccacagagctcatgtttatag

SEQ ID NO: 361971 - DNA, 25 bp, Mus musculus
cgccccacagaggtcatgtttatag

SEQ ID NO: 361972 - DNA, 25 bp, Mus musculus
cgccccatcaggagtcctatgatta

SEQ ID NO: 361973 - DNA, 25 bp, Mus musculus
cgccccatcaggtgtcctatgatta

SEQ ID NO: 361974 - DNA, 25 bp, Mus musculus
cgccccatccagcaactgtagtgtt

SEQ ID NO: 361975 - DNA, 25 bp, Mus musculus
cgccccatccaggaactgtagtgtt

SEQ ID NO: 361976 - DNA, 25 bp, Mus musculus
cgccccgagtagaagacactcttgg

SEQ ID NO: 361977 - DNA, 25 bp, Mus musculus
cgccccgagtagtagacactcttgg

SEQ ID NO: 361978 - DNA, 25 bp, Mus musculus
cgcccctctgatctgagacatgaac

SEQ ID NO: 361979 - DNA, 25 bp, Mus musculus
cgcccctctgatgtgagacatgaac

SEQ ID NO: 361980 - DNA, 25 bp, Mus musculus
cgcccctgtctacatcagaagtata

SEQ ID NO: 361981 - DNA, 25 bp, Mus musculus
cgcccctgtctagatcagaagtata

SEQ ID NO: 361982 - DNA, 25 bp, Mus musculus
cgccccttctttatgctgatttgca

SEQ ID NO: 361983 - DNA, 25 bp, Mus musculus
cgccccttctttttgctgatttgca

SEQ ID NO: 361984 - DNA, 25 bp, Mus musculus
cgcccctttccactgtttgacagtg

SEQ ID NO: 361985 - DNA, 25 bp, Mus musculus
cgcccctttccagtgtttgacagtg

SEQ ID NO: 361986 - DNA, 25 bp, Mus musculus
cgcccgaggtgaccgagatgatctc

SEQ ID NO: 361987 - DNA, 25 bp, Mus musculus
cgcccgaggtgagcgagatgatctc

SEQ ID NO: 361988 - DNA, 25 bp, Mus musculus
cgcccgcagtctacgaggtgatgaa

SEQ ID NO: 361989 - DNA, 25 bp, Mus musculus
cgcccgcagtcttcgaggtgatgaa

SEQ ID NO: 361990 - DNA, 25 bp, Mus musculus
cgcccggctgagatattcaggtttt

SEQ ID NO: 361991 - DNA, 25 bp, Mus musculus
cgcccggctgagttattcaggtttt

SEQ ID NO: 361992 - DNA, 25 bp, Mus musculus
cgcccggcttataactcattatgta

SEQ ID NO: 361993 - DNA, 25 bp, Mus musculus
cgcccggcttattactcattatgta

SEQ ID NO: 361994 - DNA, 25 bp, Mus musculus
cgcccgggccttacattaatatatg

SEQ ID NO: 361995 - DNA, 25 bp, Mus musculus
cgcccgggcctttcattaatatatg

SEQ ID NO: 361996 - DNA, 25 bp, Mus musculus
cgcccggttcaaaaaatgccacaca

SEQ ID NO: 361997 - DNA, 25 bp, Mus musculus
cgcccggttcaataaatgccacaca

SEQ ID NO: 361998 - DNA, 25 bp, Mus musculus
cgcccgtaaccacggctgtgggcaa

SEQ ID NO: 361999 - DNA, 25 bp, Mus musculus
cgcccgtaaccagggctgtgggcaa

SEQ ID NO: 362000 - DNA, 25 bp, Mus musculus
cgcccgtgtcaaagccaagtcaaag

SEQ ID NO: 362001 - DNA, 25 bp, Mus musculus
cgcccgtgtcaatgccaagtcaaag

SEQ ID NO: 362002 - DNA, 25 bp, Mus musculus
cgccctagtggacatgacaatgaag

SEQ ID NO: 362003 - DNA, 25 bp, Mus musculus
cgccctagtggagatgacaatgaag

SEQ ID NO: 362004 - DNA, 25 bp, Mus musculus
cgccctatacctctgtggatgaata

SEQ ID NO: 362005 - DNA, 25 bp, Mus musculus
cgccctatacctgtgtggatgaata

SEQ ID NO: 362006 - DNA, 25 bp, Mus musculus
cgccctcagacaacgtcgacaaaat

SEQ ID NO: 362007 - DNA, 25 bp, Mus musculus
cgccctcagacatcgtcgacaaaat

SEQ ID NO: 362008 - DNA, 25 bp, Mus musculus
cgccctccggtgaattgtgtatttg

SEQ ID NO: 362009 - DNA, 25 bp, Mus musculus
cgccctccggtgtattgtgtatttg

SEQ ID NO: 362010 - DNA, 25 bp, Mus musculus
cgccctcggtgaagtagtgtccaat

SEQ ID NO: 362011 - DNA, 25 bp, Mus musculus
cgccctcggtgatgtagtgtccaat

SEQ ID NO: 362012 - DNA, 25 bp, Mus musculus
cgccctctgcctatcttgataaata

SEQ ID NO: 362013 - DNA, 25 bp, Mus musculus
cgccctctgcctttcttgataaata

SEQ ID NO: 362014 - DNA, 25 bp, Mus musculus
cgccctcttcgtattttgttgatat

SEQ ID NO: 362015 - DNA, 25 bp, Mus musculus
cgccctcttcgttttttgttgatat

SEQ ID NO: 362016 - DNA, 25 bp, Mus musculus
cgccctcttgtaagtacactgcaaa

SEQ ID NO: 362017 - DNA, 25 bp, Mus musculus
cgccctcttgtatgtacactgcaaa

SEQ ID NO: 362018 - DNA, 25 bp, Mus musculus
cgccctgaccagagccttcagtggg

SEQ ID NO: 362019 - DNA, 25 bp, Mus musculus
cgccctgaccagtgccttcagtggg

SEQ ID NO: 362020 - DNA, 25 bp, Mus musculus
cgccctgagaacacggacatcctga

SEQ ID NO: 362021 - DNA, 25 bp, Mus musculus
cgccctgagaactcggacatcctga

SEQ ID NO: 362022 - DNA, 25 bp, Mus musculus
cgccctgcactgcttacgggaagca

SEQ ID NO: 362023 - DNA, 25 bp, Mus musculus
cgccctgcactggttacgggaagca

SEQ ID NO: 362024 - DNA, 25 bp, Mus musculus
cgccctgcatggagcctgtgtgtca

SEQ ID NO: 362025 - DNA, 25 bp, Mus musculus
cgccctgcatggtgcctgtgtgtca

SEQ ID NO: 362026 - DNA, 25 bp, Mus musculus
cgccctgcccctataattgaataaa

SEQ ID NO: 362027 - DNA, 25 bp, Mus musculus
cgccctgcccctttaattgaataaa

SEQ ID NO: 362028 - DNA, 25 bp, Mus musculus
cgccctgcgactattcacagcagta

SEQ ID NO: 362029 - DNA, 25 bp, Mus musculus
cgccctgcgacttttcacagcagta

SEQ ID NO: 362030 - DNA, 25 bp, Mus musculus
cgccctgctataactgttttctgaa

SEQ ID NO: 362031 - DNA, 25 bp, Mus musculus
cgccctgctatatctgttttctgaa

SEQ ID NO: 362032 - DNA, 25 bp, Mus musculus
cgccctgctgtaaggctcttagtga

SEQ ID NO: 362033 - DNA, 25 bp, Mus musculus
cgccctgctgtatggctcttagtga

SEQ ID NO: 362034 - DNA, 25 bp, Mus musculus
cgccctggaattcccttcatgtgct

SEQ ID NO: 362035 - DNA, 25 bp, Mus musculus
cgccctggaattgccttcatgtgct

SEQ ID NO: 362036 - DNA, 25 bp, Mus musculus
cgccctggagctacaggatgtccat

SEQ ID NO: 362037 - DNA, 25 bp, Mus musculus
cgccctggagcttcaggatgtccat

SEQ ID NO: 362038 - DNA, 25 bp, Mus musculus
cgccctggctgactacaaactgaag

SEQ ID NO: 362039 - DNA, 25 bp, Mus musculus
cgccctggctgagtacaaactgaag

SEQ ID NO: 362040 - DNA, 25 bp, Mus musculus
cgcccttaggctacttcgtggtcat

SEQ ID NO: 362041 - DNA, 25 bp, Mus musculus
cgcccttaggcttcttcgtggtcat

SEQ ID NO: 362042 - DNA, 25 bp, Mus musculus
cgcccttcagctacgataccttcaa

SEQ ID NO: 362043 - DNA, 25 bp, Mus musculus
cgcccttcagcttcgataccttcaa

SEQ ID NO: 362044 - DNA, 25 bp, Mus musculus
cgcccttctgatcttctgtctacag

SEQ ID NO: 362045 - DNA, 25 bp, Mus musculus
cgcccttctgatgttctgtctacag

SEQ ID NO: 362046 - DNA, 25 bp, Mus musculus
cgcccttgctgtccgagatctggga

SEQ ID NO: 362047 - DNA, 25 bp, Mus musculus
cgcccttgctgtgcgagatctggga

SEQ ID NO: 362048 - DNA, 25 bp, Mus musculus
cgcccttggtttctacatcatggtg

SEQ ID NO: 362049 - DNA, 25 bp, Mus musculus
cgcccttggtttgtacatcatggtg

SEQ ID NO: 362050 - DNA, 25 bp, Mus musculus
cgccctttgtcactgagttgctgtg

SEQ ID NO: 362051 - DNA, 25 bp, Mus musculus
cgccctttgtcagtgagttgctgtg

SEQ ID NO: 362052 - DNA, 25 bp, Mus musculus
cgccgaacttgcagccccagttggg

SEQ ID NO: 362053 - DNA, 25 bp, Mus musculus
cgccgaacttgctgccccagttggg

SEQ ID NO: 362054 - DNA, 25 bp, Mus musculus
cgccgagatgatcggctttctgctg

SEQ ID NO: 362055 - DNA, 25 bp, Mus musculus
cgccgagatgatgggctttctgctg

SEQ ID NO: 362056 - DNA, 25 bp, Mus musculus
cgccgagcgcggagtgagtgccatc

SEQ ID NO: 362057 - DNA, 25 bp, Mus musculus
cgccgagcgcggtgtgagtgccatc

SEQ ID NO: 362058 - DNA, 25 bp, Mus musculus
cgccgaggccctaggcagcctgaaa

SEQ ID NO: 362059 - DNA, 25 bp, Mus musculus
cgccgaggcccttggcagcctgaaa

SEQ ID NO: 362060 - DNA, 25 bp, Mus musculus
cgccgaggtcagagttgctgcaagt

SEQ ID NO: 362061 - DNA, 25 bp, Mus musculus
cgccgaggtcagtgttgctgcaagt

SEQ ID NO: 362062 - DNA, 25 bp, Mus musculus
cgccgatctctacattgggaaaaaa

SEQ ID NO: 362063 - DNA, 25 bp, Mus musculus
cgccgatctctagattgggaaaaaa

SEQ ID NO: 362064 - DNA, 25 bp, Mus musculus
cgccgatgggatctaattgccatta

SEQ ID NO: 362065 - DNA, 25 bp, Mus musculus
cgccgatgggatgtaattgccatta

SEQ ID NO: 362066 - DNA, 25 bp, Mus musculus
cgccgcagaggccactgttttggaa

SEQ ID NO: 362067 - DNA, 25 bp, Mus musculus
cgccgcagaggcgactgttttggaa

SEQ ID NO: 362068 - DNA, 25 bp, Mus musculus
cgccgccaatgcatgttcaggcacg

SEQ ID NO: 362069 - DNA, 25 bp, Mus musculus
cgccgccaatgcttgttcaggcacg

SEQ ID NO: 362070 - DNA, 25 bp, Mus musculus
cgccgccctgcaagttttatatttt

SEQ ID NO: 362071 - DNA, 25 bp, Mus musculus
cgccgccctgcatgttttatatttt

SEQ ID NO: 362072 - DNA, 25 bp, Mus musculus
cgccgcctgtacatcatgtttgaga

SEQ ID NO: 362073 - DNA, 25 bp, Mus musculus
cgccgcctgtacttcatgtttgaga

SEQ ID NO: 362074 - DNA, 25 bp, Mus musculus
cgccgcgcgcccattgtgaggtcag

SEQ ID NO: 362075 - DNA, 25 bp, Mus musculus
cgccgcgcgccctttgtgaggtcag

SEQ ID NO: 362076 - DNA, 25 bp, Mus musculus
cgccgcggacaactgcacgtgctgt

SEQ ID NO: 362077 - DNA, 25 bp, Mus musculus
cgccgcggacaagtgcacgtgctgt

SEQ ID NO: 362078 - DNA, 25 bp, Mus musculus
cgccgcggtgtcactggaatgttct

SEQ ID NO: 362079 - DNA, 25 bp, Mus musculus
cgccgcggtgtctctggaatgttct

SEQ ID NO: 362080 - DNA, 25 bp, Mus musculus
cgccgctactgaactgctctggacc

SEQ ID NO: 362081 - DNA, 25 bp, Mus musculus
cgccgctactgatctgctctggacc

SEQ ID NO: 362082 - DNA, 25 bp, Mus musculus
cgccgctgccccatgtacgtttggg

SEQ ID NO: 362083 - DNA, 25 bp, Mus musculus
cgccgctgccccttgtacgtttggg

SEQ ID NO: 362084 - DNA, 25 bp, Mus musculus
cgccgctggataaggctttcctagc

SEQ ID NO: 362085 - DNA, 25 bp, Mus musculus
cgccgctggatatggctttcctagc

SEQ ID NO: 362086 - DNA, 25 bp, Mus musculus
cgccggaaagcgagccaatcaacat

SEQ ID NO: 362087 - DNA, 25 bp, Mus musculus
cgccggaaagcgtgccaatcaacat

SEQ ID NO: 362088 - DNA, 25 bp, Mus musculus
cgccggaagttcctcatctttgata

SEQ ID NO: 362089 - DNA, 25 bp, Mus musculus
cgccggaagttcgtcatctttgata

SEQ ID NO: 362090 - DNA, 25 bp, Mus musculus
cgccggagccgacatgcctaaagga

SEQ ID NO: 362091 - DNA, 25 bp, Mus musculus
cgccggagccgagatgcctaaagga

SEQ ID NO: 362092 - DNA, 25 bp, Mus musculus
cgccggagtggcaaaatgtctggta

SEQ ID NO: 362093 - DNA, 25 bp, Mus musculus
cgccggagtggctaaatgtctggta

SEQ ID NO: 362094 - DNA, 25 bp, Mus musculus
cgccggctgttcatcgtgtgaaatg

SEQ ID NO: 362095 - DNA, 25 bp, Mus musculus
cgccggctgttcttcgtgtgaaatg

SEQ ID NO: 362096 - DNA, 25 bp, Mus musculus
cgccgggagtctacacaaaacttat

SEQ ID NO: 362097 - DNA, 25 bp, Mus musculus
cgccgggagtcttcacaaaacttat

SEQ ID NO: 362098 - DNA, 25 bp, Mus musculus
cgccggtcaattagttttcctgtca

SEQ ID NO: 362099 - DNA, 25 bp, Mus musculus
cgccggtcaatttgttttcctgtca

SEQ ID NO: 362100 - DNA, 25 bp, Mus musculus
cgccggtgtcggaccctactcaggg

SEQ ID NO: 362101 - DNA, 25 bp, Mus musculus
cgccggtgtcggtccctactcaggg

SEQ ID NO: 362102 - DNA, 25 bp, Mus musculus
cgccgtctcagcaccagcggagagt

SEQ ID NO: 362103 - DNA, 25 bp, Mus musculus
cgccgtctcagctccagcggagagt

SEQ ID NO: 362104 - DNA, 25 bp, Mus musculus
cgccgtggctacatgagttaatgtt

SEQ ID NO: 362105 - DNA, 25 bp, Mus musculus
cgccgtggctacttgagttaatgtt

SEQ ID NO: 362106 - DNA, 25 bp, Mus musculus
cgccgttatcagcaccagcttgaag

SEQ ID NO: 362107 - DNA, 25 bp, Mus musculus
cgccgttatcaggaccagcttgaag

SEQ ID NO: 362108 - DNA, 25 bp, Mus musculus
cgccgtttggagactaccgacagta

SEQ ID NO: 362109 - DNA, 25 bp, Mus musculus
cgccgtttggagtctaccgacagta

SEQ ID NO: 362110 - DNA, 25 bp, Mus musculus
cgcctaaacagtatgcccttcaaat

SEQ ID NO: 362111 - DNA, 25 bp, Mus musculus
cgcctaaacagtttgcccttcaaat

SEQ ID NO: 362112 - DNA, 25 bp, Mus musculus
cgcctaagattgcttttgtagaatg

SEQ ID NO: 362113 - DNA, 25 bp, Mus musculus
cgcctaagattggttttgtagaatg

SEQ ID NO: 362114 - DNA, 25 bp, Mus musculus
cgcctaccagagcaaaatcaagatg

SEQ ID NO: 362115 - DNA, 25 bp, Mus musculus
cgcctaccagaggaaaatcaagatg

SEQ ID NO: 362116 - DNA, 25 bp, Mus musculus
cgcctacctgtacaccagagaagtt

SEQ ID NO: 362117 - DNA, 25 bp, Mus musculus
cgcctacctgtagaccagagaagtt

SEQ ID NO: 362118 - DNA, 25 bp, Mus musculus
cgcctacctgttaactcgttcaaat

SEQ ID NO: 362119 - DNA, 25 bp, Mus musculus
cgcctacctgtttactcgttcaaat

SEQ ID NO: 362120 - DNA, 25 bp, Mus musculus
cgcctactgagcagaggtggcctaa

SEQ ID NO: 362121 - DNA, 25 bp, Mus musculus
cgcctactgagctgaggtggcctaa

SEQ ID NO: 362122 - DNA, 25 bp, Mus musculus
cgcctactgctcaatgcttttgaaa

SEQ ID NO: 362123 - DNA, 25 bp, Mus musculus
cgcctactgctctatgcttttgaaa

SEQ ID NO: 362124 - DNA, 25 bp, Mus musculus
cgcctagcctcaaaaatactcacaa

SEQ ID NO: 362125 - DNA, 25 bp, Mus musculus
cgcctagcctcataaatactcacaa

SEQ ID NO: 362126 - DNA, 25 bp, Mus musculus
cgcctaggaacacatcctgactggt

SEQ ID NO: 362127 - DNA, 25 bp, Mus musculus
cgcctaggaacagatcctgactggt

SEQ ID NO: 362128 - DNA, 25 bp, Mus musculus
cgcctagttcggcagcttgctgtag

SEQ ID NO: 362129 - DNA, 25 bp, Mus musculus
cgcctagttcgggagcttgctgtag

SEQ ID NO: 362130 - DNA, 25 bp, Mus musculus
cgcctatatttaactgagtgctgtc

SEQ ID NO: 362131 - DNA, 25 bp, Mus musculus
cgcctatatttatctgagtgctgtc

SEQ ID NO: 362132 - DNA, 25 bp, Mus musculus
cgcctatctggtaataactgcggtg

SEQ ID NO: 362133 - DNA, 25 bp, Mus musculus
cgcctatctggttataactgcggtg

SEQ ID NO: 362134 - DNA, 25 bp, Mus musculus
cgcctatgccagaactctcagaaga

SEQ ID NO: 362135 - DNA, 25 bp, Mus musculus
cgcctatgccagtactctcagaaga

SEQ ID NO: 362136 - DNA, 25 bp, Mus musculus
cgcctcaagggcctgggcttctact

SEQ ID NO: 362137 - DNA, 25 bp, Mus musculus
cgcctcaagggcgtgggcttctact

SEQ ID NO: 362138 - DNA, 25 bp, Mus musculus
cgcctcagcctaatggagtacaggt

SEQ ID NO: 362139 - DNA, 25 bp, Mus musculus
cgcctcagcctattggagtacaggt

SEQ ID NO: 362140 - DNA, 25 bp, Mus musculus
cgcctcaggtggattttgtgttact

SEQ ID NO: 362141 - DNA, 25 bp, Mus musculus
cgcctcaggtggtttttgtgttact

SEQ ID NO: 362142 - DNA, 25 bp, Mus musculus
cgcctcatactcatccaagacggag

SEQ ID NO: 362143 - DNA, 25 bp, Mus musculus
cgcctcatactcttccaagacggag

SEQ ID NO: 362144 - DNA, 25 bp, Mus musculus
cgcctcattatcaggcctgtgatag

SEQ ID NO: 362145 - DNA, 25 bp, Mus musculus
cgcctcattatctggcctgtgatag

SEQ ID NO: 362146 - DNA, 25 bp, Mus musculus
cgcctccaatatctaattcttaatg

SEQ ID NO: 362147 - DNA, 25 bp, Mus musculus
cgcctccaatatgtaattcttaatg

SEQ ID NO: 362148 - DNA, 25 bp, Mus musculus
cgcctccagaaactgttgcaggaca

SEQ ID NO: 362149 - DNA, 25 bp, Mus musculus
cgcctccagaaagtgttgcaggaca

SEQ ID NO: 362150 - DNA, 25 bp, Mus musculus
cgcctcccgagcagcaggaaggagc

SEQ ID NO: 362151 - DNA, 25 bp, Mus musculus
cgcctcccgagctgcaggaaggagc

SEQ ID NO: 362152 - DNA, 25 bp, Mus musculus
cgcctcccgtggagatgtggtgaaa

SEQ ID NO: 362153 - DNA, 25 bp, Mus musculus
cgcctcccgtggtgatgtggtgaaa

SEQ ID NO: 362154 - DNA, 25 bp, Mus musculus
cgcctccctggaccatagaagagat

SEQ ID NO: 362155 - DNA, 25 bp, Mus musculus
cgcctccctggagcatagaagagat

SEQ ID NO: 362156 - DNA, 25 bp, Mus musculus
cgcctcctaggtcacatcatttctt

SEQ ID NO: 362157 - DNA, 25 bp, Mus musculus
cgcctcctaggtgacatcatttctt

SEQ ID NO: 362158 - DNA, 25 bp, Mus musculus
cgcctcctatatagaactctctgaa

SEQ ID NO: 362159 - DNA, 25 bp, Mus musculus
cgcctcctatattgaactctctgaa

SEQ ID NO: 362160 - DNA, 25 bp, Mus musculus
cgcctcggattcactttaatacagt

SEQ ID NO: 362161 - DNA, 25 bp, Mus musculus
cgcctcggattctctttaatacagt

SEQ ID NO: 362162 - DNA, 25 bp, Mus musculus
cgcctctaccttaacagtacaggac

SEQ ID NO: 362163 - DNA, 25 bp, Mus musculus
cgcctctacctttacagtacaggac

SEQ ID NO: 362164 - DNA, 25 bp, Mus musculus
cgcctctcaccacggactagaaagt

SEQ ID NO: 362165 - DNA, 25 bp, Mus musculus
cgcctctcaccagggactagaaagt

SEQ ID NO: 362166 - DNA, 25 bp, Mus musculus
cgcctctgacatcaactcaaggaaa

SEQ ID NO: 362167 - DNA, 25 bp, Mus musculus
cgcctctgacatgaactcaaggaaa

SEQ ID NO: 362168 - DNA, 25 bp, Mus musculus
cgcctctgcattccagggcgctgtc

SEQ ID NO: 362169 - DNA, 25 bp, Mus musculus
cgcctctgcattgcagggcgctgtc

SEQ ID NO: 362170 - DNA, 25 bp, Mus musculus
cgcctctgtccaacatttcatctgt

SEQ ID NO: 362171 - DNA, 25 bp, Mus musculus
cgcctctgtccatcatttcatctgt

SEQ ID NO: 362172 - DNA, 25 bp, Mus musculus
cgcctcttccggaacatttttgttg

SEQ ID NO: 362173 - DNA, 25 bp, Mus musculus
cgcctcttccggtacatttttgttg

SEQ ID NO: 362174 - DNA, 25 bp, Mus musculus
cgcctgaaggctacgtgttccggga

SEQ ID NO: 362175 - DNA, 25 bp, Mus musculus
cgcctgaaggcttcgtgttccggga

SEQ ID NO: 362176 - DNA, 25 bp, Mus musculus
cgcctgatgattatttgggtcggac

SEQ ID NO: 362177 - DNA, 25 bp, Mus musculus
cgcctgatgattttttgggtcggac

SEQ ID NO: 362178 - DNA, 25 bp, Mus musculus
cgcctgattctcactggagcggagg

SEQ ID NO: 362179 - DNA, 25 bp, Mus musculus
cgcctgattctctctggagcggagg

SEQ ID NO: 362180 - DNA, 25 bp, Mus musculus
cgcctgcataggagcaattgatttc

SEQ ID NO: 362181 - DNA, 25 bp, Mus musculus
cgcctgcataggtgcaattgatttc

SEQ ID NO: 362182 - DNA, 25 bp, Mus musculus
cgcctgctaggcatgtgcgtagaaa

SEQ ID NO: 362183 - DNA, 25 bp, Mus musculus
cgcctgctaggcttgtgcgtagaaa

SEQ ID NO: 362184 - DNA, 25 bp, Mus musculus
cgcctggaagccctcgatgccaatt

SEQ ID NO: 362185 - DNA, 25 bp, Mus musculus
cgcctggaagccgtcgatgccaatt

SEQ ID NO: 362186 - DNA, 25 bp, Mus musculus
cgcctggacatacacccgaaggact

SEQ ID NO: 362187 - DNA, 25 bp, Mus musculus
cgcctggacatagacccgaaggact

SEQ ID NO: 362188 - DNA, 25 bp, Mus musculus
cgcctggagaccctagaccctggtg

SEQ ID NO: 362189 - DNA, 25 bp, Mus musculus
cgcctggagaccgtagaccctggtg

SEQ ID NO: 362190 - DNA, 25 bp, Mus musculus
cgcctggataccccagctaggaata

SEQ ID NO: 362191 - DNA, 25 bp, Mus musculus
cgcctggataccgcagctaggaata

SEQ ID NO: 362192 - DNA, 25 bp, Mus musculus
cgcctggcccatatctagatttaaa

SEQ ID NO: 362193 - DNA, 25 bp, Mus musculus
cgcctggcccatttctagatttaaa

SEQ ID NO: 362194 - DNA, 25 bp, Mus musculus
cgcctgggacggcagaaaacaatga

SEQ ID NO: 362195 - DNA, 25 bp, Mus musculus
cgcctgggacgggagaaaacaatga

SEQ ID NO: 362196 - DNA, 25 bp, Mus musculus
cgcctgggcggcaaagtttatgctt

SEQ ID NO: 362197 - DNA, 25 bp, Mus musculus
cgcctgggcggctaagtttatgctt

SEQ ID NO: 362198 - DNA, 25 bp, Mus musculus
cgcctgggctccaagaatccttgct

SEQ ID NO: 362199 - DNA, 25 bp, Mus musculus
cgcctgggctcctagaatccttgct

SEQ ID NO: 362200 - DNA, 25 bp, Mus musculus
cgcctggggagtcatcatgttgata

SEQ ID NO: 362201 - DNA, 25 bp, Mus musculus
cgcctggggagtgatcatgttgata

SEQ ID NO: 362202 - DNA, 25 bp, Mus musculus
cgcctggtccagattatcaaagaca

SEQ ID NO: 362203 - DNA, 25 bp, Mus musculus
cgcctggtccagtttatcaaagaca

SEQ ID NO: 362204 - DNA, 25 bp, Mus musculus
cgcctgtacttcatgaccttttaca

SEQ ID NO: 362205 - DNA, 25 bp, Mus musculus
cgcctgtacttcttgaccttttaca

SEQ ID NO: 362206 - DNA, 25 bp, Mus musculus
cgcctgtccagcctgcaactttggg

SEQ ID NO: 362207 - DNA, 25 bp, Mus musculus
cgcctgtccagcgtgcaactttggg

SEQ ID NO: 362208 - DNA, 25 bp, Mus musculus
cgcctgtctatcaagggcttgttaa

SEQ ID NO: 362209 - DNA, 25 bp, Mus musculus
cgcctgtctatctagggcttgttaa

SEQ ID NO: 362210 - DNA, 25 bp, Mus musculus
cgcctgtctgtaatgtcctaatgtt

SEQ ID NO: 362211 - DNA, 25 bp, Mus musculus
cgcctgtctgtattgtcctaatgtt

SEQ ID NO: 362212 - DNA, 25 bp, Mus musculus
cgcctgtgctggacccgtgagaaga

SEQ ID NO: 362213 - DNA, 25 bp, Mus musculus
cgcctgtgctggtcccgtgagaaga

SEQ ID NO: 362214 - DNA, 25 bp, Mus musculus
cgcctgtttgttacgatgcagatat

SEQ ID NO: 362215 - DNA, 25 bp, Mus musculus
cgcctgtttgtttcgatgcagatat

SEQ ID NO: 362216 - DNA, 25 bp, Mus musculus
cgccttcagggaagctaacttctta

SEQ ID NO: 362217 - DNA, 25 bp, Mus musculus
cgccttcagggatgctaacttctta

SEQ ID NO: 362218 - DNA, 25 bp, Mus musculus
cgccttccgtatccgggtcaacaga

SEQ ID NO: 362219 - DNA, 25 bp, Mus musculus
cgccttccgtatgcgggtcaacaga

SEQ ID NO: 362220 - DNA, 25 bp, Mus musculus
cgccttcctcaaagggtatggtcat

SEQ ID NO: 362221 - DNA, 25 bp, Mus musculus
cgccttcctcaatgggtatggtcat

SEQ ID NO: 362222 - DNA, 25 bp, Mus musculus
cgccttctggatctggcacaagtaa

SEQ ID NO: 362223 - DNA, 25 bp, Mus musculus
cgccttctggatgtggcacaagtaa

SEQ ID NO: 362224 - DNA, 25 bp, Mus musculus
cgccttcttgtaaatgttgtatatg

SEQ ID NO: 362225 - DNA, 25 bp, Mus musculus
cgccttcttgtatatgttgtatatg

SEQ ID NO: 362226 - DNA, 25 bp, Mus musculus
cgccttgaattacgccttcatgtcc

SEQ ID NO: 362227 - DNA, 25 bp, Mus musculus
cgccttgaattaggccttcatgtcc

SEQ ID NO: 362228 - DNA, 25 bp, Mus musculus
cgccttgcaggccttgggactgtca

SEQ ID NO: 362229 - DNA, 25 bp, Mus musculus
cgccttgcaggcgttgggactgtca

SEQ ID NO: 362230 - DNA, 25 bp, Mus musculus
cgccttgtggaacggacctgcttta

SEQ ID NO: 362231 - DNA, 25 bp, Mus musculus
cgccttgtggaagggacctgcttta

SEQ ID NO: 362232 - DNA, 25 bp, Mus musculus
cgcctttgcgggaacagggtgctat

SEQ ID NO: 362233 - DNA, 25 bp, Mus musculus
cgcctttgcgggtacagggtgctat

SEQ ID NO: 362234 - DNA, 25 bp, Mus musculus
cgcctttgtgctagtcttgtatgat

SEQ ID NO: 362235 - DNA, 25 bp, Mus musculus
cgcctttgtgcttgtcttgtatgat

SEQ ID NO: 362236 - DNA, 25 bp, Mus musculus
cgccttttttgcacgagatagacca

SEQ ID NO: 362237 - DNA, 25 bp, Mus musculus
cgccttttttgctcgagatagacca

SEQ ID NO: 362238 - DNA, 25 bp, Mus musculus
cgcgaaacgggcctgcaggaggtca

SEQ ID NO: 362239 - DNA, 25 bp, Mus musculus
cgcgaaacgggcgtgcaggaggtca

SEQ ID NO: 362240 - DNA, 25 bp, Mus musculus
cgcgaacacgcaagcgcagatcaaa

SEQ ID NO: 362241 - DNA, 25 bp, Mus musculus
cgcgaacacgcatgcgcagatcaaa

SEQ ID NO: 362242 - DNA, 25 bp, Mus musculus
cgcgaactccggagattagaaagat

SEQ ID NO: 362243 - DNA, 25 bp, Mus musculus
cgcgaactccggtgattagaaagat

SEQ ID NO: 362244 - DNA, 25 bp, Mus musculus
cgcgaagactggctacaacgtgaag

SEQ ID NO: 362245 - DNA, 25 bp, Mus musculus
cgcgaagactgggtacaacgtgaag

SEQ ID NO: 362246 - DNA, 25 bp, Mus musculus
cgcgaccacccgcagacaagaagga

SEQ ID NO: 362247 - DNA, 25 bp, Mus musculus
cgcgaccacccggagacaagaagga

SEQ ID NO: 362248 - DNA, 25 bp, Mus musculus
cgcgacgatcgccaagttccatctt

SEQ ID NO: 362249 - DNA, 25 bp, Mus musculus
cgcgacgatcgcgaagttccatctt

SEQ ID NO: 362250 - DNA, 25 bp, Mus musculus
cgcgacggtcctcgcgcagcaaaaa

SEQ ID NO: 362251 - DNA, 25 bp, Mus musculus
cgcgacggtcctggcgcagcaaaaa

SEQ ID NO: 362252 - DNA, 25 bp, Mus musculus
cgcgactttcccatctttgaaagca

SEQ ID NO: 362253 - DNA, 25 bp, Mus musculus
cgcgactttcccttctttgaaagca

SEQ ID NO: 362254 - DNA, 25 bp, Mus musculus
cgcgagaaacgtcctttataataaa

SEQ ID NO: 362255 - DNA, 25 bp, Mus musculus
cgcgagaaacgtgctttataataaa

SEQ ID NO: 362256 - DNA, 25 bp, Mus musculus
cgcgagctaaacacacccagtttga

SEQ ID NO: 362257 - DNA, 25 bp, Mus musculus
cgcgagctaaactcacccagtttga

SEQ ID NO: 362258 - DNA, 25 bp, Mus musculus
cgcgaggtatcactacatgcttttt

SEQ ID NO: 362259 - DNA, 25 bp, Mus musculus
cgcgaggtatcagtacatgcttttt

SEQ ID NO: 362260 - DNA, 25 bp, Mus musculus
cgcgagtcctggaaagagccattaa

SEQ ID NO: 362261 - DNA, 25 bp, Mus musculus
cgcgagtcctggtaagagccattaa

SEQ ID NO: 362262 - DNA, 25 bp, Mus musculus
cgcgatctcccgacccggtggacgg

SEQ ID NO: 362263 - DNA, 25 bp, Mus musculus
cgcgatctcccgtcccggtggacgg

SEQ ID NO: 362264 - DNA, 25 bp, Mus musculus
cgcgatgaagggagcaaggcttttt

SEQ ID NO: 362265 - DNA, 25 bp, Mus musculus
cgcgatgaagggtgcaaggcttttt

SEQ ID NO: 362266 - DNA, 25 bp, Mus musculus
cgcgatggggcccttttaaagatat

SEQ ID NO: 362267 - DNA, 25 bp, Mus musculus
cgcgatggggccgttttaaagatat

SEQ ID NO: 362268 - DNA, 25 bp, Mus musculus
cgcgcaagacgcagtcggtgaagct

SEQ ID NO: 362269 - DNA, 25 bp, Mus musculus
cgcgcaagacgctgtcggtgaagct

SEQ ID NO: 362270 - DNA, 25 bp, Mus musculus
cgcgcaaggaggacatgcagactaa

SEQ ID NO: 362271 - DNA, 25 bp, Mus musculus
cgcgcaaggaggtcatgcagactaa

SEQ ID NO: 362272 - DNA, 25 bp, Mus musculus
cgcgcaaggcacacggagaactgca

SEQ ID NO: 362273 - DNA, 25 bp, Mus musculus
cgcgcaaggcactcggagaactgca

SEQ ID NO: 362274 - DNA, 25 bp, Mus musculus
cgcgcacgcagcatggtcaagggaa

SEQ ID NO: 362275 - DNA, 25 bp, Mus musculus
cgcgcacgcagcttggtcaagggaa

SEQ ID NO: 362276 - DNA, 25 bp, Mus musculus
cgcgcacgctgcagtacaagttact

SEQ ID NO: 362277 - DNA, 25 bp, Mus musculus
cgcgcacgctgctgtacaagttact

SEQ ID NO: 362278 - DNA, 25 bp, Mus musculus
cgcgcagaatgccaaagtgattgaa

SEQ ID NO: 362279 - DNA, 25 bp, Mus musculus
cgcgcagaatgcgaaagtgattgaa

SEQ ID NO: 362280 - DNA, 25 bp, Mus musculus
cgcgcagcagtgagtgccgccgcaa

SEQ ID NO: 362281 - DNA, 25 bp, Mus musculus
cgcgcagcagtgtgtgccgccgcaa

SEQ ID NO: 362282 - DNA, 25 bp, Mus musculus
cgcgcagtgggcctgacaagatcaa

SEQ ID NO: 362283 - DNA, 25 bp, Mus musculus
cgcgcagtgggcgtgacaagatcaa

SEQ ID NO: 362284 - DNA, 25 bp, Mus musculus
cgcgcatctgccctattaagctaga

SEQ ID NO: 362285 - DNA, 25 bp, Mus musculus
cgcgcatctgccgtattaagctaga

SEQ ID NO: 362286 - DNA, 25 bp, Mus musculus
cgcgccacatatccgtgttctatat

SEQ ID NO: 362287 - DNA, 25 bp, Mus musculus
cgcgccacatatgcgtgttctatat

SEQ ID NO: 362288 - DNA, 25 bp, Mus musculus
cgcgccattcacagacatgattgca

SEQ ID NO: 362289 - DNA, 25 bp, Mus musculus
cgcgccattcactgacatgattgca

SEQ ID NO: 362290 - DNA, 25 bp, Mus musculus
cgcgccattgaaactcagtgctatg

SEQ ID NO: 362291 - DNA, 25 bp, Mus musculus
cgcgccattgaatctcagtgctatg

SEQ ID NO: 362292 - DNA, 25 bp, Mus musculus
cgcgcccatgacaggaaccattgaa

SEQ ID NO: 362293 - DNA, 25 bp, Mus musculus
cgcgcccatgactggaaccattgaa

SEQ ID NO: 362294 - DNA, 25 bp, Mus musculus
cgcgcccgggcgattgagaggagct

SEQ ID NO: 362295 - DNA, 25 bp, Mus musculus
cgcgcccgggcgtttgagaggagct

SEQ ID NO: 362296 - DNA, 25 bp, Mus musculus
cgcgccctggacagtaatgtttaga

SEQ ID NO: 362297 - DNA, 25 bp, Mus musculus
cgcgccctggactgtaatgtttaga

SEQ ID NO: 362298 - DNA, 25 bp, Mus musculus
cgcgcccttgttatgcgtgtattaa

SEQ ID NO: 362299 - DNA, 25 bp, Mus musculus
cgcgcccttgttttgcgtgtattaa

SEQ ID NO: 362300 - DNA, 25 bp, Mus musculus
cgcgccgaggctcgctagagccgga

SEQ ID NO: 362301 - DNA, 25 bp, Mus musculus
cgcgccgaggctggctagagccgga

SEQ ID NO: 362302 - DNA, 25 bp, Mus musculus
cgcgccgctgctcggagagatcccc

SEQ ID NO: 362303 - DNA, 25 bp, Mus musculus
cgcgccgctgctgggagagatcccc

SEQ ID NO: 362304 - DNA, 25 bp, Mus musculus
cgcgcgagaacgaccagctggattt

SEQ ID NO: 362305 - DNA, 25 bp, Mus musculus
cgcgcgagaacgtccagctggattt

SEQ ID NO: 362306 - DNA, 25 bp, Mus musculus
cgcgcgagccttccagatggagaaa

SEQ ID NO: 362307 - DNA, 25 bp, Mus musculus
cgcgcgagccttgcagatggagaaa

SEQ ID NO: 362308 - DNA, 25 bp, Mus musculus
cgcgcgcatgaaagcaggtacccat

SEQ ID NO: 362309 - DNA, 25 bp, Mus musculus
cgcgcgcatgaatgcaggtacccat

SEQ ID NO: 362310 - DNA, 25 bp, Mus musculus
cgcgcgccaacgatgacaaggtatt

SEQ ID NO: 362311 - DNA, 25 bp, Mus musculus
cgcgcgccaacgttgacaaggtatt

SEQ ID NO: 362312 - DNA, 25 bp, Mus musculus
cgcgcgccattgacctatgccttaa

SEQ ID NO: 362313 - DNA, 25 bp, Mus musculus
cgcgcgccattgtcctatgccttaa

SEQ ID NO: 362314 - DNA, 25 bp, Mus musculus
cgcgcgggcggcaggagacagtgga

SEQ ID NO: 362315 - DNA, 25 bp, Mus musculus
cgcgcgggcggctggagacagtgga

SEQ ID NO: 362316 - DNA, 25 bp, Mus musculus
cgcgcgtggcccacaggaagctgta

SEQ ID NO: 362317 - DNA, 25 bp, Mus musculus
cgcgcgtggccctcaggaagctgta

SEQ ID NO: 362318 - DNA, 25 bp, Mus musculus
cgcgctacaaaaccgggctggaagc

SEQ ID NO: 362319 - DNA, 25 bp, Mus musculus
cgcgctacaaaagcgggctggaagc

SEQ ID NO: 362320 - DNA, 25 bp, Mus musculus
cgcgctacactgactggctcagcgt

SEQ ID NO: 362321 - DNA, 25 bp, Mus musculus
cgcgctacactgtctggctcagcgt

SEQ ID NO: 362322 - DNA, 25 bp, Mus musculus
cgcgctaccgggaactggccagaaa

SEQ ID NO: 362323 - DNA, 25 bp, Mus musculus
cgcgctaccgggtactggccagaaa

SEQ ID NO: 362324 - DNA, 25 bp, Mus musculus
cgcgctatccttacggtgagggaac

SEQ ID NO: 362325 - DNA, 25 bp, Mus musculus
cgcgctatcctttcggtgagggaac

SEQ ID NO: 362326 - DNA, 25 bp, Mus musculus
cgcgctgacaacatcaaactctttg

SEQ ID NO: 362327 - DNA, 25 bp, Mus musculus
cgcgctgacaacttcaaactctttg

SEQ ID NO: 362328 - DNA, 25 bp, Mus musculus
cgcgctgcagccagagtcagggtaa

SEQ ID NO: 362329 - DNA, 25 bp, Mus musculus
cgcgctgcagcctgagtcagggtaa

SEQ ID NO: 362330 - DNA, 25 bp, Mus musculus
cgcgcttctaagataccttgtgctt

SEQ ID NO: 362331 - DNA, 25 bp, Mus musculus
cgcgcttctaagttaccttgtgctt

SEQ ID NO: 362332 - DNA, 25 bp, Mus musculus
cgcgcttggttcactgtctttattt

SEQ ID NO: 362333 - DNA, 25 bp, Mus musculus
cgcgcttggttctctgtctttattt

SEQ ID NO: 362334 - DNA, 25 bp, Mus musculus
cgcgctttgtctcgagtctcggtag

SEQ ID NO: 362335 - DNA, 25 bp, Mus musculus
cgcgctttgtctggagtctcggtag

SEQ ID NO: 362336 - DNA, 25 bp, Mus musculus
cgcgcttttgtgatggagtgctgtt

SEQ ID NO: 362337 - DNA, 25 bp, Mus musculus
cgcgcttttgtgttggagtgctgtt

SEQ ID NO: 362338 - DNA, 25 bp, Mus musculus
cgcggaataacaccctgatactcaa

SEQ ID NO: 362339 - DNA, 25 bp, Mus musculus
cgcggaataacagcctgatactcaa

SEQ ID NO: 362340 - DNA, 25 bp, Mus musculus
cgcggagagcgtccagattcagttc

SEQ ID NO: 362341 - DNA, 25 bp, Mus musculus
cgcggagagcgtgcagattcagttc

SEQ ID NO: 362342 - DNA, 25 bp, Mus musculus
cgcggaggtctcacccaagaagtag

SEQ ID NO: 362343 - DNA, 25 bp, Mus musculus
cgcggaggtctctcccaagaagtag

SEQ ID NO: 362344 - DNA, 25 bp, Mus musculus
cgcggaggtggcaggtatcacattt

SEQ ID NO: 362345 - DNA, 25 bp, Mus musculus
cgcggaggtggctggtatcacattt

SEQ ID NO: 362346 - DNA, 25 bp, Mus musculus
cgcggatccgagagcacaagatgta

SEQ ID NO: 362347 - DNA, 25 bp, Mus musculus
cgcggatccgagtgcacaagatgta

SEQ ID NO: 362348 - DNA, 25 bp, Mus musculus
cgcggatgagcccatcagacaaaga

SEQ ID NO: 362349 - DNA, 25 bp, Mus musculus
cgcggatgagccgatcagacaaaga

SEQ ID NO: 362350 - DNA, 25 bp, Mus musculus
cgcggcaaagccaaggtcaatcaag

SEQ ID NO: 362351 - DNA, 25 bp, Mus musculus
cgcggcaaagcctaggtcaatcaag

SEQ ID NO: 362352 - DNA, 25 bp, Mus musculus
cgcggcagccacatagggcaggatt

SEQ ID NO: 362353 - DNA, 25 bp, Mus musculus
cgcggcagccacttagggcaggatt

SEQ ID NO: 362354 - DNA, 25 bp, Mus musculus
cgcggccgctgacatgttcgacaac

SEQ ID NO: 362355 - DNA, 25 bp, Mus musculus
cgcggccgctgagatgttcgacaac

SEQ ID NO: 362356 - DNA, 25 bp, Mus musculus
cgcggccgtcgcaatggagacagat

SEQ ID NO: 362357 - DNA, 25 bp, Mus musculus
cgcggccgtcgctatggagacagat

SEQ ID NO: 362358 - DNA, 25 bp, Mus musculus
cgcggctattgcaaccatcaagaca

SEQ ID NO: 362359 - DNA, 25 bp, Mus musculus
cgcggctattgctaccatcaagaca

SEQ ID NO: 362360 - DNA, 25 bp, Mus musculus
cgcggctccgctacggtaaatagga

SEQ ID NO: 362361 - DNA, 25 bp, Mus musculus
cgcggctccgcttcggtaaatagga

SEQ ID NO: 362362 - DNA, 25 bp, Mus musculus
cgcggctctttacgctgagatgttt

SEQ ID NO: 362363 - DNA, 25 bp, Mus musculus
cgcggctctttaggctgagatgttt

SEQ ID NO: 362364 - DNA, 25 bp, Mus musculus
cgcggctggaagatgcgcttagcca

SEQ ID NO: 362365 - DNA, 25 bp, Mus musculus
cgcggctggaagttgcgcttagcca

SEQ ID NO: 362366 - DNA, 25 bp, Mus musculus
cgcggctgtcagacctaagtgcaaa

SEQ ID NO: 362367 - DNA, 25 bp, Mus musculus
cgcggctgtcagtcctaagtgcaaa

SEQ ID NO: 362368 - DNA, 25 bp, Mus musculus
cgcgggaagcctcgcatgagtcact

SEQ ID NO: 362369 - DNA, 25 bp, Mus musculus
cgcgggaagcctggcatgagtcact

SEQ ID NO: 362370 - DNA, 25 bp, Mus musculus
cgcgggcaagaaccgctttgaagtt

SEQ ID NO: 362371 - DNA, 25 bp, Mus musculus
cgcgggcaagaagcgctttgaagtt

SEQ ID NO: 362372 - DNA, 25 bp, Mus musculus
cgcgggcttcgaccctcctgaaaga

SEQ ID NO: 362373 - DNA, 25 bp, Mus musculus
cgcgggcttcgagcctcctgaaaga

SEQ ID NO: 362374 - DNA, 25 bp, Mus musculus
cgcggtacagacctggtctctgtga

SEQ ID NO: 362375 - DNA, 25 bp, Mus musculus
cgcggtacagacgtggtctctgtga

SEQ ID NO: 362376 - DNA, 25 bp, Mus musculus
cgcggtcattccagtactctgttat

SEQ ID NO: 362377 - DNA, 25 bp, Mus musculus
cgcggtcattcctgtactctgttat

SEQ ID NO: 362378 - DNA, 25 bp, Mus musculus
cgcggtccattcatttgtgtttcat

SEQ ID NO: 362379 - DNA, 25 bp, Mus musculus
cgcggtccattcttttgtgtttcat

SEQ ID NO: 362380 - DNA, 25 bp, Mus musculus
cgcggtcgtggccaggacatacctc

SEQ ID NO: 362381 - DNA, 25 bp, Mus musculus
cgcggtcgtggcgaggacatacctc

SEQ ID NO: 362382 - DNA, 25 bp, Mus musculus
cgcggtggatggattctaagatgat

SEQ ID NO: 362383 - DNA, 25 bp, Mus musculus
cgcggtggatggtttctaagatgat

SEQ ID NO: 362384 - DNA, 25 bp, Mus musculus
cgcggttccaccaggggataggata

SEQ ID NO: 362385 - DNA, 25 bp, Mus musculus
cgcggttccacctggggataggata

SEQ ID NO: 362386 - DNA, 25 bp, Mus musculus
cgcggttgacgcagtttttaggaag

SEQ ID NO: 362387 - DNA, 25 bp, Mus musculus
cgcggttgacgctgtttttaggaag

SEQ ID NO: 362388 - DNA, 25 bp, Mus musculus
cgcggtttgcttagggcccaggatt

SEQ ID NO: 362389 - DNA, 25 bp, Mus musculus
cgcggtttgctttgggcccaggatt

SEQ ID NO: 362390 - DNA, 25 bp, Mus musculus
cgcgtcacccagagtgagtgcaaat

SEQ ID NO: 362391 - DNA, 25 bp, Mus musculus
cgcgtcacccagtgtgagtgcaaat

SEQ ID NO: 362392 - DNA, 25 bp, Mus musculus
cgcgtcagtcatcccgaagcacgag

SEQ ID NO: 362393 - DNA, 25 bp, Mus musculus
cgcgtcagtcatgccgaagcacgag

SEQ ID NO: 362394 - DNA, 25 bp, Mus musculus
cgcgtcattcctatctctagaatta

SEQ ID NO: 362395 - DNA, 25 bp, Mus musculus
cgcgtcattcctttctctagaatta

SEQ ID NO: 362396 - DNA, 25 bp, Mus musculus
cgcgtccacacacatacagcttcct

SEQ ID NO: 362397 - DNA, 25 bp, Mus musculus
cgcgtccacacagatacagcttcct

SEQ ID NO: 362398 - DNA, 25 bp, Mus musculus
cgcgtcctcgctcgcatatagttaa

SEQ ID NO: 362399 - DNA, 25 bp, Mus musculus
cgcgtcctcgctggcatatagttaa

SEQ ID NO: 362400 - DNA, 25 bp, Mus musculus
cgcgtcgctgtgaaaggctgcacga

SEQ ID NO: 362401 - DNA, 25 bp, Mus musculus
cgcgtcgctgtgtaaggctgcacga

SEQ ID NO: 362402 - DNA, 25 bp, Mus musculus
cgcgtcgtcgcaaaagctgtgctga

SEQ ID NO: 362403 - DNA, 25 bp, Mus musculus
cgcgtcgtcgcataagctgtgctga

SEQ ID NO: 362404 - DNA, 25 bp, Mus musculus
cgcgtctggattccagtgcggtcct

SEQ ID NO: 362405 - DNA, 25 bp, Mus musculus
cgcgtctggattgcagtgcggtcct

SEQ ID NO: 362406 - DNA, 25 bp, Mus musculus
cgcgtgcggttcaacctgatggaga

SEQ ID NO: 362407 - DNA, 25 bp, Mus musculus
cgcgtgcggttctacctgatggaga

SEQ ID NO: 362408 - DNA, 25 bp, Mus musculus
cgcgtgcgtctcattttggaatcta

SEQ ID NO: 362409 - DNA, 25 bp, Mus musculus
cgcgtgcgtctctttttggaatcta

SEQ ID NO: 362410 - DNA, 25 bp, Mus musculus
cgcgtgctggttaggcagtatgaaa

SEQ ID NO: 362411 - DNA, 25 bp, Mus musculus
cgcgtgctggtttggcagtatgaaa

SEQ ID NO: 362412 - DNA, 25 bp, Mus musculus
cgcgtgggtccactggatcgaaata

SEQ ID NO: 362413 - DNA, 25 bp, Mus musculus
cgcgtgggtccagtggatcgaaata

SEQ ID NO: 362414 - DNA, 25 bp, Mus musculus
cgcgtggtagttaagtgtgctgttt

SEQ ID NO: 362415 - DNA, 25 bp, Mus musculus
cgcgtggtagtttagtgtgctgttt

SEQ ID NO: 362416 - DNA, 25 bp, Mus musculus
cgcgtggtcttcacggacaaggaga

SEQ ID NO: 362417 - DNA, 25 bp, Mus musculus
cgcgtggtcttctcggacaaggaga

SEQ ID NO: 362418 - DNA, 25 bp, Mus musculus
cgcgtggtggttacgaatggccatt

SEQ ID NO: 362419 - DNA, 25 bp, Mus musculus
cgcgtggtggtttcgaatggccatt

SEQ ID NO: 362420 - DNA, 25 bp, Mus musculus
cgcgtgtaaagccactgtatgcatg

SEQ ID NO: 362421 - DNA, 25 bp, Mus musculus
cgcgtgtaaagcgactgtatgcatg

SEQ ID NO: 362422 - DNA, 25 bp, Mus musculus
cgcgtgtgcgggatgtaaatgttct

SEQ ID NO: 362423 - DNA, 25 bp, Mus musculus
cgcgtgtgcgggttgtaaatgttct

SEQ ID NO: 362424 - DNA, 25 bp, Mus musculus
cgcgttatccaaaagctgcggaact

SEQ ID NO: 362425 - DNA, 25 bp, Mus musculus
cgcgttatccaatagctgcggaact

SEQ ID NO: 362426 - DNA, 25 bp, Mus musculus
cgcgttcccaatctgtagacggact

SEQ ID NO: 362427 - DNA, 25 bp, Mus musculus
cgcgttcccaatgtgtagacggact

SEQ ID NO: 362428 - DNA, 25 bp, Mus musculus
cgcgttcttttcactggtttatcta

SEQ ID NO: 362429 - DNA, 25 bp, Mus musculus
cgcgttcttttctctggtttatcta

SEQ ID NO: 362430 - DNA, 25 bp, Mus musculus
cgcgttgaccgcagatgtttgcaaa

SEQ ID NO: 362431 - DNA, 25 bp, Mus musculus
cgcgttgaccgctgatgtttgcaaa

SEQ ID NO: 362432 - DNA, 25 bp, Mus musculus
cgcgttgcaagtccagcgagtctca

SEQ ID NO: 362433 - DNA, 25 bp, Mus musculus
cgcgttgcaagtgcagcgagtctca

SEQ ID NO: 362434 - DNA, 25 bp, Mus musculus
cgcgttgcctttcacgagctggtga

SEQ ID NO: 362435 - DNA, 25 bp, Mus musculus
cgcgttgcctttgacgagctggtga

SEQ ID NO: 362436 - DNA, 25 bp, Mus musculus
cgcgttgttgccatccagggagtga

SEQ ID NO: 362437 - DNA, 25 bp, Mus musculus
cgcgttgttgccttccagggagtga

SEQ ID NO: 362438 - DNA, 25 bp, Mus musculus
cgcgtttaacgtcaagttctggtgt

SEQ ID NO: 362439 - DNA, 25 bp, Mus musculus
cgcgtttaacgtgaagttctggtgt

SEQ ID NO: 362440 - DNA, 25 bp, Mus musculus
cgcgtttatacgctgaagaaatttg

SEQ ID NO: 362441 - DNA, 25 bp, Mus musculus
cgcgtttatacggtgaagaaatttg

SEQ ID NO: 362442 - DNA, 25 bp, Mus musculus
cgcgtttctactcggctgtgccaag

SEQ ID NO: 362443 - DNA, 25 bp, Mus musculus
cgcgtttctactgggctgtgccaag

SEQ ID NO: 362444 - DNA, 25 bp, Mus musculus
cgcgttttggagaccttggccctga

SEQ ID NO: 362445 - DNA, 25 bp, Mus musculus
cgcgttttggagtccttggccctga

SEQ ID NO: 362446 - DNA, 25 bp, Mus musculus
cgctaagatcaccactgactactat

SEQ ID NO: 362447 - DNA, 25 bp, Mus musculus
cgctaagatcacgactgactactat

SEQ ID NO: 362448 - DNA, 25 bp, Mus musculus
cgctaagcatggcaatcgctctgtc

SEQ ID NO: 362449 - DNA, 25 bp, Mus musculus
cgctaagcatgggaatcgctctgtc

SEQ ID NO: 362450 - DNA, 25 bp, Mus musculus
cgctaagcttgaagacttcttggag

SEQ ID NO: 362451 - DNA, 25 bp, Mus musculus
cgctaagcttgatgacttcttggag

SEQ ID NO: 362452 - DNA, 25 bp, Mus musculus
cgctacaagtttatggaatcgtgcc

SEQ ID NO: 362453 - DNA, 25 bp, Mus musculus
cgctacaagtttttggaatcgtgcc

SEQ ID NO: 362454 - DNA, 25 bp, Mus musculus
cgctaccagcaaatctttacttttc

SEQ ID NO: 362455 - DNA, 25 bp, Mus musculus
cgctaccagcaattctttacttttc

SEQ ID NO: 362456 - DNA, 25 bp, Mus musculus
cgctacccgtagaccgagaaatgaa

SEQ ID NO: 362457 - DNA, 25 bp, Mus musculus
cgctacccgtagtccgagaaatgaa

SEQ ID NO: 362458 - DNA, 25 bp, Mus musculus
cgctacctgcggctggatggaaatt

SEQ ID NO: 362459 - DNA, 25 bp, Mus musculus
cgctacctgcgggtggatggaaatt

SEQ ID NO: 362460 - DNA, 25 bp, Mus musculus
cgctaccttctgaggttacagtgga

SEQ ID NO: 362461 - DNA, 25 bp, Mus musculus
cgctaccttctgtggttacagtgga

SEQ ID NO: 362462 - DNA, 25 bp, Mus musculus
cgctactcgcgtaatccaaaagctg

SEQ ID NO: 362463 - DNA, 25 bp, Mus musculus
cgctactcgcgttatccaaaagctg

SEQ ID NO: 362464 - DNA, 25 bp, Mus musculus
cgctactggtcgcttgacaagctcg

SEQ ID NO: 362465 - DNA, 25 bp, Mus musculus
cgctactggtcggttgacaagctcg

SEQ ID NO: 362466 - DNA, 25 bp, Mus musculus
cgctaggaaccacgctctggaattt

SEQ ID NO: 362467 - DNA, 25 bp, Mus musculus
cgctaggaaccaggctctggaattt

SEQ ID NO: 362468 - DNA, 25 bp, Mus musculus
cgctaggacattcggttttcagggt

SEQ ID NO: 362469 - DNA, 25 bp, Mus musculus
cgctaggacattgggttttcagggt

SEQ ID NO: 362470 - DNA, 25 bp, Mus musculus
cgctaggctcttacattgtttttaa

SEQ ID NO: 362471 - DNA, 25 bp, Mus musculus
cgctaggctctttcattgtttttaa

SEQ ID NO: 362472 - DNA, 25 bp, Mus musculus
cgctaggtaaccctgctaggcctgc

SEQ ID NO: 362473 - DNA, 25 bp, Mus musculus
cgctaggtaaccgtgctaggcctgc

SEQ ID NO: 362474 - DNA, 25 bp, Mus musculus
cgctataatgtgattcctgcgaata

SEQ ID NO: 362475 - DNA, 25 bp, Mus musculus
cgctataatgtgtttcctgcgaata

SEQ ID NO: 362476 - DNA, 25 bp, Mus musculus
cgctataccttaccaccgtgggagg

SEQ ID NO: 362477 - DNA, 25 bp, Mus musculus
cgctataccttagcaccgtgggagg

SEQ ID NO: 362478 - DNA, 25 bp, Mus musculus
cgctatatttagacagtggcagtct

SEQ ID NO: 362479 - DNA, 25 bp, Mus musculus
cgctatatttagtcagtggcagtct

SEQ ID NO: 362480 - DNA, 25 bp, Mus musculus
cgctatctatagaggagtttgaaac

SEQ ID NO: 362481 - DNA, 25 bp, Mus musculus
cgctatctatagtggagtttgaaac

SEQ ID NO: 362482 - DNA, 25 bp, Mus musculus
cgctatgaatgtatgctctgcaaga

SEQ ID NO: 362483 - DNA, 25 bp, Mus musculus
cgctatgaatgtttgctctgcaaga

SEQ ID NO: 362484 - DNA, 25 bp, Mus musculus
cgctatgacatccacatgaccaagt

SEQ ID NO: 362485 - DNA, 25 bp, Mus musculus
cgctatgacatcgacatgaccaagt

SEQ ID NO: 362486 - DNA, 25 bp, Mus musculus
cgctatgacgagaaccgaggctgct

SEQ ID NO: 362487 - DNA, 25 bp, Mus musculus
cgctatgacgagtaccgaggctgct

SEQ ID NO: 362488 - DNA, 25 bp, Mus musculus
cgctatgagaagaatcccgcagttt

SEQ ID NO: 362489 - DNA, 25 bp, Mus musculus
cgctatgagaagtatcccgcagttt

SEQ ID NO: 362490 - DNA, 25 bp, Mus musculus
cgctatgagatacactcatgcttca

SEQ ID NO: 362491 - DNA, 25 bp, Mus musculus
cgctatgagatagactcatgcttca

SEQ ID NO: 362492 - DNA, 25 bp, Mus musculus
cgctatgagctcactacagggcaag

SEQ ID NO: 362493 - DNA, 25 bp, Mus musculus
cgctatgagctctctacagggcaag

SEQ ID NO: 362494 - DNA, 25 bp, Mus musculus
cgctatgcaaatctgcttttgttag

SEQ ID NO: 362495 - DNA, 25 bp, Mus musculus
cgctatgcaaatgtgcttttgttag

SEQ ID NO: 362496 - DNA, 25 bp, Mus musculus
cgctatggcacactgtggagtgact

SEQ ID NO: 362497 - DNA, 25 bp, Mus musculus
cgctatggcacagtgtggagtgact

SEQ ID NO: 362498 - DNA, 25 bp, Mus musculus
cgctatggccgcaggagactatgcg

SEQ ID NO: 362499 - DNA, 25 bp, Mus musculus
cgctatggccgctggagactatgcg

SEQ ID NO: 362500 - DNA, 25 bp, Mus musculus
cgctatggttagagtttgttgatga

SEQ ID NO: 362501 - DNA, 25 bp, Mus musculus
cgctatggttagtgtttgttgatga

SEQ ID NO: 362502 - DNA, 25 bp, Mus musculus
cgctatgtacgtcccagtgccaaag

SEQ ID NO: 362503 - DNA, 25 bp, Mus musculus
cgctatgtacgtgccagtgccaaag

SEQ ID NO: 362504 - DNA, 25 bp, Mus musculus
cgctcaacatgtcccacttgtgtaa

SEQ ID NO: 362505 - DNA, 25 bp, Mus musculus
cgctcaacatgtgccacttgtgtaa

SEQ ID NO: 362506 - DNA, 25 bp, Mus musculus
cgctcaacgactcgaggaactggtt

SEQ ID NO: 362507 - DNA, 25 bp, Mus musculus
cgctcaacgactggaggaactggtt

SEQ ID NO: 362508 - DNA, 25 bp, Mus musculus
cgctcaactgtgacctatagggaga

SEQ ID NO: 362509 - DNA, 25 bp, Mus musculus
cgctcaactgtgtcctatagggaga

SEQ ID NO: 362510 - DNA, 25 bp, Mus musculus
cgctcaagttctctgtgtggcacaa

SEQ ID NO: 362511 - DNA, 25 bp, Mus musculus
cgctcaagttctgtgtgtggcacaa

SEQ ID NO: 362512 - DNA, 25 bp, Mus musculus
cgctcacagccactttgttggtgta

SEQ ID NO: 362513 - DNA, 25 bp, Mus musculus
cgctcacagccagtttgttggtgta

SEQ ID NO: 362514 - DNA, 25 bp, Mus musculus
cgctcaccgtatatcagggatctac

SEQ ID NO: 362515 - DNA, 25 bp, Mus musculus
cgctcaccgtatttcagggatctac

SEQ ID NO: 362516 - DNA, 25 bp, Mus musculus
cgctcactctttcaggactggaggg

SEQ ID NO: 362517 - DNA, 25 bp, Mus musculus
cgctcactctttgaggactggaggg

SEQ ID NO: 362518 - DNA, 25 bp, Mus musculus
cgctcactgagcaaaacttaccttt

SEQ ID NO: 362519 - DNA, 25 bp, Mus musculus
cgctcactgagctaaacttaccttt

SEQ ID NO: 362520 - DNA, 25 bp, Mus musculus
cgctcactttttctatttaaatatt

SEQ ID NO: 362521 - DNA, 25 bp, Mus musculus
cgctcactttttgtatttaaatatt

SEQ ID NO: 362522 - DNA, 25 bp, Mus musculus
cgctcagaaactagtctataaactt

SEQ ID NO: 362523 - DNA, 25 bp, Mus musculus
cgctcagaaacttgtctataaactt

SEQ ID NO: 362524 - DNA, 25 bp, Mus musculus
cgctcagagtcgagttagaggagtc

SEQ ID NO: 362525 - DNA, 25 bp, Mus musculus
cgctcagagtcgtgttagaggagtc

SEQ ID NO: 362526 - DNA, 25 bp, Mus musculus
cgctcagccatgcatcgtgtgttat

SEQ ID NO: 362527 - DNA, 25 bp, Mus musculus
cgctcagccatggatcgtgtgttat

SEQ ID NO: 362528 - DNA, 25 bp, Mus musculus
cgctcagctctacagattgtttctt

SEQ ID NO: 362529 - DNA, 25 bp, Mus musculus
cgctcagctctagagattgtttctt

SEQ ID NO: 362530 - DNA, 25 bp, Mus musculus
cgctcagctctgctaagggatttgt

SEQ ID NO: 362531 - DNA, 25 bp, Mus musculus
cgctcagctctggtaagggatttgt

SEQ ID NO: 362532 - DNA, 25 bp, Mus musculus
cgctcaggagcgagactttgtataa

SEQ ID NO: 362533 - DNA, 25 bp, Mus musculus
cgctcaggagcgtgactttgtataa

SEQ ID NO: 362534 - DNA, 25 bp, Mus musculus
cgctcaggcatcatgtgtaggctca

SEQ ID NO: 362535 - DNA, 25 bp, Mus musculus
cgctcaggcatcttgtgtaggctca

SEQ ID NO: 362536 - DNA, 25 bp, Mus musculus
cgctcaggcctgcaattggaggaat

SEQ ID NO: 362537 - DNA, 25 bp, Mus musculus
cgctcaggcctggaattggaggaat

SEQ ID NO: 362538 - DNA, 25 bp, Mus musculus
cgctcaggctggagtctgacatatt

SEQ ID NO: 362539 - DNA, 25 bp, Mus musculus
cgctcaggctggtgtctgacatatt

SEQ ID NO: 362540 - DNA, 25 bp, Mus musculus
cgctcaggtggaccgtcagcagctt

SEQ ID NO: 362541 - DNA, 25 bp, Mus musculus
cgctcaggtggagcgtcagcagctt

SEQ ID NO: 362542 - DNA, 25 bp, Mus musculus
cgctcagtgattctaaacgggacgc

SEQ ID NO: 362543 - DNA, 25 bp, Mus musculus
cgctcagtgattgtaaacgggacgc

SEQ ID NO: 362544 - DNA, 25 bp, Mus musculus
cgctcatcaaggacaacgacaccgt

SEQ ID NO: 362545 - DNA, 25 bp, Mus musculus
cgctcatcaaggtcaacgacaccgt

SEQ ID NO: 362546 - DNA, 25 bp, Mus musculus
cgctccagtcctcaaaacagactag

SEQ ID NO: 362547 - DNA, 25 bp, Mus musculus
cgctccagtcctgaaaacagactag

SEQ ID NO: 362548 - DNA, 25 bp, Mus musculus
cgctccatgcccatgacatttttta

SEQ ID NO: 362549 - DNA, 25 bp, Mus musculus
cgctccatgcccttgacatttttta

SEQ ID NO: 362550 - DNA, 25 bp, Mus musculus
cgctcccaaccaagattagtactgc

SEQ ID NO: 362551 - DNA, 25 bp, Mus musculus
cgctcccaaccatgattagtactgc

SEQ ID NO: 362552 - DNA, 25 bp, Mus musculus
cgctcccctatcacattattagtaa

SEQ ID NO: 362553 - DNA, 25 bp, Mus musculus
cgctcccctatctcattattagtaa

SEQ ID NO: 362554 - DNA, 25 bp, Mus musculus
cgctcccctcagattcattatataa

SEQ ID NO: 362555 - DNA, 25 bp, Mus musculus
cgctcccctcagtttcattatataa

SEQ ID NO: 362556 - DNA, 25 bp, Mus musculus
cgctcccctcttacatttgaaatta

SEQ ID NO: 362557 - DNA, 25 bp, Mus musculus
cgctcccctctttcatttgaaatta

SEQ ID NO: 362558 - DNA, 25 bp, Mus musculus
cgctccccttctaggatagaatcat

SEQ ID NO: 362559 - DNA, 25 bp, Mus musculus
cgctccccttcttggatagaatcat

SEQ ID NO: 362560 - DNA, 25 bp, Mus musculus
cgctcccgcagcagtgcgcctatga

SEQ ID NO: 362561 - DNA, 25 bp, Mus musculus
cgctcccgcagctgtgcgcctatga

SEQ ID NO: 362562 - DNA, 25 bp, Mus musculus
cgctccctgcggatcgatgataagc

SEQ ID NO: 362563 - DNA, 25 bp, Mus musculus
cgctccctgcggttcgatgataagc

SEQ ID NO: 362564 - DNA, 25 bp, Mus musculus
cgctccctggagcagtaccgacttt

SEQ ID NO: 362565 - DNA, 25 bp, Mus musculus
cgctccctggaggagtaccgacttt

SEQ ID NO: 362566 - DNA, 25 bp, Mus musculus
cgctcccttcatatggtgagggcaa

SEQ ID NO: 362567 - DNA, 25 bp, Mus musculus
cgctcccttcatttggtgagggcaa

SEQ ID NO: 362568 - DNA, 25 bp, Mus musculus
cgctcctaattcaggctttacataa

SEQ ID NO: 362569 - DNA, 25 bp, Mus musculus
cgctcctaattctggctttacataa

SEQ ID NO: 362570 - DNA, 25 bp, Mus musculus
cgctcctacccgcagtttgtgagag

SEQ ID NO: 362571 - DNA, 25 bp, Mus musculus
cgctcctacccggagtttgtgagag

SEQ ID NO: 362572 - DNA, 25 bp, Mus musculus
cgctcctcgataagtacggataggc

SEQ ID NO: 362573 - DNA, 25 bp, Mus musculus
cgctcctcgatatgtacggataggc

SEQ ID NO: 362574 - DNA, 25 bp, Mus musculus
cgctcctcggctatggttggcaggc

SEQ ID NO: 362575 - DNA, 25 bp, Mus musculus
cgctcctcggctttggttggcaggc

SEQ ID NO: 362576 - DNA, 25 bp, Mus musculus
cgctcctcttggagaagggaaatta

SEQ ID NO: 362577 - DNA, 25 bp, Mus musculus
cgctcctcttggtgaagggaaatta

SEQ ID NO: 362578 - DNA, 25 bp, Mus musculus
cgctccttcactatcaaggttgagg

SEQ ID NO: 362579 - DNA, 25 bp, Mus musculus
cgctccttcactttcaaggttgagg

SEQ ID NO: 362580 - DNA, 25 bp, Mus musculus
cgctccttgtacagtatcttactgg

SEQ ID NO: 362581 - DNA, 25 bp, Mus musculus
cgctccttgtactgtatcttactgg

SEQ ID NO: 362582 - DNA, 25 bp, Mus musculus
cgctccttttcacttgaggctagaa

SEQ ID NO: 362583 - DNA, 25 bp, Mus musculus
cgctccttttcagttgaggctagaa

SEQ ID NO: 362584 - DNA, 25 bp, Mus musculus
cgctcgcagtggctctgatgtttag

SEQ ID NO: 362585 - DNA, 25 bp, Mus musculus
cgctcgcagtgggtctgatgtttag

SEQ ID NO: 362586 - DNA, 25 bp, Mus musculus
cgctcgcctggccaaattcaaaggc

SEQ ID NO: 362587 - DNA, 25 bp, Mus musculus
cgctcgcctggcgaaattcaaaggc

SEQ ID NO: 362588 - DNA, 25 bp, Mus musculus
cgctcgctcgggaacggtcggctaa

SEQ ID NO: 362589 - DNA, 25 bp, Mus musculus
cgctcgctcgggtacggtcggctaa

SEQ ID NO: 362590 - DNA, 25 bp, Mus musculus
cgctcgctcttcagagaagtgccat

SEQ ID NO: 362591 - DNA, 25 bp, Mus musculus
cgctcgctcttctgagaagtgccat

SEQ ID NO: 362592 - DNA, 25 bp, Mus musculus
cgctcgctgtaacggcagttgcctc

SEQ ID NO: 362593 - DNA, 25 bp, Mus musculus
cgctcgctgtaagggcagttgcctc

SEQ ID NO: 362594 - DNA, 25 bp, Mus musculus
cgctcgggactcagacttcaatgga

SEQ ID NO: 362595 - DNA, 25 bp, Mus musculus
cgctcgggactctgacttcaatgga

SEQ ID NO: 362596 - DNA, 25 bp, Mus musculus
cgctcggtgccacgcatttgaaaaa

SEQ ID NO: 362597 - DNA, 25 bp, Mus musculus
cgctcggtgccaggcatttgaaaaa

SEQ ID NO: 362598 - DNA, 25 bp, Mus musculus
cgctcggtgcgaaactgatgatgaa

SEQ ID NO: 362599 - DNA, 25 bp, Mus musculus
cgctcggtgcgatactgatgatgaa

SEQ ID NO: 362600 - DNA, 25 bp, Mus musculus
cgctctacaaggatggcttcttcaa

SEQ ID NO: 362601 - DNA, 25 bp, Mus musculus
cgctctacaaggttggcttcttcaa

SEQ ID NO: 362602 - DNA, 25 bp, Mus musculus
cgctctagtgagcaccgcactgtaa

SEQ ID NO: 362603 - DNA, 25 bp, Mus musculus
cgctctagtgaggaccgcactgtaa

SEQ ID NO: 362604 - DNA, 25 bp, Mus musculus
cgctctagttttactcccagagaga

SEQ ID NO: 362605 - DNA, 25 bp, Mus musculus
cgctctagtttttctcccagagaga

SEQ ID NO: 362606 - DNA, 25 bp, Mus musculus
cgctctcccaaacgctcttatgtta

SEQ ID NO: 362607 - DNA, 25 bp, Mus musculus
cgctctcccaaaggctcttatgtta

SEQ ID NO: 362608 - DNA, 25 bp, Mus musculus
cgctctcccagccttgagatgggaa

SEQ ID NO: 362609 - DNA, 25 bp, Mus musculus
cgctctcccagcgttgagatgggaa

SEQ ID NO: 362610 - DNA, 25 bp, Mus musculus
cgctctcgggtgagcaccacgtggt

SEQ ID NO: 362611 - DNA, 25 bp, Mus musculus
cgctctcgggtgtgcaccacgtggt

SEQ ID NO: 362612 - DNA, 25 bp, Mus musculus
cgctctctacctcaggagactgtgg

SEQ ID NO: 362613 - DNA, 25 bp, Mus musculus
cgctctctacctgaggagactgtgg

SEQ ID NO: 362614 - DNA, 25 bp, Mus musculus
cgctctctatttattcaactccagg

SEQ ID NO: 362615 - DNA, 25 bp, Mus musculus
cgctctctattttttcaactccagg

SEQ ID NO: 362616 - DNA, 25 bp, Mus musculus
cgctctcttcctctatgtgataaat

SEQ ID NO: 362617 - DNA, 25 bp, Mus musculus
cgctctcttcctgtatgtgataaat

SEQ ID NO: 362618 - DNA, 25 bp, Mus musculus
cgctctgaccagaggagggatctta

SEQ ID NO: 362619 - DNA, 25 bp, Mus musculus
cgctctgaccagtggagggatctta

SEQ ID NO: 362620 - DNA, 25 bp, Mus musculus
cgctctgactgcacatgtgggagta

SEQ ID NO: 362621 - DNA, 25 bp, Mus musculus
cgctctgactgctcatgtgggagta

SEQ ID NO: 362622 - DNA, 25 bp, Mus musculus
cgctctgatcatcggcatggcatac

SEQ ID NO: 362623 - DNA, 25 bp, Mus musculus
cgctctgatcatgggcatggcatac

SEQ ID NO: 362624 - DNA, 25 bp, Mus musculus
cgctctgccaatctagctgaatcaa

SEQ ID NO: 362625 - DNA, 25 bp, Mus musculus
cgctctgccaatgtagctgaatcaa

SEQ ID NO: 362626 - DNA, 25 bp, Mus musculus
cgctctgcgcctcaaggccaaagag

SEQ ID NO: 362627 - DNA, 25 bp, Mus musculus
cgctctgcgcctgaaggccaaagag

SEQ ID NO: 362628 - DNA, 25 bp, Mus musculus
cgctctgcgcgtactacagtactaa

SEQ ID NO: 362629 - DNA, 25 bp, Mus musculus
cgctctgcgcgttctacagtactaa

SEQ ID NO: 362630 - DNA, 25 bp, Mus musculus
cgctctggaaacatctgggctgtga

SEQ ID NO: 362631 - DNA, 25 bp, Mus musculus
cgctctggaaacttctgggctgtga

SEQ ID NO: 362632 - DNA, 25 bp, Mus musculus
cgctctggagcgacatgtggcacaa

SEQ ID NO: 362633 - DNA, 25 bp, Mus musculus
cgctctggagcgtcatgtggcacaa

SEQ ID NO: 362634 - DNA, 25 bp, Mus musculus
cgctctggtcctcaagtcattgaaa

SEQ ID NO: 362635 - DNA, 25 bp, Mus musculus
cgctctggtcctgaagtcattgaaa

SEQ ID NO: 362636 - DNA, 25 bp, Mus musculus
cgctctgtggatcctctagatgaca

SEQ ID NO: 362637 - DNA, 25 bp, Mus musculus
cgctctgtggatgctctagatgaca

SEQ ID NO: 362638 - DNA, 25 bp, Mus musculus
cgctcttaccttcggtttctggaat

SEQ ID NO: 362639 - DNA, 25 bp, Mus musculus
cgctcttaccttgggtttctggaat

SEQ ID NO: 362640 - DNA, 25 bp, Mus musculus
cgctcttcagagacacttatgctat

SEQ ID NO: 362641 - DNA, 25 bp, Mus musculus
cgctcttcagagtcacttatgctat

SEQ ID NO: 362642 - DNA, 25 bp, Mus musculus
cgctcttcagttacagatggctcag

SEQ ID NO: 362643 - DNA, 25 bp, Mus musculus
cgctcttcagtttcagatggctcag

SEQ ID NO: 362644 - DNA, 25 bp, Mus musculus
cgctcttccccactcaaaatgaaaa

SEQ ID NO: 362645 - DNA, 25 bp, Mus musculus
cgctcttccccagtcaaaatgaaaa

SEQ ID NO: 362646 - DNA, 25 bp, Mus musculus
cgctcttgatttcgcgtcagtcaaa

SEQ ID NO: 362647 - DNA, 25 bp, Mus musculus
cgctcttgatttggcgtcagtcaaa

SEQ ID NO: 362648 - DNA, 25 bp, Mus musculus
cgctctttattaacccatacgcatt

SEQ ID NO: 362649 - DNA, 25 bp, Mus musculus
cgctctttattatcccatacgcatt

SEQ ID NO: 362650 - DNA, 25 bp, Mus musculus
cgctctttctcgctctttcattctg

SEQ ID NO: 362651 - DNA, 25 bp, Mus musculus
cgctctttctcggtctttcattctg

SEQ ID NO: 362652 - DNA, 25 bp, Mus musculus
cgctgaacccggagcaactggagca

SEQ ID NO: 362653 - DNA, 25 bp, Mus musculus
cgctgaacccggtgcaactggagca

SEQ ID NO: 362654 - DNA, 25 bp, Mus musculus
cgctgaactccacgtcctaagtttc

SEQ ID NO: 362655 - DNA, 25 bp, Mus musculus
cgctgaactccactctattcatgga

SEQ ID NO: 362656 - DNA, 25 bp, Mus musculus
cgctgaactccaggtcctaagtttc

SEQ ID NO: 362657 - DNA, 25 bp, Mus musculus
cgctgaactccagtctattcatgga

SEQ ID NO: 362658 - DNA, 25 bp, Mus musculus
cgctgaactctgacctctgggacaa

SEQ ID NO: 362659 - DNA, 25 bp, Mus musculus
cgctgaactctgtcctctgggacaa

SEQ ID NO: 362660 - DNA, 25 bp, Mus musculus
cgctgaatcagtcatcgtcgccaac

SEQ ID NO: 362661 - DNA, 25 bp, Mus musculus
cgctgaatcagtgatcgtcgccaac

SEQ ID NO: 362662 - DNA, 25 bp, Mus musculus
cgctgacatcctctgatggtgccat

SEQ ID NO: 362663 - DNA, 25 bp, Mus musculus
cgctgacatcctgtgatggtgccat

SEQ ID NO: 362664 - DNA, 25 bp, Mus musculus
cgctgaccactgagtctgccatgaa

SEQ ID NO: 362665 - DNA, 25 bp, Mus musculus
cgctgaccactgtgtctgccatgaa

SEQ ID NO: 362666 - DNA, 25 bp, Mus musculus
cgctgacgttgtaaagatgcgtgtt

SEQ ID NO: 362667 - DNA, 25 bp, Mus musculus
cgctgacgttgttaagatgcgtgtt

SEQ ID NO: 362668 - DNA, 25 bp, Mus musculus
cgctgactctcacccgggttagaaa

SEQ ID NO: 362669 - DNA, 25 bp, Mus musculus
cgctgactctcagccgggttagaaa

SEQ ID NO: 362670 - DNA, 25 bp, Mus musculus
cgctgactgcggaaaagctgtgcat

SEQ ID NO: 362671 - DNA, 25 bp, Mus musculus
cgctgactgcggtaaagctgtgcat

SEQ ID NO: 362672 - DNA, 25 bp, Mus musculus
cgctgacttagtctttcctctgaaa

SEQ ID NO: 362673 - DNA, 25 bp, Mus musculus
cgctgacttagtgtttcctctgaaa

SEQ ID NO: 362674 - DNA, 25 bp, Mus musculus
cgctgacttatgcacagttcactgt

SEQ ID NO: 362675 - DNA, 25 bp, Mus musculus
cgctgacttatggacagttcactgt

SEQ ID NO: 362676 - DNA, 25 bp, Mus musculus
cgctgagacttcaacttctcctaaa

SEQ ID NO: 362677 - DNA, 25 bp, Mus musculus
cgctgagacttctacttctcctaaa

SEQ ID NO: 362678 - DNA, 25 bp, Mus musculus
cgctgagcgttccaacagagacttt

SEQ ID NO: 362679 - DNA, 25 bp, Mus musculus
cgctgagcgttcgaacagagacttt

SEQ ID NO: 362680 - DNA, 25 bp, Mus musculus
cgctgaggaaaacggaaaagacatc

SEQ ID NO: 362681 - DNA, 25 bp, Mus musculus
cgctgaggaaaagggaaaagacatc

SEQ ID NO: 362682 - DNA, 25 bp, Mus musculus
cgctgaggccctcaaggaccccgag

SEQ ID NO: 362683 - DNA, 25 bp, Mus musculus
cgctgaggccctgaaggaccccgag

SEQ ID NO: 362684 - DNA, 25 bp, Mus musculus
cgctgaggcgatcccagagcatgaa

SEQ ID NO: 362685 - DNA, 25 bp, Mus musculus
cgctgaggcgatgccagagcatgaa

SEQ ID NO: 362686 - DNA, 25 bp, Mus musculus
cgctgatcaaccctatctacagtgt

SEQ ID NO: 362687 - DNA, 25 bp, Mus musculus
cgctgatcaaccgtatctacagtgt

SEQ ID NO: 362688 - DNA, 25 bp, Mus musculus
cgctgatctattatcctttttgtga

SEQ ID NO: 362689 - DNA, 25 bp, Mus musculus
cgctgatctattttcctttttgtga

SEQ ID NO: 362690 - DNA, 25 bp, Mus musculus
cgctgattgaggatcttcaggccac

SEQ ID NO: 362691 - DNA, 25 bp, Mus musculus
cgctgattgaggttcttcaggccac

SEQ ID NO: 362692 - DNA, 25 bp, Mus musculus
cgctgcacaggtcgctcactgggct

SEQ ID NO: 362693 - DNA, 25 bp, Mus musculus
cgctgcacaggtggctcactgggct

SEQ ID NO: 362694 - DNA, 25 bp, Mus musculus
cgctgcacccaacgcgcgtagagga

SEQ ID NO: 362695 - DNA, 25 bp, Mus musculus
cgctgcacccaaggcgcgtagagga

SEQ ID NO: 362696 - DNA, 25 bp, Mus musculus
cgctgcacctctctaatatgaccgt

SEQ ID NO: 362697 - DNA, 25 bp, Mus musculus
cgctgcacctctgtaatatgaccgt

SEQ ID NO: 362698 - DNA, 25 bp, Mus musculus
cgctgcagcctcatgtgattggaca

SEQ ID NO: 362699 - DNA, 25 bp, Mus musculus
cgctgcagcctcttgtgattggaca

SEQ ID NO: 362700 - DNA, 25 bp, Mus musculus
cgctgcagggctagactttacggtt

SEQ ID NO: 362701 - DNA, 25 bp, Mus musculus
cgctgcagggcttgactttacggtt

SEQ ID NO: 362702 - DNA, 25 bp, Mus musculus
cgctgcatatctcgtggcttcacac

SEQ ID NO: 362703 - DNA, 25 bp, Mus musculus
cgctgcatatctggtggcttcacac

SEQ ID NO: 362704 - DNA, 25 bp, Mus musculus
cgctgcatcctgaaacttatgaacc

SEQ ID NO: 362705 - DNA, 25 bp, Mus musculus
cgctgcatcctgtaacttatgaacc

SEQ ID NO: 362706 - DNA, 25 bp, Mus musculus
cgctgcatcttcactaatccaaaag

SEQ ID NO: 362707 - DNA, 25 bp, Mus musculus
cgctgcatcttctctaatccaaaag

SEQ ID NO: 362708 - DNA, 25 bp, Mus musculus
cgctgccacttgagaacgtctggat

SEQ ID NO: 362709 - DNA, 25 bp, Mus musculus
cgctgccacttgtgaacgtctggat

SEQ ID NO: 362710 - DNA, 25 bp, Mus musculus
cgctgccataatcggtatgtctcaa

SEQ ID NO: 362711 - DNA, 25 bp, Mus musculus
cgctgccataatgggtatgtctcaa

SEQ ID NO: 362712 - DNA, 25 bp, Mus musculus
cgctgccctggacaaatagatttgt

SEQ ID NO: 362713 - DNA, 25 bp, Mus musculus
cgctgccctggagaaatagatttgt

SEQ ID NO: 362714 - DNA, 25 bp, Mus musculus
cgctgccgggtcaatgggattccat

SEQ ID NO: 362715 - DNA, 25 bp, Mus musculus
cgctgccgggtctatgggattccat

SEQ ID NO: 362716 - DNA, 25 bp, Mus musculus
cgctgcctcctgagatagggaacat

SEQ ID NO: 362717 - DNA, 25 bp, Mus musculus
cgctgcctcctgtgatagggaacat

SEQ ID NO: 362718 - DNA, 25 bp, Mus musculus
cgctgccttggaagccgacagaggt

SEQ ID NO: 362719 - DNA, 25 bp, Mus musculus
cgctgccttggatgccgacagaggt

SEQ ID NO: 362720 - DNA, 25 bp, Mus musculus
cgctgcgagctcatcaatggcattg

SEQ ID NO: 362721 - DNA, 25 bp, Mus musculus
cgctgcgagctcttcaatggcattg

SEQ ID NO: 362722 - DNA, 25 bp, Mus musculus
cgctgcgcagatattttgagtctgt

SEQ ID NO: 362723 - DNA, 25 bp, Mus musculus
cgctgcgcagattttttgagtctgt

SEQ ID NO: 362724 - DNA, 25 bp, Mus musculus
cgctgcgcgagcagagtgtagatct

SEQ ID NO: 362725 - DNA, 25 bp, Mus musculus
cgctgcgcgagctgagtgtagatct

SEQ ID NO: 362726 - DNA, 25 bp, Mus musculus
cgctgctccgtgagccttttttcag

SEQ ID NO: 362727 - DNA, 25 bp, Mus musculus
cgctgctccgtgtgccttttttcag

SEQ ID NO: 362728 - DNA, 25 bp, Mus musculus
cgctgctcctctctgatttacagaa

SEQ ID NO: 362729 - DNA, 25 bp, Mus musculus
cgctgctcctctgtgatttacagaa

SEQ ID NO: 362730 - DNA, 25 bp, Mus musculus
cgctgctcgaacaatcaaaagcaag

SEQ ID NO: 362731 - DNA, 25 bp, Mus musculus
cgctgctcgaactatcaaaagcaag

SEQ ID NO: 362732 - DNA, 25 bp, Mus musculus
cgctgctctggacaaggtgatgctt

SEQ ID NO: 362733 - DNA, 25 bp, Mus musculus
cgctgctctggagaaggtgatgctt

SEQ ID NO: 362734 - DNA, 25 bp, Mus musculus
cgctgctctgtgctaagctgactaa

SEQ ID NO: 362735 - DNA, 25 bp, Mus musculus
cgctgctctgtggtaagctgactaa

SEQ ID NO: 362736 - DNA, 25 bp, Mus musculus
cgctgctgaactccacagtgcttta

SEQ ID NO: 362737 - DNA, 25 bp, Mus musculus
cgctgctgaactgcacagtgcttta

SEQ ID NO: 362738 - DNA, 25 bp, Mus musculus
cgctgctgcagtctgagaacataga

SEQ ID NO: 362739 - DNA, 25 bp, Mus musculus
cgctgctgcagtgtgagaacataga

SEQ ID NO: 362740 - DNA, 25 bp, Mus musculus
cgctgctggactcgacctacagaaa

SEQ ID NO: 362741 - DNA, 25 bp, Mus musculus
cgctgctggactggacctacagaaa

SEQ ID NO: 362742 - DNA, 25 bp, Mus musculus
cgctgctggccacagggaatctttt

SEQ ID NO: 362743 - DNA, 25 bp, Mus musculus
cgctgctggccagagggaatctttt

SEQ ID NO: 362744 - DNA, 25 bp, Mus musculus
cgctgcttcaggatgcccgctgggc

SEQ ID NO: 362745 - DNA, 25 bp, Mus musculus
cgctgcttcaggttgcccgctgggc

SEQ ID NO: 362746 - DNA, 25 bp, Mus musculus
cgctgcttctgtccacattagtttg

SEQ ID NO: 362747 - DNA, 25 bp, Mus musculus
cgctgcttctgtgcacattagtttg

SEQ ID NO: 362748 - DNA, 25 bp, Mus musculus
cgctggaaaagcccgtaccctcagg

SEQ ID NO: 362749 - DNA, 25 bp, Mus musculus
cgctggaaaagcgcgtaccctcagg

SEQ ID NO: 362750 - DNA, 25 bp, Mus musculus
cgctggaacagtcgcgcatcattca

SEQ ID NO: 362751 - DNA, 25 bp, Mus musculus
cgctggaacagtggcgcatcattca

SEQ ID NO: 362752 - DNA, 25 bp, Mus musculus
cgctggaagtgcagttgctctacaa

SEQ ID NO: 362753 - DNA, 25 bp, Mus musculus
cgctggaagtgctgttgctctacaa

SEQ ID NO: 362754 - DNA, 25 bp, Mus musculus
cgctggacactcatatcgttgctat

SEQ ID NO: 362755 - DNA, 25 bp, Mus musculus
cgctggacactcttatcgttgctat

SEQ ID NO: 362756 - DNA, 25 bp, Mus musculus
cgctggaccacgcatcgcaaagtac

SEQ ID NO: 362757 - DNA, 25 bp, Mus musculus
cgctggaccacggatcgcaaagtac

SEQ ID NO: 362758 - DNA, 25 bp, Mus musculus
cgctggacctggagtctcgagtaaa

SEQ ID NO: 362759 - DNA, 25 bp, Mus musculus
cgctggacctggtgtctcgagtaaa

SEQ ID NO: 362760 - DNA, 25 bp, Mus musculus
cgctggaggtacagatgctcagtgt

SEQ ID NO: 362761 - DNA, 25 bp, Mus musculus
cgctggaggtactgatgctcagtgt

SEQ ID NO: 362762 - DNA, 25 bp, Mus musculus
cgctggcaaaggctctatgaatcta

SEQ ID NO: 362763 - DNA, 25 bp, Mus musculus
cgctggcaaagggtctatgaatcta

SEQ ID NO: 362764 - DNA, 25 bp, Mus musculus
cgctggcaacgacgcttctttggaa

SEQ ID NO: 362765 - DNA, 25 bp, Mus musculus
cgctggcaacgaggcttctttggaa

SEQ ID NO: 362766 - DNA, 25 bp, Mus musculus
cgctggcactggcatggaactttac

SEQ ID NO: 362767 - DNA, 25 bp, Mus musculus
cgctggcactgggatggaactttac

SEQ ID NO: 362768 - DNA, 25 bp, Mus musculus
cgctggcagctcaaatggattctat

SEQ ID NO: 362769 - DNA, 25 bp, Mus musculus
cgctggcagctctaatggattctat

SEQ ID NO: 362770 - DNA, 25 bp, Mus musculus
cgctggcgacgcatccttgtttggg

SEQ ID NO: 362771 - DNA, 25 bp, Mus musculus
cgctggcgacgcttccttgtttggg

SEQ ID NO: 362772 - DNA, 25 bp, Mus musculus
cgctggctctctagtatacaaacat

SEQ ID NO: 362773 - DNA, 25 bp, Mus musculus
cgctggctctcttgtatacaaacat

SEQ ID NO: 362774 - DNA, 25 bp, Mus musculus
cgctggctgcttactggacacggag

SEQ ID NO: 362775 - DNA, 25 bp, Mus musculus
cgctggctgctttctggacacggag

SEQ ID NO: 362776 - DNA, 25 bp, Mus musculus
cgctggctggtcaacgtcaacttga

SEQ ID NO: 362777 - DNA, 25 bp, Mus musculus
cgctggctggtctacgtcaacttga

SEQ ID NO: 362778 - DNA, 25 bp, Mus musculus
cgctgggaatggactgtgacccaca

SEQ ID NO: 362779 - DNA, 25 bp, Mus musculus
cgctgggaatggtctgtgacccaca

SEQ ID NO: 362780 - DNA, 25 bp, Mus musculus
cgctgggcaataatgtcagataatt

SEQ ID NO: 362781 - DNA, 25 bp, Mus musculus
cgctgggcaatattgtcagataatt

SEQ ID NO: 362782 - DNA, 25 bp, Mus musculus
cgctgggccagcagacaggttatga

SEQ ID NO: 362783 - DNA, 25 bp, Mus musculus
cgctgggccagctgacaggttatga

SEQ ID NO: 362784 - DNA, 25 bp, Mus musculus
cgctgggcgaggagctcatgtacaa

SEQ ID NO: 362785 - DNA, 25 bp, Mus musculus
cgctgggcgaggtgctcatgtacaa

SEQ ID NO: 362786 - DNA, 25 bp, Mus musculus
cgctgggcgcatcctctctgaagga

SEQ ID NO: 362787 - DNA, 25 bp, Mus musculus
cgctgggcgcatgctctctgaagga

SEQ ID NO: 362788 - DNA, 25 bp, Mus musculus
cgctgggtatccagttagctgtgtg

SEQ ID NO: 362789 - DNA, 25 bp, Mus musculus
cgctgggtatcctgttagctgtgtg

SEQ ID NO: 362790 - DNA, 25 bp, Mus musculus
cgctgggtctaaatatctctgtctc

SEQ ID NO: 362791 - DNA, 25 bp, Mus musculus
cgctgggtctaattatctctgtctc

SEQ ID NO: 362792 - DNA, 25 bp, Mus musculus
cgctgggttcccacttcagcaccac

SEQ ID NO: 362793 - DNA, 25 bp, Mus musculus
cgctgggttccctcttcagcaccac

SEQ ID NO: 362794 - DNA, 25 bp, Mus musculus
cgctggtaacttacgtgcctgttac

SEQ ID NO: 362795 - DNA, 25 bp, Mus musculus
cgctggtaactttcgtgcctgttac

SEQ ID NO: 362796 - DNA, 25 bp, Mus musculus
cgctggtagcttatgttgttttcct

SEQ ID NO: 362797 - DNA, 25 bp, Mus musculus
cgctggtagcttttgttgttttcct

SEQ ID NO: 362798 - DNA, 25 bp, Mus musculus
cgctggtattgtataaaggtttgat

SEQ ID NO: 362799 - DNA, 25 bp, Mus musculus
cgctggtattgtttaaaggtttgat

SEQ ID NO: 362800 - DNA, 25 bp, Mus musculus
cgctggtcctagactcggagtcgga

SEQ ID NO: 362801 - DNA, 25 bp, Mus musculus
cgctggtcctagtctcggagtcgga

SEQ ID NO: 362802 - DNA, 25 bp, Mus musculus
cgctggtgagtaagaactatgagat

SEQ ID NO: 362803 - DNA, 25 bp, Mus musculus
cgctggtgagtatgaactatgagat

SEQ ID NO: 362804 - DNA, 25 bp, Mus musculus
cgctggtgcaggcatcgttacccga

SEQ ID NO: 362805 - DNA, 25 bp, Mus musculus
cgctggtgcagggatcgttacccga

SEQ ID NO: 362806 - DNA, 25 bp, Mus musculus
cgctggtgttgaccacttgggaatc

SEQ ID NO: 362807 - DNA, 25 bp, Mus musculus
cgctggtgttgagcacttgggaatc

SEQ ID NO: 362808 - DNA, 25 bp, Mus musculus
cgctggttagcaccgcaggtgtaga

SEQ ID NO: 362809 - DNA, 25 bp, Mus musculus
cgctggttagcagcgcaggtgtaga

SEQ ID NO: 362810 - DNA, 25 bp, Mus musculus
cgctgtaagcatcatgttagcctca

SEQ ID NO: 362811 - DNA, 25 bp, Mus musculus
cgctgtaagcatgatgttagcctca

SEQ ID NO: 362812 - DNA, 25 bp, Mus musculus
cgctgtagatagagcatggatgaga

SEQ ID NO: 362813 - DNA, 25 bp, Mus musculus
cgctgtagatagtgcatggatgaga

SEQ ID NO: 362814 - DNA, 25 bp, Mus musculus
cgctgtatccgtatcaaccacaaga

SEQ ID NO: 362815 - DNA, 25 bp, Mus musculus
cgctgtatccgtttcaaccacaaga

SEQ ID NO: 362816 - DNA, 25 bp, Mus musculus
cgctgtattgtgaactggctctgag

SEQ ID NO: 362817 - DNA, 25 bp, Mus musculus
cgctgtattgtgtactggctctgag

SEQ ID NO: 362818 - DNA, 25 bp, Mus musculus
cgctgtcagagacatggccgccgta

SEQ ID NO: 362819 - DNA, 25 bp, Mus musculus
cgctgtcagagagatggccgccgta

SEQ ID NO: 362820 - DNA, 25 bp, Mus musculus
cgctgtcatagaatactgctgtgct

SEQ ID NO: 362821 - DNA, 25 bp, Mus musculus
cgctgtcatagattactgctgtgct

SEQ ID NO: 362822 - DNA, 25 bp, Mus musculus
cgctgtccttcgctcaactgagttg

SEQ ID NO: 362823 - DNA, 25 bp, Mus musculus
cgctgtccttcggtcaactgagttg

SEQ ID NO: 362824 - DNA, 25 bp, Mus musculus
cgctgtcggaccacccgggaaatgg

SEQ ID NO: 362825 - DNA, 25 bp, Mus musculus
cgctgtcggacctcccgggaaatgg

SEQ ID NO: 362826 - DNA, 25 bp, Mus musculus
cgctgtcgttccaaaggtctagata

SEQ ID NO: 362827 - DNA, 25 bp, Mus musculus
cgctgtcgttcctaaggtctagata

SEQ ID NO: 362828 - DNA, 25 bp, Mus musculus
cgctgtctgcaaaccaaatggccat

SEQ ID NO: 362829 - DNA, 25 bp, Mus musculus
cgctgtctgcaatccaaatggccat

SEQ ID NO: 362830 - DNA, 25 bp, Mus musculus
cgctgtctggtgctgcctatgagca

SEQ ID NO: 362831 - DNA, 25 bp, Mus musculus
cgctgtctggtggtgcctatgagca

SEQ ID NO: 362832 - DNA, 25 bp, Mus musculus
cgctgtgaaatgattgctgcctcat

SEQ ID NO: 362833 - DNA, 25 bp, Mus musculus
cgctgtgaaatgtttgctgcctcat

SEQ ID NO: 362834 - DNA, 25 bp, Mus musculus
cgctgtgaatggagcgagttcctca

SEQ ID NO: 362835 - DNA, 25 bp, Mus musculus
cgctgtgaatggtgcgagttcctca

SEQ ID NO: 362836 - DNA, 25 bp, Mus musculus
cgctgtgaccagctgatcaagaaca

SEQ ID NO: 362837 - DNA, 25 bp, Mus musculus
cgctgtgaccaggtgatcaagaaca

SEQ ID NO: 362838 - DNA, 25 bp, Mus musculus
cgctgtgaccttagggccttcaaga

SEQ ID NO: 362839 - DNA, 25 bp, Mus musculus
cgctgtgacctttgggccttcaaga

SEQ ID NO: 362840 - DNA, 25 bp, Mus musculus
cgctgtgcccgtctcagctcctggg

SEQ ID NO: 362841 - DNA, 25 bp, Mus musculus
cgctgtgcccgtgtcagctcctggg

SEQ ID NO: 362842 - DNA, 25 bp, Mus musculus
cgctgtgccttaccatgtggcaaat

SEQ ID NO: 362843 - DNA, 25 bp, Mus musculus
cgctgtgccttagcatgtggcaaat

SEQ ID NO: 362844 - DNA, 25 bp, Mus musculus
cgctgtgctgtgatactcgcatggg

SEQ ID NO: 362845 - DNA, 25 bp, Mus musculus
cgctgtgctgtgttactcgcatggg

SEQ ID NO: 362846 - DNA, 25 bp, Mus musculus
cgctgtggagctacaccaggcgaaa

SEQ ID NO: 362847 - DNA, 25 bp, Mus musculus
cgctgtggagcttcaccaggcgaaa

SEQ ID NO: 362848 - DNA, 25 bp, Mus musculus
cgctgtggccagaacccaatttgaa

SEQ ID NO: 362849 - DNA, 25 bp, Mus musculus
cgctgtggccagtacccaatttgaa

SEQ ID NO: 362850 - DNA, 25 bp, Mus musculus
cgctgtggctagcatcagggataaa

SEQ ID NO: 362851 - DNA, 25 bp, Mus musculus
cgctgtggctaggatcagggataaa

SEQ ID NO: 362852 - DNA, 25 bp, Mus musculus
cgctgtgggagcatggatcaatgct

SEQ ID NO: 362853 - DNA, 25 bp, Mus musculus
cgctgtgggagcttggatcaatgct

SEQ ID NO: 362854 - DNA, 25 bp, Mus musculus
cgctgtgggatcacattagggaata

SEQ ID NO: 362855 - DNA, 25 bp, Mus musculus
cgctgtgggatctcattagggaata

SEQ ID NO: 362856 - DNA, 25 bp, Mus musculus
cgctgtgggtacaggagtctgcact

SEQ ID NO: 362857 - DNA, 25 bp, Mus musculus
cgctgtgggtactggagtctgcact

SEQ ID NO: 362858 - DNA, 25 bp, Mus musculus
cgctgtggtactctgcatctgtttc

SEQ ID NO: 362859 - DNA, 25 bp, Mus musculus
cgctgtggtactgtgcatctgtttc

SEQ ID NO: 362860 - DNA, 25 bp, Mus musculus
cgctgtgtctcactactcattttgc

SEQ ID NO: 362861 - DNA, 25 bp, Mus musculus
cgctgtgtctcagtactcattttgc

SEQ ID NO: 362862 - DNA, 25 bp, Mus musculus
cgctgtgtgggccagctacaacaga

SEQ ID NO: 362863 - DNA, 25 bp, Mus musculus
cgctgtgtgggcgagctacaacaga

SEQ ID NO: 362864 - DNA, 25 bp, Mus musculus
cgctgttaatgtctccagtgtttaa

SEQ ID NO: 362865 - DNA, 25 bp, Mus musculus
cgctgttaatgtgtccagtgtttaa

SEQ ID NO: 362866 - DNA, 25 bp, Mus musculus
cgctgttctatgatcagggcttatt

SEQ ID NO: 362867 - DNA, 25 bp, Mus musculus
cgctgttctatgttcagggcttatt

SEQ ID NO: 362868 - DNA, 25 bp, Mus musculus
cgctgttgaaacaccgccatagtaa

SEQ ID NO: 362869 - DNA, 25 bp, Mus musculus
cgctgttgaaactccgccatagtaa

SEQ ID NO: 362870 - DNA, 25 bp, Mus musculus
cgctgttgccttataggagccttta

SEQ ID NO: 362871 - DNA, 25 bp, Mus musculus
cgctgttgccttttaggagccttta

SEQ ID NO: 362872 - DNA, 25 bp, Mus musculus
cgctgttgctgtagagacgtattta

SEQ ID NO: 362873 - DNA, 25 bp, Mus musculus
cgctgttgctgttgagacgtattta

SEQ ID NO: 362874 - DNA, 25 bp, Mus musculus
cgctgttggaagcatgagcactcat

SEQ ID NO: 362875 - DNA, 25 bp, Mus musculus
cgctgttggaaggatgagcactcat

SEQ ID NO: 362876 - DNA, 25 bp, Mus musculus
cgctgttgtcggagaaaatgacttt

SEQ ID NO: 362877 - DNA, 25 bp, Mus musculus
cgctgttgtcggtgaaaatgacttt

SEQ ID NO: 362878 - DNA, 25 bp, Mus musculus
cgctgtttctgactgggaccccaga

SEQ ID NO: 362879 - DNA, 25 bp, Mus musculus
cgctgtttctgagtgggaccccaga

SEQ ID NO: 362880 - DNA, 25 bp, Mus musculus
cgctgtttgtctcctgatgatgggt

SEQ ID NO: 362881 - DNA, 25 bp, Mus musculus
cgctgtttgtctgctgatgatgggt

SEQ ID NO: 362882 - DNA, 25 bp, Mus musculus
cgctgttttataattagtcgggcat

SEQ ID NO: 362883 - DNA, 25 bp, Mus musculus
cgctgttttatatttagtcgggcat

SEQ ID NO: 362884 - DNA, 25 bp, Mus musculus
cgcttaagtgtcctctcagtagatt

SEQ ID NO: 362885 - DNA, 25 bp, Mus musculus
cgcttaagtgtcgtctcagtagatt

SEQ ID NO: 362886 - DNA, 25 bp, Mus musculus
cgcttaatagtgctgacttctggcc

SEQ ID NO: 362887 - DNA, 25 bp, Mus musculus
cgcttaatagtggtgacttctggcc

SEQ ID NO: 362888 - DNA, 25 bp, Mus musculus
cgcttaccattgagctaaatcccca

SEQ ID NO: 362889 - DNA, 25 bp, Mus musculus
cgcttaccattgtgctaaatcccca

SEQ ID NO: 362890 - DNA, 25 bp, Mus musculus
cgcttactagcgatgttcagatgag

SEQ ID NO: 362891 - DNA, 25 bp, Mus musculus
cgcttactagcgttgttcagatgag

SEQ ID NO: 362892 - DNA, 25 bp, Mus musculus
cgcttagtgcgtcaaggcccatgga

SEQ ID NO: 362893 - DNA, 25 bp, Mus musculus
cgcttagtgcgtgaaggcccatgga

SEQ ID NO: 362894 - DNA, 25 bp, Mus musculus
cgcttagtgtagatcatgtgcttat

SEQ ID NO: 362895 - DNA, 25 bp, Mus musculus
cgcttagtgtagttcatgtgcttat

SEQ ID NO: 362896 - DNA, 25 bp, Mus musculus
cgcttatccggcctctgcgtggatg

SEQ ID NO: 362897 - DNA, 25 bp, Mus musculus
cgcttatccggcgtctgcgtggatg

SEQ ID NO: 362898 - DNA, 25 bp, Mus musculus
cgcttcaaggcacagcaaatgtgac

SEQ ID NO: 362899 - DNA, 25 bp, Mus musculus
cgcttcaaggcagagcaaatgtgac

SEQ ID NO: 362900 - DNA, 25 bp, Mus musculus
cgcttcacaggacagcgtcgttgaa

SEQ ID NO: 362901 - DNA, 25 bp, Mus musculus
cgcttcacaggagagcgtcgttgaa

SEQ ID NO: 362902 - DNA, 25 bp, Mus musculus
cgcttcactatcagcaaccaggagt

SEQ ID NO: 362903 - DNA, 25 bp, Mus musculus
cgcttcactatctgcaaccaggagt

SEQ ID NO: 362904 - DNA, 25 bp, Mus musculus
cgcttcaggctgcatgactatgtta

SEQ ID NO: 362905 - DNA, 25 bp, Mus musculus
cgcttcaggctggatgactatgtta

SEQ ID NO: 362906 - DNA, 25 bp, Mus musculus
cgcttcattgcgcaccatatgcgaa

SEQ ID NO: 362907 - DNA, 25 bp, Mus musculus
cgcttcattgcggaccatatgcgaa

SEQ ID NO: 362908 - DNA, 25 bp, Mus musculus
cgcttccaccaaaactctgtgtttc

SEQ ID NO: 362909 - DNA, 25 bp, Mus musculus
cgcttccaccaatactctgtgtttc

SEQ ID NO: 362910 - DNA, 25 bp, Mus musculus
cgcttccagcaaaccatgtttctat

SEQ ID NO: 362911 - DNA, 25 bp, Mus musculus
cgcttccagcaatccatgtttctat

SEQ ID NO: 362912 - DNA, 25 bp, Mus musculus
cgcttccaggcgctgttactcggag

SEQ ID NO: 362913 - DNA, 25 bp, Mus musculus
cgcttccaggcggtgttactcggag

SEQ ID NO: 362914 - DNA, 25 bp, Mus musculus
cgcttcccaattacctaatctttag

SEQ ID NO: 362915 - DNA, 25 bp, Mus musculus
cgcttcccaatttcctaatctttag

SEQ ID NO: 362916 - DNA, 25 bp, Mus musculus
cgcttcccagatcgagaacttcaag

SEQ ID NO: 362917 - DNA, 25 bp, Mus musculus
cgcttcccagatggagaacttcaag

SEQ ID NO: 362918 - DNA, 25 bp, Mus musculus
cgcttccctctacttgtttgcaatg

SEQ ID NO: 362919 - DNA, 25 bp, Mus musculus
cgcttccctctagttgtttgcaatg

SEQ ID NO: 362920 - DNA, 25 bp, Mus musculus
cgcttccgagaccagcagtatgaga

SEQ ID NO: 362921 - DNA, 25 bp, Mus musculus
cgcttccgagacgagcagtatgaga

SEQ ID NO: 362922 - DNA, 25 bp, Mus musculus
cgcttccgtgccaatattattacca

SEQ ID NO: 362923 - DNA, 25 bp, Mus musculus
cgcttccgtgcctatattattacca

SEQ ID NO: 362924 - DNA, 25 bp, Mus musculus
cgcttcctgcatacaactgggtgaa

SEQ ID NO: 362925 - DNA, 25 bp, Mus musculus
cgcttcctgcattcaactgggtgaa

SEQ ID NO: 362926 - DNA, 25 bp, Mus musculus
cgcttcggattcatggaccagactg

SEQ ID NO: 362927 - DNA, 25 bp, Mus musculus
cgcttcggattcttggaccagactg

SEQ ID NO: 362928 - DNA, 25 bp, Mus musculus
cgcttctaattcatgtacctgcaca

SEQ ID NO: 362929 - DNA, 25 bp, Mus musculus
cgcttctaattcttgtacctgcaca

SEQ ID NO: 362930 - DNA, 25 bp, Mus musculus
cgcttctctcgtcggcggacttgtg

SEQ ID NO: 362931 - DNA, 25 bp, Mus musculus
cgcttctctcgtgggcggacttgtg

SEQ ID NO: 362932 - DNA, 25 bp, Mus musculus
cgcttctctgtgcatttagctggga

SEQ ID NO: 362933 - DNA, 25 bp, Mus musculus
cgcttctctgtggatttagctggga

SEQ ID NO: 362934 - DNA, 25 bp, Mus musculus
cgcttgagcaccccatcggctgcat

SEQ ID NO: 362935 - DNA, 25 bp, Mus musculus
cgcttgagcaccgcatcggctgcat

SEQ ID NO: 362936 - DNA, 25 bp, Mus musculus
cgcttgatgggcacggatgctgcaa

SEQ ID NO: 362937 - DNA, 25 bp, Mus musculus
cgcttgatgggctcggatgctgcaa

SEQ ID NO: 362938 - DNA, 25 bp, Mus musculus
cgcttgcctagcaagcgcaaggccc

SEQ ID NO: 362939 - DNA, 25 bp, Mus musculus
cgcttgcctagctagcgcaaggccc

SEQ ID NO: 362940 - DNA, 25 bp, Mus musculus
cgcttgcctcataaacacatttctt

SEQ ID NO: 362941 - DNA, 25 bp, Mus musculus
cgcttgcctcattaacacatttctt

SEQ ID NO: 362942 - DNA, 25 bp, Mus musculus
cgcttgctgctacccgaggaaagga

SEQ ID NO: 362943 - DNA, 25 bp, Mus musculus
cgcttgctgctagccgaggaaagga

SEQ ID NO: 362944 - DNA, 25 bp, Mus musculus
cgcttgctgctcatcaaggtgatgt

SEQ ID NO: 362945 - DNA, 25 bp, Mus musculus
cgcttgctgctcttcaaggtgatgt

SEQ ID NO: 362946 - DNA, 25 bp, Mus musculus
cgcttgggccctcgcatctcatagt

SEQ ID NO: 362947 - DNA, 25 bp, Mus musculus
cgcttgggccctggcatctcatagt

SEQ ID NO: 362948 - DNA, 25 bp, Mus musculus
cgcttgggtctaagtagtggttgca

SEQ ID NO: 362949 - DNA, 25 bp, Mus musculus
cgcttgggtctatgtagtggttgca

SEQ ID NO: 362950 - DNA, 25 bp, Mus musculus
cgcttggtccagattgtaaaagaca

SEQ ID NO: 362951 - DNA, 25 bp, Mus musculus
cgcttggtccagtttgtaaaagaca

SEQ ID NO: 362952 - DNA, 25 bp, Mus musculus
cgcttggtgaatctgagccggcatt

SEQ ID NO: 362953 - DNA, 25 bp, Mus musculus
cgcttggtgaatgtgagccggcatt

SEQ ID NO: 362954 - DNA, 25 bp, Mus musculus
cgcttggtggttataaagtgcatgc

SEQ ID NO: 362955 - DNA, 25 bp, Mus musculus
cgcttggtggttttaaagtgcatgc

SEQ ID NO: 362956 - DNA, 25 bp, Mus musculus
cgcttggtgttcctcttattcatga

SEQ ID NO: 362957 - DNA, 25 bp, Mus musculus
cgcttggtgttcgtcttattcatga

SEQ ID NO: 362958 - DNA, 25 bp, Mus musculus
cgcttgtgtagcaaagggatccttt

SEQ ID NO: 362959 - DNA, 25 bp, Mus musculus
cgcttgtgtagctaagggatccttt

SEQ ID NO: 362960 - DNA, 25 bp, Mus musculus
cgcttgttaaaaagccagtcccgtg

SEQ ID NO: 362961 - DNA, 25 bp, Mus musculus
cgcttgttaaaatgccagtcccgtg

SEQ ID NO: 362962 - DNA, 25 bp, Mus musculus
cgcttgttgatcactttcttttcat

SEQ ID NO: 362963 - DNA, 25 bp, Mus musculus
cgcttgttgatctctttcttttcat

SEQ ID NO: 362964 - DNA, 25 bp, Mus musculus
cgctttacattgcttcctagtttac

SEQ ID NO: 362965 - DNA, 25 bp, Mus musculus
cgctttacattggttcctagtttac

SEQ ID NO: 362966 - DNA, 25 bp, Mus musculus
cgctttatgactatgctggccagga

SEQ ID NO: 362967 - DNA, 25 bp, Mus musculus
cgctttatgactttgctggccagga

SEQ ID NO: 362968 - DNA, 25 bp, Mus musculus
cgctttatgtaaacggacctcctat

SEQ ID NO: 362969 - DNA, 25 bp, Mus musculus
cgctttatgtaatcggacctcctat

SEQ ID NO: 362970 - DNA, 25 bp, Mus musculus
cgctttcaactccagccactgtttg

SEQ ID NO: 362971 - DNA, 25 bp, Mus musculus
cgctttcaactcgagccactgtttg

SEQ ID NO: 362972 - DNA, 25 bp, Mus musculus
cgctttcagtgtaggatggaacgtt

SEQ ID NO: 362973 - DNA, 25 bp, Mus musculus
cgctttcagtgttggatggaacgtt

SEQ ID NO: 362974 - DNA, 25 bp, Mus musculus
cgctttcatggaacccagccccggg

SEQ ID NO: 362975 - DNA, 25 bp, Mus musculus
cgctttcatggatcccagccccggg

SEQ ID NO: 362976 - DNA, 25 bp, Mus musculus
cgctttccatagactgctgtagtga

SEQ ID NO: 362977 - DNA, 25 bp, Mus musculus
cgctttccatagtctgctgtagtga

SEQ ID NO: 362978 - DNA, 25 bp, Mus musculus
cgctttcctgaaaaccctggtacaa

SEQ ID NO: 362979 - DNA, 25 bp, Mus musculus
cgctttcctgaataccctggtacaa

SEQ ID NO: 362980 - DNA, 25 bp, Mus musculus
cgctttcctgctctttactaacgtt

SEQ ID NO: 362981 - DNA, 25 bp, Mus musculus
cgctttcctgctgtttactaacgtt

SEQ ID NO: 362982 - DNA, 25 bp, Mus musculus
cgctttcgcttaagatttacagttt

SEQ ID NO: 362983 - DNA, 25 bp, Mus musculus
cgctttcgcttatgatttacagttt

SEQ ID NO: 362984 - DNA, 25 bp, Mus musculus
cgctttctggagcactcctagaaat

SEQ ID NO: 362985 - DNA, 25 bp, Mus musculus
cgctttctggaggactcctagaaat

SEQ ID NO: 362986 - DNA, 25 bp, Mus musculus
cgctttctgtgaacacacgcagaga

SEQ ID NO: 362987 - DNA, 25 bp, Mus musculus
cgctttctgtgatcacacgcagaga

SEQ ID NO: 362988 - DNA, 25 bp, Mus musculus
cgctttgatgccacacaagggctcc

SEQ ID NO: 362989 - DNA, 25 bp, Mus musculus
cgctttgatgcctcacaagggctcc

SEQ ID NO: 362990 - DNA, 25 bp, Mus musculus
cgctttgcagacattgtcccaatga

SEQ ID NO: 362991 - DNA, 25 bp, Mus musculus
cgctttgcagactttgtcccaatga

SEQ ID NO: 362992 - DNA, 25 bp, Mus musculus
cgctttgctggtcaagtttatcttc

SEQ ID NO: 362993 - DNA, 25 bp, Mus musculus
cgctttgctggtgaagtttatcttc

SEQ ID NO: 362994 - DNA, 25 bp, Mus musculus
cgctttgctgttcttcctggattga

SEQ ID NO: 362995 - DNA, 25 bp, Mus musculus
cgctttgctgttgttcctggattga

SEQ ID NO: 362996 - DNA, 25 bp, Mus musculus
cgctttgcttgtcatcgactggaac

SEQ ID NO: 362997 - DNA, 25 bp, Mus musculus
cgctttgcttgtgatcgactggaac

SEQ ID NO: 362998 - DNA, 25 bp, Mus musculus
cgctttggggttatcgtcattcaga

SEQ ID NO: 362999 - DNA, 25 bp, Mus musculus
cgctttggggttttcgtcattcaga

SEQ ID NO: 363000 - DNA, 25 bp, Mus musculus
cgctttgtgcgcactgaattttata

SEQ ID NO: 363001 - DNA, 25 bp, Mus musculus
cgctttgtgcgctctgaattttata

SEQ ID NO: 363002 - DNA, 25 bp, Mus musculus
cgcttttatagtcttcatgtttgta

SEQ ID NO: 363003 - DNA, 25 bp, Mus musculus
cgcttttatagtgttcatgtttgta

SEQ ID NO: 363004 - DNA, 25 bp, Mus musculus
cgcttttctgtaatcaactttccta

SEQ ID NO: 363005 - DNA, 25 bp, Mus musculus
cgcttttctgtattcaactttccta

SEQ ID NO: 363006 - DNA, 25 bp, Mus musculus
cgcttttcttgcaattagtttcttt

SEQ ID NO: 363007 - DNA, 25 bp, Mus musculus
cgcttttcttgctattagtttcttt

SEQ ID NO: 363008 - DNA, 25 bp, Mus musculus
cgctttttacgaaggcttgaggagg

SEQ ID NO: 363009 - DNA, 25 bp, Mus musculus
cgctttttacgatggcttgaggagg

SEQ ID NO: 363010 - DNA, 25 bp, Mus musculus
cgctttttgaaacttcctgccagca

SEQ ID NO: 363011 - DNA, 25 bp, Mus musculus
cgctttttgaaagttcctgccagca

SEQ ID NO: 363012 - DNA, 25 bp, Mus musculus
cgctttttggacattattgggcaca

SEQ ID NO: 363013 - DNA, 25 bp, Mus musculus
cgctttttggactttattgggcaca

SEQ ID NO: 363014 - DNA, 25 bp, Mus musculus
cggaaaatagccatcgccatcactg

SEQ ID NO: 363015 - DNA, 25 bp, Mus musculus
cggaaaatagccttcgccatcactg

SEQ ID NO: 363016 - DNA, 25 bp, Mus musculus
cggaaactttctacagtgcgtgacc

SEQ ID NO: 363017 - DNA, 25 bp, Mus musculus
cggaaactttcttcagtgcgtgacc

SEQ ID NO: 363018 - DNA, 25 bp, Mus musculus
cggaaagaactgctgcacaaggcaa

SEQ ID NO: 363019 - DNA, 25 bp, Mus musculus
cggaaagaactggtgcacaaggcaa

SEQ ID NO: 363020 - DNA, 25 bp, Mus musculus
cggaaagacctcatcagatcctggt

SEQ ID NO: 363021 - DNA, 25 bp, Mus musculus
cggaaagacctcttcagatcctggt

SEQ ID NO: 363022 - DNA, 25 bp, Mus musculus
cggaaagcgaacaggttgtttactg

SEQ ID NO: 363023 - DNA, 25 bp, Mus musculus
cggaaagcgaactggttgtttactg

SEQ ID NO: 363024 - DNA, 25 bp, Mus musculus
cggaaagcgtgccaatcaacatgct

SEQ ID NO: 363025 - DNA, 25 bp, Mus musculus
cggaaagcgtgcgaatcaacatgct

SEQ ID NO: 363026 - DNA, 25 bp, Mus musculus
cggaaagctcttaatctgcctgaga

SEQ ID NO: 363027 - DNA, 25 bp, Mus musculus
cggaaagctctttatctgcctgaga

SEQ ID NO: 363028 - DNA, 25 bp, Mus musculus
cggaaagctgagaacatcaagcgac

SEQ ID NO: 363029 - DNA, 25 bp, Mus musculus
cggaaagctgagtacatcaagcgac

SEQ ID NO: 363030 - DNA, 25 bp, Mus musculus
cggaaaggaattccctattgtaatt

SEQ ID NO: 363031 - DNA, 25 bp, Mus musculus
cggaaaggaattgcctattgtaatt

SEQ ID NO: 363032 - DNA, 25 bp, Mus musculus
cggaaagtgcttatatgccagatgt

SEQ ID NO: 363033 - DNA, 25 bp, Mus musculus
cggaaagtgcttttatgccagatgt

SEQ ID NO: 363034 - DNA, 25 bp, Mus musculus
cggaaatacttcacacttcttcaga

SEQ ID NO: 363035 - DNA, 25 bp, Mus musculus
cggaaatacttctcacttcttcaga

SEQ ID NO: 363036 - DNA, 25 bp, Mus musculus
cggaaatgccctcacatgattttaa

SEQ ID NO: 363037 - DNA, 25 bp, Mus musculus
cggaaatgccctgacatgattttaa

SEQ ID NO: 363038 - DNA, 25 bp, Mus musculus
cggaaatggtttcccgcagaacctg

SEQ ID NO: 363039 - DNA, 25 bp, Mus musculus
cggaaatggtttgccgcagaacctg

SEQ ID NO: 363040 - DNA, 25 bp, Mus musculus
cggaacaagatacccggctatgtca

SEQ ID NO: 363041 - DNA, 25 bp, Mus musculus
cggaacaagatagccggctatgtca

SEQ ID NO: 363042 - DNA, 25 bp, Mus musculus
cggaacagtcagatccctgagcaga

SEQ ID NO: 363043 - DNA, 25 bp, Mus musculus
cggaacagtcagttccctgagcaga

SEQ ID NO: 363044 - DNA, 25 bp, Mus musculus
cggaacagtgttcgctcacgttttc

SEQ ID NO: 363045 - DNA, 25 bp, Mus musculus
cggaacagtgttggctcacgttttc

SEQ ID NO: 363046 - DNA, 25 bp, Mus musculus
cggaaccagcaaaagtttctgaaaa

SEQ ID NO: 363047 - DNA, 25 bp, Mus musculus
cggaaccagcaatagtttctgaaaa

SEQ ID NO: 363048 - DNA, 25 bp, Mus musculus
cggaaccgcagcacctcagtggaca

SEQ ID NO: 363049 - DNA, 25 bp, Mus musculus
cggaaccgcagctcctcagtggaca

SEQ ID NO: 363050 - DNA, 25 bp, Mus musculus
cggaaccggcgtatgctggaagact

SEQ ID NO: 363051 - DNA, 25 bp, Mus musculus
cggaaccggcgtttgctggaagact

SEQ ID NO: 363052 - DNA, 25 bp, Mus musculus
cggaacgctggtcctcaaggctagc

SEQ ID NO: 363053 - DNA, 25 bp, Mus musculus
cggaacgctggtgctcaaggctagc

SEQ ID NO: 363054 - DNA, 25 bp, Mus musculus
cggaacgggaaactgctcctctaag

SEQ ID NO: 363055 - DNA, 25 bp, Mus musculus
cggaacgggaaagtgctcctctaag

SEQ ID NO: 363056 - DNA, 25 bp, Mus musculus
cggaactatgtcccagaggatgaag

SEQ ID NO: 363057 - DNA, 25 bp, Mus musculus
cggaactatgtcgcagaggatgaag

SEQ ID NO: 363058 - DNA, 25 bp, Mus musculus
cggaactcacagaatagcacaggct

SEQ ID NO: 363059 - DNA, 25 bp, Mus musculus
cggaactcacagtatagcacaggct

SEQ ID NO: 363060 - DNA, 25 bp, Mus musculus
cggaactcagaaccccaagttgtag

SEQ ID NO: 363061 - DNA, 25 bp, Mus musculus
cggaactcagaagcccaagttgtag

SEQ ID NO: 363062 - DNA, 25 bp, Mus musculus
cggaactccagcagcgccttctggt

SEQ ID NO: 363063 - DNA, 25 bp, Mus musculus
cggaactccagctgcgccttctggt

SEQ ID NO: 363064 - DNA, 25 bp, Mus musculus
cggaactgaggccatgattaagagg

SEQ ID NO: 363065 - DNA, 25 bp, Mus musculus
cggaactgaggcgatgattaagagg

SEQ ID NO: 363066 - DNA, 25 bp, Mus musculus
cggaacttatggcagtcttcgcaaa

SEQ ID NO: 363067 - DNA, 25 bp, Mus musculus
cggaacttatgggagtcttcgcaaa

SEQ ID NO: 363068 - DNA, 25 bp, Mus musculus
cggaagagcggaagtcctacagtgt

SEQ ID NO: 363069 - DNA, 25 bp, Mus musculus
cggaagagcggatgtcctacagtgt

SEQ ID NO: 363070 - DNA, 25 bp, Mus musculus
cggaagatgcagatgtacgtggcta

SEQ ID NO: 363071 - DNA, 25 bp, Mus musculus
cggaagatgcagttgtacgtggcta

SEQ ID NO: 363072 - DNA, 25 bp, Mus musculus
cggaagattccccagggctcaaagt

SEQ ID NO: 363073 - DNA, 25 bp, Mus musculus
cggaagattcccgagggctcaaagt

SEQ ID NO: 363074 - DNA, 25 bp, Mus musculus
cggaagattgaaaagctctaccaca

SEQ ID NO: 363075 - DNA, 25 bp, Mus musculus
cggaagattgaatagctctaccaca

SEQ ID NO: 363076 - DNA, 25 bp, Mus musculus
cggaagcacgtgaacagatggccca

SEQ ID NO: 363077 - DNA, 25 bp, Mus musculus
cggaagcacgtgtacagatggccca

SEQ ID NO: 363078 - DNA, 25 bp, Mus musculus
cggaagcagcgcacagctgtctgta

SEQ ID NO: 363079 - DNA, 25 bp, Mus musculus
cggaagcagcgctcagctgtctgta

SEQ ID NO: 363080 - DNA, 25 bp, Mus musculus
cggaagcgagtccagtttgtgacat

SEQ ID NO: 363081 - DNA, 25 bp, Mus musculus
cggaagcgagtcgagtttgtgacat

SEQ ID NO: 363082 - DNA, 25 bp, Mus musculus
cggaagctacagactacgtgcacaa

SEQ ID NO: 363083 - DNA, 25 bp, Mus musculus
cggaagctacagtctacgtgcacaa

SEQ ID NO: 363084 - DNA, 25 bp, Mus musculus
cggaaggattctcatctgtcataac

SEQ ID NO: 363085 - DNA, 25 bp, Mus musculus
cggaaggattctgatctgtcataac

SEQ ID NO: 363086 - DNA, 25 bp, Mus musculus
cggaaggctgtgaccgccgtttcag

SEQ ID NO: 363087 - DNA, 25 bp, Mus musculus
cggaaggctgtgtccgccgtttcag

SEQ ID NO: 363088 - DNA, 25 bp, Mus musculus
cggaagggcctcaatgtggaagaaa

SEQ ID NO: 363089 - DNA, 25 bp, Mus musculus
cggaagggcctctatgtggaagaaa

SEQ ID NO: 363090 - DNA, 25 bp, Mus musculus
cggaaggttgcccaccagcagagca

SEQ ID NO: 363091 - DNA, 25 bp, Mus musculus
cggaaggttgccgaccagcagagca

SEQ ID NO: 363092 - DNA, 25 bp, Mus musculus
cggaagtactccactatgtttgaag

SEQ ID NO: 363093 - DNA, 25 bp, Mus musculus
cggaagtactcctctatgtttgaag

SEQ ID NO: 363094 - DNA, 25 bp, Mus musculus
cggaagtctgtgcagagctttagtt

SEQ ID NO: 363095 - DNA, 25 bp, Mus musculus
cggaagtctgtggagagctttagtt

SEQ ID NO: 363096 - DNA, 25 bp, Mus musculus
cggaagtcttccactgttttacata

SEQ ID NO: 363097 - DNA, 25 bp, Mus musculus
cggaagtcttcctctgttttacata

SEQ ID NO: 363098 - DNA, 25 bp, Mus musculus
cggaagttctctcgccccttgatga

SEQ ID NO: 363099 - DNA, 25 bp, Mus musculus
cggaagttctctggccccttgatga

SEQ ID NO: 363100 - DNA, 25 bp, Mus musculus
cggaagttcttcaccatcttggctt

SEQ ID NO: 363101 - DNA, 25 bp, Mus musculus
cggaagttcttctccatcttggctt

SEQ ID NO: 363102 - DNA, 25 bp, Mus musculus
cggaataagattccatgtgtatttt

SEQ ID NO: 363103 - DNA, 25 bp, Mus musculus
cggaataagattgcatgtgtatttt

SEQ ID NO: 363104 - DNA, 25 bp, Mus musculus
cggaatagctttatattccgctcca

SEQ ID NO: 363105 - DNA, 25 bp, Mus musculus
cggaatagctttttattccgctcca

SEQ ID NO: 363106 - DNA, 25 bp, Mus musculus
cggaatatattgagggatccccttg

SEQ ID NO: 363107 - DNA, 25 bp, Mus musculus
cggaatatattgtgggatccccttg

SEQ ID NO: 363108 - DNA, 25 bp, Mus musculus
cggaatcaaagccagcatgctgtaa

SEQ ID NO: 363109 - DNA, 25 bp, Mus musculus
cggaatcaaagcgagcatgctgtaa

SEQ ID NO: 363110 - DNA, 25 bp, Mus musculus
cggaatcagtttaatccactctccc

SEQ ID NO: 363111 - DNA, 25 bp, Mus musculus
cggaatcagttttatccactctccc

SEQ ID NO: 363112 - DNA, 25 bp, Mus musculus
cggaatcgccgacaggaaccaagat

SEQ ID NO: 363113 - DNA, 25 bp, Mus musculus
cggaatcgccgagaggaaccaagat

SEQ ID NO: 363114 - DNA, 25 bp, Mus musculus
cggaatcgtcctcggaagagtacca

SEQ ID NO: 363115 - DNA, 25 bp, Mus musculus
cggaatcgtcctgggaagagtacca

SEQ ID NO: 363116 - DNA, 25 bp, Mus musculus
cggaatgacttcctgtgaaaatact

SEQ ID NO: 363117 - DNA, 25 bp, Mus musculus
cggaatgacttcgtgtgaaaatact

SEQ ID NO: 363118 - DNA, 25 bp, Mus musculus
cggaatgagatacaagcatcacctt

SEQ ID NO: 363119 - DNA, 25 bp, Mus musculus
cggaatgagatagaagcatcacctt

SEQ ID NO: 363120 - DNA, 25 bp, Mus musculus
cggaatgatctgcaactgttaaata

SEQ ID NO: 363121 - DNA, 25 bp, Mus musculus
cggaatgatctggaactgttaaata

SEQ ID NO: 363122 - DNA, 25 bp, Mus musculus
cggaatgcctgcctagtatatgtta

SEQ ID NO: 363123 - DNA, 25 bp, Mus musculus
cggaatgcctgcgtagtatatgtta

SEQ ID NO: 363124 - DNA, 25 bp, Mus musculus
cggaatgcgcctctggatcatgact

SEQ ID NO: 363125 - DNA, 25 bp, Mus musculus
cggaatgcgcctgtggatcatgact

SEQ ID NO: 363126 - DNA, 25 bp, Mus musculus
cggaatgtcagacacaaacacgaca

SEQ ID NO: 363127 - DNA, 25 bp, Mus musculus
cggaatgtcagagacaaacacgaca

SEQ ID NO: 363128 - DNA, 25 bp, Mus musculus
cggaatgtcctaatgatacggtgtt

SEQ ID NO: 363129 - DNA, 25 bp, Mus musculus
cggaatgtcctattgatacggtgtt

SEQ ID NO: 363130 - DNA, 25 bp, Mus musculus
cggaatgtggagacacctcaggtga

SEQ ID NO: 363131 - DNA, 25 bp, Mus musculus
cggaatgtggagtcacctcaggtga

SEQ ID NO: 363132 - DNA, 25 bp, Mus musculus
cggaattcattacgcgttgattttt

SEQ ID NO: 363133 - DNA, 25 bp, Mus musculus
cggaattcattaggcgttgattttt

SEQ ID NO: 363134 - DNA, 25 bp, Mus musculus
cggaattcccatatgtctgagtggg

SEQ ID NO: 363135 - DNA, 25 bp, Mus musculus
cggaattcccatttgtctgagtggg

SEQ ID NO: 363136 - DNA, 25 bp, Mus musculus
cggacaagcttgagaaggagtacgt

SEQ ID NO: 363137 - DNA, 25 bp, Mus musculus
cggacaagcttgtgaaggagtacgt

SEQ ID NO: 363138 - DNA, 25 bp, Mus musculus
cggacaatcgggactgcgtctataa

SEQ ID NO: 363139 - DNA, 25 bp, Mus musculus
cggacaatcgggtctgcgtctataa

SEQ ID NO: 363140 - DNA, 25 bp, Mus musculus
cggacaatttacactctgagggcta

SEQ ID NO: 363141 - DNA, 25 bp, Mus musculus
cggacaatttactctctgagggcta

SEQ ID NO: 363142 - DNA, 25 bp, Mus musculus
cggacacaggtcactagtattctaa

SEQ ID NO: 363143 - DNA, 25 bp, Mus musculus
cggacacaggtctctagtattctaa

SEQ ID NO: 363144 - DNA, 25 bp, Mus musculus
cggacaccaggcacatttgatggat

SEQ ID NO: 363145 - DNA, 25 bp, Mus musculus
cggacaccaggctcatttgatggat

SEQ ID NO: 363146 - DNA, 25 bp, Mus musculus
cggacacttgtgcagcattctggaa

SEQ ID NO: 363147 - DNA, 25 bp, Mus musculus
cggacacttgtggagcattctggaa

SEQ ID NO: 363148 - DNA, 25 bp, Mus musculus
cggacagaagcgctggctataccag

SEQ ID NO: 363149 - DNA, 25 bp, Mus musculus
cggacagaagcggtggctataccag

SEQ ID NO: 363150 - DNA, 25 bp, Mus musculus
cggacagacgccaggttacagccgg

SEQ ID NO: 363151 - DNA, 25 bp, Mus musculus
cggacagacgcctggttacagccgg

SEQ ID NO: 363152 - DNA, 25 bp, Mus musculus
cggacagatctgagcgtgtgacatc

SEQ ID NO: 363153 - DNA, 25 bp, Mus musculus
cggacagatctgtgcgtgtgacatc

SEQ ID NO: 363154 - DNA, 25 bp, Mus musculus
cggacaggtggaccctcggatcata

SEQ ID NO: 363155 - DNA, 25 bp, Mus musculus
cggacaggtggagcctcggatcata

SEQ ID NO: 363156 - DNA, 25 bp, Mus musculus
cggacagttttacgctctcctgaat

SEQ ID NO: 363157 - DNA, 25 bp, Mus musculus
cggacagttttaggctctcctgaat

SEQ ID NO: 363158 - DNA, 25 bp, Mus musculus
cggacatgtcacaccactatgaatc

SEQ ID NO: 363159 - DNA, 25 bp, Mus musculus
cggacatgtcactccactatgaatc

SEQ ID NO: 363160 - DNA, 25 bp, Mus musculus
cggacattaactaacgaggtgaggt

SEQ ID NO: 363161 - DNA, 25 bp, Mus musculus
cggacattaacttacgaggtgaggt

SEQ ID NO: 363162 - DNA, 25 bp, Mus musculus
cggacattcaggctgcctctttggg

SEQ ID NO: 363163 - DNA, 25 bp, Mus musculus
cggacattcagggtgcctctttggg

SEQ ID NO: 363164 - DNA, 25 bp, Mus musculus
cggacatttgtccatgaaagccctg

SEQ ID NO: 363165 - DNA, 25 bp, Mus musculus
cggacatttgtcgatgaaagccctg

SEQ ID NO: 363166 - DNA, 25 bp, Mus musculus
cggaccaaagagattcagggcagct

SEQ ID NO: 363167 - DNA, 25 bp, Mus musculus
cggaccaaagagtttcagggcagct

SEQ ID NO: 363168 - DNA, 25 bp, Mus musculus
cggaccaacaccatttactgacgag

SEQ ID NO: 363169 - DNA, 25 bp, Mus musculus
cggaccaacaccttttactgacgag

SEQ ID NO: 363170 - DNA, 25 bp, Mus musculus
cggaccaataaaagatccaatcggg

SEQ ID NO: 363171 - DNA, 25 bp, Mus musculus
cggaccaataaatgatccaatcggg

SEQ ID NO: 363172 - DNA, 25 bp, Mus musculus
cggaccaccaaccaggaggcatgaa

SEQ ID NO: 363173 - DNA, 25 bp, Mus musculus
cggaccaccaacgaggaggcatgaa

SEQ ID NO: 363174 - DNA, 25 bp, Mus musculus
cggaccagcctgctaaattagtgct

SEQ ID NO: 363175 - DNA, 25 bp, Mus musculus
cggaccagcctggtaaattagtgct

SEQ ID NO: 363176 - DNA, 25 bp, Mus musculus
cggaccatccaacgactcattgact

SEQ ID NO: 363177 - DNA, 25 bp, Mus musculus
cggaccatccaaggactcattgact

SEQ ID NO: 363178 - DNA, 25 bp, Mus musculus
cggaccatctggactgtacggagca

SEQ ID NO: 363179 - DNA, 25 bp, Mus musculus
cggaccatctggtctgtacggagca

SEQ ID NO: 363180 - DNA, 25 bp, Mus musculus
cggaccatgttgcttctatctaata

SEQ ID NO: 363181 - DNA, 25 bp, Mus musculus
cggaccatgttggttctatctaata

SEQ ID NO: 363182 - DNA, 25 bp, Mus musculus
cggaccgaaaccactggaatctgaa

SEQ ID NO: 363183 - DNA, 25 bp, Mus musculus
cggaccgaaacctctggaatctgaa

SEQ ID NO: 363184 - DNA, 25 bp, Mus musculus
cggaccggttacaggctcatggaaa

SEQ ID NO: 363185 - DNA, 25 bp, Mus musculus
cggaccggttactggctcatggaaa

SEQ ID NO: 363186 - DNA, 25 bp, Mus musculus
cggacctacgcaagggcgagatcgc

SEQ ID NO: 363187 - DNA, 25 bp, Mus musculus
cggacctacgcatgggcgagatcgc

SEQ ID NO: 363188 - DNA, 25 bp, Mus musculus
cggacctggcgtaacagagagttcg

SEQ ID NO: 363189 - DNA, 25 bp, Mus musculus
cggacctggcgttacagagagttcg

SEQ ID NO: 363190 - DNA, 25 bp, Mus musculus
cggaccttggctcgcatctgggcta

SEQ ID NO: 363191 - DNA, 25 bp, Mus musculus
cggaccttggctggcatctgggcta

SEQ ID NO: 363192 - DNA, 25 bp, Mus musculus
cggacgcatcagatggttttactga

SEQ ID NO: 363193 - DNA, 25 bp, Mus musculus
cggacgcatcagttggttttactga

SEQ ID NO: 363194 - DNA, 25 bp, Mus musculus
cggacgctactcctcagagagtgat

SEQ ID NO: 363195 - DNA, 25 bp, Mus musculus
cggacgctactcgtcagagagtgat

SEQ ID NO: 363196 - DNA, 25 bp, Mus musculus
cggacggagcggattttcctatgga

SEQ ID NO: 363197 - DNA, 25 bp, Mus musculus
cggacggagcggtttttcctatgga

SEQ ID NO: 363198 - DNA, 25 bp, Mus musculus
cggacgtcagaacaggataccccaa

SEQ ID NO: 363199 - DNA, 25 bp, Mus musculus
cggacgtcagaagaggataccccaa

SEQ ID NO: 363200 - DNA, 25 bp, Mus musculus
cggacgtgcgcaacaccggctgagc

SEQ ID NO: 363201 - DNA, 25 bp, Mus musculus
cggacgtgcgcatcaccggctgagc

SEQ ID NO: 363202 - DNA, 25 bp, Mus musculus
cggactaaaccccagacatgtgcaa

SEQ ID NO: 363203 - DNA, 25 bp, Mus musculus
cggactaaacccgagacatgtgcaa

SEQ ID NO: 363204 - DNA, 25 bp, Mus musculus
cggactccctggaggtgtgtgaagt

SEQ ID NO: 363205 - DNA, 25 bp, Mus musculus
cggactccctggtggtgtgtgaagt

SEQ ID NO: 363206 - DNA, 25 bp, Mus musculus
cggactcgggaaacctgccgcagag

SEQ ID NO: 363207 - DNA, 25 bp, Mus musculus
cggactcgggaatcctgccgcagag

SEQ ID NO: 363208 - DNA, 25 bp, Mus musculus
cggactctgttacataggccgccac

SEQ ID NO: 363209 - DNA, 25 bp, Mus musculus
cggactctgttagataggccgccac

SEQ ID NO: 363210 - DNA, 25 bp, Mus musculus
cggactcttctgactgtattctaac

SEQ ID NO: 363211 - DNA, 25 bp, Mus musculus
cggactcttctgtctgtattctaac

SEQ ID NO: 363212 - DNA, 25 bp, Mus musculus
cggactgagaaactgcccatgggct

SEQ ID NO: 363213 - DNA, 25 bp, Mus musculus
cggactgagaaagtgcccatgggct

SEQ ID NO: 363214 - DNA, 25 bp, Mus musculus
cggactgccaaaattcaccggtttg

SEQ ID NO: 363215 - DNA, 25 bp, Mus musculus
cggactgccaaatttcaccggtttg

SEQ ID NO: 363216 - DNA, 25 bp, Mus musculus
cggactgcgcacagccaacgggcac

SEQ ID NO: 363217 - DNA, 25 bp, Mus musculus
cggactgcgcactgccaacgggcac

SEQ ID NO: 363218 - DNA, 25 bp, Mus musculus
cggactggaacgactcagtctcgtt

SEQ ID NO: 363219 - DNA, 25 bp, Mus musculus
cggactggaacgtctcagtctcgtt

SEQ ID NO: 363220 - DNA, 25 bp, Mus musculus
cggactgtagcaacttcattaaatt

SEQ ID NO: 363221 - DNA, 25 bp, Mus musculus
cggactgtagcatcttcattaaatt

SEQ ID NO: 363222 - DNA, 25 bp, Mus musculus
cggactgttggaaactgtattgctt

SEQ ID NO: 363223 - DNA, 25 bp, Mus musculus
cggactgttggatactgtattgctt

SEQ ID NO: 363224 - DNA, 25 bp, Mus musculus
cggacttgcaatctgtgaacttttt

SEQ ID NO: 363225 - DNA, 25 bp, Mus musculus
cggacttgcaatgtgtgaacttttt

SEQ ID NO: 363226 - DNA, 25 bp, Mus musculus
cggactttatagctgggccattcat

SEQ ID NO: 363227 - DNA, 25 bp, Mus musculus
cggactttataggtgggccattcat

SEQ ID NO: 363228 - DNA, 25 bp, Mus musculus
cggactttcaggaagcacagctttc

SEQ ID NO: 363229 - DNA, 25 bp, Mus musculus
cggactttcaggtagcacagctttc

SEQ ID NO: 363230 - DNA, 25 bp, Mus musculus
cggactttctacaacacctcaagaa

SEQ ID NO: 363231 - DNA, 25 bp, Mus musculus
cggactttctactacacctcaagaa

SEQ ID NO: 363232 - DNA, 25 bp, Mus musculus
cggactttgtgtcaacaagcagtta

SEQ ID NO: 363233 - DNA, 25 bp, Mus musculus
cggactttgtgtgaacaagcagtta

SEQ ID NO: 363234 - DNA, 25 bp, Mus musculus
cggagaaagctgacctaccagttca

SEQ ID NO: 363235 - DNA, 25 bp, Mus musculus
cggagaaagctgtcctaccagttca

SEQ ID NO: 363236 - DNA, 25 bp, Mus musculus
cggagaacatttctgatcccctgga

SEQ ID NO: 363237 - DNA, 25 bp, Mus musculus
cggagaacatttgtgatcccctgga

SEQ ID NO: 363238 - DNA, 25 bp, Mus musculus
cggagaacctgaccctgctcaagag

SEQ ID NO: 363239 - DNA, 25 bp, Mus musculus
cggagaacctgagcctgctcaagag

SEQ ID NO: 363240 - DNA, 25 bp, Mus musculus
cggagaactttgctgcgtcttctag

SEQ ID NO: 363241 - DNA, 25 bp, Mus musculus
cggagaactttggtgcgtcttctag

SEQ ID NO: 363242 - DNA, 25 bp, Mus musculus
cggagaagccgaacgaccgcgagaa

SEQ ID NO: 363243 - DNA, 25 bp, Mus musculus
cggagaagccgatcgaccgcgagaa

SEQ ID NO: 363244 - DNA, 25 bp, Mus musculus
cggagaagtcagagccacggcacat

SEQ ID NO: 363245 - DNA, 25 bp, Mus musculus
cggagaagtcagtgccacggcacat

SEQ ID NO: 363246 - DNA, 25 bp, Mus musculus
cggagaatgacgaccagctgctgtt

SEQ ID NO: 363247 - DNA, 25 bp, Mus musculus
cggagaatgacgtccagctgctgtt

SEQ ID NO: 363248 - DNA, 25 bp, Mus musculus
cggagacacccacaaaaaggatggt

SEQ ID NO: 363249 - DNA, 25 bp, Mus musculus
cggagacacccagaaaaaggatggt

SEQ ID NO: 363250 - DNA, 25 bp, Mus musculus
cggagacagagtaactgctgtccga

SEQ ID NO: 363251 - DNA, 25 bp, Mus musculus
cggagacagagttactgctgtccga

SEQ ID NO: 363252 - DNA, 25 bp, Mus musculus
cggagacattcccagctttgtgaaa

SEQ ID NO: 363253 - DNA, 25 bp, Mus musculus
cggagacattccgagctttgtgaaa
